United States Patent 7,888,497 (BIOINFORMATICALLY DETECTABLE GROUP OF NOVEL REGULATORY OLIGONUCLEOTIDES AND USES THEREOF) - sequence listing, part 24

SEQ ID NO: 986931 - DNA, 19 bp, Homo sapiens
cggttcagacccctgcctg

SEQ ID NO: 986932 - DNA, 18 bp, Homo sapiens
cggttccacgtccccctg

SEQ ID NO: 986933 - DNA, 14 bp, Homo sapiens
cggttcctcatctg

SEQ ID NO: 986934 - DNA, 11 bp, Homo sapiens
cggttgcagtc

SEQ ID NO: 986935 - DNA, 16 bp, Homo sapiens
cggttgcagtcactgt

SEQ ID NO: 986936 - DNA, 14 bp, Homo sapiens
cggttgccatggag

SEQ ID NO: 986937 - DNA, 21 bp, Homo sapiens
cggttggagcgagcatccccc

SEQ ID NO: 986938 - DNA, 21 bp, Homo sapiens
cggttgttctttcctcacatt

SEQ ID NO: 986939 - DNA, 18 bp, Homo sapiens
cggtttagtcatccaaca

SEQ ID NO: 986940 - DNA, 18 bp, Homo sapiens
cggtttccaaggtgcaca

SEQ ID NO: 986941 - DNA, 19 bp, Homo sapiens
cggtttccaaggtgcacat

SEQ ID NO: 986942 - DNA, 19 bp, Homo sapiens
cggtttctagcctctgaga

SEQ ID NO: 986943 - DNA, 12 bp, Homo sapiens
cggtttctgagc

SEQ ID NO: 986944 - DNA, 20 bp, Homo sapiens
cggtttctgagcataatgct

SEQ ID NO: 986945 - DNA, 19 bp, Homo sapiens
cggtttggataatcttaaa

SEQ ID NO: 986946 - DNA, 21 bp, Homo sapiens
cggtttggggagcagagacac

SEQ ID NO: 986947 - DNA, 18 bp, Homo sapiens
cggtttgtcagttcttgg

SEQ ID NO: 986948 - DNA, 23 bp, Homo sapiens
cgtaaaaaaatagaaaaaaagaa

SEQ ID NO: 986949 - DNA, 19 bp, Homo sapiens
cgtaaaagagataataaga

SEQ ID NO: 986950 - DNA, 13 bp, Homo sapiens
cgtaaaatttaca

SEQ ID NO: 986951 - DNA, 22 bp, Homo sapiens
cgtaagaccaaatgtagttttg

SEQ ID NO: 986952 - DNA, 21 bp, Homo sapiens
cgtaataggaatcaccctcct

SEQ ID NO: 986953 - DNA, 16 bp, Homo sapiens
cgtaatgggcctgccc

SEQ ID NO: 986954 - DNA, 13 bp, Homo sapiens
cgtaatttaatgg

SEQ ID NO: 986955 - DNA, 23 bp, Homo sapiens
cgtacaaccccctccacccccca

SEQ ID NO: 986956 - DNA, 12 bp, Homo sapiens
cgtacacagaga

SEQ ID NO: 986957 - DNA, 15 bp, Homo sapiens
cgtacacagagaagg

SEQ ID NO: 986958 - DNA, 20 bp, Homo sapiens
cgtacatctgcaatatgaat

SEQ ID NO: 986959 - DNA, 13 bp, Homo sapiens
cgtacatgtttat

SEQ ID NO: 986960 - DNA, 19 bp, Homo sapiens
cgtaccccactgggccagc

SEQ ID NO: 986961 - DNA, 15 bp, Homo sapiens
cgtaccgcttcctta

SEQ ID NO: 986962 - DNA, 16 bp, Homo sapiens
cgtaccgcttccttag

SEQ ID NO: 986963 - DNA, 17 bp, Homo sapiens
cgtaccgcttccttaga

SEQ ID NO: 986964 - DNA, 13 bp, Homo sapiens
cgtaccttcccac

SEQ ID NO: 986965 - DNA, 13 bp, Homo sapiens
cgtacgcccagga

SEQ ID NO: 986966 - DNA, 17 bp, Homo sapiens
cgtactctcacatgtgg

SEQ ID NO: 986967 - DNA, 13 bp, Homo sapiens
cgtagaaaatttg

SEQ ID NO: 986968 - DNA, 16 bp, Homo sapiens
cgtagaattccttcga

SEQ ID NO: 986969 - DNA, 16 bp, Homo sapiens
cgtagagaatgtgtgt

SEQ ID NO: 986970 - DNA, 23 bp, Homo sapiens
cgtagcctgggctcactgtgctg

SEQ ID NO: 986971 - DNA, 14 bp, Homo sapiens
cgtaggcagcctct

SEQ ID NO: 986972 - DNA, 20 bp, Homo sapiens
cgtaggcagcctctctgcta

SEQ ID NO: 986973 - DNA, 20 bp, Homo sapiens
cgtagtccatcaccatttct

SEQ ID NO: 986974 - DNA, 22 bp, Homo sapiens
cgtataaatatcagtattctga

SEQ ID NO: 986975 - DNA, 14 bp, Homo sapiens
cgtataatgctttc

SEQ ID NO: 986976 - DNA, 17 bp, Homo sapiens
cgtataatgctttctga

SEQ ID NO: 986977 - DNA, 15 bp, Homo sapiens
cgtataggcatgtaa

SEQ ID NO: 986978 - DNA, 22 bp, Homo sapiens
cgtatatgtctcaggtccctgc

SEQ ID NO: 986979 - DNA, 13 bp, Homo sapiens
cgtatcacagtgt

SEQ ID NO: 986980 - DNA, 14 bp, Homo sapiens
cgtatcacagtgtt

SEQ ID NO: 986981 - DNA, 16 bp, Homo sapiens
cgtatgtgtgcaggag

SEQ ID NO: 986982 - DNA, 18 bp, Homo sapiens
cgtatgtgtgcaggagcc

SEQ ID NO: 986983 - DNA, 21 bp, Homo sapiens
cgtatttaatagcaaagaatt

SEQ ID NO: 986984 - DNA, 22 bp, Homo sapiens
cgtatttagactgtggccatat

SEQ ID NO: 986985 - DNA, 17 bp, Homo sapiens
cgtatttagccattacc

SEQ ID NO: 986986 - DNA, 14 bp, Homo sapiens
cgtatttctccaga

SEQ ID NO: 986987 - DNA, 16 bp, Homo sapiens
cgtatttctccagacc

SEQ ID NO: 986988 - DNA, 22 bp, Homo sapiens
cgtcaaaacagattgtttgcaa

SEQ ID NO: 986989 - DNA, 19 bp, Homo sapiens
cgtcaacccaagctctggg

SEQ ID NO: 986990 - DNA, 21 bp, Homo sapiens
cgtcaacccaagctctgggga

SEQ ID NO: 986991 - DNA, 17 bp, Homo sapiens
cgtcaagagcatgcaca

SEQ ID NO: 986992 - DNA, 21 bp, Homo sapiens
cgtcaccaccacccctaccac

SEQ ID NO: 986993 - DNA, 16 bp, Homo sapiens
cgtcaccatctcaggc

SEQ ID NO: 986994 - DNA, 12 bp, Homo sapiens
cgtcactgccca

SEQ ID NO: 986995 - DNA, 19 bp, Homo sapiens
cgtcactgcccaccaaagg

SEQ ID NO: 986996 - DNA, 18 bp, Homo sapiens
cgtcactttttggccatg

SEQ ID NO: 986997 - DNA, 21 bp, Homo sapiens
cgtcagacagcaaggaactgt

SEQ ID NO: 986998 - DNA, 23 bp, Homo sapiens
cgtcaggcagaggcaactgactt

SEQ ID NO: 986999 - DNA, 22 bp, Homo sapiens
cgtcaggccctgactcctctgg

SEQ ID NO: 987000 - DNA, 22 bp, Homo sapiens
cgtcagggagaggtcaccagct

SEQ ID NO: 987001 - DNA, 15 bp, Homo sapiens
cgtcagtttcactcc

SEQ ID NO: 987002 - DNA, 16 bp, Homo sapiens
cgtcagtttcactccc

SEQ ID NO: 987003 - DNA, 18 bp, Homo sapiens
cgtcagtttcactccctc

SEQ ID NO: 987004 - DNA, 20 bp, Homo sapiens
cgtcagtttcactccctctt

SEQ ID NO: 987005 - DNA, 22 bp, Homo sapiens
cgtcatccatgccctcccagga

SEQ ID NO: 987006 - DNA, 18 bp, Homo sapiens
cgtcatcggaggctgggc

SEQ ID NO: 987007 - DNA, 16 bp, Homo sapiens
cgtccaaccccggggc

SEQ ID NO: 987008 - DNA, 17 bp, Homo sapiens
cgtccacaggggcaggc

SEQ ID NO: 987009 - DNA, 21 bp, Homo sapiens
cgtccacaggggcaggcctgg

SEQ ID NO: 987010 - DNA, 23 bp, Homo sapiens
cgtccacaggggcaggcctggga

SEQ ID NO: 987011 - DNA, 12 bp, Homo sapiens
cgtccaccaggc

SEQ ID NO: 987012 - DNA, 19 bp, Homo sapiens
cgtccaccaggcctcactg

SEQ ID NO: 987013 - DNA, 15 bp, Homo sapiens
cgtccacccaggctg

SEQ ID NO: 987014 - DNA, 16 bp, Homo sapiens
cgtccacccaggctgc

SEQ ID NO: 987015 - DNA, 23 bp, Homo sapiens
cgtccacccaggctgcactgcag

SEQ ID NO: 987016 - DNA, 17 bp, Homo sapiens
cgtccagctcagccctg

SEQ ID NO: 987017 - DNA, 22 bp, Homo sapiens
cgtccagctcagccctggcctg

SEQ ID NO: 987018 - DNA, 16 bp, Homo sapiens
cgtccagctgcccttc

SEQ ID NO: 987019 - DNA, 21 bp, Homo sapiens
cgtccaggggagatggggagg

SEQ ID NO: 987020 - DNA, 23 bp, Homo sapiens
cgtccatcacgttagctgtccca

SEQ ID NO: 987021 - DNA, 18 bp, Homo sapiens
cgtccatccgactgcccc

SEQ ID NO: 987022 - DNA, 13 bp, Homo sapiens
cgtcccaccagct

SEQ ID NO: 987023 - DNA, 17 bp, Homo sapiens
cgtcccagcatccctgg

SEQ ID NO: 987024 - DNA, 18 bp, Homo sapiens
cgtcccagcatccctgga

SEQ ID NO: 987025 - DNA, 19 bp, Homo sapiens
cgtcccagcatccctggag

SEQ ID NO: 987026 - DNA, 18 bp, Homo sapiens
ctcttgggctgagactgg

SEQ ID NO: 987027 - DNA, 18 bp, Homo sapiens
ctcttgggttcaagtgat

SEQ ID NO: 987028 - DNA, 19 bp, Homo sapiens
ctcttgggttcaagtgatt

SEQ ID NO: 987029 - DNA, 23 bp, Homo sapiens
ctcttggtgggtgtggccagcac

SEQ ID NO: 987030 - DNA, 14 bp, Homo sapiens
ctcttggtgtctgg

SEQ ID NO: 987031 - DNA, 21 bp, Homo sapiens
ctcttggtgtgattgcacaga

SEQ ID NO: 987032 - DNA, 12 bp, Homo sapiens
ctcttgtaaata

SEQ ID NO: 987033 - DNA, 13 bp, Homo sapiens
ctcttgtaagtca

SEQ ID NO: 987034 - DNA, 14 bp, Homo sapiens
ctcttgtacagtta

SEQ ID NO: 987035 - DNA, 23 bp, Homo sapiens
ctcttgtacagttaactctccca

SEQ ID NO: 987036 - DNA, 16 bp, Homo sapiens
ctcttgtaccatagaa

SEQ ID NO: 987037 - DNA, 23 bp, Homo sapiens
ctcttgtaccatagaaaaatgta

SEQ ID NO: 987038 - DNA, 20 bp, Homo sapiens
ctcttgtcatttttaatatt

SEQ ID NO: 987039 - DNA, 16 bp, Homo sapiens
ctcttgtcccacgtgt

SEQ ID NO: 987040 - DNA, 15 bp, Homo sapiens
ctcttgtcccttggc

SEQ ID NO: 987041 - DNA, 22 bp, Homo sapiens
ctcttgtcctgtgatctgtgta

SEQ ID NO: 987042 - DNA, 12 bp, Homo sapiens
ctcttgtctccc

SEQ ID NO: 987043 - DNA, 22 bp, Homo sapiens
ctcttgtctggcaaaagaaaaa

SEQ ID NO: 987044 - DNA, 22 bp, Homo sapiens
ctcttgtgatttctttaaaaga

SEQ ID NO: 987045 - DNA, 21 bp, Homo sapiens
ctcttgtgcaaggtggccttt

SEQ ID NO: 987046 - DNA, 18 bp, Homo sapiens
ctcttgttaccatgtatg

SEQ ID NO: 987047 - DNA, 24 bp, Homo sapiens
ctcttgtttacgatttcactagga

SEQ ID NO: 987048 - DNA, 17 bp, Homo sapiens
ctcttgtttctgtgccc

SEQ ID NO: 987049 - DNA, 19 bp, Homo sapiens
ctcttgtttttattaattt

SEQ ID NO: 987050 - DNA, 20 bp, Homo sapiens
ctcttgtttttattaattta

SEQ ID NO: 987051 - DNA, 23 bp, Homo sapiens
ctcttgtttttattaatttatat

SEQ ID NO: 987052 - DNA, 13 bp, Homo sapiens
ctctttaaaaaca

SEQ ID NO: 987053 - DNA, 15 bp, Homo sapiens
ctctttaaaaactca

SEQ ID NO: 987054 - DNA, 19 bp, Homo sapiens
ctctttaaaaggaaagaaa

SEQ ID NO: 987055 - DNA, 20 bp, Homo sapiens
ctctttaaaaggaaagaaaa

SEQ ID NO: 987056 - DNA, 15 bp, Homo sapiens
ctctttaaccctccc

SEQ ID NO: 987057 - DNA, 15 bp, Homo sapiens
ctctttaactgtgtg

SEQ ID NO: 987058 - DNA, 17 bp, Homo sapiens
ctctttaataaattgct

SEQ ID NO: 987059 - DNA, 18 bp, Homo sapiens
cgtcccagcggcctcagg

SEQ ID NO: 987060 - DNA, 13 bp, Homo sapiens
cgtcccaggccac

SEQ ID NO: 987061 - DNA, 12 bp, Homo sapiens
cgtcccagggct

SEQ ID NO: 987062 - DNA, 15 bp, Homo sapiens
cgtcccatatcctgc

SEQ ID NO: 987063 - DNA, 22 bp, Homo sapiens
cgtccccctctggctccagctg

SEQ ID NO: 987064 - DNA, 17 bp, Homo sapiens
cgtcccgcgttcaagac

SEQ ID NO: 987065 - DNA, 19 bp, Homo sapiens
cgtcccgcgttcaagactt

SEQ ID NO: 987066 - DNA, 13 bp, Homo sapiens
cgtccctgcccat

SEQ ID NO: 987067 - DNA, 11 bp, Homo sapiens
cgtccctggcg

SEQ ID NO: 987068 - DNA, 13 bp, Homo sapiens
cgtccctgtcccc

SEQ ID NO: 987069 - DNA, 17 bp, Homo sapiens
cgtccctgtcccccagc

SEQ ID NO: 987070 - DNA, 20 bp, Homo sapiens
cgtccgaggctgcttcccag

SEQ ID NO: 987071 - DNA, 12 bp, Homo sapiens
cgtccgccctgc

SEQ ID NO: 987072 - DNA, 15 bp, Homo sapiens
cgtccgccctgctcc

SEQ ID NO: 987073 - DNA, 15 bp, Homo sapiens
cgtccgcgcgccagc

SEQ ID NO: 987074 - DNA, 17 bp, Homo sapiens
cgtcctcccgggccctc

SEQ ID NO: 987075 - DNA, 18 bp, Homo sapiens
cgtcctcccgggccctcc

SEQ ID NO: 987076 - DNA, 13 bp, Homo sapiens
cgtcctccctcag

SEQ ID NO: 987077 - DNA, 17 bp, Homo sapiens
cgtcctccctcagcctc

SEQ ID NO: 987078 - DNA, 17 bp, Homo sapiens
cgtcctgacgccctgcg

SEQ ID NO: 987079 - DNA, 12 bp, Homo sapiens
cgtcctgaggaa

SEQ ID NO: 987080 - DNA, 13 bp, Homo sapiens
cgtcctgatccct

SEQ ID NO: 987081 - DNA, 19 bp, Homo sapiens
cgtcctgatccctccaccc

SEQ ID NO: 987082 - DNA, 15 bp, Homo sapiens
cgtcctgcagaggac

SEQ ID NO: 987083 - DNA, 15 bp, Homo sapiens
aatcacacctctggg

SEQ ID NO: 987084 - DNA, 13 bp, Homo sapiens
aatcacaggaaaa

SEQ ID NO: 987085 - DNA, 12 bp, Homo sapiens
aatcacagtgtt

SEQ ID NO: 987086 - DNA, 16 bp, Homo sapiens
aatcacagtgttatgt

SEQ ID NO: 987087 - DNA, 15 bp, Homo sapiens
atagtatatctggac

SEQ ID NO: 987088 - DNA, 16 bp, Homo sapiens
atagtatatctggaca

SEQ ID NO: 987089 - DNA, 18 bp, Homo sapiens
atagtatatttatactct

SEQ ID NO: 987090 - DNA, 22 bp, Homo sapiens
atagtatctgtatataagttgc

SEQ ID NO: 987091 - DNA, 19 bp, Homo sapiens
atagtatgagggttgaaga

SEQ ID NO: 987092 - DNA, 20 bp, Homo sapiens
atagtatgcactatatacat

SEQ ID NO: 987093 - DNA, 23 bp, Homo sapiens
atagtatgggaaaaaaactgaag

SEQ ID NO: 987094 - DNA, 21 bp, Homo sapiens
atagtattccattgtgtgagt

SEQ ID NO: 987095 - DNA, 22 bp, Homo sapiens
atagtattggaaaataaaaatg

SEQ ID NO: 987096 - DNA, 12 bp, Homo sapiens
atagtatttgat

SEQ ID NO: 987097 - DNA, 20 bp, Homo sapiens
atagtatttgattcaaaata

SEQ ID NO: 987098 - DNA, 14 bp, Homo sapiens
atagtcacaagagc

SEQ ID NO: 987099 - DNA, 16 bp, Homo sapiens
atagtccaatatttgg

SEQ ID NO: 987100 - DNA, 20 bp, Homo sapiens
atagtccagacacttaactc

SEQ ID NO: 987101 - DNA, 21 bp, Homo sapiens
atagtcgtgaatcttgttcaa

SEQ ID NO: 987102 - DNA, 19 bp, Homo sapiens
atagtctattcattaagta

SEQ ID NO: 987103 - DNA, 14 bp, Homo sapiens
atagtctctttaaa

SEQ ID NO: 987104 - DNA, 14 bp, Homo sapiens
atagtcttccacaa

SEQ ID NO: 987105 - DNA, 22 bp, Homo sapiens
atagtcttggaagctgtttgga

SEQ ID NO: 987106 - DNA, 17 bp, Homo sapiens
atagtcttttgcttttg

SEQ ID NO: 987107 - DNA, 16 bp, Homo sapiens
atagtgaatacttact

SEQ ID NO: 987108 - DNA, 23 bp, Homo sapiens
atagtgaatacttactataattt

SEQ ID NO: 987109 - DNA, 20 bp, Homo sapiens
atagtgacaagtgaagaaca

SEQ ID NO: 987110 - DNA, 19 bp, Homo sapiens
atagtgagagaggaggcct

SEQ ID NO: 987111 - DNA, 20 bp, Homo sapiens
atagtgcaaaactgtgtcac

SEQ ID NO: 987112 - DNA, 23 bp, Homo sapiens
atagtgcaacatctctgaatcct

SEQ ID NO: 987113 - DNA, 22 bp, Homo sapiens
atagtgccaggaaactaatttc

SEQ ID NO: 987114 - DNA, 20 bp, Homo sapiens
atagtgcctaaagtgctgca

SEQ ID NO: 987115 - DNA, 12 bp, Homo sapiens
atagtgcttttt

SEQ ID NO: 987116 - DNA, 19 bp, Homo sapiens
atagtggaccacttggaaa

SEQ ID NO: 987117 - DNA, 21 bp, Homo sapiens
atagtggatgatatacacagt

SEQ ID NO: 987118 - DNA, 12 bp, Homo sapiens
atagtggggcct

SEQ ID NO: 987119 - DNA, 17 bp, Homo sapiens
atagtggggcctgggag

SEQ ID NO: 987120 - DNA, 14 bp, Homo sapiens
atagtgtaaaataa

SEQ ID NO: 987121 - DNA, 14 bp, Homo sapiens
atagtgtaacttgc

SEQ ID NO: 987122 - DNA, 18 bp, Homo sapiens
atagtgtaacttgcttaa

SEQ ID NO: 987123 - DNA, 23 bp, Homo sapiens
atagtgtaagaactgtacattgt

SEQ ID NO: 987124 - DNA, 16 bp, Homo sapiens
atagtgtaataatgtt

SEQ ID NO: 987125 - DNA, 22 bp, Homo sapiens
atagtgtataccacctgtacat

SEQ ID NO: 987126 - DNA, 13 bp, Homo sapiens
atagtgtccaggc

SEQ ID NO: 987127 - DNA, 16 bp, Homo sapiens
atagtgtcctgcccac

SEQ ID NO: 987128 - DNA, 12 bp, Homo sapiens
atagtgtgttct

SEQ ID NO: 987129 - DNA, 13 bp, Homo sapiens
atagtgtgttctg

SEQ ID NO: 987130 - DNA, 19 bp, Homo sapiens
atagtgtgttctgattaga

SEQ ID NO: 987131 - DNA, 19 bp, Homo sapiens
atagtgttcacaaactgtg

SEQ ID NO: 987132 - DNA, 17 bp, Homo sapiens
atagtgttctgctcctg

SEQ ID NO: 987133 - DNA, 19 bp, Homo sapiens
atagtgttctgctcctgct

SEQ ID NO: 987134 - DNA, 15 bp, Homo sapiens
atagtgtttaactgg

SEQ ID NO: 987135 - DNA, 18 bp, Homo sapiens
atagtgttttattataaa

SEQ ID NO: 987136 - DNA, 19 bp, Homo sapiens
atagttaaaagactgcagc

SEQ ID NO: 987137 - DNA, 23 bp, Homo sapiens
atagttaaaagactgcagctgct

SEQ ID NO: 987138 - DNA, 15 bp, Homo sapiens
atagttaatattttg

SEQ ID NO: 987139 - DNA, 16 bp, Homo sapiens
atagttaatattttgt

SEQ ID NO: 987140 - DNA, 13 bp, Homo sapiens
atagttactgtgt

SEQ ID NO: 987141 - DNA, 14 bp, Homo sapiens
atagttactgtgta

SEQ ID NO: 987142 - DNA, 20 bp, Homo sapiens
atagttactgtgtaattagt

SEQ ID NO: 987143 - DNA, 16 bp, Homo sapiens
atagttagctaataaa

SEQ ID NO: 987144 - DNA, 15 bp, Homo sapiens
atagttatatgtaca

SEQ ID NO: 987145 - DNA, 21 bp, Homo sapiens
atagttcagaatttagtgtat

SEQ ID NO: 987146 - DNA, 18 bp, Homo sapiens
atagttcagtagaattac

SEQ ID NO: 987147 - DNA, 17 bp, Homo sapiens
atagttccttgccttaa

SEQ ID NO: 987148 - DNA, 21 bp, Homo sapiens
atagttccttgccttaataaa

SEQ ID NO: 987149 - DNA, 20 bp, Homo sapiens
atagttctaaacacattctt

SEQ ID NO: 987150 - DNA, 21 bp, Homo sapiens
atagttctatcaggaaaacaa

SEQ ID NO: 987151 - DNA, 16 bp, Homo sapiens
atagttctatcctttt

SEQ ID NO: 987152 - DNA, 14 bp, Homo sapiens
atagttctgcaggt

SEQ ID NO: 987153 - DNA, 21 bp, Homo sapiens
atagttcttagctttgaaact

SEQ ID NO: 987154 - DNA, 18 bp, Homo sapiens
atagttgcatagcagtat

SEQ ID NO: 987155 - DNA, 19 bp, Homo sapiens
atagttgtagacaaagtac

SEQ ID NO: 987156 - DNA, 18 bp, Homo sapiens
atagtttcaccactcctc

SEQ ID NO: 987157 - DNA, 19 bp, Homo sapiens
atagtttcaccactcctct

SEQ ID NO: 987158 - DNA, 21 bp, Homo sapiens
atagtttcaccactcctctcc

SEQ ID NO: 987159 - DNA, 12 bp, Homo sapiens
atagtttcctga

SEQ ID NO: 987160 - DNA, 17 bp, Homo sapiens
atagtttgaaatagaaa

SEQ ID NO: 987161 - DNA, 18 bp, Homo sapiens
atagtttggatatgtaaa

SEQ ID NO: 987162 - DNA, 19 bp, Homo sapiens
atagtttggatatgtaaaa

SEQ ID NO: 987163 - DNA, 23 bp, Homo sapiens
atagtttggatatgtaaaacatt

SEQ ID NO: 987164 - DNA, 13 bp, Homo sapiens
atagtttgtctat

SEQ ID NO: 987165 - DNA, 15 bp, Homo sapiens
atagtttgtctattt

SEQ ID NO: 987166 - DNA, 17 bp, Homo sapiens
atagttttataaaactc

SEQ ID NO: 987167 - DNA, 22 bp, Homo sapiens
atagttttcatccataactgaa

SEQ ID NO: 987168 - DNA, 19 bp, Homo sapiens
atagttttttacttctctt

SEQ ID NO: 987169 - DNA, 16 bp, Homo sapiens
atataaaaaatcatgc

SEQ ID NO: 987170 - DNA, 18 bp, Homo sapiens
atataaaaagcagcagag

SEQ ID NO: 987171 - DNA, 14 bp, Homo sapiens
atataaaactgaaa

SEQ ID NO: 987172 - DNA, 13 bp, Homo sapiens
atataaaactgcg

SEQ ID NO: 987173 - DNA, 22 bp, Homo sapiens
atataaaactgcgttaaaggct

SEQ ID NO: 987174 - DNA, 17 bp, Homo sapiens
atataaaactgtacttc

SEQ ID NO: 987175 - DNA, 20 bp, Homo sapiens
atataaaaggcaaatgtgta

SEQ ID NO: 987176 - DNA, 14 bp, Homo sapiens
atataaaatgtatt

SEQ ID NO: 987177 - DNA, 18 bp, Homo sapiens
atataaaatgtattcaag

SEQ ID NO: 987178 - DNA, 13 bp, Homo sapiens
atataaaatgtgc

SEQ ID NO: 987179 - DNA, 20 bp, Homo sapiens
atataaacagaactcccttc

SEQ ID NO: 987180 - DNA, 14 bp, Homo sapiens
atataaacatattt

SEQ ID NO: 987181 - DNA, 14 bp, Homo sapiens
atataaactcattt

SEQ ID NO: 987182 - DNA, 16 bp, Homo sapiens
atataaactcatttat

SEQ ID NO: 987183 - DNA, 22 bp, Homo sapiens
atataaaggaccctgtttctgt

SEQ ID NO: 987184 - DNA, 16 bp, Homo sapiens
atataaaggttatgaa

SEQ ID NO: 987185 - DNA, 19 bp, Homo sapiens
atataaaggttatgaaaca

SEQ ID NO: 987186 - DNA, 21 bp, Homo sapiens
atataaaggttatgaaacata

SEQ ID NO: 987187 - DNA, 19 bp, Homo sapiens
atataaagtagtcctgtga

SEQ ID NO: 987188 - DNA, 13 bp, Homo sapiens
atataaataagct

SEQ ID NO: 987189 - DNA, 16 bp, Homo sapiens
atataaatagctaatg

SEQ ID NO: 987190 - DNA, 20 bp, Homo sapiens
atataaatagctgaaaacta

SEQ ID NO: 987191 - DNA, 11 bp, Homo sapiens
atataaatata

SEQ ID NO: 987192 - DNA, 21 bp, Homo sapiens
atataaatatatatttttcaa

SEQ ID NO: 987193 - DNA, 23 bp, Homo sapiens
atataaatggctggtttttagaa

SEQ ID NO: 987194 - DNA, 12 bp, Homo sapiens
atataaatgtgt

SEQ ID NO: 987195 - DNA, 12 bp, Homo sapiens
atataaattgta

SEQ ID NO: 987196 - DNA, 14 bp, Homo sapiens
atataaatttaagc

SEQ ID NO: 987197 - DNA, 15 bp, Homo sapiens
atataaattttttgt

SEQ ID NO: 987198 - DNA, 14 bp, Homo sapiens
atataacacttaac

SEQ ID NO: 987199 - DNA, 23 bp, Homo sapiens
atataaccacaaagcacagtttg

SEQ ID NO: 987200 - DNA, 18 bp, Homo sapiens
atataaccctaggaattt

SEQ ID NO: 987201 - DNA, 12 bp, Homo sapiens
atataactcttt

SEQ ID NO: 987202 - DNA, 14 bp, Homo sapiens
atataactgtcttg

SEQ ID NO: 987203 - DNA, 19 bp, Homo sapiens
atataactgtcttgtttca

SEQ ID NO: 987204 - DNA, 20 bp, Homo sapiens
atataactgtcttgtttcag

SEQ ID NO: 987205 - DNA, 13 bp, Homo sapiens
aatctaaggataa

SEQ ID NO: 987206 - DNA, 21 bp, Homo sapiens
aatctaaggataatgaaataa

SEQ ID NO: 987207 - DNA, 14 bp, Homo sapiens
aatctaagtatatg

SEQ ID NO: 987208 - DNA, 17 bp, Homo sapiens
aatctaagtgatataaa

SEQ ID NO: 987209 - DNA, 19 bp, Homo sapiens
aatctaatattaaaaatat

SEQ ID NO: 987210 - DNA, 12 bp, Homo sapiens
aatctaatctct

SEQ ID NO: 987211 - DNA, 19 bp, Homo sapiens
aatctaatctcttattcta

SEQ ID NO: 987212 - DNA, 15 bp, Homo sapiens
aatctaatctgaact

SEQ ID NO: 987213 - DNA, 16 bp, Homo sapiens
aatctaatctgaactg

SEQ ID NO: 987214 - DNA, 23 bp, Homo sapiens
aatctaatgtgagtgtgaagctt

SEQ ID NO: 987215 - DNA, 15 bp, Homo sapiens
aatctactaattcca

SEQ ID NO: 987216 - DNA, 18 bp, Homo sapiens
aatctactggaaatgtag

SEQ ID NO: 987217 - DNA, 12 bp, Homo sapiens
aatctacttaac

SEQ ID NO: 987218 - DNA, 21 bp, Homo sapiens
aatctacttaaccctgacaaa

SEQ ID NO: 987219 - DNA, 21 bp, Homo sapiens
aatctactttttgtatttagt

SEQ ID NO: 987220 - DNA, 13 bp, Homo sapiens
atatatgatcatt

SEQ ID NO: 987221 - DNA, 12 bp, Homo sapiens
atatatgctgta

SEQ ID NO: 987222 - DNA, 13 bp, Homo sapiens
atatatgctgtat

SEQ ID NO: 987223 - DNA, 15 bp, Homo sapiens
atatatgcttacatt

SEQ ID NO: 987224 - DNA, 15 bp, Homo sapiens
atatatggacatggc

SEQ ID NO: 987225 - DNA, 12 bp, Homo sapiens
atatatggacct

SEQ ID NO: 987226 - DNA, 17 bp, Homo sapiens
atatatggatcagagga

SEQ ID NO: 987227 - DNA, 14 bp, Homo sapiens
atatatggcagagt

SEQ ID NO: 987228 - DNA, 16 bp, Homo sapiens
atatatggcatattta

SEQ ID NO: 987229 - DNA, 19 bp, Homo sapiens
atatatggcatatttatat

SEQ ID NO: 987230 - DNA, 13 bp, Homo sapiens
atatatgtacagt

SEQ ID NO: 987231 - DNA, 14 bp, Homo sapiens
atatatgtacagtt

SEQ ID NO: 987232 - DNA, 11 bp, Homo sapiens
atatatgtatg

SEQ ID NO: 987233 - DNA, 19 bp, Homo sapiens
atatatgtattatttataa

SEQ ID NO: 987234 - DNA, 15 bp, Homo sapiens
atatatgtatttaaa

SEQ ID NO: 987235 - DNA, 12 bp, Homo sapiens
atatatgtcaat

SEQ ID NO: 987236 - DNA, 13 bp, Homo sapiens
atatatgtgaaag

SEQ ID NO: 987237 - DNA, 16 bp, Homo sapiens
atatatgtgtatacat

SEQ ID NO: 987238 - DNA, 17 bp, Homo sapiens
atatatgtgtatacata

SEQ ID NO: 987239 - DNA, 16 bp, Homo sapiens
atatatgtgtgtgtat

SEQ ID NO: 987240 - DNA, 22 bp, Homo sapiens
atatatgtgtgtgtatataaat

SEQ ID NO: 987241 - DNA, 13 bp, Homo sapiens
atatatgtgtttt

SEQ ID NO: 987242 - DNA, 21 bp, Homo sapiens
atatatgtgtttttcacattt

SEQ ID NO: 987243 - DNA, 23 bp, Homo sapiens
atatatgtgtttttcacatttgc

SEQ ID NO: 987244 - DNA, 15 bp, Homo sapiens
atatatgttctgcaa

SEQ ID NO: 987245 - DNA, 20 bp, Homo sapiens
atatatgttctgcaagaatt

SEQ ID NO: 987246 - DNA, 18 bp, Homo sapiens
atatatgtttttgaaggc

SEQ ID NO: 987247 - DNA, 18 bp, Homo sapiens
atatattaaaaatataaa

SEQ ID NO: 987248 - DNA, 17 bp, Homo sapiens
atatattacaagggata

SEQ ID NO: 987249 - DNA, 14 bp, Homo sapiens
atatattattataa

SEQ ID NO: 987250 - DNA, 16 bp, Homo sapiens
atatattattataatc

SEQ ID NO: 987251 - DNA, 18 bp, Homo sapiens
atatattcatctaataaa

SEQ ID NO: 987252 - DNA, 17 bp, Homo sapiens
atatattcttataaaaa

SEQ ID NO: 987253 - DNA, 13 bp, Homo sapiens
atatattgaactt

SEQ ID NO: 987254 - DNA, 22 bp, Homo sapiens
atatattgaacttttgtactga

SEQ ID NO: 987255 - DNA, 14 bp, Homo sapiens
atatattgaattaa

SEQ ID NO: 987256 - DNA, 17 bp, Homo sapiens
atatattgacttgttac

SEQ ID NO: 987257 - DNA, 16 bp, Homo sapiens
atatattgctgcattt

SEQ ID NO: 987258 - DNA, 14 bp, Homo sapiens
atatattgtaaaga

SEQ ID NO: 987259 - DNA, 15 bp, Homo sapiens
atatattgtaaagaa

SEQ ID NO: 987260 - DNA, 14 bp, Homo sapiens
atatattgtacaaa

SEQ ID NO: 987261 - DNA, 16 bp, Homo sapiens
atatatttaatatgtc

SEQ ID NO: 987262 - DNA, 16 bp, Homo sapiens
atatatttacagaaga

SEQ ID NO: 987263 - DNA, 15 bp, Homo sapiens
atatatttataactc

SEQ ID NO: 987264 - DNA, 21 bp, Homo sapiens
atatatttataactcatcata

SEQ ID NO: 987265 - DNA, 17 bp, Homo sapiens
atatatttcacttttgt

SEQ ID NO: 987266 - DNA, 14 bp, Homo sapiens
atatatttcagata

SEQ ID NO: 987267 - DNA, 17 bp, Homo sapiens
atatatttctattatta

SEQ ID NO: 987268 - DNA, 13 bp, Homo sapiens
atatatttgcaga

SEQ ID NO: 987269 - DNA, 23 bp, Homo sapiens
atatatttgcagataattctgga

SEQ ID NO: 987270 - DNA, 15 bp, Homo sapiens
atatatttgcagtat

SEQ ID NO: 987271 - DNA, 15 bp, Homo sapiens
atatatttgtaacat

SEQ ID NO: 987272 - DNA, 17 bp, Homo sapiens
atatatttgtaacattg

SEQ ID NO: 987273 - DNA, 13 bp, Homo sapiens
atatatttgtgta

SEQ ID NO: 987274 - DNA, 17 bp, Homo sapiens
atatatttgtgtattta

SEQ ID NO: 987275 - DNA, 12 bp, Homo sapiens
atatattttata

SEQ ID NO: 987276 - DNA, 12 bp, Homo sapiens
atatattttcat

SEQ ID NO: 987277 - DNA, 16 bp, Homo sapiens
atatattttgtttaca

SEQ ID NO: 987278 - DNA, 21 bp, Homo sapiens
atatatttttatatttagtta

SEQ ID NO: 987279 - DNA, 16 bp, Homo sapiens
atatatttttctgaga

SEQ ID NO: 987280 - DNA, 18 bp, Homo sapiens
atatattttttaaaataa

SEQ ID NO: 987281 - DNA, 17 bp, Homo sapiens
atatcaaagagaagatg

SEQ ID NO: 987282 - DNA, 15 bp, Homo sapiens
atatcaaataaaata

SEQ ID NO: 987283 - DNA, 21 bp, Homo sapiens
atatcaaataaaatatcataa

SEQ ID NO: 987284 - DNA, 16 bp, Homo sapiens
atatcaaataataaag

SEQ ID NO: 987285 - DNA, 14 bp, Homo sapiens
atatcaatcacatt

SEQ ID NO: 987286 - DNA, 11 bp, Homo sapiens
atatcacctct

SEQ ID NO: 987287 - DNA, 12 bp, Homo sapiens
atatcacctctc

SEQ ID NO: 987288 - DNA, 14 bp, Homo sapiens
atatcactaaataa

SEQ ID NO: 987289 - DNA, 16 bp, Homo sapiens
atatcactcattaatt

SEQ ID NO: 987290 - DNA, 17 bp, Homo sapiens
atatcagaaaagggaag

SEQ ID NO: 987291 - DNA, 19 bp, Homo sapiens
atatcagacaagcactatt

SEQ ID NO: 987292 - DNA, 21 bp, Homo sapiens
atatcagagctcttaatgttg

SEQ ID NO: 987293 - DNA, 17 bp, Homo sapiens
atatcagagctgggaaa

SEQ ID NO: 987294 - DNA, 20 bp, Homo sapiens
atatcagcctgagtctcctg

SEQ ID NO: 987295 - DNA, 22 bp, Homo sapiens
atatcagcctgagtctcctgtg

SEQ ID NO: 987296 - DNA, 20 bp, Homo sapiens
atatcaggtgtataaatgta

SEQ ID NO: 987297 - DNA, 23 bp, Homo sapiens
atatcaggtgtataaatgtacat

SEQ ID NO: 987298 - DNA, 14 bp, Homo sapiens
atatcagtagtgta

SEQ ID NO: 987299 - DNA, 18 bp, Homo sapiens
atatcagtagtgtacatt

SEQ ID NO: 987300 - DNA, 22 bp, Homo sapiens
atatcagttactcagccctggg

SEQ ID NO: 987301 - DNA, 23 bp, Homo sapiens
atatcagttactcagccctgggc

SEQ ID NO: 987302 - DNA, 13 bp, Homo sapiens
atatcagtttgct

SEQ ID NO: 987303 - DNA, 14 bp, Homo sapiens
atatcatacagttt

SEQ ID NO: 987304 - DNA, 14 bp, Homo sapiens
atatcatgaaacac

SEQ ID NO: 987305 - DNA, 21 bp, Homo sapiens
atatcatgagtgaataaatgt

SEQ ID NO: 987306 - DNA, 13 bp, Homo sapiens
atatcatgcaaaa

SEQ ID NO: 987307 - DNA, 19 bp, Homo sapiens
atatcatggtaatgacaga

SEQ ID NO: 987308 - DNA, 13 bp, Homo sapiens
atatcatgtacct

SEQ ID NO: 987309 - DNA, 14 bp, Homo sapiens
atatcattaaacaa

SEQ ID NO: 987310 - DNA, 14 bp, Homo sapiens
atatcattatttag

SEQ ID NO: 987311 - DNA, 20 bp, Homo sapiens
atatcattcagcatctactc

SEQ ID NO: 987312 - DNA, 16 bp, Homo sapiens
atatcatttgtgaaga

SEQ ID NO: 987313 - DNA, 13 bp, Homo sapiens
atatcattttaaa

SEQ ID NO: 987314 - DNA, 21 bp, Homo sapiens
atatccacataaatgctcctt

SEQ ID NO: 987315 - DNA, 18 bp, Homo sapiens
atatccagaaggggagct

SEQ ID NO: 987316 - DNA, 18 bp, Homo sapiens
atatccagttcctgctct

SEQ ID NO: 987317 - DNA, 21 bp, Homo sapiens
atatccatgacctagttttcc

SEQ ID NO: 987318 - DNA, 14 bp, Homo sapiens
atatccatgtactg

SEQ ID NO: 987319 - DNA, 15 bp, Homo sapiens
atatccatgtactgt

SEQ ID NO: 987320 - DNA, 18 bp, Homo sapiens
atatccatgtactgtagt

SEQ ID NO: 987321 - DNA, 20 bp, Homo sapiens
atatcccaaacttcggaaac

SEQ ID NO: 987322 - DNA, 16 bp, Homo sapiens
atatcccaacattctg

SEQ ID NO: 987323 - DNA, 13 bp, Homo sapiens
atatcccactggg

SEQ ID NO: 987324 - DNA, 18 bp, Homo sapiens
atatccctaatgttttgc

SEQ ID NO: 987325 - DNA, 14 bp, Homo sapiens
atatccctcttgta

SEQ ID NO: 987326 - DNA, 15 bp, Homo sapiens
atatccctcttgtaa

SEQ ID NO: 987327 - DNA, 16 bp, Homo sapiens
atatccctgcccagcc

SEQ ID NO: 987328 - DNA, 19 bp, Homo sapiens
atatcctaggaggtaatga

SEQ ID NO: 987329 - DNA, 18 bp, Homo sapiens
cagctcctctaggggcag

SEQ ID NO: 987330 - DNA, 17 bp, Homo sapiens
cagctcctctccttggg

SEQ ID NO: 987331 - DNA, 19 bp, Homo sapiens
cagctcctctccttgggct

SEQ ID NO: 987332 - DNA, 21 bp, Homo sapiens
cagctcctctccttgggctcc

SEQ ID NO: 987333 - DNA, 23 bp, Homo sapiens
cagctcctctccttgggctcctg

SEQ ID NO: 987334 - DNA, 12 bp, Homo sapiens
cagctcctctga

SEQ ID NO: 987335 - DNA, 15 bp, Homo sapiens
cagctcctctgagcc

SEQ ID NO: 987336 - DNA, 21 bp, Homo sapiens
cagctcctgagtagctgggcc

SEQ ID NO: 987337 - DNA, 11 bp, Homo sapiens
cagctcctgcc

SEQ ID NO: 987338 - DNA, 13 bp, Homo sapiens
cagctcctgccag

SEQ ID NO: 987339 - DNA, 14 bp, Homo sapiens
cagctccttcctgg

SEQ ID NO: 987340 - DNA, 12 bp, Homo sapiens
cagctccttggc

SEQ ID NO: 987341 - DNA, 13 bp, Homo sapiens
cagctccttggct

SEQ ID NO: 987342 - DNA, 19 bp, Homo sapiens
cagctccttttgtccccag

SEQ ID NO: 987343 - DNA, 22 bp, Homo sapiens
cagctcgtttttcagcaccccc

SEQ ID NO: 987344 - DNA, 17 bp, Homo sapiens
cagctctaagcagccag

SEQ ID NO: 987345 - DNA, 19 bp, Homo sapiens
cagctctaagcagccagga

SEQ ID NO: 987346 - DNA, 21 bp, Homo sapiens
cagctctaagcagccaggagg

SEQ ID NO: 987347 - DNA, 20 bp, Homo sapiens
cagctctagacaaccctgca

SEQ ID NO: 987348 - DNA, 12 bp, Homo sapiens
cagctctccagt

SEQ ID NO: 987349 - DNA, 13 bp, Homo sapiens
cagctctcccaca

SEQ ID NO: 987350 - DNA, 20 bp, Homo sapiens
cagctctcccacatcccact

SEQ ID NO: 987351 - DNA, 17 bp, Homo sapiens
cagctctcccctccctt

SEQ ID NO: 987352 - DNA, 19 bp, Homo sapiens
cagctctccctctggccct

SEQ ID NO: 987353 - DNA, 23 bp, Homo sapiens
cagctctccctctggccctgcct

SEQ ID NO: 987354 - DNA, 13 bp, Homo sapiens
cagctctcctggc

SEQ ID NO: 987355 - DNA, 17 bp, Homo sapiens
cagctctcgttctcctt

SEQ ID NO: 987356 - DNA, 18 bp, Homo sapiens
cagctctcgttctccttc

SEQ ID NO: 987357 - DNA, 17 bp, Homo sapiens
cagctggcctggacagt

SEQ ID NO: 987358 - DNA, 23 bp, Homo sapiens
cagctggcctggggtccctctga

SEQ ID NO: 987359 - DNA, 18 bp, Homo sapiens
cagctggctatctactac

SEQ ID NO: 987360 - DNA, 20 bp, Homo sapiens
cagctggctctgacaagatg

SEQ ID NO: 987361 - DNA, 22 bp, Homo sapiens
cagctggctctgacaagatggt

SEQ ID NO: 987362 - DNA, 17 bp, Homo sapiens
cagctgggaagcccttt

SEQ ID NO: 987363 - DNA, 16 bp, Homo sapiens
cagctgggacccctcc

SEQ ID NO: 987364 - DNA, 23 bp, Homo sapiens
cagctgggacccctcccaacctc

SEQ ID NO: 987365 - DNA, 16 bp, Homo sapiens
cagctgggagcactgg

SEQ ID NO: 987366 - DNA, 16 bp, Homo sapiens
cagctgggagccagtg

SEQ ID NO: 987367 - DNA, 19 bp, Homo sapiens
cagctgggagccagtgtgc

SEQ ID NO: 987368 - DNA, 20 bp, Homo sapiens
cagctgggagccagtgtgcc

SEQ ID NO: 987369 - DNA, 14 bp, Homo sapiens
cagctgggcaaagc

SEQ ID NO: 987370 - DNA, 15 bp, Homo sapiens
cagctgggcaaagcc

SEQ ID NO: 987371 - DNA, 16 bp, Homo sapiens
cagctgggcaaagcca

SEQ ID NO: 987372 - DNA, 13 bp, Homo sapiens
cagctgggcaggg

SEQ ID NO: 987373 - DNA, 15 bp, Homo sapiens
cagctgggcagggtg

SEQ ID NO: 987374 - DNA, 16 bp, Homo sapiens
cagctgggcagggtga

SEQ ID NO: 987375 - DNA, 20 bp, Homo sapiens
cagctgggcagggtgagaag

SEQ ID NO: 987376 - DNA, 17 bp, Homo sapiens
cagctgggccccatgct

SEQ ID NO: 987377 - DNA, 19 bp, Homo sapiens
cagctgggccccatgctct

SEQ ID NO: 987378 - DNA, 21 bp, Homo sapiens
cagctgggccccatgctctgc

SEQ ID NO: 987379 - DNA, 22 bp, Homo sapiens
cagctgggccccatgctctgcc

SEQ ID NO: 987380 - DNA, 23 bp, Homo sapiens
cagctgggccccatgctctgccc

SEQ ID NO: 987381 - DNA, 17 bp, Homo sapiens
cagctgggctctgcaat

SEQ ID NO: 987382 - DNA, 15 bp, Homo sapiens
cagctgggctctgcc

SEQ ID NO: 987383 - DNA, 19 bp, Homo sapiens
cagctggggagatgggggc

SEQ ID NO: 987384 - DNA, 18 bp, Homo sapiens
cagctggggccagaggct

SEQ ID NO: 987385 - DNA, 21 bp, Homo sapiens
cagctggggccagaggctggg

SEQ ID NO: 987386 - DNA, 22 bp, Homo sapiens
cagctggggccagaggctggga

SEQ ID NO: 987387 - DNA, 20 bp, Homo sapiens
cagctggggtaggctgtctg

SEQ ID NO: 987388 - DNA, 18 bp, Homo sapiens
cagctggtcagtctttgc

SEQ ID NO: 987389 - DNA, 20 bp, Homo sapiens
cagctggtcagtctttgctc

SEQ ID NO: 987390 - DNA, 16 bp, Homo sapiens
cagctggtcctgtgga

SEQ ID NO: 987391 - DNA, 15 bp, Homo sapiens
cagctggtcttttct

SEQ ID NO: 987392 - DNA, 22 bp, Homo sapiens
cagctggtcttttctcctactc

SEQ ID NO: 987393 - DNA, 19 bp, Homo sapiens
cagctggtgcaaattcaga

SEQ ID NO: 987394 - DNA, 13 bp, Homo sapiens
cagctggtgccaa

SEQ ID NO: 987395 - DNA, 21 bp, Homo sapiens
cagctggtggccctgtgcctg

SEQ ID NO: 987396 - DNA, 20 bp, Homo sapiens
cagctggtgggaagcgtctg

SEQ ID NO: 987397 - DNA, 18 bp, Homo sapiens
cagctgtaacacagctga

SEQ ID NO: 987398 - DNA, 19 bp, Homo sapiens
cagctgtaagaagagactg

SEQ ID NO: 987399 - DNA, 17 bp, Homo sapiens
cagctgtacttcgtctt

SEQ ID NO: 987400 - DNA, 12 bp, Homo sapiens
cagctgtagcca

SEQ ID NO: 987401 - DNA, 16 bp, Homo sapiens
cagctgtagccatggc

SEQ ID NO: 987402 - DNA, 17 bp, Homo sapiens
cagctgtagccatggct

SEQ ID NO: 987403 - DNA, 22 bp, Homo sapiens
cagctgtagccatggctcaggc

SEQ ID NO: 987404 - DNA, 23 bp, Homo sapiens
cagctgtattttggctttctccc

SEQ ID NO: 987405 - DNA, 14 bp, Homo sapiens
cagctgtcacctgc

SEQ ID NO: 987406 - DNA, 20 bp, Homo sapiens
cagctgtcacctgctcacag

SEQ ID NO: 987407 - DNA, 17 bp, Homo sapiens
cagctgtcccctctccc

SEQ ID NO: 987408 - DNA, 15 bp, Homo sapiens
cagctgtccctgtca

SEQ ID NO: 987409 - DNA, 14 bp, Homo sapiens
cagctgtcctgaac

SEQ ID NO: 987410 - DNA, 22 bp, Homo sapiens
cagctgtcctgcagcaaacact

SEQ ID NO: 987411 - DNA, 21 bp, Homo sapiens
cagctgtcgtctgactctggg

SEQ ID NO: 987412 - DNA, 16 bp, Homo sapiens
cagctgtctgccaggc

SEQ ID NO: 987413 - DNA, 18 bp, Homo sapiens
cagctgtctgccaggcac

SEQ ID NO: 987414 - DNA, 21 bp, Homo sapiens
cagctgtctgccaggcactct

SEQ ID NO: 987415 - DNA, 20 bp, Homo sapiens
cagctgtgaaggcttcactc

SEQ ID NO: 987416 - DNA, 19 bp, Homo sapiens
cagctgtgagccatgcctc

SEQ ID NO: 987417 - DNA, 20 bp, Homo sapiens
cagctgtgagccatgcctcc

SEQ ID NO: 987418 - DNA, 10 bp, Homo sapiens
cagctgtgat

SEQ ID NO: 987419 - DNA, 18 bp, Homo sapiens
cagctgtgcatccaattt

SEQ ID NO: 987420 - DNA, 16 bp, Homo sapiens
cagctgtgctgtggag

SEQ ID NO: 987421 - DNA, 17 bp, Homo sapiens
cagctgtggcagagtta

SEQ ID NO: 987422 - DNA, 22 bp, Homo sapiens
cagctgtggtacaaatgtgata

SEQ ID NO: 987423 - DNA, 15 bp, Homo sapiens
cagctgtgtctgcca

SEQ ID NO: 987424 - DNA, 16 bp, Homo sapiens
cagctgttactttctt

SEQ ID NO: 987425 - DNA, 19 bp, Homo sapiens
cagctgttgagaaaacgaa

SEQ ID NO: 987426 - DNA, 21 bp, Homo sapiens
cagctgtttatgcatagataa

SEQ ID NO: 987427 - DNA, 13 bp, Homo sapiens
cagctgtttctca

SEQ ID NO: 987428 - DNA, 16 bp, Homo sapiens
cagctgtttctcatga

SEQ ID NO: 987429 - DNA, 23 bp, Homo sapiens
cagctgttttgttgacattctga

SEQ ID NO: 987430 - DNA, 19 bp, Homo sapiens
cagcttaaacccatacaat

SEQ ID NO: 987431 - DNA, 16 bp, Homo sapiens
cagcttaattctcctt

SEQ ID NO: 987432 - DNA, 19 bp, Homo sapiens
cagcttaattctccttccc

SEQ ID NO: 987433 - DNA, 20 bp, Homo sapiens
cagcttagggccctggaggc

SEQ ID NO: 987434 - DNA, 14 bp, Homo sapiens
cagcttataatgaa

SEQ ID NO: 987435 - DNA, 16 bp, Homo sapiens
cagcttatctctttta

SEQ ID NO: 987436 - DNA, 14 bp, Homo sapiens
caggaaggacatgg

SEQ ID NO: 987437 - DNA, 19 bp, Homo sapiens
caggaaggaccccacatcc

SEQ ID NO: 987438 - DNA, 16 bp, Homo sapiens
caggaaggactatgaa

SEQ ID NO: 987439 - DNA, 16 bp, Homo sapiens
caggaaggagagcctg

SEQ ID NO: 987440 - DNA, 17 bp, Homo sapiens
caggaaggagagcctgc

SEQ ID NO: 987441 - DNA, 16 bp, Homo sapiens
caggaaggaggggaga

SEQ ID NO: 987442 - DNA, 13 bp, Homo sapiens
caggaaggcagaa

SEQ ID NO: 987443 - DNA, 22 bp, Homo sapiens
caggaaggccaaaatcaagagt

SEQ ID NO: 987444 - DNA, 13 bp, Homo sapiens
caggaagggaagc

SEQ ID NO: 987445 - DNA, 14 bp, Homo sapiens
caggaagggaagcg

SEQ ID NO: 987446 - DNA, 21 bp, Homo sapiens
caggaagggagtgaggggctg

SEQ ID NO: 987447 - DNA, 21 bp, Homo sapiens
caggaagggcaggaaggagag

SEQ ID NO: 987448 - DNA, 18 bp, Homo sapiens
caggaagggggtccaccc

SEQ ID NO: 987449 - DNA, 22 bp, Homo sapiens
caggaaggtaaaaacccagcgg

SEQ ID NO: 987450 - DNA, 18 bp, Homo sapiens
caggaaggtgaggcagaa

SEQ ID NO: 987451 - DNA, 16 bp, Homo sapiens
caggaaggtgcctggc

SEQ ID NO: 987452 - DNA, 15 bp, Homo sapiens
caggaagtacttcca

SEQ ID NO: 987453 - DNA, 15 bp, Homo sapiens
caggaagtgtttatg

SEQ ID NO: 987454 - DNA, 22 bp, Homo sapiens
caggaagtgtttatgaggaaac

SEQ ID NO: 987455 - DNA, 17 bp, Homo sapiens
caggaagtttggagcct

SEQ ID NO: 987456 - DNA, 23 bp, Homo sapiens
caggaataaggccttaatatgtt

SEQ ID NO: 987457 - DNA, 14 bp, Homo sapiens
caggaatatgacac

SEQ ID NO: 987458 - DNA, 19 bp, Homo sapiens
caggaatattgtcatcctt

SEQ ID NO: 987459 - DNA, 19 bp, Homo sapiens
caggaatctgtatatattt

SEQ ID NO: 987460 - DNA, 14 bp, Homo sapiens
caggaatgatctct

SEQ ID NO: 987461 - DNA, 16 bp, Homo sapiens
caggaatgctgggccc

SEQ ID NO: 987462 - DNA, 17 bp, Homo sapiens
caggaatggaaagcgga

SEQ ID NO: 987463 - DNA, 19 bp, Homo sapiens
caggaatggctgcaccttt

SEQ ID NO: 987464 - DNA, 16 bp, Homo sapiens
caggaatgggggtcag

SEQ ID NO: 987465 - DNA, 17 bp, Homo sapiens
caggaatgggggtcaga

SEQ ID NO: 987466 - DNA, 19 bp, Homo sapiens
caggaatgtgtggcctgca

SEQ ID NO: 987467 - DNA, 23 bp, Homo sapiens
caggaatgtgtggcctgcacagt

SEQ ID NO: 987468 - DNA, 19 bp, Homo sapiens
caggaatgttaaagtcagt

SEQ ID NO: 987469 - DNA, 13 bp, Homo sapiens
caggaattatgtc

SEQ ID NO: 987470 - DNA, 18 bp, Homo sapiens
caggaattctcaagacct

SEQ ID NO: 987471 - DNA, 16 bp, Homo sapiens
caggaattttattttg

SEQ ID NO: 987472 - DNA, 21 bp, Homo sapiens
caggaattttattttgctgag

SEQ ID NO: 987473 - DNA, 23 bp, Homo sapiens
caggacaatgaaatactccagca

SEQ ID NO: 987474 - DNA, 24 bp, Homo sapiens
caggacaatgaaatactccagcac

SEQ ID NO: 987475 - DNA, 21 bp, Homo sapiens
caggacacgaaggctgcccct

SEQ ID NO: 987476 - DNA, 19 bp, Homo sapiens
caggacagcatcccttccc

SEQ ID NO: 987477 - DNA, 24 bp, Homo sapiens
caggacagcatcccttcccacatg

SEQ ID NO: 987478 - DNA, 12 bp, Homo sapiens
caggacagctct

SEQ ID NO: 987479 - DNA, 13 bp, Homo sapiens
caggacagctctt

SEQ ID NO: 987480 - DNA, 14 bp, Homo sapiens
caggacagctcttg

SEQ ID NO: 987481 - DNA, 12 bp, Homo sapiens
caggacagctgg

SEQ ID NO: 987482 - DNA, 20 bp, Homo sapiens
caggacagtgcttcagcctg

SEQ ID NO: 987483 - DNA, 12 bp, Homo sapiens
cagctgcctgca

SEQ ID NO: 987484 - DNA, 14 bp, Homo sapiens
cagctgcctggggc

SEQ ID NO: 987485 - DNA, 15 bp, Homo sapiens
cagctgcctggggcc

SEQ ID NO: 987486 - DNA, 17 bp, Homo sapiens
cagctgcctggggccca

SEQ ID NO: 987487 - DNA, 19 bp, Homo sapiens
cagctgcgcttgcttttct

SEQ ID NO: 987488 - DNA, 14 bp, Homo sapiens
cagctgcgggtctg

SEQ ID NO: 987489 - DNA, 18 bp, Homo sapiens
cagctgctatccccatct

SEQ ID NO: 987490 - DNA, 16 bp, Homo sapiens
cagctgctcccacact

SEQ ID NO: 987491 - DNA, 12 bp, Homo sapiens
cagctgctccta

SEQ ID NO: 987492 - DNA, 18 bp, Homo sapiens
cagctgctcctagaggga

SEQ ID NO: 987493 - DNA, 23 bp, Homo sapiens
cagctgctcctagagggaggggc

SEQ ID NO: 987494 - DNA, 12 bp, Homo sapiens
cagctgctctgc

SEQ ID NO: 987495 - DNA, 17 bp, Homo sapiens
cagctgctctgcccctt

SEQ ID NO: 987496 - DNA, 22 bp, Homo sapiens
cagctgctcttagtgcccgcct

SEQ ID NO: 987497 - DNA, 21 bp, Homo sapiens
cagctgctgaagttctgagcc

SEQ ID NO: 987498 - DNA, 15 bp, Homo sapiens
cagctgctggagaat

SEQ ID NO: 987499 - DNA, 22 bp, Homo sapiens
cagctgctggagaataaatttg

SEQ ID NO: 987500 - DNA, 12 bp, Homo sapiens
cagctgctgtct

SEQ ID NO: 987501 - DNA, 13 bp, Homo sapiens
cagctgctgtggg

SEQ ID NO: 987502 - DNA, 16 bp, Homo sapiens
cagctgctgttctcag

SEQ ID NO: 987503 - DNA, 18 bp, Homo sapiens
cagctgctgttctcagga

SEQ ID NO: 987504 - DNA, 22 bp, Homo sapiens
cagctgctgttctcaggacagc

SEQ ID NO: 987505 - DNA, 12 bp, Homo sapiens
cagctgcttctc

SEQ ID NO: 987506 - DNA, 21 bp, Homo sapiens
cagctgcttgtgggcccggag

SEQ ID NO: 987507 - DNA, 21 bp, Homo sapiens
cagctgctttgagctacagga

SEQ ID NO: 987508 - DNA, 15 bp, Homo sapiens
cagctggacagaggg

SEQ ID NO: 987509 - DNA, 24 bp, Homo sapiens
cagctggacagaggggactctggg

SEQ ID NO: 987510 - DNA, 18 bp, Homo sapiens
cagctggactctgcatcc

SEQ ID NO: 987511 - DNA, 18 bp, Homo sapiens
cagctggagaaatatggt

SEQ ID NO: 987512 - DNA, 21 bp, Homo sapiens
cagctggaggaatacatttta

SEQ ID NO: 987513 - DNA, 22 bp, Homo sapiens
cagctggaggaatacattttat

SEQ ID NO: 987514 - DNA, 14 bp, Homo sapiens
cagctggcccccag

SEQ ID NO: 987515 - DNA, 15 bp, Homo sapiens
cagctggcccccagc

SEQ ID NO: 987516 - DNA, 11 bp, Homo sapiens
cagctggccta

SEQ ID NO: 987517 - DNA, 23 bp, Homo sapiens
cagctggcctaatcactctgagt

SEQ ID NO: 987518 - DNA, 14 bp, Homo sapiens
cagctggcctggac

SEQ ID NO: 987519 - DNA, 16 bp, Homo sapiens
cagctggcctggacag

SEQ ID NO: 987520 - DNA, 19 bp, Homo sapiens
agcctagaacatccctggg

SEQ ID NO: 987521 - DNA, 17 bp, Homo sapiens
agcctagaagagcttct

SEQ ID NO: 987522 - DNA, 19 bp, Homo sapiens
agcctagaagagcttctga

SEQ ID NO: 987523 - DNA, 14 bp, Homo sapiens
agcctagaagctgg

SEQ ID NO: 987524 - DNA, 19 bp, Homo sapiens
agcctagacaacctttctg

SEQ ID NO: 987525 - DNA, 20 bp, Homo sapiens
agcctagacaacctttctgt

SEQ ID NO: 987526 - DNA, 18 bp, Homo sapiens
agcctagaccctcctcct

SEQ ID NO: 987527 - DNA, 17 bp, Homo sapiens
agcctagcacagcagct

SEQ ID NO: 987528 - DNA, 15 bp, Homo sapiens
agcctaggaccactc

SEQ ID NO: 987529 - DNA, 18 bp, Homo sapiens
agcctaggaccactcagc

SEQ ID NO: 987530 - DNA, 19 bp, Homo sapiens
agcctaggaccactcagcc

SEQ ID NO: 987531 - DNA, 23 bp, Homo sapiens
agcctaggaccactcagccccta

SEQ ID NO: 987532 - DNA, 21 bp, Homo sapiens
agcctaggacgccaacttctc

SEQ ID NO: 987533 - DNA, 14 bp, Homo sapiens
agcctaggggtcag

SEQ ID NO: 987534 - DNA, 23 bp, Homo sapiens
agcctaggggtcagggaccaagg

SEQ ID NO: 987535 - DNA, 22 bp, Homo sapiens
agcctagttcatccaatcctca

SEQ ID NO: 987536 - DNA, 23 bp, Homo sapiens
agcctagttcatccaatcctcac

SEQ ID NO: 987537 - DNA, 21 bp, Homo sapiens
agcctatacgtttctgtggag

SEQ ID NO: 987538 - DNA, 18 bp, Homo sapiens
agcctatagtaaatgtgt

SEQ ID NO: 987539 - DNA, 21 bp, Homo sapiens
agcctatgagcatcctgagcc

SEQ ID NO: 987540 - DNA, 20 bp, Homo sapiens
agcctatgatattccccatt

SEQ ID NO: 987541 - DNA, 15 bp, Homo sapiens
agcctatttttcaaa

SEQ ID NO: 987542 - DNA, 20 bp, Homo sapiens
agcctcaaaacaaaggccta

SEQ ID NO: 987543 - DNA, 24 bp, Homo sapiens
agcctcaaagtcccttgagactcc

SEQ ID NO: 987544 - DNA, 19 bp, Homo sapiens
agcctcaaggccctcggag

SEQ ID NO: 987545 - DNA, 21 bp, Homo sapiens
agcctcaatttcctcatctgg

SEQ ID NO: 987546 - DNA, 22 bp, Homo sapiens
agcctcacagcagtgagactgg

SEQ ID NO: 987547 - DNA, 16 bp, Homo sapiens
agcctcacggagggcc

SEQ ID NO: 987548 - DNA, 22 bp, Homo sapiens
agcctcacggagggccgtgtga

SEQ ID NO: 987549 - DNA, 21 bp, Homo sapiens
agcctcacggggttggctgtt

SEQ ID NO: 987550 - DNA, 21 bp, Homo sapiens
agcctcacgtatttcacagag

SEQ ID NO: 987551 - DNA, 23 bp, Homo sapiens
agcctcacgtatttcacagagca

SEQ ID NO: 987552 - DNA, 16 bp, Homo sapiens
agcctcacttgaatgt

SEQ ID NO: 987553 - DNA, 23 bp, Homo sapiens
agcctcacttttaatgaacaaat

SEQ ID NO: 987554 - DNA, 17 bp, Homo sapiens
agcctcagaaggcccca

SEQ ID NO: 987555 - DNA, 22 bp, Homo sapiens
agcctcagaaggccccagagag

SEQ ID NO: 987556 - DNA, 12 bp, Homo sapiens
agcctcagccat

SEQ ID NO: 987557 - DNA, 14 bp, Homo sapiens
agcctcagcccaac

SEQ ID NO: 987558 - DNA, 15 bp, Homo sapiens
agcctcagcccaact

SEQ ID NO: 987559 - DNA, 18 bp, Homo sapiens
agcctcagcccaacttct

SEQ ID NO: 987560 - DNA, 23 bp, Homo sapiens
agcctcaggcttgagggagggct

SEQ ID NO: 987561 - DNA, 16 bp, Homo sapiens
agcctcagtctccctc

SEQ ID NO: 987562 - DNA, 22 bp, Homo sapiens
agcctcagtctccctcccttgg

SEQ ID NO: 987563 - DNA, 14 bp, Homo sapiens
agcctcagtgccac

SEQ ID NO: 987564 - DNA, 23 bp, Homo sapiens
agcctcagtgccacttgacattc

SEQ ID NO: 987565 - DNA, 17 bp, Homo sapiens
agcctcatactcctggg

SEQ ID NO: 987566 - DNA, 18 bp, Homo sapiens
agcctcatactcctgggc

SEQ ID NO: 987567 - DNA, 19 bp, Homo sapiens
agcctcatactcctgggct

SEQ ID NO: 987568 - DNA, 16 bp, Homo sapiens
agcctcatatttaaag

SEQ ID NO: 987569 - DNA, 20 bp, Homo sapiens
agcctcatccgaggcagggt

SEQ ID NO: 987570 - DNA, 20 bp, Homo sapiens
agcctcatcctccccaggac

SEQ ID NO: 987571 - DNA, 12 bp, Homo sapiens
agcctcatctct

SEQ ID NO: 987572 - DNA, 22 bp, Homo sapiens
agcctcatgttctcttcccagg

SEQ ID NO: 987573 - DNA, 23 bp, Homo sapiens
agcctcatgttctcttcccaggc

SEQ ID NO: 987574 - DNA, 14 bp, Homo sapiens
agcctcatgttctg

SEQ ID NO: 987575 - DNA, 15 bp, Homo sapiens
agcctcatgttctgt

SEQ ID NO: 987576 - DNA, 17 bp, Homo sapiens
agcctcatgttctgtgg

SEQ ID NO: 987577 - DNA, 19 bp, Homo sapiens
agcctcattgtgccaagcc

SEQ ID NO: 987578 - DNA, 22 bp, Homo sapiens
agcctccaagcacagagcctgg

SEQ ID NO: 987579 - DNA, 13 bp, Homo sapiens
agcctccaagcct

SEQ ID NO: 987580 - DNA, 18 bp, Homo sapiens
agcctccaagcctgcctc

SEQ ID NO: 987581 - DNA, 12 bp, Homo sapiens
agcctccacagc

SEQ ID NO: 987582 - DNA, 23 bp, Homo sapiens
agcctccacagcgagggcagctg

SEQ ID NO: 987583 - DNA, 18 bp, Homo sapiens
agcctccaccttgctctt

SEQ ID NO: 987584 - DNA, 19 bp, Homo sapiens
agcctccaccttgctcttc

SEQ ID NO: 987585 - DNA, 20 bp, Homo sapiens
agcctccactgcctctggaa

SEQ ID NO: 987586 - DNA, 16 bp, Homo sapiens
agcctccagagaagcc

SEQ ID NO: 987587 - DNA, 15 bp, Homo sapiens
agcctccagagccag

SEQ ID NO: 987588 - DNA, 17 bp, Homo sapiens
agcctccagagccagcc

SEQ ID NO: 987589 - DNA, 21 bp, Homo sapiens
agcctccagagccagcctggg

SEQ ID NO: 987590 - DNA, 23 bp, Homo sapiens
agcctccagagccagcctgggac

SEQ ID NO: 987591 - DNA, 20 bp, Homo sapiens
agcctccaggcccccaactc

SEQ ID NO: 987592 - DNA, 17 bp, Homo sapiens
agcctccatgctgcctc

SEQ ID NO: 987593 - DNA, 15 bp, Homo sapiens
agcctccatttagtt

SEQ ID NO: 987594 - DNA, 20 bp, Homo sapiens
agcctccatttagttctttg

SEQ ID NO: 987595 - DNA, 12 bp, Homo sapiens
agcctcccaagt

SEQ ID NO: 987596 - DNA, 13 bp, Homo sapiens
agcctcccacccc

SEQ ID NO: 987597 - DNA, 18 bp, Homo sapiens
agcctcccatccagggcc

SEQ ID NO: 987598 - DNA, 18 bp, Homo sapiens
agcctcccccgccagccc

SEQ ID NO: 987599 - DNA, 23 bp, Homo sapiens
agcctccccctcagatgatctct

SEQ ID NO: 987600 - DNA, 21 bp, Homo sapiens
agcctcccctcccctggggac

SEQ ID NO: 987601 - DNA, 16 bp, Homo sapiens
agcctcccctgccagg

SEQ ID NO: 987602 - DNA, 17 bp, Homo sapiens
agcctcccctgccaggg

SEQ ID NO: 987603 - DNA, 14 bp, Homo sapiens
agcctccccttctt

SEQ ID NO: 987604 - DNA, 17 bp, Homo sapiens
cgtgcctgggcccctcc

SEQ ID NO: 987605 - DNA, 23 bp, Homo sapiens
cgtgcctgggcccctcccctcag

SEQ ID NO: 987606 - DNA, 14 bp, Homo sapiens
cgtgcctgtgtcca

SEQ ID NO: 987607 - DNA, 16 bp, Homo sapiens
cgtgccttcagctcta

SEQ ID NO: 987608 - DNA, 19 bp, Homo sapiens
cgtgccttttgcacccctc

SEQ ID NO: 987609 - DNA, 14 bp, Homo sapiens
cgtgcgagctgccg

SEQ ID NO: 987610 - DNA, 22 bp, Homo sapiens
cgtgcgtgttagtgtgtgtgca

SEQ ID NO: 987611 - DNA, 13 bp, Homo sapiens
cgtgctgggcagc

SEQ ID NO: 987612 - DNA, 16 bp, Homo sapiens
cgtgctgggcagcccg

SEQ ID NO: 987613 - DNA, 19 bp, Homo sapiens
cgtgctgggcggctgtgct

SEQ ID NO: 987614 - DNA, 13 bp, Homo sapiens
cgtgctgtaaata

SEQ ID NO: 987615 - DNA, 15 bp, Homo sapiens
cgtggaaagggtgct

SEQ ID NO: 987616 - DNA, 14 bp, Homo sapiens
cgtggaacattctg

SEQ ID NO: 987617 - DNA, 16 bp, Homo sapiens
cgtggaacctctgtct

SEQ ID NO: 987618 - DNA, 19 bp, Homo sapiens
cgtggaacctctgtctcat

SEQ ID NO: 987619 - DNA, 15 bp, Homo sapiens
cgtggaccttcctgc

SEQ ID NO: 987620 - DNA, 19 bp, Homo sapiens
cgtggactgagtgggaagc

SEQ ID NO: 987621 - DNA, 19 bp, Homo sapiens
cgtggactgtgctggtgca

SEQ ID NO: 987622 - DNA, 17 bp, Homo sapiens
cgtggagagctggtgcc

SEQ ID NO: 987623 - DNA, 16 bp, Homo sapiens
cgtggagatagtgcca

SEQ ID NO: 987624 - DNA, 22 bp, Homo sapiens
cgtggagatagtgccaggtggc

SEQ ID NO: 987625 - DNA, 16 bp, Homo sapiens
cgtggagccagggagc

SEQ ID NO: 987626 - DNA, 23 bp, Homo sapiens
cgtggagccattgaacagctgtg

SEQ ID NO: 987627 - DNA, 19 bp, Homo sapiens
cgtggagctcgcccctccc

SEQ ID NO: 987628 - DNA, 20 bp, Homo sapiens
cgtggagcttaagccactgc

SEQ ID NO: 987629 - DNA, 18 bp, Homo sapiens
cgtggaggaatgctcccc

SEQ ID NO: 987630 - DNA, 17 bp, Homo sapiens
cgtggaggaggaaggca

SEQ ID NO: 987631 - DNA, 18 bp, Homo sapiens
cgtggatacagagccacg

SEQ ID NO: 987632 - DNA, 18 bp, Homo sapiens
cgtggatcaagcttgtgt

SEQ ID NO: 987633 - DNA, 17 bp, Homo sapiens
cgtggattgcacgtggc

SEQ ID NO: 987634 - DNA, 14 bp, Homo sapiens
cgtggcacagctgg

SEQ ID NO: 987635 - DNA, 15 bp, Homo sapiens
cgtggcacagctggg

SEQ ID NO: 987636 - DNA, 22 bp, Homo sapiens
cgtggcacagctgggagcctgg

SEQ ID NO: 987637 - DNA, 15 bp, Homo sapiens
cgtggcactagaatg

SEQ ID NO: 987638 - DNA, 22 bp, Homo sapiens
cgtggcagataatcagcctctt

SEQ ID NO: 987639 - DNA, 20 bp, Homo sapiens
cgtggcatgttttgatttgt

SEQ ID NO: 987640 - DNA, 17 bp, Homo sapiens
cgtggccacgggggcag

SEQ ID NO: 987641 - DNA, 11 bp, Homo sapiens
cgtggccagcc

SEQ ID NO: 987642 - DNA, 15 bp, Homo sapiens
cgtggccagcccggc

SEQ ID NO: 987643 - DNA, 17 bp, Homo sapiens
cgtggcccgtggcctgg

SEQ ID NO: 987644 - DNA, 18 bp, Homo sapiens
cgtggcccgtggcctggc

SEQ ID NO: 987645 - DNA, 14 bp, Homo sapiens
cgtggcctctctct

SEQ ID NO: 987646 - DNA, 16 bp, Homo sapiens
cgtggcctcttgagca

SEQ ID NO: 987647 - DNA, 16 bp, Homo sapiens
cgtggcctggcatctg

SEQ ID NO: 987648 - DNA, 13 bp, Homo sapiens
cgtggcctgggct

SEQ ID NO: 987649 - DNA, 19 bp, Homo sapiens
cgtggcctgggcttggccc

SEQ ID NO: 987650 - DNA, 15 bp, Homo sapiens
cgtggccttgggagg

SEQ ID NO: 987651 - DNA, 14 bp, Homo sapiens
cgtggctcagccag

SEQ ID NO: 987652 - DNA, 15 bp, Homo sapiens
cgtggctcagccagc

SEQ ID NO: 987653 - DNA, 13 bp, Homo sapiens
cgtggctctgctg

SEQ ID NO: 987654 - DNA, 11 bp, Homo sapiens
cgtggctctgg

SEQ ID NO: 987655 - DNA, 13 bp, Homo sapiens
cgtggctctggga

SEQ ID NO: 987656 - DNA, 21 bp, Homo sapiens
cgtggctctgggagagccagc

SEQ ID NO: 987657 - DNA, 20 bp, Homo sapiens
cgtggcttcccgctcagccc

SEQ ID NO: 987658 - DNA, 21 bp, Homo sapiens
cgtggcttcccgctcagccct

SEQ ID NO: 987659 - DNA, 15 bp, Homo sapiens
cgtggcttggcatct

SEQ ID NO: 987660 - DNA, 19 bp, Homo sapiens
cgtggcttggcatctgtgt

SEQ ID NO: 987661 - DNA, 14 bp, Homo sapiens
cgtgggagccagcc

SEQ ID NO: 987662 - DNA, 19 bp, Homo sapiens
cgtgggccctgcaggctgc

SEQ ID NO: 987663 - DNA, 16 bp, Homo sapiens
cgtgggccgggaggca

SEQ ID NO: 987664 - DNA, 17 bp, Homo sapiens
cgtgggccgggaggcag

SEQ ID NO: 987665 - DNA, 12 bp, Homo sapiens
cgtgggctctgc

SEQ ID NO: 987666 - DNA, 13 bp, Homo sapiens
cgtgggctctgcc

SEQ ID NO: 987667 - DNA, 18 bp, Homo sapiens
cgtgggcttaaagcagaa

SEQ ID NO: 987668 - DNA, 13 bp, Homo sapiens
cgtggggaagggg

SEQ ID NO: 987669 - DNA, 18 bp, Homo sapiens
cgtggggaaggggtgcag

SEQ ID NO: 987670 - DNA, 23 bp, Homo sapiens
cgtggggagggccgtaccccacc

SEQ ID NO: 987671 - DNA, 23 bp, Homo sapiens
cgtggggtgacttccctggtcac

SEQ ID NO: 987672 - DNA, 15 bp, Homo sapiens
cgtggggtgtgctgg

SEQ ID NO: 987673 - DNA, 17 bp, Homo sapiens
cgtggggtgtgctggga

SEQ ID NO: 987674 - DNA, 21 bp, Homo sapiens
cgtgggtcactacagggagaa

SEQ ID NO: 987675 - DNA, 15 bp, Homo sapiens
cgtgggtctctgggg

SEQ ID NO: 987676 - DNA, 16 bp, Homo sapiens
cgtgggtctctgggga

SEQ ID NO: 987677 - DNA, 23 bp, Homo sapiens
cgtgggtttttgtatccagagct

SEQ ID NO: 987678 - DNA, 14 bp, Homo sapiens
cgtggtagaagcca

SEQ ID NO: 987679 - DNA, 17 bp, Homo sapiens
cgtggtatgtctgccat

SEQ ID NO: 987680 - DNA, 20 bp, Homo sapiens
cgtggtccatgctgatgatt

SEQ ID NO: 987681 - DNA, 23 bp, Homo sapiens
cgtggtgggggaggagcctctgg

SEQ ID NO: 987682 - DNA, 12 bp, Homo sapiens
cgtgtaaataat

SEQ ID NO: 987683 - DNA, 13 bp, Homo sapiens
cgtgtacagcaca

SEQ ID NO: 987684 - DNA, 16 bp, Homo sapiens
cgtgtacagcacagaa

SEQ ID NO: 987685 - DNA, 18 bp, Homo sapiens
cgtgtacatagccctggt

SEQ ID NO: 987686 - DNA, 18 bp, Homo sapiens
cgtgtagcgtcctgagga

SEQ ID NO: 987687 - DNA, 19 bp, Homo sapiens
cgtgtagcgtcctgaggaa

SEQ ID NO: 987688 - DNA, 15 bp, Homo sapiens
cgtgtatagtgccta

SEQ ID NO: 987689 - DNA, 22 bp, Homo sapiens
cgtgtattgagatttcttaaat

SEQ ID NO: 987690 - DNA, 16 bp, Homo sapiens
cgtgtatttattacat

SEQ ID NO: 987691 - DNA, 17 bp, Homo sapiens
cgtgtatttggctgggc

SEQ ID NO: 987692 - DNA, 14 bp, Homo sapiens
cgtgtcaagctgct

SEQ ID NO: 987693 - DNA, 15 bp, Homo sapiens
cgtgtcaagctgctc

SEQ ID NO: 987694 - DNA, 23 bp, Homo sapiens
cgtgtccaagggccgtgcccttg

SEQ ID NO: 987695 - DNA, 19 bp, Homo sapiens
cgtgtcccctgacagggcc

SEQ ID NO: 987696 - DNA, 15 bp, Homo sapiens
cgtgtccctctcgga

SEQ ID NO: 987697 - DNA, 13 bp, Homo sapiens
cgtgtccgtccac

SEQ ID NO: 987698 - DNA, 18 bp, Homo sapiens
cgtgtccgtccacccttc

SEQ ID NO: 987699 - DNA, 17 bp, Homo sapiens
cgtgtcctcctctgagg

SEQ ID NO: 987700 - DNA, 15 bp, Homo sapiens
cgtgtcgtgggtgtg

SEQ ID NO: 987701 - DNA, 15 bp, Homo sapiens
cgtgtctcagcctct

SEQ ID NO: 987702 - DNA, 16 bp, Homo sapiens
cgtgtctcagcctctg

SEQ ID NO: 987703 - DNA, 13 bp, Homo sapiens
cgtgtctctccca

SEQ ID NO: 987704 - DNA, 14 bp, Homo sapiens
cgtgtctctgagga

SEQ ID NO: 987705 - DNA, 20 bp, Homo sapiens
cgtgtcttccactttgcata

SEQ ID NO: 987706 - DNA, 13 bp, Homo sapiens
cgtgtgaatgtag

SEQ ID NO: 987707 - DNA, 23 bp, Homo sapiens
cgtgtgagaagtgaatgctggga

SEQ ID NO: 987708 - DNA, 21 bp, Homo sapiens
cgtgtgcatagcgtcctgccc

SEQ ID NO: 987709 - DNA, 22 bp, Homo sapiens
cgtgtgcatagcgtcctgccct

SEQ ID NO: 987710 - DNA, 16 bp, Homo sapiens
cgtgtgctgaagacat

SEQ ID NO: 987711 - DNA, 18 bp, Homo sapiens
cgtgtggagcagagctct

SEQ ID NO: 987712 - DNA, 16 bp, Homo sapiens
cgtgtggcagccacac

SEQ ID NO: 987713 - DNA, 20 bp, Homo sapiens
cgtgtggctcacgtgtgtga

SEQ ID NO: 987714 - DNA, 15 bp, Homo sapiens
cgtgtggctcctggt

SEQ ID NO: 987715 - DNA, 22 bp, Homo sapiens
cgtgtggtttccctgcccctgt

SEQ ID NO: 987716 - DNA, 15 bp, Homo sapiens
cgtgtgtatttctaa

SEQ ID NO: 987717 - DNA, 17 bp, Homo sapiens
cgtgtgtcccagatgct

SEQ ID NO: 987718 - DNA, 22 bp, Homo sapiens
cgtgtgtgcaagtgtctgtgtg

SEQ ID NO: 987719 - DNA, 20 bp, Homo sapiens
cgtgtgttcttttgagtcct

SEQ ID NO: 987720 - DNA, 17 bp, Homo sapiens
cgtgttacccactgcca

SEQ ID NO: 987721 - DNA, 20 bp, Homo sapiens
cgtgttagtgtgtgtgcatg

SEQ ID NO: 987722 - DNA, 22 bp, Homo sapiens
cgtgttagtgtgtgtgcatgtg

SEQ ID NO: 987723 - DNA, 22 bp, Homo sapiens
cgtgttatgaatctgtgctggc

SEQ ID NO: 987724 - DNA, 15 bp, Homo sapiens
cgtgttcaatatttt

SEQ ID NO: 987725 - DNA, 22 bp, Homo sapiens
cgtgttcaggacacatctattg

SEQ ID NO: 987726 - DNA, 22 bp, Homo sapiens
gtggatttgattcattttcctg

SEQ ID NO: 987727 - DNA, 20 bp, Homo sapiens
gtggattttctactgtaaga

SEQ ID NO: 987728 - DNA, 19 bp, Homo sapiens
gtggattttttattattat

SEQ ID NO: 987729 - DNA, 14 bp, Homo sapiens
gtggcaaagtgctg

SEQ ID NO: 987730 - DNA, 15 bp, Homo sapiens
gtggcaagaccaaaa

SEQ ID NO: 987731 - DNA, 16 bp, Homo sapiens
gtggcaatctgtgggc

SEQ ID NO: 987732 - DNA, 14 bp, Homo sapiens
gtggcacaaaaaaa

SEQ ID NO: 987733 - DNA, 22 bp, Homo sapiens
gtggcacagacttctggaaggc

SEQ ID NO: 987734 - DNA, 13 bp, Homo sapiens
gtggcacaggcac

SEQ ID NO: 987735 - DNA, 14 bp, Homo sapiens
gtggcaccagcagc

SEQ ID NO: 987736 - DNA, 16 bp, Homo sapiens
gtggcacctcctgaga

SEQ ID NO: 987737 - DNA, 17 bp, Homo sapiens
gtggcacctgtttcccg

SEQ ID NO: 987738 - DNA, 19 bp, Homo sapiens
gtggcacggagagaaggcc

SEQ ID NO: 987739 - DNA, 20 bp, Homo sapiens
gtggcacgggccctccctcc

SEQ ID NO: 987740 - DNA, 15 bp, Homo sapiens
gtggcactgagcccc

SEQ ID NO: 987741 - DNA, 16 bp, Homo sapiens
gtggcactgagccccc

SEQ ID NO: 987742 - DNA, 22 bp, Homo sapiens
gtggcactggtaggttgggaca

SEQ ID NO: 987743 - DNA, 15 bp, Homo sapiens
gtggcacttctgcct

SEQ ID NO: 987744 - DNA, 14 bp, Homo sapiens
gtggcagaaaagag

SEQ ID NO: 987745 - DNA, 20 bp, Homo sapiens
gtggcagaaaagaggagacc

SEQ ID NO: 987746 - DNA, 19 bp, Homo sapiens
gtggcagatgtcttccctg

SEQ ID NO: 987747 - DNA, 22 bp, Homo sapiens
gtggcagattttacaaaagatg

SEQ ID NO: 987748 - DNA, 13 bp, Homo sapiens
gtggcagcaacaa

SEQ ID NO: 987749 - DNA, 19 bp, Homo sapiens
gtggcagcaacggcacagc

SEQ ID NO: 987750 - DNA, 13 bp, Homo sapiens
gtggcagccatgc

SEQ ID NO: 987751 - DNA, 22 bp, Homo sapiens
gtggcagctgtcccctctccct

SEQ ID NO: 987752 - DNA, 13 bp, Homo sapiens
gtggcaggaccag

SEQ ID NO: 987753 - DNA, 14 bp, Homo sapiens
cttcctgcttgcca

SEQ ID NO: 987754 - DNA, 14 bp, Homo sapiens
cttcctggacacac

SEQ ID NO: 987755 - DNA, 15 bp, Homo sapiens
cttcctggacacact

SEQ ID NO: 987756 - DNA, 17 bp, Homo sapiens
cttcctggacacactct

SEQ ID NO: 987757 - DNA, 15 bp, Homo sapiens
cttcctggacctgag

SEQ ID NO: 987758 - DNA, 21 bp, Homo sapiens
cttcctggcccaggccttgct

SEQ ID NO: 987759 - DNA, 13 bp, Homo sapiens
cttcctggcctct

SEQ ID NO: 987760 - DNA, 19 bp, Homo sapiens
cttcctggctccttcactg

SEQ ID NO: 987761 - DNA, 16 bp, Homo sapiens
cttcctggctctgggg

SEQ ID NO: 987762 - DNA, 21 bp, Homo sapiens
cttcctgggaccccctcgcca

SEQ ID NO: 987763 - DNA, 16 bp, Homo sapiens
cttcctgggaggacag

SEQ ID NO: 987764 - DNA, 19 bp, Homo sapiens
cttcctgggaggacaggca

SEQ ID NO: 987765 - DNA, 16 bp, Homo sapiens
cttcctggggatgtca

SEQ ID NO: 987766 - DNA, 18 bp, Homo sapiens
cttcctggggatgtcata

SEQ ID NO: 987767 - DNA, 20 bp, Homo sapiens
cttcctggggcatctggcga

SEQ ID NO: 987768 - DNA, 17 bp, Homo sapiens
cttcctggggccccgct

SEQ ID NO: 987769 - DNA, 21 bp, Homo sapiens
cttcctggggccccgctggga

SEQ ID NO: 987770 - DNA, 23 bp, Homo sapiens
cttcctgggtcctgttccctacc

SEQ ID NO: 987771 - DNA, 18 bp, Homo sapiens
cttcctggtgaggcccag

SEQ ID NO: 987772 - DNA, 19 bp, Homo sapiens
cttcctggtgaggcccagc

SEQ ID NO: 987773 - DNA, 17 bp, Homo sapiens
cttcctgtcccacctct

SEQ ID NO: 987774 - DNA, 16 bp, Homo sapiens
cttcctgtccctgagg

SEQ ID NO: 987775 - DNA, 13 bp, Homo sapiens
cttcctgtcctgc

SEQ ID NO: 987776 - DNA, 15 bp, Homo sapiens
cttcctgtcctgcct

SEQ ID NO: 987777 - DNA, 16 bp, Homo sapiens
cttcctgtcctgcctc

SEQ ID NO: 987778 - DNA, 18 bp, Homo sapiens
cttcctgtcctgcctcct

SEQ ID NO: 987779 - DNA, 20 bp, Homo sapiens
cttcctgtcctgcctcctca

SEQ ID NO: 987780 - DNA, 14 bp, Homo sapiens
cttcctgtctgttt

SEQ ID NO: 987781 - DNA, 16 bp, Homo sapiens
cttcctgtctgtttat

SEQ ID NO: 987782 - DNA, 16 bp, Homo sapiens
cttcctgtgacttcag

SEQ ID NO: 987783 - DNA, 14 bp, Homo sapiens
cttcctgtgccctc

SEQ ID NO: 987784 - DNA, 15 bp, Homo sapiens
cttcctgtgccctca

SEQ ID NO: 987785 - DNA, 17 bp, Homo sapiens
cttcctgtgccctcacc

SEQ ID NO: 987786 - DNA, 16 bp, Homo sapiens
cttcctgtgccctgca

SEQ ID NO: 987787 - DNA, 14 bp, Homo sapiens
cttcctgtgtcctg

SEQ ID NO: 987788 - DNA, 15 bp, Homo sapiens
cttcctgtgtcctga

SEQ ID NO: 987789 - DNA, 15 bp, Homo sapiens
cttcctgtgtgtcca

SEQ ID NO: 987790 - DNA, 16 bp, Homo sapiens
cttcctgttacctgtc

SEQ ID NO: 987791 - DNA, 16 bp, Homo sapiens
cttcctgttccctcct

SEQ ID NO: 987792 - DNA, 19 bp, Homo sapiens
cttcctgttccctcctggt

SEQ ID NO: 987793 - DNA, 22 bp, Homo sapiens
cttcctgttccctcctggtcct

SEQ ID NO: 987794 - DNA, 23 bp, Homo sapiens
cttcctgtttcagacccccccat

SEQ ID NO: 987795 - DNA, 19 bp, Homo sapiens
cttccttaattcactccca

SEQ ID NO: 987796 - DNA, 15 bp, Homo sapiens
cttccttcaggactc

SEQ ID NO: 987797 - DNA, 18 bp, Homo sapiens
cttccttcaggactctgc

SEQ ID NO: 987798 - DNA, 13 bp, Homo sapiens
cttccttcagggt

SEQ ID NO: 987799 - DNA, 18 bp, Homo sapiens
cttccttcagggtttaat

SEQ ID NO: 987800 - DNA, 14 bp, Homo sapiens
cttccttcctgctt

SEQ ID NO: 987801 - DNA, 15 bp, Homo sapiens
cttccttctacccca

SEQ ID NO: 987802 - DNA, 22 bp, Homo sapiens
cttccttgacctgcattgtaaa

SEQ ID NO: 987803 - DNA, 15 bp, Homo sapiens
cttccttgactgtct

SEQ ID NO: 987804 - DNA, 20 bp, Homo sapiens
cttccttgagacacggagcc

SEQ ID NO: 987805 - DNA, 15 bp, Homo sapiens
cttccttgctctccc

SEQ ID NO: 987806 - DNA, 19 bp, Homo sapiens
cttccttgggcgtctcccc

SEQ ID NO: 987807 - DNA, 16 bp, Homo sapiens
cttcctttactttccc

SEQ ID NO: 987808 - DNA, 22 bp, Homo sapiens
cttcctttactttcccttgctt

SEQ ID NO: 987809 - DNA, 23 bp, Homo sapiens
cttcctttactttcccttgcttt

SEQ ID NO: 987810 - DNA, 18 bp, Homo sapiens
cttcctttaggtctggtt

SEQ ID NO: 987811 - DNA, 18 bp, Homo sapiens
cttcctttccctggagct

SEQ ID NO: 987812 - DNA, 17 bp, Homo sapiens
cttcctttcctactgtc

SEQ ID NO: 987813 - DNA, 20 bp, Homo sapiens
cttcctttcctactgtcctg

SEQ ID NO: 987814 - DNA, 16 bp, Homo sapiens
cttcctttctccagga

SEQ ID NO: 987815 - DNA, 17 bp, Homo sapiens
cttcctttctccaggac

SEQ ID NO: 987816 - DNA, 13 bp, Homo sapiens
cttcctttctctc

SEQ ID NO: 987817 - DNA, 14 bp, Homo sapiens
cttcctttctctcc

SEQ ID NO: 987818 - DNA, 15 bp, Homo sapiens
cttcctttctctcct

SEQ ID NO: 987819 - DNA, 17 bp, Homo sapiens
cttcctttctctcctgg

SEQ ID NO: 987820 - DNA, 21 bp, Homo sapiens
cttcctttggggaagtttatt

SEQ ID NO: 987821 - DNA, 17 bp, Homo sapiens
cttccttttatcagtag

SEQ ID NO: 987822 - DNA, 19 bp, Homo sapiens
cttccttttccctgcttcc

SEQ ID NO: 987823 - DNA, 22 bp, Homo sapiens
cttccttttccctgcttccagg

SEQ ID NO: 987824 - DNA, 17 bp, Homo sapiens
cttcgaaaggccttcag

SEQ ID NO: 987825 - DNA, 18 bp, Homo sapiens
cttcgacatgctgccagg

SEQ ID NO: 987826 - DNA, 19 bp, Homo sapiens
cttcgacatgctgccagga

SEQ ID NO: 987827 - DNA, 14 bp, Homo sapiens
cttcgactcaggat

SEQ ID NO: 987828 - DNA, 15 bp, Homo sapiens
cttcgactcaggatc

SEQ ID NO: 987829 - DNA, 16 bp, Homo sapiens
cttcgactcaggatcc

SEQ ID NO: 987830 - DNA, 16 bp, Homo sapiens
cttcgatacaccgggc

SEQ ID NO: 987831 - DNA, 16 bp, Homo sapiens
cttcgcaccttgctgt

SEQ ID NO: 987832 - DNA, 13 bp, Homo sapiens
cttcgctagaaaa

SEQ ID NO: 987833 - DNA, 15 bp, Homo sapiens
cttcgctcctcctct

SEQ ID NO: 987834 - DNA, 13 bp, Homo sapiens
cttcgctgaaatt

SEQ ID NO: 987835 - DNA, 13 bp, Homo sapiens
cttcgctgctcta

SEQ ID NO: 987836 - DNA, 15 bp, Homo sapiens
cttcgctgctctagc

SEQ ID NO: 987837 - DNA, 20 bp, Homo sapiens
cttcgcttcttgcctctgtg

SEQ ID NO: 987838 - DNA, 21 bp, Homo sapiens
cttcgcttcttgcctctgtgc

SEQ ID NO: 987839 - DNA, 15 bp, Homo sapiens
cttcggacaaaatat

SEQ ID NO: 987840 - DNA, 21 bp, Homo sapiens
cttcggaccgcttgtggggac

SEQ ID NO: 987841 - DNA, 15 bp, Homo sapiens
cttcggagggccgca

SEQ ID NO: 987842 - DNA, 19 bp, Homo sapiens
cttcggagggccgcagggc

SEQ ID NO: 987843 - DNA, 21 bp, Homo sapiens
cttcggagggccgcagggccc

SEQ ID NO: 987844 - DNA, 20 bp, Homo sapiens
cttcgggaggtcgaggcagg

SEQ ID NO: 987845 - DNA, 16 bp, Homo sapiens
cttcgggctgtgcccg

SEQ ID NO: 987846 - DNA, 17 bp, Homo sapiens
cttcggggccggtgagg

SEQ ID NO: 987847 - DNA, 20 bp, Homo sapiens
cttcgtacatagtctgttcc

SEQ ID NO: 987848 - DNA, 17 bp, Homo sapiens
gtggccttccccagcat

SEQ ID NO: 987849 - DNA, 21 bp, Homo sapiens
gtggccttccccagcatgcac

SEQ ID NO: 987850 - DNA, 22 bp, Homo sapiens
gtggccttccccttttgcctgg

SEQ ID NO: 987851 - DNA, 20 bp, Homo sapiens
gtggcgactctatagactct

SEQ ID NO: 987852 - DNA, 17 bp, Homo sapiens
gtggcgccgtctccagg

SEQ ID NO: 987853 - DNA, 21 bp, Homo sapiens
gtggcgctttctcctgtgccc

SEQ ID NO: 987854 - DNA, 22 bp, Homo sapiens
gtggcgctttctcctgtgccca

SEQ ID NO: 987855 - DNA, 14 bp, Homo sapiens
gtggcggggtgggg

SEQ ID NO: 987856 - DNA, 13 bp, Homo sapiens
gtggcggtgcctg

SEQ ID NO: 987857 - DNA, 14 bp, Homo sapiens
gtggcgtctccctc

SEQ ID NO: 987858 - DNA, 16 bp, Homo sapiens
gtggcgtctccctcgc

SEQ ID NO: 987859 - DNA, 16 bp, Homo sapiens
gtggcgtgagctgccc

SEQ ID NO: 987860 - DNA, 13 bp, Homo sapiens
gtggcgtggcctc

SEQ ID NO: 987861 - DNA, 16 bp, Homo sapiens
gtggcgttatggcagc

SEQ ID NO: 987862 - DNA, 14 bp, Homo sapiens
gtggctactgacat

SEQ ID NO: 987863 - DNA, 20 bp, Homo sapiens
gtggctcacgtgtgtgactc

SEQ ID NO: 987864 - DNA, 14 bp, Homo sapiens
gtggctcactactg

SEQ ID NO: 987865 - DNA, 15 bp, Homo sapiens
gtggctcactactga

SEQ ID NO: 987866 - DNA, 15 bp, Homo sapiens
gtggctcactggctg

SEQ ID NO: 987867 - DNA, 18 bp, Homo sapiens
gtggctcactggctggga

SEQ ID NO: 987868 - DNA, 18 bp, Homo sapiens
gtggctcaggggagcaag

SEQ ID NO: 987869 - DNA, 22 bp, Homo sapiens
gtggctcatggcgtaatgggcc

SEQ ID NO: 987870 - DNA, 23 bp, Homo sapiens
gtggctccccacctggacacaca

SEQ ID NO: 987871 - DNA, 14 bp, Homo sapiens
gtggctccccctct

SEQ ID NO: 987872 - DNA, 15 bp, Homo sapiens
gtggctccccctctg

SEQ ID NO: 987873 - DNA, 12 bp, Homo sapiens
gtggctcccctc

SEQ ID NO: 987874 - DNA, 14 bp, Homo sapiens
gtggctcccctcta

SEQ ID NO: 987875 - DNA, 22 bp, Homo sapiens
gtggctcccctctatttagcat

SEQ ID NO: 987876 - DNA, 20 bp, Homo sapiens
gtggctcctcccggtgccca

SEQ ID NO: 987877 - DNA, 20 bp, Homo sapiens
gtggctcctcctaggaaacc

SEQ ID NO: 987878 - DNA, 15 bp, Homo sapiens
gtggctctgggagag

SEQ ID NO: 987879 - DNA, 20 bp, Homo sapiens
gtggctctgggatcctgggg

SEQ ID NO: 987880 - DNA, 13 bp, Homo sapiens
gtggctctggggt

SEQ ID NO: 987881 - DNA, 21 bp, Homo sapiens
cttctaggggtagctggtggt

SEQ ID NO: 987882 - DNA, 20 bp, Homo sapiens
cttctagtgcttttcagtga

SEQ ID NO: 987883 - DNA, 23 bp, Homo sapiens
cttctagtttcacgtaaatattc

SEQ ID NO: 987884 - DNA, 14 bp, Homo sapiens
cttctagtttccca

SEQ ID NO: 987885 - DNA, 20 bp, Homo sapiens
cttctataattttgccttta

SEQ ID NO: 987886 - DNA, 16 bp, Homo sapiens
cttctatcattccaat

SEQ ID NO: 987887 - DNA, 15 bp, Homo sapiens
cttctatcctttctt

SEQ ID NO: 987888 - DNA, 13 bp, Homo sapiens
cttctatgtatta

SEQ ID NO: 987889 - DNA, 13 bp, Homo sapiens
cttctatgttggt

SEQ ID NO: 987890 - DNA, 16 bp, Homo sapiens
cttctatgttggtttc

SEQ ID NO: 987891 - DNA, 22 bp, Homo sapiens
cttctatgttggtttcagtggc

SEQ ID NO: 987892 - DNA, 23 bp, Homo sapiens
cttctattaatcaagagaaactt

SEQ ID NO: 987893 - DNA, 15 bp, Homo sapiens
cttctattttcccta

SEQ ID NO: 987894 - DNA, 14 bp, Homo sapiens
cttctattttgtaa

SEQ ID NO: 987895 - DNA, 15 bp, Homo sapiens
cttctattttgtaaa

SEQ ID NO: 987896 - DNA, 17 bp, Homo sapiens
cttctattttgtaaact

SEQ ID NO: 987897 - DNA, 20 bp, Homo sapiens
cttctatttttatcatgaat

SEQ ID NO: 987898 - DNA, 21 bp, Homo sapiens
cttctcaactccagagcccct

SEQ ID NO: 987899 - DNA, 15 bp, Homo sapiens
cttctcactgccatg

SEQ ID NO: 987900 - DNA, 19 bp, Homo sapiens
cttctcacttcaattaatg

SEQ ID NO: 987901 - DNA, 14 bp, Homo sapiens
cttctcagaagcac

SEQ ID NO: 987902 - DNA, 17 bp, Homo sapiens
cttctcagaagcacaga

SEQ ID NO: 987903 - DNA, 18 bp, Homo sapiens
cttctcagaatctaccca

SEQ ID NO: 987904 - DNA, 16 bp, Homo sapiens
cttctcagagtggtgg

SEQ ID NO: 987905 - DNA, 16 bp, Homo sapiens
cttctcagctcttcca

SEQ ID NO: 987906 - DNA, 13 bp, Homo sapiens
cttctcatagcat

SEQ ID NO: 987907 - DNA, 18 bp, Homo sapiens
cttctcatcgaagggatt

SEQ ID NO: 987908 - DNA, 17 bp, Homo sapiens
cttctcatcttttatct

SEQ ID NO: 987909 - DNA, 21 bp, Homo sapiens
cttctcattccaacagtgagt

SEQ ID NO: 987910 - DNA, 15 bp, Homo sapiens
cttctccaacactga

SEQ ID NO: 987911 - DNA, 22 bp, Homo sapiens
cttctccaagaatggaagcctg

SEQ ID NO: 987912 - DNA, 16 bp, Homo sapiens
cttctccaatgctctg

SEQ ID NO: 987913 - DNA, 19 bp, Homo sapiens
cttctccaattctgcccaa

SEQ ID NO: 987914 - DNA, 17 bp, Homo sapiens
cttctccaccgcacaga

SEQ ID NO: 987915 - DNA, 14 bp, Homo sapiens
cttctccatctggc

SEQ ID NO: 987916 - DNA, 17 bp, Homo sapiens
cttctccatctggcagg

SEQ ID NO: 987917 - DNA, 14 bp, Homo sapiens
cttctccatgctgc

SEQ ID NO: 987918 - DNA, 13 bp, Homo sapiens
cttctcccacact

SEQ ID NO: 987919 - DNA, 17 bp, Homo sapiens
cttctcccacatgaggc

SEQ ID NO: 987920 - DNA, 20 bp, Homo sapiens
cttctcccaccccttggccc

SEQ ID NO: 987921 - DNA, 16 bp, Homo sapiens
cttctcccagaatccc

SEQ ID NO: 987922 - DNA, 20 bp, Homo sapiens
cttctcccagaatcccagcc

SEQ ID NO: 987923 - DNA, 23 bp, Homo sapiens
cttctcccagaatcccagccggc

SEQ ID NO: 987924 - DNA, 13 bp, Homo sapiens
cttctcccagcac

SEQ ID NO: 987925 - DNA, 18 bp, Homo sapiens
cttctcccatttcctgat

SEQ ID NO: 987926 - DNA, 21 bp, Homo sapiens
cttctcccatttcctgatcta

SEQ ID NO: 987927 - DNA, 22 bp, Homo sapiens
cttctcccatttcctgatctag

SEQ ID NO: 987928 - DNA, 21 bp, Homo sapiens
cttctcccccacggtatccta

SEQ ID NO: 987929 - DNA, 21 bp, Homo sapiens
cttctccccccatcccagggt

SEQ ID NO: 987930 - DNA, 19 bp, Homo sapiens
cttctcccccttgtcttcc

SEQ ID NO: 987931 - DNA, 19 bp, Homo sapiens
cttctccccgcagcccgcc

SEQ ID NO: 987932 - DNA, 15 bp, Homo sapiens
cttctcccctgccct

SEQ ID NO: 987933 - DNA, 14 bp, Homo sapiens
cttctccccttcct

SEQ ID NO: 987934 - DNA, 16 bp, Homo sapiens
cttctccccttcctgg

SEQ ID NO: 987935 - DNA, 19 bp, Homo sapiens
cttctccccttcctggaca

SEQ ID NO: 987936 - DNA, 12 bp, Homo sapiens
cttctccctgga

SEQ ID NO: 987937 - DNA, 15 bp, Homo sapiens
cttctccgccagcct

SEQ ID NO: 987938 - DNA, 18 bp, Homo sapiens
cttctccgccagcctcct

SEQ ID NO: 987939 - DNA, 14 bp, Homo sapiens
cttctcctatgtgt

SEQ ID NO: 987940 - DNA, 19 bp, Homo sapiens
cttctcctcctctgtcttt

SEQ ID NO: 987941 - DNA, 14 bp, Homo sapiens
cttctcctctctgg

SEQ ID NO: 987942 - DNA, 16 bp, Homo sapiens
cttctcctctctgggc

SEQ ID NO: 987943 - DNA, 18 bp, Homo sapiens
cttctcctctctgggcct

SEQ ID NO: 987944 - DNA, 14 bp, Homo sapiens
cttctcctcttgta

SEQ ID NO: 987945 - DNA, 17 bp, Homo sapiens
cttctcctcttgtaaat

SEQ ID NO: 987946 - DNA, 19 bp, Homo sapiens
cttctccttagacactttg

SEQ ID NO: 987947 - DNA, 20 bp, Homo sapiens
cttctccttgccttgcttct

SEQ ID NO: 987948 - DNA, 15 bp, Homo sapiens
cttctcggccagccc

SEQ ID NO: 987949 - DNA, 19 bp, Homo sapiens
cttctcggggtccagtgca

SEQ ID NO: 987950 - DNA, 20 bp, Homo sapiens
cttctcggggtccagtgcat

SEQ ID NO: 987951 - DNA, 22 bp, Homo sapiens
cttctcgtgtttgcttaaaata

SEQ ID NO: 987952 - DNA, 11 bp, Homo sapiens
cttctctacag

SEQ ID NO: 987953 - DNA, 15 bp, Homo sapiens
cttctctacagactt

SEQ ID NO: 987954 - DNA, 12 bp, Homo sapiens
cttctctataaa

SEQ ID NO: 987955 - DNA, 14 bp, Homo sapiens
cttctctcacttct

SEQ ID NO: 987956 - DNA, 16 bp, Homo sapiens
cttctctcacttctaa

SEQ ID NO: 987957 - DNA, 14 bp, Homo sapiens
cttctctcagatgg

SEQ ID NO: 987958 - DNA, 22 bp, Homo sapiens
cttctctcagccagctgtttaa

SEQ ID NO: 987959 - DNA, 15 bp, Homo sapiens
cttctctccacttct

SEQ ID NO: 987960 - DNA, 16 bp, Homo sapiens
cttctctccagctgac

SEQ ID NO: 987961 - DNA, 17 bp, Homo sapiens
cttctctccagctgact

SEQ ID NO: 987962 - DNA, 15 bp, Homo sapiens
cttctctcctcagac

SEQ ID NO: 987963 - DNA, 13 bp, Homo sapiens
cttctctccttgc

SEQ ID NO: 987964 - DNA, 15 bp, Homo sapiens
cttctctccttgccc

SEQ ID NO: 987965 - DNA, 19 bp, Homo sapiens
cttctctcctttctccctg

SEQ ID NO: 987966 - DNA, 15 bp, Homo sapiens
cttctctctccctgt

SEQ ID NO: 987967 - DNA, 16 bp, Homo sapiens
cttctctctgtgggat

SEQ ID NO: 987968 - DNA, 17 bp, Homo sapiens
cttctctctgttccctt

SEQ ID NO: 987969 - DNA, 13 bp, Homo sapiens
cttctctgaatca

SEQ ID NO: 987970 - DNA, 12 bp, Homo sapiens
cttctctgactt

SEQ ID NO: 987971 - DNA, 15 bp, Homo sapiens
cttctctgacttctg

SEQ ID NO: 987972 - DNA, 20 bp, Homo sapiens
cttctctgcctccctaagtt

SEQ ID NO: 987973 - DNA, 11 bp, Homo sapiens
cttctctgctc

SEQ ID NO: 987974 - DNA, 22 bp, Homo sapiens
cttctctgctccaccacatcct

SEQ ID NO: 987975 - DNA, 12 bp, Homo sapiens
cttctctgctgc

SEQ ID NO: 987976 - DNA, 16 bp, Homo sapiens
cttctctgctgcctct

SEQ ID NO: 987977 - DNA, 19 bp, Homo sapiens
cttctctggaaagggggga

SEQ ID NO: 987978 - DNA, 21 bp, Homo sapiens
cttctctgggtctgattttct

SEQ ID NO: 987979 - DNA, 11 bp, Homo sapiens
cttctctgtaa

SEQ ID NO: 987980 - DNA, 13 bp, Homo sapiens
cttctctgtaagt

SEQ ID NO: 987981 - DNA, 22 bp, Homo sapiens
cttctctgtaagtaattgccac

SEQ ID NO: 987982 - DNA, 12 bp, Homo sapiens
cttctctgtctc

SEQ ID NO: 987983 - DNA, 13 bp, Homo sapiens
cttctctgtctct

SEQ ID NO: 987984 - DNA, 14 bp, Homo sapiens
cttctctgtctctg

SEQ ID NO: 987985 - DNA, 22 bp, Homo sapiens
cttctctgtgaacgatttagaa

SEQ ID NO: 987986 - DNA, 21 bp, Homo sapiens
cttctctgttcccttgcaggg

SEQ ID NO: 987987 - DNA, 20 bp, Homo sapiens
cttctcttgaaaagttcagg

SEQ ID NO: 987988 - DNA, 17 bp, Homo sapiens
cttctcttgctttctat

SEQ ID NO: 987989 - DNA, 20 bp, Homo sapiens
cttctcttgggaactccact

SEQ ID NO: 987990 - DNA, 20 bp, Homo sapiens
cttctgaaaacccaaggcca

SEQ ID NO: 987991 - DNA, 12 bp, Homo sapiens
cttctgaagact

SEQ ID NO: 987992 - DNA, 20 bp, Homo sapiens
cttctgaagactgagaactt

SEQ ID NO: 987993 - DNA, 16 bp, Homo sapiens
cttctgaagtgtgtcc

SEQ ID NO: 987994 - DNA, 14 bp, Homo sapiens
cttctgaatatttt

SEQ ID NO: 987995 - DNA, 11 bp, Homo sapiens
cttctgaatca

SEQ ID NO: 987996 - DNA, 15 bp, Homo sapiens
cttctgaatcactgt

SEQ ID NO: 987997 - DNA, 15 bp, Homo sapiens
cttctgaccacactt

SEQ ID NO: 987998 - DNA, 18 bp, Homo sapiens
cttctgaccacagcatca

SEQ ID NO: 987999 - DNA, 14 bp, Homo sapiens
cttctgaccccact

SEQ ID NO: 988000 - DNA, 21 bp, Homo sapiens
cttctgactgctgattctccc

SEQ ID NO: 988001 - DNA, 15 bp, Homo sapiens
cttctgagcactgtt

SEQ ID NO: 988002 - DNA, 23 bp, Homo sapiens
cttctgagcactgtttatacact

SEQ ID NO: 988003 - DNA, 18 bp, Homo sapiens
cttctgagctatttcatc

SEQ ID NO: 988004 - DNA, 20 bp, Homo sapiens
cttctgagctatttcatcta

SEQ ID NO: 988005 - DNA, 21 bp, Homo sapiens
cttctgagctccacctctggt

SEQ ID NO: 988006 - DNA, 20 bp, Homo sapiens
cttctgagtaattaataaag

SEQ ID NO: 988007 - DNA, 17 bp, Homo sapiens
gtggctctgggtgaggt

SEQ ID NO: 988008 - DNA, 14 bp, Homo sapiens
gtggctgccagccc

SEQ ID NO: 988009 - DNA, 18 bp, Homo sapiens
gtggctgccagcccactg

SEQ ID NO: 988010 - DNA, 19 bp, Homo sapiens
gtggctgccagcccactgc

SEQ ID NO: 988011 - DNA, 13 bp, Homo sapiens
gtggctgccccgg

SEQ ID NO: 988012 - DNA, 18 bp, Homo sapiens
gtggctgcgcccccagct

SEQ ID NO: 988013 - DNA, 17 bp, Homo sapiens
gtggctgctagcacttg

SEQ ID NO: 988014 - DNA, 20 bp, Homo sapiens
gtggctggaagatcctgcgg

SEQ ID NO: 988015 - DNA, 18 bp, Homo sapiens
gtggctggtgagaccccg

SEQ ID NO: 988016 - DNA, 15 bp, Homo sapiens
gtggctggtgtcccc

SEQ ID NO: 988017 - DNA, 19 bp, Homo sapiens
gtggctggtgtccccttcc

SEQ ID NO: 988018 - DNA, 12 bp, Homo sapiens
gtggctgtggca

SEQ ID NO: 988019 - DNA, 16 bp, Homo sapiens
gtggctgtggcacaga

SEQ ID NO: 988020 - DNA, 12 bp, Homo sapiens
gtggctgtgtct

SEQ ID NO: 988021 - DNA, 11 bp, Homo sapiens
gtggctgttca

SEQ ID NO: 988022 - DNA, 13 bp, Homo sapiens
gtggctgtttctt

SEQ ID NO: 988023 - DNA, 19 bp, Homo sapiens
gtggcttaagtgagcagaa

SEQ ID NO: 988024 - DNA, 20 bp, Homo sapiens
gtggcttaagtgagcagaac

SEQ ID NO: 988025 - DNA, 22 bp, Homo sapiens
gtggcttaagtgagcagaacag

SEQ ID NO: 988026 - DNA, 20 bp, Homo sapiens
gtggcttcccgctcagccct

SEQ ID NO: 988027 - DNA, 22 bp, Homo sapiens
gtggcttctctgtctctgtgga

SEQ ID NO: 988028 - DNA, 19 bp, Homo sapiens
gtggcttggcatctgtgtg

SEQ ID NO: 988029 - DNA, 21 bp, Homo sapiens
gtggcttgggacatggcacag

SEQ ID NO: 988030 - DNA, 15 bp, Homo sapiens
gtggctttaattgta

SEQ ID NO: 988031 - DNA, 18 bp, Homo sapiens
gtggctttaattgtataa

SEQ ID NO: 988032 - DNA, 19 bp, Homo sapiens
gtggctttaattgtataag

SEQ ID NO: 988033 - DNA, 19 bp, Homo sapiens
gtggctttaggagcagtgg

SEQ ID NO: 988034 - DNA, 18 bp, Homo sapiens
gtggctttcaaggctggg

SEQ ID NO: 988035 - DNA, 22 bp, Homo sapiens
gtggctttccaggcaccctcag

SEQ ID NO: 988036 - DNA, 19 bp, Homo sapiens
gtggctttggcagtgtttt

SEQ ID NO: 988037 - DNA, 22 bp, Homo sapiens
gtgggaagaccaaaggaaggaa

SEQ ID NO: 988038 - DNA, 15 bp, Homo sapiens
gtgggaaggacttgg

SEQ ID NO: 988039 - DNA, 15 bp, Homo sapiens
gtgggacagagtctg

SEQ ID NO: 988040 - DNA, 13 bp, Homo sapiens
gtgggacagccca

SEQ ID NO: 988041 - DNA, 14 bp, Homo sapiens
gtgggacagggagg

SEQ ID NO: 988042 - DNA, 22 bp, Homo sapiens
gtgggacccatagatcttctga

SEQ ID NO: 988043 - DNA, 16 bp, Homo sapiens
gtgggaccgcctggcc

SEQ ID NO: 988044 - DNA, 17 bp, Homo sapiens
gtgggaccgcctggccc

SEQ ID NO: 988045 - DNA, 19 bp, Homo sapiens
gtgggacggtgcccaagcc

SEQ ID NO: 988046 - DNA, 14 bp, Homo sapiens
gtgggagaggctgg

SEQ ID NO: 988047 - DNA, 18 bp, Homo sapiens
gtgggagaggctgggagg

SEQ ID NO: 988048 - DNA, 14 bp, Homo sapiens
gtgggagcagcttc

SEQ ID NO: 988049 - DNA, 18 bp, Homo sapiens
gtgggagcagcttcttgg

SEQ ID NO: 988050 - DNA, 14 bp, Homo sapiens
gtgggagctgagct

SEQ ID NO: 988051 - DNA, 17 bp, Homo sapiens
gtgggagctgagctgga

SEQ ID NO: 988052 - DNA, 15 bp, Homo sapiens
gtgggaggcgtgccc

SEQ ID NO: 988053 - DNA, 21 bp, Homo sapiens
gtgggagggcgtcaggcagag

SEQ ID NO: 988054 - DNA, 15 bp, Homo sapiens
gtgggaggggcaggc

SEQ ID NO: 988055 - DNA, 15 bp, Homo sapiens
gtgggagggtaccag

SEQ ID NO: 988056 - DNA, 16 bp, Homo sapiens
gtgggaggtcttgcta

SEQ ID NO: 988057 - DNA, 19 bp, Homo sapiens
gtgggagtaacagggcaga

SEQ ID NO: 988058 - DNA, 16 bp, Homo sapiens
gtgggagtgtgtctgc

SEQ ID NO: 988059 - DNA, 22 bp, Homo sapiens
gtgggatcattgcatttccaga

SEQ ID NO: 988060 - DNA, 18 bp, Homo sapiens
gtgggatccacttcttgg

SEQ ID NO: 988061 - DNA, 17 bp, Homo sapiens
gtgggattttttccctt

SEQ ID NO: 988062 - DNA, 18 bp, Homo sapiens
gtgggattttttcccttt

SEQ ID NO: 988063 - DNA, 17 bp, Homo sapiens
gtgggcaaacaggcagt

SEQ ID NO: 988064 - DNA, 16 bp, Homo sapiens
gtgggcaaaggcaggg

SEQ ID NO: 988065 - DNA, 18 bp, Homo sapiens
gtgggcaaaggcagggcc

SEQ ID NO: 988066 - DNA, 16 bp, Homo sapiens
gtgggcactggcccag

SEQ ID NO: 988067 - DNA, 15 bp, Homo sapiens
gtgggcactggtggg

SEQ ID NO: 988068 - DNA, 14 bp, Homo sapiens
gtgggcagcaccct

SEQ ID NO: 988069 - DNA, 15 bp, Homo sapiens
gtgggcagcaccctc

SEQ ID NO: 988070 - DNA, 17 bp, Homo sapiens
gtgggcagcaccctccc

SEQ ID NO: 988071 - DNA, 23 bp, Homo sapiens
gtgggcagcctatgggggctctc

SEQ ID NO: 988072 - DNA, 15 bp, Homo sapiens
gtgggcagctgagga

SEQ ID NO: 988073 - DNA, 23 bp, Homo sapiens
gtgggcagcttagggccctggag

SEQ ID NO: 988074 - DNA, 20 bp, Homo sapiens
gtgggcaggatctcaagcca

SEQ ID NO: 988075 - DNA, 19 bp, Homo sapiens
gtgggcagggaggggctgg

SEQ ID NO: 988076 - DNA, 12 bp, Homo sapiens
gtgggcaggtgg

SEQ ID NO: 988077 - DNA, 14 bp, Homo sapiens
gtgggcagtcacca

SEQ ID NO: 988078 - DNA, 21 bp, Homo sapiens
gtgggcagtcaccacccagcc

SEQ ID NO: 988079 - DNA, 22 bp, Homo sapiens
gtgggcagtcaccacccagccc

SEQ ID NO: 988080 - DNA, 19 bp, Homo sapiens
gtgggcagtgccacccgca

SEQ ID NO: 988081 - DNA, 21 bp, Homo sapiens
gtgggccacacccaggaaggg

SEQ ID NO: 988082 - DNA, 15 bp, Homo sapiens
gtgggccagcccctc

SEQ ID NO: 988083 - DNA, 19 bp, Homo sapiens
gtgggccagggctgccctg

SEQ ID NO: 988084 - DNA, 22 bp, Homo sapiens
gtgggcccagaactgcccccac

SEQ ID NO: 988085 - DNA, 20 bp, Homo sapiens
gtgggcccagcacatggcca

SEQ ID NO: 988086 - DNA, 23 bp, Homo sapiens
gtgggcccaggaccagctggggc

SEQ ID NO: 988087 - DNA, 16 bp, Homo sapiens
gtgggccgggaggcag

SEQ ID NO: 988088 - DNA, 23 bp, Homo sapiens
gtgggcctcctctgtccagggcc

SEQ ID NO: 988089 - DNA, 15 bp, Homo sapiens
gtgggcctgctgagg

SEQ ID NO: 988090 - DNA, 20 bp, Homo sapiens
gtgggcctgctgaggccttc

SEQ ID NO: 988091 - DNA, 14 bp, Homo sapiens
gtgggcctggcctg

SEQ ID NO: 988092 - DNA, 17 bp, Homo sapiens
gtgggcctggcctgagc

SEQ ID NO: 988093 - DNA, 20 bp, Homo sapiens
gtgggcctggcctgagctgg

SEQ ID NO: 988094 - DNA, 16 bp, Homo sapiens
gtgggccttttgctca

SEQ ID NO: 988095 - DNA, 14 bp, Homo sapiens
gtgggcgcaaaggt

SEQ ID NO: 988096 - DNA, 22 bp, Homo sapiens
gtgggcgcaaaggtgcctcata

SEQ ID NO: 988097 - DNA, 20 bp, Homo sapiens
gtgggcggatcacaaggtca

SEQ ID NO: 988098 - DNA, 20 bp, Homo sapiens
gtgggcgttgggagcctagc

SEQ ID NO: 988099 - DNA, 24 bp, Homo sapiens
gtgggcgtttggggccctctatgc

SEQ ID NO: 988100 - DNA, 19 bp, Homo sapiens
gtgggctcccctcttcctc

SEQ ID NO: 988101 - DNA, 13 bp, Homo sapiens
gtgggctccctga

SEQ ID NO: 988102 - DNA, 15 bp, Homo sapiens
gtgggctccctgact

SEQ ID NO: 988103 - DNA, 14 bp, Homo sapiens
gtgggctgagccct

SEQ ID NO: 988104 - DNA, 20 bp, Homo sapiens
gtgggctgggccctctcttc

SEQ ID NO: 988105 - DNA, 13 bp, Homo sapiens
gtgggctggggac

SEQ ID NO: 988106 - DNA, 20 bp, Homo sapiens
gtgggctggggactctggca

SEQ ID NO: 988107 - DNA, 22 bp, Homo sapiens
gtgggctggggactctggcaca

SEQ ID NO: 988108 - DNA, 15 bp, Homo sapiens
gtgggcttcagcact

SEQ ID NO: 988109 - DNA, 20 bp, Homo sapiens
gtgggcttcctgctgggact

SEQ ID NO: 988110 - DNA, 21 bp, Homo sapiens
gtgggcttcctgctgggactg

SEQ ID NO: 988111 - DNA, 16 bp, Homo sapiens
gtgggcttctgcgtcc

SEQ ID NO: 988112 - DNA, 18 bp, Homo sapiens
gtgggctttaaaagaaaa

SEQ ID NO: 988113 - DNA, 17 bp, Homo sapiens
gtggggaaggagggact

SEQ ID NO: 988114 - DNA, 18 bp, Homo sapiens
gtggggacacagcagtga

SEQ ID NO: 988115 - DNA, 19 bp, Homo sapiens
gtggggacacagcagtgag

SEQ ID NO: 988116 - DNA, 15 bp, Homo sapiens
gtggggacagggagg

SEQ ID NO: 988117 - DNA, 16 bp, Homo sapiens
gtggggacccaggctc

SEQ ID NO: 988118 - DNA, 18 bp, Homo sapiens
gtggggaccttggcagtg

SEQ ID NO: 988119 - DNA, 22 bp, Homo sapiens
gtggggagcacttgcgtcctgc

SEQ ID NO: 988120 - DNA, 21 bp, Homo sapiens
gtggggagcagttttcccctg

SEQ ID NO: 988121 - DNA, 16 bp, Homo sapiens
gtggggaggaaataga

SEQ ID NO: 988122 - DNA, 14 bp, Homo sapiens
gtggggaggaggaa

SEQ ID NO: 988123 - DNA, 17 bp, Homo sapiens
gtggggaggccctgcct

SEQ ID NO: 988124 - DNA, 13 bp, Homo sapiens
gtggggaggggcg

SEQ ID NO: 988125 - DNA, 18 bp, Homo sapiens
gtggggatctcaggggct

SEQ ID NO: 988126 - DNA, 19 bp, Homo sapiens
gtggggatctcaggggctg

SEQ ID NO: 988127 - DNA, 17 bp, Homo sapiens
gtggggatttctcccag

SEQ ID NO: 988128 - DNA, 21 bp, Homo sapiens
gtggggcaggagtgccaggac

SEQ ID NO: 988129 - DNA, 23 bp, Homo sapiens
gtggggcaggagtgccaggacca

SEQ ID NO: 988130 - DNA, 22 bp, Homo sapiens
gtggggccatgcctcctcagga

SEQ ID NO: 988131 - DNA, 14 bp, Homo sapiens
cttctgagtattct

SEQ ID NO: 988132 - DNA, 22 bp, Homo sapiens
cttctgcaaaaatggatattat

SEQ ID NO: 988133 - DNA, 12 bp, Homo sapiens
cttctgcaccct

SEQ ID NO: 988134 - DNA, 14 bp, Homo sapiens
cttctgcaccctcc

SEQ ID NO: 988135 - DNA, 15 bp, Homo sapiens
cttctgcaccctcca

SEQ ID NO: 988136 - DNA, 16 bp, Homo sapiens
cttctgcaccctccac

SEQ ID NO: 988137 - DNA, 16 bp, Homo sapiens
cttctgcagcctcggc

SEQ ID NO: 988138 - DNA, 12 bp, Homo sapiens
cttctgcctgca

SEQ ID NO: 988139 - DNA, 13 bp, Homo sapiens
cttctgcctggag

SEQ ID NO: 988140 - DNA, 18 bp, Homo sapiens
cttctgccttagtctcag

SEQ ID NO: 988141 - DNA, 19 bp, Homo sapiens
cttctgccttagtctcagt

SEQ ID NO: 988142 - DNA, 20 bp, Homo sapiens
cttctgccttagtctcagtt

SEQ ID NO: 988143 - DNA, 21 bp, Homo sapiens
cttctgccttagtctcagttt

SEQ ID NO: 988144 - DNA, 16 bp, Homo sapiens
cttctgccttctcatg

SEQ ID NO: 988145 - DNA, 14 bp, Homo sapiens
cttctgccttggcc

SEQ ID NO: 988146 - DNA, 13 bp, Homo sapiens
cttctgcgggctc

SEQ ID NO: 988147 - DNA, 18 bp, Homo sapiens
cttctgcgggctccctcc

SEQ ID NO: 988148 - DNA, 21 bp, Homo sapiens
cttctgcgggctccctcctct

SEQ ID NO: 988149 - DNA, 23 bp, Homo sapiens
cttctgcgggctccctcctctgg

SEQ ID NO: 988150 - DNA, 17 bp, Homo sapiens
cttctgcgtccaccagg

SEQ ID NO: 988151 - DNA, 13 bp, Homo sapiens
cttctgctccacc

SEQ ID NO: 988152 - DNA, 15 bp, Homo sapiens
cttctgctccaccct

SEQ ID NO: 988153 - DNA, 19 bp, Homo sapiens
cttctgctccacccttggc

SEQ ID NO: 988154 - DNA, 12 bp, Homo sapiens
cttctgctccag

SEQ ID NO: 988155 - DNA, 15 bp, Homo sapiens
cttctgctccagccc

SEQ ID NO: 988156 - DNA, 22 bp, Homo sapiens
cttctgctggaggaggggaagc

SEQ ID NO: 988157 - DNA, 17 bp, Homo sapiens
cttctgctggataaaat

SEQ ID NO: 988158 - DNA, 21 bp, Homo sapiens
cttctgctgttcttcacttct

SEQ ID NO: 988159 - DNA, 15 bp, Homo sapiens
cttctgcttaggaga

SEQ ID NO: 988160 - DNA, 16 bp, Homo sapiens
cttctgcttaggagag

SEQ ID NO: 988161 - DNA, 21 bp, Homo sapiens
cttctgcttttctgccctggc

SEQ ID NO: 988162 - DNA, 23 bp, Homo sapiens
cttctgcttttctgccctggctg

SEQ ID NO: 988163 - DNA, 15 bp, Homo sapiens
cttctggaaggctgg

SEQ ID NO: 988164 - DNA, 16 bp, Homo sapiens
cttctggaaggctggc

SEQ ID NO: 988165 - DNA, 22 bp, Homo sapiens
cttctggaaggctggctgagtg

SEQ ID NO: 988166 - DNA, 15 bp, Homo sapiens
cttctggacaggctc

SEQ ID NO: 988167 - DNA, 11 bp, Homo sapiens
cttctggagcc

SEQ ID NO: 988168 - DNA, 13 bp, Homo sapiens
cttctggagccct

SEQ ID NO: 988169 - DNA, 14 bp, Homo sapiens
cttctggagccctt

SEQ ID NO: 988170 - DNA, 18 bp, Homo sapiens
cttctggagtctccagtg

SEQ ID NO: 988171 - DNA, 20 bp, Homo sapiens
cttctggagtctccagtggt

SEQ ID NO: 988172 - DNA, 18 bp, Homo sapiens
cttctggagtttctctaa

SEQ ID NO: 988173 - DNA, 15 bp, Homo sapiens
cttctggatatagct

SEQ ID NO: 988174 - DNA, 20 bp, Homo sapiens
cttctggccacatcagcccc

SEQ ID NO: 988175 - DNA, 13 bp, Homo sapiens
cttctggcctcca

SEQ ID NO: 988176 - DNA, 14 bp, Homo sapiens
cttctggcctccag

SEQ ID NO: 988177 - DNA, 16 bp, Homo sapiens
cttctggcctcccaca

SEQ ID NO: 988178 - DNA, 19 bp, Homo sapiens
cttctggcctctgctgaat

SEQ ID NO: 988179 - DNA, 20 bp, Homo sapiens
cttctggcttccttctctca

SEQ ID NO: 988180 - DNA, 23 bp, Homo sapiens
cttctgggaaattgaagtgtctt

SEQ ID NO: 988181 - DNA, 17 bp, Homo sapiens
cttctgggacctgtgtt

SEQ ID NO: 988182 - DNA, 15 bp, Homo sapiens
cttctgggagggcag

SEQ ID NO: 988183 - DNA, 15 bp, Homo sapiens
cttctgggcaagggc

SEQ ID NO: 988184 - DNA, 18 bp, Homo sapiens
cttctgggcaagggctcc

SEQ ID NO: 988185 - DNA, 19 bp, Homo sapiens
cttctgggcaagggctcct

SEQ ID NO: 988186 - DNA, 16 bp, Homo sapiens
cttctgggcacagtgg

SEQ ID NO: 988187 - DNA, 15 bp, Homo sapiens
cttctgggcagagcc

SEQ ID NO: 988188 - DNA, 17 bp, Homo sapiens
cttctgggcagagcctg

SEQ ID NO: 988189 - DNA, 19 bp, Homo sapiens
cttctgggcagagcctgtc

SEQ ID NO: 988190 - DNA, 16 bp, Homo sapiens
cttctgggcctgacca

SEQ ID NO: 988191 - DNA, 21 bp, Homo sapiens
cttctgggcttcatctggcaa

SEQ ID NO: 988192 - DNA, 21 bp, Homo sapiens
cttctgggcttcattctggaa

SEQ ID NO: 988193 - DNA, 14 bp, Homo sapiens
cttctggggcaggc

SEQ ID NO: 988194 - DNA, 22 bp, Homo sapiens
cttctggggcaggctgggccat

SEQ ID NO: 988195 - DNA, 22 bp, Homo sapiens
cttctggggtcaggtgccactg

SEQ ID NO: 988196 - DNA, 17 bp, Homo sapiens
cttctgggttccttcct

SEQ ID NO: 988197 - DNA, 15 bp, Homo sapiens
cttctggtactctcc

SEQ ID NO: 988198 - DNA, 17 bp, Homo sapiens
cttctggtactctccta

SEQ ID NO: 988199 - DNA, 17 bp, Homo sapiens
cttctggttgcttcaga

SEQ ID NO: 988200 - DNA, 16 bp, Homo sapiens
cttctggttgtatttc

SEQ ID NO: 988201 - DNA, 18 bp, Homo sapiens
cttctggttgtatttcta

SEQ ID NO: 988202 - DNA, 16 bp, Homo sapiens
cttctggtttcttcca

SEQ ID NO: 988203 - DNA, 21 bp, Homo sapiens
cttctggttttctagcccctc

SEQ ID NO: 988204 - DNA, 14 bp, Homo sapiens
cttctgtaatcaat

SEQ ID NO: 988205 - DNA, 18 bp, Homo sapiens
cttctgtagtactcctta

SEQ ID NO: 988206 - DNA, 21 bp, Homo sapiens
cttctgtagtactccttaaga

SEQ ID NO: 988207 - DNA, 18 bp, Homo sapiens
cttctgtagtttttaatt

SEQ ID NO: 988208 - DNA, 14 bp, Homo sapiens
cttctgtatgcatc

SEQ ID NO: 988209 - DNA, 15 bp, Homo sapiens
cttctgtatttctag

SEQ ID NO: 988210 - DNA, 15 bp, Homo sapiens
cttctgtattttaat

SEQ ID NO: 988211 - DNA, 22 bp, Homo sapiens
cttctgtatttttttttctaag

SEQ ID NO: 988212 - DNA, 19 bp, Homo sapiens
cttctgtccaccagaccca

SEQ ID NO: 988213 - DNA, 15 bp, Homo sapiens
cttctgtccaggaca

SEQ ID NO: 988214 - DNA, 18 bp, Homo sapiens
cttctgtccaggacatga

SEQ ID NO: 988215 - DNA, 13 bp, Homo sapiens
cttgaaagtagga

SEQ ID NO: 988216 - DNA, 19 bp, Homo sapiens
cttgaaatatataatattc

SEQ ID NO: 988217 - DNA, 22 bp, Homo sapiens
cttgaaatatataatattcagc

SEQ ID NO: 988218 - DNA, 20 bp, Homo sapiens
cttgaaatctaatatttcta

SEQ ID NO: 988219 - DNA, 22 bp, Homo sapiens
cttgaaatgagtaaaaactaga

SEQ ID NO: 988220 - DNA, 20 bp, Homo sapiens
cttgaaattaagaaggcaaa

SEQ ID NO: 988221 - DNA, 16 bp, Homo sapiens
cttgaaattactgtgt

SEQ ID NO: 988222 - DNA, 19 bp, Homo sapiens
cttgaaattactgtgtaaa

SEQ ID NO: 988223 - DNA, 13 bp, Homo sapiens
cttgaaattttaa

SEQ ID NO: 988224 - DNA, 16 bp, Homo sapiens
cttgaaattttaacct

SEQ ID NO: 988225 - DNA, 18 bp, Homo sapiens
cttgaacatgttttgtat

SEQ ID NO: 988226 - DNA, 16 bp, Homo sapiens
cttgaacattaatcca

SEQ ID NO: 988227 - DNA, 14 bp, Homo sapiens
cttgaaccacttcc

SEQ ID NO: 988228 - DNA, 15 bp, Homo sapiens
cttgaaccacttccc

SEQ ID NO: 988229 - DNA, 14 bp, Homo sapiens
cttgaaccccctcc

SEQ ID NO: 988230 - DNA, 14 bp, Homo sapiens
cttgaacctgggaa

SEQ ID NO: 988231 - DNA, 17 bp, Homo sapiens
cttgaactcctggcctc

SEQ ID NO: 988232 - DNA, 18 bp, Homo sapiens
cttgaactcctggcctca

SEQ ID NO: 988233 - DNA, 13 bp, Homo sapiens
cttgaactgggcg

SEQ ID NO: 988234 - DNA, 14 bp, Homo sapiens
cttgaactgggctc

SEQ ID NO: 988235 - DNA, 15 bp, Homo sapiens
cttgaactgggctca

SEQ ID NO: 988236 - DNA, 22 bp, Homo sapiens
cttgaacttagatgttaaatgt

SEQ ID NO: 988237 - DNA, 21 bp, Homo sapiens
cttgaactttgacctctgcag

SEQ ID NO: 988238 - DNA, 21 bp, Homo sapiens
cttgaagaaaatgactttatt

SEQ ID NO: 988239 - DNA, 17 bp, Homo sapiens
cttgaagaaacagagtg

SEQ ID NO: 988240 - DNA, 22 bp, Homo sapiens
cttgaagaaacagagtggcctc

SEQ ID NO: 988241 - DNA, 23 bp, Homo sapiens
cttgaagaaacagagtggcctcc

SEQ ID NO: 988242 - DNA, 17 bp, Homo sapiens
cttgaagaactgcaggc

SEQ ID NO: 988243 - DNA, 15 bp, Homo sapiens
cttgaagacagagca

SEQ ID NO: 988244 - DNA, 20 bp, Homo sapiens
cttgaagatcgttagtatct

SEQ ID NO: 988245 - DNA, 15 bp, Homo sapiens
cttgaagcaaatgtg

SEQ ID NO: 988246 - DNA, 13 bp, Homo sapiens
cttgaagcaataa

SEQ ID NO: 988247 - DNA, 15 bp, Homo sapiens
cttgaagcaataact

SEQ ID NO: 988248 - DNA, 23 bp, Homo sapiens
cttgaagcaataactccaagcag

SEQ ID NO: 988249 - DNA, 16 bp, Homo sapiens
cttgaagcagccttga

SEQ ID NO: 988250 - DNA, 12 bp, Homo sapiens
cttgaagcagta

SEQ ID NO: 988251 - DNA, 12 bp, Homo sapiens
cttgaagcagtc

SEQ ID NO: 988252 - DNA, 20 bp, Homo sapiens
cttgaagcatttcaaagccc

SEQ ID NO: 988253 - DNA, 13 bp, Homo sapiens
cttgaagccaaag

SEQ ID NO: 988254 - DNA, 15 bp, Homo sapiens
cttgaagccaaagaa

SEQ ID NO: 988255 - DNA, 17 bp, Homo sapiens
cttgaagccactgaagc

SEQ ID NO: 988256 - DNA, 21 bp, Homo sapiens
cttgaagctgggctgtctctc

SEQ ID NO: 988257 - DNA, 13 bp, Homo sapiens
cttgaaggactgc

SEQ ID NO: 988258 - DNA, 17 bp, Homo sapiens
cttgaaggactgcagac

SEQ ID NO: 988259 - DNA, 14 bp, Homo sapiens
gtggggcccactgc

SEQ ID NO: 988260 - DNA, 17 bp, Homo sapiens
gtggggcccactgctcg

SEQ ID NO: 988261 - DNA, 14 bp, Homo sapiens
gtggggcctgatgg

SEQ ID NO: 988262 - DNA, 14 bp, Homo sapiens
gtggggcctgggag

SEQ ID NO: 988263 - DNA, 19 bp, Homo sapiens
gtggggcctgtggaatgag

SEQ ID NO: 988264 - DNA, 18 bp, Homo sapiens
gtggggctcgtggccttc

SEQ ID NO: 988265 - DNA, 12 bp, Homo sapiens
gtggggctgagc

SEQ ID NO: 988266 - DNA, 18 bp, Homo sapiens
gtggggctgagctgggga

SEQ ID NO: 988267 - DNA, 12 bp, Homo sapiens
gtggggctgctc

SEQ ID NO: 988268 - DNA, 16 bp, Homo sapiens
gtggggctgctcctcc

SEQ ID NO: 988269 - DNA, 13 bp, Homo sapiens
gtggggctgggca

SEQ ID NO: 988270 - DNA, 17 bp, Homo sapiens
gtgggggagattctggg

SEQ ID NO: 988271 - DNA, 13 bp, Homo sapiens
gtgggggccaggc

SEQ ID NO: 988272 - DNA, 16 bp, Homo sapiens
gtgggggcctcctcag

SEQ ID NO: 988273 - DNA, 14 bp, Homo sapiens
gtgggggcggggaa

SEQ ID NO: 988274 - DNA, 18 bp, Homo sapiens
gtgggggctgtggccctg

SEQ ID NO: 988275 - DNA, 13 bp, Homo sapiens
gtggggggtcctt

SEQ ID NO: 988276 - DNA, 19 bp, Homo sapiens
gtgggggtagagctgatcc

SEQ ID NO: 988277 - DNA, 15 bp, Homo sapiens
gtgggggtggaggct

SEQ ID NO: 988278 - DNA, 12 bp, Homo sapiens
gtgggggtggcc

SEQ ID NO: 988279 - DNA, 14 bp, Homo sapiens
gtgggggtggccat

SEQ ID NO: 988280 - DNA, 20 bp, Homo sapiens
gtgggggttctggcaggacc

SEQ ID NO: 988281 - DNA, 22 bp, Homo sapiens
gtggggtatacagcattgactc

SEQ ID NO: 988282 - DNA, 17 bp, Homo sapiens
gtggggtctccctctcc

SEQ ID NO: 988283 - DNA, 19 bp, Homo sapiens
gtggggtctccctctcctg

SEQ ID NO: 988284 - DNA, 21 bp, Homo sapiens
gtggggtctccctctcctgcc

SEQ ID NO: 988285 - DNA, 20 bp, Homo sapiens
gtggggtgaacagctggtgc

SEQ ID NO: 988286 - DNA, 18 bp, Homo sapiens
gtggggtgcagctgggtg

SEQ ID NO: 988287 - DNA, 21 bp, Homo sapiens
gtggggtgcagctgggtgggg

SEQ ID NO: 988288 - DNA, 15 bp, Homo sapiens
gtggggtgctctggt

SEQ ID NO: 988289 - DNA, 23 bp, Homo sapiens
gtggggtggagtcgcagaccaga

SEQ ID NO: 988290 - DNA, 12 bp, Homo sapiens
gtggggtggggg

SEQ ID NO: 988291 - DNA, 12 bp, Homo sapiens
gtggggtggggt

SEQ ID NO: 988292 - DNA, 16 bp, Homo sapiens
gtggggtggtgtcaga

SEQ ID NO: 988293 - DNA, 19 bp, Homo sapiens
gtggggtgtgctgggagct

SEQ ID NO: 988294 - DNA, 15 bp, Homo sapiens
gtggggttctaggca

SEQ ID NO: 988295 - DNA, 23 bp, Homo sapiens
gtggggttggggcaaagcctcct

SEQ ID NO: 988296 - DNA, 20 bp, Homo sapiens
gtgggtaggagcccttctct

SEQ ID NO: 988297 - DNA, 22 bp, Homo sapiens
gtgggtcacacacacgcactgc

SEQ ID NO: 988298 - DNA, 18 bp, Homo sapiens
gtgggtcagaacatgtta

SEQ ID NO: 988299 - DNA, 22 bp, Homo sapiens
gtgggtccaggaaggcagctgc

SEQ ID NO: 988300 - DNA, 23 bp, Homo sapiens
gtgggtccaggaaggcagctgct

SEQ ID NO: 988301 - DNA, 22 bp, Homo sapiens
gtgggtccatgggcagagccca

SEQ ID NO: 988302 - DNA, 13 bp, Homo sapiens
gtgggtctctgaa

SEQ ID NO: 988303 - DNA, 14 bp, Homo sapiens
gtgggtctctgaag

SEQ ID NO: 988304 - DNA, 14 bp, Homo sapiens
gtgggtctctgggg

SEQ ID NO: 988305 - DNA, 20 bp, Homo sapiens
gtgggtctggactaaccctg

SEQ ID NO: 988306 - DNA, 13 bp, Homo sapiens
gtgggtctgggag

SEQ ID NO: 988307 - DNA, 16 bp, Homo sapiens
gtgggtgacaagagcc

SEQ ID NO: 988308 - DNA, 15 bp, Homo sapiens
gtgggtgagagagac

SEQ ID NO: 988309 - DNA, 13 bp, Homo sapiens
gtgggtgctcaga

SEQ ID NO: 988310 - DNA, 16 bp, Homo sapiens
gtgggtgctgccctgt

SEQ ID NO: 988311 - DNA, 17 bp, Homo sapiens
gtgggtgggcagggagg

SEQ ID NO: 988312 - DNA, 16 bp, Homo sapiens
gtgggtgggcctgact

SEQ ID NO: 988313 - DNA, 17 bp, Homo sapiens
gtgggtgggcctgactg

SEQ ID NO: 988314 - DNA, 14 bp, Homo sapiens
gtgggtggggaggc

SEQ ID NO: 988315 - DNA, 20 bp, Homo sapiens
gtgggtggggaggccctgcc

SEQ ID NO: 988316 - DNA, 23 bp, Homo sapiens
gtgggtgtctccctcgggggctc

SEQ ID NO: 988317 - DNA, 13 bp, Homo sapiens
gtgggtgtggcca

SEQ ID NO: 988318 - DNA, 14 bp, Homo sapiens
gtgggtgtgtgcgc

SEQ ID NO: 988319 - DNA, 17 bp, Homo sapiens
gtgggtgtgtgcgcctg

SEQ ID NO: 988320 - DNA, 21 bp, Homo sapiens
gtgggtgttctttcctgccct

SEQ ID NO: 988321 - DNA, 23 bp, Homo sapiens
gtgggtgtttattacaagtggct

SEQ ID NO: 988322 - DNA, 15 bp, Homo sapiens
gtgggtttctctgtg

SEQ ID NO: 988323 - DNA, 12 bp, Homo sapiens
gtggtaaaaagg

SEQ ID NO: 988324 - DNA, 21 bp, Homo sapiens
gtggtaaatactgtgaaatac

SEQ ID NO: 988325 - DNA, 12 bp, Homo sapiens
gtggtaaccctg

SEQ ID NO: 988326 - DNA, 18 bp, Homo sapiens
gtggtacatacacaccag

SEQ ID NO: 988327 - DNA, 17 bp, Homo sapiens
gtggtaccttcagccct

SEQ ID NO: 988328 - DNA, 19 bp, Homo sapiens
gtggtaccttcagccctgg

SEQ ID NO: 988329 - DNA, 12 bp, Homo sapiens
gtggtagaaaca

SEQ ID NO: 988330 - DNA, 13 bp, Homo sapiens
gtggtagaaacaa

SEQ ID NO: 988331 - DNA, 13 bp, Homo sapiens
gtggtagagaagc

SEQ ID NO: 988332 - DNA, 14 bp, Homo sapiens
gtggtatagaaatg

SEQ ID NO: 988333 - DNA, 13 bp, Homo sapiens
gtggtattctgtc

SEQ ID NO: 988334 - DNA, 20 bp, Homo sapiens
gtggtcaacggagggagtgg

SEQ ID NO: 988335 - DNA, 16 bp, Homo sapiens
gtggtcactggtcagg

SEQ ID NO: 988336 - DNA, 19 bp, Homo sapiens
gtggtcactggtcagggca

SEQ ID NO: 988337 - DNA, 14 bp, Homo sapiens
gtggtcataaaata

SEQ ID NO: 988338 - DNA, 15 bp, Homo sapiens
tcctgagtggtgcca

SEQ ID NO: 988339 - DNA, 19 bp, Homo sapiens
tcctgataaacattaaaca

SEQ ID NO: 988340 - DNA, 18 bp, Homo sapiens
tcctgataataattgatc

SEQ ID NO: 988341 - DNA, 19 bp, Homo sapiens
tcctgataataattgatca

SEQ ID NO: 988342 - DNA, 18 bp, Homo sapiens
tcctgatccctccacccc

SEQ ID NO: 988343 - DNA, 11 bp, Homo sapiens
tcctgatctag

SEQ ID NO: 988344 - DNA, 22 bp, Homo sapiens
tcctgatctagcactcctcaag

SEQ ID NO: 988345 - DNA, 15 bp, Homo sapiens
tcctgatgcccctga

SEQ ID NO: 988346 - DNA, 18 bp, Homo sapiens
tcctgatggagtgtgcag

SEQ ID NO: 988347 - DNA, 14 bp, Homo sapiens
tcctgatggccaag

SEQ ID NO: 988348 - DNA, 21 bp, Homo sapiens
tcctgatggtcagctcccttc

SEQ ID NO: 988349 - DNA, 19 bp, Homo sapiens
tcctgatggtgtcattctg

SEQ ID NO: 988350 - DNA, 18 bp, Homo sapiens
tcctgattaccagtctga

SEQ ID NO: 988351 - DNA, 16 bp, Homo sapiens
tcctgatttctctgaa

SEQ ID NO: 988352 - DNA, 17 bp, Homo sapiens
tcctgatttctctgaac

SEQ ID NO: 988353 - DNA, 19 bp, Homo sapiens
tcctgatttctctgaacag

SEQ ID NO: 988354 - DNA, 15 bp, Homo sapiens
tcctgcaaaggccct

SEQ ID NO: 988355 - DNA, 18 bp, Homo sapiens
tcctgcaactcaaggact

SEQ ID NO: 988356 - DNA, 13 bp, Homo sapiens
tcctgcaatgaaa

SEQ ID NO: 988357 - DNA, 14 bp, Homo sapiens
tcctgcaatgaaag

SEQ ID NO: 988358 - DNA, 15 bp, Homo sapiens
tcctgcacacagaat

SEQ ID NO: 988359 - DNA, 13 bp, Homo sapiens
tcctgcacacagg

SEQ ID NO: 988360 - DNA, 18 bp, Homo sapiens
tcctgcacacagggcagt

SEQ ID NO: 988361 - DNA, 13 bp, Homo sapiens
tcctgcaccccag

SEQ ID NO: 988362 - DNA, 23 bp, Homo sapiens
tcctgcaccccagcattccagct

SEQ ID NO: 988363 - DNA, 11 bp, Homo sapiens
tcctgcagaca

SEQ ID NO: 988364 - DNA, 18 bp, Homo sapiens
tcctgcagacacctggac

SEQ ID NO: 988365 - DNA, 22 bp, Homo sapiens
tcctgcagcaaacactccaccc

SEQ ID NO: 988366 - DNA, 18 bp, Homo sapiens
gcctggacctatgcaggg

SEQ ID NO: 988367 - DNA, 20 bp, Homo sapiens
gcctggacctatgcagggag

SEQ ID NO: 988368 - DNA, 22 bp, Homo sapiens
gcctggacctatgcagggaggc

SEQ ID NO: 988369 - DNA, 11 bp, Homo sapiens
gcctggacctg

SEQ ID NO: 988370 - DNA, 18 bp, Homo sapiens
gcctggacctgcctcctg

SEQ ID NO: 988371 - DNA, 19 bp, Homo sapiens
gcctggacctgcctcctgc

SEQ ID NO: 988372 - DNA, 15 bp, Homo sapiens
gcctggacctgggat

SEQ ID NO: 988373 - DNA, 15 bp, Homo sapiens
gcctggactctaagc

SEQ ID NO: 988374 - DNA, 13 bp, Homo sapiens
gcctggactctgc

SEQ ID NO: 988375 - DNA, 15 bp, Homo sapiens
gcctggactctgccc

SEQ ID NO: 988376 - DNA, 16 bp, Homo sapiens
gcctggactttcctgc

SEQ ID NO: 988377 - DNA, 15 bp, Homo sapiens
gcctggagaagctga

SEQ ID NO: 988378 - DNA, 20 bp, Homo sapiens
gcctggagacaaggtgctaa

SEQ ID NO: 988379 - DNA, 17 bp, Homo sapiens
gcctggagacttagggc

SEQ ID NO: 988380 - DNA, 13 bp, Homo sapiens
gcctggagaggcc

SEQ ID NO: 988381 - DNA, 14 bp, Homo sapiens
gcctggagaggcct

SEQ ID NO: 988382 - DNA, 15 bp, Homo sapiens
gcctggagaggcctg

SEQ ID NO: 988383 - DNA, 20 bp, Homo sapiens
gcctggagatcctcctgcag

SEQ ID NO: 988384 - DNA, 18 bp, Homo sapiens
gcctggagccctgggcgg

SEQ ID NO: 988385 - DNA, 14 bp, Homo sapiens
gcctggagcgtttg

SEQ ID NO: 988386 - DNA, 15 bp, Homo sapiens
gcctggagggacttt

SEQ ID NO: 988387 - DNA, 17 bp, Homo sapiens
gcctggagggatgcccc

SEQ ID NO: 988388 - DNA, 19 bp, Homo sapiens
gcctggagggatgccccca

SEQ ID NO: 988389 - DNA, 23 bp, Homo sapiens
gcctggagggatgcccccaggca

SEQ ID NO: 988390 - DNA, 18 bp, Homo sapiens
gcctggagggcacttcct

SEQ ID NO: 988391 - DNA, 22 bp, Homo sapiens
gcctggagggcacttcctccac

SEQ ID NO: 988392 - DNA, 18 bp, Homo sapiens
gcctggatccctgccctt

SEQ ID NO: 988393 - DNA, 20 bp, Homo sapiens
gcctggatgcggatggccgg

SEQ ID NO: 988394 - DNA, 23 bp, Homo sapiens
gcctggatgggggtgcaggcagc

SEQ ID NO: 988395 - DNA, 16 bp, Homo sapiens
gcctggattcatttcc

SEQ ID NO: 988396 - DNA, 19 bp, Homo sapiens
gcctggattcatttcctgc

SEQ ID NO: 988397 - DNA, 18 bp, Homo sapiens
gcctggcaacagagcgag

SEQ ID NO: 988398 - DNA, 22 bp, Homo sapiens
gcctggcaaggcattcctcatc

SEQ ID NO: 988399 - DNA, 18 bp, Homo sapiens
gcctggcaagtgggtgaa

SEQ ID NO: 988400 - DNA, 21 bp, Homo sapiens
gcctggcacagaccaggcctt

SEQ ID NO: 988401 - DNA, 19 bp, Homo sapiens
gcctggcacagggcagtgg

SEQ ID NO: 988402 - DNA, 11 bp, Homo sapiens
gcctggcaccc

SEQ ID NO: 988403 - DNA, 14 bp, Homo sapiens
gcctggcacccacc

SEQ ID NO: 988404 - DNA, 15 bp, Homo sapiens
gcctggcacccaccg

SEQ ID NO: 988405 - DNA, 18 bp, Homo sapiens
gcctggcagaactgagct

SEQ ID NO: 988406 - DNA, 19 bp, Homo sapiens
gcctggcagaactgagctc

SEQ ID NO: 988407 - DNA, 22 bp, Homo sapiens
gcctggcagaactgagctcctc

SEQ ID NO: 988408 - DNA, 12 bp, Homo sapiens
gcctggcagccg

SEQ ID NO: 988409 - DNA, 20 bp, Homo sapiens
gcctggcagttgaacagagg

SEQ ID NO: 988410 - DNA, 15 bp, Homo sapiens
gcctggcatctgtgc

SEQ ID NO: 988411 - DNA, 18 bp, Homo sapiens
gcctggcatctgtgtgcg

SEQ ID NO: 988412 - DNA, 20 bp, Homo sapiens
gcctggcatctgtgtgcgtg

SEQ ID NO: 988413 - DNA, 16 bp, Homo sapiens
gcctggccaccagcca

SEQ ID NO: 988414 - DNA, 18 bp, Homo sapiens
gcctggccaccagccatc

SEQ ID NO: 988415 - DNA, 14 bp, Homo sapiens
gcctggccacctct

SEQ ID NO: 988416 - DNA, 19 bp, Homo sapiens
gcctggccacctctctcct

SEQ ID NO: 988417 - DNA, 12 bp, Homo sapiens
gcctggccaggc

SEQ ID NO: 988418 - DNA, 15 bp, Homo sapiens
gcctggccaggcaga

SEQ ID NO: 988419 - DNA, 17 bp, Homo sapiens
gcctggccaggcagatc

SEQ ID NO: 988420 - DNA, 18 bp, Homo sapiens
gcctggccagtcctggtc

SEQ ID NO: 988421 - DNA, 22 bp, Homo sapiens
gcctggccatgtcacctggctg

SEQ ID NO: 988422 - DNA, 13 bp, Homo sapiens
gcctggccccagc

SEQ ID NO: 988423 - DNA, 17 bp, Homo sapiens
gcctggccccagcctgg

SEQ ID NO: 988424 - DNA, 17 bp, Homo sapiens
gcctggccccaggcccc

SEQ ID NO: 988425 - DNA, 13 bp, Homo sapiens
gcctggcccccaa

SEQ ID NO: 988426 - DNA, 20 bp, Homo sapiens
gcctggccccggcctttatg

SEQ ID NO: 988427 - DNA, 17 bp, Homo sapiens
gcctggcctcgcctgcc

SEQ ID NO: 988428 - DNA, 18 bp, Homo sapiens
gcctggcctcgcctgcct

SEQ ID NO: 988429 - DNA, 20 bp, Homo sapiens
gcctggcctgagctggggcc

SEQ ID NO: 988430 - DNA, 22 bp, Homo sapiens
gcctggcctgagctggggccac

SEQ ID NO: 988431 - DNA, 12 bp, Homo sapiens
gcctggcctgat

SEQ ID NO: 988432 - DNA, 14 bp, Homo sapiens
gcctggcctggctc

SEQ ID NO: 988433 - DNA, 15 bp, Homo sapiens
gcctggcctggctcc

SEQ ID NO: 988434 - DNA, 16 bp, Homo sapiens
gcctggcgtcggccag

SEQ ID NO: 988435 - DNA, 17 bp, Homo sapiens
gcctggcgtcggccaga

SEQ ID NO: 988436 - DNA, 13 bp, Homo sapiens
gcctggctcccca

SEQ ID NO: 988437 - DNA, 23 bp, Homo sapiens
gcctggctccccacgagtcacct

SEQ ID NO: 988438 - DNA, 16 bp, Homo sapiens
gcctggctccgtccag

SEQ ID NO: 988439 - DNA, 13 bp, Homo sapiens
gcctggctctgcc

SEQ ID NO: 988440 - DNA, 22 bp, Homo sapiens
gcctggctctgccccctccccc

SEQ ID NO: 988441 - DNA, 17 bp, Homo sapiens
gcctggctggaggagca

SEQ ID NO: 988442 - DNA, 23 bp, Homo sapiens
gcctggctggaggagcagcagct

SEQ ID NO: 988443 - DNA, 18 bp, Homo sapiens
gcctggctgtggaggcct

SEQ ID NO: 988444 - DNA, 19 bp, Homo sapiens
gcctggctgtggaggcctg

SEQ ID NO: 988445 - DNA, 21 bp, Homo sapiens
gcctggcttacctatctgtgg

SEQ ID NO: 988446 - DNA, 13 bp, Homo sapiens
gcctggcttctgg

SEQ ID NO: 988447 - DNA, 14 bp, Homo sapiens
gcctggcttctgga

SEQ ID NO: 988448 - DNA, 22 bp, Homo sapiens
gcctggcttctggagcccttgg

SEQ ID NO: 988449 - DNA, 15 bp, Homo sapiens
gcctggcttgctcca

SEQ ID NO: 988450 - DNA, 19 bp, Homo sapiens
gcctggcttgctccagggt

SEQ ID NO: 988451 - DNA, 21 bp, Homo sapiens
gcctggcttgctccagggtct

SEQ ID NO: 988452 - DNA, 22 bp, Homo sapiens
gcctggctttggtccccagcat

SEQ ID NO: 988453 - DNA, 16 bp, Homo sapiens
gcctgggactcccagt

SEQ ID NO: 988454 - DNA, 21 bp, Homo sapiens
gcctgggagggttcccctggc

SEQ ID NO: 988455 - DNA, 22 bp, Homo sapiens
gcctgggagggttcccctggcc

SEQ ID NO: 988456 - DNA, 19 bp, Homo sapiens
gcctgggatcgtgcatttg

SEQ ID NO: 988457 - DNA, 22 bp, Homo sapiens
gcctgggatctggcacactccc

SEQ ID NO: 988458 - DNA, 16 bp, Homo sapiens
gcctgggcaacagagc

SEQ ID NO: 988459 - DNA, 18 bp, Homo sapiens
gcctgggcaacagagcaa

SEQ ID NO: 988460 - DNA, 18 bp, Homo sapiens
gcctgtgccttcctcccc

SEQ ID NO: 988461 - DNA, 17 bp, Homo sapiens
gcctgtggagctcagcc

SEQ ID NO: 988462 - DNA, 22 bp, Homo sapiens
gcctgtggcagaaaagaggaga

SEQ ID NO: 988463 - DNA, 14 bp, Homo sapiens
gcctgtggcctgtg

SEQ ID NO: 988464 - DNA, 19 bp, Homo sapiens
gcctgtggcgccgtctcca

SEQ ID NO: 988465 - DNA, 23 bp, Homo sapiens
gcctgtggcgccgtctccagggg

SEQ ID NO: 988466 - DNA, 16 bp, Homo sapiens
gcctgtggcttggagt

SEQ ID NO: 988467 - DNA, 14 bp, Homo sapiens
gcctgtgggcctca

SEQ ID NO: 988468 - DNA, 20 bp, Homo sapiens
gcctgtgggcctcacctgcc

SEQ ID NO: 988469 - DNA, 22 bp, Homo sapiens
gcctgtgggtccccactcaccc

SEQ ID NO: 988470 - DNA, 13 bp, Homo sapiens
gcctgtgggtctc

SEQ ID NO: 988471 - DNA, 14 bp, Homo sapiens
gcctgtgggtctct

SEQ ID NO: 988472 - DNA, 17 bp, Homo sapiens
gcctgtgggtctctgaa

SEQ ID NO: 988473 - DNA, 14 bp, Homo sapiens
gcctgtggtgaagt

SEQ ID NO: 988474 - DNA, 19 bp, Homo sapiens
gcctgtggtgaagtgtggc

SEQ ID NO: 988475 - DNA, 20 bp, Homo sapiens
gcctgtggtgaagtgtggct

SEQ ID NO: 988476 - DNA, 12 bp, Homo sapiens
gcctgtggtgct

SEQ ID NO: 988477 - DNA, 21 bp, Homo sapiens
gcctgtggttacagtgcagac

SEQ ID NO: 988478 - DNA, 16 bp, Homo sapiens
gcctgtgtccagcagc

SEQ ID NO: 988479 - DNA, 18 bp, Homo sapiens
gcctgtgtccagcagctg

SEQ ID NO: 988480 - DNA, 22 bp, Homo sapiens
gcctgtgtcccatgacccaccc

SEQ ID NO: 988481 - DNA, 23 bp, Homo sapiens
gcctgtgtcccatgacccacccc

SEQ ID NO: 988482 - DNA, 15 bp, Homo sapiens
gcctgtgtgactcca

SEQ ID NO: 988483 - DNA, 17 bp, Homo sapiens
gcctgtgtgtgggtggg

SEQ ID NO: 988484 - DNA, 22 bp, Homo sapiens
gcctgttaatttataatgtatt

SEQ ID NO: 988485 - DNA, 19 bp, Homo sapiens
gcctgttcccattcttgca

SEQ ID NO: 988486 - DNA, 14 bp, Homo sapiens
gcctgttctgcttc

SEQ ID NO: 988487 - DNA, 15 bp, Homo sapiens
gcctgttctgcttcg

SEQ ID NO: 988488 - DNA, 19 bp, Homo sapiens
gcctgttgctgaagtcatt

SEQ ID NO: 988489 - DNA, 20 bp, Homo sapiens
gcctgttgctttcttcctgc

SEQ ID NO: 988490 - DNA, 16 bp, Homo sapiens
gcctgttggcaggccc

SEQ ID NO: 988491 - DNA, 14 bp, Homo sapiens
gcctgttgtattta

SEQ ID NO: 988492 - DNA, 22 bp, Homo sapiens
gcctgtttctgcagcccttggg

SEQ ID NO: 988493 - DNA, 14 bp, Homo sapiens
gcctgtttggcctc

SEQ ID NO: 988494 - DNA, 17 bp, Homo sapiens
gcctgtttgggagtgcg

SEQ ID NO: 988495 - DNA, 17 bp, Homo sapiens
tcctggaacctgtctcc

SEQ ID NO: 988496 - DNA, 17 bp, Homo sapiens
tcctggaaccttgctgt

SEQ ID NO: 988497 - DNA, 18 bp, Homo sapiens
tcctggaaccttgctgtc

SEQ ID NO: 988498 - DNA, 12 bp, Homo sapiens
tcctggaagaca

SEQ ID NO: 988499 - DNA, 18 bp, Homo sapiens
tcctggaagccagctttc

SEQ ID NO: 988500 - DNA, 20 bp, Homo sapiens
tcctggaagccagctttccc

SEQ ID NO: 988501 - DNA, 22 bp, Homo sapiens
tcctggaagcgcgagggcctca

SEQ ID NO: 988502 - DNA, 14 bp, Homo sapiens
tcctggacacactc

SEQ ID NO: 988503 - DNA, 13 bp, Homo sapiens
tcctggacacctc

SEQ ID NO: 988504 - DNA, 19 bp, Homo sapiens
tcctggacacctcccaggg

SEQ ID NO: 988505 - DNA, 20 bp, Homo sapiens
tcctggacacctcccagggg

SEQ ID NO: 988506 - DNA, 23 bp, Homo sapiens
tcctggacacctcccaggggact

SEQ ID NO: 988507 - DNA, 19 bp, Homo sapiens
tcctggacactcagacctg

SEQ ID NO: 988508 - DNA, 18 bp, Homo sapiens
tcctggacatcaccagtc

SEQ ID NO: 988509 - DNA, 21 bp, Homo sapiens
tcctggacatgaagattcttt

SEQ ID NO: 988510 - DNA, 22 bp, Homo sapiens
tcctggacatgaagattctttc

SEQ ID NO: 988511 - DNA, 14 bp, Homo sapiens
tcctggacattttt

SEQ ID NO: 988512 - DNA, 19 bp, Homo sapiens
tcctggacattttttcagt

SEQ ID NO: 988513 - DNA, 21 bp, Homo sapiens
tcctggaccttgacagagcag

SEQ ID NO: 988514 - DNA, 15 bp, Homo sapiens
tcctggactccggag

SEQ ID NO: 988515 - DNA, 16 bp, Homo sapiens
tcctggactccggagg

SEQ ID NO: 988516 - DNA, 17 bp, Homo sapiens
tcctggactccggagga

SEQ ID NO: 988517 - DNA, 20 bp, Homo sapiens
tcctggactccggaggactg

SEQ ID NO: 988518 - DNA, 20 bp, Homo sapiens
tcctggacttacaaaatgcc

SEQ ID NO: 988519 - DNA, 21 bp, Homo sapiens
tcctggagaggtggctgcgcc

SEQ ID NO: 988520 - DNA, 18 bp, Homo sapiens
tcctggagatagctgggg

SEQ ID NO: 988521 - DNA, 20 bp, Homo sapiens
tcctggagatagctggggct

SEQ ID NO: 988522 - DNA, 19 bp, Homo sapiens
tcctggagcagaaagtgcc

SEQ ID NO: 988523 - DNA, 16 bp, Homo sapiens
tcctggagcatcccag

SEQ ID NO: 988524 - DNA, 19 bp, Homo sapiens
tcctggagcatcccaggcg

SEQ ID NO: 988525 - DNA, 14 bp, Homo sapiens
tcctggaggcaggg

SEQ ID NO: 988526 - DNA, 19 bp, Homo sapiens
tcctggaggggctggggac

SEQ ID NO: 988527 - DNA, 14 bp, Homo sapiens
tcctggatttatag

SEQ ID NO: 988528 - DNA, 21 bp, Homo sapiens
tcctggcaatagtgtgttctg

SEQ ID NO: 988529 - DNA, 22 bp, Homo sapiens
tcctggcaatagtgtgttctga

SEQ ID NO: 988530 - DNA, 17 bp, Homo sapiens
tcctggcacgccctact

SEQ ID NO: 988531 - DNA, 13 bp, Homo sapiens
tcctggcagccca

SEQ ID NO: 988532 - DNA, 16 bp, Homo sapiens
tcctggcagcccagag

SEQ ID NO: 988533 - DNA, 19 bp, Homo sapiens
tcctggcagcccagagact

SEQ ID NO: 988534 - DNA, 13 bp, Homo sapiens
tcctggcagctgc

SEQ ID NO: 988535 - DNA, 15 bp, Homo sapiens
tcctggcagctgctg

SEQ ID NO: 988536 - DNA, 16 bp, Homo sapiens
tcctggcagctgctgt

SEQ ID NO: 988537 - DNA, 17 bp, Homo sapiens
tcctggcagctgctgtg

SEQ ID NO: 988538 - DNA, 18 bp, Homo sapiens
tcctggcagctgctgtgg

SEQ ID NO: 988539 - DNA, 16 bp, Homo sapiens
tcctggcagctggacc

SEQ ID NO: 988540 - DNA, 23 bp, Homo sapiens
tcctggcagggccacctgcagga

SEQ ID NO: 988541 - DNA, 10 bp, Homo sapiens
tcctggccag

SEQ ID NO: 988542 - DNA, 14 bp, Homo sapiens
tcctggcccaggcc

SEQ ID NO: 988543 - DNA, 15 bp, Homo sapiens
tcctggcccaggcct

SEQ ID NO: 988544 - DNA, 20 bp, Homo sapiens
tcctggccccctcattcaga

SEQ ID NO: 988545 - DNA, 21 bp, Homo sapiens
tcctggccccgggctctggcc

SEQ ID NO: 988546 - DNA, 22 bp, Homo sapiens
tcctggccccgggctctggcca

SEQ ID NO: 988547 - DNA, 23 bp, Homo sapiens
tcctggccccgggctctggccac

SEQ ID NO: 988548 - DNA, 22 bp, Homo sapiens
tcctggcccctccagaccctgc

SEQ ID NO: 988549 - DNA, 16 bp, Homo sapiens
tcctggcccgccctca

SEQ ID NO: 988550 - DNA, 22 bp, Homo sapiens
tcctggccctgggggtctgggc

SEQ ID NO: 988551 - DNA, 23 bp, Homo sapiens
tcctggcccttcagtctgctcca

SEQ ID NO: 988552 - DNA, 14 bp, Homo sapiens
tcctggcctatccg

SEQ ID NO: 988553 - DNA, 22 bp, Homo sapiens
tcctggcctatccgctgccagc

SEQ ID NO: 988554 - DNA, 22 bp, Homo sapiens
tcctggcctcactggctggggc

SEQ ID NO: 988555 - DNA, 13 bp, Homo sapiens
tcctggcctcctt

SEQ ID NO: 988556 - DNA, 13 bp, Homo sapiens
tcctggcctgaga

SEQ ID NO: 988557 - DNA, 15 bp, Homo sapiens
tcctggccttctgaa

SEQ ID NO: 988558 - DNA, 18 bp, Homo sapiens
tcctggccttctgaactc

SEQ ID NO: 988559 - DNA, 19 bp, Homo sapiens
tcctggcgggggtgggccg

SEQ ID NO: 988560 - DNA, 18 bp, Homo sapiens
tcctggctacatcccagc

SEQ ID NO: 988561 - DNA, 21 bp, Homo sapiens
tcctggctacatcccagcctg

SEQ ID NO: 988562 - DNA, 16 bp, Homo sapiens
tcctggctcctgaggg

SEQ ID NO: 988563 - DNA, 14 bp, Homo sapiens
tcctggctcgcagg

SEQ ID NO: 988564 - DNA, 23 bp, Homo sapiens
tcctggctcggggtaaaaagtgg

SEQ ID NO: 988565 - DNA, 22 bp, Homo sapiens
tcctggctctaccctgtctgtc

SEQ ID NO: 988566 - DNA, 23 bp, Homo sapiens
tcctggctctaccctgtctgtcc

SEQ ID NO: 988567 - DNA, 11 bp, Homo sapiens
tcctggctctg

SEQ ID NO: 988568 - DNA, 14 bp, Homo sapiens
tcctggctgccagg

SEQ ID NO: 988569 - DNA, 14 bp, Homo sapiens
tcctggctgtaaat

SEQ ID NO: 988570 - DNA, 18 bp, Homo sapiens
tcctggctgtgcccagca

SEQ ID NO: 988571 - DNA, 19 bp, Homo sapiens
tcctggctgtgcccagcag

SEQ ID NO: 988572 - DNA, 21 bp, Homo sapiens
tcctggctgtgcccagcaggc

SEQ ID NO: 988573 - DNA, 18 bp, Homo sapiens
tcctggctttccaggaga

SEQ ID NO: 988574 - DNA, 18 bp, Homo sapiens
tcctgggaatggaataac

SEQ ID NO: 988575 - DNA, 23 bp, Homo sapiens
tcctgggaccccctcgccagctt

SEQ ID NO: 988576 - DNA, 20 bp, Homo sapiens
tcctgggagaacctcaggct

SEQ ID NO: 988577 - DNA, 19 bp, Homo sapiens
tcctgggcaatcagacacc

SEQ ID NO: 988578 - DNA, 23 bp, Homo sapiens
tcctgggcagcctttccagcctc

SEQ ID NO: 988579 - DNA, 12 bp, Homo sapiens
tcctgggcaggt

SEQ ID NO: 988580 - DNA, 21 bp, Homo sapiens
tcctgggcaggtgggagctga

SEQ ID NO: 988581 - DNA, 18 bp, Homo sapiens
tcctgttacttacctaaa

SEQ ID NO: 988582 - DNA, 16 bp, Homo sapiens
tcctgttacttgcttc

SEQ ID NO: 988583 - DNA, 17 bp, Homo sapiens
tcctgttacttgcttca

SEQ ID NO: 988584 - DNA, 15 bp, Homo sapiens
tcctgttcacaccag

SEQ ID NO: 988585 - DNA, 15 bp, Homo sapiens
tcctgttcagtgaga

SEQ ID NO: 988586 - DNA, 20 bp, Homo sapiens
tcctgttccctcctggtcct

SEQ ID NO: 988587 - DNA, 13 bp, Homo sapiens
tcctgttcttcct

SEQ ID NO: 988588 - DNA, 17 bp, Homo sapiens
tcctgttgaagacttcc

SEQ ID NO: 988589 - DNA, 21 bp, Homo sapiens
tcctgttgaagacttcctctc

SEQ ID NO: 988590 - DNA, 22 bp, Homo sapiens
tcctgttgaccttcccacacaa

SEQ ID NO: 988591 - DNA, 22 bp, Homo sapiens
tcctgtttataatctgaagata

SEQ ID NO: 988592 - DNA, 12 bp, Homo sapiens
tcctgtttcaga

SEQ ID NO: 988593 - DNA, 21 bp, Homo sapiens
tcctgtttgaaatatcatgtt

SEQ ID NO: 988594 - DNA, 20 bp, Homo sapiens
tcctgtttggtggggtggca

SEQ ID NO: 988595 - DNA, 15 bp, Homo sapiens
tcctgttttctccct

SEQ ID NO: 988596 - DNA, 19 bp, Homo sapiens
tcctgttttctccctctca

SEQ ID NO: 988597 - DNA, 17 bp, Homo sapiens
tcctgttttctctgtga

SEQ ID NO: 988598 - DNA, 16 bp, Homo sapiens
tcctgtttttctgggt

SEQ ID NO: 988599 - DNA, 20 bp, Homo sapiens
tcctgtttttctgggtggcc

SEQ ID NO: 988600 - DNA, 20 bp, Homo sapiens
tccttaaaattaagttgaaa

SEQ ID NO: 988601 - DNA, 21 bp, Homo sapiens
tccttaaaattaagttgaaaa

SEQ ID NO: 988602 - DNA, 15 bp, Homo sapiens
tccttaaactgtgtg

SEQ ID NO: 988603 - DNA, 23 bp, Homo sapiens
tccttaaactgtgtggactgtga

SEQ ID NO: 988604 - DNA, 15 bp, Homo sapiens
tccttaaatatatat

SEQ ID NO: 988605 - DNA, 21 bp, Homo sapiens
tccttaaatcttaatgttcct

SEQ ID NO: 988606 - DNA, 19 bp, Homo sapiens
tccttaaatttttagccat

SEQ ID NO: 988607 - DNA, 22 bp, Homo sapiens
tccttaaccaccgcatatgcat

SEQ ID NO: 988608 - DNA, 13 bp, Homo sapiens
tccttaagagatt

SEQ ID NO: 988609 - DNA, 14 bp, Homo sapiens
tccttaagcatctg

SEQ ID NO: 988610 - DNA, 17 bp, Homo sapiens
tccttaagtcagaacag

SEQ ID NO: 988611 - DNA, 18 bp, Homo sapiens
tccttaattcactcccac

SEQ ID NO: 988612 - DNA, 11 bp, Homo sapiens
tccttacctcg

SEQ ID NO: 988613 - DNA, 14 bp, Homo sapiens
tccttacctctgga

SEQ ID NO: 988614 - DNA, 21 bp, Homo sapiens
tccttacctctggaacccccc

SEQ ID NO: 988615 - DNA, 17 bp, Homo sapiens
tccttacctcttccgga

SEQ ID NO: 988616 - DNA, 20 bp, Homo sapiens
tccttacgctttgtcacaca

SEQ ID NO: 988617 - DNA, 19 bp, Homo sapiens
tccttactcccccaccact

SEQ ID NO: 988618 - DNA, 23 bp, Homo sapiens
tccttactcccccaccactcagg

SEQ ID NO: 988619 - DNA, 17 bp, Homo sapiens
tccttactctgagccca

SEQ ID NO: 988620 - DNA, 18 bp, Homo sapiens
tccttactctgagcccag

SEQ ID NO: 988621 - DNA, 16 bp, Homo sapiens
tccttacttgcactgt

SEQ ID NO: 988622 - DNA, 21 bp, Homo sapiens
tccttacttgcactgttactc

SEQ ID NO: 988623 - DNA, 16 bp, Homo sapiens
gccttgccgctcccct

SEQ ID NO: 988624 - DNA, 15 bp, Homo sapiens
gccttgcggaagcca

SEQ ID NO: 988625 - DNA, 16 bp, Homo sapiens
gccttgcggaagccat

SEQ ID NO: 988626 - DNA, 18 bp, Homo sapiens
gccttgcggaagccatag

SEQ ID NO: 988627 - DNA, 19 bp, Homo sapiens
gccttgcggaagccatagg

SEQ ID NO: 988628 - DNA, 14 bp, Homo sapiens
gccttgctcactca

SEQ ID NO: 988629 - DNA, 18 bp, Homo sapiens
gccttgctctgagcacag

SEQ ID NO: 988630 - DNA, 21 bp, Homo sapiens
gccttgctgactctctgagct

SEQ ID NO: 988631 - DNA, 18 bp, Homo sapiens
gccttgctgggccaggga

SEQ ID NO: 988632 - DNA, 12 bp, Homo sapiens
gccttgctgggg

SEQ ID NO: 988633 - DNA, 13 bp, Homo sapiens
gccttgctggggt

SEQ ID NO: 988634 - DNA, 20 bp, Homo sapiens
gccttgctggggtccagggc

SEQ ID NO: 988635 - DNA, 17 bp, Homo sapiens
gccttgctgtttgtcct

SEQ ID NO: 988636 - DNA, 23 bp, Homo sapiens
gccttgcttctcccatttcctga

SEQ ID NO: 988637 - DNA, 22 bp, Homo sapiens
gccttgctttgggctttgcagg

SEQ ID NO: 988638 - DNA, 18 bp, Homo sapiens
gccttggaaccagcccca

SEQ ID NO: 988639 - DNA, 19 bp, Homo sapiens
gccttggataatgctgttg

SEQ ID NO: 988640 - DNA, 23 bp, Homo sapiens
gccttggataatgctgttgcctc

SEQ ID NO: 988641 - DNA, 23 bp, Homo sapiens
gccttggatcgctaagctggctc

SEQ ID NO: 988642 - DNA, 17 bp, Homo sapiens
gccttggcatgggcgca

SEQ ID NO: 988643 - DNA, 19 bp, Homo sapiens
gccttggcatgggcgcagg

SEQ ID NO: 988644 - DNA, 15 bp, Homo sapiens
gccttggccggctgt

SEQ ID NO: 988645 - DNA, 17 bp, Homo sapiens
gccttggcctcccaaag

SEQ ID NO: 988646 - DNA, 20 bp, Homo sapiens
gccttggcctcccctgctga

SEQ ID NO: 988647 - DNA, 17 bp, Homo sapiens
gccttggctcgttctct

SEQ ID NO: 988648 - DNA, 18 bp, Homo sapiens
gccttggctgggcctctg

SEQ ID NO: 988649 - DNA, 23 bp, Homo sapiens
gccttgggaggacatgcgtgtgt

SEQ ID NO: 988650 - DNA, 22 bp, Homo sapiens
gccttgggccggtgctgggggc

SEQ ID NO: 988651 - DNA, 15 bp, Homo sapiens
gccttgggcctttca

SEQ ID NO: 988652 - DNA, 22 bp, Homo sapiens
gccttgggcctttcagtcccaa

SEQ ID NO: 988653 - DNA, 18 bp, Homo sapiens
gccttgggctgctcctca

SEQ ID NO: 988654 - DNA, 22 bp, Homo sapiens
gccttgggctgctcctcatggt

SEQ ID NO: 988655 - DNA, 19 bp, Homo sapiens
gccttggggaatttcctct

SEQ ID NO: 988656 - DNA, 18 bp, Homo sapiens
gccttgggggggctgcct

SEQ ID NO: 988657 - DNA, 20 bp, Homo sapiens
gccttgggggggctgccttt

SEQ ID NO: 988658 - DNA, 15 bp, Homo sapiens
gccttggggtggggg

SEQ ID NO: 988659 - DNA, 16 bp, Homo sapiens
gccttggtatcatttt

SEQ ID NO: 988660 - DNA, 17 bp, Homo sapiens
gccttggtatgtgccag

SEQ ID NO: 988661 - DNA, 18 bp, Homo sapiens
gccttggtatgtgccagg

SEQ ID NO: 988662 - DNA, 21 bp, Homo sapiens
gccttggtatgtgccaggctt

SEQ ID NO: 988663 - DNA, 20 bp, Homo sapiens
gccttggtggagcagccaga

SEQ ID NO: 988664 - DNA, 16 bp, Homo sapiens
gccttggtgtccacct

SEQ ID NO: 988665 - DNA, 18 bp, Homo sapiens
gccttggtgtccacctgg

SEQ ID NO: 988666 - DNA, 22 bp, Homo sapiens
gccttggtttttactgctctga

SEQ ID NO: 988667 - DNA, 17 bp, Homo sapiens
gccttgtaattctaaat

SEQ ID NO: 988668 - DNA, 21 bp, Homo sapiens
gccttgtataatattgaaaat

SEQ ID NO: 988669 - DNA, 22 bp, Homo sapiens
gccttgtataatattgaaaatt

SEQ ID NO: 988670 - DNA, 14 bp, Homo sapiens
gccttgtcatcctc

SEQ ID NO: 988671 - DNA, 14 bp, Homo sapiens
gccttgtccaggaa

SEQ ID NO: 988672 - DNA, 18 bp, Homo sapiens
gccttgtggataagggag

SEQ ID NO: 988673 - DNA, 20 bp, Homo sapiens
gccttgtgtggcttggagga

SEQ ID NO: 988674 - DNA, 22 bp, Homo sapiens
gccttgtgtggcttggaggaaa

SEQ ID NO: 988675 - DNA, 21 bp, Homo sapiens
gccttgtgtgtcaggccctct

SEQ ID NO: 988676 - DNA, 18 bp, Homo sapiens
gccttgttgtgacacatc

SEQ ID NO: 988677 - DNA, 13 bp, Homo sapiens
gccttgtttctga

SEQ ID NO: 988678 - DNA, 15 bp, Homo sapiens
gccttgtttctgatg

SEQ ID NO: 988679 - DNA, 14 bp, Homo sapiens
gcctttaaaaccag

SEQ ID NO: 988680 - DNA, 15 bp, Homo sapiens
gcctttaaaaccagt

SEQ ID NO: 988681 - DNA, 23 bp, Homo sapiens
gcctttaaaaccagtaacgtgct

SEQ ID NO: 988682 - DNA, 23 bp, Homo sapiens
gcctttaaaacgcgtctgcctgg

SEQ ID NO: 988683 - DNA, 24 bp, Homo sapiens
gcctttaaaacgcgtctgcctggg

SEQ ID NO: 988684 - DNA, 17 bp, Homo sapiens
gcctttaaaggttttta

SEQ ID NO: 988685 - DNA, 18 bp, Homo sapiens
gcctttaaaggtttttaa

SEQ ID NO: 988686 - DNA, 15 bp, Homo sapiens
gcctttaaagtatga

SEQ ID NO: 988687 - DNA, 18 bp, Homo sapiens
gcctttaaagtatgaatc

SEQ ID NO: 988688 - DNA, 14 bp, Homo sapiens
gcctttaacagaaa

SEQ ID NO: 988689 - DNA, 20 bp, Homo sapiens
gcctttacgttcatcacctg

SEQ ID NO: 988690 - DNA, 20 bp, Homo sapiens
gcctttagcctggaccaaag

SEQ ID NO: 988691 - DNA, 20 bp, Homo sapiens
gcctttaggggtgtgtattc

SEQ ID NO: 988692 - DNA, 16 bp, Homo sapiens
gcctttaggtctttag

SEQ ID NO: 988693 - DNA, 22 bp, Homo sapiens
gcctttatctcagccatccgca

SEQ ID NO: 988694 - DNA, 23 bp, Homo sapiens
gcctttcaagcggtgcctaagaa

SEQ ID NO: 988695 - DNA, 22 bp, Homo sapiens
gcctttccataaggaatgtagc

SEQ ID NO: 988696 - DNA, 18 bp, Homo sapiens
gcctttcccaactctagc

SEQ ID NO: 988697 - DNA, 21 bp, Homo sapiens
gcctttcctgtagccttctgt

SEQ ID NO: 988698 - DNA, 12 bp, Homo sapiens
gcctttcctgtg

SEQ ID NO: 988699 - DNA, 21 bp, Homo sapiens
gcctttcctgtgccaacctga

SEQ ID NO: 988700 - DNA, 16 bp, Homo sapiens
gcctttcgaggcctga

SEQ ID NO: 988701 - DNA, 14 bp, Homo sapiens
actcactgaagcct

SEQ ID NO: 988702 - DNA, 19 bp, Homo sapiens
actcactgaagcctgcgtt

SEQ ID NO: 988703 - DNA, 10 bp, Homo sapiens
actcactgct

SEQ ID NO: 988704 - DNA, 20 bp, Homo sapiens
actcactgggaagctcccac

SEQ ID NO: 988705 - DNA, 16 bp, Homo sapiens
actcacttacatcttc

SEQ ID NO: 988706 - DNA, 14 bp, Homo sapiens
actcacttctcagc

SEQ ID NO: 988707 - DNA, 12 bp, Homo sapiens
actcacttgcca

SEQ ID NO: 988708 - DNA, 21 bp, Homo sapiens
actcacttgccattgccagga

SEQ ID NO: 988709 - DNA, 13 bp, Homo sapiens
actcacttttcac

SEQ ID NO: 988710 - DNA, 15 bp, Homo sapiens
actcacttttcactt

SEQ ID NO: 988711 - DNA, 13 bp, Homo sapiens
actcagaaagcca

SEQ ID NO: 988712 - DNA, 15 bp, Homo sapiens
actcagaactgtccc

SEQ ID NO: 988713 - DNA, 23 bp, Homo sapiens
actcagaactgtcccatccccag

SEQ ID NO: 988714 - DNA, 14 bp, Homo sapiens
actcagaagagaaa

SEQ ID NO: 988715 - DNA, 23 bp, Homo sapiens
actcagaagagaaatacagctgg

SEQ ID NO: 988716 - DNA, 17 bp, Homo sapiens
actcagaatataacatg

SEQ ID NO: 988717 - DNA, 23 bp, Homo sapiens
actcagaatataacatgtaaaat

SEQ ID NO: 988718 - DNA, 18 bp, Homo sapiens
actcagaattatttttaa

SEQ ID NO: 988719 - DNA, 21 bp, Homo sapiens
actcagaattctctagtttga

SEQ ID NO: 988720 - DNA, 22 bp, Homo sapiens
actcagaattctctagtttgat

SEQ ID NO: 988721 - DNA, 20 bp, Homo sapiens
ctgtgttcgggggagcagag

SEQ ID NO: 988722 - DNA, 23 bp, Homo sapiens
ctgtgttcgggggagcagagaga

SEQ ID NO: 988723 - DNA, 14 bp, Homo sapiens
ctgtgttgactgct

SEQ ID NO: 988724 - DNA, 17 bp, Homo sapiens
ctgtgttgactgctgct

SEQ ID NO: 988725 - DNA, 18 bp, Homo sapiens
ctgtgttgactgctgctc

SEQ ID NO: 988726 - DNA, 13 bp, Homo sapiens
ctgtgttgccaag

SEQ ID NO: 988727 - DNA, 16 bp, Homo sapiens
ctgtgttgccaagctc

SEQ ID NO: 988728 - DNA, 21 bp, Homo sapiens
ctgtgttgccaagctccaagc

SEQ ID NO: 988729 - DNA, 22 bp, Homo sapiens
ctgtgttgccacagtagaactg

SEQ ID NO: 988730 - DNA, 18 bp, Homo sapiens
ctgtgttgcgtgtcgtgg

SEQ ID NO: 988731 - DNA, 13 bp, Homo sapiens
ctgtgttgtatta

SEQ ID NO: 988732 - DNA, 19 bp, Homo sapiens
ctgtgttgtattaacaaaa

SEQ ID NO: 988733 - DNA, 13 bp, Homo sapiens
ctgtgtttagttg

SEQ ID NO: 988734 - DNA, 19 bp, Homo sapiens
ctgtgtttcaagtggggct

SEQ ID NO: 988735 - DNA, 18 bp, Homo sapiens
ctgtgtttcacttaatgt

SEQ ID NO: 988736 - DNA, 21 bp, Homo sapiens
ctgtgtttccaaaggttcccc

SEQ ID NO: 988737 - DNA, 20 bp, Homo sapiens
ctgtgtttgcagcctgctct

SEQ ID NO: 988738 - DNA, 23 bp, Homo sapiens
ctgttaaaaaagaaatctgtttc

SEQ ID NO: 988739 - DNA, 17 bp, Homo sapiens
ctgttaaaatgtacact

SEQ ID NO: 988740 - DNA, 23 bp, Homo sapiens
ctgttaaacagtagttgtattct

SEQ ID NO: 988741 - DNA, 14 bp, Homo sapiens
ctgttaaactgtta

SEQ ID NO: 988742 - DNA, 23 bp, Homo sapiens
ctgttaaactgttagcactgttg

SEQ ID NO: 988743 - DNA, 14 bp, Homo sapiens
ctgttaaatataca

SEQ ID NO: 988744 - DNA, 16 bp, Homo sapiens
ctgttaaatatacact

SEQ ID NO: 988745 - DNA, 15 bp, Homo sapiens
ctgttaactgaatac

SEQ ID NO: 988746 - DNA, 21 bp, Homo sapiens
ctgttaatacacagtacttta

SEQ ID NO: 988747 - DNA, 18 bp, Homo sapiens
ctgttacacgtgcctgta

SEQ ID NO: 988748 - DNA, 19 bp, Homo sapiens
ctgttacacgtgcctgtag

SEQ ID NO: 988749 - DNA, 15 bp, Homo sapiens
ctgttacagtaatgt

SEQ ID NO: 988750 - DNA, 16 bp, Homo sapiens
ctgttaccatgtcact

SEQ ID NO: 988751 - DNA, 17 bp, Homo sapiens
ctgttacccaggctgga

SEQ ID NO: 988752 - DNA, 22 bp, Homo sapiens
ctgttaccccatcctccctccc

SEQ ID NO: 988753 - DNA, 22 bp, Homo sapiens
ctgttacctcaacaagaagaat

SEQ ID NO: 988754 - DNA, 21 bp, Homo sapiens
ctgttactaaatccttttgtt

SEQ ID NO: 988755 - DNA, 23 bp, Homo sapiens
ctgttactctaaatagaaatata

SEQ ID NO: 988756 - DNA, 20 bp, Homo sapiens
ctgttactgcttctctttgt

SEQ ID NO: 988757 - DNA, 13 bp, Homo sapiens
ctgttactgtctt

SEQ ID NO: 988758 - DNA, 21 bp, Homo sapiens
ctgttacttgaaataccagtg

SEQ ID NO: 988759 - DNA, 15 bp, Homo sapiens
ctgttacttgcttca

SEQ ID NO: 988760 - DNA, 13 bp, Homo sapiens
ctgttagatgctg

SEQ ID NO: 988761 - DNA, 15 bp, Homo sapiens
ctgttagcactgttg

SEQ ID NO: 988762 - DNA, 17 bp, Homo sapiens
ctgttagcactgttgat

SEQ ID NO: 988763 - DNA, 20 bp, Homo sapiens
ctgttagcactgttgatgta

SEQ ID NO: 988764 - DNA, 13 bp, Homo sapiens
ctgttagcagaca

SEQ ID NO: 988765 - DNA, 14 bp, Homo sapiens
ctgttagcagagtc

SEQ ID NO: 988766 - DNA, 23 bp, Homo sapiens
ctgttagcagagtctgtctcttg

SEQ ID NO: 988767 - DNA, 12 bp, Homo sapiens
ctgttagccagg

SEQ ID NO: 988768 - DNA, 14 bp, Homo sapiens
ctgttagggccttg

SEQ ID NO: 988769 - DNA, 14 bp, Homo sapiens
ctgttagtcatttg

SEQ ID NO: 988770 - DNA, 12 bp, Homo sapiens
ctgttagttttg

SEQ ID NO: 988771 - DNA, 17 bp, Homo sapiens
ctgttatatatctcttt

SEQ ID NO: 988772 - DNA, 19 bp, Homo sapiens
ctgttatcaaaactttctt

SEQ ID NO: 988773 - DNA, 15 bp, Homo sapiens
ctgttatgattctga

SEQ ID NO: 988774 - DNA, 14 bp, Homo sapiens
ctgttatgctgtga

SEQ ID NO: 988775 - DNA, 19 bp, Homo sapiens
ctgttattatatttgacat

SEQ ID NO: 988776 - DNA, 23 bp, Homo sapiens
ctgttcaatgtttttaaaaatct

SEQ ID NO: 988777 - DNA, 22 bp, Homo sapiens
ctgttcacaaactacctctgga

SEQ ID NO: 988778 - DNA, 14 bp, Homo sapiens
ctgttcacactgca

SEQ ID NO: 988779 - DNA, 20 bp, Homo sapiens
ctgttcacactgcagagact

SEQ ID NO: 988780 - DNA, 13 bp, Homo sapiens
ctgttcactctac

SEQ ID NO: 988781 - DNA, 17 bp, Homo sapiens
ctgttcagaaagcaata

SEQ ID NO: 988782 - DNA, 14 bp, Homo sapiens
ctgttcagatgtgc

SEQ ID NO: 988783 - DNA, 15 bp, Homo sapiens
ctgttcagatgtgca

SEQ ID NO: 988784 - DNA, 17 bp, Homo sapiens
ctgttcagatgtgcatt

SEQ ID NO: 988785 - DNA, 21 bp, Homo sapiens
ctgttcagctggttgaggttt

SEQ ID NO: 988786 - DNA, 20 bp, Homo sapiens
ctgttcagggcatcggcagc

SEQ ID NO: 988787 - DNA, 16 bp, Homo sapiens
ctgttcagtaataaaa

SEQ ID NO: 988788 - DNA, 20 bp, Homo sapiens
ctgttcagtgtcccgggccc

SEQ ID NO: 988789 - DNA, 14 bp, Homo sapiens
ctgttccaaattca

SEQ ID NO: 988790 - DNA, 17 bp, Homo sapiens
ctgttccaaattcagtt

SEQ ID NO: 988791 - DNA, 22 bp, Homo sapiens
ctgttccaaattcagtttcata

SEQ ID NO: 988792 - DNA, 15 bp, Homo sapiens
ctgttccagactcag

SEQ ID NO: 988793 - DNA, 17 bp, Homo sapiens
ctgttccaggccctcca

SEQ ID NO: 988794 - DNA, 13 bp, Homo sapiens
ctgttcccaagga

SEQ ID NO: 988795 - DNA, 16 bp, Homo sapiens
ctgttccccaaatggc

SEQ ID NO: 988796 - DNA, 15 bp, Homo sapiens
ctgttcccccaccct

SEQ ID NO: 988797 - DNA, 19 bp, Homo sapiens
ctgttccccctgccgcagg

SEQ ID NO: 988798 - DNA, 17 bp, Homo sapiens
ctgttccccctgtgcag

SEQ ID NO: 988799 - DNA, 17 bp, Homo sapiens
ctgttcccccttcacaa

SEQ ID NO: 988800 - DNA, 17 bp, Homo sapiens
ctgttcccctcacccaa

SEQ ID NO: 988801 - DNA, 17 bp, Homo sapiens
ctgttcccctcactgga

SEQ ID NO: 988802 - DNA, 17 bp, Homo sapiens
ctgttccctctgctcct

SEQ ID NO: 988803 - DNA, 20 bp, Homo sapiens
ctgttccctctgctcctgga

SEQ ID NO: 988804 - DNA, 13 bp, Homo sapiens
ctgttccctctgg

SEQ ID NO: 988805 - DNA, 17 bp, Homo sapiens
ctgttccctctggcttc

SEQ ID NO: 988806 - DNA, 18 bp, Homo sapiens
ctgttcccttgtggcttg

SEQ ID NO: 988807 - DNA, 14 bp, Homo sapiens
ctgttccctttgcc

SEQ ID NO: 988808 - DNA, 14 bp, Homo sapiens
ctgttcctgtgttc

SEQ ID NO: 988809 - DNA, 15 bp, Homo sapiens
ctgttccttagacct

SEQ ID NO: 988810 - DNA, 21 bp, Homo sapiens
ctgttccttatttctctctcc

SEQ ID NO: 988811 - DNA, 23 bp, Homo sapiens
ctgttccttatttctctctcctg

SEQ ID NO: 988812 - DNA, 15 bp, Homo sapiens
ctgttccttcacatc

SEQ ID NO: 988813 - DNA, 21 bp, Homo sapiens
ctgttccttcacatcctgtgt

SEQ ID NO: 988814 - DNA, 18 bp, Homo sapiens
ctgttccttcctccactg

SEQ ID NO: 988815 - DNA, 14 bp, Homo sapiens
ctgttccttttata

SEQ ID NO: 988816 - DNA, 16 bp, Homo sapiens
ctgttcgctcctccca

SEQ ID NO: 988817 - DNA, 17 bp, Homo sapiens
ctgttcgctcctcccag

SEQ ID NO: 988818 - DNA, 13 bp, Homo sapiens
ctgttcggaaggg

SEQ ID NO: 988819 - DNA, 15 bp, Homo sapiens
ctgttctaacatgta

SEQ ID NO: 988820 - DNA, 19 bp, Homo sapiens
ctgttctacatagatgctt

SEQ ID NO: 988821 - DNA, 14 bp, Homo sapiens
ctgttctagttttt

SEQ ID NO: 988822 - DNA, 16 bp, Homo sapiens
cattgatacaaagtac

SEQ ID NO: 988823 - DNA, 15 bp, Homo sapiens
cattgatagaactac

SEQ ID NO: 988824 - DNA, 23 bp, Homo sapiens
cattgatcatttttatatgaaat

SEQ ID NO: 988825 - DNA, 21 bp, Homo sapiens
cattgatgtaatttaaaactt

SEQ ID NO: 988826 - DNA, 18 bp, Homo sapiens
cattgattgtcagctact

SEQ ID NO: 988827 - DNA, 14 bp, Homo sapiens
cattgcacctatct

SEQ ID NO: 988828 - DNA, 21 bp, Homo sapiens
cattgcacctatctcagccat

SEQ ID NO: 988829 - DNA, 18 bp, Homo sapiens
cattgcactcccgcctgg

SEQ ID NO: 988830 - DNA, 18 bp, Homo sapiens
cattgcactctagcctgg

SEQ ID NO: 988831 - DNA, 19 bp, Homo sapiens
cattgcagccttgcgctgt

SEQ ID NO: 988832 - DNA, 22 bp, Homo sapiens
cattgcagccttgcgctgtccc

SEQ ID NO: 988833 - DNA, 13 bp, Homo sapiens
cattgccaccagg

SEQ ID NO: 988834 - DNA, 14 bp, Homo sapiens
cattgccaccagga

SEQ ID NO: 988835 - DNA, 15 bp, Homo sapiens
cattgccaccaggag

SEQ ID NO: 988836 - DNA, 16 bp, Homo sapiens
cattgccaccaggaga

SEQ ID NO: 988837 - DNA, 20 bp, Homo sapiens
cattgccaccaggagaacca

SEQ ID NO: 988838 - DNA, 20 bp, Homo sapiens
cattgccatgaatttctacc

SEQ ID NO: 988839 - DNA, 21 bp, Homo sapiens
cattgccccagacctggaaga

SEQ ID NO: 988840 - DNA, 12 bp, Homo sapiens
cattgccctggt

SEQ ID NO: 988841 - DNA, 21 bp, Homo sapiens
cattgccgtggcatcttaaaa

SEQ ID NO: 988842 - DNA, 17 bp, Homo sapiens
cattgcctgttctgctt

SEQ ID NO: 988843 - DNA, 16 bp, Homo sapiens
cggtttagatgaatgc

SEQ ID NO: 988844 - DNA, 16 bp, Homo sapiens
cggtttcccggccctt

SEQ ID NO: 988845 - DNA, 17 bp, Homo sapiens
cggtttctagcctctga

SEQ ID NO: 988846 - DNA, 11 bp, Homo sapiens
cggtttctcca

SEQ ID NO: 988847 - DNA, 13 bp, Homo sapiens
cggtttctgagca

SEQ ID NO: 988848 - DNA, 20 bp, Homo sapiens
cggtttgccatgttgccaga

SEQ ID NO: 988849 - DNA, 12 bp, Homo sapiens
cggtttgtgaga

SEQ ID NO: 988850 - DNA, 16 bp, Homo sapiens
cggttttactgcagct

SEQ ID NO: 988851 - DNA, 14 bp, Homo sapiens
cgtaaagaattttc

SEQ ID NO: 988852 - DNA, 20 bp, Homo sapiens
cgtaaatacacaacacacac

SEQ ID NO: 988853 - DNA, 13 bp, Homo sapiens
cgtaagcagtata

SEQ ID NO: 988854 - DNA, 23 bp, Homo sapiens
cgtaagcagtatattagtattat

SEQ ID NO: 988855 - DNA, 14 bp, Homo sapiens
cgtaataattatta

SEQ ID NO: 988856 - DNA, 19 bp, Homo sapiens
cgtaataggaatcaccctc

SEQ ID NO: 988857 - DNA, 13 bp, Homo sapiens
cgtaatgcttaga

SEQ ID NO: 988858 - DNA, 21 bp, Homo sapiens
cgtaatgcttagagaatgttc

SEQ ID NO: 988859 - DNA, 17 bp, Homo sapiens
cgtaatgggcctgccca

SEQ ID NO: 988860 - DNA, 16 bp, Homo sapiens
cgtaattaaaagaatt

SEQ ID NO: 988861 - DNA, 13 bp, Homo sapiens
cgtacacagagaa

SEQ ID NO: 988862 - DNA, 17 bp, Homo sapiens
cgtacattcaatgttta

SEQ ID NO: 988863 - DNA, 15 bp, Homo sapiens
cgtaccccaccctca

SEQ ID NO: 988864 - DNA, 15 bp, Homo sapiens
cgtacgcccaggaca

SEQ ID NO: 988865 - DNA, 18 bp, Homo sapiens
cgtactacggagaaactc

SEQ ID NO: 988866 - DNA, 21 bp, Homo sapiens
cgtactaggttggacagcccc

SEQ ID NO: 988867 - DNA, 22 bp, Homo sapiens
cgtactaggttggacagccccc

SEQ ID NO: 988868 - DNA, 13 bp, Homo sapiens
cgtactccactgg

SEQ ID NO: 988869 - DNA, 18 bp, Homo sapiens
cgtactcggcttcctgtg

SEQ ID NO: 988870 - DNA, 12 bp, Homo sapiens
cgtactgtaact

SEQ ID NO: 988871 - DNA, 14 bp, Homo sapiens
cgtacttataaaga

SEQ ID NO: 988872 - DNA, 13 bp, Homo sapiens
cgtagaagctctt

SEQ ID NO: 988873 - DNA, 14 bp, Homo sapiens
cgtagaagctcttg

SEQ ID NO: 988874 - DNA, 13 bp, Homo sapiens
cgtagagaatgtg

SEQ ID NO: 988875 - DNA, 22 bp, Homo sapiens
cgtagcttctaccatgaacaga

SEQ ID NO: 988876 - DNA, 21 bp, Homo sapiens
cgtaggcagcctctctgctat

SEQ ID NO: 988877 - DNA, 12 bp, Homo sapiens
cgtaggtaaact

SEQ ID NO: 988878 - DNA, 13 bp, Homo sapiens
cgtagtctcctgg

SEQ ID NO: 988879 - DNA, 14 bp, Homo sapiens
cgtagttccctgaa

SEQ ID NO: 988880 - DNA, 22 bp, Homo sapiens
cgtagttccctgaaaacccaga

SEQ ID NO: 988881 - DNA, 16 bp, Homo sapiens
cgtataatgctttctg

SEQ ID NO: 988882 - DNA, 16 bp, Homo sapiens
cgtataggcatgtaaa

SEQ ID NO: 988883 - DNA, 16 bp, Homo sapiens
cgtatcccgagtctgg

SEQ ID NO: 988884 - DNA, 19 bp, Homo sapiens
cgtatctccctggagaagc

SEQ ID NO: 988885 - DNA, 21 bp, Homo sapiens
cgtatctccctggagaagcac

SEQ ID NO: 988886 - DNA, 20 bp, Homo sapiens
cgtatctgtcacaataaatg

SEQ ID NO: 988887 - DNA, 14 bp, Homo sapiens
cgtatgaatgatat

SEQ ID NO: 988888 - DNA, 17 bp, Homo sapiens
cgtatgaatgatatctt

SEQ ID NO: 988889 - DNA, 16 bp, Homo sapiens
cgtatgtctgttacca

SEQ ID NO: 988890 - DNA, 23 bp, Homo sapiens
cgtatttaatagcaaagaattga

SEQ ID NO: 988891 - DNA, 16 bp, Homo sapiens
cgtatttatatttgga

SEQ ID NO: 988892 - DNA, 21 bp, Homo sapiens
cgtcaaaacagattgtttgca

SEQ ID NO: 988893 - DNA, 12 bp, Homo sapiens
cgtcaagacatt

SEQ ID NO: 988894 - DNA, 13 bp, Homo sapiens
cgtcaccaccacc

SEQ ID NO: 988895 - DNA, 14 bp, Homo sapiens
cgtcaccacctctc

SEQ ID NO: 988896 - DNA, 18 bp, Homo sapiens
cgtcaccacgactggcca

SEQ ID NO: 988897 - DNA, 19 bp, Homo sapiens
cgtcaccatccaccttccc

SEQ ID NO: 988898 - DNA, 16 bp, Homo sapiens
cgtcacgctccctgac

SEQ ID NO: 988899 - DNA, 19 bp, Homo sapiens
cgtcacgctttcatgacca

SEQ ID NO: 988900 - DNA, 20 bp, Homo sapiens
cgtcactgcccaccaaaggt

SEQ ID NO: 988901 - DNA, 21 bp, Homo sapiens
cgtcagccacctgggaacaca

SEQ ID NO: 988902 - DNA, 19 bp, Homo sapiens
cgtcagcgggcgctgctgg

SEQ ID NO: 988903 - DNA, 20 bp, Homo sapiens
cgtcagctgcttctgctgcc

SEQ ID NO: 988904 - DNA, 14 bp, Homo sapiens
cgtcaggccctgac

SEQ ID NO: 988905 - DNA, 21 bp, Homo sapiens
cgtcagggagaggtcaccagc

SEQ ID NO: 988906 - DNA, 19 bp, Homo sapiens
cgtcagtttcactccctct

SEQ ID NO: 988907 - DNA, 22 bp, Homo sapiens
cgtcagtttcactccctcttgg

SEQ ID NO: 988908 - DNA, 16 bp, Homo sapiens
cgtcatccatgccctc

SEQ ID NO: 988909 - DNA, 19 bp, Homo sapiens
cgtcatccatgccctccca

SEQ ID NO: 988910 - DNA, 13 bp, Homo sapiens
cgtcatgtctcta

SEQ ID NO: 988911 - DNA, 15 bp, Homo sapiens
cgtcatgttcctcaa

SEQ ID NO: 988912 - DNA, 15 bp, Homo sapiens
cgtcattgctgctgc

SEQ ID NO: 988913 - DNA, 16 bp, Homo sapiens
cgtcattgctgctgct

SEQ ID NO: 988914 - DNA, 20 bp, Homo sapiens
cgtcattgctgctgctacca

SEQ ID NO: 988915 - DNA, 19 bp, Homo sapiens
cgtccacaggggcaggcct

SEQ ID NO: 988916 - DNA, 20 bp, Homo sapiens
cgtccacaggggcaggcctg

SEQ ID NO: 988917 - DNA, 22 bp, Homo sapiens
cgtccacaggggcaggcctggg

SEQ ID NO: 988918 - DNA, 13 bp, Homo sapiens
cgtccacccaggc

SEQ ID NO: 988919 - DNA, 12 bp, Homo sapiens
cgtccaccccag

SEQ ID NO: 988920 - DNA, 14 bp, Homo sapiens
cgtccacccttcca

SEQ ID NO: 988921 - DNA, 21 bp, Homo sapiens
cgtccagccgccattgccacc

SEQ ID NO: 988922 - DNA, 17 bp, Homo sapiens
cgtccagctgcccttcc

SEQ ID NO: 988923 - DNA, 21 bp, Homo sapiens
cgtccaggttcaacccacagc

SEQ ID NO: 988924 - DNA, 19 bp, Homo sapiens
cgtccatccgactgcccct

SEQ ID NO: 988925 - DNA, 16 bp, Homo sapiens
cgtccatggcaccagc

SEQ ID NO: 988926 - DNA, 17 bp, Homo sapiens
cgtccatggcaccagcc

SEQ ID NO: 988927 - DNA, 18 bp, Homo sapiens
cgtccatggcaccagccc

SEQ ID NO: 988928 - DNA, 15 bp, Homo sapiens
cgtcccagcatccct

SEQ ID NO: 988929 - DNA, 14 bp, Homo sapiens
cgtcccagcggcct

SEQ ID NO: 988930 - DNA, 15 bp, Homo sapiens
cgtcccagggctctg

SEQ ID NO: 988931 - DNA, 17 bp, Homo sapiens
cgtcccatatcctgcct

SEQ ID NO: 988932 - DNA, 16 bp, Homo sapiens
cgtccccaaacctagc

SEQ ID NO: 988933 - DNA, 14 bp, Homo sapiens
cgtccccactccct

SEQ ID NO: 988934 - DNA, 17 bp, Homo sapiens
cgtccccccccaacctt

SEQ ID NO: 988935 - DNA, 22 bp, Homo sapiens
cgtccccccccaacctttccct

SEQ ID NO: 988936 - DNA, 21 bp, Homo sapiens
cgtccccccccaggccctccc

SEQ ID NO: 988937 - DNA, 13 bp, Homo sapiens
cgtccccctccct

SEQ ID NO: 988938 - DNA, 16 bp, Homo sapiens
cgtccccctccctgcc

SEQ ID NO: 988939 - DNA, 14 bp, Homo sapiens
cgtcccctctcccc

SEQ ID NO: 988940 - DNA, 13 bp, Homo sapiens
cgtcccctgcagc

SEQ ID NO: 988941 - DNA, 14 bp, Homo sapiens
cgtcccctgcagcc

SEQ ID NO: 988942 - DNA, 18 bp, Homo sapiens
cgtcccctgcagcctggg

SEQ ID NO: 988943 - DNA, 13 bp, Homo sapiens
cgtcccctgctac

SEQ ID NO: 988944 - DNA, 15 bp, Homo sapiens
cgtcccgcacagtgg

SEQ ID NO: 988945 - DNA, 14 bp, Homo sapiens
cgtcccgccagtgc

SEQ ID NO: 988946 - DNA, 18 bp, Homo sapiens
cgtcccgctgcctcctgc

SEQ ID NO: 988947 - DNA, 14 bp, Homo sapiens
cgtcccgctgctgt

SEQ ID NO: 988948 - DNA, 15 bp, Homo sapiens
cgtcctccccctgcc

SEQ ID NO: 988949 - DNA, 17 bp, Homo sapiens
cgtcctccccctgccag

SEQ ID NO: 988950 - DNA, 14 bp, Homo sapiens
cgtcctccctcagc

SEQ ID NO: 988951 - DNA, 18 bp, Homo sapiens
cgtcctccctcagcctcc

SEQ ID NO: 988952 - DNA, 19 bp, Homo sapiens
cgtcctccctcagcctccc

SEQ ID NO: 988953 - DNA, 21 bp, Homo sapiens
cgtcctccctgatcccacccc

SEQ ID NO: 988954 - DNA, 12 bp, Homo sapiens
cgtcctcctctg

SEQ ID NO: 988955 - DNA, 14 bp, Homo sapiens
cgtcctcctctgtg

SEQ ID NO: 988956 - DNA, 20 bp, Homo sapiens
cgtcctgacgccctgcgttg

SEQ ID NO: 988957 - DNA, 14 bp, Homo sapiens
gttggcaaaaaggc

SEQ ID NO: 988958 - DNA, 14 bp, Homo sapiens
gttggcaagctgca

SEQ ID NO: 988959 - DNA, 15 bp, Homo sapiens
gttggcaagctgcag

SEQ ID NO: 988960 - DNA, 20 bp, Homo sapiens
gttggcactcacagacctgg

SEQ ID NO: 988961 - DNA, 22 bp, Homo sapiens
gttggcagagcttttgcatttc

SEQ ID NO: 988962 - DNA, 12 bp, Homo sapiens
gttggcaggccc

SEQ ID NO: 988963 - DNA, 14 bp, Homo sapiens
gttggcaggcccac

SEQ ID NO: 988964 - DNA, 16 bp, Homo sapiens
gttggcaggcccactc

SEQ ID NO: 988965 - DNA, 16 bp, Homo sapiens
gttggcaggctggcca

SEQ ID NO: 988966 - DNA, 20 bp, Homo sapiens
gttggcaggctggccagtcc

SEQ ID NO: 988967 - DNA, 19 bp, Homo sapiens
gttggcatagctctggggt

SEQ ID NO: 988968 - DNA, 16 bp, Homo sapiens
gttggccaagcagaaa

SEQ ID NO: 988969 - DNA, 19 bp, Homo sapiens
gttggccagattgtggggt

SEQ ID NO: 988970 - DNA, 21 bp, Homo sapiens
gttggccagattgtggggtgc

SEQ ID NO: 988971 - DNA, 13 bp, Homo sapiens
gttggccaggagg

SEQ ID NO: 988972 - DNA, 14 bp, Homo sapiens
gttggccaggctgg

SEQ ID NO: 988973 - DNA, 14 bp, Homo sapiens
gttggccatggtga

SEQ ID NO: 988974 - DNA, 18 bp, Homo sapiens
gttggcccttgtcttttc

SEQ ID NO: 988975 - DNA, 18 bp, Homo sapiens
gttggcgtgccctggagg

SEQ ID NO: 988976 - DNA, 14 bp, Homo sapiens
gttggctcaggcag

SEQ ID NO: 988977 - DNA, 15 bp, Homo sapiens
gttggctcaggcaga

SEQ ID NO: 988978 - DNA, 16 bp, Homo sapiens
gttggctgggcccaga

SEQ ID NO: 988979 - DNA, 19 bp, Homo sapiens
gttggctgtgtgacagaat

SEQ ID NO: 988980 - DNA, 12 bp, Homo sapiens
gttggctgtgtt

SEQ ID NO: 988981 - DNA, 13 bp, Homo sapiens
gttggctgttcca

SEQ ID NO: 988982 - DNA, 16 bp, Homo sapiens
gttggctttcataaat

SEQ ID NO: 988983 - DNA, 20 bp, Homo sapiens
gttggctttgcccacccctc

SEQ ID NO: 988984 - DNA, 17 bp, Homo sapiens
gttgggaaggggtcctg

SEQ ID NO: 988985 - DNA, 14 bp, Homo sapiens
gttgggactcagga

SEQ ID NO: 988986 - DNA, 14 bp, Homo sapiens
gttgggagcactgg

SEQ ID NO: 988987 - DNA, 15 bp, Homo sapiens
gttgggagcactgga

SEQ ID NO: 988988 - DNA, 18 bp, Homo sapiens
gttgggaggatacagagg

SEQ ID NO: 988989 - DNA, 19 bp, Homo sapiens
gttgggattcctgacccag

SEQ ID NO: 988990 - DNA, 21 bp, Homo sapiens
gttgggattgggggctggtgc

SEQ ID NO: 988991 - DNA, 19 bp, Homo sapiens
gttgggcagccagaccagc

SEQ ID NO: 988992 - DNA, 19 bp, Homo sapiens
gttgggccgaaagagagag

SEQ ID NO: 988993 - DNA, 12 bp, Homo sapiens
gttggggaaggc

SEQ ID NO: 988994 - DNA, 14 bp, Homo sapiens
gttggggcaaagcc

SEQ ID NO: 988995 - DNA, 17 bp, Homo sapiens
gttggggcaaagcctcc

SEQ ID NO: 988996 - DNA, 16 bp, Homo sapiens
tgtgttgccaagctcc

SEQ ID NO: 988997 - DNA, 13 bp, Homo sapiens
tgtgttggaaact

SEQ ID NO: 988998 - DNA, 12 bp, Homo sapiens
tgtgttgtatta

SEQ ID NO: 988999 - DNA, 21 bp, Homo sapiens
tgtgttgtgtgagcgtggcct

SEQ ID NO: 989000 - DNA, 13 bp, Homo sapiens
tgtgttgttgctt

SEQ ID NO: 989001 - DNA, 13 bp, Homo sapiens
tgtgttgtttaat

SEQ ID NO: 989002 - DNA, 19 bp, Homo sapiens
tgtgttgttttttgttcaa

SEQ ID NO: 989003 - DNA, 23 bp, Homo sapiens
tgtgtttaaaaattgaaaaaagt

SEQ ID NO: 989004 - DNA, 13 bp, Homo sapiens
tgtgtttactttt

SEQ ID NO: 989005 - DNA, 15 bp, Homo sapiens
tgtgtttaggcctca

SEQ ID NO: 989006 - DNA, 21 bp, Homo sapiens
tgtgtttcaaaaccatgcctg

SEQ ID NO: 989007 - DNA, 22 bp, Homo sapiens
tgtgtttcgcattaagcacaca

SEQ ID NO: 989008 - DNA, 10 bp, Homo sapiens
tgtgtttcta

SEQ ID NO: 989009 - DNA, 14 bp, Homo sapiens
tgtgtttctgacac

SEQ ID NO: 989010 - DNA, 12 bp, Homo sapiens
tgtgtttgacat

SEQ ID NO: 989011 - DNA, 15 bp, Homo sapiens
tgtgtttgctgcctt

SEQ ID NO: 989012 - DNA, 17 bp, Homo sapiens
tgtgtttggcttggcct

SEQ ID NO: 989013 - DNA, 18 bp, Homo sapiens
tgtgtttggcttggcctt

SEQ ID NO: 989014 - DNA, 16 bp, Homo sapiens
tgtgtttgtcctgggt

SEQ ID NO: 989015 - DNA, 14 bp, Homo sapiens
tgtgtttgttccta

SEQ ID NO: 989016 - DNA, 20 bp, Homo sapiens
tgtgtttgttctttttattg

SEQ ID NO: 989017 - DNA, 21 bp, Homo sapiens
tgtgttttaaaaaaactgaag

SEQ ID NO: 989018 - DNA, 20 bp, Homo sapiens
tgtgttttaattttctttat

SEQ ID NO: 989019 - DNA, 21 bp, Homo sapiens
tgtgttttaattttctttatg

SEQ ID NO: 989020 - DNA, 20 bp, Homo sapiens
tgtgttttcccaaagcactt

SEQ ID NO: 989021 - DNA, 13 bp, Homo sapiens
tgtgttttctgta

SEQ ID NO: 989022 - DNA, 15 bp, Homo sapiens
tgtgttttctttggt

SEQ ID NO: 989023 - DNA, 23 bp, Homo sapiens
tgtgttttgcacgtcttgctatt

SEQ ID NO: 989024 - DNA, 16 bp, Homo sapiens
tgtgttttggttaata

SEQ ID NO: 989025 - DNA, 18 bp, Homo sapiens
tgtgttttgtcctgcctc

SEQ ID NO: 989026 - DNA, 15 bp, Homo sapiens
tgtgtttttaataaa

SEQ ID NO: 989027 - DNA, 14 bp, Homo sapiens
tgtgtttttattgt

SEQ ID NO: 989028 - DNA, 13 bp, Homo sapiens
tgtgtttttgaaa

SEQ ID NO: 989029 - DNA, 17 bp, Homo sapiens
tgtgttttttaagatag

SEQ ID NO: 989030 - DNA, 19 bp, Homo sapiens
tgttaaaaaatttttgaaa

SEQ ID NO: 989031 - DNA, 15 bp, Homo sapiens
tgttaaaagattttt

SEQ ID NO: 989032 - DNA, 15 bp, Homo sapiens
tgttaaaatgtacac

SEQ ID NO: 989033 - DNA, 21 bp, Homo sapiens
tgttaaaattatcaatatcta

SEQ ID NO: 989034 - DNA, 20 bp, Homo sapiens
tgttaaacagtagttgtatt

SEQ ID NO: 989035 - DNA, 19 bp, Homo sapiens
tgttaaagctggaacattt

SEQ ID NO: 989036 - DNA, 17 bp, Homo sapiens
tgttaaagctgtacacc

SEQ ID NO: 989037 - DNA, 12 bp, Homo sapiens
tgttaaagctta

SEQ ID NO: 989038 - DNA, 16 bp, Homo sapiens
tgttaaatacaggaaa

SEQ ID NO: 989039 - DNA, 18 bp, Homo sapiens
tgttaaatacaggaaaca

SEQ ID NO: 989040 - DNA, 12 bp, Homo sapiens
tgttaaatactg

SEQ ID NO: 989041 - DNA, 14 bp, Homo sapiens
tgttaaatactgtg

SEQ ID NO: 989042 - DNA, 16 bp, Homo sapiens
tgttaaatactgtgca

SEQ ID NO: 989043 - DNA, 14 bp, Homo sapiens
tgttaaatgaaacc

SEQ ID NO: 989044 - DNA, 12 bp, Homo sapiens
tgttaaattcat

SEQ ID NO: 989045 - DNA, 16 bp, Homo sapiens
tgttaaattcatttta

SEQ ID NO: 989046 - DNA, 21 bp, Homo sapiens
tgttaacaagaggggaaaaca

SEQ ID NO: 989047 - DNA, 14 bp, Homo sapiens
tgttaacaatgcct

SEQ ID NO: 989048 - DNA, 15 bp, Homo sapiens
tgttaacagtatttc

SEQ ID NO: 989049 - DNA, 21 bp, Homo sapiens
tgttaacatggacatgatctt

SEQ ID NO: 989050 - DNA, 15 bp, Homo sapiens
tgttaacctcagtgt

SEQ ID NO: 989051 - DNA, 17 bp, Homo sapiens
tgttaaccttaaataca

SEQ ID NO: 989052 - DNA, 14 bp, Homo sapiens
tgttaactgaatac

SEQ ID NO: 989053 - DNA, 22 bp, Homo sapiens
tgttaactgaataccactctgt

SEQ ID NO: 989054 - DNA, 13 bp, Homo sapiens
tgttaactgccaa

SEQ ID NO: 989055 - DNA, 15 bp, Homo sapiens
tgttaacttattcaa

SEQ ID NO: 989056 - DNA, 23 bp, Homo sapiens
tgttaacttattcaaagagaaaa

SEQ ID NO: 989057 - DNA, 19 bp, Homo sapiens
tgttaagaaaaactacagc

SEQ ID NO: 989058 - DNA, 23 bp, Homo sapiens
tgttaagaattgaccatctgctt

SEQ ID NO: 989059 - DNA, 17 bp, Homo sapiens
tgttaagacttgacagt

SEQ ID NO: 989060 - DNA, 21 bp, Homo sapiens
tgttaagataacttactgtat

SEQ ID NO: 989061 - DNA, 23 bp, Homo sapiens
tgttaagcagctaaattttctga

SEQ ID NO: 989062 - DNA, 20 bp, Homo sapiens
tgttaaggacttctgcagct

SEQ ID NO: 989063 - DNA, 16 bp, Homo sapiens
tgttaagggcattttt

SEQ ID NO: 989064 - DNA, 19 bp, Homo sapiens
tgttaatacacagtacttt

SEQ ID NO: 989065 - DNA, 20 bp, Homo sapiens
tgttaatacacagtacttta

SEQ ID NO: 989066 - DNA, 21 bp, Homo sapiens
tgttaatacacagtactttat

SEQ ID NO: 989067 - DNA, 20 bp, Homo sapiens
tgttaatataccccaaattg

SEQ ID NO: 989068 - DNA, 16 bp, Homo sapiens
tgttaatatcttcaca

SEQ ID NO: 989069 - DNA, 17 bp, Homo sapiens
tgttaatcttaatgtat

SEQ ID NO: 989070 - DNA, 16 bp, Homo sapiens
tgttaatgctctatgt

SEQ ID NO: 989071 - DNA, 17 bp, Homo sapiens
tgttaatgtcattgcta

SEQ ID NO: 989072 - DNA, 18 bp, Homo sapiens
tgttaattataggagcct

SEQ ID NO: 989073 - DNA, 22 bp, Homo sapiens
tgttaattcagcactgatttca

SEQ ID NO: 989074 - DNA, 15 bp, Homo sapiens
tgttaatttagaaaa

SEQ ID NO: 989075 - DNA, 18 bp, Homo sapiens
tgttaatttagaaaactt

SEQ ID NO: 989076 - DNA, 20 bp, Homo sapiens
tgttaatttagaaaacttta

SEQ ID NO: 989077 - DNA, 14 bp, Homo sapiens
tgttaatttataat

SEQ ID NO: 989078 - DNA, 18 bp, Homo sapiens
tgttaatttataatgtat

SEQ ID NO: 989079 - DNA, 19 bp, Homo sapiens
tgttaatttataatgtatt

SEQ ID NO: 989080 - DNA, 21 bp, Homo sapiens
tctcctgctgccttttctgga

SEQ ID NO: 989081 - DNA, 15 bp, Homo sapiens
tctcctgctgctcct

SEQ ID NO: 989082 - DNA, 17 bp, Homo sapiens
tctcctggaggcagggg

SEQ ID NO: 989083 - DNA, 18 bp, Homo sapiens
tctcctggaggcaggggc

SEQ ID NO: 989084 - DNA, 23 bp, Homo sapiens
tctcctggaggctggttctgctg

SEQ ID NO: 989085 - DNA, 21 bp, Homo sapiens
tctcctggcctatccgctgcc

SEQ ID NO: 989086 - DNA, 23 bp, Homo sapiens
tctcctggcctatccgctgccag

SEQ ID NO: 989087 - DNA, 21 bp, Homo sapiens
tctcctgggaaacctgccttt

SEQ ID NO: 989088 - DNA, 18 bp, Homo sapiens
tctcctgggggtggcagg

SEQ ID NO: 989089 - DNA, 22 bp, Homo sapiens
tctcctgggggtggcaggcaca

SEQ ID NO: 989090 - DNA, 15 bp, Homo sapiens
tctcctggtgttctg

SEQ ID NO: 989091 - DNA, 22 bp, Homo sapiens
tctcctgtcttatggtccagaa

SEQ ID NO: 989092 - DNA, 23 bp, Homo sapiens
tctcctgtcttatggtccagaaa

SEQ ID NO: 989093 - DNA, 12 bp, Homo sapiens
tctcctgtgacc

SEQ ID NO: 989094 - DNA, 23 bp, Homo sapiens
tctcctgtgcatgggtgaaggga

SEQ ID NO: 989095 - DNA, 17 bp, Homo sapiens
tctcctgtgcccacatc

SEQ ID NO: 989096 - DNA, 20 bp, Homo sapiens
tctcctgtttattcccatct

SEQ ID NO: 989097 - DNA, 13 bp, Homo sapiens
tctcctgtttgtt

SEQ ID NO: 989098 - DNA, 19 bp, Homo sapiens
tctcctgtttttctgggtg

SEQ ID NO: 989099 - DNA, 16 bp, Homo sapiens
tctccttacctctgga

SEQ ID NO: 989100 - DNA, 17 bp, Homo sapiens
tctccttacctctggaa

SEQ ID NO: 989101 - DNA, 18 bp, Homo sapiens
tctccttactctgagccc

SEQ ID NO: 989102 - DNA, 19 bp, Homo sapiens
tctccttactctgagccca

SEQ ID NO: 989103 - DNA, 21 bp, Homo sapiens
tctccttactctgagcccagg

SEQ ID NO: 989104 - DNA, 22 bp, Homo sapiens
tctccttactctgagcccaggc

SEQ ID NO: 989105 - DNA, 15 bp, Homo sapiens
tctccttagttggct

SEQ ID NO: 989106 - DNA, 18 bp, Homo sapiens
tctccttagttggctgga

SEQ ID NO: 989107 - DNA, 21 bp, Homo sapiens
tctccttcatgacagcctcca

SEQ ID NO: 989108 - DNA, 14 bp, Homo sapiens
tctccttccattca

SEQ ID NO: 989109 - DNA, 19 bp, Homo sapiens
tctccttcccctttcccca

SEQ ID NO: 989110 - DNA, 16 bp, Homo sapiens
tctccttctcctagct

SEQ ID NO: 989111 - DNA, 16 bp, Homo sapiens
tctccttggccacaga

SEQ ID NO: 989112 - DNA, 16 bp, Homo sapiens
tctccttgggctcctg

SEQ ID NO: 989113 - DNA, 19 bp, Homo sapiens
tctccttgggctcctggct

SEQ ID NO: 989114 - DNA, 21 bp, Homo sapiens
tctccttgggctcctggctgc

SEQ ID NO: 989115 - DNA, 22 bp, Homo sapiens
tctccttgggctcctggctgcc

SEQ ID NO: 989116 - DNA, 23 bp, Homo sapiens
tctccttgggctcctggctgcca

SEQ ID NO: 989117 - DNA, 21 bp, Homo sapiens
tctccttgtgttactaagttt

SEQ ID NO: 989118 - DNA, 14 bp, Homo sapiens
tctcctttcaggga

SEQ ID NO: 989119 - DNA, 14 bp, Homo sapiens
tctcctttcagggc

SEQ ID NO: 989120 - DNA, 14 bp, Homo sapiens
tctcctttctgact

SEQ ID NO: 989121 - DNA, 15 bp, Homo sapiens
tctcctttctgactg

SEQ ID NO: 989122 - DNA, 19 bp, Homo sapiens
tctcctttctgactgtccc

SEQ ID NO: 989123 - DNA, 22 bp, Homo sapiens
tctccttttatctggtgcctcc

SEQ ID NO: 989124 - DNA, 14 bp, Homo sapiens
tctccttttgaact

SEQ ID NO: 989125 - DNA, 17 bp, Homo sapiens
tctccttttgaacttgt

SEQ ID NO: 989126 - DNA, 19 bp, Homo sapiens
tctccttttgaacttgtca

SEQ ID NO: 989127 - DNA, 22 bp, Homo sapiens
tctcctttttattttaggcact

SEQ ID NO: 989128 - DNA, 14 bp, Homo sapiens
tctcgaactcctgg

SEQ ID NO: 989129 - DNA, 15 bp, Homo sapiens
tctcgagccccctgg

SEQ ID NO: 989130 - DNA, 14 bp, Homo sapiens
tctcgatctcctga

SEQ ID NO: 989131 - DNA, 13 bp, Homo sapiens
tctcgcagcctga

SEQ ID NO: 989132 - DNA, 15 bp, Homo sapiens
tctcgccatgatcag

SEQ ID NO: 989133 - DNA, 14 bp, Homo sapiens
tctcgcgccctccc

SEQ ID NO: 989134 - DNA, 17 bp, Homo sapiens
tctcgcgccctccccca

SEQ ID NO: 989135 - DNA, 17 bp, Homo sapiens
tctcgctctgttgccca

SEQ ID NO: 989136 - DNA, 17 bp, Homo sapiens
tctcggaaggctggctg

SEQ ID NO: 989137 - DNA, 16 bp, Homo sapiens
tctcggagccctcaga

SEQ ID NO: 989138 - DNA, 18 bp, Homo sapiens
tctcggatgaccaaacca

SEQ ID NO: 989139 - DNA, 20 bp, Homo sapiens
tctcggatgaccaaaccagc

SEQ ID NO: 989140 - DNA, 23 bp, Homo sapiens
tctcggccagcccgtcctcctct

SEQ ID NO: 989141 - DNA, 18 bp, Homo sapiens
tctcggccccatcgcccc

SEQ ID NO: 989142 - DNA, 14 bp, Homo sapiens
tctcgggagaggat

SEQ ID NO: 989143 - DNA, 14 bp, Homo sapiens
tctcgggtgcattt

SEQ ID NO: 989144 - DNA, 16 bp, Homo sapiens
tctcgtccccctccct

SEQ ID NO: 989145 - DNA, 22 bp, Homo sapiens
tctcgtccccctccctgcccaa

SEQ ID NO: 989146 - DNA, 14 bp, Homo sapiens
tctcgtctttactt

SEQ ID NO: 989147 - DNA, 17 bp, Homo sapiens
tctcgtggtagaagcca

SEQ ID NO: 989148 - DNA, 15 bp, Homo sapiens
tctcgtgtacagctc

SEQ ID NO: 989149 - DNA, 23 bp, Homo sapiens
tctcgtgtacagctcccttccct

SEQ ID NO: 989150 - DNA, 19 bp, Homo sapiens
tctcgtgtcagtaatttat

SEQ ID NO: 989151 - DNA, 15 bp, Homo sapiens
tctcgtgtttgctta

SEQ ID NO: 989152 - DNA, 12 bp, Homo sapiens
tctcgtttttct

SEQ ID NO: 989153 - DNA, 16 bp, Homo sapiens
tctctaaactggtaca

SEQ ID NO: 989154 - DNA, 14 bp, Homo sapiens
tctctaacagtgga

SEQ ID NO: 989155 - DNA, 20 bp, Homo sapiens
tctctaacagtggacaaagt

SEQ ID NO: 989156 - DNA, 22 bp, Homo sapiens
tctctaactcagaaacatcagt

SEQ ID NO: 989157 - DNA, 19 bp, Homo sapiens
tctctaacttcaccatatt

SEQ ID NO: 989158 - DNA, 13 bp, Homo sapiens
tctctaagccaca

SEQ ID NO: 989159 - DNA, 16 bp, Homo sapiens
tctctaagccacagct

SEQ ID NO: 989160 - DNA, 17 bp, Homo sapiens
tctctaagccacagctt

SEQ ID NO: 989161 - DNA, 16 bp, Homo sapiens
tctctaagttccactg

SEQ ID NO: 989162 - DNA, 15 bp, Homo sapiens
tctctaataataaat

SEQ ID NO: 989163 - DNA, 22 bp, Homo sapiens
tctctaataataaatagttctt

SEQ ID NO: 989164 - DNA, 23 bp, Homo sapiens
tctctaatgagctagtgtcttat

SEQ ID NO: 989165 - DNA, 15 bp, Homo sapiens
tctctacaaaaagca

SEQ ID NO: 989166 - DNA, 22 bp, Homo sapiens
tctctacaggcctcttcctgtt

SEQ ID NO: 989167 - DNA, 14 bp, Homo sapiens
tctctacagtgcca

SEQ ID NO: 989168 - DNA, 20 bp, Homo sapiens
tctctaccactgctgatatt

SEQ ID NO: 989169 - DNA, 12 bp, Homo sapiens
tctctacctcca

SEQ ID NO: 989170 - DNA, 17 bp, Homo sapiens
tctctacctccaccctg

SEQ ID NO: 989171 - DNA, 15 bp, Homo sapiens
tctctactaaaaata

SEQ ID NO: 989172 - DNA, 17 bp, Homo sapiens
tctctactaaaaatgca

SEQ ID NO: 989173 - DNA, 17 bp, Homo sapiens
tctctactaccacaagg

SEQ ID NO: 989174 - DNA, 20 bp, Homo sapiens
tctctactaccacaaggaaa

SEQ ID NO: 989175 - DNA, 12 bp, Homo sapiens
tctctactgaaa

SEQ ID NO: 989176 - DNA, 15 bp, Homo sapiens
tctctactggagtgg

SEQ ID NO: 989177 - DNA, 15 bp, Homo sapiens
tctctacttcccctt

SEQ ID NO: 989178 - DNA, 22 bp, Homo sapiens
tctctacttccccttcttgcca

SEQ ID NO: 989179 - DNA, 17 bp, Homo sapiens
tctctagaattttaagt

SEQ ID NO: 989180 - DNA, 14 bp, Homo sapiens
tctctagctcccca

SEQ ID NO: 989181 - DNA, 19 bp, Homo sapiens
tctctagctgttctggact

SEQ ID NO: 989182 - DNA, 19 bp, Homo sapiens
tctctgcatctactcccaa

SEQ ID NO: 989183 - DNA, 15 bp, Homo sapiens
tctctgcatctgacc

SEQ ID NO: 989184 - DNA, 16 bp, Homo sapiens
tctctgcatctgacca

SEQ ID NO: 989185 - DNA, 20 bp, Homo sapiens
tctctgcatttaaaaaaatc

SEQ ID NO: 989186 - DNA, 12 bp, Homo sapiens
tctctgccaccc

SEQ ID NO: 989187 - DNA, 13 bp, Homo sapiens
tctctgccaccca

SEQ ID NO: 989188 - DNA, 15 bp, Homo sapiens
tctctgccagtgaca

SEQ ID NO: 989189 - DNA, 23 bp, Homo sapiens
tctctgcctccctcaccctgagc

SEQ ID NO: 989190 - DNA, 15 bp, Homo sapiens
tctctgcctctcttc

SEQ ID NO: 989191 - DNA, 14 bp, Homo sapiens
tctctgcctgtaaa

SEQ ID NO: 989192 - DNA, 13 bp, Homo sapiens
tctctgctatata

SEQ ID NO: 989193 - DNA, 14 bp, Homo sapiens
tctctgctcatggg

SEQ ID NO: 989194 - DNA, 16 bp, Homo sapiens
tctctgctcatgggtg

SEQ ID NO: 989195 - DNA, 19 bp, Homo sapiens
tctctgctccaccacatcc

SEQ ID NO: 989196 - DNA, 22 bp, Homo sapiens
tctctgctcgccctcctttctg

SEQ ID NO: 989197 - DNA, 16 bp, Homo sapiens
tctctgctctagccag

SEQ ID NO: 989198 - DNA, 17 bp, Homo sapiens
tctctgctctagccagg

SEQ ID NO: 989199 - DNA, 21 bp, Homo sapiens
tctctgctctgcgtgtcacct

SEQ ID NO: 989200 - DNA, 21 bp, Homo sapiens
tctctgctgagctgggcccag

SEQ ID NO: 989201 - DNA, 14 bp, Homo sapiens
tctctgctgagggc

SEQ ID NO: 989202 - DNA, 15 bp, Homo sapiens
tctctgctgagggcc

SEQ ID NO: 989203 - DNA, 19 bp, Homo sapiens
tctctgctggcccagccaa

SEQ ID NO: 989204 - DNA, 17 bp, Homo sapiens
tctctgctggggaaggg

SEQ ID NO: 989205 - DNA, 15 bp, Homo sapiens
tctctgcttaccctt

SEQ ID NO: 989206 - DNA, 13 bp, Homo sapiens
tctctgcttaccg

SEQ ID NO: 989207 - DNA, 15 bp, Homo sapiens
tctctgcttgcctag

SEQ ID NO: 989208 - DNA, 14 bp, Homo sapiens
tctctgctttaaag

SEQ ID NO: 989209 - DNA, 13 bp, Homo sapiens
tctctgctttcct

SEQ ID NO: 989210 - DNA, 17 bp, Homo sapiens
tctcttctgctccaccc

SEQ ID NO: 989211 - DNA, 19 bp, Homo sapiens
tctcttctgctccaccctt

SEQ ID NO: 989212 - DNA, 20 bp, Homo sapiens
tctcttctgggttccttcct

SEQ ID NO: 989213 - DNA, 13 bp, Homo sapiens
tctcttctgtcca

SEQ ID NO: 989214 - DNA, 22 bp, Homo sapiens
tctcttcttccctgtcagcctg

SEQ ID NO: 989215 - DNA, 12 bp, Homo sapiens
tctcttcttgtt

SEQ ID NO: 989216 - DNA, 18 bp, Homo sapiens
tctcttctttattgcact

SEQ ID NO: 989217 - DNA, 13 bp, Homo sapiens
tctcttctttcca

SEQ ID NO: 989218 - DNA, 18 bp, Homo sapiens
tctcttcttttggcttcc

SEQ ID NO: 989219 - DNA, 14 bp, Homo sapiens
tctcttgagcctgg

SEQ ID NO: 989220 - DNA, 16 bp, Homo sapiens
tctcttgagctggcct

SEQ ID NO: 989221 - DNA, 14 bp, Homo sapiens
tctcttgaggcctg

SEQ ID NO: 989222 - DNA, 17 bp, Homo sapiens
tctcttgaggcctgtgc

SEQ ID NO: 989223 - DNA, 14 bp, Homo sapiens
tctcttgagtttgt

SEQ ID NO: 989224 - DNA, 15 bp, Homo sapiens
tctcttgcacccgcc

SEQ ID NO: 989225 - DNA, 13 bp, Homo sapiens
tctcttgcccctt

SEQ ID NO: 989226 - DNA, 15 bp, Homo sapiens
tctcttgccccttgt

SEQ ID NO: 989227 - DNA, 18 bp, Homo sapiens
tctcttgccccttgtcct

SEQ ID NO: 989228 - DNA, 12 bp, Homo sapiens
tctcttgccctt

SEQ ID NO: 989229 - DNA, 18 bp, Homo sapiens
tctcttgcccttcctact

SEQ ID NO: 989230 - DNA, 16 bp, Homo sapiens
tctcttgcctcagcct

SEQ ID NO: 989231 - DNA, 16 bp, Homo sapiens
tctcttggctttgtca

SEQ ID NO: 989232 - DNA, 23 bp, Homo sapiens
tctcttgggaactgaactcactt

SEQ ID NO: 989233 - DNA, 19 bp, Homo sapiens
tctcttgggagtcttgggt

SEQ ID NO: 989234 - DNA, 15 bp, Homo sapiens
tctcttgggcaggca

SEQ ID NO: 989235 - DNA, 17 bp, Homo sapiens
tctcttgggcaggcaga

SEQ ID NO: 989236 - DNA, 21 bp, Homo sapiens
tctcttggtgaaataataaaa

SEQ ID NO: 989237 - DNA, 16 bp, Homo sapiens
tctcttgtcctgtgat

SEQ ID NO: 989238 - DNA, 17 bp, Homo sapiens
tctcttgtgatttggtt

SEQ ID NO: 989239 - DNA, 16 bp, Homo sapiens
tctcttgtttgtctta

SEQ ID NO: 989240 - DNA, 18 bp, Homo sapiens
tctctttaaaaggaaaga

SEQ ID NO: 989241 - DNA, 21 bp, Homo sapiens
tctctttaaaaggaaagaaaa

SEQ ID NO: 989242 - DNA, 18 bp, Homo sapiens
ttaaattttttgttgaca

SEQ ID NO: 989243 - DNA, 22 bp, Homo sapiens
ttaacaaaaaacagattctata

SEQ ID NO: 989244 - DNA, 15 bp, Homo sapiens
ttaacaaaagcaaga

SEQ ID NO: 989245 - DNA, 18 bp, Homo sapiens
ttaacaaactcttcagtt

SEQ ID NO: 989246 - DNA, 22 bp, Homo sapiens
ttaacaaggaatgcctgtgcca

SEQ ID NO: 989247 - DNA, 21 bp, Homo sapiens
ttaacaatgcctattgtaata

SEQ ID NO: 989248 - DNA, 21 bp, Homo sapiens
ttaacaattgtcttaaaacca

SEQ ID NO: 989249 - DNA, 15 bp, Homo sapiens
ttaacactttgtatt

SEQ ID NO: 989250 - DNA, 17 bp, Homo sapiens
ttaacactttgtattac

SEQ ID NO: 989251 - DNA, 12 bp, Homo sapiens
ttaacagaaatg

SEQ ID NO: 989252 - DNA, 14 bp, Homo sapiens
ttaacagaaatgta

SEQ ID NO: 989253 - DNA, 15 bp, Homo sapiens
ttaacagaaattgta

SEQ ID NO: 989254 - DNA, 16 bp, Homo sapiens
ttaacagaaattgtat

SEQ ID NO: 989255 - DNA, 21 bp, Homo sapiens
ttaacagaaattgtatattgt

SEQ ID NO: 989256 - DNA, 18 bp, Homo sapiens
ttaacagtatttctcttt

SEQ ID NO: 989257 - DNA, 17 bp, Homo sapiens
ttaacagtcatttaaaa

SEQ ID NO: 989258 - DNA, 15 bp, Homo sapiens
ttaacagttgtattt

SEQ ID NO: 989259 - DNA, 21 bp, Homo sapiens
ttaacagttttccatgaaaac

SEQ ID NO: 989260 - DNA, 13 bp, Homo sapiens
ttaacataatggt

SEQ ID NO: 989261 - DNA, 22 bp, Homo sapiens
ttaacatacctaagaagtacat

SEQ ID NO: 989262 - DNA, 18 bp, Homo sapiens
ttaacatctttgttttta

SEQ ID NO: 989263 - DNA, 15 bp, Homo sapiens
ttaacatgaactctt

SEQ ID NO: 989264 - DNA, 16 bp, Homo sapiens
ttaacatgatttcaaa

SEQ ID NO: 989265 - DNA, 16 bp, Homo sapiens
ttaacattagatgtca

SEQ ID NO: 989266 - DNA, 21 bp, Homo sapiens
ttaacattctttttctgttga

SEQ ID NO: 989267 - DNA, 19 bp, Homo sapiens
ttaacattgaccaagaact

SEQ ID NO: 989268 - DNA, 21 bp, Homo sapiens
ttaacattgaccaagaactgc

SEQ ID NO: 989269 - DNA, 16 bp, Homo sapiens
ttaacattgtttttgt

SEQ ID NO: 989270 - DNA, 18 bp, Homo sapiens
ttaacatttcattgtaca

SEQ ID NO: 989271 - DNA, 12 bp, Homo sapiens
ttaacatttgcc

SEQ ID NO: 989272 - DNA, 14 bp, Homo sapiens
ttaaccaaaggtga

SEQ ID NO: 989273 - DNA, 18 bp, Homo sapiens
ttaaccactctacagact

SEQ ID NO: 989274 - DNA, 21 bp, Homo sapiens
ttaaccagtctgaagtttcat

SEQ ID NO: 989275 - DNA, 14 bp, Homo sapiens
ttaaccataaatca

SEQ ID NO: 989276 - DNA, 16 bp, Homo sapiens
ttaaccatccttaaat

SEQ ID NO: 989277 - DNA, 21 bp, Homo sapiens
ttaaccatttaataaagaaat

SEQ ID NO: 989278 - DNA, 18 bp, Homo sapiens
ttaaccccataattagat

SEQ ID NO: 989279 - DNA, 18 bp, Homo sapiens
ttaacccccctgtacaca

SEQ ID NO: 989280 - DNA, 20 bp, Homo sapiens
ttaacccccctgtacacaac

SEQ ID NO: 989281 - DNA, 15 bp, Homo sapiens
ttaaccctaatcttt

SEQ ID NO: 989282 - DNA, 15 bp, Homo sapiens
ttaacccttcatctt

SEQ ID NO: 989283 - DNA, 15 bp, Homo sapiens
ttaaccctttttcca

SEQ ID NO: 989284 - DNA, 19 bp, Homo sapiens
ttaacctctctaagccaca

SEQ ID NO: 989285 - DNA, 15 bp, Homo sapiens
ttaacctctgcacta

SEQ ID NO: 989286 - DNA, 15 bp, Homo sapiens
ttaacctctgctttt

SEQ ID NO: 989287 - DNA, 20 bp, Homo sapiens
ttaacctgggcattgttgag

SEQ ID NO: 989288 - DNA, 13 bp, Homo sapiens
ttaacctggtgct

SEQ ID NO: 989289 - DNA, 17 bp, Homo sapiens
ttaacctgttttgttaa

SEQ ID NO: 989290 - DNA, 23 bp, Homo sapiens
ttaaccttccaagactgaagact

SEQ ID NO: 989291 - DNA, 12 bp, Homo sapiens
ttaacctttgat

SEQ ID NO: 989292 - DNA, 21 bp, Homo sapiens
ttaacctttttgtaaatactg

SEQ ID NO: 989293 - DNA, 13 bp, Homo sapiens
ttaacgctgccta

SEQ ID NO: 989294 - DNA, 17 bp, Homo sapiens
ttaacgggcatgtatta

SEQ ID NO: 989295 - DNA, 13 bp, Homo sapiens
ttaacggtgctaa

SEQ ID NO: 989296 - DNA, 14 bp, Homo sapiens
ttaacggtgctaaa

SEQ ID NO: 989297 - DNA, 19 bp, Homo sapiens
ttaacgtggcttgtagaat

SEQ ID NO: 989298 - DNA, 14 bp, Homo sapiens
ttaacgtttctcat

SEQ ID NO: 989299 - DNA, 21 bp, Homo sapiens
ttaactaaataaacagatgta

SEQ ID NO: 989300 - DNA, 16 bp, Homo sapiens
ttaactaaatgctcat

SEQ ID NO: 989301 - DNA, 17 bp, Homo sapiens
ttaactaaattttaaag

SEQ ID NO: 989302 - DNA, 20 bp, Homo sapiens
ttaactaaattttaaagcca

SEQ ID NO: 989303 - DNA, 23 bp, Homo sapiens
ttaactaatatgggcattgtagt

SEQ ID NO: 989304 - DNA, 23 bp, Homo sapiens
ttaactaatctattgggttcatt

SEQ ID NO: 989305 - DNA, 15 bp, Homo sapiens
ttaactaatttgaat

SEQ ID NO: 989306 - DNA, 20 bp, Homo sapiens
ttaactaatttgaatgtggt

SEQ ID NO: 989307 - DNA, 18 bp, Homo sapiens
ttaactactatattgatt

SEQ ID NO: 989308 - DNA, 21 bp, Homo sapiens
ttaactactttactaaattaa

SEQ ID NO: 989309 - DNA, 19 bp, Homo sapiens
ttaactataaggtgcctca

SEQ ID NO: 989310 - DNA, 23 bp, Homo sapiens
ttaactcatctgttatcctgcta

SEQ ID NO: 989311 - DNA, 22 bp, Homo sapiens
ttaactcccattaccatgtaat

SEQ ID NO: 989312 - DNA, 23 bp, Homo sapiens
ttaactcccattaccatgtaatg

SEQ ID NO: 989313 - DNA, 13 bp, Homo sapiens
ttaactccctcca

SEQ ID NO: 989314 - DNA, 14 bp, Homo sapiens
ttaactccctccac

SEQ ID NO: 989315 - DNA, 18 bp, Homo sapiens
ttaactctggattttgaa

SEQ ID NO: 989316 - DNA, 19 bp, Homo sapiens
ttaactgaaaatgtaaatt

SEQ ID NO: 989317 - DNA, 22 bp, Homo sapiens
ttaactgaataccactctgtaa

SEQ ID NO: 989318 - DNA, 19 bp, Homo sapiens
ttaactgatttaacacttt

SEQ ID NO: 989319 - DNA, 17 bp, Homo sapiens
ttaactgccaatcctta

SEQ ID NO: 989320 - DNA, 21 bp, Homo sapiens
ttaactgccaatccttaaata

SEQ ID NO: 989321 - DNA, 19 bp, Homo sapiens
ttaactgccgtaatttaac

SEQ ID NO: 989322 - DNA, 17 bp, Homo sapiens
ttaactggcatggatta

SEQ ID NO: 989323 - DNA, 22 bp, Homo sapiens
ttaactggtgcactttgtaaat

SEQ ID NO: 989324 - DNA, 12 bp, Homo sapiens
ttaactgtattt

SEQ ID NO: 989325 - DNA, 14 bp, Homo sapiens
ttaactgtgaataa

SEQ ID NO: 989326 - DNA, 15 bp, Homo sapiens
ttaactgtggatatt

SEQ ID NO: 989327 - DNA, 22 bp, Homo sapiens
ttaacttaaattttaatttatt

SEQ ID NO: 989328 - DNA, 13 bp, Homo sapiens
ttaacttaactga

SEQ ID NO: 989329 - DNA, 14 bp, Homo sapiens
ttaacttaactgaa

SEQ ID NO: 989330 - DNA, 15 bp, Homo sapiens
ttaacttaactgaag

SEQ ID NO: 989331 - DNA, 15 bp, Homo sapiens
gattggattattcat

SEQ ID NO: 989332 - DNA, 16 bp, Homo sapiens
gattggatttgctgtg

SEQ ID NO: 989333 - DNA, 20 bp, Homo sapiens
gattggcaagtaacttctga

SEQ ID NO: 989334 - DNA, 23 bp, Homo sapiens
gattggcctgtagagttgctgag

SEQ ID NO: 989335 - DNA, 12 bp, Homo sapiens
gattggctcacc

SEQ ID NO: 989336 - DNA, 18 bp, Homo sapiens
gattggctcacccaagca

SEQ ID NO: 989337 - DNA, 17 bp, Homo sapiens
gattggctggattgcct

SEQ ID NO: 989338 - DNA, 22 bp, Homo sapiens
gattggcttaaagtgaaggaaa

SEQ ID NO: 989339 - DNA, 23 bp, Homo sapiens
gattggcttaaagtgaaggaaat

SEQ ID NO: 989340 - DNA, 22 bp, Homo sapiens
gattgggaggtgcgtgttcagc

SEQ ID NO: 989341 - DNA, 20 bp, Homo sapiens
gattggtgattcaaagtgtt

SEQ ID NO: 989342 - DNA, 15 bp, Homo sapiens
gattggttaaaatgt

SEQ ID NO: 989343 - DNA, 15 bp, Homo sapiens
gattgtattgttgaa

SEQ ID NO: 989344 - DNA, 12 bp, Homo sapiens
gattgtccctgt

SEQ ID NO: 989345 - DNA, 16 bp, Homo sapiens
gattgtctcagggccg

SEQ ID NO: 989346 - DNA, 15 bp, Homo sapiens
gattgtcttaatatt

SEQ ID NO: 989347 - DNA, 12 bp, Homo sapiens
gattgtcttgca

SEQ ID NO: 989348 - DNA, 21 bp, Homo sapiens
gattgtgaatatttccatatg

SEQ ID NO: 989349 - DNA, 18 bp, Homo sapiens
gattgtggaaaaccagga

SEQ ID NO: 989350 - DNA, 16 bp, Homo sapiens
gattgtggaatgttgg

SEQ ID NO: 989351 - DNA, 21 bp, Homo sapiens
gattgtggggtgcagctgggt

SEQ ID NO: 989352 - DNA, 14 bp, Homo sapiens
gattgttaaaataa

SEQ ID NO: 989353 - DNA, 18 bp, Homo sapiens
gattgttcgggtgtgcaa

SEQ ID NO: 989354 - DNA, 13 bp, Homo sapiens
gattgttgtttgc

SEQ ID NO: 989355 - DNA, 11 bp, Homo sapiens
gattgtttaag

SEQ ID NO: 989356 - DNA, 16 bp, Homo sapiens
gatttaaaaactggaa

SEQ ID NO: 989357 - DNA, 16 bp, Homo sapiens
gatttaaaagcctgct

SEQ ID NO: 989358 - DNA, 16 bp, Homo sapiens
gatttaaacacacaga

SEQ ID NO: 989359 - DNA, 13 bp, Homo sapiens
gatttaacacttt

SEQ ID NO: 989360 - DNA, 13 bp, Homo sapiens
gatttaacagaaa

SEQ ID NO: 989361 - DNA, 16 bp, Homo sapiens
gatttaacagaaatgt

SEQ ID NO: 989362 - DNA, 23 bp, Homo sapiens
gatttaacagaaatgtacagcaa

SEQ ID NO: 989363 - DNA, 15 bp, Homo sapiens
gatttaactgtgaac

SEQ ID NO: 989364 - DNA, 16 bp, Homo sapiens
gatttaacttgtattt

SEQ ID NO: 989365 - DNA, 22 bp, Homo sapiens
gatttaagggatggaaaaggaa

SEQ ID NO: 989366 - DNA, 13 bp, Homo sapiens
gatttaatgtttt

SEQ ID NO: 989367 - DNA, 22 bp, Homo sapiens
gatttaatgttttctgctgttt

SEQ ID NO: 989368 - DNA, 16 bp, Homo sapiens
gatttaatttgaaata

SEQ ID NO: 989369 - DNA, 10 bp, Homo sapiens
gatttacatt

SEQ ID NO: 989370 - DNA, 12 bp, Homo sapiens
gatttagaaaaa

SEQ ID NO: 989371 - DNA, 20 bp, Homo sapiens
gatttagaaaaaagtttaca

SEQ ID NO: 989372 - DNA, 20 bp, Homo sapiens
gatttagaggtaaaagtaca

SEQ ID NO: 989373 - DNA, 16 bp, Homo sapiens
gatttagggaagcagg

SEQ ID NO: 989374 - DNA, 14 bp, Homo sapiens
gatttataaagcaa

SEQ ID NO: 989375 - DNA, 13 bp, Homo sapiens
gatttataaatgc

SEQ ID NO: 989376 - DNA, 17 bp, Homo sapiens
gatttatagtttgtaca

SEQ ID NO: 989377 - DNA, 11 bp, Homo sapiens
gatttatcttt

SEQ ID NO: 989378 - DNA, 18 bp, Homo sapiens
gatttatttcatcatatt

SEQ ID NO: 989379 - DNA, 22 bp, Homo sapiens
gatttatttcatcatattatac

SEQ ID NO: 989380 - DNA, 17 bp, Homo sapiens
gatttatttgcttcttc

SEQ ID NO: 989381 - DNA, 22 bp, Homo sapiens
gatttattttacatttagagta

SEQ ID NO: 989382 - DNA, 20 bp, Homo sapiens
gatttatttttcagttccaa

SEQ ID NO: 989383 - DNA, 15 bp, Homo sapiens
gatttcaagatcctc

SEQ ID NO: 989384 - DNA, 19 bp, Homo sapiens
gatttcactaggactcaga

SEQ ID NO: 989385 - DNA, 21 bp, Homo sapiens
gatttcagaaagagcaagtct

SEQ ID NO: 989386 - DNA, 20 bp, Homo sapiens
gatttcagtttttcatttgt

SEQ ID NO: 989387 - DNA, 21 bp, Homo sapiens
gatttcagtttttcatttgtt

SEQ ID NO: 989388 - DNA, 11 bp, Homo sapiens
gatttcataat

SEQ ID NO: 989389 - DNA, 16 bp, Homo sapiens
gatttcatacctcaga

SEQ ID NO: 989390 - DNA, 17 bp, Homo sapiens
gatttcatcttctggaa

SEQ ID NO: 989391 - DNA, 13 bp, Homo sapiens
gatttcatgattt

SEQ ID NO: 989392 - DNA, 12 bp, Homo sapiens
gatttccaggcc

SEQ ID NO: 989393 - DNA, 15 bp, Homo sapiens
gatttccctgcagac

SEQ ID NO: 989394 - DNA, 18 bp, Homo sapiens
gatttccgttaaaatacc

SEQ ID NO: 989395 - DNA, 21 bp, Homo sapiens
gatttcctggagtgccctgca

SEQ ID NO: 989396 - DNA, 20 bp, Homo sapiens
gatttccttttttcttttct

SEQ ID NO: 989397 - DNA, 15 bp, Homo sapiens
gatttctaattgtaa

SEQ ID NO: 989398 - DNA, 22 bp, Homo sapiens
gatttctaattgtaagtgaaat

SEQ ID NO: 989399 - DNA, 18 bp, Homo sapiens
gatttctaggtaggaaat

SEQ ID NO: 989400 - DNA, 11 bp, Homo sapiens
gatttctccca

SEQ ID NO: 989401 - DNA, 10 bp, Homo sapiens
gatttctctg

SEQ ID NO: 989402 - DNA, 21 bp, Homo sapiens
gatttctgtttagataataca

SEQ ID NO: 989403 - DNA, 20 bp, Homo sapiens
gatttcttattgaatttgtt

SEQ ID NO: 989404 - DNA, 15 bp, Homo sapiens
gatttcttcagaatt

SEQ ID NO: 989405 - DNA, 14 bp, Homo sapiens
gatttcttctccct

SEQ ID NO: 989406 - DNA, 17 bp, Homo sapiens
gatttctttgaaaaaaa

SEQ ID NO: 989407 - DNA, 14 bp, Homo sapiens
gatttgaaaaactt

SEQ ID NO: 989408 - DNA, 13 bp, Homo sapiens
gatttgaaaattg

SEQ ID NO: 989409 - DNA, 14 bp, Homo sapiens
gatttgaattctgt

SEQ ID NO: 989410 - DNA, 13 bp, Homo sapiens
gatttgacattgc

SEQ ID NO: 989411 - DNA, 14 bp, Homo sapiens
gatttgaccaaatc

SEQ ID NO: 989412 - DNA, 14 bp, Homo sapiens
gatttgatctttgt

SEQ ID NO: 989413 - DNA, 15 bp, Homo sapiens
gatttgatgtgactt

SEQ ID NO: 989414 - DNA, 18 bp, Homo sapiens
gatttgattcattttcct

SEQ ID NO: 989415 - DNA, 14 bp, Homo sapiens
gatttgcaaaaaaa

SEQ ID NO: 989416 - DNA, 22 bp, Homo sapiens
gatttgcacgttggggagctgg

SEQ ID NO: 989417 - DNA, 22 bp, Homo sapiens
gatttgcaggattcccttctgg

SEQ ID NO: 989418 - DNA, 17 bp, Homo sapiens
gatttgcattgaacaca

SEQ ID NO: 989419 - DNA, 15 bp, Homo sapiens
gatttgcctgtgcca

SEQ ID NO: 989420 - DNA, 12 bp, Homo sapiens
gatttggaaaaa

SEQ ID NO: 989421 - DNA, 21 bp, Homo sapiens
gatttggaagagaggcacctg

SEQ ID NO: 989422 - DNA, 15 bp, Homo sapiens
gatttgggaaccaag

SEQ ID NO: 989423 - DNA, 15 bp, Homo sapiens
gatttgggggctcgg

SEQ ID NO: 989424 - DNA, 18 bp, Homo sapiens
gatttgggggctcgggga

SEQ ID NO: 989425 - DNA, 23 bp, Homo sapiens
gatttgggtggaaaacagggtgc

SEQ ID NO: 989426 - DNA, 22 bp, Homo sapiens
gatttggtgtaggtaggtctgt

SEQ ID NO: 989427 - DNA, 16 bp, Homo sapiens
gatttgtaccattcct

SEQ ID NO: 989428 - DNA, 19 bp, Homo sapiens
gatttgtagcactgagggt

SEQ ID NO: 989429 - DNA, 18 bp, Homo sapiens
gatttgtagcataactgt

SEQ ID NO: 989430 - DNA, 17 bp, Homo sapiens
gatttgtatgttaaagt

SEQ ID NO: 989431 - DNA, 14 bp, Homo sapiens
gatttgtcccaggt

SEQ ID NO: 989432 - DNA, 18 bp, Homo sapiens
gatttgtgcccattccta

SEQ ID NO: 989433 - DNA, 16 bp, Homo sapiens
gatttgttttgaattt

SEQ ID NO: 989434 - DNA, 16 bp, Homo sapiens
gatttgtttttaaact

SEQ ID NO: 989435 - DNA, 22 bp, Homo sapiens
gatttgtttttaaactgtacag

SEQ ID NO: 989436 - DNA, 16 bp, Homo sapiens
gattttaaaaaatcaa

SEQ ID NO: 989437 - DNA, 20 bp, Homo sapiens
gattttaaaaaatcaatcaa

SEQ ID NO: 989438 - DNA, 21 bp, Homo sapiens
gattttaaaaaatcaatcaat

SEQ ID NO: 989439 - DNA, 12 bp, Homo sapiens
gattttaacaat

SEQ ID NO: 989440 - DNA, 15 bp, Homo sapiens
gattttaacaataac

SEQ ID NO: 989441 - DNA, 16 bp, Homo sapiens
gattttaatacattga

SEQ ID NO: 989442 - DNA, 18 bp, Homo sapiens
gattttaatttatttgtt

SEQ ID NO: 989443 - DNA, 19 bp, Homo sapiens
gattttaatttatttgttt

SEQ ID NO: 989444 - DNA, 13 bp, Homo sapiens
gattttaattttg

SEQ ID NO: 989445 - DNA, 17 bp, Homo sapiens
gattttacagagcgcac

SEQ ID NO: 989446 - DNA, 15 bp, Homo sapiens
gattttaccaaagca

SEQ ID NO: 989447 - DNA, 16 bp, Homo sapiens
gattttagacttacct

SEQ ID NO: 989448 - DNA, 18 bp, Homo sapiens
gattttatgcacagccta

SEQ ID NO: 989449 - DNA, 12 bp, Homo sapiens
gattttattaca

SEQ ID NO: 989450 - DNA, 13 bp, Homo sapiens
gattttccaaatg

SEQ ID NO: 989451 - DNA, 14 bp, Homo sapiens
gattttctccagct

SEQ ID NO: 989452 - DNA, 15 bp, Homo sapiens
gattttcttttgcct

SEQ ID NO: 989453 - DNA, 21 bp, Homo sapiens
gattttgaaatttttattaaa

SEQ ID NO: 989454 - DNA, 14 bp, Homo sapiens
gcaagaattaaaac

SEQ ID NO: 989455 - DNA, 21 bp, Homo sapiens
gcaagaattaaaactgagtcc

SEQ ID NO: 989456 - DNA, 13 bp, Homo sapiens
gcaagacagaaaa

SEQ ID NO: 989457 - DNA, 15 bp, Homo sapiens
gcaagacagaaaagt

SEQ ID NO: 989458 - DNA, 19 bp, Homo sapiens
gcaagacagaaaagtgcct

SEQ ID NO: 989459 - DNA, 14 bp, Homo sapiens
gcaagacctcatct

SEQ ID NO: 989460 - DNA, 21 bp, Homo sapiens
gcaagacctcatctgtggagc

SEQ ID NO: 989461 - DNA, 24 bp, Homo sapiens
gcaagacctcatctgtggagctgc

SEQ ID NO: 989462 - DNA, 15 bp, Homo sapiens
gcaagacctgaaaat

SEQ ID NO: 989463 - DNA, 14 bp, Homo sapiens
gcaagagagatgtt

SEQ ID NO: 989464 - DNA, 18 bp, Homo sapiens
gcaagagagcagcgccca

SEQ ID NO: 989465 - DNA, 17 bp, Homo sapiens
gcaagagatgggacaag

SEQ ID NO: 989466 - DNA, 15 bp, Homo sapiens
gcaagagcagatact

SEQ ID NO: 989467 - DNA, 13 bp, Homo sapiens
gcaagagggaggg

SEQ ID NO: 989468 - DNA, 21 bp, Homo sapiens
gcaagagggaggggacagagg

SEQ ID NO: 989469 - DNA, 23 bp, Homo sapiens
gcaagagggaggggacagaggcc

SEQ ID NO: 989470 - DNA, 23 bp, Homo sapiens
gcaagagggggtggaggggtgtg

SEQ ID NO: 989471 - DNA, 13 bp, Homo sapiens
gcaagaggggtgg

SEQ ID NO: 989472 - DNA, 22 bp, Homo sapiens
gcaagagggtctctttgttcaa

SEQ ID NO: 989473 - DNA, 23 bp, Homo sapiens
gcaagagggtctctttgttcaat

SEQ ID NO: 989474 - DNA, 18 bp, Homo sapiens
gcaagagtgattgcagct

SEQ ID NO: 989475 - DNA, 19 bp, Homo sapiens
gcaagatagatttggaata

SEQ ID NO: 989476 - DNA, 13 bp, Homo sapiens
gcaagatatttat

SEQ ID NO: 989477 - DNA, 15 bp, Homo sapiens
gcaagatatttatat

SEQ ID NO: 989478 - DNA, 16 bp, Homo sapiens
gcaagatatttatata

SEQ ID NO: 989479 - DNA, 14 bp, Homo sapiens
gcaagatgaaataa

SEQ ID NO: 989480 - DNA, 15 bp, Homo sapiens
gcaagatgagctgtg

SEQ ID NO: 989481 - DNA, 16 bp, Homo sapiens
gcaagatgagctgtgc

SEQ ID NO: 989482 - DNA, 23 bp, Homo sapiens
gcaagatggggagtgagaggctg

SEQ ID NO: 989483 - DNA, 14 bp, Homo sapiens
gcaagatgtgaatt

SEQ ID NO: 989484 - DNA, 14 bp, Homo sapiens
gcaagatgtttctt

SEQ ID NO: 989485 - DNA, 13 bp, Homo sapiens
gcaagattgctta

SEQ ID NO: 989486 - DNA, 16 bp, Homo sapiens
gcaagcagctggtcag

SEQ ID NO: 989487 - DNA, 17 bp, Homo sapiens
gcaagcagctggtcagt

SEQ ID NO: 989488 - DNA, 11 bp, Homo sapiens
gcaagcagctt

SEQ ID NO: 989489 - DNA, 13 bp, Homo sapiens
gcaagcagggaaa

SEQ ID NO: 989490 - DNA, 22 bp, Homo sapiens
gcaagcagggaaagctccacgg

SEQ ID NO: 989491 - DNA, 13 bp, Homo sapiens
gcaagccacagga

SEQ ID NO: 989492 - DNA, 17 bp, Homo sapiens
gcaagccacaggaagga

SEQ ID NO: 989493 - DNA, 13 bp, Homo sapiens
gcaagccagggcc

SEQ ID NO: 989494 - DNA, 20 bp, Homo sapiens
gcaagccagggcccagagcc

SEQ ID NO: 989495 - DNA, 21 bp, Homo sapiens
gcaagccagggcccagagccc

SEQ ID NO: 989496 - DNA, 18 bp, Homo sapiens
gcaagccataacgtgccc

SEQ ID NO: 989497 - DNA, 13 bp, Homo sapiens
gcaagccccaggg

SEQ ID NO: 989498 - DNA, 15 bp, Homo sapiens
gcaagcccctcagcc

SEQ ID NO: 989499 - DNA, 16 bp, Homo sapiens
gcaagcccctcagccc

SEQ ID NO: 989500 - DNA, 17 bp, Homo sapiens
gcaagcccctcagccct

SEQ ID NO: 989501 - DNA, 19 bp, Homo sapiens
gcaagcctaagggatcctg

SEQ ID NO: 989502 - DNA, 13 bp, Homo sapiens
gcaagcgggagcc

SEQ ID NO: 989503 - DNA, 9 bp, Homo sapiens
gcaaggaaa

SEQ ID NO: 989504 - DNA, 16 bp, Homo sapiens
gcaaggaaaaacaggt

SEQ ID NO: 989505 - DNA, 18 bp, Homo sapiens
gcaaggaaatgtcctgca

SEQ ID NO: 989506 - DNA, 21 bp, Homo sapiens
gcaaggaaatgtcctgcatgg

SEQ ID NO: 989507 - DNA, 13 bp, Homo sapiens
gcaaggaaggaaa

SEQ ID NO: 989508 - DNA, 14 bp, Homo sapiens
gcaaggaccaggac

SEQ ID NO: 989509 - DNA, 17 bp, Homo sapiens
gcaaggacctaaaacat

SEQ ID NO: 989510 - DNA, 16 bp, Homo sapiens
gcaaggagaaaatata

SEQ ID NO: 989511 - DNA, 21 bp, Homo sapiens
gcaaggagtttattacaatgt

SEQ ID NO: 989512 - DNA, 19 bp, Homo sapiens
gcaaggatatcagagctgg

SEQ ID NO: 989513 - DNA, 20 bp, Homo sapiens
gcaaggatatcagagctggg

SEQ ID NO: 989514 - DNA, 18 bp, Homo sapiens
gcaaggcaggtgcctcca

SEQ ID NO: 989515 - DNA, 15 bp, Homo sapiens
gcaaggcaggttgga

SEQ ID NO: 989516 - DNA, 19 bp, Homo sapiens
gcaaggcaggttggatggg

SEQ ID NO: 989517 - DNA, 21 bp, Homo sapiens
gcaaggccttggtggagcagc

SEQ ID NO: 989518 - DNA, 23 bp, Homo sapiens
gcaaggccttggtggagcagcca

SEQ ID NO: 989519 - DNA, 12 bp, Homo sapiens
gcaaggctgact

SEQ ID NO: 989520 - DNA, 13 bp, Homo sapiens
gcaaggctgctgc

SEQ ID NO: 989521 - DNA, 17 bp, Homo sapiens
gcaaggctgctgccgga

SEQ ID NO: 989522 - DNA, 20 bp, Homo sapiens
gcaagggcatcaggcactgg

SEQ ID NO: 989523 - DNA, 16 bp, Homo sapiens
gcaagggcccagagtg

SEQ ID NO: 989524 - DNA, 13 bp, Homo sapiens
gcaagggcctgga

SEQ ID NO: 989525 - DNA, 14 bp, Homo sapiens
gcaagggctccagc

SEQ ID NO: 989526 - DNA, 15 bp, Homo sapiens
gcaagggctccagca

SEQ ID NO: 989527 - DNA, 22 bp, Homo sapiens
gcaagggctccagcatccagcc

SEQ ID NO: 989528 - DNA, 21 bp, Homo sapiens
gcaagggggtgtcatctgagg

SEQ ID NO: 989529 - DNA, 22 bp, Homo sapiens
gcaagggggtgtcatctgagga

SEQ ID NO: 989530 - DNA, 22 bp, Homo sapiens
gcaaggggttcccttgagggct

SEQ ID NO: 989531 - DNA, 16 bp, Homo sapiens
gcaagggttccctcaa

SEQ ID NO: 989532 - DNA, 22 bp, Homo sapiens
gcaagggttggaggcaatgtgg

SEQ ID NO: 989533 - DNA, 17 bp, Homo sapiens
gcaaggtactctggtga

SEQ ID NO: 989534 - DNA, 21 bp, Homo sapiens
gcaaggtatttctccagttgg

SEQ ID NO: 989535 - DNA, 23 bp, Homo sapiens
gcaaggtctccttactctgagcc

SEQ ID NO: 989536 - DNA, 22 bp, Homo sapiens
gcaaggtgctcttgaacctgtg

SEQ ID NO: 989537 - DNA, 18 bp, Homo sapiens
gcaaggtggcctctgcct

SEQ ID NO: 989538 - DNA, 20 bp, Homo sapiens
gcaaggtggcctctgcctgg

SEQ ID NO: 989539 - DNA, 22 bp, Homo sapiens
gcaaggtggcctttgtgctgcg

SEQ ID NO: 989540 - DNA, 17 bp, Homo sapiens
gcaaggtttaagttatt

SEQ ID NO: 989541 - DNA, 19 bp, Homo sapiens
gcaaggtttaagttattaa

SEQ ID NO: 989542 - DNA, 22 bp, Homo sapiens
gcaaggtttaagttattaagag

SEQ ID NO: 989543 - DNA, 20 bp, Homo sapiens
gcaaggtttaggctggtggc

SEQ ID NO: 989544 - DNA, 24 bp, Homo sapiens
gcaaggtttaggctggtggcccag

SEQ ID NO: 989545 - DNA, 18 bp, Homo sapiens
gcaagtagataaatattt

SEQ ID NO: 989546 - DNA, 19 bp, Homo sapiens
gcaagtagataaatatttg

SEQ ID NO: 989547 - DNA, 14 bp, Homo sapiens
gcaagtatgtgagt

SEQ ID NO: 989548 - DNA, 23 bp, Homo sapiens
gcaagtatgttttagcatgtgtt

SEQ ID NO: 989549 - DNA, 21 bp, Homo sapiens
gcaagtcccagacaaggagag

SEQ ID NO: 989550 - DNA, 22 bp, Homo sapiens
gcaagtcccagacaaggagagc

SEQ ID NO: 989551 - DNA, 11 bp, Homo sapiens
gcaagtcttaa

SEQ ID NO: 989552 - DNA, 18 bp, Homo sapiens
gcaagtgagaggggaggg

SEQ ID NO: 989553 - DNA, 22 bp, Homo sapiens
gcaagtgagaggggagggaggg

SEQ ID NO: 989554 - DNA, 15 bp, Homo sapiens
gcaagtgctggagtc

SEQ ID NO: 989555 - DNA, 14 bp, Homo sapiens
gcaagtggatggcc

SEQ ID NO: 989556 - DNA, 22 bp, Homo sapiens
gcaagtgtggggggtccttctc

SEQ ID NO: 989557 - DNA, 19 bp, Homo sapiens
gcaagtgtgtgcatgtgtg

SEQ ID NO: 989558 - DNA, 15 bp, Homo sapiens
gcaagtgtttgtggg

SEQ ID NO: 989559 - DNA, 17 bp, Homo sapiens
gcaagttattttatttg

SEQ ID NO: 989560 - DNA, 17 bp, Homo sapiens
gcaagttctagagaaga

SEQ ID NO: 989561 - DNA, 13 bp, Homo sapiens
gcaagtttctgtt

SEQ ID NO: 989562 - DNA, 11 bp, Homo sapiens
gcaataaagca

SEQ ID NO: 989563 - DNA, 15 bp, Homo sapiens
gcaataaagtggaaa

SEQ ID NO: 989564 - DNA, 16 bp, Homo sapiens
gcaataacagctgcaa

SEQ ID NO: 989565 - DNA, 17 bp, Homo sapiens
gcaataactccaagcag

SEQ ID NO: 989566 - DNA, 23 bp, Homo sapiens
gcaataactccaagcagactcca

SEQ ID NO: 989567 - DNA, 16 bp, Homo sapiens
gcaataactctgggag

SEQ ID NO: 989568 - DNA, 21 bp, Homo sapiens
gcaataacttctatattttaa

SEQ ID NO: 989569 - DNA, 22 bp, Homo sapiens
gcaataacttctatattttaat

SEQ ID NO: 989570 - DNA, 23 bp, Homo sapiens
gcaataagaaatgaacaaaagat

SEQ ID NO: 989571 - DNA, 17 bp, Homo sapiens
gcaataagctggactag

SEQ ID NO: 989572 - DNA, 20 bp, Homo sapiens
gcaataagctggactagtgt

SEQ ID NO: 989573 - DNA, 16 bp, Homo sapiens
gcaataataataaatt

SEQ ID NO: 989574 - DNA, 17 bp, Homo sapiens
gcaataatccaccccca

SEQ ID NO: 989575 - DNA, 22 bp, Homo sapiens
gcaataatggtcccatccaggc

SEQ ID NO: 989576 - DNA, 17 bp, Homo sapiens
tccaaggtcactcttgg

SEQ ID NO: 989577 - DNA, 16 bp, Homo sapiens
tccaaggtgatgttgt

SEQ ID NO: 989578 - DNA, 18 bp, Homo sapiens
tccaaggtttataaagca

SEQ ID NO: 989579 - DNA, 16 bp, Homo sapiens
tccaagtaccaatgct

SEQ ID NO: 989580 - DNA, 17 bp, Homo sapiens
tccaagtaccaatgctg

SEQ ID NO: 989581 - DNA, 20 bp, Homo sapiens
tccaagtaccaatgctgttg

SEQ ID NO: 989582 - DNA, 22 bp, Homo sapiens
tccaagtcaacactcttcttga

SEQ ID NO: 989583 - DNA, 20 bp, Homo sapiens
tccaagtcactagaagtcct

SEQ ID NO: 989584 - DNA, 20 bp, Homo sapiens
tccaagtccaacctgcctgt

SEQ ID NO: 989585 - DNA, 18 bp, Homo sapiens
tccaagtctctctgtgaa

SEQ ID NO: 989586 - DNA, 21 bp, Homo sapiens
tccaagtgaacactagccaga

SEQ ID NO: 989587 - DNA, 15 bp, Homo sapiens
tccaagtgccaatat

SEQ ID NO: 989588 - DNA, 14 bp, Homo sapiens
tccaagtggctgtg

SEQ ID NO: 989589 - DNA, 15 bp, Homo sapiens
tccaagtggctgtga

SEQ ID NO: 989590 - DNA, 20 bp, Homo sapiens
tccaagttcttcacctctat

SEQ ID NO: 989591 - DNA, 22 bp, Homo sapiens
tccaataaaaacattttgaagt

SEQ ID NO: 989592 - DNA, 17 bp, Homo sapiens
tccaataaagcagcctc

SEQ ID NO: 989593 - DNA, 22 bp, Homo sapiens
tccaataccctagaagaaaacc

SEQ ID NO: 989594 - DNA, 11 bp, Homo sapiens
tccaatactgc

SEQ ID NO: 989595 - DNA, 17 bp, Homo sapiens
tccaatactgcccaagg

SEQ ID NO: 989596 - DNA, 13 bp, Homo sapiens
tccaatagaaaga

SEQ ID NO: 989597 - DNA, 16 bp, Homo sapiens
tccaatattttgcctt

SEQ ID NO: 989598 - DNA, 20 bp, Homo sapiens
tccaatcaacagcagtgagt

SEQ ID NO: 989599 - DNA, 16 bp, Homo sapiens
tccaatccacaatgag

SEQ ID NO: 989600 - DNA, 22 bp, Homo sapiens
tccaatcccatagatgggtctg

SEQ ID NO: 989601 - DNA, 16 bp, Homo sapiens
tccaatcctcactggg

SEQ ID NO: 989602 - DNA, 17 bp, Homo sapiens
tccaatcctcactgggt

SEQ ID NO: 989603 - DNA, 14 bp, Homo sapiens
tccaatgaaggaaa

SEQ ID NO: 989604 - DNA, 17 bp, Homo sapiens
tccaatgaaggaaacat

SEQ ID NO: 989605 - DNA, 21 bp, Homo sapiens
tccaatgatacccaacagttt

SEQ ID NO: 989606 - DNA, 17 bp, Homo sapiens
tccaatgtcctgaaaca

SEQ ID NO: 989607 - DNA, 18 bp, Homo sapiens
tccaatgtggcaaggaaa

SEQ ID NO: 989608 - DNA, 15 bp, Homo sapiens
tccaattagtttcct

SEQ ID NO: 989609 - DNA, 23 bp, Homo sapiens
tccaattagtttcctttttaata

SEQ ID NO: 989610 - DNA, 20 bp, Homo sapiens
tccaattcccccttaaactt

SEQ ID NO: 989611 - DNA, 17 bp, Homo sapiens
tccaattctaaatccga

SEQ ID NO: 989612 - DNA, 11 bp, Homo sapiens
tccaattctat

SEQ ID NO: 989613 - DNA, 19 bp, Homo sapiens
tccaattgatgtatatgtt

SEQ ID NO: 989614 - DNA, 13 bp, Homo sapiens
tccaattggtgct

SEQ ID NO: 989615 - DNA, 18 bp, Homo sapiens
tccaatttacatactctg

SEQ ID NO: 989616 - DNA, 22 bp, Homo sapiens
tccaattttctggaatacatga

SEQ ID NO: 989617 - DNA, 17 bp, Homo sapiens
tccaattttttcttaaa

SEQ ID NO: 989618 - DNA, 21 bp, Homo sapiens
tccacaaacctggatttttta

SEQ ID NO: 989619 - DNA, 14 bp, Homo sapiens
tccacaaagaaaat

SEQ ID NO: 989620 - DNA, 16 bp, Homo sapiens
tccacaacagcctggg

SEQ ID NO: 989621 - DNA, 21 bp, Homo sapiens
tccacaagacagaagctgaag

SEQ ID NO: 989622 - DNA, 21 bp, Homo sapiens
tccacaagattcccagagaca

SEQ ID NO: 989623 - DNA, 18 bp, Homo sapiens
tccacaagttaaataaat

SEQ ID NO: 989624 - DNA, 16 bp, Homo sapiens
tccacaatgactgctt

SEQ ID NO: 989625 - DNA, 14 bp, Homo sapiens
tccacaattcttct

SEQ ID NO: 989626 - DNA, 15 bp, Homo sapiens
tccacaattcttctg

SEQ ID NO: 989627 - DNA, 17 bp, Homo sapiens
tccacaattcttctgtc

SEQ ID NO: 989628 - DNA, 20 bp, Homo sapiens
tccacaattcttctgtcaag

SEQ ID NO: 989629 - DNA, 14 bp, Homo sapiens
tccacacacagagg

SEQ ID NO: 989630 - DNA, 15 bp, Homo sapiens
tccacacacagagga

SEQ ID NO: 989631 - DNA, 22 bp, Homo sapiens
tccacacacagaggaagagcag

SEQ ID NO: 989632 - DNA, 20 bp, Homo sapiens
tccacacattccagccaggc

SEQ ID NO: 989633 - DNA, 18 bp, Homo sapiens
tccacacatttaaaacat

SEQ ID NO: 989634 - DNA, 17 bp, Homo sapiens
tccacaccaagcagcaa

SEQ ID NO: 989635 - DNA, 16 bp, Homo sapiens
tccacacccgtgagaa

SEQ ID NO: 989636 - DNA, 15 bp, Homo sapiens
tccacagaggacaca

SEQ ID NO: 989637 - DNA, 16 bp, Homo sapiens
tccacagccgcagcct

SEQ ID NO: 989638 - DNA, 18 bp, Homo sapiens
tccacagccgcagcctcc

SEQ ID NO: 989639 - DNA, 18 bp, Homo sapiens
tccacagcctgcaagtca

SEQ ID NO: 989640 - DNA, 18 bp, Homo sapiens
tccacagcgagggcagct

SEQ ID NO: 989641 - DNA, 12 bp, Homo sapiens
tccacaggatat

SEQ ID NO: 989642 - DNA, 20 bp, Homo sapiens
tccacagggagcaaacactt

SEQ ID NO: 989643 - DNA, 21 bp, Homo sapiens
tccacagggcttgttttccaa

SEQ ID NO: 989644 - DNA, 16 bp, Homo sapiens
tccacaggggcaggcc

SEQ ID NO: 989645 - DNA, 17 bp, Homo sapiens
tccacaggggcaggcct

SEQ ID NO: 989646 - DNA, 21 bp, Homo sapiens
tccacaggtcatcagatgcct

SEQ ID NO: 989647 - DNA, 15 bp, Homo sapiens
tccacagtcccccac

SEQ ID NO: 989648 - DNA, 13 bp, Homo sapiens
tccacagtgctgc

SEQ ID NO: 989649 - DNA, 15 bp, Homo sapiens
tccacagtgtttata

SEQ ID NO: 989650 - DNA, 19 bp, Homo sapiens
tccacagttatcttagctg

SEQ ID NO: 989651 - DNA, 21 bp, Homo sapiens
tccacagttgccaccacctct

SEQ ID NO: 989652 - DNA, 14 bp, Homo sapiens
tccacataaatgct

SEQ ID NO: 989653 - DNA, 19 bp, Homo sapiens
tccacatcccagcagccca

SEQ ID NO: 989654 - DNA, 16 bp, Homo sapiens
tccacatccccagagc

SEQ ID NO: 989655 - DNA, 17 bp, Homo sapiens
tccacatccccagagcc

SEQ ID NO: 989656 - DNA, 23 bp, Homo sapiens
tccacatccccagagcccagctc

SEQ ID NO: 989657 - DNA, 13 bp, Homo sapiens
tccacatctgcct

SEQ ID NO: 989658 - DNA, 15 bp, Homo sapiens
tccacatctgcctcc

SEQ ID NO: 989659 - DNA, 16 bp, Homo sapiens
tccacatctgcctcct

SEQ ID NO: 989660 - DNA, 17 bp, Homo sapiens
tccacatgctgcctggc

SEQ ID NO: 989661 - DNA, 19 bp, Homo sapiens
tccacatgctgcctggcac

SEQ ID NO: 989662 - DNA, 15 bp, Homo sapiens
tccacatgggagccg

SEQ ID NO: 989663 - DNA, 14 bp, Homo sapiens
tccacatgtacata

SEQ ID NO: 989664 - DNA, 22 bp, Homo sapiens
tccacattctacttcagctttg

SEQ ID NO: 989665 - DNA, 16 bp, Homo sapiens
tccacatttgtcacag

SEQ ID NO: 989666 - DNA, 21 bp, Homo sapiens
tccacattttacaggcaagga

SEQ ID NO: 989667 - DNA, 16 bp, Homo sapiens
tccaccaacccatcag

SEQ ID NO: 989668 - DNA, 20 bp, Homo sapiens
tccaccaaccccgcggccca

SEQ ID NO: 989669 - DNA, 17 bp, Homo sapiens
tccaccaagaaagcagg

SEQ ID NO: 989670 - DNA, 24 bp, Homo sapiens
tccaccacccaacccaaaccatga

SEQ ID NO: 989671 - DNA, 22 bp, Homo sapiens
tccaccacctccctcaccaaca

SEQ ID NO: 989672 - DNA, 14 bp, Homo sapiens
tccaccagcagcat

SEQ ID NO: 989673 - DNA, 15 bp, Homo sapiens
tccaccagcagcatg

SEQ ID NO: 989674 - DNA, 16 bp, Homo sapiens
tccaccagccctactc

SEQ ID NO: 989675 - DNA, 20 bp, Homo sapiens
tccaccagccctactcctgc

SEQ ID NO: 989676 - DNA, 12 bp, Homo sapiens
tccaccagcctg

SEQ ID NO: 989677 - DNA, 18 bp, Homo sapiens
tccaccagcctgctgaca

SEQ ID NO: 989678 - DNA, 19 bp, Homo sapiens
tccaccagcctgctgacag

SEQ ID NO: 989679 - DNA, 12 bp, Homo sapiens
tccaccaggcct

SEQ ID NO: 989680 - DNA, 21 bp, Homo sapiens
tccaccaggcctcactggctc

SEQ ID NO: 989681 - DNA, 15 bp, Homo sapiens
tccaccagtttatac

SEQ ID NO: 989682 - DNA, 17 bp, Homo sapiens
tccaccatccccacccc

SEQ ID NO: 989683 - DNA, 19 bp, Homo sapiens
tccacccaaccctatctcc

SEQ ID NO: 989684 - DNA, 14 bp, Homo sapiens
tccacccagcaggc

SEQ ID NO: 989685 - DNA, 14 bp, Homo sapiens
tccacccagcccat

SEQ ID NO: 989686 - DNA, 15 bp, Homo sapiens
tccacccaggctgca

SEQ ID NO: 989687 - DNA, 24 bp, Homo sapiens
tccacccaggctgcactgcagtga

SEQ ID NO: 989688 - DNA, 15 bp, Homo sapiens
tccacccagtgctgc

SEQ ID NO: 989689 - DNA, 17 bp, Homo sapiens
tccacccagtgctgcca

SEQ ID NO: 989690 - DNA, 18 bp, Homo sapiens
tccacccagtgctgccat

SEQ ID NO: 989691 - DNA, 19 bp, Homo sapiens
tccacccagtgctgccatg

SEQ ID NO: 989692 - DNA, 24 bp, Homo sapiens
tccacccattcccccatgtggctg

SEQ ID NO: 989693 - DNA, 18 bp, Homo sapiens
tccaccccaagagaactc

SEQ ID NO: 989694 - DNA, 19 bp, Homo sapiens
tccaccccaggacgccact

SEQ ID NO: 989695 - DNA, 22 bp, Homo sapiens
tccaccccataataaccctgcc

SEQ ID NO: 989696 - DNA, 20 bp, Homo sapiens
tccaccccatccctccccag

SEQ ID NO: 989697 - DNA, 20 bp, Homo sapiens
tccacccccatgtggcagcc

SEQ ID NO: 989698 - DNA, 23 bp, Homo sapiens
tccagggtctggcagagcctctg

SEQ ID NO: 989699 - DNA, 13 bp, Homo sapiens
tccagggtcttgg

SEQ ID NO: 989700 - DNA, 16 bp, Homo sapiens
tccagggtcttgggct

SEQ ID NO: 989701 - DNA, 20 bp, Homo sapiens
tccagggtggcagcaacaat

SEQ ID NO: 989702 - DNA, 21 bp, Homo sapiens
tccaggtcatgcagttcctgg

SEQ ID NO: 989703 - DNA, 20 bp, Homo sapiens
tccaggtccaaacccttcaa

SEQ ID NO: 989704 - DNA, 16 bp, Homo sapiens
tccaggtcttgactca

SEQ ID NO: 989705 - DNA, 23 bp, Homo sapiens
tccaggtcttgactcatggcagc

SEQ ID NO: 989706 - DNA, 18 bp, Homo sapiens
tccaggtgagaacatcca

SEQ ID NO: 989707 - DNA, 18 bp, Homo sapiens
tccaggtgagtgtgaggg

SEQ ID NO: 989708 - DNA, 18 bp, Homo sapiens
tccaggtgttactgtaat

SEQ ID NO: 989709 - DNA, 17 bp, Homo sapiens
tccaggttccctcccag

SEQ ID NO: 989710 - DNA, 20 bp, Homo sapiens
tccaggttccctcccagagg

SEQ ID NO: 989711 - DNA, 20 bp, Homo sapiens
tccaggtttaagctgttact

SEQ ID NO: 989712 - DNA, 15 bp, Homo sapiens
tccagtaactttttt

SEQ ID NO: 989713 - DNA, 18 bp, Homo sapiens
tccagtaacttttttgtg

SEQ ID NO: 989714 - DNA, 20 bp, Homo sapiens
tccagtaacttttttgtgta

SEQ ID NO: 989715 - DNA, 15 bp, Homo sapiens
tccagtaccttgctt

SEQ ID NO: 989716 - DNA, 21 bp, Homo sapiens
tccagtacgtcccgctgctgt

SEQ ID NO: 989717 - DNA, 21 bp, Homo sapiens
tccagtataagactactgaat

SEQ ID NO: 989718 - DNA, 14 bp, Homo sapiens
tccagtatcttgtt

SEQ ID NO: 989719 - DNA, 16 bp, Homo sapiens
tccagtcatcctgccc

SEQ ID NO: 989720 - DNA, 23 bp, Homo sapiens
tccagtcatctgtaagagcttgc

SEQ ID NO: 989721 - DNA, 15 bp, Homo sapiens
tccagtcatggtact

SEQ ID NO: 989722 - DNA, 19 bp, Homo sapiens
tccagtcatggtactaccc

SEQ ID NO: 989723 - DNA, 16 bp, Homo sapiens
tccagtctcttgtaca

SEQ ID NO: 989724 - DNA, 22 bp, Homo sapiens
tccagtctcttgtacagcgttt

SEQ ID NO: 989725 - DNA, 20 bp, Homo sapiens
tccagtctgaagtgcctact

SEQ ID NO: 989726 - DNA, 16 bp, Homo sapiens
tccagtctgctgccct

SEQ ID NO: 989727 - DNA, 18 bp, Homo sapiens
tccagtctgctgccctcc

SEQ ID NO: 989728 - DNA, 14 bp, Homo sapiens
tccagtctggaaaa

SEQ ID NO: 989729 - DNA, 21 bp, Homo sapiens
tccagtctggaaaacagaaac

SEQ ID NO: 989730 - DNA, 15 bp, Homo sapiens
tccagtgaacattcc

SEQ ID NO: 989731 - DNA, 23 bp, Homo sapiens
tccagtgacatgattctgaactt

SEQ ID NO: 989732 - DNA, 18 bp, Homo sapiens
tccagtgacttgttctga

SEQ ID NO: 989733 - DNA, 19 bp, Homo sapiens
tccagtgacttgttctgag

SEQ ID NO: 989734 - DNA, 22 bp, Homo sapiens
tccagtgacttgttctgagtaa

SEQ ID NO: 989735 - DNA, 12 bp, Homo sapiens
tccagtgaggaa

SEQ ID NO: 989736 - DNA, 15 bp, Homo sapiens
tccagtgagtgtaaa

SEQ ID NO: 989737 - DNA, 20 bp, Homo sapiens
tccagtgagtgtaaataatt

SEQ ID NO: 989738 - DNA, 14 bp, Homo sapiens
tccagtgcaattgt

SEQ ID NO: 989739 - DNA, 16 bp, Homo sapiens
tccagtgctctgcctc

SEQ ID NO: 989740 - DNA, 17 bp, Homo sapiens
tccagtgctctgcctca

SEQ ID NO: 989741 - DNA, 12 bp, Homo sapiens
tccagtggaccc

SEQ ID NO: 989742 - DNA, 20 bp, Homo sapiens
tccagtggctggtttctgag

SEQ ID NO: 989743 - DNA, 13 bp, Homo sapiens
tccagtgggctga

SEQ ID NO: 989744 - DNA, 23 bp, Homo sapiens
tccagtggtttgagacactggtt

SEQ ID NO: 989745 - DNA, 13 bp, Homo sapiens
tccagtgttgcct

SEQ ID NO: 989746 - DNA, 17 bp, Homo sapiens
tccagtgttgcctcctc

SEQ ID NO: 989747 - DNA, 17 bp, Homo sapiens
tccagtgttggctgtgt

SEQ ID NO: 989748 - DNA, 19 bp, Homo sapiens
tccagttaaaaaaaatttt

SEQ ID NO: 989749 - DNA, 21 bp, Homo sapiens
tccagttaaaaaaaattttaa

SEQ ID NO: 989750 - DNA, 20 bp, Homo sapiens
tccagttcatcgattttcta

SEQ ID NO: 989751 - DNA, 16 bp, Homo sapiens
tccagttcatgagaat

SEQ ID NO: 989752 - DNA, 16 bp, Homo sapiens
tccagttccagttccc

SEQ ID NO: 989753 - DNA, 21 bp, Homo sapiens
tccagttcctgctctctgctc

SEQ ID NO: 989754 - DNA, 15 bp, Homo sapiens
tccagttcctttaga

SEQ ID NO: 989755 - DNA, 15 bp, Homo sapiens
tccagttgctgtgga

SEQ ID NO: 989756 - DNA, 16 bp, Homo sapiens
tccagttgggactcag

SEQ ID NO: 989757 - DNA, 17 bp, Homo sapiens
tccagtttgcacctgtc

SEQ ID NO: 989758 - DNA, 19 bp, Homo sapiens
tccagtttgcacctgtccc

SEQ ID NO: 989759 - DNA, 19 bp, Homo sapiens
tccagtttgttctccgggt

SEQ ID NO: 989760 - DNA, 20 bp, Homo sapiens
tccagttttttgttatatag

SEQ ID NO: 989761 - DNA, 16 bp, Homo sapiens
tccataaacatgaaaa

SEQ ID NO: 989762 - DNA, 24 bp, Homo sapiens
tccataaagtacaaatgaagaaag

SEQ ID NO: 989763 - DNA, 15 bp, Homo sapiens
tccataaatgtgttc

SEQ ID NO: 989764 - DNA, 16 bp, Homo sapiens
tccataaatgtgttcc

SEQ ID NO: 989765 - DNA, 19 bp, Homo sapiens
tccataagtttaactttaa

SEQ ID NO: 989766 - DNA, 22 bp, Homo sapiens
tccataatctggactcctctgt

SEQ ID NO: 989767 - DNA, 22 bp, Homo sapiens
tccataatgcattcttctctgt

SEQ ID NO: 989768 - DNA, 16 bp, Homo sapiens
tccataatgctactgt

SEQ ID NO: 989769 - DNA, 14 bp, Homo sapiens
tccatacacagagg

SEQ ID NO: 989770 - DNA, 14 bp, Homo sapiens
tccatacagcctct

SEQ ID NO: 989771 - DNA, 13 bp, Homo sapiens
tccatacagctct

SEQ ID NO: 989772 - DNA, 18 bp, Homo sapiens
tccatactatgacaatct

SEQ ID NO: 989773 - DNA, 19 bp, Homo sapiens
tccatagatttattttaca

SEQ ID NO: 989774 - DNA, 16 bp, Homo sapiens
tccatagcaacaggaa

SEQ ID NO: 989775 - DNA, 21 bp, Homo sapiens
tccatagcctaatccctgggc

SEQ ID NO: 989776 - DNA, 19 bp, Homo sapiens
tccataggtttctctccct

SEQ ID NO: 989777 - DNA, 24 bp, Homo sapiens
tccatatctccttcccctacacct

SEQ ID NO: 989778 - DNA, 14 bp, Homo sapiens
tccatatttattca

SEQ ID NO: 989779 - DNA, 16 bp, Homo sapiens
tccatatttgatttct

SEQ ID NO: 989780 - DNA, 17 bp, Homo sapiens
tccatattttattactg

SEQ ID NO: 989781 - DNA, 19 bp, Homo sapiens
tccatattttattactgtt

SEQ ID NO: 989782 - DNA, 20 bp, Homo sapiens
tccatattttattactgttt

SEQ ID NO: 989783 - DNA, 17 bp, Homo sapiens
tccatcaactaaaacat

SEQ ID NO: 989784 - DNA, 17 bp, Homo sapiens
tccatcaccctcttcct

SEQ ID NO: 989785 - DNA, 23 bp, Homo sapiens
tccatcacctgaaacactggacc

SEQ ID NO: 989786 - DNA, 22 bp, Homo sapiens
tccatcagcgggtctcctccca

SEQ ID NO: 989787 - DNA, 18 bp, Homo sapiens
tccatcaggttccatccc

SEQ ID NO: 989788 - DNA, 21 bp, Homo sapiens
tccatcatatgcctgacccct

SEQ ID NO: 989789 - DNA, 15 bp, Homo sapiens
tccatcatcactgta

SEQ ID NO: 989790 - DNA, 17 bp, Homo sapiens
tccatcatcactgtaaa

SEQ ID NO: 989791 - DNA, 19 bp, Homo sapiens
tccatcatcactgtaaaga

SEQ ID NO: 989792 - DNA, 13 bp, Homo sapiens
tccatcatcatgt

SEQ ID NO: 989793 - DNA, 15 bp, Homo sapiens
tccatcatgtctgta

SEQ ID NO: 989794 - DNA, 23 bp, Homo sapiens
tccatcatgtctgtatactcctg

SEQ ID NO: 989795 - DNA, 13 bp, Homo sapiens
tccatcattcatc

SEQ ID NO: 989796 - DNA, 21 bp, Homo sapiens
tccatccacctcatcactgga

SEQ ID NO: 989797 - DNA, 18 bp, Homo sapiens
tccatccacctttcccaa

SEQ ID NO: 989798 - DNA, 15 bp, Homo sapiens
tccatccacgtggcc

SEQ ID NO: 989799 - DNA, 15 bp, Homo sapiens
tccatccatctccag

SEQ ID NO: 989800 - DNA, 15 bp, Homo sapiens
tccatccatctgtcc

SEQ ID NO: 989801 - DNA, 19 bp, Homo sapiens
tccatcccaacagccatgc

SEQ ID NO: 989802 - DNA, 16 bp, Homo sapiens
tccatcccccttcttc

SEQ ID NO: 989803 - DNA, 23 bp, Homo sapiens
tccatcccccttcttcctcccct

SEQ ID NO: 989804 - DNA, 21 bp, Homo sapiens
tccatccccttcccccatccc

SEQ ID NO: 989805 - DNA, 14 bp, Homo sapiens
tccatccctacccc

SEQ ID NO: 989806 - DNA, 18 bp, Homo sapiens
tccatccctaccccctaa

SEQ ID NO: 989807 - DNA, 12 bp, Homo sapiens
tccatccctcta

SEQ ID NO: 989808 - DNA, 15 bp, Homo sapiens
tccatccctctaatg

SEQ ID NO: 989809 - DNA, 14 bp, Homo sapiens
tccatccctgctct

SEQ ID NO: 989810 - DNA, 24 bp, Homo sapiens
tccatcgcccaggcctgggatgca

SEQ ID NO: 989811 - DNA, 19 bp, Homo sapiens
tccatctagcagctggcct

SEQ ID NO: 989812 - DNA, 14 bp, Homo sapiens
tccatctctcatcc

SEQ ID NO: 989813 - DNA, 15 bp, Homo sapiens
tccatctggcagggt

SEQ ID NO: 989814 - DNA, 16 bp, Homo sapiens
tccatctgtccgtcca

SEQ ID NO: 989815 - DNA, 17 bp, Homo sapiens
tccatctgtctgtccta

SEQ ID NO: 989816 - DNA, 21 bp, Homo sapiens
tccatcttgagatggtgaggc

SEQ ID NO: 989817 - DNA, 22 bp, Homo sapiens
tccatcttggtagttctgtgcc

SEQ ID NO: 989818 - DNA, 18 bp, Homo sapiens
tccatcttgtggggccag

SEQ ID NO: 989819 - DNA, 19 bp, Homo sapiens
tccatcttgtggggccagg

SEQ ID NO: 989820 - DNA, 20 bp, Homo sapiens
tccatcttgtggggccagga

SEQ ID NO: 989821 - DNA, 15 bp, Homo sapiens
tccatctttatagaa

SEQ ID NO: 989822 - DNA, 21 bp, Homo sapiens
tccatgaagaccacatccaca

SEQ ID NO: 989823 - DNA, 17 bp, Homo sapiens
tccatgacctcccctcc

SEQ ID NO: 989824 - DNA, 14 bp, Homo sapiens
tccatgactggctg

SEQ ID NO: 989825 - DNA, 15 bp, Homo sapiens
tccatgagcacccca

SEQ ID NO: 989826 - DNA, 19 bp, Homo sapiens
tccatgagcaccccaaggc

SEQ ID NO: 989827 - DNA, 15 bp, Homo sapiens
tccatgaggtactgg

SEQ ID NO: 989828 - DNA, 22 bp, Homo sapiens
tccatgagttatcatgaatttt

SEQ ID NO: 989829 - DNA, 16 bp, Homo sapiens
tccatgatgatagttg

SEQ ID NO: 989830 - DNA, 15 bp, Homo sapiens
tccatgatggagtca

SEQ ID NO: 989831 - DNA, 20 bp, Homo sapiens
tccatgatgtaatggaagct

SEQ ID NO: 989832 - DNA, 16 bp, Homo sapiens
tccatgcagccttggg

SEQ ID NO: 989833 - DNA, 14 bp, Homo sapiens
tccatgccccagct

SEQ ID NO: 989834 - DNA, 15 bp, Homo sapiens
tccatgccccagctc

SEQ ID NO: 989835 - DNA, 17 bp, Homo sapiens
tccatgccctcccagga

SEQ ID NO: 989836 - DNA, 18 bp, Homo sapiens
tccatgcctctggaggcc

SEQ ID NO: 989837 - DNA, 12 bp, Homo sapiens
tccatgcctgag

SEQ ID NO: 989838 - DNA, 14 bp, Homo sapiens
tccatgcctgaggg

SEQ ID NO: 989839 - DNA, 21 bp, Homo sapiens
tccatgcctgagggtggagac

SEQ ID NO: 989840 - DNA, 21 bp, Homo sapiens
tccatgccttaaacctacctc

SEQ ID NO: 989841 - DNA, 16 bp, Homo sapiens
tccatgcgctcagggc

SEQ ID NO: 989842 - DNA, 17 bp, Homo sapiens
tccatgctataaaaact

SEQ ID NO: 989843 - DNA, 16 bp, Homo sapiens
tccatgctccttgaga

SEQ ID NO: 989844 - DNA, 14 bp, Homo sapiens
tccatgctgcctcc

SEQ ID NO: 989845 - DNA, 21 bp, Homo sapiens
tccatgctgtgcgcccagggc

SEQ ID NO: 989846 - DNA, 19 bp, Homo sapiens
tccatgcttagtcactgcc

SEQ ID NO: 989847 - DNA, 20 bp, Homo sapiens
tccatgcttagtcactgcct

SEQ ID NO: 989848 - DNA, 22 bp, Homo sapiens
tccatgcttagtcactgcctgc

SEQ ID NO: 989849 - DNA, 23 bp, Homo sapiens
tccatgcttagtcactgcctgca

SEQ ID NO: 989850 - DNA, 23 bp, Homo sapiens
tccatggaaataaaaagtatgtt

SEQ ID NO: 989851 - DNA, 16 bp, Homo sapiens
tccatggaatttctag

SEQ ID NO: 989852 - DNA, 16 bp, Homo sapiens
tccatggcaattttgt

SEQ ID NO: 989853 - DNA, 15 bp, Homo sapiens
tccatggcaccagcc

SEQ ID NO: 989854 - DNA, 17 bp, Homo sapiens
tccatggcaccagcccc

SEQ ID NO: 989855 - DNA, 19 bp, Homo sapiens
tccatggcactaaaccact

SEQ ID NO: 989856 - DNA, 14 bp, Homo sapiens
tccatggccacccc

SEQ ID NO: 989857 - DNA, 16 bp, Homo sapiens
tccatggcttcctgag

SEQ ID NO: 989858 - DNA, 18 bp, Homo sapiens
tccatgggagaaaataga

SEQ ID NO: 989859 - DNA, 14 bp, Homo sapiens
tccatgggagccag

SEQ ID NO: 989860 - DNA, 15 bp, Homo sapiens
tccatgggagccagc

SEQ ID NO: 989861 - DNA, 22 bp, Homo sapiens
tccatgggagccagctgctttt

SEQ ID NO: 989862 - DNA, 17 bp, Homo sapiens
tccatgggcagagccca

SEQ ID NO: 989863 - DNA, 22 bp, Homo sapiens
tccatgggcagagcccaaggga

SEQ ID NO: 989864 - DNA, 19 bp, Homo sapiens
tccatgggcccgctgcctc

SEQ ID NO: 989865 - DNA, 21 bp, Homo sapiens
tccatgggcccgctgcctctt

SEQ ID NO: 989866 - DNA, 20 bp, Homo sapiens
tccatgtaataagcacttgc

SEQ ID NO: 989867 - DNA, 20 bp, Homo sapiens
tccatgtactgtagtttttc

SEQ ID NO: 989868 - DNA, 17 bp, Homo sapiens
tccatgtacttgtttgc

SEQ ID NO: 989869 - DNA, 17 bp, Homo sapiens
tccatgtagcaggactg

SEQ ID NO: 989870 - DNA, 21 bp, Homo sapiens
tccatgtataagtgtaaatat

SEQ ID NO: 989871 - DNA, 14 bp, Homo sapiens
tccatgtcagataa

SEQ ID NO: 989872 - DNA, 18 bp, Homo sapiens
tccatgtcgcctctgcat

SEQ ID NO: 989873 - DNA, 11 bp, Homo sapiens
tccatgtgtgt

SEQ ID NO: 989874 - DNA, 14 bp, Homo sapiens
tccatgtgtgtgca

SEQ ID NO: 989875 - DNA, 18 bp, Homo sapiens
tccatgtgtgtgcaagtg

SEQ ID NO: 989876 - DNA, 15 bp, Homo sapiens
tccatgttgctgcca

SEQ ID NO: 989877 - DNA, 18 bp, Homo sapiens
tccatgttggcctgtcac

SEQ ID NO: 989878 - DNA, 13 bp, Homo sapiens
tccatgtttgtaa

SEQ ID NO: 989879 - DNA, 18 bp, Homo sapiens
tccattaaatcaatcagg

SEQ ID NO: 989880 - DNA, 15 bp, Homo sapiens
tccattaacagcaat

SEQ ID NO: 989881 - DNA, 15 bp, Homo sapiens
tccattaactgcttt

SEQ ID NO: 989882 - DNA, 19 bp, Homo sapiens
tccattaactgctttccac

SEQ ID NO: 989883 - DNA, 20 bp, Homo sapiens
tccattaacttagcatgtgt

SEQ ID NO: 989884 - DNA, 22 bp, Homo sapiens
tccattaacttagcatgtgttg

SEQ ID NO: 989885 - DNA, 15 bp, Homo sapiens
tccattaatttaaat

SEQ ID NO: 989886 - DNA, 22 bp, Homo sapiens
tccattaatttaaatgatttaa

SEQ ID NO: 989887 - DNA, 17 bp, Homo sapiens
tccattacgtgcattta

SEQ ID NO: 989888 - DNA, 23 bp, Homo sapiens
tccattacgtgcatttaaactct

SEQ ID NO: 989889 - DNA, 17 bp, Homo sapiens
tccattaggccagcaac

SEQ ID NO: 989890 - DNA, 15 bp, Homo sapiens
tccattatcctttat

SEQ ID NO: 989891 - DNA, 20 bp, Homo sapiens
tccattattgagttcctcct

SEQ ID NO: 989892 - DNA, 15 bp, Homo sapiens
tccattatttatatt

SEQ ID NO: 989893 - DNA, 15 bp, Homo sapiens
tccattattttgtat

SEQ ID NO: 989894 - DNA, 14 bp, Homo sapiens
tccattcagaaagc

SEQ ID NO: 989895 - DNA, 14 bp, Homo sapiens
tccattcagatgaa

SEQ ID NO: 989896 - DNA, 23 bp, Homo sapiens
tccattcattaattagttccagt

SEQ ID NO: 989897 - DNA, 13 bp, Homo sapiens
tccattcctcagg

SEQ ID NO: 989898 - DNA, 12 bp, Homo sapiens
tccattctcatt

SEQ ID NO: 989899 - DNA, 13 bp, Homo sapiens
tccattcttcagt

SEQ ID NO: 989900 - DNA, 16 bp, Homo sapiens
tccattggatctcatt

SEQ ID NO: 989901 - DNA, 23 bp, Homo sapiens
tccattggatctgcaagaacact

SEQ ID NO: 989902 - DNA, 20 bp, Homo sapiens
tccattgggcacagtccaga

SEQ ID NO: 989903 - DNA, 23 bp, Homo sapiens
tccattgtaaaccacaaggctgt

SEQ ID NO: 989904 - DNA, 18 bp, Homo sapiens
tccattgtgtggcctggt

SEQ ID NO: 989905 - DNA, 19 bp, Homo sapiens
tccattgtgtggcctggtg

SEQ ID NO: 989906 - DNA, 20 bp, Homo sapiens
tccattgtgtggcctggtgg

SEQ ID NO: 989907 - DNA, 14 bp, Homo sapiens
tccattgtttaaag

SEQ ID NO: 989908 - DNA, 20 bp, Homo sapiens
tccattgtttgaaacaaaga

SEQ ID NO: 989909 - DNA, 14 bp, Homo sapiens
tccatttaagacac

SEQ ID NO: 989910 - DNA, 19 bp, Homo sapiens
tccatttacagtctctttc

SEQ ID NO: 989911 - DNA, 16 bp, Homo sapiens
tccatttatttatgaa

SEQ ID NO: 989912 - DNA, 18 bp, Homo sapiens
tccatttcccacatcttt

SEQ ID NO: 989913 - DNA, 12 bp, Homo sapiens
tccatttcctaa

SEQ ID NO: 989914 - DNA, 19 bp, Homo sapiens
tccatttctcaatcagtgc

SEQ ID NO: 989915 - DNA, 12 bp, Homo sapiens
tccatttctgat

SEQ ID NO: 989916 - DNA, 17 bp, Homo sapiens
tccatttcttcagaggg

SEQ ID NO: 989917 - DNA, 15 bp, Homo sapiens
tccatttctttcttc

SEQ ID NO: 989918 - DNA, 16 bp, Homo sapiens
tccatttctttcttcc

SEQ ID NO: 989919 - DNA, 13 bp, Homo sapiens
tccatttgagaaa

SEQ ID NO: 989920 - DNA, 12 bp, Homo sapiens
tccatttgcatt

SEQ ID NO: 989921 - DNA, 17 bp, Homo sapiens
tccatttggtcctttct

SEQ ID NO: 989922 - DNA, 14 bp, Homo sapiens
tccatttgttcctg

SEQ ID NO: 989923 - DNA, 14 bp, Homo sapiens
tccattttaaaaac

SEQ ID NO: 989924 - DNA, 13 bp, Homo sapiens
tccattttatgca

SEQ ID NO: 989925 - DNA, 14 bp, Homo sapiens
tccattttccccca

SEQ ID NO: 989926 - DNA, 21 bp, Homo sapiens
tccattttcccccactactgc

SEQ ID NO: 989927 - DNA, 12 bp, Homo sapiens
tccattttctaa

SEQ ID NO: 989928 - DNA, 15 bp, Homo sapiens
tccatttttacaagt

SEQ ID NO: 989929 - DNA, 18 bp, Homo sapiens
tccatttttcctctgttc

SEQ ID NO: 989930 - DNA, 20 bp, Homo sapiens
tccatttttcctctgttcac

SEQ ID NO: 989931 - DNA, 14 bp, Homo sapiens
tcccaaaaaactac

SEQ ID NO: 989932 - DNA, 23 bp, Homo sapiens
tcccaaaacattttaaatgaaag

SEQ ID NO: 989933 - DNA, 16 bp, Homo sapiens
tcccaaaatcccctca

SEQ ID NO: 989934 - DNA, 17 bp, Homo sapiens
tcccaaaatcccctcag

SEQ ID NO: 989935 - DNA, 20 bp, Homo sapiens
tcccaaaatcccctcagcct

SEQ ID NO: 989936 - DNA, 23 bp, Homo sapiens
tcccaaaatcccctcagcctctt

SEQ ID NO: 989937 - DNA, 20 bp, Homo sapiens
tcccaaaatgttgaaatatg

SEQ ID NO: 989938 - DNA, 22 bp, Homo sapiens
tcccaaacgccctttcctcctc

SEQ ID NO: 989939 - DNA, 15 bp, Homo sapiens
tcccaaacgcctccc

SEQ ID NO: 989940 - DNA, 21 bp, Homo sapiens
tcccaaacgcctcccctgccc

SEQ ID NO: 989941 - DNA, 12 bp, Homo sapiens
agcccgggctgc

SEQ ID NO: 989942 - DNA, 14 bp, Homo sapiens
agcccgggctgcct

SEQ ID NO: 989943 - DNA, 20 bp, Homo sapiens
agcccgggctgcctgggctg

SEQ ID NO: 989944 - DNA, 21 bp, Homo sapiens
agcccgggctgcctgggctgt

SEQ ID NO: 989945 - DNA, 14 bp, Homo sapiens
agcccgtctcagtg

SEQ ID NO: 989946 - DNA, 21 bp, Homo sapiens
agcccgtgacagatgccaact

SEQ ID NO: 989947 - DNA, 18 bp, Homo sapiens
agcccgttagccccaggg

SEQ ID NO: 989948 - DNA, 14 bp, Homo sapiens
agccctaaacatca

SEQ ID NO: 989949 - DNA, 15 bp, Homo sapiens
agccctaagcctgtc

SEQ ID NO: 989950 - DNA, 16 bp, Homo sapiens
agccctaagcctgtcc

SEQ ID NO: 989951 - DNA, 19 bp, Homo sapiens
agccctaagcctgtcccca

SEQ ID NO: 989952 - DNA, 20 bp, Homo sapiens
agccctaagcctgtccccag

SEQ ID NO: 989953 - DNA, 22 bp, Homo sapiens
agccctaagcctgtccccagac

SEQ ID NO: 989954 - DNA, 24 bp, Homo sapiens
agccctaagcctgtccccagacca

SEQ ID NO: 989955 - DNA, 15 bp, Homo sapiens
agccctacagagctg

SEQ ID NO: 989956 - DNA, 17 bp, Homo sapiens
agccctacagagctgtg

SEQ ID NO: 989957 - DNA, 21 bp, Homo sapiens
agccctactccctgcagatgc

SEQ ID NO: 989958 - DNA, 19 bp, Homo sapiens
agccctagggtgctctgaa

SEQ ID NO: 989959 - DNA, 17 bp, Homo sapiens
agccctagggtggagag

SEQ ID NO: 989960 - DNA, 13 bp, Homo sapiens
agccctatggatg

SEQ ID NO: 989961 - DNA, 19 bp, Homo sapiens
agccctcacctctgaggac

SEQ ID NO: 989962 - DNA, 20 bp, Homo sapiens
agccctcacctctgaggaca

SEQ ID NO: 989963 - DNA, 21 bp, Homo sapiens
agccctcacctctgaggacag

SEQ ID NO: 989964 - DNA, 23 bp, Homo sapiens
agccctcacctctgaggacagag

SEQ ID NO: 989965 - DNA, 18 bp, Homo sapiens
agccctcagacatttata

SEQ ID NO: 989966 - DNA, 13 bp, Homo sapiens
agccctcaggctc

SEQ ID NO: 989967 - DNA, 16 bp, Homo sapiens
agccctcaggctcccc

SEQ ID NO: 989968 - DNA, 17 bp, Homo sapiens
agccctcaggctcccca

SEQ ID NO: 989969 - DNA, 20 bp, Homo sapiens
agccctcaggctccccagaa

SEQ ID NO: 989970 - DNA, 23 bp, Homo sapiens
agccctcaggctccccagaactg

SEQ ID NO: 989971 - DNA, 14 bp, Homo sapiens
agccctcagtcacc

SEQ ID NO: 989972 - DNA, 16 bp, Homo sapiens
agccctcagtcacccc

SEQ ID NO: 989973 - DNA, 23 bp, Homo sapiens
agccctcagtcagttcccggagc

SEQ ID NO: 989974 - DNA, 23 bp, Homo sapiens
agccctcagttccttcatttcca

SEQ ID NO: 989975 - DNA, 17 bp, Homo sapiens
agccctcatcccacttc

SEQ ID NO: 989976 - DNA, 19 bp, Homo sapiens
agccctcatcccacttcct

SEQ ID NO: 989977 - DNA, 15 bp, Homo sapiens
agccctcatttttat

SEQ ID NO: 989978 - DNA, 17 bp, Homo sapiens
agccctccaaaagcact

SEQ ID NO: 989979 - DNA, 22 bp, Homo sapiens
agccctcccactttgctgttcc

SEQ ID NO: 989980 - DNA, 12 bp, Homo sapiens
agccctccccat

SEQ ID NO: 989981 - DNA, 20 bp, Homo sapiens
agccctccccatggagccag

SEQ ID NO: 989982 - DNA, 12 bp, Homo sapiens
agccctccccct

SEQ ID NO: 989983 - DNA, 14 bp, Homo sapiens
agccctccccctca

SEQ ID NO: 989984 - DNA, 16 bp, Homo sapiens
agccctccccctcaac

SEQ ID NO: 989985 - DNA, 16 bp, Homo sapiens
agccctcccccttccc

SEQ ID NO: 989986 - DNA, 12 bp, Homo sapiens
agccctccctgc

SEQ ID NO: 989987 - DNA, 13 bp, Homo sapiens
agccctccctgcc

SEQ ID NO: 989988 - DNA, 20 bp, Homo sapiens
agccctccctgtcctcctcg

SEQ ID NO: 989989 - DNA, 21 bp, Homo sapiens
agccctccctgtcctcctcgg

SEQ ID NO: 989990 - DNA, 14 bp, Homo sapiens
agccctcctcaccc

SEQ ID NO: 989991 - DNA, 17 bp, Homo sapiens
agccctcctctgcactc

SEQ ID NO: 989992 - DNA, 11 bp, Homo sapiens
agccctccttc

SEQ ID NO: 989993 - DNA, 12 bp, Homo sapiens
agccctccttcc

SEQ ID NO: 989994 - DNA, 13 bp, Homo sapiens
agccctcctttgg

SEQ ID NO: 989995 - DNA, 22 bp, Homo sapiens
agccctcgaaccaaggcagcct

SEQ ID NO: 989996 - DNA, 24 bp, Homo sapiens
agccctcgaaccaaggcagcctcc

SEQ ID NO: 989997 - DNA, 13 bp, Homo sapiens
agccctcggcctc

SEQ ID NO: 989998 - DNA, 16 bp, Homo sapiens
agccctctagggcagg

SEQ ID NO: 989999 - DNA, 19 bp, Homo sapiens
agccctctagggcagggtg

SEQ ID NO: 990000 - DNA, 21 bp, Homo sapiens
agccctctcactccagccaaa

SEQ ID NO: 990001 - DNA, 17 bp, Homo sapiens
agccctctgagccgcca

SEQ ID NO: 990002 - DNA, 16 bp, Homo sapiens
agccctctgcctcctc

SEQ ID NO: 990003 - DNA, 19 bp, Homo sapiens
agccctctttaatgctgtc

SEQ ID NO: 990004 - DNA, 13 bp, Homo sapiens
agccctgaccctg

SEQ ID NO: 990005 - DNA, 23 bp, Homo sapiens
agccctgaccttggctgactggg

SEQ ID NO: 990006 - DNA, 11 bp, Homo sapiens
agccctgactc

SEQ ID NO: 990007 - DNA, 15 bp, Homo sapiens
agccctgactcctgg

SEQ ID NO: 990008 - DNA, 16 bp, Homo sapiens
agccctgactcctgga

SEQ ID NO: 990009 - DNA, 19 bp, Homo sapiens
agccctgagcccggccctc

SEQ ID NO: 990010 - DNA, 20 bp, Homo sapiens
agccctgaggacctctcagc

SEQ ID NO: 990011 - DNA, 22 bp, Homo sapiens
agccctgagtggtcactggtca

SEQ ID NO: 990012 - DNA, 23 bp, Homo sapiens
agccctgagtggtcactggtcag

SEQ ID NO: 990013 - DNA, 16 bp, Homo sapiens
agccctgcataatgtt

SEQ ID NO: 990014 - DNA, 14 bp, Homo sapiens
agccctgcccaccc

SEQ ID NO: 990015 - DNA, 13 bp, Homo sapiens
agccctgccctgc

SEQ ID NO: 990016 - DNA, 14 bp, Homo sapiens
agccctgccctgca

SEQ ID NO: 990017 - DNA, 19 bp, Homo sapiens
agccctgctggggatcccc

SEQ ID NO: 990018 - DNA, 17 bp, Homo sapiens
agccctgctttgggctg

SEQ ID NO: 990019 - DNA, 20 bp, Homo sapiens
agccctgctttgggctgccc

SEQ ID NO: 990020 - DNA, 21 bp, Homo sapiens
agccctgctttgggctgccct

SEQ ID NO: 990021 - DNA, 19 bp, Homo sapiens
agccctggacacccctgct

SEQ ID NO: 990022 - DNA, 18 bp, Homo sapiens
agccctggattaggaggg

SEQ ID NO: 990023 - DNA, 23 bp, Homo sapiens
agccctggatttcagaaagagca

SEQ ID NO: 990024 - DNA, 12 bp, Homo sapiens
agccctggcagg

SEQ ID NO: 990025 - DNA, 13 bp, Homo sapiens
agccctggcagga

SEQ ID NO: 990026 - DNA, 17 bp, Homo sapiens
agccctggcaggatgac

SEQ ID NO: 990027 - DNA, 15 bp, Homo sapiens
agccctggccaagct

SEQ ID NO: 990028 - DNA, 15 bp, Homo sapiens
agccctggcctggct

SEQ ID NO: 990029 - DNA, 12 bp, Homo sapiens
agccctggctcc

SEQ ID NO: 990030 - DNA, 14 bp, Homo sapiens
agccctggctccca

SEQ ID NO: 990031 - DNA, 16 bp, Homo sapiens
agccctggctctgccc

SEQ ID NO: 990032 - DNA, 23 bp, Homo sapiens
agccctggctctgcccctcaggg

SEQ ID NO: 990033 - DNA, 14 bp, Homo sapiens
agccctggctgggt

SEQ ID NO: 990034 - DNA, 18 bp, Homo sapiens
agccctgggatcactgtg

SEQ ID NO: 990035 - DNA, 19 bp, Homo sapiens
agccctgggccccaccacc

SEQ ID NO: 990036 - DNA, 23 bp, Homo sapiens
agccctgggccccaccacctagg

SEQ ID NO: 990037 - DNA, 11 bp, Homo sapiens
agccctgggct

SEQ ID NO: 990038 - DNA, 15 bp, Homo sapiens
agccctgggcttggc

SEQ ID NO: 990039 - DNA, 17 bp, Homo sapiens
agccctgggcttggctc

SEQ ID NO: 990040 - DNA, 23 bp, Homo sapiens
agccctgggtgacttcaggtgga

SEQ ID NO: 990041 - DNA, 22 bp, Homo sapiens
agccctggtgctacttgcttga

SEQ ID NO: 990042 - DNA, 16 bp, Homo sapiens
agccctggtgtgtttc

SEQ ID NO: 990043 - DNA, 15 bp, Homo sapiens
agccctggttctggc

SEQ ID NO: 990044 - DNA, 15 bp, Homo sapiens
agccctgtacccacc

SEQ ID NO: 990045 - DNA, 16 bp, Homo sapiens
agccctgtacccaccc

SEQ ID NO: 990046 - DNA, 18 bp, Homo sapiens
agccctgtacccacccca

SEQ ID NO: 990047 - DNA, 21 bp, Homo sapiens
agccctgtacccaccccagca

SEQ ID NO: 990048 - DNA, 23 bp, Homo sapiens
agccctgtacccaccccagcaca

SEQ ID NO: 990049 - DNA, 16 bp, Homo sapiens
agccctgtcctggtgg

SEQ ID NO: 990050 - DNA, 19 bp, Homo sapiens
agccctgtcctggttcctt

SEQ ID NO: 990051 - DNA, 18 bp, Homo sapiens
agccctgtcgagacactt

SEQ ID NO: 990052 - DNA, 12 bp, Homo sapiens
agccctgtgtct

SEQ ID NO: 990053 - DNA, 21 bp, Homo sapiens
agccctgttgacacaggtctt

SEQ ID NO: 990054 - DNA, 18 bp, Homo sapiens
agccctgttggcagctct

SEQ ID NO: 990055 - DNA, 16 bp, Homo sapiens
agcccttagcacagag

SEQ ID NO: 990056 - DNA, 19 bp, Homo sapiens
agcccttagcacagagagg

SEQ ID NO: 990057 - DNA, 22 bp, Homo sapiens
agcccttagcacagagagggac

SEQ ID NO: 990058 - DNA, 23 bp, Homo sapiens
agcccttagcacagagagggaca

SEQ ID NO: 990059 - DNA, 16 bp, Homo sapiens
agcccttatggccaat

SEQ ID NO: 990060 - DNA, 17 bp, Homo sapiens
agcccttcactgccatg

SEQ ID NO: 990061 - DNA, 15 bp, Homo sapiens
agcccttccagcctg

SEQ ID NO: 990062 - DNA, 17 bp, Homo sapiens
agcccttccagcctggg

SEQ ID NO: 990063 - DNA, 19 bp, Homo sapiens
ccatctcagcctcctgagc

SEQ ID NO: 990064 - DNA, 22 bp, Homo sapiens
ccatctcagcctcctgagcctg

SEQ ID NO: 990065 - DNA, 23 bp, Homo sapiens
ccatctcagcctcctgagcctgt

SEQ ID NO: 990066 - DNA, 21 bp, Homo sapiens
ccatctcaggacacttccgta

SEQ ID NO: 990067 - DNA, 23 bp, Homo sapiens
ccatctcaggagatggagggctt

SEQ ID NO: 990068 - DNA, 18 bp, Homo sapiens
ccatctcaggccacctgc

SEQ ID NO: 990069 - DNA, 22 bp, Homo sapiens
ccatctcaggccacctgccccc

SEQ ID NO: 990070 - DNA, 17 bp, Homo sapiens
ccatctcaggtgccact

SEQ ID NO: 990071 - DNA, 14 bp, Homo sapiens
ccatctcaggttgg

SEQ ID NO: 990072 - DNA, 14 bp, Homo sapiens
ccatctcatcctgg

SEQ ID NO: 990073 - DNA, 20 bp, Homo sapiens
ccatctcatgaggggagagg

SEQ ID NO: 990074 - DNA, 15 bp, Homo sapiens
ccatctccagggaag

SEQ ID NO: 990075 - DNA, 21 bp, Homo sapiens
ccatctccagggagcaagaca

SEQ ID NO: 990076 - DNA, 14 bp, Homo sapiens
ccatctccccaggc

SEQ ID NO: 990077 - DNA, 16 bp, Homo sapiens
ccatctccccaggcct

SEQ ID NO: 990078 - DNA, 16 bp, Homo sapiens
ccatctccctccccag

SEQ ID NO: 990079 - DNA, 22 bp, Homo sapiens
ccatctccctccccagaaacag

SEQ ID NO: 990080 - DNA, 16 bp, Homo sapiens
ccatctccctgctttg

SEQ ID NO: 990081 - DNA, 19 bp, Homo sapiens
ccatctccttacctctgga

SEQ ID NO: 990082 - DNA, 20 bp, Homo sapiens
ccatctcgggcacaggccca

SEQ ID NO: 990083 - DNA, 16 bp, Homo sapiens
ccatctcggggctgct

SEQ ID NO: 990084 - DNA, 15 bp, Homo sapiens
ccatctctcccactt

SEQ ID NO: 990085 - DNA, 19 bp, Homo sapiens
ccatctctcccacttcctc

SEQ ID NO: 990086 - DNA, 20 bp, Homo sapiens
ccatctctcccacttcctcc

SEQ ID NO: 990087 - DNA, 21 bp, Homo sapiens
ccatctctcccacttcctcct

SEQ ID NO: 990088 - DNA, 23 bp, Homo sapiens
ccatctctccctcccctgccatt

SEQ ID NO: 990089 - DNA, 22 bp, Homo sapiens
ccatctgatgtgatgtgaatac

SEQ ID NO: 990090 - DNA, 19 bp, Homo sapiens
ccatctgatgtttcatatt

SEQ ID NO: 990091 - DNA, 23 bp, Homo sapiens
ccatctgcaccccttctctcctc

SEQ ID NO: 990092 - DNA, 12 bp, Homo sapiens
ccatctgcccag

SEQ ID NO: 990093 - DNA, 21 bp, Homo sapiens
ccatctgcccaggggtgcccc

SEQ ID NO: 990094 - DNA, 22 bp, Homo sapiens
ccatctgcgtgacaataaaaca

SEQ ID NO: 990095 - DNA, 14 bp, Homo sapiens
ccatctgctgcagt

SEQ ID NO: 990096 - DNA, 16 bp, Homo sapiens
ccatctgggagtcccc

SEQ ID NO: 990097 - DNA, 12 bp, Homo sapiens
ccatctgggctc

SEQ ID NO: 990098 - DNA, 22 bp, Homo sapiens
ccatctgggtccttgcacccct

SEQ ID NO: 990099 - DNA, 15 bp, Homo sapiens
ccatctgtaaatatc

SEQ ID NO: 990100 - DNA, 13 bp, Homo sapiens
ccatctgtccaca

SEQ ID NO: 990101 - DNA, 23 bp, Homo sapiens
ccatctgtccacatccccagagc

SEQ ID NO: 990102 - DNA, 20 bp, Homo sapiens
ccatctgtccagctggggcc

SEQ ID NO: 990103 - DNA, 23 bp, Homo sapiens
ccatctgtccgtccagagccggc

SEQ ID NO: 990104 - DNA, 12 bp, Homo sapiens
ccatctgtctgt

SEQ ID NO: 990105 - DNA, 16 bp, Homo sapiens
ccatctgtctgtccta

SEQ ID NO: 990106 - DNA, 14 bp, Homo sapiens
ccatctgtcttcag

SEQ ID NO: 990107 - DNA, 15 bp, Homo sapiens
ccatctgtcttcagc

SEQ ID NO: 990108 - DNA, 20 bp, Homo sapiens
ccatcttaaatgacagtgaa

SEQ ID NO: 990109 - DNA, 18 bp, Homo sapiens
ccatcttactctgcccta

SEQ ID NO: 990110 - DNA, 22 bp, Homo sapiens
ccatcttccacctcacctcttt

SEQ ID NO: 990111 - DNA, 15 bp, Homo sapiens
ccatcttccacctgt

SEQ ID NO: 990112 - DNA, 19 bp, Homo sapiens
ccatcttccacctgtgccc

SEQ ID NO: 990113 - DNA, 15 bp, Homo sapiens
ccatcttccaggatg

SEQ ID NO: 990114 - DNA, 22 bp, Homo sapiens
ccatcttcttcccttaactcca

SEQ ID NO: 990115 - DNA, 22 bp, Homo sapiens
ccatcttgagatggtgaggctg

SEQ ID NO: 990116 - DNA, 21 bp, Homo sapiens
ccatcttgcttccctaatcta

SEQ ID NO: 990117 - DNA, 17 bp, Homo sapiens
ccatcttggtagttctg

SEQ ID NO: 990118 - DNA, 21 bp, Homo sapiens
ccatcttggtagttctgtgcc

SEQ ID NO: 990119 - DNA, 16 bp, Homo sapiens
ccatcttgtggggcca

SEQ ID NO: 990120 - DNA, 17 bp, Homo sapiens
ccatcttgtggggccag

SEQ ID NO: 990121 - DNA, 19 bp, Homo sapiens
ccatcttgtggggccagga

SEQ ID NO: 990122 - DNA, 15 bp, Homo sapiens
ccatctttactccca

SEQ ID NO: 990123 - DNA, 24 bp, Homo sapiens
ccatctttatagaaggaatttgta

SEQ ID NO: 990124 - DNA, 14 bp, Homo sapiens
ccatctttgatcct

SEQ ID NO: 990125 - DNA, 12 bp, Homo sapiens
ccatctttttct

SEQ ID NO: 990126 - DNA, 19 bp, Homo sapiens
ccatgaaaacgttttattg

SEQ ID NO: 990127 - DNA, 21 bp, Homo sapiens
ccatgaaaacgttttattgtg

SEQ ID NO: 990128 - DNA, 23 bp, Homo sapiens
ccatgaaaataccataggaagac

SEQ ID NO: 990129 - DNA, 16 bp, Homo sapiens
ccatgaacagaaaaca

SEQ ID NO: 990130 - DNA, 22 bp, Homo sapiens
ccatgaacagaaaacattctga

SEQ ID NO: 990131 - DNA, 14 bp, Homo sapiens
ccatgaacttgata

SEQ ID NO: 990132 - DNA, 22 bp, Homo sapiens
ccatgaacttgatacgtccgtg

SEQ ID NO: 990133 - DNA, 17 bp, Homo sapiens
ccatgaagacaggacag

SEQ ID NO: 990134 - DNA, 13 bp, Homo sapiens
ccatgaagcatta

SEQ ID NO: 990135 - DNA, 18 bp, Homo sapiens
ccatgaatctctgcctct

SEQ ID NO: 990136 - DNA, 20 bp, Homo sapiens
ccatgaatctctgcctctcc

SEQ ID NO: 990137 - DNA, 19 bp, Homo sapiens
ccatgaatgtatcaggaaa

SEQ ID NO: 990138 - DNA, 17 bp, Homo sapiens
ccatgacaaacctagct

SEQ ID NO: 990139 - DNA, 20 bp, Homo sapiens
ccatgacagaggctgcaccc

SEQ ID NO: 990140 - DNA, 18 bp, Homo sapiens
ccatgacatttcatctgg

SEQ ID NO: 990141 - DNA, 17 bp, Homo sapiens
ccatgacccacccctgt

SEQ ID NO: 990142 - DNA, 21 bp, Homo sapiens
ccatgaccctacataaggctg

SEQ ID NO: 990143 - DNA, 17 bp, Homo sapiens
ccatgacctcccctccc

SEQ ID NO: 990144 - DNA, 21 bp, Homo sapiens
ccatgacctcccctccccagc

SEQ ID NO: 990145 - DNA, 16 bp, Homo sapiens
ccatgactgcacccag

SEQ ID NO: 990146 - DNA, 21 bp, Homo sapiens
ccatgactgcacccagctcca

SEQ ID NO: 990147 - DNA, 17 bp, Homo sapiens
ccatgactgcattttac

SEQ ID NO: 990148 - DNA, 14 bp, Homo sapiens
ccatgactggctgt

SEQ ID NO: 990149 - DNA, 17 bp, Homo sapiens
ccatgagaagagggcct

SEQ ID NO: 990150 - DNA, 19 bp, Homo sapiens
ccatgagaagagggcctgt

SEQ ID NO: 990151 - DNA, 21 bp, Homo sapiens
ccatgagaagagggcctgtgg

SEQ ID NO: 990152 - DNA, 20 bp, Homo sapiens
ccatgagactgatccctggc

SEQ ID NO: 990153 - DNA, 21 bp, Homo sapiens
ccatgagcaccccaaggctgc

SEQ ID NO: 990154 - DNA, 22 bp, Homo sapiens
ccatgagcaccccaaggctgcg

SEQ ID NO: 990155 - DNA, 23 bp, Homo sapiens
ccatgagcctgcccgctgcaatg

SEQ ID NO: 990156 - DNA, 19 bp, Homo sapiens
ccatgagctccagaccccc

SEQ ID NO: 990157 - DNA, 19 bp, Homo sapiens
ccatgagctcggggtccac

SEQ ID NO: 990158 - DNA, 21 bp, Homo sapiens
ccatgagctcggggtccacca

SEQ ID NO: 990159 - DNA, 22 bp, Homo sapiens
ccatgagctcggggtccaccag

SEQ ID NO: 990160 - DNA, 22 bp, Homo sapiens
ccatgaggtactggtcccttcc

SEQ ID NO: 990161 - DNA, 17 bp, Homo sapiens
ccatgagtccttgaaaa

SEQ ID NO: 990162 - DNA, 21 bp, Homo sapiens
ccatgagttggggtctggcag

SEQ ID NO: 990163 - DNA, 16 bp, Homo sapiens
ccatgataagaacaga

SEQ ID NO: 990164 - DNA, 13 bp, Homo sapiens
ccatgatagctgg

SEQ ID NO: 990165 - DNA, 16 bp, Homo sapiens
ccatgatccctgtgtt

SEQ ID NO: 990166 - DNA, 17 bp, Homo sapiens
ccatgatccctgtgttg

SEQ ID NO: 990167 - DNA, 22 bp, Homo sapiens
ccatgatccctgtgttgtctct

SEQ ID NO: 990168 - DNA, 15 bp, Homo sapiens
ccatgatctgtattt

SEQ ID NO: 990169 - DNA, 14 bp, Homo sapiens
ccatgatgtatatc

SEQ ID NO: 990170 - DNA, 21 bp, Homo sapiens
ccatgattaaccacttcagct

SEQ ID NO: 990171 - DNA, 14 bp, Homo sapiens
ccatgattcgccca

SEQ ID NO: 990172 - DNA, 19 bp, Homo sapiens
ccatgatttgtcccagcct

SEQ ID NO: 990173 - DNA, 20 bp, Homo sapiens
ccatgatttgtcccagcctg

SEQ ID NO: 990174 - DNA, 22 bp, Homo sapiens
ccatgatttgtcccagcctggg

SEQ ID NO: 990175 - DNA, 21 bp, Homo sapiens
ccatgatttttggtatttatg

SEQ ID NO: 990176 - DNA, 18 bp, Homo sapiens
ccatgcacctcagggcca

SEQ ID NO: 990177 - DNA, 19 bp, Homo sapiens
ccatgcactttaattgaag

SEQ ID NO: 990178 - DNA, 14 bp, Homo sapiens
ccatgcagaacacc

SEQ ID NO: 990179 - DNA, 21 bp, Homo sapiens
ccatgcagacctcatgcccag

SEQ ID NO: 990180 - DNA, 22 bp, Homo sapiens
ccatgcagacctcatgcccagc

SEQ ID NO: 990181 - DNA, 20 bp, Homo sapiens
ccatgcagcccctgggccct

SEQ ID NO: 990182 - DNA, 16 bp, Homo sapiens
ccatgcaggaagaggc

SEQ ID NO: 990183 - DNA, 22 bp, Homo sapiens
cccaaaggggacaggcctcacc

SEQ ID NO: 990184 - DNA, 22 bp, Homo sapiens
cccaaagtaccacactgagttc

SEQ ID NO: 990185 - DNA, 19 bp, Homo sapiens
cccaaagtcctctgctcca

SEQ ID NO: 990186 - DNA, 21 bp, Homo sapiens
cccaaagtcctctgctccagc

SEQ ID NO: 990187 - DNA, 19 bp, Homo sapiens
cccaaatatgtattttcct

SEQ ID NO: 990188 - DNA, 18 bp, Homo sapiens
cccaaatggccattttaa

SEQ ID NO: 990189 - DNA, 13 bp, Homo sapiens
cccaacactgtgc

SEQ ID NO: 990190 - DNA, 15 bp, Homo sapiens
cccaacactgtgccc

SEQ ID NO: 990191 - DNA, 18 bp, Homo sapiens
cccaacactgtgccctgg

SEQ ID NO: 990192 - DNA, 20 bp, Homo sapiens
cccaacactgtgccctggtg

SEQ ID NO: 990193 - DNA, 18 bp, Homo sapiens
cccaacagaaggaaggag

SEQ ID NO: 990194 - DNA, 19 bp, Homo sapiens
cccaacaggaatttttaaa

SEQ ID NO: 990195 - DNA, 23 bp, Homo sapiens
cccaacatgggagggatcagccc

SEQ ID NO: 990196 - DNA, 17 bp, Homo sapiens
cccaaccaaccagcagg

SEQ ID NO: 990197 - DNA, 16 bp, Homo sapiens
cccaaccaaggaagga

SEQ ID NO: 990198 - DNA, 16 bp, Homo sapiens
cccaacccaaaccatg

SEQ ID NO: 990199 - DNA, 12 bp, Homo sapiens
cccaacccccac

SEQ ID NO: 990200 - DNA, 13 bp, Homo sapiens
cccaacccccacc

SEQ ID NO: 990201 - DNA, 23 bp, Homo sapiens
cccaacccccagaggtggccctt

SEQ ID NO: 990202 - DNA, 18 bp, Homo sapiens
cccaacccccctcctgct

SEQ ID NO: 990203 - DNA, 22 bp, Homo sapiens
cccaacccccgcaccaagcaga

SEQ ID NO: 990204 - DNA, 20 bp, Homo sapiens
cccaaccccgcggtgctctg

SEQ ID NO: 990205 - DNA, 21 bp, Homo sapiens
cccaaccccgcggtgctctgg

SEQ ID NO: 990206 - DNA, 20 bp, Homo sapiens
cccaaccctatctcctgaca

SEQ ID NO: 990207 - DNA, 15 bp, Homo sapiens
cccaacctcaatgcc

SEQ ID NO: 990208 - DNA, 18 bp, Homo sapiens
cccaacctcaatgccctg

SEQ ID NO: 990209 - DNA, 21 bp, Homo sapiens
cccaacctcaatgccctgcca

SEQ ID NO: 990210 - DNA, 20 bp, Homo sapiens
cccaacctcagggctcccag

SEQ ID NO: 990211 - DNA, 14 bp, Homo sapiens
cccaacctgctctc

SEQ ID NO: 990212 - DNA, 21 bp, Homo sapiens
cccaacctgctctcctcttgc

SEQ ID NO: 990213 - DNA, 23 bp, Homo sapiens
cccaacctgctctcctcttgcca

SEQ ID NO: 990214 - DNA, 14 bp, Homo sapiens
cccaacctgctgaa

SEQ ID NO: 990215 - DNA, 16 bp, Homo sapiens
cccaacctttccctca

SEQ ID NO: 990216 - DNA, 16 bp, Homo sapiens
cccaacggccctgcag

SEQ ID NO: 990217 - DNA, 20 bp, Homo sapiens
cccaacggccctgcagccag

SEQ ID NO: 990218 - DNA, 17 bp, Homo sapiens
cccaacggggtggggag

SEQ ID NO: 990219 - DNA, 19 bp, Homo sapiens
cccaacgtcccctccgccg

SEQ ID NO: 990220 - DNA, 18 bp, Homo sapiens
cccaactccaggaaagag

SEQ ID NO: 990221 - DNA, 18 bp, Homo sapiens
cccaactccaggggcacc

SEQ ID NO: 990222 - DNA, 19 bp, Homo sapiens
cccaactccaggggcacct

SEQ ID NO: 990223 - DNA, 16 bp, Homo sapiens
cccaactccctgccat

SEQ ID NO: 990224 - DNA, 22 bp, Homo sapiens
cccaactccctgccatttttta

SEQ ID NO: 990225 - DNA, 16 bp, Homo sapiens
cccaactccgcccagc

SEQ ID NO: 990226 - DNA, 16 bp, Homo sapiens
cccaactctccccagt

SEQ ID NO: 990227 - DNA, 17 bp, Homo sapiens
cccaactctccccagtg

SEQ ID NO: 990228 - DNA, 15 bp, Homo sapiens
cccaactctgagccc

SEQ ID NO: 990229 - DNA, 18 bp, Homo sapiens
cccaactctgagcccatg

SEQ ID NO: 990230 - DNA, 19 bp, Homo sapiens
cccaactctgagcccatgt

SEQ ID NO: 990231 - DNA, 23 bp, Homo sapiens
cccaactcttgcacagtcactgc

SEQ ID NO: 990232 - DNA, 23 bp, Homo sapiens
cccaactgagtcatcttgtgagt

SEQ ID NO: 990233 - DNA, 13 bp, Homo sapiens
cccaactgtcttt

SEQ ID NO: 990234 - DNA, 16 bp, Homo sapiens
cccaacttcaccaccc

SEQ ID NO: 990235 - DNA, 19 bp, Homo sapiens
cccaacttcaccaccccct

SEQ ID NO: 990236 - DNA, 20 bp, Homo sapiens
cccaactttgtggatgtctt

SEQ ID NO: 990237 - DNA, 17 bp, Homo sapiens
cccaagaaaccaaagtc

SEQ ID NO: 990238 - DNA, 19 bp, Homo sapiens
cccaagaaaggaaaccttt

SEQ ID NO: 990239 - DNA, 21 bp, Homo sapiens
cccaagaatagatgctgactg

SEQ ID NO: 990240 - DNA, 16 bp, Homo sapiens
cccaagacacttcccc

SEQ ID NO: 990241 - DNA, 18 bp, Homo sapiens
cccaagacacttcccctt

SEQ ID NO: 990242 - DNA, 14 bp, Homo sapiens
cccaagagaactcg

SEQ ID NO: 990243 - DNA, 16 bp, Homo sapiens
cccaagagcagagtct

SEQ ID NO: 990244 - DNA, 21 bp, Homo sapiens
cccaagagcagagtctgggcc

SEQ ID NO: 990245 - DNA, 12 bp, Homo sapiens
cccaagagccat

SEQ ID NO: 990246 - DNA, 20 bp, Homo sapiens
cccaagaggggcgggctcag

SEQ ID NO: 990247 - DNA, 21 bp, Homo sapiens
cccaagaggggcgggctcaga

SEQ ID NO: 990248 - DNA, 23 bp, Homo sapiens
cccaagaggtcaaggctgcagtg

SEQ ID NO: 990249 - DNA, 20 bp, Homo sapiens
cccaagaggtctgagccctg

SEQ ID NO: 990250 - DNA, 18 bp, Homo sapiens
cccaagatgagctgcagc

SEQ ID NO: 990251 - DNA, 22 bp, Homo sapiens
cccaagatgggcatcttttgta

SEQ ID NO: 990252 - DNA, 15 bp, Homo sapiens
cccaagcagccagcc

SEQ ID NO: 990253 - DNA, 12 bp, Homo sapiens
cccaagcagccg

SEQ ID NO: 990254 - DNA, 14 bp, Homo sapiens
cccaagccagaggc

SEQ ID NO: 990255 - DNA, 20 bp, Homo sapiens
cccaagccccatctcatcct

SEQ ID NO: 990256 - DNA, 12 bp, Homo sapiens
cccaagcctggg

SEQ ID NO: 990257 - DNA, 16 bp, Homo sapiens
cccaagctgcctctgg

SEQ ID NO: 990258 - DNA, 11 bp, Homo sapiens
cccaagctggc

SEQ ID NO: 990259 - DNA, 14 bp, Homo sapiens
cccaagctgtggca

SEQ ID NO: 990260 - DNA, 21 bp, Homo sapiens
cccaagctgtggcagccgtcc

SEQ ID NO: 990261 - DNA, 18 bp, Homo sapiens
cccaagcttggcagccga

SEQ ID NO: 990262 - DNA, 22 bp, Homo sapiens
cccaaggaagctccttcctgtt

SEQ ID NO: 990263 - DNA, 23 bp, Homo sapiens
cccaaggacatgagtctgtagga

SEQ ID NO: 990264 - DNA, 16 bp, Homo sapiens
cccaaggactgagggc

SEQ ID NO: 990265 - DNA, 23 bp, Homo sapiens
cccaaggactgagggcagtgccc

SEQ ID NO: 990266 - DNA, 22 bp, Homo sapiens
cccaaggagcacaggtcccacc

SEQ ID NO: 990267 - DNA, 22 bp, Homo sapiens
cccaaggagctgatttccaggc

SEQ ID NO: 990268 - DNA, 23 bp, Homo sapiens
cccaaggagctgatttccaggcc

SEQ ID NO: 990269 - DNA, 14 bp, Homo sapiens
cccaaggaggaaaa

SEQ ID NO: 990270 - DNA, 22 bp, Homo sapiens
cccaaggaggaaaaacagacaa

SEQ ID NO: 990271 - DNA, 11 bp, Homo sapiens
cccaaggccag

SEQ ID NO: 990272 - DNA, 19 bp, Homo sapiens
cccaaggctcactgcagcg

SEQ ID NO: 990273 - DNA, 19 bp, Homo sapiens
cccaaggctcccggaattc

SEQ ID NO: 990274 - DNA, 13 bp, Homo sapiens
cccaagggatctg

SEQ ID NO: 990275 - DNA, 22 bp, Homo sapiens
cccaaggggtctgtatatacat

SEQ ID NO: 990276 - DNA, 11 bp, Homo sapiens
cccaaggttcc

SEQ ID NO: 990277 - DNA, 13 bp, Homo sapiens
cccaaggttccag

SEQ ID NO: 990278 - DNA, 15 bp, Homo sapiens
cccaaggttggagcc

SEQ ID NO: 990279 - DNA, 19 bp, Homo sapiens
cccaaggttggagcccagg

SEQ ID NO: 990280 - DNA, 20 bp, Homo sapiens
cccaagtagctgggattaca

SEQ ID NO: 990281 - DNA, 17 bp, Homo sapiens
cccaagtatgccttaag

SEQ ID NO: 990282 - DNA, 21 bp, Homo sapiens
cccaagtcaaagatgccccat

SEQ ID NO: 990283 - DNA, 22 bp, Homo sapiens
cccaagtcatttccgtcccccc

SEQ ID NO: 990284 - DNA, 16 bp, Homo sapiens
cccaagtcctgaagag

SEQ ID NO: 990285 - DNA, 23 bp, Homo sapiens
cccaagtgatccttccacctcag

SEQ ID NO: 990286 - DNA, 12 bp, Homo sapiens
cccaagtgcctc

SEQ ID NO: 990287 - DNA, 17 bp, Homo sapiens
cccaagtgggcagtcac

SEQ ID NO: 990288 - DNA, 18 bp, Homo sapiens
cccaagtgggcagtcacc

SEQ ID NO: 990289 - DNA, 20 bp, Homo sapiens
cccaagtgggcagtcaccac

SEQ ID NO: 990290 - DNA, 14 bp, Homo sapiens
cccaagtgggggca

SEQ ID NO: 990291 - DNA, 15 bp, Homo sapiens
cccaagtgtgaacaa

SEQ ID NO: 990292 - DNA, 13 bp, Homo sapiens
cccaagttgcagt

SEQ ID NO: 990293 - DNA, 17 bp, Homo sapiens
cccaagttgcagtgagc

SEQ ID NO: 990294 - DNA, 15 bp, Homo sapiens
cccaagttgggggtc

SEQ ID NO: 990295 - DNA, 11 bp, Homo sapiens
cccaataaaag

SEQ ID NO: 990296 - DNA, 12 bp, Homo sapiens
cccaataaaagt

SEQ ID NO: 990297 - DNA, 13 bp, Homo sapiens
cccaataaaggca

SEQ ID NO: 990298 - DNA, 16 bp, Homo sapiens
cccaataaaggcagct

SEQ ID NO: 990299 - DNA, 20 bp, Homo sapiens
cccaataaaggcagctgcct

SEQ ID NO: 990300 - DNA, 20 bp, Homo sapiens
cccaatcagcttttgttcta

SEQ ID NO: 990301 - DNA, 19 bp, Homo sapiens
cccaatcccagctacctca

SEQ ID NO: 990302 - DNA, 17 bp, Homo sapiens
cccaatccctctccact

SEQ ID NO: 990303 - DNA, 15 bp, Homo sapiens
cccaatccctgccac

SEQ ID NO: 990304 - DNA, 18 bp, Homo sapiens
tgggcaggcaagcccttc

SEQ ID NO: 990305 - DNA, 13 bp, Homo sapiens
tgggcagggaggg

SEQ ID NO: 990306 - DNA, 15 bp, Homo sapiens
tgggcagggaggggc

SEQ ID NO: 990307 - DNA, 15 bp, Homo sapiens
tgggcaggtggtggc

SEQ ID NO: 990308 - DNA, 16 bp, Homo sapiens
tgggcaggtggtggca

SEQ ID NO: 990309 - DNA, 16 bp, Homo sapiens
tgggcaggttcctggg

SEQ ID NO: 990310 - DNA, 18 bp, Homo sapiens
tgggcaggttcctggggc

SEQ ID NO: 990311 - DNA, 20 bp, Homo sapiens
tgggcaggttcctggggccg

SEQ ID NO: 990312 - DNA, 23 bp, Homo sapiens
tgggcaggttcctggggccgcct

SEQ ID NO: 990313 - DNA, 15 bp, Homo sapiens
tgggcagtcaccacc

SEQ ID NO: 990314 - DNA, 20 bp, Homo sapiens
tgggcagtcaccacccagcc

SEQ ID NO: 990315 - DNA, 21 bp, Homo sapiens
tgggcagtcaccacccagccc

SEQ ID NO: 990316 - DNA, 12 bp, Homo sapiens
tgggcagtgcca

SEQ ID NO: 990317 - DNA, 18 bp, Homo sapiens
tgggcagtgccacccgca

SEQ ID NO: 990318 - DNA, 23 bp, Homo sapiens
tgggcagtgccccagggagtcca

SEQ ID NO: 990319 - DNA, 24 bp, Homo sapiens
tgggcagtgccccagggagtccag

SEQ ID NO: 990320 - DNA, 17 bp, Homo sapiens
tgggcagttctcccagg

SEQ ID NO: 990321 - DNA, 18 bp, Homo sapiens
tgggcagttctcccaggg

SEQ ID NO: 990322 - DNA, 15 bp, Homo sapiens
tgggcagttttttga

SEQ ID NO: 990323 - DNA, 23 bp, Homo sapiens
tgggcatccacccagtgctgcca

SEQ ID NO: 990324 - DNA, 19 bp, Homo sapiens
tgggcatcttttgtattaa

SEQ ID NO: 990325 - DNA, 22 bp, Homo sapiens
tgggcatgccaccctcacacac

SEQ ID NO: 990326 - DNA, 18 bp, Homo sapiens
tgggcatgggtccagggc

SEQ ID NO: 990327 - DNA, 16 bp, Homo sapiens
tgggcattgcagcctt

SEQ ID NO: 990328 - DNA, 19 bp, Homo sapiens
tgggcattgcagccttgcg

SEQ ID NO: 990329 - DNA, 23 bp, Homo sapiens
tgggcattgcagccttgcgctgt

SEQ ID NO: 990330 - DNA, 18 bp, Homo sapiens
tgggcattgggctgacac

SEQ ID NO: 990331 - DNA, 13 bp, Homo sapiens
tgggcatttattt

SEQ ID NO: 990332 - DNA, 16 bp, Homo sapiens
tgggcatttattttat

SEQ ID NO: 990333 - DNA, 22 bp, Homo sapiens
tgggcatttattttataacatg

SEQ ID NO: 990334 - DNA, 15 bp, Homo sapiens
tgggcatttggtgag

SEQ ID NO: 990335 - DNA, 16 bp, Homo sapiens
tgggcatttggtgaga

SEQ ID NO: 990336 - DNA, 14 bp, Homo sapiens
tgggcattttcctc

SEQ ID NO: 990337 - DNA, 19 bp, Homo sapiens
tgggcattttcctcctctg

SEQ ID NO: 990338 - DNA, 21 bp, Homo sapiens
tgggccaaatccgctctcttc

SEQ ID NO: 990339 - DNA, 18 bp, Homo sapiens
tgggccaaggtgtttcca

SEQ ID NO: 990340 - DNA, 21 bp, Homo sapiens
tgggccaagtccactgtcctc

SEQ ID NO: 990341 - DNA, 22 bp, Homo sapiens
tgggccacacccaggaagggaa

SEQ ID NO: 990342 - DNA, 15 bp, Homo sapiens
tgggccacaggggac

SEQ ID NO: 990343 - DNA, 22 bp, Homo sapiens
tgggccacaggggacagggctg

SEQ ID NO: 990344 - DNA, 18 bp, Homo sapiens
tgggccaccgcccagctc

SEQ ID NO: 990345 - DNA, 17 bp, Homo sapiens
tgggccacctcctaccc

SEQ ID NO: 990346 - DNA, 20 bp, Homo sapiens
tgggccactctcccctccct

SEQ ID NO: 990347 - DNA, 14 bp, Homo sapiens
tgggccactgggga

SEQ ID NO: 990348 - DNA, 15 bp, Homo sapiens
tgggccactgtggtg

SEQ ID NO: 990349 - DNA, 13 bp, Homo sapiens
tgggccagagaag

SEQ ID NO: 990350 - DNA, 11 bp, Homo sapiens
tgggccagagc

SEQ ID NO: 990351 - DNA, 22 bp, Homo sapiens
tgggccagcataggggggaggg

SEQ ID NO: 990352 - DNA, 18 bp, Homo sapiens
tgggccagccacagagca

SEQ ID NO: 990353 - DNA, 15 bp, Homo sapiens
tgggccagcccctcc

SEQ ID NO: 990354 - DNA, 18 bp, Homo sapiens
tgggccagcccctcccac

SEQ ID NO: 990355 - DNA, 13 bp, Homo sapiens
tgggccagccctg

SEQ ID NO: 990356 - DNA, 17 bp, Homo sapiens
tgggccagcggggctgc

SEQ ID NO: 990357 - DNA, 20 bp, Homo sapiens
tgggccagcggggctgctca

SEQ ID NO: 990358 - DNA, 17 bp, Homo sapiens
tgggccaggacaggccc

SEQ ID NO: 990359 - DNA, 18 bp, Homo sapiens
tgggccaggacaggcccg

SEQ ID NO: 990360 - DNA, 19 bp, Homo sapiens
tgggccaggatccccctct

SEQ ID NO: 990361 - DNA, 13 bp, Homo sapiens
tgggccaggcagg

SEQ ID NO: 990362 - DNA, 16 bp, Homo sapiens
tgggccaggcaggcga

SEQ ID NO: 990363 - DNA, 13 bp, Homo sapiens
tgggccagggaaa

SEQ ID NO: 990364 - DNA, 21 bp, Homo sapiens
tgggccagggctgccctgaga

SEQ ID NO: 990365 - DNA, 23 bp, Homo sapiens
tgggagtcacacagtgttggagg

SEQ ID NO: 990366 - DNA, 16 bp, Homo sapiens
tgggagtcagagccct

SEQ ID NO: 990367 - DNA, 21 bp, Homo sapiens
tgggagtcagagccctggctg

SEQ ID NO: 990368 - DNA, 22 bp, Homo sapiens
tgggagtcagagccctggctgg

SEQ ID NO: 990369 - DNA, 23 bp, Homo sapiens
tgggagtcaggcctgggcaggac

SEQ ID NO: 990370 - DNA, 14 bp, Homo sapiens
tgggagtccaggca

SEQ ID NO: 990371 - DNA, 17 bp, Homo sapiens
tgggagtcttaataaaa

SEQ ID NO: 990372 - DNA, 15 bp, Homo sapiens
tgggagtcttgggtg

SEQ ID NO: 990373 - DNA, 23 bp, Homo sapiens
tgggagtgaggggttacctccct

SEQ ID NO: 990374 - DNA, 13 bp, Homo sapiens
tgggagtgggcac

SEQ ID NO: 990375 - DNA, 19 bp, Homo sapiens
tgggagtgggcacctcaga

SEQ ID NO: 990376 - DNA, 15 bp, Homo sapiens
tgggagtgtgtctgc

SEQ ID NO: 990377 - DNA, 17 bp, Homo sapiens
tgggagttcagctgctt

SEQ ID NO: 990378 - DNA, 19 bp, Homo sapiens
tgggagttcagctgcttct

SEQ ID NO: 990379 - DNA, 22 bp, Homo sapiens
tgggagttgatcgcctttccca

SEQ ID NO: 990380 - DNA, 20 bp, Homo sapiens
tgggagtttttatgagaaac

SEQ ID NO: 990381 - DNA, 21 bp, Homo sapiens
tgggataaacatcacatgaga

SEQ ID NO: 990382 - DNA, 23 bp, Homo sapiens
tgggataaagatgcaaggaccag

SEQ ID NO: 990383 - DNA, 15 bp, Homo sapiens
tgggataaagcaagg

SEQ ID NO: 990384 - DNA, 22 bp, Homo sapiens
tgggatacttagtggtatgtct

SEQ ID NO: 990385 - DNA, 18 bp, Homo sapiens
tgggatagtgttctgctc

SEQ ID NO: 990386 - DNA, 19 bp, Homo sapiens
tgggatagtgttctgctcc

SEQ ID NO: 990387 - DNA, 23 bp, Homo sapiens
tgggatagtgttctgctcctgct

SEQ ID NO: 990388 - DNA, 16 bp, Homo sapiens
tgggatatcattttaa

SEQ ID NO: 990389 - DNA, 15 bp, Homo sapiens
tgggatatggctgcc

SEQ ID NO: 990390 - DNA, 15 bp, Homo sapiens
tgggatatgtggtgt

SEQ ID NO: 990391 - DNA, 15 bp, Homo sapiens
tgggatcaataggaa

SEQ ID NO: 990392 - DNA, 13 bp, Homo sapiens
tgggatcagcctc

SEQ ID NO: 990393 - DNA, 22 bp, Homo sapiens
tgggatcatttttccaggactc

SEQ ID NO: 990394 - DNA, 17 bp, Homo sapiens
tgggatccaaggggcag

SEQ ID NO: 990395 - DNA, 23 bp, Homo sapiens
tgggatccacttcttggttcctg

SEQ ID NO: 990396 - DNA, 19 bp, Homo sapiens
tgggatcctccctcatggc

SEQ ID NO: 990397 - DNA, 21 bp, Homo sapiens
tgggatccttgggcccatcac

SEQ ID NO: 990398 - DNA, 22 bp, Homo sapiens
tgggatcgtgcatttgaggggc

SEQ ID NO: 990399 - DNA, 15 bp, Homo sapiens
tgggatctaggagag

SEQ ID NO: 990400 - DNA, 18 bp, Homo sapiens
tgggatctgtcttggcat

SEQ ID NO: 990401 - DNA, 18 bp, Homo sapiens
tgggatgcagtgatgtga

SEQ ID NO: 990402 - DNA, 23 bp, Homo sapiens
tgggatgccaatttcctctccac

SEQ ID NO: 990403 - DNA, 16 bp, Homo sapiens
tgggatgctgacccag

SEQ ID NO: 990404 - DNA, 19 bp, Homo sapiens
tgggatgctgacccaggaa

SEQ ID NO: 990405 - DNA, 18 bp, Homo sapiens
tgggatggaacctcagga

SEQ ID NO: 990406 - DNA, 13 bp, Homo sapiens
tgggatggaggag

SEQ ID NO: 990407 - DNA, 23 bp, Homo sapiens
tgggatggcatttggtctcaggc

SEQ ID NO: 990408 - DNA, 12 bp, Homo sapiens
tgggatggcgat

SEQ ID NO: 990409 - DNA, 15 bp, Homo sapiens
tgggatggcgatggg

SEQ ID NO: 990410 - DNA, 13 bp, Homo sapiens
tgggatgggctct

SEQ ID NO: 990411 - DNA, 17 bp, Homo sapiens
tgggatgggctctacct

SEQ ID NO: 990412 - DNA, 20 bp, Homo sapiens
tgggatgggctctacctctc

SEQ ID NO: 990413 - DNA, 12 bp, Homo sapiens
tgggatggggag

SEQ ID NO: 990414 - DNA, 19 bp, Homo sapiens
tgggatggtcggatctcac

SEQ ID NO: 990415 - DNA, 20 bp, Homo sapiens
tgggatggtcggatctcaca

SEQ ID NO: 990416 - DNA, 20 bp, Homo sapiens
tgggatgttcagcactgtcc

SEQ ID NO: 990417 - DNA, 15 bp, Homo sapiens
tgggattaagggcaa

SEQ ID NO: 990418 - DNA, 12 bp, Homo sapiens
tgggattacagg

SEQ ID NO: 990419 - DNA, 20 bp, Homo sapiens
tgggattacaggcgtgagcc

SEQ ID NO: 990420 - DNA, 19 bp, Homo sapiens
tgggattacaggcttgagc

SEQ ID NO: 990421 - DNA, 20 bp, Homo sapiens
tgggattataggcatgagcc

SEQ ID NO: 990422 - DNA, 14 bp, Homo sapiens
tgggattattcttt

SEQ ID NO: 990423 - DNA, 18 bp, Homo sapiens
tgggattattctttgaaa

SEQ ID NO: 990424 - DNA, 17 bp, Homo sapiens
tgggattcaggaatgtg

SEQ ID NO: 990425 - DNA, 23 bp, Homo sapiens
tgggattcccaccaaggtcttca

SEQ ID NO: 990426 - DNA, 16 bp, Homo sapiens
tgggattcctgaccca

SEQ ID NO: 990427 - DNA, 20 bp, Homo sapiens
tgggattcctgacccaggcc

SEQ ID NO: 990428 - DNA, 24 bp, Homo sapiens
tgggattcctgacccaggccgcag

SEQ ID NO: 990429 - DNA, 22 bp, Homo sapiens
tgggattctactttaagcacta

SEQ ID NO: 990430 - DNA, 16 bp, Homo sapiens
tgggattgagtctgtg

SEQ ID NO: 990431 - DNA, 10 bp, Homo sapiens
tgggattgct

SEQ ID NO: 990432 - DNA, 19 bp, Homo sapiens
tgggattgggggctggtgc

SEQ ID NO: 990433 - DNA, 21 bp, Homo sapiens
tgggattggggggaaagaggg

SEQ ID NO: 990434 - DNA, 16 bp, Homo sapiens
taaagttgataaagat

SEQ ID NO: 990435 - DNA, 21 bp, Homo sapiens
taaagttgattttgaactttt

SEQ ID NO: 990436 - DNA, 15 bp, Homo sapiens
taaagttggccatgt

SEQ ID NO: 990437 - DNA, 20 bp, Homo sapiens
taaagttggtattaataaaa

SEQ ID NO: 990438 - DNA, 21 bp, Homo sapiens
taaagttgtaaataattttct

SEQ ID NO: 990439 - DNA, 12 bp, Homo sapiens
taaagtttatta

SEQ ID NO: 990440 - DNA, 14 bp, Homo sapiens
taaagtttccatta

SEQ ID NO: 990441 - DNA, 14 bp, Homo sapiens
taaagtttgcttag

SEQ ID NO: 990442 - DNA, 17 bp, Homo sapiens
taaagtttgcttagaaa

SEQ ID NO: 990443 - DNA, 18 bp, Homo sapiens
taaagtttggtattgtaa

SEQ ID NO: 990444 - DNA, 16 bp, Homo sapiens
taaagtttgttcactt

SEQ ID NO: 990445 - DNA, 15 bp, Homo sapiens
taaagtttgttgaaa

SEQ ID NO: 990446 - DNA, 13 bp, Homo sapiens
taaagttttgcaa

SEQ ID NO: 990447 - DNA, 17 bp, Homo sapiens
taaataaaaagtacaaa

SEQ ID NO: 990448 - DNA, 17 bp, Homo sapiens
taaataaaaatatgtaa

SEQ ID NO: 990449 - DNA, 19 bp, Homo sapiens
taaataaaaatatgtaatt

SEQ ID NO: 990450 - DNA, 21 bp, Homo sapiens
taaataaaagaaaaaatatct

SEQ ID NO: 990451 - DNA, 14 bp, Homo sapiens
taaataaaagcaca

SEQ ID NO: 990452 - DNA, 22 bp, Homo sapiens
taaataaaagcacaagtacttt

SEQ ID NO: 990453 - DNA, 15 bp, Homo sapiens
taaataaaatgtgta

SEQ ID NO: 990454 - DNA, 16 bp, Homo sapiens
taaataaaatgtgtac

SEQ ID NO: 990455 - DNA, 20 bp, Homo sapiens
taaataaaatgtgtacagtg

SEQ ID NO: 990456 - DNA, 22 bp, Homo sapiens
taaataaaatgtgtacagtgaa

SEQ ID NO: 990457 - DNA, 13 bp, Homo sapiens
taaataaaatttg

SEQ ID NO: 990458 - DNA, 14 bp, Homo sapiens
taaataaaatttgt

SEQ ID NO: 990459 - DNA, 17 bp, Homo sapiens
taaataaacagatgtat

SEQ ID NO: 990460 - DNA, 14 bp, Homo sapiens
taaataaaccactg

SEQ ID NO: 990461 - DNA, 13 bp, Homo sapiens
taaataaactgtt

SEQ ID NO: 990462 - DNA, 21 bp, Homo sapiens
taaataaactgttttcaagtc

SEQ ID NO: 990463 - DNA, 14 bp, Homo sapiens
taaataaatatttt

SEQ ID NO: 990464 - DNA, 13 bp, Homo sapiens
taaataaatttga

SEQ ID NO: 990465 - DNA, 14 bp, Homo sapiens
taaataaatttgac

SEQ ID NO: 990466 - DNA, 18 bp, Homo sapiens
taaataacacagatattg

SEQ ID NO: 990467 - DNA, 22 bp, Homo sapiens
taaataacaggcatttgttcac

SEQ ID NO: 990468 - DNA, 22 bp, Homo sapiens
taaataacctctggcccttgga

SEQ ID NO: 990469 - DNA, 13 bp, Homo sapiens
taaataacttttt

SEQ ID NO: 990470 - DNA, 22 bp, Homo sapiens
taaataagaaacaactctttga

SEQ ID NO: 990471 - DNA, 15 bp, Homo sapiens
taaataagagatttg

SEQ ID NO: 990472 - DNA, 16 bp, Homo sapiens
taaataagcccagtgc

SEQ ID NO: 990473 - DNA, 12 bp, Homo sapiens
taaataatgaaa

SEQ ID NO: 990474 - DNA, 21 bp, Homo sapiens
taaataatgaataaactgaat

SEQ ID NO: 990475 - DNA, 17 bp, Homo sapiens
taaataatgcttcagat

SEQ ID NO: 990476 - DNA, 15 bp, Homo sapiens
taaataattggaaaa

SEQ ID NO: 990477 - DNA, 17 bp, Homo sapiens
taaataatttatttaat

SEQ ID NO: 990478 - DNA, 16 bp, Homo sapiens
taaataatttcctaca

SEQ ID NO: 990479 - DNA, 14 bp, Homo sapiens
taaataatttctac

SEQ ID NO: 990480 - DNA, 17 bp, Homo sapiens
taaataatttgcactga

SEQ ID NO: 990481 - DNA, 13 bp, Homo sapiens
taaataattttaa

SEQ ID NO: 990482 - DNA, 17 bp, Homo sapiens
taaataattttctaaga

SEQ ID NO: 990483 - DNA, 17 bp, Homo sapiens
taaatacaaaacttcca

SEQ ID NO: 990484 - DNA, 15 bp, Homo sapiens
taaatacaaattttg

SEQ ID NO: 990485 - DNA, 18 bp, Homo sapiens
taaatacacaacacacac

SEQ ID NO: 990486 - DNA, 21 bp, Homo sapiens
taaatacacttcctgcttaaa

SEQ ID NO: 990487 - DNA, 15 bp, Homo sapiens
taaatacagacacta

SEQ ID NO: 990488 - DNA, 18 bp, Homo sapiens
taaatacagacactaagt

SEQ ID NO: 990489 - DNA, 20 bp, Homo sapiens
taaatacatgcacacacttg

SEQ ID NO: 990490 - DNA, 21 bp, Homo sapiens
taaatacatgcatataatgaa

SEQ ID NO: 990491 - DNA, 14 bp, Homo sapiens
taaataccaagagc

SEQ ID NO: 990492 - DNA, 18 bp, Homo sapiens
taaataccaagagcaatt

SEQ ID NO: 990493 - DNA, 17 bp, Homo sapiens
taaataccagacacgta

SEQ ID NO: 990494 - DNA, 13 bp, Homo sapiens
taaatacctctta

SEQ ID NO: 990495 - DNA, 23 bp, Homo sapiens
taaatacctcttagctgagtgga

SEQ ID NO: 990496 - DNA, 18 bp, Homo sapiens
taaatactcatgaatgaa

SEQ ID NO: 990497 - DNA, 16 bp, Homo sapiens
taaatactgcaaatca

SEQ ID NO: 990498 - DNA, 14 bp, Homo sapiens
taaatactggactc

SEQ ID NO: 990499 - DNA, 17 bp, Homo sapiens
taaatactggactcagg

SEQ ID NO: 990500 - DNA, 17 bp, Homo sapiens
taaatactgtgcagaat

SEQ ID NO: 990501 - DNA, 16 bp, Homo sapiens
taaatacttgcagttg

SEQ ID NO: 990502 - DNA, 12 bp, Homo sapiens
taaatacttttt

SEQ ID NO: 990503 - DNA, 16 bp, Homo sapiens
taaatagaaattttca

SEQ ID NO: 990504 - DNA, 18 bp, Homo sapiens
taaatagaagagtttaaa

SEQ ID NO: 990505 - DNA, 22 bp, Homo sapiens
taaatagaagagtttaaaagca

SEQ ID NO: 990506 - DNA, 16 bp, Homo sapiens
taaatagcctaaatga

SEQ ID NO: 990507 - DNA, 14 bp, Homo sapiens
taaatagctatatc

SEQ ID NO: 990508 - DNA, 18 bp, Homo sapiens
taaatagctatatccatg

SEQ ID NO: 990509 - DNA, 19 bp, Homo sapiens
taaatagctatatccatgt

SEQ ID NO: 990510 - DNA, 20 bp, Homo sapiens
taaatagctatatccatgta

SEQ ID NO: 990511 - DNA, 16 bp, Homo sapiens
taaatagctgaaaact

SEQ ID NO: 990512 - DNA, 19 bp, Homo sapiens
taaatagctgaaaactaat

SEQ ID NO: 990513 - DNA, 17 bp, Homo sapiens
taaatataaatgtttaa

SEQ ID NO: 990514 - DNA, 19 bp, Homo sapiens
taaatataccactctttac

SEQ ID NO: 990515 - DNA, 21 bp, Homo sapiens
taaatatactcaagtttcagg

SEQ ID NO: 990516 - DNA, 12 bp, Homo sapiens
taaatatataaa

SEQ ID NO: 990517 - DNA, 13 bp, Homo sapiens
taaatatataaat

SEQ ID NO: 990518 - DNA, 16 bp, Homo sapiens
taaatatataaatata

SEQ ID NO: 990519 - DNA, 14 bp, Homo sapiens
taaatatatataaa

SEQ ID NO: 990520 - DNA, 15 bp, Homo sapiens
taaatatatataaac

SEQ ID NO: 990521 - DNA, 19 bp, Homo sapiens
taaatatatataaacctaa

SEQ ID NO: 990522 - DNA, 14 bp, Homo sapiens
taaatatatatgat

SEQ ID NO: 990523 - DNA, 16 bp, Homo sapiens
taaatatatatgtcaa

SEQ ID NO: 990524 - DNA, 17 bp, Homo sapiens
taaatatatatttctaa

SEQ ID NO: 990525 - DNA, 14 bp, Homo sapiens
taaatatatatttt

SEQ ID NO: 990526 - DNA, 23 bp, Homo sapiens
taaatatatatttttcaaataga

SEQ ID NO: 990527 - DNA, 18 bp, Homo sapiens
taaatatatctaccccag

SEQ ID NO: 990528 - DNA, 20 bp, Homo sapiens
taaatatatctaccccagac

SEQ ID NO: 990529 - DNA, 22 bp, Homo sapiens
taaatatatctagaactatcat

SEQ ID NO: 990530 - DNA, 14 bp, Homo sapiens
taaatatatgtatg

SEQ ID NO: 990531 - DNA, 16 bp, Homo sapiens
taaatatatgtatgta

SEQ ID NO: 990532 - DNA, 12 bp, Homo sapiens
taaatatccaaa

SEQ ID NO: 990533 - DNA, 21 bp, Homo sapiens
taaatatccaaagactgtact

SEQ ID NO: 990534 - DNA, 23 bp, Homo sapiens
taaatatccaaagactgtactgg

SEQ ID NO: 990535 - DNA, 22 bp, Homo sapiens
taaatatctgtacttcttcgat

SEQ ID NO: 990536 - DNA, 18 bp, Homo sapiens
taaatatcttctgatttg

SEQ ID NO: 990537 - DNA, 17 bp, Homo sapiens
taaatatggactgctca

SEQ ID NO: 990538 - DNA, 22 bp, Homo sapiens
gtggagagggacagcccactga

SEQ ID NO: 990539 - DNA, 20 bp, Homo sapiens
gtggagagggagactcctgg

SEQ ID NO: 990540 - DNA, 20 bp, Homo sapiens
gtggagatagtgccaggtgg

SEQ ID NO: 990541 - DNA, 21 bp, Homo sapiens
gtggagatcagaaagtgacat

SEQ ID NO: 990542 - DNA, 15 bp, Homo sapiens
gtggagcactggact

SEQ ID NO: 990543 - DNA, 16 bp, Homo sapiens
gtggagcactggactc

SEQ ID NO: 990544 - DNA, 16 bp, Homo sapiens
gtggagcagccagagc

SEQ ID NO: 990545 - DNA, 22 bp, Homo sapiens
gtggagcagccagagctgtgcc

SEQ ID NO: 990546 - DNA, 17 bp, Homo sapiens
gtggagcatgggcctgg

SEQ ID NO: 990547 - DNA, 22 bp, Homo sapiens
gtggagccattgaacagctgtg

SEQ ID NO: 990548 - DNA, 14 bp, Homo sapiens
gtggagctcagccc

SEQ ID NO: 990549 - DNA, 15 bp, Homo sapiens
gtggagctcagcccc

SEQ ID NO: 990550 - DNA, 18 bp, Homo sapiens
gtggagctcgcccctccc

SEQ ID NO: 990551 - DNA, 23 bp, Homo sapiens
gtggagctcgcccctcccctcag

SEQ ID NO: 990552 - DNA, 16 bp, Homo sapiens
gtggagcttgcagtga

SEQ ID NO: 990553 - DNA, 17 bp, Homo sapiens
gtggaggaagagccacc

SEQ ID NO: 990554 - DNA, 20 bp, Homo sapiens
gtggaggaagagccacctgc

SEQ ID NO: 990555 - DNA, 17 bp, Homo sapiens
gtggaggaaggctctgt

SEQ ID NO: 990556 - DNA, 12 bp, Homo sapiens
gtggaggaaggt

SEQ ID NO: 990557 - DNA, 12 bp, Homo sapiens
gtggaggagagg

SEQ ID NO: 990558 - DNA, 15 bp, Homo sapiens
gtggaggagaggaga

SEQ ID NO: 990559 - DNA, 22 bp, Homo sapiens
gtggaggagctgagggagggag

SEQ ID NO: 990560 - DNA, 19 bp, Homo sapiens
gggctgagtggggagcagt

SEQ ID NO: 990561 - DNA, 17 bp, Homo sapiens
gggctgatggcctggct

SEQ ID NO: 990562 - DNA, 18 bp, Homo sapiens
gggctgcacgctcccctc

SEQ ID NO: 990563 - DNA, 23 bp, Homo sapiens
gggctgcacgctcccctccatcc

SEQ ID NO: 990564 - DNA, 18 bp, Homo sapiens
gggctgcagcagccggaa

SEQ ID NO: 990565 - DNA, 19 bp, Homo sapiens
gggctgcagcatgttgctg

SEQ ID NO: 990566 - DNA, 15 bp, Homo sapiens
gggctgcaggcaggc

SEQ ID NO: 990567 - DNA, 16 bp, Homo sapiens
gggctgcatgatgttt

SEQ ID NO: 990568 - DNA, 17 bp, Homo sapiens
gggctgcccagctgctc

SEQ ID NO: 990569 - DNA, 20 bp, Homo sapiens
gggctgcccctaatctctgt

SEQ ID NO: 990570 - DNA, 20 bp, Homo sapiens
gggctgccggatctgggctg

SEQ ID NO: 990571 - DNA, 11 bp, Homo sapiens
gggctgctcct

SEQ ID NO: 990572 - DNA, 14 bp, Homo sapiens
gggctgctcctcat

SEQ ID NO: 990573 - DNA, 19 bp, Homo sapiens
gggctgctcctccagggcc

SEQ ID NO: 990574 - DNA, 12 bp, Homo sapiens
gggctgctgcct

SEQ ID NO: 990575 - DNA, 14 bp, Homo sapiens
gggctgctgcttct

SEQ ID NO: 990576 - DNA, 23 bp, Homo sapiens
gggctgctgcttctgctccagcc

SEQ ID NO: 990577 - DNA, 14 bp, Homo sapiens
gggctgctgggcgt

SEQ ID NO: 990578 - DNA, 14 bp, Homo sapiens
gggctgctggggca

SEQ ID NO: 990579 - DNA, 16 bp, Homo sapiens
gggctgctggggcatg

SEQ ID NO: 990580 - DNA, 11 bp, Homo sapiens
gggctgctgtg

SEQ ID NO: 990581 - DNA, 12 bp, Homo sapiens
gggctgcttcct

SEQ ID NO: 990582 - DNA, 16 bp, Homo sapiens
gggctggaatgggaga

SEQ ID NO: 990583 - DNA, 21 bp, Homo sapiens
gggctggactggaggtgggca

SEQ ID NO: 990584 - DNA, 21 bp, Homo sapiens
gggctggagtgcgctcttggt

SEQ ID NO: 990585 - DNA, 22 bp, Homo sapiens
gggctggatggacagacacctc

SEQ ID NO: 990586 - DNA, 15 bp, Homo sapiens
gggctggcaagcagg

SEQ ID NO: 990587 - DNA, 11 bp, Homo sapiens
gggctggccca

SEQ ID NO: 990588 - DNA, 15 bp, Homo sapiens
gggctggcctaggag

SEQ ID NO: 990589 - DNA, 17 bp, Homo sapiens
gggctggctcccagggt

SEQ ID NO: 990590 - DNA, 18 bp, Homo sapiens
gggctggctcccagggtg

SEQ ID NO: 990591 - DNA, 19 bp, Homo sapiens
gggctggctcccagggtgg

SEQ ID NO: 990592 - DNA, 14 bp, Homo sapiens
gggctggctcctga

SEQ ID NO: 990593 - DNA, 22 bp, Homo sapiens
gggctggctgcttgcagccagg

SEQ ID NO: 990594 - DNA, 15 bp, Homo sapiens
gggctgggaggaagg

SEQ ID NO: 990595 - DNA, 14 bp, Homo sapiens
gggctgggcagcct

SEQ ID NO: 990596 - DNA, 13 bp, Homo sapiens
gggctgggcccac

SEQ ID NO: 990597 - DNA, 20 bp, Homo sapiens
gggctgggcccacccaggga

SEQ ID NO: 990598 - DNA, 18 bp, Homo sapiens
gggctgggccctctcttc

SEQ ID NO: 990599 - DNA, 22 bp, Homo sapiens
gggctgggcctgcgagacccaa

SEQ ID NO: 990600 - DNA, 16 bp, Homo sapiens
gggctgggctgagccc

SEQ ID NO: 990601 - DNA, 17 bp, Homo sapiens
gggctgggctgggctgg

SEQ ID NO: 990602 - DNA, 19 bp, Homo sapiens
gggctggggacagagggtg

SEQ ID NO: 990603 - DNA, 13 bp, Homo sapiens
gggctggggactg

SEQ ID NO: 990604 - DNA, 16 bp, Homo sapiens
gggctggggaggagga

SEQ ID NO: 990605 - DNA, 13 bp, Homo sapiens
gggctggggaggg

SEQ ID NO: 990606 - DNA, 13 bp, Homo sapiens
gggctggggcagg

SEQ ID NO: 990607 - DNA, 19 bp, Homo sapiens
gggctggggcaggggcctg

SEQ ID NO: 990608 - DNA, 14 bp, Homo sapiens
gggctggggccacc

SEQ ID NO: 990609 - DNA, 14 bp, Homo sapiens
gggctggggcctca

SEQ ID NO: 990610 - DNA, 17 bp, Homo sapiens
gggctggggctgctccc

SEQ ID NO: 990611 - DNA, 18 bp, Homo sapiens
gggctgggggctgccgag

SEQ ID NO: 990612 - DNA, 16 bp, Homo sapiens
gggctggggtgagcct

SEQ ID NO: 990613 - DNA, 13 bp, Homo sapiens
gggctgggtgctg

SEQ ID NO: 990614 - DNA, 14 bp, Homo sapiens
gggctgggtgctgg

SEQ ID NO: 990615 - DNA, 15 bp, Homo sapiens
gggctggtgccagcc

SEQ ID NO: 990616 - DNA, 19 bp, Homo sapiens
gggctggtgccccacagct

SEQ ID NO: 990617 - DNA, 18 bp, Homo sapiens
gggctgtaaaatgcatga

SEQ ID NO: 990618 - DNA, 16 bp, Homo sapiens
gggctgtcatctgtgc

SEQ ID NO: 990619 - DNA, 16 bp, Homo sapiens
gggctgtcccagcccc

SEQ ID NO: 990620 - DNA, 19 bp, Homo sapiens
gggctgtcctccttcctgg

SEQ ID NO: 990621 - DNA, 23 bp, Homo sapiens
gggctgtcctccttcctgggacc

SEQ ID NO: 990622 - DNA, 14 bp, Homo sapiens
gggctgtctgtcac

SEQ ID NO: 990623 - DNA, 18 bp, Homo sapiens
gggctgtctttgcagggc

SEQ ID NO: 990624 - DNA, 20 bp, Homo sapiens
gggctgtgcccggccccacc

SEQ ID NO: 990625 - DNA, 21 bp, Homo sapiens
gggctgtgcccggccccaccc

SEQ ID NO: 990626 - DNA, 15 bp, Homo sapiens
gggctgtggccctgc

SEQ ID NO: 990627 - DNA, 17 bp, Homo sapiens
gggctgtgttgactgct

SEQ ID NO: 990628 - DNA, 20 bp, Homo sapiens
gggctgtgttgactgctgct

SEQ ID NO: 990629 - DNA, 16 bp, Homo sapiens
gggctgttgagatgcc

SEQ ID NO: 990630 - DNA, 19 bp, Homo sapiens
gggctgttggacagctgct

SEQ ID NO: 990631 - DNA, 22 bp, Homo sapiens
gggctgttggacagctgcttgt

SEQ ID NO: 990632 - DNA, 20 bp, Homo sapiens
gggcttaaagcagaagcccc

SEQ ID NO: 990633 - DNA, 18 bp, Homo sapiens
gggcttagtatttctcag

SEQ ID NO: 990634 - DNA, 14 bp, Homo sapiens
gggcttatgggtgg

SEQ ID NO: 990635 - DNA, 21 bp, Homo sapiens
gggcttcacagccacacctgg

SEQ ID NO: 990636 - DNA, 23 bp, Homo sapiens
gggcttcctgcccttccctctgg

SEQ ID NO: 990637 - DNA, 19 bp, Homo sapiens
gggcttcctgctgggactg

SEQ ID NO: 990638 - DNA, 22 bp, Homo sapiens
gggcttcgttttcagtcttctg

SEQ ID NO: 990639 - DNA, 21 bp, Homo sapiens
gggcttctcctcctctgtctt

SEQ ID NO: 990640 - DNA, 15 bp, Homo sapiens
gggcttctgcaccct

SEQ ID NO: 990641 - DNA, 21 bp, Homo sapiens
gggcttctgcaccctccaccc

SEQ ID NO: 990642 - DNA, 16 bp, Homo sapiens
gggcttctgcgtccac

SEQ ID NO: 990643 - DNA, 21 bp, Homo sapiens
gggcttctgcgtccaccaggc

SEQ ID NO: 990644 - DNA, 17 bp, Homo sapiens
gggcttctgttctctgc

SEQ ID NO: 990645 - DNA, 14 bp, Homo sapiens
gggcttcttcctca

SEQ ID NO: 990646 - DNA, 16 bp, Homo sapiens
gggcttgagtgagaag

SEQ ID NO: 990647 - DNA, 18 bp, Homo sapiens
gggcttggacttcctggg

SEQ ID NO: 990648 - DNA, 12 bp, Homo sapiens
gggcttggccca

SEQ ID NO: 990649 - DNA, 17 bp, Homo sapiens
gggcttggcctgctgtg

SEQ ID NO: 990650 - DNA, 17 bp, Homo sapiens
gggcttggcctggagag

SEQ ID NO: 990651 - DNA, 13 bp, Homo sapiens
gggcttggccttg

SEQ ID NO: 990652 - DNA, 15 bp, Homo sapiens
gggcttggggctgca

SEQ ID NO: 990653 - DNA, 15 bp, Homo sapiens
gggctttctcctgga

SEQ ID NO: 990654 - DNA, 16 bp, Homo sapiens
gggctttctcctggag

SEQ ID NO: 990655 - DNA, 22 bp, Homo sapiens
gggctttctcttccccttcctg

SEQ ID NO: 990656 - DNA, 14 bp, Homo sapiens
gggctttctggaga

SEQ ID NO: 990657 - DNA, 16 bp, Homo sapiens
gggctttgagggtgga

SEQ ID NO: 990658 - DNA, 17 bp, Homo sapiens
gggctttgggcccaaga

SEQ ID NO: 990659 - DNA, 18 bp, Homo sapiens
gggctttgggcccaagaa

SEQ ID NO: 990660 - DNA, 16 bp, Homo sapiens
gggcttttgttctgag

SEQ ID NO: 990661 - DNA, 19 bp, Homo sapiens
gggcttttgttctgagggg

SEQ ID NO: 990662 - DNA, 20 bp, Homo sapiens
gggcttttgttctgaggggt

SEQ ID NO: 990663 - DNA, 14 bp, Homo sapiens
ggggaaaaaaatgt

SEQ ID NO: 990664 - DNA, 23 bp, Homo sapiens
ggggaaaacgggcagtctgctct

SEQ ID NO: 990665 - DNA, 17 bp, Homo sapiens
ggggaaaatcagcctgc

SEQ ID NO: 990666 - DNA, 21 bp, Homo sapiens
ggggaaaatggccatgcagga

SEQ ID NO: 990667 - DNA, 23 bp, Homo sapiens
ggggaaaatggccatgcaggagg

SEQ ID NO: 990668 - DNA, 17 bp, Homo sapiens
ggggaaaccctggagcc

SEQ ID NO: 990669 - DNA, 13 bp, Homo sapiens
ggtggacacacaa

SEQ ID NO: 990670 - DNA, 16 bp, Homo sapiens
ggtggacagtcctggg

SEQ ID NO: 990671 - DNA, 17 bp, Homo sapiens
ggtggacagtcctggga

SEQ ID NO: 990672 - DNA, 12 bp, Homo sapiens
ggtggacccagg

SEQ ID NO: 990673 - DNA, 17 bp, Homo sapiens
ggtggactgcgctggac

SEQ ID NO: 990674 - DNA, 20 bp, Homo sapiens
ggtggagagggagatgtgtg

SEQ ID NO: 990675 - DNA, 18 bp, Homo sapiens
ggtggagcactggactcc

SEQ ID NO: 990676 - DNA, 14 bp, Homo sapiens
ggtggagcagccag

SEQ ID NO: 990677 - DNA, 16 bp, Homo sapiens
ggtggagcagccagag

SEQ ID NO: 990678 - DNA, 18 bp, Homo sapiens
ggtggagcagccagagct

SEQ ID NO: 990679 - DNA, 19 bp, Homo sapiens
ggtggagccaatccactcc

SEQ ID NO: 990680 - DNA, 16 bp, Homo sapiens
ggtggagccagggcct

SEQ ID NO: 990681 - DNA, 18 bp, Homo sapiens
ggtggagctgagaagagg

SEQ ID NO: 990682 - DNA, 21 bp, Homo sapiens
ggtggagcttgcagtgagccg

SEQ ID NO: 990683 - DNA, 12 bp, Homo sapiens
ggtggaggaagg

SEQ ID NO: 990684 - DNA, 13 bp, Homo sapiens
ggtggagggcact

SEQ ID NO: 990685 - DNA, 23 bp, Homo sapiens
ggtggagggccacatgggaggct

SEQ ID NO: 990686 - DNA, 20 bp, Homo sapiens
ggttattttaaatataaata

SEQ ID NO: 990687 - DNA, 17 bp, Homo sapiens
gagcccattcttctggg

SEQ ID NO: 990688 - DNA, 18 bp, Homo sapiens
gagcccattcttctgggt

SEQ ID NO: 990689 - DNA, 19 bp, Homo sapiens
gagcccattcttctgggtg

SEQ ID NO: 990690 - DNA, 11 bp, Homo sapiens
gagccccaagt

SEQ ID NO: 990691 - DNA, 13 bp, Homo sapiens
gagccccaagtcc

SEQ ID NO: 990692 - DNA, 15 bp, Homo sapiens
gagccccaagtcctg

SEQ ID NO: 990693 - DNA, 16 bp, Homo sapiens
gagccccacacggagg

SEQ ID NO: 990694 - DNA, 16 bp, Homo sapiens
gagccccagctaccct

SEQ ID NO: 990695 - DNA, 14 bp, Homo sapiens
gagccccagctgac

SEQ ID NO: 990696 - DNA, 12 bp, Homo sapiens
gagccccagggt

SEQ ID NO: 990697 - DNA, 19 bp, Homo sapiens
gagccccagggtgcccaga

SEQ ID NO: 990698 - DNA, 18 bp, Homo sapiens
gagccccagtgctggaag

SEQ ID NO: 990699 - DNA, 16 bp, Homo sapiens
gagccccattcctggg

SEQ ID NO: 990700 - DNA, 16 bp, Homo sapiens
gagcccccaacacagg

SEQ ID NO: 990701 - DNA, 12 bp, Homo sapiens
gagcccccacca

SEQ ID NO: 990702 - DNA, 21 bp, Homo sapiens
gagcccccaccagcagcacaa

SEQ ID NO: 990703 - DNA, 23 bp, Homo sapiens
gagcccccaccggaactgggctg

SEQ ID NO: 990704 - DNA, 20 bp, Homo sapiens
gagcccccaccttgatccca

SEQ ID NO: 990705 - DNA, 15 bp, Homo sapiens
gagcccccagcagag

SEQ ID NO: 990706 - DNA, 14 bp, Homo sapiens
gagcccccagccct

SEQ ID NO: 990707 - DNA, 12 bp, Homo sapiens
gagccccctgga

SEQ ID NO: 990708 - DNA, 13 bp, Homo sapiens
gagccccgccctc

SEQ ID NO: 990709 - DNA, 16 bp, Homo sapiens
gagccccgccctcttc

SEQ ID NO: 990710 - DNA, 19 bp, Homo sapiens
gagccccgccctcttcctg

SEQ ID NO: 990711 - DNA, 16 bp, Homo sapiens
gagcccctccccagcc

SEQ ID NO: 990712 - DNA, 21 bp, Homo sapiens
gagcccctccccagccagccc

SEQ ID NO: 990713 - DNA, 20 bp, Homo sapiens
gagcccctcctccagcccct

SEQ ID NO: 990714 - DNA, 18 bp, Homo sapiens
gagcccctcggctctgga

SEQ ID NO: 990715 - DNA, 20 bp, Homo sapiens
gagcccctcggctctggagg

SEQ ID NO: 990716 - DNA, 22 bp, Homo sapiens
gagcccctgaaagcctcacgta

SEQ ID NO: 990717 - DNA, 12 bp, Homo sapiens
gagcccctggtc

SEQ ID NO: 990718 - DNA, 13 bp, Homo sapiens
gagcccctggtct

SEQ ID NO: 990719 - DNA, 13 bp, Homo sapiens
gagccccttcctt

SEQ ID NO: 990720 - DNA, 19 bp, Homo sapiens
gagccccttccttgctctg

SEQ ID NO: 990721 - DNA, 17 bp, Homo sapiens
gagcccgatattctccc

SEQ ID NO: 990722 - DNA, 17 bp, Homo sapiens
gagcccgcacccccacc

SEQ ID NO: 990723 - DNA, 19 bp, Homo sapiens
gagcccgcacccccaccct

SEQ ID NO: 990724 - DNA, 23 bp, Homo sapiens
gagcccgcacccccaccctttgg

SEQ ID NO: 990725 - DNA, 19 bp, Homo sapiens
gagcccgcagggccatgca

SEQ ID NO: 990726 - DNA, 18 bp, Homo sapiens
gagcccgccgtctgcagg

SEQ ID NO: 990727 - DNA, 21 bp, Homo sapiens
gagcccgccgtctgcaggggc

SEQ ID NO: 990728 - DNA, 21 bp, Homo sapiens
gagcccggccccacctccctg

SEQ ID NO: 990729 - DNA, 20 bp, Homo sapiens
gagcccggccctcccccagc

SEQ ID NO: 990730 - DNA, 22 bp, Homo sapiens
gagcccggccctcccccagctc

SEQ ID NO: 990731 - DNA, 23 bp, Homo sapiens
gagcccggccctcccccagctcc

SEQ ID NO: 990732 - DNA, 15 bp, Homo sapiens
gagcccgggctgcct

SEQ ID NO: 990733 - DNA, 18 bp, Homo sapiens
gagcccgggctgcctggg

SEQ ID NO: 990734 - DNA, 19 bp, Homo sapiens
gagcccgggctgcctgggc

SEQ ID NO: 990735 - DNA, 20 bp, Homo sapiens
gagccctaaccccttccaga

SEQ ID NO: 990736 - DNA, 17 bp, Homo sapiens
gagccctactccctgca

SEQ ID NO: 990737 - DNA, 11 bp, Homo sapiens
gagccctcagg

SEQ ID NO: 990738 - DNA, 12 bp, Homo sapiens
gagccctcaggc

SEQ ID NO: 990739 - DNA, 16 bp, Homo sapiens
gagccctgactcctgg

SEQ ID NO: 990740 - DNA, 20 bp, Homo sapiens
gagccctgactcctggactc

SEQ ID NO: 990741 - DNA, 19 bp, Homo sapiens
gagccctgaggacctctca

SEQ ID NO: 990742 - DNA, 22 bp, Homo sapiens
gagccctgaggacctctcagca

SEQ ID NO: 990743 - DNA, 19 bp, Homo sapiens
gagccctgaggggctgggc

SEQ ID NO: 990744 - DNA, 21 bp, Homo sapiens
gagccctggacacccctgctc

SEQ ID NO: 990745 - DNA, 14 bp, Homo sapiens
gagccctggacctt

SEQ ID NO: 990746 - DNA, 16 bp, Homo sapiens
gagccctggctctgcc

SEQ ID NO: 990747 - DNA, 19 bp, Homo sapiens
gagccctggctctgcccct

SEQ ID NO: 990748 - DNA, 17 bp, Homo sapiens
gagccctggctgggttc

SEQ ID NO: 990749 - DNA, 13 bp, Homo sapiens
gagccctgggcgg

SEQ ID NO: 990750 - DNA, 20 bp, Homo sapiens
gagccctgtacccaccccag

SEQ ID NO: 990751 - DNA, 16 bp, Homo sapiens
gagcccttcactgcca

SEQ ID NO: 990752 - DNA, 18 bp, Homo sapiens
gagcccttcactgccatg

SEQ ID NO: 990753 - DNA, 18 bp, Homo sapiens
gagcccttctctttgact

SEQ ID NO: 990754 - DNA, 21 bp, Homo sapiens
gagcccttgactgtacagaga

SEQ ID NO: 990755 - DNA, 22 bp, Homo sapiens
gagcccttgactgtacagagac

SEQ ID NO: 990756 - DNA, 17 bp, Homo sapiens
gagcccttgcctcccca

SEQ ID NO: 990757 - DNA, 14 bp, Homo sapiens
gagccgaagcccag

SEQ ID NO: 990758 - DNA, 13 bp, Homo sapiens
gagccgacaatgc

SEQ ID NO: 990759 - DNA, 17 bp, Homo sapiens
gagccgacaatgccctg

SEQ ID NO: 990760 - DNA, 20 bp, Homo sapiens
gagccgagatcgcgccactg

SEQ ID NO: 990761 - DNA, 22 bp, Homo sapiens
gagccgattgtcctatctccag

SEQ ID NO: 990762 - DNA, 20 bp, Homo sapiens
gagccgctgtgagcccctgg

SEQ ID NO: 990763 - DNA, 15 bp, Homo sapiens
gagccgggccccgga

SEQ ID NO: 990764 - DNA, 15 bp, Homo sapiens
gagccgggcccctgg

SEQ ID NO: 990765 - DNA, 16 bp, Homo sapiens
gagccgggcccctggg

SEQ ID NO: 990766 - DNA, 19 bp, Homo sapiens
gagccggtaactgtcctgt

SEQ ID NO: 990767 - DNA, 16 bp, Homo sapiens
gagccggtggtgcccg

SEQ ID NO: 990768 - DNA, 20 bp, Homo sapiens
gagccgtggtccctgaggat

SEQ ID NO: 990769 - DNA, 20 bp, Homo sapiens
gagcctacctgtatgtcaat

SEQ ID NO: 990770 - DNA, 20 bp, Homo sapiens
gagcctaccttcaccaccta

SEQ ID NO: 990771 - DNA, 20 bp, Homo sapiens
gagcctagaacatccctggg

SEQ ID NO: 990772 - DNA, 22 bp, Homo sapiens
gagcctagaacatccctgggca

SEQ ID NO: 990773 - DNA, 23 bp, Homo sapiens
gagcctagaacatccctgggcaa

SEQ ID NO: 990774 - DNA, 23 bp, Homo sapiens
gagcctagcggagcccagcctgg

SEQ ID NO: 990775 - DNA, 21 bp, Homo sapiens
gagcctagtttttaatagcta

SEQ ID NO: 990776 - DNA, 11 bp, Homo sapiens
gagcctatgat

SEQ ID NO: 990777 - DNA, 14 bp, Homo sapiens
gagcctcacagcag

SEQ ID NO: 990778 - DNA, 19 bp, Homo sapiens
gagcctcagtctccctccc

SEQ ID NO: 990779 - DNA, 17 bp, Homo sapiens
gagcctcatgttctctt

SEQ ID NO: 990780 - DNA, 12 bp, Homo sapiens
gagcctcccacc

SEQ ID NO: 990781 - DNA, 18 bp, Homo sapiens
gagcctcccaccagagcc

SEQ ID NO: 990782 - DNA, 19 bp, Homo sapiens
gagcctcccaccagagccg

SEQ ID NO: 990783 - DNA, 20 bp, Homo sapiens
gagcctccccatctgtccag

SEQ ID NO: 990784 - DNA, 21 bp, Homo sapiens
gagcctccccatctgtccagc

SEQ ID NO: 990785 - DNA, 16 bp, Homo sapiens
gagcctccccctcaga

SEQ ID NO: 990786 - DNA, 17 bp, Homo sapiens
gagcctccccctcagat

SEQ ID NO: 990787 - DNA, 11 bp, Homo sapiens
gagcctcctgg

SEQ ID NO: 990788 - DNA, 17 bp, Homo sapiens
gagcctcctgtgcctgg

SEQ ID NO: 990789 - DNA, 19 bp, Homo sapiens
gagcctcctgtgcctggcc

SEQ ID NO: 990790 - DNA, 21 bp, Homo sapiens
gagcctcgcccctccagtgtt

SEQ ID NO: 990791 - DNA, 22 bp, Homo sapiens
gagcctcgcccctccagtgttg

SEQ ID NO: 990792 - DNA, 20 bp, Homo sapiens
gagcctcggccctagcattg

SEQ ID NO: 990793 - DNA, 19 bp, Homo sapiens
gagcctcgtgtccagactc

SEQ ID NO: 990794 - DNA, 12 bp, Homo sapiens
gagcctcttagt

SEQ ID NO: 990795 - DNA, 14 bp, Homo sapiens
gagcctctttgtaa

SEQ ID NO: 990796 - DNA, 17 bp, Homo sapiens
gagcctgaagctggcct

SEQ ID NO: 990797 - DNA, 18 bp, Homo sapiens
gagcctgaagctggcctg

SEQ ID NO: 990798 - DNA, 21 bp, Homo sapiens
gagcctgaagctggcctggac

SEQ ID NO: 990799 - DNA, 18 bp, Homo sapiens
gagcctgatctcttcctg

SEQ ID NO: 990800 - DNA, 22 bp, Homo sapiens
gagcctgcagggtggtgctggg

SEQ ID NO: 990801 - DNA, 15 bp, Homo sapiens
gagctctctgccctt

SEQ ID NO: 990802 - DNA, 16 bp, Homo sapiens
gagctctgcgccaggc

SEQ ID NO: 990803 - DNA, 18 bp, Homo sapiens
gagctctgcgccaggcag

SEQ ID NO: 990804 - DNA, 20 bp, Homo sapiens
gagctctgtgggtctctgga

SEQ ID NO: 990805 - DNA, 15 bp, Homo sapiens
gagctcttaatgttg

SEQ ID NO: 990806 - DNA, 22 bp, Homo sapiens
gagctcttcaagctgtcccctc

SEQ ID NO: 990807 - DNA, 20 bp, Homo sapiens
gagctcttcggtttctgagc

SEQ ID NO: 990808 - DNA, 17 bp, Homo sapiens
gagctcttggaagagct

SEQ ID NO: 990809 - DNA, 19 bp, Homo sapiens
gagctgaacccattttgag

SEQ ID NO: 990810 - DNA, 13 bp, Homo sapiens
gagctgaagacct

SEQ ID NO: 990811 - DNA, 12 bp, Homo sapiens
gagctgaatgtt

SEQ ID NO: 990812 - DNA, 16 bp, Homo sapiens
gagctgagaagaggag

SEQ ID NO: 990813 - DNA, 19 bp, Homo sapiens
gagctgagaagaggaggag

SEQ ID NO: 990814 - DNA, 23 bp, Homo sapiens
gagctgagaagaggaggaggtgg

SEQ ID NO: 990815 - DNA, 14 bp, Homo sapiens
gagctgagcagcct

SEQ ID NO: 990816 - DNA, 17 bp, Homo sapiens
gagctgagcagcctctg

SEQ ID NO: 990817 - DNA, 19 bp, Homo sapiens
ggccagggtgggaagagaa

SEQ ID NO: 990818 - DNA, 16 bp, Homo sapiens
ggccaggtgcagacct

SEQ ID NO: 990819 - DNA, 14 bp, Homo sapiens
ggccaggtgcagtg

SEQ ID NO: 990820 - DNA, 15 bp, Homo sapiens
ggccaggtgcggcct

SEQ ID NO: 990821 - DNA, 21 bp, Homo sapiens
ggccagtatctatatatgtgt

SEQ ID NO: 990822 - DNA, 13 bp, Homo sapiens
ggccagtccccat

SEQ ID NO: 990823 - DNA, 19 bp, Homo sapiens
ggccagtccccgaggagct

SEQ ID NO: 990824 - DNA, 16 bp, Homo sapiens
ggccagtcctgcctgg

SEQ ID NO: 990825 - DNA, 20 bp, Homo sapiens
ggccagtcctggtcctggct

SEQ ID NO: 990826 - DNA, 17 bp, Homo sapiens
ggccagtctgggctgcc

SEQ ID NO: 990827 - DNA, 18 bp, Homo sapiens
ggccagtctgtggatcag

SEQ ID NO: 990828 - DNA, 15 bp, Homo sapiens
ggccagtgagggctg

SEQ ID NO: 990829 - DNA, 18 bp, Homo sapiens
ggccagtgagggctgggc

SEQ ID NO: 990830 - DNA, 22 bp, Homo sapiens
ggccagtgagggctgggcccac

SEQ ID NO: 990831 - DNA, 13 bp, Homo sapiens
ggccagtgatgat

SEQ ID NO: 990832 - DNA, 13 bp, Homo sapiens
ggccagtgctgct

SEQ ID NO: 990833 - DNA, 16 bp, Homo sapiens
ggccagtggcccccgg

SEQ ID NO: 990834 - DNA, 22 bp, Homo sapiens
ggccagtggcccccgggcctgc

SEQ ID NO: 990835 - DNA, 18 bp, Homo sapiens
ggccagtggggcctgtgg

SEQ ID NO: 990836 - DNA, 19 bp, Homo sapiens
ggccagtggggcctgtgga

SEQ ID NO: 990837 - DNA, 23 bp, Homo sapiens
ggccagttgatctgctctgtttt

SEQ ID NO: 990838 - DNA, 12 bp, Homo sapiens
ggccagttttct

SEQ ID NO: 990839 - DNA, 15 bp, Homo sapiens
ggccataattatgaa

SEQ ID NO: 990840 - DNA, 16 bp, Homo sapiens
ggccatagaggcccag

SEQ ID NO: 990841 - DNA, 20 bp, Homo sapiens
ggccatagaggcccaggcac

SEQ ID NO: 990842 - DNA, 22 bp, Homo sapiens
ggccatagaggcccaggcacca

SEQ ID NO: 990843 - DNA, 16 bp, Homo sapiens
ggccataggagaggag

SEQ ID NO: 990844 - DNA, 13 bp, Homo sapiens
ggccatcactcag

SEQ ID NO: 990845 - DNA, 17 bp, Homo sapiens
ggccatcactcagcccc

SEQ ID NO: 990846 - DNA, 18 bp, Homo sapiens
ggccatcactcagcccct

SEQ ID NO: 990847 - DNA, 13 bp, Homo sapiens
ggccatcagggcc

SEQ ID NO: 990848 - DNA, 17 bp, Homo sapiens
ggccatcagggccctgc

SEQ ID NO: 990849 - DNA, 18 bp, Homo sapiens
ggccatcagggccctgcc

SEQ ID NO: 990850 - DNA, 13 bp, Homo sapiens
ggccatccctggg

SEQ ID NO: 990851 - DNA, 16 bp, Homo sapiens
ggccatccctgggccc

SEQ ID NO: 990852 - DNA, 21 bp, Homo sapiens
ggccatccctgggcccctcca

SEQ ID NO: 990853 - DNA, 17 bp, Homo sapiens
ggccatcctacccagcg

SEQ ID NO: 990854 - DNA, 17 bp, Homo sapiens
ggccatctccctcccca

SEQ ID NO: 990855 - DNA, 19 bp, Homo sapiens
ggccatctgtaaatatccc

SEQ ID NO: 990856 - DNA, 20 bp, Homo sapiens
ggccatctgtaaatatccca

SEQ ID NO: 990857 - DNA, 22 bp, Homo sapiens
ggccatctgtaaatatcccaga

SEQ ID NO: 990858 - DNA, 18 bp, Homo sapiens
ggccatgagctccagacc

SEQ ID NO: 990859 - DNA, 12 bp, Homo sapiens
ggccatgcagac

SEQ ID NO: 990860 - DNA, 13 bp, Homo sapiens
ggccatgcagacc

SEQ ID NO: 990861 - DNA, 15 bp, Homo sapiens
ggccatgcaggaggt

SEQ ID NO: 990862 - DNA, 14 bp, Homo sapiens
ggccatgccccacc

SEQ ID NO: 990863 - DNA, 21 bp, Homo sapiens
ggccatgcctcctcaggagcc

SEQ ID NO: 990864 - DNA, 21 bp, Homo sapiens
ggccatgcgaggggccagcag

SEQ ID NO: 990865 - DNA, 22 bp, Homo sapiens
ggccatgcgaggggccagcaga

SEQ ID NO: 990866 - DNA, 23 bp, Homo sapiens
ggccatgcgaggggccagcagag

SEQ ID NO: 990867 - DNA, 15 bp, Homo sapiens
ggccaacaccaggga

SEQ ID NO: 990868 - DNA, 15 bp, Homo sapiens
ggccaaccaggaccc

SEQ ID NO: 990869 - DNA, 17 bp, Homo sapiens
ggccaaccaggacccag

SEQ ID NO: 990870 - DNA, 20 bp, Homo sapiens
ggccaacccttctcctcttg

SEQ ID NO: 990871 - DNA, 17 bp, Homo sapiens
ggccaagaatattgcaa

SEQ ID NO: 990872 - DNA, 15 bp, Homo sapiens
ggccaagacttggca

SEQ ID NO: 990873 - DNA, 23 bp, Homo sapiens
ggccaagctttgaggctctgtca

SEQ ID NO: 990874 - DNA, 11 bp, Homo sapiens
ggccaaggact

SEQ ID NO: 990875 - DNA, 15 bp, Homo sapiens
ggccaaggactgccg

SEQ ID NO: 990876 - DNA, 13 bp, Homo sapiens
ggccaaggagctg

SEQ ID NO: 990877 - DNA, 21 bp, Homo sapiens
ggccaaggatgccccgtcccc

SEQ ID NO: 990878 - DNA, 15 bp, Homo sapiens
ggccaaggtcctgct

SEQ ID NO: 990879 - DNA, 14 bp, Homo sapiens
ggccaaggtgcata

SEQ ID NO: 990880 - DNA, 17 bp, Homo sapiens
ggccaagtccactgtcc

SEQ ID NO: 990881 - DNA, 18 bp, Homo sapiens
ggccaagtccactgtcct

SEQ ID NO: 990882 - DNA, 20 bp, Homo sapiens
ggccaagtgcaggctggcac

SEQ ID NO: 990883 - DNA, 15 bp, Homo sapiens
ggccaataaaaagtt

SEQ ID NO: 990884 - DNA, 16 bp, Homo sapiens
ggccaataaaaagttc

SEQ ID NO: 990885 - DNA, 17 bp, Homo sapiens
ggccaataataaagaca

SEQ ID NO: 990886 - DNA, 22 bp, Homo sapiens
ggccaatgcacctaaagaaaaa

SEQ ID NO: 990887 - DNA, 18 bp, Homo sapiens
ggccaatggtgcttcccc

SEQ ID NO: 990888 - DNA, 15 bp, Homo sapiens
ggccacaaaaacaat

SEQ ID NO: 990889 - DNA, 15 bp, Homo sapiens
ggccacaactgctgt

SEQ ID NO: 990890 - DNA, 17 bp, Homo sapiens
ggccacaactgctgtgg

SEQ ID NO: 990891 - DNA, 17 bp, Homo sapiens
ggccacacccaggaagg

SEQ ID NO: 990892 - DNA, 18 bp, Homo sapiens
ggccacacctgagcgctg

SEQ ID NO: 990893 - DNA, 22 bp, Homo sapiens
ggccacacctgagcgctgtgga

SEQ ID NO: 990894 - DNA, 21 bp, Homo sapiens
ggccacagcaagtacagcggc

SEQ ID NO: 990895 - DNA, 12 bp, Homo sapiens
ggccacagcacc

SEQ ID NO: 990896 - DNA, 15 bp, Homo sapiens
ggccacagcaccccg

SEQ ID NO: 990897 - DNA, 22 bp, Homo sapiens
ggccacagcccccttgccctcc

SEQ ID NO: 990898 - DNA, 15 bp, Homo sapiens
ggccacagccccgat

SEQ ID NO: 990899 - DNA, 13 bp, Homo sapiens
ggccacagcgtgc

SEQ ID NO: 990900 - DNA, 14 bp, Homo sapiens
ggccacagctgctg

SEQ ID NO: 990901 - DNA, 21 bp, Homo sapiens
ggccacaggcagtccaggcct

SEQ ID NO: 990902 - DNA, 12 bp, Homo sapiens
ggccacagggca

SEQ ID NO: 990903 - DNA, 20 bp, Homo sapiens
ggccacagggcgagactccg

SEQ ID NO: 990904 - DNA, 20 bp, Homo sapiens
ggccacagtagtcttgatga

SEQ ID NO: 990905 - DNA, 15 bp, Homo sapiens
ggccacagtggggct

SEQ ID NO: 990906 - DNA, 16 bp, Homo sapiens
ggccacatagatgctg

SEQ ID NO: 990907 - DNA, 14 bp, Homo sapiens
ggccacatcagccc

SEQ ID NO: 990908 - DNA, 19 bp, Homo sapiens
ggccacatcattctgtgtc

SEQ ID NO: 990909 - DNA, 13 bp, Homo sapiens
ggccaccaaagct

SEQ ID NO: 990910 - DNA, 15 bp, Homo sapiens
ggccaccagccatcc

SEQ ID NO: 990911 - DNA, 15 bp, Homo sapiens
ggccaccaggctggc

SEQ ID NO: 990912 - DNA, 15 bp, Homo sapiens
ggccaccatgacccc

SEQ ID NO: 990913 - DNA, 18 bp, Homo sapiens
ggccaccatgaccccttc

SEQ ID NO: 990914 - DNA, 19 bp, Homo sapiens
ggccacccaaatgtgtaca

SEQ ID NO: 990915 - DNA, 16 bp, Homo sapiens
ggccaccccaaacccc

SEQ ID NO: 990916 - DNA, 21 bp, Homo sapiens
ggccaccccaaaccccagccc

SEQ ID NO: 990917 - DNA, 23 bp, Homo sapiens
ggccaccccaaaccccagcccca

SEQ ID NO: 990918 - DNA, 15 bp, Homo sapiens
ggccaccccgtgcca

SEQ ID NO: 990919 - DNA, 15 bp, Homo sapiens
ggccaccctccttcc

SEQ ID NO: 990920 - DNA, 16 bp, Homo sapiens
ggccaccctgctgcac

SEQ ID NO: 990921 - DNA, 14 bp, Homo sapiens
ggccaccctggccc

SEQ ID NO: 990922 - DNA, 21 bp, Homo sapiens
ggccaccgggggtggctctgt

SEQ ID NO: 990923 - DNA, 16 bp, Homo sapiens
ggccacctccccagca

SEQ ID NO: 990924 - DNA, 13 bp, Homo sapiens
ggccacctcctac

SEQ ID NO: 990925 - DNA, 20 bp, Homo sapiens
ggccacctcctaccccttcc

SEQ ID NO: 990926 - DNA, 23 bp, Homo sapiens
ggccacctcctaccccttcctgt

SEQ ID NO: 990927 - DNA, 13 bp, Homo sapiens
ggccacctcctcc

SEQ ID NO: 990928 - DNA, 15 bp, Homo sapiens
ggccacctcctcccc

SEQ ID NO: 990929 - DNA, 16 bp, Homo sapiens
ggccacctcctccccc

SEQ ID NO: 990930 - DNA, 11 bp, Homo sapiens
ggccacctctc

SEQ ID NO: 990931 - DNA, 13 bp, Homo sapiens
ggccacctctcca

SEQ ID NO: 990932 - DNA, 15 bp, Homo sapiens
ggccacctctccaag

SEQ ID NO: 990933 - DNA, 19 bp, Homo sapiens
ggccacctgaggtgggccc

SEQ ID NO: 990934 - DNA, 21 bp, Homo sapiens
ggccacctgccacccccaggt

SEQ ID NO: 990935 - DNA, 13 bp, Homo sapiens
ggccaccttggag

SEQ ID NO: 990936 - DNA, 18 bp, Homo sapiens
ggccacgggggcagtgtg

SEQ ID NO: 990937 - DNA, 21 bp, Homo sapiens
ggccacgggggcagtgtgagg

SEQ ID NO: 990938 - DNA, 21 bp, Homo sapiens
ggccacgtatagtcctagctg

SEQ ID NO: 990939 - DNA, 12 bp, Homo sapiens
ggccacgtgcca

SEQ ID NO: 990940 - DNA, 18 bp, Homo sapiens
ggccactaaagcttcaga

SEQ ID NO: 990941 - DNA, 11 bp, Homo sapiens
ggccactaagc

SEQ ID NO: 990942 - DNA, 19 bp, Homo sapiens
ggccactctcccctccctc

SEQ ID NO: 990943 - DNA, 12 bp, Homo sapiens
ggccactgaccc

SEQ ID NO: 990944 - DNA, 15 bp, Homo sapiens
gccgcggccctgggg

SEQ ID NO: 990945 - DNA, 13 bp, Homo sapiens
gccgcggcctccc

SEQ ID NO: 990946 - DNA, 15 bp, Homo sapiens
gccgcggcctccccg

SEQ ID NO: 990947 - DNA, 19 bp, Homo sapiens
gccgcggggaagctggctt

SEQ ID NO: 990948 - DNA, 20 bp, Homo sapiens
gccgcggtaggtaagggccg

SEQ ID NO: 990949 - DNA, 17 bp, Homo sapiens
gccgcgtcgccctccca

SEQ ID NO: 990950 - DNA, 11 bp, Homo sapiens
gccgctacctc

SEQ ID NO: 990951 - DNA, 17 bp, Homo sapiens
gccgctaggagagactg

SEQ ID NO: 990952 - DNA, 23 bp, Homo sapiens
gccgctcctccctgctcctcatg

SEQ ID NO: 990953 - DNA, 15 bp, Homo sapiens
gccgctcctgtctgc

SEQ ID NO: 990954 - DNA, 20 bp, Homo sapiens
gccgctcctgtctgccagcc

SEQ ID NO: 990955 - DNA, 21 bp, Homo sapiens
gccgctcctgtctgccagcca

SEQ ID NO: 990956 - DNA, 23 bp, Homo sapiens
gccgctcctgtctgccagccagc

SEQ ID NO: 990957 - DNA, 13 bp, Homo sapiens
gccgctctgattt

SEQ ID NO: 990958 - DNA, 17 bp, Homo sapiens
gccgctgagcgaggaga

SEQ ID NO: 990959 - DNA, 23 bp, Homo sapiens
gccgctgagcgcccccgagccct

SEQ ID NO: 990960 - DNA, 14 bp, Homo sapiens
gccgctgcccgctc

SEQ ID NO: 990961 - DNA, 18 bp, Homo sapiens
gccgctgcccgctcagcc

SEQ ID NO: 990962 - DNA, 19 bp, Homo sapiens
gccgctgcttccaggctgg

SEQ ID NO: 990963 - DNA, 19 bp, Homo sapiens
gccgctgtcaaggccgagg

SEQ ID NO: 990964 - DNA, 21 bp, Homo sapiens
gccgctgtccaggttctgtct

SEQ ID NO: 990965 - DNA, 23 bp, Homo sapiens
gccgctgtgagcccctggtcctg

SEQ ID NO: 990966 - DNA, 23 bp, Homo sapiens
gccggaaggaatgtcagggccag

SEQ ID NO: 990967 - DNA, 15 bp, Homo sapiens
gccggagcccagata

SEQ ID NO: 990968 - DNA, 15 bp, Homo sapiens
gccggatctgggctg

SEQ ID NO: 990969 - DNA, 15 bp, Homo sapiens
gccggatgtgctttt

SEQ ID NO: 990970 - DNA, 16 bp, Homo sapiens
gccggatgtgcttttc

SEQ ID NO: 990971 - DNA, 11 bp, Homo sapiens
gccggcaaccc

SEQ ID NO: 990972 - DNA, 21 bp, Homo sapiens
gccggcacagggtctgctctt

SEQ ID NO: 990973 - DNA, 14 bp, Homo sapiens
gccggccagcccct

SEQ ID NO: 990974 - DNA, 14 bp, Homo sapiens
gccggcccagatgt

SEQ ID NO: 990975 - DNA, 22 bp, Homo sapiens
gccggcccagatgtgtcccccc

SEQ ID NO: 990976 - DNA, 12 bp, Homo sapiens
gccggccccagg

SEQ ID NO: 990977 - DNA, 22 bp, Homo sapiens
gccggcctctgctgcccccttc

SEQ ID NO: 990978 - DNA, 20 bp, Homo sapiens
gccggcgagggggccggggg

SEQ ID NO: 990979 - DNA, 22 bp, Homo sapiens
gccggctatgaaagggagcgag

SEQ ID NO: 990980 - DNA, 17 bp, Homo sapiens
gccggctggcctggagg

SEQ ID NO: 990981 - DNA, 19 bp, Homo sapiens
gccggctggcctggaggct

SEQ ID NO: 990982 - DNA, 22 bp, Homo sapiens
gccggctggcctggaggctcag

SEQ ID NO: 990983 - DNA, 12 bp, Homo sapiens
gccggctggtga

SEQ ID NO: 990984 - DNA, 16 bp, Homo sapiens
gccggctgtgctcaga

SEQ ID NO: 990985 - DNA, 17 bp, Homo sapiens
gccggctgtgctcagag

SEQ ID NO: 990986 - DNA, 22 bp, Homo sapiens
gccgggaacagacaacagaagt

SEQ ID NO: 990987 - DNA, 17 bp, Homo sapiens
gccgggaagagccacct

SEQ ID NO: 990988 - DNA, 22 bp, Homo sapiens
gccgggaagagccacctggcag

SEQ ID NO: 990989 - DNA, 20 bp, Homo sapiens
gccgggaccaccctgagccg

SEQ ID NO: 990990 - DNA, 15 bp, Homo sapiens
gccgggaccctcagg

SEQ ID NO: 990991 - DNA, 15 bp, Homo sapiens
gccgggcaggcctgc

SEQ ID NO: 990992 - DNA, 17 bp, Homo sapiens
gccgggcaggtcctgcc

SEQ ID NO: 990993 - DNA, 18 bp, Homo sapiens
gccgggcaggtcctgccc

SEQ ID NO: 990994 - DNA, 14 bp, Homo sapiens
gccgggcccctggg

SEQ ID NO: 990995 - DNA, 17 bp, Homo sapiens
gccgggcgccaggacag

SEQ ID NO: 990996 - DNA, 22 bp, Homo sapiens
gccgggcgccaggacagcagca

SEQ ID NO: 990997 - DNA, 18 bp, Homo sapiens
gccgggcgcggtggctca

SEQ ID NO: 990998 - DNA, 22 bp, Homo sapiens
gccgggcgcggtggctcacgcc

SEQ ID NO: 990999 - DNA, 16 bp, Homo sapiens
gccgggcggtcacagc

SEQ ID NO: 991000 - DNA, 19 bp, Homo sapiens
gccgggcgtggtggcgggc

SEQ ID NO: 991001 - DNA, 13 bp, Homo sapiens
gccgggctgaggg

SEQ ID NO: 991002 - DNA, 18 bp, Homo sapiens
gccgggctgagggcctgc

SEQ ID NO: 991003 - DNA, 19 bp, Homo sapiens
gccggggaggggcagagag

SEQ ID NO: 991004 - DNA, 13 bp, Homo sapiens
gccggggaggggg

SEQ ID NO: 991005 - DNA, 22 bp, Homo sapiens
gccggggcagggacttgcctcc

SEQ ID NO: 991006 - DNA, 15 bp, Homo sapiens
gccgggggaggggcc

SEQ ID NO: 991007 - DNA, 21 bp, Homo sapiens
gccgggggaggggccctcagg

SEQ ID NO: 991008 - DNA, 18 bp, Homo sapiens
gccgggggctggccttct

SEQ ID NO: 991009 - DNA, 16 bp, Homo sapiens
gccggggggaggggac

SEQ ID NO: 991010 - DNA, 17 bp, Homo sapiens
gccggggggaggggaca

SEQ ID NO: 991011 - DNA, 21 bp, Homo sapiens
gccggggggggtaggagagga

SEQ ID NO: 991012 - DNA, 22 bp, Homo sapiens
gccggggtggagcatgggcctg

SEQ ID NO: 991013 - DNA, 14 bp, Homo sapiens
gccgggtctgcctc

SEQ ID NO: 991014 - DNA, 18 bp, Homo sapiens
gccgggttctagtctcct

SEQ ID NO: 991015 - DNA, 24 bp, Homo sapiens
gccggtcacactctacacggactg

SEQ ID NO: 991016 - DNA, 16 bp, Homo sapiens
gccggtcaggcacaca

SEQ ID NO: 991017 - DNA, 14 bp, Homo sapiens
gccggtcgggcagc

SEQ ID NO: 991018 - DNA, 18 bp, Homo sapiens
gccggtcgggcagccagc

SEQ ID NO: 991019 - DNA, 22 bp, Homo sapiens
gccggtgaggggaggggcctcc

SEQ ID NO: 991020 - DNA, 13 bp, Homo sapiens
gccggtgctgggg

SEQ ID NO: 991021 - DNA, 18 bp, Homo sapiens
gccggtgctgggggcaca

SEQ ID NO: 991022 - DNA, 22 bp, Homo sapiens
gccggttctgctagagcagaca

SEQ ID NO: 991023 - DNA, 13 bp, Homo sapiens
gccgtaatttaac

SEQ ID NO: 991024 - DNA, 19 bp, Homo sapiens
gccgtaccccaccctcagc

SEQ ID NO: 991025 - DNA, 16 bp, Homo sapiens
gccgtcaccaccaccc

SEQ ID NO: 991026 - DNA, 14 bp, Homo sapiens
gccgtcccaggcca

SEQ ID NO: 991027 - DNA, 15 bp, Homo sapiens
gccgtcccctctccc

SEQ ID NO: 991028 - DNA, 18 bp, Homo sapiens
gccgtcccctctcccctt

SEQ ID NO: 991029 - DNA, 18 bp, Homo sapiens
gccgtcctcccgggccct

SEQ ID NO: 991030 - DNA, 21 bp, Homo sapiens
gccgtcctcccgggccctccc

SEQ ID NO: 991031 - DNA, 14 bp, Homo sapiens
gccgtcctgctgga

SEQ ID NO: 991032 - DNA, 18 bp, Homo sapiens
gccgtcctgctggagtga

SEQ ID NO: 991033 - DNA, 16 bp, Homo sapiens
gccgtctccaggggct

SEQ ID NO: 991034 - DNA, 23 bp, Homo sapiens
gccgtctccaggggctgcttcct

SEQ ID NO: 991035 - DNA, 14 bp, Homo sapiens
gccgtctcctccct

SEQ ID NO: 991036 - DNA, 19 bp, Homo sapiens
gccgtctgactccagagtc

SEQ ID NO: 991037 - DNA, 12 bp, Homo sapiens
gccgtctgcagg

SEQ ID NO: 991038 - DNA, 23 bp, Homo sapiens
gccgtctgcaggggcctggagga

SEQ ID NO: 991039 - DNA, 19 bp, Homo sapiens
gccgtcttcactcgccccc

SEQ ID NO: 991040 - DNA, 15 bp, Homo sapiens
gccgtgaactgtgca

SEQ ID NO: 991041 - DNA, 17 bp, Homo sapiens
gccgtgatgctcaggct

SEQ ID NO: 991042 - DNA, 12 bp, Homo sapiens
gccgtgcccagg

SEQ ID NO: 991043 - DNA, 14 bp, Homo sapiens
gccgtgcccagggg

SEQ ID NO: 991044 - DNA, 14 bp, Homo sapiens
gccgtgccttcagc

SEQ ID NO: 991045 - DNA, 19 bp, Homo sapiens
gccgtgccttcagctctac

SEQ ID NO: 991046 - DNA, 15 bp, Homo sapiens
gccgtgctgtaaata

SEQ ID NO: 991047 - DNA, 23 bp, Homo sapiens
gccgtggagtcggagtggacacc

SEQ ID NO: 991048 - DNA, 18 bp, Homo sapiens
gccgtggatggccgtgga

SEQ ID NO: 991049 - DNA, 11 bp, Homo sapiens
gccgtggcttc

SEQ ID NO: 991050 - DNA, 12 bp, Homo sapiens
gccgtggcttcc

SEQ ID NO: 991051 - DNA, 13 bp, Homo sapiens
gccgtggcttccc

SEQ ID NO: 991052 - DNA, 22 bp, Homo sapiens
gccgtggcttcccgctcagccc

SEQ ID NO: 991053 - DNA, 18 bp, Homo sapiens
gccgtgggccgggaggca

SEQ ID NO: 991054 - DNA, 23 bp, Homo sapiens
gccgtggggccgccgcctctttc

SEQ ID NO: 991055 - DNA, 22 bp, Homo sapiens
gccgtggggctccggaggggac

SEQ ID NO: 991056 - DNA, 15 bp, Homo sapiens
gccgtggtccctgag

SEQ ID NO: 991057 - DNA, 15 bp, Homo sapiens
gccgtgtctctgagg

SEQ ID NO: 991058 - DNA, 16 bp, Homo sapiens
gccgttccccttggct

SEQ ID NO: 991059 - DNA, 14 bp, Homo sapiens
gccgttccctgcgc

SEQ ID NO: 991060 - DNA, 14 bp, Homo sapiens
gccgttgaatctgg

SEQ ID NO: 991061 - DNA, 18 bp, Homo sapiens
gccgttgaatctgggagg

SEQ ID NO: 991062 - DNA, 11 bp, Homo sapiens
gagcccagctc

SEQ ID NO: 991063 - DNA, 21 bp, Homo sapiens
gagcccagctgggtcaggcag

SEQ ID NO: 991064 - DNA, 11 bp, Homo sapiens
gagcccaggag

SEQ ID NO: 991065 - DNA, 23 bp, Homo sapiens
gagcccaggcagctatttcagcc

SEQ ID NO: 991066 - DNA, 11 bp, Homo sapiens
gagcccaggcc

SEQ ID NO: 991067 - DNA, 16 bp, Homo sapiens
gagcccatactcagcc

SEQ ID NO: 991068 - DNA, 22 bp, Homo sapiens
gagcccatactcagcctgctgc

SEQ ID NO: 991069 - DNA, 22 bp, Homo sapiens
gagcccatgttctgcccccagc

SEQ ID NO: 991070 - DNA, 13 bp, Homo sapiens
gagcccattccca

SEQ ID NO: 991071 - DNA, 13 bp, Homo sapiens
aaaaaaaaaaaga

SEQ ID NO: 991072 - DNA, 12 bp, Homo sapiens
aaaaaaaaactc

SEQ ID NO: 991073 - DNA, 12 bp, Homo sapiens
aaaaaaaaactt

SEQ ID NO: 991074 - DNA, 13 bp, Homo sapiens
aaaaaaaaagact

SEQ ID NO: 991075 - DNA, 12 bp, Homo sapiens
aaaaaaaaagcg

SEQ ID NO: 991076 - DNA, 13 bp, Homo sapiens
aaaaaaaaagtca

SEQ ID NO: 991077 - DNA, 13 bp, Homo sapiens
aaaaaaaacttaa

SEQ ID NO: 991078 - DNA, 12 bp, Homo sapiens
aaaaaaaagaat

SEQ ID NO: 991079 - DNA, 11 bp, Homo sapiens
aaaaaaaagat

SEQ ID NO: 991080 - DNA, 12 bp, Homo sapiens
aaaaaaaatata

SEQ ID NO: 991081 - DNA, 18 bp, Homo sapiens
aaaaaaacagtggatcac

SEQ ID NO: 991082 - DNA, 13 bp, Homo sapiens
aaaaaaacataaa

SEQ ID NO: 991083 - DNA, 12 bp, Homo sapiens
aaaaaaacttaa

SEQ ID NO: 991084 - DNA, 13 bp, Homo sapiens
aaaaaaagaaaag

SEQ ID NO: 991085 - DNA, 13 bp, Homo sapiens
aaaaaaagacaag

SEQ ID NO: 991086 - DNA, 13 bp, Homo sapiens
aaaaaaagactgt

SEQ ID NO: 991087 - DNA, 10 bp, Homo sapiens
aaaaaaagag

SEQ ID NO: 991088 - DNA, 13 bp, Homo sapiens
aaaaaaagcctcc

SEQ ID NO: 991089 - DNA, 14 bp, Homo sapiens
aaaaaaagcctcca

SEQ ID NO: 991090 - DNA, 12 bp, Homo sapiens
aaaaaaataata

SEQ ID NO: 991091 - DNA, 12 bp, Homo sapiens
aaaaaaatgact

SEQ ID NO: 991092 - DNA, 12 bp, Homo sapiens
aaaaaaatgatg

SEQ ID NO: 991093 - DNA, 12 bp, Homo sapiens
aaaaaaatgttg

SEQ ID NO: 991094 - DNA, 10 bp, Homo sapiens
aaaaaacaac

SEQ ID NO: 991095 - DNA, 16 bp, Homo sapiens
aaaaaacaatatctgc

SEQ ID NO: 991096 - DNA, 21 bp, Homo sapiens
aaaaaacacttggcatacaaa

SEQ ID NO: 991097 - DNA, 22 bp, Homo sapiens
aaaaaacagccaccgtttcttc

SEQ ID NO: 991098 - DNA, 21 bp, Homo sapiens
aaaaaacatacttacatttca

SEQ ID NO: 991099 - DNA, 11 bp, Homo sapiens
aaaaaagaaaa

SEQ ID NO: 991100 - DNA, 12 bp, Homo sapiens
aaaaaaggaaaa

SEQ ID NO: 991101 - DNA, 13 bp, Homo sapiens
aaaaaagggctga

SEQ ID NO: 991102 - DNA, 13 bp, Homo sapiens
aaaaaagttgaag

SEQ ID NO: 991103 - DNA, 20 bp, Homo sapiens
aaaaaagtttacaagtgtat

SEQ ID NO: 991104 - DNA, 13 bp, Homo sapiens
aaaaaatacttgt

SEQ ID NO: 991105 - DNA, 21 bp, Homo sapiens
aaaaaatagagagagaggtat

SEQ ID NO: 991106 - DNA, 12 bp, Homo sapiens
aaaaaatatttt

SEQ ID NO: 991107 - DNA, 13 bp, Homo sapiens
aaaaaatctatcc

SEQ ID NO: 991108 - DNA, 22 bp, Homo sapiens
aaaaaatgctgaacattgcata

SEQ ID NO: 991109 - DNA, 16 bp, Homo sapiens
aaaaaatgtatatgca

SEQ ID NO: 991110 - DNA, 13 bp, Homo sapiens
aaaaaattaactg

SEQ ID NO: 991111 - DNA, 22 bp, Homo sapiens
aaaaaattagaaattggctgga

SEQ ID NO: 991112 - DNA, 12 bp, Homo sapiens
aaaaaatttgta

SEQ ID NO: 991113 - DNA, 17 bp, Homo sapiens
aaaaaatttttgacact

SEQ ID NO: 991114 - DNA, 15 bp, Homo sapiens
aaaaacaaaaaaact

SEQ ID NO: 991115 - DNA, 18 bp, Homo sapiens
aaaaacaaaaaaactata

SEQ ID NO: 991116 - DNA, 14 bp, Homo sapiens
aaaaacacaaaaca

SEQ ID NO: 991117 - DNA, 18 bp, Homo sapiens
aaaaacacctagctttat

SEQ ID NO: 991118 - DNA, 14 bp, Homo sapiens
aaaaacagaggcca

SEQ ID NO: 991119 - DNA, 21 bp, Homo sapiens
aaaaacagcattgctttctga

SEQ ID NO: 991120 - DNA, 19 bp, Homo sapiens
aaaaacagcctcacagaag

SEQ ID NO: 991121 - DNA, 18 bp, Homo sapiens
aaaaacaggtatatactt

SEQ ID NO: 991122 - DNA, 23 bp, Homo sapiens
aaaaacatcccaaactttaaaat

SEQ ID NO: 991123 - DNA, 23 bp, Homo sapiens
aaaaacattctatctactgattt

SEQ ID NO: 991124 - DNA, 12 bp, Homo sapiens
aaaaacattgcc

SEQ ID NO: 991125 - DNA, 19 bp, Homo sapiens
aaaaaccaatcattttaag

SEQ ID NO: 991126 - DNA, 16 bp, Homo sapiens
aaaaaccacacaaaga

SEQ ID NO: 991127 - DNA, 13 bp, Homo sapiens
aaaaacccaaaat

SEQ ID NO: 991128 - DNA, 12 bp, Homo sapiens
aaaaacccagcg

SEQ ID NO: 991129 - DNA, 24 bp, Homo sapiens
aaaaaccctatttaaatgaaagga

SEQ ID NO: 991130 - DNA, 13 bp, Homo sapiens
aaaaactacacat

SEQ ID NO: 991131 - DNA, 23 bp, Homo sapiens
aaaaactattttatgttcagaaa

SEQ ID NO: 991132 - DNA, 12 bp, Homo sapiens
aaaaactcctgg

SEQ ID NO: 991133 - DNA, 13 bp, Homo sapiens
aaaaactcctgtg

SEQ ID NO: 991134 - DNA, 14 bp, Homo sapiens
aaaaactcctgtgt

SEQ ID NO: 991135 - DNA, 14 bp, Homo sapiens
aaaaactccttttg

SEQ ID NO: 991136 - DNA, 16 bp, Homo sapiens
aaaaactgaagaattt

SEQ ID NO: 991137 - DNA, 13 bp, Homo sapiens
aaaaactgaaggt

SEQ ID NO: 991138 - DNA, 22 bp, Homo sapiens
aaaaactggaacggtgaaggtg

SEQ ID NO: 991139 - DNA, 15 bp, Homo sapiens
aaaaactgtctttaa

SEQ ID NO: 991140 - DNA, 21 bp, Homo sapiens
aaaaactgtgtatcattaaaa

SEQ ID NO: 991141 - DNA, 15 bp, Homo sapiens
aaaaacttaaagcaa

SEQ ID NO: 991142 - DNA, 23 bp, Homo sapiens
aaaaacttcatgtaattttattt

SEQ ID NO: 991143 - DNA, 21 bp, Homo sapiens
aaaaactttggaaccagactc

SEQ ID NO: 991144 - DNA, 15 bp, Homo sapiens
aaaaagaaaatatta

SEQ ID NO: 991145 - DNA, 12 bp, Homo sapiens
aaaaagaaacta

SEQ ID NO: 991146 - DNA, 23 bp, Homo sapiens
aaaaagaaagaattaaaaacttt

SEQ ID NO: 991147 - DNA, 17 bp, Homo sapiens
aaaacgcgtctgcctgg

SEQ ID NO: 991148 - DNA, 20 bp, Homo sapiens
aaaacgggttactaagatga

SEQ ID NO: 991149 - DNA, 17 bp, Homo sapiens
aaaacgttttattgtgt

SEQ ID NO: 991150 - DNA, 19 bp, Homo sapiens
aaaacgttttattgtgttt

SEQ ID NO: 991151 - DNA, 18 bp, Homo sapiens
aaaactaaatctctaata

SEQ ID NO: 991152 - DNA, 20 bp, Homo sapiens
aaaactaagctctttgagaa

SEQ ID NO: 991153 - DNA, 16 bp, Homo sapiens
aaaactaatgtactgt

SEQ ID NO: 991154 - DNA, 15 bp, Homo sapiens
aaaatcgatgagcgc

SEQ ID NO: 991155 - DNA, 24 bp, Homo sapiens
aaaatctaaaatttcataattctg

SEQ ID NO: 991156 - DNA, 12 bp, Homo sapiens
aaaatctacttt

SEQ ID NO: 991157 - DNA, 18 bp, Homo sapiens
aaaatctagaagagtcta

SEQ ID NO: 991158 - DNA, 14 bp, Homo sapiens
aaaatctagttttt

SEQ ID NO: 991159 - DNA, 15 bp, Homo sapiens
aaaatctcaaatttc

SEQ ID NO: 991160 - DNA, 16 bp, Homo sapiens
aaaatctcaaatttct

SEQ ID NO: 991161 - DNA, 13 bp, Homo sapiens
aaaatctccatta

SEQ ID NO: 991162 - DNA, 21 bp, Homo sapiens
aaaatctcccattttggaatt

SEQ ID NO: 991163 - DNA, 18 bp, Homo sapiens
aaaatctgagaaactcta

SEQ ID NO: 991164 - DNA, 22 bp, Homo sapiens
aaaatctgatttaatgttttct

SEQ ID NO: 991165 - DNA, 19 bp, Homo sapiens
aaaatctgcagaaggaaaa

SEQ ID NO: 991166 - DNA, 15 bp, Homo sapiens
aaaatctgctaggga

SEQ ID NO: 991167 - DNA, 15 bp, Homo sapiens
aaaatctgctgttaa

SEQ ID NO: 991168 - DNA, 17 bp, Homo sapiens
aaaatctggaaatctgt

SEQ ID NO: 991169 - DNA, 15 bp, Homo sapiens
aaaatcttgatcagt

SEQ ID NO: 991170 - DNA, 21 bp, Homo sapiens
aaaatcttgtaggtcattgca

SEQ ID NO: 991171 - DNA, 18 bp, Homo sapiens
aaaatctttgtataaata

SEQ ID NO: 991172 - DNA, 12 bp, Homo sapiens
aaaatgaaagaa

SEQ ID NO: 991173 - DNA, 15 bp, Homo sapiens
aaaatgaaagtgact

SEQ ID NO: 991174 - DNA, 16 bp, Homo sapiens
aaaatgaaagtgactt

SEQ ID NO: 991175 - DNA, 14 bp, Homo sapiens
aaaatgaaatgcta

SEQ ID NO: 991176 - DNA, 16 bp, Homo sapiens
aaaatgaaatgctaca

SEQ ID NO: 991177 - DNA, 15 bp, Homo sapiens
aaaatgaacatctct

SEQ ID NO: 991178 - DNA, 20 bp, Homo sapiens
aaaatgaaggttaggattta

SEQ ID NO: 991179 - DNA, 15 bp, Homo sapiens
aaaatgaattttgta

SEQ ID NO: 991180 - DNA, 15 bp, Homo sapiens
aaaatgacaacagaa

SEQ ID NO: 991181 - DNA, 18 bp, Homo sapiens
aaaatgacaacagaaaaa

SEQ ID NO: 991182 - DNA, 19 bp, Homo sapiens
aaaatgacaacagaaaaac

SEQ ID NO: 991183 - DNA, 15 bp, Homo sapiens
aaaatgacaatatca

SEQ ID NO: 991184 - DNA, 15 bp, Homo sapiens
aaaatgacagatgtt

SEQ ID NO: 991185 - DNA, 17 bp, Homo sapiens
aaaatgacagatgttga

SEQ ID NO: 991186 - DNA, 17 bp, Homo sapiens
aaaatgactttgaactg

SEQ ID NO: 991187 - DNA, 12 bp, Homo sapiens
aaaatgagccct

SEQ ID NO: 991188 - DNA, 13 bp, Homo sapiens
aaaatgagccctg

SEQ ID NO: 991189 - DNA, 16 bp, Homo sapiens
aaaatgagcttgatta

SEQ ID NO: 991190 - DNA, 15 bp, Homo sapiens
aaaatgaggaatgta

SEQ ID NO: 991191 - DNA, 18 bp, Homo sapiens
aaaatgaggaatgtatat

SEQ ID NO: 991192 - DNA, 22 bp, Homo sapiens
aaaatgagtcaggcaattgatt

SEQ ID NO: 991193 - DNA, 19 bp, Homo sapiens
aaaatgagtgaaatttaaa

SEQ ID NO: 991194 - DNA, 16 bp, Homo sapiens
aaaatgagttgtgatg

SEQ ID NO: 991195 - DNA, 22 bp, Homo sapiens
aaaatgagtttgtattattaca

SEQ ID NO: 991196 - DNA, 23 bp, Homo sapiens
aaaatgagtttttatggggctga

SEQ ID NO: 991197 - DNA, 13 bp, Homo sapiens
aaaatgatactgt

SEQ ID NO: 991198 - DNA, 14 bp, Homo sapiens
aaaatgattcctct

SEQ ID NO: 991199 - DNA, 23 bp, Homo sapiens
aaaatgattcctggacatcacca

SEQ ID NO: 991200 - DNA, 16 bp, Homo sapiens
aaaatgattgtaaaat

SEQ ID NO: 991201 - DNA, 19 bp, Homo sapiens
aaaatgattgtaaaatagc

SEQ ID NO: 991202 - DNA, 20 bp, Homo sapiens
aaaatgattgtaaaatagct

SEQ ID NO: 991203 - DNA, 13 bp, Homo sapiens
aaaatgcaaatga

SEQ ID NO: 991204 - DNA, 19 bp, Homo sapiens
aaaatgcaaatgaatcatt

SEQ ID NO: 991205 - DNA, 19 bp, Homo sapiens
aaaatgcaggtgaactttt

SEQ ID NO: 991206 - DNA, 22 bp, Homo sapiens
aaaatgcattgaaagaattaga

SEQ ID NO: 991207 - DNA, 12 bp, Homo sapiens
aaaatgcatttt

SEQ ID NO: 991208 - DNA, 14 bp, Homo sapiens
aaaatgcattttct

SEQ ID NO: 991209 - DNA, 20 bp, Homo sapiens
aaaatgcattttcttcagaa

SEQ ID NO: 991210 - DNA, 17 bp, Homo sapiens
aaaatgccatagtttgt

SEQ ID NO: 991211 - DNA, 18 bp, Homo sapiens
aaaatgcctcagtgtatt

SEQ ID NO: 991212 - DNA, 20 bp, Homo sapiens
aaaatgcctcagtgtatttg

SEQ ID NO: 991213 - DNA, 21 bp, Homo sapiens
aaaatgcgaaattattggttg

SEQ ID NO: 991214 - DNA, 16 bp, Homo sapiens
aaaatgctcaatttca

SEQ ID NO: 991215 - DNA, 18 bp, Homo sapiens
aaaatgctccccacagcg

SEQ ID NO: 991216 - DNA, 14 bp, Homo sapiens
aaaatgctctaatg

SEQ ID NO: 991217 - DNA, 18 bp, Homo sapiens
aaaatgctggctgagctg

SEQ ID NO: 991218 - DNA, 13 bp, Homo sapiens
aaaatgcttttta

SEQ ID NO: 991219 - DNA, 19 bp, Homo sapiens
aaaatgctttttatttctg

SEQ ID NO: 991220 - DNA, 15 bp, Homo sapiens
aaaatggaaaaaaac

SEQ ID NO: 991221 - DNA, 18 bp, Homo sapiens
aaaatggaaaagagagat

SEQ ID NO: 991222 - DNA, 15 bp, Homo sapiens
aaaatggaagcaaag

SEQ ID NO: 991223 - DNA, 16 bp, Homo sapiens
aaaatggacacaaatt

SEQ ID NO: 991224 - DNA, 17 bp, Homo sapiens
aaaatggacacaaattt

SEQ ID NO: 991225 - DNA, 22 bp, Homo sapiens
aaaatggaggccattgtgtgag

SEQ ID NO: 991226 - DNA, 13 bp, Homo sapiens
aaaatggatacat

SEQ ID NO: 991227 - DNA, 23 bp, Homo sapiens
aaaatggccatttgctttttcac

SEQ ID NO: 991228 - DNA, 19 bp, Homo sapiens
aaaatggcgaacatgtgtt

SEQ ID NO: 991229 - DNA, 18 bp, Homo sapiens
aaaatggctaataaactg

SEQ ID NO: 991230 - DNA, 21 bp, Homo sapiens
aaaatggctaataaactgtat

SEQ ID NO: 991231 - DNA, 23 bp, Homo sapiens
aaaatggctaataaactgtatta

SEQ ID NO: 991232 - DNA, 17 bp, Homo sapiens
aaaatgggaagactgag

SEQ ID NO: 991233 - DNA, 23 bp, Homo sapiens
aaaatggggtttgggcccctcag

SEQ ID NO: 991234 - DNA, 23 bp, Homo sapiens
aaaatggtcagtattatctaaat

SEQ ID NO: 991235 - DNA, 15 bp, Homo sapiens
aaaatggtctctaac

SEQ ID NO: 991236 - DNA, 20 bp, Homo sapiens
aaaatggtgttttcatgtaa

SEQ ID NO: 991237 - DNA, 16 bp, Homo sapiens
aaaatggttatgtgca

SEQ ID NO: 991238 - DNA, 16 bp, Homo sapiens
aaaatggttgatggaa

SEQ ID NO: 991239 - DNA, 20 bp, Homo sapiens
aaaatggttgatggaaaata

SEQ ID NO: 991240 - DNA, 11 bp, Homo sapiens
aaaatgtaaat

SEQ ID NO: 991241 - DNA, 12 bp, Homo sapiens
aaaatgtaaatt

SEQ ID NO: 991242 - DNA, 15 bp, Homo sapiens
aaaattaactgctcc

SEQ ID NO: 991243 - DNA, 14 bp, Homo sapiens
aaaattaagtagaa

SEQ ID NO: 991244 - DNA, 16 bp, Homo sapiens
aaaattaagtagaaca

SEQ ID NO: 991245 - DNA, 19 bp, Homo sapiens
aaaattaagtagaacaaaa

SEQ ID NO: 991246 - DNA, 19 bp, Homo sapiens
aaaattaatacattctatg

SEQ ID NO: 991247 - DNA, 21 bp, Homo sapiens
aaaattacgtttgttattcct

SEQ ID NO: 991248 - DNA, 15 bp, Homo sapiens
aaaattactaatttt

SEQ ID NO: 991249 - DNA, 18 bp, Homo sapiens
aaaattactattcttggt

SEQ ID NO: 991250 - DNA, 20 bp, Homo sapiens
aaaattagaaaggacaacag

SEQ ID NO: 991251 - DNA, 23 bp, Homo sapiens
aaaattagactgtgattcagaaa

SEQ ID NO: 991252 - DNA, 15 bp, Homo sapiens
aaaattagccaagtg

SEQ ID NO: 991253 - DNA, 18 bp, Homo sapiens
aaaattagccgggcgtgg

SEQ ID NO: 991254 - DNA, 15 bp, Homo sapiens
aaaattatactgtgt

SEQ ID NO: 991255 - DNA, 17 bp, Homo sapiens
aaaattatcaaaaagct

SEQ ID NO: 991256 - DNA, 14 bp, Homo sapiens
aaaattatggaaac

SEQ ID NO: 991257 - DNA, 15 bp, Homo sapiens
aaaattatggaaaca

SEQ ID NO: 991258 - DNA, 17 bp, Homo sapiens
aaaattatggaaacaga

SEQ ID NO: 991259 - DNA, 13 bp, Homo sapiens
aaaattatttaaa

SEQ ID NO: 991260 - DNA, 17 bp, Homo sapiens
aaaattatttgctatgg

SEQ ID NO: 991261 - DNA, 17 bp, Homo sapiens
aaaattattttaaacaa

SEQ ID NO: 991262 - DNA, 18 bp, Homo sapiens
aaaattattttaaacaaa

SEQ ID NO: 991263 - DNA, 18 bp, Homo sapiens
aaaattcaaaagtattga

SEQ ID NO: 991264 - DNA, 15 bp, Homo sapiens
aaaattcaaagcatg

SEQ ID NO: 991265 - DNA, 18 bp, Homo sapiens
aaaattcagcaaaccatt

SEQ ID NO: 991266 - DNA, 23 bp, Homo sapiens
aaaattcagtttttgtatcttgg

SEQ ID NO: 991267 - DNA, 14 bp, Homo sapiens
aaaattcatttcta

SEQ ID NO: 991268 - DNA, 12 bp, Homo sapiens
aaaattcatttg

SEQ ID NO: 991269 - DNA, 23 bp, Homo sapiens
aaaattccaaatttttttcttag

SEQ ID NO: 991270 - DNA, 16 bp, Homo sapiens
aaaattccagaaagga

SEQ ID NO: 991271 - DNA, 21 bp, Homo sapiens
aaaattccatcccatcatctt

SEQ ID NO: 991272 - DNA, 20 bp, Homo sapiens
aaaattctcagtcagtaatt

SEQ ID NO: 991273 - DNA, 23 bp, Homo sapiens
aaaattctcttaatcactactgt

SEQ ID NO: 991274 - DNA, 17 bp, Homo sapiens
aaaattctctttggtca

SEQ ID NO: 991275 - DNA, 13 bp, Homo sapiens
aaaattctgaatt

SEQ ID NO: 991276 - DNA, 21 bp, Homo sapiens
aaaattctgaattttggggat

SEQ ID NO: 991277 - DNA, 20 bp, Homo sapiens
aaaattctgtaggttctgtg

SEQ ID NO: 991278 - DNA, 14 bp, Homo sapiens
aaaattctgttgtt

SEQ ID NO: 991279 - DNA, 17 bp, Homo sapiens
aaaattctttagagatt

SEQ ID NO: 991280 - DNA, 13 bp, Homo sapiens
aaaattgaaaaaa

SEQ ID NO: 991281 - DNA, 14 bp, Homo sapiens
aaaattgaaagtat

SEQ ID NO: 991282 - DNA, 16 bp, Homo sapiens
aaaattgaaatgtaag

SEQ ID NO: 991283 - DNA, 17 bp, Homo sapiens
aaaattgaaatgtaagg

SEQ ID NO: 991284 - DNA, 14 bp, Homo sapiens
aaaattgaatgcaa

SEQ ID NO: 991285 - DNA, 21 bp, Homo sapiens
aaaattgaatgcaaaccatag

SEQ ID NO: 991286 - DNA, 18 bp, Homo sapiens
aaaattgacttagatatt

SEQ ID NO: 991287 - DNA, 15 bp, Homo sapiens
aaaattgatagaaga

SEQ ID NO: 991288 - DNA, 13 bp, Homo sapiens
aaaattgatttct

SEQ ID NO: 991289 - DNA, 20 bp, Homo sapiens
aaaattgatttttctcttca

SEQ ID NO: 991290 - DNA, 21 bp, Homo sapiens
aaaattgatttttctcttcat

SEQ ID NO: 991291 - DNA, 13 bp, Homo sapiens
aaaattgcatgaa

SEQ ID NO: 991292 - DNA, 20 bp, Homo sapiens
aaaattgtattgaaaacact

SEQ ID NO: 991293 - DNA, 20 bp, Homo sapiens
aaaattgtctaaaatgtcag

SEQ ID NO: 991294 - DNA, 22 bp, Homo sapiens
aaaattgtgatgttttgttcaa

SEQ ID NO: 991295 - DNA, 14 bp, Homo sapiens
aaaattgttctact

SEQ ID NO: 991296 - DNA, 13 bp, Homo sapiens
aaaattgtttctt

SEQ ID NO: 991297 - DNA, 15 bp, Homo sapiens
aaaattgttttcact

SEQ ID NO: 991298 - DNA, 16 bp, Homo sapiens
aaaattgttttcactt

SEQ ID NO: 991299 - DNA, 19 bp, Homo sapiens
aaaattgttttcacttgta

SEQ ID NO: 991300 - DNA, 17 bp, Homo sapiens
aaaatttaaaagtaaaa

SEQ ID NO: 991301 - DNA, 16 bp, Homo sapiens
aaaatttaaaattacg

SEQ ID NO: 991302 - DNA, 22 bp, Homo sapiens
aaaatttaaagggtgtacttat

SEQ ID NO: 991303 - DNA, 15 bp, Homo sapiens
aaaatttaagcattg

SEQ ID NO: 991304 - DNA, 20 bp, Homo sapiens
aaaatttcataattctgaaa

SEQ ID NO: 991305 - DNA, 20 bp, Homo sapiens
aaaatttggtgcttataaga

SEQ ID NO: 991306 - DNA, 22 bp, Homo sapiens
aaaatttgtctgaaacatttca

SEQ ID NO: 991307 - DNA, 21 bp, Homo sapiens
aaaatttgtgtgcttctgctc

SEQ ID NO: 991308 - DNA, 19 bp, Homo sapiens
aaaatttgttcttgtattt

SEQ ID NO: 991309 - DNA, 13 bp, Homo sapiens
aaaatttgttgca

SEQ ID NO: 991310 - DNA, 22 bp, Homo sapiens
aaaatttgttttgacggatgat

SEQ ID NO: 991311 - DNA, 10 bp, Homo sapiens
aaaattttaa

SEQ ID NO: 991312 - DNA, 15 bp, Homo sapiens
aaaattttaaaaagt

SEQ ID NO: 991313 - DNA, 12 bp, Homo sapiens
aaaattttagct

SEQ ID NO: 991314 - DNA, 14 bp, Homo sapiens
aaaattttatagct

SEQ ID NO: 991315 - DNA, 19 bp, Homo sapiens
aaaattttctcattttctt

SEQ ID NO: 991316 - DNA, 16 bp, Homo sapiens
aaaattttgcttttaa

SEQ ID NO: 991317 - DNA, 21 bp, Homo sapiens
aaaatttttacaaaactgcca

SEQ ID NO: 991318 - DNA, 15 bp, Homo sapiens
aaaatttttacattc

SEQ ID NO: 991319 - DNA, 17 bp, Homo sapiens
aaaatttttataaatta

SEQ ID NO: 991320 - DNA, 21 bp, Homo sapiens
aaacctgttgaagattatttc

SEQ ID NO: 991321 - DNA, 19 bp, Homo sapiens
aaaccttaatatttcttca

SEQ ID NO: 991322 - DNA, 23 bp, Homo sapiens
aaaccttaatatttcttcaaata

SEQ ID NO: 991323 - DNA, 17 bp, Homo sapiens
aaaccttattgtacctc

SEQ ID NO: 991324 - DNA, 19 bp, Homo sapiens
aaaccttattttttcccaa

SEQ ID NO: 991325 - DNA, 13 bp, Homo sapiens
aaaccttgaacag

SEQ ID NO: 991326 - DNA, 16 bp, Homo sapiens
aaaccttgaaggtctg

SEQ ID NO: 991327 - DNA, 17 bp, Homo sapiens
aaaccttggagaggaga

SEQ ID NO: 991328 - DNA, 11 bp, Homo sapiens
aaaccttgggc

SEQ ID NO: 991329 - DNA, 15 bp, Homo sapiens
aaaccttgttctatt

SEQ ID NO: 991330 - DNA, 22 bp, Homo sapiens
aaaccttgttctatttttcaat

SEQ ID NO: 991331 - DNA, 13 bp, Homo sapiens
aaacctttaatga

SEQ ID NO: 991332 - DNA, 17 bp, Homo sapiens
aaacctttagggcagct

SEQ ID NO: 991333 - DNA, 18 bp, Homo sapiens
aaacctttctggcctgtt

SEQ ID NO: 991334 - DNA, 17 bp, Homo sapiens
aaacctttcttcaccaa

SEQ ID NO: 991335 - DNA, 16 bp, Homo sapiens
aaaccttttcttgtat

SEQ ID NO: 991336 - DNA, 20 bp, Homo sapiens
aaaccttttggaaaatctgc

SEQ ID NO: 991337 - DNA, 17 bp, Homo sapiens
aaacgactcaaaatgac

SEQ ID NO: 991338 - DNA, 19 bp, Homo sapiens
aaacgagtcaatcccctca

SEQ ID NO: 991339 - DNA, 13 bp, Homo sapiens
aaacgcagacact

SEQ ID NO: 991340 - DNA, 20 bp, Homo sapiens
aaacgcatggagtgtgtatt

SEQ ID NO: 991341 - DNA, 20 bp, Homo sapiens
aaacgcctcttttccctctc

SEQ ID NO: 991342 - DNA, 16 bp, Homo sapiens
aaacgcgtctgcctgg

SEQ ID NO: 991343 - DNA, 16 bp, Homo sapiens
aaacgctacctctctg

SEQ ID NO: 991344 - DNA, 20 bp, Homo sapiens
aaacgggaacatgccccctg

SEQ ID NO: 991345 - DNA, 15 bp, Homo sapiens
aaacgggctcagcaa

SEQ ID NO: 991346 - DNA, 19 bp, Homo sapiens
aaacggtatcctccctgcc

SEQ ID NO: 991347 - DNA, 17 bp, Homo sapiens
aaacgtatgcatgtgaa

SEQ ID NO: 991348 - DNA, 15 bp, Homo sapiens
aaacgtattcagagt

SEQ ID NO: 991349 - DNA, 15 bp, Homo sapiens
aaacgtctattttgt

SEQ ID NO: 991350 - DNA, 17 bp, Homo sapiens
aaacgtgatgttttgaa

SEQ ID NO: 991351 - DNA, 21 bp, Homo sapiens
aaacgtgatgttttgaatgtg

SEQ ID NO: 991352 - DNA, 22 bp, Homo sapiens
aaacgtgatgttttgaatgtgg

SEQ ID NO: 991353 - DNA, 23 bp, Homo sapiens
aaacgtgatgttttgaatgtgga

SEQ ID NO: 991354 - DNA, 22 bp, Homo sapiens
aaacgtggattttaaaaaatca

SEQ ID NO: 991355 - DNA, 23 bp, Homo sapiens
aaacgtggattttaaaaaatcaa

SEQ ID NO: 991356 - DNA, 19 bp, Homo sapiens
aaacgtggtcaccttcgag

SEQ ID NO: 991357 - DNA, 23 bp, Homo sapiens
aaacgtgttgtatctacagtaat

SEQ ID NO: 991358 - DNA, 21 bp, Homo sapiens
aaacgttttattgtgttttta

SEQ ID NO: 991359 - DNA, 16 bp, Homo sapiens
aaacgttttgtatagt

SEQ ID NO: 991360 - DNA, 17 bp, Homo sapiens
aaactaaaaaattaaac

SEQ ID NO: 991361 - DNA, 17 bp, Homo sapiens
aaactaaacagaaaact

SEQ ID NO: 991362 - DNA, 14 bp, Homo sapiens
aaactaaataatga

SEQ ID NO: 991363 - DNA, 18 bp, Homo sapiens
aaactaaatctctaatat

SEQ ID NO: 991364 - DNA, 15 bp, Homo sapiens
aaactaaattactgt

SEQ ID NO: 991365 - DNA, 22 bp, Homo sapiens
aaactaagagacagttctctgt

SEQ ID NO: 991366 - DNA, 16 bp, Homo sapiens
aaactaagatctgtta

SEQ ID NO: 991367 - DNA, 16 bp, Homo sapiens
aaactaagattctttt

SEQ ID NO: 991368 - DNA, 16 bp, Homo sapiens
aaactaatattttatg

SEQ ID NO: 991369 - DNA, 18 bp, Homo sapiens
aaactaatcaccatattg

SEQ ID NO: 991370 - DNA, 15 bp, Homo sapiens
aaactgtatttaagg

SEQ ID NO: 991371 - DNA, 14 bp, Homo sapiens
aaactgtctgtctc

SEQ ID NO: 991372 - DNA, 17 bp, Homo sapiens
aaactgtgaaaatagtg

SEQ ID NO: 991373 - DNA, 17 bp, Homo sapiens
aaactgtgcaacttttt

SEQ ID NO: 991374 - DNA, 10 bp, Homo sapiens
aaactgtgta

SEQ ID NO: 991375 - DNA, 19 bp, Homo sapiens
aaactgtgtatcattaaaa

SEQ ID NO: 991376 - DNA, 16 bp, Homo sapiens
aaactgtgtattccaa

SEQ ID NO: 991377 - DNA, 19 bp, Homo sapiens
aaactgtgtattccaagac

SEQ ID NO: 991378 - DNA, 20 bp, Homo sapiens
aaactgtgtggactgtgatg

SEQ ID NO: 991379 - DNA, 17 bp, Homo sapiens
aaactgtgttgccacag

SEQ ID NO: 991380 - DNA, 12 bp, Homo sapiens
aaactgttagca

SEQ ID NO: 991381 - DNA, 22 bp, Homo sapiens
aaactgttagcactgttgatgt

SEQ ID NO: 991382 - DNA, 16 bp, Homo sapiens
aaactgttcttttgca

SEQ ID NO: 991383 - DNA, 19 bp, Homo sapiens
aaactgttggaatggattt

SEQ ID NO: 991384 - DNA, 12 bp, Homo sapiens
aaactgtttgtt

SEQ ID NO: 991385 - DNA, 20 bp, Homo sapiens
aaacttaaaagtattcatac

SEQ ID NO: 991386 - DNA, 13 bp, Homo sapiens
aaacttaaagcaa

SEQ ID NO: 991387 - DNA, 18 bp, Homo sapiens
aaacttaaagcaaaatag

SEQ ID NO: 991388 - DNA, 15 bp, Homo sapiens
aaacttaagggcaag

SEQ ID NO: 991389 - DNA, 14 bp, Homo sapiens
aaacttacacacaa

SEQ ID NO: 991390 - DNA, 19 bp, Homo sapiens
aaacttaccaattgatgtt

SEQ ID NO: 991391 - DNA, 21 bp, Homo sapiens
aaacttaccaattgatgtttt

SEQ ID NO: 991392 - DNA, 22 bp, Homo sapiens
aaacttaccaattgatgtttta

SEQ ID NO: 991393 - DNA, 14 bp, Homo sapiens
aaacttactatttt

SEQ ID NO: 991394 - DNA, 13 bp, Homo sapiens
aaacttagaggaa

SEQ ID NO: 991395 - DNA, 15 bp, Homo sapiens
aaacttagaggaaaa

SEQ ID NO: 991396 - DNA, 17 bp, Homo sapiens
aaacttagtgacaaaat

SEQ ID NO: 991397 - DNA, 21 bp, Homo sapiens
aaacttagtgcggacaagttt

SEQ ID NO: 991398 - DNA, 14 bp, Homo sapiens
aaacttattttatc

SEQ ID NO: 991399 - DNA, 12 bp, Homo sapiens
aaacttcaaagc

SEQ ID NO: 991400 - DNA, 15 bp, Homo sapiens
aaacttcaaagctga

SEQ ID NO: 991401 - DNA, 17 bp, Homo sapiens
aaacttcaaagctgaat

SEQ ID NO: 991402 - DNA, 18 bp, Homo sapiens
aaacttcaaagctgaata

SEQ ID NO: 991403 - DNA, 23 bp, Homo sapiens
aaacttcaaagctgaatattttt

SEQ ID NO: 991404 - DNA, 12 bp, Homo sapiens
aaacttcagaag

SEQ ID NO: 991405 - DNA, 20 bp, Homo sapiens
aaacttcagaagcaaacaat

SEQ ID NO: 991406 - DNA, 20 bp, Homo sapiens
aaacttcatgtaattttatt

SEQ ID NO: 991407 - DNA, 17 bp, Homo sapiens
aaacttccaaacagtgt

SEQ ID NO: 991408 - DNA, 23 bp, Homo sapiens
aaacttccatgaggccaaacgtt

SEQ ID NO: 991409 - DNA, 17 bp, Homo sapiens
aaacttccccatcttct

SEQ ID NO: 991410 - DNA, 23 bp, Homo sapiens
aaacttcccgtcccatatcctgc

SEQ ID NO: 991411 - DNA, 19 bp, Homo sapiens
aaacttctcctgaatgcat

SEQ ID NO: 991412 - DNA, 11 bp, Homo sapiens
aaacttctgaa

SEQ ID NO: 991413 - DNA, 13 bp, Homo sapiens
aaacttgaaaata

SEQ ID NO: 991414 - DNA, 11 bp, Homo sapiens
aaacttgaaat

SEQ ID NO: 991415 - DNA, 20 bp, Homo sapiens
aaacttgaaatatataatat

SEQ ID NO: 991416 - DNA, 12 bp, Homo sapiens
aaacttgaactc

SEQ ID NO: 991417 - DNA, 15 bp, Homo sapiens
aaacttgaagcagtc

SEQ ID NO: 991418 - DNA, 19 bp, Homo sapiens
aaacttgcatcacttaacg

SEQ ID NO: 991419 - DNA, 20 bp, Homo sapiens
aaacttggacccttggaaaa

SEQ ID NO: 991420 - DNA, 17 bp, Homo sapiens
aaacttggatggacttg

SEQ ID NO: 991421 - DNA, 15 bp, Homo sapiens
aaacttggattctct

SEQ ID NO: 991422 - DNA, 16 bp, Homo sapiens
aaacttggctggaatt

SEQ ID NO: 991423 - DNA, 20 bp, Homo sapiens
aaacttggctggaatttctg

SEQ ID NO: 991424 - DNA, 20 bp, Homo sapiens
aaacttggtgcttattgata

SEQ ID NO: 991425 - DNA, 12 bp, Homo sapiens
aaacttgtaaat

SEQ ID NO: 991426 - DNA, 13 bp, Homo sapiens
aaacttgtcagaa

SEQ ID NO: 991427 - DNA, 22 bp, Homo sapiens
aaacttgttattgtgaatgatt

SEQ ID NO: 991428 - DNA, 14 bp, Homo sapiens
aaacttgttcattt

SEQ ID NO: 991429 - DNA, 17 bp, Homo sapiens
aaactttacctttttta

SEQ ID NO: 991430 - DNA, 12 bp, Homo sapiens
aaactttactat

SEQ ID NO: 991431 - DNA, 21 bp, Homo sapiens
aaactttagagtagcatgaga

SEQ ID NO: 991432 - DNA, 15 bp, Homo sapiens
aaactttatcactta

SEQ ID NO: 991433 - DNA, 21 bp, Homo sapiens
aaactttatttaaatgcatgt

SEQ ID NO: 991434 - DNA, 22 bp, Homo sapiens
aaactttatttaaatgcatgtc

SEQ ID NO: 991435 - DNA, 21 bp, Homo sapiens
aaactttattttatataataa

SEQ ID NO: 991436 - DNA, 13 bp, Homo sapiens
aaactttcacttt

SEQ ID NO: 991437 - DNA, 15 bp, Homo sapiens
aaactttctccattt

SEQ ID NO: 991438 - DNA, 18 bp, Homo sapiens
aaactttctccatttaag

SEQ ID NO: 991439 - DNA, 15 bp, Homo sapiens
aaactttgattcttt

SEQ ID NO: 991440 - DNA, 16 bp, Homo sapiens
aaactttgtgcctttg

SEQ ID NO: 991441 - DNA, 13 bp, Homo sapiens
aaacttttaactg

SEQ ID NO: 991442 - DNA, 19 bp, Homo sapiens
aaacttttaggttgttacc

SEQ ID NO: 991443 - DNA, 12 bp, Homo sapiens
aaacttttctag

SEQ ID NO: 991444 - DNA, 13 bp, Homo sapiens
aaacttttctaga

SEQ ID NO: 991445 - DNA, 20 bp, Homo sapiens
aaacttttctttcttttctt

SEQ ID NO: 991446 - DNA, 12 bp, Homo sapiens
aaacttttgtaa

SEQ ID NO: 991447 - DNA, 20 bp, Homo sapiens
aaacttttgtttaaagcatt

SEQ ID NO: 991448 - DNA, 20 bp, Homo sapiens
aaactttttccagcaaaatg

SEQ ID NO: 991449 - DNA, 24 bp, Homo sapiens
aaacttttttgaaataataaatct

SEQ ID NO: 991450 - DNA, 15 bp, Homo sapiens
aaactttttttctgt

SEQ ID NO: 991451 - DNA, 19 bp, Homo sapiens
aaactttttttctgtacca

SEQ ID NO: 991452 - DNA, 23 bp, Homo sapiens
aaactttttttctgtaccagtta

SEQ ID NO: 991453 - DNA, 21 bp, Homo sapiens
aaagaaaaaaaaaaaagccag

SEQ ID NO: 991454 - DNA, 12 bp, Homo sapiens
aaagttaacatt

SEQ ID NO: 991455 - DNA, 20 bp, Homo sapiens
aaagttaataacagctcctt

SEQ ID NO: 991456 - DNA, 16 bp, Homo sapiens
aaagttactactgatt

SEQ ID NO: 991457 - DNA, 15 bp, Homo sapiens
aaagttactaggtaa

SEQ ID NO: 991458 - DNA, 20 bp, Homo sapiens
aaagttactaggtaacttca

SEQ ID NO: 991459 - DNA, 18 bp, Homo sapiens
aaagttagtatcttttga

SEQ ID NO: 991460 - DNA, 21 bp, Homo sapiens
aaagttagtatcttttgatat

SEQ ID NO: 991461 - DNA, 18 bp, Homo sapiens
aaagttataataactgaa

SEQ ID NO: 991462 - DNA, 19 bp, Homo sapiens
aaagttataataactgaac

SEQ ID NO: 991463 - DNA, 18 bp, Homo sapiens
aaagttattagtggttta

SEQ ID NO: 991464 - DNA, 18 bp, Homo sapiens
aaagttccctgaaacacg

SEQ ID NO: 991465 - DNA, 22 bp, Homo sapiens
aaagttcctctcccttcccttc

SEQ ID NO: 991466 - DNA, 12 bp, Homo sapiens
aaagttccttaa

SEQ ID NO: 991467 - DNA, 15 bp, Homo sapiens
aaagttctcagagct

SEQ ID NO: 991468 - DNA, 12 bp, Homo sapiens
aaagttgaaatt

SEQ ID NO: 991469 - DNA, 20 bp, Homo sapiens
aaagttgagggaaagagctt

SEQ ID NO: 991470 - DNA, 17 bp, Homo sapiens
aaagttgattttgaact

SEQ ID NO: 991471 - DNA, 18 bp, Homo sapiens
aaagttgattttgaactt

SEQ ID NO: 991472 - DNA, 15 bp, Homo sapiens
aaagttgcaaggcaa

SEQ ID NO: 991473 - DNA, 12 bp, Homo sapiens
aaagttgcagat

SEQ ID NO: 991474 - DNA, 13 bp, Homo sapiens
aaagttgcagatg

SEQ ID NO: 991475 - DNA, 17 bp, Homo sapiens
aaagttgcagatgtatt

SEQ ID NO: 991476 - DNA, 18 bp, Homo sapiens
aaagttgcagatgtattg

SEQ ID NO: 991477 - DNA, 19 bp, Homo sapiens
aaagttgcagatgtattga

SEQ ID NO: 991478 - DNA, 17 bp, Homo sapiens
aaagttgcagctgtttt

SEQ ID NO: 991479 - DNA, 19 bp, Homo sapiens
aaagttgcagctgttttgt

SEQ ID NO: 991480 - DNA, 12 bp, Homo sapiens
aaagttgctttt

SEQ ID NO: 991481 - DNA, 16 bp, Homo sapiens
aaagttggccatgtat

SEQ ID NO: 991482 - DNA, 17 bp, Homo sapiens
aaagttggtattaataa

SEQ ID NO: 991483 - DNA, 20 bp, Homo sapiens
aaagttgtaaataattttct

SEQ ID NO: 991484 - DNA, 21 bp, Homo sapiens
aaagttgtaaataattttcta

SEQ ID NO: 991485 - DNA, 18 bp, Homo sapiens
aaagttgtgattccagat

SEQ ID NO: 991486 - DNA, 12 bp, Homo sapiens
aaagtttacaac

SEQ ID NO: 991487 - DNA, 16 bp, Homo sapiens
aaagtttacaacataa

SEQ ID NO: 991488 - DNA, 18 bp, Homo sapiens
aaagtttacaacttgatt

SEQ ID NO: 991489 - DNA, 19 bp, Homo sapiens
aaagtttacattgtcctgt

SEQ ID NO: 991490 - DNA, 21 bp, Homo sapiens
aaagtttagatctagaagctg

SEQ ID NO: 991491 - DNA, 21 bp, Homo sapiens
aaagtttcgacttatttctta

SEQ ID NO: 991492 - DNA, 15 bp, Homo sapiens
aaagtttgccagaag

SEQ ID NO: 991493 - DNA, 15 bp, Homo sapiens
aaagtttgcttagaa

SEQ ID NO: 991494 - DNA, 13 bp, Homo sapiens
aaagtttgtgtgt

SEQ ID NO: 991495 - DNA, 15 bp, Homo sapiens
aaagtttgttcactt

SEQ ID NO: 991496 - DNA, 13 bp, Homo sapiens
aaagtttgttgaa

SEQ ID NO: 991497 - DNA, 13 bp, Homo sapiens
aaagttttacaga

SEQ ID NO: 991498 - DNA, 15 bp, Homo sapiens
aaagttttacagaga

SEQ ID NO: 991499 - DNA, 16 bp, Homo sapiens
aaagttttatttttct

SEQ ID NO: 991500 - DNA, 18 bp, Homo sapiens
aaagttttccagtattga

SEQ ID NO: 991501 - DNA, 21 bp, Homo sapiens
aaagttttgatgaaattcttg

SEQ ID NO: 991502 - DNA, 15 bp, Homo sapiens
aaagttttgatttga

SEQ ID NO: 991503 - DNA, 23 bp, Homo sapiens
aaagttttgatttgaatgtaaaa

SEQ ID NO: 991504 - DNA, 17 bp, Homo sapiens
aaataaaaaaagatttt

SEQ ID NO: 991505 - DNA, 19 bp, Homo sapiens
aaataaaaagaaaggctgt

SEQ ID NO: 991506 - DNA, 20 bp, Homo sapiens
aaataaaaagaaaggctgtt

SEQ ID NO: 991507 - DNA, 12 bp, Homo sapiens
aaataaaaagag

SEQ ID NO: 991508 - DNA, 22 bp, Homo sapiens
aaataaaaagtatgttgtacat

SEQ ID NO: 991509 - DNA, 15 bp, Homo sapiens
aaataaaaagtgaca

SEQ ID NO: 991510 - DNA, 14 bp, Homo sapiens
aaataaaaataata

SEQ ID NO: 991511 - DNA, 22 bp, Homo sapiens
aaataaaaatcaacttgtgtac

SEQ ID NO: 991512 - DNA, 13 bp, Homo sapiens
aaataaaacaagc

SEQ ID NO: 991513 - DNA, 17 bp, Homo sapiens
aaataaaacaagcctta

SEQ ID NO: 991514 - DNA, 19 bp, Homo sapiens
aaataaaacaagccttaat

SEQ ID NO: 991515 - DNA, 18 bp, Homo sapiens
aaataaaacacacctcgt

SEQ ID NO: 991516 - DNA, 16 bp, Homo sapiens
aaataaaacatagcaa

SEQ ID NO: 991517 - DNA, 14 bp, Homo sapiens
aaataaaacctttc

SEQ ID NO: 991518 - DNA, 12 bp, Homo sapiens
aaataaaactat

SEQ ID NO: 991519 - DNA, 15 bp, Homo sapiens
aaataaaactattta

SEQ ID NO: 991520 - DNA, 11 bp, Homo sapiens
aaataaaagca

SEQ ID NO: 991521 - DNA, 12 bp, Homo sapiens
aaataaaagcac

SEQ ID NO: 991522 - DNA, 13 bp, Homo sapiens
aaataaaataacc

SEQ ID NO: 991523 - DNA, 12 bp, Homo sapiens
aaataaaatcag

SEQ ID NO: 991524 - DNA, 14 bp, Homo sapiens
aaataaaatgcctc

SEQ ID NO: 991525 - DNA, 14 bp, Homo sapiens
aaataaaatgtttc

SEQ ID NO: 991526 - DNA, 19 bp, Homo sapiens
aaataaaatttgttgcata

SEQ ID NO: 991527 - DNA, 18 bp, Homo sapiens
aaataaacaaataacaat

SEQ ID NO: 991528 - DNA, 21 bp, Homo sapiens
aaataaacacatagattcacc

SEQ ID NO: 991529 - DNA, 15 bp, Homo sapiens
aaataaacagttgtt

SEQ ID NO: 991530 - DNA, 19 bp, Homo sapiens
aaataaacagttgttactt

SEQ ID NO: 991531 - DNA, 18 bp, Homo sapiens
aaataaacatcagtttct

SEQ ID NO: 991532 - DNA, 22 bp, Homo sapiens
aaataaaccaaaggaaaatgtc

SEQ ID NO: 991533 - DNA, 13 bp, Homo sapiens
aaataaaccactg

SEQ ID NO: 991534 - DNA, 19 bp, Homo sapiens
aaataaacctataatattt

SEQ ID NO: 991535 - DNA, 14 bp, Homo sapiens
aaataaactgtttt

SEQ ID NO: 991536 - DNA, 15 bp, Homo sapiens
aaataaactgttttc

SEQ ID NO: 991537 - DNA, 16 bp, Homo sapiens
aaataaactgttttca

SEQ ID NO: 991538 - DNA, 12 bp, Homo sapiens
aaataaacttct

SEQ ID NO: 991539 - DNA, 11 bp, Homo sapiens
aaataaagaag

SEQ ID NO: 991540 - DNA, 11 bp, Homo sapiens
aaataaagacc

SEQ ID NO: 991541 - DNA, 11 bp, Homo sapiens
aaataaagcct

SEQ ID NO: 991542 - DNA, 13 bp, Homo sapiens
aaataaagccttt

SEQ ID NO: 991543 - DNA, 13 bp, Homo sapiens
aaataaaggtaca

SEQ ID NO: 991544 - DNA, 13 bp, Homo sapiens
aaataaagtatat

SEQ ID NO: 991545 - DNA, 16 bp, Homo sapiens
aaataaagtatatata

SEQ ID NO: 991546 - DNA, 19 bp, Homo sapiens
aaataaagttggtcttttg

SEQ ID NO: 991547 - DNA, 13 bp, Homo sapiens
aaataaataattt

SEQ ID NO: 991548 - DNA, 14 bp, Homo sapiens
aaataaataatttt

SEQ ID NO: 991549 - DNA, 15 bp, Homo sapiens
aaataaatatactca

SEQ ID NO: 991550 - DNA, 13 bp, Homo sapiens
aaataaatatttt

SEQ ID NO: 991551 - DNA, 21 bp, Homo sapiens
aaataaatcatcctcatgtcc

SEQ ID NO: 991552 - DNA, 19 bp, Homo sapiens
aaataaatcttagtgttca

SEQ ID NO: 991553 - DNA, 12 bp, Homo sapiens
aaataaatgtac

SEQ ID NO: 991554 - DNA, 16 bp, Homo sapiens
aaataaatgtatcata

SEQ ID NO: 991555 - DNA, 17 bp, Homo sapiens
aaataaatgtcactgcc

SEQ ID NO: 991556 - DNA, 13 bp, Homo sapiens
aaataaattaaga

SEQ ID NO: 991557 - DNA, 17 bp, Homo sapiens
aaataaattagttgtta

SEQ ID NO: 991558 - DNA, 12 bp, Homo sapiens
aaataaatttct

SEQ ID NO: 991559 - DNA, 16 bp, Homo sapiens
aaataaatttctggga

SEQ ID NO: 991560 - DNA, 14 bp, Homo sapiens
aaataaatttgact

SEQ ID NO: 991561 - DNA, 19 bp, Homo sapiens
aaataaatttggttctaat

SEQ ID NO: 991562 - DNA, 13 bp, Homo sapiens
aaataacacagat

SEQ ID NO: 991563 - DNA, 18 bp, Homo sapiens
aaataacacagatattgt

SEQ ID NO: 991564 - DNA, 16 bp, Homo sapiens
aaataacattctgaat

SEQ ID NO: 991565 - DNA, 22 bp, Homo sapiens
aaataacctctggcccttggaa

SEQ ID NO: 991566 - DNA, 12 bp, Homo sapiens
aaataactattt

SEQ ID NO: 991567 - DNA, 15 bp, Homo sapiens
aaataactattttgt

SEQ ID NO: 991568 - DNA, 19 bp, Homo sapiens
aaataactattttgtttta

SEQ ID NO: 991569 - DNA, 20 bp, Homo sapiens
aaataactattttgttttaa

SEQ ID NO: 991570 - DNA, 21 bp, Homo sapiens
aaataactattttgttttaat

SEQ ID NO: 991571 - DNA, 14 bp, Homo sapiens
aaataactgaattt

SEQ ID NO: 991572 - DNA, 15 bp, Homo sapiens
aaataactgaatttg

SEQ ID NO: 991573 - DNA, 16 bp, Homo sapiens
aaataactggaaaaca

SEQ ID NO: 991574 - DNA, 19 bp, Homo sapiens
aaataactggaaaacagaa

SEQ ID NO: 991575 - DNA, 12 bp, Homo sapiens
aaataagaaact

SEQ ID NO: 991576 - DNA, 18 bp, Homo sapiens
aaataagctcgagtgaat

SEQ ID NO: 991577 - DNA, 22 bp, Homo sapiens
aaataaggaagagggctgagct

SEQ ID NO: 991578 - DNA, 17 bp, Homo sapiens
aaataagtatttataat

SEQ ID NO: 991579 - DNA, 14 bp, Homo sapiens
aaataagtcaacag

SEQ ID NO: 991580 - DNA, 14 bp, Homo sapiens
aaataagtgtattt

SEQ ID NO: 991581 - DNA, 20 bp, Homo sapiens
aaataagtgtattttgaaat

SEQ ID NO: 991582 - DNA, 12 bp, Homo sapiens
aaataagttaaa

SEQ ID NO: 991583 - DNA, 16 bp, Homo sapiens
aaataagtttttgttt

SEQ ID NO: 991584 - DNA, 14 bp, Homo sapiens
aaataataaaatgc

SEQ ID NO: 991585 - DNA, 15 bp, Homo sapiens
aaataataaaatgca

SEQ ID NO: 991586 - DNA, 16 bp, Homo sapiens
aaataataaaatgcaa

SEQ ID NO: 991587 - DNA, 20 bp, Homo sapiens
aaataataaaatgcaaatga

SEQ ID NO: 991588 - DNA, 15 bp, Homo sapiens
aaataataataatgt

SEQ ID NO: 991589 - DNA, 14 bp, Homo sapiens
aaataatagggaaa

SEQ ID NO: 991590 - DNA, 14 bp, Homo sapiens
aaataatatgcatt

SEQ ID NO: 991591 - DNA, 14 bp, Homo sapiens
aaataatcaaaagc

SEQ ID NO: 991592 - DNA, 15 bp, Homo sapiens
aaataatcaaaagct

SEQ ID NO: 991593 - DNA, 21 bp, Homo sapiens
aaataatccattccaaaatac

SEQ ID NO: 991594 - DNA, 13 bp, Homo sapiens
aaataatctattt

SEQ ID NO: 991595 - DNA, 23 bp, Homo sapiens
aaataatctatttctatgagaaa

SEQ ID NO: 991596 - DNA, 13 bp, Homo sapiens
aaataatgcattt

SEQ ID NO: 991597 - DNA, 21 bp, Homo sapiens
aaataatgcttcagatattat

SEQ ID NO: 991598 - DNA, 12 bp, Homo sapiens
aaataatggaaa

SEQ ID NO: 991599 - DNA, 20 bp, Homo sapiens
aaataatggaaaaatagtaa

SEQ ID NO: 991600 - DNA, 18 bp, Homo sapiens
aaataatgtaattgtaat

SEQ ID NO: 991601 - DNA, 14 bp, Homo sapiens
aaataatgtgaaac

SEQ ID NO: 991602 - DNA, 18 bp, Homo sapiens
aaataatgttctgtcacg

SEQ ID NO: 991603 - DNA, 16 bp, Homo sapiens
aaataattaaatctct

SEQ ID NO: 991604 - DNA, 15 bp, Homo sapiens
aaataatttgtgtct

SEQ ID NO: 991605 - DNA, 17 bp, Homo sapiens
aaataatttgtgtctgt

SEQ ID NO: 991606 - DNA, 12 bp, Homo sapiens
aaataattttaa

SEQ ID NO: 991607 - DNA, 14 bp, Homo sapiens
aaataattttaaac

SEQ ID NO: 991608 - DNA, 19 bp, Homo sapiens
aaataattttaaataacct

SEQ ID NO: 991609 - DNA, 23 bp, Homo sapiens
aaataattttaaataacctctgg

SEQ ID NO: 991610 - DNA, 15 bp, Homo sapiens
aaataattttccaag

SEQ ID NO: 991611 - DNA, 23 bp, Homo sapiens
aaataattttccaagtaaagtga

SEQ ID NO: 991612 - DNA, 14 bp, Homo sapiens
aaataattttgtaa

SEQ ID NO: 991613 - DNA, 12 bp, Homo sapiens
aaataattttta

SEQ ID NO: 991614 - DNA, 20 bp, Homo sapiens
aaataatttttaacttttgg

SEQ ID NO: 991615 - DNA, 22 bp, Homo sapiens
aaataatttttaacttttggaa

SEQ ID NO: 991616 - DNA, 17 bp, Homo sapiens
aaatacaaaaaattagc

SEQ ID NO: 991617 - DNA, 14 bp, Homo sapiens
aaatacaagactgc

SEQ ID NO: 991618 - DNA, 14 bp, Homo sapiens
aaatacaataaact

SEQ ID NO: 991619 - DNA, 15 bp, Homo sapiens
aaatacaataaacta

SEQ ID NO: 991620 - DNA, 22 bp, Homo sapiens
aaatacaataaactattggaaa

SEQ ID NO: 991621 - DNA, 18 bp, Homo sapiens
aaatacaatgttatcaac

SEQ ID NO: 991622 - DNA, 23 bp, Homo sapiens
aaatacaatgttatcaaccaact

SEQ ID NO: 991623 - DNA, 20 bp, Homo sapiens
aaatacaatttttatttctt

SEQ ID NO: 991624 - DNA, 21 bp, Homo sapiens
aaatacaccacctcactcctg

SEQ ID NO: 991625 - DNA, 23 bp, Homo sapiens
aaatacaccacctcactcctgtt

SEQ ID NO: 991626 - DNA, 20 bp, Homo sapiens
aaatacacgtttatcttaca

SEQ ID NO: 991627 - DNA, 18 bp, Homo sapiens
aaatacacttcttttgaa

SEQ ID NO: 991628 - DNA, 17 bp, Homo sapiens
aaatacagacactaagt

SEQ ID NO: 991629 - DNA, 15 bp, Homo sapiens
aaatacagactggat

SEQ ID NO: 991630 - DNA, 14 bp, Homo sapiens
aaatacagataatt

SEQ ID NO: 991631 - DNA, 13 bp, Homo sapiens
aaatacagctggc

SEQ ID NO: 991632 - DNA, 14 bp, Homo sapiens
aaatacagctggct

SEQ ID NO: 991633 - DNA, 14 bp, Homo sapiens
aaatacaggaaaca

SEQ ID NO: 991634 - DNA, 16 bp, Homo sapiens
aaatacaggaaacagt

SEQ ID NO: 991635 - DNA, 16 bp, Homo sapiens
aaatacatacggtcag

SEQ ID NO: 991636 - DNA, 13 bp, Homo sapiens
aaatacatgctaa

SEQ ID NO: 991637 - DNA, 16 bp, Homo sapiens
aaatacatgtacctat

SEQ ID NO: 991638 - DNA, 18 bp, Homo sapiens
aaataccagccagtaaat

SEQ ID NO: 991639 - DNA, 19 bp, Homo sapiens
aaataccagccagtaaatg

SEQ ID NO: 991640 - DNA, 20 bp, Homo sapiens
aaataccagccagtaaatgg

SEQ ID NO: 991641 - DNA, 21 bp, Homo sapiens
aaataccagtgaaccaaagag

SEQ ID NO: 991642 - DNA, 18 bp, Homo sapiens
aaataccataggaagaca

SEQ ID NO: 991643 - DNA, 21 bp, Homo sapiens
aaataccataggaagacataa

SEQ ID NO: 991644 - DNA, 17 bp, Homo sapiens
aaataccatgtctctaa

SEQ ID NO: 991645 - DNA, 14 bp, Homo sapiens
aaataccattgaaa

SEQ ID NO: 991646 - DNA, 17 bp, Homo sapiens
aaataccattgaaatca

SEQ ID NO: 991647 - DNA, 11 bp, Homo sapiens
aaatacctcaa

SEQ ID NO: 991648 - DNA, 18 bp, Homo sapiens
aaatacctcttagctgag

SEQ ID NO: 991649 - DNA, 15 bp, Homo sapiens
aaatacgttttgtgt

SEQ ID NO: 991650 - DNA, 15 bp, Homo sapiens
aaatactactcctgt

SEQ ID NO: 991651 - DNA, 15 bp, Homo sapiens
aaatactatgcagta

SEQ ID NO: 991652 - DNA, 15 bp, Homo sapiens
aaatactgcaaatca

SEQ ID NO: 991653 - DNA, 14 bp, Homo sapiens
aaatactggactca

SEQ ID NO: 991654 - DNA, 15 bp, Homo sapiens
aaatactggactcag

SEQ ID NO: 991655 - DNA, 18 bp, Homo sapiens
aaatactggactcaggaa

SEQ ID NO: 991656 - DNA, 14 bp, Homo sapiens
aaatactgtacaat

SEQ ID NO: 991657 - DNA, 19 bp, Homo sapiens
aaatactgtcaaacaataa

SEQ ID NO: 991658 - DNA, 13 bp, Homo sapiens
aaatactgtgcag

SEQ ID NO: 991659 - DNA, 21 bp, Homo sapiens
aaatactgtgcagaataatgg

SEQ ID NO: 991660 - DNA, 13 bp, Homo sapiens
aaatacttgcagt

SEQ ID NO: 991661 - DNA, 11 bp, Homo sapiens
aaatacttgtc

SEQ ID NO: 991662 - DNA, 21 bp, Homo sapiens
aaatacttgtcaatatttaaa

SEQ ID NO: 991663 - DNA, 15 bp, Homo sapiens
aaatactttaaagga

SEQ ID NO: 991664 - DNA, 17 bp, Homo sapiens
aaatactttaaaggaaa

SEQ ID NO: 991665 - DNA, 12 bp, Homo sapiens
aaatactttgtc

SEQ ID NO: 991666 - DNA, 16 bp, Homo sapiens
aaatactttttatcac

SEQ ID NO: 991667 - DNA, 20 bp, Homo sapiens
aaatactttttcagttgttt

SEQ ID NO: 991668 - DNA, 21 bp, Homo sapiens
aaatactttttcagttgttta

SEQ ID NO: 991669 - DNA, 15 bp, Homo sapiens
aaatagaaaaaaaga

SEQ ID NO: 991670 - DNA, 16 bp, Homo sapiens
aaatagaaaagttatt

SEQ ID NO: 991671 - DNA, 17 bp, Homo sapiens
aaatagaaaagttatta

SEQ ID NO: 991672 - DNA, 14 bp, Homo sapiens
aaatagaaaatggt

SEQ ID NO: 991673 - DNA, 13 bp, Homo sapiens
aaatagaataatt

SEQ ID NO: 991674 - DNA, 16 bp, Homo sapiens
aaatagaataattctt

SEQ ID NO: 991675 - DNA, 18 bp, Homo sapiens
aaatagaataattctttt

SEQ ID NO: 991676 - DNA, 19 bp, Homo sapiens
aaatagacaaaaagtatat

SEQ ID NO: 991677 - DNA, 15 bp, Homo sapiens
aaatagacagtatat

SEQ ID NO: 991678 - DNA, 12 bp, Homo sapiens
aaatagacatgt

SEQ ID NO: 991679 - DNA, 16 bp, Homo sapiens
aaatagagcaaaatca

SEQ ID NO: 991680 - DNA, 21 bp, Homo sapiens
aaatagagcaaaatcaacatg

SEQ ID NO: 991681 - DNA, 20 bp, Homo sapiens
aaatagagcttttaaaaatg

SEQ ID NO: 991682 - DNA, 17 bp, Homo sapiens
aaatagagtatatgcac

SEQ ID NO: 991683 - DNA, 18 bp, Homo sapiens
aaatagatttttgattca

SEQ ID NO: 991684 - DNA, 15 bp, Homo sapiens
aaatagcatactgtg

SEQ ID NO: 991685 - DNA, 17 bp, Homo sapiens
aaatagcatactgtgta

SEQ ID NO: 991686 - DNA, 19 bp, Homo sapiens
aaatagcatactgtgtatg

SEQ ID NO: 991687 - DNA, 21 bp, Homo sapiens
aaatagcatactgtgtatgtt

SEQ ID NO: 991688 - DNA, 12 bp, Homo sapiens
aaatagtatttc

SEQ ID NO: 991689 - DNA, 15 bp, Homo sapiens
aaatagtatttgcat

SEQ ID NO: 991690 - DNA, 16 bp, Homo sapiens
aaatagtcatttttag

SEQ ID NO: 991691 - DNA, 19 bp, Homo sapiens
aaatagtgagacttgtttg

SEQ ID NO: 991692 - DNA, 21 bp, Homo sapiens
aaatagtgcagaatctcatag

SEQ ID NO: 991693 - DNA, 19 bp, Homo sapiens
aaatagtggtgtgatttgg

SEQ ID NO: 991694 - DNA, 16 bp, Homo sapiens
aaatagtgtaagaact

SEQ ID NO: 991695 - DNA, 15 bp, Homo sapiens
aaatagtgtgaaata

SEQ ID NO: 991696 - DNA, 18 bp, Homo sapiens
aaatagtgtgaaatatat

SEQ ID NO: 991697 - DNA, 14 bp, Homo sapiens
aaatagttaatata

SEQ ID NO: 991698 - DNA, 14 bp, Homo sapiens
aaatagttcccttt

SEQ ID NO: 991699 - DNA, 20 bp, Homo sapiens
aaatagttgcatagcagtat

SEQ ID NO: 991700 - DNA, 22 bp, Homo sapiens
aaatagttgcatagcagtatat

SEQ ID NO: 991701 - DNA, 18 bp, Homo sapiens
aaatagtttaggagaaac

SEQ ID NO: 991702 - DNA, 20 bp, Homo sapiens
aaatagtttggatatgtaaa

SEQ ID NO: 991703 - DNA, 21 bp, Homo sapiens
aaatagtttggatatgtaaaa

SEQ ID NO: 991704 - DNA, 16 bp, Homo sapiens
aaatataaaactgaaa

SEQ ID NO: 991705 - DNA, 17 bp, Homo sapiens
aaatataaattgtacat

SEQ ID NO: 991706 - DNA, 17 bp, Homo sapiens
aaatataaccattacat

SEQ ID NO: 991707 - DNA, 14 bp, Homo sapiens
aaatataagaataa

SEQ ID NO: 991708 - DNA, 19 bp, Homo sapiens
aaatataagacatttgttt

SEQ ID NO: 991709 - DNA, 21 bp, Homo sapiens
aaatataagacatttgtttgc

SEQ ID NO: 991710 - DNA, 19 bp, Homo sapiens
aaatataagctgggaaaaa

SEQ ID NO: 991711 - DNA, 17 bp, Homo sapiens
aaatataaggacttttt

SEQ ID NO: 991712 - DNA, 20 bp, Homo sapiens
aaatataagtggtgcttaga

SEQ ID NO: 991713 - DNA, 13 bp, Homo sapiens
aaatataattctg

SEQ ID NO: 991714 - DNA, 17 bp, Homo sapiens
aaatataattctgtaaa

SEQ ID NO: 991715 - DNA, 14 bp, Homo sapiens
aaatataattgaca

SEQ ID NO: 991716 - DNA, 13 bp, Homo sapiens
aaatatacagttt

SEQ ID NO: 991717 - DNA, 16 bp, Homo sapiens
aaatatacagtttgac

SEQ ID NO: 991718 - DNA, 19 bp, Homo sapiens
aaatatacattttctaaat

SEQ ID NO: 991719 - DNA, 20 bp, Homo sapiens
aaatataccactctttacct

SEQ ID NO: 991720 - DNA, 22 bp, Homo sapiens
aaatatacttttacaagtaaca

SEQ ID NO: 991721 - DNA, 23 bp, Homo sapiens
aaatatacttttacaagtaacaa

SEQ ID NO: 991722 - DNA, 22 bp, Homo sapiens
aaatatagaaagttgatattca

SEQ ID NO: 991723 - DNA, 16 bp, Homo sapiens
aaatatagagacagga

SEQ ID NO: 991724 - DNA, 16 bp, Homo sapiens
aaatatagctgtacaa

SEQ ID NO: 991725 - DNA, 21 bp, Homo sapiens
aaatatagctgtacaaatata

SEQ ID NO: 991726 - DNA, 21 bp, Homo sapiens
aaatatataaaaagaaaagat

SEQ ID NO: 991727 - DNA, 16 bp, Homo sapiens
aaatatataaatatat

SEQ ID NO: 991728 - DNA, 12 bp, Homo sapiens
aaatatatacta

SEQ ID NO: 991729 - DNA, 16 bp, Homo sapiens
aaatatatactaaaca

SEQ ID NO: 991730 - DNA, 17 bp, Homo sapiens
aaatatatagcttgaaa

SEQ ID NO: 991731 - DNA, 10 bp, Homo sapiens
aaatatatat

SEQ ID NO: 991732 - DNA, 15 bp, Homo sapiens
aaatatatatacata

SEQ ID NO: 991733 - DNA, 13 bp, Homo sapiens
aaatatatatata

SEQ ID NO: 991734 - DNA, 20 bp, Homo sapiens
aaatatatatatatatttaa

SEQ ID NO: 991735 - DNA, 20 bp, Homo sapiens
aaatatatatgatcattgaa

SEQ ID NO: 991736 - DNA, 13 bp, Homo sapiens
aaatatatatgtc

SEQ ID NO: 991737 - DNA, 16 bp, Homo sapiens
aaatatatatgtcaat

SEQ ID NO: 991738 - DNA, 13 bp, Homo sapiens
aaatatatattgt

SEQ ID NO: 991739 - DNA, 15 bp, Homo sapiens
aaatatatattgtaa

SEQ ID NO: 991740 - DNA, 16 bp, Homo sapiens
aaatatatatttttca

SEQ ID NO: 991741 - DNA, 20 bp, Homo sapiens
aaatatatatttttcaaata

SEQ ID NO: 991742 - DNA, 14 bp, Homo sapiens
aaatatatgtatgt

SEQ ID NO: 991743 - DNA, 19 bp, Homo sapiens
aaatatatgtatgtaaaaa

SEQ ID NO: 991744 - DNA, 20 bp, Homo sapiens
aaatatatgtatttaaaaac

SEQ ID NO: 991745 - DNA, 12 bp, Homo sapiens
aaatatatgtct

SEQ ID NO: 991746 - DNA, 18 bp, Homo sapiens
aaatatattacttaactg

SEQ ID NO: 991747 - DNA, 10 bp, Homo sapiens
aaatatattt

SEQ ID NO: 991748 - DNA, 12 bp, Homo sapiens
aaatatatttgt

SEQ ID NO: 991749 - DNA, 12 bp, Homo sapiens
aaatatcaaagt

SEQ ID NO: 991750 - DNA, 20 bp, Homo sapiens
aaatatcagacaagcactat

SEQ ID NO: 991751 - DNA, 12 bp, Homo sapiens
aaatatcagtat

SEQ ID NO: 991752 - DNA, 21 bp, Homo sapiens
aaatatcagtattctgacatg

SEQ ID NO: 991753 - DNA, 15 bp, Homo sapiens
aaatatcataaagca

SEQ ID NO: 991754 - DNA, 21 bp, Homo sapiens
aaatatcatgttaaattagaa

SEQ ID NO: 991755 - DNA, 13 bp, Homo sapiens
aaatatcattgta

SEQ ID NO: 991756 - DNA, 18 bp, Homo sapiens
aaatatcatttatttttt

SEQ ID NO: 991757 - DNA, 15 bp, Homo sapiens
aaatatccacccagc

SEQ ID NO: 991758 - DNA, 15 bp, Homo sapiens
aaatatctctgagtt

SEQ ID NO: 991759 - DNA, 12 bp, Homo sapiens
aaatatctgaaa

SEQ ID NO: 991760 - DNA, 18 bp, Homo sapiens
aaatatctgaaaatgtat

SEQ ID NO: 991761 - DNA, 19 bp, Homo sapiens
aaatatctgaaaatgtatg

SEQ ID NO: 991762 - DNA, 14 bp, Homo sapiens
aaatatctgctcaa

SEQ ID NO: 991763 - DNA, 14 bp, Homo sapiens
aaatatcttccttt

SEQ ID NO: 991764 - DNA, 15 bp, Homo sapiens
aaatatcttcctttg

SEQ ID NO: 991765 - DNA, 14 bp, Homo sapiens
aaatatgaaattcc

SEQ ID NO: 991766 - DNA, 16 bp, Homo sapiens
aaatatgaacctattt

SEQ ID NO: 991767 - DNA, 20 bp, Homo sapiens
aaatatgaacctattttcat

SEQ ID NO: 991768 - DNA, 17 bp, Homo sapiens
aaatatgaagaactgag

SEQ ID NO: 991769 - DNA, 17 bp, Homo sapiens
aaatatgaagagttttt

SEQ ID NO: 991770 - DNA, 12 bp, Homo sapiens
aaatatgaatgc

SEQ ID NO: 991771 - DNA, 10 bp, Homo sapiens
aaatatgcaa

SEQ ID NO: 991772 - DNA, 21 bp, Homo sapiens
aaatatggaacttacattgtt

SEQ ID NO: 991773 - DNA, 16 bp, Homo sapiens
aaatatggaacttcta

SEQ ID NO: 991774 - DNA, 20 bp, Homo sapiens
aaatatggacacttaatact

SEQ ID NO: 991775 - DNA, 14 bp, Homo sapiens
aaatatgtaaaact

SEQ ID NO: 991776 - DNA, 13 bp, Homo sapiens
aaatatgtaatat

SEQ ID NO: 991777 - DNA, 12 bp, Homo sapiens
aaatatgtaatt

SEQ ID NO: 991778 - DNA, 13 bp, Homo sapiens
aaatatgtatgtc

SEQ ID NO: 991779 - DNA, 21 bp, Homo sapiens
aaatatgtatttaccaaaaat

SEQ ID NO: 991780 - DNA, 16 bp, Homo sapiens
aaatatgtcctggggt

SEQ ID NO: 991781 - DNA, 16 bp, Homo sapiens
aaatatgtgaagtttt

SEQ ID NO: 991782 - DNA, 22 bp, Homo sapiens
aaatatgtgaagttttccttgc

SEQ ID NO: 991783 - DNA, 22 bp, Homo sapiens
aaatatgtttcacacaaacaag

SEQ ID NO: 991784 - DNA, 14 bp, Homo sapiens
aaatatgtttgtgc

SEQ ID NO: 991785 - DNA, 19 bp, Homo sapiens
aaatatgttttttagatca

SEQ ID NO: 991786 - DNA, 14 bp, Homo sapiens
aaatattacagtga

SEQ ID NO: 991787 - DNA, 20 bp, Homo sapiens
aaatattcaagtaacacttt

SEQ ID NO: 991788 - DNA, 14 bp, Homo sapiens
aaatattcagaaat

SEQ ID NO: 991789 - DNA, 15 bp, Homo sapiens
aaatattcagaaatt

SEQ ID NO: 991790 - DNA, 20 bp, Homo sapiens
aaattgttttcacttgtatt

SEQ ID NO: 991791 - DNA, 22 bp, Homo sapiens
aaattgttttcacttgtattga

SEQ ID NO: 991792 - DNA, 20 bp, Homo sapiens
aaattgttttgagctttcca

SEQ ID NO: 991793 - DNA, 17 bp, Homo sapiens
aaatttaaaagtaaaat

SEQ ID NO: 991794 - DNA, 14 bp, Homo sapiens
aaatttaaactata

SEQ ID NO: 991795 - DNA, 23 bp, Homo sapiens
aaatttaaagggtgtacttatat

SEQ ID NO: 991796 - DNA, 19 bp, Homo sapiens
aaatttaactctggtttct

SEQ ID NO: 991797 - DNA, 13 bp, Homo sapiens
aaatttaagaaaa

SEQ ID NO: 991798 - DNA, 15 bp, Homo sapiens
aaatttaagaaaaca

SEQ ID NO: 991799 - DNA, 18 bp, Homo sapiens
aaatttaagaaaacaagt

SEQ ID NO: 991800 - DNA, 12 bp, Homo sapiens
aaatttaagcat

SEQ ID NO: 991801 - DNA, 14 bp, Homo sapiens
aaatttaagcattg

SEQ ID NO: 991802 - DNA, 16 bp, Homo sapiens
aaatttaagcattgtt

SEQ ID NO: 991803 - DNA, 13 bp, Homo sapiens
aaatttaatgctg

SEQ ID NO: 991804 - DNA, 20 bp, Homo sapiens
aaatttagccctttaaaacg

SEQ ID NO: 991805 - DNA, 16 bp, Homo sapiens
aaatttagccgggcgc

SEQ ID NO: 991806 - DNA, 15 bp, Homo sapiens
aaatttagtgctctt

SEQ ID NO: 991807 - DNA, 12 bp, Homo sapiens
aaatttagtgtt

SEQ ID NO: 991808 - DNA, 13 bp, Homo sapiens
aaatttatatact

SEQ ID NO: 991809 - DNA, 16 bp, Homo sapiens
aaatttatgcatttca

SEQ ID NO: 991810 - DNA, 23 bp, Homo sapiens
aaatttatgcatttcattcaaat

SEQ ID NO: 991811 - DNA, 21 bp, Homo sapiens
aaatttattagccctgcattt

SEQ ID NO: 991812 - DNA, 19 bp, Homo sapiens
aaatttattttaatgtaaa

SEQ ID NO: 991813 - DNA, 19 bp, Homo sapiens
aaatttattttataagaaa

SEQ ID NO: 991814 - DNA, 16 bp, Homo sapiens
aaatttcaaatgcaga

SEQ ID NO: 991815 - DNA, 19 bp, Homo sapiens
aaatttcacagttctgtaa

SEQ ID NO: 991816 - DNA, 18 bp, Homo sapiens
aaatttcataattctgaa

SEQ ID NO: 991817 - DNA, 20 bp, Homo sapiens
aaatttcataattctgaaac

SEQ ID NO: 991818 - DNA, 15 bp, Homo sapiens
aaatttcatgattgg

SEQ ID NO: 991819 - DNA, 16 bp, Homo sapiens
aaatttccagtacctt

SEQ ID NO: 991820 - DNA, 15 bp, Homo sapiens
aaatttcctgtttga

SEQ ID NO: 991821 - DNA, 22 bp, Homo sapiens
aaatttcctgtttgaaatatca

SEQ ID NO: 991822 - DNA, 19 bp, Homo sapiens
aaatttctgggatatttaa

SEQ ID NO: 991823 - DNA, 15 bp, Homo sapiens
aacatagacagaaga

SEQ ID NO: 991824 - DNA, 21 bp, Homo sapiens
aacatagacagaagaaacaag

SEQ ID NO: 991825 - DNA, 16 bp, Homo sapiens
aacatatcatggtaat

SEQ ID NO: 991826 - DNA, 22 bp, Homo sapiens
aacatatcatggtaatgacaga

SEQ ID NO: 991827 - DNA, 18 bp, Homo sapiens
aacatatcatttgtgaag

SEQ ID NO: 991828 - DNA, 21 bp, Homo sapiens
aacatatcatttgtgaagaat

SEQ ID NO: 991829 - DNA, 14 bp, Homo sapiens
aacatatccaagtt

SEQ ID NO: 991830 - DNA, 22 bp, Homo sapiens
aacatatgtcacgaacttgaaa

SEQ ID NO: 991831 - DNA, 20 bp, Homo sapiens
aacatattcaatgcaagtaa

SEQ ID NO: 991832 - DNA, 16 bp, Homo sapiens
aaccgcatgtgatctc

SEQ ID NO: 991833 - DNA, 22 bp, Homo sapiens
aaccgcattcagtgcacctgcc

SEQ ID NO: 991834 - DNA, 12 bp, Homo sapiens
aaccgctcacct

SEQ ID NO: 991835 - DNA, 16 bp, Homo sapiens
aaccgctcacctagag

SEQ ID NO: 991836 - DNA, 16 bp, Homo sapiens
aaccggaaggaggcca

SEQ ID NO: 991837 - DNA, 22 bp, Homo sapiens
aaccggaaggaggccaaccagc

SEQ ID NO: 991838 - DNA, 18 bp, Homo sapiens
aaccgggagaaggcatga

SEQ ID NO: 991839 - DNA, 13 bp, Homo sapiens
aaccgtcctgctg

SEQ ID NO: 991840 - DNA, 16 bp, Homo sapiens
aaccgtggtatgtctg

SEQ ID NO: 991841 - DNA, 18 bp, Homo sapiens
aaccgtggtatgtctgcc

SEQ ID NO: 991842 - DNA, 17 bp, Homo sapiens
aaccgtgtgtccagcat

SEQ ID NO: 991843 - DNA, 23 bp, Homo sapiens
aaccgtgtgtccagcattgaaga

SEQ ID NO: 991844 - DNA, 18 bp, Homo sapiens
aaccgttttgaagctact

SEQ ID NO: 991845 - DNA, 15 bp, Homo sapiens
aacctaaaaaagata

SEQ ID NO: 991846 - DNA, 17 bp, Homo sapiens
aacctaaaactctttcg

SEQ ID NO: 991847 - DNA, 22 bp, Homo sapiens
aacctaaatttggttctaggcc

SEQ ID NO: 991848 - DNA, 18 bp, Homo sapiens
aacctaacttgcgcagaa

SEQ ID NO: 991849 - DNA, 20 bp, Homo sapiens
aacctaatcaccatgtaagc

SEQ ID NO: 991850 - DNA, 18 bp, Homo sapiens
aacctaattaatatatta

SEQ ID NO: 991851 - DNA, 16 bp, Homo sapiens
aacctacacacatacc

SEQ ID NO: 991852 - DNA, 21 bp, Homo sapiens
aacctacacacataccttcat

SEQ ID NO: 991853 - DNA, 23 bp, Homo sapiens
aacctaccttcatttcaggaggg

SEQ ID NO: 991854 - DNA, 13 bp, Homo sapiens
aacctactgccca

SEQ ID NO: 991855 - DNA, 17 bp, Homo sapiens
aacctactgttcctttc

SEQ ID NO: 991856 - DNA, 14 bp, Homo sapiens
aacctagaatgtca

SEQ ID NO: 991857 - DNA, 15 bp, Homo sapiens
aacctagaatgtcag

SEQ ID NO: 991858 - DNA, 23 bp, Homo sapiens
aacctagatgtttaacaaatcta

SEQ ID NO: 991859 - DNA, 17 bp, Homo sapiens
aacctagctacactgag

SEQ ID NO: 991860 - DNA, 19 bp, Homo sapiens
aacctagcttttaaaaaat

SEQ ID NO: 991861 - DNA, 23 bp, Homo sapiens
aacctagcttttaaaaaatattt

SEQ ID NO: 991862 - DNA, 18 bp, Homo sapiens
aacctagtactctctgct

SEQ ID NO: 991863 - DNA, 20 bp, Homo sapiens
aacctagttaaagaaaggaa

SEQ ID NO: 991864 - DNA, 22 bp, Homo sapiens
aacctagttaaagaaaggaaaa

SEQ ID NO: 991865 - DNA, 17 bp, Homo sapiens
aacctatctcagggagg

SEQ ID NO: 991866 - DNA, 21 bp, Homo sapiens
aacctatctcagggagggaag

SEQ ID NO: 991867 - DNA, 13 bp, Homo sapiens
aacctatctttaa

SEQ ID NO: 991868 - DNA, 11 bp, Homo sapiens
aacctattttc

SEQ ID NO: 991869 - DNA, 22 bp, Homo sapiens
aacctattttcatttgtacaag

SEQ ID NO: 991870 - DNA, 16 bp, Homo sapiens
aacctcaaactctggg

SEQ ID NO: 991871 - DNA, 16 bp, Homo sapiens
aacctcaactgcctac

SEQ ID NO: 991872 - DNA, 18 bp, Homo sapiens
aacctcaactgcctactc

SEQ ID NO: 991873 - DNA, 15 bp, Homo sapiens
aacctcaccaaacta

SEQ ID NO: 991874 - DNA, 17 bp, Homo sapiens
aacctcaccaaactagt

SEQ ID NO: 991875 - DNA, 15 bp, Homo sapiens
aacctcaccttcctg

SEQ ID NO: 991876 - DNA, 20 bp, Homo sapiens
aacctcaccttcctgtgggt

SEQ ID NO: 991877 - DNA, 14 bp, Homo sapiens
aacctcagtaattt

SEQ ID NO: 991878 - DNA, 15 bp, Homo sapiens
aacctcagtatttat

SEQ ID NO: 991879 - DNA, 18 bp, Homo sapiens
aacctcagtgtcatttat

SEQ ID NO: 991880 - DNA, 19 bp, Homo sapiens
aacctccagcctccctgtc

SEQ ID NO: 991881 - DNA, 18 bp, Homo sapiens
aacctcccagaggtccag

SEQ ID NO: 991882 - DNA, 20 bp, Homo sapiens
aacctcccagaggtccagcc

SEQ ID NO: 991883 - DNA, 24 bp, Homo sapiens
aacctcccagaggtccagcccatc

SEQ ID NO: 991884 - DNA, 13 bp, Homo sapiens
aacctcctgggtt

SEQ ID NO: 991885 - DNA, 14 bp, Homo sapiens
aacctcgctggact

SEQ ID NO: 991886 - DNA, 19 bp, Homo sapiens
aacctcggcttgtgggctg

SEQ ID NO: 991887 - DNA, 17 bp, Homo sapiens
aacctctaaccctcatt

SEQ ID NO: 991888 - DNA, 23 bp, Homo sapiens
aacctctactaaaaagaaggaaa

SEQ ID NO: 991889 - DNA, 14 bp, Homo sapiens
aacctctcacagtt

SEQ ID NO: 991890 - DNA, 21 bp, Homo sapiens
aacctctcctcatgttctgct

SEQ ID NO: 991891 - DNA, 15 bp, Homo sapiens
aacctctcctgaccc

SEQ ID NO: 991892 - DNA, 16 bp, Homo sapiens
aacctctcgccatgat

SEQ ID NO: 991893 - DNA, 21 bp, Homo sapiens
aacctctcgcttcctcagcct

SEQ ID NO: 991894 - DNA, 14 bp, Homo sapiens
aacctctctatttt

SEQ ID NO: 991895 - DNA, 19 bp, Homo sapiens
aacctctctgaactgcaac

SEQ ID NO: 991896 - DNA, 23 bp, Homo sapiens
aacctctctgatcttgtgctcag

SEQ ID NO: 991897 - DNA, 14 bp, Homo sapiens
aacctctggccctt

SEQ ID NO: 991898 - DNA, 14 bp, Homo sapiens
aacctctgtctcat

SEQ ID NO: 991899 - DNA, 16 bp, Homo sapiens
aacctctgtctcatcc

SEQ ID NO: 991900 - DNA, 18 bp, Homo sapiens
aacctcttcagaggccct

SEQ ID NO: 991901 - DNA, 14 bp, Homo sapiens
aacctcttccccag

SEQ ID NO: 991902 - DNA, 16 bp, Homo sapiens
aacctcttttctgcat

SEQ ID NO: 991903 - DNA, 18 bp, Homo sapiens
aacctcttttctgcatca

SEQ ID NO: 991904 - DNA, 20 bp, Homo sapiens
aacctcttttgttgtccttg

SEQ ID NO: 991905 - DNA, 21 bp, Homo sapiens
aacctgaaaaaaagtttacaa

SEQ ID NO: 991906 - DNA, 15 bp, Homo sapiens
aacctgaacctagga

SEQ ID NO: 991907 - DNA, 23 bp, Homo sapiens
aaccttgtctctatgccagctca

SEQ ID NO: 991908 - DNA, 15 bp, Homo sapiens
aaccttgttctattt

SEQ ID NO: 991909 - DNA, 13 bp, Homo sapiens
aaccttgttttgg

SEQ ID NO: 991910 - DNA, 23 bp, Homo sapiens
aaccttgttttggacagtttacc

SEQ ID NO: 991911 - DNA, 20 bp, Homo sapiens
aacctttaaagtaaaggcct

SEQ ID NO: 991912 - DNA, 23 bp, Homo sapiens
aacctttacagttagcagggatg

SEQ ID NO: 991913 - DNA, 14 bp, Homo sapiens
aacctttagggcag

SEQ ID NO: 991914 - DNA, 16 bp, Homo sapiens
aacctttagggcagct

SEQ ID NO: 991915 - DNA, 14 bp, Homo sapiens
aacctttccctcac

SEQ ID NO: 991916 - DNA, 17 bp, Homo sapiens
aacctttccctcacccc

SEQ ID NO: 991917 - DNA, 20 bp, Homo sapiens
aacctttccctcaccccctc

SEQ ID NO: 991918 - DNA, 18 bp, Homo sapiens
aacctttccgctgtcgcc

SEQ ID NO: 991919 - DNA, 22 bp, Homo sapiens
aacctttccgctgtcgccccag

SEQ ID NO: 991920 - DNA, 14 bp, Homo sapiens
aacctttctgtagc

SEQ ID NO: 991921 - DNA, 18 bp, Homo sapiens
aacctttcttcaccaaat

SEQ ID NO: 991922 - DNA, 17 bp, Homo sapiens
aacctttgctatgtaag

SEQ ID NO: 991923 - DNA, 15 bp, Homo sapiens
aacctttgtgtggct

SEQ ID NO: 991924 - DNA, 19 bp, Homo sapiens
aaccttttactggttgcat

SEQ ID NO: 991925 - DNA, 20 bp, Homo sapiens
aaccttttactggttgcatg

SEQ ID NO: 991926 - DNA, 14 bp, Homo sapiens
aacctttttcttga

SEQ ID NO: 991927 - DNA, 17 bp, Homo sapiens
aacctttttcttgatct

SEQ ID NO: 991928 - DNA, 12 bp, Homo sapiens
aaccttttttgt

SEQ ID NO: 991929 - DNA, 19 bp, Homo sapiens
aacgaacccctagaaagga

SEQ ID NO: 991930 - DNA, 16 bp, Homo sapiens
aacgaagatccgagcg

SEQ ID NO: 991931 - DNA, 23 bp, Homo sapiens
aacgaaggggccccggggctggc

SEQ ID NO: 991932 - DNA, 11 bp, Homo sapiens
aacgaatgaag

SEQ ID NO: 991933 - DNA, 17 bp, Homo sapiens
aacgactcaaaatgaca

SEQ ID NO: 991934 - DNA, 15 bp, Homo sapiens
aacgagcactggcca

SEQ ID NO: 991935 - DNA, 19 bp, Homo sapiens
aacgagcactggccagaga

SEQ ID NO: 991936 - DNA, 19 bp, Homo sapiens
aacgagggcaacagggagc

SEQ ID NO: 991937 - DNA, 17 bp, Homo sapiens
aacgatgaatttcttct

SEQ ID NO: 991938 - DNA, 17 bp, Homo sapiens
aacgatgatgcttgtaa

SEQ ID NO: 991939 - DNA, 22 bp, Homo sapiens
aacgatgatgcttgtaacaaga

SEQ ID NO: 991940 - DNA, 20 bp, Homo sapiens
aacgatgtgtctgtatttca

SEQ ID NO: 991941 - DNA, 20 bp, Homo sapiens
aacgcaaagggctgaaagcc

SEQ ID NO: 991942 - DNA, 12 bp, Homo sapiens
aacgcaccccac

SEQ ID NO: 991943 - DNA, 12 bp, Homo sapiens
aacgcagccctg

SEQ ID NO: 991944 - DNA, 16 bp, Homo sapiens
aacgcagccctgcttt

SEQ ID NO: 991945 - DNA, 23 bp, Homo sapiens
aacgcatggagtgtgtattgttc

SEQ ID NO: 991946 - DNA, 23 bp, Homo sapiens
aacgccagtctcccaggccccct

SEQ ID NO: 991947 - DNA, 13 bp, Homo sapiens
aacgcccctccaa

SEQ ID NO: 991948 - DNA, 16 bp, Homo sapiens
aacgcccctccaaacc

SEQ ID NO: 991949 - DNA, 20 bp, Homo sapiens
aacgcccctccaaacctcca

SEQ ID NO: 991950 - DNA, 23 bp, Homo sapiens
aacgcccctccaaacctccagcc

SEQ ID NO: 991951 - DNA, 18 bp, Homo sapiens
aacgcccctgtggccaac

SEQ ID NO: 991952 - DNA, 17 bp, Homo sapiens
aacgcctcctgtcccca

SEQ ID NO: 991953 - DNA, 19 bp, Homo sapiens
aacgcgtctgcctgggccg

SEQ ID NO: 991954 - DNA, 21 bp, Homo sapiens
aacgctaaagagcccttgcct

SEQ ID NO: 991955 - DNA, 16 bp, Homo sapiens
aacgctcctttgtgtg

SEQ ID NO: 991956 - DNA, 21 bp, Homo sapiens
aacgctctcctcgagccctcc

SEQ ID NO: 991957 - DNA, 10 bp, Homo sapiens
aacgctgtga

SEQ ID NO: 991958 - DNA, 15 bp, Homo sapiens
aacgctgtgatgctg

SEQ ID NO: 991959 - DNA, 18 bp, Homo sapiens
aacgctgtgatgctgtgt

SEQ ID NO: 991960 - DNA, 20 bp, Homo sapiens
aacgctgtgatgctgtgtgc

SEQ ID NO: 991961 - DNA, 21 bp, Homo sapiens
aacgctgtgatgctgtgtgcc

SEQ ID NO: 991962 - DNA, 11 bp, Homo sapiens
aacggatgctc

SEQ ID NO: 991963 - DNA, 15 bp, Homo sapiens
aacggattccaaaga

SEQ ID NO: 991964 - DNA, 16 bp, Homo sapiens
aacgggaacatgcccc

SEQ ID NO: 991965 - DNA, 17 bp, Homo sapiens
aacgggaacatgccccc

SEQ ID NO: 991966 - DNA, 17 bp, Homo sapiens
aacgggcagccacagga

SEQ ID NO: 991967 - DNA, 16 bp, Homo sapiens
aacgggcatgggcctc

SEQ ID NO: 991968 - DNA, 23 bp, Homo sapiens
aacgggcatgggcctctctgggg

SEQ ID NO: 991969 - DNA, 19 bp, Homo sapiens
aacgggggggttctccccc

SEQ ID NO: 991970 - DNA, 15 bp, Homo sapiens
aacggggtccttcaa

SEQ ID NO: 991971 - DNA, 13 bp, Homo sapiens
aacggggtgggga

SEQ ID NO: 991972 - DNA, 14 bp, Homo sapiens
aacgggtcagtatt

SEQ ID NO: 991973 - DNA, 17 bp, Homo sapiens
aacggtatcctccctgc

SEQ ID NO: 991974 - DNA, 21 bp, Homo sapiens
aacgtatgcatgtgaagaaag

SEQ ID NO: 991975 - DNA, 16 bp, Homo sapiens
aactatttttgaggaa

SEQ ID NO: 991976 - DNA, 19 bp, Homo sapiens
aactatttttgtgtttgaa

SEQ ID NO: 991977 - DNA, 20 bp, Homo sapiens
aactatttttgtgtttgaaa

SEQ ID NO: 991978 - DNA, 19 bp, Homo sapiens
aactcaaaacttaacatat

SEQ ID NO: 991979 - DNA, 15 bp, Homo sapiens
aactcaaaatatttg

SEQ ID NO: 991980 - DNA, 22 bp, Homo sapiens
aactcaaactgaggaatttcac

SEQ ID NO: 991981 - DNA, 19 bp, Homo sapiens
aactcaaagaggtaactga

SEQ ID NO: 991982 - DNA, 19 bp, Homo sapiens
aactcaaagatgatggaaa

SEQ ID NO: 991983 - DNA, 21 bp, Homo sapiens
aactcaaggaggtggtgaatt

SEQ ID NO: 991984 - DNA, 14 bp, Homo sapiens
aactcaatctccag

SEQ ID NO: 991985 - DNA, 13 bp, Homo sapiens
aactcaatgcttt

SEQ ID NO: 991986 - DNA, 16 bp, Homo sapiens
aactcaatgctttatt

SEQ ID NO: 991987 - DNA, 15 bp, Homo sapiens
aactcacagcttctc

SEQ ID NO: 991988 - DNA, 22 bp, Homo sapiens
aactcacagcttctccaagcat

SEQ ID NO: 991989 - DNA, 16 bp, Homo sapiens
aactcaccatgtaaaa

SEQ ID NO: 991990 - DNA, 21 bp, Homo sapiens
aactcaccatgtaaaagagtc

SEQ ID NO: 991991 - DNA, 17 bp, Homo sapiens
aactcacctaatgttta

SEQ ID NO: 991992 - DNA, 17 bp, Homo sapiens
aactcacctctcaaggt

SEQ ID NO: 991993 - DNA, 16 bp, Homo sapiens
aactcacctgctggcc

SEQ ID NO: 991994 - DNA, 22 bp, Homo sapiens
aactcacctgctggcccctcac

SEQ ID NO: 991995 - DNA, 20 bp, Homo sapiens
aactcactccttttaaagaa

SEQ ID NO: 991996 - DNA, 12 bp, Homo sapiens
aactcactctgg

SEQ ID NO: 991997 - DNA, 13 bp, Homo sapiens
aactcactctggg

SEQ ID NO: 991998 - DNA, 16 bp, Homo sapiens
aactcactctgggctg

SEQ ID NO: 991999 - DNA, 22 bp, Homo sapiens
aactcactggaatgtacagtat

SEQ ID NO: 992000 - DNA, 18 bp, Homo sapiens
aactcagaattattttta

SEQ ID NO: 992001 - DNA, 19 bp, Homo sapiens
aactcagatctgatcaaga

SEQ ID NO: 992002 - DNA, 21 bp, Homo sapiens
aactcagtagagatctatatt

SEQ ID NO: 992003 - DNA, 18 bp, Homo sapiens
aactcatacctttaaagg

SEQ ID NO: 992004 - DNA, 16 bp, Homo sapiens
aactcatcataaaata

SEQ ID NO: 992005 - DNA, 18 bp, Homo sapiens
aactcatcataaaataaa

SEQ ID NO: 992006 - DNA, 24 bp, Homo sapiens
aactcatcctcttttaatggcatt

SEQ ID NO: 992007 - DNA, 15 bp, Homo sapiens
aactccaacctctcg

SEQ ID NO: 992008 - DNA, 23 bp, Homo sapiens
aactccaacctctcggccccatc

SEQ ID NO: 992009 - DNA, 13 bp, Homo sapiens
aactccaagcaga

SEQ ID NO: 992010 - DNA, 14 bp, Homo sapiens
aactccaagcagac

SEQ ID NO: 992011 - DNA, 15 bp, Homo sapiens
aactccacatctgcc

SEQ ID NO: 992012 - DNA, 17 bp, Homo sapiens
aactccacatctgcctt

SEQ ID NO: 992013 - DNA, 21 bp, Homo sapiens
aactccaccgaccaactgccc

SEQ ID NO: 992014 - DNA, 23 bp, Homo sapiens
aactccaccgaccaactgcccta

SEQ ID NO: 992015 - DNA, 17 bp, Homo sapiens
aactccagagccccttt

SEQ ID NO: 992016 - DNA, 19 bp, Homo sapiens
aactccaggacgaggagga

SEQ ID NO: 992017 - DNA, 22 bp, Homo sapiens
aactccaggatttataaagcaa

SEQ ID NO: 992018 - DNA, 17 bp, Homo sapiens
aactccatacagcctct

SEQ ID NO: 992019 - DNA, 10 bp, Homo sapiens
aactccattt

SEQ ID NO: 992020 - DNA, 22 bp, Homo sapiens
aactcccagcaacacaagctgg

SEQ ID NO: 992021 - DNA, 15 bp, Homo sapiens
aactcccattaccat

SEQ ID NO: 992022 - DNA, 12 bp, Homo sapiens
aactccccttcc

SEQ ID NO: 992023 - DNA, 23 bp, Homo sapiens
aactccccttcctcactgcccaa

SEQ ID NO: 992024 - DNA, 17 bp, Homo sapiens
aactccctccaccagcc

SEQ ID NO: 992025 - DNA, 19 bp, Homo sapiens
aactccctgccccccagcc

SEQ ID NO: 992026 - DNA, 14 bp, Homo sapiens
aactccgcccccag

SEQ ID NO: 992027 - DNA, 23 bp, Homo sapiens
aactcctaattttaaataatttc

SEQ ID NO: 992028 - DNA, 14 bp, Homo sapiens
aactcctgacctca

SEQ ID NO: 992029 - DNA, 18 bp, Homo sapiens
aactcctgacctcaggtg

SEQ ID NO: 992030 - DNA, 19 bp, Homo sapiens
aactcctgattttgtagtt

SEQ ID NO: 992031 - DNA, 21 bp, Homo sapiens
aactcctgattttgtagttaa

SEQ ID NO: 992032 - DNA, 13 bp, Homo sapiens
aactcctgggctt

SEQ ID NO: 992033 - DNA, 13 bp, Homo sapiens
aactcctgtgtcg

SEQ ID NO: 992034 - DNA, 20 bp, Homo sapiens
aactccttcctggcctgaga

SEQ ID NO: 992035 - DNA, 18 bp, Homo sapiens
aactcctttagcaggtgg

SEQ ID NO: 992036 - DNA, 15 bp, Homo sapiens
aactcgaatctgtgt

SEQ ID NO: 992037 - DNA, 13 bp, Homo sapiens
aactcgatgcact

SEQ ID NO: 992038 - DNA, 16 bp, Homo sapiens
aactcgatgcactgac

SEQ ID NO: 992039 - DNA, 20 bp, Homo sapiens
aactcgcgagtgtaactttc

SEQ ID NO: 992040 - DNA, 19 bp, Homo sapiens
aactcgggggcgcctggag

SEQ ID NO: 992041 - DNA, 19 bp, Homo sapiens
aactcgggggtgctggggc

SEQ ID NO: 992042 - DNA, 14 bp, Homo sapiens
aagcaacaggtttt

SEQ ID NO: 992043 - DNA, 19 bp, Homo sapiens
aagcaacagtaatctatgt

SEQ ID NO: 992044 - DNA, 21 bp, Homo sapiens
aagcaacctcagtaatttaga

SEQ ID NO: 992045 - DNA, 18 bp, Homo sapiens
aagcaactacaacttctc

SEQ ID NO: 992046 - DNA, 19 bp, Homo sapiens
aagcaactaggccttcagt

SEQ ID NO: 992047 - DNA, 20 bp, Homo sapiens
aagcaactccgtgtgcctgg

SEQ ID NO: 992048 - DNA, 21 bp, Homo sapiens
aagcaactccgtgtgcctggg

SEQ ID NO: 992049 - DNA, 17 bp, Homo sapiens
aagcaacttcatttgac

SEQ ID NO: 992050 - DNA, 15 bp, Homo sapiens
aagcaacttgcttct

SEQ ID NO: 992051 - DNA, 16 bp, Homo sapiens
aagcaacttgcttcta

SEQ ID NO: 992052 - DNA, 13 bp, Homo sapiens
aagcaagaaagag

SEQ ID NO: 992053 - DNA, 18 bp, Homo sapiens
aagcaagagagatgtttt

SEQ ID NO: 992054 - DNA, 22 bp, Homo sapiens
aagcaagaggcaagctgaaatt

SEQ ID NO: 992055 - DNA, 23 bp, Homo sapiens
aagcaagaggcaagctgaaattt

SEQ ID NO: 992056 - DNA, 15 bp, Homo sapiens
aagcaagatgagctg

SEQ ID NO: 992057 - DNA, 12 bp, Homo sapiens
aagcaagccaga

SEQ ID NO: 992058 - DNA, 13 bp, Homo sapiens
aagcaagccagac

SEQ ID NO: 992059 - DNA, 17 bp, Homo sapiens
aagcaagggagaaaaga

SEQ ID NO: 992060 - DNA, 16 bp, Homo sapiens
aagcaagggctccagc

SEQ ID NO: 992061 - DNA, 20 bp, Homo sapiens
aagcaagtaaaaaggctaaa

SEQ ID NO: 992062 - DNA, 12 bp, Homo sapiens
aagcaagtgttg

SEQ ID NO: 992063 - DNA, 20 bp, Homo sapiens
aagcaataaagatttttcaa

SEQ ID NO: 992064 - DNA, 14 bp, Homo sapiens
aagcaataaatgaa

SEQ ID NO: 992065 - DNA, 18 bp, Homo sapiens
aagcaataactccaagca

SEQ ID NO: 992066 - DNA, 15 bp, Homo sapiens
aagcaataattgttt

SEQ ID NO: 992067 - DNA, 18 bp, Homo sapiens
aagcaataattgtttcca

SEQ ID NO: 992068 - DNA, 13 bp, Homo sapiens
aagcaatacaact

SEQ ID NO: 992069 - DNA, 14 bp, Homo sapiens
aagcaatactgttt

SEQ ID NO: 992070 - DNA, 17 bp, Homo sapiens
aagcaatactgtttcca

SEQ ID NO: 992071 - DNA, 19 bp, Homo sapiens
aagcaatatgcatttaaat

SEQ ID NO: 992072 - DNA, 14 bp, Homo sapiens
aagcaatattgtat

SEQ ID NO: 992073 - DNA, 17 bp, Homo sapiens
aagcaatattgtatatt

SEQ ID NO: 992074 - DNA, 17 bp, Homo sapiens
aagcaatattttggagt

SEQ ID NO: 992075 - DNA, 19 bp, Homo sapiens
aagcaatcaagcaccagga

SEQ ID NO: 992076 - DNA, 16 bp, Homo sapiens
aagcaatccacctgcc

SEQ ID NO: 992077 - DNA, 19 bp, Homo sapiens
aagcaatccacctgccttg

SEQ ID NO: 992078 - DNA, 14 bp, Homo sapiens
aagcaatcctccta

SEQ ID NO: 992079 - DNA, 15 bp, Homo sapiens
aagcaatcctcctgc

SEQ ID NO: 992080 - DNA, 20 bp, Homo sapiens
aagcaatcctcctgcctcag

SEQ ID NO: 992081 - DNA, 18 bp, Homo sapiens
aagcaatctttgaaataa

SEQ ID NO: 992082 - DNA, 20 bp, Homo sapiens
aagcaattatttaaagaaag

SEQ ID NO: 992083 - DNA, 23 bp, Homo sapiens
aagcaattatttaaagaaagtga

SEQ ID NO: 992084 - DNA, 22 bp, Homo sapiens
aagcaattctgactgtccagga

SEQ ID NO: 992085 - DNA, 15 bp, Homo sapiens
aagcaattgccctgt

SEQ ID NO: 992086 - DNA, 17 bp, Homo sapiens
aagcaattgccctgtaa

SEQ ID NO: 992087 - DNA, 14 bp, Homo sapiens
aagcacaataacta

SEQ ID NO: 992088 - DNA, 20 bp, Homo sapiens
aagcacaatcactaaacttt

SEQ ID NO: 992089 - DNA, 21 bp, Homo sapiens
aagcacaatgtctcacatggg

SEQ ID NO: 992090 - DNA, 22 bp, Homo sapiens
aagcacacacatctggccctga

SEQ ID NO: 992091 - DNA, 14 bp, Homo sapiens
aagcacactggaat

SEQ ID NO: 992092 - DNA, 15 bp, Homo sapiens
aagcacactggaata

SEQ ID NO: 992093 - DNA, 16 bp, Homo sapiens
aagcacactggaatat

SEQ ID NO: 992094 - DNA, 19 bp, Homo sapiens
aagcacagagcctggcccc

SEQ ID NO: 992095 - DNA, 15 bp, Homo sapiens
aagcacagctcctgc

SEQ ID NO: 992096 - DNA, 15 bp, Homo sapiens
aagcacagcttgggt

SEQ ID NO: 992097 - DNA, 13 bp, Homo sapiens
aagcacagtgtta

SEQ ID NO: 992098 - DNA, 14 bp, Homo sapiens
aagcacagtttgaa

SEQ ID NO: 992099 - DNA, 16 bp, Homo sapiens
aagcacagtttgaaca

SEQ ID NO: 992100 - DNA, 18 bp, Homo sapiens
aagcacagtttgaacaaa

SEQ ID NO: 992101 - DNA, 16 bp, Homo sapiens
aagcaccaaaataaga

SEQ ID NO: 992102 - DNA, 19 bp, Homo sapiens
aagcaccaaaataagaaaa

SEQ ID NO: 992103 - DNA, 13 bp, Homo sapiens
aagcaccaggaag

SEQ ID NO: 992104 - DNA, 20 bp, Homo sapiens
aagcaccaggaagtgtttat

SEQ ID NO: 992105 - DNA, 15 bp, Homo sapiens
aagcacccatttcaa

SEQ ID NO: 992106 - DNA, 22 bp, Homo sapiens
aagcacctgttaataaaggtct

SEQ ID NO: 992107 - DNA, 19 bp, Homo sapiens
aagcaccttagctggcatt

SEQ ID NO: 992108 - DNA, 23 bp, Homo sapiens
aagcactcccttaggcattattt

SEQ ID NO: 992109 - DNA, 12 bp, Homo sapiens
aagcactcgtgt

SEQ ID NO: 992110 - DNA, 19 bp, Homo sapiens
aagcactggtttcaagaat

SEQ ID NO: 992111 - DNA, 14 bp, Homo sapiens
aagcacttctagaa

SEQ ID NO: 992112 - DNA, 20 bp, Homo sapiens
aagcacttggactcttgctc

SEQ ID NO: 992113 - DNA, 14 bp, Homo sapiens
aagcactttaagct

SEQ ID NO: 992114 - DNA, 21 bp, Homo sapiens
aagcactttgaaaatatttct

SEQ ID NO: 992115 - DNA, 14 bp, Homo sapiens
aagcactttgcact

SEQ ID NO: 992116 - DNA, 15 bp, Homo sapiens
aagcacttttaaaaa

SEQ ID NO: 992117 - DNA, 20 bp, Homo sapiens
aagcacttttaaaaaaattt

SEQ ID NO: 992118 - DNA, 17 bp, Homo sapiens
aagcagaaacagcatat

SEQ ID NO: 992119 - DNA, 22 bp, Homo sapiens
aagcagaaatcctgcaatgaaa

SEQ ID NO: 992120 - DNA, 13 bp, Homo sapiens
aagcagaacaaat

SEQ ID NO: 992121 - DNA, 16 bp, Homo sapiens
aagcagaacaaatgtg

SEQ ID NO: 992122 - DNA, 19 bp, Homo sapiens
aagcagaactgaagccact

SEQ ID NO: 992123 - DNA, 17 bp, Homo sapiens
aagcagaagtctggctt

SEQ ID NO: 992124 - DNA, 15 bp, Homo sapiens
aagcagaattttaat

SEQ ID NO: 992125 - DNA, 15 bp, Homo sapiens
aagcagacagctcca

SEQ ID NO: 992126 - DNA, 17 bp, Homo sapiens
aagcagacgcagcagct

SEQ ID NO: 992127 - DNA, 19 bp, Homo sapiens
aagcagactccagcccctg

SEQ ID NO: 992128 - DNA, 11 bp, Homo sapiens
aagcagagcca

SEQ ID NO: 992129 - DNA, 17 bp, Homo sapiens
aagcagagccaaggcca

SEQ ID NO: 992130 - DNA, 12 bp, Homo sapiens
aagcagaggagg

SEQ ID NO: 992131 - DNA, 14 bp, Homo sapiens
aagcagaggagggg

SEQ ID NO: 992132 - DNA, 22 bp, Homo sapiens
aagcagaggaggggccgctgcc

SEQ ID NO: 992133 - DNA, 21 bp, Homo sapiens
aagcagaggctttggggtcct

SEQ ID NO: 992134 - DNA, 21 bp, Homo sapiens
aagcagaggtcttcagggctc

SEQ ID NO: 992135 - DNA, 17 bp, Homo sapiens
aagcagagtggactgca

SEQ ID NO: 992136 - DNA, 18 bp, Homo sapiens
aagcagcaggcctctggt

SEQ ID NO: 992137 - DNA, 17 bp, Homo sapiens
aagcagcatggaaaaat

SEQ ID NO: 992138 - DNA, 19 bp, Homo sapiens
aagcagcatggaaaaatgg

SEQ ID NO: 992139 - DNA, 11 bp, Homo sapiens
aagcagccagg

SEQ ID NO: 992140 - DNA, 16 bp, Homo sapiens
aagcagccaggaggga

SEQ ID NO: 992141 - DNA, 19 bp, Homo sapiens
aagcagccaggagggacct

SEQ ID NO: 992142 - DNA, 20 bp, Homo sapiens
aagcagccccctgtggcggc

SEQ ID NO: 992143 - DNA, 16 bp, Homo sapiens
aagcagcctctcccca

SEQ ID NO: 992144 - DNA, 15 bp, Homo sapiens
aagcagcctggagac

SEQ ID NO: 992145 - DNA, 20 bp, Homo sapiens
aagcagcctggagacttcct

SEQ ID NO: 992146 - DNA, 21 bp, Homo sapiens
aagcagcgtttctatgacaca

SEQ ID NO: 992147 - DNA, 16 bp, Homo sapiens
aagcagctgaagaaaa

SEQ ID NO: 992148 - DNA, 22 bp, Homo sapiens
aagcagctggtcagtctttgct

SEQ ID NO: 992149 - DNA, 15 bp, Homo sapiens
aagcagcttcttttg

SEQ ID NO: 992150 - DNA, 21 bp, Homo sapiens
aagcagctttaaacaaattca

SEQ ID NO: 992151 - DNA, 22 bp, Homo sapiens
aagcaggaaatgaaaatgtctt

SEQ ID NO: 992152 - DNA, 22 bp, Homo sapiens
aagcaggacctagagccgggca

SEQ ID NO: 992153 - DNA, 15 bp, Homo sapiens
aagcaggaggccctt

SEQ ID NO: 992154 - DNA, 17 bp, Homo sapiens
aagcaggggagtatgca

SEQ ID NO: 992155 - DNA, 19 bp, Homo sapiens
aagcaggggagtatgcaaa

SEQ ID NO: 992156 - DNA, 14 bp, Homo sapiens
aagcagggtaccct

SEQ ID NO: 992157 - DNA, 18 bp, Homo sapiens
aagcagggtaccctttgg

SEQ ID NO: 992158 - DNA, 14 bp, Homo sapiens
aagcaggtgctaca

SEQ ID NO: 992159 - DNA, 14 bp, Homo sapiens
aagcaggttcttgt

SEQ ID NO: 992160 - DNA, 15 bp, Homo sapiens
aagcaggttcttgtt

SEQ ID NO: 992161 - DNA, 16 bp, Homo sapiens
aagcaggtttgttttc

SEQ ID NO: 992162 - DNA, 13 bp, Homo sapiens
aagcagtaactga

SEQ ID NO: 992163 - DNA, 20 bp, Homo sapiens
aagcagtagaaataatatgc

SEQ ID NO: 992164 - DNA, 20 bp, Homo sapiens
aagcagtaggagaaacaaat

SEQ ID NO: 992165 - DNA, 22 bp, Homo sapiens
aagcagtatataataactttat

SEQ ID NO: 992166 - DNA, 12 bp, Homo sapiens
aagcagtatttt

SEQ ID NO: 992167 - DNA, 17 bp, Homo sapiens
aagcagtcccattcata

SEQ ID NO: 992168 - DNA, 21 bp, Homo sapiens
aagcagtcctgttcaaatttt

SEQ ID NO: 992169 - DNA, 21 bp, Homo sapiens
aagcagtgcctcgaggcaccg

SEQ ID NO: 992170 - DNA, 15 bp, Homo sapiens
aagcagtgccttcca

SEQ ID NO: 992171 - DNA, 17 bp, Homo sapiens
aagcagtgccttccata

SEQ ID NO: 992172 - DNA, 17 bp, Homo sapiens
aagcagtggacaccagg

SEQ ID NO: 992173 - DNA, 17 bp, Homo sapiens
aagcagtgtctgtcagc

SEQ ID NO: 992174 - DNA, 14 bp, Homo sapiens
aagcagttctcaca

SEQ ID NO: 992175 - DNA, 18 bp, Homo sapiens
aagcagttggggccctct

SEQ ID NO: 992176 - DNA, 22 bp, Homo sapiens
aagcagttggggccctcttgcc

SEQ ID NO: 992177 - DNA, 15 bp, Homo sapiens
aagcataaaaacatt

SEQ ID NO: 992178 - DNA, 20 bp, Homo sapiens
aagcataaagttacctacat

SEQ ID NO: 992179 - DNA, 21 bp, Homo sapiens
aagcataatttgtttaaaatt

SEQ ID NO: 992180 - DNA, 13 bp, Homo sapiens
aagcatacaagat

SEQ ID NO: 992181 - DNA, 18 bp, Homo sapiens
aagcatactttgtaaata

SEQ ID NO: 992182 - DNA, 15 bp, Homo sapiens
aagcatagctacaat

SEQ ID NO: 992183 - DNA, 16 bp, Homo sapiens
aagcatattttgctgg

SEQ ID NO: 992184 - DNA, 14 bp, Homo sapiens
aagcatcactgcct

SEQ ID NO: 992185 - DNA, 15 bp, Homo sapiens
aagcatcactgcctt

SEQ ID NO: 992186 - DNA, 22 bp, Homo sapiens
aagcatcagagatggtaatcta

SEQ ID NO: 992187 - DNA, 14 bp, Homo sapiens
aagcatccatgtgt

SEQ ID NO: 992188 - DNA, 18 bp, Homo sapiens
aagcatcctcagaagcct

SEQ ID NO: 992189 - DNA, 18 bp, Homo sapiens
aagcatcggagggaattg

SEQ ID NO: 992190 - DNA, 16 bp, Homo sapiens
aagcatctgatagaat

SEQ ID NO: 992191 - DNA, 13 bp, Homo sapiens
aagcatctggctc

SEQ ID NO: 992192 - DNA, 22 bp, Homo sapiens
aagcatgaataacatttaaatt

SEQ ID NO: 992193 - DNA, 23 bp, Homo sapiens
aagcatgaataacatttaaattc

SEQ ID NO: 992194 - DNA, 21 bp, Homo sapiens
aagcatgacaacttttaaaga

SEQ ID NO: 992195 - DNA, 21 bp, Homo sapiens
aagcatgatgggaaaatattt

SEQ ID NO: 992196 - DNA, 19 bp, Homo sapiens
aagcatgctttgctgctat

SEQ ID NO: 992197 - DNA, 14 bp, Homo sapiens
aagcatggacattt

SEQ ID NO: 992198 - DNA, 19 bp, Homo sapiens
aagcatgtaacttatatta

SEQ ID NO: 992199 - DNA, 16 bp, Homo sapiens
aagcatgtaggagaat

SEQ ID NO: 992200 - DNA, 16 bp, Homo sapiens
aagcatgtctctgctt

SEQ ID NO: 992201 - DNA, 15 bp, Homo sapiens
aagcatgtgtttgca

SEQ ID NO: 992202 - DNA, 20 bp, Homo sapiens
aagcatgtttcatgttttgt

SEQ ID NO: 992203 - DNA, 15 bp, Homo sapiens
aagcattaaaatgca

SEQ ID NO: 992204 - DNA, 22 bp, Homo sapiens
aagcattcaatttattcaagaa

SEQ ID NO: 992205 - DNA, 21 bp, Homo sapiens
aagcattcagaagaaaaagaa

SEQ ID NO: 992206 - DNA, 17 bp, Homo sapiens
aagcattcagagagcag

SEQ ID NO: 992207 - DNA, 13 bp, Homo sapiens
aagcattctttaa

SEQ ID NO: 992208 - DNA, 17 bp, Homo sapiens
aagcattgtaaaataat

SEQ ID NO: 992209 - DNA, 13 bp, Homo sapiens
aagcattgtctct

SEQ ID NO: 992210 - DNA, 23 bp, Homo sapiens
aagcatttaacccccctgtacac

SEQ ID NO: 992211 - DNA, 12 bp, Homo sapiens
aagcatttataa

SEQ ID NO: 992212 - DNA, 16 bp, Homo sapiens
aagcatttcaggccag

SEQ ID NO: 992213 - DNA, 15 bp, Homo sapiens
aagcatttgtatatt

SEQ ID NO: 992214 - DNA, 16 bp, Homo sapiens
aagcattttgaaacaa

SEQ ID NO: 992215 - DNA, 12 bp, Homo sapiens
aagcattttgta

SEQ ID NO: 992216 - DNA, 13 bp, Homo sapiens
aagcattttgtaa

SEQ ID NO: 992217 - DNA, 17 bp, Homo sapiens
aagcattttgtaataat

SEQ ID NO: 992218 - DNA, 20 bp, Homo sapiens
aagcatttttccatctgtgt

SEQ ID NO: 992219 - DNA, 22 bp, Homo sapiens
aagcattttttaaaagcatggc

SEQ ID NO: 992220 - DNA, 19 bp, Homo sapiens
aagccaaaactgagcataa

SEQ ID NO: 992221 - DNA, 11 bp, Homo sapiens
aagccaaagaa

SEQ ID NO: 992222 - DNA, 12 bp, Homo sapiens
aagccaaagaaa

SEQ ID NO: 992223 - DNA, 15 bp, Homo sapiens
aagccaaagaaacaa

SEQ ID NO: 992224 - DNA, 18 bp, Homo sapiens
aagccaaagaaacaagct

SEQ ID NO: 992225 - DNA, 16 bp, Homo sapiens
aagccaaagacttagt

SEQ ID NO: 992226 - DNA, 22 bp, Homo sapiens
aagccaaagtggcatgttttgt

SEQ ID NO: 992227 - DNA, 15 bp, Homo sapiens
aagccaaagtttctg

SEQ ID NO: 992228 - DNA, 19 bp, Homo sapiens
aagccaaagtttctgttga

SEQ ID NO: 992229 - DNA, 22 bp, Homo sapiens
aagccaaagttttcaaactgct

SEQ ID NO: 992230 - DNA, 20 bp, Homo sapiens
aagccaacaactctgccttt

SEQ ID NO: 992231 - DNA, 23 bp, Homo sapiens
aagccaacaactctgcctttatg

SEQ ID NO: 992232 - DNA, 17 bp, Homo sapiens
aagccaacagtcaaaac

SEQ ID NO: 992233 - DNA, 16 bp, Homo sapiens
aagccaacgacaaagc

SEQ ID NO: 992234 - DNA, 16 bp, Homo sapiens
aagccaacttgtaaat

SEQ ID NO: 992235 - DNA, 9 bp, Homo sapiens
aagccaagc

SEQ ID NO: 992236 - DNA, 23 bp, Homo sapiens
aagccaagctccctggagccctg

SEQ ID NO: 992237 - DNA, 16 bp, Homo sapiens
aagccaagggaaaggg

SEQ ID NO: 992238 - DNA, 19 bp, Homo sapiens
aagccaagtggggtgctgg

SEQ ID NO: 992239 - DNA, 16 bp, Homo sapiens
aagccaatcccctcct

SEQ ID NO: 992240 - DNA, 17 bp, Homo sapiens
aagccaattcagacagg

SEQ ID NO: 992241 - DNA, 15 bp, Homo sapiens
aagccacaagaaatt

SEQ ID NO: 992242 - DNA, 15 bp, Homo sapiens
aagccacaaggctgg

SEQ ID NO: 992243 - DNA, 11 bp, Homo sapiens
aagccacagaa

SEQ ID NO: 992244 - DNA, 17 bp, Homo sapiens
aagccacatcttgctct

SEQ ID NO: 992245 - DNA, 20 bp, Homo sapiens
aagccacatcttgctctgca

SEQ ID NO: 992246 - DNA, 22 bp, Homo sapiens
aagccacatcttgctctgcatt

SEQ ID NO: 992247 - DNA, 18 bp, Homo sapiens
aagccaccatccccaccc

SEQ ID NO: 992248 - DNA, 11 bp, Homo sapiens
aagccacctct

SEQ ID NO: 992249 - DNA, 17 bp, Homo sapiens
aagccacctctccctca

SEQ ID NO: 992250 - DNA, 16 bp, Homo sapiens
aagccacgctgtcctc

SEQ ID NO: 992251 - DNA, 14 bp, Homo sapiens
aagccactgaagct

SEQ ID NO: 992252 - DNA, 17 bp, Homo sapiens
aagccactgcctctccc

SEQ ID NO: 992253 - DNA, 19 bp, Homo sapiens
aagccactgcctctccctc

SEQ ID NO: 992254 - DNA, 21 bp, Homo sapiens
aagccacttctggcttcagcc

SEQ ID NO: 992255 - DNA, 13 bp, Homo sapiens
aagccacttgaaa

SEQ ID NO: 992256 - DNA, 18 bp, Homo sapiens
aagccacttgaaatgtta

SEQ ID NO: 992257 - DNA, 15 bp, Homo sapiens
aagccagaaccagat

SEQ ID NO: 992258 - DNA, 23 bp, Homo sapiens
aagccagacaacttctgtttctt

SEQ ID NO: 992259 - DNA, 11 bp, Homo sapiens
aagccagacag

SEQ ID NO: 992260 - DNA, 19 bp, Homo sapiens
aagccagacctagcaggct

SEQ ID NO: 992261 - DNA, 15 bp, Homo sapiens
aagccagagcctggg

SEQ ID NO: 992262 - DNA, 15 bp, Homo sapiens
aagccagaggagaag

SEQ ID NO: 992263 - DNA, 20 bp, Homo sapiens
aagccagaggagaagacaac

SEQ ID NO: 992264 - DNA, 14 bp, Homo sapiens
aagccagaggctgg

SEQ ID NO: 992265 - DNA, 16 bp, Homo sapiens
aagccagaggctgggt

SEQ ID NO: 992266 - DNA, 19 bp, Homo sapiens
aagccagcgtcctcctctg

SEQ ID NO: 992267 - DNA, 17 bp, Homo sapiens
aagccaggaaacatgaa

SEQ ID NO: 992268 - DNA, 21 bp, Homo sapiens
aagccaggagcaaatgtttct

SEQ ID NO: 992269 - DNA, 15 bp, Homo sapiens
aagccaggcctggct

SEQ ID NO: 992270 - DNA, 22 bp, Homo sapiens
aagccaggcctggctggaggag

SEQ ID NO: 992271 - DNA, 17 bp, Homo sapiens
aagccagggcccagagc

SEQ ID NO: 992272 - DNA, 19 bp, Homo sapiens
aagccagggcccagagccc

SEQ ID NO: 992273 - DNA, 21 bp, Homo sapiens
aagccagggcccagagccctt

SEQ ID NO: 992274 - DNA, 20 bp, Homo sapiens
aagccagggcccctggatct

SEQ ID NO: 992275 - DNA, 16 bp, Homo sapiens
aagccagggctggaga

SEQ ID NO: 992276 - DNA, 14 bp, Homo sapiens
aagccaggtacagg

SEQ ID NO: 992277 - DNA, 15 bp, Homo sapiens
aagccaggtacagga

SEQ ID NO: 992278 - DNA, 21 bp, Homo sapiens
aagccaggttccacagaggac

SEQ ID NO: 992279 - DNA, 20 bp, Homo sapiens
aagccagtttgggtaaaata

SEQ ID NO: 992280 - DNA, 19 bp, Homo sapiens
aagccataacgtgccccca

SEQ ID NO: 992281 - DNA, 22 bp, Homo sapiens
aagctttcctgccccaggcctg

SEQ ID NO: 992282 - DNA, 17 bp, Homo sapiens
aagctttctcagaatgt

SEQ ID NO: 992283 - DNA, 23 bp, Homo sapiens
aagctttgctacaaatttatgca

SEQ ID NO: 992284 - DNA, 17 bp, Homo sapiens
aagcttttaagaaaaac

SEQ ID NO: 992285 - DNA, 18 bp, Homo sapiens
aagcttttaagaaaaaca

SEQ ID NO: 992286 - DNA, 11 bp, Homo sapiens
aagcttttatt

SEQ ID NO: 992287 - DNA, 14 bp, Homo sapiens
aagcttttattcct

SEQ ID NO: 992288 - DNA, 17 bp, Homo sapiens
aagcttttatttcttgt

SEQ ID NO: 992289 - DNA, 23 bp, Homo sapiens
aagctttttattcctcctgctca

SEQ ID NO: 992290 - DNA, 18 bp, Homo sapiens
aagctttttggaatcttt

SEQ ID NO: 992291 - DNA, 21 bp, Homo sapiens
aagctttttttttttgaaccc

SEQ ID NO: 992292 - DNA, 21 bp, Homo sapiens
aaggaaaaaaaacacaaaaca

SEQ ID NO: 992293 - DNA, 15 bp, Homo sapiens
aaggaaaaaatgttg

SEQ ID NO: 992294 - DNA, 20 bp, Homo sapiens
aaggaaaaacacaagcaaaa

SEQ ID NO: 992295 - DNA, 15 bp, Homo sapiens
aaggaaaaataatca

SEQ ID NO: 992296 - DNA, 14 bp, Homo sapiens
aaggaaaaatgtgt

SEQ ID NO: 992297 - DNA, 16 bp, Homo sapiens
aaggaaaaatgtgtaa

SEQ ID NO: 992298 - DNA, 19 bp, Homo sapiens
aaggaaaacatgctgctct

SEQ ID NO: 992299 - DNA, 18 bp, Homo sapiens
aaggaaaacctgaagact

SEQ ID NO: 992300 - DNA, 16 bp, Homo sapiens
aaggaaaagcaagaaa

SEQ ID NO: 992301 - DNA, 15 bp, Homo sapiens
aaggaaaatctatat

SEQ ID NO: 992302 - DNA, 15 bp, Homo sapiens
aaggaaaattgaaag

SEQ ID NO: 992303 - DNA, 16 bp, Homo sapiens
aaggaaaattgaaagt

SEQ ID NO: 992304 - DNA, 16 bp, Homo sapiens
aaggaaaattgcacta

SEQ ID NO: 992305 - DNA, 22 bp, Homo sapiens
aaggaaaccaagtggtcaggag

SEQ ID NO: 992306 - DNA, 21 bp, Homo sapiens
aaggaaacttctgatgtttat

SEQ ID NO: 992307 - DNA, 21 bp, Homo sapiens
aaggaaacttgaatcaaagca

SEQ ID NO: 992308 - DNA, 15 bp, Homo sapiens
aaggaaagaaaacat

SEQ ID NO: 992309 - DNA, 16 bp, Homo sapiens
aaggaaagcaataaat

SEQ ID NO: 992310 - DNA, 12 bp, Homo sapiens
aaggaaagctgt

SEQ ID NO: 992311 - DNA, 18 bp, Homo sapiens
aaggaaagctgtgtttat

SEQ ID NO: 992312 - DNA, 18 bp, Homo sapiens
aaggaaaggctcatttaa

SEQ ID NO: 992313 - DNA, 20 bp, Homo sapiens
aaggaaaggctcatttaaaa

SEQ ID NO: 992314 - DNA, 22 bp, Homo sapiens
aaggaaagggggtcccagtggg

SEQ ID NO: 992315 - DNA, 15 bp, Homo sapiens
aaggaaataaaatca

SEQ ID NO: 992316 - DNA, 15 bp, Homo sapiens
aaggaaataaaggta

SEQ ID NO: 992317 - DNA, 19 bp, Homo sapiens
aaggaaataaaggtaaaat

SEQ ID NO: 992318 - DNA, 13 bp, Homo sapiens
aaggaaataacat

SEQ ID NO: 992319 - DNA, 21 bp, Homo sapiens
aaggaaatactttgcataaat

SEQ ID NO: 992320 - DNA, 22 bp, Homo sapiens
aaggaaatactttgcataaatt

SEQ ID NO: 992321 - DNA, 21 bp, Homo sapiens
aaggaaatatatttgtaaaag

SEQ ID NO: 992322 - DNA, 16 bp, Homo sapiens
aaggaaatctcacccc

SEQ ID NO: 992323 - DNA, 20 bp, Homo sapiens
aaggaaatctcctcttttgt

SEQ ID NO: 992324 - DNA, 13 bp, Homo sapiens
aaggaaatgatgg

SEQ ID NO: 992325 - DNA, 17 bp, Homo sapiens
aaggaaatgtcctgcat

SEQ ID NO: 992326 - DNA, 18 bp, Homo sapiens
aaggaaatttgtttgtat

SEQ ID NO: 992327 - DNA, 16 bp, Homo sapiens
aaggatatactgcagc

SEQ ID NO: 992328 - DNA, 18 bp, Homo sapiens
aaggatatttaagaaaat

SEQ ID NO: 992329 - DNA, 13 bp, Homo sapiens
aaggatcatctga

SEQ ID NO: 992330 - DNA, 17 bp, Homo sapiens
aaggatcggactctgcc

SEQ ID NO: 992331 - DNA, 21 bp, Homo sapiens
aaggatctctcaggagcacag

SEQ ID NO: 992332 - DNA, 13 bp, Homo sapiens
aaggatctgctga

SEQ ID NO: 992333 - DNA, 24 bp, Homo sapiens
aaggatctgctgaggcccagtgca

SEQ ID NO: 992334 - DNA, 14 bp, Homo sapiens
aaggatgaaagaaa

SEQ ID NO: 992335 - DNA, 19 bp, Homo sapiens
aaggatgaagaacacagca

SEQ ID NO: 992336 - DNA, 13 bp, Homo sapiens
aaggatgactttt

SEQ ID NO: 992337 - DNA, 17 bp, Homo sapiens
aaggatgagaatgtgac

SEQ ID NO: 992338 - DNA, 18 bp, Homo sapiens
aaggatgcacagagttgt

SEQ ID NO: 992339 - DNA, 24 bp, Homo sapiens
aaggatgcacagagttgttacatt

SEQ ID NO: 992340 - DNA, 20 bp, Homo sapiens
aaggatgccaagaagtttaa

SEQ ID NO: 992341 - DNA, 16 bp, Homo sapiens
aaggatggaaaaataa

SEQ ID NO: 992342 - DNA, 19 bp, Homo sapiens
aaggatggatgagtcagac

SEQ ID NO: 992343 - DNA, 21 bp, Homo sapiens
aaggatgggtcccctccgcca

SEQ ID NO: 992344 - DNA, 23 bp, Homo sapiens
aaggatgtaaacagtgcctgctg

SEQ ID NO: 992345 - DNA, 15 bp, Homo sapiens
aaggatgtacatttc

SEQ ID NO: 992346 - DNA, 14 bp, Homo sapiens
aaggatgtcacagg

SEQ ID NO: 992347 - DNA, 16 bp, Homo sapiens
aaggatgtcacagggc

SEQ ID NO: 992348 - DNA, 16 bp, Homo sapiens
aaggatgttacaagtt

SEQ ID NO: 992349 - DNA, 15 bp, Homo sapiens
aaggatgttggtgtt

SEQ ID NO: 992350 - DNA, 19 bp, Homo sapiens
aaggatgtttagcagtggc

SEQ ID NO: 992351 - DNA, 21 bp, Homo sapiens
aaggatgtttagcagtggctg

SEQ ID NO: 992352 - DNA, 19 bp, Homo sapiens
aaggattatggaaaaataa

SEQ ID NO: 992353 - DNA, 20 bp, Homo sapiens
aaggattatggaaaaataaa

SEQ ID NO: 992354 - DNA, 20 bp, Homo sapiens
aaggattcagttttgcttat

SEQ ID NO: 992355 - DNA, 14 bp, Homo sapiens
aaggattgtgatat

SEQ ID NO: 992356 - DNA, 17 bp, Homo sapiens
aaggattgtgatatttt

SEQ ID NO: 992357 - DNA, 19 bp, Homo sapiens
aaggattttaccaaagcat

SEQ ID NO: 992358 - DNA, 18 bp, Homo sapiens
aaggatttttcaagagat

SEQ ID NO: 992359 - DNA, 19 bp, Homo sapiens
aaggatttttccatgtgtg

SEQ ID NO: 992360 - DNA, 15 bp, Homo sapiens
aaggcaaaaatgtaa

SEQ ID NO: 992361 - DNA, 23 bp, Homo sapiens
aaggcaaaagactggtttgtttg

SEQ ID NO: 992362 - DNA, 12 bp, Homo sapiens
aaggcaaaattg

SEQ ID NO: 992363 - DNA, 15 bp, Homo sapiens
aaggcaaaattgcaa

SEQ ID NO: 992364 - DNA, 20 bp, Homo sapiens
aaggcaaacccatcaacaaa

SEQ ID NO: 992365 - DNA, 18 bp, Homo sapiens
aaggcaaatattatccag

SEQ ID NO: 992366 - DNA, 22 bp, Homo sapiens
aaggcaaatattatccagcaag

SEQ ID NO: 992367 - DNA, 18 bp, Homo sapiens
aaggcaaatgtgtacatg

SEQ ID NO: 992368 - DNA, 15 bp, Homo sapiens
aaggcaacattcctt

SEQ ID NO: 992369 - DNA, 12 bp, Homo sapiens
aaggcaactcaa

SEQ ID NO: 992370 - DNA, 20 bp, Homo sapiens
aaggcaagtttctagctaga

SEQ ID NO: 992371 - DNA, 17 bp, Homo sapiens
aaggcacaaaattttgt

SEQ ID NO: 992372 - DNA, 22 bp, Homo sapiens
aaggcacacagagattctggat

SEQ ID NO: 992373 - DNA, 12 bp, Homo sapiens
aaggcacagtgg

SEQ ID NO: 992374 - DNA, 20 bp, Homo sapiens
aaggcacccacaaataaatg

SEQ ID NO: 992375 - DNA, 21 bp, Homo sapiens
aaggcaccttcttaaaagaaa

SEQ ID NO: 992376 - DNA, 15 bp, Homo sapiens
aaggcagaaagcaaa

SEQ ID NO: 992377 - DNA, 19 bp, Homo sapiens
aaggcagaaagcaaaatta

SEQ ID NO: 992378 - DNA, 15 bp, Homo sapiens
aaggcagaggcctgg

SEQ ID NO: 992379 - DNA, 12 bp, Homo sapiens
aaggcagaggct

SEQ ID NO: 992380 - DNA, 13 bp, Homo sapiens
aaggcagaggctg

SEQ ID NO: 992381 - DNA, 20 bp, Homo sapiens
aaggcagattttacagagcg

SEQ ID NO: 992382 - DNA, 12 bp, Homo sapiens
aaggcagccctc

SEQ ID NO: 992383 - DNA, 13 bp, Homo sapiens
aaggcagcctcca

SEQ ID NO: 992384 - DNA, 18 bp, Homo sapiens
aaggcagcctccagagcc

SEQ ID NO: 992385 - DNA, 15 bp, Homo sapiens
aaggcagctcacccc

SEQ ID NO: 992386 - DNA, 19 bp, Homo sapiens
aaggcagctcttctggagt

SEQ ID NO: 992387 - DNA, 20 bp, Homo sapiens
aaggcagctcttctggagtt

SEQ ID NO: 992388 - DNA, 14 bp, Homo sapiens
aaggcagctgcctc

SEQ ID NO: 992389 - DNA, 13 bp, Homo sapiens
aaggcagctgctc

SEQ ID NO: 992390 - DNA, 14 bp, Homo sapiens
aaggcagctgctct

SEQ ID NO: 992391 - DNA, 16 bp, Homo sapiens
aaggcaggaatgtgtg

SEQ ID NO: 992392 - DNA, 18 bp, Homo sapiens
aaggcagggaatgcctgg

SEQ ID NO: 992393 - DNA, 20 bp, Homo sapiens
aaggcaggtgcctccaggtg

SEQ ID NO: 992394 - DNA, 16 bp, Homo sapiens
aaggcagtccagagct

SEQ ID NO: 992395 - DNA, 22 bp, Homo sapiens
aaggcagtctctatattatgtc

SEQ ID NO: 992396 - DNA, 13 bp, Homo sapiens
aaggcagtgcatg

SEQ ID NO: 992397 - DNA, 17 bp, Homo sapiens
aaggcatccttgtcttt

SEQ ID NO: 992398 - DNA, 13 bp, Homo sapiens
aaggcatgagaaa

SEQ ID NO: 992399 - DNA, 15 bp, Homo sapiens
aaggcatgagaaaga

SEQ ID NO: 992400 - DNA, 21 bp, Homo sapiens
aaggcatgatgttaaccagaa

SEQ ID NO: 992401 - DNA, 20 bp, Homo sapiens
aaggcatgcgaaatgttctc

SEQ ID NO: 992402 - DNA, 22 bp, Homo sapiens
aaggcatgtggcctttatctca

SEQ ID NO: 992403 - DNA, 19 bp, Homo sapiens
aaggcattataaaaagaat

SEQ ID NO: 992404 - DNA, 12 bp, Homo sapiens
aaggcattctct

SEQ ID NO: 992405 - DNA, 16 bp, Homo sapiens
aaggccaaaatcaaga

SEQ ID NO: 992406 - DNA, 17 bp, Homo sapiens
aaggccaaaatcaagag

SEQ ID NO: 992407 - DNA, 20 bp, Homo sapiens
aaggccaataataaagacat

SEQ ID NO: 992408 - DNA, 14 bp, Homo sapiens
aaggccacaaaaac

SEQ ID NO: 992409 - DNA, 17 bp, Homo sapiens
aaggccacaaaaacaat

SEQ ID NO: 992410 - DNA, 15 bp, Homo sapiens
aaggccacaggagac

SEQ ID NO: 992411 - DNA, 21 bp, Homo sapiens
aaggccaccttggaggaggat

SEQ ID NO: 992412 - DNA, 22 bp, Homo sapiens
aaggccatctgggctcctccag

SEQ ID NO: 992413 - DNA, 14 bp, Homo sapiens
aaggccattgggtt

SEQ ID NO: 992414 - DNA, 21 bp, Homo sapiens
aaggcccacgagcttgttctt

SEQ ID NO: 992415 - DNA, 14 bp, Homo sapiens
aaggcccagcccct

SEQ ID NO: 992416 - DNA, 16 bp, Homo sapiens
aaggcccagcccctag

SEQ ID NO: 992417 - DNA, 18 bp, Homo sapiens
aaggcccagcccctagaa

SEQ ID NO: 992418 - DNA, 16 bp, Homo sapiens
aaggcccagggaggca

SEQ ID NO: 992419 - DNA, 13 bp, Homo sapiens
aaggcccatgccc

SEQ ID NO: 992420 - DNA, 15 bp, Homo sapiens
aaggccccagagact

SEQ ID NO: 992421 - DNA, 17 bp, Homo sapiens
aaggccccagagagacc

SEQ ID NO: 992422 - DNA, 16 bp, Homo sapiens
aaggcctcggcagaac

SEQ ID NO: 992423 - DNA, 15 bp, Homo sapiens
aaggcctcttgtgct

SEQ ID NO: 992424 - DNA, 23 bp, Homo sapiens
aaggcctcttgtgctcacgctcc

SEQ ID NO: 992425 - DNA, 19 bp, Homo sapiens
aaggcctggaaccagggag

SEQ ID NO: 992426 - DNA, 20 bp, Homo sapiens
aaggcctggtgtttcttgat

SEQ ID NO: 992427 - DNA, 21 bp, Homo sapiens
aaggccttattctacatttca

SEQ ID NO: 992428 - DNA, 21 bp, Homo sapiens
aaggccttcagtttatttcca

SEQ ID NO: 992429 - DNA, 20 bp, Homo sapiens
aaggccttcatggccccagc

SEQ ID NO: 992430 - DNA, 12 bp, Homo sapiens
aaggccttctcc

SEQ ID NO: 992431 - DNA, 17 bp, Homo sapiens
aaggccttgctcactca

SEQ ID NO: 992432 - DNA, 22 bp, Homo sapiens
aaggccttggtggagcagccag

SEQ ID NO: 992433 - DNA, 23 bp, Homo sapiens
aaggccttggtggagcagccaga

SEQ ID NO: 992434 - DNA, 14 bp, Homo sapiens
aaggcctttcttct

SEQ ID NO: 992435 - DNA, 17 bp, Homo sapiens
aaggcctttcttctgtg

SEQ ID NO: 992436 - DNA, 13 bp, Homo sapiens
aaggctaaaaagt

SEQ ID NO: 992437 - DNA, 16 bp, Homo sapiens
aaggctaaaacttaac

SEQ ID NO: 992438 - DNA, 18 bp, Homo sapiens
aaggctaacatcccactt

SEQ ID NO: 992439 - DNA, 16 bp, Homo sapiens
aaggctactggcatta

SEQ ID NO: 992440 - DNA, 20 bp, Homo sapiens
aaggctcacgaagggcatcc

SEQ ID NO: 992441 - DNA, 18 bp, Homo sapiens
aaggctcatttaaaacag

SEQ ID NO: 992442 - DNA, 16 bp, Homo sapiens
aaggctccccaccccg

SEQ ID NO: 992443 - DNA, 17 bp, Homo sapiens
aaggctcgattttgtat

SEQ ID NO: 992444 - DNA, 13 bp, Homo sapiens
aaggctctcaccc

SEQ ID NO: 992445 - DNA, 19 bp, Homo sapiens
aaggctctcacccccatcc

SEQ ID NO: 992446 - DNA, 12 bp, Homo sapiens
aaggctctcccc

SEQ ID NO: 992447 - DNA, 14 bp, Homo sapiens
aaggctctcccctc

SEQ ID NO: 992448 - DNA, 23 bp, Homo sapiens
aaggctctgagcaaatgtggctc

SEQ ID NO: 992449 - DNA, 22 bp, Homo sapiens
aaggctgacagactcactggga

SEQ ID NO: 992450 - DNA, 16 bp, Homo sapiens
aaggctgcccctgtaa

SEQ ID NO: 992451 - DNA, 21 bp, Homo sapiens
aaggctgcccctgtaaggttt

SEQ ID NO: 992452 - DNA, 14 bp, Homo sapiens
aaggctgctggctt

SEQ ID NO: 992453 - DNA, 15 bp, Homo sapiens
aaggctgctggcttc

SEQ ID NO: 992454 - DNA, 22 bp, Homo sapiens
aaggctgggggaagaagctctc

SEQ ID NO: 992455 - DNA, 21 bp, Homo sapiens
aaggctgggtaatgtgaaggc

SEQ ID NO: 992456 - DNA, 17 bp, Homo sapiens
aaggctgtgctgccctg

SEQ ID NO: 992457 - DNA, 16 bp, Homo sapiens
aaggctgtgtaagatt

SEQ ID NO: 992458 - DNA, 21 bp, Homo sapiens
aaggctgtgtaagatttgttt

SEQ ID NO: 992459 - DNA, 21 bp, Homo sapiens
aaggctgttaaatacaggaaa

SEQ ID NO: 992460 - DNA, 22 bp, Homo sapiens
aaggctgttaaatacaggaaac

SEQ ID NO: 992461 - DNA, 23 bp, Homo sapiens
aaggctgttgcatgggctaatga

SEQ ID NO: 992462 - DNA, 12 bp, Homo sapiens
aaggcttctctc

SEQ ID NO: 992463 - DNA, 15 bp, Homo sapiens
aaggcttctctccac

SEQ ID NO: 992464 - DNA, 13 bp, Homo sapiens
aaggcttgaagct

SEQ ID NO: 992465 - DNA, 16 bp, Homo sapiens
aaggcttgaagctgtg

SEQ ID NO: 992466 - DNA, 12 bp, Homo sapiens
aaggcttgcagt

SEQ ID NO: 992467 - DNA, 14 bp, Homo sapiens
aaggctttctctac

SEQ ID NO: 992468 - DNA, 14 bp, Homo sapiens
aagggaaaaaagaa

SEQ ID NO: 992469 - DNA, 18 bp, Homo sapiens
aagggaaaaaagaaagaa

SEQ ID NO: 992470 - DNA, 12 bp, Homo sapiens
aagggaaaaata

SEQ ID NO: 992471 - DNA, 16 bp, Homo sapiens
aagggaaactggctga

SEQ ID NO: 992472 - DNA, 15 bp, Homo sapiens
aagggaaatatcatt

SEQ ID NO: 992473 - DNA, 12 bp, Homo sapiens
aagggaacacaa

SEQ ID NO: 992474 - DNA, 15 bp, Homo sapiens
aagggaacctgtgtc

SEQ ID NO: 992475 - DNA, 20 bp, Homo sapiens
aagggaagaaggaggaatgc

SEQ ID NO: 992476 - DNA, 18 bp, Homo sapiens
aagggaaggaactctggc

SEQ ID NO: 992477 - DNA, 18 bp, Homo sapiens
aagggaatactcacattt

SEQ ID NO: 992478 - DNA, 17 bp, Homo sapiens
aagggaatcctcctcca

SEQ ID NO: 992479 - DNA, 14 bp, Homo sapiens
aagggaatgcatta

SEQ ID NO: 992480 - DNA, 14 bp, Homo sapiens
aagggaattgctca

SEQ ID NO: 992481 - DNA, 13 bp, Homo sapiens
aagggacaggaga

SEQ ID NO: 992482 - DNA, 21 bp, Homo sapiens
aagggacaggtgggcctggcg

SEQ ID NO: 992483 - DNA, 19 bp, Homo sapiens
aagggaccctttgggggtt

SEQ ID NO: 992484 - DNA, 15 bp, Homo sapiens
aagggacgggggtgg

SEQ ID NO: 992485 - DNA, 13 bp, Homo sapiens
aagggagaaaaaa

SEQ ID NO: 992486 - DNA, 17 bp, Homo sapiens
aagggagaaagaaaact

SEQ ID NO: 992487 - DNA, 13 bp, Homo sapiens
aagggagaaatgc

SEQ ID NO: 992488 - DNA, 22 bp, Homo sapiens
aagggaggaaggcctttcttct

SEQ ID NO: 992489 - DNA, 18 bp, Homo sapiens
aagggagtttaaaaatgg

SEQ ID NO: 992490 - DNA, 16 bp, Homo sapiens
aagggatcctgcctgc

SEQ ID NO: 992491 - DNA, 15 bp, Homo sapiens
aagggatggcaccac

SEQ ID NO: 992492 - DNA, 22 bp, Homo sapiens
aagggatgttattatccttggg

SEQ ID NO: 992493 - DNA, 20 bp, Homo sapiens
aagggcaacagatcagtaaa

SEQ ID NO: 992494 - DNA, 22 bp, Homo sapiens
aagggcaacagatcagtaaaga

SEQ ID NO: 992495 - DNA, 15 bp, Homo sapiens
aagggcaagaaatgg

SEQ ID NO: 992496 - DNA, 12 bp, Homo sapiens
aagggcagccct

SEQ ID NO: 992497 - DNA, 17 bp, Homo sapiens
aagggcagccctccatg

SEQ ID NO: 992498 - DNA, 21 bp, Homo sapiens
aagggcaggaaggagagcctg

SEQ ID NO: 992499 - DNA, 22 bp, Homo sapiens
aagggcaggaaggagagcctgc

SEQ ID NO: 992500 - DNA, 22 bp, Homo sapiens
aagggcagggcatctcctgtgc

SEQ ID NO: 992501 - DNA, 11 bp, Homo sapiens
aagggcagtgc

SEQ ID NO: 992502 - DNA, 20 bp, Homo sapiens
aagggcagttttgaggcatg

SEQ ID NO: 992503 - DNA, 15 bp, Homo sapiens
aagggcataaagtaa

SEQ ID NO: 992504 - DNA, 19 bp, Homo sapiens
aagggcataccttgtgcat

SEQ ID NO: 992505 - DNA, 17 bp, Homo sapiens
aagggcatcaggcactg

SEQ ID NO: 992506 - DNA, 17 bp, Homo sapiens
aagggccaaacccactt

SEQ ID NO: 992507 - DNA, 17 bp, Homo sapiens
aagggccaccctgctgc

SEQ ID NO: 992508 - DNA, 21 bp, Homo sapiens
aagggccaccctgctgcacta

SEQ ID NO: 992509 - DNA, 17 bp, Homo sapiens
aagggccaggagatgga

SEQ ID NO: 992510 - DNA, 14 bp, Homo sapiens
aagggccagtcctg

SEQ ID NO: 992511 - DNA, 22 bp, Homo sapiens
aagggccagtcctgcctggcca

SEQ ID NO: 992512 - DNA, 19 bp, Homo sapiens
aagggccatgctgaaggga

SEQ ID NO: 992513 - DNA, 16 bp, Homo sapiens
aagggcccagattcta

SEQ ID NO: 992514 - DNA, 12 bp, Homo sapiens
aagggccccagg

SEQ ID NO: 992515 - DNA, 13 bp, Homo sapiens
aagggccccaggg

SEQ ID NO: 992516 - DNA, 20 bp, Homo sapiens
aagggcctggccagtcctgg

SEQ ID NO: 992517 - DNA, 21 bp, Homo sapiens
aagggctccagcatccagcct

SEQ ID NO: 992518 - DNA, 24 bp, Homo sapiens
aagggctccagcatccagcctgtg

SEQ ID NO: 992519 - DNA, 14 bp, Homo sapiens
aagggctgcatgat

SEQ ID NO: 992520 - DNA, 15 bp, Homo sapiens
aagggctgcatgatg

SEQ ID NO: 992521 - DNA, 17 bp, Homo sapiens
aagggctgcatgatgtt

SEQ ID NO: 992522 - DNA, 20 bp, Homo sapiens
aagggctgcatgatgtttgc

SEQ ID NO: 992523 - DNA, 17 bp, Homo sapiens
aagggctggctccccct

SEQ ID NO: 992524 - DNA, 16 bp, Homo sapiens
aagggctggggcggag

SEQ ID NO: 992525 - DNA, 17 bp, Homo sapiens
aagggctggggcggagc

SEQ ID NO: 992526 - DNA, 17 bp, Homo sapiens
aagggcttctgcaccct

SEQ ID NO: 992527 - DNA, 14 bp, Homo sapiens
aagggcttgaggtg

SEQ ID NO: 992528 - DNA, 17 bp, Homo sapiens
aaggggacacctgtaca

SEQ ID NO: 992529 - DNA, 16 bp, Homo sapiens
aaggggacccaagaaa

SEQ ID NO: 992530 - DNA, 16 bp, Homo sapiens
aaggggagaagggaat

SEQ ID NO: 992531 - DNA, 19 bp, Homo sapiens
aaggggagcacaaggcctt

SEQ ID NO: 992532 - DNA, 13 bp, Homo sapiens
aaggggaggagaa

SEQ ID NO: 992533 - DNA, 13 bp, Homo sapiens
aaggggaggaggg

SEQ ID NO: 992534 - DNA, 21 bp, Homo sapiens
aaggggcacaccactgccctg

SEQ ID NO: 992535 - DNA, 23 bp, Homo sapiens
aaggggcacaccactgccctgcc

SEQ ID NO: 992536 - DNA, 13 bp, Homo sapiens
aaggggcagcagg

SEQ ID NO: 992537 - DNA, 14 bp, Homo sapiens
aaggggcagcagga

SEQ ID NO: 992538 - DNA, 22 bp, Homo sapiens
aaggggcagcaggaggagtgga

SEQ ID NO: 992539 - DNA, 17 bp, Homo sapiens
aaggggcagccctgagt

SEQ ID NO: 992540 - DNA, 17 bp, Homo sapiens
aaggggcagtggtggtt

SEQ ID NO: 992541 - DNA, 17 bp, Homo sapiens
aaggggccagaggctcg

SEQ ID NO: 992542 - DNA, 16 bp, Homo sapiens
aaggggcccaagcccc

SEQ ID NO: 992543 - DNA, 17 bp, Homo sapiens
aaggggccccggggctg

SEQ ID NO: 992544 - DNA, 20 bp, Homo sapiens
aaggggccccggggctggca

SEQ ID NO: 992545 - DNA, 21 bp, Homo sapiens
aaggggccctggtccttccag

SEQ ID NO: 992546 - DNA, 21 bp, Homo sapiens
aaggggcccttggagcgtgga

SEQ ID NO: 992547 - DNA, 17 bp, Homo sapiens
aaggggccggggagggg

SEQ ID NO: 992548 - DNA, 13 bp, Homo sapiens
aaggggcctccct

SEQ ID NO: 992549 - DNA, 19 bp, Homo sapiens
aaggggccttgctctgagc

SEQ ID NO: 992550 - DNA, 20 bp, Homo sapiens
aaggggcggtgcccacaccg

SEQ ID NO: 992551 - DNA, 18 bp, Homo sapiens
aaggggcgtctgttcccc

SEQ ID NO: 992552 - DNA, 20 bp, Homo sapiens
aaggggctcttcatctgcct

SEQ ID NO: 992553 - DNA, 20 bp, Homo sapiens
aaggggctgcgctagcagcc

SEQ ID NO: 992554 - DNA, 21 bp, Homo sapiens
aaggggctgcgctagcagccc

SEQ ID NO: 992555 - DNA, 15 bp, Homo sapiens
aagggggaggagtca

SEQ ID NO: 992556 - DNA, 22 bp, Homo sapiens
aagggggctctgccccaggccc

SEQ ID NO: 992557 - DNA, 15 bp, Homo sapiens
aagggggtagaagta

SEQ ID NO: 992558 - DNA, 16 bp, Homo sapiens
aagggggtccacccag

SEQ ID NO: 992559 - DNA, 19 bp, Homo sapiens
aagggggtcccagtgggag

SEQ ID NO: 992560 - DNA, 14 bp, Homo sapiens
aagggggtctctgt

SEQ ID NO: 992561 - DNA, 13 bp, Homo sapiens
aagggggtgactg

SEQ ID NO: 992562 - DNA, 15 bp, Homo sapiens
aagggggtgactgga

SEQ ID NO: 992563 - DNA, 17 bp, Homo sapiens
aaggggtcaaaatttgc

SEQ ID NO: 992564 - DNA, 20 bp, Homo sapiens
aaggggtcggctaagtggga

SEQ ID NO: 992565 - DNA, 17 bp, Homo sapiens
aaggggtgcttttatag

SEQ ID NO: 992566 - DNA, 23 bp, Homo sapiens
aaggggtgggtcagaacatgtta

SEQ ID NO: 992567 - DNA, 19 bp, Homo sapiens
aaggggttggggtgacagt

SEQ ID NO: 992568 - DNA, 19 bp, Homo sapiens
aaggggttttttgggaaga

SEQ ID NO: 992569 - DNA, 16 bp, Homo sapiens
aagggtcatagaaagg

SEQ ID NO: 992570 - DNA, 13 bp, Homo sapiens
aagggtccagaag

SEQ ID NO: 992571 - DNA, 20 bp, Homo sapiens
aagggtctagggagagaccc

SEQ ID NO: 992572 - DNA, 16 bp, Homo sapiens
aagggtcttcttggca

SEQ ID NO: 992573 - DNA, 22 bp, Homo sapiens
aagggtggaaatcaaccctctc

SEQ ID NO: 992574 - DNA, 20 bp, Homo sapiens
aagggtggatgacagggcag

SEQ ID NO: 992575 - DNA, 18 bp, Homo sapiens
aagggtggcaggtcactg

SEQ ID NO: 992576 - DNA, 18 bp, Homo sapiens
aagggtgggtgctcagaa

SEQ ID NO: 992577 - DNA, 19 bp, Homo sapiens
aagggtgtaggggccacct

SEQ ID NO: 992578 - DNA, 22 bp, Homo sapiens
aagggtgtaggggccacctcct

SEQ ID NO: 992579 - DNA, 21 bp, Homo sapiens
aagggtgttgggagggtggtt

SEQ ID NO: 992580 - DNA, 16 bp, Homo sapiens
aagggttaaggcctga

SEQ ID NO: 992581 - DNA, 22 bp, Homo sapiens
aagggttgtgagccccttgggg

SEQ ID NO: 992582 - DNA, 19 bp, Homo sapiens
aagggtttcgactggtcca

SEQ ID NO: 992583 - DNA, 14 bp, Homo sapiens
aagggtttctctat

SEQ ID NO: 992584 - DNA, 12 bp, Homo sapiens
aaggtaaaatca

SEQ ID NO: 992585 - DNA, 17 bp, Homo sapiens
aaggtaaaatcacttca

SEQ ID NO: 992586 - DNA, 16 bp, Homo sapiens
aaggtaaaattgaaag

SEQ ID NO: 992587 - DNA, 18 bp, Homo sapiens
aaggtaagctcaggatat

SEQ ID NO: 992588 - DNA, 21 bp, Homo sapiens
aaggtaataacattttataca

SEQ ID NO: 992589 - DNA, 14 bp, Homo sapiens
aaggtaattgtttt

SEQ ID NO: 992590 - DNA, 19 bp, Homo sapiens
aaggtaccaaacaaggaag

SEQ ID NO: 992591 - DNA, 19 bp, Homo sapiens
aaggtactttcatatttta

SEQ ID NO: 992592 - DNA, 12 bp, Homo sapiens
aaggtagctcta

SEQ ID NO: 992593 - DNA, 20 bp, Homo sapiens
aaggtatcagttatatgata

SEQ ID NO: 992594 - DNA, 22 bp, Homo sapiens
aaggtattaaattgatgttgct

SEQ ID NO: 992595 - DNA, 18 bp, Homo sapiens
aaggtattccttttgtgt

SEQ ID NO: 992596 - DNA, 22 bp, Homo sapiens
aaggtattccttttgtgtacag

SEQ ID NO: 992597 - DNA, 22 bp, Homo sapiens
aaggtattctattctaataact

SEQ ID NO: 992598 - DNA, 17 bp, Homo sapiens
aaggtatttcgaaactg

SEQ ID NO: 992599 - DNA, 20 bp, Homo sapiens
aaggtatttcgaaactgcca

SEQ ID NO: 992600 - DNA, 23 bp, Homo sapiens
aaggtatttctccagttgggact

SEQ ID NO: 992601 - DNA, 18 bp, Homo sapiens
aaggtattttgtagatgt

SEQ ID NO: 992602 - DNA, 20 bp, Homo sapiens
aaggtattttgtagatgtga

SEQ ID NO: 992603 - DNA, 14 bp, Homo sapiens
aaggtcaaatttat

SEQ ID NO: 992604 - DNA, 14 bp, Homo sapiens
aaggtcaatgtcaa

SEQ ID NO: 992605 - DNA, 15 bp, Homo sapiens
aaggtcactgtttcc

SEQ ID NO: 992606 - DNA, 16 bp, Homo sapiens
aaggtcagcgagaagg

SEQ ID NO: 992607 - DNA, 19 bp, Homo sapiens
aaggtcagcgagaaggagt

SEQ ID NO: 992608 - DNA, 21 bp, Homo sapiens
aaggtccaacaagaatgcatt

SEQ ID NO: 992609 - DNA, 18 bp, Homo sapiens
aaggtccaggcttgcctc

SEQ ID NO: 992610 - DNA, 13 bp, Homo sapiens
aaggtccagtgga

SEQ ID NO: 992611 - DNA, 23 bp, Homo sapiens
aaggtccttgcctgaactccaga

SEQ ID NO: 992612 - DNA, 16 bp, Homo sapiens
aaggtctaactgtgga

SEQ ID NO: 992613 - DNA, 13 bp, Homo sapiens
aaggtcttcttgt

SEQ ID NO: 992614 - DNA, 12 bp, Homo sapiens
aaggtctttcag

SEQ ID NO: 992615 - DNA, 13 bp, Homo sapiens
aaggtctttggtt

SEQ ID NO: 992616 - DNA, 15 bp, Homo sapiens
aaggtgaaggaatat

SEQ ID NO: 992617 - DNA, 18 bp, Homo sapiens
aaggtgaaggaatatatg

SEQ ID NO: 992618 - DNA, 15 bp, Homo sapiens
aaggtgaatgaaaga

SEQ ID NO: 992619 - DNA, 21 bp, Homo sapiens
aaggtgagtttgagctgcctt

SEQ ID NO: 992620 - DNA, 17 bp, Homo sapiens
aaggtgatatatttaaa

SEQ ID NO: 992621 - DNA, 23 bp, Homo sapiens
aaggtgcagttcccccaacctca

SEQ ID NO: 992622 - DNA, 19 bp, Homo sapiens
aaggtgcctcagttttcct

SEQ ID NO: 992623 - DNA, 12 bp, Homo sapiens
aaggtgcctcat

SEQ ID NO: 992624 - DNA, 20 bp, Homo sapiens
aaggtgcctcatagcatagc

SEQ ID NO: 992625 - DNA, 20 bp, Homo sapiens
aaggtgcctgtgaggcaggg

SEQ ID NO: 992626 - DNA, 13 bp, Homo sapiens
aaggtgctaacat

SEQ ID NO: 992627 - DNA, 13 bp, Homo sapiens
aaggtgctcttga

SEQ ID NO: 992628 - DNA, 14 bp, Homo sapiens
aaggtgctgagctt

SEQ ID NO: 992629 - DNA, 13 bp, Homo sapiens
aaggtggagggaa

SEQ ID NO: 992630 - DNA, 16 bp, Homo sapiens
aaggtggagggaagga

SEQ ID NO: 992631 - DNA, 17 bp, Homo sapiens
aaggtggagtttctctg

SEQ ID NO: 992632 - DNA, 19 bp, Homo sapiens
aaggtggatggccccagca

SEQ ID NO: 992633 - DNA, 18 bp, Homo sapiens
aaggtggcaatgcttaaa

SEQ ID NO: 992634 - DNA, 23 bp, Homo sapiens
aaggtggcatccgaaggtgtctc

SEQ ID NO: 992635 - DNA, 14 bp, Homo sapiens
aaggtggccacagc

SEQ ID NO: 992636 - DNA, 21 bp, Homo sapiens
aaggtggcctctgcctggggc

SEQ ID NO: 992637 - DNA, 11 bp, Homo sapiens
aaggtgggagg

SEQ ID NO: 992638 - DNA, 18 bp, Homo sapiens
aaggtgggctgagccctg

SEQ ID NO: 992639 - DNA, 22 bp, Homo sapiens
aaggtggggacctggggggagg

SEQ ID NO: 992640 - DNA, 23 bp, Homo sapiens
aaggtggggacctggggggaggg

SEQ ID NO: 992641 - DNA, 15 bp, Homo sapiens
aaggtgggtccagga

SEQ ID NO: 992642 - DNA, 21 bp, Homo sapiens
aaggtgggtccaggaaggcag

SEQ ID NO: 992643 - DNA, 16 bp, Homo sapiens
aaggtggtgtgatctt

SEQ ID NO: 992644 - DNA, 17 bp, Homo sapiens
aaggtgtccttttcctt

SEQ ID NO: 992645 - DNA, 19 bp, Homo sapiens
aaggtgtcttttccactcc

SEQ ID NO: 992646 - DNA, 21 bp, Homo sapiens
aaggtgtttccatttctcaat

SEQ ID NO: 992647 - DNA, 16 bp, Homo sapiens
aaggttaataaagtaa

SEQ ID NO: 992648 - DNA, 22 bp, Homo sapiens
aaggttaattctctagggctag

SEQ ID NO: 992649 - DNA, 21 bp, Homo sapiens
aaggttactcagcagcagaga

SEQ ID NO: 992650 - DNA, 15 bp, Homo sapiens
aaggttactgagtga

SEQ ID NO: 992651 - DNA, 15 bp, Homo sapiens
aaggttatgaaacat

SEQ ID NO: 992652 - DNA, 20 bp, Homo sapiens
aaggttatgaaacatatcat

SEQ ID NO: 992653 - DNA, 22 bp, Homo sapiens
aaggttcctaggcattgcagga

SEQ ID NO: 992654 - DNA, 13 bp, Homo sapiens
aaggttctatctg

SEQ ID NO: 992655 - DNA, 16 bp, Homo sapiens
aagtagttggtttgta

SEQ ID NO: 992656 - DNA, 17 bp, Homo sapiens
aagtagttggtttgtat

SEQ ID NO: 992657 - DNA, 12 bp, Homo sapiens
aagtagtttgta

SEQ ID NO: 992658 - DNA, 23 bp, Homo sapiens
aagtataaagtcacttccagtgt

SEQ ID NO: 992659 - DNA, 19 bp, Homo sapiens
aagtataatctttctatag

SEQ ID NO: 992660 - DNA, 13 bp, Homo sapiens
aagtataatgttt

SEQ ID NO: 992661 - DNA, 20 bp, Homo sapiens
aagtataatgtttattaaat

SEQ ID NO: 992662 - DNA, 22 bp, Homo sapiens
aagtataatgtttattaaatgc

SEQ ID NO: 992663 - DNA, 14 bp, Homo sapiens
aagtatacctggct

SEQ ID NO: 992664 - DNA, 16 bp, Homo sapiens
aagtatacctggcttt

SEQ ID NO: 992665 - DNA, 18 bp, Homo sapiens
aagtatactgtattttta

SEQ ID NO: 992666 - DNA, 12 bp, Homo sapiens
aagtatagaaaa

SEQ ID NO: 992667 - DNA, 22 bp, Homo sapiens
aagtatataatttttttatgtt

SEQ ID NO: 992668 - DNA, 15 bp, Homo sapiens
aagtcatcctcctgg

SEQ ID NO: 992669 - DNA, 21 bp, Homo sapiens
aagtcatctatagttgatatg

SEQ ID NO: 992670 - DNA, 23 bp, Homo sapiens
aagtcatcttgctaccagtattt

SEQ ID NO: 992671 - DNA, 23 bp, Homo sapiens
aagtcatgaagcccaagtgaaat

SEQ ID NO: 992672 - DNA, 17 bp, Homo sapiens
aagtcatggagaatctg

SEQ ID NO: 992673 - DNA, 20 bp, Homo sapiens
aagtcatggcaggtacagta

SEQ ID NO: 992674 - DNA, 20 bp, Homo sapiens
aagtcatgggaacgcagcct

SEQ ID NO: 992675 - DNA, 19 bp, Homo sapiens
aagtcatgtatgtttctct

SEQ ID NO: 992676 - DNA, 18 bp, Homo sapiens
aagtcattagaatgtcct

SEQ ID NO: 992677 - DNA, 15 bp, Homo sapiens
aagtcattttcatgt

SEQ ID NO: 992678 - DNA, 14 bp, Homo sapiens
aagtcattttgtaa

SEQ ID NO: 992679 - DNA, 22 bp, Homo sapiens
aagtccaaattgtttgtacagt

SEQ ID NO: 992680 - DNA, 12 bp, Homo sapiens
aagtccaatgtg

SEQ ID NO: 992681 - DNA, 18 bp, Homo sapiens
aagtccaattttaattta

SEQ ID NO: 992682 - DNA, 19 bp, Homo sapiens
aagtccaattttaatttag

SEQ ID NO: 992683 - DNA, 21 bp, Homo sapiens
aagtccactgtcctccttggc

SEQ ID NO: 992684 - DNA, 19 bp, Homo sapiens
aagtccagatttacactgg

SEQ ID NO: 992685 - DNA, 23 bp, Homo sapiens
aagtccagatttacactgggaga

SEQ ID NO: 992686 - DNA, 19 bp, Homo sapiens
aagtccattttttaaaaat

SEQ ID NO: 992687 - DNA, 21 bp, Homo sapiens
aagtccccgagggcgaaggcc

SEQ ID NO: 992688 - DNA, 22 bp, Homo sapiens
aagtccccgtggaggttctgta

SEQ ID NO: 992689 - DNA, 20 bp, Homo sapiens
aagtccctccctgcctgagg

SEQ ID NO: 992690 - DNA, 16 bp, Homo sapiens
aagtcctaacttcctg

SEQ ID NO: 992691 - DNA, 19 bp, Homo sapiens
aagtcctccctctctactg

SEQ ID NO: 992692 - DNA, 21 bp, Homo sapiens
aagtcctccctgacttttctg

SEQ ID NO: 992693 - DNA, 17 bp, Homo sapiens
aagtcctctgctccagc

SEQ ID NO: 992694 - DNA, 17 bp, Homo sapiens
aagtcctgaagaggcgg

SEQ ID NO: 992695 - DNA, 22 bp, Homo sapiens
aagtcctgaagaggcgggccag

SEQ ID NO: 992696 - DNA, 12 bp, Homo sapiens
aagtcctgcttt

SEQ ID NO: 992697 - DNA, 15 bp, Homo sapiens
aagtcctgtcactga

SEQ ID NO: 992698 - DNA, 18 bp, Homo sapiens
aagtccttacctcttccg

SEQ ID NO: 992699 - DNA, 20 bp, Homo sapiens
aagtccttcagtgagcccct

SEQ ID NO: 992700 - DNA, 15 bp, Homo sapiens
aagtcgagcactcta

SEQ ID NO: 992701 - DNA, 18 bp, Homo sapiens
aagtcgccagtcactgct

SEQ ID NO: 992702 - DNA, 20 bp, Homo sapiens
aagtcgccagtcactgctgc

SEQ ID NO: 992703 - DNA, 21 bp, Homo sapiens
aagtcgccagtcactgctgca

SEQ ID NO: 992704 - DNA, 15 bp, Homo sapiens
aagtcggatgtcaga

SEQ ID NO: 992705 - DNA, 14 bp, Homo sapiens
aagtcggggcctgg

SEQ ID NO: 992706 - DNA, 22 bp, Homo sapiens
aagtcgggtcaaaaataaaata

SEQ ID NO: 992707 - DNA, 18 bp, Homo sapiens
aagtctaaaaagacctgg

SEQ ID NO: 992708 - DNA, 16 bp, Homo sapiens
aagtctaattcacagg

SEQ ID NO: 992709 - DNA, 22 bp, Homo sapiens
aagtctaggagctgggaggaaa

SEQ ID NO: 992710 - DNA, 14 bp, Homo sapiens
aagtctagtcttct

SEQ ID NO: 992711 - DNA, 13 bp, Homo sapiens
aagtctataaaaa

SEQ ID NO: 992712 - DNA, 11 bp, Homo sapiens
aagtctatttt

SEQ ID NO: 992713 - DNA, 12 bp, Homo sapiens
aagtctattttt

SEQ ID NO: 992714 - DNA, 20 bp, Homo sapiens
aagtctcacccattatctgg

SEQ ID NO: 992715 - DNA, 21 bp, Homo sapiens
aagtctcacccattatctgga

SEQ ID NO: 992716 - DNA, 11 bp, Homo sapiens
aagtctcagct

SEQ ID NO: 992717 - DNA, 20 bp, Homo sapiens
aagtctcataggttaaaaaa

SEQ ID NO: 992718 - DNA, 12 bp, Homo sapiens
aagtctcattcg

SEQ ID NO: 992719 - DNA, 12 bp, Homo sapiens
aagtctcctgtc

SEQ ID NO: 992720 - DNA, 20 bp, Homo sapiens
aagtctcctttactgaatgt

SEQ ID NO: 992721 - DNA, 22 bp, Homo sapiens
aagtctcgaatgtaattggaat

SEQ ID NO: 992722 - DNA, 15 bp, Homo sapiens
aagtctctctgtgaa

SEQ ID NO: 992723 - DNA, 18 bp, Homo sapiens
aagtctgccgcccacctc

SEQ ID NO: 992724 - DNA, 17 bp, Homo sapiens
aagtctgggatgtagaa

SEQ ID NO: 992725 - DNA, 16 bp, Homo sapiens
aagtctgtatggcatg

SEQ ID NO: 992726 - DNA, 23 bp, Homo sapiens
aagtctgtctttctatagaaata

SEQ ID NO: 992727 - DNA, 23 bp, Homo sapiens
aagtctgtgtgatgaactttctc

SEQ ID NO: 992728 - DNA, 22 bp, Homo sapiens
aagtctgttatttattattaat

SEQ ID NO: 992729 - DNA, 22 bp, Homo sapiens
aagtcttgggtctgaatttatt

SEQ ID NO: 992730 - DNA, 22 bp, Homo sapiens
aagtcttttctgtcaccaaatt

SEQ ID NO: 992731 - DNA, 23 bp, Homo sapiens
aagtctttttcattttgcagaag

SEQ ID NO: 992732 - DNA, 16 bp, Homo sapiens
aagtcttttttgatca

SEQ ID NO: 992733 - DNA, 16 bp, Homo sapiens
aagtgaaaaaaagaaa

SEQ ID NO: 992734 - DNA, 21 bp, Homo sapiens
aagtgaaaaaggaggaagaga

SEQ ID NO: 992735 - DNA, 18 bp, Homo sapiens
aagtgaaattaagcattt

SEQ ID NO: 992736 - DNA, 12 bp, Homo sapiens
aagtgaactttt

SEQ ID NO: 992737 - DNA, 17 bp, Homo sapiens
aagtgaacttttgtaat

SEQ ID NO: 992738 - DNA, 19 bp, Homo sapiens
aagtgaacttttgtaattt

SEQ ID NO: 992739 - DNA, 13 bp, Homo sapiens
aagtgaagactgg

SEQ ID NO: 992740 - DNA, 15 bp, Homo sapiens
aagtgaagagtcaga

SEQ ID NO: 992741 - DNA, 16 bp, Homo sapiens
aagtgaagagtcagaa

SEQ ID NO: 992742 - DNA, 13 bp, Homo sapiens
aagtgaaggaaat

SEQ ID NO: 992743 - DNA, 14 bp, Homo sapiens
aagtgaaggaaata

SEQ ID NO: 992744 - DNA, 14 bp, Homo sapiens
aagtgaagtgatac

SEQ ID NO: 992745 - DNA, 14 bp, Homo sapiens
aagtgaatccttaa

SEQ ID NO: 992746 - DNA, 15 bp, Homo sapiens
aagtgaattgaagtt

SEQ ID NO: 992747 - DNA, 14 bp, Homo sapiens
aagtgaatttgaat

SEQ ID NO: 992748 - DNA, 16 bp, Homo sapiens
aagtgaatttgaatga

SEQ ID NO: 992749 - DNA, 15 bp, Homo sapiens
aagtgaatttgcctg

SEQ ID NO: 992750 - DNA, 17 bp, Homo sapiens
aagtgaatttgcctgta

SEQ ID NO: 992751 - DNA, 17 bp, Homo sapiens
aagtgaatttttctcta

SEQ ID NO: 992752 - DNA, 18 bp, Homo sapiens
aagtgacaaggccccaga

SEQ ID NO: 992753 - DNA, 19 bp, Homo sapiens
aagtgacacattaatgata

SEQ ID NO: 992754 - DNA, 12 bp, Homo sapiens
aagtgacataat

SEQ ID NO: 992755 - DNA, 13 bp, Homo sapiens
aagtgaccaggga

SEQ ID NO: 992756 - DNA, 14 bp, Homo sapiens
aagtgaccagggaa

SEQ ID NO: 992757 - DNA, 23 bp, Homo sapiens
aagtgaccagggaagtgtgtgtg

SEQ ID NO: 992758 - DNA, 14 bp, Homo sapiens
aagtgactctcctg

SEQ ID NO: 992759 - DNA, 16 bp, Homo sapiens
aagtgactgtatctgt

SEQ ID NO: 992760 - DNA, 17 bp, Homo sapiens
aagtgactgtatctgtg

SEQ ID NO: 992761 - DNA, 19 bp, Homo sapiens
aagtgactttaaaagaaaa

SEQ ID NO: 992762 - DNA, 14 bp, Homo sapiens
aagtgagaaaactg

SEQ ID NO: 992763 - DNA, 20 bp, Homo sapiens
aagtgagagacctctgccta

SEQ ID NO: 992764 - DNA, 17 bp, Homo sapiens
aagtgagagagacaaga

SEQ ID NO: 992765 - DNA, 12 bp, Homo sapiens
aagtgagagggg

SEQ ID NO: 992766 - DNA, 15 bp, Homo sapiens
aagtgagaggggagg

SEQ ID NO: 992767 - DNA, 18 bp, Homo sapiens
aagtgagatggtatgaaa

SEQ ID NO: 992768 - DNA, 19 bp, Homo sapiens
aagtgagatggtatgaaat

SEQ ID NO: 992769 - DNA, 12 bp, Homo sapiens
aagtgagcagaa

SEQ ID NO: 992770 - DNA, 17 bp, Homo sapiens
aagtgagcagaacaggt

SEQ ID NO: 992771 - DNA, 12 bp, Homo sapiens
aagtgaggccca

SEQ ID NO: 992772 - DNA, 13 bp, Homo sapiens
aagtgaggcccaa

SEQ ID NO: 992773 - DNA, 19 bp, Homo sapiens
aagtgagggctcactcagc

SEQ ID NO: 992774 - DNA, 21 bp, Homo sapiens
aagtgagggctcactcagcca

SEQ ID NO: 992775 - DNA, 17 bp, Homo sapiens
aagtgagtctggtggag

SEQ ID NO: 992776 - DNA, 18 bp, Homo sapiens
aagtgagtctggtggagg

SEQ ID NO: 992777 - DNA, 13 bp, Homo sapiens
aagtgataaattc

SEQ ID NO: 992778 - DNA, 13 bp, Homo sapiens
aagtgataagtgc

SEQ ID NO: 992779 - DNA, 16 bp, Homo sapiens
aagtgatatcacctct

SEQ ID NO: 992780 - DNA, 14 bp, Homo sapiens
aagtgatcaataaa

SEQ ID NO: 992781 - DNA, 23 bp, Homo sapiens
aagtgatcaataaaatgtgattt

SEQ ID NO: 992782 - DNA, 19 bp, Homo sapiens
aagtgatgctgtgatacct

SEQ ID NO: 992783 - DNA, 20 bp, Homo sapiens
aagtgatgtattttcatagt

SEQ ID NO: 992784 - DNA, 22 bp, Homo sapiens
aagtgctgcatttaaaagatac

SEQ ID NO: 992785 - DNA, 13 bp, Homo sapiens
aagtgctgggatg

SEQ ID NO: 992786 - DNA, 17 bp, Homo sapiens
aagtgctgggattacag

SEQ ID NO: 992787 - DNA, 21 bp, Homo sapiens
aagtgctgggattgtgggcat

SEQ ID NO: 992788 - DNA, 22 bp, Homo sapiens
aagtgctggggaccttaagtga

SEQ ID NO: 992789 - DNA, 17 bp, Homo sapiens
aagtgctgtttattaat

SEQ ID NO: 992790 - DNA, 17 bp, Homo sapiens
aagtgcttaaaaatact

SEQ ID NO: 992791 - DNA, 17 bp, Homo sapiens
aagtgcttataatgtgt

SEQ ID NO: 992792 - DNA, 16 bp, Homo sapiens
aagtgcttcacatttg

SEQ ID NO: 992793 - DNA, 17 bp, Homo sapiens
aagtgcttcacatttgt

SEQ ID NO: 992794 - DNA, 23 bp, Homo sapiens
aagtgcttggaacatactgttca

SEQ ID NO: 992795 - DNA, 21 bp, Homo sapiens
aagtgctttacctaagtgttg

SEQ ID NO: 992796 - DNA, 19 bp, Homo sapiens
aagtggaaaaatagcctgc

SEQ ID NO: 992797 - DNA, 16 bp, Homo sapiens
aagtggaagtatgtat

SEQ ID NO: 992798 - DNA, 19 bp, Homo sapiens
aagtggaccaggacaggac

SEQ ID NO: 992799 - DNA, 17 bp, Homo sapiens
aagtggactcagggcag

SEQ ID NO: 992800 - DNA, 16 bp, Homo sapiens
aagtggagacagtcct

SEQ ID NO: 992801 - DNA, 18 bp, Homo sapiens
aagtggaggttgagtgag

SEQ ID NO: 992802 - DNA, 21 bp, Homo sapiens
aagtggatgggaatttgtcag

SEQ ID NO: 992803 - DNA, 16 bp, Homo sapiens
aagtggattggctttg

SEQ ID NO: 992804 - DNA, 13 bp, Homo sapiens
aagtggcagttct

SEQ ID NO: 992805 - DNA, 13 bp, Homo sapiens
aagtggccctccc

SEQ ID NO: 992806 - DNA, 24 bp, Homo sapiens
aagtggccctccctcagcggaggg

SEQ ID NO: 992807 - DNA, 17 bp, Homo sapiens
aagtggctccccacctg

SEQ ID NO: 992808 - DNA, 18 bp, Homo sapiens
aagtggctccccacctgg

SEQ ID NO: 992809 - DNA, 14 bp, Homo sapiens
aagtggctggtctg

SEQ ID NO: 992810 - DNA, 15 bp, Homo sapiens
aagtggctgtgacat

SEQ ID NO: 992811 - DNA, 17 bp, Homo sapiens
aagtgggagcagcttct

SEQ ID NO: 992812 - DNA, 19 bp, Homo sapiens
aagtgggaggtcaggaaac

SEQ ID NO: 992813 - DNA, 16 bp, Homo sapiens
aagtgggccaggacag

SEQ ID NO: 992814 - DNA, 22 bp, Homo sapiens
aagtgggctgcagcagccggaa

SEQ ID NO: 992815 - DNA, 23 bp, Homo sapiens
aagtgggctggtattctctctat

SEQ ID NO: 992816 - DNA, 16 bp, Homo sapiens
aagtgggcttgattct

SEQ ID NO: 992817 - DNA, 17 bp, Homo sapiens
aagtggggctaaatgaa

SEQ ID NO: 992818 - DNA, 19 bp, Homo sapiens
aagtggggctaaatgaagt

SEQ ID NO: 992819 - DNA, 13 bp, Homo sapiens
aagtggggctcgc

SEQ ID NO: 992820 - DNA, 13 bp, Homo sapiens
aagtggtatagaa

SEQ ID NO: 992821 - DNA, 17 bp, Homo sapiens
aagtggtatagaaatgc

SEQ ID NO: 992822 - DNA, 23 bp, Homo sapiens
aagtggtctgtggatcagcattt

SEQ ID NO: 992823 - DNA, 23 bp, Homo sapiens
aagtggtgctataagttttagaa

SEQ ID NO: 992824 - DNA, 17 bp, Homo sapiens
aagtgtaacagctgagg

SEQ ID NO: 992825 - DNA, 11 bp, Homo sapiens
aagtgtaactg

SEQ ID NO: 992826 - DNA, 12 bp, Homo sapiens
aagtgtacaatt

SEQ ID NO: 992827 - DNA, 20 bp, Homo sapiens
aagtgtagatagttaaaaga

SEQ ID NO: 992828 - DNA, 18 bp, Homo sapiens
aagtgtagatgtagcatt

SEQ ID NO: 992829 - DNA, 14 bp, Homo sapiens
aagtgtaggccacc

SEQ ID NO: 992830 - DNA, 15 bp, Homo sapiens
aagtgtagggcaagg

SEQ ID NO: 992831 - DNA, 23 bp, Homo sapiens
aagtgtagggcaagggtgcctca

SEQ ID NO: 992832 - DNA, 14 bp, Homo sapiens
aagtgtatctcctt

SEQ ID NO: 992833 - DNA, 23 bp, Homo sapiens
aagtgtatgagttgcatttgtaa

SEQ ID NO: 992834 - DNA, 18 bp, Homo sapiens
aagtgtatgcacgtgtgc

SEQ ID NO: 992835 - DNA, 21 bp, Homo sapiens
aagtgtatttggaaataaagt

SEQ ID NO: 992836 - DNA, 15 bp, Homo sapiens
aagtgtatttttcaa

SEQ ID NO: 992837 - DNA, 22 bp, Homo sapiens
aagtgtatttttcaataaagca

SEQ ID NO: 992838 - DNA, 15 bp, Homo sapiens
aagtgtcaccctgtg

SEQ ID NO: 992839 - DNA, 16 bp, Homo sapiens
aagtgtcaccctgtgg

SEQ ID NO: 992840 - DNA, 19 bp, Homo sapiens
aagtgtctcaaaggagctt

SEQ ID NO: 992841 - DNA, 15 bp, Homo sapiens
aagtgtcttaaattt

SEQ ID NO: 992842 - DNA, 13 bp, Homo sapiens
aagtgtcttctgt

SEQ ID NO: 992843 - DNA, 14 bp, Homo sapiens
aagtgtcttttaaa

SEQ ID NO: 992844 - DNA, 15 bp, Homo sapiens
aagtgtcttttaaac

SEQ ID NO: 992845 - DNA, 17 bp, Homo sapiens
aagtgtgaacaaaagat

SEQ ID NO: 992846 - DNA, 20 bp, Homo sapiens
aagttgcgacggagagaaaa

SEQ ID NO: 992847 - DNA, 18 bp, Homo sapiens
aagttgctgtaaaatttg

SEQ ID NO: 992848 - DNA, 23 bp, Homo sapiens
aagttgctgtttattttttttgg

SEQ ID NO: 992849 - DNA, 23 bp, Homo sapiens
aagttggagttttgtttcctctg

SEQ ID NO: 992850 - DNA, 19 bp, Homo sapiens
aagttggcacatttcatga

SEQ ID NO: 992851 - DNA, 16 bp, Homo sapiens
aagttgggactctgga

SEQ ID NO: 992852 - DNA, 19 bp, Homo sapiens
aagttgggatctaggagag

SEQ ID NO: 992853 - DNA, 16 bp, Homo sapiens
aagttgggtgtttcca

SEQ ID NO: 992854 - DNA, 15 bp, Homo sapiens
aagttgtaaaataga

SEQ ID NO: 992855 - DNA, 17 bp, Homo sapiens
aagttgtaaataatttt

SEQ ID NO: 992856 - DNA, 18 bp, Homo sapiens
aagttgtaacttatattg

SEQ ID NO: 992857 - DNA, 19 bp, Homo sapiens
aagttgtaacttatattga

SEQ ID NO: 992858 - DNA, 17 bp, Homo sapiens
aagttgtcaaagaagct

SEQ ID NO: 992859 - DNA, 18 bp, Homo sapiens
aagttgtcaaagaagctt

SEQ ID NO: 992860 - DNA, 14 bp, Homo sapiens
aagttgtcttaaaa

SEQ ID NO: 992861 - DNA, 22 bp, Homo sapiens
aagttgtgattacctgctgcat

SEQ ID NO: 992862 - DNA, 18 bp, Homo sapiens
aagttgtgcttttctgtt

SEQ ID NO: 992863 - DNA, 18 bp, Homo sapiens
aagttgttgtaacctgct

SEQ ID NO: 992864 - DNA, 18 bp, Homo sapiens
aagtttacaatcaaagga

SEQ ID NO: 992865 - DNA, 20 bp, Homo sapiens
aagtttacacctttatcttt

SEQ ID NO: 992866 - DNA, 11 bp, Homo sapiens
aagtttagaga

SEQ ID NO: 992867 - DNA, 20 bp, Homo sapiens
aagtttatcagtaaataact

SEQ ID NO: 992868 - DNA, 12 bp, Homo sapiens
aagtttattctc

SEQ ID NO: 992869 - DNA, 21 bp, Homo sapiens
aagtttattgtttgatgtttt

SEQ ID NO: 992870 - DNA, 13 bp, Homo sapiens
aagtttatttctc

SEQ ID NO: 992871 - DNA, 15 bp, Homo sapiens
aagtttatttgagaa

SEQ ID NO: 992872 - DNA, 17 bp, Homo sapiens
aagtttattttttctac

SEQ ID NO: 992873 - DNA, 19 bp, Homo sapiens
aagtttcaagttttaaagt

SEQ ID NO: 992874 - DNA, 16 bp, Homo sapiens
aagtttcaatgtgatt

SEQ ID NO: 992875 - DNA, 21 bp, Homo sapiens
aagtttcacaggtcaataaac

SEQ ID NO: 992876 - DNA, 14 bp, Homo sapiens
aagtttcagacagg

SEQ ID NO: 992877 - DNA, 18 bp, Homo sapiens
aagtttcagagtatattg

SEQ ID NO: 992878 - DNA, 19 bp, Homo sapiens
aagtttcagtattagatgc

SEQ ID NO: 992879 - DNA, 23 bp, Homo sapiens
aagtttcattctccctttcacta

SEQ ID NO: 992880 - DNA, 13 bp, Homo sapiens
aagtttcatttat

SEQ ID NO: 992881 - DNA, 18 bp, Homo sapiens
aagtttccatatgttata

SEQ ID NO: 992882 - DNA, 19 bp, Homo sapiens
aagtttctagctagaaata

SEQ ID NO: 992883 - DNA, 13 bp, Homo sapiens
aagtttgaacatt

SEQ ID NO: 992884 - DNA, 10 bp, Homo sapiens
aagtttgaat

SEQ ID NO: 992885 - DNA, 21 bp, Homo sapiens
aagtttgaattcctaaaatta

SEQ ID NO: 992886 - DNA, 15 bp, Homo sapiens
aagtttgaatttgta

SEQ ID NO: 992887 - DNA, 16 bp, Homo sapiens
aagtttgaccagtgca

SEQ ID NO: 992888 - DNA, 20 bp, Homo sapiens
aagtttgagatcagcctggg

SEQ ID NO: 992889 - DNA, 14 bp, Homo sapiens
aagtttgcactgta

SEQ ID NO: 992890 - DNA, 13 bp, Homo sapiens
aagtttgctaaaa

SEQ ID NO: 992891 - DNA, 12 bp, Homo sapiens
aagtttgtagcc

SEQ ID NO: 992892 - DNA, 19 bp, Homo sapiens
aagtttgtagtaaaagtgg

SEQ ID NO: 992893 - DNA, 17 bp, Homo sapiens
aagtttgtgctatctat

SEQ ID NO: 992894 - DNA, 16 bp, Homo sapiens
aagtttgttgaaaaca

SEQ ID NO: 992895 - DNA, 21 bp, Homo sapiens
aagtttgtttatgcattgcct

SEQ ID NO: 992896 - DNA, 17 bp, Homo sapiens
aagttttaaaaagccag

SEQ ID NO: 992897 - DNA, 19 bp, Homo sapiens
aagttttaaaaagccagtt

SEQ ID NO: 992898 - DNA, 13 bp, Homo sapiens
aagttttaaagtt

SEQ ID NO: 992899 - DNA, 15 bp, Homo sapiens
aagttttaaagttca

SEQ ID NO: 992900 - DNA, 14 bp, Homo sapiens
aagttttaatgtat

SEQ ID NO: 992901 - DNA, 23 bp, Homo sapiens
aagttttcaaactgctgcatact

SEQ ID NO: 992902 - DNA, 15 bp, Homo sapiens
aagttttcaatgatg

SEQ ID NO: 992903 - DNA, 12 bp, Homo sapiens
aagttttcagtg

SEQ ID NO: 992904 - DNA, 13 bp, Homo sapiens
aagttttccagta

SEQ ID NO: 992905 - DNA, 15 bp, Homo sapiens
aagttttccagtatt

SEQ ID NO: 992906 - DNA, 16 bp, Homo sapiens
aagttttccagtattg

SEQ ID NO: 992907 - DNA, 20 bp, Homo sapiens
aagttttcctacacttgaga

SEQ ID NO: 992908 - DNA, 19 bp, Homo sapiens
aagttttgatgaaattctt

SEQ ID NO: 992909 - DNA, 21 bp, Homo sapiens
aagttttgattaatgtttctt

SEQ ID NO: 992910 - DNA, 16 bp, Homo sapiens
aagttttggagaggga

SEQ ID NO: 992911 - DNA, 16 bp, Homo sapiens
aagttttgtaaaagaa

SEQ ID NO: 992912 - DNA, 12 bp, Homo sapiens
aagttttgtata

SEQ ID NO: 992913 - DNA, 20 bp, Homo sapiens
aagttttgtataaataataa

SEQ ID NO: 992914 - DNA, 14 bp, Homo sapiens
aagttttgttttcc

SEQ ID NO: 992915 - DNA, 16 bp, Homo sapiens
aagttttttactttgg

SEQ ID NO: 992916 - DNA, 15 bp, Homo sapiens
aataaaacaagcctt

SEQ ID NO: 992917 - DNA, 15 bp, Homo sapiens
aataaaacctttcaa

SEQ ID NO: 992918 - DNA, 23 bp, Homo sapiens
aataaaacctttcaaatttcaca

SEQ ID NO: 992919 - DNA, 15 bp, Homo sapiens
aataaaactatttaa

SEQ ID NO: 992920 - DNA, 24 bp, Homo sapiens
aataaaactatttaaaattggcac

SEQ ID NO: 992921 - DNA, 22 bp, Homo sapiens
aataaaactgcgaggacatcaa

SEQ ID NO: 992922 - DNA, 15 bp, Homo sapiens
aataaaactggcttt

SEQ ID NO: 992923 - DNA, 14 bp, Homo sapiens
aataaaacttttta

SEQ ID NO: 992924 - DNA, 17 bp, Homo sapiens
aataaaagaacatgctt

SEQ ID NO: 992925 - DNA, 14 bp, Homo sapiens
aataaaagagcttt

SEQ ID NO: 992926 - DNA, 16 bp, Homo sapiens
aataaaagatttacat

SEQ ID NO: 992927 - DNA, 16 bp, Homo sapiens
aataaaagctataaag

SEQ ID NO: 992928 - DNA, 12 bp, Homo sapiens
aataaaaggaaa

SEQ ID NO: 992929 - DNA, 17 bp, Homo sapiens
aataaaaggaaaagcaa

SEQ ID NO: 992930 - DNA, 16 bp, Homo sapiens
aataaaagttcctctc

SEQ ID NO: 992931 - DNA, 20 bp, Homo sapiens
aataaaagttcctctccctt

SEQ ID NO: 992932 - DNA, 22 bp, Homo sapiens
aataaaagtttacaacttgatt

SEQ ID NO: 992933 - DNA, 22 bp, Homo sapiens
aataaaatatcataaagcattt

SEQ ID NO: 992934 - DNA, 14 bp, Homo sapiens
aataaaatgaaaat

SEQ ID NO: 992935 - DNA, 14 bp, Homo sapiens
aataaaatgaacat

SEQ ID NO: 992936 - DNA, 12 bp, Homo sapiens
aataaaatgcaa

SEQ ID NO: 992937 - DNA, 13 bp, Homo sapiens
aataaaatgcaaa

SEQ ID NO: 992938 - DNA, 14 bp, Homo sapiens
aataaaatgcaaat

SEQ ID NO: 992939 - DNA, 16 bp, Homo sapiens
aataaaatgcaaatga

SEQ ID NO: 992940 - DNA, 18 bp, Homo sapiens
aataaaatgcaaatgaat

SEQ ID NO: 992941 - DNA, 16 bp, Homo sapiens
aataaaattacacagt

SEQ ID NO: 992942 - DNA, 15 bp, Homo sapiens
aataaaatttctaag

SEQ ID NO: 992943 - DNA, 13 bp, Homo sapiens
aataaacaaataa

SEQ ID NO: 992944 - DNA, 21 bp, Homo sapiens
aataaacagcttcatgccttt

SEQ ID NO: 992945 - DNA, 22 bp, Homo sapiens
aataaacattaattttgtgcat

SEQ ID NO: 992946 - DNA, 19 bp, Homo sapiens
aataaaccaaacccagcca

SEQ ID NO: 992947 - DNA, 14 bp, Homo sapiens
aataaaccattttt

SEQ ID NO: 992948 - DNA, 13 bp, Homo sapiens
aataaacgtggat

SEQ ID NO: 992949 - DNA, 11 bp, Homo sapiens
aataaactcat

SEQ ID NO: 992950 - DNA, 10 bp, Homo sapiens
aataaactga

SEQ ID NO: 992951 - DNA, 22 bp, Homo sapiens
aataaactgaatattttggaaa

SEQ ID NO: 992952 - DNA, 18 bp, Homo sapiens
aataaactgtattaaatc

SEQ ID NO: 992953 - DNA, 17 bp, Homo sapiens
aataaactgtgtttact

SEQ ID NO: 992954 - DNA, 12 bp, Homo sapiens
aataaactgttt

SEQ ID NO: 992955 - DNA, 17 bp, Homo sapiens
aataaactgttttcaag

SEQ ID NO: 992956 - DNA, 17 bp, Homo sapiens
aataaacttagaggaaa

SEQ ID NO: 992957 - DNA, 14 bp, Homo sapiens
aataaacttcttaa

SEQ ID NO: 992958 - DNA, 13 bp, Homo sapiens
aataaactttaat

SEQ ID NO: 992959 - DNA, 20 bp, Homo sapiens
aataaacttttttttgagaa

SEQ ID NO: 992960 - DNA, 20 bp, Homo sapiens
aataaagaagtatggtaatc

SEQ ID NO: 992961 - DNA, 18 bp, Homo sapiens
aataaagagttagaatga

SEQ ID NO: 992962 - DNA, 14 bp, Homo sapiens
aataaagcaatgtg

SEQ ID NO: 992963 - DNA, 20 bp, Homo sapiens
aataaagcagagccaaggcc

SEQ ID NO: 992964 - DNA, 22 bp, Homo sapiens
aataaagcagagccaaggccac

SEQ ID NO: 992965 - DNA, 23 bp, Homo sapiens
aataaagcagagccaaggccacc

SEQ ID NO: 992966 - DNA, 17 bp, Homo sapiens
aataaagcagcctcatt

SEQ ID NO: 992967 - DNA, 12 bp, Homo sapiens
aataaagcagtt

SEQ ID NO: 992968 - DNA, 12 bp, Homo sapiens
aataaagcattc

SEQ ID NO: 992969 - DNA, 15 bp, Homo sapiens
aataaagccctggga

SEQ ID NO: 992970 - DNA, 19 bp, Homo sapiens
aataaagcctatttttcaa

SEQ ID NO: 992971 - DNA, 11 bp, Homo sapiens
aataaaggact

SEQ ID NO: 992972 - DNA, 18 bp, Homo sapiens
aataaaggactgtaatct

SEQ ID NO: 992973 - DNA, 11 bp, Homo sapiens
aataaaggcag

SEQ ID NO: 992974 - DNA, 15 bp, Homo sapiens
aataaaggcagctgc

SEQ ID NO: 992975 - DNA, 17 bp, Homo sapiens
aataaaggcagctgcct

SEQ ID NO: 992976 - DNA, 15 bp, Homo sapiens
aataaaggcagtttt

SEQ ID NO: 992977 - DNA, 18 bp, Homo sapiens
aataaaggcagttttcta

SEQ ID NO: 992978 - DNA, 18 bp, Homo sapiens
aataaaggccacaggaga

SEQ ID NO: 992979 - DNA, 16 bp, Homo sapiens
aataaaggtctttgca

SEQ ID NO: 992980 - DNA, 18 bp, Homo sapiens
aataaaggttgttttgaa

SEQ ID NO: 992981 - DNA, 14 bp, Homo sapiens
aataaagtagcaaa

SEQ ID NO: 992982 - DNA, 14 bp, Homo sapiens
aataaagtatataa

SEQ ID NO: 992983 - DNA, 15 bp, Homo sapiens
aataaagtatataat

SEQ ID NO: 992984 - DNA, 18 bp, Homo sapiens
aataaagtatcatgcatt

SEQ ID NO: 992985 - DNA, 15 bp, Homo sapiens
aataaagtgatctgt

SEQ ID NO: 992986 - DNA, 23 bp, Homo sapiens
aataaagtgttacgttttattgg

SEQ ID NO: 992987 - DNA, 21 bp, Homo sapiens
aataaagttctgcaaaataca

SEQ ID NO: 992988 - DNA, 19 bp, Homo sapiens
aataaagttctgttttctg

SEQ ID NO: 992989 - DNA, 20 bp, Homo sapiens
aataaagttgttttatcttt

SEQ ID NO: 992990 - DNA, 19 bp, Homo sapiens
aataaagtttgcttagaaa

SEQ ID NO: 992991 - DNA, 13 bp, Homo sapiens
aataaatatactc

SEQ ID NO: 992992 - DNA, 15 bp, Homo sapiens
aataaatatatctac

SEQ ID NO: 992993 - DNA, 16 bp, Homo sapiens
aataaatattctgcat

SEQ ID NO: 992994 - DNA, 21 bp, Homo sapiens
aataaatcattaatactcttc

SEQ ID NO: 992995 - DNA, 20 bp, Homo sapiens
aataaatcttagtgttcaaa

SEQ ID NO: 992996 - DNA, 11 bp, Homo sapiens
aataaatcttt

SEQ ID NO: 992997 - DNA, 21 bp, Homo sapiens
aataaatgaaacttggccagt

SEQ ID NO: 992998 - DNA, 17 bp, Homo sapiens
aataaatgacacccaga

SEQ ID NO: 992999 - DNA, 13 bp, Homo sapiens
aataaatgagaaa

SEQ ID NO: 993000 - DNA, 21 bp, Homo sapiens
aataaatgattatattcacag

SEQ ID NO: 993001 - DNA, 22 bp, Homo sapiens
aataaatgattatattcacaga

SEQ ID NO: 993002 - DNA, 14 bp, Homo sapiens
aataaatggccagt

SEQ ID NO: 993003 - DNA, 22 bp, Homo sapiens
aataaatggccagtgctgcttc

SEQ ID NO: 993004 - DNA, 21 bp, Homo sapiens
aataaatgtatcttattcaca

SEQ ID NO: 993005 - DNA, 16 bp, Homo sapiens
aataaatgtcactgcc

SEQ ID NO: 993006 - DNA, 12 bp, Homo sapiens
aataaatgtctt

SEQ ID NO: 993007 - DNA, 11 bp, Homo sapiens
aataaatgtgt

SEQ ID NO: 993008 - DNA, 14 bp, Homo sapiens
aataaatgtttcaa

SEQ ID NO: 993009 - DNA, 18 bp, Homo sapiens
aataaatgttttatttct

SEQ ID NO: 993010 - DNA, 21 bp, Homo sapiens
aataaattaaacatgctgtta

SEQ ID NO: 993011 - DNA, 16 bp, Homo sapiens
aataaattaagatcct

SEQ ID NO: 993012 - DNA, 22 bp, Homo sapiens
aataaattaagatcctaaactc

SEQ ID NO: 993013 - DNA, 14 bp, Homo sapiens
aataaattagttgt

SEQ ID NO: 993014 - DNA, 16 bp, Homo sapiens
aataaattagttgtta

SEQ ID NO: 993015 - DNA, 12 bp, Homo sapiens
aataaattattt

SEQ ID NO: 993016 - DNA, 20 bp, Homo sapiens
aataaattcagtattttgcc

SEQ ID NO: 993017 - DNA, 16 bp, Homo sapiens
aataaattcatcagaa

SEQ ID NO: 993018 - DNA, 14 bp, Homo sapiens
aataaattctgact

SEQ ID NO: 993019 - DNA, 20 bp, Homo sapiens
aataaattgctaatgttgct

SEQ ID NO: 993020 - DNA, 20 bp, Homo sapiens
aataaatttattttcttgga

SEQ ID NO: 993021 - DNA, 21 bp, Homo sapiens
aataaatttcccagttaaaga

SEQ ID NO: 993022 - DNA, 22 bp, Homo sapiens
aataaatttcccagttaaagat

SEQ ID NO: 993023 - DNA, 18 bp, Homo sapiens
aataaattttcaaatcct

SEQ ID NO: 993024 - DNA, 17 bp, Homo sapiens
aataacaaacgtgtttt

SEQ ID NO: 993025 - DNA, 15 bp, Homo sapiens
aataacaaagccctt

SEQ ID NO: 993026 - DNA, 19 bp, Homo sapiens
aataacaatgtgctctcgg

SEQ ID NO: 993027 - DNA, 16 bp, Homo sapiens
aataacacagagagac

SEQ ID NO: 993028 - DNA, 14 bp, Homo sapiens
aataacactatatt

SEQ ID NO: 993029 - DNA, 22 bp, Homo sapiens
aataacactatatttatttttg

SEQ ID NO: 993030 - DNA, 22 bp, Homo sapiens
aataacagatggtgctgctaat

SEQ ID NO: 993031 - DNA, 13 bp, Homo sapiens
aataacagctcct

SEQ ID NO: 993032 - DNA, 13 bp, Homo sapiens
aataacagctgca

SEQ ID NO: 993033 - DNA, 16 bp, Homo sapiens
aataacatacaatgac

SEQ ID NO: 993034 - DNA, 22 bp, Homo sapiens
aataacatgtaattaagtacta

SEQ ID NO: 993035 - DNA, 21 bp, Homo sapiens
aataacattctgaatcaagca

SEQ ID NO: 993036 - DNA, 14 bp, Homo sapiens
aataacattgcact

SEQ ID NO: 993037 - DNA, 11 bp, Homo sapiens
aataacattta

SEQ ID NO: 993038 - DNA, 13 bp, Homo sapiens
aataacatttaaa

SEQ ID NO: 993039 - DNA, 15 bp, Homo sapiens
aataacattttatac

SEQ ID NO: 993040 - DNA, 14 bp, Homo sapiens
aataaccacttaaa

SEQ ID NO: 993041 - DNA, 22 bp, Homo sapiens
aataaccacttaaaaaatgtcc

SEQ ID NO: 993042 - DNA, 12 bp, Homo sapiens
aataacctctgg

SEQ ID NO: 993043 - DNA, 16 bp, Homo sapiens
aataacctctggccct

SEQ ID NO: 993044 - DNA, 14 bp, Homo sapiens
aataactactgtgt

SEQ ID NO: 993045 - DNA, 15 bp, Homo sapiens
aataactactgtgtt

SEQ ID NO: 993046 - DNA, 17 bp, Homo sapiens
aataactactgtgttcc

SEQ ID NO: 993047 - DNA, 19 bp, Homo sapiens
aataactagtgttgcttgg

SEQ ID NO: 993048 - DNA, 21 bp, Homo sapiens
aataactatctcacttccaga

SEQ ID NO: 993049 - DNA, 19 bp, Homo sapiens
aataactattttgttttaa

SEQ ID NO: 993050 - DNA, 18 bp, Homo sapiens
aataactcagaatattgt

SEQ ID NO: 993051 - DNA, 15 bp, Homo sapiens
aataactccaagcag

SEQ ID NO: 993052 - DNA, 13 bp, Homo sapiens
aataactctggga

SEQ ID NO: 993053 - DNA, 13 bp, Homo sapiens
aataactgaactg

SEQ ID NO: 993054 - DNA, 17 bp, Homo sapiens
aataactgaactgtttg

SEQ ID NO: 993055 - DNA, 13 bp, Homo sapiens
aataacttcagtc

SEQ ID NO: 993056 - DNA, 15 bp, Homo sapiens
aataacttcagtcct

SEQ ID NO: 993057 - DNA, 20 bp, Homo sapiens
aataacttctatattttaat

SEQ ID NO: 993058 - DNA, 17 bp, Homo sapiens
aataactttattgcata

SEQ ID NO: 993059 - DNA, 22 bp, Homo sapiens
aataagaaacaactctttgaga

SEQ ID NO: 993060 - DNA, 13 bp, Homo sapiens
aataagaaatgaa

SEQ ID NO: 993061 - DNA, 14 bp, Homo sapiens
aataagaaatgaac

SEQ ID NO: 993062 - DNA, 14 bp, Homo sapiens
aataagaatttagg

SEQ ID NO: 993063 - DNA, 13 bp, Homo sapiens
aataagagatttg

SEQ ID NO: 993064 - DNA, 22 bp, Homo sapiens
aataagagcatgatttgaaaaa

SEQ ID NO: 993065 - DNA, 21 bp, Homo sapiens
aataagcacttgcctggaata

SEQ ID NO: 993066 - DNA, 21 bp, Homo sapiens
aataagcccagtgctgctgta

SEQ ID NO: 993067 - DNA, 20 bp, Homo sapiens
aataagctactagcaaaata

SEQ ID NO: 993068 - DNA, 22 bp, Homo sapiens
aataagctctagttcttaacaa

SEQ ID NO: 993069 - DNA, 22 bp, Homo sapiens
aataaggaagagggctgagctg

SEQ ID NO: 993070 - DNA, 14 bp, Homo sapiens
aataaggagggaca

SEQ ID NO: 993071 - DNA, 22 bp, Homo sapiens
aataaggcatgcgaaatgttct

SEQ ID NO: 993072 - DNA, 18 bp, Homo sapiens
aataaggtcaagggaaaa

SEQ ID NO: 993073 - DNA, 22 bp, Homo sapiens
aataagtcaacagtaaaccact

SEQ ID NO: 993074 - DNA, 15 bp, Homo sapiens
aataagtcttcctta

SEQ ID NO: 993075 - DNA, 17 bp, Homo sapiens
aataagtggttatttct

SEQ ID NO: 993076 - DNA, 16 bp, Homo sapiens
aataagtgtctttctg

SEQ ID NO: 993077 - DNA, 22 bp, Homo sapiens
aataagtgtgtggtagaaacaa

SEQ ID NO: 993078 - DNA, 21 bp, Homo sapiens
aataagttcaaattcttctga

SEQ ID NO: 993079 - DNA, 22 bp, Homo sapiens
aataagttcaaattcttctgaa

SEQ ID NO: 993080 - DNA, 21 bp, Homo sapiens
aataagttttgatataatctt

SEQ ID NO: 993081 - DNA, 23 bp, Homo sapiens
aataagttttgatataatcttgg

SEQ ID NO: 993082 - DNA, 20 bp, Homo sapiens
aataagtttttgtttcacag

SEQ ID NO: 993083 - DNA, 12 bp, Homo sapiens
aataataaaatg

SEQ ID NO: 993084 - DNA, 14 bp, Homo sapiens
aataataaaatgca

SEQ ID NO: 993085 - DNA, 17 bp, Homo sapiens
aataataaaatgcaaat

SEQ ID NO: 993086 - DNA, 18 bp, Homo sapiens
aataataaaatgcaaatg

SEQ ID NO: 993087 - DNA, 19 bp, Homo sapiens
aataataaagatgctcttt

SEQ ID NO: 993088 - DNA, 13 bp, Homo sapiens
aataataaataca

SEQ ID NO: 993089 - DNA, 20 bp, Homo sapiens
aataataagtgatgtgctga

SEQ ID NO: 993090 - DNA, 13 bp, Homo sapiens
aataataataaat

SEQ ID NO: 993091 - DNA, 18 bp, Homo sapiens
aataatacctaagccttc

SEQ ID NO: 993092 - DNA, 14 bp, Homo sapiens
aataatagggaaaa

SEQ ID NO: 993093 - DNA, 17 bp, Homo sapiens
aataatatattttctgt

SEQ ID NO: 993094 - DNA, 19 bp, Homo sapiens
aataatatggctatgctta

SEQ ID NO: 993095 - DNA, 14 bp, Homo sapiens
aataatcaagattt

SEQ ID NO: 993096 - DNA, 15 bp, Homo sapiens
aataatcaagatttt

SEQ ID NO: 993097 - DNA, 18 bp, Homo sapiens
aataatcaagattttagg

SEQ ID NO: 993098 - DNA, 22 bp, Homo sapiens
aataatcagaaaagtaattttg

SEQ ID NO: 993099 - DNA, 14 bp, Homo sapiens
aataatccaccccc

SEQ ID NO: 993100 - DNA, 14 bp, Homo sapiens
aataatccagtatt

SEQ ID NO: 993101 - DNA, 16 bp, Homo sapiens
aataatccagtattgc

SEQ ID NO: 993102 - DNA, 12 bp, Homo sapiens
aataatccattc

SEQ ID NO: 993103 - DNA, 19 bp, Homo sapiens
aataatccattccaaaata

SEQ ID NO: 993104 - DNA, 16 bp, Homo sapiens
aataatctatttctat

SEQ ID NO: 993105 - DNA, 18 bp, Homo sapiens
aataatctcatcccccca

SEQ ID NO: 993106 - DNA, 21 bp, Homo sapiens
aataatctcatccccccaccc

SEQ ID NO: 993107 - DNA, 22 bp, Homo sapiens
aataatctcatccccccacccg

SEQ ID NO: 993108 - DNA, 19 bp, Homo sapiens
aataatcttattagggaga

SEQ ID NO: 993109 - DNA, 22 bp, Homo sapiens
aataatgaatggactcaaactg

SEQ ID NO: 993110 - DNA, 18 bp, Homo sapiens
aataatgcctttgtaacc

SEQ ID NO: 993111 - DNA, 14 bp, Homo sapiens
aataatgcttcaga

SEQ ID NO: 993112 - DNA, 17 bp, Homo sapiens
aataatggaaaaatagt

SEQ ID NO: 993113 - DNA, 12 bp, Homo sapiens
aataatggaaac

SEQ ID NO: 993114 - DNA, 13 bp, Homo sapiens
aataatggaaaca

SEQ ID NO: 993115 - DNA, 17 bp, Homo sapiens
aataatggagaatcact

SEQ ID NO: 993116 - DNA, 21 bp, Homo sapiens
aataatggtcccatccaggca

SEQ ID NO: 993117 - DNA, 16 bp, Homo sapiens
aataatgtaattgtaa

SEQ ID NO: 993118 - DNA, 22 bp, Homo sapiens
aataatgtgaaactggattaaa

SEQ ID NO: 993119 - DNA, 13 bp, Homo sapiens
aataatgtgcaaa

SEQ ID NO: 993120 - DNA, 19 bp, Homo sapiens
aataatgtgcaaattttgc

SEQ ID NO: 993121 - DNA, 21 bp, Homo sapiens
aataatgtgcaaattttgcat

SEQ ID NO: 993122 - DNA, 21 bp, Homo sapiens
aataatgtgggaagaaacaaa

SEQ ID NO: 993123 - DNA, 18 bp, Homo sapiens
aataatgtgttaaacatg

SEQ ID NO: 993124 - DNA, 19 bp, Homo sapiens
aataatgttaacatggaca

SEQ ID NO: 993125 - DNA, 14 bp, Homo sapiens
aataattctaaatc

SEQ ID NO: 993126 - DNA, 17 bp, Homo sapiens
aataattctgagttttg

SEQ ID NO: 993127 - DNA, 22 bp, Homo sapiens
aataattctgagttttgtgttt

SEQ ID NO: 993128 - DNA, 12 bp, Homo sapiens
aataattgttgt

SEQ ID NO: 993129 - DNA, 16 bp, Homo sapiens
aataattgttgtgtgt

SEQ ID NO: 993130 - DNA, 16 bp, Homo sapiens
aataattgttgttctg

SEQ ID NO: 993131 - DNA, 22 bp, Homo sapiens
aataattgttgttctgttaact

SEQ ID NO: 993132 - DNA, 14 bp, Homo sapiens
aataatttattaca

SEQ ID NO: 993133 - DNA, 22 bp, Homo sapiens
aataatttattattaaggtaac

SEQ ID NO: 993134 - DNA, 21 bp, Homo sapiens
aataatttcctggtgtgaagg

SEQ ID NO: 993135 - DNA, 12 bp, Homo sapiens
aataatttctac

SEQ ID NO: 993136 - DNA, 12 bp, Homo sapiens
aataatttctat

SEQ ID NO: 993137 - DNA, 15 bp, Homo sapiens
aataatttgaatgta

SEQ ID NO: 993138 - DNA, 20 bp, Homo sapiens
aataatttgaatgtatttga

SEQ ID NO: 993139 - DNA, 12 bp, Homo sapiens
aataatttgtaa

SEQ ID NO: 993140 - DNA, 13 bp, Homo sapiens
aataatttgtaaa

SEQ ID NO: 993141 - DNA, 15 bp, Homo sapiens
aataatttgtaaatg

SEQ ID NO: 993142 - DNA, 22 bp, Homo sapiens
aataatttgtaaatgattttaa

SEQ ID NO: 993143 - DNA, 14 bp, Homo sapiens
aatccaagctccct

SEQ ID NO: 993144 - DNA, 18 bp, Homo sapiens
aatccaagctccctgccc

SEQ ID NO: 993145 - DNA, 19 bp, Homo sapiens
aatccaagctccctgcccc

SEQ ID NO: 993146 - DNA, 22 bp, Homo sapiens
aatccaagctccctgccccaaa

SEQ ID NO: 993147 - DNA, 22 bp, Homo sapiens
aatccaagggttgagagccagt

SEQ ID NO: 993148 - DNA, 18 bp, Homo sapiens
aatccaatactgcccaag

SEQ ID NO: 993149 - DNA, 13 bp, Homo sapiens
aatccacacatca

SEQ ID NO: 993150 - DNA, 21 bp, Homo sapiens
aatccacatctttactcaggc

SEQ ID NO: 993151 - DNA, 16 bp, Homo sapiens
aatccacctgccttgg

SEQ ID NO: 993152 - DNA, 22 bp, Homo sapiens
aatccacgaattcttctggggt

SEQ ID NO: 993153 - DNA, 14 bp, Homo sapiens
aatccactaacact

SEQ ID NO: 993154 - DNA, 17 bp, Homo sapiens
aatccagaaagaaaaaa

SEQ ID NO: 993155 - DNA, 22 bp, Homo sapiens
aatccagaattgaccttttgac

SEQ ID NO: 993156 - DNA, 12 bp, Homo sapiens
aatccagctccc

SEQ ID NO: 993157 - DNA, 22 bp, Homo sapiens
aatccagctccctagactgcat

SEQ ID NO: 993158 - DNA, 16 bp, Homo sapiens
aatccaggcacagctg

SEQ ID NO: 993159 - DNA, 17 bp, Homo sapiens
aatccaggccaaagccc

SEQ ID NO: 993160 - DNA, 15 bp, Homo sapiens
aatccagtttctttc

SEQ ID NO: 993161 - DNA, 20 bp, Homo sapiens
aatccataaatgtgttcctg

SEQ ID NO: 993162 - DNA, 13 bp, Homo sapiens
aatccatatctta

SEQ ID NO: 993163 - DNA, 23 bp, Homo sapiens
aatccatgtgattaatgttttca

SEQ ID NO: 993164 - DNA, 19 bp, Homo sapiens
aatccatgttagtttttac

SEQ ID NO: 993165 - DNA, 18 bp, Homo sapiens
aatccattccaaaataca

SEQ ID NO: 993166 - DNA, 16 bp, Homo sapiens
aatcccaaatttgatt

SEQ ID NO: 993167 - DNA, 21 bp, Homo sapiens
aatcccaaatttgattgattt

SEQ ID NO: 993168 - DNA, 16 bp, Homo sapiens
aatcccaccaaatcat

SEQ ID NO: 993169 - DNA, 20 bp, Homo sapiens
aatcccagcactttgggagg

SEQ ID NO: 993170 - DNA, 22 bp, Homo sapiens
aatcccagggaaggacttggag

SEQ ID NO: 993171 - DNA, 23 bp, Homo sapiens
aatcccatgagataaataaaaat

SEQ ID NO: 993172 - DNA, 12 bp, Homo sapiens
aatccccagcct

SEQ ID NO: 993173 - DNA, 23 bp, Homo sapiens
aatccccccttcagaacagaggc

SEQ ID NO: 993174 - DNA, 11 bp, Homo sapiens
aatcccctcct

SEQ ID NO: 993175 - DNA, 17 bp, Homo sapiens
aatccccttatgacttg

SEQ ID NO: 993176 - DNA, 17 bp, Homo sapiens
aatcccgccacctatct

SEQ ID NO: 993177 - DNA, 15 bp, Homo sapiens
aatccctctccaact

SEQ ID NO: 993178 - DNA, 13 bp, Homo sapiens
aatccctgctttt

SEQ ID NO: 993179 - DNA, 23 bp, Homo sapiens
aatccctttattaccccctcctt

SEQ ID NO: 993180 - DNA, 21 bp, Homo sapiens
aatccgaccactaattgccaa

SEQ ID NO: 993181 - DNA, 13 bp, Homo sapiens
aatccgctctctt

SEQ ID NO: 993182 - DNA, 14 bp, Homo sapiens
aatccgctctcttc

SEQ ID NO: 993183 - DNA, 15 bp, Homo sapiens
aatccgctctcttcc

SEQ ID NO: 993184 - DNA, 16 bp, Homo sapiens
aatcctaacacattat

SEQ ID NO: 993185 - DNA, 17 bp, Homo sapiens
aatcctaagacacaaat

SEQ ID NO: 993186 - DNA, 19 bp, Homo sapiens
aatcctaatttctcctccc

SEQ ID NO: 993187 - DNA, 21 bp, Homo sapiens
aatcctaatttctcctccctt

SEQ ID NO: 993188 - DNA, 15 bp, Homo sapiens
aatcctacctgtttt

SEQ ID NO: 993189 - DNA, 14 bp, Homo sapiens
aatcctaccttgct

SEQ ID NO: 993190 - DNA, 21 bp, Homo sapiens
aatcctaccttgcttttgctt

SEQ ID NO: 993191 - DNA, 16 bp, Homo sapiens
aatcctagacttgaaa

SEQ ID NO: 993192 - DNA, 18 bp, Homo sapiens
aatcctatatctgtttgt

SEQ ID NO: 993193 - DNA, 16 bp, Homo sapiens
aatcctcaacactatt

SEQ ID NO: 993194 - DNA, 15 bp, Homo sapiens
aatcctcactgggtg

SEQ ID NO: 993195 - DNA, 16 bp, Homo sapiens
aatcctcactgggtgg

SEQ ID NO: 993196 - DNA, 22 bp, Homo sapiens
aatcctcagccgagaaattggg

SEQ ID NO: 993197 - DNA, 23 bp, Homo sapiens
aatcctcccaaccaaccagcagg

SEQ ID NO: 993198 - DNA, 11 bp, Homo sapiens
aatcctcctcc

SEQ ID NO: 993199 - DNA, 20 bp, Homo sapiens
aatcctcctgcctcagcctt

SEQ ID NO: 993200 - DNA, 13 bp, Homo sapiens
aatcctcttcctc

SEQ ID NO: 993201 - DNA, 17 bp, Homo sapiens
aatcctcttcctctgag

SEQ ID NO: 993202 - DNA, 20 bp, Homo sapiens
aatcctcttcctctgaggct

SEQ ID NO: 993203 - DNA, 17 bp, Homo sapiens
aatcctgaactttctcc

SEQ ID NO: 993204 - DNA, 20 bp, Homo sapiens
aatcctgaactttctccctc

SEQ ID NO: 993205 - DNA, 11 bp, Homo sapiens
aatcctgcctc

SEQ ID NO: 993206 - DNA, 13 bp, Homo sapiens
aatcctgcctctc

SEQ ID NO: 993207 - DNA, 18 bp, Homo sapiens
aatcctggaaggacacag

SEQ ID NO: 993208 - DNA, 22 bp, Homo sapiens
aatcctggcaagaaagcttgag

SEQ ID NO: 993209 - DNA, 18 bp, Homo sapiens
aatcctgtatataaaata

SEQ ID NO: 993210 - DNA, 19 bp, Homo sapiens
aatcctgtcgattagactg

SEQ ID NO: 993211 - DNA, 22 bp, Homo sapiens
aatcctgtttttagtgctgact

SEQ ID NO: 993212 - DNA, 13 bp, Homo sapiens
aatccttccctgc

SEQ ID NO: 993213 - DNA, 17 bp, Homo sapiens
aatccttccctgctctt

SEQ ID NO: 993214 - DNA, 19 bp, Homo sapiens
aatccttgataatatattg

SEQ ID NO: 993215 - DNA, 17 bp, Homo sapiens
aatccttgcttatgaca

SEQ ID NO: 993216 - DNA, 21 bp, Homo sapiens
aatccttggctgaattaaaat

SEQ ID NO: 993217 - DNA, 13 bp, Homo sapiens
aatcctttactgt

SEQ ID NO: 993218 - DNA, 16 bp, Homo sapiens
aatcctttctgcccac

SEQ ID NO: 993219 - DNA, 23 bp, Homo sapiens
aatcctttgttttctgactaatt

SEQ ID NO: 993220 - DNA, 19 bp, Homo sapiens
aataattttctaagacagt

SEQ ID NO: 993221 - DNA, 21 bp, Homo sapiens
aataattttctaagacagttt

SEQ ID NO: 993222 - DNA, 13 bp, Homo sapiens
aataattttggaa

SEQ ID NO: 993223 - DNA, 15 bp, Homo sapiens
aataattttgtaatg

SEQ ID NO: 993224 - DNA, 15 bp, Homo sapiens
aataatttttaactt

SEQ ID NO: 993225 - DNA, 13 bp, Homo sapiens
aatacaaaacttc

SEQ ID NO: 993226 - DNA, 17 bp, Homo sapiens
aatacaaagttagagaa

SEQ ID NO: 993227 - DNA, 17 bp, Homo sapiens
aatacaaatagattttt

SEQ ID NO: 993228 - DNA, 12 bp, Homo sapiens
aatacaaatgga

SEQ ID NO: 993229 - DNA, 15 bp, Homo sapiens
aatacaaattggttg

SEQ ID NO: 993230 - DNA, 22 bp, Homo sapiens
aatacaaattttgtataacttt

SEQ ID NO: 993231 - DNA, 20 bp, Homo sapiens
aatacaaccagcccaaccat

SEQ ID NO: 993232 - DNA, 19 bp, Homo sapiens
aatacaagtaatattatta

SEQ ID NO: 993233 - DNA, 20 bp, Homo sapiens
aatacaagtaatattattac

SEQ ID NO: 993234 - DNA, 19 bp, Homo sapiens
aatacaatcctgtttataa

SEQ ID NO: 993235 - DNA, 13 bp, Homo sapiens
aatacaatgtaca

SEQ ID NO: 993236 - DNA, 14 bp, Homo sapiens
aatacaatgtacaa

SEQ ID NO: 993237 - DNA, 17 bp, Homo sapiens
aatacaatgtacaatta

SEQ ID NO: 993238 - DNA, 15 bp, Homo sapiens
aatacaattaaaggt

SEQ ID NO: 993239 - DNA, 20 bp, Homo sapiens
aatacaattttttttattag

SEQ ID NO: 993240 - DNA, 15 bp, Homo sapiens
aatacacaagtaaac

SEQ ID NO: 993241 - DNA, 14 bp, Homo sapiens
aatacacagtactt

SEQ ID NO: 993242 - DNA, 14 bp, Homo sapiens
aatacacagtattc

SEQ ID NO: 993243 - DNA, 21 bp, Homo sapiens
aatacaccacctcactcctgt

SEQ ID NO: 993244 - DNA, 18 bp, Homo sapiens
aatacaccactacattct

SEQ ID NO: 993245 - DNA, 13 bp, Homo sapiens
aatacagaattga

SEQ ID NO: 993246 - DNA, 13 bp, Homo sapiens
aatacagacacta

SEQ ID NO: 993247 - DNA, 21 bp, Homo sapiens
aatacagacactaagttatag

SEQ ID NO: 993248 - DNA, 20 bp, Homo sapiens
aatacagagtacgttaaaag

SEQ ID NO: 993249 - DNA, 19 bp, Homo sapiens
aatacagataattcatttg

SEQ ID NO: 993250 - DNA, 20 bp, Homo sapiens
aatacagataattcatttgt

SEQ ID NO: 993251 - DNA, 13 bp, Homo sapiens
aatacagctggct

SEQ ID NO: 993252 - DNA, 22 bp, Homo sapiens
aatacagcttcattatctgagt

SEQ ID NO: 993253 - DNA, 15 bp, Homo sapiens
aatacaggaaacagt

SEQ ID NO: 993254 - DNA, 17 bp, Homo sapiens
aatacagtaagcatagt

SEQ ID NO: 993255 - DNA, 12 bp, Homo sapiens
aatacagtgtta

SEQ ID NO: 993256 - DNA, 17 bp, Homo sapiens
aatacagttctgctctg

SEQ ID NO: 993257 - DNA, 17 bp, Homo sapiens
aatacagttctgtcata

SEQ ID NO: 993258 - DNA, 18 bp, Homo sapiens
aatacagttgttggcctc

SEQ ID NO: 993259 - DNA, 14 bp, Homo sapiens
aatacatacggtca

SEQ ID NO: 993260 - DNA, 14 bp, Homo sapiens
aatacatctttccc

SEQ ID NO: 993261 - DNA, 17 bp, Homo sapiens
aatacatgacatttatt

SEQ ID NO: 993262 - DNA, 21 bp, Homo sapiens
aatacatgctaagagaagtag

SEQ ID NO: 993263 - DNA, 14 bp, Homo sapiens
aatacatttaaaac

SEQ ID NO: 993264 - DNA, 20 bp, Homo sapiens
aatacatttaaaacattaaa

SEQ ID NO: 993265 - DNA, 22 bp, Homo sapiens
aatacatttaaaacattaaaat

SEQ ID NO: 993266 - DNA, 12 bp, Homo sapiens
aatacattttat

SEQ ID NO: 993267 - DNA, 13 bp, Homo sapiens
aataccaaatatt

SEQ ID NO: 993268 - DNA, 17 bp, Homo sapiens
aataccaaatgcctgtt

SEQ ID NO: 993269 - DNA, 15 bp, Homo sapiens
aataccaccctacaa

SEQ ID NO: 993270 - DNA, 17 bp, Homo sapiens
aataccagccagtaaat

SEQ ID NO: 993271 - DNA, 15 bp, Homo sapiens
aataccattaaaact

SEQ ID NO: 993272 - DNA, 18 bp, Homo sapiens
aataccattgaaatcagc

SEQ ID NO: 993273 - DNA, 19 bp, Homo sapiens
aataccattgaaatcagca

SEQ ID NO: 993274 - DNA, 22 bp, Homo sapiens
aataccctactgtggggagaga

SEQ ID NO: 993275 - DNA, 17 bp, Homo sapiens
aataccgctcagtattt

SEQ ID NO: 993276 - DNA, 18 bp, Homo sapiens
aataccgctcagtatttt

SEQ ID NO: 993277 - DNA, 19 bp, Homo sapiens
aatacctcttactttgctt

SEQ ID NO: 993278 - DNA, 17 bp, Homo sapiens
aatacctcttagctgag

SEQ ID NO: 993279 - DNA, 21 bp, Homo sapiens
aatacctcttagctgagtgga

SEQ ID NO: 993280 - DNA, 19 bp, Homo sapiens
aatacggaagagcaggtga

SEQ ID NO: 993281 - DNA, 17 bp, Homo sapiens
aatacgtgccagatata

SEQ ID NO: 993282 - DNA, 22 bp, Homo sapiens
aatacgtgccagatataactgt

SEQ ID NO: 993283 - DNA, 18 bp, Homo sapiens
aatacgttttgtgtatat

SEQ ID NO: 993284 - DNA, 13 bp, Homo sapiens
aatactaaaactc

SEQ ID NO: 993285 - DNA, 18 bp, Homo sapiens
aatactaccttgaaaata

SEQ ID NO: 993286 - DNA, 19 bp, Homo sapiens
aatactatccatgtaataa

SEQ ID NO: 993287 - DNA, 20 bp, Homo sapiens
aatactattctcattatgtt

SEQ ID NO: 993288 - DNA, 13 bp, Homo sapiens
aatactcaaatga

SEQ ID NO: 993289 - DNA, 20 bp, Homo sapiens
aatactcaaatgagtaacat

SEQ ID NO: 993290 - DNA, 14 bp, Homo sapiens
aatactcacatttt

SEQ ID NO: 993291 - DNA, 13 bp, Homo sapiens
aatactcatcaga

SEQ ID NO: 993292 - DNA, 14 bp, Homo sapiens
aatactcatgtgca

SEQ ID NO: 993293 - DNA, 18 bp, Homo sapiens
aatactccctttaaagag

SEQ ID NO: 993294 - DNA, 20 bp, Homo sapiens
aatactctaccctcttagaa

SEQ ID NO: 993295 - DNA, 20 bp, Homo sapiens
aatactctagcctgggccag

SEQ ID NO: 993296 - DNA, 23 bp, Homo sapiens
aatactcttaggaagagaaacca

SEQ ID NO: 993297 - DNA, 18 bp, Homo sapiens
aatactcttgaaaggcca

SEQ ID NO: 993298 - DNA, 22 bp, Homo sapiens
aatactctttcaataaatgtat

SEQ ID NO: 993299 - DNA, 13 bp, Homo sapiens
aatactgctctga

SEQ ID NO: 993300 - DNA, 22 bp, Homo sapiens
aatactgctctgaatattttgt

SEQ ID NO: 993301 - DNA, 15 bp, Homo sapiens
aatactggaataatt

SEQ ID NO: 993302 - DNA, 20 bp, Homo sapiens
aatactggaataatttgtaa

SEQ ID NO: 993303 - DNA, 12 bp, Homo sapiens
aatactggactc

SEQ ID NO: 993304 - DNA, 19 bp, Homo sapiens
aatactggactcaggaact

SEQ ID NO: 993305 - DNA, 13 bp, Homo sapiens
aatactgggttct

SEQ ID NO: 993306 - DNA, 22 bp, Homo sapiens
aatactgtacaatgactttatt

SEQ ID NO: 993307 - DNA, 19 bp, Homo sapiens
aatactgtgcagaataatg

SEQ ID NO: 993308 - DNA, 21 bp, Homo sapiens
aatactgtgcagaataatgga

SEQ ID NO: 993309 - DNA, 14 bp, Homo sapiens
aatacttaaataaa

SEQ ID NO: 993310 - DNA, 12 bp, Homo sapiens
aatacttatttt

SEQ ID NO: 993311 - DNA, 16 bp, Homo sapiens
aatacttgaatatgga

SEQ ID NO: 993312 - DNA, 22 bp, Homo sapiens
aatacttgcaactaaggacaaa

SEQ ID NO: 993313 - DNA, 16 bp, Homo sapiens
aatacttgcagttgtg

SEQ ID NO: 993314 - DNA, 17 bp, Homo sapiens
aatacttgtcaatattt

SEQ ID NO: 993315 - DNA, 14 bp, Homo sapiens
aatactttaaagga

SEQ ID NO: 993316 - DNA, 23 bp, Homo sapiens
aatactttgatttttatccattt

SEQ ID NO: 993317 - DNA, 15 bp, Homo sapiens
aatactttgcttcat

SEQ ID NO: 993318 - DNA, 12 bp, Homo sapiens
aatactttgtat

SEQ ID NO: 993319 - DNA, 23 bp, Homo sapiens
aatactttgtcctaagagattta

SEQ ID NO: 993320 - DNA, 15 bp, Homo sapiens
aatactttttacaat

SEQ ID NO: 993321 - DNA, 17 bp, Homo sapiens
aatactttttctaatga

SEQ ID NO: 993322 - DNA, 17 bp, Homo sapiens
aatacttttttctagtt

SEQ ID NO: 993323 - DNA, 14 bp, Homo sapiens
aatagaaaaaaaga

SEQ ID NO: 993324 - DNA, 12 bp, Homo sapiens
aatagaaaaagt

SEQ ID NO: 993325 - DNA, 17 bp, Homo sapiens
aatagaaaacaggaaaa

SEQ ID NO: 993326 - DNA, 19 bp, Homo sapiens
aatagaaaagttattagtg

SEQ ID NO: 993327 - DNA, 14 bp, Homo sapiens
aatagaaaatggtc

SEQ ID NO: 993328 - DNA, 15 bp, Homo sapiens
aatagaaagaagcca

SEQ ID NO: 993329 - DNA, 17 bp, Homo sapiens
aatagaacactgcctct

SEQ ID NO: 993330 - DNA, 20 bp, Homo sapiens
aatagaacactgcctctgag

SEQ ID NO: 993331 - DNA, 19 bp, Homo sapiens
aatagaaggatgtacattt

SEQ ID NO: 993332 - DNA, 20 bp, Homo sapiens
aatagaatataattatcgga

SEQ ID NO: 993333 - DNA, 16 bp, Homo sapiens
aatagaattataactg

SEQ ID NO: 993334 - DNA, 15 bp, Homo sapiens
aatagaattgacatt

SEQ ID NO: 993335 - DNA, 21 bp, Homo sapiens
aatagaattgacattgaaatc

SEQ ID NO: 993336 - DNA, 13 bp, Homo sapiens
aatagacaattta

SEQ ID NO: 993337 - DNA, 15 bp, Homo sapiens
aatagacagtatatt

SEQ ID NO: 993338 - DNA, 13 bp, Homo sapiens
aatagacatcaaa

SEQ ID NO: 993339 - DNA, 13 bp, Homo sapiens
aatagacatgtag

SEQ ID NO: 993340 - DNA, 16 bp, Homo sapiens
aatagactaaatgaaa

SEQ ID NO: 993341 - DNA, 15 bp, Homo sapiens
aatagactaacttca

SEQ ID NO: 993342 - DNA, 17 bp, Homo sapiens
aatagacttctcttaca

SEQ ID NO: 993343 - DNA, 20 bp, Homo sapiens
aaggagactcacctctgcct

SEQ ID NO: 993344 - DNA, 15 bp, Homo sapiens
aatgcatactgttga

SEQ ID NO: 993345 - DNA, 19 bp, Homo sapiens
aatgcatactgttgataca

SEQ ID NO: 993346 - DNA, 14 bp, Homo sapiens
aatgcatatttgca

SEQ ID NO: 993347 - DNA, 22 bp, Homo sapiens
aatgcatccttaacctttatta

SEQ ID NO: 993348 - DNA, 16 bp, Homo sapiens
aatgcatctagattat

SEQ ID NO: 993349 - DNA, 19 bp, Homo sapiens
aatgcatctagattatgga

SEQ ID NO: 993350 - DNA, 13 bp, Homo sapiens
aatgcattaaaaa

SEQ ID NO: 993351 - DNA, 13 bp, Homo sapiens
aatgcattaaacc

SEQ ID NO: 993352 - DNA, 19 bp, Homo sapiens
aatgcattaataaaaatca

SEQ ID NO: 993353 - DNA, 22 bp, Homo sapiens
aatgcattaataaaaatcaact

SEQ ID NO: 993354 - DNA, 23 bp, Homo sapiens
aatgcattataggatcatttgtt

SEQ ID NO: 993355 - DNA, 14 bp, Homo sapiens
aatgcattttgctg

SEQ ID NO: 993356 - DNA, 17 bp, Homo sapiens
aatgccaaaatgtactt

SEQ ID NO: 993357 - DNA, 22 bp, Homo sapiens
aatgccaagggggtgactggaa

SEQ ID NO: 993358 - DNA, 22 bp, Homo sapiens
aatgccactgccttcgcttctt

SEQ ID NO: 993359 - DNA, 18 bp, Homo sapiens
aatgccaggatttctcat

SEQ ID NO: 993360 - DNA, 17 bp, Homo sapiens
aatgccataaaattgca

SEQ ID NO: 993361 - DNA, 19 bp, Homo sapiens
aatgccatcagcccctggg

SEQ ID NO: 993362 - DNA, 16 bp, Homo sapiens
aatgcccagccagcca

SEQ ID NO: 993363 - DNA, 13 bp, Homo sapiens
aatgcccagttca

SEQ ID NO: 993364 - DNA, 17 bp, Homo sapiens
aatgccctcctaaatgt

SEQ ID NO: 993365 - DNA, 12 bp, Homo sapiens
aatgccctgcca

SEQ ID NO: 993366 - DNA, 16 bp, Homo sapiens
aatgcccttaaatcat

SEQ ID NO: 993367 - DNA, 14 bp, Homo sapiens
aatgcccttcactg

SEQ ID NO: 993368 - DNA, 17 bp, Homo sapiens
aatgcccttcactgtca

SEQ ID NO: 993369 - DNA, 17 bp, Homo sapiens
aatgcctattgtaatat

SEQ ID NO: 993370 - DNA, 20 bp, Homo sapiens
aatgcctcagtgtatttgta

SEQ ID NO: 993371 - DNA, 12 bp, Homo sapiens
aatgcctcctcc

SEQ ID NO: 993372 - DNA, 19 bp, Homo sapiens
aatgcctgctttttggaaa

SEQ ID NO: 993373 - DNA, 21 bp, Homo sapiens
aatgcctgctttttggaaagt

SEQ ID NO: 993374 - DNA, 23 bp, Homo sapiens
aatgccttaccctcatgttctta

SEQ ID NO: 993375 - DNA, 22 bp, Homo sapiens
aatgccttagaaatgtaaactg

SEQ ID NO: 993376 - DNA, 19 bp, Homo sapiens
aatgccttcatgaatcttt

SEQ ID NO: 993377 - DNA, 15 bp, Homo sapiens
aatgccttttcccaa

SEQ ID NO: 993378 - DNA, 16 bp, Homo sapiens
aatgcgacaagtagtt

SEQ ID NO: 993379 - DNA, 21 bp, Homo sapiens
aatgcgacaagtagttcatga

SEQ ID NO: 993380 - DNA, 15 bp, Homo sapiens
aatgcgagactctga

SEQ ID NO: 993381 - DNA, 17 bp, Homo sapiens
aatgcgagactctgatg

SEQ ID NO: 993382 - DNA, 21 bp, Homo sapiens
aatgcggttataaaaaatggt

SEQ ID NO: 993383 - DNA, 22 bp, Homo sapiens
aatgcggttataaaaaatggtt

SEQ ID NO: 993384 - DNA, 19 bp, Homo sapiens
aatgctaagaatgcattat

SEQ ID NO: 993385 - DNA, 16 bp, Homo sapiens
aatgctatttgaacaa

SEQ ID NO: 993386 - DNA, 20 bp, Homo sapiens
aatgctattttttattttac

SEQ ID NO: 993387 - DNA, 15 bp, Homo sapiens
aatgctcaagaatgt

SEQ ID NO: 993388 - DNA, 21 bp, Homo sapiens
aatgctcataaagatgttaaa

SEQ ID NO: 993389 - DNA, 20 bp, Homo sapiens
aatgctcattttctggtttg

SEQ ID NO: 993390 - DNA, 13 bp, Homo sapiens
aatgctccagctg

SEQ ID NO: 993391 - DNA, 21 bp, Homo sapiens
aatgctccagctgtcgtctga

SEQ ID NO: 993392 - DNA, 14 bp, Homo sapiens
aatgctcccagctg

SEQ ID NO: 993393 - DNA, 19 bp, Homo sapiens
aatgctcccagctgtgctg

SEQ ID NO: 993394 - DNA, 22 bp, Homo sapiens
aatgctcccatctcctgatttc

SEQ ID NO: 993395 - DNA, 23 bp, Homo sapiens
aatgctcccatctcctgatttct

SEQ ID NO: 993396 - DNA, 17 bp, Homo sapiens
aatgctcgtgtgatttc

SEQ ID NO: 993397 - DNA, 18 bp, Homo sapiens
aatgctgaaaatcaaagt

SEQ ID NO: 993398 - DNA, 18 bp, Homo sapiens
aatgctgaacattgcata

SEQ ID NO: 993399 - DNA, 18 bp, Homo sapiens
aatgctgaactccttgtt

SEQ ID NO: 993400 - DNA, 12 bp, Homo sapiens
aatgctgcactt

SEQ ID NO: 993401 - DNA, 13 bp, Homo sapiens
aatgctgcacttc

SEQ ID NO: 993402 - DNA, 14 bp, Homo sapiens
aatgctgcatttta

SEQ ID NO: 993403 - DNA, 16 bp, Homo sapiens
aatgctgcattttaat

SEQ ID NO: 993404 - DNA, 11 bp, Homo sapiens
aatgctgccag

SEQ ID NO: 993405 - DNA, 15 bp, Homo sapiens
aatgctgcctgcctg

SEQ ID NO: 993406 - DNA, 14 bp, Homo sapiens
aatgctgctggcca

SEQ ID NO: 993407 - DNA, 17 bp, Homo sapiens
aatgctgctttgtccag

SEQ ID NO: 993408 - DNA, 14 bp, Homo sapiens
aatgctggcctgac

SEQ ID NO: 993409 - DNA, 20 bp, Homo sapiens
aatgctgggcccccagcctg

SEQ ID NO: 993410 - DNA, 12 bp, Homo sapiens
aatgctgggctg

SEQ ID NO: 993411 - DNA, 22 bp, Homo sapiens
aatgctgggtatgctctgtgac

SEQ ID NO: 993412 - DNA, 21 bp, Homo sapiens
aatgctggttttcctaaatgc

SEQ ID NO: 993413 - DNA, 15 bp, Homo sapiens
aatgctgtacatcta

SEQ ID NO: 993414 - DNA, 19 bp, Homo sapiens
aatgctgtacgtactgcat

SEQ ID NO: 993415 - DNA, 15 bp, Homo sapiens
aatgctgtctttgtg

SEQ ID NO: 993416 - DNA, 16 bp, Homo sapiens
aatgctgttgcctcat

SEQ ID NO: 993417 - DNA, 18 bp, Homo sapiens
aatgctgtttctaagaaa

SEQ ID NO: 993418 - DNA, 19 bp, Homo sapiens
aatgctgtttctaagaaaa

SEQ ID NO: 993419 - DNA, 20 bp, Homo sapiens
aatgctgtttctaagaaaat

SEQ ID NO: 993420 - DNA, 15 bp, Homo sapiens
aatgcttaaactaaa

SEQ ID NO: 993421 - DNA, 15 bp, Homo sapiens
aatgcttagaaattc

SEQ ID NO: 993422 - DNA, 16 bp, Homo sapiens
aatgcttcagatatta

SEQ ID NO: 993423 - DNA, 18 bp, Homo sapiens
aatgcttcagatattatt

SEQ ID NO: 993424 - DNA, 13 bp, Homo sapiens
aatgcttcattca

SEQ ID NO: 993425 - DNA, 17 bp, Homo sapiens
aatgcttcattcaatat

SEQ ID NO: 993426 - DNA, 14 bp, Homo sapiens
aatgctttatttgt

SEQ ID NO: 993427 - DNA, 16 bp, Homo sapiens
aatgctttatttgtaa

SEQ ID NO: 993428 - DNA, 17 bp, Homo sapiens
aatgctttatttgtaaa

SEQ ID NO: 993429 - DNA, 19 bp, Homo sapiens
aatgctttatttgtaaatt

SEQ ID NO: 993430 - DNA, 15 bp, Homo sapiens
aatgctttccaaaac

SEQ ID NO: 993431 - DNA, 17 bp, Homo sapiens
aatgcttttatattcta

SEQ ID NO: 993432 - DNA, 14 bp, Homo sapiens
aatggaaaaaaaca

SEQ ID NO: 993433 - DNA, 15 bp, Homo sapiens
aatggaaaaatagta

SEQ ID NO: 993434 - DNA, 20 bp, Homo sapiens
aatggaaaatgccatgaatt

SEQ ID NO: 993435 - DNA, 15 bp, Homo sapiens
aatggaaaatgtata

SEQ ID NO: 993436 - DNA, 17 bp, Homo sapiens
aatggaaacattacagt

SEQ ID NO: 993437 - DNA, 17 bp, Homo sapiens
aatggaactactgtact

SEQ ID NO: 993438 - DNA, 12 bp, Homo sapiens
aatggaagcaaa

SEQ ID NO: 993439 - DNA, 10 bp, Homo sapiens
aatggaataa

SEQ ID NO: 993440 - DNA, 22 bp, Homo sapiens
aatggaataaaaggcttgaagc

SEQ ID NO: 993441 - DNA, 13 bp, Homo sapiens
aatggaataacta

SEQ ID NO: 993442 - DNA, 14 bp, Homo sapiens
aatggaataactat

SEQ ID NO: 993443 - DNA, 15 bp, Homo sapiens
aatggaataactatc

SEQ ID NO: 993444 - DNA, 15 bp, Homo sapiens
aatggaattattttg

SEQ ID NO: 993445 - DNA, 18 bp, Homo sapiens
aatggacaaaatccatga

SEQ ID NO: 993446 - DNA, 16 bp, Homo sapiens
aatggacaaagaaaac

SEQ ID NO: 993447 - DNA, 14 bp, Homo sapiens
aatggactgtgaat

SEQ ID NO: 993448 - DNA, 20 bp, Homo sapiens
aatggagaacagtttcatca

SEQ ID NO: 993449 - DNA, 15 bp, Homo sapiens
aatggagaagctgca

SEQ ID NO: 993450 - DNA, 16 bp, Homo sapiens
aatggagaagctgcag

SEQ ID NO: 993451 - DNA, 20 bp, Homo sapiens
aatggagattcagttttcat

SEQ ID NO: 993452 - DNA, 19 bp, Homo sapiens
aatggaggatctctaaaga

SEQ ID NO: 993453 - DNA, 13 bp, Homo sapiens
aatggaggcagag

SEQ ID NO: 993454 - DNA, 20 bp, Homo sapiens
aatggaggggcagagccagg

SEQ ID NO: 993455 - DNA, 18 bp, Homo sapiens
aatggagtaaagtggcaa

SEQ ID NO: 993456 - DNA, 19 bp, Homo sapiens
aatggagtcagtttgcagt

SEQ ID NO: 993457 - DNA, 21 bp, Homo sapiens
aatggagtctcccactgcaac

SEQ ID NO: 993458 - DNA, 13 bp, Homo sapiens
aatggataaatca

SEQ ID NO: 993459 - DNA, 17 bp, Homo sapiens
aatggatacataaagac

SEQ ID NO: 993460 - DNA, 22 bp, Homo sapiens
aatggatatttgtactgtttaa

SEQ ID NO: 993461 - DNA, 13 bp, Homo sapiens
aatggatcacaag

SEQ ID NO: 993462 - DNA, 15 bp, Homo sapiens
aatcacagttggcct

SEQ ID NO: 993463 - DNA, 22 bp, Homo sapiens
aatcacatattttaaaatttgt

SEQ ID NO: 993464 - DNA, 18 bp, Homo sapiens
aatcacatgaattattac

SEQ ID NO: 993465 - DNA, 21 bp, Homo sapiens
aatcacattttaagtgcttca

SEQ ID NO: 993466 - DNA, 13 bp, Homo sapiens
aatcaccatgtaa

SEQ ID NO: 993467 - DNA, 23 bp, Homo sapiens
aatcaccatgtaagcactctgga

SEQ ID NO: 993468 - DNA, 16 bp, Homo sapiens
aatcacgctttcctga

SEQ ID NO: 993469 - DNA, 15 bp, Homo sapiens
aatcacgctttttga

SEQ ID NO: 993470 - DNA, 16 bp, Homo sapiens
aatcacgctttttgaa

SEQ ID NO: 993471 - DNA, 18 bp, Homo sapiens
aatcacgctttttgaaaa

SEQ ID NO: 993472 - DNA, 20 bp, Homo sapiens
aatcacggtggtaaagaaag

SEQ ID NO: 993473 - DNA, 21 bp, Homo sapiens
aatcacgttgctggtggtttt

SEQ ID NO: 993474 - DNA, 20 bp, Homo sapiens
aatcactactgtatgtaata

SEQ ID NO: 993475 - DNA, 18 bp, Homo sapiens
aatcactctgtccttgga

SEQ ID NO: 993476 - DNA, 12 bp, Homo sapiens
aatcactgtgaa

SEQ ID NO: 993477 - DNA, 16 bp, Homo sapiens
aatcactgtgaaattt

SEQ ID NO: 993478 - DNA, 18 bp, Homo sapiens
aatcactgtgaaatttca

SEQ ID NO: 993479 - DNA, 22 bp, Homo sapiens
aatcactgtgaaatttcatgat

SEQ ID NO: 993480 - DNA, 23 bp, Homo sapiens
aatcactgtgaaatttcatgatt

SEQ ID NO: 993481 - DNA, 21 bp, Homo sapiens
aatcactgtttagaacacaca

SEQ ID NO: 993482 - DNA, 13 bp, Homo sapiens
aatcacttcagat

SEQ ID NO: 993483 - DNA, 13 bp, Homo sapiens
aatcacttggggt

SEQ ID NO: 993484 - DNA, 16 bp, Homo sapiens
aatcactttgtctaac

SEQ ID NO: 993485 - DNA, 15 bp, Homo sapiens
aatcagaaaagctat

SEQ ID NO: 993486 - DNA, 14 bp, Homo sapiens
aatcagaaaagtaa

SEQ ID NO: 993487 - DNA, 22 bp, Homo sapiens
aatcagaaaagtaattttgtca

SEQ ID NO: 993488 - DNA, 19 bp, Homo sapiens
aatcagaacagatgctgag

SEQ ID NO: 993489 - DNA, 17 bp, Homo sapiens
aatcagaatcatggaga

SEQ ID NO: 993490 - DNA, 20 bp, Homo sapiens
aatcagaccctaccccacca

SEQ ID NO: 993491 - DNA, 14 bp, Homo sapiens
aatcagagagccta

SEQ ID NO: 993492 - DNA, 20 bp, Homo sapiens
aatcagagagcctagaacat

SEQ ID NO: 993493 - DNA, 17 bp, Homo sapiens
aatcagatgatggccat

SEQ ID NO: 993494 - DNA, 19 bp, Homo sapiens
aatcagcatatgtgtaaag

SEQ ID NO: 993495 - DNA, 14 bp, Homo sapiens
aatcagcatgacaa

SEQ ID NO: 993496 - DNA, 23 bp, Homo sapiens
aatcagcatgacaaaaataacac

SEQ ID NO: 993497 - DNA, 16 bp, Homo sapiens
aatcagcccccagcct

SEQ ID NO: 993498 - DNA, 15 bp, Homo sapiens
aatcagctggacata

SEQ ID NO: 993499 - DNA, 21 bp, Homo sapiens
aatcagcttttgttctagact

SEQ ID NO: 993500 - DNA, 16 bp, Homo sapiens
aatcaggaaaggctgt

SEQ ID NO: 993501 - DNA, 20 bp, Homo sapiens
aatcaggaatattttccaaa

SEQ ID NO: 993502 - DNA, 21 bp, Homo sapiens
aatcaggaatgagtcaatcag

SEQ ID NO: 993503 - DNA, 21 bp, Homo sapiens
aatcaggcatgtgtcccttcc

SEQ ID NO: 993504 - DNA, 22 bp, Homo sapiens
aatcaggcccctgttatgctta

SEQ ID NO: 993505 - DNA, 18 bp, Homo sapiens
aatcagggaggtcatttt

SEQ ID NO: 993506 - DNA, 14 bp, Homo sapiens
aatcaggggccaga

SEQ ID NO: 993507 - DNA, 16 bp, Homo sapiens
aatcaggtggcttttg

SEQ ID NO: 993508 - DNA, 15 bp, Homo sapiens
aatcaggtgttttaa

SEQ ID NO: 993509 - DNA, 15 bp, Homo sapiens
aatcagtataaacaa

SEQ ID NO: 993510 - DNA, 14 bp, Homo sapiens
aatcagtatcagaa

SEQ ID NO: 993511 - DNA, 15 bp, Homo sapiens
aatcagtatcagaat

SEQ ID NO: 993512 - DNA, 18 bp, Homo sapiens
aatcagtatttccttcca

SEQ ID NO: 993513 - DNA, 13 bp, Homo sapiens
aatcagtattttt

SEQ ID NO: 993514 - DNA, 15 bp, Homo sapiens
aatcagtcccctccc

SEQ ID NO: 993515 - DNA, 11 bp, Homo sapiens
aatcagtgaag

SEQ ID NO: 993516 - DNA, 17 bp, Homo sapiens
aatcagtgatctatgtt

SEQ ID NO: 993517 - DNA, 20 bp, Homo sapiens
aatcagtgatctatgtttgt

SEQ ID NO: 993518 - DNA, 17 bp, Homo sapiens
aatcagtgcagtgatac

SEQ ID NO: 993519 - DNA, 23 bp, Homo sapiens
aatcagtgcctggtgttctgaag

SEQ ID NO: 993520 - DNA, 17 bp, Homo sapiens
aatcagtgttaaattca

SEQ ID NO: 993521 - DNA, 15 bp, Homo sapiens
aatcagtgtttaaat

SEQ ID NO: 993522 - DNA, 22 bp, Homo sapiens
aatcagttatacagttataaaa

SEQ ID NO: 993523 - DNA, 19 bp, Homo sapiens
aatcagttcattagaaata

SEQ ID NO: 993524 - DNA, 14 bp, Homo sapiens
aatcagtttatcct

SEQ ID NO: 993525 - DNA, 13 bp, Homo sapiens
aatcatacaaact

SEQ ID NO: 993526 - DNA, 22 bp, Homo sapiens
aatcatactgcctactgttact

SEQ ID NO: 993527 - DNA, 15 bp, Homo sapiens
aatcatacttaacat

SEQ ID NO: 993528 - DNA, 18 bp, Homo sapiens
aatcatataataaatgta

SEQ ID NO: 993529 - DNA, 21 bp, Homo sapiens
aatcatataataaatgtacat

SEQ ID NO: 993530 - DNA, 14 bp, Homo sapiens
aatcatatgattct

SEQ ID NO: 993531 - DNA, 14 bp, Homo sapiens
aatcatcaagaagg

SEQ ID NO: 993532 - DNA, 19 bp, Homo sapiens
aatcatccctccttgccta

SEQ ID NO: 993533 - DNA, 14 bp, Homo sapiens
acactgtcttcccg

SEQ ID NO: 993534 - DNA, 19 bp, Homo sapiens
acactgtcttcccgatgag

SEQ ID NO: 993535 - DNA, 15 bp, Homo sapiens
acactgtgagagttg

SEQ ID NO: 993536 - DNA, 13 bp, Homo sapiens
acactgtgatttt

SEQ ID NO: 993537 - DNA, 22 bp, Homo sapiens
acactgtgattttgccctcctg

SEQ ID NO: 993538 - DNA, 23 bp, Homo sapiens
acactgtgattttgccctcctgc

SEQ ID NO: 993539 - DNA, 19 bp, Homo sapiens
acagatgaactctttctgg

SEQ ID NO: 993540 - DNA, 17 bp, Homo sapiens
acagatgaccataattt

SEQ ID NO: 993541 - DNA, 19 bp, Homo sapiens
acagatgaccataattttt

SEQ ID NO: 993542 - DNA, 19 bp, Homo sapiens
acagatgccttttttgtag

SEQ ID NO: 993543 - DNA, 14 bp, Homo sapiens
acagatgctccagg

SEQ ID NO: 993544 - DNA, 16 bp, Homo sapiens
acagatgctgagccat

SEQ ID NO: 993545 - DNA, 21 bp, Homo sapiens
acagatggaaaaactgaggct

SEQ ID NO: 993546 - DNA, 19 bp, Homo sapiens
acagatggacgcaggccct

SEQ ID NO: 993547 - DNA, 20 bp, Homo sapiens
acagatggagcaaatgtcct

SEQ ID NO: 993548 - DNA, 16 bp, Homo sapiens
acagatggcccaaggg

SEQ ID NO: 993549 - DNA, 21 bp, Homo sapiens
acagatggcccaagggatggc

SEQ ID NO: 993550 - DNA, 22 bp, Homo sapiens
acagatggcccaagggatggca

SEQ ID NO: 993551 - DNA, 16 bp, Homo sapiens
acagatgtgaaatgaa

SEQ ID NO: 993552 - DNA, 21 bp, Homo sapiens
acagatgtgtctgggagagcc

SEQ ID NO: 993553 - DNA, 22 bp, Homo sapiens
acagatgtgtctgggagagcct

SEQ ID NO: 993554 - DNA, 24 bp, Homo sapiens
acagatgtttcttttgtatgtaaa

SEQ ID NO: 993555 - DNA, 20 bp, Homo sapiens
acagattaggtttgtcccag

SEQ ID NO: 993556 - DNA, 23 bp, Homo sapiens
acagattcactttgtttatgcat

SEQ ID NO: 993557 - DNA, 15 bp, Homo sapiens
acagattcaggccag

SEQ ID NO: 993558 - DNA, 18 bp, Homo sapiens
acagattcaggccagccc

SEQ ID NO: 993559 - DNA, 13 bp, Homo sapiens
acagattgaagaa

SEQ ID NO: 993560 - DNA, 21 bp, Homo sapiens
acagattgaagaatctgcccc

SEQ ID NO: 993561 - DNA, 16 bp, Homo sapiens
acagattgcctcctta

SEQ ID NO: 993562 - DNA, 18 bp, Homo sapiens
acagattgctgaaactgt

SEQ ID NO: 993563 - DNA, 16 bp, Homo sapiens
acagattgctgcttct

SEQ ID NO: 993564 - DNA, 19 bp, Homo sapiens
acagatttcagtaatgtct

SEQ ID NO: 993565 - DNA, 20 bp, Homo sapiens
acagatttcagtaatgtctt

SEQ ID NO: 993566 - DNA, 20 bp, Homo sapiens
acagattttggggttgtgtt

SEQ ID NO: 993567 - DNA, 22 bp, Homo sapiens
acagattttggggttgtgttgt

SEQ ID NO: 993568 - DNA, 15 bp, Homo sapiens
acagatttttacaaa

SEQ ID NO: 993569 - DNA, 17 bp, Homo sapiens
acagatttttacactaa

SEQ ID NO: 993570 - DNA, 20 bp, Homo sapiens
acagatttttacactaatat

SEQ ID NO: 993571 - DNA, 15 bp, Homo sapiens
acagcaaacaggtgc

SEQ ID NO: 993572 - DNA, 13 bp, Homo sapiens
acagcaaaccctg

SEQ ID NO: 993573 - DNA, 14 bp, Homo sapiens
acagcaaccccagg

SEQ ID NO: 993574 - DNA, 13 bp, Homo sapiens
acagcaagaaata

SEQ ID NO: 993575 - DNA, 15 bp, Homo sapiens
acagcaagccatcat

SEQ ID NO: 993576 - DNA, 21 bp, Homo sapiens
acagcaaggaaatgtcctgca

SEQ ID NO: 993577 - DNA, 22 bp, Homo sapiens
acagcaaggaaatgtcctgcat

SEQ ID NO: 993578 - DNA, 17 bp, Homo sapiens
acagcaaggagatttac

SEQ ID NO: 993579 - DNA, 21 bp, Homo sapiens
acagcaagtagataaatattt

SEQ ID NO: 993580 - DNA, 16 bp, Homo sapiens
acagcaagtgagcaga

SEQ ID NO: 993581 - DNA, 15 bp, Homo sapiens
acagcaattcctcag

SEQ ID NO: 993582 - DNA, 14 bp, Homo sapiens
acagcaatttctaa

SEQ ID NO: 993583 - DNA, 13 bp, Homo sapiens
acagcacagaatg

SEQ ID NO: 993584 - DNA, 17 bp, Homo sapiens
acagcacatcacctctt

SEQ ID NO: 993585 - DNA, 14 bp, Homo sapiens
acagcaccactgct

SEQ ID NO: 993586 - DNA, 19 bp, Homo sapiens
acagcaccactgctgagga

SEQ ID NO: 993587 - DNA, 13 bp, Homo sapiens
acagcactactct

SEQ ID NO: 993588 - DNA, 20 bp, Homo sapiens
acagcactactgggtgtcat

SEQ ID NO: 993589 - DNA, 18 bp, Homo sapiens
acagcagactcagctctg

SEQ ID NO: 993590 - DNA, 23 bp, Homo sapiens
acagcagactcagctctgacatt

SEQ ID NO: 993591 - DNA, 19 bp, Homo sapiens
acagcagattccacaggac

SEQ ID NO: 993592 - DNA, 13 bp, Homo sapiens
acagcagcactcc

SEQ ID NO: 993593 - DNA, 20 bp, Homo sapiens
acagcagcactcccgctgca

SEQ ID NO: 993594 - DNA, 22 bp, Homo sapiens
acagcagcagaacaagtgcctc

SEQ ID NO: 993595 - DNA, 19 bp, Homo sapiens
acagcagccccccagcact

SEQ ID NO: 993596 - DNA, 20 bp, Homo sapiens
acagcagccccccagcacta

SEQ ID NO: 993597 - DNA, 17 bp, Homo sapiens
acagcagcctgtatgtg

SEQ ID NO: 993598 - DNA, 15 bp, Homo sapiens
acagcagcctgtgag

SEQ ID NO: 993599 - DNA, 17 bp, Homo sapiens
acagcagctcaggcaca

SEQ ID NO: 993600 - DNA, 16 bp, Homo sapiens
acagcagctcatagaa

SEQ ID NO: 993601 - DNA, 13 bp, Homo sapiens
acagcagcttcac

SEQ ID NO: 993602 - DNA, 22 bp, Homo sapiens
acagcagcttcaccagagcatt

SEQ ID NO: 993603 - DNA, 12 bp, Homo sapiens
acagcaggcagc

SEQ ID NO: 993604 - DNA, 16 bp, Homo sapiens
acagcaggcagcgcca

SEQ ID NO: 993605 - DNA, 17 bp, Homo sapiens
acagcaggccactagtg

SEQ ID NO: 993606 - DNA, 18 bp, Homo sapiens
acagcaggccactagtga

SEQ ID NO: 993607 - DNA, 13 bp, Homo sapiens
acagcaggggagc

SEQ ID NO: 993608 - DNA, 22 bp, Homo sapiens
acagcagggtagtctggtttct

SEQ ID NO: 993609 - DNA, 18 bp, Homo sapiens
acagcagggtcttgctgt

SEQ ID NO: 993610 - DNA, 18 bp, Homo sapiens
acagcaggtcctccatcc

SEQ ID NO: 993611 - DNA, 17 bp, Homo sapiens
acagcagtaatcctggg

SEQ ID NO: 993612 - DNA, 12 bp, Homo sapiens
acagcagtattg

SEQ ID NO: 993613 - DNA, 21 bp, Homo sapiens
acagcagtcccagtattctca

SEQ ID NO: 993614 - DNA, 22 bp, Homo sapiens
acagcagtcccagtattctcag

SEQ ID NO: 993615 - DNA, 22 bp, Homo sapiens
acagcagtgatctcagggcaga

SEQ ID NO: 993616 - DNA, 13 bp, Homo sapiens
acagcatcagggt

SEQ ID NO: 993617 - DNA, 15 bp, Homo sapiens
acagcatcccttccc

SEQ ID NO: 993618 - DNA, 19 bp, Homo sapiens
acagcatcccttcccacat

SEQ ID NO: 993619 - DNA, 20 bp, Homo sapiens
acagcatcgggagcacccag

SEQ ID NO: 993620 - DNA, 22 bp, Homo sapiens
acagcatcgggagcacccagag

SEQ ID NO: 993621 - DNA, 13 bp, Homo sapiens
acagcatgaataa

SEQ ID NO: 993622 - DNA, 24 bp, Homo sapiens
acagcatgaataaaacactcatcc

SEQ ID NO: 993623 - DNA, 13 bp, Homo sapiens
acagcatgcccct

SEQ ID NO: 993624 - DNA, 15 bp, Homo sapiens
acagcatgccccttg

SEQ ID NO: 993625 - DNA, 17 bp, Homo sapiens
acagcatgccccttggc

SEQ ID NO: 993626 - DNA, 19 bp, Homo sapiens
acagcatgccccttggctg

SEQ ID NO: 993627 - DNA, 20 bp, Homo sapiens
acagcattaaaattttacct

SEQ ID NO: 993628 - DNA, 19 bp, Homo sapiens
acagcattcttgtcacaat

SEQ ID NO: 993629 - DNA, 13 bp, Homo sapiens
acagcattgtctt

SEQ ID NO: 993630 - DNA, 20 bp, Homo sapiens
acagcattgtctttgctgta

SEQ ID NO: 993631 - DNA, 23 bp, Homo sapiens
acagccaaatgcatggtgcagtt

SEQ ID NO: 993632 - DNA, 14 bp, Homo sapiens
acagccaaatttaa

SEQ ID NO: 993633 - DNA, 15 bp, Homo sapiens
acagccaaatttaaa

SEQ ID NO: 993634 - DNA, 13 bp, Homo sapiens
acaggaccccagc

SEQ ID NO: 993635 - DNA, 17 bp, Homo sapiens
acaggaccccagctctg

SEQ ID NO: 993636 - DNA, 14 bp, Homo sapiens
acaggacccccttc

SEQ ID NO: 993637 - DNA, 14 bp, Homo sapiens
acaggactctgcct

SEQ ID NO: 993638 - DNA, 15 bp, Homo sapiens
acaggactctgcctc

SEQ ID NO: 993639 - DNA, 15 bp, Homo sapiens
acaggactgaaaagg

SEQ ID NO: 993640 - DNA, 17 bp, Homo sapiens
acaggactgagccctct

SEQ ID NO: 993641 - DNA, 20 bp, Homo sapiens
acaggactgagccctctcac

SEQ ID NO: 993642 - DNA, 15 bp, Homo sapiens
acaggactgtaaaga

SEQ ID NO: 993643 - DNA, 17 bp, Homo sapiens
acaggactgtaaagatt

SEQ ID NO: 993644 - DNA, 20 bp, Homo sapiens
acaggactgtaaagatttgt

SEQ ID NO: 993645 - DNA, 15 bp, Homo sapiens
acaggagacaaaaga

SEQ ID NO: 993646 - DNA, 14 bp, Homo sapiens
acaggagacctggc

SEQ ID NO: 993647 - DNA, 14 bp, Homo sapiens
acaggagactccaa

SEQ ID NO: 993648 - DNA, 22 bp, Homo sapiens
acaggagaggcagcatgcttgg

SEQ ID NO: 993649 - DNA, 20 bp, Homo sapiens
acaggagcaatcacaggaaa

SEQ ID NO: 993650 - DNA, 12 bp, Homo sapiens
acaggagctttt

SEQ ID NO: 993651 - DNA, 15 bp, Homo sapiens
acaggagggcccgga

SEQ ID NO: 993652 - DNA, 17 bp, Homo sapiens
acaggaggttgtggatg

SEQ ID NO: 993653 - DNA, 23 bp, Homo sapiens
acaggaggttgtggatgctccag

SEQ ID NO: 993654 - DNA, 19 bp, Homo sapiens
acaggagtcttcagaccca

SEQ ID NO: 993655 - DNA, 23 bp, Homo sapiens
acaggagtgtcctcttccctctc

SEQ ID NO: 993656 - DNA, 16 bp, Homo sapiens
acaggataataaaaca

SEQ ID NO: 993657 - DNA, 12 bp, Homo sapiens
acaggatccagg

SEQ ID NO: 993658 - DNA, 18 bp, Homo sapiens
acaggatccaggccggct

SEQ ID NO: 993659 - DNA, 23 bp, Homo sapiens
acaggatctataggcagcttcta

SEQ ID NO: 993660 - DNA, 17 bp, Homo sapiens
acaggatgaaagttccc

SEQ ID NO: 993661 - DNA, 19 bp, Homo sapiens
acaggcaaaatccttgctt

SEQ ID NO: 993662 - DNA, 17 bp, Homo sapiens
acaggcaaaccaataca

SEQ ID NO: 993663 - DNA, 14 bp, Homo sapiens
acaggcaaatgcat

SEQ ID NO: 993664 - DNA, 18 bp, Homo sapiens
acaggcaaggaaacaggc

SEQ ID NO: 993665 - DNA, 17 bp, Homo sapiens
acaggcaccgagaatgt

SEQ ID NO: 993666 - DNA, 13 bp, Homo sapiens
acaggcacgtgcc

SEQ ID NO: 993667 - DNA, 9 bp, Homo sapiens
acaggcagc

SEQ ID NO: 993668 - DNA, 16 bp, Homo sapiens
acaggcagcctggaca

SEQ ID NO: 993669 - DNA, 12 bp, Homo sapiens
acaggcaggggc

SEQ ID NO: 993670 - DNA, 12 bp, Homo sapiens
acaggcagtgca

SEQ ID NO: 993671 - DNA, 13 bp, Homo sapiens
acaggcagtgcat

SEQ ID NO: 993672 - DNA, 16 bp, Homo sapiens
acaggcagtgcatgtg

SEQ ID NO: 993673 - DNA, 17 bp, Homo sapiens
acaggcagtgcatgtga

SEQ ID NO: 993674 - DNA, 18 bp, Homo sapiens
acaggcagtgcatgtgaa

SEQ ID NO: 993675 - DNA, 21 bp, Homo sapiens
acaggcagtgcatgtgaagca

SEQ ID NO: 993676 - DNA, 18 bp, Homo sapiens
acaggcagttaggtgctg

SEQ ID NO: 993677 - DNA, 15 bp, Homo sapiens
acaggcatgagccac

SEQ ID NO: 993678 - DNA, 19 bp, Homo sapiens
acaggcatgagccactgca

SEQ ID NO: 993679 - DNA, 20 bp, Homo sapiens
acaggcatgagccactgcac

SEQ ID NO: 993680 - DNA, 22 bp, Homo sapiens
acaggcatgggtgcaaggaaaa

SEQ ID NO: 993681 - DNA, 17 bp, Homo sapiens
acaggcatttgttcact

SEQ ID NO: 993682 - DNA, 12 bp, Homo sapiens
acaggcccagca

SEQ ID NO: 993683 - DNA, 13 bp, Homo sapiens
acaggcccagtgg

SEQ ID NO: 993684 - DNA, 17 bp, Homo sapiens
acaggccccacgccctc

SEQ ID NO: 993685 - DNA, 19 bp, Homo sapiens
acaggccccacgccctctc

SEQ ID NO: 993686 - DNA, 21 bp, Homo sapiens
acaggcccccttgagtggggt

SEQ ID NO: 993687 - DNA, 16 bp, Homo sapiens
acaggccccttttgtg

SEQ ID NO: 993688 - DNA, 19 bp, Homo sapiens
acaggcccgccctctgcct

SEQ ID NO: 993689 - DNA, 17 bp, Homo sapiens
acaggccctccctgtct

SEQ ID NO: 993690 - DNA, 17 bp, Homo sapiens
acaggccctgctcctgc

SEQ ID NO: 993691 - DNA, 19 bp, Homo sapiens
acaggccctgctcctgcag

SEQ ID NO: 993692 - DNA, 22 bp, Homo sapiens
acaggccctggagaagcagcta

SEQ ID NO: 993693 - DNA, 15 bp, Homo sapiens
acaggcccttcctct

SEQ ID NO: 993694 - DNA, 12 bp, Homo sapiens
acaggccttctg

SEQ ID NO: 993695 - DNA, 14 bp, Homo sapiens
acaggccttctgtg

SEQ ID NO: 993696 - DNA, 22 bp, Homo sapiens
acaggccttctgtggggctggg

SEQ ID NO: 993697 - DNA, 17 bp, Homo sapiens
acaggcgggaggaggtg

SEQ ID NO: 993698 - DNA, 16 bp, Homo sapiens
acaggctcgtcagcca

SEQ ID NO: 993699 - DNA, 18 bp, Homo sapiens
acaggctctagagagagg

SEQ ID NO: 993700 - DNA, 23 bp, Homo sapiens
acaggctctagagagagggagaa

SEQ ID NO: 993701 - DNA, 14 bp, Homo sapiens
acaggctctgaggg

SEQ ID NO: 993702 - DNA, 16 bp, Homo sapiens
acaggctctgaggggc

SEQ ID NO: 993703 - DNA, 22 bp, Homo sapiens
acaggctgaaatatccacccag

SEQ ID NO: 993704 - DNA, 13 bp, Homo sapiens
acaggctggggcc

SEQ ID NO: 993705 - DNA, 18 bp, Homo sapiens
acaggtgtttgactttca

SEQ ID NO: 993706 - DNA, 14 bp, Homo sapiens
acaggttttataat

SEQ ID NO: 993707 - DNA, 17 bp, Homo sapiens
acagtaaaaacttgtac

SEQ ID NO: 993708 - DNA, 14 bp, Homo sapiens
acagtaaaaataaa

SEQ ID NO: 993709 - DNA, 10 bp, Homo sapiens
acagtaactt

SEQ ID NO: 993710 - DNA, 16 bp, Homo sapiens
acagtaactttatgtg

SEQ ID NO: 993711 - DNA, 20 bp, Homo sapiens
acagtaagttcctactaggc

SEQ ID NO: 993712 - DNA, 13 bp, Homo sapiens
acagtaataggag

SEQ ID NO: 993713 - DNA, 22 bp, Homo sapiens
acagtaatctatgtgtttctgt

SEQ ID NO: 993714 - DNA, 18 bp, Homo sapiens
acagtaatgaaatgttta

SEQ ID NO: 993715 - DNA, 16 bp, Homo sapiens
acagtaatgtcataaa

SEQ ID NO: 993716 - DNA, 16 bp, Homo sapiens
acagtacagaaggcaa

SEQ ID NO: 993717 - DNA, 16 bp, Homo sapiens
acagtacctatgactt

SEQ ID NO: 993718 - DNA, 18 bp, Homo sapiens
acagtacctgattgtatt

SEQ ID NO: 993719 - DNA, 20 bp, Homo sapiens
acagtactttattgtacaga

SEQ ID NO: 993720 - DNA, 13 bp, Homo sapiens
acagtagctgcta

SEQ ID NO: 993721 - DNA, 23 bp, Homo sapiens
acagtagtcttgatgaccaaagt

SEQ ID NO: 993722 - DNA, 19 bp, Homo sapiens
acagtagttgtattcttct

SEQ ID NO: 993723 - DNA, 14 bp, Homo sapiens
acagtagtttccct

SEQ ID NO: 993724 - DNA, 22 bp, Homo sapiens
acagtatatcccaagtgcactt

SEQ ID NO: 993725 - DNA, 13 bp, Homo sapiens
acagtatatttta

SEQ ID NO: 993726 - DNA, 15 bp, Homo sapiens
acagtatattttatt

SEQ ID NO: 993727 - DNA, 17 bp, Homo sapiens
acagtatattttatttc

SEQ ID NO: 993728 - DNA, 20 bp, Homo sapiens
acagtatccaatgtcttttg

SEQ ID NO: 993729 - DNA, 15 bp, Homo sapiens
acagtatcccacatc

SEQ ID NO: 993730 - DNA, 19 bp, Homo sapiens
acagtatgagtcaatgtgc

SEQ ID NO: 993731 - DNA, 18 bp, Homo sapiens
acagtatgatgaaaataa

SEQ ID NO: 993732 - DNA, 18 bp, Homo sapiens
acagtattaagggtagga

SEQ ID NO: 993733 - DNA, 20 bp, Homo sapiens
acagtattatacgctggcaa

SEQ ID NO: 993734 - DNA, 14 bp, Homo sapiens
acagtatttgtaat

SEQ ID NO: 993735 - DNA, 17 bp, Homo sapiens
acagtcaaaacagagat

SEQ ID NO: 993736 - DNA, 22 bp, Homo sapiens
acagtcaaatatcatttactct

SEQ ID NO: 993737 - DNA, 16 bp, Homo sapiens
acagtcacccttctgg

SEQ ID NO: 993738 - DNA, 16 bp, Homo sapiens
acagtcaggggctggg

SEQ ID NO: 993739 - DNA, 22 bp, Homo sapiens
acagtcaggggctgggcatccc

SEQ ID NO: 993740 - DNA, 15 bp, Homo sapiens
acagtcataaatact

SEQ ID NO: 993741 - DNA, 19 bp, Homo sapiens
acagtcataaatactgtca

SEQ ID NO: 993742 - DNA, 18 bp, Homo sapiens
acagtcatcatcagggcc

SEQ ID NO: 993743 - DNA, 21 bp, Homo sapiens
acagtcatcatcagggcctgg

SEQ ID NO: 993744 - DNA, 18 bp, Homo sapiens
acagtcatgtatgcaagt

SEQ ID NO: 993745 - DNA, 15 bp, Homo sapiens
acagtcattctagga

SEQ ID NO: 993746 - DNA, 21 bp, Homo sapiens
acagtcattctaggatgtgga

SEQ ID NO: 993747 - DNA, 14 bp, Homo sapiens
acagtcatttaaaa

SEQ ID NO: 993748 - DNA, 20 bp, Homo sapiens
acagtccaaccagaaacacc

SEQ ID NO: 993749 - DNA, 22 bp, Homo sapiens
acagtccacaggggccaccacc

SEQ ID NO: 993750 - DNA, 23 bp, Homo sapiens
acagtcccccacccacctcctgc

SEQ ID NO: 993751 - DNA, 17 bp, Homo sapiens
acagtccgtcaaaacag

SEQ ID NO: 993752 - DNA, 19 bp, Homo sapiens
acagtcctaactggtatag

SEQ ID NO: 993753 - DNA, 12 bp, Homo sapiens
acagtcctccat

SEQ ID NO: 993754 - DNA, 13 bp, Homo sapiens
acagtcctccatc

SEQ ID NO: 993755 - DNA, 21 bp, Homo sapiens
acagtcctgggagaacctcag

SEQ ID NO: 993756 - DNA, 23 bp, Homo sapiens
acagtcctgggagaacctcaggc

SEQ ID NO: 993757 - DNA, 15 bp, Homo sapiens
acagtccttgctttg

SEQ ID NO: 993758 - DNA, 22 bp, Homo sapiens
acagtcctttcccaccattcct

SEQ ID NO: 993759 - DNA, 19 bp, Homo sapiens
acagtcggtgaccccatca

SEQ ID NO: 993760 - DNA, 18 bp, Homo sapiens
acagtcgtaaaagagata

SEQ ID NO: 993761 - DNA, 20 bp, Homo sapiens
acagtctaaaaattgataga

SEQ ID NO: 993762 - DNA, 12 bp, Homo sapiens
acagtctaaagc

SEQ ID NO: 993763 - DNA, 21 bp, Homo sapiens
acatctaagcctgaaggggcg

SEQ ID NO: 993764 - DNA, 21 bp, Homo sapiens
acatctaatgtctcttcctct

SEQ ID NO: 993765 - DNA, 22 bp, Homo sapiens
acatctaatgtctcttcctctg

SEQ ID NO: 993766 - DNA, 23 bp, Homo sapiens
acatctacattttttaaaactga

SEQ ID NO: 993767 - DNA, 17 bp, Homo sapiens
acatctacctatactta

SEQ ID NO: 993768 - DNA, 18 bp, Homo sapiens
acatctattttggattgt

SEQ ID NO: 993769 - DNA, 19 bp, Homo sapiens
acatctattttggattgta

SEQ ID NO: 993770 - DNA, 19 bp, Homo sapiens
acatctcaggggccagagg

SEQ ID NO: 993771 - DNA, 20 bp, Homo sapiens
acatctcaggggccagagga

SEQ ID NO: 993772 - DNA, 12 bp, Homo sapiens
acatctccagaa

SEQ ID NO: 993773 - DNA, 19 bp, Homo sapiens
acatctccagaaaaatgaa

SEQ ID NO: 993774 - DNA, 23 bp, Homo sapiens
acatctcccttttccatgactgt

SEQ ID NO: 993775 - DNA, 23 bp, Homo sapiens
acatctctagtgtagctgccaca

SEQ ID NO: 993776 - DNA, 12 bp, Homo sapiens
acatctctcccc

SEQ ID NO: 993777 - DNA, 21 bp, Homo sapiens
acatctctccccaaccctagg

SEQ ID NO: 993778 - DNA, 17 bp, Homo sapiens
acatctctctgccctct

SEQ ID NO: 993779 - DNA, 21 bp, Homo sapiens
acatctctctgccctctccct

SEQ ID NO: 993780 - DNA, 22 bp, Homo sapiens
acatctctctgccctctccctg

SEQ ID NO: 993781 - DNA, 13 bp, Homo sapiens
acatctctctggc

SEQ ID NO: 993782 - DNA, 15 bp, Homo sapiens
acatctctgactttc

SEQ ID NO: 993783 - DNA, 13 bp, Homo sapiens
acatctcttcctc

SEQ ID NO: 993784 - DNA, 23 bp, Homo sapiens
acatctcttcctccgaggccagt

SEQ ID NO: 993785 - DNA, 21 bp, Homo sapiens
acatctcttgaaacctgttaa

SEQ ID NO: 993786 - DNA, 12 bp, Homo sapiens
acatctgataac

SEQ ID NO: 993787 - DNA, 12 bp, Homo sapiens
acatctgcaccc

SEQ ID NO: 993788 - DNA, 18 bp, Homo sapiens
acatctgcctcctctcct

SEQ ID NO: 993789 - DNA, 21 bp, Homo sapiens
acatctgcctgtaattaaact

SEQ ID NO: 993790 - DNA, 23 bp, Homo sapiens
acatctgcctgtaattaaactag

SEQ ID NO: 993791 - DNA, 23 bp, Homo sapiens
acatctgccttaaaaccaaagag

SEQ ID NO: 993792 - DNA, 12 bp, Homo sapiens
acatctgctgtg

SEQ ID NO: 993793 - DNA, 19 bp, Homo sapiens
acatctggatgccttcccc

SEQ ID NO: 993794 - DNA, 17 bp, Homo sapiens
acatctggcatggctcc

SEQ ID NO: 993795 - DNA, 14 bp, Homo sapiens
acatctggccctga

SEQ ID NO: 993796 - DNA, 18 bp, Homo sapiens
acatctggctgcacaggc

SEQ ID NO: 993797 - DNA, 20 bp, Homo sapiens
acatctggctgcacaggctg

SEQ ID NO: 993798 - DNA, 15 bp, Homo sapiens
acatctgggtgccct

SEQ ID NO: 993799 - DNA, 13 bp, Homo sapiens
acatctgtaaaga

SEQ ID NO: 993800 - DNA, 18 bp, Homo sapiens
acatctgtaaagaaaacc

SEQ ID NO: 993801 - DNA, 23 bp, Homo sapiens
acatctgtagggaattcttctgt

SEQ ID NO: 993802 - DNA, 18 bp, Homo sapiens
acatctgtcctcaccctg

SEQ ID NO: 993803 - DNA, 21 bp, Homo sapiens
acatctgtcctcaccctgtgg

SEQ ID NO: 993804 - DNA, 15 bp, Homo sapiens
acatctgtgtcttgt

SEQ ID NO: 993805 - DNA, 16 bp, Homo sapiens
acatctgtgtcttgtt

SEQ ID NO: 993806 - DNA, 15 bp, Homo sapiens
acatcttaaattcat

SEQ ID NO: 993807 - DNA, 20 bp, Homo sapiens
acatcttaaattcatttcta

SEQ ID NO: 993808 - DNA, 15 bp, Homo sapiens
acatcttacctctca

SEQ ID NO: 993809 - DNA, 13 bp, Homo sapiens
acatcttcagatt

SEQ ID NO: 993810 - DNA, 18 bp, Homo sapiens
acatcttctgtgaaatat

SEQ ID NO: 993811 - DNA, 20 bp, Homo sapiens
acatcttgaatactctgccc

SEQ ID NO: 993812 - DNA, 23 bp, Homo sapiens
acatcttgactaggtattgtcta

SEQ ID NO: 993813 - DNA, 21 bp, Homo sapiens
acatcttgcctacttttcttt

SEQ ID NO: 993814 - DNA, 20 bp, Homo sapiens
acatcttgtcaacatgcatt

SEQ ID NO: 993815 - DNA, 19 bp, Homo sapiens
acatcttgttggtaccttt

SEQ ID NO: 993816 - DNA, 11 bp, Homo sapiens
acatctttaag

SEQ ID NO: 993817 - DNA, 22 bp, Homo sapiens
acatctttacgtactgtaactg

SEQ ID NO: 993818 - DNA, 19 bp, Homo sapiens
acatctttattgaaattct

SEQ ID NO: 993819 - DNA, 22 bp, Homo sapiens
acatctttattgaaattctatt

SEQ ID NO: 993820 - DNA, 12 bp, Homo sapiens
acatcttttcta

SEQ ID NO: 993821 - DNA, 14 bp, Homo sapiens
acatcttttctaat

SEQ ID NO: 993822 - DNA, 21 bp, Homo sapiens
acatcttttctaatcacagtg

SEQ ID NO: 993823 - DNA, 22 bp, Homo sapiens
acatcttttctaatcacagtgt

SEQ ID NO: 993824 - DNA, 20 bp, Homo sapiens
acatgaaaaacacggcagct

SEQ ID NO: 993825 - DNA, 23 bp, Homo sapiens
acatgaaaattttaaaaatacat

SEQ ID NO: 993826 - DNA, 15 bp, Homo sapiens
acatgaaacagaaac

SEQ ID NO: 993827 - DNA, 20 bp, Homo sapiens
acatgaaacctacacactgt

SEQ ID NO: 993828 - DNA, 17 bp, Homo sapiens
acatgaaaggaccctgt

SEQ ID NO: 993829 - DNA, 18 bp, Homo sapiens
acatgaagattctttccc

SEQ ID NO: 993830 - DNA, 22 bp, Homo sapiens
acatgaagattctttcccaatt

SEQ ID NO: 993831 - DNA, 17 bp, Homo sapiens
acatgaagctgtataat

SEQ ID NO: 993832 - DNA, 23 bp, Homo sapiens
acatgaaggtaaataaaaagaaa

SEQ ID NO: 993833 - DNA, 19 bp, Homo sapiens
acatgaattattacagtgt

SEQ ID NO: 993834 - DNA, 21 bp, Homo sapiens
acatgaattattacagtgttt

SEQ ID NO: 993835 - DNA, 17 bp, Homo sapiens
acatgacagatatttta

SEQ ID NO: 993836 - DNA, 18 bp, Homo sapiens
acatgacagatattttat

SEQ ID NO: 993837 - DNA, 21 bp, Homo sapiens
acatgaccctaaatcttgact

SEQ ID NO: 993838 - DNA, 18 bp, Homo sapiens
acatgaccctctgtcccc

SEQ ID NO: 993839 - DNA, 23 bp, Homo sapiens
acatgaccctctgtccccaggcc

SEQ ID NO: 993840 - DNA, 13 bp, Homo sapiens
acatgacctccat

SEQ ID NO: 993841 - DNA, 23 bp, Homo sapiens
acatgactctttattgtctgtaa

SEQ ID NO: 993842 - DNA, 14 bp, Homo sapiens
acatgactgggcct

SEQ ID NO: 993843 - DNA, 13 bp, Homo sapiens
acatgactgtttc

SEQ ID NO: 993844 - DNA, 13 bp, Homo sapiens
acatgagaaagat

SEQ ID NO: 993845 - DNA, 19 bp, Homo sapiens
acatgagactgtaaaacaa

SEQ ID NO: 993846 - DNA, 23 bp, Homo sapiens
acatgagctatttccattccaga

SEQ ID NO: 993847 - DNA, 21 bp, Homo sapiens
acatgaggacatgatggagcg

SEQ ID NO: 993848 - DNA, 16 bp, Homo sapiens
acatgaggggacattt

SEQ ID NO: 993849 - DNA, 19 bp, Homo sapiens
acatgatcttctttataat

SEQ ID NO: 993850 - DNA, 13 bp, Homo sapiens
acatgattataga

SEQ ID NO: 993851 - DNA, 19 bp, Homo sapiens
acatgatttagggaagcag

SEQ ID NO: 993852 - DNA, 22 bp, Homo sapiens
acatgatttagggaagcaggga

SEQ ID NO: 993853 - DNA, 23 bp, Homo sapiens
acatgatttccttgaatgtggct

SEQ ID NO: 993854 - DNA, 12 bp, Homo sapiens
acatgcaacaga

SEQ ID NO: 993855 - DNA, 16 bp, Homo sapiens
acatgcaaggtcattt

SEQ ID NO: 993856 - DNA, 19 bp, Homo sapiens
acatgcaaggtcatttttt

SEQ ID NO: 993857 - DNA, 21 bp, Homo sapiens
acatgcaatttattaaaatga

SEQ ID NO: 993858 - DNA, 21 bp, Homo sapiens
acatgcacacacttgcataca

SEQ ID NO: 993859 - DNA, 18 bp, Homo sapiens
acatgcacacgggcgagc

SEQ ID NO: 993860 - DNA, 19 bp, Homo sapiens
acatgcacttttgggcctt

SEQ ID NO: 993861 - DNA, 15 bp, Homo sapiens
acatgcagcccatgc

SEQ ID NO: 993862 - DNA, 20 bp, Homo sapiens
acatgcagcccatgcccacc

SEQ ID NO: 993863 - DNA, 22 bp, Homo sapiens
acatgcagttcattattttgtg

SEQ ID NO: 993864 - DNA, 23 bp, Homo sapiens
acatgcagttcattattttgtgg

SEQ ID NO: 993865 - DNA, 12 bp, Homo sapiens
acatgcatttga

SEQ ID NO: 993866 - DNA, 17 bp, Homo sapiens
acatgcatttgaggtca

SEQ ID NO: 993867 - DNA, 21 bp, Homo sapiens
acatgcatttgaggtcaagta

SEQ ID NO: 993868 - DNA, 22 bp, Homo sapiens
acatgccagaaggaatcttctc

SEQ ID NO: 993869 - DNA, 23 bp, Homo sapiens
acatgccagaaggaatcttctca

SEQ ID NO: 993870 - DNA, 23 bp, Homo sapiens
acatgccagtttttaaaatgctg

SEQ ID NO: 993871 - DNA, 21 bp, Homo sapiens
acatgcccacaacttgtcacc

SEQ ID NO: 993872 - DNA, 13 bp, Homo sapiens
acatgcccctccc

SEQ ID NO: 993873 - DNA, 14 bp, Homo sapiens
acatgcccctcccc

SEQ ID NO: 993874 - DNA, 18 bp, Homo sapiens
acatgcccgggaggaaag

SEQ ID NO: 993875 - DNA, 13 bp, Homo sapiens
acatgccctccct

SEQ ID NO: 993876 - DNA, 23 bp, Homo sapiens
acatgccctcccttctccctgga

SEQ ID NO: 993877 - DNA, 13 bp, Homo sapiens
acatgccctcctg

SEQ ID NO: 993878 - DNA, 14 bp, Homo sapiens
acatgccctgtgtg

SEQ ID NO: 993879 - DNA, 17 bp, Homo sapiens
acatgccctgtgtggct

SEQ ID NO: 993880 - DNA, 15 bp, Homo sapiens
acatgcctgccaaag

SEQ ID NO: 993881 - DNA, 15 bp, Homo sapiens
acatgcctgccccaa

SEQ ID NO: 993882 - DNA, 15 bp, Homo sapiens
acatgcctgcgcctg

SEQ ID NO: 993883 - DNA, 17 bp, Homo sapiens
acatgcctgcgcctgct

SEQ ID NO: 993884 - DNA, 22 bp, Homo sapiens
acatgcctgcgcctgctgcctg

SEQ ID NO: 993885 - DNA, 20 bp, Homo sapiens
acatgccttggtgccggtca

SEQ ID NO: 993886 - DNA, 14 bp, Homo sapiens
acatagtgtcctgc

SEQ ID NO: 993887 - DNA, 17 bp, Homo sapiens
acatataacacttaact

SEQ ID NO: 993888 - DNA, 15 bp, Homo sapiens
acatatacatatata

SEQ ID NO: 993889 - DNA, 16 bp, Homo sapiens
acatatagaatgcaga

SEQ ID NO: 993890 - DNA, 15 bp, Homo sapiens
acatatataaaacta

SEQ ID NO: 993891 - DNA, 19 bp, Homo sapiens
acatatatataacaaataa

SEQ ID NO: 993892 - DNA, 18 bp, Homo sapiens
acatatatatatacacat

SEQ ID NO: 993893 - DNA, 22 bp, Homo sapiens
acatatatatatttgtaacatt

SEQ ID NO: 993894 - DNA, 17 bp, Homo sapiens
acatatatatctgataa

SEQ ID NO: 993895 - DNA, 13 bp, Homo sapiens
acatatcatggta

SEQ ID NO: 993896 - DNA, 16 bp, Homo sapiens
acatatcatggtaatg

SEQ ID NO: 993897 - DNA, 16 bp, Homo sapiens
acatatcatttgtgaa

SEQ ID NO: 993898 - DNA, 18 bp, Homo sapiens
acatatccaaagggaata

SEQ ID NO: 993899 - DNA, 23 bp, Homo sapiens
acatatctacacttcgcaccgga

SEQ ID NO: 993900 - DNA, 19 bp, Homo sapiens
acatatctcttatcttacg

SEQ ID NO: 993901 - DNA, 14 bp, Homo sapiens
acatatctgatatt

SEQ ID NO: 993902 - DNA, 15 bp, Homo sapiens
acatatcttagatgg

SEQ ID NO: 993903 - DNA, 15 bp, Homo sapiens
acatatgaaaataca

SEQ ID NO: 993904 - DNA, 13 bp, Homo sapiens
acatatgaacaca

SEQ ID NO: 993905 - DNA, 19 bp, Homo sapiens
acatatgagtgtggaagcc

SEQ ID NO: 993906 - DNA, 16 bp, Homo sapiens
acatatgatactgatg

SEQ ID NO: 993907 - DNA, 19 bp, Homo sapiens
acatatgatctgtctgtgg

SEQ ID NO: 993908 - DNA, 15 bp, Homo sapiens
acatatgcacagggg

SEQ ID NO: 993909 - DNA, 24 bp, Homo sapiens
acatatgctgatcttttaaaatca

SEQ ID NO: 993910 - DNA, 13 bp, Homo sapiens
acatatggaattt

SEQ ID NO: 993911 - DNA, 20 bp, Homo sapiens
acatatggaattttgcaaag

SEQ ID NO: 993912 - DNA, 14 bp, Homo sapiens
acatatggatgtta

SEQ ID NO: 993913 - DNA, 23 bp, Homo sapiens
acatatgtagatattgttttctg

SEQ ID NO: 993914 - DNA, 12 bp, Homo sapiens
acatatgtatac

SEQ ID NO: 993915 - DNA, 23 bp, Homo sapiens
acatatgtattaagccaaacatg

SEQ ID NO: 993916 - DNA, 18 bp, Homo sapiens
acatatgtccatccatat

SEQ ID NO: 993917 - DNA, 23 bp, Homo sapiens
acatattcaagtgataggataaa

SEQ ID NO: 993918 - DNA, 22 bp, Homo sapiens
acatattgatttccgttaaaat

SEQ ID NO: 993919 - DNA, 23 bp, Homo sapiens
acatattgatttccgttaaaata

SEQ ID NO: 993920 - DNA, 12 bp, Homo sapiens
acatattgttag

SEQ ID NO: 993921 - DNA, 20 bp, Homo sapiens
acatatttaactggtgcact

SEQ ID NO: 993922 - DNA, 12 bp, Homo sapiens
acatatttaatg

SEQ ID NO: 993923 - DNA, 17 bp, Homo sapiens
acatatttaatgtttta

SEQ ID NO: 993924 - DNA, 13 bp, Homo sapiens
acatatttcattt

SEQ ID NO: 993925 - DNA, 17 bp, Homo sapiens
acatatttgtggaataa

SEQ ID NO: 993926 - DNA, 21 bp, Homo sapiens
acatatttttatactttattg

SEQ ID NO: 993927 - DNA, 22 bp, Homo sapiens
acatatttttatactttattga

SEQ ID NO: 993928 - DNA, 16 bp, Homo sapiens
acatcaaaacttaaga

SEQ ID NO: 993929 - DNA, 12 bp, Homo sapiens
acatcaaaatga

SEQ ID NO: 993930 - DNA, 20 bp, Homo sapiens
acatcaaagtggtaaatact

SEQ ID NO: 993931 - DNA, 21 bp, Homo sapiens
acatcaaagtggtaaatactg

SEQ ID NO: 993932 - DNA, 14 bp, Homo sapiens
acatggcccattgg

SEQ ID NO: 993933 - DNA, 22 bp, Homo sapiens
acatggcccctccccctgccag

SEQ ID NO: 993934 - DNA, 16 bp, Homo sapiens
acatggcgccctgcct

SEQ ID NO: 993935 - DNA, 14 bp, Homo sapiens
acatggctagcctt

SEQ ID NO: 993936 - DNA, 20 bp, Homo sapiens
acatggcttaatcttatttt

SEQ ID NO: 993937 - DNA, 14 bp, Homo sapiens
acatgggacctggc

SEQ ID NO: 993938 - DNA, 12 bp, Homo sapiens
acatgggactgg

SEQ ID NO: 993939 - DNA, 20 bp, Homo sapiens
acatgggagccgggtctgcc

SEQ ID NO: 993940 - DNA, 12 bp, Homo sapiens
acatgggaggga

SEQ ID NO: 993941 - DNA, 17 bp, Homo sapiens
acatgggagggatcagc

SEQ ID NO: 993942 - DNA, 19 bp, Homo sapiens
acatgggagggatcagccc

SEQ ID NO: 993943 - DNA, 19 bp, Homo sapiens
acatgggatccaattttaa

SEQ ID NO: 993944 - DNA, 14 bp, Homo sapiens
acatgggctggggg

SEQ ID NO: 993945 - DNA, 15 bp, Homo sapiens
acatgggctgggggc

SEQ ID NO: 993946 - DNA, 16 bp, Homo sapiens
acatggggaaggcaga

SEQ ID NO: 993947 - DNA, 19 bp, Homo sapiens
acatggggaaggcagaggc

SEQ ID NO: 993948 - DNA, 17 bp, Homo sapiens
acatggggcaagccagg

SEQ ID NO: 993949 - DNA, 20 bp, Homo sapiens
acatggggcaagccagggcc

SEQ ID NO: 993950 - DNA, 21 bp, Homo sapiens
acatggggcaagccagggccc

SEQ ID NO: 993951 - DNA, 23 bp, Homo sapiens
acatggggcaagccagggcccag

SEQ ID NO: 993952 - DNA, 16 bp, Homo sapiens
acatgggtattttata

SEQ ID NO: 993953 - DNA, 14 bp, Homo sapiens
acatgggtttagtt

SEQ ID NO: 993954 - DNA, 21 bp, Homo sapiens
acatggtgaaacctcatctct

SEQ ID NO: 993955 - DNA, 13 bp, Homo sapiens
acatggtgcctga

SEQ ID NO: 993956 - DNA, 19 bp, Homo sapiens
acatggtgcctgagaggca

SEQ ID NO: 993957 - DNA, 23 bp, Homo sapiens
acatggtgcctgagaggcaggca

SEQ ID NO: 993958 - DNA, 20 bp, Homo sapiens
acatggtgtctcccaacatg

SEQ ID NO: 993959 - DNA, 22 bp, Homo sapiens
acatggtgtctcccaacatggg

SEQ ID NO: 993960 - DNA, 18 bp, Homo sapiens
acatggttacaatcattg

SEQ ID NO: 993961 - DNA, 19 bp, Homo sapiens
acatggttaccatgtcttt

SEQ ID NO: 993962 - DNA, 18 bp, Homo sapiens
acatggttgtgacctgag

SEQ ID NO: 993963 - DNA, 14 bp, Homo sapiens
acatggtttaaaag

SEQ ID NO: 993964 - DNA, 18 bp, Homo sapiens
acatgtaaaatatgtaaa

SEQ ID NO: 993965 - DNA, 13 bp, Homo sapiens
acatgtaaataca

SEQ ID NO: 993966 - DNA, 21 bp, Homo sapiens
acatgtaactatttcttcaga

SEQ ID NO: 993967 - DNA, 14 bp, Homo sapiens
acatgtaagaaaat

SEQ ID NO: 993968 - DNA, 18 bp, Homo sapiens
acatgtaagaaaatgtta

SEQ ID NO: 993969 - DNA, 19 bp, Homo sapiens
acatgtaagaaaatgttac

SEQ ID NO: 993970 - DNA, 17 bp, Homo sapiens
acatgtaataaaaagta

SEQ ID NO: 993971 - DNA, 19 bp, Homo sapiens
acatgtaataaaaagtata

SEQ ID NO: 993972 - DNA, 23 bp, Homo sapiens
acatgtaataaaaagtatatgtt

SEQ ID NO: 993973 - DNA, 19 bp, Homo sapiens
acatgtaataaattcaaaa

SEQ ID NO: 993974 - DNA, 19 bp, Homo sapiens
acatgtaattaagtactat

SEQ ID NO: 993975 - DNA, 13 bp, Homo sapiens
acatgtaatttga

SEQ ID NO: 993976 - DNA, 20 bp, Homo sapiens
acatgtaccccctttccctt

SEQ ID NO: 993977 - DNA, 15 bp, Homo sapiens
acatgtactccagag

SEQ ID NO: 993978 - DNA, 19 bp, Homo sapiens
acatgtagagatttgagtg

SEQ ID NO: 993979 - DNA, 15 bp, Homo sapiens
acatgtaggtgtttg

SEQ ID NO: 993980 - DNA, 11 bp, Homo sapiens
acatgtatgtg

SEQ ID NO: 993981 - DNA, 17 bp, Homo sapiens
acatgtcacaatacagt

SEQ ID NO: 993982 - DNA, 19 bp, Homo sapiens
acatgtcacaatacagtaa

SEQ ID NO: 993983 - DNA, 23 bp, Homo sapiens
acatgtcaccgtggaccttcctg

SEQ ID NO: 993984 - DNA, 21 bp, Homo sapiens
acatgtcagtaccttcaaact

SEQ ID NO: 993985 - DNA, 15 bp, Homo sapiens
acatgtccctacacc

SEQ ID NO: 993986 - DNA, 23 bp, Homo sapiens
acatgtcctgcctattatctgtc

SEQ ID NO: 993987 - DNA, 21 bp, Homo sapiens
acatgtccttgtgtgttttga

SEQ ID NO: 993988 - DNA, 17 bp, Homo sapiens
acatgtctactttttaa

SEQ ID NO: 993989 - DNA, 18 bp, Homo sapiens
acatgtctgtcctcagag

SEQ ID NO: 993990 - DNA, 16 bp, Homo sapiens
acatgtgaagctattt

SEQ ID NO: 993991 - DNA, 13 bp, Homo sapiens
acatgtgacattt

SEQ ID NO: 993992 - DNA, 21 bp, Homo sapiens
acatgtgacatttatatattg

SEQ ID NO: 993993 - DNA, 17 bp, Homo sapiens
acatgtgccaccaacat

SEQ ID NO: 993994 - DNA, 18 bp, Homo sapiens
acatgtgccttttctgaa

SEQ ID NO: 993995 - DNA, 19 bp, Homo sapiens
acatgtggctcctcccagc

SEQ ID NO: 993996 - DNA, 15 bp, Homo sapiens
acatgtggtgggaca

SEQ ID NO: 993997 - DNA, 21 bp, Homo sapiens
acatgtggttactagtacagg

SEQ ID NO: 993998 - DNA, 13 bp, Homo sapiens
acatgtggtttat

SEQ ID NO: 993999 - DNA, 14 bp, Homo sapiens
acatgtgtaaaggt

SEQ ID NO: 994000 - DNA, 20 bp, Homo sapiens
acatgtgtatgatactaaag

SEQ ID NO: 994001 - DNA, 20 bp, Homo sapiens
acatgtgtcccagccacagt

SEQ ID NO: 994002 - DNA, 16 bp, Homo sapiens
acatgtgtgcgtgtgc

SEQ ID NO: 994003 - DNA, 17 bp, Homo sapiens
acatgtgtgggtgctga

SEQ ID NO: 994004 - DNA, 18 bp, Homo sapiens
acatgtgtgggtgctgat

SEQ ID NO: 994005 - DNA, 18 bp, Homo sapiens
acatgtgttaaacagaga

SEQ ID NO: 994006 - DNA, 16 bp, Homo sapiens
acatgttactgaccag

SEQ ID NO: 994007 - DNA, 14 bp, Homo sapiens
acatgttatatatt

SEQ ID NO: 994008 - DNA, 20 bp, Homo sapiens
acatgtttaaatagcctaaa

SEQ ID NO: 994009 - DNA, 21 bp, Homo sapiens
acatgtttaataaataaaaat

SEQ ID NO: 994010 - DNA, 15 bp, Homo sapiens
acatgtttacaggtt

SEQ ID NO: 994011 - DNA, 21 bp, Homo sapiens
acatgtttacttttcagggca

SEQ ID NO: 994012 - DNA, 21 bp, Homo sapiens
acatgtttatttattctgcat

SEQ ID NO: 994013 - DNA, 23 bp, Homo sapiens
acatgtttatttattctgcattt

SEQ ID NO: 994014 - DNA, 21 bp, Homo sapiens
acatgtttccatcatttctgt

SEQ ID NO: 994015 - DNA, 16 bp, Homo sapiens
acatgtttcctctagt

SEQ ID NO: 994016 - DNA, 16 bp, Homo sapiens
acatgttttaaagaaa

SEQ ID NO: 994017 - DNA, 15 bp, Homo sapiens
acatgtttttatatg

SEQ ID NO: 994018 - DNA, 12 bp, Homo sapiens
acattaaacaca

SEQ ID NO: 994019 - DNA, 19 bp, Homo sapiens
acattaaacactgtaatct

SEQ ID NO: 994020 - DNA, 11 bp, Homo sapiens
acattaaagaa

SEQ ID NO: 994021 - DNA, 21 bp, Homo sapiens
acattaaaggcataaatgact

SEQ ID NO: 994022 - DNA, 15 bp, Homo sapiens
acattaaatgcaata

SEQ ID NO: 994023 - DNA, 21 bp, Homo sapiens
acattaaatgcaataatttta

SEQ ID NO: 994024 - DNA, 22 bp, Homo sapiens
acattaaattttttttacattt

SEQ ID NO: 994025 - DNA, 11 bp, Homo sapiens
acattaacagt

SEQ ID NO: 994026 - DNA, 16 bp, Homo sapiens
acattaacagttttcc

SEQ ID NO: 994027 - DNA, 20 bp, Homo sapiens
acattataaaccttcagaag

SEQ ID NO: 994028 - DNA, 18 bp, Homo sapiens
acattatcgggagcagtg

SEQ ID NO: 994029 - DNA, 21 bp, Homo sapiens
acattatctcacttagtcctt

SEQ ID NO: 994030 - DNA, 14 bp, Homo sapiens
acattatgtgagtt

SEQ ID NO: 994031 - DNA, 20 bp, Homo sapiens
acattatgtggaatcctaaa

SEQ ID NO: 994032 - DNA, 14 bp, Homo sapiens
acattattaagcac

SEQ ID NO: 994033 - DNA, 18 bp, Homo sapiens
acattattatcaacaata

SEQ ID NO: 994034 - DNA, 18 bp, Homo sapiens
acattatttatatgggga

SEQ ID NO: 994035 - DNA, 12 bp, Homo sapiens
acattatttcta

SEQ ID NO: 994036 - DNA, 13 bp, Homo sapiens
acattatttctag

SEQ ID NO: 994037 - DNA, 14 bp, Homo sapiens
acattatttgcatg

SEQ ID NO: 994038 - DNA, 15 bp, Homo sapiens
acattatttttagat

SEQ ID NO: 994039 - DNA, 24 bp, Homo sapiens
acattcaaaatagggtatattttc

SEQ ID NO: 994040 - DNA, 19 bp, Homo sapiens
acattcaaatttgtctggt

SEQ ID NO: 994041 - DNA, 11 bp, Homo sapiens
acattcaactc

SEQ ID NO: 994042 - DNA, 12 bp, Homo sapiens
acattcaatgtt

SEQ ID NO: 994043 - DNA, 20 bp, Homo sapiens
acattcacacagggctcttt

SEQ ID NO: 994044 - DNA, 12 bp, Homo sapiens
acattcacagcc

SEQ ID NO: 994045 - DNA, 23 bp, Homo sapiens
acattcacagcccagaaccacag

SEQ ID NO: 994046 - DNA, 13 bp, Homo sapiens
acattcacctgcc

SEQ ID NO: 994047 - DNA, 14 bp, Homo sapiens
acattcacctgccc

SEQ ID NO: 994048 - DNA, 20 bp, Homo sapiens
acattcacctgccccaactc

SEQ ID NO: 994049 - DNA, 11 bp, Homo sapiens
acattcactgg

SEQ ID NO: 994050 - DNA, 14 bp, Homo sapiens
acattcacttttgt

SEQ ID NO: 994051 - DNA, 21 bp, Homo sapiens
acattcacttttgttaacagt

SEQ ID NO: 994052 - DNA, 20 bp, Homo sapiens
acattcatcaatatccctct

SEQ ID NO: 994053 - DNA, 17 bp, Homo sapiens
acattccagggctgggg

SEQ ID NO: 994054 - DNA, 18 bp, Homo sapiens
acattccagggctggggt

SEQ ID NO: 994055 - DNA, 16 bp, Homo sapiens
acattcccagcccagc

SEQ ID NO: 994056 - DNA, 13 bp, Homo sapiens
acattccccagag

SEQ ID NO: 994057 - DNA, 21 bp, Homo sapiens
acattcccctcccacctctcc

SEQ ID NO: 994058 - DNA, 19 bp, Homo sapiens
acattccctctcctgccca

SEQ ID NO: 994059 - DNA, 18 bp, Homo sapiens
acattcctaactagaatt

SEQ ID NO: 994060 - DNA, 20 bp, Homo sapiens
acattcctaagagtggagga

SEQ ID NO: 994061 - DNA, 23 bp, Homo sapiens
acattcctaagagtggaggagga

SEQ ID NO: 994062 - DNA, 12 bp, Homo sapiens
acattcctccag

SEQ ID NO: 994063 - DNA, 13 bp, Homo sapiens
acattcctccagc

SEQ ID NO: 994064 - DNA, 20 bp, Homo sapiens
acattcctccagcctcccct

SEQ ID NO: 994065 - DNA, 15 bp, Homo sapiens
acattcctgcattca

SEQ ID NO: 994066 - DNA, 23 bp, Homo sapiens
acattcgaggtgtcaccctgcag

SEQ ID NO: 994067 - DNA, 16 bp, Homo sapiens
acattcgatctcattc

SEQ ID NO: 994068 - DNA, 21 bp, Homo sapiens
acattcgatctcattcagtat

SEQ ID NO: 994069 - DNA, 23 bp, Homo sapiens
acattcgatctcattcagtatta

SEQ ID NO: 994070 - DNA, 16 bp, Homo sapiens
acattcgggaccaata

SEQ ID NO: 994071 - DNA, 18 bp, Homo sapiens
acattctacttcagcttt

SEQ ID NO: 994072 - DNA, 19 bp, Homo sapiens
acattctcgcttccctgaa

SEQ ID NO: 994073 - DNA, 14 bp, Homo sapiens
acattctgaatgct

SEQ ID NO: 994074 - DNA, 15 bp, Homo sapiens
acattctgaatgctt

SEQ ID NO: 994075 - DNA, 18 bp, Homo sapiens
acattctgaatgcttcta

SEQ ID NO: 994076 - DNA, 15 bp, Homo sapiens
acattctgatgagca

SEQ ID NO: 994077 - DNA, 16 bp, Homo sapiens
acattctgatttggaa

SEQ ID NO: 994078 - DNA, 19 bp, Homo sapiens
acattctgatttggaaaaa

SEQ ID NO: 994079 - DNA, 19 bp, Homo sapiens
acattctgcctagagtgta

SEQ ID NO: 994080 - DNA, 22 bp, Homo sapiens
acattctgcctagagtgtagcc

SEQ ID NO: 994081 - DNA, 23 bp, Homo sapiens
acattctgcctagagtgtagcct

SEQ ID NO: 994082 - DNA, 22 bp, Homo sapiens
acattctggatctgaccctccc

SEQ ID NO: 994083 - DNA, 23 bp, Homo sapiens
acattctggggaaacaacattta

SEQ ID NO: 994084 - DNA, 18 bp, Homo sapiens
acattctggtctcgtctt

SEQ ID NO: 994085 - DNA, 12 bp, Homo sapiens
acattctgttaa

SEQ ID NO: 994086 - DNA, 15 bp, Homo sapiens
acattctgttaatca

SEQ ID NO: 994087 - DNA, 18 bp, Homo sapiens
acattcttattaattctt

SEQ ID NO: 994088 - DNA, 15 bp, Homo sapiens
acattcttccatcat

SEQ ID NO: 994089 - DNA, 21 bp, Homo sapiens
acattcttccatcatcactgt

SEQ ID NO: 994090 - DNA, 22 bp, Homo sapiens
acattcttccatcatcactgta

SEQ ID NO: 994091 - DNA, 20 bp, Homo sapiens
acattctttataaaatgtat

SEQ ID NO: 994092 - DNA, 14 bp, Homo sapiens
acattcttttaatg

SEQ ID NO: 994093 - DNA, 13 bp, Homo sapiens
acattgaaatcta

SEQ ID NO: 994094 - DNA, 19 bp, Homo sapiens
acattgaagtaatgaattt

SEQ ID NO: 994095 - DNA, 17 bp, Homo sapiens
acattgaccaagaactg

SEQ ID NO: 994096 - DNA, 23 bp, Homo sapiens
acattgatacaaagtacagaaaa

SEQ ID NO: 994097 - DNA, 16 bp, Homo sapiens
acattgattcagcctg

SEQ ID NO: 994098 - DNA, 22 bp, Homo sapiens
acattgatttttctataatcac

SEQ ID NO: 994099 - DNA, 12 bp, Homo sapiens
acattgcagagt

SEQ ID NO: 994100 - DNA, 14 bp, Homo sapiens
acattgccaaaaag

SEQ ID NO: 994101 - DNA, 20 bp, Homo sapiens
acattgccatgtaactatgt

SEQ ID NO: 994102 - DNA, 19 bp, Homo sapiens
acattgccgtggcatctta

SEQ ID NO: 994103 - DNA, 16 bp, Homo sapiens
acattgcctgttctgc

SEQ ID NO: 994104 - DNA, 20 bp, Homo sapiens
acattgcctgttctgcttcg

SEQ ID NO: 994105 - DNA, 13 bp, Homo sapiens
acattgccttcct

SEQ ID NO: 994106 - DNA, 17 bp, Homo sapiens
acattgcctttgaatgt

SEQ ID NO: 994107 - DNA, 20 bp, Homo sapiens
acattgctccaagatgttct

SEQ ID NO: 994108 - DNA, 14 bp, Homo sapiens
acattgctctctgg

SEQ ID NO: 994109 - DNA, 12 bp, Homo sapiens
acattgctgcct

SEQ ID NO: 994110 - DNA, 11 bp, Homo sapiens
acattgcttaa

SEQ ID NO: 994111 - DNA, 17 bp, Homo sapiens
acattggaagcctgagc

SEQ ID NO: 994112 - DNA, 17 bp, Homo sapiens
acattggaatgttctca

SEQ ID NO: 994113 - DNA, 21 bp, Homo sapiens
acattggggaaatttttaagt

SEQ ID NO: 994114 - DNA, 22 bp, Homo sapiens
acattggggaaatttttaagtt

SEQ ID NO: 994115 - DNA, 23 bp, Homo sapiens
acattggggaaatttttaagttt

SEQ ID NO: 994116 - DNA, 21 bp, Homo sapiens
acattggtgaaggatccagga

SEQ ID NO: 994117 - DNA, 13 bp, Homo sapiens
acattgtactgtt

SEQ ID NO: 994118 - DNA, 15 bp, Homo sapiens
acattgtactgttgc

SEQ ID NO: 994119 - DNA, 18 bp, Homo sapiens
acattgtataggccatct

SEQ ID NO: 994120 - DNA, 22 bp, Homo sapiens
acattgtataggccatctgtaa

SEQ ID NO: 994121 - DNA, 19 bp, Homo sapiens
acattgtctcccgcccccc

SEQ ID NO: 994122 - DNA, 16 bp, Homo sapiens
acattgtgcttggccc

SEQ ID NO: 994123 - DNA, 22 bp, Homo sapiens
acattgtgtgaaaaaagaaaat

SEQ ID NO: 994124 - DNA, 17 bp, Homo sapiens
acattgttcttattctg

SEQ ID NO: 994125 - DNA, 14 bp, Homo sapiens
acattgttgagcta

SEQ ID NO: 994126 - DNA, 17 bp, Homo sapiens
acattgtttgctgctat

SEQ ID NO: 994127 - DNA, 18 bp, Homo sapiens
acattgtttgctgctatt

SEQ ID NO: 994128 - DNA, 15 bp, Homo sapiens
acattgtttttgtat

SEQ ID NO: 994129 - DNA, 16 bp, Homo sapiens
acattgtttttgtata

SEQ ID NO: 994130 - DNA, 17 bp, Homo sapiens
acatttaaaattgctat

SEQ ID NO: 994131 - DNA, 12 bp, Homo sapiens
acatttaaattc

SEQ ID NO: 994132 - DNA, 17 bp, Homo sapiens
acatttacaggagggcc

SEQ ID NO: 994133 - DNA, 13 bp, Homo sapiens
acatttagaaaag

SEQ ID NO: 994134 - DNA, 16 bp, Homo sapiens
acatttagaaaagtga

SEQ ID NO: 994135 - DNA, 20 bp, Homo sapiens
acatttagaaaagtgaattg

SEQ ID NO: 994136 - DNA, 18 bp, Homo sapiens
acatttagaagaaagatg

SEQ ID NO: 994137 - DNA, 15 bp, Homo sapiens
acatttagagtattt

SEQ ID NO: 994138 - DNA, 18 bp, Homo sapiens
acatttataatgtttgct

SEQ ID NO: 994139 - DNA, 20 bp, Homo sapiens
acatttataatgtttgctat

SEQ ID NO: 994140 - DNA, 14 bp, Homo sapiens
acatttatacatca

SEQ ID NO: 994141 - DNA, 15 bp, Homo sapiens
acatttatacatcac

SEQ ID NO: 994142 - DNA, 13 bp, Homo sapiens
acatttatatatt

SEQ ID NO: 994143 - DNA, 13 bp, Homo sapiens
acatttatatttg

SEQ ID NO: 994144 - DNA, 13 bp, Homo sapiens
acatttatgacct

SEQ ID NO: 994145 - DNA, 22 bp, Homo sapiens
acatttatgttcctttatttag

SEQ ID NO: 994146 - DNA, 18 bp, Homo sapiens
acatttatttattactgt

SEQ ID NO: 994147 - DNA, 20 bp, Homo sapiens
acatttatttattactgtcc

SEQ ID NO: 994148 - DNA, 13 bp, Homo sapiens
acatttatttcct

SEQ ID NO: 994149 - DNA, 14 bp, Homo sapiens
acatttatttcctc

SEQ ID NO: 994150 - DNA, 22 bp, Homo sapiens
acatttattttttttaaagaaa

SEQ ID NO: 994151 - DNA, 16 bp, Homo sapiens
acatttcaaagctgag

SEQ ID NO: 994152 - DNA, 20 bp, Homo sapiens
acatttcaatgtcagccttt

SEQ ID NO: 994153 - DNA, 16 bp, Homo sapiens
acatttcacattattc

SEQ ID NO: 994154 - DNA, 20 bp, Homo sapiens
acatttcacctactttgtaa

SEQ ID NO: 994155 - DNA, 22 bp, Homo sapiens
acatttcagaaggtatcagtta

SEQ ID NO: 994156 - DNA, 18 bp, Homo sapiens
acatttcataaggcctgc

SEQ ID NO: 994157 - DNA, 20 bp, Homo sapiens
acatttcataaggcctgccc

SEQ ID NO: 994158 - DNA, 21 bp, Homo sapiens
acatttcataaggcctgccct

SEQ ID NO: 994159 - DNA, 16 bp, Homo sapiens
acatttcattgtacaa

SEQ ID NO: 994160 - DNA, 13 bp, Homo sapiens
acatttccattta

SEQ ID NO: 994161 - DNA, 21 bp, Homo sapiens
acatttccatttattgtttga

SEQ ID NO: 994162 - DNA, 16 bp, Homo sapiens
acatttcctctgttct

SEQ ID NO: 994163 - DNA, 18 bp, Homo sapiens
acatttccttacagaact

SEQ ID NO: 994164 - DNA, 18 bp, Homo sapiens
acatttctaacatatgta

SEQ ID NO: 994165 - DNA, 19 bp, Homo sapiens
acatttctaacatatgtat

SEQ ID NO: 994166 - DNA, 23 bp, Homo sapiens
acatttctactatgatcagaaga

SEQ ID NO: 994167 - DNA, 23 bp, Homo sapiens
acatttctctaagagaacaatgt

SEQ ID NO: 994168 - DNA, 14 bp, Homo sapiens
acatttctctgagc

SEQ ID NO: 994169 - DNA, 15 bp, Homo sapiens
acatttctggacagt

SEQ ID NO: 994170 - DNA, 14 bp, Homo sapiens
acatttctgtatac

SEQ ID NO: 994171 - DNA, 15 bp, Homo sapiens
acatttctgtatact

SEQ ID NO: 994172 - DNA, 21 bp, Homo sapiens
acatttctgtatactgtaaaa

SEQ ID NO: 994173 - DNA, 12 bp, Homo sapiens
acatttctgttc

SEQ ID NO: 994174 - DNA, 15 bp, Homo sapiens
acatttgaattcttg

SEQ ID NO: 994175 - DNA, 20 bp, Homo sapiens
acatttgagggcccagccag

SEQ ID NO: 994176 - DNA, 14 bp, Homo sapiens
acatttgatatttt

SEQ ID NO: 994177 - DNA, 19 bp, Homo sapiens
acatttgatatttttccat

SEQ ID NO: 994178 - DNA, 22 bp, Homo sapiens
acatttgatggagggtggaaat

SEQ ID NO: 994179 - DNA, 18 bp, Homo sapiens
acatttgatgtacatgtg

SEQ ID NO: 994180 - DNA, 17 bp, Homo sapiens
acatttgccttcagtct

SEQ ID NO: 994181 - DNA, 12 bp, Homo sapiens
acatttgctgaa

SEQ ID NO: 994182 - DNA, 22 bp, Homo sapiens
acatttgctgttttaaacatta

SEQ ID NO: 994183 - DNA, 17 bp, Homo sapiens
acatttggaatactttt

SEQ ID NO: 994184 - DNA, 14 bp, Homo sapiens
acatttggagaggg

SEQ ID NO: 994185 - DNA, 22 bp, Homo sapiens
acatttggaggcaatcctacct

SEQ ID NO: 994186 - DNA, 21 bp, Homo sapiens
acatttgggagacatgtgaca

SEQ ID NO: 994187 - DNA, 14 bp, Homo sapiens
acatttgggctcag

SEQ ID NO: 994188 - DNA, 17 bp, Homo sapiens
acatttgggctcagggt

SEQ ID NO: 994189 - DNA, 21 bp, Homo sapiens
acatttgggttactatttctt

SEQ ID NO: 994190 - DNA, 22 bp, Homo sapiens
acatttggtggtactttattct

SEQ ID NO: 994191 - DNA, 23 bp, Homo sapiens
acatttggtggtactttattctt

SEQ ID NO: 994192 - DNA, 16 bp, Homo sapiens
acatttgtactttatt

SEQ ID NO: 994193 - DNA, 13 bp, Homo sapiens
acatttgtatatt

SEQ ID NO: 994194 - DNA, 13 bp, Homo sapiens
acatttgttcctg

SEQ ID NO: 994195 - DNA, 16 bp, Homo sapiens
acatttgtttgctgta

SEQ ID NO: 994196 - DNA, 20 bp, Homo sapiens
acattttaaaaaatggtcac

SEQ ID NO: 994197 - DNA, 23 bp, Homo sapiens
acattttaaaaacatagaaaaat

SEQ ID NO: 994198 - DNA, 14 bp, Homo sapiens
acattttaaataaa

SEQ ID NO: 994199 - DNA, 15 bp, Homo sapiens
acattttaaataaaa

SEQ ID NO: 994200 - DNA, 22 bp, Homo sapiens
acattttaatagagatgaatca

SEQ ID NO: 994201 - DNA, 15 bp, Homo sapiens
acattttacattaaa

SEQ ID NO: 994202 - DNA, 18 bp, Homo sapiens
acattttacattaaattt

SEQ ID NO: 994203 - DNA, 16 bp, Homo sapiens
acattttatacaattt

SEQ ID NO: 994204 - DNA, 13 bp, Homo sapiens
acattttattaag

SEQ ID NO: 994205 - DNA, 20 bp, Homo sapiens
acattttcaaggactatttt

SEQ ID NO: 994206 - DNA, 17 bp, Homo sapiens
acattttgaaagtctgt

SEQ ID NO: 994207 - DNA, 13 bp, Homo sapiens
acattttgtaaaa

SEQ ID NO: 994208 - DNA, 15 bp, Homo sapiens
acattttgttacata

SEQ ID NO: 994209 - DNA, 19 bp, Homo sapiens
acattttgttatagaatac

SEQ ID NO: 994210 - DNA, 21 bp, Homo sapiens
acattttgttatagaatactt

SEQ ID NO: 994211 - DNA, 18 bp, Homo sapiens
acatttttaagtgctgca

SEQ ID NO: 994212 - DNA, 12 bp, Homo sapiens
acatttttacaa

SEQ ID NO: 994213 - DNA, 21 bp, Homo sapiens
acatttttatttagttgaaaa

SEQ ID NO: 994214 - DNA, 19 bp, Homo sapiens
acatttttcacttttgcta

SEQ ID NO: 994215 - DNA, 23 bp, Homo sapiens
acatttttcttagggaaggatac

SEQ ID NO: 994216 - DNA, 19 bp, Homo sapiens
acatttttggggggagaga

SEQ ID NO: 994217 - DNA, 16 bp, Homo sapiens
acattttttaaatgca

SEQ ID NO: 994218 - DNA, 21 bp, Homo sapiens
acattttttaaatgcacctgg

SEQ ID NO: 994219 - DNA, 21 bp, Homo sapiens
acattttttgctataatcatt

SEQ ID NO: 994220 - DNA, 13 bp, Homo sapiens
acatttttttcta

SEQ ID NO: 994221 - DNA, 23 bp, Homo sapiens
accaaaaagagactgatcatcca

SEQ ID NO: 994222 - DNA, 15 bp, Homo sapiens
accaaaacaccccaa

SEQ ID NO: 994223 - DNA, 16 bp, Homo sapiens
accaaaacagttaatc

SEQ ID NO: 994224 - DNA, 14 bp, Homo sapiens
accaaaacatccac

SEQ ID NO: 994225 - DNA, 13 bp, Homo sapiens
accaaaactgctc

SEQ ID NO: 994226 - DNA, 14 bp, Homo sapiens
accaaaactgctcc

SEQ ID NO: 994227 - DNA, 13 bp, Homo sapiens
accaaaacttcca

SEQ ID NO: 994228 - DNA, 13 bp, Homo sapiens
accaaaagggagg

SEQ ID NO: 994229 - DNA, 14 bp, Homo sapiens
accaaaagttacat

SEQ ID NO: 994230 - DNA, 13 bp, Homo sapiens
accaaaataagaa

SEQ ID NO: 994231 - DNA, 15 bp, Homo sapiens
accaaaataagaaaa

SEQ ID NO: 994232 - DNA, 16 bp, Homo sapiens
accaaaataagaaaag

SEQ ID NO: 994233 - DNA, 17 bp, Homo sapiens
accaaaataagaaaaga

SEQ ID NO: 994234 - DNA, 15 bp, Homo sapiens
accaaaataataaaa

SEQ ID NO: 994235 - DNA, 12 bp, Homo sapiens
accaaaattttt

SEQ ID NO: 994236 - DNA, 20 bp, Homo sapiens
accaaaatttttaggtgaag

SEQ ID NO: 994237 - DNA, 19 bp, Homo sapiens
accaaacaaggaagccaaa

SEQ ID NO: 994238 - DNA, 14 bp, Homo sapiens
accaaacactcagt

SEQ ID NO: 994239 - DNA, 16 bp, Homo sapiens
accaaacccagccact

SEQ ID NO: 994240 - DNA, 14 bp, Homo sapiens
accaaactcacgga

SEQ ID NO: 994241 - DNA, 16 bp, Homo sapiens
accaaactcaggtgat

SEQ ID NO: 994242 - DNA, 22 bp, Homo sapiens
accaaactgcacacacagctcc

SEQ ID NO: 994243 - DNA, 13 bp, Homo sapiens
accaaagaagaaa

SEQ ID NO: 994244 - DNA, 17 bp, Homo sapiens
accaaagacatcagtct

SEQ ID NO: 994245 - DNA, 15 bp, Homo sapiens
accaaagagggcttc

SEQ ID NO: 994246 - DNA, 23 bp, Homo sapiens
accaaagatatatacacaggatc

SEQ ID NO: 994247 - DNA, 19 bp, Homo sapiens
accaaagcaaagaaaataa

SEQ ID NO: 994248 - DNA, 20 bp, Homo sapiens
accaaagcaccttagctggc

SEQ ID NO: 994249 - DNA, 24 bp, Homo sapiens
accaaagcatcaatacaaccagcc

SEQ ID NO: 994250 - DNA, 14 bp, Homo sapiens
accacagcaggatc

SEQ ID NO: 994251 - DNA, 12 bp, Homo sapiens
acccaatttccc

SEQ ID NO: 994252 - DNA, 17 bp, Homo sapiens
acccacacagctgccct

SEQ ID NO: 994253 - DNA, 19 bp, Homo sapiens
acccacaccgtcttccttc

SEQ ID NO: 994254 - DNA, 13 bp, Homo sapiens
acccacacctggg

SEQ ID NO: 994255 - DNA, 13 bp, Homo sapiens
acccacagctctg

SEQ ID NO: 994256 - DNA, 16 bp, Homo sapiens
acccacagctctgggc

SEQ ID NO: 994257 - DNA, 19 bp, Homo sapiens
acccacagctctgggcctc

SEQ ID NO: 994258 - DNA, 13 bp, Homo sapiens
acccacaggtgag

SEQ ID NO: 994259 - DNA, 13 bp, Homo sapiens
acccaccagctcc

SEQ ID NO: 994260 - DNA, 17 bp, Homo sapiens
acccaccagctccacac

SEQ ID NO: 994261 - DNA, 14 bp, Homo sapiens
acccacccatcttc

SEQ ID NO: 994262 - DNA, 22 bp, Homo sapiens
acccacccatcttcctgctgct

SEQ ID NO: 994263 - DNA, 21 bp, Homo sapiens
acccaccccaactctccccag

SEQ ID NO: 994264 - DNA, 14 bp, Homo sapiens
acccaccccagcac

SEQ ID NO: 994265 - DNA, 21 bp, Homo sapiens
acccaccccagcacagccacc

SEQ ID NO: 994266 - DNA, 12 bp, Homo sapiens
acccacccccag

SEQ ID NO: 994267 - DNA, 13 bp, Homo sapiens
acccacccccagg

SEQ ID NO: 994268 - DNA, 16 bp, Homo sapiens
acccacccccaggcct

SEQ ID NO: 994269 - DNA, 17 bp, Homo sapiens
acccacccccaggcctc

SEQ ID NO: 994270 - DNA, 18 bp, Homo sapiens
acccacccccaggcctcc

SEQ ID NO: 994271 - DNA, 19 bp, Homo sapiens
acccacccccaggcctcct

SEQ ID NO: 994272 - DNA, 12 bp, Homo sapiens
acccacccctgt

SEQ ID NO: 994273 - DNA, 17 bp, Homo sapiens
acccacccctgtgctcc

SEQ ID NO: 994274 - DNA, 18 bp, Homo sapiens
acccaccctctggtcctt

SEQ ID NO: 994275 - DNA, 14 bp, Homo sapiens
acccaccctttttt

SEQ ID NO: 994276 - DNA, 20 bp, Homo sapiens
acccaccctttttttggggt

SEQ ID NO: 994277 - DNA, 20 bp, Homo sapiens
acccaccgatggagccccca

SEQ ID NO: 994278 - DNA, 20 bp, Homo sapiens
acccaccgtccgccctgctc

SEQ ID NO: 994279 - DNA, 21 bp, Homo sapiens
acccaccgtctcggccctgaa

SEQ ID NO: 994280 - DNA, 15 bp, Homo sapiens
acccaccgtggagga

SEQ ID NO: 994281 - DNA, 13 bp, Homo sapiens
acccacctagaac

SEQ ID NO: 994282 - DNA, 15 bp, Homo sapiens
acccacctccaccca

SEQ ID NO: 994283 - DNA, 16 bp, Homo sapiens
acccacctccaccccc

SEQ ID NO: 994284 - DNA, 14 bp, Homo sapiens
acccacctccctgc

SEQ ID NO: 994285 - DNA, 18 bp, Homo sapiens
acccacctccctgcctcc

SEQ ID NO: 994286 - DNA, 14 bp, Homo sapiens
acccacctcctgcg

SEQ ID NO: 994287 - DNA, 14 bp, Homo sapiens
acccacctggagcc

SEQ ID NO: 994288 - DNA, 19 bp, Homo sapiens
acccaccttgttggagcct

SEQ ID NO: 994289 - DNA, 19 bp, Homo sapiens
acccacgtgacaccaccga

SEQ ID NO: 994290 - DNA, 21 bp, Homo sapiens
acccactctgcggcccgggcc

SEQ ID NO: 994291 - DNA, 14 bp, Homo sapiens
acccactggactca

SEQ ID NO: 994292 - DNA, 17 bp, Homo sapiens
acccactgtccgcctct

SEQ ID NO: 994293 - DNA, 19 bp, Homo sapiens
acccactgtccgcctctgc

SEQ ID NO: 994294 - DNA, 18 bp, Homo sapiens
acccacttatttttcaag

SEQ ID NO: 994295 - DNA, 16 bp, Homo sapiens
acccacttctggcctc

SEQ ID NO: 994296 - DNA, 23 bp, Homo sapiens
acccagaatggagcctgctctcc

SEQ ID NO: 994297 - DNA, 20 bp, Homo sapiens
acccagaatggtcatttcag

SEQ ID NO: 994298 - DNA, 16 bp, Homo sapiens
acccagacaaccaaaa

SEQ ID NO: 994299 - DNA, 20 bp, Homo sapiens
acccagacaaccaaaacata

SEQ ID NO: 994300 - DNA, 22 bp, Homo sapiens
acccagacctgttagcagacag

SEQ ID NO: 994301 - DNA, 22 bp, Homo sapiens
acccagagaaaattaattatat

SEQ ID NO: 994302 - DNA, 14 bp, Homo sapiens
acccagagaatata

SEQ ID NO: 994303 - DNA, 18 bp, Homo sapiens
acccagagaatatataca

SEQ ID NO: 994304 - DNA, 17 bp, Homo sapiens
acccagagaggaatcag

SEQ ID NO: 994305 - DNA, 19 bp, Homo sapiens
acccagagcacaggagctg

SEQ ID NO: 994306 - DNA, 23 bp, Homo sapiens
acccagagcattacgtgagccag

SEQ ID NO: 994307 - DNA, 22 bp, Homo sapiens
acccagagccctctgagccgcc

SEQ ID NO: 994308 - DNA, 19 bp, Homo sapiens
acccagagtggagtctgag

SEQ ID NO: 994309 - DNA, 16 bp, Homo sapiens
acccagatcaggaacc

SEQ ID NO: 994310 - DNA, 14 bp, Homo sapiens
acccagatcctcac

SEQ ID NO: 994311 - DNA, 14 bp, Homo sapiens
acccagcaggcaga

SEQ ID NO: 994312 - DNA, 16 bp, Homo sapiens
acccagcatctcccag

SEQ ID NO: 994313 - DNA, 18 bp, Homo sapiens
acccagcatctcccagca

SEQ ID NO: 994314 - DNA, 11 bp, Homo sapiens
acccagccact

SEQ ID NO: 994315 - DNA, 13 bp, Homo sapiens
acccagccactgc

SEQ ID NO: 994316 - DNA, 11 bp, Homo sapiens
acccagccagc

SEQ ID NO: 994317 - DNA, 13 bp, Homo sapiens
acccagccagctg

SEQ ID NO: 994318 - DNA, 14 bp, Homo sapiens
acccagccagctgc

SEQ ID NO: 994319 - DNA, 15 bp, Homo sapiens
acccagccagctgca

SEQ ID NO: 994320 - DNA, 18 bp, Homo sapiens
acccagccatctgcccag

SEQ ID NO: 994321 - DNA, 20 bp, Homo sapiens
acccagccatctgcccaggg

SEQ ID NO: 994322 - DNA, 23 bp, Homo sapiens
acccagcccattctctctcctgt

SEQ ID NO: 994323 - DNA, 10 bp, Homo sapiens
acccagcccc

SEQ ID NO: 994324 - DNA, 16 bp, Homo sapiens
acccagccccttgaga

SEQ ID NO: 994325 - DNA, 21 bp, Homo sapiens
acccagccccttgagaaacct

SEQ ID NO: 994326 - DNA, 16 bp, Homo sapiens
acccagccctcatccc

SEQ ID NO: 994327 - DNA, 18 bp, Homo sapiens
acccagcccttccttggg

SEQ ID NO: 994328 - DNA, 17 bp, Homo sapiens
acccagcgtggcccagg

SEQ ID NO: 994329 - DNA, 18 bp, Homo sapiens
acccagcgtggcccaggc

SEQ ID NO: 994330 - DNA, 15 bp, Homo sapiens
acccagcgtggcctc

SEQ ID NO: 994331 - DNA, 21 bp, Homo sapiens
acccagctactctgtccaggc

SEQ ID NO: 994332 - DNA, 13 bp, Homo sapiens
acccagctccagg

SEQ ID NO: 994333 - DNA, 18 bp, Homo sapiens
acccagctccaggcccac

SEQ ID NO: 994334 - DNA, 12 bp, Homo sapiens
acccagctcctc

SEQ ID NO: 994335 - DNA, 18 bp, Homo sapiens
acccagctcctctgagcc

SEQ ID NO: 994336 - DNA, 23 bp, Homo sapiens
acccagctcctctgagccatacc

SEQ ID NO: 994337 - DNA, 15 bp, Homo sapiens
acccagctggtcctg

SEQ ID NO: 994338 - DNA, 20 bp, Homo sapiens
acccagctggtcctgtggat

SEQ ID NO: 994339 - DNA, 16 bp, Homo sapiens
acccagcttcaaacta

SEQ ID NO: 994340 - DNA, 15 bp, Homo sapiens
acccagcttcaaagc

SEQ ID NO: 994341 - DNA, 17 bp, Homo sapiens
acccaggacaggatcca

SEQ ID NO: 994342 - DNA, 20 bp, Homo sapiens
acccaggacaggatccaggc

SEQ ID NO: 994343 - DNA, 19 bp, Homo sapiens
acccaggagggagggggct

SEQ ID NO: 994344 - DNA, 21 bp, Homo sapiens
acccaggaggtggaggttgca

SEQ ID NO: 994345 - DNA, 12 bp, Homo sapiens
acccaggccctc

SEQ ID NO: 994346 - DNA, 21 bp, Homo sapiens
acccaggccctccatgggcta

SEQ ID NO: 994347 - DNA, 22 bp, Homo sapiens
acccaggccctccatgggctag

SEQ ID NO: 994348 - DNA, 15 bp, Homo sapiens
acccaggccgcagct

SEQ ID NO: 994349 - DNA, 23 bp, Homo sapiens
acccaggctccgcccttagtccc

SEQ ID NO: 994350 - DNA, 19 bp, Homo sapiens
acccaggctctggagccag

SEQ ID NO: 994351 - DNA, 20 bp, Homo sapiens
acccaggctctggagccaga

SEQ ID NO: 994352 - DNA, 16 bp, Homo sapiens
acccaggctgcactgc

SEQ ID NO: 994353 - DNA, 20 bp, Homo sapiens
acccaggctgcactgcagtg

SEQ ID NO: 994354 - DNA, 20 bp, Homo sapiens
acccaggctggagtgcagtg

SEQ ID NO: 994355 - DNA, 21 bp, Homo sapiens
acccagggagctgatgcccct

SEQ ID NO: 994356 - DNA, 15 bp, Homo sapiens
acccagggcctgact

SEQ ID NO: 994357 - DNA, 24 bp, Homo sapiens
acccagggcctgacttgagccact

SEQ ID NO: 994358 - DNA, 16 bp, Homo sapiens
acccagggctctgccc

SEQ ID NO: 994359 - DNA, 17 bp, Homo sapiens
acccagggctctgcccc

SEQ ID NO: 994360 - DNA, 20 bp, Homo sapiens
acccagggctctgccccagt

SEQ ID NO: 994361 - DNA, 18 bp, Homo sapiens
acccaggggaaggccctg

SEQ ID NO: 994362 - DNA, 16 bp, Homo sapiens
acccaggggacagctg

SEQ ID NO: 994363 - DNA, 19 bp, Homo sapiens
acccagggtcccctcccca

SEQ ID NO: 994364 - DNA, 23 bp, Homo sapiens
acccaggtcccccgactgcctgt

SEQ ID NO: 994365 - DNA, 21 bp, Homo sapiens
acccagtaacttgcaaaaagt

SEQ ID NO: 994366 - DNA, 23 bp, Homo sapiens
acccagtattactgctgctgtgc

SEQ ID NO: 994367 - DNA, 19 bp, Homo sapiens
acccagtctcctctccatt

SEQ ID NO: 994368 - DNA, 16 bp, Homo sapiens
acccagtctgttcccc

SEQ ID NO: 994369 - DNA, 17 bp, Homo sapiens
acccagtgctgccatgc

SEQ ID NO: 994370 - DNA, 23 bp, Homo sapiens
acccagtgctgccatgccactgc

SEQ ID NO: 994371 - DNA, 21 bp, Homo sapiens
acccagttacttttttacact

SEQ ID NO: 994372 - DNA, 15 bp, Homo sapiens
acccatacaatgtat

SEQ ID NO: 994373 - DNA, 22 bp, Homo sapiens
acccatacaatgtatgtacaat

SEQ ID NO: 994374 - DNA, 23 bp, Homo sapiens
acccatacaatgtatgtacaata

SEQ ID NO: 994375 - DNA, 15 bp, Homo sapiens
acccatagcagcttt

SEQ ID NO: 994376 - DNA, 14 bp, Homo sapiens
acccatagggagct

SEQ ID NO: 994377 - DNA, 20 bp, Homo sapiens
acccatattgtaaaacaggt

SEQ ID NO: 994378 - DNA, 18 bp, Homo sapiens
acccatcagaaggagaag

SEQ ID NO: 994379 - DNA, 19 bp, Homo sapiens
acccatcagaaggagaagg

SEQ ID NO: 994380 - DNA, 17 bp, Homo sapiens
acccatccccgcagtgt

SEQ ID NO: 994381 - DNA, 15 bp, Homo sapiens
acccatcgctgtgtg

SEQ ID NO: 994382 - DNA, 14 bp, Homo sapiens
acccatcttaaaaa

SEQ ID NO: 994383 - DNA, 15 bp, Homo sapiens
acccatcttccccgg

SEQ ID NO: 994384 - DNA, 19 bp, Homo sapiens
acccatcttcctgctgctg

SEQ ID NO: 994385 - DNA, 19 bp, Homo sapiens
acccatgaagacaggacag

SEQ ID NO: 994386 - DNA, 12 bp, Homo sapiens
acccatgagcct

SEQ ID NO: 994387 - DNA, 21 bp, Homo sapiens
acccatgagttggggtctggc

SEQ ID NO: 994388 - DNA, 14 bp, Homo sapiens
acccatggggagga

SEQ ID NO: 994389 - DNA, 16 bp, Homo sapiens
acccatggggaggaga

SEQ ID NO: 994390 - DNA, 12 bp, Homo sapiens
acccatgtcacc

SEQ ID NO: 994391 - DNA, 20 bp, Homo sapiens
acccatgtcaccggtcagtg

SEQ ID NO: 994392 - DNA, 14 bp, Homo sapiens
acccatgtgccaag

SEQ ID NO: 994393 - DNA, 17 bp, Homo sapiens
acccatgtgctgggaaa

SEQ ID NO: 994394 - DNA, 20 bp, Homo sapiens
acccattcccccatgtggct

SEQ ID NO: 994395 - DNA, 22 bp, Homo sapiens
acccattcgtggtgatcaatta

SEQ ID NO: 994396 - DNA, 15 bp, Homo sapiens
acccattctgttttc

SEQ ID NO: 994397 - DNA, 14 bp, Homo sapiens
acccattcttcccg

SEQ ID NO: 994398 - DNA, 18 bp, Homo sapiens
acccattgttcccttcct

SEQ ID NO: 994399 - DNA, 18 bp, Homo sapiens
accccaaacaccttccag

SEQ ID NO: 994400 - DNA, 23 bp, Homo sapiens
accccaaacaccttccagctcct

SEQ ID NO: 994401 - DNA, 18 bp, Homo sapiens
accccaaaccccagcccc

SEQ ID NO: 994402 - DNA, 19 bp, Homo sapiens
accccaaagagcctggaga

SEQ ID NO: 994403 - DNA, 18 bp, Homo sapiens
accccaaagctttcctgc

SEQ ID NO: 994404 - DNA, 19 bp, Homo sapiens
accccaacccaataaaact

SEQ ID NO: 994405 - DNA, 14 bp, Homo sapiens
accccaactctccc

SEQ ID NO: 994406 - DNA, 19 bp, Homo sapiens
accccaagatttcagatat

SEQ ID NO: 994407 - DNA, 23 bp, Homo sapiens
accccaagcggccttttccaaat

SEQ ID NO: 994408 - DNA, 21 bp, Homo sapiens
accccaatccctgccactggg

SEQ ID NO: 994409 - DNA, 20 bp, Homo sapiens
accccaatttcggatttttt

SEQ ID NO: 994410 - DNA, 17 bp, Homo sapiens
accccacaccaggccgt

SEQ ID NO: 994411 - DNA, 11 bp, Homo sapiens
accccacactt

SEQ ID NO: 994412 - DNA, 15 bp, Homo sapiens
acccccacacctcag

SEQ ID NO: 994413 - DNA, 23 bp, Homo sapiens
acccccacagacctgctctggac

SEQ ID NO: 994414 - DNA, 15 bp, Homo sapiens
acccccaccatgcag

SEQ ID NO: 994415 - DNA, 12 bp, Homo sapiens
acccccacccac

SEQ ID NO: 994416 - DNA, 15 bp, Homo sapiens
acccccacccacctc

SEQ ID NO: 994417 - DNA, 21 bp, Homo sapiens
acccccacccacctccaccca

SEQ ID NO: 994418 - DNA, 22 bp, Homo sapiens
acccccacccacctccacccag

SEQ ID NO: 994419 - DNA, 23 bp, Homo sapiens
acccccacccacctccacccagc

SEQ ID NO: 994420 - DNA, 15 bp, Homo sapiens
acccccaccccacac

SEQ ID NO: 994421 - DNA, 16 bp, Homo sapiens
acccccaccccacact

SEQ ID NO: 994422 - DNA, 14 bp, Homo sapiens
acccccacccccag

SEQ ID NO: 994423 - DNA, 15 bp, Homo sapiens
acccccacccccagc

SEQ ID NO: 994424 - DNA, 13 bp, Homo sapiens
acccccacccctt

SEQ ID NO: 994425 - DNA, 11 bp, Homo sapiens
acccccaccct

SEQ ID NO: 994426 - DNA, 12 bp, Homo sapiens
acccccaccctt

SEQ ID NO: 994427 - DNA, 15 bp, Homo sapiens
acccccactccagct

SEQ ID NO: 994428 - DNA, 13 bp, Homo sapiens
acccccactctca

SEQ ID NO: 994429 - DNA, 22 bp, Homo sapiens
acccccactctcattccccagg

SEQ ID NO: 994430 - DNA, 20 bp, Homo sapiens
acccccacttcccacttgca

SEQ ID NO: 994431 - DNA, 11 bp, Homo sapiens
acccccagcaa

SEQ ID NO: 994432 - DNA, 16 bp, Homo sapiens
acccccagcaaccctc

SEQ ID NO: 994433 - DNA, 14 bp, Homo sapiens
acccccagcccaca

SEQ ID NO: 994434 - DNA, 20 bp, Homo sapiens
acccccagcccacagagcct

SEQ ID NO: 994435 - DNA, 23 bp, Homo sapiens
acccccagccccgactccagcca

SEQ ID NO: 994436 - DNA, 13 bp, Homo sapiens
acccccagctcaa

SEQ ID NO: 994437 - DNA, 21 bp, Homo sapiens
acccccagctcaatggactgg

SEQ ID NO: 994438 - DNA, 18 bp, Homo sapiens
acccccagctccggcctg

SEQ ID NO: 994439 - DNA, 16 bp, Homo sapiens
acccccagctgactgt

SEQ ID NO: 994440 - DNA, 19 bp, Homo sapiens
acccccagctgactgttgg

SEQ ID NO: 994441 - DNA, 14 bp, Homo sapiens
acccccagctttgc

SEQ ID NO: 994442 - DNA, 11 bp, Homo sapiens
acccccaggcc

SEQ ID NO: 994443 - DNA, 13 bp, Homo sapiens
acccccaggcctc

SEQ ID NO: 994444 - DNA, 15 bp, Homo sapiens
acccccaggcctcct

SEQ ID NO: 994445 - DNA, 18 bp, Homo sapiens
acccccaggcctcctagg

SEQ ID NO: 994446 - DNA, 17 bp, Homo sapiens
acccccaggcctgtcca

SEQ ID NO: 994447 - DNA, 18 bp, Homo sapiens
acccccaggtcttcctgc

SEQ ID NO: 994448 - DNA, 14 bp, Homo sapiens
acccccagttccta

SEQ ID NO: 994449 - DNA, 14 bp, Homo sapiens
acccccatgctgcc

SEQ ID NO: 994450 - DNA, 17 bp, Homo sapiens
acccccatgctgccttc

SEQ ID NO: 994451 - DNA, 21 bp, Homo sapiens
acccccatgctgccttcaggg

SEQ ID NO: 994452 - DNA, 14 bp, Homo sapiens
accccccaagctgt

SEQ ID NO: 994453 - DNA, 14 bp, Homo sapiens
accccccactcagt

SEQ ID NO: 994454 - DNA, 14 bp, Homo sapiens
accccccaggccct

SEQ ID NO: 994455 - DNA, 12 bp, Homo sapiens
acccccctcatt

SEQ ID NO: 994456 - DNA, 15 bp, Homo sapiens
acccccctcctcccc

SEQ ID NO: 994457 - DNA, 16 bp, Homo sapiens
acccccctcctgctcc

SEQ ID NO: 994458 - DNA, 18 bp, Homo sapiens
acccccctctctttctct

SEQ ID NO: 994459 - DNA, 15 bp, Homo sapiens
acccccgaggggagg

SEQ ID NO: 994460 - DNA, 17 bp, Homo sapiens
acccccgccacctcagg

SEQ ID NO: 994461 - DNA, 14 bp, Homo sapiens
acccccgccacggc

SEQ ID NO: 994462 - DNA, 15 bp, Homo sapiens
acccccgccaggcgc

SEQ ID NO: 994463 - DNA, 13 bp, Homo sapiens
acccccgccatgc

SEQ ID NO: 994464 - DNA, 15 bp, Homo sapiens
acccccgcccccacc

SEQ ID NO: 994465 - DNA, 16 bp, Homo sapiens
acccccgcccccaccg

SEQ ID NO: 994466 - DNA, 15 bp, Homo sapiens
acccccgccccctgc

SEQ ID NO: 994467 - DNA, 21 bp, Homo sapiens
acccccgtcagctgcttctgc

SEQ ID NO: 994468 - DNA, 20 bp, Homo sapiens
acccccgtcggaatggtaac

SEQ ID NO: 994469 - DNA, 14 bp, Homo sapiens
accccctcatcccc

SEQ ID NO: 994470 - DNA, 11 bp, Homo sapiens
accccctcatt

SEQ ID NO: 994471 - DNA, 14 bp, Homo sapiens
accccctcccaccc

SEQ ID NO: 994472 - DNA, 17 bp, Homo sapiens
accccctcccaccccca

SEQ ID NO: 994473 - DNA, 19 bp, Homo sapiens
accccctcccacccccagc

SEQ ID NO: 994474 - DNA, 12 bp, Homo sapiens
accccctcccca

SEQ ID NO: 994475 - DNA, 14 bp, Homo sapiens
accccctccccagg

SEQ ID NO: 994476 - DNA, 17 bp, Homo sapiens
accccctccctggcctg

SEQ ID NO: 994477 - DNA, 16 bp, Homo sapiens
accccctcctggcaat

SEQ ID NO: 994478 - DNA, 15 bp, Homo sapiens
accccctccttcaga

SEQ ID NO: 994479 - DNA, 16 bp, Homo sapiens
accccctccttcagac

SEQ ID NO: 994480 - DNA, 17 bp, Homo sapiens
accccctcgccagcttg

SEQ ID NO: 994481 - DNA, 16 bp, Homo sapiens
accccctcgcttggac

SEQ ID NO: 994482 - DNA, 14 bp, Homo sapiens
accccctcggagcc

SEQ ID NO: 994483 - DNA, 16 bp, Homo sapiens
accccctcggagcctg

SEQ ID NO: 994484 - DNA, 18 bp, Homo sapiens
accccctcggagcctgtg

SEQ ID NO: 994485 - DNA, 17 bp, Homo sapiens
accccctcttcaaagca

SEQ ID NO: 994486 - DNA, 21 bp, Homo sapiens
accccctcttcaaagcagagt

SEQ ID NO: 994487 - DNA, 20 bp, Homo sapiens
accccctgagatcccctgag

SEQ ID NO: 994488 - DNA, 14 bp, Homo sapiens
accccctgcaaagc

SEQ ID NO: 994489 - DNA, 18 bp, Homo sapiens
accccctgcaaagcccag

SEQ ID NO: 994490 - DNA, 13 bp, Homo sapiens
accccctgcccgc

SEQ ID NO: 994491 - DNA, 11 bp, Homo sapiens
accctgtgtca

SEQ ID NO: 994492 - DNA, 20 bp, Homo sapiens
accctgtgtcagagcctacc

SEQ ID NO: 994493 - DNA, 13 bp, Homo sapiens
accctgtttctgt

SEQ ID NO: 994494 - DNA, 15 bp, Homo sapiens
acccttaactgacat

SEQ ID NO: 994495 - DNA, 19 bp, Homo sapiens
acccttacagcctctgact

SEQ ID NO: 994496 - DNA, 13 bp, Homo sapiens
acccttacagtag

SEQ ID NO: 994497 - DNA, 19 bp, Homo sapiens
acccttaccccttagcctc

SEQ ID NO: 994498 - DNA, 14 bp, Homo sapiens
acccttacttcctg

SEQ ID NO: 994499 - DNA, 13 bp, Homo sapiens
acccttagaaaat

SEQ ID NO: 994500 - DNA, 13 bp, Homo sapiens
acccttaggatgg

SEQ ID NO: 994501 - DNA, 19 bp, Homo sapiens
acccttattgctgtcctgg

SEQ ID NO: 994502 - DNA, 18 bp, Homo sapiens
acccttcaactcctggct

SEQ ID NO: 994503 - DNA, 19 bp, Homo sapiens
acccttcaactcctggctc

SEQ ID NO: 994504 - DNA, 14 bp, Homo sapiens
acccttcagacccc

SEQ ID NO: 994505 - DNA, 15 bp, Homo sapiens
acccttcatcttcct

SEQ ID NO: 994506 - DNA, 17 bp, Homo sapiens
acccttcatcttcctgt

SEQ ID NO: 994507 - DNA, 14 bp, Homo sapiens
acccttccatcagc

SEQ ID NO: 994508 - DNA, 15 bp, Homo sapiens
acccttcccagccct

SEQ ID NO: 994509 - DNA, 16 bp, Homo sapiens
acccttcccagccctc

SEQ ID NO: 994510 - DNA, 15 bp, Homo sapiens
acccttccctgcact

SEQ ID NO: 994511 - DNA, 16 bp, Homo sapiens
acccttccctgcacta

SEQ ID NO: 994512 - DNA, 15 bp, Homo sapiens
acccttcctggccca

SEQ ID NO: 994513 - DNA, 16 bp, Homo sapiens
acccttcctggcccag

SEQ ID NO: 994514 - DNA, 17 bp, Homo sapiens
acccttcctggcccagg

SEQ ID NO: 994515 - DNA, 18 bp, Homo sapiens
acccttcctggcccaggc

SEQ ID NO: 994516 - DNA, 19 bp, Homo sapiens
acccttcctggcccaggcc

SEQ ID NO: 994517 - DNA, 16 bp, Homo sapiens
acccttctccaaaggc

SEQ ID NO: 994518 - DNA, 17 bp, Homo sapiens
acccttctcctcttgta

SEQ ID NO: 994519 - DNA, 21 bp, Homo sapiens
acccttctcctcttgtaaata

SEQ ID NO: 994520 - DNA, 20 bp, Homo sapiens
acccttctctcacttctaaa

SEQ ID NO: 994521 - DNA, 12 bp, Homo sapiens
acccttctgggc

SEQ ID NO: 994522 - DNA, 14 bp, Homo sapiens
acccttctttcctc

SEQ ID NO: 994523 - DNA, 16 bp, Homo sapiens
acccttctttcctctt

SEQ ID NO: 994524 - DNA, 18 bp, Homo sapiens
acccttctttcctcttcc

SEQ ID NO: 994525 - DNA, 20 bp, Homo sapiens
acccttgaatttctagacag

SEQ ID NO: 994526 - DNA, 23 bp, Homo sapiens
acccttgaatttctagacagtat

SEQ ID NO: 994527 - DNA, 11 bp, Homo sapiens
acccttgacac

SEQ ID NO: 994528 - DNA, 22 bp, Homo sapiens
acccttgattttgccccctgag

SEQ ID NO: 994529 - DNA, 21 bp, Homo sapiens
acccttgcaccgtcctcagca

SEQ ID NO: 994530 - DNA, 21 bp, Homo sapiens
acccttgcctgcctcctaggc

SEQ ID NO: 994531 - DNA, 19 bp, Homo sapiens
acccttgctttcctgggcc

SEQ ID NO: 994532 - DNA, 20 bp, Homo sapiens
acccttggcctccatttctg

SEQ ID NO: 994533 - DNA, 17 bp, Homo sapiens
acccttggcctgtctca

SEQ ID NO: 994534 - DNA, 17 bp, Homo sapiens
acccttgggccagaagt

SEQ ID NO: 994535 - DNA, 18 bp, Homo sapiens
acccttgggccagaagta

SEQ ID NO: 994536 - DNA, 19 bp, Homo sapiens
accctttaagatatccatc

SEQ ID NO: 994537 - DNA, 16 bp, Homo sapiens
accctttattctcact

SEQ ID NO: 994538 - DNA, 15 bp, Homo sapiens
accctttcctccccc

SEQ ID NO: 994539 - DNA, 23 bp, Homo sapiens
accctttcctcccccagcgtcag

SEQ ID NO: 994540 - DNA, 15 bp, Homo sapiens
accctttccttcctt

SEQ ID NO: 994541 - DNA, 21 bp, Homo sapiens
accctttccttccttccctgg

SEQ ID NO: 994542 - DNA, 23 bp, Homo sapiens
accctttgctgtgaggctgtcct

SEQ ID NO: 994543 - DNA, 12 bp, Homo sapiens
accctttggggg

SEQ ID NO: 994544 - DNA, 13 bp, Homo sapiens
accctttgggggt

SEQ ID NO: 994545 - DNA, 12 bp, Homo sapiens
accctttggttt

SEQ ID NO: 994546 - DNA, 12 bp, Homo sapiens
accctttgtatt

SEQ ID NO: 994547 - DNA, 20 bp, Homo sapiens
accctttgtattataattgt

SEQ ID NO: 994548 - DNA, 21 bp, Homo sapiens
acccttttctgatcgtctcgg

SEQ ID NO: 994549 - DNA, 17 bp, Homo sapiens
accctttttctccagct

SEQ ID NO: 994550 - DNA, 15 bp, Homo sapiens
accgaaatctgtatt

SEQ ID NO: 994551 - DNA, 15 bp, Homo sapiens
accgaataaatgttt

SEQ ID NO: 994552 - DNA, 19 bp, Homo sapiens
accgaatatattactgatt

SEQ ID NO: 994553 - DNA, 12 bp, Homo sapiens
accgaatattga

SEQ ID NO: 994554 - DNA, 16 bp, Homo sapiens
accgaatgtgtcttta

SEQ ID NO: 994555 - DNA, 17 bp, Homo sapiens
accgacagcggccttga

SEQ ID NO: 994556 - DNA, 16 bp, Homo sapiens
accgaccaactgccct

SEQ ID NO: 994557 - DNA, 17 bp, Homo sapiens
accgaccaactgcccta

SEQ ID NO: 994558 - DNA, 21 bp, Homo sapiens
accgaccatcgtccagccctc

SEQ ID NO: 994559 - DNA, 22 bp, Homo sapiens
accgaccatcgtccagccctcc

SEQ ID NO: 994560 - DNA, 17 bp, Homo sapiens
accgacccgaggcccag

SEQ ID NO: 994561 - DNA, 18 bp, Homo sapiens
accgacccgaggcccaga

SEQ ID NO: 994562 - DNA, 18 bp, Homo sapiens
accgacgcgtctcctgtt

SEQ ID NO: 994563 - DNA, 15 bp, Homo sapiens
accgactaccccagt

SEQ ID NO: 994564 - DNA, 18 bp, Homo sapiens
accgactgaccctgagga

SEQ ID NO: 994565 - DNA, 14 bp, Homo sapiens
accgactgcccagc

SEQ ID NO: 994566 - DNA, 15 bp, Homo sapiens
accgactgcccagcc

SEQ ID NO: 994567 - DNA, 12 bp, Homo sapiens
accgagacatga

SEQ ID NO: 994568 - DNA, 16 bp, Homo sapiens
accgagataggggagg

SEQ ID NO: 994569 - DNA, 19 bp, Homo sapiens
accgagatgtgagtcctgt

SEQ ID NO: 994570 - DNA, 12 bp, Homo sapiens
accgagccagca

SEQ ID NO: 994571 - DNA, 20 bp, Homo sapiens
accgagcgctttctggaaaa

SEQ ID NO: 994572 - DNA, 20 bp, Homo sapiens
accgaggcgatgccacgctt

SEQ ID NO: 994573 - DNA, 17 bp, Homo sapiens
accgagtctcttctcca

SEQ ID NO: 994574 - DNA, 20 bp, Homo sapiens
accgagtctcttctccactg

SEQ ID NO: 994575 - DNA, 24 bp, Homo sapiens
accgagtctcttctccactggatg

SEQ ID NO: 994576 - DNA, 21 bp, Homo sapiens
accgagtgaacctaccttcat

SEQ ID NO: 994577 - DNA, 19 bp, Homo sapiens
accgatgatactgtttctt

SEQ ID NO: 994578 - DNA, 17 bp, Homo sapiens
accgatggagcccccag

SEQ ID NO: 994579 - DNA, 15 bp, Homo sapiens
accgatggtcccagg

SEQ ID NO: 994580 - DNA, 18 bp, Homo sapiens
accgatggtcccaggaag

SEQ ID NO: 994581 - DNA, 23 bp, Homo sapiens
accgatggtcccaggaagcaggg

SEQ ID NO: 994582 - DNA, 18 bp, Homo sapiens
accgatgtgtctcccaga

SEQ ID NO: 994583 - DNA, 14 bp, Homo sapiens
accgcacagctcag

SEQ ID NO: 994584 - DNA, 23 bp, Homo sapiens
accgcagctactcccctttcttc

SEQ ID NO: 994585 - DNA, 12 bp, Homo sapiens
accgcaggcccg

SEQ ID NO: 994586 - DNA, 21 bp, Homo sapiens
accgcatatgcatgccaggct

SEQ ID NO: 994587 - DNA, 15 bp, Homo sapiens
accgcccctggccgc

SEQ ID NO: 994588 - DNA, 15 bp, Homo sapiens
accgccctcctccac

SEQ ID NO: 994589 - DNA, 17 bp, Homo sapiens
accgccctgcgggccac

SEQ ID NO: 994590 - DNA, 21 bp, Homo sapiens
accgccctgcgggccacaggg

SEQ ID NO: 994591 - DNA, 14 bp, Homo sapiens
accgccctgggctg

SEQ ID NO: 994592 - DNA, 15 bp, Homo sapiens
accgcctagtttact

SEQ ID NO: 994593 - DNA, 12 bp, Homo sapiens
accgcctctggc

SEQ ID NO: 994594 - DNA, 11 bp, Homo sapiens
accgcctgccc

SEQ ID NO: 994595 - DNA, 12 bp, Homo sapiens
accgcctgccct

SEQ ID NO: 994596 - DNA, 22 bp, Homo sapiens
accgcctgccctcccgcacctt

SEQ ID NO: 994597 - DNA, 20 bp, Homo sapiens
acctacgtttgcaccgcctg

SEQ ID NO: 994598 - DNA, 21 bp, Homo sapiens
acctacgtttgcaccgcctgc

SEQ ID NO: 994599 - DNA, 15 bp, Homo sapiens
acctactatgtgctg

SEQ ID NO: 994600 - DNA, 22 bp, Homo sapiens
acctactctgtaatttgcttgt

SEQ ID NO: 994601 - DNA, 14 bp, Homo sapiens
acctactgcccaca

SEQ ID NO: 994602 - DNA, 17 bp, Homo sapiens
acctactgcccacattt

SEQ ID NO: 994603 - DNA, 20 bp, Homo sapiens
acctactgtgtcttggaatc

SEQ ID NO: 994604 - DNA, 14 bp, Homo sapiens
acctactgttcctt

SEQ ID NO: 994605 - DNA, 16 bp, Homo sapiens
acctactgttcctttc

SEQ ID NO: 994606 - DNA, 13 bp, Homo sapiens
acctactttcttc

SEQ ID NO: 994607 - DNA, 15 bp, Homo sapiens
acctagaacgtgcat

SEQ ID NO: 994608 - DNA, 22 bp, Homo sapiens
acctagaacgtgcatccttgta

SEQ ID NO: 994609 - DNA, 15 bp, Homo sapiens
acctagaatgtcaga

SEQ ID NO: 994610 - DNA, 20 bp, Homo sapiens
acctagaatgtcagatttct

SEQ ID NO: 994611 - DNA, 18 bp, Homo sapiens
acctagaccagtttgcat

SEQ ID NO: 994612 - DNA, 20 bp, Homo sapiens
acctagaccagtttgcatga

SEQ ID NO: 994613 - DNA, 15 bp, Homo sapiens
acctagagccagacc

SEQ ID NO: 994614 - DNA, 16 bp, Homo sapiens
acctagagccagacca

SEQ ID NO: 994615 - DNA, 15 bp, Homo sapiens
acctagagccgggca

SEQ ID NO: 994616 - DNA, 21 bp, Homo sapiens
acctagcaacatatctctgcc

SEQ ID NO: 994617 - DNA, 14 bp, Homo sapiens
acctagcagcaccg

SEQ ID NO: 994618 - DNA, 23 bp, Homo sapiens
acctagcagcaccgttctgtgca

SEQ ID NO: 994619 - DNA, 21 bp, Homo sapiens
acctagcaggctgttccatgt

SEQ ID NO: 994620 - DNA, 13 bp, Homo sapiens
acctagccagctg

SEQ ID NO: 994621 - DNA, 17 bp, Homo sapiens
acctagcctggatggcc

SEQ ID NO: 994622 - DNA, 21 bp, Homo sapiens
acctagctgttgtaaagaatt

SEQ ID NO: 994623 - DNA, 18 bp, Homo sapiens
acctagcttttaaaaaat

SEQ ID NO: 994624 - DNA, 19 bp, Homo sapiens
acctagcttttaaaaaata

SEQ ID NO: 994625 - DNA, 20 bp, Homo sapiens
acctagcttttaaaaaatat

SEQ ID NO: 994626 - DNA, 17 bp, Homo sapiens
acctaggccactcctcc

SEQ ID NO: 994627 - DNA, 13 bp, Homo sapiens
acctaggctgagg

SEQ ID NO: 994628 - DNA, 17 bp, Homo sapiens
acctagggaggacctta

SEQ ID NO: 994629 - DNA, 15 bp, Homo sapiens
acctaggggcgccgc

SEQ ID NO: 994630 - DNA, 19 bp, Homo sapiens
acctagggggacggggctg

SEQ ID NO: 994631 - DNA, 14 bp, Homo sapiens
acctagtactgccc

SEQ ID NO: 994632 - DNA, 13 bp, Homo sapiens
acctagtgaaact

SEQ ID NO: 994633 - DNA, 14 bp, Homo sapiens
acctagtgaaactt

SEQ ID NO: 994634 - DNA, 14 bp, Homo sapiens
acctagttttccat

SEQ ID NO: 994635 - DNA, 23 bp, Homo sapiens
acctatacagaacagagggccag

SEQ ID NO: 994636 - DNA, 23 bp, Homo sapiens
acctatactgaaagatctctgtc

SEQ ID NO: 994637 - DNA, 19 bp, Homo sapiens
acctatagaaatagaacac

SEQ ID NO: 994638 - DNA, 13 bp, Homo sapiens
acctatattgatt

SEQ ID NO: 994639 - DNA, 13 bp, Homo sapiens
acctatctatgaa

SEQ ID NO: 994640 - DNA, 15 bp, Homo sapiens
acctatctcagccat

SEQ ID NO: 994641 - DNA, 20 bp, Homo sapiens
acctgctgtgatacgatgct

SEQ ID NO: 994642 - DNA, 21 bp, Homo sapiens
acctgctgtgatacgatgctt

SEQ ID NO: 994643 - DNA, 18 bp, Homo sapiens
acctgcttcacgttggcc

SEQ ID NO: 994644 - DNA, 23 bp, Homo sapiens
acctgcttggtgtgtaggttccg

SEQ ID NO: 994645 - DNA, 15 bp, Homo sapiens
acctgctttcaagac

SEQ ID NO: 994646 - DNA, 20 bp, Homo sapiens
acctggaatctacaagccaa

SEQ ID NO: 994647 - DNA, 18 bp, Homo sapiens
acctggacacacactcac

SEQ ID NO: 994648 - DNA, 20 bp, Homo sapiens
acctggacacacactcacca

SEQ ID NO: 994649 - DNA, 17 bp, Homo sapiens
acctggagatgcagcta

SEQ ID NO: 994650 - DNA, 14 bp, Homo sapiens
acctggagcccctg

SEQ ID NO: 994651 - DNA, 16 bp, Homo sapiens
acctggagcccctggg

SEQ ID NO: 994652 - DNA, 18 bp, Homo sapiens
acctggagcccctgggtg

SEQ ID NO: 994653 - DNA, 21 bp, Homo sapiens
acctggaggcaagagggaggg

SEQ ID NO: 994654 - DNA, 18 bp, Homo sapiens
acctggatagttaagggc

SEQ ID NO: 994655 - DNA, 14 bp, Homo sapiens
acctggcactggga

SEQ ID NO: 994656 - DNA, 21 bp, Homo sapiens
acctggcatggtgcagggaga

SEQ ID NO: 994657 - DNA, 16 bp, Homo sapiens
acctggccacctgagg

SEQ ID NO: 994658 - DNA, 18 bp, Homo sapiens
acctggccacctgaggtg

SEQ ID NO: 994659 - DNA, 20 bp, Homo sapiens
acctggccacctgaggtggg

SEQ ID NO: 994660 - DNA, 21 bp, Homo sapiens
acctggccccatgtctctcag

SEQ ID NO: 994661 - DNA, 18 bp, Homo sapiens
acctggccctgcttcctg

SEQ ID NO: 994662 - DNA, 16 bp, Homo sapiens
acctggcctgctggga

SEQ ID NO: 994663 - DNA, 23 bp, Homo sapiens
acctggcctggcctccaaaatat

SEQ ID NO: 994664 - DNA, 15 bp, Homo sapiens
acctggcctgggcca

SEQ ID NO: 994665 - DNA, 16 bp, Homo sapiens
acctggcctgggccac

SEQ ID NO: 994666 - DNA, 17 bp, Homo sapiens
acctggccttaaagagg

SEQ ID NO: 994667 - DNA, 15 bp, Homo sapiens
acctggcctttcact

SEQ ID NO: 994668 - DNA, 15 bp, Homo sapiens
acctggcgtgctcag

SEQ ID NO: 994669 - DNA, 19 bp, Homo sapiens
acctggctaattttttgta

SEQ ID NO: 994670 - DNA, 18 bp, Homo sapiens
acctggctgctaggccag

SEQ ID NO: 994671 - DNA, 17 bp, Homo sapiens
acctggcttatttaata

SEQ ID NO: 994672 - DNA, 17 bp, Homo sapiens
acctggcttttacttta

SEQ ID NO: 994673 - DNA, 19 bp, Homo sapiens
acctggcttttactttatt

SEQ ID NO: 994674 - DNA, 14 bp, Homo sapiens
acctggctttttaa

SEQ ID NO: 994675 - DNA, 17 bp, Homo sapiens
acctgggaaaggaccca

SEQ ID NO: 994676 - DNA, 14 bp, Homo sapiens
acctgggaacacag

SEQ ID NO: 994677 - DNA, 15 bp, Homo sapiens
acctgggagggtggg

SEQ ID NO: 994678 - DNA, 20 bp, Homo sapiens
acctgggatgaggggtgctg

SEQ ID NO: 994679 - DNA, 18 bp, Homo sapiens
acctgggcacctggggag

SEQ ID NO: 994680 - DNA, 17 bp, Homo sapiens
acctgggcagctcctcc

SEQ ID NO: 994681 - DNA, 20 bp, Homo sapiens
acctgggcccacagagcctg

SEQ ID NO: 994682 - DNA, 11 bp, Homo sapiens
acctgggcccc

SEQ ID NO: 994683 - DNA, 14 bp, Homo sapiens
acctgggccccact

SEQ ID NO: 994684 - DNA, 15 bp, Homo sapiens
acctgggccccactg

SEQ ID NO: 994685 - DNA, 17 bp, Homo sapiens
acctgggccccactgga

SEQ ID NO: 994686 - DNA, 23 bp, Homo sapiens
acctgggcccgggcaggccagct

SEQ ID NO: 994687 - DNA, 16 bp, Homo sapiens
acctggggactcctca

SEQ ID NO: 994688 - DNA, 22 bp, Homo sapiens
acctggggcacagtccaggaac

SEQ ID NO: 994689 - DNA, 16 bp, Homo sapiens
acctgggggatggtca

SEQ ID NO: 994690 - DNA, 22 bp, Homo sapiens
acctgggggtagccccgcccca

SEQ ID NO: 994691 - DNA, 18 bp, Homo sapiens
acctggggtgaatactta

SEQ ID NO: 994692 - DNA, 20 bp, Homo sapiens
acctgggtatcccctgcctc

SEQ ID NO: 994693 - DNA, 15 bp, Homo sapiens
acctgggtccttttc

SEQ ID NO: 994694 - DNA, 19 bp, Homo sapiens
acctggtaccctcctggct

SEQ ID NO: 994695 - DNA, 22 bp, Homo sapiens
acctggtcacaggactctgcct

SEQ ID NO: 994696 - DNA, 23 bp, Homo sapiens
acctggtcacaggactctgcctc

SEQ ID NO: 994697 - DNA, 23 bp, Homo sapiens
acctggtccccactgctgagctg

SEQ ID NO: 994698 - DNA, 23 bp, Homo sapiens
acctggtgctcgggaagggaggg

SEQ ID NO: 994699 - DNA, 12 bp, Homo sapiens
acctggtggcac

SEQ ID NO: 994700 - DNA, 22 bp, Homo sapiens
acctgtaaaactttattttata

SEQ ID NO: 994701 - DNA, 17 bp, Homo sapiens
acctgtaacttttgtaa

SEQ ID NO: 994702 - DNA, 20 bp, Homo sapiens
acctgtaacttttgtaaata

SEQ ID NO: 994703 - DNA, 22 bp, Homo sapiens
acctgtactatgatgggcttct

SEQ ID NO: 994704 - DNA, 16 bp, Homo sapiens
acctgtagtcccagct

SEQ ID NO: 994705 - DNA, 15 bp, Homo sapiens
acctgtagtgagaaa

SEQ ID NO: 994706 - DNA, 16 bp, Homo sapiens
acctgtagtgagaaac

SEQ ID NO: 994707 - DNA, 17 bp, Homo sapiens
acctgtcaccctgcagg

SEQ ID NO: 994708 - DNA, 18 bp, Homo sapiens
acctgtcaccctgcagga

SEQ ID NO: 994709 - DNA, 17 bp, Homo sapiens
acctgtcatgcccccct

SEQ ID NO: 994710 - DNA, 14 bp, Homo sapiens
acctgtcatgtgcg

SEQ ID NO: 994711 - DNA, 21 bp, Homo sapiens
acctgtccccaccctccactc

SEQ ID NO: 994712 - DNA, 22 bp, Homo sapiens
acctgtccccaccctccactca

SEQ ID NO: 994713 - DNA, 12 bp, Homo sapiens
acctgtccccca

SEQ ID NO: 994714 - DNA, 16 bp, Homo sapiens
acctgtcccccactct

SEQ ID NO: 994715 - DNA, 20 bp, Homo sapiens
acctgtcccccactctctca

SEQ ID NO: 994716 - DNA, 15 bp, Homo sapiens
acctgtccggcccag

SEQ ID NO: 994717 - DNA, 23 bp, Homo sapiens
acctgtccggcccagtgccagct

SEQ ID NO: 994718 - DNA, 18 bp, Homo sapiens
acctgtcggtggctgcct

SEQ ID NO: 994719 - DNA, 19 bp, Homo sapiens
acctgtcggtggctgcctt

SEQ ID NO: 994720 - DNA, 22 bp, Homo sapiens
acctgtctaggaaggtgtgatg

SEQ ID NO: 994721 - DNA, 23 bp, Homo sapiens
acctgtctataagagaattatat

SEQ ID NO: 994722 - DNA, 18 bp, Homo sapiens
acctgtctcacctggact

SEQ ID NO: 994723 - DNA, 17 bp, Homo sapiens
acctgtctcctttctca

SEQ ID NO: 994724 - DNA, 13 bp, Homo sapiens
acctgtgacaaag

SEQ ID NO: 994725 - DNA, 13 bp, Homo sapiens
acctgtgaccagc

SEQ ID NO: 994726 - DNA, 17 bp, Homo sapiens
acctgtgagcccagctg

SEQ ID NO: 994727 - DNA, 18 bp, Homo sapiens
acctgtgagtttaaagca

SEQ ID NO: 994728 - DNA, 12 bp, Homo sapiens
acctgtgcacct

SEQ ID NO: 994729 - DNA, 18 bp, Homo sapiens
acctgtgccctcaccacc

SEQ ID NO: 994730 - DNA, 21 bp, Homo sapiens
acctgtgccctcaccaccaca

SEQ ID NO: 994731 - DNA, 14 bp, Homo sapiens
acctgtgctttgag

SEQ ID NO: 994732 - DNA, 18 bp, Homo sapiens
acctgtggccaagttctt

SEQ ID NO: 994733 - DNA, 21 bp, Homo sapiens
acctgtggggatttctcccag

SEQ ID NO: 994734 - DNA, 16 bp, Homo sapiens
acctgtgtacataact

SEQ ID NO: 994735 - DNA, 16 bp, Homo sapiens
acctgtgtgagagaat

SEQ ID NO: 994736 - DNA, 11 bp, Homo sapiens
acctgtgtgct

SEQ ID NO: 994737 - DNA, 22 bp, Homo sapiens
acctgttaaaacaaccagttaa

SEQ ID NO: 994738 - DNA, 17 bp, Homo sapiens
acctgttacctactttg

SEQ ID NO: 994739 - DNA, 18 bp, Homo sapiens
acctgttacctactttga

SEQ ID NO: 994740 - DNA, 17 bp, Homo sapiens
acctgttagcagacagg

SEQ ID NO: 994741 - DNA, 17 bp, Homo sapiens
acctgttatgtatgaag

SEQ ID NO: 994742 - DNA, 15 bp, Homo sapiens
acctgttatttatca

SEQ ID NO: 994743 - DNA, 16 bp, Homo sapiens
acctgttatttatcaa

SEQ ID NO: 994744 - DNA, 15 bp, Homo sapiens
acctgttcacagaaa

SEQ ID NO: 994745 - DNA, 19 bp, Homo sapiens
acctgttcagtgtcccggg

SEQ ID NO: 994746 - DNA, 20 bp, Homo sapiens
acctgttcagtgtcccgggc

SEQ ID NO: 994747 - DNA, 14 bp, Homo sapiens
acctgttctgaaat

SEQ ID NO: 994748 - DNA, 13 bp, Homo sapiens
acctgttctgtag

SEQ ID NO: 994749 - DNA, 15 bp, Homo sapiens
acctgttctgtagct

SEQ ID NO: 994750 - DNA, 20 bp, Homo sapiens
acctgttcttagagtgtagc

SEQ ID NO: 994751 - DNA, 20 bp, Homo sapiens
acctgttgctccaggatgca

SEQ ID NO: 994752 - DNA, 15 bp, Homo sapiens
acctgttggcctgtg

SEQ ID NO: 994753 - DNA, 17 bp, Homo sapiens
acctgttggcctgtggg

SEQ ID NO: 994754 - DNA, 18 bp, Homo sapiens
acctgtttctctttgtct

SEQ ID NO: 994755 - DNA, 16 bp, Homo sapiens
acctgttttctgaaac

SEQ ID NO: 994756 - DNA, 21 bp, Homo sapiens
acctgttttctgaaacacacg

SEQ ID NO: 994757 - DNA, 14 bp, Homo sapiens
acctgttttcttca

SEQ ID NO: 994758 - DNA, 20 bp, Homo sapiens
acctgtttttaagctgtttc

SEQ ID NO: 994759 - DNA, 16 bp, Homo sapiens
accttaaaaaatgttt

SEQ ID NO: 994760 - DNA, 17 bp, Homo sapiens
accttaaaaaatgtttc

SEQ ID NO: 994761 - DNA, 13 bp, Homo sapiens
accttaaattaaa

SEQ ID NO: 994762 - DNA, 19 bp, Homo sapiens
accttaaattaaacaattt

SEQ ID NO: 994763 - DNA, 18 bp, Homo sapiens
accttaagacactgtgag

SEQ ID NO: 994764 - DNA, 15 bp, Homo sapiens
accttaatatttctt

SEQ ID NO: 994765 - DNA, 21 bp, Homo sapiens
acctttgcgtggatcaagctt

SEQ ID NO: 994766 - DNA, 13 bp, Homo sapiens
acctttggctggt

SEQ ID NO: 994767 - DNA, 18 bp, Homo sapiens
acctttgggttctttctg

SEQ ID NO: 994768 - DNA, 21 bp, Homo sapiens
acctttgtaagacatttgtat

SEQ ID NO: 994769 - DNA, 23 bp, Homo sapiens
acctttgtattctctcctgtacc

SEQ ID NO: 994770 - DNA, 18 bp, Homo sapiens
acctttgtcttctataat

SEQ ID NO: 994771 - DNA, 21 bp, Homo sapiens
accttttactggttgcatgga

SEQ ID NO: 994772 - DNA, 14 bp, Homo sapiens
accttttataccag

SEQ ID NO: 994773 - DNA, 15 bp, Homo sapiens
accttttatgtagca

SEQ ID NO: 994774 - DNA, 14 bp, Homo sapiens
accttttattacat

SEQ ID NO: 994775 - DNA, 16 bp, Homo sapiens
accttttattgacaca

SEQ ID NO: 994776 - DNA, 11 bp, Homo sapiens
accttttccta

SEQ ID NO: 994777 - DNA, 13 bp, Homo sapiens
accttttctataa

SEQ ID NO: 994778 - DNA, 15 bp, Homo sapiens
accttttctataagt

SEQ ID NO: 994779 - DNA, 22 bp, Homo sapiens
accttttctataagttgtacca

SEQ ID NO: 994780 - DNA, 16 bp, Homo sapiens
accttttctgttgtac

SEQ ID NO: 994781 - DNA, 19 bp, Homo sapiens
accttttgaagtagtttgt

SEQ ID NO: 994782 - DNA, 21 bp, Homo sapiens
accttttgaggagccccagct

SEQ ID NO: 994783 - DNA, 22 bp, Homo sapiens
accttttgggaatgttttaaat

SEQ ID NO: 994784 - DNA, 18 bp, Homo sapiens
accttttggtcttcagcc

SEQ ID NO: 994785 - DNA, 23 bp, Homo sapiens
acctttttgcatgatatcttcaa

SEQ ID NO: 994786 - DNA, 15 bp, Homo sapiens
acctttttgtaaata

SEQ ID NO: 994787 - DNA, 16 bp, Homo sapiens
accttttttatacata

SEQ ID NO: 994788 - DNA, 22 bp, Homo sapiens
accttttttatacataaacaag

SEQ ID NO: 994789 - DNA, 16 bp, Homo sapiens
acctttttttttgaaa

SEQ ID NO: 994790 - DNA, 19 bp, Homo sapiens
acctttttttttgaaacag

SEQ ID NO: 994791 - DNA, 20 bp, Homo sapiens
accttttttttttgagttta

SEQ ID NO: 994792 - DNA, 19 bp, Homo sapiens
accttttttttttttccaa

SEQ ID NO: 994793 - DNA, 18 bp, Homo sapiens
acgaaacttgttattgtg

SEQ ID NO: 994794 - DNA, 19 bp, Homo sapiens
acgaaacttgttattgtga

SEQ ID NO: 994795 - DNA, 13 bp, Homo sapiens
acgaaagaaggca

SEQ ID NO: 994796 - DNA, 17 bp, Homo sapiens
acgaaataattgttgtt

SEQ ID NO: 994797 - DNA, 23 bp, Homo sapiens
acgaaatgttattttttaattat

SEQ ID NO: 994798 - DNA, 16 bp, Homo sapiens
acgaacccacctgctg

SEQ ID NO: 994799 - DNA, 14 bp, Homo sapiens
acgaacttgaaagt

SEQ ID NO: 994800 - DNA, 20 bp, Homo sapiens
acgaagagtttaaagagaaa

SEQ ID NO: 994801 - DNA, 17 bp, Homo sapiens
acgaagccatctttctt

SEQ ID NO: 994802 - DNA, 18 bp, Homo sapiens
acgaatagacatcaaact

SEQ ID NO: 994803 - DNA, 12 bp, Homo sapiens
acgaatatgaat

SEQ ID NO: 994804 - DNA, 13 bp, Homo sapiens
acgaatatgaatg

SEQ ID NO: 994805 - DNA, 16 bp, Homo sapiens
acgaatatgaatgtca

SEQ ID NO: 994806 - DNA, 21 bp, Homo sapiens
acgaatgaaaataactgaatt

SEQ ID NO: 994807 - DNA, 22 bp, Homo sapiens
acgacaaagccaaactctgcca

SEQ ID NO: 994808 - DNA, 20 bp, Homo sapiens
acgacaacgatgatgcttgt

SEQ ID NO: 994809 - DNA, 20 bp, Homo sapiens
acgacaatagctttaccctc

SEQ ID NO: 994810 - DNA, 19 bp, Homo sapiens
acgacacatatacatatga

SEQ ID NO: 994811 - DNA, 12 bp, Homo sapiens
acgacagaggag

SEQ ID NO: 994812 - DNA, 14 bp, Homo sapiens
acgactgtatattg

SEQ ID NO: 994813 - DNA, 22 bp, Homo sapiens
acgacttcagggcagggctctg

SEQ ID NO: 994814 - DNA, 15 bp, Homo sapiens
acgagaaagatcatt

SEQ ID NO: 994815 - DNA, 15 bp, Homo sapiens
acgagatttcttttt

SEQ ID NO: 994816 - DNA, 20 bp, Homo sapiens
acgagatttcttttttatgt

SEQ ID NO: 994817 - DNA, 13 bp, Homo sapiens
acgagatttgcca

SEQ ID NO: 994818 - DNA, 15 bp, Homo sapiens
acgagcactggccag

SEQ ID NO: 994819 - DNA, 18 bp, Homo sapiens
acgagcactggccagaga

SEQ ID NO: 994820 - DNA, 14 bp, Homo sapiens
acgagcatccccct

SEQ ID NO: 994821 - DNA, 22 bp, Homo sapiens
acgagcatccccctcctctccc

SEQ ID NO: 994822 - DNA, 23 bp, Homo sapiens
acgagcatccccctcctctccct

SEQ ID NO: 994823 - DNA, 19 bp, Homo sapiens
acgagccacaagctgcact

SEQ ID NO: 994824 - DNA, 21 bp, Homo sapiens
acgagccacaagctgcactgt

SEQ ID NO: 994825 - DNA, 22 bp, Homo sapiens
acgagccacaagctgcactgtg

SEQ ID NO: 994826 - DNA, 12 bp, Homo sapiens
acgagcctcctc

SEQ ID NO: 994827 - DNA, 16 bp, Homo sapiens
acgagcctcctcaggg

SEQ ID NO: 994828 - DNA, 17 bp, Homo sapiens
acgagcctcctcagggg

SEQ ID NO: 994829 - DNA, 23 bp, Homo sapiens
acgagcctcctcagggggtagga

SEQ ID NO: 994830 - DNA, 21 bp, Homo sapiens
acgagcctttgtttttctcca

SEQ ID NO: 994831 - DNA, 20 bp, Homo sapiens
acgagcttaatcaacagaag

SEQ ID NO: 994832 - DNA, 22 bp, Homo sapiens
acgaggaaaagaacaaacaaaa

SEQ ID NO: 994833 - DNA, 22 bp, Homo sapiens
acgaggaatctgtgggtctggg

SEQ ID NO: 994834 - DNA, 19 bp, Homo sapiens
acgaggccactcagaggcc

SEQ ID NO: 994835 - DNA, 20 bp, Homo sapiens
acgaggccactcagaggccc

SEQ ID NO: 994836 - DNA, 21 bp, Homo sapiens
acgaggccactcagaggcccc

SEQ ID NO: 994837 - DNA, 16 bp, Homo sapiens
acgaggctgcccccat

SEQ ID NO: 994838 - DNA, 20 bp, Homo sapiens
acgagggctggctggcctca

SEQ ID NO: 994839 - DNA, 21 bp, Homo sapiens
acgaggggtgtcttgggcaga

SEQ ID NO: 994840 - DNA, 19 bp, Homo sapiens
acgagggtctcccctcctg

SEQ ID NO: 994841 - DNA, 21 bp, Homo sapiens
acgagggtctcccctcctgca

SEQ ID NO: 994842 - DNA, 22 bp, Homo sapiens
acgagggtctcccctcctgcac

SEQ ID NO: 994843 - DNA, 14 bp, Homo sapiens
acgagggtgccgtg

SEQ ID NO: 994844 - DNA, 17 bp, Homo sapiens
acgagtaagtgaatcct

SEQ ID NO: 994845 - DNA, 13 bp, Homo sapiens
acgagtcacctgc

SEQ ID NO: 994846 - DNA, 16 bp, Homo sapiens
acgagtcacctgcaag

SEQ ID NO: 994847 - DNA, 18 bp, Homo sapiens
acgagtcacctgcaagcc

SEQ ID NO: 994848 - DNA, 20 bp, Homo sapiens
acgagtcacctgcaagcccc

SEQ ID NO: 994849 - DNA, 23 bp, Homo sapiens
acgatatttaattcacctcagcc

SEQ ID NO: 994850 - DNA, 16 bp, Homo sapiens
acgatcccctccccca

SEQ ID NO: 994851 - DNA, 14 bp, Homo sapiens
acgatccttcaaag

SEQ ID NO: 994852 - DNA, 22 bp, Homo sapiens
acgatcggtttcatattttaaa

SEQ ID NO: 994853 - DNA, 19 bp, Homo sapiens
acgatgaatttcttctaat

SEQ ID NO: 994854 - DNA, 20 bp, Homo sapiens
acgatgcatttaataaagat

SEQ ID NO: 994855 - DNA, 23 bp, Homo sapiens
acgatgcatttaataaagatgag

SEQ ID NO: 994856 - DNA, 16 bp, Homo sapiens
acgatgtggccctggc

SEQ ID NO: 994857 - DNA, 15 bp, Homo sapiens
acgatgtgtctgtat

SEQ ID NO: 994858 - DNA, 17 bp, Homo sapiens
acgattgacctgtcctc

SEQ ID NO: 994859 - DNA, 19 bp, Homo sapiens
acgatttctgtttagataa

SEQ ID NO: 994860 - DNA, 21 bp, Homo sapiens
acgatttgcaggattcccttc

SEQ ID NO: 994861 - DNA, 12 bp, Homo sapiens
acgatttgtctt

SEQ ID NO: 994862 - DNA, 21 bp, Homo sapiens
acgcaaagggctgaaagccat

SEQ ID NO: 994863 - DNA, 12 bp, Homo sapiens
acgcaaggaagg

SEQ ID NO: 994864 - DNA, 20 bp, Homo sapiens
acgcaagggcatcaggcact

SEQ ID NO: 994865 - DNA, 14 bp, Homo sapiens
acgcaagtgtgtga

SEQ ID NO: 994866 - DNA, 21 bp, Homo sapiens
acgcaataaatttatatactt

SEQ ID NO: 994867 - DNA, 12 bp, Homo sapiens
acgcacacacac

SEQ ID NO: 994868 - DNA, 19 bp, Homo sapiens
acgcacacacacacacagg

SEQ ID NO: 994869 - DNA, 17 bp, Homo sapiens
acgcacacatcttacct

SEQ ID NO: 994870 - DNA, 13 bp, Homo sapiens
acgcacagtgcag

SEQ ID NO: 994871 - DNA, 22 bp, Homo sapiens
acgcaccaccatgccaggctaa

SEQ ID NO: 994872 - DNA, 16 bp, Homo sapiens
acgcacctccacgcca

SEQ ID NO: 994873 - DNA, 15 bp, Homo sapiens
acgcacctgcctcag

SEQ ID NO: 994874 - DNA, 18 bp, Homo sapiens
acgcacctgtagtcccag

SEQ ID NO: 994875 - DNA, 21 bp, Homo sapiens
acgcacgctcgctgccatcac

SEQ ID NO: 994876 - DNA, 15 bp, Homo sapiens
acgcacttacaagtg

SEQ ID NO: 994877 - DNA, 15 bp, Homo sapiens
acgcagaactaccag

SEQ ID NO: 994878 - DNA, 19 bp, Homo sapiens
acgcagaagaaagggtgga

SEQ ID NO: 994879 - DNA, 16 bp, Homo sapiens
acgcagaggacgcacg

SEQ ID NO: 994880 - DNA, 18 bp, Homo sapiens
acgcagccgccgccgccc

SEQ ID NO: 994881 - DNA, 23 bp, Homo sapiens
acgcagccgccgccgcccacgcc

SEQ ID NO: 994882 - DNA, 18 bp, Homo sapiens
acgcagccggagggaggc

SEQ ID NO: 994883 - DNA, 18 bp, Homo sapiens
acgcagcctgctctggag

SEQ ID NO: 994884 - DNA, 14 bp, Homo sapiens
acgcaggccctgtc

SEQ ID NO: 994885 - DNA, 17 bp, Homo sapiens
acgcaggccctgtccag

SEQ ID NO: 994886 - DNA, 20 bp, Homo sapiens
acgcaggccctgtccagccc

SEQ ID NO: 994887 - DNA, 15 bp, Homo sapiens
acgcaggcggccagg

SEQ ID NO: 994888 - DNA, 17 bp, Homo sapiens
acgcaggcggggcagta

SEQ ID NO: 994889 - DNA, 19 bp, Homo sapiens
accttaatgacaacactta

SEQ ID NO: 994890 - DNA, 18 bp, Homo sapiens
accttaccaactttctgt

SEQ ID NO: 994891 - DNA, 12 bp, Homo sapiens
accttactcagg

SEQ ID NO: 994892 - DNA, 22 bp, Homo sapiens
accttagatgttctaagtcttt

SEQ ID NO: 994893 - DNA, 18 bp, Homo sapiens
accttagattagctctgg

SEQ ID NO: 994894 - DNA, 17 bp, Homo sapiens
accttagcgttctggac

SEQ ID NO: 994895 - DNA, 18 bp, Homo sapiens
accttagcgttctggact

SEQ ID NO: 994896 - DNA, 13 bp, Homo sapiens
accttagcttatt

SEQ ID NO: 994897 - DNA, 13 bp, Homo sapiens
accttaggccttc

SEQ ID NO: 994898 - DNA, 14 bp, Homo sapiens
accttaggccttcc

SEQ ID NO: 994899 - DNA, 15 bp, Homo sapiens
accttaggccttcct

SEQ ID NO: 994900 - DNA, 17 bp, Homo sapiens
accttaggccttcctct

SEQ ID NO: 994901 - DNA, 15 bp, Homo sapiens
accttaggctttgta

SEQ ID NO: 994902 - DNA, 21 bp, Homo sapiens
accttagggtggctttaattg

SEQ ID NO: 994903 - DNA, 22 bp, Homo sapiens
accttagggtggctttaattgt

SEQ ID NO: 994904 - DNA, 13 bp, Homo sapiens
accttagtgagtt

SEQ ID NO: 994905 - DNA, 12 bp, Homo sapiens
accttatagtta

SEQ ID NO: 994906 - DNA, 18 bp, Homo sapiens
accttatagttactgtgt

SEQ ID NO: 994907 - DNA, 23 bp, Homo sapiens
accttatagttactgtgtaatta

SEQ ID NO: 994908 - DNA, 18 bp, Homo sapiens
accttatatttctgtgta

SEQ ID NO: 994909 - DNA, 23 bp, Homo sapiens
accttatctggaagatctgcaaa

SEQ ID NO: 994910 - DNA, 13 bp, Homo sapiens
accttatctgtgc

SEQ ID NO: 994911 - DNA, 23 bp, Homo sapiens
accttatctgtgcgtgaaacaca

SEQ ID NO: 994912 - DNA, 16 bp, Homo sapiens
accttatgctacacag

SEQ ID NO: 994913 - DNA, 23 bp, Homo sapiens
accttatgctacacagacattaa

SEQ ID NO: 994914 - DNA, 14 bp, Homo sapiens
accttattgtacct

SEQ ID NO: 994915 - DNA, 17 bp, Homo sapiens
accttattgtacctctc

SEQ ID NO: 994916 - DNA, 20 bp, Homo sapiens
accttattgtacctctctta

SEQ ID NO: 994917 - DNA, 15 bp, Homo sapiens
accttcaaaatgttc

SEQ ID NO: 994918 - DNA, 13 bp, Homo sapiens
accttcaccacct

SEQ ID NO: 994919 - DNA, 22 bp, Homo sapiens
accttcacctccaggttcaagt

SEQ ID NO: 994920 - DNA, 18 bp, Homo sapiens
accttcacctcggaggga

SEQ ID NO: 994921 - DNA, 14 bp, Homo sapiens
accttcagaataag

SEQ ID NO: 994922 - DNA, 15 bp, Homo sapiens
accttcagccctggc

SEQ ID NO: 994923 - DNA, 17 bp, Homo sapiens
accttcagccctggcca

SEQ ID NO: 994924 - DNA, 22 bp, Homo sapiens
accttcatgattatagcaacta

SEQ ID NO: 994925 - DNA, 15 bp, Homo sapiens
accttcatttaaaaa

SEQ ID NO: 994926 - DNA, 15 bp, Homo sapiens
accttcatttcatgt

SEQ ID NO: 994927 - DNA, 16 bp, Homo sapiens
accttccaagactgaa

SEQ ID NO: 994928 - DNA, 17 bp, Homo sapiens
accttccagctcctgta

SEQ ID NO: 994929 - DNA, 18 bp, Homo sapiens
accttcccaccccttcat

SEQ ID NO: 994930 - DNA, 12 bp, Homo sapiens
accttcccagct

SEQ ID NO: 994931 - DNA, 17 bp, Homo sapiens
accttcccagctctccc

SEQ ID NO: 994932 - DNA, 17 bp, Homo sapiens
accttcccatgccctgg

SEQ ID NO: 994933 - DNA, 14 bp, Homo sapiens
accttccccagact

SEQ ID NO: 994934 - DNA, 20 bp, Homo sapiens
accttccccagactcagctc

SEQ ID NO: 994935 - DNA, 13 bp, Homo sapiens
accttccctccaa

SEQ ID NO: 994936 - DNA, 11 bp, Homo sapiens
accttccctcg

SEQ ID NO: 994937 - DNA, 16 bp, Homo sapiens
accttcctcacttcca

SEQ ID NO: 994938 - DNA, 17 bp, Homo sapiens
accttcctcacttccat

SEQ ID NO: 994939 - DNA, 17 bp, Homo sapiens
accttcctcctgcagac

SEQ ID NO: 994940 - DNA, 22 bp, Homo sapiens
accttccttccctgggctgtgc

SEQ ID NO: 994941 - DNA, 14 bp, Homo sapiens
accttccttcctgt

SEQ ID NO: 994942 - DNA, 15 bp, Homo sapiens
accttcgggctgtgc

SEQ ID NO: 994943 - DNA, 17 bp, Homo sapiens
accttcgggctgtgccc

SEQ ID NO: 994944 - DNA, 18 bp, Homo sapiens
accttctagtgagcctgg

SEQ ID NO: 994945 - DNA, 22 bp, Homo sapiens
accttctagtgagcctgggcca

SEQ ID NO: 994946 - DNA, 20 bp, Homo sapiens
accttctcccttcttgggtc

SEQ ID NO: 994947 - DNA, 17 bp, Homo sapiens
accttctgacagcccaa

SEQ ID NO: 994948 - DNA, 22 bp, Homo sapiens
accttctggcctcccacagact

SEQ ID NO: 994949 - DNA, 15 bp, Homo sapiens
accttctgtccccag

SEQ ID NO: 994950 - DNA, 21 bp, Homo sapiens
accttctgtccccagccctgt

SEQ ID NO: 994951 - DNA, 16 bp, Homo sapiens
accttctgtggctcac

SEQ ID NO: 994952 - DNA, 15 bp, Homo sapiens
accttctgtggctgt

SEQ ID NO: 994953 - DNA, 16 bp, Homo sapiens
accttcttggcttctg

SEQ ID NO: 994954 - DNA, 18 bp, Homo sapiens
accttcttggcttctggg

SEQ ID NO: 994955 - DNA, 19 bp, Homo sapiens
accttcttggcttctggga

SEQ ID NO: 994956 - DNA, 16 bp, Homo sapiens
accttgaaaaaaaaca

SEQ ID NO: 994957 - DNA, 11 bp, Homo sapiens
accttgaaggt

SEQ ID NO: 994958 - DNA, 17 bp, Homo sapiens
accttgaaggtctgtca

SEQ ID NO: 994959 - DNA, 18 bp, Homo sapiens
accttgaatgctgccagt

SEQ ID NO: 994960 - DNA, 13 bp, Homo sapiens
accttgacagagc

SEQ ID NO: 994961 - DNA, 17 bp, Homo sapiens
accttgacgtttcttct

SEQ ID NO: 994962 - DNA, 17 bp, Homo sapiens
accttgacttgattagt

SEQ ID NO: 994963 - DNA, 17 bp, Homo sapiens
accttgagggtgggcca

SEQ ID NO: 994964 - DNA, 11 bp, Homo sapiens
accttgaggtc

SEQ ID NO: 994965 - DNA, 12 bp, Homo sapiens
accttgccaggg

SEQ ID NO: 994966 - DNA, 18 bp, Homo sapiens
accttgccgagagaggcg

SEQ ID NO: 994967 - DNA, 21 bp, Homo sapiens
accttgcctgaacatccttcc

SEQ ID NO: 994968 - DNA, 20 bp, Homo sapiens
accttgctagctagccagcc

SEQ ID NO: 994969 - DNA, 18 bp, Homo sapiens
accttgctcttctttctg

SEQ ID NO: 994970 - DNA, 22 bp, Homo sapiens
accttgctgcaagcacagccct

SEQ ID NO: 994971 - DNA, 12 bp, Homo sapiens
accttgctgcca

SEQ ID NO: 994972 - DNA, 14 bp, Homo sapiens
accttgctgtcctg

SEQ ID NO: 994973 - DNA, 12 bp, Homo sapiens
accttgcttctt

SEQ ID NO: 994974 - DNA, 23 bp, Homo sapiens
accttggaccactcctgtccctg

SEQ ID NO: 994975 - DNA, 14 bp, Homo sapiens
accttggagaggag

SEQ ID NO: 994976 - DNA, 19 bp, Homo sapiens
accttggcatcctgtgctt

SEQ ID NO: 994977 - DNA, 13 bp, Homo sapiens
accttggcccagg

SEQ ID NO: 994978 - DNA, 18 bp, Homo sapiens
accttggcgctctcagct

SEQ ID NO: 994979 - DNA, 12 bp, Homo sapiens
accttgggacca

SEQ ID NO: 994980 - DNA, 16 bp, Homo sapiens
accttgggaccaaagg

SEQ ID NO: 994981 - DNA, 10 bp, Homo sapiens
accttgtaaa

SEQ ID NO: 994982 - DNA, 17 bp, Homo sapiens
accttgtaaaaaaagca

SEQ ID NO: 994983 - DNA, 16 bp, Homo sapiens
accttgtcatgtacca

SEQ ID NO: 994984 - DNA, 22 bp, Homo sapiens
accttgtcatgtaccatcaata

SEQ ID NO: 994985 - DNA, 17 bp, Homo sapiens
accttgttctatttttc

SEQ ID NO: 994986 - DNA, 14 bp, Homo sapiens
accttgttgtgttt

SEQ ID NO: 994987 - DNA, 15 bp, Homo sapiens
accttgttgtgtttc

SEQ ID NO: 994988 - DNA, 22 bp, Homo sapiens
accttgtttttaatctcctgtt

SEQ ID NO: 994989 - DNA, 20 bp, Homo sapiens
acctttaaagtaaaggcctc

SEQ ID NO: 994990 - DNA, 16 bp, Homo sapiens
acctttaatctgtttt

SEQ ID NO: 994991 - DNA, 14 bp, Homo sapiens
acctttacagttag

SEQ ID NO: 994992 - DNA, 17 bp, Homo sapiens
acctttagaacaggaga

SEQ ID NO: 994993 - DNA, 22 bp, Homo sapiens
acctttagaacaggagacttga

SEQ ID NO: 994994 - DNA, 15 bp, Homo sapiens
acctttagggcagct

SEQ ID NO: 994995 - DNA, 14 bp, Homo sapiens
acctttatctttca

SEQ ID NO: 994996 - DNA, 16 bp, Homo sapiens
acctttatctttcacc

SEQ ID NO: 994997 - DNA, 15 bp, Homo sapiens
acctttattaaaatc

SEQ ID NO: 994998 - DNA, 16 bp, Homo sapiens
acctttattaaaatct

SEQ ID NO: 994999 - DNA, 16 bp, Homo sapiens
acctttatttttctat

SEQ ID NO: 995000 - DNA, 19 bp, Homo sapiens
acctttatttttctatctg

SEQ ID NO: 995001 - DNA, 19 bp, Homo sapiens
acctttcaccctcatgaaa

SEQ ID NO: 995002 - DNA, 21 bp, Homo sapiens
acctttcacctttgtgtattt

SEQ ID NO: 995003 - DNA, 18 bp, Homo sapiens
acctttcataatttttaa

SEQ ID NO: 995004 - DNA, 11 bp, Homo sapiens
acctttcatac

SEQ ID NO: 995005 - DNA, 17 bp, Homo sapiens
acctttccctcaccccc

SEQ ID NO: 995006 - DNA, 18 bp, Homo sapiens
acctttccctcaccccct

SEQ ID NO: 995007 - DNA, 19 bp, Homo sapiens
acctttccctcaccccctc

SEQ ID NO: 995008 - DNA, 22 bp, Homo sapiens
acctttccctcaccccctccca

SEQ ID NO: 995009 - DNA, 14 bp, Homo sapiens
acctttcctctccc

SEQ ID NO: 995010 - DNA, 15 bp, Homo sapiens
acctttctagcctta

SEQ ID NO: 995011 - DNA, 14 bp, Homo sapiens
acctttctggcctg

SEQ ID NO: 995012 - DNA, 16 bp, Homo sapiens
acctttctggcctgtt

SEQ ID NO: 995013 - DNA, 13 bp, Homo sapiens
acctttctgggct

SEQ ID NO: 995014 - DNA, 21 bp, Homo sapiens
acctttgatgaattcttcctc

SEQ ID NO: 995015 - DNA, 17 bp, Homo sapiens
acgcagtgcctggagtt

SEQ ID NO: 995016 - DNA, 20 bp, Homo sapiens
acgcatctcaaaacagaggg

SEQ ID NO: 995017 - DNA, 23 bp, Homo sapiens
acgcatctcaaaacagagggctg

SEQ ID NO: 995018 - DNA, 21 bp, Homo sapiens
acgcatgcagtgttggggatg

SEQ ID NO: 995019 - DNA, 17 bp, Homo sapiens
acgccaaagtgcagccc

SEQ ID NO: 995020 - DNA, 14 bp, Homo sapiens
acgccaacagcccc

SEQ ID NO: 995021 - DNA, 19 bp, Homo sapiens
acgccaacttctcccaccc

SEQ ID NO: 995022 - DNA, 20 bp, Homo sapiens
acgccaataataaaaaacaa

SEQ ID NO: 995023 - DNA, 18 bp, Homo sapiens
acgccacccccgccccca

SEQ ID NO: 995024 - DNA, 20 bp, Homo sapiens
acgccaccctgcccaccccc

SEQ ID NO: 995025 - DNA, 15 bp, Homo sapiens
acgccactcatttca

SEQ ID NO: 995026 - DNA, 21 bp, Homo sapiens
acgccactcatttcatctcat

SEQ ID NO: 995027 - DNA, 16 bp, Homo sapiens
acgccactccctggga

SEQ ID NO: 995028 - DNA, 23 bp, Homo sapiens
acgccactgcactccagcctggg

SEQ ID NO: 995029 - DNA, 18 bp, Homo sapiens
acgccagataaaatgttc

SEQ ID NO: 995030 - DNA, 12 bp, Homo sapiens
acgccagctcct

SEQ ID NO: 995031 - DNA, 23 bp, Homo sapiens
acgccaggggaaaatcagcctgc

SEQ ID NO: 995032 - DNA, 16 bp, Homo sapiens
acgcccacccccagtc

SEQ ID NO: 995033 - DNA, 10 bp, Homo sapiens
acgcccacct

SEQ ID NO: 995034 - DNA, 12 bp, Homo sapiens
acgcccagctcc

SEQ ID NO: 995035 - DNA, 21 bp, Homo sapiens
acgcccagctccgcctgctgg

SEQ ID NO: 995036 - DNA, 22 bp, Homo sapiens
acgccccgctgtgtcctccctc

SEQ ID NO: 995037 - DNA, 12 bp, Homo sapiens
acgcccctgtgg

SEQ ID NO: 995038 - DNA, 15 bp, Homo sapiens
acgcccctgtggcca

SEQ ID NO: 995039 - DNA, 22 bp, Homo sapiens
acgcccctgtggccaactgcaa

SEQ ID NO: 995040 - DNA, 18 bp, Homo sapiens
acgcccgtcctgcctgtg

SEQ ID NO: 995041 - DNA, 17 bp, Homo sapiens
acgccctactccactgc

SEQ ID NO: 995042 - DNA, 24 bp, Homo sapiens
acgccctactccactgccctggca

SEQ ID NO: 995043 - DNA, 21 bp, Homo sapiens
acgccctctatcatggtgaaa

SEQ ID NO: 995044 - DNA, 21 bp, Homo sapiens
acgccctctccccacccctac

SEQ ID NO: 995045 - DNA, 23 bp, Homo sapiens
acgccctctccccacccctaccc

SEQ ID NO: 995046 - DNA, 22 bp, Homo sapiens
acgccctgcgttggagccactc

SEQ ID NO: 995047 - DNA, 21 bp, Homo sapiens
acgccctttcctcctcaggca

SEQ ID NO: 995048 - DNA, 20 bp, Homo sapiens
acgccgccctaaaagcacac

SEQ ID NO: 995049 - DNA, 14 bp, Homo sapiens
acgccgccctccat

SEQ ID NO: 995050 - DNA, 23 bp, Homo sapiens
acgccgccctccatccgtgctgc

SEQ ID NO: 995051 - DNA, 16 bp, Homo sapiens
acgccggcctctgctg

SEQ ID NO: 995052 - DNA, 21 bp, Homo sapiens
acgccgggagaagccaccttc

SEQ ID NO: 995053 - DNA, 19 bp, Homo sapiens
acgccgtcccaccagcttc

SEQ ID NO: 995054 - DNA, 16 bp, Homo sapiens
acgcctatgatcccag

SEQ ID NO: 995055 - DNA, 14 bp, Homo sapiens
acgcctcccactgg

SEQ ID NO: 995056 - DNA, 15 bp, Homo sapiens
acgcctcccactggg

SEQ ID NO: 995057 - DNA, 14 bp, Homo sapiens
acgcctcctggcca

SEQ ID NO: 995058 - DNA, 16 bp, Homo sapiens
acgcctcctggccaga

SEQ ID NO: 995059 - DNA, 19 bp, Homo sapiens
acgcctgagacagcaccac

SEQ ID NO: 995060 - DNA, 12 bp, Homo sapiens
acgcctgcaggc

SEQ ID NO: 995061 - DNA, 22 bp, Homo sapiens
acgcctgcaggctggagactgg

SEQ ID NO: 995062 - DNA, 19 bp, Homo sapiens
acgcctgccctccccagag

SEQ ID NO: 995063 - DNA, 16 bp, Homo sapiens
acgcctgccctgccca

SEQ ID NO: 995064 - DNA, 18 bp, Homo sapiens
acgcctgtaatcccagca

SEQ ID NO: 995065 - DNA, 21 bp, Homo sapiens
acgcctgtaatcccagcactt

SEQ ID NO: 995066 - DNA, 19 bp, Homo sapiens
acgcctgtaatcccagcag

SEQ ID NO: 995067 - DNA, 16 bp, Homo sapiens
acgcctgtagtcctag

SEQ ID NO: 995068 - DNA, 18 bp, Homo sapiens
acgcctgtcctcctggaa

SEQ ID NO: 995069 - DNA, 16 bp, Homo sapiens
acgccttccaggtcag

SEQ ID NO: 995070 - DNA, 17 bp, Homo sapiens
acgccttccaggtcagg

SEQ ID NO: 995071 - DNA, 13 bp, Homo sapiens
acgccttcctctc

SEQ ID NO: 995072 - DNA, 20 bp, Homo sapiens
acgccttttcttggttcttt

SEQ ID NO: 995073 - DNA, 13 bp, Homo sapiens
acgcggaggagga

SEQ ID NO: 995074 - DNA, 20 bp, Homo sapiens
acgcgtatgttcgttgcagc

SEQ ID NO: 995075 - DNA, 12 bp, Homo sapiens
acgcgtctcctg

SEQ ID NO: 995076 - DNA, 15 bp, Homo sapiens
acgcgtctgcctggg

SEQ ID NO: 995077 - DNA, 16 bp, Homo sapiens
acgcgtctgcctgggc

SEQ ID NO: 995078 - DNA, 13 bp, Homo sapiens
acgcgtcttcctg

SEQ ID NO: 995079 - DNA, 21 bp, Homo sapiens
acgcgtgtgtacacgggactg

SEQ ID NO: 995080 - DNA, 17 bp, Homo sapiens
acgctaaagagcccttg

SEQ ID NO: 995081 - DNA, 19 bp, Homo sapiens
acgctaacaatttctcata

SEQ ID NO: 995082 - DNA, 23 bp, Homo sapiens
acgctacggggaaaatgcatttt

SEQ ID NO: 995083 - DNA, 12 bp, Homo sapiens
acgctcagtgcc

SEQ ID NO: 995084 - DNA, 15 bp, Homo sapiens
acgctcagtgcccgt

SEQ ID NO: 995085 - DNA, 17 bp, Homo sapiens
acgctcagtgcccgttt

SEQ ID NO: 995086 - DNA, 17 bp, Homo sapiens
acgctcccctccatccc

SEQ ID NO: 995087 - DNA, 17 bp, Homo sapiens
acgctcccctgagaggt

SEQ ID NO: 995088 - DNA, 17 bp, Homo sapiens
acgctccctgacttctc

SEQ ID NO: 995089 - DNA, 22 bp, Homo sapiens
acgctccctgacttctcccccg

SEQ ID NO: 995090 - DNA, 12 bp, Homo sapiens
acgctcgctgcc

SEQ ID NO: 995091 - DNA, 14 bp, Homo sapiens
acgctcgctgccat

SEQ ID NO: 995092 - DNA, 15 bp, Homo sapiens
acgctcgctgccatc

SEQ ID NO: 995093 - DNA, 22 bp, Homo sapiens
acgctctaaggcaggatgtggc

SEQ ID NO: 995094 - DNA, 12 bp, Homo sapiens
acgctctggaca

SEQ ID NO: 995095 - DNA, 13 bp, Homo sapiens
acgctctggacat

SEQ ID NO: 995096 - DNA, 12 bp, Homo sapiens
acgctcttagct

SEQ ID NO: 995097 - DNA, 22 bp, Homo sapiens
acgctgaccatgcgtcaggggc

SEQ ID NO: 995098 - DNA, 19 bp, Homo sapiens
acgctgcctgccaaagtag

SEQ ID NO: 995099 - DNA, 20 bp, Homo sapiens
acgctgcctgccaaagtagt

SEQ ID NO: 995100 - DNA, 14 bp, Homo sapiens
acgctgcctggtct

SEQ ID NO: 995101 - DNA, 22 bp, Homo sapiens
acgctgcctggtctgtctggat

SEQ ID NO: 995102 - DNA, 14 bp, Homo sapiens
acgctgctgtcaca

SEQ ID NO: 995103 - DNA, 19 bp, Homo sapiens
acgctgctgtcacaaccaa

SEQ ID NO: 995104 - DNA, 22 bp, Homo sapiens
acgctgtctccagacccccacc

SEQ ID NO: 995105 - DNA, 19 bp, Homo sapiens
acgctgtgatgctgtgtgc

SEQ ID NO: 995106 - DNA, 23 bp, Homo sapiens
acgctgtgatgctgtgtgcccaa

SEQ ID NO: 995107 - DNA, 13 bp, Homo sapiens
acgcttctccgga

SEQ ID NO: 995108 - DNA, 18 bp, Homo sapiens
acgcttctgaatgctgct

SEQ ID NO: 995109 - DNA, 22 bp, Homo sapiens
acgcttctgaatgctgctactt

SEQ ID NO: 995110 - DNA, 20 bp, Homo sapiens
acgcttgcgtatgtctgtta

SEQ ID NO: 995111 - DNA, 20 bp, Homo sapiens
acgcttgtagaactcactct

SEQ ID NO: 995112 - DNA, 15 bp, Homo sapiens
acgcttgtgacagtg

SEQ ID NO: 995113 - DNA, 17 bp, Homo sapiens
acgcttgtgacagtgcc

SEQ ID NO: 995114 - DNA, 13 bp, Homo sapiens
acgctttcatgac

SEQ ID NO: 995115 - DNA, 12 bp, Homo sapiens
acgctttgattc

SEQ ID NO: 995116 - DNA, 22 bp, Homo sapiens
acgcttttaatgaaaaggaatc

SEQ ID NO: 995117 - DNA, 16 bp, Homo sapiens
acgcttttaattctca

SEQ ID NO: 995118 - DNA, 12 bp, Homo sapiens
acggaaacagaa

SEQ ID NO: 995119 - DNA, 14 bp, Homo sapiens
acggaaacagaact

SEQ ID NO: 995120 - DNA, 15 bp, Homo sapiens
acggaagagccttgc

SEQ ID NO: 995121 - DNA, 16 bp, Homo sapiens
acggaagagccttgcg

SEQ ID NO: 995122 - DNA, 13 bp, Homo sapiens
acggaagttttca

SEQ ID NO: 995123 - DNA, 15 bp, Homo sapiens
acggacaccccctcg

SEQ ID NO: 995124 - DNA, 17 bp, Homo sapiens
acggactcccgggccac

SEQ ID NO: 995125 - DNA, 21 bp, Homo sapiens
acggactcccgggccacgccc

SEQ ID NO: 995126 - DNA, 24 bp, Homo sapiens
acggactcccgggccacgccccag

SEQ ID NO: 995127 - DNA, 23 bp, Homo sapiens
acggagaaactcatcatttttat

SEQ ID NO: 995128 - DNA, 15 bp, Homo sapiens
acggagcccagccct

SEQ ID NO: 995129 - DNA, 21 bp, Homo sapiens
acggagtctcactctgtcacc

SEQ ID NO: 995130 - DNA, 17 bp, Homo sapiens
acggagtggggggacag

SEQ ID NO: 995131 - DNA, 21 bp, Homo sapiens
acggatccatgtagcaggact

SEQ ID NO: 995132 - DNA, 15 bp, Homo sapiens
acggatctgagaatc

SEQ ID NO: 995133 - DNA, 19 bp, Homo sapiens
acggatggtgcatgggctc

SEQ ID NO: 995134 - DNA, 12 bp, Homo sapiens
acggattccaaa

SEQ ID NO: 995135 - DNA, 13 bp, Homo sapiens
acggatttattat

SEQ ID NO: 995136 - DNA, 21 bp, Homo sapiens
acggatttattatataaatat

SEQ ID NO: 995137 - DNA, 19 bp, Homo sapiens
acggcaaccacatgtccca

SEQ ID NO: 995138 - DNA, 18 bp, Homo sapiens
acggcaacgtagcctggg

SEQ ID NO: 995139 - DNA, 14 bp, Homo sapiens
acgtgatgtgccac

SEQ ID NO: 995140 - DNA, 16 bp, Homo sapiens
acgtgatgtgccacta

SEQ ID NO: 995141 - DNA, 13 bp, Homo sapiens
acgtgattctaag

SEQ ID NO: 995142 - DNA, 20 bp, Homo sapiens
acgtgattgattcagtatct

SEQ ID NO: 995143 - DNA, 19 bp, Homo sapiens
acgtgattttgctgtagaa

SEQ ID NO: 995144 - DNA, 15 bp, Homo sapiens
acgtgcaaacaacct

SEQ ID NO: 995145 - DNA, 21 bp, Homo sapiens
acgtgcaaacaacctgaatct

SEQ ID NO: 995146 - DNA, 13 bp, Homo sapiens
acgtgcactgtga

SEQ ID NO: 995147 - DNA, 20 bp, Homo sapiens
acgtgcatgctgtagctgca

SEQ ID NO: 995148 - DNA, 22 bp, Homo sapiens
acgtgcatttaaactctgccag

SEQ ID NO: 995149 - DNA, 20 bp, Homo sapiens
acgtgcctgtagtcccagct

SEQ ID NO: 995150 - DNA, 15 bp, Homo sapiens
acgtgccttttgcac

SEQ ID NO: 995151 - DNA, 21 bp, Homo sapiens
acgtgccttttgcacccctcc

SEQ ID NO: 995152 - DNA, 16 bp, Homo sapiens
acgtgcgacagagaga

SEQ ID NO: 995153 - DNA, 14 bp, Homo sapiens
acgtgctggccttg

SEQ ID NO: 995154 - DNA, 15 bp, Homo sapiens
acgtgctggccttgg

SEQ ID NO: 995155 - DNA, 23 bp, Homo sapiens
acgtgctggccttggtatgtgcc

SEQ ID NO: 995156 - DNA, 14 bp, Homo sapiens
acgtggaacctctg

SEQ ID NO: 995157 - DNA, 16 bp, Homo sapiens
acgtggaacctctgtc

SEQ ID NO: 995158 - DNA, 18 bp, Homo sapiens
acgtggagagctggtgcc

SEQ ID NO: 995159 - DNA, 16 bp, Homo sapiens
acgtggagatagtgcc

SEQ ID NO: 995160 - DNA, 22 bp, Homo sapiens
acgtggatgggcaaagcttgtc

SEQ ID NO: 995161 - DNA, 20 bp, Homo sapiens
acgtggattttaaaaaatca

SEQ ID NO: 995162 - DNA, 21 bp, Homo sapiens
acgtggattttaaaaaatcaa

SEQ ID NO: 995163 - DNA, 18 bp, Homo sapiens
acgtggcctccgcagtgt

SEQ ID NO: 995164 - DNA, 23 bp, Homo sapiens
acgtggcctctctctctctcctc

SEQ ID NO: 995165 - DNA, 17 bp, Homo sapiens
acgtggctcagccagca

SEQ ID NO: 995166 - DNA, 19 bp, Homo sapiens
acgtggctcagccagcact

SEQ ID NO: 995167 - DNA, 13 bp, Homo sapiens
acgtgggaggctg

SEQ ID NO: 995168 - DNA, 19 bp, Homo sapiens
acgtgggcaaacaggcagt

SEQ ID NO: 995169 - DNA, 17 bp, Homo sapiens
acgtgggcatcatttta

SEQ ID NO: 995170 - DNA, 17 bp, Homo sapiens
acgtgggccctgcaggc

SEQ ID NO: 995171 - DNA, 16 bp, Homo sapiens
acgtgggctcccctct

SEQ ID NO: 995172 - DNA, 21 bp, Homo sapiens
acgtgggcttaaagcagaagc

SEQ ID NO: 995173 - DNA, 14 bp, Homo sapiens
acgtggggcccact

SEQ ID NO: 995174 - DNA, 16 bp, Homo sapiens
acgtgtacagcacaga

SEQ ID NO: 995175 - DNA, 17 bp, Homo sapiens
acgtgtatagtatctgt

SEQ ID NO: 995176 - DNA, 18 bp, Homo sapiens
acgtgtatagtatctgta

SEQ ID NO: 995177 - DNA, 20 bp, Homo sapiens
acgtgtgcgcacgcgcagcg

SEQ ID NO: 995178 - DNA, 23 bp, Homo sapiens
acgtgtgggccgtggcttgggct

SEQ ID NO: 995179 - DNA, 16 bp, Homo sapiens
acgtgtgtccaggctc

SEQ ID NO: 995180 - DNA, 11 bp, Homo sapiens
acgtgtgtgac

SEQ ID NO: 995181 - DNA, 20 bp, Homo sapiens
acgtgttaggaggctgcatg

SEQ ID NO: 995182 - DNA, 23 bp, Homo sapiens
acgtgttaggaggctgcatgctc

SEQ ID NO: 995183 - DNA, 22 bp, Homo sapiens
acgtgttttattcctgtatgtt

SEQ ID NO: 995184 - DNA, 13 bp, Homo sapiens
acgttaaagtagg

SEQ ID NO: 995185 - DNA, 23 bp, Homo sapiens
acgttactcagggctcctcccag

SEQ ID NO: 995186 - DNA, 13 bp, Homo sapiens
acgttcagggagg

SEQ ID NO: 995187 - DNA, 17 bp, Homo sapiens
acgttcatcacctgcta

SEQ ID NO: 995188 - DNA, 19 bp, Homo sapiens
acgttcctggccccctcat

SEQ ID NO: 995189 - DNA, 17 bp, Homo sapiens
acgttctcacacccacc

SEQ ID NO: 995190 - DNA, 19 bp, Homo sapiens
acgttcttacaagcttaaa

SEQ ID NO: 995191 - DNA, 13 bp, Homo sapiens
acgttgccacacc

SEQ ID NO: 995192 - DNA, 19 bp, Homo sapiens
acgttggacttttcgttaa

SEQ ID NO: 995193 - DNA, 14 bp, Homo sapiens
acgttgtgcatttg

SEQ ID NO: 995194 - DNA, 15 bp, Homo sapiens
acgttgtgcatttgg

SEQ ID NO: 995195 - DNA, 15 bp, Homo sapiens
acgttgttgtcattg

SEQ ID NO: 995196 - DNA, 20 bp, Homo sapiens
acgttgttgtcattgtccag

SEQ ID NO: 995197 - DNA, 18 bp, Homo sapiens
acgtttacaagccccccc

SEQ ID NO: 995198 - DNA, 15 bp, Homo sapiens
acgtttctaaaggct

SEQ ID NO: 995199 - DNA, 22 bp, Homo sapiens
acgtttctaaaggctacctttg

SEQ ID NO: 995200 - DNA, 10 bp, Homo sapiens
acgtttctca

SEQ ID NO: 995201 - DNA, 12 bp, Homo sapiens
acgtttctcatt

SEQ ID NO: 995202 - DNA, 17 bp, Homo sapiens
acgtttctcattaaaat

SEQ ID NO: 995203 - DNA, 14 bp, Homo sapiens
acgtttctgtggag

SEQ ID NO: 995204 - DNA, 13 bp, Homo sapiens
acgtttcttcccc

SEQ ID NO: 995205 - DNA, 17 bp, Homo sapiens
acgtttcttctttctag

SEQ ID NO: 995206 - DNA, 14 bp, Homo sapiens
acgtttgcaccgcc

SEQ ID NO: 995207 - DNA, 16 bp, Homo sapiens
acgttttcttctttcc

SEQ ID NO: 995208 - DNA, 18 bp, Homo sapiens
actaattcataatcactc

SEQ ID NO: 995209 - DNA, 15 bp, Homo sapiens
actaattccacacct

SEQ ID NO: 995210 - DNA, 16 bp, Homo sapiens
actaattctatttctc

SEQ ID NO: 995211 - DNA, 14 bp, Homo sapiens
actaatttcaaaat

SEQ ID NO: 995212 - DNA, 12 bp, Homo sapiens
actaatttcata

SEQ ID NO: 995213 - DNA, 17 bp, Homo sapiens
actaatttgatgtttac

SEQ ID NO: 995214 - DNA, 16 bp, Homo sapiens
actaattttgttgaaa

SEQ ID NO: 995215 - DNA, 15 bp, Homo sapiens
actaatttttatttt

SEQ ID NO: 995216 - DNA, 19 bp, Homo sapiens
actacaaacaaaagcagcc

SEQ ID NO: 995217 - DNA, 19 bp, Homo sapiens
actacaaatcaagtatttg

SEQ ID NO: 995218 - DNA, 14 bp, Homo sapiens
actacaacttttgt

SEQ ID NO: 995219 - DNA, 19 bp, Homo sapiens
actacaacttttgttttct

SEQ ID NO: 995220 - DNA, 20 bp, Homo sapiens
actacacagcacaccagccg

SEQ ID NO: 995221 - DNA, 23 bp, Homo sapiens
actacacatccctaatgtgtgcc

SEQ ID NO: 995222 - DNA, 23 bp, Homo sapiens
actacaccatgtttgagctcaga

SEQ ID NO: 995223 - DNA, 16 bp, Homo sapiens
actacactgaggagag

SEQ ID NO: 995224 - DNA, 20 bp, Homo sapiens
actacagaataatgtgttaa

SEQ ID NO: 995225 - DNA, 12 bp, Homo sapiens
actacagatcag

SEQ ID NO: 995226 - DNA, 14 bp, Homo sapiens
actacagtttgtta

SEQ ID NO: 995227 - DNA, 14 bp, Homo sapiens
actacataaaaata

SEQ ID NO: 995228 - DNA, 23 bp, Homo sapiens
actacataaactgactttatcct

SEQ ID NO: 995229 - DNA, 13 bp, Homo sapiens
actacatctgcct

SEQ ID NO: 995230 - DNA, 20 bp, Homo sapiens
actacatgagaacaaacaga

SEQ ID NO: 995231 - DNA, 18 bp, Homo sapiens
actacatgtggtttatag

SEQ ID NO: 995232 - DNA, 13 bp, Homo sapiens
actacattcattt

SEQ ID NO: 995233 - DNA, 14 bp, Homo sapiens
actacattctgtta

SEQ ID NO: 995234 - DNA, 23 bp, Homo sapiens
actaccaaacactcagtccactg

SEQ ID NO: 995235 - DNA, 21 bp, Homo sapiens
actaccaagaggccctgtctg

SEQ ID NO: 995236 - DNA, 14 bp, Homo sapiens
actaccacaaggaa

SEQ ID NO: 995237 - DNA, 15 bp, Homo sapiens
actaccacaaggaaa

SEQ ID NO: 995238 - DNA, 19 bp, Homo sapiens
actaccatctgatgtttca

SEQ ID NO: 995239 - DNA, 21 bp, Homo sapiens
actacccacgttctcacaccc

SEQ ID NO: 995240 - DNA, 19 bp, Homo sapiens
actacccatgtctttctgg

SEQ ID NO: 995241 - DNA, 21 bp, Homo sapiens
actacccgagcccagctacat

SEQ ID NO: 995242 - DNA, 17 bp, Homo sapiens
actaccgaatgtgtctt

SEQ ID NO: 995243 - DNA, 14 bp, Homo sapiens
actaccgcaggccc

SEQ ID NO: 995244 - DNA, 21 bp, Homo sapiens
actacctacgtttgcaccgcc

SEQ ID NO: 995245 - DNA, 16 bp, Homo sapiens
actacctataggaaag

SEQ ID NO: 995246 - DNA, 18 bp, Homo sapiens
actaccttggttccccca

SEQ ID NO: 995247 - DNA, 14 bp, Homo sapiens
actacgtgccagct

SEQ ID NO: 995248 - DNA, 18 bp, Homo sapiens
actactaacaaatgtaaa

SEQ ID NO: 995249 - DNA, 20 bp, Homo sapiens
actactaacaaatgtaaaat

SEQ ID NO: 995250 - DNA, 14 bp, Homo sapiens
actactaaggaaaa

SEQ ID NO: 995251 - DNA, 17 bp, Homo sapiens
actactaaggaaaataa

SEQ ID NO: 995252 - DNA, 21 bp, Homo sapiens
actactcatacttaagcaaaa

SEQ ID NO: 995253 - DNA, 17 bp, Homo sapiens
actactcccccaggtgg

SEQ ID NO: 995254 - DNA, 19 bp, Homo sapiens
actactcctctgcagtgcc

SEQ ID NO: 995255 - DNA, 13 bp, Homo sapiens
actactctgtgcc

SEQ ID NO: 995256 - DNA, 14 bp, Homo sapiens
actactctttgatt

SEQ ID NO: 995257 - DNA, 21 bp, Homo sapiens
actactgaataatgctaccag

SEQ ID NO: 995258 - DNA, 18 bp, Homo sapiens
actactgacatgtggggc

SEQ ID NO: 995259 - DNA, 22 bp, Homo sapiens
actactgacggagtcctgtgtt

SEQ ID NO: 995260 - DNA, 18 bp, Homo sapiens
actactgagggaaatagc

SEQ ID NO: 995261 - DNA, 22 bp, Homo sapiens
actactgattttaaaatgaata

SEQ ID NO: 995262 - DNA, 12 bp, Homo sapiens
actactgcagca

SEQ ID NO: 995263 - DNA, 15 bp, Homo sapiens
actactgcagcacct

SEQ ID NO: 995264 - DNA, 22 bp, Homo sapiens
actactgcctttagaaaatata

SEQ ID NO: 995265 - DNA, 14 bp, Homo sapiens
actactgctaatgt

SEQ ID NO: 995266 - DNA, 20 bp, Homo sapiens
actactgctaccacaactat

SEQ ID NO: 995267 - DNA, 13 bp, Homo sapiens
actactgggtgtc

SEQ ID NO: 995268 - DNA, 17 bp, Homo sapiens
actactgggtgtcattt

SEQ ID NO: 995269 - DNA, 18 bp, Homo sapiens
actactgggtgtcatttc

SEQ ID NO: 995270 - DNA, 19 bp, Homo sapiens
actactgggtgtcatttca

SEQ ID NO: 995271 - DNA, 20 bp, Homo sapiens
actactgggtgtcatttcat

SEQ ID NO: 995272 - DNA, 13 bp, Homo sapiens
actactttactaa

SEQ ID NO: 995273 - DNA, 15 bp, Homo sapiens
actacttttctaaaa

SEQ ID NO: 995274 - DNA, 13 bp, Homo sapiens
actagaactctcc

SEQ ID NO: 995275 - DNA, 15 bp, Homo sapiens
actagaactctccat

SEQ ID NO: 995276 - DNA, 13 bp, Homo sapiens
actagaagaaaag

SEQ ID NO: 995277 - DNA, 23 bp, Homo sapiens
actagaagggccagtcctgcctg

SEQ ID NO: 995278 - DNA, 20 bp, Homo sapiens
actagaattagtatgtctgt

SEQ ID NO: 995279 - DNA, 19 bp, Homo sapiens
actagaattctagtgctgc

SEQ ID NO: 995280 - DNA, 21 bp, Homo sapiens
actagaattctagtgctgctg

SEQ ID NO: 995281 - DNA, 23 bp, Homo sapiens
actatgtctgaacatagaaactc

SEQ ID NO: 995282 - DNA, 18 bp, Homo sapiens
actatgtgccagttcctg

SEQ ID NO: 995283 - DNA, 20 bp, Homo sapiens
actatgtgctatcacatgtg

SEQ ID NO: 995284 - DNA, 14 bp, Homo sapiens
actatgtgtttttc

SEQ ID NO: 995285 - DNA, 17 bp, Homo sapiens
actatgttcctaacaaa

SEQ ID NO: 995286 - DNA, 18 bp, Homo sapiens
actattaaaatattttgg

SEQ ID NO: 995287 - DNA, 22 bp, Homo sapiens
actattaagcagtaaaaactgt

SEQ ID NO: 995288 - DNA, 16 bp, Homo sapiens
actattagagtatttc

SEQ ID NO: 995289 - DNA, 12 bp, Homo sapiens
actattattgtt

SEQ ID NO: 995290 - DNA, 14 bp, Homo sapiens
actattccctttga

SEQ ID NO: 995291 - DNA, 20 bp, Homo sapiens
actattccctttgacttcag

SEQ ID NO: 995292 - DNA, 23 bp, Homo sapiens
actattccctttgacttcagctg

SEQ ID NO: 995293 - DNA, 23 bp, Homo sapiens
actattctgggggcccgacaggt

SEQ ID NO: 995294 - DNA, 17 bp, Homo sapiens
actattcttaagcactt

SEQ ID NO: 995295 - DNA, 14 bp, Homo sapiens
actattgaactgta

SEQ ID NO: 995296 - DNA, 16 bp, Homo sapiens
actattggaaagtact

SEQ ID NO: 995297 - DNA, 19 bp, Homo sapiens
actattggagggtgggaga

SEQ ID NO: 995298 - DNA, 14 bp, Homo sapiens
actattgttacatt

SEQ ID NO: 995299 - DNA, 11 bp, Homo sapiens
actatttaaaa

SEQ ID NO: 995300 - DNA, 13 bp, Homo sapiens
actatttaaaata

SEQ ID NO: 995301 - DNA, 14 bp, Homo sapiens
actatttaaaataa

SEQ ID NO: 995302 - DNA, 18 bp, Homo sapiens
actatttaaaataaagag

SEQ ID NO: 995303 - DNA, 20 bp, Homo sapiens
actatttaaagcctcctcat

SEQ ID NO: 995304 - DNA, 22 bp, Homo sapiens
actatttaagtaaatacagtag

SEQ ID NO: 995305 - DNA, 20 bp, Homo sapiens
actatttagtttttgtaatt

SEQ ID NO: 995306 - DNA, 21 bp, Homo sapiens
actatttagtttttgtaattt

SEQ ID NO: 995307 - DNA, 15 bp, Homo sapiens
actatttatctgtgt

SEQ ID NO: 995308 - DNA, 20 bp, Homo sapiens
actatttattgtgctgggtc

SEQ ID NO: 995309 - DNA, 23 bp, Homo sapiens
actatttattgtgctgggtccca

SEQ ID NO: 995310 - DNA, 17 bp, Homo sapiens
actatttatttacaaat

SEQ ID NO: 995311 - DNA, 18 bp, Homo sapiens
actatttatttacaaatg

SEQ ID NO: 995312 - DNA, 13 bp, Homo sapiens
actatttcaaaat

SEQ ID NO: 995313 - DNA, 17 bp, Homo sapiens
actatttccaaaagcac

SEQ ID NO: 995314 - DNA, 22 bp, Homo sapiens
actatttcccttgaaattttaa

SEQ ID NO: 995315 - DNA, 16 bp, Homo sapiens
actatttcctttataa

SEQ ID NO: 995316 - DNA, 22 bp, Homo sapiens
actatttctgggtcttttgcta

SEQ ID NO: 995317 - DNA, 23 bp, Homo sapiens
actatttctgggtcttttgctac

SEQ ID NO: 995318 - DNA, 16 bp, Homo sapiens
actatttctgttccag

SEQ ID NO: 995319 - DNA, 18 bp, Homo sapiens
actatttgtctttcagga

SEQ ID NO: 995320 - DNA, 13 bp, Homo sapiens
actattttatatg

SEQ ID NO: 995321 - DNA, 20 bp, Homo sapiens
actattttatatttaaaaat

SEQ ID NO: 995322 - DNA, 16 bp, Homo sapiens
actattttcaaagaaa

SEQ ID NO: 995323 - DNA, 14 bp, Homo sapiens
actattttctacaa

SEQ ID NO: 995324 - DNA, 14 bp, Homo sapiens
actatttttctatg

SEQ ID NO: 995325 - DNA, 17 bp, Homo sapiens
actatttttgtgtttga

SEQ ID NO: 995326 - DNA, 17 bp, Homo sapiens
actatttttttcttaaa

SEQ ID NO: 995327 - DNA, 15 bp, Homo sapiens
actcaaaaaaacaaa

SEQ ID NO: 995328 - DNA, 20 bp, Homo sapiens
actcaaaaaaacaaaaaaga

SEQ ID NO: 995329 - DNA, 18 bp, Homo sapiens
actcaaaagctgggcagg

SEQ ID NO: 995330 - DNA, 21 bp, Homo sapiens
actcaaaatatgtcaacttaa

SEQ ID NO: 995331 - DNA, 15 bp, Homo sapiens
actcaaaatatttgt

SEQ ID NO: 995332 - DNA, 23 bp, Homo sapiens
actcaaacctggagctgaggaat

SEQ ID NO: 995333 - DNA, 14 bp, Homo sapiens
actcaaagcccaga

SEQ ID NO: 995334 - DNA, 14 bp, Homo sapiens
actcaaatgagtaa

SEQ ID NO: 995335 - DNA, 18 bp, Homo sapiens
actcaaatgctcagacca

SEQ ID NO: 995336 - DNA, 21 bp, Homo sapiens
actcaaatgctcagaccagct

SEQ ID NO: 995337 - DNA, 18 bp, Homo sapiens
actcaaatggtgtcatgg

SEQ ID NO: 995338 - DNA, 21 bp, Homo sapiens
actcaaatggtgtcatggctg

SEQ ID NO: 995339 - DNA, 20 bp, Homo sapiens
actcaaatgtgagtgttttt

SEQ ID NO: 995340 - DNA, 23 bp, Homo sapiens
actcaaattttggcgaatctcaa

SEQ ID NO: 995341 - DNA, 15 bp, Homo sapiens
actcaagaagcacac

SEQ ID NO: 995342 - DNA, 23 bp, Homo sapiens
actcaagaagtgaagaatgcaca

SEQ ID NO: 995343 - DNA, 15 bp, Homo sapiens
actcaagaggaatct

SEQ ID NO: 995344 - DNA, 19 bp, Homo sapiens
actcaagaggaatctgttt

SEQ ID NO: 995345 - DNA, 14 bp, Homo sapiens
actcaagaggctga

SEQ ID NO: 995346 - DNA, 20 bp, Homo sapiens
actcaagagttcagtgctca

SEQ ID NO: 995347 - DNA, 18 bp, Homo sapiens
actcaagcgggtggctct

SEQ ID NO: 995348 - DNA, 14 bp, Homo sapiens
actcaagtgtagaa

SEQ ID NO: 995349 - DNA, 15 bp, Homo sapiens
actcaagtgtagaag

SEQ ID NO: 995350 - DNA, 18 bp, Homo sapiens
actcaagttgattagaaa

SEQ ID NO: 995351 - DNA, 18 bp, Homo sapiens
actcaataaattgcaaca

SEQ ID NO: 995352 - DNA, 22 bp, Homo sapiens
actcaataaattgcaacatatt

SEQ ID NO: 995353 - DNA, 23 bp, Homo sapiens
actcaataaattgcaacatatta

SEQ ID NO: 995354 - DNA, 14 bp, Homo sapiens
actcaatctccagg

SEQ ID NO: 995355 - DNA, 23 bp, Homo sapiens
actcaatctccccttgcactaaa

SEQ ID NO: 995356 - DNA, 14 bp, Homo sapiens
actcaatgagctct

SEQ ID NO: 995357 - DNA, 15 bp, Homo sapiens
actcaatgctttatt

SEQ ID NO: 995358 - DNA, 17 bp, Homo sapiens
actcaatgctttatttg

SEQ ID NO: 995359 - DNA, 21 bp, Homo sapiens
actcaatgctttatttgtaaa

SEQ ID NO: 995360 - DNA, 14 bp, Homo sapiens
actcaattgatcct

SEQ ID NO: 995361 - DNA, 21 bp, Homo sapiens
actcacaacctgaacctagga

SEQ ID NO: 995362 - DNA, 21 bp, Homo sapiens
actcacaagaagaccagactg

SEQ ID NO: 995363 - DNA, 22 bp, Homo sapiens
actcacaagcaatccatgatct

SEQ ID NO: 995364 - DNA, 22 bp, Homo sapiens
actcacactctctgcagcccag

SEQ ID NO: 995365 - DNA, 18 bp, Homo sapiens
actcacagacctggagcc

SEQ ID NO: 995366 - DNA, 22 bp, Homo sapiens
actcacagccgcattggtgact

SEQ ID NO: 995367 - DNA, 13 bp, Homo sapiens
actcacagcttct

SEQ ID NO: 995368 - DNA, 15 bp, Homo sapiens
actcacagcttctcc

SEQ ID NO: 995369 - DNA, 15 bp, Homo sapiens
actcacaggaaggag

SEQ ID NO: 995370 - DNA, 15 bp, Homo sapiens
actcacattttgtta

SEQ ID NO: 995371 - DNA, 18 bp, Homo sapiens
actcaccaacttgccaca

SEQ ID NO: 995372 - DNA, 17 bp, Homo sapiens
actcaccacaagctgag

SEQ ID NO: 995373 - DNA, 20 bp, Homo sapiens
actcaccacaagctgagcag

SEQ ID NO: 995374 - DNA, 19 bp, Homo sapiens
actcaccactaccagccag

SEQ ID NO: 995375 - DNA, 23 bp, Homo sapiens
actcaccagggtccgcaccagct

SEQ ID NO: 995376 - DNA, 17 bp, Homo sapiens
actcaccagtgtcccct

SEQ ID NO: 995377 - DNA, 18 bp, Homo sapiens
actcaccatgaagcgaaa

SEQ ID NO: 995378 - DNA, 21 bp, Homo sapiens
actcacccatgtgccaaggtg

SEQ ID NO: 995379 - DNA, 18 bp, Homo sapiens
actcaccccagcctcatt

SEQ ID NO: 995380 - DNA, 20 bp, Homo sapiens
actcaccccagcctcattgt

SEQ ID NO: 995381 - DNA, 16 bp, Homo sapiens
actcacccctcagcaa

SEQ ID NO: 995382 - DNA, 15 bp, Homo sapiens
actcaccctgggagc

SEQ ID NO: 995383 - DNA, 17 bp, Homo sapiens
actcacccttcctggcc

SEQ ID NO: 995384 - DNA, 23 bp, Homo sapiens
actcacccttcctggcccaggcc

SEQ ID NO: 995385 - DNA, 16 bp, Homo sapiens
actcacctaatgttta

SEQ ID NO: 995386 - DNA, 17 bp, Homo sapiens
actcacctaatgtttat

SEQ ID NO: 995387 - DNA, 19 bp, Homo sapiens
actcacctcccccatctct

SEQ ID NO: 995388 - DNA, 11 bp, Homo sapiens
actcacctctg

SEQ ID NO: 995389 - DNA, 13 bp, Homo sapiens
actcacctctgcc

SEQ ID NO: 995390 - DNA, 14 bp, Homo sapiens
actcacctctgcct

SEQ ID NO: 995391 - DNA, 22 bp, Homo sapiens
actcacctgcactaacagagtg

SEQ ID NO: 995392 - DNA, 13 bp, Homo sapiens
actcacctgctgg

SEQ ID NO: 995393 - DNA, 16 bp, Homo sapiens
actcacctgctggccc

SEQ ID NO: 995394 - DNA, 15 bp, Homo sapiens
actccacatctgcct

SEQ ID NO: 995395 - DNA, 17 bp, Homo sapiens
actccacatctgcctta

SEQ ID NO: 995396 - DNA, 13 bp, Homo sapiens
actccaccaccca

SEQ ID NO: 995397 - DNA, 17 bp, Homo sapiens
actccacccccagagga

SEQ ID NO: 995398 - DNA, 16 bp, Homo sapiens
actccaccctccacct

SEQ ID NO: 995399 - DNA, 14 bp, Homo sapiens
actccaccgaccaa

SEQ ID NO: 995400 - DNA, 18 bp, Homo sapiens
actccaccgaccaactgc

SEQ ID NO: 995401 - DNA, 21 bp, Homo sapiens
actccaccgaccaactgccct

SEQ ID NO: 995402 - DNA, 16 bp, Homo sapiens
actccactctccttcg

SEQ ID NO: 995403 - DNA, 23 bp, Homo sapiens
actccactctccttcgtgtctct

SEQ ID NO: 995404 - DNA, 15 bp, Homo sapiens
actccactctgattc

SEQ ID NO: 995405 - DNA, 22 bp, Homo sapiens
actccactctgattcacctctt

SEQ ID NO: 995406 - DNA, 17 bp, Homo sapiens
actccactgccctggca

SEQ ID NO: 995407 - DNA, 22 bp, Homo sapiens
actccactgccctggcagcagc

SEQ ID NO: 995408 - DNA, 22 bp, Homo sapiens
actccagaatctgctgttgcca

SEQ ID NO: 995409 - DNA, 12 bp, Homo sapiens
actccagagaca

SEQ ID NO: 995410 - DNA, 17 bp, Homo sapiens
actccagagtctgagcc

SEQ ID NO: 995411 - DNA, 14 bp, Homo sapiens
actccagatagaga

SEQ ID NO: 995412 - DNA, 20 bp, Homo sapiens
actccagcaacttcttctcc

SEQ ID NO: 995413 - DNA, 13 bp, Homo sapiens
actccagccagcg

SEQ ID NO: 995414 - DNA, 15 bp, Homo sapiens
actccagccagcgcc

SEQ ID NO: 995415 - DNA, 18 bp, Homo sapiens
actccagccagcgcctcc

SEQ ID NO: 995416 - DNA, 14 bp, Homo sapiens
actccagcccctgg

SEQ ID NO: 995417 - DNA, 16 bp, Homo sapiens
actccagcccctggac

SEQ ID NO: 995418 - DNA, 13 bp, Homo sapiens
actccagcccgca

SEQ ID NO: 995419 - DNA, 13 bp, Homo sapiens
actccagcctgag

SEQ ID NO: 995420 - DNA, 14 bp, Homo sapiens
actccagcctgagc

SEQ ID NO: 995421 - DNA, 16 bp, Homo sapiens
actccagcctgggcaa

SEQ ID NO: 995422 - DNA, 18 bp, Homo sapiens
actccagcctgggcgaca

SEQ ID NO: 995423 - DNA, 20 bp, Homo sapiens
actccagcctgggcgacaga

SEQ ID NO: 995424 - DNA, 14 bp, Homo sapiens
actccaggaaagag

SEQ ID NO: 995425 - DNA, 17 bp, Homo sapiens
actccaggaaagagcag

SEQ ID NO: 995426 - DNA, 18 bp, Homo sapiens
actccaggacttagaata

SEQ ID NO: 995427 - DNA, 21 bp, Homo sapiens
actccaggatttataaagcaa

SEQ ID NO: 995428 - DNA, 14 bp, Homo sapiens
actccaggggcacc

SEQ ID NO: 995429 - DNA, 16 bp, Homo sapiens
actccagggtcccctg

SEQ ID NO: 995430 - DNA, 17 bp, Homo sapiens
actccagggtcccctgc

SEQ ID NO: 995431 - DNA, 18 bp, Homo sapiens
actccagggtcccctgcc

SEQ ID NO: 995432 - DNA, 23 bp, Homo sapiens
actccagtagcgagagacggcac

SEQ ID NO: 995433 - DNA, 16 bp, Homo sapiens
actccagtagctcctg

SEQ ID NO: 995434 - DNA, 14 bp, Homo sapiens
actccagtgccagc

SEQ ID NO: 995435 - DNA, 18 bp, Homo sapiens
actccagtggtgaagaaa

SEQ ID NO: 995436 - DNA, 18 bp, Homo sapiens
actccagttaaaaaaaat

SEQ ID NO: 995437 - DNA, 16 bp, Homo sapiens
actccatacagcctct

SEQ ID NO: 995438 - DNA, 17 bp, Homo sapiens
actccatacagcctcta

SEQ ID NO: 995439 - DNA, 16 bp, Homo sapiens
actccatacataactt

SEQ ID NO: 995440 - DNA, 21 bp, Homo sapiens
actccatcgccatcttcttcc

SEQ ID NO: 995441 - DNA, 19 bp, Homo sapiens
actccatctcaaaaaataa

SEQ ID NO: 995442 - DNA, 19 bp, Homo sapiens
actccatgctccttgagag

SEQ ID NO: 995443 - DNA, 21 bp, Homo sapiens
actccatgctccttgagagga

SEQ ID NO: 995444 - DNA, 21 bp, Homo sapiens
actccatggctaagaccacag

SEQ ID NO: 995445 - DNA, 20 bp, Homo sapiens
actccatgtttggtgtttgt

SEQ ID NO: 995446 - DNA, 14 bp, Homo sapiens
actccatttctttc

SEQ ID NO: 995447 - DNA, 21 bp, Homo sapiens
actccatttggtcctttctcc

SEQ ID NO: 995448 - DNA, 23 bp, Homo sapiens
actcccaagtatggggttcaaga

SEQ ID NO: 995449 - DNA, 19 bp, Homo sapiens
actcccaatggataaatca

SEQ ID NO: 995450 - DNA, 14 bp, Homo sapiens
actcccacctgaca

SEQ ID NO: 995451 - DNA, 13 bp, Homo sapiens
actcccagcagag

SEQ ID NO: 995452 - DNA, 22 bp, Homo sapiens
actcccagcagagcccaccagc

SEQ ID NO: 995453 - DNA, 13 bp, Homo sapiens
actccccactccc

SEQ ID NO: 995454 - DNA, 20 bp, Homo sapiens
actccccactcccccaccca

SEQ ID NO: 995455 - DNA, 14 bp, Homo sapiens
actcccccacctga

SEQ ID NO: 995456 - DNA, 14 bp, Homo sapiens
actcccctgggggt

SEQ ID NO: 995457 - DNA, 14 bp, Homo sapiens
actccccttccctg

SEQ ID NO: 995458 - DNA, 20 bp, Homo sapiens
actccccttccctggggagc

SEQ ID NO: 995459 - DNA, 19 bp, Homo sapiens
actcccgaaagcctttcct

SEQ ID NO: 995460 - DNA, 23 bp, Homo sapiens
actcccgggccaagacagatgga

SEQ ID NO: 995461 - DNA, 21 bp, Homo sapiens
actcccgggccacgccccagc

SEQ ID NO: 995462 - DNA, 22 bp, Homo sapiens
actcccgggccacgccccagcc

SEQ ID NO: 995463 - DNA, 19 bp, Homo sapiens
actccctagtctccacctg

SEQ ID NO: 995464 - DNA, 15 bp, Homo sapiens
actccctccaccagc

SEQ ID NO: 995465 - DNA, 13 bp, Homo sapiens
actccctcccaga

SEQ ID NO: 995466 - DNA, 12 bp, Homo sapiens
actccctcccca

SEQ ID NO: 995467 - DNA, 16 bp, Homo sapiens
actccctccccaccca

SEQ ID NO: 995468 - DNA, 23 bp, Homo sapiens
actccctccccacccaagagagg

SEQ ID NO: 995469 - DNA, 13 bp, Homo sapiens
actccctcctcac

SEQ ID NO: 995470 - DNA, 15 bp, Homo sapiens
actccctcctcacct

SEQ ID NO: 995471 - DNA, 16 bp, Homo sapiens
actccctctgccttca

SEQ ID NO: 995472 - DNA, 13 bp, Homo sapiens
actccctcttcca

SEQ ID NO: 995473 - DNA, 19 bp, Homo sapiens
actccctgagtctggacct

SEQ ID NO: 995474 - DNA, 16 bp, Homo sapiens
actccctgcaccgtct

SEQ ID NO: 995475 - DNA, 13 bp, Homo sapiens
actccctgctcca

SEQ ID NO: 995476 - DNA, 18 bp, Homo sapiens
actccctggctctcagaa

SEQ ID NO: 995477 - DNA, 18 bp, Homo sapiens
actccctgggacacagac

SEQ ID NO: 995478 - DNA, 23 bp, Homo sapiens
actcccttaggcattatttaatg

SEQ ID NO: 995479 - DNA, 23 bp, Homo sapiens
actcccttccctctctcccattt

SEQ ID NO: 995480 - DNA, 15 bp, Homo sapiens
actcccttcctggcc

SEQ ID NO: 995481 - DNA, 20 bp, Homo sapiens
actcccttcctggcctcact

SEQ ID NO: 995482 - DNA, 16 bp, Homo sapiens
actcccttctgtagtt

SEQ ID NO: 995483 - DNA, 18 bp, Homo sapiens
actcccttgctggcccca

SEQ ID NO: 995484 - DNA, 21 bp, Homo sapiens
actcccttgctggccccagcc

SEQ ID NO: 995485 - DNA, 16 bp, Homo sapiens
actccctttaaagaga

SEQ ID NO: 995486 - DNA, 15 bp, Homo sapiens
actcattagactgga

SEQ ID NO: 995487 - DNA, 13 bp, Homo sapiens
actcattcagtcc

SEQ ID NO: 995488 - DNA, 15 bp, Homo sapiens
actcattctgaatta

SEQ ID NO: 995489 - DNA, 19 bp, Homo sapiens
actcattctgaattaatta

SEQ ID NO: 995490 - DNA, 14 bp, Homo sapiens
actcattgtagaaa

SEQ ID NO: 995491 - DNA, 22 bp, Homo sapiens
actcatttaaagctaaattttg

SEQ ID NO: 995492 - DNA, 12 bp, Homo sapiens
actcatttcatc

SEQ ID NO: 995493 - DNA, 14 bp, Homo sapiens
actcatttcatctc

SEQ ID NO: 995494 - DNA, 15 bp, Homo sapiens
actcatttcatctca

SEQ ID NO: 995495 - DNA, 22 bp, Homo sapiens
actcatttgttaaaattatcaa

SEQ ID NO: 995496 - DNA, 19 bp, Homo sapiens
actcatttttttaatttat

SEQ ID NO: 995497 - DNA, 20 bp, Homo sapiens
actccaaaaagaaaagtgtt

SEQ ID NO: 995498 - DNA, 22 bp, Homo sapiens
actccaaacagacccctgttca

SEQ ID NO: 995499 - DNA, 14 bp, Homo sapiens
actccaaacctgtc

SEQ ID NO: 995500 - DNA, 11 bp, Homo sapiens
actccaaactc

SEQ ID NO: 995501 - DNA, 20 bp, Homo sapiens
actccaactcccttaaaata

SEQ ID NO: 995502 - DNA, 17 bp, Homo sapiens
actccaagaccaccagg

SEQ ID NO: 995503 - DNA, 20 bp, Homo sapiens
actccaagaccaccagggtc

SEQ ID NO: 995504 - DNA, 17 bp, Homo sapiens
actccaagcagactcca

SEQ ID NO: 995505 - DNA, 18 bp, Homo sapiens
actccaagcagactccag

SEQ ID NO: 995506 - DNA, 15 bp, Homo sapiens
actccaagccccctg

SEQ ID NO: 995507 - DNA, 22 bp, Homo sapiens
actccaagccccctggcagctg

SEQ ID NO: 995508 - DNA, 19 bp, Homo sapiens
actctgttgtactatggaa

SEQ ID NO: 995509 - DNA, 15 bp, Homo sapiens
actcttaaatcattt

SEQ ID NO: 995510 - DNA, 20 bp, Homo sapiens
actcttaaatcatttggtta

SEQ ID NO: 995511 - DNA, 15 bp, Homo sapiens
actcttaagcaatgg

SEQ ID NO: 995512 - DNA, 13 bp, Homo sapiens
actcttaatctgt

SEQ ID NO: 995513 - DNA, 18 bp, Homo sapiens
actcttaatctgtgtgta

SEQ ID NO: 995514 - DNA, 22 bp, Homo sapiens
actcttaatctgtgtgtatatt

SEQ ID NO: 995515 - DNA, 20 bp, Homo sapiens
actcttaggaagagaaacca

SEQ ID NO: 995516 - DNA, 18 bp, Homo sapiens
actcttaggcacatcaat

SEQ ID NO: 995517 - DNA, 18 bp, Homo sapiens
actcttaggtatgtatga

SEQ ID NO: 995518 - DNA, 17 bp, Homo sapiens
actcttcacaaaatctg

SEQ ID NO: 995519 - DNA, 19 bp, Homo sapiens
actcttcagaacacacaga

SEQ ID NO: 995520 - DNA, 15 bp, Homo sapiens
actcttcagtgcaaa

SEQ ID NO: 995521 - DNA, 19 bp, Homo sapiens
actcttcccctccctccca

SEQ ID NO: 995522 - DNA, 14 bp, Homo sapiens
actcttccctctct

SEQ ID NO: 995523 - DNA, 16 bp, Homo sapiens
actcttcccttcccct

SEQ ID NO: 995524 - DNA, 22 bp, Homo sapiens
actcttccgaaaaatcctcttc

SEQ ID NO: 995525 - DNA, 20 bp, Homo sapiens
actcttccgtgcatcccaga

SEQ ID NO: 995526 - DNA, 22 bp, Homo sapiens
actcttcctatttttgtagtga

SEQ ID NO: 995527 - DNA, 19 bp, Homo sapiens
actcttcctcatcctgctt

SEQ ID NO: 995528 - DNA, 15 bp, Homo sapiens
actcttcctcccctc

SEQ ID NO: 995529 - DNA, 21 bp, Homo sapiens
actcttcctctaacatttttg

SEQ ID NO: 995530 - DNA, 15 bp, Homo sapiens
actcttcctgcaagg

SEQ ID NO: 995531 - DNA, 16 bp, Homo sapiens
actcttcctgcaagga

SEQ ID NO: 995532 - DNA, 15 bp, Homo sapiens
actcttcctgtccta

SEQ ID NO: 995533 - DNA, 20 bp, Homo sapiens
actcttcgaagccttgccta

SEQ ID NO: 995534 - DNA, 14 bp, Homo sapiens
actcttctctcctt

SEQ ID NO: 995535 - DNA, 19 bp, Homo sapiens
actcttcttaacttaaatt

SEQ ID NO: 995536 - DNA, 20 bp, Homo sapiens
actcttcttaacttaaattt

SEQ ID NO: 995537 - DNA, 15 bp, Homo sapiens
actcttcttgaaatt

SEQ ID NO: 995538 - DNA, 19 bp, Homo sapiens
actcttcttgaaattttaa

SEQ ID NO: 995539 - DNA, 18 bp, Homo sapiens
actcttctttaagccata

SEQ ID NO: 995540 - DNA, 16 bp, Homo sapiens
actcttgattatccat

SEQ ID NO: 995541 - DNA, 22 bp, Homo sapiens
actcttgcacagtcactgctct

SEQ ID NO: 995542 - DNA, 14 bp, Homo sapiens
actcttgcctgttt

SEQ ID NO: 995543 - DNA, 18 bp, Homo sapiens
actcttgcctgtttccca

SEQ ID NO: 995544 - DNA, 15 bp, Homo sapiens
actcttgcggcaagc

SEQ ID NO: 995545 - DNA, 13 bp, Homo sapiens
actcttgctcttt

SEQ ID NO: 995546 - DNA, 10 bp, Homo sapiens
actcttgctg

SEQ ID NO: 995547 - DNA, 14 bp, Homo sapiens
actcttgtcatttt

SEQ ID NO: 995548 - DNA, 18 bp, Homo sapiens
actcttgtcatttttaat

SEQ ID NO: 995549 - DNA, 17 bp, Homo sapiens
actctttacatggtggt

SEQ ID NO: 995550 - DNA, 20 bp, Homo sapiens
actctttattgtctgtaaat

SEQ ID NO: 995551 - DNA, 20 bp, Homo sapiens
actctttatttctagcagag

SEQ ID NO: 995552 - DNA, 19 bp, Homo sapiens
actctttatttttctcttt

SEQ ID NO: 995553 - DNA, 13 bp, Homo sapiens
actctttcaaaaa

SEQ ID NO: 995554 - DNA, 13 bp, Homo sapiens
actctttcaaaac

SEQ ID NO: 995555 - DNA, 16 bp, Homo sapiens
actctttcaaagaaat

SEQ ID NO: 995556 - DNA, 18 bp, Homo sapiens
actctttcattcttctca

SEQ ID NO: 995557 - DNA, 14 bp, Homo sapiens
actctttgaaatga

SEQ ID NO: 995558 - DNA, 19 bp, Homo sapiens
actctttgaagaaaagaaa

SEQ ID NO: 995559 - DNA, 16 bp, Homo sapiens
actctttgagaaacaa

SEQ ID NO: 995560 - DNA, 19 bp, Homo sapiens
actctttgagatagaagaa

SEQ ID NO: 995561 - DNA, 15 bp, Homo sapiens
actctttggctttaa

SEQ ID NO: 995562 - DNA, 13 bp, Homo sapiens
actctttgtaaga

SEQ ID NO: 995563 - DNA, 14 bp, Homo sapiens
actctttgtaagag

SEQ ID NO: 995564 - DNA, 18 bp, Homo sapiens
actctttgttatttgaaa

SEQ ID NO: 995565 - DNA, 14 bp, Homo sapiens
actcttttaagtgc

SEQ ID NO: 995566 - DNA, 12 bp, Homo sapiens
actcttttgctt

SEQ ID NO: 995567 - DNA, 19 bp, Homo sapiens
actctttttctaaagtgtt

SEQ ID NO: 995568 - DNA, 23 bp, Homo sapiens
actctttttctaaagtgttggtc

SEQ ID NO: 995569 - DNA, 18 bp, Homo sapiens
actctttttgggctcctt

SEQ ID NO: 995570 - DNA, 15 bp, Homo sapiens
actctttttttgagt

SEQ ID NO: 995571 - DNA, 18 bp, Homo sapiens
actgaaaaaatactacct

SEQ ID NO: 995572 - DNA, 16 bp, Homo sapiens
actgaaaaaatatatg

SEQ ID NO: 995573 - DNA, 15 bp, Homo sapiens
actgaaaaatgtcag

SEQ ID NO: 995574 - DNA, 15 bp, Homo sapiens
actgaaaacatctgg

SEQ ID NO: 995575 - DNA, 19 bp, Homo sapiens
actgaaaagactcagtgtt

SEQ ID NO: 995576 - DNA, 19 bp, Homo sapiens
actgaaaatgtaaatttat

SEQ ID NO: 995577 - DNA, 13 bp, Homo sapiens
actgaaacagatt

SEQ ID NO: 995578 - DNA, 18 bp, Homo sapiens
actgaaacagatttcata

SEQ ID NO: 995579 - DNA, 17 bp, Homo sapiens
actgaaacatggctgtg

SEQ ID NO: 995580 - DNA, 15 bp, Homo sapiens
actgaaaccaaaaca

SEQ ID NO: 995581 - DNA, 17 bp, Homo sapiens
actgaaaccaaaacata

SEQ ID NO: 995582 - DNA, 13 bp, Homo sapiens
actgaaaccattt

SEQ ID NO: 995583 - DNA, 13 bp, Homo sapiens
actgaaagaagaa

SEQ ID NO: 995584 - DNA, 16 bp, Homo sapiens
actgaaagcagcagct

SEQ ID NO: 995585 - DNA, 23 bp, Homo sapiens
actgaaagttttgtaaaagaaat

SEQ ID NO: 995586 - DNA, 19 bp, Homo sapiens
actgaaataaacctgcact

SEQ ID NO: 995587 - DNA, 14 bp, Homo sapiens
actgaaatctgtca

SEQ ID NO: 995588 - DNA, 13 bp, Homo sapiens
actgaaattgttt

SEQ ID NO: 995589 - DNA, 21 bp, Homo sapiens
actgaacaccattgaaggctt

SEQ ID NO: 995590 - DNA, 15 bp, Homo sapiens
actgaacaggctggg

SEQ ID NO: 995591 - DNA, 24 bp, Homo sapiens
actgaacatctgagtcctggatga

SEQ ID NO: 995592 - DNA, 12 bp, Homo sapiens
actgaacatgtt

SEQ ID NO: 995593 - DNA, 13 bp, Homo sapiens
actgaacatgttt

SEQ ID NO: 995594 - DNA, 15 bp, Homo sapiens
actgaacatgtttac

SEQ ID NO: 995595 - DNA, 23 bp, Homo sapiens
actgaaccacaaaaaaaaaggct

SEQ ID NO: 995596 - DNA, 12 bp, Homo sapiens
actgaaccactg

SEQ ID NO: 995597 - DNA, 13 bp, Homo sapiens
actgaaccactgc

SEQ ID NO: 995598 - DNA, 15 bp, Homo sapiens
actgaaccactgctt

SEQ ID NO: 995599 - DNA, 21 bp, Homo sapiens
actgaaccactgcttctcttt

SEQ ID NO: 995600 - DNA, 23 bp, Homo sapiens
actgaaccttaggctttgtatga

SEQ ID NO: 995601 - DNA, 19 bp, Homo sapiens
actgaacgatccttcaaag

SEQ ID NO: 995602 - DNA, 20 bp, Homo sapiens
actgaacgatccttcaaagt

SEQ ID NO: 995603 - DNA, 10 bp, Homo sapiens
actgaactcc

SEQ ID NO: 995604 - DNA, 14 bp, Homo sapiens
actgaactccatcg

SEQ ID NO: 995605 - DNA, 15 bp, Homo sapiens
actgaactgtttggt

SEQ ID NO: 995606 - DNA, 18 bp, Homo sapiens
actgaagaagatgagcct

SEQ ID NO: 995607 - DNA, 15 bp, Homo sapiens
actgaagatggcttt

SEQ ID NO: 995608 - DNA, 17 bp, Homo sapiens
actgaagcaacttgatg

SEQ ID NO: 995609 - DNA, 13 bp, Homo sapiens
actgaagcagcct

SEQ ID NO: 995610 - DNA, 14 bp, Homo sapiens
actgaagcagcctc

SEQ ID NO: 995611 - DNA, 21 bp, Homo sapiens
actgaagcagcctctccccag

SEQ ID NO: 995612 - DNA, 12 bp, Homo sapiens
actgaagcctgc

SEQ ID NO: 995613 - DNA, 16 bp, Homo sapiens
actgaagcctgcagga

SEQ ID NO: 995614 - DNA, 19 bp, Homo sapiens
actgaagcctgcaggagtt

SEQ ID NO: 995615 - DNA, 15 bp, Homo sapiens
actgaagccttcttc

SEQ ID NO: 995616 - DNA, 22 bp, Homo sapiens
actgaaggaaaaacacaagcaa

SEQ ID NO: 995617 - DNA, 14 bp, Homo sapiens
actgaaggagaagg

SEQ ID NO: 995618 - DNA, 16 bp, Homo sapiens
actgaaggcatatgca

SEQ ID NO: 995619 - DNA, 20 bp, Homo sapiens
actgaaggctaaaaagcaac

SEQ ID NO: 995620 - DNA, 22 bp, Homo sapiens
actgaaggggtgcacccacctg

SEQ ID NO: 995621 - DNA, 17 bp, Homo sapiens
actgaaggtaaaattga

SEQ ID NO: 995622 - DNA, 16 bp, Homo sapiens
actgaagtaaacagct

SEQ ID NO: 995623 - DNA, 18 bp, Homo sapiens
actgaagtaaacagctgt

SEQ ID NO: 995624 - DNA, 15 bp, Homo sapiens
actgaagtggctggt

SEQ ID NO: 995625 - DNA, 21 bp, Homo sapiens
actgaagttaacagagacaga

SEQ ID NO: 995626 - DNA, 19 bp, Homo sapiens
actgaagtttcacatgagc

SEQ ID NO: 995627 - DNA, 14 bp, Homo sapiens
actgaataccactc

SEQ ID NO: 995628 - DNA, 21 bp, Homo sapiens
actgaataccactctgtaatt

SEQ ID NO: 995629 - DNA, 18 bp, Homo sapiens
actgaatatataaacact

SEQ ID NO: 995630 - DNA, 21 bp, Homo sapiens
actgaatatttatatttcact

SEQ ID NO: 995631 - DNA, 22 bp, Homo sapiens
actgaatatttatatttcacta

SEQ ID NO: 995632 - DNA, 16 bp, Homo sapiens
actgaatcaggaaact

SEQ ID NO: 995633 - DNA, 17 bp, Homo sapiens
actctagcctgggccag

SEQ ID NO: 995634 - DNA, 15 bp, Homo sapiens
actctagttctgttg

SEQ ID NO: 995635 - DNA, 21 bp, Homo sapiens
actctagttctgttgttttgt

SEQ ID NO: 995636 - DNA, 18 bp, Homo sapiens
actctataagattccaaa

SEQ ID NO: 995637 - DNA, 18 bp, Homo sapiens
actctatagactctagga

SEQ ID NO: 995638 - DNA, 22 bp, Homo sapiens
actctatatagctgatcagttt

SEQ ID NO: 995639 - DNA, 14 bp, Homo sapiens
actctatcaagtat

SEQ ID NO: 995640 - DNA, 21 bp, Homo sapiens
actctatcaagtattatacct

SEQ ID NO: 995641 - DNA, 16 bp, Homo sapiens
actctatcagcattgt

SEQ ID NO: 995642 - DNA, 23 bp, Homo sapiens
actctattaatgaggtctttaaa

SEQ ID NO: 995643 - DNA, 14 bp, Homo sapiens
actctattctttaa

SEQ ID NO: 995644 - DNA, 14 bp, Homo sapiens
actctatttttaca

SEQ ID NO: 995645 - DNA, 16 bp, Homo sapiens
actctatttttacatt

SEQ ID NO: 995646 - DNA, 22 bp, Homo sapiens
actctcacactggttctcaatg

SEQ ID NO: 995647 - DNA, 14 bp, Homo sapiens
actctcagtctctg

SEQ ID NO: 995648 - DNA, 15 bp, Homo sapiens
actctcatgtcccct

SEQ ID NO: 995649 - DNA, 14 bp, Homo sapiens
actctcattcccca

SEQ ID NO: 995650 - DNA, 16 bp, Homo sapiens
actctcattccccagg

SEQ ID NO: 995651 - DNA, 21 bp, Homo sapiens
actctcattccccaggtggct

SEQ ID NO: 995652 - DNA, 15 bp, Homo sapiens
actctcattctttga

SEQ ID NO: 995653 - DNA, 17 bp, Homo sapiens
actctccaacctggaca

SEQ ID NO: 995654 - DNA, 13 bp, Homo sapiens
actctccatctta

SEQ ID NO: 995655 - DNA, 14 bp, Homo sapiens
actctcccaggcct

SEQ ID NO: 995656 - DNA, 19 bp, Homo sapiens
actctccccacgagggctg

SEQ ID NO: 995657 - DNA, 20 bp, Homo sapiens
actctccccacgagggctgg

SEQ ID NO: 995658 - DNA, 15 bp, Homo sapiens
actctccccagtgcc

SEQ ID NO: 995659 - DNA, 19 bp, Homo sapiens
actctccccagtgcctgcc

SEQ ID NO: 995660 - DNA, 15 bp, Homo sapiens
actctccccctttca

SEQ ID NO: 995661 - DNA, 18 bp, Homo sapiens
actctccccctttcaagg

SEQ ID NO: 995662 - DNA, 19 bp, Homo sapiens
actctccccctttcaagga

SEQ ID NO: 995663 - DNA, 12 bp, Homo sapiens
actctcccctcc

SEQ ID NO: 995664 - DNA, 16 bp, Homo sapiens
actctcccctccctct

SEQ ID NO: 995665 - DNA, 19 bp, Homo sapiens
actctcccctccctcttcc

SEQ ID NO: 995666 - DNA, 22 bp, Homo sapiens
actctcccctccctcttccttc

SEQ ID NO: 995667 - DNA, 20 bp, Homo sapiens
actctcccctgaatcctcag

SEQ ID NO: 995668 - DNA, 21 bp, Homo sapiens
actctcctagagacagaagca

SEQ ID NO: 995669 - DNA, 16 bp, Homo sapiens
actctcctgtttggaa

SEQ ID NO: 995670 - DNA, 23 bp, Homo sapiens
actctccttcgtgtctctcccac

SEQ ID NO: 995671 - DNA, 13 bp, Homo sapiens
actctcggggccc

SEQ ID NO: 995672 - DNA, 17 bp, Homo sapiens
actctcgtggtatgtat

SEQ ID NO: 995673 - DNA, 19 bp, Homo sapiens
actctctgcagcccagcct

SEQ ID NO: 995674 - DNA, 13 bp, Homo sapiens
actctctgctcta

SEQ ID NO: 995675 - DNA, 15 bp, Homo sapiens
actctctgctctagc

SEQ ID NO: 995676 - DNA, 22 bp, Homo sapiens
actctctggaagcccctgggcc

SEQ ID NO: 995677 - DNA, 13 bp, Homo sapiens
actctctgggact

SEQ ID NO: 995678 - DNA, 17 bp, Homo sapiens
actctctttccttgagc

SEQ ID NO: 995679 - DNA, 14 bp, Homo sapiens
actctgaaatctga

SEQ ID NO: 995680 - DNA, 13 bp, Homo sapiens
actctgactcatc

SEQ ID NO: 995681 - DNA, 11 bp, Homo sapiens
actctgagcca

SEQ ID NO: 995682 - DNA, 15 bp, Homo sapiens
actctgagccaaggg

SEQ ID NO: 995683 - DNA, 17 bp, Homo sapiens
actctgagcccaggccg

SEQ ID NO: 995684 - DNA, 21 bp, Homo sapiens
actctgagcgggaggcagagt

SEQ ID NO: 995685 - DNA, 22 bp, Homo sapiens
actctgagcgggaggcagagtt

SEQ ID NO: 995686 - DNA, 16 bp, Homo sapiens
actctgagctgctcac

SEQ ID NO: 995687 - DNA, 20 bp, Homo sapiens
actctgagtccactgctcca

SEQ ID NO: 995688 - DNA, 16 bp, Homo sapiens
actctgagtttaccat

SEQ ID NO: 995689 - DNA, 17 bp, Homo sapiens
actctgcaaaggcctgg

SEQ ID NO: 995690 - DNA, 11 bp, Homo sapiens
actctgcactc

SEQ ID NO: 995691 - DNA, 17 bp, Homo sapiens
actctgcactccatggc

SEQ ID NO: 995692 - DNA, 20 bp, Homo sapiens
actctgcactccatggccac

SEQ ID NO: 995693 - DNA, 18 bp, Homo sapiens
actctgcatcccagcacc

SEQ ID NO: 995694 - DNA, 21 bp, Homo sapiens
actctgcatcccagcacctgc

SEQ ID NO: 995695 - DNA, 15 bp, Homo sapiens
actctgccagaaaaa

SEQ ID NO: 995696 - DNA, 15 bp, Homo sapiens
actctgcccaccctc

SEQ ID NO: 995697 - DNA, 21 bp, Homo sapiens
actctgcccagccggagggac

SEQ ID NO: 995698 - DNA, 14 bp, Homo sapiens
actctgccccaatc

SEQ ID NO: 995699 - DNA, 23 bp, Homo sapiens
actctgccccaatcgggtccaga

SEQ ID NO: 995700 - DNA, 20 bp, Homo sapiens
actctgccccacgctgtggc

SEQ ID NO: 995701 - DNA, 22 bp, Homo sapiens
actctgcccctggacctgggaa

SEQ ID NO: 995702 - DNA, 13 bp, Homo sapiens
actctgccctcta

SEQ ID NO: 995703 - DNA, 14 bp, Homo sapiens
actctgccctctgc

SEQ ID NO: 995704 - DNA, 18 bp, Homo sapiens
actctgccctctgctgct

SEQ ID NO: 995705 - DNA, 19 bp, Homo sapiens
actctgccctctgctgctg

SEQ ID NO: 995706 - DNA, 20 bp, Homo sapiens
actctgccgatctaattaca

SEQ ID NO: 995707 - DNA, 21 bp, Homo sapiens
actctgcctttatgatgctaa

SEQ ID NO: 995708 - DNA, 22 bp, Homo sapiens
actctgcgggaggctggggccc

SEQ ID NO: 995709 - DNA, 17 bp, Homo sapiens
actctgctaatcatgtg

SEQ ID NO: 995710 - DNA, 20 bp, Homo sapiens
actctgctctgcccttgttc

SEQ ID NO: 995711 - DNA, 23 bp, Homo sapiens
actctgctgtctaacctgtgacc

SEQ ID NO: 995712 - DNA, 12 bp, Homo sapiens
actctgcttctc

SEQ ID NO: 995713 - DNA, 20 bp, Homo sapiens
actctgcttctctgacttct

SEQ ID NO: 995714 - DNA, 21 bp, Homo sapiens
actctggattcagccttcttt

SEQ ID NO: 995715 - DNA, 15 bp, Homo sapiens
actctggattttgaa

SEQ ID NO: 995716 - DNA, 13 bp, Homo sapiens
actctggcacagt

SEQ ID NO: 995717 - DNA, 15 bp, Homo sapiens
actctggcacagtga

SEQ ID NO: 995718 - DNA, 19 bp, Homo sapiens
actctggcacagtgatgcc

SEQ ID NO: 995719 - DNA, 15 bp, Homo sapiens
actctggccctggcc

SEQ ID NO: 995720 - DNA, 16 bp, Homo sapiens
actctggccctggccc

SEQ ID NO: 995721 - DNA, 17 bp, Homo sapiens
actctggccctggccct

SEQ ID NO: 995722 - DNA, 17 bp, Homo sapiens
actctggctcagcctgt

SEQ ID NO: 995723 - DNA, 19 bp, Homo sapiens
actctggctcagcctgtct

SEQ ID NO: 995724 - DNA, 17 bp, Homo sapiens
actctggcttccaggta

SEQ ID NO: 995725 - DNA, 23 bp, Homo sapiens
actctgggatgtgtagccttctc

SEQ ID NO: 995726 - DNA, 11 bp, Homo sapiens
actctgggcag

SEQ ID NO: 995727 - DNA, 23 bp, Homo sapiens
actctgggcagaagtgagccccc

SEQ ID NO: 995728 - DNA, 22 bp, Homo sapiens
actctgggctatggacacaggg

SEQ ID NO: 995729 - DNA, 16 bp, Homo sapiens
actctgggctccagag

SEQ ID NO: 995730 - DNA, 22 bp, Homo sapiens
actctggggcttgtcctgtgct

SEQ ID NO: 995731 - DNA, 23 bp, Homo sapiens
actctggggcttgtcctgtgctt

SEQ ID NO: 995732 - DNA, 21 bp, Homo sapiens
actctggtgataaaaataaag

SEQ ID NO: 995733 - DNA, 19 bp, Homo sapiens
actctggtggccacttcat

SEQ ID NO: 995734 - DNA, 15 bp, Homo sapiens
actctgtaaaaacac

SEQ ID NO: 995735 - DNA, 20 bp, Homo sapiens
actctgtaatttgcttgttt

SEQ ID NO: 995736 - DNA, 18 bp, Homo sapiens
actctgtagtctcagttc

SEQ ID NO: 995737 - DNA, 18 bp, Homo sapiens
actctgtataatagagat

SEQ ID NO: 995738 - DNA, 21 bp, Homo sapiens
actctgtataatagagataag

SEQ ID NO: 995739 - DNA, 17 bp, Homo sapiens
actctgtatctatgcaa

SEQ ID NO: 995740 - DNA, 23 bp, Homo sapiens
actctgtcaatttccctgactcc

SEQ ID NO: 995741 - DNA, 17 bp, Homo sapiens
actctgtcagccagccg

SEQ ID NO: 995742 - DNA, 13 bp, Homo sapiens
actctgtccaggc

SEQ ID NO: 995743 - DNA, 14 bp, Homo sapiens
actctgtccaggcc

SEQ ID NO: 995744 - DNA, 15 bp, Homo sapiens
actctgtccaggcca

SEQ ID NO: 995745 - DNA, 19 bp, Homo sapiens
actctgtccctgtccttcc

SEQ ID NO: 995746 - DNA, 20 bp, Homo sapiens
actctgtcgctcaggctgga

SEQ ID NO: 995747 - DNA, 16 bp, Homo sapiens
actctgtcttaaatga

SEQ ID NO: 995748 - DNA, 12 bp, Homo sapiens
actctgtgtaaa

SEQ ID NO: 995749 - DNA, 22 bp, Homo sapiens
actctgtgtaaatatttttccc

SEQ ID NO: 995750 - DNA, 14 bp, Homo sapiens
actctgtgtttaaa

SEQ ID NO: 995751 - DNA, 15 bp, Homo sapiens
actctgttatttaga

SEQ ID NO: 995752 - DNA, 18 bp, Homo sapiens
actctgttcccccaccct

SEQ ID NO: 995753 - DNA, 17 bp, Homo sapiens
actctgttccttcacat

SEQ ID NO: 995754 - DNA, 22 bp, Homo sapiens
actctgttgatctacccgtgcc

SEQ ID NO: 995755 - DNA, 22 bp, Homo sapiens
actctgttgcccaggctggagt

SEQ ID NO: 995756 - DNA, 22 bp, Homo sapiens
actctgttgtaagtaataattt

SEQ ID NO: 995757 - DNA, 24 bp, Homo sapiens
actgatgggctggggcaggggcct

SEQ ID NO: 995758 - DNA, 18 bp, Homo sapiens
actgatgtacaattaaaa

SEQ ID NO: 995759 - DNA, 19 bp, Homo sapiens
actgatgtgatattctgtt

SEQ ID NO: 995760 - DNA, 17 bp, Homo sapiens
actgattaaaaatacct

SEQ ID NO: 995761 - DNA, 17 bp, Homo sapiens
actgattaaatatttga

SEQ ID NO: 995762 - DNA, 19 bp, Homo sapiens
actgattcacatctcattt

SEQ ID NO: 995763 - DNA, 20 bp, Homo sapiens
actgattcacatctcatttt

SEQ ID NO: 995764 - DNA, 14 bp, Homo sapiens
actgattcctggag

SEQ ID NO: 995765 - DNA, 13 bp, Homo sapiens
actgattgggagg

SEQ ID NO: 995766 - DNA, 13 bp, Homo sapiens
actgattgtttca

SEQ ID NO: 995767 - DNA, 12 bp, Homo sapiens
actgatttcaga

SEQ ID NO: 995768 - DNA, 14 bp, Homo sapiens
actgatttcagtaa

SEQ ID NO: 995769 - DNA, 12 bp, Homo sapiens
actgatttcttc

SEQ ID NO: 995770 - DNA, 14 bp, Homo sapiens
actgatttcttgcg

SEQ ID NO: 995771 - DNA, 14 bp, Homo sapiens
actgattttaaaat

SEQ ID NO: 995772 - DNA, 19 bp, Homo sapiens
actgattttaaaatgaata

SEQ ID NO: 995773 - DNA, 17 bp, Homo sapiens
actgattttgtatgtaa

SEQ ID NO: 995774 - DNA, 14 bp, Homo sapiens
actgatttttgtga

SEQ ID NO: 995775 - DNA, 19 bp, Homo sapiens
actgcaaaaaaagcctcca

SEQ ID NO: 995776 - DNA, 15 bp, Homo sapiens
actgccaggacccca

SEQ ID NO: 995777 - DNA, 13 bp, Homo sapiens
actgccaggcacc

SEQ ID NO: 995778 - DNA, 15 bp, Homo sapiens
actgccaggccagcc

SEQ ID NO: 995779 - DNA, 19 bp, Homo sapiens
actgccaggccagcctccg

SEQ ID NO: 995780 - DNA, 13 bp, Homo sapiens
actgccaggctgt

SEQ ID NO: 995781 - DNA, 13 bp, Homo sapiens
actgccaggtggt

SEQ ID NO: 995782 - DNA, 16 bp, Homo sapiens
actgccagtctcactg

SEQ ID NO: 995783 - DNA, 14 bp, Homo sapiens
actgccataaaaca

SEQ ID NO: 995784 - DNA, 21 bp, Homo sapiens
actgccataaaacattaagaa

SEQ ID NO: 995785 - DNA, 16 bp, Homo sapiens
actgccatattaaatt

SEQ ID NO: 995786 - DNA, 21 bp, Homo sapiens
actgccatcggacaggaggat

SEQ ID NO: 995787 - DNA, 20 bp, Homo sapiens
actgccatggaattccctcc

SEQ ID NO: 995788 - DNA, 23 bp, Homo sapiens
actgccattattttctgtcagat

SEQ ID NO: 995789 - DNA, 23 bp, Homo sapiens
actgcccacatttgggctcaggg

SEQ ID NO: 995790 - DNA, 14 bp, Homo sapiens
actgcccaccccct

SEQ ID NO: 995791 - DNA, 15 bp, Homo sapiens
actgcccaccccctc

SEQ ID NO: 995792 - DNA, 16 bp, Homo sapiens
actgcccaccccctca

SEQ ID NO: 995793 - DNA, 12 bp, Homo sapiens
actgcccagcca

SEQ ID NO: 995794 - DNA, 18 bp, Homo sapiens
actgcccatcagtgacag

SEQ ID NO: 995795 - DNA, 16 bp, Homo sapiens
actgcccatggacagg

SEQ ID NO: 995796 - DNA, 18 bp, Homo sapiens
actgccccaactcctgga

SEQ ID NO: 995797 - DNA, 19 bp, Homo sapiens
actgccccacggagacaga

SEQ ID NO: 995798 - DNA, 13 bp, Homo sapiens
actgcccccagaa

SEQ ID NO: 995799 - DNA, 20 bp, Homo sapiens
actgcccccagaaagcctcc

SEQ ID NO: 995800 - DNA, 19 bp, Homo sapiens
actgccccccgaggctgct

SEQ ID NO: 995801 - DNA, 21 bp, Homo sapiens
actgccccccgaggctgctag

SEQ ID NO: 995802 - DNA, 17 bp, Homo sapiens
actgccccctgctgcca

SEQ ID NO: 995803 - DNA, 16 bp, Homo sapiens
actgcccgagctggtg

SEQ ID NO: 995804 - DNA, 18 bp, Homo sapiens
actgcccgagctggtgca

SEQ ID NO: 995805 - DNA, 22 bp, Homo sapiens
actgcccggcacagatgctcca

SEQ ID NO: 995806 - DNA, 15 bp, Homo sapiens
actgcccggcagggt

SEQ ID NO: 995807 - DNA, 20 bp, Homo sapiens
actgcccggggcagctgcca

SEQ ID NO: 995808 - DNA, 21 bp, Homo sapiens
actgcccggggcagctgccag

SEQ ID NO: 995809 - DNA, 22 bp, Homo sapiens
actgcccggggcagctgccaga

SEQ ID NO: 995810 - DNA, 17 bp, Homo sapiens
actgccctaagccccca

SEQ ID NO: 995811 - DNA, 19 bp, Homo sapiens
actgccctaagcccccagg

SEQ ID NO: 995812 - DNA, 21 bp, Homo sapiens
actgccctaagcccccagggc

SEQ ID NO: 995813 - DNA, 15 bp, Homo sapiens
actgccctgcctgcc

SEQ ID NO: 995814 - DNA, 23 bp, Homo sapiens
actgccctgcctgcccacttagc

SEQ ID NO: 995815 - DNA, 18 bp, Homo sapiens
actgccctggcagcagca

SEQ ID NO: 995816 - DNA, 19 bp, Homo sapiens
actgccctggcagcagcag

SEQ ID NO: 995817 - DNA, 12 bp, Homo sapiens
actgccctggct

SEQ ID NO: 995818 - DNA, 13 bp, Homo sapiens
actgcccttccag

SEQ ID NO: 995819 - DNA, 14 bp, Homo sapiens
actgcccttgctgc

SEQ ID NO: 995820 - DNA, 16 bp, Homo sapiens
actgcccttgctgccc

SEQ ID NO: 995821 - DNA, 18 bp, Homo sapiens
actgcccttgctgcccgc

SEQ ID NO: 995822 - DNA, 17 bp, Homo sapiens
actgcccttttcaggaa

SEQ ID NO: 995823 - DNA, 21 bp, Homo sapiens
actgccgaagaattgtcttgc

SEQ ID NO: 995824 - DNA, 19 bp, Homo sapiens
actgccgaccgaggctgga

SEQ ID NO: 995825 - DNA, 22 bp, Homo sapiens
actgccgcaagtctgcagcccg

SEQ ID NO: 995826 - DNA, 13 bp, Homo sapiens
actgcctactgtt

SEQ ID NO: 995827 - DNA, 11 bp, Homo sapiens
actgcctagga

SEQ ID NO: 995828 - DNA, 22 bp, Homo sapiens
actgcctataatcttatacaac

SEQ ID NO: 995829 - DNA, 23 bp, Homo sapiens
actgcctcccccgaatgcatttg

SEQ ID NO: 995830 - DNA, 14 bp, Homo sapiens
actgcctccctctc

SEQ ID NO: 995831 - DNA, 12 bp, Homo sapiens
actgcctcctgt

SEQ ID NO: 995832 - DNA, 22 bp, Homo sapiens
actgcctcctgttttctccctc

SEQ ID NO: 995833 - DNA, 17 bp, Homo sapiens
actgcctcgaaacacag

SEQ ID NO: 995834 - DNA, 19 bp, Homo sapiens
actgcctcgaaacacagaa

SEQ ID NO: 995835 - DNA, 18 bp, Homo sapiens
actgcctctatgccctgc

SEQ ID NO: 995836 - DNA, 21 bp, Homo sapiens
actgcctctatgccctgcaga

SEQ ID NO: 995837 - DNA, 22 bp, Homo sapiens
actgcctgcccacccgtggaga

SEQ ID NO: 995838 - DNA, 23 bp, Homo sapiens
actgcctgcccacccgtggagat

SEQ ID NO: 995839 - DNA, 21 bp, Homo sapiens
actgcctgggccatgcgaggg

SEQ ID NO: 995840 - DNA, 18 bp, Homo sapiens
actgcctgtagagacaat

SEQ ID NO: 995841 - DNA, 23 bp, Homo sapiens
actgccttaataaaaaatgaaaa

SEQ ID NO: 995842 - DNA, 15 bp, Homo sapiens
actgccttagcctct

SEQ ID NO: 995843 - DNA, 12 bp, Homo sapiens
actgccttcctc

SEQ ID NO: 995844 - DNA, 13 bp, Homo sapiens
actgccttcctct

SEQ ID NO: 995845 - DNA, 23 bp, Homo sapiens
actgccttcgcttcttgcctctg

SEQ ID NO: 995846 - DNA, 19 bp, Homo sapiens
actgccttctcctctctgg

SEQ ID NO: 995847 - DNA, 20 bp, Homo sapiens
actgccttggcccctccctc

SEQ ID NO: 995848 - DNA, 19 bp, Homo sapiens
actgcctttcagaagtgat

SEQ ID NO: 995849 - DNA, 17 bp, Homo sapiens
actgcgaggacatcaaa

SEQ ID NO: 995850 - DNA, 14 bp, Homo sapiens
actgcgcccagcct

SEQ ID NO: 995851 - DNA, 19 bp, Homo sapiens
actgcgggatggtcctggg

SEQ ID NO: 995852 - DNA, 21 bp, Homo sapiens
actgcggggagacagaagcct

SEQ ID NO: 995853 - DNA, 19 bp, Homo sapiens
actgctaaataaaatttgt

SEQ ID NO: 995854 - DNA, 15 bp, Homo sapiens
actgctaaatcctca

SEQ ID NO: 995855 - DNA, 14 bp, Homo sapiens
actgctaaggctgc

SEQ ID NO: 995856 - DNA, 17 bp, Homo sapiens
actgctaaggctgctgg

SEQ ID NO: 995857 - DNA, 22 bp, Homo sapiens
actgctaaggctgctggcttca

SEQ ID NO: 995858 - DNA, 13 bp, Homo sapiens
actgctactgtaa

SEQ ID NO: 995859 - DNA, 19 bp, Homo sapiens
actgctaggcgagtgccag

SEQ ID NO: 995860 - DNA, 22 bp, Homo sapiens
actgctaggcgagtgccaggac

SEQ ID NO: 995861 - DNA, 16 bp, Homo sapiens
actgctaggtgggcca

SEQ ID NO: 995862 - DNA, 21 bp, Homo sapiens
actgctaggtgggccagcccc

SEQ ID NO: 995863 - DNA, 22 bp, Homo sapiens
actgctaggtgggccagcccct

SEQ ID NO: 995864 - DNA, 15 bp, Homo sapiens
actgctatgccattt

SEQ ID NO: 995865 - DNA, 17 bp, Homo sapiens
actgctcagctctggtc

SEQ ID NO: 995866 - DNA, 19 bp, Homo sapiens
actgctcatcattccttga

SEQ ID NO: 995867 - DNA, 21 bp, Homo sapiens
actgctccaagggacaggtgg

SEQ ID NO: 995868 - DNA, 22 bp, Homo sapiens
actgctcccggcccgcctgccc

SEQ ID NO: 995869 - DNA, 21 bp, Homo sapiens
actgctccctaagccagcctg

SEQ ID NO: 995870 - DNA, 23 bp, Homo sapiens
actgctccgtggaggaggttggg

SEQ ID NO: 995871 - DNA, 13 bp, Homo sapiens
actgctcctgtgg

SEQ ID NO: 995872 - DNA, 19 bp, Homo sapiens
actgctcgtggactgtgct

SEQ ID NO: 995873 - DNA, 20 bp, Homo sapiens
actgctcgtggactgtgctg

SEQ ID NO: 995874 - DNA, 16 bp, Homo sapiens
actgggcccaggcagg

SEQ ID NO: 995875 - DNA, 17 bp, Homo sapiens
actgggcccaggcaggt

SEQ ID NO: 995876 - DNA, 19 bp, Homo sapiens
actgggcccaggcaggtct

SEQ ID NO: 995877 - DNA, 15 bp, Homo sapiens
actgggccctgggga

SEQ ID NO: 995878 - DNA, 18 bp, Homo sapiens
actgggcctggagccctg

SEQ ID NO: 995879 - DNA, 16 bp, Homo sapiens
actgggcctttccaga

SEQ ID NO: 995880 - DNA, 19 bp, Homo sapiens
actgggctcaagtgatcct

SEQ ID NO: 995881 - DNA, 20 bp, Homo sapiens
actgggctcaagtgatcctc

SEQ ID NO: 995882 - DNA, 16 bp, Homo sapiens
actgggctctggctct

SEQ ID NO: 995883 - DNA, 15 bp, Homo sapiens
actgggctggcgctt

SEQ ID NO: 995884 - DNA, 13 bp, Homo sapiens
actgggctgggcc

SEQ ID NO: 995885 - DNA, 23 bp, Homo sapiens
actggggactttatttatttcta

SEQ ID NO: 995886 - DNA, 18 bp, Homo sapiens
actggggagaaataattg

SEQ ID NO: 995887 - DNA, 15 bp, Homo sapiens
actggggatggtggc

SEQ ID NO: 995888 - DNA, 16 bp, Homo sapiens
actggggatgtgggag

SEQ ID NO: 995889 - DNA, 21 bp, Homo sapiens
actggggcctacagctttgat

SEQ ID NO: 995890 - DNA, 21 bp, Homo sapiens
actgtcaaggctgcttagaat

SEQ ID NO: 995891 - DNA, 17 bp, Homo sapiens
actgtcaataaacagct

SEQ ID NO: 995892 - DNA, 21 bp, Homo sapiens
actgtcaataaacagcttcat

SEQ ID NO: 995893 - DNA, 17 bp, Homo sapiens
actgtcacactggtgct

SEQ ID NO: 995894 - DNA, 18 bp, Homo sapiens
actgtcacactggtgctg

SEQ ID NO: 995895 - DNA, 23 bp, Homo sapiens
actgtcacactggtgctgagtga

SEQ ID NO: 995896 - DNA, 15 bp, Homo sapiens
actgtcaccctccac

SEQ ID NO: 995897 - DNA, 21 bp, Homo sapiens
actgtcacgcggcagcttcag

SEQ ID NO: 995898 - DNA, 20 bp, Homo sapiens
actgtcacggggttccctcc

SEQ ID NO: 995899 - DNA, 14 bp, Homo sapiens
actgtcactcattg

SEQ ID NO: 995900 - DNA, 15 bp, Homo sapiens
actgtcactgttcct

SEQ ID NO: 995901 - DNA, 21 bp, Homo sapiens
actgtcactgtttctctgctg

SEQ ID NO: 995902 - DNA, 19 bp, Homo sapiens
actgtcagcagggactgta

SEQ ID NO: 995903 - DNA, 22 bp, Homo sapiens
actgtcaggaagaaatcacaga

SEQ ID NO: 995904 - DNA, 12 bp, Homo sapiens
actgtcagggag

SEQ ID NO: 995905 - DNA, 18 bp, Homo sapiens
actgtcagggagggccag

SEQ ID NO: 995906 - DNA, 13 bp, Homo sapiens
actgtcatagaaa

SEQ ID NO: 995907 - DNA, 21 bp, Homo sapiens
actgtcatcctcaaagaaagt

SEQ ID NO: 995908 - DNA, 21 bp, Homo sapiens
actgtccacatctgcctcctc

SEQ ID NO: 995909 - DNA, 22 bp, Homo sapiens
actgtccacatctgcctcctct

SEQ ID NO: 995910 - DNA, 23 bp, Homo sapiens
actgtccctatctattaaagtga

SEQ ID NO: 995911 - DNA, 12 bp, Homo sapiens
actgtccctgcc

SEQ ID NO: 995912 - DNA, 15 bp, Homo sapiens
actgtccctgtcctt

SEQ ID NO: 995913 - DNA, 16 bp, Homo sapiens
actgtccctgtccttc

SEQ ID NO: 995914 - DNA, 20 bp, Homo sapiens
actgtccctgtccttctaca

SEQ ID NO: 995915 - DNA, 16 bp, Homo sapiens
actgtcccttgcctca

SEQ ID NO: 995916 - DNA, 15 bp, Homo sapiens
actgtccgcctctgc

SEQ ID NO: 995917 - DNA, 22 bp, Homo sapiens
actgtccgcctctgcccgcaga

SEQ ID NO: 995918 - DNA, 20 bp, Homo sapiens
actgtcctcccacagacctg

SEQ ID NO: 995919 - DNA, 12 bp, Homo sapiens
actgtcctgggc

SEQ ID NO: 995920 - DNA, 13 bp, Homo sapiens
actgtcctgggcg

SEQ ID NO: 995921 - DNA, 18 bp, Homo sapiens
actgtcctgggcgccctg

SEQ ID NO: 995922 - DNA, 13 bp, Homo sapiens
actgtcctgtcct

SEQ ID NO: 995923 - DNA, 15 bp, Homo sapiens
actgtccttgaaccc

SEQ ID NO: 995924 - DNA, 17 bp, Homo sapiens
actgtcggagaggctgt

SEQ ID NO: 995925 - DNA, 20 bp, Homo sapiens
actgtcggagaggctgtctg

SEQ ID NO: 995926 - DNA, 15 bp, Homo sapiens
actgtctaggctaca

SEQ ID NO: 995927 - DNA, 22 bp, Homo sapiens
actgtctatttaagtgcaatta

SEQ ID NO: 995928 - DNA, 19 bp, Homo sapiens
actgtctcaagagggcact

SEQ ID NO: 995929 - DNA, 21 bp, Homo sapiens
actgtctcaagagggcactgg

SEQ ID NO: 995930 - DNA, 18 bp, Homo sapiens
actgtctcagtttcactt

SEQ ID NO: 995931 - DNA, 17 bp, Homo sapiens
actgtctcctccctggg

SEQ ID NO: 995932 - DNA, 14 bp, Homo sapiens
actgtcttcccgat

SEQ ID NO: 995933 - DNA, 14 bp, Homo sapiens
actgtcttcctcaa

SEQ ID NO: 995934 - DNA, 15 bp, Homo sapiens
actgtgaaaatagtg

SEQ ID NO: 995935 - DNA, 17 bp, Homo sapiens
actgtgaaaatagtgta

SEQ ID NO: 995936 - DNA, 22 bp, Homo sapiens
actgtgaaatttacaaatcaaa

SEQ ID NO: 995937 - DNA, 22 bp, Homo sapiens
actgtgaaatttcatgattggc

SEQ ID NO: 995938 - DNA, 15 bp, Homo sapiens
actgtgaactgggca

SEQ ID NO: 995939 - DNA, 16 bp, Homo sapiens
actgtgaactgggcat

SEQ ID NO: 995940 - DNA, 20 bp, Homo sapiens
actgtgaactgggcatttca

SEQ ID NO: 995941 - DNA, 21 bp, Homo sapiens
actgtgaactgggcatttcac

SEQ ID NO: 995942 - DNA, 21 bp, Homo sapiens
actgtgaacttgactgggtga

SEQ ID NO: 995943 - DNA, 22 bp, Homo sapiens
actgtgaacttgactgggtgag

SEQ ID NO: 995944 - DNA, 19 bp, Homo sapiens
actgtgaagggtacagatt

SEQ ID NO: 995945 - DNA, 20 bp, Homo sapiens
actgtgaataataaatacac

SEQ ID NO: 995946 - DNA, 17 bp, Homo sapiens
actgtgaatcctggcaa

SEQ ID NO: 995947 - DNA, 21 bp, Homo sapiens
actgtgaattgtttttgtaca

SEQ ID NO: 995948 - DNA, 12 bp, Homo sapiens
actgtgaatttc

SEQ ID NO: 995949 - DNA, 17 bp, Homo sapiens
actgtgaatttcaaaaa

SEQ ID NO: 995950 - DNA, 13 bp, Homo sapiens
actgtgaccacct

SEQ ID NO: 995951 - DNA, 13 bp, Homo sapiens
actgtgagagttg

SEQ ID NO: 995952 - DNA, 23 bp, Homo sapiens
actgtgatcaggctatgtatgga

SEQ ID NO: 995953 - DNA, 15 bp, Homo sapiens
actgtgattagatca

SEQ ID NO: 995954 - DNA, 20 bp, Homo sapiens
actgtgattagatcacatct

SEQ ID NO: 995955 - DNA, 18 bp, Homo sapiens
actgtgattttgccctcc

SEQ ID NO: 995956 - DNA, 20 bp, Homo sapiens
actgtgattttgccctcctg

SEQ ID NO: 995957 - DNA, 22 bp, Homo sapiens
actgtgattttgccctcctgcc

SEQ ID NO: 995958 - DNA, 18 bp, Homo sapiens
actgtgcaaagggctgcc

SEQ ID NO: 995959 - DNA, 14 bp, Homo sapiens
actgtgcagaataa

SEQ ID NO: 995960 - DNA, 21 bp, Homo sapiens
actgtgcagaataatggaaac

SEQ ID NO: 995961 - DNA, 18 bp, Homo sapiens
actgttccagattcctat

SEQ ID NO: 995962 - DNA, 20 bp, Homo sapiens
actgttccaggccctccagt

SEQ ID NO: 995963 - DNA, 18 bp, Homo sapiens
actgttccccctgtgcag

SEQ ID NO: 995964 - DNA, 18 bp, Homo sapiens
actgttccctctgctcct

SEQ ID NO: 995965 - DNA, 20 bp, Homo sapiens
actgttccctctgctcctgg

SEQ ID NO: 995966 - DNA, 15 bp, Homo sapiens
actgttccctctggc

SEQ ID NO: 995967 - DNA, 16 bp, Homo sapiens
actgttccctctggct

SEQ ID NO: 995968 - DNA, 20 bp, Homo sapiens
actgttcctcatgttgctga

SEQ ID NO: 995969 - DNA, 21 bp, Homo sapiens
actgttcctcatgttgctgaa

SEQ ID NO: 995970 - DNA, 15 bp, Homo sapiens
actgttcctttcaga

SEQ ID NO: 995971 - DNA, 12 bp, Homo sapiens
actgttctgcaa

SEQ ID NO: 995972 - DNA, 20 bp, Homo sapiens
actgttctgcaaaggtggca

SEQ ID NO: 995973 - DNA, 13 bp, Homo sapiens
actgttctgtgtc

SEQ ID NO: 995974 - DNA, 13 bp, Homo sapiens
actgttcttgaat

SEQ ID NO: 995975 - DNA, 15 bp, Homo sapiens
actgttcttttgcat

SEQ ID NO: 995976 - DNA, 16 bp, Homo sapiens
actgttcttttgcatt

SEQ ID NO: 995977 - DNA, 14 bp, Homo sapiens
actgttgaaaatta

SEQ ID NO: 995978 - DNA, 23 bp, Homo sapiens
actgttgaaaattattttaaaca

SEQ ID NO: 995979 - DNA, 18 bp, Homo sapiens
actgttgagccccagtgc

SEQ ID NO: 995980 - DNA, 21 bp, Homo sapiens
actgttgagccccagtgctgg

SEQ ID NO: 995981 - DNA, 12 bp, Homo sapiens
actgttgataca

SEQ ID NO: 995982 - DNA, 17 bp, Homo sapiens
actgttgatacaaacca

SEQ ID NO: 995983 - DNA, 15 bp, Homo sapiens
actgttgatgtatct

SEQ ID NO: 995984 - DNA, 15 bp, Homo sapiens
actgttgcacagcca

SEQ ID NO: 995985 - DNA, 12 bp, Homo sapiens
actgttgcattt

SEQ ID NO: 995986 - DNA, 15 bp, Homo sapiens
actgttgcatttact

SEQ ID NO: 995987 - DNA, 21 bp, Homo sapiens
actgttgccccccagggtcct

SEQ ID NO: 995988 - DNA, 21 bp, Homo sapiens
actgttgctcaaatctattca

SEQ ID NO: 995989 - DNA, 21 bp, Homo sapiens
actgttgctttaatatgagct

SEQ ID NO: 995990 - DNA, 12 bp, Homo sapiens
actgttggaatg

SEQ ID NO: 995991 - DNA, 15 bp, Homo sapiens
acttacaatttgcac

SEQ ID NO: 995992 - DNA, 16 bp, Homo sapiens
acttacacttggagcc

SEQ ID NO: 995993 - DNA, 22 bp, Homo sapiens
acttacataaagctcccttgaa

SEQ ID NO: 995994 - DNA, 14 bp, Homo sapiens
agaaagaaaaggca

SEQ ID NO: 995995 - DNA, 17 bp, Homo sapiens
agaaagaaaaggcaaaa

SEQ ID NO: 995996 - DNA, 23 bp, Homo sapiens
agaaagaaactaaacagaaaact

SEQ ID NO: 995997 - DNA, 15 bp, Homo sapiens
agaaagaaagggaaa

SEQ ID NO: 995998 - DNA, 12 bp, Homo sapiens
agaaagaagaga

SEQ ID NO: 995999 - DNA, 17 bp, Homo sapiens
agaaagaagcagttctc

SEQ ID NO: 996000 - DNA, 20 bp, Homo sapiens
agaaagaagcagttctcaca

SEQ ID NO: 996001 - DNA, 14 bp, Homo sapiens
agaaagaagccata

SEQ ID NO: 996002 - DNA, 18 bp, Homo sapiens
agaaagaaggaagtgaag

SEQ ID NO: 996003 - DNA, 15 bp, Homo sapiens
agaaagaagtggaga

SEQ ID NO: 996004 - DNA, 17 bp, Homo sapiens
agaaagaattaaaaact

SEQ ID NO: 996005 - DNA, 22 bp, Homo sapiens
agaaagaccatgcatttaaagt

SEQ ID NO: 996006 - DNA, 23 bp, Homo sapiens
agaaagaccatgcatttaaagta

SEQ ID NO: 996007 - DNA, 22 bp, Homo sapiens
agaaagactatctaaatgttga

SEQ ID NO: 996008 - DNA, 13 bp, Homo sapiens
agaaagagaatga

SEQ ID NO: 996009 - DNA, 13 bp, Homo sapiens
agaaagagcactt

SEQ ID NO: 996010 - DNA, 12 bp, Homo sapiens
agaaagagctac

SEQ ID NO: 996011 - DNA, 19 bp, Homo sapiens
agaaagagggaaaaagagc

SEQ ID NO: 996012 - DNA, 21 bp, Homo sapiens
agaaagagggtcccagggctg

SEQ ID NO: 996013 - DNA, 13 bp, Homo sapiens
agaaagatccacc

SEQ ID NO: 996014 - DNA, 22 bp, Homo sapiens
agaaagatccaccctcaaatgt

SEQ ID NO: 996015 - DNA, 14 bp, Homo sapiens
agaaagatgacaaa

SEQ ID NO: 996016 - DNA, 14 bp, Homo sapiens
agaaagatgtatat

SEQ ID NO: 996017 - DNA, 19 bp, Homo sapiens
agaaagatttgttactgta

SEQ ID NO: 996018 - DNA, 21 bp, Homo sapiens
agaaagcaagtgtttttgtat

SEQ ID NO: 996019 - DNA, 18 bp, Homo sapiens
agaaagcacctgttttta

SEQ ID NO: 996020 - DNA, 18 bp, Homo sapiens
agaaagcatatcccacca

SEQ ID NO: 996021 - DNA, 16 bp, Homo sapiens
agaaagcatattgact

SEQ ID NO: 996022 - DNA, 17 bp, Homo sapiens
agaaagcattttgggat

SEQ ID NO: 996023 - DNA, 17 bp, Homo sapiens
agaaagccaagggcagt

SEQ ID NO: 996024 - DNA, 19 bp, Homo sapiens
agaaagccaccttgttaca

SEQ ID NO: 996025 - DNA, 14 bp, Homo sapiens
agaaagccagacaa

SEQ ID NO: 996026 - DNA, 19 bp, Homo sapiens
agaaagccatattccagca

SEQ ID NO: 996027 - DNA, 22 bp, Homo sapiens
agaaagccatattccagcagtg

SEQ ID NO: 996028 - DNA, 17 bp, Homo sapiens
agaaagcccacctgggc

SEQ ID NO: 996029 - DNA, 20 bp, Homo sapiens
agaaagcctgggtgacattt

SEQ ID NO: 996030 - DNA, 21 bp, Homo sapiens
agaaagcctgggtgacatttg

SEQ ID NO: 996031 - DNA, 20 bp, Homo sapiens
agaaagcctgttcccctcac

SEQ ID NO: 996032 - DNA, 22 bp, Homo sapiens
agaaagcctgttcccctcactg

SEQ ID NO: 996033 - DNA, 18 bp, Homo sapiens
agaaagctccttccagac

SEQ ID NO: 996034 - DNA, 20 bp, Homo sapiens
agaaagctgaggaacaggtt

SEQ ID NO: 996035 - DNA, 13 bp, Homo sapiens
agaaagctgcctg

SEQ ID NO: 996036 - DNA, 13 bp, Homo sapiens
agaaagctgcgga

SEQ ID NO: 996037 - DNA, 19 bp, Homo sapiens
agaaagctggtaaactatt

SEQ ID NO: 996038 - DNA, 20 bp, Homo sapiens
agaaagctggtaaactattt

SEQ ID NO: 996039 - DNA, 16 bp, Homo sapiens
agaaaggaaaacctga

SEQ ID NO: 996040 - DNA, 14 bp, Homo sapiens
agaaaggaaaagaa

SEQ ID NO: 996041 - DNA, 15 bp, Homo sapiens
agaaaggaaaccttt

SEQ ID NO: 996042 - DNA, 21 bp, Homo sapiens
agaaaggaaaccttttcttgt

SEQ ID NO: 996043 - DNA, 16 bp, Homo sapiens
agaaaggaacctggga

SEQ ID NO: 996044 - DNA, 14 bp, Homo sapiens
agaaaggaggggag

SEQ ID NO: 996045 - DNA, 14 bp, Homo sapiens
agaaaggatattta

SEQ ID NO: 996046 - DNA, 18 bp, Homo sapiens
agaaaggatatttaagaa

SEQ ID NO: 996047 - DNA, 12 bp, Homo sapiens
agaaaggcaggt

SEQ ID NO: 996048 - DNA, 16 bp, Homo sapiens
agaaaggcaggtttca

SEQ ID NO: 996049 - DNA, 15 bp, Homo sapiens
agaaaggctgttaaa

SEQ ID NO: 996050 - DNA, 22 bp, Homo sapiens
agaaaggctgttaaatacagga

SEQ ID NO: 996051 - DNA, 19 bp, Homo sapiens
agaaagggaaactggctga

SEQ ID NO: 996052 - DNA, 15 bp, Homo sapiens
agaaagggaggccca

SEQ ID NO: 996053 - DNA, 15 bp, Homo sapiens
agaaagggcagagga

SEQ ID NO: 996054 - DNA, 21 bp, Homo sapiens
agaaagggtgccagttgggct

SEQ ID NO: 996055 - DNA, 17 bp, Homo sapiens
agaaagggtgtttttct

SEQ ID NO: 996056 - DNA, 22 bp, Homo sapiens
agaaagtaagcatttccagcct

SEQ ID NO: 996057 - DNA, 16 bp, Homo sapiens
agaaagtaagtctttt

SEQ ID NO: 996058 - DNA, 15 bp, Homo sapiens
agaaagtagaggcat

SEQ ID NO: 996059 - DNA, 21 bp, Homo sapiens
agaaagtcgaattaatagctt

SEQ ID NO: 996060 - DNA, 15 bp, Homo sapiens
agaaagtgatttcta

SEQ ID NO: 996061 - DNA, 15 bp, Homo sapiens
agaaagtgcctgaca

SEQ ID NO: 996062 - DNA, 16 bp, Homo sapiens
agaaagtgtatttgga

SEQ ID NO: 996063 - DNA, 16 bp, Homo sapiens
agaaagtgtgagcaaa

SEQ ID NO: 996064 - DNA, 23 bp, Homo sapiens
agaaagtgtgagcaaactaactt

SEQ ID NO: 996065 - DNA, 21 bp, Homo sapiens
agaaagtgtgggtttggttag

SEQ ID NO: 996066 - DNA, 17 bp, Homo sapiens
agaaagtgtgtgtgttc

SEQ ID NO: 996067 - DNA, 20 bp, Homo sapiens
agaaagtgtgtgtgttctgt

SEQ ID NO: 996068 - DNA, 20 bp, Homo sapiens
agaaagttccaaatgtttat

SEQ ID NO: 996069 - DNA, 22 bp, Homo sapiens
agaaagttgcaaggcaaatgtt

SEQ ID NO: 996070 - DNA, 22 bp, Homo sapiens
agaaataaaaatcaacttgtgt

SEQ ID NO: 996071 - DNA, 20 bp, Homo sapiens
agaaataaaacaactctgat

SEQ ID NO: 996072 - DNA, 20 bp, Homo sapiens
agaaataaaaggaagccaaa

SEQ ID NO: 996073 - DNA, 13 bp, Homo sapiens
agaaataaaccaa

SEQ ID NO: 996074 - DNA, 23 bp, Homo sapiens
agaaataaaccaaaggaaaatgt

SEQ ID NO: 996075 - DNA, 17 bp, Homo sapiens
agaaataaaccttaata

SEQ ID NO: 996076 - DNA, 19 bp, Homo sapiens
agaaataaatagctatatc

SEQ ID NO: 996077 - DNA, 20 bp, Homo sapiens
agaaataaatcagagagcaa

SEQ ID NO: 996078 - DNA, 22 bp, Homo sapiens
agaaataaatcagagagcaagg

SEQ ID NO: 996079 - DNA, 17 bp, Homo sapiens
agaaataaatgaaactt

SEQ ID NO: 996080 - DNA, 14 bp, Homo sapiens
agaaataaattttg

SEQ ID NO: 996081 - DNA, 15 bp, Homo sapiens
agaaataaattttgt

SEQ ID NO: 996082 - DNA, 13 bp, Homo sapiens
agaaataacagaa

SEQ ID NO: 996083 - DNA, 13 bp, Homo sapiens
agaaataagtttt

SEQ ID NO: 996084 - DNA, 14 bp, Homo sapiens
agaaataagttttt

SEQ ID NO: 996085 - DNA, 14 bp, Homo sapiens
agaaataatatgca

SEQ ID NO: 996086 - DNA, 16 bp, Homo sapiens
agaaatacaaaataaa

SEQ ID NO: 996087 - DNA, 14 bp, Homo sapiens
agaaatacagtctt

SEQ ID NO: 996088 - DNA, 15 bp, Homo sapiens
agaaatactgctctg

SEQ ID NO: 996089 - DNA, 23 bp, Homo sapiens
agaaatactgctctgaatatttt

SEQ ID NO: 996090 - DNA, 14 bp, Homo sapiens
agaaatactgtaca

SEQ ID NO: 996091 - DNA, 16 bp, Homo sapiens
agaaatactgtacaat

SEQ ID NO: 996092 - DNA, 16 bp, Homo sapiens
agaaatacttgtgatt

SEQ ID NO: 996093 - DNA, 13 bp, Homo sapiens
agaaatagaacaa

SEQ ID NO: 996094 - DNA, 14 bp, Homo sapiens
agaaatagaacact

SEQ ID NO: 996095 - DNA, 13 bp, Homo sapiens
agaaatagacaaa

SEQ ID NO: 996096 - DNA, 17 bp, Homo sapiens
agaaatagacaaaaagt

SEQ ID NO: 996097 - DNA, 16 bp, Homo sapiens
agaaataggtatcaaa

SEQ ID NO: 996098 - DNA, 15 bp, Homo sapiens
agaaatagtcggtga

SEQ ID NO: 996099 - DNA, 14 bp, Homo sapiens
agaaatataattga

SEQ ID NO: 996100 - DNA, 21 bp, Homo sapiens
agaaatatacagtttgacttt

SEQ ID NO: 996101 - DNA, 23 bp, Homo sapiens
agaaatataggatagacactgga

SEQ ID NO: 996102 - DNA, 15 bp, Homo sapiens
agaaatatagtgcaa

SEQ ID NO: 996103 - DNA, 20 bp, Homo sapiens
agaaatatctgaaaatgtat

SEQ ID NO: 996104 - DNA, 12 bp, Homo sapiens
agaaatatctgt

SEQ ID NO: 996105 - DNA, 19 bp, Homo sapiens
agaaatatctgtgaaatat

SEQ ID NO: 996106 - DNA, 20 bp, Homo sapiens
agaaatatgaaattccagca

SEQ ID NO: 996107 - DNA, 15 bp, Homo sapiens
agaaatattttaaaa

SEQ ID NO: 996108 - DNA, 17 bp, Homo sapiens
agaaatattttaaaatc

SEQ ID NO: 996109 - DNA, 17 bp, Homo sapiens
agaaatcacagaatcat

SEQ ID NO: 996110 - DNA, 14 bp, Homo sapiens
agaaatcactgtga

SEQ ID NO: 996111 - DNA, 15 bp, Homo sapiens
agaaatcactgtgaa

SEQ ID NO: 996112 - DNA, 16 bp, Homo sapiens
agaaatcactgtgaaa

SEQ ID NO: 996113 - DNA, 15 bp, Homo sapiens
agaaatcgagagtgt

SEQ ID NO: 996114 - DNA, 15 bp, Homo sapiens
agaaatctaagctgt

SEQ ID NO: 996115 - DNA, 19 bp, Homo sapiens
agaaatctagaatttttac

SEQ ID NO: 996116 - DNA, 13 bp, Homo sapiens
agaaatctatctt

SEQ ID NO: 996117 - DNA, 14 bp, Homo sapiens
agaaatctgtttca

SEQ ID NO: 996118 - DNA, 17 bp, Homo sapiens
agaaatgaacaaaagat

SEQ ID NO: 996119 - DNA, 16 bp, Homo sapiens
agaaatgaataagctt

SEQ ID NO: 996120 - DNA, 22 bp, Homo sapiens
agaaatgcatatttgccacaaa

SEQ ID NO: 996121 - DNA, 18 bp, Homo sapiens
agaaatgcatccattcct

SEQ ID NO: 996122 - DNA, 16 bp, Homo sapiens
agaaatgccagaaaca

SEQ ID NO: 996123 - DNA, 21 bp, Homo sapiens
agaaatgctggtttttcagtt

SEQ ID NO: 996124 - DNA, 15 bp, Homo sapiens
agaaatggacaaaga

SEQ ID NO: 996125 - DNA, 20 bp, Homo sapiens
agaaatggcgtctgctctgg

SEQ ID NO: 996126 - DNA, 16 bp, Homo sapiens
agaaatgggcagttct

SEQ ID NO: 996127 - DNA, 19 bp, Homo sapiens
agaaatgggcctgcctgcc

SEQ ID NO: 996128 - DNA, 23 bp, Homo sapiens
agaaatgggcctgcctgcctcca

SEQ ID NO: 996129 - DNA, 15 bp, Homo sapiens
agaaatgtaaatgtt

SEQ ID NO: 996130 - DNA, 20 bp, Homo sapiens
agaaatgtctaaatgctgaa

SEQ ID NO: 996131 - DNA, 21 bp, Homo sapiens
agaaattaatatattagtgaa

SEQ ID NO: 996132 - DNA, 19 bp, Homo sapiens
agaaattacctgtggatat

SEQ ID NO: 996133 - DNA, 15 bp, Homo sapiens
agaaattagccgggc

SEQ ID NO: 996134 - DNA, 17 bp, Homo sapiens
agaaattagctgtgtga

SEQ ID NO: 996135 - DNA, 19 bp, Homo sapiens
agaaattcaatttggattt

SEQ ID NO: 996136 - DNA, 19 bp, Homo sapiens
agaaattccaactcctgat

SEQ ID NO: 996137 - DNA, 19 bp, Homo sapiens
agaaattcctgtagcatct

SEQ ID NO: 996138 - DNA, 20 bp, Homo sapiens
agaaattcctgtagcatctt

SEQ ID NO: 996139 - DNA, 18 bp, Homo sapiens
agaaattctgaagagagt

SEQ ID NO: 996140 - DNA, 21 bp, Homo sapiens
agaaattctgtcatagaaagt

SEQ ID NO: 996141 - DNA, 23 bp, Homo sapiens
agaaattctgtcatagaaagtgc

SEQ ID NO: 996142 - DNA, 17 bp, Homo sapiens
agaaattgcatttcctg

SEQ ID NO: 996143 - DNA, 20 bp, Homo sapiens
agaaattgcatttcctgaca

SEQ ID NO: 996144 - DNA, 19 bp, Homo sapiens
agaaattggaacagaatgt

SEQ ID NO: 996145 - DNA, 16 bp, Homo sapiens
agaaattggtacatag

SEQ ID NO: 996146 - DNA, 20 bp, Homo sapiens
agaaattgtatattgtaatt

SEQ ID NO: 996147 - DNA, 21 bp, Homo sapiens
agaaattgtatattgtaattt

SEQ ID NO: 996148 - DNA, 16 bp, Homo sapiens
agaaatttaaactata

SEQ ID NO: 996149 - DNA, 21 bp, Homo sapiens
agaaatttaattcatgtttct

SEQ ID NO: 996150 - DNA, 14 bp, Homo sapiens
agaaatttccagag

SEQ ID NO: 996151 - DNA, 22 bp, Homo sapiens
agaaattttacaataggtgctt

SEQ ID NO: 996152 - DNA, 13 bp, Homo sapiens
agaaattttcaag

SEQ ID NO: 996153 - DNA, 13 bp, Homo sapiens
agaaattttgtaa

SEQ ID NO: 996154 - DNA, 17 bp, Homo sapiens
agaaattttgtaagaag

SEQ ID NO: 996155 - DNA, 21 bp, Homo sapiens
agaaattttgtaagaaggcaa

SEQ ID NO: 996156 - DNA, 22 bp, Homo sapiens
agaaattttgtaagaaggcaat

SEQ ID NO: 996157 - DNA, 21 bp, Homo sapiens
agaaatttttcagatgcttct

SEQ ID NO: 996158 - DNA, 22 bp, Homo sapiens
agaaatttttcagatgcttctg

SEQ ID NO: 996159 - DNA, 21 bp, Homo sapiens
agaacaaaaaaatctgcagaa

SEQ ID NO: 996160 - DNA, 12 bp, Homo sapiens
agaacaaacaaa

SEQ ID NO: 996161 - DNA, 14 bp, Homo sapiens
agaacaaaggacag

SEQ ID NO: 996162 - DNA, 21 bp, Homo sapiens
agaacaaaggacagagtatga

SEQ ID NO: 996163 - DNA, 22 bp, Homo sapiens
agaacaaaggacagagtatgaa

SEQ ID NO: 996164 - DNA, 14 bp, Homo sapiens
agaacaaatgtgtt

SEQ ID NO: 996165 - DNA, 21 bp, Homo sapiens
agaacaaatgtgtttttctat

SEQ ID NO: 996166 - DNA, 16 bp, Homo sapiens
agaacaacttgctact

SEQ ID NO: 996167 - DNA, 18 bp, Homo sapiens
agaacaactttagcatca

SEQ ID NO: 996168 - DNA, 20 bp, Homo sapiens
agaacaagagtttgttctgt

SEQ ID NO: 996169 - DNA, 21 bp, Homo sapiens
agaacaaggcaccttcttaaa

SEQ ID NO: 996170 - DNA, 19 bp, Homo sapiens
agaacaaggtagtttttac

SEQ ID NO: 996171 - DNA, 22 bp, Homo sapiens
agaacaagtcacagctgcagct

SEQ ID NO: 996172 - DNA, 18 bp, Homo sapiens
agaacaagtgcctcctgg

SEQ ID NO: 996173 - DNA, 13 bp, Homo sapiens
agaacaatcacta

SEQ ID NO: 996174 - DNA, 18 bp, Homo sapiens
agaacaatcactattctt

SEQ ID NO: 996175 - DNA, 19 bp, Homo sapiens
agaacacaaaacttgaaag

SEQ ID NO: 996176 - DNA, 15 bp, Homo sapiens
agaacacaaagcggg

SEQ ID NO: 996177 - DNA, 16 bp, Homo sapiens
agaacacaaatgtcta

SEQ ID NO: 996178 - DNA, 12 bp, Homo sapiens
agaacacacaga

SEQ ID NO: 996179 - DNA, 15 bp, Homo sapiens
agaacacacagactt

SEQ ID NO: 996180 - DNA, 18 bp, Homo sapiens
agaacacacagactttct

SEQ ID NO: 996181 - DNA, 19 bp, Homo sapiens
agaacacacagactttctg

SEQ ID NO: 996182 - DNA, 15 bp, Homo sapiens
agaacacagcatgtg

SEQ ID NO: 996183 - DNA, 20 bp, Homo sapiens
agaacacagcatgtgccaag

SEQ ID NO: 996184 - DNA, 17 bp, Homo sapiens
agaacacctatgcaaag

SEQ ID NO: 996185 - DNA, 21 bp, Homo sapiens
agaacacctgccttctaccct

SEQ ID NO: 996186 - DNA, 14 bp, Homo sapiens
agaacacgcgtatt

SEQ ID NO: 996187 - DNA, 18 bp, Homo sapiens
agaacacggctcacgctt

SEQ ID NO: 996188 - DNA, 16 bp, Homo sapiens
agaacacgttgccagg

SEQ ID NO: 996189 - DNA, 19 bp, Homo sapiens
agaacactaattcataatc

SEQ ID NO: 996190 - DNA, 16 bp, Homo sapiens
agaacactgcctctga

SEQ ID NO: 996191 - DNA, 11 bp, Homo sapiens
agaacactggt

SEQ ID NO: 996192 - DNA, 17 bp, Homo sapiens
agaacacttcagacaca

SEQ ID NO: 996193 - DNA, 14 bp, Homo sapiens
agaacagaaaacaa

SEQ ID NO: 996194 - DNA, 15 bp, Homo sapiens
agaacagagggccag

SEQ ID NO: 996195 - DNA, 19 bp, Homo sapiens
agaacagagggccagagct

SEQ ID NO: 996196 - DNA, 18 bp, Homo sapiens
agaacagatgctgagcca

SEQ ID NO: 996197 - DNA, 18 bp, Homo sapiens
agaacagcagaggttctt

SEQ ID NO: 996198 - DNA, 18 bp, Homo sapiens
agaacagcatatgatttc

SEQ ID NO: 996199 - DNA, 18 bp, Homo sapiens
agaacagccgctcctgtc

SEQ ID NO: 996200 - DNA, 18 bp, Homo sapiens
agaacagctgttcctgtg

SEQ ID NO: 996201 - DNA, 20 bp, Homo sapiens
agaacaggcttggcaaagaa

SEQ ID NO: 996202 - DNA, 13 bp, Homo sapiens
agaacagtaaaca

SEQ ID NO: 996203 - DNA, 14 bp, Homo sapiens
agaacagtaaacat

SEQ ID NO: 996204 - DNA, 21 bp, Homo sapiens
agaacagtttcatcaggacca

SEQ ID NO: 996205 - DNA, 18 bp, Homo sapiens
agaacatacactgtgaac

SEQ ID NO: 996206 - DNA, 14 bp, Homo sapiens
agaacatactgatt

SEQ ID NO: 996207 - DNA, 21 bp, Homo sapiens
agaacatagacagaagaaaca

SEQ ID NO: 996208 - DNA, 16 bp, Homo sapiens
agaacatcattagaac

SEQ ID NO: 996209 - DNA, 15 bp, Homo sapiens
agaacatccaaggag

SEQ ID NO: 996210 - DNA, 14 bp, Homo sapiens
agaacatccctggg

SEQ ID NO: 996211 - DNA, 16 bp, Homo sapiens
agaacatccctgggca

SEQ ID NO: 996212 - DNA, 19 bp, Homo sapiens
agaacatggacttgtatat

SEQ ID NO: 996213 - DNA, 18 bp, Homo sapiens
agaacattcacttttgtt

SEQ ID NO: 996214 - DNA, 20 bp, Homo sapiens
agaaccaaaagttttcctga

SEQ ID NO: 996215 - DNA, 16 bp, Homo sapiens
agaaccaaagaagaaa

SEQ ID NO: 996216 - DNA, 15 bp, Homo sapiens
agaaccaaatacctc

SEQ ID NO: 996217 - DNA, 16 bp, Homo sapiens
agaaccaaatacctca

SEQ ID NO: 996218 - DNA, 13 bp, Homo sapiens
agaaccaaatctg

SEQ ID NO: 996219 - DNA, 24 bp, Homo sapiens
agaaccagattctatcctcatctt

SEQ ID NO: 996220 - DNA, 13 bp, Homo sapiens
agaaccagcccag

SEQ ID NO: 996221 - DNA, 14 bp, Homo sapiens
agaaccagcccagc

SEQ ID NO: 996222 - DNA, 15 bp, Homo sapiens
agaaccagcccagcc

SEQ ID NO: 996223 - DNA, 17 bp, Homo sapiens
agaaccagcccagcctg

SEQ ID NO: 996224 - DNA, 18 bp, Homo sapiens
agaaccagcccagcctgc

SEQ ID NO: 996225 - DNA, 19 bp, Homo sapiens
agaaccagcccagcctgcc

SEQ ID NO: 996226 - DNA, 19 bp, Homo sapiens
agaaccagccgtattttac

SEQ ID NO: 996227 - DNA, 16 bp, Homo sapiens
agaaccaggctacaag

SEQ ID NO: 996228 - DNA, 20 bp, Homo sapiens
agaaccatttaagagactct

SEQ ID NO: 996229 - DNA, 15 bp, Homo sapiens
agaacccaagtgcct

SEQ ID NO: 996230 - DNA, 16 bp, Homo sapiens
agaacccaagtgcctc

SEQ ID NO: 996231 - DNA, 13 bp, Homo sapiens
agaacccagggct

SEQ ID NO: 996232 - DNA, 19 bp, Homo sapiens
agaacccagggctctgccc

SEQ ID NO: 996233 - DNA, 21 bp, Homo sapiens
agaacccagggctctgcccca

SEQ ID NO: 996234 - DNA, 19 bp, Homo sapiens
agaacccctacatgaaaca

SEQ ID NO: 996235 - DNA, 20 bp, Homo sapiens
agaaccgagcaaagatcaaa

SEQ ID NO: 996236 - DNA, 21 bp, Homo sapiens
agaaccgagcaaagatcaaaa

SEQ ID NO: 996237 - DNA, 17 bp, Homo sapiens
agaacctactgttcctt

SEQ ID NO: 996238 - DNA, 16 bp, Homo sapiens
agaacctatctttaaa

SEQ ID NO: 996239 - DNA, 12 bp, Homo sapiens
agaacctcaggc

SEQ ID NO: 996240 - DNA, 20 bp, Homo sapiens
agaacctgcacacaggacag

SEQ ID NO: 996241 - DNA, 21 bp, Homo sapiens
agaacctgcacacaggacagc

SEQ ID NO: 996242 - DNA, 21 bp, Homo sapiens
agaacctggaaaaattccaga

SEQ ID NO: 996243 - DNA, 22 bp, Homo sapiens
agaaccttgcctgaacatcctt

SEQ ID NO: 996244 - DNA, 15 bp, Homo sapiens
agaaccttgtcccag

SEQ ID NO: 996245 - DNA, 13 bp, Homo sapiens
agaacgcacccca

SEQ ID NO: 996246 - DNA, 21 bp, Homo sapiens
agaacgcaccccactgggaga

SEQ ID NO: 996247 - DNA, 18 bp, Homo sapiens
agaacgccagtctcccag

SEQ ID NO: 996248 - DNA, 23 bp, Homo sapiens
agaacgggcgtcaggggtgcaca

SEQ ID NO: 996249 - DNA, 17 bp, Homo sapiens
agaacgtggctctgctg

SEQ ID NO: 996250 - DNA, 13 bp, Homo sapiens
agaacgtggtcag

SEQ ID NO: 996251 - DNA, 20 bp, Homo sapiens
agaacgttttttcctcagtg

SEQ ID NO: 996252 - DNA, 19 bp, Homo sapiens
agaactaaactagtttttc

SEQ ID NO: 996253 - DNA, 15 bp, Homo sapiens
agaactaactttggt

SEQ ID NO: 996254 - DNA, 16 bp, Homo sapiens
agaactactaaagtgc

SEQ ID NO: 996255 - DNA, 19 bp, Homo sapiens
agaactatatgtgaatcct

SEQ ID NO: 996256 - DNA, 21 bp, Homo sapiens
agaactatatgtgaatcctct

SEQ ID NO: 996257 - DNA, 19 bp, Homo sapiens
agaactatctgcattatct

SEQ ID NO: 996258 - DNA, 18 bp, Homo sapiens
agaactatttaaaataaa

SEQ ID NO: 996259 - DNA, 19 bp, Homo sapiens
agaactcactctgggctgt

SEQ ID NO: 996260 - DNA, 16 bp, Homo sapiens
agaactcagcagttga

SEQ ID NO: 996261 - DNA, 17 bp, Homo sapiens
agaactccttattttgt

SEQ ID NO: 996262 - DNA, 21 bp, Homo sapiens
agaactccttattttgtatta

SEQ ID NO: 996263 - DNA, 12 bp, Homo sapiens
agaactcgatgc

SEQ ID NO: 996264 - DNA, 17 bp, Homo sapiens
agaactcgatgcactga

SEQ ID NO: 996265 - DNA, 20 bp, Homo sapiens
agaactcgcgctcagtaaac

SEQ ID NO: 996266 - DNA, 20 bp, Homo sapiens
agaactctctccctggtctc

SEQ ID NO: 996267 - DNA, 20 bp, Homo sapiens
agaactctgggctgccatgt

SEQ ID NO: 996268 - DNA, 14 bp, Homo sapiens
agaactctttcaaa

SEQ ID NO: 996269 - DNA, 22 bp, Homo sapiens
agaactgaagccacttggccca

SEQ ID NO: 996270 - DNA, 12 bp, Homo sapiens
agaactgacaaa

SEQ ID NO: 996271 - DNA, 22 bp, Homo sapiens
agaactgacaaaggagccttga

SEQ ID NO: 996272 - DNA, 12 bp, Homo sapiens
agaactgagctc

SEQ ID NO: 996273 - DNA, 18 bp, Homo sapiens
agaactgcagacctcact

SEQ ID NO: 996274 - DNA, 19 bp, Homo sapiens
agaactgcagacctcactg

SEQ ID NO: 996275 - DNA, 20 bp, Homo sapiens
agaactgcagacctcactgt

SEQ ID NO: 996276 - DNA, 21 bp, Homo sapiens
agaactgcagatagcccagga

SEQ ID NO: 996277 - DNA, 22 bp, Homo sapiens
agaactgcagatagcccaggag

SEQ ID NO: 996278 - DNA, 15 bp, Homo sapiens
agaactgcagggcct

SEQ ID NO: 996279 - DNA, 15 bp, Homo sapiens
agaactgcatatgtt

SEQ ID NO: 996280 - DNA, 21 bp, Homo sapiens
agaactgcatatgtttcgctg

SEQ ID NO: 996281 - DNA, 17 bp, Homo sapiens
agaactgcatggaccta

SEQ ID NO: 996282 - DNA, 19 bp, Homo sapiens
agaactgcatgtggcttct

SEQ ID NO: 996283 - DNA, 17 bp, Homo sapiens
agaactgccattatttt

SEQ ID NO: 996284 - DNA, 20 bp, Homo sapiens
agaactgccattattttctg

SEQ ID NO: 996285 - DNA, 16 bp, Homo sapiens
agaactggctgggccc

SEQ ID NO: 996286 - DNA, 23 bp, Homo sapiens
agaactggctgggcccctgggga

SEQ ID NO: 996287 - DNA, 13 bp, Homo sapiens
agaactgtacatt

SEQ ID NO: 996288 - DNA, 16 bp, Homo sapiens
agaactgtacattgtg

SEQ ID NO: 996289 - DNA, 22 bp, Homo sapiens
agaactgtacattgtgagctct

SEQ ID NO: 996290 - DNA, 22 bp, Homo sapiens
agaactgtccacatctgcctcc

SEQ ID NO: 996291 - DNA, 12 bp, Homo sapiens
agaactgtccca

SEQ ID NO: 996292 - DNA, 14 bp, Homo sapiens
agaactgtctgtga

SEQ ID NO: 996293 - DNA, 20 bp, Homo sapiens
agaactgtgaaatttacaaa

SEQ ID NO: 996294 - DNA, 14 bp, Homo sapiens
agaacttcagaaag

SEQ ID NO: 996295 - DNA, 16 bp, Homo sapiens
agaacttcagaaagac

SEQ ID NO: 996296 - DNA, 16 bp, Homo sapiens
agaacttcatttttaa

SEQ ID NO: 996297 - DNA, 15 bp, Homo sapiens
agaacttctgcctct

SEQ ID NO: 996298 - DNA, 18 bp, Homo sapiens
agaacttgaatgtgtcag

SEQ ID NO: 996299 - DNA, 21 bp, Homo sapiens
agaactttaaagctcaggagg

SEQ ID NO: 996300 - DNA, 22 bp, Homo sapiens
agaactttaaagctcaggaggg

SEQ ID NO: 996301 - DNA, 13 bp, Homo sapiens
agaagaaaaagaa

SEQ ID NO: 996302 - DNA, 12 bp, Homo sapiens
agaagaaaacag

SEQ ID NO: 996303 - DNA, 13 bp, Homo sapiens
agaagaaacaagg

SEQ ID NO: 996304 - DNA, 23 bp, Homo sapiens
agaagaaactttgcctcaagact

SEQ ID NO: 996305 - DNA, 14 bp, Homo sapiens
agaagaaataaata

SEQ ID NO: 996306 - DNA, 13 bp, Homo sapiens
agaagaaatatga

SEQ ID NO: 996307 - DNA, 13 bp, Homo sapiens
agaagaaattagg

SEQ ID NO: 996308 - DNA, 23 bp, Homo sapiens
agaagaaccaaatacctcaattt

SEQ ID NO: 996309 - DNA, 15 bp, Homo sapiens
agaagaaccagccca

SEQ ID NO: 996310 - DNA, 21 bp, Homo sapiens
agaagaaccagcccagcctgc

SEQ ID NO: 996311 - DNA, 19 bp, Homo sapiens
agaagaactatatgtgaat

SEQ ID NO: 996312 - DNA, 21 bp, Homo sapiens
agaagaacttgcatggagcag

SEQ ID NO: 996313 - DNA, 12 bp, Homo sapiens
agaagaagaatt

SEQ ID NO: 996314 - DNA, 18 bp, Homo sapiens
agaagaagagaagctgct

SEQ ID NO: 996315 - DNA, 16 bp, Homo sapiens
agaagaagtcagagag

SEQ ID NO: 996316 - DNA, 19 bp, Homo sapiens
agaagaagtgggagcagct

SEQ ID NO: 996317 - DNA, 22 bp, Homo sapiens
agaagaagtttcatcatttttt

SEQ ID NO: 996318 - DNA, 14 bp, Homo sapiens
agaagaatatcaaa

SEQ ID NO: 996319 - DNA, 21 bp, Homo sapiens
agaagaatatcaaataataaa

SEQ ID NO: 996320 - DNA, 22 bp, Homo sapiens
agaagaatatcaaataataaag

SEQ ID NO: 996321 - DNA, 23 bp, Homo sapiens
agaagaatggctttcaataccct

SEQ ID NO: 996322 - DNA, 13 bp, Homo sapiens
agaagaattttat

SEQ ID NO: 996323 - DNA, 19 bp, Homo sapiens
agaagacatactgcttgat

SEQ ID NO: 996324 - DNA, 12 bp, Homo sapiens
agaagacatgaa

SEQ ID NO: 996325 - DNA, 19 bp, Homo sapiens
agaagacatggagactcct

SEQ ID NO: 996326 - DNA, 22 bp, Homo sapiens
agaagacatggagactcctgcc

SEQ ID NO: 996327 - DNA, 10 bp, Homo sapiens
agaagacatt

SEQ ID NO: 996328 - DNA, 11 bp, Homo sapiens
agaagacattt

SEQ ID NO: 996329 - DNA, 12 bp, Homo sapiens
agaagacatttt

SEQ ID NO: 996330 - DNA, 17 bp, Homo sapiens
agaagacattttgttac

SEQ ID NO: 996331 - DNA, 15 bp, Homo sapiens
agaagacctagctat

SEQ ID NO: 996332 - DNA, 17 bp, Homo sapiens
agaagacctgagaatgt

SEQ ID NO: 996333 - DNA, 18 bp, Homo sapiens
agaagagactctttgcat

SEQ ID NO: 996334 - DNA, 19 bp, Homo sapiens
agaagagagccagtaactt

SEQ ID NO: 996335 - DNA, 20 bp, Homo sapiens
agaagagatgggcttgtttt

SEQ ID NO: 996336 - DNA, 21 bp, Homo sapiens
agaagagattgtggtttcatt

SEQ ID NO: 996337 - DNA, 17 bp, Homo sapiens
agaagagccctggacac

SEQ ID NO: 996338 - DNA, 14 bp, Homo sapiens
agaagagcgcagtg

SEQ ID NO: 996339 - DNA, 23 bp, Homo sapiens
agaagagcgcagtgttttgcaag

SEQ ID NO: 996340 - DNA, 14 bp, Homo sapiens
agaagaggaagaaa

SEQ ID NO: 996341 - DNA, 20 bp, Homo sapiens
agaagagggcccagcccaga

SEQ ID NO: 996342 - DNA, 15 bp, Homo sapiens
agaagagggtgtgtt

SEQ ID NO: 996343 - DNA, 18 bp, Homo sapiens
agaagataatcattgctt

SEQ ID NO: 996344 - DNA, 20 bp, Homo sapiens
agaagatcaacgcctcactg

SEQ ID NO: 996345 - DNA, 22 bp, Homo sapiens
agaagatctaccccagggagaa

SEQ ID NO: 996346 - DNA, 12 bp, Homo sapiens
agaagatgaaaa

SEQ ID NO: 996347 - DNA, 22 bp, Homo sapiens
agaagatgaaaatggaagtggc

SEQ ID NO: 996348 - DNA, 13 bp, Homo sapiens
agaagatgagcct

SEQ ID NO: 996349 - DNA, 22 bp, Homo sapiens
agaagatgccagcttctctctc

SEQ ID NO: 996350 - DNA, 22 bp, Homo sapiens
agaagatgccctccaatccttt

SEQ ID NO: 996351 - DNA, 16 bp, Homo sapiens
agaagatggactctga

SEQ ID NO: 996352 - DNA, 19 bp, Homo sapiens
agaagatggcacttataac

SEQ ID NO: 996353 - DNA, 17 bp, Homo sapiens
agaagatggtgaagaca

SEQ ID NO: 996354 - DNA, 23 bp, Homo sapiens
agaagatggtgaagacagaaacc

SEQ ID NO: 996355 - DNA, 19 bp, Homo sapiens
agaagatttgatgctggag

SEQ ID NO: 996356 - DNA, 14 bp, Homo sapiens
agaagcaagggcaa

SEQ ID NO: 996357 - DNA, 15 bp, Homo sapiens
agaagcaagggcaag

SEQ ID NO: 996358 - DNA, 13 bp, Homo sapiens
agaagcaagtaaa

SEQ ID NO: 996359 - DNA, 20 bp, Homo sapiens
agaagcaataaagaagagtg

SEQ ID NO: 996360 - DNA, 21 bp, Homo sapiens
agaagcaataaagaagagtgc

SEQ ID NO: 996361 - DNA, 17 bp, Homo sapiens
agaagcaatctttgaaa

SEQ ID NO: 996362 - DNA, 21 bp, Homo sapiens
agaagcaattatttaaagaaa

SEQ ID NO: 996363 - DNA, 14 bp, Homo sapiens
agaagcacatgtgt

SEQ ID NO: 996364 - DNA, 15 bp, Homo sapiens
agaagcaccagcaat

SEQ ID NO: 996365 - DNA, 16 bp, Homo sapiens
agaagcactttgattg

SEQ ID NO: 996366 - DNA, 12 bp, Homo sapiens
agaagcagactt

SEQ ID NO: 996367 - DNA, 22 bp, Homo sapiens
agaagcagcccctcgaggccta

SEQ ID NO: 996368 - DNA, 15 bp, Homo sapiens
agaagcagggtaccc

SEQ ID NO: 996369 - DNA, 13 bp, Homo sapiens
agaagcagtgagc

SEQ ID NO: 996370 - DNA, 15 bp, Homo sapiens
agaagcatacaactt

SEQ ID NO: 996371 - DNA, 16 bp, Homo sapiens
agaagcatattttgct

SEQ ID NO: 996372 - DNA, 13 bp, Homo sapiens
agaagcatgaaaa

SEQ ID NO: 996373 - DNA, 16 bp, Homo sapiens
agaagcatgaaaaagc

SEQ ID NO: 996374 - DNA, 21 bp, Homo sapiens
agaagcattaacttctctgga

SEQ ID NO: 996375 - DNA, 16 bp, Homo sapiens
agaagcatttgtattt

SEQ ID NO: 996376 - DNA, 18 bp, Homo sapiens
agaagccacgctgtcctc

SEQ ID NO: 996377 - DNA, 14 bp, Homo sapiens
agaagccaggagca

SEQ ID NO: 996378 - DNA, 21 bp, Homo sapiens
agaagccatatatgaccagaa

SEQ ID NO: 996379 - DNA, 21 bp, Homo sapiens
agaagccatttagggcagcaa

SEQ ID NO: 996380 - DNA, 20 bp, Homo sapiens
agaagcccatgtcttctgct

SEQ ID NO: 996381 - DNA, 23 bp, Homo sapiens
agaagccccgacacacggggctc

SEQ ID NO: 996382 - DNA, 19 bp, Homo sapiens
agaagccccgcacgggctg

SEQ ID NO: 996383 - DNA, 14 bp, Homo sapiens
agaagccgggaaca

SEQ ID NO: 996384 - DNA, 19 bp, Homo sapiens
agaagcctccaagcacaga

SEQ ID NO: 996385 - DNA, 20 bp, Homo sapiens
agaagcctccaagcacagag

SEQ ID NO: 996386 - DNA, 13 bp, Homo sapiens
agaagcctctggc

SEQ ID NO: 996387 - DNA, 14 bp, Homo sapiens
agaagcctctggct

SEQ ID NO: 996388 - DNA, 11 bp, Homo sapiens
agaagcctgca

SEQ ID NO: 996389 - DNA, 21 bp, Homo sapiens
agaagccttaatttgcacagt

SEQ ID NO: 996390 - DNA, 12 bp, Homo sapiens
agaagccttcag

SEQ ID NO: 996391 - DNA, 16 bp, Homo sapiens
agaagcggctggcagc

SEQ ID NO: 996392 - DNA, 13 bp, Homo sapiens
agaagctaagctg

SEQ ID NO: 996393 - DNA, 20 bp, Homo sapiens
agaagctaatgtaggactgt

SEQ ID NO: 996394 - DNA, 23 bp, Homo sapiens
agaagctacccctcaaactgcac

SEQ ID NO: 996395 - DNA, 20 bp, Homo sapiens
agaagctataaattcctctt

SEQ ID NO: 996396 - DNA, 18 bp, Homo sapiens
agaagctcccaggaacaa

SEQ ID NO: 996397 - DNA, 13 bp, Homo sapiens
agaagctgaagcc

SEQ ID NO: 996398 - DNA, 17 bp, Homo sapiens
agaagctgaagcccccc

SEQ ID NO: 996399 - DNA, 18 bp, Homo sapiens
agaagctgaagcccccct

SEQ ID NO: 996400 - DNA, 11 bp, Homo sapiens
agaagctgcag

SEQ ID NO: 996401 - DNA, 12 bp, Homo sapiens
agaagctgcagg

SEQ ID NO: 996402 - DNA, 22 bp, Homo sapiens
agaagctgctccaggcctgcag

SEQ ID NO: 996403 - DNA, 13 bp, Homo sapiens
agaagctgctgac

SEQ ID NO: 996404 - DNA, 16 bp, Homo sapiens
agaagctttatttcta

SEQ ID NO: 996405 - DNA, 17 bp, Homo sapiens
agaaggaaaaagaaagt

SEQ ID NO: 996406 - DNA, 16 bp, Homo sapiens
agaaggaaaaatgtgt

SEQ ID NO: 996407 - DNA, 19 bp, Homo sapiens
agaaggaaaatgatctgag

SEQ ID NO: 996408 - DNA, 13 bp, Homo sapiens
agaaggaaagcat

SEQ ID NO: 996409 - DNA, 15 bp, Homo sapiens
agaaggaaataaaat

SEQ ID NO: 996410 - DNA, 15 bp, Homo sapiens
agaaggaaatgatgg

SEQ ID NO: 996411 - DNA, 22 bp, Homo sapiens
agaaggaaggagactcacctct

SEQ ID NO: 996412 - DNA, 15 bp, Homo sapiens
agaaggaagggcaga

SEQ ID NO: 996413 - DNA, 19 bp, Homo sapiens
agaaggaaggttggcgggg

SEQ ID NO: 996414 - DNA, 15 bp, Homo sapiens
agaaggagaaggaag

SEQ ID NO: 996415 - DNA, 10 bp, Homo sapiens
agaaggagga

SEQ ID NO: 996416 - DNA, 13 bp, Homo sapiens
agaaggaggggga

SEQ ID NO: 996417 - DNA, 15 bp, Homo sapiens
agaaggatggcatct

SEQ ID NO: 996418 - DNA, 15 bp, Homo sapiens
agaatttaggttttt

SEQ ID NO: 996419 - DNA, 14 bp, Homo sapiens
agaatttagtgtat

SEQ ID NO: 996420 - DNA, 15 bp, Homo sapiens
agaatttattacaaa

SEQ ID NO: 996421 - DNA, 19 bp, Homo sapiens
agaatttctaaagtaaaat

SEQ ID NO: 996422 - DNA, 13 bp, Homo sapiens
agaatttctaaga

SEQ ID NO: 996423 - DNA, 12 bp, Homo sapiens
agaatttctgta

SEQ ID NO: 996424 - DNA, 21 bp, Homo sapiens
agaatttcttggtaagaagcc

SEQ ID NO: 996425 - DNA, 14 bp, Homo sapiens
agaatttgaattat

SEQ ID NO: 996426 - DNA, 17 bp, Homo sapiens
agaattttaatgtgaag

SEQ ID NO: 996427 - DNA, 18 bp, Homo sapiens
agaattttaatgtgaaga

SEQ ID NO: 996428 - DNA, 22 bp, Homo sapiens
agaattttaggaacttcagaga

SEQ ID NO: 996429 - DNA, 12 bp, Homo sapiens
agaattttgtat

SEQ ID NO: 996430 - DNA, 13 bp, Homo sapiens
agaattttgtata

SEQ ID NO: 996431 - DNA, 20 bp, Homo sapiens
agaatttttaaaaaagtgat

SEQ ID NO: 996432 - DNA, 18 bp, Homo sapiens
agaatttttgtttggact

SEQ ID NO: 996433 - DNA, 16 bp, Homo sapiens
agaatttttttgtctt

SEQ ID NO: 996434 - DNA, 17 bp, Homo sapiens
agacaaaaacagcctca

SEQ ID NO: 996435 - DNA, 22 bp, Homo sapiens
agacaaaaacagcctcacagaa

SEQ ID NO: 996436 - DNA, 18 bp, Homo sapiens
agacaaaaagacaaacat

SEQ ID NO: 996437 - DNA, 19 bp, Homo sapiens
agacaaaaagtatattaaa

SEQ ID NO: 996438 - DNA, 23 bp, Homo sapiens
agacaaaaagtatattaaacaaa

SEQ ID NO: 996439 - DNA, 15 bp, Homo sapiens
agacaaaagaaactt

SEQ ID NO: 996440 - DNA, 14 bp, Homo sapiens
agacaaaatgaaag

SEQ ID NO: 996441 - DNA, 16 bp, Homo sapiens
agacaaaatggataca

SEQ ID NO: 996442 - DNA, 16 bp, Homo sapiens
agacaaaatttgagaa

SEQ ID NO: 996443 - DNA, 18 bp, Homo sapiens
agacaaacaagggagaag

SEQ ID NO: 996444 - DNA, 17 bp, Homo sapiens
agacaaaggaggaattt

SEQ ID NO: 996445 - DNA, 23 bp, Homo sapiens
agacaaatcctttctgcccccca

SEQ ID NO: 996446 - DNA, 19 bp, Homo sapiens
agacaaatttaaaggaaac

SEQ ID NO: 996447 - DNA, 13 bp, Homo sapiens
agacaacagaagt

SEQ ID NO: 996448 - DNA, 14 bp, Homo sapiens
agacaacagaagtc

SEQ ID NO: 996449 - DNA, 15 bp, Homo sapiens
agacaacagaagtca

SEQ ID NO: 996450 - DNA, 14 bp, Homo sapiens
agacaaccctgcaa

SEQ ID NO: 996451 - DNA, 20 bp, Homo sapiens
agacaaccttgtcccaagga

SEQ ID NO: 996452 - DNA, 16 bp, Homo sapiens
agacaacctttctgta

SEQ ID NO: 996453 - DNA, 19 bp, Homo sapiens
agacaacgatgaatttctt

SEQ ID NO: 996454 - DNA, 18 bp, Homo sapiens
agacaactagatttgtcc

SEQ ID NO: 996455 - DNA, 15 bp, Homo sapiens
agacaagaagcaaat

SEQ ID NO: 996456 - DNA, 15 bp, Homo sapiens
agacaagacttcagt

SEQ ID NO: 996457 - DNA, 17 bp, Homo sapiens
agacaagagctgctgtc

SEQ ID NO: 996458 - DNA, 20 bp, Homo sapiens
agacaagagctgctgtcctt

SEQ ID NO: 996459 - DNA, 15 bp, Homo sapiens
agacaagatattgta

SEQ ID NO: 996460 - DNA, 16 bp, Homo sapiens
agacaagatattgtac

SEQ ID NO: 996461 - DNA, 16 bp, Homo sapiens
agacaagcactatttt

SEQ ID NO: 996462 - DNA, 13 bp, Homo sapiens
agacaagccctgg

SEQ ID NO: 996463 - DNA, 18 bp, Homo sapiens
agacaagccctggcaaca

SEQ ID NO: 996464 - DNA, 13 bp, Homo sapiens
agacaaggagagc

SEQ ID NO: 996465 - DNA, 14 bp, Homo sapiens
agacaaggtgctaa

SEQ ID NO: 996466 - DNA, 17 bp, Homo sapiens
agacaagtatgaatatt

SEQ ID NO: 996467 - DNA, 19 bp, Homo sapiens
agacaagtatgaatattac

SEQ ID NO: 996468 - DNA, 17 bp, Homo sapiens
agacaatgacttactgt

SEQ ID NO: 996469 - DNA, 15 bp, Homo sapiens
agacaatgttttctt

SEQ ID NO: 996470 - DNA, 15 bp, Homo sapiens
agacaatttattatg

SEQ ID NO: 996471 - DNA, 21 bp, Homo sapiens
agacaatttattatggcacat

SEQ ID NO: 996472 - DNA, 16 bp, Homo sapiens
agacaatttgatacat

SEQ ID NO: 996473 - DNA, 20 bp, Homo sapiens
agacagagccaggagaagct

SEQ ID NO: 996474 - DNA, 20 bp, Homo sapiens
agacagagtccctggctcct

SEQ ID NO: 996475 - DNA, 23 bp, Homo sapiens
agacagagtcttgctctgtctcc

SEQ ID NO: 996476 - DNA, 19 bp, Homo sapiens
agacagagtgaatttcagt

SEQ ID NO: 996477 - DNA, 16 bp, Homo sapiens
agacagatacctccaa

SEQ ID NO: 996478 - DNA, 21 bp, Homo sapiens
agacagatacctccaaccctg

SEQ ID NO: 996479 - DNA, 23 bp, Homo sapiens
agacagatacctccaaccctgcc

SEQ ID NO: 996480 - DNA, 13 bp, Homo sapiens
agacagatggaca

SEQ ID NO: 996481 - DNA, 12 bp, Homo sapiens
agacagcagctc

SEQ ID NO: 996482 - DNA, 18 bp, Homo sapiens
agacagcaggcagcgcca

SEQ ID NO: 996483 - DNA, 22 bp, Homo sapiens
agacagcccaggatactggcac

SEQ ID NO: 996484 - DNA, 18 bp, Homo sapiens
agacagccccaagcttct

SEQ ID NO: 996485 - DNA, 21 bp, Homo sapiens
agacagctccaccctggccga

SEQ ID NO: 996486 - DNA, 19 bp, Homo sapiens
agacagcttacagaatggg

SEQ ID NO: 996487 - DNA, 11 bp, Homo sapiens
agacagcttct

SEQ ID NO: 996488 - DNA, 19 bp, Homo sapiens
agacaggaaaatcctctgg

SEQ ID NO: 996489 - DNA, 21 bp, Homo sapiens
agacaggaagaccaaggcctc

SEQ ID NO: 996490 - DNA, 12 bp, Homo sapiens
agacaggaagat

SEQ ID NO: 996491 - DNA, 21 bp, Homo sapiens
agacaggaatttagaaaaagt

SEQ ID NO: 996492 - DNA, 19 bp, Homo sapiens
agacaggacagaatgtgtt

SEQ ID NO: 996493 - DNA, 21 bp, Homo sapiens
agacaggacagtgcttcagcc

SEQ ID NO: 996494 - DNA, 14 bp, Homo sapiens
agacaggagaaatg

SEQ ID NO: 996495 - DNA, 23 bp, Homo sapiens
agacaggagggcaagggccatgc

SEQ ID NO: 996496 - DNA, 11 bp, Homo sapiens
agacaggcagc

SEQ ID NO: 996497 - DNA, 20 bp, Homo sapiens
agacaggccatgtgagccac

SEQ ID NO: 996498 - DNA, 22 bp, Homo sapiens
agacaggccatgtgagccaccg

SEQ ID NO: 996499 - DNA, 15 bp, Homo sapiens
agacaggcccaagag

SEQ ID NO: 996500 - DNA, 18 bp, Homo sapiens
agacaggcccaagagatg

SEQ ID NO: 996501 - DNA, 12 bp, Homo sapiens
agacaggccctc

SEQ ID NO: 996502 - DNA, 14 bp, Homo sapiens
agacaggccctccc

SEQ ID NO: 996503 - DNA, 19 bp, Homo sapiens
agacaggccctccctgtct

SEQ ID NO: 996504 - DNA, 16 bp, Homo sapiens
agacagggctgctccc

SEQ ID NO: 996505 - DNA, 16 bp, Homo sapiens
agacagggtaggaaag

SEQ ID NO: 996506 - DNA, 18 bp, Homo sapiens
agacagggtctcactctg

SEQ ID NO: 996507 - DNA, 14 bp, Homo sapiens
agacagggtcttgc

SEQ ID NO: 996508 - DNA, 16 bp, Homo sapiens
agacagggtcttgctc

SEQ ID NO: 996509 - DNA, 18 bp, Homo sapiens
agacagggtcttgctctg

SEQ ID NO: 996510 - DNA, 23 bp, Homo sapiens
agacagggtcttgctctgtcccc

SEQ ID NO: 996511 - DNA, 19 bp, Homo sapiens
agacagggtttcaccatgt

SEQ ID NO: 996512 - DNA, 23 bp, Homo sapiens
agacagggtttcaccatgttgcc

SEQ ID NO: 996513 - DNA, 16 bp, Homo sapiens
agacagggtttggctg

SEQ ID NO: 996514 - DNA, 23 bp, Homo sapiens
agacagggtttggctgtgtctaa

SEQ ID NO: 996515 - DNA, 21 bp, Homo sapiens
agacagtagccaagttatatt

SEQ ID NO: 996516 - DNA, 15 bp, Homo sapiens
agacagtatatttat

SEQ ID NO: 996517 - DNA, 21 bp, Homo sapiens
agaccacagtttacctcaggt

SEQ ID NO: 996518 - DNA, 23 bp, Homo sapiens
agaccacatctttatctgttctt

SEQ ID NO: 996519 - DNA, 20 bp, Homo sapiens
agaccaccagccgccccagc

SEQ ID NO: 996520 - DNA, 15 bp, Homo sapiens
agaccaccagggtcc

SEQ ID NO: 996521 - DNA, 20 bp, Homo sapiens
agaccaccagggtcccagga

SEQ ID NO: 996522 - DNA, 11 bp, Homo sapiens
agaccacctcc

SEQ ID NO: 996523 - DNA, 12 bp, Homo sapiens
agaccacctcca

SEQ ID NO: 996524 - DNA, 23 bp, Homo sapiens
agaccactgtctccacccacctt

SEQ ID NO: 996525 - DNA, 15 bp, Homo sapiens
agaccagagctgtct

SEQ ID NO: 996526 - DNA, 16 bp, Homo sapiens
agaccagcagacagag

SEQ ID NO: 996527 - DNA, 20 bp, Homo sapiens
agaccagcagacagagccag

SEQ ID NO: 996528 - DNA, 13 bp, Homo sapiens
agaccagcctggc

SEQ ID NO: 996529 - DNA, 14 bp, Homo sapiens
agaccagcctggcc

SEQ ID NO: 996530 - DNA, 22 bp, Homo sapiens
agaccagcctggccagtatggt

SEQ ID NO: 996531 - DNA, 15 bp, Homo sapiens
agaccagggagcctt

SEQ ID NO: 996532 - DNA, 18 bp, Homo sapiens
agaccagggctccagccc

SEQ ID NO: 996533 - DNA, 18 bp, Homo sapiens
agaccagggtcttacctc

SEQ ID NO: 996534 - DNA, 17 bp, Homo sapiens
agaccagtactgggaag

SEQ ID NO: 996535 - DNA, 19 bp, Homo sapiens
agaccagtggtctggaaac

SEQ ID NO: 996536 - DNA, 21 bp, Homo sapiens
agaccagtggtctggaaacag

SEQ ID NO: 996537 - DNA, 18 bp, Homo sapiens
agaccagttgggagcact

SEQ ID NO: 996538 - DNA, 20 bp, Homo sapiens
agaccagttgggagcactgg

SEQ ID NO: 996539 - DNA, 22 bp, Homo sapiens
agaccagttgggagcactggag

SEQ ID NO: 996540 - DNA, 15 bp, Homo sapiens
agaccagtttgcatg

SEQ ID NO: 996541 - DNA, 15 bp, Homo sapiens
agaccatagtgacca

SEQ ID NO: 996542 - DNA, 21 bp, Homo sapiens
agaccatcctggccaacatga

SEQ ID NO: 996543 - DNA, 18 bp, Homo sapiens
agaccatcctggcccctc

SEQ ID NO: 996544 - DNA, 21 bp, Homo sapiens
agaccatcctggcccctccag

SEQ ID NO: 996545 - DNA, 14 bp, Homo sapiens
agaccatgcattta

SEQ ID NO: 996546 - DNA, 12 bp, Homo sapiens
agaccatggaca

SEQ ID NO: 996547 - DNA, 12 bp, Homo sapiens
agaccatttgta

SEQ ID NO: 996548 - DNA, 22 bp, Homo sapiens
agactgcttcccatcctaccct

SEQ ID NO: 996549 - DNA, 16 bp, Homo sapiens
agactgcttggccaga

SEQ ID NO: 996550 - DNA, 17 bp, Homo sapiens
agactggaacttgaact

SEQ ID NO: 996551 - DNA, 19 bp, Homo sapiens
agagaagaaatagcagagc

SEQ ID NO: 996552 - DNA, 21 bp, Homo sapiens
agagaagagattgtggtttca

SEQ ID NO: 996553 - DNA, 17 bp, Homo sapiens
agagaagagggcccagc

SEQ ID NO: 996554 - DNA, 20 bp, Homo sapiens
agagaagagggcccagccca

SEQ ID NO: 996555 - DNA, 18 bp, Homo sapiens
agagaagatgcctgttaa

SEQ ID NO: 996556 - DNA, 14 bp, Homo sapiens
agagaagccccgca

SEQ ID NO: 996557 - DNA, 12 bp, Homo sapiens
agagaagctggg

SEQ ID NO: 996558 - DNA, 16 bp, Homo sapiens
agagaaggaaaagact

SEQ ID NO: 996559 - DNA, 23 bp, Homo sapiens
agagaaggaaaagactgaatcta

SEQ ID NO: 996560 - DNA, 14 bp, Homo sapiens
agagaagtctcatt

SEQ ID NO: 996561 - DNA, 14 bp, Homo sapiens
agagaagttctcaa

SEQ ID NO: 996562 - DNA, 23 bp, Homo sapiens
agagaagtttgtagccaggtact

SEQ ID NO: 996563 - DNA, 13 bp, Homo sapiens
agagaataaattg

SEQ ID NO: 996564 - DNA, 16 bp, Homo sapiens
agagaatctcttggga

SEQ ID NO: 996565 - DNA, 18 bp, Homo sapiens
agagaatcttaaggtcta

SEQ ID NO: 996566 - DNA, 12 bp, Homo sapiens
agagaatgaact

SEQ ID NO: 996567 - DNA, 14 bp, Homo sapiens
agagaatgaactgt

SEQ ID NO: 996568 - DNA, 22 bp, Homo sapiens
agagaatgaactgtggaattta

SEQ ID NO: 996569 - DNA, 12 bp, Homo sapiens
agagaatgagag

SEQ ID NO: 996570 - DNA, 14 bp, Homo sapiens
agagaatgagagcg

SEQ ID NO: 996571 - DNA, 20 bp, Homo sapiens
agagaatgagagcgacacag

SEQ ID NO: 996572 - DNA, 17 bp, Homo sapiens
agagaatggaaaacaga

SEQ ID NO: 996573 - DNA, 14 bp, Homo sapiens
agagaatggagaca

SEQ ID NO: 996574 - DNA, 18 bp, Homo sapiens
agagaatgtgtttcaaaa

SEQ ID NO: 996575 - DNA, 22 bp, Homo sapiens
agagaattactatttactttat

SEQ ID NO: 996576 - DNA, 14 bp, Homo sapiens
agagaattggctca

SEQ ID NO: 996577 - DNA, 13 bp, Homo sapiens
agagacaaaatat

SEQ ID NO: 996578 - DNA, 13 bp, Homo sapiens
agagacaaatctt

SEQ ID NO: 996579 - DNA, 22 bp, Homo sapiens
agagacacctgcacctcccccc

SEQ ID NO: 996580 - DNA, 14 bp, Homo sapiens
agagacagaagcag

SEQ ID NO: 996581 - DNA, 17 bp, Homo sapiens
agagacagaagcaggct

SEQ ID NO: 996582 - DNA, 20 bp, Homo sapiens
agagacagaagcaggctgga

SEQ ID NO: 996583 - DNA, 17 bp, Homo sapiens
agagacagacttgagaa

SEQ ID NO: 996584 - DNA, 18 bp, Homo sapiens
agagacagacttgagaac

SEQ ID NO: 996585 - DNA, 19 bp, Homo sapiens
agagacagacttgagaact

SEQ ID NO: 996586 - DNA, 14 bp, Homo sapiens
agagacagagtgct

SEQ ID NO: 996587 - DNA, 18 bp, Homo sapiens
agagacagatacctccaa

SEQ ID NO: 996588 - DNA, 23 bp, Homo sapiens
agagacagatacctccaaccctg

SEQ ID NO: 996589 - DNA, 15 bp, Homo sapiens
agagacagcccagga

SEQ ID NO: 996590 - DNA, 23 bp, Homo sapiens
agagacaggaaaatcctctggct

SEQ ID NO: 996591 - DNA, 13 bp, Homo sapiens
agagacaggcagc

SEQ ID NO: 996592 - DNA, 12 bp, Homo sapiens
agagacatatgg

SEQ ID NO: 996593 - DNA, 16 bp, Homo sapiens
agagacatggaagaga

SEQ ID NO: 996594 - DNA, 22 bp, Homo sapiens
agagacattaactcattagact

SEQ ID NO: 996595 - DNA, 15 bp, Homo sapiens
agagaccacacattt

SEQ ID NO: 996596 - DNA, 20 bp, Homo sapiens
agagaccacacattttatga

SEQ ID NO: 996597 - DNA, 13 bp, Homo sapiens
agagaccacacca

SEQ ID NO: 996598 - DNA, 12 bp, Homo sapiens
agagacccaagg

SEQ ID NO: 996599 - DNA, 19 bp, Homo sapiens
agagaccccttcctttcct

SEQ ID NO: 996600 - DNA, 23 bp, Homo sapiens
agagaccctcactgctggggagt

SEQ ID NO: 996601 - DNA, 16 bp, Homo sapiens
agagaccctggcctca

SEQ ID NO: 996602 - DNA, 13 bp, Homo sapiens
agagacctcatca

SEQ ID NO: 996603 - DNA, 15 bp, Homo sapiens
agagacctcatcctg

SEQ ID NO: 996604 - DNA, 15 bp, Homo sapiens
agagacctctgccta

SEQ ID NO: 996605 - DNA, 20 bp, Homo sapiens
agagacctgacccaacaccc

SEQ ID NO: 996606 - DNA, 14 bp, Homo sapiens
agagacctgaggca

SEQ ID NO: 996607 - DNA, 16 bp, Homo sapiens
agagacgcaggaatgg

SEQ ID NO: 996608 - DNA, 21 bp, Homo sapiens
agagacgccctatttctatgt

SEQ ID NO: 996609 - DNA, 22 bp, Homo sapiens
agagacgccctatttctatgtc

SEQ ID NO: 996610 - DNA, 19 bp, Homo sapiens
agagacggcagcctgacct

SEQ ID NO: 996611 - DNA, 14 bp, Homo sapiens
agagactaatgttg

SEQ ID NO: 996612 - DNA, 22 bp, Homo sapiens
agagactcatttcacagccttt

SEQ ID NO: 996613 - DNA, 18 bp, Homo sapiens
agagactctattttaatg

SEQ ID NO: 996614 - DNA, 24 bp, Homo sapiens
agagactctttatttttctctttc

SEQ ID NO: 996615 - DNA, 17 bp, Homo sapiens
agagactgagcagccgc

SEQ ID NO: 996616 - DNA, 22 bp, Homo sapiens
agagactgagcagccgccagct

SEQ ID NO: 996617 - DNA, 19 bp, Homo sapiens
agagactgatcatccaggc

SEQ ID NO: 996618 - DNA, 13 bp, Homo sapiens
agagactgccctt

SEQ ID NO: 996619 - DNA, 16 bp, Homo sapiens
agagactgcccttctc

SEQ ID NO: 996620 - DNA, 13 bp, Homo sapiens
agagactggagca

SEQ ID NO: 996621 - DNA, 22 bp, Homo sapiens
agagactgggagccacttctcc

SEQ ID NO: 996622 - DNA, 22 bp, Homo sapiens
agagactggttagtgatgcagt

SEQ ID NO: 996623 - DNA, 15 bp, Homo sapiens
agagactgtagattg

SEQ ID NO: 996624 - DNA, 16 bp, Homo sapiens
agagacttaaaggaca

SEQ ID NO: 996625 - DNA, 14 bp, Homo sapiens
agagacttctctgt

SEQ ID NO: 996626 - DNA, 15 bp, Homo sapiens
agagacttctctgta

SEQ ID NO: 996627 - DNA, 19 bp, Homo sapiens
agagactttaatcactgct

SEQ ID NO: 996628 - DNA, 16 bp, Homo sapiens
agagacttttaatcag

SEQ ID NO: 996629 - DNA, 17 bp, Homo sapiens
agagacttttaatcaga

SEQ ID NO: 996630 - DNA, 20 bp, Homo sapiens
agagagaacaactactgtga

SEQ ID NO: 996631 - DNA, 14 bp, Homo sapiens
agagagaatgagag

SEQ ID NO: 996632 - DNA, 14 bp, Homo sapiens
agagagaccctcac

SEQ ID NO: 996633 - DNA, 14 bp, Homo sapiens
agagagagaggaca

SEQ ID NO: 996634 - DNA, 16 bp, Homo sapiens
agagagagaggacaga

SEQ ID NO: 996635 - DNA, 21 bp, Homo sapiens
agagagagccatgaagcatta

SEQ ID NO: 996636 - DNA, 13 bp, Homo sapiens
agagagaggaggc

SEQ ID NO: 996637 - DNA, 14 bp, Homo sapiens
agagagaggaggga

SEQ ID NO: 996638 - DNA, 14 bp, Homo sapiens
agagagaggcagaa

SEQ ID NO: 996639 - DNA, 15 bp, Homo sapiens
agagagaggctgcct

SEQ ID NO: 996640 - DNA, 18 bp, Homo sapiens
agagagaggctgcctcag

SEQ ID NO: 996641 - DNA, 13 bp, Homo sapiens
agagagaggggag

SEQ ID NO: 996642 - DNA, 17 bp, Homo sapiens
agagagatgagaagcca

SEQ ID NO: 996643 - DNA, 16 bp, Homo sapiens
agagagattggatttt

SEQ ID NO: 996644 - DNA, 20 bp, Homo sapiens
agagagattggccagcaaaa

SEQ ID NO: 996645 - DNA, 13 bp, Homo sapiens
agagagcaaggca

SEQ ID NO: 996646 - DNA, 18 bp, Homo sapiens
agagagcacccctctctg

SEQ ID NO: 996647 - DNA, 15 bp, Homo sapiens
agagagcagcgccca

SEQ ID NO: 996648 - DNA, 16 bp, Homo sapiens
agagagcagcgcccag

SEQ ID NO: 996649 - DNA, 15 bp, Homo sapiens
agagagcaggggagc

SEQ ID NO: 996650 - DNA, 12 bp, Homo sapiens
agagagccagga

SEQ ID NO: 996651 - DNA, 16 bp, Homo sapiens
agagagccaggatgcc

SEQ ID NO: 996652 - DNA, 19 bp, Homo sapiens
agagagccatgaagcatta

SEQ ID NO: 996653 - DNA, 21 bp, Homo sapiens
agagagccctagggtgctctg

SEQ ID NO: 996654 - DNA, 23 bp, Homo sapiens
agagagccttggttcatcagtgt

SEQ ID NO: 996655 - DNA, 23 bp, Homo sapiens
agagagctggtagttagtagcat

SEQ ID NO: 996656 - DNA, 21 bp, Homo sapiens
agagagctgtattaagtgact

SEQ ID NO: 996657 - DNA, 22 bp, Homo sapiens
agagaggaaggacccctcacca

SEQ ID NO: 996658 - DNA, 11 bp, Homo sapiens
agagaggaagt

SEQ ID NO: 996659 - DNA, 15 bp, Homo sapiens
agagaggagcacctg

SEQ ID NO: 996660 - DNA, 13 bp, Homo sapiens
agagaggaggcag

SEQ ID NO: 996661 - DNA, 19 bp, Homo sapiens
agagaggcaaggttgccct

SEQ ID NO: 996662 - DNA, 12 bp, Homo sapiens
agagaggcacct

SEQ ID NO: 996663 - DNA, 15 bp, Homo sapiens
agagaggcacctgct

SEQ ID NO: 996664 - DNA, 19 bp, Homo sapiens
agagaggcacctgctggaa

SEQ ID NO: 996665 - DNA, 14 bp, Homo sapiens
agagaggccttttg

SEQ ID NO: 996666 - DNA, 20 bp, Homo sapiens
agagaggccttttggaatgt

SEQ ID NO: 996667 - DNA, 23 bp, Homo sapiens
agagaggcgcgtctgccccaccc

SEQ ID NO: 996668 - DNA, 13 bp, Homo sapiens
agagaggctgcct

SEQ ID NO: 996669 - DNA, 16 bp, Homo sapiens
agagaggctgcctcag

SEQ ID NO: 996670 - DNA, 16 bp, Homo sapiens
agagagggacaggcac

SEQ ID NO: 996671 - DNA, 15 bp, Homo sapiens
agagagggagaagaa

SEQ ID NO: 996672 - DNA, 17 bp, Homo sapiens
agagagggaggcaagcc

SEQ ID NO: 996673 - DNA, 17 bp, Homo sapiens
agagagggaggtatgga

SEQ ID NO: 996674 - DNA, 17 bp, Homo sapiens
agagagggcacatctcc

SEQ ID NO: 996675 - DNA, 15 bp, Homo sapiens
agagagggcccagct

SEQ ID NO: 996676 - DNA, 17 bp, Homo sapiens
agagaggggaagaattt

SEQ ID NO: 996677 - DNA, 19 bp, Homo sapiens
agagaggggaagaatttaa

SEQ ID NO: 996678 - DNA, 20 bp, Homo sapiens
agagaggggaagaatttaat

SEQ ID NO: 996679 - DNA, 16 bp, Homo sapiens
agagaggtagcgagct

SEQ ID NO: 996680 - DNA, 17 bp, Homo sapiens
agagaggtagcgagctg

SEQ ID NO: 996681 - DNA, 13 bp, Homo sapiens
agagaggtggcca

SEQ ID NO: 996682 - DNA, 14 bp, Homo sapiens
agagaggtggccac

SEQ ID NO: 996683 - DNA, 21 bp, Homo sapiens
agagaggtggggatcctgcct

SEQ ID NO: 996684 - DNA, 22 bp, Homo sapiens
agagagtaatgggtttcatatt

SEQ ID NO: 996685 - DNA, 15 bp, Homo sapiens
agagagtataaataa

SEQ ID NO: 996686 - DNA, 17 bp, Homo sapiens
agagagtcaatgtcatt

SEQ ID NO: 996687 - DNA, 15 bp, Homo sapiens
agagagtcctctgga

SEQ ID NO: 996688 - DNA, 13 bp, Homo sapiens
agagagtgaaatt

SEQ ID NO: 996689 - DNA, 20 bp, Homo sapiens
agagagttagcatgtatgaa

SEQ ID NO: 996690 - DNA, 15 bp, Homo sapiens
agagataaaacagaa

SEQ ID NO: 996691 - DNA, 13 bp, Homo sapiens
agagataataaga

SEQ ID NO: 996692 - DNA, 17 bp, Homo sapiens
agagatatacaaatata

SEQ ID NO: 996693 - DNA, 21 bp, Homo sapiens
agagatattgatattgaagga

SEQ ID NO: 996694 - DNA, 13 bp, Homo sapiens
agagatattttaa

SEQ ID NO: 996695 - DNA, 17 bp, Homo sapiens
agagatattttaaaatg

SEQ ID NO: 996696 - DNA, 19 bp, Homo sapiens
agagatgaagagtgagagg

SEQ ID NO: 996697 - DNA, 15 bp, Homo sapiens
agagatgacaaacca

SEQ ID NO: 996698 - DNA, 15 bp, Homo sapiens
agagatgacccctac

SEQ ID NO: 996699 - DNA, 18 bp, Homo sapiens
agagatgacccctacccc

SEQ ID NO: 996700 - DNA, 17 bp, Homo sapiens
agagatgactgagtcct

SEQ ID NO: 996701 - DNA, 18 bp, Homo sapiens
agagatgactgagtcctc

SEQ ID NO: 996702 - DNA, 15 bp, Homo sapiens
agagatgagaaatga

SEQ ID NO: 996703 - DNA, 18 bp, Homo sapiens
agagatgagaagccagga

SEQ ID NO: 996704 - DNA, 14 bp, Homo sapiens
agagatgcaatgat

SEQ ID NO: 996705 - DNA, 16 bp, Homo sapiens
agagatgcagaaatat

SEQ ID NO: 996706 - DNA, 17 bp, Homo sapiens
agagatgcagaaatatt

SEQ ID NO: 996707 - DNA, 21 bp, Homo sapiens
agagatgcctccaccgctgcc

SEQ ID NO: 996708 - DNA, 19 bp, Homo sapiens
agagatgggaatgaggtgg

SEQ ID NO: 996709 - DNA, 16 bp, Homo sapiens
agagatgggacaagca

SEQ ID NO: 996710 - DNA, 18 bp, Homo sapiens
agagatgtgcctgtggga

SEQ ID NO: 996711 - DNA, 22 bp, Homo sapiens
agagatgtgcctgtgggagggg

SEQ ID NO: 996712 - DNA, 18 bp, Homo sapiens
agagattcattttctaga

SEQ ID NO: 996713 - DNA, 23 bp, Homo sapiens
agagattctgtgatcttttaaag

SEQ ID NO: 996714 - DNA, 17 bp, Homo sapiens
agagattggatcaagta

SEQ ID NO: 996715 - DNA, 14 bp, Homo sapiens
agagattgtacatt

SEQ ID NO: 996716 - DNA, 20 bp, Homo sapiens
agagatttcccttcatttaa

SEQ ID NO: 996717 - DNA, 14 bp, Homo sapiens
agagatttgtctaa

SEQ ID NO: 996718 - DNA, 18 bp, Homo sapiens
agagcaaaagcctcagaa

SEQ ID NO: 996719 - DNA, 20 bp, Homo sapiens
agagcaaaagcctcagaaag

SEQ ID NO: 996720 - DNA, 21 bp, Homo sapiens
agagcaaagcgcccacccagg

SEQ ID NO: 996721 - DNA, 14 bp, Homo sapiens
agagcaaaggccca

SEQ ID NO: 996722 - DNA, 15 bp, Homo sapiens
agagcaacccctgta

SEQ ID NO: 996723 - DNA, 14 bp, Homo sapiens
agagcaactctgag

SEQ ID NO: 996724 - DNA, 23 bp, Homo sapiens
agagcaaggtttcgtggcagcac

SEQ ID NO: 996725 - DNA, 11 bp, Homo sapiens
agagcaataac

SEQ ID NO: 996726 - DNA, 14 bp, Homo sapiens
agagcaataacact

SEQ ID NO: 996727 - DNA, 13 bp, Homo sapiens
agagcaattgcag

SEQ ID NO: 996728 - DNA, 15 bp, Homo sapiens
agagcaattgcagca

SEQ ID NO: 996729 - DNA, 19 bp, Homo sapiens
agagcaatttacctggtac

SEQ ID NO: 996730 - DNA, 15 bp, Homo sapiens
agagcacaaacttca

SEQ ID NO: 996731 - DNA, 22 bp, Homo sapiens
agagcacaagaggaagagagag

SEQ ID NO: 996732 - DNA, 16 bp, Homo sapiens
agagcacacttattta

SEQ ID NO: 996733 - DNA, 22 bp, Homo sapiens
agagcacacttatttatgaatt

SEQ ID NO: 996734 - DNA, 16 bp, Homo sapiens
agagcacagagccctg

SEQ ID NO: 996735 - DNA, 14 bp, Homo sapiens
agagcacagcccac

SEQ ID NO: 996736 - DNA, 15 bp, Homo sapiens
agagcacctgtagct

SEQ ID NO: 996737 - DNA, 20 bp, Homo sapiens
agagcaccttcctcacttcc

SEQ ID NO: 996738 - DNA, 12 bp, Homo sapiens
agagcactgcct

SEQ ID NO: 996739 - DNA, 15 bp, Homo sapiens
agagcagagtctggg

SEQ ID NO: 996740 - DNA, 12 bp, Homo sapiens
agagcagcagaa

SEQ ID NO: 996741 - DNA, 13 bp, Homo sapiens
agagcagcaggtg

SEQ ID NO: 996742 - DNA, 21 bp, Homo sapiens
agagcagcctgatggccaagg

SEQ ID NO: 996743 - DNA, 20 bp, Homo sapiens
agagcagctccctttctcag

SEQ ID NO: 996744 - DNA, 16 bp, Homo sapiens
agagcagctggctctc

SEQ ID NO: 996745 - DNA, 20 bp, Homo sapiens
agagcagcttcggtgtgcag

SEQ ID NO: 996746 - DNA, 20 bp, Homo sapiens
agagcagctttaaactcagg

SEQ ID NO: 996747 - DNA, 22 bp, Homo sapiens
agagcaggaaggacaggaagct

SEQ ID NO: 996748 - DNA, 22 bp, Homo sapiens
agagcaggactccaggcccaag

SEQ ID NO: 996749 - DNA, 16 bp, Homo sapiens
agagcaggagcccctg

SEQ ID NO: 996750 - DNA, 14 bp, Homo sapiens
agagcaggaggccg

SEQ ID NO: 996751 - DNA, 12 bp, Homo sapiens
agagcaggcagg

SEQ ID NO: 996752 - DNA, 21 bp, Homo sapiens
agagcaggccaggcgcggtgg

SEQ ID NO: 996753 - DNA, 22 bp, Homo sapiens
agagcagggattaacctctgca

SEQ ID NO: 996754 - DNA, 22 bp, Homo sapiens
agagcaggggtccttggtgtga

SEQ ID NO: 996755 - DNA, 17 bp, Homo sapiens
agagcagtcagagtcca

SEQ ID NO: 996756 - DNA, 20 bp, Homo sapiens
agagcagtgaagactagaaa

SEQ ID NO: 996757 - DNA, 17 bp, Homo sapiens
agagcataaaacctaaa

SEQ ID NO: 996758 - DNA, 23 bp, Homo sapiens
agagcataattccgaaacaaaac

SEQ ID NO: 996759 - DNA, 18 bp, Homo sapiens
agagcataatttaaaaat

SEQ ID NO: 996760 - DNA, 20 bp, Homo sapiens
agagcataatttaaaaatat

SEQ ID NO: 996761 - DNA, 23 bp, Homo sapiens
agagcataatttaaaaatatatt

SEQ ID NO: 996762 - DNA, 21 bp, Homo sapiens
agagcatccggccaaatgcaa

SEQ ID NO: 996763 - DNA, 16 bp, Homo sapiens
agagcatcgtgaccct

SEQ ID NO: 996764 - DNA, 19 bp, Homo sapiens
agagcatcgtgacccttca

SEQ ID NO: 996765 - DNA, 22 bp, Homo sapiens
agagcatcgtgacccttcaggg

SEQ ID NO: 996766 - DNA, 14 bp, Homo sapiens
agagcatgatttga

SEQ ID NO: 996767 - DNA, 16 bp, Homo sapiens
agagcatgtgtcagag

SEQ ID NO: 996768 - DNA, 19 bp, Homo sapiens
agagcattacgtgagccag

SEQ ID NO: 996769 - DNA, 17 bp, Homo sapiens
agagcattgcatggaca

SEQ ID NO: 996770 - DNA, 16 bp, Homo sapiens
agagccaacctcggct

SEQ ID NO: 996771 - DNA, 20 bp, Homo sapiens
agagccaacctcggcttgtg

SEQ ID NO: 996772 - DNA, 14 bp, Homo sapiens
agagccaagctgca

SEQ ID NO: 996773 - DNA, 19 bp, Homo sapiens
agagccaccaagagggacg

SEQ ID NO: 996774 - DNA, 10 bp, Homo sapiens
agagccacct

SEQ ID NO: 996775 - DNA, 13 bp, Homo sapiens
agagccacctgca

SEQ ID NO: 996776 - DNA, 18 bp, Homo sapiens
agagccacctgcaagatg

SEQ ID NO: 996777 - DNA, 21 bp, Homo sapiens
agagccactgggcccctgtcc

SEQ ID NO: 996778 - DNA, 22 bp, Homo sapiens
agagccagcccacagatgatga

SEQ ID NO: 996779 - DNA, 13 bp, Homo sapiens
agagccagccctc

SEQ ID NO: 996780 - DNA, 16 bp, Homo sapiens
agagccagccctccct

SEQ ID NO: 996781 - DNA, 21 bp, Homo sapiens
agagccagccctccctgtcct

SEQ ID NO: 996782 - DNA, 13 bp, Homo sapiens
agagccagcctgg

SEQ ID NO: 996783 - DNA, 16 bp, Homo sapiens
agagccatgggcctgg

SEQ ID NO: 996784 - DNA, 18 bp, Homo sapiens
agagccatgggcctgggc

SEQ ID NO: 996785 - DNA, 19 bp, Homo sapiens
agagccatgggcctgggcc

SEQ ID NO: 996786 - DNA, 23 bp, Homo sapiens
agagccatgggcctgggcctgct

SEQ ID NO: 996787 - DNA, 16 bp, Homo sapiens
agagcccaccagccag

SEQ ID NO: 996788 - DNA, 21 bp, Homo sapiens
agagcccaccagccagccctg

SEQ ID NO: 996789 - DNA, 22 bp, Homo sapiens
agagcccagctcttgctctctt

SEQ ID NO: 996790 - DNA, 14 bp, Homo sapiens
agagcccaggggag

SEQ ID NO: 996791 - DNA, 16 bp, Homo sapiens
agagccccaagcagga

SEQ ID NO: 996792 - DNA, 22 bp, Homo sapiens
agagccccactcccggccaggc

SEQ ID NO: 996793 - DNA, 13 bp, Homo sapiens
agagccccagctg

SEQ ID NO: 996794 - DNA, 16 bp, Homo sapiens
agagccccagctgaca

SEQ ID NO: 996795 - DNA, 15 bp, Homo sapiens
agagcccccagccct

SEQ ID NO: 996796 - DNA, 16 bp, Homo sapiens
agagcccccagccctg

SEQ ID NO: 996797 - DNA, 19 bp, Homo sapiens
agagcccccagccctggga

SEQ ID NO: 996798 - DNA, 22 bp, Homo sapiens
agagcccccagccctgggaacc

SEQ ID NO: 996799 - DNA, 15 bp, Homo sapiens
agagcccctcctcca

SEQ ID NO: 996800 - DNA, 19 bp, Homo sapiens
agagcccctcctccagccc

SEQ ID NO: 996801 - DNA, 18 bp, Homo sapiens
agagcccgccgtctgcag

SEQ ID NO: 996802 - DNA, 13 bp, Homo sapiens
agagccctctgag

SEQ ID NO: 996803 - DNA, 21 bp, Homo sapiens
agagccctgaggggctgggct

SEQ ID NO: 996804 - DNA, 13 bp, Homo sapiens
agagccctgctgt

SEQ ID NO: 996805 - DNA, 19 bp, Homo sapiens
agagccctggacacccctg

SEQ ID NO: 996806 - DNA, 20 bp, Homo sapiens
agagccctggacacccctgc

SEQ ID NO: 996807 - DNA, 19 bp, Homo sapiens
agagccctggaccttgggc

SEQ ID NO: 996808 - DNA, 18 bp, Homo sapiens
agagccctggctctgccc

SEQ ID NO: 996809 - DNA, 20 bp, Homo sapiens
agagccctggctctgcccct

SEQ ID NO: 996810 - DNA, 21 bp, Homo sapiens
agagccctggctctgcccctc

SEQ ID NO: 996811 - DNA, 19 bp, Homo sapiens
agagccctgggtgacttca

SEQ ID NO: 996812 - DNA, 14 bp, Homo sapiens
agagccctgtggcc

SEQ ID NO: 996813 - DNA, 22 bp, Homo sapiens
agagccctgtggccgccacctg

SEQ ID NO: 996814 - DNA, 17 bp, Homo sapiens
agagcccttcactgcca

SEQ ID NO: 996815 - DNA, 20 bp, Homo sapiens
agagcccttcactgccatga

SEQ ID NO: 996816 - DNA, 19 bp, Homo sapiens
agagcccttgactgtacag

SEQ ID NO: 996817 - DNA, 20 bp, Homo sapiens
agagcccttgactgtacaga

SEQ ID NO: 996818 - DNA, 21 bp, Homo sapiens
agagcccttgactgtacagag

SEQ ID NO: 996819 - DNA, 21 bp, Homo sapiens
agagccggcccgcctctcctc

SEQ ID NO: 996820 - DNA, 15 bp, Homo sapiens
agagccgggccccgg

SEQ ID NO: 996821 - DNA, 19 bp, Homo sapiens
agagccggtggtgcccgtg

SEQ ID NO: 996822 - DNA, 21 bp, Homo sapiens
agagccgtggtccctgaggat

SEQ ID NO: 996823 - DNA, 21 bp, Homo sapiens
agagcctcccaccagagccgg

SEQ ID NO: 996824 - DNA, 18 bp, Homo sapiens
agagcctctttgctggag

SEQ ID NO: 996825 - DNA, 16 bp, Homo sapiens
agagcctgaatttgta

SEQ ID NO: 996826 - DNA, 16 bp, Homo sapiens
agagcctgacctgaga

SEQ ID NO: 996827 - DNA, 14 bp, Homo sapiens
agagcctgagggat

SEQ ID NO: 996828 - DNA, 20 bp, Homo sapiens
agagcctgatctcttcctgt

SEQ ID NO: 996829 - DNA, 18 bp, Homo sapiens
agagcctgctcccccacc

SEQ ID NO: 996830 - DNA, 19 bp, Homo sapiens
agagcctgctcccccaccc

SEQ ID NO: 996831 - DNA, 11 bp, Homo sapiens
agagcctgctg

SEQ ID NO: 996832 - DNA, 15 bp, Homo sapiens
agagcctgctgcatg

SEQ ID NO: 996833 - DNA, 17 bp, Homo sapiens
agagcctggagaagctg

SEQ ID NO: 996834 - DNA, 13 bp, Homo sapiens
agagcctggcaag

SEQ ID NO: 996835 - DNA, 16 bp, Homo sapiens
agagcctggccccagg

SEQ ID NO: 996836 - DNA, 18 bp, Homo sapiens
agagcctggggtgttctc

SEQ ID NO: 996837 - DNA, 18 bp, Homo sapiens
agagcctggtgctgctgc

SEQ ID NO: 996838 - DNA, 16 bp, Homo sapiens
agagcctgtaaacttt

SEQ ID NO: 996839 - DNA, 16 bp, Homo sapiens
agagcctgtccccgcc

SEQ ID NO: 996840 - DNA, 17 bp, Homo sapiens
agagcctgtccccgcct

SEQ ID NO: 996841 - DNA, 18 bp, Homo sapiens
agagcctgtccccgcctt

SEQ ID NO: 996842 - DNA, 17 bp, Homo sapiens
agagccttccatgacct

SEQ ID NO: 996843 - DNA, 23 bp, Homo sapiens
agagccttccatgacctcccctc

SEQ ID NO: 996844 - DNA, 13 bp, Homo sapiens
agagccttctcag

SEQ ID NO: 996845 - DNA, 19 bp, Homo sapiens
agagccttctcagaagcac

SEQ ID NO: 996846 - DNA, 19 bp, Homo sapiens
agagccttgagagacccag

SEQ ID NO: 996847 - DNA, 21 bp, Homo sapiens
agagccttgcggaaggttcta

SEQ ID NO: 996848 - DNA, 23 bp, Homo sapiens
agagccttggtgtccacctggcc

SEQ ID NO: 996849 - DNA, 22 bp, Homo sapiens
agagcctttatagattatatga

SEQ ID NO: 996850 - DNA, 21 bp, Homo sapiens
agagcctttggatgaccagaa

SEQ ID NO: 996851 - DNA, 23 bp, Homo sapiens
agagcctttggatgaccagaaca

SEQ ID NO: 996852 - DNA, 18 bp, Homo sapiens
agagcctttttctaggcc

SEQ ID NO: 996853 - DNA, 14 bp, Homo sapiens
agagcgacacagac

SEQ ID NO: 996854 - DNA, 13 bp, Homo sapiens
agagcgccaggaa

SEQ ID NO: 996855 - DNA, 23 bp, Homo sapiens
agagcgccaggaagccagagccc

SEQ ID NO: 996856 - DNA, 19 bp, Homo sapiens
agagcgcctcttcctctgg

SEQ ID NO: 996857 - DNA, 16 bp, Homo sapiens
agagcgctcctctgcc

SEQ ID NO: 996858 - DNA, 18 bp, Homo sapiens
agagcgctcctctgcctt

SEQ ID NO: 996859 - DNA, 19 bp, Homo sapiens
agagcgctcctctgccttg

SEQ ID NO: 996860 - DNA, 16 bp, Homo sapiens
agagcggtatctctgg

SEQ ID NO: 996861 - DNA, 23 bp, Homo sapiens
agagcggtatctctggcaccaca

SEQ ID NO: 996862 - DNA, 17 bp, Homo sapiens
agagctaagggtgggtg

SEQ ID NO: 996863 - DNA, 22 bp, Homo sapiens
agagctaagggtgggtgctcag

SEQ ID NO: 996864 - DNA, 14 bp, Homo sapiens
agagctaataaatc

SEQ ID NO: 996865 - DNA, 21 bp, Homo sapiens
agagctaataaatctcttctt

SEQ ID NO: 996866 - DNA, 11 bp, Homo sapiens
agagctacata

SEQ ID NO: 996867 - DNA, 14 bp, Homo sapiens
agagctagggctgc

SEQ ID NO: 996868 - DNA, 15 bp, Homo sapiens
agagctagggctgct

SEQ ID NO: 996869 - DNA, 16 bp, Homo sapiens
agagctagggctgctg

SEQ ID NO: 996870 - DNA, 17 bp, Homo sapiens
agagctatcaggagaaa

SEQ ID NO: 996871 - DNA, 18 bp, Homo sapiens
agagctatggcccagaaa

SEQ ID NO: 996872 - DNA, 15 bp, Homo sapiens
agagctatgttccct

SEQ ID NO: 996873 - DNA, 14 bp, Homo sapiens
agagctattgccaa

SEQ ID NO: 996874 - DNA, 15 bp, Homo sapiens
agagctcatcccccc

SEQ ID NO: 996875 - DNA, 21 bp, Homo sapiens
agagctcatcccccctgctgc

SEQ ID NO: 996876 - DNA, 17 bp, Homo sapiens
agagctcccgaggaagc

SEQ ID NO: 996877 - DNA, 20 bp, Homo sapiens
agagctcttcggtttctgag

SEQ ID NO: 996878 - DNA, 21 bp, Homo sapiens
agagctgagagtctgaaagac

SEQ ID NO: 996879 - DNA, 19 bp, Homo sapiens
agagctgaggatttcctgg

SEQ ID NO: 996880 - DNA, 20 bp, Homo sapiens
agagctgaggatttcctgga

SEQ ID NO: 996881 - DNA, 19 bp, Homo sapiens
agagctgatccagagcaca

SEQ ID NO: 996882 - DNA, 12 bp, Homo sapiens
agagctgccact

SEQ ID NO: 996883 - DNA, 13 bp, Homo sapiens
agagctgccactg

SEQ ID NO: 996884 - DNA, 14 bp, Homo sapiens
agagctgccactgg

SEQ ID NO: 996885 - DNA, 16 bp, Homo sapiens
agagctgccactgggc

SEQ ID NO: 996886 - DNA, 14 bp, Homo sapiens
agagctgcctcctg

SEQ ID NO: 996887 - DNA, 16 bp, Homo sapiens
agagctgctctggaaa

SEQ ID NO: 996888 - DNA, 13 bp, Homo sapiens
agagctgctgtcc

SEQ ID NO: 996889 - DNA, 22 bp, Homo sapiens
agagctgctgtccttttaggaa

SEQ ID NO: 996890 - DNA, 20 bp, Homo sapiens
agagctggaaggcagggcag

SEQ ID NO: 996891 - DNA, 21 bp, Homo sapiens
agagctggagatgaggccaga

SEQ ID NO: 996892 - DNA, 22 bp, Homo sapiens
agagctggagatgaggccagac

SEQ ID NO: 996893 - DNA, 12 bp, Homo sapiens
agagctggctct

SEQ ID NO: 996894 - DNA, 22 bp, Homo sapiens
agagctgggaaattcatgtgga

SEQ ID NO: 996895 - DNA, 21 bp, Homo sapiens
agagctggggctgccagcctg

SEQ ID NO: 996896 - DNA, 16 bp, Homo sapiens
agagctgggtggcctg

SEQ ID NO: 996897 - DNA, 14 bp, Homo sapiens
agagctgggtgggg

SEQ ID NO: 996898 - DNA, 21 bp, Homo sapiens
agagctggtagttagtagcat

SEQ ID NO: 996899 - DNA, 23 bp, Homo sapiens
agagctggtagttagtagcatgt

SEQ ID NO: 996900 - DNA, 17 bp, Homo sapiens
agagctggtgactttgg

SEQ ID NO: 996901 - DNA, 20 bp, Homo sapiens
agagctggtggtgcagcctt

SEQ ID NO: 996902 - DNA, 11 bp, Homo sapiens
agagctggtgt

SEQ ID NO: 996903 - DNA, 19 bp, Homo sapiens
agagctgtattaagccact

SEQ ID NO: 996904 - DNA, 16 bp, Homo sapiens
agagctgtctgaactc

SEQ ID NO: 996905 - DNA, 16 bp, Homo sapiens
agagctgtcttcccct

SEQ ID NO: 996906 - DNA, 17 bp, Homo sapiens
agagctgtcttcccctg

SEQ ID NO: 996907 - DNA, 10 bp, Homo sapiens
agagctgtgc

SEQ ID NO: 996908 - DNA, 12 bp, Homo sapiens
agagctgtgcca

SEQ ID NO: 996909 - DNA, 13 bp, Homo sapiens
agagctgtgccag

SEQ ID NO: 996910 - DNA, 17 bp, Homo sapiens
agagctgtgccagcagg

SEQ ID NO: 996911 - DNA, 12 bp, Homo sapiens
agagctgtgcct

SEQ ID NO: 996912 - DNA, 20 bp, Homo sapiens
agagctgtgcctgctcagca

SEQ ID NO: 996913 - DNA, 21 bp, Homo sapiens
agagctgttcgctcctcccag

SEQ ID NO: 996914 - DNA, 22 bp, Homo sapiens
agagctgtttggatacagctgc

SEQ ID NO: 996915 - DNA, 23 bp, Homo sapiens
agagctgtttggatacagctgct

SEQ ID NO: 996916 - DNA, 15 bp, Homo sapiens
agagcttaacagtgt

SEQ ID NO: 996917 - DNA, 18 bp, Homo sapiens
agagcttattggccactg

SEQ ID NO: 996918 - DNA, 19 bp, Homo sapiens
agagcttattggccactgg

SEQ ID NO: 996919 - DNA, 19 bp, Homo sapiens
agagcttcagaggtggccc

SEQ ID NO: 996920 - DNA, 12 bp, Homo sapiens
agagcttccaaa

SEQ ID NO: 996921 - DNA, 14 bp, Homo sapiens
agagcttgaagatt

SEQ ID NO: 996922 - DNA, 14 bp, Homo sapiens
agagcttgctccag

SEQ ID NO: 996923 - DNA, 15 bp, Homo sapiens
agagcttgtgtcctg

SEQ ID NO: 996924 - DNA, 23 bp, Homo sapiens
agagcttgttgtctccacttgta

SEQ ID NO: 996925 - DNA, 21 bp, Homo sapiens
agagctttaaaagtatcttta

SEQ ID NO: 996926 - DNA, 22 bp, Homo sapiens
agagctttaaaagtatctttaa

SEQ ID NO: 996927 - DNA, 19 bp, Homo sapiens
agagctttctgccttagcc

SEQ ID NO: 996928 - DNA, 14 bp, Homo sapiens
agagctttctttca

SEQ ID NO: 996929 - DNA, 12 bp, Homo sapiens
agagctttgtca

SEQ ID NO: 996930 - DNA, 14 bp, Homo sapiens
agagctttgtcact

SEQ ID NO: 996931 - DNA, 19 bp, Homo sapiens
agagctttgtcacttgcca

SEQ ID NO: 996932 - DNA, 22 bp, Homo sapiens
agagctttgtcacttgccacat

SEQ ID NO: 996933 - DNA, 15 bp, Homo sapiens
agagcttttaaaaat

SEQ ID NO: 996934 - DNA, 16 bp, Homo sapiens
agagcttttaaaaatg

SEQ ID NO: 996935 - DNA, 14 bp, Homo sapiens
agagcttttcagat

SEQ ID NO: 996936 - DNA, 16 bp, Homo sapiens
agagcttttgcatttc

SEQ ID NO: 996937 - DNA, 17 bp, Homo sapiens
agaggaaaaaaatgact

SEQ ID NO: 996938 - DNA, 18 bp, Homo sapiens
agaggaaaagtaaggtgc

SEQ ID NO: 996939 - DNA, 13 bp, Homo sapiens
agaggaaaatgag

SEQ ID NO: 996940 - DNA, 16 bp, Homo sapiens
agaggaaaggcgcccc

SEQ ID NO: 996941 - DNA, 22 bp, Homo sapiens
agaggaaaggcgcccccgcccc

SEQ ID NO: 996942 - DNA, 14 bp, Homo sapiens
agaggaaataagaa

SEQ ID NO: 996943 - DNA, 22 bp, Homo sapiens
agaggaaataagaaaaatcatg

SEQ ID NO: 996944 - DNA, 23 bp, Homo sapiens
agaggaaataagaaaaatcatgt

SEQ ID NO: 996945 - DNA, 20 bp, Homo sapiens
agaggaacctctgatttatt

SEQ ID NO: 996946 - DNA, 12 bp, Homo sapiens
agaggaactgtc

SEQ ID NO: 996947 - DNA, 17 bp, Homo sapiens
agaggaactgtccagag

SEQ ID NO: 996948 - DNA, 18 bp, Homo sapiens
agaggaactgtccagaga

SEQ ID NO: 996949 - DNA, 15 bp, Homo sapiens
agaggaagaaattca

SEQ ID NO: 996950 - DNA, 20 bp, Homo sapiens
agaggaagaaattcaggtac

SEQ ID NO: 996951 - DNA, 22 bp, Homo sapiens
agaggaagaatttgttatcagt

SEQ ID NO: 996952 - DNA, 12 bp, Homo sapiens
agaggaagagaa

SEQ ID NO: 996953 - DNA, 13 bp, Homo sapiens
agaggaagagaga

SEQ ID NO: 996954 - DNA, 10 bp, Homo sapiens
agaggaaggc

SEQ ID NO: 996955 - DNA, 21 bp, Homo sapiens
agaggaataaggcccagagcg

SEQ ID NO: 996956 - DNA, 24 bp, Homo sapiens
agaggaatcagacttcacactgca

SEQ ID NO: 996957 - DNA, 21 bp, Homo sapiens
agaggaatcctggcagcccag

SEQ ID NO: 996958 - DNA, 20 bp, Homo sapiens
agaggaatctgtttctctgc

SEQ ID NO: 996959 - DNA, 22 bp, Homo sapiens
agaggaatctgtttctctgctg

SEQ ID NO: 996960 - DNA, 16 bp, Homo sapiens
agaggaatgatgggct

SEQ ID NO: 996961 - DNA, 21 bp, Homo sapiens
agaggaatgtagggcctgcat

SEQ ID NO: 996962 - DNA, 18 bp, Homo sapiens
agaggaatttggctgctt

SEQ ID NO: 996963 - DNA, 23 bp, Homo sapiens
agaggacagagcaggggctccag

SEQ ID NO: 996964 - DNA, 16 bp, Homo sapiens
agaggacagctctggg

SEQ ID NO: 996965 - DNA, 19 bp, Homo sapiens
agaggaccacagtgggtgg

SEQ ID NO: 996966 - DNA, 20 bp, Homo sapiens
agaggaccacagtgggtggc

SEQ ID NO: 996967 - DNA, 14 bp, Homo sapiens
agaggaccccaggg

SEQ ID NO: 996968 - DNA, 17 bp, Homo sapiens
agaggacgcacgctcgc

SEQ ID NO: 996969 - DNA, 21 bp, Homo sapiens
agaggacgcacgctcgctgcc

SEQ ID NO: 996970 - DNA, 16 bp, Homo sapiens
agaggacggccctgcc

SEQ ID NO: 996971 - DNA, 21 bp, Homo sapiens
agaggacggccctgcctgcct

SEQ ID NO: 996972 - DNA, 23 bp, Homo sapiens
agaggacgtgcagacaggctggc

SEQ ID NO: 996973 - DNA, 22 bp, Homo sapiens
agaggacgtgttacccactgcc

SEQ ID NO: 996974 - DNA, 20 bp, Homo sapiens
agaggactctgcttaaacaa

SEQ ID NO: 996975 - DNA, 22 bp, Homo sapiens
agaggactctgcttaaacaaag

SEQ ID NO: 996976 - DNA, 17 bp, Homo sapiens
agaggagaaaaaaaaag

SEQ ID NO: 996977 - DNA, 20 bp, Homo sapiens
agaggagaaaaaaaaagtga

SEQ ID NO: 996978 - DNA, 12 bp, Homo sapiens
agaggagaacag

SEQ ID NO: 996979 - DNA, 17 bp, Homo sapiens
agaggagaacagtagga

SEQ ID NO: 996980 - DNA, 13 bp, Homo sapiens
agaggagaccctg

SEQ ID NO: 996981 - DNA, 16 bp, Homo sapiens
agaggagaccctggaa

SEQ ID NO: 996982 - DNA, 13 bp, Homo sapiens
agaggagaggggc

SEQ ID NO: 996983 - DNA, 16 bp, Homo sapiens
agaggagcacctgaac

SEQ ID NO: 996984 - DNA, 21 bp, Homo sapiens
agaggagcccagtgggctgca

SEQ ID NO: 996985 - DNA, 17 bp, Homo sapiens
agaggagctgagttggc

SEQ ID NO: 996986 - DNA, 20 bp, Homo sapiens
agaggaggacccctgccttc

SEQ ID NO: 996987 - DNA, 23 bp, Homo sapiens
agaggaggacccctgccttcctc

SEQ ID NO: 996988 - DNA, 17 bp, Homo sapiens
agaggaggaggtggggg

SEQ ID NO: 996989 - DNA, 16 bp, Homo sapiens
agaggaggcagccccc

SEQ ID NO: 996990 - DNA, 12 bp, Homo sapiens
agaggaggcctc

SEQ ID NO: 996991 - DNA, 14 bp, Homo sapiens
agaggaggcctgga

SEQ ID NO: 996992 - DNA, 15 bp, Homo sapiens
agaggaggcctggac

SEQ ID NO: 996993 - DNA, 19 bp, Homo sapiens
agaggaggcctggaccgag

SEQ ID NO: 996994 - DNA, 14 bp, Homo sapiens
agaggagggcagag

SEQ ID NO: 996995 - DNA, 18 bp, Homo sapiens
agaggagggcagagggag

SEQ ID NO: 996996 - DNA, 21 bp, Homo sapiens
agaggagggcgtgactcaccc

SEQ ID NO: 996997 - DNA, 18 bp, Homo sapiens
agaggaggggccgctgcc

SEQ ID NO: 996998 - DNA, 22 bp, Homo sapiens
agaggaggggccgctgccaccc

SEQ ID NO: 996999 - DNA, 21 bp, Homo sapiens
agaggagtaaataattggaaa

SEQ ID NO: 997000 - DNA, 14 bp, Homo sapiens
agaggagtgcttgt

SEQ ID NO: 997001 - DNA, 20 bp, Homo sapiens
agaggatacatttaataaaa

SEQ ID NO: 997002 - DNA, 21 bp, Homo sapiens
agaggatgaatgtatgtgcac

SEQ ID NO: 997003 - DNA, 16 bp, Homo sapiens
agaggatgagcagagg

SEQ ID NO: 997004 - DNA, 13 bp, Homo sapiens
agaggatgatttc

SEQ ID NO: 997005 - DNA, 12 bp, Homo sapiens
agaggatgcctt

SEQ ID NO: 997006 - DNA, 13 bp, Homo sapiens
agaggatgccttt

SEQ ID NO: 997007 - DNA, 17 bp, Homo sapiens
agaggatgccttttctg

SEQ ID NO: 997008 - DNA, 19 bp, Homo sapiens
agaggatttcttcaaatct

SEQ ID NO: 997009 - DNA, 18 bp, Homo sapiens
agaggatttttttctgag

SEQ ID NO: 997010 - DNA, 19 bp, Homo sapiens
agaggatttttttctgagc

SEQ ID NO: 997011 - DNA, 21 bp, Homo sapiens
agaggcaacactggaacatgg

SEQ ID NO: 997012 - DNA, 18 bp, Homo sapiens
agaggcaactgcattggc

SEQ ID NO: 997013 - DNA, 16 bp, Homo sapiens
agaggcaagctgaaat

SEQ ID NO: 997014 - DNA, 13 bp, Homo sapiens
agaggcaccagga

SEQ ID NO: 997015 - DNA, 14 bp, Homo sapiens
agaggcaccaggaa

SEQ ID NO: 997016 - DNA, 17 bp, Homo sapiens
agaggcaccaggaagcc

SEQ ID NO: 997017 - DNA, 19 bp, Homo sapiens
agaggcactcagtgagcct

SEQ ID NO: 997018 - DNA, 21 bp, Homo sapiens
agaggcactcagtgagcctcc

SEQ ID NO: 997019 - DNA, 23 bp, Homo sapiens
agaggcactcagtgagcctcctg

SEQ ID NO: 997020 - DNA, 13 bp, Homo sapiens
agaggcagcaagg

SEQ ID NO: 997021 - DNA, 14 bp, Homo sapiens
agaggcagccagac

SEQ ID NO: 997022 - DNA, 17 bp, Homo sapiens
agaggcagctatctgca

SEQ ID NO: 997023 - DNA, 18 bp, Homo sapiens
agaggcaggaatgggggt

SEQ ID NO: 997024 - DNA, 17 bp, Homo sapiens
agaggcaggagtggcag

SEQ ID NO: 997025 - DNA, 13 bp, Homo sapiens
agaggcagggagg

SEQ ID NO: 997026 - DNA, 17 bp, Homo sapiens
agaggcagggaggggac

SEQ ID NO: 997027 - DNA, 16 bp, Homo sapiens
agaggcatacacacag

SEQ ID NO: 997028 - DNA, 10 bp, Homo sapiens
agaggcattg

SEQ ID NO: 997029 - DNA, 18 bp, Homo sapiens
agaggccaaaggctggtg

SEQ ID NO: 997030 - DNA, 14 bp, Homo sapiens
agaggccaaggact

SEQ ID NO: 997031 - DNA, 15 bp, Homo sapiens
agaggccaaggactg

SEQ ID NO: 997032 - DNA, 16 bp, Homo sapiens
agaggccaaggactga

SEQ ID NO: 997033 - DNA, 13 bp, Homo sapiens
agaggccagaggc

SEQ ID NO: 997034 - DNA, 14 bp, Homo sapiens
agaggccagttgat

SEQ ID NO: 997035 - DNA, 20 bp, Homo sapiens
agaggccagttgatctgctc

SEQ ID NO: 997036 - DNA, 21 bp, Homo sapiens
agaggccagttgatctgctct

SEQ ID NO: 997037 - DNA, 22 bp, Homo sapiens
agaggccagttgatctgctctg

SEQ ID NO: 997038 - DNA, 16 bp, Homo sapiens
agaggccatggcagaa

SEQ ID NO: 997039 - DNA, 23 bp, Homo sapiens
agaggccatggcagaataatctt

SEQ ID NO: 997040 - DNA, 19 bp, Homo sapiens
agaggcccactagagggcc

SEQ ID NO: 997041 - DNA, 17 bp, Homo sapiens
agaggcccaggcaccac

SEQ ID NO: 997042 - DNA, 18 bp, Homo sapiens
agaggcccaggcaccacc

SEQ ID NO: 997043 - DNA, 22 bp, Homo sapiens
agaggcccccagcccagggctc

SEQ ID NO: 997044 - DNA, 22 bp, Homo sapiens
agaggcccccagtggggacagg

SEQ ID NO: 997045 - DNA, 14 bp, Homo sapiens
agaggccctcgctg

SEQ ID NO: 997046 - DNA, 21 bp, Homo sapiens
agaggccctctggagtggcca

SEQ ID NO: 997047 - DNA, 21 bp, Homo sapiens
agaggccggggtccaggcccg

SEQ ID NO: 997048 - DNA, 16 bp, Homo sapiens
agaggcctggagccca

SEQ ID NO: 997049 - DNA, 13 bp, Homo sapiens
agaggcctggggt

SEQ ID NO: 997050 - DNA, 19 bp, Homo sapiens
agaggcctggggtgggaca

SEQ ID NO: 997051 - DNA, 18 bp, Homo sapiens
agaggcctgtttggcctc

SEQ ID NO: 997052 - DNA, 20 bp, Homo sapiens
agaggcctgtttggcctctc

SEQ ID NO: 997053 - DNA, 21 bp, Homo sapiens
agaggcctttaaccatggtgc

SEQ ID NO: 997054 - DNA, 18 bp, Homo sapiens
agaggcgagtcaccctcc

SEQ ID NO: 997055 - DNA, 16 bp, Homo sapiens
agaggcgcgtctgccc

SEQ ID NO: 997056 - DNA, 21 bp, Homo sapiens
agaggcgcgtctgccccaccc

SEQ ID NO: 997057 - DNA, 12 bp, Homo sapiens
agaggcggcctc

SEQ ID NO: 997058 - DNA, 18 bp, Homo sapiens
agaggcgggagaactgaa

SEQ ID NO: 997059 - DNA, 19 bp, Homo sapiens
agaggcgggccagccaggc

SEQ ID NO: 997060 - DNA, 16 bp, Homo sapiens
agaggcgtctgtatat

SEQ ID NO: 997061 - DNA, 19 bp, Homo sapiens
agaggctagcttctgcttt

SEQ ID NO: 997062 - DNA, 16 bp, Homo sapiens
agaggctctggacagc

SEQ ID NO: 997063 - DNA, 20 bp, Homo sapiens
agaggctctggacagcagaa

SEQ ID NO: 997064 - DNA, 14 bp, Homo sapiens
agaggctgagccct

SEQ ID NO: 997065 - DNA, 15 bp, Homo sapiens
agaggctgagccctg

SEQ ID NO: 997066 - DNA, 17 bp, Homo sapiens
agaggctgagccctgta

SEQ ID NO: 997067 - DNA, 23 bp, Homo sapiens
agaggctgagccctgtacccacc

SEQ ID NO: 997068 - DNA, 21 bp, Homo sapiens
agaggctgaggctggcacagg

SEQ ID NO: 997069 - DNA, 13 bp, Homo sapiens
agaggctgaggga

SEQ ID NO: 997070 - DNA, 22 bp, Homo sapiens
agaggctgcagaaggccaagaa

SEQ ID NO: 997071 - DNA, 20 bp, Homo sapiens
agaggctgcccctctcacca

SEQ ID NO: 997072 - DNA, 14 bp, Homo sapiens
agaggctgcctcag

SEQ ID NO: 997073 - DNA, 16 bp, Homo sapiens
agaggctgcctcagcc

SEQ ID NO: 997074 - DNA, 17 bp, Homo sapiens
agaggctgcttctctac

SEQ ID NO: 997075 - DNA, 19 bp, Homo sapiens
agaggctggaggcagggcc

SEQ ID NO: 997076 - DNA, 22 bp, Homo sapiens
agaggctgggagtccctacctg

SEQ ID NO: 997077 - DNA, 14 bp, Homo sapiens
agaggctggtgctg

SEQ ID NO: 997078 - DNA, 22 bp, Homo sapiens
agaggctggtgctgtggccagg

SEQ ID NO: 997079 - DNA, 14 bp, Homo sapiens
agaggctggttttg

SEQ ID NO: 997080 - DNA, 17 bp, Homo sapiens
agaggcttccgtgtcct

SEQ ID NO: 997081 - DNA, 12 bp, Homo sapiens
agaggcttctcc

SEQ ID NO: 997082 - DNA, 16 bp, Homo sapiens
agaggcttctccgcca

SEQ ID NO: 997083 - DNA, 19 bp, Homo sapiens
agaggcttctccgccagcc

SEQ ID NO: 997084 - DNA, 20 bp, Homo sapiens
agaggcttctccgccagcct

SEQ ID NO: 997085 - DNA, 18 bp, Homo sapiens
agaggctttcaaatgtac

SEQ ID NO: 997086 - DNA, 21 bp, Homo sapiens
agagggaacaaaactgttctt

SEQ ID NO: 997087 - DNA, 15 bp, Homo sapiens
agagggaacagggcg

SEQ ID NO: 997088 - DNA, 19 bp, Homo sapiens
agagggaacagggcggaga

SEQ ID NO: 997089 - DNA, 21 bp, Homo sapiens
agagggaaggtgaccgcccag

SEQ ID NO: 997090 - DNA, 18 bp, Homo sapiens
agagggaatgttccctgc

SEQ ID NO: 997091 - DNA, 12 bp, Homo sapiens
agagggacagat

SEQ ID NO: 997092 - DNA, 21 bp, Homo sapiens
agagggacagcccactgagaa

SEQ ID NO: 997093 - DNA, 17 bp, Homo sapiens
agagggacaggcactcc

SEQ ID NO: 997094 - DNA, 22 bp, Homo sapiens
agagggaccaaattgcttctag

SEQ ID NO: 997095 - DNA, 19 bp, Homo sapiens
agagggacctctcccaggg

SEQ ID NO: 997096 - DNA, 14 bp, Homo sapiens
agagggagaagaag

SEQ ID NO: 997097 - DNA, 19 bp, Homo sapiens
agagggagaagggatggag

SEQ ID NO: 997098 - DNA, 22 bp, Homo sapiens
agagggagacagggctgctccc

SEQ ID NO: 997099 - DNA, 17 bp, Homo sapiens
agagggagactcctggg

SEQ ID NO: 997100 - DNA, 16 bp, Homo sapiens
agagggagatgtgtga

SEQ ID NO: 997101 - DNA, 18 bp, Homo sapiens
agagggaggcaagccctg

SEQ ID NO: 997102 - DNA, 13 bp, Homo sapiens
agagggaggggcc

SEQ ID NO: 997103 - DNA, 18 bp, Homo sapiens
agagggaggggcctaggc

SEQ ID NO: 997104 - DNA, 20 bp, Homo sapiens
agagggaggggcctaggcct

SEQ ID NO: 997105 - DNA, 18 bp, Homo sapiens
agagggatacaagagagg

SEQ ID NO: 997106 - DNA, 16 bp, Homo sapiens
agagggatttccctgc

SEQ ID NO: 997107 - DNA, 19 bp, Homo sapiens
agagggatttccctgcaga

SEQ ID NO: 997108 - DNA, 20 bp, Homo sapiens
agagggcaatctttgccttt

SEQ ID NO: 997109 - DNA, 14 bp, Homo sapiens
agagggcagaggct

SEQ ID NO: 997110 - DNA, 11 bp, Homo sapiens
agagggcaggg

SEQ ID NO: 997111 - DNA, 17 bp, Homo sapiens
agagggcagtacctggg

SEQ ID NO: 997112 - DNA, 20 bp, Homo sapiens
agagggcagtacctgggaaa

SEQ ID NO: 997113 - DNA, 12 bp, Homo sapiens
agagggccagca

SEQ ID NO: 997114 - DNA, 13 bp, Homo sapiens
agagggccagcag

SEQ ID NO: 997115 - DNA, 19 bp, Homo sapiens
agagggccagcaggctcct

SEQ ID NO: 997116 - DNA, 22 bp, Homo sapiens
agagggcccaaagaattggaat

SEQ ID NO: 997117 - DNA, 16 bp, Homo sapiens
agagggcccagcccag

SEQ ID NO: 997118 - DNA, 20 bp, Homo sapiens
agagggcccagctgtagcca

SEQ ID NO: 997119 - DNA, 14 bp, Homo sapiens
agagggcccaggca

SEQ ID NO: 997120 - DNA, 16 bp, Homo sapiens
agagggcccaggcagg

SEQ ID NO: 997121 - DNA, 21 bp, Homo sapiens
agagggcccaggcaggccacc

SEQ ID NO: 997122 - DNA, 16 bp, Homo sapiens
agagggcccatcaggc

SEQ ID NO: 997123 - DNA, 18 bp, Homo sapiens
agagggcccatcaggcag

SEQ ID NO: 997124 - DNA, 19 bp, Homo sapiens
agagggcccatcaggcagt

SEQ ID NO: 997125 - DNA, 13 bp, Homo sapiens
agagggccttgct

SEQ ID NO: 997126 - DNA, 16 bp, Homo sapiens
agagggcgccaccacc

SEQ ID NO: 997127 - DNA, 20 bp, Homo sapiens
agagggctcgaggggtgggc

SEQ ID NO: 997128 - DNA, 12 bp, Homo sapiens
agagggctggag

SEQ ID NO: 997129 - DNA, 23 bp, Homo sapiens
agagggctgttggacagctgctt

SEQ ID NO: 997130 - DNA, 13 bp, Homo sapiens
agagggcttcctc

SEQ ID NO: 997131 - DNA, 22 bp, Homo sapiens
agagggcttcctctagaagcca

SEQ ID NO: 997132 - DNA, 22 bp, Homo sapiens
agagggctttttaaatttggtg

SEQ ID NO: 997133 - DNA, 19 bp, Homo sapiens
agaggggaataatagaaga

SEQ ID NO: 997134 - DNA, 14 bp, Homo sapiens
agaggggactctgg

SEQ ID NO: 997135 - DNA, 23 bp, Homo sapiens
agaggggactgggggactgggag

SEQ ID NO: 997136 - DNA, 14 bp, Homo sapiens
agaggggagggagg

SEQ ID NO: 997137 - DNA, 14 bp, Homo sapiens
agaggggaggggcc

SEQ ID NO: 997138 - DNA, 20 bp, Homo sapiens
agaggggaggggcctaggga

SEQ ID NO: 997139 - DNA, 23 bp, Homo sapiens
agaggggatggggatagaggaaa

SEQ ID NO: 997140 - DNA, 13 bp, Homo sapiens
agaggggcagccc

SEQ ID NO: 997141 - DNA, 15 bp, Homo sapiens
agaggggcagccctt

SEQ ID NO: 997142 - DNA, 23 bp, Homo sapiens
agaggggcagccgctaggagaga

SEQ ID NO: 997143 - DNA, 15 bp, Homo sapiens
agaggggcgctgtcc

SEQ ID NO: 997144 - DNA, 17 bp, Homo sapiens
agaggggcgctgtcctg

SEQ ID NO: 997145 - DNA, 12 bp, Homo sapiens
agaggggctggg

SEQ ID NO: 997146 - DNA, 13 bp, Homo sapiens
agaggggctgggg

SEQ ID NO: 997147 - DNA, 18 bp, Homo sapiens
agaggggctttctggaga

SEQ ID NO: 997148 - DNA, 12 bp, Homo sapiens
agagggggaggt

SEQ ID NO: 997149 - DNA, 19 bp, Homo sapiens
agagggggagtagccaagc

SEQ ID NO: 997150 - DNA, 21 bp, Homo sapiens
agagggggcacccggggagga

SEQ ID NO: 997151 - DNA, 15 bp, Homo sapiens
agagggggctctcca

SEQ ID NO: 997152 - DNA, 13 bp, Homo sapiens
agagggggctctg

SEQ ID NO: 997153 - DNA, 19 bp, Homo sapiens
agagggggtggaggggtgt

SEQ ID NO: 997154 - DNA, 15 bp, Homo sapiens
agaggggtgcaccca

SEQ ID NO: 997155 - DNA, 15 bp, Homo sapiens
agagggtagacaggg

SEQ ID NO: 997156 - DNA, 19 bp, Homo sapiens
aggaaaatagtttaggaga

SEQ ID NO: 997157 - DNA, 21 bp, Homo sapiens
aggaaaatgagaggagaacag

SEQ ID NO: 997158 - DNA, 22 bp, Homo sapiens
aggaaaatgcttctgttgtaat

SEQ ID NO: 997159 - DNA, 23 bp, Homo sapiens
aggaaaatgtctgtaataataga

SEQ ID NO: 997160 - DNA, 21 bp, Homo sapiens
aggaaaattattctataattt

SEQ ID NO: 997161 - DNA, 15 bp, Homo sapiens
aggaaaattgaaagt

SEQ ID NO: 997162 - DNA, 21 bp, Homo sapiens
aggaaaattttagcgtgctca

SEQ ID NO: 997163 - DNA, 19 bp, Homo sapiens
aggaaacaaccatgtcatt

SEQ ID NO: 997164 - DNA, 18 bp, Homo sapiens
aggaaacaagggaagggg

SEQ ID NO: 997165 - DNA, 10 bp, Homo sapiens
aggaaacacc

SEQ ID NO: 997166 - DNA, 13 bp, Homo sapiens
aggaaacaggctc

SEQ ID NO: 997167 - DNA, 12 bp, Homo sapiens
aggaaacagtta

SEQ ID NO: 997168 - DNA, 17 bp, Homo sapiens
aggaaacagttgcatgt

SEQ ID NO: 997169 - DNA, 19 bp, Homo sapiens
aggaaaccacaaccttgca

SEQ ID NO: 997170 - DNA, 15 bp, Homo sapiens
aggaaaccagctcgt

SEQ ID NO: 997171 - DNA, 17 bp, Homo sapiens
aggaaaccttttcttgt

SEQ ID NO: 997172 - DNA, 17 bp, Homo sapiens
aggaaactcacctgctg

SEQ ID NO: 997173 - DNA, 20 bp, Homo sapiens
aggaaactcacctgctggcc

SEQ ID NO: 997174 - DNA, 19 bp, Homo sapiens
aggaaactccacatctgcc

SEQ ID NO: 997175 - DNA, 18 bp, Homo sapiens
aggaaactttatttaaat

SEQ ID NO: 997176 - DNA, 16 bp, Homo sapiens
aggaaagagagtttgt

SEQ ID NO: 997177 - DNA, 18 bp, Homo sapiens
aggaaagcaataaatgaa

SEQ ID NO: 997178 - DNA, 19 bp, Homo sapiens
aggaaagcaataaatgaat

SEQ ID NO: 997179 - DNA, 22 bp, Homo sapiens
aggaaagcatgtctctgcttcc

SEQ ID NO: 997180 - DNA, 13 bp, Homo sapiens
aggaaagccacat

SEQ ID NO: 997181 - DNA, 15 bp, Homo sapiens
aggaaagccacatct

SEQ ID NO: 997182 - DNA, 20 bp, Homo sapiens
aggaaagccccagcactaac

SEQ ID NO: 997183 - DNA, 13 bp, Homo sapiens
aggaaagccctcc

SEQ ID NO: 997184 - DNA, 14 bp, Homo sapiens
aggaaagccctccc

SEQ ID NO: 997185 - DNA, 24 bp, Homo sapiens
aggaaagcgcctccaaccctagca

SEQ ID NO: 997186 - DNA, 14 bp, Homo sapiens
aggaaaggagatca

SEQ ID NO: 997187 - DNA, 12 bp, Homo sapiens
aggaaaggattt

SEQ ID NO: 997188 - DNA, 21 bp, Homo sapiens
aggaaaggattttaccaaagc

SEQ ID NO: 997189 - DNA, 22 bp, Homo sapiens
aggaaaggattttaccaaagca

SEQ ID NO: 997190 - DNA, 15 bp, Homo sapiens
aggaaaggctcattt

SEQ ID NO: 997191 - DNA, 21 bp, Homo sapiens
aggaaaggctcatttaaaaca

SEQ ID NO: 997192 - DNA, 22 bp, Homo sapiens
aggaaagggaggagtggaggtg

SEQ ID NO: 997193 - DNA, 17 bp, Homo sapiens
aggaaagggctggctcc

SEQ ID NO: 997194 - DNA, 20 bp, Homo sapiens
cccagagtgctgtcgggacc

SEQ ID NO: 997195 - DNA, 17 bp, Homo sapiens
cccagagtggagtctga

SEQ ID NO: 997196 - DNA, 21 bp, Homo sapiens
cccagagtgggatccacttct

SEQ ID NO: 997197 - DNA, 17 bp, Homo sapiens
cccagagtgtagggggc

SEQ ID NO: 997198 - DNA, 23 bp, Homo sapiens
cccagagtgtgggaagggagagc

SEQ ID NO: 997199 - DNA, 23 bp, Homo sapiens
cccagagttgctgggagctgaaa

SEQ ID NO: 997200 - DNA, 17 bp, Homo sapiens
cccagataatggagaat

SEQ ID NO: 997201 - DNA, 23 bp, Homo sapiens
cccagatacgggggctgtgactc

SEQ ID NO: 997202 - DNA, 16 bp, Homo sapiens
cccagatagagctggg

SEQ ID NO: 997203 - DNA, 19 bp, Homo sapiens
cccagatagagctgggtgg

SEQ ID NO: 997204 - DNA, 13 bp, Homo sapiens
cccagatcaggaa

SEQ ID NO: 997205 - DNA, 15 bp, Homo sapiens
cccagatcaggaacc

SEQ ID NO: 997206 - DNA, 22 bp, Homo sapiens
cccagatcaggaaccagggcct

SEQ ID NO: 997207 - DNA, 23 bp, Homo sapiens
cccagatcaggaaccagggcctc

SEQ ID NO: 997208 - DNA, 19 bp, Homo sapiens
cccagatcagtcagagccc

SEQ ID NO: 997209 - DNA, 22 bp, Homo sapiens
cccagatccaaggccgcggccc

SEQ ID NO: 997210 - DNA, 17 bp, Homo sapiens
cccagatctcccactgc

SEQ ID NO: 997211 - DNA, 17 bp, Homo sapiens
cccagatctgcctgggc

SEQ ID NO: 997212 - DNA, 18 bp, Homo sapiens
cccagatgaccttgactg

SEQ ID NO: 997213 - DNA, 20 bp, Homo sapiens
cccagatggcttcggagggc

SEQ ID NO: 997214 - DNA, 21 bp, Homo sapiens
cccagatgtgtcccccccagg

SEQ ID NO: 997215 - DNA, 12 bp, Homo sapiens
cccagattccca

SEQ ID NO: 997216 - DNA, 19 bp, Homo sapiens
cccagattttgctgtatat

SEQ ID NO: 997217 - DNA, 13 bp, Homo sapiens
cccagcaaccctc

SEQ ID NO: 997218 - DNA, 23 bp, Homo sapiens
cccagcaacgcccctccaaacct

SEQ ID NO: 997219 - DNA, 15 bp, Homo sapiens
cccagcaagacctca

SEQ ID NO: 997220 - DNA, 20 bp, Homo sapiens
cccagcaagagcacaagagg

SEQ ID NO: 997221 - DNA, 22 bp, Homo sapiens
cccagcaagcgggagcccgtgg

SEQ ID NO: 997222 - DNA, 16 bp, Homo sapiens
cccagcaattatgaaa

SEQ ID NO: 997223 - DNA, 16 bp, Homo sapiens
cccagcacagccacct

SEQ ID NO: 997224 - DNA, 19 bp, Homo sapiens
cccagcacagcttgacctg

SEQ ID NO: 997225 - DNA, 23 bp, Homo sapiens
cccagcaccttgcagattttctt

SEQ ID NO: 997226 - DNA, 18 bp, Homo sapiens
cccagcactgcctcctgt

SEQ ID NO: 997227 - DNA, 12 bp, Homo sapiens
cccagcactttg

SEQ ID NO: 997228 - DNA, 21 bp, Homo sapiens
cccagcactttgggaggccta

SEQ ID NO: 997229 - DNA, 20 bp, Homo sapiens
cccagcactttgggaggctg

SEQ ID NO: 997230 - DNA, 20 bp, Homo sapiens
cccagcagaatggaggcagg

SEQ ID NO: 997231 - DNA, 19 bp, Homo sapiens
cccagcagagcccaccagc

SEQ ID NO: 997232 - DNA, 22 bp, Homo sapiens
cccagcagagcccaccagccag

SEQ ID NO: 997233 - DNA, 14 bp, Homo sapiens
cccagcagaggcag

SEQ ID NO: 997234 - DNA, 19 bp, Homo sapiens
cccagcagaggcaggctgg

SEQ ID NO: 997235 - DNA, 18 bp, Homo sapiens
cccagcagcccaagctta

SEQ ID NO: 997236 - DNA, 13 bp, Homo sapiens
cccagcaggcaga

SEQ ID NO: 997237 - DNA, 12 bp, Homo sapiens
cccagcaggccc

SEQ ID NO: 997238 - DNA, 13 bp, Homo sapiens
cccagcaggccca

SEQ ID NO: 997239 - DNA, 15 bp, Homo sapiens
cccagcaggcccagc

SEQ ID NO: 997240 - DNA, 16 bp, Homo sapiens
cccagcaggcccagca

SEQ ID NO: 997241 - DNA, 19 bp, Homo sapiens
cccagcaggcccagcatgc

SEQ ID NO: 997242 - DNA, 21 bp, Homo sapiens
cccagcaggcccagcatgcag

SEQ ID NO: 997243 - DNA, 21 bp, Homo sapiens
atcacaggagcaatcacagga

SEQ ID NO: 997244 - DNA, 19 bp, Homo sapiens
atcacagggcagagccggg

SEQ ID NO: 997245 - DNA, 21 bp, Homo sapiens
atcacagggccccagaaggca

SEQ ID NO: 997246 - DNA, 22 bp, Homo sapiens
atcacagggccccagaaggcag

SEQ ID NO: 997247 - DNA, 12 bp, Homo sapiens
atcacaggggcg

SEQ ID NO: 997248 - DNA, 15 bp, Homo sapiens
atcacaggggcgggg

SEQ ID NO: 997249 - DNA, 20 bp, Homo sapiens
atcacaggggcggggcagga

SEQ ID NO: 997250 - DNA, 18 bp, Homo sapiens
ctcatgcaaactgcttta

SEQ ID NO: 997251 - DNA, 20 bp, Homo sapiens
ctcatgcaaatcaattactg

SEQ ID NO: 997252 - DNA, 20 bp, Homo sapiens
ctcatgcatagtcccagcta

SEQ ID NO: 997253 - DNA, 15 bp, Homo sapiens
ctcatgccatggtct

SEQ ID NO: 997254 - DNA, 14 bp, Homo sapiens
ctcatgcccctggc

SEQ ID NO: 997255 - DNA, 15 bp, Homo sapiens
ctcatgctgttgctg

SEQ ID NO: 997256 - DNA, 16 bp, Homo sapiens
ctcatgctgttgctgc

SEQ ID NO: 997257 - DNA, 16 bp, Homo sapiens
ctcatgcttcttctca

SEQ ID NO: 997258 - DNA, 21 bp, Homo sapiens
ctcatgcttcttctcatgggg

SEQ ID NO: 997259 - DNA, 15 bp, Homo sapiens
ctcatggcccctctg

SEQ ID NO: 997260 - DNA, 22 bp, Homo sapiens
ctcatggcgtaatgggcctgcc

SEQ ID NO: 997261 - DNA, 13 bp, Homo sapiens
ctcatgggacctg

SEQ ID NO: 997262 - DNA, 15 bp, Homo sapiens
ctcatgggacctgcc

SEQ ID NO: 997263 - DNA, 23 bp, Homo sapiens
ctcatgggtggcactcagtctct

SEQ ID NO: 997264 - DNA, 11 bp, Homo sapiens
ctcatgtaaca

SEQ ID NO: 997265 - DNA, 13 bp, Homo sapiens
ctcatgtaacatt

SEQ ID NO: 997266 - DNA, 19 bp, Homo sapiens
ctcatgtaacattggtgaa

SEQ ID NO: 997267 - DNA, 16 bp, Homo sapiens
ctcatgtacataccct

SEQ ID NO: 997268 - DNA, 17 bp, Homo sapiens
ctcatgtccccttcctg

SEQ ID NO: 997269 - DNA, 17 bp, Homo sapiens
ctcatgtccctccaggg

SEQ ID NO: 997270 - DNA, 15 bp, Homo sapiens
ctcatgtgtttgcat

SEQ ID NO: 997271 - DNA, 20 bp, Homo sapiens
ctcatgttccttttgaaatt

SEQ ID NO: 997272 - DNA, 22 bp, Homo sapiens
ctcatgttctcttcccaggcct

SEQ ID NO: 997273 - DNA, 16 bp, Homo sapiens
ctcatgttctgctttc

SEQ ID NO: 997274 - DNA, 14 bp, Homo sapiens
ctcatgttcttaat

SEQ ID NO: 997275 - DNA, 15 bp, Homo sapiens
ctcatgttgagccag

SEQ ID NO: 997276 - DNA, 20 bp, Homo sapiens
ctcatgttgagccagtgggc

SEQ ID NO: 997277 - DNA, 13 bp, Homo sapiens
ctcatgttgctga

SEQ ID NO: 997278 - DNA, 17 bp, Homo sapiens
ctcatgttttcaactgc

SEQ ID NO: 997279 - DNA, 20 bp, Homo sapiens
ctcatgttttcaactgccaa

SEQ ID NO: 997280 - DNA, 17 bp, Homo sapiens
ctcatgttttccattgt

SEQ ID NO: 997281 - DNA, 18 bp, Homo sapiens
ctcatgttttccattgtt

SEQ ID NO: 997282 - DNA, 21 bp, Homo sapiens
ctcatgttttccattgtttga

SEQ ID NO: 997283 - DNA, 17 bp, Homo sapiens
ctcattaaaagaatatc

SEQ ID NO: 997284 - DNA, 14 bp, Homo sapiens
ctcattaaaatcca

SEQ ID NO: 997285 - DNA, 18 bp, Homo sapiens
ctcattaaactctaaaga

SEQ ID NO: 997286 - DNA, 13 bp, Homo sapiens
ctcattaatagct

SEQ ID NO: 997287 - DNA, 17 bp, Homo sapiens
ctcattaatagctgcct

SEQ ID NO: 997288 - DNA, 20 bp, Homo sapiens
ctcattacagttctttcctc

SEQ ID NO: 997289 - DNA, 20 bp, Homo sapiens
ctcattactacactggtgtg

SEQ ID NO: 997290 - DNA, 16 bp, Homo sapiens
ctcattactgggcctt

SEQ ID NO: 997291 - DNA, 19 bp, Homo sapiens
ctcattagaattaccattt

SEQ ID NO: 997292 - DNA, 21 bp, Homo sapiens
ctcattatcgccttttgacag

SEQ ID NO: 997293 - DNA, 14 bp, Homo sapiens
ctcattatgaaaaa

SEQ ID NO: 997294 - DNA, 15 bp, Homo sapiens
ctcattatgaaaaac

SEQ ID NO: 997295 - DNA, 13 bp, Homo sapiens
ctcattcagcatg

SEQ ID NO: 997296 - DNA, 14 bp, Homo sapiens
ctcattcagcatgg

SEQ ID NO: 997297 - DNA, 15 bp, Homo sapiens
ctcattcagtattaa

SEQ ID NO: 997298 - DNA, 22 bp, Homo sapiens
ctcattcatcactccaaaaaca

SEQ ID NO: 997299 - DNA, 12 bp, Homo sapiens
ctcattcatctt

SEQ ID NO: 997300 - DNA, 17 bp, Homo sapiens
ctcattccaacagtgag

SEQ ID NO: 997301 - DNA, 14 bp, Homo sapiens
ctcattccccaggt

SEQ ID NO: 997302 - DNA, 22 bp, Homo sapiens
ctcattccggccacatcattct

SEQ ID NO: 997303 - DNA, 15 bp, Homo sapiens
ctcattcgcctttgt

SEQ ID NO: 997304 - DNA, 17 bp, Homo sapiens
ctcattcgcctttgtct

SEQ ID NO: 997305 - DNA, 21 bp, Homo sapiens
ctcattctatcggccaggctg

SEQ ID NO: 997306 - DNA, 18 bp, Homo sapiens
ctcattctccttgtgtta

SEQ ID NO: 997307 - DNA, 17 bp, Homo sapiens
ctcattctgaaggagcc

SEQ ID NO: 997308 - DNA, 18 bp, Homo sapiens
ctcattctgaattaatta

SEQ ID NO: 997309 - DNA, 16 bp, Homo sapiens
ctcattctttgaacat

SEQ ID NO: 997310 - DNA, 14 bp, Homo sapiens
ctcattgcctcctg

SEQ ID NO: 997311 - DNA, 12 bp, Homo sapiens
ctcattggggtt

SEQ ID NO: 997312 - DNA, 12 bp, Homo sapiens
ctcattgtagaa

SEQ ID NO: 997313 - DNA, 14 bp, Homo sapiens
ctcattgtgccaag

SEQ ID NO: 997314 - DNA, 15 bp, Homo sapiens
ctcattgtgccaagc

SEQ ID NO: 997315 - DNA, 17 bp, Homo sapiens
ctcattgtgccaagcct

SEQ ID NO: 997316 - DNA, 21 bp, Homo sapiens
ctcatttaaagctaaattttg

SEQ ID NO: 997317 - DNA, 17 bp, Homo sapiens
ctcatttaagggaaaaa

SEQ ID NO: 997318 - DNA, 14 bp, Homo sapiens
ctcatttaatataa

SEQ ID NO: 997319 - DNA, 13 bp, Homo sapiens
ctcatttcatctc

SEQ ID NO: 997320 - DNA, 18 bp, Homo sapiens
ctcatttcatctcattta

SEQ ID NO: 997321 - DNA, 13 bp, Homo sapiens
ctcatttctcagg

SEQ ID NO: 997322 - DNA, 19 bp, Homo sapiens
ctcatttcttcctctgcat

SEQ ID NO: 997323 - DNA, 21 bp, Homo sapiens
ctcatttgagataaagtcaaa

SEQ ID NO: 997324 - DNA, 20 bp, Homo sapiens
ctcatttggtctgccagaat

SEQ ID NO: 997325 - DNA, 15 bp, Homo sapiens
ctcatttgtttttct

SEQ ID NO: 997326 - DNA, 16 bp, Homo sapiens
ctcattttctttagga

SEQ ID NO: 997327 - DNA, 21 bp, Homo sapiens
ctcattttgacaaagtgcctc

SEQ ID NO: 997328 - DNA, 19 bp, Homo sapiens
ctcattttgcaattttatc

SEQ ID NO: 997329 - DNA, 20 bp, Homo sapiens
ctcatttttttaatttatta

SEQ ID NO: 997330 - DNA, 23 bp, Homo sapiens
ctccaaaaaaaaaaaaaatacaa

SEQ ID NO: 997331 - DNA, 14 bp, Homo sapiens
ctccaaaaagaaaa

SEQ ID NO: 997332 - DNA, 20 bp, Homo sapiens
ctccaaaacccatgtgggaa

SEQ ID NO: 997333 - DNA, 19 bp, Homo sapiens
ctccaaaatattaacattc

SEQ ID NO: 997334 - DNA, 21 bp, Homo sapiens
ctccaaaatattaacattctt

SEQ ID NO: 997335 - DNA, 16 bp, Homo sapiens
ctccaaacaccggcag

SEQ ID NO: 997336 - DNA, 20 bp, Homo sapiens
ctccaaaccagacggtgacg

SEQ ID NO: 997337 - DNA, 18 bp, Homo sapiens
ctccaaacctccagcctc

SEQ ID NO: 997338 - DNA, 19 bp, Homo sapiens
ctccaaacctccagcctcc

SEQ ID NO: 997339 - DNA, 22 bp, Homo sapiens
ctccaaacctccagcctccctg

SEQ ID NO: 997340 - DNA, 14 bp, Homo sapiens
ctccaaactgatta

SEQ ID NO: 997341 - DNA, 15 bp, Homo sapiens
ctccaaactgattaa

SEQ ID NO: 997342 - DNA, 20 bp, Homo sapiens
ctccaaagagccttcagaat

SEQ ID NO: 997343 - DNA, 22 bp, Homo sapiens
ctccaaaggaagtctaggagct

SEQ ID NO: 997344 - DNA, 16 bp, Homo sapiens
ctccaaaggggctgct

SEQ ID NO: 997345 - DNA, 17 bp, Homo sapiens
ctccaaagtggagctgg

SEQ ID NO: 997346 - DNA, 19 bp, Homo sapiens
ctccaaagtggagctggga

SEQ ID NO: 997347 - DNA, 21 bp, Homo sapiens
ctccaaatattattcaagtgc

SEQ ID NO: 997348 - DNA, 23 bp, Homo sapiens
ctccaaatattattcaagtgcct

SEQ ID NO: 997349 - DNA, 15 bp, Homo sapiens
ctccaaatctgattt

SEQ ID NO: 997350 - DNA, 21 bp, Homo sapiens
ctccaaatggagaagctgcag

SEQ ID NO: 997351 - DNA, 22 bp, Homo sapiens
ctccaaatggagaagctgcagg

SEQ ID NO: 997352 - DNA, 23 bp, Homo sapiens
ctccaacaccaagcacagcagcc

SEQ ID NO: 997353 - DNA, 18 bp, Homo sapiens
ctccaaccaaataagact

SEQ ID NO: 997354 - DNA, 13 bp, Homo sapiens
ctccaaccactgt

SEQ ID NO: 997355 - DNA, 15 bp, Homo sapiens
ctccaaccactgtgc

SEQ ID NO: 997356 - DNA, 19 bp, Homo sapiens
ctccaaccactgtgccact

SEQ ID NO: 997357 - DNA, 15 bp, Homo sapiens
ctccaaccctgccgt

SEQ ID NO: 997358 - DNA, 17 bp, Homo sapiens
ctccaacgcccctgtgg

SEQ ID NO: 997359 - DNA, 21 bp, Homo sapiens
ctccaacgcccctgtggccaa

SEQ ID NO: 997360 - DNA, 22 bp, Homo sapiens
ctccaacgcccctgtggccaac

SEQ ID NO: 997361 - DNA, 12 bp, Homo sapiens
ctccaagaaact

SEQ ID NO: 997362 - DNA, 15 bp, Homo sapiens
ctccaagaccaccag

SEQ ID NO: 997363 - DNA, 16 bp, Homo sapiens
ctccaagaccaccagg

SEQ ID NO: 997364 - DNA, 17 bp, Homo sapiens
ctccaagaccaccaggg

SEQ ID NO: 997365 - DNA, 20 bp, Homo sapiens
ctccaagagctacataattt

SEQ ID NO: 997366 - DNA, 13 bp, Homo sapiens
ctccaagaggctg

SEQ ID NO: 997367 - DNA, 16 bp, Homo sapiens
ctccaagatgccctca

SEQ ID NO: 997368 - DNA, 13 bp, Homo sapiens
ctccaagcacaga

SEQ ID NO: 997369 - DNA, 16 bp, Homo sapiens
ctccaagcacagagcc

SEQ ID NO: 997370 - DNA, 17 bp, Homo sapiens
ctccaagcacagagcct

SEQ ID NO: 997371 - DNA, 20 bp, Homo sapiens
ctccaagcacagagcctggc

SEQ ID NO: 997372 - DNA, 13 bp, Homo sapiens
ctccaagcagact

SEQ ID NO: 997373 - DNA, 22 bp, Homo sapiens
ctccaagcagactccagcccct

SEQ ID NO: 997374 - DNA, 15 bp, Homo sapiens
ctccaagcatttcat

SEQ ID NO: 997375 - DNA, 15 bp, Homo sapiens
ctaaaaaaaaaaagg

SEQ ID NO: 997376 - DNA, 20 bp, Homo sapiens
ctaaaaaaaatgcatattaa

SEQ ID NO: 997377 - DNA, 19 bp, Homo sapiens
ctaaaaaagatatattaaa

SEQ ID NO: 997378 - DNA, 21 bp, Homo sapiens
ctaaaaagaaggaaaatgatc

SEQ ID NO: 997379 - DNA, 15 bp, Homo sapiens
ctaaaaagtataaaa

SEQ ID NO: 997380 - DNA, 14 bp, Homo sapiens
ctaaaaatattgtt

SEQ ID NO: 997381 - DNA, 22 bp, Homo sapiens
ctaaaaatgcaaaaaaaattag

SEQ ID NO: 997382 - DNA, 17 bp, Homo sapiens
ctaaaaattcccttcct

SEQ ID NO: 997383 - DNA, 18 bp, Homo sapiens
ctaaaaattcccttcctg

SEQ ID NO: 997384 - DNA, 20 bp, Homo sapiens
ctaaaaattcccttcctgtt

SEQ ID NO: 997385 - DNA, 18 bp, Homo sapiens
ctaaaaatttttacaaaa

SEQ ID NO: 997386 - DNA, 16 bp, Homo sapiens
ctaaaacattcccctc

SEQ ID NO: 997387 - DNA, 22 bp, Homo sapiens
ctaaaacgaatggtctttgctc

SEQ ID NO: 997388 - DNA, 22 bp, Homo sapiens
ctaaaactatggttcccaataa

SEQ ID NO: 997389 - DNA, 12 bp, Homo sapiens
ctaaaagaagag

SEQ ID NO: 997390 - DNA, 15 bp, Homo sapiens
ctaaaagaagagagg

SEQ ID NO: 997391 - DNA, 13 bp, Homo sapiens
ctaaaagatcctt

SEQ ID NO: 997392 - DNA, 13 bp, Homo sapiens
ctaaaaggaaaag

SEQ ID NO: 997393 - DNA, 14 bp, Homo sapiens
ctaaaagtgcattt

SEQ ID NO: 997394 - DNA, 19 bp, Homo sapiens
ctaaaagttttctaatttg

SEQ ID NO: 997395 - DNA, 16 bp, Homo sapiens
ctaaaataaagaaata

SEQ ID NO: 997396 - DNA, 20 bp, Homo sapiens
ctaaaataagctcagtgata

SEQ ID NO: 997397 - DNA, 17 bp, Homo sapiens
ctaaaataattttgtaa

SEQ ID NO: 997398 - DNA, 18 bp, Homo sapiens
ctaaaatatataatttat

SEQ ID NO: 997399 - DNA, 15 bp, Homo sapiens
ctaaaatatttattt

SEQ ID NO: 997400 - DNA, 23 bp, Homo sapiens
ctaaaatatttattttttttaag

SEQ ID NO: 997401 - DNA, 15 bp, Homo sapiens
ctaaaatattttaga

SEQ ID NO: 997402 - DNA, 19 bp, Homo sapiens
ctaaaatattttagatgtt

SEQ ID NO: 997403 - DNA, 19 bp, Homo sapiens
ctaaaatgattgtgcctct

SEQ ID NO: 997404 - DNA, 22 bp, Homo sapiens
ctaaaattaaaaagaaaatatt

SEQ ID NO: 997405 - DNA, 19 bp, Homo sapiens
ctaaaattgagttcttcct

SEQ ID NO: 997406 - DNA, 15 bp, Homo sapiens
ctaaaattgggcttg

SEQ ID NO: 997407 - DNA, 22 bp, Homo sapiens
ctaaacaagattttaaagacat

SEQ ID NO: 997408 - DNA, 23 bp, Homo sapiens
ctaaacaagattttaaagacatg

SEQ ID NO: 997409 - DNA, 19 bp, Homo sapiens
ctaaacaatgctgatttgg

SEQ ID NO: 997410 - DNA, 13 bp, Homo sapiens
ctaaacagatata

SEQ ID NO: 997411 - DNA, 14 bp, Homo sapiens
ctaaacataattgt

SEQ ID NO: 997412 - DNA, 12 bp, Homo sapiens
ctaaacatccat

SEQ ID NO: 997413 - DNA, 15 bp, Homo sapiens
ctaaaccaaaacaga

SEQ ID NO: 997414 - DNA, 20 bp, Homo sapiens
ctaaaccaagattatgtgac

SEQ ID NO: 997415 - DNA, 19 bp, Homo sapiens
ctaaaccaaggactgagca

SEQ ID NO: 997416 - DNA, 20 bp, Homo sapiens
ctaaaccaaggactgagcac

SEQ ID NO: 997417 - DNA, 23 bp, Homo sapiens
ctaaaccaaggactgagcaccct

SEQ ID NO: 997418 - DNA, 15 bp, Homo sapiens
ctaaaccacttctct

SEQ ID NO: 997419 - DNA, 16 bp, Homo sapiens
ctaaacccaatccaaa

SEQ ID NO: 997420 - DNA, 15 bp, Homo sapiens
ctaaacccctgtccc

SEQ ID NO: 997421 - DNA, 17 bp, Homo sapiens
ctaaacctcagttatta

SEQ ID NO: 997422 - DNA, 16 bp, Homo sapiens
ctaaactccttcctgg

SEQ ID NO: 997423 - DNA, 22 bp, Homo sapiens
ctaaactccttcctggcctgag

SEQ ID NO: 997424 - DNA, 17 bp, Homo sapiens
ctaaactctctagctta

SEQ ID NO: 997425 - DNA, 12 bp, Homo sapiens
ctaaactctggg

SEQ ID NO: 997426 - DNA, 13 bp, Homo sapiens
ctaaactctgggg

SEQ ID NO: 997427 - DNA, 15 bp, Homo sapiens
ctaaactctggggct

SEQ ID NO: 997428 - DNA, 21 bp, Homo sapiens
ctaaactgcagcctctctggc

SEQ ID NO: 997429 - DNA, 12 bp, Homo sapiens
ctaaactttatt

SEQ ID NO: 997430 - DNA, 16 bp, Homo sapiens
ctaaactttatttgta

SEQ ID NO: 997431 - DNA, 17 bp, Homo sapiens
ctaaactttatttgtaa

SEQ ID NO: 997432 - DNA, 15 bp, Homo sapiens
ctaaactttttttct

SEQ ID NO: 997433 - DNA, 17 bp, Homo sapiens
ctaaactttttttctgt

SEQ ID NO: 997434 - DNA, 13 bp, Homo sapiens
ctaaagaaaaaca

SEQ ID NO: 997435 - DNA, 17 bp, Homo sapiens
ctaaagaaaaacaaact

SEQ ID NO: 997436 - DNA, 12 bp, Homo sapiens
ctaaagaaaaat

SEQ ID NO: 997437 - DNA, 21 bp, Homo sapiens
ctaaagaaaaatatcttggcc

SEQ ID NO: 997438 - DNA, 23 bp, Homo sapiens
ctaaagaaaaatatcttggccta

SEQ ID NO: 997439 - DNA, 18 bp, Homo sapiens
ctaaagaaaaatgcctgt

SEQ ID NO: 997440 - DNA, 20 bp, Homo sapiens
ctaaagaaacttggctggaa

SEQ ID NO: 997441 - DNA, 18 bp, Homo sapiens
ctaaagactaacttgaaa

SEQ ID NO: 997442 - DNA, 16 bp, Homo sapiens
ctaaagagagaatgta

SEQ ID NO: 997443 - DNA, 18 bp, Homo sapiens
ctaaagaggctgaaagag

SEQ ID NO: 997444 - DNA, 19 bp, Homo sapiens
ctaaagagttattcaaatg

SEQ ID NO: 997445 - DNA, 21 bp, Homo sapiens
ctaaagagttattcaaatgaa

SEQ ID NO: 997446 - DNA, 18 bp, Homo sapiens
ctaaagagtttattttaa

SEQ ID NO: 997447 - DNA, 19 bp, Homo sapiens
ctaaagagtttattttaag

SEQ ID NO: 997448 - DNA, 12 bp, Homo sapiens
ctaaagcacttt

SEQ ID NO: 997449 - DNA, 20 bp, Homo sapiens
ctaaagcactttgcacttaa

SEQ ID NO: 997450 - DNA, 15 bp, Homo sapiens
ctaaagccagcctga

SEQ ID NO: 997451 - DNA, 17 bp, Homo sapiens
ctaaagcccaacctcct

SEQ ID NO: 997452 - DNA, 16 bp, Homo sapiens
ctaaagcctcaaaaca

SEQ ID NO: 997453 - DNA, 12 bp, Homo sapiens
ctaaagccttaa

SEQ ID NO: 997454 - DNA, 21 bp, Homo sapiens
ctaaagccttaactaagactc

SEQ ID NO: 997455 - DNA, 15 bp, Homo sapiens
ctaaagcttcagact

SEQ ID NO: 997456 - DNA, 12 bp, Homo sapiens
ctaaagctttat

SEQ ID NO: 997457 - DNA, 15 bp, Homo sapiens
ctaaaggatccagag

SEQ ID NO: 997458 - DNA, 18 bp, Homo sapiens
ctaaaggatggaaaaata

SEQ ID NO: 997459 - DNA, 19 bp, Homo sapiens
ctaaaggatggaaaaataa

SEQ ID NO: 997460 - DNA, 20 bp, Homo sapiens
ctaaaggatggaaaaataaa

SEQ ID NO: 997461 - DNA, 15 bp, Homo sapiens
ctaggactctgaggc

SEQ ID NO: 997462 - DNA, 15 bp, Homo sapiens
ctaggactgaggagt

SEQ ID NO: 997463 - DNA, 13 bp, Homo sapiens
ctaggacttaaaa

SEQ ID NO: 997464 - DNA, 22 bp, Homo sapiens
ctaggacttaaaattagtcttt

SEQ ID NO: 997465 - DNA, 18 bp, Homo sapiens
ctaggagaaccaaatctg

SEQ ID NO: 997466 - DNA, 21 bp, Homo sapiens
ctaggagaaccaaatctggaa

SEQ ID NO: 997467 - DNA, 17 bp, Homo sapiens
ctaggagagccaacctc

SEQ ID NO: 997468 - DNA, 18 bp, Homo sapiens
ctaggagggagacactgg

SEQ ID NO: 997469 - DNA, 22 bp, Homo sapiens
ctaggagggagacactggcccc

SEQ ID NO: 997470 - DNA, 14 bp, Homo sapiens
ctaggaggtaatga

SEQ ID NO: 997471 - DNA, 19 bp, Homo sapiens
ctaggagtatatttccgca

SEQ ID NO: 997472 - DNA, 19 bp, Homo sapiens
ctaggagtcaactggctgg

SEQ ID NO: 997473 - DNA, 22 bp, Homo sapiens
ctaggatagctaactgtaaatc

SEQ ID NO: 997474 - DNA, 22 bp, Homo sapiens
ctaggatgtgcattctccagcc

SEQ ID NO: 997475 - DNA, 14 bp, Homo sapiens
ctaggatgtggagc

SEQ ID NO: 997476 - DNA, 18 bp, Homo sapiens
ctaggattccccctgccc

SEQ ID NO: 997477 - DNA, 19 bp, Homo sapiens
ctaggattccccctgccct

SEQ ID NO: 997478 - DNA, 20 bp, Homo sapiens
ctaggattccccctgccctg

SEQ ID NO: 997479 - DNA, 15 bp, Homo sapiens
ctaggcaggacctgt

SEQ ID NO: 997480 - DNA, 18 bp, Homo sapiens
ctaggcatacactgtagt

SEQ ID NO: 997481 - DNA, 21 bp, Homo sapiens
ctaggcataggtctctttgct

SEQ ID NO: 997482 - DNA, 22 bp, Homo sapiens
ctaggcatcacccccgctttgg

SEQ ID NO: 997483 - DNA, 17 bp, Homo sapiens
ctaggcatctctgtact

SEQ ID NO: 997484 - DNA, 20 bp, Homo sapiens
ctaggcatgtcagaggaccc

SEQ ID NO: 997485 - DNA, 23 bp, Homo sapiens
ctaggcatgtcagaggaccccag

SEQ ID NO: 997486 - DNA, 24 bp, Homo sapiens
ctaggcatgtcagaggaccccagg

SEQ ID NO: 997487 - DNA, 22 bp, Homo sapiens
ctaggcattgcaggaccttggg

SEQ ID NO: 997488 - DNA, 19 bp, Homo sapiens
ctaggccacaccatctcct

SEQ ID NO: 997489 - DNA, 16 bp, Homo sapiens
ctaggccactcctcca

SEQ ID NO: 997490 - DNA, 17 bp, Homo sapiens
ctaggccactcctccaa

SEQ ID NO: 997491 - DNA, 17 bp, Homo sapiens
ctaggccagagccatgc

SEQ ID NO: 997492 - DNA, 22 bp, Homo sapiens
ctaggccccccagaaagctgcc

SEQ ID NO: 997493 - DNA, 13 bp, Homo sapiens
ctaggcctcagcc

SEQ ID NO: 997494 - DNA, 19 bp, Homo sapiens
ctaggcctcagccagagaa

SEQ ID NO: 997495 - DNA, 13 bp, Homo sapiens
ctaggcctgggga

SEQ ID NO: 997496 - DNA, 16 bp, Homo sapiens
ctaggcgagtgccagg

SEQ ID NO: 997497 - DNA, 20 bp, Homo sapiens
ctaggcgagtgccaggactc

SEQ ID NO: 997498 - DNA, 17 bp, Homo sapiens
ctaggcgcgatggctgt

SEQ ID NO: 997499 - DNA, 16 bp, Homo sapiens
ctaggcgggatgggct

SEQ ID NO: 997500 - DNA, 21 bp, Homo sapiens
ctaggctcgccttccctcctg

SEQ ID NO: 997501 - DNA, 15 bp, Homo sapiens
ctaggctggaagcca

SEQ ID NO: 997502 - DNA, 21 bp, Homo sapiens
ctaggcttaatacctgggtga

SEQ ID NO: 997503 - DNA, 19 bp, Homo sapiens
ctagggaaaaaccagcgtg

SEQ ID NO: 997504 - DNA, 17 bp, Homo sapiens
ctagggaaacttcccgt

SEQ ID NO: 997505 - DNA, 16 bp, Homo sapiens
ctagggacatgggaaa

SEQ ID NO: 997506 - DNA, 20 bp, Homo sapiens
ctagggactatcaggtaata

SEQ ID NO: 997507 - DNA, 14 bp, Homo sapiens
ctagggagagaccc

SEQ ID NO: 997508 - DNA, 11 bp, Homo sapiens
ctagggagagg

SEQ ID NO: 997509 - DNA, 15 bp, Homo sapiens
ctagggagagggaag

SEQ ID NO: 997510 - DNA, 10 bp, Homo sapiens
ctagggagcc

SEQ ID NO: 997511 - DNA, 14 bp, Homo sapiens
ctagggaggacctt

SEQ ID NO: 997512 - DNA, 19 bp, Homo sapiens
ctagggatataaaaacaga

SEQ ID NO: 997513 - DNA, 17 bp, Homo sapiens
ctagggatccctcatct

SEQ ID NO: 997514 - DNA, 23 bp, Homo sapiens
ctagggatccctcatctgtccct

SEQ ID NO: 997515 - DNA, 20 bp, Homo sapiens
ctagggcagggtgggagccg

SEQ ID NO: 997516 - DNA, 13 bp, Homo sapiens
ctagggctgctgc

SEQ ID NO: 997517 - DNA, 12 bp, Homo sapiens
ctaggggaaggg

SEQ ID NO: 997518 - DNA, 15 bp, Homo sapiens
ctaggggaagggggt

SEQ ID NO: 997519 - DNA, 20 bp, Homo sapiens
ctaggggagaagagccctgg

SEQ ID NO: 997520 - DNA, 15 bp, Homo sapiens
ctaggggtagctggt

SEQ ID NO: 997521 - DNA, 16 bp, Homo sapiens
ctaggggtcaggctcc

SEQ ID NO: 997522 - DNA, 16 bp, Homo sapiens
ctaggggtggcgctca

SEQ ID NO: 997523 - DNA, 19 bp, Homo sapiens
ctaggggtggcgctcagac

SEQ ID NO: 997524 - DNA, 21 bp, Homo sapiens
ctagggtctgataggaacaga

SEQ ID NO: 997525 - DNA, 17 bp, Homo sapiens
ctagggtggcccttgca

SEQ ID NO: 997526 - DNA, 19 bp, Homo sapiens
ctagggttaggaggtcctt

SEQ ID NO: 997527 - DNA, 20 bp, Homo sapiens
ctaggtacgatgacagtgtt

SEQ ID NO: 997528 - DNA, 15 bp, Homo sapiens
ctaggtaggaagagc

SEQ ID NO: 997529 - DNA, 15 bp, Homo sapiens
ctaggtcccttcccg

SEQ ID NO: 997530 - DNA, 20 bp, Homo sapiens
ctaggtcccttcccgaccca

SEQ ID NO: 997531 - DNA, 16 bp, Homo sapiens
ctaggtgacatataca

SEQ ID NO: 997532 - DNA, 18 bp, Homo sapiens
ctaggtgctatttgtcat

SEQ ID NO: 997533 - DNA, 19 bp, Homo sapiens
ctaggtggaggttgtgcat

SEQ ID NO: 997534 - DNA, 20 bp, Homo sapiens
ctaggtgggaagatggtttg

SEQ ID NO: 997535 - DNA, 19 bp, Homo sapiens
ctaggtgggccagcccctc

SEQ ID NO: 997536 - DNA, 16 bp, Homo sapiens
ctaggtgtccccaacg

SEQ ID NO: 997537 - DNA, 22 bp, Homo sapiens
ctaggtgtccccaacgtcccct

SEQ ID NO: 997538 - DNA, 13 bp, Homo sapiens
ctaggttatacaa

SEQ ID NO: 997539 - DNA, 13 bp, Homo sapiens
ctaggttccctgt

SEQ ID NO: 997540 - DNA, 22 bp, Homo sapiens
ctagtaacaatacatgagaaag

SEQ ID NO: 997541 - DNA, 22 bp, Homo sapiens
ctagtactctctgctctagcca

SEQ ID NO: 997542 - DNA, 13 bp, Homo sapiens
ctagtactgtatt

SEQ ID NO: 997543 - DNA, 14 bp, Homo sapiens
ctagtactgtattg

SEQ ID NO: 997544 - DNA, 13 bp, Homo sapiens
ctagtactttgat

SEQ ID NO: 997545 - DNA, 16 bp, Homo sapiens
ctagtagcaatgtgcc

SEQ ID NO: 997546 - DNA, 23 bp, Homo sapiens
ctagtaggcagcaaaagaccaaa

SEQ ID NO: 997547 - DNA, 14 bp, Homo sapiens
cacctgtaaacctg

SEQ ID NO: 997548 - DNA, 13 bp, Homo sapiens
cacctgtaatccc

SEQ ID NO: 997549 - DNA, 12 bp, Homo sapiens
cacctgtacata

SEQ ID NO: 997550 - DNA, 15 bp, Homo sapiens
cacctgtactcagga

SEQ ID NO: 997551 - DNA, 16 bp, Homo sapiens
cacctgtactcaggag

SEQ ID NO: 997552 - DNA, 18 bp, Homo sapiens
cacctgtactcttccgaa

SEQ ID NO: 997553 - DNA, 12 bp, Homo sapiens
cacctgtagctg

SEQ ID NO: 997554 - DNA, 19 bp, Homo sapiens
cacctgtaggcagaggctg

SEQ ID NO: 997555 - DNA, 15 bp, Homo sapiens
cacctgtagtcccag

SEQ ID NO: 997556 - DNA, 17 bp, Homo sapiens
cacctgtagtcccagct

SEQ ID NO: 997557 - DNA, 22 bp, Homo sapiens
cacctgtccccaccctccactc

SEQ ID NO: 997558 - DNA, 21 bp, Homo sapiens
cacctgtccggcccagtgcca

SEQ ID NO: 997559 - DNA, 17 bp, Homo sapiens
cacctgtctcagcctcc

SEQ ID NO: 997560 - DNA, 18 bp, Homo sapiens
cacctgtctcagcctccc

SEQ ID NO: 997561 - DNA, 13 bp, Homo sapiens
cacctgtgacaaa

SEQ ID NO: 997562 - DNA, 14 bp, Homo sapiens
cacctgtgacaaag

SEQ ID NO: 997563 - DNA, 19 bp, Homo sapiens
cacctgtgagtttaaagca

SEQ ID NO: 997564 - DNA, 23 bp, Homo sapiens
cacctgtgccctcaccaccacac

SEQ ID NO: 997565 - DNA, 14 bp, Homo sapiens
cacctgtgctgctg

SEQ ID NO: 997566 - DNA, 15 bp, Homo sapiens
cacctgtgctgctgc

SEQ ID NO: 997567 - DNA, 21 bp, Homo sapiens
cacctgtgctgctgcaccaac

SEQ ID NO: 997568 - DNA, 12 bp, Homo sapiens
cacctgtggctg

SEQ ID NO: 997569 - DNA, 22 bp, Homo sapiens
cacctgttggctacacagaccc

SEQ ID NO: 997570 - DNA, 15 bp, Homo sapiens
cacctgttttctgaa

SEQ ID NO: 997571 - DNA, 21 bp, Homo sapiens
cacctgttttctgaaacacac

SEQ ID NO: 997572 - DNA, 13 bp, Homo sapiens
caccttaaattaa

SEQ ID NO: 997573 - DNA, 19 bp, Homo sapiens
caccttaccaactttctgt

SEQ ID NO: 997574 - DNA, 18 bp, Homo sapiens
caccttagagaagctacc

SEQ ID NO: 997575 - DNA, 16 bp, Homo sapiens
caccttagtctttcct

SEQ ID NO: 997576 - DNA, 15 bp, Homo sapiens
caccttcaaaatgtt

SEQ ID NO: 997577 - DNA, 21 bp, Homo sapiens
caccttcaatgacttctaatt

SEQ ID NO: 997578 - DNA, 15 bp, Homo sapiens
caccttccagctcct

SEQ ID NO: 997579 - DNA, 18 bp, Homo sapiens
caccttccagctcctgta

SEQ ID NO: 997580 - DNA, 18 bp, Homo sapiens
caccttccattttccccc

SEQ ID NO: 997581 - DNA, 15 bp, Homo sapiens
caccttcccacccct

SEQ ID NO: 997582 - DNA, 15 bp, Homo sapiens
caccttcccagctct

SEQ ID NO: 997583 - DNA, 14 bp, Homo sapiens
ctatcttcatgtaa

SEQ ID NO: 997584 - DNA, 20 bp, Homo sapiens
ctatcttcatgtaaattgac

SEQ ID NO: 997585 - DNA, 13 bp, Homo sapiens
ctatcttccaaat

SEQ ID NO: 997586 - DNA, 16 bp, Homo sapiens
ctatgaaaagctagaa

SEQ ID NO: 997587 - DNA, 17 bp, Homo sapiens
ctatgaaaatgagccct

SEQ ID NO: 997588 - DNA, 17 bp, Homo sapiens
ctatgaaaatgctggct

SEQ ID NO: 997589 - DNA, 12 bp, Homo sapiens
ctatgaacaact

SEQ ID NO: 997590 - DNA, 11 bp, Homo sapiens
ctatgaacaga

SEQ ID NO: 997591 - DNA, 16 bp, Homo sapiens
ctatgaagttgctgtt

SEQ ID NO: 997592 - DNA, 23 bp, Homo sapiens
ctatgaatgaaattcttttataa

SEQ ID NO: 997593 - DNA, 16 bp, Homo sapiens
ctatgacaatcttatt

SEQ ID NO: 997594 - DNA, 14 bp, Homo sapiens
ctatgacagctggc

SEQ ID NO: 997595 - DNA, 15 bp, Homo sapiens
ctatgacttttttaa

SEQ ID NO: 997596 - DNA, 16 bp, Homo sapiens
ctatgacttttttaaa

SEQ ID NO: 997597 - DNA, 11 bp, Homo sapiens
ctatgagaaaa

SEQ ID NO: 997598 - DNA, 22 bp, Homo sapiens
ctatgagaacaagtcacagctg

SEQ ID NO: 997599 - DNA, 22 bp, Homo sapiens
ctatgagatggccatgctcaac

SEQ ID NO: 997600 - DNA, 14 bp, Homo sapiens
ctatgaggaaaggt

SEQ ID NO: 997601 - DNA, 12 bp, Homo sapiens
ctatgataaagt

SEQ ID NO: 997602 - DNA, 17 bp, Homo sapiens
ctatgatagataataaa

SEQ ID NO: 997603 - DNA, 23 bp, Homo sapiens
ctatgatattccccatttcctgt

SEQ ID NO: 997604 - DNA, 23 bp, Homo sapiens
ctatgatattttctgtgcctgaa

SEQ ID NO: 997605 - DNA, 15 bp, Homo sapiens
ctatgatcacagtga

SEQ ID NO: 997606 - DNA, 21 bp, Homo sapiens
ctatgatcagaagaacatgat

SEQ ID NO: 997607 - DNA, 14 bp, Homo sapiens
ctatgatcatcttg

SEQ ID NO: 997608 - DNA, 20 bp, Homo sapiens
ctatgatccttttttgtcat

SEQ ID NO: 997609 - DNA, 17 bp, Homo sapiens
ctatgatgggcttctgt

SEQ ID NO: 997610 - DNA, 13 bp, Homo sapiens
ctatgatggtgac

SEQ ID NO: 997611 - DNA, 20 bp, Homo sapiens
ctatgatttttttttccaaa

SEQ ID NO: 997612 - DNA, 19 bp, Homo sapiens
ctatgcaaaaaattcttta

SEQ ID NO: 997613 - DNA, 20 bp, Homo sapiens
ctatgcaaagcactctctgc

SEQ ID NO: 997614 - DNA, 21 bp, Homo sapiens
ctatgcaaagcactctctgca

SEQ ID NO: 997615 - DNA, 22 bp, Homo sapiens
ctatgcaataatccacccccag

SEQ ID NO: 997616 - DNA, 20 bp, Homo sapiens
ctatgcagacatctctggag

SEQ ID NO: 997617 - DNA, 21 bp, Homo sapiens
ctatgcagacatctctggagc

SEQ ID NO: 997618 - DNA, 22 bp, Homo sapiens
ctatgcagacatctctggagcc

SEQ ID NO: 997619 - DNA, 23 bp, Homo sapiens
ctatgcagacatctctggagcca

SEQ ID NO: 997620 - DNA, 21 bp, Homo sapiens
ctatgcagcatggggttttta

SEQ ID NO: 997621 - DNA, 15 bp, Homo sapiens
ctatgcaggcagcac

SEQ ID NO: 997622 - DNA, 14 bp, Homo sapiens
ctatgcagtatctc

SEQ ID NO: 997623 - DNA, 20 bp, Homo sapiens
ctatgcatatcagttgagct

SEQ ID NO: 997624 - DNA, 21 bp, Homo sapiens
ctatgcatctgagaaaggtct

SEQ ID NO: 997625 - DNA, 11 bp, Homo sapiens
ctatgcatttg

SEQ ID NO: 997626 - DNA, 19 bp, Homo sapiens
ctatgcattttaaagttaa

SEQ ID NO: 997627 - DNA, 19 bp, Homo sapiens
ctatgcattttcttcacag

SEQ ID NO: 997628 - DNA, 22 bp, Homo sapiens
ctatgcattttcttcacagtgc

SEQ ID NO: 997629 - DNA, 13 bp, Homo sapiens
ctatgcccacata

SEQ ID NO: 997630 - DNA, 15 bp, Homo sapiens
ctatgcccaggtacc

SEQ ID NO: 997631 - DNA, 20 bp, Homo sapiens
ctatgcccaggtaccaccct

SEQ ID NO: 997632 - DNA, 15 bp, Homo sapiens
ctatgccctgcagag

SEQ ID NO: 997633 - DNA, 20 bp, Homo sapiens
ctatgccctgcagagcaata

SEQ ID NO: 997634 - DNA, 13 bp, Homo sapiens
ctatgccctgccc

SEQ ID NO: 997635 - DNA, 20 bp, Homo sapiens
ctatgccctgcccttcctca

SEQ ID NO: 997636 - DNA, 23 bp, Homo sapiens
ctatgccctgcccttcctcaggg

SEQ ID NO: 997637 - DNA, 12 bp, Homo sapiens
ctatgcctgcac

SEQ ID NO: 997638 - DNA, 14 bp, Homo sapiens
ctatgcctgtggtg

SEQ ID NO: 997639 - DNA, 21 bp, Homo sapiens
ctatgcctgtggtgaagtgtg

SEQ ID NO: 997640 - DNA, 23 bp, Homo sapiens
ctatgcggaggaaagcaagtgtt

SEQ ID NO: 997641 - DNA, 16 bp, Homo sapiens
ctatgctattgacaat

SEQ ID NO: 997642 - DNA, 17 bp, Homo sapiens
ctatgctattgacaata

SEQ ID NO: 997643 - DNA, 20 bp, Homo sapiens
ctatgctattgacaataaaa

SEQ ID NO: 997644 - DNA, 19 bp, Homo sapiens
ctatgctgaagacattcaa

SEQ ID NO: 997645 - DNA, 13 bp, Homo sapiens
ctatgctggcttt

SEQ ID NO: 997646 - DNA, 22 bp, Homo sapiens
ctatgctggcttttcaccccag

SEQ ID NO: 997647 - DNA, 13 bp, Homo sapiens
ctatgctgtttgt

SEQ ID NO: 997648 - DNA, 17 bp, Homo sapiens
ctatgcttaataaaaga

SEQ ID NO: 997649 - DNA, 21 bp, Homo sapiens
ctatggaaaagggtcttcttg

SEQ ID NO: 997650 - DNA, 12 bp, Homo sapiens
ctatggaaatgt

SEQ ID NO: 997651 - DNA, 16 bp, Homo sapiens
ctatggaagtggttct

SEQ ID NO: 997652 - DNA, 14 bp, Homo sapiens
ctatggacaactta

SEQ ID NO: 997653 - DNA, 17 bp, Homo sapiens
ctatggacaacttattt

SEQ ID NO: 997654 - DNA, 14 bp, Homo sapiens
ctatggatggcttc

SEQ ID NO: 997655 - DNA, 11 bp, Homo sapiens
ctatggatgtg

SEQ ID NO: 997656 - DNA, 24 bp, Homo sapiens
ctatggatgtggggtccccatcat

SEQ ID NO: 997657 - DNA, 13 bp, Homo sapiens
ctatggccagtct

SEQ ID NO: 997658 - DNA, 14 bp, Homo sapiens
ctatggccagtctg

SEQ ID NO: 997659 - DNA, 17 bp, Homo sapiens
ctatggccagtctgccc

SEQ ID NO: 997660 - DNA, 16 bp, Homo sapiens
ctatggccctgcaaaa

SEQ ID NO: 997661 - DNA, 14 bp, Homo sapiens
ctatgggagcccca

SEQ ID NO: 997662 - DNA, 17 bp, Homo sapiens
ctatgggagccccaggg

SEQ ID NO: 997663 - DNA, 23 bp, Homo sapiens
ctatggggaaggttatcagtgct

SEQ ID NO: 997664 - DNA, 19 bp, Homo sapiens
ctatggggattcaggggct

SEQ ID NO: 997665 - DNA, 21 bp, Homo sapiens
ctatggggattcaggggcttt

SEQ ID NO: 997666 - DNA, 23 bp, Homo sapiens
ctatggggattcaggggctttgg

SEQ ID NO: 997667 - DNA, 19 bp, Homo sapiens
ctatgggtctaggacacag

SEQ ID NO: 997668 - DNA, 14 bp, Homo sapiens
ctatgggttatttt

SEQ ID NO: 997669 - DNA, 21 bp, Homo sapiens
ctatgggtttagttactttag

SEQ ID NO: 997670 - DNA, 18 bp, Homo sapiens
ctatggtatgctggccag

SEQ ID NO: 997671 - DNA, 21 bp, Homo sapiens
ctatggtgagatgcagctgga

SEQ ID NO: 997672 - DNA, 18 bp, Homo sapiens
ctatggttcccaataaaa

SEQ ID NO: 997673 - DNA, 22 bp, Homo sapiens
ctatggttcccaataaaagtga

SEQ ID NO: 997674 - DNA, 23 bp, Homo sapiens
ctatggttcccaataaaagtgac

SEQ ID NO: 997675 - DNA, 16 bp, Homo sapiens
ctatggttgccacccc

SEQ ID NO: 997676 - DNA, 13 bp, Homo sapiens
ctatgtaaactac

SEQ ID NO: 997677 - DNA, 13 bp, Homo sapiens
ctatgtaaattat

SEQ ID NO: 997678 - DNA, 14 bp, Homo sapiens
ctatgtaaattatt

SEQ ID NO: 997679 - DNA, 15 bp, Homo sapiens
ctatgtaaattattg

SEQ ID NO: 997680 - DNA, 23 bp, Homo sapiens
ctatgtaaattattgtaaacttt

SEQ ID NO: 997681 - DNA, 14 bp, Homo sapiens
ctatgtacagagct

SEQ ID NO: 997682 - DNA, 17 bp, Homo sapiens
ctatgtacagagctttc

SEQ ID NO: 997683 - DNA, 14 bp, Homo sapiens
ctatgtatatacat

SEQ ID NO: 997684 - DNA, 22 bp, Homo sapiens
ctatgtatcgctcctattgaaa

SEQ ID NO: 997685 - DNA, 20 bp, Homo sapiens
cactattcttaagcactttg

SEQ ID NO: 997686 - DNA, 21 bp, Homo sapiens
cactattgtgaatatttggaa

SEQ ID NO: 997687 - DNA, 18 bp, Homo sapiens
cactatttatttacaaat

SEQ ID NO: 997688 - DNA, 13 bp, Homo sapiens
cactatttccaaa

SEQ ID NO: 997689 - DNA, 14 bp, Homo sapiens
cactatttccaaaa

SEQ ID NO: 997690 - DNA, 14 bp, Homo sapiens
cactatttccttta

SEQ ID NO: 997691 - DNA, 16 bp, Homo sapiens
cactattttcaaagaa

SEQ ID NO: 997692 - DNA, 15 bp, Homo sapiens
cactcaaaagctggg

SEQ ID NO: 997693 - DNA, 17 bp, Homo sapiens
cactcaaaagctgggca

SEQ ID NO: 997694 - DNA, 18 bp, Homo sapiens
cactcaaaagctgggcag

SEQ ID NO: 997695 - DNA, 20 bp, Homo sapiens
cactcaaattaatctttctt

SEQ ID NO: 997696 - DNA, 16 bp, Homo sapiens
cactcaagacccggtt

SEQ ID NO: 997697 - DNA, 20 bp, Homo sapiens
cactcaaggacaggagcctg

SEQ ID NO: 997698 - DNA, 22 bp, Homo sapiens
cactcacaatttaaaatatttc

SEQ ID NO: 997699 - DNA, 22 bp, Homo sapiens
cactcaccacaagctgagcagg

SEQ ID NO: 997700 - DNA, 18 bp, Homo sapiens
cactcaccactaccagcc

SEQ ID NO: 997701 - DNA, 14 bp, Homo sapiens
cactcaccagggtc

SEQ ID NO: 997702 - DNA, 18 bp, Homo sapiens
cactcaccagtggccttt

SEQ ID NO: 997703 - DNA, 14 bp, Homo sapiens
cactcaccatgaag

SEQ ID NO: 997704 - DNA, 17 bp, Homo sapiens
cactcaccccagcctca

SEQ ID NO: 997705 - DNA, 19 bp, Homo sapiens
ctattttgtaaactcaaaa

SEQ ID NO: 997706 - DNA, 17 bp, Homo sapiens
ctattttgtgaagccat

SEQ ID NO: 997707 - DNA, 16 bp, Homo sapiens
ctattttgtgatgatg

SEQ ID NO: 997708 - DNA, 14 bp, Homo sapiens
ctatttttaaataa

SEQ ID NO: 997709 - DNA, 23 bp, Homo sapiens
ctatttttaaataatttcctaca

SEQ ID NO: 997710 - DNA, 13 bp, Homo sapiens
ctatttttatcat

SEQ ID NO: 997711 - DNA, 17 bp, Homo sapiens
ctatttttatcatgaat

SEQ ID NO: 997712 - DNA, 15 bp, Homo sapiens
ctatttttatttata

SEQ ID NO: 997713 - DNA, 15 bp, Homo sapiens
ctatttttcaatcat

SEQ ID NO: 997714 - DNA, 20 bp, Homo sapiens
ctatttttcttgttgcatct

SEQ ID NO: 997715 - DNA, 22 bp, Homo sapiens
ctatttttgacatggaaatgaa

SEQ ID NO: 997716 - DNA, 15 bp, Homo sapiens
ctattttttaaagac

SEQ ID NO: 997717 - DNA, 16 bp, Homo sapiens
ctattttttaaagact

SEQ ID NO: 997718 - DNA, 18 bp, Homo sapiens
ctattttttattttactt

SEQ ID NO: 997719 - DNA, 14 bp, Homo sapiens
ctatttttttctct

SEQ ID NO: 997720 - DNA, 18 bp, Homo sapiens
ctatttttttttcttttt

SEQ ID NO: 997721 - DNA, 19 bp, Homo sapiens
ctatttttttttcttttta

SEQ ID NO: 997722 - DNA, 21 bp, Homo sapiens
ctcaaaaaaaagaaaatgtct

SEQ ID NO: 997723 - DNA, 22 bp, Homo sapiens
ctcaaaaaaacaaaaaagactt

SEQ ID NO: 997724 - DNA, 15 bp, Homo sapiens
ctcaaaacctggaga

SEQ ID NO: 997725 - DNA, 19 bp, Homo sapiens
ctcaaaacgggtcagtatt

SEQ ID NO: 997726 - DNA, 15 bp, Homo sapiens
ctcaaaagtctattt

SEQ ID NO: 997727 - DNA, 18 bp, Homo sapiens
ctcaaaatatttgtacat

SEQ ID NO: 997728 - DNA, 22 bp, Homo sapiens
ctcaaaatctttgtataaataa

SEQ ID NO: 997729 - DNA, 21 bp, Homo sapiens
ctcaaaatgacagtttcagag

SEQ ID NO: 997730 - DNA, 15 bp, Homo sapiens
ctcaaaccacttgcc

SEQ ID NO: 997731 - DNA, 17 bp, Homo sapiens
ctcaaaccacttgcctg

SEQ ID NO: 997732 - DNA, 14 bp, Homo sapiens
ctcaaacctcctct

SEQ ID NO: 997733 - DNA, 15 bp, Homo sapiens
ctcaaacctcctctt

SEQ ID NO: 997734 - DNA, 19 bp, Homo sapiens
ctcaaacctggagctgagg

SEQ ID NO: 997735 - DNA, 16 bp, Homo sapiens
ctcaaacgacagagga

SEQ ID NO: 997736 - DNA, 14 bp, Homo sapiens
ctcaaactcctgac

SEQ ID NO: 997737 - DNA, 19 bp, Homo sapiens
ctcaaactctggggctcaa

SEQ ID NO: 997738 - DNA, 11 bp, Homo sapiens
ctcaaactgca

SEQ ID NO: 997739 - DNA, 13 bp, Homo sapiens
ctcaaacttgtgg

SEQ ID NO: 997740 - DNA, 13 bp, Homo sapiens
ctcaaagaaagtg

SEQ ID NO: 997741 - DNA, 16 bp, Homo sapiens
ctcaaagaaagtgtat

SEQ ID NO: 997742 - DNA, 17 bp, Homo sapiens
ctcaaagaaagtgtatt

SEQ ID NO: 997743 - DNA, 14 bp, Homo sapiens
ctcaaagaggcctt

SEQ ID NO: 997744 - DNA, 22 bp, Homo sapiens
ctcaaagagggggctctgccca

SEQ ID NO: 997745 - DNA, 16 bp, Homo sapiens
ctcaaagatctgaatt

SEQ ID NO: 997746 - DNA, 18 bp, Homo sapiens
ctcaaagatgatggaaac

SEQ ID NO: 997747 - DNA, 23 bp, Homo sapiens
ctcaaagatgcgtttgcctcctg

SEQ ID NO: 997748 - DNA, 21 bp, Homo sapiens
ctcaaagcaacccgctggagc

SEQ ID NO: 997749 - DNA, 19 bp, Homo sapiens
ctcaaagcaagcattcaga

SEQ ID NO: 997750 - DNA, 23 bp, Homo sapiens
ctcaaagcttggattaaatacat

SEQ ID NO: 997751 - DNA, 17 bp, Homo sapiens
ctcaaaggagaaaaaaa

SEQ ID NO: 997752 - DNA, 22 bp, Homo sapiens
ctcaaaggagaaaaaaaacctt

SEQ ID NO: 997753 - DNA, 18 bp, Homo sapiens
ctcaaaggtttggaagga

SEQ ID NO: 997754 - DNA, 19 bp, Homo sapiens
ctcaaaggtttggaaggag

SEQ ID NO: 997755 - DNA, 20 bp, Homo sapiens
ctcaaagttaattcacctat

SEQ ID NO: 997756 - DNA, 12 bp, Homo sapiens
ctcaaataacta

SEQ ID NO: 997757 - DNA, 13 bp, Homo sapiens
ctcaaatctattc

SEQ ID NO: 997758 - DNA, 15 bp, Homo sapiens
ctcaaatctgaggga

SEQ ID NO: 997759 - DNA, 17 bp, Homo sapiens
ctcaaatgacccaaaga

SEQ ID NO: 997760 - DNA, 21 bp, Homo sapiens
ctcaaatgagtaacatttgct

SEQ ID NO: 997761 - DNA, 16 bp, Homo sapiens
ctcaaatgctcagacc

SEQ ID NO: 997762 - DNA, 22 bp, Homo sapiens
ctcaaatgctcagaccagctct

SEQ ID NO: 997763 - DNA, 20 bp, Homo sapiens
ctcaaatggtgtcatggctg

SEQ ID NO: 997764 - DNA, 16 bp, Homo sapiens
ctcaaattaatctttc

SEQ ID NO: 997765 - DNA, 23 bp, Homo sapiens
ctcaaattaatctttctttacct

SEQ ID NO: 997766 - DNA, 17 bp, Homo sapiens
ctcaaattgttaggaag

SEQ ID NO: 997767 - DNA, 13 bp, Homo sapiens
ctcaaatttctaa

SEQ ID NO: 997768 - DNA, 14 bp, Homo sapiens
ctcaaatttctaaa

SEQ ID NO: 997769 - DNA, 15 bp, Homo sapiens
ctcaaatttctaaat

SEQ ID NO: 997770 - DNA, 17 bp, Homo sapiens
ctcaaatttctaaatct

SEQ ID NO: 997771 - DNA, 21 bp, Homo sapiens
ctcaaattttttgactttttt

SEQ ID NO: 997772 - DNA, 19 bp, Homo sapiens
ctcaacaagggagagacct

SEQ ID NO: 997773 - DNA, 20 bp, Homo sapiens
ctcaacaccctgcttctccc

SEQ ID NO: 997774 - DNA, 12 bp, Homo sapiens
ctcaacatgtgt

SEQ ID NO: 997775 - DNA, 16 bp, Homo sapiens
ctcaacatgttactga

SEQ ID NO: 997776 - DNA, 21 bp, Homo sapiens
ctcaacccccctcccagacag

SEQ ID NO: 997777 - DNA, 16 bp, Homo sapiens
ctcaaccctccctcag

SEQ ID NO: 997778 - DNA, 15 bp, Homo sapiens
ctcaacctcctgggt

SEQ ID NO: 997779 - DNA, 18 bp, Homo sapiens
ctcaacctcttctggctc

SEQ ID NO: 997780 - DNA, 20 bp, Homo sapiens
ctcaacctcttctggctcaa

SEQ ID NO: 997781 - DNA, 19 bp, Homo sapiens
ctcaactcgggggcgcctg

SEQ ID NO: 997782 - DNA, 13 bp, Homo sapiens
ctcaactctgagc

SEQ ID NO: 997783 - DNA, 15 bp, Homo sapiens
ctcaactgcctactc

SEQ ID NO: 997784 - DNA, 15 bp, Homo sapiens
ctcaagaaattccca

SEQ ID NO: 997785 - DNA, 19 bp, Homo sapiens
ctcaagaagacatggagac

SEQ ID NO: 997786 - DNA, 22 bp, Homo sapiens
ctcaagaagacatggagactcc

SEQ ID NO: 997787 - DNA, 20 bp, Homo sapiens
ctcaagaatctagaagatgt

SEQ ID NO: 997788 - DNA, 21 bp, Homo sapiens
ctcaagaatctagaagatgtg

SEQ ID NO: 997789 - DNA, 18 bp, Homo sapiens
ctcaagacaaggctggca

SEQ ID NO: 997790 - DNA, 12 bp, Homo sapiens
ctcaagaccccc

SEQ ID NO: 997791 - DNA, 20 bp, Homo sapiens
ctcaagacttatggaacagg

SEQ ID NO: 997792 - DNA, 15 bp, Homo sapiens
ctcaagactttagct

SEQ ID NO: 997793 - DNA, 17 bp, Homo sapiens
ctcaagaggaatctgtt

SEQ ID NO: 997794 - DNA, 21 bp, Homo sapiens
ctcaagagggcactggtggcc

SEQ ID NO: 997795 - DNA, 21 bp, Homo sapiens
ctcaagaggggaagcaactcc

SEQ ID NO: 997796 - DNA, 21 bp, Homo sapiens
ctcaagatactgctactgtaa

SEQ ID NO: 997797 - DNA, 14 bp, Homo sapiens
ctcaagattctact

SEQ ID NO: 997798 - DNA, 16 bp, Homo sapiens
ctcaagatttgaccaa

SEQ ID NO: 997799 - DNA, 16 bp, Homo sapiens
ctcaagcaataattgt

SEQ ID NO: 997800 - DNA, 21 bp, Homo sapiens
ctcaagcaataattgtttcca

SEQ ID NO: 997801 - DNA, 23 bp, Homo sapiens
ctcaagcaatccacctgccttgg

SEQ ID NO: 997802 - DNA, 17 bp, Homo sapiens
ctcaagcaatcctcctg

SEQ ID NO: 997803 - DNA, 23 bp, Homo sapiens
ctcaagcagcgaccgccccctcc

SEQ ID NO: 997804 - DNA, 15 bp, Homo sapiens
ctcaagcagttctcc

SEQ ID NO: 997805 - DNA, 16 bp, Homo sapiens
ctcaagcagttctccc

SEQ ID NO: 997806 - DNA, 20 bp, Homo sapiens
ctcaagccaatcccctcctt

SEQ ID NO: 997807 - DNA, 12 bp, Homo sapiens
ctcaagccagcc

SEQ ID NO: 997808 - DNA, 16 bp, Homo sapiens
ctcaagccagcctgta

SEQ ID NO: 997809 - DNA, 17 bp, Homo sapiens
ctcaagccccatttcct

SEQ ID NO: 997810 - DNA, 15 bp, Homo sapiens
ctcaagcctgtgggc

SEQ ID NO: 997811 - DNA, 23 bp, Homo sapiens
ctcaagctatccttgcacctcag

SEQ ID NO: 997812 - DNA, 14 bp, Homo sapiens
ctcaaggaaagggg

SEQ ID NO: 997813 - DNA, 19 bp, Homo sapiens
ctcaaggacaggagcctgg

SEQ ID NO: 997814 - DNA, 10 bp, Homo sapiens
ctcaaggact

SEQ ID NO: 997815 - DNA, 15 bp, Homo sapiens
ctcaaggacttgaaa

SEQ ID NO: 997816 - DNA, 18 bp, Homo sapiens
ctcaaggacttgaaagca

SEQ ID NO: 997817 - DNA, 19 bp, Homo sapiens
ctcaaggacttgaaagcat

SEQ ID NO: 997818 - DNA, 20 bp, Homo sapiens
ctcaaggaggtggtgaattt

SEQ ID NO: 997819 - DNA, 14 bp, Homo sapiens
ctcaaggctaattt

SEQ ID NO: 997820 - DNA, 21 bp, Homo sapiens
ctcaagggctagcatccctga

SEQ ID NO: 997821 - DNA, 16 bp, Homo sapiens
ctcaaggggcagggag

SEQ ID NO: 997822 - DNA, 13 bp, Homo sapiens
ctcaagggggtga

SEQ ID NO: 997823 - DNA, 16 bp, Homo sapiens
ctcaagggtggcaggt

SEQ ID NO: 997824 - DNA, 18 bp, Homo sapiens
ctcaagggttctttcctc

SEQ ID NO: 997825 - DNA, 22 bp, Homo sapiens
ctcaagtacccattctgttttc

SEQ ID NO: 997826 - DNA, 14 bp, Homo sapiens
ctcaagtagaaaag

SEQ ID NO: 997827 - DNA, 20 bp, Homo sapiens
ctcaccctttaccttcctca

SEQ ID NO: 997828 - DNA, 13 bp, Homo sapiens
ctcaccgcccatc

SEQ ID NO: 997829 - DNA, 16 bp, Homo sapiens
ctcaccgcccatcagg

SEQ ID NO: 997830 - DNA, 17 bp, Homo sapiens
ctcaccgcccatcaggg

SEQ ID NO: 997831 - DNA, 19 bp, Homo sapiens
ctcaccgctggcccttaga

SEQ ID NO: 997832 - DNA, 14 bp, Homo sapiens
ctcacctagagcca

SEQ ID NO: 997833 - DNA, 17 bp, Homo sapiens
ctcacctagagccagac

SEQ ID NO: 997834 - DNA, 13 bp, Homo sapiens
ctcacctctaccc

SEQ ID NO: 997835 - DNA, 19 bp, Homo sapiens
ctcacctctacccaaaccc

SEQ ID NO: 997836 - DNA, 12 bp, Homo sapiens
ctcacctctgag

SEQ ID NO: 997837 - DNA, 17 bp, Homo sapiens
ctcacctctgaggacag

SEQ ID NO: 997838 - DNA, 14 bp, Homo sapiens
ctcacctctgcctc

SEQ ID NO: 997839 - DNA, 19 bp, Homo sapiens
ctcacctctgcctcaatgt

SEQ ID NO: 997840 - DNA, 14 bp, Homo sapiens
ctcacctctggact

SEQ ID NO: 997841 - DNA, 21 bp, Homo sapiens
ctcacctctggactggctaga

SEQ ID NO: 997842 - DNA, 19 bp, Homo sapiens
ctcacctgagtcaccctac

SEQ ID NO: 997843 - DNA, 14 bp, Homo sapiens
ctcacctgcagaga

SEQ ID NO: 997844 - DNA, 16 bp, Homo sapiens
ctcacctgctggcccc

SEQ ID NO: 997845 - DNA, 16 bp, Homo sapiens
ctcacctgtactattg

SEQ ID NO: 997846 - DNA, 21 bp, Homo sapiens
ctcacctgtactattgcagac

SEQ ID NO: 997847 - DNA, 19 bp, Homo sapiens
ctcaccttgcaacacacag

SEQ ID NO: 997848 - DNA, 21 bp, Homo sapiens
ctcaccttgcaacacacagac

SEQ ID NO: 997849 - DNA, 22 bp, Homo sapiens
ctcaccttgcaacacacagaca

SEQ ID NO: 997850 - DNA, 17 bp, Homo sapiens
ctcacctttagaacagg

SEQ ID NO: 997851 - DNA, 14 bp, Homo sapiens
ctcacgactcttcc

SEQ ID NO: 997852 - DNA, 16 bp, Homo sapiens
ctcacgactcttcctg

SEQ ID NO: 997853 - DNA, 18 bp, Homo sapiens
ctcacgagatttgccagg

SEQ ID NO: 997854 - DNA, 22 bp, Homo sapiens
ctcacgagatttgccaggggca

SEQ ID NO: 997855 - DNA, 15 bp, Homo sapiens
ctcacgccacccccg

SEQ ID NO: 997856 - DNA, 20 bp, Homo sapiens
ctcacgccccgctgtgtcct

SEQ ID NO: 997857 - DNA, 20 bp, Homo sapiens
ctcacgcctgtaatcccagc

SEQ ID NO: 997858 - DNA, 15 bp, Homo sapiens
ctcacgcgttctggg

SEQ ID NO: 997859 - DNA, 17 bp, Homo sapiens
ctcacgctcccccgcag

SEQ ID NO: 997860 - DNA, 13 bp, Homo sapiens
ctcacgctctgga

SEQ ID NO: 997861 - DNA, 15 bp, Homo sapiens
ctcacgctctggaca

SEQ ID NO: 997862 - DNA, 14 bp, Homo sapiens
ctcacgctgggtcc

SEQ ID NO: 997863 - DNA, 14 bp, Homo sapiens
ctcacgggccctgc

SEQ ID NO: 997864 - DNA, 18 bp, Homo sapiens
ctcacgggccctgcccca

SEQ ID NO: 997865 - DNA, 22 bp, Homo sapiens
ctcacgggctctatgcctgcac

SEQ ID NO: 997866 - DNA, 23 bp, Homo sapiens
ctcacgggctctatgcctgcact

SEQ ID NO: 997867 - DNA, 15 bp, Homo sapiens
ctcacggggcctcca

SEQ ID NO: 997868 - DNA, 16 bp, Homo sapiens
ctcacggggttggctg

SEQ ID NO: 997869 - DNA, 20 bp, Homo sapiens
ctcacggggttggctgttcc

SEQ ID NO: 997870 - DNA, 22 bp, Homo sapiens
ctcacggggttggctgttccag

SEQ ID NO: 997871 - DNA, 23 bp, Homo sapiens
ctcacggggttggctgttccaga

SEQ ID NO: 997872 - DNA, 15 bp, Homo sapiens
ctcacgtgcaggaca

SEQ ID NO: 997873 - DNA, 16 bp, Homo sapiens
ctcacgtgcaggacag

SEQ ID NO: 997874 - DNA, 13 bp, Homo sapiens
ctcacgtgtgtga

SEQ ID NO: 997875 - DNA, 17 bp, Homo sapiens
ctcactaatttttgtat

SEQ ID NO: 997876 - DNA, 17 bp, Homo sapiens
ctcactaccgtggacca

SEQ ID NO: 997877 - DNA, 15 bp, Homo sapiens
ctcactaggccccca

SEQ ID NO: 997878 - DNA, 18 bp, Homo sapiens
ctcactaggcccccactt

SEQ ID NO: 997879 - DNA, 17 bp, Homo sapiens
ctcactatcctacccca

SEQ ID NO: 997880 - DNA, 24 bp, Homo sapiens
ctcactatggtatgctggccagca

SEQ ID NO: 997881 - DNA, 14 bp, Homo sapiens
ctcactattcttgg

SEQ ID NO: 997882 - DNA, 21 bp, Homo sapiens
ctcactcaccccagcgagctc

SEQ ID NO: 997883 - DNA, 15 bp, Homo sapiens
ctcactcactcactc

SEQ ID NO: 997884 - DNA, 16 bp, Homo sapiens
ctcactcactccaaga

SEQ ID NO: 997885 - DNA, 22 bp, Homo sapiens
ctcactcagccaccctgagttg

SEQ ID NO: 997886 - DNA, 14 bp, Homo sapiens
ctcactccaccacc

SEQ ID NO: 997887 - DNA, 14 bp, Homo sapiens
ctcactccacccag

SEQ ID NO: 997888 - DNA, 12 bp, Homo sapiens
ctcactccagcc

SEQ ID NO: 997889 - DNA, 18 bp, Homo sapiens
ctcactccagccaaagaa

SEQ ID NO: 997890 - DNA, 14 bp, Homo sapiens
ctcactccagccca

SEQ ID NO: 997891 - DNA, 15 bp, Homo sapiens
ctcactcccagtcca

SEQ ID NO: 997892 - DNA, 12 bp, Homo sapiens
ctcactccccac

SEQ ID NO: 997893 - DNA, 18 bp, Homo sapiens
ctcactccccacatccca

SEQ ID NO: 997894 - DNA, 19 bp, Homo sapiens
ctcactccccactccccca

SEQ ID NO: 997895 - DNA, 19 bp, Homo sapiens
ctcactccccagcctgggc

SEQ ID NO: 997896 - DNA, 20 bp, Homo sapiens
ctcactccccagcctgggcc

SEQ ID NO: 997897 - DNA, 15 bp, Homo sapiens
ctcactccccaggga

SEQ ID NO: 997898 - DNA, 19 bp, Homo sapiens
ctcactccccagggagctc

SEQ ID NO: 997899 - DNA, 22 bp, Homo sapiens
ctcactccccagggagctctgg

SEQ ID NO: 997900 - DNA, 23 bp, Homo sapiens
ctcactccccagggagctctggg

SEQ ID NO: 997901 - DNA, 12 bp, Homo sapiens
ctcactccccat

SEQ ID NO: 997902 - DNA, 15 bp, Homo sapiens
ctcactccctctgca

SEQ ID NO: 997903 - DNA, 22 bp, Homo sapiens
ctcactcctgaattcagttgct

SEQ ID NO: 997904 - DNA, 13 bp, Homo sapiens
ctcactcctttta

SEQ ID NO: 997905 - DNA, 19 bp, Homo sapiens
ctcactccttttaaagaaa

SEQ ID NO: 997906 - DNA, 13 bp, Homo sapiens
ctcactctctggg

SEQ ID NO: 997907 - DNA, 12 bp, Homo sapiens
ctcactctgggc

SEQ ID NO: 997908 - DNA, 13 bp, Homo sapiens
ctcactctgggct

SEQ ID NO: 997909 - DNA, 12 bp, Homo sapiens
ctcactctgtca

SEQ ID NO: 997910 - DNA, 15 bp, Homo sapiens
ctcactctgtcagcc

SEQ ID NO: 997911 - DNA, 23 bp, Homo sapiens
ctcactctgtccctgtccttccc

SEQ ID NO: 997912 - DNA, 22 bp, Homo sapiens
ctcactctgtcgctcaggctgg

SEQ ID NO: 997913 - DNA, 15 bp, Homo sapiens
ctcactctgtttcct

SEQ ID NO: 997914 - DNA, 13 bp, Homo sapiens
ctcactcttcctc

SEQ ID NO: 997915 - DNA, 19 bp, Homo sapiens
ctcactgaaaacatctgga

SEQ ID NO: 997916 - DNA, 14 bp, Homo sapiens
ctcactgaactcca

SEQ ID NO: 997917 - DNA, 17 bp, Homo sapiens
ctcactgaactccaccg

SEQ ID NO: 997918 - DNA, 18 bp, Homo sapiens
ctcactgaactccaccga

SEQ ID NO: 997919 - DNA, 19 bp, Homo sapiens
ctcactgaactccttcccc

SEQ ID NO: 997920 - DNA, 22 bp, Homo sapiens
ctcactgaactccttccccact

SEQ ID NO: 997921 - DNA, 12 bp, Homo sapiens
ctcactgaagcc

SEQ ID NO: 997922 - DNA, 17 bp, Homo sapiens
ctcactgaatcttcacg

SEQ ID NO: 997923 - DNA, 12 bp, Homo sapiens
ctcactgagagg

SEQ ID NO: 997924 - DNA, 19 bp, Homo sapiens
ctcactgagaggcctggag

SEQ ID NO: 997925 - DNA, 17 bp, Homo sapiens
ctcactgaggccatcag

SEQ ID NO: 997926 - DNA, 20 bp, Homo sapiens
ctcactgaggccatcagggc

SEQ ID NO: 997927 - DNA, 21 bp, Homo sapiens
ctcactgaggccatcagggcc

SEQ ID NO: 997928 - DNA, 14 bp, Homo sapiens
ctcactgcaacctc

SEQ ID NO: 997929 - DNA, 20 bp, Homo sapiens
ctcactgcaacctccgcctc

SEQ ID NO: 997930 - DNA, 16 bp, Homo sapiens
ctcactgcagccttga

SEQ ID NO: 997931 - DNA, 19 bp, Homo sapiens
ctcactgcagccttgtcct

SEQ ID NO: 997932 - DNA, 22 bp, Homo sapiens
ctcactgcagtcttatttccaa

SEQ ID NO: 997933 - DNA, 12 bp, Homo sapiens
ctcactgcattt

SEQ ID NO: 997934 - DNA, 12 bp, Homo sapiens
ctcactgccagg

SEQ ID NO: 997935 - DNA, 20 bp, Homo sapiens
ctcactgccaggccagcctc

SEQ ID NO: 997936 - DNA, 21 bp, Homo sapiens
ctcactgccatggaattccct

SEQ ID NO: 997937 - DNA, 23 bp, Homo sapiens
ctcactgcctaggaggctggcca

SEQ ID NO: 997938 - DNA, 20 bp, Homo sapiens
ctcactgcctggtaaaatta

SEQ ID NO: 997939 - DNA, 19 bp, Homo sapiens
ctcactgctcaagaagaca

SEQ ID NO: 997940 - DNA, 21 bp, Homo sapiens
ctcactgctcaagaagacatg

SEQ ID NO: 997941 - DNA, 12 bp, Homo sapiens
ctcactgctgat

SEQ ID NO: 997942 - DNA, 18 bp, Homo sapiens
ctcactgctggggagtcc

SEQ ID NO: 997943 - DNA, 20 bp, Homo sapiens
ctcactgctggggagtccct

SEQ ID NO: 997944 - DNA, 21 bp, Homo sapiens
ctcactgctgtgagtgcgcct

SEQ ID NO: 997945 - DNA, 22 bp, Homo sapiens
ctcactgctgtgagtgcgcctc

SEQ ID NO: 997946 - DNA, 16 bp, Homo sapiens
ctcactgcttgaacta

SEQ ID NO: 997947 - DNA, 17 bp, Homo sapiens
ctcactggctctcctgg

SEQ ID NO: 997948 - DNA, 21 bp, Homo sapiens
ctcactggctctcctggccct

SEQ ID NO: 997949 - DNA, 23 bp, Homo sapiens
ctcagatgtcccttgatgcacag

SEQ ID NO: 997950 - DNA, 15 bp, Homo sapiens
ctcagattatttaaa

SEQ ID NO: 997951 - DNA, 22 bp, Homo sapiens
ctcagattcaataatgagagct

SEQ ID NO: 997952 - DNA, 19 bp, Homo sapiens
ctcagcaatagggtgcagt

SEQ ID NO: 997953 - DNA, 14 bp, Homo sapiens
ctcagcacaaggcc

SEQ ID NO: 997954 - DNA, 17 bp, Homo sapiens
ctcagcaccacattgcc

SEQ ID NO: 997955 - DNA, 17 bp, Homo sapiens
ctcagcacccctagcat

SEQ ID NO: 997956 - DNA, 13 bp, Homo sapiens
ctcagcacccctt

SEQ ID NO: 997957 - DNA, 15 bp, Homo sapiens
ctcagcaccccttcc

SEQ ID NO: 997958 - DNA, 20 bp, Homo sapiens
cactcgagaccatcctggcc

SEQ ID NO: 997959 - DNA, 22 bp, Homo sapiens
cactcgattgttgtaaactgtt

SEQ ID NO: 997960 - DNA, 16 bp, Homo sapiens
cactcgccatttcctc

SEQ ID NO: 997961 - DNA, 22 bp, Homo sapiens
cactcgccatttcctcacgtgc

SEQ ID NO: 997962 - DNA, 17 bp, Homo sapiens
cactcgcccgcccactg

SEQ ID NO: 997963 - DNA, 22 bp, Homo sapiens
cactcggcggcagcatggagct

SEQ ID NO: 997964 - DNA, 18 bp, Homo sapiens
cactcgggaggctgagac

SEQ ID NO: 997965 - DNA, 22 bp, Homo sapiens
cactcgggaggctgagacagga

SEQ ID NO: 997966 - DNA, 16 bp, Homo sapiens
cactcgtgtgtttcta

SEQ ID NO: 997967 - DNA, 16 bp, Homo sapiens
cactctaactgtatat

SEQ ID NO: 997968 - DNA, 19 bp, Homo sapiens
cactctaccctcccacccc

SEQ ID NO: 997969 - DNA, 18 bp, Homo sapiens
cactctagtgacttcctg

SEQ ID NO: 997970 - DNA, 20 bp, Homo sapiens
cactctagtgacttcctggt

SEQ ID NO: 997971 - DNA, 17 bp, Homo sapiens
cactctagttctagatg

SEQ ID NO: 997972 - DNA, 17 bp, Homo sapiens
cactctatatgtagtgc

SEQ ID NO: 997973 - DNA, 20 bp, Homo sapiens
cactctcatcaccccagagg

SEQ ID NO: 997974 - DNA, 18 bp, Homo sapiens
cactctcatgtccccttc

SEQ ID NO: 997975 - DNA, 17 bp, Homo sapiens
cactctcattccccagg

SEQ ID NO: 997976 - DNA, 18 bp, Homo sapiens
cactctcattccccaggt

SEQ ID NO: 997977 - DNA, 14 bp, Homo sapiens
cactctccccacac

SEQ ID NO: 997978 - DNA, 15 bp, Homo sapiens
cactctccccacact

SEQ ID NO: 997979 - DNA, 16 bp, Homo sapiens
cactctcccctccctc

SEQ ID NO: 997980 - DNA, 17 bp, Homo sapiens
cactctcccctccctct

SEQ ID NO: 997981 - DNA, 21 bp, Homo sapiens
cactctcccctccctcttcct

SEQ ID NO: 997982 - DNA, 23 bp, Homo sapiens
cactctccttcgtgtctctccca

SEQ ID NO: 997983 - DNA, 15 bp, Homo sapiens
cactctcggggccct

SEQ ID NO: 997984 - DNA, 17 bp, Homo sapiens
cactctcggggcccttg

SEQ ID NO: 997985 - DNA, 23 bp, Homo sapiens
cactctcggggcccttggggcct

SEQ ID NO: 997986 - DNA, 15 bp, Homo sapiens
cactctctcacccac

SEQ ID NO: 997987 - DNA, 18 bp, Homo sapiens
cactctctcacccaccag

SEQ ID NO: 997988 - DNA, 20 bp, Homo sapiens
cactctctgaagatgatcat

SEQ ID NO: 997989 - DNA, 23 bp, Homo sapiens
cactctctgaagatgatcatttg

SEQ ID NO: 997990 - DNA, 14 bp, Homo sapiens
cactctctgcagcc

SEQ ID NO: 997991 - DNA, 20 bp, Homo sapiens
cactctctgcagcccagcct

SEQ ID NO: 997992 - DNA, 21 bp, Homo sapiens
cactctctgcagtcctccggg

SEQ ID NO: 997993 - DNA, 19 bp, Homo sapiens
cactctctgggactctcct

SEQ ID NO: 997994 - DNA, 21 bp, Homo sapiens
cactctgagtcacaggtgtgg

SEQ ID NO: 997995 - DNA, 19 bp, Homo sapiens
cactctgattcacctcttc

SEQ ID NO: 997996 - DNA, 22 bp, Homo sapiens
cactctgattcacctcttcctc

SEQ ID NO: 997997 - DNA, 15 bp, Homo sapiens
cactctgcaggaaat

SEQ ID NO: 997998 - DNA, 12 bp, Homo sapiens
cactctgccccc

SEQ ID NO: 997999 - DNA, 18 bp, Homo sapiens
cactctgccctctgctgc

SEQ ID NO: 998000 - DNA, 21 bp, Homo sapiens
cactctgccctctgctgctgc

SEQ ID NO: 998001 - DNA, 13 bp, Homo sapiens
cactctgcctgcc

SEQ ID NO: 998002 - DNA, 16 bp, Homo sapiens
cactctgctctgccct

SEQ ID NO: 998003 - DNA, 11 bp, Homo sapiens
cactctgctgc

SEQ ID NO: 998004 - DNA, 18 bp, Homo sapiens
cactctgcttctctgact

SEQ ID NO: 998005 - DNA, 19 bp, Homo sapiens
cactctgcttctctgactt

SEQ ID NO: 998006 - DNA, 16 bp, Homo sapiens
cactctgcttgttatt

SEQ ID NO: 998007 - DNA, 18 bp, Homo sapiens
cactctggatgatggatt

SEQ ID NO: 998008 - DNA, 22 bp, Homo sapiens
cactctggattcagccttcttt

SEQ ID NO: 998009 - DNA, 17 bp, Homo sapiens
cactctgggctccagag

SEQ ID NO: 998010 - DNA, 20 bp, Homo sapiens
cactctggtggccacttcat

SEQ ID NO: 998011 - DNA, 24 bp, Homo sapiens
cactctgtaatagttcagtagaat

SEQ ID NO: 998012 - DNA, 17 bp, Homo sapiens
cactctgtatctatgca

SEQ ID NO: 998013 - DNA, 14 bp, Homo sapiens
cactctgtcagcca

SEQ ID NO: 998014 - DNA, 16 bp, Homo sapiens
cactctgtcagccagc

SEQ ID NO: 998015 - DNA, 12 bp, Homo sapiens
cactctgtccct

SEQ ID NO: 998016 - DNA, 18 bp, Homo sapiens
cactctgtccctgtcctt

SEQ ID NO: 998017 - DNA, 20 bp, Homo sapiens
cactctgtcgctcaggctgg

SEQ ID NO: 998018 - DNA, 22 bp, Homo sapiens
cactctgtcgctcaggctggag

SEQ ID NO: 998019 - DNA, 17 bp, Homo sapiens
cactctgttgcccaggc

SEQ ID NO: 998020 - DNA, 18 bp, Homo sapiens
cactctgttgcccaggct

SEQ ID NO: 998021 - DNA, 22 bp, Homo sapiens
cactctgttgcccaggctggag

SEQ ID NO: 998022 - DNA, 21 bp, Homo sapiens
cactcttccagaatcccaaga

SEQ ID NO: 998023 - DNA, 22 bp, Homo sapiens
cactcttcctcatcctgcttct

SEQ ID NO: 998024 - DNA, 15 bp, Homo sapiens
cactcttctctcctt

SEQ ID NO: 998025 - DNA, 15 bp, Homo sapiens
cactcttctgtaaat

SEQ ID NO: 998026 - DNA, 20 bp, Homo sapiens
cactcttcttgagcagaccg

SEQ ID NO: 998027 - DNA, 19 bp, Homo sapiens
cactctttacctttattga

SEQ ID NO: 998028 - DNA, 12 bp, Homo sapiens
cactctttgtaa

SEQ ID NO: 998029 - DNA, 15 bp, Homo sapiens
cactctttgtaagag

SEQ ID NO: 998030 - DNA, 16 bp, Homo sapiens
cactcttttgctgtgc

SEQ ID NO: 998031 - DNA, 15 bp, Homo sapiens
cactcttttgcttta

SEQ ID NO: 998032 - DNA, 14 bp, Homo sapiens
cactgaaaaaatat

SEQ ID NO: 998033 - DNA, 16 bp, Homo sapiens
cactgaaaaaatatat

SEQ ID NO: 998034 - DNA, 11 bp, Homo sapiens
cactgaaaaat

SEQ ID NO: 998035 - DNA, 23 bp, Homo sapiens
cactgaaaaatctaagtgatata

SEQ ID NO: 998036 - DNA, 12 bp, Homo sapiens
cactgaaaacat

SEQ ID NO: 998037 - DNA, 15 bp, Homo sapiens
cactgaaaacatctg

SEQ ID NO: 998038 - DNA, 16 bp, Homo sapiens
cactgaaaagctttcc

SEQ ID NO: 998039 - DNA, 13 bp, Homo sapiens
cactgaaaccaaa

SEQ ID NO: 998040 - DNA, 23 bp, Homo sapiens
cactgaaagttttgtaaaagaaa

SEQ ID NO: 998041 - DNA, 19 bp, Homo sapiens
cactgaacaggctggggcc

SEQ ID NO: 998042 - DNA, 22 bp, Homo sapiens
cactgaacaggctggggccttt

SEQ ID NO: 998043 - DNA, 15 bp, Homo sapiens
cactgaactccaccg

SEQ ID NO: 998044 - DNA, 17 bp, Homo sapiens
cactgaactccttcccc

SEQ ID NO: 998045 - DNA, 21 bp, Homo sapiens
cactgaagaagtcactgaaca

SEQ ID NO: 998046 - DNA, 18 bp, Homo sapiens
cactgaagtgcttgcaga

SEQ ID NO: 998047 - DNA, 22 bp, Homo sapiens
cactgaagtgcttgcagatcat

SEQ ID NO: 998048 - DNA, 22 bp, Homo sapiens
cactgaagttaacagagacaga

SEQ ID NO: 998049 - DNA, 13 bp, Homo sapiens
cactgaatatata

SEQ ID NO: 998050 - DNA, 20 bp, Homo sapiens
cactgaatatataaacactc

SEQ ID NO: 998051 - DNA, 15 bp, Homo sapiens
cactgaattaatcat

SEQ ID NO: 998052 - DNA, 18 bp, Homo sapiens
cactgacaaagtcatccc

SEQ ID NO: 998053 - DNA, 17 bp, Homo sapiens
cactgacagcctcccac

SEQ ID NO: 998054 - DNA, 14 bp, Homo sapiens
cactgacagccttt

SEQ ID NO: 998055 - DNA, 17 bp, Homo sapiens
cactgaccatccactct

SEQ ID NO: 998056 - DNA, 15 bp, Homo sapiens
cactgacccacctgc

SEQ ID NO: 998057 - DNA, 21 bp, Homo sapiens
cactgacccactcggatggac

SEQ ID NO: 998058 - DNA, 17 bp, Homo sapiens
cactgaccccccccatt

SEQ ID NO: 998059 - DNA, 21 bp, Homo sapiens
cactgaccccccccattagaa

SEQ ID NO: 998060 - DNA, 21 bp, Homo sapiens
cactgacctgctccgccagga

SEQ ID NO: 998061 - DNA, 22 bp, Homo sapiens
cactgacctgctccgccaggaa

SEQ ID NO: 998062 - DNA, 22 bp, Homo sapiens
cactgacctgtcatgcccccct

SEQ ID NO: 998063 - DNA, 15 bp, Homo sapiens
cactgactgtatggc

SEQ ID NO: 998064 - DNA, 14 bp, Homo sapiens
cactgacttgctgt

SEQ ID NO: 998065 - DNA, 15 bp, Homo sapiens
cactgacttgctgtg

SEQ ID NO: 998066 - DNA, 18 bp, Homo sapiens
cactgacttgctgtgtga

SEQ ID NO: 998067 - DNA, 20 bp, Homo sapiens
cactgagagggcaaggaagt

SEQ ID NO: 998068 - DNA, 19 bp, Homo sapiens
cactgagataccagcgagg

SEQ ID NO: 998069 - DNA, 17 bp, Homo sapiens
cactgagatctgtttga

SEQ ID NO: 998070 - DNA, 22 bp, Homo sapiens
ctcaggacctctgtaggcagca

SEQ ID NO: 998071 - DNA, 22 bp, Homo sapiens
ctcaggacctgggacctcccct

SEQ ID NO: 998072 - DNA, 19 bp, Homo sapiens
ctcaggagatggagggctt

SEQ ID NO: 998073 - DNA, 12 bp, Homo sapiens
ctcaggagcaca

SEQ ID NO: 998074 - DNA, 12 bp, Homo sapiens
ctcaggagcagg

SEQ ID NO: 998075 - DNA, 23 bp, Homo sapiens
ctcaggaggaggctgccctgagg

SEQ ID NO: 998076 - DNA, 24 bp, Homo sapiens
ctcaggaggcagaggttgcagtga

SEQ ID NO: 998077 - DNA, 18 bp, Homo sapiens
ctcaggaggctgaggcag

SEQ ID NO: 998078 - DNA, 19 bp, Homo sapiens
ctcaggaggctgaggcaga

SEQ ID NO: 998079 - DNA, 17 bp, Homo sapiens
ctcaggagggcaggctg

SEQ ID NO: 998080 - DNA, 21 bp, Homo sapiens
ctcaggagggtgacgcccagc

SEQ ID NO: 998081 - DNA, 15 bp, Homo sapiens
ctcaggagtctgcca

SEQ ID NO: 998082 - DNA, 20 bp, Homo sapiens
ctcaggatatccttatcaga

SEQ ID NO: 998083 - DNA, 15 bp, Homo sapiens
ctcaggcaagcccct

SEQ ID NO: 998084 - DNA, 21 bp, Homo sapiens
cactgagggtggcactcaact

SEQ ID NO: 998085 - DNA, 16 bp, Homo sapiens
cactgaggtccacaga

SEQ ID NO: 998086 - DNA, 14 bp, Homo sapiens
cactgataagactg

SEQ ID NO: 998087 - DNA, 13 bp, Homo sapiens
cactgatagtcct

SEQ ID NO: 998088 - DNA, 18 bp, Homo sapiens
cactgatgagtttcactg

SEQ ID NO: 998089 - DNA, 21 bp, Homo sapiens
cactgatgagtttcactgtac

SEQ ID NO: 998090 - DNA, 21 bp, Homo sapiens
cactgatggctcaagacaagg

SEQ ID NO: 998091 - DNA, 18 bp, Homo sapiens
cactgatgggctggggca

SEQ ID NO: 998092 - DNA, 20 bp, Homo sapiens
cactgatgggctggggcagg

SEQ ID NO: 998093 - DNA, 17 bp, Homo sapiens
cactgattcctggagag

SEQ ID NO: 998094 - DNA, 19 bp, Homo sapiens
cactgatttcacaacagat

SEQ ID NO: 998095 - DNA, 21 bp, Homo sapiens
cactgatttcacaacagatca

SEQ ID NO: 998096 - DNA, 17 bp, Homo sapiens
cactgcaaataaagcct

SEQ ID NO: 998097 - DNA, 18 bp, Homo sapiens
cactgcaaataaagcctt

SEQ ID NO: 998098 - DNA, 14 bp, Homo sapiens
cactgcaacttgtg

SEQ ID NO: 998099 - DNA, 17 bp, Homo sapiens
cactgcaagagccttgg

SEQ ID NO: 998100 - DNA, 20 bp, Homo sapiens
cactgcaagagccttggtgt

SEQ ID NO: 998101 - DNA, 18 bp, Homo sapiens
cactgcacacacctcaga

SEQ ID NO: 998102 - DNA, 22 bp, Homo sapiens
cactgcacacacctcagaggct

SEQ ID NO: 998103 - DNA, 17 bp, Homo sapiens
cactgcacacagtgact

SEQ ID NO: 998104 - DNA, 23 bp, Homo sapiens
cactgcacagaagacagcagcaa

SEQ ID NO: 998105 - DNA, 23 bp, Homo sapiens
cactgcacagtgcatctcagccc

SEQ ID NO: 998106 - DNA, 18 bp, Homo sapiens
cactgcactccagcctgg

SEQ ID NO: 998107 - DNA, 22 bp, Homo sapiens
cactgcactccagcttgggtga

SEQ ID NO: 998108 - DNA, 14 bp, Homo sapiens
cactgcactttgtt

SEQ ID NO: 998109 - DNA, 20 bp, Homo sapiens
cactgcagcctcaacctcct

SEQ ID NO: 998110 - DNA, 21 bp, Homo sapiens
cactgcagcctcatactcctg

SEQ ID NO: 998111 - DNA, 13 bp, Homo sapiens
cactgcagccttg

SEQ ID NO: 998112 - DNA, 16 bp, Homo sapiens
cactgcaggccccgct

SEQ ID NO: 998113 - DNA, 14 bp, Homo sapiens
cactgcagtcagat

SEQ ID NO: 998114 - DNA, 17 bp, Homo sapiens
cactgcagtctgcagag

SEQ ID NO: 998115 - DNA, 15 bp, Homo sapiens
cactgcagtgatggc

SEQ ID NO: 998116 - DNA, 16 bp, Homo sapiens
cactgcagtttcctgg

SEQ ID NO: 998117 - DNA, 17 bp, Homo sapiens
cactgcagtttcctgga

SEQ ID NO: 998118 - DNA, 18 bp, Homo sapiens
cactgcatgagcttttat

SEQ ID NO: 998119 - DNA, 16 bp, Homo sapiens
cactgcattcctgtgc

SEQ ID NO: 998120 - DNA, 17 bp, Homo sapiens
cactgccaagagccgac

SEQ ID NO: 998121 - DNA, 20 bp, Homo sapiens
cactgccaagcttcctgtgc

SEQ ID NO: 998122 - DNA, 20 bp, Homo sapiens
cactgccagcagcagcaggt

SEQ ID NO: 998123 - DNA, 12 bp, Homo sapiens
cactgccaggca

SEQ ID NO: 998124 - DNA, 16 bp, Homo sapiens
cactgccaggcacctg

SEQ ID NO: 998125 - DNA, 20 bp, Homo sapiens
cactgccaggcacctggcct

SEQ ID NO: 998126 - DNA, 21 bp, Homo sapiens
cactgccaggcacctggcctg

SEQ ID NO: 998127 - DNA, 17 bp, Homo sapiens
cactgccaggccagcct

SEQ ID NO: 998128 - DNA, 18 bp, Homo sapiens
cactgccaggccagcctc

SEQ ID NO: 998129 - DNA, 19 bp, Homo sapiens
cactgccaggccagcctcc

SEQ ID NO: 998130 - DNA, 21 bp, Homo sapiens
cactgccaggccagcctccga

SEQ ID NO: 998131 - DNA, 16 bp, Homo sapiens
cactgccataaaacat

SEQ ID NO: 998132 - DNA, 21 bp, Homo sapiens
cactgccataaaacattaaga

SEQ ID NO: 998133 - DNA, 19 bp, Homo sapiens
cactgcccacatgggacct

SEQ ID NO: 998134 - DNA, 18 bp, Homo sapiens
cactgcccatggacaggc

SEQ ID NO: 998135 - DNA, 21 bp, Homo sapiens
cactgccccacttctggcatg

SEQ ID NO: 998136 - DNA, 21 bp, Homo sapiens
cactgcccccagctcttctcc

SEQ ID NO: 998137 - DNA, 19 bp, Homo sapiens
cactgccccccgaggctgc

SEQ ID NO: 998138 - DNA, 21 bp, Homo sapiens
cactgccccccgaggctgcta

SEQ ID NO: 998139 - DNA, 17 bp, Homo sapiens
cactgccccctgctgcc

SEQ ID NO: 998140 - DNA, 16 bp, Homo sapiens
cactgccccctgcttg

SEQ ID NO: 998141 - DNA, 15 bp, Homo sapiens
cactgcccgagctgg

SEQ ID NO: 998142 - DNA, 17 bp, Homo sapiens
cactgcccgagctggtg

SEQ ID NO: 998143 - DNA, 15 bp, Homo sapiens
cactgcccgaggcgc

SEQ ID NO: 998144 - DNA, 11 bp, Homo sapiens
cactgccctgc

SEQ ID NO: 998145 - DNA, 12 bp, Homo sapiens
cactgccctgcc

SEQ ID NO: 998146 - DNA, 14 bp, Homo sapiens
cactgccctgcctg

SEQ ID NO: 998147 - DNA, 18 bp, Homo sapiens
cactgccctggcagcagc

SEQ ID NO: 998148 - DNA, 18 bp, Homo sapiens
cactgcccttttcaggaa

SEQ ID NO: 998149 - DNA, 20 bp, Homo sapiens
cactgcccttttcaggaagc

SEQ ID NO: 998150 - DNA, 22 bp, Homo sapiens
cactgccgacatccctccccca

SEQ ID NO: 998151 - DNA, 14 bp, Homo sapiens
cactgccggcagga

SEQ ID NO: 998152 - DNA, 21 bp, Homo sapiens
cactgcctagtcgggacttgt

SEQ ID NO: 998153 - DNA, 22 bp, Homo sapiens
cactgcctcctgttttctccct

SEQ ID NO: 998154 - DNA, 23 bp, Homo sapiens
cactgcctctatgccctgcagag

SEQ ID NO: 998155 - DNA, 16 bp, Homo sapiens
cactgcctctccctct

SEQ ID NO: 998156 - DNA, 12 bp, Homo sapiens
cactgcctctga

SEQ ID NO: 998157 - DNA, 16 bp, Homo sapiens
cactgcctcttcctcc

SEQ ID NO: 998158 - DNA, 14 bp, Homo sapiens
cactgcctgcccac

SEQ ID NO: 998159 - DNA, 20 bp, Homo sapiens
cactgccttcgatacaccgg

SEQ ID NO: 998160 - DNA, 19 bp, Homo sapiens
cactgccttcgcttcttgc

SEQ ID NO: 998161 - DNA, 21 bp, Homo sapiens
cactgccttctcctctctggg

SEQ ID NO: 998162 - DNA, 22 bp, Homo sapiens
cactgccttctcctctctgggc

SEQ ID NO: 998163 - DNA, 23 bp, Homo sapiens
cactgccttctcctctctgggcc

SEQ ID NO: 998164 - DNA, 22 bp, Homo sapiens
cactgccttggcccctccctcc

SEQ ID NO: 998165 - DNA, 23 bp, Homo sapiens
cactgctaaggctgctggcttca

SEQ ID NO: 998166 - DNA, 21 bp, Homo sapiens
cactgctaggcgagtgccagg

SEQ ID NO: 998167 - DNA, 17 bp, Homo sapiens
cactgctaggtgggcca

SEQ ID NO: 998168 - DNA, 22 bp, Homo sapiens
cactgctaggtgggccagcccc

SEQ ID NO: 998169 - DNA, 19 bp, Homo sapiens
cactgctcaagaagacatg

SEQ ID NO: 998170 - DNA, 17 bp, Homo sapiens
cactgctccgtggagga

SEQ ID NO: 998171 - DNA, 13 bp, Homo sapiens
cactgctgaggag

SEQ ID NO: 998172 - DNA, 14 bp, Homo sapiens
cactgctgaggagt

SEQ ID NO: 998173 - DNA, 21 bp, Homo sapiens
cactgctgaggagtctgagga

SEQ ID NO: 998174 - DNA, 20 bp, Homo sapiens
cactgctgatattttctcta

SEQ ID NO: 998175 - DNA, 12 bp, Homo sapiens
cactgctgcacc

SEQ ID NO: 998176 - DNA, 17 bp, Homo sapiens
cactgctgcccagcctc

SEQ ID NO: 998177 - DNA, 18 bp, Homo sapiens
cactgctgctcctctttc

SEQ ID NO: 998178 - DNA, 17 bp, Homo sapiens
cactgctggacatgaga

SEQ ID NO: 998179 - DNA, 12 bp, Homo sapiens
cactgctggctg

SEQ ID NO: 998180 - DNA, 16 bp, Homo sapiens
cactgctggctgcctt

SEQ ID NO: 998181 - DNA, 21 bp, Homo sapiens
cactgctggctgccttagaac

SEQ ID NO: 998182 - DNA, 13 bp, Homo sapiens
cactgctggggag

SEQ ID NO: 998183 - DNA, 22 bp, Homo sapiens
cactgctggggaggagaggact

SEQ ID NO: 998184 - DNA, 18 bp, Homo sapiens
cactgctggggagtccct

SEQ ID NO: 998185 - DNA, 14 bp, Homo sapiens
cactgctgtccaca

SEQ ID NO: 998186 - DNA, 16 bp, Homo sapiens
cactgctgtccacatg

SEQ ID NO: 998187 - DNA, 21 bp, Homo sapiens
cactgctgtgagtgcgcctca

SEQ ID NO: 998188 - DNA, 23 bp, Homo sapiens
cactgctgtgagtgcgcctcacc

SEQ ID NO: 998189 - DNA, 18 bp, Homo sapiens
cactgctgttaaagacat

SEQ ID NO: 998190 - DNA, 18 bp, Homo sapiens
cactgctgttcctgctcc

SEQ ID NO: 998191 - DNA, 21 bp, Homo sapiens
ctcagtactttggaggcccct

SEQ ID NO: 998192 - DNA, 22 bp, Homo sapiens
ctcagtagaaaaggatctaagg

SEQ ID NO: 998193 - DNA, 13 bp, Homo sapiens
ctcagtagtccct

SEQ ID NO: 998194 - DNA, 15 bp, Homo sapiens
ctcagtatatttaaa

SEQ ID NO: 998195 - DNA, 20 bp, Homo sapiens
ctcagtatgctttccctgag

SEQ ID NO: 998196 - DNA, 22 bp, Homo sapiens
ctcagtatgctttccctgagga

SEQ ID NO: 998197 - DNA, 17 bp, Homo sapiens
ctcagtcacccccactt

SEQ ID NO: 998198 - DNA, 13 bp, Homo sapiens
ctcagtcatattt

SEQ ID NO: 998199 - DNA, 21 bp, Homo sapiens
ctcagtcccccaccacactga

SEQ ID NO: 998200 - DNA, 22 bp, Homo sapiens
ctcagtcccccaccacactgaa

SEQ ID NO: 998201 - DNA, 13 bp, Homo sapiens
ctcagtctcagga

SEQ ID NO: 998202 - DNA, 13 bp, Homo sapiens
ctcagtctccctc

SEQ ID NO: 998203 - DNA, 17 bp, Homo sapiens
ctcagtctccctccctt

SEQ ID NO: 998204 - DNA, 13 bp, Homo sapiens
ctcagtctccctt

SEQ ID NO: 998205 - DNA, 19 bp, Homo sapiens
ctcagtctctcttctctcc

SEQ ID NO: 998206 - DNA, 20 bp, Homo sapiens
ctcagtctctgagcagtgaa

SEQ ID NO: 998207 - DNA, 21 bp, Homo sapiens
ctcagtctgttcactgcattc

SEQ ID NO: 998208 - DNA, 18 bp, Homo sapiens
ctcagtgaagaatacttc

SEQ ID NO: 998209 - DNA, 14 bp, Homo sapiens
ctcagtgaagacta

SEQ ID NO: 998210 - DNA, 22 bp, Homo sapiens
cactggagagcacagcatgcct

SEQ ID NO: 998211 - DNA, 16 bp, Homo sapiens
cactggagcaccaggc

SEQ ID NO: 998212 - DNA, 15 bp, Homo sapiens
cactggagcccagga

SEQ ID NO: 998213 - DNA, 20 bp, Homo sapiens
cactggaggttgaagccaag

SEQ ID NO: 998214 - DNA, 21 bp, Homo sapiens
cactggaggttgaagccaagt

SEQ ID NO: 998215 - DNA, 23 bp, Homo sapiens
cactggatgcaaagaaaatcaga

SEQ ID NO: 998216 - DNA, 21 bp, Homo sapiens
cactggattgactttgctgtc

SEQ ID NO: 998217 - DNA, 12 bp, Homo sapiens
cactggcagagc

SEQ ID NO: 998218 - DNA, 16 bp, Homo sapiens
cactggcagagcacag

SEQ ID NO: 998219 - DNA, 19 bp, Homo sapiens
cactggcattgtccctgtg

SEQ ID NO: 998220 - DNA, 17 bp, Homo sapiens
cactggccaccaggctg

SEQ ID NO: 998221 - DNA, 21 bp, Homo sapiens
cactggccaccaggctggcgc

SEQ ID NO: 998222 - DNA, 18 bp, Homo sapiens
cactggccagagagggcc

SEQ ID NO: 998223 - DNA, 20 bp, Homo sapiens
cactggccttctgatgaaat

SEQ ID NO: 998224 - DNA, 21 bp, Homo sapiens
cactggccttctgatgaaatg

SEQ ID NO: 998225 - DNA, 15 bp, Homo sapiens
cactggctcatgccc

SEQ ID NO: 998226 - DNA, 16 bp, Homo sapiens
cactggctcatgcccc

SEQ ID NO: 998227 - DNA, 17 bp, Homo sapiens
cactggctcatgcccct

SEQ ID NO: 998228 - DNA, 11 bp, Homo sapiens
cactggctctc

SEQ ID NO: 998229 - DNA, 22 bp, Homo sapiens
cactggctctccaagtgccaga

SEQ ID NO: 998230 - DNA, 15 bp, Homo sapiens
cactggctctctcca

SEQ ID NO: 998231 - DNA, 21 bp, Homo sapiens
cactggctgagaatctggggg

SEQ ID NO: 998232 - DNA, 23 bp, Homo sapiens
cactggctgagaatctgggggtg

SEQ ID NO: 998233 - DNA, 18 bp, Homo sapiens
cactggctggcctgagca

SEQ ID NO: 998234 - DNA, 14 bp, Homo sapiens
cactggctgggagt

SEQ ID NO: 998235 - DNA, 19 bp, Homo sapiens
cactggctggggcagaggg

SEQ ID NO: 998236 - DNA, 22 bp, Homo sapiens
cactggctggggcagaggggca

SEQ ID NO: 998237 - DNA, 23 bp, Homo sapiens
cactgggaacctagctacactga

SEQ ID NO: 998238 - DNA, 18 bp, Homo sapiens
cactgggaagaagcaagg

SEQ ID NO: 998239 - DNA, 18 bp, Homo sapiens
cactgggaagctcccacc

SEQ ID NO: 998240 - DNA, 20 bp, Homo sapiens
cactgggaagctcccacccc

SEQ ID NO: 998241 - DNA, 16 bp, Homo sapiens
cactgggaaggaaaca

SEQ ID NO: 998242 - DNA, 20 bp, Homo sapiens
cactgggactcccagcagag

SEQ ID NO: 998243 - DNA, 23 bp, Homo sapiens
cactgggactcccagcagagccc

SEQ ID NO: 998244 - DNA, 20 bp, Homo sapiens
cactgggagaggtgccagca

SEQ ID NO: 998245 - DNA, 23 bp, Homo sapiens
cactgggagaggtgccagcaact

SEQ ID NO: 998246 - DNA, 17 bp, Homo sapiens
cactgggaggcagggct

SEQ ID NO: 998247 - DNA, 22 bp, Homo sapiens
cactgggatgagccgctgtgag

SEQ ID NO: 998248 - DNA, 16 bp, Homo sapiens
cactgggcacctgcgc

SEQ ID NO: 998249 - DNA, 20 bp, Homo sapiens
cactgggcacctgcgcacag

SEQ ID NO: 998250 - DNA, 12 bp, Homo sapiens
cactgggcagca

SEQ ID NO: 998251 - DNA, 14 bp, Homo sapiens
cactgggcagcaag

SEQ ID NO: 998252 - DNA, 23 bp, Homo sapiens
cactgggcagcaaggctgctgcc

SEQ ID NO: 998253 - DNA, 23 bp, Homo sapiens
cactgggccagccctgcagccca

SEQ ID NO: 998254 - DNA, 17 bp, Homo sapiens
cactgggcccctgtccc

SEQ ID NO: 998255 - DNA, 18 bp, Homo sapiens
cactgggcccctgtcccc

SEQ ID NO: 998256 - DNA, 20 bp, Homo sapiens
cactgggcccctgtccccag

SEQ ID NO: 998257 - DNA, 13 bp, Homo sapiens
cactgggcctgct

SEQ ID NO: 998258 - DNA, 16 bp, Homo sapiens
cactgggcctttccag

SEQ ID NO: 998259 - DNA, 13 bp, Homo sapiens
cactgggcgtctg

SEQ ID NO: 998260 - DNA, 17 bp, Homo sapiens
cactggggaaaaataaa

SEQ ID NO: 998261 - DNA, 19 bp, Homo sapiens
cactggggaatgctcccag

SEQ ID NO: 998262 - DNA, 18 bp, Homo sapiens
cactggggatggtggcac

SEQ ID NO: 998263 - DNA, 14 bp, Homo sapiens
cactggggcacttg

SEQ ID NO: 998264 - DNA, 14 bp, Homo sapiens
cactggggcctaca

SEQ ID NO: 998265 - DNA, 20 bp, Homo sapiens
cactggggtcctggggcctc

SEQ ID NO: 998266 - DNA, 18 bp, Homo sapiens
cactgggtccagccttga

SEQ ID NO: 998267 - DNA, 18 bp, Homo sapiens
cactgggtgcgtctccag

SEQ ID NO: 998268 - DNA, 15 bp, Homo sapiens
cactgggtggggtga

SEQ ID NO: 998269 - DNA, 21 bp, Homo sapiens
cactgggtggggtgaggacca

SEQ ID NO: 998270 - DNA, 20 bp, Homo sapiens
cactgggtggtggcctggtc

SEQ ID NO: 998271 - DNA, 16 bp, Homo sapiens
cactgggtgttgatct

SEQ ID NO: 998272 - DNA, 15 bp, Homo sapiens
cactgggttgacttt

SEQ ID NO: 998273 - DNA, 20 bp, Homo sapiens
cactggtagaccaaaataaa

SEQ ID NO: 998274 - DNA, 19 bp, Homo sapiens
cactggtatttatatttca

SEQ ID NO: 998275 - DNA, 12 bp, Homo sapiens
cactggtcacag

SEQ ID NO: 998276 - DNA, 14 bp, Homo sapiens
cactggtcagggca

SEQ ID NO: 998277 - DNA, 21 bp, Homo sapiens
cactggtcagggcagtggcca

SEQ ID NO: 998278 - DNA, 14 bp, Homo sapiens
cactggtcaggtgc

SEQ ID NO: 998279 - DNA, 15 bp, Homo sapiens
cactggtgaactgag

SEQ ID NO: 998280 - DNA, 19 bp, Homo sapiens
cactggtgtgaactcaccc

SEQ ID NO: 998281 - DNA, 20 bp, Homo sapiens
cactggttaaaataaagcct

SEQ ID NO: 998282 - DNA, 14 bp, Homo sapiens
cactggtttgaaga

SEQ ID NO: 998283 - DNA, 14 bp, Homo sapiens
cactgtaaaatgaa

SEQ ID NO: 998284 - DNA, 16 bp, Homo sapiens
cactgtaaaatgaaat

SEQ ID NO: 998285 - DNA, 18 bp, Homo sapiens
cactgtaaaatgaaatta

SEQ ID NO: 998286 - DNA, 20 bp, Homo sapiens
cactgtaaagacaaataaat

SEQ ID NO: 998287 - DNA, 13 bp, Homo sapiens
cactgtaaatatc

SEQ ID NO: 998288 - DNA, 18 bp, Homo sapiens
cactgtaaatatccctcc

SEQ ID NO: 998289 - DNA, 22 bp, Homo sapiens
cactgtaaatatccctcccctc

SEQ ID NO: 998290 - DNA, 22 bp, Homo sapiens
cactgtaagactcattccctag

SEQ ID NO: 998291 - DNA, 16 bp, Homo sapiens
cactgtaagcttttaa

SEQ ID NO: 998292 - DNA, 14 bp, Homo sapiens
cactgtaagtttat

SEQ ID NO: 998293 - DNA, 22 bp, Homo sapiens
cactgtaagtttattttttcta

SEQ ID NO: 998294 - DNA, 21 bp, Homo sapiens
cactgtagcattacagtgggt

SEQ ID NO: 998295 - DNA, 13 bp, Homo sapiens
cactgtagttttg

SEQ ID NO: 998296 - DNA, 22 bp, Homo sapiens
cactgtagttttgagtgtatac

SEQ ID NO: 998297 - DNA, 19 bp, Homo sapiens
cactgtagtttttgaaaat

SEQ ID NO: 998298 - DNA, 22 bp, Homo sapiens
cactgtagtttttgaaaattat

SEQ ID NO: 998299 - DNA, 23 bp, Homo sapiens
cactgtagtttttgaaaattatg

SEQ ID NO: 998300 - DNA, 13 bp, Homo sapiens
cactgtatataaa

SEQ ID NO: 998301 - DNA, 14 bp, Homo sapiens
cactgtatataaac

SEQ ID NO: 998302 - DNA, 18 bp, Homo sapiens
cactgtatataaacatat

SEQ ID NO: 998303 - DNA, 22 bp, Homo sapiens
cactgtatgatttataaacaga

SEQ ID NO: 998304 - DNA, 18 bp, Homo sapiens
cactgtatgctggacggc

SEQ ID NO: 998305 - DNA, 21 bp, Homo sapiens
cactgtcaccaccctgctcat

SEQ ID NO: 998306 - DNA, 13 bp, Homo sapiens
cactgtcactgcc

SEQ ID NO: 998307 - DNA, 14 bp, Homo sapiens
cactgtcactgccg

SEQ ID NO: 998308 - DNA, 21 bp, Homo sapiens
cactgtcactgccgacatccc

SEQ ID NO: 998309 - DNA, 17 bp, Homo sapiens
cactgtcatcaatgttc

SEQ ID NO: 998310 - DNA, 16 bp, Homo sapiens
cactgtcatgcttcat

SEQ ID NO: 998311 - DNA, 19 bp, Homo sapiens
cactgtccccctacccacc

SEQ ID NO: 998312 - DNA, 12 bp, Homo sapiens
ctcatctcctga

SEQ ID NO: 998313 - DNA, 15 bp, Homo sapiens
ctcatctctgaaaat

SEQ ID NO: 998314 - DNA, 13 bp, Homo sapiens
ctcatctctggaa

SEQ ID NO: 998315 - DNA, 22 bp, Homo sapiens
ctcatctctggaaggggcagcc

SEQ ID NO: 998316 - DNA, 13 bp, Homo sapiens
ctcatctgcaaaa

SEQ ID NO: 998317 - DNA, 18 bp, Homo sapiens
ctcatctgcacccttctt

SEQ ID NO: 998318 - DNA, 19 bp, Homo sapiens
ctcatctgcacccttcttt

SEQ ID NO: 998319 - DNA, 12 bp, Homo sapiens
ctcatctgctgg

SEQ ID NO: 998320 - DNA, 17 bp, Homo sapiens
ctcatctgggtctccca

SEQ ID NO: 998321 - DNA, 18 bp, Homo sapiens
ctcatctgtccctccggg

SEQ ID NO: 998322 - DNA, 21 bp, Homo sapiens
ctcatctgtggagctgccaca

SEQ ID NO: 998323 - DNA, 14 bp, Homo sapiens
ctcatcttctctca

SEQ ID NO: 998324 - DNA, 16 bp, Homo sapiens
ctcatcttgttcttcc

SEQ ID NO: 998325 - DNA, 12 bp, Homo sapiens
ctcatctttaaa

SEQ ID NO: 998326 - DNA, 15 bp, Homo sapiens
ctcatctttaaaatg

SEQ ID NO: 998327 - DNA, 17 bp, Homo sapiens
ctcatgaagcaggaggc

SEQ ID NO: 998328 - DNA, 12 bp, Homo sapiens
ctcatgaagcta

SEQ ID NO: 998329 - DNA, 16 bp, Homo sapiens
ctcatgagaagccaag

SEQ ID NO: 998330 - DNA, 21 bp, Homo sapiens
ctcatgagtctacctgagcat

SEQ ID NO: 998331 - DNA, 18 bp, Homo sapiens
ctcatgataccaccttta

SEQ ID NO: 998332 - DNA, 14 bp, Homo sapiens
ctcatgatcaagat

SEQ ID NO: 998333 - DNA, 16 bp, Homo sapiens
ctcatgatcaagatat

SEQ ID NO: 998334 - DNA, 20 bp, Homo sapiens
ctcatgatcaagatatatgt

SEQ ID NO: 998335 - DNA, 20 bp, Homo sapiens
ctcatgatcttgtgacatat

SEQ ID NO: 998336 - DNA, 16 bp, Homo sapiens
ctcatgattccatgcc

SEQ ID NO: 998337 - DNA, 16 bp, Homo sapiens
ctcccttcccagtggg

SEQ ID NO: 998338 - DNA, 13 bp, Homo sapiens
ctcccttccctcc

SEQ ID NO: 998339 - DNA, 16 bp, Homo sapiens
ctcccttccctcctcc

SEQ ID NO: 998340 - DNA, 14 bp, Homo sapiens
ctcccttccgaccc

SEQ ID NO: 998341 - DNA, 12 bp, Homo sapiens
ctcccttccttt

SEQ ID NO: 998342 - DNA, 13 bp, Homo sapiens
ctcccttctccct

SEQ ID NO: 998343 - DNA, 15 bp, Homo sapiens
ctcccttctccctgg

SEQ ID NO: 998344 - DNA, 14 bp, Homo sapiens
ctcccttctgctac

SEQ ID NO: 998345 - DNA, 22 bp, Homo sapiens
ctcccttcttgggtagggcaga

SEQ ID NO: 998346 - DNA, 15 bp, Homo sapiens
ctcccttcttgggtc

SEQ ID NO: 998347 - DNA, 20 bp, Homo sapiens
ctcccttgccccaggccagg

SEQ ID NO: 998348 - DNA, 23 bp, Homo sapiens
ctcccttgcctttcgaggcctga

SEQ ID NO: 998349 - DNA, 21 bp, Homo sapiens
ctcccttgctcagtgcctcct

SEQ ID NO: 998350 - DNA, 18 bp, Homo sapiens
ctcccttgctggccccag

SEQ ID NO: 998351 - DNA, 20 bp, Homo sapiens
ctcccttggaaacctgccct

SEQ ID NO: 998352 - DNA, 21 bp, Homo sapiens
ctcccttggaaacctgccctg

SEQ ID NO: 998353 - DNA, 13 bp, Homo sapiens
ctcccttgggctc

SEQ ID NO: 998354 - DNA, 14 bp, Homo sapiens
ctcccttgggctcc

SEQ ID NO: 998355 - DNA, 14 bp, Homo sapiens
ctcccttgttctct

SEQ ID NO: 998356 - DNA, 17 bp, Homo sapiens
ctcccttgttctctaag

SEQ ID NO: 998357 - DNA, 15 bp, Homo sapiens
ctccctttcactaaa

SEQ ID NO: 998358 - DNA, 19 bp, Homo sapiens
ctccctttctatcgttctc

SEQ ID NO: 998359 - DNA, 14 bp, Homo sapiens
ctccctttctcagg

SEQ ID NO: 998360 - DNA, 15 bp, Homo sapiens
ctccctttctctctc

SEQ ID NO: 998361 - DNA, 14 bp, Homo sapiens
ctccctttctggga

SEQ ID NO: 998362 - DNA, 17 bp, Homo sapiens
ctccctttcttccctac

SEQ ID NO: 998363 - DNA, 15 bp, Homo sapiens
ctccctttttgggta

SEQ ID NO: 998364 - DNA, 13 bp, Homo sapiens
ctccgacctctct

SEQ ID NO: 998365 - DNA, 16 bp, Homo sapiens
ctccgacctctctcag

SEQ ID NO: 998366 - DNA, 18 bp, Homo sapiens
ctccgacctctctcagcc

SEQ ID NO: 998367 - DNA, 15 bp, Homo sapiens
ctccgacctctctcg

SEQ ID NO: 998368 - DNA, 16 bp, Homo sapiens
ctccgactgctaggga

SEQ ID NO: 998369 - DNA, 14 bp, Homo sapiens
ctccgagagggaga

SEQ ID NO: 998370 - DNA, 15 bp, Homo sapiens
ctccgaggacccagg

SEQ ID NO: 998371 - DNA, 17 bp, Homo sapiens
ctccgaggacccaggaa

SEQ ID NO: 998372 - DNA, 21 bp, Homo sapiens
ctccgaggctccccgcctcca

SEQ ID NO: 998373 - DNA, 14 bp, Homo sapiens
ctccgagggcggcc

SEQ ID NO: 998374 - DNA, 21 bp, Homo sapiens
ctccgatgcctggcctgccag

SEQ ID NO: 998375 - DNA, 20 bp, Homo sapiens
ctccgcagtgtctccaccta

SEQ ID NO: 998376 - DNA, 13 bp, Homo sapiens
ctccgccagcctc

SEQ ID NO: 998377 - DNA, 20 bp, Homo sapiens
ctccgccagcctcctctgga

SEQ ID NO: 998378 - DNA, 21 bp, Homo sapiens
ctccgccagcctcctctggac

SEQ ID NO: 998379 - DNA, 13 bp, Homo sapiens
ctccgccatccac

SEQ ID NO: 998380 - DNA, 17 bp, Homo sapiens
ctccgcccagcctctcc

SEQ ID NO: 998381 - DNA, 21 bp, Homo sapiens
ctcctctcccattgtccctct

SEQ ID NO: 998382 - DNA, 21 bp, Homo sapiens
ctcctctcctactcggctctg

SEQ ID NO: 998383 - DNA, 16 bp, Homo sapiens
ctcctctccttgggct

SEQ ID NO: 998384 - DNA, 19 bp, Homo sapiens
ctcctctcctttttctctt

SEQ ID NO: 998385 - DNA, 14 bp, Homo sapiens
ctcctctctctctt

SEQ ID NO: 998386 - DNA, 13 bp, Homo sapiens
ctcctctctgggc

SEQ ID NO: 998387 - DNA, 15 bp, Homo sapiens
ctcctctctgggcct

SEQ ID NO: 998388 - DNA, 16 bp, Homo sapiens
ctcctctgaccctcct

SEQ ID NO: 998389 - DNA, 18 bp, Homo sapiens
ctcctctgactcagggct

SEQ ID NO: 998390 - DNA, 22 bp, Homo sapiens
ctcctctgactcagggctcctg

SEQ ID NO: 998391 - DNA, 13 bp, Homo sapiens
ctcctctgaggaa

SEQ ID NO: 998392 - DNA, 16 bp, Homo sapiens
ctcctctgaggaagca

SEQ ID NO: 998393 - DNA, 17 bp, Homo sapiens
ctcctctgaggaagcag

SEQ ID NO: 998394 - DNA, 17 bp, Homo sapiens
ctcctctgcagtgcctt

SEQ ID NO: 998395 - DNA, 18 bp, Homo sapiens
ctcctctgcagtgccttg

SEQ ID NO: 998396 - DNA, 11 bp, Homo sapiens
ctcctctgcca

SEQ ID NO: 998397 - DNA, 16 bp, Homo sapiens
ctcctctgccacctcc

SEQ ID NO: 998398 - DNA, 13 bp, Homo sapiens
ctcctctgcctac

SEQ ID NO: 998399 - DNA, 20 bp, Homo sapiens
ctcctctgcctacagccagg

SEQ ID NO: 998400 - DNA, 12 bp, Homo sapiens
ctcctctgcctt

SEQ ID NO: 998401 - DNA, 14 bp, Homo sapiens
ctcctctgctgacc

SEQ ID NO: 998402 - DNA, 19 bp, Homo sapiens
ctcctctgctgacctgctg

SEQ ID NO: 998403 - DNA, 21 bp, Homo sapiens
ctcctctgctgacctgctgac

SEQ ID NO: 998404 - DNA, 14 bp, Homo sapiens
ctcctctgctggga

SEQ ID NO: 998405 - DNA, 16 bp, Homo sapiens
ctcctctgctgggact

SEQ ID NO: 998406 - DNA, 19 bp, Homo sapiens
ctcctctggcaggcttccc

SEQ ID NO: 998407 - DNA, 15 bp, Homo sapiens
ctcctctgggcagga

SEQ ID NO: 998408 - DNA, 23 bp, Homo sapiens
ctcctctgggcaggacctcagag

SEQ ID NO: 998409 - DNA, 15 bp, Homo sapiens
ctcctctgtccaggc

SEQ ID NO: 998410 - DNA, 16 bp, Homo sapiens
ctcctctgtccagggc

SEQ ID NO: 998411 - DNA, 17 bp, Homo sapiens
ctcctctgtccagggcc

SEQ ID NO: 998412 - DNA, 20 bp, Homo sapiens
ctcctcttaccgtagcctcc

SEQ ID NO: 998413 - DNA, 18 bp, Homo sapiens
ctcctcttccatgctgtg

SEQ ID NO: 998414 - DNA, 16 bp, Homo sapiens
ctcctcttgattcctg

SEQ ID NO: 998415 - DNA, 19 bp, Homo sapiens
ctcctcttgccactgcctc

SEQ ID NO: 998416 - DNA, 12 bp, Homo sapiens
ctcctcttggaa

SEQ ID NO: 998417 - DNA, 23 bp, Homo sapiens
ctcctcttggtgggtgtggccag

SEQ ID NO: 998418 - DNA, 12 bp, Homo sapiens
ctcctcttgtaa

SEQ ID NO: 998419 - DNA, 14 bp, Homo sapiens
ctcctcttgtaaat

SEQ ID NO: 998420 - DNA, 14 bp, Homo sapiens
ctcctctttctctc

SEQ ID NO: 998421 - DNA, 16 bp, Homo sapiens
ctcctctttctctccc

SEQ ID NO: 998422 - DNA, 17 bp, Homo sapiens
ctcctctttctctcccc

SEQ ID NO: 998423 - DNA, 20 bp, Homo sapiens
ctcctctttctctccccaac

SEQ ID NO: 998424 - DNA, 19 bp, Homo sapiens
ctcctgaaccgcacagctc

SEQ ID NO: 998425 - DNA, 21 bp, Homo sapiens
ctcctgaaccgcacagctcag

SEQ ID NO: 998426 - DNA, 23 bp, Homo sapiens
ctcctgaaccgcacagctcagga

SEQ ID NO: 998427 - DNA, 20 bp, Homo sapiens
ctcctgaagcctctgccctg

SEQ ID NO: 998428 - DNA, 16 bp, Homo sapiens
ctcctgacaagttatt

SEQ ID NO: 998429 - DNA, 18 bp, Homo sapiens
ctcctgacagaaggtgcc

SEQ ID NO: 998430 - DNA, 19 bp, Homo sapiens
ctcctgacccctccctgca

SEQ ID NO: 998431 - DNA, 21 bp, Homo sapiens
ctcctgaccctcccactccca

SEQ ID NO: 998432 - DNA, 22 bp, Homo sapiens
ctcctgaccctcccactcccat

SEQ ID NO: 998433 - DNA, 18 bp, Homo sapiens
ctcctgacctcaagtgat

SEQ ID NO: 998434 - DNA, 13 bp, Homo sapiens
ctcctgagcctgt

SEQ ID NO: 998435 - DNA, 18 bp, Homo sapiens
ctcctgagcctgtgggtc

SEQ ID NO: 998436 - DNA, 13 bp, Homo sapiens
ctcctgagctagg

SEQ ID NO: 998437 - DNA, 20 bp, Homo sapiens
ctcctgagggaggacctggg

SEQ ID NO: 998438 - DNA, 19 bp, Homo sapiens
ctcctgaggggcatctgcc

SEQ ID NO: 998439 - DNA, 16 bp, Homo sapiens
ctcctgagtagctggg

SEQ ID NO: 998440 - DNA, 23 bp, Homo sapiens
ctcctgagtagctgggcctgtgc

SEQ ID NO: 998441 - DNA, 20 bp, Homo sapiens
ctcctgagtgccccacttct

SEQ ID NO: 998442 - DNA, 13 bp, Homo sapiens
ctcctgatggcca

SEQ ID NO: 998443 - DNA, 19 bp, Homo sapiens
ctcctgatttctctgaaca

SEQ ID NO: 998444 - DNA, 17 bp, Homo sapiens
ctcctgcacacagggca

SEQ ID NO: 998445 - DNA, 20 bp, Homo sapiens
ctcctgcacttacttgctta

SEQ ID NO: 998446 - DNA, 19 bp, Homo sapiens
ctcctgcagcatggtccct

SEQ ID NO: 998447 - DNA, 15 bp, Homo sapiens
ctcctgcagccccag

SEQ ID NO: 998448 - DNA, 19 bp, Homo sapiens
ctcctgcagtttgggagac

SEQ ID NO: 998449 - DNA, 23 bp, Homo sapiens
ctcctgcagtttgggagacatgg

SEQ ID NO: 998450 - DNA, 19 bp, Homo sapiens
ctcctgccaccagcatcca

SEQ ID NO: 998451 - DNA, 17 bp, Homo sapiens
ctcctgccaccccttcc

SEQ ID NO: 998452 - DNA, 21 bp, Homo sapiens
ctcctgccaggcacacacagc

SEQ ID NO: 998453 - DNA, 11 bp, Homo sapiens
ctcctgcccac

SEQ ID NO: 998454 - DNA, 17 bp, Homo sapiens
ctcctgcccacggagtc

SEQ ID NO: 998455 - DNA, 18 bp, Homo sapiens
ctcctgcccacgggagga

SEQ ID NO: 998456 - DNA, 13 bp, Homo sapiens
ctcctgcccagat

SEQ ID NO: 998457 - DNA, 23 bp, Homo sapiens
ctcctgcccagatgccctttgga

SEQ ID NO: 998458 - DNA, 13 bp, Homo sapiens
ctcctgcccagcc

SEQ ID NO: 998459 - DNA, 15 bp, Homo sapiens
ctcctgcccagccac

SEQ ID NO: 998460 - DNA, 16 bp, Homo sapiens
ctcctgcccagccacc

SEQ ID NO: 998461 - DNA, 17 bp, Homo sapiens
ctcctgcccagctcctc

SEQ ID NO: 998462 - DNA, 17 bp, Homo sapiens
ctcctgccccctgccag

SEQ ID NO: 998463 - DNA, 18 bp, Homo sapiens
ctcctgccccctgccagt

SEQ ID NO: 998464 - DNA, 13 bp, Homo sapiens
ctcctgccctctg

SEQ ID NO: 998465 - DNA, 23 bp, Homo sapiens
ctcctgccctctgctctgcctgg

SEQ ID NO: 998466 - DNA, 18 bp, Homo sapiens
ctcctgccctgtccctgt

SEQ ID NO: 998467 - DNA, 17 bp, Homo sapiens
ctcctgccctttcccag

SEQ ID NO: 998468 - DNA, 19 bp, Homo sapiens
ctcctgcctgagtttccag

SEQ ID NO: 998469 - DNA, 21 bp, Homo sapiens
ctcctgcctgagtttccagcc

SEQ ID NO: 998470 - DNA, 17 bp, Homo sapiens
ctcctgcctgcccctct

SEQ ID NO: 998471 - DNA, 20 bp, Homo sapiens
ctcctgcctgccctgcctca

SEQ ID NO: 998472 - DNA, 14 bp, Homo sapiens
ctcctgcctgtagc

SEQ ID NO: 998473 - DNA, 15 bp, Homo sapiens
ctcctgcctgtagca

SEQ ID NO: 998474 - DNA, 16 bp, Homo sapiens
ctcctgcctgtagcag

SEQ ID NO: 998475 - DNA, 22 bp, Homo sapiens
cagaataatccagtattgctga

SEQ ID NO: 998476 - DNA, 23 bp, Homo sapiens
cagaataatggaaacattacagt

SEQ ID NO: 998477 - DNA, 17 bp, Homo sapiens
cagaatacggaagagca

SEQ ID NO: 998478 - DNA, 12 bp, Homo sapiens
cagaatactggt

SEQ ID NO: 998479 - DNA, 19 bp, Homo sapiens
cagaatacttgcactcttt

SEQ ID NO: 998480 - DNA, 21 bp, Homo sapiens
cagaatagatctgatggtgag

SEQ ID NO: 998481 - DNA, 21 bp, Homo sapiens
cagaatagccacatttggaat

SEQ ID NO: 998482 - DNA, 22 bp, Homo sapiens
cagaatagctgttttgtgtata

SEQ ID NO: 998483 - DNA, 21 bp, Homo sapiens
cagaatagcttccaataaagc

SEQ ID NO: 998484 - DNA, 14 bp, Homo sapiens
cagaataggaaaac

SEQ ID NO: 998485 - DNA, 20 bp, Homo sapiens
cagaatataacatgtaaaat

SEQ ID NO: 998486 - DNA, 22 bp, Homo sapiens
cagaatcagtgttaaattcatt

SEQ ID NO: 998487 - DNA, 15 bp, Homo sapiens
cagaatcatggagaa

SEQ ID NO: 998488 - DNA, 19 bp, Homo sapiens
cagaatccataaatgtgtt

SEQ ID NO: 998489 - DNA, 21 bp, Homo sapiens
cagaatccttggctgaattaa

SEQ ID NO: 998490 - DNA, 16 bp, Homo sapiens
cagaatctaaacgtgg

SEQ ID NO: 998491 - DNA, 22 bp, Homo sapiens
cagaatctaaacgtggtcacct

SEQ ID NO: 998492 - DNA, 13 bp, Homo sapiens
cagaatctgctgt

SEQ ID NO: 998493 - DNA, 14 bp, Homo sapiens
cagaatctgctgtt

SEQ ID NO: 998494 - DNA, 17 bp, Homo sapiens
cagaatcttgttttgaa

SEQ ID NO: 998495 - DNA, 16 bp, Homo sapiens
cagaatctttgttaag

SEQ ID NO: 998496 - DNA, 22 bp, Homo sapiens
cagaatgaacccatagggagct

SEQ ID NO: 998497 - DNA, 18 bp, Homo sapiens
cagaatgaaccctcctcc

SEQ ID NO: 998498 - DNA, 19 bp, Homo sapiens
cagaatgaaccctcctcct

SEQ ID NO: 998499 - DNA, 21 bp, Homo sapiens
cagaatgaaccctcctccttt

SEQ ID NO: 998500 - DNA, 12 bp, Homo sapiens
cagaatgaatct

SEQ ID NO: 998501 - DNA, 11 bp, Homo sapiens
cagaatgaatt

SEQ ID NO: 998502 - DNA, 16 bp, Homo sapiens
cagaatgctgaactcc

SEQ ID NO: 998503 - DNA, 16 bp, Homo sapiens
cagacatacttttcct

SEQ ID NO: 998504 - DNA, 16 bp, Homo sapiens
cagacatatccaaagg

SEQ ID NO: 998505 - DNA, 17 bp, Homo sapiens
cagacatatttaactgg

SEQ ID NO: 998506 - DNA, 23 bp, Homo sapiens
cagacatccatgtttgtaaaact

SEQ ID NO: 998507 - DNA, 14 bp, Homo sapiens
cagacatggagatg

SEQ ID NO: 998508 - DNA, 20 bp, Homo sapiens
cagacatggagatgtaaaat

SEQ ID NO: 998509 - DNA, 22 bp, Homo sapiens
cagacatgtggtgggacaggga

SEQ ID NO: 998510 - DNA, 17 bp, Homo sapiens
cagacattctcaaagcc

SEQ ID NO: 998511 - DNA, 12 bp, Homo sapiens
cagacatttata

SEQ ID NO: 998512 - DNA, 13 bp, Homo sapiens
cagacattttaaa

SEQ ID NO: 998513 - DNA, 15 bp, Homo sapiens
cagaccaaccctggg

SEQ ID NO: 998514 - DNA, 18 bp, Homo sapiens
cagaccaaccctgggacc

SEQ ID NO: 998515 - DNA, 23 bp, Homo sapiens
cagaccaacgttactcagggctc

SEQ ID NO: 998516 - DNA, 16 bp, Homo sapiens
cagaccaccagccgcc

SEQ ID NO: 998517 - DNA, 19 bp, Homo sapiens
cagaccaccagccgcccca

SEQ ID NO: 998518 - DNA, 21 bp, Homo sapiens
cagaccaccagccgccccagc

SEQ ID NO: 998519 - DNA, 13 bp, Homo sapiens
cagaccaccccgc

SEQ ID NO: 998520 - DNA, 22 bp, Homo sapiens
cagaccaccccgcctgccctca

SEQ ID NO: 998521 - DNA, 23 bp, Homo sapiens
cagaccacgcccgtcctgcctgt

SEQ ID NO: 998522 - DNA, 13 bp, Homo sapiens
cagaccacggctc

SEQ ID NO: 998523 - DNA, 16 bp, Homo sapiens
cagaccacttgccacg

SEQ ID NO: 998524 - DNA, 18 bp, Homo sapiens
cagaccacttgccacgct

SEQ ID NO: 998525 - DNA, 16 bp, Homo sapiens
cagaccagccctgcag

SEQ ID NO: 998526 - DNA, 14 bp, Homo sapiens
cagaccatgaagta

SEQ ID NO: 998527 - DNA, 22 bp, Homo sapiens
cagaccatgaagtaaattatgt

SEQ ID NO: 998528 - DNA, 14 bp, Homo sapiens
cagacccacctgga

SEQ ID NO: 998529 - DNA, 23 bp, Homo sapiens
cagacccactcccaaagctcaga

SEQ ID NO: 998530 - DNA, 13 bp, Homo sapiens
cagacccagagaa

SEQ ID NO: 998531 - DNA, 15 bp, Homo sapiens
cagacccagaggccc

SEQ ID NO: 998532 - DNA, 22 bp, Homo sapiens
cagacccagaggccctgaagcc

SEQ ID NO: 998533 - DNA, 21 bp, Homo sapiens
cagacccagcccgcggcctgg

SEQ ID NO: 998534 - DNA, 22 bp, Homo sapiens
cagacccagcccgcggcctgga

SEQ ID NO: 998535 - DNA, 20 bp, Homo sapiens
cagacccagtcccacactgt

SEQ ID NO: 998536 - DNA, 19 bp, Homo sapiens
cagacccatacctttccag

SEQ ID NO: 998537 - DNA, 14 bp, Homo sapiens
cagacccattcctt

SEQ ID NO: 998538 - DNA, 17 bp, Homo sapiens
cagacccattccttagc

SEQ ID NO: 998539 - DNA, 22 bp, Homo sapiens
cagaccccaccctacgctcatc

SEQ ID NO: 998540 - DNA, 12 bp, Homo sapiens
cagaccccagcg

SEQ ID NO: 998541 - DNA, 15 bp, Homo sapiens
cagacccccacccct

SEQ ID NO: 998542 - DNA, 18 bp, Homo sapiens
cagacccccaccccttcc

SEQ ID NO: 998543 - DNA, 21 bp, Homo sapiens
cagacccccaccccttcccca

SEQ ID NO: 998544 - DNA, 13 bp, Homo sapiens
cagacccccactc

SEQ ID NO: 998545 - DNA, 16 bp, Homo sapiens
cagacccccactctca

SEQ ID NO: 998546 - DNA, 22 bp, Homo sapiens
cagacccccccatttcccgcac

SEQ ID NO: 998547 - DNA, 16 bp, Homo sapiens
cagaccccctcagcct

SEQ ID NO: 998548 - DNA, 20 bp, Homo sapiens
cagaccccgcccctggggaa

SEQ ID NO: 998549 - DNA, 16 bp, Homo sapiens
cagaccccgtggctct

SEQ ID NO: 998550 - DNA, 17 bp, Homo sapiens
cagaccccgtggctctg

SEQ ID NO: 998551 - DNA, 19 bp, Homo sapiens
cagaccccgtggctctggg

SEQ ID NO: 998552 - DNA, 18 bp, Homo sapiens
cagacccctcccctcgtg

SEQ ID NO: 998553 - DNA, 13 bp, Homo sapiens
cagacccctctgg

SEQ ID NO: 998554 - DNA, 16 bp, Homo sapiens
cagacccctctggcca

SEQ ID NO: 998555 - DNA, 16 bp, Homo sapiens
cagacccctggctttt

SEQ ID NO: 998556 - DNA, 22 bp, Homo sapiens
cagacccctttgagagacgcca

SEQ ID NO: 998557 - DNA, 18 bp, Homo sapiens
cagaccctgaacccacac

SEQ ID NO: 998558 - DNA, 16 bp, Homo sapiens
cagaccctgcctgagc

SEQ ID NO: 998559 - DNA, 18 bp, Homo sapiens
cagaccctgcctgagccc

SEQ ID NO: 998560 - DNA, 19 bp, Homo sapiens
cagaccctgcctgagccca

SEQ ID NO: 998561 - DNA, 19 bp, Homo sapiens
cagaccctggaggccccaa

SEQ ID NO: 998562 - DNA, 22 bp, Homo sapiens
cagaccctggaggccccaaccc

SEQ ID NO: 998563 - DNA, 15 bp, Homo sapiens
cagacctaagccctg

SEQ ID NO: 998564 - DNA, 22 bp, Homo sapiens
cagacctaagccctgccccggg

SEQ ID NO: 998565 - DNA, 16 bp, Homo sapiens
cagacctagcaggctg

SEQ ID NO: 998566 - DNA, 16 bp, Homo sapiens
cagacctcaagccatc

SEQ ID NO: 998567 - DNA, 19 bp, Homo sapiens
cagacctcaagggacaggg

SEQ ID NO: 998568 - DNA, 20 bp, Homo sapiens
cagacctcaagggacaggga

SEQ ID NO: 998569 - DNA, 13 bp, Homo sapiens
cagacctcactgt

SEQ ID NO: 998570 - DNA, 21 bp, Homo sapiens
cagacctcactgtcagggtct

SEQ ID NO: 998571 - DNA, 15 bp, Homo sapiens
cagacctcatgccca

SEQ ID NO: 998572 - DNA, 15 bp, Homo sapiens
cagacctgcagtgag

SEQ ID NO: 998573 - DNA, 22 bp, Homo sapiens
cagacctgcagtgaggggccct

SEQ ID NO: 998574 - DNA, 15 bp, Homo sapiens
cagacctgctctgga

SEQ ID NO: 998575 - DNA, 15 bp, Homo sapiens
cagacctggagcccc

SEQ ID NO: 998576 - DNA, 18 bp, Homo sapiens
cagacctggagcccctgg

SEQ ID NO: 998577 - DNA, 13 bp, Homo sapiens
cagacctgtcacc

SEQ ID NO: 998578 - DNA, 21 bp, Homo sapiens
cagacctgtcaccctgcagga

SEQ ID NO: 998579 - DNA, 19 bp, Homo sapiens
cagacctgtcttccaagga

SEQ ID NO: 998580 - DNA, 20 bp, Homo sapiens
cagacctgttagcagacagg

SEQ ID NO: 998581 - DNA, 18 bp, Homo sapiens
cagaccttgggggaagac

SEQ ID NO: 998582 - DNA, 15 bp, Homo sapiens
cagaccttttttagg

SEQ ID NO: 998583 - DNA, 14 bp, Homo sapiens
cagacgagatcctg

SEQ ID NO: 998584 - DNA, 23 bp, Homo sapiens
cagacgagatcctgtttcagcta

SEQ ID NO: 998585 - DNA, 17 bp, Homo sapiens
cagacgcagcagctggg

SEQ ID NO: 998586 - DNA, 20 bp, Homo sapiens
cagacgcatagactgaggta

SEQ ID NO: 998587 - DNA, 15 bp, Homo sapiens
cagacgccttactgg

SEQ ID NO: 998588 - DNA, 17 bp, Homo sapiens
cagacgctgccgctgcc

SEQ ID NO: 998589 - DNA, 18 bp, Homo sapiens
cagacgctgctgtcacaa

SEQ ID NO: 998590 - DNA, 13 bp, Homo sapiens
cagacggcctagg

SEQ ID NO: 998591 - DNA, 15 bp, Homo sapiens
cagacggcctagggg

SEQ ID NO: 998592 - DNA, 17 bp, Homo sapiens
cagacgggaatgcctag

SEQ ID NO: 998593 - DNA, 19 bp, Homo sapiens
cagacgggaatgcctaggt

SEQ ID NO: 998594 - DNA, 18 bp, Homo sapiens
cagacgggcacacagact

SEQ ID NO: 998595 - DNA, 16 bp, Homo sapiens
cagacggtctgtgtgc

SEQ ID NO: 998596 - DNA, 19 bp, Homo sapiens
cagacggtctgtgtgctgt

SEQ ID NO: 998597 - DNA, 13 bp, Homo sapiens
cagacggtgacgc

SEQ ID NO: 998598 - DNA, 22 bp, Homo sapiens
cagacgtcgtacccagccatgt

SEQ ID NO: 998599 - DNA, 16 bp, Homo sapiens
cagacgtgctccctcc

SEQ ID NO: 998600 - DNA, 15 bp, Homo sapiens
cagacgttgcctgag

SEQ ID NO: 998601 - DNA, 14 bp, Homo sapiens
cagactacacagga

SEQ ID NO: 998602 - DNA, 23 bp, Homo sapiens
cagactagaattctagtgctgct

SEQ ID NO: 998603 - DNA, 15 bp, Homo sapiens
cagactagatgtagt

SEQ ID NO: 998604 - DNA, 20 bp, Homo sapiens
cagactagatgtagtatttt

SEQ ID NO: 998605 - DNA, 16 bp, Homo sapiens
ctccttctccccaatc

SEQ ID NO: 998606 - DNA, 14 bp, Homo sapiens
ctccttcttccact

SEQ ID NO: 998607 - DNA, 15 bp, Homo sapiens
ctccttcttccactt

SEQ ID NO: 998608 - DNA, 17 bp, Homo sapiens
ctccttcttccacttct

SEQ ID NO: 998609 - DNA, 19 bp, Homo sapiens
ctccttgcaaccaggcagc

SEQ ID NO: 998610 - DNA, 14 bp, Homo sapiens
ctccttgcagcagg

SEQ ID NO: 998611 - DNA, 21 bp, Homo sapiens
ctccttgcagcagggctgggc

SEQ ID NO: 998612 - DNA, 14 bp, Homo sapiens
ctccttgcccagac

SEQ ID NO: 998613 - DNA, 18 bp, Homo sapiens
ctccttgcctcctgtgta

SEQ ID NO: 998614 - DNA, 23 bp, Homo sapiens
ctccttgccttgcttctcccatt

SEQ ID NO: 998615 - DNA, 13 bp, Homo sapiens
ctccttggcaccc

SEQ ID NO: 998616 - DNA, 16 bp, Homo sapiens
ctccttggcaccccca

SEQ ID NO: 998617 - DNA, 21 bp, Homo sapiens
ctccttggcacccccatgctg

SEQ ID NO: 998618 - DNA, 15 bp, Homo sapiens
ctccttggctgtctg

SEQ ID NO: 998619 - DNA, 21 bp, Homo sapiens
ctccttggcttacctgacctc

SEQ ID NO: 998620 - DNA, 15 bp, Homo sapiens
ctccttgggcacttt

SEQ ID NO: 998621 - DNA, 18 bp, Homo sapiens
ctccttgggccctttgag

SEQ ID NO: 998622 - DNA, 14 bp, Homo sapiens
ctccttgggctcct

SEQ ID NO: 998623 - DNA, 17 bp, Homo sapiens
ctccttgggctcctggc

SEQ ID NO: 998624 - DNA, 18 bp, Homo sapiens
ctccttgggctcctggct

SEQ ID NO: 998625 - DNA, 20 bp, Homo sapiens
ctcggcagaactctctgtct

SEQ ID NO: 998626 - DNA, 16 bp, Homo sapiens
ctcggccactgtgtct

SEQ ID NO: 998627 - DNA, 20 bp, Homo sapiens
ctcggccactgtgtctctgt

SEQ ID NO: 998628 - DNA, 24 bp, Homo sapiens
ctcggccccacccaccctctggtc

SEQ ID NO: 998629 - DNA, 17 bp, Homo sapiens
ctcggccccatcgcccc

SEQ ID NO: 998630 - DNA, 13 bp, Homo sapiens
ctcggcccctctg

SEQ ID NO: 998631 - DNA, 14 bp, Homo sapiens
ctcggcctcccaaa

SEQ ID NO: 998632 - DNA, 18 bp, Homo sapiens
ctcggcctcccaaagtgc

SEQ ID NO: 998633 - DNA, 20 bp, Homo sapiens
ctcggcctcccaaagtgctg

SEQ ID NO: 998634 - DNA, 19 bp, Homo sapiens
ctcggctccccatgtgtcc

SEQ ID NO: 998635 - DNA, 18 bp, Homo sapiens
ctcggctggaagaacatc

SEQ ID NO: 998636 - DNA, 17 bp, Homo sapiens
ctcggcttggatcctgg

SEQ ID NO: 998637 - DNA, 20 bp, Homo sapiens
ctcggcttggatcctgggct

SEQ ID NO: 998638 - DNA, 21 bp, Homo sapiens
ctcggcttggatcctgggctg

SEQ ID NO: 998639 - DNA, 15 bp, Homo sapiens
ctcgggaagggaggg

SEQ ID NO: 998640 - DNA, 18 bp, Homo sapiens
ctcgggactagctgcctt

SEQ ID NO: 998641 - DNA, 12 bp, Homo sapiens
ctcgggagctgc

SEQ ID NO: 998642 - DNA, 21 bp, Homo sapiens
ctcgggaggctgagacaggag

SEQ ID NO: 998643 - DNA, 16 bp, Homo sapiens
ctcgggcccacctggc

SEQ ID NO: 998644 - DNA, 18 bp, Homo sapiens
ctcgggcccacctggcca

SEQ ID NO: 998645 - DNA, 21 bp, Homo sapiens
ctcgggcccacctggccacct

SEQ ID NO: 998646 - DNA, 17 bp, Homo sapiens
ctcgggctctctcaccc

SEQ ID NO: 998647 - DNA, 20 bp, Homo sapiens
ctcgggctgacccttttctg

SEQ ID NO: 998648 - DNA, 18 bp, Homo sapiens
ctcggggagagggggagg

SEQ ID NO: 998649 - DNA, 16 bp, Homo sapiens
ctcggggatggggagg

SEQ ID NO: 998650 - DNA, 21 bp, Homo sapiens
ctcggggcccttggggcctgg

SEQ ID NO: 998651 - DNA, 15 bp, Homo sapiens
ctcgggggcgcctgg

SEQ ID NO: 998652 - DNA, 13 bp, Homo sapiens
ctcgggggtgctg

SEQ ID NO: 998653 - DNA, 20 bp, Homo sapiens
ctcgggggtgctggggccag

SEQ ID NO: 998654 - DNA, 22 bp, Homo sapiens
ctcgggggtgctggggccaggg

SEQ ID NO: 998655 - DNA, 17 bp, Homo sapiens
ctcggggtaaaaagtgg

SEQ ID NO: 998656 - DNA, 19 bp, Homo sapiens
ctcggggtaaaaagtggct

SEQ ID NO: 998657 - DNA, 15 bp, Homo sapiens
ctcggggtccaccag

SEQ ID NO: 998658 - DNA, 15 bp, Homo sapiens
ctcggggtccagtgc

SEQ ID NO: 998659 - DNA, 21 bp, Homo sapiens
ctcgggtggctagtcagagag

SEQ ID NO: 998660 - DNA, 20 bp, Homo sapiens
ctcggtctcccaaagtgctg

SEQ ID NO: 998661 - DNA, 16 bp, Homo sapiens
ctcggtctcccttccg

SEQ ID NO: 998662 - DNA, 23 bp, Homo sapiens
ctcggtctcccttccgtccatcc

SEQ ID NO: 998663 - DNA, 22 bp, Homo sapiens
ctcggtttgccaaaattcattt

SEQ ID NO: 998664 - DNA, 24 bp, Homo sapiens
ctcgtcaagagcatgcacatgctg

SEQ ID NO: 998665 - DNA, 16 bp, Homo sapiens
ctcgtccacaggggca

SEQ ID NO: 998666 - DNA, 22 bp, Homo sapiens
ctcgtccacaggggcaggcctg

SEQ ID NO: 998667 - DNA, 13 bp, Homo sapiens
ctcgtcccatcca

SEQ ID NO: 998668 - DNA, 15 bp, Homo sapiens
ctcgtccccctccct

SEQ ID NO: 998669 - DNA, 18 bp, Homo sapiens
ctcgtccccctccctgcc

SEQ ID NO: 998670 - DNA, 21 bp, Homo sapiens
ctcgtccccctccctgcccaa

SEQ ID NO: 998671 - DNA, 17 bp, Homo sapiens
ctcgtccgtctgtctcg

SEQ ID NO: 998672 - DNA, 14 bp, Homo sapiens
ctcgtcctccccct

SEQ ID NO: 998673 - DNA, 15 bp, Homo sapiens
ctcgtcctccccctg

SEQ ID NO: 998674 - DNA, 16 bp, Homo sapiens
ctcgtcctccccctgc

SEQ ID NO: 998675 - DNA, 17 bp, Homo sapiens
ctcgtcctgtcccagag

SEQ ID NO: 998676 - DNA, 18 bp, Homo sapiens
ctcgtctccctggccacc

SEQ ID NO: 998677 - DNA, 15 bp, Homo sapiens
ctcgtcttccgtctc

SEQ ID NO: 998678 - DNA, 20 bp, Homo sapiens
ctcgtgagtcatttaaatgt

SEQ ID NO: 998679 - DNA, 20 bp, Homo sapiens
ctcgtgcagagctggggctg

SEQ ID NO: 998680 - DNA, 16 bp, Homo sapiens
ctcgtgcatccctgag

SEQ ID NO: 998681 - DNA, 15 bp, Homo sapiens
ctcgtgccagcagcc

SEQ ID NO: 998682 - DNA, 18 bp, Homo sapiens
ctcgtgccagcagcctcg

SEQ ID NO: 998683 - DNA, 21 bp, Homo sapiens
ctcgtgccagcagcctcgcac

SEQ ID NO: 998684 - DNA, 21 bp, Homo sapiens
ctcgtggactgtgctggtgca

SEQ ID NO: 998685 - DNA, 23 bp, Homo sapiens
ctcgtggagctcgcccctcccct

SEQ ID NO: 998686 - DNA, 17 bp, Homo sapiens
ctcgtggccagcccggc

SEQ ID NO: 998687 - DNA, 18 bp, Homo sapiens
ctcgtggccagcccggct

SEQ ID NO: 998688 - DNA, 19 bp, Homo sapiens
ctcgtggccagcccggctg

SEQ ID NO: 998689 - DNA, 15 bp, Homo sapiens
ctcgtgggcttgtgc

SEQ ID NO: 998690 - DNA, 16 bp, Homo sapiens
ctcgtggtagaagcca

SEQ ID NO: 998691 - DNA, 15 bp, Homo sapiens
ctcgtggtaggactg

SEQ ID NO: 998692 - DNA, 17 bp, Homo sapiens
ctcgtggtaggactgta

SEQ ID NO: 998693 - DNA, 20 bp, Homo sapiens
ctcgtggttattagcaaggc

SEQ ID NO: 998694 - DNA, 18 bp, Homo sapiens
ctcgtgtatcctggggct

SEQ ID NO: 998695 - DNA, 19 bp, Homo sapiens
ctcgtgtatcctggggctc

SEQ ID NO: 998696 - DNA, 20 bp, Homo sapiens
ctcgtgtatcctggggctcc

SEQ ID NO: 998697 - DNA, 16 bp, Homo sapiens
ctcgtgtcagctcagg

SEQ ID NO: 998698 - DNA, 18 bp, Homo sapiens
ctcgtgtcagtaatttat

SEQ ID NO: 998699 - DNA, 18 bp, Homo sapiens
ctcgtgtttgcttaaaat

SEQ ID NO: 998700 - DNA, 23 bp, Homo sapiens
ctcgtgtttgcttaaaatatgtg

SEQ ID NO: 998701 - DNA, 19 bp, Homo sapiens
ctcgttattgttgttgcca

SEQ ID NO: 998702 - DNA, 14 bp, Homo sapiens
ctcgttcctttctc

SEQ ID NO: 998703 - DNA, 15 bp, Homo sapiens
ctcgttcctttctcc

SEQ ID NO: 998704 - DNA, 13 bp, Homo sapiens
ctcgttctccttc

SEQ ID NO: 998705 - DNA, 15 bp, Homo sapiens
ctcgttctccttccc

SEQ ID NO: 998706 - DNA, 17 bp, Homo sapiens
ctcgttctccttcccca

SEQ ID NO: 998707 - DNA, 20 bp, Homo sapiens
ctcgttgactggctgtgtgt

SEQ ID NO: 998708 - DNA, 23 bp, Homo sapiens
ctcgttgactggctgtgtgttgg

SEQ ID NO: 998709 - DNA, 18 bp, Homo sapiens
ctcgttggaagaggaaca

SEQ ID NO: 998710 - DNA, 20 bp, Homo sapiens
ctcgttggatgtctgtgagt

SEQ ID NO: 998711 - DNA, 21 bp, Homo sapiens
ctcgttgggccgctctgattt

SEQ ID NO: 998712 - DNA, 23 bp, Homo sapiens
ctcgtttttcagcacccccaccc

SEQ ID NO: 998713 - DNA, 20 bp, Homo sapiens
ctctaaaataggtaaatgta

SEQ ID NO: 998714 - DNA, 17 bp, Homo sapiens
ctctaaaatggacattt

SEQ ID NO: 998715 - DNA, 19 bp, Homo sapiens
ctctaaaatggacattttc

SEQ ID NO: 998716 - DNA, 15 bp, Homo sapiens
ctctaaaattataaa

SEQ ID NO: 998717 - DNA, 13 bp, Homo sapiens
ctctaaactgcaa

SEQ ID NO: 998718 - DNA, 19 bp, Homo sapiens
ctctaaactgcaaacagaa

SEQ ID NO: 998719 - DNA, 18 bp, Homo sapiens
ctctaaagaaaaatgcct

SEQ ID NO: 998720 - DNA, 18 bp, Homo sapiens
ctctaaagcaataatggt

SEQ ID NO: 998721 - DNA, 17 bp, Homo sapiens
ctctaaagccaagcact

SEQ ID NO: 998722 - DNA, 22 bp, Homo sapiens
ctctaaagtctgttgattaaag

SEQ ID NO: 998723 - DNA, 21 bp, Homo sapiens
ctctaaatgcagttttaagaa

SEQ ID NO: 998724 - DNA, 13 bp, Homo sapiens
ctctaacatttcc

SEQ ID NO: 998725 - DNA, 16 bp, Homo sapiens
ctctaaccattcaaat

SEQ ID NO: 998726 - DNA, 18 bp, Homo sapiens
ctctaaccctcattgctg

SEQ ID NO: 998727 - DNA, 13 bp, Homo sapiens
ctctaaccctgtg

SEQ ID NO: 998728 - DNA, 14 bp, Homo sapiens
ctctaaccctgtgg

SEQ ID NO: 998729 - DNA, 15 bp, Homo sapiens
ctctaaccctgtgga

SEQ ID NO: 998730 - DNA, 15 bp, Homo sapiens
ctctaacttctcaag

SEQ ID NO: 998731 - DNA, 15 bp, Homo sapiens
ctctaagcagccagg

SEQ ID NO: 998732 - DNA, 20 bp, Homo sapiens
ctctaagcagccaggaggga

SEQ ID NO: 998733 - DNA, 23 bp, Homo sapiens
ctctaagcctatacgtttctgtg

SEQ ID NO: 998734 - DNA, 19 bp, Homo sapiens
cagagagggacacatgccc

SEQ ID NO: 998735 - DNA, 12 bp, Homo sapiens
cagagagggcag

SEQ ID NO: 998736 - DNA, 13 bp, Homo sapiens
cagagagggccca

SEQ ID NO: 998737 - DNA, 20 bp, Homo sapiens
cagagagggcccagctgtag

SEQ ID NO: 998738 - DNA, 19 bp, Homo sapiens
cagagagtcctctggatgg

SEQ ID NO: 998739 - DNA, 15 bp, Homo sapiens
cagagagtcctgtgc

SEQ ID NO: 998740 - DNA, 23 bp, Homo sapiens
cagagagtgagagacattaactc

SEQ ID NO: 998741 - DNA, 18 bp, Homo sapiens
cagagagtggctcctccc

SEQ ID NO: 998742 - DNA, 19 bp, Homo sapiens
cagagatatacaaatatat

SEQ ID NO: 998743 - DNA, 19 bp, Homo sapiens
cagagatgcatgcgcaggc

SEQ ID NO: 998744 - DNA, 21 bp, Homo sapiens
cagagatgcatgcgcaggctc

SEQ ID NO: 998745 - DNA, 22 bp, Homo sapiens
cagagatgcatgcgcaggctca

SEQ ID NO: 998746 - DNA, 17 bp, Homo sapiens
ctctacaaactcccact

SEQ ID NO: 998747 - DNA, 17 bp, Homo sapiens
ctctacaattcctctga

SEQ ID NO: 998748 - DNA, 23 bp, Homo sapiens
ctctacacaggggccctgtacag

SEQ ID NO: 998749 - DNA, 16 bp, Homo sapiens
ctctacactgaaacgt

SEQ ID NO: 998750 - DNA, 14 bp, Homo sapiens
ctctacagccgtcc

SEQ ID NO: 998751 - DNA, 21 bp, Homo sapiens
ctctacaggcctcttcctgtt

SEQ ID NO: 998752 - DNA, 20 bp, Homo sapiens
ctctacagtgccaactcctc

SEQ ID NO: 998753 - DNA, 15 bp, Homo sapiens
ctctacatcttctgc

SEQ ID NO: 998754 - DNA, 14 bp, Homo sapiens
ctctaccaaataat

SEQ ID NO: 998755 - DNA, 14 bp, Homo sapiens
ctctaccatcatcc

SEQ ID NO: 998756 - DNA, 20 bp, Homo sapiens
ctctaccatttgcagagtcc

SEQ ID NO: 998757 - DNA, 18 bp, Homo sapiens
ctctacccaaaccctagg

SEQ ID NO: 998758 - DNA, 16 bp, Homo sapiens
ctctacccatattaca

SEQ ID NO: 998759 - DNA, 22 bp, Homo sapiens
ctctacccatcttaaaaacaac

SEQ ID NO: 998760 - DNA, 16 bp, Homo sapiens
ctctaccccccacctt

SEQ ID NO: 998761 - DNA, 17 bp, Homo sapiens
ctctacccggcccagag

SEQ ID NO: 998762 - DNA, 22 bp, Homo sapiens
ctctaccctcccacccccttct

SEQ ID NO: 998763 - DNA, 14 bp, Homo sapiens
ctctaccctgtctg

SEQ ID NO: 998764 - DNA, 19 bp, Homo sapiens
ctctaccctgtctgtccct

SEQ ID NO: 998765 - DNA, 12 bp, Homo sapiens
ctctacctccac

SEQ ID NO: 998766 - DNA, 14 bp, Homo sapiens
ctctacctccaccc

SEQ ID NO: 998767 - DNA, 17 bp, Homo sapiens
ctctacctctctttctc

SEQ ID NO: 998768 - DNA, 16 bp, Homo sapiens
ctctaccttcctgtcc

SEQ ID NO: 998769 - DNA, 23 bp, Homo sapiens
ctctaccttcctgtccctgaggt

SEQ ID NO: 998770 - DNA, 22 bp, Homo sapiens
ctctactaaaaatacaaaaatt

SEQ ID NO: 998771 - DNA, 18 bp, Homo sapiens
ctctactaccacaaggaa

SEQ ID NO: 998772 - DNA, 15 bp, Homo sapiens
ctctactcttcctgt

SEQ ID NO: 998773 - DNA, 15 bp, Homo sapiens
ctctactgttgcaca

SEQ ID NO: 998774 - DNA, 20 bp, Homo sapiens
ctctactgttgcacagccag

SEQ ID NO: 998775 - DNA, 20 bp, Homo sapiens
ctctacttagcatgtcccta

SEQ ID NO: 998776 - DNA, 19 bp, Homo sapiens
ctctacttccccttcttgc

SEQ ID NO: 998777 - DNA, 23 bp, Homo sapiens
ctctagaaagtatagatggccaa

SEQ ID NO: 998778 - DNA, 12 bp, Homo sapiens
ctctagaaattt

SEQ ID NO: 998779 - DNA, 17 bp, Homo sapiens
ctctagaacatgcacat

SEQ ID NO: 998780 - DNA, 20 bp, Homo sapiens
ctctagaattttaagtgctt

SEQ ID NO: 998781 - DNA, 18 bp, Homo sapiens
ctctagacaaccctgcaa

SEQ ID NO: 998782 - DNA, 23 bp, Homo sapiens
ctctagacaaccctgcaaaggac

SEQ ID NO: 998783 - DNA, 16 bp, Homo sapiens
ctctagacaagatatt

SEQ ID NO: 998784 - DNA, 13 bp, Homo sapiens
ctctagagagagg

SEQ ID NO: 998785 - DNA, 22 bp, Homo sapiens
ctctagagagatgagaagccag

SEQ ID NO: 998786 - DNA, 13 bp, Homo sapiens
ctctagagcaggg

SEQ ID NO: 998787 - DNA, 22 bp, Homo sapiens
ctctagagccttcagccttaat

SEQ ID NO: 998788 - DNA, 14 bp, Homo sapiens
ctctagatgcaaat

SEQ ID NO: 998789 - DNA, 13 bp, Homo sapiens
ctctagccaggag

SEQ ID NO: 998790 - DNA, 17 bp, Homo sapiens
ctctagccaggagtctg

SEQ ID NO: 998791 - DNA, 22 bp, Homo sapiens
ctctagccaggagtctgtgctc

SEQ ID NO: 998792 - DNA, 20 bp, Homo sapiens
ctctagcccactccctgcct

SEQ ID NO: 998793 - DNA, 20 bp, Homo sapiens
ctctagcctgggccagagaa

SEQ ID NO: 998794 - DNA, 22 bp, Homo sapiens
ctctagctccccaattctgcct

SEQ ID NO: 998795 - DNA, 15 bp, Homo sapiens
ctctagctggcagga

SEQ ID NO: 998796 - DNA, 16 bp, Homo sapiens
ctctagctggcaggac

SEQ ID NO: 998797 - DNA, 14 bp, Homo sapiens
ctctagctgttctt

SEQ ID NO: 998798 - DNA, 13 bp, Homo sapiens
ctctagcttttct

SEQ ID NO: 998799 - DNA, 18 bp, Homo sapiens
ctctaggagggagccttg

SEQ ID NO: 998800 - DNA, 22 bp, Homo sapiens
ctctaggagggagccttgtgag

SEQ ID NO: 998801 - DNA, 23 bp, Homo sapiens
ctctagggaaaaaccagcgtgtg

SEQ ID NO: 998802 - DNA, 17 bp, Homo sapiens
ctctagggaatctggat

SEQ ID NO: 998803 - DNA, 14 bp, Homo sapiens
ctctaggggcagcc

SEQ ID NO: 998804 - DNA, 23 bp, Homo sapiens
ctctaggtacgatgacagtgttc

SEQ ID NO: 998805 - DNA, 17 bp, Homo sapiens
ctctaggttatacaata

SEQ ID NO: 998806 - DNA, 13 bp, Homo sapiens
ctctagtgccctc

SEQ ID NO: 998807 - DNA, 21 bp, Homo sapiens
ctctagtgccctccacagccg

SEQ ID NO: 998808 - DNA, 14 bp, Homo sapiens
ctctagtgccttct

SEQ ID NO: 998809 - DNA, 12 bp, Homo sapiens
ctctagtgctgt

SEQ ID NO: 998810 - DNA, 13 bp, Homo sapiens
ctctagtgctgtg

SEQ ID NO: 998811 - DNA, 14 bp, Homo sapiens
ctctagtgctgtga

SEQ ID NO: 998812 - DNA, 16 bp, Homo sapiens
ctctagtgggacagcc

SEQ ID NO: 998813 - DNA, 15 bp, Homo sapiens
ctctagttctttgtt

SEQ ID NO: 998814 - DNA, 15 bp, Homo sapiens
ctctagtttgattaa

SEQ ID NO: 998815 - DNA, 20 bp, Homo sapiens
ctctagtttgattaaattct

SEQ ID NO: 998816 - DNA, 18 bp, Homo sapiens
ctctatacaggacttaga

SEQ ID NO: 998817 - DNA, 22 bp, Homo sapiens
ctctatatttagattgttaaaa

SEQ ID NO: 998818 - DNA, 15 bp, Homo sapiens
ctctatcagcattgt

SEQ ID NO: 998819 - DNA, 19 bp, Homo sapiens
ctctatcagcattgtttca

SEQ ID NO: 998820 - DNA, 23 bp, Homo sapiens
ctctatcatctgctaagtaattt

SEQ ID NO: 998821 - DNA, 16 bp, Homo sapiens
ctctatcctctctctc

SEQ ID NO: 998822 - DNA, 12 bp, Homo sapiens
ctctatgccctg

SEQ ID NO: 998823 - DNA, 18 bp, Homo sapiens
ctctatgccctgcagagc

SEQ ID NO: 998824 - DNA, 19 bp, Homo sapiens
ctctatgccctgcagagca

SEQ ID NO: 998825 - DNA, 22 bp, Homo sapiens
ctctatgccctgcagagcaata

SEQ ID NO: 998826 - DNA, 15 bp, Homo sapiens
ctctatgcctgcact

SEQ ID NO: 998827 - DNA, 14 bp, Homo sapiens
ctctatgctggctt

SEQ ID NO: 998828 - DNA, 12 bp, Homo sapiens
ctctatgtacta

SEQ ID NO: 998829 - DNA, 18 bp, Homo sapiens
ctctattaagatttccaa

SEQ ID NO: 998830 - DNA, 20 bp, Homo sapiens
ctctattaagatttccaagt

SEQ ID NO: 998831 - DNA, 23 bp, Homo sapiens
ctctattgatgtacagtctgtca

SEQ ID NO: 998832 - DNA, 19 bp, Homo sapiens
ctctattgggcacagccta

SEQ ID NO: 998833 - DNA, 17 bp, Homo sapiens
ctctatttaatatttat

SEQ ID NO: 998834 - DNA, 13 bp, Homo sapiens
ctctatttagcat

SEQ ID NO: 998835 - DNA, 14 bp, Homo sapiens
ctctatttagcatg

SEQ ID NO: 998836 - DNA, 20 bp, Homo sapiens
ctctattttcataatcagta

SEQ ID NO: 998837 - DNA, 19 bp, Homo sapiens
ctctcaaaagtctattttt

SEQ ID NO: 998838 - DNA, 14 bp, Homo sapiens
ctctcaaagtataa

SEQ ID NO: 998839 - DNA, 18 bp, Homo sapiens
ctctcaaatccctctcca

SEQ ID NO: 998840 - DNA, 17 bp, Homo sapiens
ctctcaagaccagagac

SEQ ID NO: 998841 - DNA, 22 bp, Homo sapiens
ctctcaagctaagtaaaaatat

SEQ ID NO: 998842 - DNA, 20 bp, Homo sapiens
ctctcaagctagccagaggg

SEQ ID NO: 998843 - DNA, 21 bp, Homo sapiens
ctctcaagctagtgtttctag

SEQ ID NO: 998844 - DNA, 22 bp, Homo sapiens
ctctcaatttttggttgaataa

SEQ ID NO: 998845 - DNA, 13 bp, Homo sapiens
ctctcacactgaa

SEQ ID NO: 998846 - DNA, 13 bp, Homo sapiens
ctctcacccacca

SEQ ID NO: 998847 - DNA, 13 bp, Homo sapiens
ctctcaccccact

SEQ ID NO: 998848 - DNA, 14 bp, Homo sapiens
ctctcacccccatc

SEQ ID NO: 998849 - DNA, 16 bp, Homo sapiens
ctctcacccccatccc

SEQ ID NO: 998850 - DNA, 19 bp, Homo sapiens
ctctcacccgggactctcc

SEQ ID NO: 998851 - DNA, 13 bp, Homo sapiens
ctctcacctcagc

SEQ ID NO: 998852 - DNA, 15 bp, Homo sapiens
ctctcacgccacccc

SEQ ID NO: 998853 - DNA, 19 bp, Homo sapiens
ctctcactaggctaaactc

SEQ ID NO: 998854 - DNA, 13 bp, Homo sapiens
ctctcactccacc

SEQ ID NO: 998855 - DNA, 15 bp, Homo sapiens
ctctcactccagcca

SEQ ID NO: 998856 - DNA, 16 bp, Homo sapiens
ctctcactccagccaa

SEQ ID NO: 998857 - DNA, 12 bp, Homo sapiens
ctctcactcccc

SEQ ID NO: 998858 - DNA, 13 bp, Homo sapiens
ctctcactcccca

SEQ ID NO: 998859 - DNA, 21 bp, Homo sapiens
ctctcactccccagcctgggc

SEQ ID NO: 998860 - DNA, 19 bp, Homo sapiens
ctctcactccccatgccac

SEQ ID NO: 998861 - DNA, 15 bp, Homo sapiens
ctctcactccctccc

SEQ ID NO: 998862 - DNA, 20 bp, Homo sapiens
ctcccctcacatcctcctgc

SEQ ID NO: 998863 - DNA, 13 bp, Homo sapiens
ctcccctcagagt

SEQ ID NO: 998864 - DNA, 14 bp, Homo sapiens
ctcccctcagcctg

SEQ ID NO: 998865 - DNA, 16 bp, Homo sapiens
ctcccctcagcctgcc

SEQ ID NO: 998866 - DNA, 20 bp, Homo sapiens
ctcccctcagcctgcccacc

SEQ ID NO: 998867 - DNA, 15 bp, Homo sapiens
ctcccctcagcgcag

SEQ ID NO: 998868 - DNA, 22 bp, Homo sapiens
ctcccctcagcgcaggctgcag

SEQ ID NO: 998869 - DNA, 12 bp, Homo sapiens
ctcccctccatc

SEQ ID NO: 998870 - DNA, 22 bp, Homo sapiens
ctcccctcccaggggagccagc

SEQ ID NO: 998871 - DNA, 23 bp, Homo sapiens
ctcccctcccaggggagccagct

SEQ ID NO: 998872 - DNA, 14 bp, Homo sapiens
ctcccctccctctt

SEQ ID NO: 998873 - DNA, 13 bp, Homo sapiens
ctcccctcccttg

SEQ ID NO: 998874 - DNA, 16 bp, Homo sapiens
ctcccctcctcttccc

SEQ ID NO: 998875 - DNA, 17 bp, Homo sapiens
ctcccctcctcttccct

SEQ ID NO: 998876 - DNA, 12 bp, Homo sapiens
ctcccctcctgc

SEQ ID NO: 998877 - DNA, 13 bp, Homo sapiens
ctcccctcctgca

SEQ ID NO: 998878 - DNA, 17 bp, Homo sapiens
ctcccctcctgcacaca

SEQ ID NO: 998879 - DNA, 19 bp, Homo sapiens
ctcccctcctgcacacagg

SEQ ID NO: 998880 - DNA, 16 bp, Homo sapiens
ctcccctcctgctggg

SEQ ID NO: 998881 - DNA, 20 bp, Homo sapiens
ctcccctccttgcctcctgt

SEQ ID NO: 998882 - DNA, 22 bp, Homo sapiens
ctcccctctcagaacatactga

SEQ ID NO: 998883 - DNA, 19 bp, Homo sapiens
ctcccctctcatccccctg

SEQ ID NO: 998884 - DNA, 22 bp, Homo sapiens
ctcccctctcatccccctgtgg

SEQ ID NO: 998885 - DNA, 13 bp, Homo sapiens
ctcccctctccca

SEQ ID NO: 998886 - DNA, 17 bp, Homo sapiens
ctcccctctcccaggga

SEQ ID NO: 998887 - DNA, 18 bp, Homo sapiens
ctcccctctcccagggat

SEQ ID NO: 998888 - DNA, 16 bp, Homo sapiens
ctcccctctcctccgc

SEQ ID NO: 998889 - DNA, 19 bp, Homo sapiens
ctcccctctcgccccatcc

SEQ ID NO: 998890 - DNA, 22 bp, Homo sapiens
ctcccctctcgccccatccctg

SEQ ID NO: 998891 - DNA, 12 bp, Homo sapiens
ctcccctctctt

SEQ ID NO: 998892 - DNA, 14 bp, Homo sapiens
ctcccctctgcttc

SEQ ID NO: 998893 - DNA, 12 bp, Homo sapiens
ctcccctctgga

SEQ ID NO: 998894 - DNA, 14 bp, Homo sapiens
ctcccctcttcctc

SEQ ID NO: 998895 - DNA, 17 bp, Homo sapiens
ctcccctgaatcctcag

SEQ ID NO: 998896 - DNA, 16 bp, Homo sapiens
ctcccctgacctgtga

SEQ ID NO: 998897 - DNA, 17 bp, Homo sapiens
ctcccctgacctgtgag

SEQ ID NO: 998898 - DNA, 23 bp, Homo sapiens
ctcccctgagaccacccccaaac

SEQ ID NO: 998899 - DNA, 13 bp, Homo sapiens
ctcccctgccaca

SEQ ID NO: 998900 - DNA, 15 bp, Homo sapiens
ctcccctgccagggc

SEQ ID NO: 998901 - DNA, 21 bp, Homo sapiens
ctcccctgccagggcagggcc

SEQ ID NO: 998902 - DNA, 14 bp, Homo sapiens
ctcccctgccattt

SEQ ID NO: 998903 - DNA, 14 bp, Homo sapiens
ctcccctgccctgc

SEQ ID NO: 998904 - DNA, 15 bp, Homo sapiens
ctcccctgcccttcc

SEQ ID NO: 998905 - DNA, 14 bp, Homo sapiens
ctcccctgccttgc

SEQ ID NO: 998906 - DNA, 15 bp, Homo sapiens
ctcccctgccttgct

SEQ ID NO: 998907 - DNA, 16 bp, Homo sapiens
ctcccctgctgaaggt

SEQ ID NO: 998908 - DNA, 17 bp, Homo sapiens
ctcccctgttcccctct

SEQ ID NO: 998909 - DNA, 11 bp, Homo sapiens
ctccccttccc

SEQ ID NO: 998910 - DNA, 13 bp, Homo sapiens
ctccccttccctg

SEQ ID NO: 998911 - DNA, 17 bp, Homo sapiens
ctccccttccctgggga

SEQ ID NO: 998912 - DNA, 11 bp, Homo sapiens
ctccccttcct

SEQ ID NO: 998913 - DNA, 16 bp, Homo sapiens
ctccccttcctggaca

SEQ ID NO: 998914 - DNA, 15 bp, Homo sapiens
ctccccttgcagcct

SEQ ID NO: 998915 - DNA, 12 bp, Homo sapiens
ctccctgagctt

SEQ ID NO: 998916 - DNA, 22 bp, Homo sapiens
ctccctgagtctggacctccat

SEQ ID NO: 998917 - DNA, 20 bp, Homo sapiens
ctccctgatcccaccccctc

SEQ ID NO: 998918 - DNA, 20 bp, Homo sapiens
ctccctgatggaccctcagt

SEQ ID NO: 998919 - DNA, 22 bp, Homo sapiens
ctccctgcaccgccgcagaagc

SEQ ID NO: 998920 - DNA, 17 bp, Homo sapiens
ctccctgcaccgtctca

SEQ ID NO: 998921 - DNA, 14 bp, Homo sapiens
ctccctgcacggcc

SEQ ID NO: 998922 - DNA, 16 bp, Homo sapiens
ctccctgcagatgcca

SEQ ID NO: 998923 - DNA, 23 bp, Homo sapiens
ctccctgcagatgccaccctagc

SEQ ID NO: 998924 - DNA, 15 bp, Homo sapiens
ctccctgcatcctga

SEQ ID NO: 998925 - DNA, 19 bp, Homo sapiens
ctccctgcatcctgaggcc

SEQ ID NO: 998926 - DNA, 22 bp, Homo sapiens
ctccctgcatctgaccagcagc

SEQ ID NO: 998927 - DNA, 18 bp, Homo sapiens
ctccctgccatccccctc

SEQ ID NO: 998928 - DNA, 10 bp, Homo sapiens
ctccctgccc

SEQ ID NO: 998929 - DNA, 20 bp, Homo sapiens
ctccctgcccaaactcccct

SEQ ID NO: 998930 - DNA, 12 bp, Homo sapiens
ctccctgcccat

SEQ ID NO: 998931 - DNA, 14 bp, Homo sapiens
ctccctgcccctcc

SEQ ID NO: 998932 - DNA, 20 bp, Homo sapiens
ctccctgcccctcccttcaa

SEQ ID NO: 998933 - DNA, 18 bp, Homo sapiens
ctccctgccccttaaccc

SEQ ID NO: 998934 - DNA, 23 bp, Homo sapiens
ctccctgcctacacacacagcct

SEQ ID NO: 998935 - DNA, 16 bp, Homo sapiens
ctccctgcctccagga

SEQ ID NO: 998936 - DNA, 15 bp, Homo sapiens
ctccctgcctgctcc

SEQ ID NO: 998937 - DNA, 19 bp, Homo sapiens
ctccctgcctgctccttgg

SEQ ID NO: 998938 - DNA, 15 bp, Homo sapiens
ctccctgcctggccc

SEQ ID NO: 998939 - DNA, 14 bp, Homo sapiens
ctccctgctcagtg

SEQ ID NO: 998940 - DNA, 18 bp, Homo sapiens
ctccctgctcagtgcttg

SEQ ID NO: 998941 - DNA, 18 bp, Homo sapiens
ctccctgctcctcatggg

SEQ ID NO: 998942 - DNA, 13 bp, Homo sapiens
ctccctgctgtgc

SEQ ID NO: 998943 - DNA, 15 bp, Homo sapiens
ctccctgctgtgcca

SEQ ID NO: 998944 - DNA, 23 bp, Homo sapiens
ctccctgctgtgccatgctgggc

SEQ ID NO: 998945 - DNA, 16 bp, Homo sapiens
ctccctggagaagcac

SEQ ID NO: 998946 - DNA, 16 bp, Homo sapiens
ctccctggagccctgt

SEQ ID NO: 998947 - DNA, 21 bp, Homo sapiens
ctccctggatctacctggagg

SEQ ID NO: 998948 - DNA, 19 bp, Homo sapiens
ctccctggatgtgtggggc

SEQ ID NO: 998949 - DNA, 16 bp, Homo sapiens
ctccctggcagacaca

SEQ ID NO: 998950 - DNA, 21 bp, Homo sapiens
ctccctggcagcacaggaaaa

SEQ ID NO: 998951 - DNA, 13 bp, Homo sapiens
ctccctggcctgt

SEQ ID NO: 998952 - DNA, 16 bp, Homo sapiens
ctccctggcctgttct

SEQ ID NO: 998953 - DNA, 18 bp, Homo sapiens
ctccctggccttgcccgt

SEQ ID NO: 998954 - DNA, 14 bp, Homo sapiens
ctccctggctccct

SEQ ID NO: 998955 - DNA, 15 bp, Homo sapiens
ctccctggctccctc

SEQ ID NO: 998956 - DNA, 20 bp, Homo sapiens
ctccctggctctcagaaggt

SEQ ID NO: 998957 - DNA, 13 bp, Homo sapiens
ctccctggctgcc

SEQ ID NO: 998958 - DNA, 23 bp, Homo sapiens
ctccctgggaagcctgtgccagc

SEQ ID NO: 998959 - DNA, 14 bp, Homo sapiens
ctccctgggccacc

SEQ ID NO: 998960 - DNA, 22 bp, Homo sapiens
ctccctgggccacctcctaccc

SEQ ID NO: 998961 - DNA, 20 bp, Homo sapiens
ctccctggggttctctacag

SEQ ID NO: 998962 - DNA, 14 bp, Homo sapiens
ctccctgggttcag

SEQ ID NO: 998963 - DNA, 16 bp, Homo sapiens
ctccctggtgcctctg

SEQ ID NO: 998964 - DNA, 20 bp, Homo sapiens
ctccctggtgcctctgtgca

SEQ ID NO: 998965 - DNA, 13 bp, Homo sapiens
ctccctggttgcc

SEQ ID NO: 998966 - DNA, 18 bp, Homo sapiens
ctccctggttgcctctct

SEQ ID NO: 998967 - DNA, 18 bp, Homo sapiens
ctccctgtacagtgttac

SEQ ID NO: 998968 - DNA, 17 bp, Homo sapiens
ctccctgtataagacac

SEQ ID NO: 998969 - DNA, 15 bp, Homo sapiens
ctccctgtcacacac

SEQ ID NO: 998970 - DNA, 19 bp, Homo sapiens
ctccctgtcacacactgga

SEQ ID NO: 998971 - DNA, 19 bp, Homo sapiens
ctccctgtcccttcctttc

SEQ ID NO: 998972 - DNA, 21 bp, Homo sapiens
ctccctgtcccttcctttctc

SEQ ID NO: 998973 - DNA, 14 bp, Homo sapiens
ctccctgtcctcct

SEQ ID NO: 998974 - DNA, 16 bp, Homo sapiens
ctccctgtcctcctcg

SEQ ID NO: 998975 - DNA, 15 bp, Homo sapiens
ctccctgtctccagc

SEQ ID NO: 998976 - DNA, 17 bp, Homo sapiens
ctccctgtctccagctg

SEQ ID NO: 998977 - DNA, 23 bp, Homo sapiens
ctccctgtctccagctgcctggg

SEQ ID NO: 998978 - DNA, 22 bp, Homo sapiens
ctccctgtctccagggccccca

SEQ ID NO: 998979 - DNA, 21 bp, Homo sapiens
ctccctgtgcccccagcctca

SEQ ID NO: 998980 - DNA, 23 bp, Homo sapiens
ctccctgtgcccccagcctcagc

SEQ ID NO: 998981 - DNA, 18 bp, Homo sapiens
ctccctgtggggcaggag

SEQ ID NO: 998982 - DNA, 20 bp, Homo sapiens
ctccctgttatctgctagat

SEQ ID NO: 998983 - DNA, 19 bp, Homo sapiens
ctcccttaggcattattta

SEQ ID NO: 998984 - DNA, 22 bp, Homo sapiens
ctcccttaggcattatttaatg

SEQ ID NO: 998985 - DNA, 19 bp, Homo sapiens
ctcccttcaaccattcccc

SEQ ID NO: 998986 - DNA, 19 bp, Homo sapiens
ctcccttcaatgctagaaa

SEQ ID NO: 998987 - DNA, 14 bp, Homo sapiens
ctcccttcacaggg

SEQ ID NO: 998988 - DNA, 14 bp, Homo sapiens
ctcccttccaggaa

SEQ ID NO: 998989 - DNA, 15 bp, Homo sapiens
ctcccttcccagtgg

SEQ ID NO: 998990 - DNA, 19 bp, Homo sapiens
ctccaagcatttcatgaaa

SEQ ID NO: 998991 - DNA, 15 bp, Homo sapiens
ctccaagccccatct

SEQ ID NO: 998992 - DNA, 17 bp, Homo sapiens
ctccaagccccatcttc

SEQ ID NO: 998993 - DNA, 14 bp, Homo sapiens
ctccaagcctgcct

SEQ ID NO: 998994 - DNA, 12 bp, Homo sapiens
ctccaagcctgg

SEQ ID NO: 998995 - DNA, 14 bp, Homo sapiens
ctccaagcctggca

SEQ ID NO: 998996 - DNA, 16 bp, Homo sapiens
ctccaagcctggcacc

SEQ ID NO: 998997 - DNA, 20 bp, Homo sapiens
ctccaagcctggcacccacc

SEQ ID NO: 998998 - DNA, 15 bp, Homo sapiens
ctccaaggaccaggt

SEQ ID NO: 998999 - DNA, 22 bp, Homo sapiens
ctccaaggaggggctgtaaaat

SEQ ID NO: 999000 - DNA, 18 bp, Homo sapiens
ctccaagggacaggtggg

SEQ ID NO: 999001 - DNA, 22 bp, Homo sapiens
ctccaagggagggtgcagccct

SEQ ID NO: 999002 - DNA, 20 bp, Homo sapiens
ctccaagggcttctgcaccc

SEQ ID NO: 999003 - DNA, 18 bp, Homo sapiens
ctccaaggtgatgttgta

SEQ ID NO: 999004 - DNA, 18 bp, Homo sapiens
ctccaagtctctctgtga

SEQ ID NO: 999005 - DNA, 16 bp, Homo sapiens
ctccaagtgccagagg

SEQ ID NO: 999006 - DNA, 19 bp, Homo sapiens
ctccaagtgccagaggtgg

SEQ ID NO: 999007 - DNA, 20 bp, Homo sapiens
ctccaataaagtgccttctg

SEQ ID NO: 999008 - DNA, 19 bp, Homo sapiens
ctccaatatcagtgctcga

SEQ ID NO: 999009 - DNA, 21 bp, Homo sapiens
ctccaatcagtgtttggtgta

SEQ ID NO: 999010 - DNA, 14 bp, Homo sapiens
ctccaatcctttcc

SEQ ID NO: 999011 - DNA, 15 bp, Homo sapiens
ctccaatcctttcca

SEQ ID NO: 999012 - DNA, 13 bp, Homo sapiens
ctccaatgctctg

SEQ ID NO: 999013 - DNA, 15 bp, Homo sapiens
ctccaatgctctgga

SEQ ID NO: 999014 - DNA, 16 bp, Homo sapiens
ctccaatgctctggag

SEQ ID NO: 999015 - DNA, 11 bp, Homo sapiens
ctccaatgtcg

SEQ ID NO: 999016 - DNA, 18 bp, Homo sapiens
ctccaattcccccttaaa

SEQ ID NO: 999017 - DNA, 18 bp, Homo sapiens
ctccaattggtgcttcag

SEQ ID NO: 999018 - DNA, 20 bp, Homo sapiens
ctccaattggtgcttcagcc

SEQ ID NO: 999019 - DNA, 14 bp, Homo sapiens
ctccaatttcccca

SEQ ID NO: 999020 - DNA, 17 bp, Homo sapiens
ctccacaacagcctggg

SEQ ID NO: 999021 - DNA, 16 bp, Homo sapiens
ctccacaacccaagca

SEQ ID NO: 999022 - DNA, 13 bp, Homo sapiens
ctccacaaggtcc

SEQ ID NO: 999023 - DNA, 19 bp, Homo sapiens
ctccacacattccagccag

SEQ ID NO: 999024 - DNA, 22 bp, Homo sapiens
ctccacacattccagccaggcc

SEQ ID NO: 999025 - DNA, 17 bp, Homo sapiens
ctccacagagtgagcca

SEQ ID NO: 999026 - DNA, 18 bp, Homo sapiens
ctccacagataccagacc

SEQ ID NO: 999027 - DNA, 19 bp, Homo sapiens
ctccacagcaaccccaggc

SEQ ID NO: 999028 - DNA, 21 bp, Homo sapiens
ctccacagcgagggcagctgc

SEQ ID NO: 999029 - DNA, 23 bp, Homo sapiens
ctccacagtcccccacccacctc

SEQ ID NO: 999030 - DNA, 13 bp, Homo sapiens
ctccacagtgctg

SEQ ID NO: 999031 - DNA, 15 bp, Homo sapiens
ctccacagtgctgct

SEQ ID NO: 999032 - DNA, 16 bp, Homo sapiens
ctccacagtgctgctt

SEQ ID NO: 999033 - DNA, 17 bp, Homo sapiens
ctccacatcccagcagc

SEQ ID NO: 999034 - DNA, 14 bp, Homo sapiens
ctccacatcctcca

SEQ ID NO: 999035 - DNA, 14 bp, Homo sapiens
ctccacatcctttc

SEQ ID NO: 999036 - DNA, 16 bp, Homo sapiens
ctccacatctgcctta

SEQ ID NO: 999037 - DNA, 17 bp, Homo sapiens
ctccaccaaccccgcgg

SEQ ID NO: 999038 - DNA, 21 bp, Homo sapiens
ctccaccaaccccgcggccca

SEQ ID NO: 999039 - DNA, 17 bp, Homo sapiens
ctccaccacatctgcca

SEQ ID NO: 999040 - DNA, 23 bp, Homo sapiens
ctccaccacatctgccagacctt

SEQ ID NO: 999041 - DNA, 19 bp, Homo sapiens
ctccaccaccactggccac

SEQ ID NO: 999042 - DNA, 23 bp, Homo sapiens
ctccaccaccactggccaccagg

SEQ ID NO: 999043 - DNA, 12 bp, Homo sapiens
ctccaccaccca

SEQ ID NO: 999044 - DNA, 13 bp, Homo sapiens
ctccaccacccaa

SEQ ID NO: 999045 - DNA, 10 bp, Homo sapiens
ctccaccagc

SEQ ID NO: 999046 - DNA, 13 bp, Homo sapiens
ctccaccagcagc

SEQ ID NO: 999047 - DNA, 15 bp, Homo sapiens
ctccaccagcagcat

SEQ ID NO: 999048 - DNA, 11 bp, Homo sapiens
ctccaccagcc

SEQ ID NO: 999049 - DNA, 16 bp, Homo sapiens
ctccaccagccctact

SEQ ID NO: 999050 - DNA, 14 bp, Homo sapiens
ctccaccagcctgc

SEQ ID NO: 999051 - DNA, 15 bp, Homo sapiens
ctccaccagcctgct

SEQ ID NO: 999052 - DNA, 16 bp, Homo sapiens
ctccaccagcctgctg

SEQ ID NO: 999053 - DNA, 19 bp, Homo sapiens
ctccaccagcctgctgaca

SEQ ID NO: 999054 - DNA, 22 bp, Homo sapiens
ctccaccagcctgctgacagac

SEQ ID NO: 999055 - DNA, 15 bp, Homo sapiens
ctccaccatccccac

SEQ ID NO: 999056 - DNA, 20 bp, Homo sapiens
ctccacccaaaccccttccc

SEQ ID NO: 999057 - DNA, 15 bp, Homo sapiens
ctccacccagagtag

SEQ ID NO: 999058 - DNA, 21 bp, Homo sapiens
ctccacccagagtagagccag

SEQ ID NO: 999059 - DNA, 15 bp, Homo sapiens
ctccacccatccagt

SEQ ID NO: 999060 - DNA, 18 bp, Homo sapiens
ctccaccccacagaacct

SEQ ID NO: 999061 - DNA, 20 bp, Homo sapiens
ctccacccccatgtggcagc

SEQ ID NO: 999062 - DNA, 21 bp, Homo sapiens
ctccacccccatgtggcagcc

SEQ ID NO: 999063 - DNA, 23 bp, Homo sapiens
ctccacccccatgtggcagccca

SEQ ID NO: 999064 - DNA, 22 bp, Homo sapiens
ctccaccccccactcagtgcct

SEQ ID NO: 999065 - DNA, 18 bp, Homo sapiens
ctccacccccgccacggc

SEQ ID NO: 999066 - DNA, 17 bp, Homo sapiens
ctccacccgtcctccct

SEQ ID NO: 999067 - DNA, 15 bp, Homo sapiens
ctccaccctccacct

SEQ ID NO: 999068 - DNA, 20 bp, Homo sapiens
ctccaccctgcattttcctc

SEQ ID NO: 999069 - DNA, 14 bp, Homo sapiens
ctccaccctggccg

SEQ ID NO: 999070 - DNA, 13 bp, Homo sapiens
ctccaccctgtcc

SEQ ID NO: 999071 - DNA, 15 bp, Homo sapiens
ctccaccctgtcccc

SEQ ID NO: 999072 - DNA, 17 bp, Homo sapiens
ctccaccctgtccccca

SEQ ID NO: 999073 - DNA, 22 bp, Homo sapiens
ctccaccctgtcccccagctct

SEQ ID NO: 999074 - DNA, 15 bp, Homo sapiens
ctccacccttggcct

SEQ ID NO: 999075 - DNA, 20 bp, Homo sapiens
cacttctgcgggctccctcc

SEQ ID NO: 999076 - DNA, 13 bp, Homo sapiens
cacttctggcatg

SEQ ID NO: 999077 - DNA, 22 bp, Homo sapiens
cacttctggccacatcagcccc

SEQ ID NO: 999078 - DNA, 16 bp, Homo sapiens
cacttctggcctccag

SEQ ID NO: 999079 - DNA, 12 bp, Homo sapiens
cacttctggctt

SEQ ID NO: 999080 - DNA, 12 bp, Homo sapiens
cacttctgggaa

SEQ ID NO: 999081 - DNA, 20 bp, Homo sapiens
cacttctgggcttcatctgg

SEQ ID NO: 999082 - DNA, 17 bp, Homo sapiens
cacttctggtcccctgt

SEQ ID NO: 999083 - DNA, 22 bp, Homo sapiens
cacttctggtcccctgtggtga

SEQ ID NO: 999084 - DNA, 21 bp, Homo sapiens
cacttctgtgagacccccaca

SEQ ID NO: 999085 - DNA, 13 bp, Homo sapiens
cacttctgtgcca

SEQ ID NO: 999086 - DNA, 13 bp, Homo sapiens
cacttctgtgggc

SEQ ID NO: 999087 - DNA, 21 bp, Homo sapiens
cacttcttaaaggcctggaac

SEQ ID NO: 999088 - DNA, 19 bp, Homo sapiens
cacttcttcacctcttcca

SEQ ID NO: 999089 - DNA, 21 bp, Homo sapiens
cacttcttccactgtgtgttg

SEQ ID NO: 999090 - DNA, 23 bp, Homo sapiens
cacttcttcttggtcttatttat

SEQ ID NO: 999091 - DNA, 20 bp, Homo sapiens
cacttcttggttcctgggat

SEQ ID NO: 999092 - DNA, 17 bp, Homo sapiens
cacttctttgcagagcc

SEQ ID NO: 999093 - DNA, 19 bp, Homo sapiens
cacttgaaagattttattg

SEQ ID NO: 999094 - DNA, 15 bp, Homo sapiens
cacttgaatttattg

SEQ ID NO: 999095 - DNA, 18 bp, Homo sapiens
cacttgaatttattgata

SEQ ID NO: 999096 - DNA, 13 bp, Homo sapiens
cacttgacattcc

SEQ ID NO: 999097 - DNA, 14 bp, Homo sapiens
cacttgacattcct

SEQ ID NO: 999098 - DNA, 15 bp, Homo sapiens
cacttgacattcctt

SEQ ID NO: 999099 - DNA, 21 bp, Homo sapiens
cacttgagaaccagtctcctc

SEQ ID NO: 999100 - DNA, 23 bp, Homo sapiens
cacttgagaaccagtctcctcac

SEQ ID NO: 999101 - DNA, 15 bp, Homo sapiens
cacttgagttggctg

SEQ ID NO: 999102 - DNA, 17 bp, Homo sapiens
cacttgagttggctgtg

SEQ ID NO: 999103 - DNA, 17 bp, Homo sapiens
cacttgattcaggaggt

SEQ ID NO: 999104 - DNA, 18 bp, Homo sapiens
cacttgattcatctctgg

SEQ ID NO: 999105 - DNA, 14 bp, Homo sapiens
cacttgcagaggag

SEQ ID NO: 999106 - DNA, 19 bp, Homo sapiens
cacttgcagaggagcccag

SEQ ID NO: 999107 - DNA, 20 bp, Homo sapiens
cacttgcagaggagcccagt

SEQ ID NO: 999108 - DNA, 21 bp, Homo sapiens
cacttgcagaggagcccagtg

SEQ ID NO: 999109 - DNA, 17 bp, Homo sapiens
cacttgcaggggtccct

SEQ ID NO: 999110 - DNA, 14 bp, Homo sapiens
cacttgccacatgg

SEQ ID NO: 999111 - DNA, 19 bp, Homo sapiens
cacttgccattgccaggag

SEQ ID NO: 999112 - DNA, 13 bp, Homo sapiens
cacttgcctcttc

SEQ ID NO: 999113 - DNA, 14 bp, Homo sapiens
cacttgcctggggc

SEQ ID NO: 999114 - DNA, 17 bp, Homo sapiens
cacttgcgtcctgcaga

SEQ ID NO: 999115 - DNA, 18 bp, Homo sapiens
cacttgcgtcctgcagag

SEQ ID NO: 999116 - DNA, 22 bp, Homo sapiens
cacttgctcatgccctgccaag

SEQ ID NO: 999117 - DNA, 17 bp, Homo sapiens
cacttgctcccaaccca

SEQ ID NO: 999118 - DNA, 20 bp, Homo sapiens
cacttgctgcactcttgcac

SEQ ID NO: 999119 - DNA, 13 bp, Homo sapiens
cacttgctggggc

SEQ ID NO: 999120 - DNA, 20 bp, Homo sapiens
cacttgctggggctcacggg

SEQ ID NO: 999121 - DNA, 17 bp, Homo sapiens
cacttggactcttgctc

SEQ ID NO: 999122 - DNA, 18 bp, Homo sapiens
cacttggactcttgctct

SEQ ID NO: 999123 - DNA, 12 bp, Homo sapiens
cacttggagcca

SEQ ID NO: 999124 - DNA, 14 bp, Homo sapiens
cacttggagcccgt

SEQ ID NO: 999125 - DNA, 13 bp, Homo sapiens
cacttggcccaga

SEQ ID NO: 999126 - DNA, 13 bp, Homo sapiens
cacttgggagctg

SEQ ID NO: 999127 - DNA, 17 bp, Homo sapiens
cacttgggctctctcta

SEQ ID NO: 999128 - DNA, 20 bp, Homo sapiens
cacttgggctctctctagct

SEQ ID NO: 999129 - DNA, 16 bp, Homo sapiens
cacttgtatatacgca

SEQ ID NO: 999130 - DNA, 11 bp, Homo sapiens
cacttgtattt

SEQ ID NO: 999131 - DNA, 14 bp, Homo sapiens
cacttgtatttaat

SEQ ID NO: 999132 - DNA, 15 bp, Homo sapiens
cacttgtatttaatt

SEQ ID NO: 999133 - DNA, 17 bp, Homo sapiens
cacttgtcaaagaaggt

SEQ ID NO: 999134 - DNA, 23 bp, Homo sapiens
cacttgtccagctgagcgccagg

SEQ ID NO: 999135 - DNA, 17 bp, Homo sapiens
cacttgtcgggggccca

SEQ ID NO: 999136 - DNA, 12 bp, Homo sapiens
cacttgtctcct

SEQ ID NO: 999137 - DNA, 15 bp, Homo sapiens
cacttgtcttgctct

SEQ ID NO: 999138 - DNA, 14 bp, Homo sapiens
cacttgtgccagcc

SEQ ID NO: 999139 - DNA, 19 bp, Homo sapiens
cacttgtgctttgctcttg

SEQ ID NO: 999140 - DNA, 13 bp, Homo sapiens
cacttgtgtgtgg

SEQ ID NO: 999141 - DNA, 14 bp, Homo sapiens
cacttgtgtgtggg

SEQ ID NO: 999142 - DNA, 15 bp, Homo sapiens
cacttgtgtgtgggc

SEQ ID NO: 999143 - DNA, 17 bp, Homo sapiens
cacttgtgtgtgggctg

SEQ ID NO: 999144 - DNA, 23 bp, Homo sapiens
cacttgtgtgtgggctgtgagtg

SEQ ID NO: 999145 - DNA, 13 bp, Homo sapiens
ctccatcattcat

SEQ ID NO: 999146 - DNA, 18 bp, Homo sapiens
ctccatccatctgtccgt

SEQ ID NO: 999147 - DNA, 22 bp, Homo sapiens
ctccatcccaacagccatgccc

SEQ ID NO: 999148 - DNA, 15 bp, Homo sapiens
ctccatccccatcgg

SEQ ID NO: 999149 - DNA, 15 bp, Homo sapiens
ctccatcccctccct

SEQ ID NO: 999150 - DNA, 21 bp, Homo sapiens
ctccatcccctccctgcctgc

SEQ ID NO: 999151 - DNA, 13 bp, Homo sapiens
ctccatccctcta

SEQ ID NO: 999152 - DNA, 18 bp, Homo sapiens
ctccatccctgctctggt

SEQ ID NO: 999153 - DNA, 15 bp, Homo sapiens
ctccatccgtgctgc

SEQ ID NO: 999154 - DNA, 14 bp, Homo sapiens
ctccatcctcttga

SEQ ID NO: 999155 - DNA, 14 bp, Homo sapiens
ctccatcgcccagg

SEQ ID NO: 999156 - DNA, 22 bp, Homo sapiens
ctccatcgcgccagcgacctct

SEQ ID NO: 999157 - DNA, 22 bp, Homo sapiens
ctccatcgtctcatcctccttt

SEQ ID NO: 999158 - DNA, 19 bp, Homo sapiens
ctccatcttactctgccct

SEQ ID NO: 999159 - DNA, 23 bp, Homo sapiens
ctccatcttggtagttctgtgcc

SEQ ID NO: 999160 - DNA, 17 bp, Homo sapiens
ctccatgaagagcttgt

SEQ ID NO: 999161 - DNA, 21 bp, Homo sapiens
ctccatgaagagcttgtgtcc

SEQ ID NO: 999162 - DNA, 23 bp, Homo sapiens
ctccatgccccagctctggatga

SEQ ID NO: 999163 - DNA, 20 bp, Homo sapiens
ctccatgcctctggaggcct

SEQ ID NO: 999164 - DNA, 17 bp, Homo sapiens
ctccatgctcctcacct

SEQ ID NO: 999165 - DNA, 15 bp, Homo sapiens
ctccatgctgcaaag

SEQ ID NO: 999166 - DNA, 16 bp, Homo sapiens
ctccatgctgcctcca

SEQ ID NO: 999167 - DNA, 17 bp, Homo sapiens
ctccatgctgcctccag

SEQ ID NO: 999168 - DNA, 20 bp, Homo sapiens
ctccatgcttagtcactgcc

SEQ ID NO: 999169 - DNA, 21 bp, Homo sapiens
ctccatgcttagtcactgcct

SEQ ID NO: 999170 - DNA, 12 bp, Homo sapiens
ctccatggccac

SEQ ID NO: 999171 - DNA, 16 bp, Homo sapiens
ctccatggccaccccg

SEQ ID NO: 999172 - DNA, 21 bp, Homo sapiens
ctccatggccaccccgtgcca

SEQ ID NO: 999173 - DNA, 20 bp, Homo sapiens
ctccatggccctgtcccagg

SEQ ID NO: 999174 - DNA, 16 bp, Homo sapiens
ctccatggcttcctcc

SEQ ID NO: 999175 - DNA, 21 bp, Homo sapiens
ctccatggcttcctcctccct

SEQ ID NO: 999176 - DNA, 24 bp, Homo sapiens
ctccatgggccaccgcccagctca

SEQ ID NO: 999177 - DNA, 18 bp, Homo sapiens
ctccatggtcctgtctgt

SEQ ID NO: 999178 - DNA, 20 bp, Homo sapiens
ctccatgttggtcaggctgg

SEQ ID NO: 999179 - DNA, 14 bp, Homo sapiens
ctccattaaagtct

SEQ ID NO: 999180 - DNA, 16 bp, Homo sapiens
ctccattaaagtctga

SEQ ID NO: 999181 - DNA, 17 bp, Homo sapiens
ctccattctattttaga

SEQ ID NO: 999182 - DNA, 14 bp, Homo sapiens
ctccattgcacatg

SEQ ID NO: 999183 - DNA, 23 bp, Homo sapiens
ctccattgtcatgagtccatgag

SEQ ID NO: 999184 - DNA, 14 bp, Homo sapiens
ctccatttaagaca

SEQ ID NO: 999185 - DNA, 19 bp, Homo sapiens
ctccatttataaccccagc

SEQ ID NO: 999186 - DNA, 23 bp, Homo sapiens
ctccatttcccaaagtcctctgc

SEQ ID NO: 999187 - DNA, 18 bp, Homo sapiens
ctccatttggtcctttct

SEQ ID NO: 999188 - DNA, 19 bp, Homo sapiens
ctccatttggtcctttctc

SEQ ID NO: 999189 - DNA, 20 bp, Homo sapiens
ctccatttggtcctttctcc

SEQ ID NO: 999190 - DNA, 19 bp, Homo sapiens
ctccattttcttctctgtg

SEQ ID NO: 999191 - DNA, 20 bp, Homo sapiens
ctccattttcttctctgtga

SEQ ID NO: 999192 - DNA, 17 bp, Homo sapiens
ctccatttttatttctt

SEQ ID NO: 999193 - DNA, 23 bp, Homo sapiens
ctccattttttcttcccttttcc

SEQ ID NO: 999194 - DNA, 15 bp, Homo sapiens
ctcccaaaacatttt

SEQ ID NO: 999195 - DNA, 22 bp, Homo sapiens
ctcccaaagtgctaggattaca

SEQ ID NO: 999196 - DNA, 15 bp, Homo sapiens
ctcccaaagtgctgg

SEQ ID NO: 999197 - DNA, 21 bp, Homo sapiens
ctcccaacatgggagggatca

SEQ ID NO: 999198 - DNA, 22 bp, Homo sapiens
ctcccaacatgggagggatcag

SEQ ID NO: 999199 - DNA, 21 bp, Homo sapiens
ctcccaaccaaccagcagggt

SEQ ID NO: 999200 - DNA, 22 bp, Homo sapiens
ctcccaacccattcactacagg

SEQ ID NO: 999201 - DNA, 14 bp, Homo sapiens
ctcccaaccctggc

SEQ ID NO: 999202 - DNA, 21 bp, Homo sapiens
ctcccaacctcaatgccctgc

SEQ ID NO: 999203 - DNA, 17 bp, Homo sapiens
ctcccaagcgttcctgg

SEQ ID NO: 999204 - DNA, 19 bp, Homo sapiens
ctcccaagcgttcctggcc

SEQ ID NO: 999205 - DNA, 20 bp, Homo sapiens
ctcccaagctatctaaagtt

SEQ ID NO: 999206 - DNA, 21 bp, Homo sapiens
ctcccaaggttggagcccagg

SEQ ID NO: 999207 - DNA, 16 bp, Homo sapiens
ctcccacacccaccct

SEQ ID NO: 999208 - DNA, 20 bp, Homo sapiens
ctcccacacccacccttttt

SEQ ID NO: 999209 - DNA, 19 bp, Homo sapiens
ctcccacacttgctggggc

SEQ ID NO: 999210 - DNA, 20 bp, Homo sapiens
ctcccacacttgctggggct

SEQ ID NO: 999211 - DNA, 17 bp, Homo sapiens
ctcccacacttgtgcca

SEQ ID NO: 999212 - DNA, 19 bp, Homo sapiens
ctcccacacttgtgccagc

SEQ ID NO: 999213 - DNA, 12 bp, Homo sapiens
ctcccacagacc

SEQ ID NO: 999214 - DNA, 19 bp, Homo sapiens
ctcccacagacctgcagtg

SEQ ID NO: 999215 - DNA, 21 bp, Homo sapiens
ctcccacagagtgctggactg

SEQ ID NO: 999216 - DNA, 16 bp, Homo sapiens
ctcccacagcttcctg

SEQ ID NO: 999217 - DNA, 19 bp, Homo sapiens
ctcccacagcttcctgagg

SEQ ID NO: 999218 - DNA, 15 bp, Homo sapiens
ctcccacaggccctt

SEQ ID NO: 999219 - DNA, 20 bp, Homo sapiens
ctcccacaggcccttcctct

SEQ ID NO: 999220 - DNA, 15 bp, Homo sapiens
ctcccacatcccact

SEQ ID NO: 999221 - DNA, 14 bp, Homo sapiens
ctcccaccacagca

SEQ ID NO: 999222 - DNA, 15 bp, Homo sapiens
ctcccaccaccccat

SEQ ID NO: 999223 - DNA, 14 bp, Homo sapiens
ctcccaccagagcc

SEQ ID NO: 999224 - DNA, 12 bp, Homo sapiens
ctcccaccccac

SEQ ID NO: 999225 - DNA, 22 bp, Homo sapiens
ctcccaccccacccccttcagt

SEQ ID NO: 999226 - DNA, 14 bp, Homo sapiens
ctcccaccccactc

SEQ ID NO: 999227 - DNA, 15 bp, Homo sapiens
ctcccaccccactca

SEQ ID NO: 999228 - DNA, 14 bp, Homo sapiens
ctcccaccccagaa

SEQ ID NO: 999229 - DNA, 16 bp, Homo sapiens
ctcccaccccagaaat

SEQ ID NO: 999230 - DNA, 11 bp, Homo sapiens
ctcccaccccc

SEQ ID NO: 999231 - DNA, 15 bp, Homo sapiens
ctcccacccccagcc

SEQ ID NO: 999232 - DNA, 15 bp, Homo sapiens
ctcccacccccatct

SEQ ID NO: 999233 - DNA, 20 bp, Homo sapiens
ctcccacccccatctctccc

SEQ ID NO: 999234 - DNA, 19 bp, Homo sapiens
ctcccaccccgccgttccc

SEQ ID NO: 999235 - DNA, 20 bp, Homo sapiens
ctcccaccccggcctccact

SEQ ID NO: 999236 - DNA, 11 bp, Homo sapiens
ctcccacccct

SEQ ID NO: 999237 - DNA, 12 bp, Homo sapiens
ctcccacccctt

SEQ ID NO: 999238 - DNA, 21 bp, Homo sapiens
ctcccacccgatgctgctttc

SEQ ID NO: 999239 - DNA, 23 bp, Homo sapiens
ctcccacccggccacagctgctg

SEQ ID NO: 999240 - DNA, 19 bp, Homo sapiens
ctcccacccggctgcagag

SEQ ID NO: 999241 - DNA, 19 bp, Homo sapiens
ctcccaccgcccccacccc

SEQ ID NO: 999242 - DNA, 20 bp, Homo sapiens
ctcccaccgcccccacccct

SEQ ID NO: 999243 - DNA, 22 bp, Homo sapiens
ctcccaccgcccccaccccttc

SEQ ID NO: 999244 - DNA, 23 bp, Homo sapiens
ctcccacctccccctcccccttc

SEQ ID NO: 999245 - DNA, 18 bp, Homo sapiens
ctcccacctcccttccca

SEQ ID NO: 999246 - DNA, 15 bp, Homo sapiens
ctcccacctctcctt

SEQ ID NO: 999247 - DNA, 23 bp, Homo sapiens
ctcccacctctccttttgaggct

SEQ ID NO: 999248 - DNA, 14 bp, Homo sapiens
ctcccacctgacac

SEQ ID NO: 999249 - DNA, 15 bp, Homo sapiens
ctcccacctgacaca

SEQ ID NO: 999250 - DNA, 15 bp, Homo sapiens
ctcccacgtgggaga

SEQ ID NO: 999251 - DNA, 14 bp, Homo sapiens
ctcccactgggact

SEQ ID NO: 999252 - DNA, 15 bp, Homo sapiens
ctcccacttcctcct

SEQ ID NO: 999253 - DNA, 21 bp, Homo sapiens
ctcccagaaaaactggctctg

SEQ ID NO: 999254 - DNA, 21 bp, Homo sapiens
ctcccagaaacatctctggcc

SEQ ID NO: 999255 - DNA, 20 bp, Homo sapiens
ctcccagaatcccagccggc

SEQ ID NO: 999256 - DNA, 15 bp, Homo sapiens
ctcccagacaggccc

SEQ ID NO: 999257 - DNA, 16 bp, Homo sapiens
ctcccagacaggccct

SEQ ID NO: 999258 - DNA, 22 bp, Homo sapiens
ctcccagacaggccctccctgt

SEQ ID NO: 999259 - DNA, 22 bp, Homo sapiens
ctcccagagcttgttgtctcca

SEQ ID NO: 999260 - DNA, 15 bp, Homo sapiens
ctcccagaggagcca

SEQ ID NO: 999261 - DNA, 22 bp, Homo sapiens
ctcccagaggagccaccagttc

SEQ ID NO: 999262 - DNA, 15 bp, Homo sapiens
ctcccagaggtccag

SEQ ID NO: 999263 - DNA, 14 bp, Homo sapiens
ctcccagatgtaaa

SEQ ID NO: 999264 - DNA, 18 bp, Homo sapiens
ctcccagcactgcctcct

SEQ ID NO: 999265 - DNA, 14 bp, Homo sapiens
ctcccagcagagcc

SEQ ID NO: 999266 - DNA, 12 bp, Homo sapiens
cagaaagtgcct

SEQ ID NO: 999267 - DNA, 14 bp, Homo sapiens
cagaaagtgcctga

SEQ ID NO: 999268 - DNA, 15 bp, Homo sapiens
cagaaagtgcctgac

SEQ ID NO: 999269 - DNA, 23 bp, Homo sapiens
cagaaataaaacaactctgatgt

SEQ ID NO: 999270 - DNA, 21 bp, Homo sapiens
cagaaatacagtcttccacaa

SEQ ID NO: 999271 - DNA, 21 bp, Homo sapiens
cagaaatagacaaaaagtata

SEQ ID NO: 999272 - DNA, 15 bp, Homo sapiens
cagaaatatagtgca

SEQ ID NO: 999273 - DNA, 15 bp, Homo sapiens
cagaaatatgtggtt

SEQ ID NO: 999274 - DNA, 19 bp, Homo sapiens
cagaaatattcttattact

SEQ ID NO: 999275 - DNA, 11 bp, Homo sapiens
cagaaatcact

SEQ ID NO: 999276 - DNA, 13 bp, Homo sapiens
cagaaatcactgt

SEQ ID NO: 999277 - DNA, 14 bp, Homo sapiens
cagaaatcactgtg

SEQ ID NO: 999278 - DNA, 17 bp, Homo sapiens
cagaaatcactgtgaaa

SEQ ID NO: 999279 - DNA, 19 bp, Homo sapiens
cagaaatcactgtgaaatt

SEQ ID NO: 999280 - DNA, 22 bp, Homo sapiens
cagaaatcactgtgaaatttca

SEQ ID NO: 999281 - DNA, 14 bp, Homo sapiens
cagaaatcagagga

SEQ ID NO: 999282 - DNA, 20 bp, Homo sapiens
cagaaatgctgcctgcctgt

SEQ ID NO: 999283 - DNA, 17 bp, Homo sapiens
cagaaatgggcagttct

SEQ ID NO: 999284 - DNA, 15 bp, Homo sapiens
cagaaatgtaaatgt

SEQ ID NO: 999285 - DNA, 11 bp, Homo sapiens
cagaaatgtct

SEQ ID NO: 999286 - DNA, 11 bp, Homo sapiens
cagaaatgttt

SEQ ID NO: 999287 - DNA, 17 bp, Homo sapiens
cagaaatgtttttaaca

SEQ ID NO: 999288 - DNA, 18 bp, Homo sapiens
cagaaatgtttttaacac

SEQ ID NO: 999289 - DNA, 14 bp, Homo sapiens
cagaaattaaaata

SEQ ID NO: 999290 - DNA, 21 bp, Homo sapiens
cagaaattaaaatattatttg

SEQ ID NO: 999291 - DNA, 23 bp, Homo sapiens
cagaaattagaaaccttaatatg

SEQ ID NO: 999292 - DNA, 18 bp, Homo sapiens
cagaaattccagtaaatc

SEQ ID NO: 999293 - DNA, 20 bp, Homo sapiens
cagaaattccagtaaatcct

SEQ ID NO: 999294 - DNA, 15 bp, Homo sapiens
cagaaattgtatatt

SEQ ID NO: 999295 - DNA, 22 bp, Homo sapiens
cagaaattgtatattgtaattt

SEQ ID NO: 999296 - DNA, 14 bp, Homo sapiens
cagaacaaaaagaa

SEQ ID NO: 999297 - DNA, 20 bp, Homo sapiens
cagaacaaaccccgaaacag

SEQ ID NO: 999298 - DNA, 19 bp, Homo sapiens
cagaacaaatgtgtttttc

SEQ ID NO: 999299 - DNA, 14 bp, Homo sapiens
cagaacacaaatgt

SEQ ID NO: 999300 - DNA, 20 bp, Homo sapiens
cagaacacaaatgtctagtt

SEQ ID NO: 999301 - DNA, 18 bp, Homo sapiens
cagaacacaaccttgttt

SEQ ID NO: 999302 - DNA, 15 bp, Homo sapiens
cagaacacctggccg

SEQ ID NO: 999303 - DNA, 19 bp, Homo sapiens
cagaacacggctcacgctt

SEQ ID NO: 999304 - DNA, 15 bp, Homo sapiens
cagaacagaggcatt

SEQ ID NO: 999305 - DNA, 12 bp, Homo sapiens
cagaacagaggg

SEQ ID NO: 999306 - DNA, 17 bp, Homo sapiens
cagaacagagggccaga

SEQ ID NO: 999307 - DNA, 13 bp, Homo sapiens
cagaacagccctc

SEQ ID NO: 999308 - DNA, 20 bp, Homo sapiens
cagaacagccctcggcctcc

SEQ ID NO: 999309 - DNA, 23 bp, Homo sapiens
cagaacagccctcggcctccgag

SEQ ID NO: 999310 - DNA, 12 bp, Homo sapiens
cagaacagccgc

SEQ ID NO: 999311 - DNA, 13 bp, Homo sapiens
cagaacagggtca

SEQ ID NO: 999312 - DNA, 14 bp, Homo sapiens
cagaacagggtcat

SEQ ID NO: 999313 - DNA, 13 bp, Homo sapiens
cagaacaggtagt

SEQ ID NO: 999314 - DNA, 17 bp, Homo sapiens
cagaacagtggtggcaa

SEQ ID NO: 999315 - DNA, 22 bp, Homo sapiens
cagaacatactgattgggaggt

SEQ ID NO: 999316 - DNA, 18 bp, Homo sapiens
cagaacatcattagaaca

SEQ ID NO: 999317 - DNA, 18 bp, Homo sapiens
cagaacatcgatatgtat

SEQ ID NO: 999318 - DNA, 20 bp, Homo sapiens
cagaacatcgatatgtatat

SEQ ID NO: 999319 - DNA, 23 bp, Homo sapiens
cagaacattgccttcctcgtgca

SEQ ID NO: 999320 - DNA, 19 bp, Homo sapiens
cagaaccaaaagggaggct

SEQ ID NO: 999321 - DNA, 13 bp, Homo sapiens
cagaaccacagat

SEQ ID NO: 999322 - DNA, 15 bp, Homo sapiens
cagaaccacagatgt

SEQ ID NO: 999323 - DNA, 16 bp, Homo sapiens
cagaacccacagtgag

SEQ ID NO: 999324 - DNA, 20 bp, Homo sapiens
cagaacccagggctctgccc

SEQ ID NO: 999325 - DNA, 21 bp, Homo sapiens
cagaacccagggctctgcccc

SEQ ID NO: 999326 - DNA, 22 bp, Homo sapiens
cagaacccttggagccaatgga

SEQ ID NO: 999327 - DNA, 19 bp, Homo sapiens
cagaacctactgttccttt

SEQ ID NO: 999328 - DNA, 21 bp, Homo sapiens
cagaacctactgttcctttca

SEQ ID NO: 999329 - DNA, 12 bp, Homo sapiens
cagaacctcttc

SEQ ID NO: 999330 - DNA, 13 bp, Homo sapiens
ctcccatctcctg

SEQ ID NO: 999331 - DNA, 21 bp, Homo sapiens
ctcccatctccttacctctgg

SEQ ID NO: 999332 - DNA, 20 bp, Homo sapiens
ctcccatctgggagtcccct

SEQ ID NO: 999333 - DNA, 22 bp, Homo sapiens
ctcccatgactgcccagctctg

SEQ ID NO: 999334 - DNA, 16 bp, Homo sapiens
ctcccatgcctggtcc

SEQ ID NO: 999335 - DNA, 16 bp, Homo sapiens
ctcccatgtcactgca

SEQ ID NO: 999336 - DNA, 17 bp, Homo sapiens
ctcccatgtcactgcag

SEQ ID NO: 999337 - DNA, 20 bp, Homo sapiens
ctcccattcactcttccaga

SEQ ID NO: 999338 - DNA, 19 bp, Homo sapiens
ctcccattgtccctctgcc

SEQ ID NO: 999339 - DNA, 21 bp, Homo sapiens
ctcccatttcaggaatttaaa

SEQ ID NO: 999340 - DNA, 12 bp, Homo sapiens
ctcccatttcct

SEQ ID NO: 999341 - DNA, 13 bp, Homo sapiens
ctcccatttcctg

SEQ ID NO: 999342 - DNA, 15 bp, Homo sapiens
ctcccatttcctgat

SEQ ID NO: 999343 - DNA, 18 bp, Homo sapiens
ctcccatttctgttgctg

SEQ ID NO: 999344 - DNA, 22 bp, Homo sapiens
ctcccattttcagttccctcct

SEQ ID NO: 999345 - DNA, 16 bp, Homo sapiens
ctcccattttggaatt

SEQ ID NO: 999346 - DNA, 11 bp, Homo sapiens
ctccccaaccc

SEQ ID NO: 999347 - DNA, 15 bp, Homo sapiens
ctccccaacccccat

SEQ ID NO: 999348 - DNA, 17 bp, Homo sapiens
ctccccaaccctgcccc

SEQ ID NO: 999349 - DNA, 20 bp, Homo sapiens
ctccccaaccctgcccctgc

SEQ ID NO: 999350 - DNA, 21 bp, Homo sapiens
ctccccaaggatgaccacacc

SEQ ID NO: 999351 - DNA, 17 bp, Homo sapiens
ctccccaatccaggcca

SEQ ID NO: 999352 - DNA, 18 bp, Homo sapiens
ctccccacacacaggcct

SEQ ID NO: 999353 - DNA, 23 bp, Homo sapiens
ctccccacacacaggccttctgt

SEQ ID NO: 999354 - DNA, 17 bp, Homo sapiens
ctccccacactccactc

SEQ ID NO: 999355 - DNA, 18 bp, Homo sapiens
ctccccacactccactct

SEQ ID NO: 999356 - DNA, 21 bp, Homo sapiens
ctccccacactccactctgat

SEQ ID NO: 999357 - DNA, 18 bp, Homo sapiens
ctccccacagcgtccctg

SEQ ID NO: 999358 - DNA, 15 bp, Homo sapiens
ctccccacccaagag

SEQ ID NO: 999359 - DNA, 19 bp, Homo sapiens
ctccccaccctcctcttgg

SEQ ID NO: 999360 - DNA, 12 bp, Homo sapiens
ctccccacctgg

SEQ ID NO: 999361 - DNA, 14 bp, Homo sapiens
ctccccacctggac

SEQ ID NO: 999362 - DNA, 23 bp, Homo sapiens
ctccccacctggacacacactca

SEQ ID NO: 999363 - DNA, 15 bp, Homo sapiens
ctccccacgagggct

SEQ ID NO: 999364 - DNA, 23 bp, Homo sapiens
ctccccacgagtcacctgcaagc

SEQ ID NO: 999365 - DNA, 21 bp, Homo sapiens
ctccccacgatgatatctata

SEQ ID NO: 999366 - DNA, 22 bp, Homo sapiens
ctccccacgggaaactcaagga

SEQ ID NO: 999367 - DNA, 12 bp, Homo sapiens
ctccccactgaa

SEQ ID NO: 999368 - DNA, 10 bp, Homo sapiens
ctccccagaa

SEQ ID NO: 999369 - DNA, 17 bp, Homo sapiens
ctccccagaactggctg

SEQ ID NO: 999370 - DNA, 18 bp, Homo sapiens
ctccccagaactggctgg

SEQ ID NO: 999371 - DNA, 19 bp, Homo sapiens
ctccccagaactggctggg

SEQ ID NO: 999372 - DNA, 22 bp, Homo sapiens
ctccccagaactggctgggccc

SEQ ID NO: 999373 - DNA, 11 bp, Homo sapiens
ctccccagaat

SEQ ID NO: 999374 - DNA, 15 bp, Homo sapiens
ctccccagagctgtg

SEQ ID NO: 999375 - DNA, 13 bp, Homo sapiens
ctccccagatctc

SEQ ID NO: 999376 - DNA, 15 bp, Homo sapiens
ctccccagcaggtgg

SEQ ID NO: 999377 - DNA, 16 bp, Homo sapiens
ctccccagcaggtggg

SEQ ID NO: 999378 - DNA, 19 bp, Homo sapiens
ctccccagcaggtggggag

SEQ ID NO: 999379 - DNA, 21 bp, Homo sapiens
ctccccagcattccagcccct

SEQ ID NO: 999380 - DNA, 23 bp, Homo sapiens
ctccccagcattccagcccctct

SEQ ID NO: 999381 - DNA, 11 bp, Homo sapiens
ctccccagcca

SEQ ID NO: 999382 - DNA, 15 bp, Homo sapiens
ctccccagccagccc

SEQ ID NO: 999383 - DNA, 17 bp, Homo sapiens
ctccccagccagccctt

SEQ ID NO: 999384 - DNA, 18 bp, Homo sapiens
ctccccagccagcccttc

SEQ ID NO: 999385 - DNA, 13 bp, Homo sapiens
ctccccagcccag

SEQ ID NO: 999386 - DNA, 16 bp, Homo sapiens
ctccccagcccagggt

SEQ ID NO: 999387 - DNA, 14 bp, Homo sapiens
ctccccagccccag

SEQ ID NO: 999388 - DNA, 20 bp, Homo sapiens
cctgccccgcccccagtccc

SEQ ID NO: 999389 - DNA, 18 bp, Homo sapiens
cctgccccgccccccaga

SEQ ID NO: 999390 - DNA, 23 bp, Homo sapiens
cctgccccgccccccagagccag

SEQ ID NO: 999391 - DNA, 15 bp, Homo sapiens
cctgccccggaggaa

SEQ ID NO: 999392 - DNA, 22 bp, Homo sapiens
cctgccccgtcaccatctcagg

SEQ ID NO: 999393 - DNA, 14 bp, Homo sapiens
cctgcccctccctt

SEQ ID NO: 999394 - DNA, 14 bp, Homo sapiens
cctgcccctctttc

SEQ ID NO: 999395 - DNA, 23 bp, Homo sapiens
cctgcccctctttctctttcttc

SEQ ID NO: 999396 - DNA, 18 bp, Homo sapiens
cctgcccctgcctgacag

SEQ ID NO: 999397 - DNA, 13 bp, Homo sapiens
cctgcccgccaca

SEQ ID NO: 999398 - DNA, 12 bp, Homo sapiens
cctgcccgctcc

SEQ ID NO: 999399 - DNA, 14 bp, Homo sapiens
cctgcccggggagc

SEQ ID NO: 999400 - DNA, 18 bp, Homo sapiens
cctgccctcaagggtgtg

SEQ ID NO: 999401 - DNA, 14 bp, Homo sapiens
cctgccctcatggg

SEQ ID NO: 999402 - DNA, 24 bp, Homo sapiens
cctgccctcccatgttgcatgcct

SEQ ID NO: 999403 - DNA, 16 bp, Homo sapiens
cctgccctccccagag

SEQ ID NO: 999404 - DNA, 20 bp, Homo sapiens
cctgccctccccagagcact

SEQ ID NO: 999405 - DNA, 15 bp, Homo sapiens
cctgttttctgaaac

SEQ ID NO: 999406 - DNA, 19 bp, Homo sapiens
cctgttttctgaaacacac

SEQ ID NO: 999407 - DNA, 13 bp, Homo sapiens
cctgttttctgag

SEQ ID NO: 999408 - DNA, 15 bp, Homo sapiens
cctgttttctgagcc

SEQ ID NO: 999409 - DNA, 15 bp, Homo sapiens
cctgttttcttaggc

SEQ ID NO: 999410 - DNA, 17 bp, Homo sapiens
cctgttttgttggaagg

SEQ ID NO: 999411 - DNA, 21 bp, Homo sapiens
cctgtttttagagcttccaaa

SEQ ID NO: 999412 - DNA, 16 bp, Homo sapiens
cctgtttttctgggtg

SEQ ID NO: 999413 - DNA, 11 bp, Homo sapiens
ccttaaaatgc

SEQ ID NO: 999414 - DNA, 23 bp, Homo sapiens
ccttaaaatgcattgaaagaatt

SEQ ID NO: 999415 - DNA, 21 bp, Homo sapiens
ccttaaaattaagttgaaaaa

SEQ ID NO: 999416 - DNA, 12 bp, Homo sapiens
ccttaaagaaaa

SEQ ID NO: 999417 - DNA, 18 bp, Homo sapiens
ccttaaagaaaattgcat

SEQ ID NO: 999418 - DNA, 21 bp, Homo sapiens
ccttaaagaaaattgcatgaa

SEQ ID NO: 999419 - DNA, 13 bp, Homo sapiens
ccttaaattaaac

SEQ ID NO: 999420 - DNA, 12 bp, Homo sapiens
ccttaaattatt

SEQ ID NO: 999421 - DNA, 23 bp, Homo sapiens
ccttaacatccctcctgctttta

SEQ ID NO: 999422 - DNA, 14 bp, Homo sapiens
ccttaaccagtctc

SEQ ID NO: 999423 - DNA, 14 bp, Homo sapiens
ccttaaccccaagg

SEQ ID NO: 999424 - DNA, 23 bp, Homo sapiens
ccttaaccctaaaattttaaggc

SEQ ID NO: 999425 - DNA, 15 bp, Homo sapiens
ccttaactaagactc

SEQ ID NO: 999426 - DNA, 19 bp, Homo sapiens
ccttaactaagactcccgc

SEQ ID NO: 999427 - DNA, 21 bp, Homo sapiens
ccttaactctaaccctgtgga

SEQ ID NO: 999428 - DNA, 22 bp, Homo sapiens
ccttaactctaaccctgtggaa

SEQ ID NO: 999429 - DNA, 12 bp, Homo sapiens
ccttaactgaca

SEQ ID NO: 999430 - DNA, 19 bp, Homo sapiens
ccttaagaacacaaagcgg

SEQ ID NO: 999431 - DNA, 14 bp, Homo sapiens
ccttaagacactgt

SEQ ID NO: 999432 - DNA, 13 bp, Homo sapiens
ccttaagcaaatt

SEQ ID NO: 999433 - DNA, 15 bp, Homo sapiens
ccttaagcaaatttt

SEQ ID NO: 999434 - DNA, 15 bp, Homo sapiens
ccttaagcagaacaa

SEQ ID NO: 999435 - DNA, 20 bp, Homo sapiens
ccttaaggacaaaaatgaac

SEQ ID NO: 999436 - DNA, 20 bp, Homo sapiens
ccttaaggcacagtgggagc

SEQ ID NO: 999437 - DNA, 18 bp, Homo sapiens
ccttaaggtctccaaacc

SEQ ID NO: 999438 - DNA, 12 bp, Homo sapiens
ccttaagtcaga

SEQ ID NO: 999439 - DNA, 20 bp, Homo sapiens
caaaatattttttgcaagtt

SEQ ID NO: 999440 - DNA, 21 bp, Homo sapiens
caaaatattttttgcaagtta

SEQ ID NO: 999441 - DNA, 15 bp, Homo sapiens
caaaatcaacatgac

SEQ ID NO: 999442 - DNA, 16 bp, Homo sapiens
caaaatcaacatgact

SEQ ID NO: 999443 - DNA, 13 bp, Homo sapiens
caaaatcaagagt

SEQ ID NO: 999444 - DNA, 20 bp, Homo sapiens
caaaatccaaaacttctctt

SEQ ID NO: 999445 - DNA, 18 bp, Homo sapiens
caaaatccattccaggta

SEQ ID NO: 999446 - DNA, 16 bp, Homo sapiens
caaaatcctcaggaaa

SEQ ID NO: 999447 - DNA, 22 bp, Homo sapiens
caaaatcctgaactttctccct

SEQ ID NO: 999448 - DNA, 16 bp, Homo sapiens
caaaatccttgcttat

SEQ ID NO: 999449 - DNA, 20 bp, Homo sapiens
caaaatccttgcttatgaca

SEQ ID NO: 999450 - DNA, 19 bp, Homo sapiens
caaaatctcccattttgga

SEQ ID NO: 999451 - DNA, 21 bp, Homo sapiens
caaaatctgaactctcaaaag

SEQ ID NO: 999452 - DNA, 17 bp, Homo sapiens
caaaatctgattagaag

SEQ ID NO: 999453 - DNA, 19 bp, Homo sapiens
caaaatctttgtataaata

SEQ ID NO: 999454 - DNA, 11 bp, Homo sapiens
caaaatgactt

SEQ ID NO: 999455 - DNA, 19 bp, Homo sapiens
caaaatgactttgaactga

SEQ ID NO: 999456 - DNA, 18 bp, Homo sapiens
caaaatgctttttatttc

SEQ ID NO: 999457 - DNA, 15 bp, Homo sapiens
caaaatggcttcagt

SEQ ID NO: 999458 - DNA, 22 bp, Homo sapiens
caaaatggtcagtattatctaa

SEQ ID NO: 999459 - DNA, 17 bp, Homo sapiens
caaaatgtaatgtcaga

SEQ ID NO: 999460 - DNA, 18 bp, Homo sapiens
caaaatgtacttaaatga

SEQ ID NO: 999461 - DNA, 23 bp, Homo sapiens
caaaatgtagcttttggggaggg

SEQ ID NO: 999462 - DNA, 23 bp, Homo sapiens
caaaatgtaggcttagtttgtgt

SEQ ID NO: 999463 - DNA, 22 bp, Homo sapiens
caaaatgtctgtagctcctcaa

SEQ ID NO: 999464 - DNA, 17 bp, Homo sapiens
caaaatgtctgttttag

SEQ ID NO: 999465 - DNA, 23 bp, Homo sapiens
caaaatgtctgttttagttggaa

SEQ ID NO: 999466 - DNA, 20 bp, Homo sapiens
caaaatgtcttaatgcaaat

SEQ ID NO: 999467 - DNA, 16 bp, Homo sapiens
caaaatgttgaagaaa

SEQ ID NO: 999468 - DNA, 11 bp, Homo sapiens
caaaatgttgg

SEQ ID NO: 999469 - DNA, 18 bp, Homo sapiens
caaaatgttggtcatttt

SEQ ID NO: 999470 - DNA, 16 bp, Homo sapiens
caaaattaaatctaga

SEQ ID NO: 999471 - DNA, 20 bp, Homo sapiens
caaaattaccaaaaatcttg

SEQ ID NO: 999472 - DNA, 21 bp, Homo sapiens
caaaattagatcctaagatgt

SEQ ID NO: 999473 - DNA, 21 bp, Homo sapiens
caaaattagtacctcaaagta

SEQ ID NO: 999474 - DNA, 17 bp, Homo sapiens
caaaattataaagcctt

SEQ ID NO: 999475 - DNA, 20 bp, Homo sapiens
caaaattcactaatcttgaa

SEQ ID NO: 999476 - DNA, 12 bp, Homo sapiens
caaaattcctgt

SEQ ID NO: 999477 - DNA, 17 bp, Homo sapiens
caaaattctagctgtat

SEQ ID NO: 999478 - DNA, 16 bp, Homo sapiens
caaaattgcaaatctt

SEQ ID NO: 999479 - DNA, 17 bp, Homo sapiens
caaaattgcaaatcttg

SEQ ID NO: 999480 - DNA, 22 bp, Homo sapiens
caaaattgcaaatcttgaaatt

SEQ ID NO: 999481 - DNA, 21 bp, Homo sapiens
caaaattgcctataatacttg

SEQ ID NO: 999482 - DNA, 20 bp, Homo sapiens
caaaattgtctaaaatgtca

SEQ ID NO: 999483 - DNA, 13 bp, Homo sapiens
caaaattgtttac

SEQ ID NO: 999484 - DNA, 13 bp, Homo sapiens
caaaattgttttc

SEQ ID NO: 999485 - DNA, 19 bp, Homo sapiens
caaaatttattttataaga

SEQ ID NO: 999486 - DNA, 20 bp, Homo sapiens
caaaatttattttataagaa

SEQ ID NO: 999487 - DNA, 23 bp, Homo sapiens
caaaatttattttataagaaaaa

SEQ ID NO: 999488 - DNA, 15 bp, Homo sapiens
caaaatttccagtac

SEQ ID NO: 999489 - DNA, 17 bp, Homo sapiens
caaaatttccagtacct

SEQ ID NO: 999490 - DNA, 18 bp, Homo sapiens
caaaatttccagtacctt

SEQ ID NO: 999491 - DNA, 23 bp, Homo sapiens
caaaatttgactaattttacatg

SEQ ID NO: 999492 - DNA, 13 bp, Homo sapiens
caaaatttgagaa

SEQ ID NO: 999493 - DNA, 23 bp, Homo sapiens
caaaatttgtttgtcactgccaa

SEQ ID NO: 999494 - DNA, 16 bp, Homo sapiens
caaaattttaaaaaag

SEQ ID NO: 999495 - DNA, 16 bp, Homo sapiens
caaaatttttttaatc

SEQ ID NO: 999496 - DNA, 10 bp, Homo sapiens
caaacaaaaa

SEQ ID NO: 999497 - DNA, 16 bp, Homo sapiens
caaacaaaaaggttct

SEQ ID NO: 999498 - DNA, 14 bp, Homo sapiens
caaacaaaacttaa

SEQ ID NO: 999499 - DNA, 16 bp, Homo sapiens
caaacaaaagcagccc

SEQ ID NO: 999500 - DNA, 16 bp, Homo sapiens
caaacaaggaagccaa

SEQ ID NO: 999501 - DNA, 21 bp, Homo sapiens
caaacaaggcctgtcagctaa

SEQ ID NO: 999502 - DNA, 22 bp, Homo sapiens
caaacaagtggatgtttttaat

SEQ ID NO: 999503 - DNA, 20 bp, Homo sapiens
caaacaatcccaatctttct

SEQ ID NO: 999504 - DNA, 21 bp, Homo sapiens
caaacaatcccaatctttcta

SEQ ID NO: 999505 - DNA, 14 bp, Homo sapiens
caaacaatgaagaa

SEQ ID NO: 999506 - DNA, 21 bp, Homo sapiens
caaacaatgaagaattatgta

SEQ ID NO: 999507 - DNA, 17 bp, Homo sapiens
caaacacaaaacattca

SEQ ID NO: 999508 - DNA, 15 bp, Homo sapiens
caaacacatacagga

SEQ ID NO: 999509 - DNA, 19 bp, Homo sapiens
caaacacatttaccctttg

SEQ ID NO: 999510 - DNA, 16 bp, Homo sapiens
caaacaccaacataaa

SEQ ID NO: 999511 - DNA, 18 bp, Homo sapiens
caaacaccaacataaaaa

SEQ ID NO: 999512 - DNA, 18 bp, Homo sapiens
caaacactccaccctcca

SEQ ID NO: 999513 - DNA, 20 bp, Homo sapiens
caaacactgcagtttcctgg

SEQ ID NO: 999514 - DNA, 15 bp, Homo sapiens
caaacacttctgctt

SEQ ID NO: 999515 - DNA, 16 bp, Homo sapiens
caaacacttctgcttt

SEQ ID NO: 999516 - DNA, 15 bp, Homo sapiens
caaacagaaacacaa

SEQ ID NO: 999517 - DNA, 19 bp, Homo sapiens
caaacagcaagagtaagca

SEQ ID NO: 999518 - DNA, 21 bp, Homo sapiens
caaacagcaagagtaagcagt

SEQ ID NO: 999519 - DNA, 18 bp, Homo sapiens
caaacagccaagattttc

SEQ ID NO: 999520 - DNA, 17 bp, Homo sapiens
caaacagctgaaagagg

SEQ ID NO: 999521 - DNA, 13 bp, Homo sapiens
caaacaggacagc

SEQ ID NO: 999522 - DNA, 20 bp, Homo sapiens
caaacaggatcagttaacta

SEQ ID NO: 999523 - DNA, 11 bp, Homo sapiens
caaacataata

SEQ ID NO: 999524 - DNA, 15 bp, Homo sapiens
caaacatattctttt

SEQ ID NO: 999525 - DNA, 17 bp, Homo sapiens
caaacatcaaataaatt

SEQ ID NO: 999526 - DNA, 12 bp, Homo sapiens
caaacatgaaaa

SEQ ID NO: 999527 - DNA, 21 bp, Homo sapiens
ccttatgggatcatttttcca

SEQ ID NO: 999528 - DNA, 17 bp, Homo sapiens
ccttatgtgttacatta

SEQ ID NO: 999529 - DNA, 18 bp, Homo sapiens
ccttatgtgttacattat

SEQ ID NO: 999530 - DNA, 18 bp, Homo sapiens
ccttattaaggccccaga

SEQ ID NO: 999531 - DNA, 16 bp, Homo sapiens
ccttattagagtgtct

SEQ ID NO: 999532 - DNA, 20 bp, Homo sapiens
ccttattgcctcccaggcaa

SEQ ID NO: 999533 - DNA, 15 bp, Homo sapiens
ccttattgctgccaa

SEQ ID NO: 999534 - DNA, 10 bp, Homo sapiens
ccttatttat

SEQ ID NO: 999535 - DNA, 19 bp, Homo sapiens
ccttatttatttttgtgta

SEQ ID NO: 999536 - DNA, 18 bp, Homo sapiens
ccttatttctcattgcct

SEQ ID NO: 999537 - DNA, 15 bp, Homo sapiens
ccttatttctctctc

SEQ ID NO: 999538 - DNA, 16 bp, Homo sapiens
ccttatttctctctcc

SEQ ID NO: 999539 - DNA, 18 bp, Homo sapiens
ccttatttctctctcctg

SEQ ID NO: 999540 - DNA, 20 bp, Homo sapiens
ccttatttctctctcctggt

SEQ ID NO: 999541 - DNA, 15 bp, Homo sapiens
ccttatttgtctgta

SEQ ID NO: 999542 - DNA, 18 bp, Homo sapiens
ccttattttcaagaaact

SEQ ID NO: 999543 - DNA, 15 bp, Homo sapiens
ccttattttgtatta

SEQ ID NO: 999544 - DNA, 13 bp, Homo sapiens
ccttcaactcctg

SEQ ID NO: 999545 - DNA, 18 bp, Homo sapiens
ccttcaagcgctccaggg

SEQ ID NO: 999546 - DNA, 23 bp, Homo sapiens
ccttcaaggactgtttcagtgtg

SEQ ID NO: 999547 - DNA, 16 bp, Homo sapiens
ccttcaattcctgggc

SEQ ID NO: 999548 - DNA, 20 bp, Homo sapiens
ccttcaattcctgggcccca

SEQ ID NO: 999549 - DNA, 19 bp, Homo sapiens
ccttcacaggcagtgcatg

SEQ ID NO: 999550 - DNA, 20 bp, Homo sapiens
ccttcacaggcagtgcatgt

SEQ ID NO: 999551 - DNA, 13 bp, Homo sapiens
ccttcaccaccta

SEQ ID NO: 999552 - DNA, 19 bp, Homo sapiens
ccttcacctcggagggatg

SEQ ID NO: 999553 - DNA, 19 bp, Homo sapiens
ccttcacctttggtgcaga

SEQ ID NO: 999554 - DNA, 14 bp, Homo sapiens
ccttcactccggtg

SEQ ID NO: 999555 - DNA, 23 bp, Homo sapiens
ccttcactccggtgtgcctgcag

SEQ ID NO: 999556 - DNA, 16 bp, Homo sapiens
ccttcactgaacatgc

SEQ ID NO: 999557 - DNA, 18 bp, Homo sapiens
ccttcactgaacatgcct

SEQ ID NO: 999558 - DNA, 17 bp, Homo sapiens
ccttcactgttccctct

SEQ ID NO: 999559 - DNA, 20 bp, Homo sapiens
ccttcactgttccctctggc

SEQ ID NO: 999560 - DNA, 18 bp, Homo sapiens
ccttcagaaccatccata

SEQ ID NO: 999561 - DNA, 18 bp, Homo sapiens
ccttcagaagctattttt

SEQ ID NO: 999562 - DNA, 17 bp, Homo sapiens
ccttcagaccccagttc

SEQ ID NO: 999563 - DNA, 20 bp, Homo sapiens
ccttcagccctggccaagct

SEQ ID NO: 999564 - DNA, 13 bp, Homo sapiens
ccttcagctcctg

SEQ ID NO: 999565 - DNA, 16 bp, Homo sapiens
ccttcagctcctgagt

SEQ ID NO: 999566 - DNA, 20 bp, Homo sapiens
caaacccagtctcctctcca

SEQ ID NO: 999567 - DNA, 18 bp, Homo sapiens
caaaccccagccccaact

SEQ ID NO: 999568 - DNA, 18 bp, Homo sapiens
caaaccctagccttgctt

SEQ ID NO: 999569 - DNA, 21 bp, Homo sapiens
caaaccctcccagaaacatct

SEQ ID NO: 999570 - DNA, 16 bp, Homo sapiens
caaacccttaactgac

SEQ ID NO: 999571 - DNA, 17 bp, Homo sapiens
caaacccttcaactcct

SEQ ID NO: 999572 - DNA, 20 bp, Homo sapiens
caaacccttcaactcctggc

SEQ ID NO: 999573 - DNA, 17 bp, Homo sapiens
caaacctcactgagagg

SEQ ID NO: 999574 - DNA, 20 bp, Homo sapiens
caaacctccagcctccctgt

SEQ ID NO: 999575 - DNA, 15 bp, Homo sapiens
caaacctcctcttct

SEQ ID NO: 999576 - DNA, 20 bp, Homo sapiens
caaacctgacccctgctcag

SEQ ID NO: 999577 - DNA, 21 bp, Homo sapiens
caaacctgtatttaaaaagaa

SEQ ID NO: 999578 - DNA, 13 bp, Homo sapiens
caaaccttcctgg

SEQ ID NO: 999579 - DNA, 19 bp, Homo sapiens
caaaccttcctgggaggac

SEQ ID NO: 999580 - DNA, 18 bp, Homo sapiens
caaacctttattttagaa

SEQ ID NO: 999581 - DNA, 20 bp, Homo sapiens
caaacctttattttagaatt

SEQ ID NO: 999582 - DNA, 19 bp, Homo sapiens
caaacctttctggcctgtt

SEQ ID NO: 999583 - DNA, 19 bp, Homo sapiens
caaacgactaacctatcta

SEQ ID NO: 999584 - DNA, 22 bp, Homo sapiens
caaacgccctttcctcctcagg

SEQ ID NO: 999585 - DNA, 23 bp, Homo sapiens
caaacgccctttcctcctcaggc

SEQ ID NO: 999586 - DNA, 17 bp, Homo sapiens
caaacgcctcccctgcc

SEQ ID NO: 999587 - DNA, 15 bp, Homo sapiens
caaacggagcccctg

SEQ ID NO: 999588 - DNA, 16 bp, Homo sapiens
caaacggagcccctga

SEQ ID NO: 999589 - DNA, 18 bp, Homo sapiens
caaacggagcccctgaaa

SEQ ID NO: 999590 - DNA, 15 bp, Homo sapiens
caaacgtgtttttta

SEQ ID NO: 999591 - DNA, 13 bp, Homo sapiens
caaactaagcccc

SEQ ID NO: 999592 - DNA, 19 bp, Homo sapiens
caaactaagcccccgctgt

SEQ ID NO: 999593 - DNA, 20 bp, Homo sapiens
caaactaagcccccgctgta

SEQ ID NO: 999594 - DNA, 18 bp, Homo sapiens
caaactacagaataatgt

SEQ ID NO: 999595 - DNA, 13 bp, Homo sapiens
caaactacctctg

SEQ ID NO: 999596 - DNA, 18 bp, Homo sapiens
caaactcactgctcaaga

SEQ ID NO: 999597 - DNA, 19 bp, Homo sapiens
caaactcactgctcaagaa

SEQ ID NO: 999598 - DNA, 14 bp, Homo sapiens
caaactccccttcc

SEQ ID NO: 999599 - DNA, 15 bp, Homo sapiens
caaactccccttccc

SEQ ID NO: 999600 - DNA, 21 bp, Homo sapiens
caaactccccttccctgggga

SEQ ID NO: 999601 - DNA, 14 bp, Homo sapiens
caaactcctgggct

SEQ ID NO: 999602 - DNA, 12 bp, Homo sapiens
caaactctgctg

SEQ ID NO: 999603 - DNA, 18 bp, Homo sapiens
caaactctgctgtctaac

SEQ ID NO: 999604 - DNA, 17 bp, Homo sapiens
caaactgaagcagcctc

SEQ ID NO: 999605 - DNA, 15 bp, Homo sapiens
caaactgaagccaga

SEQ ID NO: 999606 - DNA, 21 bp, Homo sapiens
caaactgagtaaattggaaac

SEQ ID NO: 999607 - DNA, 15 bp, Homo sapiens
caaactgatctaaaa

SEQ ID NO: 999608 - DNA, 23 bp, Homo sapiens
caaactgatggaccgggtgggcc

SEQ ID NO: 999609 - DNA, 15 bp, Homo sapiens
caaactgcaatagag

SEQ ID NO: 999610 - DNA, 19 bp, Homo sapiens
caaactgcaatagagactg

SEQ ID NO: 999611 - DNA, 20 bp, Homo sapiens
caaactgcaatagagactgt

SEQ ID NO: 999612 - DNA, 13 bp, Homo sapiens
caaactgcacatc

SEQ ID NO: 999613 - DNA, 15 bp, Homo sapiens
caaactgcacatcta

SEQ ID NO: 999614 - DNA, 15 bp, Homo sapiens
caaactgcagctgtg

SEQ ID NO: 999615 - DNA, 16 bp, Homo sapiens
caaactgcctcaatcc

SEQ ID NO: 999616 - DNA, 13 bp, Homo sapiens
caaactgctttat

SEQ ID NO: 999617 - DNA, 15 bp, Homo sapiens
caaactgctttattt

SEQ ID NO: 999618 - DNA, 17 bp, Homo sapiens
caaactggcaaacttca

SEQ ID NO: 999619 - DNA, 19 bp, Homo sapiens
caaactggcaaacttcaga

SEQ ID NO: 999620 - DNA, 15 bp, Homo sapiens
caaactggggcctcc

SEQ ID NO: 999621 - DNA, 19 bp, Homo sapiens
caaactggggcctccagaa

SEQ ID NO: 999622 - DNA, 21 bp, Homo sapiens
caaactggtattctgttctgg

SEQ ID NO: 999623 - DNA, 20 bp, Homo sapiens
caaactgtaaataaaaagaa

SEQ ID NO: 999624 - DNA, 21 bp, Homo sapiens
caaactgtaaataaaaagaaa

SEQ ID NO: 999625 - DNA, 18 bp, Homo sapiens
caaactgtgaaaatagtg

SEQ ID NO: 999626 - DNA, 14 bp, Homo sapiens
caaactgtgaagca

SEQ ID NO: 999627 - DNA, 17 bp, Homo sapiens
caaacttaagaaacact

SEQ ID NO: 999628 - DNA, 19 bp, Homo sapiens
caaacttaagaaacactga

SEQ ID NO: 999629 - DNA, 16 bp, Homo sapiens
caaacttactattttg

SEQ ID NO: 999630 - DNA, 13 bp, Homo sapiens
caaacttgcttta

SEQ ID NO: 999631 - DNA, 17 bp, Homo sapiens
caaacttggatttttga

SEQ ID NO: 999632 - DNA, 22 bp, Homo sapiens
caaactttattgacaagtgatt

SEQ ID NO: 999633 - DNA, 13 bp, Homo sapiens
caaactttgcatc

SEQ ID NO: 999634 - DNA, 19 bp, Homo sapiens
caaacttttcccctgtcct

SEQ ID NO: 999635 - DNA, 17 bp, Homo sapiens
caaactttttccagcaa

SEQ ID NO: 999636 - DNA, 15 bp, Homo sapiens
caaacttttttatat

SEQ ID NO: 999637 - DNA, 19 bp, Homo sapiens
caaacttttttatatcttt

SEQ ID NO: 999638 - DNA, 14 bp, Homo sapiens
caaagaaaaacaat

SEQ ID NO: 999639 - DNA, 23 bp, Homo sapiens
caaagaaaaagtaaatcaaagat

SEQ ID NO: 999640 - DNA, 23 bp, Homo sapiens
caaagaaaagacttttgttgaaa

SEQ ID NO: 999641 - DNA, 14 bp, Homo sapiens
caaagaaaatgaaa

SEQ ID NO: 999642 - DNA, 19 bp, Homo sapiens
caaagaaacaagctgtgca

SEQ ID NO: 999643 - DNA, 23 bp, Homo sapiens
caaagaaacaagctgtgcaggca

SEQ ID NO: 999644 - DNA, 13 bp, Homo sapiens
caaagaaatccaa

SEQ ID NO: 999645 - DNA, 18 bp, Homo sapiens
caaagaaatccaaatttc

SEQ ID NO: 999646 - DNA, 23 bp, Homo sapiens
caaagaaatccccccttcagaac

SEQ ID NO: 999647 - DNA, 20 bp, Homo sapiens
caaagaaatccggagaagct

SEQ ID NO: 999648 - DNA, 20 bp, Homo sapiens
caaagaaatgggcctgcctg

SEQ ID NO: 999649 - DNA, 21 bp, Homo sapiens
ccttctagtgagcctgggcca

SEQ ID NO: 999650 - DNA, 15 bp, Homo sapiens
ccttctagtttccca

SEQ ID NO: 999651 - DNA, 15 bp, Homo sapiens
ccttctattctagcc

SEQ ID NO: 999652 - DNA, 14 bp, Homo sapiens
ccttctcactgcca

SEQ ID NO: 999653 - DNA, 15 bp, Homo sapiens
ccttctcagaagcac

SEQ ID NO: 999654 - DNA, 18 bp, Homo sapiens
ccttctcagaagcacaga

SEQ ID NO: 999655 - DNA, 13 bp, Homo sapiens
ccttctccaaagg

SEQ ID NO: 999656 - DNA, 19 bp, Homo sapiens
ccttctccaaaggctctgt

SEQ ID NO: 999657 - DNA, 15 bp, Homo sapiens
ccttctccaaatgag

SEQ ID NO: 999658 - DNA, 13 bp, Homo sapiens
ccttctccatcca

SEQ ID NO: 999659 - DNA, 14 bp, Homo sapiens
ccttctcccacact

SEQ ID NO: 999660 - DNA, 12 bp, Homo sapiens
ccttctccccaa

SEQ ID NO: 999661 - DNA, 19 bp, Homo sapiens
ccttctcccctctcccagg

SEQ ID NO: 999662 - DNA, 16 bp, Homo sapiens
ccttctccccttcctg

SEQ ID NO: 999663 - DNA, 17 bp, Homo sapiens
ccttctccccttcctgg

SEQ ID NO: 999664 - DNA, 16 bp, Homo sapiens
ccttctcccttcttgg

SEQ ID NO: 999665 - DNA, 21 bp, Homo sapiens
ccttctcctacttagggaaga

SEQ ID NO: 999666 - DNA, 16 bp, Homo sapiens
ccttctcctagctctg

SEQ ID NO: 999667 - DNA, 16 bp, Homo sapiens
ccttctcctctctggg

SEQ ID NO: 999668 - DNA, 15 bp, Homo sapiens
ccttctcctcttgta

SEQ ID NO: 999669 - DNA, 16 bp, Homo sapiens
ccttctcctcttgtaa

SEQ ID NO: 999670 - DNA, 22 bp, Homo sapiens
ccttctccttcccatttctcta

SEQ ID NO: 999671 - DNA, 20 bp, Homo sapiens
ccttctctacactcttgtaa

SEQ ID NO: 999672 - DNA, 15 bp, Homo sapiens
ccttctctcctcccc

SEQ ID NO: 999673 - DNA, 16 bp, Homo sapiens
ccttctctcctcccca

SEQ ID NO: 999674 - DNA, 13 bp, Homo sapiens
ccttctctctcca

SEQ ID NO: 999675 - DNA, 16 bp, Homo sapiens
ccttctctgctccacc

SEQ ID NO: 999676 - DNA, 22 bp, Homo sapiens
ccttctctgctccaccacatcc

SEQ ID NO: 999677 - DNA, 23 bp, Homo sapiens
ccttctctgggtctgattttctc

SEQ ID NO: 999678 - DNA, 16 bp, Homo sapiens
ccttctcttgaggcct

SEQ ID NO: 999679 - DNA, 13 bp, Homo sapiens
ccttctgaactcc

SEQ ID NO: 999680 - DNA, 14 bp, Homo sapiens
ccttctgagctcca

SEQ ID NO: 999681 - DNA, 19 bp, Homo sapiens
ccttctgccaacgcctcct

SEQ ID NO: 999682 - DNA, 21 bp, Homo sapiens
ccttctgccaacgcctcctgt

SEQ ID NO: 999683 - DNA, 17 bp, Homo sapiens
ccttctgcctttgatgt

SEQ ID NO: 999684 - DNA, 17 bp, Homo sapiens
ccttctgctcagctctg

SEQ ID NO: 999685 - DNA, 19 bp, Homo sapiens
ccttctgctcccaccccag

SEQ ID NO: 999686 - DNA, 10 bp, Homo sapiens
ccttctggcc

SEQ ID NO: 999687 - DNA, 18 bp, Homo sapiens
ccttctggcctcccacag

SEQ ID NO: 999688 - DNA, 20 bp, Homo sapiens
ccttctggcctcccacagac

SEQ ID NO: 999689 - DNA, 16 bp, Homo sapiens
ccttctggccttgtaa

SEQ ID NO: 999690 - DNA, 19 bp, Homo sapiens
ccttctgggactggacagc

SEQ ID NO: 999691 - DNA, 14 bp, Homo sapiens
ccttctgggcttca

SEQ ID NO: 999692 - DNA, 17 bp, Homo sapiens
ccttctgggctttttct

SEQ ID NO: 999693 - DNA, 16 bp, Homo sapiens
ccttctggttgcttca

SEQ ID NO: 999694 - DNA, 14 bp, Homo sapiens
ccttctgtccacca

SEQ ID NO: 999695 - DNA, 17 bp, Homo sapiens
ccttctgtccaccagac

SEQ ID NO: 999696 - DNA, 15 bp, Homo sapiens
ccttctgtccccagc

SEQ ID NO: 999697 - DNA, 20 bp, Homo sapiens
ccttctgtgagataaatgca

SEQ ID NO: 999698 - DNA, 12 bp, Homo sapiens
ccttctgtgggg

SEQ ID NO: 999699 - DNA, 22 bp, Homo sapiens
caaagggaccaggggagaggca

SEQ ID NO: 999700 - DNA, 21 bp, Homo sapiens
caaagggcctgcccagacaag

SEQ ID NO: 999701 - DNA, 12 bp, Homo sapiens
caaagggctgcc

SEQ ID NO: 999702 - DNA, 19 bp, Homo sapiens
caaagggctgccttgctgt

SEQ ID NO: 999703 - DNA, 13 bp, Homo sapiens
caaaggggacagc

SEQ ID NO: 999704 - DNA, 18 bp, Homo sapiens
caaaggggacagctgtgt

SEQ ID NO: 999705 - DNA, 21 bp, Homo sapiens
caaaggggacaggcctcacct

SEQ ID NO: 999706 - DNA, 14 bp, Homo sapiens
caaaggggagccag

SEQ ID NO: 999707 - DNA, 15 bp, Homo sapiens
caaaggggagccaga

SEQ ID NO: 999708 - DNA, 11 bp, Homo sapiens
caaaggggctg

SEQ ID NO: 999709 - DNA, 14 bp, Homo sapiens
caaaggggctgctg

SEQ ID NO: 999710 - DNA, 17 bp, Homo sapiens
caaaggggctgctgggg

SEQ ID NO: 999711 - DNA, 20 bp, Homo sapiens
caaaggggctgctggggcat

SEQ ID NO: 999712 - DNA, 14 bp, Homo sapiens
caaaggtataattt

SEQ ID NO: 999713 - DNA, 15 bp, Homo sapiens
caaaggtcttgaata

SEQ ID NO: 999714 - DNA, 18 bp, Homo sapiens
caaaggtgaaggaatata

SEQ ID NO: 999715 - DNA, 19 bp, Homo sapiens
caaaggtgaaggaatatat

SEQ ID NO: 999716 - DNA, 13 bp, Homo sapiens
caaaggtggaata

SEQ ID NO: 999717 - DNA, 15 bp, Homo sapiens
caaaggttgagatgt

SEQ ID NO: 999718 - DNA, 21 bp, Homo sapiens
caaaggtttggaaggagcaga

SEQ ID NO: 999719 - DNA, 19 bp, Homo sapiens
caaaggttttcctcttcta

SEQ ID NO: 999720 - DNA, 21 bp, Homo sapiens
caaagtaaaaaattaaagccc

SEQ ID NO: 999721 - DNA, 12 bp, Homo sapiens
caaagtaaaatg

SEQ ID NO: 999722 - DNA, 14 bp, Homo sapiens
caaagtaaaatgaa

SEQ ID NO: 999723 - DNA, 18 bp, Homo sapiens
caaagtaatttggaaatt

SEQ ID NO: 999724 - DNA, 14 bp, Homo sapiens
caaagtacaaaatt

SEQ ID NO: 999725 - DNA, 17 bp, Homo sapiens
caaagtacaaaattgcc

SEQ ID NO: 999726 - DNA, 20 bp, Homo sapiens
caaagtacagaaaaatactt

SEQ ID NO: 999727 - DNA, 20 bp, Homo sapiens
caaagtaccacactgagttc

SEQ ID NO: 999728 - DNA, 23 bp, Homo sapiens
caaagtacttgtcatagactcct

SEQ ID NO: 999729 - DNA, 20 bp, Homo sapiens
caaagtagatcatgcataga

SEQ ID NO: 999730 - DNA, 14 bp, Homo sapiens
caaagtatcaaaga

SEQ ID NO: 999731 - DNA, 20 bp, Homo sapiens
caaagtattgtaaattatat

SEQ ID NO: 999732 - DNA, 22 bp, Homo sapiens
caaagtatttttttcactgttt

SEQ ID NO: 999733 - DNA, 15 bp, Homo sapiens
caaagtcacagtcgt

SEQ ID NO: 999734 - DNA, 21 bp, Homo sapiens
caaagtcatcccctctcagga

SEQ ID NO: 999735 - DNA, 16 bp, Homo sapiens
caaagtcccttcctgc

SEQ ID NO: 999736 - DNA, 22 bp, Homo sapiens
caaagtcccttcctgcttcctg

SEQ ID NO: 999737 - DNA, 18 bp, Homo sapiens
caaagtcccttgagactc

SEQ ID NO: 999738 - DNA, 17 bp, Homo sapiens
caaagtcctttttttcc

SEQ ID NO: 999739 - DNA, 21 bp, Homo sapiens
caaagtcgccagtcactgctg

SEQ ID NO: 999740 - DNA, 15 bp, Homo sapiens
caaagtctaggttgg

SEQ ID NO: 999741 - DNA, 20 bp, Homo sapiens
caaagtctgccgcccacctc

SEQ ID NO: 999742 - DNA, 23 bp, Homo sapiens
caaagtctgctctcatataagac

SEQ ID NO: 999743 - DNA, 14 bp, Homo sapiens
caaagtctgtgtga

SEQ ID NO: 999744 - DNA, 18 bp, Homo sapiens
caaagtgactgtttggct

SEQ ID NO: 999745 - DNA, 12 bp, Homo sapiens
caaagtgcaagg

SEQ ID NO: 999746 - DNA, 21 bp, Homo sapiens
caaagtgcagcccttcctcct

SEQ ID NO: 999747 - DNA, 23 bp, Homo sapiens
caaagtgcagcccttcctcctga

SEQ ID NO: 999748 - DNA, 14 bp, Homo sapiens
caaagtgcctggga

SEQ ID NO: 999749 - DNA, 19 bp, Homo sapiens
caaagtgctaggattacag

SEQ ID NO: 999750 - DNA, 19 bp, Homo sapiens
caaagtgctgagattacag

SEQ ID NO: 999751 - DNA, 13 bp, Homo sapiens
caaagtgctggga

SEQ ID NO: 999752 - DNA, 18 bp, Homo sapiens
caaagtgctgggattaca

SEQ ID NO: 999753 - DNA, 19 bp, Homo sapiens
caaagtgctttgacttctt

SEQ ID NO: 999754 - DNA, 16 bp, Homo sapiens
caaagtgggtgtgtgg

SEQ ID NO: 999755 - DNA, 21 bp, Homo sapiens
caaagtgggtgtgtggcctcc

SEQ ID NO: 999756 - DNA, 17 bp, Homo sapiens
caaagtggtaaatactg

SEQ ID NO: 999757 - DNA, 18 bp, Homo sapiens
caaagtggtaaatactgt

SEQ ID NO: 999758 - DNA, 20 bp, Homo sapiens
caaagtggtaaatactgtga

SEQ ID NO: 999759 - DNA, 18 bp, Homo sapiens
caaagtggtatagaaatg

SEQ ID NO: 999760 - DNA, 17 bp, Homo sapiens
caaagtgtgtattaaaa

SEQ ID NO: 999761 - DNA, 20 bp, Homo sapiens
caaagtgttgtgttcctggc

SEQ ID NO: 999762 - DNA, 23 bp, Homo sapiens
caaagtgttgtgttcctggctga

SEQ ID NO: 999763 - DNA, 15 bp, Homo sapiens
caaagttaacagatt

SEQ ID NO: 999764 - DNA, 22 bp, Homo sapiens
caaagttaattcacctatgtta

SEQ ID NO: 999765 - DNA, 21 bp, Homo sapiens
caaagttactaggtaacttca

SEQ ID NO: 999766 - DNA, 14 bp, Homo sapiens
caaagttagagaac

SEQ ID NO: 999767 - DNA, 17 bp, Homo sapiens
caaagttagagaactaa

SEQ ID NO: 999768 - DNA, 18 bp, Homo sapiens
caaagttccaaaatgcca

SEQ ID NO: 999769 - DNA, 15 bp, Homo sapiens
caaagttctcagagc

SEQ ID NO: 999770 - DNA, 22 bp, Homo sapiens
caaagttgccacagatgatact

SEQ ID NO: 999771 - DNA, 18 bp, Homo sapiens
ccttgataaatatatatg

SEQ ID NO: 999772 - DNA, 16 bp, Homo sapiens
ccttgataatacttga

SEQ ID NO: 999773 - DNA, 17 bp, Homo sapiens
ccttgataatacttgac

SEQ ID NO: 999774 - DNA, 14 bp, Homo sapiens
ccttgatcagtgac

SEQ ID NO: 999775 - DNA, 14 bp, Homo sapiens
ccttgatcccaatc

SEQ ID NO: 999776 - DNA, 14 bp, Homo sapiens
ccttgatgccagag

SEQ ID NO: 999777 - DNA, 17 bp, Homo sapiens
ccttgatgccagagggc

SEQ ID NO: 999778 - DNA, 18 bp, Homo sapiens
ccttgatgccagagggcc

SEQ ID NO: 999779 - DNA, 19 bp, Homo sapiens
ccttgatggagatatttac

SEQ ID NO: 999780 - DNA, 19 bp, Homo sapiens
ccttgatggggtccagaga

SEQ ID NO: 999781 - DNA, 18 bp, Homo sapiens
ccttgatgggtgctgccc

SEQ ID NO: 999782 - DNA, 19 bp, Homo sapiens
ccttgatttaaacacacag

SEQ ID NO: 999783 - DNA, 15 bp, Homo sapiens
ccttgatttgttctt

SEQ ID NO: 999784 - DNA, 14 bp, Homo sapiens
ccttgcaaccaggc

SEQ ID NO: 999785 - DNA, 21 bp, Homo sapiens
ccttgcaacctcaccttcctg

SEQ ID NO: 999786 - DNA, 23 bp, Homo sapiens
ccttgcaagccataacgtgcccc

SEQ ID NO: 999787 - DNA, 18 bp, Homo sapiens
ccttgcacacccactgcc

SEQ ID NO: 999788 - DNA, 20 bp, Homo sapiens
ccttgcacacccactgcccc

SEQ ID NO: 999789 - DNA, 14 bp, Homo sapiens
ccttgcacccctca

SEQ ID NO: 999790 - DNA, 18 bp, Homo sapiens
ccttgcacccctcactct

SEQ ID NO: 999791 - DNA, 16 bp, Homo sapiens
ccttgcacctgcatcc

SEQ ID NO: 999792 - DNA, 12 bp, Homo sapiens
ccttgcactcct

SEQ ID NO: 999793 - DNA, 18 bp, Homo sapiens
ccttgcagaactgccatt

SEQ ID NO: 999794 - DNA, 11 bp, Homo sapiens
ccttgcatcaa

SEQ ID NO: 999795 - DNA, 22 bp, Homo sapiens
ccttgccacccattcttcccgt

SEQ ID NO: 999796 - DNA, 15 bp, Homo sapiens
ccttgccactttgca

SEQ ID NO: 999797 - DNA, 13 bp, Homo sapiens
ccttgccagggca

SEQ ID NO: 999798 - DNA, 18 bp, Homo sapiens
ccttgccatccattctgg

SEQ ID NO: 999799 - DNA, 23 bp, Homo sapiens
ccttgccatcctaaaagccaccc

SEQ ID NO: 999800 - DNA, 15 bp, Homo sapiens
ccttgcccacaggtg

SEQ ID NO: 999801 - DNA, 16 bp, Homo sapiens
ccttgcccacaggtgc

SEQ ID NO: 999802 - DNA, 23 bp, Homo sapiens
ccttgcccagagatgcctccacc

SEQ ID NO: 999803 - DNA, 13 bp, Homo sapiens
ccttgcccagggc

SEQ ID NO: 999804 - DNA, 15 bp, Homo sapiens
ccttgcccagggctc

SEQ ID NO: 999805 - DNA, 16 bp, Homo sapiens
ccttgcccagggctca

SEQ ID NO: 999806 - DNA, 14 bp, Homo sapiens
ccttgcccatcagc

SEQ ID NO: 999807 - DNA, 12 bp, Homo sapiens
ccttgccccact

SEQ ID NO: 999808 - DNA, 21 bp, Homo sapiens
ccttgccccactcctctccac

SEQ ID NO: 999809 - DNA, 16 bp, Homo sapiens
ccttgccccaggccag

SEQ ID NO: 999810 - DNA, 17 bp, Homo sapiens
ccttgccccaggccagg

SEQ ID NO: 999811 - DNA, 17 bp, Homo sapiens
ccttgcccccatccctc

SEQ ID NO: 999812 - DNA, 19 bp, Homo sapiens
ccttgccccccgccctcat

SEQ ID NO: 999813 - DNA, 19 bp, Homo sapiens
ccttgcccgtcgtgtgctg

SEQ ID NO: 999814 - DNA, 12 bp, Homo sapiens
ccttgccctgac

SEQ ID NO: 999815 - DNA, 19 bp, Homo sapiens
ccttgccctgacctcccag

SEQ ID NO: 999816 - DNA, 18 bp, Homo sapiens
ccttgcccttgccctgac

SEQ ID NO: 999817 - DNA, 19 bp, Homo sapiens
ccttgcccttggagctgcc

SEQ ID NO: 999818 - DNA, 15 bp, Homo sapiens
ccttgccgctcccct

SEQ ID NO: 999819 - DNA, 18 bp, Homo sapiens
ccttgccgctccccttgg

SEQ ID NO: 999820 - DNA, 16 bp, Homo sapiens
ccttgcctcaatgcca

SEQ ID NO: 999821 - DNA, 12 bp, Homo sapiens
ccttgcctcctg

SEQ ID NO: 999822 - DNA, 17 bp, Homo sapiens
ccttgcctgaactccag

SEQ ID NO: 999823 - DNA, 15 bp, Homo sapiens
ccttgcctgcctcct

SEQ ID NO: 999824 - DNA, 17 bp, Homo sapiens
ccttgcctgcctcctag

SEQ ID NO: 999825 - DNA, 20 bp, Homo sapiens
ccttgccttaataaatatgt

SEQ ID NO: 999826 - DNA, 18 bp, Homo sapiens
ccttgcctttcgaggcct

SEQ ID NO: 999827 - DNA, 14 bp, Homo sapiens
ccttgcgcctcagc

SEQ ID NO: 999828 - DNA, 17 bp, Homo sapiens
ccttgcgctgtcccagg

SEQ ID NO: 999829 - DNA, 15 bp, Homo sapiens
caaattctgtttctt

SEQ ID NO: 999830 - DNA, 17 bp, Homo sapiens
caaattcttttgaattg

SEQ ID NO: 999831 - DNA, 22 bp, Homo sapiens
caaattgatcaagatattaaaa

SEQ ID NO: 999832 - DNA, 12 bp, Homo sapiens
caaattgctgct

SEQ ID NO: 999833 - DNA, 13 bp, Homo sapiens
caaattgctgctt

SEQ ID NO: 999834 - DNA, 23 bp, Homo sapiens
caaattgcttctaggagtcaact

SEQ ID NO: 999835 - DNA, 17 bp, Homo sapiens
caaattgcttgagcctg

SEQ ID NO: 999836 - DNA, 20 bp, Homo sapiens
caaattgcttttttccaaaa

SEQ ID NO: 999837 - DNA, 19 bp, Homo sapiens
caaattgtatctagtgcag

SEQ ID NO: 999838 - DNA, 14 bp, Homo sapiens
caaattgtatctta

SEQ ID NO: 999839 - DNA, 22 bp, Homo sapiens
caaattgtatcttattataaaa

SEQ ID NO: 999840 - DNA, 12 bp, Homo sapiens
caaattgtttac

SEQ ID NO: 999841 - DNA, 22 bp, Homo sapiens
caaatttagaaactaattgact

SEQ ID NO: 999842 - DNA, 12 bp, Homo sapiens
caaatttatgca

SEQ ID NO: 999843 - DNA, 15 bp, Homo sapiens
caaatttatgcattt

SEQ ID NO: 999844 - DNA, 21 bp, Homo sapiens
caaatttatgcatttcattca

SEQ ID NO: 999845 - DNA, 23 bp, Homo sapiens
caaatttatgcatttcattcaaa

SEQ ID NO: 999846 - DNA, 14 bp, Homo sapiens
caaatttatttcca

SEQ ID NO: 999847 - DNA, 21 bp, Homo sapiens
caaatttatttttttcttttg

SEQ ID NO: 999848 - DNA, 11 bp, Homo sapiens
caaatttctaa

SEQ ID NO: 999849 - DNA, 12 bp, Homo sapiens
caaatttctaaa

SEQ ID NO: 999850 - DNA, 15 bp, Homo sapiens
caaatttctaaatct

SEQ ID NO: 999851 - DNA, 19 bp, Homo sapiens
caaatttctataaatttaa

SEQ ID NO: 999852 - DNA, 15 bp, Homo sapiens
caaatttctctcttt

SEQ ID NO: 999853 - DNA, 20 bp, Homo sapiens
caaatttctctctttcttca

SEQ ID NO: 999854 - DNA, 19 bp, Homo sapiens
caaatttgaaaataattgt

SEQ ID NO: 999855 - DNA, 21 bp, Homo sapiens
caaatttgccatgacatttca

SEQ ID NO: 999856 - DNA, 22 bp, Homo sapiens
caaatttggccttaagaactgt

SEQ ID NO: 999857 - DNA, 23 bp, Homo sapiens
caaatttggccttaagaactgtg

SEQ ID NO: 999858 - DNA, 24 bp, Homo sapiens
caaatttggccttaagaactgtgt

SEQ ID NO: 999859 - DNA, 21 bp, Homo sapiens
caaatttggctcacttgcctt

SEQ ID NO: 999860 - DNA, 11 bp, Homo sapiens
caaatttgtac

SEQ ID NO: 999861 - DNA, 15 bp, Homo sapiens
caaattttcaagttt

SEQ ID NO: 999862 - DNA, 16 bp, Homo sapiens
caaattttcagaaggt

SEQ ID NO: 999863 - DNA, 19 bp, Homo sapiens
caaattttgagttgccaca

SEQ ID NO: 999864 - DNA, 13 bp, Homo sapiens
caaattttgcatt

SEQ ID NO: 999865 - DNA, 17 bp, Homo sapiens
caaattttgcatttagt

SEQ ID NO: 999866 - DNA, 15 bp, Homo sapiens
caaattttggccaaa

SEQ ID NO: 999867 - DNA, 15 bp, Homo sapiens
caaattttttgactt

SEQ ID NO: 999868 - DNA, 23 bp, Homo sapiens
caaattttttgactttttttgta

SEQ ID NO: 999869 - DNA, 16 bp, Homo sapiens
caaatttttttcttag

SEQ ID NO: 999870 - DNA, 12 bp, Homo sapiens
caacaaaaacag

SEQ ID NO: 999871 - DNA, 16 bp, Homo sapiens
caacaaaaagcttccc

SEQ ID NO: 999872 - DNA, 15 bp, Homo sapiens
caacaaaagaatttt

SEQ ID NO: 999873 - DNA, 17 bp, Homo sapiens
caacaaaagaatttttg

SEQ ID NO: 999874 - DNA, 15 bp, Homo sapiens
caacaaaatccatgt

SEQ ID NO: 999875 - DNA, 20 bp, Homo sapiens
caacaaagaaacaaagatgt

SEQ ID NO: 999876 - DNA, 12 bp, Homo sapiens
caacaaagaaat

SEQ ID NO: 999877 - DNA, 20 bp, Homo sapiens
caacaaagagcgagtcccct

SEQ ID NO: 999878 - DNA, 19 bp, Homo sapiens
caacaaagccaacagtcaa

SEQ ID NO: 999879 - DNA, 13 bp, Homo sapiens
caacaacaaaaac

SEQ ID NO: 999880 - DNA, 16 bp, Homo sapiens
caacaacaattggtaa

SEQ ID NO: 999881 - DNA, 14 bp, Homo sapiens
caacaactctgcct

SEQ ID NO: 999882 - DNA, 20 bp, Homo sapiens
caacaactctgcctttatga

SEQ ID NO: 999883 - DNA, 21 bp, Homo sapiens
caacaactctgcctttatgat

SEQ ID NO: 999884 - DNA, 12 bp, Homo sapiens
caacaagaagaa

SEQ ID NO: 999885 - DNA, 18 bp, Homo sapiens
caacaagaagaaatatga

SEQ ID NO: 999886 - DNA, 20 bp, Homo sapiens
caacaagaagaaatatgaaa

SEQ ID NO: 999887 - DNA, 20 bp, Homo sapiens
caacaagaagggactgagag

SEQ ID NO: 999888 - DNA, 12 bp, Homo sapiens
caacaagaatgc

SEQ ID NO: 999889 - DNA, 20 bp, Homo sapiens
caacaagaccgccccagggc

SEQ ID NO: 999890 - DNA, 21 bp, Homo sapiens
caacaagcccgttagccccag

SEQ ID NO: 999891 - DNA, 14 bp, Homo sapiens
caacaagggagaga

SEQ ID NO: 999892 - DNA, 15 bp, Homo sapiens
caacaagggagagac

SEQ ID NO: 999893 - DNA, 18 bp, Homo sapiens
caacaagggagagacctc

SEQ ID NO: 999894 - DNA, 18 bp, Homo sapiens
caaccaagtcatgtgcat

SEQ ID NO: 999895 - DNA, 13 bp, Homo sapiens
caaccacagagaa

SEQ ID NO: 999896 - DNA, 22 bp, Homo sapiens
caaccacatacaacacaaagag

SEQ ID NO: 999897 - DNA, 16 bp, Homo sapiens
caaccacatgtcccag

SEQ ID NO: 999898 - DNA, 17 bp, Homo sapiens
caaccaccgctccccag

SEQ ID NO: 999899 - DNA, 21 bp, Homo sapiens
caaccaccgctccccagccca

SEQ ID NO: 999900 - DNA, 22 bp, Homo sapiens
caaccaccgctccccagcccag

SEQ ID NO: 999901 - DNA, 22 bp, Homo sapiens
caaccactggtctgtagggatt

SEQ ID NO: 999902 - DNA, 11 bp, Homo sapiens
caaccagcccg

SEQ ID NO: 999903 - DNA, 11 bp, Homo sapiens
caaccagcctt

SEQ ID NO: 999904 - DNA, 17 bp, Homo sapiens
caaccagctaagaaaag

SEQ ID NO: 999905 - DNA, 14 bp, Homo sapiens
caaccaggacccag

SEQ ID NO: 999906 - DNA, 15 bp, Homo sapiens
caaccaggacccagg

SEQ ID NO: 999907 - DNA, 20 bp, Homo sapiens
caaccaggagctgatggcag

SEQ ID NO: 999908 - DNA, 12 bp, Homo sapiens
caaccaggcagc

SEQ ID NO: 999909 - DNA, 13 bp, Homo sapiens
caaccatcgcttt

SEQ ID NO: 999910 - DNA, 18 bp, Homo sapiens
caaccatgagaccactgt

SEQ ID NO: 999911 - DNA, 23 bp, Homo sapiens
caaccatgagaccactgttatca

SEQ ID NO: 999912 - DNA, 14 bp, Homo sapiens
caaccatgtcattt

SEQ ID NO: 999913 - DNA, 22 bp, Homo sapiens
caaccatgtcatttcagaagtt

SEQ ID NO: 999914 - DNA, 14 bp, Homo sapiens
caaccattaaagtc

SEQ ID NO: 999915 - DNA, 18 bp, Homo sapiens
caaccattataaccttaa

SEQ ID NO: 999916 - DNA, 15 bp, Homo sapiens
caacccaaaccatga

SEQ ID NO: 999917 - DNA, 18 bp, Homo sapiens
caacccaagctctgggga

SEQ ID NO: 999918 - DNA, 16 bp, Homo sapiens
caacccaatccctctc

SEQ ID NO: 999919 - DNA, 17 bp, Homo sapiens
caacccaatccctctcc

SEQ ID NO: 999920 - DNA, 20 bp, Homo sapiens
caacccacaccgtcttcctt

SEQ ID NO: 999921 - DNA, 19 bp, Homo sapiens
caacccagtgggtctggga

SEQ ID NO: 999922 - DNA, 16 bp, Homo sapiens
caaccccagacactgg

SEQ ID NO: 999923 - DNA, 14 bp, Homo sapiens
caaccccagttctg

SEQ ID NO: 999924 - DNA, 17 bp, Homo sapiens
caaccccagttctgctc

SEQ ID NO: 999925 - DNA, 14 bp, Homo sapiens
caacccccacccca

SEQ ID NO: 999926 - DNA, 20 bp, Homo sapiens
caacccccagaggtggccct

SEQ ID NO: 999927 - DNA, 21 bp, Homo sapiens
caacccccagaggtggccctt

SEQ ID NO: 999928 - DNA, 16 bp, Homo sapiens
caacccccatttctat

SEQ ID NO: 999929 - DNA, 13 bp, Homo sapiens
caacccccctccc

SEQ ID NO: 999930 - DNA, 14 bp, Homo sapiens
caacccccctccca

SEQ ID NO: 999931 - DNA, 16 bp, Homo sapiens
caacccccctcctgct

SEQ ID NO: 999932 - DNA, 21 bp, Homo sapiens
caacccccctcctgctcctcc

SEQ ID NO: 999933 - DNA, 22 bp, Homo sapiens
caacccccctcctgctcctccc

SEQ ID NO: 999934 - DNA, 20 bp, Homo sapiens
caacccccgcaccaagcaga

SEQ ID NO: 999935 - DNA, 12 bp, Homo sapiens
caaccccctgca

SEQ ID NO: 999936 - DNA, 13 bp, Homo sapiens
caaccccctgcaa

SEQ ID NO: 999937 - DNA, 14 bp, Homo sapiens
caaccccctgcaag

SEQ ID NO: 999938 - DNA, 19 bp, Homo sapiens
caaccccgcggtgctctgg

SEQ ID NO: 999939 - DNA, 17 bp, Homo sapiens
caaccccggggcatgga

SEQ ID NO: 999940 - DNA, 14 bp, Homo sapiens
caacccctgtaccc

SEQ ID NO: 999941 - DNA, 20 bp, Homo sapiens
caacccctgtacccagctcc

SEQ ID NO: 999942 - DNA, 19 bp, Homo sapiens
caacccgctggagcccaca

SEQ ID NO: 999943 - DNA, 22 bp, Homo sapiens
caacccgctggagcccacagcg

SEQ ID NO: 999944 - DNA, 20 bp, Homo sapiens
caacccgtctggcccaccag

SEQ ID NO: 999945 - DNA, 22 bp, Homo sapiens
caacccgtctggcccaccaggg

SEQ ID NO: 999946 - DNA, 19 bp, Homo sapiens
caaccctaggttccctgtt

SEQ ID NO: 999947 - DNA, 22 bp, Homo sapiens
caaccctaggttccctgttctt

SEQ ID NO: 999948 - DNA, 22 bp, Homo sapiens
caaccctatctcctgacagaag

SEQ ID NO: 999949 - DNA, 14 bp, Homo sapiens
caaccctattcatt

SEQ ID NO: 999950 - DNA, 19 bp, Homo sapiens
caaccctccctcagcccct

SEQ ID NO: 999951 - DNA, 21 bp, Homo sapiens
caaccctccctcagcccctct

SEQ ID NO: 999952 - DNA, 22 bp, Homo sapiens
caaccctcctatcacctcccct

SEQ ID NO: 999953 - DNA, 12 bp, Homo sapiens
caaccctctcct

SEQ ID NO: 999954 - DNA, 21 bp, Homo sapiens
caaccctctcctgtctgccct

SEQ ID NO: 999955 - DNA, 12 bp, Homo sapiens
caaccctgcaat

SEQ ID NO: 999956 - DNA, 15 bp, Homo sapiens
caaccctgcccctgc

SEQ ID NO: 999957 - DNA, 11 bp, Homo sapiens
caaccctgcct

SEQ ID NO: 999958 - DNA, 15 bp, Homo sapiens
caaccctgcctgtca

SEQ ID NO: 999959 - DNA, 17 bp, Homo sapiens
ccttggtgtccacctgg

SEQ ID NO: 999960 - DNA, 17 bp, Homo sapiens
ccttggttcccttgtgt

SEQ ID NO: 999961 - DNA, 20 bp, Homo sapiens
ccttggttctgcactgttgc

SEQ ID NO: 999962 - DNA, 22 bp, Homo sapiens
ccttggttctgcactgttgcca

SEQ ID NO: 999963 - DNA, 22 bp, Homo sapiens
ccttggttgtctggcaaggact

SEQ ID NO: 999964 - DNA, 15 bp, Homo sapiens
ccttggtttgctagt

SEQ ID NO: 999965 - DNA, 11 bp, Homo sapiens
ccttgtatagt

SEQ ID NO: 999966 - DNA, 19 bp, Homo sapiens
ccttgtatgaataaaaggc

SEQ ID NO: 999967 - DNA, 19 bp, Homo sapiens
ccttgtattttgttaaagc

SEQ ID NO: 999968 - DNA, 21 bp, Homo sapiens
ccttgtattttgttaaagctg

SEQ ID NO: 999969 - DNA, 16 bp, Homo sapiens
ccttgtcactggtaga

SEQ ID NO: 999970 - DNA, 15 bp, Homo sapiens
ccttgtcatcctccc

SEQ ID NO: 999971 - DNA, 22 bp, Homo sapiens
ccttgtcatcctcccttgcccc

SEQ ID NO: 999972 - DNA, 21 bp, Homo sapiens
ccttgtccaggaactgcctgg

SEQ ID NO: 999973 - DNA, 15 bp, Homo sapiens
ccttgtcccagccag

SEQ ID NO: 999974 - DNA, 15 bp, Homo sapiens
ccttgtcctgaagcc

SEQ ID NO: 999975 - DNA, 14 bp, Homo sapiens
ccttgtcctttccc

SEQ ID NO: 999976 - DNA, 17 bp, Homo sapiens
ccttgtctccctggttg

SEQ ID NO: 999977 - DNA, 16 bp, Homo sapiens
ccttgtctctcactgc

SEQ ID NO: 999978 - DNA, 18 bp, Homo sapiens
ccttgtctgggtctacca

SEQ ID NO: 999979 - DNA, 23 bp, Homo sapiens
ccttgtctgggtctaccaggaac

SEQ ID NO: 999980 - DNA, 12 bp, Homo sapiens
ccttgtcttccc

SEQ ID NO: 999981 - DNA, 13 bp, Homo sapiens
ccttgtcttcccc

SEQ ID NO: 999982 - DNA, 14 bp, Homo sapiens
ccttgtcttccccc

SEQ ID NO: 999983 - DNA, 22 bp, Homo sapiens
ccttgtcttcccccctctcctc

SEQ ID NO: 999984 - DNA, 13 bp, Homo sapiens
ccttgtgccctgc

SEQ ID NO: 999985 - DNA, 16 bp, Homo sapiens
ccttgtgccctgcccc

SEQ ID NO: 999986 - DNA, 17 bp, Homo sapiens
ccttgtgcctgctcctg

SEQ ID NO: 999987 - DNA, 20 bp, Homo sapiens
ccttgtgcctgctcctgtac

SEQ ID NO: 999988 - DNA, 15 bp, Homo sapiens
ccttgtgccttcttt

SEQ ID NO: 999989 - DNA, 14 bp, Homo sapiens
ccttgtggactggc

SEQ ID NO: 999990 - DNA, 12 bp, Homo sapiens
ccttgtggcttc

SEQ ID NO: 999991 - DNA, 14 bp, Homo sapiens
ccttgtgggcaaag

SEQ ID NO: 999992 - DNA, 17 bp, Homo sapiens
ccttgtgtgtcaggccc

SEQ ID NO: 999993 - DNA, 18 bp, Homo sapiens
ccttgtgtgtcaggccct

SEQ ID NO: 999994 - DNA, 21 bp, Homo sapiens
ccttgtgtgtcaggccctctg

SEQ ID NO: 999995 - DNA, 22 bp, Homo sapiens
ccttgtgtgtcaggccctctgc

SEQ ID NO: 999996 - DNA, 23 bp, Homo sapiens
ccttgtgtgtcaggccctctgcc

SEQ ID NO: 999997 - DNA, 22 bp, Homo sapiens
ccttgtgtgtgccctgggccag

SEQ ID NO: 999998 - DNA, 20 bp, Homo sapiens
ccttgtgttgcactgaacag

SEQ ID NO: 999999 - DNA, 21 bp, Homo sapiens
ccttgtgttgcactgaacagg

SEQ ID NO: 1000000 - DNA, 18 bp, Homo sapiens
ccttgttagaatgcaagc

SEQ ID NO: 1000001 - DNA, 15 bp, Homo sapiens
ccttgttccagcttt

SEQ ID NO: 1000002 - DNA, 20 bp, Homo sapiens
ccttgttccagctttgacgt

SEQ ID NO: 1000003 - DNA, 13 bp, Homo sapiens
ccttgttgcactg

SEQ ID NO: 1000004 - DNA, 18 bp, Homo sapiens
ccttgttgcactgccccc

SEQ ID NO: 1000005 - DNA, 19 bp, Homo sapiens
ccttgttgcactgccccct

SEQ ID NO: 1000006 - DNA, 22 bp, Homo sapiens
ccttgttgcactgccccctgct

SEQ ID NO: 1000007 - DNA, 17 bp, Homo sapiens
ccttgttggagcctgca

SEQ ID NO: 1000008 - DNA, 18 bp, Homo sapiens
ccttgtttatagccactt

SEQ ID NO: 1000009 - DNA, 20 bp, Homo sapiens
ccttgtttgagtttttcctc

SEQ ID NO: 1000010 - DNA, 21 bp, Homo sapiens
ccttgtttgagtttttcctcc

SEQ ID NO: 1000011 - DNA, 18 bp, Homo sapiens
ccttgttttcagcccccc

SEQ ID NO: 1000012 - DNA, 21 bp, Homo sapiens
cctttaaaacgcgtctgcctg

SEQ ID NO: 1000013 - DNA, 23 bp, Homo sapiens
cctttaaaacgcgtctgcctggg

SEQ ID NO: 1000014 - DNA, 23 bp, Homo sapiens
cctttaaaatatatgtctatata

SEQ ID NO: 1000015 - DNA, 20 bp, Homo sapiens
cctttaactgacaagccatc

SEQ ID NO: 1000016 - DNA, 11 bp, Homo sapiens
cctttgccttt

SEQ ID NO: 1000017 - DNA, 21 bp, Homo sapiens
cctttgcctttcttctgccct

SEQ ID NO: 1000018 - DNA, 13 bp, Homo sapiens
cctttgctctgga

SEQ ID NO: 1000019 - DNA, 23 bp, Homo sapiens
cctttgctgtgaggctgtcctgt

SEQ ID NO: 1000020 - DNA, 13 bp, Homo sapiens
cctttggaaagcc

SEQ ID NO: 1000021 - DNA, 18 bp, Homo sapiens
cctttggaacaagacagc

SEQ ID NO: 1000022 - DNA, 20 bp, Homo sapiens
cctttggaacaagacagcct

SEQ ID NO: 1000023 - DNA, 22 bp, Homo sapiens
cctttggacccagggcctgact

SEQ ID NO: 1000024 - DNA, 21 bp, Homo sapiens
cctttggagaacgccagtctc

SEQ ID NO: 1000025 - DNA, 18 bp, Homo sapiens
cctttggagcaaagaagg

SEQ ID NO: 1000026 - DNA, 16 bp, Homo sapiens
cctttggatgaccaga

SEQ ID NO: 1000027 - DNA, 17 bp, Homo sapiens
cctttggccaacagggt

SEQ ID NO: 1000028 - DNA, 22 bp, Homo sapiens
cctttggctggtagcagcaggc

SEQ ID NO: 1000029 - DNA, 18 bp, Homo sapiens
cctttgggatcagcctcc

SEQ ID NO: 1000030 - DNA, 11 bp, Homo sapiens
cctttgggggt

SEQ ID NO: 1000031 - DNA, 12 bp, Homo sapiens
cctttgggtgtg

SEQ ID NO: 1000032 - DNA, 15 bp, Homo sapiens
cctttggtgaattcc

SEQ ID NO: 1000033 - DNA, 17 bp, Homo sapiens
cctttggtgcagaggtt

SEQ ID NO: 1000034 - DNA, 16 bp, Homo sapiens
cctttggtttttttct

SEQ ID NO: 1000035 - DNA, 12 bp, Homo sapiens
cctttgtaacca

SEQ ID NO: 1000036 - DNA, 12 bp, Homo sapiens
cctttgtaagtt

SEQ ID NO: 1000037 - DNA, 14 bp, Homo sapiens
cctttgtaagttat

SEQ ID NO: 1000038 - DNA, 18 bp, Homo sapiens
cctttgtatgtggaagta

SEQ ID NO: 1000039 - DNA, 19 bp, Homo sapiens
cctttgtattataaaagct

SEQ ID NO: 1000040 - DNA, 15 bp, Homo sapiens
cctttgtattctctc

SEQ ID NO: 1000041 - DNA, 20 bp, Homo sapiens
cctttgtattctctcctgta

SEQ ID NO: 1000042 - DNA, 23 bp, Homo sapiens
cctttgtattctctcctgtacct

SEQ ID NO: 1000043 - DNA, 18 bp, Homo sapiens
cctttgtcatctttcttc

SEQ ID NO: 1000044 - DNA, 17 bp, Homo sapiens
cctttgtccccacacag

SEQ ID NO: 1000045 - DNA, 12 bp, Homo sapiens
cctttgtcctgc

SEQ ID NO: 1000046 - DNA, 15 bp, Homo sapiens
cctttgtctggatgc

SEQ ID NO: 1000047 - DNA, 20 bp, Homo sapiens
cctttgtcttgtacttctgt

SEQ ID NO: 1000048 - DNA, 19 bp, Homo sapiens
cctttgtcttttttttcat

SEQ ID NO: 1000049 - DNA, 20 bp, Homo sapiens
cctttgtcttttttttcatc

SEQ ID NO: 1000050 - DNA, 13 bp, Homo sapiens
cctttgtgagtca

SEQ ID NO: 1000051 - DNA, 16 bp, Homo sapiens
cctttgtgtggctcct

SEQ ID NO: 1000052 - DNA, 17 bp, Homo sapiens
cctttgtgtggctcctg

SEQ ID NO: 1000053 - DNA, 15 bp, Homo sapiens
cctttgtgtggctgc

SEQ ID NO: 1000054 - DNA, 20 bp, Homo sapiens
cctttgtgtggctgccccac

SEQ ID NO: 1000055 - DNA, 19 bp, Homo sapiens
cctttgttaaccttaaata

SEQ ID NO: 1000056 - DNA, 18 bp, Homo sapiens
cctttgtttccttgttgg

SEQ ID NO: 1000057 - DNA, 23 bp, Homo sapiens
cctttgttttgatgtttgtggcc

SEQ ID NO: 1000058 - DNA, 12 bp, Homo sapiens
ccttttaaagaa

SEQ ID NO: 1000059 - DNA, 15 bp, Homo sapiens
ccttttacattctgt

SEQ ID NO: 1000060 - DNA, 16 bp, Homo sapiens
ccttttacattctgtg

SEQ ID NO: 1000061 - DNA, 16 bp, Homo sapiens
ccttttaccactccca

SEQ ID NO: 1000062 - DNA, 15 bp, Homo sapiens
ccttttacccctgca

SEQ ID NO: 1000063 - DNA, 19 bp, Homo sapiens
ccttttactggttgcatgg

SEQ ID NO: 1000064 - DNA, 11 bp, Homo sapiens
ccttttacttt

SEQ ID NO: 1000065 - DNA, 22 bp, Homo sapiens
ccttttagtttgatcagacagc

SEQ ID NO: 1000066 - DNA, 18 bp, Homo sapiens
ccttttataaggaaactt

SEQ ID NO: 1000067 - DNA, 19 bp, Homo sapiens
ccttttatctgcagaacat

SEQ ID NO: 1000068 - DNA, 22 bp, Homo sapiens
ccttttatgtagtaattgacat

SEQ ID NO: 1000069 - DNA, 23 bp, Homo sapiens
ccttttattataagtcttacata

SEQ ID NO: 1000070 - DNA, 13 bp, Homo sapiens
ccttttcacggga

SEQ ID NO: 1000071 - DNA, 16 bp, Homo sapiens
ccttttcactttattg

SEQ ID NO: 1000072 - DNA, 12 bp, Homo sapiens
ccttttcagccc

SEQ ID NO: 1000073 - DNA, 10 bp, Homo sapiens
ccttttcata

SEQ ID NO: 1000074 - DNA, 11 bp, Homo sapiens
ccttttcatag

SEQ ID NO: 1000075 - DNA, 18 bp, Homo sapiens
ccttttcatctgttgttc

SEQ ID NO: 1000076 - DNA, 16 bp, Homo sapiens
ccttttccacacgcat

SEQ ID NO: 1000077 - DNA, 20 bp, Homo sapiens
ccttttccccaaccacagag

SEQ ID NO: 1000078 - DNA, 13 bp, Homo sapiens
ccttttccctgct

SEQ ID NO: 1000079 - DNA, 15 bp, Homo sapiens
ccttttccctgcttc

SEQ ID NO: 1000080 - DNA, 13 bp, Homo sapiens
ccttttctatgtt

SEQ ID NO: 1000081 - DNA, 14 bp, Homo sapiens
ccttttctatgttg

SEQ ID NO: 1000082 - DNA, 11 bp, Homo sapiens
ccttttctcag

SEQ ID NO: 1000083 - DNA, 14 bp, Homo sapiens
ccttttctcccatt

SEQ ID NO: 1000084 - DNA, 13 bp, Homo sapiens
ccttttctctgct

SEQ ID NO: 1000085 - DNA, 16 bp, Homo sapiens
ccttttctctgctctt

SEQ ID NO: 1000086 - DNA, 18 bp, Homo sapiens
ccttttctctgctcttgt

SEQ ID NO: 1000087 - DNA, 22 bp, Homo sapiens
ccttttctgcattttgctattg

SEQ ID NO: 1000088 - DNA, 18 bp, Homo sapiens
ccttttctggtccctctt

SEQ ID NO: 1000089 - DNA, 19 bp, Homo sapiens
ccttttctgtggctggctc

SEQ ID NO: 1000090 - DNA, 19 bp, Homo sapiens
caactgaataaattcagta

SEQ ID NO: 1000091 - DNA, 22 bp, Homo sapiens
caactgaataaattcagtattt

SEQ ID NO: 1000092 - DNA, 15 bp, Homo sapiens
caactgaccagcctc

SEQ ID NO: 1000093 - DNA, 17 bp, Homo sapiens
caactgaccagcctcca

SEQ ID NO: 1000094 - DNA, 18 bp, Homo sapiens
caactgacctgagcggca

SEQ ID NO: 1000095 - DNA, 16 bp, Homo sapiens
caactgagatgtcaga

SEQ ID NO: 1000096 - DNA, 20 bp, Homo sapiens
caactgaggcagacagcagc

SEQ ID NO: 1000097 - DNA, 22 bp, Homo sapiens
caactgaggcagacagcagctc

SEQ ID NO: 1000098 - DNA, 17 bp, Homo sapiens
caactgattttgtatgt

SEQ ID NO: 1000099 - DNA, 23 bp, Homo sapiens
caactgcaaagaaagtgggaggt

SEQ ID NO: 1000100 - DNA, 18 bp, Homo sapiens
caactgcacatgaaagtt

SEQ ID NO: 1000101 - DNA, 15 bp, Homo sapiens
caactgcataacctt

SEQ ID NO: 1000102 - DNA, 15 bp, Homo sapiens
caactgccccagggg

SEQ ID NO: 1000103 - DNA, 16 bp, Homo sapiens
caactgccccaggggg

SEQ ID NO: 1000104 - DNA, 15 bp, Homo sapiens
caactgccccgggtg

SEQ ID NO: 1000105 - DNA, 14 bp, Homo sapiens
caactgcccttcca

SEQ ID NO: 1000106 - DNA, 14 bp, Homo sapiens
caactgcctactcc

SEQ ID NO: 1000107 - DNA, 23 bp, Homo sapiens
caactgcctcgaaacacagaaac

SEQ ID NO: 1000108 - DNA, 18 bp, Homo sapiens
caactgctcagctctggt

SEQ ID NO: 1000109 - DNA, 19 bp, Homo sapiens
caactgctggggagacaaa

SEQ ID NO: 1000110 - DNA, 15 bp, Homo sapiens
caactgctgtggccc

SEQ ID NO: 1000111 - DNA, 18 bp, Homo sapiens
caactggagcaagaagga

SEQ ID NO: 1000112 - DNA, 15 bp, Homo sapiens
caactggccagccaa

SEQ ID NO: 1000113 - DNA, 19 bp, Homo sapiens
caactggccctatttagat

SEQ ID NO: 1000114 - DNA, 12 bp, Homo sapiens
caactggcttct

SEQ ID NO: 1000115 - DNA, 15 bp, Homo sapiens
caactggcttctgtg

SEQ ID NO: 1000116 - DNA, 13 bp, Homo sapiens
caactgggcccaa

SEQ ID NO: 1000117 - DNA, 21 bp, Homo sapiens
caactggggttgcgtctgagg

SEQ ID NO: 1000118 - DNA, 22 bp, Homo sapiens
caactggggttgcgtctgaggc

SEQ ID NO: 1000119 - DNA, 13 bp, Homo sapiens
caactgggtcatg

SEQ ID NO: 1000120 - DNA, 16 bp, Homo sapiens
caactggttagtgtga

SEQ ID NO: 1000121 - DNA, 14 bp, Homo sapiens
caactgtaaagcaa

SEQ ID NO: 1000122 - DNA, 12 bp, Homo sapiens
caactgtatata

SEQ ID NO: 1000123 - DNA, 19 bp, Homo sapiens
caactgttatgaaataaag

SEQ ID NO: 1000124 - DNA, 16 bp, Homo sapiens
caacttaacatgggct

SEQ ID NO: 1000125 - DNA, 14 bp, Homo sapiens
caacttaatggaaa

SEQ ID NO: 1000126 - DNA, 16 bp, Homo sapiens
caacttagaatagttt

SEQ ID NO: 1000127 - DNA, 19 bp, Homo sapiens
caacttagatctctcctgc

SEQ ID NO: 1000128 - DNA, 13 bp, Homo sapiens
caacttagctcag

SEQ ID NO: 1000129 - DNA, 18 bp, Homo sapiens
caacttagctcaggtgcc

SEQ ID NO: 1000130 - DNA, 16 bp, Homo sapiens
caacttatttaaaaat

SEQ ID NO: 1000131 - DNA, 21 bp, Homo sapiens
caacttatttaaaaatatttc

SEQ ID NO: 1000132 - DNA, 17 bp, Homo sapiens
caacttcaagtgcatgc

SEQ ID NO: 1000133 - DNA, 18 bp, Homo sapiens
caacttcaagtgcatgct

SEQ ID NO: 1000134 - DNA, 16 bp, Homo sapiens
caacttcaccaccccc

SEQ ID NO: 1000135 - DNA, 17 bp, Homo sapiens
caacttcaccaccccct

SEQ ID NO: 1000136 - DNA, 22 bp, Homo sapiens
caacttcaccaccccctgtccc

SEQ ID NO: 1000137 - DNA, 15 bp, Homo sapiens
caacttcagttttat

SEQ ID NO: 1000138 - DNA, 20 bp, Homo sapiens
caacttcagttttatttttg

SEQ ID NO: 1000139 - DNA, 21 bp, Homo sapiens
cgagctggtgcattacagaga

SEQ ID NO: 1000140 - DNA, 18 bp, Homo sapiens
cgagcttggccttgggcc

SEQ ID NO: 1000141 - DNA, 19 bp, Homo sapiens
cgagcttggccttgggccg

SEQ ID NO: 1000142 - DNA, 13 bp, Homo sapiens
cgagctttctctc

SEQ ID NO: 1000143 - DNA, 23 bp, Homo sapiens
cgaggaaaaggtccttgcctcct

SEQ ID NO: 1000144 - DNA, 13 bp, Homo sapiens
cgaggaaaggatt

SEQ ID NO: 1000145 - DNA, 16 bp, Homo sapiens
cgaggaaccagagcca

SEQ ID NO: 1000146 - DNA, 15 bp, Homo sapiens
cgaggaactccagga

SEQ ID NO: 1000147 - DNA, 16 bp, Homo sapiens
cgaggaatctgtgggt

SEQ ID NO: 1000148 - DNA, 22 bp, Homo sapiens
cgaggaatctgtgggtctggga

SEQ ID NO: 1000149 - DNA, 12 bp, Homo sapiens
cgaggacaggaa

SEQ ID NO: 1000150 - DNA, 14 bp, Homo sapiens
cgaggacaggaaag

SEQ ID NO: 1000151 - DNA, 20 bp, Homo sapiens
cgaggactttgattgcacat

SEQ ID NO: 1000152 - DNA, 19 bp, Homo sapiens
cgaggaggctccagagggc

SEQ ID NO: 1000153 - DNA, 20 bp, Homo sapiens
cgaggaggctccagagggca

SEQ ID NO: 1000154 - DNA, 21 bp, Homo sapiens
cgaggagtaacaatacaaatg

SEQ ID NO: 1000155 - DNA, 22 bp, Homo sapiens
cgaggagtaacaatacaaatgg

SEQ ID NO: 1000156 - DNA, 17 bp, Homo sapiens
cgaggattctgtgcctc

SEQ ID NO: 1000157 - DNA, 16 bp, Homo sapiens
cgaggcaccggcgctg

SEQ ID NO: 1000158 - DNA, 17 bp, Homo sapiens
cgaggcaccggcgctgc

SEQ ID NO: 1000159 - DNA, 14 bp, Homo sapiens
cgaggcagggtcag

SEQ ID NO: 1000160 - DNA, 22 bp, Homo sapiens
cgaggcagggtcaggagagggg

SEQ ID NO: 1000161 - DNA, 21 bp, Homo sapiens
cgaggcccagatccaaggccg

SEQ ID NO: 1000162 - DNA, 15 bp, Homo sapiens
cgaggcctacagagg

SEQ ID NO: 1000163 - DNA, 21 bp, Homo sapiens
cgaggcctacagaggaggcct

SEQ ID NO: 1000164 - DNA, 23 bp, Homo sapiens
cgaggcctacagaggaggcctca

SEQ ID NO: 1000165 - DNA, 23 bp, Homo sapiens
cgaggcctaccccgcagacacct

SEQ ID NO: 1000166 - DNA, 13 bp, Homo sapiens
cgaggcctgcaaa

SEQ ID NO: 1000167 - DNA, 21 bp, Homo sapiens
cgaggcctgcaaaccttcctg

SEQ ID NO: 1000168 - DNA, 13 bp, Homo sapiens
cgaggctccccgc

SEQ ID NO: 1000169 - DNA, 12 bp, Homo sapiens
cgaggctgcccc

SEQ ID NO: 1000170 - DNA, 15 bp, Homo sapiens
cgaggctgccccagg

SEQ ID NO: 1000171 - DNA, 19 bp, Homo sapiens
cgaggctgccccaggccgg

SEQ ID NO: 1000172 - DNA, 14 bp, Homo sapiens
cgaggctgccccca

SEQ ID NO: 1000173 - DNA, 21 bp, Homo sapiens
cgaggctgcccccatccagcc

SEQ ID NO: 1000174 - DNA, 23 bp, Homo sapiens
cgaggctgcccccatccagccac

SEQ ID NO: 1000175 - DNA, 15 bp, Homo sapiens
cgaggctgcttccca

SEQ ID NO: 1000176 - DNA, 21 bp, Homo sapiens
cgaggctggtggttttcagag

SEQ ID NO: 1000177 - DNA, 17 bp, Homo sapiens
cgagggatggtgcccct

SEQ ID NO: 1000178 - DNA, 18 bp, Homo sapiens
cgagggcaacagggagca

SEQ ID NO: 1000179 - DNA, 21 bp, Homo sapiens
cgagggcagggaccacaccct

SEQ ID NO: 1000180 - DNA, 15 bp, Homo sapiens
cgagggccgcctgcc

SEQ ID NO: 1000181 - DNA, 16 bp, Homo sapiens
cgagggccgcctgcct

SEQ ID NO: 1000182 - DNA, 17 bp, Homo sapiens
cgagggccgcctgcctt

SEQ ID NO: 1000183 - DNA, 14 bp, Homo sapiens
cgagggcggccagg

SEQ ID NO: 1000184 - DNA, 12 bp, Homo sapiens
cgagggctgagg

SEQ ID NO: 1000185 - DNA, 14 bp, Homo sapiens
cgagggctggctgg

SEQ ID NO: 1000186 - DNA, 18 bp, Homo sapiens
cgaggggagggtggcagg

SEQ ID NO: 1000187 - DNA, 22 bp, Homo sapiens
cgaggggcctcccggggcccag

SEQ ID NO: 1000188 - DNA, 20 bp, Homo sapiens
cgaggggctctcagctcagc

SEQ ID NO: 1000189 - DNA, 21 bp, Homo sapiens
cgagggggccggggggagggg

SEQ ID NO: 1000190 - DNA, 17 bp, Homo sapiens
cgagggtcacgcttgcc

SEQ ID NO: 1000191 - DNA, 23 bp, Homo sapiens
cgagggtcctggctcctgagggg

SEQ ID NO: 1000192 - DNA, 21 bp, Homo sapiens
cgagggtctcccctcctgcac

SEQ ID NO: 1000193 - DNA, 20 bp, Homo sapiens
cgaggtagagtttgaaggag

SEQ ID NO: 1000194 - DNA, 15 bp, Homo sapiens
cgaggtcaacagaga

SEQ ID NO: 1000195 - DNA, 16 bp, Homo sapiens
cgaggtcaacagagaa

SEQ ID NO: 1000196 - DNA, 23 bp, Homo sapiens
cgaggtcaacagagaaggcagga

SEQ ID NO: 1000197 - DNA, 13 bp, Homo sapiens
cgaggtcaggaga

SEQ ID NO: 1000198 - DNA, 14 bp, Homo sapiens
cgaggtccagaccc

SEQ ID NO: 1000199 - DNA, 23 bp, Homo sapiens
cgaggtggatcacagaggcttct

SEQ ID NO: 1000200 - DNA, 16 bp, Homo sapiens
cgaggtgtcaccctgc

SEQ ID NO: 1000201 - DNA, 19 bp, Homo sapiens
cgaggtgtcaccctgcaga

SEQ ID NO: 1000202 - DNA, 17 bp, Homo sapiens
cgagtaaacttgaaaag

SEQ ID NO: 1000203 - DNA, 15 bp, Homo sapiens
cgagtaatatgcctg

SEQ ID NO: 1000204 - DNA, 12 bp, Homo sapiens
cgagtacctcca

SEQ ID NO: 1000205 - DNA, 19 bp, Homo sapiens
cgagtagagaggcccgccc

SEQ ID NO: 1000206 - DNA, 14 bp, Homo sapiens
cgagtagctgggat

SEQ ID NO: 1000207 - DNA, 22 bp, Homo sapiens
cgagtcacacccggtggctctg

SEQ ID NO: 1000208 - DNA, 14 bp, Homo sapiens
cgagtcacattctg

SEQ ID NO: 1000209 - DNA, 15 bp, Homo sapiens
cgagtcacattctgc

SEQ ID NO: 1000210 - DNA, 16 bp, Homo sapiens
cgagtcacattctgct

SEQ ID NO: 1000211 - DNA, 17 bp, Homo sapiens
cgagtcacattctgctt

SEQ ID NO: 1000212 - DNA, 19 bp, Homo sapiens
cgagtcaccctcctcacag

SEQ ID NO: 1000213 - DNA, 15 bp, Homo sapiens
cgagtcacctgcaag

SEQ ID NO: 1000214 - DNA, 16 bp, Homo sapiens
cgagtcacctgcaagc

SEQ ID NO: 1000215 - DNA, 19 bp, Homo sapiens
cgagtcattcgttctgtgg

SEQ ID NO: 1000216 - DNA, 14 bp, Homo sapiens
cgagtccaagctgg

SEQ ID NO: 1000217 - DNA, 13 bp, Homo sapiens
cgagtccaaggcc

SEQ ID NO: 1000218 - DNA, 17 bp, Homo sapiens
cgagtccgcccatccct

SEQ ID NO: 1000219 - DNA, 14 bp, Homo sapiens
cgagtctttgtgtg

SEQ ID NO: 1000220 - DNA, 14 bp, Homo sapiens
cgagtgaatttcta

SEQ ID NO: 1000221 - DNA, 11 bp, Homo sapiens
cgagtgccagg

SEQ ID NO: 1000222 - DNA, 14 bp, Homo sapiens
cgagtgccaggact

SEQ ID NO: 1000223 - DNA, 22 bp, Homo sapiens
cgagtgcccctgtcccacctgg

SEQ ID NO: 1000224 - DNA, 19 bp, Homo sapiens
cgagtggtttcggaaaaaa

SEQ ID NO: 1000225 - DNA, 21 bp, Homo sapiens
cgagtttggatgttgtaaata

SEQ ID NO: 1000226 - DNA, 17 bp, Homo sapiens
caagattcccagagaca

SEQ ID NO: 1000227 - DNA, 18 bp, Homo sapiens
caagattctaaagctcaa

SEQ ID NO: 1000228 - DNA, 12 bp, Homo sapiens
caagattgaaaa

SEQ ID NO: 1000229 - DNA, 20 bp, Homo sapiens
caagattgagctctctgccc

SEQ ID NO: 1000230 - DNA, 16 bp, Homo sapiens
caagattgcttaaaat

SEQ ID NO: 1000231 - DNA, 19 bp, Homo sapiens
caagattggaaagacagga

SEQ ID NO: 1000232 - DNA, 22 bp, Homo sapiens
caagattggaaagacaggaaga

SEQ ID NO: 1000233 - DNA, 14 bp, Homo sapiens
caagatttagaaaa

SEQ ID NO: 1000234 - DNA, 15 bp, Homo sapiens
caagatttagaaaaa

SEQ ID NO: 1000235 - DNA, 12 bp, Homo sapiens
caagattttagg

SEQ ID NO: 1000236 - DNA, 14 bp, Homo sapiens
caagattttagggc

SEQ ID NO: 1000237 - DNA, 21 bp, Homo sapiens
caagattttagggcttttatt

SEQ ID NO: 1000238 - DNA, 18 bp, Homo sapiens
caagattttccacaagat

SEQ ID NO: 1000239 - DNA, 19 bp, Homo sapiens
caagattttttaattgttt

SEQ ID NO: 1000240 - DNA, 21 bp, Homo sapiens
caagattttttaattgtttaa

SEQ ID NO: 1000241 - DNA, 21 bp, Homo sapiens
caagattttttttttaagtga

SEQ ID NO: 1000242 - DNA, 18 bp, Homo sapiens
caagcaaacatcaaataa

SEQ ID NO: 1000243 - DNA, 18 bp, Homo sapiens
caagcaatccatgatcta

SEQ ID NO: 1000244 - DNA, 15 bp, Homo sapiens
caagcaatcctcctg

SEQ ID NO: 1000245 - DNA, 20 bp, Homo sapiens
caagcaatcctcctgcctca

SEQ ID NO: 1000246 - DNA, 22 bp, Homo sapiens
caagcaatcctcctgcctcagc

SEQ ID NO: 1000247 - DNA, 14 bp, Homo sapiens
caagcacagagcct

SEQ ID NO: 1000248 - DNA, 21 bp, Homo sapiens
caagcacagagcctggcccca

SEQ ID NO: 1000249 - DNA, 12 bp, Homo sapiens
caagcacagcag

SEQ ID NO: 1000250 - DNA, 14 bp, Homo sapiens
caagcacagcagcc

SEQ ID NO: 1000251 - DNA, 18 bp, Homo sapiens
caagcacatgtaataaat

SEQ ID NO: 1000252 - DNA, 16 bp, Homo sapiens
caagcacgaggcctca

SEQ ID NO: 1000253 - DNA, 19 bp, Homo sapiens
caagcactcgagaccatcc

SEQ ID NO: 1000254 - DNA, 20 bp, Homo sapiens
caagcactcgagaccatcct

SEQ ID NO: 1000255 - DNA, 14 bp, Homo sapiens
caagcagactccag

SEQ ID NO: 1000256 - DNA, 15 bp, Homo sapiens
caagcagactccagc

SEQ ID NO: 1000257 - DNA, 17 bp, Homo sapiens
caagcagactccagccc

SEQ ID NO: 1000258 - DNA, 22 bp, Homo sapiens
caagcagactccagcccctgga

SEQ ID NO: 1000259 - DNA, 23 bp, Homo sapiens
caagcagactccagcccctggac

SEQ ID NO: 1000260 - DNA, 17 bp, Homo sapiens
caagcagaggtggccag

SEQ ID NO: 1000261 - DNA, 22 bp, Homo sapiens
caagcttaatagccctccccct

SEQ ID NO: 1000262 - DNA, 19 bp, Homo sapiens
caagcttccctccatcccc

SEQ ID NO: 1000263 - DNA, 14 bp, Homo sapiens
caagcttcctgtgc

SEQ ID NO: 1000264 - DNA, 19 bp, Homo sapiens
caagcttcctgtgccctca

SEQ ID NO: 1000265 - DNA, 16 bp, Homo sapiens
caagcttggcagccga

SEQ ID NO: 1000266 - DNA, 15 bp, Homo sapiens
caagcttgtgtactt

SEQ ID NO: 1000267 - DNA, 14 bp, Homo sapiens
caagctttaaatta

SEQ ID NO: 1000268 - DNA, 15 bp, Homo sapiens
caaggaaaattgaaa

SEQ ID NO: 1000269 - DNA, 17 bp, Homo sapiens
caaggaaaattgaaagt

SEQ ID NO: 1000270 - DNA, 16 bp, Homo sapiens
caaggaaacaggctcc

SEQ ID NO: 1000271 - DNA, 15 bp, Homo sapiens
caaggaaacatttta

SEQ ID NO: 1000272 - DNA, 18 bp, Homo sapiens
caaggaaaggctcattta

SEQ ID NO: 1000273 - DNA, 20 bp, Homo sapiens
caaggaaaggctcatttaaa

SEQ ID NO: 1000274 - DNA, 23 bp, Homo sapiens
caaggaaagggggtcccagtggg

SEQ ID NO: 1000275 - DNA, 16 bp, Homo sapiens
caaggaaccctcaggc

SEQ ID NO: 1000276 - DNA, 22 bp, Homo sapiens
caaggaaccctcaggccaccct

SEQ ID NO: 1000277 - DNA, 24 bp, Homo sapiens
caaggaaccctcaggccaccctcc

SEQ ID NO: 1000278 - DNA, 11 bp, Homo sapiens
caaggaagaaa

SEQ ID NO: 1000279 - DNA, 15 bp, Homo sapiens
caaggaagaagaaat

SEQ ID NO: 1000280 - DNA, 17 bp, Homo sapiens
caaggaagatatacatg

SEQ ID NO: 1000281 - DNA, 13 bp, Homo sapiens
caaggaagcagcc

SEQ ID NO: 1000282 - DNA, 18 bp, Homo sapiens
caaggaagcagcctcaga

SEQ ID NO: 1000283 - DNA, 18 bp, Homo sapiens
caaggaagccaaagtttt

SEQ ID NO: 1000284 - DNA, 11 bp, Homo sapiens
caaggaagctc

SEQ ID NO: 1000285 - DNA, 16 bp, Homo sapiens
caaggaagctccttcc

SEQ ID NO: 1000286 - DNA, 17 bp, Homo sapiens
caaggaagctccttcct

SEQ ID NO: 1000287 - DNA, 12 bp, Homo sapiens
caaggaaggaaa

SEQ ID NO: 1000288 - DNA, 18 bp, Homo sapiens
caaggaaggaaagaaaga

SEQ ID NO: 1000289 - DNA, 23 bp, Homo sapiens
caaggaaggaaagaaagaaggaa

SEQ ID NO: 1000290 - DNA, 16 bp, Homo sapiens
caaggaaggagcccct

SEQ ID NO: 1000291 - DNA, 20 bp, Homo sapiens
caaggaagggatgtatttgt

SEQ ID NO: 1000292 - DNA, 23 bp, Homo sapiens
caaggaaggttcatgtagagaaa

SEQ ID NO: 1000293 - DNA, 12 bp, Homo sapiens
caaggaagtcaa

SEQ ID NO: 1000294 - DNA, 20 bp, Homo sapiens
caaggaataaatgagaggga

SEQ ID NO: 1000295 - DNA, 23 bp, Homo sapiens
caaggaatccatcctgcaaaggc

SEQ ID NO: 1000296 - DNA, 16 bp, Homo sapiens
caaggaatgtgtccaa

SEQ ID NO: 1000297 - DNA, 16 bp, Homo sapiens
caaggaatttcttaac

SEQ ID NO: 1000298 - DNA, 18 bp, Homo sapiens
caaggaatttcttaactt

SEQ ID NO: 1000299 - DNA, 12 bp, Homo sapiens
caaggacaggag

SEQ ID NO: 1000300 - DNA, 16 bp, Homo sapiens
caaggacagggctgag

SEQ ID NO: 1000301 - DNA, 18 bp, Homo sapiens
caaggacagggctgagcg

SEQ ID NO: 1000302 - DNA, 20 bp, Homo sapiens
caaggacattgtatgcaggg

SEQ ID NO: 1000303 - DNA, 21 bp, Homo sapiens
caaggacattgtatgcaggga

SEQ ID NO: 1000304 - DNA, 20 bp, Homo sapiens
caaggaccaggactccctcc

SEQ ID NO: 1000305 - DNA, 13 bp, Homo sapiens
caaggacccctca

SEQ ID NO: 1000306 - DNA, 15 bp, Homo sapiens
caaggacccctcacc

SEQ ID NO: 1000307 - DNA, 20 bp, Homo sapiens
caaggacccctcaccttgca

SEQ ID NO: 1000308 - DNA, 22 bp, Homo sapiens
caaggactgcagggactgccag

SEQ ID NO: 1000309 - DNA, 14 bp, Homo sapiens
caaggactgccgac

SEQ ID NO: 1000310 - DNA, 19 bp, Homo sapiens
caaggactgtttcagtgtg

SEQ ID NO: 1000311 - DNA, 18 bp, Homo sapiens
caaggacttgaaagcatc

SEQ ID NO: 1000312 - DNA, 20 bp, Homo sapiens
caaggacttgaaagcatcca

SEQ ID NO: 1000313 - DNA, 16 bp, Homo sapiens
caaggagaaacagaga

SEQ ID NO: 1000314 - DNA, 16 bp, Homo sapiens
caaggagaccaagtcc

SEQ ID NO: 1000315 - DNA, 13 bp, Homo sapiens
caaggagatttct

SEQ ID NO: 1000316 - DNA, 16 bp, Homo sapiens
caaggagcacaggtcc

SEQ ID NO: 1000317 - DNA, 14 bp, Homo sapiens
caaggagctactga

SEQ ID NO: 1000318 - DNA, 20 bp, Homo sapiens
caaggagctactgacattcc

SEQ ID NO: 1000319 - DNA, 14 bp, Homo sapiens
caaggagctcaccc

SEQ ID NO: 1000320 - DNA, 19 bp, Homo sapiens
caaggagctcaccctgccc

SEQ ID NO: 1000321 - DNA, 21 bp, Homo sapiens
caaggagctcaccctgcccgc

SEQ ID NO: 1000322 - DNA, 19 bp, Homo sapiens
caaggagcttacccaagct

SEQ ID NO: 1000323 - DNA, 12 bp, Homo sapiens
caaggaggaaaa

SEQ ID NO: 1000324 - DNA, 14 bp, Homo sapiens
caaggaggaaaaac

SEQ ID NO: 1000325 - DNA, 13 bp, Homo sapiens
caaggaggcctgg

SEQ ID NO: 1000326 - DNA, 12 bp, Homo sapiens
caaggaggggcc

SEQ ID NO: 1000327 - DNA, 17 bp, Homo sapiens
caaggaggtagagaggg

SEQ ID NO: 1000328 - DNA, 18 bp, Homo sapiens
caaggagtcactgagacc

SEQ ID NO: 1000329 - DNA, 17 bp, Homo sapiens
caaggagtgtaaaatgt

SEQ ID NO: 1000330 - DNA, 19 bp, Homo sapiens
caaggagttccatgaagac

SEQ ID NO: 1000331 - DNA, 14 bp, Homo sapiens
caaggagttctctt

SEQ ID NO: 1000332 - DNA, 16 bp, Homo sapiens
caaggagttctcttcc

SEQ ID NO: 1000333 - DNA, 17 bp, Homo sapiens
caaggatcaggctgctg

SEQ ID NO: 1000334 - DNA, 19 bp, Homo sapiens
caaggatcaggctgctgga

SEQ ID NO: 1000335 - DNA, 19 bp, Homo sapiens
caaggatgggccatctggg

SEQ ID NO: 1000336 - DNA, 21 bp, Homo sapiens
caaggatgggccatctggggt

SEQ ID NO: 1000337 - DNA, 13 bp, Homo sapiens
caaggcaaatgtt

SEQ ID NO: 1000338 - DNA, 14 bp, Homo sapiens
caaggcaagcattt

SEQ ID NO: 1000339 - DNA, 16 bp, Homo sapiens
caaggcaaggcaggtg

SEQ ID NO: 1000340 - DNA, 13 bp, Homo sapiens
caaggcagaggcc

SEQ ID NO: 1000341 - DNA, 20 bp, Homo sapiens
caaggcagaggcctgggctg

SEQ ID NO: 1000342 - DNA, 12 bp, Homo sapiens
caaggcagcctc

SEQ ID NO: 1000343 - DNA, 13 bp, Homo sapiens
caaggcagcctcc

SEQ ID NO: 1000344 - DNA, 22 bp, Homo sapiens
caaggcagcctccagagccagc

SEQ ID NO: 1000345 - DNA, 21 bp, Homo sapiens
caaggcagctcttctggagtt

SEQ ID NO: 1000346 - DNA, 22 bp, Homo sapiens
caaggcagctcttctggagttt

SEQ ID NO: 1000347 - DNA, 16 bp, Homo sapiens
caaggcagggaaagga

SEQ ID NO: 1000348 - DNA, 15 bp, Homo sapiens
caaggcaggtgcctc

SEQ ID NO: 1000349 - DNA, 16 bp, Homo sapiens
caaggcaggtgcctcc

SEQ ID NO: 1000350 - DNA, 18 bp, Homo sapiens
caaggcaggttggatggg

SEQ ID NO: 1000351 - DNA, 13 bp, Homo sapiens
caaggcagtgcat

SEQ ID NO: 1000352 - DNA, 14 bp, Homo sapiens
caaggcattcctca

SEQ ID NO: 1000353 - DNA, 15 bp, Homo sapiens
caaggccacaaaaac

SEQ ID NO: 1000354 - DNA, 18 bp, Homo sapiens
caaggccacaaaaacaat

SEQ ID NO: 1000355 - DNA, 16 bp, Homo sapiens
caaggccagaaggagg

SEQ ID NO: 1000356 - DNA, 11 bp, Homo sapiens
cgcagtgtctc

SEQ ID NO: 1000357 - DNA, 17 bp, Homo sapiens
cgcagtgtgcactaagg

SEQ ID NO: 1000358 - DNA, 22 bp, Homo sapiens
cgcatacacacatgccctcctg

SEQ ID NO: 1000359 - DNA, 13 bp, Homo sapiens
cgcatatgcatgc

SEQ ID NO: 1000360 - DNA, 14 bp, Homo sapiens
cgcatatgcatgcc

SEQ ID NO: 1000361 - DNA, 15 bp, Homo sapiens
cgcatatgcatgcca

SEQ ID NO: 1000362 - DNA, 13 bp, Homo sapiens
cgcatcccatctc

SEQ ID NO: 1000363 - DNA, 15 bp, Homo sapiens
cgcatccgtcctggg

SEQ ID NO: 1000364 - DNA, 14 bp, Homo sapiens
cgcatcctatgctt

SEQ ID NO: 1000365 - DNA, 20 bp, Homo sapiens
cgcatctcaaaacagagggc

SEQ ID NO: 1000366 - DNA, 18 bp, Homo sapiens
cgcatgagtatctgtggg

SEQ ID NO: 1000367 - DNA, 14 bp, Homo sapiens
cgcatgctcagtgc

SEQ ID NO: 1000368 - DNA, 19 bp, Homo sapiens
cgcatggtcacacactgat

SEQ ID NO: 1000369 - DNA, 21 bp, Homo sapiens
cgcatgtctgcacctccgctt

SEQ ID NO: 1000370 - DNA, 13 bp, Homo sapiens
cgcattaagaggt

SEQ ID NO: 1000371 - DNA, 15 bp, Homo sapiens
cgcattaagcacaca

SEQ ID NO: 1000372 - DNA, 13 bp, Homo sapiens
cgcattccctgag

SEQ ID NO: 1000373 - DNA, 21 bp, Homo sapiens
cgcatttctcatgcttcttct

SEQ ID NO: 1000374 - DNA, 20 bp, Homo sapiens
cgccaaagtgcagcccttcc

SEQ ID NO: 1000375 - DNA, 22 bp, Homo sapiens
cgccaaatgttcatcctcattg

SEQ ID NO: 1000376 - DNA, 13 bp, Homo sapiens
cgccaacttctcc

SEQ ID NO: 1000377 - DNA, 19 bp, Homo sapiens
cgccaaggaggtgggccac

SEQ ID NO: 1000378 - DNA, 23 bp, Homo sapiens
cgccaaggctgggggaagaagct

SEQ ID NO: 1000379 - DNA, 21 bp, Homo sapiens
cgccaaggtagccatcccatg

SEQ ID NO: 1000380 - DNA, 22 bp, Homo sapiens
cgccaaggtagccatcccatga

SEQ ID NO: 1000381 - DNA, 16 bp, Homo sapiens
cgccaagtgcgtgccg

SEQ ID NO: 1000382 - DNA, 23 bp, Homo sapiens
cgccaataataaaaaacaagaaa

SEQ ID NO: 1000383 - DNA, 20 bp, Homo sapiens
cgccacatggtgtggccatc

SEQ ID NO: 1000384 - DNA, 13 bp, Homo sapiens
cgccaccatcctg

SEQ ID NO: 1000385 - DNA, 23 bp, Homo sapiens
cgccaccatcctgcagcctcctc

SEQ ID NO: 1000386 - DNA, 13 bp, Homo sapiens
cgccaccatgccc

SEQ ID NO: 1000387 - DNA, 12 bp, Homo sapiens
cgccacccccat

SEQ ID NO: 1000388 - DNA, 17 bp, Homo sapiens
cgccacccccatcttcc

SEQ ID NO: 1000389 - DNA, 20 bp, Homo sapiens
cgccacccccatcttccacc

SEQ ID NO: 1000390 - DNA, 23 bp, Homo sapiens
cgccacccccatcttccacctgt

SEQ ID NO: 1000391 - DNA, 13 bp, Homo sapiens
cgccacccgcagc

SEQ ID NO: 1000392 - DNA, 18 bp, Homo sapiens
cgccaccgccacccgcag

SEQ ID NO: 1000393 - DNA, 23 bp, Homo sapiens
cgccaccgcgggtgtgggaaagc

SEQ ID NO: 1000394 - DNA, 14 bp, Homo sapiens
cgccaccgtgcctg

SEQ ID NO: 1000395 - DNA, 15 bp, Homo sapiens
cgccacctcagggca

SEQ ID NO: 1000396 - DNA, 14 bp, Homo sapiens
cgccacgctcagtg

SEQ ID NO: 1000397 - DNA, 15 bp, Homo sapiens
cgccacgctcagtgc

SEQ ID NO: 1000398 - DNA, 16 bp, Homo sapiens
cgccacgctcagtgcc

SEQ ID NO: 1000399 - DNA, 12 bp, Homo sapiens
cgccacggccac

SEQ ID NO: 1000400 - DNA, 13 bp, Homo sapiens
cgccacggccacc

SEQ ID NO: 1000401 - DNA, 14 bp, Homo sapiens
cgccacggccaccc

SEQ ID NO: 1000402 - DNA, 18 bp, Homo sapiens
cgccacggccaccctcct

SEQ ID NO: 1000403 - DNA, 21 bp, Homo sapiens
cgccactacactccagcctga

SEQ ID NO: 1000404 - DNA, 22 bp, Homo sapiens
cgccactacactccagcctgag

SEQ ID NO: 1000405 - DNA, 18 bp, Homo sapiens
cgccactaggtgtcccca

SEQ ID NO: 1000406 - DNA, 19 bp, Homo sapiens
cgccactaggtgtccccaa

SEQ ID NO: 1000407 - DNA, 23 bp, Homo sapiens
cgccactaggtgtccccaacgtc

SEQ ID NO: 1000408 - DNA, 13 bp, Homo sapiens
cgccactcagcca

SEQ ID NO: 1000409 - DNA, 12 bp, Homo sapiens
cgccactcattt

SEQ ID NO: 1000410 - DNA, 17 bp, Homo sapiens
cgccactcatttcatct

SEQ ID NO: 1000411 - DNA, 15 bp, Homo sapiens
cgccactccctggga

SEQ ID NO: 1000412 - DNA, 13 bp, Homo sapiens
cgccactgcctcc

SEQ ID NO: 1000413 - DNA, 20 bp, Homo sapiens
cgccagaccccgtggctctg

SEQ ID NO: 1000414 - DNA, 17 bp, Homo sapiens
cgccagccccaagctgg

SEQ ID NO: 1000415 - DNA, 20 bp, Homo sapiens
cgccagccccgctcccacct

SEQ ID NO: 1000416 - DNA, 17 bp, Homo sapiens
cgccagcctcagtgcca

SEQ ID NO: 1000417 - DNA, 20 bp, Homo sapiens
cgccagcctcagtgccactt

SEQ ID NO: 1000418 - DNA, 21 bp, Homo sapiens
cgccagcctcctctggacggc

SEQ ID NO: 1000419 - DNA, 20 bp, Homo sapiens
cgccagcgacctctctgcct

SEQ ID NO: 1000420 - DNA, 19 bp, Homo sapiens
cgccagcgtgtggagcaga

SEQ ID NO: 1000421 - DNA, 21 bp, Homo sapiens
cgccagcgtgtggagcagagc

SEQ ID NO: 1000422 - DNA, 11 bp, Homo sapiens
cgccagctcct

SEQ ID NO: 1000423 - DNA, 19 bp, Homo sapiens
cgccaggaagccagagccc

SEQ ID NO: 1000424 - DNA, 12 bp, Homo sapiens
cgccaggactgt

SEQ ID NO: 1000425 - DNA, 21 bp, Homo sapiens
cgccaggatggaacacggcca

SEQ ID NO: 1000426 - DNA, 14 bp, Homo sapiens
cgccaggcagagct

SEQ ID NO: 1000427 - DNA, 16 bp, Homo sapiens
cgccaggcagagctga

SEQ ID NO: 1000428 - DNA, 16 bp, Homo sapiens
cgccaggctgaccaca

SEQ ID NO: 1000429 - DNA, 17 bp, Homo sapiens
cgccaggctgaccacag

SEQ ID NO: 1000430 - DNA, 20 bp, Homo sapiens
cgccaggctgaccacagcac

SEQ ID NO: 1000431 - DNA, 12 bp, Homo sapiens
cgccagggctgg

SEQ ID NO: 1000432 - DNA, 13 bp, Homo sapiens
cgccagggctggg

SEQ ID NO: 1000433 - DNA, 14 bp, Homo sapiens
cgccagtacttgtc

SEQ ID NO: 1000434 - DNA, 15 bp, Homo sapiens
cgccagtacttgtca

SEQ ID NO: 1000435 - DNA, 16 bp, Homo sapiens
cgccataggccaaggt

SEQ ID NO: 1000436 - DNA, 15 bp, Homo sapiens
cgccatccagggtct

SEQ ID NO: 1000437 - DNA, 17 bp, Homo sapiens
cgccatgctcctggccc

SEQ ID NO: 1000438 - DNA, 19 bp, Homo sapiens
cgccatggggtcggctcct

SEQ ID NO: 1000439 - DNA, 23 bp, Homo sapiens
cgccatgtgatggacactccagg

SEQ ID NO: 1000440 - DNA, 17 bp, Homo sapiens
cgccattgccaccagga

SEQ ID NO: 1000441 - DNA, 18 bp, Homo sapiens
cgccattgccaccaggag

SEQ ID NO: 1000442 - DNA, 14 bp, Homo sapiens
cgccatttcctcac

SEQ ID NO: 1000443 - DNA, 14 bp, Homo sapiens
cgcccaacccttcc

SEQ ID NO: 1000444 - DNA, 13 bp, Homo sapiens
cgcccaactccac

SEQ ID NO: 1000445 - DNA, 20 bp, Homo sapiens
cgcccacaggaagcctgcag

SEQ ID NO: 1000446 - DNA, 13 bp, Homo sapiens
cgcccacccagct

SEQ ID NO: 1000447 - DNA, 14 bp, Homo sapiens
cgcccacccagctg

SEQ ID NO: 1000448 - DNA, 15 bp, Homo sapiens
cgcccacccagctgg

SEQ ID NO: 1000449 - DNA, 16 bp, Homo sapiens
cgcccacccagctggt

SEQ ID NO: 1000450 - DNA, 13 bp, Homo sapiens
cgcccacccccac

SEQ ID NO: 1000451 - DNA, 22 bp, Homo sapiens
cgcccacctcagcctcccaaag

SEQ ID NO: 1000452 - DNA, 19 bp, Homo sapiens
cgcccacctcgctcccctc

SEQ ID NO: 1000453 - DNA, 18 bp, Homo sapiens
cgcccaccttcgggcagt

SEQ ID NO: 1000454 - DNA, 18 bp, Homo sapiens
cgcccacgccggcctctg

SEQ ID NO: 1000455 - DNA, 22 bp, Homo sapiens
cgcccacgccggcctctgctgc

SEQ ID NO: 1000456 - DNA, 15 bp, Homo sapiens
cgcccactgtcctgg

SEQ ID NO: 1000457 - DNA, 17 bp, Homo sapiens
cgcccactgtcctgggc

SEQ ID NO: 1000458 - DNA, 18 bp, Homo sapiens
cgcccactgtcctgggcg

SEQ ID NO: 1000459 - DNA, 20 bp, Homo sapiens
cgcccactgtcctgggcgcc

SEQ ID NO: 1000460 - DNA, 22 bp, Homo sapiens
cgcccactgtcctgggcgccct

SEQ ID NO: 1000461 - DNA, 12 bp, Homo sapiens
cgcccagacacc

SEQ ID NO: 1000462 - DNA, 21 bp, Homo sapiens
cgcccagacaccatgtgcaat

SEQ ID NO: 1000463 - DNA, 17 bp, Homo sapiens
cgcccagagctggcctc

SEQ ID NO: 1000464 - DNA, 18 bp, Homo sapiens
cgcccagagctggcctcc

SEQ ID NO: 1000465 - DNA, 15 bp, Homo sapiens
cgcccagcgctcgcc

SEQ ID NO: 1000466 - DNA, 16 bp, Homo sapiens
cgcccagcgctcgcca

SEQ ID NO: 1000467 - DNA, 17 bp, Homo sapiens
cgcccagctctcccaca

SEQ ID NO: 1000468 - DNA, 23 bp, Homo sapiens
cgcccaggcctgctggcatcagg

SEQ ID NO: 1000469 - DNA, 20 bp, Homo sapiens
cgcccaggctggagtgcagt

SEQ ID NO: 1000470 - DNA, 15 bp, Homo sapiens
cgcccagtccttcca

SEQ ID NO: 1000471 - DNA, 13 bp, Homo sapiens
cgcccatccctga

SEQ ID NO: 1000472 - DNA, 14 bp, Homo sapiens
cgcccatctcagga

SEQ ID NO: 1000473 - DNA, 13 bp, Homo sapiens
cgcccatgtgtga

SEQ ID NO: 1000474 - DNA, 13 bp, Homo sapiens
cgccccacctccc

SEQ ID NO: 1000475 - DNA, 21 bp, Homo sapiens
cgccccagatcaccagcccgg

SEQ ID NO: 1000476 - DNA, 19 bp, Homo sapiens
cgccccaggcttccgcgcc

SEQ ID NO: 1000477 - DNA, 19 bp, Homo sapiens
cgccccagtggcactgaag

SEQ ID NO: 1000478 - DNA, 22 bp, Homo sapiens
cgccccatccctgcttgcccgc

SEQ ID NO: 1000479 - DNA, 15 bp, Homo sapiens
cgcccccaccgggct

SEQ ID NO: 1000480 - DNA, 13 bp, Homo sapiens
cgcccccagtgtg

SEQ ID NO: 1000481 - DNA, 18 bp, Homo sapiens
caaggccagagtggcctg

SEQ ID NO: 1000482 - DNA, 19 bp, Homo sapiens
caaggccagagtggcctgg

SEQ ID NO: 1000483 - DNA, 21 bp, Homo sapiens
caaggccagagtggcctggcc

SEQ ID NO: 1000484 - DNA, 22 bp, Homo sapiens
caaggccagagtggcctggcca

SEQ ID NO: 1000485 - DNA, 20 bp, Homo sapiens
caaggccagtccccatttct

SEQ ID NO: 1000486 - DNA, 12 bp, Homo sapiens
caaggccccaga

SEQ ID NO: 1000487 - DNA, 15 bp, Homo sapiens
caaggccccagggac

SEQ ID NO: 1000488 - DNA, 17 bp, Homo sapiens
caaggccccagggacag

SEQ ID NO: 1000489 - DNA, 22 bp, Homo sapiens
caaggccctcagagatgatcag

SEQ ID NO: 1000490 - DNA, 21 bp, Homo sapiens
caaggccctcggagctggctg

SEQ ID NO: 1000491 - DNA, 13 bp, Homo sapiens
caaggccctgctt

SEQ ID NO: 1000492 - DNA, 20 bp, Homo sapiens
caaggccctgctttttttct

SEQ ID NO: 1000493 - DNA, 14 bp, Homo sapiens
caaggccctttcct

SEQ ID NO: 1000494 - DNA, 16 bp, Homo sapiens
caaggccgaagctctg

SEQ ID NO: 1000495 - DNA, 13 bp, Homo sapiens
caaggccgagggc

SEQ ID NO: 1000496 - DNA, 18 bp, Homo sapiens
caaggccgagggccaggc

SEQ ID NO: 1000497 - DNA, 11 bp, Homo sapiens
caaggcctccc

SEQ ID NO: 1000498 - DNA, 18 bp, Homo sapiens
caaggccttgcctggcct

SEQ ID NO: 1000499 - DNA, 20 bp, Homo sapiens
caaggccttgctcactcact

SEQ ID NO: 1000500 - DNA, 21 bp, Homo sapiens
caaggccttggtggagcagcc

SEQ ID NO: 1000501 - DNA, 19 bp, Homo sapiens
caaggcgtccgcgcgccag

SEQ ID NO: 1000502 - DNA, 18 bp, Homo sapiens
caaggctaacatcccact

SEQ ID NO: 1000503 - DNA, 16 bp, Homo sapiens
caaggctctcccctct

SEQ ID NO: 1000504 - DNA, 17 bp, Homo sapiens
caaggctctcccctctc

SEQ ID NO: 1000505 - DNA, 23 bp, Homo sapiens
caaggctgaccaagagagaaaga

SEQ ID NO: 1000506 - DNA, 14 bp, Homo sapiens
caagtcaaattaat

SEQ ID NO: 1000507 - DNA, 15 bp, Homo sapiens
caagtcaaattaata

SEQ ID NO: 1000508 - DNA, 12 bp, Homo sapiens
caagtcacagct

SEQ ID NO: 1000509 - DNA, 16 bp, Homo sapiens
caagtcacagctgcag

SEQ ID NO: 1000510 - DNA, 22 bp, Homo sapiens
caagtcactagaagtcctgctg

SEQ ID NO: 1000511 - DNA, 17 bp, Homo sapiens
caagtcacttaactata

SEQ ID NO: 1000512 - DNA, 21 bp, Homo sapiens
caagtcaggaatcattaattt

SEQ ID NO: 1000513 - DNA, 15 bp, Homo sapiens
caagtcaggccaggt

SEQ ID NO: 1000514 - DNA, 17 bp, Homo sapiens
caagtcaggccaggtgg

SEQ ID NO: 1000515 - DNA, 20 bp, Homo sapiens
caagtcataggttaatattt

SEQ ID NO: 1000516 - DNA, 12 bp, Homo sapiens
caagtcattgtt

SEQ ID NO: 1000517 - DNA, 18 bp, Homo sapiens
caagtccaacctgcctgt

SEQ ID NO: 1000518 - DNA, 19 bp, Homo sapiens
caagtccaacctgcctgtg

SEQ ID NO: 1000519 - DNA, 22 bp, Homo sapiens
caagtccattatgtaatagtga

SEQ ID NO: 1000520 - DNA, 19 bp, Homo sapiens
caagtccctgttttctgag

SEQ ID NO: 1000521 - DNA, 15 bp, Homo sapiens
caagtcctccctctc

SEQ ID NO: 1000522 - DNA, 19 bp, Homo sapiens
caagtcctgaagaggcggg

SEQ ID NO: 1000523 - DNA, 15 bp, Homo sapiens
caagtcctgtgaatt

SEQ ID NO: 1000524 - DNA, 18 bp, Homo sapiens
caagtccttgacctctat

SEQ ID NO: 1000525 - DNA, 22 bp, Homo sapiens
caagtctaaaaagacctggcct

SEQ ID NO: 1000526 - DNA, 24 bp, Homo sapiens
caagtctaaaaagacctggccttt

SEQ ID NO: 1000527 - DNA, 15 bp, Homo sapiens
caagtctagtcttct

SEQ ID NO: 1000528 - DNA, 17 bp, Homo sapiens
caagtctagtcttctgg

SEQ ID NO: 1000529 - DNA, 18 bp, Homo sapiens
caagtctcctagacactc

SEQ ID NO: 1000530 - DNA, 17 bp, Homo sapiens
caagtctccttcccctt

SEQ ID NO: 1000531 - DNA, 14 bp, Homo sapiens
caagtctctctgtg

SEQ ID NO: 1000532 - DNA, 22 bp, Homo sapiens
caagtctctctgtgaatacaat

SEQ ID NO: 1000533 - DNA, 14 bp, Homo sapiens
caagtcttaacaaa

SEQ ID NO: 1000534 - DNA, 22 bp, Homo sapiens
caagtcttgggtctgaatttat

SEQ ID NO: 1000535 - DNA, 22 bp, Homo sapiens
caagtctttgagatgcttctgg

SEQ ID NO: 1000536 - DNA, 19 bp, Homo sapiens
caagtgaacactagccaga

SEQ ID NO: 1000537 - DNA, 11 bp, Homo sapiens
caagtgaaggt

SEQ ID NO: 1000538 - DNA, 14 bp, Homo sapiens
caagtgaaggttta

SEQ ID NO: 1000539 - DNA, 19 bp, Homo sapiens
caagtgaccccagggcctg

SEQ ID NO: 1000540 - DNA, 17 bp, Homo sapiens
caagtgacgaaaacatt

SEQ ID NO: 1000541 - DNA, 22 bp, Homo sapiens
caagtgactctcctgcctcagc

SEQ ID NO: 1000542 - DNA, 18 bp, Homo sapiens
caagtgactgtatctgtg

SEQ ID NO: 1000543 - DNA, 21 bp, Homo sapiens
caagtgactgtatctgtgtag

SEQ ID NO: 1000544 - DNA, 14 bp, Homo sapiens
caagtgagaccctg

SEQ ID NO: 1000545 - DNA, 20 bp, Homo sapiens
caagtgagaggggagggagg

SEQ ID NO: 1000546 - DNA, 14 bp, Homo sapiens
caagtgagcagaga

SEQ ID NO: 1000547 - DNA, 19 bp, Homo sapiens
caagtgagtctggtggagg

SEQ ID NO: 1000548 - DNA, 21 bp, Homo sapiens
caagtgagtctggtggaggag

SEQ ID NO: 1000549 - DNA, 19 bp, Homo sapiens
caagtgagttgaatagttg

SEQ ID NO: 1000550 - DNA, 16 bp, Homo sapiens
caagtgataattttat

SEQ ID NO: 1000551 - DNA, 17 bp, Homo sapiens
caagtgatcctcacgcc

SEQ ID NO: 1000552 - DNA, 21 bp, Homo sapiens
caagtgatccttccacctcag

SEQ ID NO: 1000553 - DNA, 14 bp, Homo sapiens
caagtgattctcct

SEQ ID NO: 1000554 - DNA, 23 bp, Homo sapiens
caagtgattcttccacctcagcc

SEQ ID NO: 1000555 - DNA, 14 bp, Homo sapiens
caagtgcaatagat

SEQ ID NO: 1000556 - DNA, 23 bp, Homo sapiens
caagtgcaatagattactgatgt

SEQ ID NO: 1000557 - DNA, 14 bp, Homo sapiens
caagtgcacggggc

SEQ ID NO: 1000558 - DNA, 14 bp, Homo sapiens
caagtgcaggctgg

SEQ ID NO: 1000559 - DNA, 17 bp, Homo sapiens
caagtgcatgctctctg

SEQ ID NO: 1000560 - DNA, 17 bp, Homo sapiens
caagtgcatttttctta

SEQ ID NO: 1000561 - DNA, 22 bp, Homo sapiens
caagtgccactgcccgagctgg

SEQ ID NO: 1000562 - DNA, 23 bp, Homo sapiens
caagtgccactgcccgagctggt

SEQ ID NO: 1000563 - DNA, 17 bp, Homo sapiens
caagtgccagaggtggg

SEQ ID NO: 1000564 - DNA, 21 bp, Homo sapiens
caagtgccagaggtgggcagg

SEQ ID NO: 1000565 - DNA, 22 bp, Homo sapiens
caagtgccagaggtgggcaggt

SEQ ID NO: 1000566 - DNA, 17 bp, Homo sapiens
caagtgccgcaaattgt

SEQ ID NO: 1000567 - DNA, 12 bp, Homo sapiens
caagtgcctcac

SEQ ID NO: 1000568 - DNA, 15 bp, Homo sapiens
caagtgcctcttgtt

SEQ ID NO: 1000569 - DNA, 18 bp, Homo sapiens
caagtgcctcttgttgca

SEQ ID NO: 1000570 - DNA, 16 bp, Homo sapiens
caagtgcctgcttttg

SEQ ID NO: 1000571 - DNA, 14 bp, Homo sapiens
caagtgctgaacag

SEQ ID NO: 1000572 - DNA, 21 bp, Homo sapiens
caagtgctgcacaaaagcaga

SEQ ID NO: 1000573 - DNA, 19 bp, Homo sapiens
caagtgcttaaaaatactt

SEQ ID NO: 1000574 - DNA, 18 bp, Homo sapiens
caagtggacctcgtccca

SEQ ID NO: 1000575 - DNA, 12 bp, Homo sapiens
caagtggacctt

SEQ ID NO: 1000576 - DNA, 15 bp, Homo sapiens
caagtggatggccca

SEQ ID NO: 1000577 - DNA, 17 bp, Homo sapiens
caagtggatggcccagc

SEQ ID NO: 1000578 - DNA, 23 bp, Homo sapiens
caagtggatggcccagcaggcag

SEQ ID NO: 1000579 - DNA, 23 bp, Homo sapiens
caagtggatgggaatttgtcagc

SEQ ID NO: 1000580 - DNA, 20 bp, Homo sapiens
caagtggatgtttttaatga

SEQ ID NO: 1000581 - DNA, 15 bp, Homo sapiens
caagtggctccccac

SEQ ID NO: 1000582 - DNA, 21 bp, Homo sapiens
caagtgggcagtcaccaccca

SEQ ID NO: 1000583 - DNA, 16 bp, Homo sapiens
caagtggggctcgcca

SEQ ID NO: 1000584 - DNA, 17 bp, Homo sapiens
caagtggggctcgccat

SEQ ID NO: 1000585 - DNA, 21 bp, Homo sapiens
caagtggggctcgccatgccg

SEQ ID NO: 1000586 - DNA, 12 bp, Homo sapiens
caagtggggtgc

SEQ ID NO: 1000587 - DNA, 18 bp, Homo sapiens
caagtggggtgctgggag

SEQ ID NO: 1000588 - DNA, 14 bp, Homo sapiens
caagtggtcaggag

SEQ ID NO: 1000589 - DNA, 19 bp, Homo sapiens
caagtggtggtaaccctgg

SEQ ID NO: 1000590 - DNA, 20 bp, Homo sapiens
caagtggtggtaaccctggt

SEQ ID NO: 1000591 - DNA, 23 bp, Homo sapiens
caagtgtaaaatattttgaatca

SEQ ID NO: 1000592 - DNA, 13 bp, Homo sapiens
caagtgtcttcca

SEQ ID NO: 1000593 - DNA, 21 bp, Homo sapiens
caagtgtgggccactgtggtg

SEQ ID NO: 1000594 - DNA, 14 bp, Homo sapiens
caagtgtgtgcaca

SEQ ID NO: 1000595 - DNA, 22 bp, Homo sapiens
caagtgtgtgccaccatgcctc

SEQ ID NO: 1000596 - DNA, 13 bp, Homo sapiens
caagtgttcactg

SEQ ID NO: 1000597 - DNA, 15 bp, Homo sapiens
caagtgttcactgct

SEQ ID NO: 1000598 - DNA, 20 bp, Homo sapiens
caagtgttggtcagtagttt

SEQ ID NO: 1000599 - DNA, 20 bp, Homo sapiens
caagtgttttggagaaaaaa

SEQ ID NO: 1000600 - DNA, 14 bp, Homo sapiens
caagttaaataaat

SEQ ID NO: 1000601 - DNA, 16 bp, Homo sapiens
caagttagaaaacata

SEQ ID NO: 1000602 - DNA, 19 bp, Homo sapiens
caagttagctcaggaggct

SEQ ID NO: 1000603 - DNA, 16 bp, Homo sapiens
caagttataaatcaat

SEQ ID NO: 1000604 - DNA, 20 bp, Homo sapiens
caagttataaatcaatgtca

SEQ ID NO: 1000605 - DNA, 20 bp, Homo sapiens
caagttatattagtgaagat

SEQ ID NO: 1000606 - DNA, 17 bp, Homo sapiens
caagttatattgaatat

SEQ ID NO: 1000607 - DNA, 15 bp, Homo sapiens
caagttattttattt

SEQ ID NO: 1000608 - DNA, 15 bp, Homo sapiens
caagttcccaactga

SEQ ID NO: 1000609 - DNA, 15 bp, Homo sapiens
caagttcgtctgttg

SEQ ID NO: 1000610 - DNA, 18 bp, Homo sapiens
cgcctgtaatcccagcag

SEQ ID NO: 1000611 - DNA, 17 bp, Homo sapiens
cgcctgtaatcccagct

SEQ ID NO: 1000612 - DNA, 20 bp, Homo sapiens
cgcctgtagtcctagccact

SEQ ID NO: 1000613 - DNA, 17 bp, Homo sapiens
cgcctgtcctcctggaa

SEQ ID NO: 1000614 - DNA, 15 bp, Homo sapiens
cgcctgtgatgctgg

SEQ ID NO: 1000615 - DNA, 16 bp, Homo sapiens
cgcctgtgatgctggg

SEQ ID NO: 1000616 - DNA, 17 bp, Homo sapiens
cgcctgtgatgctgggc

SEQ ID NO: 1000617 - DNA, 18 bp, Homo sapiens
cgcctgtggagctcagcc

SEQ ID NO: 1000618 - DNA, 19 bp, Homo sapiens
cgcctgtggagctcagccc

SEQ ID NO: 1000619 - DNA, 14 bp, Homo sapiens
cgccttaagctgat

SEQ ID NO: 1000620 - DNA, 22 bp, Homo sapiens
cgccttcactccggtgtgcctg

SEQ ID NO: 1000621 - DNA, 18 bp, Homo sapiens
cgccttcatctgggacaa

SEQ ID NO: 1000622 - DNA, 18 bp, Homo sapiens
cgccttccaaaacctgct

SEQ ID NO: 1000623 - DNA, 22 bp, Homo sapiens
cgccttccctcactcttcctca

SEQ ID NO: 1000624 - DNA, 13 bp, Homo sapiens
cgccttccctcct

SEQ ID NO: 1000625 - DNA, 14 bp, Homo sapiens
cgccttccctcctg

SEQ ID NO: 1000626 - DNA, 16 bp, Homo sapiens
cgccttcctcctccac

SEQ ID NO: 1000627 - DNA, 16 bp, Homo sapiens
cgctgccacccacctc

SEQ ID NO: 1000628 - DNA, 20 bp, Homo sapiens
cgctgccacccacctccctg

SEQ ID NO: 1000629 - DNA, 14 bp, Homo sapiens
cgctgccagccttg

SEQ ID NO: 1000630 - DNA, 19 bp, Homo sapiens
cgctgccagctctgtatca

SEQ ID NO: 1000631 - DNA, 16 bp, Homo sapiens
cgctgcccctccccgt

SEQ ID NO: 1000632 - DNA, 20 bp, Homo sapiens
cgctgcccctccccgtccct

SEQ ID NO: 1000633 - DNA, 15 bp, Homo sapiens
cgctgcccgctcagc

SEQ ID NO: 1000634 - DNA, 14 bp, Homo sapiens
cgctgccctgcatg

SEQ ID NO: 1000635 - DNA, 16 bp, Homo sapiens
cgctgccctgcatgct

SEQ ID NO: 1000636 - DNA, 17 bp, Homo sapiens
cgctgccctgcatgctg

SEQ ID NO: 1000637 - DNA, 18 bp, Homo sapiens
cgctgccctttggccaac

SEQ ID NO: 1000638 - DNA, 15 bp, Homo sapiens
cgctgccgctgcacc

SEQ ID NO: 1000639 - DNA, 17 bp, Homo sapiens
cgctgcctaagtggctg

SEQ ID NO: 1000640 - DNA, 17 bp, Homo sapiens
cgctgcctcctgctctc

SEQ ID NO: 1000641 - DNA, 12 bp, Homo sapiens
cgctgcctcttg

SEQ ID NO: 1000642 - DNA, 16 bp, Homo sapiens
cgctgcctgccaaagt

SEQ ID NO: 1000643 - DNA, 14 bp, Homo sapiens
cgctgccttttgtt

SEQ ID NO: 1000644 - DNA, 21 bp, Homo sapiens
cgctgcgcggactcgccccca

SEQ ID NO: 1000645 - DNA, 19 bp, Homo sapiens
cgctgctacatcagactct

SEQ ID NO: 1000646 - DNA, 15 bp, Homo sapiens
cgctgctagagaagg

SEQ ID NO: 1000647 - DNA, 12 bp, Homo sapiens
cgctgctccttg

SEQ ID NO: 1000648 - DNA, 14 bp, Homo sapiens
cgctgctctagctg

SEQ ID NO: 1000649 - DNA, 17 bp, Homo sapiens
cgctgctctagctggca

SEQ ID NO: 1000650 - DNA, 12 bp, Homo sapiens
cgctgctgtgct

SEQ ID NO: 1000651 - DNA, 19 bp, Homo sapiens
cgctgctgtgctctgggga

SEQ ID NO: 1000652 - DNA, 15 bp, Homo sapiens
cgctgcttccaggct

SEQ ID NO: 1000653 - DNA, 12 bp, Homo sapiens
cgctggagccca

SEQ ID NO: 1000654 - DNA, 20 bp, Homo sapiens
cgctggaggatgtgggcagc

SEQ ID NO: 1000655 - DNA, 10 bp, Homo sapiens
cgctggccca

SEQ ID NO: 1000656 - DNA, 12 bp, Homo sapiens
cgctggcccagc

SEQ ID NO: 1000657 - DNA, 22 bp, Homo sapiens
cgctggctcacgcgttctggga

SEQ ID NO: 1000658 - DNA, 18 bp, Homo sapiens
cgctggctccctgggcag

SEQ ID NO: 1000659 - DNA, 11 bp, Homo sapiens
cgctgggaagg

SEQ ID NO: 1000660 - DNA, 22 bp, Homo sapiens
cgctgggatttcttcgctgctc

SEQ ID NO: 1000661 - DNA, 14 bp, Homo sapiens
cgctgggctgagcc

SEQ ID NO: 1000662 - DNA, 21 bp, Homo sapiens
cgctggggaagtacgtcccag

SEQ ID NO: 1000663 - DNA, 22 bp, Homo sapiens
cgctgggtcctaattaccagtc

SEQ ID NO: 1000664 - DNA, 16 bp, Homo sapiens
cgctgggtgcctgcag

SEQ ID NO: 1000665 - DNA, 22 bp, Homo sapiens
cgctgggtggttttttccccct

SEQ ID NO: 1000666 - DNA, 20 bp, Homo sapiens
cgctggtgcattctgtttcc

SEQ ID NO: 1000667 - DNA, 18 bp, Homo sapiens
cgctgtaccctttaagat

SEQ ID NO: 1000668 - DNA, 21 bp, Homo sapiens
cgctgtcaaggccgagggcca

SEQ ID NO: 1000669 - DNA, 13 bp, Homo sapiens
cgctgtcacaggc

SEQ ID NO: 1000670 - DNA, 14 bp, Homo sapiens
cgctgtcctgcgtt

SEQ ID NO: 1000671 - DNA, 18 bp, Homo sapiens
cgctgtcgccccaggccc

SEQ ID NO: 1000672 - DNA, 19 bp, Homo sapiens
cgctgtgagcccctggtcc

SEQ ID NO: 1000673 - DNA, 16 bp, Homo sapiens
cgctgtgatgctgtgt

SEQ ID NO: 1000674 - DNA, 21 bp, Homo sapiens
cgctgttgacatcagcctgct

SEQ ID NO: 1000675 - DNA, 20 bp, Homo sapiens
cgctgttggagcaaaccatt

SEQ ID NO: 1000676 - DNA, 21 bp, Homo sapiens
cgctgtttttgttgtgtgtgc

SEQ ID NO: 1000677 - DNA, 22 bp, Homo sapiens
cgcttaatccaatattttgcct

SEQ ID NO: 1000678 - DNA, 22 bp, Homo sapiens
cgcttactcctctgaccctcct

SEQ ID NO: 1000679 - DNA, 23 bp, Homo sapiens
cgcttagccccgctgagcttgga

SEQ ID NO: 1000680 - DNA, 17 bp, Homo sapiens
cgcttagcctgcctcac

SEQ ID NO: 1000681 - DNA, 19 bp, Homo sapiens
cgcttagcgctctggacag

SEQ ID NO: 1000682 - DNA, 19 bp, Homo sapiens
cgcttagtgctgctttgct

SEQ ID NO: 1000683 - DNA, 17 bp, Homo sapiens
cgcttagttcttgaatt

SEQ ID NO: 1000684 - DNA, 18 bp, Homo sapiens
cgcttagttcttgaattg

SEQ ID NO: 1000685 - DNA, 20 bp, Homo sapiens
cgcttatcaactaatgattt

SEQ ID NO: 1000686 - DNA, 22 bp, Homo sapiens
cgcttcaaggatatactgcagc

SEQ ID NO: 1000687 - DNA, 16 bp, Homo sapiens
cgcttcacccctgcac

SEQ ID NO: 1000688 - DNA, 17 bp, Homo sapiens
cgcttcgaactccaggc

SEQ ID NO: 1000689 - DNA, 19 bp, Homo sapiens
cgcttctccaatgctctgg

SEQ ID NO: 1000690 - DNA, 21 bp, Homo sapiens
cgcttctccaatgctctggag

SEQ ID NO: 1000691 - DNA, 19 bp, Homo sapiens
cgcttctgcagcctcggcc

SEQ ID NO: 1000692 - DNA, 15 bp, Homo sapiens
cgcttctgccttttc

SEQ ID NO: 1000693 - DNA, 15 bp, Homo sapiens
cgcttctgctggagg

SEQ ID NO: 1000694 - DNA, 20 bp, Homo sapiens
cgcttctgtgtatctctttc

SEQ ID NO: 1000695 - DNA, 16 bp, Homo sapiens
cgcttcttgcctctgt

SEQ ID NO: 1000696 - DNA, 18 bp, Homo sapiens
cgcttcttgcctctgtgc

SEQ ID NO: 1000697 - DNA, 13 bp, Homo sapiens
cgcttgagcccag

SEQ ID NO: 1000698 - DNA, 14 bp, Homo sapiens
cgcttggagcagag

SEQ ID NO: 1000699 - DNA, 20 bp, Homo sapiens
cgcttgtagaactcactctg

SEQ ID NO: 1000700 - DNA, 20 bp, Homo sapiens
cgcttgtccagcgcctagtg

SEQ ID NO: 1000701 - DNA, 13 bp, Homo sapiens
cgcttgtgacagt

SEQ ID NO: 1000702 - DNA, 14 bp, Homo sapiens
cgcttgtgacagtg

SEQ ID NO: 1000703 - DNA, 17 bp, Homo sapiens
cgcttgtgacagtgcct

SEQ ID NO: 1000704 - DNA, 19 bp, Homo sapiens
cgcttgtgacagtgcctct

SEQ ID NO: 1000705 - DNA, 14 bp, Homo sapiens
cgctttcctgaatc

SEQ ID NO: 1000706 - DNA, 17 bp, Homo sapiens
cgctttctaaagttacc

SEQ ID NO: 1000707 - DNA, 22 bp, Homo sapiens
cgctttctggaaaagaggagtt

SEQ ID NO: 1000708 - DNA, 21 bp, Homo sapiens
cgcttttgcagcagaggagct

SEQ ID NO: 1000709 - DNA, 17 bp, Homo sapiens
cggaaaaaaaaaaagaa

SEQ ID NO: 1000710 - DNA, 11 bp, Homo sapiens
cggaaacagaa

SEQ ID NO: 1000711 - DNA, 13 bp, Homo sapiens
cggaaacagaact

SEQ ID NO: 1000712 - DNA, 22 bp, Homo sapiens
cggaaacaggtgtgtgtgaact

SEQ ID NO: 1000713 - DNA, 13 bp, Homo sapiens
cggaaagtgagag

SEQ ID NO: 1000714 - DNA, 17 bp, Homo sapiens
cggaacccaagcttaga

SEQ ID NO: 1000715 - DNA, 16 bp, Homo sapiens
cggaactatgaaaagt

SEQ ID NO: 1000716 - DNA, 12 bp, Homo sapiens
cggaactgggct

SEQ ID NO: 1000717 - DNA, 17 bp, Homo sapiens
cggaactgggctggcgc

SEQ ID NO: 1000718 - DNA, 13 bp, Homo sapiens
cggaagagccttg

SEQ ID NO: 1000719 - DNA, 22 bp, Homo sapiens
cggaagcagtgccttccataat

SEQ ID NO: 1000720 - DNA, 11 bp, Homo sapiens
cggaagccata

SEQ ID NO: 1000721 - DNA, 12 bp, Homo sapiens
cggaagccatag

SEQ ID NO: 1000722 - DNA, 17 bp, Homo sapiens
cggaagccatagggggc

SEQ ID NO: 1000723 - DNA, 24 bp, Homo sapiens
cggaagccccctcttcctccctgg

SEQ ID NO: 1000724 - DNA, 21 bp, Homo sapiens
cggaagccgtctgactccaga

SEQ ID NO: 1000725 - DNA, 17 bp, Homo sapiens
cggaagcgccaggctgg

SEQ ID NO: 1000726 - DNA, 20 bp, Homo sapiens
cggaaggaatgtcagggcca

SEQ ID NO: 1000727 - DNA, 17 bp, Homo sapiens
cggaaggggttcctcaa

SEQ ID NO: 1000728 - DNA, 12 bp, Homo sapiens
cggaagttttca

SEQ ID NO: 1000729 - DNA, 13 bp, Homo sapiens
cggaagttttcaa

SEQ ID NO: 1000730 - DNA, 18 bp, Homo sapiens
cggacaaagttcagtgtc

SEQ ID NO: 1000731 - DNA, 16 bp, Homo sapiens
cggacaagacccccag

SEQ ID NO: 1000732 - DNA, 20 bp, Homo sapiens
cggacaagacccccagcact

SEQ ID NO: 1000733 - DNA, 13 bp, Homo sapiens
cggacaagtttta

SEQ ID NO: 1000734 - DNA, 20 bp, Homo sapiens
cggacaccgtggcctgggct

SEQ ID NO: 1000735 - DNA, 22 bp, Homo sapiens
cggacaggtggggcctcagcct

SEQ ID NO: 1000736 - DNA, 23 bp, Homo sapiens
cggacaggtggggcctcagcctg

SEQ ID NO: 1000737 - DNA, 20 bp, Homo sapiens
cggacatgcttttctgccac

SEQ ID NO: 1000738 - DNA, 21 bp, Homo sapiens
cggaccaccctcactggctct

SEQ ID NO: 1000739 - DNA, 21 bp, Homo sapiens
cggaccagcatctggaagatg

SEQ ID NO: 1000740 - DNA, 13 bp, Homo sapiens
caatatacgaaaa

SEQ ID NO: 1000741 - DNA, 15 bp, Homo sapiens
caatatacgaaaagc

SEQ ID NO: 1000742 - DNA, 23 bp, Homo sapiens
caatatatatttctttaaacctt

SEQ ID NO: 1000743 - DNA, 20 bp, Homo sapiens
caatatcatgtcttgtgcat

SEQ ID NO: 1000744 - DNA, 21 bp, Homo sapiens
caatatcatgtcttgtgcata

SEQ ID NO: 1000745 - DNA, 15 bp, Homo sapiens
caatatcccaacatt

SEQ ID NO: 1000746 - DNA, 17 bp, Homo sapiens
caatatcccaacattct

SEQ ID NO: 1000747 - DNA, 17 bp, Homo sapiens
caatatgcaagcagctt

SEQ ID NO: 1000748 - DNA, 20 bp, Homo sapiens
caatatgcaagcagcttttt

SEQ ID NO: 1000749 - DNA, 22 bp, Homo sapiens
cggctgggcctccttcttccac

SEQ ID NO: 1000750 - DNA, 16 bp, Homo sapiens
cggctggggacccacc

SEQ ID NO: 1000751 - DNA, 18 bp, Homo sapiens
caatgttctttgtctcaa

SEQ ID NO: 1000752 - DNA, 15 bp, Homo sapiens
caatgttgagaagtt

SEQ ID NO: 1000753 - DNA, 23 bp, Homo sapiens
caatgttgcatttatgatgcagt

SEQ ID NO: 1000754 - DNA, 23 bp, Homo sapiens
caatgttgctagttttttgcttc

SEQ ID NO: 1000755 - DNA, 15 bp, Homo sapiens
caatgttgtccaaca

SEQ ID NO: 1000756 - DNA, 17 bp, Homo sapiens
caatgttgttttaagac

SEQ ID NO: 1000757 - DNA, 21 bp, Homo sapiens
caatgtttatttcataaagaa

SEQ ID NO: 1000758 - DNA, 22 bp, Homo sapiens
caatgtttcttcatttctctgc

SEQ ID NO: 1000759 - DNA, 14 bp, Homo sapiens
caatgtttgatgtc

SEQ ID NO: 1000760 - DNA, 18 bp, Homo sapiens
caatgtttgggggaaaaa

SEQ ID NO: 1000761 - DNA, 14 bp, Homo sapiens
caatgttttcttca

SEQ ID NO: 1000762 - DNA, 17 bp, Homo sapiens
caatgtttttaaaaatc

SEQ ID NO: 1000763 - DNA, 11 bp, Homo sapiens
caattaaaata

SEQ ID NO: 1000764 - DNA, 19 bp, Homo sapiens
caattaaaattacaaaaga

SEQ ID NO: 1000765 - DNA, 13 bp, Homo sapiens
caattaaacagct

SEQ ID NO: 1000766 - DNA, 14 bp, Homo sapiens
caattaaacagctg

SEQ ID NO: 1000767 - DNA, 13 bp, Homo sapiens
caattaaaggtcc

SEQ ID NO: 1000768 - DNA, 22 bp, Homo sapiens
caattaaatgtaggtatgaata

SEQ ID NO: 1000769 - DNA, 18 bp, Homo sapiens
caattaataaaaaatgga

SEQ ID NO: 1000770 - DNA, 14 bp, Homo sapiens
caattaattgtctt

SEQ ID NO: 1000771 - DNA, 17 bp, Homo sapiens
caattactggtccaaaa

SEQ ID NO: 1000772 - DNA, 15 bp, Homo sapiens
caattagatttctca

SEQ ID NO: 1000773 - DNA, 15 bp, Homo sapiens
caattagcagaatgg

SEQ ID NO: 1000774 - DNA, 16 bp, Homo sapiens
caattaggaagtgtaa

SEQ ID NO: 1000775 - DNA, 22 bp, Homo sapiens
caattaggaagtgtaacagctg

SEQ ID NO: 1000776 - DNA, 20 bp, Homo sapiens
caattagtgatatagtgctg

SEQ ID NO: 1000777 - DNA, 18 bp, Homo sapiens
caattagtggtcataaaa

SEQ ID NO: 1000778 - DNA, 17 bp, Homo sapiens
caattagtttccttttt

SEQ ID NO: 1000779 - DNA, 21 bp, Homo sapiens
caattagtttcctttttaata

SEQ ID NO: 1000780 - DNA, 23 bp, Homo sapiens
caattatatcagtcctctttcaa

SEQ ID NO: 1000781 - DNA, 15 bp, Homo sapiens
caattatgaaaataa

SEQ ID NO: 1000782 - DNA, 16 bp, Homo sapiens
caattatgtctcttga

SEQ ID NO: 1000783 - DNA, 15 bp, Homo sapiens
caattattacattta

SEQ ID NO: 1000784 - DNA, 22 bp, Homo sapiens
caattattgttacacattaagt

SEQ ID NO: 1000785 - DNA, 18 bp, Homo sapiens
caattatttaaagaaagt

SEQ ID NO: 1000786 - DNA, 13 bp, Homo sapiens
caattatttttac

SEQ ID NO: 1000787 - DNA, 19 bp, Homo sapiens
caattcaagctgagaaaag

SEQ ID NO: 1000788 - DNA, 23 bp, Homo sapiens
caattcagacaggcaaataaaag

SEQ ID NO: 1000789 - DNA, 21 bp, Homo sapiens
caattccaagaaaatatcact

SEQ ID NO: 1000790 - DNA, 14 bp, Homo sapiens
caattcccccttaa

SEQ ID NO: 1000791 - DNA, 11 bp, Homo sapiens
caattcccctc

SEQ ID NO: 1000792 - DNA, 15 bp, Homo sapiens
caattcctagataaa

SEQ ID NO: 1000793 - DNA, 18 bp, Homo sapiens
caattcctagataaaaag

SEQ ID NO: 1000794 - DNA, 13 bp, Homo sapiens
caattctaaatcc

SEQ ID NO: 1000795 - DNA, 15 bp, Homo sapiens
caattctgactgtcc

SEQ ID NO: 1000796 - DNA, 13 bp, Homo sapiens
caattctggaagc

SEQ ID NO: 1000797 - DNA, 14 bp, Homo sapiens
caattctggaagct

SEQ ID NO: 1000798 - DNA, 17 bp, Homo sapiens
caattctgtaattacat

SEQ ID NO: 1000799 - DNA, 18 bp, Homo sapiens
caattctgtaattacata

SEQ ID NO: 1000800 - DNA, 12 bp, Homo sapiens
caattctgtccc

SEQ ID NO: 1000801 - DNA, 15 bp, Homo sapiens
caattctgtcccaat

SEQ ID NO: 1000802 - DNA, 16 bp, Homo sapiens
caattctgtccctgtc

SEQ ID NO: 1000803 - DNA, 21 bp, Homo sapiens
caattctgtccctgtccctgc

SEQ ID NO: 1000804 - DNA, 23 bp, Homo sapiens
caattctgtccctgtccctgccc

SEQ ID NO: 1000805 - DNA, 20 bp, Homo sapiens
caattgaaggatcatctgaa

SEQ ID NO: 1000806 - DNA, 22 bp, Homo sapiens
caattgaaggatcatctgaagg

SEQ ID NO: 1000807 - DNA, 21 bp, Homo sapiens
caattgaagtaaactttttgt

SEQ ID NO: 1000808 - DNA, 21 bp, Homo sapiens
caattgaattaaattaggaat

SEQ ID NO: 1000809 - DNA, 16 bp, Homo sapiens
caattgatacttcagg

SEQ ID NO: 1000810 - DNA, 22 bp, Homo sapiens
caattgatccttaaccaataat

SEQ ID NO: 1000811 - DNA, 20 bp, Homo sapiens
caattgatgttttacgtgca

SEQ ID NO: 1000812 - DNA, 14 bp, Homo sapiens
caattgattgtgaa

SEQ ID NO: 1000813 - DNA, 17 bp, Homo sapiens
caattgcatctcccaga

SEQ ID NO: 1000814 - DNA, 15 bp, Homo sapiens
caattgctcttctcc

SEQ ID NO: 1000815 - DNA, 17 bp, Homo sapiens
caattgctcttctccac

SEQ ID NO: 1000816 - DNA, 20 bp, Homo sapiens
caattgcttactcattaaaa

SEQ ID NO: 1000817 - DNA, 18 bp, Homo sapiens
caattggaagtctaagaa

SEQ ID NO: 1000818 - DNA, 21 bp, Homo sapiens
caattggcagtgactttgtat

SEQ ID NO: 1000819 - DNA, 16 bp, Homo sapiens
caattggcccaacact

SEQ ID NO: 1000820 - DNA, 17 bp, Homo sapiens
caattgggagctgccaa

SEQ ID NO: 1000821 - DNA, 21 bp, Homo sapiens
caattggtaaaactcactgtg

SEQ ID NO: 1000822 - DNA, 20 bp, Homo sapiens
caattggtgcttcagccctg

SEQ ID NO: 1000823 - DNA, 17 bp, Homo sapiens
caattggtggtaacagt

SEQ ID NO: 1000824 - DNA, 16 bp, Homo sapiens
caattggttaatcttt

SEQ ID NO: 1000825 - DNA, 14 bp, Homo sapiens
caattgtaaattga

SEQ ID NO: 1000826 - DNA, 12 bp, Homo sapiens
caattgtatttt

SEQ ID NO: 1000827 - DNA, 15 bp, Homo sapiens
caattgtcacttttt

SEQ ID NO: 1000828 - DNA, 16 bp, Homo sapiens
caattgtcacttttta

SEQ ID NO: 1000829 - DNA, 14 bp, Homo sapiens
caattgtcatttat

SEQ ID NO: 1000830 - DNA, 17 bp, Homo sapiens
caattgtcatttataaa

SEQ ID NO: 1000831 - DNA, 21 bp, Homo sapiens
caattgtgagccaccacgtcc

SEQ ID NO: 1000832 - DNA, 13 bp, Homo sapiens
caattgtgctgcc

SEQ ID NO: 1000833 - DNA, 16 bp, Homo sapiens
caattgtgctgccatt

SEQ ID NO: 1000834 - DNA, 16 bp, Homo sapiens
caattgtgtagccttt

SEQ ID NO: 1000835 - DNA, 18 bp, Homo sapiens
caattgtgtagccttttt

SEQ ID NO: 1000836 - DNA, 20 bp, Homo sapiens
caattgtgtagcctttttgt

SEQ ID NO: 1000837 - DNA, 14 bp, Homo sapiens
caattgttgacagt

SEQ ID NO: 1000838 - DNA, 23 bp, Homo sapiens
caattgttgacagttctgaagaa

SEQ ID NO: 1000839 - DNA, 15 bp, Homo sapiens
caatttaaaatattt

SEQ ID NO: 1000840 - DNA, 16 bp, Homo sapiens
caatttaaaatatttc

SEQ ID NO: 1000841 - DNA, 12 bp, Homo sapiens
caatttaaaatt

SEQ ID NO: 1000842 - DNA, 13 bp, Homo sapiens
caatttaaaatta

SEQ ID NO: 1000843 - DNA, 15 bp, Homo sapiens
caatttaaaattatt

SEQ ID NO: 1000844 - DNA, 13 bp, Homo sapiens
caatttaaatgtt

SEQ ID NO: 1000845 - DNA, 20 bp, Homo sapiens
caatttaatggatatttctc

SEQ ID NO: 1000846 - DNA, 13 bp, Homo sapiens
caatttaattcct

SEQ ID NO: 1000847 - DNA, 23 bp, Homo sapiens
caatttatatgcttcacatagca

SEQ ID NO: 1000848 - DNA, 14 bp, Homo sapiens
caatttatgaattg

SEQ ID NO: 1000849 - DNA, 13 bp, Homo sapiens
caatttatttgaa

SEQ ID NO: 1000850 - DNA, 15 bp, Homo sapiens
caatttatttgaatg

SEQ ID NO: 1000851 - DNA, 14 bp, Homo sapiens
caatttattttatt

SEQ ID NO: 1000852 - DNA, 11 bp, Homo sapiens
caatttcaagt

SEQ ID NO: 1000853 - DNA, 14 bp, Homo sapiens
caatttcaataaaa

SEQ ID NO: 1000854 - DNA, 12 bp, Homo sapiens
caatttcagctc

SEQ ID NO: 1000855 - DNA, 17 bp, Homo sapiens
caatttcccccctcgtg

SEQ ID NO: 1000856 - DNA, 16 bp, Homo sapiens
caatttcctttatatt

SEQ ID NO: 1000857 - DNA, 19 bp, Homo sapiens
caatttcctttatatttag

SEQ ID NO: 1000858 - DNA, 21 bp, Homo sapiens
caatttcctttatatttagtg

SEQ ID NO: 1000859 - DNA, 22 bp, Homo sapiens
caatttcggattttttccaaaa

SEQ ID NO: 1000860 - DNA, 17 bp, Homo sapiens
caatttctaatttttaa

SEQ ID NO: 1000861 - DNA, 20 bp, Homo sapiens
caatttctgtgttgccaagc

SEQ ID NO: 1000862 - DNA, 22 bp, Homo sapiens
caatttctgtgttgccaagctc

SEQ ID NO: 1000863 - DNA, 13 bp, Homo sapiens
caatttcttcctt

SEQ ID NO: 1000864 - DNA, 23 bp, Homo sapiens
caatttgagactgaaatttagta

SEQ ID NO: 1000865 - DNA, 19 bp, Homo sapiens
caatttgatacataataaa

SEQ ID NO: 1000866 - DNA, 18 bp, Homo sapiens
caatttggcaattttgtg

SEQ ID NO: 1000867 - DNA, 19 bp, Homo sapiens
caatttggcaattttgtgg

SEQ ID NO: 1000868 - DNA, 23 bp, Homo sapiens
caatttgtaaaaacagcattgct

SEQ ID NO: 1000869 - DNA, 23 bp, Homo sapiens
caatttgtaattgcttacatttt

SEQ ID NO: 1000870 - DNA, 22 bp, Homo sapiens
caatttgttaattcctatgaag

SEQ ID NO: 1000871 - DNA, 22 bp, Homo sapiens
cacaatcctaacacattatcgg

SEQ ID NO: 1000872 - DNA, 23 bp, Homo sapiens
cacaatcctaacacattatcggg

SEQ ID NO: 1000873 - DNA, 21 bp, Homo sapiens
cacaatcctccaagaatttga

SEQ ID NO: 1000874 - DNA, 15 bp, Homo sapiens
cacaatgaatgtata

SEQ ID NO: 1000875 - DNA, 22 bp, Homo sapiens
cacaatgagaatgatgcacact

SEQ ID NO: 1000876 - DNA, 17 bp, Homo sapiens
cacaatgagatgcatga

SEQ ID NO: 1000877 - DNA, 23 bp, Homo sapiens
cacaatgagattgaatttcactg

SEQ ID NO: 1000878 - DNA, 21 bp, Homo sapiens
cacaatgcatgtgctgtctcc

SEQ ID NO: 1000879 - DNA, 21 bp, Homo sapiens
cacaatggctaattcccagag

SEQ ID NO: 1000880 - DNA, 17 bp, Homo sapiens
cacaatggtttttaaat

SEQ ID NO: 1000881 - DNA, 13 bp, Homo sapiens
cgggccctccctc

SEQ ID NO: 1000882 - DNA, 23 bp, Homo sapiens
cgggccctgctgaggaggggcct

SEQ ID NO: 1000883 - DNA, 21 bp, Homo sapiens
cgggcccttcccacaggacat

SEQ ID NO: 1000884 - DNA, 19 bp, Homo sapiens
cgggcccttcttgctgccc

SEQ ID NO: 1000885 - DNA, 21 bp, Homo sapiens
cgggcccttcttgctgccctg

SEQ ID NO: 1000886 - DNA, 19 bp, Homo sapiens
cgggccgcaggagggaggc

SEQ ID NO: 1000887 - DNA, 16 bp, Homo sapiens
cgggcctggagaacta

SEQ ID NO: 1000888 - DNA, 14 bp, Homo sapiens
cgggcgccaggaca

SEQ ID NO: 1000889 - DNA, 15 bp, Homo sapiens
cgggcgccaggacag

SEQ ID NO: 1000890 - DNA, 18 bp, Homo sapiens
cgggcgccaggacagcag

SEQ ID NO: 1000891 - DNA, 23 bp, Homo sapiens
cgggcgcctgtagtcccagccac

SEQ ID NO: 1000892 - DNA, 14 bp, Homo sapiens
cgggcgcgggcagc

SEQ ID NO: 1000893 - DNA, 18 bp, Homo sapiens
cgggcgcgggcagccacc

SEQ ID NO: 1000894 - DNA, 23 bp, Homo sapiens
cgggcgcgggcagccacccaagc

SEQ ID NO: 1000895 - DNA, 16 bp, Homo sapiens
cgggcgcggtggctca

SEQ ID NO: 1000896 - DNA, 20 bp, Homo sapiens
cgggcgtcaggggtgcacag

SEQ ID NO: 1000897 - DNA, 15 bp, Homo sapiens
cgggctaaggtccct

SEQ ID NO: 1000898 - DNA, 11 bp, Homo sapiens
cgggctcagag

SEQ ID NO: 1000899 - DNA, 15 bp, Homo sapiens
cgggctcagagcttt

SEQ ID NO: 1000900 - DNA, 17 bp, Homo sapiens
cgggctcagagctttgt

SEQ ID NO: 1000901 - DNA, 13 bp, Homo sapiens
cgggctccagcca

SEQ ID NO: 1000902 - DNA, 15 bp, Homo sapiens
cgggctccctcctct

SEQ ID NO: 1000903 - DNA, 16 bp, Homo sapiens
cgggctccctcctctg

SEQ ID NO: 1000904 - DNA, 19 bp, Homo sapiens
cgggctcgggtctgggcag

SEQ ID NO: 1000905 - DNA, 16 bp, Homo sapiens
cgggctctatgcctgc

SEQ ID NO: 1000906 - DNA, 13 bp, Homo sapiens
cgggctctggcca

SEQ ID NO: 1000907 - DNA, 17 bp, Homo sapiens
cgggctctggccaccct

SEQ ID NO: 1000908 - DNA, 19 bp, Homo sapiens
cgggctgactgggccacag

SEQ ID NO: 1000909 - DNA, 13 bp, Homo sapiens
cgggctgcctggg

SEQ ID NO: 1000910 - DNA, 11 bp, Homo sapiens
cgggctggccc

SEQ ID NO: 1000911 - DNA, 18 bp, Homo sapiens
cgggctggccctgtgcag

SEQ ID NO: 1000912 - DNA, 19 bp, Homo sapiens
cgggctggctgcttgcagc

SEQ ID NO: 1000913 - DNA, 14 bp, Homo sapiens
cgggcttgcggtgg

SEQ ID NO: 1000914 - DNA, 14 bp, Homo sapiens
cgggctttgttgct

SEQ ID NO: 1000915 - DNA, 15 bp, Homo sapiens
cgggcttttccccgg

SEQ ID NO: 1000916 - DNA, 17 bp, Homo sapiens
cggggaaaatgcatttt

SEQ ID NO: 1000917 - DNA, 17 bp, Homo sapiens
cggggaagctgcacatg

SEQ ID NO: 1000918 - DNA, 19 bp, Homo sapiens
cggggaagggtgcatagct

SEQ ID NO: 1000919 - DNA, 13 bp, Homo sapiens
cggggaagtgctc

SEQ ID NO: 1000920 - DNA, 13 bp, Homo sapiens
cggggacctggat

SEQ ID NO: 1000921 - DNA, 18 bp, Homo sapiens
cggggacgcttttgagtg

SEQ ID NO: 1000922 - DNA, 15 bp, Homo sapiens
cggggactgctggct

SEQ ID NO: 1000923 - DNA, 21 bp, Homo sapiens
cggggagagggggaggttggt

SEQ ID NO: 1000924 - DNA, 18 bp, Homo sapiens
cggggagcgcccgcgccc

SEQ ID NO: 1000925 - DNA, 12 bp, Homo sapiens
cggggaggcaga

SEQ ID NO: 1000926 - DNA, 14 bp, Homo sapiens
cggggaggcagaga

SEQ ID NO: 1000927 - DNA, 23 bp, Homo sapiens
cggggaggcagagaatctcttgg

SEQ ID NO: 1000928 - DNA, 21 bp, Homo sapiens
cggggaggggcagagaggaag

SEQ ID NO: 1000929 - DNA, 16 bp, Homo sapiens
cggggcaaggtctcct

SEQ ID NO: 1000930 - DNA, 18 bp, Homo sapiens
cggggcagcagcagccct

SEQ ID NO: 1000931 - DNA, 20 bp, Homo sapiens
cggggcagcagcagccctgc

SEQ ID NO: 1000932 - DNA, 15 bp, Homo sapiens
cggggcaggccagca

SEQ ID NO: 1000933 - DNA, 20 bp, Homo sapiens
cggggcagtatgtgatggac

SEQ ID NO: 1000934 - DNA, 19 bp, Homo sapiens
cggggcatgctggggcaag

SEQ ID NO: 1000935 - DNA, 12 bp, Homo sapiens
cggggcatggac

SEQ ID NO: 1000936 - DNA, 19 bp, Homo sapiens
cggggcccttggggcctgg

SEQ ID NO: 1000937 - DNA, 22 bp, Homo sapiens
cggggcccttggggcctggctt

SEQ ID NO: 1000938 - DNA, 17 bp, Homo sapiens
cggggcctcgggacctc

SEQ ID NO: 1000939 - DNA, 22 bp, Homo sapiens
cggggccttatcgggctccagc

SEQ ID NO: 1000940 - DNA, 19 bp, Homo sapiens
cggggccttttgcccggag

SEQ ID NO: 1000941 - DNA, 22 bp, Homo sapiens
cggggctgctgtgtggacggcg

SEQ ID NO: 1000942 - DNA, 16 bp, Homo sapiens
cggggctggcaagcag

SEQ ID NO: 1000943 - DNA, 15 bp, Homo sapiens
cggggctgggaggaa

SEQ ID NO: 1000944 - DNA, 18 bp, Homo sapiens
cggggctgggaggaaggg

SEQ ID NO: 1000945 - DNA, 13 bp, Homo sapiens
cgggggagagagt

SEQ ID NO: 1000946 - DNA, 14 bp, Homo sapiens
cgggggagcccagt

SEQ ID NO: 1000947 - DNA, 16 bp, Homo sapiens
cgggggagcccagtga

SEQ ID NO: 1000948 - DNA, 14 bp, Homo sapiens
cgggggaggaaggg

SEQ ID NO: 1000949 - DNA, 18 bp, Homo sapiens
cgggggaggggccctcag

SEQ ID NO: 1000950 - DNA, 22 bp, Homo sapiens
cgggggaggggccctcaggcca

SEQ ID NO: 1000951 - DNA, 23 bp, Homo sapiens
cgggggcctgcaaatctagtgcc

SEQ ID NO: 1000952 - DNA, 14 bp, Homo sapiens
cgggggcctgtggt

SEQ ID NO: 1000953 - DNA, 15 bp, Homo sapiens
cgggggcctgtggtg

SEQ ID NO: 1000954 - DNA, 14 bp, Homo sapiens
cgggggcgcctgga

SEQ ID NO: 1000955 - DNA, 18 bp, Homo sapiens
cgggggcgtggctggcct

SEQ ID NO: 1000956 - DNA, 12 bp, Homo sapiens
cgggggctggcc

SEQ ID NO: 1000957 - DNA, 13 bp, Homo sapiens
cgggggctggcct

SEQ ID NO: 1000958 - DNA, 18 bp, Homo sapiens
cgggggctggcctaggag

SEQ ID NO: 1000959 - DNA, 12 bp, Homo sapiens
cggggggagggg

SEQ ID NO: 1000960 - DNA, 15 bp, Homo sapiens
cggggggaggggaca

SEQ ID NO: 1000961 - DNA, 13 bp, Homo sapiens
cggggggctggga

SEQ ID NO: 1000962 - DNA, 14 bp, Homo sapiens
cggggggctgggac

SEQ ID NO: 1000963 - DNA, 18 bp, Homo sapiens
cggggggggtaggagagg

SEQ ID NO: 1000964 - DNA, 22 bp, Homo sapiens
cggggggggtaggagaggagaa

SEQ ID NO: 1000965 - DNA, 12 bp, Homo sapiens
cgggggtgctgg

SEQ ID NO: 1000966 - DNA, 16 bp, Homo sapiens
cgggggtgctggggcc

SEQ ID NO: 1000967 - DNA, 15 bp, Homo sapiens
cgggggtgtgtctgt

SEQ ID NO: 1000968 - DNA, 22 bp, Homo sapiens
cgggggttgtggcccccgcccc

SEQ ID NO: 1000969 - DNA, 19 bp, Homo sapiens
cggggtaaaaagtggctgc

SEQ ID NO: 1000970 - DNA, 15 bp, Homo sapiens
cggggtcccctctgt

SEQ ID NO: 1000971 - DNA, 16 bp, Homo sapiens
cggggtctcctggacc

SEQ ID NO: 1000972 - DNA, 17 bp, Homo sapiens
cggggtctcctggacct

SEQ ID NO: 1000973 - DNA, 14 bp, Homo sapiens
cggggtctgtgctg

SEQ ID NO: 1000974 - DNA, 19 bp, Homo sapiens
cggggtctgtgctgtgcct

SEQ ID NO: 1000975 - DNA, 22 bp, Homo sapiens
cggggtgagtccattctcccag

SEQ ID NO: 1000976 - DNA, 12 bp, Homo sapiens
cggggtggagca

SEQ ID NO: 1000977 - DNA, 14 bp, Homo sapiens
cggggtggccacag

SEQ ID NO: 1000978 - DNA, 16 bp, Homo sapiens
cggggtggccacagcg

SEQ ID NO: 1000979 - DNA, 14 bp, Homo sapiens
cggggtggggaggg

SEQ ID NO: 1000980 - DNA, 16 bp, Homo sapiens
cggggtggggagggtg

SEQ ID NO: 1000981 - DNA, 18 bp, Homo sapiens
cggggtggtgggaaccat

SEQ ID NO: 1000982 - DNA, 23 bp, Homo sapiens
cggggttagagccaagctgcaca

SEQ ID NO: 1000983 - DNA, 13 bp, Homo sapiens
cggggttggggtg

SEQ ID NO: 1000984 - DNA, 16 bp, Homo sapiens
cggggttggggtggga

SEQ ID NO: 1000985 - DNA, 20 bp, Homo sapiens
cgggtcctcagctgctccca

SEQ ID NO: 1000986 - DNA, 18 bp, Homo sapiens
cgggtctcctcccagcgg

SEQ ID NO: 1000987 - DNA, 14 bp, Homo sapiens
cgggtctctggatt

SEQ ID NO: 1000988 - DNA, 13 bp, Homo sapiens
cgggtctgcctct

SEQ ID NO: 1000989 - DNA, 21 bp, Homo sapiens
cgggtgaacaaagcagccacg

SEQ ID NO: 1000990 - DNA, 16 bp, Homo sapiens
cgggtgacgcccacct

SEQ ID NO: 1000991 - DNA, 15 bp, Homo sapiens
cgggtgatggccagc

SEQ ID NO: 1000992 - DNA, 19 bp, Homo sapiens
cgggtgatggccagcccct

SEQ ID NO: 1000993 - DNA, 23 bp, Homo sapiens
cgggtgcatttgagagaagccac

SEQ ID NO: 1000994 - DNA, 16 bp, Homo sapiens
cacagagaggagggga

SEQ ID NO: 1000995 - DNA, 19 bp, Homo sapiens
cacagagaggaggggacca

SEQ ID NO: 1000996 - DNA, 14 bp, Homo sapiens
cacagagagggaca

SEQ ID NO: 1000997 - DNA, 22 bp, Homo sapiens
cacagagagggagagcagagaa

SEQ ID NO: 1000998 - DNA, 13 bp, Homo sapiens
cacagagatgcat

SEQ ID NO: 1000999 - DNA, 16 bp, Homo sapiens
cacagagattctggat

SEQ ID NO: 1001000 - DNA, 18 bp, Homo sapiens
cacagagcacacttattt

SEQ ID NO: 1001001 - DNA, 15 bp, Homo sapiens
cacagagcacgcctg

SEQ ID NO: 1001002 - DNA, 21 bp, Homo sapiens
cacagagcacgcctgccatct

SEQ ID NO: 1001003 - DNA, 14 bp, Homo sapiens
cacagagcaggact

SEQ ID NO: 1001004 - DNA, 21 bp, Homo sapiens
cacagagcaggactgcacagc

SEQ ID NO: 1001005 - DNA, 20 bp, Homo sapiens
cacagagccctgaggggctg

SEQ ID NO: 1001006 - DNA, 22 bp, Homo sapiens
cacagagccctgaggggctggg

SEQ ID NO: 1001007 - DNA, 19 bp, Homo sapiens
cacagagcctgaatttgta

SEQ ID NO: 1001008 - DNA, 23 bp, Homo sapiens
cacagagcctgaatttgtaagca

SEQ ID NO: 1001009 - DNA, 13 bp, Homo sapiens
cacagagcctggc

SEQ ID NO: 1001010 - DNA, 14 bp, Homo sapiens
cacagagcctggcc

SEQ ID NO: 1001011 - DNA, 18 bp, Homo sapiens
cacagagcctggccccag

SEQ ID NO: 1001012 - DNA, 18 bp, Homo sapiens
cacagagcctggctttgg

SEQ ID NO: 1001013 - DNA, 19 bp, Homo sapiens
cacagagcgtccttccccc

SEQ ID NO: 1001014 - DNA, 13 bp, Homo sapiens
cacagaggaagag

SEQ ID NO: 1001015 - DNA, 20 bp, Homo sapiens
cgtcatgcacagtatttgta

SEQ ID NO: 1001016 - DNA, 20 bp, Homo sapiens
cgtcatggcttaatgtttat

SEQ ID NO: 1001017 - DNA, 21 bp, Homo sapiens
cgtcattgctgctgctaccag

SEQ ID NO: 1001018 - DNA, 14 bp, Homo sapiens
cgtccaccaggcct

SEQ ID NO: 1001019 - DNA, 16 bp, Homo sapiens
cgtccaccaggcctca

SEQ ID NO: 1001020 - DNA, 14 bp, Homo sapiens
cgtccacccaggct

SEQ ID NO: 1001021 - DNA, 17 bp, Homo sapiens
cgtccacccaggctgca

SEQ ID NO: 1001022 - DNA, 19 bp, Homo sapiens
cgtccacccttccatcagc

SEQ ID NO: 1001023 - DNA, 12 bp, Homo sapiens
cgtccagccctc

SEQ ID NO: 1001024 - DNA, 13 bp, Homo sapiens
cgtccagccctcc

SEQ ID NO: 1001025 - DNA, 19 bp, Homo sapiens
cgtccaggagcctgtgcct

SEQ ID NO: 1001026 - DNA, 20 bp, Homo sapiens
cgtccatatcagaactgtgc

SEQ ID NO: 1001027 - DNA, 17 bp, Homo sapiens
cgtccatcccccttctt

SEQ ID NO: 1001028 - DNA, 19 bp, Homo sapiens
cgtccatggcaccagcccc

SEQ ID NO: 1001029 - DNA, 16 bp, Homo sapiens
cgtcccagcggcctca

SEQ ID NO: 1001030 - DNA, 12 bp, Homo sapiens
cgtcccaggcca

SEQ ID NO: 1001031 - DNA, 13 bp, Homo sapiens
cgtccccactccc

SEQ ID NO: 1001032 - DNA, 15 bp, Homo sapiens
cgtccccccccaggc

SEQ ID NO: 1001033 - DNA, 17 bp, Homo sapiens
cgtccccccccaggccc

SEQ ID NO: 1001034 - DNA, 17 bp, Homo sapiens
cgtccccctccctgccc

SEQ ID NO: 1001035 - DNA, 14 bp, Homo sapiens
cgtccccctctggc

SEQ ID NO: 1001036 - DNA, 21 bp, Homo sapiens
cgtccccctctggctccagct

SEQ ID NO: 1001037 - DNA, 13 bp, Homo sapiens
cgtccccctgggg

SEQ ID NO: 1001038 - DNA, 14 bp, Homo sapiens
cgtcccctccgccg

SEQ ID NO: 1001039 - DNA, 18 bp, Homo sapiens
cgtcccctccgccgtgcc

SEQ ID NO: 1001040 - DNA, 21 bp, Homo sapiens
cgtcccctccgccgtgccggc

SEQ ID NO: 1001041 - DNA, 22 bp, Homo sapiens
cgtcccctccgccgtgccggcg

SEQ ID NO: 1001042 - DNA, 17 bp, Homo sapiens
cgtcccctctccccttg

SEQ ID NO: 1001043 - DNA, 17 bp, Homo sapiens
cgtcccctgcagcctgg

SEQ ID NO: 1001044 - DNA, 16 bp, Homo sapiens
cgtcccgcacagtgga

SEQ ID NO: 1001045 - DNA, 15 bp, Homo sapiens
cgtcccgctgcctcc

SEQ ID NO: 1001046 - DNA, 16 bp, Homo sapiens
cgtcccgctgcctcct

SEQ ID NO: 1001047 - DNA, 19 bp, Homo sapiens
cgtcccgctgcctcctgct

SEQ ID NO: 1001048 - DNA, 21 bp, Homo sapiens
cgtcccgctgctgtgctctgg

SEQ ID NO: 1001049 - DNA, 14 bp, Homo sapiens
cgtccctgcccatg

SEQ ID NO: 1001050 - DNA, 14 bp, Homo sapiens
cgtccctggcgcag

SEQ ID NO: 1001051 - DNA, 22 bp, Homo sapiens
cgtccgccctgctcctccctgg

SEQ ID NO: 1001052 - DNA, 13 bp, Homo sapiens
cgtcctccccctg

SEQ ID NO: 1001053 - DNA, 16 bp, Homo sapiens
cgtcctccccctgcca

SEQ ID NO: 1001054 - DNA, 22 bp, Homo sapiens
cgtcctccccctgccagtgcct

SEQ ID NO: 1001055 - DNA, 16 bp, Homo sapiens
cgtcctcccgggccct

SEQ ID NO: 1001056 - DNA, 12 bp, Homo sapiens
cgtcctccctca

SEQ ID NO: 1001057 - DNA, 15 bp, Homo sapiens
cgtcctccctcagcc

SEQ ID NO: 1001058 - DNA, 21 bp, Homo sapiens
cgtcctccctcagcctcccct

SEQ ID NO: 1001059 - DNA, 23 bp, Homo sapiens
cgtcctccctcagcctccccttc

SEQ ID NO: 1001060 - DNA, 21 bp, Homo sapiens
cgtcctcctcacctcatgccc

SEQ ID NO: 1001061 - DNA, 14 bp, Homo sapiens
cgtcctgaggaata

SEQ ID NO: 1001062 - DNA, 17 bp, Homo sapiens
cgtcctgatccctccac

SEQ ID NO: 1001063 - DNA, 14 bp, Homo sapiens
cgtcctgcctgtgg

SEQ ID NO: 1001064 - DNA, 20 bp, Homo sapiens
cgtcctgctgtccctgtcag

SEQ ID NO: 1001065 - DNA, 14 bp, Homo sapiens
cgtcctgtcactga

SEQ ID NO: 1001066 - DNA, 15 bp, Homo sapiens
cgtcctgtcactgat

SEQ ID NO: 1001067 - DNA, 16 bp, Homo sapiens
cgtcctgtcccagagg

SEQ ID NO: 1001068 - DNA, 17 bp, Homo sapiens
cgtcctttcacacatct

SEQ ID NO: 1001069 - DNA, 17 bp, Homo sapiens
cgtcgaggggctctcag

SEQ ID NO: 1001070 - DNA, 17 bp, Homo sapiens
cgtcggactgcccccag

SEQ ID NO: 1001071 - DNA, 16 bp, Homo sapiens
cgtcggagctgcctgc

SEQ ID NO: 1001072 - DNA, 23 bp, Homo sapiens
cgtcggccctgcgtcggccctgg

SEQ ID NO: 1001073 - DNA, 19 bp, Homo sapiens
cgtcgggggctgaggggca

SEQ ID NO: 1001074 - DNA, 17 bp, Homo sapiens
cgtcgtacccagccatg

SEQ ID NO: 1001075 - DNA, 16 bp, Homo sapiens
cgtcgtgtgctgaaga

SEQ ID NO: 1001076 - DNA, 11 bp, Homo sapiens
cgtctcagtgt

SEQ ID NO: 1001077 - DNA, 16 bp, Homo sapiens
cgtctcatcctccttt

SEQ ID NO: 1001078 - DNA, 14 bp, Homo sapiens
cgtctccaggggct

SEQ ID NO: 1001079 - DNA, 19 bp, Homo sapiens
cgtctccaggggctgcttc

SEQ ID NO: 1001080 - DNA, 10 bp, Homo sapiens
cgtctccccc

SEQ ID NO: 1001081 - DNA, 15 bp, Homo sapiens
cgtctcccccagagt

SEQ ID NO: 1001082 - DNA, 14 bp, Homo sapiens
cgtctcccccgtgt

SEQ ID NO: 1001083 - DNA, 18 bp, Homo sapiens
cgtctccctggtgcctct

SEQ ID NO: 1001084 - DNA, 22 bp, Homo sapiens
cgtctccctggtgcctctgtgc

SEQ ID NO: 1001085 - DNA, 14 bp, Homo sapiens
cgtctcggcccctc

SEQ ID NO: 1001086 - DNA, 14 bp, Homo sapiens
cgtctcggccctga

SEQ ID NO: 1001087 - DNA, 16 bp, Homo sapiens
cgtctcggccttcaca

SEQ ID NO: 1001088 - DNA, 19 bp, Homo sapiens
cgtctctactaaaaatgca

SEQ ID NO: 1001089 - DNA, 22 bp, Homo sapiens
cgtctctttttggtaataacaa

SEQ ID NO: 1001090 - DNA, 18 bp, Homo sapiens
cgtctgaagcttgactcc

SEQ ID NO: 1001091 - DNA, 15 bp, Homo sapiens
cgtctgactccagag

SEQ ID NO: 1001092 - DNA, 14 bp, Homo sapiens
cgtctgactccctc

SEQ ID NO: 1001093 - DNA, 16 bp, Homo sapiens
cgtctgactccctccc

SEQ ID NO: 1001094 - DNA, 14 bp, Homo sapiens
cgtctgaggcctgc

SEQ ID NO: 1001095 - DNA, 15 bp, Homo sapiens
cgtctgaggcctgcc

SEQ ID NO: 1001096 - DNA, 18 bp, Homo sapiens
cgtctgcaggggcctgga

SEQ ID NO: 1001097 - DNA, 13 bp, Homo sapiens
cgtctgccaggcc

SEQ ID NO: 1001098 - DNA, 20 bp, Homo sapiens
cgtctgcgttaggcagggca

SEQ ID NO: 1001099 - DNA, 12 bp, Homo sapiens
cgtctgctctgg

SEQ ID NO: 1001100 - DNA, 15 bp, Homo sapiens
cgtctggaagtccaa

SEQ ID NO: 1001101 - DNA, 13 bp, Homo sapiens
cgtctggctccct

SEQ ID NO: 1001102 - DNA, 14 bp, Homo sapiens
cgtctgggagaaat

SEQ ID NO: 1001103 - DNA, 23 bp, Homo sapiens
cgtctggggttcagcccctcctc

SEQ ID NO: 1001104 - DNA, 21 bp, Homo sapiens
cgtctgtctcgatgcctgatt

SEQ ID NO: 1001105 - DNA, 16 bp, Homo sapiens
cgtcttcaatctctgt

SEQ ID NO: 1001106 - DNA, 18 bp, Homo sapiens
cgtcttcatctccctgcc

SEQ ID NO: 1001107 - DNA, 20 bp, Homo sapiens
cgtcttccgcccctgcctgc

SEQ ID NO: 1001108 - DNA, 16 bp, Homo sapiens
cgtcttccgtctcccc

SEQ ID NO: 1001109 - DNA, 17 bp, Homo sapiens
cgtcttccgtctccccc

SEQ ID NO: 1001110 - DNA, 13 bp, Homo sapiens
cgtcttgcccagc

SEQ ID NO: 1001111 - DNA, 18 bp, Homo sapiens
cgtcttgctatttgagca

SEQ ID NO: 1001112 - DNA, 23 bp, Homo sapiens
cgtcttggtgccttttgtgtgat

SEQ ID NO: 1001113 - DNA, 15 bp, Homo sapiens
cgtgaaacacaccag

SEQ ID NO: 1001114 - DNA, 16 bp, Homo sapiens
cgtgaaacacaccagg

SEQ ID NO: 1001115 - DNA, 20 bp, Homo sapiens
cgtgaaacacaccaggctgt

SEQ ID NO: 1001116 - DNA, 24 bp, Homo sapiens
cgtgaaacacaccaggctgtgggc

SEQ ID NO: 1001117 - DNA, 15 bp, Homo sapiens
ccataccccttattg

SEQ ID NO: 1001118 - DNA, 18 bp, Homo sapiens
ccataccccttattgctg

SEQ ID NO: 1001119 - DNA, 19 bp, Homo sapiens
ccataccccttattgctgc

SEQ ID NO: 1001120 - DNA, 21 bp, Homo sapiens
ccataccccttattgctgcca

SEQ ID NO: 1001121 - DNA, 23 bp, Homo sapiens
ccataccttccttccctgggctg

SEQ ID NO: 1001122 - DNA, 16 bp, Homo sapiens
ccatacctttccaggg

SEQ ID NO: 1001123 - DNA, 23 bp, Homo sapiens
ccatactaattataccccctgca

SEQ ID NO: 1001124 - DNA, 15 bp, Homo sapiens
ccatactcagcctgc

SEQ ID NO: 1001125 - DNA, 17 bp, Homo sapiens
ccatactgagcctgcca

SEQ ID NO: 1001126 - DNA, 16 bp, Homo sapiens
ccatactgtctctgga

SEQ ID NO: 1001127 - DNA, 22 bp, Homo sapiens
ccatacttttggctcctctagt

SEQ ID NO: 1001128 - DNA, 14 bp, Homo sapiens
ccatagaaaaatgt

SEQ ID NO: 1001129 - DNA, 22 bp, Homo sapiens
ccatagagcccctcctggttga

SEQ ID NO: 1001130 - DNA, 21 bp, Homo sapiens
ccatagaggcccaggcaccac

SEQ ID NO: 1001131 - DNA, 17 bp, Homo sapiens
ccatagagtaatgatgt

SEQ ID NO: 1001132 - DNA, 18 bp, Homo sapiens
ccatagagtaatgatgta

SEQ ID NO: 1001133 - DNA, 21 bp, Homo sapiens
ccatagatgggtctggctgag

SEQ ID NO: 1001134 - DNA, 14 bp, Homo sapiens
ccatagcaacagga

SEQ ID NO: 1001135 - DNA, 17 bp, Homo sapiens
ccatagctattttcctt

SEQ ID NO: 1001136 - DNA, 22 bp, Homo sapiens
ccataggaagacataaaacttt

SEQ ID NO: 1001137 - DNA, 12 bp, Homo sapiens
atcatttgtgaa

SEQ ID NO: 1001138 - DNA, 18 bp, Homo sapiens
atcatttgtgaagaatta

SEQ ID NO: 1001139 - DNA, 18 bp, Homo sapiens
atcattttatatgtcaaa

SEQ ID NO: 1001140 - DNA, 14 bp, Homo sapiens
atcattttcccccc

SEQ ID NO: 1001141 - DNA, 17 bp, Homo sapiens
atcattttccccccact

SEQ ID NO: 1001142 - DNA, 22 bp, Homo sapiens
atcattttgcaatcccttaata

SEQ ID NO: 1001143 - DNA, 20 bp, Homo sapiens
atcatttttacactattgtg

SEQ ID NO: 1001144 - DNA, 17 bp, Homo sapiens
atcatttttatattata

SEQ ID NO: 1001145 - DNA, 18 bp, Homo sapiens
atcatttttccaggactc

SEQ ID NO: 1001146 - DNA, 18 bp, Homo sapiens
atcatttttgatgactac

SEQ ID NO: 1001147 - DNA, 17 bp, Homo sapiens
atcatttttgtgcacag

SEQ ID NO: 1001148 - DNA, 19 bp, Homo sapiens
atccaaaaagctctgaaaa

SEQ ID NO: 1001149 - DNA, 20 bp, Homo sapiens
atccaaaagacaaaaatcaa

SEQ ID NO: 1001150 - DNA, 13 bp, Homo sapiens
atccaaaagcttt

SEQ ID NO: 1001151 - DNA, 19 bp, Homo sapiens
atccaaaatattttttgca

SEQ ID NO: 1001152 - DNA, 19 bp, Homo sapiens
atccaaaatcttgatcagt

SEQ ID NO: 1001153 - DNA, 20 bp, Homo sapiens
atccaaaatgaatgcaaaat

SEQ ID NO: 1001154 - DNA, 14 bp, Homo sapiens
atccaaaatgtgta

SEQ ID NO: 1001155 - DNA, 23 bp, Homo sapiens
atccaaagaacttgatttgcatg

SEQ ID NO: 1001156 - DNA, 23 bp, Homo sapiens
atccaaagactgtactggccagt

SEQ ID NO: 1001157 - DNA, 21 bp, Homo sapiens
atccaaatctgtcctctgtag

SEQ ID NO: 1001158 - DNA, 18 bp, Homo sapiens
atccaaatcttgaatttc

SEQ ID NO: 1001159 - DNA, 13 bp, Homo sapiens
atccaacaagaag

SEQ ID NO: 1001160 - DNA, 21 bp, Homo sapiens
atccaacaagaagaaatatga

SEQ ID NO: 1001161 - DNA, 19 bp, Homo sapiens
atccaagcctccacagcga

SEQ ID NO: 1001162 - DNA, 14 bp, Homo sapiens
atccaagctccctg

SEQ ID NO: 1001163 - DNA, 14 bp, Homo sapiens
atccaaggaaacat

SEQ ID NO: 1001164 - DNA, 15 bp, Homo sapiens
atccaaggaaacatg

SEQ ID NO: 1001165 - DNA, 14 bp, Homo sapiens
atccaaggagaaac

SEQ ID NO: 1001166 - DNA, 20 bp, Homo sapiens
atccaaggcagggaaaggaa

SEQ ID NO: 1001167 - DNA, 14 bp, Homo sapiens
atccaaggggcagt

SEQ ID NO: 1001168 - DNA, 17 bp, Homo sapiens
atccaagggttgagagc

SEQ ID NO: 1001169 - DNA, 22 bp, Homo sapiens
atccaagggttgagagccagtg

SEQ ID NO: 1001170 - DNA, 15 bp, Homo sapiens
atccaatattgtaat

SEQ ID NO: 1001171 - DNA, 20 bp, Homo sapiens
atccaattgatgtatatgtt

SEQ ID NO: 1001172 - DNA, 17 bp, Homo sapiens
atccaattttgatcttt

SEQ ID NO: 1001173 - DNA, 20 bp, Homo sapiens
atccaattttgatcttttta

SEQ ID NO: 1001174 - DNA, 12 bp, Homo sapiens
atccacacaaat

SEQ ID NO: 1001175 - DNA, 15 bp, Homo sapiens
atccacacacagagg

SEQ ID NO: 1001176 - DNA, 11 bp, Homo sapiens
atccacaggat

SEQ ID NO: 1001177 - DNA, 15 bp, Homo sapiens
atccacccagcaggc

SEQ ID NO: 1001178 - DNA, 16 bp, Homo sapiens
atccacccagcaggca

SEQ ID NO: 1001179 - DNA, 13 bp, Homo sapiens
atccacccagtgc

SEQ ID NO: 1001180 - DNA, 12 bp, Homo sapiens
atccacccccag

SEQ ID NO: 1001181 - DNA, 17 bp, Homo sapiens
atccacccccaggtgca

SEQ ID NO: 1001182 - DNA, 17 bp, Homo sapiens
atccacccgctgcccct

SEQ ID NO: 1001183 - DNA, 20 bp, Homo sapiens
atccacccgggggagcccag

SEQ ID NO: 1001184 - DNA, 23 bp, Homo sapiens
atccacccgggggagcccagtga

SEQ ID NO: 1001185 - DNA, 15 bp, Homo sapiens
atccaccctatccct

SEQ ID NO: 1001186 - DNA, 22 bp, Homo sapiens
atccaccctatccctgtacaga

SEQ ID NO: 1001187 - DNA, 20 bp, Homo sapiens
atccaccctcaaatgtcaga

SEQ ID NO: 1001188 - DNA, 20 bp, Homo sapiens
atccacctcatcactggact

SEQ ID NO: 1001189 - DNA, 23 bp, Homo sapiens
atccacctccctaccaaaaattg

SEQ ID NO: 1001190 - DNA, 14 bp, Homo sapiens
atccacctgccttg

SEQ ID NO: 1001191 - DNA, 17 bp, Homo sapiens
atccacctgccttggcc

SEQ ID NO: 1001192 - DNA, 21 bp, Homo sapiens
atccaccttcccttctacaag

SEQ ID NO: 1001193 - DNA, 16 bp, Homo sapiens
atccacgtggcctctc

SEQ ID NO: 1001194 - DNA, 19 bp, Homo sapiens
atccactagtgcaaatcat

SEQ ID NO: 1001195 - DNA, 20 bp, Homo sapiens
atccactctaccctcccacc

SEQ ID NO: 1001196 - DNA, 20 bp, Homo sapiens
atccactggaaaaggtgaaa

SEQ ID NO: 1001197 - DNA, 20 bp, Homo sapiens
atccactgggtgtaaacaca

SEQ ID NO: 1001198 - DNA, 17 bp, Homo sapiens
atccacttaagttcttt

SEQ ID NO: 1001199 - DNA, 20 bp, Homo sapiens
atccacttaagttctttgat

SEQ ID NO: 1001200 - DNA, 21 bp, Homo sapiens
atccacttcttggttcctggg

SEQ ID NO: 1001201 - DNA, 12 bp, Homo sapiens
atccactttgca

SEQ ID NO: 1001202 - DNA, 16 bp, Homo sapiens
atccagaacagtggct

SEQ ID NO: 1001203 - DNA, 15 bp, Homo sapiens
atccagaaggggagc

SEQ ID NO: 1001204 - DNA, 16 bp, Homo sapiens
atccagaaggggagct

SEQ ID NO: 1001205 - DNA, 19 bp, Homo sapiens
atccagaagttttaacttc

SEQ ID NO: 1001206 - DNA, 23 bp, Homo sapiens
atccagaatttattagtttaaaa

SEQ ID NO: 1001207 - DNA, 12 bp, Homo sapiens
atccagactgta

SEQ ID NO: 1001208 - DNA, 13 bp, Homo sapiens
atccagactgtaa

SEQ ID NO: 1001209 - DNA, 14 bp, Homo sapiens
atccagagagcagc

SEQ ID NO: 1001210 - DNA, 22 bp, Homo sapiens
atccagagattcattttctaga

SEQ ID NO: 1001211 - DNA, 13 bp, Homo sapiens
atccagagcagag

SEQ ID NO: 1001212 - DNA, 14 bp, Homo sapiens
atccagagcagagt

SEQ ID NO: 1001213 - DNA, 21 bp, Homo sapiens
atccagaggaacaagcatgtc

SEQ ID NO: 1001214 - DNA, 12 bp, Homo sapiens
atccagaggaat

SEQ ID NO: 1001215 - DNA, 22 bp, Homo sapiens
atccagagtttagaggaaaaaa

SEQ ID NO: 1001216 - DNA, 20 bp, Homo sapiens
atccagatacacccaaagta

SEQ ID NO: 1001217 - DNA, 19 bp, Homo sapiens
atccagccggaggccagag

SEQ ID NO: 1001218 - DNA, 21 bp, Homo sapiens
atccagcgagagagtttcaaa

SEQ ID NO: 1001219 - DNA, 22 bp, Homo sapiens
atccagcgtgacggagcccaca

SEQ ID NO: 1001220 - DNA, 18 bp, Homo sapiens
atccaggaatatgacaca

SEQ ID NO: 1001221 - DNA, 18 bp, Homo sapiens
atccaggagggctaatta

SEQ ID NO: 1001222 - DNA, 15 bp, Homo sapiens
atccaggcaccagga

SEQ ID NO: 1001223 - DNA, 19 bp, Homo sapiens
atccaggccaaagccccat

SEQ ID NO: 1001224 - DNA, 14 bp, Homo sapiens
atccaggccggctt

SEQ ID NO: 1001225 - DNA, 13 bp, Homo sapiens
atccaggggaagc

SEQ ID NO: 1001226 - DNA, 18 bp, Homo sapiens
atccaggggaagccagtg

SEQ ID NO: 1001227 - DNA, 23 bp, Homo sapiens
atccaggggaagccagtgacact

SEQ ID NO: 1001228 - DNA, 17 bp, Homo sapiens
atccagggggcaagagg

SEQ ID NO: 1001229 - DNA, 20 bp, Homo sapiens
atccagggtctggcagagcc

SEQ ID NO: 1001230 - DNA, 21 bp, Homo sapiens
atccagggtctggcagagcct

SEQ ID NO: 1001231 - DNA, 18 bp, Homo sapiens
atccaggtcttgactcat

SEQ ID NO: 1001232 - DNA, 15 bp, Homo sapiens
atccaggttccctcc

SEQ ID NO: 1001233 - DNA, 14 bp, Homo sapiens
atccagtattatat

SEQ ID NO: 1001234 - DNA, 21 bp, Homo sapiens
atccagtgatccttacaagtt

SEQ ID NO: 1001235 - DNA, 17 bp, Homo sapiens
atccagttccagttccc

SEQ ID NO: 1001236 - DNA, 16 bp, Homo sapiens
atccagttcctgctct

SEQ ID NO: 1001237 - DNA, 20 bp, Homo sapiens
atccagttcctgctctctgc

SEQ ID NO: 1001238 - DNA, 12 bp, Homo sapiens
atcccccccagc

SEQ ID NO: 1001239 - DNA, 14 bp, Homo sapiens
atcccccccagcct

SEQ ID NO: 1001240 - DNA, 13 bp, Homo sapiens
atcccccctgctg

SEQ ID NO: 1001241 - DNA, 14 bp, Homo sapiens
atcccccctgctgc

SEQ ID NO: 1001242 - DNA, 16 bp, Homo sapiens
atcccccctgctgccc

SEQ ID NO: 1001243 - DNA, 22 bp, Homo sapiens
atccccctacaaccccagcctc

SEQ ID NO: 1001244 - DNA, 12 bp, Homo sapiens
atccccctctca

SEQ ID NO: 1001245 - DNA, 13 bp, Homo sapiens
atccccctgccct

SEQ ID NO: 1001246 - DNA, 12 bp, Homo sapiens
atcccccttaaa

SEQ ID NO: 1001247 - DNA, 13 bp, Homo sapiens
atcccccttcttc

SEQ ID NO: 1001248 - DNA, 17 bp, Homo sapiens
atccccgacagtggctc

SEQ ID NO: 1001249 - DNA, 16 bp, Homo sapiens
atccccgaccccccta

SEQ ID NO: 1001250 - DNA, 18 bp, Homo sapiens
atccccgcagtgtgcact

SEQ ID NO: 1001251 - DNA, 18 bp, Homo sapiens
atccccgcctggccagga

SEQ ID NO: 1001252 - DNA, 13 bp, Homo sapiens
atccccgcttccc

SEQ ID NO: 1001253 - DNA, 13 bp, Homo sapiens
atcccctcagcct

SEQ ID NO: 1001254 - DNA, 13 bp, Homo sapiens
atcccctccccca

SEQ ID NO: 1001255 - DNA, 15 bp, Homo sapiens
atcccctccctgcct

SEQ ID NO: 1001256 - DNA, 16 bp, Homo sapiens
atcccctccctgcctg

SEQ ID NO: 1001257 - DNA, 18 bp, Homo sapiens
atcccctccctgcctgct

SEQ ID NO: 1001258 - DNA, 21 bp, Homo sapiens
atcccctccctgcctgctcct

SEQ ID NO: 1001259 - DNA, 15 bp, Homo sapiens
atcccctccctgtca

SEQ ID NO: 1001260 - DNA, 21 bp, Homo sapiens
atcccctcgtcctgtcccaga

SEQ ID NO: 1001261 - DNA, 23 bp, Homo sapiens
atcccctcgtcctgtcccagagg

SEQ ID NO: 1001262 - DNA, 13 bp, Homo sapiens
atcccctgcctcc

SEQ ID NO: 1001263 - DNA, 14 bp, Homo sapiens
atcccctgcctcct

SEQ ID NO: 1001264 - DNA, 15 bp, Homo sapiens
atcccctgcctcctg

SEQ ID NO: 1001265 - DNA, 18 bp, Homo sapiens
atcccctggactgggagg

SEQ ID NO: 1001266 - DNA, 14 bp, Homo sapiens
atcccctttcctcc

SEQ ID NO: 1001267 - DNA, 15 bp, Homo sapiens
atcccctttcctccc

SEQ ID NO: 1001268 - DNA, 13 bp, Homo sapiens
ccatcgtccagcc

SEQ ID NO: 1001269 - DNA, 14 bp, Homo sapiens
ccatcgtccagccc

SEQ ID NO: 1001270 - DNA, 16 bp, Homo sapiens
ccatcgtccagccctc

SEQ ID NO: 1001271 - DNA, 15 bp, Homo sapiens
ccatcgtcctgggac

SEQ ID NO: 1001272 - DNA, 19 bp, Homo sapiens
ccatcgtctcatcctcctt

SEQ ID NO: 1001273 - DNA, 22 bp, Homo sapiens
ccatctaaactggagtgatgtt

SEQ ID NO: 1001274 - DNA, 22 bp, Homo sapiens
ccatctatgtcccttgctgtga

SEQ ID NO: 1001275 - DNA, 21 bp, Homo sapiens
ccatctcagacctttactgat

SEQ ID NO: 1001276 - DNA, 18 bp, Homo sapiens
ccatctcagcctcctgag

SEQ ID NO: 1001277 - DNA, 14 bp, Homo sapiens
ccatctcaggagat

SEQ ID NO: 1001278 - DNA, 16 bp, Homo sapiens
ccatctcaggccacct

SEQ ID NO: 1001279 - DNA, 21 bp, Homo sapiens
ccatctcaggccacctgcccc

SEQ ID NO: 1001280 - DNA, 11 bp, Homo sapiens
ccatctcaggt

SEQ ID NO: 1001281 - DNA, 14 bp, Homo sapiens
ccatctcaggtgcc

SEQ ID NO: 1001282 - DNA, 20 bp, Homo sapiens
ccatctcatgcccctggctg

SEQ ID NO: 1001283 - DNA, 12 bp, Homo sapiens
ccatctccaggg

SEQ ID NO: 1001284 - DNA, 17 bp, Homo sapiens
ccatctccccaggcctc

SEQ ID NO: 1001285 - DNA, 20 bp, Homo sapiens
ccatctccccaggcctccag

SEQ ID NO: 1001286 - DNA, 16 bp, Homo sapiens
ccatctccctgcctgg

SEQ ID NO: 1001287 - DNA, 17 bp, Homo sapiens
ccatctccctgcctggc

SEQ ID NO: 1001288 - DNA, 18 bp, Homo sapiens
ccatctcctgatttctct

SEQ ID NO: 1001289 - DNA, 16 bp, Homo sapiens
ccatctccttacctct

SEQ ID NO: 1001290 - DNA, 21 bp, Homo sapiens
ccatctccttacctctggaac

SEQ ID NO: 1001291 - DNA, 17 bp, Homo sapiens
ccatctcctttcaggga

SEQ ID NO: 1001292 - DNA, 18 bp, Homo sapiens
ccatctcctttcagggaa

SEQ ID NO: 1001293 - DNA, 20 bp, Homo sapiens
ccatctcggagcatcccgga

SEQ ID NO: 1001294 - DNA, 21 bp, Homo sapiens
ccatctcggagcatcccggag

SEQ ID NO: 1001295 - DNA, 17 bp, Homo sapiens
ccatctctaccatcatc

SEQ ID NO: 1001296 - DNA, 18 bp, Homo sapiens
ccatctctcatcctccag

SEQ ID NO: 1001297 - DNA, 12 bp, Homo sapiens
ccatctctccca

SEQ ID NO: 1001298 - DNA, 22 bp, Homo sapiens
ccatctctcccacttcctccta

SEQ ID NO: 1001299 - DNA, 17 bp, Homo sapiens
ccatctctccctcccct

SEQ ID NO: 1001300 - DNA, 16 bp, Homo sapiens
ccatctctgagtggag

SEQ ID NO: 1001301 - DNA, 18 bp, Homo sapiens
ccatctctgattttcaaa

SEQ ID NO: 1001302 - DNA, 12 bp, Homo sapiens
ccatctctgtag

SEQ ID NO: 1001303 - DNA, 12 bp, Homo sapiens
ccatctctgtct

SEQ ID NO: 1001304 - DNA, 18 bp, Homo sapiens
ccatctctgtctggggct

SEQ ID NO: 1001305 - DNA, 19 bp, Homo sapiens
ccatctctgtctggggcta

SEQ ID NO: 1001306 - DNA, 23 bp, Homo sapiens
ccatctctgtctggggctacaga

SEQ ID NO: 1001307 - DNA, 13 bp, Homo sapiens
ccatctcttccta

SEQ ID NO: 1001308 - DNA, 21 bp, Homo sapiens
ccatctcttcctacccaacca

SEQ ID NO: 1001309 - DNA, 22 bp, Homo sapiens
ccatctgcaccccttctctcct

SEQ ID NO: 1001310 - DNA, 13 bp, Homo sapiens
ccatctgcccagg

SEQ ID NO: 1001311 - DNA, 13 bp, Homo sapiens
ccatctgccctcc

SEQ ID NO: 1001312 - DNA, 17 bp, Homo sapiens
ccatctgccctccctgt

SEQ ID NO: 1001313 - DNA, 13 bp, Homo sapiens
ccatctgctgcag

SEQ ID NO: 1001314 - DNA, 20 bp, Homo sapiens
ccatctgctgcagttaccac

SEQ ID NO: 1001315 - DNA, 14 bp, Homo sapiens
ccatctggcagggt

SEQ ID NO: 1001316 - DNA, 16 bp, Homo sapiens
ccatctggcagggtgg

SEQ ID NO: 1001317 - DNA, 17 bp, Homo sapiens
ccatctgggagtcccct

SEQ ID NO: 1001318 - DNA, 17 bp, Homo sapiens
ccatctgggtccttgca

SEQ ID NO: 1001319 - DNA, 18 bp, Homo sapiens
ccatctgggtccttgcac

SEQ ID NO: 1001320 - DNA, 19 bp, Homo sapiens
ccatctgtaaaggggcagc

SEQ ID NO: 1001321 - DNA, 12 bp, Homo sapiens
ccatctgtccag

SEQ ID NO: 1001322 - DNA, 17 bp, Homo sapiens
ccatctgtctgtcctac

SEQ ID NO: 1001323 - DNA, 12 bp, Homo sapiens
ccatctgtgaat

SEQ ID NO: 1001324 - DNA, 19 bp, Homo sapiens
ccatctgtgatatgccata

SEQ ID NO: 1001325 - DNA, 16 bp, Homo sapiens
ccatcttaaaaacaac

SEQ ID NO: 1001326 - DNA, 15 bp, Homo sapiens
ccatcttagtttgga

SEQ ID NO: 1001327 - DNA, 13 bp, Homo sapiens
ccatcttcccagc

SEQ ID NO: 1001328 - DNA, 14 bp, Homo sapiens
ccatcttcctgctg

SEQ ID NO: 1001329 - DNA, 16 bp, Homo sapiens
ccatcttcctgctgct

SEQ ID NO: 1001330 - DNA, 14 bp, Homo sapiens
ccatcttgagatgg

SEQ ID NO: 1001331 - DNA, 13 bp, Homo sapiens
ccatcttgatctt

SEQ ID NO: 1001332 - DNA, 20 bp, Homo sapiens
ccatcttgatctttgagccc

SEQ ID NO: 1001333 - DNA, 17 bp, Homo sapiens
ccatctttactcccaag

SEQ ID NO: 1001334 - DNA, 23 bp, Homo sapiens
ccatgaaaacgttttattgtgtt

SEQ ID NO: 1001335 - DNA, 21 bp, Homo sapiens
ccatgaacacactgtgtcctg

SEQ ID NO: 1001336 - DNA, 20 bp, Homo sapiens
ccatgaaccaaatggttctt

SEQ ID NO: 1001337 - DNA, 12 bp, Homo sapiens
ccatgaagacag

SEQ ID NO: 1001338 - DNA, 14 bp, Homo sapiens
ccatgaagacagga

SEQ ID NO: 1001339 - DNA, 16 bp, Homo sapiens
ccatgaagacaggaca

SEQ ID NO: 1001340 - DNA, 21 bp, Homo sapiens
ccatgaagaggagattggcca

SEQ ID NO: 1001341 - DNA, 18 bp, Homo sapiens
ccatgaagggaccctttg

SEQ ID NO: 1001342 - DNA, 16 bp, Homo sapiens
ccatgaatcaaagaca

SEQ ID NO: 1001343 - DNA, 16 bp, Homo sapiens
ccatgacaagaacaaa

SEQ ID NO: 1001344 - DNA, 14 bp, Homo sapiens
ccatgacagaggct

SEQ ID NO: 1001345 - DNA, 19 bp, Homo sapiens
ccatgacagaggctgcacc

SEQ ID NO: 1001346 - DNA, 17 bp, Homo sapiens
ccatgacatttcatctg

SEQ ID NO: 1001347 - DNA, 12 bp, Homo sapiens
ccatgacccacc

SEQ ID NO: 1001348 - DNA, 12 bp, Homo sapiens
ccatgacctccc

SEQ ID NO: 1001349 - DNA, 21 bp, Homo sapiens
ccatgactcttggagcctctt

SEQ ID NO: 1001350 - DNA, 19 bp, Homo sapiens
ccatgactgcacccagctc

SEQ ID NO: 1001351 - DNA, 20 bp, Homo sapiens
ccatgactgcacccagctcc

SEQ ID NO: 1001352 - DNA, 17 bp, Homo sapiens
ccatgactggctgtctg

SEQ ID NO: 1001353 - DNA, 14 bp, Homo sapiens
ccatgacttgggct

SEQ ID NO: 1001354 - DNA, 13 bp, Homo sapiens
ccatgagaagagg

SEQ ID NO: 1001355 - DNA, 18 bp, Homo sapiens
ccatgagaagagggcctg

SEQ ID NO: 1001356 - DNA, 22 bp, Homo sapiens
ccatgagaataagagaaagaaa

SEQ ID NO: 1001357 - DNA, 19 bp, Homo sapiens
ccatgagcacctccagctg

SEQ ID NO: 1001358 - DNA, 20 bp, Homo sapiens
ccatgagcacctccagctgt

SEQ ID NO: 1001359 - DNA, 13 bp, Homo sapiens
ccatgagctccag

SEQ ID NO: 1001360 - DNA, 18 bp, Homo sapiens
ccatgagctccagacccc

SEQ ID NO: 1001361 - DNA, 16 bp, Homo sapiens
ccatggggtccttgga

SEQ ID NO: 1001362 - DNA, 17 bp, Homo sapiens
ccatggggttcgagact

SEQ ID NO: 1001363 - DNA, 19 bp, Homo sapiens
ccatggtactgtagcaggg

SEQ ID NO: 1001364 - DNA, 23 bp, Homo sapiens
ccatggtcctgtctgtccttctg

SEQ ID NO: 1001365 - DNA, 23 bp, Homo sapiens
ccatggtgaaagggtttgatatg

SEQ ID NO: 1001366 - DNA, 20 bp, Homo sapiens
ccatggtgatggtgtagccc

SEQ ID NO: 1001367 - DNA, 14 bp, Homo sapiens
ccatggtggaaggg

SEQ ID NO: 1001368 - DNA, 14 bp, Homo sapiens
ccatggtggagggc

SEQ ID NO: 1001369 - DNA, 18 bp, Homo sapiens
ccatggtggagggcactt

SEQ ID NO: 1001370 - DNA, 21 bp, Homo sapiens
ccatggtggagggcacttcag

SEQ ID NO: 1001371 - DNA, 23 bp, Homo sapiens
ccatggtggagggcacttcaggt

SEQ ID NO: 1001372 - DNA, 14 bp, Homo sapiens
ccatggtggcctca

SEQ ID NO: 1001373 - DNA, 16 bp, Homo sapiens
ccatggtgtattcaga

SEQ ID NO: 1001374 - DNA, 15 bp, Homo sapiens
ccatggtgtcccggt

SEQ ID NO: 1001375 - DNA, 19 bp, Homo sapiens
ccatggtgtgatcgtctga

SEQ ID NO: 1001376 - DNA, 15 bp, Homo sapiens
ccatggttttggctc

SEQ ID NO: 1001377 - DNA, 20 bp, Homo sapiens
ccatggttttggctctccca

SEQ ID NO: 1001378 - DNA, 21 bp, Homo sapiens
ccatggttttggctctcccac

SEQ ID NO: 1001379 - DNA, 23 bp, Homo sapiens
ccatggttttggctctcccaccc

SEQ ID NO: 1001380 - DNA, 23 bp, Homo sapiens
ccatgtaaggttgtgcagggtgt

SEQ ID NO: 1001381 - DNA, 19 bp, Homo sapiens
ccatgtaataagcacttgc

SEQ ID NO: 1001382 - DNA, 20 bp, Homo sapiens
ccatgtaatggcagttatat

SEQ ID NO: 1001383 - DNA, 16 bp, Homo sapiens
ccatgtacatgaagaa

SEQ ID NO: 1001384 - DNA, 13 bp, Homo sapiens
ccatgtacctccc

SEQ ID NO: 1001385 - DNA, 20 bp, Homo sapiens
ccatgtacctcccctgcctt

SEQ ID NO: 1001386 - DNA, 15 bp, Homo sapiens
ccatgtagaaaattt

SEQ ID NO: 1001387 - DNA, 19 bp, Homo sapiens
ccatgtagaataaatgaag

SEQ ID NO: 1001388 - DNA, 15 bp, Homo sapiens
ccatgtagccaccca

SEQ ID NO: 1001389 - DNA, 14 bp, Homo sapiens
ccatgtagccccct

SEQ ID NO: 1001390 - DNA, 20 bp, Homo sapiens
ccatgtagccccctggcctc

SEQ ID NO: 1001391 - DNA, 22 bp, Homo sapiens
ccatgtagccccctggcctctg

SEQ ID NO: 1001392 - DNA, 23 bp, Homo sapiens
ccatgtagccccctggcctctgt

SEQ ID NO: 1001393 - DNA, 23 bp, Homo sapiens
ccatgtatttatctctatttaat

SEQ ID NO: 1001394 - DNA, 20 bp, Homo sapiens
ccatgtatttcagggacctc

SEQ ID NO: 1001395 - DNA, 13 bp, Homo sapiens
ccatgtcacagca

SEQ ID NO: 1001396 - DNA, 14 bp, Homo sapiens
ccatgtcacctcag

SEQ ID NO: 1001397 - DNA, 16 bp, Homo sapiens
ccatgtcacctcagct

SEQ ID NO: 1001398 - DNA, 17 bp, Homo sapiens
atcctcccttgccccag

SEQ ID NO: 1001399 - DNA, 20 bp, Homo sapiens
atcctcccttgccccaggcc

SEQ ID NO: 1001400 - DNA, 15 bp, Homo sapiens
atcctcctccagggt

SEQ ID NO: 1001401 - DNA, 13 bp, Homo sapiens
atcctcctctcca

SEQ ID NO: 1001402 - DNA, 12 bp, Homo sapiens
atcctcctgccc

SEQ ID NO: 1001403 - DNA, 13 bp, Homo sapiens
atcctcctgcctc

SEQ ID NO: 1001404 - DNA, 18 bp, Homo sapiens
atcctcctgggattggct

SEQ ID NO: 1001405 - DNA, 16 bp, Homo sapiens
atcctctaaagcagag

SEQ ID NO: 1001406 - DNA, 12 bp, Homo sapiens
atcctctatttt

SEQ ID NO: 1001407 - DNA, 16 bp, Homo sapiens
atcctctcacctcagc

SEQ ID NO: 1001408 - DNA, 11 bp, Homo sapiens
atcctctccag

SEQ ID NO: 1001409 - DNA, 20 bp, Homo sapiens
atcctctccccctcctccag

SEQ ID NO: 1001410 - DNA, 15 bp, Homo sapiens
atcctctcctttctt

SEQ ID NO: 1001411 - DNA, 14 bp, Homo sapiens
atcctctctctctc

SEQ ID NO: 1001412 - DNA, 17 bp, Homo sapiens
atcctctcttcctcttc

SEQ ID NO: 1001413 - DNA, 10 bp, Homo sapiens
atcctctggc

SEQ ID NO: 1001414 - DNA, 17 bp, Homo sapiens
atcctcttcctctgagg

SEQ ID NO: 1001415 - DNA, 19 bp, Homo sapiens
atcctcttcctctgaggct

SEQ ID NO: 1001416 - DNA, 15 bp, Homo sapiens
atcctcttgtatact

SEQ ID NO: 1001417 - DNA, 19 bp, Homo sapiens
atcctctttactctgggca

SEQ ID NO: 1001418 - DNA, 22 bp, Homo sapiens
atcctctttactctgggcagaa

SEQ ID NO: 1001419 - DNA, 23 bp, Homo sapiens
atcctcttttaatggcatttctc

SEQ ID NO: 1001420 - DNA, 17 bp, Homo sapiens
atcctgaaatttcagat

SEQ ID NO: 1001421 - DNA, 19 bp, Homo sapiens
atcctgaactttctccctc

SEQ ID NO: 1001422 - DNA, 19 bp, Homo sapiens
atcctgaatctgatctttt

SEQ ID NO: 1001423 - DNA, 16 bp, Homo sapiens
atcctgaatctgtgca

SEQ ID NO: 1001424 - DNA, 11 bp, Homo sapiens
atcctgagccc

SEQ ID NO: 1001425 - DNA, 12 bp, Homo sapiens
atcctgagccca

SEQ ID NO: 1001426 - DNA, 20 bp, Homo sapiens
atcctgagccccgccctctt

SEQ ID NO: 1001427 - DNA, 23 bp, Homo sapiens
atcctgagccccgccctcttcct

SEQ ID NO: 1001428 - DNA, 14 bp, Homo sapiens
atcctgaggccagt

SEQ ID NO: 1001429 - DNA, 20 bp, Homo sapiens
atcctgataaacattaaaca

SEQ ID NO: 1001430 - DNA, 15 bp, Homo sapiens
atcctgatcccagac

SEQ ID NO: 1001431 - DNA, 19 bp, Homo sapiens
atcctgatggacctgcccc

SEQ ID NO: 1001432 - DNA, 15 bp, Homo sapiens
atcctgattccaaat

SEQ ID NO: 1001433 - DNA, 16 bp, Homo sapiens
atcctgcaaggtgaaa

SEQ ID NO: 1001434 - DNA, 17 bp, Homo sapiens
atcctgcaatgaaaggt

SEQ ID NO: 1001435 - DNA, 16 bp, Homo sapiens
atcctgcaccccagca

SEQ ID NO: 1001436 - DNA, 17 bp, Homo sapiens
atcctgcaccccagcat

SEQ ID NO: 1001437 - DNA, 20 bp, Homo sapiens
atcctgcagggcttctcctc

SEQ ID NO: 1001438 - DNA, 14 bp, Homo sapiens
atcctgccatcctc

SEQ ID NO: 1001439 - DNA, 16 bp, Homo sapiens
atcctgccatttaaaa

SEQ ID NO: 1001440 - DNA, 15 bp, Homo sapiens
atcctgcccccaagt

SEQ ID NO: 1001441 - DNA, 12 bp, Homo sapiens
atcctgccctgc

SEQ ID NO: 1001442 - DNA, 12 bp, Homo sapiens
atcctgcctctc

SEQ ID NO: 1001443 - DNA, 18 bp, Homo sapiens
atcctgcctctccccaaa

SEQ ID NO: 1001444 - DNA, 20 bp, Homo sapiens
atcctgctagcaggccccct

SEQ ID NO: 1001445 - DNA, 19 bp, Homo sapiens
atcctgctagctgtagaaa

SEQ ID NO: 1001446 - DNA, 16 bp, Homo sapiens
atcctgctcaggaaac

SEQ ID NO: 1001447 - DNA, 14 bp, Homo sapiens
atcctgctgctgtg

SEQ ID NO: 1001448 - DNA, 23 bp, Homo sapiens
atcctgcttctcttttcctcgca

SEQ ID NO: 1001449 - DNA, 19 bp, Homo sapiens
atcctgcttctgatatgca

SEQ ID NO: 1001450 - DNA, 21 bp, Homo sapiens
atcctgcttctgatatgcagt

SEQ ID NO: 1001451 - DNA, 22 bp, Homo sapiens
atcctggaaggacacagtgatg

SEQ ID NO: 1001452 - DNA, 22 bp, Homo sapiens
atcctggacatgaagattcttt

SEQ ID NO: 1001453 - DNA, 16 bp, Homo sapiens
atcctggagaagcctc

SEQ ID NO: 1001454 - DNA, 16 bp, Homo sapiens
atcctggcaagaaagc

SEQ ID NO: 1001455 - DNA, 21 bp, Homo sapiens
atcctggcaagaaagcttgag

SEQ ID NO: 1001456 - DNA, 21 bp, Homo sapiens
atcctggcacgccctactcca

SEQ ID NO: 1001457 - DNA, 16 bp, Homo sapiens
atcctggcagcccaga

SEQ ID NO: 1001458 - DNA, 18 bp, Homo sapiens
atcctggcagcccagaga

SEQ ID NO: 1001459 - DNA, 24 bp, Homo sapiens
atcctggcagcccagagactttgt

SEQ ID NO: 1001460 - DNA, 12 bp, Homo sapiens
atcctggccaac

SEQ ID NO: 1001461 - DNA, 14 bp, Homo sapiens
atcctggcccctcc

SEQ ID NO: 1001462 - DNA, 15 bp, Homo sapiens
atcctggcctccttt

SEQ ID NO: 1001463 - DNA, 18 bp, Homo sapiens
atcctggctaacatggtg

SEQ ID NO: 1001464 - DNA, 15 bp, Homo sapiens
atcctggggctccct

SEQ ID NO: 1001465 - DNA, 16 bp, Homo sapiens
atcctggggctccctt

SEQ ID NO: 1001466 - DNA, 19 bp, Homo sapiens
atcctggtaaccaaatatt

SEQ ID NO: 1001467 - DNA, 14 bp, Homo sapiens
atcctggtttcata

SEQ ID NO: 1001468 - DNA, 22 bp, Homo sapiens
atcctgtaactacaatgatggt

SEQ ID NO: 1001469 - DNA, 16 bp, Homo sapiens
atcctgtataagcact

SEQ ID NO: 1001470 - DNA, 17 bp, Homo sapiens
atcctgtataagcactg

SEQ ID NO: 1001471 - DNA, 19 bp, Homo sapiens
atcctgtctttaaggaaaa

SEQ ID NO: 1001472 - DNA, 21 bp, Homo sapiens
atcctgtctttaaggaaaaaa

SEQ ID NO: 1001473 - DNA, 22 bp, Homo sapiens
atcctgtgagtaggctgggcct

SEQ ID NO: 1001474 - DNA, 18 bp, Homo sapiens
atcctgtgccagaggaag

SEQ ID NO: 1001475 - DNA, 18 bp, Homo sapiens
atcctgtgtttctaggga

SEQ ID NO: 1001476 - DNA, 18 bp, Homo sapiens
atcctgtttgtatgaaat

SEQ ID NO: 1001477 - DNA, 21 bp, Homo sapiens
atcctgtttttagtgctgact

SEQ ID NO: 1001478 - DNA, 16 bp, Homo sapiens
atccttaaatatgtga

SEQ ID NO: 1001479 - DNA, 20 bp, Homo sapiens
atccttaaatcttaatgttc

SEQ ID NO: 1001480 - DNA, 18 bp, Homo sapiens
atccttagagaagtttgt

SEQ ID NO: 1001481 - DNA, 13 bp, Homo sapiens
atccttagaggtc

SEQ ID NO: 1001482 - DNA, 23 bp, Homo sapiens
atccttaggaaaatgcttctgtt

SEQ ID NO: 1001483 - DNA, 19 bp, Homo sapiens
atcgtggcacgtattgctg

SEQ ID NO: 1001484 - DNA, 21 bp, Homo sapiens
atcgtggcacgtattgctgtg

SEQ ID NO: 1001485 - DNA, 21 bp, Homo sapiens
atcgtgtgccatggatctgat

SEQ ID NO: 1001486 - DNA, 22 bp, Homo sapiens
atcgtgtgccatggatctgatc

SEQ ID NO: 1001487 - DNA, 15 bp, Homo sapiens
atcgttatcactgtg

SEQ ID NO: 1001488 - DNA, 15 bp, Homo sapiens
atcgttccagttccc

SEQ ID NO: 1001489 - DNA, 23 bp, Homo sapiens
atcgttcctatacatttctgttc

SEQ ID NO: 1001490 - DNA, 15 bp, Homo sapiens
atcgttggaaaataa

SEQ ID NO: 1001491 - DNA, 21 bp, Homo sapiens
atcgttgttttgctggaggga

SEQ ID NO: 1001492 - DNA, 21 bp, Homo sapiens
atcgtttaaaaacaaaggaat

SEQ ID NO: 1001493 - DNA, 22 bp, Homo sapiens
atcgtttgcaaatgtcagtttc

SEQ ID NO: 1001494 - DNA, 17 bp, Homo sapiens
atcgttttcttaaagtg

SEQ ID NO: 1001495 - DNA, 23 bp, Homo sapiens
atctaaaaatagacttaaatctc

SEQ ID NO: 1001496 - DNA, 20 bp, Homo sapiens
atctaaaacaaaatctgaac

SEQ ID NO: 1001497 - DNA, 19 bp, Homo sapiens
atctaaaagaaatgtctat

SEQ ID NO: 1001498 - DNA, 14 bp, Homo sapiens
atctaaaatgattg

SEQ ID NO: 1001499 - DNA, 19 bp, Homo sapiens
atctaaacgtggtcacctt

SEQ ID NO: 1001500 - DNA, 21 bp, Homo sapiens
atctaaacgtggtcaccttcg

SEQ ID NO: 1001501 - DNA, 20 bp, Homo sapiens
atctaaactggagtgatgtt

SEQ ID NO: 1001502 - DNA, 20 bp, Homo sapiens
atctaaagtgtgttgttgct

SEQ ID NO: 1001503 - DNA, 23 bp, Homo sapiens
atctaaagtgtgttgttgcttta

SEQ ID NO: 1001504 - DNA, 14 bp, Homo sapiens
atctaaagttatat

SEQ ID NO: 1001505 - DNA, 18 bp, Homo sapiens
atctaaagttatatttca

SEQ ID NO: 1001506 - DNA, 13 bp, Homo sapiens
atctaaagtttgt

SEQ ID NO: 1001507 - DNA, 16 bp, Homo sapiens
atctaaatctatttat

SEQ ID NO: 1001508 - DNA, 18 bp, Homo sapiens
atctaaatctatttatta

SEQ ID NO: 1001509 - DNA, 19 bp, Homo sapiens
atctaaatggaaccactct

SEQ ID NO: 1001510 - DNA, 20 bp, Homo sapiens
atctaaattacagtgcagtt

SEQ ID NO: 1001511 - DNA, 13 bp, Homo sapiens
atctaacctcatc

SEQ ID NO: 1001512 - DNA, 18 bp, Homo sapiens
atctaacgggcattcaca

SEQ ID NO: 1001513 - DNA, 15 bp, Homo sapiens
atctaactttccttc

SEQ ID NO: 1001514 - DNA, 15 bp, Homo sapiens
atctaagctgtttgc

SEQ ID NO: 1001515 - DNA, 18 bp, Homo sapiens
atctaagctgtttgccaa

SEQ ID NO: 1001516 - DNA, 15 bp, Homo sapiens
atctaataattattc

SEQ ID NO: 1001517 - DNA, 14 bp, Homo sapiens
atctaatacaaaat

SEQ ID NO: 1001518 - DNA, 17 bp, Homo sapiens
atctaatatatatgaat

SEQ ID NO: 1001519 - DNA, 20 bp, Homo sapiens
atctaatatatatgaataaa

SEQ ID NO: 1001520 - DNA, 16 bp, Homo sapiens
atctaatatggccaca

SEQ ID NO: 1001521 - DNA, 23 bp, Homo sapiens
atctaatctgaactgaccttgaa

SEQ ID NO: 1001522 - DNA, 23 bp, Homo sapiens
atctaatgaaaaacaaaaagcta

SEQ ID NO: 1001523 - DNA, 15 bp, Homo sapiens
atctaatgtgaaaat

SEQ ID NO: 1001524 - DNA, 13 bp, Homo sapiens
atctaatttataa

SEQ ID NO: 1001525 - DNA, 15 bp, Homo sapiens
atctaatttataaaa

SEQ ID NO: 1001526 - DNA, 23 bp, Homo sapiens
atctaatttataaaaaggtgttt

SEQ ID NO: 1001527 - DNA, 16 bp, Homo sapiens
atctacaaaagtgaac

SEQ ID NO: 1001528 - DNA, 12 bp, Homo sapiens
atctacaagcca

SEQ ID NO: 1001529 - DNA, 19 bp, Homo sapiens
ccattgaagccgactctgg

SEQ ID NO: 1001530 - DNA, 20 bp, Homo sapiens
ccattgaagccgactctggc

SEQ ID NO: 1001531 - DNA, 11 bp, Homo sapiens
ccattgaaggc

SEQ ID NO: 1001532 - DNA, 17 bp, Homo sapiens
ccattgaaggcttaaac

SEQ ID NO: 1001533 - DNA, 21 bp, Homo sapiens
ccattgaaggcttaaacccat

SEQ ID NO: 1001534 - DNA, 15 bp, Homo sapiens
ccattgacctcagct

SEQ ID NO: 1001535 - DNA, 16 bp, Homo sapiens
ccattgagtccctgct

SEQ ID NO: 1001536 - DNA, 16 bp, Homo sapiens
ccattgatgtttaagt

SEQ ID NO: 1001537 - DNA, 20 bp, Homo sapiens
ccattgcactctagcctggc

SEQ ID NO: 1001538 - DNA, 15 bp, Homo sapiens
ccattgccaccagga

SEQ ID NO: 1001539 - DNA, 14 bp, Homo sapiens
ccattggagcacct

SEQ ID NO: 1001540 - DNA, 20 bp, Homo sapiens
ccattggagcacctgggccc

SEQ ID NO: 1001541 - DNA, 17 bp, Homo sapiens
ccattggatcttttact

SEQ ID NO: 1001542 - DNA, 17 bp, Homo sapiens
ccattggccgagctcct

SEQ ID NO: 1001543 - DNA, 20 bp, Homo sapiens
ccattggccgagctcctggg

SEQ ID NO: 1001544 - DNA, 21 bp, Homo sapiens
ccattggccgagctcctgggg

SEQ ID NO: 1001545 - DNA, 19 bp, Homo sapiens
ccattggctatttaaaact

SEQ ID NO: 1001546 - DNA, 20 bp, Homo sapiens
ccattggctatttaaaactt

SEQ ID NO: 1001547 - DNA, 22 bp, Homo sapiens
ccattggctgcgctaaccccca

SEQ ID NO: 1001548 - DNA, 22 bp, Homo sapiens
ccattgggcacagtccagaccc

SEQ ID NO: 1001549 - DNA, 14 bp, Homo sapiens
ccattgggtttggg

SEQ ID NO: 1001550 - DNA, 22 bp, Homo sapiens
ccattgggtttggggccatggt

SEQ ID NO: 1001551 - DNA, 23 bp, Homo sapiens
ccattgggtttggggccatggtg

SEQ ID NO: 1001552 - DNA, 19 bp, Homo sapiens
ccattgtactccagcctgg

SEQ ID NO: 1001553 - DNA, 19 bp, Homo sapiens
ccattgtccaatcctatgt

SEQ ID NO: 1001554 - DNA, 14 bp, Homo sapiens
ccattgtcctcctt

SEQ ID NO: 1001555 - DNA, 19 bp, Homo sapiens
ccattgtcctccttttcac

SEQ ID NO: 1001556 - DNA, 20 bp, Homo sapiens
ccattgtgcctaagtccagt

SEQ ID NO: 1001557 - DNA, 23 bp, Homo sapiens
ccattgtgtgatccagccctggt

SEQ ID NO: 1001558 - DNA, 15 bp, Homo sapiens
ccattgttcccttcc

SEQ ID NO: 1001559 - DNA, 21 bp, Homo sapiens
ccattgttcccttcctcttcc

SEQ ID NO: 1001560 - DNA, 21 bp, Homo sapiens
ccattgttgtcaaggaagaag

SEQ ID NO: 1001561 - DNA, 19 bp, Homo sapiens
ccatttaaatttttttcct

SEQ ID NO: 1001562 - DNA, 19 bp, Homo sapiens
ccatttaagtatcttgtgc

SEQ ID NO: 1001563 - DNA, 21 bp, Homo sapiens
ccatttaagtatcttgtgctt

SEQ ID NO: 1001564 - DNA, 21 bp, Homo sapiens
ccatttaataaagaaatattt

SEQ ID NO: 1001565 - DNA, 20 bp, Homo sapiens
ccatttacagtctctttctt

SEQ ID NO: 1001566 - DNA, 23 bp, Homo sapiens
ccatttacagtctctttcttcct

SEQ ID NO: 1001567 - DNA, 20 bp, Homo sapiens
ccatttacatgttttaaaga

SEQ ID NO: 1001568 - DNA, 14 bp, Homo sapiens
ccatttactaacag

SEQ ID NO: 1001569 - DNA, 15 bp, Homo sapiens
ccatttactgacact

SEQ ID NO: 1001570 - DNA, 23 bp, Homo sapiens
ccatttactgacacttcctgtcc

SEQ ID NO: 1001571 - DNA, 11 bp, Homo sapiens
ccatttattgt

SEQ ID NO: 1001572 - DNA, 21 bp, Homo sapiens
ccatttattgtttgaaatgtc

SEQ ID NO: 1001573 - DNA, 17 bp, Homo sapiens
ccatttcaattctcaaa

SEQ ID NO: 1001574 - DNA, 17 bp, Homo sapiens
ccatttccactgtatat

SEQ ID NO: 1001575 - DNA, 17 bp, Homo sapiens
ccatttcccacatcttt

SEQ ID NO: 1001576 - DNA, 17 bp, Homo sapiens
ccatttcccatctgcac

SEQ ID NO: 1001577 - DNA, 14 bp, Homo sapiens
ccatttccccctcc

SEQ ID NO: 1001578 - DNA, 17 bp, Homo sapiens
ccatttccccctcctca

SEQ ID NO: 1001579 - DNA, 18 bp, Homo sapiens
ccatttcccgcacatggt

SEQ ID NO: 1001580 - DNA, 16 bp, Homo sapiens
ccatttcctcacgtgc

SEQ ID NO: 1001581 - DNA, 19 bp, Homo sapiens
ccatttcctcagcttatct

SEQ ID NO: 1001582 - DNA, 11 bp, Homo sapiens
ccatttcctga

SEQ ID NO: 1001583 - DNA, 17 bp, Homo sapiens
ccatttctatttattta

SEQ ID NO: 1001584 - DNA, 13 bp, Homo sapiens
ccatttctcactg

SEQ ID NO: 1001585 - DNA, 14 bp, Homo sapiens
ccatttctcactga

SEQ ID NO: 1001586 - DNA, 12 bp, Homo sapiens
ccatttctcatg

SEQ ID NO: 1001587 - DNA, 13 bp, Homo sapiens
ccatttcttcaga

SEQ ID NO: 1001588 - DNA, 13 bp, Homo sapiens
ccatttctttctt

SEQ ID NO: 1001589 - DNA, 22 bp, Homo sapiens
ccatttgccaattttcctactc

SEQ ID NO: 1001590 - DNA, 20 bp, Homo sapiens
ccatttgtgatcagcattgt

SEQ ID NO: 1001591 - DNA, 18 bp, Homo sapiens
ccatttgtgccagaggaa

SEQ ID NO: 1001592 - DNA, 13 bp, Homo sapiens
ccatttgttcctg

SEQ ID NO: 1001593 - DNA, 16 bp, Homo sapiens
ccattttaaattttat

SEQ ID NO: 1001594 - DNA, 17 bp, Homo sapiens
ccattttaacgctgcct

SEQ ID NO: 1001595 - DNA, 18 bp, Homo sapiens
ccattttaacgctgccta

SEQ ID NO: 1001596 - DNA, 19 bp, Homo sapiens
ccattttattttttgggcc

SEQ ID NO: 1001597 - DNA, 13 bp, Homo sapiens
ccattttcccctt

SEQ ID NO: 1001598 - DNA, 16 bp, Homo sapiens
ccattttccccttcct

SEQ ID NO: 1001599 - DNA, 14 bp, Homo sapiens
ccattttcctttgg

SEQ ID NO: 1001600 - DNA, 21 bp, Homo sapiens
ccattttgcaaaatttccagt

SEQ ID NO: 1001601 - DNA, 23 bp, Homo sapiens
ccattttgttattgactaacagg

SEQ ID NO: 1001602 - DNA, 16 bp, Homo sapiens
ccatttttaaccactt

SEQ ID NO: 1001603 - DNA, 15 bp, Homo sapiens
ccatttttcaaagca

SEQ ID NO: 1001604 - DNA, 19 bp, Homo sapiens
cccaaggaaagccccagca

SEQ ID NO: 1001605 - DNA, 22 bp, Homo sapiens
cccaaggaaagccccagcacta

SEQ ID NO: 1001606 - DNA, 15 bp, Homo sapiens
cccaaggactgaggg

SEQ ID NO: 1001607 - DNA, 14 bp, Homo sapiens
cccaaggagcacag

SEQ ID NO: 1001608 - DNA, 15 bp, Homo sapiens
cccaaggaggaaaaa

SEQ ID NO: 1001609 - DNA, 14 bp, Homo sapiens
cccaaggatgcctt

SEQ ID NO: 1001610 - DNA, 19 bp, Homo sapiens
cccaaggccccagggacag

SEQ ID NO: 1001611 - DNA, 21 bp, Homo sapiens
cccaaggcctctcaccccact

SEQ ID NO: 1001612 - DNA, 17 bp, Homo sapiens
cccaaggctctgagcaa

SEQ ID NO: 1001613 - DNA, 23 bp, Homo sapiens
cccaagggatctggtcctaccca

SEQ ID NO: 1001614 - DNA, 22 bp, Homo sapiens
cccaagggatggcaccacttat

SEQ ID NO: 1001615 - DNA, 19 bp, Homo sapiens
cccaagggtgccctttggg

SEQ ID NO: 1001616 - DNA, 16 bp, Homo sapiens
cccaaggtcagggagg

SEQ ID NO: 1001617 - DNA, 15 bp, Homo sapiens
cccaaggtcccctcc

SEQ ID NO: 1001618 - DNA, 15 bp, Homo sapiens
cccaagtagctggga

SEQ ID NO: 1001619 - DNA, 22 bp, Homo sapiens
cccaagtatgccttaagcagaa

SEQ ID NO: 1001620 - DNA, 21 bp, Homo sapiens
cccaagtattgcgaatgtgca

SEQ ID NO: 1001621 - DNA, 19 bp, Homo sapiens
cccaagtgaccagggaagt

SEQ ID NO: 1001622 - DNA, 19 bp, Homo sapiens
cccaagtgcactttctaat

SEQ ID NO: 1001623 - DNA, 15 bp, Homo sapiens
cccaagtgccagtct

SEQ ID NO: 1001624 - DNA, 13 bp, Homo sapiens
cccaagtgcctca

SEQ ID NO: 1001625 - DNA, 14 bp, Homo sapiens
cccaagtgcctcac

SEQ ID NO: 1001626 - DNA, 13 bp, Homo sapiens
cccaagtgggcag

SEQ ID NO: 1001627 - DNA, 23 bp, Homo sapiens
cccaagtgggcagtcaccaccca

SEQ ID NO: 1001628 - DNA, 21 bp, Homo sapiens
cccaagttctaggccccccag

SEQ ID NO: 1001629 - DNA, 19 bp, Homo sapiens
cccaagttgcagtgagcag

SEQ ID NO: 1001630 - DNA, 21 bp, Homo sapiens
cccaagttgcagtgagcaggg

SEQ ID NO: 1001631 - DNA, 20 bp, Homo sapiens
cccaagtttatttctctctt

SEQ ID NO: 1001632 - DNA, 23 bp, Homo sapiens
cccaagttttaggacaaacagct

SEQ ID NO: 1001633 - DNA, 16 bp, Homo sapiens
cccaagttttttaatt

SEQ ID NO: 1001634 - DNA, 14 bp, Homo sapiens
cccaataaaagtga

SEQ ID NO: 1001635 - DNA, 21 bp, Homo sapiens
cccaataaacattaagattga

SEQ ID NO: 1001636 - DNA, 14 bp, Homo sapiens
cccaataaaggcag

SEQ ID NO: 1001637 - DNA, 15 bp, Homo sapiens
cccaatcaaagaatt

SEQ ID NO: 1001638 - DNA, 18 bp, Homo sapiens
cccaatcaaagaattaca

SEQ ID NO: 1001639 - DNA, 15 bp, Homo sapiens
cccaatcagcttttg

SEQ ID NO: 1001640 - DNA, 23 bp, Homo sapiens
cccaatcagcttttgttctagac

SEQ ID NO: 1001641 - DNA, 17 bp, Homo sapiens
cccaatccctttattac

SEQ ID NO: 1001642 - DNA, 16 bp, Homo sapiens
cccaatcggactgcca

SEQ ID NO: 1001643 - DNA, 13 bp, Homo sapiens
cccaatctttcta

SEQ ID NO: 1001644 - DNA, 16 bp, Homo sapiens
cccaatgcctataaaa

SEQ ID NO: 1001645 - DNA, 14 bp, Homo sapiens
cccaatgctttggg

SEQ ID NO: 1001646 - DNA, 20 bp, Homo sapiens
cccaatggataaatcagtgc

SEQ ID NO: 1001647 - DNA, 21 bp, Homo sapiens
cccaatgggaccgtgccccac

SEQ ID NO: 1001648 - DNA, 23 bp, Homo sapiens
cccaatgggaccgtgccccacct

SEQ ID NO: 1001649 - DNA, 16 bp, Homo sapiens
cccaatgtaggagctg

SEQ ID NO: 1001650 - DNA, 19 bp, Homo sapiens
cccaatgtctcccacaccc

SEQ ID NO: 1001651 - DNA, 14 bp, Homo sapiens
cccaatgtttaaaa

SEQ ID NO: 1001652 - DNA, 15 bp, Homo sapiens
cccaattaggaagtg

SEQ ID NO: 1001653 - DNA, 19 bp, Homo sapiens
cccaattaggaagtgtaac

SEQ ID NO: 1001654 - DNA, 18 bp, Homo sapiens
cccaattctgcctgcctc

SEQ ID NO: 1001655 - DNA, 11 bp, Homo sapiens
cccaatttccc

SEQ ID NO: 1001656 - DNA, 22 bp, Homo sapiens
cccaatttcggattttttccaa

SEQ ID NO: 1001657 - DNA, 22 bp, Homo sapiens
cccaattttaatctgaaaattt

SEQ ID NO: 1001658 - DNA, 16 bp, Homo sapiens
atctcatgattccatg

SEQ ID NO: 1001659 - DNA, 21 bp, Homo sapiens
atctcatgcccctggctggga

SEQ ID NO: 1001660 - DNA, 16 bp, Homo sapiens
atctcattgcttacaa

SEQ ID NO: 1001661 - DNA, 13 bp, Homo sapiens
atctcatttaagg

SEQ ID NO: 1001662 - DNA, 17 bp, Homo sapiens
atctcatttaagggaaa

SEQ ID NO: 1001663 - DNA, 18 bp, Homo sapiens
atctcatttaagggaaaa

SEQ ID NO: 1001664 - DNA, 13 bp, Homo sapiens
atctccaaaataa

SEQ ID NO: 1001665 - DNA, 18 bp, Homo sapiens
atctccaagaccagagat

SEQ ID NO: 1001666 - DNA, 17 bp, Homo sapiens
atctccaagacctggtg

SEQ ID NO: 1001667 - DNA, 18 bp, Homo sapiens
atctccaagacctggtgt

SEQ ID NO: 1001668 - DNA, 12 bp, Homo sapiens
atctccaaggac

SEQ ID NO: 1001669 - DNA, 15 bp, Homo sapiens
atctccactccagat

SEQ ID NO: 1001670 - DNA, 21 bp, Homo sapiens
atctccagggagcaagacaga

SEQ ID NO: 1001671 - DNA, 16 bp, Homo sapiens
atctccataaacatga

SEQ ID NO: 1001672 - DNA, 14 bp, Homo sapiens
atctccatggcttc

SEQ ID NO: 1001673 - DNA, 19 bp, Homo sapiens
atctcccagataatgtgaa

SEQ ID NO: 1001674 - DNA, 18 bp, Homo sapiens
atctcccattttggaatt

SEQ ID NO: 1001675 - DNA, 12 bp, Homo sapiens
atctccccaggc

SEQ ID NO: 1001676 - DNA, 13 bp, Homo sapiens
atctccccaggcc

SEQ ID NO: 1001677 - DNA, 16 bp, Homo sapiens
atctccccaggcctcc

SEQ ID NO: 1001678 - DNA, 19 bp, Homo sapiens
atctccccaggcctccagc

SEQ ID NO: 1001679 - DNA, 22 bp, Homo sapiens
atctccccaggcctccagcctc

SEQ ID NO: 1001680 - DNA, 21 bp, Homo sapiens
atctcccccatagcaccctgc

SEQ ID NO: 1001681 - DNA, 22 bp, Homo sapiens
atctcccctcctggcgagttct

SEQ ID NO: 1001682 - DNA, 23 bp, Homo sapiens
atctccccttgcactaaagtatg

SEQ ID NO: 1001683 - DNA, 23 bp, Homo sapiens
atctccctgccatccccctctca

SEQ ID NO: 1001684 - DNA, 12 bp, Homo sapiens
atctccctgccg

SEQ ID NO: 1001685 - DNA, 13 bp, Homo sapiens
atctccctgcctg

SEQ ID NO: 1001686 - DNA, 14 bp, Homo sapiens
atctccctggagaa

SEQ ID NO: 1001687 - DNA, 17 bp, Homo sapiens
atctcctataatctgtc

SEQ ID NO: 1001688 - DNA, 18 bp, Homo sapiens
atctcctccaatgtcctg

SEQ ID NO: 1001689 - DNA, 15 bp, Homo sapiens
atctcctctgctcat

SEQ ID NO: 1001690 - DNA, 12 bp, Homo sapiens
atctcctgaaaa

SEQ ID NO: 1001691 - DNA, 18 bp, Homo sapiens
atctcctgacagaaggtg

SEQ ID NO: 1001692 - DNA, 13 bp, Homo sapiens
atctcctgagtat

SEQ ID NO: 1001693 - DNA, 14 bp, Homo sapiens
atctcctgatttct

SEQ ID NO: 1001694 - DNA, 17 bp, Homo sapiens
atctcctgccttcctcc

SEQ ID NO: 1001695 - DNA, 17 bp, Homo sapiens
atctcctggtgttctgc

SEQ ID NO: 1001696 - DNA, 21 bp, Homo sapiens
atctcctgtccatcagccagg

SEQ ID NO: 1001697 - DNA, 18 bp, Homo sapiens
atctcctgtgcatgggtg

SEQ ID NO: 1001698 - DNA, 17 bp, Homo sapiens
atctccttcccctacac

SEQ ID NO: 1001699 - DNA, 15 bp, Homo sapiens
atctcctttcaggga

SEQ ID NO: 1001700 - DNA, 15 bp, Homo sapiens
atctcgagccccctg

SEQ ID NO: 1001701 - DNA, 22 bp, Homo sapiens
atctcgcagtgtttctgtgaat

SEQ ID NO: 1001702 - DNA, 16 bp, Homo sapiens
atctcggctcagcctc

SEQ ID NO: 1001703 - DNA, 18 bp, Homo sapiens
atctcggctcagcctccc

SEQ ID NO: 1001704 - DNA, 14 bp, Homo sapiens
atctcggggctgct

SEQ ID NO: 1001705 - DNA, 18 bp, Homo sapiens
atctctaaaataggtaaa

SEQ ID NO: 1001706 - DNA, 15 bp, Homo sapiens
atctctaatatggca

SEQ ID NO: 1001707 - DNA, 17 bp, Homo sapiens
atctctaattagtctat

SEQ ID NO: 1001708 - DNA, 14 bp, Homo sapiens
atctctaccccaaa

SEQ ID NO: 1001709 - DNA, 16 bp, Homo sapiens
atctctacccctttct

SEQ ID NO: 1001710 - DNA, 17 bp, Homo sapiens
atctctatttaatattt

SEQ ID NO: 1001711 - DNA, 18 bp, Homo sapiens
atctctatttaatattta

SEQ ID NO: 1001712 - DNA, 16 bp, Homo sapiens
atctctcaggagcaca

SEQ ID NO: 1001713 - DNA, 12 bp, Homo sapiens
atctctcatcct

SEQ ID NO: 1001714 - DNA, 17 bp, Homo sapiens
atctctcatcctccagt

SEQ ID NO: 1001715 - DNA, 21 bp, Homo sapiens
atctctcatcctccagtacct

SEQ ID NO: 1001716 - DNA, 17 bp, Homo sapiens
atctctcccacttcctc

SEQ ID NO: 1001717 - DNA, 19 bp, Homo sapiens
atctctcccacttcctcct

SEQ ID NO: 1001718 - DNA, 21 bp, Homo sapiens
atctctcccacttcctcctac

SEQ ID NO: 1001719 - DNA, 11 bp, Homo sapiens
atctctccctc

SEQ ID NO: 1001720 - DNA, 22 bp, Homo sapiens
atctctcctggcctatccgctg

SEQ ID NO: 1001721 - DNA, 18 bp, Homo sapiens
atctctctacctccaccc

SEQ ID NO: 1001722 - DNA, 20 bp, Homo sapiens
atctctctacctccaccctg

SEQ ID NO: 1001723 - DNA, 23 bp, Homo sapiens
atctctctactcctacctcagcc

SEQ ID NO: 1001724 - DNA, 16 bp, Homo sapiens
atctctctgccctctc

SEQ ID NO: 1001725 - DNA, 13 bp, Homo sapiens
atctctctggctt

SEQ ID NO: 1001726 - DNA, 13 bp, Homo sapiens
atctgctgaggcc

SEQ ID NO: 1001727 - DNA, 21 bp, Homo sapiens
atctgctgcatagctctattt

SEQ ID NO: 1001728 - DNA, 23 bp, Homo sapiens
atctgctgcatagctctatttta

SEQ ID NO: 1001729 - DNA, 13 bp, Homo sapiens
atctgctgtgtgg

SEQ ID NO: 1001730 - DNA, 14 bp, Homo sapiens
atctgctgtgtgga

SEQ ID NO: 1001731 - DNA, 17 bp, Homo sapiens
atctgctgtgtggaaaa

SEQ ID NO: 1001732 - DNA, 13 bp, Homo sapiens
atctgctgttatc

SEQ ID NO: 1001733 - DNA, 15 bp, Homo sapiens
atctgctgttgccat

SEQ ID NO: 1001734 - DNA, 17 bp, Homo sapiens
atctgctgttgccatag

SEQ ID NO: 1001735 - DNA, 19 bp, Homo sapiens
atctgcttacaattccctg

SEQ ID NO: 1001736 - DNA, 13 bp, Homo sapiens
atctggaaatctg

SEQ ID NO: 1001737 - DNA, 16 bp, Homo sapiens
atctggaaggcccctc

SEQ ID NO: 1001738 - DNA, 21 bp, Homo sapiens
atctggaatctggagaccagg

SEQ ID NO: 1001739 - DNA, 14 bp, Homo sapiens
atctggacagaaca

SEQ ID NO: 1001740 - DNA, 17 bp, Homo sapiens
atctggacccttggcct

SEQ ID NO: 1001741 - DNA, 17 bp, Homo sapiens
atctggaggccttccag

SEQ ID NO: 1001742 - DNA, 22 bp, Homo sapiens
atctggaggccttccagctgct

SEQ ID NO: 1001743 - DNA, 23 bp, Homo sapiens
atctggaggccttccagctgctg

SEQ ID NO: 1001744 - DNA, 15 bp, Homo sapiens
atctggattcaaatt

SEQ ID NO: 1001745 - DNA, 16 bp, Homo sapiens
atctggcaacatcttt

SEQ ID NO: 1001746 - DNA, 12 bp, Homo sapiens
atctggcagggt

SEQ ID NO: 1001747 - DNA, 14 bp, Homo sapiens
atctggcatggctc

SEQ ID NO: 1001748 - DNA, 14 bp, Homo sapiens
atctggcgttcttt

SEQ ID NO: 1001749 - DNA, 19 bp, Homo sapiens
atctggctgtctagaatgt

SEQ ID NO: 1001750 - DNA, 11 bp, Homo sapiens
atctgggaaag

SEQ ID NO: 1001751 - DNA, 15 bp, Homo sapiens
atctgggaagctatt

SEQ ID NO: 1001752 - DNA, 17 bp, Homo sapiens
atctgggaccctttcct

SEQ ID NO: 1001753 - DNA, 22 bp, Homo sapiens
atctgggaccctttccttcctt

SEQ ID NO: 1001754 - DNA, 23 bp, Homo sapiens
atctgggaccctttccttccttc

SEQ ID NO: 1001755 - DNA, 20 bp, Homo sapiens
atctgggagtccccttttct

SEQ ID NO: 1001756 - DNA, 16 bp, Homo sapiens
atctgggattattctt

SEQ ID NO: 1001757 - DNA, 17 bp, Homo sapiens
atctgggattattcttt

SEQ ID NO: 1001758 - DNA, 22 bp, Homo sapiens
atctgggcattaagtcagtggc

SEQ ID NO: 1001759 - DNA, 17 bp, Homo sapiens
atctgggcattttcctc

SEQ ID NO: 1001760 - DNA, 18 bp, Homo sapiens
atctgggcattttcctcc

SEQ ID NO: 1001761 - DNA, 17 bp, Homo sapiens
atctgggctgtgggcaa

SEQ ID NO: 1001762 - DNA, 18 bp, Homo sapiens
atctggggagctcctggc

SEQ ID NO: 1001763 - DNA, 14 bp, Homo sapiens
atctggggggtggg

SEQ ID NO: 1001764 - DNA, 19 bp, Homo sapiens
atctggggggtggggagga

SEQ ID NO: 1001765 - DNA, 23 bp, Homo sapiens
atctggggtgggagtaacagggc

SEQ ID NO: 1001766 - DNA, 21 bp, Homo sapiens
atctgggtgcatgatcttgag

SEQ ID NO: 1001767 - DNA, 22 bp, Homo sapiens
atctgggtgcatgatcttgagc

SEQ ID NO: 1001768 - DNA, 13 bp, Homo sapiens
atctgggtgccct

SEQ ID NO: 1001769 - DNA, 14 bp, Homo sapiens
atctgggtggtctg

SEQ ID NO: 1001770 - DNA, 18 bp, Homo sapiens
atctggtatatgtcatta

SEQ ID NO: 1001771 - DNA, 15 bp, Homo sapiens
atctggtattaaatg

SEQ ID NO: 1001772 - DNA, 18 bp, Homo sapiens
atctggtattaaatgcca

SEQ ID NO: 1001773 - DNA, 22 bp, Homo sapiens
atctggtcttgtttccaggagc

SEQ ID NO: 1001774 - DNA, 20 bp, Homo sapiens
atctggtgacaaatattctc

SEQ ID NO: 1001775 - DNA, 14 bp, Homo sapiens
atctggtgatctcc

SEQ ID NO: 1001776 - DNA, 14 bp, Homo sapiens
atctggtgatttct

SEQ ID NO: 1001777 - DNA, 18 bp, Homo sapiens
atctgtaaagccagttag

SEQ ID NO: 1001778 - DNA, 17 bp, Homo sapiens
atctgtaacccccaagg

SEQ ID NO: 1001779 - DNA, 22 bp, Homo sapiens
atctgtaacccttgaatttcta

SEQ ID NO: 1001780 - DNA, 21 bp, Homo sapiens
atctgtaagagcttgctccag

SEQ ID NO: 1001781 - DNA, 16 bp, Homo sapiens
atctgtaattgataat

SEQ ID NO: 1001782 - DNA, 15 bp, Homo sapiens
atctgtacaatgaac

SEQ ID NO: 1001783 - DNA, 13 bp, Homo sapiens
atctgtacatgtt

SEQ ID NO: 1001784 - DNA, 17 bp, Homo sapiens
atctgtacatgttcttg

SEQ ID NO: 1001785 - DNA, 11 bp, Homo sapiens
atctgtacttt

SEQ ID NO: 1001786 - DNA, 18 bp, Homo sapiens
atctgtagggctggacct

SEQ ID NO: 1001787 - DNA, 17 bp, Homo sapiens
atctgtataagtaagaa

SEQ ID NO: 1001788 - DNA, 21 bp, Homo sapiens
atctgtataagtaagaaaata

SEQ ID NO: 1001789 - DNA, 15 bp, Homo sapiens
atctgtataatactt

SEQ ID NO: 1001790 - DNA, 15 bp, Homo sapiens
cccaccccttcccca

SEQ ID NO: 1001791 - DNA, 22 bp, Homo sapiens
cccaccccttccccactgcctg

SEQ ID NO: 1001792 - DNA, 16 bp, Homo sapiens
cccacccgagtacctc

SEQ ID NO: 1001793 - DNA, 14 bp, Homo sapiens
cccacccgatgctg

SEQ ID NO: 1001794 - DNA, 13 bp, Homo sapiens
cccacccgccgcc

SEQ ID NO: 1001795 - DNA, 22 bp, Homo sapiens
cccacccgccgcctcccacggc

SEQ ID NO: 1001796 - DNA, 16 bp, Homo sapiens
cccacccggccacagc

SEQ ID NO: 1001797 - DNA, 21 bp, Homo sapiens
cccacccgtcttcaatctctg

SEQ ID NO: 1001798 - DNA, 18 bp, Homo sapiens
cccaccctaagggcagcc

SEQ ID NO: 1001799 - DNA, 19 bp, Homo sapiens
cccaccctaagggcagccc

SEQ ID NO: 1001800 - DNA, 21 bp, Homo sapiens
cccaccctaagggcagccctc

SEQ ID NO: 1001801 - DNA, 18 bp, Homo sapiens
cccaccctaccagctcct

SEQ ID NO: 1001802 - DNA, 19 bp, Homo sapiens
cccaccctcaaaccctgtg

SEQ ID NO: 1001803 - DNA, 21 bp, Homo sapiens
cccaccctcaaaccctgtggg

SEQ ID NO: 1001804 - DNA, 13 bp, Homo sapiens
cccaccctcagca

SEQ ID NO: 1001805 - DNA, 15 bp, Homo sapiens
cccaccctccatgct

SEQ ID NO: 1001806 - DNA, 13 bp, Homo sapiens
cccaccctctgcc

SEQ ID NO: 1001807 - DNA, 18 bp, Homo sapiens
cccaccctgaaagccctg

SEQ ID NO: 1001808 - DNA, 17 bp, Homo sapiens
cccaccctgcgggccag

SEQ ID NO: 1001809 - DNA, 20 bp, Homo sapiens
cccaccctggcctagaccag

SEQ ID NO: 1001810 - DNA, 22 bp, Homo sapiens
cccacccttacttcctggcctc

SEQ ID NO: 1001811 - DNA, 18 bp, Homo sapiens
cccaccggaactgggctg

SEQ ID NO: 1001812 - DNA, 17 bp, Homo sapiens
cccaccgtccgccctgc

SEQ ID NO: 1001813 - DNA, 22 bp, Homo sapiens
cccaccgtctcggccctgaacc

SEQ ID NO: 1001814 - DNA, 23 bp, Homo sapiens
cccaccgtctcggccctgaacca

SEQ ID NO: 1001815 - DNA, 19 bp, Homo sapiens
cccaccgtggaggaggaag

SEQ ID NO: 1001816 - DNA, 20 bp, Homo sapiens
cccaccgtggaggaggaagg

SEQ ID NO: 1001817 - DNA, 17 bp, Homo sapiens
cccaccgtgggcaggga

SEQ ID NO: 1001818 - DNA, 17 bp, Homo sapiens
cccacctaagcctggtg

SEQ ID NO: 1001819 - DNA, 19 bp, Homo sapiens
cccacctagtgccccagac

SEQ ID NO: 1001820 - DNA, 15 bp, Homo sapiens
cccacctcagcctcc

SEQ ID NO: 1001821 - DNA, 21 bp, Homo sapiens
cccacctccacccagcccctg

SEQ ID NO: 1001822 - DNA, 13 bp, Homo sapiens
cccacctccagcc

SEQ ID NO: 1001823 - DNA, 14 bp, Homo sapiens
cccacctccagccc

SEQ ID NO: 1001824 - DNA, 20 bp, Homo sapiens
cccacctcccatttctgttg

SEQ ID NO: 1001825 - DNA, 13 bp, Homo sapiens
cccacctccctgc

SEQ ID NO: 1001826 - DNA, 17 bp, Homo sapiens
cccacctccctgcctcc

SEQ ID NO: 1001827 - DNA, 16 bp, Homo sapiens
cccacctccctgcgcc

SEQ ID NO: 1001828 - DNA, 14 bp, Homo sapiens
cccacctcccttcc

SEQ ID NO: 1001829 - DNA, 22 bp, Homo sapiens
cccacctcctgcggctcagcct

SEQ ID NO: 1001830 - DNA, 20 bp, Homo sapiens
cccacctcggcacacactgt

SEQ ID NO: 1001831 - DNA, 17 bp, Homo sapiens
cccacctcggtcactcc

SEQ ID NO: 1001832 - DNA, 22 bp, Homo sapiens
cccacctctccctgcatcctga

SEQ ID NO: 1001833 - DNA, 20 bp, Homo sapiens
cccacctctcttttcctctc

SEQ ID NO: 1001834 - DNA, 22 bp, Homo sapiens
cccacctctcttttcctctctg

SEQ ID NO: 1001835 - DNA, 18 bp, Homo sapiens
cccacctcttgtttctgg

SEQ ID NO: 1001836 - DNA, 14 bp, Homo sapiens
cccacctgaaagcc

SEQ ID NO: 1001837 - DNA, 18 bp, Homo sapiens
cccacctgaaagcctgtc

SEQ ID NO: 1001838 - DNA, 21 bp, Homo sapiens
cccacctgaaagcctgtctct

SEQ ID NO: 1001839 - DNA, 22 bp, Homo sapiens
cccacctgaaagcctgtctctt

SEQ ID NO: 1001840 - DNA, 13 bp, Homo sapiens
cccacctgcccat

SEQ ID NO: 1001841 - DNA, 20 bp, Homo sapiens
cccacctgcccatcacaggg

SEQ ID NO: 1001842 - DNA, 23 bp, Homo sapiens
cccacctgcccatcacagggttg

SEQ ID NO: 1001843 - DNA, 12 bp, Homo sapiens
cccacctggcca

SEQ ID NO: 1001844 - DNA, 20 bp, Homo sapiens
cccacctggccacctgaggt

SEQ ID NO: 1001845 - DNA, 12 bp, Homo sapiens
cccacctgggct

SEQ ID NO: 1001846 - DNA, 19 bp, Homo sapiens
cccacctggggtctctctc

SEQ ID NO: 1001847 - DNA, 22 bp, Homo sapiens
cccacctggggtctctctccct

SEQ ID NO: 1001848 - DNA, 21 bp, Homo sapiens
atcagatgtgttcctccattt

SEQ ID NO: 1001849 - DNA, 23 bp, Homo sapiens
atcagcaaagaaaaaaaaaaaag

SEQ ID NO: 1001850 - DNA, 13 bp, Homo sapiens
atcagcaagactt

SEQ ID NO: 1001851 - DNA, 18 bp, Homo sapiens
atcagcaatactcatcag

SEQ ID NO: 1001852 - DNA, 13 bp, Homo sapiens
atcagcacgattt

SEQ ID NO: 1001853 - DNA, 15 bp, Homo sapiens
atcagcacgatttct

SEQ ID NO: 1001854 - DNA, 16 bp, Homo sapiens
atcagcacgatttctg

SEQ ID NO: 1001855 - DNA, 18 bp, Homo sapiens
atcagcacgatttctgtt

SEQ ID NO: 1001856 - DNA, 20 bp, Homo sapiens
atcagcacgatttctgttta

SEQ ID NO: 1001857 - DNA, 23 bp, Homo sapiens
atcagcacgatttctgtttagat

SEQ ID NO: 1001858 - DNA, 20 bp, Homo sapiens
atcagcaggatgtgtgggcc

SEQ ID NO: 1001859 - DNA, 18 bp, Homo sapiens
atcagcatctgtgatggg

SEQ ID NO: 1001860 - DNA, 15 bp, Homo sapiens
atcagcatgaaaatg

SEQ ID NO: 1001861 - DNA, 20 bp, Homo sapiens
atcagcatgacaaaaataac

SEQ ID NO: 1001862 - DNA, 20 bp, Homo sapiens
atcagcattgtgacttggag

SEQ ID NO: 1001863 - DNA, 19 bp, Homo sapiens
atcagcattgtttcaaaat

SEQ ID NO: 1001864 - DNA, 15 bp, Homo sapiens
atcagccagccttcc

SEQ ID NO: 1001865 - DNA, 17 bp, Homo sapiens
atcagccagtgaatctg

SEQ ID NO: 1001866 - DNA, 14 bp, Homo sapiens
atcagccatgtttg

SEQ ID NO: 1001867 - DNA, 16 bp, Homo sapiens
atcagccattaaaata

SEQ ID NO: 1001868 - DNA, 17 bp, Homo sapiens
atcagccattaaaataa

SEQ ID NO: 1001869 - DNA, 21 bp, Homo sapiens
atcagccattaaaataaaaca

SEQ ID NO: 1001870 - DNA, 15 bp, Homo sapiens
atcagccatttgcca

SEQ ID NO: 1001871 - DNA, 16 bp, Homo sapiens
atcagccccaccctgg

SEQ ID NO: 1001872 - DNA, 13 bp, Homo sapiens
atcagcccccagc

SEQ ID NO: 1001873 - DNA, 12 bp, Homo sapiens
atcagcccctgg

SEQ ID NO: 1001874 - DNA, 14 bp, Homo sapiens
atcagcccctggga

SEQ ID NO: 1001875 - DNA, 15 bp, Homo sapiens
atcagcccctgggaa

SEQ ID NO: 1001876 - DNA, 23 bp, Homo sapiens
atcagcccctgggaacaggcccc

SEQ ID NO: 1001877 - DNA, 20 bp, Homo sapiens
atcagcctaggggtcaggga

SEQ ID NO: 1001878 - DNA, 20 bp, Homo sapiens
atcagcctccgccattccaa

SEQ ID NO: 1001879 - DNA, 15 bp, Homo sapiens
atcagcctcttaaag

SEQ ID NO: 1001880 - DNA, 12 bp, Homo sapiens
atcagcctgagt

SEQ ID NO: 1001881 - DNA, 20 bp, Homo sapiens
atcagcctgagtctcctgtg

SEQ ID NO: 1001882 - DNA, 17 bp, Homo sapiens
atcagcctgctccagct

SEQ ID NO: 1001883 - DNA, 18 bp, Homo sapiens
atcagcctgctccagctg

SEQ ID NO: 1001884 - DNA, 19 bp, Homo sapiens
atcagcctgctccagctgt

SEQ ID NO: 1001885 - DNA, 11 bp, Homo sapiens
atcagcctggg

SEQ ID NO: 1001886 - DNA, 18 bp, Homo sapiens
atcagcgggtctcctccc

SEQ ID NO: 1001887 - DNA, 21 bp, Homo sapiens
atcagcgggtctcctcccagc

SEQ ID NO: 1001888 - DNA, 15 bp, Homo sapiens
atcagctccttcctg

SEQ ID NO: 1001889 - DNA, 17 bp, Homo sapiens
atcagctccttcctgga

SEQ ID NO: 1001890 - DNA, 18 bp, Homo sapiens
atcagctctcctggctcc

SEQ ID NO: 1001891 - DNA, 18 bp, Homo sapiens
atcagctctctgctgggt

SEQ ID NO: 1001892 - DNA, 13 bp, Homo sapiens
atcagctgctact

SEQ ID NO: 1001893 - DNA, 13 bp, Homo sapiens
atcagctggacat

SEQ ID NO: 1001894 - DNA, 22 bp, Homo sapiens
atcagctggtcaaacaaactct

SEQ ID NO: 1001895 - DNA, 16 bp, Homo sapiens
atcagctgtttgtcat

SEQ ID NO: 1001896 - DNA, 14 bp, Homo sapiens
atcagcttttctga

SEQ ID NO: 1001897 - DNA, 19 bp, Homo sapiens
atcagcttttgttctagac

SEQ ID NO: 1001898 - DNA, 16 bp, Homo sapiens
atcaggaaaggctgta

SEQ ID NO: 1001899 - DNA, 21 bp, Homo sapiens
atcaggaaatatatatgtgtg

SEQ ID NO: 1001900 - DNA, 19 bp, Homo sapiens
atcaggaatattttccaaa

SEQ ID NO: 1001901 - DNA, 20 bp, Homo sapiens
atcaggaatgagtcaatcag

SEQ ID NO: 1001902 - DNA, 20 bp, Homo sapiens
atcaggaattctaaataaat

SEQ ID NO: 1001903 - DNA, 16 bp, Homo sapiens
atcaggacccagagga

SEQ ID NO: 1001904 - DNA, 20 bp, Homo sapiens
atcaggacccagaggaaggg

SEQ ID NO: 1001905 - DNA, 16 bp, Homo sapiens
atcaggcactggtggc

SEQ ID NO: 1001906 - DNA, 17 bp, Homo sapiens
atcaggctcctcagcct

SEQ ID NO: 1001907 - DNA, 19 bp, Homo sapiens
atcaggctctgttcctcaa

SEQ ID NO: 1001908 - DNA, 13 bp, Homo sapiens
atcaggctgaggt

SEQ ID NO: 1001909 - DNA, 16 bp, Homo sapiens
atcaggcttttgtttc

SEQ ID NO: 1001910 - DNA, 14 bp, Homo sapiens
atcagggaatccag

SEQ ID NO: 1001911 - DNA, 21 bp, Homo sapiens
atcagggcaatcccaacacat

SEQ ID NO: 1001912 - DNA, 22 bp, Homo sapiens
atcagggccctgccccaggcct

SEQ ID NO: 1001913 - DNA, 23 bp, Homo sapiens
atcagggccctgccccaggcctg

SEQ ID NO: 1001914 - DNA, 13 bp, Homo sapiens
atcagggcctggg

SEQ ID NO: 1001915 - DNA, 15 bp, Homo sapiens
atcagggcctggggc

SEQ ID NO: 1001916 - DNA, 20 bp, Homo sapiens
atcagggcctggggcctgag

SEQ ID NO: 1001917 - DNA, 17 bp, Homo sapiens
atcagggcctttctcct

SEQ ID NO: 1001918 - DNA, 15 bp, Homo sapiens
atcaggggagaaaaa

SEQ ID NO: 1001919 - DNA, 13 bp, Homo sapiens
atcaggggccaga

SEQ ID NO: 1001920 - DNA, 14 bp, Homo sapiens
atcaggggccagag

SEQ ID NO: 1001921 - DNA, 18 bp, Homo sapiens
atcagggggaagaagcag

SEQ ID NO: 1001922 - DNA, 21 bp, Homo sapiens
atcaggtcattattttttaca

SEQ ID NO: 1001923 - DNA, 16 bp, Homo sapiens
atcaggtcctcagaga

SEQ ID NO: 1001924 - DNA, 15 bp, Homo sapiens
atcaggtctgggcaa

SEQ ID NO: 1001925 - DNA, 13 bp, Homo sapiens
atcaggtgcaggt

SEQ ID NO: 1001926 - DNA, 17 bp, Homo sapiens
atcaggtgtataaatgt

SEQ ID NO: 1001927 - DNA, 18 bp, Homo sapiens
atcaggtgtataaatgta

SEQ ID NO: 1001928 - DNA, 13 bp, Homo sapiens
atcagtaaaatta

SEQ ID NO: 1001929 - DNA, 17 bp, Homo sapiens
atcagtaaaattatact

SEQ ID NO: 1001930 - DNA, 22 bp, Homo sapiens
atcagtaaatagtgtcatataa

SEQ ID NO: 1001931 - DNA, 17 bp, Homo sapiens
atcagtaagaggtgtta

SEQ ID NO: 1001932 - DNA, 20 bp, Homo sapiens
atcagtatcacgatttgcag

SEQ ID NO: 1001933 - DNA, 16 bp, Homo sapiens
atcagtattctgacat

SEQ ID NO: 1001934 - DNA, 14 bp, Homo sapiens
atcagtattctgcc

SEQ ID NO: 1001935 - DNA, 16 bp, Homo sapiens
atcagtatttccttcc

SEQ ID NO: 1001936 - DNA, 17 bp, Homo sapiens
atcagtatttccttcca

SEQ ID NO: 1001937 - DNA, 21 bp, Homo sapiens
atcagtatttttttttaattt

SEQ ID NO: 1001938 - DNA, 13 bp, Homo sapiens
atcagtcaatatt

SEQ ID NO: 1001939 - DNA, 23 bp, Homo sapiens
atcagtcaatggaagaaatggct

SEQ ID NO: 1001940 - DNA, 13 bp, Homo sapiens
atcagtcccctcc

SEQ ID NO: 1001941 - DNA, 15 bp, Homo sapiens
atcagtcccctccca

SEQ ID NO: 1001942 - DNA, 16 bp, Homo sapiens
atcagtcccctcccat

SEQ ID NO: 1001943 - DNA, 22 bp, Homo sapiens
atcagtcccctcccatctggga

SEQ ID NO: 1001944 - DNA, 21 bp, Homo sapiens
atcagtcctagaatgtttcat

SEQ ID NO: 1001945 - DNA, 20 bp, Homo sapiens
atcagtccttattatcccag

SEQ ID NO: 1001946 - DNA, 14 bp, Homo sapiens
atcagtgactgaaa

SEQ ID NO: 1001947 - DNA, 21 bp, Homo sapiens
atcagtgactgaattctgcct

SEQ ID NO: 1001948 - DNA, 15 bp, Homo sapiens
atcagtgatctatgt

SEQ ID NO: 1001949 - DNA, 16 bp, Homo sapiens
atcagtgatctatgtt

SEQ ID NO: 1001950 - DNA, 21 bp, Homo sapiens
atcagtgcctggtgttctgaa

SEQ ID NO: 1001951 - DNA, 17 bp, Homo sapiens
atcagtgtcctcttgct

SEQ ID NO: 1001952 - DNA, 22 bp, Homo sapiens
atcagtgtctgtttcagaatct

SEQ ID NO: 1001953 - DNA, 22 bp, Homo sapiens
atcagtgtgtaaataatttgca

SEQ ID NO: 1001954 - DNA, 12 bp, Homo sapiens
atcagtgttaaa

SEQ ID NO: 1001955 - DNA, 13 bp, Homo sapiens
atcagtgttaaaa

SEQ ID NO: 1001956 - DNA, 17 bp, Homo sapiens
atcagtgttaaattcat

SEQ ID NO: 1001957 - DNA, 18 bp, Homo sapiens
atcagtgttaaattcatt

SEQ ID NO: 1001958 - DNA, 20 bp, Homo sapiens
atcagtgttaaattcatttt

SEQ ID NO: 1001959 - DNA, 10 bp, Homo sapiens
atcagtgttg

SEQ ID NO: 1001960 - DNA, 21 bp, Homo sapiens
atcagtgtttaaataaagacc

SEQ ID NO: 1001961 - DNA, 14 bp, Homo sapiens
atcagtgtttatgt

SEQ ID NO: 1001962 - DNA, 22 bp, Homo sapiens
atcagtgtttatgtgctattaa

SEQ ID NO: 1001963 - DNA, 19 bp, Homo sapiens
atcagttaaaatcacattt

SEQ ID NO: 1001964 - DNA, 21 bp, Homo sapiens
atcagttaaaatcacatttta

SEQ ID NO: 1001965 - DNA, 12 bp, Homo sapiens
atcagttaacta

SEQ ID NO: 1001966 - DNA, 20 bp, Homo sapiens
atcagttacccactcggtcc

SEQ ID NO: 1001967 - DNA, 23 bp, Homo sapiens
atcagttacccactcggtcccag

SEQ ID NO: 1001968 - DNA, 18 bp, Homo sapiens
atcagttactaagaagaa

SEQ ID NO: 1001969 - DNA, 18 bp, Homo sapiens
atcagttactcagccctg

SEQ ID NO: 1001970 - DNA, 19 bp, Homo sapiens
atcagttactcagccctgg

SEQ ID NO: 1001971 - DNA, 18 bp, Homo sapiens
atcagttatatgatattc

SEQ ID NO: 1001972 - DNA, 18 bp, Homo sapiens
atcagttatcctttgtga

SEQ ID NO: 1001973 - DNA, 15 bp, Homo sapiens
ccaggctggagctgg

SEQ ID NO: 1001974 - DNA, 20 bp, Homo sapiens
ccaggctggagtgcaatggt

SEQ ID NO: 1001975 - DNA, 21 bp, Homo sapiens
ccaggctggagtgcagtggca

SEQ ID NO: 1001976 - DNA, 14 bp, Homo sapiens
ccaggctggcgcag

SEQ ID NO: 1001977 - DNA, 16 bp, Homo sapiens
ccaggctggcgcagcc

SEQ ID NO: 1001978 - DNA, 18 bp, Homo sapiens
ccaggctggcgcagccaa

SEQ ID NO: 1001979 - DNA, 20 bp, Homo sapiens
ccaggctggtctcaaactcc

SEQ ID NO: 1001980 - DNA, 23 bp, Homo sapiens
ccaggctggtctcaaactcctgg

SEQ ID NO: 1001981 - DNA, 15 bp, Homo sapiens
ccaggctgtgcagcg

SEQ ID NO: 1001982 - DNA, 13 bp, Homo sapiens
ccaggctgtttca

SEQ ID NO: 1001983 - DNA, 15 bp, Homo sapiens
ccaggcttccgcgcc

SEQ ID NO: 1001984 - DNA, 17 bp, Homo sapiens
ccaggcttccgcgccca

SEQ ID NO: 1001985 - DNA, 22 bp, Homo sapiens
ccaggcttccgcgcccagcgct

SEQ ID NO: 1001986 - DNA, 23 bp, Homo sapiens
ccaggcttccgcgcccagcgctc

SEQ ID NO: 1001987 - DNA, 16 bp, Homo sapiens
ccaggcttgcctgggc

SEQ ID NO: 1001988 - DNA, 21 bp, Homo sapiens
ccaggcttgcctgggctgggc

SEQ ID NO: 1001989 - DNA, 18 bp, Homo sapiens
ccaggctttgtacagagt

SEQ ID NO: 1001990 - DNA, 17 bp, Homo sapiens
ccagggaagctgtccct

SEQ ID NO: 1001991 - DNA, 17 bp, Homo sapiens
ccagggaaggtggggcc

SEQ ID NO: 1001992 - DNA, 15 bp, Homo sapiens
ccagggaatccaagc

SEQ ID NO: 1001993 - DNA, 18 bp, Homo sapiens
ccagggaatccaagcctc

SEQ ID NO: 1001994 - DNA, 19 bp, Homo sapiens
ccagggacacacagcctag

SEQ ID NO: 1001995 - DNA, 22 bp, Homo sapiens
ccagggaccactgggtgagaga

SEQ ID NO: 1001996 - DNA, 19 bp, Homo sapiens
ccagggacccaaagcagga

SEQ ID NO: 1001997 - DNA, 22 bp, Homo sapiens
ccagggacccaaagcaggatga

SEQ ID NO: 1001998 - DNA, 14 bp, Homo sapiens
ccagggaccggcgg

SEQ ID NO: 1001999 - DNA, 15 bp, Homo sapiens
ccagggagaatctga

SEQ ID NO: 1002000 - DNA, 13 bp, Homo sapiens
ccagggagaccga

SEQ ID NO: 1002001 - DNA, 14 bp, Homo sapiens
ccagggagaggcca

SEQ ID NO: 1002002 - DNA, 16 bp, Homo sapiens
ccagggagcaagacag

SEQ ID NO: 1002003 - DNA, 14 bp, Homo sapiens
ccagggagcctaga

SEQ ID NO: 1002004 - DNA, 16 bp, Homo sapiens
ccagggagcctagaag

SEQ ID NO: 1002005 - DNA, 14 bp, Homo sapiens
ccagggagcctttg

SEQ ID NO: 1002006 - DNA, 22 bp, Homo sapiens
ccagggagcctttggttctggc

SEQ ID NO: 1002007 - DNA, 18 bp, Homo sapiens
ccagggagcttcctggct

SEQ ID NO: 1002008 - DNA, 20 bp, Homo sapiens
ccagggagcttcctggctct

SEQ ID NO: 1002009 - DNA, 13 bp, Homo sapiens
ccagggagcttgc

SEQ ID NO: 1002010 - DNA, 18 bp, Homo sapiens
ccagggagcttgccacac

SEQ ID NO: 1002011 - DNA, 13 bp, Homo sapiens
ccagggaggcagc

SEQ ID NO: 1002012 - DNA, 18 bp, Homo sapiens
ccagggaggcagcgtggg

SEQ ID NO: 1002013 - DNA, 23 bp, Homo sapiens
ccagggaggcagcgtgggctctg

SEQ ID NO: 1002014 - DNA, 13 bp, Homo sapiens
ccagggaggcgca

SEQ ID NO: 1002015 - DNA, 16 bp, Homo sapiens
ccagggaggcgcaggg

SEQ ID NO: 1002016 - DNA, 19 bp, Homo sapiens
ccagggaggcgcagggaca

SEQ ID NO: 1002017 - DNA, 13 bp, Homo sapiens
ccagggagtccag

SEQ ID NO: 1002018 - DNA, 17 bp, Homo sapiens
ccagggagtccagggtt

SEQ ID NO: 1002019 - DNA, 17 bp, Homo sapiens
ccagggagtcccctccc

SEQ ID NO: 1002020 - DNA, 13 bp, Homo sapiens
ccagggagtgagc

SEQ ID NO: 1002021 - DNA, 15 bp, Homo sapiens
ccagggagtgagcag

SEQ ID NO: 1002022 - DNA, 18 bp, Homo sapiens
ccagggagtgagcagcta

SEQ ID NO: 1002023 - DNA, 19 bp, Homo sapiens
ccagggagtgagcagctac

SEQ ID NO: 1002024 - DNA, 20 bp, Homo sapiens
ccagggatgattcaagccat

SEQ ID NO: 1002025 - DNA, 15 bp, Homo sapiens
ccagggatgctgggc

SEQ ID NO: 1002026 - DNA, 23 bp, Homo sapiens
ccagggcaagggttaaggcctga

SEQ ID NO: 1002027 - DNA, 11 bp, Homo sapiens
ccagggcaatg

SEQ ID NO: 1002028 - DNA, 19 bp, Homo sapiens
ccagggcaatgccatcagc

SEQ ID NO: 1002029 - DNA, 23 bp, Homo sapiens
ccagggcaatgccatcagcccct

SEQ ID NO: 1002030 - DNA, 10 bp, Homo sapiens
ccagggcaga

SEQ ID NO: 1002031 - DNA, 14 bp, Homo sapiens
ccagggcagaggaa

SEQ ID NO: 1002032 - DNA, 15 bp, Homo sapiens
ccagggcagaggaat

SEQ ID NO: 1002033 - DNA, 16 bp, Homo sapiens
ccagggcagaggaatg

SEQ ID NO: 1002034 - DNA, 17 bp, Homo sapiens
ccagggcagaggaatgt

SEQ ID NO: 1002035 - DNA, 14 bp, Homo sapiens
ccagggcagatgtg

SEQ ID NO: 1002036 - DNA, 20 bp, Homo sapiens
ccagggcagggtctgggctg

SEQ ID NO: 1002037 - DNA, 21 bp, Homo sapiens
ccagggcagggtgggcagcct

SEQ ID NO: 1002038 - DNA, 22 bp, Homo sapiens
ccagggcatgtgtatgtgtctg

SEQ ID NO: 1002039 - DNA, 14 bp, Homo sapiens
ccagggccacgctc

SEQ ID NO: 1002040 - DNA, 16 bp, Homo sapiens
ccagggccacgctcca

SEQ ID NO: 1002041 - DNA, 18 bp, Homo sapiens
ccagggccacgctccagc

SEQ ID NO: 1002042 - DNA, 13 bp, Homo sapiens
ccagggccacgtg

SEQ ID NO: 1002043 - DNA, 17 bp, Homo sapiens
ccagggccacgtgccag

SEQ ID NO: 1002044 - DNA, 19 bp, Homo sapiens
ccagggccacgtgccaggc

SEQ ID NO: 1002045 - DNA, 12 bp, Homo sapiens
ccagggccaggg

SEQ ID NO: 1002046 - DNA, 16 bp, Homo sapiens
ccagggccagggccct

SEQ ID NO: 1002047 - DNA, 16 bp, Homo sapiens
ccagggccatgtcaga

SEQ ID NO: 1002048 - DNA, 18 bp, Homo sapiens
ccagggcccagagccctt

SEQ ID NO: 1002049 - DNA, 13 bp, Homo sapiens
ccagggcccaggc

SEQ ID NO: 1002050 - DNA, 17 bp, Homo sapiens
ccagggcccaggcaaat

SEQ ID NO: 1002051 - DNA, 19 bp, Homo sapiens
ccagggcccctccctctgc

SEQ ID NO: 1002052 - DNA, 21 bp, Homo sapiens
ccagggcccctccctctgccc

SEQ ID NO: 1002053 - DNA, 18 bp, Homo sapiens
ccagggcccctggatctc

SEQ ID NO: 1002054 - DNA, 22 bp, Homo sapiens
ccagggcccgggcacccacaag

SEQ ID NO: 1002055 - DNA, 15 bp, Homo sapiens
ccagggccctgagct

SEQ ID NO: 1002056 - DNA, 16 bp, Homo sapiens
ccagggccctgggcag

SEQ ID NO: 1002057 - DNA, 17 bp, Homo sapiens
ccagggccctgggcagg

SEQ ID NO: 1002058 - DNA, 22 bp, Homo sapiens
ccagggcctactgccacccgct

SEQ ID NO: 1002059 - DNA, 12 bp, Homo sapiens
ccagggcctcca

SEQ ID NO: 1002060 - DNA, 15 bp, Homo sapiens
ccagggcctccaggg

SEQ ID NO: 1002061 - DNA, 17 bp, Homo sapiens
ccagggcctccagggcc

SEQ ID NO: 1002062 - DNA, 12 bp, Homo sapiens
ccagggcctccc

SEQ ID NO: 1002063 - DNA, 12 bp, Homo sapiens
ccagggcctcct

SEQ ID NO: 1002064 - DNA, 14 bp, Homo sapiens
ccagggcctcctgg

SEQ ID NO: 1002065 - DNA, 12 bp, Homo sapiens
ccagggcctgac

SEQ ID NO: 1002066 - DNA, 14 bp, Homo sapiens
ccagggcctgactt

SEQ ID NO: 1002067 - DNA, 20 bp, Homo sapiens
ccagggcctgacttgagcca

SEQ ID NO: 1002068 - DNA, 22 bp, Homo sapiens
ccagggcctgacttgagccact

SEQ ID NO: 1002069 - DNA, 13 bp, Homo sapiens
ccagggcctgtct

SEQ ID NO: 1002070 - DNA, 18 bp, Homo sapiens
ccagggcgctgggaaggg

SEQ ID NO: 1002071 - DNA, 11 bp, Homo sapiens
ccagggctcag

SEQ ID NO: 1002072 - DNA, 15 bp, Homo sapiens
ccagggctcagcctg

SEQ ID NO: 1002073 - DNA, 13 bp, Homo sapiens
ccagggctccaaa

SEQ ID NO: 1002074 - DNA, 17 bp, Homo sapiens
ccagggctccctcctgg

SEQ ID NO: 1002075 - DNA, 13 bp, Homo sapiens
ccagggctcctgc

SEQ ID NO: 1002076 - DNA, 17 bp, Homo sapiens
ccagggctctgcaggcc

SEQ ID NO: 1002077 - DNA, 18 bp, Homo sapiens
ccagggctctgcaggcca

SEQ ID NO: 1002078 - DNA, 14 bp, Homo sapiens
ccagggctctgccc

SEQ ID NO: 1002079 - DNA, 17 bp, Homo sapiens
ccagggctctgccccag

SEQ ID NO: 1002080 - DNA, 18 bp, Homo sapiens
ccagggctctgccccagt

SEQ ID NO: 1002081 - DNA, 16 bp, Homo sapiens
ccagggctgccctgag

SEQ ID NO: 1002082 - DNA, 17 bp, Homo sapiens
ccagggctgccctgaga

SEQ ID NO: 1002083 - DNA, 21 bp, Homo sapiens
ccagggctgccctgagaagct

SEQ ID NO: 1002084 - DNA, 13 bp, Homo sapiens
ccagggctggaga

SEQ ID NO: 1002085 - DNA, 13 bp, Homo sapiens
ccagggctgggga

SEQ ID NO: 1002086 - DNA, 14 bp, Homo sapiens
ccagggctggggac

SEQ ID NO: 1002087 - DNA, 19 bp, Homo sapiens
ccagggctggggacagagg

SEQ ID NO: 1002088 - DNA, 22 bp, Homo sapiens
ccagggctggggtgagcctgac

SEQ ID NO: 1002089 - DNA, 15 bp, Homo sapiens
ccagggctgtcctta

SEQ ID NO: 1002090 - DNA, 23 bp, Homo sapiens
ccagggctgttggaggaccccga

SEQ ID NO: 1002091 - DNA, 20 bp, Homo sapiens
ccagggcttacctgtacact

SEQ ID NO: 1002092 - DNA, 19 bp, Homo sapiens
ccagggcttccccatcagc

SEQ ID NO: 1002093 - DNA, 22 bp, Homo sapiens
ccagggcttccccatcagctcc

SEQ ID NO: 1002094 - DNA, 24 bp, Homo sapiens
ccaggggaacctgccatgccagga

SEQ ID NO: 1002095 - DNA, 19 bp, Homo sapiens
ccaggggaaggaaggaggg

SEQ ID NO: 1002096 - DNA, 22 bp, Homo sapiens
ccaggggaaggaaggagggcac

SEQ ID NO: 1002097 - DNA, 15 bp, Homo sapiens
ccaggggaaggccct

SEQ ID NO: 1002098 - DNA, 23 bp, Homo sapiens
atatttcagatatcaaaattcta

SEQ ID NO: 1002099 - DNA, 18 bp, Homo sapiens
atatttcagatgtaatgt

SEQ ID NO: 1002100 - DNA, 19 bp, Homo sapiens
atatttcagatgtaatgtt

SEQ ID NO: 1002101 - DNA, 15 bp, Homo sapiens
atatttcctgacttg

SEQ ID NO: 1002102 - DNA, 18 bp, Homo sapiens
atatttcctgtattgctt

SEQ ID NO: 1002103 - DNA, 19 bp, Homo sapiens
atatttcctttatgtgaat

SEQ ID NO: 1002104 - DNA, 15 bp, Homo sapiens
atatttctatgtaaa

SEQ ID NO: 1002105 - DNA, 16 bp, Homo sapiens
atatttctatgtaaat

SEQ ID NO: 1002106 - DNA, 12 bp, Homo sapiens
atatttcttaat

SEQ ID NO: 1002107 - DNA, 22 bp, Homo sapiens
atatttcttcttctaagaagac

SEQ ID NO: 1002108 - DNA, 15 bp, Homo sapiens
atatttgaaaaaaac

SEQ ID NO: 1002109 - DNA, 23 bp, Homo sapiens
atatttgaaaaaaacttcattct

SEQ ID NO: 1002110 - DNA, 14 bp, Homo sapiens
atatttgaatgaaa

SEQ ID NO: 1002111 - DNA, 17 bp, Homo sapiens
atatttgaattgacagg

SEQ ID NO: 1002112 - DNA, 12 bp, Homo sapiens
atatttgaattt

SEQ ID NO: 1002113 - DNA, 16 bp, Homo sapiens
atatttgactctttca

SEQ ID NO: 1002114 - DNA, 22 bp, Homo sapiens
atatttgacttgcatgaagaga

SEQ ID NO: 1002115 - DNA, 14 bp, Homo sapiens
atatttgatttcta

SEQ ID NO: 1002116 - DNA, 18 bp, Homo sapiens
atatttgatttctaattg

SEQ ID NO: 1002117 - DNA, 23 bp, Homo sapiens
atatttgcaaaccctttgtatta

SEQ ID NO: 1002118 - DNA, 11 bp, Homo sapiens
atatttgctgc

SEQ ID NO: 1002119 - DNA, 16 bp, Homo sapiens
atatttgctgcaaaga

SEQ ID NO: 1002120 - DNA, 15 bp, Homo sapiens
atatttgctttatac

SEQ ID NO: 1002121 - DNA, 19 bp, Homo sapiens
atatttgtaaactacaaag

SEQ ID NO: 1002122 - DNA, 11 bp, Homo sapiens
atatttgtaac

SEQ ID NO: 1002123 - DNA, 11 bp, Homo sapiens
atatttgtaca

SEQ ID NO: 1002124 - DNA, 18 bp, Homo sapiens
atatttgtatagttgctt

SEQ ID NO: 1002125 - DNA, 16 bp, Homo sapiens
atatttgtcatgacag

SEQ ID NO: 1002126 - DNA, 13 bp, Homo sapiens
atatttgtcttcc

SEQ ID NO: 1002127 - DNA, 17 bp, Homo sapiens
atatttgtctttaaaca

SEQ ID NO: 1002128 - DNA, 20 bp, Homo sapiens
atatttgtgatagcactttc

SEQ ID NO: 1002129 - DNA, 22 bp, Homo sapiens
atatttgttactttacttttgc

SEQ ID NO: 1002130 - DNA, 23 bp, Homo sapiens
atatttgtttagttcagcaaaac

SEQ ID NO: 1002131 - DNA, 16 bp, Homo sapiens
atatttgttttaatac

SEQ ID NO: 1002132 - DNA, 20 bp, Homo sapiens
atattttaaaatctcctaaa

SEQ ID NO: 1002133 - DNA, 13 bp, Homo sapiens
atattttaaaatt

SEQ ID NO: 1002134 - DNA, 14 bp, Homo sapiens
atattttaaacaga

SEQ ID NO: 1002135 - DNA, 14 bp, Homo sapiens
atattttaaagaat

SEQ ID NO: 1002136 - DNA, 17 bp, Homo sapiens
atattttaatagaaata

SEQ ID NO: 1002137 - DNA, 19 bp, Homo sapiens
atattttaatagaattttt

SEQ ID NO: 1002138 - DNA, 19 bp, Homo sapiens
atattttaatgcagttgct

SEQ ID NO: 1002139 - DNA, 14 bp, Homo sapiens
atattttacataca

SEQ ID NO: 1002140 - DNA, 15 bp, Homo sapiens
atattttagaagcta

SEQ ID NO: 1002141 - DNA, 14 bp, Homo sapiens
atattttagcattt

SEQ ID NO: 1002142 - DNA, 15 bp, Homo sapiens
atattttatataaag

SEQ ID NO: 1002143 - DNA, 22 bp, Homo sapiens
atattttatataaagtattctt

SEQ ID NO: 1002144 - DNA, 13 bp, Homo sapiens
atattttatgaac

SEQ ID NO: 1002145 - DNA, 16 bp, Homo sapiens
atattttatgaacatt

SEQ ID NO: 1002146 - DNA, 15 bp, Homo sapiens
atattttatggttat

SEQ ID NO: 1002147 - DNA, 16 bp, Homo sapiens
atattttattactgtt

SEQ ID NO: 1002148 - DNA, 15 bp, Homo sapiens
atattttattatata

SEQ ID NO: 1002149 - DNA, 21 bp, Homo sapiens
atattttatttcaatgtaatt

SEQ ID NO: 1002150 - DNA, 24 bp, Homo sapiens
atattttcaaattgtatctagtgc

SEQ ID NO: 1002151 - DNA, 17 bp, Homo sapiens
atattttccataaattt

SEQ ID NO: 1002152 - DNA, 21 bp, Homo sapiens
atattttcctagtagatctat

SEQ ID NO: 1002153 - DNA, 22 bp, Homo sapiens
atattttcctcccagttctaca

SEQ ID NO: 1002154 - DNA, 20 bp, Homo sapiens
atattttctatttctctgtg

SEQ ID NO: 1002155 - DNA, 14 bp, Homo sapiens
atattttctatttt

SEQ ID NO: 1002156 - DNA, 18 bp, Homo sapiens
atattttctctgtacttt

SEQ ID NO: 1002157 - DNA, 23 bp, Homo sapiens
atattttcttccaagcaaaggtg

SEQ ID NO: 1002158 - DNA, 14 bp, Homo sapiens
atattttgaatcaa

SEQ ID NO: 1002159 - DNA, 20 bp, Homo sapiens
atattttgccactgcctttc

SEQ ID NO: 1002160 - DNA, 19 bp, Homo sapiens
atattttgtaaaatgtatt

SEQ ID NO: 1002161 - DNA, 17 bp, Homo sapiens
atattttgtaatattct

SEQ ID NO: 1002162 - DNA, 21 bp, Homo sapiens
atattttgtaatattctgttt

SEQ ID NO: 1002163 - DNA, 21 bp, Homo sapiens
atattttgtatatatctgctt

SEQ ID NO: 1002164 - DNA, 14 bp, Homo sapiens
atatttttaaagaa

SEQ ID NO: 1002165 - DNA, 15 bp, Homo sapiens
atatttttaaagatc

SEQ ID NO: 1002166 - DNA, 16 bp, Homo sapiens
atatttttatatttag

SEQ ID NO: 1002167 - DNA, 16 bp, Homo sapiens
atatttttatctatat

SEQ ID NO: 1002168 - DNA, 20 bp, Homo sapiens
atatttttatctttatatga

SEQ ID NO: 1002169 - DNA, 16 bp, Homo sapiens
atatttttatgtgcag

SEQ ID NO: 1002170 - DNA, 18 bp, Homo sapiens
atatttttatgtgcagcg

SEQ ID NO: 1002171 - DNA, 12 bp, Homo sapiens
atatttttctga

SEQ ID NO: 1002172 - DNA, 13 bp, Homo sapiens
atatttttctgag

SEQ ID NO: 1002173 - DNA, 22 bp, Homo sapiens
atatttttggggcatcctggat

SEQ ID NO: 1002174 - DNA, 21 bp, Homo sapiens
atatttttggttgtcaatatt

SEQ ID NO: 1002175 - DNA, 13 bp, Homo sapiens
atatttttgtaca

SEQ ID NO: 1002176 - DNA, 16 bp, Homo sapiens
atatttttgtatttct

SEQ ID NO: 1002177 - DNA, 20 bp, Homo sapiens
atatttttgtctgcagctgt

SEQ ID NO: 1002178 - DNA, 21 bp, Homo sapiens
atatttttgtgttttcttgta

SEQ ID NO: 1002179 - DNA, 22 bp, Homo sapiens
atatttttgtgttttcttgtaa

SEQ ID NO: 1002180 - DNA, 16 bp, Homo sapiens
atattttttatttcta

SEQ ID NO: 1002181 - DNA, 15 bp, Homo sapiens
atattttttctgaat

SEQ ID NO: 1002182 - DNA, 12 bp, Homo sapiens
atattttttgca

SEQ ID NO: 1002183 - DNA, 13 bp, Homo sapiens
atattttttgcaa

SEQ ID NO: 1002184 - DNA, 16 bp, Homo sapiens
atattttttgcttttg

SEQ ID NO: 1002185 - DNA, 16 bp, Homo sapiens
atatttttttaattta

SEQ ID NO: 1002186 - DNA, 17 bp, Homo sapiens
atcaaaaaaagactcag

SEQ ID NO: 1002187 - DNA, 20 bp, Homo sapiens
atcaaaaaaagactcagcca

SEQ ID NO: 1002188 - DNA, 12 bp, Homo sapiens
atcaaaaagcct

SEQ ID NO: 1002189 - DNA, 21 bp, Homo sapiens
atcaaaacctttcaaatatca

SEQ ID NO: 1002190 - DNA, 16 bp, Homo sapiens
atcaaaacttaagatg

SEQ ID NO: 1002191 - DNA, 21 bp, Homo sapiens
atcaaaactttcttttctgga

SEQ ID NO: 1002192 - DNA, 22 bp, Homo sapiens
atcaaaagggccaaagaaccaa

SEQ ID NO: 1002193 - DNA, 14 bp, Homo sapiens
atcaaaataaaaag

SEQ ID NO: 1002194 - DNA, 13 bp, Homo sapiens
atcaaaatagttt

SEQ ID NO: 1002195 - DNA, 17 bp, Homo sapiens
atcaaaatcatggatct

SEQ ID NO: 1002196 - DNA, 16 bp, Homo sapiens
atcaaaatgcctttca

SEQ ID NO: 1002197 - DNA, 12 bp, Homo sapiens
atcaaaatgtag

SEQ ID NO: 1002198 - DNA, 14 bp, Homo sapiens
atcaaaatgtagct

SEQ ID NO: 1002199 - DNA, 17 bp, Homo sapiens
atcaaaatgtagctttt

SEQ ID NO: 1002200 - DNA, 12 bp, Homo sapiens
atcaaaattaca

SEQ ID NO: 1002201 - DNA, 23 bp, Homo sapiens
atcaaacaccaacataaaaatga

SEQ ID NO: 1002202 - DNA, 23 bp, Homo sapiens
atcaaacagccccagtcttcctt

SEQ ID NO: 1002203 - DNA, 16 bp, Homo sapiens
atcaaacattttctgg

SEQ ID NO: 1002204 - DNA, 20 bp, Homo sapiens
atcaaaccctagccttgctt

SEQ ID NO: 1002205 - DNA, 19 bp, Homo sapiens
atcaaacctttctggcctg

SEQ ID NO: 1002206 - DNA, 16 bp, Homo sapiens
atcaaactgaagccag

SEQ ID NO: 1002207 - DNA, 17 bp, Homo sapiens
atcaaactgaagccaga

SEQ ID NO: 1002208 - DNA, 16 bp, Homo sapiens
atcaaagaacagatgg

SEQ ID NO: 1002209 - DNA, 18 bp, Homo sapiens
atcaaagaattacagtac

SEQ ID NO: 1002210 - DNA, 15 bp, Homo sapiens
atcaaagagaagatg

SEQ ID NO: 1002211 - DNA, 12 bp, Homo sapiens
atcaaagatgaa

SEQ ID NO: 1002212 - DNA, 13 bp, Homo sapiens
atcaaagatgact

SEQ ID NO: 1002213 - DNA, 14 bp, Homo sapiens
atcaaagcaagggc

SEQ ID NO: 1002214 - DNA, 15 bp, Homo sapiens
atcaaagcaagggct

SEQ ID NO: 1002215 - DNA, 14 bp, Homo sapiens
atcaaagccacact

SEQ ID NO: 1002216 - DNA, 13 bp, Homo sapiens
atcaaagccaggg

SEQ ID NO: 1002217 - DNA, 14 bp, Homo sapiens
atcaaagctcataa

SEQ ID NO: 1002218 - DNA, 21 bp, Homo sapiens
atcaaaggaaaatagtaatgt

SEQ ID NO: 1002219 - DNA, 17 bp, Homo sapiens
atcaaaggaatataaga

SEQ ID NO: 1002220 - DNA, 12 bp, Homo sapiens
atcaaaggacac

SEQ ID NO: 1002221 - DNA, 21 bp, Homo sapiens
caacaagaatgcattccctga

SEQ ID NO: 1002222 - DNA, 17 bp, Homo sapiens
caacaagactgccaggt

SEQ ID NO: 1002223 - DNA, 15 bp, Homo sapiens
caacaagagtttatt

SEQ ID NO: 1002224 - DNA, 15 bp, Homo sapiens
caacaagatttccac

SEQ ID NO: 1002225 - DNA, 13 bp, Homo sapiens
caacaagcctcaa

SEQ ID NO: 1002226 - DNA, 23 bp, Homo sapiens
caacaaggaaaaatgccactccc

SEQ ID NO: 1002227 - DNA, 21 bp, Homo sapiens
caacaagggagagacctcatc

SEQ ID NO: 1002228 - DNA, 20 bp, Homo sapiens
caacaagggtccgtggacca

SEQ ID NO: 1002229 - DNA, 20 bp, Homo sapiens
caacaaggtggtgtgatctt

SEQ ID NO: 1002230 - DNA, 19 bp, Homo sapiens
caacaaggttatatgaata

SEQ ID NO: 1002231 - DNA, 16 bp, Homo sapiens
caacaataaaattttt

SEQ ID NO: 1002232 - DNA, 20 bp, Homo sapiens
caacaataaacaggaatttt

SEQ ID NO: 1002233 - DNA, 12 bp, Homo sapiens
caacaataaacc

SEQ ID NO: 1002234 - DNA, 12 bp, Homo sapiens
caacaataaata

SEQ ID NO: 1002235 - DNA, 12 bp, Homo sapiens
caacaatccttt

SEQ ID NO: 1002236 - DNA, 13 bp, Homo sapiens
caacaatctggag

SEQ ID NO: 1002237 - DNA, 19 bp, Homo sapiens
caacaatggggtgggccca

SEQ ID NO: 1002238 - DNA, 13 bp, Homo sapiens
caacaattctaaa

SEQ ID NO: 1002239 - DNA, 16 bp, Homo sapiens
caacaatttatgaatt

SEQ ID NO: 1002240 - DNA, 13 bp, Homo sapiens
caacaatttctac

SEQ ID NO: 1002241 - DNA, 18 bp, Homo sapiens
caacaatttctactttga

SEQ ID NO: 1002242 - DNA, 20 bp, Homo sapiens
caacacaaagagaaaaagaa

SEQ ID NO: 1002243 - DNA, 22 bp, Homo sapiens
caacacaaagagaaaaagaaat

SEQ ID NO: 1002244 - DNA, 23 bp, Homo sapiens
caacacaaagagaaaaagaaatg

SEQ ID NO: 1002245 - DNA, 14 bp, Homo sapiens
caacacacacactc

SEQ ID NO: 1002246 - DNA, 14 bp, Homo sapiens
caacacagaggcag

SEQ ID NO: 1002247 - DNA, 21 bp, Homo sapiens
caacacagataattttttctt

SEQ ID NO: 1002248 - DNA, 13 bp, Homo sapiens
caacaccacagac

SEQ ID NO: 1002249 - DNA, 18 bp, Homo sapiens
caacaccacagacacaca

SEQ ID NO: 1002250 - DNA, 19 bp, Homo sapiens
caacaccacagacacacac

SEQ ID NO: 1002251 - DNA, 22 bp, Homo sapiens
caacaccactaggaatcccaga

SEQ ID NO: 1002252 - DNA, 20 bp, Homo sapiens
caacacctctgcacaagctg

SEQ ID NO: 1002253 - DNA, 22 bp, Homo sapiens
caacacctctgcacaagctgca

SEQ ID NO: 1002254 - DNA, 15 bp, Homo sapiens
caacacctgcctctg

SEQ ID NO: 1002255 - DNA, 16 bp, Homo sapiens
caacaccttcctcctg

SEQ ID NO: 1002256 - DNA, 18 bp, Homo sapiens
caacaccttcctcctgca

SEQ ID NO: 1002257 - DNA, 19 bp, Homo sapiens
caacaccttcctcctgcag

SEQ ID NO: 1002258 - DNA, 17 bp, Homo sapiens
caacacgcacctgcctc

SEQ ID NO: 1002259 - DNA, 16 bp, Homo sapiens
caacactatataaata

SEQ ID NO: 1002260 - DNA, 15 bp, Homo sapiens
caacactcttcttga

SEQ ID NO: 1002261 - DNA, 22 bp, Homo sapiens
caacactcttcttgagcagacc

SEQ ID NO: 1002262 - DNA, 18 bp, Homo sapiens
caacactgattcctggag

SEQ ID NO: 1002263 - DNA, 16 bp, Homo sapiens
caacactgctgtccac

SEQ ID NO: 1002264 - DNA, 13 bp, Homo sapiens
caacactgtgccc

SEQ ID NO: 1002265 - DNA, 19 bp, Homo sapiens
caacactgtgccctggtgg

SEQ ID NO: 1002266 - DNA, 20 bp, Homo sapiens
caacacttgcaggggtccct

SEQ ID NO: 1002267 - DNA, 21 bp, Homo sapiens
caacacttgcaggggtccctg

SEQ ID NO: 1002268 - DNA, 15 bp, Homo sapiens
caacagaaaaacaat

SEQ ID NO: 1002269 - DNA, 16 bp, Homo sapiens
caacagaaaaacaatc

SEQ ID NO: 1002270 - DNA, 19 bp, Homo sapiens
caacagaaacatgccagaa

SEQ ID NO: 1002271 - DNA, 17 bp, Homo sapiens
caacagaagcatttgta

SEQ ID NO: 1002272 - DNA, 18 bp, Homo sapiens
caacagaagcatttgtat

SEQ ID NO: 1002273 - DNA, 16 bp, Homo sapiens
caacagaagcttcaga

SEQ ID NO: 1002274 - DNA, 17 bp, Homo sapiens
caacagagaaggcagga

SEQ ID NO: 1002275 - DNA, 15 bp, Homo sapiens
caacagagggagttt

SEQ ID NO: 1002276 - DNA, 19 bp, Homo sapiens
caacagagtgagaccctgt

SEQ ID NO: 1002277 - DNA, 20 bp, Homo sapiens
caacagatgaccgtgtacaa

SEQ ID NO: 1002278 - DNA, 22 bp, Homo sapiens
caacagatgatagtccaatttt

SEQ ID NO: 1002279 - DNA, 15 bp, Homo sapiens
caacagatgcttttc

SEQ ID NO: 1002280 - DNA, 21 bp, Homo sapiens
caacagatgcttttctgtctc

SEQ ID NO: 1002281 - DNA, 15 bp, Homo sapiens
caacagcactggctc

SEQ ID NO: 1002282 - DNA, 14 bp, Homo sapiens
caacagccaagacc

SEQ ID NO: 1002283 - DNA, 21 bp, Homo sapiens
caacagcccaggcatctcctt

SEQ ID NO: 1002284 - DNA, 17 bp, Homo sapiens
caacagccctgcctgag

SEQ ID NO: 1002285 - DNA, 12 bp, Homo sapiens
caacagctcaga

SEQ ID NO: 1002286 - DNA, 11 bp, Homo sapiens
caacagctctc

SEQ ID NO: 1002287 - DNA, 12 bp, Homo sapiens
caacagctctcg

SEQ ID NO: 1002288 - DNA, 13 bp, Homo sapiens
caacaggagagag

SEQ ID NO: 1002289 - DNA, 15 bp, Homo sapiens
caacaggagagagat

SEQ ID NO: 1002290 - DNA, 18 bp, Homo sapiens
caacaggcaggggcccac

SEQ ID NO: 1002291 - DNA, 15 bp, Homo sapiens
caacaggggaaacta

SEQ ID NO: 1002292 - DNA, 23 bp, Homo sapiens
caacagggtagatttctcttggg

SEQ ID NO: 1002293 - DNA, 21 bp, Homo sapiens
caacaggtgctgaactgtgca

SEQ ID NO: 1002294 - DNA, 21 bp, Homo sapiens
caacaggtggcaggaccagga

SEQ ID NO: 1002295 - DNA, 22 bp, Homo sapiens
caacaggtggcaggaccaggac

SEQ ID NO: 1002296 - DNA, 21 bp, Homo sapiens
caacataaggagaatgtatct

SEQ ID NO: 1002297 - DNA, 17 bp, Homo sapiens
caacatcaatgttcatt

SEQ ID NO: 1002298 - DNA, 16 bp, Homo sapiens
caacatcacagcccag

SEQ ID NO: 1002299 - DNA, 20 bp, Homo sapiens
caacatcacagcccagcccg

SEQ ID NO: 1002300 - DNA, 15 bp, Homo sapiens
caacatcagaaagaa

SEQ ID NO: 1002301 - DNA, 17 bp, Homo sapiens
caacatcccattgccct

SEQ ID NO: 1002302 - DNA, 19 bp, Homo sapiens
caacatctcgagccccctg

SEQ ID NO: 1002303 - DNA, 18 bp, Homo sapiens
ccacctgcaggaccctgt

SEQ ID NO: 1002304 - DNA, 12 bp, Homo sapiens
ccacctgcctgc

SEQ ID NO: 1002305 - DNA, 13 bp, Homo sapiens
ccacctgcctgcg

SEQ ID NO: 1002306 - DNA, 17 bp, Homo sapiens
ccacctgcgcttctgct

SEQ ID NO: 1002307 - DNA, 20 bp, Homo sapiens
ccacctgcgcttctgctgga

SEQ ID NO: 1002308 - DNA, 23 bp, Homo sapiens
ccacctgcggccgccccccgccc

SEQ ID NO: 1002309 - DNA, 15 bp, Homo sapiens
ccacctgctgagaga

SEQ ID NO: 1002310 - DNA, 23 bp, Homo sapiens
ccacctggacacacactcaccag

SEQ ID NO: 1002311 - DNA, 15 bp, Homo sapiens
ccacctggagcccgc

SEQ ID NO: 1002312 - DNA, 12 bp, Homo sapiens
ccacctggagtg

SEQ ID NO: 1002313 - DNA, 21 bp, Homo sapiens
ccacctggatctatccctgcg

SEQ ID NO: 1002314 - DNA, 23 bp, Homo sapiens
ccacctggatctatccctgcggc

SEQ ID NO: 1002315 - DNA, 12 bp, Homo sapiens
ccacctggcagg

SEQ ID NO: 1002316 - DNA, 22 bp, Homo sapiens
ccacctggcagggctcacactc

SEQ ID NO: 1002317 - DNA, 14 bp, Homo sapiens
ccacctggccacct

SEQ ID NO: 1002318 - DNA, 18 bp, Homo sapiens
ccacctggccacctgagg

SEQ ID NO: 1002319 - DNA, 12 bp, Homo sapiens
ccacctggcccc

SEQ ID NO: 1002320 - DNA, 14 bp, Homo sapiens
ccacctggctcccc

SEQ ID NO: 1002321 - DNA, 17 bp, Homo sapiens
ccacctgggaacacagt

SEQ ID NO: 1002322 - DNA, 13 bp, Homo sapiens
ccacctgggctgg

SEQ ID NO: 1002323 - DNA, 13 bp, Homo sapiens
ccacctggggtct

SEQ ID NO: 1002324 - DNA, 12 bp, Homo sapiens
ccacctgtacat

SEQ ID NO: 1002325 - DNA, 18 bp, Homo sapiens
ccacctgtctcagcctcc

SEQ ID NO: 1002326 - DNA, 15 bp, Homo sapiens
ccacctgtgccctca

SEQ ID NO: 1002327 - DNA, 16 bp, Homo sapiens
ccacctgtgctgctgc

SEQ ID NO: 1002328 - DNA, 12 bp, Homo sapiens
ccacctgtgggt

SEQ ID NO: 1002329 - DNA, 14 bp, Homo sapiens
cccagccctggctc

SEQ ID NO: 1002330 - DNA, 12 bp, Homo sapiens
cccagccctggg

SEQ ID NO: 1002331 - DNA, 21 bp, Homo sapiens
cccagccctgggaaccactcc

SEQ ID NO: 1002332 - DNA, 22 bp, Homo sapiens
cccagccctgggaaccactccc

SEQ ID NO: 1002333 - DNA, 15 bp, Homo sapiens
cccagccctgtggaa

SEQ ID NO: 1002334 - DNA, 13 bp, Homo sapiens
cccagcccttagc

SEQ ID NO: 1002335 - DNA, 24 bp, Homo sapiens
cccagcccttccttgggcgtctcc

SEQ ID NO: 1002336 - DNA, 17 bp, Homo sapiens
cccagcccttctgcctt

SEQ ID NO: 1002337 - DNA, 18 bp, Homo sapiens
cccagccgcaggaaggca

SEQ ID NO: 1002338 - DNA, 14 bp, Homo sapiens
cccagccggaggga

SEQ ID NO: 1002339 - DNA, 15 bp, Homo sapiens
cccagccggcctctc

SEQ ID NO: 1002340 - DNA, 17 bp, Homo sapiens
cccagccggcctctctg

SEQ ID NO: 1002341 - DNA, 18 bp, Homo sapiens
cccagccggcctctctgg

SEQ ID NO: 1002342 - DNA, 19 bp, Homo sapiens
cccagccggcctctctggc

SEQ ID NO: 1002343 - DNA, 22 bp, Homo sapiens
cccagccggcctctctggcctc

SEQ ID NO: 1002344 - DNA, 18 bp, Homo sapiens
cccagcctacccttcctg

SEQ ID NO: 1002345 - DNA, 13 bp, Homo sapiens
cccagcctaggtg

SEQ ID NO: 1002346 - DNA, 17 bp, Homo sapiens
cccagcctaggtggagg

SEQ ID NO: 1002347 - DNA, 22 bp, Homo sapiens
cccagcctagtcagggcacagc

SEQ ID NO: 1002348 - DNA, 12 bp, Homo sapiens
cccagcctcagc

SEQ ID NO: 1002349 - DNA, 14 bp, Homo sapiens
cccagcctcagccc

SEQ ID NO: 1002350 - DNA, 20 bp, Homo sapiens
cccagcctccaagctccatc

SEQ ID NO: 1002351 - DNA, 22 bp, Homo sapiens
cccagcctccagagaagccccg

SEQ ID NO: 1002352 - DNA, 19 bp, Homo sapiens
cccagcctcctgagggctc

SEQ ID NO: 1002353 - DNA, 15 bp, Homo sapiens
cccagcctgccccct

SEQ ID NO: 1002354 - DNA, 19 bp, Homo sapiens
cccagcctgctgagagccc

SEQ ID NO: 1002355 - DNA, 20 bp, Homo sapiens
cccagcctgctgagagcccc

SEQ ID NO: 1002356 - DNA, 11 bp, Homo sapiens
cccagcctggc

SEQ ID NO: 1002357 - DNA, 13 bp, Homo sapiens
cccagcctggcca

SEQ ID NO: 1002358 - DNA, 14 bp, Homo sapiens
cccagcctgggcca

SEQ ID NO: 1002359 - DNA, 21 bp, Homo sapiens
cccagcctgggcccatctccc

SEQ ID NO: 1002360 - DNA, 23 bp, Homo sapiens
cccagcctgggcccatctccctg

SEQ ID NO: 1002361 - DNA, 23 bp, Homo sapiens
cccagcctggggctccctctctg

SEQ ID NO: 1002362 - DNA, 11 bp, Homo sapiens
cccagcctggt

SEQ ID NO: 1002363 - DNA, 13 bp, Homo sapiens
cccagcctgtcct

SEQ ID NO: 1002364 - DNA, 15 bp, Homo sapiens
cccagcctgtcctgg

SEQ ID NO: 1002365 - DNA, 22 bp, Homo sapiens
cccagcctgtcctggtacagca

SEQ ID NO: 1002366 - DNA, 13 bp, Homo sapiens
cccagccttgttt

SEQ ID NO: 1002367 - DNA, 14 bp, Homo sapiens
cccagcgacacaga

SEQ ID NO: 1002368 - DNA, 19 bp, Homo sapiens
cccagcgagccacaggaac

SEQ ID NO: 1002369 - DNA, 20 bp, Homo sapiens
cccagcgagccacaggaacg

SEQ ID NO: 1002370 - DNA, 21 bp, Homo sapiens
cccagcgagccacaggaacgg

SEQ ID NO: 1002371 - DNA, 19 bp, Homo sapiens
cccagcggccccccgcaca

SEQ ID NO: 1002372 - DNA, 18 bp, Homo sapiens
atgaaaacttttgtaaat

SEQ ID NO: 1002373 - DNA, 21 bp, Homo sapiens
atgaaaacttttgtaaattat

SEQ ID NO: 1002374 - DNA, 12 bp, Homo sapiens
atgaaaaggaat

SEQ ID NO: 1002375 - DNA, 14 bp, Homo sapiens
atgaaaataaaaca

SEQ ID NO: 1002376 - DNA, 18 bp, Homo sapiens
atgaaaataactgaattt

SEQ ID NO: 1002377 - DNA, 13 bp, Homo sapiens
atgaaaatacaac

SEQ ID NO: 1002378 - DNA, 18 bp, Homo sapiens
atgaaaatcctatatctg

SEQ ID NO: 1002379 - DNA, 23 bp, Homo sapiens
atgaaaatcctatatctgtttgt

SEQ ID NO: 1002380 - DNA, 16 bp, Homo sapiens
atgaaaatgagcatca

SEQ ID NO: 1002381 - DNA, 16 bp, Homo sapiens
atgaaaatgagccctg

SEQ ID NO: 1002382 - DNA, 19 bp, Homo sapiens
atgaaaatgtcagaaacca

SEQ ID NO: 1002383 - DNA, 13 bp, Homo sapiens
atgaaaatgtctt

SEQ ID NO: 1002384 - DNA, 16 bp, Homo sapiens
atgaaaatgtcttgtg

SEQ ID NO: 1002385 - DNA, 22 bp, Homo sapiens
atgaaaatgttacaagctaaga

SEQ ID NO: 1002386 - DNA, 19 bp, Homo sapiens
atgaaacaccttctctgga

SEQ ID NO: 1002387 - DNA, 15 bp, Homo sapiens
atgaaacatatcatg

SEQ ID NO: 1002388 - DNA, 16 bp, Homo sapiens
atgaaacatatcatgg

SEQ ID NO: 1002389 - DNA, 22 bp, Homo sapiens
atgaaacatatcatggtaatga

SEQ ID NO: 1002390 - DNA, 12 bp, Homo sapiens
atgaaacattca

SEQ ID NO: 1002391 - DNA, 20 bp, Homo sapiens
atgaaactaggcttctgtaa

SEQ ID NO: 1002392 - DNA, 23 bp, Homo sapiens
atgaaactctttcattcttctca

SEQ ID NO: 1002393 - DNA, 17 bp, Homo sapiens
atgaaagactgtacaaa

SEQ ID NO: 1002394 - DNA, 20 bp, Homo sapiens
atgaaagactgtacaaagta

SEQ ID NO: 1002395 - DNA, 13 bp, Homo sapiens
atgaaagaggagg

SEQ ID NO: 1002396 - DNA, 21 bp, Homo sapiens
atgaaagcaacaaagaaatcc

SEQ ID NO: 1002397 - DNA, 21 bp, Homo sapiens
atgaaagggaaagtcagcttt

SEQ ID NO: 1002398 - DNA, 18 bp, Homo sapiens
atgaaagggtttgtaata

SEQ ID NO: 1002399 - DNA, 14 bp, Homo sapiens
atgaaaggtactat

SEQ ID NO: 1002400 - DNA, 20 bp, Homo sapiens
atgaaagtctagaaataaaa

SEQ ID NO: 1002401 - DNA, 17 bp, Homo sapiens
atgaaagtgactttaaa

SEQ ID NO: 1002402 - DNA, 23 bp, Homo sapiens
atgaaataaaaaaaaaaggatga

SEQ ID NO: 1002403 - DNA, 14 bp, Homo sapiens
atgaaataaaatta

SEQ ID NO: 1002404 - DNA, 23 bp, Homo sapiens
atgaaatactgagatgctgggct

SEQ ID NO: 1002405 - DNA, 13 bp, Homo sapiens
atgaaatatcaga

SEQ ID NO: 1002406 - DNA, 13 bp, Homo sapiens
atgaaatatgcat

SEQ ID NO: 1002407 - DNA, 19 bp, Homo sapiens
atgaaatccttgactggac

SEQ ID NO: 1002408 - DNA, 19 bp, Homo sapiens
atgaaatctcacagatgta

SEQ ID NO: 1002409 - DNA, 21 bp, Homo sapiens
atgaaatctgctagaaagtta

SEQ ID NO: 1002410 - DNA, 16 bp, Homo sapiens
atgaaatctttctttc

SEQ ID NO: 1002411 - DNA, 15 bp, Homo sapiens
atgaaatgcactgta

SEQ ID NO: 1002412 - DNA, 13 bp, Homo sapiens
atgaaatgtatgt

SEQ ID NO: 1002413 - DNA, 18 bp, Homo sapiens
atgaaatgtggaagtcag

SEQ ID NO: 1002414 - DNA, 13 bp, Homo sapiens
atgaaattcctcc

SEQ ID NO: 1002415 - DNA, 17 bp, Homo sapiens
atgaaattcctccttcc

SEQ ID NO: 1002416 - DNA, 23 bp, Homo sapiens
atgaaattgccaaaaaaatttat

SEQ ID NO: 1002417 - DNA, 15 bp, Homo sapiens
atgaaattgtatctc

SEQ ID NO: 1002418 - DNA, 20 bp, Homo sapiens
atgaaattgtctagcagagc

SEQ ID NO: 1002419 - DNA, 22 bp, Homo sapiens
atgaaattgtctagcagagcag

SEQ ID NO: 1002420 - DNA, 23 bp, Homo sapiens
atgaaattgtctagcagagcagg

SEQ ID NO: 1002421 - DNA, 15 bp, Homo sapiens
atgaacaaaattatt

SEQ ID NO: 1002422 - DNA, 13 bp, Homo sapiens
atgaacaagtttt

SEQ ID NO: 1002423 - DNA, 21 bp, Homo sapiens
atgaacaagttttaatgtata

SEQ ID NO: 1002424 - DNA, 12 bp, Homo sapiens
atgaacacagac

SEQ ID NO: 1002425 - DNA, 17 bp, Homo sapiens
atgaacacccttagaaa

SEQ ID NO: 1002426 - DNA, 18 bp, Homo sapiens
atgaacacttaaattatg

SEQ ID NO: 1002427 - DNA, 19 bp, Homo sapiens
atgaacagaaactacattt

SEQ ID NO: 1002428 - DNA, 16 bp, Homo sapiens
atgaacagaacataga

SEQ ID NO: 1002429 - DNA, 17 bp, Homo sapiens
atgaacagctctgagat

SEQ ID NO: 1002430 - DNA, 21 bp, Homo sapiens
atgaacagctgtgtctgccaa

SEQ ID NO: 1002431 - DNA, 14 bp, Homo sapiens
atgaacatattcat

SEQ ID NO: 1002432 - DNA, 17 bp, Homo sapiens
atgaacatgcagttcat

SEQ ID NO: 1002433 - DNA, 15 bp, Homo sapiens
atgaacatgttcctg

SEQ ID NO: 1002434 - DNA, 19 bp, Homo sapiens
atgaacattgtactgttgc

SEQ ID NO: 1002435 - DNA, 11 bp, Homo sapiens
atgaacatttc

SEQ ID NO: 1002436 - DNA, 13 bp, Homo sapiens
atgaacatttcaa

SEQ ID NO: 1002437 - DNA, 19 bp, Homo sapiens
atgaacatttcaaattgaa

SEQ ID NO: 1002438 - DNA, 18 bp, Homo sapiens
atgaacattttgtggagt

SEQ ID NO: 1002439 - DNA, 23 bp, Homo sapiens
atgaacattttgtggagtttgta

SEQ ID NO: 1002440 - DNA, 21 bp, Homo sapiens
atgaacccaggacgcttctga

SEQ ID NO: 1002441 - DNA, 22 bp, Homo sapiens
atgaacccaggacgcttctgaa

SEQ ID NO: 1002442 - DNA, 17 bp, Homo sapiens
atgaaccctcctccttt

SEQ ID NO: 1002443 - DNA, 18 bp, Homo sapiens
atgaaccctcctcctttt

SEQ ID NO: 1002444 - DNA, 21 bp, Homo sapiens
atgaaccctcttgccatcctg

SEQ ID NO: 1002445 - DNA, 18 bp, Homo sapiens
atgaacctattttcattt

SEQ ID NO: 1002446 - DNA, 21 bp, Homo sapiens
atgaacctattttcatttgta

SEQ ID NO: 1002447 - DNA, 14 bp, Homo sapiens
atgaaccttctggc

SEQ ID NO: 1002448 - DNA, 14 bp, Homo sapiens
atgaactgaagttt

SEQ ID NO: 1002449 - DNA, 12 bp, Homo sapiens
atgaactgtgga

SEQ ID NO: 1002450 - DNA, 15 bp, Homo sapiens
atgaactgtggaatt

SEQ ID NO: 1002451 - DNA, 16 bp, Homo sapiens
atgaacttattctgta

SEQ ID NO: 1002452 - DNA, 17 bp, Homo sapiens
atgaactttctcttcat

SEQ ID NO: 1002453 - DNA, 14 bp, Homo sapiens
atgaactttgtcat

SEQ ID NO: 1002454 - DNA, 15 bp, Homo sapiens
atgaacttttacaga

SEQ ID NO: 1002455 - DNA, 15 bp, Homo sapiens
atgaagaaaaagtac

SEQ ID NO: 1002456 - DNA, 17 bp, Homo sapiens
atgaagaaaaagtacaa

SEQ ID NO: 1002457 - DNA, 21 bp, Homo sapiens
atgaagaaaagtgggccagtg

SEQ ID NO: 1002458 - DNA, 22 bp, Homo sapiens
atgaagaaaagtgggccagtgt

SEQ ID NO: 1002459 - DNA, 20 bp, Homo sapiens
atgaagaaagggaggcccag

SEQ ID NO: 1002460 - DNA, 22 bp, Homo sapiens
atgaagaaagggaggcccagcc

SEQ ID NO: 1002461 - DNA, 21 bp, Homo sapiens
atgaagaaagtcaaaaaatta

SEQ ID NO: 1002462 - DNA, 15 bp, Homo sapiens
atgaagaaatttatg

SEQ ID NO: 1002463 - DNA, 17 bp, Homo sapiens
atgaagaacacagcatg

SEQ ID NO: 1002464 - DNA, 14 bp, Homo sapiens
atgaagaactgagg

SEQ ID NO: 1002465 - DNA, 16 bp, Homo sapiens
atgaagaagacacctc

SEQ ID NO: 1002466 - DNA, 16 bp, Homo sapiens
atgaagaatagaaaca

SEQ ID NO: 1002467 - DNA, 19 bp, Homo sapiens
atgaagaatcacgatttca

SEQ ID NO: 1002468 - DNA, 22 bp, Homo sapiens
atgaagaatgcattcaaaatat

SEQ ID NO: 1002469 - DNA, 15 bp, Homo sapiens
atgaagaattatgta

SEQ ID NO: 1002470 - DNA, 15 bp, Homo sapiens
atgaagacagaaggc

SEQ ID NO: 1002471 - DNA, 16 bp, Homo sapiens
atgaagacaggacagt

SEQ ID NO: 1002472 - DNA, 21 bp, Homo sapiens
atgaagacaggacagtgcttc

SEQ ID NO: 1002473 - DNA, 21 bp, Homo sapiens
atgaagagaaggcacacagag

SEQ ID NO: 1002474 - DNA, 16 bp, Homo sapiens
atgaagagctgtcttc

SEQ ID NO: 1002475 - DNA, 24 bp, Homo sapiens
atgaagaggagattggccagtgag

SEQ ID NO: 1002476 - DNA, 22 bp, Homo sapiens
atgaagagtttttttctgttta

SEQ ID NO: 1002477 - DNA, 20 bp, Homo sapiens
atgaagatcatatacgtgaa

SEQ ID NO: 1002478 - DNA, 22 bp, Homo sapiens
atgaagatgtttcaaaaaatct

SEQ ID NO: 1002479 - DNA, 19 bp, Homo sapiens
atgaagattctcctgtgct

SEQ ID NO: 1002480 - DNA, 14 bp, Homo sapiens
ccccagccaggcta

SEQ ID NO: 1002481 - DNA, 17 bp, Homo sapiens
ccccagccatccagggg

SEQ ID NO: 1002482 - DNA, 22 bp, Homo sapiens
ccccagccatgccagctggcct

SEQ ID NO: 1002483 - DNA, 18 bp, Homo sapiens
ccccagcccacagagcct

SEQ ID NO: 1002484 - DNA, 20 bp, Homo sapiens
ccccagcccacagagcctga

SEQ ID NO: 1002485 - DNA, 12 bp, Homo sapiens
ccccagcccacc

SEQ ID NO: 1002486 - DNA, 21 bp, Homo sapiens
ccccagcccagggttccccca

SEQ ID NO: 1002487 - DNA, 23 bp, Homo sapiens
ccccagcccatccattaggccag

SEQ ID NO: 1002488 - DNA, 14 bp, Homo sapiens
ccccagccccaact

SEQ ID NO: 1002489 - DNA, 23 bp, Homo sapiens
ccccagccccgactccagccagc

SEQ ID NO: 1002490 - DNA, 15 bp, Homo sapiens
ccccagccccttcca

SEQ ID NO: 1002491 - DNA, 15 bp, Homo sapiens
ccccagccctcagtc

SEQ ID NO: 1002492 - DNA, 17 bp, Homo sapiens
ccccagccctgctgggg

SEQ ID NO: 1002493 - DNA, 20 bp, Homo sapiens
ccccatctttgatccttctg

SEQ ID NO: 1002494 - DNA, 20 bp, Homo sapiens
ccccatgagctcggggtcca

SEQ ID NO: 1002495 - DNA, 15 bp, Homo sapiens
ccccatgatgtaagt

SEQ ID NO: 1002496 - DNA, 13 bp, Homo sapiens
ccccatgcctgtc

SEQ ID NO: 1002497 - DNA, 17 bp, Homo sapiens
ccccatgcctgtccagc

SEQ ID NO: 1002498 - DNA, 18 bp, Homo sapiens
ccccatgcctgtccagcc

SEQ ID NO: 1002499 - DNA, 17 bp, Homo sapiens
ccccatgctctgcccca

SEQ ID NO: 1002500 - DNA, 15 bp, Homo sapiens
ccccatgctggaggt

SEQ ID NO: 1002501 - DNA, 23 bp, Homo sapiens
ccccatgggctgtgtcctaaggc

SEQ ID NO: 1002502 - DNA, 12 bp, Homo sapiens
ccccatgggctt

SEQ ID NO: 1002503 - DNA, 20 bp, Homo sapiens
ccccatggtgctaggaagag

SEQ ID NO: 1002504 - DNA, 17 bp, Homo sapiens
ccccatgtctctcagaa

SEQ ID NO: 1002505 - DNA, 13 bp, Homo sapiens
ccccatgtgcctt

SEQ ID NO: 1002506 - DNA, 20 bp, Homo sapiens
ccccatgtgccttgtccagg

SEQ ID NO: 1002507 - DNA, 14 bp, Homo sapiens
ccccatgtgtcctg

SEQ ID NO: 1002508 - DNA, 16 bp, Homo sapiens
ccccatgtgtcctggt

SEQ ID NO: 1002509 - DNA, 20 bp, Homo sapiens
ccccatgttgtaatgctgca

SEQ ID NO: 1002510 - DNA, 23 bp, Homo sapiens
ccccatgttgtaatgctgcactt

SEQ ID NO: 1002511 - DNA, 21 bp, Homo sapiens
ccccatgtttaaactttgtgc

SEQ ID NO: 1002512 - DNA, 15 bp, Homo sapiens
ccccattccctctct

SEQ ID NO: 1002513 - DNA, 17 bp, Homo sapiens
ccccattctcccagtct

SEQ ID NO: 1002514 - DNA, 16 bp, Homo sapiens
ccccattcttcctagt

SEQ ID NO: 1002515 - DNA, 19 bp, Homo sapiens
ccccattggagcaagcttg

SEQ ID NO: 1002516 - DNA, 17 bp, Homo sapiens
ccccatttctatttatt

SEQ ID NO: 1002517 - DNA, 19 bp, Homo sapiens
ccccatttctgcctcgctc

SEQ ID NO: 1002518 - DNA, 15 bp, Homo sapiens
ccccatttgtcccag

SEQ ID NO: 1002519 - DNA, 15 bp, Homo sapiens
ccccattttctgtgg

SEQ ID NO: 1002520 - DNA, 18 bp, Homo sapiens
cccccaaaatccaaaact

SEQ ID NO: 1002521 - DNA, 16 bp, Homo sapiens
cccccaacactgtgcc

SEQ ID NO: 1002522 - DNA, 19 bp, Homo sapiens
cccccaacccccagaggtg

SEQ ID NO: 1002523 - DNA, 14 bp, Homo sapiens
cccccaacctcagg

SEQ ID NO: 1002524 - DNA, 20 bp, Homo sapiens
cccccaactctgagcccatg

SEQ ID NO: 1002525 - DNA, 15 bp, Homo sapiens
cccccaataaaggca

SEQ ID NO: 1002526 - DNA, 20 bp, Homo sapiens
cccccaataaaggcagctgc

SEQ ID NO: 1002527 - DNA, 21 bp, Homo sapiens
cccccaataaaggcagctgcc

SEQ ID NO: 1002528 - DNA, 22 bp, Homo sapiens
cccccaataaaggcagctgcct

SEQ ID NO: 1002529 - DNA, 17 bp, Homo sapiens
cccccacacctcagttc

SEQ ID NO: 1002530 - DNA, 20 bp, Homo sapiens
cccccacacttccctggcgg

SEQ ID NO: 1002531 - DNA, 17 bp, Homo sapiens
cccccaccacactgaat

SEQ ID NO: 1002532 - DNA, 20 bp, Homo sapiens
cccccacccacccccaggcc

SEQ ID NO: 1002533 - DNA, 18 bp, Homo sapiens
cccccacccacctcctgc

SEQ ID NO: 1002534 - DNA, 14 bp, Homo sapiens
cccccacccctcca

SEQ ID NO: 1002535 - DNA, 20 bp, Homo sapiens
cccccaccccttccccaggc

SEQ ID NO: 1002536 - DNA, 13 bp, Homo sapiens
cccccaccctcca

SEQ ID NO: 1002537 - DNA, 12 bp, Homo sapiens
cccccacccttt

SEQ ID NO: 1002538 - DNA, 18 bp, Homo sapiens
cccccaccggtccagctg

SEQ ID NO: 1002539 - DNA, 19 bp, Homo sapiens
cccccaccggtccagctgg

SEQ ID NO: 1002540 - DNA, 22 bp, Homo sapiens
cccccacctctccctgaccctg

SEQ ID NO: 1002541 - DNA, 22 bp, Homo sapiens
cccccacctgacaatggcagct

SEQ ID NO: 1002542 - DNA, 23 bp, Homo sapiens
cccccaccttggtccctctcaga

SEQ ID NO: 1002543 - DNA, 18 bp, Homo sapiens
cccccactcagtgcctcc

SEQ ID NO: 1002544 - DNA, 11 bp, Homo sapiens
cccccactccc

SEQ ID NO: 1002545 - DNA, 12 bp, Homo sapiens
cccccactcccc

SEQ ID NO: 1002546 - DNA, 20 bp, Homo sapiens
cccccactctctcacccacc

SEQ ID NO: 1002547 - DNA, 14 bp, Homo sapiens
cccccactgcaggc

SEQ ID NO: 1002548 - DNA, 12 bp, Homo sapiens
cccccactgcta

SEQ ID NO: 1002549 - DNA, 22 bp, Homo sapiens
cccccactgctaaggctgctgg

SEQ ID NO: 1002550 - DNA, 18 bp, Homo sapiens
cccccagaaagctgccag

SEQ ID NO: 1002551 - DNA, 12 bp, Homo sapiens
cccccagagcca

SEQ ID NO: 1002552 - DNA, 21 bp, Homo sapiens
cccccagagccagggctgtcc

SEQ ID NO: 1002553 - DNA, 23 bp, Homo sapiens
cccccagagccagggctgtcctt

SEQ ID NO: 1002554 - DNA, 22 bp, Homo sapiens
cccccagagtgctgtcgggacc

SEQ ID NO: 1002555 - DNA, 16 bp, Homo sapiens
cccccagatagagctg

SEQ ID NO: 1002556 - DNA, 19 bp, Homo sapiens
cccccagattccaacattt

SEQ ID NO: 1002557 - DNA, 12 bp, Homo sapiens
cccccagcactt

SEQ ID NO: 1002558 - DNA, 12 bp, Homo sapiens
cccccagccagg

SEQ ID NO: 1002559 - DNA, 13 bp, Homo sapiens
cccccagccaggc

SEQ ID NO: 1002560 - DNA, 20 bp, Homo sapiens
cccccagccatgccagctgg

SEQ ID NO: 1002561 - DNA, 15 bp, Homo sapiens
cccccagcccaaagg

SEQ ID NO: 1002562 - DNA, 14 bp, Homo sapiens
cccccagcccaggg

SEQ ID NO: 1002563 - DNA, 23 bp, Homo sapiens
cccccagccccgactccagccag

SEQ ID NO: 1002564 - DNA, 13 bp, Homo sapiens
cccccagcctatg

SEQ ID NO: 1002565 - DNA, 17 bp, Homo sapiens
cccccagcctcagccca

SEQ ID NO: 1002566 - DNA, 15 bp, Homo sapiens
cccccagcctctggc

SEQ ID NO: 1002567 - DNA, 23 bp, Homo sapiens
cccccagccttgtttctgatgac

SEQ ID NO: 1002568 - DNA, 18 bp, Homo sapiens
cccccagctccctgcacc

SEQ ID NO: 1002569 - DNA, 23 bp, Homo sapiens
cccccagctctaagcagccagga

SEQ ID NO: 1002570 - DNA, 12 bp, Homo sapiens
cccccagctctg

SEQ ID NO: 1002571 - DNA, 23 bp, Homo sapiens
cccccagcttctctctccctgtc

SEQ ID NO: 1002572 - DNA, 22 bp, Homo sapiens
cccccaggaacgctctcctcga

SEQ ID NO: 1002573 - DNA, 11 bp, Homo sapiens
cccccaggcag

SEQ ID NO: 1002574 - DNA, 14 bp, Homo sapiens
cccccaggcagcca

SEQ ID NO: 1002575 - DNA, 18 bp, Homo sapiens
cccccaggcagccaccag

SEQ ID NO: 1002576 - DNA, 13 bp, Homo sapiens
cccccaggccctc

SEQ ID NO: 1002577 - DNA, 14 bp, Homo sapiens
cccccaggcctcct

SEQ ID NO: 1002578 - DNA, 22 bp, Homo sapiens
cccccaggcctgtccaccctgc

SEQ ID NO: 1002579 - DNA, 12 bp, Homo sapiens
cccccagggcct

SEQ ID NO: 1002580 - DNA, 19 bp, Homo sapiens
cccccagggcctccagggc

SEQ ID NO: 1002581 - DNA, 20 bp, Homo sapiens
cccccaggggaaagatgagc

SEQ ID NO: 1002582 - DNA, 19 bp, Homo sapiens
cccccagggtcctaaaact

SEQ ID NO: 1002583 - DNA, 18 bp, Homo sapiens
cccccaggtgcagcccca

SEQ ID NO: 1002584 - DNA, 20 bp, Homo sapiens
cccccagtccccacccctgc

SEQ ID NO: 1002585 - DNA, 22 bp, Homo sapiens
cccccagtccccacccctgccc

SEQ ID NO: 1002586 - DNA, 15 bp, Homo sapiens
cccccatagcaccct

SEQ ID NO: 1002587 - DNA, 17 bp, Homo sapiens
cccccatccagccacgg

SEQ ID NO: 1002588 - DNA, 20 bp, Homo sapiens
cccccatccagccacggagg

SEQ ID NO: 1002589 - DNA, 13 bp, Homo sapiens
cccccatcccagg

SEQ ID NO: 1002590 - DNA, 23 bp, Homo sapiens
cccccatccccatcctccagctt

SEQ ID NO: 1002591 - DNA, 20 bp, Homo sapiens
cccccatctccccaggcctc

SEQ ID NO: 1002592 - DNA, 16 bp, Homo sapiens
cccccatctcttctgg

SEQ ID NO: 1002593 - DNA, 14 bp, Homo sapiens
cccccatctgagct

SEQ ID NO: 1002594 - DNA, 17 bp, Homo sapiens
cccccatcttccacctg

SEQ ID NO: 1002595 - DNA, 22 bp, Homo sapiens
cccccatgtttaaactttgtgc

SEQ ID NO: 1002596 - DNA, 20 bp, Homo sapiens
cccccattctcatctgcacc

SEQ ID NO: 1002597 - DNA, 14 bp, Homo sapiens
cccccattctccca

SEQ ID NO: 1002598 - DNA, 13 bp, Homo sapiens
ccccccacccacc

SEQ ID NO: 1002599 - DNA, 11 bp, Homo sapiens
ccccccactct

SEQ ID NO: 1002600 - DNA, 22 bp, Homo sapiens
ccccccagactctttttttgag

SEQ ID NO: 1002601 - DNA, 12 bp, Homo sapiens
ccccccagagcc

SEQ ID NO: 1002602 - DNA, 13 bp, Homo sapiens
ccccccagagcca

SEQ ID NO: 1002603 - DNA, 13 bp, Homo sapiens
ccccccagcacta

SEQ ID NO: 1002604 - DNA, 11 bp, Homo sapiens
cccccccagcc

SEQ ID NO: 1002605 - DNA, 13 bp, Homo sapiens
cccccccttccac

SEQ ID NO: 1002606 - DNA, 12 bp, Homo sapiens
cccccctcctgc

SEQ ID NO: 1002607 - DNA, 15 bp, Homo sapiens
cccccctcctgctcc

SEQ ID NO: 1002608 - DNA, 12 bp, Homo sapiens
ccccccttgaag

SEQ ID NO: 1002609 - DNA, 22 bp, Homo sapiens
ccccccttgaagcaataactcc

SEQ ID NO: 1002610 - DNA, 14 bp, Homo sapiens
cccccgacggctgt

SEQ ID NO: 1002611 - DNA, 19 bp, Homo sapiens
atgaccattgagtccctgc

SEQ ID NO: 1002612 - DNA, 17 bp, Homo sapiens
atgacccacccctgtgc

SEQ ID NO: 1002613 - DNA, 12 bp, Homo sapiens
atgacccagacc

SEQ ID NO: 1002614 - DNA, 18 bp, Homo sapiens
atgaccccttctctctcc

SEQ ID NO: 1002615 - DNA, 18 bp, Homo sapiens
ccccgggctctctgctgt

SEQ ID NO: 1002616 - DNA, 22 bp, Homo sapiens
atgaggcctcttggacctctgc

SEQ ID NO: 1002617 - DNA, 23 bp, Homo sapiens
atgaggcctcttggacctctgct

SEQ ID NO: 1002618 - DNA, 15 bp, Homo sapiens
atgaggctggtgacg

SEQ ID NO: 1002619 - DNA, 19 bp, Homo sapiens
atgaggggacattttggtg

SEQ ID NO: 1002620 - DNA, 12 bp, Homo sapiens
atgaggggagag

SEQ ID NO: 1002621 - DNA, 14 bp, Homo sapiens
atgaggggccactg

SEQ ID NO: 1002622 - DNA, 14 bp, Homo sapiens
atgagggtgactgt

SEQ ID NO: 1002623 - DNA, 14 bp, Homo sapiens
atgaggtcccaggc

SEQ ID NO: 1002624 - DNA, 15 bp, Homo sapiens
atgaggtcccaggca

SEQ ID NO: 1002625 - DNA, 17 bp, Homo sapiens
atgaggtcccaggcaga

SEQ ID NO: 1002626 - DNA, 20 bp, Homo sapiens
atgaggtcccaggcagagaa

SEQ ID NO: 1002627 - DNA, 13 bp, Homo sapiens
atgaggtcctcag

SEQ ID NO: 1002628 - DNA, 22 bp, Homo sapiens
atgaggtgggaggtggaagaag

SEQ ID NO: 1002629 - DNA, 23 bp, Homo sapiens
atgaggttgggggaaccagcaga

SEQ ID NO: 1002630 - DNA, 18 bp, Homo sapiens
atgagtcaatcagccttt

SEQ ID NO: 1002631 - DNA, 19 bp, Homo sapiens
atgagtcaatgtgcagtgt

SEQ ID NO: 1002632 - DNA, 22 bp, Homo sapiens
atgagtcactatgggatgagaa

SEQ ID NO: 1002633 - DNA, 18 bp, Homo sapiens
atgagtccttgaaaatat

SEQ ID NO: 1002634 - DNA, 20 bp, Homo sapiens
atgagtccttgaaaatattt

SEQ ID NO: 1002635 - DNA, 21 bp, Homo sapiens
atgagtctgtaggagcaaggg

SEQ ID NO: 1002636 - DNA, 20 bp, Homo sapiens
atgagtgcaggtttctattg

SEQ ID NO: 1002637 - DNA, 20 bp, Homo sapiens
atgagtgcgcagatctgtgc

SEQ ID NO: 1002638 - DNA, 13 bp, Homo sapiens
atgagtggccagc

SEQ ID NO: 1002639 - DNA, 19 bp, Homo sapiens
atgagtggccagcgccagg

SEQ ID NO: 1002640 - DNA, 22 bp, Homo sapiens
atgagtggccagcgccagggcc

SEQ ID NO: 1002641 - DNA, 13 bp, Homo sapiens
atgagtgtgcatg

SEQ ID NO: 1002642 - DNA, 16 bp, Homo sapiens
atgagttagaggagaa

SEQ ID NO: 1002643 - DNA, 17 bp, Homo sapiens
atgagttatgagttatt

SEQ ID NO: 1002644 - DNA, 15 bp, Homo sapiens
atgagttattatcta

SEQ ID NO: 1002645 - DNA, 13 bp, Homo sapiens
atgagttgcagtt

SEQ ID NO: 1002646 - DNA, 16 bp, Homo sapiens
atgagttgcagttttt

SEQ ID NO: 1002647 - DNA, 14 bp, Homo sapiens
atgagttgtgatga

SEQ ID NO: 1002648 - DNA, 17 bp, Homo sapiens
atgagtttcactgtact

SEQ ID NO: 1002649 - DNA, 14 bp, Homo sapiens
atgagtttgcttat

SEQ ID NO: 1002650 - DNA, 12 bp, Homo sapiens
atgagtttgtat

SEQ ID NO: 1002651 - DNA, 23 bp, Homo sapiens
atgagtttgtattattacaaata

SEQ ID NO: 1002652 - DNA, 13 bp, Homo sapiens
atgagtttttgat

SEQ ID NO: 1002653 - DNA, 19 bp, Homo sapiens
atgagtttttgatagcttt

SEQ ID NO: 1002654 - DNA, 12 bp, Homo sapiens
atgataaagact

SEQ ID NO: 1002655 - DNA, 15 bp, Homo sapiens
atgataaagactttt

SEQ ID NO: 1002656 - DNA, 20 bp, Homo sapiens
atgataaagagacagtgata

SEQ ID NO: 1002657 - DNA, 23 bp, Homo sapiens
atgataatcaattattacattta

SEQ ID NO: 1002658 - DNA, 17 bp, Homo sapiens
atgatacaagattagaa

SEQ ID NO: 1002659 - DNA, 15 bp, Homo sapiens
atgatacatccaaag

SEQ ID NO: 1002660 - DNA, 17 bp, Homo sapiens
atgataccacctttact

SEQ ID NO: 1002661 - DNA, 20 bp, Homo sapiens
atgataccacctttactgtg

SEQ ID NO: 1002662 - DNA, 17 bp, Homo sapiens
atgatacccaacagttt

SEQ ID NO: 1002663 - DNA, 19 bp, Homo sapiens
atgatagtaataggataca

SEQ ID NO: 1002664 - DNA, 17 bp, Homo sapiens
atgatataactttagaa

SEQ ID NO: 1002665 - DNA, 20 bp, Homo sapiens
atgatattccccatttcctg

SEQ ID NO: 1002666 - DNA, 15 bp, Homo sapiens
atgatattgtttaaa

SEQ ID NO: 1002667 - DNA, 18 bp, Homo sapiens
atgatattgtttaaaatt

SEQ ID NO: 1002668 - DNA, 20 bp, Homo sapiens
atgatattttgtctcctacc

SEQ ID NO: 1002669 - DNA, 20 bp, Homo sapiens
atgatcaaaacctgtgccag

SEQ ID NO: 1002670 - DNA, 15 bp, Homo sapiens
atgatcaagatatat

SEQ ID NO: 1002671 - DNA, 15 bp, Homo sapiens
atgatcacagtgact

SEQ ID NO: 1002672 - DNA, 19 bp, Homo sapiens
atgatcacatctaaagctt

SEQ ID NO: 1002673 - DNA, 19 bp, Homo sapiens
atgatcacttatcagtttg

SEQ ID NO: 1002674 - DNA, 18 bp, Homo sapiens
atgatcagacatacagct

SEQ ID NO: 1002675 - DNA, 20 bp, Homo sapiens
atgatcagctgtttgtcata

SEQ ID NO: 1002676 - DNA, 14 bp, Homo sapiens
atgatcagtactga

SEQ ID NO: 1002677 - DNA, 13 bp, Homo sapiens
atgatcagtgttg

SEQ ID NO: 1002678 - DNA, 21 bp, Homo sapiens
atgatccagaacagtggctcg

SEQ ID NO: 1002679 - DNA, 17 bp, Homo sapiens
atgatccagagcagagt

SEQ ID NO: 1002680 - DNA, 13 bp, Homo sapiens
atgatccctgtgt

SEQ ID NO: 1002681 - DNA, 18 bp, Homo sapiens
atgatccttttttgtcat

SEQ ID NO: 1002682 - DNA, 23 bp, Homo sapiens
atgatccttttttgtcattttat

SEQ ID NO: 1002683 - DNA, 19 bp, Homo sapiens
atgatcgcccgataaagac

SEQ ID NO: 1002684 - DNA, 12 bp, Homo sapiens
atgatctccctg

SEQ ID NO: 1002685 - DNA, 14 bp, Homo sapiens
atgatctccctgcc

SEQ ID NO: 1002686 - DNA, 23 bp, Homo sapiens
atgatctcggatgaccaaaccag

SEQ ID NO: 1002687 - DNA, 23 bp, Homo sapiens
atgatctctccacggtagcactt

SEQ ID NO: 1002688 - DNA, 14 bp, Homo sapiens
atgatcttgtgaca

SEQ ID NO: 1002689 - DNA, 20 bp, Homo sapiens
atgatcttgttactgtgata

SEQ ID NO: 1002690 - DNA, 23 bp, Homo sapiens
atgatcttgttactgtgatattt

SEQ ID NO: 1002691 - DNA, 14 bp, Homo sapiens
atgatgaaaataat

SEQ ID NO: 1002692 - DNA, 14 bp, Homo sapiens
atgatgaaacattc

SEQ ID NO: 1002693 - DNA, 20 bp, Homo sapiens
atgatgaagaaatgatggaa

SEQ ID NO: 1002694 - DNA, 17 bp, Homo sapiens
atgatgacgacgacaac

SEQ ID NO: 1002695 - DNA, 20 bp, Homo sapiens
atgatgagccttcgtgcccc

SEQ ID NO: 1002696 - DNA, 21 bp, Homo sapiens
atgatgcagctgttgagaaaa

SEQ ID NO: 1002697 - DNA, 14 bp, Homo sapiens
atgatgcatacagt

SEQ ID NO: 1002698 - DNA, 16 bp, Homo sapiens
atgatgcatacagttt

SEQ ID NO: 1002699 - DNA, 17 bp, Homo sapiens
atgatgccaacctctgg

SEQ ID NO: 1002700 - DNA, 21 bp, Homo sapiens
atgatgccgaacattaggaat

SEQ ID NO: 1002701 - DNA, 23 bp, Homo sapiens
atgatgcttctataattttgcct

SEQ ID NO: 1002702 - DNA, 18 bp, Homo sapiens
atgatgcttttatagctg

SEQ ID NO: 1002703 - DNA, 19 bp, Homo sapiens
atgatggaaacgcacttac

SEQ ID NO: 1002704 - DNA, 22 bp, Homo sapiens
atgatggaaacgcacttacaag

SEQ ID NO: 1002705 - DNA, 21 bp, Homo sapiens
atgatggatcaccattatatt

SEQ ID NO: 1002706 - DNA, 16 bp, Homo sapiens
atgatggatggcagac

SEQ ID NO: 1002707 - DNA, 16 bp, Homo sapiens
atgatggcagagccag

SEQ ID NO: 1002708 - DNA, 18 bp, Homo sapiens
atgatggcagagccaggc

SEQ ID NO: 1002709 - DNA, 18 bp, Homo sapiens
atgatgggaaaatatttc

SEQ ID NO: 1002710 - DNA, 23 bp, Homo sapiens
atgatggggtgggagactttcca

SEQ ID NO: 1002711 - DNA, 15 bp, Homo sapiens
atgatggtgttaaag

SEQ ID NO: 1002712 - DNA, 16 bp, Homo sapiens
atgatggtgttaaagc

SEQ ID NO: 1002713 - DNA, 15 bp, Homo sapiens
atgatgtccagaaga

SEQ ID NO: 1002714 - DNA, 22 bp, Homo sapiens
atgatgtctacagaaaatgctg

SEQ ID NO: 1002715 - DNA, 13 bp, Homo sapiens
atgatgtcttctg

SEQ ID NO: 1002716 - DNA, 22 bp, Homo sapiens
atgatgtgcaaaaccttttact

SEQ ID NO: 1002717 - DNA, 13 bp, Homo sapiens
atgatgtggacat

SEQ ID NO: 1002718 - DNA, 14 bp, Homo sapiens
atgatgttaaaaaa

SEQ ID NO: 1002719 - DNA, 17 bp, Homo sapiens
atgatgttagaagaaga

SEQ ID NO: 1002720 - DNA, 14 bp, Homo sapiens
atgatgttgataat

SEQ ID NO: 1002721 - DNA, 15 bp, Homo sapiens
atgatgttgataatt

SEQ ID NO: 1002722 - DNA, 16 bp, Homo sapiens
atgatgtttgcccaaa

SEQ ID NO: 1002723 - DNA, 13 bp, Homo sapiens
atgatgttttgat

SEQ ID NO: 1002724 - DNA, 19 bp, Homo sapiens
atgattaaccacttcagct

SEQ ID NO: 1002725 - DNA, 21 bp, Homo sapiens
atgattaaccacttcagctga

SEQ ID NO: 1002726 - DNA, 12 bp, Homo sapiens
atgattaatcaa

SEQ ID NO: 1002727 - DNA, 22 bp, Homo sapiens
atgattactggcctttttcatt

SEQ ID NO: 1002728 - DNA, 14 bp, Homo sapiens
atgattagcaagtt

SEQ ID NO: 1002729 - DNA, 23 bp, Homo sapiens
atgattagcaagttacagtgatg

SEQ ID NO: 1002730 - DNA, 12 bp, Homo sapiens
atgattataagc

SEQ ID NO: 1002731 - DNA, 17 bp, Homo sapiens
atgattatattcacaga

SEQ ID NO: 1002732 - DNA, 12 bp, Homo sapiens
atgattcaagcc

SEQ ID NO: 1002733 - DNA, 17 bp, Homo sapiens
atgattcagaaattgga

SEQ ID NO: 1002734 - DNA, 13 bp, Homo sapiens
atgattccaaata

SEQ ID NO: 1002735 - DNA, 19 bp, Homo sapiens
atgattcctggacatcacc

SEQ ID NO: 1002736 - DNA, 23 bp, Homo sapiens
atgattctaatttttaagcaaaa

SEQ ID NO: 1002737 - DNA, 17 bp, Homo sapiens
atgcactttccctagaa

SEQ ID NO: 1002738 - DNA, 17 bp, Homo sapiens
atgcacttttgggcctt

SEQ ID NO: 1002739 - DNA, 18 bp, Homo sapiens
atgcagaaatagacaaaa

SEQ ID NO: 1002740 - DNA, 17 bp, Homo sapiens
atgcagaaccacaaaca

SEQ ID NO: 1002741 - DNA, 17 bp, Homo sapiens
atgcagaacgtatttag

SEQ ID NO: 1002742 - DNA, 18 bp, Homo sapiens
atgcagaagcatattttg

SEQ ID NO: 1002743 - DNA, 20 bp, Homo sapiens
atgcagaagcatattttgct

SEQ ID NO: 1002744 - DNA, 20 bp, Homo sapiens
atgcagaatgtttttaaaat

SEQ ID NO: 1002745 - DNA, 19 bp, Homo sapiens
atgcagacaacaccttcct

SEQ ID NO: 1002746 - DNA, 17 bp, Homo sapiens
atgcagacatctctgga

SEQ ID NO: 1002747 - DNA, 13 bp, Homo sapiens
cccctctcggcca

SEQ ID NO: 1002748 - DNA, 11 bp, Homo sapiens
cccctctctgc

SEQ ID NO: 1002749 - DNA, 14 bp, Homo sapiens
cccctctctttctc

SEQ ID NO: 1002750 - DNA, 17 bp, Homo sapiens
cccctctgcacccagaa

SEQ ID NO: 1002751 - DNA, 19 bp, Homo sapiens
cccctctgcacccagaaca

SEQ ID NO: 1002752 - DNA, 13 bp, Homo sapiens
cccctctgcccag

SEQ ID NO: 1002753 - DNA, 22 bp, Homo sapiens
cccctctgccggtcgggcagcc

SEQ ID NO: 1002754 - DNA, 15 bp, Homo sapiens
cccctctgctctgtc

SEQ ID NO: 1002755 - DNA, 14 bp, Homo sapiens
cccctctgcttctc

SEQ ID NO: 1002756 - DNA, 16 bp, Homo sapiens
cccctctggctccagc

SEQ ID NO: 1002757 - DNA, 22 bp, Homo sapiens
cccctctgtcatcactccctgg

SEQ ID NO: 1002758 - DNA, 12 bp, Homo sapiens
cccctctgtcca

SEQ ID NO: 1002759 - DNA, 12 bp, Homo sapiens
cccctctgtctt

SEQ ID NO: 1002760 - DNA, 21 bp, Homo sapiens
cccctctgtcttcaaggacta

SEQ ID NO: 1002761 - DNA, 22 bp, Homo sapiens
cccctctgtgcttcgactactg

SEQ ID NO: 1002762 - DNA, 12 bp, Homo sapiens
cccctcttccct

SEQ ID NO: 1002763 - DNA, 12 bp, Homo sapiens
cccctcttcctc

SEQ ID NO: 1002764 - DNA, 23 bp, Homo sapiens
cccctcttggagaagtctcagct

SEQ ID NO: 1002765 - DNA, 15 bp, Homo sapiens
cccctgacctgtgag

SEQ ID NO: 1002766 - DNA, 21 bp, Homo sapiens
cccctgagaccacccccaaac

SEQ ID NO: 1002767 - DNA, 22 bp, Homo sapiens
cccctgagagtggtgccctgga

SEQ ID NO: 1002768 - DNA, 17 bp, Homo sapiens
cccctgagatcccctga

SEQ ID NO: 1002769 - DNA, 19 bp, Homo sapiens
cccctgagatcccctgagc

SEQ ID NO: 1002770 - DNA, 21 bp, Homo sapiens
cccctgagcaatgtctgtgct

SEQ ID NO: 1002771 - DNA, 14 bp, Homo sapiens
cccctgaggactgg

SEQ ID NO: 1002772 - DNA, 20 bp, Homo sapiens
cccctgagtcaactggagca

SEQ ID NO: 1002773 - DNA, 19 bp, Homo sapiens
cccctgatctctgacctct

SEQ ID NO: 1002774 - DNA, 21 bp, Homo sapiens
cccctgatctctgacctctgc

SEQ ID NO: 1002775 - DNA, 15 bp, Homo sapiens
cccctgatgcagcct

SEQ ID NO: 1002776 - DNA, 19 bp, Homo sapiens
cccctgatgcagcctgtgg

SEQ ID NO: 1002777 - DNA, 15 bp, Homo sapiens
cccctgatgcccagg

SEQ ID NO: 1002778 - DNA, 18 bp, Homo sapiens
cccctgatgcccaggtca

SEQ ID NO: 1002779 - DNA, 15 bp, Homo sapiens
cccctgcaaaaagaa

SEQ ID NO: 1002780 - DNA, 21 bp, Homo sapiens
cccctgcaaagcccagcttga

SEQ ID NO: 1002781 - DNA, 17 bp, Homo sapiens
cccctgcacctggcctg

SEQ ID NO: 1002782 - DNA, 16 bp, Homo sapiens
cccctgcactaggcag

SEQ ID NO: 1002783 - DNA, 17 bp, Homo sapiens
cccctgcagcctgggtc

SEQ ID NO: 1002784 - DNA, 17 bp, Homo sapiens
cccctgccacgcaggcc

SEQ ID NO: 1002785 - DNA, 19 bp, Homo sapiens
cccctgccagggcagggcc

SEQ ID NO: 1002786 - DNA, 14 bp, Homo sapiens
cccctgccctgcac

SEQ ID NO: 1002787 - DNA, 15 bp, Homo sapiens
cccctgccctgctgc

SEQ ID NO: 1002788 - DNA, 17 bp, Homo sapiens
cccctgccctggggaga

SEQ ID NO: 1002789 - DNA, 13 bp, Homo sapiens
cccctgccctggt

SEQ ID NO: 1002790 - DNA, 17 bp, Homo sapiens
cccctgccctggtccag

SEQ ID NO: 1002791 - DNA, 17 bp, Homo sapiens
cccctgccggccggggc

SEQ ID NO: 1002792 - DNA, 15 bp, Homo sapiens
cccctgcctcctgcc

SEQ ID NO: 1002793 - DNA, 17 bp, Homo sapiens
cccctgcctgacagcct

SEQ ID NO: 1002794 - DNA, 11 bp, Homo sapiens
cccctgcctgc

SEQ ID NO: 1002795 - DNA, 12 bp, Homo sapiens
cccctgcctgcc

SEQ ID NO: 1002796 - DNA, 21 bp, Homo sapiens
cccctgcctgggaacacgtgt

SEQ ID NO: 1002797 - DNA, 22 bp, Homo sapiens
cccctgcctgttggcaggccca

SEQ ID NO: 1002798 - DNA, 19 bp, Homo sapiens
cccctgccttcctctgagg

SEQ ID NO: 1002799 - DNA, 14 bp, Homo sapiens
cccctgcgtggggg

SEQ ID NO: 1002800 - DNA, 21 bp, Homo sapiens
cccctgcgtgggggccagtca

SEQ ID NO: 1002801 - DNA, 18 bp, Homo sapiens
cccctgctactcctgtgc

SEQ ID NO: 1002802 - DNA, 13 bp, Homo sapiens
cccctgctcagca

SEQ ID NO: 1002803 - DNA, 16 bp, Homo sapiens
cccctgctcccagcct

SEQ ID NO: 1002804 - DNA, 17 bp, Homo sapiens
cccctgctcccagcctg

SEQ ID NO: 1002805 - DNA, 16 bp, Homo sapiens
cccctgctgcccagtg

SEQ ID NO: 1002806 - DNA, 20 bp, Homo sapiens
cccctgctgcctccccaacc

SEQ ID NO: 1002807 - DNA, 21 bp, Homo sapiens
cccctgctgtctctctgggct

SEQ ID NO: 1002808 - DNA, 18 bp, Homo sapiens
cccctgctgtgctgctca

SEQ ID NO: 1002809 - DNA, 19 bp, Homo sapiens
cccctgctgtgctgctcaa

SEQ ID NO: 1002810 - DNA, 22 bp, Homo sapiens
cccctggaaccagcaagtccca

SEQ ID NO: 1002811 - DNA, 19 bp, Homo sapiens
cccctggaccaccagcccc

SEQ ID NO: 1002812 - DNA, 15 bp, Homo sapiens
cccctggacccctgg

SEQ ID NO: 1002813 - DNA, 15 bp, Homo sapiens
cccctggagagaagt

SEQ ID NO: 1002814 - DNA, 20 bp, Homo sapiens
cccctggaggcactgaagtg

SEQ ID NO: 1002815 - DNA, 21 bp, Homo sapiens
cccctggagtgtgtcagagcc

SEQ ID NO: 1002816 - DNA, 15 bp, Homo sapiens
cccctggatgtcccc

SEQ ID NO: 1002817 - DNA, 16 bp, Homo sapiens
cccctggcagctgccc

SEQ ID NO: 1002818 - DNA, 17 bp, Homo sapiens
cccctggcagctgcccc

SEQ ID NO: 1002819 - DNA, 18 bp, Homo sapiens
cccctggcagctgcccct

SEQ ID NO: 1002820 - DNA, 16 bp, Homo sapiens
cccctggccagctctg

SEQ ID NO: 1002821 - DNA, 18 bp, Homo sapiens
cccctggccagctctgag

SEQ ID NO: 1002822 - DNA, 11 bp, Homo sapiens
cccctggccca

SEQ ID NO: 1002823 - DNA, 15 bp, Homo sapiens
cccctggcccagcgg

SEQ ID NO: 1002824 - DNA, 22 bp, Homo sapiens
cccctggcccagcggcccctcc

SEQ ID NO: 1002825 - DNA, 16 bp, Homo sapiens
cccctggccgcgctcc

SEQ ID NO: 1002826 - DNA, 23 bp, Homo sapiens
cccctggccgcgctccgggcttt

SEQ ID NO: 1002827 - DNA, 20 bp, Homo sapiens
cccctggcctcagttcccag

SEQ ID NO: 1002828 - DNA, 12 bp, Homo sapiens
cccctggcctct

SEQ ID NO: 1002829 - DNA, 15 bp, Homo sapiens
cccctggctctgggc

SEQ ID NO: 1002830 - DNA, 22 bp, Homo sapiens
cccctggctgggacgtggctca

SEQ ID NO: 1002831 - DNA, 23 bp, Homo sapiens
cccctggctgtactgctcaggct

SEQ ID NO: 1002832 - DNA, 14 bp, Homo sapiens
cccctgggaacagg

SEQ ID NO: 1002833 - DNA, 18 bp, Homo sapiens
cccctgggaacaggcccc

SEQ ID NO: 1002834 - DNA, 15 bp, Homo sapiens
cccctgggcagggtt

SEQ ID NO: 1002835 - DNA, 15 bp, Homo sapiens
cccctgggctctgcc

SEQ ID NO: 1002836 - DNA, 23 bp, Homo sapiens
cccctgggctctgccccagctct

SEQ ID NO: 1002837 - DNA, 11 bp, Homo sapiens
cccctgggctg

SEQ ID NO: 1002838 - DNA, 21 bp, Homo sapiens
cccctgggctggggcctcaga

SEQ ID NO: 1002839 - DNA, 18 bp, Homo sapiens
cccctgggcttggcctgc

SEQ ID NO: 1002840 - DNA, 20 bp, Homo sapiens
cccctggggacgccaaggag

SEQ ID NO: 1002841 - DNA, 19 bp, Homo sapiens
cccctggggcccagcccct

SEQ ID NO: 1002842 - DNA, 19 bp, Homo sapiens
cccctggggcttctcctga

SEQ ID NO: 1002843 - DNA, 12 bp, Homo sapiens
cccctggggtgg

SEQ ID NO: 1002844 - DNA, 16 bp, Homo sapiens
cccctggggtggccag

SEQ ID NO: 1002845 - DNA, 20 bp, Homo sapiens
cccctggggtggccagggct

SEQ ID NO: 1002846 - DNA, 20 bp, Homo sapiens
cccctgggtgggtggtgggg

SEQ ID NO: 1002847 - DNA, 23 bp, Homo sapiens
cccctgggtgggtggtggggagg

SEQ ID NO: 1002848 - DNA, 16 bp, Homo sapiens
cccctggtaagcagag

SEQ ID NO: 1002849 - DNA, 20 bp, Homo sapiens
cccctggtggacagtcctgg

SEQ ID NO: 1002850 - DNA, 17 bp, Homo sapiens
cccctgtacccagctcc

SEQ ID NO: 1002851 - DNA, 11 bp, Homo sapiens
cccctgtccca

SEQ ID NO: 1002852 - DNA, 14 bp, Homo sapiens
cccctgtcccattc

SEQ ID NO: 1002853 - DNA, 14 bp, Homo sapiens
cccctgtccccaag

SEQ ID NO: 1002854 - DNA, 15 bp, Homo sapiens
cccctgtccccagtc

SEQ ID NO: 1002855 - DNA, 21 bp, Homo sapiens
cccctgtccccagtccccagc

SEQ ID NO: 1002856 - DNA, 21 bp, Homo sapiens
cccctgtcgcccacccagctg

SEQ ID NO: 1002857 - DNA, 14 bp, Homo sapiens
cccctgtctagaga

SEQ ID NO: 1002858 - DNA, 20 bp, Homo sapiens
cccctgtgcagccgctgagc

SEQ ID NO: 1002859 - DNA, 22 bp, Homo sapiens
cccgaggagctgggcccctgca

SEQ ID NO: 1002860 - DNA, 14 bp, Homo sapiens
cccgaggctgcccc

SEQ ID NO: 1002861 - DNA, 14 bp, Homo sapiens
cccgagggagctgc

SEQ ID NO: 1002862 - DNA, 18 bp, Homo sapiens
cccgagggagctgctggc

SEQ ID NO: 1002863 - DNA, 13 bp, Homo sapiens
cccgagggatggt

SEQ ID NO: 1002864 - DNA, 22 bp, Homo sapiens
cccgagggcgaaggccattggg

SEQ ID NO: 1002865 - DNA, 18 bp, Homo sapiens
cccgagggctcagaagag

SEQ ID NO: 1002866 - DNA, 23 bp, Homo sapiens
cccgagggctgagcctggtccca

SEQ ID NO: 1002867 - DNA, 22 bp, Homo sapiens
cccgagggctgaggagcagcca

SEQ ID NO: 1002868 - DNA, 23 bp, Homo sapiens
cccgagggctgaggagcagccag

SEQ ID NO: 1002869 - DNA, 16 bp, Homo sapiens
cccgagtagctgggat

SEQ ID NO: 1002870 - DNA, 15 bp, Homo sapiens
cccgagtcctcaggt

SEQ ID NO: 1002871 - DNA, 14 bp, Homo sapiens
cccgagtctgggac

SEQ ID NO: 1002872 - DNA, 15 bp, Homo sapiens
cccgagttcctctgg

SEQ ID NO: 1002873 - DNA, 19 bp, Homo sapiens
cccgatattctccctgacc

SEQ ID NO: 1002874 - DNA, 23 bp, Homo sapiens
cccgatgctgctttcccctgtgg

SEQ ID NO: 1002875 - DNA, 22 bp, Homo sapiens
cccgatggaggactccaggcag

SEQ ID NO: 1002876 - DNA, 13 bp, Homo sapiens
cccgatggggcat

SEQ ID NO: 1002877 - DNA, 13 bp, Homo sapiens
cccgatggtctct

SEQ ID NO: 1002878 - DNA, 20 bp, Homo sapiens
cccgatggtctctctccctc

SEQ ID NO: 1002879 - DNA, 15 bp, Homo sapiens
cccgatgtcccctgc

SEQ ID NO: 1002880 - DNA, 19 bp, Homo sapiens
atgcggttaattttgaagt

SEQ ID NO: 1002881 - DNA, 16 bp, Homo sapiens
atgcgtaaacgacact

SEQ ID NO: 1002882 - DNA, 15 bp, Homo sapiens
atgcgtaatttaatg

SEQ ID NO: 1002883 - DNA, 21 bp, Homo sapiens
atgcgtacgtttcctgagaag

SEQ ID NO: 1002884 - DNA, 17 bp, Homo sapiens
atgcgtattctgtggcc

SEQ ID NO: 1002885 - DNA, 21 bp, Homo sapiens
atgcgtgccgcctgctcctca

SEQ ID NO: 1002886 - DNA, 18 bp, Homo sapiens
atgcgtgctgagaggcga

SEQ ID NO: 1002887 - DNA, 22 bp, Homo sapiens
atgcgtggccacgggggcagtg

SEQ ID NO: 1002888 - DNA, 14 bp, Homo sapiens
atgcgtgggaggca

SEQ ID NO: 1002889 - DNA, 16 bp, Homo sapiens
atgcgtgtttctgact

SEQ ID NO: 1002890 - DNA, 15 bp, Homo sapiens
atgcgttcgcctctg

SEQ ID NO: 1002891 - DNA, 17 bp, Homo sapiens
atgcgtttgcctcctgg

SEQ ID NO: 1002892 - DNA, 17 bp, Homo sapiens
atgctaacatctaaaaa

SEQ ID NO: 1002893 - DNA, 14 bp, Homo sapiens
atgctaacgtgtca

SEQ ID NO: 1002894 - DNA, 16 bp, Homo sapiens
atgctaattcaatgcc

SEQ ID NO: 1002895 - DNA, 17 bp, Homo sapiens
atgctaatttaaagaga

SEQ ID NO: 1002896 - DNA, 18 bp, Homo sapiens
atgctacacactgcatgt

SEQ ID NO: 1002897 - DNA, 19 bp, Homo sapiens
atgctaccaggatgctaaa

SEQ ID NO: 1002898 - DNA, 23 bp, Homo sapiens
atgctactgtctcactgaaacat

SEQ ID NO: 1002899 - DNA, 22 bp, Homo sapiens
atgctactttatttatacactg

SEQ ID NO: 1002900 - DNA, 12 bp, Homo sapiens
atgctagtttat

SEQ ID NO: 1002901 - DNA, 16 bp, Homo sapiens
atgctatgagttttct

SEQ ID NO: 1002902 - DNA, 15 bp, Homo sapiens
atgctatgttctgtc

SEQ ID NO: 1002903 - DNA, 17 bp, Homo sapiens
atgctattgacaataaa

SEQ ID NO: 1002904 - DNA, 23 bp, Homo sapiens
atgctattgacaataaaatatta

SEQ ID NO: 1002905 - DNA, 13 bp, Homo sapiens
atgctcaaagaaa

SEQ ID NO: 1002906 - DNA, 14 bp, Homo sapiens
atgctcaaagaaat

SEQ ID NO: 1002907 - DNA, 17 bp, Homo sapiens
atgctcaaagaaatcta

SEQ ID NO: 1002908 - DNA, 23 bp, Homo sapiens
atgctcaacccccctcccagaca

SEQ ID NO: 1002909 - DNA, 16 bp, Homo sapiens
atgctcaatttcagca

SEQ ID NO: 1002910 - DNA, 18 bp, Homo sapiens
atgctcacctctagcctt

SEQ ID NO: 1002911 - DNA, 13 bp, Homo sapiens
atgctcactttat

SEQ ID NO: 1002912 - DNA, 14 bp, Homo sapiens
atgctcagagcttt

SEQ ID NO: 1002913 - DNA, 18 bp, Homo sapiens
atgctcagccctgactgg

SEQ ID NO: 1002914 - DNA, 17 bp, Homo sapiens
atgctcagtgccttttg

SEQ ID NO: 1002915 - DNA, 15 bp, Homo sapiens
atgctcataaagatg

SEQ ID NO: 1002916 - DNA, 12 bp, Homo sapiens
atgctccagcca

SEQ ID NO: 1002917 - DNA, 18 bp, Homo sapiens
atgctccagccaacccct

SEQ ID NO: 1002918 - DNA, 20 bp, Homo sapiens
atgctccagccaacccctgt

SEQ ID NO: 1002919 - DNA, 13 bp, Homo sapiens
atgctccagctgt

SEQ ID NO: 1002920 - DNA, 11 bp, Homo sapiens
atgctcccagc

SEQ ID NO: 1002921 - DNA, 22 bp, Homo sapiens
atgctcccagctgtgctgtgga

SEQ ID NO: 1002922 - DNA, 17 bp, Homo sapiens
atgctcccatctcctga

SEQ ID NO: 1002923 - DNA, 21 bp, Homo sapiens
atgctcccatctcctgatttc

SEQ ID NO: 1002924 - DNA, 21 bp, Homo sapiens
atgctccccacagcgtccctg

SEQ ID NO: 1002925 - DNA, 20 bp, Homo sapiens
atgctcccccatcctcccct

SEQ ID NO: 1002926 - DNA, 21 bp, Homo sapiens
atgctcccccatcctcccctt

SEQ ID NO: 1002927 - DNA, 23 bp, Homo sapiens
atgctcccccatcctccccttcc

SEQ ID NO: 1002928 - DNA, 18 bp, Homo sapiens
atgctccctcccctgccc

SEQ ID NO: 1002929 - DNA, 20 bp, Homo sapiens
atgctccctcccctgccctg

SEQ ID NO: 1002930 - DNA, 22 bp, Homo sapiens
atgctccctcccctgccctggt

SEQ ID NO: 1002931 - DNA, 21 bp, Homo sapiens
atgctccctcctctcctaccc

SEQ ID NO: 1002932 - DNA, 13 bp, Homo sapiens
atgctcctcacct

SEQ ID NO: 1002933 - DNA, 14 bp, Homo sapiens
atgctcctggccca

SEQ ID NO: 1002934 - DNA, 19 bp, Homo sapiens
atgctccttgagaggagaa

SEQ ID NO: 1002935 - DNA, 23 bp, Homo sapiens
atgctcgccatcaaggtccagtg

SEQ ID NO: 1002936 - DNA, 14 bp, Homo sapiens
atgctcgtgtgatt

SEQ ID NO: 1002937 - DNA, 15 bp, Homo sapiens
atgctcgtgtgattt

SEQ ID NO: 1002938 - DNA, 16 bp, Homo sapiens
atgctcgtgtgatttc

SEQ ID NO: 1002939 - DNA, 17 bp, Homo sapiens
atgctctagtgccttct

SEQ ID NO: 1002940 - DNA, 17 bp, Homo sapiens
atgctctatgtttgtat

SEQ ID NO: 1002941 - DNA, 19 bp, Homo sapiens
atgctctctgcagccagcc

SEQ ID NO: 1002942 - DNA, 23 bp, Homo sapiens
atgctctctgcagccagcccagc

SEQ ID NO: 1002943 - DNA, 19 bp, Homo sapiens
atgctctgcatgttacata

SEQ ID NO: 1002944 - DNA, 12 bp, Homo sapiens
atgctctggctt

SEQ ID NO: 1002945 - DNA, 22 bp, Homo sapiens
atgctctggcttgccccaggac

SEQ ID NO: 1002946 - DNA, 21 bp, Homo sapiens
atgctctgtggctggctcacc

SEQ ID NO: 1002947 - DNA, 17 bp, Homo sapiens
atgctcttaaaatatct

SEQ ID NO: 1002948 - DNA, 14 bp, Homo sapiens
atgctcttctgtgg

SEQ ID NO: 1002949 - DNA, 20 bp, Homo sapiens
atgctcttgaaatattcaga

SEQ ID NO: 1002950 - DNA, 21 bp, Homo sapiens
atgctcttgaccttgtagaga

SEQ ID NO: 1002951 - DNA, 17 bp, Homo sapiens
atgctgaaaaaacacct

SEQ ID NO: 1002952 - DNA, 17 bp, Homo sapiens
atgctgaacattgcata

SEQ ID NO: 1002953 - DNA, 14 bp, Homo sapiens
atgctgaacgcaga

SEQ ID NO: 1002954 - DNA, 14 bp, Homo sapiens
atgctgaactcctt

SEQ ID NO: 1002955 - DNA, 22 bp, Homo sapiens
atgctgaagacattcaaaacgt

SEQ ID NO: 1002956 - DNA, 18 bp, Homo sapiens
atgctgaatactcctccc

SEQ ID NO: 1002957 - DNA, 23 bp, Homo sapiens
atgctgaatatacagcaggtgct

SEQ ID NO: 1002958 - DNA, 18 bp, Homo sapiens
atgctgaatatctgttca

SEQ ID NO: 1002959 - DNA, 13 bp, Homo sapiens
atgctgaatttct

SEQ ID NO: 1002960 - DNA, 13 bp, Homo sapiens
atgctgacagctc

SEQ ID NO: 1002961 - DNA, 19 bp, Homo sapiens
atgctgacattcacctgcc

SEQ ID NO: 1002962 - DNA, 22 bp, Homo sapiens
atgctgaggcctgggccgctgc

SEQ ID NO: 1002963 - DNA, 17 bp, Homo sapiens
atgctgaggttttgaat

SEQ ID NO: 1002964 - DNA, 23 bp, Homo sapiens
atgctgaggttttgaataaaaag

SEQ ID NO: 1002965 - DNA, 17 bp, Homo sapiens
atgctgataatcatttt

SEQ ID NO: 1002966 - DNA, 22 bp, Homo sapiens
atgctgatgatcaaaacctgtg

SEQ ID NO: 1002967 - DNA, 18 bp, Homo sapiens
atgctgattatttagagc

SEQ ID NO: 1002968 - DNA, 20 bp, Homo sapiens
atgctgattatttagagcca

SEQ ID NO: 1002969 - DNA, 16 bp, Homo sapiens
atgctgcaacaaaatg

SEQ ID NO: 1002970 - DNA, 18 bp, Homo sapiens
atgctgcaacaaaatgta

SEQ ID NO: 1002971 - DNA, 20 bp, Homo sapiens
atgctgcaagcgaggtccaa

SEQ ID NO: 1002972 - DNA, 23 bp, Homo sapiens
atgctgcattttaattttaacca

SEQ ID NO: 1002973 - DNA, 14 bp, Homo sapiens
atgctgccaaattt

SEQ ID NO: 1002974 - DNA, 17 bp, Homo sapiens
atgctgcccagccactc

SEQ ID NO: 1002975 - DNA, 22 bp, Homo sapiens
atgctgccccgttccctgtcag

SEQ ID NO: 1002976 - DNA, 24 bp, Homo sapiens
atgctgccccgttccctgtcagag

SEQ ID NO: 1002977 - DNA, 15 bp, Homo sapiens
atgctgcctgcctgt

SEQ ID NO: 1002978 - DNA, 22 bp, Homo sapiens
atgctgccttcagggagacagg

SEQ ID NO: 1002979 - DNA, 22 bp, Homo sapiens
atgctgctaaagggagaaatgc

SEQ ID NO: 1002980 - DNA, 19 bp, Homo sapiens
atggaacactggaacattc

SEQ ID NO: 1002981 - DNA, 15 bp, Homo sapiens
atggaacagaataga

SEQ ID NO: 1002982 - DNA, 18 bp, Homo sapiens
atggaacatatgcacagg

SEQ ID NO: 1002983 - DNA, 15 bp, Homo sapiens
atggaaccttccctc

SEQ ID NO: 1002984 - DNA, 19 bp, Homo sapiens
atggaaccttccctccaaa

SEQ ID NO: 1002985 - DNA, 24 bp, Homo sapiens
atggaacgggcatgggcctctctg

SEQ ID NO: 1002986 - DNA, 16 bp, Homo sapiens
atggaactactgtact

SEQ ID NO: 1002987 - DNA, 17 bp, Homo sapiens
atggaactactgtactt

SEQ ID NO: 1002988 - DNA, 15 bp, Homo sapiens
atggaactgtgtatt

SEQ ID NO: 1002989 - DNA, 16 bp, Homo sapiens
atggaagattttaaat

SEQ ID NO: 1002990 - DNA, 22 bp, Homo sapiens
atggaagcaaagacaaaagaaa

SEQ ID NO: 1002991 - DNA, 14 bp, Homo sapiens
atggaaggggcttc

SEQ ID NO: 1002992 - DNA, 16 bp, Homo sapiens
atggaaggtgccagaa

SEQ ID NO: 1002993 - DNA, 21 bp, Homo sapiens
atggaaggtgccagaaggaag

SEQ ID NO: 1002994 - DNA, 18 bp, Homo sapiens
atggaataactatctcac

SEQ ID NO: 1002995 - DNA, 16 bp, Homo sapiens
atggaataactctgtg

SEQ ID NO: 1002996 - DNA, 21 bp, Homo sapiens
atggaatcccactgtatgatt

SEQ ID NO: 1002997 - DNA, 17 bp, Homo sapiens
atggaattcacaaagta

SEQ ID NO: 1002998 - DNA, 23 bp, Homo sapiens
atggaattccctcctgagtgccc

SEQ ID NO: 1002999 - DNA, 20 bp, Homo sapiens
atggaattcgtgttatgaat

SEQ ID NO: 1003000 - DNA, 23 bp, Homo sapiens
atggaattcgtgttatgaatctg

SEQ ID NO: 1003001 - DNA, 15 bp, Homo sapiens
atggaattcttcctc

SEQ ID NO: 1003002 - DNA, 15 bp, Homo sapiens
atggaattgatttgc

SEQ ID NO: 1003003 - DNA, 16 bp, Homo sapiens
atggaattgatttgca

SEQ ID NO: 1003004 - DNA, 18 bp, Homo sapiens
atggaattgatttgcatt

SEQ ID NO: 1003005 - DNA, 19 bp, Homo sapiens
atggaattttgcaaagatt

SEQ ID NO: 1003006 - DNA, 17 bp, Homo sapiens
atggacaacttatttaa

SEQ ID NO: 1003007 - DNA, 20 bp, Homo sapiens
atggacaacttatttaaaaa

SEQ ID NO: 1003008 - DNA, 23 bp, Homo sapiens
atggacaagcagtgtctgtcagc

SEQ ID NO: 1003009 - DNA, 16 bp, Homo sapiens
atggacaatataaact

SEQ ID NO: 1003010 - DNA, 14 bp, Homo sapiens
cccggcccagagac

SEQ ID NO: 1003011 - DNA, 20 bp, Homo sapiens
cccggccccaccccctgggc

SEQ ID NO: 1003012 - DNA, 12 bp, Homo sapiens
cccggcccctca

SEQ ID NO: 1003013 - DNA, 17 bp, Homo sapiens
cccggcccctcaccctc

SEQ ID NO: 1003014 - DNA, 19 bp, Homo sapiens
cccggcctccactccccca

SEQ ID NO: 1003015 - DNA, 23 bp, Homo sapiens
cccggcctcctcggagagcagca

SEQ ID NO: 1003016 - DNA, 18 bp, Homo sapiens
cccggcctgctcccagca

SEQ ID NO: 1003017 - DNA, 14 bp, Homo sapiens
cccggcgcctgccc

SEQ ID NO: 1003018 - DNA, 21 bp, Homo sapiens
cccggcgcctgccctgcccaa

SEQ ID NO: 1003019 - DNA, 15 bp, Homo sapiens
cccggctaatgtttg

SEQ ID NO: 1003020 - DNA, 14 bp, Homo sapiens
cccggctgctgctt

SEQ ID NO: 1003021 - DNA, 17 bp, Homo sapiens
cccggctgctgcttgga

SEQ ID NO: 1003022 - DNA, 14 bp, Homo sapiens
cccggctggccggg

SEQ ID NO: 1003023 - DNA, 15 bp, Homo sapiens
cccggctgggcctcc

SEQ ID NO: 1003024 - DNA, 23 bp, Homo sapiens
cccggctgggtcggccctgccca

SEQ ID NO: 1003025 - DNA, 23 bp, Homo sapiens
cccggctggttttgtaagatgct

SEQ ID NO: 1003026 - DNA, 17 bp, Homo sapiens
cccggctttcctccgga

SEQ ID NO: 1003027 - DNA, 18 bp, Homo sapiens
cccggctttcctccggag

SEQ ID NO: 1003028 - DNA, 23 bp, Homo sapiens
cccgggacgcaggggttgcagtg

SEQ ID NO: 1003029 - DNA, 23 bp, Homo sapiens
cccgggaggtggagcttgcagtg

SEQ ID NO: 1003030 - DNA, 14 bp, Homo sapiens
cccgggatattata

SEQ ID NO: 1003031 - DNA, 18 bp, Homo sapiens
cccgggatattatagaaa

SEQ ID NO: 1003032 - DNA, 15 bp, Homo sapiens
cccgggatcctgccc

SEQ ID NO: 1003033 - DNA, 17 bp, Homo sapiens
cccgggatcctgccccc

SEQ ID NO: 1003034 - DNA, 14 bp, Homo sapiens
cccgggccacgccc

SEQ ID NO: 1003035 - DNA, 16 bp, Homo sapiens
cccgggccacgcccca

SEQ ID NO: 1003036 - DNA, 17 bp, Homo sapiens
cccgggccacgccccag

SEQ ID NO: 1003037 - DNA, 18 bp, Homo sapiens
cccgggccacgccccagc

SEQ ID NO: 1003038 - DNA, 15 bp, Homo sapiens
cccgggccagggctg

SEQ ID NO: 1003039 - DNA, 16 bp, Homo sapiens
cccgggccgaccctgc

SEQ ID NO: 1003040 - DNA, 16 bp, Homo sapiens
cccgggcctgcacaga

SEQ ID NO: 1003041 - DNA, 15 bp, Homo sapiens
cccgggctctggcca

SEQ ID NO: 1003042 - DNA, 12 bp, Homo sapiens
cccgggctgcct

SEQ ID NO: 1003043 - DNA, 13 bp, Homo sapiens
cccgggctgcctg

SEQ ID NO: 1003044 - DNA, 17 bp, Homo sapiens
cccgggctgcctgggct

SEQ ID NO: 1003045 - DNA, 12 bp, Homo sapiens
cccgggctggcc

SEQ ID NO: 1003046 - DNA, 14 bp, Homo sapiens
cccgggctggccct

SEQ ID NO: 1003047 - DNA, 15 bp, Homo sapiens
cccgggctggccctg

SEQ ID NO: 1003048 - DNA, 18 bp, Homo sapiens
cccgggctggccctgtgc

SEQ ID NO: 1003049 - DNA, 22 bp, Homo sapiens
cccggggaaaggcaaggtccgg

SEQ ID NO: 1003050 - DNA, 17 bp, Homo sapiens
cccggggaccctgtgac

SEQ ID NO: 1003051 - DNA, 14 bp, Homo sapiens
cccggggactcaag

SEQ ID NO: 1003052 - DNA, 18 bp, Homo sapiens
cccggggagctgcagagc

SEQ ID NO: 1003053 - DNA, 20 bp, Homo sapiens
cccggggcagcagcagccct

SEQ ID NO: 1003054 - DNA, 14 bp, Homo sapiens
cccggggcagctgc

SEQ ID NO: 1003055 - DNA, 21 bp, Homo sapiens
cccggggcagctgccagagaa

SEQ ID NO: 1003056 - DNA, 14 bp, Homo sapiens
cccggggccagcac

SEQ ID NO: 1003057 - DNA, 22 bp, Homo sapiens
cccgggggacgcctgccctgcc

SEQ ID NO: 1003058 - DNA, 16 bp, Homo sapiens
cccggggtggccacag

SEQ ID NO: 1003059 - DNA, 22 bp, Homo sapiens
cccgggtctccttggctgtctg

SEQ ID NO: 1003060 - DNA, 14 bp, Homo sapiens
cccggtaccttcca

SEQ ID NO: 1003061 - DNA, 17 bp, Homo sapiens
cccggtcccgagtacag

SEQ ID NO: 1003062 - DNA, 13 bp, Homo sapiens
cccggtgctccct

SEQ ID NO: 1003063 - DNA, 16 bp, Homo sapiens
cccggtgctccctctg

SEQ ID NO: 1003064 - DNA, 18 bp, Homo sapiens
cccggtggtttgccatgt

SEQ ID NO: 1003065 - DNA, 17 bp, Homo sapiens
cccggttgcagtcactg

SEQ ID NO: 1003066 - DNA, 20 bp, Homo sapiens
cccggttgcagtcactgtga

SEQ ID NO: 1003067 - DNA, 15 bp, Homo sapiens
cccggttgccatgga

SEQ ID NO: 1003068 - DNA, 21 bp, Homo sapiens
cccgtacctcttcccatgact

SEQ ID NO: 1003069 - DNA, 19 bp, Homo sapiens
cccgtaggcagcctctctg

SEQ ID NO: 1003070 - DNA, 12 bp, Homo sapiens
cccgtcagggag

SEQ ID NO: 1003071 - DNA, 14 bp, Homo sapiens
cccgtcagggagag

SEQ ID NO: 1003072 - DNA, 22 bp, Homo sapiens
cccgtcagggcccaagtccctg

SEQ ID NO: 1003073 - DNA, 14 bp, Homo sapiens
cccgtccattcttc

SEQ ID NO: 1003074 - DNA, 17 bp, Homo sapiens
cccgtccattcttcagt

SEQ ID NO: 1003075 - DNA, 23 bp, Homo sapiens
cccgtccattcttcagtgtctct

SEQ ID NO: 1003076 - DNA, 19 bp, Homo sapiens
cccgtcccctaacccccag

SEQ ID NO: 1003077 - DNA, 20 bp, Homo sapiens
cccgtcccctgcagcctggg

SEQ ID NO: 1003078 - DNA, 21 bp, Homo sapiens
cccgtcccctgcagcctgggt

SEQ ID NO: 1003079 - DNA, 19 bp, Homo sapiens
cccgtccctgtcccccagc

SEQ ID NO: 1003080 - DNA, 15 bp, Homo sapiens
cccgtcctccctcag

SEQ ID NO: 1003081 - DNA, 16 bp, Homo sapiens
cccgtcctgcctgtgg

SEQ ID NO: 1003082 - DNA, 22 bp, Homo sapiens
cccgtcggactgcccccagaaa

SEQ ID NO: 1003083 - DNA, 23 bp, Homo sapiens
cccgtcggactgcccccagaaag

SEQ ID NO: 1003084 - DNA, 18 bp, Homo sapiens
cccgtcggagctgcctgc

SEQ ID NO: 1003085 - DNA, 21 bp, Homo sapiens
cccgtcggagctgcctgcagc

SEQ ID NO: 1003086 - DNA, 22 bp, Homo sapiens
cccgtcggagctgcctgcagca

SEQ ID NO: 1003087 - DNA, 12 bp, Homo sapiens
cccgtcggccct

SEQ ID NO: 1003088 - DNA, 14 bp, Homo sapiens
cccgtcggccctgc

SEQ ID NO: 1003089 - DNA, 15 bp, Homo sapiens
cccgtcttcagccta

SEQ ID NO: 1003090 - DNA, 16 bp, Homo sapiens
cccgtcttcagcctag

SEQ ID NO: 1003091 - DNA, 17 bp, Homo sapiens
cccgtcttcagcctagc

SEQ ID NO: 1003092 - DNA, 19 bp, Homo sapiens
cccgtgaagcagtgcctcg

SEQ ID NO: 1003093 - DNA, 21 bp, Homo sapiens
cccgtgcatcccccctgctca

SEQ ID NO: 1003094 - DNA, 21 bp, Homo sapiens
cccgtgcccccgcctgccacc

SEQ ID NO: 1003095 - DNA, 11 bp, Homo sapiens
cccgtgcctgg

SEQ ID NO: 1003096 - DNA, 17 bp, Homo sapiens
cccgtgcctgggcccct

SEQ ID NO: 1003097 - DNA, 21 bp, Homo sapiens
cccgtgcctgggcccctcccc

SEQ ID NO: 1003098 - DNA, 22 bp, Homo sapiens
cccgtggcctggcatctgtgtg

SEQ ID NO: 1003099 - DNA, 14 bp, Homo sapiens
cccgtggctctggg

SEQ ID NO: 1003100 - DNA, 23 bp, Homo sapiens
cccgtggctctgggagagccagc

SEQ ID NO: 1003101 - DNA, 15 bp, Homo sapiens
ccctcactccctctg

SEQ ID NO: 1003102 - DNA, 15 bp, Homo sapiens
ccctcactctgtcag

SEQ ID NO: 1003103 - DNA, 18 bp, Homo sapiens
ccctcactctgtcagcca

SEQ ID NO: 1003104 - DNA, 16 bp, Homo sapiens
ccctcactcttcctca

SEQ ID NO: 1003105 - DNA, 20 bp, Homo sapiens
ccctcactggctctcctggc

SEQ ID NO: 1003106 - DNA, 14 bp, Homo sapiens
ccctcagcacccct

SEQ ID NO: 1003107 - DNA, 21 bp, Homo sapiens
ccctcagcccctcttgccccc

SEQ ID NO: 1003108 - DNA, 13 bp, Homo sapiens
ccctcagccctgg

SEQ ID NO: 1003109 - DNA, 17 bp, Homo sapiens
ccctcagccctggcctt

SEQ ID NO: 1003110 - DNA, 18 bp, Homo sapiens
ccctcagccctggccttt

SEQ ID NO: 1003111 - DNA, 13 bp, Homo sapiens
ccctcagcccttg

SEQ ID NO: 1003112 - DNA, 13 bp, Homo sapiens
ccctcagcctccc

SEQ ID NO: 1003113 - DNA, 18 bp, Homo sapiens
ccctcagcctccccttct

SEQ ID NO: 1003114 - DNA, 19 bp, Homo sapiens
ccctcagcctccccttctt

SEQ ID NO: 1003115 - DNA, 15 bp, Homo sapiens
ccctcagcctcttct

SEQ ID NO: 1003116 - DNA, 16 bp, Homo sapiens
ccctcagcctcttctc

SEQ ID NO: 1003117 - DNA, 20 bp, Homo sapiens
ccctcagcctcttctctgca

SEQ ID NO: 1003118 - DNA, 12 bp, Homo sapiens
ccctcagcctgc

SEQ ID NO: 1003119 - DNA, 22 bp, Homo sapiens
ccctcagcctgcccacctctcc

SEQ ID NO: 1003120 - DNA, 20 bp, Homo sapiens
ccctcagcctgtaccggttt

SEQ ID NO: 1003121 - DNA, 14 bp, Homo sapiens
ccctcagcgcaggc

SEQ ID NO: 1003122 - DNA, 20 bp, Homo sapiens
ccctcagcgcaggctgcaga

SEQ ID NO: 1003123 - DNA, 15 bp, Homo sapiens
ccctcagctctctgg

SEQ ID NO: 1003124 - DNA, 17 bp, Homo sapiens
ccctcagctgtcacctg

SEQ ID NO: 1003125 - DNA, 19 bp, Homo sapiens
ccctcagctgtcacctgct

SEQ ID NO: 1003126 - DNA, 23 bp, Homo sapiens
ccctcagctgtcacctgctcaca

SEQ ID NO: 1003127 - DNA, 20 bp, Homo sapiens
ccctcaggcataggcctggg

SEQ ID NO: 1003128 - DNA, 14 bp, Homo sapiens
ccctcaggccaccc

SEQ ID NO: 1003129 - DNA, 17 bp, Homo sapiens
ccctcaggccattcccc

SEQ ID NO: 1003130 - DNA, 17 bp, Homo sapiens
ccctcagggagcctccc

SEQ ID NO: 1003131 - DNA, 20 bp, Homo sapiens
ccctcagggagcctccccat

SEQ ID NO: 1003132 - DNA, 22 bp, Homo sapiens
ccctcagggatcttgcattccc

SEQ ID NO: 1003133 - DNA, 15 bp, Homo sapiens
ccctcagggggccag

SEQ ID NO: 1003134 - DNA, 22 bp, Homo sapiens
ccctcagggggccagctgggga

SEQ ID NO: 1003135 - DNA, 14 bp, Homo sapiens
ccctcaggtgcctc

SEQ ID NO: 1003136 - DNA, 15 bp, Homo sapiens
ccctcaggtgcctcc

SEQ ID NO: 1003137 - DNA, 20 bp, Homo sapiens
ccctcaggtgtagctgagct

SEQ ID NO: 1003138 - DNA, 16 bp, Homo sapiens
ccctcaggttcctttt

SEQ ID NO: 1003139 - DNA, 16 bp, Homo sapiens
ccctcagtcaccccca

SEQ ID NO: 1003140 - DNA, 12 bp, Homo sapiens
atggcaaggaac

SEQ ID NO: 1003141 - DNA, 18 bp, Homo sapiens
atggcaatagggtagaat

SEQ ID NO: 1003142 - DNA, 22 bp, Homo sapiens
atggcaatcaaacattttctgg

SEQ ID NO: 1003143 - DNA, 13 bp, Homo sapiens
atggcaattctgg

SEQ ID NO: 1003144 - DNA, 17 bp, Homo sapiens
atggcacagaaggatct

SEQ ID NO: 1003145 - DNA, 19 bp, Homo sapiens
atggcaccagccccctgga

SEQ ID NO: 1003146 - DNA, 14 bp, Homo sapiens
atggcacctcaggc

SEQ ID NO: 1003147 - DNA, 17 bp, Homo sapiens
atggcacctcaggctga

SEQ ID NO: 1003148 - DNA, 18 bp, Homo sapiens
atggcacctcaggctgag

SEQ ID NO: 1003149 - DNA, 24 bp, Homo sapiens
atggcactaaaccacttctctgct

SEQ ID NO: 1003150 - DNA, 22 bp, Homo sapiens
atggcacttagctatcagaaga

SEQ ID NO: 1003151 - DNA, 21 bp, Homo sapiens
atggcacttctccaaccccgg

SEQ ID NO: 1003152 - DNA, 15 bp, Homo sapiens
atggcagaaggcaaa

SEQ ID NO: 1003153 - DNA, 12 bp, Homo sapiens
atggcagaaggg

SEQ ID NO: 1003154 - DNA, 13 bp, Homo sapiens
atggcagagccag

SEQ ID NO: 1003155 - DNA, 15 bp, Homo sapiens
atggcagagccaggc

SEQ ID NO: 1003156 - DNA, 16 bp, Homo sapiens
atggcagagccaggct

SEQ ID NO: 1003157 - DNA, 20 bp, Homo sapiens
atggcagagtttgtgtgttg

SEQ ID NO: 1003158 - DNA, 13 bp, Homo sapiens
atggcagcccggc

SEQ ID NO: 1003159 - DNA, 17 bp, Homo sapiens
atggcagcccggctgct

SEQ ID NO: 1003160 - DNA, 18 bp, Homo sapiens
atggcagcccggctgctg

SEQ ID NO: 1003161 - DNA, 19 bp, Homo sapiens
atggcagcccggctgctgc

SEQ ID NO: 1003162 - DNA, 22 bp, Homo sapiens
atggcagcccggctgctgcttg

SEQ ID NO: 1003163 - DNA, 22 bp, Homo sapiens
atggcagctgtttctcatgaag

SEQ ID NO: 1003164 - DNA, 14 bp, Homo sapiens
atggcaggactcct

SEQ ID NO: 1003165 - DNA, 13 bp, Homo sapiens
atggcaggcctga

SEQ ID NO: 1003166 - DNA, 18 bp, Homo sapiens
atggcagggcctcatctc

SEQ ID NO: 1003167 - DNA, 15 bp, Homo sapiens
atggcaggtgtcata

SEQ ID NO: 1003168 - DNA, 14 bp, Homo sapiens
atggcagtttgaag

SEQ ID NO: 1003169 - DNA, 16 bp, Homo sapiens
atggcatcttcaatat

SEQ ID NO: 1003170 - DNA, 23 bp, Homo sapiens
atggcatgatttatatatggcat

SEQ ID NO: 1003171 - DNA, 21 bp, Homo sapiens
atggcatttctctttaaacta

SEQ ID NO: 1003172 - DNA, 24 bp, Homo sapiens
atggcatttgctggttataacagc

SEQ ID NO: 1003173 - DNA, 20 bp, Homo sapiens
atggcatttggtctcaggca

SEQ ID NO: 1003174 - DNA, 21 bp, Homo sapiens
atggcatttggtctcaggcag

SEQ ID NO: 1003175 - DNA, 22 bp, Homo sapiens
atggcatttggtctcaggcagc

SEQ ID NO: 1003176 - DNA, 22 bp, Homo sapiens
atggccacagtagtcttgatga

SEQ ID NO: 1003177 - DNA, 15 bp, Homo sapiens
atggccagagcctct

SEQ ID NO: 1003178 - DNA, 16 bp, Homo sapiens
atggccagagcctctg

SEQ ID NO: 1003179 - DNA, 18 bp, Homo sapiens
atggccagagcctctggc

SEQ ID NO: 1003180 - DNA, 12 bp, Homo sapiens
atggccagcccc

SEQ ID NO: 1003181 - DNA, 16 bp, Homo sapiens
atggccagttttctgg

SEQ ID NO: 1003182 - DNA, 10 bp, Homo sapiens
atggccatgc

SEQ ID NO: 1003183 - DNA, 17 bp, Homo sapiens
atggccatgcaggaggt

SEQ ID NO: 1003184 - DNA, 11 bp, Homo sapiens
atggcccaagg

SEQ ID NO: 1003185 - DNA, 13 bp, Homo sapiens
atggcccagcctt

SEQ ID NO: 1003186 - DNA, 21 bp, Homo sapiens
atggcccaggcagcctcaagg

SEQ ID NO: 1003187 - DNA, 14 bp, Homo sapiens
atggccccagcaca

SEQ ID NO: 1003188 - DNA, 15 bp, Homo sapiens
atggcccccaataaa

SEQ ID NO: 1003189 - DNA, 20 bp, Homo sapiens
atggcccccaataaaggcag

SEQ ID NO: 1003190 - DNA, 21 bp, Homo sapiens
atggcccccaataaaggcagc

SEQ ID NO: 1003191 - DNA, 23 bp, Homo sapiens
atggcccccaataaaggcagctg

SEQ ID NO: 1003192 - DNA, 13 bp, Homo sapiens
atggcccctccac

SEQ ID NO: 1003193 - DNA, 15 bp, Homo sapiens
atggcccctccactg

SEQ ID NO: 1003194 - DNA, 23 bp, Homo sapiens
atggcccctctgacctgcactgg

SEQ ID NO: 1003195 - DNA, 19 bp, Homo sapiens
atggccctagaactgtgcc

SEQ ID NO: 1003196 - DNA, 16 bp, Homo sapiens
atggccctgtcccagg

SEQ ID NO: 1003197 - DNA, 18 bp, Homo sapiens
atggccgcttctagagcc

SEQ ID NO: 1003198 - DNA, 16 bp, Homo sapiens
atggccgggccctgct

SEQ ID NO: 1003199 - DNA, 20 bp, Homo sapiens
atggcctattatattaaaat

SEQ ID NO: 1003200 - DNA, 21 bp, Homo sapiens
atggcctcagctgcctcactt

SEQ ID NO: 1003201 - DNA, 20 bp, Homo sapiens
atggcctgccttgaagccac

SEQ ID NO: 1003202 - DNA, 13 bp, Homo sapiens
atggccttgaaac

SEQ ID NO: 1003203 - DNA, 14 bp, Homo sapiens
atggccttgaaaca

SEQ ID NO: 1003204 - DNA, 20 bp, Homo sapiens
atggccttgaaacagttcca

SEQ ID NO: 1003205 - DNA, 15 bp, Homo sapiens
atggcctttccttcc

SEQ ID NO: 1003206 - DNA, 23 bp, Homo sapiens
atggccttttgctacgtgcctcc

SEQ ID NO: 1003207 - DNA, 15 bp, Homo sapiens
atggcgaacatgtgt

SEQ ID NO: 1003208 - DNA, 16 bp, Homo sapiens
atggcgaccaccaaag

SEQ ID NO: 1003209 - DNA, 17 bp, Homo sapiens
atggcgaccaccaaagt

SEQ ID NO: 1003210 - DNA, 21 bp, Homo sapiens
atggcgatggggactctgccg

SEQ ID NO: 1003211 - DNA, 16 bp, Homo sapiens
atggcgccctgcctcc

SEQ ID NO: 1003212 - DNA, 19 bp, Homo sapiens
atggcgccctgcctcctgg

SEQ ID NO: 1003213 - DNA, 17 bp, Homo sapiens
atggcgcgggaggcacc

SEQ ID NO: 1003214 - DNA, 16 bp, Homo sapiens
atggcggcctgcagtg

SEQ ID NO: 1003215 - DNA, 19 bp, Homo sapiens
atggcgtaatgggcctgcc

SEQ ID NO: 1003216 - DNA, 21 bp, Homo sapiens
atggcgtaatgggcctgccca

SEQ ID NO: 1003217 - DNA, 15 bp, Homo sapiens
atggcgtctgctctg

SEQ ID NO: 1003218 - DNA, 19 bp, Homo sapiens
atggcgtctgctctggtgg

SEQ ID NO: 1003219 - DNA, 17 bp, Homo sapiens
atggcgtttttctcgtc

SEQ ID NO: 1003220 - DNA, 18 bp, Homo sapiens
atggctaactgatgaatt

SEQ ID NO: 1003221 - DNA, 17 bp, Homo sapiens
atggctaagaccacaga

SEQ ID NO: 1003222 - DNA, 16 bp, Homo sapiens
atggctaataaactgt

SEQ ID NO: 1003223 - DNA, 20 bp, Homo sapiens
atggggctggcatgttttct

SEQ ID NO: 1003224 - DNA, 18 bp, Homo sapiens
atgggggcaggaaagcca

SEQ ID NO: 1003225 - DNA, 14 bp, Homo sapiens
atgggggcctccgc

SEQ ID NO: 1003226 - DNA, 16 bp, Homo sapiens
atggggggccaacacc

SEQ ID NO: 1003227 - DNA, 20 bp, Homo sapiens
atggggggcgggccagggtg

SEQ ID NO: 1003228 - DNA, 17 bp, Homo sapiens
atgggggtagcagctgg

SEQ ID NO: 1003229 - DNA, 17 bp, Homo sapiens
atgggggtgaccccacg

SEQ ID NO: 1003230 - DNA, 21 bp, Homo sapiens
atgggggtgcaggcagccttg

SEQ ID NO: 1003231 - DNA, 22 bp, Homo sapiens
atgggggtgcaggcagccttga

SEQ ID NO: 1003232 - DNA, 14 bp, Homo sapiens
atgggggtgcattt

SEQ ID NO: 1003233 - DNA, 15 bp, Homo sapiens
atgggggtgcatttg

SEQ ID NO: 1003234 - DNA, 14 bp, Homo sapiens
atggggtagaaaca

SEQ ID NO: 1003235 - DNA, 18 bp, Homo sapiens
atggggtcagccccaagg

SEQ ID NO: 1003236 - DNA, 21 bp, Homo sapiens
atggggtcagccccaagggct

SEQ ID NO: 1003237 - DNA, 19 bp, Homo sapiens
atggggtcggctcctgatg

SEQ ID NO: 1003238 - DNA, 19 bp, Homo sapiens
atggggtcttgctatgttg

SEQ ID NO: 1003239 - DNA, 15 bp, Homo sapiens
atggggttcctgctg

SEQ ID NO: 1003240 - DNA, 16 bp, Homo sapiens
atggggttcctgctgt

SEQ ID NO: 1003241 - DNA, 17 bp, Homo sapiens
atggggttcctgctgtg

SEQ ID NO: 1003242 - DNA, 21 bp, Homo sapiens
atggggtttgggcccctcaga

SEQ ID NO: 1003243 - DNA, 17 bp, Homo sapiens
atgggtagagaaacact

SEQ ID NO: 1003244 - DNA, 14 bp, Homo sapiens
atgggtattaaact

SEQ ID NO: 1003245 - DNA, 14 bp, Homo sapiens
atgggtcagagcta

SEQ ID NO: 1003246 - DNA, 17 bp, Homo sapiens
atgggtccaagagacat

SEQ ID NO: 1003247 - DNA, 22 bp, Homo sapiens
atgggtccaggggtctgtctgc

SEQ ID NO: 1003248 - DNA, 13 bp, Homo sapiens
atgggtcctctgg

SEQ ID NO: 1003249 - DNA, 21 bp, Homo sapiens
atgggtccttgatgccagagg

SEQ ID NO: 1003250 - DNA, 17 bp, Homo sapiens
atgggtctggctgagct

SEQ ID NO: 1003251 - DNA, 13 bp, Homo sapiens
atgggtgctgccc

SEQ ID NO: 1003252 - DNA, 13 bp, Homo sapiens
atgggtggaaagg

SEQ ID NO: 1003253 - DNA, 23 bp, Homo sapiens
atgggtggctttcaaggctgggg

SEQ ID NO: 1003254 - DNA, 19 bp, Homo sapiens
atgggtgtgggagtgaggg

SEQ ID NO: 1003255 - DNA, 14 bp, Homo sapiens
atgggttgcatttg

SEQ ID NO: 1003256 - DNA, 22 bp, Homo sapiens
atgggtttttccctgtacagta

SEQ ID NO: 1003257 - DNA, 16 bp, Homo sapiens
atggtaaaaaatttat

SEQ ID NO: 1003258 - DNA, 23 bp, Homo sapiens
atggtaagtacttgagtaaatct

SEQ ID NO: 1003259 - DNA, 19 bp, Homo sapiens
atggtaatgacagatgcaa

SEQ ID NO: 1003260 - DNA, 21 bp, Homo sapiens
atggtaatgacagatgcaagt

SEQ ID NO: 1003261 - DNA, 14 bp, Homo sapiens
atggtactgctgag

SEQ ID NO: 1003262 - DNA, 23 bp, Homo sapiens
atggtagcattttaaacaaaata

SEQ ID NO: 1003263 - DNA, 17 bp, Homo sapiens
atggtaggcatttccta

SEQ ID NO: 1003264 - DNA, 13 bp, Homo sapiens
atggtaggggagg

SEQ ID NO: 1003265 - DNA, 18 bp, Homo sapiens
atggtagggtataatgtg

SEQ ID NO: 1003266 - DNA, 19 bp, Homo sapiens
atggtataatggttgactg

SEQ ID NO: 1003267 - DNA, 12 bp, Homo sapiens
atggtataattg

SEQ ID NO: 1003268 - DNA, 13 bp, Homo sapiens
atggtataattga

SEQ ID NO: 1003269 - DNA, 15 bp, Homo sapiens
atggtatcctactga

SEQ ID NO: 1003270 - DNA, 21 bp, Homo sapiens
atggtatgattctattatata

SEQ ID NO: 1003271 - DNA, 21 bp, Homo sapiens
ccctcctgagggaggacctgg

SEQ ID NO: 1003272 - DNA, 20 bp, Homo sapiens
ccctcctgcacacagaatgc

SEQ ID NO: 1003273 - DNA, 11 bp, Homo sapiens
ccctcctgccc

SEQ ID NO: 1003274 - DNA, 12 bp, Homo sapiens
ccctcctgccca

SEQ ID NO: 1003275 - DNA, 13 bp, Homo sapiens
ccctcctgcccac

SEQ ID NO: 1003276 - DNA, 21 bp, Homo sapiens
ccctcctgcccacgcagacct

SEQ ID NO: 1003277 - DNA, 15 bp, Homo sapiens
ccctcctgctcctcc

SEQ ID NO: 1003278 - DNA, 16 bp, Homo sapiens
ccctcctgctcctccc

SEQ ID NO: 1003279 - DNA, 21 bp, Homo sapiens
ccctcctgctcctccctgccc

SEQ ID NO: 1003280 - DNA, 13 bp, Homo sapiens
ccctcctgctttg

SEQ ID NO: 1003281 - DNA, 17 bp, Homo sapiens
ccctcctggagcagaaa

SEQ ID NO: 1003282 - DNA, 21 bp, Homo sapiens
ccctcctggagctctgtgggt

SEQ ID NO: 1003283 - DNA, 13 bp, Homo sapiens
ccctcctggcaat

SEQ ID NO: 1003284 - DNA, 12 bp, Homo sapiens
ccctcctggcct

SEQ ID NO: 1003285 - DNA, 16 bp, Homo sapiens
ccctcctggccttcct

SEQ ID NO: 1003286 - DNA, 17 bp, Homo sapiens
ccctcctggtcctggac

SEQ ID NO: 1003287 - DNA, 21 bp, Homo sapiens
ccctcctggtcctggacacct

SEQ ID NO: 1003288 - DNA, 16 bp, Homo sapiens
ccctcctgtgccccag

SEQ ID NO: 1003289 - DNA, 12 bp, Homo sapiens
ccctccttcaga

SEQ ID NO: 1003290 - DNA, 11 bp, Homo sapiens
ccctccttcca

SEQ ID NO: 1003291 - DNA, 15 bp, Homo sapiens
ccctccttccacatg

SEQ ID NO: 1003292 - DNA, 17 bp, Homo sapiens
ccctccttgcctcctgt

SEQ ID NO: 1003293 - DNA, 18 bp, Homo sapiens
ccctccttgcctcctgtg

SEQ ID NO: 1003294 - DNA, 13 bp, Homo sapiens
ccctcctttgtct

SEQ ID NO: 1003295 - DNA, 16 bp, Homo sapiens
ccctcgaaccaaggca

SEQ ID NO: 1003296 - DNA, 21 bp, Homo sapiens
ccctcgaaccaaggcagcctc

SEQ ID NO: 1003297 - DNA, 24 bp, Homo sapiens
ccctcgaaccaaggcagcctccag

SEQ ID NO: 1003298 - DNA, 15 bp, Homo sapiens
ccctcgactcagcac

SEQ ID NO: 1003299 - DNA, 21 bp, Homo sapiens
ccctcgacttgaccctttcct

SEQ ID NO: 1003300 - DNA, 23 bp, Homo sapiens
ccctcgaggcctacagaggaggc

SEQ ID NO: 1003301 - DNA, 16 bp, Homo sapiens
ccctcgatatttttaa

SEQ ID NO: 1003302 - DNA, 17 bp, Homo sapiens
ccctcgcaaccctgcct

SEQ ID NO: 1003303 - DNA, 18 bp, Homo sapiens
ccctcgcaaccctgcctg

SEQ ID NO: 1003304 - DNA, 17 bp, Homo sapiens
ccctcgcacacagggct

SEQ ID NO: 1003305 - DNA, 20 bp, Homo sapiens
ccctcgcacacagggctcac

SEQ ID NO: 1003306 - DNA, 21 bp, Homo sapiens
ccctcgcagacctaagccctg

SEQ ID NO: 1003307 - DNA, 14 bp, Homo sapiens
ccctcgccagcttg

SEQ ID NO: 1003308 - DNA, 12 bp, Homo sapiens
ccctcgcctgtg

SEQ ID NO: 1003309 - DNA, 16 bp, Homo sapiens
ccctcgcgcccaaaag

SEQ ID NO: 1003310 - DNA, 14 bp, Homo sapiens
ccctcgctgccagc

SEQ ID NO: 1003311 - DNA, 23 bp, Homo sapiens
ccctcggaagccgtctgactcca

SEQ ID NO: 1003312 - DNA, 16 bp, Homo sapiens
ccctcggagcctgtgt

SEQ ID NO: 1003313 - DNA, 14 bp, Homo sapiens
ccctcggagctggc

SEQ ID NO: 1003314 - DNA, 17 bp, Homo sapiens
ccctcggagctggctgt

SEQ ID NO: 1003315 - DNA, 13 bp, Homo sapiens
ccctcggctctgg

SEQ ID NO: 1003316 - DNA, 19 bp, Homo sapiens
ccctcgggccccatcctca

SEQ ID NO: 1003317 - DNA, 14 bp, Homo sapiens
ccctcgggggctct

SEQ ID NO: 1003318 - DNA, 15 bp, Homo sapiens
ccctcgggggctctt

SEQ ID NO: 1003319 - DNA, 21 bp, Homo sapiens
ccctcgggggctcttccccta

SEQ ID NO: 1003320 - DNA, 19 bp, Homo sapiens
ccctcggggtgtcagaaat

SEQ ID NO: 1003321 - DNA, 16 bp, Homo sapiens
ccctcggtggctgcac

SEQ ID NO: 1003322 - DNA, 24 bp, Homo sapiens
ccctcgtccacaggggcaggcctg

SEQ ID NO: 1003323 - DNA, 14 bp, Homo sapiens
ccctcgtcctgtcc

SEQ ID NO: 1003324 - DNA, 16 bp, Homo sapiens
ccctcgtcctgtccca

SEQ ID NO: 1003325 - DNA, 17 bp, Homo sapiens
ccctcgtcctgtcccag

SEQ ID NO: 1003326 - DNA, 21 bp, Homo sapiens
ccctcgtcctgtcccagaggt

SEQ ID NO: 1003327 - DNA, 17 bp, Homo sapiens
ccctcgtggccagcccg

SEQ ID NO: 1003328 - DNA, 19 bp, Homo sapiens
ccctcgtggccagcccggc

SEQ ID NO: 1003329 - DNA, 21 bp, Homo sapiens
ccctcgtgggcttgtgctcgg

SEQ ID NO: 1003330 - DNA, 17 bp, Homo sapiens
ccctcgtgtcagctcag

SEQ ID NO: 1003331 - DNA, 14 bp, Homo sapiens
ccctcgttagcctt

SEQ ID NO: 1003332 - DNA, 15 bp, Homo sapiens
ccctctactcttcct

SEQ ID NO: 1003333 - DNA, 16 bp, Homo sapiens
ccctctactcttcctg

SEQ ID NO: 1003334 - DNA, 17 bp, Homo sapiens
ccctctactcttcctgt

SEQ ID NO: 1003335 - DNA, 18 bp, Homo sapiens
ccctctactcttcctgtc

SEQ ID NO: 1003336 - DNA, 17 bp, Homo sapiens
ccctctagtgccttctt

SEQ ID NO: 1003337 - DNA, 15 bp, Homo sapiens
ccctctatgctggct

SEQ ID NO: 1003338 - DNA, 16 bp, Homo sapiens
ccctctatgctggctt

SEQ ID NO: 1003339 - DNA, 20 bp, Homo sapiens
ccctctcacgccacccccgc

SEQ ID NO: 1003340 - DNA, 12 bp, Homo sapiens
ccctctcactcc

SEQ ID NO: 1003341 - DNA, 16 bp, Homo sapiens
ccctctcactccagcc

SEQ ID NO: 1003342 - DNA, 19 bp, Homo sapiens
ccctctcagaggcctgctg

SEQ ID NO: 1003343 - DNA, 23 bp, Homo sapiens
ccctctcagaggcctgctgccag

SEQ ID NO: 1003344 - DNA, 14 bp, Homo sapiens
ccctctcagctcca

SEQ ID NO: 1003345 - DNA, 16 bp, Homo sapiens
ccctgacctcccagcc

SEQ ID NO: 1003346 - DNA, 18 bp, Homo sapiens
ccctgacctcccagccct

SEQ ID NO: 1003347 - DNA, 19 bp, Homo sapiens
ccctgacctcccagcccta

SEQ ID NO: 1003348 - DNA, 20 bp, Homo sapiens
ccctgacctcccagccctat

SEQ ID NO: 1003349 - DNA, 21 bp, Homo sapiens
ccctgacctcccagccctatg

SEQ ID NO: 1003350 - DNA, 22 bp, Homo sapiens
ccctgacctcccagccctatgg

SEQ ID NO: 1003351 - DNA, 15 bp, Homo sapiens
ccctgacctccgccc

SEQ ID NO: 1003352 - DNA, 22 bp, Homo sapiens
ccctgacctccgcccctgcccc

SEQ ID NO: 1003353 - DNA, 14 bp, Homo sapiens
ccctgacctgtcca

SEQ ID NO: 1003354 - DNA, 16 bp, Homo sapiens
ccctgacctgtgagcc

SEQ ID NO: 1003355 - DNA, 21 bp, Homo sapiens
ccctgaccttagcgttctgga

SEQ ID NO: 1003356 - DNA, 15 bp, Homo sapiens
ccctgaccttggctg

SEQ ID NO: 1003357 - DNA, 19 bp, Homo sapiens
ccctgactcattctgaagg

SEQ ID NO: 1003358 - DNA, 18 bp, Homo sapiens
ccctgactccctgtgggg

SEQ ID NO: 1003359 - DNA, 18 bp, Homo sapiens
ccctgactcctctggctt

SEQ ID NO: 1003360 - DNA, 13 bp, Homo sapiens
ccctgactcctgg

SEQ ID NO: 1003361 - DNA, 14 bp, Homo sapiens
ccctgactcctgga

SEQ ID NO: 1003362 - DNA, 17 bp, Homo sapiens
ccctgactctctgtgac

SEQ ID NO: 1003363 - DNA, 16 bp, Homo sapiens
ccctgactgtcaggga

SEQ ID NO: 1003364 - DNA, 20 bp, Homo sapiens
ccctgacttctcccccgccc

SEQ ID NO: 1003365 - DNA, 16 bp, Homo sapiens
ccctgacttctggaga

SEQ ID NO: 1003366 - DNA, 19 bp, Homo sapiens
ccctgagactccagaatct

SEQ ID NO: 1003367 - DNA, 21 bp, Homo sapiens
ccctgagagagaatagagctg

SEQ ID NO: 1003368 - DNA, 17 bp, Homo sapiens
ccctgagatcccctgag

SEQ ID NO: 1003369 - DNA, 20 bp, Homo sapiens
ccctgagatcccctgagccc

SEQ ID NO: 1003370 - DNA, 16 bp, Homo sapiens
ccctgagcaatgtctg

SEQ ID NO: 1003371 - DNA, 18 bp, Homo sapiens
ccctgagcaatgtctgtg

SEQ ID NO: 1003372 - DNA, 20 bp, Homo sapiens
ccctgagcaatgtctgtgct

SEQ ID NO: 1003373 - DNA, 21 bp, Homo sapiens
ccctgagcaatgtctgtgcta

SEQ ID NO: 1003374 - DNA, 21 bp, Homo sapiens
ccctgagcagaatactggtct

SEQ ID NO: 1003375 - DNA, 16 bp, Homo sapiens
ccctgagcaggaaagt

SEQ ID NO: 1003376 - DNA, 23 bp, Homo sapiens
ccctgagcccagagaagctggaa

SEQ ID NO: 1003377 - DNA, 12 bp, Homo sapiens
ccctgagcccct

SEQ ID NO: 1003378 - DNA, 17 bp, Homo sapiens
ccctgagcccggccctc

SEQ ID NO: 1003379 - DNA, 18 bp, Homo sapiens
ccctgagcctgcattctg

SEQ ID NO: 1003380 - DNA, 19 bp, Homo sapiens
ccctgagctgaggcagcag

SEQ ID NO: 1003381 - DNA, 21 bp, Homo sapiens
ccctgagctgaggcagcagtg

SEQ ID NO: 1003382 - DNA, 16 bp, Homo sapiens
ccctgaggacctctca

SEQ ID NO: 1003383 - DNA, 17 bp, Homo sapiens
ccctgaggacctctcag

SEQ ID NO: 1003384 - DNA, 21 bp, Homo sapiens
ccctgaggatgggtcagagct

SEQ ID NO: 1003385 - DNA, 13 bp, Homo sapiens
ccctgaggccctg

SEQ ID NO: 1003386 - DNA, 21 bp, Homo sapiens
ccctgaggccctgggctgggt

SEQ ID NO: 1003387 - DNA, 12 bp, Homo sapiens
ccctgaggccta

SEQ ID NO: 1003388 - DNA, 12 bp, Homo sapiens
ccctgaggctca

SEQ ID NO: 1003389 - DNA, 18 bp, Homo sapiens
ccctgaggctcagggaaa

SEQ ID NO: 1003390 - DNA, 15 bp, Homo sapiens
ccctgaggggctggg

SEQ ID NO: 1003391 - DNA, 23 bp, Homo sapiens
ccctgaggggctggggagggggt

SEQ ID NO: 1003392 - DNA, 18 bp, Homo sapiens
ccctgaggtcagggagtg

SEQ ID NO: 1003393 - DNA, 20 bp, Homo sapiens
ccctgaggtgaaagggagct

SEQ ID NO: 1003394 - DNA, 15 bp, Homo sapiens
ccctgaggtgtgggg

SEQ ID NO: 1003395 - DNA, 19 bp, Homo sapiens
ccctgaggtgtgggggctg

SEQ ID NO: 1003396 - DNA, 20 bp, Homo sapiens
ccctgaggtgtgggggctgc

SEQ ID NO: 1003397 - DNA, 22 bp, Homo sapiens
ccctgaggtgtgggggctgcag

SEQ ID NO: 1003398 - DNA, 17 bp, Homo sapiens
ccctgagtcaccaggaa

SEQ ID NO: 1003399 - DNA, 20 bp, Homo sapiens
ccctgagtccgcctgcgcct

SEQ ID NO: 1003400 - DNA, 13 bp, Homo sapiens
ccctgagtctgga

SEQ ID NO: 1003401 - DNA, 18 bp, Homo sapiens
atgtaaataggtttctaa

SEQ ID NO: 1003402 - DNA, 19 bp, Homo sapiens
atgtaaatattttaaagaa

SEQ ID NO: 1003403 - DNA, 21 bp, Homo sapiens
atgtaaatattttaaagaatt

SEQ ID NO: 1003404 - DNA, 14 bp, Homo sapiens
atgtaaatccccac

SEQ ID NO: 1003405 - DNA, 14 bp, Homo sapiens
atgtaaatgctcat

SEQ ID NO: 1003406 - DNA, 13 bp, Homo sapiens
atgtaaatgtgca

SEQ ID NO: 1003407 - DNA, 12 bp, Homo sapiens
atgtaaatgtgt

SEQ ID NO: 1003408 - DNA, 13 bp, Homo sapiens
atgtaaatgttat

SEQ ID NO: 1003409 - DNA, 14 bp, Homo sapiens
atgtaaatgttatt

SEQ ID NO: 1003410 - DNA, 16 bp, Homo sapiens
atgtaaattattgtaa

SEQ ID NO: 1003411 - DNA, 18 bp, Homo sapiens
atgtaaattgactgtact

SEQ ID NO: 1003412 - DNA, 15 bp, Homo sapiens
atgtaaatttgttga

SEQ ID NO: 1003413 - DNA, 20 bp, Homo sapiens
atgtaaattttgtatgaaaa

SEQ ID NO: 1003414 - DNA, 19 bp, Homo sapiens
atgtaacatcataattaca

SEQ ID NO: 1003415 - DNA, 15 bp, Homo sapiens
atgtaacatccagaa

SEQ ID NO: 1003416 - DNA, 16 bp, Homo sapiens
atgtaacatccagaag

SEQ ID NO: 1003417 - DNA, 12 bp, Homo sapiens
atgtaacatgaa

SEQ ID NO: 1003418 - DNA, 17 bp, Homo sapiens
atgtaacatgatgttaa

SEQ ID NO: 1003419 - DNA, 19 bp, Homo sapiens
atgtaacatgatgttaact

SEQ ID NO: 1003420 - DNA, 12 bp, Homo sapiens
atgtaacattgg

SEQ ID NO: 1003421 - DNA, 19 bp, Homo sapiens
atgtaactaggtttttgct

SEQ ID NO: 1003422 - DNA, 24 bp, Homo sapiens
atgtaactccagatagagaaatag

SEQ ID NO: 1003423 - DNA, 13 bp, Homo sapiens
atgtaactctcca

SEQ ID NO: 1003424 - DNA, 23 bp, Homo sapiens
atgtaactgcattgagaactgca

SEQ ID NO: 1003425 - DNA, 12 bp, Homo sapiens
atgtaacttgaa

SEQ ID NO: 1003426 - DNA, 17 bp, Homo sapiens
atgtaacttttgtaaga

SEQ ID NO: 1003427 - DNA, 15 bp, Homo sapiens
atgtaagaaaatgtt

SEQ ID NO: 1003428 - DNA, 17 bp, Homo sapiens
atgtaagaaaatgttac

SEQ ID NO: 1003429 - DNA, 21 bp, Homo sapiens
atgtaagcaaaggctctgaaa

SEQ ID NO: 1003430 - DNA, 22 bp, Homo sapiens
atgtaagcatactttgtaaata

SEQ ID NO: 1003431 - DNA, 19 bp, Homo sapiens
atgtaagtgtggttttgta

SEQ ID NO: 1003432 - DNA, 18 bp, Homo sapiens
atgtaagtttacctatgt

SEQ ID NO: 1003433 - DNA, 15 bp, Homo sapiens
atgtaataaattcaa

SEQ ID NO: 1003434 - DNA, 14 bp, Homo sapiens
atgtaataagcact

SEQ ID NO: 1003435 - DNA, 20 bp, Homo sapiens
atgtaataagcacttgcctg

SEQ ID NO: 1003436 - DNA, 15 bp, Homo sapiens
atgtaatactggaat

SEQ ID NO: 1003437 - DNA, 18 bp, Homo sapiens
atgtaatacttaaataaa

SEQ ID NO: 1003438 - DNA, 22 bp, Homo sapiens
atgtaatacttaaataaacatg

SEQ ID NO: 1003439 - DNA, 22 bp, Homo sapiens
atgtaatagttctatccttttg

SEQ ID NO: 1003440 - DNA, 20 bp, Homo sapiens
atgtaatataaatttaagca

SEQ ID NO: 1003441 - DNA, 16 bp, Homo sapiens
atgtaatcaatgtttc

SEQ ID NO: 1003442 - DNA, 23 bp, Homo sapiens
atgtaatctctctgcagctgccg

SEQ ID NO: 1003443 - DNA, 22 bp, Homo sapiens
atgtaatgatgctgaggatata

SEQ ID NO: 1003444 - DNA, 13 bp, Homo sapiens
atgtaatgtcaga

SEQ ID NO: 1003445 - DNA, 14 bp, Homo sapiens
atgtaatgtccctt

SEQ ID NO: 1003446 - DNA, 20 bp, Homo sapiens
atgtaatgtgtggtggcctc

SEQ ID NO: 1003447 - DNA, 21 bp, Homo sapiens
atgtaatgtgtggtggcctca

SEQ ID NO: 1003448 - DNA, 22 bp, Homo sapiens
atgtaatgtgtggtggcctcag

SEQ ID NO: 1003449 - DNA, 23 bp, Homo sapiens
atgtaatgttttctttgcaaagt

SEQ ID NO: 1003450 - DNA, 19 bp, Homo sapiens
atgtaattaactgtaaact

SEQ ID NO: 1003451 - DNA, 12 bp, Homo sapiens
atgtaattggaa

SEQ ID NO: 1003452 - DNA, 17 bp, Homo sapiens
atgtaattgtaattttg

SEQ ID NO: 1003453 - DNA, 11 bp, Homo sapiens
atgtaattgtt

SEQ ID NO: 1003454 - DNA, 21 bp, Homo sapiens
atgtaatttagaaactgattt

SEQ ID NO: 1003455 - DNA, 15 bp, Homo sapiens
atgtaatttatgcaa

SEQ ID NO: 1003456 - DNA, 20 bp, Homo sapiens
atgtaatttcaaaatacatt

SEQ ID NO: 1003457 - DNA, 14 bp, Homo sapiens
atgtaatttgcatt

SEQ ID NO: 1003458 - DNA, 18 bp, Homo sapiens
atgtaatttgcattactc

SEQ ID NO: 1003459 - DNA, 21 bp, Homo sapiens
atgtaatttgcattactctgg

SEQ ID NO: 1003460 - DNA, 22 bp, Homo sapiens
atgtaatttgcattactctggt

SEQ ID NO: 1003461 - DNA, 19 bp, Homo sapiens
atgtaatttgtacaggggc

SEQ ID NO: 1003462 - DNA, 22 bp, Homo sapiens
atgtaatttgtacaggggccat

SEQ ID NO: 1003463 - DNA, 15 bp, Homo sapiens
atgtaattttgtgta

SEQ ID NO: 1003464 - DNA, 16 bp, Homo sapiens
atgtaattttgtgtaa

SEQ ID NO: 1003465 - DNA, 22 bp, Homo sapiens
atgtaattttgtgtaagaaata

SEQ ID NO: 1003466 - DNA, 15 bp, Homo sapiens
ccctgccactcaccc

SEQ ID NO: 1003467 - DNA, 19 bp, Homo sapiens
ccctgccactcactaggcc

SEQ ID NO: 1003468 - DNA, 18 bp, Homo sapiens
ccctgccactgggctctg

SEQ ID NO: 1003469 - DNA, 14 bp, Homo sapiens
ccctgccagggcag

SEQ ID NO: 1003470 - DNA, 15 bp, Homo sapiens
ccctgccagtgcctt

SEQ ID NO: 1003471 - DNA, 19 bp, Homo sapiens
ccctgccatccccctctca

SEQ ID NO: 1003472 - DNA, 16 bp, Homo sapiens
ccctgccatcttccca

SEQ ID NO: 1003473 - DNA, 18 bp, Homo sapiens
ccctgccattggcctctt

SEQ ID NO: 1003474 - DNA, 16 bp, Homo sapiens
ccctgcccaaaccctt

SEQ ID NO: 1003475 - DNA, 20 bp, Homo sapiens
ccctgcccaaacccttaact

SEQ ID NO: 1003476 - DNA, 20 bp, Homo sapiens
ccctgcccaagggcctccca

SEQ ID NO: 1003477 - DNA, 12 bp, Homo sapiens
ccctgcccaagt

SEQ ID NO: 1003478 - DNA, 14 bp, Homo sapiens
ccctgcccaagtga

SEQ ID NO: 1003479 - DNA, 16 bp, Homo sapiens
ccctgcccaagtgacc

SEQ ID NO: 1003480 - DNA, 15 bp, Homo sapiens
ccctgcccacccccg

SEQ ID NO: 1003481 - DNA, 17 bp, Homo sapiens
ccctgcccacccccggg

SEQ ID NO: 1003482 - DNA, 23 bp, Homo sapiens
ccctgcccacccccgggatcctg

SEQ ID NO: 1003483 - DNA, 13 bp, Homo sapiens
ccctgcccagcct

SEQ ID NO: 1003484 - DNA, 15 bp, Homo sapiens
ccctgcccagcctgt

SEQ ID NO: 1003485 - DNA, 10 bp, Homo sapiens
ccctgcccat

SEQ ID NO: 1003486 - DNA, 20 bp, Homo sapiens
ccctgcccatactgagcctg

SEQ ID NO: 1003487 - DNA, 23 bp, Homo sapiens
ccctgcccatactgagcctgcca

SEQ ID NO: 1003488 - DNA, 21 bp, Homo sapiens
ccctgcccatccgtctgtctg

SEQ ID NO: 1003489 - DNA, 18 bp, Homo sapiens
ccctgccccacacctcct

SEQ ID NO: 1003490 - DNA, 15 bp, Homo sapiens
ccctgccccagcccc

SEQ ID NO: 1003491 - DNA, 14 bp, Homo sapiens
ccctgccccaggcc

SEQ ID NO: 1003492 - DNA, 20 bp, Homo sapiens
ccctgcccccatctccccag

SEQ ID NO: 1003493 - DNA, 23 bp, Homo sapiens
ccctgcccccatctccccaggcc

SEQ ID NO: 1003494 - DNA, 12 bp, Homo sapiens
ccctgcccccca

SEQ ID NO: 1003495 - DNA, 14 bp, Homo sapiens
ccctgccccccaag

SEQ ID NO: 1003496 - DNA, 22 bp, Homo sapiens
ccctgccccccaaggttctggt

SEQ ID NO: 1003497 - DNA, 16 bp, Homo sapiens
ccctgccccccagcct

SEQ ID NO: 1003498 - DNA, 19 bp, Homo sapiens
ccctgccccccagcctctg

SEQ ID NO: 1003499 - DNA, 16 bp, Homo sapiens
ccctgccccctgccag

SEQ ID NO: 1003500 - DNA, 10 bp, Homo sapiens
ccctgcccct

SEQ ID NO: 1003501 - DNA, 21 bp, Homo sapiens
ccctgcccctaggatgctgca

SEQ ID NO: 1003502 - DNA, 19 bp, Homo sapiens
ccctgcccctcccttcaac

SEQ ID NO: 1003503 - DNA, 20 bp, Homo sapiens
ccctgccccttaaccccaag

SEQ ID NO: 1003504 - DNA, 14 bp, Homo sapiens
ccctgccctcatgg

SEQ ID NO: 1003505 - DNA, 15 bp, Homo sapiens
ccctgccctcccctc

SEQ ID NO: 1003506 - DNA, 18 bp, Homo sapiens
ccctgccctcgtggccag

SEQ ID NO: 1003507 - DNA, 19 bp, Homo sapiens
ccctgccctcgtggccagc

SEQ ID NO: 1003508 - DNA, 20 bp, Homo sapiens
ccctgccctcgtggccagcc

SEQ ID NO: 1003509 - DNA, 21 bp, Homo sapiens
ccctgccctcgtggccagccc

SEQ ID NO: 1003510 - DNA, 13 bp, Homo sapiens
ccctgccctgggg

SEQ ID NO: 1003511 - DNA, 15 bp, Homo sapiens
ccctgccctggtcca

SEQ ID NO: 1003512 - DNA, 12 bp, Homo sapiens
ccctgccctgtg

SEQ ID NO: 1003513 - DNA, 10 bp, Homo sapiens
ccctgccctt

SEQ ID NO: 1003514 - DNA, 23 bp, Homo sapiens
ccctgcccttcctcctgatggag

SEQ ID NO: 1003515 - DNA, 18 bp, Homo sapiens
ccctgcccttggcaccac

SEQ ID NO: 1003516 - DNA, 19 bp, Homo sapiens
ccctgcccttggcaccacc

SEQ ID NO: 1003517 - DNA, 17 bp, Homo sapiens
ccctgccgtcaccacca

SEQ ID NO: 1003518 - DNA, 15 bp, Homo sapiens
ccctgcctacacaca

SEQ ID NO: 1003519 - DNA, 19 bp, Homo sapiens
ccctgcctcccatgcctgg

SEQ ID NO: 1003520 - DNA, 20 bp, Homo sapiens
ccctgcctcccatgcctggt

SEQ ID NO: 1003521 - DNA, 18 bp, Homo sapiens
ccctgcctcccattctgc

SEQ ID NO: 1003522 - DNA, 10 bp, Homo sapiens
ccctgcctga

SEQ ID NO: 1003523 - DNA, 18 bp, Homo sapiens
ccctgcctgacagccttc

SEQ ID NO: 1003524 - DNA, 23 bp, Homo sapiens
ccctgcctgagaagccccgacac

SEQ ID NO: 1003525 - DNA, 14 bp, Homo sapiens
ccctgcctgaggag

SEQ ID NO: 1003526 - DNA, 18 bp, Homo sapiens
ccctgcctgaggaggagg

SEQ ID NO: 1003527 - DNA, 22 bp, Homo sapiens
ccctgcctgaggaggaggacac

SEQ ID NO: 1003528 - DNA, 14 bp, Homo sapiens
atgtaggaagtagg

SEQ ID NO: 1003529 - DNA, 23 bp, Homo sapiens
atgtaggagctgccttggctcag

SEQ ID NO: 1003530 - DNA, 18 bp, Homo sapiens
atgtagggtaaggtgcct

SEQ ID NO: 1003531 - DNA, 16 bp, Homo sapiens
atgtaggtgagcctgg

SEQ ID NO: 1003532 - DNA, 17 bp, Homo sapiens
atgtaggtgagcctggg

SEQ ID NO: 1003533 - DNA, 20 bp, Homo sapiens
atgtaggtgagcctgggcag

SEQ ID NO: 1003534 - DNA, 17 bp, Homo sapiens
atgtagtaacactaata

SEQ ID NO: 1003535 - DNA, 20 bp, Homo sapiens
atgtagtaacactaatatat

SEQ ID NO: 1003536 - DNA, 13 bp, Homo sapiens
atgtagtaattga

SEQ ID NO: 1003537 - DNA, 16 bp, Homo sapiens
atgtagtaattgacat

SEQ ID NO: 1003538 - DNA, 16 bp, Homo sapiens
atgtagtatggtatat

SEQ ID NO: 1003539 - DNA, 18 bp, Homo sapiens
atgtagtatggtatatgc

SEQ ID NO: 1003540 - DNA, 19 bp, Homo sapiens
atgtagtattaaaagttgc

SEQ ID NO: 1003541 - DNA, 21 bp, Homo sapiens
atgtagtattttttgtataat

SEQ ID NO: 1003542 - DNA, 18 bp, Homo sapiens
atgtagtcagttgcattc

SEQ ID NO: 1003543 - DNA, 15 bp, Homo sapiens
atgtagtgattaaat

SEQ ID NO: 1003544 - DNA, 21 bp, Homo sapiens
atgtagtgcatttttaaactt

SEQ ID NO: 1003545 - DNA, 14 bp, Homo sapiens
atgtagtgcctctt

SEQ ID NO: 1003546 - DNA, 16 bp, Homo sapiens
atgtagtgcctctttc

SEQ ID NO: 1003547 - DNA, 15 bp, Homo sapiens
atgtagttttgtata

SEQ ID NO: 1003548 - DNA, 17 bp, Homo sapiens
atgtataaagaacaagg

SEQ ID NO: 1003549 - DNA, 12 bp, Homo sapiens
atgtataaagat

SEQ ID NO: 1003550 - DNA, 13 bp, Homo sapiens
atgtataaattaa

SEQ ID NO: 1003551 - DNA, 19 bp, Homo sapiens
atgtataaattattcagaa

SEQ ID NO: 1003552 - DNA, 17 bp, Homo sapiens
atgtataaccaagtgtg

SEQ ID NO: 1003553 - DNA, 21 bp, Homo sapiens
atgtataattcaaagcaccaa

SEQ ID NO: 1003554 - DNA, 14 bp, Homo sapiens
atgtatacacacat

SEQ ID NO: 1003555 - DNA, 16 bp, Homo sapiens
atgtatacacacatat

SEQ ID NO: 1003556 - DNA, 19 bp, Homo sapiens
atgtatacacacatataca

SEQ ID NO: 1003557 - DNA, 19 bp, Homo sapiens
atgtatactatagtaccag

SEQ ID NO: 1003558 - DNA, 12 bp, Homo sapiens
atgtatagtaaa

SEQ ID NO: 1003559 - DNA, 16 bp, Homo sapiens
atgtatagttttccct

SEQ ID NO: 1003560 - DNA, 21 bp, Homo sapiens
atgtatataatcatgctcatg

SEQ ID NO: 1003561 - DNA, 19 bp, Homo sapiens
atgtatatatatatagtaa

SEQ ID NO: 1003562 - DNA, 16 bp, Homo sapiens
atgtatatatctatta

SEQ ID NO: 1003563 - DNA, 19 bp, Homo sapiens
atgtatatcattctacaga

SEQ ID NO: 1003564 - DNA, 13 bp, Homo sapiens
atgtatatgtata

SEQ ID NO: 1003565 - DNA, 16 bp, Homo sapiens
atgtatatgtttatat

SEQ ID NO: 1003566 - DNA, 15 bp, Homo sapiens
atgtatattcctttg

SEQ ID NO: 1003567 - DNA, 15 bp, Homo sapiens
atgtatatttgctgc

SEQ ID NO: 1003568 - DNA, 22 bp, Homo sapiens
atgtatatttttaaagaatgtt

SEQ ID NO: 1003569 - DNA, 21 bp, Homo sapiens
atgtatatttttttaatttaa

SEQ ID NO: 1003570 - DNA, 15 bp, Homo sapiens
atgtatcaatgagta

SEQ ID NO: 1003571 - DNA, 15 bp, Homo sapiens
atgtatcagctctct

SEQ ID NO: 1003572 - DNA, 13 bp, Homo sapiens
atgtatcaggaaa

SEQ ID NO: 1003573 - DNA, 21 bp, Homo sapiens
atgtatcataattaccaagtg

SEQ ID NO: 1003574 - DNA, 17 bp, Homo sapiens
atgtatcatttttgtgc

SEQ ID NO: 1003575 - DNA, 20 bp, Homo sapiens
atgtatccaaggaaacattt

SEQ ID NO: 1003576 - DNA, 22 bp, Homo sapiens
atgtatccaaggaaacatttta

SEQ ID NO: 1003577 - DNA, 22 bp, Homo sapiens
atgtatcgcatattagttaatc

SEQ ID NO: 1003578 - DNA, 16 bp, Homo sapiens
atgtatctatttgtac

SEQ ID NO: 1003579 - DNA, 19 bp, Homo sapiens
atgtatctatttgtacaat

SEQ ID NO: 1003580 - DNA, 17 bp, Homo sapiens
atgtatctgagttgcca

SEQ ID NO: 1003581 - DNA, 22 bp, Homo sapiens
atgtatgaaggaatcattccag

SEQ ID NO: 1003582 - DNA, 17 bp, Homo sapiens
atgtatgcacacacata

SEQ ID NO: 1003583 - DNA, 14 bp, Homo sapiens
atgtatgcattcac

SEQ ID NO: 1003584 - DNA, 13 bp, Homo sapiens
atgtatgcctgca

SEQ ID NO: 1003585 - DNA, 15 bp, Homo sapiens
atgtatgctttgaat

SEQ ID NO: 1003586 - DNA, 15 bp, Homo sapiens
atgtatgctttttac

SEQ ID NO: 1003587 - DNA, 18 bp, Homo sapiens
atgtatggaatacagtgt

SEQ ID NO: 1003588 - DNA, 19 bp, Homo sapiens
atgtcccttgatgcacaga

SEQ ID NO: 1003589 - DNA, 23 bp, Homo sapiens
atgtcccttgatgcacagagaag

SEQ ID NO: 1003590 - DNA, 19 bp, Homo sapiens
atgtcctaaggacacacta

SEQ ID NO: 1003591 - DNA, 20 bp, Homo sapiens
atgtcctactatcactgaac

SEQ ID NO: 1003592 - DNA, 22 bp, Homo sapiens
atgtcctccagaagcctctggc

SEQ ID NO: 1003593 - DNA, 20 bp, Homo sapiens
atgtcctgactttgccccct

SEQ ID NO: 1003594 - DNA, 17 bp, Homo sapiens
atgtccttcagctgact

SEQ ID NO: 1003595 - DNA, 19 bp, Homo sapiens
atgtcgaaacctacaagat

SEQ ID NO: 1003596 - DNA, 12 bp, Homo sapiens
atgtcgcacaat

SEQ ID NO: 1003597 - DNA, 13 bp, Homo sapiens
atgtcgcacaatg

SEQ ID NO: 1003598 - DNA, 15 bp, Homo sapiens
atgtcgcctctgcat

SEQ ID NO: 1003599 - DNA, 17 bp, Homo sapiens
atgtcgtagaattcctt

SEQ ID NO: 1003600 - DNA, 16 bp, Homo sapiens
atgtcgtaggtaaact

SEQ ID NO: 1003601 - DNA, 17 bp, Homo sapiens
atgtctaattttctttc

SEQ ID NO: 1003602 - DNA, 21 bp, Homo sapiens
atgtctacagaaaatgctggc

SEQ ID NO: 1003603 - DNA, 16 bp, Homo sapiens
atgtctacctggcaga

SEQ ID NO: 1003604 - DNA, 20 bp, Homo sapiens
atgtctactcagcatttgat

SEQ ID NO: 1003605 - DNA, 16 bp, Homo sapiens
atgtctagtttctagt

SEQ ID NO: 1003606 - DNA, 22 bp, Homo sapiens
atgtctagtttctagtgtcact

SEQ ID NO: 1003607 - DNA, 15 bp, Homo sapiens
atgtctatgatagat

SEQ ID NO: 1003608 - DNA, 15 bp, Homo sapiens
atgtctattcagctt

SEQ ID NO: 1003609 - DNA, 14 bp, Homo sapiens
atgtctcactgttc

SEQ ID NO: 1003610 - DNA, 20 bp, Homo sapiens
atgtctcactgttctgcaaa

SEQ ID NO: 1003611 - DNA, 17 bp, Homo sapiens
atgtctcaggtccctgc

SEQ ID NO: 1003612 - DNA, 16 bp, Homo sapiens
atgtctcatgtaattt

SEQ ID NO: 1003613 - DNA, 14 bp, Homo sapiens
atgtctcccacacc

SEQ ID NO: 1003614 - DNA, 16 bp, Homo sapiens
atgtctcccacaccca

SEQ ID NO: 1003615 - DNA, 13 bp, Homo sapiens
atgtctcctcaag

SEQ ID NO: 1003616 - DNA, 14 bp, Homo sapiens
atgtctcctcaagc

SEQ ID NO: 1003617 - DNA, 22 bp, Homo sapiens
atgtctcctcaagcctgtgggc

SEQ ID NO: 1003618 - DNA, 16 bp, Homo sapiens
atgtctcgtggtagga

SEQ ID NO: 1003619 - DNA, 14 bp, Homo sapiens
atgtctctgctcct

SEQ ID NO: 1003620 - DNA, 14 bp, Homo sapiens
atgtctctgcttcc

SEQ ID NO: 1003621 - DNA, 16 bp, Homo sapiens
atgtctctgcttccat

SEQ ID NO: 1003622 - DNA, 16 bp, Homo sapiens
atgtctcttcctctgt

SEQ ID NO: 1003623 - DNA, 17 bp, Homo sapiens
atgtctcttctgagcta

SEQ ID NO: 1003624 - DNA, 18 bp, Homo sapiens
atgtctcttgagcatcaa

SEQ ID NO: 1003625 - DNA, 16 bp, Homo sapiens
atgtctcttgtagaag

SEQ ID NO: 1003626 - DNA, 16 bp, Homo sapiens
atgtctgaagtacaaa

SEQ ID NO: 1003627 - DNA, 22 bp, Homo sapiens
atgtctgaagtacaaacatgaa

SEQ ID NO: 1003628 - DNA, 16 bp, Homo sapiens
atgtctgagtgaacct

SEQ ID NO: 1003629 - DNA, 22 bp, Homo sapiens
atgtctgataatgatttgctct

SEQ ID NO: 1003630 - DNA, 12 bp, Homo sapiens
atgtctgcacct

SEQ ID NO: 1003631 - DNA, 14 bp, Homo sapiens
atgtctgcacctcc

SEQ ID NO: 1003632 - DNA, 22 bp, Homo sapiens
atgtctgcacctccgcttgcca

SEQ ID NO: 1003633 - DNA, 14 bp, Homo sapiens
atgtctgcatttcg

SEQ ID NO: 1003634 - DNA, 13 bp, Homo sapiens
atgtctgccttac

SEQ ID NO: 1003635 - DNA, 12 bp, Homo sapiens
atgtctgctggt

SEQ ID NO: 1003636 - DNA, 12 bp, Homo sapiens
atgtctggggca

SEQ ID NO: 1003637 - DNA, 22 bp, Homo sapiens
atgtctgtatactcctgtcacc

SEQ ID NO: 1003638 - DNA, 16 bp, Homo sapiens
atgtctgtcctcagag

SEQ ID NO: 1003639 - DNA, 13 bp, Homo sapiens
atgtctgtgagta

SEQ ID NO: 1003640 - DNA, 11 bp, Homo sapiens
atgtctgtgct

SEQ ID NO: 1003641 - DNA, 13 bp, Homo sapiens
atgtctgttacca

SEQ ID NO: 1003642 - DNA, 16 bp, Homo sapiens
atgtctgttctacata

SEQ ID NO: 1003643 - DNA, 16 bp, Homo sapiens
atgtctgtttttgtat

SEQ ID NO: 1003644 - DNA, 17 bp, Homo sapiens
atgtctgtttttgtatc

SEQ ID NO: 1003645 - DNA, 19 bp, Homo sapiens
atgtctgtttttgtatctt

SEQ ID NO: 1003646 - DNA, 20 bp, Homo sapiens
atgtctgtttttgtatcttt

SEQ ID NO: 1003647 - DNA, 22 bp, Homo sapiens
atgtctgtttttgtatctttat

SEQ ID NO: 1003648 - DNA, 20 bp, Homo sapiens
atgtcttaaatgctcataaa

SEQ ID NO: 1003649 - DNA, 17 bp, Homo sapiens
atgtcttaactgtcacc

SEQ ID NO: 1003650 - DNA, 15 bp, Homo sapiens
atgtcttcagtggaa

SEQ ID NO: 1003651 - DNA, 24 bp, Homo sapiens
atgtcttcatcacttcttccactg

SEQ ID NO: 1003652 - DNA, 18 bp, Homo sapiens
atgtcttcatttcattgt

SEQ ID NO: 1003653 - DNA, 24 bp, Homo sapiens
atgtcttccctgggctgccaccag

SEQ ID NO: 1003654 - DNA, 14 bp, Homo sapiens
atgtcttctgctgt

SEQ ID NO: 1003655 - DNA, 17 bp, Homo sapiens
atgtcttctgctgttct

SEQ ID NO: 1003656 - DNA, 23 bp, Homo sapiens
atgtcttgatgcatgcactgttc

SEQ ID NO: 1003657 - DNA, 19 bp, Homo sapiens
atgtcttgctgttgacata

SEQ ID NO: 1003658 - DNA, 22 bp, Homo sapiens
atgtcttgctgttgacatattt

SEQ ID NO: 1003659 - DNA, 22 bp, Homo sapiens
ccctgggagaatcgctcctgca

SEQ ID NO: 1003660 - DNA, 24 bp, Homo sapiens
ccctgggagaatcgctcctgcagc

SEQ ID NO: 1003661 - DNA, 18 bp, Homo sapiens
ccctgggatctggtggtc

SEQ ID NO: 1003662 - DNA, 20 bp, Homo sapiens
ccctgggatctggtggtcag

SEQ ID NO: 1003663 - DNA, 17 bp, Homo sapiens
ccctgggatgcctcacc

SEQ ID NO: 1003664 - DNA, 21 bp, Homo sapiens
ccctgggatgcctcaccacac

SEQ ID NO: 1003665 - DNA, 21 bp, Homo sapiens
ccctgggatgctgacccagga

SEQ ID NO: 1003666 - DNA, 23 bp, Homo sapiens
ccctgggatggaacctcaggatg

SEQ ID NO: 1003667 - DNA, 15 bp, Homo sapiens
ccctgggcaggcggt

SEQ ID NO: 1003668 - DNA, 19 bp, Homo sapiens
ccctgggcatcttctggct

SEQ ID NO: 1003669 - DNA, 21 bp, Homo sapiens
ccctgggcatcttctggcttg

SEQ ID NO: 1003670 - DNA, 21 bp, Homo sapiens
ccctgggccaaaaccaatgct

SEQ ID NO: 1003671 - DNA, 22 bp, Homo sapiens
ccctgggccaccgggcagcctg

SEQ ID NO: 1003672 - DNA, 17 bp, Homo sapiens
ccctgggccacctccta

SEQ ID NO: 1003673 - DNA, 21 bp, Homo sapiens
ccctgggccagcggggctgct

SEQ ID NO: 1003674 - DNA, 14 bp, Homo sapiens
ccctgggccaggca

SEQ ID NO: 1003675 - DNA, 13 bp, Homo sapiens
ccctgggccaggg

SEQ ID NO: 1003676 - DNA, 22 bp, Homo sapiens
ccctgggccccaccacctaggc

SEQ ID NO: 1003677 - DNA, 15 bp, Homo sapiens
ccctgggcccctcca

SEQ ID NO: 1003678 - DNA, 17 bp, Homo sapiens
ccctgggcccctccacg

SEQ ID NO: 1003679 - DNA, 18 bp, Homo sapiens
ccctgggcccctccacgc

SEQ ID NO: 1003680 - DNA, 19 bp, Homo sapiens
ccctgggcccctccacgcc

SEQ ID NO: 1003681 - DNA, 13 bp, Homo sapiens
ccctgggccctgg

SEQ ID NO: 1003682 - DNA, 19 bp, Homo sapiens
ccctgggccctgggctgga

SEQ ID NO: 1003683 - DNA, 23 bp, Homo sapiens
ccctgggcctcagttcaacctgg

SEQ ID NO: 1003684 - DNA, 13 bp, Homo sapiens
ccctgggctctgc

SEQ ID NO: 1003685 - DNA, 15 bp, Homo sapiens
ccctgggctgatgga

SEQ ID NO: 1003686 - DNA, 11 bp, Homo sapiens
ccctgggctgg

SEQ ID NO: 1003687 - DNA, 14 bp, Homo sapiens
ccctgggctggaat

SEQ ID NO: 1003688 - DNA, 20 bp, Homo sapiens
ccctgggctggactggaggt

SEQ ID NO: 1003689 - DNA, 16 bp, Homo sapiens
ccctgggctggggagg

SEQ ID NO: 1003690 - DNA, 21 bp, Homo sapiens
ccctgggctggggaggaggag

SEQ ID NO: 1003691 - DNA, 20 bp, Homo sapiens
ccctgggctggggcctcaga

SEQ ID NO: 1003692 - DNA, 18 bp, Homo sapiens
ccctgggctgggtgctgg

SEQ ID NO: 1003693 - DNA, 20 bp, Homo sapiens
ccctgggctgggtgctggga

SEQ ID NO: 1003694 - DNA, 18 bp, Homo sapiens
ccctgggctgtctgtcac

SEQ ID NO: 1003695 - DNA, 20 bp, Homo sapiens
ccctgggctgtctgtcacca

SEQ ID NO: 1003696 - DNA, 15 bp, Homo sapiens
ccctgggctgtgcta

SEQ ID NO: 1003697 - DNA, 17 bp, Homo sapiens
ccctgggcttggcctgc

SEQ ID NO: 1003698 - DNA, 18 bp, Homo sapiens
ccctgggcttggcctgct

SEQ ID NO: 1003699 - DNA, 21 bp, Homo sapiens
ccctgggcttggcctgctgtg

SEQ ID NO: 1003700 - DNA, 16 bp, Homo sapiens
ccctgggcttggctct

SEQ ID NO: 1003701 - DNA, 18 bp, Homo sapiens
ccctgggcttggctcttg

SEQ ID NO: 1003702 - DNA, 18 bp, Homo sapiens
ccctggggaaggagccag

SEQ ID NO: 1003703 - DNA, 23 bp, Homo sapiens
ccctggggacagagccaccccat

SEQ ID NO: 1003704 - DNA, 22 bp, Homo sapiens
ccctggggagccctcaggctcc

SEQ ID NO: 1003705 - DNA, 19 bp, Homo sapiens
ccctggggatatgcaaccc

SEQ ID NO: 1003706 - DNA, 18 bp, Homo sapiens
ccctggggcccagcccct

SEQ ID NO: 1003707 - DNA, 14 bp, Homo sapiens
ccctggggcctgac

SEQ ID NO: 1003708 - DNA, 19 bp, Homo sapiens
ccctggggcttctcctgac

SEQ ID NO: 1003709 - DNA, 17 bp, Homo sapiens
ccctgtgttgtctctag

SEQ ID NO: 1003710 - DNA, 18 bp, Homo sapiens
ccctgtgttgtctctaga

SEQ ID NO: 1003711 - DNA, 13 bp, Homo sapiens
ccctgttaaacag

SEQ ID NO: 1003712 - DNA, 20 bp, Homo sapiens
ccctgttcacggtgacacag

SEQ ID NO: 1003713 - DNA, 19 bp, Homo sapiens
ccctgttcagctactccca

SEQ ID NO: 1003714 - DNA, 12 bp, Homo sapiens
ccctgttccctg

SEQ ID NO: 1003715 - DNA, 14 bp, Homo sapiens
ccctgttccctgtt

SEQ ID NO: 1003716 - DNA, 20 bp, Homo sapiens
ccctgttctccctttctctc

SEQ ID NO: 1003717 - DNA, 21 bp, Homo sapiens
ccctgttctccctttctctct

SEQ ID NO: 1003718 - DNA, 17 bp, Homo sapiens
ccctgttctcctcccca

SEQ ID NO: 1003719 - DNA, 22 bp, Homo sapiens
ccctgttctgttggggaggggt

SEQ ID NO: 1003720 - DNA, 17 bp, Homo sapiens
ccctgttgaggtgggtg

SEQ ID NO: 1003721 - DNA, 17 bp, Homo sapiens
ccctgtttaatatttaa

SEQ ID NO: 1003722 - DNA, 18 bp, Homo sapiens
ccctgtttaatatttaaa

SEQ ID NO: 1003723 - DNA, 16 bp, Homo sapiens
ccctgtttcagaggct

SEQ ID NO: 1003724 - DNA, 19 bp, Homo sapiens
ccctgtttcagaggctcag

SEQ ID NO: 1003725 - DNA, 11 bp, Homo sapiens
ccctgtttctg

SEQ ID NO: 1003726 - DNA, 23 bp, Homo sapiens
ccctgtttttagagcttccaaat

SEQ ID NO: 1003727 - DNA, 14 bp, Homo sapiens
cccttaaaatagaa

SEQ ID NO: 1003728 - DNA, 19 bp, Homo sapiens
cccttaaacttccaaagct

SEQ ID NO: 1003729 - DNA, 16 bp, Homo sapiens
cccttaacccaaggag

SEQ ID NO: 1003730 - DNA, 15 bp, Homo sapiens
cccttaactccaaga

SEQ ID NO: 1003731 - DNA, 17 bp, Homo sapiens
cccttaaggtctccaaa

SEQ ID NO: 1003732 - DNA, 16 bp, Homo sapiens
cccttacacgtacctc

SEQ ID NO: 1003733 - DNA, 15 bp, Homo sapiens
cccttacagcctctg

SEQ ID NO: 1003734 - DNA, 14 bp, Homo sapiens
cccttacagtagga

SEQ ID NO: 1003735 - DNA, 20 bp, Homo sapiens
cccttaccctcctctgctgg

SEQ ID NO: 1003736 - DNA, 19 bp, Homo sapiens
cccttacctcggtgccttc

SEQ ID NO: 1003737 - DNA, 20 bp, Homo sapiens
cccttacttgcttctctagc

SEQ ID NO: 1003738 - DNA, 14 bp, Homo sapiens
cccttagaggacct

SEQ ID NO: 1003739 - DNA, 19 bp, Homo sapiens
cccttagaggacctgagtt

SEQ ID NO: 1003740 - DNA, 14 bp, Homo sapiens
cccttagcctccct

SEQ ID NO: 1003741 - DNA, 16 bp, Homo sapiens
cccttagcctctccca

SEQ ID NO: 1003742 - DNA, 17 bp, Homo sapiens
cccttagcctctcccac

SEQ ID NO: 1003743 - DNA, 12 bp, Homo sapiens
cccttagtcccc

SEQ ID NO: 1003744 - DNA, 15 bp, Homo sapiens
cccttagtcccccaa

SEQ ID NO: 1003745 - DNA, 23 bp, Homo sapiens
cccttagtcccccaactctgagc

SEQ ID NO: 1003746 - DNA, 13 bp, Homo sapiens
cccttatccagga

SEQ ID NO: 1003747 - DNA, 14 bp, Homo sapiens
cccttatccaggac

SEQ ID NO: 1003748 - DNA, 23 bp, Homo sapiens
cccttatgagcgtcactgcccac

SEQ ID NO: 1003749 - DNA, 19 bp, Homo sapiens
cccttatgcggttaatttt

SEQ ID NO: 1003750 - DNA, 16 bp, Homo sapiens
cccttattacacggaa

SEQ ID NO: 1003751 - DNA, 20 bp, Homo sapiens
cccttattacacggaaaacg

SEQ ID NO: 1003752 - DNA, 19 bp, Homo sapiens
cccttattgctgtcctgga

SEQ ID NO: 1003753 - DNA, 21 bp, Homo sapiens
cccttcacctttggtgcagag

SEQ ID NO: 1003754 - DNA, 15 bp, Homo sapiens
cccttcactgccatg

SEQ ID NO: 1003755 - DNA, 22 bp, Homo sapiens
cccttcacttctgaccacactt

SEQ ID NO: 1003756 - DNA, 23 bp, Homo sapiens
cccttcacttctgaccacacttc

SEQ ID NO: 1003757 - DNA, 13 bp, Homo sapiens
cccttcagctcct

SEQ ID NO: 1003758 - DNA, 17 bp, Homo sapiens
cccttcagtaccctctc

SEQ ID NO: 1003759 - DNA, 12 bp, Homo sapiens
cccttcagtctg

SEQ ID NO: 1003760 - DNA, 19 bp, Homo sapiens
cccttcagtctgctccacc

SEQ ID NO: 1003761 - DNA, 17 bp, Homo sapiens
cccttcagtgcccacca

SEQ ID NO: 1003762 - DNA, 15 bp, Homo sapiens
cccttcatctccagg

SEQ ID NO: 1003763 - DNA, 18 bp, Homo sapiens
cccttcatctccagggag

SEQ ID NO: 1003764 - DNA, 20 bp, Homo sapiens
cccttcatcttcctgtgtcc

SEQ ID NO: 1003765 - DNA, 11 bp, Homo sapiens
cccttccaaag

SEQ ID NO: 1003766 - DNA, 12 bp, Homo sapiens
cccttccaaaga

SEQ ID NO: 1003767 - DNA, 18 bp, Homo sapiens
cccttccacctcctagag

SEQ ID NO: 1003768 - DNA, 16 bp, Homo sapiens
cccttccactgagggc

SEQ ID NO: 1003769 - DNA, 20 bp, Homo sapiens
cccttccagatcactgccac

SEQ ID NO: 1003770 - DNA, 19 bp, Homo sapiens
cccttccagcctgggacac

SEQ ID NO: 1003771 - DNA, 23 bp, Homo sapiens
cccttccagcctgggacacacac

SEQ ID NO: 1003772 - DNA, 20 bp, Homo sapiens
cccttccaggaatgctgggc

SEQ ID NO: 1003773 - DNA, 22 bp, Homo sapiens
cccttccaggaatgctgggccc

SEQ ID NO: 1003774 - DNA, 14 bp, Homo sapiens
cccttccaggtggg

SEQ ID NO: 1003775 - DNA, 12 bp, Homo sapiens
cccttccagtgg

SEQ ID NO: 1003776 - DNA, 20 bp, Homo sapiens
cccttccatgtcgcctctgc

SEQ ID NO: 1003777 - DNA, 16 bp, Homo sapiens
cccttcccactggagg

SEQ ID NO: 1003778 - DNA, 15 bp, Homo sapiens
cccttcccagccctc

SEQ ID NO: 1003779 - DNA, 14 bp, Homo sapiens
cccttcccagtggg

SEQ ID NO: 1003780 - DNA, 21 bp, Homo sapiens
cccttcccagtgggctgtgtt

SEQ ID NO: 1003781 - DNA, 16 bp, Homo sapiens
cccttccccagccctt

SEQ ID NO: 1003782 - DNA, 16 bp, Homo sapiens
cccttcccccagccca

SEQ ID NO: 1003783 - DNA, 14 bp, Homo sapiens
cccttccccgtccc

SEQ ID NO: 1003784 - DNA, 17 bp, Homo sapiens
cccttccccgtcccctg

SEQ ID NO: 1003785 - DNA, 21 bp, Homo sapiens
cccttcccctaccccctcctc

SEQ ID NO: 1003786 - DNA, 21 bp, Homo sapiens
cccttcccctcccccactcct

SEQ ID NO: 1003787 - DNA, 22 bp, Homo sapiens
cccttcccctcccccactcctc

SEQ ID NO: 1003788 - DNA, 17 bp, Homo sapiens
cccttcccctccctggc

SEQ ID NO: 1003789 - DNA, 21 bp, Homo sapiens
atgtggaggaagagccacctg

SEQ ID NO: 1003790 - DNA, 23 bp, Homo sapiens
atgtggaggaagagccacctgca

SEQ ID NO: 1003791 - DNA, 18 bp, Homo sapiens
atgtggcaaggaaaaaca

SEQ ID NO: 1003792 - DNA, 16 bp, Homo sapiens
atgtggcagcccatgg

SEQ ID NO: 1003793 - DNA, 22 bp, Homo sapiens
atgtggcattggggggccgggc

SEQ ID NO: 1003794 - DNA, 21 bp, Homo sapiens
atgtggccctccagtgtatga

SEQ ID NO: 1003795 - DNA, 18 bp, Homo sapiens
atgtggccgaggactttg

SEQ ID NO: 1003796 - DNA, 18 bp, Homo sapiens
atgtggcctgcccagcct

SEQ ID NO: 1003797 - DNA, 19 bp, Homo sapiens
atgtggcctgtggcctgtg

SEQ ID NO: 1003798 - DNA, 20 bp, Homo sapiens
atgtggcctttgaattctgt

SEQ ID NO: 1003799 - DNA, 15 bp, Homo sapiens
atgtgggcacggagg

SEQ ID NO: 1003800 - DNA, 18 bp, Homo sapiens
atgtgggcactggcccag

SEQ ID NO: 1003801 - DNA, 13 bp, Homo sapiens
atgtggggctgag

SEQ ID NO: 1003802 - DNA, 15 bp, Homo sapiens
atgtgggtcttccag

SEQ ID NO: 1003803 - DNA, 18 bp, Homo sapiens
atgtgggtctttttctct

SEQ ID NO: 1003804 - DNA, 21 bp, Homo sapiens
atgtgggtctttttctcttct

SEQ ID NO: 1003805 - DNA, 15 bp, Homo sapiens
atgtgggtgagccag

SEQ ID NO: 1003806 - DNA, 15 bp, Homo sapiens
atgtgggttatcctc

SEQ ID NO: 1003807 - DNA, 15 bp, Homo sapiens
atgtggtacaggggc

SEQ ID NO: 1003808 - DNA, 20 bp, Homo sapiens
atgtggtgacacctccccct

SEQ ID NO: 1003809 - DNA, 15 bp, Homo sapiens
atgtggtgggacagg

SEQ ID NO: 1003810 - DNA, 23 bp, Homo sapiens
atgtggttaccgagtatctgtaa

SEQ ID NO: 1003811 - DNA, 17 bp, Homo sapiens
atgtggttatttctctg

SEQ ID NO: 1003812 - DNA, 18 bp, Homo sapiens
atgtggttatttctctga

SEQ ID NO: 1003813 - DNA, 15 bp, Homo sapiens
atgtggttcttcaaa

SEQ ID NO: 1003814 - DNA, 22 bp, Homo sapiens
atgtgtaagaacaatgccaggg

SEQ ID NO: 1003815 - DNA, 15 bp, Homo sapiens
atgtgtaaggtgaac

SEQ ID NO: 1003816 - DNA, 13 bp, Homo sapiens
atgtgtaagtatt

SEQ ID NO: 1003817 - DNA, 17 bp, Homo sapiens
atgtgtaataaatatgt

SEQ ID NO: 1003818 - DNA, 18 bp, Homo sapiens
atgtgtacaatgtacaca

SEQ ID NO: 1003819 - DNA, 14 bp, Homo sapiens
atgtgtacagtgaa

SEQ ID NO: 1003820 - DNA, 23 bp, Homo sapiens
atgtgtacagtgaattgtctttt

SEQ ID NO: 1003821 - DNA, 22 bp, Homo sapiens
atgtgtacatggcagagtttgt

SEQ ID NO: 1003822 - DNA, 18 bp, Homo sapiens
atgtgtacattctgccta

SEQ ID NO: 1003823 - DNA, 12 bp, Homo sapiens
atgtgtactggt

SEQ ID NO: 1003824 - DNA, 16 bp, Homo sapiens
atgtgtagccttctcc

SEQ ID NO: 1003825 - DNA, 17 bp, Homo sapiens
atgtgtagccttctccc

SEQ ID NO: 1003826 - DNA, 15 bp, Homo sapiens
atgtgtataaactgc

SEQ ID NO: 1003827 - DNA, 15 bp, Homo sapiens
atgtgtatacataca

SEQ ID NO: 1003828 - DNA, 16 bp, Homo sapiens
atgtgtatacatacat

SEQ ID NO: 1003829 - DNA, 20 bp, Homo sapiens
atgtgtatacatacatgtat

SEQ ID NO: 1003830 - DNA, 21 bp, Homo sapiens
atgtgtatatttttgtatgtc

SEQ ID NO: 1003831 - DNA, 22 bp, Homo sapiens
atgttcaactggagacactatt

SEQ ID NO: 1003832 - DNA, 15 bp, Homo sapiens
atgttcactgtgagt

SEQ ID NO: 1003833 - DNA, 18 bp, Homo sapiens
atgttcacttttgacaaa

SEQ ID NO: 1003834 - DNA, 16 bp, Homo sapiens
atgttcagagtggctc

SEQ ID NO: 1003835 - DNA, 16 bp, Homo sapiens
atgttcagcactgtcc

SEQ ID NO: 1003836 - DNA, 19 bp, Homo sapiens
atgttcagcactgtccctt

SEQ ID NO: 1003837 - DNA, 18 bp, Homo sapiens
atgttcatatttattgat

SEQ ID NO: 1003838 - DNA, 19 bp, Homo sapiens
atgttcatcccatgatgta

SEQ ID NO: 1003839 - DNA, 20 bp, Homo sapiens
atgttcattataatctcaaa

SEQ ID NO: 1003840 - DNA, 21 bp, Homo sapiens
atgttcatttttaaagcctgg

SEQ ID NO: 1003841 - DNA, 19 bp, Homo sapiens
atgttccctcttgtccctt

SEQ ID NO: 1003842 - DNA, 13 bp, Homo sapiens
atgttccctgcac

SEQ ID NO: 1003843 - DNA, 18 bp, Homo sapiens
atgttccctgcaccctgg

SEQ ID NO: 1003844 - DNA, 22 bp, Homo sapiens
atgttcccttgaccattggctg

SEQ ID NO: 1003845 - DNA, 23 bp, Homo sapiens
atgttcccttgaccattggctgc

SEQ ID NO: 1003846 - DNA, 17 bp, Homo sapiens
atgttcctaacaaaatg

SEQ ID NO: 1003847 - DNA, 19 bp, Homo sapiens
atgttcctaacaaaatgag

SEQ ID NO: 1003848 - DNA, 17 bp, Homo sapiens
atgttcctcaaagcttg

SEQ ID NO: 1003849 - DNA, 21 bp, Homo sapiens
atgttcctcaaagcttggatt

SEQ ID NO: 1003850 - DNA, 23 bp, Homo sapiens
atgttcctgaattctatttgctg

SEQ ID NO: 1003851 - DNA, 17 bp, Homo sapiens
atgttccttttgaaatt

SEQ ID NO: 1003852 - DNA, 22 bp, Homo sapiens
atgttctaacagatcagaacat

SEQ ID NO: 1003853 - DNA, 17 bp, Homo sapiens
atgttctaacctttaca

SEQ ID NO: 1003854 - DNA, 19 bp, Homo sapiens
atgttctaagtctttccat

SEQ ID NO: 1003855 - DNA, 21 bp, Homo sapiens
atgttctaggtcagtctaaca

SEQ ID NO: 1003856 - DNA, 19 bp, Homo sapiens
atgttctatttaacaactg

SEQ ID NO: 1003857 - DNA, 17 bp, Homo sapiens
atgttctgacattaaca

SEQ ID NO: 1003858 - DNA, 20 bp, Homo sapiens
atgttctgacattaacagtt

SEQ ID NO: 1003859 - DNA, 22 bp, Homo sapiens
atgttctgaccctgcttcaaat

SEQ ID NO: 1003860 - DNA, 16 bp, Homo sapiens
atgttctgcccccagc

SEQ ID NO: 1003861 - DNA, 13 bp, Homo sapiens
atgttctgctttc

SEQ ID NO: 1003862 - DNA, 18 bp, Homo sapiens
atgttctgtcacgtgaaa

SEQ ID NO: 1003863 - DNA, 17 bp, Homo sapiens
atgttcttggaacatgg

SEQ ID NO: 1003864 - DNA, 18 bp, Homo sapiens
atgttcttgggtggttcc

SEQ ID NO: 1003865 - DNA, 13 bp, Homo sapiens
atgttctttggaa

SEQ ID NO: 1003866 - DNA, 14 bp, Homo sapiens
atgttctttggaaa

SEQ ID NO: 1003867 - DNA, 21 bp, Homo sapiens
atgttgaaaaaatttaaaagt

SEQ ID NO: 1003868 - DNA, 19 bp, Homo sapiens
atgttgaatactttttaca

SEQ ID NO: 1003869 - DNA, 22 bp, Homo sapiens
atgttgagaatcccaaatttga

SEQ ID NO: 1003870 - DNA, 14 bp, Homo sapiens
atgttgagggaaca

SEQ ID NO: 1003871 - DNA, 20 bp, Homo sapiens
atgttgagggaacagacagg

SEQ ID NO: 1003872 - DNA, 17 bp, Homo sapiens
atgttgagggcaagcca

SEQ ID NO: 1003873 - DNA, 12 bp, Homo sapiens
atgttgataatt

SEQ ID NO: 1003874 - DNA, 19 bp, Homo sapiens
atgttgataatttcaggga

SEQ ID NO: 1003875 - DNA, 18 bp, Homo sapiens
atgttgatcatgtacttt

SEQ ID NO: 1003876 - DNA, 22 bp, Homo sapiens
atgttgcaatgtgaaaaatctg

SEQ ID NO: 1003877 - DNA, 22 bp, Homo sapiens
atgttgccatcctaccgtcttt

SEQ ID NO: 1003878 - DNA, 13 bp, Homo sapiens
atgttgcccaagc

SEQ ID NO: 1003879 - DNA, 20 bp, Homo sapiens
atgttgctcagtctcccttt

SEQ ID NO: 1003880 - DNA, 11 bp, Homo sapiens
atgttgcttct

SEQ ID NO: 1003881 - DNA, 18 bp, Homo sapiens
atgttgcttctgaatcac

SEQ ID NO: 1003882 - DNA, 22 bp, Homo sapiens
atgttgctttaacctgaacctt

SEQ ID NO: 1003883 - DNA, 23 bp, Homo sapiens
atgttgctttaacctgaaccttg

SEQ ID NO: 1003884 - DNA, 17 bp, Homo sapiens
atgttggaagagaaagc

SEQ ID NO: 1003885 - DNA, 21 bp, Homo sapiens
atgttggatgatgaaacattc

SEQ ID NO: 1003886 - DNA, 23 bp, Homo sapiens
atgttggccaccaggtgcctttc

SEQ ID NO: 1003887 - DNA, 17 bp, Homo sapiens
atgttggccaggctggt

SEQ ID NO: 1003888 - DNA, 14 bp, Homo sapiens
atgttggcctgtca

SEQ ID NO: 1003889 - DNA, 23 bp, Homo sapiens
atgttgggaggatacagaggaga

SEQ ID NO: 1003890 - DNA, 17 bp, Homo sapiens
atgttgtaatatttctt

SEQ ID NO: 1003891 - DNA, 16 bp, Homo sapiens
atgttgtaatgctgca

SEQ ID NO: 1003892 - DNA, 16 bp, Homo sapiens
atgttgtacttgaaaa

SEQ ID NO: 1003893 - DNA, 21 bp, Homo sapiens
atgttgtacttgaaaatgcta

SEQ ID NO: 1003894 - DNA, 23 bp, Homo sapiens
atgttgtacttgaaaatgctata

SEQ ID NO: 1003895 - DNA, 11 bp, Homo sapiens
atgttgtattg

SEQ ID NO: 1003896 - DNA, 13 bp, Homo sapiens
atgttgtcaaaga

SEQ ID NO: 1003897 - DNA, 12 bp, Homo sapiens
atgttgtcataa

SEQ ID NO: 1003898 - DNA, 22 bp, Homo sapiens
atgttgtcataacatttaaaga

SEQ ID NO: 1003899 - DNA, 22 bp, Homo sapiens
atgttgtccaattgttgacagt

SEQ ID NO: 1003900 - DNA, 15 bp, Homo sapiens
atgttgtgtggcaat

SEQ ID NO: 1003901 - DNA, 15 bp, Homo sapiens
atgttgtgtttttaa

SEQ ID NO: 1003902 - DNA, 13 bp, Homo sapiens
atgttgttattta

SEQ ID NO: 1003903 - DNA, 19 bp, Homo sapiens
atgttgttcaaatgcattt

SEQ ID NO: 1003904 - DNA, 20 bp, Homo sapiens
atgttgtttataataaaaat

SEQ ID NO: 1003905 - DNA, 16 bp, Homo sapiens
atgttgttttttcata

SEQ ID NO: 1003906 - DNA, 15 bp, Homo sapiens
atgtttaaaagaaat

SEQ ID NO: 1003907 - DNA, 15 bp, Homo sapiens
atgtttaaaataaaa

SEQ ID NO: 1003908 - DNA, 17 bp, Homo sapiens
atgtttaaaataaaatg

SEQ ID NO: 1003909 - DNA, 14 bp, Homo sapiens
atgtttaaaccttt

SEQ ID NO: 1003910 - DNA, 18 bp, Homo sapiens
atgtttaaatagcctaaa

SEQ ID NO: 1003911 - DNA, 13 bp, Homo sapiens
atgtttaaatcat

SEQ ID NO: 1003912 - DNA, 16 bp, Homo sapiens
atgtttaaatcatgta

SEQ ID NO: 1003913 - DNA, 22 bp, Homo sapiens
atgtttaaatcatgtatgttat

SEQ ID NO: 1003914 - DNA, 13 bp, Homo sapiens
atgtttaaattgt

SEQ ID NO: 1003915 - DNA, 14 bp, Homo sapiens
atgtttaatctgtt

SEQ ID NO: 1003916 - DNA, 14 bp, Homo sapiens
atgtttacacaatt

SEQ ID NO: 1003917 - DNA, 22 bp, Homo sapiens
atgtttacactctttgtaagag

SEQ ID NO: 1003918 - DNA, 18 bp, Homo sapiens
atgtttacaggtttgaat

SEQ ID NO: 1003919 - DNA, 13 bp, Homo sapiens
atgtttacatatc

SEQ ID NO: 1003920 - DNA, 16 bp, Homo sapiens
ccctttctagaccaat

SEQ ID NO: 1003921 - DNA, 18 bp, Homo sapiens
ccctttctctctcctctc

SEQ ID NO: 1003922 - DNA, 14 bp, Homo sapiens
ccctttcttggcca

SEQ ID NO: 1003923 - DNA, 16 bp, Homo sapiens
ccctttcttggccagt

SEQ ID NO: 1003924 - DNA, 18 bp, Homo sapiens
ccctttgcacctgagacc

SEQ ID NO: 1003925 - DNA, 21 bp, Homo sapiens
ccctttgcatagctctccttc

SEQ ID NO: 1003926 - DNA, 22 bp, Homo sapiens
ccctttgcctttcttctgccct

SEQ ID NO: 1003927 - DNA, 23 bp, Homo sapiens
ccctttgcctttcttctgccctt

SEQ ID NO: 1003928 - DNA, 12 bp, Homo sapiens
ccctttgctctg

SEQ ID NO: 1003929 - DNA, 14 bp, Homo sapiens
ccctttgctgtgag

SEQ ID NO: 1003930 - DNA, 23 bp, Homo sapiens
ccctttgctgtgaggctgtcctg

SEQ ID NO: 1003931 - DNA, 21 bp, Homo sapiens
ccctttggccccactttgaag

SEQ ID NO: 1003932 - DNA, 22 bp, Homo sapiens
ccctttggggagcaggaggcca

SEQ ID NO: 1003933 - DNA, 21 bp, Homo sapiens
ccctttggggtagaccttgag

SEQ ID NO: 1003934 - DNA, 20 bp, Homo sapiens
ccctttggtttttttcttct

SEQ ID NO: 1003935 - DNA, 13 bp, Homo sapiens
ccctttgtcctgc

SEQ ID NO: 1003936 - DNA, 23 bp, Homo sapiens
ccctttgttaccatactgtctct

SEQ ID NO: 1003937 - DNA, 16 bp, Homo sapiens
cccttttacagctctt

SEQ ID NO: 1003938 - DNA, 16 bp, Homo sapiens
cccttttctctgctct

SEQ ID NO: 1003939 - DNA, 13 bp, Homo sapiens
cccttttctttga

SEQ ID NO: 1003940 - DNA, 18 bp, Homo sapiens
cccttttcttttctaccc

SEQ ID NO: 1003941 - DNA, 18 bp, Homo sapiens
cccttttgactcttccgt

SEQ ID NO: 1003942 - DNA, 14 bp, Homo sapiens
cccttttgcctggc

SEQ ID NO: 1003943 - DNA, 16 bp, Homo sapiens
cccttttgcctggctg

SEQ ID NO: 1003944 - DNA, 19 bp, Homo sapiens
cccttttgcctggctgtgg

SEQ ID NO: 1003945 - DNA, 14 bp, Homo sapiens
cccttttggccccc

SEQ ID NO: 1003946 - DNA, 21 bp, Homo sapiens
cccttttgtgggtttctctgt

SEQ ID NO: 1003947 - DNA, 22 bp, Homo sapiens
cccttttgtgggtttctctgtg

SEQ ID NO: 1003948 - DNA, 20 bp, Homo sapiens
cccttttgttgagccaggcc

SEQ ID NO: 1003949 - DNA, 23 bp, Homo sapiens
ccctttttactccccttgagctg

SEQ ID NO: 1003950 - DNA, 14 bp, Homo sapiens
ccctttttcaatga

SEQ ID NO: 1003951 - DNA, 16 bp, Homo sapiens
cccttttttgtccccc

SEQ ID NO: 1003952 - DNA, 14 bp, Homo sapiens
ccgagtatctgtaa

SEQ ID NO: 1003953 - DNA, 22 bp, Homo sapiens
ccgagtatctgtaacccttgaa

SEQ ID NO: 1003954 - DNA, 22 bp, Homo sapiens
ccgagtcaattaaacagctggt

SEQ ID NO: 1003955 - DNA, 15 bp, Homo sapiens
ccgagtccaagctgg

SEQ ID NO: 1003956 - DNA, 14 bp, Homo sapiens
ccgagtctcttctc

SEQ ID NO: 1003957 - DNA, 18 bp, Homo sapiens
ccgagtctcttctccact

SEQ ID NO: 1003958 - DNA, 20 bp, Homo sapiens
ccgagtctcttctccactgg

SEQ ID NO: 1003959 - DNA, 17 bp, Homo sapiens
ccgagtctgggacacaa

SEQ ID NO: 1003960 - DNA, 11 bp, Homo sapiens
ccgagtcttgc

SEQ ID NO: 1003961 - DNA, 23 bp, Homo sapiens
ccgagtgagtcagtgatgaggcc

SEQ ID NO: 1003962 - DNA, 18 bp, Homo sapiens
ccgatagggtatttgacc

SEQ ID NO: 1003963 - DNA, 18 bp, Homo sapiens
ccgatgatactgtttctt

SEQ ID NO: 1003964 - DNA, 19 bp, Homo sapiens
ccgatgccaccggcctgtg

SEQ ID NO: 1003965 - DNA, 14 bp, Homo sapiens
ccgatgctccagcc

SEQ ID NO: 1003966 - DNA, 19 bp, Homo sapiens
ccgatgctccagccaaccc

SEQ ID NO: 1003967 - DNA, 20 bp, Homo sapiens
ccgatgctgctttcccctgt

SEQ ID NO: 1003968 - DNA, 22 bp, Homo sapiens
ccgatgctgctttcccctgtgg

SEQ ID NO: 1003969 - DNA, 17 bp, Homo sapiens
ccgatggagcccccaga

SEQ ID NO: 1003970 - DNA, 17 bp, Homo sapiens
ccgatgtcgacatgttt

SEQ ID NO: 1003971 - DNA, 19 bp, Homo sapiens
ccgatgtcgacatgttttt

SEQ ID NO: 1003972 - DNA, 15 bp, Homo sapiens
ccgcaaggcctccag

SEQ ID NO: 1003973 - DNA, 21 bp, Homo sapiens
ccgcaaggcctctcagaccca

SEQ ID NO: 1003974 - DNA, 15 bp, Homo sapiens
ccgcaagggcctgga

SEQ ID NO: 1003975 - DNA, 18 bp, Homo sapiens
ccgcacatggtgtggggg

SEQ ID NO: 1003976 - DNA, 14 bp, Homo sapiens
ccgcaccagctgct

SEQ ID NO: 1003977 - DNA, 15 bp, Homo sapiens
ccgcaccagctgctc

SEQ ID NO: 1003978 - DNA, 11 bp, Homo sapiens
ccgcaccccag

SEQ ID NO: 1003979 - DNA, 13 bp, Homo sapiens
ccgcaccccagag

SEQ ID NO: 1003980 - DNA, 14 bp, Homo sapiens
ccgcaccccatccc

SEQ ID NO: 1003981 - DNA, 16 bp, Homo sapiens
ccgcacccccaccctt

SEQ ID NO: 1003982 - DNA, 17 bp, Homo sapiens
ccgcacccccgccaggc

SEQ ID NO: 1003983 - DNA, 15 bp, Homo sapiens
ccgcaccctgcacct

SEQ ID NO: 1003984 - DNA, 18 bp, Homo sapiens
ccgcaccctgcacctgct

SEQ ID NO: 1003985 - DNA, 21 bp, Homo sapiens
ccgcaccctgcacctgctgcg

SEQ ID NO: 1003986 - DNA, 14 bp, Homo sapiens
ccgcaccttcctcc

SEQ ID NO: 1003987 - DNA, 23 bp, Homo sapiens
ccgcaccttcctcctccccgctc

SEQ ID NO: 1003988 - DNA, 14 bp, Homo sapiens
ccgcactcacccat

SEQ ID NO: 1003989 - DNA, 12 bp, Homo sapiens
ccgcactctgcc

SEQ ID NO: 1003990 - DNA, 15 bp, Homo sapiens
ccgcactctggcggt

SEQ ID NO: 1003991 - DNA, 21 bp, Homo sapiens
ccgcactttccacttcttcct

SEQ ID NO: 1003992 - DNA, 22 bp, Homo sapiens
ccgcagaagcagcccctcgagg

SEQ ID NO: 1003993 - DNA, 16 bp, Homo sapiens
ccgcagacaccttgga

SEQ ID NO: 1003994 - DNA, 23 bp, Homo sapiens
ccgcagacggtctgtgtgctgtt

SEQ ID NO: 1003995 - DNA, 17 bp, Homo sapiens
ccgcagactgcttggcc

SEQ ID NO: 1003996 - DNA, 11 bp, Homo sapiens
ccgcagaggca

SEQ ID NO: 1003997 - DNA, 14 bp, Homo sapiens
ccgcagaggcagaa

SEQ ID NO: 1003998 - DNA, 23 bp, Homo sapiens
ccgcagccagccggtgcctggcg

SEQ ID NO: 1003999 - DNA, 15 bp, Homo sapiens
ccgcagcccccaccc

SEQ ID NO: 1004000 - DNA, 21 bp, Homo sapiens
ccgcagcccccacccccaagg

SEQ ID NO: 1004001 - DNA, 16 bp, Homo sapiens
ccgcagcccctttccc

SEQ ID NO: 1004002 - DNA, 18 bp, Homo sapiens
ccgcagcccgcctgccgt

SEQ ID NO: 1004003 - DNA, 23 bp, Homo sapiens
ccgcagcccgtgaagcagtgcct

SEQ ID NO: 1004004 - DNA, 21 bp, Homo sapiens
ccgcagcgcccccatctgtct

SEQ ID NO: 1004005 - DNA, 18 bp, Homo sapiens
ccgcagcggtgggaagga

SEQ ID NO: 1004006 - DNA, 22 bp, Homo sapiens
ccgcagcggtgggaaggaaagg

SEQ ID NO: 1004007 - DNA, 18 bp, Homo sapiens
ccgcagctcttgcccttc

SEQ ID NO: 1004008 - DNA, 23 bp, Homo sapiens
ccgcaggagggaggcggggagga

SEQ ID NO: 1004009 - DNA, 21 bp, Homo sapiens
ccgcaggcccggactcaccaa

SEQ ID NO: 1004010 - DNA, 14 bp, Homo sapiens
ccgcagggcccacc

SEQ ID NO: 1004011 - DNA, 16 bp, Homo sapiens
ccgcagggcccacctt

SEQ ID NO: 1004012 - DNA, 15 bp, Homo sapiens
ccgcagtccccagcc

SEQ ID NO: 1004013 - DNA, 15 bp, Homo sapiens
ccgcagtgtgcacta

SEQ ID NO: 1004014 - DNA, 22 bp, Homo sapiens
ccgcagtgtgcactaaggggcc

SEQ ID NO: 1004015 - DNA, 23 bp, Homo sapiens
ccgcagtgtgcactaaggggccc

SEQ ID NO: 1004016 - DNA, 18 bp, Homo sapiens
ccgcagtgtggccaggct

SEQ ID NO: 1004017 - DNA, 14 bp, Homo sapiens
ccgcatcacctcac

SEQ ID NO: 1004018 - DNA, 22 bp, Homo sapiens
ccgcatcttctccatctggcag

SEQ ID NO: 1004019 - DNA, 18 bp, Homo sapiens
ccgcatgtgtgcctggcc

SEQ ID NO: 1004020 - DNA, 20 bp, Homo sapiens
ccgcatgtgtgcctggccgc

SEQ ID NO: 1004021 - DNA, 18 bp, Homo sapiens
ccgcattggaagagcccg

SEQ ID NO: 1004022 - DNA, 21 bp, Homo sapiens
ccgccaaaagctgctcaggga

SEQ ID NO: 1004023 - DNA, 23 bp, Homo sapiens
ccgccaaggtagccatcccatga

SEQ ID NO: 1004024 - DNA, 14 bp, Homo sapiens
ccgccacagccttc

SEQ ID NO: 1004025 - DNA, 16 bp, Homo sapiens
ccgccacccccatctt

SEQ ID NO: 1004026 - DNA, 22 bp, Homo sapiens
ccgccacccccatcttccacct

SEQ ID NO: 1004027 - DNA, 13 bp, Homo sapiens
ccgccacctcagg

SEQ ID NO: 1004028 - DNA, 12 bp, Homo sapiens
ccgccacggcca

SEQ ID NO: 1004029 - DNA, 16 bp, Homo sapiens
ccgccacgtcccagca

SEQ ID NO: 1004030 - DNA, 19 bp, Homo sapiens
ccgccactaggtgtcccca

SEQ ID NO: 1004031 - DNA, 21 bp, Homo sapiens
ccgccagaccccgtggctctg

SEQ ID NO: 1004032 - DNA, 17 bp, Homo sapiens
ccgccagccccaagctg

SEQ ID NO: 1004033 - DNA, 14 bp, Homo sapiens
ccgccagcctcctc

SEQ ID NO: 1004034 - DNA, 14 bp, Homo sapiens
ccgccagctgggag

SEQ ID NO: 1004035 - DNA, 12 bp, Homo sapiens
ccgccagggctg

SEQ ID NO: 1004036 - DNA, 15 bp, Homo sapiens
ccgccagggctgggg

SEQ ID NO: 1004037 - DNA, 16 bp, Homo sapiens
ccgccatagccccagt

SEQ ID NO: 1004038 - DNA, 22 bp, Homo sapiens
ccgccatccagggtctggcaga

SEQ ID NO: 1004039 - DNA, 15 bp, Homo sapiens
ccgccatctgcgcag

SEQ ID NO: 1004040 - DNA, 16 bp, Homo sapiens
ccgccatgctcctggc

SEQ ID NO: 1004041 - DNA, 16 bp, Homo sapiens
ccgccattgccaccag

SEQ ID NO: 1004042 - DNA, 23 bp, Homo sapiens
ccgcccacaggaagcctgcagtc

SEQ ID NO: 1004043 - DNA, 12 bp, Homo sapiens
ccgcccacctcg

SEQ ID NO: 1004044 - DNA, 15 bp, Homo sapiens
ccgcccacgccggcc

SEQ ID NO: 1004045 - DNA, 21 bp, Homo sapiens
ccgcccacgccggcctctgct

SEQ ID NO: 1004046 - DNA, 12 bp, Homo sapiens
ccgcccagctct

SEQ ID NO: 1004047 - DNA, 15 bp, Homo sapiens
ccgcccagctctccc

SEQ ID NO: 1004048 - DNA, 23 bp, Homo sapiens
ccgcccattctgacccagggcct

SEQ ID NO: 1004049 - DNA, 13 bp, Homo sapiens
ccgccccacattc

SEQ ID NO: 1004050 - DNA, 14 bp, Homo sapiens
attaaaagaatatc

SEQ ID NO: 1004051 - DNA, 16 bp, Homo sapiens
attaaaagaatatctg

SEQ ID NO: 1004052 - DNA, 14 bp, Homo sapiens
attaaaagcacaag

SEQ ID NO: 1004053 - DNA, 18 bp, Homo sapiens
attaaaagcccactgtgg

SEQ ID NO: 1004054 - DNA, 16 bp, Homo sapiens
attaaaaggaaagtca

SEQ ID NO: 1004055 - DNA, 15 bp, Homo sapiens
attaaaagtttgaaa

SEQ ID NO: 1004056 - DNA, 18 bp, Homo sapiens
attaaaataaaacaagcc

SEQ ID NO: 1004057 - DNA, 13 bp, Homo sapiens
attaaaatagcat

SEQ ID NO: 1004058 - DNA, 19 bp, Homo sapiens
attaaaatagcatactgtg

SEQ ID NO: 1004059 - DNA, 22 bp, Homo sapiens
attaaaatagcatactgtgtat

SEQ ID NO: 1004060 - DNA, 11 bp, Homo sapiens
attaaaatata

SEQ ID NO: 1004061 - DNA, 17 bp, Homo sapiens
attaaaatatatgttct

SEQ ID NO: 1004062 - DNA, 14 bp, Homo sapiens
attaaaatattatt

SEQ ID NO: 1004063 - DNA, 18 bp, Homo sapiens
attaaaatattatttgat

SEQ ID NO: 1004064 - DNA, 14 bp, Homo sapiens
attaaaatatttca

SEQ ID NO: 1004065 - DNA, 14 bp, Homo sapiens
attaaaatattttg

SEQ ID NO: 1004066 - DNA, 16 bp, Homo sapiens
attaaaatctggaaat

SEQ ID NO: 1004067 - DNA, 15 bp, Homo sapiens
attaaaatcttaaac

SEQ ID NO: 1004068 - DNA, 14 bp, Homo sapiens
attaaaattctgaa

SEQ ID NO: 1004069 - DNA, 16 bp, Homo sapiens
attaaaattttacctc

SEQ ID NO: 1004070 - DNA, 20 bp, Homo sapiens
attaaacaaagtttcagagt

SEQ ID NO: 1004071 - DNA, 13 bp, Homo sapiens
attaaacaaataa

SEQ ID NO: 1004072 - DNA, 15 bp, Homo sapiens
attaaacaatttatt

SEQ ID NO: 1004073 - DNA, 16 bp, Homo sapiens
attaaacaatttattt

SEQ ID NO: 1004074 - DNA, 15 bp, Homo sapiens
attaagcagaaacag

SEQ ID NO: 1004075 - DNA, 17 bp, Homo sapiens
attaagcagactggaaa

SEQ ID NO: 1004076 - DNA, 19 bp, Homo sapiens
attaagcagtaaaaactgt

SEQ ID NO: 1004077 - DNA, 20 bp, Homo sapiens
attaagcattttgaaacaaa

SEQ ID NO: 1004078 - DNA, 21 bp, Homo sapiens
attaagcattttgaaacaaag

SEQ ID NO: 1004079 - DNA, 14 bp, Homo sapiens
attaagccaaacat

SEQ ID NO: 1004080 - DNA, 15 bp, Homo sapiens
attaagccaaacatg

SEQ ID NO: 1004081 - DNA, 16 bp, Homo sapiens
attaagccaaacatga

SEQ ID NO: 1004082 - DNA, 20 bp, Homo sapiens
attaagcccacagtatattt

SEQ ID NO: 1004083 - DNA, 22 bp, Homo sapiens
attaagctgttcctgttcagta

SEQ ID NO: 1004084 - DNA, 16 bp, Homo sapiens
attaagggctacttaa

SEQ ID NO: 1004085 - DNA, 22 bp, Homo sapiens
attaagggtaggatgttgcttc

SEQ ID NO: 1004086 - DNA, 17 bp, Homo sapiens
attaaggtcaagcccag

SEQ ID NO: 1004087 - DNA, 12 bp, Homo sapiens
attaaggttttc

SEQ ID NO: 1004088 - DNA, 14 bp, Homo sapiens
attaagtaaatgct

SEQ ID NO: 1004089 - DNA, 22 bp, Homo sapiens
attaagtaatctttttacagtt

SEQ ID NO: 1004090 - DNA, 14 bp, Homo sapiens
attaagtactatgt

SEQ ID NO: 1004091 - DNA, 19 bp, Homo sapiens
attaagtcattttgtaata

SEQ ID NO: 1004092 - DNA, 20 bp, Homo sapiens
attaagtggttactttgtgt

SEQ ID NO: 1004093 - DNA, 12 bp, Homo sapiens
attaagttgaaa

SEQ ID NO: 1004094 - DNA, 13 bp, Homo sapiens
attaagttgaaaa

SEQ ID NO: 1004095 - DNA, 19 bp, Homo sapiens
attaagttgttaataaaag

SEQ ID NO: 1004096 - DNA, 12 bp, Homo sapiens
attaataaaaag

SEQ ID NO: 1004097 - DNA, 13 bp, Homo sapiens
attaataaagaaa

SEQ ID NO: 1004098 - DNA, 11 bp, Homo sapiens
attaataaagc

SEQ ID NO: 1004099 - DNA, 12 bp, Homo sapiens
attaataaagca

SEQ ID NO: 1004100 - DNA, 14 bp, Homo sapiens
attaataaagcatt

SEQ ID NO: 1004101 - DNA, 13 bp, Homo sapiens
attaatacagagt

SEQ ID NO: 1004102 - DNA, 20 bp, Homo sapiens
attaataccaaatattttag

SEQ ID NO: 1004103 - DNA, 17 bp, Homo sapiens
attaatagcagcctttc

SEQ ID NO: 1004104 - DNA, 13 bp, Homo sapiens
attaatagctttt

SEQ ID NO: 1004105 - DNA, 18 bp, Homo sapiens
attaatagcttttattgt

SEQ ID NO: 1004106 - DNA, 23 bp, Homo sapiens
attaatagcttttattgtataaa

SEQ ID NO: 1004107 - DNA, 20 bp, Homo sapiens
attaatatatgtattattta

SEQ ID NO: 1004108 - DNA, 12 bp, Homo sapiens
attaatatatta

SEQ ID NO: 1004109 - DNA, 14 bp, Homo sapiens
attaatatattaaa

SEQ ID NO: 1004110 - DNA, 16 bp, Homo sapiens
attaatatatttaata

SEQ ID NO: 1004111 - DNA, 14 bp, Homo sapiens
attaatatgaaaac

SEQ ID NO: 1004112 - DNA, 13 bp, Homo sapiens
attaatatgagtt

SEQ ID NO: 1004113 - DNA, 11 bp, Homo sapiens
attaatattta

SEQ ID NO: 1004114 - DNA, 11 bp, Homo sapiens
attaatcaaag

SEQ ID NO: 1004115 - DNA, 11 bp, Homo sapiens
attaatcaaga

SEQ ID NO: 1004116 - DNA, 16 bp, Homo sapiens
attaatcaagagaaac

SEQ ID NO: 1004117 - DNA, 17 bp, Homo sapiens
attaatcaagagaaact

SEQ ID NO: 1004118 - DNA, 20 bp, Homo sapiens
attaatcaagagaaacttca

SEQ ID NO: 1004119 - DNA, 23 bp, Homo sapiens
attaatcaatcatctgtgtgaaa

SEQ ID NO: 1004120 - DNA, 18 bp, Homo sapiens
attaatcacctctctgta

SEQ ID NO: 1004121 - DNA, 16 bp, Homo sapiens
attaatcactattgtt

SEQ ID NO: 1004122 - DNA, 20 bp, Homo sapiens
attaatcatacaaactctca

SEQ ID NO: 1004123 - DNA, 14 bp, Homo sapiens
attaatcatagatt

SEQ ID NO: 1004124 - DNA, 14 bp, Homo sapiens
attaatcatctata

SEQ ID NO: 1004125 - DNA, 23 bp, Homo sapiens
attaatccccatcattactggta

SEQ ID NO: 1004126 - DNA, 23 bp, Homo sapiens
attaatcctgtttttagtgctga

SEQ ID NO: 1004127 - DNA, 19 bp, Homo sapiens
attaatctgtttgtgcaaa

SEQ ID NO: 1004128 - DNA, 16 bp, Homo sapiens
attaatcttagtgtat

SEQ ID NO: 1004129 - DNA, 23 bp, Homo sapiens
attaatctttctttacctgagac

SEQ ID NO: 1004130 - DNA, 14 bp, Homo sapiens
attaatgataaact

SEQ ID NO: 1004131 - DNA, 17 bp, Homo sapiens
attaatgcattttgctg

SEQ ID NO: 1004132 - DNA, 15 bp, Homo sapiens
attaatgcctgcttt

SEQ ID NO: 1004133 - DNA, 16 bp, Homo sapiens
attaatgcctttaaag

SEQ ID NO: 1004134 - DNA, 21 bp, Homo sapiens
attaatgcctttaaagtatga

SEQ ID NO: 1004135 - DNA, 16 bp, Homo sapiens
attaatgcttagtgaa

SEQ ID NO: 1004136 - DNA, 16 bp, Homo sapiens
attaatgtacttgttt

SEQ ID NO: 1004137 - DNA, 13 bp, Homo sapiens
attaatgttaatt

SEQ ID NO: 1004138 - DNA, 19 bp, Homo sapiens
attaatgtttatttagctc

SEQ ID NO: 1004139 - DNA, 12 bp, Homo sapiens
attaatgtttct

SEQ ID NO: 1004140 - DNA, 16 bp, Homo sapiens
attaatgtttctatct

SEQ ID NO: 1004141 - DNA, 20 bp, Homo sapiens
attaatgtttctatctgatt

SEQ ID NO: 1004142 - DNA, 22 bp, Homo sapiens
attaatgtttctatctgatttt

SEQ ID NO: 1004143 - DNA, 17 bp, Homo sapiens
attaattaaatgaactt

SEQ ID NO: 1004144 - DNA, 15 bp, Homo sapiens
attaattaatttgga

SEQ ID NO: 1004145 - DNA, 18 bp, Homo sapiens
attaattcctgtttgtct

SEQ ID NO: 1004146 - DNA, 20 bp, Homo sapiens
attaattcctgtttgtctac

SEQ ID NO: 1004147 - DNA, 13 bp, Homo sapiens
attaattctataa

SEQ ID NO: 1004148 - DNA, 12 bp, Homo sapiens
attaattcttca

SEQ ID NO: 1004149 - DNA, 16 bp, Homo sapiens
attaattcttcacctg

SEQ ID NO: 1004150 - DNA, 17 bp, Homo sapiens
attaattgcctgttaaa

SEQ ID NO: 1004151 - DNA, 23 bp, Homo sapiens
attaattgcctgttaaatataca

SEQ ID NO: 1004152 - DNA, 12 bp, Homo sapiens
attaattgcttt

SEQ ID NO: 1004153 - DNA, 14 bp, Homo sapiens
attaattgctttga

SEQ ID NO: 1004154 - DNA, 23 bp, Homo sapiens
attaattgtcctgtgtctatgta

SEQ ID NO: 1004155 - DNA, 20 bp, Homo sapiens
attaattgttttgcactttt

SEQ ID NO: 1004156 - DNA, 14 bp, Homo sapiens
attaatttcaaaat

SEQ ID NO: 1004157 - DNA, 14 bp, Homo sapiens
attaatttctgata

SEQ ID NO: 1004158 - DNA, 13 bp, Homo sapiens
attaatttctgcc

SEQ ID NO: 1004159 - DNA, 14 bp, Homo sapiens
attaatttgagaat

SEQ ID NO: 1004160 - DNA, 14 bp, Homo sapiens
attaatttgtgaat

SEQ ID NO: 1004161 - DNA, 16 bp, Homo sapiens
attaatttgtgaattt

SEQ ID NO: 1004162 - DNA, 17 bp, Homo sapiens
attaatttgtgaatttg

SEQ ID NO: 1004163 - DNA, 13 bp, Homo sapiens
attaattttactc

SEQ ID NO: 1004164 - DNA, 19 bp, Homo sapiens
attaattttgtgcattctt

SEQ ID NO: 1004165 - DNA, 20 bp, Homo sapiens
attaattttgtgcattcttt

SEQ ID NO: 1004166 - DNA, 24 bp, Homo sapiens
attaattttgtgcattctttggta

SEQ ID NO: 1004167 - DNA, 13 bp, Homo sapiens
attacaaaaacaa

SEQ ID NO: 1004168 - DNA, 16 bp, Homo sapiens
attacaaacaagtgga

SEQ ID NO: 1004169 - DNA, 13 bp, Homo sapiens
attacaaagttaa

SEQ ID NO: 1004170 - DNA, 15 bp, Homo sapiens
attacaaagttaaaa

SEQ ID NO: 1004171 - DNA, 23 bp, Homo sapiens
attacaaagttaaaattgttatc

SEQ ID NO: 1004172 - DNA, 16 bp, Homo sapiens
attacaaataaacagt

SEQ ID NO: 1004173 - DNA, 20 bp, Homo sapiens
attacaaataaacagttgtt

SEQ ID NO: 1004174 - DNA, 18 bp, Homo sapiens
attacaaatcagaagtca

SEQ ID NO: 1004175 - DNA, 21 bp, Homo sapiens
attacaaatcagaagtcatct

SEQ ID NO: 1004176 - DNA, 21 bp, Homo sapiens
attacaaattttcactgctgc

SEQ ID NO: 1004177 - DNA, 15 bp, Homo sapiens
attacaagccctggg

SEQ ID NO: 1004178 - DNA, 13 bp, Homo sapiens
attacaagtggct

SEQ ID NO: 1004179 - DNA, 14 bp, Homo sapiens
attacaatgtatct

SEQ ID NO: 1004180 - DNA, 17 bp, Homo sapiens
attacaatgtatcttta

SEQ ID NO: 1004181 - DNA, 21 bp, Homo sapiens
attacaatgtatctttattaa

SEQ ID NO: 1004182 - DNA, 12 bp, Homo sapiens
ccgctctgattt

SEQ ID NO: 1004183 - DNA, 18 bp, Homo sapiens
ccgctctggatcctgcac

SEQ ID NO: 1004184 - DNA, 19 bp, Homo sapiens
ccgctctggatcctgcact

SEQ ID NO: 1004185 - DNA, 23 bp, Homo sapiens
ccgctgagcgaggagatgctcct

SEQ ID NO: 1004186 - DNA, 21 bp, Homo sapiens
ccgctgagcgcccccgagccc

SEQ ID NO: 1004187 - DNA, 19 bp, Homo sapiens
ccgctgagctgagtggcca

SEQ ID NO: 1004188 - DNA, 22 bp, Homo sapiens
ccgctgagctgagtggccagcc

SEQ ID NO: 1004189 - DNA, 14 bp, Homo sapiens
ccgctgagcttgga

SEQ ID NO: 1004190 - DNA, 13 bp, Homo sapiens
ccgctgaggggtc

SEQ ID NO: 1004191 - DNA, 16 bp, Homo sapiens
ccgctgcaatgcctag

SEQ ID NO: 1004192 - DNA, 19 bp, Homo sapiens
ccgctgcaatgcctagact

SEQ ID NO: 1004193 - DNA, 15 bp, Homo sapiens
ccgctgcacacagac

SEQ ID NO: 1004194 - DNA, 20 bp, Homo sapiens
ccgctgcacacagacggcct

SEQ ID NO: 1004195 - DNA, 13 bp, Homo sapiens
ccgctgcacctgc

SEQ ID NO: 1004196 - DNA, 17 bp, Homo sapiens
ccgctgcagggctccca

SEQ ID NO: 1004197 - DNA, 18 bp, Homo sapiens
ccggcggctctgagcagg

SEQ ID NO: 1004198 - DNA, 16 bp, Homo sapiens
ccggcgggcgggccgg

SEQ ID NO: 1004199 - DNA, 21 bp, Homo sapiens
ccggcgtcttgcccagcagct

SEQ ID NO: 1004200 - DNA, 17 bp, Homo sapiens
ccggctatgggggcact

SEQ ID NO: 1004201 - DNA, 22 bp, Homo sapiens
ccggctatgggggcactgagga

SEQ ID NO: 1004202 - DNA, 23 bp, Homo sapiens
ccggctcgagcagtcctgcctca

SEQ ID NO: 1004203 - DNA, 18 bp, Homo sapiens
ccggctgcccccatcacc

SEQ ID NO: 1004204 - DNA, 12 bp, Homo sapiens
ccggctgcctgc

SEQ ID NO: 1004205 - DNA, 14 bp, Homo sapiens
ccggctgcctgccg

SEQ ID NO: 1004206 - DNA, 18 bp, Homo sapiens
ccggctgctcctccagcc

SEQ ID NO: 1004207 - DNA, 12 bp, Homo sapiens
ccggctgctgct

SEQ ID NO: 1004208 - DNA, 21 bp, Homo sapiens
ccggctgctgtgtgtgagcag

SEQ ID NO: 1004209 - DNA, 12 bp, Homo sapiens
ccggctggaaat

SEQ ID NO: 1004210 - DNA, 15 bp, Homo sapiens
ccggctgggcctcct

SEQ ID NO: 1004211 - DNA, 20 bp, Homo sapiens
ccggctgggtcggccctgcc

SEQ ID NO: 1004212 - DNA, 23 bp, Homo sapiens
ccggctgggtcggccctgcccaa

SEQ ID NO: 1004213 - DNA, 17 bp, Homo sapiens
ccggctgtgctcagaga

SEQ ID NO: 1004214 - DNA, 23 bp, Homo sapiens
ccggctgtggagcaaaaggcagc

SEQ ID NO: 1004215 - DNA, 14 bp, Homo sapiens
ccggcttctcggct

SEQ ID NO: 1004216 - DNA, 12 bp, Homo sapiens
ccggctttcctc

SEQ ID NO: 1004217 - DNA, 13 bp, Homo sapiens
ccgggaagagcca

SEQ ID NO: 1004218 - DNA, 15 bp, Homo sapiens
ccgggacaccgtggg

SEQ ID NO: 1004219 - DNA, 21 bp, Homo sapiens
ccgggacaccgtggggaaggg

SEQ ID NO: 1004220 - DNA, 13 bp, Homo sapiens
ccgggaccctcag

SEQ ID NO: 1004221 - DNA, 20 bp, Homo sapiens
ccgggaccctcaggtgtagc

SEQ ID NO: 1004222 - DNA, 21 bp, Homo sapiens
ccgggaccctgctcacaggca

SEQ ID NO: 1004223 - DNA, 17 bp, Homo sapiens
ccgggacctggtgctgc

SEQ ID NO: 1004224 - DNA, 17 bp, Homo sapiens
ccgggagaaggcatgag

SEQ ID NO: 1004225 - DNA, 12 bp, Homo sapiens
ccgggagagggg

SEQ ID NO: 1004226 - DNA, 19 bp, Homo sapiens
ccgggagcctaggaccact

SEQ ID NO: 1004227 - DNA, 15 bp, Homo sapiens
ccgggagcctccccc

SEQ ID NO: 1004228 - DNA, 19 bp, Homo sapiens
ccgggagcctccccctcag

SEQ ID NO: 1004229 - DNA, 20 bp, Homo sapiens
ccgggagcctccccctcaga

SEQ ID NO: 1004230 - DNA, 11 bp, Homo sapiens
ccgggagctgg

SEQ ID NO: 1004231 - DNA, 14 bp, Homo sapiens
ccgggaggcagtgc

SEQ ID NO: 1004232 - DNA, 17 bp, Homo sapiens
ccgggcaggggagccag

SEQ ID NO: 1004233 - DNA, 19 bp, Homo sapiens
ccgggcaggggagccaggg

SEQ ID NO: 1004234 - DNA, 21 bp, Homo sapiens
ccgggcaggtcctgcccatgt

SEQ ID NO: 1004235 - DNA, 22 bp, Homo sapiens
ccgggcatggtggcgcaagcct

SEQ ID NO: 1004236 - DNA, 22 bp, Homo sapiens
ccgggccaagacagatggacac

SEQ ID NO: 1004237 - DNA, 18 bp, Homo sapiens
ccgggccacgccccagcc

SEQ ID NO: 1004238 - DNA, 12 bp, Homo sapiens
ccgggcccccgc

SEQ ID NO: 1004239 - DNA, 15 bp, Homo sapiens
ccgggcccccgcccc

SEQ ID NO: 1004240 - DNA, 16 bp, Homo sapiens
ccgggcccctgggctt

SEQ ID NO: 1004241 - DNA, 18 bp, Homo sapiens
ccgggccctcccttggaa

SEQ ID NO: 1004242 - DNA, 22 bp, Homo sapiens
ccgggccgaccctgcggcctcc

SEQ ID NO: 1004243 - DNA, 22 bp, Homo sapiens
ccgggccggacctgagcccgca

SEQ ID NO: 1004244 - DNA, 14 bp, Homo sapiens
ccgggcctggggct

SEQ ID NO: 1004245 - DNA, 17 bp, Homo sapiens
ccgggcctttctctggc

SEQ ID NO: 1004246 - DNA, 17 bp, Homo sapiens
ccgggcgccaggacagc

SEQ ID NO: 1004247 - DNA, 18 bp, Homo sapiens
ccgggcgccaggacagca

SEQ ID NO: 1004248 - DNA, 14 bp, Homo sapiens
ccgggcgcggtggc

SEQ ID NO: 1004249 - DNA, 16 bp, Homo sapiens
ccgggcgtgtgaagaa

SEQ ID NO: 1004250 - DNA, 20 bp, Homo sapiens
ccgggctccatgcctctgga

SEQ ID NO: 1004251 - DNA, 13 bp, Homo sapiens
ccgggctctggcc

SEQ ID NO: 1004252 - DNA, 15 bp, Homo sapiens
ccgggctctggccac

SEQ ID NO: 1004253 - DNA, 17 bp, Homo sapiens
ccgggctctggccaccc

SEQ ID NO: 1004254 - DNA, 12 bp, Homo sapiens
ccgggctgcctg

SEQ ID NO: 1004255 - DNA, 14 bp, Homo sapiens
ccgggctgcctgcc

SEQ ID NO: 1004256 - DNA, 15 bp, Homo sapiens
ccgggctgcctgggc

SEQ ID NO: 1004257 - DNA, 15 bp, Homo sapiens
ccgggctggccctgt

SEQ ID NO: 1004258 - DNA, 21 bp, Homo sapiens
ccgggctggctgcttgcagcc

SEQ ID NO: 1004259 - DNA, 22 bp, Homo sapiens
ccgggctggctgcttgcagcca

SEQ ID NO: 1004260 - DNA, 13 bp, Homo sapiens
ccgggctgggagc

SEQ ID NO: 1004261 - DNA, 19 bp, Homo sapiens
ccgggctgggagctctgca

SEQ ID NO: 1004262 - DNA, 20 bp, Homo sapiens
ccgggctgtagatcaggttt

SEQ ID NO: 1004263 - DNA, 13 bp, Homo sapiens
ccggggagctgca

SEQ ID NO: 1004264 - DNA, 11 bp, Homo sapiens
ccggggagggg

SEQ ID NO: 1004265 - DNA, 16 bp, Homo sapiens
ccggggaggggcagag

SEQ ID NO: 1004266 - DNA, 12 bp, Homo sapiens
ccggggaggggg

SEQ ID NO: 1004267 - DNA, 17 bp, Homo sapiens
ccggggcagcagcagcc

SEQ ID NO: 1004268 - DNA, 21 bp, Homo sapiens
ccggggcatggacagggccag

SEQ ID NO: 1004269 - DNA, 15 bp, Homo sapiens
ccggggcccaggact

SEQ ID NO: 1004270 - DNA, 13 bp, Homo sapiens
ccggggcccctca

SEQ ID NO: 1004271 - DNA, 12 bp, Homo sapiens
ccggggctggca

SEQ ID NO: 1004272 - DNA, 19 bp, Homo sapiens
ccggggctggcaagcaggg

SEQ ID NO: 1004273 - DNA, 20 bp, Homo sapiens
ccggggctggcaagcaggga

SEQ ID NO: 1004274 - DNA, 21 bp, Homo sapiens
ccgggggaggggccctcaggc

SEQ ID NO: 1004275 - DNA, 17 bp, Homo sapiens
ccgggggctgctgggcg

SEQ ID NO: 1004276 - DNA, 12 bp, Homo sapiens
ccggggggaggg

SEQ ID NO: 1004277 - DNA, 13 bp, Homo sapiens
ccggggggagggg

SEQ ID NO: 1004278 - DNA, 23 bp, Homo sapiens
ccggggggggtaggagaggagaa

SEQ ID NO: 1004279 - DNA, 16 bp, Homo sapiens
ccgggggtggctctgt

SEQ ID NO: 1004280 - DNA, 18 bp, Homo sapiens
ccggggtctcctggacct

SEQ ID NO: 1004281 - DNA, 18 bp, Homo sapiens
ccggggtctgtgctgtgc

SEQ ID NO: 1004282 - DNA, 21 bp, Homo sapiens
ccggggtggagcatgggcctg

SEQ ID NO: 1004283 - DNA, 23 bp, Homo sapiens
ccggggtggggtgcactcgccat

SEQ ID NO: 1004284 - DNA, 22 bp, Homo sapiens
ccggggtgggtgggtgggcagg

SEQ ID NO: 1004285 - DNA, 18 bp, Homo sapiens
ccggggttcaagccatgg

SEQ ID NO: 1004286 - DNA, 19 bp, Homo sapiens
ccggggttcaagccatggc

SEQ ID NO: 1004287 - DNA, 16 bp, Homo sapiens
ccgggtcaccctgtga

SEQ ID NO: 1004288 - DNA, 14 bp, Homo sapiens
ccgggtctgcctct

SEQ ID NO: 1004289 - DNA, 20 bp, Homo sapiens
ccgggtggaaaagaatccct

SEQ ID NO: 1004290 - DNA, 15 bp, Homo sapiens
ccgggtgggcctggc

SEQ ID NO: 1004291 - DNA, 16 bp, Homo sapiens
ccgggtgggcctggcc

SEQ ID NO: 1004292 - DNA, 18 bp, Homo sapiens
ccgggtgggcctggcctg

SEQ ID NO: 1004293 - DNA, 20 bp, Homo sapiens
ccgggtgggcctggcctgag

SEQ ID NO: 1004294 - DNA, 18 bp, Homo sapiens
ccgggtgtgcctgccctg

SEQ ID NO: 1004295 - DNA, 16 bp, Homo sapiens
ccgggtgtggcacgca

SEQ ID NO: 1004296 - DNA, 21 bp, Homo sapiens
ccgggtgtggcacgcacctgt

SEQ ID NO: 1004297 - DNA, 22 bp, Homo sapiens
ccgggtgtggcacgcacctgta

SEQ ID NO: 1004298 - DNA, 14 bp, Homo sapiens
ccgggtgtggcctc

SEQ ID NO: 1004299 - DNA, 18 bp, Homo sapiens
ccgggtgtggcctcagcc

SEQ ID NO: 1004300 - DNA, 21 bp, Homo sapiens
ccgggtgtggcctcagccctc

SEQ ID NO: 1004301 - DNA, 21 bp, Homo sapiens
ccgggtttggcgggccaagga

SEQ ID NO: 1004302 - DNA, 19 bp, Homo sapiens
ccgggtttggctgagcctg

SEQ ID NO: 1004303 - DNA, 21 bp, Homo sapiens
ccggtaactgtcctgtcctgc

SEQ ID NO: 1004304 - DNA, 19 bp, Homo sapiens
ccggtaagagcaaaagaat

SEQ ID NO: 1004305 - DNA, 14 bp, Homo sapiens
ccggtaatgtcact

SEQ ID NO: 1004306 - DNA, 23 bp, Homo sapiens
ccggtcagaggagcgcaggcagc

SEQ ID NO: 1004307 - DNA, 15 bp, Homo sapiens
ccggtcaggcacaca

SEQ ID NO: 1004308 - DNA, 23 bp, Homo sapiens
ccggtcaggcacacaaggggccc

SEQ ID NO: 1004309 - DNA, 15 bp, Homo sapiens
ccggtccagctggcc

SEQ ID NO: 1004310 - DNA, 21 bp, Homo sapiens
ccggtccccacagactgcccc

SEQ ID NO: 1004311 - DNA, 18 bp, Homo sapiens
ccggtcccctgcctggaa

SEQ ID NO: 1004312 - DNA, 22 bp, Homo sapiens
attagatattaggggggaaagt

SEQ ID NO: 1004313 - DNA, 22 bp, Homo sapiens
attagatcaattacttatttta

SEQ ID NO: 1004314 - DNA, 19 bp, Homo sapiens
attagatcctaagatgtgt

SEQ ID NO: 1004315 - DNA, 13 bp, Homo sapiens
attagatgtcatg

SEQ ID NO: 1004316 - DNA, 14 bp, Homo sapiens
attagatgtcatga

SEQ ID NO: 1004317 - DNA, 16 bp, Homo sapiens
attagattatttctgt

SEQ ID NO: 1004318 - DNA, 20 bp, Homo sapiens
attagattttattttactat

SEQ ID NO: 1004319 - DNA, 17 bp, Homo sapiens
ccggtgaggggaggggc

SEQ ID NO: 1004320 - DNA, 19 bp, Homo sapiens
ccggtgaggggaggggcct

SEQ ID NO: 1004321 - DNA, 21 bp, Homo sapiens
ccggtgaggggaggggcctcc

SEQ ID NO: 1004322 - DNA, 22 bp, Homo sapiens
ccggtgaggggaggggcctccc

SEQ ID NO: 1004323 - DNA, 23 bp, Homo sapiens
ccggtgaggggaggggcctcccc

SEQ ID NO: 1004324 - DNA, 16 bp, Homo sapiens
ccggtgctgcaggagt

SEQ ID NO: 1004325 - DNA, 17 bp, Homo sapiens
ccggtgcttctggaaac

SEQ ID NO: 1004326 - DNA, 18 bp, Homo sapiens
ccggtggcctattccagg

SEQ ID NO: 1004327 - DNA, 18 bp, Homo sapiens
ccggtgggaccctgtccg

SEQ ID NO: 1004328 - DNA, 16 bp, Homo sapiens
ccggtgtatcctggcc

SEQ ID NO: 1004329 - DNA, 18 bp, Homo sapiens
ccggtgtatcctggccct

SEQ ID NO: 1004330 - DNA, 22 bp, Homo sapiens
ccggtgtatcctggccctgggg

SEQ ID NO: 1004331 - DNA, 19 bp, Homo sapiens
ccggttattcgcccacccg

SEQ ID NO: 1004332 - DNA, 16 bp, Homo sapiens
ccggttcttccagtgg

SEQ ID NO: 1004333 - DNA, 19 bp, Homo sapiens
ccggttgctggtcaggtcc

SEQ ID NO: 1004334 - DNA, 21 bp, Homo sapiens
ccggtttagtcatccaacaag

SEQ ID NO: 1004335 - DNA, 17 bp, Homo sapiens
ccgtaataattattatt

SEQ ID NO: 1004336 - DNA, 12 bp, Homo sapiens
ccgtaccccacc

SEQ ID NO: 1004337 - DNA, 17 bp, Homo sapiens
ccgtaccccaccctcag

SEQ ID NO: 1004338 - DNA, 18 bp, Homo sapiens
ccgtaccccaccctcagc

SEQ ID NO: 1004339 - DNA, 20 bp, Homo sapiens
ccgtaccccaccctcagcac

SEQ ID NO: 1004340 - DNA, 22 bp, Homo sapiens
ccgtacctcttcccatgactgc

SEQ ID NO: 1004341 - DNA, 14 bp, Homo sapiens
ccgtagagaatgtg

SEQ ID NO: 1004342 - DNA, 18 bp, Homo sapiens
ccgtagggagtacctgct

SEQ ID NO: 1004343 - DNA, 11 bp, Homo sapiens
ccgtagtctcc

SEQ ID NO: 1004344 - DNA, 14 bp, Homo sapiens
ccgtagttccctga

SEQ ID NO: 1004345 - DNA, 15 bp, Homo sapiens
ccgtagttccctgaa

SEQ ID NO: 1004346 - DNA, 16 bp, Homo sapiens
ccgtagttccctgaaa

SEQ ID NO: 1004347 - DNA, 22 bp, Homo sapiens
ccgtagttccctgaaaacccag

SEQ ID NO: 1004348 - DNA, 16 bp, Homo sapiens
ccgtatcacagtgttt

SEQ ID NO: 1004349 - DNA, 18 bp, Homo sapiens
ccgtatcacagtgttttt

SEQ ID NO: 1004350 - DNA, 14 bp, Homo sapiens
ccgtatctgtcaca

SEQ ID NO: 1004351 - DNA, 14 bp, Homo sapiens
ccgtatttaaagtt

SEQ ID NO: 1004352 - DNA, 13 bp, Homo sapiens
ccgtcaccaccac

SEQ ID NO: 1004353 - DNA, 22 bp, Homo sapiens
ccgtcaccaccacccctaccac

SEQ ID NO: 1004354 - DNA, 14 bp, Homo sapiens
ccgtcagggcccaa

SEQ ID NO: 1004355 - DNA, 16 bp, Homo sapiens
ccgtcagggcccaagt

SEQ ID NO: 1004356 - DNA, 21 bp, Homo sapiens
ccgtcatggcttaatgtttat

SEQ ID NO: 1004357 - DNA, 19 bp, Homo sapiens
ccgtcattgctgctgctac

SEQ ID NO: 1004358 - DNA, 12 bp, Homo sapiens
ccgtccacccag

SEQ ID NO: 1004359 - DNA, 16 bp, Homo sapiens
ccgtccacccaggctg

SEQ ID NO: 1004360 - DNA, 17 bp, Homo sapiens
ccgtccacccaggctgc

SEQ ID NO: 1004361 - DNA, 19 bp, Homo sapiens
ccgtccacccaggctgcac

SEQ ID NO: 1004362 - DNA, 16 bp, Homo sapiens
ccgtccaggagcctgg

SEQ ID NO: 1004363 - DNA, 21 bp, Homo sapiens
ccgtccatatcagaactgtgc

SEQ ID NO: 1004364 - DNA, 16 bp, Homo sapiens
ccgtccatcccccttc

SEQ ID NO: 1004365 - DNA, 17 bp, Homo sapiens
ccgtccatcccccttct

SEQ ID NO: 1004366 - DNA, 15 bp, Homo sapiens
ccgtccatggcacca

SEQ ID NO: 1004367 - DNA, 17 bp, Homo sapiens
ccgtcccaccagcttca

SEQ ID NO: 1004368 - DNA, 13 bp, Homo sapiens
ccgtcccaggcca

SEQ ID NO: 1004369 - DNA, 15 bp, Homo sapiens
ccgtcccctctcccc

SEQ ID NO: 1004370 - DNA, 15 bp, Homo sapiens
ccgtcccctgcagcc

SEQ ID NO: 1004371 - DNA, 20 bp, Homo sapiens
ccgtcccctgcagcctgggt

SEQ ID NO: 1004372 - DNA, 23 bp, Homo sapiens
ccgtcccctgcagcctgggtctg

SEQ ID NO: 1004373 - DNA, 15 bp, Homo sapiens
ccgtcccgcacagtg

SEQ ID NO: 1004374 - DNA, 15 bp, Homo sapiens
ccgtccctgtccccc

SEQ ID NO: 1004375 - DNA, 17 bp, Homo sapiens
ccgtccctgtcccccag

SEQ ID NO: 1004376 - DNA, 14 bp, Homo sapiens
ccgtccgccctgct

SEQ ID NO: 1004377 - DNA, 14 bp, Homo sapiens
ccgtcctcccgggc

SEQ ID NO: 1004378 - DNA, 16 bp, Homo sapiens
ccgtcctcccgggccc

SEQ ID NO: 1004379 - DNA, 19 bp, Homo sapiens
ccgtcctcccgggccctcc

SEQ ID NO: 1004380 - DNA, 14 bp, Homo sapiens
ccgtcctccctcag

SEQ ID NO: 1004381 - DNA, 15 bp, Homo sapiens
ccgtcctgctggagt

SEQ ID NO: 1004382 - DNA, 20 bp, Homo sapiens
ccgtcctgctgtccctgtca

SEQ ID NO: 1004383 - DNA, 21 bp, Homo sapiens
ccgtcctgctgtccctgtcag

SEQ ID NO: 1004384 - DNA, 18 bp, Homo sapiens
ccgtcctgggcgtgaccc

SEQ ID NO: 1004385 - DNA, 15 bp, Homo sapiens
ccgtcctgtcactga

SEQ ID NO: 1004386 - DNA, 19 bp, Homo sapiens
ccgtcctgtcactgatgga

SEQ ID NO: 1004387 - DNA, 15 bp, Homo sapiens
ccgtcgaccaggaaa

SEQ ID NO: 1004388 - DNA, 14 bp, Homo sapiens
ccgtcggccctgcg

SEQ ID NO: 1004389 - DNA, 17 bp, Homo sapiens
ccgtcggccctgcgtcg

SEQ ID NO: 1004390 - DNA, 17 bp, Homo sapiens
ccgtctctcctgctctc

SEQ ID NO: 1004391 - DNA, 19 bp, Homo sapiens
ccgtctgactccagagtct

SEQ ID NO: 1004392 - DNA, 20 bp, Homo sapiens
ccgtctgactccagagtctg

SEQ ID NO: 1004393 - DNA, 17 bp, Homo sapiens
ccgtctgcaggggcctg

SEQ ID NO: 1004394 - DNA, 16 bp, Homo sapiens
ccgtctggcccaccag

SEQ ID NO: 1004395 - DNA, 17 bp, Homo sapiens
ccgtctggcccaccagg

SEQ ID NO: 1004396 - DNA, 18 bp, Homo sapiens
ccgtctggcccaccaggg

SEQ ID NO: 1004397 - DNA, 17 bp, Homo sapiens
ccgtctggggttcagcc

SEQ ID NO: 1004398 - DNA, 16 bp, Homo sapiens
ccgtctgtctcgatgc

SEQ ID NO: 1004399 - DNA, 20 bp, Homo sapiens
ccgtctgtctcgatgcctga

SEQ ID NO: 1004400 - DNA, 23 bp, Homo sapiens
ccgtctgtctgtctagtgtctgg

SEQ ID NO: 1004401 - DNA, 22 bp, Homo sapiens
ccgtcttagaagtggaccagga

SEQ ID NO: 1004402 - DNA, 22 bp, Homo sapiens
ccgtcttggggctcgccccacc

SEQ ID NO: 1004403 - DNA, 23 bp, Homo sapiens
ccgtcttgtaaaaaggggaggag

SEQ ID NO: 1004404 - DNA, 16 bp, Homo sapiens
ccgtcttttcctgttt

SEQ ID NO: 1004405 - DNA, 18 bp, Homo sapiens
ccgtgaaccagagggtgt

SEQ ID NO: 1004406 - DNA, 16 bp, Homo sapiens
ccgtgaactgtgcata

SEQ ID NO: 1004407 - DNA, 14 bp, Homo sapiens
ccgtgaagcagtgc

SEQ ID NO: 1004408 - DNA, 23 bp, Homo sapiens
ccgtgacagatgccaacttccca

SEQ ID NO: 1004409 - DNA, 20 bp, Homo sapiens
ccgtgacctattcaccctcc

SEQ ID NO: 1004410 - DNA, 21 bp, Homo sapiens
ccgtgagtgacatagcctcat

SEQ ID NO: 1004411 - DNA, 15 bp, Homo sapiens
ccgtgatagaaaaaa

SEQ ID NO: 1004412 - DNA, 23 bp, Homo sapiens
ccgtgatccatccatctccaggg

SEQ ID NO: 1004413 - DNA, 20 bp, Homo sapiens
ccgtgcatcccccctgctca

SEQ ID NO: 1004414 - DNA, 22 bp, Homo sapiens
ccgtgccacccgtaggcagcct

SEQ ID NO: 1004415 - DNA, 23 bp, Homo sapiens
ccgtgccattgtactccagcctg

SEQ ID NO: 1004416 - DNA, 20 bp, Homo sapiens
ccgtgcccaggggcccacag

SEQ ID NO: 1004417 - DNA, 19 bp, Homo sapiens
ccgtgccccacctccccac

SEQ ID NO: 1004418 - DNA, 14 bp, Homo sapiens
ccgtgcccgcagga

SEQ ID NO: 1004419 - DNA, 18 bp, Homo sapiens
ccgtgcccttgcccttgg

SEQ ID NO: 1004420 - DNA, 22 bp, Homo sapiens
ccgtgccggcggcagccccact

SEQ ID NO: 1004421 - DNA, 23 bp, Homo sapiens
ccgtgcctccaccaccactggcc

SEQ ID NO: 1004422 - DNA, 13 bp, Homo sapiens
ccgtgcctggcca

SEQ ID NO: 1004423 - DNA, 13 bp, Homo sapiens
ccgtgcctggcta

SEQ ID NO: 1004424 - DNA, 13 bp, Homo sapiens
ccgtgcctgggcc

SEQ ID NO: 1004425 - DNA, 18 bp, Homo sapiens
ccgtgcctgggcccctcc

SEQ ID NO: 1004426 - DNA, 15 bp, Homo sapiens
ccgtgcgagctgccg

SEQ ID NO: 1004427 - DNA, 14 bp, Homo sapiens
ccgtgctgacagct

SEQ ID NO: 1004428 - DNA, 19 bp, Homo sapiens
ccgtgctgacagctgctcc

SEQ ID NO: 1004429 - DNA, 20 bp, Homo sapiens
ccgtgctgacagctgctcct

SEQ ID NO: 1004430 - DNA, 21 bp, Homo sapiens
ccgtgctgacagctgctccta

SEQ ID NO: 1004431 - DNA, 15 bp, Homo sapiens
ccgtgctgggcagcc

SEQ ID NO: 1004432 - DNA, 12 bp, Homo sapiens
ccgtggacaccc

SEQ ID NO: 1004433 - DNA, 14 bp, Homo sapiens
ccgtggacacccca

SEQ ID NO: 1004434 - DNA, 15 bp, Homo sapiens
ccgtggaccttcctg

SEQ ID NO: 1004435 - DNA, 13 bp, Homo sapiens
ccgtggactgcag

SEQ ID NO: 1004436 - DNA, 16 bp, Homo sapiens
ccgtggagactgagat

SEQ ID NO: 1004437 - DNA, 23 bp, Homo sapiens
ccgtggagatgggatgcttgcct

SEQ ID NO: 1004438 - DNA, 22 bp, Homo sapiens
ccgtggagtcggagtggacacc

SEQ ID NO: 1004439 - DNA, 21 bp, Homo sapiens
attatcctttcctcattaaat

SEQ ID NO: 1004440 - DNA, 21 bp, Homo sapiens
attatcggaagcagtgccttc

SEQ ID NO: 1004441 - DNA, 22 bp, Homo sapiens
cctacaagatttagaaaaaagt

SEQ ID NO: 1004442 - DNA, 22 bp, Homo sapiens
cctacacactgtcatgcttcat

SEQ ID NO: 1004443 - DNA, 16 bp, Homo sapiens
attattttaaaatatt

SEQ ID NO: 1004444 - DNA, 17 bp, Homo sapiens
attattttaaaatattt

SEQ ID NO: 1004445 - DNA, 13 bp, Homo sapiens
attattttaaaca

SEQ ID NO: 1004446 - DNA, 14 bp, Homo sapiens
attattttaaacaa

SEQ ID NO: 1004447 - DNA, 18 bp, Homo sapiens
attattttaatattttgt

SEQ ID NO: 1004448 - DNA, 13 bp, Homo sapiens
attattttatatc

SEQ ID NO: 1004449 - DNA, 16 bp, Homo sapiens
attattttattgtgta

SEQ ID NO: 1004450 - DNA, 13 bp, Homo sapiens
attattttcaagg

SEQ ID NO: 1004451 - DNA, 22 bp, Homo sapiens
attattttctgtcagatgagaa

SEQ ID NO: 1004452 - DNA, 14 bp, Homo sapiens
attattttcttcat

SEQ ID NO: 1004453 - DNA, 14 bp, Homo sapiens
attatttttaccta

SEQ ID NO: 1004454 - DNA, 17 bp, Homo sapiens
attatttttcactctaa

SEQ ID NO: 1004455 - DNA, 18 bp, Homo sapiens
attatttttgtgtttcta

SEQ ID NO: 1004456 - DNA, 23 bp, Homo sapiens
attcaaaaagacagcagacaaaa

SEQ ID NO: 1004457 - DNA, 14 bp, Homo sapiens
attcaaaaagtgtt

SEQ ID NO: 1004458 - DNA, 17 bp, Homo sapiens
attcaaaaagtgtttat

SEQ ID NO: 1004459 - DNA, 13 bp, Homo sapiens
attcaaaacgtga

SEQ ID NO: 1004460 - DNA, 12 bp, Homo sapiens
attcaaaatatt

SEQ ID NO: 1004461 - DNA, 15 bp, Homo sapiens
attcaaaatatttaa

SEQ ID NO: 1004462 - DNA, 17 bp, Homo sapiens
attcaaacatattcttt

SEQ ID NO: 1004463 - DNA, 19 bp, Homo sapiens
attcaaaccaaagctgcct

SEQ ID NO: 1004464 - DNA, 20 bp, Homo sapiens
attcaaaccaatttcttcct

SEQ ID NO: 1004465 - DNA, 21 bp, Homo sapiens
attcaaaccaatttcttcctt

SEQ ID NO: 1004466 - DNA, 19 bp, Homo sapiens
attcaaactggggcctcca

SEQ ID NO: 1004467 - DNA, 13 bp, Homo sapiens
attcaaagagaaa

SEQ ID NO: 1004468 - DNA, 23 bp, Homo sapiens
attcaaagtgttgtgttcctggc

SEQ ID NO: 1004469 - DNA, 14 bp, Homo sapiens
attcaaatcagtga

SEQ ID NO: 1004470 - DNA, 18 bp, Homo sapiens
attcaaatgaactttaaa

SEQ ID NO: 1004471 - DNA, 20 bp, Homo sapiens
attcaaattatgtataaata

SEQ ID NO: 1004472 - DNA, 16 bp, Homo sapiens
attcaaattgctgctt

SEQ ID NO: 1004473 - DNA, 17 bp, Homo sapiens
attcaacaatttcaata

SEQ ID NO: 1004474 - DNA, 22 bp, Homo sapiens
attcaacaatttcaataaaaga

SEQ ID NO: 1004475 - DNA, 19 bp, Homo sapiens
attcaaccactgtaaaatg

SEQ ID NO: 1004476 - DNA, 22 bp, Homo sapiens
attcaaccactgtaaaatgaaa

SEQ ID NO: 1004477 - DNA, 14 bp, Homo sapiens
attcaacttttcta

SEQ ID NO: 1004478 - DNA, 19 bp, Homo sapiens
attcaagaaaagtaagccc

SEQ ID NO: 1004479 - DNA, 15 bp, Homo sapiens
attcaagaaaataaa

SEQ ID NO: 1004480 - DNA, 19 bp, Homo sapiens
attcaagagctagaaaaat

SEQ ID NO: 1004481 - DNA, 14 bp, Homo sapiens
attcaagagtgggg

SEQ ID NO: 1004482 - DNA, 17 bp, Homo sapiens
attcaagagtgggggga

SEQ ID NO: 1004483 - DNA, 15 bp, Homo sapiens
attcaagcaaacatc

SEQ ID NO: 1004484 - DNA, 21 bp, Homo sapiens
attcaagccattccaaagttc

SEQ ID NO: 1004485 - DNA, 19 bp, Homo sapiens
attcaagcctctaaacaga

SEQ ID NO: 1004486 - DNA, 22 bp, Homo sapiens
attcaagcctgtgaataaaaac

SEQ ID NO: 1004487 - DNA, 15 bp, Homo sapiens
attcaagctatttaa

SEQ ID NO: 1004488 - DNA, 16 bp, Homo sapiens
attcaagctgagaaaa

SEQ ID NO: 1004489 - DNA, 17 bp, Homo sapiens
attcaaggaatttctta

SEQ ID NO: 1004490 - DNA, 18 bp, Homo sapiens
attcaaggaatttcttaa

SEQ ID NO: 1004491 - DNA, 20 bp, Homo sapiens
attcaaggaatttcttaact

SEQ ID NO: 1004492 - DNA, 21 bp, Homo sapiens
attcaaggcatttctatcaca

SEQ ID NO: 1004493 - DNA, 21 bp, Homo sapiens
attcaaggccacaaaaacaat

SEQ ID NO: 1004494 - DNA, 15 bp, Homo sapiens
attcaaggtggccaa

SEQ ID NO: 1004495 - DNA, 10 bp, Homo sapiens
attcaagtaa

SEQ ID NO: 1004496 - DNA, 15 bp, Homo sapiens
attcaagtaacactt

SEQ ID NO: 1004497 - DNA, 12 bp, Homo sapiens
attcaagtgcct

SEQ ID NO: 1004498 - DNA, 20 bp, Homo sapiens
attcaagtgtaaaatatttt

SEQ ID NO: 1004499 - DNA, 16 bp, Homo sapiens
attcaagttattgtac

SEQ ID NO: 1004500 - DNA, 19 bp, Homo sapiens
attcaataccgctcagtat

SEQ ID NO: 1004501 - DNA, 22 bp, Homo sapiens
attcaataccgctcagtatttt

SEQ ID NO: 1004502 - DNA, 13 bp, Homo sapiens
attcaatattgac

SEQ ID NO: 1004503 - DNA, 16 bp, Homo sapiens
attcaatcatttattc

SEQ ID NO: 1004504 - DNA, 24 bp, Homo sapiens
attcaattagtggtcataaaatag

SEQ ID NO: 1004505 - DNA, 16 bp, Homo sapiens
attcaattcaaagctg

SEQ ID NO: 1004506 - DNA, 18 bp, Homo sapiens
attcaattcctctgggaa

SEQ ID NO: 1004507 - DNA, 14 bp, Homo sapiens
attcaattgtaaat

SEQ ID NO: 1004508 - DNA, 22 bp, Homo sapiens
attcaattgtaaattgaatcag

SEQ ID NO: 1004509 - DNA, 19 bp, Homo sapiens
attcacaacctcaccaaac

SEQ ID NO: 1004510 - DNA, 15 bp, Homo sapiens
attcacaagcctcct

SEQ ID NO: 1004511 - DNA, 17 bp, Homo sapiens
attcacaagcctcctgt

SEQ ID NO: 1004512 - DNA, 16 bp, Homo sapiens
attcacaagctaactt

SEQ ID NO: 1004513 - DNA, 13 bp, Homo sapiens
attcacaatagaa

SEQ ID NO: 1004514 - DNA, 20 bp, Homo sapiens
attcacacctcacgctctgg

SEQ ID NO: 1004515 - DNA, 16 bp, Homo sapiens
attcacactgttccag

SEQ ID NO: 1004516 - DNA, 21 bp, Homo sapiens
attcacactttttatttaatt

SEQ ID NO: 1004517 - DNA, 22 bp, Homo sapiens
attcacagaacctactgttcct

SEQ ID NO: 1004518 - DNA, 12 bp, Homo sapiens
attcacagccca

SEQ ID NO: 1004519 - DNA, 13 bp, Homo sapiens
attcacagcccag

SEQ ID NO: 1004520 - DNA, 23 bp, Homo sapiens
attcacagcccagaaccacagat

SEQ ID NO: 1004521 - DNA, 20 bp, Homo sapiens
attcacaggtggacaaatgt

SEQ ID NO: 1004522 - DNA, 19 bp, Homo sapiens
attcacagtgctcttttct

SEQ ID NO: 1004523 - DNA, 21 bp, Homo sapiens
attcacagtgctcttttctcc

SEQ ID NO: 1004524 - DNA, 20 bp, Homo sapiens
attcacagttttttaaaaat

SEQ ID NO: 1004525 - DNA, 14 bp, Homo sapiens
attcacatttagaa

SEQ ID NO: 1004526 - DNA, 16 bp, Homo sapiens
attcacatttgatgta

SEQ ID NO: 1004527 - DNA, 18 bp, Homo sapiens
attcacatttgatgtaca

SEQ ID NO: 1004528 - DNA, 19 bp, Homo sapiens
attcacatttgatgtacat

SEQ ID NO: 1004529 - DNA, 22 bp, Homo sapiens
attcaccaacacagttgggacc

SEQ ID NO: 1004530 - DNA, 20 bp, Homo sapiens
attcaccagatattttgttc

SEQ ID NO: 1004531 - DNA, 15 bp, Homo sapiens
attcaccctccactt

SEQ ID NO: 1004532 - DNA, 20 bp, Homo sapiens
attcaccctccacttcccgt

SEQ ID NO: 1004533 - DNA, 16 bp, Homo sapiens
attcacctcttcctct

SEQ ID NO: 1004534 - DNA, 12 bp, Homo sapiens
attcacctgtaa

SEQ ID NO: 1004535 - DNA, 15 bp, Homo sapiens
attcacctgtaaaac

SEQ ID NO: 1004536 - DNA, 18 bp, Homo sapiens
attcacctgtaaaacttt

SEQ ID NO: 1004537 - DNA, 23 bp, Homo sapiens
attcaccttccagtgtctcggag

SEQ ID NO: 1004538 - DNA, 22 bp, Homo sapiens
attcactcactcactcattcct

SEQ ID NO: 1004539 - DNA, 19 bp, Homo sapiens
attcactcttccagaatcc

SEQ ID NO: 1004540 - DNA, 20 bp, Homo sapiens
attcactgcccccagctctt

SEQ ID NO: 1004541 - DNA, 18 bp, Homo sapiens
attcactgccttcctctc

SEQ ID NO: 1004542 - DNA, 12 bp, Homo sapiens
attcactgtgca

SEQ ID NO: 1004543 - DNA, 15 bp, Homo sapiens
attcactttcatttt

SEQ ID NO: 1004544 - DNA, 23 bp, Homo sapiens
attcacttttgttaacagtattt

SEQ ID NO: 1004545 - DNA, 20 bp, Homo sapiens
attcagaaaatgttctgttt

SEQ ID NO: 1004546 - DNA, 14 bp, Homo sapiens
attcagaaatgtgg

SEQ ID NO: 1004547 - DNA, 16 bp, Homo sapiens
attcagaaatgtggca

SEQ ID NO: 1004548 - DNA, 17 bp, Homo sapiens
attcagaaattaaaata

SEQ ID NO: 1004549 - DNA, 20 bp, Homo sapiens
attcagaaattaaaatatta

SEQ ID NO: 1004550 - DNA, 13 bp, Homo sapiens
attcagaaattgg

SEQ ID NO: 1004551 - DNA, 17 bp, Homo sapiens
attcagacaaaatggat

SEQ ID NO: 1004552 - DNA, 13 bp, Homo sapiens
attcagacaggca

SEQ ID NO: 1004553 - DNA, 11 bp, Homo sapiens
attcagacatc

SEQ ID NO: 1004554 - DNA, 14 bp, Homo sapiens
attcagagagcagc

SEQ ID NO: 1004555 - DNA, 13 bp, Homo sapiens
attcagagtcctt

SEQ ID NO: 1004556 - DNA, 20 bp, Homo sapiens
attcagatcaaaatgccttt

SEQ ID NO: 1004557 - DNA, 15 bp, Homo sapiens
attcagattgtcttg

SEQ ID NO: 1004558 - DNA, 14 bp, Homo sapiens
attcagattttaaa

SEQ ID NO: 1004559 - DNA, 14 bp, Homo sapiens
attcagcaaaccat

SEQ ID NO: 1004560 - DNA, 15 bp, Homo sapiens
attcagcaaaccatt

SEQ ID NO: 1004561 - DNA, 16 bp, Homo sapiens
attcagcaccctgggt

SEQ ID NO: 1004562 - DNA, 18 bp, Homo sapiens
attcagcaccctgggtgc

SEQ ID NO: 1004563 - DNA, 15 bp, Homo sapiens
cctataatctgtcaa

SEQ ID NO: 1004564 - DNA, 18 bp, Homo sapiens
cctataatcttatacaac

SEQ ID NO: 1004565 - DNA, 23 bp, Homo sapiens
cctatacagaacagagggccaga

SEQ ID NO: 1004566 - DNA, 23 bp, Homo sapiens
cctataccatatgtctgcttctg

SEQ ID NO: 1004567 - DNA, 22 bp, Homo sapiens
cctatacgcagcgtgctttaaa

SEQ ID NO: 1004568 - DNA, 16 bp, Homo sapiens
cctatactgaaagatc

SEQ ID NO: 1004569 - DNA, 22 bp, Homo sapiens
cctatactgaaagatctctgtc

SEQ ID NO: 1004570 - DNA, 23 bp, Homo sapiens
cctatagaaatagaacactgcct

SEQ ID NO: 1004571 - DNA, 18 bp, Homo sapiens
cctatagcactgagctca

SEQ ID NO: 1004572 - DNA, 18 bp, Homo sapiens
cctatagtcccagctact

SEQ ID NO: 1004573 - DNA, 22 bp, Homo sapiens
cctatagtttcaccactcctct

SEQ ID NO: 1004574 - DNA, 19 bp, Homo sapiens
cctatatctgtttgtatat

SEQ ID NO: 1004575 - DNA, 18 bp, Homo sapiens
cctatatgatttatagtt

SEQ ID NO: 1004576 - DNA, 22 bp, Homo sapiens
attccccaacggggtggggagg

SEQ ID NO: 1004577 - DNA, 22 bp, Homo sapiens
attccccaccctgaaagccctg

SEQ ID NO: 1004578 - DNA, 13 bp, Homo sapiens
attccccagagtg

SEQ ID NO: 1004579 - DNA, 21 bp, Homo sapiens
attccccaggtggctgaccca

SEQ ID NO: 1004580 - DNA, 14 bp, Homo sapiens
attccccattcttc

SEQ ID NO: 1004581 - DNA, 15 bp, Homo sapiens
attccccattcttcc

SEQ ID NO: 1004582 - DNA, 21 bp, Homo sapiens
attcccccagccaaactgtct

SEQ ID NO: 1004583 - DNA, 16 bp, Homo sapiens
attccccctgccctgt

SEQ ID NO: 1004584 - DNA, 20 bp, Homo sapiens
attccccctgccctgtgccg

SEQ ID NO: 1004585 - DNA, 21 bp, Homo sapiens
attcccctcccacctctcctt

SEQ ID NO: 1004586 - DNA, 22 bp, Homo sapiens
attcccctcccacctctccttt

SEQ ID NO: 1004587 - DNA, 17 bp, Homo sapiens
attccctagatctttct

SEQ ID NO: 1004588 - DNA, 22 bp, Homo sapiens
attccctatcttttagttttag

SEQ ID NO: 1004589 - DNA, 12 bp, Homo sapiens
attccctccccc

SEQ ID NO: 1004590 - DNA, 13 bp, Homo sapiens
attccctccccct

SEQ ID NO: 1004591 - DNA, 16 bp, Homo sapiens
attccctccccctcct

SEQ ID NO: 1004592 - DNA, 17 bp, Homo sapiens
attccctctcctgccca

SEQ ID NO: 1004593 - DNA, 19 bp, Homo sapiens
attccctgagtcaccagga

SEQ ID NO: 1004594 - DNA, 12 bp, Homo sapiens
attccctgccca

SEQ ID NO: 1004595 - DNA, 18 bp, Homo sapiens
attccctgcccaaaccct

SEQ ID NO: 1004596 - DNA, 16 bp, Homo sapiens
attcccttatctttta

SEQ ID NO: 1004597 - DNA, 22 bp, Homo sapiens
attcccttatcttttacttttt

SEQ ID NO: 1004598 - DNA, 18 bp, Homo sapiens
attcccttcctgttccct

SEQ ID NO: 1004599 - DNA, 16 bp, Homo sapiens
attcccttctttttca

SEQ ID NO: 1004600 - DNA, 13 bp, Homo sapiens
attcccttgtatt

SEQ ID NO: 1004601 - DNA, 20 bp, Homo sapiens
attccctttgacttcagctg

SEQ ID NO: 1004602 - DNA, 15 bp, Homo sapiens
attccgaagagggaa

SEQ ID NO: 1004603 - DNA, 22 bp, Homo sapiens
attccgaagagggaatggatgg

SEQ ID NO: 1004604 - DNA, 18 bp, Homo sapiens
attccgagcattccagta

SEQ ID NO: 1004605 - DNA, 22 bp, Homo sapiens
attccgagcattccagtaactt

SEQ ID NO: 1004606 - DNA, 22 bp, Homo sapiens
attccgcgcggagacctcctga

SEQ ID NO: 1004607 - DNA, 21 bp, Homo sapiens
attccggccacatcattctgt

SEQ ID NO: 1004608 - DNA, 22 bp, Homo sapiens
attccggccacatcattctgtg

SEQ ID NO: 1004609 - DNA, 14 bp, Homo sapiens
attccgtatttaaa

SEQ ID NO: 1004610 - DNA, 12 bp, Homo sapiens
attccgtcacca

SEQ ID NO: 1004611 - DNA, 20 bp, Homo sapiens
attcctaactagaattagta

SEQ ID NO: 1004612 - DNA, 18 bp, Homo sapiens
attcctaagagtggagga

SEQ ID NO: 1004613 - DNA, 17 bp, Homo sapiens
attcctacagcactact

SEQ ID NO: 1004614 - DNA, 23 bp, Homo sapiens
attcctacagcactactgggtgt

SEQ ID NO: 1004615 - DNA, 17 bp, Homo sapiens
attcctacccctcttcc

SEQ ID NO: 1004616 - DNA, 19 bp, Homo sapiens
attcctactccctcttcca

SEQ ID NO: 1004617 - DNA, 12 bp, Homo sapiens
attcctagaaat

SEQ ID NO: 1004618 - DNA, 21 bp, Homo sapiens
attcctagaattaaaccagat

SEQ ID NO: 1004619 - DNA, 19 bp, Homo sapiens
attcctagataaaaagatg

SEQ ID NO: 1004620 - DNA, 21 bp, Homo sapiens
attcctagataaaaagatggc

SEQ ID NO: 1004621 - DNA, 19 bp, Homo sapiens
attcctagtggatgactgt

SEQ ID NO: 1004622 - DNA, 22 bp, Homo sapiens
attcctatgaagttggcacatt

SEQ ID NO: 1004623 - DNA, 24 bp, Homo sapiens
attcctatgatggatggcagactc

SEQ ID NO: 1004624 - DNA, 18 bp, Homo sapiens
attcctcagattgctgaa

SEQ ID NO: 1004625 - DNA, 16 bp, Homo sapiens
attcctcagctgccaa

SEQ ID NO: 1004626 - DNA, 16 bp, Homo sapiens
attcctcaggaaggac

SEQ ID NO: 1004627 - DNA, 17 bp, Homo sapiens
attcctcaggaaggaca

SEQ ID NO: 1004628 - DNA, 18 bp, Homo sapiens
attcctcaggaaggacat

SEQ ID NO: 1004629 - DNA, 18 bp, Homo sapiens
attcctcatcaccatcgt

SEQ ID NO: 1004630 - DNA, 15 bp, Homo sapiens
attcctcctgctcat

SEQ ID NO: 1004631 - DNA, 20 bp, Homo sapiens
attcctcctgctcatattgt

SEQ ID NO: 1004632 - DNA, 22 bp, Homo sapiens
attcctccttccccccatctct

SEQ ID NO: 1004633 - DNA, 21 bp, Homo sapiens
attcctcgaagttctaggaaa

SEQ ID NO: 1004634 - DNA, 20 bp, Homo sapiens
attcctctactaacaatcag

SEQ ID NO: 1004635 - DNA, 22 bp, Homo sapiens
attcctctgggaatgttacatt

SEQ ID NO: 1004636 - DNA, 13 bp, Homo sapiens
attcctcttattg

SEQ ID NO: 1004637 - DNA, 17 bp, Homo sapiens
attcctcttgcctctct

SEQ ID NO: 1004638 - DNA, 23 bp, Homo sapiens
attcctcttggcaagatgtttct

SEQ ID NO: 1004639 - DNA, 16 bp, Homo sapiens
attcctctttgctttg

SEQ ID NO: 1004640 - DNA, 14 bp, Homo sapiens
attcctgaagccag

SEQ ID NO: 1004641 - DNA, 11 bp, Homo sapiens
attcctgaccc

SEQ ID NO: 1004642 - DNA, 12 bp, Homo sapiens
attcctgaccca

SEQ ID NO: 1004643 - DNA, 15 bp, Homo sapiens
attcctgacccaggc

SEQ ID NO: 1004644 - DNA, 17 bp, Homo sapiens
attcctgacccaggccg

SEQ ID NO: 1004645 - DNA, 22 bp, Homo sapiens
attcctgacccaggccgcagct

SEQ ID NO: 1004646 - DNA, 18 bp, Homo sapiens
attcctgagctggcctgt

SEQ ID NO: 1004647 - DNA, 17 bp, Homo sapiens
attcctgatcttcccac

SEQ ID NO: 1004648 - DNA, 18 bp, Homo sapiens
attcctgcatttgtgaaa

SEQ ID NO: 1004649 - DNA, 21 bp, Homo sapiens
attcctgcctttaagccaaag

SEQ ID NO: 1004650 - DNA, 15 bp, Homo sapiens
attcctggacatcac

SEQ ID NO: 1004651 - DNA, 19 bp, Homo sapiens
attcctggcatgacactct

SEQ ID NO: 1004652 - DNA, 20 bp, Homo sapiens
attcctggcatgacactcta

SEQ ID NO: 1004653 - DNA, 12 bp, Homo sapiens
attcctggcccc

SEQ ID NO: 1004654 - DNA, 13 bp, Homo sapiens
attcctgggcctg

SEQ ID NO: 1004655 - DNA, 16 bp, Homo sapiens
attcctgggcctgtcc

SEQ ID NO: 1004656 - DNA, 20 bp, Homo sapiens
attcctggtacccagccatc

SEQ ID NO: 1004657 - DNA, 23 bp, Homo sapiens
attcctggtttgactcagttcca

SEQ ID NO: 1004658 - DNA, 17 bp, Homo sapiens
attcctgtagcatcttc

SEQ ID NO: 1004659 - DNA, 18 bp, Homo sapiens
attcctgtagcatcttct

SEQ ID NO: 1004660 - DNA, 17 bp, Homo sapiens
attcctgtatgttgtcc

SEQ ID NO: 1004661 - DNA, 18 bp, Homo sapiens
attcctgtatgttgtcca

SEQ ID NO: 1004662 - DNA, 13 bp, Homo sapiens
attcctgttgacc

SEQ ID NO: 1004663 - DNA, 14 bp, Homo sapiens
attccttacttgca

SEQ ID NO: 1004664 - DNA, 18 bp, Homo sapiens
attccttacttgcactgt

SEQ ID NO: 1004665 - DNA, 24 bp, Homo sapiens
attccttagcttagacctcagcct

SEQ ID NO: 1004666 - DNA, 17 bp, Homo sapiens
attccttcaaataaaga

SEQ ID NO: 1004667 - DNA, 14 bp, Homo sapiens
attccttcactcat

SEQ ID NO: 1004668 - DNA, 15 bp, Homo sapiens
attccttcagatttg

SEQ ID NO: 1004669 - DNA, 21 bp, Homo sapiens
attccttgcgcctcagccctc

SEQ ID NO: 1004670 - DNA, 16 bp, Homo sapiens
attccttgtcaccagc

SEQ ID NO: 1004671 - DNA, 19 bp, Homo sapiens
attccttgtgttttgtcct

SEQ ID NO: 1004672 - DNA, 16 bp, Homo sapiens
attcctttaaaatata

SEQ ID NO: 1004673 - DNA, 14 bp, Homo sapiens
attcctttcccttc

SEQ ID NO: 1004674 - DNA, 15 bp, Homo sapiens
attcctttcccttcc

SEQ ID NO: 1004675 - DNA, 18 bp, Homo sapiens
attcctttcctgatcact

SEQ ID NO: 1004676 - DNA, 17 bp, Homo sapiens
attcctttctcatccca

SEQ ID NO: 1004677 - DNA, 19 bp, Homo sapiens
attcctttcttgtgccctg

SEQ ID NO: 1004678 - DNA, 22 bp, Homo sapiens
attcctttcttgtgccctgggc

SEQ ID NO: 1004679 - DNA, 20 bp, Homo sapiens
attcctttgaatattttttg

SEQ ID NO: 1004680 - DNA, 20 bp, Homo sapiens
attcctttgaccaaatagtt

SEQ ID NO: 1004681 - DNA, 14 bp, Homo sapiens
attcctttgcatat

SEQ ID NO: 1004682 - DNA, 16 bp, Homo sapiens
attcctttgtcttcaa

SEQ ID NO: 1004683 - DNA, 18 bp, Homo sapiens
attccttttgatggggag

SEQ ID NO: 1004684 - DNA, 14 bp, Homo sapiens
attctgcaagtata

SEQ ID NO: 1004685 - DNA, 15 bp, Homo sapiens
attctgcaatggcag

SEQ ID NO: 1004686 - DNA, 20 bp, Homo sapiens
attctgcaatggcagcattc

SEQ ID NO: 1004687 - DNA, 20 bp, Homo sapiens
attctgcaccacacctggca

SEQ ID NO: 1004688 - DNA, 18 bp, Homo sapiens
attctgcacgctgcccag

SEQ ID NO: 1004689 - DNA, 23 bp, Homo sapiens
attctgcacgctgcccaggggct

SEQ ID NO: 1004690 - DNA, 13 bp, Homo sapiens
attctgcatgtac

SEQ ID NO: 1004691 - DNA, 19 bp, Homo sapiens
attctgcattgctagataa

SEQ ID NO: 1004692 - DNA, 22 bp, Homo sapiens
attctgcattgctagataaaag

SEQ ID NO: 1004693 - DNA, 16 bp, Homo sapiens
attctgcccaaaaata

SEQ ID NO: 1004694 - DNA, 17 bp, Homo sapiens
attctgccctccttaat

SEQ ID NO: 1004695 - DNA, 21 bp, Homo sapiens
attctgcctacgttctcttta

SEQ ID NO: 1004696 - DNA, 15 bp, Homo sapiens
attctgcctctcctc

SEQ ID NO: 1004697 - DNA, 22 bp, Homo sapiens
attctgcctgcctcctccctcc

SEQ ID NO: 1004698 - DNA, 15 bp, Homo sapiens
attctgcctgctcca

SEQ ID NO: 1004699 - DNA, 20 bp, Homo sapiens
attctgcttaaagttgtaac

SEQ ID NO: 1004700 - DNA, 22 bp, Homo sapiens
attctgcttaaagttgtaacaa

SEQ ID NO: 1004701 - DNA, 22 bp, Homo sapiens
attctggaaaaaaaatatatat

SEQ ID NO: 1004702 - DNA, 18 bp, Homo sapiens
attctggaagctgattaa

SEQ ID NO: 1004703 - DNA, 19 bp, Homo sapiens
attctggatctcctgctgc

SEQ ID NO: 1004704 - DNA, 15 bp, Homo sapiens
attctgggaagggag

SEQ ID NO: 1004705 - DNA, 22 bp, Homo sapiens
attctggggaaacaacatttat

SEQ ID NO: 1004706 - DNA, 11 bp, Homo sapiens
cctcacctctg

SEQ ID NO: 1004707 - DNA, 19 bp, Homo sapiens
cctcacctctgaggacaga

SEQ ID NO: 1004708 - DNA, 20 bp, Homo sapiens
cctcacctctggactggcta

SEQ ID NO: 1004709 - DNA, 22 bp, Homo sapiens
cctcacctctggactggctaga

SEQ ID NO: 1004710 - DNA, 17 bp, Homo sapiens
cctcacctgcagagaaa

SEQ ID NO: 1004711 - DNA, 19 bp, Homo sapiens
cctcacctgggcacctggg

SEQ ID NO: 1004712 - DNA, 14 bp, Homo sapiens
cctcacctgggcct

SEQ ID NO: 1004713 - DNA, 18 bp, Homo sapiens
cctcacctgggcctttcc

SEQ ID NO: 1004714 - DNA, 20 bp, Homo sapiens
cctcacctgggcctttcctg

SEQ ID NO: 1004715 - DNA, 13 bp, Homo sapiens
cctcaccttcctg

SEQ ID NO: 1004716 - DNA, 18 bp, Homo sapiens
cctcaccttgcaacacac

SEQ ID NO: 1004717 - DNA, 22 bp, Homo sapiens
cctcaccttgcaacacacagac

SEQ ID NO: 1004718 - DNA, 17 bp, Homo sapiens
cctcacctttcccatct

SEQ ID NO: 1004719 - DNA, 16 bp, Homo sapiens
cctcacgactggtcac

SEQ ID NO: 1004720 - DNA, 14 bp, Homo sapiens
cctcacgcaagtgc

SEQ ID NO: 1004721 - DNA, 17 bp, Homo sapiens
cctcacgcaggctgagt

SEQ ID NO: 1004722 - DNA, 14 bp, Homo sapiens
cctcacgctctgga

SEQ ID NO: 1004723 - DNA, 15 bp, Homo sapiens
cctcacgctctggac

SEQ ID NO: 1004724 - DNA, 18 bp, Homo sapiens
cctcacggggttggctgt

SEQ ID NO: 1004725 - DNA, 21 bp, Homo sapiens
cctcacggggttggctgttcc

SEQ ID NO: 1004726 - DNA, 17 bp, Homo sapiens
cctcacgtttcttcccc

SEQ ID NO: 1004727 - DNA, 14 bp, Homo sapiens
cctcactaattttt

SEQ ID NO: 1004728 - DNA, 23 bp, Homo sapiens
cctcactatggtatgctggccag

SEQ ID NO: 1004729 - DNA, 24 bp, Homo sapiens
cctcactatggtatgctggccagc

SEQ ID NO: 1004730 - DNA, 16 bp, Homo sapiens
cctcactccacagagt

SEQ ID NO: 1004731 - DNA, 13 bp, Homo sapiens
cctcactccccag

SEQ ID NO: 1004732 - DNA, 14 bp, Homo sapiens
cctcactccccagg

SEQ ID NO: 1004733 - DNA, 15 bp, Homo sapiens
cctcactccccaggg

SEQ ID NO: 1004734 - DNA, 13 bp, Homo sapiens
cctcactccctct

SEQ ID NO: 1004735 - DNA, 12 bp, Homo sapiens
cctcactcctgt

SEQ ID NO: 1004736 - DNA, 17 bp, Homo sapiens
cctcactctgtcagcca

SEQ ID NO: 1004737 - DNA, 20 bp, Homo sapiens
cctcactctgtcagccagcc

SEQ ID NO: 1004738 - DNA, 18 bp, Homo sapiens
cctcactctgtccctgtc

SEQ ID NO: 1004739 - DNA, 17 bp, Homo sapiens
cctcactgaatgcctca

SEQ ID NO: 1004740 - DNA, 13 bp, Homo sapiens
cctcactgagagg

SEQ ID NO: 1004741 - DNA, 15 bp, Homo sapiens
cctcactgagcctca

SEQ ID NO: 1004742 - DNA, 14 bp, Homo sapiens
cctcactgccctcc

SEQ ID NO: 1004743 - DNA, 23 bp, Homo sapiens
cctcactgccctccctcggcccc

SEQ ID NO: 1004744 - DNA, 20 bp, Homo sapiens
cctcactgctggggagtccc

SEQ ID NO: 1004745 - DNA, 21 bp, Homo sapiens
cctcactgctggggagtccct

SEQ ID NO: 1004746 - DNA, 15 bp, Homo sapiens
cctcactggaggagc

SEQ ID NO: 1004747 - DNA, 13 bp, Homo sapiens
cctcactggctct

SEQ ID NO: 1004748 - DNA, 16 bp, Homo sapiens
cctcactggctctcct

SEQ ID NO: 1004749 - DNA, 17 bp, Homo sapiens
cctcactggctctcctg

SEQ ID NO: 1004750 - DNA, 16 bp, Homo sapiens
cctcactggctggggc

SEQ ID NO: 1004751 - DNA, 17 bp, Homo sapiens
cctcactggctggggca

SEQ ID NO: 1004752 - DNA, 13 bp, Homo sapiens
cctcactgggtgg

SEQ ID NO: 1004753 - DNA, 14 bp, Homo sapiens
cctcactgggtggg

SEQ ID NO: 1004754 - DNA, 14 bp, Homo sapiens
cctcactgtcctgt

SEQ ID NO: 1004755 - DNA, 20 bp, Homo sapiens
cctcacttgattcatctctg

SEQ ID NO: 1004756 - DNA, 21 bp, Homo sapiens
cctcacttgattcatctctgg

SEQ ID NO: 1004757 - DNA, 14 bp, Homo sapiens
cctcacttttcaat

SEQ ID NO: 1004758 - DNA, 19 bp, Homo sapiens
cctcagaaagtcaccagga

SEQ ID NO: 1004759 - DNA, 23 bp, Homo sapiens
cctcagaagcctcgactgagctt

SEQ ID NO: 1004760 - DNA, 15 bp, Homo sapiens
cctcagacatctcca

SEQ ID NO: 1004761 - DNA, 18 bp, Homo sapiens
cctcagacgttgcctgag

SEQ ID NO: 1004762 - DNA, 17 bp, Homo sapiens
cctcagagaccagggct

SEQ ID NO: 1004763 - DNA, 15 bp, Homo sapiens
cctcagagatgatca

SEQ ID NO: 1004764 - DNA, 16 bp, Homo sapiens
cctcagagatgatcag

SEQ ID NO: 1004765 - DNA, 18 bp, Homo sapiens
cctcagagcaggggccag

SEQ ID NO: 1004766 - DNA, 17 bp, Homo sapiens
cctcagagccctgccct

SEQ ID NO: 1004767 - DNA, 12 bp, Homo sapiens
cctcagagcctg

SEQ ID NO: 1004768 - DNA, 14 bp, Homo sapiens
cctcagagcctgac

SEQ ID NO: 1004769 - DNA, 19 bp, Homo sapiens
cctcagagcgccaggaagc

SEQ ID NO: 1004770 - DNA, 18 bp, Homo sapiens
cctcagaggctgagccct

SEQ ID NO: 1004771 - DNA, 19 bp, Homo sapiens
cctcagaggctgagccctg

SEQ ID NO: 1004772 - DNA, 16 bp, Homo sapiens
cctcagagtccaggcc

SEQ ID NO: 1004773 - DNA, 17 bp, Homo sapiens
cctcagagtccaggccc

SEQ ID NO: 1004774 - DNA, 19 bp, Homo sapiens
cctcagatgatctctccac

SEQ ID NO: 1004775 - DNA, 23 bp, Homo sapiens
cctcagatgtcccttgatgcaca

SEQ ID NO: 1004776 - DNA, 15 bp, Homo sapiens
cctcagattttatat

SEQ ID NO: 1004777 - DNA, 14 bp, Homo sapiens
cctcagcacccctt

SEQ ID NO: 1004778 - DNA, 22 bp, Homo sapiens
cctcagcaccccttccatgtgg

SEQ ID NO: 1004779 - DNA, 15 bp, Homo sapiens
cctcagccagagaag

SEQ ID NO: 1004780 - DNA, 16 bp, Homo sapiens
cctcagccagagaagc

SEQ ID NO: 1004781 - DNA, 14 bp, Homo sapiens
cctcagccaggccc

SEQ ID NO: 1004782 - DNA, 16 bp, Homo sapiens
cctcagccaggccctg

SEQ ID NO: 1004783 - DNA, 20 bp, Homo sapiens
cctcagccagtggcacagga

SEQ ID NO: 1004784 - DNA, 21 bp, Homo sapiens
cctcagccatgggaacctcat

SEQ ID NO: 1004785 - DNA, 16 bp, Homo sapiens
cctcagccattcactg

SEQ ID NO: 1004786 - DNA, 12 bp, Homo sapiens
cctcagccccca

SEQ ID NO: 1004787 - DNA, 16 bp, Homo sapiens
cctcagcccccaggat

SEQ ID NO: 1004788 - DNA, 13 bp, Homo sapiens
cctcagccctcag

SEQ ID NO: 1004789 - DNA, 16 bp, Homo sapiens
cctcagccctcagaac

SEQ ID NO: 1004790 - DNA, 13 bp, Homo sapiens
cctcagccctgac

SEQ ID NO: 1004791 - DNA, 15 bp, Homo sapiens
cctcagccctgaccc

SEQ ID NO: 1004792 - DNA, 15 bp, Homo sapiens
cctcagccctggcct

SEQ ID NO: 1004793 - DNA, 17 bp, Homo sapiens
cctcagcccttgccccc

SEQ ID NO: 1004794 - DNA, 18 bp, Homo sapiens
cctcagcccttgccccca

SEQ ID NO: 1004795 - DNA, 14 bp, Homo sapiens
cctcagcctagacc

SEQ ID NO: 1004796 - DNA, 13 bp, Homo sapiens
cctcagcctccaa

SEQ ID NO: 1004797 - DNA, 21 bp, Homo sapiens
cctcagcctccaaagtggagc

SEQ ID NO: 1004798 - DNA, 22 bp, Homo sapiens
cctcagcctccaaagtggagct

SEQ ID NO: 1004799 - DNA, 22 bp, Homo sapiens
cctcagcctcccaaagtgctgg

SEQ ID NO: 1004800 - DNA, 17 bp, Homo sapiens
cctcagcctcccaggta

SEQ ID NO: 1004801 - DNA, 16 bp, Homo sapiens
cctcagcctccccttc

SEQ ID NO: 1004802 - DNA, 12 bp, Homo sapiens
cctcagcctccg

SEQ ID NO: 1004803 - DNA, 19 bp, Homo sapiens
cctcagcctcctgggtagc

SEQ ID NO: 1004804 - DNA, 14 bp, Homo sapiens
cctcagcctgccca

SEQ ID NO: 1004805 - DNA, 18 bp, Homo sapiens
cctcagcctgcccacctc

SEQ ID NO: 1004806 - DNA, 19 bp, Homo sapiens
attgatttttataaatact

SEQ ID NO: 1004807 - DNA, 17 bp, Homo sapiens
attgatttttctcttca

SEQ ID NO: 1004808 - DNA, 23 bp, Homo sapiens
attgattttttttcttggtttct

SEQ ID NO: 1004809 - DNA, 14 bp, Homo sapiens
attgcaaaatacat

SEQ ID NO: 1004810 - DNA, 12 bp, Homo sapiens
attgcaaatatt

SEQ ID NO: 1004811 - DNA, 16 bp, Homo sapiens
attgcaataaagtata

SEQ ID NO: 1004812 - DNA, 17 bp, Homo sapiens
attgcaataaagtataa

SEQ ID NO: 1004813 - DNA, 15 bp, Homo sapiens
attgcacattgtaaa

SEQ ID NO: 1004814 - DNA, 13 bp, Homo sapiens
attgcacattgtt

SEQ ID NO: 1004815 - DNA, 15 bp, Homo sapiens
attgcaccattttca

SEQ ID NO: 1004816 - DNA, 20 bp, Homo sapiens
attgcacctatctcagccat

SEQ ID NO: 1004817 - DNA, 16 bp, Homo sapiens
attgcacgtggcctct

SEQ ID NO: 1004818 - DNA, 15 bp, Homo sapiens
attgcactaggaatt

SEQ ID NO: 1004819 - DNA, 16 bp, Homo sapiens
attgcactaggaattc

SEQ ID NO: 1004820 - DNA, 17 bp, Homo sapiens
attgcactaggaattct

SEQ ID NO: 1004821 - DNA, 20 bp, Homo sapiens
attgcactgcttatatgcca

SEQ ID NO: 1004822 - DNA, 21 bp, Homo sapiens
attgcagagactcatttcaca

SEQ ID NO: 1004823 - DNA, 20 bp, Homo sapiens
attgcagataactttgactt

SEQ ID NO: 1004824 - DNA, 22 bp, Homo sapiens
attgcagcagacccagcagcag

SEQ ID NO: 1004825 - DNA, 14 bp, Homo sapiens
attgcagccttgcg

SEQ ID NO: 1004826 - DNA, 20 bp, Homo sapiens
attgcagctttatgttcatt

SEQ ID NO: 1004827 - DNA, 13 bp, Homo sapiens
attgcagtttcat

SEQ ID NO: 1004828 - DNA, 15 bp, Homo sapiens
attgcatatagattt

SEQ ID NO: 1004829 - DNA, 18 bp, Homo sapiens
attgcatatagatttagt

SEQ ID NO: 1004830 - DNA, 22 bp, Homo sapiens
attgcatctcccagataatgtg

SEQ ID NO: 1004831 - DNA, 23 bp, Homo sapiens
attgcatctcccagataatgtga

SEQ ID NO: 1004832 - DNA, 23 bp, Homo sapiens
attgcattaaatataatatgcac

SEQ ID NO: 1004833 - DNA, 16 bp, Homo sapiens
attgcatttcctgaca

SEQ ID NO: 1004834 - DNA, 17 bp, Homo sapiens
attgcatttcctgacag

SEQ ID NO: 1004835 - DNA, 15 bp, Homo sapiens
attgccaaaaaggat

SEQ ID NO: 1004836 - DNA, 16 bp, Homo sapiens
attgccaaaaaggata

SEQ ID NO: 1004837 - DNA, 19 bp, Homo sapiens
attgccacagctcaactcg

SEQ ID NO: 1004838 - DNA, 21 bp, Homo sapiens
cctcaggagccgaagcccagg

SEQ ID NO: 1004839 - DNA, 19 bp, Homo sapiens
cctcaggaggcaggacctt

SEQ ID NO: 1004840 - DNA, 20 bp, Homo sapiens
cctcaggagggcaggctgag

SEQ ID NO: 1004841 - DNA, 24 bp, Homo sapiens
cctcaggagggcaggctgaggtgg

SEQ ID NO: 1004842 - DNA, 19 bp, Homo sapiens
cctcaggagtttctatagg

SEQ ID NO: 1004843 - DNA, 23 bp, Homo sapiens
cctcaggcagcgtgtgggtcccg

SEQ ID NO: 1004844 - DNA, 18 bp, Homo sapiens
cctcaggcaggtgggatg

SEQ ID NO: 1004845 - DNA, 17 bp, Homo sapiens
cctcaggccaccctcca

SEQ ID NO: 1004846 - DNA, 18 bp, Homo sapiens
cctcaggccaccctccac

SEQ ID NO: 1004847 - DNA, 14 bp, Homo sapiens
cctcaggccagggc

SEQ ID NO: 1004848 - DNA, 13 bp, Homo sapiens
cctcaggcccagc

SEQ ID NO: 1004849 - DNA, 17 bp, Homo sapiens
cctcaggctccccagaa

SEQ ID NO: 1004850 - DNA, 21 bp, Homo sapiens
cctcaggctccccagaactgg

SEQ ID NO: 1004851 - DNA, 17 bp, Homo sapiens
cctcaggcttccttggc

SEQ ID NO: 1004852 - DNA, 23 bp, Homo sapiens
cctcagggagcagggaaggcctg

SEQ ID NO: 1004853 - DNA, 14 bp, Homo sapiens
cctcagggagcgat

SEQ ID NO: 1004854 - DNA, 11 bp, Homo sapiens
cctcagggcac

SEQ ID NO: 1004855 - DNA, 19 bp, Homo sapiens
cctcagggcacgcaggacc

SEQ ID NO: 1004856 - DNA, 20 bp, Homo sapiens
cctcagggccaagcgggggc

SEQ ID NO: 1004857 - DNA, 16 bp, Homo sapiens
cctcagggctcccagg

SEQ ID NO: 1004858 - DNA, 21 bp, Homo sapiens
cctcagggctgtcccagcccc

SEQ ID NO: 1004859 - DNA, 14 bp, Homo sapiens
cctcaggggcacct

SEQ ID NO: 1004860 - DNA, 14 bp, Homo sapiens
cctcaggggcaggt

SEQ ID NO: 1004861 - DNA, 19 bp, Homo sapiens
cctcaggggcctctctcct

SEQ ID NO: 1004862 - DNA, 13 bp, Homo sapiens
cctcagggggcca

SEQ ID NO: 1004863 - DNA, 17 bp, Homo sapiens
cctcagggggccagctg

SEQ ID NO: 1004864 - DNA, 18 bp, Homo sapiens
cctcagggggccagctgg

SEQ ID NO: 1004865 - DNA, 23 bp, Homo sapiens
cctcagggggccagctggggaga

SEQ ID NO: 1004866 - DNA, 19 bp, Homo sapiens
cctcagggggtaggagagc

SEQ ID NO: 1004867 - DNA, 16 bp, Homo sapiens
cctcaggggtggagaa

SEQ ID NO: 1004868 - DNA, 17 bp, Homo sapiens
cctcagggtcctgccct

SEQ ID NO: 1004869 - DNA, 13 bp, Homo sapiens
cctcagggtgtcc

SEQ ID NO: 1004870 - DNA, 17 bp, Homo sapiens
cctcaggtacagcgggc

SEQ ID NO: 1004871 - DNA, 21 bp, Homo sapiens
cctcaggtacagcgggctgtg

SEQ ID NO: 1004872 - DNA, 15 bp, Homo sapiens
cctcaggtcagctgg

SEQ ID NO: 1004873 - DNA, 22 bp, Homo sapiens
cctcaggtcagctgggagccag

SEQ ID NO: 1004874 - DNA, 16 bp, Homo sapiens
cctcaggtgagaagca

SEQ ID NO: 1004875 - DNA, 18 bp, Homo sapiens
cctcaggtgagaagcaga

SEQ ID NO: 1004876 - DNA, 18 bp, Homo sapiens
cctcaggtgctgtccatg

SEQ ID NO: 1004877 - DNA, 12 bp, Homo sapiens
cctcaggtggcc

SEQ ID NO: 1004878 - DNA, 18 bp, Homo sapiens
cctcaggtgtagctgagc

SEQ ID NO: 1004879 - DNA, 21 bp, Homo sapiens
cctcaggtgtagctgagctgt

SEQ ID NO: 1004880 - DNA, 18 bp, Homo sapiens
cctcaggtgtgcctgttg

SEQ ID NO: 1004881 - DNA, 24 bp, Homo sapiens
cctcaggtgttttttatgaagtgc

SEQ ID NO: 1004882 - DNA, 19 bp, Homo sapiens
cctcaggtttgcctgaggg

SEQ ID NO: 1004883 - DNA, 15 bp, Homo sapiens
cctcagtagtccctg

SEQ ID NO: 1004884 - DNA, 18 bp, Homo sapiens
cctcagtagtccctgcac

SEQ ID NO: 1004885 - DNA, 16 bp, Homo sapiens
cctcagtatttatgta

SEQ ID NO: 1004886 - DNA, 15 bp, Homo sapiens
cctcagtcagttccc

SEQ ID NO: 1004887 - DNA, 14 bp, Homo sapiens
cctcagtcatattt

SEQ ID NO: 1004888 - DNA, 16 bp, Homo sapiens
cctcagtggactttcc

SEQ ID NO: 1004889 - DNA, 23 bp, Homo sapiens
cctcagtggactttccaccccct

SEQ ID NO: 1004890 - DNA, 11 bp, Homo sapiens
cctcagtgtca

SEQ ID NO: 1004891 - DNA, 16 bp, Homo sapiens
cctcagttcccagctc

SEQ ID NO: 1004892 - DNA, 20 bp, Homo sapiens
cctcagttcccttggcctca

SEQ ID NO: 1004893 - DNA, 22 bp, Homo sapiens
cctcagttcccttggcctcaga

SEQ ID NO: 1004894 - DNA, 15 bp, Homo sapiens
cctcagttccttcat

SEQ ID NO: 1004895 - DNA, 22 bp, Homo sapiens
cctcagtttggtagtgccccac

SEQ ID NO: 1004896 - DNA, 18 bp, Homo sapiens
cctcagttttccttctgt

SEQ ID NO: 1004897 - DNA, 14 bp, Homo sapiens
cctcatactcctgg

SEQ ID NO: 1004898 - DNA, 22 bp, Homo sapiens
cctcatagcatagccagcattc

SEQ ID NO: 1004899 - DNA, 12 bp, Homo sapiens
cctcatatttaa

SEQ ID NO: 1004900 - DNA, 13 bp, Homo sapiens
cctcatatttaaa

SEQ ID NO: 1004901 - DNA, 18 bp, Homo sapiens
cctcatcactggactgca

SEQ ID NO: 1004902 - DNA, 22 bp, Homo sapiens
cctcatcactggactgcatggg

SEQ ID NO: 1004903 - DNA, 15 bp, Homo sapiens
cctcatcatccaccc

SEQ ID NO: 1004904 - DNA, 15 bp, Homo sapiens
cctcatccagggccc

SEQ ID NO: 1004905 - DNA, 18 bp, Homo sapiens
cctcatccagggcccagc

SEQ ID NO: 1004906 - DNA, 16 bp, Homo sapiens
cctcatccatttcttt

SEQ ID NO: 1004907 - DNA, 16 bp, Homo sapiens
cctcatcccacttcct

SEQ ID NO: 1004908 - DNA, 15 bp, Homo sapiens
cctcatcccccagtt

SEQ ID NO: 1004909 - DNA, 21 bp, Homo sapiens
cctcatcccctcgtcctgtcc

SEQ ID NO: 1004910 - DNA, 17 bp, Homo sapiens
cctcatccgaggcaggg

SEQ ID NO: 1004911 - DNA, 20 bp, Homo sapiens
cctcatccgaggcagggtca

SEQ ID NO: 1004912 - DNA, 23 bp, Homo sapiens
cctcatcctgctcttttgtgatg

SEQ ID NO: 1004913 - DNA, 14 bp, Homo sapiens
cctcatcctttccc

SEQ ID NO: 1004914 - DNA, 15 bp, Homo sapiens
cctcatcctttccct

SEQ ID NO: 1004915 - DNA, 16 bp, Homo sapiens
cctcatctcacctctc

SEQ ID NO: 1004916 - DNA, 15 bp, Homo sapiens
cctcatctccagcct

SEQ ID NO: 1004917 - DNA, 21 bp, Homo sapiens
cctcatctgagaggctctccg

SEQ ID NO: 1004918 - DNA, 15 bp, Homo sapiens
cctcatctgtccctc

SEQ ID NO: 1004919 - DNA, 15 bp, Homo sapiens
cctcatcttcttcac

SEQ ID NO: 1004920 - DNA, 20 bp, Homo sapiens
cctcatgccacaccttcttc

SEQ ID NO: 1004921 - DNA, 24 bp, Homo sapiens
cctcatgcccaccccctgccctgc

SEQ ID NO: 1004922 - DNA, 20 bp, Homo sapiens
cctcatgcccagctctctga

SEQ ID NO: 1004923 - DNA, 15 bp, Homo sapiens
cctcatggcccctct

SEQ ID NO: 1004924 - DNA, 15 bp, Homo sapiens
cctcatgggtcctag

SEQ ID NO: 1004925 - DNA, 16 bp, Homo sapiens
cctcatgggtcctagc

SEQ ID NO: 1004926 - DNA, 13 bp, Homo sapiens
cctcatgtaacat

SEQ ID NO: 1004927 - DNA, 17 bp, Homo sapiens
cctcatgtggctggaag

SEQ ID NO: 1004928 - DNA, 19 bp, Homo sapiens
cctccagtgggctgatgct

SEQ ID NO: 1004929 - DNA, 20 bp, Homo sapiens
cctccagtgttgcctcctcc

SEQ ID NO: 1004930 - DNA, 21 bp, Homo sapiens
cctccagtgttgcctcctccc

SEQ ID NO: 1004931 - DNA, 22 bp, Homo sapiens
cctccagtgttgcctcctccca

SEQ ID NO: 1004932 - DNA, 21 bp, Homo sapiens
cctccatactcaagctgtctc

SEQ ID NO: 1004933 - DNA, 21 bp, Homo sapiens
cctccatcacctgaaacactg

SEQ ID NO: 1004934 - DNA, 22 bp, Homo sapiens
cctccatcacctgaaacactgg

SEQ ID NO: 1004935 - DNA, 11 bp, Homo sapiens
cctccatccac

SEQ ID NO: 1004936 - DNA, 12 bp, Homo sapiens
cctccatccacg

SEQ ID NO: 1004937 - DNA, 13 bp, Homo sapiens
cctccatccctgc

SEQ ID NO: 1004938 - DNA, 14 bp, Homo sapiens
cctccatccctgct

SEQ ID NO: 1004939 - DNA, 14 bp, Homo sapiens
cctccatgccccag

SEQ ID NO: 1004940 - DNA, 23 bp, Homo sapiens
cctccatgctcctcacctgtcta

SEQ ID NO: 1004941 - DNA, 14 bp, Homo sapiens
cctccatggtcctg

SEQ ID NO: 1004942 - DNA, 19 bp, Homo sapiens
cctccatgtgggtgctagg

SEQ ID NO: 1004943 - DNA, 18 bp, Homo sapiens
cctccattgggcacagtc

SEQ ID NO: 1004944 - DNA, 20 bp, Homo sapiens
cctcccaaagtgctgagatt

SEQ ID NO: 1004945 - DNA, 17 bp, Homo sapiens
cctcccaaagtgctggg

SEQ ID NO: 1004946 - DNA, 19 bp, Homo sapiens
cctcccaaagtgctgggat

SEQ ID NO: 1004947 - DNA, 19 bp, Homo sapiens
cctcccaagcgttcctggc

SEQ ID NO: 1004948 - DNA, 24 bp, Homo sapiens
cctcccaagcgttcctggccttct

SEQ ID NO: 1004949 - DNA, 18 bp, Homo sapiens
cctcccaaggtcctctca

SEQ ID NO: 1004950 - DNA, 19 bp, Homo sapiens
cctcccaaggtcctctcag

SEQ ID NO: 1004951 - DNA, 20 bp, Homo sapiens
cctcccaaggtcctctcagt

SEQ ID NO: 1004952 - DNA, 17 bp, Homo sapiens
cctcccaagtagctggg

SEQ ID NO: 1004953 - DNA, 18 bp, Homo sapiens
cctcccaagtagctggga

SEQ ID NO: 1004954 - DNA, 19 bp, Homo sapiens
cctcccaagtagctgggat

SEQ ID NO: 1004955 - DNA, 22 bp, Homo sapiens
cctcccacaatctgggactttc

SEQ ID NO: 1004956 - DNA, 16 bp, Homo sapiens
cctcccacacttgctg

SEQ ID NO: 1004957 - DNA, 21 bp, Homo sapiens
cctcccacacttgctggggct

SEQ ID NO: 1004958 - DNA, 13 bp, Homo sapiens
cctcccacagacc

SEQ ID NO: 1004959 - DNA, 15 bp, Homo sapiens
cctcccacagacctg

SEQ ID NO: 1004960 - DNA, 11 bp, Homo sapiens
cctcccaccag

SEQ ID NO: 1004961 - DNA, 15 bp, Homo sapiens
cctcccacccccagc

SEQ ID NO: 1004962 - DNA, 13 bp, Homo sapiens
cctcccaccccct

SEQ ID NO: 1004963 - DNA, 20 bp, Homo sapiens
cctcccacccccttctctgc

SEQ ID NO: 1004964 - DNA, 14 bp, Homo sapiens
cctcccactcccat

SEQ ID NO: 1004965 - DNA, 12 bp, Homo sapiens
cctcccactggg

SEQ ID NO: 1004966 - DNA, 23 bp, Homo sapiens
cctcccactgggactcccagcag

SEQ ID NO: 1004967 - DNA, 20 bp, Homo sapiens
cctcccactttgtctgtaca

SEQ ID NO: 1004968 - DNA, 19 bp, Homo sapiens
attggggaaatttttaagt

SEQ ID NO: 1004969 - DNA, 12 bp, Homo sapiens
attggggaggga

SEQ ID NO: 1004970 - DNA, 23 bp, Homo sapiens
attggggagggagaaagggtagt

SEQ ID NO: 1004971 - DNA, 17 bp, Homo sapiens
attgggggaggaaaagt

SEQ ID NO: 1004972 - DNA, 21 bp, Homo sapiens
attggggggaaagagggagca

SEQ ID NO: 1004973 - DNA, 10 bp, Homo sapiens
attgggtccc

SEQ ID NO: 1004974 - DNA, 23 bp, Homo sapiens
attgggtgaatatggtggaaaat

SEQ ID NO: 1004975 - DNA, 12 bp, Homo sapiens
attggtaaattc

SEQ ID NO: 1004976 - DNA, 19 bp, Homo sapiens
attggtaaattctggtata

SEQ ID NO: 1004977 - DNA, 14 bp, Homo sapiens
attggtaattaaaa

SEQ ID NO: 1004978 - DNA, 17 bp, Homo sapiens
attggtaattaaaagac

SEQ ID NO: 1004979 - DNA, 20 bp, Homo sapiens
attggtacataggcttctat

SEQ ID NO: 1004980 - DNA, 18 bp, Homo sapiens
attggtatcaagaaagtc

SEQ ID NO: 1004981 - DNA, 17 bp, Homo sapiens
attggtcatggtagatt

SEQ ID NO: 1004982 - DNA, 20 bp, Homo sapiens
attggtccaccctttcatag

SEQ ID NO: 1004983 - DNA, 18 bp, Homo sapiens
attggtctaatttattca

SEQ ID NO: 1004984 - DNA, 22 bp, Homo sapiens
attggtcttaatgttgaatgta

SEQ ID NO: 1004985 - DNA, 22 bp, Homo sapiens
attggtgacgatgggtgttgct

SEQ ID NO: 1004986 - DNA, 21 bp, Homo sapiens
attggtggcagattttacaaa

SEQ ID NO: 1004987 - DNA, 19 bp, Homo sapiens
attggtgtaaggtactttc

SEQ ID NO: 1004988 - DNA, 12 bp, Homo sapiens
attggtgtatat

SEQ ID NO: 1004989 - DNA, 18 bp, Homo sapiens
attggtgttgtcattgta

SEQ ID NO: 1004990 - DNA, 14 bp, Homo sapiens
attggttcttcccc

SEQ ID NO: 1004991 - DNA, 23 bp, Homo sapiens
attggttggaagctaccagagct

SEQ ID NO: 1004992 - DNA, 19 bp, Homo sapiens
attggttggtgtgaagaaa

SEQ ID NO: 1004993 - DNA, 22 bp, Homo sapiens
attggttggtgtgaagaaagcc

SEQ ID NO: 1004994 - DNA, 15 bp, Homo sapiens
attggtttttttgta

SEQ ID NO: 1004995 - DNA, 14 bp, Homo sapiens
attgtaaaacaggt

SEQ ID NO: 1004996 - DNA, 20 bp, Homo sapiens
attgtaaaacctgtcaatga

SEQ ID NO: 1004997 - DNA, 16 bp, Homo sapiens
attgtaaacatgtgtt

SEQ ID NO: 1004998 - DNA, 20 bp, Homo sapiens
attgtaaatatttactcttt

SEQ ID NO: 1004999 - DNA, 18 bp, Homo sapiens
attgtaaatattttgata

SEQ ID NO: 1005000 - DNA, 22 bp, Homo sapiens
attgtaaatattttgatacaaa

SEQ ID NO: 1005001 - DNA, 14 bp, Homo sapiens
attgtaaatctgaa

SEQ ID NO: 1005002 - DNA, 13 bp, Homo sapiens
attgtaaatgtgg

SEQ ID NO: 1005003 - DNA, 23 bp, Homo sapiens
attgtaaattgaatcagtataaa

SEQ ID NO: 1005004 - DNA, 12 bp, Homo sapiens
attgtaacctgc

SEQ ID NO: 1005005 - DNA, 20 bp, Homo sapiens
attgtaactattaacctttt

SEQ ID NO: 1005006 - DNA, 19 bp, Homo sapiens
attgtaaggtctttgtaaa

SEQ ID NO: 1005007 - DNA, 17 bp, Homo sapiens
attgtaagtgaaattaa

SEQ ID NO: 1005008 - DNA, 18 bp, Homo sapiens
attgtaagtgaaattaag

SEQ ID NO: 1005009 - DNA, 20 bp, Homo sapiens
attgtaagtgaaattaagca

SEQ ID NO: 1005010 - DNA, 19 bp, Homo sapiens
attgtaagtggaaaatgca

SEQ ID NO: 1005011 - DNA, 15 bp, Homo sapiens
attgtaatatagaaa

SEQ ID NO: 1005012 - DNA, 15 bp, Homo sapiens
attgtaatcgtgtgc

SEQ ID NO: 1005013 - DNA, 15 bp, Homo sapiens
attgtaatgttactg

SEQ ID NO: 1005014 - DNA, 13 bp, Homo sapiens
attgtacaaatgt

SEQ ID NO: 1005015 - DNA, 22 bp, Homo sapiens
attgtacaagagtccctttgaa

SEQ ID NO: 1005016 - DNA, 14 bp, Homo sapiens
attgtacagactgt

SEQ ID NO: 1005017 - DNA, 13 bp, Homo sapiens
attgtacagtttt

SEQ ID NO: 1005018 - DNA, 14 bp, Homo sapiens
attgtacagttttt

SEQ ID NO: 1005019 - DNA, 23 bp, Homo sapiens
attgtacatttatttattactgt

SEQ ID NO: 1005020 - DNA, 17 bp, Homo sapiens
attgtacctatttctga

SEQ ID NO: 1005021 - DNA, 18 bp, Homo sapiens
attgtactacctgtgtat

SEQ ID NO: 1005022 - DNA, 20 bp, Homo sapiens
attgtacttggagtaattgc

SEQ ID NO: 1005023 - DNA, 17 bp, Homo sapiens
attgtagaattgtatat

SEQ ID NO: 1005024 - DNA, 22 bp, Homo sapiens
attgtagcaataagctggacta

SEQ ID NO: 1005025 - DNA, 14 bp, Homo sapiens
attgtagtgcaaaa

SEQ ID NO: 1005026 - DNA, 20 bp, Homo sapiens
attgtagtgcaaaatggtca

SEQ ID NO: 1005027 - DNA, 17 bp, Homo sapiens
attgtagttcatatatt

SEQ ID NO: 1005028 - DNA, 19 bp, Homo sapiens
attgtagttctgtgtactt

SEQ ID NO: 1005029 - DNA, 22 bp, Homo sapiens
attgtagttctgtgtacttttt

SEQ ID NO: 1005030 - DNA, 21 bp, Homo sapiens
attgtataaaaagtttcacag

SEQ ID NO: 1005031 - DNA, 18 bp, Homo sapiens
attgtataccaatgtgtt

SEQ ID NO: 1005032 - DNA, 22 bp, Homo sapiens
attgtataggccatctgtaaat

SEQ ID NO: 1005033 - DNA, 15 bp, Homo sapiens
attgtatattacaat

SEQ ID NO: 1005034 - DNA, 18 bp, Homo sapiens
attgtatattacaatgat

SEQ ID NO: 1005035 - DNA, 19 bp, Homo sapiens
attgtatattacaatgatc

SEQ ID NO: 1005036 - DNA, 16 bp, Homo sapiens
attgtatctgtctttc

SEQ ID NO: 1005037 - DNA, 17 bp, Homo sapiens
attgtatgaaaatcctt

SEQ ID NO: 1005038 - DNA, 13 bp, Homo sapiens
attgtatgatgtg

SEQ ID NO: 1005039 - DNA, 21 bp, Homo sapiens
attgtatgatgtgttgtgata

SEQ ID NO: 1005040 - DNA, 14 bp, Homo sapiens
attgtatgcaggga

SEQ ID NO: 1005041 - DNA, 23 bp, Homo sapiens
attgtattaggtgtcatttccat

SEQ ID NO: 1005042 - DNA, 15 bp, Homo sapiens
attgtattatttgga

SEQ ID NO: 1005043 - DNA, 17 bp, Homo sapiens
attgtattatttggagt

SEQ ID NO: 1005044 - DNA, 16 bp, Homo sapiens
attgtattcagataat

SEQ ID NO: 1005045 - DNA, 17 bp, Homo sapiens
attgtattgaaaacact

SEQ ID NO: 1005046 - DNA, 19 bp, Homo sapiens
attgtattgaaaacactta

SEQ ID NO: 1005047 - DNA, 21 bp, Homo sapiens
attgtattttgtttgtggcat

SEQ ID NO: 1005048 - DNA, 14 bp, Homo sapiens
attgtcagatattt

SEQ ID NO: 1005049 - DNA, 14 bp, Homo sapiens
cctccgtagggtct

SEQ ID NO: 1005050 - DNA, 14 bp, Homo sapiens
cctccgtcatccat

SEQ ID NO: 1005051 - DNA, 15 bp, Homo sapiens
cctccgtccacccag

SEQ ID NO: 1005052 - DNA, 18 bp, Homo sapiens
cctccgtccaggagcctg

SEQ ID NO: 1005053 - DNA, 20 bp, Homo sapiens
cctccgtcctgtcactgatg

SEQ ID NO: 1005054 - DNA, 18 bp, Homo sapiens
cctccgtctgaccctctg

SEQ ID NO: 1005055 - DNA, 19 bp, Homo sapiens
cctccgtctgaccctctgc

SEQ ID NO: 1005056 - DNA, 13 bp, Homo sapiens
cctccgtggaaca

SEQ ID NO: 1005057 - DNA, 21 bp, Homo sapiens
cctccgtttatgggccttgct

SEQ ID NO: 1005058 - DNA, 22 bp, Homo sapiens
cctcctaaggctccccaccccg

SEQ ID NO: 1005059 - DNA, 23 bp, Homo sapiens
cctcctaaggctccccaccccga

SEQ ID NO: 1005060 - DNA, 18 bp, Homo sapiens
cctcctaagtcccttcct

SEQ ID NO: 1005061 - DNA, 15 bp, Homo sapiens
cctcctaccccttcc

SEQ ID NO: 1005062 - DNA, 14 bp, Homo sapiens
cctcctaccctccc

SEQ ID NO: 1005063 - DNA, 15 bp, Homo sapiens
cctcctaccctccca

SEQ ID NO: 1005064 - DNA, 11 bp, Homo sapiens
cctcctacctg

SEQ ID NO: 1005065 - DNA, 14 bp, Homo sapiens
cctcctacctgggg

SEQ ID NO: 1005066 - DNA, 15 bp, Homo sapiens
cctcctacctgggga

SEQ ID NO: 1005067 - DNA, 16 bp, Homo sapiens
cctcctacctggggac

SEQ ID NO: 1005068 - DNA, 20 bp, Homo sapiens
cctcctacctggggactcct

SEQ ID NO: 1005069 - DNA, 22 bp, Homo sapiens
cctcctagaggtgggcagctgg

SEQ ID NO: 1005070 - DNA, 23 bp, Homo sapiens
cctcctagaggtgggcagctggg

SEQ ID NO: 1005071 - DNA, 21 bp, Homo sapiens
cctcctagccccttcttccaa

SEQ ID NO: 1005072 - DNA, 17 bp, Homo sapiens
cctcctagctctcccag

SEQ ID NO: 1005073 - DNA, 19 bp, Homo sapiens
cctcctagctctcccagtg

SEQ ID NO: 1005074 - DNA, 20 bp, Homo sapiens
cctcctagggaaaagttcat

SEQ ID NO: 1005075 - DNA, 16 bp, Homo sapiens
cctcctaggggaaggg

SEQ ID NO: 1005076 - DNA, 17 bp, Homo sapiens
cctcctaggggaagggg

SEQ ID NO: 1005077 - DNA, 18 bp, Homo sapiens
cctcctatcacctcccct

SEQ ID NO: 1005078 - DNA, 22 bp, Homo sapiens
cctcctatgtgtgcctcctaga

SEQ ID NO: 1005079 - DNA, 13 bp, Homo sapiens
cctcctcacccac

SEQ ID NO: 1005080 - DNA, 13 bp, Homo sapiens
cctcctcaccccc

SEQ ID NO: 1005081 - DNA, 12 bp, Homo sapiens
cctcctcacctc

SEQ ID NO: 1005082 - DNA, 14 bp, Homo sapiens
cctcctcacctcat

SEQ ID NO: 1005083 - DNA, 15 bp, Homo sapiens
cctcctcacctcatg

SEQ ID NO: 1005084 - DNA, 14 bp, Homo sapiens
cctcctcagccccc

SEQ ID NO: 1005085 - DNA, 21 bp, Homo sapiens
cctcctcagcccccaggccag

SEQ ID NO: 1005086 - DNA, 17 bp, Homo sapiens
cctcctcaggcacacag

SEQ ID NO: 1005087 - DNA, 13 bp, Homo sapiens
cctcctcatcagt

SEQ ID NO: 1005088 - DNA, 18 bp, Homo sapiens
cctcctccagcccctgtc

SEQ ID NO: 1005089 - DNA, 21 bp, Homo sapiens
cctcctccagccgccatgctc

SEQ ID NO: 1005090 - DNA, 12 bp, Homo sapiens
cctcctccaggg

SEQ ID NO: 1005091 - DNA, 20 bp, Homo sapiens
cctcctccatcacctgaaac

SEQ ID NO: 1005092 - DNA, 14 bp, Homo sapiens
cctcctcccactgg

SEQ ID NO: 1005093 - DNA, 19 bp, Homo sapiens
cctcctcccagggcctcct

SEQ ID NO: 1005094 - DNA, 22 bp, Homo sapiens
cctcctcccatgtcactgcaga

SEQ ID NO: 1005095 - DNA, 13 bp, Homo sapiens
cctcctccccact

SEQ ID NO: 1005096 - DNA, 14 bp, Homo sapiens
cctcctccccactt

SEQ ID NO: 1005097 - DNA, 15 bp, Homo sapiens
cctcctcccccagtg

SEQ ID NO: 1005098 - DNA, 23 bp, Homo sapiens
cctcctccccgctccgtctctgt

SEQ ID NO: 1005099 - DNA, 15 bp, Homo sapiens
cctcctccctcccag

SEQ ID NO: 1005100 - DNA, 16 bp, Homo sapiens
cctcctccctcccagc

SEQ ID NO: 1005101 - DNA, 13 bp, Homo sapiens
atttaaaaagctc

SEQ ID NO: 1005102 - DNA, 18 bp, Homo sapiens
atttaaaaataagtcaac

SEQ ID NO: 1005103 - DNA, 23 bp, Homo sapiens
atttaaaaataagtcaacagtaa

SEQ ID NO: 1005104 - DNA, 18 bp, Homo sapiens
atttaaaaatgtcttgct

SEQ ID NO: 1005105 - DNA, 13 bp, Homo sapiens
atttaaaaattgt

SEQ ID NO: 1005106 - DNA, 14 bp, Homo sapiens
atttaaaacagaca

SEQ ID NO: 1005107 - DNA, 15 bp, Homo sapiens
atttaaaacagacac

SEQ ID NO: 1005108 - DNA, 17 bp, Homo sapiens
atttaaaacagacactg

SEQ ID NO: 1005109 - DNA, 23 bp, Homo sapiens
atttaaaacagacactggcatgg

SEQ ID NO: 1005110 - DNA, 13 bp, Homo sapiens
atttaaaacaggc

SEQ ID NO: 1005111 - DNA, 14 bp, Homo sapiens
atttaaaacaggca

SEQ ID NO: 1005112 - DNA, 13 bp, Homo sapiens
atttaaaacattt

SEQ ID NO: 1005113 - DNA, 16 bp, Homo sapiens
atttaaaactctggtg

SEQ ID NO: 1005114 - DNA, 14 bp, Homo sapiens
atttaaaagagcag

SEQ ID NO: 1005115 - DNA, 14 bp, Homo sapiens
atttaaaagataca

SEQ ID NO: 1005116 - DNA, 14 bp, Homo sapiens
atttaaaataaatt

SEQ ID NO: 1005117 - DNA, 22 bp, Homo sapiens
atttaaaatagcaaaagaagaa

SEQ ID NO: 1005118 - DNA, 14 bp, Homo sapiens
atttaaaatatttc

SEQ ID NO: 1005119 - DNA, 14 bp, Homo sapiens
atttaaaatgatta

SEQ ID NO: 1005120 - DNA, 14 bp, Homo sapiens
atttaaaattggca

SEQ ID NO: 1005121 - DNA, 15 bp, Homo sapiens
atttaaaattggcac

SEQ ID NO: 1005122 - DNA, 21 bp, Homo sapiens
atttaaacaaatttagaagaa

SEQ ID NO: 1005123 - DNA, 19 bp, Homo sapiens
atttaaacaataaatgtgc

SEQ ID NO: 1005124 - DNA, 13 bp, Homo sapiens
atttaaacacaca

SEQ ID NO: 1005125 - DNA, 20 bp, Homo sapiens
atttaaacagcagtgttccc

SEQ ID NO: 1005126 - DNA, 20 bp, Homo sapiens
atttaaaccgctaaaagaaa

SEQ ID NO: 1005127 - DNA, 22 bp, Homo sapiens
atttaaaccgctaaaagaaact

SEQ ID NO: 1005128 - DNA, 20 bp, Homo sapiens
atttaaaccttttattataa

SEQ ID NO: 1005129 - DNA, 15 bp, Homo sapiens
atttaaacctttttc

SEQ ID NO: 1005130 - DNA, 22 bp, Homo sapiens
atttaaacctttttcttgatct

SEQ ID NO: 1005131 - DNA, 14 bp, Homo sapiens
atttaaactaaatt

SEQ ID NO: 1005132 - DNA, 16 bp, Homo sapiens
atttaaactatcttgt

SEQ ID NO: 1005133 - DNA, 17 bp, Homo sapiens
atttaaactatcttgtg

SEQ ID NO: 1005134 - DNA, 13 bp, Homo sapiens
atttaaactctgc

SEQ ID NO: 1005135 - DNA, 17 bp, Homo sapiens
atttaaactctgccaga

SEQ ID NO: 1005136 - DNA, 21 bp, Homo sapiens
atttaaactctgccagaaaaa

SEQ ID NO: 1005137 - DNA, 12 bp, Homo sapiens
atttaaactttt

SEQ ID NO: 1005138 - DNA, 22 bp, Homo sapiens
atttaaagaaaataaacaccat

SEQ ID NO: 1005139 - DNA, 13 bp, Homo sapiens
atttaaagaaagt

SEQ ID NO: 1005140 - DNA, 19 bp, Homo sapiens
atttaaagaatgagaaaca

SEQ ID NO: 1005141 - DNA, 13 bp, Homo sapiens
atttaaagagatt

SEQ ID NO: 1005142 - DNA, 16 bp, Homo sapiens
atttaaagcaggttct

SEQ ID NO: 1005143 - DNA, 15 bp, Homo sapiens
atttaaagcctcctc

SEQ ID NO: 1005144 - DNA, 14 bp, Homo sapiens
atttaaaggggaga

SEQ ID NO: 1005145 - DNA, 20 bp, Homo sapiens
atttaaagggtgtacttata

SEQ ID NO: 1005146 - DNA, 18 bp, Homo sapiens
atttaaagtattctccat

SEQ ID NO: 1005147 - DNA, 14 bp, Homo sapiens
atttaaagttgttt

SEQ ID NO: 1005148 - DNA, 18 bp, Homo sapiens
atttaaatgcatgtctta

SEQ ID NO: 1005149 - DNA, 14 bp, Homo sapiens
atttaaatggcttt

SEQ ID NO: 1005150 - DNA, 14 bp, Homo sapiens
atttaaatgtgaat

SEQ ID NO: 1005151 - DNA, 15 bp, Homo sapiens
atttaaatgtgaatt

SEQ ID NO: 1005152 - DNA, 23 bp, Homo sapiens
atttaaatgttatgactatgtaa

SEQ ID NO: 1005153 - DNA, 14 bp, Homo sapiens
atttaaatttgatt

SEQ ID NO: 1005154 - DNA, 19 bp, Homo sapiens
atttaaatttgatttccat

SEQ ID NO: 1005155 - DNA, 21 bp, Homo sapiens
atttaaatttgatttccatct

SEQ ID NO: 1005156 - DNA, 22 bp, Homo sapiens
atttaaatttgatttccatctt

SEQ ID NO: 1005157 - DNA, 19 bp, Homo sapiens
atttaaattttacccttta

SEQ ID NO: 1005158 - DNA, 17 bp, Homo sapiens
atttaaatttttttcct

SEQ ID NO: 1005159 - DNA, 16 bp, Homo sapiens
atttaacaaaaagtgc

SEQ ID NO: 1005160 - DNA, 12 bp, Homo sapiens
atttaacagaaa

SEQ ID NO: 1005161 - DNA, 16 bp, Homo sapiens
atttaacagaaatgta

SEQ ID NO: 1005162 - DNA, 19 bp, Homo sapiens
atttaacagaaatgtacag

SEQ ID NO: 1005163 - DNA, 20 bp, Homo sapiens
atttaacagaaatgtacagc

SEQ ID NO: 1005164 - DNA, 14 bp, Homo sapiens
atttaacagaaatt

SEQ ID NO: 1005165 - DNA, 20 bp, Homo sapiens
atttaacagaaattgtatat

SEQ ID NO: 1005166 - DNA, 22 bp, Homo sapiens
atttaacagggtctctagtgct

SEQ ID NO: 1005167 - DNA, 17 bp, Homo sapiens
atttaacagtcatttaa

SEQ ID NO: 1005168 - DNA, 18 bp, Homo sapiens
atttaacagtcatttaaa

SEQ ID NO: 1005169 - DNA, 15 bp, Homo sapiens
atttaacattattta

SEQ ID NO: 1005170 - DNA, 14 bp, Homo sapiens
atttaacattgttt

SEQ ID NO: 1005171 - DNA, 24 bp, Homo sapiens
atttaaccataaatcaattcatgt

SEQ ID NO: 1005172 - DNA, 18 bp, Homo sapiens
cctgaagcctccgtggaa

SEQ ID NO: 1005173 - DNA, 21 bp, Homo sapiens
cctgaagcctccgtggaacat

SEQ ID NO: 1005174 - DNA, 13 bp, Homo sapiens
cctgaagcctctg

SEQ ID NO: 1005175 - DNA, 15 bp, Homo sapiens
cctgaagcctctgcc

SEQ ID NO: 1005176 - DNA, 17 bp, Homo sapiens
cctgaagcctctgccct

SEQ ID NO: 1005177 - DNA, 21 bp, Homo sapiens
cctgaagcctctgccctgcct

SEQ ID NO: 1005178 - DNA, 15 bp, Homo sapiens
cctgaagctgctgtg

SEQ ID NO: 1005179 - DNA, 16 bp, Homo sapiens
cctgaagctgctgtgt

SEQ ID NO: 1005180 - DNA, 19 bp, Homo sapiens
cctgaagctgctgtgtcct

SEQ ID NO: 1005181 - DNA, 17 bp, Homo sapiens
cctgaagctggcctgga

SEQ ID NO: 1005182 - DNA, 21 bp, Homo sapiens
cctgaaggaacattccttagt

SEQ ID NO: 1005183 - DNA, 14 bp, Homo sapiens
cctgaaggggcgtc

SEQ ID NO: 1005184 - DNA, 22 bp, Homo sapiens
cctgaaggggcgtctgttcccc

SEQ ID NO: 1005185 - DNA, 18 bp, Homo sapiens
cctgaaggtattggcctg

SEQ ID NO: 1005186 - DNA, 19 bp, Homo sapiens
cctgaaggtgccactccag

SEQ ID NO: 1005187 - DNA, 12 bp, Homo sapiens
cctgaagtattt

SEQ ID NO: 1005188 - DNA, 19 bp, Homo sapiens
cctgaagttgctgctgtga

SEQ ID NO: 1005189 - DNA, 15 bp, Homo sapiens
cctgaatacaagcct

SEQ ID NO: 1005190 - DNA, 19 bp, Homo sapiens
cctgaatcatgagcctgct

SEQ ID NO: 1005191 - DNA, 13 bp, Homo sapiens
cctgaatgaaata

SEQ ID NO: 1005192 - DNA, 21 bp, Homo sapiens
cctgaatggttccatgcctga

SEQ ID NO: 1005193 - DNA, 23 bp, Homo sapiens
cctgaatgtattgaacttggaaa

SEQ ID NO: 1005194 - DNA, 20 bp, Homo sapiens
cctgaattcagttgctttgc

SEQ ID NO: 1005195 - DNA, 14 bp, Homo sapiens
cctgaattctattt

SEQ ID NO: 1005196 - DNA, 15 bp, Homo sapiens
cctgaattctttttc

SEQ ID NO: 1005197 - DNA, 14 bp, Homo sapiens
cctgaatttcttct

SEQ ID NO: 1005198 - DNA, 21 bp, Homo sapiens
cctgaattttgttgctgtttt

SEQ ID NO: 1005199 - DNA, 15 bp, Homo sapiens
cctgacaaatatttt

SEQ ID NO: 1005200 - DNA, 14 bp, Homo sapiens
cctgacaagcactg

SEQ ID NO: 1005201 - DNA, 14 bp, Homo sapiens
cctgacaatggcag

SEQ ID NO: 1005202 - DNA, 14 bp, Homo sapiens
cctgacacattctg

SEQ ID NO: 1005203 - DNA, 21 bp, Homo sapiens
cctgacaccgtccctcagtga

SEQ ID NO: 1005204 - DNA, 14 bp, Homo sapiens
cctgacactttaat

SEQ ID NO: 1005205 - DNA, 17 bp, Homo sapiens
cctgacagaaggtgcca

SEQ ID NO: 1005206 - DNA, 21 bp, Homo sapiens
cctgacagatgtcagccgagc

SEQ ID NO: 1005207 - DNA, 13 bp, Homo sapiens
cctgacagccttc

SEQ ID NO: 1005208 - DNA, 19 bp, Homo sapiens
cctgacagccttccccagc

SEQ ID NO: 1005209 - DNA, 19 bp, Homo sapiens
cctgacatcatcattcttg

SEQ ID NO: 1005210 - DNA, 17 bp, Homo sapiens
cctgacatccactgttt

SEQ ID NO: 1005211 - DNA, 22 bp, Homo sapiens
cctgacatgctaacctctctga

SEQ ID NO: 1005212 - DNA, 19 bp, Homo sapiens
cctgaccaagactgagcca

SEQ ID NO: 1005213 - DNA, 21 bp, Homo sapiens
cctgaccaagactgagccagc

SEQ ID NO: 1005214 - DNA, 15 bp, Homo sapiens
cctgaccaccctccc

SEQ ID NO: 1005215 - DNA, 18 bp, Homo sapiens
cctgaccaccctcccctc

SEQ ID NO: 1005216 - DNA, 23 bp, Homo sapiens
cctgaccaccctcccctctcttg

SEQ ID NO: 1005217 - DNA, 20 bp, Homo sapiens
cctgaccacgctttctagct

SEQ ID NO: 1005218 - DNA, 16 bp, Homo sapiens
cctgacccaggccgca

SEQ ID NO: 1005219 - DNA, 18 bp, Homo sapiens
cctgacccaggccgcagc

SEQ ID NO: 1005220 - DNA, 15 bp, Homo sapiens
cctgacccagtcccc

SEQ ID NO: 1005221 - DNA, 16 bp, Homo sapiens
cctgacccatcccttt

SEQ ID NO: 1005222 - DNA, 17 bp, Homo sapiens
cctgacccctctcctca

SEQ ID NO: 1005223 - DNA, 13 bp, Homo sapiens
cctgacccctgcc

SEQ ID NO: 1005224 - DNA, 16 bp, Homo sapiens
cctgacccctgcctgt

SEQ ID NO: 1005225 - DNA, 14 bp, Homo sapiens
cctgaccccttgct

SEQ ID NO: 1005226 - DNA, 15 bp, Homo sapiens
cctgaccccttgctc

SEQ ID NO: 1005227 - DNA, 19 bp, Homo sapiens
cctgaccctcccactccca

SEQ ID NO: 1005228 - DNA, 20 bp, Homo sapiens
cctgaccctcccactcccat

SEQ ID NO: 1005229 - DNA, 19 bp, Homo sapiens
cctgaccctcccggcctgg

SEQ ID NO: 1005230 - DNA, 18 bp, Homo sapiens
cctgacctcaagcaacca

SEQ ID NO: 1005231 - DNA, 16 bp, Homo sapiens
cctgacctcactgtga

SEQ ID NO: 1005232 - DNA, 16 bp, Homo sapiens
cctgacctcaggtgat

SEQ ID NO: 1005233 - DNA, 12 bp, Homo sapiens
cctgacctccca

SEQ ID NO: 1005234 - DNA, 17 bp, Homo sapiens
cctgacctcccagccct

SEQ ID NO: 1005235 - DNA, 16 bp, Homo sapiens
cctgacctccctctaa

SEQ ID NO: 1005236 - DNA, 18 bp, Homo sapiens
cctgacctcttgctgcca

SEQ ID NO: 1005237 - DNA, 21 bp, Homo sapiens
cctgacctcttgctgccagct

SEQ ID NO: 1005238 - DNA, 17 bp, Homo sapiens
cctgacctcttgctgtc

SEQ ID NO: 1005239 - DNA, 18 bp, Homo sapiens
cctgacctcttgctgtct

SEQ ID NO: 1005240 - DNA, 24 bp, Homo sapiens
cctgacctcttgctgtctctgctc

SEQ ID NO: 1005241 - DNA, 14 bp, Homo sapiens
cctgacctgtgagc

SEQ ID NO: 1005242 - DNA, 22 bp, Homo sapiens
cctgacctgtgagcccagctgg

SEQ ID NO: 1005243 - DNA, 17 bp, Homo sapiens
cctgaccttccttcctg

SEQ ID NO: 1005244 - DNA, 13 bp, Homo sapiens
cctgacgaaactg

SEQ ID NO: 1005245 - DNA, 18 bp, Homo sapiens
cctgacgaaactggcccc

SEQ ID NO: 1005246 - DNA, 21 bp, Homo sapiens
cctgacgccctgcgttggagc

SEQ ID NO: 1005247 - DNA, 22 bp, Homo sapiens
cctgacgccctgcgttggagcc

SEQ ID NO: 1005248 - DNA, 21 bp, Homo sapiens
cctgacggcgcccccagtgtg

SEQ ID NO: 1005249 - DNA, 16 bp, Homo sapiens
cctgacggctggggac

SEQ ID NO: 1005250 - DNA, 20 bp, Homo sapiens
cctgacgtctgaagcttgac

SEQ ID NO: 1005251 - DNA, 20 bp, Homo sapiens
cctgactaatttttgtattt

SEQ ID NO: 1005252 - DNA, 17 bp, Homo sapiens
cctgactccctgtgggg

SEQ ID NO: 1005253 - DNA, 13 bp, Homo sapiens
cctgactctctgt

SEQ ID NO: 1005254 - DNA, 15 bp, Homo sapiens
cctgactctctgtga

SEQ ID NO: 1005255 - DNA, 20 bp, Homo sapiens
atttggagcacaaaattcaa

SEQ ID NO: 1005256 - DNA, 21 bp, Homo sapiens
atttggagcattaactaaatg

SEQ ID NO: 1005257 - DNA, 23 bp, Homo sapiens
atttggagcattaactaaatgct

SEQ ID NO: 1005258 - DNA, 21 bp, Homo sapiens
atttggagtgagccagaaaaa

SEQ ID NO: 1005259 - DNA, 18 bp, Homo sapiens
atttggataataaaaatt

SEQ ID NO: 1005260 - DNA, 19 bp, Homo sapiens
atttggataataaaaattg

SEQ ID NO: 1005261 - DNA, 23 bp, Homo sapiens
atttggatttaaaagcctgctca

SEQ ID NO: 1005262 - DNA, 17 bp, Homo sapiens
atttggcaaaacaaaat

SEQ ID NO: 1005263 - DNA, 20 bp, Homo sapiens
atttggcaaaacaaaatgta

SEQ ID NO: 1005264 - DNA, 14 bp, Homo sapiens
atttggcaaaatgt

SEQ ID NO: 1005265 - DNA, 19 bp, Homo sapiens
atttggcagcacgcaggcg

SEQ ID NO: 1005266 - DNA, 15 bp, Homo sapiens
atttggcgtgacccg

SEQ ID NO: 1005267 - DNA, 19 bp, Homo sapiens
atttggctcacttgcctta

SEQ ID NO: 1005268 - DNA, 14 bp, Homo sapiens
atttggctgcttct

SEQ ID NO: 1005269 - DNA, 15 bp, Homo sapiens
atttggcttgctgtt

SEQ ID NO: 1005270 - DNA, 14 bp, Homo sapiens
atttgggaagtgaa

SEQ ID NO: 1005271 - DNA, 17 bp, Homo sapiens
atttgggagacatgtga

SEQ ID NO: 1005272 - DNA, 13 bp, Homo sapiens
atttgggagctga

SEQ ID NO: 1005273 - DNA, 16 bp, Homo sapiens
atttgggagctgaacc

SEQ ID NO: 1005274 - DNA, 16 bp, Homo sapiens
atttgggccaaggtgt

SEQ ID NO: 1005275 - DNA, 19 bp, Homo sapiens
atttgggctgaatgtatgt

SEQ ID NO: 1005276 - DNA, 21 bp, Homo sapiens
atttggggtataggtctcatc

SEQ ID NO: 1005277 - DNA, 23 bp, Homo sapiens
atttggggtataggtctcatctc

SEQ ID NO: 1005278 - DNA, 21 bp, Homo sapiens
atttggtaaattagtatttat

SEQ ID NO: 1005279 - DNA, 20 bp, Homo sapiens
atttggtccaaaaaaaggaa

SEQ ID NO: 1005280 - DNA, 14 bp, Homo sapiens
atttggtcctttct

SEQ ID NO: 1005281 - DNA, 17 bp, Homo sapiens
atttggtggtttcagaa

SEQ ID NO: 1005282 - DNA, 23 bp, Homo sapiens
atttggttgcactttagacattt

SEQ ID NO: 1005283 - DNA, 23 bp, Homo sapiens
atttggtttgggatcaataggaa

SEQ ID NO: 1005284 - DNA, 23 bp, Homo sapiens
atttgtaaaaacagcattgcttt

SEQ ID NO: 1005285 - DNA, 12 bp, Homo sapiens
atttgtaaacca

SEQ ID NO: 1005286 - DNA, 18 bp, Homo sapiens
atttgtaaaccattgtaa

SEQ ID NO: 1005287 - DNA, 16 bp, Homo sapiens
atttgtaaacttctga

SEQ ID NO: 1005288 - DNA, 13 bp, Homo sapiens
atttgtaaagttg

SEQ ID NO: 1005289 - DNA, 22 bp, Homo sapiens
atttgtaaagttggttggataa

SEQ ID NO: 1005290 - DNA, 16 bp, Homo sapiens
atttgtaaatctgcca

SEQ ID NO: 1005291 - DNA, 17 bp, Homo sapiens
atttgtaaatctgccac

SEQ ID NO: 1005292 - DNA, 13 bp, Homo sapiens
atttgtaaatgat

SEQ ID NO: 1005293 - DNA, 21 bp, Homo sapiens
cctgcaaaaatataaccatta

SEQ ID NO: 1005294 - DNA, 19 bp, Homo sapiens
cctgcaaaaggactctcag

SEQ ID NO: 1005295 - DNA, 17 bp, Homo sapiens
cctgcaaacagaacagg

SEQ ID NO: 1005296 - DNA, 20 bp, Homo sapiens
cctgcaaacagaacagggtc

SEQ ID NO: 1005297 - DNA, 15 bp, Homo sapiens
cctgcaaactcactg

SEQ ID NO: 1005298 - DNA, 22 bp, Homo sapiens
cctgcaaactcactgctcaaga

SEQ ID NO: 1005299 - DNA, 18 bp, Homo sapiens
cctgcaaagcccagcttg

SEQ ID NO: 1005300 - DNA, 18 bp, Homo sapiens
cctgcaactcaaggactt

SEQ ID NO: 1005301 - DNA, 20 bp, Homo sapiens
cctgcaacttccgctgaggg

SEQ ID NO: 1005302 - DNA, 23 bp, Homo sapiens
cctgcaacttctatcctttcttc

SEQ ID NO: 1005303 - DNA, 17 bp, Homo sapiens
cctgcaagaagcgccga

SEQ ID NO: 1005304 - DNA, 18 bp, Homo sapiens
cctgcaagagtggtccta

SEQ ID NO: 1005305 - DNA, 15 bp, Homo sapiens
cctgcaagccccagg

SEQ ID NO: 1005306 - DNA, 20 bp, Homo sapiens
cctgcaagccccagggcctg

SEQ ID NO: 1005307 - DNA, 23 bp, Homo sapiens
cctgcaagccccagggcctgggg

SEQ ID NO: 1005308 - DNA, 22 bp, Homo sapiens
cctgcaatgtggtgacacctcc

SEQ ID NO: 1005309 - DNA, 23 bp, Homo sapiens
cctgcaatgtggtgacacctccc

SEQ ID NO: 1005310 - DNA, 23 bp, Homo sapiens
cctgcacaaagcccttccatgtc

SEQ ID NO: 1005311 - DNA, 11 bp, Homo sapiens
cctgcacacag

SEQ ID NO: 1005312 - DNA, 22 bp, Homo sapiens
cctgcacacagaatgctcaggg

SEQ ID NO: 1005313 - DNA, 17 bp, Homo sapiens
cctgcacacaggacagc

SEQ ID NO: 1005314 - DNA, 20 bp, Homo sapiens
cctgcacacaggacagcggg

SEQ ID NO: 1005315 - DNA, 24 bp, Homo sapiens
cctgcacagatacctcatcatcca

SEQ ID NO: 1005316 - DNA, 20 bp, Homo sapiens
cctgcacaggcacacagggc

SEQ ID NO: 1005317 - DNA, 15 bp, Homo sapiens
cctgcacagtgactt

SEQ ID NO: 1005318 - DNA, 12 bp, Homo sapiens
cctgcacagttt

SEQ ID NO: 1005319 - DNA, 17 bp, Homo sapiens
cctgcaccccagcattc

SEQ ID NO: 1005320 - DNA, 12 bp, Homo sapiens
cctgcaccctgg

SEQ ID NO: 1005321 - DNA, 13 bp, Homo sapiens
cctgcaccctgga

SEQ ID NO: 1005322 - DNA, 21 bp, Homo sapiens
cctgcaccctggaaaggggag

SEQ ID NO: 1005323 - DNA, 19 bp, Homo sapiens
cctgcaccgaccccgggcc

SEQ ID NO: 1005324 - DNA, 18 bp, Homo sapiens
cctgcaccgacccgaggc

SEQ ID NO: 1005325 - DNA, 20 bp, Homo sapiens
cctgcaccgacccgaggccc

SEQ ID NO: 1005326 - DNA, 21 bp, Homo sapiens
cctgcaccgacccgaggccca

SEQ ID NO: 1005327 - DNA, 18 bp, Homo sapiens
cctgcaccgccgcagaag

SEQ ID NO: 1005328 - DNA, 19 bp, Homo sapiens
cctgcaccgccgcagaagc

SEQ ID NO: 1005329 - DNA, 14 bp, Homo sapiens
cctgcaccgccgcc

SEQ ID NO: 1005330 - DNA, 15 bp, Homo sapiens
cctgcaccgccgcca

SEQ ID NO: 1005331 - DNA, 22 bp, Homo sapiens
cctgcacctccccccactgcag

SEQ ID NO: 1005332 - DNA, 15 bp, Homo sapiens
cctgcacctgctgcg

SEQ ID NO: 1005333 - DNA, 16 bp, Homo sapiens
cctgcacctgctgcgt

SEQ ID NO: 1005334 - DNA, 19 bp, Homo sapiens
cctgcacctgctgcgtccc

SEQ ID NO: 1005335 - DNA, 21 bp, Homo sapiens
cctgcactaatttgatgttta

SEQ ID NO: 1005336 - DNA, 21 bp, Homo sapiens
cctgcactcccgaccttagct

SEQ ID NO: 1005337 - DNA, 18 bp, Homo sapiens
cctgcactccctcctgga

SEQ ID NO: 1005338 - DNA, 20 bp, Homo sapiens
cctgcactccctcctggagc

SEQ ID NO: 1005339 - DNA, 16 bp, Homo sapiens
cctgcactccctggcc

SEQ ID NO: 1005340 - DNA, 17 bp, Homo sapiens
cctgcactccctggcct

SEQ ID NO: 1005341 - DNA, 21 bp, Homo sapiens
cctgcactggggagcccgtct

SEQ ID NO: 1005342 - DNA, 20 bp, Homo sapiens
cctgcactgtgccccgcggg

SEQ ID NO: 1005343 - DNA, 14 bp, Homo sapiens
cctgcacttacttg

SEQ ID NO: 1005344 - DNA, 17 bp, Homo sapiens
cctgcacttacttgctt

SEQ ID NO: 1005345 - DNA, 18 bp, Homo sapiens
cctgcagacacctggact

SEQ ID NO: 1005346 - DNA, 19 bp, Homo sapiens
cctgcagacacctggactg

SEQ ID NO: 1005347 - DNA, 22 bp, Homo sapiens
cctgcagacagacctcaaggga

SEQ ID NO: 1005348 - DNA, 15 bp, Homo sapiens
cctgcagacctcaag

SEQ ID NO: 1005349 - DNA, 21 bp, Homo sapiens
cctgcagacctcaagccatca

SEQ ID NO: 1005350 - DNA, 14 bp, Homo sapiens
cctgcagagcaata

SEQ ID NO: 1005351 - DNA, 15 bp, Homo sapiens
cctgcagagcaataa

SEQ ID NO: 1005352 - DNA, 19 bp, Homo sapiens
cctgcagagcaataacact

SEQ ID NO: 1005353 - DNA, 15 bp, Homo sapiens
cctgcagagctatgg

SEQ ID NO: 1005354 - DNA, 19 bp, Homo sapiens
cctgcagaggaccacagtg

SEQ ID NO: 1005355 - DNA, 21 bp, Homo sapiens
cctgcagaggaccacagtggg

SEQ ID NO: 1005356 - DNA, 19 bp, Homo sapiens
cctgcagaggtctgtgctg

SEQ ID NO: 1005357 - DNA, 20 bp, Homo sapiens
cctgcagaggtctgtgctga

SEQ ID NO: 1005358 - DNA, 21 bp, Homo sapiens
cctgcagaggtctgtgctgag

SEQ ID NO: 1005359 - DNA, 15 bp, Homo sapiens
cctgcagatgccacc

SEQ ID NO: 1005360 - DNA, 21 bp, Homo sapiens
cctgcagcacatgcgggctcg

SEQ ID NO: 1005361 - DNA, 22 bp, Homo sapiens
cctgcagcacatgcgggctcgc

SEQ ID NO: 1005362 - DNA, 18 bp, Homo sapiens
cctgcagcatggtccctg

SEQ ID NO: 1005363 - DNA, 19 bp, Homo sapiens
cctgcagcatggtccctgc

SEQ ID NO: 1005364 - DNA, 18 bp, Homo sapiens
cctgcagcccaaaaccca

SEQ ID NO: 1005365 - DNA, 17 bp, Homo sapiens
cctgcagccccagaaga

SEQ ID NO: 1005366 - DNA, 19 bp, Homo sapiens
cctgcagccccagaagaaa

SEQ ID NO: 1005367 - DNA, 18 bp, Homo sapiens
cctgcagcctcctcctga

SEQ ID NO: 1005368 - DNA, 19 bp, Homo sapiens
cctgcagcctcctcctgac

SEQ ID NO: 1005369 - DNA, 19 bp, Homo sapiens
cctgcagcctgcaggacct

SEQ ID NO: 1005370 - DNA, 22 bp, Homo sapiens
cctgcagcctgggtctggatgg

SEQ ID NO: 1005371 - DNA, 14 bp, Homo sapiens
cctgcagccttttc

SEQ ID NO: 1005372 - DNA, 15 bp, Homo sapiens
cctgcagccttttct

SEQ ID NO: 1005373 - DNA, 20 bp, Homo sapiens
cctgcagccttttctggtcc

SEQ ID NO: 1005374 - DNA, 16 bp, Homo sapiens
cctgcagcgcctccct

SEQ ID NO: 1005375 - DNA, 17 bp, Homo sapiens
cctgcagcgcctccctt

SEQ ID NO: 1005376 - DNA, 19 bp, Homo sapiens
cctgcagcgcctcccttgt

SEQ ID NO: 1005377 - DNA, 18 bp, Homo sapiens
cctgcaggaacgagcact

SEQ ID NO: 1005378 - DNA, 21 bp, Homo sapiens
cctgcaggaacgagcactggc

SEQ ID NO: 1005379 - DNA, 21 bp, Homo sapiens
cctgcaggaccctgtcctgca

SEQ ID NO: 1005380 - DNA, 17 bp, Homo sapiens
cctgcaggagagagcag

SEQ ID NO: 1005381 - DNA, 15 bp, Homo sapiens
cctgcaggagcaggg

SEQ ID NO: 1005382 - DNA, 17 bp, Homo sapiens
cctgcaggagcagggcg

SEQ ID NO: 1005383 - DNA, 20 bp, Homo sapiens
cctgcaggagcagggcggct

SEQ ID NO: 1005384 - DNA, 16 bp, Homo sapiens
cctgcaggccaggcca

SEQ ID NO: 1005385 - DNA, 14 bp, Homo sapiens
cctgcaggctgcag

SEQ ID NO: 1005386 - DNA, 19 bp, Homo sapiens
ccacctgttaaaatgtaca

SEQ ID NO: 1005387 - DNA, 21 bp, Homo sapiens
ccacctgtttctggaagactg

SEQ ID NO: 1005388 - DNA, 23 bp, Homo sapiens
ccacctgtttctggaagactgct

SEQ ID NO: 1005389 - DNA, 17 bp, Homo sapiens
ccacctgttttctgaaa

SEQ ID NO: 1005390 - DNA, 16 bp, Homo sapiens
ccaccttaaattaaac

SEQ ID NO: 1005391 - DNA, 20 bp, Homo sapiens
ccaccttaaattaaacaatt

SEQ ID NO: 1005392 - DNA, 22 bp, Homo sapiens
ccaccttcaatgacttctaatt

SEQ ID NO: 1005393 - DNA, 13 bp, Homo sapiens
ccaccttcccagc

SEQ ID NO: 1005394 - DNA, 18 bp, Homo sapiens
ccaccttccccagactca

SEQ ID NO: 1005395 - DNA, 20 bp, Homo sapiens
ccaccttccccagactcagc

SEQ ID NO: 1005396 - DNA, 21 bp, Homo sapiens
ccaccttcgggcagtcctgtg

SEQ ID NO: 1005397 - DNA, 23 bp, Homo sapiens
ccaccttcgggcagtcctgtgtg

SEQ ID NO: 1005398 - DNA, 14 bp, Homo sapiens
ccaccttctcacct

SEQ ID NO: 1005399 - DNA, 21 bp, Homo sapiens
ccaccttctgtccccagccct

SEQ ID NO: 1005400 - DNA, 14 bp, Homo sapiens
ccaccttgatccca

SEQ ID NO: 1005401 - DNA, 14 bp, Homo sapiens
ccaccttgccaggg

SEQ ID NO: 1005402 - DNA, 14 bp, Homo sapiens
ccaccttggaccct

SEQ ID NO: 1005403 - DNA, 17 bp, Homo sapiens
ccaccttggactcctcc

SEQ ID NO: 1005404 - DNA, 20 bp, Homo sapiens
ccaccttggactcctcccac

SEQ ID NO: 1005405 - DNA, 17 bp, Homo sapiens
ccaccttggtccctctc

SEQ ID NO: 1005406 - DNA, 18 bp, Homo sapiens
ccaccttggtccctctca

SEQ ID NO: 1005407 - DNA, 20 bp, Homo sapiens
ccaccttggtccctctcaga

SEQ ID NO: 1005408 - DNA, 19 bp, Homo sapiens
ccacctttgggatcagcct

SEQ ID NO: 1005409 - DNA, 17 bp, Homo sapiens
ccacctttgtgcagctt

SEQ ID NO: 1005410 - DNA, 14 bp, Homo sapiens
ccaccttttcagcg

SEQ ID NO: 1005411 - DNA, 20 bp, Homo sapiens
ccaccttttccttatactgt

SEQ ID NO: 1005412 - DNA, 22 bp, Homo sapiens
ccacgaacagcccgccagaggc

SEQ ID NO: 1005413 - DNA, 23 bp, Homo sapiens
ccacgaatttgctggggaatctc

SEQ ID NO: 1005414 - DNA, 20 bp, Homo sapiens
ccacgacaaaaacaagactg

SEQ ID NO: 1005415 - DNA, 22 bp, Homo sapiens
ccacgacaaaaacaagactgcc

SEQ ID NO: 1005416 - DNA, 13 bp, Homo sapiens
ccacgactgccat

SEQ ID NO: 1005417 - DNA, 15 bp, Homo sapiens
ccacgactgtctcca

SEQ ID NO: 1005418 - DNA, 16 bp, Homo sapiens
ccacgactgtctccat

SEQ ID NO: 1005419 - DNA, 15 bp, Homo sapiens
ccacgaggagcagca

SEQ ID NO: 1005420 - DNA, 17 bp, Homo sapiens
ccacgaggagcagcagc

SEQ ID NO: 1005421 - DNA, 23 bp, Homo sapiens
ccacgaggctgcccccatccagc

SEQ ID NO: 1005422 - DNA, 17 bp, Homo sapiens
ccacgagggctggctgg

SEQ ID NO: 1005423 - DNA, 20 bp, Homo sapiens
ccacgagggctggctggcct

SEQ ID NO: 1005424 - DNA, 22 bp, Homo sapiens
ccacgagggctggctggcctca

SEQ ID NO: 1005425 - DNA, 19 bp, Homo sapiens
ccacgaggggacccatggg

SEQ ID NO: 1005426 - DNA, 23 bp, Homo sapiens
ccacgagggtctcccctcctgca

SEQ ID NO: 1005427 - DNA, 16 bp, Homo sapiens
ccacgagggtgccgtg

SEQ ID NO: 1005428 - DNA, 22 bp, Homo sapiens
ccacgaggttaaagaagctgca

SEQ ID NO: 1005429 - DNA, 19 bp, Homo sapiens
ccacgagtcacctgcaagc

SEQ ID NO: 1005430 - DNA, 15 bp, Homo sapiens
ccacgatcccctccc

SEQ ID NO: 1005431 - DNA, 17 bp, Homo sapiens
ccacgatcccctccccc

SEQ ID NO: 1005432 - DNA, 21 bp, Homo sapiens
ccacgatgatatctatatatg

SEQ ID NO: 1005433 - DNA, 17 bp, Homo sapiens
ccacgatgtggccctgg

SEQ ID NO: 1005434 - DNA, 21 bp, Homo sapiens
ccacgattttctccagctcag

SEQ ID NO: 1005435 - DNA, 14 bp, Homo sapiens
ccacgcacctccac

SEQ ID NO: 1005436 - DNA, 17 bp, Homo sapiens
ccacgcagacctgcagc

SEQ ID NO: 1005437 - DNA, 15 bp, Homo sapiens
ccacgcagccgccgc

SEQ ID NO: 1005438 - DNA, 19 bp, Homo sapiens
ccacgcaggccacccgggc

SEQ ID NO: 1005439 - DNA, 19 bp, Homo sapiens
ccacgcaggggctctgagc

SEQ ID NO: 1005440 - DNA, 18 bp, Homo sapiens
ccacgcagtgcctggagt

SEQ ID NO: 1005441 - DNA, 19 bp, Homo sapiens
ccacgcagtgcctggagtt

SEQ ID NO: 1005442 - DNA, 19 bp, Homo sapiens
ccacgcatacacacatgcc

SEQ ID NO: 1005443 - DNA, 17 bp, Homo sapiens
ccacgcatgctcagtgc

SEQ ID NO: 1005444 - DNA, 19 bp, Homo sapiens
ccacgcatgctcagtgcct

SEQ ID NO: 1005445 - DNA, 17 bp, Homo sapiens
ccacgcccacccccagt

SEQ ID NO: 1005446 - DNA, 17 bp, Homo sapiens
ccacgccgccctccatc

SEQ ID NO: 1005447 - DNA, 15 bp, Homo sapiens
ccacgccggcctctg

SEQ ID NO: 1005448 - DNA, 17 bp, Homo sapiens
ccacgccggcctctgct

SEQ ID NO: 1005449 - DNA, 14 bp, Homo sapiens
ccacgcctcctggc

SEQ ID NO: 1005450 - DNA, 17 bp, Homo sapiens
ccacgcctcctggccag

SEQ ID NO: 1005451 - DNA, 14 bp, Homo sapiens
ccacgctcctgccc

SEQ ID NO: 1005452 - DNA, 23 bp, Homo sapiens
ccacgctcttgaggaagcccagg

SEQ ID NO: 1005453 - DNA, 15 bp, Homo sapiens
ccacgctgtctccag

SEQ ID NO: 1005454 - DNA, 18 bp, Homo sapiens
ccacgctgtggccctgga

SEQ ID NO: 1005455 - DNA, 17 bp, Homo sapiens
ccacgcttctccggatc

SEQ ID NO: 1005456 - DNA, 16 bp, Homo sapiens
ccacggaaacagaact

SEQ ID NO: 1005457 - DNA, 19 bp, Homo sapiens
ccacggacgtttccatcag

SEQ ID NO: 1005458 - DNA, 20 bp, Homo sapiens
ccacggacgtttccatcagg

SEQ ID NO: 1005459 - DNA, 12 bp, Homo sapiens
ccacggagccac

SEQ ID NO: 1005460 - DNA, 13 bp, Homo sapiens
ccacggagggagg

SEQ ID NO: 1005461 - DNA, 18 bp, Homo sapiens
ccacggagggaggcacca

SEQ ID NO: 1005462 - DNA, 23 bp, Homo sapiens
ccacggagggaggcaccatgcaa

SEQ ID NO: 1005463 - DNA, 12 bp, Homo sapiens
ccacggccaccc

SEQ ID NO: 1005464 - DNA, 20 bp, Homo sapiens
ccacggcgttgtacctgtag

SEQ ID NO: 1005465 - DNA, 23 bp, Homo sapiens
ccacgggcaggggtcagagcact

SEQ ID NO: 1005466 - DNA, 20 bp, Homo sapiens
ccacggggatcacagcgttt

SEQ ID NO: 1005467 - DNA, 13 bp, Homo sapiens
ccacggtgcgtgg

SEQ ID NO: 1005468 - DNA, 24 bp, Homo sapiens
ccacggtgcgtggctgtggcacag

SEQ ID NO: 1005469 - DNA, 15 bp, Homo sapiens
ccacgtcccacccca

SEQ ID NO: 1005470 - DNA, 22 bp, Homo sapiens
ccacgtcccaccccacctcttg

SEQ ID NO: 1005471 - DNA, 22 bp, Homo sapiens
ccacgtcccagcatccctggag

SEQ ID NO: 1005472 - DNA, 22 bp, Homo sapiens
ccacgtccccctggggcttctc

SEQ ID NO: 1005473 - DNA, 15 bp, Homo sapiens
ccacgtcccgctgcc

SEQ ID NO: 1005474 - DNA, 16 bp, Homo sapiens
ccacgtcccgctgcct

SEQ ID NO: 1005475 - DNA, 18 bp, Homo sapiens
ccacgtcccgctgcctcc

SEQ ID NO: 1005476 - DNA, 17 bp, Homo sapiens
ccacgtcctcgaattct

SEQ ID NO: 1005477 - DNA, 22 bp, Homo sapiens
ccacgtcctcgaattctcagac

SEQ ID NO: 1005478 - DNA, 19 bp, Homo sapiens
ccacgtcctggtctttgtt

SEQ ID NO: 1005479 - DNA, 13 bp, Homo sapiens
ccacgtctgccag

SEQ ID NO: 1005480 - DNA, 22 bp, Homo sapiens
ccacgtctgccaggcccatctc

SEQ ID NO: 1005481 - DNA, 15 bp, Homo sapiens
ccacgtctggccagg

SEQ ID NO: 1005482 - DNA, 17 bp, Homo sapiens
ccacgtctggctccctg

SEQ ID NO: 1005483 - DNA, 18 bp, Homo sapiens
ccacgtctggctccctgc

SEQ ID NO: 1005484 - DNA, 19 bp, Homo sapiens
ccacgtctggctccctgcc

SEQ ID NO: 1005485 - DNA, 19 bp, Homo sapiens
ccacgtctttcctgctaca

SEQ ID NO: 1005486 - DNA, 18 bp, Homo sapiens
ccacgtgaaactgctgtt

SEQ ID NO: 1005487 - DNA, 18 bp, Homo sapiens
ccacgtgaaatttgcctc

SEQ ID NO: 1005488 - DNA, 21 bp, Homo sapiens
ccacgtgaaatttgcctctgt

SEQ ID NO: 1005489 - DNA, 22 bp, Homo sapiens
ccacgtgaaatttgcctctgtc

SEQ ID NO: 1005490 - DNA, 23 bp, Homo sapiens
ccacgtgaatggccctagaactg

SEQ ID NO: 1005491 - DNA, 22 bp, Homo sapiens
ccacgtgagagaatctgcctgt

SEQ ID NO: 1005492 - DNA, 23 bp, Homo sapiens
ccacgtgagagaatctgcctgtg

SEQ ID NO: 1005493 - DNA, 22 bp, Homo sapiens
ccacgtgtaactgtcagccggg

SEQ ID NO: 1005494 - DNA, 14 bp, Homo sapiens
ccacgtgtccgtcc

SEQ ID NO: 1005495 - DNA, 12 bp, Homo sapiens
ccacgtgtcttc

SEQ ID NO: 1005496 - DNA, 15 bp, Homo sapiens
ccacgtgtcttccac

SEQ ID NO: 1005497 - DNA, 20 bp, Homo sapiens
ccacgtgtgctgtggccagg

SEQ ID NO: 1005498 - DNA, 22 bp, Homo sapiens
ccacgtgtgctgtggccaggcc

SEQ ID NO: 1005499 - DNA, 21 bp, Homo sapiens
ccacgttccttactgcagaat

SEQ ID NO: 1005500 - DNA, 17 bp, Homo sapiens
ccacgttctcacaccca

SEQ ID NO: 1005501 - DNA, 19 bp, Homo sapiens
ccacgttctcacacccacc

SEQ ID NO: 1005502 - DNA, 23 bp, Homo sapiens
ccacgttctgctcatcattctct

SEQ ID NO: 1005503 - DNA, 20 bp, Homo sapiens
ccacgttggagaagcccgtg

SEQ ID NO: 1005504 - DNA, 21 bp, Homo sapiens
ccacgttggagaagcccgtgt

SEQ ID NO: 1005505 - DNA, 16 bp, Homo sapiens
ccactaaaaatattgt

SEQ ID NO: 1005506 - DNA, 23 bp, Homo sapiens
ccactaaaaatattgtttctgca

SEQ ID NO: 1005507 - DNA, 13 bp, Homo sapiens
ccactaaagcttc

SEQ ID NO: 1005508 - DNA, 16 bp, Homo sapiens
ccactaaagcttcaga

SEQ ID NO: 1005509 - DNA, 13 bp, Homo sapiens
ataagtaagaaaa

SEQ ID NO: 1005510 - DNA, 18 bp, Homo sapiens
ataagtaagaaaatattt

SEQ ID NO: 1005511 - DNA, 13 bp, Homo sapiens
ataagtaagtttg

SEQ ID NO: 1005512 - DNA, 13 bp, Homo sapiens
ataagtactgtgt

SEQ ID NO: 1005513 - DNA, 18 bp, Homo sapiens
ataagtactgtgtacaga

SEQ ID NO: 1005514 - DNA, 14 bp, Homo sapiens
ataagtagttggtt

SEQ ID NO: 1005515 - DNA, 21 bp, Homo sapiens
ataagtatgggatgatagttg

SEQ ID NO: 1005516 - DNA, 15 bp, Homo sapiens
ataagtatttataat

SEQ ID NO: 1005517 - DNA, 19 bp, Homo sapiens
ataagtatttataatagca

SEQ ID NO: 1005518 - DNA, 14 bp, Homo sapiens
ataagtcaacagta

SEQ ID NO: 1005519 - DNA, 16 bp, Homo sapiens
ataagtcattgaaatt

SEQ ID NO: 1005520 - DNA, 16 bp, Homo sapiens
ataagtcattgtatgt

SEQ ID NO: 1005521 - DNA, 16 bp, Homo sapiens
ataagtccattaactg

SEQ ID NO: 1005522 - DNA, 18 bp, Homo sapiens
ataagtgaagggaaagat

SEQ ID NO: 1005523 - DNA, 20 bp, Homo sapiens
ataagtggaggcactttagg

SEQ ID NO: 1005524 - DNA, 13 bp, Homo sapiens
ataagtgtaaata

SEQ ID NO: 1005525 - DNA, 19 bp, Homo sapiens
ataagtgtacatatgtgct

SEQ ID NO: 1005526 - DNA, 20 bp, Homo sapiens
ataagttaaaggcagtccag

SEQ ID NO: 1005527 - DNA, 22 bp, Homo sapiens
ataagttaacttccaatttaca

SEQ ID NO: 1005528 - DNA, 14 bp, Homo sapiens
ataagttattgcag

SEQ ID NO: 1005529 - DNA, 24 bp, Homo sapiens
ataagttattgcagtttatcattc

SEQ ID NO: 1005530 - DNA, 18 bp, Homo sapiens
ataagttcaaattcttct

SEQ ID NO: 1005531 - DNA, 16 bp, Homo sapiens
ataagttcctttcctt

SEQ ID NO: 1005532 - DNA, 14 bp, Homo sapiens
ataagttgctgtaa

SEQ ID NO: 1005533 - DNA, 21 bp, Homo sapiens
ataagttgctgtaaaatttgt

SEQ ID NO: 1005534 - DNA, 23 bp, Homo sapiens
ataagttgtaccaaaacatccac

SEQ ID NO: 1005535 - DNA, 16 bp, Homo sapiens
ataagtttctattctg

SEQ ID NO: 1005536 - DNA, 21 bp, Homo sapiens
ataagtttctgggacctcagt

SEQ ID NO: 1005537 - DNA, 13 bp, Homo sapiens
ataagtttgaagg

SEQ ID NO: 1005538 - DNA, 21 bp, Homo sapiens
ataagtttgtgttagaaaagt

SEQ ID NO: 1005539 - DNA, 18 bp, Homo sapiens
ataagttttgatataatc

SEQ ID NO: 1005540 - DNA, 17 bp, Homo sapiens
ataagtttttctttaat

SEQ ID NO: 1005541 - DNA, 14 bp, Homo sapiens
ataataaaaggaaa

SEQ ID NO: 1005542 - DNA, 15 bp, Homo sapiens
ataataaaaggaaaa

SEQ ID NO: 1005543 - DNA, 15 bp, Homo sapiens
ataataaaatgcaaa

SEQ ID NO: 1005544 - DNA, 17 bp, Homo sapiens
ataataaaatgcaaatg

SEQ ID NO: 1005545 - DNA, 23 bp, Homo sapiens
ataataaaatgcaaatgaatcat

SEQ ID NO: 1005546 - DNA, 21 bp, Homo sapiens
ataataaagaactccttattt

SEQ ID NO: 1005547 - DNA, 14 bp, Homo sapiens
ataataaagaatag

SEQ ID NO: 1005548 - DNA, 12 bp, Homo sapiens
ataataaagaca

SEQ ID NO: 1005549 - DNA, 11 bp, Homo sapiens
ataataaagga

SEQ ID NO: 1005550 - DNA, 15 bp, Homo sapiens
ataataaagttgttt

SEQ ID NO: 1005551 - DNA, 11 bp, Homo sapiens
ataataaatag

SEQ ID NO: 1005552 - DNA, 22 bp, Homo sapiens
ataataaattaaacatgctgtt

SEQ ID NO: 1005553 - DNA, 23 bp, Homo sapiens
ataataaccctgccagtgccagg

SEQ ID NO: 1005554 - DNA, 16 bp, Homo sapiens
ataataactgaactgt

SEQ ID NO: 1005555 - DNA, 18 bp, Homo sapiens
ataataactgaactgttt

SEQ ID NO: 1005556 - DNA, 20 bp, Homo sapiens
ataataactgaactgtttgg

SEQ ID NO: 1005557 - DNA, 21 bp, Homo sapiens
ataataactttattgcatata

SEQ ID NO: 1005558 - DNA, 16 bp, Homo sapiens
ataataagcaaaaaga

SEQ ID NO: 1005559 - DNA, 17 bp, Homo sapiens
ataataagcaggatgtt

SEQ ID NO: 1005560 - DNA, 22 bp, Homo sapiens
ataataagttttgatataatct

SEQ ID NO: 1005561 - DNA, 12 bp, Homo sapiens
ataatacaccac

SEQ ID NO: 1005562 - DNA, 21 bp, Homo sapiens
ataatacaccactacattctg

SEQ ID NO: 1005563 - DNA, 21 bp, Homo sapiens
ataatacactaattcctttct

SEQ ID NO: 1005564 - DNA, 23 bp, Homo sapiens
ataatacttgacctctgtgacca

SEQ ID NO: 1005565 - DNA, 13 bp, Homo sapiens
ataatacttgcaa

SEQ ID NO: 1005566 - DNA, 15 bp, Homo sapiens
ataatacttgcaact

SEQ ID NO: 1005567 - DNA, 15 bp, Homo sapiens
ataatactttgtata

SEQ ID NO: 1005568 - DNA, 19 bp, Homo sapiens
ataatactttgtatacaag

SEQ ID NO: 1005569 - DNA, 22 bp, Homo sapiens
ataatagacatacagagatata

SEQ ID NO: 1005570 - DNA, 17 bp, Homo sapiens
ataatagagataagtcc

SEQ ID NO: 1005571 - DNA, 12 bp, Homo sapiens
ataatagggaaa

SEQ ID NO: 1005572 - DNA, 17 bp, Homo sapiens
ataataggtagtttgga

SEQ ID NO: 1005573 - DNA, 19 bp, Homo sapiens
ataataggtagtttggata

SEQ ID NO: 1005574 - DNA, 20 bp, Homo sapiens
ataataggtagtttggatat

SEQ ID NO: 1005575 - DNA, 23 bp, Homo sapiens
ataatatataaacaataaaaaca

SEQ ID NO: 1005576 - DNA, 17 bp, Homo sapiens
ataatatattgtgttga

SEQ ID NO: 1005577 - DNA, 14 bp, Homo sapiens
ataatatatttctt

SEQ ID NO: 1005578 - DNA, 12 bp, Homo sapiens
ataatatatttg

SEQ ID NO: 1005579 - DNA, 13 bp, Homo sapiens
ataatatattttc

SEQ ID NO: 1005580 - DNA, 14 bp, Homo sapiens
ataatatattttca

SEQ ID NO: 1005581 - DNA, 17 bp, Homo sapiens
ataatatctaaagttat

SEQ ID NO: 1005582 - DNA, 20 bp, Homo sapiens
ataatatctaaagttatatt

SEQ ID NO: 1005583 - DNA, 12 bp, Homo sapiens
ataatatgagaa

SEQ ID NO: 1005584 - DNA, 15 bp, Homo sapiens
ataatatgagaatca

SEQ ID NO: 1005585 - DNA, 20 bp, Homo sapiens
ataatatgcacacagtgctt

SEQ ID NO: 1005586 - DNA, 22 bp, Homo sapiens
ataatatggctatgcttaaaag

SEQ ID NO: 1005587 - DNA, 15 bp, Homo sapiens
ataatatgtttagtt

SEQ ID NO: 1005588 - DNA, 22 bp, Homo sapiens
ataatatgtttagttttacatt

SEQ ID NO: 1005589 - DNA, 15 bp, Homo sapiens
ataatattagtgatt

SEQ ID NO: 1005590 - DNA, 18 bp, Homo sapiens
ataatattagtgattctg

SEQ ID NO: 1005591 - DNA, 12 bp, Homo sapiens
ataatattcagc

SEQ ID NO: 1005592 - DNA, 14 bp, Homo sapiens
ataatattgaaaat

SEQ ID NO: 1005593 - DNA, 21 bp, Homo sapiens
ataatattgaaaattgaaaag

SEQ ID NO: 1005594 - DNA, 22 bp, Homo sapiens
ataatatttttgtatttctcta

SEQ ID NO: 1005595 - DNA, 21 bp, Homo sapiens
ataatcaattattacatttat

SEQ ID NO: 1005596 - DNA, 17 bp, Homo sapiens
ataatcagaaaagtaat

SEQ ID NO: 1005597 - DNA, 20 bp, Homo sapiens
ataatcagaaaagtaatttt

SEQ ID NO: 1005598 - DNA, 15 bp, Homo sapiens
ataatcagcctctta

SEQ ID NO: 1005599 - DNA, 13 bp, Homo sapiens
ataatcaggaaaa

SEQ ID NO: 1005600 - DNA, 17 bp, Homo sapiens
ataatcaggaaaaatga

SEQ ID NO: 1005601 - DNA, 15 bp, Homo sapiens
ataatcagtaaatag

SEQ ID NO: 1005602 - DNA, 18 bp, Homo sapiens
ataatcatgctcatgtat

SEQ ID NO: 1005603 - DNA, 16 bp, Homo sapiens
ataatcatgtaaatgc

SEQ ID NO: 1005604 - DNA, 19 bp, Homo sapiens
ataatcattagttttagag

SEQ ID NO: 1005605 - DNA, 12 bp, Homo sapiens
ataatcattgct

SEQ ID NO: 1005606 - DNA, 16 bp, Homo sapiens
ataatcattgcttatg

SEQ ID NO: 1005607 - DNA, 14 bp, Homo sapiens
ataatccattccaa

SEQ ID NO: 1005608 - DNA, 18 bp, Homo sapiens
ataatccattccaaaata

SEQ ID NO: 1005609 - DNA, 16 bp, Homo sapiens
ataatcccagcacttt

SEQ ID NO: 1005610 - DNA, 16 bp, Homo sapiens
ataatccttaaatctt

SEQ ID NO: 1005611 - DNA, 12 bp, Homo sapiens
ataatctagaac

SEQ ID NO: 1005612 - DNA, 15 bp, Homo sapiens
ataatctagaacaca

SEQ ID NO: 1005613 - DNA, 18 bp, Homo sapiens
ataatctatattaaatga

SEQ ID NO: 1005614 - DNA, 20 bp, Homo sapiens
ataatctatattaaatgagg

SEQ ID NO: 1005615 - DNA, 17 bp, Homo sapiens
ataatctatttctatga

SEQ ID NO: 1005616 - DNA, 15 bp, Homo sapiens
ataatctcaaaggag

SEQ ID NO: 1005617 - DNA, 18 bp, Homo sapiens
ataatctcaaaggagaaa

SEQ ID NO: 1005618 - DNA, 16 bp, Homo sapiens
ataatctcatcccccc

SEQ ID NO: 1005619 - DNA, 21 bp, Homo sapiens
ataatctcatccccccacccg

SEQ ID NO: 1005620 - DNA, 15 bp, Homo sapiens
ataatctcatgctgt

SEQ ID NO: 1005621 - DNA, 17 bp, Homo sapiens
ataatctccatttcaaa

SEQ ID NO: 1005622 - DNA, 16 bp, Homo sapiens
ataatctcttcttata

SEQ ID NO: 1005623 - DNA, 19 bp, Homo sapiens
ataatctggtgacaaatat

SEQ ID NO: 1005624 - DNA, 17 bp, Homo sapiens
ataatctgtacaatgaa

SEQ ID NO: 1005625 - DNA, 20 bp, Homo sapiens
ataatctgtcaaaacactgt

SEQ ID NO: 1005626 - DNA, 12 bp, Homo sapiens
ataatcttcagg

SEQ ID NO: 1005627 - DNA, 14 bp, Homo sapiens
ataatcttctgcct

SEQ ID NO: 1005628 - DNA, 17 bp, Homo sapiens
ataatcttctgccttct

SEQ ID NO: 1005629 - DNA, 20 bp, Homo sapiens
ataatcttctgccttctcat

SEQ ID NO: 1005630 - DNA, 18 bp, Homo sapiens
ataatcttggcttcttaa

SEQ ID NO: 1005631 - DNA, 21 bp, Homo sapiens
ataatcttggcttcttaaaaa

SEQ ID NO: 1005632 - DNA, 12 bp, Homo sapiens
ataatctttcta

SEQ ID NO: 1005633 - DNA, 13 bp, Homo sapiens
ataatctttgggt

SEQ ID NO: 1005634 - DNA, 19 bp, Homo sapiens
ccactaaatctccaagacc

SEQ ID NO: 1005635 - DNA, 13 bp, Homo sapiens
ccactaaccatcc

SEQ ID NO: 1005636 - DNA, 16 bp, Homo sapiens
ccactaaccatcccca

SEQ ID NO: 1005637 - DNA, 20 bp, Homo sapiens
ccactaaccatccccaactc

SEQ ID NO: 1005638 - DNA, 20 bp, Homo sapiens
ccactaagaacccctctgct

SEQ ID NO: 1005639 - DNA, 21 bp, Homo sapiens
ccactaagaacccctctgctt

SEQ ID NO: 1005640 - DNA, 20 bp, Homo sapiens
ccactaagagattgcacagt

SEQ ID NO: 1005641 - DNA, 19 bp, Homo sapiens
ccactaagcagaggagggg

SEQ ID NO: 1005642 - DNA, 21 bp, Homo sapiens
ccactaagcagaggaggggcc

SEQ ID NO: 1005643 - DNA, 14 bp, Homo sapiens
ccactacacctggc

SEQ ID NO: 1005644 - DNA, 15 bp, Homo sapiens
ccactacacctggct

SEQ ID NO: 1005645 - DNA, 16 bp, Homo sapiens
ccactacacctggctg

SEQ ID NO: 1005646 - DNA, 22 bp, Homo sapiens
ccactacatgcagcccatgccc

SEQ ID NO: 1005647 - DNA, 17 bp, Homo sapiens
ccactacattctgttaa

SEQ ID NO: 1005648 - DNA, 13 bp, Homo sapiens
ccactaccagcca

SEQ ID NO: 1005649 - DNA, 19 bp, Homo sapiens
ccactaccagccagcctca

SEQ ID NO: 1005650 - DNA, 13 bp, Homo sapiens
ccactactgcagc

SEQ ID NO: 1005651 - DNA, 20 bp, Homo sapiens
ccactactgcagcacctcca

SEQ ID NO: 1005652 - DNA, 19 bp, Homo sapiens
ccactagagctgagagtct

SEQ ID NO: 1005653 - DNA, 23 bp, Homo sapiens
ccactagagctgagagtctgaaa

SEQ ID NO: 1005654 - DNA, 13 bp, Homo sapiens
ccactagagggcc

SEQ ID NO: 1005655 - DNA, 14 bp, Homo sapiens
ccactagagggccc

SEQ ID NO: 1005656 - DNA, 16 bp, Homo sapiens
ccactagagggcccat

SEQ ID NO: 1005657 - DNA, 18 bp, Homo sapiens
ccactagagggcccatca

SEQ ID NO: 1005658 - DNA, 20 bp, Homo sapiens
ccactagagggcccatcagg

SEQ ID NO: 1005659 - DNA, 19 bp, Homo sapiens
ccactaggaatcccagagg

SEQ ID NO: 1005660 - DNA, 18 bp, Homo sapiens
ccactaggactctgaggc

SEQ ID NO: 1005661 - DNA, 19 bp, Homo sapiens
ccactaggactctgaggct

SEQ ID NO: 1005662 - DNA, 15 bp, Homo sapiens
ccactaggtgtcccc

SEQ ID NO: 1005663 - DNA, 16 bp, Homo sapiens
ccactaggtgtcccca

SEQ ID NO: 1005664 - DNA, 19 bp, Homo sapiens
ccactaggttcttttccat

SEQ ID NO: 1005665 - DNA, 20 bp, Homo sapiens
ccactatcccaatcaaagaa

SEQ ID NO: 1005666 - DNA, 13 bp, Homo sapiens
ccactattttcaa

SEQ ID NO: 1005667 - DNA, 14 bp, Homo sapiens
ccactcaaaatatg

SEQ ID NO: 1005668 - DNA, 21 bp, Homo sapiens
ccactcaccacaagctgagca

SEQ ID NO: 1005669 - DNA, 14 bp, Homo sapiens
ccactcaccagccc

SEQ ID NO: 1005670 - DNA, 19 bp, Homo sapiens
ccactcaccagccctagct

SEQ ID NO: 1005671 - DNA, 13 bp, Homo sapiens
ccactcaccaggg

SEQ ID NO: 1005672 - DNA, 13 bp, Homo sapiens
ccactcaccccct

SEQ ID NO: 1005673 - DNA, 17 bp, Homo sapiens
ccactcacccttcctgg

SEQ ID NO: 1005674 - DNA, 12 bp, Homo sapiens
ccactcactcca

SEQ ID NO: 1005675 - DNA, 17 bp, Homo sapiens
ccactcagaggccccca

SEQ ID NO: 1005676 - DNA, 19 bp, Homo sapiens
ccactcagaggcccccagt

SEQ ID NO: 1005677 - DNA, 20 bp, Homo sapiens
ccactcagaggcccccagtg

SEQ ID NO: 1005678 - DNA, 11 bp, Homo sapiens
ccactcagcca

SEQ ID NO: 1005679 - DNA, 17 bp, Homo sapiens
ccactcagccatttccc

SEQ ID NO: 1005680 - DNA, 23 bp, Homo sapiens
ccactcagccatttccccctcct

SEQ ID NO: 1005681 - DNA, 12 bp, Homo sapiens
ccactcagcccc

SEQ ID NO: 1005682 - DNA, 17 bp, Homo sapiens
ccactcagcccctagga

SEQ ID NO: 1005683 - DNA, 18 bp, Homo sapiens
ccactcagcccctaggag

SEQ ID NO: 1005684 - DNA, 13 bp, Homo sapiens
ccactcaggccaa

SEQ ID NO: 1005685 - DNA, 20 bp, Homo sapiens
ccactcaggccaacaagcca

SEQ ID NO: 1005686 - DNA, 18 bp, Homo sapiens
ccactcaggggaccccac

SEQ ID NO: 1005687 - DNA, 16 bp, Homo sapiens
ccactcaggtgcacac

SEQ ID NO: 1005688 - DNA, 18 bp, Homo sapiens
ccactcaggttcttcagg

SEQ ID NO: 1005689 - DNA, 13 bp, Homo sapiens
ccactcatttcat

SEQ ID NO: 1005690 - DNA, 14 bp, Homo sapiens
ccactcatttcatc

SEQ ID NO: 1005691 - DNA, 20 bp, Homo sapiens
ccactccacctccacccact

SEQ ID NO: 1005692 - DNA, 22 bp, Homo sapiens
ccactccagacccctggctttt

SEQ ID NO: 1005693 - DNA, 13 bp, Homo sapiens
ccactccagcccg

SEQ ID NO: 1005694 - DNA, 20 bp, Homo sapiens
ccactccagctccttcgctt

SEQ ID NO: 1005695 - DNA, 15 bp, Homo sapiens
ccactcccatctcct

SEQ ID NO: 1005696 - DNA, 17 bp, Homo sapiens
ccactcccccacctgac

SEQ ID NO: 1005697 - DNA, 17 bp, Homo sapiens
ccactcccccttccctt

SEQ ID NO: 1005698 - DNA, 22 bp, Homo sapiens
ccactccctacccaatgtctcc

SEQ ID NO: 1005699 - DNA, 12 bp, Homo sapiens
ccactccctccc

SEQ ID NO: 1005700 - DNA, 14 bp, Homo sapiens
ccactccctcccag

SEQ ID NO: 1005701 - DNA, 13 bp, Homo sapiens
ccactccctgagc

SEQ ID NO: 1005702 - DNA, 14 bp, Homo sapiens
ccactccctgagct

SEQ ID NO: 1005703 - DNA, 14 bp, Homo sapiens
ccactccctgccta

SEQ ID NO: 1005704 - DNA, 12 bp, Homo sapiens
ccactccctgct

SEQ ID NO: 1005705 - DNA, 14 bp, Homo sapiens
ccactccctgctcc

SEQ ID NO: 1005706 - DNA, 15 bp, Homo sapiens
ccactccctgggaca

SEQ ID NO: 1005707 - DNA, 18 bp, Homo sapiens
ccactcccttgctggccc

SEQ ID NO: 1005708 - DNA, 20 bp, Homo sapiens
ccactccgagaggtgggcca

SEQ ID NO: 1005709 - DNA, 12 bp, Homo sapiens
ccactcctccaa

SEQ ID NO: 1005710 - DNA, 11 bp, Homo sapiens
ccactcctccc

SEQ ID NO: 1005711 - DNA, 14 bp, Homo sapiens
ccactcctccctcc

SEQ ID NO: 1005712 - DNA, 12 bp, Homo sapiens
ccactcctctaa

SEQ ID NO: 1005713 - DNA, 11 bp, Homo sapiens
ccactcctctc

SEQ ID NO: 1005714 - DNA, 14 bp, Homo sapiens
ccactcctgtacac

SEQ ID NO: 1005715 - DNA, 15 bp, Homo sapiens
ccactcctgtacact

SEQ ID NO: 1005716 - DNA, 20 bp, Homo sapiens
ccactcctgtcccgccttcc

SEQ ID NO: 1005717 - DNA, 20 bp, Homo sapiens
ccactcctgtccctgtagct

SEQ ID NO: 1005718 - DNA, 17 bp, Homo sapiens
ccactccttctctcact

SEQ ID NO: 1005719 - DNA, 20 bp, Homo sapiens
ccactcgacccagaatggag

SEQ ID NO: 1005720 - DNA, 14 bp, Homo sapiens
ccactcgaggcctg

SEQ ID NO: 1005721 - DNA, 17 bp, Homo sapiens
ccactcgcagtcgcagg

SEQ ID NO: 1005722 - DNA, 20 bp, Homo sapiens
ccactcgggaggctgagaca

SEQ ID NO: 1005723 - DNA, 23 bp, Homo sapiens
ccactcgggaggctgagacagga

SEQ ID NO: 1005724 - DNA, 16 bp, Homo sapiens
ccactctaccctccca

SEQ ID NO: 1005725 - DNA, 18 bp, Homo sapiens
ccactctaccctcccacc

SEQ ID NO: 1005726 - DNA, 21 bp, Homo sapiens
ccactctaggggtcaggctcc

SEQ ID NO: 1005727 - DNA, 23 bp, Homo sapiens
ccactctaggggtcaggctccat

SEQ ID NO: 1005728 - DNA, 18 bp, Homo sapiens
ccactctcattccccagg

SEQ ID NO: 1005729 - DNA, 19 bp, Homo sapiens
ccactctcattccccaggt

SEQ ID NO: 1005730 - DNA, 13 bp, Homo sapiens
ccactctccccac

SEQ ID NO: 1005731 - DNA, 13 bp, Homo sapiens
ccactctcccctc

SEQ ID NO: 1005732 - DNA, 16 bp, Homo sapiens
ccactctcccctccct

SEQ ID NO: 1005733 - DNA, 13 bp, Homo sapiens
ccactctcggggc

SEQ ID NO: 1005734 - DNA, 17 bp, Homo sapiens
ccactctctcacccacc

SEQ ID NO: 1005735 - DNA, 18 bp, Homo sapiens
ccactctctcacccacca

SEQ ID NO: 1005736 - DNA, 20 bp, Homo sapiens
ccactctctcacccaccagc

SEQ ID NO: 1005737 - DNA, 21 bp, Homo sapiens
ccactctctcacccaccagct

SEQ ID NO: 1005738 - DNA, 15 bp, Homo sapiens
ccactctgcctgcct

SEQ ID NO: 1005739 - DNA, 18 bp, Homo sapiens
ccactctggattcagcct

SEQ ID NO: 1005740 - DNA, 13 bp, Homo sapiens
ccactctggtggc

SEQ ID NO: 1005741 - DNA, 14 bp, Homo sapiens
ccactctggtggcc

SEQ ID NO: 1005742 - DNA, 17 bp, Homo sapiens
ccactctggtggccact

SEQ ID NO: 1005743 - DNA, 12 bp, Homo sapiens
ccactctgtaat

SEQ ID NO: 1005744 - DNA, 13 bp, Homo sapiens
ccactctgtaatt

SEQ ID NO: 1005745 - DNA, 14 bp, Homo sapiens
ccactctgtaattg

SEQ ID NO: 1005746 - DNA, 19 bp, Homo sapiens
ccactctgtaattgcaaaa

SEQ ID NO: 1005747 - DNA, 19 bp, Homo sapiens
ccactctgtatctatgcaa

SEQ ID NO: 1005748 - DNA, 13 bp, Homo sapiens
ccactcttcctgt

SEQ ID NO: 1005749 - DNA, 18 bp, Homo sapiens
ccactcttcctttctcct

SEQ ID NO: 1005750 - DNA, 14 bp, Homo sapiens
ccactcttctctcc

SEQ ID NO: 1005751 - DNA, 16 bp, Homo sapiens
ccactcttctctcctt

SEQ ID NO: 1005752 - DNA, 22 bp, Homo sapiens
ccactgaaaacatttcaaagct

SEQ ID NO: 1005753 - DNA, 17 bp, Homo sapiens
ccactgaaaagctttcc

SEQ ID NO: 1005754 - DNA, 12 bp, Homo sapiens
ccactgaaaatt

SEQ ID NO: 1005755 - DNA, 17 bp, Homo sapiens
ccactgaacaaaaccta

SEQ ID NO: 1005756 - DNA, 20 bp, Homo sapiens
ccactgaattgacatgaccc

SEQ ID NO: 1005757 - DNA, 21 bp, Homo sapiens
ccactgaattgacatgaccct

SEQ ID NO: 1005758 - DNA, 22 bp, Homo sapiens
ccactgaattgacatgaccctc

SEQ ID NO: 1005759 - DNA, 16 bp, Homo sapiens
ccactgacagcctccc

SEQ ID NO: 1005760 - DNA, 16 bp, Homo sapiens
ataatgaacaaaatta

SEQ ID NO: 1005761 - DNA, 15 bp, Homo sapiens
ataatgaataaactg

SEQ ID NO: 1005762 - DNA, 16 bp, Homo sapiens
ataatgaataaactga

SEQ ID NO: 1005763 - DNA, 22 bp, Homo sapiens
ataatgaggatgattattttca

SEQ ID NO: 1005764 - DNA, 22 bp, Homo sapiens
ataatgataaaataaataattt

SEQ ID NO: 1005765 - DNA, 16 bp, Homo sapiens
ataatgatgatgatga

SEQ ID NO: 1005766 - DNA, 14 bp, Homo sapiens
ataatgattcataa

SEQ ID NO: 1005767 - DNA, 16 bp, Homo sapiens
ataatgatttgctctt

SEQ ID NO: 1005768 - DNA, 21 bp, Homo sapiens
ataatgcgtgcataccacttt

SEQ ID NO: 1005769 - DNA, 18 bp, Homo sapiens
ataatgctgttgcctcat

SEQ ID NO: 1005770 - DNA, 22 bp, Homo sapiens
ataatggaaaatgccatgaatt

SEQ ID NO: 1005771 - DNA, 19 bp, Homo sapiens
ataatggacagattaatat

SEQ ID NO: 1005772 - DNA, 17 bp, Homo sapiens
ataatgggccactgaaa

SEQ ID NO: 1005773 - DNA, 23 bp, Homo sapiens
ataatgggccactgaaatctgtc

SEQ ID NO: 1005774 - DNA, 19 bp, Homo sapiens
ataatggggtcctggccat

SEQ ID NO: 1005775 - DNA, 20 bp, Homo sapiens
ataatggtcccatccaggca

SEQ ID NO: 1005776 - DNA, 22 bp, Homo sapiens
ataatggtcccatccaggcagt

SEQ ID NO: 1005777 - DNA, 14 bp, Homo sapiens
ataatggttgtgaa

SEQ ID NO: 1005778 - DNA, 15 bp, Homo sapiens
ataatggttgtgaaa

SEQ ID NO: 1005779 - DNA, 19 bp, Homo sapiens
ataatggttgtgaaatgta

SEQ ID NO: 1005780 - DNA, 14 bp, Homo sapiens
ataatgtaattgta

SEQ ID NO: 1005781 - DNA, 22 bp, Homo sapiens
ataatgtataaagaacaaggta

SEQ ID NO: 1005782 - DNA, 14 bp, Homo sapiens
ataatgtattgttg

SEQ ID NO: 1005783 - DNA, 11 bp, Homo sapiens
ataatgtattt

SEQ ID NO: 1005784 - DNA, 17 bp, Homo sapiens
ataatgtattttcagct

SEQ ID NO: 1005785 - DNA, 17 bp, Homo sapiens
ataatgtccccactccc

SEQ ID NO: 1005786 - DNA, 19 bp, Homo sapiens
ataatgtgaaactggatta

SEQ ID NO: 1005787 - DNA, 19 bp, Homo sapiens
ataatgtgcaaattttgca

SEQ ID NO: 1005788 - DNA, 20 bp, Homo sapiens
ataatgtgcaaattttgcat

SEQ ID NO: 1005789 - DNA, 17 bp, Homo sapiens
ataatgtgggaagaaac

SEQ ID NO: 1005790 - DNA, 14 bp, Homo sapiens
ataatgtgtctgtg

SEQ ID NO: 1005791 - DNA, 20 bp, Homo sapiens
ataatgtgtgctttattgaa

SEQ ID NO: 1005792 - DNA, 17 bp, Homo sapiens
ataatgtttaaatcatg

SEQ ID NO: 1005793 - DNA, 16 bp, Homo sapiens
ataatgtttattaaat

SEQ ID NO: 1005794 - DNA, 14 bp, Homo sapiens
ataatgtttttcct

SEQ ID NO: 1005795 - DNA, 19 bp, Homo sapiens
ataatgtttttcctttctt

SEQ ID NO: 1005796 - DNA, 13 bp, Homo sapiens
ataattaaagatg

SEQ ID NO: 1005797 - DNA, 20 bp, Homo sapiens
ataattaaagcttaaactga

SEQ ID NO: 1005798 - DNA, 15 bp, Homo sapiens
ataattaacttaact

SEQ ID NO: 1005799 - DNA, 19 bp, Homo sapiens
ataattaacttaactgaag

SEQ ID NO: 1005800 - DNA, 22 bp, Homo sapiens
ataattaacttaactgaagaaa

SEQ ID NO: 1005801 - DNA, 14 bp, Homo sapiens
ataattaattgtca

SEQ ID NO: 1005802 - DNA, 14 bp, Homo sapiens
ataattacattcct

SEQ ID NO: 1005803 - DNA, 17 bp, Homo sapiens
ataattacgtttaaagt

SEQ ID NO: 1005804 - DNA, 22 bp, Homo sapiens
ataattagatccattaatttaa

SEQ ID NO: 1005805 - DNA, 15 bp, Homo sapiens
ataattatataactg

SEQ ID NO: 1005806 - DNA, 19 bp, Homo sapiens
ataattatataactgtatt

SEQ ID NO: 1005807 - DNA, 17 bp, Homo sapiens
ataattatccagagttt

SEQ ID NO: 1005808 - DNA, 19 bp, Homo sapiens
ataattatcggaagcagtg

SEQ ID NO: 1005809 - DNA, 14 bp, Homo sapiens
ataattatgaaaac

SEQ ID NO: 1005810 - DNA, 15 bp, Homo sapiens
ataattatgaaaact

SEQ ID NO: 1005811 - DNA, 16 bp, Homo sapiens
ataattatgacagtta

SEQ ID NO: 1005812 - DNA, 19 bp, Homo sapiens
ataattatgacagttatac

SEQ ID NO: 1005813 - DNA, 16 bp, Homo sapiens
ataattatttatttaa

SEQ ID NO: 1005814 - DNA, 23 bp, Homo sapiens
ataattcagggtggtaaagtatg

SEQ ID NO: 1005815 - DNA, 13 bp, Homo sapiens
ataattcatttgt

SEQ ID NO: 1005816 - DNA, 22 bp, Homo sapiens
ataattccagtcacagtttttg

SEQ ID NO: 1005817 - DNA, 12 bp, Homo sapiens
ataattccctat

SEQ ID NO: 1005818 - DNA, 16 bp, Homo sapiens
ataattcctacagcac

SEQ ID NO: 1005819 - DNA, 16 bp, Homo sapiens
ataattctaaatccct

SEQ ID NO: 1005820 - DNA, 14 bp, Homo sapiens
ataattctcattaa

SEQ ID NO: 1005821 - DNA, 15 bp, Homo sapiens
ataattctcattaaa

SEQ ID NO: 1005822 - DNA, 12 bp, Homo sapiens
ataattctgaaa

SEQ ID NO: 1005823 - DNA, 14 bp, Homo sapiens
ataattctgtaaat

SEQ ID NO: 1005824 - DNA, 14 bp, Homo sapiens
ataattcttgtata

SEQ ID NO: 1005825 - DNA, 12 bp, Homo sapiens
ataattgattaa

SEQ ID NO: 1005826 - DNA, 13 bp, Homo sapiens
ataattgattaaa

SEQ ID NO: 1005827 - DNA, 19 bp, Homo sapiens
ataattgattaaaatctct

SEQ ID NO: 1005828 - DNA, 17 bp, Homo sapiens
ataattggatttcctaa

SEQ ID NO: 1005829 - DNA, 20 bp, Homo sapiens
ataattggatttcctaatac

SEQ ID NO: 1005830 - DNA, 18 bp, Homo sapiens
ataattggtgctatttga

SEQ ID NO: 1005831 - DNA, 19 bp, Homo sapiens
ataattgtaccaacctcat

SEQ ID NO: 1005832 - DNA, 15 bp, Homo sapiens
ataattgtggattat

SEQ ID NO: 1005833 - DNA, 13 bp, Homo sapiens
ataattgtgtatt

SEQ ID NO: 1005834 - DNA, 17 bp, Homo sapiens
ataattgtgtattttct

SEQ ID NO: 1005835 - DNA, 15 bp, Homo sapiens
ataattgttgatatt

SEQ ID NO: 1005836 - DNA, 21 bp, Homo sapiens
ataattgttgattaatttgag

SEQ ID NO: 1005837 - DNA, 22 bp, Homo sapiens
ataattgttgattaatttgaga

SEQ ID NO: 1005838 - DNA, 15 bp, Homo sapiens
ataattgttgttctg

SEQ ID NO: 1005839 - DNA, 23 bp, Homo sapiens
ataattgttgttctgttaactga

SEQ ID NO: 1005840 - DNA, 13 bp, Homo sapiens
ataatttaaatga

SEQ ID NO: 1005841 - DNA, 18 bp, Homo sapiens
ataatttaataaaaagga

SEQ ID NO: 1005842 - DNA, 18 bp, Homo sapiens
ataatttacaggttctta

SEQ ID NO: 1005843 - DNA, 13 bp, Homo sapiens
ataatttacctaa

SEQ ID NO: 1005844 - DNA, 17 bp, Homo sapiens
ataatttagtttcatat

SEQ ID NO: 1005845 - DNA, 20 bp, Homo sapiens
ataatttagtttcatataaa

SEQ ID NO: 1005846 - DNA, 16 bp, Homo sapiens
ataatttattattaag

SEQ ID NO: 1005847 - DNA, 20 bp, Homo sapiens
ataatttcagggaaattaat

SEQ ID NO: 1005848 - DNA, 13 bp, Homo sapiens
ataatttcagggt

SEQ ID NO: 1005849 - DNA, 14 bp, Homo sapiens
ataatttcagggtg

SEQ ID NO: 1005850 - DNA, 22 bp, Homo sapiens
ataatttccatttacttaagac

SEQ ID NO: 1005851 - DNA, 23 bp, Homo sapiens
ataatttccatttacttaagact

SEQ ID NO: 1005852 - DNA, 21 bp, Homo sapiens
ataatttcccaattaggaagt

SEQ ID NO: 1005853 - DNA, 18 bp, Homo sapiens
ataatttcttactaaaca

SEQ ID NO: 1005854 - DNA, 12 bp, Homo sapiens
ataatttgaaaa

SEQ ID NO: 1005855 - DNA, 16 bp, Homo sapiens
ataatttgaatgtatt

SEQ ID NO: 1005856 - DNA, 16 bp, Homo sapiens
ataatttgaggtgaaa

SEQ ID NO: 1005857 - DNA, 11 bp, Homo sapiens
ataatttgcat

SEQ ID NO: 1005858 - DNA, 12 bp, Homo sapiens
ataatttgcata

SEQ ID NO: 1005859 - DNA, 16 bp, Homo sapiens
ataatttgcatattct

SEQ ID NO: 1005860 - DNA, 18 bp, Homo sapiens
ataatttgcatattctat

SEQ ID NO: 1005861 - DNA, 21 bp, Homo sapiens
ataatttgcatattctattgt

SEQ ID NO: 1005862 - DNA, 12 bp, Homo sapiens
ataatttgtaaa

SEQ ID NO: 1005863 - DNA, 22 bp, Homo sapiens
ataatttgtacatatgtaaaat

SEQ ID NO: 1005864 - DNA, 18 bp, Homo sapiens
ataatttgtttaaaattc

SEQ ID NO: 1005865 - DNA, 20 bp, Homo sapiens
ataatttgtttaaaattctc

SEQ ID NO: 1005866 - DNA, 16 bp, Homo sapiens
ataatttgtttccagc

SEQ ID NO: 1005867 - DNA, 15 bp, Homo sapiens
ataattttaaacaaa

SEQ ID NO: 1005868 - DNA, 14 bp, Homo sapiens
ataattttaaattc

SEQ ID NO: 1005869 - DNA, 18 bp, Homo sapiens
ataattttaatattcttt

SEQ ID NO: 1005870 - DNA, 15 bp, Homo sapiens
ataattttacaattt

SEQ ID NO: 1005871 - DNA, 16 bp, Homo sapiens
ataattttacaattta

SEQ ID NO: 1005872 - DNA, 14 bp, Homo sapiens
ataattttagtaat

SEQ ID NO: 1005873 - DNA, 15 bp, Homo sapiens
ataattttatgaatg

SEQ ID NO: 1005874 - DNA, 19 bp, Homo sapiens
ataattttatgaatgtctt

SEQ ID NO: 1005875 - DNA, 21 bp, Homo sapiens
ataattttatttataaactag

SEQ ID NO: 1005876 - DNA, 22 bp, Homo sapiens
ataattttctaagacagttttt

SEQ ID NO: 1005877 - DNA, 12 bp, Homo sapiens
ataattttgcat

SEQ ID NO: 1005878 - DNA, 15 bp, Homo sapiens
ataattttgcatact

SEQ ID NO: 1005879 - DNA, 13 bp, Homo sapiens
ataattttgctgg

SEQ ID NO: 1005880 - DNA, 22 bp, Homo sapiens
ataattttgctggaattcctaa

SEQ ID NO: 1005881 - DNA, 21 bp, Homo sapiens
ataattttggaataatttcta

SEQ ID NO: 1005882 - DNA, 23 bp, Homo sapiens
ataattttgtaatgtatcaaata

SEQ ID NO: 1005883 - DNA, 17 bp, Homo sapiens
ataatttttaacttttg

SEQ ID NO: 1005884 - DNA, 17 bp, Homo sapiens
ataattttttattcaag

SEQ ID NO: 1005885 - DNA, 11 bp, Homo sapiens
ccactgagctc

SEQ ID NO: 1005886 - DNA, 13 bp, Homo sapiens
ccactgagggcag

SEQ ID NO: 1005887 - DNA, 22 bp, Homo sapiens
ccactgatagatgtctattctt

SEQ ID NO: 1005888 - DNA, 16 bp, Homo sapiens
ccactgcaaataaagc

SEQ ID NO: 1005889 - DNA, 18 bp, Homo sapiens
ccactgcaacttgtgaac

SEQ ID NO: 1005890 - DNA, 16 bp, Homo sapiens
ccactgcaagtctgtg

SEQ ID NO: 1005891 - DNA, 13 bp, Homo sapiens
ccactgcacacac

SEQ ID NO: 1005892 - DNA, 20 bp, Homo sapiens
ccactgcacctgacctgctg

SEQ ID NO: 1005893 - DNA, 19 bp, Homo sapiens
ccactgcactccagcctgg

SEQ ID NO: 1005894 - DNA, 20 bp, Homo sapiens
ccactgcactccagcctggc

SEQ ID NO: 1005895 - DNA, 13 bp, Homo sapiens
ccactgcaggccc

SEQ ID NO: 1005896 - DNA, 20 bp, Homo sapiens
ccactgccaagcttcctgtg

SEQ ID NO: 1005897 - DNA, 22 bp, Homo sapiens
ccactgccaagcttcctgtgcc

SEQ ID NO: 1005898 - DNA, 21 bp, Homo sapiens
ccactgccaatgctgtacgta

SEQ ID NO: 1005899 - DNA, 23 bp, Homo sapiens
ccactgccagcagcagcaggtga

SEQ ID NO: 1005900 - DNA, 11 bp, Homo sapiens
ccactgccagg

SEQ ID NO: 1005901 - DNA, 14 bp, Homo sapiens
ccactgccaggcac

SEQ ID NO: 1005902 - DNA, 17 bp, Homo sapiens
ccactgccaggcacctg

SEQ ID NO: 1005903 - DNA, 20 bp, Homo sapiens
ccactgccaggcacctggcc

SEQ ID NO: 1005904 - DNA, 22 bp, Homo sapiens
ccactgccaggcacctggcctg

SEQ ID NO: 1005905 - DNA, 17 bp, Homo sapiens
ccactgcccgagctggt

SEQ ID NO: 1005906 - DNA, 23 bp, Homo sapiens
ccactgcccgagctggtgcatta

SEQ ID NO: 1005907 - DNA, 12 bp, Homo sapiens
ccactgccctgc

SEQ ID NO: 1005908 - DNA, 21 bp, Homo sapiens
ccactgccctgcctgcccact

SEQ ID NO: 1005909 - DNA, 17 bp, Homo sapiens
ccactgcctctccctct

SEQ ID NO: 1005910 - DNA, 15 bp, Homo sapiens
ccactgcctgcccac

SEQ ID NO: 1005911 - DNA, 16 bp, Homo sapiens
ccactgcctgcccacc

SEQ ID NO: 1005912 - DNA, 17 bp, Homo sapiens
ccactgcctgcccaccc

SEQ ID NO: 1005913 - DNA, 21 bp, Homo sapiens
ccactgccttcgatacaccgg

SEQ ID NO: 1005914 - DNA, 14 bp, Homo sapiens
ccactgccttcgct

SEQ ID NO: 1005915 - DNA, 22 bp, Homo sapiens
ccactgccttcgcttcttgcct

SEQ ID NO: 1005916 - DNA, 13 bp, Homo sapiens
ccactgcgcccag

SEQ ID NO: 1005917 - DNA, 18 bp, Homo sapiens
ccactgctaaggctgctg

SEQ ID NO: 1005918 - DNA, 20 bp, Homo sapiens
ccactgctaaggctgctggc

SEQ ID NO: 1005919 - DNA, 21 bp, Homo sapiens
ccactgctaaggctgctggct

SEQ ID NO: 1005920 - DNA, 22 bp, Homo sapiens
ccactgctaaggctgctggctt

SEQ ID NO: 1005921 - DNA, 23 bp, Homo sapiens
ccactgctaaggctgctggcttc

SEQ ID NO: 1005922 - DNA, 16 bp, Homo sapiens
ccactgctccgtggag

SEQ ID NO: 1005923 - DNA, 14 bp, Homo sapiens
ccactgctgagctg

SEQ ID NO: 1005924 - DNA, 23 bp, Homo sapiens
ccactgctgaggagtctgaggac

SEQ ID NO: 1005925 - DNA, 22 bp, Homo sapiens
ccactgctgatattttctctag

SEQ ID NO: 1005926 - DNA, 16 bp, Homo sapiens
ccactgctgcttctcc

SEQ ID NO: 1005927 - DNA, 13 bp, Homo sapiens
ccactgcttctct

SEQ ID NO: 1005928 - DNA, 16 bp, Homo sapiens
ccactggacttgagct

SEQ ID NO: 1005929 - DNA, 21 bp, Homo sapiens
ccactggacttgagcttggca

SEQ ID NO: 1005930 - DNA, 20 bp, Homo sapiens
ccactggcagaaacaggagg

SEQ ID NO: 1005931 - DNA, 16 bp, Homo sapiens
ccactggcatcgcagc

SEQ ID NO: 1005932 - DNA, 18 bp, Homo sapiens
ccactggccaccaggctg

SEQ ID NO: 1005933 - DNA, 20 bp, Homo sapiens
ccactggccaccaggctggc

SEQ ID NO: 1005934 - DNA, 20 bp, Homo sapiens
ccactggctgagaatctggg

SEQ ID NO: 1005935 - DNA, 23 bp, Homo sapiens
ccactggctgagaatctgggggt

SEQ ID NO: 1005936 - DNA, 16 bp, Homo sapiens
ccactgggactcccag

SEQ ID NO: 1005937 - DNA, 16 bp, Homo sapiens
ccactgggcacctgcg

SEQ ID NO: 1005938 - DNA, 20 bp, Homo sapiens
ccactgggccagccctgcag

SEQ ID NO: 1005939 - DNA, 22 bp, Homo sapiens
ccactgggccagccctgcagcc

SEQ ID NO: 1005940 - DNA, 13 bp, Homo sapiens
ccactgggcccct

SEQ ID NO: 1005941 - DNA, 14 bp, Homo sapiens
ccactgggcccctg

SEQ ID NO: 1005942 - DNA, 17 bp, Homo sapiens
ccactgggcccctgtcc

SEQ ID NO: 1005943 - DNA, 21 bp, Homo sapiens
ccactgggcccctgtccccag

SEQ ID NO: 1005944 - DNA, 17 bp, Homo sapiens
ccactgggctctggacc

SEQ ID NO: 1005945 - DNA, 18 bp, Homo sapiens
ccactgggctctggacct

SEQ ID NO: 1005946 - DNA, 19 bp, Homo sapiens
ccactgggctctggacctc

SEQ ID NO: 1005947 - DNA, 20 bp, Homo sapiens
ccactgggctctggacctca

SEQ ID NO: 1005948 - DNA, 17 bp, Homo sapiens
ccactggggactttatt

SEQ ID NO: 1005949 - DNA, 22 bp, Homo sapiens
ccactggggtccagggagcagg

SEQ ID NO: 1005950 - DNA, 15 bp, Homo sapiens
ccactgggtctcact

SEQ ID NO: 1005951 - DNA, 21 bp, Homo sapiens
ccactggttaaaataaagcct

SEQ ID NO: 1005952 - DNA, 23 bp, Homo sapiens
ccactggttaaaataaagcctat

SEQ ID NO: 1005953 - DNA, 18 bp, Homo sapiens
ccactgtaaaatgaaatt

SEQ ID NO: 1005954 - DNA, 19 bp, Homo sapiens
ccactgtcactgtttctct

SEQ ID NO: 1005955 - DNA, 24 bp, Homo sapiens
ccactgtcactgtttctctgctgt

SEQ ID NO: 1005956 - DNA, 22 bp, Homo sapiens
ccactgtccccctacccaccga

SEQ ID NO: 1005957 - DNA, 14 bp, Homo sapiens
ccactgtccctgtc

SEQ ID NO: 1005958 - DNA, 14 bp, Homo sapiens
ccactgtccgcctc

SEQ ID NO: 1005959 - DNA, 13 bp, Homo sapiens
ccactgtcctcct

SEQ ID NO: 1005960 - DNA, 13 bp, Homo sapiens
ccactgtcctggg

SEQ ID NO: 1005961 - DNA, 14 bp, Homo sapiens
ccactgtcctgggc

SEQ ID NO: 1005962 - DNA, 15 bp, Homo sapiens
ccactgtcctgggcg

SEQ ID NO: 1005963 - DNA, 19 bp, Homo sapiens
ccactgtctccacccacct

SEQ ID NO: 1005964 - DNA, 22 bp, Homo sapiens
ccactgtctccacccaccttga

SEQ ID NO: 1005965 - DNA, 14 bp, Homo sapiens
ccactgtgcctcag

SEQ ID NO: 1005966 - DNA, 15 bp, Homo sapiens
ccactgtgcctcaga

SEQ ID NO: 1005967 - DNA, 19 bp, Homo sapiens
ccactgtgcctcagagacc

SEQ ID NO: 1005968 - DNA, 20 bp, Homo sapiens
ccactgtgctccagcctggg

SEQ ID NO: 1005969 - DNA, 16 bp, Homo sapiens
ccactgtggccccaag

SEQ ID NO: 1005970 - DNA, 22 bp, Homo sapiens
ccactgtgtgccttctgccaac

SEQ ID NO: 1005971 - DNA, 22 bp, Homo sapiens
ccactgttgagccccagtgctg

SEQ ID NO: 1005972 - DNA, 15 bp, Homo sapiens
ccactgttgggtggg

SEQ ID NO: 1005973 - DNA, 23 bp, Homo sapiens
ccactgttgggtgggtgggccct

SEQ ID NO: 1005974 - DNA, 18 bp, Homo sapiens
ccactgtttctcttgagc

SEQ ID NO: 1005975 - DNA, 19 bp, Homo sapiens
ccactgtttctcttgagct

SEQ ID NO: 1005976 - DNA, 22 bp, Homo sapiens
ccactgtttctcttgagctggc

SEQ ID NO: 1005977 - DNA, 23 bp, Homo sapiens
ccactgtttctcttgagctggcc

SEQ ID NO: 1005978 - DNA, 16 bp, Homo sapiens
ccacttaaaaaatgtc

SEQ ID NO: 1005979 - DNA, 21 bp, Homo sapiens
ccacttaaaaaatgtccatga

SEQ ID NO: 1005980 - DNA, 13 bp, Homo sapiens
ccacttaaaatgt

SEQ ID NO: 1005981 - DNA, 14 bp, Homo sapiens
ccacttaagttctt

SEQ ID NO: 1005982 - DNA, 15 bp, Homo sapiens
ccacttaatgtatgt

SEQ ID NO: 1005983 - DNA, 20 bp, Homo sapiens
ccacttaatgtatgttacca

SEQ ID NO: 1005984 - DNA, 21 bp, Homo sapiens
ccacttacatttacaaactga

SEQ ID NO: 1005985 - DNA, 22 bp, Homo sapiens
ccacttagccgtccatggcacc

SEQ ID NO: 1005986 - DNA, 14 bp, Homo sapiens
ccacttagttaaaa

SEQ ID NO: 1005987 - DNA, 22 bp, Homo sapiens
ccacttagttaaaattgatttc

SEQ ID NO: 1005988 - DNA, 21 bp, Homo sapiens
ccacttatatcaacttatttt

SEQ ID NO: 1005989 - DNA, 15 bp, Homo sapiens
ccacttatgctgctg

SEQ ID NO: 1005990 - DNA, 20 bp, Homo sapiens
ccacttatgctgctgtgaat

SEQ ID NO: 1005991 - DNA, 16 bp, Homo sapiens
ccacttatttattgtt

SEQ ID NO: 1005992 - DNA, 22 bp, Homo sapiens
ccacttatttattgttgccttt

SEQ ID NO: 1005993 - DNA, 13 bp, Homo sapiens
ccacttcaataga

SEQ ID NO: 1005994 - DNA, 14 bp, Homo sapiens
ccacttcactgtga

SEQ ID NO: 1005995 - DNA, 13 bp, Homo sapiens
ccacttcagctga

SEQ ID NO: 1005996 - DNA, 14 bp, Homo sapiens
ccacttcagctgac

SEQ ID NO: 1005997 - DNA, 15 bp, Homo sapiens
ccacttcattccagc

SEQ ID NO: 1005998 - DNA, 16 bp, Homo sapiens
ccacttcattccagca

SEQ ID NO: 1005999 - DNA, 17 bp, Homo sapiens
ccacttcattccagcag

SEQ ID NO: 1006000 - DNA, 19 bp, Homo sapiens
ccacttcattccagcagct

SEQ ID NO: 1006001 - DNA, 13 bp, Homo sapiens
ccacttccagggg

SEQ ID NO: 1006002 - DNA, 19 bp, Homo sapiens
ccacttccaggggaacctg

SEQ ID NO: 1006003 - DNA, 14 bp, Homo sapiens
ccacttcccatctc

SEQ ID NO: 1006004 - DNA, 12 bp, Homo sapiens
ccacttccctca

SEQ ID NO: 1006005 - DNA, 18 bp, Homo sapiens
ccacttcctcctacctgg

SEQ ID NO: 1006006 - DNA, 15 bp, Homo sapiens
ccacttcctttccta

SEQ ID NO: 1006007 - DNA, 18 bp, Homo sapiens
ccacttctccatgctgca

SEQ ID NO: 1006008 - DNA, 12 bp, Homo sapiens
ccacttctcccc

SEQ ID NO: 1006009 - DNA, 22 bp, Homo sapiens
ataatttttttaaaaaagaaaa

SEQ ID NO: 1006010 - DNA, 23 bp, Homo sapiens
ataatttttttattactgatttt

SEQ ID NO: 1006011 - DNA, 22 bp, Homo sapiens
ataatttttttcaatatttatt

SEQ ID NO: 1006012 - DNA, 13 bp, Homo sapiens
atacaaaaagaaa

SEQ ID NO: 1006013 - DNA, 23 bp, Homo sapiens
atacaaaaagcaaaacaaaaccc

SEQ ID NO: 1006014 - DNA, 15 bp, Homo sapiens
atacaaaagcatgtg

SEQ ID NO: 1006015 - DNA, 17 bp, Homo sapiens
atacaaaccactgtgaa

SEQ ID NO: 1006016 - DNA, 15 bp, Homo sapiens
atacaaactctcacc

SEQ ID NO: 1006017 - DNA, 14 bp, Homo sapiens
atacaaagatgact

SEQ ID NO: 1006018 - DNA, 17 bp, Homo sapiens
atacaaagatgactggt

SEQ ID NO: 1006019 - DNA, 16 bp, Homo sapiens
atacaaagtggaaact

SEQ ID NO: 1006020 - DNA, 19 bp, Homo sapiens
atacaaatgtttataactc

SEQ ID NO: 1006021 - DNA, 17 bp, Homo sapiens
atacaaattagaaaatg

SEQ ID NO: 1006022 - DNA, 16 bp, Homo sapiens
atacaacacaaagaga

SEQ ID NO: 1006023 - DNA, 18 bp, Homo sapiens
atacaacagaaaccagaa

SEQ ID NO: 1006024 - DNA, 20 bp, Homo sapiens
atacaacatgtagctgagtt

SEQ ID NO: 1006025 - DNA, 22 bp, Homo sapiens
atacaaccctggcattatgtcc

SEQ ID NO: 1006026 - DNA, 16 bp, Homo sapiens
atacaaccttcattta

SEQ ID NO: 1006027 - DNA, 18 bp, Homo sapiens
atacaactgtaaagcaaa

SEQ ID NO: 1006028 - DNA, 16 bp, Homo sapiens
atacaactttaccata

SEQ ID NO: 1006029 - DNA, 22 bp, Homo sapiens
atacaagccattctaaggaaat

SEQ ID NO: 1006030 - DNA, 19 bp, Homo sapiens
atacaaggacattcactgc

SEQ ID NO: 1006031 - DNA, 23 bp, Homo sapiens
atacaaggacattcactgctgat

SEQ ID NO: 1006032 - DNA, 12 bp, Homo sapiens
atacaagtttca

SEQ ID NO: 1006033 - DNA, 17 bp, Homo sapiens
atacaagtttcagacag

SEQ ID NO: 1006034 - DNA, 18 bp, Homo sapiens
atacaagtttcagacagg

SEQ ID NO: 1006035 - DNA, 19 bp, Homo sapiens
atacaagtttcagacaggg

SEQ ID NO: 1006036 - DNA, 10 bp, Homo sapiens
atacaataaa

SEQ ID NO: 1006037 - DNA, 16 bp, Homo sapiens
atacaataaaagagct

SEQ ID NO: 1006038 - DNA, 12 bp, Homo sapiens
atacaataaact

SEQ ID NO: 1006039 - DNA, 21 bp, Homo sapiens
atacaataaactattggaaag

SEQ ID NO: 1006040 - DNA, 17 bp, Homo sapiens
atacaataaattgctaa

SEQ ID NO: 1006041 - DNA, 15 bp, Homo sapiens
atacaataacccagt

SEQ ID NO: 1006042 - DNA, 19 bp, Homo sapiens
atacaataacccagttact

SEQ ID NO: 1006043 - DNA, 21 bp, Homo sapiens
atacaataacccagttacttt

SEQ ID NO: 1006044 - DNA, 23 bp, Homo sapiens
atacaatcctgtttataatctga

SEQ ID NO: 1006045 - DNA, 17 bp, Homo sapiens
atacaatggaataaatt

SEQ ID NO: 1006046 - DNA, 16 bp, Homo sapiens
atacaatgtacaatta

SEQ ID NO: 1006047 - DNA, 15 bp, Homo sapiens
atacaatgtatgtac

SEQ ID NO: 1006048 - DNA, 18 bp, Homo sapiens
atacaatgtatgtacaat

SEQ ID NO: 1006049 - DNA, 11 bp, Homo sapiens
atacaattaaa

SEQ ID NO: 1006050 - DNA, 23 bp, Homo sapiens
atacaattaaaggtcctgccctc

SEQ ID NO: 1006051 - DNA, 13 bp, Homo sapiens
atacacaactttg

SEQ ID NO: 1006052 - DNA, 18 bp, Homo sapiens
atacacaactttgcaaat

SEQ ID NO: 1006053 - DNA, 12 bp, Homo sapiens
atacacaatata

SEQ ID NO: 1006054 - DNA, 15 bp, Homo sapiens
atacacaatcctcca

SEQ ID NO: 1006055 - DNA, 14 bp, Homo sapiens
atacacacatatac

SEQ ID NO: 1006056 - DNA, 17 bp, Homo sapiens
atacacacatatacata

SEQ ID NO: 1006057 - DNA, 20 bp, Homo sapiens
atacacacatatacatatat

SEQ ID NO: 1006058 - DNA, 22 bp, Homo sapiens
atacacacatatacatatatat

SEQ ID NO: 1006059 - DNA, 19 bp, Homo sapiens
atacacacatgccctcctg

SEQ ID NO: 1006060 - DNA, 13 bp, Homo sapiens
atacacagaggag

SEQ ID NO: 1006061 - DNA, 21 bp, Homo sapiens
atacacagaggagtgcagcct

SEQ ID NO: 1006062 - DNA, 21 bp, Homo sapiens
atacacagtactttattgtac

SEQ ID NO: 1006063 - DNA, 12 bp, Homo sapiens
atacacagtatt

SEQ ID NO: 1006064 - DNA, 17 bp, Homo sapiens
atacacagttaaataaa

SEQ ID NO: 1006065 - DNA, 13 bp, Homo sapiens
atacacatacata

SEQ ID NO: 1006066 - DNA, 18 bp, Homo sapiens
atacacatacatacacat

SEQ ID NO: 1006067 - DNA, 23 bp, Homo sapiens
atacacatatatatattttacat

SEQ ID NO: 1006068 - DNA, 18 bp, Homo sapiens
atacaccactacattctg

SEQ ID NO: 1006069 - DNA, 20 bp, Homo sapiens
atacaccactacattctgtt

SEQ ID NO: 1006070 - DNA, 17 bp, Homo sapiens
atacaccagcaatttag

SEQ ID NO: 1006071 - DNA, 24 bp, Homo sapiens
atacacccaagatgggcatctttt

SEQ ID NO: 1006072 - DNA, 18 bp, Homo sapiens
atacaccgggcctggaga

SEQ ID NO: 1006073 - DNA, 19 bp, Homo sapiens
atacactaattcctttcta

SEQ ID NO: 1006074 - DNA, 17 bp, Homo sapiens
atacactagcttgaact

SEQ ID NO: 1006075 - DNA, 21 bp, Homo sapiens
atacactatgaagatgtttca

SEQ ID NO: 1006076 - DNA, 19 bp, Homo sapiens
atacactccacttgaagca

SEQ ID NO: 1006077 - DNA, 15 bp, Homo sapiens
atacactgaattgaa

SEQ ID NO: 1006078 - DNA, 22 bp, Homo sapiens
atacactgcactttgtttagaa

SEQ ID NO: 1006079 - DNA, 22 bp, Homo sapiens
atacactgtagtttttgaaaat

SEQ ID NO: 1006080 - DNA, 11 bp, Homo sapiens
atacactgtgt

SEQ ID NO: 1006081 - DNA, 17 bp, Homo sapiens
atacactgtgtaaatac

SEQ ID NO: 1006082 - DNA, 18 bp, Homo sapiens
atacactgtgtaaatacc

SEQ ID NO: 1006083 - DNA, 13 bp, Homo sapiens
atacacttacact

SEQ ID NO: 1006084 - DNA, 22 bp, Homo sapiens
atacacttacactttatgcaca

SEQ ID NO: 1006085 - DNA, 21 bp, Homo sapiens
atacacttctggctcacagga

SEQ ID NO: 1006086 - DNA, 19 bp, Homo sapiens
atacacttcttttgaacat

SEQ ID NO: 1006087 - DNA, 15 bp, Homo sapiens
atacactttgttgca

SEQ ID NO: 1006088 - DNA, 23 bp, Homo sapiens
atacactttgttgcaagatgtga

SEQ ID NO: 1006089 - DNA, 17 bp, Homo sapiens
atacagaactcacagta

SEQ ID NO: 1006090 - DNA, 18 bp, Homo sapiens
atacagaactctttcaaa

SEQ ID NO: 1006091 - DNA, 19 bp, Homo sapiens
atacagaagcccatgtctt

SEQ ID NO: 1006092 - DNA, 20 bp, Homo sapiens
atacagaatcttgttttgaa

SEQ ID NO: 1006093 - DNA, 22 bp, Homo sapiens
atacagaattgactgcagttga

SEQ ID NO: 1006094 - DNA, 18 bp, Homo sapiens
atacagacactaagttat

SEQ ID NO: 1006095 - DNA, 20 bp, Homo sapiens
atacagaccgaactgttgta

SEQ ID NO: 1006096 - DNA, 21 bp, Homo sapiens
atacagaccgaactgttgtat

SEQ ID NO: 1006097 - DNA, 22 bp, Homo sapiens
atacagaggatgccttttctgt

SEQ ID NO: 1006098 - DNA, 21 bp, Homo sapiens
atacagagtacgttaaaagca

SEQ ID NO: 1006099 - DNA, 20 bp, Homo sapiens
atacagataattcatttgta

SEQ ID NO: 1006100 - DNA, 17 bp, Homo sapiens
atacagatcatcttgga

SEQ ID NO: 1006101 - DNA, 16 bp, Homo sapiens
atacagcaacaattta

SEQ ID NO: 1006102 - DNA, 19 bp, Homo sapiens
atacagcattgactcagat

SEQ ID NO: 1006103 - DNA, 18 bp, Homo sapiens
atacagccaaagataatc

SEQ ID NO: 1006104 - DNA, 13 bp, Homo sapiens
atacagctgccta

SEQ ID NO: 1006105 - DNA, 11 bp, Homo sapiens
atacagctggc

SEQ ID NO: 1006106 - DNA, 12 bp, Homo sapiens
atacagctggct

SEQ ID NO: 1006107 - DNA, 12 bp, Homo sapiens
atacagcttcat

SEQ ID NO: 1006108 - DNA, 16 bp, Homo sapiens
atacaggaaacagttg

SEQ ID NO: 1006109 - DNA, 19 bp, Homo sapiens
atacagtaagctgctctat

SEQ ID NO: 1006110 - DNA, 20 bp, Homo sapiens
atacagtccctaaagaaaaa

SEQ ID NO: 1006111 - DNA, 22 bp, Homo sapiens
atacagtccctaaagaaaaaaa

SEQ ID NO: 1006112 - DNA, 17 bp, Homo sapiens
atacagtcttccacaaa

SEQ ID NO: 1006113 - DNA, 21 bp, Homo sapiens
atacagtcttccacaaagaaa

SEQ ID NO: 1006114 - DNA, 13 bp, Homo sapiens
atacagtgcagag

SEQ ID NO: 1006115 - DNA, 23 bp, Homo sapiens
atacagtgcagagccttctcaga

SEQ ID NO: 1006116 - DNA, 15 bp, Homo sapiens
atacagtgcccaccg

SEQ ID NO: 1006117 - DNA, 15 bp, Homo sapiens
atacagtgttatttt

SEQ ID NO: 1006118 - DNA, 22 bp, Homo sapiens
atacagttttcagaaaaagaaa

SEQ ID NO: 1006119 - DNA, 14 bp, Homo sapiens
atacataaaagaaa

SEQ ID NO: 1006120 - DNA, 16 bp, Homo sapiens
atacataaaagaaata

SEQ ID NO: 1006121 - DNA, 18 bp, Homo sapiens
atacataaaagaaataaa

SEQ ID NO: 1006122 - DNA, 12 bp, Homo sapiens
atacataatggg

SEQ ID NO: 1006123 - DNA, 17 bp, Homo sapiens
atacatacacatacata

SEQ ID NO: 1006124 - DNA, 15 bp, Homo sapiens
atacatacaccagca

SEQ ID NO: 1006125 - DNA, 14 bp, Homo sapiens
atacatacatacat

SEQ ID NO: 1006126 - DNA, 18 bp, Homo sapiens
atacatacatacatacat

SEQ ID NO: 1006127 - DNA, 18 bp, Homo sapiens
atacatacatacatatat

SEQ ID NO: 1006128 - DNA, 19 bp, Homo sapiens
atacatacatacatatata

SEQ ID NO: 1006129 - DNA, 14 bp, Homo sapiens
atacatacatatat

SEQ ID NO: 1006130 - DNA, 16 bp, Homo sapiens
atacatacatgtatct

SEQ ID NO: 1006131 - DNA, 21 bp, Homo sapiens
atacatacggtcaggtttaac

SEQ ID NO: 1006132 - DNA, 20 bp, Homo sapiens
atacatagacatttcaaaat

SEQ ID NO: 1006133 - DNA, 15 bp, Homo sapiens
ccacttctgcgggct

SEQ ID NO: 1006134 - DNA, 16 bp, Homo sapiens
ccacttctgcgggctc

SEQ ID NO: 1006135 - DNA, 17 bp, Homo sapiens
ccacttctgcgggctcc

SEQ ID NO: 1006136 - DNA, 20 bp, Homo sapiens
ccacttctgcgggctccctc

SEQ ID NO: 1006137 - DNA, 12 bp, Homo sapiens
ccacttctggcc

SEQ ID NO: 1006138 - DNA, 16 bp, Homo sapiens
ccacttctggcctcca

SEQ ID NO: 1006139 - DNA, 21 bp, Homo sapiens
ccacttctggcctccagcctt

SEQ ID NO: 1006140 - DNA, 12 bp, Homo sapiens
ccacttctggct

SEQ ID NO: 1006141 - DNA, 18 bp, Homo sapiens
ccacttctggcttcagcc

SEQ ID NO: 1006142 - DNA, 20 bp, Homo sapiens
ccacttctggcttcagcccc

SEQ ID NO: 1006143 - DNA, 15 bp, Homo sapiens
ccacttctggtcccc

SEQ ID NO: 1006144 - DNA, 17 bp, Homo sapiens
ccacttctggtcccctg

SEQ ID NO: 1006145 - DNA, 14 bp, Homo sapiens
ccacttctgtgcca

SEQ ID NO: 1006146 - DNA, 12 bp, Homo sapiens
ccacttctgtgg

SEQ ID NO: 1006147 - DNA, 14 bp, Homo sapiens
ccacttctgtgggc

SEQ ID NO: 1006148 - DNA, 18 bp, Homo sapiens
ccacttcttaaaggcctg

SEQ ID NO: 1006149 - DNA, 20 bp, Homo sapiens
ccacttcttaaaggcctgga

SEQ ID NO: 1006150 - DNA, 22 bp, Homo sapiens
ccacttcttaaaggcctggaac

SEQ ID NO: 1006151 - DNA, 23 bp, Homo sapiens
ccacttcttcctttctctttctc

SEQ ID NO: 1006152 - DNA, 17 bp, Homo sapiens
ccacttcttggttcctg

SEQ ID NO: 1006153 - DNA, 20 bp, Homo sapiens
ccacttcttggttcctggga

SEQ ID NO: 1006154 - DNA, 23 bp, Homo sapiens
ccacttgacactattcactaaaa

SEQ ID NO: 1006155 - DNA, 17 bp, Homo sapiens
ccacttgattgagaaag

SEQ ID NO: 1006156 - DNA, 13 bp, Homo sapiens
ccacttgcctctt

SEQ ID NO: 1006157 - DNA, 22 bp, Homo sapiens
ccacttgcctcttccttgaaga

SEQ ID NO: 1006158 - DNA, 16 bp, Homo sapiens
ccacttgcctttttct

SEQ ID NO: 1006159 - DNA, 21 bp, Homo sapiens
ccacttggaggcctttcatcc

SEQ ID NO: 1006160 - DNA, 23 bp, Homo sapiens
ccacttggggccttcccccttgt

SEQ ID NO: 1006161 - DNA, 19 bp, Homo sapiens
ccactttacccacctagaa

SEQ ID NO: 1006162 - DNA, 14 bp, Homo sapiens
ccactttctgttcc

SEQ ID NO: 1006163 - DNA, 13 bp, Homo sapiens
ccactttgaaggg

SEQ ID NO: 1006164 - DNA, 17 bp, Homo sapiens
ccactttggctgaacta

SEQ ID NO: 1006165 - DNA, 21 bp, Homo sapiens
ccactttggcttctcctgtga

SEQ ID NO: 1006166 - DNA, 13 bp, Homo sapiens
ccactttgtccat

SEQ ID NO: 1006167 - DNA, 17 bp, Homo sapiens
ccactttgtctgtacat

SEQ ID NO: 1006168 - DNA, 20 bp, Homo sapiens
ccactttgttggcccttcca

SEQ ID NO: 1006169 - DNA, 16 bp, Homo sapiens
ccacttttattcattt

SEQ ID NO: 1006170 - DNA, 22 bp, Homo sapiens
ccacttttgaagtcttccctca

SEQ ID NO: 1006171 - DNA, 15 bp, Homo sapiens
ccacttttgttcttg

SEQ ID NO: 1006172 - DNA, 20 bp, Homo sapiens
ccagaaaaatgaaaagcaat

SEQ ID NO: 1006173 - DNA, 16 bp, Homo sapiens
ccagaaaaccccagca

SEQ ID NO: 1006174 - DNA, 18 bp, Homo sapiens
ccagaaaatgtaaggcaa

SEQ ID NO: 1006175 - DNA, 23 bp, Homo sapiens
ccagaaacagctgcttctccccc

SEQ ID NO: 1006176 - DNA, 19 bp, Homo sapiens
ccagaaactgaaccaacag

SEQ ID NO: 1006177 - DNA, 12 bp, Homo sapiens
ccagaaagaaaa

SEQ ID NO: 1006178 - DNA, 19 bp, Homo sapiens
ccagaaagcctcctgcccc

SEQ ID NO: 1006179 - DNA, 23 bp, Homo sapiens
ccagaaagcctcctgccccctgc

SEQ ID NO: 1006180 - DNA, 14 bp, Homo sapiens
ccagaaagctgcca

SEQ ID NO: 1006181 - DNA, 15 bp, Homo sapiens
ccagaaagctgccag

SEQ ID NO: 1006182 - DNA, 16 bp, Homo sapiens
ccagaaaggatattta

SEQ ID NO: 1006183 - DNA, 20 bp, Homo sapiens
ccagaaaggatatttaagaa

SEQ ID NO: 1006184 - DNA, 16 bp, Homo sapiens
ccagaaagggtgccag

SEQ ID NO: 1006185 - DNA, 23 bp, Homo sapiens
ccagaaagggtgccagttgggct

SEQ ID NO: 1006186 - DNA, 23 bp, Homo sapiens
ccagaaataaagttggtgacaga

SEQ ID NO: 1006187 - DNA, 17 bp, Homo sapiens
ccagaaatacctgtcta

SEQ ID NO: 1006188 - DNA, 15 bp, Homo sapiens
ccagaaatgggcagt

SEQ ID NO: 1006189 - DNA, 17 bp, Homo sapiens
ccagaaattagaaacct

SEQ ID NO: 1006190 - DNA, 17 bp, Homo sapiens
ccagaaattccagtaaa

SEQ ID NO: 1006191 - DNA, 14 bp, Homo sapiens
ccagaacaaaaaga

SEQ ID NO: 1006192 - DNA, 15 bp, Homo sapiens
ccagaacagccctcg

SEQ ID NO: 1006193 - DNA, 15 bp, Homo sapiens
ccagaacagtatgaa

SEQ ID NO: 1006194 - DNA, 15 bp, Homo sapiens
ccagaacatacactg

SEQ ID NO: 1006195 - DNA, 23 bp, Homo sapiens
ccagaacgcaccccactgggaga

SEQ ID NO: 1006196 - DNA, 20 bp, Homo sapiens
ccagaacgtggctctgctgg

SEQ ID NO: 1006197 - DNA, 15 bp, Homo sapiens
ccagaactggctggg

SEQ ID NO: 1006198 - DNA, 20 bp, Homo sapiens
ccagaactggctgggcccct

SEQ ID NO: 1006199 - DNA, 17 bp, Homo sapiens
ccagaacttagccttta

SEQ ID NO: 1006200 - DNA, 22 bp, Homo sapiens
ccagaagaaaatagtggtgtga

SEQ ID NO: 1006201 - DNA, 19 bp, Homo sapiens
ccagaagaagagaagctgc

SEQ ID NO: 1006202 - DNA, 21 bp, Homo sapiens
ccagaagaagagaagctgctg

SEQ ID NO: 1006203 - DNA, 20 bp, Homo sapiens
ccagaagaatattcaggact

SEQ ID NO: 1006204 - DNA, 15 bp, Homo sapiens
ccagaagcctctggc

SEQ ID NO: 1006205 - DNA, 19 bp, Homo sapiens
ccagaagccttggaaccag

SEQ ID NO: 1006206 - DNA, 23 bp, Homo sapiens
ccagaagccttggaaccagcccc

SEQ ID NO: 1006207 - DNA, 11 bp, Homo sapiens
ccagaagctgc

SEQ ID NO: 1006208 - DNA, 18 bp, Homo sapiens
ataccttatatatgcact

SEQ ID NO: 1006209 - DNA, 15 bp, Homo sapiens
ataccttctatgtat

SEQ ID NO: 1006210 - DNA, 14 bp, Homo sapiens
ataccttcttcgct

SEQ ID NO: 1006211 - DNA, 14 bp, Homo sapiens
ataccttgtgcatt

SEQ ID NO: 1006212 - DNA, 21 bp, Homo sapiens
atacctttcctttttggggag

SEQ ID NO: 1006213 - DNA, 12 bp, Homo sapiens
atacctttgaaa

SEQ ID NO: 1006214 - DNA, 14 bp, Homo sapiens
atacgaaataattg

SEQ ID NO: 1006215 - DNA, 13 bp, Homo sapiens
atacgactttatt

SEQ ID NO: 1006216 - DNA, 22 bp, Homo sapiens
atacgcatcccatctctcccac

SEQ ID NO: 1006217 - DNA, 21 bp, Homo sapiens
atacgctggcaacacagaggc

SEQ ID NO: 1006218 - DNA, 14 bp, Homo sapiens
atacgtacacattt

SEQ ID NO: 1006219 - DNA, 19 bp, Homo sapiens
atacgtagttgtgcttttg

SEQ ID NO: 1006220 - DNA, 13 bp, Homo sapiens
atacgtgcacagg

SEQ ID NO: 1006221 - DNA, 21 bp, Homo sapiens
atacgtgttaggaggctgcat

SEQ ID NO: 1006222 - DNA, 16 bp, Homo sapiens
atacgttttggtgttg

SEQ ID NO: 1006223 - DNA, 22 bp, Homo sapiens
atacgttttggtgttgcttttc

SEQ ID NO: 1006224 - DNA, 17 bp, Homo sapiens
atactaagcattgaatg

SEQ ID NO: 1006225 - DNA, 18 bp, Homo sapiens
atactaataaactaataa

SEQ ID NO: 1006226 - DNA, 12 bp, Homo sapiens
atactaatgatg

SEQ ID NO: 1006227 - DNA, 13 bp, Homo sapiens
atactacagtttg

SEQ ID NO: 1006228 - DNA, 15 bp, Homo sapiens
atactacagtttgtt

SEQ ID NO: 1006229 - DNA, 16 bp, Homo sapiens
atactacagtttgtta

SEQ ID NO: 1006230 - DNA, 14 bp, Homo sapiens
atactacatcttta

SEQ ID NO: 1006231 - DNA, 14 bp, Homo sapiens
atactaccttgaaa

SEQ ID NO: 1006232 - DNA, 17 bp, Homo sapiens
atactaccttgaaaata

SEQ ID NO: 1006233 - DNA, 14 bp, Homo sapiens
atactataattgta

SEQ ID NO: 1006234 - DNA, 16 bp, Homo sapiens
atactataattgtaaa

SEQ ID NO: 1006235 - DNA, 18 bp, Homo sapiens
atactataattgtaaata

SEQ ID NO: 1006236 - DNA, 13 bp, Homo sapiens
atactatgcagta

SEQ ID NO: 1006237 - DNA, 18 bp, Homo sapiens
atactatgcagtatctct

SEQ ID NO: 1006238 - DNA, 16 bp, Homo sapiens
atactatttagatttt

SEQ ID NO: 1006239 - DNA, 13 bp, Homo sapiens
atactcaaatggt

SEQ ID NO: 1006240 - DNA, 18 bp, Homo sapiens
atactcaagtttcaggta

SEQ ID NO: 1006241 - DNA, 21 bp, Homo sapiens
atactcagaactgtcccatcc

SEQ ID NO: 1006242 - DNA, 23 bp, Homo sapiens
atactcagaactgtcccatcccc

SEQ ID NO: 1006243 - DNA, 15 bp, Homo sapiens
atactcagcctgctg

SEQ ID NO: 1006244 - DNA, 15 bp, Homo sapiens
atactcatcagagca

SEQ ID NO: 1006245 - DNA, 12 bp, Homo sapiens
atactcatgaat

SEQ ID NO: 1006246 - DNA, 14 bp, Homo sapiens
atactcatttctta

SEQ ID NO: 1006247 - DNA, 22 bp, Homo sapiens
atactccagcacctgtggctga

SEQ ID NO: 1006248 - DNA, 22 bp, Homo sapiens
atactccctttaaagagagttt

SEQ ID NO: 1006249 - DNA, 20 bp, Homo sapiens
atactctagaacatgcacat

SEQ ID NO: 1006250 - DNA, 22 bp, Homo sapiens
atactctccctgacatttctaa

SEQ ID NO: 1006251 - DNA, 13 bp, Homo sapiens
atactctgtcaga

SEQ ID NO: 1006252 - DNA, 14 bp, Homo sapiens
atactcttgaaagg

SEQ ID NO: 1006253 - DNA, 20 bp, Homo sapiens
atactcttgaaatgtagaat

SEQ ID NO: 1006254 - DNA, 15 bp, Homo sapiens
atactctttcaataa

SEQ ID NO: 1006255 - DNA, 14 bp, Homo sapiens
atactctttctgta

SEQ ID NO: 1006256 - DNA, 15 bp, Homo sapiens
atactgaacatctga

SEQ ID NO: 1006257 - DNA, 15 bp, Homo sapiens
atactgaaggaaaaa

SEQ ID NO: 1006258 - DNA, 22 bp, Homo sapiens
atactgaaggaaaaacacaagc

SEQ ID NO: 1006259 - DNA, 16 bp, Homo sapiens
atactgacctacctca

SEQ ID NO: 1006260 - DNA, 15 bp, Homo sapiens
ccagaccatggacac

SEQ ID NO: 1006261 - DNA, 21 bp, Homo sapiens
ccagacccacctggagcccgc

SEQ ID NO: 1006262 - DNA, 22 bp, Homo sapiens
ccagacccacctggagcccgct

SEQ ID NO: 1006263 - DNA, 19 bp, Homo sapiens
ccagacccactctgcggcc

SEQ ID NO: 1006264 - DNA, 14 bp, Homo sapiens
ccagacccactgaa

SEQ ID NO: 1006265 - DNA, 15 bp, Homo sapiens
ccagaccccagggca

SEQ ID NO: 1006266 - DNA, 14 bp, Homo sapiens
ccagacccccaccc

SEQ ID NO: 1006267 - DNA, 15 bp, Homo sapiens
ccagacccccacccc

SEQ ID NO: 1006268 - DNA, 22 bp, Homo sapiens
ccagacccccaccccttcccca

SEQ ID NO: 1006269 - DNA, 15 bp, Homo sapiens
ccagaccccgtggct

SEQ ID NO: 1006270 - DNA, 21 bp, Homo sapiens
ccagaccccgtggctctggga

SEQ ID NO: 1006271 - DNA, 12 bp, Homo sapiens
ccagacccctct

SEQ ID NO: 1006272 - DNA, 18 bp, Homo sapiens
ccagacccctctggccag

SEQ ID NO: 1006273 - DNA, 21 bp, Homo sapiens
ccagacccctctggccaggat

SEQ ID NO: 1006274 - DNA, 23 bp, Homo sapiens
ccagacccctctggccaggatgg

SEQ ID NO: 1006275 - DNA, 16 bp, Homo sapiens
ccagacccctggcttt

SEQ ID NO: 1006276 - DNA, 18 bp, Homo sapiens
ccagacccctggcttttc

SEQ ID NO: 1006277 - DNA, 24 bp, Homo sapiens
ccagacccctggcttttcactgct

SEQ ID NO: 1006278 - DNA, 16 bp, Homo sapiens
ccagaccctgcctgag

SEQ ID NO: 1006279 - DNA, 21 bp, Homo sapiens
ccagaccctgcctgagcccag

SEQ ID NO: 1006280 - DNA, 18 bp, Homo sapiens
ccagacctagcaggctgt

SEQ ID NO: 1006281 - DNA, 19 bp, Homo sapiens
ccagacctgcgaaggatga

SEQ ID NO: 1006282 - DNA, 21 bp, Homo sapiens
ccagacctgttagcagacagg

SEQ ID NO: 1006283 - DNA, 19 bp, Homo sapiens
ccagaccttaagacactgt

SEQ ID NO: 1006284 - DNA, 21 bp, Homo sapiens
ccagaccttaagacactgtga

SEQ ID NO: 1006285 - DNA, 23 bp, Homo sapiens
ccagaccttaagacactgtgaga

SEQ ID NO: 1006286 - DNA, 16 bp, Homo sapiens
ccagacgaggggcttc

SEQ ID NO: 1006287 - DNA, 21 bp, Homo sapiens
ccagacgcatagactgaggta

SEQ ID NO: 1006288 - DNA, 24 bp, Homo sapiens
ccagacgctgccgctgccgctgca

SEQ ID NO: 1006289 - DNA, 15 bp, Homo sapiens
ccagacgtcaggccc

SEQ ID NO: 1006290 - DNA, 22 bp, Homo sapiens
ccagactaaaggatccagagag

SEQ ID NO: 1006291 - DNA, 12 bp, Homo sapiens
ccagactacagg

SEQ ID NO: 1006292 - DNA, 16 bp, Homo sapiens
ccagactacttgggag

SEQ ID NO: 1006293 - DNA, 18 bp, Homo sapiens
ccagactagatgtagtat

SEQ ID NO: 1006294 - DNA, 15 bp, Homo sapiens
ccagactcaggttcc

SEQ ID NO: 1006295 - DNA, 19 bp, Homo sapiens
ccagactcaggttccagaa

SEQ ID NO: 1006296 - DNA, 13 bp, Homo sapiens
ccagactcttgcc

SEQ ID NO: 1006297 - DNA, 15 bp, Homo sapiens
ccagactgagctctc

SEQ ID NO: 1006298 - DNA, 18 bp, Homo sapiens
ccagactgagctctccag

SEQ ID NO: 1006299 - DNA, 23 bp, Homo sapiens
ccagactgagctctccaggccag

SEQ ID NO: 1006300 - DNA, 16 bp, Homo sapiens
ccagactgatgagcac

SEQ ID NO: 1006301 - DNA, 18 bp, Homo sapiens
ccagactgatgagcacat

SEQ ID NO: 1006302 - DNA, 22 bp, Homo sapiens
ccagactgcttccaattttctg

SEQ ID NO: 1006303 - DNA, 17 bp, Homo sapiens
ccagactggaagacact

SEQ ID NO: 1006304 - DNA, 13 bp, Homo sapiens
ccagactgggccc

SEQ ID NO: 1006305 - DNA, 16 bp, Homo sapiens
ccagactgggcccagg

SEQ ID NO: 1006306 - DNA, 23 bp, Homo sapiens
ccagactgggcccaggcaggtct

SEQ ID NO: 1006307 - DNA, 18 bp, Homo sapiens
ccagactgtggagaaata

SEQ ID NO: 1006308 - DNA, 16 bp, Homo sapiens
ccagacttggcctcca

SEQ ID NO: 1006309 - DNA, 19 bp, Homo sapiens
ccagacttggcctccagct

SEQ ID NO: 1006310 - DNA, 16 bp, Homo sapiens
ccagactttgagcctg

SEQ ID NO: 1006311 - DNA, 21 bp, Homo sapiens
ccagacttttgcttacctttt

SEQ ID NO: 1006312 - DNA, 18 bp, Homo sapiens
ccagagaaaattaattat

SEQ ID NO: 1006313 - DNA, 21 bp, Homo sapiens
ccagagaaactaacttggtgg

SEQ ID NO: 1006314 - DNA, 12 bp, Homo sapiens
ccagagaacagc

SEQ ID NO: 1006315 - DNA, 15 bp, Homo sapiens
ccagagaagccccgc

SEQ ID NO: 1006316 - DNA, 14 bp, Homo sapiens
ccagagaatcttaa

SEQ ID NO: 1006317 - DNA, 20 bp, Homo sapiens
ccagagaccaggctgtgtcc

SEQ ID NO: 1006318 - DNA, 20 bp, Homo sapiens
ccagagacccaacagcagtg

SEQ ID NO: 1006319 - DNA, 16 bp, Homo sapiens
ccagagaccccttcct

SEQ ID NO: 1006320 - DNA, 17 bp, Homo sapiens
ccagagaccccttcctt

SEQ ID NO: 1006321 - DNA, 20 bp, Homo sapiens
ccagagaccccttcctttcc

SEQ ID NO: 1006322 - DNA, 15 bp, Homo sapiens
ccagagactcagagg

SEQ ID NO: 1006323 - DNA, 16 bp, Homo sapiens
ccagagactttgtaga

SEQ ID NO: 1006324 - DNA, 17 bp, Homo sapiens
ccagagagaccctgcaa

SEQ ID NO: 1006325 - DNA, 14 bp, Homo sapiens
ccagagagagaagt

SEQ ID NO: 1006326 - DNA, 21 bp, Homo sapiens
ccagagagagaagtgcccctg

SEQ ID NO: 1006327 - DNA, 20 bp, Homo sapiens
ccagagagcaactctgagat

SEQ ID NO: 1006328 - DNA, 21 bp, Homo sapiens
ccagagagcaactctgagatc

SEQ ID NO: 1006329 - DNA, 15 bp, Homo sapiens
ccagagagcaggcag

SEQ ID NO: 1006330 - DNA, 16 bp, Homo sapiens
atacttggatttagtt

SEQ ID NO: 1006331 - DNA, 20 bp, Homo sapiens
atacttggctgcttcctgtg

SEQ ID NO: 1006332 - DNA, 14 bp, Homo sapiens
atacttgtgatttt

SEQ ID NO: 1006333 - DNA, 16 bp, Homo sapiens
atactttaaaggaaaa

SEQ ID NO: 1006334 - DNA, 14 bp, Homo sapiens
atactttacaaacc

SEQ ID NO: 1006335 - DNA, 18 bp, Homo sapiens
atactttagtagacattt

SEQ ID NO: 1006336 - DNA, 20 bp, Homo sapiens
atactttagtagacatttat

SEQ ID NO: 1006337 - DNA, 21 bp, Homo sapiens
atactttatcaatgtgtcttt

SEQ ID NO: 1006338 - DNA, 19 bp, Homo sapiens
atactttgacaaggaaaat

SEQ ID NO: 1006339 - DNA, 16 bp, Homo sapiens
atactttgagttttga

SEQ ID NO: 1006340 - DNA, 16 bp, Homo sapiens
atactttgcattgtct

SEQ ID NO: 1006341 - DNA, 18 bp, Homo sapiens
atactttgcattgtctgt

SEQ ID NO: 1006342 - DNA, 15 bp, Homo sapiens
atactttgcttcata

SEQ ID NO: 1006343 - DNA, 23 bp, Homo sapiens
atactttgcttcatagtattgga

SEQ ID NO: 1006344 - DNA, 18 bp, Homo sapiens
atactttgtcctaagaga

SEQ ID NO: 1006345 - DNA, 22 bp, Homo sapiens
atactttgtcctaagagattta

SEQ ID NO: 1006346 - DNA, 16 bp, Homo sapiens
atacttttacaagtaa

SEQ ID NO: 1006347 - DNA, 20 bp, Homo sapiens
atacttttacaagtaacaaa

SEQ ID NO: 1006348 - DNA, 15 bp, Homo sapiens
atacttttactctgc

SEQ ID NO: 1006349 - DNA, 20 bp, Homo sapiens
atacttttcccctgttaaac

SEQ ID NO: 1006350 - DNA, 21 bp, Homo sapiens
atacttttcccctgttaaaca

SEQ ID NO: 1006351 - DNA, 22 bp, Homo sapiens
atacttttcccctgttaaacag

SEQ ID NO: 1006352 - DNA, 13 bp, Homo sapiens
atactttttctaa

SEQ ID NO: 1006353 - DNA, 13 bp, Homo sapiens
atacttttttcta

SEQ ID NO: 1006354 - DNA, 19 bp, Homo sapiens
atacttttttcttatttaa

SEQ ID NO: 1006355 - DNA, 15 bp, Homo sapiens
atactttttttcaca

SEQ ID NO: 1006356 - DNA, 15 bp, Homo sapiens
atagaaaaaaagaaa

SEQ ID NO: 1006357 - DNA, 10 bp, Homo sapiens
atagaaaaat

SEQ ID NO: 1006358 - DNA, 19 bp, Homo sapiens
atagaaaaatgtataaaaa

SEQ ID NO: 1006359 - DNA, 23 bp, Homo sapiens
atagaaaaattcagcaaaccatt

SEQ ID NO: 1006360 - DNA, 16 bp, Homo sapiens
atagaaaacaaaggag

SEQ ID NO: 1006361 - DNA, 21 bp, Homo sapiens
atagaaaacaggaaaaaaact

SEQ ID NO: 1006362 - DNA, 22 bp, Homo sapiens
atagaaaagtatgttctaacct

SEQ ID NO: 1006363 - DNA, 17 bp, Homo sapiens
atagaaacaatactgtt

SEQ ID NO: 1006364 - DNA, 15 bp, Homo sapiens
atagaaagagttcta

SEQ ID NO: 1006365 - DNA, 20 bp, Homo sapiens
atagaaagttgatattcaac

SEQ ID NO: 1006366 - DNA, 17 bp, Homo sapiens
atagaaagttgcaaggc

SEQ ID NO: 1006367 - DNA, 18 bp, Homo sapiens
atagaaagttgcaaggca

SEQ ID NO: 1006368 - DNA, 14 bp, Homo sapiens
atagaaataaattc

SEQ ID NO: 1006369 - DNA, 19 bp, Homo sapiens
atagaaataagtggttatt

SEQ ID NO: 1006370 - DNA, 19 bp, Homo sapiens
atagaaatgctggtttttc

SEQ ID NO: 1006371 - DNA, 23 bp, Homo sapiens
atagaaatggaaattttgctatc

SEQ ID NO: 1006372 - DNA, 23 bp, Homo sapiens
atagaacacaaaacttgaaagaa

SEQ ID NO: 1006373 - DNA, 18 bp, Homo sapiens
atagaactactttgaaaa

SEQ ID NO: 1006374 - DNA, 22 bp, Homo sapiens
atagaactttgccagtctttaa

SEQ ID NO: 1006375 - DNA, 15 bp, Homo sapiens
atagaagaactgcaa

SEQ ID NO: 1006376 - DNA, 22 bp, Homo sapiens
atagaagaatatcgatataaat

SEQ ID NO: 1006377 - DNA, 15 bp, Homo sapiens
atagaagagtttaaa

SEQ ID NO: 1006378 - DNA, 20 bp, Homo sapiens
atagaagcccaaattcatat

SEQ ID NO: 1006379 - DNA, 23 bp, Homo sapiens
atagaagctgcagtggtattaat

SEQ ID NO: 1006380 - DNA, 17 bp, Homo sapiens
atagaaggaatttgtac

SEQ ID NO: 1006381 - DNA, 17 bp, Homo sapiens
atagaagtctggaaaaa

SEQ ID NO: 1006382 - DNA, 18 bp, Homo sapiens
atagaataaaatataatt

SEQ ID NO: 1006383 - DNA, 19 bp, Homo sapiens
atagaataaaggcagtttt

SEQ ID NO: 1006384 - DNA, 19 bp, Homo sapiens
atagaataattcttttctg

SEQ ID NO: 1006385 - DNA, 12 bp, Homo sapiens
atagaatacatt

SEQ ID NO: 1006386 - DNA, 19 bp, Homo sapiens
ccagagctgtgcctgctca

SEQ ID NO: 1006387 - DNA, 19 bp, Homo sapiens
ccagagctgtttatggcct

SEQ ID NO: 1006388 - DNA, 22 bp, Homo sapiens
ccagagctgtttatggcctcag

SEQ ID NO: 1006389 - DNA, 19 bp, Homo sapiens
ccagagcttattggccact

SEQ ID NO: 1006390 - DNA, 21 bp, Homo sapiens
ccagagcttattggccactgg

SEQ ID NO: 1006391 - DNA, 19 bp, Homo sapiens
ccagagcttgttgtctcca

SEQ ID NO: 1006392 - DNA, 14 bp, Homo sapiens
ccagagcttttcag

SEQ ID NO: 1006393 - DNA, 19 bp, Homo sapiens
ccagaggaactgtccagag

SEQ ID NO: 1006394 - DNA, 20 bp, Homo sapiens
ccagaggaactgtccagaga

SEQ ID NO: 1006395 - DNA, 17 bp, Homo sapiens
ccagaggaaggggccag

SEQ ID NO: 1006396 - DNA, 18 bp, Homo sapiens
ccagaggaatcctggcag

SEQ ID NO: 1006397 - DNA, 21 bp, Homo sapiens
ccagaggaatgatgggctttt

SEQ ID NO: 1006398 - DNA, 22 bp, Homo sapiens
ccagaggaatgatgggcttttg

SEQ ID NO: 1006399 - DNA, 22 bp, Homo sapiens
ccagaggaattgattgtcagcc

SEQ ID NO: 1006400 - DNA, 18 bp, Homo sapiens
ccagaggacagctctggg

SEQ ID NO: 1006401 - DNA, 18 bp, Homo sapiens
ccagaggacctgagactc

SEQ ID NO: 1006402 - DNA, 20 bp, Homo sapiens
ccagaggactcccaaccctg

SEQ ID NO: 1006403 - DNA, 21 bp, Homo sapiens
ccagaggagccaccagttctc

SEQ ID NO: 1006404 - DNA, 13 bp, Homo sapiens
ccagaggagggca

SEQ ID NO: 1006405 - DNA, 15 bp, Homo sapiens
ccagaggagggcaga

SEQ ID NO: 1006406 - DNA, 19 bp, Homo sapiens
ccagaggagggcagaggga

SEQ ID NO: 1006407 - DNA, 15 bp, Homo sapiens
ccagaggcccccagc

SEQ ID NO: 1006408 - DNA, 19 bp, Homo sapiens
ccagaggccctgaagcctc

SEQ ID NO: 1006409 - DNA, 21 bp, Homo sapiens
ccagaggccttgtcatcctcc

SEQ ID NO: 1006410 - DNA, 19 bp, Homo sapiens
ccagaggctattattttca

SEQ ID NO: 1006411 - DNA, 12 bp, Homo sapiens
ccagaggctggg

SEQ ID NO: 1006412 - DNA, 13 bp, Homo sapiens
ccagaggctggga

SEQ ID NO: 1006413 - DNA, 13 bp, Homo sapiens
ccagagggacagg

SEQ ID NO: 1006414 - DNA, 13 bp, Homo sapiens
ccagagggcagtg

SEQ ID NO: 1006415 - DNA, 13 bp, Homo sapiens
ccagagggcatgc

SEQ ID NO: 1006416 - DNA, 14 bp, Homo sapiens
ccagagggccagca

SEQ ID NO: 1006417 - DNA, 17 bp, Homo sapiens
ccagagggccagcaggc

SEQ ID NO: 1006418 - DNA, 13 bp, Homo sapiens
ccagagggcccag

SEQ ID NO: 1006419 - DNA, 15 bp, Homo sapiens
ccagagggcccaggc

SEQ ID NO: 1006420 - DNA, 17 bp, Homo sapiens
ccagagggcccaggcag

SEQ ID NO: 1006421 - DNA, 18 bp, Homo sapiens
ccagagggcccaggcagg

SEQ ID NO: 1006422 - DNA, 21 bp, Homo sapiens
ccagagggtgtggctttccag

SEQ ID NO: 1006423 - DNA, 21 bp, Homo sapiens
ccagaggtggaggtgggctga

SEQ ID NO: 1006424 - DNA, 16 bp, Homo sapiens
ccagaggtggatgtta

SEQ ID NO: 1006425 - DNA, 12 bp, Homo sapiens
ccagaggtggcc

SEQ ID NO: 1006426 - DNA, 20 bp, Homo sapiens
ccagaggtgggatcctccct

SEQ ID NO: 1006427 - DNA, 17 bp, Homo sapiens
ccagaggtgggcaggtg

SEQ ID NO: 1006428 - DNA, 18 bp, Homo sapiens
ccagaggtgggcaggtgg

SEQ ID NO: 1006429 - DNA, 22 bp, Homo sapiens
ccagaggtgtcgggacatggtt

SEQ ID NO: 1006430 - DNA, 18 bp, Homo sapiens
ccagaggttatctgcctg

SEQ ID NO: 1006431 - DNA, 19 bp, Homo sapiens
ccagaggttatctgcctgg

SEQ ID NO: 1006432 - DNA, 22 bp, Homo sapiens
ccagaggttatctgcctggcct

SEQ ID NO: 1006433 - DNA, 20 bp, Homo sapiens
ccagagtattgggattacag

SEQ ID NO: 1006434 - DNA, 21 bp, Homo sapiens
ccagagtcctttccaaggctt

SEQ ID NO: 1006435 - DNA, 13 bp, Homo sapiens
ccagagtctccca

SEQ ID NO: 1006436 - DNA, 18 bp, Homo sapiens
ccagagtctcccagtggg

SEQ ID NO: 1006437 - DNA, 21 bp, Homo sapiens
ccagagtctcccagtgggtga

SEQ ID NO: 1006438 - DNA, 19 bp, Homo sapiens
ccagagtgaaagggctatg

SEQ ID NO: 1006439 - DNA, 17 bp, Homo sapiens
ccagagtggagtctgag

SEQ ID NO: 1006440 - DNA, 18 bp, Homo sapiens
ccagagtggagtctgagt

SEQ ID NO: 1006441 - DNA, 13 bp, Homo sapiens
ccagagtggccca

SEQ ID NO: 1006442 - DNA, 13 bp, Homo sapiens
ccagagtggcctg

SEQ ID NO: 1006443 - DNA, 14 bp, Homo sapiens
ccagagtggcctgg

SEQ ID NO: 1006444 - DNA, 18 bp, Homo sapiens
ccagagtggcctggccag

SEQ ID NO: 1006445 - DNA, 22 bp, Homo sapiens
ccagagtggcctggccaggagc

SEQ ID NO: 1006446 - DNA, 23 bp, Homo sapiens
ccagagtgggagaggctgggagg

SEQ ID NO: 1006447 - DNA, 14 bp, Homo sapiens
ccagagtgtagggg

SEQ ID NO: 1006448 - DNA, 18 bp, Homo sapiens
ccagagtgtgcagactga

SEQ ID NO: 1006449 - DNA, 18 bp, Homo sapiens
ccagagtgtgggaaggga

SEQ ID NO: 1006450 - DNA, 12 bp, Homo sapiens
ccagagttgctg

SEQ ID NO: 1006451 - DNA, 22 bp, Homo sapiens
atagatttttaatggttaagaa

SEQ ID NO: 1006452 - DNA, 23 bp, Homo sapiens
atagattttttttaaagtttggt

SEQ ID NO: 1006453 - DNA, 15 bp, Homo sapiens
atagcaaaagaagaa

SEQ ID NO: 1006454 - DNA, 18 bp, Homo sapiens
atagcaaaagaagaagtt

SEQ ID NO: 1006455 - DNA, 17 bp, Homo sapiens
atagcaactaatgtttg

SEQ ID NO: 1006456 - DNA, 20 bp, Homo sapiens
atagcaagatattgatcaaa

SEQ ID NO: 1006457 - DNA, 21 bp, Homo sapiens
atagcaagatattgatcaaat

SEQ ID NO: 1006458 - DNA, 22 bp, Homo sapiens
atagcaagatattgatcaaata

SEQ ID NO: 1006459 - DNA, 13 bp, Homo sapiens
atagcaagtgaat

SEQ ID NO: 1006460 - DNA, 22 bp, Homo sapiens
atagcaatccatgttagttttt

SEQ ID NO: 1006461 - DNA, 21 bp, Homo sapiens
atagcaccctgccctcatggg

SEQ ID NO: 1006462 - DNA, 21 bp, Homo sapiens
atagcagactttcccaaatgt

SEQ ID NO: 1006463 - DNA, 18 bp, Homo sapiens
atagcagaggtttaaatg

SEQ ID NO: 1006464 - DNA, 19 bp, Homo sapiens
atagcagatctgttttgtg

SEQ ID NO: 1006465 - DNA, 19 bp, Homo sapiens
atagcagcctttctctctt

SEQ ID NO: 1006466 - DNA, 20 bp, Homo sapiens
atagcataaaatgaaatgct

SEQ ID NO: 1006467 - DNA, 21 bp, Homo sapiens
atagcataaaatgaaatgcta

SEQ ID NO: 1006468 - DNA, 19 bp, Homo sapiens
atagcataatatgaagcct

SEQ ID NO: 1006469 - DNA, 21 bp, Homo sapiens
atagcataatatgaagccttt

SEQ ID NO: 1006470 - DNA, 18 bp, Homo sapiens
atagcatactgtgtatgt

SEQ ID NO: 1006471 - DNA, 19 bp, Homo sapiens
atagcatactgtgtatgtt

SEQ ID NO: 1006472 - DNA, 15 bp, Homo sapiens
atagcatagccagca

SEQ ID NO: 1006473 - DNA, 15 bp, Homo sapiens
atagcatgaaataaa

SEQ ID NO: 1006474 - DNA, 20 bp, Homo sapiens
atagcatgacaggctgttca

SEQ ID NO: 1006475 - DNA, 14 bp, Homo sapiens
atagcatgcttcct

SEQ ID NO: 1006476 - DNA, 16 bp, Homo sapiens
atagcatgcttccttt

SEQ ID NO: 1006477 - DNA, 18 bp, Homo sapiens
atagcatgcttcctttct

SEQ ID NO: 1006478 - DNA, 19 bp, Homo sapiens
atagcatgcttcctttctc

SEQ ID NO: 1006479 - DNA, 14 bp, Homo sapiens
atagcatgggaggt

SEQ ID NO: 1006480 - DNA, 16 bp, Homo sapiens
atagcatggggcccct

SEQ ID NO: 1006481 - DNA, 18 bp, Homo sapiens
atagcatggggcccctgg

SEQ ID NO: 1006482 - DNA, 20 bp, Homo sapiens
atagcatgtcaacttttgac

SEQ ID NO: 1006483 - DNA, 16 bp, Homo sapiens
atagcattgaacattt

SEQ ID NO: 1006484 - DNA, 23 bp, Homo sapiens
atagcattgaacatttcttatga

SEQ ID NO: 1006485 - DNA, 19 bp, Homo sapiens
atagcattgataatcttca

SEQ ID NO: 1006486 - DNA, 16 bp, Homo sapiens
atagcattgtgaactg

SEQ ID NO: 1006487 - DNA, 19 bp, Homo sapiens
atagcatttttgatttatg

SEQ ID NO: 1006488 - DNA, 19 bp, Homo sapiens
atagccaaaaaggcaaata

SEQ ID NO: 1006489 - DNA, 13 bp, Homo sapiens
atagccaaaaata

SEQ ID NO: 1006490 - DNA, 16 bp, Homo sapiens
atagccaaaaatagct

SEQ ID NO: 1006491 - DNA, 18 bp, Homo sapiens
atagccaaaaatagctaa

SEQ ID NO: 1006492 - DNA, 14 bp, Homo sapiens
atagccaaagccag

SEQ ID NO: 1006493 - DNA, 23 bp, Homo sapiens
atagccaactgctaatgcaaatt

SEQ ID NO: 1006494 - DNA, 13 bp, Homo sapiens
atagccactaacc

SEQ ID NO: 1006495 - DNA, 23 bp, Homo sapiens
atagccactaaccttgcctggta

SEQ ID NO: 1006496 - DNA, 13 bp, Homo sapiens
atagccagagagg

SEQ ID NO: 1006497 - DNA, 16 bp, Homo sapiens
atagccagagaggagc

SEQ ID NO: 1006498 - DNA, 21 bp, Homo sapiens
atagccaggcctgacctcaag

SEQ ID NO: 1006499 - DNA, 20 bp, Homo sapiens
atagccatcgactcctgcct

SEQ ID NO: 1006500 - DNA, 22 bp, Homo sapiens
atagccatcgactcctgcctga

SEQ ID NO: 1006501 - DNA, 22 bp, Homo sapiens
atagcccaaagccaagaaagaa

SEQ ID NO: 1006502 - DNA, 15 bp, Homo sapiens
atagcccacttacat

SEQ ID NO: 1006503 - DNA, 14 bp, Homo sapiens
atagcccaggagca

SEQ ID NO: 1006504 - DNA, 14 bp, Homo sapiens
atagcccaggtcct

SEQ ID NO: 1006505 - DNA, 21 bp, Homo sapiens
atagccccagactgggcccag

SEQ ID NO: 1006506 - DNA, 17 bp, Homo sapiens
atagccctcagacattt

SEQ ID NO: 1006507 - DNA, 23 bp, Homo sapiens
atagccctggtgctcctgcccag

SEQ ID NO: 1006508 - DNA, 19 bp, Homo sapiens
atagccgatatcagaattt

SEQ ID NO: 1006509 - DNA, 16 bp, Homo sapiens
atagccgattctctgc

SEQ ID NO: 1006510 - DNA, 19 bp, Homo sapiens
atagccgattctctgcccg

SEQ ID NO: 1006511 - DNA, 15 bp, Homo sapiens
atagcctgaggtccc

SEQ ID NO: 1006512 - DNA, 23 bp, Homo sapiens
ccagcaacatctcgagccccctg

SEQ ID NO: 1006513 - DNA, 15 bp, Homo sapiens
ccagcaaccctccta

SEQ ID NO: 1006514 - DNA, 15 bp, Homo sapiens
ccagcaactgaataa

SEQ ID NO: 1006515 - DNA, 16 bp, Homo sapiens
ccagcaactgaataaa

SEQ ID NO: 1006516 - DNA, 19 bp, Homo sapiens
ccagcaactgcccttccag

SEQ ID NO: 1006517 - DNA, 14 bp, Homo sapiens
ccagcaacttcttc

SEQ ID NO: 1006518 - DNA, 13 bp, Homo sapiens
ccagcaagacctc

SEQ ID NO: 1006519 - DNA, 23 bp, Homo sapiens
ccagcaagacctcatctgtggag

SEQ ID NO: 1006520 - DNA, 20 bp, Homo sapiens
ccagcaagagggaacaaaac

SEQ ID NO: 1006521 - DNA, 17 bp, Homo sapiens
ccagcaagcgggagccc

SEQ ID NO: 1006522 - DNA, 20 bp, Homo sapiens
ccagcaagcgggagcccgtg

SEQ ID NO: 1006523 - DNA, 13 bp, Homo sapiens
ccagcaaggcagg

SEQ ID NO: 1006524 - DNA, 15 bp, Homo sapiens
ccagcaaggcaggtt

SEQ ID NO: 1006525 - DNA, 16 bp, Homo sapiens
ccagcaagtcccagac

SEQ ID NO: 1006526 - DNA, 13 bp, Homo sapiens
ccagcaataaaaa

SEQ ID NO: 1006527 - DNA, 13 bp, Homo sapiens
ccagcaataagaa

SEQ ID NO: 1006528 - DNA, 16 bp, Homo sapiens
ccagcaataagaaatg

SEQ ID NO: 1006529 - DNA, 17 bp, Homo sapiens
ccagcaataagaaatga

SEQ ID NO: 1006530 - DNA, 21 bp, Homo sapiens
ccagcaattctctttctttta

SEQ ID NO: 1006531 - DNA, 18 bp, Homo sapiens
ccagcacagatgaggagc

SEQ ID NO: 1006532 - DNA, 14 bp, Homo sapiens
ccagcacagccacc

SEQ ID NO: 1006533 - DNA, 23 bp, Homo sapiens
ccagcacagccacctccgccaga

SEQ ID NO: 1006534 - DNA, 13 bp, Homo sapiens
ccagcacagcttg

SEQ ID NO: 1006535 - DNA, 15 bp, Homo sapiens
ccagcacaggggccc

SEQ ID NO: 1006536 - DNA, 17 bp, Homo sapiens
ccagcacatagcttgcc

SEQ ID NO: 1006537 - DNA, 18 bp, Homo sapiens
ccagcacatagcttgcct

SEQ ID NO: 1006538 - DNA, 20 bp, Homo sapiens
ccagcacatggccatagagg

SEQ ID NO: 1006539 - DNA, 12 bp, Homo sapiens
ccagcaccgagc

SEQ ID NO: 1006540 - DNA, 15 bp, Homo sapiens
ccagcacctgcctcc

SEQ ID NO: 1006541 - DNA, 16 bp, Homo sapiens
ccagcacctgcctcct

SEQ ID NO: 1006542 - DNA, 15 bp, Homo sapiens
ccagcacctggcatc

SEQ ID NO: 1006543 - DNA, 21 bp, Homo sapiens
ccagcactatgctttccttct

SEQ ID NO: 1006544 - DNA, 21 bp, Homo sapiens
ccagcactgcctcctgttttc

SEQ ID NO: 1006545 - DNA, 15 bp, Homo sapiens
ccagcacttgtatat

SEQ ID NO: 1006546 - DNA, 19 bp, Homo sapiens
ccagcacttgtccagctga

SEQ ID NO: 1006547 - DNA, 15 bp, Homo sapiens
ccagcactttgggag

SEQ ID NO: 1006548 - DNA, 19 bp, Homo sapiens
ccagcactttgggaggcca

SEQ ID NO: 1006549 - DNA, 22 bp, Homo sapiens
ccagcactttgggaggccaagg

SEQ ID NO: 1006550 - DNA, 21 bp, Homo sapiens
ccagcactttgggaggctgag

SEQ ID NO: 1006551 - DNA, 18 bp, Homo sapiens
ccagcagaaatgccccca

SEQ ID NO: 1006552 - DNA, 16 bp, Homo sapiens
ccagcagaaatgcctt

SEQ ID NO: 1006553 - DNA, 22 bp, Homo sapiens
ccagcagaagacaaaaagacaa

SEQ ID NO: 1006554 - DNA, 12 bp, Homo sapiens
ccagcagacaga

SEQ ID NO: 1006555 - DNA, 17 bp, Homo sapiens
ccagcagacagagccag

SEQ ID NO: 1006556 - DNA, 13 bp, Homo sapiens
ccagcagagccca

SEQ ID NO: 1006557 - DNA, 22 bp, Homo sapiens
ccagcagagcccaccagccagc

SEQ ID NO: 1006558 - DNA, 14 bp, Homo sapiens
ccagcagaggcagg

SEQ ID NO: 1006559 - DNA, 22 bp, Homo sapiens
ccagcagaggcaggctgggacg

SEQ ID NO: 1006560 - DNA, 23 bp, Homo sapiens
ccagcagcacaattctgtccctg

SEQ ID NO: 1006561 - DNA, 14 bp, Homo sapiens
ccagcagcagcagg

SEQ ID NO: 1006562 - DNA, 15 bp, Homo sapiens
ccagcagcagcccaa

SEQ ID NO: 1006563 - DNA, 12 bp, Homo sapiens
ccagcagcagga

SEQ ID NO: 1006564 - DNA, 23 bp, Homo sapiens
ccagcagcaggatgggctgagct

SEQ ID NO: 1006565 - DNA, 15 bp, Homo sapiens
ccagcagccagctct

SEQ ID NO: 1006566 - DNA, 16 bp, Homo sapiens
ccagcagccagctctc

SEQ ID NO: 1006567 - DNA, 20 bp, Homo sapiens
ccagcagccagctctcagcc

SEQ ID NO: 1006568 - DNA, 21 bp, Homo sapiens
ccagcagccagctctcagcca

SEQ ID NO: 1006569 - DNA, 18 bp, Homo sapiens
ccagcagcctcgcacagg

SEQ ID NO: 1006570 - DNA, 21 bp, Homo sapiens
ccagcagcctcgcacaggccc

SEQ ID NO: 1006571 - DNA, 13 bp, Homo sapiens
ccagcagcctgga

SEQ ID NO: 1006572 - DNA, 21 bp, Homo sapiens
ataggatttatttaaaatagc

SEQ ID NO: 1006573 - DNA, 14 bp, Homo sapiens
ataggcaaattaat

SEQ ID NO: 1006574 - DNA, 17 bp, Homo sapiens
ataggcactttaaaaca

SEQ ID NO: 1006575 - DNA, 17 bp, Homo sapiens
ataggcagactgggttt

SEQ ID NO: 1006576 - DNA, 20 bp, Homo sapiens
ataggcagactgggtttcta

SEQ ID NO: 1006577 - DNA, 18 bp, Homo sapiens
ataggcagcttctaagag

SEQ ID NO: 1006578 - DNA, 20 bp, Homo sapiens
ataggcaggaagcccaattg

SEQ ID NO: 1006579 - DNA, 20 bp, Homo sapiens
ataggcagggggccctgccc

SEQ ID NO: 1006580 - DNA, 14 bp, Homo sapiens
ataggcattttaag

SEQ ID NO: 1006581 - DNA, 14 bp, Homo sapiens
ataggcccaaggtc

SEQ ID NO: 1006582 - DNA, 20 bp, Homo sapiens
ataggcccaaggtcccctcc

SEQ ID NO: 1006583 - DNA, 14 bp, Homo sapiens
ataggcctgggtgc

SEQ ID NO: 1006584 - DNA, 16 bp, Homo sapiens
ataggcggtcatgtgt

SEQ ID NO: 1006585 - DNA, 21 bp, Homo sapiens
ataggcggtcatgtgtgcatg

SEQ ID NO: 1006586 - DNA, 15 bp, Homo sapiens
ataggctaaatgttg

SEQ ID NO: 1006587 - DNA, 11 bp, Homo sapiens
ataggctctgc

SEQ ID NO: 1006588 - DNA, 13 bp, Homo sapiens
ataggctggagaa

SEQ ID NO: 1006589 - DNA, 14 bp, Homo sapiens
ataggctggagaag

SEQ ID NO: 1006590 - DNA, 21 bp, Homo sapiens
ataggctggagaagctcaccc

SEQ ID NO: 1006591 - DNA, 19 bp, Homo sapiens
ataggctggtggccttggg

SEQ ID NO: 1006592 - DNA, 22 bp, Homo sapiens
atagggaaaattctaacccagg

SEQ ID NO: 1006593 - DNA, 19 bp, Homo sapiens
atagggaaaggttttgtat

SEQ ID NO: 1006594 - DNA, 17 bp, Homo sapiens
atagggaatatatctct

SEQ ID NO: 1006595 - DNA, 18 bp, Homo sapiens
atagggagaatatttact

SEQ ID NO: 1006596 - DNA, 20 bp, Homo sapiens
atagggagaatatttactaa

SEQ ID NO: 1006597 - DNA, 22 bp, Homo sapiens
atagggcctggtccctgggagg

SEQ ID NO: 1006598 - DNA, 18 bp, Homo sapiens
atagggggaagacagata

SEQ ID NO: 1006599 - DNA, 13 bp, Homo sapiens
atagggggctgca

SEQ ID NO: 1006600 - DNA, 15 bp, Homo sapiens
atagggtatttgacc

SEQ ID NO: 1006601 - DNA, 14 bp, Homo sapiens
atagggtgtggctc

SEQ ID NO: 1006602 - DNA, 15 bp, Homo sapiens
ataggtaacgtgatt

SEQ ID NO: 1006603 - DNA, 20 bp, Homo sapiens
ataggtaacgtgattgattc

SEQ ID NO: 1006604 - DNA, 13 bp, Homo sapiens
ataggtagaaaca

SEQ ID NO: 1006605 - DNA, 23 bp, Homo sapiens
ataggtagaatgtaaagcttgtc

SEQ ID NO: 1006606 - DNA, 20 bp, Homo sapiens
ataggtagtttggatatttt

SEQ ID NO: 1006607 - DNA, 15 bp, Homo sapiens
ataggtcactcctgg

SEQ ID NO: 1006608 - DNA, 15 bp, Homo sapiens
ataggtcactggctc

SEQ ID NO: 1006609 - DNA, 16 bp, Homo sapiens
ataggtcactggctct

SEQ ID NO: 1006610 - DNA, 22 bp, Homo sapiens
ataggtcactggctctccaagt

SEQ ID NO: 1006611 - DNA, 13 bp, Homo sapiens
ataggtctcttct

SEQ ID NO: 1006612 - DNA, 14 bp, Homo sapiens
ataggtctcttctc

SEQ ID NO: 1006613 - DNA, 17 bp, Homo sapiens
ataggtctcttctccca

SEQ ID NO: 1006614 - DNA, 18 bp, Homo sapiens
ataggtctcttctcccag

SEQ ID NO: 1006615 - DNA, 19 bp, Homo sapiens
ataggtctcttctcccaga

SEQ ID NO: 1006616 - DNA, 13 bp, Homo sapiens
ataggtctgaaat

SEQ ID NO: 1006617 - DNA, 15 bp, Homo sapiens
ataggtctgaaattt

SEQ ID NO: 1006618 - DNA, 16 bp, Homo sapiens
ataggtctttctctca

SEQ ID NO: 1006619 - DNA, 22 bp, Homo sapiens
ataggtgcttattctcaaagca

SEQ ID NO: 1006620 - DNA, 19 bp, Homo sapiens
ataggttaaactgaagcaa

SEQ ID NO: 1006621 - DNA, 22 bp, Homo sapiens
atagtaaacattaagtaaatgc

SEQ ID NO: 1006622 - DNA, 19 bp, Homo sapiens
atagtaacttcttatggaa

SEQ ID NO: 1006623 - DNA, 21 bp, Homo sapiens
atagtaacttcttatggaatt

SEQ ID NO: 1006624 - DNA, 23 bp, Homo sapiens
atagtaagttactgggcattctc

SEQ ID NO: 1006625 - DNA, 19 bp, Homo sapiens
atagtaataagatggctgt

SEQ ID NO: 1006626 - DNA, 20 bp, Homo sapiens
atagtaataagatggctgtg

SEQ ID NO: 1006627 - DNA, 19 bp, Homo sapiens
atagtaattagtagaaatg

SEQ ID NO: 1006628 - DNA, 13 bp, Homo sapiens
atagtaatttgta

SEQ ID NO: 1006629 - DNA, 16 bp, Homo sapiens
atagtaatttgtaaag

SEQ ID NO: 1006630 - DNA, 20 bp, Homo sapiens
atagtacatgataaatgata

SEQ ID NO: 1006631 - DNA, 19 bp, Homo sapiens
atagtaccatttatacaaa

SEQ ID NO: 1006632 - DNA, 18 bp, Homo sapiens
atagtaccttcaatactt

SEQ ID NO: 1006633 - DNA, 18 bp, Homo sapiens
atagtactctttgtagca

SEQ ID NO: 1006634 - DNA, 22 bp, Homo sapiens
atagtagatgtggcctttgaat

SEQ ID NO: 1006635 - DNA, 15 bp, Homo sapiens
atagtagcatacatt

SEQ ID NO: 1006636 - DNA, 16 bp, Homo sapiens
atagtagcatacattt

SEQ ID NO: 1006637 - DNA, 17 bp, Homo sapiens
atagtaggggttgaaga

SEQ ID NO: 1006638 - DNA, 19 bp, Homo sapiens
atagtaggggttgaagaaa

SEQ ID NO: 1006639 - DNA, 12 bp, Homo sapiens
ccagccagcgcc

SEQ ID NO: 1006640 - DNA, 14 bp, Homo sapiens
ccagccagcgcctc

SEQ ID NO: 1006641 - DNA, 20 bp, Homo sapiens
ccagccagcgcctccctcca

SEQ ID NO: 1006642 - DNA, 15 bp, Homo sapiens
ccagccagctgcagg

SEQ ID NO: 1006643 - DNA, 17 bp, Homo sapiens
ccagccagctgcagggc

SEQ ID NO: 1006644 - DNA, 14 bp, Homo sapiens
ccagccaggagcag

SEQ ID NO: 1006645 - DNA, 10 bp, Homo sapiens
ccagccaggc

SEQ ID NO: 1006646 - DNA, 21 bp, Homo sapiens
ccagccaggcaggtccacaga

SEQ ID NO: 1006647 - DNA, 17 bp, Homo sapiens
ccagccaggccaacagc

SEQ ID NO: 1006648 - DNA, 20 bp, Homo sapiens
ccagccaggccaacagcacc

SEQ ID NO: 1006649 - DNA, 14 bp, Homo sapiens
ccagccaggcccag

SEQ ID NO: 1006650 - DNA, 20 bp, Homo sapiens
ccagccaggcccaggccagc

SEQ ID NO: 1006651 - DNA, 22 bp, Homo sapiens
ccagccaggcccaggccagccc

SEQ ID NO: 1006652 - DNA, 17 bp, Homo sapiens
ccagccaggccccaggc

SEQ ID NO: 1006653 - DNA, 15 bp, Homo sapiens
ccagccaggccctgc

SEQ ID NO: 1006654 - DNA, 16 bp, Homo sapiens
ccagccagtcttgcct

SEQ ID NO: 1006655 - DNA, 18 bp, Homo sapiens
ccagccataaaagcattg

SEQ ID NO: 1006656 - DNA, 21 bp, Homo sapiens
ccagccataaaagcattgtct

SEQ ID NO: 1006657 - DNA, 23 bp, Homo sapiens
ccagccataaaagcattgtctct

SEQ ID NO: 1006658 - DNA, 16 bp, Homo sapiens
ccagccatctgcccag

SEQ ID NO: 1006659 - DNA, 18 bp, Homo sapiens
ccagccatctgcccaggg

SEQ ID NO: 1006660 - DNA, 21 bp, Homo sapiens
ccagccatctgcccaggggtg

SEQ ID NO: 1006661 - DNA, 16 bp, Homo sapiens
ccagccatgtctgcat

SEQ ID NO: 1006662 - DNA, 19 bp, Homo sapiens
ccagccattaccatggaga

SEQ ID NO: 1006663 - DNA, 21 bp, Homo sapiens
ccagccattaccatggagaca

SEQ ID NO: 1006664 - DNA, 12 bp, Homo sapiens
ccagcccaaagg

SEQ ID NO: 1006665 - DNA, 23 bp, Homo sapiens
ccagcccaaaggggacaggcctc

SEQ ID NO: 1006666 - DNA, 14 bp, Homo sapiens
ccagcccacagagc

SEQ ID NO: 1006667 - DNA, 17 bp, Homo sapiens
ccagcccacagagcctg

SEQ ID NO: 1006668 - DNA, 22 bp, Homo sapiens
ccagcccaccctgctcctcctg

SEQ ID NO: 1006669 - DNA, 13 bp, Homo sapiens
ccagcccagagcc

SEQ ID NO: 1006670 - DNA, 21 bp, Homo sapiens
ccagcccagattcccctgtgt

SEQ ID NO: 1006671 - DNA, 12 bp, Homo sapiens
ccagcccagcca

SEQ ID NO: 1006672 - DNA, 12 bp, Homo sapiens
ccagcccagccc

SEQ ID NO: 1006673 - DNA, 12 bp, Homo sapiens
ccagcccagcct

SEQ ID NO: 1006674 - DNA, 17 bp, Homo sapiens
ccagcccatggccccca

SEQ ID NO: 1006675 - DNA, 17 bp, Homo sapiens
ccagcccattctctctc

SEQ ID NO: 1006676 - DNA, 21 bp, Homo sapiens
ccagcccattctctctcctgt

SEQ ID NO: 1006677 - DNA, 22 bp, Homo sapiens
ccagcccattctctctcctgtc

SEQ ID NO: 1006678 - DNA, 15 bp, Homo sapiens
ccagccccacccagg

SEQ ID NO: 1006679 - DNA, 18 bp, Homo sapiens
ccagccccacccccagcc

SEQ ID NO: 1006680 - DNA, 21 bp, Homo sapiens
ccagccccacccccagccagg

SEQ ID NO: 1006681 - DNA, 19 bp, Homo sapiens
ccagccccactcctctgct

SEQ ID NO: 1006682 - DNA, 21 bp, Homo sapiens
ccagccccactgccagcagca

SEQ ID NO: 1006683 - DNA, 14 bp, Homo sapiens
ccagccccagcaag

SEQ ID NO: 1006684 - DNA, 15 bp, Homo sapiens
ccagccccagcaaga

SEQ ID NO: 1006685 - DNA, 18 bp, Homo sapiens
ccagccccaggcctggcc

SEQ ID NO: 1006686 - DNA, 21 bp, Homo sapiens
ccagccccaggcctggcctcg

SEQ ID NO: 1006687 - DNA, 21 bp, Homo sapiens
ccagcccccaggaagacatta

SEQ ID NO: 1006688 - DNA, 15 bp, Homo sapiens
ccagcccccagggcc

SEQ ID NO: 1006689 - DNA, 16 bp, Homo sapiens
ccagcccccagggccc

SEQ ID NO: 1006690 - DNA, 15 bp, Homo sapiens
ccagcccccccaccc

SEQ ID NO: 1006691 - DNA, 23 bp, Homo sapiens
ccagcccccccacccacccccag

SEQ ID NO: 1006692 - DNA, 16 bp, Homo sapiens
ccagcccccgccccag

SEQ ID NO: 1006693 - DNA, 17 bp, Homo sapiens
ccagcccccgccccaga

SEQ ID NO: 1006694 - DNA, 13 bp, Homo sapiens
atagtttgtacat

SEQ ID NO: 1006695 - DNA, 16 bp, Homo sapiens
atagtttgtctatttt

SEQ ID NO: 1006696 - DNA, 17 bp, Homo sapiens
atagtttgtctatttta

SEQ ID NO: 1006697 - DNA, 14 bp, Homo sapiens
atagtttgtgaatc

SEQ ID NO: 1006698 - DNA, 23 bp, Homo sapiens
atagttttacttttaaactgtgt

SEQ ID NO: 1006699 - DNA, 13 bp, Homo sapiens
atagttttcatcc

SEQ ID NO: 1006700 - DNA, 21 bp, Homo sapiens
atataaaaacagattctgatt

SEQ ID NO: 1006701 - DNA, 21 bp, Homo sapiens
atataaaaactcctgggctta

SEQ ID NO: 1006702 - DNA, 22 bp, Homo sapiens
atataaaaagaaaagataaaga

SEQ ID NO: 1006703 - DNA, 23 bp, Homo sapiens
atataaaaagcagatagatggcg

SEQ ID NO: 1006704 - DNA, 22 bp, Homo sapiens
atataaaaagcagcagaggtga

SEQ ID NO: 1006705 - DNA, 15 bp, Homo sapiens
atataaaaatggctt

SEQ ID NO: 1006706 - DNA, 16 bp, Homo sapiens
atataaaactgaaata

SEQ ID NO: 1006707 - DNA, 22 bp, Homo sapiens
atataaaactgtacttcactgt

SEQ ID NO: 1006708 - DNA, 11 bp, Homo sapiens
atataaaagga

SEQ ID NO: 1006709 - DNA, 16 bp, Homo sapiens
atataaaataaatata

SEQ ID NO: 1006710 - DNA, 12 bp, Homo sapiens
atataaaataac

SEQ ID NO: 1006711 - DNA, 14 bp, Homo sapiens
atataaaatatgaa

SEQ ID NO: 1006712 - DNA, 19 bp, Homo sapiens
atataaaatgtattcaagc

SEQ ID NO: 1006713 - DNA, 23 bp, Homo sapiens
atataaacatatttttatacttt

SEQ ID NO: 1006714 - DNA, 15 bp, Homo sapiens
atataaagatatata

SEQ ID NO: 1006715 - DNA, 21 bp, Homo sapiens
atataaaggaaaggccctgca

SEQ ID NO: 1006716 - DNA, 20 bp, Homo sapiens
atataaaggaccctgtttct

SEQ ID NO: 1006717 - DNA, 24 bp, Homo sapiens
atataaagtatcatcagtgtagaa

SEQ ID NO: 1006718 - DNA, 15 bp, Homo sapiens
atataaagtattctt

SEQ ID NO: 1006719 - DNA, 12 bp, Homo sapiens
atataaataagc

SEQ ID NO: 1006720 - DNA, 12 bp, Homo sapiens
atataaatagct

SEQ ID NO: 1006721 - DNA, 16 bp, Homo sapiens
atataaatagctgaaa

SEQ ID NO: 1006722 - DNA, 14 bp, Homo sapiens
atataaatatatat

SEQ ID NO: 1006723 - DNA, 23 bp, Homo sapiens
atataaatatatatatatataaa

SEQ ID NO: 1006724 - DNA, 22 bp, Homo sapiens
atataaatatatatttttcaaa

SEQ ID NO: 1006725 - DNA, 15 bp, Homo sapiens
atataaattaaaata

SEQ ID NO: 1006726 - DNA, 22 bp, Homo sapiens
atataaattcactttcattttt

SEQ ID NO: 1006727 - DNA, 19 bp, Homo sapiens
atataaattgtacattttg

SEQ ID NO: 1006728 - DNA, 19 bp, Homo sapiens
atataaatttaagcaaacg

SEQ ID NO: 1006729 - DNA, 17 bp, Homo sapiens
atataaattttttttgt

SEQ ID NO: 1006730 - DNA, 16 bp, Homo sapiens
atataacagatacatt

SEQ ID NO: 1006731 - DNA, 15 bp, Homo sapiens
atataacatgtaaaa

SEQ ID NO: 1006732 - DNA, 19 bp, Homo sapiens
atataaccattacatgttt

SEQ ID NO: 1006733 - DNA, 21 bp, Homo sapiens
atataaccattacatgtttaa

SEQ ID NO: 1006734 - DNA, 20 bp, Homo sapiens
atataaccttcatttttaag

SEQ ID NO: 1006735 - DNA, 14 bp, Homo sapiens
atataactctttga

SEQ ID NO: 1006736 - DNA, 20 bp, Homo sapiens
atataactgtatttgaaata

SEQ ID NO: 1006737 - DNA, 17 bp, Homo sapiens
atataactgtcttgttt

SEQ ID NO: 1006738 - DNA, 11 bp, Homo sapiens
atataagaaaa

SEQ ID NO: 1006739 - DNA, 16 bp, Homo sapiens
atataagaaaaaattc

SEQ ID NO: 1006740 - DNA, 23 bp, Homo sapiens
atataagaaaagtaatgaagaat

SEQ ID NO: 1006741 - DNA, 22 bp, Homo sapiens
atataagaagcaatctttgaaa

SEQ ID NO: 1006742 - DNA, 13 bp, Homo sapiens
atataagacaaat

SEQ ID NO: 1006743 - DNA, 15 bp, Homo sapiens
atataagacatttgt

SEQ ID NO: 1006744 - DNA, 18 bp, Homo sapiens
atataagagaagtctcat

SEQ ID NO: 1006745 - DNA, 22 bp, Homo sapiens
atataagtctatactaatgctt

SEQ ID NO: 1006746 - DNA, 14 bp, Homo sapiens
atataagtgtacat

SEQ ID NO: 1006747 - DNA, 14 bp, Homo sapiens
atataagtttgaag

SEQ ID NO: 1006748 - DNA, 21 bp, Homo sapiens
atataagtttgaaggaaacag

SEQ ID NO: 1006749 - DNA, 21 bp, Homo sapiens
atataataaagctactgattt

SEQ ID NO: 1006750 - DNA, 15 bp, Homo sapiens
atataataactttat

SEQ ID NO: 1006751 - DNA, 14 bp, Homo sapiens
atataatatgtata

SEQ ID NO: 1006752 - DNA, 13 bp, Homo sapiens
atataatatgtca

SEQ ID NO: 1006753 - DNA, 22 bp, Homo sapiens
atataatattcagccagcttaa

SEQ ID NO: 1006754 - DNA, 16 bp, Homo sapiens
atataatatttactgt

SEQ ID NO: 1006755 - DNA, 20 bp, Homo sapiens
atataatcttggcttcttaa

SEQ ID NO: 1006756 - DNA, 22 bp, Homo sapiens
atataatcttggcttcttaaaa

SEQ ID NO: 1006757 - DNA, 12 bp, Homo sapiens
atataatgtatt

SEQ ID NO: 1006758 - DNA, 12 bp, Homo sapiens
atataatgtgtg

SEQ ID NO: 1006759 - DNA, 15 bp, Homo sapiens
atataatgttgataa

SEQ ID NO: 1006760 - DNA, 14 bp, Homo sapiens
atataattctgtaa

SEQ ID NO: 1006761 - DNA, 22 bp, Homo sapiens
atataatttatttccactaaaa

SEQ ID NO: 1006762 - DNA, 13 bp, Homo sapiens
atataatttcctc

SEQ ID NO: 1006763 - DNA, 15 bp, Homo sapiens
atataatttcctcac

SEQ ID NO: 1006764 - DNA, 17 bp, Homo sapiens
atataatttgagtgtat

SEQ ID NO: 1006765 - DNA, 20 bp, Homo sapiens
atataatttgagtgtatata

SEQ ID NO: 1006766 - DNA, 19 bp, Homo sapiens
ccagcctcagtgccacttg

SEQ ID NO: 1006767 - DNA, 21 bp, Homo sapiens
ccagcctccaagctccatctc

SEQ ID NO: 1006768 - DNA, 15 bp, Homo sapiens
ccagcctccagagaa

SEQ ID NO: 1006769 - DNA, 17 bp, Homo sapiens
ccagcctccagagaagc

SEQ ID NO: 1006770 - DNA, 11 bp, Homo sapiens
ccagcctccct

SEQ ID NO: 1006771 - DNA, 14 bp, Homo sapiens
ccagcctccctgtc

SEQ ID NO: 1006772 - DNA, 18 bp, Homo sapiens
ccagcctccctgtctcca

SEQ ID NO: 1006773 - DNA, 19 bp, Homo sapiens
ccagcctccctgtctccag

SEQ ID NO: 1006774 - DNA, 24 bp, Homo sapiens
ccagcctccctgtctccagctgcc

SEQ ID NO: 1006775 - DNA, 18 bp, Homo sapiens
ccagcctccgagagggag

SEQ ID NO: 1006776 - DNA, 11 bp, Homo sapiens
ccagcctcctc

SEQ ID NO: 1006777 - DNA, 16 bp, Homo sapiens
ccagcctcctctggac

SEQ ID NO: 1006778 - DNA, 15 bp, Homo sapiens
ccagcctctggcatt

SEQ ID NO: 1006779 - DNA, 18 bp, Homo sapiens
ccagcctgaacagaagct

SEQ ID NO: 1006780 - DNA, 11 bp, Homo sapiens
ccagcctgagc

SEQ ID NO: 1006781 - DNA, 16 bp, Homo sapiens
ccagcctgcctggcag

SEQ ID NO: 1006782 - DNA, 19 bp, Homo sapiens
ccagcctgcctggcaggct

SEQ ID NO: 1006783 - DNA, 21 bp, Homo sapiens
ccagcctgcctggcaggctgt

SEQ ID NO: 1006784 - DNA, 20 bp, Homo sapiens
ccagcctgctgacagacact

SEQ ID NO: 1006785 - DNA, 17 bp, Homo sapiens
ccagcctgctgagagcc

SEQ ID NO: 1006786 - DNA, 11 bp, Homo sapiens
ccagcctggcc

SEQ ID NO: 1006787 - DNA, 12 bp, Homo sapiens
ccagcctggcca

SEQ ID NO: 1006788 - DNA, 15 bp, Homo sapiens
ccagcctggccagac

SEQ ID NO: 1006789 - DNA, 17 bp, Homo sapiens
ccagcctggcttctgga

SEQ ID NO: 1006790 - DNA, 19 bp, Homo sapiens
ccagcctgggacacacaca

SEQ ID NO: 1006791 - DNA, 13 bp, Homo sapiens
ccagcctgggagc

SEQ ID NO: 1006792 - DNA, 18 bp, Homo sapiens
ccagcctgggagcccaga

SEQ ID NO: 1006793 - DNA, 16 bp, Homo sapiens
ccagcctgggcagcca

SEQ ID NO: 1006794 - DNA, 13 bp, Homo sapiens
ccagcctgggcca

SEQ ID NO: 1006795 - DNA, 19 bp, Homo sapiens
ccagcctgggcgacagagc

SEQ ID NO: 1006796 - DNA, 16 bp, Homo sapiens
ccagcctggggctccc

SEQ ID NO: 1006797 - DNA, 17 bp, Homo sapiens
ccagcctggggctccct

SEQ ID NO: 1006798 - DNA, 21 bp, Homo sapiens
ccagcctggggctccctctct

SEQ ID NO: 1006799 - DNA, 21 bp, Homo sapiens
ccagcctggggctgaggctga

SEQ ID NO: 1006800 - DNA, 19 bp, Homo sapiens
ccagcctgggtgacagagc

SEQ ID NO: 1006801 - DNA, 23 bp, Homo sapiens
ccagcctgtcccatggacactcc

SEQ ID NO: 1006802 - DNA, 14 bp, Homo sapiens
ccagcctgtcctgg

SEQ ID NO: 1006803 - DNA, 18 bp, Homo sapiens
ccagcctgtcctggtaca

SEQ ID NO: 1006804 - DNA, 12 bp, Homo sapiens
ccagcctgtggt

SEQ ID NO: 1006805 - DNA, 21 bp, Homo sapiens
ccagcctgtggttacagtgca

SEQ ID NO: 1006806 - DNA, 15 bp, Homo sapiens
ccagcctgtgtgttc

SEQ ID NO: 1006807 - DNA, 20 bp, Homo sapiens
ccagcctgttggacccgctc

SEQ ID NO: 1006808 - DNA, 14 bp, Homo sapiens
ccagccttatgtgt

SEQ ID NO: 1006809 - DNA, 16 bp, Homo sapiens
ccagccttcctctgca

SEQ ID NO: 1006810 - DNA, 17 bp, Homo sapiens
ccagccttgagccctgg

SEQ ID NO: 1006811 - DNA, 21 bp, Homo sapiens
ccagccttgagccctggctgt

SEQ ID NO: 1006812 - DNA, 14 bp, Homo sapiens
ccagcctttccaag

SEQ ID NO: 1006813 - DNA, 19 bp, Homo sapiens
ccagcctttgctccctccc

SEQ ID NO: 1006814 - DNA, 23 bp, Homo sapiens
ccagcctttgggtcctgggcagg

SEQ ID NO: 1006815 - DNA, 15 bp, Homo sapiens
ccagcgacctctctg

SEQ ID NO: 1006816 - DNA, 22 bp, Homo sapiens
atatagagacaggacagaatgt

SEQ ID NO: 1006817 - DNA, 23 bp, Homo sapiens
atatagagacaggacagaatgtg

SEQ ID NO: 1006818 - DNA, 16 bp, Homo sapiens
atatagagatgttttt

SEQ ID NO: 1006819 - DNA, 22 bp, Homo sapiens
atatagagatgtttttaaaagt

SEQ ID NO: 1006820 - DNA, 23 bp, Homo sapiens
atatagatcagttataagtagca

SEQ ID NO: 1006821 - DNA, 16 bp, Homo sapiens
atatagcaaaatgatt

SEQ ID NO: 1006822 - DNA, 14 bp, Homo sapiens
atatagcattgata

SEQ ID NO: 1006823 - DNA, 19 bp, Homo sapiens
atatagcattgataatctt

SEQ ID NO: 1006824 - DNA, 23 bp, Homo sapiens
atatagcattgataatcttcagg

SEQ ID NO: 1006825 - DNA, 16 bp, Homo sapiens
atatagcccagccagg

SEQ ID NO: 1006826 - DNA, 15 bp, Homo sapiens
atatagcctttaaat

SEQ ID NO: 1006827 - DNA, 15 bp, Homo sapiens
atataggaattaaga

SEQ ID NO: 1006828 - DNA, 20 bp, Homo sapiens
atataggatagacactggac

SEQ ID NO: 1006829 - DNA, 22 bp, Homo sapiens
atataggatagacactggacat

SEQ ID NO: 1006830 - DNA, 22 bp, Homo sapiens
atataggctattttctaaagac

SEQ ID NO: 1006831 - DNA, 19 bp, Homo sapiens
atataggtctcttctccca

SEQ ID NO: 1006832 - DNA, 23 bp, Homo sapiens
atatagtaactactttttatact

SEQ ID NO: 1006833 - DNA, 19 bp, Homo sapiens
atatagtaggggttgaaga

SEQ ID NO: 1006834 - DNA, 20 bp, Homo sapiens
atatagtatatttatactct

SEQ ID NO: 1006835 - DNA, 18 bp, Homo sapiens
atatagtgggtacatcaa

SEQ ID NO: 1006836 - DNA, 10 bp, Homo sapiens
atatataaaa

SEQ ID NO: 1006837 - DNA, 17 bp, Homo sapiens
atatataaaacggtgct

SEQ ID NO: 1006838 - DNA, 14 bp, Homo sapiens
atatataaaataaa

SEQ ID NO: 1006839 - DNA, 16 bp, Homo sapiens
atatataaaataaata

SEQ ID NO: 1006840 - DNA, 13 bp, Homo sapiens
atatataaacact

SEQ ID NO: 1006841 - DNA, 18 bp, Homo sapiens
atatataaagatatatag

SEQ ID NO: 1006842 - DNA, 12 bp, Homo sapiens
atatataaccag

SEQ ID NO: 1006843 - DNA, 23 bp, Homo sapiens
atatataagctcagattatttaa

SEQ ID NO: 1006844 - DNA, 16 bp, Homo sapiens
atatataagtgtacat

SEQ ID NO: 1006845 - DNA, 20 bp, Homo sapiens
atatataagtgtacatatgt

SEQ ID NO: 1006846 - DNA, 12 bp, Homo sapiens
atatataatttg

SEQ ID NO: 1006847 - DNA, 23 bp, Homo sapiens
atatataatttgagtgtatatat

SEQ ID NO: 1006848 - DNA, 17 bp, Homo sapiens
atatatacaaaaagaaa

SEQ ID NO: 1006849 - DNA, 15 bp, Homo sapiens
atatatacaaggtga

SEQ ID NO: 1006850 - DNA, 13 bp, Homo sapiens
atatatacacata

SEQ ID NO: 1006851 - DNA, 18 bp, Homo sapiens
atatatacacatacatac

SEQ ID NO: 1006852 - DNA, 16 bp, Homo sapiens
atatatacagtaactt

SEQ ID NO: 1006853 - DNA, 20 bp, Homo sapiens
atatatacagtaactttatg

SEQ ID NO: 1006854 - DNA, 21 bp, Homo sapiens
atatatacagtaactttatgt

SEQ ID NO: 1006855 - DNA, 13 bp, Homo sapiens
atatatacatgga

SEQ ID NO: 1006856 - DNA, 14 bp, Homo sapiens
atatatacattgct

SEQ ID NO: 1006857 - DNA, 15 bp, Homo sapiens
atatatacatttttt

SEQ ID NO: 1006858 - DNA, 20 bp, Homo sapiens
atatatagtccagacactta

SEQ ID NO: 1006859 - DNA, 16 bp, Homo sapiens
atatatagtgaaaaat

SEQ ID NO: 1006860 - DNA, 11 bp, Homo sapiens
atatatataaa

SEQ ID NO: 1006861 - DNA, 13 bp, Homo sapiens
atatatataaacc

SEQ ID NO: 1006862 - DNA, 12 bp, Homo sapiens
atatatatacat

SEQ ID NO: 1006863 - DNA, 11 bp, Homo sapiens
atatatatata

SEQ ID NO: 1006864 - DNA, 12 bp, Homo sapiens
atatatatatat

SEQ ID NO: 1006865 - DNA, 14 bp, Homo sapiens
atatatatatataa

SEQ ID NO: 1006866 - DNA, 16 bp, Homo sapiens
atatatatatatatgt

SEQ ID NO: 1006867 - DNA, 15 bp, Homo sapiens
atatatatatatgca

SEQ ID NO: 1006868 - DNA, 12 bp, Homo sapiens
atatatatatgt

SEQ ID NO: 1006869 - DNA, 16 bp, Homo sapiens
atatatatatgtatat

SEQ ID NO: 1006870 - DNA, 12 bp, Homo sapiens
atatatatattt

SEQ ID NO: 1006871 - DNA, 21 bp, Homo sapiens
atatatatctatctatttgag

SEQ ID NO: 1006872 - DNA, 16 bp, Homo sapiens
atatatatgccatgat

SEQ ID NO: 1006873 - DNA, 15 bp, Homo sapiens
atatatatgtacagt

SEQ ID NO: 1006874 - DNA, 14 bp, Homo sapiens
atatatatgtatat

SEQ ID NO: 1006875 - DNA, 20 bp, Homo sapiens
atatatatgtgtgtgtatat

SEQ ID NO: 1006876 - DNA, 14 bp, Homo sapiens
atatatattaagtg

SEQ ID NO: 1006877 - DNA, 23 bp, Homo sapiens
atatatattctattacattttca

SEQ ID NO: 1006878 - DNA, 15 bp, Homo sapiens
atatatatttaaagg

SEQ ID NO: 1006879 - DNA, 17 bp, Homo sapiens
atatatatttgtaacat

SEQ ID NO: 1006880 - DNA, 15 bp, Homo sapiens
atatatatttttcaa

SEQ ID NO: 1006881 - DNA, 16 bp, Homo sapiens
atatatcagaatctgt

SEQ ID NO: 1006882 - DNA, 13 bp, Homo sapiens
atatatcatattg

SEQ ID NO: 1006883 - DNA, 15 bp, Homo sapiens
atatatcatgagtga

SEQ ID NO: 1006884 - DNA, 16 bp, Homo sapiens
atatatcccagaaatt

SEQ ID NO: 1006885 - DNA, 13 bp, Homo sapiens
atatatctattat

SEQ ID NO: 1006886 - DNA, 22 bp, Homo sapiens
atatatctgataaaattgtgat

SEQ ID NO: 1006887 - DNA, 18 bp, Homo sapiens
atatatctgcttcagtgg

SEQ ID NO: 1006888 - DNA, 17 bp, Homo sapiens
atatatcttataactgt

SEQ ID NO: 1006889 - DNA, 19 bp, Homo sapiens
atatatcttataactgttt

SEQ ID NO: 1006890 - DNA, 12 bp, Homo sapiens
atatatgaataa

SEQ ID NO: 1006891 - DNA, 13 bp, Homo sapiens
atatatgaggact

SEQ ID NO: 1006892 - DNA, 17 bp, Homo sapiens
atatatgatcattgaaa

SEQ ID NO: 1006893 - DNA, 22 bp, Homo sapiens
atatatgatcattgaaatactt

SEQ ID NO: 1006894 - DNA, 15 bp, Homo sapiens
atatatgctgtattt

SEQ ID NO: 1006895 - DNA, 17 bp, Homo sapiens
ccagctcctctgagcca

SEQ ID NO: 1006896 - DNA, 13 bp, Homo sapiens
ccagctccttggc

SEQ ID NO: 1006897 - DNA, 20 bp, Homo sapiens
ccagctcctttctcctgtga

SEQ ID NO: 1006898 - DNA, 20 bp, Homo sapiens
ccagctcgtttttcagcacc

SEQ ID NO: 1006899 - DNA, 17 bp, Homo sapiens
ccagctctaagcagcca

SEQ ID NO: 1006900 - DNA, 18 bp, Homo sapiens
ccagctctaagcagccag

SEQ ID NO: 1006901 - DNA, 16 bp, Homo sapiens
ccagctctactaccta

SEQ ID NO: 1006902 - DNA, 22 bp, Homo sapiens
ccagctctagacaaccctgcaa

SEQ ID NO: 1006903 - DNA, 15 bp, Homo sapiens
ccagctctgaaacca

SEQ ID NO: 1006904 - DNA, 20 bp, Homo sapiens
ccagctctgacatcccttcc

SEQ ID NO: 1006905 - DNA, 22 bp, Homo sapiens
ccagctctgacatcccttcctg

SEQ ID NO: 1006906 - DNA, 22 bp, Homo sapiens
ccagctctgagacccttttctc

SEQ ID NO: 1006907 - DNA, 12 bp, Homo sapiens
ccagctctgccc

SEQ ID NO: 1006908 - DNA, 11 bp, Homo sapiens
ccagctctgtg

SEQ ID NO: 1006909 - DNA, 18 bp, Homo sapiens
ccagctctgtggcctgtg

SEQ ID NO: 1006910 - DNA, 20 bp, Homo sapiens
ccagctctgtggcctgtgtc

SEQ ID NO: 1006911 - DNA, 12 bp, Homo sapiens
ccagctcttgct

SEQ ID NO: 1006912 - DNA, 15 bp, Homo sapiens
ccagctcttgctctc

SEQ ID NO: 1006913 - DNA, 17 bp, Homo sapiens
ccagctgactaaacttt

SEQ ID NO: 1006914 - DNA, 23 bp, Homo sapiens
ccagctgactaaactttttttct

SEQ ID NO: 1006915 - DNA, 12 bp, Homo sapiens
ccagctgactgt

SEQ ID NO: 1006916 - DNA, 13 bp, Homo sapiens
ccagctgactgtg

SEQ ID NO: 1006917 - DNA, 15 bp, Homo sapiens
ccagctgactgtggc

SEQ ID NO: 1006918 - DNA, 16 bp, Homo sapiens
ccagctgactgtggcc

SEQ ID NO: 1006919 - DNA, 20 bp, Homo sapiens
ccagctgcacctgccagcct

SEQ ID NO: 1006920 - DNA, 23 bp, Homo sapiens
ccagctgcacctgccagcctggc

SEQ ID NO: 1006921 - DNA, 23 bp, Homo sapiens
ccagctgcagatgccacacctgc

SEQ ID NO: 1006922 - DNA, 14 bp, Homo sapiens
ccagctgcagggca

SEQ ID NO: 1006923 - DNA, 15 bp, Homo sapiens
ccagctgcagggcac

SEQ ID NO: 1006924 - DNA, 17 bp, Homo sapiens
ccagctgcagggcacgg

SEQ ID NO: 1006925 - DNA, 22 bp, Homo sapiens
ccagctgcagggcacggggacc

SEQ ID NO: 1006926 - DNA, 14 bp, Homo sapiens
ccagctgcccctcc

SEQ ID NO: 1006927 - DNA, 21 bp, Homo sapiens
ccagctgccctatgggcctgc

SEQ ID NO: 1006928 - DNA, 16 bp, Homo sapiens
ccagctgcccttccgc

SEQ ID NO: 1006929 - DNA, 21 bp, Homo sapiens
ccagctgcccttccgcagtgt

SEQ ID NO: 1006930 - DNA, 19 bp, Homo sapiens
ccagctgccgaccagagcc

SEQ ID NO: 1006931 - DNA, 13 bp, Homo sapiens
ccagctgcctctt

SEQ ID NO: 1006932 - DNA, 13 bp, Homo sapiens
ccagctgcctggg

SEQ ID NO: 1006933 - DNA, 19 bp, Homo sapiens
ccagctgcctgggcccgga

SEQ ID NO: 1006934 - DNA, 11 bp, Homo sapiens
ccagctgcctt

SEQ ID NO: 1006935 - DNA, 18 bp, Homo sapiens
ccagctgcgcttgctttt

SEQ ID NO: 1006936 - DNA, 16 bp, Homo sapiens
ccagctgctcccctgc

SEQ ID NO: 1006937 - DNA, 20 bp, Homo sapiens
ccagctgctcccctgccacg

SEQ ID NO: 1006938 - DNA, 13 bp, Homo sapiens
ccagctgctctgc

SEQ ID NO: 1006939 - DNA, 14 bp, Homo sapiens
atatatttacagaa

SEQ ID NO: 1006940 - DNA, 14 bp, Homo sapiens
atatatttataact

SEQ ID NO: 1006941 - DNA, 16 bp, Homo sapiens
atatatttataactca

SEQ ID NO: 1006942 - DNA, 14 bp, Homo sapiens
atatatttctttgt

SEQ ID NO: 1006943 - DNA, 15 bp, Homo sapiens
atatatttgtaaaag

SEQ ID NO: 1006944 - DNA, 23 bp, Homo sapiens
atatatttgtaacattgtaaagt

SEQ ID NO: 1006945 - DNA, 21 bp, Homo sapiens
atatatttgtgtatttaacag

SEQ ID NO: 1006946 - DNA, 22 bp, Homo sapiens
atatatttgtgtatttaacagg

SEQ ID NO: 1006947 - DNA, 19 bp, Homo sapiens
atatatttgtttcatttct

SEQ ID NO: 1006948 - DNA, 21 bp, Homo sapiens
atatatttgtttcatttctgc

SEQ ID NO: 1006949 - DNA, 13 bp, Homo sapiens
atatattttaagc

SEQ ID NO: 1006950 - DNA, 21 bp, Homo sapiens
atatattttaagccttcattt

SEQ ID NO: 1006951 - DNA, 18 bp, Homo sapiens
atatattttacaattttt

SEQ ID NO: 1006952 - DNA, 13 bp, Homo sapiens
atatattttatat

SEQ ID NO: 1006953 - DNA, 15 bp, Homo sapiens
atatattttatatgt

SEQ ID NO: 1006954 - DNA, 20 bp, Homo sapiens
atatattttcatcctataag

SEQ ID NO: 1006955 - DNA, 15 bp, Homo sapiens
atatatttttatatt

SEQ ID NO: 1006956 - DNA, 18 bp, Homo sapiens
atatatttttcaaataga

SEQ ID NO: 1006957 - DNA, 19 bp, Homo sapiens
atatatttttcaaatagat

SEQ ID NO: 1006958 - DNA, 20 bp, Homo sapiens
atatatttttcaaatagatt

SEQ ID NO: 1006959 - DNA, 14 bp, Homo sapiens
atatatttttcaca

SEQ ID NO: 1006960 - DNA, 15 bp, Homo sapiens
atatatttttcacag

SEQ ID NO: 1006961 - DNA, 15 bp, Homo sapiens
atatatttttggttg

SEQ ID NO: 1006962 - DNA, 20 bp, Homo sapiens
atatatttttggttgtcaat

SEQ ID NO: 1006963 - DNA, 21 bp, Homo sapiens
atatattttttgttattatta

SEQ ID NO: 1006964 - DNA, 20 bp, Homo sapiens
atatcaaaaaacctttacag

SEQ ID NO: 1006965 - DNA, 13 bp, Homo sapiens
atatcaaaacaag

SEQ ID NO: 1006966 - DNA, 17 bp, Homo sapiens
atatcaaacatgcacac

SEQ ID NO: 1006967 - DNA, 17 bp, Homo sapiens
atatcaaataaaatatc

SEQ ID NO: 1006968 - DNA, 13 bp, Homo sapiens
atatcaaatgcag

SEQ ID NO: 1006969 - DNA, 14 bp, Homo sapiens
atatcaactctgaa

SEQ ID NO: 1006970 - DNA, 23 bp, Homo sapiens
atatcactaaataaacacgattt

SEQ ID NO: 1006971 - DNA, 13 bp, Homo sapiens
atatcactaattt

SEQ ID NO: 1006972 - DNA, 15 bp, Homo sapiens
atatcactcattaat

SEQ ID NO: 1006973 - DNA, 18 bp, Homo sapiens
atatcactcttgagtaaa

SEQ ID NO: 1006974 - DNA, 14 bp, Homo sapiens
atatcagaaaaggg

SEQ ID NO: 1006975 - DNA, 20 bp, Homo sapiens
atatcagacaagcactattt

SEQ ID NO: 1006976 - DNA, 21 bp, Homo sapiens
atatcagcctgagtctcctgt

SEQ ID NO: 1006977 - DNA, 23 bp, Homo sapiens
atatcaggctattatttattgta

SEQ ID NO: 1006978 - DNA, 15 bp, Homo sapiens
atatcaggtgtataa

SEQ ID NO: 1006979 - DNA, 22 bp, Homo sapiens
atatcaggtgtataaatgtaca

SEQ ID NO: 1006980 - DNA, 16 bp, Homo sapiens
atatcagtagtgtaca

SEQ ID NO: 1006981 - DNA, 21 bp, Homo sapiens
atatcagtattctgacatgta

SEQ ID NO: 1006982 - DNA, 16 bp, Homo sapiens
atatcagtgacagttg

SEQ ID NO: 1006983 - DNA, 20 bp, Homo sapiens
atatcagttactcagccctg

SEQ ID NO: 1006984 - DNA, 14 bp, Homo sapiens
atatcataaagcat

SEQ ID NO: 1006985 - DNA, 16 bp, Homo sapiens
atatcataaagcattt

SEQ ID NO: 1006986 - DNA, 13 bp, Homo sapiens
atatcataactat

SEQ ID NO: 1006987 - DNA, 15 bp, Homo sapiens
atatcatacagtttt

SEQ ID NO: 1006988 - DNA, 14 bp, Homo sapiens
atatcatattggta

SEQ ID NO: 1006989 - DNA, 19 bp, Homo sapiens
atatcatattggtattcac

SEQ ID NO: 1006990 - DNA, 14 bp, Homo sapiens
atatcatggggagt

SEQ ID NO: 1006991 - DNA, 22 bp, Homo sapiens
atatcatggtaatgacagatgc

SEQ ID NO: 1006992 - DNA, 19 bp, Homo sapiens
atatcatgttaaattagaa

SEQ ID NO: 1006993 - DNA, 18 bp, Homo sapiens
atatcattaaacaaataa

SEQ ID NO: 1006994 - DNA, 16 bp, Homo sapiens
atatcattatttagca

SEQ ID NO: 1006995 - DNA, 15 bp, Homo sapiens
atatcattctacaga

SEQ ID NO: 1006996 - DNA, 17 bp, Homo sapiens
atatcattgattttata

SEQ ID NO: 1006997 - DNA, 21 bp, Homo sapiens
atatcatttattttttacatt

SEQ ID NO: 1006998 - DNA, 20 bp, Homo sapiens
atatcatttcactgtctagg

SEQ ID NO: 1006999 - DNA, 18 bp, Homo sapiens
atatcatttgtgaagaat

SEQ ID NO: 1007000 - DNA, 12 bp, Homo sapiens
atatcattttaa

SEQ ID NO: 1007001 - DNA, 16 bp, Homo sapiens
atatccaaagactgta

SEQ ID NO: 1007002 - DNA, 17 bp, Homo sapiens
atatccaaagactgtac

SEQ ID NO: 1007003 - DNA, 11 bp, Homo sapiens
atatccacagt

SEQ ID NO: 1007004 - DNA, 13 bp, Homo sapiens
atatccacataaa

SEQ ID NO: 1007005 - DNA, 20 bp, Homo sapiens
atatccacataaatgctcct

SEQ ID NO: 1007006 - DNA, 14 bp, Homo sapiens
atatccacccagca

SEQ ID NO: 1007007 - DNA, 13 bp, Homo sapiens
atatccagaaata

SEQ ID NO: 1007008 - DNA, 16 bp, Homo sapiens
atatccagctgagtga

SEQ ID NO: 1007009 - DNA, 17 bp, Homo sapiens
atatccagttcctgctc

SEQ ID NO: 1007010 - DNA, 22 bp, Homo sapiens
atatccagttcctgctctctgc

SEQ ID NO: 1007011 - DNA, 12 bp, Homo sapiens
atatccatcttt

SEQ ID NO: 1007012 - DNA, 12 bp, Homo sapiens
atatccatgtac

SEQ ID NO: 1007013 - DNA, 17 bp, Homo sapiens
atatccatgtactgtag

SEQ ID NO: 1007014 - DNA, 17 bp, Homo sapiens
atatcccaacattctgc

SEQ ID NO: 1007015 - DNA, 18 bp, Homo sapiens
atatcccaacattctgca

SEQ ID NO: 1007016 - DNA, 16 bp, Homo sapiens
atatcccaagtgcact

SEQ ID NO: 1007017 - DNA, 18 bp, Homo sapiens
atatcccctatttaacag

SEQ ID NO: 1007018 - DNA, 11 bp, Homo sapiens
atatccctccc

SEQ ID NO: 1007019 - DNA, 12 bp, Homo sapiens
atatccctgccc

SEQ ID NO: 1007020 - DNA, 18 bp, Homo sapiens
atatccctgcccagcctg

SEQ ID NO: 1007021 - DNA, 13 bp, Homo sapiens
atatcctaaacat

SEQ ID NO: 1007022 - DNA, 14 bp, Homo sapiens
atatcctatatagg

SEQ ID NO: 1007023 - DNA, 13 bp, Homo sapiens
atatcctgtgact

SEQ ID NO: 1007024 - DNA, 18 bp, Homo sapiens
ccaggaccagcctgtacc

SEQ ID NO: 1007025 - DNA, 18 bp, Homo sapiens
ccaggaccagctggggcg

SEQ ID NO: 1007026 - DNA, 14 bp, Homo sapiens
ccaggacccagggt

SEQ ID NO: 1007027 - DNA, 12 bp, Homo sapiens
ccaggaccccaa

SEQ ID NO: 1007028 - DNA, 15 bp, Homo sapiens
ccaggacccctcagc

SEQ ID NO: 1007029 - DNA, 19 bp, Homo sapiens
ccaggacccctgtccagga

SEQ ID NO: 1007030 - DNA, 21 bp, Homo sapiens
ccaggacccctgtccaggatg

SEQ ID NO: 1007031 - DNA, 21 bp, Homo sapiens
ccaggacccgccagccccgct

SEQ ID NO: 1007032 - DNA, 16 bp, Homo sapiens
ccaggacccgcctgct

SEQ ID NO: 1007033 - DNA, 20 bp, Homo sapiens
ccaggaccctccactcactg

SEQ ID NO: 1007034 - DNA, 20 bp, Homo sapiens
ccaggacgccactcatttca

SEQ ID NO: 1007035 - DNA, 21 bp, Homo sapiens
ccaggacgccactcatttcat

SEQ ID NO: 1007036 - DNA, 15 bp, Homo sapiens
ccaggacgcttctga

SEQ ID NO: 1007037 - DNA, 16 bp, Homo sapiens
ccaggacgcttctgaa

SEQ ID NO: 1007038 - DNA, 20 bp, Homo sapiens
ccaggacgcttctgaatgct

SEQ ID NO: 1007039 - DNA, 19 bp, Homo sapiens
ccaggacgtctggggtgtg

SEQ ID NO: 1007040 - DNA, 22 bp, Homo sapiens
ccaggactccccaggccaggcc

SEQ ID NO: 1007041 - DNA, 14 bp, Homo sapiens
ccaggactccctcc

SEQ ID NO: 1007042 - DNA, 23 bp, Homo sapiens
ccaggactccctcctcacctctg

SEQ ID NO: 1007043 - DNA, 14 bp, Homo sapiens
ccaggactctggca

SEQ ID NO: 1007044 - DNA, 14 bp, Homo sapiens
ccaggactggctgt

SEQ ID NO: 1007045 - DNA, 20 bp, Homo sapiens
ccaggacttggggtcaggaa

SEQ ID NO: 1007046 - DNA, 16 bp, Homo sapiens
ccaggagaaagccggg

SEQ ID NO: 1007047 - DNA, 21 bp, Homo sapiens
ccaggagaaccactacatgca

SEQ ID NO: 1007048 - DNA, 17 bp, Homo sapiens
ccaggagaagctcagct

SEQ ID NO: 1007049 - DNA, 18 bp, Homo sapiens
ccaggagaagctcagctg

SEQ ID NO: 1007050 - DNA, 20 bp, Homo sapiens
ccaggagaagggctggggcc

SEQ ID NO: 1007051 - DNA, 15 bp, Homo sapiens
ccaggagaaggtcag

SEQ ID NO: 1007052 - DNA, 23 bp, Homo sapiens
ccaggagacagaccacttgccac

SEQ ID NO: 1007053 - DNA, 23 bp, Homo sapiens
ccaggagacatatataggggaac

SEQ ID NO: 1007054 - DNA, 18 bp, Homo sapiens
ccaggagagccagccctc

SEQ ID NO: 1007055 - DNA, 23 bp, Homo sapiens
ccaggagagccagccctccctgt

SEQ ID NO: 1007056 - DNA, 24 bp, Homo sapiens
ccaggagagcccccaccagcagca

SEQ ID NO: 1007057 - DNA, 16 bp, Homo sapiens
ccaggagagcctgggg

SEQ ID NO: 1007058 - DNA, 13 bp, Homo sapiens
ccaggagataatt

SEQ ID NO: 1007059 - DNA, 15 bp, Homo sapiens
ccaggagatggcccc

SEQ ID NO: 1007060 - DNA, 15 bp, Homo sapiens
ccaggagatgggtcc

SEQ ID NO: 1007061 - DNA, 13 bp, Homo sapiens
atatcttgccttc

SEQ ID NO: 1007062 - DNA, 18 bp, Homo sapiens
atatcttgcgaatccaag

SEQ ID NO: 1007063 - DNA, 20 bp, Homo sapiens
atatcttggacaaatcacat

SEQ ID NO: 1007064 - DNA, 23 bp, Homo sapiens
atatcttggcctaaacctcagtt

SEQ ID NO: 1007065 - DNA, 16 bp, Homo sapiens
atatcttgtttacaat

SEQ ID NO: 1007066 - DNA, 18 bp, Homo sapiens
atatcttgtttacaataa

SEQ ID NO: 1007067 - DNA, 22 bp, Homo sapiens
atatcttgtttacaataaagaa

SEQ ID NO: 1007068 - DNA, 15 bp, Homo sapiens
atatgaaaaatgtaa

SEQ ID NO: 1007069 - DNA, 16 bp, Homo sapiens
atatgaaaatacaact

SEQ ID NO: 1007070 - DNA, 20 bp, Homo sapiens
atatgaacctattttcattt

SEQ ID NO: 1007071 - DNA, 22 bp, Homo sapiens
atatgaatacagggcatgcatt

SEQ ID NO: 1007072 - DNA, 14 bp, Homo sapiens
atatgaatgtcaca

SEQ ID NO: 1007073 - DNA, 15 bp, Homo sapiens
atatgaatgtcacat

SEQ ID NO: 1007074 - DNA, 16 bp, Homo sapiens
atatgaatgtcacatt

SEQ ID NO: 1007075 - DNA, 17 bp, Homo sapiens
atatgaatgtcacattt

SEQ ID NO: 1007076 - DNA, 17 bp, Homo sapiens
atatgaatttaaatata

SEQ ID NO: 1007077 - DNA, 23 bp, Homo sapiens
atatgacggaagaacatagaact

SEQ ID NO: 1007078 - DNA, 13 bp, Homo sapiens
atatgactcacat

SEQ ID NO: 1007079 - DNA, 20 bp, Homo sapiens
atatgagagaatcacacaag

SEQ ID NO: 1007080 - DNA, 13 bp, Homo sapiens
atatgagcttcaa

SEQ ID NO: 1007081 - DNA, 23 bp, Homo sapiens
atatgagtgtggaagccggaggg

SEQ ID NO: 1007082 - DNA, 17 bp, Homo sapiens
atatgagttactgaagg

SEQ ID NO: 1007083 - DNA, 14 bp, Homo sapiens
atatgatattcttt

SEQ ID NO: 1007084 - DNA, 17 bp, Homo sapiens
atatgatattctttaaa

SEQ ID NO: 1007085 - DNA, 20 bp, Homo sapiens
atatgatattctttaaacaa

SEQ ID NO: 1007086 - DNA, 19 bp, Homo sapiens
atatgatcaggtaactttc

SEQ ID NO: 1007087 - DNA, 18 bp, Homo sapiens
atatgatcagtgttactg

SEQ ID NO: 1007088 - DNA, 21 bp, Homo sapiens
atatgatccagttaacatcat

SEQ ID NO: 1007089 - DNA, 13 bp, Homo sapiens
atatgatctaata

SEQ ID NO: 1007090 - DNA, 15 bp, Homo sapiens
atatgatctaataca

SEQ ID NO: 1007091 - DNA, 16 bp, Homo sapiens
atatgatctaatacaa

SEQ ID NO: 1007092 - DNA, 18 bp, Homo sapiens
atatgatctaatacaaag

SEQ ID NO: 1007093 - DNA, 12 bp, Homo sapiens
atatgatttata

SEQ ID NO: 1007094 - DNA, 16 bp, Homo sapiens
atatgattttatttga

SEQ ID NO: 1007095 - DNA, 14 bp, Homo sapiens
atatgcaacattgt

SEQ ID NO: 1007096 - DNA, 13 bp, Homo sapiens
atatgcaagtaag

SEQ ID NO: 1007097 - DNA, 15 bp, Homo sapiens
atatgcacaatagca

SEQ ID NO: 1007098 - DNA, 11 bp, Homo sapiens
atatgcacttt

SEQ ID NO: 1007099 - DNA, 19 bp, Homo sapiens
atatgcactttccctagaa

SEQ ID NO: 1007100 - DNA, 18 bp, Homo sapiens
atatgcagaaatagacaa

SEQ ID NO: 1007101 - DNA, 17 bp, Homo sapiens
atatgcagaacgtattt

SEQ ID NO: 1007102 - DNA, 21 bp, Homo sapiens
atatgcagaacgtatttagcc

SEQ ID NO: 1007103 - DNA, 17 bp, Homo sapiens
atatgcagttttcctta

SEQ ID NO: 1007104 - DNA, 14 bp, Homo sapiens
atatgcatatttgt

SEQ ID NO: 1007105 - DNA, 16 bp, Homo sapiens
atatgcatgccaggct

SEQ ID NO: 1007106 - DNA, 17 bp, Homo sapiens
atatgctctgcatgtta

SEQ ID NO: 1007107 - DNA, 20 bp, Homo sapiens
atatgctctgcatgttacat

SEQ ID NO: 1007108 - DNA, 14 bp, Homo sapiens
atatgctctgcttt

SEQ ID NO: 1007109 - DNA, 22 bp, Homo sapiens
atatgctgaacgcagaagaaag

SEQ ID NO: 1007110 - DNA, 16 bp, Homo sapiens
atatgctgatctttta

SEQ ID NO: 1007111 - DNA, 22 bp, Homo sapiens
atatgctgccaaattttggcca

SEQ ID NO: 1007112 - DNA, 13 bp, Homo sapiens
atatgctgtattt

SEQ ID NO: 1007113 - DNA, 16 bp, Homo sapiens
atatgcttatacactt

SEQ ID NO: 1007114 - DNA, 19 bp, Homo sapiens
atatgcttatacacttaca

SEQ ID NO: 1007115 - DNA, 14 bp, Homo sapiens
atatggaaatcttt

SEQ ID NO: 1007116 - DNA, 23 bp, Homo sapiens
atatggaaatcttttacattttt

SEQ ID NO: 1007117 - DNA, 20 bp, Homo sapiens
atatggaacatatgcacagg

SEQ ID NO: 1007118 - DNA, 17 bp, Homo sapiens
atatggacctagcttga

SEQ ID NO: 1007119 - DNA, 16 bp, Homo sapiens
atatggatgtgtgtgt

SEQ ID NO: 1007120 - DNA, 22 bp, Homo sapiens
atatggattttctattgttact

SEQ ID NO: 1007121 - DNA, 18 bp, Homo sapiens
atatggcaagaaagctgg

SEQ ID NO: 1007122 - DNA, 18 bp, Homo sapiens
atatggcagagttgtaaa

SEQ ID NO: 1007123 - DNA, 22 bp, Homo sapiens
atatggcagagttgtaaatata

SEQ ID NO: 1007124 - DNA, 13 bp, Homo sapiens
atatggccacagt

SEQ ID NO: 1007125 - DNA, 23 bp, Homo sapiens
atatggccacagtagtcttgatg

SEQ ID NO: 1007126 - DNA, 15 bp, Homo sapiens
atatggcttcaagtt

SEQ ID NO: 1007127 - DNA, 15 bp, Homo sapiens
atatgggagaaatag

SEQ ID NO: 1007128 - DNA, 20 bp, Homo sapiens
atatggggatggtagttttt

SEQ ID NO: 1007129 - DNA, 17 bp, Homo sapiens
atatgggggcatctctt

SEQ ID NO: 1007130 - DNA, 21 bp, Homo sapiens
atatgggggcatctcttcccc

SEQ ID NO: 1007131 - DNA, 16 bp, Homo sapiens
atatgggtagtatttt

SEQ ID NO: 1007132 - DNA, 23 bp, Homo sapiens
atatggtcttgagccagtaatct

SEQ ID NO: 1007133 - DNA, 22 bp, Homo sapiens
atatggttctccaagaaactga

SEQ ID NO: 1007134 - DNA, 12 bp, Homo sapiens
atatgtaaaaca

SEQ ID NO: 1007135 - DNA, 16 bp, Homo sapiens
atatgtaaatgtgtta

SEQ ID NO: 1007136 - DNA, 20 bp, Homo sapiens
atatgtaatacttaaataaa

SEQ ID NO: 1007137 - DNA, 22 bp, Homo sapiens
atatgtaatacttaaataaaca

SEQ ID NO: 1007138 - DNA, 21 bp, Homo sapiens
atatgtaatataaatttaagc

SEQ ID NO: 1007139 - DNA, 13 bp, Homo sapiens
atatgtaatttca

SEQ ID NO: 1007140 - DNA, 13 bp, Homo sapiens
atatgtacagttt

SEQ ID NO: 1007141 - DNA, 15 bp, Homo sapiens
atatgtacagtttat

SEQ ID NO: 1007142 - DNA, 19 bp, Homo sapiens
atatgtaccatgtacatga

SEQ ID NO: 1007143 - DNA, 17 bp, Homo sapiens
atatgtacttgtcaaag

SEQ ID NO: 1007144 - DNA, 23 bp, Homo sapiens
atatgtagatattgttttctgta

SEQ ID NO: 1007145 - DNA, 18 bp, Homo sapiens
atatgtagccttcacaca

SEQ ID NO: 1007146 - DNA, 17 bp, Homo sapiens
atatgtaggtgtctgca

SEQ ID NO: 1007147 - DNA, 21 bp, Homo sapiens
atatgtataaattaatacaga

SEQ ID NO: 1007148 - DNA, 16 bp, Homo sapiens
atatgtatatatacat

SEQ ID NO: 1007149 - DNA, 22 bp, Homo sapiens
atatgtatatcattctacagaa

SEQ ID NO: 1007150 - DNA, 17 bp, Homo sapiens
atatgtatatgtatata

SEQ ID NO: 1007151 - DNA, 18 bp, Homo sapiens
ccaggcaggggtgggaga

SEQ ID NO: 1007152 - DNA, 22 bp, Homo sapiens
ccaggcaggtctgcaagggccc

SEQ ID NO: 1007153 - DNA, 17 bp, Homo sapiens
ccaggcaggtgcctgga

SEQ ID NO: 1007154 - DNA, 19 bp, Homo sapiens
ccaggcaggtgcctggaca

SEQ ID NO: 1007155 - DNA, 20 bp, Homo sapiens
ccaggcagtcgggggctggc

SEQ ID NO: 1007156 - DNA, 22 bp, Homo sapiens
ccaggcagtcgggggctggcct

SEQ ID NO: 1007157 - DNA, 15 bp, Homo sapiens
ccaggcatctccttg

SEQ ID NO: 1007158 - DNA, 16 bp, Homo sapiens
ccaggcatctccttgg

SEQ ID NO: 1007159 - DNA, 18 bp, Homo sapiens
ccaggcatctccttgggc

SEQ ID NO: 1007160 - DNA, 20 bp, Homo sapiens
ccaggcatctgttagcagag

SEQ ID NO: 1007161 - DNA, 16 bp, Homo sapiens
ccaggcatgcagctgc

SEQ ID NO: 1007162 - DNA, 20 bp, Homo sapiens
ccaggcatgcagctgcctgg

SEQ ID NO: 1007163 - DNA, 22 bp, Homo sapiens
ccaggcatgcagctgcctgggg

SEQ ID NO: 1007164 - DNA, 13 bp, Homo sapiens
ccaggcatggtgg

SEQ ID NO: 1007165 - DNA, 16 bp, Homo sapiens
ccaggcattgccaagg

SEQ ID NO: 1007166 - DNA, 22 bp, Homo sapiens
ccaggccaaagccccatgtgcc

SEQ ID NO: 1007167 - DNA, 18 bp, Homo sapiens
ccaggccaacagcacctc

SEQ ID NO: 1007168 - DNA, 16 bp, Homo sapiens
ccaggccacctccaga

SEQ ID NO: 1007169 - DNA, 12 bp, Homo sapiens
ccaggccactgt

SEQ ID NO: 1007170 - DNA, 15 bp, Homo sapiens
ccaggccactgtggc

SEQ ID NO: 1007171 - DNA, 22 bp, Homo sapiens
ccaggccactgtggccagagct

SEQ ID NO: 1007172 - DNA, 13 bp, Homo sapiens
ccaggccagcccc

SEQ ID NO: 1007173 - DNA, 14 bp, Homo sapiens
ccaggccagccccc

SEQ ID NO: 1007174 - DNA, 18 bp, Homo sapiens
ccaggccagcccccccac

SEQ ID NO: 1007175 - DNA, 20 bp, Homo sapiens
ccaggccagcccccccaccc

SEQ ID NO: 1007176 - DNA, 22 bp, Homo sapiens
ccaggccagcccccccacccac

SEQ ID NO: 1007177 - DNA, 11 bp, Homo sapiens
ccaggccaggt

SEQ ID NO: 1007178 - DNA, 14 bp, Homo sapiens
ccaggccaggtagc

SEQ ID NO: 1007179 - DNA, 22 bp, Homo sapiens
ccaggccatgtggcctgcccag

SEQ ID NO: 1007180 - DNA, 23 bp, Homo sapiens
ccaggccatgtggcctgcccagc

SEQ ID NO: 1007181 - DNA, 16 bp, Homo sapiens
ccaggcccaaggaggg

SEQ ID NO: 1007182 - DNA, 19 bp, Homo sapiens
atatgtgtttttcacattt

SEQ ID NO: 1007183 - DNA, 17 bp, Homo sapiens
atatgttaaagcttatt

SEQ ID NO: 1007184 - DNA, 20 bp, Homo sapiens
atatgttaacctcagtgtca

SEQ ID NO: 1007185 - DNA, 15 bp, Homo sapiens
atatgttcaactgga

SEQ ID NO: 1007186 - DNA, 20 bp, Homo sapiens
atatgttctgcaagaattaa

SEQ ID NO: 1007187 - DNA, 18 bp, Homo sapiens
atatgttctttaaaaata

SEQ ID NO: 1007188 - DNA, 14 bp, Homo sapiens
atatgttgaatact

SEQ ID NO: 1007189 - DNA, 17 bp, Homo sapiens
atatgttgaatactttt

SEQ ID NO: 1007190 - DNA, 18 bp, Homo sapiens
atatgttgaatacttttt

SEQ ID NO: 1007191 - DNA, 14 bp, Homo sapiens
atatgttgtaataa

SEQ ID NO: 1007192 - DNA, 16 bp, Homo sapiens
atatgttgttaaacac

SEQ ID NO: 1007193 - DNA, 16 bp, Homo sapiens
atatgtttacacaatt

SEQ ID NO: 1007194 - DNA, 23 bp, Homo sapiens
atatgtttagttttacattttaa

SEQ ID NO: 1007195 - DNA, 15 bp, Homo sapiens
atatgtttatatact

SEQ ID NO: 1007196 - DNA, 21 bp, Homo sapiens
atatgtttatattctttctta

SEQ ID NO: 1007197 - DNA, 21 bp, Homo sapiens
atatgtttcacacaaacaagg

SEQ ID NO: 1007198 - DNA, 15 bp, Homo sapiens
atatgttttatttca

SEQ ID NO: 1007199 - DNA, 20 bp, Homo sapiens
atatgtttttatttaaaaga

SEQ ID NO: 1007200 - DNA, 21 bp, Homo sapiens
atatgttttttagatcaaata

SEQ ID NO: 1007201 - DNA, 13 bp, Homo sapiens
atattaaaaatat

SEQ ID NO: 1007202 - DNA, 14 bp, Homo sapiens
atattaaaaatata

SEQ ID NO: 1007203 - DNA, 18 bp, Homo sapiens
atattaaaaatataaaac

SEQ ID NO: 1007204 - DNA, 21 bp, Homo sapiens
atattaaaaatataaaactgc

SEQ ID NO: 1007205 - DNA, 15 bp, Homo sapiens
atattaaaatagcat

SEQ ID NO: 1007206 - DNA, 17 bp, Homo sapiens
atattaaaatagcatac

SEQ ID NO: 1007207 - DNA, 11 bp, Homo sapiens
atattaaaatt

SEQ ID NO: 1007208 - DNA, 15 bp, Homo sapiens
atattaaaattccaa

SEQ ID NO: 1007209 - DNA, 21 bp, Homo sapiens
atattaaaattccaaattcat

SEQ ID NO: 1007210 - DNA, 19 bp, Homo sapiens
atattaaaatttggtgctt

SEQ ID NO: 1007211 - DNA, 22 bp, Homo sapiens
atattaaacaaaaacaaagaaa

SEQ ID NO: 1007212 - DNA, 14 bp, Homo sapiens
atattaaacgtgta

SEQ ID NO: 1007213 - DNA, 18 bp, Homo sapiens
atattaaacgtgtaaatt

SEQ ID NO: 1007214 - DNA, 19 bp, Homo sapiens
atattaaacgtgtaaattg

SEQ ID NO: 1007215 - DNA, 21 bp, Homo sapiens
atattaaacgtgtaaattgca

SEQ ID NO: 1007216 - DNA, 18 bp, Homo sapiens
atattaaagattctcttt

SEQ ID NO: 1007217 - DNA, 12 bp, Homo sapiens
atattaaataca

SEQ ID NO: 1007218 - DNA, 16 bp, Homo sapiens
atattaaatgttgctt

SEQ ID NO: 1007219 - DNA, 16 bp, Homo sapiens
atattaaatttcaaat

SEQ ID NO: 1007220 - DNA, 16 bp, Homo sapiens
atattaaattttttgt

SEQ ID NO: 1007221 - DNA, 16 bp, Homo sapiens
atattaacatcatctt

SEQ ID NO: 1007222 - DNA, 16 bp, Homo sapiens
atattaacttttaatg

SEQ ID NO: 1007223 - DNA, 19 bp, Homo sapiens
atattaagaagcaataact

SEQ ID NO: 1007224 - DNA, 13 bp, Homo sapiens
atattaagaatct

SEQ ID NO: 1007225 - DNA, 12 bp, Homo sapiens
atattaagcact

SEQ ID NO: 1007226 - DNA, 22 bp, Homo sapiens
atattaagtgtgccaaatcagt

SEQ ID NO: 1007227 - DNA, 13 bp, Homo sapiens
atattaatcaaaa

SEQ ID NO: 1007228 - DNA, 19 bp, Homo sapiens
atattaatcaaaattgtct

SEQ ID NO: 1007229 - DNA, 15 bp, Homo sapiens
atattaatgccttta

SEQ ID NO: 1007230 - DNA, 24 bp, Homo sapiens
atattaattagtttatattactct

SEQ ID NO: 1007231 - DNA, 18 bp, Homo sapiens
atattaattgcctgttaa

SEQ ID NO: 1007232 - DNA, 13 bp, Homo sapiens
atattacaatgat

SEQ ID NO: 1007233 - DNA, 19 bp, Homo sapiens
atattaccacagacatact

SEQ ID NO: 1007234 - DNA, 17 bp, Homo sapiens
atattacggtttgcccc

SEQ ID NO: 1007235 - DNA, 15 bp, Homo sapiens
atattactactcctt

SEQ ID NO: 1007236 - DNA, 21 bp, Homo sapiens
atattactctagtttattcta

SEQ ID NO: 1007237 - DNA, 21 bp, Homo sapiens
atattactgtctttattctta

SEQ ID NO: 1007238 - DNA, 17 bp, Homo sapiens
atattactgttgcattt

SEQ ID NO: 1007239 - DNA, 21 bp, Homo sapiens
atattactgttgcatttactt

SEQ ID NO: 1007240 - DNA, 13 bp, Homo sapiens
atattacttttgt

SEQ ID NO: 1007241 - DNA, 14 bp, Homo sapiens
atattacttttgta

SEQ ID NO: 1007242 - DNA, 15 bp, Homo sapiens
atattacttttgtaa

SEQ ID NO: 1007243 - DNA, 18 bp, Homo sapiens
atattacttttgtaaata

SEQ ID NO: 1007244 - DNA, 13 bp, Homo sapiens
atattagatcaaa

SEQ ID NO: 1007245 - DNA, 14 bp, Homo sapiens
atattagcaaagaa

SEQ ID NO: 1007246 - DNA, 20 bp, Homo sapiens
atattagctttactgtttgt

SEQ ID NO: 1007247 - DNA, 21 bp, Homo sapiens
atattaggatctgcaaacaat

SEQ ID NO: 1007248 - DNA, 22 bp, Homo sapiens
atattaggcataaattaaaatg

SEQ ID NO: 1007249 - DNA, 23 bp, Homo sapiens
atattagtgattctgatttcagt

SEQ ID NO: 1007250 - DNA, 14 bp, Homo sapiens
atattagttaatga

SEQ ID NO: 1007251 - DNA, 19 bp, Homo sapiens
atattataaaggataaaga

SEQ ID NO: 1007252 - DNA, 20 bp, Homo sapiens
atattataaaggataaagaa

SEQ ID NO: 1007253 - DNA, 16 bp, Homo sapiens
atattataactctgta

SEQ ID NO: 1007254 - DNA, 20 bp, Homo sapiens
atattatacaggaaagcaat

SEQ ID NO: 1007255 - DNA, 14 bp, Homo sapiens
atattatagaaaat

SEQ ID NO: 1007256 - DNA, 14 bp, Homo sapiens
atattatagagagt

SEQ ID NO: 1007257 - DNA, 21 bp, Homo sapiens
atattatcatgcaaatgctgt

SEQ ID NO: 1007258 - DNA, 14 bp, Homo sapiens
atattatgtcttct

SEQ ID NO: 1007259 - DNA, 18 bp, Homo sapiens
atattatgtcttcttttg

SEQ ID NO: 1007260 - DNA, 23 bp, Homo sapiens
atattatgttcctcaaggtccat

SEQ ID NO: 1007261 - DNA, 18 bp, Homo sapiens
atattatgtttaattatt

SEQ ID NO: 1007262 - DNA, 14 bp, Homo sapiens
atattattaatata

SEQ ID NO: 1007263 - DNA, 19 bp, Homo sapiens
atattattagaaattagaa

SEQ ID NO: 1007264 - DNA, 18 bp, Homo sapiens
atattattataatcttat

SEQ ID NO: 1007265 - DNA, 21 bp, Homo sapiens
atattattataatcttataat

SEQ ID NO: 1007266 - DNA, 23 bp, Homo sapiens
atattattataatcttataattg

SEQ ID NO: 1007267 - DNA, 13 bp, Homo sapiens
atattatttcttc

SEQ ID NO: 1007268 - DNA, 13 bp, Homo sapiens
atattatttgata

SEQ ID NO: 1007269 - DNA, 14 bp, Homo sapiens
atattatttgatat

SEQ ID NO: 1007270 - DNA, 15 bp, Homo sapiens
atattatttgtctta

SEQ ID NO: 1007271 - DNA, 20 bp, Homo sapiens
atattattttagcttcagtt

SEQ ID NO: 1007272 - DNA, 20 bp, Homo sapiens
atattcaactcataagactt

SEQ ID NO: 1007273 - DNA, 14 bp, Homo sapiens
atattcaaggcttt

SEQ ID NO: 1007274 - DNA, 18 bp, Homo sapiens
atattcaagtaacacttt

SEQ ID NO: 1007275 - DNA, 14 bp, Homo sapiens
atattcaagtgata

SEQ ID NO: 1007276 - DNA, 20 bp, Homo sapiens
atattcactggttttacaca

SEQ ID NO: 1007277 - DNA, 12 bp, Homo sapiens
atattcagaaat

SEQ ID NO: 1007278 - DNA, 19 bp, Homo sapiens
atattcagaatctttgtta

SEQ ID NO: 1007279 - DNA, 20 bp, Homo sapiens
atattcagaatctttgttaa

SEQ ID NO: 1007280 - DNA, 19 bp, Homo sapiens
atattcagacaaaatggat

SEQ ID NO: 1007281 - DNA, 17 bp, Homo sapiens
atattcagccagcttaa

SEQ ID NO: 1007282 - DNA, 21 bp, Homo sapiens
atattcaggctactcattcag

SEQ ID NO: 1007283 - DNA, 20 bp, Homo sapiens
atattcagtgaaaagatttt

SEQ ID NO: 1007284 - DNA, 18 bp, Homo sapiens
atattcatcagaatgtta

SEQ ID NO: 1007285 - DNA, 21 bp, Homo sapiens
atattcatctaataaatcagt

SEQ ID NO: 1007286 - DNA, 15 bp, Homo sapiens
atattcatttacatg

SEQ ID NO: 1007287 - DNA, 19 bp, Homo sapiens
atattccaacccagccacg

SEQ ID NO: 1007288 - DNA, 13 bp, Homo sapiens
atattccaaggaa

SEQ ID NO: 1007289 - DNA, 19 bp, Homo sapiens
atattccaccattcacatt

SEQ ID NO: 1007290 - DNA, 14 bp, Homo sapiens
atattccagaagaa

SEQ ID NO: 1007291 - DNA, 16 bp, Homo sapiens
atattccatgaatgta

SEQ ID NO: 1007292 - DNA, 19 bp, Homo sapiens
atattccccatttcctgta

SEQ ID NO: 1007293 - DNA, 18 bp, Homo sapiens
atattcccctatctctag

SEQ ID NO: 1007294 - DNA, 22 bp, Homo sapiens
atattcctattgtgcaatgtaa

SEQ ID NO: 1007295 - DNA, 20 bp, Homo sapiens
atattcctggacttacaaaa

SEQ ID NO: 1007296 - DNA, 12 bp, Homo sapiens
atattcctttgc

SEQ ID NO: 1007297 - DNA, 14 bp, Homo sapiens
atattcctttttct

SEQ ID NO: 1007298 - DNA, 16 bp, Homo sapiens
atattcctttttctat

SEQ ID NO: 1007299 - DNA, 21 bp, Homo sapiens
atattcctttttctatgaaat

SEQ ID NO: 1007300 - DNA, 23 bp, Homo sapiens
atattcctttttctatgaaataa

SEQ ID NO: 1007301 - DNA, 18 bp, Homo sapiens
atattctaagaaatatct

SEQ ID NO: 1007302 - DNA, 21 bp, Homo sapiens
atattctacacatgtaaaata

SEQ ID NO: 1007303 - DNA, 20 bp, Homo sapiens
atattctatatgaatttaaa

SEQ ID NO: 1007304 - DNA, 21 bp, Homo sapiens
gcaggctctgggctcagggct

SEQ ID NO: 1007305 - DNA, 15 bp, Homo sapiens
gcaggctgacatctg

SEQ ID NO: 1007306 - DNA, 19 bp, Homo sapiens
gcaggctgaggtggggaag

SEQ ID NO: 1007307 - DNA, 22 bp, Homo sapiens
gcaggctgaggtggggaaggag

SEQ ID NO: 1007308 - DNA, 18 bp, Homo sapiens
gcaggctggcaccgcctt

SEQ ID NO: 1007309 - DNA, 19 bp, Homo sapiens
gcaggctggcaccgccttc

SEQ ID NO: 1007310 - DNA, 22 bp, Homo sapiens
gcaggctggcagctctccagtc

SEQ ID NO: 1007311 - DNA, 14 bp, Homo sapiens
gcaggctggccagt

SEQ ID NO: 1007312 - DNA, 11 bp, Homo sapiens
gcaggctgggc

SEQ ID NO: 1007313 - DNA, 12 bp, Homo sapiens
gcaggctgggcc

SEQ ID NO: 1007314 - DNA, 23 bp, Homo sapiens
gcaggctgggccatgtccaaaga

SEQ ID NO: 1007315 - DNA, 14 bp, Homo sapiens
gcaggcttccccct

SEQ ID NO: 1007316 - DNA, 15 bp, Homo sapiens
gcaggcttccccctt

SEQ ID NO: 1007317 - DNA, 15 bp, Homo sapiens
gcagggaaggcctga

SEQ ID NO: 1007318 - DNA, 21 bp, Homo sapiens
gcagggaaggggaggcagccg

SEQ ID NO: 1007319 - DNA, 19 bp, Homo sapiens
gcagggacatggggcaagc

SEQ ID NO: 1007320 - DNA, 23 bp, Homo sapiens
gcagggacatggggcaagccagg

SEQ ID NO: 1007321 - DNA, 21 bp, Homo sapiens
gcagggacccggggtctcctg

SEQ ID NO: 1007322 - DNA, 23 bp, Homo sapiens
gcagggacccggggtctcctgga

SEQ ID NO: 1007323 - DNA, 20 bp, Homo sapiens
gcagggactgtaaacacaga

SEQ ID NO: 1007324 - DNA, 12 bp, Homo sapiens
gcagggagaagg

SEQ ID NO: 1007325 - DNA, 20 bp, Homo sapiens
gcagggagacatctgcaccc

SEQ ID NO: 1007326 - DNA, 13 bp, Homo sapiens
gcagggagcactg

SEQ ID NO: 1007327 - DNA, 22 bp, Homo sapiens
gcagggaggcaacactgctgtc

SEQ ID NO: 1007328 - DNA, 12 bp, Homo sapiens
gcagggaggcca

SEQ ID NO: 1007329 - DNA, 13 bp, Homo sapiens
gcagggagggctt

SEQ ID NO: 1007330 - DNA, 14 bp, Homo sapiens
gcagggaggggact

SEQ ID NO: 1007331 - DNA, 14 bp, Homo sapiens
gcagggaggggagg

SEQ ID NO: 1007332 - DNA, 19 bp, Homo sapiens
gcagggatgatggcagagc

SEQ ID NO: 1007333 - DNA, 21 bp, Homo sapiens
gcagggatgccctggaggtgg

SEQ ID NO: 1007334 - DNA, 19 bp, Homo sapiens
gcagggattaacctctgca

SEQ ID NO: 1007335 - DNA, 15 bp, Homo sapiens
gcagggattacaggc

SEQ ID NO: 1007336 - DNA, 13 bp, Homo sapiens
gcagggcacagat

SEQ ID NO: 1007337 - DNA, 17 bp, Homo sapiens
gcagggcacagatgacc

SEQ ID NO: 1007338 - DNA, 18 bp, Homo sapiens
gcagggcaggaaggggaa

SEQ ID NO: 1007339 - DNA, 15 bp, Homo sapiens
gcagggcatctcctg

SEQ ID NO: 1007340 - DNA, 19 bp, Homo sapiens
gcagggcatctcctgtgca

SEQ ID NO: 1007341 - DNA, 21 bp, Homo sapiens
gcagggccacctgcaggaccc

SEQ ID NO: 1007342 - DNA, 21 bp, Homo sapiens
gcagggccagggcaatgccat

SEQ ID NO: 1007343 - DNA, 13 bp, Homo sapiens
gcagggcccacct

SEQ ID NO: 1007344 - DNA, 22 bp, Homo sapiens
gcagggcccaccttggaccctg

SEQ ID NO: 1007345 - DNA, 14 bp, Homo sapiens
gcagggcccacgtg

SEQ ID NO: 1007346 - DNA, 21 bp, Homo sapiens
gcagggccccaggcattgcca

SEQ ID NO: 1007347 - DNA, 19 bp, Homo sapiens
gcagggcccctgaccctcc

SEQ ID NO: 1007348 - DNA, 18 bp, Homo sapiens
gcagggcctcatctcacc

SEQ ID NO: 1007349 - DNA, 19 bp, Homo sapiens
gcagggcgcccctgggaga

SEQ ID NO: 1007350 - DNA, 22 bp, Homo sapiens
gcagggcggctgccgactcccc

SEQ ID NO: 1007351 - DNA, 18 bp, Homo sapiens
gcagggcgggcagagggc

SEQ ID NO: 1007352 - DNA, 21 bp, Homo sapiens
gcagggcgggcagagggctgg

SEQ ID NO: 1007353 - DNA, 21 bp, Homo sapiens
gcagggcggtctcactcccag

SEQ ID NO: 1007354 - DNA, 17 bp, Homo sapiens
gcagggctaccctgagc

SEQ ID NO: 1007355 - DNA, 16 bp, Homo sapiens
gcagggctcacactcc

SEQ ID NO: 1007356 - DNA, 19 bp, Homo sapiens
gcagggctcacactcctgg

SEQ ID NO: 1007357 - DNA, 13 bp, Homo sapiens
gcagggctggtct

SEQ ID NO: 1007358 - DNA, 15 bp, Homo sapiens
gcagggctgtgcttg

SEQ ID NO: 1007359 - DNA, 20 bp, Homo sapiens
gcaggggaattccctccccc

SEQ ID NO: 1007360 - DNA, 20 bp, Homo sapiens
gcaggggagacaggagccta

SEQ ID NO: 1007361 - DNA, 22 bp, Homo sapiens
gcaggggagacaggagcctagc

SEQ ID NO: 1007362 - DNA, 13 bp, Homo sapiens
gcaggggagccag

SEQ ID NO: 1007363 - DNA, 14 bp, Homo sapiens
gcaggggagccagg

SEQ ID NO: 1007364 - DNA, 15 bp, Homo sapiens
gcaggggagccaggg

SEQ ID NO: 1007365 - DNA, 20 bp, Homo sapiens
gcaggggagccagggtagag

SEQ ID NO: 1007366 - DNA, 14 bp, Homo sapiens
gcaggggagcttgg

SEQ ID NO: 1007367 - DNA, 16 bp, Homo sapiens
gcaggggagcttggga

SEQ ID NO: 1007368 - DNA, 13 bp, Homo sapiens
gcaggggcctggg

SEQ ID NO: 1007369 - DNA, 16 bp, Homo sapiens
gcaggggcctgggccg

SEQ ID NO: 1007370 - DNA, 22 bp, Homo sapiens
gcagggggccccgccagggctg

SEQ ID NO: 1007371 - DNA, 23 bp, Homo sapiens
gcagggggccccgccagggctgg

SEQ ID NO: 1007372 - DNA, 22 bp, Homo sapiens
gcaggggggctgtgccaacctg

SEQ ID NO: 1007373 - DNA, 14 bp, Homo sapiens
gcaggggtccctgc

SEQ ID NO: 1007374 - DNA, 23 bp, Homo sapiens
gcaggggtgggggtggaggcttc

SEQ ID NO: 1007375 - DNA, 22 bp, Homo sapiens
gcaggggttgagagctttctgc

SEQ ID NO: 1007376 - DNA, 19 bp, Homo sapiens
gcaggggtttgggtggggg

SEQ ID NO: 1007377 - DNA, 14 bp, Homo sapiens
gcagggtcaggaga

SEQ ID NO: 1007378 - DNA, 16 bp, Homo sapiens
gcagggtcaggagagg

SEQ ID NO: 1007379 - DNA, 22 bp, Homo sapiens
cctggatttatagtatgtgact

SEQ ID NO: 1007380 - DNA, 20 bp, Homo sapiens
cctggattttttatgtacaa

SEQ ID NO: 1007381 - DNA, 16 bp, Homo sapiens
cctggcaacagagcga

SEQ ID NO: 1007382 - DNA, 14 bp, Homo sapiens
cctggcaagaaagc

SEQ ID NO: 1007383 - DNA, 21 bp, Homo sapiens
cctggcaaggcattcctcatc

SEQ ID NO: 1007384 - DNA, 16 bp, Homo sapiens
cctggcacagggcagt

SEQ ID NO: 1007385 - DNA, 13 bp, Homo sapiens
cctggcacattca

SEQ ID NO: 1007386 - DNA, 16 bp, Homo sapiens
cctggcacccaccgtc

SEQ ID NO: 1007387 - DNA, 23 bp, Homo sapiens
cctggcactaacgttgagcccct

SEQ ID NO: 1007388 - DNA, 14 bp, Homo sapiens
cctggcagaactga

SEQ ID NO: 1007389 - DNA, 17 bp, Homo sapiens
cctggcagaactgagct

SEQ ID NO: 1007390 - DNA, 18 bp, Homo sapiens
cctggcagaactgagctc

SEQ ID NO: 1007391 - DNA, 13 bp, Homo sapiens
cctggcagcagca

SEQ ID NO: 1007392 - DNA, 14 bp, Homo sapiens
cctggcagcccaga

SEQ ID NO: 1007393 - DNA, 18 bp, Homo sapiens
cctggcagccgtgccttc

SEQ ID NO: 1007394 - DNA, 15 bp, Homo sapiens
cctggcagctgcccc

SEQ ID NO: 1007395 - DNA, 17 bp, Homo sapiens
cctggcagctgcccctc

SEQ ID NO: 1007396 - DNA, 19 bp, Homo sapiens
cctggcagctgcccctcct

SEQ ID NO: 1007397 - DNA, 15 bp, Homo sapiens
cctggcagctggacc

SEQ ID NO: 1007398 - DNA, 22 bp, Homo sapiens
cctggcaggatgaccctgcgaa

SEQ ID NO: 1007399 - DNA, 17 bp, Homo sapiens
cctggcagggccacctg

SEQ ID NO: 1007400 - DNA, 20 bp, Homo sapiens
cctggcagggccacctgcag

SEQ ID NO: 1007401 - DNA, 22 bp, Homo sapiens
cctggcagggccacctgcagga

SEQ ID NO: 1007402 - DNA, 12 bp, Homo sapiens
cctggcagggct

SEQ ID NO: 1007403 - DNA, 21 bp, Homo sapiens
cctggcagtccgtgggacggg

SEQ ID NO: 1007404 - DNA, 20 bp, Homo sapiens
cctggcagtggctctcagag

SEQ ID NO: 1007405 - DNA, 18 bp, Homo sapiens
cctggcagttgaacagag

SEQ ID NO: 1007406 - DNA, 16 bp, Homo sapiens
cctggcatctgtgtgc

SEQ ID NO: 1007407 - DNA, 16 bp, Homo sapiens
cctggcatttgctgat

SEQ ID NO: 1007408 - DNA, 22 bp, Homo sapiens
cctggcatttgctgatttctag

SEQ ID NO: 1007409 - DNA, 21 bp, Homo sapiens
cctggcatttgtggccactca

SEQ ID NO: 1007410 - DNA, 14 bp, Homo sapiens
cctggccaccagcc

SEQ ID NO: 1007411 - DNA, 13 bp, Homo sapiens
cctggccaccctt

SEQ ID NO: 1007412 - DNA, 14 bp, Homo sapiens
cctggccacctctc

SEQ ID NO: 1007413 - DNA, 17 bp, Homo sapiens
cctggccacctgaggtg

SEQ ID NO: 1007414 - DNA, 20 bp, Homo sapiens
cctggccactaaagcttcag

SEQ ID NO: 1007415 - DNA, 21 bp, Homo sapiens
cctggccactaaagcttcaga

SEQ ID NO: 1007416 - DNA, 19 bp, Homo sapiens
cctggccactgaaaagctt

SEQ ID NO: 1007417 - DNA, 13 bp, Homo sapiens
cctggccactgct

SEQ ID NO: 1007418 - DNA, 13 bp, Homo sapiens
cctggccactgtc

SEQ ID NO: 1007419 - DNA, 13 bp, Homo sapiens
cctggccagacgc

SEQ ID NO: 1007420 - DNA, 12 bp, Homo sapiens
cctggccaggac

SEQ ID NO: 1007421 - DNA, 13 bp, Homo sapiens
cctggccaggagc

SEQ ID NO: 1007422 - DNA, 18 bp, Homo sapiens
cctggccaggagctcttc

SEQ ID NO: 1007423 - DNA, 21 bp, Homo sapiens
cctggccaggagctcttcagg

SEQ ID NO: 1007424 - DNA, 12 bp, Homo sapiens
cctggccaggca

SEQ ID NO: 1007425 - DNA, 17 bp, Homo sapiens
cctggccagtcctggtc

SEQ ID NO: 1007426 - DNA, 18 bp, Homo sapiens
cctggccatcatggcgaa

SEQ ID NO: 1007427 - DNA, 15 bp, Homo sapiens
cctggccatcccaca

SEQ ID NO: 1007428 - DNA, 12 bp, Homo sapiens
cctggccatgct

SEQ ID NO: 1007429 - DNA, 24 bp, Homo sapiens
cctggccatgctgtccctgcactg

SEQ ID NO: 1007430 - DNA, 17 bp, Homo sapiens
cctggccatttggcccc

SEQ ID NO: 1007431 - DNA, 15 bp, Homo sapiens
cctggcccaaagcag

SEQ ID NO: 1007432 - DNA, 13 bp, Homo sapiens
cctggcccactgc

SEQ ID NO: 1007433 - DNA, 15 bp, Homo sapiens
cctggcccagcggcc

SEQ ID NO: 1007434 - DNA, 21 bp, Homo sapiens
cctggcccagcggcccctccc

SEQ ID NO: 1007435 - DNA, 18 bp, Homo sapiens
cctggcccaggccttgct

SEQ ID NO: 1007436 - DNA, 23 bp, Homo sapiens
cctggcccaggccttgctgactc

SEQ ID NO: 1007437 - DNA, 17 bp, Homo sapiens
cctggccccagcctggg

SEQ ID NO: 1007438 - DNA, 12 bp, Homo sapiens
cctggccccagg

SEQ ID NO: 1007439 - DNA, 14 bp, Homo sapiens
cctggccccatgtc

SEQ ID NO: 1007440 - DNA, 18 bp, Homo sapiens
cctggccccatgtctctc

SEQ ID NO: 1007441 - DNA, 21 bp, Homo sapiens
cctggccccatgtctctcaga

SEQ ID NO: 1007442 - DNA, 16 bp, Homo sapiens
cctggcccccaacctc

SEQ ID NO: 1007443 - DNA, 19 bp, Homo sapiens
cctggcccccaacctcagg

SEQ ID NO: 1007444 - DNA, 22 bp, Homo sapiens
cctggcccccaacctcagggct

SEQ ID NO: 1007445 - DNA, 17 bp, Homo sapiens
cctggccccgcctgcct

SEQ ID NO: 1007446 - DNA, 22 bp, Homo sapiens
cctggccccgggctctggccac

SEQ ID NO: 1007447 - DNA, 15 bp, Homo sapiens
cctggcccctcgcct

SEQ ID NO: 1007448 - DNA, 17 bp, Homo sapiens
cctggcccctcgcctgt

SEQ ID NO: 1007449 - DNA, 13 bp, Homo sapiens
cctggcccctgtg

SEQ ID NO: 1007450 - DNA, 15 bp, Homo sapiens
cctggcccgcccctc

SEQ ID NO: 1007451 - DNA, 15 bp, Homo sapiens
cctggccctccctcc

SEQ ID NO: 1007452 - DNA, 14 bp, Homo sapiens
cctggccctcctgg

SEQ ID NO: 1007453 - DNA, 16 bp, Homo sapiens
cctggccctgcttcct

SEQ ID NO: 1007454 - DNA, 17 bp, Homo sapiens
cctggccctgcttcctg

SEQ ID NO: 1007455 - DNA, 21 bp, Homo sapiens
cctggccctgcttcctgcttg

SEQ ID NO: 1007456 - DNA, 20 bp, Homo sapiens
cctggccctgggggtctggg

SEQ ID NO: 1007457 - DNA, 12 bp, Homo sapiens
cctggcccttac

SEQ ID NO: 1007458 - DNA, 19 bp, Homo sapiens
cctggcccttcagtctgct

SEQ ID NO: 1007459 - DNA, 14 bp, Homo sapiens
cctggccgccccct

SEQ ID NO: 1007460 - DNA, 20 bp, Homo sapiens
cctggccgccccctgccccc

SEQ ID NO: 1007461 - DNA, 21 bp, Homo sapiens
cctggccgccccctgcccccc

SEQ ID NO: 1007462 - DNA, 19 bp, Homo sapiens
cctggccgcggagcctgca

SEQ ID NO: 1007463 - DNA, 21 bp, Homo sapiens
cctggccggcaaccccagttc

SEQ ID NO: 1007464 - DNA, 23 bp, Homo sapiens
cctggccggcaaccccagttctg

SEQ ID NO: 1007465 - DNA, 20 bp, Homo sapiens
cctggccgggtcaccctgtg

SEQ ID NO: 1007466 - DNA, 21 bp, Homo sapiens
cctggccgggtcaccctgtga

SEQ ID NO: 1007467 - DNA, 13 bp, Homo sapiens
cctggcctcaagt

SEQ ID NO: 1007468 - DNA, 21 bp, Homo sapiens
cctggcctcactggctggggc

SEQ ID NO: 1007469 - DNA, 22 bp, Homo sapiens
cctggcctcactggctggggca

SEQ ID NO: 1007470 - DNA, 16 bp, Homo sapiens
cctggcctcagttccc

SEQ ID NO: 1007471 - DNA, 20 bp, Homo sapiens
cctggcctcagttcccagct

SEQ ID NO: 1007472 - DNA, 18 bp, Homo sapiens
cctggcctcccctgccac

SEQ ID NO: 1007473 - DNA, 21 bp, Homo sapiens
cctggcctccgatgcctggcc

SEQ ID NO: 1007474 - DNA, 16 bp, Homo sapiens
cctggcctcgcctgcc

SEQ ID NO: 1007475 - DNA, 17 bp, Homo sapiens
cctggcctcgcctgcct

SEQ ID NO: 1007476 - DNA, 18 bp, Homo sapiens
cctggcctcgcctgcctt

SEQ ID NO: 1007477 - DNA, 23 bp, Homo sapiens
cctggcctcgcctgcctttctgc

SEQ ID NO: 1007478 - DNA, 20 bp, Homo sapiens
cctggcctctgcttactttt

SEQ ID NO: 1007479 - DNA, 13 bp, Homo sapiens
cctggcctctgtg

SEQ ID NO: 1007480 - DNA, 18 bp, Homo sapiens
cctggcctgaactgagga

SEQ ID NO: 1007481 - DNA, 20 bp, Homo sapiens
cctggcctgaactgaggaga

SEQ ID NO: 1007482 - DNA, 21 bp, Homo sapiens
cctggcctgaactgaggagat

SEQ ID NO: 1007483 - DNA, 13 bp, Homo sapiens
cctggcctgagag

SEQ ID NO: 1007484 - DNA, 16 bp, Homo sapiens
cctggcctgagagtca

SEQ ID NO: 1007485 - DNA, 12 bp, Homo sapiens
cctggcctgagc

SEQ ID NO: 1007486 - DNA, 19 bp, Homo sapiens
cctggcctggccatctccc

SEQ ID NO: 1007487 - DNA, 14 bp, Homo sapiens
cctggcctggctcc

SEQ ID NO: 1007488 - DNA, 19 bp, Homo sapiens
cctggcctgttctgttttg

SEQ ID NO: 1007489 - DNA, 18 bp, Homo sapiens
cctggccttaaagaggga

SEQ ID NO: 1007490 - DNA, 13 bp, Homo sapiens
cctggccttcctc

SEQ ID NO: 1007491 - DNA, 13 bp, Homo sapiens
cctggccttctga

SEQ ID NO: 1007492 - DNA, 21 bp, Homo sapiens
cctggccttgtgtggcttgga

SEQ ID NO: 1007493 - DNA, 14 bp, Homo sapiens
cctggcctttttct

SEQ ID NO: 1007494 - DNA, 20 bp, Homo sapiens
cctggcgactgcccctgcct

SEQ ID NO: 1007495 - DNA, 23 bp, Homo sapiens
cctggcgagttctctttggaaat

SEQ ID NO: 1007496 - DNA, 19 bp, Homo sapiens
cctggcgcaggtgggctgg

SEQ ID NO: 1007497 - DNA, 23 bp, Homo sapiens
cctggcgcaggtgggctggactt

SEQ ID NO: 1007498 - DNA, 15 bp, Homo sapiens
cctggcgcctggcag

SEQ ID NO: 1007499 - DNA, 17 bp, Homo sapiens
cctggcggcctgtgggt

SEQ ID NO: 1007500 - DNA, 20 bp, Homo sapiens
cctggcggggttggcccttg

SEQ ID NO: 1007501 - DNA, 16 bp, Homo sapiens
cctggctatgtcctaa

SEQ ID NO: 1007502 - DNA, 17 bp, Homo sapiens
cctggctcccacaggcc

SEQ ID NO: 1007503 - DNA, 14 bp, Homo sapiens
cctggctcccatga

SEQ ID NO: 1007504 - DNA, 20 bp, Homo sapiens
gcagggtccaaaggccagcg

SEQ ID NO: 1007505 - DNA, 16 bp, Homo sapiens
gcagggtccacgcctc

SEQ ID NO: 1007506 - DNA, 20 bp, Homo sapiens
gcagggtctgggctgggcac

SEQ ID NO: 1007507 - DNA, 16 bp, Homo sapiens
gcagggtcttttcatc

SEQ ID NO: 1007508 - DNA, 19 bp, Homo sapiens
gcagggtgggcagcctatg

SEQ ID NO: 1007509 - DNA, 13 bp, Homo sapiens
gcagggtggggtc

SEQ ID NO: 1007510 - DNA, 15 bp, Homo sapiens
gcagggtggtgctgg

SEQ ID NO: 1007511 - DNA, 18 bp, Homo sapiens
gcaggtcactgtcactgc

SEQ ID NO: 1007512 - DNA, 16 bp, Homo sapiens
gcaggtcctgcccatg

SEQ ID NO: 1007513 - DNA, 21 bp, Homo sapiens
gcaggtcctgcccatgtgtcc

SEQ ID NO: 1007514 - DNA, 21 bp, Homo sapiens
gcaggtctgcaagggcccaga

SEQ ID NO: 1007515 - DNA, 22 bp, Homo sapiens
gcaggtctgcaagggcccagag

SEQ ID NO: 1007516 - DNA, 15 bp, Homo sapiens
gcaggtgcctccagg

SEQ ID NO: 1007517 - DNA, 18 bp, Homo sapiens
gcaggtgcctccaggtgt

SEQ ID NO: 1007518 - DNA, 13 bp, Homo sapiens
gcaggtgctgctg

SEQ ID NO: 1007519 - DNA, 23 bp, Homo sapiens
gcaggtgctgtgcgccttgtaga

SEQ ID NO: 1007520 - DNA, 21 bp, Homo sapiens
gcaggtggatctatttcatgt

SEQ ID NO: 1007521 - DNA, 18 bp, Homo sapiens
gcaggtgggctgcctgct

SEQ ID NO: 1007522 - DNA, 21 bp, Homo sapiens
gcaggtggggttcgaggggaa

SEQ ID NO: 1007523 - DNA, 13 bp, Homo sapiens
gcaggtggtggag

SEQ ID NO: 1007524 - DNA, 15 bp, Homo sapiens
gcaggtggtggaggg

SEQ ID NO: 1007525 - DNA, 21 bp, Homo sapiens
gcaggtggtggcactgagccc

SEQ ID NO: 1007526 - DNA, 22 bp, Homo sapiens
gcaggtgtcatatatggggggc

SEQ ID NO: 1007527 - DNA, 18 bp, Homo sapiens
gcaggtgtggtggctcat

SEQ ID NO: 1007528 - DNA, 20 bp, Homo sapiens
gcaggtgtggtggctcatgg

SEQ ID NO: 1007529 - DNA, 21 bp, Homo sapiens
gcaggtgtggtggctcatggc

SEQ ID NO: 1007530 - DNA, 13 bp, Homo sapiens
gcaggtgtttctt

SEQ ID NO: 1007531 - DNA, 17 bp, Homo sapiens
gcaggttcctggggccg

SEQ ID NO: 1007532 - DNA, 19 bp, Homo sapiens
gcaggttcctggggccgcc

SEQ ID NO: 1007533 - DNA, 21 bp, Homo sapiens
gcaggttcctggggccgcctg

SEQ ID NO: 1007534 - DNA, 17 bp, Homo sapiens
gcaggttcttgttggtg

SEQ ID NO: 1007535 - DNA, 20 bp, Homo sapiens
gcaggttgaggggctcctgg

SEQ ID NO: 1007536 - DNA, 21 bp, Homo sapiens
gcaggttgaggggctcctgga

SEQ ID NO: 1007537 - DNA, 15 bp, Homo sapiens
gcaggtttcatttct

SEQ ID NO: 1007538 - DNA, 17 bp, Homo sapiens
gcaggtttcatttctta

SEQ ID NO: 1007539 - DNA, 19 bp, Homo sapiens
gcaggtttcatttcttatc

SEQ ID NO: 1007540 - DNA, 20 bp, Homo sapiens
gcaggtttgttttcagcact

SEQ ID NO: 1007541 - DNA, 14 bp, Homo sapiens
gcagtaaaaactgt

SEQ ID NO: 1007542 - DNA, 20 bp, Homo sapiens
gcagtaaaagataaatttgt

SEQ ID NO: 1007543 - DNA, 18 bp, Homo sapiens
gcagtaaatacttgcagt

SEQ ID NO: 1007544 - DNA, 15 bp, Homo sapiens
gcagtaaatttgcta

SEQ ID NO: 1007545 - DNA, 22 bp, Homo sapiens
gcagtaatattttaagatggac

SEQ ID NO: 1007546 - DNA, 16 bp, Homo sapiens
gcagtacagtgtgtgt

SEQ ID NO: 1007547 - DNA, 19 bp, Homo sapiens
cctggcttgcttgccgagc

SEQ ID NO: 1007548 - DNA, 20 bp, Homo sapiens
cctggcttgtaactccacca

SEQ ID NO: 1007549 - DNA, 22 bp, Homo sapiens
cctggcttgtaactccaccaac

SEQ ID NO: 1007550 - DNA, 22 bp, Homo sapiens
cctggctttggtccccagcatt

SEQ ID NO: 1007551 - DNA, 20 bp, Homo sapiens
cctggcttttcactgctggc

SEQ ID NO: 1007552 - DNA, 21 bp, Homo sapiens
cctggcttttcactgctggct

SEQ ID NO: 1007553 - DNA, 23 bp, Homo sapiens
cctgggaaaggacccacccatct

SEQ ID NO: 1007554 - DNA, 14 bp, Homo sapiens
cctgggaacacagt

SEQ ID NO: 1007555 - DNA, 19 bp, Homo sapiens
cctgggaacacagttctgg

SEQ ID NO: 1007556 - DNA, 18 bp, Homo sapiens
cctgggaacaggccccac

SEQ ID NO: 1007557 - DNA, 15 bp, Homo sapiens
cctgggaaccactcc

SEQ ID NO: 1007558 - DNA, 14 bp, Homo sapiens
cctgggaagtggag

SEQ ID NO: 1007559 - DNA, 16 bp, Homo sapiens
cctgggacacagaccc

SEQ ID NO: 1007560 - DNA, 19 bp, Homo sapiens
cctgggacacagacccagg

SEQ ID NO: 1007561 - DNA, 23 bp, Homo sapiens
cctgggacacagacccaggaccc

SEQ ID NO: 1007562 - DNA, 19 bp, Homo sapiens
cctgggacacttccctggg

SEQ ID NO: 1007563 - DNA, 23 bp, Homo sapiens
cctgggacatcaggagactgggc

SEQ ID NO: 1007564 - DNA, 14 bp, Homo sapiens
cctgggacccagct

SEQ ID NO: 1007565 - DNA, 13 bp, Homo sapiens
cctgggacccttg

SEQ ID NO: 1007566 - DNA, 17 bp, Homo sapiens
cctgggacctcccctga

SEQ ID NO: 1007567 - DNA, 14 bp, Homo sapiens
cctgggacttccat

SEQ ID NO: 1007568 - DNA, 18 bp, Homo sapiens
cctgggagaacctcaggc

SEQ ID NO: 1007569 - DNA, 22 bp, Homo sapiens
cctgggagaaggtctccaaggg

SEQ ID NO: 1007570 - DNA, 18 bp, Homo sapiens
cctgggagccagggtgag

SEQ ID NO: 1007571 - DNA, 16 bp, Homo sapiens
cctgggagcccagagg

SEQ ID NO: 1007572 - DNA, 19 bp, Homo sapiens
cctgggaggaaatttgaat

SEQ ID NO: 1007573 - DNA, 15 bp, Homo sapiens
cctgggaggacaggc

SEQ ID NO: 1007574 - DNA, 20 bp, Homo sapiens
cctgggaggatcctgagctg

SEQ ID NO: 1007575 - DNA, 20 bp, Homo sapiens
cctgggaggcagaggttgca

SEQ ID NO: 1007576 - DNA, 14 bp, Homo sapiens
cctgggaggcggag

SEQ ID NO: 1007577 - DNA, 23 bp, Homo sapiens
cctgggaggcggagagtacagtg

SEQ ID NO: 1007578 - DNA, 20 bp, Homo sapiens
cctgggaggtcaaggctgca

SEQ ID NO: 1007579 - DNA, 22 bp, Homo sapiens
cctgggatctggcacactccct

SEQ ID NO: 1007580 - DNA, 15 bp, Homo sapiens
cctgggatctggtgg

SEQ ID NO: 1007581 - DNA, 14 bp, Homo sapiens
cctgggatgcctca

SEQ ID NO: 1007582 - DNA, 16 bp, Homo sapiens
cctgggatgcctcacc

SEQ ID NO: 1007583 - DNA, 17 bp, Homo sapiens
cctgggatgctgaccca

SEQ ID NO: 1007584 - DNA, 20 bp, Homo sapiens
cctgggatgctgacccagga

SEQ ID NO: 1007585 - DNA, 15 bp, Homo sapiens
cctgggatggaacct

SEQ ID NO: 1007586 - DNA, 15 bp, Homo sapiens
cctgggcaagagatg

SEQ ID NO: 1007587 - DNA, 15 bp, Homo sapiens
cctgggcacctgggg

SEQ ID NO: 1007588 - DNA, 17 bp, Homo sapiens
cctgggcactccgcgcc

SEQ ID NO: 1007589 - DNA, 19 bp, Homo sapiens
cctgggcactccgcgccga

SEQ ID NO: 1007590 - DNA, 17 bp, Homo sapiens
cctgggcagccccacag

SEQ ID NO: 1007591 - DNA, 12 bp, Homo sapiens
cctgggcagctc

SEQ ID NO: 1007592 - DNA, 14 bp, Homo sapiens
cctgggcagctcct

SEQ ID NO: 1007593 - DNA, 11 bp, Homo sapiens
cctgggcagga

SEQ ID NO: 1007594 - DNA, 15 bp, Homo sapiens
cctgggcaggaccct

SEQ ID NO: 1007595 - DNA, 16 bp, Homo sapiens
cctgggcaggaccctg

SEQ ID NO: 1007596 - DNA, 22 bp, Homo sapiens
cctgggcagggatgatggcaga

SEQ ID NO: 1007597 - DNA, 21 bp, Homo sapiens
cctgggcagggttctccaagg

SEQ ID NO: 1007598 - DNA, 19 bp, Homo sapiens
cctgggcagtgagtgccat

SEQ ID NO: 1007599 - DNA, 18 bp, Homo sapiens
cctgggcatcttctggct

SEQ ID NO: 1007600 - DNA, 21 bp, Homo sapiens
cctgggcatgggtccagggcc

SEQ ID NO: 1007601 - DNA, 22 bp, Homo sapiens
cctgggcatgggtccagggcct

SEQ ID NO: 1007602 - DNA, 18 bp, Homo sapiens
cctgggccacacctgagc

SEQ ID NO: 1007603 - DNA, 13 bp, Homo sapiens
cctgggccacctc

SEQ ID NO: 1007604 - DNA, 13 bp, Homo sapiens
cctgggccaggca

SEQ ID NO: 1007605 - DNA, 14 bp, Homo sapiens
cctgggccaggcag

SEQ ID NO: 1007606 - DNA, 15 bp, Homo sapiens
cctgggccaggcagg

SEQ ID NO: 1007607 - DNA, 19 bp, Homo sapiens
cctgggccaggcaggcgat

SEQ ID NO: 1007608 - DNA, 15 bp, Homo sapiens
cctgggcccacagag

SEQ ID NO: 1007609 - DNA, 17 bp, Homo sapiens
cctgggcccatctccct

SEQ ID NO: 1007610 - DNA, 12 bp, Homo sapiens
cctgggccccac

SEQ ID NO: 1007611 - DNA, 15 bp, Homo sapiens
cctgggccccaccac

SEQ ID NO: 1007612 - DNA, 23 bp, Homo sapiens
cctgggccccactggacaacact

SEQ ID NO: 1007613 - DNA, 12 bp, Homo sapiens
cctgggcccctc

SEQ ID NO: 1007614 - DNA, 19 bp, Homo sapiens
cctgggcccgggcaggcca

SEQ ID NO: 1007615 - DNA, 15 bp, Homo sapiens
cctgggccctctctg

SEQ ID NO: 1007616 - DNA, 12 bp, Homo sapiens
cctgggccctgg

SEQ ID NO: 1007617 - DNA, 14 bp, Homo sapiens
cctgggccctgggc

SEQ ID NO: 1007618 - DNA, 19 bp, Homo sapiens
cctgggccctgggctggaa

SEQ ID NO: 1007619 - DNA, 13 bp, Homo sapiens
cctgggccgctgc

SEQ ID NO: 1007620 - DNA, 14 bp, Homo sapiens
cctgggcctgcccc

SEQ ID NO: 1007621 - DNA, 21 bp, Homo sapiens
cctgggcctgcttttccagga

SEQ ID NO: 1007622 - DNA, 13 bp, Homo sapiens
cctgggccttggc

SEQ ID NO: 1007623 - DNA, 21 bp, Homo sapiens
cctgggccttggctgggcctc

SEQ ID NO: 1007624 - DNA, 15 bp, Homo sapiens
cctgggcctttcctg

SEQ ID NO: 1007625 - DNA, 17 bp, Homo sapiens
cctgggcctttcctgtg

SEQ ID NO: 1007626 - DNA, 20 bp, Homo sapiens
cctgggcctttcctgtgcca

SEQ ID NO: 1007627 - DNA, 19 bp, Homo sapiens
cctgggcctttgcaagatg

SEQ ID NO: 1007628 - DNA, 22 bp, Homo sapiens
cctgggcctttgcaagatgctt

SEQ ID NO: 1007629 - DNA, 23 bp, Homo sapiens
cctgggcctttgcaagatgcttg

SEQ ID NO: 1007630 - DNA, 18 bp, Homo sapiens
gcagtgggagggtaccag

SEQ ID NO: 1007631 - DNA, 15 bp, Homo sapiens
gcagtgggcaggtgg

SEQ ID NO: 1007632 - DNA, 14 bp, Homo sapiens
gcagtggggtgaaa

SEQ ID NO: 1007633 - DNA, 22 bp, Homo sapiens
gcagtggtggttttctgttctt

SEQ ID NO: 1007634 - DNA, 14 bp, Homo sapiens
gcagtgtagatttt

SEQ ID NO: 1007635 - DNA, 18 bp, Homo sapiens
gcagtgtagcccacactt

SEQ ID NO: 1007636 - DNA, 22 bp, Homo sapiens
gcagtgtcctgtgctttctgca

SEQ ID NO: 1007637 - DNA, 18 bp, Homo sapiens
gcagtgtctgtgttttga

SEQ ID NO: 1007638 - DNA, 11 bp, Homo sapiens
gcagtgtcttc

SEQ ID NO: 1007639 - DNA, 14 bp, Homo sapiens
gcagtgtcttccat

SEQ ID NO: 1007640 - DNA, 16 bp, Homo sapiens
gcagtgtcttccataa

SEQ ID NO: 1007641 - DNA, 20 bp, Homo sapiens
gcagtgtcttccataatgta

SEQ ID NO: 1007642 - DNA, 13 bp, Homo sapiens
gcagtgtgaggac

SEQ ID NO: 1007643 - DNA, 20 bp, Homo sapiens
gcagtgtgaggacctccctg

SEQ ID NO: 1007644 - DNA, 19 bp, Homo sapiens
gcagtgtgaggccagggca

SEQ ID NO: 1007645 - DNA, 22 bp, Homo sapiens
gcagtgtggagaccctgccaca

SEQ ID NO: 1007646 - DNA, 21 bp, Homo sapiens
gcagtgtggagttcaccttgg

SEQ ID NO: 1007647 - DNA, 18 bp, Homo sapiens
gcagtgttacttgcaggt

SEQ ID NO: 1007648 - DNA, 21 bp, Homo sapiens
gcagtgttccccatctgggtc

SEQ ID NO: 1007649 - DNA, 13 bp, Homo sapiens
gcagttaccacag

SEQ ID NO: 1007650 - DNA, 15 bp, Homo sapiens
gcagttagagcagcc

SEQ ID NO: 1007651 - DNA, 18 bp, Homo sapiens
gcagttagagcagcctcg

SEQ ID NO: 1007652 - DNA, 13 bp, Homo sapiens
gcagttatatttt

SEQ ID NO: 1007653 - DNA, 19 bp, Homo sapiens
gcagttatggtgatgactt

SEQ ID NO: 1007654 - DNA, 19 bp, Homo sapiens
gcagttcagcaccacccta

SEQ ID NO: 1007655 - DNA, 13 bp, Homo sapiens
gcagttcctgagt

SEQ ID NO: 1007656 - DNA, 19 bp, Homo sapiens
gcagttctactcaggctgg

SEQ ID NO: 1007657 - DNA, 18 bp, Homo sapiens
gcagttctcactcctagg

SEQ ID NO: 1007658 - DNA, 19 bp, Homo sapiens
gcagttctcactcctagga

SEQ ID NO: 1007659 - DNA, 15 bp, Homo sapiens
gcagttctcccaggg

SEQ ID NO: 1007660 - DNA, 17 bp, Homo sapiens
gcagttctcccagggag

SEQ ID NO: 1007661 - DNA, 18 bp, Homo sapiens
gcagttctcccagggagt

SEQ ID NO: 1007662 - DNA, 21 bp, Homo sapiens
gcagttctcccagggagtgag

SEQ ID NO: 1007663 - DNA, 11 bp, Homo sapiens
gcagttctgca

SEQ ID NO: 1007664 - DNA, 19 bp, Homo sapiens
gcagttctgcaaatagaaa

SEQ ID NO: 1007665 - DNA, 22 bp, Homo sapiens
gcagttgacaggtacttggagg

SEQ ID NO: 1007666 - DNA, 18 bp, Homo sapiens
gcagttgataagaggaat

SEQ ID NO: 1007667 - DNA, 14 bp, Homo sapiens
gcagttggggccct

SEQ ID NO: 1007668 - DNA, 13 bp, Homo sapiens
gcagtttaaagca

SEQ ID NO: 1007669 - DNA, 22 bp, Homo sapiens
cctggggagtgggacagagtct

SEQ ID NO: 1007670 - DNA, 21 bp, Homo sapiens
cctggggatgtaaccaagctg

SEQ ID NO: 1007671 - DNA, 13 bp, Homo sapiens
cctggggcacagt

SEQ ID NO: 1007672 - DNA, 22 bp, Homo sapiens
cctggggcacagtccaggaaca

SEQ ID NO: 1007673 - DNA, 13 bp, Homo sapiens
cctggggcagaga

SEQ ID NO: 1007674 - DNA, 21 bp, Homo sapiens
cctggggcaggggtgcttcct

SEQ ID NO: 1007675 - DNA, 12 bp, Homo sapiens
cctggggccccg

SEQ ID NO: 1007676 - DNA, 17 bp, Homo sapiens
cctggggccccgctggg

SEQ ID NO: 1007677 - DNA, 14 bp, Homo sapiens
cctggggccgcctg

SEQ ID NO: 1007678 - DNA, 15 bp, Homo sapiens
cctggggccgcctgc

SEQ ID NO: 1007679 - DNA, 17 bp, Homo sapiens
cctggggccgcctgccc

SEQ ID NO: 1007680 - DNA, 23 bp, Homo sapiens
cctggggcctccagaagctgctc

SEQ ID NO: 1007681 - DNA, 13 bp, Homo sapiens
cctggggcctgac

SEQ ID NO: 1007682 - DNA, 17 bp, Homo sapiens
cctggggcctgactgct

SEQ ID NO: 1007683 - DNA, 14 bp, Homo sapiens
cctggggcctgaga

SEQ ID NO: 1007684 - DNA, 17 bp, Homo sapiens
cctggggcctgagagaa

SEQ ID NO: 1007685 - DNA, 18 bp, Homo sapiens
cctggggcctggacctgc

SEQ ID NO: 1007686 - DNA, 16 bp, Homo sapiens
cctggggctcctttct

SEQ ID NO: 1007687 - DNA, 12 bp, Homo sapiens
cctggggctctc

SEQ ID NO: 1007688 - DNA, 19 bp, Homo sapiens
cctggggctctctgacccg

SEQ ID NO: 1007689 - DNA, 15 bp, Homo sapiens
cctggggctctgtgc

SEQ ID NO: 1007690 - DNA, 18 bp, Homo sapiens
cctggggctctgtgcagg

SEQ ID NO: 1007691 - DNA, 21 bp, Homo sapiens
cctggggctgcttaggaaacc

SEQ ID NO: 1007692 - DNA, 17 bp, Homo sapiens
cctggggctggcctccc

SEQ ID NO: 1007693 - DNA, 19 bp, Homo sapiens
cctggggctggcctcccaa

SEQ ID NO: 1007694 - DNA, 19 bp, Homo sapiens
cctgggggacccctggctc

SEQ ID NO: 1007695 - DNA, 19 bp, Homo sapiens
cctgggggattcctgagct

SEQ ID NO: 1007696 - DNA, 16 bp, Homo sapiens
cctgggggcagtgact

SEQ ID NO: 1007697 - DNA, 21 bp, Homo sapiens
cctgggggcagtgactggcag

SEQ ID NO: 1007698 - DNA, 22 bp, Homo sapiens
cctgggggcagtgactggcagg

SEQ ID NO: 1007699 - DNA, 17 bp, Homo sapiens
cctgggggcctgggttg

SEQ ID NO: 1007700 - DNA, 22 bp, Homo sapiens
cctgggggccttgggtgagtgg

SEQ ID NO: 1007701 - DNA, 15 bp, Homo sapiens
cctgggggctggctc

SEQ ID NO: 1007702 - DNA, 14 bp, Homo sapiens
cctggggggaacgg

SEQ ID NO: 1007703 - DNA, 13 bp, Homo sapiens
cctggggggaggg

SEQ ID NO: 1007704 - DNA, 14 bp, Homo sapiens
cctggggggaggga

SEQ ID NO: 1007705 - DNA, 15 bp, Homo sapiens
cctgggggtggcagg

SEQ ID NO: 1007706 - DNA, 18 bp, Homo sapiens
cctgggggtggcaggcac

SEQ ID NO: 1007707 - DNA, 17 bp, Homo sapiens
cctgggggtttcacctg

SEQ ID NO: 1007708 - DNA, 20 bp, Homo sapiens
cctgggggtttcacctgggc

SEQ ID NO: 1007709 - DNA, 14 bp, Homo sapiens
cctggggtaaagta

SEQ ID NO: 1007710 - DNA, 15 bp, Homo sapiens
cctggggtccctctg

SEQ ID NO: 1007711 - DNA, 15 bp, Homo sapiens
cctggggtctctctc

SEQ ID NO: 1007712 - DNA, 19 bp, Homo sapiens
cctggggtctctctcccta

SEQ ID NO: 1007713 - DNA, 13 bp, Homo sapiens
cctggggtggcca

SEQ ID NO: 1007714 - DNA, 15 bp, Homo sapiens
cctggggtggccagg

SEQ ID NO: 1007715 - DNA, 16 bp, Homo sapiens
cctggggtggccaggg

SEQ ID NO: 1007716 - DNA, 18 bp, Homo sapiens
cctggggtggccagggct

SEQ ID NO: 1007717 - DNA, 18 bp, Homo sapiens
cctggggtggcctggccc

SEQ ID NO: 1007718 - DNA, 21 bp, Homo sapiens
cctggggtggcctggccctcc

SEQ ID NO: 1007719 - DNA, 13 bp, Homo sapiens
cctggggtgggac

SEQ ID NO: 1007720 - DNA, 16 bp, Homo sapiens
cctggggtgggacagg

SEQ ID NO: 1007721 - DNA, 18 bp, Homo sapiens
cctggggtgggacaggga

SEQ ID NO: 1007722 - DNA, 23 bp, Homo sapiens
cctggggtgggatctgagctccc

SEQ ID NO: 1007723 - DNA, 18 bp, Homo sapiens
cctgggtactgaaagcct

SEQ ID NO: 1007724 - DNA, 18 bp, Homo sapiens
cctgggtatcccctgcct

SEQ ID NO: 1007725 - DNA, 19 bp, Homo sapiens
cctgggtatcccctgcctc

SEQ ID NO: 1007726 - DNA, 20 bp, Homo sapiens
cctgggtcctgttccctacc

SEQ ID NO: 1007727 - DNA, 21 bp, Homo sapiens
cctgggtctggggacaggccc

SEQ ID NO: 1007728 - DNA, 15 bp, Homo sapiens
cctgggtctgtgtct

SEQ ID NO: 1007729 - DNA, 21 bp, Homo sapiens
cctgggtctgtgtctcttttc

SEQ ID NO: 1007730 - DNA, 18 bp, Homo sapiens
cctgggtgacagagcgag

SEQ ID NO: 1007731 - DNA, 13 bp, Homo sapiens
cctgggtgacatt

SEQ ID NO: 1007732 - DNA, 14 bp, Homo sapiens
cctgggtgacattt

SEQ ID NO: 1007733 - DNA, 16 bp, Homo sapiens
cctgggtgacttcagg

SEQ ID NO: 1007734 - DNA, 19 bp, Homo sapiens
cctgggtgacttcaggtgg

SEQ ID NO: 1007735 - DNA, 20 bp, Homo sapiens
cctgggtgagaatcctgcct

SEQ ID NO: 1007736 - DNA, 22 bp, Homo sapiens
cctgggtgagaatcctgcctct

SEQ ID NO: 1007737 - DNA, 18 bp, Homo sapiens
cctgggtgccattcccag

SEQ ID NO: 1007738 - DNA, 19 bp, Homo sapiens
cctgggtgccctggctcct

SEQ ID NO: 1007739 - DNA, 16 bp, Homo sapiens
cctgggtgggctctgt

SEQ ID NO: 1007740 - DNA, 22 bp, Homo sapiens
cctgggtggggctgctcctcca

SEQ ID NO: 1007741 - DNA, 23 bp, Homo sapiens
cctgggtggggctgctcctccag

SEQ ID NO: 1007742 - DNA, 13 bp, Homo sapiens
cctgggtgggtgg

SEQ ID NO: 1007743 - DNA, 20 bp, Homo sapiens
cctgggtgggtggtggggag

SEQ ID NO: 1007744 - DNA, 22 bp, Homo sapiens
cctgggtgggtggtggggaggg

SEQ ID NO: 1007745 - DNA, 16 bp, Homo sapiens
cctgggttaagtatta

SEQ ID NO: 1007746 - DNA, 23 bp, Homo sapiens
cctgggttcagaaatgctgcctg

SEQ ID NO: 1007747 - DNA, 13 bp, Homo sapiens
cctgggttccctt

SEQ ID NO: 1007748 - DNA, 13 bp, Homo sapiens
cctgggttggagg

SEQ ID NO: 1007749 - DNA, 21 bp, Homo sapiens
cctgggttttgtattctctga

SEQ ID NO: 1007750 - DNA, 22 bp, Homo sapiens
cctggtaaccaaatattaaaga

SEQ ID NO: 1007751 - DNA, 22 bp, Homo sapiens
cctggtaacgtggctccacctt

SEQ ID NO: 1007752 - DNA, 18 bp, Homo sapiens
cctggtaagcagaggctt

SEQ ID NO: 1007753 - DNA, 14 bp, Homo sapiens
cctggtacagcagg

SEQ ID NO: 1007754 - DNA, 15 bp, Homo sapiens
cctggtacagcaggg

SEQ ID NO: 1007755 - DNA, 16 bp, Homo sapiens
cctggtacagcagggt

SEQ ID NO: 1007756 - DNA, 19 bp, Homo sapiens
cctggtacccagccatctg

SEQ ID NO: 1007757 - DNA, 15 bp, Homo sapiens
cctggtactcaagcc

SEQ ID NO: 1007758 - DNA, 15 bp, Homo sapiens
gcatattctattgta

SEQ ID NO: 1007759 - DNA, 19 bp, Homo sapiens
gcatattgctttttctaat

SEQ ID NO: 1007760 - DNA, 13 bp, Homo sapiens
gcatatttatatt

SEQ ID NO: 1007761 - DNA, 13 bp, Homo sapiens
gcatatttctgta

SEQ ID NO: 1007762 - DNA, 15 bp, Homo sapiens
gcatatttctgtata

SEQ ID NO: 1007763 - DNA, 18 bp, Homo sapiens
gcatatttgtatagttgc

SEQ ID NO: 1007764 - DNA, 20 bp, Homo sapiens
gcatatttgttactttactt

SEQ ID NO: 1007765 - DNA, 20 bp, Homo sapiens
gcatattttcttacttttat

SEQ ID NO: 1007766 - DNA, 14 bp, Homo sapiens
gcatattttgctgg

SEQ ID NO: 1007767 - DNA, 15 bp, Homo sapiens
gcatattttgctggt

SEQ ID NO: 1007768 - DNA, 18 bp, Homo sapiens
gcatatttttctaaagaa

SEQ ID NO: 1007769 - DNA, 24 bp, Homo sapiens
gcatcaaccaggaagagttctatc

SEQ ID NO: 1007770 - DNA, 13 bp, Homo sapiens
gcatcaagaatta

SEQ ID NO: 1007771 - DNA, 19 bp, Homo sapiens
gcatcacactcaaggacag

SEQ ID NO: 1007772 - DNA, 14 bp, Homo sapiens
gcatcacagggcag

SEQ ID NO: 1007773 - DNA, 22 bp, Homo sapiens
gcatcacagggcagagccggga

SEQ ID NO: 1007774 - DNA, 16 bp, Homo sapiens
gcatcacctcaccaag

SEQ ID NO: 1007775 - DNA, 17 bp, Homo sapiens
gcatcacctcaggccag

SEQ ID NO: 1007776 - DNA, 20 bp, Homo sapiens
gcatcactgatcattagaga

SEQ ID NO: 1007777 - DNA, 17 bp, Homo sapiens
gcatcactgccttggcc

SEQ ID NO: 1007778 - DNA, 17 bp, Homo sapiens
gcatcactgggtgttga

SEQ ID NO: 1007779 - DNA, 11 bp, Homo sapiens
gcatcagcctg

SEQ ID NO: 1007780 - DNA, 14 bp, Homo sapiens
gcatcaggcactgg

SEQ ID NO: 1007781 - DNA, 19 bp, Homo sapiens
gcatcagggcctttctcct

SEQ ID NO: 1007782 - DNA, 24 bp, Homo sapiens
gcatcagggggaagaagcagagag

SEQ ID NO: 1007783 - DNA, 17 bp, Homo sapiens
gcatcaggtctgggcaa

SEQ ID NO: 1007784 - DNA, 18 bp, Homo sapiens
gcatcaggtctgggcaag

SEQ ID NO: 1007785 - DNA, 16 bp, Homo sapiens
gcatccacccagtgct

SEQ ID NO: 1007786 - DNA, 17 bp, Homo sapiens
gcatccacccagtgctg

SEQ ID NO: 1007787 - DNA, 23 bp, Homo sapiens
gcatccacccagtgctgccatgc

SEQ ID NO: 1007788 - DNA, 11 bp, Homo sapiens
gcatccagcct

SEQ ID NO: 1007789 - DNA, 12 bp, Homo sapiens
gcatccagcctg

SEQ ID NO: 1007790 - DNA, 17 bp, Homo sapiens
gcatccagcctgtgtgt

SEQ ID NO: 1007791 - DNA, 13 bp, Homo sapiens
gcatgccccttgg

SEQ ID NO: 1007792 - DNA, 14 bp, Homo sapiens
gcatgcctggacaa

SEQ ID NO: 1007793 - DNA, 19 bp, Homo sapiens
gcatgcgaaatgttctcat

SEQ ID NO: 1007794 - DNA, 22 bp, Homo sapiens
gcatgcgaaatgttctcatgaa

SEQ ID NO: 1007795 - DNA, 21 bp, Homo sapiens
gcatgcgcacaaggctgacca

SEQ ID NO: 1007796 - DNA, 13 bp, Homo sapiens
gcatgcgcaggct

SEQ ID NO: 1007797 - DNA, 13 bp, Homo sapiens
gcatgctctctgc

SEQ ID NO: 1007798 - DNA, 14 bp, Homo sapiens
gcatgctctctgca

SEQ ID NO: 1007799 - DNA, 23 bp, Homo sapiens
gcatgctctctgcagccagccca

SEQ ID NO: 1007800 - DNA, 12 bp, Homo sapiens
gcatgctctgga

SEQ ID NO: 1007801 - DNA, 15 bp, Homo sapiens
gcatgctctggaagc

SEQ ID NO: 1007802 - DNA, 22 bp, Homo sapiens
gcatgctgaatgccccctgctt

SEQ ID NO: 1007803 - DNA, 16 bp, Homo sapiens
gcatgctgataatcat

SEQ ID NO: 1007804 - DNA, 13 bp, Homo sapiens
gcatgctgcccag

SEQ ID NO: 1007805 - DNA, 15 bp, Homo sapiens
gcatgctgcccagcc

SEQ ID NO: 1007806 - DNA, 18 bp, Homo sapiens
gcatgctgtagctgcagc

SEQ ID NO: 1007807 - DNA, 20 bp, Homo sapiens
gcatgctgtagctgcagcct

SEQ ID NO: 1007808 - DNA, 18 bp, Homo sapiens
gcatgcttaaattttaac

SEQ ID NO: 1007809 - DNA, 14 bp, Homo sapiens
gcatgcttcctttc

SEQ ID NO: 1007810 - DNA, 15 bp, Homo sapiens
gcatgcttcctttct

SEQ ID NO: 1007811 - DNA, 19 bp, Homo sapiens
gcatgcttcctttctctcc

SEQ ID NO: 1007812 - DNA, 11 bp, Homo sapiens
gcatggaaatt

SEQ ID NO: 1007813 - DNA, 17 bp, Homo sapiens
gcatggaaatttaaagc

SEQ ID NO: 1007814 - DNA, 14 bp, Homo sapiens
gcatggaaggggct

SEQ ID NO: 1007815 - DNA, 18 bp, Homo sapiens
gcatggaaggggcttctg

SEQ ID NO: 1007816 - DNA, 21 bp, Homo sapiens
gcatggaaggggcttctggac

SEQ ID NO: 1007817 - DNA, 23 bp, Homo sapiens
gcatggacaccccttatccagga

SEQ ID NO: 1007818 - DNA, 15 bp, Homo sapiens
gcatggacagggcca

SEQ ID NO: 1007819 - DNA, 17 bp, Homo sapiens
gcatggacagggccagg

SEQ ID NO: 1007820 - DNA, 16 bp, Homo sapiens
gcatggacctaacatt

SEQ ID NO: 1007821 - DNA, 18 bp, Homo sapiens
gcatggacctaacattcg

SEQ ID NO: 1007822 - DNA, 23 bp, Homo sapiens
gcatggagaagggttctgccctg

SEQ ID NO: 1007823 - DNA, 19 bp, Homo sapiens
gcatggagagcctcttagt

SEQ ID NO: 1007824 - DNA, 21 bp, Homo sapiens
gcatggagagcctcttagtga

SEQ ID NO: 1007825 - DNA, 15 bp, Homo sapiens
gcatggagcctggaa

SEQ ID NO: 1007826 - DNA, 15 bp, Homo sapiens
gcatggaggaggagg

SEQ ID NO: 1007827 - DNA, 18 bp, Homo sapiens
gcatggagtgtgtattgt

SEQ ID NO: 1007828 - DNA, 19 bp, Homo sapiens
gcatggagtgtgtattgtt

SEQ ID NO: 1007829 - DNA, 24 bp, Homo sapiens
gcatggagtgtgtattgttcccag

SEQ ID NO: 1007830 - DNA, 21 bp, Homo sapiens
gcatggatgttttagccattg

SEQ ID NO: 1007831 - DNA, 18 bp, Homo sapiens
gcatggattttggataaa

SEQ ID NO: 1007832 - DNA, 21 bp, Homo sapiens
gcatggattttggataaatca

SEQ ID NO: 1007833 - DNA, 17 bp, Homo sapiens
gcatggcaaatcagggg

SEQ ID NO: 1007834 - DNA, 14 bp, Homo sapiens
gcatggcaattctg

SEQ ID NO: 1007835 - DNA, 16 bp, Homo sapiens
gcatggcaggctgggt

SEQ ID NO: 1007836 - DNA, 18 bp, Homo sapiens
gcatggcagggcctcatc

SEQ ID NO: 1007837 - DNA, 16 bp, Homo sapiens
gcatggccctggggtc

SEQ ID NO: 1007838 - DNA, 14 bp, Homo sapiens
gcatggctccagtc

SEQ ID NO: 1007839 - DNA, 15 bp, Homo sapiens
gcatggctccagtct

SEQ ID NO: 1007840 - DNA, 19 bp, Homo sapiens
gcatggctcctgtctggct

SEQ ID NO: 1007841 - DNA, 21 bp, Homo sapiens
gcatgggcattgcagccttgc

SEQ ID NO: 1007842 - DNA, 13 bp, Homo sapiens
gcatgggcctctc

SEQ ID NO: 1007843 - DNA, 16 bp, Homo sapiens
gcatgggcctctctgg

SEQ ID NO: 1007844 - DNA, 15 bp, Homo sapiens
gcatgggcgcaggcc

SEQ ID NO: 1007845 - DNA, 20 bp, Homo sapiens
gcatgggcgcaggcccagtg

SEQ ID NO: 1007846 - DNA, 22 bp, Homo sapiens
gcatgggcgcaggcccagtgac

SEQ ID NO: 1007847 - DNA, 13 bp, Homo sapiens
gcatgggctcgcc

SEQ ID NO: 1007848 - DNA, 22 bp, Homo sapiens
gcatgggctcgccgtgtctcag

SEQ ID NO: 1007849 - DNA, 22 bp, Homo sapiens
gcatggggataaaggagaaggc

SEQ ID NO: 1007850 - DNA, 15 bp, Homo sapiens
gcatggggcatgtcc

SEQ ID NO: 1007851 - DNA, 20 bp, Homo sapiens
gcatggggcatgtcctttcc

SEQ ID NO: 1007852 - DNA, 22 bp, Homo sapiens
gcatgggggaccctgtgcatct

SEQ ID NO: 1007853 - DNA, 14 bp, Homo sapiens
gcatggggtcagcc

SEQ ID NO: 1007854 - DNA, 19 bp, Homo sapiens
gcatggggtcagccccaag

SEQ ID NO: 1007855 - DNA, 21 bp, Homo sapiens
gcatggggtcagccccaaggg

SEQ ID NO: 1007856 - DNA, 17 bp, Homo sapiens
gcatgggtccagggcct

SEQ ID NO: 1007857 - DNA, 21 bp, Homo sapiens
gcatgggtccttgatgccaga

SEQ ID NO: 1007858 - DNA, 13 bp, Homo sapiens
gcatggtggcatg

SEQ ID NO: 1007859 - DNA, 15 bp, Homo sapiens
gcatgtaggagaatc

SEQ ID NO: 1007860 - DNA, 22 bp, Homo sapiens
gcatgtagtaacactaatatat

SEQ ID NO: 1007861 - DNA, 24 bp, Homo sapiens
gcatgtagtaacactaatatattt

SEQ ID NO: 1007862 - DNA, 15 bp, Homo sapiens
gcatgtatgaatgta

SEQ ID NO: 1007863 - DNA, 15 bp, Homo sapiens
gcatgtatgtctgca

SEQ ID NO: 1007864 - DNA, 23 bp, Homo sapiens
gcatgtatgtctgcaggtgtctg

SEQ ID NO: 1007865 - DNA, 18 bp, Homo sapiens
gcatgtattggcctggag

SEQ ID NO: 1007866 - DNA, 13 bp, Homo sapiens
gcatgtcccaccc

SEQ ID NO: 1007867 - DNA, 17 bp, Homo sapiens
gcatgtcctcatccttt

SEQ ID NO: 1007868 - DNA, 15 bp, Homo sapiens
gcatgtcgcacaatg

SEQ ID NO: 1007869 - DNA, 16 bp, Homo sapiens
gcatgtcgcacaatgt

SEQ ID NO: 1007870 - DNA, 22 bp, Homo sapiens
gcatgtctctgcttccatggct

SEQ ID NO: 1007871 - DNA, 11 bp, Homo sapiens
gcatgtcttaa

SEQ ID NO: 1007872 - DNA, 16 bp, Homo sapiens
gcatgtcttaaatgct

SEQ ID NO: 1007873 - DNA, 17 bp, Homo sapiens
gcatgtcttaaatgctc

SEQ ID NO: 1007874 - DNA, 14 bp, Homo sapiens
gcatgtcttttaaa

SEQ ID NO: 1007875 - DNA, 17 bp, Homo sapiens
gcatgtcttttaaaatg

SEQ ID NO: 1007876 - DNA, 12 bp, Homo sapiens
gcatgtgaagaa

SEQ ID NO: 1007877 - DNA, 16 bp, Homo sapiens
gcatgtgaagcatgct

SEQ ID NO: 1007878 - DNA, 22 bp, Homo sapiens
gcatgtgaagcatgctttgctg

SEQ ID NO: 1007879 - DNA, 23 bp, Homo sapiens
gcatgtgactcctgaagggaagg

SEQ ID NO: 1007880 - DNA, 23 bp, Homo sapiens
gcatgtgacttctcccctgccct

SEQ ID NO: 1007881 - DNA, 14 bp, Homo sapiens
gcatgtgctgtctc

SEQ ID NO: 1007882 - DNA, 11 bp, Homo sapiens
gcatgtggaga

SEQ ID NO: 1007883 - DNA, 16 bp, Homo sapiens
gcatgtggcctgtggc

SEQ ID NO: 1007884 - DNA, 17 bp, Homo sapiens
gcatgtggcctgtggcc

SEQ ID NO: 1007885 - DNA, 20 bp, Homo sapiens
gcatgtggcctttatctcaa

SEQ ID NO: 1007886 - DNA, 17 bp, Homo sapiens
gcatgtggcttttttaa

SEQ ID NO: 1007887 - DNA, 12 bp, Homo sapiens
cctgtcatgccc

SEQ ID NO: 1007888 - DNA, 14 bp, Homo sapiens
cctgtcattcctct

SEQ ID NO: 1007889 - DNA, 22 bp, Homo sapiens
cctgtccaaaagcgccctcact

SEQ ID NO: 1007890 - DNA, 12 bp, Homo sapiens
cctgtccaacct

SEQ ID NO: 1007891 - DNA, 18 bp, Homo sapiens
cctgtccacacccagctc

SEQ ID NO: 1007892 - DNA, 22 bp, Homo sapiens
cctgtccacacccagctcagca

SEQ ID NO: 1007893 - DNA, 13 bp, Homo sapiens
cctgtccaccctg

SEQ ID NO: 1007894 - DNA, 14 bp, Homo sapiens
cctgtccaccctgc

SEQ ID NO: 1007895 - DNA, 16 bp, Homo sapiens
cctgtccacctgtgct

SEQ ID NO: 1007896 - DNA, 23 bp, Homo sapiens
cctgtccactctcggggcccttg

SEQ ID NO: 1007897 - DNA, 12 bp, Homo sapiens
cctgtccagccc

SEQ ID NO: 1007898 - DNA, 22 bp, Homo sapiens
cctgtccagcctgggcagccag

SEQ ID NO: 1007899 - DNA, 20 bp, Homo sapiens
cctgtcccaccaactctgca

SEQ ID NO: 1007900 - DNA, 22 bp, Homo sapiens
cctgtcccaccaactctgcact

SEQ ID NO: 1007901 - DNA, 13 bp, Homo sapiens
cctgtcccacccc

SEQ ID NO: 1007902 - DNA, 19 bp, Homo sapiens
cctgtcccacctggctccc

SEQ ID NO: 1007903 - DNA, 16 bp, Homo sapiens
cctgtcccaggccggc

SEQ ID NO: 1007904 - DNA, 16 bp, Homo sapiens
cctgtcccatggacac

SEQ ID NO: 1007905 - DNA, 23 bp, Homo sapiens
cctgtcccatggacactccagtg

SEQ ID NO: 1007906 - DNA, 16 bp, Homo sapiens
cctgtcccattctaga

SEQ ID NO: 1007907 - DNA, 19 bp, Homo sapiens
cctgtccccaccctccact

SEQ ID NO: 1007908 - DNA, 22 bp, Homo sapiens
cctgtccccagaccaaccctgg

SEQ ID NO: 1007909 - DNA, 16 bp, Homo sapiens
cctgtccccaggccca

SEQ ID NO: 1007910 - DNA, 13 bp, Homo sapiens
cctgtccccagtc

SEQ ID NO: 1007911 - DNA, 15 bp, Homo sapiens
cctgtccccagtccc

SEQ ID NO: 1007912 - DNA, 18 bp, Homo sapiens
cctgtccccagtccccag

SEQ ID NO: 1007913 - DNA, 16 bp, Homo sapiens
cctgtggcagaaaaga

SEQ ID NO: 1007914 - DNA, 18 bp, Homo sapiens
cctgtggcatctttgcct

SEQ ID NO: 1007915 - DNA, 23 bp, Homo sapiens
cctgtggcatctttgccttgggc

SEQ ID NO: 1007916 - DNA, 16 bp, Homo sapiens
cctgtggccaactgca

SEQ ID NO: 1007917 - DNA, 17 bp, Homo sapiens
cctgtggccaactgcaa

SEQ ID NO: 1007918 - DNA, 12 bp, Homo sapiens
cctgtggccagg

SEQ ID NO: 1007919 - DNA, 16 bp, Homo sapiens
cctgtggccccaccct

SEQ ID NO: 1007920 - DNA, 18 bp, Homo sapiens
cctgtggccccaccctgg

SEQ ID NO: 1007921 - DNA, 22 bp, Homo sapiens
cctgtggccccaccctgggccc

SEQ ID NO: 1007922 - DNA, 15 bp, Homo sapiens
cctgtggccgccacc

SEQ ID NO: 1007923 - DNA, 15 bp, Homo sapiens
cctgtggcctgtgtc

SEQ ID NO: 1007924 - DNA, 21 bp, Homo sapiens
cctgtggcctgtgtcccatga

SEQ ID NO: 1007925 - DNA, 15 bp, Homo sapiens
cctgtggccttgccc

SEQ ID NO: 1007926 - DNA, 17 bp, Homo sapiens
cctgtggccttgcccgc

SEQ ID NO: 1007927 - DNA, 19 bp, Homo sapiens
cctgtggcgctgcagcagg

SEQ ID NO: 1007928 - DNA, 15 bp, Homo sapiens
cctgtggcggtgcct

SEQ ID NO: 1007929 - DNA, 16 bp, Homo sapiens
cctgtggcggtgcctg

SEQ ID NO: 1007930 - DNA, 18 bp, Homo sapiens
cctgtggctcaggggagc

SEQ ID NO: 1007931 - DNA, 19 bp, Homo sapiens
cctgtggcttggagtggcc

SEQ ID NO: 1007932 - DNA, 17 bp, Homo sapiens
cctgtgggaccgcctgg

SEQ ID NO: 1007933 - DNA, 19 bp, Homo sapiens
cctgtgggaccgcctggcc

SEQ ID NO: 1007934 - DNA, 21 bp, Homo sapiens
cctgtgggcctcacctgcccc

SEQ ID NO: 1007935 - DNA, 22 bp, Homo sapiens
cctgtgggcctcacctgcccct

SEQ ID NO: 1007936 - DNA, 20 bp, Homo sapiens
cctgtggggatctcaggggc

SEQ ID NO: 1007937 - DNA, 23 bp, Homo sapiens
cctgtggggcaggagtgccagga

SEQ ID NO: 1007938 - DNA, 21 bp, Homo sapiens
cctgtggggcctgatggtgct

SEQ ID NO: 1007939 - DNA, 17 bp, Homo sapiens
cctgtgggtgtagccag

SEQ ID NO: 1007940 - DNA, 17 bp, Homo sapiens
cctgtgggtgtctccct

SEQ ID NO: 1007941 - DNA, 19 bp, Homo sapiens
cctgtgggtgtctccctcg

SEQ ID NO: 1007942 - DNA, 22 bp, Homo sapiens
cctgtgggtgttctttcctgcc

SEQ ID NO: 1007943 - DNA, 23 bp, Homo sapiens
cctgtgggtgttctttcctgccc

SEQ ID NO: 1007944 - DNA, 19 bp, Homo sapiens
cctgtggtgaagtgtggct

SEQ ID NO: 1007945 - DNA, 21 bp, Homo sapiens
cctgtggtggctccccctctg

SEQ ID NO: 1007946 - DNA, 16 bp, Homo sapiens
cctgtggttacagtgc

SEQ ID NO: 1007947 - DNA, 21 bp, Homo sapiens
cctgtgtaatcatttcttggg

SEQ ID NO: 1007948 - DNA, 18 bp, Homo sapiens
cctgtgtattcaccacca

SEQ ID NO: 1007949 - DNA, 19 bp, Homo sapiens
cctgtgtccatctgaccgt

SEQ ID NO: 1007950 - DNA, 13 bp, Homo sapiens
cctgtgtccatgc

SEQ ID NO: 1007951 - DNA, 14 bp, Homo sapiens
cctgtgtcccatga

SEQ ID NO: 1007952 - DNA, 23 bp, Homo sapiens
cctgtgtcccatgacccacccct

SEQ ID NO: 1007953 - DNA, 18 bp, Homo sapiens
cctgtgtcccctgacctg

SEQ ID NO: 1007954 - DNA, 23 bp, Homo sapiens
cctgtgtcccctgacctgtccag

SEQ ID NO: 1007955 - DNA, 14 bp, Homo sapiens
cctgtgtctatgta

SEQ ID NO: 1007956 - DNA, 22 bp, Homo sapiens
cctgtgtctgtcacaggctggg

SEQ ID NO: 1007957 - DNA, 14 bp, Homo sapiens
cctgtgtgattgac

SEQ ID NO: 1007958 - DNA, 19 bp, Homo sapiens
cctgtgtgattgacagctt

SEQ ID NO: 1007959 - DNA, 15 bp, Homo sapiens
cctgtgtgcttggtc

SEQ ID NO: 1007960 - DNA, 23 bp, Homo sapiens
cctgtgtggatgctgagctgtga

SEQ ID NO: 1007961 - DNA, 20 bp, Homo sapiens
cctgtgtgtactctgtccag

SEQ ID NO: 1007962 - DNA, 21 bp, Homo sapiens
cctgtgtgtgaaaggaagctc

SEQ ID NO: 1007963 - DNA, 16 bp, Homo sapiens
cctgtgtgtgggtggg

SEQ ID NO: 1007964 - DNA, 20 bp, Homo sapiens
cctgtgtgtgggtggggtta

SEQ ID NO: 1007965 - DNA, 17 bp, Homo sapiens
cctgtgtgtgtcccctc

SEQ ID NO: 1007966 - DNA, 22 bp, Homo sapiens
cctgtgtgtgttgccctggcat

SEQ ID NO: 1007967 - DNA, 22 bp, Homo sapiens
cctgtgttagtgtctgtccatc

SEQ ID NO: 1007968 - DNA, 14 bp, Homo sapiens
cctgtgttctgggc

SEQ ID NO: 1007969 - DNA, 19 bp, Homo sapiens
cctgtgttctgggctgggg

SEQ ID NO: 1007970 - DNA, 22 bp, Homo sapiens
cctgtgttctgggctggggcca

SEQ ID NO: 1007971 - DNA, 16 bp, Homo sapiens
cctgtgttgtctctag

SEQ ID NO: 1007972 - DNA, 13 bp, Homo sapiens
cctgtgtttctag

SEQ ID NO: 1007973 - DNA, 16 bp, Homo sapiens
cctgtgtttgtcctgg

SEQ ID NO: 1007974 - DNA, 17 bp, Homo sapiens
cctgtgtttgtcctggg

SEQ ID NO: 1007975 - DNA, 19 bp, Homo sapiens
cctgtgtttgtcctgggtt

SEQ ID NO: 1007976 - DNA, 20 bp, Homo sapiens
cctgtgtttgtcctgggttc

SEQ ID NO: 1007977 - DNA, 12 bp, Homo sapiens
cctgttaaacag

SEQ ID NO: 1007978 - DNA, 22 bp, Homo sapiens
cctgttaatttataatgtattt

SEQ ID NO: 1007979 - DNA, 18 bp, Homo sapiens
cctgttacctactttgac

SEQ ID NO: 1007980 - DNA, 21 bp, Homo sapiens
cctgttacctgtcttgctcct

SEQ ID NO: 1007981 - DNA, 14 bp, Homo sapiens
cctgttacttacct

SEQ ID NO: 1007982 - DNA, 18 bp, Homo sapiens
cctgttacttgcttcagt

SEQ ID NO: 1007983 - DNA, 15 bp, Homo sapiens
cctgttagcagacag

SEQ ID NO: 1007984 - DNA, 15 bp, Homo sapiens
cctgttagccaggtg

SEQ ID NO: 1007985 - DNA, 23 bp, Homo sapiens
cctgttagttttgtaaaaactga

SEQ ID NO: 1007986 - DNA, 15 bp, Homo sapiens
cctgttatttatcaa

SEQ ID NO: 1007987 - DNA, 15 bp, Homo sapiens
cctgttattttatgt

SEQ ID NO: 1007988 - DNA, 18 bp, Homo sapiens
cctgttattttatgtctg

SEQ ID NO: 1007989 - DNA, 22 bp, Homo sapiens
cctgttcatgccgacgcttgca

SEQ ID NO: 1007990 - DNA, 12 bp, Homo sapiens
cctgttcccatt

SEQ ID NO: 1007991 - DNA, 12 bp, Homo sapiens
cctgttcccctc

SEQ ID NO: 1007992 - DNA, 22 bp, Homo sapiens
cctgttcccctcactggatgaa

SEQ ID NO: 1007993 - DNA, 11 bp, Homo sapiens
cctgttccctg

SEQ ID NO: 1007994 - DNA, 12 bp, Homo sapiens
cctgttccctgg

SEQ ID NO: 1007995 - DNA, 14 bp, Homo sapiens
cctgttcctggagg

SEQ ID NO: 1007996 - DNA, 18 bp, Homo sapiens
cctgttcggttccagaca

SEQ ID NO: 1007997 - DNA, 13 bp, Homo sapiens
cctgttctccctt

SEQ ID NO: 1007998 - DNA, 17 bp, Homo sapiens
cctgttctccctttctc

SEQ ID NO: 1007999 - DNA, 21 bp, Homo sapiens
cctgttctccctttctctctc

SEQ ID NO: 1008000 - DNA, 20 bp, Homo sapiens
cctgttctgaaatgttctta

SEQ ID NO: 1008001 - DNA, 14 bp, Homo sapiens
cctgttctgcccac

SEQ ID NO: 1008002 - DNA, 12 bp, Homo sapiens
cctgttctgctt

SEQ ID NO: 1008003 - DNA, 19 bp, Homo sapiens
cctgttctggtatttcccc

SEQ ID NO: 1008004 - DNA, 22 bp, Homo sapiens
cctgttctggtatttcccctgt

SEQ ID NO: 1008005 - DNA, 23 bp, Homo sapiens
cctgttctggtatttcccctgtc

SEQ ID NO: 1008006 - DNA, 16 bp, Homo sapiens
cctgttcttagagtgt

SEQ ID NO: 1008007 - DNA, 14 bp, Homo sapiens
cctgttcttcctcc

SEQ ID NO: 1008008 - DNA, 17 bp, Homo sapiens
cctgttgaagacttcct

SEQ ID NO: 1008009 - DNA, 21 bp, Homo sapiens
cctgttgaagattatttcatt

SEQ ID NO: 1008010 - DNA, 15 bp, Homo sapiens
cctgttgccagcaga

SEQ ID NO: 1008011 - DNA, 19 bp, Homo sapiens
cctgttgctatagagccta

SEQ ID NO: 1008012 - DNA, 19 bp, Homo sapiens
cctgttggacccgctctgg

SEQ ID NO: 1008013 - DNA, 18 bp, Homo sapiens
cctgttggcaggcccact

SEQ ID NO: 1008014 - DNA, 16 bp, Homo sapiens
cctgttggcctgtggg

SEQ ID NO: 1008015 - DNA, 20 bp, Homo sapiens
cctgttggcctgtgggcctc

SEQ ID NO: 1008016 - DNA, 22 bp, Homo sapiens
cctgttggctacacagacccct

SEQ ID NO: 1008017 - DNA, 14 bp, Homo sapiens
gcatttcctgctga

SEQ ID NO: 1008018 - DNA, 22 bp, Homo sapiens
gcatttctcatgcttcttctca

SEQ ID NO: 1008019 - DNA, 13 bp, Homo sapiens
gcatttctcttct

SEQ ID NO: 1008020 - DNA, 21 bp, Homo sapiens
gcatttctgtggatacagtgc

SEQ ID NO: 1008021 - DNA, 21 bp, Homo sapiens
gcatttgaggggccaggggca

SEQ ID NO: 1008022 - DNA, 20 bp, Homo sapiens
gcatttgaggtctgttcttt

SEQ ID NO: 1008023 - DNA, 17 bp, Homo sapiens
gcatttgatctgttgca

SEQ ID NO: 1008024 - DNA, 23 bp, Homo sapiens
gcatttgcacctctgttcatttc

SEQ ID NO: 1008025 - DNA, 23 bp, Homo sapiens
gcatttgctctttcatctctgct

SEQ ID NO: 1008026 - DNA, 14 bp, Homo sapiens
gcatttgctgaata

SEQ ID NO: 1008027 - DNA, 17 bp, Homo sapiens
gcatttgctgaatacag

SEQ ID NO: 1008028 - DNA, 12 bp, Homo sapiens
gcatttgctgat

SEQ ID NO: 1008029 - DNA, 19 bp, Homo sapiens
gcatttggaaccaaagtct

SEQ ID NO: 1008030 - DNA, 22 bp, Homo sapiens
gcatttggaaccaaagtctaaa

SEQ ID NO: 1008031 - DNA, 23 bp, Homo sapiens
gcatttggattggggtccctcta

SEQ ID NO: 1008032 - DNA, 14 bp, Homo sapiens
gcatttggcagcac

SEQ ID NO: 1008033 - DNA, 20 bp, Homo sapiens
gcatttggcaggaagatgta

SEQ ID NO: 1008034 - DNA, 14 bp, Homo sapiens
gccaaggaggcctg

SEQ ID NO: 1008035 - DNA, 18 bp, Homo sapiens
gccaaggaggcctgggga

SEQ ID NO: 1008036 - DNA, 21 bp, Homo sapiens
gccaaggagggtgagtgcaag

SEQ ID NO: 1008037 - DNA, 15 bp, Homo sapiens
gccaaggcagaggcc

SEQ ID NO: 1008038 - DNA, 21 bp, Homo sapiens
gccaaggcagaggcctgggct

SEQ ID NO: 1008039 - DNA, 23 bp, Homo sapiens
gccaaggcagctcttctggagtt

SEQ ID NO: 1008040 - DNA, 20 bp, Homo sapiens
gccaaggccagagtggcctg

SEQ ID NO: 1008041 - DNA, 17 bp, Homo sapiens
gccaaggccgccagcgt

SEQ ID NO: 1008042 - DNA, 15 bp, Homo sapiens
gccaaggccttctcc

SEQ ID NO: 1008043 - DNA, 19 bp, Homo sapiens
gccaaggctctcccctctc

SEQ ID NO: 1008044 - DNA, 18 bp, Homo sapiens
gccaagggaacctgtgtc

SEQ ID NO: 1008045 - DNA, 19 bp, Homo sapiens
gccaagggaacctgtgtcc

SEQ ID NO: 1008046 - DNA, 14 bp, Homo sapiens
gccaagggagggaa

SEQ ID NO: 1008047 - DNA, 21 bp, Homo sapiens
gccaagggccccaggggcagc

SEQ ID NO: 1008048 - DNA, 21 bp, Homo sapiens
gccaagggccgactaagagaa

SEQ ID NO: 1008049 - DNA, 13 bp, Homo sapiens
gccaaggggctgc

SEQ ID NO: 1008050 - DNA, 20 bp, Homo sapiens
gccaaggggctgcgctagca

SEQ ID NO: 1008051 - DNA, 21 bp, Homo sapiens
gccaaggggctgcgctagcag

SEQ ID NO: 1008052 - DNA, 20 bp, Homo sapiens
gccaagggtcctcacccctc

SEQ ID NO: 1008053 - DNA, 22 bp, Homo sapiens
gccaaggtgcatatagaaaaca

SEQ ID NO: 1008054 - DNA, 17 bp, Homo sapiens
gccaaggtggagggaag

SEQ ID NO: 1008055 - DNA, 14 bp, Homo sapiens
gccaaggtgggagg

SEQ ID NO: 1008056 - DNA, 15 bp, Homo sapiens
gccaaggtgggagga

SEQ ID NO: 1008057 - DNA, 15 bp, Homo sapiens
gccaaggtgggcgga

SEQ ID NO: 1008058 - DNA, 19 bp, Homo sapiens
gccaaggtgggctgagccc

SEQ ID NO: 1008059 - DNA, 22 bp, Homo sapiens
gccaaggtgggctgagccctgg

SEQ ID NO: 1008060 - DNA, 14 bp, Homo sapiens
gccaaggtgtccag

SEQ ID NO: 1008061 - DNA, 20 bp, Homo sapiens
gccaagtaaacagggtacct

SEQ ID NO: 1008062 - DNA, 19 bp, Homo sapiens
gccaagtgcgtgccgtgtg

SEQ ID NO: 1008063 - DNA, 13 bp, Homo sapiens
gccaagtgtcttt

SEQ ID NO: 1008064 - DNA, 14 bp, Homo sapiens
gccaagttatattg

SEQ ID NO: 1008065 - DNA, 15 bp, Homo sapiens
gccaagtttatatac

SEQ ID NO: 1008066 - DNA, 20 bp, Homo sapiens
gccaagtttatatacaatta

SEQ ID NO: 1008067 - DNA, 10 bp, Homo sapiens
gccaataaaa

SEQ ID NO: 1008068 - DNA, 13 bp, Homo sapiens
gccaataaaaagt

SEQ ID NO: 1008069 - DNA, 14 bp, Homo sapiens
gccaataaaaagtt

SEQ ID NO: 1008070 - DNA, 18 bp, Homo sapiens
gccaataaagtgatctgt

SEQ ID NO: 1008071 - DNA, 22 bp, Homo sapiens
gccaataataaaaaacaagaaa

SEQ ID NO: 1008072 - DNA, 16 bp, Homo sapiens
gccaataataaagaca

SEQ ID NO: 1008073 - DNA, 23 bp, Homo sapiens
gccaataccctactgtggggaga

SEQ ID NO: 1008074 - DNA, 16 bp, Homo sapiens
gccaatagtgtcatcc

SEQ ID NO: 1008075 - DNA, 13 bp, Homo sapiens
gccaatatgtatt

SEQ ID NO: 1008076 - DNA, 18 bp, Homo sapiens
gccaatctgcaatttcta

SEQ ID NO: 1008077 - DNA, 19 bp, Homo sapiens
gccaatgcacctaaagaaa

SEQ ID NO: 1008078 - DNA, 21 bp, Homo sapiens
gccaatgcacctaaagaaaaa

SEQ ID NO: 1008079 - DNA, 21 bp, Homo sapiens
gccaatgctacagtaataaat

SEQ ID NO: 1008080 - DNA, 16 bp, Homo sapiens
gccaatggagactgtc

SEQ ID NO: 1008081 - DNA, 22 bp, Homo sapiens
gccaatggaggggggtgctggc

SEQ ID NO: 1008082 - DNA, 19 bp, Homo sapiens
gccaatggtgcttccccca

SEQ ID NO: 1008083 - DNA, 16 bp, Homo sapiens
gccaatgtctcctccc

SEQ ID NO: 1008084 - DNA, 18 bp, Homo sapiens
gccaattcagacaggcaa

SEQ ID NO: 1008085 - DNA, 13 bp, Homo sapiens
gccaattcctata

SEQ ID NO: 1008086 - DNA, 19 bp, Homo sapiens
gccaattgaataggatcaa

SEQ ID NO: 1008087 - DNA, 17 bp, Homo sapiens
gccaatttcccggagcc

SEQ ID NO: 1008088 - DNA, 13 bp, Homo sapiens
gccaatttttgtt

SEQ ID NO: 1008089 - DNA, 13 bp, Homo sapiens
gccacaaaaacaa

SEQ ID NO: 1008090 - DNA, 20 bp, Homo sapiens
gccacaaatcaaagcaaggg

SEQ ID NO: 1008091 - DNA, 23 bp, Homo sapiens
gccacaaatcaaagcaagggctc

SEQ ID NO: 1008092 - DNA, 14 bp, Homo sapiens
gccacaactgctgt

SEQ ID NO: 1008093 - DNA, 22 bp, Homo sapiens
gccacaactgctgtggccccct

SEQ ID NO: 1008094 - DNA, 23 bp, Homo sapiens
gccacaactgctgtggccccctg

SEQ ID NO: 1008095 - DNA, 14 bp, Homo sapiens
gccacaagaaattt

SEQ ID NO: 1008096 - DNA, 14 bp, Homo sapiens
gccacaaggctggc

SEQ ID NO: 1008097 - DNA, 17 bp, Homo sapiens
gccacaaggctggccag

SEQ ID NO: 1008098 - DNA, 16 bp, Homo sapiens
gccacaagtcttccag

SEQ ID NO: 1008099 - DNA, 21 bp, Homo sapiens
gccacaatgaacatccctttt

SEQ ID NO: 1008100 - DNA, 18 bp, Homo sapiens
gccacacaaacgtttact

SEQ ID NO: 1008101 - DNA, 20 bp, Homo sapiens
gccacaccaatcagagagcc

SEQ ID NO: 1008102 - DNA, 20 bp, Homo sapiens
gccacaccacagcaagccgg

SEQ ID NO: 1008103 - DNA, 16 bp, Homo sapiens
gccacacccaggaagg

SEQ ID NO: 1008104 - DNA, 13 bp, Homo sapiens
gccacacctggcc

SEQ ID NO: 1008105 - DNA, 20 bp, Homo sapiens
gccacacgcaggcggccagg

SEQ ID NO: 1008106 - DNA, 21 bp, Homo sapiens
gccacacgcaggcggccaggg

SEQ ID NO: 1008107 - DNA, 22 bp, Homo sapiens
gccacacgcaggcggccagggc

SEQ ID NO: 1008108 - DNA, 18 bp, Homo sapiens
gccacactctccatcacc

SEQ ID NO: 1008109 - DNA, 22 bp, Homo sapiens
gccacactctgggctccagagt

SEQ ID NO: 1008110 - DNA, 16 bp, Homo sapiens
gccacactgggcctgg

SEQ ID NO: 1008111 - DNA, 22 bp, Homo sapiens
gccacacttcaggctcttctcc

SEQ ID NO: 1008112 - DNA, 23 bp, Homo sapiens
gccacacttcaggctcttctcct

SEQ ID NO: 1008113 - DNA, 19 bp, Homo sapiens
gccacagaagccaggagca

SEQ ID NO: 1008114 - DNA, 17 bp, Homo sapiens
gccacagcagcctctga

SEQ ID NO: 1008115 - DNA, 13 bp, Homo sapiens
gccacagccagag

SEQ ID NO: 1008116 - DNA, 23 bp, Homo sapiens
gccacagccagaggagggcagag

SEQ ID NO: 1008117 - DNA, 12 bp, Homo sapiens
gccacagcctgc

SEQ ID NO: 1008118 - DNA, 16 bp, Homo sapiens
gccacagcctgctggc

SEQ ID NO: 1008119 - DNA, 19 bp, Homo sapiens
gccacagcctgctggcagg

SEQ ID NO: 1008120 - DNA, 12 bp, Homo sapiens
gccacagctcaa

SEQ ID NO: 1008121 - DNA, 12 bp, Homo sapiens
gccacagctttt

SEQ ID NO: 1008122 - DNA, 15 bp, Homo sapiens
gccacagcttttgca

SEQ ID NO: 1008123 - DNA, 17 bp, Homo sapiens
gccacaggactgagccc

SEQ ID NO: 1008124 - DNA, 22 bp, Homo sapiens
gccacaggactgagccctctca

SEQ ID NO: 1008125 - DNA, 11 bp, Homo sapiens
gccacaggaga

SEQ ID NO: 1008126 - DNA, 16 bp, Homo sapiens
gccacaggcaggggtg

SEQ ID NO: 1008127 - DNA, 15 bp, Homo sapiens
gccacaggcagtcca

SEQ ID NO: 1008128 - DNA, 17 bp, Homo sapiens
gccacaggctagatccc

SEQ ID NO: 1008129 - DNA, 18 bp, Homo sapiens
gccacagtagtcttgatg

SEQ ID NO: 1008130 - DNA, 19 bp, Homo sapiens
gccacagtggggctgcagg

SEQ ID NO: 1008131 - DNA, 23 bp, Homo sapiens
gccacagtggggctgcaggcagg

SEQ ID NO: 1008132 - DNA, 13 bp, Homo sapiens
gccacatccagct

SEQ ID NO: 1008133 - DNA, 14 bp, Homo sapiens
gccacatccagctt

SEQ ID NO: 1008134 - DNA, 22 bp, Homo sapiens
gccacatcgttgagacatcagg

SEQ ID NO: 1008135 - DNA, 18 bp, Homo sapiens
gccacatcttgctctgca

SEQ ID NO: 1008136 - DNA, 13 bp, Homo sapiens
gccacatggagcc

SEQ ID NO: 1008137 - DNA, 21 bp, Homo sapiens
gccacatggagccccctctgc

SEQ ID NO: 1008138 - DNA, 17 bp, Homo sapiens
gccacatggtgtggcca

SEQ ID NO: 1008139 - DNA, 21 bp, Homo sapiens
gccacattgacagtggtgggc

SEQ ID NO: 1008140 - DNA, 19 bp, Homo sapiens
gccacattgatttttctat

SEQ ID NO: 1008141 - DNA, 14 bp, Homo sapiens
gccacatttggaat

SEQ ID NO: 1008142 - DNA, 16 bp, Homo sapiens
gccacatttggttcta

SEQ ID NO: 1008143 - DNA, 14 bp, Homo sapiens
gccaccaaagctgc

SEQ ID NO: 1008144 - DNA, 15 bp, Homo sapiens
gccaccaaagctgcc

SEQ ID NO: 1008145 - DNA, 16 bp, Homo sapiens
gccaccaaagctgccc

SEQ ID NO: 1008146 - DNA, 17 bp, Homo sapiens
gccaccaaagctgccca

SEQ ID NO: 1008147 - DNA, 23 bp, Homo sapiens
ccttatgcccggcgccgggcacc

SEQ ID NO: 1008148 - DNA, 16 bp, Homo sapiens
ccttatgctacacaga

SEQ ID NO: 1008149 - DNA, 20 bp, Homo sapiens
ccttatgggatcatttttcc

SEQ ID NO: 1008150 - DNA, 14 bp, Homo sapiens
ccttattcttctca

SEQ ID NO: 1008151 - DNA, 21 bp, Homo sapiens
ccttattgcctcccaggcaag

SEQ ID NO: 1008152 - DNA, 13 bp, Homo sapiens
ccttattgctgcc

SEQ ID NO: 1008153 - DNA, 14 bp, Homo sapiens
ccttattgctgcca

SEQ ID NO: 1008154 - DNA, 16 bp, Homo sapiens
ccttattgctgccaaa

SEQ ID NO: 1008155 - DNA, 17 bp, Homo sapiens
ccttattgctgccaaaa

SEQ ID NO: 1008156 - DNA, 12 bp, Homo sapiens
ccttccctcctg

SEQ ID NO: 1008157 - DNA, 14 bp, Homo sapiens
ccttccctcctgct

SEQ ID NO: 1008158 - DNA, 14 bp, Homo sapiens
ccttccctcctgtg

SEQ ID NO: 1008159 - DNA, 13 bp, Homo sapiens
ccttccctcgact

SEQ ID NO: 1008160 - DNA, 20 bp, Homo sapiens
ccttccctctgggcacgcct

SEQ ID NO: 1008161 - DNA, 15 bp, Homo sapiens
ccttccctggggagc

SEQ ID NO: 1008162 - DNA, 24 bp, Homo sapiens
ccttccctggggagccctcaggct

SEQ ID NO: 1008163 - DNA, 16 bp, Homo sapiens
ccttccctgtccctct

SEQ ID NO: 1008164 - DNA, 23 bp, Homo sapiens
ccttccctgttctccctttctct

SEQ ID NO: 1008165 - DNA, 13 bp, Homo sapiens
ccttcccttgcca

SEQ ID NO: 1008166 - DNA, 14 bp, Homo sapiens
ccttcccttgccac

SEQ ID NO: 1008167 - DNA, 16 bp, Homo sapiens
ccttcccttgccactt

SEQ ID NO: 1008168 - DNA, 16 bp, Homo sapiens
ccttcccttggaggga

SEQ ID NO: 1008169 - DNA, 21 bp, Homo sapiens
ccttcccttggagggagaggt

SEQ ID NO: 1008170 - DNA, 19 bp, Homo sapiens
ccttccgaccctctgggaa

SEQ ID NO: 1008171 - DNA, 17 bp, Homo sapiens
ccttccgctctgaggca

SEQ ID NO: 1008172 - DNA, 22 bp, Homo sapiens
ccttccgggtctcgcagcctga

SEQ ID NO: 1008173 - DNA, 17 bp, Homo sapiens
ccttccgggttcaagtg

SEQ ID NO: 1008174 - DNA, 17 bp, Homo sapiens
ccttccgtccatccccc

SEQ ID NO: 1008175 - DNA, 19 bp, Homo sapiens
ccttccgtccatccccctt

SEQ ID NO: 1008176 - DNA, 21 bp, Homo sapiens
ccttcctaaatatccaaagac

SEQ ID NO: 1008177 - DNA, 20 bp, Homo sapiens
ccttcctaattccacagctg

SEQ ID NO: 1008178 - DNA, 21 bp, Homo sapiens
ccttcctaattccacagctgc

SEQ ID NO: 1008179 - DNA, 18 bp, Homo sapiens
ccttcctagaagcccctg

SEQ ID NO: 1008180 - DNA, 21 bp, Homo sapiens
ccttcctagaagcccctgtcg

SEQ ID NO: 1008181 - DNA, 15 bp, Homo sapiens
ccttcctatgcccag

SEQ ID NO: 1008182 - DNA, 16 bp, Homo sapiens
ccttcctatgcccagg

SEQ ID NO: 1008183 - DNA, 19 bp, Homo sapiens
ccttcctatgcccaggtac

SEQ ID NO: 1008184 - DNA, 16 bp, Homo sapiens
ccttcctattctcctg

SEQ ID NO: 1008185 - DNA, 21 bp, Homo sapiens
ccttcctattctcctgccatg

SEQ ID NO: 1008186 - DNA, 20 bp, Homo sapiens
ccttcctcatccaccccatc

SEQ ID NO: 1008187 - DNA, 13 bp, Homo sapiens
ccttcctcatccc

SEQ ID NO: 1008188 - DNA, 15 bp, Homo sapiens
ccttcctccccacac

SEQ ID NO: 1008189 - DNA, 18 bp, Homo sapiens
ccttcctccccgcctcct

SEQ ID NO: 1008190 - DNA, 17 bp, Homo sapiens
ccttcctcctccacagt

SEQ ID NO: 1008191 - DNA, 13 bp, Homo sapiens
ccttcctcctgaa

SEQ ID NO: 1008192 - DNA, 20 bp, Homo sapiens
ccttcctcctgaagcctctg

SEQ ID NO: 1008193 - DNA, 17 bp, Homo sapiens
ccttcctcgtgcagagc

SEQ ID NO: 1008194 - DNA, 18 bp, Homo sapiens
ccttcctcgtgcagagct

SEQ ID NO: 1008195 - DNA, 15 bp, Homo sapiens
ccttcctctccactg

SEQ ID NO: 1008196 - DNA, 15 bp, Homo sapiens
ccttcctctctccag

SEQ ID NO: 1008197 - DNA, 16 bp, Homo sapiens
ccttcctctgagcctt

SEQ ID NO: 1008198 - DNA, 16 bp, Homo sapiens
ccttcctctgcagctg

SEQ ID NO: 1008199 - DNA, 17 bp, Homo sapiens
ccttcctctgcagctga

SEQ ID NO: 1008200 - DNA, 19 bp, Homo sapiens
ccttcctcttcctgccctt

SEQ ID NO: 1008201 - DNA, 12 bp, Homo sapiens
ccttcctcttcg

SEQ ID NO: 1008202 - DNA, 16 bp, Homo sapiens
ccttcctgcagcgcct

SEQ ID NO: 1008203 - DNA, 14 bp, Homo sapiens
ccttcctgccacca

SEQ ID NO: 1008204 - DNA, 15 bp, Homo sapiens
ccttcctggaaacag

SEQ ID NO: 1008205 - DNA, 13 bp, Homo sapiens
ccttcctggacac

SEQ ID NO: 1008206 - DNA, 16 bp, Homo sapiens
ccttcctggacacact

SEQ ID NO: 1008207 - DNA, 11 bp, Homo sapiens
ccttcctggcc

SEQ ID NO: 1008208 - DNA, 15 bp, Homo sapiens
ccttcctggcccagg

SEQ ID NO: 1008209 - DNA, 19 bp, Homo sapiens
ccttcctggcccaggcctt

SEQ ID NO: 1008210 - DNA, 12 bp, Homo sapiens
ccttcctggcct

SEQ ID NO: 1008211 - DNA, 15 bp, Homo sapiens
ccttcctggcctcac

SEQ ID NO: 1008212 - DNA, 17 bp, Homo sapiens
ccttcctggcctcactg

SEQ ID NO: 1008213 - DNA, 18 bp, Homo sapiens
ccttcctggcctcactgg

SEQ ID NO: 1008214 - DNA, 13 bp, Homo sapiens
ccttcctggcctg

SEQ ID NO: 1008215 - DNA, 17 bp, Homo sapiens
ccttcctgggaccccct

SEQ ID NO: 1008216 - DNA, 23 bp, Homo sapiens
ccttcctgggaccccctcgccag

SEQ ID NO: 1008217 - DNA, 13 bp, Homo sapiens
ccttcctgtccct

SEQ ID NO: 1008218 - DNA, 14 bp, Homo sapiens
ccttcctgtcctgc

SEQ ID NO: 1008219 - DNA, 16 bp, Homo sapiens
ccttcctgtcctgcct

SEQ ID NO: 1008220 - DNA, 18 bp, Homo sapiens
ccttcctgtcctgcctcc

SEQ ID NO: 1008221 - DNA, 18 bp, Homo sapiens
ccttcctgttccctcctg

SEQ ID NO: 1008222 - DNA, 19 bp, Homo sapiens
ccttcctgttccctcctgg

SEQ ID NO: 1008223 - DNA, 21 bp, Homo sapiens
ccttcctgttccctcctggtc

SEQ ID NO: 1008224 - DNA, 22 bp, Homo sapiens
ccttcctgttccctcctggtcc

SEQ ID NO: 1008225 - DNA, 17 bp, Homo sapiens
ccttcctgtttcagacc

SEQ ID NO: 1008226 - DNA, 17 bp, Homo sapiens
ccttcctgtttttcaca

SEQ ID NO: 1008227 - DNA, 16 bp, Homo sapiens
ccttccttcaggactc

SEQ ID NO: 1008228 - DNA, 12 bp, Homo sapiens
ccttcctttcct

SEQ ID NO: 1008229 - DNA, 22 bp, Homo sapiens
ccttcctttcctctgcagcact

SEQ ID NO: 1008230 - DNA, 19 bp, Homo sapiens
ccttcctttctccaggacc

SEQ ID NO: 1008231 - DNA, 13 bp, Homo sapiens
ccttccttttccc

SEQ ID NO: 1008232 - DNA, 15 bp, Homo sapiens
ccttccttttccctg

SEQ ID NO: 1008233 - DNA, 17 bp, Homo sapiens
ccttccttttccctgct

SEQ ID NO: 1008234 - DNA, 17 bp, Homo sapiens
ccttcgacatgctgcca

SEQ ID NO: 1008235 - DNA, 19 bp, Homo sapiens
ccttcgacatgctgccagg

SEQ ID NO: 1008236 - DNA, 21 bp, Homo sapiens
ccttcgcttcttgcctctgtg

SEQ ID NO: 1008237 - DNA, 23 bp, Homo sapiens
ccttcgcttcttgcctctgtgct

SEQ ID NO: 1008238 - DNA, 19 bp, Homo sapiens
ccttcgggcagtcctgtgt

SEQ ID NO: 1008239 - DNA, 17 bp, Homo sapiens
ccttcgtgaacatcccc

SEQ ID NO: 1008240 - DNA, 17 bp, Homo sapiens
ccttcgtgtctctccca

SEQ ID NO: 1008241 - DNA, 22 bp, Homo sapiens
ccttcgtgtctctcccaccccg

SEQ ID NO: 1008242 - DNA, 22 bp, Homo sapiens
ccttcgtgtgctgctgctgcta

SEQ ID NO: 1008243 - DNA, 13 bp, Homo sapiens
ccttctaaaggtg

SEQ ID NO: 1008244 - DNA, 15 bp, Homo sapiens
ccttctaagataaaa

SEQ ID NO: 1008245 - DNA, 18 bp, Homo sapiens
ccttctacagaacctgag

SEQ ID NO: 1008246 - DNA, 23 bp, Homo sapiens
ccttctagaacacctgccttcta

SEQ ID NO: 1008247 - DNA, 20 bp, Homo sapiens
ccttctagggttattgcatt

SEQ ID NO: 1008248 - DNA, 22 bp, Homo sapiens
ccttctagtcttggccagccaa

SEQ ID NO: 1008249 - DNA, 17 bp, Homo sapiens
ccttctagtgagcctgg

SEQ ID NO: 1008250 - DNA, 20 bp, Homo sapiens
ccttctagtgagcctgggcc

SEQ ID NO: 1008251 - DNA, 22 bp, Homo sapiens
ccttctagtgagcctgggccag

SEQ ID NO: 1008252 - DNA, 18 bp, Homo sapiens
ccttctagtttcccacaa

SEQ ID NO: 1008253 - DNA, 15 bp, Homo sapiens
ccttctattggtctc

SEQ ID NO: 1008254 - DNA, 14 bp, Homo sapiens
ccttctccaaaggc

SEQ ID NO: 1008255 - DNA, 11 bp, Homo sapiens
ccttctccatc

SEQ ID NO: 1008256 - DNA, 16 bp, Homo sapiens
ccttctcccacactgc

SEQ ID NO: 1008257 - DNA, 13 bp, Homo sapiens
ccttctcccagca

SEQ ID NO: 1008258 - DNA, 14 bp, Homo sapiens
ccttctccccaatc

SEQ ID NO: 1008259 - DNA, 12 bp, Homo sapiens
ccttctcccctc

SEQ ID NO: 1008260 - DNA, 13 bp, Homo sapiens
ccttctccccttc

SEQ ID NO: 1008261 - DNA, 11 bp, Homo sapiens
ccttctccctt

SEQ ID NO: 1008262 - DNA, 14 bp, Homo sapiens
ccttctcccttctt

SEQ ID NO: 1008263 - DNA, 23 bp, Homo sapiens
ccttctcctacttagggaagaaa

SEQ ID NO: 1008264 - DNA, 21 bp, Homo sapiens
ccttctcctccccacccgccc

SEQ ID NO: 1008265 - DNA, 22 bp, Homo sapiens
ccttctcgtgtttgcttaaaat

SEQ ID NO: 1008266 - DNA, 14 bp, Homo sapiens
ccttctctgcctcc

SEQ ID NO: 1008267 - DNA, 12 bp, Homo sapiens
ccttctctttga

SEQ ID NO: 1008268 - DNA, 17 bp, Homo sapiens
ccttctgagctccacct

SEQ ID NO: 1008269 - DNA, 19 bp, Homo sapiens
ccttctgagctccacctct

SEQ ID NO: 1008270 - DNA, 21 bp, Homo sapiens
ccttctgagctccacctctgg

SEQ ID NO: 1008271 - DNA, 15 bp, Homo sapiens
ccttctgagtattct

SEQ ID NO: 1008272 - DNA, 20 bp, Homo sapiens
ccttctgccaacgcctcctg

SEQ ID NO: 1008273 - DNA, 18 bp, Homo sapiens
ccttctggcctctgctga

SEQ ID NO: 1008274 - DNA, 16 bp, Homo sapiens
ccttctgggaactctc

SEQ ID NO: 1008275 - DNA, 11 bp, Homo sapiens
ccttctgggca

SEQ ID NO: 1008276 - DNA, 20 bp, Homo sapiens
ccttctgggcagaccttgac

SEQ ID NO: 1008277 - DNA, 13 bp, Homo sapiens
ccttctgggcttt

SEQ ID NO: 1008278 - DNA, 22 bp, Homo sapiens
gccacgtgtgctgtggccaggc

SEQ ID NO: 1008279 - DNA, 21 bp, Homo sapiens
gccagacaaaatttgagaata

SEQ ID NO: 1008280 - DNA, 19 bp, Homo sapiens
ccttctgtccccagccctg

SEQ ID NO: 1008281 - DNA, 16 bp, Homo sapiens
ccttctgtgagataaa

SEQ ID NO: 1008282 - DNA, 14 bp, Homo sapiens
ccttctgtggctca

SEQ ID NO: 1008283 - DNA, 21 bp, Homo sapiens
ccttctgtggctcacagaacc

SEQ ID NO: 1008284 - DNA, 18 bp, Homo sapiens
ccttctgtggggctgggc

SEQ ID NO: 1008285 - DNA, 12 bp, Homo sapiens
ccttctgtgtca

SEQ ID NO: 1008286 - DNA, 13 bp, Homo sapiens
ccttctgttaaga

SEQ ID NO: 1008287 - DNA, 19 bp, Homo sapiens
ccttctgttaagaaaggat

SEQ ID NO: 1008288 - DNA, 19 bp, Homo sapiens
ccttcttattctcactcca

SEQ ID NO: 1008289 - DNA, 19 bp, Homo sapiens
ccttcttcacccagctaat

SEQ ID NO: 1008290 - DNA, 22 bp, Homo sapiens
ccttcttcccgccccacctccc

SEQ ID NO: 1008291 - DNA, 21 bp, Homo sapiens
ccttcttgctgccctgcccca

SEQ ID NO: 1008292 - DNA, 15 bp, Homo sapiens
ccttcttgggcccca

SEQ ID NO: 1008293 - DNA, 23 bp, Homo sapiens
ccttcttgggtagggcagacatg

SEQ ID NO: 1008294 - DNA, 18 bp, Homo sapiens
ccttcttgggtctgccct

SEQ ID NO: 1008295 - DNA, 11 bp, Homo sapiens
ccttcttgtca

SEQ ID NO: 1008296 - DNA, 13 bp, Homo sapiens
ccttctttcctct

SEQ ID NO: 1008297 - DNA, 17 bp, Homo sapiens
ccttctttcctcttccc

SEQ ID NO: 1008298 - DNA, 13 bp, Homo sapiens
ccttctttctgga

SEQ ID NO: 1008299 - DNA, 16 bp, Homo sapiens
ccttctttgcagggct

SEQ ID NO: 1008300 - DNA, 19 bp, Homo sapiens
ccttcttttctcatgtgtt

SEQ ID NO: 1008301 - DNA, 23 bp, Homo sapiens
ccttctttttcatatttctacct

SEQ ID NO: 1008302 - DNA, 17 bp, Homo sapiens
ccttgaaaaaaaacagt

SEQ ID NO: 1008303 - DNA, 21 bp, Homo sapiens
ccttgaaaataagaatagaaa

SEQ ID NO: 1008304 - DNA, 20 bp, Homo sapiens
ccttgaacactgggggaggg

SEQ ID NO: 1008305 - DNA, 15 bp, Homo sapiens
ccttgaactgaggcc

SEQ ID NO: 1008306 - DNA, 17 bp, Homo sapiens
ccttgaactttgacctc

SEQ ID NO: 1008307 - DNA, 18 bp, Homo sapiens
ccttgaagaacctctcac

SEQ ID NO: 1008308 - DNA, 12 bp, Homo sapiens
ccttgaagacag

SEQ ID NO: 1008309 - DNA, 17 bp, Homo sapiens
ccttgaagacagagcaa

SEQ ID NO: 1008310 - DNA, 23 bp, Homo sapiens
ccttgaagatatcttgaaatgaa

SEQ ID NO: 1008311 - DNA, 16 bp, Homo sapiens
ccttgaagcaaatgtg

SEQ ID NO: 1008312 - DNA, 16 bp, Homo sapiens
ccttgaagcaataact

SEQ ID NO: 1008313 - DNA, 17 bp, Homo sapiens
ccttgaagcaataactc

SEQ ID NO: 1008314 - DNA, 19 bp, Homo sapiens
ccttgaagcaataactcca

SEQ ID NO: 1008315 - DNA, 13 bp, Homo sapiens
ccttgaaggacta

SEQ ID NO: 1008316 - DNA, 21 bp, Homo sapiens
ccttgaagggtaaagaagttt

SEQ ID NO: 1008317 - DNA, 12 bp, Homo sapiens
ccttgaaggtct

SEQ ID NO: 1008318 - DNA, 15 bp, Homo sapiens
ccttgaatctgcagg

SEQ ID NO: 1008319 - DNA, 14 bp, Homo sapiens
ccttgaatttctag

SEQ ID NO: 1008320 - DNA, 16 bp, Homo sapiens
ccttgacaacagactg

SEQ ID NO: 1008321 - DNA, 14 bp, Homo sapiens
ccttgacacctgct

SEQ ID NO: 1008322 - DNA, 23 bp, Homo sapiens
ccttgaccctgaaaggaacactg

SEQ ID NO: 1008323 - DNA, 20 bp, Homo sapiens
ccttgacctgcattgtaaat

SEQ ID NO: 1008324 - DNA, 16 bp, Homo sapiens
ccttgactgtacagag

SEQ ID NO: 1008325 - DNA, 18 bp, Homo sapiens
ccttgactgtacagagac

SEQ ID NO: 1008326 - DNA, 19 bp, Homo sapiens
ccttgactgtacagagact

SEQ ID NO: 1008327 - DNA, 13 bp, Homo sapiens
ccttgactgtcta

SEQ ID NO: 1008328 - DNA, 15 bp, Homo sapiens
ccttgactgtctagc

SEQ ID NO: 1008329 - DNA, 20 bp, Homo sapiens
ccttgactttgctcctcaca

SEQ ID NO: 1008330 - DNA, 14 bp, Homo sapiens
ccttgagacctcag

SEQ ID NO: 1008331 - DNA, 17 bp, Homo sapiens
ccttgagacctcagcca

SEQ ID NO: 1008332 - DNA, 19 bp, Homo sapiens
ccttgagacctcagccatg

SEQ ID NO: 1008333 - DNA, 22 bp, Homo sapiens
ccttgagatgcttcactttcct

SEQ ID NO: 1008334 - DNA, 23 bp, Homo sapiens
ccttgagccaggtggatgtttac

SEQ ID NO: 1008335 - DNA, 16 bp, Homo sapiens
ccttgagccctggctg

SEQ ID NO: 1008336 - DNA, 16 bp, Homo sapiens
ccttgagctgttgtga

SEQ ID NO: 1008337 - DNA, 17 bp, Homo sapiens
ccttgaggattgtggaa

SEQ ID NO: 1008338 - DNA, 23 bp, Homo sapiens
ccttgaggattgtggaaaaccag

SEQ ID NO: 1008339 - DNA, 15 bp, Homo sapiens
ccttgaggtgaaatg

SEQ ID NO: 1008340 - DNA, 15 bp, Homo sapiens
ccttgagtaaaaagg

SEQ ID NO: 1008341 - DNA, 23 bp, Homo sapiens
ccttgagtggggttatctctgtg

SEQ ID NO: 1008342 - DNA, 22 bp, Homo sapiens
ccttgagttgattcagctctgc

SEQ ID NO: 1008343 - DNA, 17 bp, Homo sapiens
ccttgataaatatatat

SEQ ID NO: 1008344 - DNA, 18 bp, Homo sapiens
ccttgatcagccccaccc

SEQ ID NO: 1008345 - DNA, 14 bp, Homo sapiens
ccttgatctgtata

SEQ ID NO: 1008346 - DNA, 15 bp, Homo sapiens
ccttgatgcacagag

SEQ ID NO: 1008347 - DNA, 18 bp, Homo sapiens
ccttgatgcacagagaag

SEQ ID NO: 1008348 - DNA, 16 bp, Homo sapiens
ccttgatgccagaggg

SEQ ID NO: 1008349 - DNA, 19 bp, Homo sapiens
ccttgatgccagagggcca

SEQ ID NO: 1008350 - DNA, 21 bp, Homo sapiens
ccttgatggggtccagagagc

SEQ ID NO: 1008351 - DNA, 21 bp, Homo sapiens
ccttgatgggtcaacctttgt

SEQ ID NO: 1008352 - DNA, 22 bp, Homo sapiens
ccttgatgggtgctgccctcag

SEQ ID NO: 1008353 - DNA, 23 bp, Homo sapiens
ccttgcaaagaccataaagtcca

SEQ ID NO: 1008354 - DNA, 16 bp, Homo sapiens
ccttgcaacacacaga

SEQ ID NO: 1008355 - DNA, 22 bp, Homo sapiens
ccttgcaacacacagacacacg

SEQ ID NO: 1008356 - DNA, 15 bp, Homo sapiens
ccttgcaaccaggca

SEQ ID NO: 1008357 - DNA, 16 bp, Homo sapiens
ccttgcaaccaggcag

SEQ ID NO: 1008358 - DNA, 11 bp, Homo sapiens
ccttgcaagcc

SEQ ID NO: 1008359 - DNA, 12 bp, Homo sapiens
ccttgcaagcca

SEQ ID NO: 1008360 - DNA, 14 bp, Homo sapiens
ccttgcaagccata

SEQ ID NO: 1008361 - DNA, 14 bp, Homo sapiens
ccttgcacctgcat

SEQ ID NO: 1008362 - DNA, 19 bp, Homo sapiens
ccttgcacggctgctcggc

SEQ ID NO: 1008363 - DNA, 16 bp, Homo sapiens
ccttgcagaactgcca

SEQ ID NO: 1008364 - DNA, 20 bp, Homo sapiens
ccttgcagatatctgcatgt

SEQ ID NO: 1008365 - DNA, 21 bp, Homo sapiens
ccttgcagatatctgcatgtg

SEQ ID NO: 1008366 - DNA, 13 bp, Homo sapiens
ccttgcagcaggg

SEQ ID NO: 1008367 - DNA, 16 bp, Homo sapiens
ccttgcagcctggtca

SEQ ID NO: 1008368 - DNA, 23 bp, Homo sapiens
ccttgcagttcagcaccacccta

SEQ ID NO: 1008369 - DNA, 22 bp, Homo sapiens
ccttgcatgtacttgaaggatg

SEQ ID NO: 1008370 - DNA, 19 bp, Homo sapiens
ccttgccactttgcacgac

SEQ ID NO: 1008371 - DNA, 17 bp, Homo sapiens
ccttgccagggcagggt

SEQ ID NO: 1008372 - DNA, 18 bp, Homo sapiens
ccttgccagggcagggtc

SEQ ID NO: 1008373 - DNA, 14 bp, Homo sapiens
ccttgcccagagat

SEQ ID NO: 1008374 - DNA, 18 bp, Homo sapiens
ccttgcccagggctcagc

SEQ ID NO: 1008375 - DNA, 22 bp, Homo sapiens
ccttgcccagggctcagcctgg

SEQ ID NO: 1008376 - DNA, 13 bp, Homo sapiens
ccttgccccactc

SEQ ID NO: 1008377 - DNA, 14 bp, Homo sapiens
ccttgccccactcc

SEQ ID NO: 1008378 - DNA, 15 bp, Homo sapiens
ccttgccccaggcca

SEQ ID NO: 1008379 - DNA, 22 bp, Homo sapiens
ccttgccccaggccaggtagca

SEQ ID NO: 1008380 - DNA, 17 bp, Homo sapiens
ccttgcccgccagcctc

SEQ ID NO: 1008381 - DNA, 19 bp, Homo sapiens
ccttgcccggattctggga

SEQ ID NO: 1008382 - DNA, 17 bp, Homo sapiens
ccttgccctcaagcaat

SEQ ID NO: 1008383 - DNA, 17 bp, Homo sapiens
ccttgccctccgcctgg

SEQ ID NO: 1008384 - DNA, 13 bp, Homo sapiens
ccttgccctgacc

SEQ ID NO: 1008385 - DNA, 14 bp, Homo sapiens
ccttgccctgacct

SEQ ID NO: 1008386 - DNA, 15 bp, Homo sapiens
ccttgccctgacctc

SEQ ID NO: 1008387 - DNA, 22 bp, Homo sapiens
ccttgcctaaatttaatgctgc

SEQ ID NO: 1008388 - DNA, 23 bp, Homo sapiens
ccttgcctaaatttaatgctgcc

SEQ ID NO: 1008389 - DNA, 15 bp, Homo sapiens
ccttgcctcaatgcc

SEQ ID NO: 1008390 - DNA, 19 bp, Homo sapiens
ccttgcctcaatgccagta

SEQ ID NO: 1008391 - DNA, 17 bp, Homo sapiens
ccttgcctccccatttc

SEQ ID NO: 1008392 - DNA, 14 bp, Homo sapiens
ccttgcctcctgtg

SEQ ID NO: 1008393 - DNA, 23 bp, Homo sapiens
ccttgcctgaacatccttccttc

SEQ ID NO: 1008394 - DNA, 18 bp, Homo sapiens
ccttgcctgaactccaga

SEQ ID NO: 1008395 - DNA, 19 bp, Homo sapiens
ccttgcctgaactccagag

SEQ ID NO: 1008396 - DNA, 20 bp, Homo sapiens
ccttgcctgaactccagagg

SEQ ID NO: 1008397 - DNA, 13 bp, Homo sapiens
ccttgcctgcctc

SEQ ID NO: 1008398 - DNA, 16 bp, Homo sapiens
ccttgcctgcctccta

SEQ ID NO: 1008399 - DNA, 19 bp, Homo sapiens
ccttgcctgcctcctaggc

SEQ ID NO: 1008400 - DNA, 22 bp, Homo sapiens
ccttgcctgcctcctaggctgg

SEQ ID NO: 1008401 - DNA, 13 bp, Homo sapiens
gcacgcctgctgg

SEQ ID NO: 1008402 - DNA, 14 bp, Homo sapiens
gcacgcctgctggc

SEQ ID NO: 1008403 - DNA, 17 bp, Homo sapiens
gcacgctgcccaggggc

SEQ ID NO: 1008404 - DNA, 21 bp, Homo sapiens
gcacgcttgcgtatgtctgtt

SEQ ID NO: 1008405 - DNA, 14 bp, Homo sapiens
gcacggagagaagg

SEQ ID NO: 1008406 - DNA, 14 bp, Homo sapiens
gcacggcagccaca

SEQ ID NO: 1008407 - DNA, 16 bp, Homo sapiens
gcacggcagccacagc

SEQ ID NO: 1008408 - DNA, 14 bp, Homo sapiens
gcacggcaggcgtg

SEQ ID NO: 1008409 - DNA, 20 bp, Homo sapiens
gcacggcaggcgtgtggcag

SEQ ID NO: 1008410 - DNA, 19 bp, Homo sapiens
gcacggcccggcccctcac

SEQ ID NO: 1008411 - DNA, 22 bp, Homo sapiens
gcacggcccggcccctcaccct

SEQ ID NO: 1008412 - DNA, 20 bp, Homo sapiens
gcacggcgggatcctccaca

SEQ ID NO: 1008413 - DNA, 20 bp, Homo sapiens
gcacgggccctccctcccag

SEQ ID NO: 1008414 - DNA, 18 bp, Homo sapiens
gcacggtgactctgtcca

SEQ ID NO: 1008415 - DNA, 15 bp, Homo sapiens
gcacgtattgctgtg

SEQ ID NO: 1008416 - DNA, 15 bp, Homo sapiens
gcacgtggagagctg

SEQ ID NO: 1008417 - DNA, 18 bp, Homo sapiens
gcacgtggagagctggtg

SEQ ID NO: 1008418 - DNA, 18 bp, Homo sapiens
gcacgtggagatagtgcc

SEQ ID NO: 1008419 - DNA, 21 bp, Homo sapiens
gcacgtggagatagtgccagg

SEQ ID NO: 1008420 - DNA, 13 bp, Homo sapiens
gcacgtggcctct

SEQ ID NO: 1008421 - DNA, 19 bp, Homo sapiens
gcactaaaccacttctctg

SEQ ID NO: 1008422 - DNA, 20 bp, Homo sapiens
gcactaaaccacttctctgc

SEQ ID NO: 1008423 - DNA, 23 bp, Homo sapiens
gcactaaaccacttctctgctgc

SEQ ID NO: 1008424 - DNA, 14 bp, Homo sapiens
gcactaaagcagtg

SEQ ID NO: 1008425 - DNA, 20 bp, Homo sapiens
gcactaaagcagtggacacc

SEQ ID NO: 1008426 - DNA, 15 bp, Homo sapiens
gcactaaagccagcc

SEQ ID NO: 1008427 - DNA, 17 bp, Homo sapiens
gcactaaatcagagaca

SEQ ID NO: 1008428 - DNA, 19 bp, Homo sapiens
gcactaaccaatgcctttt

SEQ ID NO: 1008429 - DNA, 20 bp, Homo sapiens
gcactaaccaatgccttttt

SEQ ID NO: 1008430 - DNA, 19 bp, Homo sapiens
gcactaacgttgagcccct

SEQ ID NO: 1008431 - DNA, 14 bp, Homo sapiens
gcactaaggccgtg

SEQ ID NO: 1008432 - DNA, 23 bp, Homo sapiens
gcactaaggccgtgtctctgagg

SEQ ID NO: 1008433 - DNA, 14 bp, Homo sapiens
gcactacataaact

SEQ ID NO: 1008434 - DNA, 16 bp, Homo sapiens
gcactactcctctgca

SEQ ID NO: 1008435 - DNA, 17 bp, Homo sapiens
gcactactctgtgccag

SEQ ID NO: 1008436 - DNA, 18 bp, Homo sapiens
gcactactgacatgtggg

SEQ ID NO: 1008437 - DNA, 18 bp, Homo sapiens
gcactactgggtgtcatt

SEQ ID NO: 1008438 - DNA, 20 bp, Homo sapiens
gcactagcattttcttgaac

SEQ ID NO: 1008439 - DNA, 14 bp, Homo sapiens
gcactagcctgtga

SEQ ID NO: 1008440 - DNA, 20 bp, Homo sapiens
gcactataatgtaagctcta

SEQ ID NO: 1008441 - DNA, 19 bp, Homo sapiens
gcactatatttgtatatat

SEQ ID NO: 1008442 - DNA, 18 bp, Homo sapiens
gcactatttatttacaaa

SEQ ID NO: 1008443 - DNA, 16 bp, Homo sapiens
gcactattttatattt

SEQ ID NO: 1008444 - DNA, 23 bp, Homo sapiens
gcactcaaaagctgggaaccagc

SEQ ID NO: 1008445 - DNA, 21 bp, Homo sapiens
gcactcaactctgagcccata

SEQ ID NO: 1008446 - DNA, 19 bp, Homo sapiens
gcactcacagacctggagc

SEQ ID NO: 1008447 - DNA, 16 bp, Homo sapiens
gcactcagtgagcctc

SEQ ID NO: 1008448 - DNA, 18 bp, Homo sapiens
gcactcagtgagcctcct

SEQ ID NO: 1008449 - DNA, 22 bp, Homo sapiens
gcactcagtgagcctcctgtgc

SEQ ID NO: 1008450 - DNA, 17 bp, Homo sapiens
gcactcatgtggactgg

SEQ ID NO: 1008451 - DNA, 17 bp, Homo sapiens
gcactccagcctgggca

SEQ ID NO: 1008452 - DNA, 19 bp, Homo sapiens
gcactccagcctgggggac

SEQ ID NO: 1008453 - DNA, 17 bp, Homo sapiens
gcactccagcctgggtg

SEQ ID NO: 1008454 - DNA, 13 bp, Homo sapiens
gcactccatggcc

SEQ ID NO: 1008455 - DNA, 14 bp, Homo sapiens
gcactccatggcca

SEQ ID NO: 1008456 - DNA, 15 bp, Homo sapiens
gcactccatggccac

SEQ ID NO: 1008457 - DNA, 16 bp, Homo sapiens
gcactccatggccacc

SEQ ID NO: 1008458 - DNA, 15 bp, Homo sapiens
gcactcccaaccctg

SEQ ID NO: 1008459 - DNA, 18 bp, Homo sapiens
gcactcccacctgacaca

SEQ ID NO: 1008460 - DNA, 14 bp, Homo sapiens
gcactccccagagc

SEQ ID NO: 1008461 - DNA, 19 bp, Homo sapiens
gcactccccagagctgtgc

SEQ ID NO: 1008462 - DNA, 14 bp, Homo sapiens
gcactcccgcctgg

SEQ ID NO: 1008463 - DNA, 14 bp, Homo sapiens
gcactccctcctgg

SEQ ID NO: 1008464 - DNA, 23 bp, Homo sapiens
gcactcccttggtggcaagagcc

SEQ ID NO: 1008465 - DNA, 17 bp, Homo sapiens
gcactccggcctgatga

SEQ ID NO: 1008466 - DNA, 21 bp, Homo sapiens
gcactccggtcccaaatgtag

SEQ ID NO: 1008467 - DNA, 19 bp, Homo sapiens
gcactcctcggtactccca

SEQ ID NO: 1008468 - DNA, 20 bp, Homo sapiens
gcactcctcggtactcccat

SEQ ID NO: 1008469 - DNA, 24 bp, Homo sapiens
gcactcctttatctgtaattgtaa

SEQ ID NO: 1008470 - DNA, 15 bp, Homo sapiens
gcactctaaactgca

SEQ ID NO: 1008471 - DNA, 16 bp, Homo sapiens
gcactctaaactgcaa

SEQ ID NO: 1008472 - DNA, 18 bp, Homo sapiens
gcactctaaactgcaaac

SEQ ID NO: 1008473 - DNA, 23 bp, Homo sapiens
gcactctaattagagaactggag

SEQ ID NO: 1008474 - DNA, 14 bp, Homo sapiens
gcactctcacccca

SEQ ID NO: 1008475 - DNA, 17 bp, Homo sapiens
gcactctcaccccaagc

SEQ ID NO: 1008476 - DNA, 23 bp, Homo sapiens
gcactctcaccccaagcggcctt

SEQ ID NO: 1008477 - DNA, 22 bp, Homo sapiens
gcactctcatcaccccagaggc

SEQ ID NO: 1008478 - DNA, 13 bp, Homo sapiens
gcactctctgcag

SEQ ID NO: 1008479 - DNA, 20 bp, Homo sapiens
gcactctggcggtggccaca

SEQ ID NO: 1008480 - DNA, 23 bp, Homo sapiens
gcactcttgtttgctttgaaaat

SEQ ID NO: 1008481 - DNA, 21 bp, Homo sapiens
gcactgaaaacttagccagag

SEQ ID NO: 1008482 - DNA, 17 bp, Homo sapiens
gcactgaaacctgagat

SEQ ID NO: 1008483 - DNA, 22 bp, Homo sapiens
gcactgaaagtcacggctgcgc

SEQ ID NO: 1008484 - DNA, 15 bp, Homo sapiens
gcactgaacaggctg

SEQ ID NO: 1008485 - DNA, 16 bp, Homo sapiens
gcactgaacaggctgg

SEQ ID NO: 1008486 - DNA, 17 bp, Homo sapiens
gcactgaacaggctggg

SEQ ID NO: 1008487 - DNA, 19 bp, Homo sapiens
gcactgaaccttaggcttt

SEQ ID NO: 1008488 - DNA, 13 bp, Homo sapiens
gcactgacagcct

SEQ ID NO: 1008489 - DNA, 15 bp, Homo sapiens
gcactgaccaggccc

SEQ ID NO: 1008490 - DNA, 21 bp, Homo sapiens
gcactgacctgctccgccagg

SEQ ID NO: 1008491 - DNA, 22 bp, Homo sapiens
gcactgacctgctccgccagga

SEQ ID NO: 1008492 - DNA, 11 bp, Homo sapiens
gcactgactgt

SEQ ID NO: 1008493 - DNA, 21 bp, Homo sapiens
gcactgagataccagcgagga

SEQ ID NO: 1008494 - DNA, 16 bp, Homo sapiens
gcactgagctcacatg

SEQ ID NO: 1008495 - DNA, 13 bp, Homo sapiens
gcactgagggcca

SEQ ID NO: 1008496 - DNA, 20 bp, Homo sapiens
gcactgagggccacactatt

SEQ ID NO: 1008497 - DNA, 20 bp, Homo sapiens
gcactgaggtccacagacct

SEQ ID NO: 1008498 - DNA, 17 bp, Homo sapiens
gcactgcattcctgtgc

SEQ ID NO: 1008499 - DNA, 14 bp, Homo sapiens
gcactgcccacatg

SEQ ID NO: 1008500 - DNA, 20 bp, Homo sapiens
gcactgcccacatgggacct

SEQ ID NO: 1008501 - DNA, 21 bp, Homo sapiens
gcactgcccacatgggacctg

SEQ ID NO: 1008502 - DNA, 18 bp, Homo sapiens
gcactgcccatcagtgac

SEQ ID NO: 1008503 - DNA, 13 bp, Homo sapiens
gcactgcctcctg

SEQ ID NO: 1008504 - DNA, 14 bp, Homo sapiens
gcactgcctcctgt

SEQ ID NO: 1008505 - DNA, 18 bp, Homo sapiens
gcactgccttctcctctc

SEQ ID NO: 1008506 - DNA, 22 bp, Homo sapiens
gcactgccttctcctctctggg

SEQ ID NO: 1008507 - DNA, 23 bp, Homo sapiens
gcactgccttctcctctctgggc

SEQ ID NO: 1008508 - DNA, 17 bp, Homo sapiens
gcactgctccaagggac

SEQ ID NO: 1008509 - DNA, 15 bp, Homo sapiens
gcactgctgcccagc

SEQ ID NO: 1008510 - DNA, 12 bp, Homo sapiens
gcactgctgttc

SEQ ID NO: 1008511 - DNA, 16 bp, Homo sapiens
gcactgcttgaggaaa

SEQ ID NO: 1008512 - DNA, 11 bp, Homo sapiens
gcactggactc

SEQ ID NO: 1008513 - DNA, 15 bp, Homo sapiens
gcactggactccggg

SEQ ID NO: 1008514 - DNA, 13 bp, Homo sapiens
gcactggagccac

SEQ ID NO: 1008515 - DNA, 16 bp, Homo sapiens
gcactggatggacttg

SEQ ID NO: 1008516 - DNA, 23 bp, Homo sapiens
gcactggatggacttggcttcag

SEQ ID NO: 1008517 - DNA, 20 bp, Homo sapiens
gcactggccacccctcccca

SEQ ID NO: 1008518 - DNA, 13 bp, Homo sapiens
gcactggccagag

SEQ ID NO: 1008519 - DNA, 17 bp, Homo sapiens
gcactggccttctgatg

SEQ ID NO: 1008520 - DNA, 15 bp, Homo sapiens
gcactggcgaggaga

SEQ ID NO: 1008521 - DNA, 16 bp, Homo sapiens
gcactggcgaggagag

SEQ ID NO: 1008522 - DNA, 19 bp, Homo sapiens
gcactggctctctccagga

SEQ ID NO: 1008523 - DNA, 14 bp, Homo sapiens
gcactgggaagctg

SEQ ID NO: 1008524 - DNA, 19 bp, Homo sapiens
gcactgggaagctggagtg

SEQ ID NO: 1008525 - DNA, 18 bp, Homo sapiens
cctgcacacaggacagcg

SEQ ID NO: 1008526 - DNA, 17 bp, Homo sapiens
cctgcacacagggcagt

SEQ ID NO: 1008527 - DNA, 22 bp, Homo sapiens
cctgcacaggcacacagggccc

SEQ ID NO: 1008528 - DNA, 21 bp, Homo sapiens
cctgcacaggtggctgtttct

SEQ ID NO: 1008529 - DNA, 17 bp, Homo sapiens
cctgcacagtgacttct

SEQ ID NO: 1008530 - DNA, 18 bp, Homo sapiens
cctgcacagtgacttctg

SEQ ID NO: 1008531 - DNA, 21 bp, Homo sapiens
cctgcacagtgacttctgaga

SEQ ID NO: 1008532 - DNA, 12 bp, Homo sapiens
cctgcaccccag

SEQ ID NO: 1008533 - DNA, 14 bp, Homo sapiens
cctgcaccctccta

SEQ ID NO: 1008534 - DNA, 16 bp, Homo sapiens
cctgcaccctcctagg

SEQ ID NO: 1008535 - DNA, 23 bp, Homo sapiens
cctgcaccgacccgaggcccaga

SEQ ID NO: 1008536 - DNA, 18 bp, Homo sapiens
cctgcaccgccgccaccc

SEQ ID NO: 1008537 - DNA, 21 bp, Homo sapiens
cctgcaccgccgccaccctgc

SEQ ID NO: 1008538 - DNA, 22 bp, Homo sapiens
cctgcaccgtctcactgtgtgt

SEQ ID NO: 1008539 - DNA, 14 bp, Homo sapiens
cctgcacctccccc

SEQ ID NO: 1008540 - DNA, 17 bp, Homo sapiens
cctgcacctccccccac

SEQ ID NO: 1008541 - DNA, 20 bp, Homo sapiens
cctgcacctccccccactgc

SEQ ID NO: 1008542 - DNA, 12 bp, Homo sapiens
cctgcacctgct

SEQ ID NO: 1008543 - DNA, 21 bp, Homo sapiens
cctgcacctggcctgggccac

SEQ ID NO: 1008544 - DNA, 23 bp, Homo sapiens
cctgcacctggcctgggccacac

SEQ ID NO: 1008545 - DNA, 18 bp, Homo sapiens
cctgcacgtcatgggagg

SEQ ID NO: 1008546 - DNA, 21 bp, Homo sapiens
cctgcactaaagccagcctga

SEQ ID NO: 1008547 - DNA, 15 bp, Homo sapiens
cctgcactccctggc

SEQ ID NO: 1008548 - DNA, 18 bp, Homo sapiens
cctgcactccctggcctt

SEQ ID NO: 1008549 - DNA, 13 bp, Homo sapiens
cctgcactgggaa

SEQ ID NO: 1008550 - DNA, 16 bp, Homo sapiens
cctgcactgggaagga

SEQ ID NO: 1008551 - DNA, 18 bp, Homo sapiens
cctgcactgggaaggaaa

SEQ ID NO: 1008552 - DNA, 21 bp, Homo sapiens
cctgcactgggaaggaaacaa

SEQ ID NO: 1008553 - DNA, 16 bp, Homo sapiens
cctgcactgtgccccg

SEQ ID NO: 1008554 - DNA, 17 bp, Homo sapiens
cctgcagacacctggac

SEQ ID NO: 1008555 - DNA, 13 bp, Homo sapiens
cctgcagagaaac

SEQ ID NO: 1008556 - DNA, 11 bp, Homo sapiens
cctgcagagag

SEQ ID NO: 1008557 - DNA, 12 bp, Homo sapiens
cctgcagagcaa

SEQ ID NO: 1008558 - DNA, 16 bp, Homo sapiens
cctgcagagcaataac

SEQ ID NO: 1008559 - DNA, 17 bp, Homo sapiens
cctgcagagcaataaca

SEQ ID NO: 1008560 - DNA, 20 bp, Homo sapiens
cctgcagagcaataacacta

SEQ ID NO: 1008561 - DNA, 14 bp, Homo sapiens
cctgcagatgccac

SEQ ID NO: 1008562 - DNA, 21 bp, Homo sapiens
cctgcagatgccaccctagcc

SEQ ID NO: 1008563 - DNA, 18 bp, Homo sapiens
cctgcagcaaacactcca

SEQ ID NO: 1008564 - DNA, 23 bp, Homo sapiens
cctgcagcaggaatatatgtgtg

SEQ ID NO: 1008565 - DNA, 16 bp, Homo sapiens
cctgcagcatggtccc

SEQ ID NO: 1008566 - DNA, 17 bp, Homo sapiens
cctgcagcatggtccct

SEQ ID NO: 1008567 - DNA, 13 bp, Homo sapiens
cctgcagccacca

SEQ ID NO: 1008568 - DNA, 21 bp, Homo sapiens
cctgcagcccaaaacccaggg

SEQ ID NO: 1008569 - DNA, 23 bp, Homo sapiens
cctgcagcccaccagacgtcagg

SEQ ID NO: 1008570 - DNA, 17 bp, Homo sapiens
cctgcagcccccactca

SEQ ID NO: 1008571 - DNA, 17 bp, Homo sapiens
cctgcagcctgggtctg

SEQ ID NO: 1008572 - DNA, 15 bp, Homo sapiens
cctgcagcgcctccc

SEQ ID NO: 1008573 - DNA, 18 bp, Homo sapiens
cctgcagcgcctcccttg

SEQ ID NO: 1008574 - DNA, 22 bp, Homo sapiens
cctgcagcgcctcccttgtctc

SEQ ID NO: 1008575 - DNA, 16 bp, Homo sapiens
cctgcaggaacgagca

SEQ ID NO: 1008576 - DNA, 17 bp, Homo sapiens
cctgcaggaacgagcac

SEQ ID NO: 1008577 - DNA, 20 bp, Homo sapiens
cctgcaggaacgagcactgg

SEQ ID NO: 1008578 - DNA, 18 bp, Homo sapiens
cctgcaggacctcgtgcc

SEQ ID NO: 1008579 - DNA, 20 bp, Homo sapiens
cctgcaggagagagcagcac

SEQ ID NO: 1008580 - DNA, 14 bp, Homo sapiens
cctgcaggagcagg

SEQ ID NO: 1008581 - DNA, 16 bp, Homo sapiens
cctgcaggagcagggc

SEQ ID NO: 1008582 - DNA, 18 bp, Homo sapiens
cctgcaggagcagggcgg

SEQ ID NO: 1008583 - DNA, 22 bp, Homo sapiens
cctgcaggagcagggcggctgc

SEQ ID NO: 1008584 - DNA, 22 bp, Homo sapiens
cctgcaggcacagaggaggtca

SEQ ID NO: 1008585 - DNA, 12 bp, Homo sapiens
cctgcaggccag

SEQ ID NO: 1008586 - DNA, 13 bp, Homo sapiens
cctgcaggctgga

SEQ ID NO: 1008587 - DNA, 20 bp, Homo sapiens
cctgcagggcgcccctggga

SEQ ID NO: 1008588 - DNA, 15 bp, Homo sapiens
cctgcagggcttctc

SEQ ID NO: 1008589 - DNA, 10 bp, Homo sapiens
cctgcagggg

SEQ ID NO: 1008590 - DNA, 13 bp, Homo sapiens
cctgcagggggag

SEQ ID NO: 1008591 - DNA, 19 bp, Homo sapiens
cctgcagggtggtgctggg

SEQ ID NO: 1008592 - DNA, 18 bp, Homo sapiens
cctgcagtgaggggccct

SEQ ID NO: 1008593 - DNA, 14 bp, Homo sapiens
cctgcagttcctga

SEQ ID NO: 1008594 - DNA, 19 bp, Homo sapiens
cctgcagtttcttgtgtag

SEQ ID NO: 1008595 - DNA, 15 bp, Homo sapiens
cctgcagtttggccc

SEQ ID NO: 1008596 - DNA, 22 bp, Homo sapiens
cctgcagtttggccctggagcc

SEQ ID NO: 1008597 - DNA, 22 bp, Homo sapiens
cctgcataatgtttctggattt

SEQ ID NO: 1008598 - DNA, 18 bp, Homo sapiens
cctgcatccccttggctg

SEQ ID NO: 1008599 - DNA, 21 bp, Homo sapiens
cctgcatccccttggctgtga

SEQ ID NO: 1008600 - DNA, 24 bp, Homo sapiens
cctgcatccccttggctgtgaggc

SEQ ID NO: 1008601 - DNA, 13 bp, Homo sapiens
cctgcatcctgag

SEQ ID NO: 1008602 - DNA, 19 bp, Homo sapiens
cctgcatcctgaggccagt

SEQ ID NO: 1008603 - DNA, 22 bp, Homo sapiens
cctgcatctatcgagtttgcaa

SEQ ID NO: 1008604 - DNA, 21 bp, Homo sapiens
cctgcatctctgtgaagcctc

SEQ ID NO: 1008605 - DNA, 15 bp, Homo sapiens
cctgcatgcaactaa

SEQ ID NO: 1008606 - DNA, 16 bp, Homo sapiens
cctgcatgcaactaat

SEQ ID NO: 1008607 - DNA, 20 bp, Homo sapiens
cctgcatggggcagaggctt

SEQ ID NO: 1008608 - DNA, 18 bp, Homo sapiens
cctgcatgggggcaccgg

SEQ ID NO: 1008609 - DNA, 22 bp, Homo sapiens
cctgcattctgcacgctgccca

SEQ ID NO: 1008610 - DNA, 13 bp, Homo sapiens
cctgcatttcctc

SEQ ID NO: 1008611 - DNA, 23 bp, Homo sapiens
cctgcatttgtgaaatgatggtg

SEQ ID NO: 1008612 - DNA, 16 bp, Homo sapiens
cctgccaaagacgtgt

SEQ ID NO: 1008613 - DNA, 19 bp, Homo sapiens
cctgccaaagtagtcctgg

SEQ ID NO: 1008614 - DNA, 22 bp, Homo sapiens
cctgccaaagtagtcctggcag

SEQ ID NO: 1008615 - DNA, 17 bp, Homo sapiens
cctgccaaagtgcctgg

SEQ ID NO: 1008616 - DNA, 18 bp, Homo sapiens
cctgccaagactcctcag

SEQ ID NO: 1008617 - DNA, 19 bp, Homo sapiens
cctgccaagactcctcagg

SEQ ID NO: 1008618 - DNA, 13 bp, Homo sapiens
cctgccaatgctc

SEQ ID NO: 1008619 - DNA, 17 bp, Homo sapiens
cctgccaatgctccagc

SEQ ID NO: 1008620 - DNA, 22 bp, Homo sapiens
cctgccacaaaccaccaggact

SEQ ID NO: 1008621 - DNA, 20 bp, Homo sapiens
cctgccacactgatggctca

SEQ ID NO: 1008622 - DNA, 23 bp, Homo sapiens
cctgccacactgatggctcaaga

SEQ ID NO: 1008623 - DNA, 11 bp, Homo sapiens
cctgccacagc

SEQ ID NO: 1008624 - DNA, 14 bp, Homo sapiens
cctgccacagccag

SEQ ID NO: 1008625 - DNA, 15 bp, Homo sapiens
cctgccacagccaga

SEQ ID NO: 1008626 - DNA, 19 bp, Homo sapiens
cctgccacagccagaggag

SEQ ID NO: 1008627 - DNA, 17 bp, Homo sapiens
cctgccacatccagctt

SEQ ID NO: 1008628 - DNA, 16 bp, Homo sapiens
cctgccacatggagcc

SEQ ID NO: 1008629 - DNA, 23 bp, Homo sapiens
cctgccaccagggagcttcctgg

SEQ ID NO: 1008630 - DNA, 19 bp, Homo sapiens
cctgccaccagtcactgtc

SEQ ID NO: 1008631 - DNA, 19 bp, Homo sapiens
cctgccacccccaggtctt

SEQ ID NO: 1008632 - DNA, 15 bp, Homo sapiens
cctgccaccccttcc

SEQ ID NO: 1008633 - DNA, 19 bp, Homo sapiens
cctgccaccccttcctccc

SEQ ID NO: 1008634 - DNA, 23 bp, Homo sapiens
cctgccaccgactgcccagccac

SEQ ID NO: 1008635 - DNA, 13 bp, Homo sapiens
cctgccacctccc

SEQ ID NO: 1008636 - DNA, 15 bp, Homo sapiens
cctgccactcaccct

SEQ ID NO: 1008637 - DNA, 18 bp, Homo sapiens
cctgccactcactaggcc

SEQ ID NO: 1008638 - DNA, 19 bp, Homo sapiens
cctgccactctctgggact

SEQ ID NO: 1008639 - DNA, 12 bp, Homo sapiens
cctgccactggg

SEQ ID NO: 1008640 - DNA, 17 bp, Homo sapiens
cctgccactgggctctg

SEQ ID NO: 1008641 - DNA, 22 bp, Homo sapiens
cctgccactgggctctggacct

SEQ ID NO: 1008642 - DNA, 11 bp, Homo sapiens
cctgccagcag

SEQ ID NO: 1008643 - DNA, 18 bp, Homo sapiens
cctgccagccgaccctcc

SEQ ID NO: 1008644 - DNA, 19 bp, Homo sapiens
cctgccagccgaccctcct

SEQ ID NO: 1008645 - DNA, 22 bp, Homo sapiens
cctgccagccgaccctcctggc

SEQ ID NO: 1008646 - DNA, 13 bp, Homo sapiens
cctgccagccggt

SEQ ID NO: 1008647 - DNA, 13 bp, Homo sapiens
cctgccagcctgg

SEQ ID NO: 1008648 - DNA, 21 bp, Homo sapiens
cctgccagcctggcttctgga

SEQ ID NO: 1008649 - DNA, 14 bp, Homo sapiens
gcactgggaaggaa

SEQ ID NO: 1008650 - DNA, 11 bp, Homo sapiens
gcactgggagg

SEQ ID NO: 1008651 - DNA, 14 bp, Homo sapiens
gcactgggaggcag

SEQ ID NO: 1008652 - DNA, 19 bp, Homo sapiens
gcactgggaggcagggctc

SEQ ID NO: 1008653 - DNA, 20 bp, Homo sapiens
gcactgggcaggttcctggg

SEQ ID NO: 1008654 - DNA, 21 bp, Homo sapiens
gcactgggcaggttcctgggg

SEQ ID NO: 1008655 - DNA, 15 bp, Homo sapiens
gcactgggctccgga

SEQ ID NO: 1008656 - DNA, 15 bp, Homo sapiens
gcactggggagcccg

SEQ ID NO: 1008657 - DNA, 20 bp, Homo sapiens
gcactggtgtgaactcaccc

SEQ ID NO: 1008658 - DNA, 19 bp, Homo sapiens
gcactgtaaatatccctcc

SEQ ID NO: 1008659 - DNA, 20 bp, Homo sapiens
gcactgtaagacgtatgtaa

SEQ ID NO: 1008660 - DNA, 21 bp, Homo sapiens
gcactgtcactttgctctggg

SEQ ID NO: 1008661 - DNA, 17 bp, Homo sapiens
gcactgtgaatcctggc

SEQ ID NO: 1008662 - DNA, 19 bp, Homo sapiens
gcactgtgaatcctggcaa

SEQ ID NO: 1008663 - DNA, 20 bp, Homo sapiens
gcactgtgaatcctggcaag

SEQ ID NO: 1008664 - DNA, 22 bp, Homo sapiens
gcactgtgccccgcgggctttg

SEQ ID NO: 1008665 - DNA, 19 bp, Homo sapiens
gcactgtggtttcagatgt

SEQ ID NO: 1008666 - DNA, 15 bp, Homo sapiens
gcactgttcaatact

SEQ ID NO: 1008667 - DNA, 14 bp, Homo sapiens
gcactgttcacatc

SEQ ID NO: 1008668 - DNA, 20 bp, Homo sapiens
gcactgttgcaaactcagtg

SEQ ID NO: 1008669 - DNA, 13 bp, Homo sapiens
gcacttaaagaag

SEQ ID NO: 1008670 - DNA, 23 bp, Homo sapiens
gcacttaatctgtaacccccaag

SEQ ID NO: 1008671 - DNA, 23 bp, Homo sapiens
gcacttaatttgtaaacttctga

SEQ ID NO: 1008672 - DNA, 18 bp, Homo sapiens
gcacttaccgccctgcgg

SEQ ID NO: 1008673 - DNA, 15 bp, Homo sapiens
gcacttagcaggcac

SEQ ID NO: 1008674 - DNA, 18 bp, Homo sapiens
gcacttatttaatgccga

SEQ ID NO: 1008675 - DNA, 19 bp, Homo sapiens
gcacttcctccacagtccc

SEQ ID NO: 1008676 - DNA, 20 bp, Homo sapiens
gcacttcctctcgcggccct

SEQ ID NO: 1008677 - DNA, 22 bp, Homo sapiens
gcacttcgggaggtcgaggcag

SEQ ID NO: 1008678 - DNA, 21 bp, Homo sapiens
gcacttgcacgcccatgtgtg

SEQ ID NO: 1008679 - DNA, 22 bp, Homo sapiens
gcacttgcacgcccatgtgtga

SEQ ID NO: 1008680 - DNA, 20 bp, Homo sapiens
gcacttgcagaggagcccag

SEQ ID NO: 1008681 - DNA, 15 bp, Homo sapiens
gcacttgcctggaat

SEQ ID NO: 1008682 - DNA, 22 bp, Homo sapiens
gcacttgcctggaataaaatat

SEQ ID NO: 1008683 - DNA, 16 bp, Homo sapiens
gcacttgcgtcctgca

SEQ ID NO: 1008684 - DNA, 18 bp, Homo sapiens
gcacttggagacttgtat

SEQ ID NO: 1008685 - DNA, 21 bp, Homo sapiens
gcacttggcaaaaagaatccc

SEQ ID NO: 1008686 - DNA, 22 bp, Homo sapiens
gcacttgggggttcaggcccgg

SEQ ID NO: 1008687 - DNA, 15 bp, Homo sapiens
gcacttgtatatacg

SEQ ID NO: 1008688 - DNA, 11 bp, Homo sapiens
gcacttgtatt

SEQ ID NO: 1008689 - DNA, 14 bp, Homo sapiens
gcacttgtatttaa

SEQ ID NO: 1008690 - DNA, 21 bp, Homo sapiens
gcacttgtgattatttattat

SEQ ID NO: 1008691 - DNA, 22 bp, Homo sapiens
gcactttaaccctctcttccct

SEQ ID NO: 1008692 - DNA, 16 bp, Homo sapiens
gcactttaatggcctg

SEQ ID NO: 1008693 - DNA, 16 bp, Homo sapiens
gcactttataaacact

SEQ ID NO: 1008694 - DNA, 20 bp, Homo sapiens
gcactttatattttcctctt

SEQ ID NO: 1008695 - DNA, 20 bp, Homo sapiens
gcactttccacttcttcctt

SEQ ID NO: 1008696 - DNA, 15 bp, Homo sapiens
gcactttcccccttc

SEQ ID NO: 1008697 - DNA, 21 bp, Homo sapiens
gcactttgaaaatatttctat

SEQ ID NO: 1008698 - DNA, 22 bp, Homo sapiens
gcactttgaaaatatttctatg

SEQ ID NO: 1008699 - DNA, 15 bp, Homo sapiens
gcactttgcacttaa

SEQ ID NO: 1008700 - DNA, 19 bp, Homo sapiens
gcactttgggaggccaagg

SEQ ID NO: 1008701 - DNA, 22 bp, Homo sapiens
gcactttgggaggccgaggcgg

SEQ ID NO: 1008702 - DNA, 13 bp, Homo sapiens
gcactttgtaaat

SEQ ID NO: 1008703 - DNA, 16 bp, Homo sapiens
gcactttgtttagaaa

SEQ ID NO: 1008704 - DNA, 12 bp, Homo sapiens
gcacttttattt

SEQ ID NO: 1008705 - DNA, 14 bp, Homo sapiens
gcacttttgggcct

SEQ ID NO: 1008706 - DNA, 20 bp, Homo sapiens
gcactttttaattcaccaaa

SEQ ID NO: 1008707 - DNA, 20 bp, Homo sapiens
gcagaaaaaacaaaaaaact

SEQ ID NO: 1008708 - DNA, 17 bp, Homo sapiens
gcagaaaaaggctgtgc

SEQ ID NO: 1008709 - DNA, 17 bp, Homo sapiens
gcagaaaacccttgggc

SEQ ID NO: 1008710 - DNA, 22 bp, Homo sapiens
gcagaaaacccttgggccagaa

SEQ ID NO: 1008711 - DNA, 22 bp, Homo sapiens
gcagaaaacggagagtgcttgg

SEQ ID NO: 1008712 - DNA, 23 bp, Homo sapiens
gcagaaaagatgaatttgtccaa

SEQ ID NO: 1008713 - DNA, 16 bp, Homo sapiens
gcagaaaagcacctgc

SEQ ID NO: 1008714 - DNA, 18 bp, Homo sapiens
gcagaaaagcacctgccg

SEQ ID NO: 1008715 - DNA, 23 bp, Homo sapiens
gcagaaacctatctcagggaggg

SEQ ID NO: 1008716 - DNA, 23 bp, Homo sapiens
gcagaaacgaagccatctttctt

SEQ ID NO: 1008717 - DNA, 21 bp, Homo sapiens
gcagaaaggaaaacctgaaga

SEQ ID NO: 1008718 - DNA, 23 bp, Homo sapiens
gcagaaaggaaaacctgaagact

SEQ ID NO: 1008719 - DNA, 18 bp, Homo sapiens
gcagaaagtaagcatttc

SEQ ID NO: 1008720 - DNA, 16 bp, Homo sapiens
gcagaaatacagtctt

SEQ ID NO: 1008721 - DNA, 21 bp, Homo sapiens
gcagaacaaatgtgtttttct

SEQ ID NO: 1008722 - DNA, 16 bp, Homo sapiens
gcagaacactgcagtc

SEQ ID NO: 1008723 - DNA, 21 bp, Homo sapiens
gcagaacagccgctcctgtct

SEQ ID NO: 1008724 - DNA, 23 bp, Homo sapiens
gcagaacagccgctcctgtctgc

SEQ ID NO: 1008725 - DNA, 23 bp, Homo sapiens
gcagaacaggtagtattacacca

SEQ ID NO: 1008726 - DNA, 19 bp, Homo sapiens
gcagaacccaccaaccaga

SEQ ID NO: 1008727 - DNA, 19 bp, Homo sapiens
gcagaacctgcacacagga

SEQ ID NO: 1008728 - DNA, 14 bp, Homo sapiens
gcagaactctctgt

SEQ ID NO: 1008729 - DNA, 20 bp, Homo sapiens
gcagaactgaagccacttgg

SEQ ID NO: 1008730 - DNA, 14 bp, Homo sapiens
gcagaactgagctc

SEQ ID NO: 1008731 - DNA, 19 bp, Homo sapiens
gcagaactgccattatttt

SEQ ID NO: 1008732 - DNA, 23 bp, Homo sapiens
gcagaactgccattattttctgt

SEQ ID NO: 1008733 - DNA, 14 bp, Homo sapiens
gcagaagagggtgt

SEQ ID NO: 1008734 - DNA, 18 bp, Homo sapiens
gcagaagcagggtaccct

SEQ ID NO: 1008735 - DNA, 13 bp, Homo sapiens
gcagaagcattaa

SEQ ID NO: 1008736 - DNA, 14 bp, Homo sapiens
gcagaagccagaag

SEQ ID NO: 1008737 - DNA, 22 bp, Homo sapiens
gcagaagccccacagcctggca

SEQ ID NO: 1008738 - DNA, 21 bp, Homo sapiens
gcagaaggaaaaatgtgtaat

SEQ ID NO: 1008739 - DNA, 16 bp, Homo sapiens
gcagaaggaaatgatg

SEQ ID NO: 1008740 - DNA, 15 bp, Homo sapiens
gcagaagtaagcctc

SEQ ID NO: 1008741 - DNA, 19 bp, Homo sapiens
gcagaagtctggctttgct

SEQ ID NO: 1008742 - DNA, 21 bp, Homo sapiens
gcagaagtctggctttgctct

SEQ ID NO: 1008743 - DNA, 11 bp, Homo sapiens
gcagaataatg

SEQ ID NO: 1008744 - DNA, 17 bp, Homo sapiens
gcagaatagcaaggtgc

SEQ ID NO: 1008745 - DNA, 14 bp, Homo sapiens
gcagaatggaggca

SEQ ID NO: 1008746 - DNA, 21 bp, Homo sapiens
gcagaattcattcatacttaa

SEQ ID NO: 1008747 - DNA, 17 bp, Homo sapiens
gcagaattttaatgtga

SEQ ID NO: 1008748 - DNA, 18 bp, Homo sapiens
gcagaattttaatgtgaa

SEQ ID NO: 1008749 - DNA, 22 bp, Homo sapiens
gcagacaacaccttcctcctgc

SEQ ID NO: 1008750 - DNA, 24 bp, Homo sapiens
gcagacaacaccttcctcctgcag

SEQ ID NO: 1008751 - DNA, 13 bp, Homo sapiens
gcagacaagagct

SEQ ID NO: 1008752 - DNA, 14 bp, Homo sapiens
gcagacaagagctg

SEQ ID NO: 1008753 - DNA, 15 bp, Homo sapiens
gcagacaagagctgc

SEQ ID NO: 1008754 - DNA, 16 bp, Homo sapiens
gcagacaagagctgct

SEQ ID NO: 1008755 - DNA, 21 bp, Homo sapiens
gcagacacctggactgagcca

SEQ ID NO: 1008756 - DNA, 22 bp, Homo sapiens
gcagacacctggactgagccaa

SEQ ID NO: 1008757 - DNA, 16 bp, Homo sapiens
gcagacacggatctga

SEQ ID NO: 1008758 - DNA, 23 bp, Homo sapiens
gcagacacggatctgagaatctt

SEQ ID NO: 1008759 - DNA, 18 bp, Homo sapiens
gcagacagagccaggaga

SEQ ID NO: 1008760 - DNA, 14 bp, Homo sapiens
gcagacagcagctc

SEQ ID NO: 1008761 - DNA, 17 bp, Homo sapiens
gcagacagcagctcagg

SEQ ID NO: 1008762 - DNA, 19 bp, Homo sapiens
gcagacagccatgcgtggc

SEQ ID NO: 1008763 - DNA, 22 bp, Homo sapiens
gcagacaggccatgtgagccac

SEQ ID NO: 1008764 - DNA, 20 bp, Homo sapiens
gcagacaggccccgtgaggc

SEQ ID NO: 1008765 - DNA, 22 bp, Homo sapiens
gcagacatctctggagccagag

SEQ ID NO: 1008766 - DNA, 15 bp, Homo sapiens
gcagacatgccttgg

SEQ ID NO: 1008767 - DNA, 16 bp, Homo sapiens
gcagacatgccttggt

SEQ ID NO: 1008768 - DNA, 20 bp, Homo sapiens
gcagacatgccttggtgccg

SEQ ID NO: 1008769 - DNA, 19 bp, Homo sapiens
gcagacattctcaaagcct

SEQ ID NO: 1008770 - DNA, 21 bp, Homo sapiens
gcagaccaccccgcctgccct

SEQ ID NO: 1008771 - DNA, 23 bp, Homo sapiens
gcagaccacgcccgtcctgcctg

SEQ ID NO: 1008772 - DNA, 12 bp, Homo sapiens
cctgccagctgc

SEQ ID NO: 1008773 - DNA, 14 bp, Homo sapiens
cctgccagctgcct

SEQ ID NO: 1008774 - DNA, 16 bp, Homo sapiens
cctgccagctgccttc

SEQ ID NO: 1008775 - DNA, 21 bp, Homo sapiens
cctgccaggcacacacagccc

SEQ ID NO: 1008776 - DNA, 17 bp, Homo sapiens
cctgccagtgaagtcct

SEQ ID NO: 1008777 - DNA, 20 bp, Homo sapiens
cctgccagtgaagtccttca

SEQ ID NO: 1008778 - DNA, 12 bp, Homo sapiens
cctgccagtgcc

SEQ ID NO: 1008779 - DNA, 14 bp, Homo sapiens
cctgccagtgccag

SEQ ID NO: 1008780 - DNA, 18 bp, Homo sapiens
cctgccagtgccagggtg

SEQ ID NO: 1008781 - DNA, 18 bp, Homo sapiens
cctgccagtgccttacct

SEQ ID NO: 1008782 - DNA, 19 bp, Homo sapiens
cctgccagttgaaaatgga

SEQ ID NO: 1008783 - DNA, 22 bp, Homo sapiens
cctgccatccccctctcacgcc

SEQ ID NO: 1008784 - DNA, 13 bp, Homo sapiens
cctgccatcctca

SEQ ID NO: 1008785 - DNA, 16 bp, Homo sapiens
cctgccatcttcccag

SEQ ID NO: 1008786 - DNA, 17 bp, Homo sapiens
cctgccattggcctctt

SEQ ID NO: 1008787 - DNA, 14 bp, Homo sapiens
cctgccatttaaaa

SEQ ID NO: 1008788 - DNA, 22 bp, Homo sapiens
cctgcccaaacagctgtattta

SEQ ID NO: 1008789 - DNA, 17 bp, Homo sapiens
cctgcccaaacccttaa

SEQ ID NO: 1008790 - DNA, 23 bp, Homo sapiens
cctgcccaagggcctcccaccag

SEQ ID NO: 1008791 - DNA, 23 bp, Homo sapiens
cctgcccaatgagactctagggt

SEQ ID NO: 1008792 - DNA, 17 bp, Homo sapiens
cctgcccaatgctttgg

SEQ ID NO: 1008793 - DNA, 14 bp, Homo sapiens
cctgcccacccccg

SEQ ID NO: 1008794 - DNA, 13 bp, Homo sapiens
cctgcccacccta

SEQ ID NO: 1008795 - DNA, 17 bp, Homo sapiens
cctgcccaccctaccag

SEQ ID NO: 1008796 - DNA, 23 bp, Homo sapiens
cctgcccaccctaccagctcctc

SEQ ID NO: 1008797 - DNA, 12 bp, Homo sapiens
cctgcccacctc

SEQ ID NO: 1008798 - DNA, 18 bp, Homo sapiens
cctgcccacctctccctg

SEQ ID NO: 1008799 - DNA, 22 bp, Homo sapiens
cctgcccacgcagacctgcagc

SEQ ID NO: 1008800 - DNA, 17 bp, Homo sapiens
cctgcccactgctgcag

SEQ ID NO: 1008801 - DNA, 16 bp, Homo sapiens
cctgcccagactgatg

SEQ ID NO: 1008802 - DNA, 22 bp, Homo sapiens
cctgcccagactgatgagcaca

SEQ ID NO: 1008803 - DNA, 14 bp, Homo sapiens
cctgcccagcctca

SEQ ID NO: 1008804 - DNA, 15 bp, Homo sapiens
cctgcccagcctcaa

SEQ ID NO: 1008805 - DNA, 16 bp, Homo sapiens
cctgcccagcctcaat

SEQ ID NO: 1008806 - DNA, 17 bp, Homo sapiens
cctgcccagcctcaatg

SEQ ID NO: 1008807 - DNA, 13 bp, Homo sapiens
cctgcccagcctg

SEQ ID NO: 1008808 - DNA, 14 bp, Homo sapiens
cctgcccagctcct

SEQ ID NO: 1008809 - DNA, 17 bp, Homo sapiens
cctgcccagctcctcac

SEQ ID NO: 1008810 - DNA, 15 bp, Homo sapiens
cctgcccaggactgc

SEQ ID NO: 1008811 - DNA, 12 bp, Homo sapiens
cctgcccaggag

SEQ ID NO: 1008812 - DNA, 20 bp, Homo sapiens
cctgcccaggagagccagcc

SEQ ID NO: 1008813 - DNA, 21 bp, Homo sapiens
cctgcccaggtggcctcctgg

SEQ ID NO: 1008814 - DNA, 12 bp, Homo sapiens
cctgcccagtgt

SEQ ID NO: 1008815 - DNA, 22 bp, Homo sapiens
cctgcccagttgcactcaggtg

SEQ ID NO: 1008816 - DNA, 18 bp, Homo sapiens
cctgcccatactgagcct

SEQ ID NO: 1008817 - DNA, 19 bp, Homo sapiens
cctgcccatactgagcctg

SEQ ID NO: 1008818 - DNA, 16 bp, Homo sapiens
cctgcccatccgtctg

SEQ ID NO: 1008819 - DNA, 17 bp, Homo sapiens
cctgcccatgccccagt

SEQ ID NO: 1008820 - DNA, 16 bp, Homo sapiens
cctgcccatgggagct

SEQ ID NO: 1008821 - DNA, 23 bp, Homo sapiens
cctgcccatgtcgcgctcagcat

SEQ ID NO: 1008822 - DNA, 11 bp, Homo sapiens
cctgccccaca

SEQ ID NO: 1008823 - DNA, 19 bp, Homo sapiens
cctgccccaccccatccag

SEQ ID NO: 1008824 - DNA, 13 bp, Homo sapiens
cctgccccagccc

SEQ ID NO: 1008825 - DNA, 15 bp, Homo sapiens
cctgccccaggcctg

SEQ ID NO: 1008826 - DNA, 13 bp, Homo sapiens
cctgcccccaagt

SEQ ID NO: 1008827 - DNA, 15 bp, Homo sapiens
cctgcccccaatcca

SEQ ID NO: 1008828 - DNA, 15 bp, Homo sapiens
cctgcccccagcccc

SEQ ID NO: 1008829 - DNA, 21 bp, Homo sapiens
cctgcccccatctccccaggc

SEQ ID NO: 1008830 - DNA, 17 bp, Homo sapiens
cctgccccccagcctct

SEQ ID NO: 1008831 - DNA, 17 bp, Homo sapiens
cctgccccctgccagcc

SEQ ID NO: 1008832 - DNA, 18 bp, Homo sapiens
cctgccccctgccagccg

SEQ ID NO: 1008833 - DNA, 13 bp, Homo sapiens
cctgccccctggg

SEQ ID NO: 1008834 - DNA, 23 bp, Homo sapiens
cctgccccctgggctggggcctc

SEQ ID NO: 1008835 - DNA, 14 bp, Homo sapiens
cctgccccctggtg

SEQ ID NO: 1008836 - DNA, 16 bp, Homo sapiens
cctgccccctggtgga

SEQ ID NO: 1008837 - DNA, 16 bp, Homo sapiens
cctgcccccttctccc

SEQ ID NO: 1008838 - DNA, 19 bp, Homo sapiens
cctgcccccttctcccaca

SEQ ID NO: 1008839 - DNA, 16 bp, Homo sapiens
cctgccccgcccagct

SEQ ID NO: 1008840 - DNA, 20 bp, Homo sapiens
cctgccccgccttcgtgtgc

SEQ ID NO: 1008841 - DNA, 19 bp, Homo sapiens
cctgccccggacctacctc

SEQ ID NO: 1008842 - DNA, 15 bp, Homo sapiens
cctgcccctaagtta

SEQ ID NO: 1008843 - DNA, 12 bp, Homo sapiens
cctgcccctagg

SEQ ID NO: 1008844 - DNA, 22 bp, Homo sapiens
cctgcccctaggatgctgcagc

SEQ ID NO: 1008845 - DNA, 23 bp, Homo sapiens
cctgcccctaggatgctgcagca

SEQ ID NO: 1008846 - DNA, 20 bp, Homo sapiens
cctgcccctccccaaaagaa

SEQ ID NO: 1008847 - DNA, 21 bp, Homo sapiens
cctgcccctccccaaaagaaa

SEQ ID NO: 1008848 - DNA, 22 bp, Homo sapiens
cctgcccctccccaaaagaaac

SEQ ID NO: 1008849 - DNA, 16 bp, Homo sapiens
cctgcccctcccttca

SEQ ID NO: 1008850 - DNA, 17 bp, Homo sapiens
cctgcccctctgttctc

SEQ ID NO: 1008851 - DNA, 17 bp, Homo sapiens
cctgcccctctttctct

SEQ ID NO: 1008852 - DNA, 18 bp, Homo sapiens
cctgcccctctttctctt

SEQ ID NO: 1008853 - DNA, 20 bp, Homo sapiens
cctgcccctctttctctttc

SEQ ID NO: 1008854 - DNA, 10 bp, Homo sapiens
cctgcccctg

SEQ ID NO: 1008855 - DNA, 17 bp, Homo sapiens
cctgcccctgccccgtc

SEQ ID NO: 1008856 - DNA, 13 bp, Homo sapiens
cctgcccctgcct

SEQ ID NO: 1008857 - DNA, 17 bp, Homo sapiens
cctgccccttaacccca

SEQ ID NO: 1008858 - DNA, 16 bp, Homo sapiens
cctgccccttccttta

SEQ ID NO: 1008859 - DNA, 16 bp, Homo sapiens
cctgcccgctgcaatg

SEQ ID NO: 1008860 - DNA, 18 bp, Homo sapiens
cctgcccggggagctgca

SEQ ID NO: 1008861 - DNA, 21 bp, Homo sapiens
cctgcccggggagctgcagag

SEQ ID NO: 1008862 - DNA, 22 bp, Homo sapiens
cctgcccggtggtttgccatgt

SEQ ID NO: 1008863 - DNA, 23 bp, Homo sapiens
cctgccctacagaggtctctgcc

SEQ ID NO: 1008864 - DNA, 19 bp, Homo sapiens
cctgccctagagcacactg

SEQ ID NO: 1008865 - DNA, 16 bp, Homo sapiens
cctgccctcactccct

SEQ ID NO: 1008866 - DNA, 18 bp, Homo sapiens
cctgccctcactccctct

SEQ ID NO: 1008867 - DNA, 21 bp, Homo sapiens
cctgccctcactccctctgca

SEQ ID NO: 1008868 - DNA, 14 bp, Homo sapiens
cctgccctcaggga

SEQ ID NO: 1008869 - DNA, 14 bp, Homo sapiens
cctgccctccccag

SEQ ID NO: 1008870 - DNA, 15 bp, Homo sapiens
cctgccctccccaga

SEQ ID NO: 1008871 - DNA, 19 bp, Homo sapiens
cctgccctccccagagcac

SEQ ID NO: 1008872 - DNA, 21 bp, Homo sapiens
cctgccctccccagagcactg

SEQ ID NO: 1008873 - DNA, 22 bp, Homo sapiens
cctgccctccccagagcactgg

SEQ ID NO: 1008874 - DNA, 16 bp, Homo sapiens
cctgccctcccctgtc

SEQ ID NO: 1008875 - DNA, 15 bp, Homo sapiens
cctgccctcccgcac

SEQ ID NO: 1008876 - DNA, 18 bp, Homo sapiens
cctgccctcccgcacctt

SEQ ID NO: 1008877 - DNA, 12 bp, Homo sapiens
cctgccctcgtg

SEQ ID NO: 1008878 - DNA, 13 bp, Homo sapiens
cctgccctcgtgg

SEQ ID NO: 1008879 - DNA, 14 bp, Homo sapiens
cctgccctcgtggc

SEQ ID NO: 1008880 - DNA, 17 bp, Homo sapiens
cctgccctcgtggccag

SEQ ID NO: 1008881 - DNA, 20 bp, Homo sapiens
cctgccctcgtggccagccc

SEQ ID NO: 1008882 - DNA, 13 bp, Homo sapiens
cctgccctctgct

SEQ ID NO: 1008883 - DNA, 16 bp, Homo sapiens
cctgccctctgctctg

SEQ ID NO: 1008884 - DNA, 22 bp, Homo sapiens
cctgccctctgctctgcctgga

SEQ ID NO: 1008885 - DNA, 12 bp, Homo sapiens
cctgccctgcac

SEQ ID NO: 1008886 - DNA, 17 bp, Homo sapiens
cctgccctgcccaagtg

SEQ ID NO: 1008887 - DNA, 15 bp, Homo sapiens
cctgccctgccccct

SEQ ID NO: 1008888 - DNA, 14 bp, Homo sapiens
cctgccctgcctga

SEQ ID NO: 1008889 - DNA, 15 bp, Homo sapiens
cctgccctgcctgag

SEQ ID NO: 1008890 - DNA, 15 bp, Homo sapiens
cctgccctgcctggg

SEQ ID NO: 1008891 - DNA, 21 bp, Homo sapiens
cctgccctgccttgccgctcc

SEQ ID NO: 1008892 - DNA, 15 bp, Homo sapiens
cctgccctggtccag

SEQ ID NO: 1008893 - DNA, 13 bp, Homo sapiens
cctgccctgtcca

SEQ ID NO: 1008894 - DNA, 14 bp, Homo sapiens
cctgccctgtccaa

SEQ ID NO: 1008895 - DNA, 16 bp, Homo sapiens
cctgccctgtccctgt

SEQ ID NO: 1008896 - DNA, 17 bp, Homo sapiens
cctgccctgtccctgtc

SEQ ID NO: 1008897 - DNA, 21 bp, Homo sapiens
cctgccctgttgtgtatagat

SEQ ID NO: 1008898 - DNA, 22 bp, Homo sapiens
gcagaccatgaagtaaattatg

SEQ ID NO: 1008899 - DNA, 19 bp, Homo sapiens
gcagacccagtcccacact

SEQ ID NO: 1008900 - DNA, 17 bp, Homo sapiens
gcagaccgtgatttgga

SEQ ID NO: 1008901 - DNA, 12 bp, Homo sapiens
gcagacctcaag

SEQ ID NO: 1008902 - DNA, 13 bp, Homo sapiens
gcagacctcactg

SEQ ID NO: 1008903 - DNA, 18 bp, Homo sapiens
gcagacctcactgtcagg

SEQ ID NO: 1008904 - DNA, 22 bp, Homo sapiens
gcagacctcactgtcagggtct

SEQ ID NO: 1008905 - DNA, 21 bp, Homo sapiens
gcagacctcatgcccagctct

SEQ ID NO: 1008906 - DNA, 20 bp, Homo sapiens
gcagaccttactcaggggat

SEQ ID NO: 1008907 - DNA, 19 bp, Homo sapiens
gcagacgggaatgcctagg

SEQ ID NO: 1008908 - DNA, 19 bp, Homo sapiens
gcagacggtctgtgtgctg

SEQ ID NO: 1008909 - DNA, 21 bp, Homo sapiens
gcagacggtctgtgtgctgtt

SEQ ID NO: 1008910 - DNA, 23 bp, Homo sapiens
gcagacggtctgtgtgctgtttg

SEQ ID NO: 1008911 - DNA, 16 bp, Homo sapiens
gcagactacacaggat

SEQ ID NO: 1008912 - DNA, 23 bp, Homo sapiens
gcagactagagtctgagatgccc

SEQ ID NO: 1008913 - DNA, 16 bp, Homo sapiens
gcagactcagctctga

SEQ ID NO: 1008914 - DNA, 17 bp, Homo sapiens
gcagactccagcccctg

SEQ ID NO: 1008915 - DNA, 16 bp, Homo sapiens
gcagactcctcagatc

SEQ ID NO: 1008916 - DNA, 20 bp, Homo sapiens
gcagactgatgggacatcaa

SEQ ID NO: 1008917 - DNA, 16 bp, Homo sapiens
gcagactgcttggcca

SEQ ID NO: 1008918 - DNA, 18 bp, Homo sapiens
gcagactgcttggccaga

SEQ ID NO: 1008919 - DNA, 19 bp, Homo sapiens
gcagactgcttggccagat

SEQ ID NO: 1008920 - DNA, 18 bp, Homo sapiens
gcagacttcccagctagg

SEQ ID NO: 1008921 - DNA, 19 bp, Homo sapiens
gcagactttcccaaatgta

SEQ ID NO: 1008922 - DNA, 13 bp, Homo sapiens
gcagagaaagaaa

SEQ ID NO: 1008923 - DNA, 23 bp, Homo sapiens
gcagagaaagaaagggaaactgg

SEQ ID NO: 1008924 - DNA, 16 bp, Homo sapiens
gcagagaaagaagaga

SEQ ID NO: 1008925 - DNA, 22 bp, Homo sapiens
gcagagaaagaagagacaggag

SEQ ID NO: 1008926 - DNA, 23 bp, Homo sapiens
gcagagaaagaagagacaggagg

SEQ ID NO: 1008927 - DNA, 19 bp, Homo sapiens
gcagagaatggctgggtca

SEQ ID NO: 1008928 - DNA, 20 bp, Homo sapiens
gcagagaatggctgggtcag

SEQ ID NO: 1008929 - DNA, 21 bp, Homo sapiens
gcagagaattctcttatccaa

SEQ ID NO: 1008930 - DNA, 16 bp, Homo sapiens
gcagagagaagcctgt

SEQ ID NO: 1008931 - DNA, 18 bp, Homo sapiens
gcagagagagaggacaga

SEQ ID NO: 1008932 - DNA, 11 bp, Homo sapiens
gcagagagagc

SEQ ID NO: 1008933 - DNA, 20 bp, Homo sapiens
gcagagagatgcggccaaga

SEQ ID NO: 1008934 - DNA, 17 bp, Homo sapiens
gcagagcaaatgaggga

SEQ ID NO: 1008935 - DNA, 18 bp, Homo sapiens
gcagagcaataacactat

SEQ ID NO: 1008936 - DNA, 21 bp, Homo sapiens
gcagagcaataacactatatt

SEQ ID NO: 1008937 - DNA, 20 bp, Homo sapiens
gcagagcacaaacttcagaa

SEQ ID NO: 1008938 - DNA, 16 bp, Homo sapiens
gcagagcacagcccac

SEQ ID NO: 1008939 - DNA, 18 bp, Homo sapiens
gcagagcagcagcacctt

SEQ ID NO: 1008940 - DNA, 15 bp, Homo sapiens
gcagagccaaggcca

SEQ ID NO: 1008941 - DNA, 16 bp, Homo sapiens
gcagagccaggaagat

SEQ ID NO: 1008942 - DNA, 17 bp, Homo sapiens
gcagagccatgggcctg

SEQ ID NO: 1008943 - DNA, 19 bp, Homo sapiens
gcagagccatgggcctggg

SEQ ID NO: 1008944 - DNA, 20 bp, Homo sapiens
gcagagccatgggcctgggc

SEQ ID NO: 1008945 - DNA, 15 bp, Homo sapiens
gcagagcccaccagc

SEQ ID NO: 1008946 - DNA, 18 bp, Homo sapiens
gcagagcccaccagccag

SEQ ID NO: 1008947 - DNA, 22 bp, Homo sapiens
gcagagcccaccagccagccct

SEQ ID NO: 1008948 - DNA, 23 bp, Homo sapiens
gcagagcccggccccacctccct

SEQ ID NO: 1008949 - DNA, 13 bp, Homo sapiens
gcagagcctcctg

SEQ ID NO: 1008950 - DNA, 14 bp, Homo sapiens
gcagagcctctgag

SEQ ID NO: 1008951 - DNA, 13 bp, Homo sapiens
gcagagcctgtcc

SEQ ID NO: 1008952 - DNA, 17 bp, Homo sapiens
gcagagctgagggccct

SEQ ID NO: 1008953 - DNA, 14 bp, Homo sapiens
gcagagctggagcc

SEQ ID NO: 1008954 - DNA, 13 bp, Homo sapiens
gcagagctggctc

SEQ ID NO: 1008955 - DNA, 12 bp, Homo sapiens
gcagaggaatgt

SEQ ID NO: 1008956 - DNA, 20 bp, Homo sapiens
gcagaggaatttggctgctt

SEQ ID NO: 1008957 - DNA, 16 bp, Homo sapiens
gcagaggaccacagtg

SEQ ID NO: 1008958 - DNA, 13 bp, Homo sapiens
gcagaggagccca

SEQ ID NO: 1008959 - DNA, 15 bp, Homo sapiens
gcagaggagcccagt

SEQ ID NO: 1008960 - DNA, 18 bp, Homo sapiens
gcagaggagcccagtggg

SEQ ID NO: 1008961 - DNA, 21 bp, Homo sapiens
gcagaggagcccagtgggctg

SEQ ID NO: 1008962 - DNA, 14 bp, Homo sapiens
gcagaggaggggcc

SEQ ID NO: 1008963 - DNA, 15 bp, Homo sapiens
gcagaggaggggccg

SEQ ID NO: 1008964 - DNA, 16 bp, Homo sapiens
gcagaggatgttcata

SEQ ID NO: 1008965 - DNA, 12 bp, Homo sapiens
gcagaggccaga

SEQ ID NO: 1008966 - DNA, 15 bp, Homo sapiens
gcagaggccagaggc

SEQ ID NO: 1008967 - DNA, 22 bp, Homo sapiens
gcagaggcctgggctgggaaaa

SEQ ID NO: 1008968 - DNA, 21 bp, Homo sapiens
gcagaggctggaggcagggcc

SEQ ID NO: 1008969 - DNA, 22 bp, Homo sapiens
gcagaggctggcaccatggtga

SEQ ID NO: 1008970 - DNA, 11 bp, Homo sapiens
gcagaggctgt

SEQ ID NO: 1008971 - DNA, 18 bp, Homo sapiens
gcagaggctgtggctggt

SEQ ID NO: 1008972 - DNA, 14 bp, Homo sapiens
gcagaggctttggg

SEQ ID NO: 1008973 - DNA, 21 bp, Homo sapiens
gcagagggaatgttccctgca

SEQ ID NO: 1008974 - DNA, 14 bp, Homo sapiens
gcagagggaggaag

SEQ ID NO: 1008975 - DNA, 16 bp, Homo sapiens
gcagagggcagaggct

SEQ ID NO: 1008976 - DNA, 12 bp, Homo sapiens
gcagagggctgg

SEQ ID NO: 1008977 - DNA, 14 bp, Homo sapiens
gcagaggggcagcc

SEQ ID NO: 1008978 - DNA, 16 bp, Homo sapiens
gcagaggggctttctg

SEQ ID NO: 1008979 - DNA, 19 bp, Homo sapiens
gcagaggggctttctggag

SEQ ID NO: 1008980 - DNA, 19 bp, Homo sapiens
gcagaggggtaggcagagc

SEQ ID NO: 1008981 - DNA, 13 bp, Homo sapiens
gcagaggtaaaag

SEQ ID NO: 1008982 - DNA, 21 bp, Homo sapiens
gcagaggtccacaacacacag

SEQ ID NO: 1008983 - DNA, 20 bp, Homo sapiens
gcagaggtcccagccccagg

SEQ ID NO: 1008984 - DNA, 21 bp, Homo sapiens
gcagaggtcccagccccaggc

SEQ ID NO: 1008985 - DNA, 19 bp, Homo sapiens
gcagaggtctccaaactga

SEQ ID NO: 1008986 - DNA, 15 bp, Homo sapiens
gcagaggtctgtgct

SEQ ID NO: 1008987 - DNA, 13 bp, Homo sapiens
gcagaggtgcaag

SEQ ID NO: 1008988 - DNA, 21 bp, Homo sapiens
gcagaggttttaatgtctgtt

SEQ ID NO: 1008989 - DNA, 12 bp, Homo sapiens
gcagagtctggg

SEQ ID NO: 1008990 - DNA, 20 bp, Homo sapiens
gcagagtgagcaagggggcc

SEQ ID NO: 1008991 - DNA, 22 bp, Homo sapiens
gcagagtgagcaagggggccca

SEQ ID NO: 1008992 - DNA, 17 bp, Homo sapiens
gcagagtggactgcatt

SEQ ID NO: 1008993 - DNA, 18 bp, Homo sapiens
gcagagtgggacttggag

SEQ ID NO: 1008994 - DNA, 18 bp, Homo sapiens
gcagagttacagttctgt

SEQ ID NO: 1008995 - DNA, 21 bp, Homo sapiens
gcagagttctcctggaggcag

SEQ ID NO: 1008996 - DNA, 16 bp, Homo sapiens
gcagagttgtaaatat

SEQ ID NO: 1008997 - DNA, 13 bp, Homo sapiens
gcagagtttgcct

SEQ ID NO: 1008998 - DNA, 20 bp, Homo sapiens
gcagagtttgtgtgttgtct

SEQ ID NO: 1008999 - DNA, 24 bp, Homo sapiens
gcagagtttgtgtgttgtcttgaa

SEQ ID NO: 1009000 - DNA, 18 bp, Homo sapiens
gcagataatcagcctctt

SEQ ID NO: 1009001 - DNA, 19 bp, Homo sapiens
gcagataatcagcctctta

SEQ ID NO: 1009002 - DNA, 19 bp, Homo sapiens
gcagataattctggaccag

SEQ ID NO: 1009003 - DNA, 15 bp, Homo sapiens
gcagatagcccagga

SEQ ID NO: 1009004 - DNA, 17 bp, Homo sapiens
gcagatagcccaggagc

SEQ ID NO: 1009005 - DNA, 18 bp, Homo sapiens
gcagatagcccaggagca

SEQ ID NO: 1009006 - DNA, 16 bp, Homo sapiens
gcagatcctctggaca

SEQ ID NO: 1009007 - DNA, 16 bp, Homo sapiens
gcagatcttttcttta

SEQ ID NO: 1009008 - DNA, 17 bp, Homo sapiens
gcagatcttttctttaa

SEQ ID NO: 1009009 - DNA, 17 bp, Homo sapiens
gcagatgactgagaaca

SEQ ID NO: 1009010 - DNA, 16 bp, Homo sapiens
gcagatgccagtgaag

SEQ ID NO: 1009011 - DNA, 11 bp, Homo sapiens
gcagatgctgc

SEQ ID NO: 1009012 - DNA, 21 bp, Homo sapiens
gcagatgctgctgaagagagg

SEQ ID NO: 1009013 - DNA, 15 bp, Homo sapiens
gcagatggaaagaaa

SEQ ID NO: 1009014 - DNA, 14 bp, Homo sapiens
gcagatgggtgcta

SEQ ID NO: 1009015 - DNA, 18 bp, Homo sapiens
gcagatgtattgactgta

SEQ ID NO: 1009016 - DNA, 15 bp, Homo sapiens
gcagatgtcccccac

SEQ ID NO: 1009017 - DNA, 22 bp, Homo sapiens
gcagatgtcttccctgggctgc

SEQ ID NO: 1009018 - DNA, 15 bp, Homo sapiens
gcagatgtgagccac

SEQ ID NO: 1009019 - DNA, 15 bp, Homo sapiens
gcagattacactgat

SEQ ID NO: 1009020 - DNA, 20 bp, Homo sapiens
gcagattcatttttctttct

SEQ ID NO: 1009021 - DNA, 13 bp, Homo sapiens
gcagattcctggg

SEQ ID NO: 1009022 - DNA, 14 bp, Homo sapiens
cctgcccttccctc

SEQ ID NO: 1009023 - DNA, 18 bp, Homo sapiens
cctgcccttccctctggg

SEQ ID NO: 1009024 - DNA, 19 bp, Homo sapiens
cctgcccttccctctgggc

SEQ ID NO: 1009025 - DNA, 17 bp, Homo sapiens
cctgcccttcctcaggg

SEQ ID NO: 1009026 - DNA, 18 bp, Homo sapiens
cctgccgacctcgtcctc

SEQ ID NO: 1009027 - DNA, 14 bp, Homo sapiens
cctgccgactcctg

SEQ ID NO: 1009028 - DNA, 16 bp, Homo sapiens
cctgccgactcctggg

SEQ ID NO: 1009029 - DNA, 12 bp, Homo sapiens
cctgccgagggg

SEQ ID NO: 1009030 - DNA, 18 bp, Homo sapiens
cctgccggtgggaccctg

SEQ ID NO: 1009031 - DNA, 22 bp, Homo sapiens
cctgccgtcaccaccaccccta

SEQ ID NO: 1009032 - DNA, 14 bp, Homo sapiens
cctgccgtgcatgg

SEQ ID NO: 1009033 - DNA, 18 bp, Homo sapiens
cctgccgtgcatggctcc

SEQ ID NO: 1009034 - DNA, 20 bp, Homo sapiens
cctgccgtgcatggctcctg

SEQ ID NO: 1009035 - DNA, 22 bp, Homo sapiens
cctgcctacacacacagcctat

SEQ ID NO: 1009036 - DNA, 21 bp, Homo sapiens
cctgcctaggaattcccagcc

SEQ ID NO: 1009037 - DNA, 19 bp, Homo sapiens
cctgcctattatctgtcag

SEQ ID NO: 1009038 - DNA, 17 bp, Homo sapiens
cctgcctcacccacacc

SEQ ID NO: 1009039 - DNA, 12 bp, Homo sapiens
cctgcctcagcc

SEQ ID NO: 1009040 - DNA, 16 bp, Homo sapiens
cctgcctcagccaggc

SEQ ID NO: 1009041 - DNA, 13 bp, Homo sapiens
cctgcctcagcct

SEQ ID NO: 1009042 - DNA, 16 bp, Homo sapiens
cctgcctcagcctccc

SEQ ID NO: 1009043 - DNA, 12 bp, Homo sapiens
cctgcctcagga

SEQ ID NO: 1009044 - DNA, 13 bp, Homo sapiens
cctgcctccaccc

SEQ ID NO: 1009045 - DNA, 20 bp, Homo sapiens
cctgcctccaggaaccacac

SEQ ID NO: 1009046 - DNA, 20 bp, Homo sapiens
cctgcctcccacttcactgc

SEQ ID NO: 1009047 - DNA, 17 bp, Homo sapiens
cctgcctcccatgcctg

SEQ ID NO: 1009048 - DNA, 17 bp, Homo sapiens
cctgcctcccattctgc

SEQ ID NO: 1009049 - DNA, 12 bp, Homo sapiens
cctgcctccctt

SEQ ID NO: 1009050 - DNA, 11 bp, Homo sapiens
cctgcctcctc

SEQ ID NO: 1009051 - DNA, 20 bp, Homo sapiens
cctgcctcctccctcccagc

SEQ ID NO: 1009052 - DNA, 21 bp, Homo sapiens
cctgcctcctccctcccagct

SEQ ID NO: 1009053 - DNA, 22 bp, Homo sapiens
cctgcctcctccctcccagctg

SEQ ID NO: 1009054 - DNA, 15 bp, Homo sapiens
cctgcctcctgccac

SEQ ID NO: 1009055 - DNA, 16 bp, Homo sapiens
cctgcctcctgccacc

SEQ ID NO: 1009056 - DNA, 19 bp, Homo sapiens
cctgcctcctgccacccct

SEQ ID NO: 1009057 - DNA, 16 bp, Homo sapiens
cctgcctcgagggccg

SEQ ID NO: 1009058 - DNA, 18 bp, Homo sapiens
cctgcctcgagggccgcc

SEQ ID NO: 1009059 - DNA, 23 bp, Homo sapiens
cctgcctcgagggccgcctgcct

SEQ ID NO: 1009060 - DNA, 20 bp, Homo sapiens
cctgcctctcatcaactgaa

SEQ ID NO: 1009061 - DNA, 13 bp, Homo sapiens
cctgcctctgacc

SEQ ID NO: 1009062 - DNA, 19 bp, Homo sapiens
cctgcctctgaccccagca

SEQ ID NO: 1009063 - DNA, 22 bp, Homo sapiens
cctgcctcttgtttctgtgccc

SEQ ID NO: 1009064 - DNA, 14 bp, Homo sapiens
cctgcctgacagcc

SEQ ID NO: 1009065 - DNA, 13 bp, Homo sapiens
cctgcctgagccc

SEQ ID NO: 1009066 - DNA, 16 bp, Homo sapiens
cctgcctgaggaggag

SEQ ID NO: 1009067 - DNA, 13 bp, Homo sapiens
cctgcctgagggc

SEQ ID NO: 1009068 - DNA, 18 bp, Homo sapiens
cctgcctgagggcccctc

SEQ ID NO: 1009069 - DNA, 20 bp, Homo sapiens
cctgcctgagggcccctctg

SEQ ID NO: 1009070 - DNA, 21 bp, Homo sapiens
cctgcctgagggcccctctgc

SEQ ID NO: 1009071 - DNA, 22 bp, Homo sapiens
cctgcctgagggcccctctgcc

SEQ ID NO: 1009072 - DNA, 13 bp, Homo sapiens
cctgcctgccacc

SEQ ID NO: 1009073 - DNA, 18 bp, Homo sapiens
cctgcctgccctgcctca

SEQ ID NO: 1009074 - DNA, 17 bp, Homo sapiens
cctgcctgccgctgcac

SEQ ID NO: 1009075 - DNA, 11 bp, Homo sapiens
cctgcctgcct

SEQ ID NO: 1009076 - DNA, 14 bp, Homo sapiens
cctgcctggcaggc

SEQ ID NO: 1009077 - DNA, 11 bp, Homo sapiens
cctgcctggcc

SEQ ID NO: 1009078 - DNA, 22 bp, Homo sapiens
cctgcctggccaggcagatctg

SEQ ID NO: 1009079 - DNA, 17 bp, Homo sapiens
cctgcctgtcacctggg

SEQ ID NO: 1009080 - DNA, 15 bp, Homo sapiens
cctgcctgtctgccc

SEQ ID NO: 1009081 - DNA, 22 bp, Homo sapiens
cctgcctgttggcaggcccact

SEQ ID NO: 1009082 - DNA, 20 bp, Homo sapiens
cctgccttagcaatgggggc

SEQ ID NO: 1009083 - DNA, 10 bp, Homo sapiens
cctgccttcc

SEQ ID NO: 1009084 - DNA, 14 bp, Homo sapiens
cctgccttcctcct

SEQ ID NO: 1009085 - DNA, 15 bp, Homo sapiens
cctgccttcctctga

SEQ ID NO: 1009086 - DNA, 14 bp, Homo sapiens
cctgccttcgttaa

SEQ ID NO: 1009087 - DNA, 13 bp, Homo sapiens
cctgccttgaagc

SEQ ID NO: 1009088 - DNA, 21 bp, Homo sapiens
cctgccttgaagccactgaag

SEQ ID NO: 1009089 - DNA, 22 bp, Homo sapiens
cctgccttgaagccactgaagc

SEQ ID NO: 1009090 - DNA, 20 bp, Homo sapiens
cctgccttgccgctcccctt

SEQ ID NO: 1009091 - DNA, 11 bp, Homo sapiens
cctgccttggc

SEQ ID NO: 1009092 - DNA, 20 bp, Homo sapiens
cctgccttggcctcccaaag

SEQ ID NO: 1009093 - DNA, 22 bp, Homo sapiens
cctgccttgtttatagccactt

SEQ ID NO: 1009094 - DNA, 16 bp, Homo sapiens
cctgcctttaagccaa

SEQ ID NO: 1009095 - DNA, 20 bp, Homo sapiens
cctgcgagacccaaggctca

SEQ ID NO: 1009096 - DNA, 21 bp, Homo sapiens
cctgcgagacgcacacagctg

SEQ ID NO: 1009097 - DNA, 18 bp, Homo sapiens
cctgcgattttgcctgtg

SEQ ID NO: 1009098 - DNA, 17 bp, Homo sapiens
cctgcgcccagagctgg

SEQ ID NO: 1009099 - DNA, 20 bp, Homo sapiens
cctgcgcccagagctggcct

SEQ ID NO: 1009100 - DNA, 18 bp, Homo sapiens
cctgcgcccagtccttcc

SEQ ID NO: 1009101 - DNA, 21 bp, Homo sapiens
cctgcgccctgacatgctaac

SEQ ID NO: 1009102 - DNA, 19 bp, Homo sapiens
cctgcgcccttgaggggcc

SEQ ID NO: 1009103 - DNA, 14 bp, Homo sapiens
cctgcgcctccaga

SEQ ID NO: 1009104 - DNA, 15 bp, Homo sapiens
cctgcgcctccatcc

SEQ ID NO: 1009105 - DNA, 16 bp, Homo sapiens
cctgcgcctccatcca

SEQ ID NO: 1009106 - DNA, 21 bp, Homo sapiens
cctgcgcctccatccatctgt

SEQ ID NO: 1009107 - DNA, 13 bp, Homo sapiens
cctgcgcctgctg

SEQ ID NO: 1009108 - DNA, 15 bp, Homo sapiens
cctgcgcctgctgcc

SEQ ID NO: 1009109 - DNA, 16 bp, Homo sapiens
cctgcgcctgctgcct

SEQ ID NO: 1009110 - DNA, 18 bp, Homo sapiens
cctgcgcctgctgcctgc

SEQ ID NO: 1009111 - DNA, 16 bp, Homo sapiens
cctgcgcttcatctca

SEQ ID NO: 1009112 - DNA, 20 bp, Homo sapiens
cctgcgcttctgctggagga

SEQ ID NO: 1009113 - DNA, 21 bp, Homo sapiens
cctgcgcttctgctggaggag

SEQ ID NO: 1009114 - DNA, 19 bp, Homo sapiens
cctgcggaggcggtggcag

SEQ ID NO: 1009115 - DNA, 22 bp, Homo sapiens
cctgcggagtgaagaggggcag

SEQ ID NO: 1009116 - DNA, 14 bp, Homo sapiens
cctgcggcctccac

SEQ ID NO: 1009117 - DNA, 17 bp, Homo sapiens
cctgcggcctgctggag

SEQ ID NO: 1009118 - DNA, 15 bp, Homo sapiens
cctgcggctcagcct

SEQ ID NO: 1009119 - DNA, 18 bp, Homo sapiens
cctgcggctcagccttgc

SEQ ID NO: 1009120 - DNA, 15 bp, Homo sapiens
cctgcgggccacagg

SEQ ID NO: 1009121 - DNA, 15 bp, Homo sapiens
cctgcgggccagggt

SEQ ID NO: 1009122 - DNA, 22 bp, Homo sapiens
cctgcgggctgccccgctttgc

SEQ ID NO: 1009123 - DNA, 22 bp, Homo sapiens
cctgcgggtcctcagctgctcc

SEQ ID NO: 1009124 - DNA, 23 bp, Homo sapiens
cctgcgggtgaacaaagcagcca

SEQ ID NO: 1009125 - DNA, 21 bp, Homo sapiens
cctgcgggtggggcttggggc

SEQ ID NO: 1009126 - DNA, 19 bp, Homo sapiens
cctgcgtcctcctcacctc

SEQ ID NO: 1009127 - DNA, 21 bp, Homo sapiens
cctgcgtcctgacgccctgcg

SEQ ID NO: 1009128 - DNA, 13 bp, Homo sapiens
cctgcgttggagc

SEQ ID NO: 1009129 - DNA, 21 bp, Homo sapiens
cctgcgttggagccactcctg

SEQ ID NO: 1009130 - DNA, 19 bp, Homo sapiens
cctgctacaacttcagcag

SEQ ID NO: 1009131 - DNA, 14 bp, Homo sapiens
cctgctacaagtgt

SEQ ID NO: 1009132 - DNA, 15 bp, Homo sapiens
cctgctactcctgtg

SEQ ID NO: 1009133 - DNA, 16 bp, Homo sapiens
cctgctactcctgtgc

SEQ ID NO: 1009134 - DNA, 13 bp, Homo sapiens
cctgctactctgt

SEQ ID NO: 1009135 - DNA, 22 bp, Homo sapiens
cctgctacttaaatttgaatct

SEQ ID NO: 1009136 - DNA, 13 bp, Homo sapiens
cctgctagagcaa

SEQ ID NO: 1009137 - DNA, 20 bp, Homo sapiens
cctgctagagcaacccctgt

SEQ ID NO: 1009138 - DNA, 23 bp, Homo sapiens
cctgctagagcaacccctgtacc

SEQ ID NO: 1009139 - DNA, 14 bp, Homo sapiens
cctgctagcaggcc

SEQ ID NO: 1009140 - DNA, 17 bp, Homo sapiens
cctgctagcaggccccc

SEQ ID NO: 1009141 - DNA, 22 bp, Homo sapiens
cctgctagcaggccccctagga

SEQ ID NO: 1009142 - DNA, 17 bp, Homo sapiens
cctgctagctgtagaaa

SEQ ID NO: 1009143 - DNA, 17 bp, Homo sapiens
cctgctatgacagctgg

SEQ ID NO: 1009144 - DNA, 17 bp, Homo sapiens
cctgctcaactctaccc

SEQ ID NO: 1009145 - DNA, 22 bp, Homo sapiens
cctgctcaactctacccctgct

SEQ ID NO: 1009146 - DNA, 23 bp, Homo sapiens
cctgctcagcaattcagacccct

SEQ ID NO: 1009147 - DNA, 21 bp, Homo sapiens
gcagattcctgggcctgtccc

SEQ ID NO: 1009148 - DNA, 23 bp, Homo sapiens
gcagattgagacctacaggctga

SEQ ID NO: 1009149 - DNA, 23 bp, Homo sapiens
gcagatttagtgaaagctagaga

SEQ ID NO: 1009150 - DNA, 16 bp, Homo sapiens
gcagattttacaaaag

SEQ ID NO: 1009151 - DNA, 22 bp, Homo sapiens
gcagattttcttaaggaatttt

SEQ ID NO: 1009152 - DNA, 22 bp, Homo sapiens
gcagcaaacactccaccctcca

SEQ ID NO: 1009153 - DNA, 14 bp, Homo sapiens
gcagcaaagagggg

SEQ ID NO: 1009154 - DNA, 18 bp, Homo sapiens
gcagcaaagaggggcgct

SEQ ID NO: 1009155 - DNA, 18 bp, Homo sapiens
gcagcaagaagcagcctg

SEQ ID NO: 1009156 - DNA, 16 bp, Homo sapiens
gcagcaaggccttggt

SEQ ID NO: 1009157 - DNA, 15 bp, Homo sapiens
gcagcaagggacctg

SEQ ID NO: 1009158 - DNA, 16 bp, Homo sapiens
gcagcaataaagcagc

SEQ ID NO: 1009159 - DNA, 23 bp, Homo sapiens
gcagcaataaagcagcgtttcta

SEQ ID NO: 1009160 - DNA, 15 bp, Homo sapiens
gcagcaatttaaatg

SEQ ID NO: 1009161 - DNA, 18 bp, Homo sapiens
gcagcacacctctggggg

SEQ ID NO: 1009162 - DNA, 14 bp, Homo sapiens
gcagcacagcccag

SEQ ID NO: 1009163 - DNA, 19 bp, Homo sapiens
gcagcacagcccagggcct

SEQ ID NO: 1009164 - DNA, 15 bp, Homo sapiens
gcagcacagctgaga

SEQ ID NO: 1009165 - DNA, 21 bp, Homo sapiens
gcagcaccaaccacagcatcg

SEQ ID NO: 1009166 - DNA, 16 bp, Homo sapiens
gcagcaccacactggg

SEQ ID NO: 1009167 - DNA, 20 bp, Homo sapiens
gcagcaccaccacacagtca

SEQ ID NO: 1009168 - DNA, 11 bp, Homo sapiens
gcagcaccctt

SEQ ID NO: 1009169 - DNA, 18 bp, Homo sapiens
gcagcacctccaggcctg

SEQ ID NO: 1009170 - DNA, 19 bp, Homo sapiens
gcagcacctccaggcctgt

SEQ ID NO: 1009171 - DNA, 16 bp, Homo sapiens
gcagcactcacacagg

SEQ ID NO: 1009172 - DNA, 16 bp, Homo sapiens
gcagcactccccagag

SEQ ID NO: 1009173 - DNA, 21 bp, Homo sapiens
gcagcactccccagagctgtg

SEQ ID NO: 1009174 - DNA, 22 bp, Homo sapiens
gcagcactccccagagctgtgc

SEQ ID NO: 1009175 - DNA, 23 bp, Homo sapiens
gcagcactccccagagctgtgcc

SEQ ID NO: 1009176 - DNA, 18 bp, Homo sapiens
gcagcactcccgctgcac

SEQ ID NO: 1009177 - DNA, 21 bp, Homo sapiens
gcagcactgggaagctggagt

SEQ ID NO: 1009178 - DNA, 11 bp, Homo sapiens
gcagcacttta

SEQ ID NO: 1009179 - DNA, 18 bp, Homo sapiens
gcagcactttaaccctct

SEQ ID NO: 1009180 - DNA, 19 bp, Homo sapiens
gcagcactttaaccctctc

SEQ ID NO: 1009181 - DNA, 21 bp, Homo sapiens
gcagcactttaaccctctctt

SEQ ID NO: 1009182 - DNA, 12 bp, Homo sapiens
gcagcagagagc

SEQ ID NO: 1009183 - DNA, 15 bp, Homo sapiens
gcagcagaggtgaga

SEQ ID NO: 1009184 - DNA, 21 bp, Homo sapiens
gcagcagagtgagcaaggggg

SEQ ID NO: 1009185 - DNA, 13 bp, Homo sapiens
gcagcagcacctt

SEQ ID NO: 1009186 - DNA, 19 bp, Homo sapiens
gcagcagcacctttctctg

SEQ ID NO: 1009187 - DNA, 16 bp, Homo sapiens
gcagcagccagcacca

SEQ ID NO: 1009188 - DNA, 14 bp, Homo sapiens
gcagcagcccaagc

SEQ ID NO: 1009189 - DNA, 20 bp, Homo sapiens
gcagcagcccaagcttccct

SEQ ID NO: 1009190 - DNA, 19 bp, Homo sapiens
gcagcagcccagcttcctg

SEQ ID NO: 1009191 - DNA, 13 bp, Homo sapiens
gcagcagccctgc

SEQ ID NO: 1009192 - DNA, 12 bp, Homo sapiens
gcagcagctagg

SEQ ID NO: 1009193 - DNA, 16 bp, Homo sapiens
gcagcagctaggactg

SEQ ID NO: 1009194 - DNA, 20 bp, Homo sapiens
gcagcagctaggactgagga

SEQ ID NO: 1009195 - DNA, 17 bp, Homo sapiens
gcagcagcttggggaga

SEQ ID NO: 1009196 - DNA, 12 bp, Homo sapiens
gcagcaggaagg

SEQ ID NO: 1009197 - DNA, 16 bp, Homo sapiens
gcagcaggaaggaaca

SEQ ID NO: 1009198 - DNA, 21 bp, Homo sapiens
gcagcaggaaggaacaaagac

SEQ ID NO: 1009199 - DNA, 13 bp, Homo sapiens
gcagcaggaaggc

SEQ ID NO: 1009200 - DNA, 21 bp, Homo sapiens
gcagcaggaatatatgtgtgc

SEQ ID NO: 1009201 - DNA, 15 bp, Homo sapiens
gcagcaggaggagtg

SEQ ID NO: 1009202 - DNA, 12 bp, Homo sapiens
gcagcaggatgg

SEQ ID NO: 1009203 - DNA, 16 bp, Homo sapiens
gcagcaggatgggctg

SEQ ID NO: 1009204 - DNA, 13 bp, Homo sapiens
gcagcaggctcag

SEQ ID NO: 1009205 - DNA, 17 bp, Homo sapiens
gcagcaggctcaggcac

SEQ ID NO: 1009206 - DNA, 17 bp, Homo sapiens
gcagcagggatgccctg

SEQ ID NO: 1009207 - DNA, 19 bp, Homo sapiens
gcagcagggctaccctgag

SEQ ID NO: 1009208 - DNA, 17 bp, Homo sapiens
gcagcagggctgggcct

SEQ ID NO: 1009209 - DNA, 16 bp, Homo sapiens
gcagcaggggctgctg

SEQ ID NO: 1009210 - DNA, 20 bp, Homo sapiens
gcagcaggggctgctgtgat

SEQ ID NO: 1009211 - DNA, 20 bp, Homo sapiens
gcagcagtagctttggggaa

SEQ ID NO: 1009212 - DNA, 13 bp, Homo sapiens
gcagcagtggggt

SEQ ID NO: 1009213 - DNA, 15 bp, Homo sapiens
gcagcagtggggtga

SEQ ID NO: 1009214 - DNA, 15 bp, Homo sapiens
gcagcagtgtgaggc

SEQ ID NO: 1009215 - DNA, 22 bp, Homo sapiens
gcagcagtgtgaggccagggca

SEQ ID NO: 1009216 - DNA, 16 bp, Homo sapiens
gcagcatcccagcctt

SEQ ID NO: 1009217 - DNA, 19 bp, Homo sapiens
gcagcatcccagccttgag

SEQ ID NO: 1009218 - DNA, 19 bp, Homo sapiens
gcagcatcttcacttctaa

SEQ ID NO: 1009219 - DNA, 22 bp, Homo sapiens
gcagcatgcccagattcccaga

SEQ ID NO: 1009220 - DNA, 23 bp, Homo sapiens
gcagcatgcccagattcccagac

SEQ ID NO: 1009221 - DNA, 18 bp, Homo sapiens
gcagcatggggtttttat

SEQ ID NO: 1009222 - DNA, 20 bp, Homo sapiens
gcagcatggtccctgcctta

SEQ ID NO: 1009223 - DNA, 21 bp, Homo sapiens
gcagccaaacccatgaggcaa

SEQ ID NO: 1009224 - DNA, 13 bp, Homo sapiens
gcagccaaagaat

SEQ ID NO: 1009225 - DNA, 16 bp, Homo sapiens
gcagccaaaggggagc

SEQ ID NO: 1009226 - DNA, 20 bp, Homo sapiens
gcagccaaaggggagccaga

SEQ ID NO: 1009227 - DNA, 20 bp, Homo sapiens
gcagccaaggaatgtgtcca

SEQ ID NO: 1009228 - DNA, 23 bp, Homo sapiens
gcagccacacgcaggcggccagg

SEQ ID NO: 1009229 - DNA, 11 bp, Homo sapiens
gcagccacagg

SEQ ID NO: 1009230 - DNA, 14 bp, Homo sapiens
gcagccacaggact

SEQ ID NO: 1009231 - DNA, 15 bp, Homo sapiens
gcagccacaggactg

SEQ ID NO: 1009232 - DNA, 15 bp, Homo sapiens
gcagccaccagggag

SEQ ID NO: 1009233 - DNA, 12 bp, Homo sapiens
gcagccaccagt

SEQ ID NO: 1009234 - DNA, 15 bp, Homo sapiens
gcagccaccagtgga

SEQ ID NO: 1009235 - DNA, 19 bp, Homo sapiens
gcagccacgattggagaat

SEQ ID NO: 1009236 - DNA, 21 bp, Homo sapiens
gcagccacgattggagaatac

SEQ ID NO: 1009237 - DNA, 17 bp, Homo sapiens
gcagccagagctgtgcc

SEQ ID NO: 1009238 - DNA, 13 bp, Homo sapiens
gcagccagcacca

SEQ ID NO: 1009239 - DNA, 15 bp, Homo sapiens
gcagccagcaccacc

SEQ ID NO: 1009240 - DNA, 17 bp, Homo sapiens
gcagccagccagtcttg

SEQ ID NO: 1009241 - DNA, 13 bp, Homo sapiens
gcagccagcccag

SEQ ID NO: 1009242 - DNA, 15 bp, Homo sapiens
gcagccagcccagcc

SEQ ID NO: 1009243 - DNA, 13 bp, Homo sapiens
gcagccagctctc

SEQ ID NO: 1009244 - DNA, 12 bp, Homo sapiens
gcagccaggacc

SEQ ID NO: 1009245 - DNA, 13 bp, Homo sapiens
gcagccaggaccc

SEQ ID NO: 1009246 - DNA, 21 bp, Homo sapiens
gcagccaggacccgcctgctc

SEQ ID NO: 1009247 - DNA, 17 bp, Homo sapiens
gcagccaggagtgcccc

SEQ ID NO: 1009248 - DNA, 20 bp, Homo sapiens
gcagccaggagtgcccccgg

SEQ ID NO: 1009249 - DNA, 18 bp, Homo sapiens
gcagccagtctcagagac

SEQ ID NO: 1009250 - DNA, 19 bp, Homo sapiens
gcagccagtctcagagacc

SEQ ID NO: 1009251 - DNA, 21 bp, Homo sapiens
gcagccagtctcagagaccag

SEQ ID NO: 1009252 - DNA, 13 bp, Homo sapiens
gcagccagtgaga

SEQ ID NO: 1009253 - DNA, 20 bp, Homo sapiens
gcagccatgcctcatgccac

SEQ ID NO: 1009254 - DNA, 23 bp, Homo sapiens
gcagccatgcctcatgccacacc

SEQ ID NO: 1009255 - DNA, 14 bp, Homo sapiens
gcagcccaccagga

SEQ ID NO: 1009256 - DNA, 17 bp, Homo sapiens
gcagcccaccaggagca

SEQ ID NO: 1009257 - DNA, 14 bp, Homo sapiens
gcagcccagagact

SEQ ID NO: 1009258 - DNA, 17 bp, Homo sapiens
gcagcccaggccggggt

SEQ ID NO: 1009259 - DNA, 22 bp, Homo sapiens
gcagcccatgcccacctgccca

SEQ ID NO: 1009260 - DNA, 13 bp, Homo sapiens
gcagccccacttc

SEQ ID NO: 1009261 - DNA, 19 bp, Homo sapiens
gcagccccacttcaccccc

SEQ ID NO: 1009262 - DNA, 16 bp, Homo sapiens
gcagccccagaagaaa

SEQ ID NO: 1009263 - DNA, 20 bp, Homo sapiens
gcagccccagggcctgcgga

SEQ ID NO: 1009264 - DNA, 16 bp, Homo sapiens
gcagccccccagcact

SEQ ID NO: 1009265 - DNA, 18 bp, Homo sapiens
gcagccccctgtggcggc

SEQ ID NO: 1009266 - DNA, 23 bp, Homo sapiens
gcagccccgcgcctccttccttg

SEQ ID NO: 1009267 - DNA, 18 bp, Homo sapiens
gcagcccctcgaggccta

SEQ ID NO: 1009268 - DNA, 23 bp, Homo sapiens
gcagcccctcgaggcctacagag

SEQ ID NO: 1009269 - DNA, 15 bp, Homo sapiens
gcagcccctgggccc

SEQ ID NO: 1009270 - DNA, 23 bp, Homo sapiens
gcagcccgcctgccgtgcatggc

SEQ ID NO: 1009271 - DNA, 22 bp, Homo sapiens
gcagcccgccttggctttctcc

SEQ ID NO: 1009272 - DNA, 13 bp, Homo sapiens
cctgctcagcagc

SEQ ID NO: 1009273 - DNA, 13 bp, Homo sapiens
cctgctccaccag

SEQ ID NO: 1009274 - DNA, 19 bp, Homo sapiens
cctgctccacgaagcctta

SEQ ID NO: 1009275 - DNA, 11 bp, Homo sapiens
cctgctccaga

SEQ ID NO: 1009276 - DNA, 11 bp, Homo sapiens
cctgctccagt

SEQ ID NO: 1009277 - DNA, 12 bp, Homo sapiens
cctgctcccagc

SEQ ID NO: 1009278 - DNA, 15 bp, Homo sapiens
cctgctcccagcagc

SEQ ID NO: 1009279 - DNA, 16 bp, Homo sapiens
cctgctcccagcctgc

SEQ ID NO: 1009280 - DNA, 19 bp, Homo sapiens
cctgctcccattcctccct

SEQ ID NO: 1009281 - DNA, 22 bp, Homo sapiens
cctgctcccattcctccctccg

SEQ ID NO: 1009282 - DNA, 16 bp, Homo sapiens
cctgctcccccacccc

SEQ ID NO: 1009283 - DNA, 14 bp, Homo sapiens
cctgctccgctgct

SEQ ID NO: 1009284 - DNA, 15 bp, Homo sapiens
cctgctccgctgctc

SEQ ID NO: 1009285 - DNA, 20 bp, Homo sapiens
cctgctccgctgctccttgg

SEQ ID NO: 1009286 - DNA, 21 bp, Homo sapiens
cctgctccgctgctccttggc

SEQ ID NO: 1009287 - DNA, 22 bp, Homo sapiens
cctgctccgctgctccttggct

SEQ ID NO: 1009288 - DNA, 15 bp, Homo sapiens
cctgctccgtggact

SEQ ID NO: 1009289 - DNA, 12 bp, Homo sapiens
cctgctcctcat

SEQ ID NO: 1009290 - DNA, 15 bp, Homo sapiens
cctgctcctcatggg

SEQ ID NO: 1009291 - DNA, 16 bp, Homo sapiens
cctgctcctccctgcc

SEQ ID NO: 1009292 - DNA, 20 bp, Homo sapiens
cctgctcctccctggctgcc

SEQ ID NO: 1009293 - DNA, 22 bp, Homo sapiens
cctgctcctccctggctgccct

SEQ ID NO: 1009294 - DNA, 16 bp, Homo sapiens
cctgctcctcctgccc

SEQ ID NO: 1009295 - DNA, 20 bp, Homo sapiens
cctgctcctcctgccctgtc

SEQ ID NO: 1009296 - DNA, 16 bp, Homo sapiens
cctgctcctgcagcat

SEQ ID NO: 1009297 - DNA, 23 bp, Homo sapiens
cctgctccttggcacccccatgc

SEQ ID NO: 1009298 - DNA, 20 bp, Homo sapiens
cctgctctacccatgagcct

SEQ ID NO: 1009299 - DNA, 14 bp, Homo sapiens
cctgctctctgctc

SEQ ID NO: 1009300 - DNA, 13 bp, Homo sapiens
cctgctctcttca

SEQ ID NO: 1009301 - DNA, 19 bp, Homo sapiens
cctgctctggtcccctctc

SEQ ID NO: 1009302 - DNA, 13 bp, Homo sapiens
cctgctctgtccc

SEQ ID NO: 1009303 - DNA, 23 bp, Homo sapiens
cctgctcttttgtgatgaacata

SEQ ID NO: 1009304 - DNA, 16 bp, Homo sapiens
cctgctgacagacact

SEQ ID NO: 1009305 - DNA, 20 bp, Homo sapiens
cctgctgagagacccaagga

SEQ ID NO: 1009306 - DNA, 11 bp, Homo sapiens
cctgctgcacc

SEQ ID NO: 1009307 - DNA, 12 bp, Homo sapiens
cctgctgcaccc

SEQ ID NO: 1009308 - DNA, 22 bp, Homo sapiens
cctgctgcaccctgcgcctcca

SEQ ID NO: 1009309 - DNA, 15 bp, Homo sapiens
cctgctgcactagga

SEQ ID NO: 1009310 - DNA, 10 bp, Homo sapiens
cctgctgcat

SEQ ID NO: 1009311 - DNA, 15 bp, Homo sapiens
cctgctgccacagca

SEQ ID NO: 1009312 - DNA, 16 bp, Homo sapiens
cctgctgccacagcaa

SEQ ID NO: 1009313 - DNA, 13 bp, Homo sapiens
cctgctgccagtg

SEQ ID NO: 1009314 - DNA, 17 bp, Homo sapiens
cctgctgccagtgcagc

SEQ ID NO: 1009315 - DNA, 21 bp, Homo sapiens
cctgctgccagtgcagccact

SEQ ID NO: 1009316 - DNA, 13 bp, Homo sapiens
cctgctgcccagt

SEQ ID NO: 1009317 - DNA, 23 bp, Homo sapiens
cctgctgccgcctcccagcctgg

SEQ ID NO: 1009318 - DNA, 20 bp, Homo sapiens
cctgctgcctccccaaccct

SEQ ID NO: 1009319 - DNA, 21 bp, Homo sapiens
cctgctgcctccccaaccctg

SEQ ID NO: 1009320 - DNA, 14 bp, Homo sapiens
cctgctgccttttc

SEQ ID NO: 1009321 - DNA, 17 bp, Homo sapiens
cctgctgccttttctgg

SEQ ID NO: 1009322 - DNA, 18 bp, Homo sapiens
cctgctgccttttctgga

SEQ ID NO: 1009323 - DNA, 17 bp, Homo sapiens
cctgctgcgtcagacca

SEQ ID NO: 1009324 - DNA, 18 bp, Homo sapiens
cctgctgcgtcagaccag

SEQ ID NO: 1009325 - DNA, 17 bp, Homo sapiens
cctgctgcgtccccact

SEQ ID NO: 1009326 - DNA, 20 bp, Homo sapiens
cctgctgcgtccccactccc

SEQ ID NO: 1009327 - DNA, 22 bp, Homo sapiens
cctgctgcgtccccactccctt

SEQ ID NO: 1009328 - DNA, 20 bp, Homo sapiens
cctgctggaaaccacacttc

SEQ ID NO: 1009329 - DNA, 12 bp, Homo sapiens
cctgctggaggc

SEQ ID NO: 1009330 - DNA, 15 bp, Homo sapiens
cctgctggaggcctc

SEQ ID NO: 1009331 - DNA, 21 bp, Homo sapiens
cctgctggaggcctcaggtgc

SEQ ID NO: 1009332 - DNA, 19 bp, Homo sapiens
cctgctggcacccaccgtg

SEQ ID NO: 1009333 - DNA, 18 bp, Homo sapiens
cctgctggcagggccagg

SEQ ID NO: 1009334 - DNA, 19 bp, Homo sapiens
cctgctggcagggccaggg

SEQ ID NO: 1009335 - DNA, 20 bp, Homo sapiens
cctgctggcagggccagggc

SEQ ID NO: 1009336 - DNA, 15 bp, Homo sapiens
cctgctggcatcagg

SEQ ID NO: 1009337 - DNA, 18 bp, Homo sapiens
cctgctggcatcaggtct

SEQ ID NO: 1009338 - DNA, 20 bp, Homo sapiens
cctgctggcatcaggtctgg

SEQ ID NO: 1009339 - DNA, 14 bp, Homo sapiens
cctgctggcccctc

SEQ ID NO: 1009340 - DNA, 15 bp, Homo sapiens
cctgctggcccctca

SEQ ID NO: 1009341 - DNA, 12 bp, Homo sapiens
cctgctggctgc

SEQ ID NO: 1009342 - DNA, 23 bp, Homo sapiens
cctgctgggaaccccgcagcccg

SEQ ID NO: 1009343 - DNA, 14 bp, Homo sapiens
cctgctgggactga

SEQ ID NO: 1009344 - DNA, 12 bp, Homo sapiens
cctgctgggctc

SEQ ID NO: 1009345 - DNA, 19 bp, Homo sapiens
cctgctgggctctccacct

SEQ ID NO: 1009346 - DNA, 20 bp, Homo sapiens
cctgctgggctctccacctc

SEQ ID NO: 1009347 - DNA, 21 bp, Homo sapiens
cctgctggggatccccgcctg

SEQ ID NO: 1009348 - DNA, 12 bp, Homo sapiens
cctgctggggct

SEQ ID NO: 1009349 - DNA, 21 bp, Homo sapiens
cctgctggggcttaggaacct

SEQ ID NO: 1009350 - DNA, 15 bp, Homo sapiens
cctgctgggtaaact

SEQ ID NO: 1009351 - DNA, 17 bp, Homo sapiens
cctgctgggtaaactgt

SEQ ID NO: 1009352 - DNA, 13 bp, Homo sapiens
cctgctgtccctg

SEQ ID NO: 1009353 - DNA, 14 bp, Homo sapiens
cctgctgtccctgt

SEQ ID NO: 1009354 - DNA, 17 bp, Homo sapiens
cctgctgtccctgtcag

SEQ ID NO: 1009355 - DNA, 18 bp, Homo sapiens
cctgctgtctctctgggc

SEQ ID NO: 1009356 - DNA, 19 bp, Homo sapiens
cctgctgtctctctgggct

SEQ ID NO: 1009357 - DNA, 21 bp, Homo sapiens
cctgctgtgcctcgcatccta

SEQ ID NO: 1009358 - DNA, 14 bp, Homo sapiens
cctgctgtgctgct

SEQ ID NO: 1009359 - DNA, 16 bp, Homo sapiens
cctgctgtgctgctca

SEQ ID NO: 1009360 - DNA, 12 bp, Homo sapiens
cctgctgtgggg

SEQ ID NO: 1009361 - DNA, 14 bp, Homo sapiens
cctgctgtggggcg

SEQ ID NO: 1009362 - DNA, 12 bp, Homo sapiens
cctgcttcccct

SEQ ID NO: 1009363 - DNA, 17 bp, Homo sapiens
cctgcttccccttccta

SEQ ID NO: 1009364 - DNA, 14 bp, Homo sapiens
cctgcttcctgctt

SEQ ID NO: 1009365 - DNA, 18 bp, Homo sapiens
cctgcttcctgcttgcca

SEQ ID NO: 1009366 - DNA, 21 bp, Homo sapiens
cctgcttcctgttacctgtct

SEQ ID NO: 1009367 - DNA, 12 bp, Homo sapiens
cctgcttctccc

SEQ ID NO: 1009368 - DNA, 13 bp, Homo sapiens
cctgcttctcccg

SEQ ID NO: 1009369 - DNA, 16 bp, Homo sapiens
cctgcttctcccgggg

SEQ ID NO: 1009370 - DNA, 20 bp, Homo sapiens
cctgcttctcccggggacgc

SEQ ID NO: 1009371 - DNA, 21 bp, Homo sapiens
cctgcttctcccggggacgct

SEQ ID NO: 1009372 - DNA, 14 bp, Homo sapiens
cctgcttctctcag

SEQ ID NO: 1009373 - DNA, 15 bp, Homo sapiens
cctgcttctctcagc

SEQ ID NO: 1009374 - DNA, 17 bp, Homo sapiens
cctgcttctcttttcct

SEQ ID NO: 1009375 - DNA, 18 bp, Homo sapiens
cctgcttgataatatata

SEQ ID NO: 1009376 - DNA, 17 bp, Homo sapiens
cctgcttgcacacttcc

SEQ ID NO: 1009377 - DNA, 20 bp, Homo sapiens
cctgcttgcacacttcccca

SEQ ID NO: 1009378 - DNA, 18 bp, Homo sapiens
cctgcttgccaaggcaga

SEQ ID NO: 1009379 - DNA, 22 bp, Homo sapiens
cctgcttgccaaggcagaggcc

SEQ ID NO: 1009380 - DNA, 21 bp, Homo sapiens
cctgcttgcccgctcccacag

SEQ ID NO: 1009381 - DNA, 19 bp, Homo sapiens
cctgcttgtactaagccag

SEQ ID NO: 1009382 - DNA, 22 bp, Homo sapiens
cctgctttcaagacccctgtct

SEQ ID NO: 1009383 - DNA, 14 bp, Homo sapiens
cctgctttggcctt

SEQ ID NO: 1009384 - DNA, 15 bp, Homo sapiens
cctgctttggccttt

SEQ ID NO: 1009385 - DNA, 23 bp, Homo sapiens
cctgctttgggctgccctggtgc

SEQ ID NO: 1009386 - DNA, 14 bp, Homo sapiens
cctgcttttccagg

SEQ ID NO: 1009387 - DNA, 15 bp, Homo sapiens
cctgcttttccagga

SEQ ID NO: 1009388 - DNA, 19 bp, Homo sapiens
cctgcttttctgtcctggg

SEQ ID NO: 1009389 - DNA, 15 bp, Homo sapiens
cctgctttttggaaa

SEQ ID NO: 1009390 - DNA, 16 bp, Homo sapiens
cctgctttttgtgttt

SEQ ID NO: 1009391 - DNA, 14 bp, Homo sapiens
cctgctttttttct

SEQ ID NO: 1009392 - DNA, 12 bp, Homo sapiens
cctggaaacagc

SEQ ID NO: 1009393 - DNA, 21 bp, Homo sapiens
cctggaaacagcatgaataaa

SEQ ID NO: 1009394 - DNA, 15 bp, Homo sapiens
cctggaaaggctcag

SEQ ID NO: 1009395 - DNA, 17 bp, Homo sapiens
cctggaaaggctcagtc

SEQ ID NO: 1009396 - DNA, 20 bp, Homo sapiens
cctggaaaggctcagtctca

SEQ ID NO: 1009397 - DNA, 19 bp, Homo sapiens
cctggaaaggggagttgag

SEQ ID NO: 1009398 - DNA, 17 bp, Homo sapiens
gcagcccgtgtggcccc

SEQ ID NO: 1009399 - DNA, 18 bp, Homo sapiens
gcagcccgtgtggcccct

SEQ ID NO: 1009400 - DNA, 19 bp, Homo sapiens
gcagcccgtgtggcccctt

SEQ ID NO: 1009401 - DNA, 24 bp, Homo sapiens
gcagccctaaggatctctcaggag

SEQ ID NO: 1009402 - DNA, 16 bp, Homo sapiens
gcagccctcacctctg

SEQ ID NO: 1009403 - DNA, 21 bp, Homo sapiens
gcagccctcacctctgaggac

SEQ ID NO: 1009404 - DNA, 19 bp, Homo sapiens
gcagccctccatggtcctg

SEQ ID NO: 1009405 - DNA, 22 bp, Homo sapiens
gcagccctccatggtcctgtct

SEQ ID NO: 1009406 - DNA, 13 bp, Homo sapiens
gcagccctcctca

SEQ ID NO: 1009407 - DNA, 18 bp, Homo sapiens
gcagccctcctcaccccg

SEQ ID NO: 1009408 - DNA, 10 bp, Homo sapiens
gcagccctct

SEQ ID NO: 1009409 - DNA, 12 bp, Homo sapiens
gcagccctctgc

SEQ ID NO: 1009410 - DNA, 13 bp, Homo sapiens
gcagccctctgcc

SEQ ID NO: 1009411 - DNA, 12 bp, Homo sapiens
gcagccctgagt

SEQ ID NO: 1009412 - DNA, 20 bp, Homo sapiens
gcagccctgagtggtcactg

SEQ ID NO: 1009413 - DNA, 19 bp, Homo sapiens
gcagccctgccccacacct

SEQ ID NO: 1009414 - DNA, 14 bp, Homo sapiens
gcagccctgctttg

SEQ ID NO: 1009415 - DNA, 14 bp, Homo sapiens
gcagcccttccaaa

SEQ ID NO: 1009416 - DNA, 15 bp, Homo sapiens
gcagcccttgggcag

SEQ ID NO: 1009417 - DNA, 20 bp, Homo sapiens
gcagcccttgtgtgtgccct

SEQ ID NO: 1009418 - DNA, 23 bp, Homo sapiens
gcagcccttgtgtgtgccctggg

SEQ ID NO: 1009419 - DNA, 14 bp, Homo sapiens
gcagccgagctcgt

SEQ ID NO: 1009420 - DNA, 13 bp, Homo sapiens
gcagccgccagct

SEQ ID NO: 1009421 - DNA, 15 bp, Homo sapiens
gcagccgccgccgcc

SEQ ID NO: 1009422 - DNA, 16 bp, Homo sapiens
gcagccgccgggcagg

SEQ ID NO: 1009423 - DNA, 19 bp, Homo sapiens
gcagccgctaggagagact

SEQ ID NO: 1009424 - DNA, 17 bp, Homo sapiens
gcagccgctgagcgagg

SEQ ID NO: 1009425 - DNA, 20 bp, Homo sapiens
gcagccggaatagagcctcg

SEQ ID NO: 1009426 - DNA, 14 bp, Homo sapiens
gcagccggaggagg

SEQ ID NO: 1009427 - DNA, 18 bp, Homo sapiens
gcagccggaggaggagat

SEQ ID NO: 1009428 - DNA, 18 bp, Homo sapiens
gcagccggcacagggtct

SEQ ID NO: 1009429 - DNA, 18 bp, Homo sapiens
gcagccgtgccttcagct

SEQ ID NO: 1009430 - DNA, 17 bp, Homo sapiens
gcagccgttttcctcat

SEQ ID NO: 1009431 - DNA, 18 bp, Homo sapiens
gcagccgttttcctcatc

SEQ ID NO: 1009432 - DNA, 22 bp, Homo sapiens
gcagcctatgggggctctcgga

SEQ ID NO: 1009433 - DNA, 21 bp, Homo sapiens
gcagcctcaacctcctgggtt

SEQ ID NO: 1009434 - DNA, 15 bp, Homo sapiens
gcagcctcagagtgg

SEQ ID NO: 1009435 - DNA, 21 bp, Homo sapiens
gcagcctcatactcctgggct

SEQ ID NO: 1009436 - DNA, 21 bp, Homo sapiens
gcagcctccaccttgctcttc

SEQ ID NO: 1009437 - DNA, 13 bp, Homo sapiens
gcagcctccagag

SEQ ID NO: 1009438 - DNA, 17 bp, Homo sapiens
gcagcctccagagccag

SEQ ID NO: 1009439 - DNA, 18 bp, Homo sapiens
gcagcctcccatccaggg

SEQ ID NO: 1009440 - DNA, 20 bp, Homo sapiens
gcagcctcccatccagggcc

SEQ ID NO: 1009441 - DNA, 23 bp, Homo sapiens
gcagcctccctctgacctgcagg

SEQ ID NO: 1009442 - DNA, 21 bp, Homo sapiens
gcagcctccgggcgtgtgaag

SEQ ID NO: 1009443 - DNA, 17 bp, Homo sapiens
gcagcctcgaggctggt

SEQ ID NO: 1009444 - DNA, 15 bp, Homo sapiens
gcagcctcgcacagg

SEQ ID NO: 1009445 - DNA, 17 bp, Homo sapiens
gcagcctcgcacaggcc

SEQ ID NO: 1009446 - DNA, 19 bp, Homo sapiens
gcagcctcgcacaggccct

SEQ ID NO: 1009447 - DNA, 21 bp, Homo sapiens
gcagcctcgcacaggccctag

SEQ ID NO: 1009448 - DNA, 23 bp, Homo sapiens
gcagcctcgcacaggccctagct

SEQ ID NO: 1009449 - DNA, 22 bp, Homo sapiens
gcagcctcgcggtcttgggcac

SEQ ID NO: 1009450 - DNA, 13 bp, Homo sapiens
gcagcctcgtgga

SEQ ID NO: 1009451 - DNA, 16 bp, Homo sapiens
gcagcctcgtggagct

SEQ ID NO: 1009452 - DNA, 12 bp, Homo sapiens
gcagcctctccc

SEQ ID NO: 1009453 - DNA, 20 bp, Homo sapiens
gcagcctctccccaggtcca

SEQ ID NO: 1009454 - DNA, 14 bp, Homo sapiens
gcagcctctctggc

SEQ ID NO: 1009455 - DNA, 21 bp, Homo sapiens
gcagcctctctggctggtctt

SEQ ID NO: 1009456 - DNA, 12 bp, Homo sapiens
gcagcctctgga

SEQ ID NO: 1009457 - DNA, 17 bp, Homo sapiens
gcagcctgaagcctgga

SEQ ID NO: 1009458 - DNA, 20 bp, Homo sapiens
gcagcctgaagcctggattc

SEQ ID NO: 1009459 - DNA, 15 bp, Homo sapiens
gcagcctgatggcca

SEQ ID NO: 1009460 - DNA, 18 bp, Homo sapiens
gcagcctgatggccaagg

SEQ ID NO: 1009461 - DNA, 13 bp, Homo sapiens
gcagcctgcagga

SEQ ID NO: 1009462 - DNA, 23 bp, Homo sapiens
gcagcctgcgccaccgcccagag

SEQ ID NO: 1009463 - DNA, 13 bp, Homo sapiens
gcagcctgctttg

SEQ ID NO: 1009464 - DNA, 21 bp, Homo sapiens
gcagcctgctttggcctttcc

SEQ ID NO: 1009465 - DNA, 22 bp, Homo sapiens
gcagcctgctttggcctttcct

SEQ ID NO: 1009466 - DNA, 23 bp, Homo sapiens
gcagcctgctttggcctttcctt

SEQ ID NO: 1009467 - DNA, 18 bp, Homo sapiens
gcagcctggagacttcct

SEQ ID NO: 1009468 - DNA, 14 bp, Homo sapiens
gcagcctggcatct

SEQ ID NO: 1009469 - DNA, 17 bp, Homo sapiens
gcagcctggcatctgtg

SEQ ID NO: 1009470 - DNA, 22 bp, Homo sapiens
gcagcctgggctccctcttgtg

SEQ ID NO: 1009471 - DNA, 11 bp, Homo sapiens
gcagcctgggt

SEQ ID NO: 1009472 - DNA, 13 bp, Homo sapiens
gcagcctgggtct

SEQ ID NO: 1009473 - DNA, 13 bp, Homo sapiens
gcagcctgtgagg

SEQ ID NO: 1009474 - DNA, 17 bp, Homo sapiens
gcagcctgtgagggagt

SEQ ID NO: 1009475 - DNA, 22 bp, Homo sapiens
gcagcctgtggcatctttgcct

SEQ ID NO: 1009476 - DNA, 19 bp, Homo sapiens
gcagccttcccctccctgt

SEQ ID NO: 1009477 - DNA, 21 bp, Homo sapiens
gcagccttcccctccctgtat

SEQ ID NO: 1009478 - DNA, 19 bp, Homo sapiens
gcagccttgaccacggctg

SEQ ID NO: 1009479 - DNA, 19 bp, Homo sapiens
gcagccttgcgctgtccca

SEQ ID NO: 1009480 - DNA, 20 bp, Homo sapiens
gcagccttgcgctgtcccag

SEQ ID NO: 1009481 - DNA, 23 bp, Homo sapiens
gcagccttgcgctgtcccaggca

SEQ ID NO: 1009482 - DNA, 14 bp, Homo sapiens
gcagccttggggca

SEQ ID NO: 1009483 - DNA, 20 bp, Homo sapiens
gcagccttgggggggctgcc

SEQ ID NO: 1009484 - DNA, 22 bp, Homo sapiens
gcagccttgggggggctgcctt

SEQ ID NO: 1009485 - DNA, 17 bp, Homo sapiens
gcagcctttccagcctc

SEQ ID NO: 1009486 - DNA, 14 bp, Homo sapiens
gcagcgaccgcccc

SEQ ID NO: 1009487 - DNA, 18 bp, Homo sapiens
gcagcgaccgccccctcc

SEQ ID NO: 1009488 - DNA, 21 bp, Homo sapiens
gcagcgagggcggagccggcc

SEQ ID NO: 1009489 - DNA, 15 bp, Homo sapiens
gcagcgcagggctgg

SEQ ID NO: 1009490 - DNA, 13 bp, Homo sapiens
gcagcgccaggct

SEQ ID NO: 1009491 - DNA, 14 bp, Homo sapiens
gcagcgccaggctg

SEQ ID NO: 1009492 - DNA, 14 bp, Homo sapiens
gcagcgcccaggcc

SEQ ID NO: 1009493 - DNA, 12 bp, Homo sapiens
gcagcgccccca

SEQ ID NO: 1009494 - DNA, 13 bp, Homo sapiens
gcagcgcctttcc

SEQ ID NO: 1009495 - DNA, 15 bp, Homo sapiens
gcagcgcctttccca

SEQ ID NO: 1009496 - DNA, 22 bp, Homo sapiens
gcagcgctcggcccggagcagc

SEQ ID NO: 1009497 - DNA, 15 bp, Homo sapiens
gcagcggctctggtc

SEQ ID NO: 1009498 - DNA, 14 bp, Homo sapiens
gcagcgtgggctct

SEQ ID NO: 1009499 - DNA, 15 bp, Homo sapiens
gcagcgtgggctctg

SEQ ID NO: 1009500 - DNA, 17 bp, Homo sapiens
gcagcgtgggctctgcc

SEQ ID NO: 1009501 - DNA, 18 bp, Homo sapiens
gcagcgtgggctctgcca

SEQ ID NO: 1009502 - DNA, 16 bp, Homo sapiens
gcagcgtgtgggtccc

SEQ ID NO: 1009503 - DNA, 18 bp, Homo sapiens
gcagcgtgtgggtcccgc

SEQ ID NO: 1009504 - DNA, 22 bp, Homo sapiens
gcagctaactccgagagcagtg

SEQ ID NO: 1009505 - DNA, 17 bp, Homo sapiens
gcagctactcccctttc

SEQ ID NO: 1009506 - DNA, 21 bp, Homo sapiens
gcagctactgtaactttttta

SEQ ID NO: 1009507 - DNA, 17 bp, Homo sapiens
gcagctagactggagtg

SEQ ID NO: 1009508 - DNA, 19 bp, Homo sapiens
gcagctagactggagtgag

SEQ ID NO: 1009509 - DNA, 12 bp, Homo sapiens
gcagctagtgcc

SEQ ID NO: 1009510 - DNA, 14 bp, Homo sapiens
gcagctagtgcctt

SEQ ID NO: 1009511 - DNA, 15 bp, Homo sapiens
gcagctagtgccttt

SEQ ID NO: 1009512 - DNA, 14 bp, Homo sapiens
gcagctagttttct

SEQ ID NO: 1009513 - DNA, 17 bp, Homo sapiens
gcagctatatatttccc

SEQ ID NO: 1009514 - DNA, 22 bp, Homo sapiens
gcagctatgcgcaatgtggcat

SEQ ID NO: 1009515 - DNA, 15 bp, Homo sapiens
gcagctcacccctgg

SEQ ID NO: 1009516 - DNA, 18 bp, Homo sapiens
gcagctcacccctgggca

SEQ ID NO: 1009517 - DNA, 21 bp, Homo sapiens
gcagctccatcctcttgactc

SEQ ID NO: 1009518 - DNA, 14 bp, Homo sapiens
gcagctcccgcagg

SEQ ID NO: 1009519 - DNA, 16 bp, Homo sapiens
gcagctccctttctca

SEQ ID NO: 1009520 - DNA, 14 bp, Homo sapiens
gcagctcctccctg

SEQ ID NO: 1009521 - DNA, 22 bp, Homo sapiens
gcagctcctccctgtgccccca

SEQ ID NO: 1009522 - DNA, 17 bp, Homo sapiens
gcagctcctctccttgg

SEQ ID NO: 1009523 - DNA, 19 bp, Homo sapiens
cctggaacaatattttatg

SEQ ID NO: 1009524 - DNA, 16 bp, Homo sapiens
cctggaaccagggagg

SEQ ID NO: 1009525 - DNA, 21 bp, Homo sapiens
cctggaaccagggaggagagg

SEQ ID NO: 1009526 - DNA, 15 bp, Homo sapiens
cctggaaccttgctg

SEQ ID NO: 1009527 - DNA, 16 bp, Homo sapiens
cctggaaccttgctgt

SEQ ID NO: 1009528 - DNA, 17 bp, Homo sapiens
cctggaaccttgctgtc

SEQ ID NO: 1009529 - DNA, 22 bp, Homo sapiens
cctggaagaacaaatctaccag

SEQ ID NO: 1009530 - DNA, 17 bp, Homo sapiens
cctggaagctgtgtcct

SEQ ID NO: 1009531 - DNA, 15 bp, Homo sapiens
cctggaataaaatat

SEQ ID NO: 1009532 - DNA, 22 bp, Homo sapiens
cctggaattcagcaccctgggt

SEQ ID NO: 1009533 - DNA, 13 bp, Homo sapiens
cctggacaaaccc

SEQ ID NO: 1009534 - DNA, 10 bp, Homo sapiens
cctggacaca

SEQ ID NO: 1009535 - DNA, 13 bp, Homo sapiens
cctggacacacac

SEQ ID NO: 1009536 - DNA, 14 bp, Homo sapiens
cctggacacacact

SEQ ID NO: 1009537 - DNA, 15 bp, Homo sapiens
cctggacacacactc

SEQ ID NO: 1009538 - DNA, 16 bp, Homo sapiens
cctggacacacactca

SEQ ID NO: 1009539 - DNA, 13 bp, Homo sapiens
cctggacacactc

SEQ ID NO: 1009540 - DNA, 17 bp, Homo sapiens
cctggacacctcccagg

SEQ ID NO: 1009541 - DNA, 19 bp, Homo sapiens
cctggacacctcccagggg

SEQ ID NO: 1009542 - DNA, 20 bp, Homo sapiens
cctggacacctcccagggga

SEQ ID NO: 1009543 - DNA, 14 bp, Homo sapiens
cctggacagatggc

SEQ ID NO: 1009544 - DNA, 18 bp, Homo sapiens
cctggacatagagaggga

SEQ ID NO: 1009545 - DNA, 24 bp, Homo sapiens
cctggacatgaagattctttccca

SEQ ID NO: 1009546 - DNA, 21 bp, Homo sapiens
cctggacatttgccttgctgg

SEQ ID NO: 1009547 - DNA, 20 bp, Homo sapiens
cctggacattttttcagtca

SEQ ID NO: 1009548 - DNA, 18 bp, Homo sapiens
cctggaccaccagcccca

SEQ ID NO: 1009549 - DNA, 22 bp, Homo sapiens
cctggaccaccagccccagcaa

SEQ ID NO: 1009550 - DNA, 14 bp, Homo sapiens
cctggaccattcct

SEQ ID NO: 1009551 - DNA, 17 bp, Homo sapiens
cctggaccattcctgtc

SEQ ID NO: 1009552 - DNA, 20 bp, Homo sapiens
cctggaccattcctgtccct

SEQ ID NO: 1009553 - DNA, 15 bp, Homo sapiens
cctggaccccctgcc

SEQ ID NO: 1009554 - DNA, 17 bp, Homo sapiens
cctggaccccctgcccg

SEQ ID NO: 1009555 - DNA, 18 bp, Homo sapiens
cctggaccccctgcccgc

SEQ ID NO: 1009556 - DNA, 20 bp, Homo sapiens
cctggaccccctgcccgcca

SEQ ID NO: 1009557 - DNA, 14 bp, Homo sapiens
cctggacccctggg

SEQ ID NO: 1009558 - DNA, 14 bp, Homo sapiens
cctggaccctgtgg

SEQ ID NO: 1009559 - DNA, 22 bp, Homo sapiens
cctggaccgagatgtgagtcct

SEQ ID NO: 1009560 - DNA, 13 bp, Homo sapiens
cctggacctatgc

SEQ ID NO: 1009561 - DNA, 19 bp, Homo sapiens
cctggacctatgcagggag

SEQ ID NO: 1009562 - DNA, 22 bp, Homo sapiens
cctggacctgcctcctgcctgc

SEQ ID NO: 1009563 - DNA, 13 bp, Homo sapiens
cctggacctggga

SEQ ID NO: 1009564 - DNA, 16 bp, Homo sapiens
cctggaccttgggcct

SEQ ID NO: 1009565 - DNA, 15 bp, Homo sapiens
cctggactagaggga

SEQ ID NO: 1009566 - DNA, 20 bp, Homo sapiens
cctggactctaagctggagc

SEQ ID NO: 1009567 - DNA, 14 bp, Homo sapiens
cctggactctgccc

SEQ ID NO: 1009568 - DNA, 17 bp, Homo sapiens
cctggactgagccaagg

SEQ ID NO: 1009569 - DNA, 19 bp, Homo sapiens
cctggactgagccaaggag

SEQ ID NO: 1009570 - DNA, 14 bp, Homo sapiens
cctggactgggagg

SEQ ID NO: 1009571 - DNA, 17 bp, Homo sapiens
cctggactgggaggtag

SEQ ID NO: 1009572 - DNA, 16 bp, Homo sapiens
cctggacttaaagaaa

SEQ ID NO: 1009573 - DNA, 20 bp, Homo sapiens
cctggacttaagcatctggc

SEQ ID NO: 1009574 - DNA, 24 bp, Homo sapiens
cctggacttaagcatctggctcta

SEQ ID NO: 1009575 - DNA, 15 bp, Homo sapiens
cctggactttcctgc

SEQ ID NO: 1009576 - DNA, 17 bp, Homo sapiens
cctggactttcctgcaa

SEQ ID NO: 1009577 - DNA, 19 bp, Homo sapiens
cctggactttcctgcaact

SEQ ID NO: 1009578 - DNA, 15 bp, Homo sapiens
cctggagaagcacca

SEQ ID NO: 1009579 - DNA, 17 bp, Homo sapiens
cctggagaagctgatgc

SEQ ID NO: 1009580 - DNA, 18 bp, Homo sapiens
cctggagacaaggtgcta

SEQ ID NO: 1009581 - DNA, 20 bp, Homo sapiens
cctggagacaaggtgctaac

SEQ ID NO: 1009582 - DNA, 15 bp, Homo sapiens
gcaggaacgagcact

SEQ ID NO: 1009583 - DNA, 14 bp, Homo sapiens
gcaggaactcccag

SEQ ID NO: 1009584 - DNA, 21 bp, Homo sapiens
gcaggaagaggcccactagag

SEQ ID NO: 1009585 - DNA, 18 bp, Homo sapiens
gcaggaaggaacaaagac

SEQ ID NO: 1009586 - DNA, 22 bp, Homo sapiens
gcaggaaggaacaaagacaggc

SEQ ID NO: 1009587 - DNA, 16 bp, Homo sapiens
gcaggaaggaccccac

SEQ ID NO: 1009588 - DNA, 22 bp, Homo sapiens
gcaggaaggactgtcccagacg

SEQ ID NO: 1009589 - DNA, 12 bp, Homo sapiens
gcaggaaggaga

SEQ ID NO: 1009590 - DNA, 13 bp, Homo sapiens
gcaggaaggagag

SEQ ID NO: 1009591 - DNA, 15 bp, Homo sapiens
gcaggaaggagagcc

SEQ ID NO: 1009592 - DNA, 17 bp, Homo sapiens
gcaggaaggagagcctg

SEQ ID NO: 1009593 - DNA, 14 bp, Homo sapiens
gcaggaagggaagc

SEQ ID NO: 1009594 - DNA, 21 bp, Homo sapiens
gcaggaatatatgtgtgccta

SEQ ID NO: 1009595 - DNA, 13 bp, Homo sapiens
gcaggaatgaaaa

SEQ ID NO: 1009596 - DNA, 15 bp, Homo sapiens
gcaggaatgggggtc

SEQ ID NO: 1009597 - DNA, 18 bp, Homo sapiens
gcaggaatgggggtcaga

SEQ ID NO: 1009598 - DNA, 17 bp, Homo sapiens
gcaggaatgtgtggcag

SEQ ID NO: 1009599 - DNA, 15 bp, Homo sapiens
gcaggacagctcttg

SEQ ID NO: 1009600 - DNA, 15 bp, Homo sapiens
gcaggaccaaggggg

SEQ ID NO: 1009601 - DNA, 12 bp, Homo sapiens
gcaggaccagga

SEQ ID NO: 1009602 - DNA, 15 bp, Homo sapiens
gcaggaccaggacta

SEQ ID NO: 1009603 - DNA, 13 bp, Homo sapiens
gcaggaccctgct

SEQ ID NO: 1009604 - DNA, 19 bp, Homo sapiens
gcaggaccctgtcctgcag

SEQ ID NO: 1009605 - DNA, 21 bp, Homo sapiens
gcaggacctgtgctttgagat

SEQ ID NO: 1009606 - DNA, 17 bp, Homo sapiens
gcaggaccttgggcaca

SEQ ID NO: 1009607 - DNA, 17 bp, Homo sapiens
gcaggacgaaaaagagg

SEQ ID NO: 1009608 - DNA, 18 bp, Homo sapiens
gcaggactccaggcccaa

SEQ ID NO: 1009609 - DNA, 16 bp, Homo sapiens
gcaggagaatcagcct

SEQ ID NO: 1009610 - DNA, 20 bp, Homo sapiens
gcaggagagactgagcagcc

SEQ ID NO: 1009611 - DNA, 17 bp, Homo sapiens
gcaggagcagtatcatg

SEQ ID NO: 1009612 - DNA, 24 bp, Homo sapiens
gcaggagcatgtatgtctgcaggt

SEQ ID NO: 1009613 - DNA, 14 bp, Homo sapiens
gcaggagccccgcc

SEQ ID NO: 1009614 - DNA, 19 bp, Homo sapiens
gcaggagccccgccacagc

SEQ ID NO: 1009615 - DNA, 18 bp, Homo sapiens
gcaggagcctccctgcac

SEQ ID NO: 1009616 - DNA, 14 bp, Homo sapiens
gcaggagcctgagc

SEQ ID NO: 1009617 - DNA, 22 bp, Homo sapiens
gcaggagcttctgggagatttt

SEQ ID NO: 1009618 - DNA, 14 bp, Homo sapiens
gcaggaggagtgga

SEQ ID NO: 1009619 - DNA, 20 bp, Homo sapiens
gcaggaggatcacttgagtc

SEQ ID NO: 1009620 - DNA, 16 bp, Homo sapiens
gcaggaggccaataaa

SEQ ID NO: 1009621 - DNA, 17 bp, Homo sapiens
gcaggaggccaataaaa

SEQ ID NO: 1009622 - DNA, 20 bp, Homo sapiens
gcaggaggctttgggtggct

SEQ ID NO: 1009623 - DNA, 16 bp, Homo sapiens
gcaggagggaggcggg

SEQ ID NO: 1009624 - DNA, 21 bp, Homo sapiens
gcaggagggaggcggggagga

SEQ ID NO: 1009625 - DNA, 22 bp, Homo sapiens
gcaggagggaggcggggaggag

SEQ ID NO: 1009626 - DNA, 13 bp, Homo sapiens
gcaggagggcact

SEQ ID NO: 1009627 - DNA, 14 bp, Homo sapiens
gcaggagggcactg

SEQ ID NO: 1009628 - DNA, 18 bp, Homo sapiens
gcaggagggtgaggaggt

SEQ ID NO: 1009629 - DNA, 14 bp, Homo sapiens
gcaggaggtggaga

SEQ ID NO: 1009630 - DNA, 23 bp, Homo sapiens
gcaggagtctctgccacccactc

SEQ ID NO: 1009631 - DNA, 15 bp, Homo sapiens
gcaggagtgccagga

SEQ ID NO: 1009632 - DNA, 20 bp, Homo sapiens
gcaggagtgccaggaccagc

SEQ ID NO: 1009633 - DNA, 18 bp, Homo sapiens
gcaggagtggtgcagaca

SEQ ID NO: 1009634 - DNA, 17 bp, Homo sapiens
gcaggagtgtcctgccc

SEQ ID NO: 1009635 - DNA, 21 bp, Homo sapiens
gcaggagtgtcctgcccatgc

SEQ ID NO: 1009636 - DNA, 22 bp, Homo sapiens
gcaggagtgtcctgcccatgcc

SEQ ID NO: 1009637 - DNA, 23 bp, Homo sapiens
gcaggatcagatgactctctcca

SEQ ID NO: 1009638 - DNA, 18 bp, Homo sapiens
gcaggatctcaagccagc

SEQ ID NO: 1009639 - DNA, 21 bp, Homo sapiens
gcaggatgaccacgcacctcc

SEQ ID NO: 1009640 - DNA, 23 bp, Homo sapiens
gcaggatgaccacgcacctccac

SEQ ID NO: 1009641 - DNA, 18 bp, Homo sapiens
gcaggatgattgtacaga

SEQ ID NO: 1009642 - DNA, 19 bp, Homo sapiens
gcaggcaatgctgtacttt

SEQ ID NO: 1009643 - DNA, 21 bp, Homo sapiens
gcaggcacagaggaggtcagc

SEQ ID NO: 1009644 - DNA, 22 bp, Homo sapiens
gcaggcacagaggaggtcagca

SEQ ID NO: 1009645 - DNA, 11 bp, Homo sapiens
gcaggcagaca

SEQ ID NO: 1009646 - DNA, 20 bp, Homo sapiens
gcaggcagacacggatctga

SEQ ID NO: 1009647 - DNA, 20 bp, Homo sapiens
gcaggcagactacacaggat

SEQ ID NO: 1009648 - DNA, 13 bp, Homo sapiens
gcaggcagagagt

SEQ ID NO: 1009649 - DNA, 14 bp, Homo sapiens
gcaggcagccttga

SEQ ID NO: 1009650 - DNA, 17 bp, Homo sapiens
gactttgcccccttgcc

SEQ ID NO: 1009651 - DNA, 12 bp, Homo sapiens
gactttgctgtt

SEQ ID NO: 1009652 - DNA, 12 bp, Homo sapiens
gactttgcttgc

SEQ ID NO: 1009653 - DNA, 18 bp, Homo sapiens
gactttgggataggaaaa

SEQ ID NO: 1009654 - DNA, 15 bp, Homo sapiens
gactttggggacagg

SEQ ID NO: 1009655 - DNA, 16 bp, Homo sapiens
gactttgtgaatctga

SEQ ID NO: 1009656 - DNA, 19 bp, Homo sapiens
gactttgtgttcatttcat

SEQ ID NO: 1009657 - DNA, 18 bp, Homo sapiens
gacttttaatcagtgaag

SEQ ID NO: 1009658 - DNA, 15 bp, Homo sapiens
gacttttccaagccc

SEQ ID NO: 1009659 - DNA, 19 bp, Homo sapiens
gacttttcgaccaattcaa

SEQ ID NO: 1009660 - DNA, 14 bp, Homo sapiens
gacttttctgccct

SEQ ID NO: 1009661 - DNA, 23 bp, Homo sapiens
gacttttctgtccgagctttgaa

SEQ ID NO: 1009662 - DNA, 22 bp, Homo sapiens
gacttttgcttaccttttccta

SEQ ID NO: 1009663 - DNA, 14 bp, Homo sapiens
gacttttgttgaaa

SEQ ID NO: 1009664 - DNA, 13 bp, Homo sapiens
gactttttataaa

SEQ ID NO: 1009665 - DNA, 16 bp, Homo sapiens
gactttttgcatttaa

SEQ ID NO: 1009666 - DNA, 20 bp, Homo sapiens
gactttttggaattcagcag

SEQ ID NO: 1009667 - DNA, 23 bp, Homo sapiens
gactttttttggtataatgttta

SEQ ID NO: 1009668 - DNA, 17 bp, Homo sapiens
gactttttttgtatgtg

SEQ ID NO: 1009669 - DNA, 16 bp, Homo sapiens
gagaaaaaaaaaatag

SEQ ID NO: 1009670 - DNA, 13 bp, Homo sapiens
gagaaaaaaaaag

SEQ ID NO: 1009671 - DNA, 14 bp, Homo sapiens
gagaaaaaaaaagt

SEQ ID NO: 1009672 - DNA, 19 bp, Homo sapiens
gagaaaaaaaaccttgtaa

SEQ ID NO: 1009673 - DNA, 13 bp, Homo sapiens
gagaaaaaaatat

SEQ ID NO: 1009674 - DNA, 20 bp, Homo sapiens
gagaaaaaaatcaaccctgc

SEQ ID NO: 1009675 - DNA, 14 bp, Homo sapiens
gagaaaaaagaagt

SEQ ID NO: 1009676 - DNA, 18 bp, Homo sapiens
gagaaaaaatcactgttt

SEQ ID NO: 1009677 - DNA, 11 bp, Homo sapiens
gagaaaaacaa

SEQ ID NO: 1009678 - DNA, 14 bp, Homo sapiens
gagaaaaagaaatg

SEQ ID NO: 1009679 - DNA, 13 bp, Homo sapiens
gagaaaaagatat

SEQ ID NO: 1009680 - DNA, 19 bp, Homo sapiens
gagaaaaagctcctgtcct

SEQ ID NO: 1009681 - DNA, 22 bp, Homo sapiens
gagaaaaatattcaagtaacac

SEQ ID NO: 1009682 - DNA, 18 bp, Homo sapiens
gagaaaaatgctccccac

SEQ ID NO: 1009683 - DNA, 20 bp, Homo sapiens
gagaaaagaaaaaaaaagaa

SEQ ID NO: 1009684 - DNA, 18 bp, Homo sapiens
gagaaaatataaggactt

SEQ ID NO: 1009685 - DNA, 19 bp, Homo sapiens
gagaaaatatatgtatttt

SEQ ID NO: 1009686 - DNA, 11 bp, Homo sapiens
gagaaaatcat

SEQ ID NO: 1009687 - DNA, 15 bp, Homo sapiens
gagaaaatccaggtc

SEQ ID NO: 1009688 - DNA, 20 bp, Homo sapiens
ccccttcttgggccccagac

SEQ ID NO: 1009689 - DNA, 22 bp, Homo sapiens
ccccttgaagaggggaggggcc

SEQ ID NO: 1009690 - DNA, 15 bp, Homo sapiens
ccccttgaagcaata

SEQ ID NO: 1009691 - DNA, 16 bp, Homo sapiens
ccccttgaagcaataa

SEQ ID NO: 1009692 - DNA, 18 bp, Homo sapiens
ccccttgattcccaccgt

SEQ ID NO: 1009693 - DNA, 17 bp, Homo sapiens
ccccttgcccagggctc

SEQ ID NO: 1009694 - DNA, 12 bp, Homo sapiens
ccccttgccctc

SEQ ID NO: 1009695 - DNA, 18 bp, Homo sapiens
ccccttgccctccgcctg

SEQ ID NO: 1009696 - DNA, 21 bp, Homo sapiens
ccccttgccctccgcctggga

SEQ ID NO: 1009697 - DNA, 19 bp, Homo sapiens
ccccttgcccttgccctga

SEQ ID NO: 1009698 - DNA, 16 bp, Homo sapiens
ccccttgctcccttca

SEQ ID NO: 1009699 - DNA, 22 bp, Homo sapiens
ccccttggaaatgtctgctggt

SEQ ID NO: 1009700 - DNA, 16 bp, Homo sapiens
ccccttggacctccag

SEQ ID NO: 1009701 - DNA, 17 bp, Homo sapiens
ccccttggacctccagg

SEQ ID NO: 1009702 - DNA, 18 bp, Homo sapiens
ccccttgtcctttccctt

SEQ ID NO: 1009703 - DNA, 16 bp, Homo sapiens
ccccttgtctccctgg

SEQ ID NO: 1009704 - DNA, 19 bp, Homo sapiens
ccccttgtgggcaaaggca

SEQ ID NO: 1009705 - DNA, 16 bp, Homo sapiens
ccccttgttgcactgc

SEQ ID NO: 1009706 - DNA, 14 bp, Homo sapiens
cccctttcacactg

SEQ ID NO: 1009707 - DNA, 17 bp, Homo sapiens
cccctttcacactggat

SEQ ID NO: 1009708 - DNA, 10 bp, Homo sapiens
cccctttcct

SEQ ID NO: 1009709 - DNA, 12 bp, Homo sapiens
cccctttccttc

SEQ ID NO: 1009710 - DNA, 13 bp, Homo sapiens
cccctttccttca

SEQ ID NO: 1009711 - DNA, 13 bp, Homo sapiens
cccctttgtcctg

SEQ ID NO: 1009712 - DNA, 14 bp, Homo sapiens
ccccttttaccact

SEQ ID NO: 1009713 - DNA, 19 bp, Homo sapiens
ccccttttctatgttgcta

SEQ ID NO: 1009714 - DNA, 17 bp, Homo sapiens
ccccttttctccccacg

SEQ ID NO: 1009715 - DNA, 12 bp, Homo sapiens
ccccttttctct

SEQ ID NO: 1009716 - DNA, 20 bp, Homo sapiens
ccccttttctctgctcttgt

SEQ ID NO: 1009717 - DNA, 21 bp, Homo sapiens
ccccttttctctgctcttgtt

SEQ ID NO: 1009718 - DNA, 16 bp, Homo sapiens
ccccttttctgcattt

SEQ ID NO: 1009719 - DNA, 20 bp, Homo sapiens
ccccttttgcctggctgtgg

SEQ ID NO: 1009720 - DNA, 23 bp, Homo sapiens
ccccttttgcctggctgtggagg

SEQ ID NO: 1009721 - DNA, 20 bp, Homo sapiens
ccccttttgtgggtttctct

SEQ ID NO: 1009722 - DNA, 22 bp, Homo sapiens
ccccttttgtgggtttctctgt

SEQ ID NO: 1009723 - DNA, 18 bp, Homo sapiens
cccctttttactcccctt

SEQ ID NO: 1009724 - DNA, 15 bp, Homo sapiens
cccgaaagcatcact

SEQ ID NO: 1009725 - DNA, 19 bp, Homo sapiens
cccgaaagcatcactgcct

SEQ ID NO: 1009726 - DNA, 17 bp, Homo sapiens
cccgaaatcagccccca

SEQ ID NO: 1009727 - DNA, 15 bp, Homo sapiens
cccgaagtcctgtca

SEQ ID NO: 1009728 - DNA, 20 bp, Homo sapiens
cccgacacacggggctcggg

SEQ ID NO: 1009729 - DNA, 14 bp, Homo sapiens
cccgacactgctgc

SEQ ID NO: 1009730 - DNA, 18 bp, Homo sapiens
cccgacactgctgcacca

SEQ ID NO: 1009731 - DNA, 22 bp, Homo sapiens
cccgacactgctgcaccagagt

SEQ ID NO: 1009732 - DNA, 23 bp, Homo sapiens
cccgacactgctgcaccagagtg

SEQ ID NO: 1009733 - DNA, 12 bp, Homo sapiens
cccgacagccca

SEQ ID NO: 1009734 - DNA, 15 bp, Homo sapiens
cccgacagcctggca

SEQ ID NO: 1009735 - DNA, 13 bp, Homo sapiens
cccgacagtgcca

SEQ ID NO: 1009736 - DNA, 23 bp, Homo sapiens
cccgacagtgccatccccacctt

SEQ ID NO: 1009737 - DNA, 17 bp, Homo sapiens
cccgacagtggctctcc

SEQ ID NO: 1009738 - DNA, 18 bp, Homo sapiens
cccgaccaatccccagcc

SEQ ID NO: 1009739 - DNA, 20 bp, Homo sapiens
cccgaccaatccccagccta

SEQ ID NO: 1009740 - DNA, 16 bp, Homo sapiens
cccgacccagccagct

SEQ ID NO: 1009741 - DNA, 19 bp, Homo sapiens
cccgacccccgcagaggca

SEQ ID NO: 1009742 - DNA, 14 bp, Homo sapiens
cccgaccccgagtc

SEQ ID NO: 1009743 - DNA, 19 bp, Homo sapiens
cccgacggcctccaggagg

SEQ ID NO: 1009744 - DNA, 13 bp, Homo sapiens
cccgacggctgtg

SEQ ID NO: 1009745 - DNA, 15 bp, Homo sapiens
cccgacggctgtgac

SEQ ID NO: 1009746 - DNA, 15 bp, Homo sapiens
cccgactagcaggca

SEQ ID NO: 1009747 - DNA, 20 bp, Homo sapiens
cccgactccagccagcgcct

SEQ ID NO: 1009748 - DNA, 12 bp, Homo sapiens
cccgactcctca

SEQ ID NO: 1009749 - DNA, 14 bp, Homo sapiens
cccgactcctcaaa

SEQ ID NO: 1009750 - DNA, 12 bp, Homo sapiens
cccgactgcctg

SEQ ID NO: 1009751 - DNA, 13 bp, Homo sapiens
cccgacttgctgt

SEQ ID NO: 1009752 - DNA, 12 bp, Homo sapiens
cccgagcccagc

SEQ ID NO: 1009753 - DNA, 17 bp, Homo sapiens
cccgagctcctcttcca

SEQ ID NO: 1009754 - DNA, 21 bp, Homo sapiens
cccgaggagctgggcccctgc

SEQ ID NO: 1009755 - DNA, 12 bp, Homo sapiens
cccgaggctgcc

SEQ ID NO: 1009756 - DNA, 19 bp, Homo sapiens
cccgaggctgccccaggcc

SEQ ID NO: 1009757 - DNA, 22 bp, Homo sapiens
cccgagggatggtgcccctagg

SEQ ID NO: 1009758 - DNA, 16 bp, Homo sapiens
cccgagggcgaaggcc

SEQ ID NO: 1009759 - DNA, 15 bp, Homo sapiens
cccgagggctgagga

SEQ ID NO: 1009760 - DNA, 19 bp, Homo sapiens
cccgagggctgaggagcag

SEQ ID NO: 1009761 - DNA, 21 bp, Homo sapiens
cccgagggctgaggagcagcc

SEQ ID NO: 1009762 - DNA, 20 bp, Homo sapiens
cccgagtagctgggattaca

SEQ ID NO: 1009763 - DNA, 14 bp, Homo sapiens
cccgagtcctcagg

SEQ ID NO: 1009764 - DNA, 17 bp, Homo sapiens
cccgagttcctctgggt

SEQ ID NO: 1009765 - DNA, 22 bp, Homo sapiens
cccgatgagggaaggagcccag

SEQ ID NO: 1009766 - DNA, 17 bp, Homo sapiens
cccgatgattcttaaca

SEQ ID NO: 1009767 - DNA, 16 bp, Homo sapiens
cccgatgctgctttcc

SEQ ID NO: 1009768 - DNA, 22 bp, Homo sapiens
cccgatgctgctttcccctgtg

SEQ ID NO: 1009769 - DNA, 23 bp, Homo sapiens
cccgatggaggactccaggcagc

SEQ ID NO: 1009770 - DNA, 16 bp, Homo sapiens
cccgatggtctctctc

SEQ ID NO: 1009771 - DNA, 16 bp, Homo sapiens
cccgatgtcccctgcg

SEQ ID NO: 1009772 - DNA, 14 bp, Homo sapiens
cccgcaaggcctct

SEQ ID NO: 1009773 - DNA, 16 bp, Homo sapiens
cccgcacagccacccg

SEQ ID NO: 1009774 - DNA, 18 bp, Homo sapiens
cccgcacagccacccgtg

SEQ ID NO: 1009775 - DNA, 15 bp, Homo sapiens
cccgcaccaagcaga

SEQ ID NO: 1009776 - DNA, 15 bp, Homo sapiens
cccgcaccccagtgc

SEQ ID NO: 1009777 - DNA, 17 bp, Homo sapiens
cccgcacccccaccctt

SEQ ID NO: 1009778 - DNA, 19 bp, Homo sapiens
cccgcacccccgccaggcg

SEQ ID NO: 1009779 - DNA, 18 bp, Homo sapiens
gagaagttcatatttctt

SEQ ID NO: 1009780 - DNA, 21 bp, Homo sapiens
gagaagtttcgaggggtcctc

SEQ ID NO: 1009781 - DNA, 16 bp, Homo sapiens
gagaataaaattccta

SEQ ID NO: 1009782 - DNA, 22 bp, Homo sapiens
gagaataagagaaagaaaatga

SEQ ID NO: 1009783 - DNA, 18 bp, Homo sapiens
gagaatactttgcttcat

SEQ ID NO: 1009784 - DNA, 19 bp, Homo sapiens
gagaatactttgcttcata

SEQ ID NO: 1009785 - DNA, 16 bp, Homo sapiens
gagaatagagctgcca

SEQ ID NO: 1009786 - DNA, 19 bp, Homo sapiens
gagaatagagctgccactg

SEQ ID NO: 1009787 - DNA, 19 bp, Homo sapiens
gagaatagatcagtatttc

SEQ ID NO: 1009788 - DNA, 16 bp, Homo sapiens
gagaatagcttttact

SEQ ID NO: 1009789 - DNA, 14 bp, Homo sapiens
gagaatatatacat

SEQ ID NO: 1009790 - DNA, 19 bp, Homo sapiens
gagaatatgtatgcctgca

SEQ ID NO: 1009791 - DNA, 22 bp, Homo sapiens
gagaatatttactaactaaata

SEQ ID NO: 1009792 - DNA, 21 bp, Homo sapiens
gagaatattttaagtattgca

SEQ ID NO: 1009793 - DNA, 22 bp, Homo sapiens
gagaatcacttaagcctggaag

SEQ ID NO: 1009794 - DNA, 19 bp, Homo sapiens
gagaatcacttttctagac

SEQ ID NO: 1009795 - DNA, 15 bp, Homo sapiens
gagaatcaggttgca

SEQ ID NO: 1009796 - DNA, 17 bp, Homo sapiens
gagaatcccttaaaatt

SEQ ID NO: 1009797 - DNA, 15 bp, Homo sapiens
gagaatctcttggga

SEQ ID NO: 1009798 - DNA, 20 bp, Homo sapiens
gagaatctgggggtgaggag

SEQ ID NO: 1009799 - DNA, 21 bp, Homo sapiens
gagaatctgggggtgaggagg

SEQ ID NO: 1009800 - DNA, 22 bp, Homo sapiens
gagaatctgggggtgaggagga

SEQ ID NO: 1009801 - DNA, 17 bp, Homo sapiens
gagaatcttaaggtcta

SEQ ID NO: 1009802 - DNA, 13 bp, Homo sapiens
gagaatgaactgt

SEQ ID NO: 1009803 - DNA, 14 bp, Homo sapiens
gagaatgaactgtg

SEQ ID NO: 1009804 - DNA, 14 bp, Homo sapiens
gagaatgagaaatg

SEQ ID NO: 1009805 - DNA, 13 bp, Homo sapiens
gagaatgagggtc

SEQ ID NO: 1009806 - DNA, 15 bp, Homo sapiens
gagaatgagtgggaa

SEQ ID NO: 1009807 - DNA, 17 bp, Homo sapiens
gagaatgcagcccacca

SEQ ID NO: 1009808 - DNA, 15 bp, Homo sapiens
gagaatggaaaacag

SEQ ID NO: 1009809 - DNA, 23 bp, Homo sapiens
gagaatggcccagtcctctccca

SEQ ID NO: 1009810 - DNA, 17 bp, Homo sapiens
cccgccccgggctggcc

SEQ ID NO: 1009811 - DNA, 16 bp, Homo sapiens
cccgcccctcgctgct

SEQ ID NO: 1009812 - DNA, 22 bp, Homo sapiens
cccgcccctcgctgctgctact

SEQ ID NO: 1009813 - DNA, 14 bp, Homo sapiens
cccgcccctgtggc

SEQ ID NO: 1009814 - DNA, 15 bp, Homo sapiens
cccgcccctgtggcc

SEQ ID NO: 1009815 - DNA, 20 bp, Homo sapiens
cccgcccctgtggccctggc

SEQ ID NO: 1009816 - DNA, 13 bp, Homo sapiens
cccgcccgcgtcc

SEQ ID NO: 1009817 - DNA, 20 bp, Homo sapiens
cccgccgcccctccacccat

SEQ ID NO: 1009818 - DNA, 16 bp, Homo sapiens
cccgccgtctgcaggg

SEQ ID NO: 1009819 - DNA, 15 bp, Homo sapiens
cccgccgtctgctcc

SEQ ID NO: 1009820 - DNA, 22 bp, Homo sapiens
cccgccgtctgctccggggtgg

SEQ ID NO: 1009821 - DNA, 13 bp, Homo sapiens
cccgcctccctct

SEQ ID NO: 1009822 - DNA, 12 bp, Homo sapiens
cccgcctctccc

SEQ ID NO: 1009823 - DNA, 13 bp, Homo sapiens
cccgcctctcccg

SEQ ID NO: 1009824 - DNA, 23 bp, Homo sapiens
cccgcctgagtcagtgctctcag

SEQ ID NO: 1009825 - DNA, 13 bp, Homo sapiens
cccgcctgccacc

SEQ ID NO: 1009826 - DNA, 13 bp, Homo sapiens
cccgcctgccctc

SEQ ID NO: 1009827 - DNA, 17 bp, Homo sapiens
cccgcctgccctcatgg

SEQ ID NO: 1009828 - DNA, 14 bp, Homo sapiens
cccgcctgccgtgc

SEQ ID NO: 1009829 - DNA, 19 bp, Homo sapiens
cccgcctgccgtgcatggc

SEQ ID NO: 1009830 - DNA, 16 bp, Homo sapiens
cccgcctgcctgccac

SEQ ID NO: 1009831 - DNA, 15 bp, Homo sapiens
cccgcctggccagga

SEQ ID NO: 1009832 - DNA, 16 bp, Homo sapiens
cccgcctggccaggag

SEQ ID NO: 1009833 - DNA, 16 bp, Homo sapiens
cccgccttcctcctcc

SEQ ID NO: 1009834 - DNA, 23 bp, Homo sapiens
cccgccttcctcctccacagtgc

SEQ ID NO: 1009835 - DNA, 14 bp, Homo sapiens
cccgccttcgtgtg

SEQ ID NO: 1009836 - DNA, 17 bp, Homo sapiens
cccgcgcccgcgccctc

SEQ ID NO: 1009837 - DNA, 14 bp, Homo sapiens
cccgcgccctccct

SEQ ID NO: 1009838 - DNA, 15 bp, Homo sapiens
cccgcgccctccctc

SEQ ID NO: 1009839 - DNA, 15 bp, Homo sapiens
cccgcgcctccttcc

SEQ ID NO: 1009840 - DNA, 17 bp, Homo sapiens
cccgcgctcgcccagca

SEQ ID NO: 1009841 - DNA, 22 bp, Homo sapiens
cccgcggcccagacccagcccg

SEQ ID NO: 1009842 - DNA, 18 bp, Homo sapiens
cccgcgggcacagccagc

SEQ ID NO: 1009843 - DNA, 20 bp, Homo sapiens
cccgcgggcacagccagccc

SEQ ID NO: 1009844 - DNA, 14 bp, Homo sapiens
cccgcgggttctag

SEQ ID NO: 1009845 - DNA, 16 bp, Homo sapiens
cccgcggtgctctggc

SEQ ID NO: 1009846 - DNA, 18 bp, Homo sapiens
cccgcgtccaaccccggg

SEQ ID NO: 1009847 - DNA, 21 bp, Homo sapiens
cccgctaggctcgccttccct

SEQ ID NO: 1009848 - DNA, 21 bp, Homo sapiens
cccgctcacaacttgggttct

SEQ ID NO: 1009849 - DNA, 12 bp, Homo sapiens
cccgctcagccc

SEQ ID NO: 1009850 - DNA, 17 bp, Homo sapiens
cccgctcagcccagctg

SEQ ID NO: 1009851 - DNA, 14 bp, Homo sapiens
cccgctcagccctc

SEQ ID NO: 1009852 - DNA, 19 bp, Homo sapiens
cccgctcagccctccctgc

SEQ ID NO: 1009853 - DNA, 23 bp, Homo sapiens
cccgctcagccctccctgcccct

SEQ ID NO: 1009854 - DNA, 13 bp, Homo sapiens
cccgctcccacag

SEQ ID NO: 1009855 - DNA, 21 bp, Homo sapiens
cccgctgagctgagtggccag

SEQ ID NO: 1009856 - DNA, 20 bp, Homo sapiens
cccgctgcaatgcctagact

SEQ ID NO: 1009857 - DNA, 21 bp, Homo sapiens
cccgctgcagcctctgcctct

SEQ ID NO: 1009858 - DNA, 16 bp, Homo sapiens
cccgctgcctcctgct

SEQ ID NO: 1009859 - DNA, 15 bp, Homo sapiens
cccgctgcctcttgg

SEQ ID NO: 1009860 - DNA, 16 bp, Homo sapiens
cccgctgcctcttggc

SEQ ID NO: 1009861 - DNA, 13 bp, Homo sapiens
cccgctgctgtgc

SEQ ID NO: 1009862 - DNA, 19 bp, Homo sapiens
cccgctgctgtgctctggg

SEQ ID NO: 1009863 - DNA, 21 bp, Homo sapiens
cccgctgctgtgctctgggga

SEQ ID NO: 1009864 - DNA, 22 bp, Homo sapiens
cccgctggaggatgtgggcagc

SEQ ID NO: 1009865 - DNA, 17 bp, Homo sapiens
cccgcttagccccgctg

SEQ ID NO: 1009866 - DNA, 14 bp, Homo sapiens
cccgcttagcctgc

SEQ ID NO: 1009867 - DNA, 17 bp, Homo sapiens
cccgcttagcctgcctc

SEQ ID NO: 1009868 - DNA, 16 bp, Homo sapiens
cccgcttagcgctctg

SEQ ID NO: 1009869 - DNA, 22 bp, Homo sapiens
cccgcttagcgctctggacaga

SEQ ID NO: 1009870 - DNA, 19 bp, Homo sapiens
cccgcttagttcttgaatt

SEQ ID NO: 1009871 - DNA, 17 bp, Homo sapiens
cccgcttccccttgcca

SEQ ID NO: 1009872 - DNA, 20 bp, Homo sapiens
cccggacaggtggggcctca

SEQ ID NO: 1009873 - DNA, 22 bp, Homo sapiens
cccggacaggtggggcctcagc

SEQ ID NO: 1009874 - DNA, 23 bp, Homo sapiens
cccggacaggtggggcctcagcc

SEQ ID NO: 1009875 - DNA, 18 bp, Homo sapiens
cccggactcaccaacttg

SEQ ID NO: 1009876 - DNA, 14 bp, Homo sapiens
cccggagcacagcc

SEQ ID NO: 1009877 - DNA, 21 bp, Homo sapiens
cccggagccatcaccctcacc

SEQ ID NO: 1009878 - DNA, 20 bp, Homo sapiens
cccggagctaacactggccc

SEQ ID NO: 1009879 - DNA, 16 bp, Homo sapiens
cccggaggaaatctgc

SEQ ID NO: 1009880 - DNA, 19 bp, Homo sapiens
cccggaggcgtggaggaga

SEQ ID NO: 1009881 - DNA, 21 bp, Homo sapiens
cccggagtaatcaggcagcct

SEQ ID NO: 1009882 - DNA, 17 bp, Homo sapiens
cccggatcagagcagga

SEQ ID NO: 1009883 - DNA, 22 bp, Homo sapiens
cccggatcagagcaggacctcc

SEQ ID NO: 1009884 - DNA, 13 bp, Homo sapiens
cccggcaggcctg

SEQ ID NO: 1009885 - DNA, 21 bp, Homo sapiens
cccggcaggcctgagaatgag

SEQ ID NO: 1009886 - DNA, 15 bp, Homo sapiens
cccggccacacccag

SEQ ID NO: 1009887 - DNA, 13 bp, Homo sapiens
cccggccacagct

SEQ ID NO: 1009888 - DNA, 14 bp, Homo sapiens
cccggccacagctg

SEQ ID NO: 1009889 - DNA, 21 bp, Homo sapiens
cccggccccacctccctgcgc

SEQ ID NO: 1009890 - DNA, 13 bp, Homo sapiens
cccggccccagcc

SEQ ID NO: 1009891 - DNA, 15 bp, Homo sapiens
cccggccccagccag

SEQ ID NO: 1009892 - DNA, 16 bp, Homo sapiens
cccggccccagccaga

SEQ ID NO: 1009893 - DNA, 21 bp, Homo sapiens
cccggccccccgcgctcgccc

SEQ ID NO: 1009894 - DNA, 19 bp, Homo sapiens
cccggcccccctctcgggc

SEQ ID NO: 1009895 - DNA, 13 bp, Homo sapiens
cccggcccctcac

SEQ ID NO: 1009896 - DNA, 15 bp, Homo sapiens
cccggcccctcaccc

SEQ ID NO: 1009897 - DNA, 22 bp, Homo sapiens
cccggccctaccagcgcccgct

SEQ ID NO: 1009898 - DNA, 22 bp, Homo sapiens
cccggcctcctcggagagcagc

SEQ ID NO: 1009899 - DNA, 11 bp, Homo sapiens
cccggcctctt

SEQ ID NO: 1009900 - DNA, 15 bp, Homo sapiens
cccggcctcttccac

SEQ ID NO: 1009901 - DNA, 17 bp, Homo sapiens
cccggcctcttccaccc

SEQ ID NO: 1009902 - DNA, 17 bp, Homo sapiens
cccggcctgctcccagc

SEQ ID NO: 1009903 - DNA, 20 bp, Homo sapiens
cccggcctgctcccagcagc

SEQ ID NO: 1009904 - DNA, 15 bp, Homo sapiens
cccggcgcctgccct

SEQ ID NO: 1009905 - DNA, 16 bp, Homo sapiens
cccggcgcctgccctg

SEQ ID NO: 1009906 - DNA, 23 bp, Homo sapiens
gagactccagaatctgctgttgc

SEQ ID NO: 1009907 - DNA, 15 bp, Homo sapiens
gagactccatagttt

SEQ ID NO: 1009908 - DNA, 14 bp, Homo sapiens
gagactccatcttg

SEQ ID NO: 1009909 - DNA, 23 bp, Homo sapiens
gagactcctggtctgtgaagagc

SEQ ID NO: 1009910 - DNA, 17 bp, Homo sapiens
gagactctattttaatg

SEQ ID NO: 1009911 - DNA, 22 bp, Homo sapiens
gagactctattttaatgtatat

SEQ ID NO: 1009912 - DNA, 23 bp, Homo sapiens
gagactctgatggaatgtgccac

SEQ ID NO: 1009913 - DNA, 14 bp, Homo sapiens
gagactctgtctca

SEQ ID NO: 1009914 - DNA, 15 bp, Homo sapiens
gagactgaaagcagc

SEQ ID NO: 1009915 - DNA, 19 bp, Homo sapiens
gagactgaaagcagcagct

SEQ ID NO: 1009916 - DNA, 20 bp, Homo sapiens
gagactgaaagcagcagcta

SEQ ID NO: 1009917 - DNA, 14 bp, Homo sapiens
gagactgagcagcc

SEQ ID NO: 1009918 - DNA, 22 bp, Homo sapiens
gagactgataacttggggaggc

SEQ ID NO: 1009919 - DNA, 22 bp, Homo sapiens
gagactgatccctggccactga

SEQ ID NO: 1009920 - DNA, 19 bp, Homo sapiens
gagactgcaggtgggctgg

SEQ ID NO: 1009921 - DNA, 22 bp, Homo sapiens
gagactgcaggtgggctgggcc

SEQ ID NO: 1009922 - DNA, 15 bp, Homo sapiens
gagactgcccagcta

SEQ ID NO: 1009923 - DNA, 16 bp, Homo sapiens
gagactgcccttctca

SEQ ID NO: 1009924 - DNA, 19 bp, Homo sapiens
gagactgcgggatggtcct

SEQ ID NO: 1009925 - DNA, 17 bp, Homo sapiens
gagactgcttcccatcc

SEQ ID NO: 1009926 - DNA, 23 bp, Homo sapiens
gagactgcttcccatcctaccct

SEQ ID NO: 1009927 - DNA, 20 bp, Homo sapiens
gagactggagcatctgactc

SEQ ID NO: 1009928 - DNA, 13 bp, Homo sapiens
gagactgggaaga

SEQ ID NO: 1009929 - DNA, 17 bp, Homo sapiens
gagactgggaaggcttg

SEQ ID NO: 1009930 - DNA, 22 bp, Homo sapiens
gagactgggaaggcttgggatt

SEQ ID NO: 1009931 - DNA, 16 bp, Homo sapiens
gagactgggagccact

SEQ ID NO: 1009932 - DNA, 18 bp, Homo sapiens
cccgggggcagggtgggg

SEQ ID NO: 1009933 - DNA, 14 bp, Homo sapiens
cccggggtctcctg

SEQ ID NO: 1009934 - DNA, 15 bp, Homo sapiens
cccggggtctcctgg

SEQ ID NO: 1009935 - DNA, 19 bp, Homo sapiens
cccggggtctcctggacct

SEQ ID NO: 1009936 - DNA, 17 bp, Homo sapiens
cccgggtgcctcagagc

SEQ ID NO: 1009937 - DNA, 23 bp, Homo sapiens
cccgggtgcctcagagcaggctc

SEQ ID NO: 1009938 - DNA, 20 bp, Homo sapiens
cccgggtgtgcctgccctgg

SEQ ID NO: 1009939 - DNA, 22 bp, Homo sapiens
cccgggtgtgcctgccctggag

SEQ ID NO: 1009940 - DNA, 22 bp, Homo sapiens
cccgggtttggcgggccaagga

SEQ ID NO: 1009941 - DNA, 14 bp, Homo sapiens
cccggtgctccctc

SEQ ID NO: 1009942 - DNA, 19 bp, Homo sapiens
cccggttattcgcccaccc

SEQ ID NO: 1009943 - DNA, 15 bp, Homo sapiens
cccggttgcagtcac

SEQ ID NO: 1009944 - DNA, 15 bp, Homo sapiens
cccggttgctggtca

SEQ ID NO: 1009945 - DNA, 18 bp, Homo sapiens
cccggttgctggtcaggt

SEQ ID NO: 1009946 - DNA, 19 bp, Homo sapiens
cccgtactaggttggacag

SEQ ID NO: 1009947 - DNA, 19 bp, Homo sapiens
cccgtagagaatgtgtgta

SEQ ID NO: 1009948 - DNA, 16 bp, Homo sapiens
cccgtagtctcctggg

SEQ ID NO: 1009949 - DNA, 14 bp, Homo sapiens
cccgtatcacagtg

SEQ ID NO: 1009950 - DNA, 15 bp, Homo sapiens
cccgtatcacagtgt

SEQ ID NO: 1009951 - DNA, 18 bp, Homo sapiens
cccgtcaccatctcaggc

SEQ ID NO: 1009952 - DNA, 15 bp, Homo sapiens
cccgtcagctgcttc

SEQ ID NO: 1009953 - DNA, 16 bp, Homo sapiens
cccgtcccatatcctg

SEQ ID NO: 1009954 - DNA, 14 bp, Homo sapiens
cccgtcccctgcag

SEQ ID NO: 1009955 - DNA, 19 bp, Homo sapiens
cccgtcccctgcagcctgg

SEQ ID NO: 1009956 - DNA, 23 bp, Homo sapiens
cccgtcccctgcagcctgggtct

SEQ ID NO: 1009957 - DNA, 21 bp, Homo sapiens
cccgtccctgtcccccagcat

SEQ ID NO: 1009958 - DNA, 18 bp, Homo sapiens
cccgtcctccctcagcct

SEQ ID NO: 1009959 - DNA, 20 bp, Homo sapiens
cccgtcctccctcagcctcc

SEQ ID NO: 1009960 - DNA, 12 bp, Homo sapiens
cccgtcctcctc

SEQ ID NO: 1009961 - DNA, 17 bp, Homo sapiens
cccgtcctgcctgtggc

SEQ ID NO: 1009962 - DNA, 19 bp, Homo sapiens
cccgtcggactgcccccag

SEQ ID NO: 1009963 - DNA, 15 bp, Homo sapiens
cccgtcggagctgcc

SEQ ID NO: 1009964 - DNA, 19 bp, Homo sapiens
cccgtcggagctgcctgca

SEQ ID NO: 1009965 - DNA, 13 bp, Homo sapiens
cccgtcggccctg

SEQ ID NO: 1009966 - DNA, 15 bp, Homo sapiens
cccgtcggccctgcg

SEQ ID NO: 1009967 - DNA, 14 bp, Homo sapiens
cccgtcgtgcagtc

SEQ ID NO: 1009968 - DNA, 17 bp, Homo sapiens
cccgtctggcccaccag

SEQ ID NO: 1009969 - DNA, 20 bp, Homo sapiens
cccgtctggggttcagcccc

SEQ ID NO: 1009970 - DNA, 19 bp, Homo sapiens
cccgtcttcaatctctgtt

SEQ ID NO: 1009971 - DNA, 14 bp, Homo sapiens
cccgtcttcagcct

SEQ ID NO: 1009972 - DNA, 18 bp, Homo sapiens
cccgtcttcagcctagcc

SEQ ID NO: 1009973 - DNA, 14 bp, Homo sapiens
cccgtgaagcagtg

SEQ ID NO: 1009974 - DNA, 18 bp, Homo sapiens
cccgtgacagactcctga

SEQ ID NO: 1009975 - DNA, 16 bp, Homo sapiens
cccgtgacagtggctg

SEQ ID NO: 1009976 - DNA, 12 bp, Homo sapiens
cccgtgcccctt

SEQ ID NO: 1009977 - DNA, 15 bp, Homo sapiens
cccgtgcccgcagga

SEQ ID NO: 1009978 - DNA, 19 bp, Homo sapiens
cccgtgcctgggcccctcc

SEQ ID NO: 1009979 - DNA, 17 bp, Homo sapiens
cccgtggcctggcatct

SEQ ID NO: 1009980 - DNA, 15 bp, Homo sapiens
cccgtggctctggga

SEQ ID NO: 1009981 - DNA, 20 bp, Homo sapiens
cccgtggcttggcatctgtg

SEQ ID NO: 1009982 - DNA, 22 bp, Homo sapiens
cccgtggtggcggtggctgccc

SEQ ID NO: 1009983 - DNA, 15 bp, Homo sapiens
cccgtgtgaatgtag

SEQ ID NO: 1009984 - DNA, 22 bp, Homo sapiens
cccgtgtggtaccttcagccct

SEQ ID NO: 1009985 - DNA, 16 bp, Homo sapiens
cccgtgtgtatttcta

SEQ ID NO: 1009986 - DNA, 16 bp, Homo sapiens
cccgtgttcaggacac

SEQ ID NO: 1009987 - DNA, 23 bp, Homo sapiens
cccgtgttcccctcttgtctccc

SEQ ID NO: 1009988 - DNA, 21 bp, Homo sapiens
cccgttaaataattccctatg

SEQ ID NO: 1009989 - DNA, 16 bp, Homo sapiens
cccgttccctgtcaga

SEQ ID NO: 1009990 - DNA, 14 bp, Homo sapiens
cccgtttcagaagg

SEQ ID NO: 1009991 - DNA, 20 bp, Homo sapiens
cccgttttaccaataaactg

SEQ ID NO: 1009992 - DNA, 13 bp, Homo sapiens
cccgttttgtcac

SEQ ID NO: 1009993 - DNA, 14 bp, Homo sapiens
ccctaaaagcacac

SEQ ID NO: 1009994 - DNA, 18 bp, Homo sapiens
ccctaaactttggccttt

SEQ ID NO: 1009995 - DNA, 19 bp, Homo sapiens
ccctaaagaagataaacac

SEQ ID NO: 1009996 - DNA, 17 bp, Homo sapiens
ccctaaccccttccaga

SEQ ID NO: 1009997 - DNA, 17 bp, Homo sapiens
ccctaacctcttttctg

SEQ ID NO: 1009998 - DNA, 20 bp, Homo sapiens
ccctaactctgcccaccctc

SEQ ID NO: 1009999 - DNA, 11 bp, Homo sapiens
ccctaacttct

SEQ ID NO: 1010000 - DNA, 23 bp, Homo sapiens
ccctaagccagcctggtccatgc

SEQ ID NO: 1010001 - DNA, 18 bp, Homo sapiens
ccctaagcccccagggcc

SEQ ID NO: 1010002 - DNA, 23 bp, Homo sapiens
ccctaagcccccagggcctccag

SEQ ID NO: 1010003 - DNA, 20 bp, Homo sapiens
ccctaagctggctgtacctg

SEQ ID NO: 1010004 - DNA, 20 bp, Homo sapiens
ccctaagtaagtttcttcct

SEQ ID NO: 1010005 - DNA, 21 bp, Homo sapiens
ccctaagtaagtttcttcctg

SEQ ID NO: 1010006 - DNA, 22 bp, Homo sapiens
ccctaagtaagtttcttcctgc

SEQ ID NO: 1010007 - DNA, 23 bp, Homo sapiens
ccctaagtggattggctttgtgc

SEQ ID NO: 1010008 - DNA, 22 bp, Homo sapiens
ccctaatctatggtcgggagac

SEQ ID NO: 1010009 - DNA, 17 bp, Homo sapiens
ccctaatgttttgctta

SEQ ID NO: 1010010 - DNA, 19 bp, Homo sapiens
ccctaatgttttgcttaaa

SEQ ID NO: 1010011 - DNA, 12 bp, Homo sapiens
ccctacaaacct

SEQ ID NO: 1010012 - DNA, 13 bp, Homo sapiens
ccctacagagctg

SEQ ID NO: 1010013 - DNA, 15 bp, Homo sapiens
ccctacagcctaggg

SEQ ID NO: 1010014 - DNA, 17 bp, Homo sapiens
ccctacagcctagggca

SEQ ID NO: 1010015 - DNA, 20 bp, Homo sapiens
ccctaccagcgcccgctggg

SEQ ID NO: 1010016 - DNA, 23 bp, Homo sapiens
ccctaccagcgcccgctgggctg

SEQ ID NO: 1010017 - DNA, 14 bp, Homo sapiens
ccctacccaccgat

SEQ ID NO: 1010018 - DNA, 16 bp, Homo sapiens
ccctaccccctcatcc

SEQ ID NO: 1010019 - DNA, 15 bp, Homo sapiens
ccctacccctgccct

SEQ ID NO: 1010020 - DNA, 20 bp, Homo sapiens
ccctacccctgccctgctcc

SEQ ID NO: 1010021 - DNA, 23 bp, Homo sapiens
ccctacccctggctgtactgctc

SEQ ID NO: 1010022 - DNA, 13 bp, Homo sapiens
ccctacctccctc

SEQ ID NO: 1010023 - DNA, 14 bp, Homo sapiens
ccctacctgcttca

SEQ ID NO: 1010024 - DNA, 19 bp, Homo sapiens
ccctacgctcatctctgga

SEQ ID NO: 1010025 - DNA, 22 bp, Homo sapiens
ccctactcattggggttccgca

SEQ ID NO: 1010026 - DNA, 12 bp, Homo sapiens
ccctactcctgc

SEQ ID NO: 1010027 - DNA, 14 bp, Homo sapiens
ccctactgctgtga

SEQ ID NO: 1010028 - DNA, 18 bp, Homo sapiens
ccctacttcttttgctct

SEQ ID NO: 1010029 - DNA, 18 bp, Homo sapiens
ccctagaaacccaagctc

SEQ ID NO: 1010030 - DNA, 19 bp, Homo sapiens
ccctagaaacccaagctcc

SEQ ID NO: 1010031 - DNA, 22 bp, Homo sapiens
ccctagaaagccatattccagc

SEQ ID NO: 1010032 - DNA, 23 bp, Homo sapiens
ccctagaaagccatattccagca

SEQ ID NO: 1010033 - DNA, 14 bp, Homo sapiens
gagaggatgaatgt

SEQ ID NO: 1010034 - DNA, 18 bp, Homo sapiens
gagaggcactcagtgagc

SEQ ID NO: 1010035 - DNA, 22 bp, Homo sapiens
gagaggcactcagtgagcctcc

SEQ ID NO: 1010036 - DNA, 23 bp, Homo sapiens
gagaggcagcaaggtggccacag

SEQ ID NO: 1010037 - DNA, 18 bp, Homo sapiens
gagaggcagcatgcttgg

SEQ ID NO: 1010038 - DNA, 15 bp, Homo sapiens
gagaggcaggaatgg

SEQ ID NO: 1010039 - DNA, 16 bp, Homo sapiens
gagaggcaggaatggg

SEQ ID NO: 1010040 - DNA, 17 bp, Homo sapiens
gagaggcaggaatgggg

SEQ ID NO: 1010041 - DNA, 18 bp, Homo sapiens
gagaggcaggaatggggg

SEQ ID NO: 1010042 - DNA, 12 bp, Homo sapiens
gagaggcaggca

SEQ ID NO: 1010043 - DNA, 14 bp, Homo sapiens
gagaggccagttga

SEQ ID NO: 1010044 - DNA, 16 bp, Homo sapiens
gagaggcccgcccgcc

SEQ ID NO: 1010045 - DNA, 13 bp, Homo sapiens
gagaggcctggag

SEQ ID NO: 1010046 - DNA, 14 bp, Homo sapiens
gagaggcctggagc

SEQ ID NO: 1010047 - DNA, 13 bp, Homo sapiens
gagaggcctgggg

SEQ ID NO: 1010048 - DNA, 18 bp, Homo sapiens
gagaggccttttggaatg

SEQ ID NO: 1010049 - DNA, 19 bp, Homo sapiens
gagaggcgcgtctgcccca

SEQ ID NO: 1010050 - DNA, 12 bp, Homo sapiens
gagaggcggcct

SEQ ID NO: 1010051 - DNA, 17 bp, Homo sapiens
gagaggctctccgtgca

SEQ ID NO: 1010052 - DNA, 15 bp, Homo sapiens
gagaggctgcctcag

SEQ ID NO: 1010053 - DNA, 16 bp, Homo sapiens
gagaggctgcctcagc

SEQ ID NO: 1010054 - DNA, 19 bp, Homo sapiens
ccctagctgtcccatgggg

SEQ ID NO: 1010055 - DNA, 18 bp, Homo sapiens
ccctagctttagaccctg

SEQ ID NO: 1010056 - DNA, 21 bp, Homo sapiens
ccctaggagtatatttccgca

SEQ ID NO: 1010057 - DNA, 22 bp, Homo sapiens
ccctaggataaaaagccagggc

SEQ ID NO: 1010058 - DNA, 16 bp, Homo sapiens
ccctaggatgctgcag

SEQ ID NO: 1010059 - DNA, 18 bp, Homo sapiens
ccctaggatgctgcagca

SEQ ID NO: 1010060 - DNA, 17 bp, Homo sapiens
ccctaggattccccctg

SEQ ID NO: 1010061 - DNA, 14 bp, Homo sapiens
ccctaggggacact

SEQ ID NO: 1010062 - DNA, 18 bp, Homo sapiens
ccctaggggacacttccc

SEQ ID NO: 1010063 - DNA, 12 bp, Homo sapiens
ccctaggttccc

SEQ ID NO: 1010064 - DNA, 23 bp, Homo sapiens
ccctaggttccctgttcttcctc

SEQ ID NO: 1010065 - DNA, 17 bp, Homo sapiens
ccctagtcccttcccct

SEQ ID NO: 1010066 - DNA, 11 bp, Homo sapiens
ccctataaatc

SEQ ID NO: 1010067 - DNA, 18 bp, Homo sapiens
ccctatagagagggggct

SEQ ID NO: 1010068 - DNA, 21 bp, Homo sapiens
ccctatagagagggggctctc

SEQ ID NO: 1010069 - DNA, 21 bp, Homo sapiens
ccctatagtttcaccactcct

SEQ ID NO: 1010070 - DNA, 24 bp, Homo sapiens
ccctatccatggcactaaaccact

SEQ ID NO: 1010071 - DNA, 17 bp, Homo sapiens
ccctatccctgtacaga

SEQ ID NO: 1010072 - DNA, 13 bp, Homo sapiens
ccctatctcctga

SEQ ID NO: 1010073 - DNA, 22 bp, Homo sapiens
ccctatctcctgacagaaggtg

SEQ ID NO: 1010074 - DNA, 13 bp, Homo sapiens
ccctatgctgtgc

SEQ ID NO: 1010075 - DNA, 14 bp, Homo sapiens
ccctatgggcctgc

SEQ ID NO: 1010076 - DNA, 17 bp, Homo sapiens
ccctatggggaggccct

SEQ ID NO: 1010077 - DNA, 16 bp, Homo sapiens
ccctatggggatggtc

SEQ ID NO: 1010078 - DNA, 19 bp, Homo sapiens
ccctatttaaatgaaagga

SEQ ID NO: 1010079 - DNA, 16 bp, Homo sapiens
ccctatttccccaccc

SEQ ID NO: 1010080 - DNA, 16 bp, Homo sapiens
ccctcaaaccctgtgg

SEQ ID NO: 1010081 - DNA, 15 bp, Homo sapiens
ccctcaaacctcctc

SEQ ID NO: 1010082 - DNA, 20 bp, Homo sapiens
ccctcaaacctcctcttctg

SEQ ID NO: 1010083 - DNA, 24 bp, Homo sapiens
ccctcaaacctcctcttctgacgt

SEQ ID NO: 1010084 - DNA, 19 bp, Homo sapiens
ccctcaaactgcacatcta

SEQ ID NO: 1010085 - DNA, 16 bp, Homo sapiens
ccctcaaagaggcctt

SEQ ID NO: 1010086 - DNA, 18 bp, Homo sapiens
ccctcaaatgacccaaag

SEQ ID NO: 1010087 - DNA, 21 bp, Homo sapiens
ccctcaacaagggagagacct

SEQ ID NO: 1010088 - DNA, 16 bp, Homo sapiens
ccctcaacaccctgct

SEQ ID NO: 1010089 - DNA, 17 bp, Homo sapiens
ccctcaacaccctgctt

SEQ ID NO: 1010090 - DNA, 18 bp, Homo sapiens
ccctcaacaccctgcttc

SEQ ID NO: 1010091 - DNA, 19 bp, Homo sapiens
ccctcaacaccctgcttct

SEQ ID NO: 1010092 - DNA, 21 bp, Homo sapiens
ccctcaacaccctgcttctcc

SEQ ID NO: 1010093 - DNA, 16 bp, Homo sapiens
ccctcaacacctctgc

SEQ ID NO: 1010094 - DNA, 15 bp, Homo sapiens
ccctcaactgaaggg

SEQ ID NO: 1010095 - DNA, 23 bp, Homo sapiens
ccctcaagaggggaagcaactcc

SEQ ID NO: 1010096 - DNA, 14 bp, Homo sapiens
ccctcacacacaca

SEQ ID NO: 1010097 - DNA, 18 bp, Homo sapiens
ccctcacacacacccccc

SEQ ID NO: 1010098 - DNA, 23 bp, Homo sapiens
ccctcacacacacccccccacaa

SEQ ID NO: 1010099 - DNA, 13 bp, Homo sapiens
ccctcaccaccac

SEQ ID NO: 1010100 - DNA, 14 bp, Homo sapiens
ccctcaccaccaca

SEQ ID NO: 1010101 - DNA, 13 bp, Homo sapiens
ccctcaccacccc

SEQ ID NO: 1010102 - DNA, 17 bp, Homo sapiens
ccctcacccactctggt

SEQ ID NO: 1010103 - DNA, 10 bp, Homo sapiens
ccctcacccc

SEQ ID NO: 1010104 - DNA, 14 bp, Homo sapiens
ccctcaccccaagg

SEQ ID NO: 1010105 - DNA, 16 bp, Homo sapiens
ccctcaccccaatccc

SEQ ID NO: 1010106 - DNA, 24 bp, Homo sapiens
ccctcaccccaatccctgccactg

SEQ ID NO: 1010107 - DNA, 18 bp, Homo sapiens
ccctcacccccaggtgtt

SEQ ID NO: 1010108 - DNA, 18 bp, Homo sapiens
ccctcaccccctcccacc

SEQ ID NO: 1010109 - DNA, 16 bp, Homo sapiens
ccctcaccctgcctta

SEQ ID NO: 1010110 - DNA, 10 bp, Homo sapiens
ccctcacctc

SEQ ID NO: 1010111 - DNA, 15 bp, Homo sapiens
ccctcacctctgagg

SEQ ID NO: 1010112 - DNA, 17 bp, Homo sapiens
ccctcacctctgaggac

SEQ ID NO: 1010113 - DNA, 14 bp, Homo sapiens
ccctcacctctgat

SEQ ID NO: 1010114 - DNA, 15 bp, Homo sapiens
ccctcacctgcagag

SEQ ID NO: 1010115 - DNA, 17 bp, Homo sapiens
ccctcacctgggccttt

SEQ ID NO: 1010116 - DNA, 18 bp, Homo sapiens
ccctcacgtttcttcccc

SEQ ID NO: 1010117 - DNA, 21 bp, Homo sapiens
ccctcactaagccccggcact

SEQ ID NO: 1010118 - DNA, 13 bp, Homo sapiens
ccctcactcccca

SEQ ID NO: 1010119 - DNA, 15 bp, Homo sapiens
ccctcactccccagg

SEQ ID NO: 1010120 - DNA, 18 bp, Homo sapiens
ccctcactgaatgcctca

SEQ ID NO: 1010121 - DNA, 14 bp, Homo sapiens
ccctcactgagcct

SEQ ID NO: 1010122 - DNA, 16 bp, Homo sapiens
ccctcagacatctcca

SEQ ID NO: 1010123 - DNA, 18 bp, Homo sapiens
ccctcagacatctccagt

SEQ ID NO: 1010124 - DNA, 13 bp, Homo sapiens
ccctcagagccca

SEQ ID NO: 1010125 - DNA, 14 bp, Homo sapiens
ccctcagagcccat

SEQ ID NO: 1010126 - DNA, 18 bp, Homo sapiens
ccctcagagccctgccct

SEQ ID NO: 1010127 - DNA, 12 bp, Homo sapiens
ccctcagagctc

SEQ ID NO: 1010128 - DNA, 15 bp, Homo sapiens
ccctcagagtgcaag

SEQ ID NO: 1010129 - DNA, 22 bp, Homo sapiens
ccctcagatgcgttcgcctctg

SEQ ID NO: 1010130 - DNA, 21 bp, Homo sapiens
ccctcagattttatattttct

SEQ ID NO: 1010131 - DNA, 15 bp, Homo sapiens
ccctcagcacccctt

SEQ ID NO: 1010132 - DNA, 17 bp, Homo sapiens
ccctcagcaccccttcc

SEQ ID NO: 1010133 - DNA, 18 bp, Homo sapiens
ccctcagcaccccttcca

SEQ ID NO: 1010134 - DNA, 19 bp, Homo sapiens
ccctcagcaccccttccat

SEQ ID NO: 1010135 - DNA, 15 bp, Homo sapiens
ccctcagccctggcc

SEQ ID NO: 1010136 - DNA, 21 bp, Homo sapiens
ccctcagccctggcctttttc

SEQ ID NO: 1010137 - DNA, 14 bp, Homo sapiens
ccctcagcctcccc

SEQ ID NO: 1010138 - DNA, 17 bp, Homo sapiens
ccctcagcctccccttc

SEQ ID NO: 1010139 - DNA, 20 bp, Homo sapiens
ccctcagcctccccttcttc

SEQ ID NO: 1010140 - DNA, 16 bp, Homo sapiens
ccctcagcctgcccac

SEQ ID NO: 1010141 - DNA, 15 bp, Homo sapiens
ccctcagccttggga

SEQ ID NO: 1010142 - DNA, 16 bp, Homo sapiens
ccctcagcgcaggctg

SEQ ID NO: 1010143 - DNA, 17 bp, Homo sapiens
ccctcagcgcaggctgc

SEQ ID NO: 1010144 - DNA, 18 bp, Homo sapiens
ccctcagcgcaggctgca

SEQ ID NO: 1010145 - DNA, 21 bp, Homo sapiens
ccctcagcgcaggctgcagag

SEQ ID NO: 1010146 - DNA, 23 bp, Homo sapiens
ccctcagcgcaggctgcagagcc

SEQ ID NO: 1010147 - DNA, 20 bp, Homo sapiens
ccctcagctccccggcactg

SEQ ID NO: 1010148 - DNA, 14 bp, Homo sapiens
ccctcagctgtcac

SEQ ID NO: 1010149 - DNA, 15 bp, Homo sapiens
ccctcagctgtcacc

SEQ ID NO: 1010150 - DNA, 16 bp, Homo sapiens
ccctcagctgtcacct

SEQ ID NO: 1010151 - DNA, 20 bp, Homo sapiens
ccctcagctgtcacctgctc

SEQ ID NO: 1010152 - DNA, 19 bp, Homo sapiens
ccctcaggcataggcctgg

SEQ ID NO: 1010153 - DNA, 23 bp, Homo sapiens
ccctcaggcataggcctgggtgc

SEQ ID NO: 1010154 - DNA, 18 bp, Homo sapiens
ccctcaggccaccctcca

SEQ ID NO: 1010155 - DNA, 15 bp, Homo sapiens
ccctcaggccattcc

SEQ ID NO: 1010156 - DNA, 16 bp, Homo sapiens
ccctcaggccattccc

SEQ ID NO: 1010157 - DNA, 12 bp, Homo sapiens
ccctcagggatc

SEQ ID NO: 1010158 - DNA, 13 bp, Homo sapiens
ccctcaggggcag

SEQ ID NO: 1010159 - DNA, 13 bp, Homo sapiens
ccctcaggggcct

SEQ ID NO: 1010160 - DNA, 15 bp, Homo sapiens
ccctcaggggcctct

SEQ ID NO: 1010161 - DNA, 15 bp, Homo sapiens
gagattatgttcttt

SEQ ID NO: 1010162 - DNA, 13 bp, Homo sapiens
gagattcattttc

SEQ ID NO: 1010163 - DNA, 16 bp, Homo sapiens
gagattcccgcgggtt

SEQ ID NO: 1010164 - DNA, 23 bp, Homo sapiens
gagattctcataacttgagacct

SEQ ID NO: 1010165 - DNA, 19 bp, Homo sapiens
gagattctggatctcctgc

SEQ ID NO: 1010166 - DNA, 16 bp, Homo sapiens
gagattggatcaagta

SEQ ID NO: 1010167 - DNA, 17 bp, Homo sapiens
gagattggccagtgaga

SEQ ID NO: 1010168 - DNA, 18 bp, Homo sapiens
gagattgggagacaatta

SEQ ID NO: 1010169 - DNA, 23 bp, Homo sapiens
gagattgttgtttgccatacttt

SEQ ID NO: 1010170 - DNA, 15 bp, Homo sapiens
gagatttgccagcac

SEQ ID NO: 1010171 - DNA, 11 bp, Homo sapiens
gagatttttaa

SEQ ID NO: 1010172 - DNA, 19 bp, Homo sapiens
gagatttttaaaaaatatt

SEQ ID NO: 1010173 - DNA, 18 bp, Homo sapiens
gagcaaaaatctgagaaa

SEQ ID NO: 1010174 - DNA, 17 bp, Homo sapiens
gagcaaaaggcagctca

SEQ ID NO: 1010175 - DNA, 24 bp, Homo sapiens
gagcaaaaggcagctcacccctgg

SEQ ID NO: 1010176 - DNA, 17 bp, Homo sapiens
ccctcatttttccttta

SEQ ID NO: 1010177 - DNA, 17 bp, Homo sapiens
ccctccaaaagcactta

SEQ ID NO: 1010178 - DNA, 17 bp, Homo sapiens
ccctccaaacctccagc

SEQ ID NO: 1010179 - DNA, 12 bp, Homo sapiens
ccctccaaagag

SEQ ID NO: 1010180 - DNA, 23 bp, Homo sapiens
ccctccaaatggagaagctgcag

SEQ ID NO: 1010181 - DNA, 20 bp, Homo sapiens
ccctccaagcctggcaccca

SEQ ID NO: 1010182 - DNA, 12 bp, Homo sapiens
ccctccacacca

SEQ ID NO: 1010183 - DNA, 13 bp, Homo sapiens
ccctccacaccag

SEQ ID NO: 1010184 - DNA, 16 bp, Homo sapiens
ccctccacagccgcag

SEQ ID NO: 1010185 - DNA, 19 bp, Homo sapiens
ccctccacagctgcagctg

SEQ ID NO: 1010186 - DNA, 22 bp, Homo sapiens
ccctccacagctgcagctgatc

SEQ ID NO: 1010187 - DNA, 15 bp, Homo sapiens
ccctccacatcccag

SEQ ID NO: 1010188 - DNA, 13 bp, Homo sapiens
ccctccaccagcc

SEQ ID NO: 1010189 - DNA, 21 bp, Homo sapiens
ccctccacccatccagtggac

SEQ ID NO: 1010190 - DNA, 15 bp, Homo sapiens
ccctccaccccacag

SEQ ID NO: 1010191 - DNA, 14 bp, Homo sapiens
ccctccaccccagg

SEQ ID NO: 1010192 - DNA, 19 bp, Homo sapiens
ccctccaccccccactcag

SEQ ID NO: 1010193 - DNA, 16 bp, Homo sapiens
ccctccaccctgtccc

SEQ ID NO: 1010194 - DNA, 15 bp, Homo sapiens
ccctccacctctcac

SEQ ID NO: 1010195 - DNA, 18 bp, Homo sapiens
ccctccacgcctcctggc

SEQ ID NO: 1010196 - DNA, 19 bp, Homo sapiens
ccctccagaacacggctca

SEQ ID NO: 1010197 - DNA, 14 bp, Homo sapiens
ccctccagctcatg

SEQ ID NO: 1010198 - DNA, 20 bp, Homo sapiens
ccctccagctcatgacactg

SEQ ID NO: 1010199 - DNA, 16 bp, Homo sapiens
ccctccagtgggctga

SEQ ID NO: 1010200 - DNA, 14 bp, Homo sapiens
ccctccatccaccc

SEQ ID NO: 1010201 - DNA, 15 bp, Homo sapiens
ccctccatccgtgct

SEQ ID NO: 1010202 - DNA, 18 bp, Homo sapiens
ccctccatggtcctgtct

SEQ ID NO: 1010203 - DNA, 13 bp, Homo sapiens
ccctcccacacac

SEQ ID NO: 1010204 - DNA, 12 bp, Homo sapiens
ccctcccaccac

SEQ ID NO: 1010205 - DNA, 14 bp, Homo sapiens
ccctcccaccacag

SEQ ID NO: 1010206 - DNA, 16 bp, Homo sapiens
ccctcccaccacccca

SEQ ID NO: 1010207 - DNA, 13 bp, Homo sapiens
ccctcccaccccc

SEQ ID NO: 1010208 - DNA, 14 bp, Homo sapiens
ccctcccactccca

SEQ ID NO: 1010209 - DNA, 16 bp, Homo sapiens
ccctcccagaaaaact

SEQ ID NO: 1010210 - DNA, 20 bp, Homo sapiens
ccctcccagaaaaactggct

SEQ ID NO: 1010211 - DNA, 12 bp, Homo sapiens
ccctcccagaca

SEQ ID NO: 1010212 - DNA, 20 bp, Homo sapiens
ccctcccaggaccctccact

SEQ ID NO: 1010213 - DNA, 21 bp, Homo sapiens
ccctcccaggaccctccactc

SEQ ID NO: 1010214 - DNA, 22 bp, Homo sapiens
ccctcccaggaccctccactca

SEQ ID NO: 1010215 - DNA, 22 bp, Homo sapiens
ccctcccagggccagggccctg

SEQ ID NO: 1010216 - DNA, 22 bp, Homo sapiens
ccctcccaggggagccagctgc

SEQ ID NO: 1010217 - DNA, 13 bp, Homo sapiens
ccctcccagtctc

SEQ ID NO: 1010218 - DNA, 20 bp, Homo sapiens
ccctcccagtctcatctcct

SEQ ID NO: 1010219 - DNA, 13 bp, Homo sapiens
ccctcccatctgg

SEQ ID NO: 1010220 - DNA, 16 bp, Homo sapiens
ccctcccatctgggag

SEQ ID NO: 1010221 - DNA, 17 bp, Homo sapiens
ccctcccatctgggagt

SEQ ID NO: 1010222 - DNA, 13 bp, Homo sapiens
ccctcccattagg

SEQ ID NO: 1010223 - DNA, 19 bp, Homo sapiens
ccctccccaaatggctgct

SEQ ID NO: 1010224 - DNA, 22 bp, Homo sapiens
ccctccccaaatggctgctttg

SEQ ID NO: 1010225 - DNA, 21 bp, Homo sapiens
ccctccccacacctccctact

SEQ ID NO: 1010226 - DNA, 16 bp, Homo sapiens
ccctccccacccaaga

SEQ ID NO: 1010227 - DNA, 11 bp, Homo sapiens
ccctccccact

SEQ ID NO: 1010228 - DNA, 16 bp, Homo sapiens
ccctccccagagcact

SEQ ID NO: 1010229 - DNA, 12 bp, Homo sapiens
ccctccccagcc

SEQ ID NO: 1010230 - DNA, 17 bp, Homo sapiens
ccctccccagccagccc

SEQ ID NO: 1010231 - DNA, 18 bp, Homo sapiens
ccctccccagccagccct

SEQ ID NO: 1010232 - DNA, 20 bp, Homo sapiens
ccctccccagccagcccttc

SEQ ID NO: 1010233 - DNA, 12 bp, Homo sapiens
ccctccccaggg

SEQ ID NO: 1010234 - DNA, 13 bp, Homo sapiens
ccctccccagggg

SEQ ID NO: 1010235 - DNA, 14 bp, Homo sapiens
ccctccccagggga

SEQ ID NO: 1010236 - DNA, 14 bp, Homo sapiens
ccctccccatggag

SEQ ID NO: 1010237 - DNA, 14 bp, Homo sapiens
ccctcccccactgc

SEQ ID NO: 1010238 - DNA, 14 bp, Homo sapiens
ccctccccccagct

SEQ ID NO: 1010239 - DNA, 17 bp, Homo sapiens
ccctccccccagctccc

SEQ ID NO: 1010240 - DNA, 12 bp, Homo sapiens
ccctccccctca

SEQ ID NO: 1010241 - DNA, 13 bp, Homo sapiens
ccctccccctgag

SEQ ID NO: 1010242 - DNA, 12 bp, Homo sapiens
ccctcccccttg

SEQ ID NO: 1010243 - DNA, 14 bp, Homo sapiens
ccctccccggccct

SEQ ID NO: 1010244 - DNA, 12 bp, Homo sapiens
ccctcccctcag

SEQ ID NO: 1010245 - DNA, 17 bp, Homo sapiens
ccctcccctcagagccc

SEQ ID NO: 1010246 - DNA, 18 bp, Homo sapiens
ccctcccctcagcctgcc

SEQ ID NO: 1010247 - DNA, 20 bp, Homo sapiens
ccctcccctcagcctgccca

SEQ ID NO: 1010248 - DNA, 21 bp, Homo sapiens
ccctcccctcagcctgcccac

SEQ ID NO: 1010249 - DNA, 17 bp, Homo sapiens
ccctcccctcagcgcag

SEQ ID NO: 1010250 - DNA, 19 bp, Homo sapiens
ccctcccctcagcgcaggc

SEQ ID NO: 1010251 - DNA, 17 bp, Homo sapiens
ccctcccctcccagtcc

SEQ ID NO: 1010252 - DNA, 16 bp, Homo sapiens
ccctcccctctcttgc

SEQ ID NO: 1010253 - DNA, 24 bp, Homo sapiens
ccctcccctctcttgcacccgcct

SEQ ID NO: 1010254 - DNA, 14 bp, Homo sapiens
ccctcccctgccct

SEQ ID NO: 1010255 - DNA, 18 bp, Homo sapiens
ccctcccctggggacgcc

SEQ ID NO: 1010256 - DNA, 23 bp, Homo sapiens
ccctcccgacagcccatcacctc

SEQ ID NO: 1010257 - DNA, 13 bp, Homo sapiens
ccctcccgcacct

SEQ ID NO: 1010258 - DNA, 14 bp, Homo sapiens
ccctcccggcctgg

SEQ ID NO: 1010259 - DNA, 22 bp, Homo sapiens
ccctcccgtgtgtggttggaaa

SEQ ID NO: 1010260 - DNA, 17 bp, Homo sapiens
ccctccctagcccttcc

SEQ ID NO: 1010261 - DNA, 20 bp, Homo sapiens
ccctccctagcccttccagc

SEQ ID NO: 1010262 - DNA, 16 bp, Homo sapiens
ccctccctcagcccct

SEQ ID NO: 1010263 - DNA, 16 bp, Homo sapiens
ccctccctcagccgtc

SEQ ID NO: 1010264 - DNA, 13 bp, Homo sapiens
ccctccctcagcg

SEQ ID NO: 1010265 - DNA, 13 bp, Homo sapiens
ccctccctcgtgg

SEQ ID NO: 1010266 - DNA, 20 bp, Homo sapiens
ccctccctctactcttcctg

SEQ ID NO: 1010267 - DNA, 13 bp, Homo sapiens
ccctccctctccg

SEQ ID NO: 1010268 - DNA, 15 bp, Homo sapiens
ccctccctctgcccc

SEQ ID NO: 1010269 - DNA, 14 bp, Homo sapiens
ccctccctgcccaa

SEQ ID NO: 1010270 - DNA, 18 bp, Homo sapiens
ccctccctgcccaaactc

SEQ ID NO: 1010271 - DNA, 13 bp, Homo sapiens
ccctccctgcctg

SEQ ID NO: 1010272 - DNA, 21 bp, Homo sapiens
ccctccctgcctgagggcagt

SEQ ID NO: 1010273 - DNA, 14 bp, Homo sapiens
ccctccctgcctgc

SEQ ID NO: 1010274 - DNA, 13 bp, Homo sapiens
ccctccctgcttg

SEQ ID NO: 1010275 - DNA, 23 bp, Homo sapiens
ccctccctgcttgcacacttccc

SEQ ID NO: 1010276 - DNA, 17 bp, Homo sapiens
ccctccctggcctgttc

SEQ ID NO: 1010277 - DNA, 16 bp, Homo sapiens
ccctccctggctccca

SEQ ID NO: 1010278 - DNA, 23 bp, Homo sapiens
ccctccctgtctccagggccccc

SEQ ID NO: 1010279 - DNA, 14 bp, Homo sapiens
ccctcccttcaacc

SEQ ID NO: 1010280 - DNA, 15 bp, Homo sapiens
ccctcccttcacagg

SEQ ID NO: 1010281 - DNA, 14 bp, Homo sapiens
ccctcccttccttg

SEQ ID NO: 1010282 - DNA, 22 bp, Homo sapiens
ccctcccttggaaacctgccct

SEQ ID NO: 1010283 - DNA, 15 bp, Homo sapiens
ccctccgagcttggg

SEQ ID NO: 1010284 - DNA, 20 bp, Homo sapiens
ccctccgatccttcctccca

SEQ ID NO: 1010285 - DNA, 14 bp, Homo sapiens
ccctccgccctgcc

SEQ ID NO: 1010286 - DNA, 22 bp, Homo sapiens
ccctccgccttcactccggtgt

SEQ ID NO: 1010287 - DNA, 16 bp, Homo sapiens
ccctccggaggagcag

SEQ ID NO: 1010288 - DNA, 19 bp, Homo sapiens
ccctccggaggagcagcct

SEQ ID NO: 1010289 - DNA, 14 bp, Homo sapiens
gagcaggggcaggc

SEQ ID NO: 1010290 - DNA, 17 bp, Homo sapiens
gagcaggggcaggcgca

SEQ ID NO: 1010291 - DNA, 23 bp, Homo sapiens
gagcaggggcaggcgcagaggtc

SEQ ID NO: 1010292 - DNA, 19 bp, Homo sapiens
gagcaggggcattgctgat

SEQ ID NO: 1010293 - DNA, 17 bp, Homo sapiens
gagcagggtcaagcctc

SEQ ID NO: 1010294 - DNA, 17 bp, Homo sapiens
gagcagtatcatgaagc

SEQ ID NO: 1010295 - DNA, 20 bp, Homo sapiens
gagcagtcagggtgggaaga

SEQ ID NO: 1010296 - DNA, 20 bp, Homo sapiens
gagcagtcctgcctcagcct

SEQ ID NO: 1010297 - DNA, 14 bp, Homo sapiens
gagcagtggctggt

SEQ ID NO: 1010298 - DNA, 18 bp, Homo sapiens
gagcagtttttaaaatag

SEQ ID NO: 1010299 - DNA, 23 bp, Homo sapiens
ccctcctcacctctggactggct

SEQ ID NO: 1010300 - DNA, 10 bp, Homo sapiens
ccctcctcag

SEQ ID NO: 1010301 - DNA, 15 bp, Homo sapiens
ccctcctccacttgg

SEQ ID NO: 1010302 - DNA, 15 bp, Homo sapiens
ccctcctccaggcct

SEQ ID NO: 1010303 - DNA, 23 bp, Homo sapiens
ccctcctccaggcctgcctccca

SEQ ID NO: 1010304 - DNA, 12 bp, Homo sapiens
ccctcctccagt

SEQ ID NO: 1010305 - DNA, 12 bp, Homo sapiens
ccctcctcccat

SEQ ID NO: 1010306 - DNA, 17 bp, Homo sapiens
ccctcctctcccatccc

SEQ ID NO: 1010307 - DNA, 17 bp, Homo sapiens
ccctcctctccctgtta

SEQ ID NO: 1010308 - DNA, 12 bp, Homo sapiens
ccctcctctgcc

SEQ ID NO: 1010309 - DNA, 14 bp, Homo sapiens
ccctcctcttggaa

SEQ ID NO: 1010310 - DNA, 18 bp, Homo sapiens
ccctcctgaaacttacac

SEQ ID NO: 1010311 - DNA, 19 bp, Homo sapiens
ccctcctgagtgccccact

SEQ ID NO: 1010312 - DNA, 21 bp, Homo sapiens
ccctcctgagtgccccacttc

SEQ ID NO: 1010313 - DNA, 14 bp, Homo sapiens
ccctcctgcccagg

SEQ ID NO: 1010314 - DNA, 18 bp, Homo sapiens
ccctcctgccgactcctg

SEQ ID NO: 1010315 - DNA, 19 bp, Homo sapiens
ccctcctgccgactcctgg

SEQ ID NO: 1010316 - DNA, 13 bp, Homo sapiens
ccctcctggagca

SEQ ID NO: 1010317 - DNA, 16 bp, Homo sapiens
ccctcctggagcagaa

SEQ ID NO: 1010318 - DNA, 17 bp, Homo sapiens
ccctcctggagcatccc

SEQ ID NO: 1010319 - DNA, 19 bp, Homo sapiens
ccctcctggagctctgtgg

SEQ ID NO: 1010320 - DNA, 20 bp, Homo sapiens
ccctcctggcaatcaataca

SEQ ID NO: 1010321 - DNA, 13 bp, Homo sapiens
ccctcctggcctt

SEQ ID NO: 1010322 - DNA, 23 bp, Homo sapiens
ccctcctggcgagttctctttgg

SEQ ID NO: 1010323 - DNA, 10 bp, Homo sapiens
ccctcctggt

SEQ ID NO: 1010324 - DNA, 14 bp, Homo sapiens
ccctcctggtcctg

SEQ ID NO: 1010325 - DNA, 18 bp, Homo sapiens
ccctcctgtgccccagct

SEQ ID NO: 1010326 - DNA, 22 bp, Homo sapiens
ccctcctgtgccccagctgcca

SEQ ID NO: 1010327 - DNA, 23 bp, Homo sapiens
ccctcctgtgccccagctgccag

SEQ ID NO: 1010328 - DNA, 19 bp, Homo sapiens
ccctcctgtgctgggggaa

SEQ ID NO: 1010329 - DNA, 13 bp, Homo sapiens
ccctccttcaggg

SEQ ID NO: 1010330 - DNA, 20 bp, Homo sapiens
ccctccttccacatgtacat

SEQ ID NO: 1010331 - DNA, 15 bp, Homo sapiens
ccctccttctgctgt

SEQ ID NO: 1010332 - DNA, 21 bp, Homo sapiens
ccctccttgcaaccaggcagc

SEQ ID NO: 1010333 - DNA, 13 bp, Homo sapiens
ccctcctttccct

SEQ ID NO: 1010334 - DNA, 14 bp, Homo sapiens
ccctcctttgtctt

SEQ ID NO: 1010335 - DNA, 17 bp, Homo sapiens
ccctcgaaccaaggcag

SEQ ID NO: 1010336 - DNA, 20 bp, Homo sapiens
ccctcgaaccaaggcagcct

SEQ ID NO: 1010337 - DNA, 19 bp, Homo sapiens
ccctcgacttgaccctttc

SEQ ID NO: 1010338 - DNA, 14 bp, Homo sapiens
ccctcgaggcctac

SEQ ID NO: 1010339 - DNA, 17 bp, Homo sapiens
ccctcgaggcctacaga

SEQ ID NO: 1010340 - DNA, 20 bp, Homo sapiens
ccctcgaggcctacagagga

SEQ ID NO: 1010341 - DNA, 17 bp, Homo sapiens
ccctcgatcatatttcc

SEQ ID NO: 1010342 - DNA, 15 bp, Homo sapiens
ccctcgcaaccctgc

SEQ ID NO: 1010343 - DNA, 16 bp, Homo sapiens
ccctcgcaaccctgcc

SEQ ID NO: 1010344 - DNA, 16 bp, Homo sapiens
ccctcgcacacagggc

SEQ ID NO: 1010345 - DNA, 22 bp, Homo sapiens
ccctcgcacacagggctcacag

SEQ ID NO: 1010346 - DNA, 16 bp, Homo sapiens
ccctcgccagcttggc

SEQ ID NO: 1010347 - DNA, 13 bp, Homo sapiens
ccctcgcccccgc

SEQ ID NO: 1010348 - DNA, 17 bp, Homo sapiens
ccctcgcccgcccacac

SEQ ID NO: 1010349 - DNA, 17 bp, Homo sapiens
ccctcgctgctgctact

SEQ ID NO: 1010350 - DNA, 15 bp, Homo sapiens
ccctcgctgcttctg

SEQ ID NO: 1010351 - DNA, 17 bp, Homo sapiens
ccctcgctgcttctgtg

SEQ ID NO: 1010352 - DNA, 21 bp, Homo sapiens
ccctcggaagccgtctgactc

SEQ ID NO: 1010353 - DNA, 15 bp, Homo sapiens
ccctcggagcctgtg

SEQ ID NO: 1010354 - DNA, 15 bp, Homo sapiens
ccctcgggcccacct

SEQ ID NO: 1010355 - DNA, 19 bp, Homo sapiens
ccctcgggcccacctggcc

SEQ ID NO: 1010356 - DNA, 21 bp, Homo sapiens
ccctcgggcccacctggccac

SEQ ID NO: 1010357 - DNA, 18 bp, Homo sapiens
ccctcgggggctcttccc

SEQ ID NO: 1010358 - DNA, 23 bp, Homo sapiens
ccctcgtccacaggggcaggcct

SEQ ID NO: 1010359 - DNA, 14 bp, Homo sapiens
ccctcgtctccctg

SEQ ID NO: 1010360 - DNA, 17 bp, Homo sapiens
ccctcgtctccctggcc

SEQ ID NO: 1010361 - DNA, 16 bp, Homo sapiens
ccctcgtggccagccc

SEQ ID NO: 1010362 - DNA, 15 bp, Homo sapiens
ccctctacagagctt

SEQ ID NO: 1010363 - DNA, 18 bp, Homo sapiens
ccctctacagagcttccc

SEQ ID NO: 1010364 - DNA, 13 bp, Homo sapiens
ccctctacaggtc

SEQ ID NO: 1010365 - DNA, 13 bp, Homo sapiens
ccctctagggcag

SEQ ID NO: 1010366 - DNA, 14 bp, Homo sapiens
ccctctagggcagg

SEQ ID NO: 1010367 - DNA, 14 bp, Homo sapiens
ccctctagtgcctt

SEQ ID NO: 1010368 - DNA, 15 bp, Homo sapiens
ccctctatttagcat

SEQ ID NO: 1010369 - DNA, 13 bp, Homo sapiens
ccctctcaccaaa

SEQ ID NO: 1010370 - DNA, 16 bp, Homo sapiens
ccctctcacgccaccc

SEQ ID NO: 1010371 - DNA, 13 bp, Homo sapiens
ccctctcactcca

SEQ ID NO: 1010372 - DNA, 17 bp, Homo sapiens
ccctctcactccagcca

SEQ ID NO: 1010373 - DNA, 17 bp, Homo sapiens
ccctctcagaggcctgc

SEQ ID NO: 1010374 - DNA, 12 bp, Homo sapiens
ccctctcaggag

SEQ ID NO: 1010375 - DNA, 13 bp, Homo sapiens
ccctctcatcccc

SEQ ID NO: 1010376 - DNA, 20 bp, Homo sapiens
ccctctcatccccctgtgga

SEQ ID NO: 1010377 - DNA, 20 bp, Homo sapiens
ccctctcatctcaggtagaa

SEQ ID NO: 1010378 - DNA, 14 bp, Homo sapiens
ccctctccactctt

SEQ ID NO: 1010379 - DNA, 22 bp, Homo sapiens
ccctctccactcttctctcctt

SEQ ID NO: 1010380 - DNA, 20 bp, Homo sapiens
ccctctcccaaaaaactact

SEQ ID NO: 1010381 - DNA, 14 bp, Homo sapiens
ccctctcccaggga

SEQ ID NO: 1010382 - DNA, 21 bp, Homo sapiens
ccctctccctgtgttctgggc

SEQ ID NO: 1010383 - DNA, 13 bp, Homo sapiens
ccctctcccttcc

SEQ ID NO: 1010384 - DNA, 14 bp, Homo sapiens
ccctctcctcccag

SEQ ID NO: 1010385 - DNA, 16 bp, Homo sapiens
ccctctcctcccagct

SEQ ID NO: 1010386 - DNA, 11 bp, Homo sapiens
ccctctcctgc

SEQ ID NO: 1010387 - DNA, 19 bp, Homo sapiens
ccctctcctgcccagatgc

SEQ ID NO: 1010388 - DNA, 13 bp, Homo sapiens
ccctctcctgggg

SEQ ID NO: 1010389 - DNA, 17 bp, Homo sapiens
ccctctccttcctgtgt

SEQ ID NO: 1010390 - DNA, 22 bp, Homo sapiens
ccctctcgccccatccctgctt

SEQ ID NO: 1010391 - DNA, 13 bp, Homo sapiens
ccctctctctggg

SEQ ID NO: 1010392 - DNA, 14 bp, Homo sapiens
ccctctctctgggc

SEQ ID NO: 1010393 - DNA, 15 bp, Homo sapiens
ccctctctctgggtc

SEQ ID NO: 1010394 - DNA, 18 bp, Homo sapiens
ccctctctcttctgctcc

SEQ ID NO: 1010395 - DNA, 19 bp, Homo sapiens
ccctctctcttctgctcca

SEQ ID NO: 1010396 - DNA, 12 bp, Homo sapiens
ccctctctgcat

SEQ ID NO: 1010397 - DNA, 20 bp, Homo sapiens
ccctctctgcatctgaccac

SEQ ID NO: 1010398 - DNA, 14 bp, Homo sapiens
ccctctctgctcct

SEQ ID NO: 1010399 - DNA, 14 bp, Homo sapiens
ccctctctgctctg

SEQ ID NO: 1010400 - DNA, 15 bp, Homo sapiens
ccctctctggtttcc

SEQ ID NO: 1010401 - DNA, 14 bp, Homo sapiens
ccctctcttcccta

SEQ ID NO: 1010402 - DNA, 15 bp, Homo sapiens
ccctctcttccctat

SEQ ID NO: 1010403 - DNA, 17 bp, Homo sapiens
ccctctcttccctatta

SEQ ID NO: 1010404 - DNA, 14 bp, Homo sapiens
ccctctcttccggg

SEQ ID NO: 1010405 - DNA, 17 bp, Homo sapiens
ccctctcttccgggagc

SEQ ID NO: 1010406 - DNA, 18 bp, Homo sapiens
ccctctcttccgggagct

SEQ ID NO: 1010407 - DNA, 16 bp, Homo sapiens
ccctctctttctctgg

SEQ ID NO: 1010408 - DNA, 22 bp, Homo sapiens
ccctctgaatggtccagggttg

SEQ ID NO: 1010409 - DNA, 15 bp, Homo sapiens
ccctctgacctgcac

SEQ ID NO: 1010410 - DNA, 19 bp, Homo sapiens
ccctctgacctgcactggg

SEQ ID NO: 1010411 - DNA, 13 bp, Homo sapiens
ccctctgcccagc

SEQ ID NO: 1010412 - DNA, 19 bp, Homo sapiens
ccctctgcccagcttgggc

SEQ ID NO: 1010413 - DNA, 15 bp, Homo sapiens
ccctctgcccaggga

SEQ ID NO: 1010414 - DNA, 12 bp, Homo sapiens
ccctctgcccca

SEQ ID NO: 1010415 - DNA, 15 bp, Homo sapiens
ccctctgccccatcc

SEQ ID NO: 1010416 - DNA, 15 bp, Homo sapiens
ccctctgcctgcact

SEQ ID NO: 1010417 - DNA, 18 bp, Homo sapiens
ccctctgcctgcactccc

SEQ ID NO: 1010418 - DNA, 12 bp, Homo sapiens
gagcccaggccg

SEQ ID NO: 1010419 - DNA, 15 bp, Homo sapiens
gagcccaggggagaa

SEQ ID NO: 1010420 - DNA, 23 bp, Homo sapiens
gagcccaggggagaatgcagccc

SEQ ID NO: 1010421 - DNA, 16 bp, Homo sapiens
gagcccagtctgttga

SEQ ID NO: 1010422 - DNA, 17 bp, Homo sapiens
gagcccagtgaagcctc

SEQ ID NO: 1010423 - DNA, 20 bp, Homo sapiens
gagcctctttttccttcttc

SEQ ID NO: 1010424 - DNA, 21 bp, Homo sapiens
gagcctctttttccttcttca

SEQ ID NO: 1010425 - DNA, 15 bp, Homo sapiens
gagcctgacctgaga

SEQ ID NO: 1010426 - DNA, 16 bp, Homo sapiens
gagcctgacctgagag

SEQ ID NO: 1010427 - DNA, 19 bp, Homo sapiens
gagcctgactgccaggacc

SEQ ID NO: 1010428 - DNA, 15 bp, Homo sapiens
gagcctgaggcagga

SEQ ID NO: 1010429 - DNA, 12 bp, Homo sapiens
gagcctgaggga

SEQ ID NO: 1010430 - DNA, 21 bp, Homo sapiens
gagcctgcaaactcactgctc

SEQ ID NO: 1010431 - DNA, 15 bp, Homo sapiens
gagcctgcagggtgg

SEQ ID NO: 1010432 - DNA, 16 bp, Homo sapiens
gagcctgcagggtggt

SEQ ID NO: 1010433 - DNA, 14 bp, Homo sapiens
gagcctgcatcttc

SEQ ID NO: 1010434 - DNA, 23 bp, Homo sapiens
gagcctgcattctgcacgctgcc

SEQ ID NO: 1010435 - DNA, 20 bp, Homo sapiens
gagcctgccaaagtgcctgg

SEQ ID NO: 1010436 - DNA, 13 bp, Homo sapiens
gagcctgccaaga

SEQ ID NO: 1010437 - DNA, 18 bp, Homo sapiens
gagcctgccctcactccc

SEQ ID NO: 1010438 - DNA, 19 bp, Homo sapiens
gagcctgctcccccacccc

SEQ ID NO: 1010439 - DNA, 18 bp, Homo sapiens
gagcctgctctccgcgcc

SEQ ID NO: 1010440 - DNA, 11 bp, Homo sapiens
gagcctgctgg

SEQ ID NO: 1010441 - DNA, 15 bp, Homo sapiens
gagcctgctggaagc

SEQ ID NO: 1010442 - DNA, 13 bp, Homo sapiens
gagcctgctggca

SEQ ID NO: 1010443 - DNA, 13 bp, Homo sapiens
gagcctggagaag

SEQ ID NO: 1010444 - DNA, 15 bp, Homo sapiens
gagcctggagaagct

SEQ ID NO: 1010445 - DNA, 17 bp, Homo sapiens
gagcctggcaaggcatt

SEQ ID NO: 1010446 - DNA, 20 bp, Homo sapiens
gagcctggccccaggcccca

SEQ ID NO: 1010447 - DNA, 14 bp, Homo sapiens
gagcctggctgtcc

SEQ ID NO: 1010448 - DNA, 19 bp, Homo sapiens
gagcctggctgtccaacca

SEQ ID NO: 1010449 - DNA, 21 bp, Homo sapiens
gagcctgggaggtcaaggctg

SEQ ID NO: 1010450 - DNA, 13 bp, Homo sapiens
gagcctgggccag

SEQ ID NO: 1010451 - DNA, 11 bp, Homo sapiens
gagcctggggg

SEQ ID NO: 1010452 - DNA, 12 bp, Homo sapiens
gagcctggggtg

SEQ ID NO: 1010453 - DNA, 16 bp, Homo sapiens
gagcctggtgctgctg

SEQ ID NO: 1010454 - DNA, 22 bp, Homo sapiens
gagcctggttcagacacagctc

SEQ ID NO: 1010455 - DNA, 15 bp, Homo sapiens
gagcctgtaaacttt

SEQ ID NO: 1010456 - DNA, 17 bp, Homo sapiens
gagcctgtgaccttggg

SEQ ID NO: 1010457 - DNA, 20 bp, Homo sapiens
gagcctgtgaccttgggacc

SEQ ID NO: 1010458 - DNA, 18 bp, Homo sapiens
gagcctgtgggtccccac

SEQ ID NO: 1010459 - DNA, 20 bp, Homo sapiens
gagcctgtgttagtgtctgt

SEQ ID NO: 1010460 - DNA, 20 bp, Homo sapiens
gagccttcgtgccccccctt

SEQ ID NO: 1010461 - DNA, 22 bp, Homo sapiens
gagccttgaactttgacctctg

SEQ ID NO: 1010462 - DNA, 21 bp, Homo sapiens
gagccttgataatacttgacc

SEQ ID NO: 1010463 - DNA, 22 bp, Homo sapiens
gagccttgcagatatctgcatg

SEQ ID NO: 1010464 - DNA, 14 bp, Homo sapiens
gagccttgcatgta

SEQ ID NO: 1010465 - DNA, 20 bp, Homo sapiens
gagccttgcatgtacttgaa

SEQ ID NO: 1010466 - DNA, 21 bp, Homo sapiens
gagccttgcatgtacttgaag

SEQ ID NO: 1010467 - DNA, 14 bp, Homo sapiens
gagccttgctgggc

SEQ ID NO: 1010468 - DNA, 22 bp, Homo sapiens
gagccttggtgtccacctggcc

SEQ ID NO: 1010469 - DNA, 15 bp, Homo sapiens
gagcctttgccttta

SEQ ID NO: 1010470 - DNA, 23 bp, Homo sapiens
gagccttttccctctttggctcc

SEQ ID NO: 1010471 - DNA, 13 bp, Homo sapiens
gagcgacacagac

SEQ ID NO: 1010472 - DNA, 21 bp, Homo sapiens
gagcgagacttggtttcaaaa

SEQ ID NO: 1010473 - DNA, 16 bp, Homo sapiens
gagcgagcatccccca

SEQ ID NO: 1010474 - DNA, 13 bp, Homo sapiens
gagcgaggaaagg

SEQ ID NO: 1010475 - DNA, 21 bp, Homo sapiens
gagcgcacagggagtgcacat

SEQ ID NO: 1010476 - DNA, 12 bp, Homo sapiens
gagcgcaggcag

SEQ ID NO: 1010477 - DNA, 20 bp, Homo sapiens
gagcgcaggcagcgcagggc

SEQ ID NO: 1010478 - DNA, 21 bp, Homo sapiens
gagcgcaggcagcgcagggct

SEQ ID NO: 1010479 - DNA, 22 bp, Homo sapiens
gagcgcaggcagcgcagggctg

SEQ ID NO: 1010480 - DNA, 12 bp, Homo sapiens
gagcgccacctc

SEQ ID NO: 1010481 - DNA, 21 bp, Homo sapiens
gagcgcccactagacccactg

SEQ ID NO: 1010482 - DNA, 14 bp, Homo sapiens
gagcgcccccgagc

SEQ ID NO: 1010483 - DNA, 15 bp, Homo sapiens
gagcgcccccgagcc

SEQ ID NO: 1010484 - DNA, 23 bp, Homo sapiens
gagcgcccccgagccctgactcc

SEQ ID NO: 1010485 - DNA, 21 bp, Homo sapiens
gagcgcccgccgtctgctccg

SEQ ID NO: 1010486 - DNA, 21 bp, Homo sapiens
gagcgcctcttcctctgggca

SEQ ID NO: 1010487 - DNA, 22 bp, Homo sapiens
gagcgcctcttcctctgggcag

SEQ ID NO: 1010488 - DNA, 15 bp, Homo sapiens
gagcgctacccactt

SEQ ID NO: 1010489 - DNA, 15 bp, Homo sapiens
gagcgctagtgcctt

SEQ ID NO: 1010490 - DNA, 14 bp, Homo sapiens
gagcgctcctctgc

SEQ ID NO: 1010491 - DNA, 15 bp, Homo sapiens
gagcggcaccctggt

SEQ ID NO: 1010492 - DNA, 12 bp, Homo sapiens
gagcgggaggca

SEQ ID NO: 1010493 - DNA, 15 bp, Homo sapiens
gagcgggaggcagag

SEQ ID NO: 1010494 - DNA, 14 bp, Homo sapiens
gagcgtcactgccc

SEQ ID NO: 1010495 - DNA, 18 bp, Homo sapiens
gagcgtcactgcccacca

SEQ ID NO: 1010496 - DNA, 22 bp, Homo sapiens
gagcgtcctccatcttccagga

SEQ ID NO: 1010497 - DNA, 16 bp, Homo sapiens
gagcgtgaatctgtat

SEQ ID NO: 1010498 - DNA, 20 bp, Homo sapiens
gagcgtggaagggggaggag

SEQ ID NO: 1010499 - DNA, 21 bp, Homo sapiens
gagcgtggaagggggaggagt

SEQ ID NO: 1010500 - DNA, 22 bp, Homo sapiens
gagcgtggactggttggttttg

SEQ ID NO: 1010501 - DNA, 17 bp, Homo sapiens
gagcgtttggttaaagt

SEQ ID NO: 1010502 - DNA, 19 bp, Homo sapiens
gagctaaactccttcctgg

SEQ ID NO: 1010503 - DNA, 14 bp, Homo sapiens
gagctaacactggc

SEQ ID NO: 1010504 - DNA, 23 bp, Homo sapiens
gagctaaccccaagctgcctctg

SEQ ID NO: 1010505 - DNA, 22 bp, Homo sapiens
gagctaagggtgggtgctcaga

SEQ ID NO: 1010506 - DNA, 16 bp, Homo sapiens
gagctaagtcacccag

SEQ ID NO: 1010507 - DNA, 14 bp, Homo sapiens
gagctaataaatct

SEQ ID NO: 1010508 - DNA, 22 bp, Homo sapiens
gagctaatttactggacaaaga

SEQ ID NO: 1010509 - DNA, 15 bp, Homo sapiens
gagctacataattta

SEQ ID NO: 1010510 - DNA, 15 bp, Homo sapiens
gagctacgtatttaa

SEQ ID NO: 1010511 - DNA, 22 bp, Homo sapiens
gagctactagagatattcttat

SEQ ID NO: 1010512 - DNA, 13 bp, Homo sapiens
gagctactgatga

SEQ ID NO: 1010513 - DNA, 13 bp, Homo sapiens
gagctagagaaat

SEQ ID NO: 1010514 - DNA, 13 bp, Homo sapiens
gagctagcctcca

SEQ ID NO: 1010515 - DNA, 15 bp, Homo sapiens
gagctagcctccagc

SEQ ID NO: 1010516 - DNA, 23 bp, Homo sapiens
gagctagcgctgccgcaccccag

SEQ ID NO: 1010517 - DNA, 14 bp, Homo sapiens
gagctagggctgct

SEQ ID NO: 1010518 - DNA, 20 bp, Homo sapiens
gagctagggctgctgcttct

SEQ ID NO: 1010519 - DNA, 22 bp, Homo sapiens
gagctagggctgctgcttctgc

SEQ ID NO: 1010520 - DNA, 15 bp, Homo sapiens
gagctagtgtcttat

SEQ ID NO: 1010521 - DNA, 23 bp, Homo sapiens
gagctatgatttttttttccaaa

SEQ ID NO: 1010522 - DNA, 13 bp, Homo sapiens
gagctatttccat

SEQ ID NO: 1010523 - DNA, 18 bp, Homo sapiens
gagctatttccattccag

SEQ ID NO: 1010524 - DNA, 21 bp, Homo sapiens
gagctatttgtggttgttgag

SEQ ID NO: 1010525 - DNA, 15 bp, Homo sapiens
gagctattttcctct

SEQ ID NO: 1010526 - DNA, 15 bp, Homo sapiens
gagctcaagcccttg

SEQ ID NO: 1010527 - DNA, 21 bp, Homo sapiens
gagctcaagcccttggggagg

SEQ ID NO: 1010528 - DNA, 17 bp, Homo sapiens
gagctcacatgggactg

SEQ ID NO: 1010529 - DNA, 15 bp, Homo sapiens
gagctcaccctgccc

SEQ ID NO: 1010530 - DNA, 18 bp, Homo sapiens
gagctcaccctgcccgct

SEQ ID NO: 1010531 - DNA, 21 bp, Homo sapiens
gagctcaccctgcccgctccc

SEQ ID NO: 1010532 - DNA, 19 bp, Homo sapiens
gagctcactgtggtgtctg

SEQ ID NO: 1010533 - DNA, 12 bp, Homo sapiens
gagctcagggca

SEQ ID NO: 1010534 - DNA, 17 bp, Homo sapiens
gagctcatcccccctgc

SEQ ID NO: 1010535 - DNA, 18 bp, Homo sapiens
gagctcatcccccctgct

SEQ ID NO: 1010536 - DNA, 23 bp, Homo sapiens
gagctccacctctggtggctcct

SEQ ID NO: 1010537 - DNA, 17 bp, Homo sapiens
gagctccagacccccag

SEQ ID NO: 1010538 - DNA, 19 bp, Homo sapiens
gagctccagacccccagca

SEQ ID NO: 1010539 - DNA, 16 bp, Homo sapiens
gagctcccacctccct

SEQ ID NO: 1010540 - DNA, 19 bp, Homo sapiens
gagctcccacctcccttcc

SEQ ID NO: 1010541 - DNA, 23 bp, Homo sapiens
gagctcccacctcccttcccacc

SEQ ID NO: 1010542 - DNA, 17 bp, Homo sapiens
gagctcccctccacagc

SEQ ID NO: 1010543 - DNA, 18 bp, Homo sapiens
gagctcccctccacagct

SEQ ID NO: 1010544 - DNA, 23 bp, Homo sapiens
gagctcccctgtttgcatgagaa

SEQ ID NO: 1010545 - DNA, 20 bp, Homo sapiens
ccctggagtgtgtcagagcc

SEQ ID NO: 1010546 - DNA, 24 bp, Homo sapiens
ccctggagtgtgtcagagcccagg

SEQ ID NO: 1010547 - DNA, 24 bp, Homo sapiens
ccctggatcacgacgctgcagagc

SEQ ID NO: 1010548 - DNA, 19 bp, Homo sapiens
ccctggatccatcaggcca

SEQ ID NO: 1010549 - DNA, 19 bp, Homo sapiens
ccctggatctacctggagg

SEQ ID NO: 1010550 - DNA, 16 bp, Homo sapiens
ccctggatgcccagga

SEQ ID NO: 1010551 - DNA, 21 bp, Homo sapiens
ccctggatgggcattgggctg

SEQ ID NO: 1010552 - DNA, 23 bp, Homo sapiens
ccctggatgggcattgggctgac

SEQ ID NO: 1010553 - DNA, 21 bp, Homo sapiens
ccctggatgtcccctgtccca

SEQ ID NO: 1010554 - DNA, 13 bp, Homo sapiens
ccctggatgtgtg

SEQ ID NO: 1010555 - DNA, 21 bp, Homo sapiens
gagctttaaaagtatctttaa

SEQ ID NO: 1010556 - DNA, 15 bp, Homo sapiens
gagctttcaaagaag

SEQ ID NO: 1010557 - DNA, 17 bp, Homo sapiens
gagctttccatgttgct

SEQ ID NO: 1010558 - DNA, 17 bp, Homo sapiens
gagctttccttctccag

SEQ ID NO: 1010559 - DNA, 20 bp, Homo sapiens
gagctttctcaatgtcttcc

SEQ ID NO: 1010560 - DNA, 12 bp, Homo sapiens
gagctttctctc

SEQ ID NO: 1010561 - DNA, 22 bp, Homo sapiens
gagctttctgctatcaaagagg

SEQ ID NO: 1010562 - DNA, 17 bp, Homo sapiens
gagctttgctgctacag

SEQ ID NO: 1010563 - DNA, 15 bp, Homo sapiens
gagcttttgcatttc

SEQ ID NO: 1010564 - DNA, 18 bp, Homo sapiens
gagcttttgcatttcctg

SEQ ID NO: 1010565 - DNA, 19 bp, Homo sapiens
gagctttttaatagcacta

SEQ ID NO: 1010566 - DNA, 18 bp, Homo sapiens
gaggaaaacacagcctcc

SEQ ID NO: 1010567 - DNA, 16 bp, Homo sapiens
gaggaaaagactgtgg

SEQ ID NO: 1010568 - DNA, 18 bp, Homo sapiens
gaggaaaaggcccctgca

SEQ ID NO: 1010569 - DNA, 23 bp, Homo sapiens
gaggaaaaggcccctgcaatgtg

SEQ ID NO: 1010570 - DNA, 16 bp, Homo sapiens
gaggaaaaggtccttg

SEQ ID NO: 1010571 - DNA, 20 bp, Homo sapiens
gaggaaaaggtccttgcctc

SEQ ID NO: 1010572 - DNA, 22 bp, Homo sapiens
gaggaaaaggtccttgcctcct

SEQ ID NO: 1010573 - DNA, 21 bp, Homo sapiens
gaggaaaagtaaggtgcagtt

SEQ ID NO: 1010574 - DNA, 13 bp, Homo sapiens
gaggaaaagtgca

SEQ ID NO: 1010575 - DNA, 21 bp, Homo sapiens
gaggaaaataatgtaattgta

SEQ ID NO: 1010576 - DNA, 14 bp, Homo sapiens
gaggaaaatgagta

SEQ ID NO: 1010577 - DNA, 21 bp, Homo sapiens
gaggaaagtgcgttctcccag

SEQ ID NO: 1010578 - DNA, 17 bp, Homo sapiens
gaggaaataactaagag

SEQ ID NO: 1010579 - DNA, 21 bp, Homo sapiens
gaggaaataagaaaaatcatg

SEQ ID NO: 1010580 - DNA, 22 bp, Homo sapiens
gaggaaccacatataacactta

SEQ ID NO: 1010581 - DNA, 14 bp, Homo sapiens
gaggaaccagagcc

SEQ ID NO: 1010582 - DNA, 22 bp, Homo sapiens
gaggaaccagagccatggactc

SEQ ID NO: 1010583 - DNA, 22 bp, Homo sapiens
gaggaaccaggagaagggctgg

SEQ ID NO: 1010584 - DNA, 14 bp, Homo sapiens
gaggaacgggcagc

SEQ ID NO: 1010585 - DNA, 16 bp, Homo sapiens
gaggaacgggcagcca

SEQ ID NO: 1010586 - DNA, 19 bp, Homo sapiens
gaggaacgggcagccacag

SEQ ID NO: 1010587 - DNA, 17 bp, Homo sapiens
gaggaactccaggacga

SEQ ID NO: 1010588 - DNA, 16 bp, Homo sapiens
gaggaactgtccagag

SEQ ID NO: 1010589 - DNA, 17 bp, Homo sapiens
gaggaacttgctgctgt

SEQ ID NO: 1010590 - DNA, 23 bp, Homo sapiens
gaggaacttgctgctgtgcctgc

SEQ ID NO: 1010591 - DNA, 13 bp, Homo sapiens
gaggaagagaagc

SEQ ID NO: 1010592 - DNA, 19 bp, Homo sapiens
gaggaagagacatgagaaa

SEQ ID NO: 1010593 - DNA, 12 bp, Homo sapiens
gaggaagagaga

SEQ ID NO: 1010594 - DNA, 15 bp, Homo sapiens
gaggaagagccacct

SEQ ID NO: 1010595 - DNA, 21 bp, Homo sapiens
gaggaagagccacctgcaaga

SEQ ID NO: 1010596 - DNA, 23 bp, Homo sapiens
gaggaagagccacctgcaagatg

SEQ ID NO: 1010597 - DNA, 13 bp, Homo sapiens
gaggaagagtctt

SEQ ID NO: 1010598 - DNA, 15 bp, Homo sapiens
gaggaagcaagacgt

SEQ ID NO: 1010599 - DNA, 18 bp, Homo sapiens
gaggaagcagttggggcc

SEQ ID NO: 1010600 - DNA, 17 bp, Homo sapiens
gaggaagccagtggagc

SEQ ID NO: 1010601 - DNA, 15 bp, Homo sapiens
gaggaagcccaggct

SEQ ID NO: 1010602 - DNA, 22 bp, Homo sapiens
gaggaagccggtgtccctggat

SEQ ID NO: 1010603 - DNA, 19 bp, Homo sapiens
gaggaaggaacagcaatgg

SEQ ID NO: 1010604 - DNA, 16 bp, Homo sapiens
gaggaaggaggaccca

SEQ ID NO: 1010605 - DNA, 18 bp, Homo sapiens
gaggaaggaggacccagg

SEQ ID NO: 1010606 - DNA, 21 bp, Homo sapiens
gaggaaggcatgcctggacaa

SEQ ID NO: 1010607 - DNA, 13 bp, Homo sapiens
gaggaaggctctg

SEQ ID NO: 1010608 - DNA, 12 bp, Homo sapiens
gaggaaggctga

SEQ ID NO: 1010609 - DNA, 15 bp, Homo sapiens
gaggaaggtgctgag

SEQ ID NO: 1010610 - DNA, 19 bp, Homo sapiens
gaggaagtatgagtgctga

SEQ ID NO: 1010611 - DNA, 17 bp, Homo sapiens
gaggaagtgtggaaaaa

SEQ ID NO: 1010612 - DNA, 13 bp, Homo sapiens
gaggaagttctcc

SEQ ID NO: 1010613 - DNA, 18 bp, Homo sapiens
gaggaataattatttatt

SEQ ID NO: 1010614 - DNA, 17 bp, Homo sapiens
gaggaatacattttatt

SEQ ID NO: 1010615 - DNA, 22 bp, Homo sapiens
gaggaatcatgtcaggcctgtg

SEQ ID NO: 1010616 - DNA, 19 bp, Homo sapiens
gaggaatcctggcagccca

SEQ ID NO: 1010617 - DNA, 20 bp, Homo sapiens
gaggaatctgtgggtctggg

SEQ ID NO: 1010618 - DNA, 15 bp, Homo sapiens
gaggaatctgtttct

SEQ ID NO: 1010619 - DNA, 14 bp, Homo sapiens
gaggaatgtagggc

SEQ ID NO: 1010620 - DNA, 16 bp, Homo sapiens
gaggaatgtagggcct

SEQ ID NO: 1010621 - DNA, 15 bp, Homo sapiens
gaggacaaccattcc

SEQ ID NO: 1010622 - DNA, 18 bp, Homo sapiens
gaggacaagagaaaaaag

SEQ ID NO: 1010623 - DNA, 15 bp, Homo sapiens
gaggacacagcacaa

SEQ ID NO: 1010624 - DNA, 14 bp, Homo sapiens
gaggacacaggcag

SEQ ID NO: 1010625 - DNA, 16 bp, Homo sapiens
gaggacagctctgggg

SEQ ID NO: 1010626 - DNA, 13 bp, Homo sapiens
gaggacagctgtc

SEQ ID NO: 1010627 - DNA, 14 bp, Homo sapiens
gaggacagctgtcc

SEQ ID NO: 1010628 - DNA, 18 bp, Homo sapiens
gaggacagcttgagccgg

SEQ ID NO: 1010629 - DNA, 14 bp, Homo sapiens
gaggacaggcggga

SEQ ID NO: 1010630 - DNA, 21 bp, Homo sapiens
gaggacaggctctagagagag

SEQ ID NO: 1010631 - DNA, 11 bp, Homo sapiens
gaggacatcat

SEQ ID NO: 1010632 - DNA, 19 bp, Homo sapiens
gaggacatgcgtgtgtcag

SEQ ID NO: 1010633 - DNA, 22 bp, Homo sapiens
gaggacatgcgtgtgtcaggga

SEQ ID NO: 1010634 - DNA, 18 bp, Homo sapiens
gaggaccacagtgggtgg

SEQ ID NO: 1010635 - DNA, 13 bp, Homo sapiens
gaggaccactcct

SEQ ID NO: 1010636 - DNA, 16 bp, Homo sapiens
gaggaccagggtggag

SEQ ID NO: 1010637 - DNA, 11 bp, Homo sapiens
gaggacccagg

SEQ ID NO: 1010638 - DNA, 20 bp, Homo sapiens
gaggacccaggaaaggcagg

SEQ ID NO: 1010639 - DNA, 12 bp, Homo sapiens
gaggaccccagg

SEQ ID NO: 1010640 - DNA, 13 bp, Homo sapiens
gaggaccccaggg

SEQ ID NO: 1010641 - DNA, 18 bp, Homo sapiens
gaggaccccgagggctga

SEQ ID NO: 1010642 - DNA, 14 bp, Homo sapiens
gaggacccctgcct

SEQ ID NO: 1010643 - DNA, 11 bp, Homo sapiens
gaggaccctgg

SEQ ID NO: 1010644 - DNA, 12 bp, Homo sapiens
gaggacctccct

SEQ ID NO: 1010645 - DNA, 22 bp, Homo sapiens
gaggacctggcgtgctcagacc

SEQ ID NO: 1010646 - DNA, 15 bp, Homo sapiens
gaggaccttatctgt

SEQ ID NO: 1010647 - DNA, 13 bp, Homo sapiens
gaggacgcacgct

SEQ ID NO: 1010648 - DNA, 23 bp, Homo sapiens
gaggactccaggcagcagacaca

SEQ ID NO: 1010649 - DNA, 20 bp, Homo sapiens
gaggactcccaaccctggct

SEQ ID NO: 1010650 - DNA, 11 bp, Homo sapiens
gaggactgaga

SEQ ID NO: 1010651 - DNA, 13 bp, Homo sapiens
gaggactgagact

SEQ ID NO: 1010652 - DNA, 14 bp, Homo sapiens
gaggactgagcccc

SEQ ID NO: 1010653 - DNA, 13 bp, Homo sapiens
gaggactggactg

SEQ ID NO: 1010654 - DNA, 21 bp, Homo sapiens
gaggactgtagggagggcggc

SEQ ID NO: 1010655 - DNA, 15 bp, Homo sapiens
gaggactgtcctccc

SEQ ID NO: 1010656 - DNA, 17 bp, Homo sapiens
gaggacttggagggtct

SEQ ID NO: 1010657 - DNA, 17 bp, Homo sapiens
gaggacttgtgtctctg

SEQ ID NO: 1010658 - DNA, 16 bp, Homo sapiens
gaggagaaaaaaaaag

SEQ ID NO: 1010659 - DNA, 15 bp, Homo sapiens
gaggagaaatgcaat

SEQ ID NO: 1010660 - DNA, 15 bp, Homo sapiens
gaggagaaggaggag

SEQ ID NO: 1010661 - DNA, 12 bp, Homo sapiens
gaggagaccctg

SEQ ID NO: 1010662 - DNA, 16 bp, Homo sapiens
gaggagagaaaatata

SEQ ID NO: 1010663 - DNA, 14 bp, Homo sapiens
gaggagagaagaat

SEQ ID NO: 1010664 - DNA, 15 bp, Homo sapiens
gaggagagaagaatg

SEQ ID NO: 1010665 - DNA, 13 bp, Homo sapiens
gaggagagccact

SEQ ID NO: 1010666 - DNA, 14 bp, Homo sapiens
gaggagagccactg

SEQ ID NO: 1010667 - DNA, 20 bp, Homo sapiens
gaggagaggggaagggccag

SEQ ID NO: 1010668 - DNA, 12 bp, Homo sapiens
gaggcaggaatg

SEQ ID NO: 1010669 - DNA, 14 bp, Homo sapiens
gaggcaggaatggg

SEQ ID NO: 1010670 - DNA, 16 bp, Homo sapiens
gaggcaggaatggggg

SEQ ID NO: 1010671 - DNA, 17 bp, Homo sapiens
gaggcaggaatgggggt

SEQ ID NO: 1010672 - DNA, 21 bp, Homo sapiens
gaggcaggaatgggggtcaga

SEQ ID NO: 1010673 - DNA, 12 bp, Homo sapiens
gaggcaggctgg

SEQ ID NO: 1010674 - DNA, 14 bp, Homo sapiens
gaggcaggctggga

SEQ ID NO: 1010675 - DNA, 16 bp, Homo sapiens
gaggcagggaggggac

SEQ ID NO: 1010676 - DNA, 17 bp, Homo sapiens
gaggcagggaggggact

SEQ ID NO: 1010677 - DNA, 16 bp, Homo sapiens
gaggcagggctctccc

SEQ ID NO: 1010678 - DNA, 12 bp, Homo sapiens
gaggcagggctg

SEQ ID NO: 1010679 - DNA, 15 bp, Homo sapiens
gaggcaggggcggag

SEQ ID NO: 1010680 - DNA, 21 bp, Homo sapiens
gaggcagtgatgacttgctgt

SEQ ID NO: 1010681 - DNA, 16 bp, Homo sapiens
gaggcagtgctgatcc

SEQ ID NO: 1010682 - DNA, 14 bp, Homo sapiens
gaggcagtggctag

SEQ ID NO: 1010683 - DNA, 22 bp, Homo sapiens
gaggcatcatggaaagactggg

SEQ ID NO: 1010684 - DNA, 17 bp, Homo sapiens
gaggcatcgcaatgtaa

SEQ ID NO: 1010685 - DNA, 23 bp, Homo sapiens
gaggcatcttttctagagacaca

SEQ ID NO: 1010686 - DNA, 13 bp, Homo sapiens
gaggcatggccct

SEQ ID NO: 1010687 - DNA, 17 bp, Homo sapiens
gaggcattcggggaagc

SEQ ID NO: 1010688 - DNA, 17 bp, Homo sapiens
ccctgtatatagcccag

SEQ ID NO: 1010689 - DNA, 22 bp, Homo sapiens
ccctgtcaaatatcagttaccc

SEQ ID NO: 1010690 - DNA, 18 bp, Homo sapiens
ccctgtcaagttaacaag

SEQ ID NO: 1010691 - DNA, 17 bp, Homo sapiens
ccctgtcacacactgga

SEQ ID NO: 1010692 - DNA, 20 bp, Homo sapiens
ccctgtcacacactggaccc

SEQ ID NO: 1010693 - DNA, 14 bp, Homo sapiens
ccctgtcaccaagc

SEQ ID NO: 1010694 - DNA, 22 bp, Homo sapiens
ccctgtcatttttaacagcatg

SEQ ID NO: 1010695 - DNA, 14 bp, Homo sapiens
ccctgtccaaaagc

SEQ ID NO: 1010696 - DNA, 23 bp, Homo sapiens
ccctgtccaaaagcgccctcact

SEQ ID NO: 1010697 - DNA, 15 bp, Homo sapiens
ccctgtcccaccaac

SEQ ID NO: 1010698 - DNA, 16 bp, Homo sapiens
ccctgtcccaccaact

SEQ ID NO: 1010699 - DNA, 20 bp, Homo sapiens
ccctgtcccaccaactctgc

SEQ ID NO: 1010700 - DNA, 21 bp, Homo sapiens
ccctgtcccaccaactctgca

SEQ ID NO: 1010701 - DNA, 14 bp, Homo sapiens
ccctgtcccaccca

SEQ ID NO: 1010702 - DNA, 22 bp, Homo sapiens
ccctgtcccacccccttccccc

SEQ ID NO: 1010703 - DNA, 14 bp, Homo sapiens
ccctgtcccacctg

SEQ ID NO: 1010704 - DNA, 17 bp, Homo sapiens
ccctgtcccacctggct

SEQ ID NO: 1010705 - DNA, 16 bp, Homo sapiens
ccctgtcccaggccgg

SEQ ID NO: 1010706 - DNA, 17 bp, Homo sapiens
ccctgtcccagggccct

SEQ ID NO: 1010707 - DNA, 14 bp, Homo sapiens
ccctgtcccatgca

SEQ ID NO: 1010708 - DNA, 17 bp, Homo sapiens
ccctgtcccatgcaggc

SEQ ID NO: 1010709 - DNA, 19 bp, Homo sapiens
ccctgtcccatgcaggccc

SEQ ID NO: 1010710 - DNA, 18 bp, Homo sapiens
ccctgtcccattctagat

SEQ ID NO: 1010711 - DNA, 15 bp, Homo sapiens
ccctgtccccaacag

SEQ ID NO: 1010712 - DNA, 15 bp, Homo sapiens
ccctgtccccaggcc

SEQ ID NO: 1010713 - DNA, 20 bp, Homo sapiens
ccctgtccccagtccccagc

SEQ ID NO: 1010714 - DNA, 13 bp, Homo sapiens
ccctgtcccccag

SEQ ID NO: 1010715 - DNA, 14 bp, Homo sapiens
ccctgtcccccagc

SEQ ID NO: 1010716 - DNA, 19 bp, Homo sapiens
ccctgtcccccagctctgg

SEQ ID NO: 1010717 - DNA, 13 bp, Homo sapiens
ccctgtcccctgg

SEQ ID NO: 1010718 - DNA, 13 bp, Homo sapiens
ccctgtccctcta

SEQ ID NO: 1010719 - DNA, 22 bp, Homo sapiens
ccctgtccctctagtgccttct

SEQ ID NO: 1010720 - DNA, 17 bp, Homo sapiens
ccctgtcccttcctttc

SEQ ID NO: 1010721 - DNA, 22 bp, Homo sapiens
ccctgtcccttcgagtccagga

SEQ ID NO: 1010722 - DNA, 15 bp, Homo sapiens
ccctgtccggcccag

SEQ ID NO: 1010723 - DNA, 23 bp, Homo sapiens
ccctgtcctgatggtcagctccc

SEQ ID NO: 1010724 - DNA, 13 bp, Homo sapiens
ccctgtcctggtg

SEQ ID NO: 1010725 - DNA, 16 bp, Homo sapiens
ccctgtccttccctgt

SEQ ID NO: 1010726 - DNA, 18 bp, Homo sapiens
ccctgtccttccctgttc

SEQ ID NO: 1010727 - DNA, 12 bp, Homo sapiens
ccctgtcctttg

SEQ ID NO: 1010728 - DNA, 14 bp, Homo sapiens
ccctgtcctttgca

SEQ ID NO: 1010729 - DNA, 19 bp, Homo sapiens
ccctgtcgcccacccagct

SEQ ID NO: 1010730 - DNA, 12 bp, Homo sapiens
ccctgtctagag

SEQ ID NO: 1010731 - DNA, 20 bp, Homo sapiens
ccctgtctagagagggaggc

SEQ ID NO: 1010732 - DNA, 12 bp, Homo sapiens
ccctgtctccag

SEQ ID NO: 1010733 - DNA, 16 bp, Homo sapiens
ccctgtctccagctgc

SEQ ID NO: 1010734 - DNA, 18 bp, Homo sapiens
ccctgtctccagctgcct

SEQ ID NO: 1010735 - DNA, 13 bp, Homo sapiens
ccctgtctccagg

SEQ ID NO: 1010736 - DNA, 15 bp, Homo sapiens
ccctgtctccagggc

SEQ ID NO: 1010737 - DNA, 14 bp, Homo sapiens
ccctgtctgtccct

SEQ ID NO: 1010738 - DNA, 17 bp, Homo sapiens
ccctgtcttctgggcac

SEQ ID NO: 1010739 - DNA, 19 bp, Homo sapiens
ccctgtcttctgggcacag

SEQ ID NO: 1010740 - DNA, 20 bp, Homo sapiens
ccctgtcttctgggcacagt

SEQ ID NO: 1010741 - DNA, 13 bp, Homo sapiens
ccctgtcttgtcc

SEQ ID NO: 1010742 - DNA, 22 bp, Homo sapiens
ccctgtgacatggtgcctgaga

SEQ ID NO: 1010743 - DNA, 22 bp, Homo sapiens
ccctgtgcagccgctgagcgag

SEQ ID NO: 1010744 - DNA, 22 bp, Homo sapiens
ccctgtgccgcactctggcggt

SEQ ID NO: 1010745 - DNA, 14 bp, Homo sapiens
ccctgtgcctgggc

SEQ ID NO: 1010746 - DNA, 12 bp, Homo sapiens
ccctgtgctggt

SEQ ID NO: 1010747 - DNA, 15 bp, Homo sapiens
ccctgtgctggtgtc

SEQ ID NO: 1010748 - DNA, 21 bp, Homo sapiens
ccctgtgctggtgtcctgacc

SEQ ID NO: 1010749 - DNA, 21 bp, Homo sapiens
ccctgtggaagcatggctgtc

SEQ ID NO: 1010750 - DNA, 21 bp, Homo sapiens
ccctgtggaagggactaggag

SEQ ID NO: 1010751 - DNA, 16 bp, Homo sapiens
ccctgtggagtccagc

SEQ ID NO: 1010752 - DNA, 20 bp, Homo sapiens
ccctgtggagtccagctcta

SEQ ID NO: 1010753 - DNA, 18 bp, Homo sapiens
ccctgtggccaactgcaa

SEQ ID NO: 1010754 - DNA, 15 bp, Homo sapiens
ccctgtggccctggc

SEQ ID NO: 1010755 - DNA, 17 bp, Homo sapiens
ccctgtggccctggcca

SEQ ID NO: 1010756 - DNA, 16 bp, Homo sapiens
ccctgtggccgccacc

SEQ ID NO: 1010757 - DNA, 18 bp, Homo sapiens
ccctgtggccgccacctg

SEQ ID NO: 1010758 - DNA, 19 bp, Homo sapiens
ccctgtggccgccacctga

SEQ ID NO: 1010759 - DNA, 19 bp, Homo sapiens
ccctgtgggaccgcctggc

SEQ ID NO: 1010760 - DNA, 12 bp, Homo sapiens
ccctgtggggat

SEQ ID NO: 1010761 - DNA, 14 bp, Homo sapiens
ccctgtggggatct

SEQ ID NO: 1010762 - DNA, 19 bp, Homo sapiens
ccctgtggggcaggagtgc

SEQ ID NO: 1010763 - DNA, 23 bp, Homo sapiens
ccctgtggggcaggagtgccagg

SEQ ID NO: 1010764 - DNA, 19 bp, Homo sapiens
ccctgtgggggtggccatc

SEQ ID NO: 1010765 - DNA, 23 bp, Homo sapiens
ccctgtgggggtggccatccctg

SEQ ID NO: 1010766 - DNA, 21 bp, Homo sapiens
ccctgtgggtgtctccctcgg

SEQ ID NO: 1010767 - DNA, 16 bp, Homo sapiens
ccctgtggtctgggga

SEQ ID NO: 1010768 - DNA, 19 bp, Homo sapiens
ccctgtggtgatgtgcctg

SEQ ID NO: 1010769 - DNA, 20 bp, Homo sapiens
ccctgtggtgatgtgcctgt

SEQ ID NO: 1010770 - DNA, 15 bp, Homo sapiens
ccctgtgtcagagcc

SEQ ID NO: 1010771 - DNA, 19 bp, Homo sapiens
ccctgtgtccacctgtggg

SEQ ID NO: 1010772 - DNA, 21 bp, Homo sapiens
ccctgtgtccacctgtgggtg

SEQ ID NO: 1010773 - DNA, 12 bp, Homo sapiens
ccctgtgtctgt

SEQ ID NO: 1010774 - DNA, 20 bp, Homo sapiens
ccctgtgtctgtcacaggct

SEQ ID NO: 1010775 - DNA, 21 bp, Homo sapiens
ccctgtgtctgtcacaggctg

SEQ ID NO: 1010776 - DNA, 21 bp, Homo sapiens
ccctgtgtggatgctgagctg

SEQ ID NO: 1010777 - DNA, 19 bp, Homo sapiens
ccctgtgttctgggctggg

SEQ ID NO: 1010778 - DNA, 22 bp, Homo sapiens
ccctgtgttctgggctggggcc

SEQ ID NO: 1010779 - DNA, 23 bp, Homo sapiens
ccctgtgttgtcccatctgccct

SEQ ID NO: 1010780 - DNA, 15 bp, Homo sapiens
ccctgttcacggtga

SEQ ID NO: 1010781 - DNA, 14 bp, Homo sapiens
ccctgttccctgga

SEQ ID NO: 1010782 - DNA, 13 bp, Homo sapiens
ccctgttccctgt

SEQ ID NO: 1010783 - DNA, 14 bp, Homo sapiens
ccctgttctccctt

SEQ ID NO: 1010784 - DNA, 16 bp, Homo sapiens
ccctgttcttcctcca

SEQ ID NO: 1010785 - DNA, 20 bp, Homo sapiens
ccctgttcttcctccagctg

SEQ ID NO: 1010786 - DNA, 11 bp, Homo sapiens
ccctgtttaat

SEQ ID NO: 1010787 - DNA, 14 bp, Homo sapiens
ccctgtttaatatt

SEQ ID NO: 1010788 - DNA, 19 bp, Homo sapiens
ccctgtttaatatttaaac

SEQ ID NO: 1010789 - DNA, 17 bp, Homo sapiens
ccctgtttactggttct

SEQ ID NO: 1010790 - DNA, 22 bp, Homo sapiens
gaggcgtgcccccctcctccag

SEQ ID NO: 1010791 - DNA, 14 bp, Homo sapiens
gaggcgtggaggag

SEQ ID NO: 1010792 - DNA, 15 bp, Homo sapiens
gaggcgtggaggaga

SEQ ID NO: 1010793 - DNA, 19 bp, Homo sapiens
gaggcgtggaggagaggag

SEQ ID NO: 1010794 - DNA, 13 bp, Homo sapiens
gaggcgtgtgcag

SEQ ID NO: 1010795 - DNA, 18 bp, Homo sapiens
gaggcgttctcctgcttg

SEQ ID NO: 1010796 - DNA, 23 bp, Homo sapiens
gaggctaagatgagatttgccag

SEQ ID NO: 1010797 - DNA, 15 bp, Homo sapiens
gaggctaagttggga

SEQ ID NO: 1010798 - DNA, 18 bp, Homo sapiens
gaggctacctcacctggg

SEQ ID NO: 1010799 - DNA, 22 bp, Homo sapiens
gaggctacctcacctgggcagg

SEQ ID NO: 1010800 - DNA, 14 bp, Homo sapiens
gaggctcagattgt

SEQ ID NO: 1010801 - DNA, 17 bp, Homo sapiens
gaggctccagagggcac

SEQ ID NO: 1010802 - DNA, 14 bp, Homo sapiens
gaggctccccgcct

SEQ ID NO: 1010803 - DNA, 15 bp, Homo sapiens
gaggctctccgtgca

SEQ ID NO: 1010804 - DNA, 21 bp, Homo sapiens
gaggctctggacagcagaagc

SEQ ID NO: 1010805 - DNA, 15 bp, Homo sapiens
gaggctctgtcactg

SEQ ID NO: 1010806 - DNA, 17 bp, Homo sapiens
gaggctctgttctgcct

SEQ ID NO: 1010807 - DNA, 16 bp, Homo sapiens
gaggctctttctgggc

SEQ ID NO: 1010808 - DNA, 14 bp, Homo sapiens
gaggctgacacaga

SEQ ID NO: 1010809 - DNA, 22 bp, Homo sapiens
gaggctgagcctacagatgaac

SEQ ID NO: 1010810 - DNA, 17 bp, Homo sapiens
gaggctgaggactttgc

SEQ ID NO: 1010811 - DNA, 16 bp, Homo sapiens
gaggctgaggcaagag

SEQ ID NO: 1010812 - DNA, 13 bp, Homo sapiens
gaggctgaggcag

SEQ ID NO: 1010813 - DNA, 18 bp, Homo sapiens
gaggctgaggcctggact

SEQ ID NO: 1010814 - DNA, 15 bp, Homo sapiens
gaggctgaggctggc

SEQ ID NO: 1010815 - DNA, 17 bp, Homo sapiens
gaggctgcactggagcc

SEQ ID NO: 1010816 - DNA, 15 bp, Homo sapiens
cccttatccaggact

SEQ ID NO: 1010817 - DNA, 16 bp, Homo sapiens
cccttatccaggactc

SEQ ID NO: 1010818 - DNA, 17 bp, Homo sapiens
cccttattagttacaaa

SEQ ID NO: 1010819 - DNA, 21 bp, Homo sapiens
cccttattgcctcccaggcaa

SEQ ID NO: 1010820 - DNA, 14 bp, Homo sapiens
cccttattgctgcc

SEQ ID NO: 1010821 - DNA, 15 bp, Homo sapiens
cccttattgctgcca

SEQ ID NO: 1010822 - DNA, 16 bp, Homo sapiens
cccttattgctgccaa

SEQ ID NO: 1010823 - DNA, 12 bp, Homo sapiens
cccttattttca

SEQ ID NO: 1010824 - DNA, 14 bp, Homo sapiens
cccttcaactcctg

SEQ ID NO: 1010825 - DNA, 15 bp, Homo sapiens
cccttcaactcctgg

SEQ ID NO: 1010826 - DNA, 16 bp, Homo sapiens
cccttcaactcctggc

SEQ ID NO: 1010827 - DNA, 17 bp, Homo sapiens
cccttcaactcctggct

SEQ ID NO: 1010828 - DNA, 15 bp, Homo sapiens
cccttcaaggcctcc

SEQ ID NO: 1010829 - DNA, 16 bp, Homo sapiens
cccttcaaggcctccc

SEQ ID NO: 1010830 - DNA, 20 bp, Homo sapiens
cccttcacaaagcccaaggg

SEQ ID NO: 1010831 - DNA, 16 bp, Homo sapiens
cccttcacagtgtttc

SEQ ID NO: 1010832 - DNA, 14 bp, Homo sapiens
cccttcagctcctg

SEQ ID NO: 1010833 - DNA, 15 bp, Homo sapiens
cccttcagctcctga

SEQ ID NO: 1010834 - DNA, 20 bp, Homo sapiens
cccttcagggattccctgtc

SEQ ID NO: 1010835 - DNA, 21 bp, Homo sapiens
cccttcagggattccctgtcc

SEQ ID NO: 1010836 - DNA, 14 bp, Homo sapiens
cccttcagggccag

SEQ ID NO: 1010837 - DNA, 19 bp, Homo sapiens
cccttcagtaccctctcag

SEQ ID NO: 1010838 - DNA, 15 bp, Homo sapiens
cccttcagtctgctc

SEQ ID NO: 1010839 - DNA, 16 bp, Homo sapiens
cccttcagtctgctcc

SEQ ID NO: 1010840 - DNA, 16 bp, Homo sapiens
cccttcagtcttaata

SEQ ID NO: 1010841 - DNA, 18 bp, Homo sapiens
cccttcatccgcctgtgg

SEQ ID NO: 1010842 - DNA, 15 bp, Homo sapiens
cccttcatcttcctg

SEQ ID NO: 1010843 - DNA, 11 bp, Homo sapiens
cccttcatttg

SEQ ID NO: 1010844 - DNA, 13 bp, Homo sapiens
cccttccagatca

SEQ ID NO: 1010845 - DNA, 13 bp, Homo sapiens
cccttccagcctg

SEQ ID NO: 1010846 - DNA, 14 bp, Homo sapiens
cccttccagcctgg

SEQ ID NO: 1010847 - DNA, 18 bp, Homo sapiens
cccttccagcctgggaca

SEQ ID NO: 1010848 - DNA, 19 bp, Homo sapiens
cccttccatcagcgggtct

SEQ ID NO: 1010849 - DNA, 23 bp, Homo sapiens
cccttcccacaggacatttctct

SEQ ID NO: 1010850 - DNA, 19 bp, Homo sapiens
cccttcccagccagcccgc

SEQ ID NO: 1010851 - DNA, 18 bp, Homo sapiens
cccttcccatctcttcct

SEQ ID NO: 1010852 - DNA, 22 bp, Homo sapiens
cccttccccaagaaggtgagtg

SEQ ID NO: 1010853 - DNA, 15 bp, Homo sapiens
cccttccccagccct

SEQ ID NO: 1010854 - DNA, 19 bp, Homo sapiens
cccttccccagcccttagc

SEQ ID NO: 1010855 - DNA, 21 bp, Homo sapiens
cccttcccccagcccatccat

SEQ ID NO: 1010856 - DNA, 21 bp, Homo sapiens
cccttccccgtcccctgcagc

SEQ ID NO: 1010857 - DNA, 12 bp, Homo sapiens
cccttcccctcc

SEQ ID NO: 1010858 - DNA, 23 bp, Homo sapiens
cccttcccctcccgacagcccat

SEQ ID NO: 1010859 - DNA, 15 bp, Homo sapiens
cccttcccctccctg

SEQ ID NO: 1010860 - DNA, 16 bp, Homo sapiens
cccttcccctccctgg

SEQ ID NO: 1010861 - DNA, 19 bp, Homo sapiens
cccttcccctccctggctc

SEQ ID NO: 1010862 - DNA, 16 bp, Homo sapiens
cccttcccgcctccct

SEQ ID NO: 1010863 - DNA, 13 bp, Homo sapiens
cccttccctcacc

SEQ ID NO: 1010864 - DNA, 13 bp, Homo sapiens
cccttccctgagt

SEQ ID NO: 1010865 - DNA, 14 bp, Homo sapiens
cccttccctgagtg

SEQ ID NO: 1010866 - DNA, 15 bp, Homo sapiens
cccttccctggggag

SEQ ID NO: 1010867 - DNA, 16 bp, Homo sapiens
cccttccctggggagc

SEQ ID NO: 1010868 - DNA, 23 bp, Homo sapiens
cccttccctggggagccctcagg

SEQ ID NO: 1010869 - DNA, 18 bp, Homo sapiens
cccttccgaccctctggg

SEQ ID NO: 1010870 - DNA, 19 bp, Homo sapiens
cccttccgaccctctggga

SEQ ID NO: 1010871 - DNA, 23 bp, Homo sapiens
cccttccgcagtgtggccaggct

SEQ ID NO: 1010872 - DNA, 19 bp, Homo sapiens
cccttccgtccatccccct

SEQ ID NO: 1010873 - DNA, 14 bp, Homo sapiens
cccttcctaattcc

SEQ ID NO: 1010874 - DNA, 20 bp, Homo sapiens
cccttcctaattccacagct

SEQ ID NO: 1010875 - DNA, 21 bp, Homo sapiens
cccttcctaattccacagctg

SEQ ID NO: 1010876 - DNA, 17 bp, Homo sapiens
cccttcctcagggcccc

SEQ ID NO: 1010877 - DNA, 17 bp, Homo sapiens
cccttcctccccacact

SEQ ID NO: 1010878 - DNA, 21 bp, Homo sapiens
cccttcctcctgaagcctctg

SEQ ID NO: 1010879 - DNA, 19 bp, Homo sapiens
cccttcctcggtggctctg

SEQ ID NO: 1010880 - DNA, 20 bp, Homo sapiens
cccttcctctccactgcctt

SEQ ID NO: 1010881 - DNA, 22 bp, Homo sapiens
cccttcctcttcggccctcaga

SEQ ID NO: 1010882 - DNA, 11 bp, Homo sapiens
cccttcctgaa

SEQ ID NO: 1010883 - DNA, 15 bp, Homo sapiens
cccttcctgccactg

SEQ ID NO: 1010884 - DNA, 12 bp, Homo sapiens
cccttcctgctg

SEQ ID NO: 1010885 - DNA, 19 bp, Homo sapiens
cccttcctggaaacagcat

SEQ ID NO: 1010886 - DNA, 14 bp, Homo sapiens
cccttcctggacac

SEQ ID NO: 1010887 - DNA, 16 bp, Homo sapiens
cccttcctggcccagg

SEQ ID NO: 1010888 - DNA, 13 bp, Homo sapiens
cccttcctggcct

SEQ ID NO: 1010889 - DNA, 15 bp, Homo sapiens
cccttcctggcctca

SEQ ID NO: 1010890 - DNA, 15 bp, Homo sapiens
cccttcctgtcctgc

SEQ ID NO: 1010891 - DNA, 11 bp, Homo sapiens
cccttcctgtt

SEQ ID NO: 1010892 - DNA, 22 bp, Homo sapiens
cccttcctgttccctcctggtc

SEQ ID NO: 1010893 - DNA, 18 bp, Homo sapiens
cccttcctgttcttcctt

SEQ ID NO: 1010894 - DNA, 14 bp, Homo sapiens
cccttcctttcctc

SEQ ID NO: 1010895 - DNA, 16 bp, Homo sapiens
cccttcctttcctctg

SEQ ID NO: 1010896 - DNA, 20 bp, Homo sapiens
cccttcctttcctctgcagc

SEQ ID NO: 1010897 - DNA, 17 bp, Homo sapiens
cccttccttttccctgc

SEQ ID NO: 1010898 - DNA, 16 bp, Homo sapiens
cccttcgagtccagga

SEQ ID NO: 1010899 - DNA, 18 bp, Homo sapiens
cccttcgctcctcctctc

SEQ ID NO: 1010900 - DNA, 15 bp, Homo sapiens
cccttctccatggag

SEQ ID NO: 1010901 - DNA, 15 bp, Homo sapiens
cccttctcccagcac

SEQ ID NO: 1010902 - DNA, 13 bp, Homo sapiens
cccttctcccctt

SEQ ID NO: 1010903 - DNA, 18 bp, Homo sapiens
cccttctcctcttgtaaa

SEQ ID NO: 1010904 - DNA, 20 bp, Homo sapiens
cccttctcctcttgtaaata

SEQ ID NO: 1010905 - DNA, 20 bp, Homo sapiens
cccttctcgtgtttgcttaa

SEQ ID NO: 1010906 - DNA, 17 bp, Homo sapiens
cccttctctctccagaa

SEQ ID NO: 1010907 - DNA, 17 bp, Homo sapiens
cccttctctgctccacc

SEQ ID NO: 1010908 - DNA, 23 bp, Homo sapiens
cccttctctgtagggaactctgg

SEQ ID NO: 1010909 - DNA, 15 bp, Homo sapiens
cccttctcttagtta

SEQ ID NO: 1010910 - DNA, 23 bp, Homo sapiens
cccttctgctcagctctgggcca

SEQ ID NO: 1010911 - DNA, 12 bp, Homo sapiens
cccttctgtgtc

SEQ ID NO: 1010912 - DNA, 17 bp, Homo sapiens
cccttctgtgtcacagt

SEQ ID NO: 1010913 - DNA, 20 bp, Homo sapiens
ccctttgggaggctgaggcg

SEQ ID NO: 1010914 - DNA, 20 bp, Homo sapiens
ccctttggggtagaccttga

SEQ ID NO: 1010915 - DNA, 12 bp, Homo sapiens
ccctttgtcctg

SEQ ID NO: 1010916 - DNA, 14 bp, Homo sapiens
ccctttgtcctgcg

SEQ ID NO: 1010917 - DNA, 23 bp, Homo sapiens
cccttttacagctcttggcattt

SEQ ID NO: 1010918 - DNA, 15 bp, Homo sapiens
cccttttccagcctc

SEQ ID NO: 1010919 - DNA, 22 bp, Homo sapiens
cccttttccagttgctgtggac

SEQ ID NO: 1010920 - DNA, 19 bp, Homo sapiens
cccttttcctttctggccc

SEQ ID NO: 1010921 - DNA, 18 bp, Homo sapiens
cccttttctctgctcttg

SEQ ID NO: 1010922 - DNA, 23 bp, Homo sapiens
cccttttgtgggtttctctgtgc

SEQ ID NO: 1010923 - DNA, 17 bp, Homo sapiens
ccctttttaaaaaatac

SEQ ID NO: 1010924 - DNA, 22 bp, Homo sapiens
ccctttttaaaaaataccattg

SEQ ID NO: 1010925 - DNA, 18 bp, Homo sapiens
ccctttttactccccttg

SEQ ID NO: 1010926 - DNA, 16 bp, Homo sapiens
ccctttttctccagct

SEQ ID NO: 1010927 - DNA, 15 bp, Homo sapiens
ccctttttgaagtgt

SEQ ID NO: 1010928 - DNA, 21 bp, Homo sapiens
cccttttttgtacaatatgtt

SEQ ID NO: 1010929 - DNA, 17 bp, Homo sapiens
cccttttttgtccccca

SEQ ID NO: 1010930 - DNA, 23 bp, Homo sapiens
cccttttttttttaaatttttat

SEQ ID NO: 1010931 - DNA, 19 bp, Homo sapiens
ccgaaaatggacattgaga

SEQ ID NO: 1010932 - DNA, 17 bp, Homo sapiens
ccgaaaatgtttttaaa

SEQ ID NO: 1010933 - DNA, 17 bp, Homo sapiens
ccgaaaccaaagaagaa

SEQ ID NO: 1010934 - DNA, 19 bp, Homo sapiens
ccgaaaggcaattatatct

SEQ ID NO: 1010935 - DNA, 23 bp, Homo sapiens
ccgaacatcaccgacgcgtctcc

SEQ ID NO: 1010936 - DNA, 17 bp, Homo sapiens
ccgaaccccgggcccgg

SEQ ID NO: 1010937 - DNA, 13 bp, Homo sapiens
ccgaagccatcac

SEQ ID NO: 1010938 - DNA, 21 bp, Homo sapiens
ccgaagccatcacttctcccc

SEQ ID NO: 1010939 - DNA, 15 bp, Homo sapiens
ccgaagcccaggggc

SEQ ID NO: 1010940 - DNA, 16 bp, Homo sapiens
ccgaagcccaggggcc

SEQ ID NO: 1010941 - DNA, 17 bp, Homo sapiens
ccgaagccccttggaga

SEQ ID NO: 1010942 - DNA, 18 bp, Homo sapiens
ccgaagccccttggagag

SEQ ID NO: 1010943 - DNA, 21 bp, Homo sapiens
ccgaagctctggctgaaccct

SEQ ID NO: 1010944 - DNA, 13 bp, Homo sapiens
ccgaagtaaaata

SEQ ID NO: 1010945 - DNA, 15 bp, Homo sapiens
ccgaatatattactg

SEQ ID NO: 1010946 - DNA, 19 bp, Homo sapiens
gagggcccagccaggagca

SEQ ID NO: 1010947 - DNA, 15 bp, Homo sapiens
gagggcccagcccag

SEQ ID NO: 1010948 - DNA, 23 bp, Homo sapiens
gagggcccagcccagagccacct

SEQ ID NO: 1010949 - DNA, 12 bp, Homo sapiens
gagggcccagct

SEQ ID NO: 1010950 - DNA, 23 bp, Homo sapiens
gagggcccagctgtagccatggc

SEQ ID NO: 1010951 - DNA, 15 bp, Homo sapiens
gagggcccatcaggc

SEQ ID NO: 1010952 - DNA, 17 bp, Homo sapiens
gagggcccatcaggcag

SEQ ID NO: 1010953 - DNA, 18 bp, Homo sapiens
gagggcccatcaggcagt

SEQ ID NO: 1010954 - DNA, 13 bp, Homo sapiens
gagggcccctgcg

SEQ ID NO: 1010955 - DNA, 23 bp, Homo sapiens
gagggccctgtggagtccagctc

SEQ ID NO: 1010956 - DNA, 15 bp, Homo sapiens
gagggccgcccgctc

SEQ ID NO: 1010957 - DNA, 17 bp, Homo sapiens
gagggccgcccgctccc

SEQ ID NO: 1010958 - DNA, 21 bp, Homo sapiens
gagggccggcggctctgagca

SEQ ID NO: 1010959 - DNA, 14 bp, Homo sapiens
gagggcctcagagc

SEQ ID NO: 1010960 - DNA, 17 bp, Homo sapiens
gagggcctcagagcctg

SEQ ID NO: 1010961 - DNA, 18 bp, Homo sapiens
gagggcctcagagcctga

SEQ ID NO: 1010962 - DNA, 14 bp, Homo sapiens
gagggcctgctgga

SEQ ID NO: 1010963 - DNA, 14 bp, Homo sapiens
gagggcgaaggcca

SEQ ID NO: 1010964 - DNA, 16 bp, Homo sapiens
gagggcggagccggcc

SEQ ID NO: 1010965 - DNA, 15 bp, Homo sapiens
gagggcggccaggga

SEQ ID NO: 1010966 - DNA, 15 bp, Homo sapiens
gagggcgtcaggcag

SEQ ID NO: 1010967 - DNA, 22 bp, Homo sapiens
gagggcgtcaggcagaggcaac

SEQ ID NO: 1010968 - DNA, 17 bp, Homo sapiens
gagggctagccctgagc

SEQ ID NO: 1010969 - DNA, 14 bp, Homo sapiens
gagggctcactcag

SEQ ID NO: 1010970 - DNA, 15 bp, Homo sapiens
gagggctcagaagag

SEQ ID NO: 1010971 - DNA, 18 bp, Homo sapiens
gagggctcagaagagcag

SEQ ID NO: 1010972 - DNA, 14 bp, Homo sapiens
gagggctcagggca

SEQ ID NO: 1010973 - DNA, 16 bp, Homo sapiens
gagggctcctggggca

SEQ ID NO: 1010974 - DNA, 17 bp, Homo sapiens
gagggctcctggggcag

SEQ ID NO: 1010975 - DNA, 19 bp, Homo sapiens
gagggctgaggagcagcca

SEQ ID NO: 1010976 - DNA, 20 bp, Homo sapiens
gagggctgatggaggaaaaa

SEQ ID NO: 1010977 - DNA, 10 bp, Homo sapiens
gagggctgga

SEQ ID NO: 1010978 - DNA, 13 bp, Homo sapiens
gagggctggctgg

SEQ ID NO: 1010979 - DNA, 14 bp, Homo sapiens
gagggctgggccca

SEQ ID NO: 1010980 - DNA, 16 bp, Homo sapiens
gaggggaaatggggaa

SEQ ID NO: 1010981 - DNA, 18 bp, Homo sapiens
gaggggaaatggggaaag

SEQ ID NO: 1010982 - DNA, 13 bp, Homo sapiens
gaggggaaatgta

SEQ ID NO: 1010983 - DNA, 22 bp, Homo sapiens
gaggggaaatgtaatactggaa

SEQ ID NO: 1010984 - DNA, 20 bp, Homo sapiens
gaggggaacagggtgcagga

SEQ ID NO: 1010985 - DNA, 23 bp, Homo sapiens
gaggggaagaaacactttctctt

SEQ ID NO: 1010986 - DNA, 20 bp, Homo sapiens
gaggggaagaatttaatgga

SEQ ID NO: 1010987 - DNA, 16 bp, Homo sapiens
gaggggaagaggcctg

SEQ ID NO: 1010988 - DNA, 18 bp, Homo sapiens
gaggggaagctgggccca

SEQ ID NO: 1010989 - DNA, 16 bp, Homo sapiens
gaggggaaggggcggt

SEQ ID NO: 1010990 - DNA, 18 bp, Homo sapiens
gaggggacagagctgagg

SEQ ID NO: 1010991 - DNA, 16 bp, Homo sapiens
gaggggacgggcaagt

SEQ ID NO: 1010992 - DNA, 19 bp, Homo sapiens
gaggggactctgggctatg

SEQ ID NO: 1010993 - DNA, 16 bp, Homo sapiens
gaggggactgggggac

SEQ ID NO: 1010994 - DNA, 14 bp, Homo sapiens
gaggggagagacag

SEQ ID NO: 1010995 - DNA, 17 bp, Homo sapiens
gaggggagcagcggctc

SEQ ID NO: 1010996 - DNA, 12 bp, Homo sapiens
gaggggaggagg

SEQ ID NO: 1010997 - DNA, 16 bp, Homo sapiens
gaggggagggctcctg

SEQ ID NO: 1010998 - DNA, 18 bp, Homo sapiens
gaggggatggggatagag

SEQ ID NO: 1010999 - DNA, 18 bp, Homo sapiens
gaggggcaacgaagaaaa

SEQ ID NO: 1011000 - DNA, 20 bp, Homo sapiens
gaggggcagagccaggaaga

SEQ ID NO: 1011001 - DNA, 13 bp, Homo sapiens
gaggggcagccct

SEQ ID NO: 1011002 - DNA, 16 bp, Homo sapiens
gaggggcagcccttgc

SEQ ID NO: 1011003 - DNA, 16 bp, Homo sapiens
gaggggcagcctgtgc

SEQ ID NO: 1011004 - DNA, 19 bp, Homo sapiens
gaggggcagcctgtgcctg

SEQ ID NO: 1011005 - DNA, 15 bp, Homo sapiens
gaggggcaggacctg

SEQ ID NO: 1011006 - DNA, 22 bp, Homo sapiens
gaggggcagggagagcgcctct

SEQ ID NO: 1011007 - DNA, 17 bp, Homo sapiens
gaggggcatctgcccct

SEQ ID NO: 1011008 - DNA, 23 bp, Homo sapiens
gaggggccactgacccacctgcg

SEQ ID NO: 1011009 - DNA, 14 bp, Homo sapiens
gaggggccagcaga

SEQ ID NO: 1011010 - DNA, 17 bp, Homo sapiens
gaggggccaggggcagg

SEQ ID NO: 1011011 - DNA, 14 bp, Homo sapiens
gaggggccctcagg

SEQ ID NO: 1011012 - DNA, 15 bp, Homo sapiens
gaggggccctcaggc

SEQ ID NO: 1011013 - DNA, 17 bp, Homo sapiens
gaggggccctcaggcca

SEQ ID NO: 1011014 - DNA, 17 bp, Homo sapiens
gaggggccggctggcct

SEQ ID NO: 1011015 - DNA, 22 bp, Homo sapiens
gaggggcctgatgagactccac

SEQ ID NO: 1011016 - DNA, 21 bp, Homo sapiens
gaggggcctgcgcccagagct

SEQ ID NO: 1011017 - DNA, 13 bp, Homo sapiens
gaggggcctggag

SEQ ID NO: 1011018 - DNA, 14 bp, Homo sapiens
gaggggcctgggca

SEQ ID NO: 1011019 - DNA, 21 bp, Homo sapiens
gaggggcctgggcagccccac

SEQ ID NO: 1011020 - DNA, 16 bp, Homo sapiens
gaggggcgcccagggt

SEQ ID NO: 1011021 - DNA, 19 bp, Homo sapiens
gaggggcgctggcccagcc

SEQ ID NO: 1011022 - DNA, 15 bp, Homo sapiens
gaggggcgggctcag

SEQ ID NO: 1011023 - DNA, 11 bp, Homo sapiens
gaggggctctc

SEQ ID NO: 1011024 - DNA, 12 bp, Homo sapiens
gaggggctgggc

SEQ ID NO: 1011025 - DNA, 14 bp, Homo sapiens
gaggggctgggctg

SEQ ID NO: 1011026 - DNA, 23 bp, Homo sapiens
gaggggctggggacttgtgtctg

SEQ ID NO: 1011027 - DNA, 22 bp, Homo sapiens
gaggggctggggcaggctctct

SEQ ID NO: 1011028 - DNA, 23 bp, Homo sapiens
gaggggctgtcctccttcctggg

SEQ ID NO: 1011029 - DNA, 13 bp, Homo sapiens
gagggggaagcaa

SEQ ID NO: 1011030 - DNA, 15 bp, Homo sapiens
gagggggacctgtcc

SEQ ID NO: 1011031 - DNA, 20 bp, Homo sapiens
gagggggactgctgctgcct

SEQ ID NO: 1011032 - DNA, 21 bp, Homo sapiens
gagggggactgctgctgcctg

SEQ ID NO: 1011033 - DNA, 21 bp, Homo sapiens
gagggggccgggcgcggtggc

SEQ ID NO: 1011034 - DNA, 13 bp, Homo sapiens
gagggggcggcag

SEQ ID NO: 1011035 - DNA, 17 bp, Homo sapiens
gagggggcggcagggct

SEQ ID NO: 1011036 - DNA, 15 bp, Homo sapiens
gagggggctctgccc

SEQ ID NO: 1011037 - DNA, 17 bp, Homo sapiens
gagggggcttgaagcca

SEQ ID NO: 1011038 - DNA, 21 bp, Homo sapiens
gaggggggtgctggcccccag

SEQ ID NO: 1011039 - DNA, 14 bp, Homo sapiens
gagggggtggaggg

SEQ ID NO: 1011040 - DNA, 18 bp, Homo sapiens
gaggggtaggcagagcct

SEQ ID NO: 1011041 - DNA, 23 bp, Homo sapiens
gaggggtgagtcccctactccct

SEQ ID NO: 1011042 - DNA, 15 bp, Homo sapiens
gaggggtgcacccac

SEQ ID NO: 1011043 - DNA, 22 bp, Homo sapiens
gaggggtgcggcggtcccagct

SEQ ID NO: 1011044 - DNA, 15 bp, Homo sapiens
gaggggtgggctggt

SEQ ID NO: 1011045 - DNA, 15 bp, Homo sapiens
gaggggtgtccgaga

SEQ ID NO: 1011046 - DNA, 21 bp, Homo sapiens
gaggggtgtggctccttccca

SEQ ID NO: 1011047 - DNA, 16 bp, Homo sapiens
gaggggttacctccct

SEQ ID NO: 1011048 - DNA, 18 bp, Homo sapiens
gaggggttacctccctcg

SEQ ID NO: 1011049 - DNA, 17 bp, Homo sapiens
gaggggttgagggaagg

SEQ ID NO: 1011050 - DNA, 22 bp, Homo sapiens
gagggtaactggggggccacca

SEQ ID NO: 1011051 - DNA, 19 bp, Homo sapiens
gagggtaagacaatatgaa

SEQ ID NO: 1011052 - DNA, 14 bp, Homo sapiens
gagggtagacaggg

SEQ ID NO: 1011053 - DNA, 17 bp, Homo sapiens
gagggtcccagggctgc

SEQ ID NO: 1011054 - DNA, 19 bp, Homo sapiens
gagggtccccacctgggac

SEQ ID NO: 1011055 - DNA, 23 bp, Homo sapiens
gagggtcccggtgtatcctggcc

SEQ ID NO: 1011056 - DNA, 13 bp, Homo sapiens
gagggtcctgcag

SEQ ID NO: 1011057 - DNA, 18 bp, Homo sapiens
gagggtcctgcagcctgc

SEQ ID NO: 1011058 - DNA, 21 bp, Homo sapiens
gagggtcctgcagcctgcagg

SEQ ID NO: 1011059 - DNA, 21 bp, Homo sapiens
gagggtctcccctcctgcaca

SEQ ID NO: 1011060 - DNA, 18 bp, Homo sapiens
gagggtctctttgttcaa

SEQ ID NO: 1011061 - DNA, 21 bp, Homo sapiens
gagggtctgggggcagctgtc

SEQ ID NO: 1011062 - DNA, 20 bp, Homo sapiens
gagggtcttttaccctgtgt

SEQ ID NO: 1011063 - DNA, 23 bp, Homo sapiens
gagggtcttttaccctgtgtcag

SEQ ID NO: 1011064 - DNA, 16 bp, Homo sapiens
gagggtgacccacagc

SEQ ID NO: 1011065 - DNA, 19 bp, Homo sapiens
gagggtgacccacagctct

SEQ ID NO: 1011066 - DNA, 22 bp, Homo sapiens
gagggtgacccacagctctggg

SEQ ID NO: 1011067 - DNA, 20 bp, Homo sapiens
gagggtgacgcccagctccg

SEQ ID NO: 1011068 - DNA, 13 bp, Homo sapiens
gagggtggagact

SEQ ID NO: 1011069 - DNA, 14 bp, Homo sapiens
gagggtggaggaag

SEQ ID NO: 1011070 - DNA, 13 bp, Homo sapiens
gagggtggcaggt

SEQ ID NO: 1011071 - DNA, 19 bp, Homo sapiens
ccgaatatattactgattt

SEQ ID NO: 1011072 - DNA, 22 bp, Homo sapiens
ccgaatattgagcaatatgtca

SEQ ID NO: 1011073 - DNA, 18 bp, Homo sapiens
ccgaatcccctccctgtc

SEQ ID NO: 1011074 - DNA, 13 bp, Homo sapiens
ccgaatgcctgtc

SEQ ID NO: 1011075 - DNA, 13 bp, Homo sapiens
ccgaatgtgtctt

SEQ ID NO: 1011076 - DNA, 14 bp, Homo sapiens
ccgaatgtgtcttt

SEQ ID NO: 1011077 - DNA, 20 bp, Homo sapiens
ccgacaaccgatgctccagc

SEQ ID NO: 1011078 - DNA, 20 bp, Homo sapiens
ccgacaatgccctgctggcc

SEQ ID NO: 1011079 - DNA, 18 bp, Homo sapiens
ccgacacacggggctcgg

SEQ ID NO: 1011080 - DNA, 17 bp, Homo sapiens
ccgacactgctgcacca

SEQ ID NO: 1011081 - DNA, 12 bp, Homo sapiens
ccgacagcctgg

SEQ ID NO: 1011082 - DNA, 22 bp, Homo sapiens
ccgacagcctggcacagggcag

SEQ ID NO: 1011083 - DNA, 12 bp, Homo sapiens
ccgacagtgcca

SEQ ID NO: 1011084 - DNA, 14 bp, Homo sapiens
ccgacagtgccatc

SEQ ID NO: 1011085 - DNA, 13 bp, Homo sapiens
ccgacagtggctc

SEQ ID NO: 1011086 - DNA, 13 bp, Homo sapiens
ccgacatcagcat

SEQ ID NO: 1011087 - DNA, 12 bp, Homo sapiens
ccgacatttctt

SEQ ID NO: 1011088 - DNA, 23 bp, Homo sapiens
ccgaccaatccccagcctaggac

SEQ ID NO: 1011089 - DNA, 13 bp, Homo sapiens
ccgaccagagccc

SEQ ID NO: 1011090 - DNA, 19 bp, Homo sapiens
ccgaccatcgtccagccct

SEQ ID NO: 1011091 - DNA, 21 bp, Homo sapiens
ccgaccatcgtccagccctcc

SEQ ID NO: 1011092 - DNA, 22 bp, Homo sapiens
ccgaccatcgtccagccctcct

SEQ ID NO: 1011093 - DNA, 12 bp, Homo sapiens
ccgacccagcca

SEQ ID NO: 1011094 - DNA, 14 bp, Homo sapiens
ccgacccagccagc

SEQ ID NO: 1011095 - DNA, 14 bp, Homo sapiens
ccgacccgaggccc

SEQ ID NO: 1011096 - DNA, 12 bp, Homo sapiens
ccgaccctgcgg

SEQ ID NO: 1011097 - DNA, 21 bp, Homo sapiens
ccgacctacgttcctggcccc

SEQ ID NO: 1011098 - DNA, 22 bp, Homo sapiens
ccgacctcgtcctccccctgcc

SEQ ID NO: 1011099 - DNA, 13 bp, Homo sapiens
ccgacctctctcg

SEQ ID NO: 1011100 - DNA, 23 bp, Homo sapiens
ccgaccttccctccgccttctcc

SEQ ID NO: 1011101 - DNA, 23 bp, Homo sapiens
ccgacggtgggcatttgtgaggc

SEQ ID NO: 1011102 - DNA, 17 bp, Homo sapiens
ccgacgttccacctggg

SEQ ID NO: 1011103 - DNA, 15 bp, Homo sapiens
ccgactaccccagtc

SEQ ID NO: 1011104 - DNA, 15 bp, Homo sapiens
ccgactagcaggcat

SEQ ID NO: 1011105 - DNA, 10 bp, Homo sapiens
ccgactccag

SEQ ID NO: 1011106 - DNA, 13 bp, Homo sapiens
ccgactccagcca

SEQ ID NO: 1011107 - DNA, 14 bp, Homo sapiens
ccgactccagccag

SEQ ID NO: 1011108 - DNA, 11 bp, Homo sapiens
ccgactccccc

SEQ ID NO: 1011109 - DNA, 19 bp, Homo sapiens
ccgactcccccaaccaagg

SEQ ID NO: 1011110 - DNA, 20 bp, Homo sapiens
ccgactgaaaatattgtttt

SEQ ID NO: 1011111 - DNA, 22 bp, Homo sapiens
ccgactgaccctgaggaggccg

SEQ ID NO: 1011112 - DNA, 12 bp, Homo sapiens
ccgactgcctgt

SEQ ID NO: 1011113 - DNA, 17 bp, Homo sapiens
ccgactgctttggacct

SEQ ID NO: 1011114 - DNA, 16 bp, Homo sapiens
ccgacttgctgttttg

SEQ ID NO: 1011115 - DNA, 17 bp, Homo sapiens
ccgacttggagactcct

SEQ ID NO: 1011116 - DNA, 13 bp, Homo sapiens
ccgagaagaacag

SEQ ID NO: 1011117 - DNA, 18 bp, Homo sapiens
ccgagacatgaatactat

SEQ ID NO: 1011118 - DNA, 19 bp, Homo sapiens
ccgagaggtgggccagtct

SEQ ID NO: 1011119 - DNA, 21 bp, Homo sapiens
ccgagagtagccgagagcctg

SEQ ID NO: 1011120 - DNA, 17 bp, Homo sapiens
ccgagataggggagggg

SEQ ID NO: 1011121 - DNA, 12 bp, Homo sapiens
ccgagattgcac

SEQ ID NO: 1011122 - DNA, 21 bp, Homo sapiens
ccgagattgcaccactgcact

SEQ ID NO: 1011123 - DNA, 22 bp, Homo sapiens
ccgagcacatagagctttttaa

SEQ ID NO: 1011124 - DNA, 19 bp, Homo sapiens
ccgagccgggcctggggct

SEQ ID NO: 1011125 - DNA, 14 bp, Homo sapiens
ccgagcctaatgaa

SEQ ID NO: 1011126 - DNA, 20 bp, Homo sapiens
ccgagctcctggggagctcc

SEQ ID NO: 1011127 - DNA, 19 bp, Homo sapiens
ccgagctcgtgtatcctgg

SEQ ID NO: 1011128 - DNA, 14 bp, Homo sapiens
ccgagctgcctggc

SEQ ID NO: 1011129 - DNA, 16 bp, Homo sapiens
ccgagctgggggccat

SEQ ID NO: 1011130 - DNA, 19 bp, Homo sapiens
ccgagctgggggccatgag

SEQ ID NO: 1011131 - DNA, 21 bp, Homo sapiens
ccgagctgggggccatgagct

SEQ ID NO: 1011132 - DNA, 13 bp, Homo sapiens
ccgagctgtcccc

SEQ ID NO: 1011133 - DNA, 23 bp, Homo sapiens
ccgaggaagctggacagcggcag

SEQ ID NO: 1011134 - DNA, 13 bp, Homo sapiens
ccgaggacccagg

SEQ ID NO: 1011135 - DNA, 12 bp, Homo sapiens
ccgaggactgga

SEQ ID NO: 1011136 - DNA, 20 bp, Homo sapiens
ccgaggcagggtcaggagag

SEQ ID NO: 1011137 - DNA, 11 bp, Homo sapiens
ccgaggccagt

SEQ ID NO: 1011138 - DNA, 15 bp, Homo sapiens
ccgaggcctgcgccc

SEQ ID NO: 1011139 - DNA, 12 bp, Homo sapiens
ccgaggctgaga

SEQ ID NO: 1011140 - DNA, 17 bp, Homo sapiens
ccgagggatggtgcccc

SEQ ID NO: 1011141 - DNA, 13 bp, Homo sapiens
ccgagggccaggc

SEQ ID NO: 1011142 - DNA, 17 bp, Homo sapiens
ccgagggcggccaggga

SEQ ID NO: 1011143 - DNA, 16 bp, Homo sapiens
ccgagggctgaggagc

SEQ ID NO: 1011144 - DNA, 16 bp, Homo sapiens
ccgaggggagggcagg

SEQ ID NO: 1011145 - DNA, 18 bp, Homo sapiens
ccgaggggctcaggaaaa

SEQ ID NO: 1011146 - DNA, 17 bp, Homo sapiens
ccgagggtcctggctcc

SEQ ID NO: 1011147 - DNA, 19 bp, Homo sapiens
ccgagggtcctggctcctg

SEQ ID NO: 1011148 - DNA, 19 bp, Homo sapiens
ccgaggtgagcggatcaca

SEQ ID NO: 1011149 - DNA, 20 bp, Homo sapiens
ccgaggttgtggggaggctg

SEQ ID NO: 1011150 - DNA, 13 bp, Homo sapiens
ccgagtacagtct

SEQ ID NO: 1011151 - DNA, 18 bp, Homo sapiens
ccgagtccgcccatccct

SEQ ID NO: 1011152 - DNA, 19 bp, Homo sapiens
ccgagtccgcccatccctg

SEQ ID NO: 1011153 - DNA, 23 bp, Homo sapiens
ccgagtccgcccatccctgacca

SEQ ID NO: 1011154 - DNA, 15 bp, Homo sapiens
ccgagtcctcaggta

SEQ ID NO: 1011155 - DNA, 17 bp, Homo sapiens
ccgagtcctcaggtaca

SEQ ID NO: 1011156 - DNA, 13 bp, Homo sapiens
ccgagtctgggac

SEQ ID NO: 1011157 - DNA, 15 bp, Homo sapiens
ccgccgtctgcaggg

SEQ ID NO: 1011158 - DNA, 22 bp, Homo sapiens
ccgcctccactctagttctaga

SEQ ID NO: 1011159 - DNA, 14 bp, Homo sapiens
ccgcctccctctca

SEQ ID NO: 1011160 - DNA, 20 bp, Homo sapiens
ccgcctcgtgccagcagcct

SEQ ID NO: 1011161 - DNA, 16 bp, Homo sapiens
ccgcctgaaagccaca

SEQ ID NO: 1011162 - DNA, 16 bp, Homo sapiens
ccgcctgaatcattct

SEQ ID NO: 1011163 - DNA, 14 bp, Homo sapiens
ccgcctgccctcat

SEQ ID NO: 1011164 - DNA, 12 bp, Homo sapiens
ccgcctgccctg

SEQ ID NO: 1011165 - DNA, 16 bp, Homo sapiens
ccgcctgccctgcctg

SEQ ID NO: 1011166 - DNA, 18 bp, Homo sapiens
ccgcctgccctgccttgc

SEQ ID NO: 1011167 - DNA, 21 bp, Homo sapiens
ccgcctgccgtgcatggctcc

SEQ ID NO: 1011168 - DNA, 15 bp, Homo sapiens
ccgcctgcctgccac

SEQ ID NO: 1011169 - DNA, 16 bp, Homo sapiens
ccgcctgctcctcact

SEQ ID NO: 1011170 - DNA, 22 bp, Homo sapiens
ccgcctggatgcggatggccgg

SEQ ID NO: 1011171 - DNA, 16 bp, Homo sapiens
ccgcctggccaggagc

SEQ ID NO: 1011172 - DNA, 20 bp, Homo sapiens
ccgcctggccaggagcaggc

SEQ ID NO: 1011173 - DNA, 14 bp, Homo sapiens
ccgcctggccctcc

SEQ ID NO: 1011174 - DNA, 14 bp, Homo sapiens
ccgcctggcctggc

SEQ ID NO: 1011175 - DNA, 17 bp, Homo sapiens
ccgcctgggcgactcca

SEQ ID NO: 1011176 - DNA, 14 bp, Homo sapiens
ccgcctggtactca

SEQ ID NO: 1011177 - DNA, 17 bp, Homo sapiens
ccgcctgtcacaataaa

SEQ ID NO: 1011178 - DNA, 21 bp, Homo sapiens
ccgcctgtgtccatctgaccg

SEQ ID NO: 1011179 - DNA, 16 bp, Homo sapiens
ccgccttccaaaacct

SEQ ID NO: 1011180 - DNA, 15 bp, Homo sapiens
ccgccttccctcact

SEQ ID NO: 1011181 - DNA, 14 bp, Homo sapiens
ccgccttcctcctc

SEQ ID NO: 1011182 - DNA, 16 bp, Homo sapiens
ccgccttcctcctcca

SEQ ID NO: 1011183 - DNA, 14 bp, Homo sapiens
ccgccttctcccct

SEQ ID NO: 1011184 - DNA, 23 bp, Homo sapiens
ccgccttgagtgacatgcggctg

SEQ ID NO: 1011185 - DNA, 17 bp, Homo sapiens
ccgcgccgatgccaccg

SEQ ID NO: 1011186 - DNA, 20 bp, Homo sapiens
ccgcgcgccggtccggcgcc

SEQ ID NO: 1011187 - DNA, 18 bp, Homo sapiens
ccgcgcgcgtccccctgc

SEQ ID NO: 1011188 - DNA, 14 bp, Homo sapiens
ccgcgcgtccagct

SEQ ID NO: 1011189 - DNA, 17 bp, Homo sapiens
ccgcgcgttccttcgca

SEQ ID NO: 1011190 - DNA, 21 bp, Homo sapiens
ccgcgctccgggctttcacgg

SEQ ID NO: 1011191 - DNA, 20 bp, Homo sapiens
ccgcgctcgcccagcaggag

SEQ ID NO: 1011192 - DNA, 18 bp, Homo sapiens
ccgcggacgtgctggcct

SEQ ID NO: 1011193 - DNA, 12 bp, Homo sapiens
ccgcggcccaga

SEQ ID NO: 1011194 - DNA, 16 bp, Homo sapiens
ccgcggcctgcaccga

SEQ ID NO: 1011195 - DNA, 17 bp, Homo sapiens
ccgcgggacagccaagc

SEQ ID NO: 1011196 - DNA, 15 bp, Homo sapiens
ccgcggtgctctggc

SEQ ID NO: 1011197 - DNA, 17 bp, Homo sapiens
ccgcgtcgccctcccag

SEQ ID NO: 1011198 - DNA, 19 bp, Homo sapiens
ccgcgtcgccctcccaggc

SEQ ID NO: 1011199 - DNA, 14 bp, Homo sapiens
ccgctaaaagaaac

SEQ ID NO: 1011200 - DNA, 12 bp, Homo sapiens
ccgctcagtgtc

SEQ ID NO: 1011201 - DNA, 13 bp, Homo sapiens
ccgctcccacagc

SEQ ID NO: 1011202 - DNA, 20 bp, Homo sapiens
ccgctcccaccgcccccacc

SEQ ID NO: 1011203 - DNA, 16 bp, Homo sapiens
gaggttgcagcatgag

SEQ ID NO: 1011204 - DNA, 19 bp, Homo sapiens
gaggttgcagtgagctgag

SEQ ID NO: 1011205 - DNA, 15 bp, Homo sapiens
gaggttgctgtacag

SEQ ID NO: 1011206 - DNA, 14 bp, Homo sapiens
gaggttggtgtgga

SEQ ID NO: 1011207 - DNA, 16 bp, Homo sapiens
gaggttggtgtggagt

SEQ ID NO: 1011208 - DNA, 14 bp, Homo sapiens
gaggttgtggatgc

SEQ ID NO: 1011209 - DNA, 16 bp, Homo sapiens
gaggttgtggggaggc

SEQ ID NO: 1011210 - DNA, 15 bp, Homo sapiens
gaggtttgcctgtga

SEQ ID NO: 1011211 - DNA, 17 bp, Homo sapiens
gaggtttggtttcctgt

SEQ ID NO: 1011212 - DNA, 19 bp, Homo sapiens
gaggttttaaaaaaatccc

SEQ ID NO: 1011213 - DNA, 18 bp, Homo sapiens
gaggttttattctgactt

SEQ ID NO: 1011214 - DNA, 16 bp, Homo sapiens
gaggttttatttcatt

SEQ ID NO: 1011215 - DNA, 13 bp, Homo sapiens
gaggttttgtatt

SEQ ID NO: 1011216 - DNA, 22 bp, Homo sapiens
gaggtttttaaatatatatttt

SEQ ID NO: 1011217 - DNA, 13 bp, Homo sapiens
gagtaaaaactag

SEQ ID NO: 1011218 - DNA, 16 bp, Homo sapiens
gagtaaactgaggccc

SEQ ID NO: 1011219 - DNA, 17 bp, Homo sapiens
gagtaaagctcctatct

SEQ ID NO: 1011220 - DNA, 16 bp, Homo sapiens
gagtaaatacaggtag

SEQ ID NO: 1011221 - DNA, 15 bp, Homo sapiens
gagtaacaatacaaa

SEQ ID NO: 1011222 - DNA, 13 bp, Homo sapiens
gagtaacagggca

SEQ ID NO: 1011223 - DNA, 13 bp, Homo sapiens
gagtaagcagtgt

SEQ ID NO: 1011224 - DNA, 14 bp, Homo sapiens
gagtaataggacca

SEQ ID NO: 1011225 - DNA, 14 bp, Homo sapiens
gagtaatcaggcag

SEQ ID NO: 1011226 - DNA, 15 bp, Homo sapiens
gagtaatcaggcagc

SEQ ID NO: 1011227 - DNA, 17 bp, Homo sapiens
gagtaatcaggcagcct

SEQ ID NO: 1011228 - DNA, 22 bp, Homo sapiens
gagtaatgggtttcatatttct

SEQ ID NO: 1011229 - DNA, 14 bp, Homo sapiens
gagtacaaaacaat

SEQ ID NO: 1011230 - DNA, 19 bp, Homo sapiens
gagtacaaggacagacagc

SEQ ID NO: 1011231 - DNA, 20 bp, Homo sapiens
gagtacaaggacagacagca

SEQ ID NO: 1011232 - DNA, 16 bp, Homo sapiens
gagtacagactgcaga

SEQ ID NO: 1011233 - DNA, 20 bp, Homo sapiens
gagtacagactgcagacatt

SEQ ID NO: 1011234 - DNA, 22 bp, Homo sapiens
gagtacctgctgccccagctga

SEQ ID NO: 1011235 - DNA, 15 bp, Homo sapiens
gagtacctggtcata

SEQ ID NO: 1011236 - DNA, 17 bp, Homo sapiens
gagtacgttgtgcattt

SEQ ID NO: 1011237 - DNA, 13 bp, Homo sapiens
gagtactgggaga

SEQ ID NO: 1011238 - DNA, 15 bp, Homo sapiens
gagtagaaaatgtga

SEQ ID NO: 1011239 - DNA, 14 bp, Homo sapiens
gagtagaattgcat

SEQ ID NO: 1011240 - DNA, 17 bp, Homo sapiens
gagtagaattgcattga

SEQ ID NO: 1011241 - DNA, 15 bp, Homo sapiens
gagtagacaaaagga

SEQ ID NO: 1011242 - DNA, 14 bp, Homo sapiens
gagtagagccaggt

SEQ ID NO: 1011243 - DNA, 21 bp, Homo sapiens
gagtagccagggtgtggccct

SEQ ID NO: 1011244 - DNA, 21 bp, Homo sapiens
gagtagccgagagcctgctcc

SEQ ID NO: 1011245 - DNA, 13 bp, Homo sapiens
gagtagctgggat

SEQ ID NO: 1011246 - DNA, 13 bp, Homo sapiens
gagtagctgggcc

SEQ ID NO: 1011247 - DNA, 14 bp, Homo sapiens
gagtagctgggcct

SEQ ID NO: 1011248 - DNA, 17 bp, Homo sapiens
gagtaggtctgggatgg

SEQ ID NO: 1011249 - DNA, 22 bp, Homo sapiens
gagtaggtctgggatggacagg

SEQ ID NO: 1011250 - DNA, 20 bp, Homo sapiens
gagtagttgatgttgcattt

SEQ ID NO: 1011251 - DNA, 17 bp, Homo sapiens
gagtagtttttcagcta

SEQ ID NO: 1011252 - DNA, 12 bp, Homo sapiens
gagtatatgcac

SEQ ID NO: 1011253 - DNA, 12 bp, Homo sapiens
gagtatctgtaa

SEQ ID NO: 1011254 - DNA, 19 bp, Homo sapiens
gagtatctgtaacccttga

SEQ ID NO: 1011255 - DNA, 14 bp, Homo sapiens
gagtatctgtggga

SEQ ID NO: 1011256 - DNA, 15 bp, Homo sapiens
gagtatctgtgggag

SEQ ID NO: 1011257 - DNA, 11 bp, Homo sapiens
gagtatgttgt

SEQ ID NO: 1011258 - DNA, 15 bp, Homo sapiens
gagtatgttgtcata

SEQ ID NO: 1011259 - DNA, 19 bp, Homo sapiens
gagtatgttgtcataacat

SEQ ID NO: 1011260 - DNA, 20 bp, Homo sapiens
gagtatgttgtcataacatt

SEQ ID NO: 1011261 - DNA, 18 bp, Homo sapiens
gagtattccatgagctgc

SEQ ID NO: 1011262 - DNA, 12 bp, Homo sapiens
gagtattttaag

SEQ ID NO: 1011263 - DNA, 21 bp, Homo sapiens
gagtatttttaaaaaatatgt

SEQ ID NO: 1011264 - DNA, 17 bp, Homo sapiens
gagtatttttaacactt

SEQ ID NO: 1011265 - DNA, 16 bp, Homo sapiens
gagtcaaaagcctggg

SEQ ID NO: 1011266 - DNA, 21 bp, Homo sapiens
gagtcaaatgggaaaaaaaca

SEQ ID NO: 1011267 - DNA, 15 bp, Homo sapiens
gagtcaactggctgg

SEQ ID NO: 1011268 - DNA, 15 bp, Homo sapiens
gagtcaatcagcctt

SEQ ID NO: 1011269 - DNA, 16 bp, Homo sapiens
gagtcaatcagccttt

SEQ ID NO: 1011270 - DNA, 17 bp, Homo sapiens
gagtcaatcagccttta

SEQ ID NO: 1011271 - DNA, 19 bp, Homo sapiens
gagtcaatcccctcattca

SEQ ID NO: 1011272 - DNA, 12 bp, Homo sapiens
gagtcacacagt

SEQ ID NO: 1011273 - DNA, 17 bp, Homo sapiens
gagtcacaggtgtggga

SEQ ID NO: 1011274 - DNA, 19 bp, Homo sapiens
gagtcacaggtgtgggatg

SEQ ID NO: 1011275 - DNA, 14 bp, Homo sapiens
gagtcacattctgc

SEQ ID NO: 1011276 - DNA, 21 bp, Homo sapiens
gagtcacattctgcttaaagt

SEQ ID NO: 1011277 - DNA, 14 bp, Homo sapiens
gagtcaccaggaat

SEQ ID NO: 1011278 - DNA, 13 bp, Homo sapiens
gagtcacctcctc

SEQ ID NO: 1011279 - DNA, 14 bp, Homo sapiens
gagtcacctcctcc

SEQ ID NO: 1011280 - DNA, 15 bp, Homo sapiens
gagtcacctcctcca

SEQ ID NO: 1011281 - DNA, 11 bp, Homo sapiens
ccgggggctgc

SEQ ID NO: 1011282 - DNA, 16 bp, Homo sapiens
ccgggggctgctgggc

SEQ ID NO: 1011283 - DNA, 15 bp, Homo sapiens
ccggggggaggggac

SEQ ID NO: 1011284 - DNA, 17 bp, Homo sapiens
ccggggggaggggacag

SEQ ID NO: 1011285 - DNA, 16 bp, Homo sapiens
ccggggggctgggaca

SEQ ID NO: 1011286 - DNA, 18 bp, Homo sapiens
ccggggggggtaggagag

SEQ ID NO: 1011287 - DNA, 22 bp, Homo sapiens
ccggggggggtaggagaggaga

SEQ ID NO: 1011288 - DNA, 14 bp, Homo sapiens
ccggggtctcctgg

SEQ ID NO: 1011289 - DNA, 17 bp, Homo sapiens
ccggggtctcctggacc

SEQ ID NO: 1011290 - DNA, 13 bp, Homo sapiens
ccggggtctgtgc

SEQ ID NO: 1011291 - DNA, 15 bp, Homo sapiens
ccggggtctgtgctg

SEQ ID NO: 1011292 - DNA, 23 bp, Homo sapiens
ccggggtctgtgctgtgcctgct

SEQ ID NO: 1011293 - DNA, 21 bp, Homo sapiens
ccggggtggccacagcgccag

SEQ ID NO: 1011294 - DNA, 14 bp, Homo sapiens
ccggggtggggtgc

SEQ ID NO: 1011295 - DNA, 23 bp, Homo sapiens
ccggggtgggtgggtgggcaggg

SEQ ID NO: 1011296 - DNA, 17 bp, Homo sapiens
ccggggtgtaacttcct

SEQ ID NO: 1011297 - DNA, 21 bp, Homo sapiens
ccggggtgtaacttcctgctg

SEQ ID NO: 1011298 - DNA, 23 bp, Homo sapiens
ccggggtgtaacttcctgctgca

SEQ ID NO: 1011299 - DNA, 20 bp, Homo sapiens
ccggggttccccacacaggg

SEQ ID NO: 1011300 - DNA, 15 bp, Homo sapiens
ccgggtcactgctgt

SEQ ID NO: 1011301 - DNA, 13 bp, Homo sapiens
ccgggtcctccta

SEQ ID NO: 1011302 - DNA, 17 bp, Homo sapiens
ccgggtctcgcagcctg

SEQ ID NO: 1011303 - DNA, 23 bp, Homo sapiens
ccgggtctcgcagcctgaagcct

SEQ ID NO: 1011304 - DNA, 21 bp, Homo sapiens
ccgggtgcctcagagcaggct

SEQ ID NO: 1011305 - DNA, 13 bp, Homo sapiens
ccgggtgggcctg

SEQ ID NO: 1011306 - DNA, 20 bp, Homo sapiens
ccgggtgtgcctgccctgga

SEQ ID NO: 1011307 - DNA, 16 bp, Homo sapiens
ccgggtgtggcctcag

SEQ ID NO: 1011308 - DNA, 17 bp, Homo sapiens
ccgggtgtggcctcagc

SEQ ID NO: 1011309 - DNA, 17 bp, Homo sapiens
ccgggttctagtctcct

SEQ ID NO: 1011310 - DNA, 20 bp, Homo sapiens
ccgggttctagtctcctttg

SEQ ID NO: 1011311 - DNA, 19 bp, Homo sapiens
ccgggtttggcgggccaag

SEQ ID NO: 1011312 - DNA, 17 bp, Homo sapiens
ccgggtttggctgagcc

SEQ ID NO: 1011313 - DNA, 16 bp, Homo sapiens
ccggtaactgtcctgt

SEQ ID NO: 1011314 - DNA, 16 bp, Homo sapiens
ccggtcacccaggctc

SEQ ID NO: 1011315 - DNA, 20 bp, Homo sapiens
ccggtcagaggagcgcaggc

SEQ ID NO: 1011316 - DNA, 14 bp, Homo sapiens
ccggtcagcccctg

SEQ ID NO: 1011317 - DNA, 15 bp, Homo sapiens
ccggtcagtgccttt

SEQ ID NO: 1011318 - DNA, 20 bp, Homo sapiens
ccggtcagtgccttttggaa

SEQ ID NO: 1011319 - DNA, 15 bp, Homo sapiens
ccggtcatttgaatg

SEQ ID NO: 1011320 - DNA, 20 bp, Homo sapiens
ccggtccccacagactgccc

SEQ ID NO: 1011321 - DNA, 12 bp, Homo sapiens
ccggtcccctgc

SEQ ID NO: 1011322 - DNA, 15 bp, Homo sapiens
ccggtcccttccatg

SEQ ID NO: 1011323 - DNA, 19 bp, Homo sapiens
ccggtcccttccatgccct

SEQ ID NO: 1011324 - DNA, 20 bp, Homo sapiens
ccggtcccttgagacctcag

SEQ ID NO: 1011325 - DNA, 18 bp, Homo sapiens
ccggtcgggcagccagca

SEQ ID NO: 1011326 - DNA, 21 bp, Homo sapiens
ccggtcgggcagccagcagag

SEQ ID NO: 1011327 - DNA, 23 bp, Homo sapiens
ccggtctatgtcgagagctggcc

SEQ ID NO: 1011328 - DNA, 14 bp, Homo sapiens
ccggtgaggggagg

SEQ ID NO: 1011329 - DNA, 14 bp, Homo sapiens
ccggtgctgcagga

SEQ ID NO: 1011330 - DNA, 15 bp, Homo sapiens
ccggtgctgggggca

SEQ ID NO: 1011331 - DNA, 24 bp, Homo sapiens
ccggtgcttccaacaaggacagcc

SEQ ID NO: 1011332 - DNA, 19 bp, Homo sapiens
ccggtgtatcctggccctg

SEQ ID NO: 1011333 - DNA, 20 bp, Homo sapiens
ccggtgtatcctggccctgg

SEQ ID NO: 1011334 - DNA, 22 bp, Homo sapiens
gagtccctcacgtttcttcccc

SEQ ID NO: 1011335 - DNA, 11 bp, Homo sapiens
gagtccctgct

SEQ ID NO: 1011336 - DNA, 14 bp, Homo sapiens
gagtccctttgaag

SEQ ID NO: 1011337 - DNA, 17 bp, Homo sapiens
gagtccggaggcagcag

SEQ ID NO: 1011338 - DNA, 13 bp, Homo sapiens
gagtcctctccag

SEQ ID NO: 1011339 - DNA, 22 bp, Homo sapiens
gagtcctgaagatcaagccagt

SEQ ID NO: 1011340 - DNA, 19 bp, Homo sapiens
gagtcctggatgatactaa

SEQ ID NO: 1011341 - DNA, 13 bp, Homo sapiens
gagtcctgtctct

SEQ ID NO: 1011342 - DNA, 17 bp, Homo sapiens
gagtcctgtctctgcct

SEQ ID NO: 1011343 - DNA, 20 bp, Homo sapiens
gagtccttacctcggggaga

SEQ ID NO: 1011344 - DNA, 22 bp, Homo sapiens
gagtccttacctcggggagagg

SEQ ID NO: 1011345 - DNA, 17 bp, Homo sapiens
gagtcgtacagaaagct

SEQ ID NO: 1011346 - DNA, 21 bp, Homo sapiens
gagtcgtggggtgtgctggga

SEQ ID NO: 1011347 - DNA, 22 bp, Homo sapiens
gagtcgtggggtgtgctgggag

SEQ ID NO: 1011348 - DNA, 18 bp, Homo sapiens
gagtctaatagtctttgc

SEQ ID NO: 1011349 - DNA, 23 bp, Homo sapiens
gagtctagatacagaagcccatg

SEQ ID NO: 1011350 - DNA, 17 bp, Homo sapiens
gagtctatgttcaaaga

SEQ ID NO: 1011351 - DNA, 21 bp, Homo sapiens
gagtctccctccgactccaga

SEQ ID NO: 1011352 - DNA, 12 bp, Homo sapiens
gagtctcctgtg

SEQ ID NO: 1011353 - DNA, 18 bp, Homo sapiens
gagtctctgccacccact

SEQ ID NO: 1011354 - DNA, 12 bp, Homo sapiens
gagtctcttctc

SEQ ID NO: 1011355 - DNA, 15 bp, Homo sapiens
gagtctcttctccac

SEQ ID NO: 1011356 - DNA, 17 bp, Homo sapiens
gagtctcttctccactg

SEQ ID NO: 1011357 - DNA, 22 bp, Homo sapiens
gagtctgaaagacagaatgtca

SEQ ID NO: 1011358 - DNA, 12 bp, Homo sapiens
gagtctgagccc

SEQ ID NO: 1011359 - DNA, 13 bp, Homo sapiens
gagtctgagtcct

SEQ ID NO: 1011360 - DNA, 12 bp, Homo sapiens
gagtctgccact

SEQ ID NO: 1011361 - DNA, 16 bp, Homo sapiens
gagtctggacctccat

SEQ ID NO: 1011362 - DNA, 13 bp, Homo sapiens
gagtctgggcctc

SEQ ID NO: 1011363 - DNA, 14 bp, Homo sapiens
gagtctgggcctct

SEQ ID NO: 1011364 - DNA, 21 bp, Homo sapiens
gagtctggggacctggcactg

SEQ ID NO: 1011365 - DNA, 15 bp, Homo sapiens
gagtctggtggagga

SEQ ID NO: 1011366 - DNA, 18 bp, Homo sapiens
gagtcttaactgtatttc

SEQ ID NO: 1011367 - DNA, 15 bp, Homo sapiens
gagtcttcagaccca

SEQ ID NO: 1011368 - DNA, 16 bp, Homo sapiens
gagtcttcagacccag

SEQ ID NO: 1011369 - DNA, 22 bp, Homo sapiens
gagtcttccaaggccagaagga

SEQ ID NO: 1011370 - DNA, 20 bp, Homo sapiens
gagtcttgctctgtctccca

SEQ ID NO: 1011371 - DNA, 20 bp, Homo sapiens
gagtcttggcggcagcagcc

SEQ ID NO: 1011372 - DNA, 21 bp, Homo sapiens
gagtcttggcggcagcagcca

SEQ ID NO: 1011373 - DNA, 20 bp, Homo sapiens
gagtcttggtctgttgccca

SEQ ID NO: 1011374 - DNA, 13 bp, Homo sapiens
gagtcttggttct

SEQ ID NO: 1011375 - DNA, 22 bp, Homo sapiens
gagtcttggtttctctctacag

SEQ ID NO: 1011376 - DNA, 19 bp, Homo sapiens
gagtctttcattcggtgtg

SEQ ID NO: 1011377 - DNA, 23 bp, Homo sapiens
gagtctttcattcggtgtgaact

SEQ ID NO: 1011378 - DNA, 13 bp, Homo sapiens
gagtgaaacagag

SEQ ID NO: 1011379 - DNA, 18 bp, Homo sapiens
gagtgaaacagagaaaga

SEQ ID NO: 1011380 - DNA, 22 bp, Homo sapiens
gagtgaaaccatgactgtgacc

SEQ ID NO: 1011381 - DNA, 18 bp, Homo sapiens
gagtgaaagggctatggc

SEQ ID NO: 1011382 - DNA, 15 bp, Homo sapiens
gagtgaagaggggca

SEQ ID NO: 1011383 - DNA, 19 bp, Homo sapiens
gagtgaagaggggcagccc

SEQ ID NO: 1011384 - DNA, 15 bp, Homo sapiens
gagtgaagccacaga

SEQ ID NO: 1011385 - DNA, 14 bp, Homo sapiens
gagtgaatttcagt

SEQ ID NO: 1011386 - DNA, 16 bp, Homo sapiens
gagtgacagctttctg

SEQ ID NO: 1011387 - DNA, 19 bp, Homo sapiens
gagtgacagctttctggga

SEQ ID NO: 1011388 - DNA, 20 bp, Homo sapiens
gagtgacatagcctcatgtt

SEQ ID NO: 1011389 - DNA, 13 bp, Homo sapiens
gagtgacatgaag

SEQ ID NO: 1011390 - DNA, 15 bp, Homo sapiens
gagtgacatgaagca

SEQ ID NO: 1011391 - DNA, 20 bp, Homo sapiens
gagtgacatgcggctgccca

SEQ ID NO: 1011392 - DNA, 14 bp, Homo sapiens
gagtgacccagcta

SEQ ID NO: 1011393 - DNA, 16 bp, Homo sapiens
gagtgactacacacag

SEQ ID NO: 1011394 - DNA, 21 bp, Homo sapiens
gagtgactgtaggcagggaac

SEQ ID NO: 1011395 - DNA, 14 bp, Homo sapiens
gagtgagagccttt

SEQ ID NO: 1011396 - DNA, 17 bp, Homo sapiens
gagtgagcaagggggcc

SEQ ID NO: 1011397 - DNA, 15 bp, Homo sapiens
gagtgagcagctact

SEQ ID NO: 1011398 - DNA, 16 bp, Homo sapiens
gagtgagggcctcaga

SEQ ID NO: 1011399 - DNA, 11 bp, Homo sapiens
gagtgaggggt

SEQ ID NO: 1011400 - DNA, 15 bp, Homo sapiens
gagtgagtcacctgc

SEQ ID NO: 1011401 - DNA, 20 bp, Homo sapiens
gagtgagtcacctgctccag

SEQ ID NO: 1011402 - DNA, 21 bp, Homo sapiens
gagtgagtcacctgctccaga

SEQ ID NO: 1011403 - DNA, 22 bp, Homo sapiens
gagttatgatgtaatctctctg

SEQ ID NO: 1011404 - DNA, 16 bp, Homo sapiens
gagttattcaaatgaa

SEQ ID NO: 1011405 - DNA, 21 bp, Homo sapiens
gagttattgaatcttaatttt

SEQ ID NO: 1011406 - DNA, 17 bp, Homo sapiens
gagttattttttgtatt

SEQ ID NO: 1011407 - DNA, 15 bp, Homo sapiens
gagttcagctgcttc

SEQ ID NO: 1011408 - DNA, 15 bp, Homo sapiens
gagttccagttgaag

SEQ ID NO: 1011409 - DNA, 15 bp, Homo sapiens
gagttcccaagaaag

SEQ ID NO: 1011410 - DNA, 14 bp, Homo sapiens
gagttccggcctgg

SEQ ID NO: 1011411 - DNA, 16 bp, Homo sapiens
gagttcctctgcagtt

SEQ ID NO: 1011412 - DNA, 16 bp, Homo sapiens
gagttcctgctccgtg

SEQ ID NO: 1011413 - DNA, 19 bp, Homo sapiens
gagttcgtaccgcttcctt

SEQ ID NO: 1011414 - DNA, 22 bp, Homo sapiens
gagttctccctgtacagtgtta

SEQ ID NO: 1011415 - DNA, 12 bp, Homo sapiens
gagttctctgat

SEQ ID NO: 1011416 - DNA, 18 bp, Homo sapiens
gagttctcttccgcagcc

SEQ ID NO: 1011417 - DNA, 23 bp, Homo sapiens
gagttctgattgtgttgaagaag

SEQ ID NO: 1011418 - DNA, 14 bp, Homo sapiens
gagttctgtgaaga

SEQ ID NO: 1011419 - DNA, 21 bp, Homo sapiens
gagttctgtgtattttcagtc

SEQ ID NO: 1011420 - DNA, 22 bp, Homo sapiens
gagttcttagctatccttggct

SEQ ID NO: 1011421 - DNA, 21 bp, Homo sapiens
gagttcttcctgtaatcttgt

SEQ ID NO: 1011422 - DNA, 16 bp, Homo sapiens
gagttctttgctgccc

SEQ ID NO: 1011423 - DNA, 22 bp, Homo sapiens
gagttgaggtctttctcctcag

SEQ ID NO: 1011424 - DNA, 23 bp, Homo sapiens
gagttgaggtctttctcctcagg

SEQ ID NO: 1011425 - DNA, 17 bp, Homo sapiens
gagttgattcagctctg

SEQ ID NO: 1011426 - DNA, 16 bp, Homo sapiens
gagttgcatatccaaa

SEQ ID NO: 1011427 - DNA, 23 bp, Homo sapiens
gagttgcctgactcctgggtggg

SEQ ID NO: 1011428 - DNA, 15 bp, Homo sapiens
gagttgctttgccag

SEQ ID NO: 1011429 - DNA, 17 bp, Homo sapiens
gagttgctttgccagag

SEQ ID NO: 1011430 - DNA, 18 bp, Homo sapiens
gagttgctttgccagagc

SEQ ID NO: 1011431 - DNA, 20 bp, Homo sapiens
gagttgctttgccagagcag

SEQ ID NO: 1011432 - DNA, 17 bp, Homo sapiens
gagttggagttttattt

SEQ ID NO: 1011433 - DNA, 22 bp, Homo sapiens
gagttggccagattgtggggtg

SEQ ID NO: 1011434 - DNA, 14 bp, Homo sapiens
gagttggctcaggc

SEQ ID NO: 1011435 - DNA, 17 bp, Homo sapiens
gagttggctcaggcaga

SEQ ID NO: 1011436 - DNA, 18 bp, Homo sapiens
gagttggctcaggcagac

SEQ ID NO: 1011437 - DNA, 12 bp, Homo sapiens
gagttggctgtg

SEQ ID NO: 1011438 - DNA, 17 bp, Homo sapiens
gagttgggcagccagga

SEQ ID NO: 1011439 - DNA, 20 bp, Homo sapiens
gagttgtggaaagcctctgc

SEQ ID NO: 1011440 - DNA, 16 bp, Homo sapiens
gagttgttttcagact

SEQ ID NO: 1011441 - DNA, 21 bp, Homo sapiens
gagtttaaaaatggtatcaaa

SEQ ID NO: 1011442 - DNA, 11 bp, Homo sapiens
gagtttacagt

SEQ ID NO: 1011443 - DNA, 23 bp, Homo sapiens
gagtttacagtttgtgttttaaa

SEQ ID NO: 1011444 - DNA, 22 bp, Homo sapiens
gagtttagggaacaatttggca

SEQ ID NO: 1011445 - DNA, 15 bp, Homo sapiens
gagtttatccatcct

SEQ ID NO: 1011446 - DNA, 15 bp, Homo sapiens
gagtttattctgatt

SEQ ID NO: 1011447 - DNA, 21 bp, Homo sapiens
gagtttcactgtactgcatgt

SEQ ID NO: 1011448 - DNA, 18 bp, Homo sapiens
gagtttcattctcctgcc

SEQ ID NO: 1011449 - DNA, 12 bp, Homo sapiens
gagtttctgttt

SEQ ID NO: 1011450 - DNA, 14 bp, Homo sapiens
gagtttctgtttga

SEQ ID NO: 1011451 - DNA, 20 bp, Homo sapiens
gagtttgagacaagccctgg

SEQ ID NO: 1011452 - DNA, 17 bp, Homo sapiens
gagtttgcaatgtcaca

SEQ ID NO: 1011453 - DNA, 21 bp, Homo sapiens
gagtttgtaaaattgttcctg

SEQ ID NO: 1011454 - DNA, 13 bp, Homo sapiens
gagtttgtaaata

SEQ ID NO: 1011455 - DNA, 15 bp, Homo sapiens
gagttttactgcctg

SEQ ID NO: 1011456 - DNA, 18 bp, Homo sapiens
gagttttgatttggtgga

SEQ ID NO: 1011457 - DNA, 15 bp, Homo sapiens
gagttttgtctgtct

SEQ ID NO: 1011458 - DNA, 13 bp, Homo sapiens
gagttttgtgttt

SEQ ID NO: 1011459 - DNA, 19 bp, Homo sapiens
gagtttttatggggctgaa

SEQ ID NO: 1011460 - DNA, 14 bp, Homo sapiens
gagtttttcctccc

SEQ ID NO: 1011461 - DNA, 20 bp, Homo sapiens
gagtttttcctcccagtgag

SEQ ID NO: 1011462 - DNA, 19 bp, Homo sapiens
gagtttttttctgtttata

SEQ ID NO: 1011463 - DNA, 13 bp, Homo sapiens
ccgtgtgcctggg

SEQ ID NO: 1011464 - DNA, 13 bp, Homo sapiens
ccgtgtggacaca

SEQ ID NO: 1011465 - DNA, 23 bp, Homo sapiens
ccgtgtgggctttaaaagaaaaa

SEQ ID NO: 1011466 - DNA, 21 bp, Homo sapiens
ccgtgtggtaccttcagccct

SEQ ID NO: 1011467 - DNA, 15 bp, Homo sapiens
ccgtgtgtatttcta

SEQ ID NO: 1011468 - DNA, 16 bp, Homo sapiens
ccgtgtgtatttctaa

SEQ ID NO: 1011469 - DNA, 14 bp, Homo sapiens
ccgtgttcaggaca

SEQ ID NO: 1011470 - DNA, 21 bp, Homo sapiens
ccgtgttgcaggttcatggat

SEQ ID NO: 1011471 - DNA, 15 bp, Homo sapiens
ccgttaacctttttg

SEQ ID NO: 1011472 - DNA, 14 bp, Homo sapiens
ccgttagctcctgt

SEQ ID NO: 1011473 - DNA, 17 bp, Homo sapiens
ccgttagctcctgtggc

SEQ ID NO: 1011474 - DNA, 14 bp, Homo sapiens
ccgttcacatgtgt

SEQ ID NO: 1011475 - DNA, 20 bp, Homo sapiens
ccgttcagtgtcccaggcag

SEQ ID NO: 1011476 - DNA, 17 bp, Homo sapiens
ccgttccaccccaagag

SEQ ID NO: 1011477 - DNA, 18 bp, Homo sapiens
ccgttccaccccaagaga

SEQ ID NO: 1011478 - DNA, 20 bp, Homo sapiens
ccgttccaccccaagagaac

SEQ ID NO: 1011479 - DNA, 21 bp, Homo sapiens
ccgttccaccccaagagaact

SEQ ID NO: 1011480 - DNA, 14 bp, Homo sapiens
ccgttccctgtcag

SEQ ID NO: 1011481 - DNA, 15 bp, Homo sapiens
ccgttccctgtcaga

SEQ ID NO: 1011482 - DNA, 12 bp, Homo sapiens
ccgttcctggca

SEQ ID NO: 1011483 - DNA, 18 bp, Homo sapiens
ccgttctgctggcctgga

SEQ ID NO: 1011484 - DNA, 13 bp, Homo sapiens
ccgttgaccagat

SEQ ID NO: 1011485 - DNA, 14 bp, Homo sapiens
ccgttgctgaaaat

SEQ ID NO: 1011486 - DNA, 15 bp, Homo sapiens
ccgttgtgagctgga

SEQ ID NO: 1011487 - DNA, 19 bp, Homo sapiens
ccgtttatgggccttgctt

SEQ ID NO: 1011488 - DNA, 23 bp, Homo sapiens
ccgtttcatttagtcatgtgacc

SEQ ID NO: 1011489 - DNA, 13 bp, Homo sapiens
ccgtttgcttttg

SEQ ID NO: 1011490 - DNA, 14 bp, Homo sapiens
ccgttttcatcctg

SEQ ID NO: 1011491 - DNA, 19 bp, Homo sapiens
ccgttttcatcctggcctc

SEQ ID NO: 1011492 - DNA, 21 bp, Homo sapiens
ccgttttcatcctggcctcct

SEQ ID NO: 1011493 - DNA, 16 bp, Homo sapiens
ccgttttcctcatcct

SEQ ID NO: 1011494 - DNA, 19 bp, Homo sapiens
ccgttttgtcactttttct

SEQ ID NO: 1011495 - DNA, 12 bp, Homo sapiens
cctaaaaaagat

SEQ ID NO: 1011496 - DNA, 21 bp, Homo sapiens
cctaaaaacatttactgacca

SEQ ID NO: 1011497 - DNA, 17 bp, Homo sapiens
cctaaaaattcccttcc

SEQ ID NO: 1011498 - DNA, 20 bp, Homo sapiens
cctaaaaattcccttcctgt

SEQ ID NO: 1011499 - DNA, 12 bp, Homo sapiens
cctaaaacaaat

SEQ ID NO: 1011500 - DNA, 23 bp, Homo sapiens
cctaaaacgaatggtctttgctc

SEQ ID NO: 1011501 - DNA, 17 bp, Homo sapiens
cctaaaacttggatgga

SEQ ID NO: 1011502 - DNA, 20 bp, Homo sapiens
cctaaaagagatctgggcat

SEQ ID NO: 1011503 - DNA, 22 bp, Homo sapiens
cctaaaaggaaatctcacccca

SEQ ID NO: 1011504 - DNA, 14 bp, Homo sapiens
cctaaaagtaaaca

SEQ ID NO: 1011505 - DNA, 16 bp, Homo sapiens
cctaaaattatggaaa

SEQ ID NO: 1011506 - DNA, 12 bp, Homo sapiens
cctaaacataat

SEQ ID NO: 1011507 - DNA, 14 bp, Homo sapiens
cctaaacccaatga

SEQ ID NO: 1011508 - DNA, 13 bp, Homo sapiens
cctaaacctcagt

SEQ ID NO: 1011509 - DNA, 11 bp, Homo sapiens
cctaaactgta

SEQ ID NO: 1011510 - DNA, 20 bp, Homo sapiens
cctaaagaaaaatatcttgg

SEQ ID NO: 1011511 - DNA, 19 bp, Homo sapiens
cctaaagcaaatctgccac

SEQ ID NO: 1011512 - DNA, 11 bp, Homo sapiens
cctaaagccaa

SEQ ID NO: 1011513 - DNA, 18 bp, Homo sapiens
cctaaagggcagggccca

SEQ ID NO: 1011514 - DNA, 22 bp, Homo sapiens
cctaaaggttatagtagaacaa

SEQ ID NO: 1011515 - DNA, 14 bp, Homo sapiens
cctaaatatccaaa

SEQ ID NO: 1011516 - DNA, 21 bp, Homo sapiens
cctaaatccactctgcaggaa

SEQ ID NO: 1011517 - DNA, 12 bp, Homo sapiens
cctaaatgatgg

SEQ ID NO: 1011518 - DNA, 14 bp, Homo sapiens
cctaaatggcctca

SEQ ID NO: 1011519 - DNA, 16 bp, Homo sapiens
cctaaatttaatgctg

SEQ ID NO: 1011520 - DNA, 20 bp, Homo sapiens
cctaaatttaatgctgcctt

SEQ ID NO: 1011521 - DNA, 22 bp, Homo sapiens
cctaacaacattgtagcctcaa

SEQ ID NO: 1011522 - DNA, 15 bp, Homo sapiens
cctaacccccagtcc

SEQ ID NO: 1011523 - DNA, 23 bp, Homo sapiens
cctaactagaattagtatgtctg

SEQ ID NO: 1011524 - DNA, 13 bp, Homo sapiens
cctaacttctgta

SEQ ID NO: 1011525 - DNA, 17 bp, Homo sapiens
gataatatgagaatcag

SEQ ID NO: 1011526 - DNA, 14 bp, Homo sapiens
gataatatgtttag

SEQ ID NO: 1011527 - DNA, 21 bp, Homo sapiens
gataatattttacatacactg

SEQ ID NO: 1011528 - DNA, 13 bp, Homo sapiens
gataatcagcctc

SEQ ID NO: 1011529 - DNA, 14 bp, Homo sapiens
gataatcaggaaaa

SEQ ID NO: 1011530 - DNA, 13 bp, Homo sapiens
gataatcttcagg

SEQ ID NO: 1011531 - DNA, 23 bp, Homo sapiens
gataatgaaataatcagtgactg

SEQ ID NO: 1011532 - DNA, 13 bp, Homo sapiens
gataatgaacaga

SEQ ID NO: 1011533 - DNA, 19 bp, Homo sapiens
gataattacgtttaaagtg

SEQ ID NO: 1011534 - DNA, 14 bp, Homo sapiens
gataattataatat

SEQ ID NO: 1011535 - DNA, 13 bp, Homo sapiens
gataattcatttg

SEQ ID NO: 1011536 - DNA, 22 bp, Homo sapiens
gataattcatttgtattgctta

SEQ ID NO: 1011537 - DNA, 16 bp, Homo sapiens
gataattgctatttat

SEQ ID NO: 1011538 - DNA, 22 bp, Homo sapiens
gataattgctatttatttttac

SEQ ID NO: 1011539 - DNA, 16 bp, Homo sapiens
gataatttaaaatcca

SEQ ID NO: 1011540 - DNA, 14 bp, Homo sapiens
gataatttatcata

SEQ ID NO: 1011541 - DNA, 13 bp, Homo sapiens
gataatttcaggg

SEQ ID NO: 1011542 - DNA, 12 bp, Homo sapiens
gataatttgcat

SEQ ID NO: 1011543 - DNA, 21 bp, Homo sapiens
gataatttgcatattctattg

SEQ ID NO: 1011544 - DNA, 22 bp, Homo sapiens
gataatttgcatattctattgt

SEQ ID NO: 1011545 - DNA, 21 bp, Homo sapiens
gataattttatttataaacta

SEQ ID NO: 1011546 - DNA, 16 bp, Homo sapiens
gatacaaaagcatgtg

SEQ ID NO: 1011547 - DNA, 17 bp, Homo sapiens
gatacaaaagcatgtga

SEQ ID NO: 1011548 - DNA, 15 bp, Homo sapiens
gatacaaaccactgt

SEQ ID NO: 1011549 - DNA, 20 bp, Homo sapiens
gatacaaaccactgtgaaca

SEQ ID NO: 1011550 - DNA, 20 bp, Homo sapiens
gatacaacttcaagtgcatg

SEQ ID NO: 1011551 - DNA, 12 bp, Homo sapiens
gatacaataaat

SEQ ID NO: 1011552 - DNA, 13 bp, Homo sapiens
gatacaatgctgt

SEQ ID NO: 1011553 - DNA, 13 bp, Homo sapiens
gatacacacacac

SEQ ID NO: 1011554 - DNA, 21 bp, Homo sapiens
gatacacccaaagtatcagga

SEQ ID NO: 1011555 - DNA, 18 bp, Homo sapiens
gatacactcaagcatgaa

SEQ ID NO: 1011556 - DNA, 17 bp, Homo sapiens
gatacactgcactttgt

SEQ ID NO: 1011557 - DNA, 19 bp, Homo sapiens
gatacagtccctaaagaaa

SEQ ID NO: 1011558 - DNA, 14 bp, Homo sapiens
gatacagtgcccac

SEQ ID NO: 1011559 - DNA, 21 bp, Homo sapiens
gatacagtgcccaccgccctc

SEQ ID NO: 1011560 - DNA, 16 bp, Homo sapiens
gatacagttactcaga

SEQ ID NO: 1011561 - DNA, 14 bp, Homo sapiens
gatacataataaaa

SEQ ID NO: 1011562 - DNA, 21 bp, Homo sapiens
gatacatacaccagcattcct

SEQ ID NO: 1011563 - DNA, 18 bp, Homo sapiens
gatacatatgagtgtgga

SEQ ID NO: 1011564 - DNA, 13 bp, Homo sapiens
gatacatcactgc

SEQ ID NO: 1011565 - DNA, 21 bp, Homo sapiens
gatacatccaaagcagacagc

SEQ ID NO: 1011566 - DNA, 11 bp, Homo sapiens
gatacatctgc

SEQ ID NO: 1011567 - DNA, 13 bp, Homo sapiens
gatacatctgctg

SEQ ID NO: 1011568 - DNA, 15 bp, Homo sapiens
gatacatctgctgtg

SEQ ID NO: 1011569 - DNA, 12 bp, Homo sapiens
gatacatgtgcc

SEQ ID NO: 1011570 - DNA, 12 bp, Homo sapiens
gatacatttaat

SEQ ID NO: 1011571 - DNA, 13 bp, Homo sapiens
gatacatttctga

SEQ ID NO: 1011572 - DNA, 13 bp, Homo sapiens
gatacatttttat

SEQ ID NO: 1011573 - DNA, 20 bp, Homo sapiens
gataccacaaaccctgctga

SEQ ID NO: 1011574 - DNA, 18 bp, Homo sapiens
gataccacctttactgtg

SEQ ID NO: 1011575 - DNA, 17 bp, Homo sapiens
gataccaggttgaaaga

SEQ ID NO: 1011576 - DNA, 20 bp, Homo sapiens
gatacccatagcttccatga

SEQ ID NO: 1011577 - DNA, 19 bp, Homo sapiens
gatacctcatcatccaccc

SEQ ID NO: 1011578 - DNA, 18 bp, Homo sapiens
gatacctccaaccctgcc

SEQ ID NO: 1011579 - DNA, 20 bp, Homo sapiens
gatacctccaaccctgccgt

SEQ ID NO: 1011580 - DNA, 20 bp, Homo sapiens
gataccttcttatttaatct

SEQ ID NO: 1011581 - DNA, 16 bp, Homo sapiens
gatacgacagtacact

SEQ ID NO: 1011582 - DNA, 17 bp, Homo sapiens
gatacgacagtacactg

SEQ ID NO: 1011583 - DNA, 21 bp, Homo sapiens
gatactgacagaagttatttc

SEQ ID NO: 1011584 - DNA, 23 bp, Homo sapiens
gatactgcgactttctgcctgga

SEQ ID NO: 1011585 - DNA, 20 bp, Homo sapiens
gatactggaagttttgcatt

SEQ ID NO: 1011586 - DNA, 16 bp, Homo sapiens
gatactggcacagagg

SEQ ID NO: 1011587 - DNA, 16 bp, Homo sapiens
gatactgtaacacttt

SEQ ID NO: 1011588 - DNA, 22 bp, Homo sapiens
gatactgtaacactttacaatg

SEQ ID NO: 1011589 - DNA, 17 bp, Homo sapiens
gatactgtatcatgaca

SEQ ID NO: 1011590 - DNA, 21 bp, Homo sapiens
gatactgtatcatgacaaaga

SEQ ID NO: 1011591 - DNA, 13 bp, Homo sapiens
gatactgtttctt

SEQ ID NO: 1011592 - DNA, 15 bp, Homo sapiens
cctaccatgctgctt

SEQ ID NO: 1011593 - DNA, 15 bp, Homo sapiens
cctacccaaccactc

SEQ ID NO: 1011594 - DNA, 18 bp, Homo sapiens
cctacccaatgtctccca

SEQ ID NO: 1011595 - DNA, 14 bp, Homo sapiens
cctacccatccccg

SEQ ID NO: 1011596 - DNA, 13 bp, Homo sapiens
cctaccccacacc

SEQ ID NO: 1011597 - DNA, 20 bp, Homo sapiens
cctaccccacaccaggccgt

SEQ ID NO: 1011598 - DNA, 13 bp, Homo sapiens
cctaccccaccac

SEQ ID NO: 1011599 - DNA, 17 bp, Homo sapiens
cctaccccctcatcccc

SEQ ID NO: 1011600 - DNA, 20 bp, Homo sapiens
cctaccccgcagacaccttg

SEQ ID NO: 1011601 - DNA, 16 bp, Homo sapiens
cctacccctcttccag

SEQ ID NO: 1011602 - DNA, 12 bp, Homo sapiens
cctacccctgcc

SEQ ID NO: 1011603 - DNA, 13 bp, Homo sapiens
cctacccctggct

SEQ ID NO: 1011604 - DNA, 13 bp, Homo sapiens
cctaccccttcct

SEQ ID NO: 1011605 - DNA, 14 bp, Homo sapiens
cctaccccttcctg

SEQ ID NO: 1011606 - DNA, 16 bp, Homo sapiens
cctaccccttcctgtc

SEQ ID NO: 1011607 - DNA, 17 bp, Homo sapiens
cctacccgcccgcgtcc

SEQ ID NO: 1011608 - DNA, 23 bp, Homo sapiens
cctaccctcgggcccacctggcc

SEQ ID NO: 1011609 - DNA, 13 bp, Homo sapiens
cctacccttcctg

SEQ ID NO: 1011610 - DNA, 14 bp, Homo sapiens
cctacccttcctgc

SEQ ID NO: 1011611 - DNA, 15 bp, Homo sapiens
cctaccgatggtccc

SEQ ID NO: 1011612 - DNA, 14 bp, Homo sapiens
cctacctcagccta

SEQ ID NO: 1011613 - DNA, 16 bp, Homo sapiens
cctacctcagcctaga

SEQ ID NO: 1011614 - DNA, 15 bp, Homo sapiens
cctacctccactctc

SEQ ID NO: 1011615 - DNA, 11 bp, Homo sapiens
cctacctccct

SEQ ID NO: 1011616 - DNA, 12 bp, Homo sapiens
cctacctccctc

SEQ ID NO: 1011617 - DNA, 14 bp, Homo sapiens
cctacctccctccc

SEQ ID NO: 1011618 - DNA, 15 bp, Homo sapiens
cctacctctggtgat

SEQ ID NO: 1011619 - DNA, 15 bp, Homo sapiens
cctacctgctgctgc

SEQ ID NO: 1011620 - DNA, 13 bp, Homo sapiens
cctacctggggac

SEQ ID NO: 1011621 - DNA, 19 bp, Homo sapiens
cctacctggggactcctca

SEQ ID NO: 1011622 - DNA, 22 bp, Homo sapiens
cctacctgttcagtgtcccggg

SEQ ID NO: 1011623 - DNA, 19 bp, Homo sapiens
cctaccttcatttcaggag

SEQ ID NO: 1011624 - DNA, 16 bp, Homo sapiens
cctaccttttgtctct

SEQ ID NO: 1011625 - DNA, 22 bp, Homo sapiens
cctacgcagatgctgtcactgg

SEQ ID NO: 1011626 - DNA, 17 bp, Homo sapiens
cctacgctcatctctgg

SEQ ID NO: 1011627 - DNA, 18 bp, Homo sapiens
cctacgctcatctctgga

SEQ ID NO: 1011628 - DNA, 19 bp, Homo sapiens
cctacgctcatctctggaa

SEQ ID NO: 1011629 - DNA, 17 bp, Homo sapiens
cctacgttcctggcccc

SEQ ID NO: 1011630 - DNA, 19 bp, Homo sapiens
cctacgttcctggccccct

SEQ ID NO: 1011631 - DNA, 22 bp, Homo sapiens
cctacgttctctttaaaagctg

SEQ ID NO: 1011632 - DNA, 17 bp, Homo sapiens
cctactcattggggttc

SEQ ID NO: 1011633 - DNA, 15 bp, Homo sapiens
cctactccactgccc

SEQ ID NO: 1011634 - DNA, 14 bp, Homo sapiens
cctactcccctggg

SEQ ID NO: 1011635 - DNA, 23 bp, Homo sapiens
cctactccctccaattccccctt

SEQ ID NO: 1011636 - DNA, 12 bp, Homo sapiens
cctactccctct

SEQ ID NO: 1011637 - DNA, 18 bp, Homo sapiens
cctactcggctctgcagt

SEQ ID NO: 1011638 - DNA, 22 bp, Homo sapiens
cctactctgtgtaaatattttt

SEQ ID NO: 1011639 - DNA, 15 bp, Homo sapiens
cctactcttcagggt

SEQ ID NO: 1011640 - DNA, 22 bp, Homo sapiens
cctactgtggggagagatggca

SEQ ID NO: 1011641 - DNA, 15 bp, Homo sapiens
cctactgttactcta

SEQ ID NO: 1011642 - DNA, 14 bp, Homo sapiens
cctactgttccttt

SEQ ID NO: 1011643 - DNA, 15 bp, Homo sapiens
cctactgttcctttc

SEQ ID NO: 1011644 - DNA, 16 bp, Homo sapiens
cctactgttcctttca

SEQ ID NO: 1011645 - DNA, 17 bp, Homo sapiens
cctactgttcctttcag

SEQ ID NO: 1011646 - DNA, 14 bp, Homo sapiens
cctacttccaggat

SEQ ID NO: 1011647 - DNA, 21 bp, Homo sapiens
cctacttgataatattagtga

SEQ ID NO: 1011648 - DNA, 13 bp, Homo sapiens
cctatagtcccag

SEQ ID NO: 1011649 - DNA, 15 bp, Homo sapiens
cctatagtcccagct

SEQ ID NO: 1011650 - DNA, 15 bp, Homo sapiens
cctatatatttctat

SEQ ID NO: 1011651 - DNA, 23 bp, Homo sapiens
cctatatccagaaggggagcttt

SEQ ID NO: 1011652 - DNA, 16 bp, Homo sapiens
cctatatcctgtgact

SEQ ID NO: 1011653 - DNA, 15 bp, Homo sapiens
cctatatctgtttgt

SEQ ID NO: 1011654 - DNA, 14 bp, Homo sapiens
cctatatgtagtat

SEQ ID NO: 1011655 - DNA, 18 bp, Homo sapiens
cctatattgttttcagtg

SEQ ID NO: 1011656 - DNA, 18 bp, Homo sapiens
cctatcacctcccctcct

SEQ ID NO: 1011657 - DNA, 17 bp, Homo sapiens
cctatccacccagccca

SEQ ID NO: 1011658 - DNA, 18 bp, Homo sapiens
cctatccacccagcccat

SEQ ID NO: 1011659 - DNA, 21 bp, Homo sapiens
cctatccacccagcccattct

SEQ ID NO: 1011660 - DNA, 16 bp, Homo sapiens
cctatccatggcacta

SEQ ID NO: 1011661 - DNA, 18 bp, Homo sapiens
cctatccgctgccagcct

SEQ ID NO: 1011662 - DNA, 14 bp, Homo sapiens
cctatcctctgagt

SEQ ID NO: 1011663 - DNA, 18 bp, Homo sapiens
cctatccttggagagcag

SEQ ID NO: 1011664 - DNA, 16 bp, Homo sapiens
cctatctagcatttat

SEQ ID NO: 1011665 - DNA, 22 bp, Homo sapiens
cctatctattaaagtgactttc

SEQ ID NO: 1011666 - DNA, 13 bp, Homo sapiens
cctatctcaggga

SEQ ID NO: 1011667 - DNA, 14 bp, Homo sapiens
cctatctcagggag

SEQ ID NO: 1011668 - DNA, 15 bp, Homo sapiens
cctatctcagggagg

SEQ ID NO: 1011669 - DNA, 23 bp, Homo sapiens
cctatctcatagggatgctgtga

SEQ ID NO: 1011670 - DNA, 20 bp, Homo sapiens
cctatctccagcggccctgt

SEQ ID NO: 1011671 - DNA, 14 bp, Homo sapiens
cctatctcctgaca

SEQ ID NO: 1011672 - DNA, 16 bp, Homo sapiens
cctatctggggagctc

SEQ ID NO: 1011673 - DNA, 19 bp, Homo sapiens
cctatctggggagctcctg

SEQ ID NO: 1011674 - DNA, 21 bp, Homo sapiens
cctatctggggagctcctggc

SEQ ID NO: 1011675 - DNA, 13 bp, Homo sapiens
cctatgacacagt

SEQ ID NO: 1011676 - DNA, 19 bp, Homo sapiens
cctatgagatggccatgct

SEQ ID NO: 1011677 - DNA, 20 bp, Homo sapiens
cctatgagcatcctgagccc

SEQ ID NO: 1011678 - DNA, 13 bp, Homo sapiens
cctatgatcccag

SEQ ID NO: 1011679 - DNA, 15 bp, Homo sapiens
cctatgatcccagca

SEQ ID NO: 1011680 - DNA, 19 bp, Homo sapiens
cctatgatggatggcagac

SEQ ID NO: 1011681 - DNA, 21 bp, Homo sapiens
cctatgcagacatctctggag

SEQ ID NO: 1011682 - DNA, 14 bp, Homo sapiens
cctatgcagggagg

SEQ ID NO: 1011683 - DNA, 16 bp, Homo sapiens
cctatgcccaggtacc

SEQ ID NO: 1011684 - DNA, 13 bp, Homo sapiens
cctatgcctgtgg

SEQ ID NO: 1011685 - DNA, 20 bp, Homo sapiens
cctatgcctgtggtgaagtg

SEQ ID NO: 1011686 - DNA, 12 bp, Homo sapiens
cctatgctgtgc

SEQ ID NO: 1011687 - DNA, 20 bp, Homo sapiens
cctatgcttaataaaagaac

SEQ ID NO: 1011688 - DNA, 21 bp, Homo sapiens
cctatgcttaataaaagaaca

SEQ ID NO: 1011689 - DNA, 21 bp, Homo sapiens
cctatggaagtggttctatgt

SEQ ID NO: 1011690 - DNA, 22 bp, Homo sapiens
cctatggtataatggttgactg

SEQ ID NO: 1011691 - DNA, 19 bp, Homo sapiens
cctatgtacttaatccttt

SEQ ID NO: 1011692 - DNA, 18 bp, Homo sapiens
cctatgtagtccgtgctg

SEQ ID NO: 1011693 - DNA, 14 bp, Homo sapiens
cctatgtatttgca

SEQ ID NO: 1011694 - DNA, 19 bp, Homo sapiens
cctatgtcaatttgtatat

SEQ ID NO: 1011695 - DNA, 15 bp, Homo sapiens
cctattaggtggaaa

SEQ ID NO: 1011696 - DNA, 21 bp, Homo sapiens
cctattaggtggaaattttat

SEQ ID NO: 1011697 - DNA, 20 bp, Homo sapiens
cctattcaccctccacttcc

SEQ ID NO: 1011698 - DNA, 21 bp, Homo sapiens
cctattccaggaattcctctt

SEQ ID NO: 1011699 - DNA, 20 bp, Homo sapiens
cctattctatccatctcctg

SEQ ID NO: 1011700 - DNA, 21 bp, Homo sapiens
cctattgtaatcgtgtgccat

SEQ ID NO: 1011701 - DNA, 13 bp, Homo sapiens
cctattgtcatta

SEQ ID NO: 1011702 - DNA, 15 bp, Homo sapiens
cctattgtcattaaa

SEQ ID NO: 1011703 - DNA, 14 bp, Homo sapiens
cctatttatgaaaa

SEQ ID NO: 1011704 - DNA, 23 bp, Homo sapiens
cctatttcagtgttacctgtgtg

SEQ ID NO: 1011705 - DNA, 18 bp, Homo sapiens
cctatttccattcaacaa

SEQ ID NO: 1011706 - DNA, 14 bp, Homo sapiens
cctatttcctcaga

SEQ ID NO: 1011707 - DNA, 11 bp, Homo sapiens
cctatttctat

SEQ ID NO: 1011708 - DNA, 14 bp, Homo sapiens
cctatttctatgtc

SEQ ID NO: 1011709 - DNA, 15 bp, Homo sapiens
cctatttctatgtca

SEQ ID NO: 1011710 - DNA, 13 bp, Homo sapiens
cctatttctgatg

SEQ ID NO: 1011711 - DNA, 14 bp, Homo sapiens
cctattttcatttg

SEQ ID NO: 1011712 - DNA, 15 bp, Homo sapiens
cctattttcatttgt

SEQ ID NO: 1011713 - DNA, 18 bp, Homo sapiens
cctattttcatttgtaca

SEQ ID NO: 1011714 - DNA, 15 bp, Homo sapiens
cctatttttaaataa

SEQ ID NO: 1011715 - DNA, 12 bp, Homo sapiens
cctcaaaacaga

SEQ ID NO: 1011716 - DNA, 17 bp, Homo sapiens
cctcaaaacagaagcag

SEQ ID NO: 1011717 - DNA, 17 bp, Homo sapiens
cctcaaaactggagtcc

SEQ ID NO: 1011718 - DNA, 14 bp, Homo sapiens
cctcaaaccctgtg

SEQ ID NO: 1011719 - DNA, 18 bp, Homo sapiens
cctcaaacctcctcttct

SEQ ID NO: 1011720 - DNA, 14 bp, Homo sapiens
cctcaaactgcaca

SEQ ID NO: 1011721 - DNA, 16 bp, Homo sapiens
cctcaaagaaagtgta

SEQ ID NO: 1011722 - DNA, 15 bp, Homo sapiens
cctcaaagaggcctt

SEQ ID NO: 1011723 - DNA, 24 bp, Homo sapiens
cctcaaagcaacccgctggagccc

SEQ ID NO: 1011724 - DNA, 15 bp, Homo sapiens
gatattggaacttgc

SEQ ID NO: 1011725 - DNA, 18 bp, Homo sapiens
gatattggttcttcccct

SEQ ID NO: 1011726 - DNA, 13 bp, Homo sapiens
gatattgtacata

SEQ ID NO: 1011727 - DNA, 14 bp, Homo sapiens
gatattgtacataa

SEQ ID NO: 1011728 - DNA, 15 bp, Homo sapiens
gatattgtacataaa

SEQ ID NO: 1011729 - DNA, 22 bp, Homo sapiens
gatattgtcagagttctgctct

SEQ ID NO: 1011730 - DNA, 17 bp, Homo sapiens
gatattgtgaagtacat

SEQ ID NO: 1011731 - DNA, 19 bp, Homo sapiens
gatattgtttaaaattcag

SEQ ID NO: 1011732 - DNA, 23 bp, Homo sapiens
gatatttaagaaaatacaataaa

SEQ ID NO: 1011733 - DNA, 15 bp, Homo sapiens
gatatttatttcctg

SEQ ID NO: 1011734 - DNA, 17 bp, Homo sapiens
gatatttcctaaggcat

SEQ ID NO: 1011735 - DNA, 21 bp, Homo sapiens
gatattttacctcttattgca

SEQ ID NO: 1011736 - DNA, 12 bp, Homo sapiens
gatattttcaaa

SEQ ID NO: 1011737 - DNA, 20 bp, Homo sapiens
gatattttcttccaagcaaa

SEQ ID NO: 1011738 - DNA, 17 bp, Homo sapiens
gatatttttatgtgcag

SEQ ID NO: 1011739 - DNA, 13 bp, Homo sapiens
gatatttttccat

SEQ ID NO: 1011740 - DNA, 11 bp, Homo sapiens
gatatttttgt

SEQ ID NO: 1011741 - DNA, 21 bp, Homo sapiens
gatcaaaacatgcttgaataa

SEQ ID NO: 1011742 - DNA, 22 bp, Homo sapiens
gatcaaaacctgtgccaggctg

SEQ ID NO: 1011743 - DNA, 22 bp, Homo sapiens
gatcaaaataaaaagtgacaca

SEQ ID NO: 1011744 - DNA, 22 bp, Homo sapiens
gatcaaacctttctggcctgtt

SEQ ID NO: 1011745 - DNA, 18 bp, Homo sapiens
gatcaaagatgaaaagta

SEQ ID NO: 1011746 - DNA, 14 bp, Homo sapiens
gatcaaataactta

SEQ ID NO: 1011747 - DNA, 17 bp, Homo sapiens
gatcaaatatagaaagt

SEQ ID NO: 1011748 - DNA, 23 bp, Homo sapiens
gatcaaattcatttttttcactg

SEQ ID NO: 1011749 - DNA, 16 bp, Homo sapiens
gatcaaattctacaac

SEQ ID NO: 1011750 - DNA, 18 bp, Homo sapiens
gatcaaccagctaagaaa

SEQ ID NO: 1011751 - DNA, 16 bp, Homo sapiens
gatcaacgcctcactg

SEQ ID NO: 1011752 - DNA, 14 bp, Homo sapiens
gatcaagaaagtgt

SEQ ID NO: 1011753 - DNA, 12 bp, Homo sapiens
gatcaagccagt

SEQ ID NO: 1011754 - DNA, 19 bp, Homo sapiens
gatcaagttgttgactgtg

SEQ ID NO: 1011755 - DNA, 22 bp, Homo sapiens
gatcaagttgttgactgtgatt

SEQ ID NO: 1011756 - DNA, 13 bp, Homo sapiens
gatcaataaatgt

SEQ ID NO: 1011757 - DNA, 16 bp, Homo sapiens
gatcaattaaatgtag

SEQ ID NO: 1011758 - DNA, 13 bp, Homo sapiens
gatcacaagatgg

SEQ ID NO: 1011759 - DNA, 15 bp, Homo sapiens
gatcacaaggtcagg

SEQ ID NO: 1011760 - DNA, 13 bp, Homo sapiens
gatcacacagtgt

SEQ ID NO: 1011761 - DNA, 14 bp, Homo sapiens
gatcacacagtgtt

SEQ ID NO: 1011762 - DNA, 19 bp, Homo sapiens
gatcacacctcagtgggaa

SEQ ID NO: 1011763 - DNA, 11 bp, Homo sapiens
gatcacagcct

SEQ ID NO: 1011764 - DNA, 14 bp, Homo sapiens
gatcacagcctctg

SEQ ID NO: 1011765 - DNA, 18 bp, Homo sapiens
gatcacagcgtttcagga

SEQ ID NO: 1011766 - DNA, 19 bp, Homo sapiens
gatcacagcgtttcaggaa

SEQ ID NO: 1011767 - DNA, 13 bp, Homo sapiens
gatcacagggccc

SEQ ID NO: 1011768 - DNA, 20 bp, Homo sapiens
gatcacagggccccagaagg

SEQ ID NO: 1011769 - DNA, 22 bp, Homo sapiens
gatcacagtgactttacaggag

SEQ ID NO: 1011770 - DNA, 17 bp, Homo sapiens
gatcacatctaaagctt

SEQ ID NO: 1011771 - DNA, 22 bp, Homo sapiens
gatcctgggtactgaaagcctt

SEQ ID NO: 1011772 - DNA, 16 bp, Homo sapiens
gatcctgtccttttaa

SEQ ID NO: 1011773 - DNA, 19 bp, Homo sapiens
gatcctgtctttaaggaaa

SEQ ID NO: 1011774 - DNA, 23 bp, Homo sapiens
gatcctgttacttgcttcagtgg

SEQ ID NO: 1011775 - DNA, 17 bp, Homo sapiens
gatccttagagaagttt

SEQ ID NO: 1011776 - DNA, 13 bp, Homo sapiens
gatccttcaaagt

SEQ ID NO: 1011777 - DNA, 21 bp, Homo sapiens
gatccttcacaggcagtgcat

SEQ ID NO: 1011778 - DNA, 16 bp, Homo sapiens
gatccttcagcacagg

SEQ ID NO: 1011779 - DNA, 17 bp, Homo sapiens
gatccttttttgtcatt

SEQ ID NO: 1011780 - DNA, 19 bp, Homo sapiens
gatccttttttgtcatttt

SEQ ID NO: 1011781 - DNA, 16 bp, Homo sapiens
gatcgagaccatcctg

SEQ ID NO: 1011782 - DNA, 17 bp, Homo sapiens
gatcgagaccatcctgg

SEQ ID NO: 1011783 - DNA, 18 bp, Homo sapiens
gatcgagaccatcctggc

SEQ ID NO: 1011784 - DNA, 16 bp, Homo sapiens
gatcgaggcatggggc

SEQ ID NO: 1011785 - DNA, 19 bp, Homo sapiens
gatcgagtgtagctgtgaa

SEQ ID NO: 1011786 - DNA, 20 bp, Homo sapiens
gatcgagtgtagctgtgaaa

SEQ ID NO: 1011787 - DNA, 22 bp, Homo sapiens
gatcgagtgtagctgtgaaatc

SEQ ID NO: 1011788 - DNA, 15 bp, Homo sapiens
gatcgcatcattgca

SEQ ID NO: 1011789 - DNA, 14 bp, Homo sapiens
gatcgcgttagcca

SEQ ID NO: 1011790 - DNA, 16 bp, Homo sapiens
gatcggactctgcccc

SEQ ID NO: 1011791 - DNA, 20 bp, Homo sapiens
gatcggagcctcctctctca

SEQ ID NO: 1011792 - DNA, 18 bp, Homo sapiens
gatcgtctcggcccctct

SEQ ID NO: 1011793 - DNA, 18 bp, Homo sapiens
gatcgtctgactggtgtt

SEQ ID NO: 1011794 - DNA, 13 bp, Homo sapiens
gatcgtgcatttg

SEQ ID NO: 1011795 - DNA, 23 bp, Homo sapiens
gatcgtgccgttactctccaacc

SEQ ID NO: 1011796 - DNA, 13 bp, Homo sapiens
gatcgtgcggccg

SEQ ID NO: 1011797 - DNA, 16 bp, Homo sapiens
gatcgttcaaagcatg

SEQ ID NO: 1011798 - DNA, 18 bp, Homo sapiens
gatctaagcctttccata

SEQ ID NO: 1011799 - DNA, 18 bp, Homo sapiens
gatctaccagcataaata

SEQ ID NO: 1011800 - DNA, 17 bp, Homo sapiens
gatctacccgtgcctgg

SEQ ID NO: 1011801 - DNA, 14 bp, Homo sapiens
gatctacctggagg

SEQ ID NO: 1011802 - DNA, 20 bp, Homo sapiens
gatctacttcatagctcctt

SEQ ID NO: 1011803 - DNA, 16 bp, Homo sapiens
gatctagcactcctca

SEQ ID NO: 1011804 - DNA, 21 bp, Homo sapiens
gatctagttctcaatcactgc

SEQ ID NO: 1011805 - DNA, 19 bp, Homo sapiens
gatctatgtttgtgtgatt

SEQ ID NO: 1011806 - DNA, 20 bp, Homo sapiens
gatctatgtttgtgtgattt

SEQ ID NO: 1011807 - DNA, 21 bp, Homo sapiens
gatctatgtttgtgtgatttc

SEQ ID NO: 1011808 - DNA, 13 bp, Homo sapiens
gatctatttcatg

SEQ ID NO: 1011809 - DNA, 14 bp, Homo sapiens
gatctatttcatgt

SEQ ID NO: 1011810 - DNA, 14 bp, Homo sapiens
gatctcaagccagc

SEQ ID NO: 1011811 - DNA, 16 bp, Homo sapiens
gatctcaagccagccc

SEQ ID NO: 1011812 - DNA, 22 bp, Homo sapiens
gatctcaagccagccccctcca

SEQ ID NO: 1011813 - DNA, 14 bp, Homo sapiens
gatctcagctttga

SEQ ID NO: 1011814 - DNA, 16 bp, Homo sapiens
gatctcagctttgaga

SEQ ID NO: 1011815 - DNA, 14 bp, Homo sapiens
gatctcagggcaga

SEQ ID NO: 1011816 - DNA, 18 bp, Homo sapiens
gatctcaggggctgtttg

SEQ ID NO: 1011817 - DNA, 21 bp, Homo sapiens
gatctcattcagtattaaagg

SEQ ID NO: 1011818 - DNA, 19 bp, Homo sapiens
gatctccaaggaccaggtt

SEQ ID NO: 1011819 - DNA, 20 bp, Homo sapiens
gatctccaaggaccaggtta

SEQ ID NO: 1011820 - DNA, 22 bp, Homo sapiens
gatctccactgataagactgtt

SEQ ID NO: 1011821 - DNA, 19 bp, Homo sapiens
gatctccatggcttcctcc

SEQ ID NO: 1011822 - DNA, 21 bp, Homo sapiens
gatctcccactgcggggagac

SEQ ID NO: 1011823 - DNA, 15 bp, Homo sapiens
gatctccctgccgcc

SEQ ID NO: 1011824 - DNA, 18 bp, Homo sapiens
gatctccctgccgcctca

SEQ ID NO: 1011825 - DNA, 12 bp, Homo sapiens
gatctctcagga

SEQ ID NO: 1011826 - DNA, 22 bp, Homo sapiens
gatctctcaggagcacaggcag

SEQ ID NO: 1011827 - DNA, 14 bp, Homo sapiens
gatctctcctggcc

SEQ ID NO: 1011828 - DNA, 16 bp, Homo sapiens
gatctctcctggccta

SEQ ID NO: 1011829 - DNA, 19 bp, Homo sapiens
gatctctgacctctgctga

SEQ ID NO: 1011830 - DNA, 24 bp, Homo sapiens
gatctctgacctctgctgagtgct

SEQ ID NO: 1011831 - DNA, 12 bp, Homo sapiens
gatctctgtcac

SEQ ID NO: 1011832 - DNA, 14 bp, Homo sapiens
gatctgactgccaa

SEQ ID NO: 1011833 - DNA, 21 bp, Homo sapiens
gatctgagaacacgttgccag

SEQ ID NO: 1011834 - DNA, 14 bp, Homo sapiens
gatctgagaatctt

SEQ ID NO: 1011835 - DNA, 18 bp, Homo sapiens
gatctgagaatctttatt

SEQ ID NO: 1011836 - DNA, 21 bp, Homo sapiens
gatctgagctcccacctccct

SEQ ID NO: 1011837 - DNA, 24 bp, Homo sapiens
gatctgagctcccacctcccttcc

SEQ ID NO: 1011838 - DNA, 17 bp, Homo sapiens
gatctgatctgtaccat

SEQ ID NO: 1011839 - DNA, 22 bp, Homo sapiens
gatctgcaagaacactggacct

SEQ ID NO: 1011840 - DNA, 20 bp, Homo sapiens
gatctgcagggggtgtgtct

SEQ ID NO: 1011841 - DNA, 13 bp, Homo sapiens
gatctgcctgggc

SEQ ID NO: 1011842 - DNA, 14 bp, Homo sapiens
gatctgcctgggcc

SEQ ID NO: 1011843 - DNA, 16 bp, Homo sapiens
gatctgcctgggcctg

SEQ ID NO: 1011844 - DNA, 21 bp, Homo sapiens
gatctgcggatctcagctttg

SEQ ID NO: 1011845 - DNA, 21 bp, Homo sapiens
gatctgctgaggcccagtgca

SEQ ID NO: 1011846 - DNA, 19 bp, Homo sapiens
gatctgctgggctctgcct

SEQ ID NO: 1011847 - DNA, 14 bp, Homo sapiens
gatctggcacactc

SEQ ID NO: 1011848 - DNA, 16 bp, Homo sapiens
gatctggcacactccc

SEQ ID NO: 1011849 - DNA, 19 bp, Homo sapiens
gatctgggcattttcctcc

SEQ ID NO: 1011850 - DNA, 20 bp, Homo sapiens
gatctgggcattttcctcct

SEQ ID NO: 1011851 - DNA, 14 bp, Homo sapiens
gatctggggaggca

SEQ ID NO: 1011852 - DNA, 15 bp, Homo sapiens
gatctggggaggcag

SEQ ID NO: 1011853 - DNA, 16 bp, Homo sapiens
cctcagccctgaccct

SEQ ID NO: 1011854 - DNA, 21 bp, Homo sapiens
cctcagccctgaccctgtgga

SEQ ID NO: 1011855 - DNA, 19 bp, Homo sapiens
cctcagccctggccttttt

SEQ ID NO: 1011856 - DNA, 13 bp, Homo sapiens
cctcagcccttgc

SEQ ID NO: 1011857 - DNA, 16 bp, Homo sapiens
cctcagcccttgcccc

SEQ ID NO: 1011858 - DNA, 18 bp, Homo sapiens
cctcagccgtcagccatc

SEQ ID NO: 1011859 - DNA, 16 bp, Homo sapiens
cctcagcctagaccct

SEQ ID NO: 1011860 - DNA, 19 bp, Homo sapiens
cctcagcctagaccctcct

SEQ ID NO: 1011861 - DNA, 16 bp, Homo sapiens
cctcagcctccccagt

SEQ ID NO: 1011862 - DNA, 13 bp, Homo sapiens
cctcagcctcctg

SEQ ID NO: 1011863 - DNA, 15 bp, Homo sapiens
cctcagcctcctgag

SEQ ID NO: 1011864 - DNA, 15 bp, Homo sapiens
cctcagcctcctggg

SEQ ID NO: 1011865 - DNA, 16 bp, Homo sapiens
cctcagcctcctgggt

SEQ ID NO: 1011866 - DNA, 11 bp, Homo sapiens
cctcagcctct

SEQ ID NO: 1011867 - DNA, 14 bp, Homo sapiens
cctcagcctcttct

SEQ ID NO: 1011868 - DNA, 11 bp, Homo sapiens
cctcagcctgc

SEQ ID NO: 1011869 - DNA, 15 bp, Homo sapiens
cctcagcctgcccac

SEQ ID NO: 1011870 - DNA, 19 bp, Homo sapiens
cctcagcctgcccacctct

SEQ ID NO: 1011871 - DNA, 15 bp, Homo sapiens
cctcagcctggagag

SEQ ID NO: 1011872 - DNA, 18 bp, Homo sapiens
cctcagcctggagaggcc

SEQ ID NO: 1011873 - DNA, 21 bp, Homo sapiens
cctcagcctggagaggcctgg

SEQ ID NO: 1011874 - DNA, 17 bp, Homo sapiens
cctcagcctggggctct

SEQ ID NO: 1011875 - DNA, 14 bp, Homo sapiens
cctcagccttctga

SEQ ID NO: 1011876 - DNA, 13 bp, Homo sapiens
cctcagcgcaggc

SEQ ID NO: 1011877 - DNA, 19 bp, Homo sapiens
cctcagcgcaggctgcaga

SEQ ID NO: 1011878 - DNA, 13 bp, Homo sapiens
cctcagctaccca

SEQ ID NO: 1011879 - DNA, 20 bp, Homo sapiens
cctcagctacccactatcct

SEQ ID NO: 1011880 - DNA, 14 bp, Homo sapiens
cctcagctctctgg

SEQ ID NO: 1011881 - DNA, 14 bp, Homo sapiens
cctcagctgaatgc

SEQ ID NO: 1011882 - DNA, 19 bp, Homo sapiens
cctcagctgcacattcctg

SEQ ID NO: 1011883 - DNA, 19 bp, Homo sapiens
cctcagctgccaagcactc

SEQ ID NO: 1011884 - DNA, 16 bp, Homo sapiens
cctcagctgcctcact

SEQ ID NO: 1011885 - DNA, 19 bp, Homo sapiens
cctcagctgctcccacact

SEQ ID NO: 1011886 - DNA, 18 bp, Homo sapiens
cctcagctgtcacctgct

SEQ ID NO: 1011887 - DNA, 24 bp, Homo sapiens
cctcagctgtcacctgctcacagg

SEQ ID NO: 1011888 - DNA, 19 bp, Homo sapiens
cctcaggaccctcagccct

SEQ ID NO: 1011889 - DNA, 14 bp, Homo sapiens
cctcaggagggcag

SEQ ID NO: 1011890 - DNA, 17 bp, Homo sapiens
cctcaggcacacagcta

SEQ ID NO: 1011891 - DNA, 15 bp, Homo sapiens
cctcaggcagctcaa

SEQ ID NO: 1011892 - DNA, 22 bp, Homo sapiens
cctcaggcataggcctgggtgc

SEQ ID NO: 1011893 - DNA, 14 bp, Homo sapiens
cctcattgtgccaa

SEQ ID NO: 1011894 - DNA, 19 bp, Homo sapiens
cctcattgtgccaagcctt

SEQ ID NO: 1011895 - DNA, 12 bp, Homo sapiens
cctcatttcttt

SEQ ID NO: 1011896 - DNA, 15 bp, Homo sapiens
cctccaaacctccag

SEQ ID NO: 1011897 - DNA, 10 bp, Homo sapiens
cctccaaaga

SEQ ID NO: 1011898 - DNA, 16 bp, Homo sapiens
cctccaaagagccttc

SEQ ID NO: 1011899 - DNA, 19 bp, Homo sapiens
cctccaaaggaaggggttt

SEQ ID NO: 1011900 - DNA, 18 bp, Homo sapiens
cctccaaagtggagctgg

SEQ ID NO: 1011901 - DNA, 22 bp, Homo sapiens
cctccaaatggagaagctgcag

SEQ ID NO: 1011902 - DNA, 19 bp, Homo sapiens
cctccaacaccaagcacag

SEQ ID NO: 1011903 - DNA, 14 bp, Homo sapiens
cctccaacccaacc

SEQ ID NO: 1011904 - DNA, 17 bp, Homo sapiens
cctccaacgcccctgtg

SEQ ID NO: 1011905 - DNA, 19 bp, Homo sapiens
cctccaacgcccctgtggc

SEQ ID NO: 1011906 - DNA, 14 bp, Homo sapiens
cctccaagcaagta

SEQ ID NO: 1011907 - DNA, 14 bp, Homo sapiens
cctccaagcacaga

SEQ ID NO: 1011908 - DNA, 23 bp, Homo sapiens
cctccaagcacagagcctggccc

SEQ ID NO: 1011909 - DNA, 18 bp, Homo sapiens
cctccaagcatttcatga

SEQ ID NO: 1011910 - DNA, 15 bp, Homo sapiens
cctccaagcctggca

SEQ ID NO: 1011911 - DNA, 16 bp, Homo sapiens
cctccaagcctggcac

SEQ ID NO: 1011912 - DNA, 21 bp, Homo sapiens
cctccaagcctggcacccacc

SEQ ID NO: 1011913 - DNA, 23 bp, Homo sapiens
cctccaagggtttcgactggtcc

SEQ ID NO: 1011914 - DNA, 16 bp, Homo sapiens
cctccaataaagtgcc

SEQ ID NO: 1011915 - DNA, 18 bp, Homo sapiens
cctccaataaagtgcctt

SEQ ID NO: 1011916 - DNA, 22 bp, Homo sapiens
cctccaatcccaccaaccctca

SEQ ID NO: 1011917 - DNA, 15 bp, Homo sapiens
cctccaatcctttcc

SEQ ID NO: 1011918 - DNA, 19 bp, Homo sapiens
cctccaatcctttccaccc

SEQ ID NO: 1011919 - DNA, 21 bp, Homo sapiens
cctccaatgctgcctgggagc

SEQ ID NO: 1011920 - DNA, 13 bp, Homo sapiens
cctccaatgtcta

SEQ ID NO: 1011921 - DNA, 12 bp, Homo sapiens
cctccacagaga

SEQ ID NO: 1011922 - DNA, 13 bp, Homo sapiens
cctccacagagag

SEQ ID NO: 1011923 - DNA, 15 bp, Homo sapiens
cctccacagccgcag

SEQ ID NO: 1011924 - DNA, 13 bp, Homo sapiens
cctccacagcgag

SEQ ID NO: 1011925 - DNA, 15 bp, Homo sapiens
cctccacagcgaggg

SEQ ID NO: 1011926 - DNA, 22 bp, Homo sapiens
cctccacagcgagggcagctgc

SEQ ID NO: 1011927 - DNA, 16 bp, Homo sapiens
cctccacagctgcagc

SEQ ID NO: 1011928 - DNA, 16 bp, Homo sapiens
cctccacagtgctgct

SEQ ID NO: 1011929 - DNA, 19 bp, Homo sapiens
cctccacatcccagcagcc

SEQ ID NO: 1011930 - DNA, 21 bp, Homo sapiens
cctccacatgctgcctggcac

SEQ ID NO: 1011931 - DNA, 15 bp, Homo sapiens
cctccaccaccactg

SEQ ID NO: 1011932 - DNA, 17 bp, Homo sapiens
cctccaccaccactggc

SEQ ID NO: 1011933 - DNA, 16 bp, Homo sapiens
cctccacccagcccct

SEQ ID NO: 1011934 - DNA, 11 bp, Homo sapiens
cctccacccat

SEQ ID NO: 1011935 - DNA, 14 bp, Homo sapiens
cctccaccccagga

SEQ ID NO: 1011936 - DNA, 15 bp, Homo sapiens
cctccaccccaggac

SEQ ID NO: 1011937 - DNA, 22 bp, Homo sapiens
cctccacccccatgtggcagcc

SEQ ID NO: 1011938 - DNA, 18 bp, Homo sapiens
cctccacccccgccacgg

SEQ ID NO: 1011939 - DNA, 11 bp, Homo sapiens
cctccaccctg

SEQ ID NO: 1011940 - DNA, 15 bp, Homo sapiens
cctccaccctgtccc

SEQ ID NO: 1011941 - DNA, 20 bp, Homo sapiens
cctccaccctgtcccccagc

SEQ ID NO: 1011942 - DNA, 13 bp, Homo sapiens
cctccaccgctgc

SEQ ID NO: 1011943 - DNA, 13 bp, Homo sapiens
cctccacctctca

SEQ ID NO: 1011944 - DNA, 22 bp, Homo sapiens
cctccacctctcacgggccctg

SEQ ID NO: 1011945 - DNA, 13 bp, Homo sapiens
cctccaccttcca

SEQ ID NO: 1011946 - DNA, 14 bp, Homo sapiens
cctccaccttccat

SEQ ID NO: 1011947 - DNA, 21 bp, Homo sapiens
cctccaccttccattttcccc

SEQ ID NO: 1011948 - DNA, 17 bp, Homo sapiens
cctccaccttgctcttc

SEQ ID NO: 1011949 - DNA, 23 bp, Homo sapiens
cctccaccttgctcttctttctg

SEQ ID NO: 1011950 - DNA, 13 bp, Homo sapiens
cctccacgcctcc

SEQ ID NO: 1011951 - DNA, 20 bp, Homo sapiens
cctccacgcctcctggccag

SEQ ID NO: 1011952 - DNA, 21 bp, Homo sapiens
cctccacgcctcctggccaga

SEQ ID NO: 1011953 - DNA, 20 bp, Homo sapiens
cctccacggtccgcggcctg

SEQ ID NO: 1011954 - DNA, 18 bp, Homo sapiens
cctccacgtgtccgtcca

SEQ ID NO: 1011955 - DNA, 22 bp, Homo sapiens
cctccacgtgtccgtccaccct

SEQ ID NO: 1011956 - DNA, 17 bp, Homo sapiens
cctccacgttctgctca

SEQ ID NO: 1011957 - DNA, 16 bp, Homo sapiens
cctccactcactccag

SEQ ID NO: 1011958 - DNA, 21 bp, Homo sapiens
cctccactcactccagcccaa

SEQ ID NO: 1011959 - DNA, 15 bp, Homo sapiens
cctccactcgaccca

SEQ ID NO: 1011960 - DNA, 19 bp, Homo sapiens
cctccactctagttctaga

SEQ ID NO: 1011961 - DNA, 12 bp, Homo sapiens
cctccactctgt

SEQ ID NO: 1011962 - DNA, 21 bp, Homo sapiens
cctccactctgtatctatgca

SEQ ID NO: 1011963 - DNA, 22 bp, Homo sapiens
cctccactggggaatgctccca

SEQ ID NO: 1011964 - DNA, 13 bp, Homo sapiens
cctccactgtcac

SEQ ID NO: 1011965 - DNA, 13 bp, Homo sapiens
cctccacttcccg

SEQ ID NO: 1011966 - DNA, 17 bp, Homo sapiens
cctccagaagcctctgg

SEQ ID NO: 1011967 - DNA, 18 bp, Homo sapiens
cctccagaagcctctggc

SEQ ID NO: 1011968 - DNA, 14 bp, Homo sapiens
cctccagaccacca

SEQ ID NO: 1011969 - DNA, 16 bp, Homo sapiens
cctccagaccaccagc

SEQ ID NO: 1011970 - DNA, 16 bp, Homo sapiens
cctccagaccctgcct

SEQ ID NO: 1011971 - DNA, 19 bp, Homo sapiens
cctccagaccctgcctgag

SEQ ID NO: 1011972 - DNA, 21 bp, Homo sapiens
cctccagaccctgcctgagcc

SEQ ID NO: 1011973 - DNA, 11 bp, Homo sapiens
cctccagagcc

SEQ ID NO: 1011974 - DNA, 13 bp, Homo sapiens
cctccagagccag

SEQ ID NO: 1011975 - DNA, 17 bp, Homo sapiens
cctccagagccagcctg

SEQ ID NO: 1011976 - DNA, 21 bp, Homo sapiens
cctccagagccagcctgggac

SEQ ID NO: 1011977 - DNA, 22 bp, Homo sapiens
cctccagagccagcctgggact

SEQ ID NO: 1011978 - DNA, 23 bp, Homo sapiens
cctccagagccagcctgggactc

SEQ ID NO: 1011979 - DNA, 14 bp, Homo sapiens
cctccagcccctgt

SEQ ID NO: 1011980 - DNA, 15 bp, Homo sapiens
cctccagcccctgtc

SEQ ID NO: 1011981 - DNA, 14 bp, Homo sapiens
cctccagcccggga

SEQ ID NO: 1011982 - DNA, 16 bp, Homo sapiens
cctccagcccgggagc

SEQ ID NO: 1011983 - DNA, 18 bp, Homo sapiens
cctccagccctgcccacc

SEQ ID NO: 1011984 - DNA, 16 bp, Homo sapiens
gatgcaccaccaagcc

SEQ ID NO: 1011985 - DNA, 19 bp, Homo sapiens
gatgcacgtggggcccact

SEQ ID NO: 1011986 - DNA, 21 bp, Homo sapiens
gatgcacgtggggcccactgc

SEQ ID NO: 1011987 - DNA, 22 bp, Homo sapiens
gatgcactatatgtttacacaa

SEQ ID NO: 1011988 - DNA, 21 bp, Homo sapiens
gatgcactgaaaacttagcca

SEQ ID NO: 1011989 - DNA, 15 bp, Homo sapiens
gatgcacttcaaatt

SEQ ID NO: 1011990 - DNA, 22 bp, Homo sapiens
gatgcacttcaaattcaaataa

SEQ ID NO: 1011991 - DNA, 21 bp, Homo sapiens
gatgcagcattttgtatttgt

SEQ ID NO: 1011992 - DNA, 14 bp, Homo sapiens
gatgcagcttatac

SEQ ID NO: 1011993 - DNA, 15 bp, Homo sapiens
gatgcagggcagtca

SEQ ID NO: 1011994 - DNA, 20 bp, Homo sapiens
gatgcatacagttttctagc

SEQ ID NO: 1011995 - DNA, 14 bp, Homo sapiens
gatgcatgtctttt

SEQ ID NO: 1011996 - DNA, 17 bp, Homo sapiens
gatgcattaaaagaaaa

SEQ ID NO: 1011997 - DNA, 16 bp, Homo sapiens
gatgcatttaataaag

SEQ ID NO: 1011998 - DNA, 21 bp, Homo sapiens
gatgcatttaataaagatgag

SEQ ID NO: 1011999 - DNA, 19 bp, Homo sapiens
gatgccaaaccacaagact

SEQ ID NO: 1012000 - DNA, 19 bp, Homo sapiens
gatgccaaagatgtttgaa

SEQ ID NO: 1012001 - DNA, 19 bp, Homo sapiens
gatgccaacttcccacacg

SEQ ID NO: 1012002 - DNA, 20 bp, Homo sapiens
gatgccaatttcctctccac

SEQ ID NO: 1012003 - DNA, 13 bp, Homo sapiens
gatgccaccggcc

SEQ ID NO: 1012004 - DNA, 19 bp, Homo sapiens
gatgccacgcacttcctct

SEQ ID NO: 1012005 - DNA, 16 bp, Homo sapiens
gatgccactttgcagc

SEQ ID NO: 1012006 - DNA, 17 bp, Homo sapiens
gatgccagagggccagc

SEQ ID NO: 1012007 - DNA, 16 bp, Homo sapiens
gatgccagcttctctc

SEQ ID NO: 1012008 - DNA, 11 bp, Homo sapiens
gatgccaggac

SEQ ID NO: 1012009 - DNA, 13 bp, Homo sapiens
gatgccaggtgca

SEQ ID NO: 1012010 - DNA, 15 bp, Homo sapiens
gatgccataaataca

SEQ ID NO: 1012011 - DNA, 23 bp, Homo sapiens
gatgccatagcataatatgaagc

SEQ ID NO: 1012012 - DNA, 19 bp, Homo sapiens
gatgcccagagggcccagg

SEQ ID NO: 1012013 - DNA, 22 bp, Homo sapiens
gatgcccagagggcccaggcag

SEQ ID NO: 1012014 - DNA, 12 bp, Homo sapiens
gatgccccagag

SEQ ID NO: 1012015 - DNA, 17 bp, Homo sapiens
cctccagtgtcagggtc

SEQ ID NO: 1012016 - DNA, 16 bp, Homo sapiens
cctccagtgtgggctt

SEQ ID NO: 1012017 - DNA, 23 bp, Homo sapiens
cctccagtgttgcctcctcccat

SEQ ID NO: 1012018 - DNA, 16 bp, Homo sapiens
cctccataagtttaac

SEQ ID NO: 1012019 - DNA, 20 bp, Homo sapiens
cctccataagtttaacttta

SEQ ID NO: 1012020 - DNA, 14 bp, Homo sapiens
cctccatagccacg

SEQ ID NO: 1012021 - DNA, 17 bp, Homo sapiens
cctccatccatctgtcc

SEQ ID NO: 1012022 - DNA, 22 bp, Homo sapiens
cctccatccatctgtccgtcca

SEQ ID NO: 1012023 - DNA, 14 bp, Homo sapiens
cctccatcccgaca

SEQ ID NO: 1012024 - DNA, 18 bp, Homo sapiens
cctccatccctgctctgg

SEQ ID NO: 1012025 - DNA, 16 bp, Homo sapiens
cctccatctttctaca

SEQ ID NO: 1012026 - DNA, 19 bp, Homo sapiens
cctccatgccccagctctg

SEQ ID NO: 1012027 - DNA, 18 bp, Homo sapiens
cctccatgctcctcacct

SEQ ID NO: 1012028 - DNA, 22 bp, Homo sapiens
cctccatgctcctcacctgtct

SEQ ID NO: 1012029 - DNA, 15 bp, Homo sapiens
cctccatgctgcctc

SEQ ID NO: 1012030 - DNA, 19 bp, Homo sapiens
cctccatgctgcctccaga

SEQ ID NO: 1012031 - DNA, 22 bp, Homo sapiens
cctccatggtcctgtctgtcct

SEQ ID NO: 1012032 - DNA, 14 bp, Homo sapiens
cctccatggtggaa

SEQ ID NO: 1012033 - DNA, 12 bp, Homo sapiens
cctccatgtttt

SEQ ID NO: 1012034 - DNA, 15 bp, Homo sapiens
cctccattctgacca

SEQ ID NO: 1012035 - DNA, 13 bp, Homo sapiens
cctccattgctcc

SEQ ID NO: 1012036 - DNA, 22 bp, Homo sapiens
cctccattgggcacagtccaga

SEQ ID NO: 1012037 - DNA, 13 bp, Homo sapiens
cctccatttctgt

SEQ ID NO: 1012038 - DNA, 18 bp, Homo sapiens
cctcccaaccaaccagca

SEQ ID NO: 1012039 - DNA, 16 bp, Homo sapiens
cctcccaacctcaatg

SEQ ID NO: 1012040 - DNA, 21 bp, Homo sapiens
cctcccaacctcaatgccctg

SEQ ID NO: 1012041 - DNA, 21 bp, Homo sapiens
cctcccaagcgttcctggcct

SEQ ID NO: 1012042 - DNA, 23 bp, Homo sapiens
cctcccaagcgttcctggccttc

SEQ ID NO: 1012043 - DNA, 20 bp, Homo sapiens
cctcccaagtagctgggatt

SEQ ID NO: 1012044 - DNA, 21 bp, Homo sapiens
cctcccaagtagctgggatta

SEQ ID NO: 1012045 - DNA, 11 bp, Homo sapiens
cctcccacaca

SEQ ID NO: 1012046 - DNA, 11 bp, Homo sapiens
cctcccacact

SEQ ID NO: 1012047 - DNA, 22 bp, Homo sapiens
cctcccacacttcccaccccca

SEQ ID NO: 1012048 - DNA, 15 bp, Homo sapiens
cctcccacacttgct

SEQ ID NO: 1012049 - DNA, 18 bp, Homo sapiens
cctcccacagacctgcag

SEQ ID NO: 1012050 - DNA, 20 bp, Homo sapiens
cctcccacagacctgcagtg

SEQ ID NO: 1012051 - DNA, 12 bp, Homo sapiens
cctcccaccaca

SEQ ID NO: 1012052 - DNA, 15 bp, Homo sapiens
cctcccaccacagca

SEQ ID NO: 1012053 - DNA, 15 bp, Homo sapiens
cctcccaccacccca

SEQ ID NO: 1012054 - DNA, 12 bp, Homo sapiens
cctcccaccaga

SEQ ID NO: 1012055 - DNA, 15 bp, Homo sapiens
cctcccaccagagcc

SEQ ID NO: 1012056 - DNA, 12 bp, Homo sapiens
cctcccaccccc

SEQ ID NO: 1012057 - DNA, 13 bp, Homo sapiens
cctcccaccccca

SEQ ID NO: 1012058 - DNA, 16 bp, Homo sapiens
cctcccacccccagcc

SEQ ID NO: 1012059 - DNA, 21 bp, Homo sapiens
cctcccacccccttctctgct

SEQ ID NO: 1012060 - DNA, 19 bp, Homo sapiens
cctcccacccgatgctgct

SEQ ID NO: 1012061 - DNA, 21 bp, Homo sapiens
cctcccacccgatgctgcttt

SEQ ID NO: 1012062 - DNA, 16 bp, Homo sapiens
cctcccacctccgtgt

SEQ ID NO: 1012063 - DNA, 13 bp, Homo sapiens
cctcccactccca

SEQ ID NO: 1012064 - DNA, 15 bp, Homo sapiens
cctcccactcccatc

SEQ ID NO: 1012065 - DNA, 12 bp, Homo sapiens
cctcccactttg

SEQ ID NO: 1012066 - DNA, 19 bp, Homo sapiens
cctcccactttgctgttcc

SEQ ID NO: 1012067 - DNA, 22 bp, Homo sapiens
cctcccagaaaaactggctctg

SEQ ID NO: 1012068 - DNA, 18 bp, Homo sapiens
cctcccagacaggccctc

SEQ ID NO: 1012069 - DNA, 22 bp, Homo sapiens
cctcccagacaggccctccctg

SEQ ID NO: 1012070 - DNA, 20 bp, Homo sapiens
cctcccagaggagccaccag

SEQ ID NO: 1012071 - DNA, 12 bp, Homo sapiens
cctcccagcggc

SEQ ID NO: 1012072 - DNA, 15 bp, Homo sapiens
cctcccagctgcact

SEQ ID NO: 1012073 - DNA, 19 bp, Homo sapiens
cctcccaggcaagcagctg

SEQ ID NO: 1012074 - DNA, 14 bp, Homo sapiens
cctcccaggcgccc

SEQ ID NO: 1012075 - DNA, 15 bp, Homo sapiens
cctcccaggctctca

SEQ ID NO: 1012076 - DNA, 14 bp, Homo sapiens
cctcccagggccag

SEQ ID NO: 1012077 - DNA, 21 bp, Homo sapiens
cctcccagggccagggccctg

SEQ ID NO: 1012078 - DNA, 18 bp, Homo sapiens
cctcccaggggagccagc

SEQ ID NO: 1012079 - DNA, 13 bp, Homo sapiens
cctcccagtcctc

SEQ ID NO: 1012080 - DNA, 12 bp, Homo sapiens
cctcccagtctc

SEQ ID NO: 1012081 - DNA, 21 bp, Homo sapiens
cctcccagtctcatctcctga

SEQ ID NO: 1012082 - DNA, 22 bp, Homo sapiens
cctcccagttctacaagcatat

SEQ ID NO: 1012083 - DNA, 23 bp, Homo sapiens
cctcccatcattacccttccctg

SEQ ID NO: 1012084 - DNA, 11 bp, Homo sapiens
cctcccatccc

SEQ ID NO: 1012085 - DNA, 13 bp, Homo sapiens
cctcccatcccct

SEQ ID NO: 1012086 - DNA, 13 bp, Homo sapiens
cctcccatctggg

SEQ ID NO: 1012087 - DNA, 15 bp, Homo sapiens
cctcccatggcacct

SEQ ID NO: 1012088 - DNA, 14 bp, Homo sapiens
cctcccattctgca

SEQ ID NO: 1012089 - DNA, 23 bp, Homo sapiens
cctccccaaaagaaaccatgaca

SEQ ID NO: 1012090 - DNA, 15 bp, Homo sapiens
cctccccacactcca

SEQ ID NO: 1012091 - DNA, 16 bp, Homo sapiens
cctccccacactccac

SEQ ID NO: 1012092 - DNA, 19 bp, Homo sapiens
cctccccacactccactct

SEQ ID NO: 1012093 - DNA, 18 bp, Homo sapiens
cctccccaccttccccag

SEQ ID NO: 1012094 - DNA, 19 bp, Homo sapiens
cctccccaccttccccaga

SEQ ID NO: 1012095 - DNA, 17 bp, Homo sapiens
cctccccagcaggtggg

SEQ ID NO: 1012096 - DNA, 22 bp, Homo sapiens
cctccccagcattccagcccct

SEQ ID NO: 1012097 - DNA, 13 bp, Homo sapiens
cctccccagccag

SEQ ID NO: 1012098 - DNA, 17 bp, Homo sapiens
cctccccagccagccct

SEQ ID NO: 1012099 - DNA, 23 bp, Homo sapiens
cctccccagccagcccttccctg

SEQ ID NO: 1012100 - DNA, 19 bp, Homo sapiens
cctccccagctcccttggg

SEQ ID NO: 1012101 - DNA, 17 bp, Homo sapiens
cctccccagctccggag

SEQ ID NO: 1012102 - DNA, 12 bp, Homo sapiens
cctccccagggg

SEQ ID NO: 1012103 - DNA, 14 bp, Homo sapiens
cctccccaggggag

SEQ ID NO: 1012104 - DNA, 17 bp, Homo sapiens
cctccccatctgtccag

SEQ ID NO: 1012105 - DNA, 21 bp, Homo sapiens
cctccccatctgtccagctgg

SEQ ID NO: 1012106 - DNA, 21 bp, Homo sapiens
cctccccattagagtcagcct

SEQ ID NO: 1012107 - DNA, 23 bp, Homo sapiens
cctccccatttcccatctgcacc

SEQ ID NO: 1012108 - DNA, 18 bp, Homo sapiens
cctcccccaacacctgct

SEQ ID NO: 1012109 - DNA, 15 bp, Homo sapiens
cctcccccagagggg

SEQ ID NO: 1012110 - DNA, 23 bp, Homo sapiens
cctcccccagccatgccagctgg

SEQ ID NO: 1012111 - DNA, 17 bp, Homo sapiens
gatggagggtggaaata

SEQ ID NO: 1012112 - DNA, 20 bp, Homo sapiens
gatggagtgtgcagacagcc

SEQ ID NO: 1012113 - DNA, 17 bp, Homo sapiens
gatggagtttctctctt

SEQ ID NO: 1012114 - DNA, 23 bp, Homo sapiens
gatggatgccaatattaaatctg

SEQ ID NO: 1012115 - DNA, 14 bp, Homo sapiens
gatggatttgcctg

SEQ ID NO: 1012116 - DNA, 14 bp, Homo sapiens
gatggcaccagagg

SEQ ID NO: 1012117 - DNA, 16 bp, Homo sapiens
gatggcagagccaggc

SEQ ID NO: 1012118 - DNA, 17 bp, Homo sapiens
gatggcaggatccaagg

SEQ ID NO: 1012119 - DNA, 13 bp, Homo sapiens
gatggcaggcctg

SEQ ID NO: 1012120 - DNA, 14 bp, Homo sapiens
gatggcaggcctga

SEQ ID NO: 1012121 - DNA, 13 bp, Homo sapiens
gatggccagagga

SEQ ID NO: 1012122 - DNA, 22 bp, Homo sapiens
gatggccagcccctggggccca

SEQ ID NO: 1012123 - DNA, 12 bp, Homo sapiens
gatggcccaagg

SEQ ID NO: 1012124 - DNA, 13 bp, Homo sapiens
gatggcccaaggg

SEQ ID NO: 1012125 - DNA, 21 bp, Homo sapiens
gatggccccaacaagcacccc

SEQ ID NO: 1012126 - DNA, 12 bp, Homo sapiens
gatggccccagc

SEQ ID NO: 1012127 - DNA, 13 bp, Homo sapiens
gatggcccctcca

SEQ ID NO: 1012128 - DNA, 15 bp, Homo sapiens
gatggcccctccact

SEQ ID NO: 1012129 - DNA, 16 bp, Homo sapiens
gatggcccctccactg

SEQ ID NO: 1012130 - DNA, 18 bp, Homo sapiens
gatggcccctccttgcaa

SEQ ID NO: 1012131 - DNA, 22 bp, Homo sapiens
gatggccgggcgcggtggctca

SEQ ID NO: 1012132 - DNA, 16 bp, Homo sapiens
gatggcctttccttcc

SEQ ID NO: 1012133 - DNA, 21 bp, Homo sapiens
gatggcctttggacccagggc

SEQ ID NO: 1012134 - DNA, 24 bp, Homo sapiens
gatggcctttggacccagggcctg

SEQ ID NO: 1012135 - DNA, 22 bp, Homo sapiens
gatggcgcgggaggcaccagct

SEQ ID NO: 1012136 - DNA, 17 bp, Homo sapiens
gatggctcaagacaagg

SEQ ID NO: 1012137 - DNA, 17 bp, Homo sapiens
gatgtggaaatgaggtt

SEQ ID NO: 1012138 - DNA, 22 bp, Homo sapiens
gatgtggacgtcacgctccctg

SEQ ID NO: 1012139 - DNA, 24 bp, Homo sapiens
gatgtggagctactgatgaaatct

SEQ ID NO: 1012140 - DNA, 17 bp, Homo sapiens
gatgtggaggaagagcc

SEQ ID NO: 1012141 - DNA, 18 bp, Homo sapiens
gatgtggaggaagagcca

SEQ ID NO: 1012142 - DNA, 23 bp, Homo sapiens
gatgtggaggaagagccacctgc

SEQ ID NO: 1012143 - DNA, 17 bp, Homo sapiens
gatgtggcaaagtgctg

SEQ ID NO: 1012144 - DNA, 19 bp, Homo sapiens
gatgtggcaaagtgctgta

SEQ ID NO: 1012145 - DNA, 21 bp, Homo sapiens
gatgtggctactgacatatct

SEQ ID NO: 1012146 - DNA, 12 bp, Homo sapiens
gatgtgggcagc

SEQ ID NO: 1012147 - DNA, 19 bp, Homo sapiens
gatgtggggctgagctggg

SEQ ID NO: 1012148 - DNA, 23 bp, Homo sapiens
gatgtgggtctttttctcttctg

SEQ ID NO: 1012149 - DNA, 20 bp, Homo sapiens
gatgtggtgcctgaggtctg

SEQ ID NO: 1012150 - DNA, 16 bp, Homo sapiens
gatgtgtaaacaggta

SEQ ID NO: 1012151 - DNA, 21 bp, Homo sapiens
gatgtgtcccccccaggcctt

SEQ ID NO: 1012152 - DNA, 18 bp, Homo sapiens
gatgtgtctcccagaact

SEQ ID NO: 1012153 - DNA, 22 bp, Homo sapiens
gatgtgtctgggagagcctggc

SEQ ID NO: 1012154 - DNA, 15 bp, Homo sapiens
gatgtgtggggcatg

SEQ ID NO: 1012155 - DNA, 19 bp, Homo sapiens
gatgtgttcattcaagcta

SEQ ID NO: 1012156 - DNA, 22 bp, Homo sapiens
gatgtgttcattcaagctattt

SEQ ID NO: 1012157 - DNA, 23 bp, Homo sapiens
gatgtgttcattcaagctattta

SEQ ID NO: 1012158 - DNA, 17 bp, Homo sapiens
gatgtgttttgcacgtc

SEQ ID NO: 1012159 - DNA, 23 bp, Homo sapiens
gatgtgttttgcacgtcttgcta

SEQ ID NO: 1012160 - DNA, 12 bp, Homo sapiens
gatgttaaaatc

SEQ ID NO: 1012161 - DNA, 12 bp, Homo sapiens
gatgttaaatgg

SEQ ID NO: 1012162 - DNA, 14 bp, Homo sapiens
gatgttaactttgt

SEQ ID NO: 1012163 - DNA, 12 bp, Homo sapiens
gatgttacaagt

SEQ ID NO: 1012164 - DNA, 20 bp, Homo sapiens
gatgttacaagtttgctaaa

SEQ ID NO: 1012165 - DNA, 16 bp, Homo sapiens
gatgttagaaagtgct

SEQ ID NO: 1012166 - DNA, 22 bp, Homo sapiens
gatgttattactgttttgggcc

SEQ ID NO: 1012167 - DNA, 23 bp, Homo sapiens
gatgttattactgttttgggcct

SEQ ID NO: 1012168 - DNA, 13 bp, Homo sapiens
gatgttcagagtg

SEQ ID NO: 1012169 - DNA, 19 bp, Homo sapiens
gatgttcagcactgtccct

SEQ ID NO: 1012170 - DNA, 20 bp, Homo sapiens
gatgttcagcactgtccctt

SEQ ID NO: 1012171 - DNA, 22 bp, Homo sapiens
gatgttcatttttaaagcctgg

SEQ ID NO: 1012172 - DNA, 24 bp, Homo sapiens
gatgttcatttttaaagcctggct

SEQ ID NO: 1012173 - DNA, 17 bp, Homo sapiens
gatgttccagtgaggaa

SEQ ID NO: 1012174 - DNA, 12 bp, Homo sapiens
gatgttcctttt

SEQ ID NO: 1012175 - DNA, 20 bp, Homo sapiens
gatgttctgcctctccctgg

SEQ ID NO: 1012176 - DNA, 18 bp, Homo sapiens
gatgttctggataccatt

SEQ ID NO: 1012177 - DNA, 21 bp, Homo sapiens
gatgttgaaatatgcatacta

SEQ ID NO: 1012178 - DNA, 15 bp, Homo sapiens
gatgttgataatttc

SEQ ID NO: 1012179 - DNA, 19 bp, Homo sapiens
gatgttgataatttcaggg

SEQ ID NO: 1012180 - DNA, 13 bp, Homo sapiens
gatgttgcttctg

SEQ ID NO: 1012181 - DNA, 15 bp, Homo sapiens
gatgttgcttctgaa

SEQ ID NO: 1012182 - DNA, 14 bp, Homo sapiens
gatgtttacatttt

SEQ ID NO: 1012183 - DNA, 16 bp, Homo sapiens
gatgtttaccgtgtgt

SEQ ID NO: 1012184 - DNA, 15 bp, Homo sapiens
gatgtttacctggtg

SEQ ID NO: 1012185 - DNA, 16 bp, Homo sapiens
gatgtttacctggtgc

SEQ ID NO: 1012186 - DNA, 17 bp, Homo sapiens
gatgtttcaactgtgct

SEQ ID NO: 1012187 - DNA, 14 bp, Homo sapiens
gatgtttgaaaatg

SEQ ID NO: 1012188 - DNA, 22 bp, Homo sapiens
gatgtttggaaaaaactctgaa

SEQ ID NO: 1012189 - DNA, 17 bp, Homo sapiens
gatgtttgtggcctcag

SEQ ID NO: 1012190 - DNA, 14 bp, Homo sapiens
gatgttttaaaaaa

SEQ ID NO: 1012191 - DNA, 19 bp, Homo sapiens
gatgttttaaaaaaatttg

SEQ ID NO: 1012192 - DNA, 21 bp, Homo sapiens
gatgttttaaggatgcttgta

SEQ ID NO: 1012193 - DNA, 22 bp, Homo sapiens
gatgttttacgcaaggaaggac

SEQ ID NO: 1012194 - DNA, 23 bp, Homo sapiens
gatgttttacgcaaggaaggact

SEQ ID NO: 1012195 - DNA, 15 bp, Homo sapiens
gatgttttacgtgca

SEQ ID NO: 1012196 - DNA, 17 bp, Homo sapiens
gatgttttacgtgcaaa

SEQ ID NO: 1012197 - DNA, 18 bp, Homo sapiens
gatgttttacgtgcaaac

SEQ ID NO: 1012198 - DNA, 18 bp, Homo sapiens
gatgtttttaaaagtttc

SEQ ID NO: 1012199 - DNA, 14 bp, Homo sapiens
gatgtttttcttta

SEQ ID NO: 1012200 - DNA, 21 bp, Homo sapiens
gattaaaaataccttctatgt

SEQ ID NO: 1012201 - DNA, 16 bp, Homo sapiens
gattaaaggaaggaaa

SEQ ID NO: 1012202 - DNA, 19 bp, Homo sapiens
gattaaataacttgaagag

SEQ ID NO: 1012203 - DNA, 15 bp, Homo sapiens
gattaaatatttgaa

SEQ ID NO: 1012204 - DNA, 18 bp, Homo sapiens
gattaaatatttgaagag

SEQ ID NO: 1012205 - DNA, 20 bp, Homo sapiens
gattaaatgtgtcattggaa

SEQ ID NO: 1012206 - DNA, 19 bp, Homo sapiens
gattaaattcttgcaaagt

SEQ ID NO: 1012207 - DNA, 12 bp, Homo sapiens
gattaacatttg

SEQ ID NO: 1012208 - DNA, 21 bp, Homo sapiens
gattaaccacttcagctgact

SEQ ID NO: 1012209 - DNA, 14 bp, Homo sapiens
gattaacctctgca

SEQ ID NO: 1012210 - DNA, 16 bp, Homo sapiens
gattaactgtgaataa

SEQ ID NO: 1012211 - DNA, 19 bp, Homo sapiens
gattaagggacgggggtgg

SEQ ID NO: 1012212 - DNA, 14 bp, Homo sapiens
gattaatatattta

SEQ ID NO: 1012213 - DNA, 15 bp, Homo sapiens
gattaatgttttgta

SEQ ID NO: 1012214 - DNA, 19 bp, Homo sapiens
gattaatgttttgtacaat

SEQ ID NO: 1012215 - DNA, 20 bp, Homo sapiens
gattaatttgagaattattc

SEQ ID NO: 1012216 - DNA, 17 bp, Homo sapiens
gattacaaataaacagt

SEQ ID NO: 1012217 - DNA, 23 bp, Homo sapiens
gattacaaatcagaagtcatctt

SEQ ID NO: 1012218 - DNA, 19 bp, Homo sapiens
gattacaggcatgagccac

SEQ ID NO: 1012219 - DNA, 22 bp, Homo sapiens
gattacaggcatgagccactgc

SEQ ID NO: 1012220 - DNA, 11 bp, Homo sapiens
gattacataga

SEQ ID NO: 1012221 - DNA, 13 bp, Homo sapiens
gattacatagatc

SEQ ID NO: 1012222 - DNA, 17 bp, Homo sapiens
gattacatagatcagcc

SEQ ID NO: 1012223 - DNA, 20 bp, Homo sapiens
gattacatagatcagccatt

SEQ ID NO: 1012224 - DNA, 19 bp, Homo sapiens
gattaccagtctgattata

SEQ ID NO: 1012225 - DNA, 17 bp, Homo sapiens
gattacctcctgagaaa

SEQ ID NO: 1012226 - DNA, 18 bp, Homo sapiens
gattacgtgtatgtttct

SEQ ID NO: 1012227 - DNA, 23 bp, Homo sapiens
gattactctccatatcccttcct

SEQ ID NO: 1012228 - DNA, 23 bp, Homo sapiens
gattactctttgagatagaagaa

SEQ ID NO: 1012229 - DNA, 15 bp, Homo sapiens
gattactgatgtgat

SEQ ID NO: 1012230 - DNA, 20 bp, Homo sapiens
gattacttagattgtgttcc

SEQ ID NO: 1012231 - DNA, 15 bp, Homo sapiens
gattagaaattacct

SEQ ID NO: 1012232 - DNA, 20 bp, Homo sapiens
gattagaaattacctgtgga

SEQ ID NO: 1012233 - DNA, 14 bp, Homo sapiens
gattagaaggcaag

SEQ ID NO: 1012234 - DNA, 14 bp, Homo sapiens
gattagacagaaca

SEQ ID NO: 1012235 - DNA, 16 bp, Homo sapiens
gattagacagaacacc

SEQ ID NO: 1012236 - DNA, 14 bp, Homo sapiens
gattagagggaggt

SEQ ID NO: 1012237 - DNA, 19 bp, Homo sapiens
gattagcaagttacagtga

SEQ ID NO: 1012238 - DNA, 12 bp, Homo sapiens
gattagctctgg

SEQ ID NO: 1012239 - DNA, 15 bp, Homo sapiens
gattagtaagatctc

SEQ ID NO: 1012240 - DNA, 19 bp, Homo sapiens
cctccgagagggagagaga

SEQ ID NO: 1012241 - DNA, 14 bp, Homo sapiens
cctccgaggccagt

SEQ ID NO: 1012242 - DNA, 13 bp, Homo sapiens
cctccgaggctcc

SEQ ID NO: 1012243 - DNA, 19 bp, Homo sapiens
cctccgaggctccccgcct

SEQ ID NO: 1012244 - DNA, 20 bp, Homo sapiens
cctccgaggctccccgcctc

SEQ ID NO: 1012245 - DNA, 22 bp, Homo sapiens
cctccgaggctccccgcctcca

SEQ ID NO: 1012246 - DNA, 15 bp, Homo sapiens
cctccgatccttcct

SEQ ID NO: 1012247 - DNA, 19 bp, Homo sapiens
cctccgatgcctggcctgc

SEQ ID NO: 1012248 - DNA, 13 bp, Homo sapiens
cctccgccagacc

SEQ ID NO: 1012249 - DNA, 21 bp, Homo sapiens
cctccgccatggggtcggctc

SEQ ID NO: 1012250 - DNA, 13 bp, Homo sapiens
cctccgcccctgc

SEQ ID NO: 1012251 - DNA, 12 bp, Homo sapiens
cctccgccctgc

SEQ ID NO: 1012252 - DNA, 14 bp, Homo sapiens
cctccgccctgcca

SEQ ID NO: 1012253 - DNA, 16 bp, Homo sapiens
cctccgccgtgccggc

SEQ ID NO: 1012254 - DNA, 16 bp, Homo sapiens
cctccgcctcccatcc

SEQ ID NO: 1012255 - DNA, 17 bp, Homo sapiens
cctccgcctcccatccc

SEQ ID NO: 1012256 - DNA, 17 bp, Homo sapiens
cctccgcttatcctgct

SEQ ID NO: 1012257 - DNA, 15 bp, Homo sapiens
cctccggacatccag

SEQ ID NO: 1012258 - DNA, 16 bp, Homo sapiens
cctctaaagcagaggc

SEQ ID NO: 1012259 - DNA, 17 bp, Homo sapiens
cctctaaagcagaggca

SEQ ID NO: 1012260 - DNA, 13 bp, Homo sapiens
cctctaacatttt

SEQ ID NO: 1012261 - DNA, 20 bp, Homo sapiens
cctctaaccctcattgctgt

SEQ ID NO: 1012262 - DNA, 19 bp, Homo sapiens
cctctaactcactgcctag

SEQ ID NO: 1012263 - DNA, 14 bp, Homo sapiens
cctctaagccactc

SEQ ID NO: 1012264 - DNA, 18 bp, Homo sapiens
cctctaagcgtgctgaca

SEQ ID NO: 1012265 - DNA, 19 bp, Homo sapiens
cctctacacaggggccctg

SEQ ID NO: 1012266 - DNA, 21 bp, Homo sapiens
cctctacagagcttccctgac

SEQ ID NO: 1012267 - DNA, 19 bp, Homo sapiens
cctctacccaaaccctagg

SEQ ID NO: 1012268 - DNA, 18 bp, Homo sapiens
cctctacctctctcctct

SEQ ID NO: 1012269 - DNA, 17 bp, Homo sapiens
cctctactaaaaagaag

SEQ ID NO: 1012270 - DNA, 20 bp, Homo sapiens
cctctactgtctcctccctg

SEQ ID NO: 1012271 - DNA, 22 bp, Homo sapiens
cctctactgtctcctccctggg

SEQ ID NO: 1012272 - DNA, 19 bp, Homo sapiens
cctctactttgattctgat

SEQ ID NO: 1012273 - DNA, 19 bp, Homo sapiens
cctctagaaatttttcaga

SEQ ID NO: 1012274 - DNA, 14 bp, Homo sapiens
cctctagagccttc

SEQ ID NO: 1012275 - DNA, 14 bp, Homo sapiens
cctctagcaggcct

SEQ ID NO: 1012276 - DNA, 19 bp, Homo sapiens
cctctagcccactccctgc

SEQ ID NO: 1012277 - DNA, 15 bp, Homo sapiens
cctctagctgttctt

SEQ ID NO: 1012278 - DNA, 15 bp, Homo sapiens
cctctagcttttcta

SEQ ID NO: 1012279 - DNA, 17 bp, Homo sapiens
cctctagggcagggtgg

SEQ ID NO: 1012280 - DNA, 16 bp, Homo sapiens
cctctaggggcagcct

SEQ ID NO: 1012281 - DNA, 17 bp, Homo sapiens
cctctaggggcagcctc

SEQ ID NO: 1012282 - DNA, 21 bp, Homo sapiens
cctctagtaagatgcactgaa

SEQ ID NO: 1012283 - DNA, 18 bp, Homo sapiens
cctctagtagtatattta

SEQ ID NO: 1012284 - DNA, 13 bp, Homo sapiens
cctctagtgccct

SEQ ID NO: 1012285 - DNA, 14 bp, Homo sapiens
cctctagtgccctc

SEQ ID NO: 1012286 - DNA, 15 bp, Homo sapiens
cctctagtgccctcc

SEQ ID NO: 1012287 - DNA, 18 bp, Homo sapiens
cctctagttgagtttctg

SEQ ID NO: 1012288 - DNA, 13 bp, Homo sapiens
cctctatacatct

SEQ ID NO: 1012289 - DNA, 16 bp, Homo sapiens
cctctatacatctctc

SEQ ID NO: 1012290 - DNA, 19 bp, Homo sapiens
cctctatacatctctcccc

SEQ ID NO: 1012291 - DNA, 21 bp, Homo sapiens
cctctatacatctctccccaa

SEQ ID NO: 1012292 - DNA, 13 bp, Homo sapiens
cctctatcccaat

SEQ ID NO: 1012293 - DNA, 15 bp, Homo sapiens
cctctatgccctgca

SEQ ID NO: 1012294 - DNA, 13 bp, Homo sapiens
cctctatgctggc

SEQ ID NO: 1012295 - DNA, 14 bp, Homo sapiens
cctctatgctggct

SEQ ID NO: 1012296 - DNA, 16 bp, Homo sapiens
cctctatgctggcttt

SEQ ID NO: 1012297 - DNA, 17 bp, Homo sapiens
cctctatgctggctttt

SEQ ID NO: 1012298 - DNA, 19 bp, Homo sapiens
cctctattcttgggaaaca

SEQ ID NO: 1012299 - DNA, 20 bp, Homo sapiens
cctctattcttgggaaacac

SEQ ID NO: 1012300 - DNA, 20 bp, Homo sapiens
cctctattgatgtacagtct

SEQ ID NO: 1012301 - DNA, 14 bp, Homo sapiens
cctctattttaatt

SEQ ID NO: 1012302 - DNA, 15 bp, Homo sapiens
cctctcaactgcctc

SEQ ID NO: 1012303 - DNA, 21 bp, Homo sapiens
cctctcaagctagtgtttcta

SEQ ID NO: 1012304 - DNA, 14 bp, Homo sapiens
cctctcacctcagc

SEQ ID NO: 1012305 - DNA, 20 bp, Homo sapiens
cctctcacctgccgtgcgta

SEQ ID NO: 1012306 - DNA, 17 bp, Homo sapiens
cctctcacctgtactct

SEQ ID NO: 1012307 - DNA, 15 bp, Homo sapiens
cctctcacgccaccc

SEQ ID NO: 1012308 - DNA, 15 bp, Homo sapiens
cctctcacgggccct

SEQ ID NO: 1012309 - DNA, 17 bp, Homo sapiens
cctctcacgggccctgc

SEQ ID NO: 1012310 - DNA, 21 bp, Homo sapiens
cctctcacgggccctgcccca

SEQ ID NO: 1012311 - DNA, 14 bp, Homo sapiens
cctctcagaacata

SEQ ID NO: 1012312 - DNA, 20 bp, Homo sapiens
cctctcagaacatactgatt

SEQ ID NO: 1012313 - DNA, 17 bp, Homo sapiens
cctctcagaggcctgct

SEQ ID NO: 1012314 - DNA, 17 bp, Homo sapiens
cctctcagagtgacagt

SEQ ID NO: 1012315 - DNA, 15 bp, Homo sapiens
cctctcagataccca

SEQ ID NO: 1012316 - DNA, 18 bp, Homo sapiens
cctctcagcatagcctgc

SEQ ID NO: 1012317 - DNA, 21 bp, Homo sapiens
cctctcagcatagcctgcctg

SEQ ID NO: 1012318 - DNA, 22 bp, Homo sapiens
cctctcagcatagcctgcctga

SEQ ID NO: 1012319 - DNA, 16 bp, Homo sapiens
cctctcagctccaggt

SEQ ID NO: 1012320 - DNA, 18 bp, Homo sapiens
cctctcagctccaggtgg

SEQ ID NO: 1012321 - DNA, 13 bp, Homo sapiens
cctctcaggagag

SEQ ID NO: 1012322 - DNA, 15 bp, Homo sapiens
cctctcagtactttg

SEQ ID NO: 1012323 - DNA, 13 bp, Homo sapiens
cctctcagtgttt

SEQ ID NO: 1012324 - DNA, 16 bp, Homo sapiens
cctctcatgtccctcc

SEQ ID NO: 1012325 - DNA, 17 bp, Homo sapiens
cctctcatgtccctcca

SEQ ID NO: 1012326 - DNA, 21 bp, Homo sapiens
cctctcatgtccctccaggga

SEQ ID NO: 1012327 - DNA, 15 bp, Homo sapiens
cctctccaaccactg

SEQ ID NO: 1012328 - DNA, 22 bp, Homo sapiens
cctctccaaccactgtgccact

SEQ ID NO: 1012329 - DNA, 12 bp, Homo sapiens
cctctccaaggg

SEQ ID NO: 1012330 - DNA, 18 bp, Homo sapiens
cctctccaccagacgcct

SEQ ID NO: 1012331 - DNA, 21 bp, Homo sapiens
cctctccaccagacgccttcc

SEQ ID NO: 1012332 - DNA, 15 bp, Homo sapiens
cctctccaccctcct

SEQ ID NO: 1012333 - DNA, 22 bp, Homo sapiens
cctctccaccctcctctagcca

SEQ ID NO: 1012334 - DNA, 16 bp, Homo sapiens
cctctccactccatgt

SEQ ID NO: 1012335 - DNA, 13 bp, Homo sapiens
cctctccactctt

SEQ ID NO: 1012336 - DNA, 13 bp, Homo sapiens
cctctccactgcc

SEQ ID NO: 1012337 - DNA, 16 bp, Homo sapiens
cctctccactgccttc

SEQ ID NO: 1012338 - DNA, 19 bp, Homo sapiens
cctctccactgccttcgat

SEQ ID NO: 1012339 - DNA, 11 bp, Homo sapiens
cctctccaggc

SEQ ID NO: 1012340 - DNA, 22 bp, Homo sapiens
cctctcccacagagtgctggac

SEQ ID NO: 1012341 - DNA, 11 bp, Homo sapiens
cctctcccagg

SEQ ID NO: 1012342 - DNA, 12 bp, Homo sapiens
cctctcccaggc

SEQ ID NO: 1012343 - DNA, 12 bp, Homo sapiens
cctctcccatca

SEQ ID NO: 1012344 - DNA, 16 bp, Homo sapiens
cctctcccatccccct

SEQ ID NO: 1012345 - DNA, 18 bp, Homo sapiens
cctctcccatccccctgc

SEQ ID NO: 1012346 - DNA, 12 bp, Homo sapiens
cctctccccaaa

SEQ ID NO: 1012347 - DNA, 19 bp, Homo sapiens
cctctcccccaaccccctg

SEQ ID NO: 1012348 - DNA, 22 bp, Homo sapiens
cctctccccctcctccagggaa

SEQ ID NO: 1012349 - DNA, 12 bp, Homo sapiens
cctctccccctt

SEQ ID NO: 1012350 - DNA, 17 bp, Homo sapiens
cctctcccccttcagct

SEQ ID NO: 1012351 - DNA, 19 bp, Homo sapiens
cctctcccccttcagctcc

SEQ ID NO: 1012352 - DNA, 16 bp, Homo sapiens
cctctcccctctctgc

SEQ ID NO: 1012353 - DNA, 17 bp, Homo sapiens
cctctcccggctgcctg

SEQ ID NO: 1012354 - DNA, 18 bp, Homo sapiens
cctctcccggctgcctgc

SEQ ID NO: 1012355 - DNA, 20 bp, Homo sapiens
cctctcccggctgcctgccg

SEQ ID NO: 1012356 - DNA, 22 bp, Homo sapiens
cctctcccggctgcctgccgcc

SEQ ID NO: 1012357 - DNA, 11 bp, Homo sapiens
cctctccctca

SEQ ID NO: 1012358 - DNA, 17 bp, Homo sapiens
cctctccctcaacaagg

SEQ ID NO: 1012359 - DNA, 22 bp, Homo sapiens
cctctccctcaacaagggagag

SEQ ID NO: 1012360 - DNA, 20 bp, Homo sapiens
cctctccctcaggggcaggt

SEQ ID NO: 1012361 - DNA, 12 bp, Homo sapiens
cctctccctgac

SEQ ID NO: 1012362 - DNA, 20 bp, Homo sapiens
cctctccctgtgttctgggc

SEQ ID NO: 1012363 - DNA, 22 bp, Homo sapiens
cctctccctgtgttctgggctg

SEQ ID NO: 1012364 - DNA, 13 bp, Homo sapiens
cctctcccttgag

SEQ ID NO: 1012365 - DNA, 23 bp, Homo sapiens
cctctccgaaagaagacacagaa

SEQ ID NO: 1012366 - DNA, 17 bp, Homo sapiens
cctctccgcgccctccg

SEQ ID NO: 1012367 - DNA, 18 bp, Homo sapiens
cctctccgcgggagaccc

SEQ ID NO: 1012368 - DNA, 20 bp, Homo sapiens
cctctccgcgggagacccct

SEQ ID NO: 1012369 - DNA, 11 bp, Homo sapiens
cctctcctccc

SEQ ID NO: 1012370 - DNA, 15 bp, Homo sapiens
cctctcctcccagct

SEQ ID NO: 1012371 - DNA, 18 bp, Homo sapiens
cctctcctcccagctgct

SEQ ID NO: 1012372 - DNA, 21 bp, Homo sapiens
cctctcctcccagctgcttta

SEQ ID NO: 1012373 - DNA, 14 bp, Homo sapiens
cctctcctcctcag

SEQ ID NO: 1012374 - DNA, 14 bp, Homo sapiens
cctctcctgcccag

SEQ ID NO: 1012375 - DNA, 21 bp, Homo sapiens
gattgatcacacagtgttagt

SEQ ID NO: 1012376 - DNA, 15 bp, Homo sapiens
gattgatttgaagaa

SEQ ID NO: 1012377 - DNA, 22 bp, Homo sapiens
gattgcaaatattggttagtat

SEQ ID NO: 1012378 - DNA, 15 bp, Homo sapiens
gattgcacagaattt

SEQ ID NO: 1012379 - DNA, 16 bp, Homo sapiens
gattgcacagagctgg

SEQ ID NO: 1012380 - DNA, 23 bp, Homo sapiens
gattgcaccactgcactccagcc

SEQ ID NO: 1012381 - DNA, 16 bp, Homo sapiens
gatttctcttgggcag

SEQ ID NO: 1012382 - DNA, 18 bp, Homo sapiens
gatttctcttgggcaggc

SEQ ID NO: 1012383 - DNA, 20 bp, Homo sapiens
gatttctgacatcaaaactt

SEQ ID NO: 1012384 - DNA, 17 bp, Homo sapiens
gatttctgcaggttctt

SEQ ID NO: 1012385 - DNA, 11 bp, Homo sapiens
gatttctggga

SEQ ID NO: 1012386 - DNA, 17 bp, Homo sapiens
gatttctgtaaactctg

SEQ ID NO: 1012387 - DNA, 11 bp, Homo sapiens
gatttctgttt

SEQ ID NO: 1012388 - DNA, 13 bp, Homo sapiens
gatttcttaaata

SEQ ID NO: 1012389 - DNA, 20 bp, Homo sapiens
gatttcttcaaatctcagca

SEQ ID NO: 1012390 - DNA, 24 bp, Homo sapiens
gatttcttcgctgctctagctggc

SEQ ID NO: 1012391 - DNA, 13 bp, Homo sapiens
gatttcttgcttt

SEQ ID NO: 1012392 - DNA, 20 bp, Homo sapiens
gatttctttaaaagaatgac

SEQ ID NO: 1012393 - DNA, 17 bp, Homo sapiens
gatttctttagtgtcat

SEQ ID NO: 1012394 - DNA, 15 bp, Homo sapiens
gatttctttccagag

SEQ ID NO: 1012395 - DNA, 22 bp, Homo sapiens
gatttctttctttgcaccaaag

SEQ ID NO: 1012396 - DNA, 14 bp, Homo sapiens
gatttctttgaaaa

SEQ ID NO: 1012397 - DNA, 15 bp, Homo sapiens
gatttgaaaaacttt

SEQ ID NO: 1012398 - DNA, 12 bp, Homo sapiens
gatttgaaaatt

SEQ ID NO: 1012399 - DNA, 16 bp, Homo sapiens
gatttgaaaattgtat

SEQ ID NO: 1012400 - DNA, 19 bp, Homo sapiens
gatttgaagaacatgtgag

SEQ ID NO: 1012401 - DNA, 16 bp, Homo sapiens
gatttgagctcagccc

SEQ ID NO: 1012402 - DNA, 19 bp, Homo sapiens
gatttgatgtgactttttt

SEQ ID NO: 1012403 - DNA, 15 bp, Homo sapiens
gatttgattcatttt

SEQ ID NO: 1012404 - DNA, 16 bp, Homo sapiens
gatttgattcattttc

SEQ ID NO: 1012405 - DNA, 21 bp, Homo sapiens
gatttgattcattttcctgtt

SEQ ID NO: 1012406 - DNA, 19 bp, Homo sapiens
gatttgcacgttggggagc

SEQ ID NO: 1012407 - DNA, 15 bp, Homo sapiens
gatttgcatggattt

SEQ ID NO: 1012408 - DNA, 18 bp, Homo sapiens
gatttgcatggattttgg

SEQ ID NO: 1012409 - DNA, 21 bp, Homo sapiens
gatttgcattgaacacaaact

SEQ ID NO: 1012410 - DNA, 17 bp, Homo sapiens
gatttgccagcacaggg

SEQ ID NO: 1012411 - DNA, 14 bp, Homo sapiens
gatttgccattcaa

SEQ ID NO: 1012412 - DNA, 19 bp, Homo sapiens
gatttggaagagaggcacc

SEQ ID NO: 1012413 - DNA, 23 bp, Homo sapiens
gatttggaagagaggcacctgct

SEQ ID NO: 1012414 - DNA, 18 bp, Homo sapiens
gatttggatcaaaaggag

SEQ ID NO: 1012415 - DNA, 19 bp, Homo sapiens
gatttggatcaaaaggaga

SEQ ID NO: 1012416 - DNA, 16 bp, Homo sapiens
gatttggcatgggaca

SEQ ID NO: 1012417 - DNA, 20 bp, Homo sapiens
gatttggcatgggacagacg

SEQ ID NO: 1012418 - DNA, 20 bp, Homo sapiens
gatttggcttgacaaaggca

SEQ ID NO: 1012419 - DNA, 17 bp, Homo sapiens
gatttgggctgaatgta

SEQ ID NO: 1012420 - DNA, 21 bp, Homo sapiens
gatttgggggctcggggaggc

SEQ ID NO: 1012421 - DNA, 23 bp, Homo sapiens
gatttggtgtaggtaggtctgtt

SEQ ID NO: 1012422 - DNA, 15 bp, Homo sapiens
gatttggttgcactt

SEQ ID NO: 1012423 - DNA, 14 bp, Homo sapiens
gatttgtactgaaa

SEQ ID NO: 1012424 - DNA, 19 bp, Homo sapiens
gatttgtagcataactgta

SEQ ID NO: 1012425 - DNA, 16 bp, Homo sapiens
gatttgtcccagcctg

SEQ ID NO: 1012426 - DNA, 21 bp, Homo sapiens
gatttgtcccagcctggggct

SEQ ID NO: 1012427 - DNA, 23 bp, Homo sapiens
gatttgtgaaacagttgctgtga

SEQ ID NO: 1012428 - DNA, 17 bp, Homo sapiens
gatttgtgcccattcct

SEQ ID NO: 1012429 - DNA, 18 bp, Homo sapiens
gatttgtgtttctttata

SEQ ID NO: 1012430 - DNA, 18 bp, Homo sapiens
gatttgtgtttttctttt

SEQ ID NO: 1012431 - DNA, 18 bp, Homo sapiens
gatttgttatggttacat

SEQ ID NO: 1012432 - DNA, 14 bp, Homo sapiens
gatttgttttgaat

SEQ ID NO: 1012433 - DNA, 18 bp, Homo sapiens
gatttgttttgaattttg

SEQ ID NO: 1012434 - DNA, 18 bp, Homo sapiens
gatttgtttttaaactgt

SEQ ID NO: 1012435 - DNA, 21 bp, Homo sapiens
gatttgtttttaaactgtaca

SEQ ID NO: 1012436 - DNA, 23 bp, Homo sapiens
gatttgtttttaaactgtacagt

SEQ ID NO: 1012437 - DNA, 19 bp, Homo sapiens
gatttgtttttgtattttt

SEQ ID NO: 1012438 - DNA, 17 bp, Homo sapiens
gattttaaaaaatcaat

SEQ ID NO: 1012439 - DNA, 19 bp, Homo sapiens
gattttaaaaaatcaatca

SEQ ID NO: 1012440 - DNA, 13 bp, Homo sapiens
gattttaaaatga

SEQ ID NO: 1012441 - DNA, 14 bp, Homo sapiens
gattttaaaggcag

SEQ ID NO: 1012442 - DNA, 20 bp, Homo sapiens
gattttaacttaactgaaat

SEQ ID NO: 1012443 - DNA, 23 bp, Homo sapiens
gattttaatagggaatatatctc

SEQ ID NO: 1012444 - DNA, 18 bp, Homo sapiens
gattttaatcaagttgaa

SEQ ID NO: 1012445 - DNA, 14 bp, Homo sapiens
gattttacaagtat

SEQ ID NO: 1012446 - DNA, 12 bp, Homo sapiens
gattttaccaaa

SEQ ID NO: 1012447 - DNA, 16 bp, Homo sapiens
gattttagaaaaacat

SEQ ID NO: 1012448 - DNA, 14 bp, Homo sapiens
gattttagcctctt

SEQ ID NO: 1012449 - DNA, 20 bp, Homo sapiens
gattttatctgtgaattcag

SEQ ID NO: 1012450 - DNA, 19 bp, Homo sapiens
gattttatgatcagtgttg

SEQ ID NO: 1012451 - DNA, 13 bp, Homo sapiens
gattttatgcaca

SEQ ID NO: 1012452 - DNA, 17 bp, Homo sapiens
gattttattacagaaat

SEQ ID NO: 1012453 - DNA, 15 bp, Homo sapiens
gattttattttacta

SEQ ID NO: 1012454 - DNA, 17 bp, Homo sapiens
gattttcaaaagataat

SEQ ID NO: 1012455 - DNA, 18 bp, Homo sapiens
gattttcaaagctttttc

SEQ ID NO: 1012456 - DNA, 19 bp, Homo sapiens
gattttcaaagctttttcc

SEQ ID NO: 1012457 - DNA, 20 bp, Homo sapiens
gattttcaagattctaaagc

SEQ ID NO: 1012458 - DNA, 14 bp, Homo sapiens
gattttcagttact

SEQ ID NO: 1012459 - DNA, 16 bp, Homo sapiens
gattttcatttcatga

SEQ ID NO: 1012460 - DNA, 20 bp, Homo sapiens
gattttctcactgaactcca

SEQ ID NO: 1012461 - DNA, 23 bp, Homo sapiens
gattttctcactgaactccaccg

SEQ ID NO: 1012462 - DNA, 15 bp, Homo sapiens
gattttctccagctc

SEQ ID NO: 1012463 - DNA, 19 bp, Homo sapiens
gattttctccatttgtcat

SEQ ID NO: 1012464 - DNA, 14 bp, Homo sapiens
gattttctctggaa

SEQ ID NO: 1012465 - DNA, 15 bp, Homo sapiens
gattttgaacttttt

SEQ ID NO: 1012466 - DNA, 12 bp, Homo sapiens
gattttgaatct

SEQ ID NO: 1012467 - DNA, 21 bp, Homo sapiens
gattttggggttgtgttgtca

SEQ ID NO: 1012468 - DNA, 21 bp, Homo sapiens
gattttggtattacactgtat

SEQ ID NO: 1012469 - DNA, 17 bp, Homo sapiens
gattttgtaagaagttt

SEQ ID NO: 1012470 - DNA, 21 bp, Homo sapiens
gatttttaaaaaatattttct

SEQ ID NO: 1012471 - DNA, 15 bp, Homo sapiens
gatttttaacaaaaa

SEQ ID NO: 1012472 - DNA, 16 bp, Homo sapiens
gatttttaagaacttc

SEQ ID NO: 1012473 - DNA, 19 bp, Homo sapiens
gatttttaatggttaagaa

SEQ ID NO: 1012474 - DNA, 15 bp, Homo sapiens
gatttttatgtctgg

SEQ ID NO: 1012475 - DNA, 11 bp, Homo sapiens
gatttttcctt

SEQ ID NO: 1012476 - DNA, 12 bp, Homo sapiens
gatttttccttt

SEQ ID NO: 1012477 - DNA, 16 bp, Homo sapiens
gatttttctaaccttg

SEQ ID NO: 1012478 - DNA, 14 bp, Homo sapiens
gatttttctcttca

SEQ ID NO: 1012479 - DNA, 14 bp, Homo sapiens
gatttttctttaca

SEQ ID NO: 1012480 - DNA, 13 bp, Homo sapiens
gatttttgcctct

SEQ ID NO: 1012481 - DNA, 20 bp, Homo sapiens
gattttttacagctgcctgc

SEQ ID NO: 1012482 - DNA, 23 bp, Homo sapiens
gattttttatgtacaaccctgac

SEQ ID NO: 1012483 - DNA, 21 bp, Homo sapiens
gattttttccttcaaagttta

SEQ ID NO: 1012484 - DNA, 19 bp, Homo sapiens
gatttttttaaagtagttc

SEQ ID NO: 1012485 - DNA, 19 bp, Homo sapiens
gatttttttaatagtgctt

SEQ ID NO: 1012486 - DNA, 13 bp, Homo sapiens
gatttttttcctc

SEQ ID NO: 1012487 - DNA, 17 bp, Homo sapiens
gatttttttgtgtatgt

SEQ ID NO: 1012488 - DNA, 15 bp, Homo sapiens
gatttttttttcata

SEQ ID NO: 1012489 - DNA, 17 bp, Homo sapiens
gattttttttttaagtg

SEQ ID NO: 1012490 - DNA, 23 bp, Homo sapiens
gatttttttttttgtttgtttga

SEQ ID NO: 1012491 - DNA, 21 bp, Homo sapiens
gatttttttttttttttcctt

SEQ ID NO: 1012492 - DNA, 13 bp, Homo sapiens
gcaaaaaaaaact

SEQ ID NO: 1012493 - DNA, 20 bp, Homo sapiens
gcaaaaaaaaacttaaagca

SEQ ID NO: 1012494 - DNA, 22 bp, Homo sapiens
gcaaaaaaaaacttaaagcaaa

SEQ ID NO: 1012495 - DNA, 19 bp, Homo sapiens
gcaaaaaaaaatttagcta

SEQ ID NO: 1012496 - DNA, 16 bp, Homo sapiens
gcaaaaaaagcctcca

SEQ ID NO: 1012497 - DNA, 17 bp, Homo sapiens
gcaaaaaaagcctccaa

SEQ ID NO: 1012498 - DNA, 22 bp, Homo sapiens
gcaaaaaaagcctccaagggtt

SEQ ID NO: 1012499 - DNA, 21 bp, Homo sapiens
gcaaaaaaattaaaatggatg

SEQ ID NO: 1012500 - DNA, 13 bp, Homo sapiens
gcaaaaaactctt

SEQ ID NO: 1012501 - DNA, 14 bp, Homo sapiens
gcaaaaaagaaaac

SEQ ID NO: 1012502 - DNA, 16 bp, Homo sapiens
gcaaaaaagtccaatt

SEQ ID NO: 1012503 - DNA, 14 bp, Homo sapiens
gcaaattactccaa

SEQ ID NO: 1012504 - DNA, 15 bp, Homo sapiens
gcaaattagaaacac

SEQ ID NO: 1012505 - DNA, 16 bp, Homo sapiens
gcaaattatttattac

SEQ ID NO: 1012506 - DNA, 17 bp, Homo sapiens
gcaaattatttattact

SEQ ID NO: 1012507 - DNA, 14 bp, Homo sapiens
gcaaattattttaa

SEQ ID NO: 1012508 - DNA, 16 bp, Homo sapiens
gcaaattgtttcagtt

SEQ ID NO: 1012509 - DNA, 17 bp, Homo sapiens
gcaaatttctataaatt

SEQ ID NO: 1012510 - DNA, 16 bp, Homo sapiens
gcaacaaacctcactg

SEQ ID NO: 1012511 - DNA, 12 bp, Homo sapiens
cctcttgccccc

SEQ ID NO: 1012512 - DNA, 16 bp, Homo sapiens
cctcttgccccccacc

SEQ ID NO: 1012513 - DNA, 21 bp, Homo sapiens
cctcttgccccccaccccagc

SEQ ID NO: 1012514 - DNA, 12 bp, Homo sapiens
cctcttgcccgc

SEQ ID NO: 1012515 - DNA, 21 bp, Homo sapiens
cctcttgcccgtcggccctgc

SEQ ID NO: 1012516 - DNA, 18 bp, Homo sapiens
cctcttgcgggcctggac

SEQ ID NO: 1012517 - DNA, 13 bp, Homo sapiens
cctcttgctgtct

SEQ ID NO: 1012518 - DNA, 15 bp, Homo sapiens
cctcttgctgtctct

SEQ ID NO: 1012519 - DNA, 20 bp, Homo sapiens
cctcttgctgtctctgctcg

SEQ ID NO: 1012520 - DNA, 23 bp, Homo sapiens
cctcttgctgtctctgctcgccc

SEQ ID NO: 1012521 - DNA, 23 bp, Homo sapiens
cctcttggaattacaagccctgg

SEQ ID NO: 1012522 - DNA, 19 bp, Homo sapiens
cctcttggacctctgctct

SEQ ID NO: 1012523 - DNA, 14 bp, Homo sapiens
cctcttggagaagt

SEQ ID NO: 1012524 - DNA, 19 bp, Homo sapiens
cctcttggagaagtctcag

SEQ ID NO: 1012525 - DNA, 22 bp, Homo sapiens
cctcttggagaagtctcagcta

SEQ ID NO: 1012526 - DNA, 23 bp, Homo sapiens
cctcttggataccagctcagggg

SEQ ID NO: 1012527 - DNA, 22 bp, Homo sapiens
cctcttggattaaggaagactg

SEQ ID NO: 1012528 - DNA, 19 bp, Homo sapiens
cctcttggtgtctggtttc

SEQ ID NO: 1012529 - DNA, 16 bp, Homo sapiens
cctcttgtaaagactg

SEQ ID NO: 1012530 - DNA, 13 bp, Homo sapiens
cctcttgtaaata

SEQ ID NO: 1012531 - DNA, 17 bp, Homo sapiens
cctcttgtaaataaagc

SEQ ID NO: 1012532 - DNA, 13 bp, Homo sapiens
cctcttgtccctt

SEQ ID NO: 1012533 - DNA, 15 bp, Homo sapiens
cctcttgtcctggcc

SEQ ID NO: 1012534 - DNA, 16 bp, Homo sapiens
cctcttgtcctggccc

SEQ ID NO: 1012535 - DNA, 21 bp, Homo sapiens
cctcttgtcctggcccttcag

SEQ ID NO: 1012536 - DNA, 22 bp, Homo sapiens
cctcttgtgcaaggtggccttt

SEQ ID NO: 1012537 - DNA, 15 bp, Homo sapiens
cctcttgttgcagag

SEQ ID NO: 1012538 - DNA, 13 bp, Homo sapiens
cctcttgtttctg

SEQ ID NO: 1012539 - DNA, 17 bp, Homo sapiens
cctcttgtttctgtgcc

SEQ ID NO: 1012540 - DNA, 18 bp, Homo sapiens
cctcttgtttctgtgccc

SEQ ID NO: 1012541 - DNA, 21 bp, Homo sapiens
cctctttaatgctgtctttgt

SEQ ID NO: 1012542 - DNA, 22 bp, Homo sapiens
cctctttaatgctgtctttgtg

SEQ ID NO: 1012543 - DNA, 15 bp, Homo sapiens
cctctttactctggg

SEQ ID NO: 1012544 - DNA, 13 bp, Homo sapiens
cctctttcatcca

SEQ ID NO: 1012545 - DNA, 17 bp, Homo sapiens
cctctttcccaccctcc

SEQ ID NO: 1012546 - DNA, 12 bp, Homo sapiens
cctctttctctc

SEQ ID NO: 1012547 - DNA, 20 bp, Homo sapiens
cctctttctctttcttcctt

SEQ ID NO: 1012548 - DNA, 21 bp, Homo sapiens
cctctttctctttcttccttt

SEQ ID NO: 1012549 - DNA, 15 bp, Homo sapiens
cctctttctgctctg

SEQ ID NO: 1012550 - DNA, 22 bp, Homo sapiens
cctctttctgctctgccatctt

SEQ ID NO: 1012551 - DNA, 14 bp, Homo sapiens
cctctttgctgcag

SEQ ID NO: 1012552 - DNA, 21 bp, Homo sapiens
cctctttgctttgctttctgc

SEQ ID NO: 1012553 - DNA, 18 bp, Homo sapiens
cctctttggctcccctgt

SEQ ID NO: 1012554 - DNA, 19 bp, Homo sapiens
cctctttggctcccctgta

SEQ ID NO: 1012555 - DNA, 17 bp, Homo sapiens
cctctttgtaataaaat

SEQ ID NO: 1012556 - DNA, 23 bp, Homo sapiens
cctctttgtgataattctcagta

SEQ ID NO: 1012557 - DNA, 20 bp, Homo sapiens
cctctttgttcttcctgtct

SEQ ID NO: 1012558 - DNA, 13 bp, Homo sapiens
cctcttttaccaa

SEQ ID NO: 1012559 - DNA, 21 bp, Homo sapiens
cctcttttcttactcctcctc

SEQ ID NO: 1012560 - DNA, 12 bp, Homo sapiens
cctcttttgtgc

SEQ ID NO: 1012561 - DNA, 19 bp, Homo sapiens
cctcttttgttaaataata

SEQ ID NO: 1012562 - DNA, 21 bp, Homo sapiens
cctcttttgttgtccttgccc

SEQ ID NO: 1012563 - DNA, 17 bp, Homo sapiens
cctctttttcctcctgg

SEQ ID NO: 1012564 - DNA, 18 bp, Homo sapiens
cctctttttcctcctgga

SEQ ID NO: 1012565 - DNA, 14 bp, Homo sapiens
cctctttttccttc

SEQ ID NO: 1012566 - DNA, 18 bp, Homo sapiens
cctctttttccttcttca

SEQ ID NO: 1012567 - DNA, 20 bp, Homo sapiens
cctctttttccttcttcagc

SEQ ID NO: 1012568 - DNA, 17 bp, Homo sapiens
cctgaaaacactgtgca

SEQ ID NO: 1012569 - DNA, 13 bp, Homo sapiens
cctgaaaacccag

SEQ ID NO: 1012570 - DNA, 17 bp, Homo sapiens
cctgaaaacccagagag

SEQ ID NO: 1012571 - DNA, 22 bp, Homo sapiens
cctgaaaaggtttatgaaaaag

SEQ ID NO: 1012572 - DNA, 14 bp, Homo sapiens
cctgaaaagttgaa

SEQ ID NO: 1012573 - DNA, 14 bp, Homo sapiens
cctgaaaatatgtc

SEQ ID NO: 1012574 - DNA, 14 bp, Homo sapiens
cctgaaacactgga

SEQ ID NO: 1012575 - DNA, 16 bp, Homo sapiens
cctgaaacactggacc

SEQ ID NO: 1012576 - DNA, 19 bp, Homo sapiens
cctgaaacccaaagccctg

SEQ ID NO: 1012577 - DNA, 19 bp, Homo sapiens
cctgaaacccgccctcagg

SEQ ID NO: 1012578 - DNA, 20 bp, Homo sapiens
cctgaaacccgccctcaggg

SEQ ID NO: 1012579 - DNA, 20 bp, Homo sapiens
cctgaaagagaagatggcca

SEQ ID NO: 1012580 - DNA, 15 bp, Homo sapiens
cctgaaagaggctga

SEQ ID NO: 1012581 - DNA, 18 bp, Homo sapiens
cctgaaagccctgagctt

SEQ ID NO: 1012582 - DNA, 13 bp, Homo sapiens
cctgaaagcctca

SEQ ID NO: 1012583 - DNA, 14 bp, Homo sapiens
cctgaaagcctcac

SEQ ID NO: 1012584 - DNA, 13 bp, Homo sapiens
cctgaaagcctgt

SEQ ID NO: 1012585 - DNA, 20 bp, Homo sapiens
cctgaaagcctgtctctttc

SEQ ID NO: 1012586 - DNA, 22 bp, Homo sapiens
cctgaaagggcccttcccctcc

SEQ ID NO: 1012587 - DNA, 22 bp, Homo sapiens
cctgaaatgccaagtgcctgct

SEQ ID NO: 1012588 - DNA, 21 bp, Homo sapiens
cctgaacatccttccttccca

SEQ ID NO: 1012589 - DNA, 21 bp, Homo sapiens
cctgaaccacgaggctgcccc

SEQ ID NO: 1012590 - DNA, 17 bp, Homo sapiens
cctgaacccacacctgg

SEQ ID NO: 1012591 - DNA, 18 bp, Homo sapiens
cctgaacccacacctggg

SEQ ID NO: 1012592 - DNA, 15 bp, Homo sapiens
cctgaaccccatggg

SEQ ID NO: 1012593 - DNA, 17 bp, Homo sapiens
cctgaaccccatgggct

SEQ ID NO: 1012594 - DNA, 15 bp, Homo sapiens
cctgaacccctggcc

SEQ ID NO: 1012595 - DNA, 16 bp, Homo sapiens
cctgaacccctggcca

SEQ ID NO: 1012596 - DNA, 14 bp, Homo sapiens
cctgaaccgactga

SEQ ID NO: 1012597 - DNA, 18 bp, Homo sapiens
cctgaaccgactgaccct

SEQ ID NO: 1012598 - DNA, 22 bp, Homo sapiens
cctgaaccgactgaccctgagg

SEQ ID NO: 1012599 - DNA, 15 bp, Homo sapiens
cctgaaccgcacagc

SEQ ID NO: 1012600 - DNA, 20 bp, Homo sapiens
cctgaaccgcacagctcagg

SEQ ID NO: 1012601 - DNA, 21 bp, Homo sapiens
cctgaaccgcacagctcagga

SEQ ID NO: 1012602 - DNA, 18 bp, Homo sapiens
cctgaacgttttcttctt

SEQ ID NO: 1012603 - DNA, 13 bp, Homo sapiens
cctgaactgagga

SEQ ID NO: 1012604 - DNA, 16 bp, Homo sapiens
cctgaactttctccct

SEQ ID NO: 1012605 - DNA, 16 bp, Homo sapiens
cctgaagaactatttt

SEQ ID NO: 1012606 - DNA, 18 bp, Homo sapiens
cctgaagaattaagatac

SEQ ID NO: 1012607 - DNA, 22 bp, Homo sapiens
cctgaagacgagcatccccctc

SEQ ID NO: 1012608 - DNA, 12 bp, Homo sapiens
cctgaagactga

SEQ ID NO: 1012609 - DNA, 15 bp, Homo sapiens
cctgaagactgagga

SEQ ID NO: 1012610 - DNA, 19 bp, Homo sapiens
cctgaagagcgctcctctg

SEQ ID NO: 1012611 - DNA, 20 bp, Homo sapiens
cctgaagaggcgggccagcc

SEQ ID NO: 1012612 - DNA, 22 bp, Homo sapiens
cctgaagaggcgggccagccag

SEQ ID NO: 1012613 - DNA, 13 bp, Homo sapiens
cctgaagatgtct

SEQ ID NO: 1012614 - DNA, 14 bp, Homo sapiens
cctgaagatgtctc

SEQ ID NO: 1012615 - DNA, 17 bp, Homo sapiens
cctgaagatgtctcctc

SEQ ID NO: 1012616 - DNA, 13 bp, Homo sapiens
cctgaagccagat

SEQ ID NO: 1012617 - DNA, 14 bp, Homo sapiens
cctgaagcctccgt

SEQ ID NO: 1012618 - DNA, 12 bp, Homo sapiens
cctgaagcctgg

SEQ ID NO: 1012619 - DNA, 13 bp, Homo sapiens
cctgaagcctgga

SEQ ID NO: 1012620 - DNA, 16 bp, Homo sapiens
cctgaagcctggattc

SEQ ID NO: 1012621 - DNA, 18 bp, Homo sapiens
cctgaagctgctgtgtcc

SEQ ID NO: 1012622 - DNA, 14 bp, Homo sapiens
cctgaagctggcct

SEQ ID NO: 1012623 - DNA, 17 bp, Homo sapiens
cctgaagcttcggccgc

SEQ ID NO: 1012624 - DNA, 21 bp, Homo sapiens
cctgaagggaaggcaaaggca

SEQ ID NO: 1012625 - DNA, 16 bp, Homo sapiens
cctgaggagccctgag

SEQ ID NO: 1012626 - DNA, 18 bp, Homo sapiens
cctgaggaggaggacaca

SEQ ID NO: 1012627 - DNA, 16 bp, Homo sapiens
cctgaggaggccgctt

SEQ ID NO: 1012628 - DNA, 13 bp, Homo sapiens
cctgaggatgagc

SEQ ID NO: 1012629 - DNA, 16 bp, Homo sapiens
cctgaggatgagctgg

SEQ ID NO: 1012630 - DNA, 20 bp, Homo sapiens
cctgaggatgagctggaagg

SEQ ID NO: 1012631 - DNA, 20 bp, Homo sapiens
cctgaggatgggtcagagct

SEQ ID NO: 1012632 - DNA, 21 bp, Homo sapiens
cctgaggcaggagaatcgctt

SEQ ID NO: 1012633 - DNA, 15 bp, Homo sapiens
cctgaggccagtggc

SEQ ID NO: 1012634 - DNA, 17 bp, Homo sapiens
cctgaggccagtggccc

SEQ ID NO: 1012635 - DNA, 18 bp, Homo sapiens
cctgaggccagtggcccc

SEQ ID NO: 1012636 - DNA, 19 bp, Homo sapiens
cctgaggccagtggccccc

SEQ ID NO: 1012637 - DNA, 16 bp, Homo sapiens
cctgaggccctgggct

SEQ ID NO: 1012638 - DNA, 21 bp, Homo sapiens
cctgaggcggaggctgtgctc

SEQ ID NO: 1012639 - DNA, 17 bp, Homo sapiens
cctgaggctcagggaaa

SEQ ID NO: 1012640 - DNA, 15 bp, Homo sapiens
cctgaggctgtggtc

SEQ ID NO: 1012641 - DNA, 22 bp, Homo sapiens
gcaaggccttggtggagcagcc

SEQ ID NO: 1012642 - DNA, 19 bp, Homo sapiens
gcaaggcgcctgccttggg

SEQ ID NO: 1012643 - DNA, 16 bp, Homo sapiens
gcaaggctgctgccgg

SEQ ID NO: 1012644 - DNA, 12 bp, Homo sapiens
gcaaggctgggt

SEQ ID NO: 1012645 - DNA, 15 bp, Homo sapiens
gcaagggacctgctc

SEQ ID NO: 1012646 - DNA, 20 bp, Homo sapiens
gcaagggacctgctcatcat

SEQ ID NO: 1012647 - DNA, 20 bp, Homo sapiens
gcaagggagaaaagagaaac

SEQ ID NO: 1012648 - DNA, 22 bp, Homo sapiens
gcaagggcacaaactgcagctg

SEQ ID NO: 1012649 - DNA, 18 bp, Homo sapiens
gcaagggcatcaggcact

SEQ ID NO: 1012650 - DNA, 19 bp, Homo sapiens
gcaagggccatgctgaagg

SEQ ID NO: 1012651 - DNA, 10 bp, Homo sapiens
gcaagggctc

SEQ ID NO: 1012652 - DNA, 11 bp, Homo sapiens
gcaagggctcc

SEQ ID NO: 1012653 - DNA, 13 bp, Homo sapiens
gcaagggctccag

SEQ ID NO: 1012654 - DNA, 16 bp, Homo sapiens
gcaagggctccagcat

SEQ ID NO: 1012655 - DNA, 19 bp, Homo sapiens
gcaagggctccagcatcca

SEQ ID NO: 1012656 - DNA, 20 bp, Homo sapiens
gcaagggctccagcatccag

SEQ ID NO: 1012657 - DNA, 21 bp, Homo sapiens
gcaagggctccagcatccagc

SEQ ID NO: 1012658 - DNA, 13 bp, Homo sapiens
gcaagggctccta

SEQ ID NO: 1012659 - DNA, 13 bp, Homo sapiens
gcaaggggacctt

SEQ ID NO: 1012660 - DNA, 23 bp, Homo sapiens
gcaagggggtgtcatctgaggag

SEQ ID NO: 1012661 - DNA, 15 bp, Homo sapiens
gcaagggtgcctcag

SEQ ID NO: 1012662 - DNA, 18 bp, Homo sapiens
gcaaggtatttctccagt

SEQ ID NO: 1012663 - DNA, 14 bp, Homo sapiens
gcaaggtcattttt

SEQ ID NO: 1012664 - DNA, 18 bp, Homo sapiens
gcaaggtccggcccatcc

SEQ ID NO: 1012665 - DNA, 22 bp, Homo sapiens
gcaaggtctccttactctgagc

SEQ ID NO: 1012666 - DNA, 21 bp, Homo sapiens
gcaaggtgctcacaccccatt

SEQ ID NO: 1012667 - DNA, 17 bp, Homo sapiens
gcaaggtggcctctgcc

SEQ ID NO: 1012668 - DNA, 14 bp, Homo sapiens
gcaaggtttaagtt

SEQ ID NO: 1012669 - DNA, 21 bp, Homo sapiens
gcaaggtttaggctggtggcc

SEQ ID NO: 1012670 - DNA, 23 bp, Homo sapiens
gcaaggtttaggctggtggccca

SEQ ID NO: 1012671 - DNA, 18 bp, Homo sapiens
gcaaggtttcgtggcagc

SEQ ID NO: 1012672 - DNA, 16 bp, Homo sapiens
gcaagtagcaggacta

SEQ ID NO: 1012673 - DNA, 18 bp, Homo sapiens
gcaagtagctttccacat

SEQ ID NO: 1012674 - DNA, 18 bp, Homo sapiens
gcaagtcccagacaagga

SEQ ID NO: 1012675 - DNA, 17 bp, Homo sapiens
gcaagtcgagagggctg

SEQ ID NO: 1012676 - DNA, 11 bp, Homo sapiens
gcaagtctctt

SEQ ID NO: 1012677 - DNA, 18 bp, Homo sapiens
gcaagtctgagggtctgg

SEQ ID NO: 1012678 - DNA, 14 bp, Homo sapiens
gcaagtgagagggg

SEQ ID NO: 1012679 - DNA, 15 bp, Homo sapiens
gcaagtgagagggga

SEQ ID NO: 1012680 - DNA, 16 bp, Homo sapiens
gcaagtgagaggggag

SEQ ID NO: 1012681 - DNA, 21 bp, Homo sapiens
gcaagtgagaggggagggagg

SEQ ID NO: 1012682 - DNA, 13 bp, Homo sapiens
gcaagtgagcaga

SEQ ID NO: 1012683 - DNA, 22 bp, Homo sapiens
gcaagtgagcagagatgtactg

SEQ ID NO: 1012684 - DNA, 18 bp, Homo sapiens
gcaagtgatatcacctct

SEQ ID NO: 1012685 - DNA, 12 bp, Homo sapiens
gcaagtgctgga

SEQ ID NO: 1012686 - DNA, 21 bp, Homo sapiens
gcaagtgctggagtctcctga

SEQ ID NO: 1012687 - DNA, 16 bp, Homo sapiens
gcaagtggatgggaat

SEQ ID NO: 1012688 - DNA, 23 bp, Homo sapiens
gcaagtggatgggaatttgtcag

SEQ ID NO: 1012689 - DNA, 22 bp, Homo sapiens
gcaagtggggtgagtggatgaa

SEQ ID NO: 1012690 - DNA, 16 bp, Homo sapiens
gcaagtgtgcactcca

SEQ ID NO: 1012691 - DNA, 14 bp, Homo sapiens
gcaagtgtgtgagt

SEQ ID NO: 1012692 - DNA, 13 bp, Homo sapiens
gcaagtgtgtgca

SEQ ID NO: 1012693 - DNA, 21 bp, Homo sapiens
gcaagtgtgtgcatgtgtgcg

SEQ ID NO: 1012694 - DNA, 22 bp, Homo sapiens
gcaagtgtgtgcatgtgtgcga

SEQ ID NO: 1012695 - DNA, 23 bp, Homo sapiens
gcaagttattttatttgcttatt

SEQ ID NO: 1012696 - DNA, 21 bp, Homo sapiens
gcaagttctagagaagaggct

SEQ ID NO: 1012697 - DNA, 23 bp, Homo sapiens
gcaagtttctgtttcaaagcaca

SEQ ID NO: 1012698 - DNA, 11 bp, Homo sapiens
gcaataaactc

SEQ ID NO: 1012699 - DNA, 13 bp, Homo sapiens
gcaataaagaaga

SEQ ID NO: 1012700 - DNA, 18 bp, Homo sapiens
gcaataacactatattta

SEQ ID NO: 1012701 - DNA, 12 bp, Homo sapiens
gcaataactatt

SEQ ID NO: 1012702 - DNA, 14 bp, Homo sapiens
gcaataagaaatga

SEQ ID NO: 1012703 - DNA, 14 bp, Homo sapiens
gcaataataataaa

SEQ ID NO: 1012704 - DNA, 18 bp, Homo sapiens
gcaataatatcaaaacaa

SEQ ID NO: 1012705 - DNA, 19 bp, Homo sapiens
gcaataatatcaaaacaag

SEQ ID NO: 1012706 - DNA, 18 bp, Homo sapiens
gcaataatggtcccatcc

SEQ ID NO: 1012707 - DNA, 19 bp, Homo sapiens
gcaataatggtcccatcca

SEQ ID NO: 1012708 - DNA, 21 bp, Homo sapiens
gcaataatggtcccatccagg

SEQ ID NO: 1012709 - DNA, 20 bp, Homo sapiens
gcaataatttgtacaatggt

SEQ ID NO: 1012710 - DNA, 22 bp, Homo sapiens
gcaataatttgtacaatggttt

SEQ ID NO: 1012711 - DNA, 19 bp, Homo sapiens
gcaatacaactttaccata

SEQ ID NO: 1012712 - DNA, 23 bp, Homo sapiens
gcaatacgacgtgggaatttcaa

SEQ ID NO: 1012713 - DNA, 20 bp, Homo sapiens
gcaatacgggagtgacccag

SEQ ID NO: 1012714 - DNA, 15 bp, Homo sapiens
gcaatactggaatat

SEQ ID NO: 1012715 - DNA, 14 bp, Homo sapiens
gcaatagagactgt

SEQ ID NO: 1012716 - DNA, 22 bp, Homo sapiens
gcaatagtgcaacatctctgaa

SEQ ID NO: 1012717 - DNA, 13 bp, Homo sapiens
gcaatagtgtgtt

SEQ ID NO: 1012718 - DNA, 20 bp, Homo sapiens
gcaatatcttcgttagtaat

SEQ ID NO: 1012719 - DNA, 14 bp, Homo sapiens
gcaatatgtaaata

SEQ ID NO: 1012720 - DNA, 21 bp, Homo sapiens
gcaatattctgtaactattgg

SEQ ID NO: 1012721 - DNA, 15 bp, Homo sapiens
gcaatcacaggaaaa

SEQ ID NO: 1012722 - DNA, 23 bp, Homo sapiens
gcaatccatgatctatacacata

SEQ ID NO: 1012723 - DNA, 18 bp, Homo sapiens
gcaatcctcctacctcag

SEQ ID NO: 1012724 - DNA, 16 bp, Homo sapiens
gcaatctttgaaataa

SEQ ID NO: 1012725 - DNA, 15 bp, Homo sapiens
gcaatgaaaaattct

SEQ ID NO: 1012726 - DNA, 18 bp, Homo sapiens
gcaatgacaggtaaatta

SEQ ID NO: 1012727 - DNA, 19 bp, Homo sapiens
gcaatgacatctcaggggc

SEQ ID NO: 1012728 - DNA, 21 bp, Homo sapiens
gcaatgacatctcaggggcca

SEQ ID NO: 1012729 - DNA, 16 bp, Homo sapiens
gcaatgatgaatgaga

SEQ ID NO: 1012730 - DNA, 17 bp, Homo sapiens
gcaatgccatcagcccc

SEQ ID NO: 1012731 - DNA, 20 bp, Homo sapiens
gcaatgccatcagcccctgg

SEQ ID NO: 1012732 - DNA, 22 bp, Homo sapiens
gcaatgccatcagcccctggga

SEQ ID NO: 1012733 - DNA, 23 bp, Homo sapiens
gcaatgccatcagcccctgggaa

SEQ ID NO: 1012734 - DNA, 17 bp, Homo sapiens
gcaatgcttaaactaaa

SEQ ID NO: 1012735 - DNA, 15 bp, Homo sapiens
gcaatggccagagcc

SEQ ID NO: 1012736 - DNA, 16 bp, Homo sapiens
gcaatggccagagcct

SEQ ID NO: 1012737 - DNA, 14 bp, Homo sapiens
gcaatgggcactgg

SEQ ID NO: 1012738 - DNA, 18 bp, Homo sapiens
gcaatgggggagggaggg

SEQ ID NO: 1012739 - DNA, 13 bp, Homo sapiens
gcaatgtaaatat

SEQ ID NO: 1012740 - DNA, 15 bp, Homo sapiens
gcaatgtaaatattt

SEQ ID NO: 1012741 - DNA, 19 bp, Homo sapiens
gcaatgtaaatattttaaa

SEQ ID NO: 1012742 - DNA, 22 bp, Homo sapiens
gcaatgtcaggaacagaaggat

SEQ ID NO: 1012743 - DNA, 19 bp, Homo sapiens
gcaatgtctgagtgaacct

SEQ ID NO: 1012744 - DNA, 14 bp, Homo sapiens
gcaatgtgaaaaat

SEQ ID NO: 1012745 - DNA, 15 bp, Homo sapiens
gcaatgtgccttgat

SEQ ID NO: 1012746 - DNA, 21 bp, Homo sapiens
gcaattaaacttccaaagaaa

SEQ ID NO: 1012747 - DNA, 20 bp, Homo sapiens
gcaccagctctgtggcctgt

SEQ ID NO: 1012748 - DNA, 17 bp, Homo sapiens
gcaccagctgctctgcc

SEQ ID NO: 1012749 - DNA, 19 bp, Homo sapiens
gcaccagctgctctgcccc

SEQ ID NO: 1012750 - DNA, 21 bp, Homo sapiens
gcaccagctgctctgcccctt

SEQ ID NO: 1012751 - DNA, 17 bp, Homo sapiens
gcaccagcttctccagg

SEQ ID NO: 1012752 - DNA, 13 bp, Homo sapiens
gcaccaggaagcc

SEQ ID NO: 1012753 - DNA, 18 bp, Homo sapiens
gcaccaggaagtgtttat

SEQ ID NO: 1012754 - DNA, 20 bp, Homo sapiens
gcaccatctctgattttcaa

SEQ ID NO: 1012755 - DNA, 14 bp, Homo sapiens
gcaccatctgcttg

SEQ ID NO: 1012756 - DNA, 16 bp, Homo sapiens
gcaccattctcctgcc

SEQ ID NO: 1012757 - DNA, 20 bp, Homo sapiens
gcaccattctcctgcctcag

SEQ ID NO: 1012758 - DNA, 22 bp, Homo sapiens
gcaccattttcaatttggagca

SEQ ID NO: 1012759 - DNA, 14 bp, Homo sapiens
gcacccacaagccc

SEQ ID NO: 1012760 - DNA, 19 bp, Homo sapiens
gcacccacaagtgccactg

SEQ ID NO: 1012761 - DNA, 14 bp, Homo sapiens
gcacccaccctggg

SEQ ID NO: 1012762 - DNA, 17 bp, Homo sapiens
gcacccaccctgggacc

SEQ ID NO: 1012763 - DNA, 12 bp, Homo sapiens
gcacccaccgtc

SEQ ID NO: 1012764 - DNA, 22 bp, Homo sapiens
gcacccaccgtctcggccctga

SEQ ID NO: 1012765 - DNA, 19 bp, Homo sapiens
gcacccaccgtggaggagg

SEQ ID NO: 1012766 - DNA, 17 bp, Homo sapiens
gcacccacctccacccc

SEQ ID NO: 1012767 - DNA, 16 bp, Homo sapiens
gcacccagctccaggg

SEQ ID NO: 1012768 - DNA, 18 bp, Homo sapiens
gcacccagctccaggggc

SEQ ID NO: 1012769 - DNA, 17 bp, Homo sapiens
gcaccccaaagctttcc

SEQ ID NO: 1012770 - DNA, 13 bp, Homo sapiens
gcaccccaaggct

SEQ ID NO: 1012771 - DNA, 19 bp, Homo sapiens
gcaccccagcgtcaggcct

SEQ ID NO: 1012772 - DNA, 20 bp, Homo sapiens
gcaccccagcgtcaggccta

SEQ ID NO: 1012773 - DNA, 15 bp, Homo sapiens
gcacccccaagcctg

SEQ ID NO: 1012774 - DNA, 10 bp, Homo sapiens
ctttcctgcc

SEQ ID NO: 1012775 - DNA, 11 bp, Homo sapiens
ctttcctgccc

SEQ ID NO: 1012776 - DNA, 19 bp, Homo sapiens
ctttcctgccccaggcctg

SEQ ID NO: 1012777 - DNA, 18 bp, Homo sapiens
ctttcctgccctgtccaa

SEQ ID NO: 1012778 - DNA, 23 bp, Homo sapiens
ctttcctggacactcagacctga

SEQ ID NO: 1012779 - DNA, 17 bp, Homo sapiens
ctttcctgggcctttgc

SEQ ID NO: 1012780 - DNA, 10 bp, Homo sapiens
ctttcctgtc

SEQ ID NO: 1012781 - DNA, 13 bp, Homo sapiens
ctttcctgtccca

SEQ ID NO: 1012782 - DNA, 16 bp, Homo sapiens
ctttcctgtgccaacc

SEQ ID NO: 1012783 - DNA, 14 bp, Homo sapiens
ctttccttcactgc

SEQ ID NO: 1012784 - DNA, 18 bp, Homo sapiens
ctttccttcactgcccca

SEQ ID NO: 1012785 - DNA, 11 bp, Homo sapiens
ctttccttccc

SEQ ID NO: 1012786 - DNA, 13 bp, Homo sapiens
ctttccttccctc

SEQ ID NO: 1012787 - DNA, 17 bp, Homo sapiens
ctttccttccctctctg

SEQ ID NO: 1012788 - DNA, 11 bp, Homo sapiens
ctttccttcct

SEQ ID NO: 1012789 - DNA, 16 bp, Homo sapiens
ctttccttccttccct

SEQ ID NO: 1012790 - DNA, 17 bp, Homo sapiens
ctttccttgagctgttg

SEQ ID NO: 1012791 - DNA, 19 bp, Homo sapiens
ctttcgatacccaggacca

SEQ ID NO: 1012792 - DNA, 22 bp, Homo sapiens
ctttcggggagaggctgaggac

SEQ ID NO: 1012793 - DNA, 13 bp, Homo sapiens
ctttcggggaggg

SEQ ID NO: 1012794 - DNA, 14 bp, Homo sapiens
ctttcggggagggc

SEQ ID NO: 1012795 - DNA, 15 bp, Homo sapiens
ctttcgtacattggc

SEQ ID NO: 1012796 - DNA, 22 bp, Homo sapiens
ctttcgttctgctgaccaaatg

SEQ ID NO: 1012797 - DNA, 13 bp, Homo sapiens
ctttctaaaactg

SEQ ID NO: 1012798 - DNA, 16 bp, Homo sapiens
ctttctaagaaatcaa

SEQ ID NO: 1012799 - DNA, 17 bp, Homo sapiens
ctttctaatagagagat

SEQ ID NO: 1012800 - DNA, 22 bp, Homo sapiens
ctttctaatcctatctggggag

SEQ ID NO: 1012801 - DNA, 17 bp, Homo sapiens
ctttctaatgtgtgaat

SEQ ID NO: 1012802 - DNA, 15 bp, Homo sapiens
ctttctacaatgtga

SEQ ID NO: 1012803 - DNA, 19 bp, Homo sapiens
ctttctagccataataaaa

SEQ ID NO: 1012804 - DNA, 14 bp, Homo sapiens
ctttctagccttag

SEQ ID NO: 1012805 - DNA, 20 bp, Homo sapiens
ctttctagccttagacaaat

SEQ ID NO: 1012806 - DNA, 14 bp, Homo sapiens
ctttctagctgttg

SEQ ID NO: 1012807 - DNA, 21 bp, Homo sapiens
ctttctagtcctattctattg

SEQ ID NO: 1012808 - DNA, 13 bp, Homo sapiens
ctttctagttcaa

SEQ ID NO: 1012809 - DNA, 20 bp, Homo sapiens
ctttctagttcaatgcctca

SEQ ID NO: 1012810 - DNA, 17 bp, Homo sapiens
ctttctagttcagctgc

SEQ ID NO: 1012811 - DNA, 21 bp, Homo sapiens
ctttctagttgaaaataaagt

SEQ ID NO: 1012812 - DNA, 23 bp, Homo sapiens
ctttctatataaaatgtattcaa

SEQ ID NO: 1012813 - DNA, 17 bp, Homo sapiens
ctttctatcctctgtaa

SEQ ID NO: 1012814 - DNA, 17 bp, Homo sapiens
ctttctcaatgtcttcc

SEQ ID NO: 1012815 - DNA, 22 bp, Homo sapiens
ctttctcagccgcttctgactg

SEQ ID NO: 1012816 - DNA, 24 bp, Homo sapiens
ctttctcagggggtcagcagagtt

SEQ ID NO: 1012817 - DNA, 16 bp, Homo sapiens
ctttctcagttttcat

SEQ ID NO: 1012818 - DNA, 14 bp, Homo sapiens
ctttctccagccag

SEQ ID NO: 1012819 - DNA, 15 bp, Homo sapiens
ctttctccagccagc

SEQ ID NO: 1012820 - DNA, 19 bp, Homo sapiens
ctttctccagccagcaatg

SEQ ID NO: 1012821 - DNA, 13 bp, Homo sapiens
ctttctccaggac

SEQ ID NO: 1012822 - DNA, 17 bp, Homo sapiens
ctttctcccagtgaaat

SEQ ID NO: 1012823 - DNA, 21 bp, Homo sapiens
ctttctcccccgacactgctg

SEQ ID NO: 1012824 - DNA, 13 bp, Homo sapiens
ctttctccctcaa

SEQ ID NO: 1012825 - DNA, 19 bp, Homo sapiens
ctttctccctcaactgaag

SEQ ID NO: 1012826 - DNA, 21 bp, Homo sapiens
ctttctccctcaactgaaggg

SEQ ID NO: 1012827 - DNA, 16 bp, Homo sapiens
ctttctccctgcagcc

SEQ ID NO: 1012828 - DNA, 13 bp, Homo sapiens
ctttctccctttt

SEQ ID NO: 1012829 - DNA, 21 bp, Homo sapiens
ctttctccggggtctgtgctg

SEQ ID NO: 1012830 - DNA, 21 bp, Homo sapiens
ctttctcctcaggacaaggcc

SEQ ID NO: 1012831 - DNA, 21 bp, Homo sapiens
ctttctcctccccacctgtag

SEQ ID NO: 1012832 - DNA, 14 bp, Homo sapiens
ctttctcctggaga

SEQ ID NO: 1012833 - DNA, 20 bp, Homo sapiens
ctttctcctggagatagctg

SEQ ID NO: 1012834 - DNA, 21 bp, Homo sapiens
ctttctcctggagatagctgg

SEQ ID NO: 1012835 - DNA, 12 bp, Homo sapiens
ctttctcctggt

SEQ ID NO: 1012836 - DNA, 14 bp, Homo sapiens
ctttctcctggtga

SEQ ID NO: 1012837 - DNA, 12 bp, Homo sapiens
ctttctcctgtg

SEQ ID NO: 1012838 - DNA, 22 bp, Homo sapiens
ctttctcctgtgaatggaggca

SEQ ID NO: 1012839 - DNA, 13 bp, Homo sapiens
ctttctcctgtgc

SEQ ID NO: 1012840 - DNA, 15 bp, Homo sapiens
ctttctcctgtgccc

SEQ ID NO: 1012841 - DNA, 21 bp, Homo sapiens
ctttctccttagtcttctcat

SEQ ID NO: 1012842 - DNA, 18 bp, Homo sapiens
ctttctcctttaattgta

SEQ ID NO: 1012843 - DNA, 20 bp, Homo sapiens
ctttctcgtggtagaagcca

SEQ ID NO: 1012844 - DNA, 16 bp, Homo sapiens
ctttctctaataataa

SEQ ID NO: 1012845 - DNA, 17 bp, Homo sapiens
ctttctctaataataaa

SEQ ID NO: 1012846 - DNA, 13 bp, Homo sapiens
ctttctctacttt

SEQ ID NO: 1012847 - DNA, 17 bp, Homo sapiens
ctttctctcactgtcta

SEQ ID NO: 1012848 - DNA, 13 bp, Homo sapiens
ctttctctcagaa

SEQ ID NO: 1012849 - DNA, 13 bp, Homo sapiens
ctttctctcccca

SEQ ID NO: 1012850 - DNA, 18 bp, Homo sapiens
ctttctctccccaacccc

SEQ ID NO: 1012851 - DNA, 22 bp, Homo sapiens
ctttctctcctcagtttacatc

SEQ ID NO: 1012852 - DNA, 14 bp, Homo sapiens
ctttctctcctggc

SEQ ID NO: 1012853 - DNA, 21 bp, Homo sapiens
ctttctctcctggctcggggt

SEQ ID NO: 1012854 - DNA, 15 bp, Homo sapiens
ctttctctctcctct

SEQ ID NO: 1012855 - DNA, 13 bp, Homo sapiens
ctttctctcttcc

SEQ ID NO: 1012856 - DNA, 15 bp, Homo sapiens
ctttctctcttccct

SEQ ID NO: 1012857 - DNA, 22 bp, Homo sapiens
ctttctctctttatacagctgt

SEQ ID NO: 1012858 - DNA, 16 bp, Homo sapiens
ctttctctgcctctgg

SEQ ID NO: 1012859 - DNA, 18 bp, Homo sapiens
ctttctctgcctctgggc

SEQ ID NO: 1012860 - DNA, 15 bp, Homo sapiens
ctttctcttacctgt

SEQ ID NO: 1012861 - DNA, 17 bp, Homo sapiens
ctttctcttccccttcc

SEQ ID NO: 1012862 - DNA, 15 bp, Homo sapiens
ctttctcttccctga

SEQ ID NO: 1012863 - DNA, 24 bp, Homo sapiens
ctttctcttccctgaacgttttct

SEQ ID NO: 1012864 - DNA, 20 bp, Homo sapiens
ctttctcttccttttatata

SEQ ID NO: 1012865 - DNA, 15 bp, Homo sapiens
ctttctctttcttcc

SEQ ID NO: 1012866 - DNA, 21 bp, Homo sapiens
ctttctcttttcccctttcct

SEQ ID NO: 1012867 - DNA, 22 bp, Homo sapiens
ctttctcttttcccctttcctg

SEQ ID NO: 1012868 - DNA, 17 bp, Homo sapiens
ctttctgaattgcacat

SEQ ID NO: 1012869 - DNA, 16 bp, Homo sapiens
ctttctgactgtccct

SEQ ID NO: 1012870 - DNA, 20 bp, Homo sapiens
ctttctgagcacactttagt

SEQ ID NO: 1012871 - DNA, 16 bp, Homo sapiens
ctttctgattactgtc

SEQ ID NO: 1012872 - DNA, 17 bp, Homo sapiens
ctttctgattactgtcc

SEQ ID NO: 1012873 - DNA, 20 bp, Homo sapiens
ctttctgccccccagggcta

SEQ ID NO: 1012874 - DNA, 11 bp, Homo sapiens
ctttctgcctg

SEQ ID NO: 1012875 - DNA, 15 bp, Homo sapiens
ctttctgcctggagt

SEQ ID NO: 1012876 - DNA, 14 bp, Homo sapiens
ctttctgctcagct

SEQ ID NO: 1012877 - DNA, 19 bp, Homo sapiens
ctttctgctcagcttctcc

SEQ ID NO: 1012878 - DNA, 16 bp, Homo sapiens
ctttctgctctgccat

SEQ ID NO: 1012879 - DNA, 19 bp, Homo sapiens
ctttctgctctgccatctt

SEQ ID NO: 1012880 - DNA, 13 bp, Homo sapiens
ctttctggactgg

SEQ ID NO: 1012881 - DNA, 14 bp, Homo sapiens
ctttctggcctgtt

SEQ ID NO: 1012882 - DNA, 18 bp, Homo sapiens
ctttctggctatgcattt

SEQ ID NO: 1012883 - DNA, 19 bp, Homo sapiens
ctttctggctatgcatttg

SEQ ID NO: 1012884 - DNA, 20 bp, Homo sapiens
ctttctggctatgcatttga

SEQ ID NO: 1012885 - DNA, 21 bp, Homo sapiens
ctttctgggctttctcctgga

SEQ ID NO: 1012886 - DNA, 22 bp, Homo sapiens
ctttctggtgttttatttccta

SEQ ID NO: 1012887 - DNA, 17 bp, Homo sapiens
ctttctgtaaacagaat

SEQ ID NO: 1012888 - DNA, 16 bp, Homo sapiens
ctttctgtaaccataa

SEQ ID NO: 1012889 - DNA, 14 bp, Homo sapiens
ctttctgtgaagct

SEQ ID NO: 1012890 - DNA, 15 bp, Homo sapiens
ctttctgtgcttgga

SEQ ID NO: 1012891 - DNA, 14 bp, Homo sapiens
ccagccctgctggg

SEQ ID NO: 1012892 - DNA, 22 bp, Homo sapiens
ccagccctgctggggatccccg

SEQ ID NO: 1012893 - DNA, 14 bp, Homo sapiens
ccagccctgggaac

SEQ ID NO: 1012894 - DNA, 15 bp, Homo sapiens
ccagccctgggaacc

SEQ ID NO: 1012895 - DNA, 22 bp, Homo sapiens
ccagccctgggcttggctcttg

SEQ ID NO: 1012896 - DNA, 23 bp, Homo sapiens
ccagccctgggggattcctgagc

SEQ ID NO: 1012897 - DNA, 14 bp, Homo sapiens
ctttctgttccaaa

SEQ ID NO: 1012898 - DNA, 23 bp, Homo sapiens
ctttctgttccttcctccactgc

SEQ ID NO: 1012899 - DNA, 16 bp, Homo sapiens
ctttctgttgccacaa

SEQ ID NO: 1012900 - DNA, 15 bp, Homo sapiens
ctttctgttggtgta

SEQ ID NO: 1012901 - DNA, 21 bp, Homo sapiens
ctttctgttgtcattgctgtt

SEQ ID NO: 1012902 - DNA, 13 bp, Homo sapiens
ctttctgttttct

SEQ ID NO: 1012903 - DNA, 23 bp, Homo sapiens
ctttctgttttctgtttgtaaat

SEQ ID NO: 1012904 - DNA, 13 bp, Homo sapiens
ctttcttaatttt

SEQ ID NO: 1012905 - DNA, 13 bp, Homo sapiens
ctttcttcaccaa

SEQ ID NO: 1012906 - DNA, 23 bp, Homo sapiens
ctttcttcaccaagtgcaataga

SEQ ID NO: 1012907 - DNA, 20 bp, Homo sapiens
ctttcttccattccttcatg

SEQ ID NO: 1012908 - DNA, 23 bp, Homo sapiens
ctttcttcccgtgtgtatttcta

SEQ ID NO: 1012909 - DNA, 12 bp, Homo sapiens
ctttcttcctct

SEQ ID NO: 1012910 - DNA, 15 bp, Homo sapiens
ctttcttctagtatt

SEQ ID NO: 1012911 - DNA, 15 bp, Homo sapiens
ctttcttctgccctt

SEQ ID NO: 1012912 - DNA, 13 bp, Homo sapiens
ctttcttctgtgt

SEQ ID NO: 1012913 - DNA, 13 bp, Homo sapiens
ctttcttctttcc

SEQ ID NO: 1012914 - DNA, 16 bp, Homo sapiens
ctttcttgctggttgt

SEQ ID NO: 1012915 - DNA, 22 bp, Homo sapiens
ctttcttggttcataaatgaat

SEQ ID NO: 1012916 - DNA, 20 bp, Homo sapiens
ctttcttgtctttcctccta

SEQ ID NO: 1012917 - DNA, 17 bp, Homo sapiens
ctttctttacctgagac

SEQ ID NO: 1012918 - DNA, 15 bp, Homo sapiens
ctttctttagaattt

SEQ ID NO: 1012919 - DNA, 20 bp, Homo sapiens
ctttctttccgtcaccctgg

SEQ ID NO: 1012920 - DNA, 17 bp, Homo sapiens
ctttctttgcaccaaag

SEQ ID NO: 1012921 - DNA, 18 bp, Homo sapiens
ctttctttgcaccaaaga

SEQ ID NO: 1012922 - DNA, 19 bp, Homo sapiens
ctttctttgtttctttctt

SEQ ID NO: 1012923 - DNA, 22 bp, Homo sapiens
ctttcttttctggaatgtaatc

SEQ ID NO: 1012924 - DNA, 20 bp, Homo sapiens
ctttctttttctggaaattt

SEQ ID NO: 1012925 - DNA, 15 bp, Homo sapiens
ctttctttttcttct

SEQ ID NO: 1012926 - DNA, 17 bp, Homo sapiens
ctttgaaaaaaaataaa

SEQ ID NO: 1012927 - DNA, 18 bp, Homo sapiens
ctttgaaaagttggaagg

SEQ ID NO: 1012928 - DNA, 16 bp, Homo sapiens
ctttgaaacctcaggg

SEQ ID NO: 1012929 - DNA, 20 bp, Homo sapiens
ctttgaaacctcagggctgt

SEQ ID NO: 1012930 - DNA, 22 bp, Homo sapiens
ctttgaaactggaataagtgtt

SEQ ID NO: 1012931 - DNA, 20 bp, Homo sapiens
ctttgaaaggttagagaata

SEQ ID NO: 1012932 - DNA, 10 bp, Homo sapiens
ctttgaaagt

SEQ ID NO: 1012933 - DNA, 14 bp, Homo sapiens
ctttgaaatgtgtt

SEQ ID NO: 1012934 - DNA, 16 bp, Homo sapiens
ctttgaagaaaagaaa

SEQ ID NO: 1012935 - DNA, 19 bp, Homo sapiens
ctttgaagcagttgtgtca

SEQ ID NO: 1012936 - DNA, 16 bp, Homo sapiens
ctttgaagcctcagct

SEQ ID NO: 1012937 - DNA, 12 bp, Homo sapiens
ctttgaagggca

SEQ ID NO: 1012938 - DNA, 14 bp, Homo sapiens
ctttgaagggcaag

SEQ ID NO: 1012939 - DNA, 16 bp, Homo sapiens
ctttgaaggggcctca

SEQ ID NO: 1012940 - DNA, 16 bp, Homo sapiens
ctttgaagtcatacca

SEQ ID NO: 1012941 - DNA, 17 bp, Homo sapiens
ctttgaataaaaatgca

SEQ ID NO: 1012942 - DNA, 16 bp, Homo sapiens
ctttgaatctctgtat

SEQ ID NO: 1012943 - DNA, 16 bp, Homo sapiens
ctttgaatgctttttg

SEQ ID NO: 1012944 - DNA, 13 bp, Homo sapiens
ctttgaatgttaa

SEQ ID NO: 1012945 - DNA, 21 bp, Homo sapiens
ctttgaattatttctttatta

SEQ ID NO: 1012946 - DNA, 12 bp, Homo sapiens
ctttgaattttc

SEQ ID NO: 1012947 - DNA, 17 bp, Homo sapiens
ctttgacaaaagtaaat

SEQ ID NO: 1012948 - DNA, 18 bp, Homo sapiens
ctttgacaaaagtaaatg

SEQ ID NO: 1012949 - DNA, 16 bp, Homo sapiens
ctttgacaactaaaat

SEQ ID NO: 1012950 - DNA, 16 bp, Homo sapiens
ctttgacaaggaaaat

SEQ ID NO: 1012951 - DNA, 21 bp, Homo sapiens
ctttgacaattactcaggttt

SEQ ID NO: 1012952 - DNA, 19 bp, Homo sapiens
ctttgacaattctgggtgc

SEQ ID NO: 1012953 - DNA, 20 bp, Homo sapiens
ctttgacaattctgggtgcg

SEQ ID NO: 1012954 - DNA, 19 bp, Homo sapiens
ctttgaccagatctttctc

SEQ ID NO: 1012955 - DNA, 21 bp, Homo sapiens
ctttgacctaaattatttact

SEQ ID NO: 1012956 - DNA, 24 bp, Homo sapiens
ctttgacctctgcagcaataaagc

SEQ ID NO: 1012957 - DNA, 19 bp, Homo sapiens
ctttgactcacctgttact

SEQ ID NO: 1012958 - DNA, 17 bp, Homo sapiens
ctttgactgtcagcaag

SEQ ID NO: 1012959 - DNA, 14 bp, Homo sapiens
ctttgacttcagct

SEQ ID NO: 1012960 - DNA, 15 bp, Homo sapiens
ctttgacttcagctg

SEQ ID NO: 1012961 - DNA, 14 bp, Homo sapiens
ctttgactttttgc

SEQ ID NO: 1012962 - DNA, 23 bp, Homo sapiens
ctttgagaactgcttctaagatg

SEQ ID NO: 1012963 - DNA, 22 bp, Homo sapiens
ctttgagaagccttcagctcca

SEQ ID NO: 1012964 - DNA, 17 bp, Homo sapiens
ctttgagactgggtctc

SEQ ID NO: 1012965 - DNA, 21 bp, Homo sapiens
ctttgagcccacaaagcctta

SEQ ID NO: 1012966 - DNA, 19 bp, Homo sapiens
ctttgagcctgcatcttct

SEQ ID NO: 1012967 - DNA, 24 bp, Homo sapiens
ctttgagcctgcatcttcttgcat

SEQ ID NO: 1012968 - DNA, 22 bp, Homo sapiens
ctttgagcctttattggtaaat

SEQ ID NO: 1012969 - DNA, 21 bp, Homo sapiens
ctttgagcttaatctttgaaa

SEQ ID NO: 1012970 - DNA, 23 bp, Homo sapiens
ctttgaggttattttccgccaga

SEQ ID NO: 1012971 - DNA, 15 bp, Homo sapiens
ctttgaggttgcttt

SEQ ID NO: 1012972 - DNA, 13 bp, Homo sapiens
ctttgagtaccaa

SEQ ID NO: 1012973 - DNA, 19 bp, Homo sapiens
ctttgagttaagtctatct

SEQ ID NO: 1012974 - DNA, 13 bp, Homo sapiens
ctttgatccttgg

SEQ ID NO: 1012975 - DNA, 18 bp, Homo sapiens
ctttgatccttggaaacc

SEQ ID NO: 1012976 - DNA, 18 bp, Homo sapiens
ctttgatctggacagaac

SEQ ID NO: 1012977 - DNA, 22 bp, Homo sapiens
ctttgatctggacagaacattt

SEQ ID NO: 1012978 - DNA, 14 bp, Homo sapiens
ctttgatgagcatt

SEQ ID NO: 1012979 - DNA, 16 bp, Homo sapiens
ctttgattatttgcat

SEQ ID NO: 1012980 - DNA, 19 bp, Homo sapiens
ctttgattatttgcatgtt

SEQ ID NO: 1012981 - DNA, 20 bp, Homo sapiens
ctttgattatttgcatgtta

SEQ ID NO: 1012982 - DNA, 24 bp, Homo sapiens
ctttgattatttgcatgttatgtt

SEQ ID NO: 1012983 - DNA, 19 bp, Homo sapiens
ctttgattcatagtaactt

SEQ ID NO: 1012984 - DNA, 13 bp, Homo sapiens
ctttgattctgat

SEQ ID NO: 1012985 - DNA, 14 bp, Homo sapiens
ctttgattgcacat

SEQ ID NO: 1012986 - DNA, 18 bp, Homo sapiens
ctttgattgcacattgtt

SEQ ID NO: 1012987 - DNA, 21 bp, Homo sapiens
ctttgattgcacattgttgtt

SEQ ID NO: 1012988 - DNA, 22 bp, Homo sapiens
ctttgcaaaatgagactttcta

SEQ ID NO: 1012989 - DNA, 20 bp, Homo sapiens
ctttgcaaagtattgtaaat

SEQ ID NO: 1012990 - DNA, 22 bp, Homo sapiens
ctttgcaaattatttattactt

SEQ ID NO: 1012991 - DNA, 19 bp, Homo sapiens
ctttgcaattgctcttctc

SEQ ID NO: 1012992 - DNA, 13 bp, Homo sapiens
ctttgcacaatga

SEQ ID NO: 1012993 - DNA, 18 bp, Homo sapiens
ctttgcacagctctccgg

SEQ ID NO: 1012994 - DNA, 17 bp, Homo sapiens
ctttgcacaggaaagag

SEQ ID NO: 1012995 - DNA, 16 bp, Homo sapiens
ctttgcacaggatgct

SEQ ID NO: 1012996 - DNA, 15 bp, Homo sapiens
ctttgcacatgtgac

SEQ ID NO: 1012997 - DNA, 16 bp, Homo sapiens
ctttgcacatgtgacc

SEQ ID NO: 1012998 - DNA, 14 bp, Homo sapiens
ctttgcaccaaaga

SEQ ID NO: 1012999 - DNA, 15 bp, Homo sapiens
ctttgcaccaaagac

SEQ ID NO: 1013000 - DNA, 18 bp, Homo sapiens
ctttgcaccaaagacatc

SEQ ID NO: 1013001 - DNA, 23 bp, Homo sapiens
ctttgcacgacgccctctcccca

SEQ ID NO: 1013002 - DNA, 14 bp, Homo sapiens
ctttgcacgtgctg

SEQ ID NO: 1013003 - DNA, 13 bp, Homo sapiens
ctttgcactgagg

SEQ ID NO: 1013004 - DNA, 16 bp, Homo sapiens
ctttgcactgagggcc

SEQ ID NO: 1013005 - DNA, 16 bp, Homo sapiens
ctttgcactgatatat

SEQ ID NO: 1013006 - DNA, 13 bp, Homo sapiens
ctttgcagagcct

SEQ ID NO: 1013007 - DNA, 21 bp, Homo sapiens
ctttgcagaggtccaaatgat

SEQ ID NO: 1013008 - DNA, 19 bp, Homo sapiens
ctttgcaggcggccctcag

SEQ ID NO: 1013009 - DNA, 22 bp, Homo sapiens
ctttgcaggcggccctcagtgc

SEQ ID NO: 1013010 - DNA, 22 bp, Homo sapiens
ctttgcagggctaaggccccca

SEQ ID NO: 1013011 - DNA, 19 bp, Homo sapiens
ctttgcagtgtgcagggtg

SEQ ID NO: 1013012 - DNA, 21 bp, Homo sapiens
ctttgcagttggactctcagg

SEQ ID NO: 1013013 - DNA, 15 bp, Homo sapiens
ctttgcataaattaa

SEQ ID NO: 1013014 - DNA, 21 bp, Homo sapiens
ctttgcatagctctccttccc

SEQ ID NO: 1013015 - DNA, 15 bp, Homo sapiens
ctttgcatggatttc

SEQ ID NO: 1013016 - DNA, 22 bp, Homo sapiens
ctttgcatggatttctttgaaa

SEQ ID NO: 1013017 - DNA, 18 bp, Homo sapiens
ctttgcatggcagggcct

SEQ ID NO: 1013018 - DNA, 17 bp, Homo sapiens
ctttggttcttcagatg

SEQ ID NO: 1013019 - DNA, 14 bp, Homo sapiens
ctttggttggaact

SEQ ID NO: 1013020 - DNA, 20 bp, Homo sapiens
ctttggtttaatttaaagcc

SEQ ID NO: 1013021 - DNA, 23 bp, Homo sapiens
ctttggtttttttcttctgtatt

SEQ ID NO: 1013022 - DNA, 13 bp, Homo sapiens
ctttgtaaattgt

SEQ ID NO: 1013023 - DNA, 19 bp, Homo sapiens
ctttgtaagacatttgtat

SEQ ID NO: 1013024 - DNA, 23 bp, Homo sapiens
ccagctcagccctggcctggctg

SEQ ID NO: 1013025 - DNA, 17 bp, Homo sapiens
ccagctcaggggacact

SEQ ID NO: 1013026 - DNA, 20 bp, Homo sapiens
ccagctcaggggacactggc

SEQ ID NO: 1013027 - DNA, 21 bp, Homo sapiens
ccagctcaggggacactggcc

SEQ ID NO: 1013028 - DNA, 15 bp, Homo sapiens
ccagctcagtcccat

SEQ ID NO: 1013029 - DNA, 21 bp, Homo sapiens
ccagctcatctccaaggatcc

SEQ ID NO: 1013030 - DNA, 16 bp, Homo sapiens
ccagctcatgacactg

SEQ ID NO: 1013031 - DNA, 21 bp, Homo sapiens
ccagctcatgtaggtgagcct

SEQ ID NO: 1013032 - DNA, 15 bp, Homo sapiens
ccagctccacacatt

SEQ ID NO: 1013033 - DNA, 14 bp, Homo sapiens
ccagctccaggccc

SEQ ID NO: 1013034 - DNA, 15 bp, Homo sapiens
ccagctccaggccca

SEQ ID NO: 1013035 - DNA, 18 bp, Homo sapiens
ccagctccaggcccaccg

SEQ ID NO: 1013036 - DNA, 12 bp, Homo sapiens
ccagctccaggg

SEQ ID NO: 1013037 - DNA, 14 bp, Homo sapiens
ccagctccaggggc

SEQ ID NO: 1013038 - DNA, 20 bp, Homo sapiens
ccagctccaggggcccttgg

SEQ ID NO: 1013039 - DNA, 22 bp, Homo sapiens
ccagctccagtgccgctcctgc

SEQ ID NO: 1013040 - DNA, 21 bp, Homo sapiens
ccagctcccgctgtggccgca

SEQ ID NO: 1013041 - DNA, 22 bp, Homo sapiens
ccagctcccgtgtaaataattt

SEQ ID NO: 1013042 - DNA, 18 bp, Homo sapiens
ccagctccctagactgca

SEQ ID NO: 1013043 - DNA, 14 bp, Homo sapiens
ccagctccctctat

SEQ ID NO: 1013044 - DNA, 16 bp, Homo sapiens
ccagctccctctattt

SEQ ID NO: 1013045 - DNA, 16 bp, Homo sapiens
ccagctccctgcaccg

SEQ ID NO: 1013046 - DNA, 18 bp, Homo sapiens
ccagctccctgcaccgcc

SEQ ID NO: 1013047 - DNA, 16 bp, Homo sapiens
ccagctcccttgggaa

SEQ ID NO: 1013048 - DNA, 23 bp, Homo sapiens
ccagctcccttgggaaggacaca

SEQ ID NO: 1013049 - DNA, 17 bp, Homo sapiens
ccagctcctccagccct

SEQ ID NO: 1013050 - DNA, 20 bp, Homo sapiens
ccagctcctcccttgttctc

SEQ ID NO: 1013051 - DNA, 20 bp, Homo sapiens
ccagctcctctaggggcagc

SEQ ID NO: 1013052 - DNA, 17 bp, Homo sapiens
ccagctcctctctgaag

SEQ ID NO: 1013053 - DNA, 20 bp, Homo sapiens
ccagctcctctctgaagcga

SEQ ID NO: 1013054 - DNA, 12 bp, Homo sapiens
ccagctcctctg

SEQ ID NO: 1013055 - DNA, 15 bp, Homo sapiens
ccagctcctctgagc

SEQ ID NO: 1013056 - DNA, 18 bp, Homo sapiens
ccagctcctctgagccat

SEQ ID NO: 1013057 - DNA, 17 bp, Homo sapiens
ccagctccttggctgca

SEQ ID NO: 1013058 - DNA, 21 bp, Homo sapiens
ccagctccttggctgcagcca

SEQ ID NO: 1013059 - DNA, 19 bp, Homo sapiens
ccagctcctttctcctgtg

SEQ ID NO: 1013060 - DNA, 23 bp, Homo sapiens
ccagctccttttgtccccagggc

SEQ ID NO: 1013061 - DNA, 20 bp, Homo sapiens
ccagctcgtgtgtcctcatg

SEQ ID NO: 1013062 - DNA, 15 bp, Homo sapiens
ccagctctcagccaa

SEQ ID NO: 1013063 - DNA, 12 bp, Homo sapiens
ccagctctccca

SEQ ID NO: 1013064 - DNA, 15 bp, Homo sapiens
ccagctctcccacat

SEQ ID NO: 1013065 - DNA, 16 bp, Homo sapiens
ccagctctccctctgg

SEQ ID NO: 1013066 - DNA, 17 bp, Homo sapiens
ccagctctccctctggc

SEQ ID NO: 1013067 - DNA, 18 bp, Homo sapiens
ccagctctccctctggcc

SEQ ID NO: 1013068 - DNA, 21 bp, Homo sapiens
ccagctctccctctggccctg

SEQ ID NO: 1013069 - DNA, 14 bp, Homo sapiens
ccagctctctgacg

SEQ ID NO: 1013070 - DNA, 16 bp, Homo sapiens
ccagctctctgacgct

SEQ ID NO: 1013071 - DNA, 23 bp, Homo sapiens
ccagctctctgacgcttgtgaca

SEQ ID NO: 1013072 - DNA, 18 bp, Homo sapiens
ccagctctgacatccctt

SEQ ID NO: 1013073 - DNA, 13 bp, Homo sapiens
ccagctctgcccc

SEQ ID NO: 1013074 - DNA, 14 bp, Homo sapiens
ccagctctgccccc

SEQ ID NO: 1013075 - DNA, 16 bp, Homo sapiens
ccagctctgcccccgc

SEQ ID NO: 1013076 - DNA, 14 bp, Homo sapiens
ccagctctggaggg

SEQ ID NO: 1013077 - DNA, 18 bp, Homo sapiens
ccagctctggatgaaggc

SEQ ID NO: 1013078 - DNA, 19 bp, Homo sapiens
ccagctctggatgaaggca

SEQ ID NO: 1013079 - DNA, 20 bp, Homo sapiens
ccagctctggatgaaggcaa

SEQ ID NO: 1013080 - DNA, 18 bp, Homo sapiens
ccagctctgggaactgaa

SEQ ID NO: 1013081 - DNA, 14 bp, Homo sapiens
ccagctctgtatca

SEQ ID NO: 1013082 - DNA, 13 bp, Homo sapiens
ccagctctgtggc

SEQ ID NO: 1013083 - DNA, 16 bp, Homo sapiens
ccagctctgtggcctg

SEQ ID NO: 1013084 - DNA, 22 bp, Homo sapiens
ccagctctgtggcctgtgtcca

SEQ ID NO: 1013085 - DNA, 19 bp, Homo sapiens
ccagctcttgctctcttgt

SEQ ID NO: 1013086 - DNA, 20 bp, Homo sapiens
ccagctgactgtggccccct

SEQ ID NO: 1013087 - DNA, 15 bp, Homo sapiens
ccagctgagcgccag

SEQ ID NO: 1013088 - DNA, 13 bp, Homo sapiens
ccagctgcaccag

SEQ ID NO: 1013089 - DNA, 17 bp, Homo sapiens
ccagctgcacctgccag

SEQ ID NO: 1013090 - DNA, 18 bp, Homo sapiens
ccagctgcacctgccagc

SEQ ID NO: 1013091 - DNA, 19 bp, Homo sapiens
ccagctgcacctgccagcc

SEQ ID NO: 1013092 - DNA, 16 bp, Homo sapiens
ccagctgcagaccatg

SEQ ID NO: 1013093 - DNA, 18 bp, Homo sapiens
ccagctgcagggcacggg

SEQ ID NO: 1013094 - DNA, 23 bp, Homo sapiens
ccagctgcagggcacggggacct

SEQ ID NO: 1013095 - DNA, 14 bp, Homo sapiens
ccagctgccaggcg

SEQ ID NO: 1013096 - DNA, 18 bp, Homo sapiens
ccagctgcccctccctca

SEQ ID NO: 1013097 - DNA, 20 bp, Homo sapiens
ccagctgcccctccctcagg

SEQ ID NO: 1013098 - DNA, 23 bp, Homo sapiens
ccagctgcccctccctcagggag

SEQ ID NO: 1013099 - DNA, 16 bp, Homo sapiens
ccagctgccctatggg

SEQ ID NO: 1013100 - DNA, 17 bp, Homo sapiens
ccagctgcccttccgca

SEQ ID NO: 1013101 - DNA, 18 bp, Homo sapiens
ccagctgccgaccagagc

SEQ ID NO: 1013102 - DNA, 10 bp, Homo sapiens
ccagctgcct

SEQ ID NO: 1013103 - DNA, 15 bp, Homo sapiens
ccagctgcctgggcc

SEQ ID NO: 1013104 - DNA, 13 bp, Homo sapiens
ccagctgccttcc

SEQ ID NO: 1013105 - DNA, 20 bp, Homo sapiens
ccagctgccttcctcatccc

SEQ ID NO: 1013106 - DNA, 20 bp, Homo sapiens
ccagctgcgcttgcttttct

SEQ ID NO: 1013107 - DNA, 14 bp, Homo sapiens
ccagctgcgttttt

SEQ ID NO: 1013108 - DNA, 14 bp, Homo sapiens
ccagctgctctgcc

SEQ ID NO: 1013109 - DNA, 21 bp, Homo sapiens
ccagctgctgtgccccaccac

SEQ ID NO: 1013110 - DNA, 12 bp, Homo sapiens
ccagctggaagg

SEQ ID NO: 1013111 - DNA, 19 bp, Homo sapiens
ccagctggagtgagggcct

SEQ ID NO: 1013112 - DNA, 16 bp, Homo sapiens
ccagctggcctggaca

SEQ ID NO: 1013113 - DNA, 17 bp, Homo sapiens
ccagctggcctggacag

SEQ ID NO: 1013114 - DNA, 16 bp, Homo sapiens
ccagctggcctttgta

SEQ ID NO: 1013115 - DNA, 16 bp, Homo sapiens
ccagctgggaagccct

SEQ ID NO: 1013116 - DNA, 17 bp, Homo sapiens
ccagctgggaagccctt

SEQ ID NO: 1013117 - DNA, 21 bp, Homo sapiens
ccagctgggacctaatgctgg

SEQ ID NO: 1013118 - DNA, 17 bp, Homo sapiens
ccagctgggagcactgg

SEQ ID NO: 1013119 - DNA, 18 bp, Homo sapiens
ccagctgggagcactggt

SEQ ID NO: 1013120 - DNA, 22 bp, Homo sapiens
ccagctgggaggcaagaggggt

SEQ ID NO: 1013121 - DNA, 11 bp, Homo sapiens
ccagctgggct

SEQ ID NO: 1013122 - DNA, 12 bp, Homo sapiens
ccagctgggctc

SEQ ID NO: 1013123 - DNA, 19 bp, Homo sapiens
ccagctgggctctgcaatt

SEQ ID NO: 1013124 - DNA, 15 bp, Homo sapiens
ccagctggggagatg

SEQ ID NO: 1013125 - DNA, 17 bp, Homo sapiens
ccagctggtcctgtgga

SEQ ID NO: 1013126 - DNA, 12 bp, Homo sapiens
ccagctggtggc

SEQ ID NO: 1013127 - DNA, 14 bp, Homo sapiens
ccagctgtagccat

SEQ ID NO: 1013128 - DNA, 20 bp, Homo sapiens
ccagctgtagccatggctca

SEQ ID NO: 1013129 - DNA, 24 bp, Homo sapiens
ccagctgtagccatggctcaggca

SEQ ID NO: 1013130 - DNA, 18 bp, Homo sapiens
ccagctgtcgtctgactc

SEQ ID NO: 1013131 - DNA, 16 bp, Homo sapiens
ccagctgtgcccctcc

SEQ ID NO: 1013132 - DNA, 16 bp, Homo sapiens
ccagctgttcagctgg

SEQ ID NO: 1013133 - DNA, 20 bp, Homo sapiens
ccagcttaagcgttcatatg

SEQ ID NO: 1013134 - DNA, 16 bp, Homo sapiens
ccagcttaatagctgt

SEQ ID NO: 1013135 - DNA, 23 bp, Homo sapiens
ccagcttagagttcttctttctt

SEQ ID NO: 1013136 - DNA, 22 bp, Homo sapiens
ccagcttagcaactgctgggga

SEQ ID NO: 1013137 - DNA, 16 bp, Homo sapiens
ccagcttatctcaggg

SEQ ID NO: 1013138 - DNA, 13 bp, Homo sapiens
ccagcttcagctc

SEQ ID NO: 1013139 - DNA, 15 bp, Homo sapiens
ccagcttcagctcaa

SEQ ID NO: 1013140 - DNA, 18 bp, Homo sapiens
cttttctgagttcttgaa

SEQ ID NO: 1013141 - DNA, 19 bp, Homo sapiens
cttttctgatcgtctcggc

SEQ ID NO: 1013142 - DNA, 14 bp, Homo sapiens
cttttctgcatttt

SEQ ID NO: 1013143 - DNA, 13 bp, Homo sapiens
cttttctgccctg

SEQ ID NO: 1013144 - DNA, 14 bp, Homo sapiens
cttttctgccctgg

SEQ ID NO: 1013145 - DNA, 15 bp, Homo sapiens
cttttctgccctggc

SEQ ID NO: 1013146 - DNA, 16 bp, Homo sapiens
cttttctgcctgctcc

SEQ ID NO: 1013147 - DNA, 20 bp, Homo sapiens
cttttctgctgttgcctctc

SEQ ID NO: 1013148 - DNA, 19 bp, Homo sapiens
cttttctggaatgtaatca

SEQ ID NO: 1013149 - DNA, 19 bp, Homo sapiens
cttttctggccaaaagcag

SEQ ID NO: 1013150 - DNA, 16 bp, Homo sapiens
cttttctggttccaaa

SEQ ID NO: 1013151 - DNA, 13 bp, Homo sapiens
cttttctgtaatg

SEQ ID NO: 1013152 - DNA, 13 bp, Homo sapiens
cttttctgtaatt

SEQ ID NO: 1013153 - DNA, 16 bp, Homo sapiens
cttttctgtaattcag

SEQ ID NO: 1013154 - DNA, 21 bp, Homo sapiens
cttttctgtcaccaaatttgt

SEQ ID NO: 1013155 - DNA, 18 bp, Homo sapiens
cttttctgtccgagcttt

SEQ ID NO: 1013156 - DNA, 16 bp, Homo sapiens
ccaggcaccccctgga

SEQ ID NO: 1013157 - DNA, 17 bp, Homo sapiens
ccaggcaccccctggag

SEQ ID NO: 1013158 - DNA, 21 bp, Homo sapiens
ccaggcaccccctggagagaa

SEQ ID NO: 1013159 - DNA, 19 bp, Homo sapiens
ccaggcaccctcagggagc

SEQ ID NO: 1013160 - DNA, 14 bp, Homo sapiens
ccaggcacccttct

SEQ ID NO: 1013161 - DNA, 16 bp, Homo sapiens
ccaggcacctcttcct

SEQ ID NO: 1013162 - DNA, 12 bp, Homo sapiens
ccaggcactgcc

SEQ ID NO: 1013163 - DNA, 18 bp, Homo sapiens
ccaggcactgctgcccag

SEQ ID NO: 1013164 - DNA, 12 bp, Homo sapiens
ccaggcactgtt

SEQ ID NO: 1013165 - DNA, 14 bp, Homo sapiens
ccaggcagagctga

SEQ ID NO: 1013166 - DNA, 20 bp, Homo sapiens
ccaggcagagctgagggccc

SEQ ID NO: 1013167 - DNA, 21 bp, Homo sapiens
ccaggcagagctgagggccct

SEQ ID NO: 1013168 - DNA, 17 bp, Homo sapiens
ccaggcagaggggcgtt

SEQ ID NO: 1013169 - DNA, 15 bp, Homo sapiens
ccaggcagcagacac

SEQ ID NO: 1013170 - DNA, 17 bp, Homo sapiens
ccaggcagcagacacat

SEQ ID NO: 1013171 - DNA, 13 bp, Homo sapiens
ccaggcagccacc

SEQ ID NO: 1013172 - DNA, 13 bp, Homo sapiens
ccaggcagcctca

SEQ ID NO: 1013173 - DNA, 22 bp, Homo sapiens
ccaggcagctatttcagcctcc

SEQ ID NO: 1013174 - DNA, 19 bp, Homo sapiens
ccaggcagctccctcctgc

SEQ ID NO: 1013175 - DNA, 12 bp, Homo sapiens
ccaggcagctga

SEQ ID NO: 1013176 - DNA, 13 bp, Homo sapiens
ccaggcaggccag

SEQ ID NO: 1013177 - DNA, 12 bp, Homo sapiens
ccaggcaggcga

SEQ ID NO: 1013178 - DNA, 13 bp, Homo sapiens
ccaggcaggcgat

SEQ ID NO: 1013179 - DNA, 15 bp, Homo sapiens
ccaggcaggggtggg

SEQ ID NO: 1013180 - DNA, 19 bp, Homo sapiens
ccaggcaggggtgggagag

SEQ ID NO: 1013181 - DNA, 21 bp, Homo sapiens
ccaggcaggggtgggggtgga

SEQ ID NO: 1013182 - DNA, 19 bp, Homo sapiens
ccaggcagtcgggggctgg

SEQ ID NO: 1013183 - DNA, 21 bp, Homo sapiens
ccaggcagtcgggggctggcc

SEQ ID NO: 1013184 - DNA, 24 bp, Homo sapiens
ccaggcagtcgggggctggcctag

SEQ ID NO: 1013185 - DNA, 21 bp, Homo sapiens
ccaggcatccatcttggaaga

SEQ ID NO: 1013186 - DNA, 23 bp, Homo sapiens
ccaggcatctgttagcagagtct

SEQ ID NO: 1013187 - DNA, 24 bp, Homo sapiens
ccaggcatctgttagcagagtctg

SEQ ID NO: 1013188 - DNA, 12 bp, Homo sapiens
ccaggcatgcag

SEQ ID NO: 1013189 - DNA, 17 bp, Homo sapiens
ccaggcatgcagctgcc

SEQ ID NO: 1013190 - DNA, 19 bp, Homo sapiens
ccaggcatgcagctgcctg

SEQ ID NO: 1013191 - DNA, 21 bp, Homo sapiens
ccaggcatgcagctgcctggg

SEQ ID NO: 1013192 - DNA, 15 bp, Homo sapiens
ccaggcattggctca

SEQ ID NO: 1013193 - DNA, 17 bp, Homo sapiens
ccaggccaaagccccat

SEQ ID NO: 1013194 - DNA, 21 bp, Homo sapiens
ccaggccaaagccccatgtgc

SEQ ID NO: 1013195 - DNA, 14 bp, Homo sapiens
ccaggccaccagga

SEQ ID NO: 1013196 - DNA, 15 bp, Homo sapiens
ccaggccaccaggat

SEQ ID NO: 1013197 - DNA, 13 bp, Homo sapiens
ccaggccacctcc

SEQ ID NO: 1013198 - DNA, 17 bp, Homo sapiens
ccaggccactgtggcca

SEQ ID NO: 1013199 - DNA, 20 bp, Homo sapiens
ccaggccactgtggccagag

SEQ ID NO: 1013200 - DNA, 21 bp, Homo sapiens
ccaggccactgtggccagagc

SEQ ID NO: 1013201 - DNA, 23 bp, Homo sapiens
ccaggccactgtggccagagctg

SEQ ID NO: 1013202 - DNA, 19 bp, Homo sapiens
ccaggccagagggcagtgg

SEQ ID NO: 1013203 - DNA, 15 bp, Homo sapiens
ccaggccagcccccc

SEQ ID NO: 1013204 - DNA, 23 bp, Homo sapiens
ccaggccagcccccccacccacc

SEQ ID NO: 1013205 - DNA, 13 bp, Homo sapiens
ccaggccagcctc

SEQ ID NO: 1013206 - DNA, 20 bp, Homo sapiens
ccaggccagcctccgagagg

SEQ ID NO: 1013207 - DNA, 13 bp, Homo sapiens
ccaggccaggtag

SEQ ID NO: 1013208 - DNA, 15 bp, Homo sapiens
ccaggccaggtagca

SEQ ID NO: 1013209 - DNA, 16 bp, Homo sapiens
ccaggccaggtagcaa

SEQ ID NO: 1013210 - DNA, 16 bp, Homo sapiens
ccaggccagtgggcct

SEQ ID NO: 1013211 - DNA, 21 bp, Homo sapiens
ccaggcccaaggagggtccag

SEQ ID NO: 1013212 - DNA, 14 bp, Homo sapiens
ccaggcccaaggct

SEQ ID NO: 1013213 - DNA, 18 bp, Homo sapiens
ccaggcccaaggctcccg

SEQ ID NO: 1013214 - DNA, 22 bp, Homo sapiens
ccaggcccactgtgcctcagag

SEQ ID NO: 1013215 - DNA, 13 bp, Homo sapiens
ccaggcccagccc

SEQ ID NO: 1013216 - DNA, 14 bp, Homo sapiens
ccaggcccaggcca

SEQ ID NO: 1013217 - DNA, 16 bp, Homo sapiens
ccaggcccatctcagg

SEQ ID NO: 1013218 - DNA, 20 bp, Homo sapiens
ccaggccccagacagggtgg

SEQ ID NO: 1013219 - DNA, 17 bp, Homo sapiens
ccaggccccagcctcca

SEQ ID NO: 1013220 - DNA, 18 bp, Homo sapiens
ccaggcccccggctttcc

SEQ ID NO: 1013221 - DNA, 15 bp, Homo sapiens
ccaggcccctgagga

SEQ ID NO: 1013222 - DNA, 23 bp, Homo sapiens
ccaggcccctgaggactggagac

SEQ ID NO: 1013223 - DNA, 13 bp, Homo sapiens
ccaggccctccag

SEQ ID NO: 1013224 - DNA, 21 bp, Homo sapiens
ccaggccctccagtgggctga

SEQ ID NO: 1013225 - DNA, 16 bp, Homo sapiens
ccaggccctccatggg

SEQ ID NO: 1013226 - DNA, 21 bp, Homo sapiens
ccaggccctccatgggctagt

SEQ ID NO: 1013227 - DNA, 20 bp, Homo sapiens
ccaggccctcccaccacccc

SEQ ID NO: 1013228 - DNA, 22 bp, Homo sapiens
ccaggccctcccaccaccccat

SEQ ID NO: 1013229 - DNA, 14 bp, Homo sapiens
ccaggccctgagat

SEQ ID NO: 1013230 - DNA, 23 bp, Homo sapiens
ccaggccctgccagtggggaagg

SEQ ID NO: 1013231 - DNA, 15 bp, Homo sapiens
ccaggcccttggctg

SEQ ID NO: 1013232 - DNA, 16 bp, Homo sapiens
ccaggcccttggctgc

SEQ ID NO: 1013233 - DNA, 17 bp, Homo sapiens
ccaggcccttggctgca

SEQ ID NO: 1013234 - DNA, 14 bp, Homo sapiens
ccaggccgcagctc

SEQ ID NO: 1013235 - DNA, 17 bp, Homo sapiens
ccaggccggagcccaga

SEQ ID NO: 1013236 - DNA, 19 bp, Homo sapiens
ccaggccggagcccagata

SEQ ID NO: 1013237 - DNA, 15 bp, Homo sapiens
ccaggccggcccaga

SEQ ID NO: 1013238 - DNA, 14 bp, Homo sapiens
ccaggccgggaaga

SEQ ID NO: 1013239 - DNA, 18 bp, Homo sapiens
ccaggccgggaagagcca

SEQ ID NO: 1013240 - DNA, 20 bp, Homo sapiens
ccaggccgtggactggctca

SEQ ID NO: 1013241 - DNA, 20 bp, Homo sapiens
ccaggccgttccccttggct

SEQ ID NO: 1013242 - DNA, 23 bp, Homo sapiens
ccaggcctcactggctcatgccc

SEQ ID NO: 1013243 - DNA, 16 bp, Homo sapiens
ccaggcctccagcctc

SEQ ID NO: 1013244 - DNA, 17 bp, Homo sapiens
ccaggcctccagcctct

SEQ ID NO: 1013245 - DNA, 19 bp, Homo sapiens
ccaggcctccagcctctcc

SEQ ID NO: 1013246 - DNA, 21 bp, Homo sapiens
ccaggcctccagcctctcccg

SEQ ID NO: 1013247 - DNA, 19 bp, Homo sapiens
ccaggcctcctaggggaag

SEQ ID NO: 1013248 - DNA, 22 bp, Homo sapiens
ccaggcctcgcacttgcagagg

SEQ ID NO: 1013249 - DNA, 15 bp, Homo sapiens
ccaggcctctctctg

SEQ ID NO: 1013250 - DNA, 17 bp, Homo sapiens
ccaggcctctctctgct

SEQ ID NO: 1013251 - DNA, 18 bp, Homo sapiens
ccaggcctctctctgctc

SEQ ID NO: 1013252 - DNA, 17 bp, Homo sapiens
ccaggcctctgtgtcct

SEQ ID NO: 1013253 - DNA, 18 bp, Homo sapiens
ccaggcctctgtgtcctt

SEQ ID NO: 1013254 - DNA, 18 bp, Homo sapiens
ccaggcctcttggcagtc

SEQ ID NO: 1013255 - DNA, 19 bp, Homo sapiens
ccaggcctgaaagaggctg

SEQ ID NO: 1013256 - DNA, 14 bp, Homo sapiens
ccaggcctgcagac

SEQ ID NO: 1013257 - DNA, 13 bp, Homo sapiens
ccaggcctgcagc

SEQ ID NO: 1013258 - DNA, 12 bp, Homo sapiens
ccaggcctgcct

SEQ ID NO: 1013259 - DNA, 15 bp, Homo sapiens
ccaggcctgcctgca

SEQ ID NO: 1013260 - DNA, 16 bp, Homo sapiens
ccaggcctgcctgcat

SEQ ID NO: 1013261 - DNA, 16 bp, Homo sapiens
ccaggcctgctggcat

SEQ ID NO: 1013262 - DNA, 15 bp, Homo sapiens
gaaaaaaaaaacact

SEQ ID NO: 1013263 - DNA, 22 bp, Homo sapiens
gaaaaaaaaaataaaactctca

SEQ ID NO: 1013264 - DNA, 18 bp, Homo sapiens
gaaaaaaaaaatgctgaa

SEQ ID NO: 1013265 - DNA, 19 bp, Homo sapiens
gaaaaaaaaaatgctgaac

SEQ ID NO: 1013266 - DNA, 17 bp, Homo sapiens
gaaaaaaaaagaaaaaa

SEQ ID NO: 1013267 - DNA, 18 bp, Homo sapiens
gaaaaaaaaccttgtaaa

SEQ ID NO: 1013268 - DNA, 13 bp, Homo sapiens
gaaaaaaaagaaa

SEQ ID NO: 1013269 - DNA, 15 bp, Homo sapiens
gaaaaaaaagaaagc

SEQ ID NO: 1013270 - DNA, 18 bp, Homo sapiens
gaaaaaaaccacacaaag

SEQ ID NO: 1013271 - DNA, 11 bp, Homo sapiens
gaaaaaaagaa

SEQ ID NO: 1013272 - DNA, 13 bp, Homo sapiens
gaaaaaaagaaac

SEQ ID NO: 1013273 - DNA, 14 bp, Homo sapiens
gaaaaaaagaaacg

SEQ ID NO: 1013274 - DNA, 22 bp, Homo sapiens
gaaaaaaagaggtttaagtttg

SEQ ID NO: 1013275 - DNA, 20 bp, Homo sapiens
gaaaaaaagcacaaagttct

SEQ ID NO: 1013276 - DNA, 18 bp, Homo sapiens
gaaaaaaataactatttt

SEQ ID NO: 1013277 - DNA, 22 bp, Homo sapiens
gaaaaaaatgtacatttattca

SEQ ID NO: 1013278 - DNA, 12 bp, Homo sapiens
gaaaaaaattga

SEQ ID NO: 1013279 - DNA, 23 bp, Homo sapiens
gaaaaaacaactaaaaaaatttt

SEQ ID NO: 1013280 - DNA, 21 bp, Homo sapiens
gaaaaaaccaccccattaaaa

SEQ ID NO: 1013281 - DNA, 10 bp, Homo sapiens
gaaaaaagaa

SEQ ID NO: 1013282 - DNA, 19 bp, Homo sapiens
gaaaaaagaaaatggctaa

SEQ ID NO: 1013283 - DNA, 15 bp, Homo sapiens
gaaaaaagaaagaaa

SEQ ID NO: 1013284 - DNA, 16 bp, Homo sapiens
gaaaaaagaaagaaaa

SEQ ID NO: 1013285 - DNA, 19 bp, Homo sapiens
gaaaaaagaaccaaaactt

SEQ ID NO: 1013286 - DNA, 14 bp, Homo sapiens
gaaaaaagttgtag

SEQ ID NO: 1013287 - DNA, 16 bp, Homo sapiens
gaaaaaataattattt

SEQ ID NO: 1013288 - DNA, 11 bp, Homo sapiens
gaaaaaatata

SEQ ID NO: 1013289 - DNA, 12 bp, Homo sapiens
gaaaaaatatat

SEQ ID NO: 1013290 - DNA, 13 bp, Homo sapiens
ccagggctcagcc

SEQ ID NO: 1013291 - DNA, 14 bp, Homo sapiens
ccagggctcagcct

SEQ ID NO: 1013292 - DNA, 20 bp, Homo sapiens
ccagggctcagcctggtggg

SEQ ID NO: 1013293 - DNA, 12 bp, Homo sapiens
ccagggctccag

SEQ ID NO: 1013294 - DNA, 17 bp, Homo sapiens
ccagggctccagcccct

SEQ ID NO: 1013295 - DNA, 12 bp, Homo sapiens
ccagggctcctg

SEQ ID NO: 1013296 - DNA, 23 bp, Homo sapiens
ccagggctggagacttcctctgg

SEQ ID NO: 1013297 - DNA, 21 bp, Homo sapiens
ccagggctggatggacagaca

SEQ ID NO: 1013298 - DNA, 11 bp, Homo sapiens
ccagggctggg

SEQ ID NO: 1013299 - DNA, 15 bp, Homo sapiens
ccagggctgggagga

SEQ ID NO: 1013300 - DNA, 19 bp, Homo sapiens
ccagggctgggaggaagga

SEQ ID NO: 1013301 - DNA, 12 bp, Homo sapiens
ccagggctgggg

SEQ ID NO: 1013302 - DNA, 20 bp, Homo sapiens
ccagggctggggtgagcctg

SEQ ID NO: 1013303 - DNA, 10 bp, Homo sapiens
ccagggctgt

SEQ ID NO: 1013304 - DNA, 22 bp, Homo sapiens
ccagggcttacctgtacactga

SEQ ID NO: 1013305 - DNA, 18 bp, Homo sapiens
ccagggcttccccatcag

SEQ ID NO: 1013306 - DNA, 21 bp, Homo sapiens
ccagggcttccccatcagctc

SEQ ID NO: 1013307 - DNA, 23 bp, Homo sapiens
ccagggcttccccatcagctccc

SEQ ID NO: 1013308 - DNA, 20 bp, Homo sapiens
ccagggcttcctcttccggg

SEQ ID NO: 1013309 - DNA, 20 bp, Homo sapiens
ccaggggaaaatcagcctgc

SEQ ID NO: 1013310 - DNA, 15 bp, Homo sapiens
ccaggggaacctgcc

SEQ ID NO: 1013311 - DNA, 16 bp, Homo sapiens
ccaggggaaggaagga

SEQ ID NO: 1013312 - DNA, 18 bp, Homo sapiens
ccaggggagagggtctgg

SEQ ID NO: 1013313 - DNA, 21 bp, Homo sapiens
ccaggggagagggtctggaga

SEQ ID NO: 1013314 - DNA, 18 bp, Homo sapiens
ccaggggagatggggagg

SEQ ID NO: 1013315 - DNA, 15 bp, Homo sapiens
ccaggggagccagct

SEQ ID NO: 1013316 - DNA, 22 bp, Homo sapiens
ccaggggattgtctcagggccg

SEQ ID NO: 1013317 - DNA, 14 bp, Homo sapiens
ccaggggcagcaag

SEQ ID NO: 1013318 - DNA, 15 bp, Homo sapiens
ccaggggcagcaagg

SEQ ID NO: 1013319 - DNA, 21 bp, Homo sapiens
ccaggggcagttttagcagca

SEQ ID NO: 1013320 - DNA, 22 bp, Homo sapiens
ccaggggcagttttagcagcac

SEQ ID NO: 1013321 - DNA, 21 bp, Homo sapiens
ccaggggcatgtattggcctg

SEQ ID NO: 1013322 - DNA, 22 bp, Homo sapiens
ccaggggcatgtattggcctgg

SEQ ID NO: 1013323 - DNA, 21 bp, Homo sapiens
ccaggggcccaccctctgccc

SEQ ID NO: 1013324 - DNA, 14 bp, Homo sapiens
ccaggggcgaggcc

SEQ ID NO: 1013325 - DNA, 14 bp, Homo sapiens
ccaggggctcctgg

SEQ ID NO: 1013326 - DNA, 16 bp, Homo sapiens
ccaggggctcctgggt

SEQ ID NO: 1013327 - DNA, 22 bp, Homo sapiens
ccaggggctgcttcctcctgga

SEQ ID NO: 1013328 - DNA, 23 bp, Homo sapiens
ccaggggctgcttcctcctggaa

SEQ ID NO: 1013329 - DNA, 18 bp, Homo sapiens
ccagggggatgccactcc

SEQ ID NO: 1013330 - DNA, 17 bp, Homo sapiens
ccaggggtcccagccac

SEQ ID NO: 1013331 - DNA, 18 bp, Homo sapiens
ccaggggtcccagccacc

SEQ ID NO: 1013332 - DNA, 18 bp, Homo sapiens
ccaggggtctccctggct

SEQ ID NO: 1013333 - DNA, 16 bp, Homo sapiens
ccaggggtgccccctc

SEQ ID NO: 1013334 - DNA, 19 bp, Homo sapiens
ccaggggtgccccctcctc

SEQ ID NO: 1013335 - DNA, 17 bp, Homo sapiens
ccagggtagaattcaat

SEQ ID NO: 1013336 - DNA, 14 bp, Homo sapiens
ccagggtcccaccc

SEQ ID NO: 1013337 - DNA, 15 bp, Homo sapiens
ccagggtcccctccc

SEQ ID NO: 1013338 - DNA, 18 bp, Homo sapiens
ccagggtcccctccccag

SEQ ID NO: 1013339 - DNA, 16 bp, Homo sapiens
ccagggtccctctgtg

SEQ ID NO: 1013340 - DNA, 18 bp, Homo sapiens
ccagggtccctctgtgta

SEQ ID NO: 1013341 - DNA, 23 bp, Homo sapiens
ccagggtccgcaccagctgctct

SEQ ID NO: 1013342 - DNA, 16 bp, Homo sapiens
ccagggtcgtctttgt

SEQ ID NO: 1013343 - DNA, 18 bp, Homo sapiens
ccagggtctctccctcag

SEQ ID NO: 1013344 - DNA, 17 bp, Homo sapiens
ccagggtctggcagagc

SEQ ID NO: 1013345 - DNA, 18 bp, Homo sapiens
ccagggtctggcagagcc

SEQ ID NO: 1013346 - DNA, 21 bp, Homo sapiens
ccagggtctggcagagcctct

SEQ ID NO: 1013347 - DNA, 22 bp, Homo sapiens
ccagggtctgtgtgaatgtggg

SEQ ID NO: 1013348 - DNA, 23 bp, Homo sapiens
ccagggtcttccctacctcaggc

SEQ ID NO: 1013349 - DNA, 14 bp, Homo sapiens
ccagggtcttgggc

SEQ ID NO: 1013350 - DNA, 19 bp, Homo sapiens
ccagggtcttgggctactg

SEQ ID NO: 1013351 - DNA, 20 bp, Homo sapiens
ccagggtcttgggctactgg

SEQ ID NO: 1013352 - DNA, 21 bp, Homo sapiens
ccagggtcttgggctactggc

SEQ ID NO: 1013353 - DNA, 23 bp, Homo sapiens
ccagggtcttgggctactggcag

SEQ ID NO: 1013354 - DNA, 15 bp, Homo sapiens
ccagggtgagagctg

SEQ ID NO: 1013355 - DNA, 16 bp, Homo sapiens
ccagggtgagagctgc

SEQ ID NO: 1013356 - DNA, 23 bp, Homo sapiens
ccagggtgagagctgctctggaa

SEQ ID NO: 1013357 - DNA, 15 bp, Homo sapiens
ccagggtgcccagaa

SEQ ID NO: 1013358 - DNA, 22 bp, Homo sapiens
ccagggtgcccagaacttccct

SEQ ID NO: 1013359 - DNA, 17 bp, Homo sapiens
ccagggtggaccaggcc

SEQ ID NO: 1013360 - DNA, 14 bp, Homo sapiens
ccagggtggaggaa

SEQ ID NO: 1013361 - DNA, 23 bp, Homo sapiens
ccagggtgggctggggactctgg

SEQ ID NO: 1013362 - DNA, 14 bp, Homo sapiens
ccagggttccccca

SEQ ID NO: 1013363 - DNA, 20 bp, Homo sapiens
ccagggttcccccagccctg

SEQ ID NO: 1013364 - DNA, 17 bp, Homo sapiens
ccagggtttacccagtg

SEQ ID NO: 1013365 - DNA, 14 bp, Homo sapiens
ccagggtttctctg

SEQ ID NO: 1013366 - DNA, 15 bp, Homo sapiens
ccaggtacaggagag

SEQ ID NO: 1013367 - DNA, 19 bp, Homo sapiens
ccaggtacaggagaggcag

SEQ ID NO: 1013368 - DNA, 19 bp, Homo sapiens
ccaggtaccacccttcaga

SEQ ID NO: 1013369 - DNA, 23 bp, Homo sapiens
ccaggtaccagctgcgcttgctt

SEQ ID NO: 1013370 - DNA, 20 bp, Homo sapiens
ccaggtagcaagagagcagc

SEQ ID NO: 1013371 - DNA, 15 bp, Homo sapiens
ccaggtagctgggat

SEQ ID NO: 1013372 - DNA, 19 bp, Homo sapiens
ccaggtatccaaaaatgtg

SEQ ID NO: 1013373 - DNA, 18 bp, Homo sapiens
ccaggtatctccaggatt

SEQ ID NO: 1013374 - DNA, 22 bp, Homo sapiens
ccaggtcaccatcctcagaggc

SEQ ID NO: 1013375 - DNA, 14 bp, Homo sapiens
ccaggtcagccctg

SEQ ID NO: 1013376 - DNA, 11 bp, Homo sapiens
ccaggtcagga

SEQ ID NO: 1013377 - DNA, 19 bp, Homo sapiens
ccaggtcaggatgcacatt

SEQ ID NO: 1013378 - DNA, 19 bp, Homo sapiens
ccaggtcaggggctcccta

SEQ ID NO: 1013379 - DNA, 15 bp, Homo sapiens
ccaggtccagctctg

SEQ ID NO: 1013380 - DNA, 18 bp, Homo sapiens
ccaggtccagctctggag

SEQ ID NO: 1013381 - DNA, 16 bp, Homo sapiens
ccaggtccccaaactt

SEQ ID NO: 1013382 - DNA, 22 bp, Homo sapiens
ccaggtcctctgatacccagag

SEQ ID NO: 1013383 - DNA, 19 bp, Homo sapiens
gaaaatgtatccagaggaa

SEQ ID NO: 1013384 - DNA, 22 bp, Homo sapiens
gaaaatgtcagaaaccagttat

SEQ ID NO: 1013385 - DNA, 23 bp, Homo sapiens
gaaaatgtcagaaaccagttatg

SEQ ID NO: 1013386 - DNA, 15 bp, Homo sapiens
gaaaatgtcctgtgg

SEQ ID NO: 1013387 - DNA, 11 bp, Homo sapiens
gaaaatgtctt

SEQ ID NO: 1013388 - DNA, 19 bp, Homo sapiens
gaaaatgtgtcctatctat

SEQ ID NO: 1013389 - DNA, 19 bp, Homo sapiens
gaaaatgtgtctctgcttt

SEQ ID NO: 1013390 - DNA, 19 bp, Homo sapiens
gaaaatgtgtttgctgcct

SEQ ID NO: 1013391 - DNA, 15 bp, Homo sapiens
gaaaatgttatttaa

SEQ ID NO: 1013392 - DNA, 20 bp, Homo sapiens
gaaaatgttgagaatcccaa

SEQ ID NO: 1013393 - DNA, 21 bp, Homo sapiens
gaaaatgttgagaatcccaaa

SEQ ID NO: 1013394 - DNA, 23 bp, Homo sapiens
gaaaattacatgttttttcattt

SEQ ID NO: 1013395 - DNA, 14 bp, Homo sapiens
gaaaattatgcaaa

SEQ ID NO: 1013396 - DNA, 15 bp, Homo sapiens
gaaaattatttgcat

SEQ ID NO: 1013397 - DNA, 17 bp, Homo sapiens
gaaaattattttaaaca

SEQ ID NO: 1013398 - DNA, 22 bp, Homo sapiens
gaaaattctcttaatcactact

SEQ ID NO: 1013399 - DNA, 11 bp, Homo sapiens
gaaaattctgg

SEQ ID NO: 1013400 - DNA, 17 bp, Homo sapiens
gaaaattctggaaggaa

SEQ ID NO: 1013401 - DNA, 22 bp, Homo sapiens
gaaaattctgtgccttgttttt

SEQ ID NO: 1013402 - DNA, 18 bp, Homo sapiens
gaaaattgaaacacagag

SEQ ID NO: 1013403 - DNA, 15 bp, Homo sapiens
gaaaattgctgtgcc

SEQ ID NO: 1013404 - DNA, 16 bp, Homo sapiens
gaaaattgctgtgcct

SEQ ID NO: 1013405 - DNA, 21 bp, Homo sapiens
gaaaatttacaaaatttattc

SEQ ID NO: 1013406 - DNA, 17 bp, Homo sapiens
gaaaatttgttattttg

SEQ ID NO: 1013407 - DNA, 20 bp, Homo sapiens
gaaaattttaaaaatacata

SEQ ID NO: 1013408 - DNA, 12 bp, Homo sapiens
gaaaattttctc

SEQ ID NO: 1013409 - DNA, 14 bp, Homo sapiens
gaaaattttctcct

SEQ ID NO: 1013410 - DNA, 13 bp, Homo sapiens
gaaaatttttgta

SEQ ID NO: 1013411 - DNA, 21 bp, Homo sapiens
gaaacaaaaagagctttcctt

SEQ ID NO: 1013412 - DNA, 12 bp, Homo sapiens
gaaacaaagaag

SEQ ID NO: 1013413 - DNA, 23 bp, Homo sapiens
gaaacaaagagttcaagaaataa

SEQ ID NO: 1013414 - DNA, 12 bp, Homo sapiens
gaaacaaagatg

SEQ ID NO: 1013415 - DNA, 20 bp, Homo sapiens
gaaacaaagtaatctactgt

SEQ ID NO: 1013416 - DNA, 14 bp, Homo sapiens
gaaacaaataatca

SEQ ID NO: 1013417 - DNA, 18 bp, Homo sapiens
gaaacaaatgtgtataaa

SEQ ID NO: 1013418 - DNA, 16 bp, Homo sapiens
gaaacaacatttatat

SEQ ID NO: 1013419 - DNA, 13 bp, Homo sapiens
gaaacaagggaag

SEQ ID NO: 1013420 - DNA, 20 bp, Homo sapiens
gaaacaagtctagtcttctg

SEQ ID NO: 1013421 - DNA, 20 bp, Homo sapiens
gaaacaagtgaccccagggc

SEQ ID NO: 1013422 - DNA, 22 bp, Homo sapiens
ccagtgggaggggcaggctgac

SEQ ID NO: 1013423 - DNA, 14 bp, Homo sapiens
ccagtgggcagggg

SEQ ID NO: 1013424 - DNA, 13 bp, Homo sapiens
ccagtgggctgca

SEQ ID NO: 1013425 - DNA, 14 bp, Homo sapiens
ccagtgggctgcac

SEQ ID NO: 1013426 - DNA, 15 bp, Homo sapiens
ccagtgggctgcacg

SEQ ID NO: 1013427 - DNA, 15 bp, Homo sapiens
ccagtgggctgtgtt

SEQ ID NO: 1013428 - DNA, 13 bp, Homo sapiens
ccagtggggacag

SEQ ID NO: 1013429 - DNA, 22 bp, Homo sapiens
ccagtggggcctgtggaatgag

SEQ ID NO: 1013430 - DNA, 18 bp, Homo sapiens
ccagtgtagcatcttcct

SEQ ID NO: 1013431 - DNA, 24 bp, Homo sapiens
ccagtgtagcatcttcctctgcag

SEQ ID NO: 1013432 - DNA, 14 bp, Homo sapiens
ccagtgtagccttg

SEQ ID NO: 1013433 - DNA, 20 bp, Homo sapiens
ccagtgtatgagagggccct

SEQ ID NO: 1013434 - DNA, 21 bp, Homo sapiens
ccagtgtcagggtccaggaga

SEQ ID NO: 1013435 - DNA, 16 bp, Homo sapiens
ccagtgtcccctccac

SEQ ID NO: 1013436 - DNA, 18 bp, Homo sapiens
ccagtgtgggcttgacca

SEQ ID NO: 1013437 - DNA, 20 bp, Homo sapiens
ccagtgtgggcttgaccagg

SEQ ID NO: 1013438 - DNA, 15 bp, Homo sapiens
ccagtgtgtggggga

SEQ ID NO: 1013439 - DNA, 16 bp, Homo sapiens
ccagtgtgtgggggag

SEQ ID NO: 1013440 - DNA, 22 bp, Homo sapiens
ccagtgtgtgtttaacattcac

SEQ ID NO: 1013441 - DNA, 18 bp, Homo sapiens
ccagtgttcctgaagctg

SEQ ID NO: 1013442 - DNA, 17 bp, Homo sapiens
ccagtgttggctgtgtg

SEQ ID NO: 1013443 - DNA, 21 bp, Homo sapiens
ccagtgttggctgtgtgacag

SEQ ID NO: 1013444 - DNA, 17 bp, Homo sapiens
ccagtgttgggtttttt

SEQ ID NO: 1013445 - DNA, 18 bp, Homo sapiens
ccagtgttgtgggcttcc

SEQ ID NO: 1013446 - DNA, 17 bp, Homo sapiens
ccagtgttgtttgtaaa

SEQ ID NO: 1013447 - DNA, 18 bp, Homo sapiens
ccagtgttgtttgtaaat

SEQ ID NO: 1013448 - DNA, 23 bp, Homo sapiens
ccagtgttgtttgtaaataagag

SEQ ID NO: 1013449 - DNA, 19 bp, Homo sapiens
ccagttaaaatgtgtttct

SEQ ID NO: 1013450 - DNA, 13 bp, Homo sapiens
ccagttaaagcca

SEQ ID NO: 1013451 - DNA, 17 bp, Homo sapiens
ccagttcaaagtgtata

SEQ ID NO: 1013452 - DNA, 19 bp, Homo sapiens
ccagttcaaagtgtatatt

SEQ ID NO: 1013453 - DNA, 21 bp, Homo sapiens
ccagttcacttctttgcagag

SEQ ID NO: 1013454 - DNA, 18 bp, Homo sapiens
ccagttcattgcactttg

SEQ ID NO: 1013455 - DNA, 21 bp, Homo sapiens
ccagttcccatggtgtatgtg

SEQ ID NO: 1013456 - DNA, 22 bp, Homo sapiens
ccagttcccatggtgtatgtgg

SEQ ID NO: 1013457 - DNA, 19 bp, Homo sapiens
ccagttcctatgacacagt

SEQ ID NO: 1013458 - DNA, 16 bp, Homo sapiens
ccagttcctcttttgt

SEQ ID NO: 1013459 - DNA, 13 bp, Homo sapiens
ccagttcctgctc

SEQ ID NO: 1013460 - DNA, 14 bp, Homo sapiens
ccagttcctgctct

SEQ ID NO: 1013461 - DNA, 17 bp, Homo sapiens
ccagttcctgctctctg

SEQ ID NO: 1013462 - DNA, 18 bp, Homo sapiens
ccagttcctgctctctgc

SEQ ID NO: 1013463 - DNA, 23 bp, Homo sapiens
ccagttctaggggagaagagccc

SEQ ID NO: 1013464 - DNA, 19 bp, Homo sapiens
ccagttctccttccctgca

SEQ ID NO: 1013465 - DNA, 17 bp, Homo sapiens
ccagttctgctcctctc

SEQ ID NO: 1013466 - DNA, 20 bp, Homo sapiens
ccagttctgctcctctccag

SEQ ID NO: 1013467 - DNA, 22 bp, Homo sapiens
ccagttctgctcctctccaggc

SEQ ID NO: 1013468 - DNA, 23 bp, Homo sapiens
ccagttgaacactagtctgtgta

SEQ ID NO: 1013469 - DNA, 13 bp, Homo sapiens
ccagttgggctcg

SEQ ID NO: 1013470 - DNA, 19 bp, Homo sapiens
ccagttgggctcgcactgc

SEQ ID NO: 1013471 - DNA, 15 bp, Homo sapiens
ccagttgtatttaat

SEQ ID NO: 1013472 - DNA, 17 bp, Homo sapiens
ccagttgtgttgacaca

SEQ ID NO: 1013473 - DNA, 16 bp, Homo sapiens
ccagttgttatttaca

SEQ ID NO: 1013474 - DNA, 20 bp, Homo sapiens
ccagtttaatgaactaccat

SEQ ID NO: 1013475 - DNA, 17 bp, Homo sapiens
ccagtttgcacctgtcc

SEQ ID NO: 1013476 - DNA, 13 bp, Homo sapiens
ccagtttgcagag

SEQ ID NO: 1013477 - DNA, 13 bp, Homo sapiens
ccagtttgcatga

SEQ ID NO: 1013478 - DNA, 18 bp, Homo sapiens
ccagttttactgtgattc

SEQ ID NO: 1013479 - DNA, 12 bp, Homo sapiens
ccagttttcatt

SEQ ID NO: 1013480 - DNA, 17 bp, Homo sapiens
ccataaaatgatcctgc

SEQ ID NO: 1013481 - DNA, 13 bp, Homo sapiens
ccataaagaagca

SEQ ID NO: 1013482 - DNA, 13 bp, Homo sapiens
ccataaagccttt

SEQ ID NO: 1013483 - DNA, 15 bp, Homo sapiens
ccataaatgtgttcc

SEQ ID NO: 1013484 - DNA, 17 bp, Homo sapiens
ccataacgtgcccccag

SEQ ID NO: 1013485 - DNA, 20 bp, Homo sapiens
ccataacgtgcccccagagt

SEQ ID NO: 1013486 - DNA, 17 bp, Homo sapiens
ccataagtgacaccaat

SEQ ID NO: 1013487 - DNA, 19 bp, Homo sapiens
ccataatagttagccctca

SEQ ID NO: 1013488 - DNA, 20 bp, Homo sapiens
ccataatagttagccctcag

SEQ ID NO: 1013489 - DNA, 19 bp, Homo sapiens
ccataatgtataaagaaca

SEQ ID NO: 1013490 - DNA, 21 bp, Homo sapiens
ccataatttggggccctgagt

SEQ ID NO: 1013491 - DNA, 12 bp, Homo sapiens
ccatacaatgta

SEQ ID NO: 1013492 - DNA, 18 bp, Homo sapiens
ccatacaatgtatgtaca

SEQ ID NO: 1013493 - DNA, 15 bp, Homo sapiens
ccatacacacacaaa

SEQ ID NO: 1013494 - DNA, 20 bp, Homo sapiens
ccatacactttgttgcaaga

SEQ ID NO: 1013495 - DNA, 22 bp, Homo sapiens
ccataccccttattgctgccaa

SEQ ID NO: 1013496 - DNA, 16 bp, Homo sapiens
ccataccgaccatcgt

SEQ ID NO: 1013497 - DNA, 17 bp, Homo sapiens
ccataccgaccatcgtc

SEQ ID NO: 1013498 - DNA, 22 bp, Homo sapiens
ccataccgaccatcgtccagcc

SEQ ID NO: 1013499 - DNA, 13 bp, Homo sapiens
ccatacctttcca

SEQ ID NO: 1013500 - DNA, 20 bp, Homo sapiens
ccatactaatgatgagcatt

SEQ ID NO: 1013501 - DNA, 19 bp, Homo sapiens
ccatactcaagctgtctct

SEQ ID NO: 1013502 - DNA, 13 bp, Homo sapiens
ccatactcagcct

SEQ ID NO: 1013503 - DNA, 14 bp, Homo sapiens
ccatactgtctctg

SEQ ID NO: 1013504 - DNA, 16 bp, Homo sapiens
ccatacttttggctcc

SEQ ID NO: 1013505 - DNA, 16 bp, Homo sapiens
gaaagcggcgccacag

SEQ ID NO: 1013506 - DNA, 13 bp, Homo sapiens
gaaagctagagat

SEQ ID NO: 1013507 - DNA, 16 bp, Homo sapiens
gaaagctgaaaagcat

SEQ ID NO: 1013508 - DNA, 22 bp, Homo sapiens
gaaagctgatgatgtctcttgt

SEQ ID NO: 1013509 - DNA, 15 bp, Homo sapiens
gaaagctgtttattt

SEQ ID NO: 1013510 - DNA, 19 bp, Homo sapiens
gaaagcttactgtttttga

SEQ ID NO: 1013511 - DNA, 19 bp, Homo sapiens
gaaagcttcaaattataga

SEQ ID NO: 1013512 - DNA, 18 bp, Homo sapiens
gaaaggaaaacctgaaga

SEQ ID NO: 1013513 - DNA, 20 bp, Homo sapiens
gaaaggaaaacctgaagact

SEQ ID NO: 1013514 - DNA, 14 bp, Homo sapiens
gaaaggaaacattg

SEQ ID NO: 1013515 - DNA, 15 bp, Homo sapiens
gaaaggaacactggc

SEQ ID NO: 1013516 - DNA, 16 bp, Homo sapiens
gaaaggaacctgggat

SEQ ID NO: 1013517 - DNA, 18 bp, Homo sapiens
gaaaggaagctccactgt

SEQ ID NO: 1013518 - DNA, 22 bp, Homo sapiens
gaaaggacacgccgtctgtcct

SEQ ID NO: 1013519 - DNA, 16 bp, Homo sapiens
gaaaggagaaattttg

SEQ ID NO: 1013520 - DNA, 14 bp, Homo sapiens
gaaaggagacattg

SEQ ID NO: 1013521 - DNA, 16 bp, Homo sapiens
gaaaggagtagaaaaa

SEQ ID NO: 1013522 - DNA, 20 bp, Homo sapiens
gaaaggagtttaaaaacatt

SEQ ID NO: 1013523 - DNA, 16 bp, Homo sapiens
gaaaggatatttaaga

SEQ ID NO: 1013524 - DNA, 17 bp, Homo sapiens
gaaaggatatttaagaa

SEQ ID NO: 1013525 - DNA, 22 bp, Homo sapiens
gaaaggatgtaaacagtgcctg

SEQ ID NO: 1013526 - DNA, 12 bp, Homo sapiens
gaaaggatttta

SEQ ID NO: 1013527 - DNA, 13 bp, Homo sapiens
gaaaggattttac

SEQ ID NO: 1013528 - DNA, 19 bp, Homo sapiens
gaaaggattttaccaaagc

SEQ ID NO: 1013529 - DNA, 21 bp, Homo sapiens
gaaaggattttaccaaagcat

SEQ ID NO: 1013530 - DNA, 24 bp, Homo sapiens
gaaaggattttaccaaagcatcaa

SEQ ID NO: 1013531 - DNA, 14 bp, Homo sapiens
gaaaggcagatgta

SEQ ID NO: 1013532 - DNA, 15 bp, Homo sapiens
gaaaggcaggtttca

SEQ ID NO: 1013533 - DNA, 17 bp, Homo sapiens
gaaaggcaggtttcatt

SEQ ID NO: 1013534 - DNA, 17 bp, Homo sapiens
gaaaggccctgcacagg

SEQ ID NO: 1013535 - DNA, 16 bp, Homo sapiens
gaaaggccttcagaca

SEQ ID NO: 1013536 - DNA, 15 bp, Homo sapiens
gaaaggcgcccccgc

SEQ ID NO: 1013537 - DNA, 16 bp, Homo sapiens
gaaaggcgcccccgcc

SEQ ID NO: 1013538 - DNA, 18 bp, Homo sapiens
gaaaggcgcccccgcccc

SEQ ID NO: 1013539 - DNA, 23 bp, Homo sapiens
gaaaggcgcccccgccccaggct

SEQ ID NO: 1013540 - DNA, 18 bp, Homo sapiens
gaaaggctattttcagat

SEQ ID NO: 1013541 - DNA, 18 bp, Homo sapiens
gaaaggctcagtctcagg

SEQ ID NO: 1013542 - DNA, 16 bp, Homo sapiens
gaaaggctcatttaaa

SEQ ID NO: 1013543 - DNA, 19 bp, Homo sapiens
gaaaggctcatttaaaaca

SEQ ID NO: 1013544 - DNA, 16 bp, Homo sapiens
gaaagggaacagaaag

SEQ ID NO: 1013545 - DNA, 21 bp, Homo sapiens
gaaagggatggtaagttgaga

SEQ ID NO: 1013546 - DNA, 16 bp, Homo sapiens
gaaagggcacttaatt

SEQ ID NO: 1013547 - DNA, 22 bp, Homo sapiens
gaaagggcacttaatttgtaaa

SEQ ID NO: 1013548 - DNA, 18 bp, Homo sapiens
gaaagggccaggagatgg

SEQ ID NO: 1013549 - DNA, 21 bp, Homo sapiens
gaaaggggagagcctgctggc

SEQ ID NO: 1013550 - DNA, 20 bp, Homo sapiens
gaaaggggcagtttaaagca

SEQ ID NO: 1013551 - DNA, 17 bp, Homo sapiens
gaaagggggtcccagtg

SEQ ID NO: 1013552 - DNA, 18 bp, Homo sapiens
gaaagggggtcccagtgg

SEQ ID NO: 1013553 - DNA, 21 bp, Homo sapiens
gaaagggtaatttcctttgct

SEQ ID NO: 1013554 - DNA, 23 bp, Homo sapiens
ccatctcaggccacctgccccct

SEQ ID NO: 1013555 - DNA, 15 bp, Homo sapiens
ccatctcaggtgcca

SEQ ID NO: 1013556 - DNA, 17 bp, Homo sapiens
ccatctcaggttggcgg

SEQ ID NO: 1013557 - DNA, 13 bp, Homo sapiens
ccatctcatcctg

SEQ ID NO: 1013558 - DNA, 17 bp, Homo sapiens
ccatctcatcctggcac

SEQ ID NO: 1013559 - DNA, 13 bp, Homo sapiens
ccatctccaggga

SEQ ID NO: 1013560 - DNA, 14 bp, Homo sapiens
ccatctccagggag

SEQ ID NO: 1013561 - DNA, 18 bp, Homo sapiens
ccatctccccaggcctcc

SEQ ID NO: 1013562 - DNA, 21 bp, Homo sapiens
ccatctcctataatctgtcaa

SEQ ID NO: 1013563 - DNA, 23 bp, Homo sapiens
ccatctcctataatctgtcaaaa

SEQ ID NO: 1013564 - DNA, 16 bp, Homo sapiens
ccatctcctttcaggg

SEQ ID NO: 1013565 - DNA, 12 bp, Homo sapiens
ccatctctacaa

SEQ ID NO: 1013566 - DNA, 16 bp, Homo sapiens
ccatctctaccatcat

SEQ ID NO: 1013567 - DNA, 14 bp, Homo sapiens
ccatctctcccact

SEQ ID NO: 1013568 - DNA, 18 bp, Homo sapiens
ccatctctcccacttcct

SEQ ID NO: 1013569 - DNA, 14 bp, Homo sapiens
ccatctctccctcc

SEQ ID NO: 1013570 - DNA, 23 bp, Homo sapiens
ccatctctgattttcaaagcttt

SEQ ID NO: 1013571 - DNA, 13 bp, Homo sapiens
ccatctctgtctg

SEQ ID NO: 1013572 - DNA, 16 bp, Homo sapiens
ccatctctgtctgggg

SEQ ID NO: 1013573 - DNA, 17 bp, Homo sapiens
ccatctctgtctggggc

SEQ ID NO: 1013574 - DNA, 15 bp, Homo sapiens
ccatctcttccttga

SEQ ID NO: 1013575 - DNA, 22 bp, Homo sapiens
ccatctgacaaaatggggcaga

SEQ ID NO: 1013576 - DNA, 16 bp, Homo sapiens
ccatctgaccgttttc

SEQ ID NO: 1013577 - DNA, 12 bp, Homo sapiens
ccatctgagctg

SEQ ID NO: 1013578 - DNA, 14 bp, Homo sapiens
ccatctgagctggg

SEQ ID NO: 1013579 - DNA, 12 bp, Homo sapiens
ccatctgcaccc

SEQ ID NO: 1013580 - DNA, 14 bp, Homo sapiens
ccatctgcacccct

SEQ ID NO: 1013581 - DNA, 22 bp, Homo sapiens
ccatctgcccaggggtgccccc

SEQ ID NO: 1013582 - DNA, 23 bp, Homo sapiens
ccatctgcccaggggtgccccct

SEQ ID NO: 1013583 - DNA, 14 bp, Homo sapiens
ccatctgcgcaggg

SEQ ID NO: 1013584 - DNA, 17 bp, Homo sapiens
ccatctgcgcagggtgg

SEQ ID NO: 1013585 - DNA, 22 bp, Homo sapiens
ccatctgggagtccccttttct

SEQ ID NO: 1013586 - DNA, 23 bp, Homo sapiens
ccatctgggtccttgcacccctc

SEQ ID NO: 1013587 - DNA, 16 bp, Homo sapiens
ccatctggtcatttgg

SEQ ID NO: 1013588 - DNA, 11 bp, Homo sapiens
ccatctgtaaa

SEQ ID NO: 1013589 - DNA, 13 bp, Homo sapiens
ccatctgtaaata

SEQ ID NO: 1013590 - DNA, 20 bp, Homo sapiens
ccatctgtaaatatcccaga

SEQ ID NO: 1013591 - DNA, 22 bp, Homo sapiens
ccatctgtaaatatcccagaga

SEQ ID NO: 1013592 - DNA, 14 bp, Homo sapiens
ccatctgtacatat

SEQ ID NO: 1013593 - DNA, 21 bp, Homo sapiens
ccatctgtccgtccagagccg

SEQ ID NO: 1013594 - DNA, 15 bp, Homo sapiens
ccatctgtctgccaa

SEQ ID NO: 1013595 - DNA, 16 bp, Homo sapiens
ccatctgtcttcagca

SEQ ID NO: 1013596 - DNA, 15 bp, Homo sapiens
ccatctgtgaataag

SEQ ID NO: 1013597 - DNA, 24 bp, Homo sapiens
ccatctgtttgaagattatatgaa

SEQ ID NO: 1013598 - DNA, 16 bp, Homo sapiens
ccatctgtttgttttt

SEQ ID NO: 1013599 - DNA, 13 bp, Homo sapiens
ccatcttcactct

SEQ ID NO: 1013600 - DNA, 14 bp, Homo sapiens
ccatcttccacctg

SEQ ID NO: 1013601 - DNA, 22 bp, Homo sapiens
ccatcttccacctgtgccctca

SEQ ID NO: 1013602 - DNA, 15 bp, Homo sapiens
ccatcttcctgctgc

SEQ ID NO: 1013603 - DNA, 17 bp, Homo sapiens
ccatcttcctgctgctg

SEQ ID NO: 1013604 - DNA, 23 bp, Homo sapiens
ccatcttcttcccttaactccaa

SEQ ID NO: 1013605 - DNA, 16 bp, Homo sapiens
ccatcttgagccacag

SEQ ID NO: 1013606 - DNA, 17 bp, Homo sapiens
ccatcttggcctcccag

SEQ ID NO: 1013607 - DNA, 22 bp, Homo sapiens
ccatcttggtagttctgtgcct

SEQ ID NO: 1013608 - DNA, 23 bp, Homo sapiens
ccatcttggtagttctgtgcctc

SEQ ID NO: 1013609 - DNA, 18 bp, Homo sapiens
ccatcttgtggggccagg

SEQ ID NO: 1013610 - DNA, 20 bp, Homo sapiens
ccatctttactcccaagact

SEQ ID NO: 1013611 - DNA, 14 bp, Homo sapiens
ccatctttctttgg

SEQ ID NO: 1013612 - DNA, 23 bp, Homo sapiens
ccatctttgatccttctgagctc

SEQ ID NO: 1013613 - DNA, 20 bp, Homo sapiens
ccatgaaaacgttttattgt

SEQ ID NO: 1013614 - DNA, 11 bp, Homo sapiens
ccatgaaaata

SEQ ID NO: 1013615 - DNA, 12 bp, Homo sapiens
ccatgaacacac

SEQ ID NO: 1013616 - DNA, 16 bp, Homo sapiens
ccatgaacacactgtg

SEQ ID NO: 1013617 - DNA, 17 bp, Homo sapiens
ccatgaacacactgtgt

SEQ ID NO: 1013618 - DNA, 22 bp, Homo sapiens
ccatgaacacactgtgtcctgg

SEQ ID NO: 1013619 - DNA, 15 bp, Homo sapiens
ccatgaaccaagacc

SEQ ID NO: 1013620 - DNA, 22 bp, Homo sapiens
ccatgaagaggagattggccag

SEQ ID NO: 1013621 - DNA, 18 bp, Homo sapiens
ccatgaatgtatcaggaa

SEQ ID NO: 1013622 - DNA, 13 bp, Homo sapiens
ccatgaatttcta

SEQ ID NO: 1013623 - DNA, 11 bp, Homo sapiens
ccatgacaaac

SEQ ID NO: 1013624 - DNA, 18 bp, Homo sapiens
ccatgacaaacctagctt

SEQ ID NO: 1013625 - DNA, 16 bp, Homo sapiens
ccatgacagaggctgc

SEQ ID NO: 1013626 - DNA, 14 bp, Homo sapiens
ccatgacatttcat

SEQ ID NO: 1013627 - DNA, 18 bp, Homo sapiens
ccatggccccccactccc

SEQ ID NO: 1013628 - DNA, 14 bp, Homo sapiens
ccatggctcaggca

SEQ ID NO: 1013629 - DNA, 15 bp, Homo sapiens
ccatggctgaagctg

SEQ ID NO: 1013630 - DNA, 11 bp, Homo sapiens
ccatggctggg

SEQ ID NO: 1013631 - DNA, 14 bp, Homo sapiens
ccatggcttcctga

SEQ ID NO: 1013632 - DNA, 20 bp, Homo sapiens
ccatggctttcatcctgtgt

SEQ ID NO: 1013633 - DNA, 21 bp, Homo sapiens
ccatgggaaatgtcaacaagt

SEQ ID NO: 1013634 - DNA, 18 bp, Homo sapiens
ccatgggaacctcatatg

SEQ ID NO: 1013635 - DNA, 17 bp, Homo sapiens
ccatgggacctcctccc

SEQ ID NO: 1013636 - DNA, 20 bp, Homo sapiens
ccatgggacctcctccctca

SEQ ID NO: 1013637 - DNA, 17 bp, Homo sapiens
ccatgggagccagctgc

SEQ ID NO: 1013638 - DNA, 19 bp, Homo sapiens
ccatgggagccagctgctt

SEQ ID NO: 1013639 - DNA, 14 bp, Homo sapiens
ccatgggcagagcc

SEQ ID NO: 1013640 - DNA, 18 bp, Homo sapiens
ccatgggcccgctgcctc

SEQ ID NO: 1013641 - DNA, 19 bp, Homo sapiens
ccatgggcccgctgcctct

SEQ ID NO: 1013642 - DNA, 12 bp, Homo sapiens
ccatgggcctgc

SEQ ID NO: 1013643 - DNA, 13 bp, Homo sapiens
ccatgggcctgct

SEQ ID NO: 1013644 - DNA, 20 bp, Homo sapiens
ccatgggcctgctgcgtcag

SEQ ID NO: 1013645 - DNA, 21 bp, Homo sapiens
ccatgggcctgctgcgtcaga

SEQ ID NO: 1013646 - DNA, 17 bp, Homo sapiens
ccatgggctagtgtgag

SEQ ID NO: 1013647 - DNA, 20 bp, Homo sapiens
ccatgggctagtgtgagtgg

SEQ ID NO: 1013648 - DNA, 15 bp, Homo sapiens
ccatgggctcccact

SEQ ID NO: 1013649 - DNA, 22 bp, Homo sapiens
ccatgggctgagtggggagcag

SEQ ID NO: 1013650 - DNA, 22 bp, Homo sapiens
ccatgggcttggacttcctggg

SEQ ID NO: 1013651 - DNA, 17 bp, Homo sapiens
ccatggggtccttggag

SEQ ID NO: 1013652 - DNA, 20 bp, Homo sapiens
ccatggggtcggctcctgat

SEQ ID NO: 1013653 - DNA, 21 bp, Homo sapiens
ccatggggtcggctcctgatg

SEQ ID NO: 1013654 - DNA, 16 bp, Homo sapiens
ccatggggttcgagac

SEQ ID NO: 1013655 - DNA, 21 bp, Homo sapiens
ccatggtagcccatctctcct

SEQ ID NO: 1013656 - DNA, 16 bp, Homo sapiens
ccatggtcctgtctgt

SEQ ID NO: 1013657 - DNA, 16 bp, Homo sapiens
ccatggtgatggtgta

SEQ ID NO: 1013658 - DNA, 13 bp, Homo sapiens
ccatggtggaggg

SEQ ID NO: 1013659 - DNA, 17 bp, Homo sapiens
ccatggtggagggcact

SEQ ID NO: 1013660 - DNA, 14 bp, Homo sapiens
ccatggtgtatgtg

SEQ ID NO: 1013661 - DNA, 17 bp, Homo sapiens
ccatggtgtatgtggtt

SEQ ID NO: 1013662 - DNA, 15 bp, Homo sapiens
ccatggttaagtcat

SEQ ID NO: 1013663 - DNA, 19 bp, Homo sapiens
ccatggttttggctctccc

SEQ ID NO: 1013664 - DNA, 23 bp, Homo sapiens
ccatgtaatggcagttatatttt

SEQ ID NO: 1013665 - DNA, 19 bp, Homo sapiens
ccatgtacctcccctgcct

SEQ ID NO: 1013666 - DNA, 17 bp, Homo sapiens
ccatgtactagttttag

SEQ ID NO: 1013667 - DNA, 14 bp, Homo sapiens
ccatgtactgtagt

SEQ ID NO: 1013668 - DNA, 20 bp, Homo sapiens
ccatgtagaataaatgaaga

SEQ ID NO: 1013669 - DNA, 14 bp, Homo sapiens
ccatgtagacccct

SEQ ID NO: 1013670 - DNA, 11 bp, Homo sapiens
ccatgtagcca

SEQ ID NO: 1013671 - DNA, 16 bp, Homo sapiens
ccatgtagccacccaa

SEQ ID NO: 1013672 - DNA, 23 bp, Homo sapiens
ccatgtatggaatcccactgtat

SEQ ID NO: 1013673 - DNA, 15 bp, Homo sapiens
ccatgtattatgaaa

SEQ ID NO: 1013674 - DNA, 18 bp, Homo sapiens
ccatgtattatgaaaaag

SEQ ID NO: 1013675 - DNA, 16 bp, Homo sapiens
ccatgtatttcaggga

SEQ ID NO: 1013676 - DNA, 21 bp, Homo sapiens
ccatgtatttcagggacctca

SEQ ID NO: 1013677 - DNA, 20 bp, Homo sapiens
ccatgtcaccggtcagtgcc

SEQ ID NO: 1013678 - DNA, 15 bp, Homo sapiens
ccatgtcactgcaga

SEQ ID NO: 1013679 - DNA, 19 bp, Homo sapiens
ccatgtccaagtccaacct

SEQ ID NO: 1013680 - DNA, 23 bp, Homo sapiens
ccatgtccaagtccaacctgcct

SEQ ID NO: 1013681 - DNA, 20 bp, Homo sapiens
ccatgtccaagttcttcacc

SEQ ID NO: 1013682 - DNA, 18 bp, Homo sapiens
ccatgtcgcgctcagcat

SEQ ID NO: 1013683 - DNA, 16 bp, Homo sapiens
ccatgtctctcagaat

SEQ ID NO: 1013684 - DNA, 13 bp, Homo sapiens
ccatgtctgcatt

SEQ ID NO: 1013685 - DNA, 19 bp, Homo sapiens
gaaatcattgttataaaga

SEQ ID NO: 1013686 - DNA, 17 bp, Homo sapiens
gaaatccaaatttctca

SEQ ID NO: 1013687 - DNA, 17 bp, Homo sapiens
gaaatccagaagtttta

SEQ ID NO: 1013688 - DNA, 20 bp, Homo sapiens
gaaatccagtttcccaccac

SEQ ID NO: 1013689 - DNA, 19 bp, Homo sapiens
gaaatccctgtttaatatt

SEQ ID NO: 1013690 - DNA, 21 bp, Homo sapiens
gaaatccctgtttaatattta

SEQ ID NO: 1013691 - DNA, 21 bp, Homo sapiens
gaaatcctcagccgagaaatt

SEQ ID NO: 1013692 - DNA, 12 bp, Homo sapiens
gaaatctcaccc

SEQ ID NO: 1013693 - DNA, 14 bp, Homo sapiens
gaaatctgaacatt

SEQ ID NO: 1013694 - DNA, 14 bp, Homo sapiens
gaaatcttgtctta

SEQ ID NO: 1013695 - DNA, 15 bp, Homo sapiens
gaaatcttttacatt

SEQ ID NO: 1013696 - DNA, 18 bp, Homo sapiens
gaaatcttttacattttt

SEQ ID NO: 1013697 - DNA, 19 bp, Homo sapiens
gaaatcttttacatttttc

SEQ ID NO: 1013698 - DNA, 20 bp, Homo sapiens
gaaatgaaaaaaaaaaacaa

SEQ ID NO: 1013699 - DNA, 16 bp, Homo sapiens
gaaatgaaaacatgta

SEQ ID NO: 1013700 - DNA, 24 bp, Homo sapiens
gaaatgaataagctttctctcaga

SEQ ID NO: 1013701 - DNA, 15 bp, Homo sapiens
gaaatgaattaaagt

SEQ ID NO: 1013702 - DNA, 16 bp, Homo sapiens
gaaatgaggtctgttt

SEQ ID NO: 1013703 - DNA, 17 bp, Homo sapiens
gaaatgaggtctgttta

SEQ ID NO: 1013704 - DNA, 13 bp, Homo sapiens
gaaatgaggtttt

SEQ ID NO: 1013705 - DNA, 15 bp, Homo sapiens
gaaatgataaagact

SEQ ID NO: 1013706 - DNA, 17 bp, Homo sapiens
gaaatgataaagacttt

SEQ ID NO: 1013707 - DNA, 18 bp, Homo sapiens
gaaatgataaagactttt

SEQ ID NO: 1013708 - DNA, 22 bp, Homo sapiens
gaaatgcattgctctggatctg

SEQ ID NO: 1013709 - DNA, 19 bp, Homo sapiens
gaaatgccaagtgcctgct

SEQ ID NO: 1013710 - DNA, 19 bp, Homo sapiens
gaaatgccctcctaaatgt

SEQ ID NO: 1013711 - DNA, 18 bp, Homo sapiens
gaaatgctgatggataac

SEQ ID NO: 1013712 - DNA, 14 bp, Homo sapiens
gaaatgctgcagga

SEQ ID NO: 1013713 - DNA, 15 bp, Homo sapiens
gaaatgctgctggcc

SEQ ID NO: 1013714 - DNA, 23 bp, Homo sapiens
gaaatgctggtttttcagttttc

SEQ ID NO: 1013715 - DNA, 13 bp, Homo sapiens
gaaatgcttaaaa

SEQ ID NO: 1013716 - DNA, 20 bp, Homo sapiens
gaaatgcttatgcttgtgta

SEQ ID NO: 1013717 - DNA, 15 bp, Homo sapiens
gaaatgcttttatat

SEQ ID NO: 1013718 - DNA, 14 bp, Homo sapiens
gaaatggaaatttt

SEQ ID NO: 1013719 - DNA, 14 bp, Homo sapiens
gaaatggaatcagg

SEQ ID NO: 1013720 - DNA, 16 bp, Homo sapiens
gaaatggctttgtgat

SEQ ID NO: 1013721 - DNA, 18 bp, Homo sapiens
gaaatgggagatggtcag

SEQ ID NO: 1013722 - DNA, 16 bp, Homo sapiens
gaaatgggcagttctc

SEQ ID NO: 1013723 - DNA, 19 bp, Homo sapiens
gaaatgggcatttatttta

SEQ ID NO: 1013724 - DNA, 12 bp, Homo sapiens
gaaatgggcctg

SEQ ID NO: 1013725 - DNA, 13 bp, Homo sapiens
gaaatgggcctgc

SEQ ID NO: 1013726 - DNA, 16 bp, Homo sapiens
gaaatgggcctgcctg

SEQ ID NO: 1013727 - DNA, 14 bp, Homo sapiens
gaaatggggaaagc

SEQ ID NO: 1013728 - DNA, 20 bp, Homo sapiens
gaaatggggaaagcagaact

SEQ ID NO: 1013729 - DNA, 21 bp, Homo sapiens
gaaatggtatgagctgagggg

SEQ ID NO: 1013730 - DNA, 20 bp, Homo sapiens
gaaatggtttcacttgctct

SEQ ID NO: 1013731 - DNA, 14 bp, Homo sapiens
gaaatgtaaactgc

SEQ ID NO: 1013732 - DNA, 13 bp, Homo sapiens
gaaatgtaacatg

SEQ ID NO: 1013733 - DNA, 14 bp, Homo sapiens
gaaatgtaaggctg

SEQ ID NO: 1013734 - DNA, 17 bp, Homo sapiens
gaaatgtaatactggaa

SEQ ID NO: 1013735 - DNA, 23 bp, Homo sapiens
gaaatgtcgatcaagagaatcaa

SEQ ID NO: 1013736 - DNA, 18 bp, Homo sapiens
gaaatgtgagaaatgtct

SEQ ID NO: 1013737 - DNA, 14 bp, Homo sapiens
gaaatgtgtttctg

SEQ ID NO: 1013738 - DNA, 12 bp, Homo sapiens
gaaatgttctta

SEQ ID NO: 1013739 - DNA, 19 bp, Homo sapiens
gaaatgttttgtaaacatt

SEQ ID NO: 1013740 - DNA, 18 bp, Homo sapiens
gaaattaaagtatgcaaa

SEQ ID NO: 1013741 - DNA, 22 bp, Homo sapiens
gaaattaaagtatgcaaaataa

SEQ ID NO: 1013742 - DNA, 18 bp, Homo sapiens
gaaattaaatccaataaa

SEQ ID NO: 1013743 - DNA, 22 bp, Homo sapiens
gaaattaagaaggcaaaaatgt

SEQ ID NO: 1013744 - DNA, 18 bp, Homo sapiens
gaaattaagcattttgaa

SEQ ID NO: 1013745 - DNA, 16 bp, Homo sapiens
gaaattaatttgtgaa

SEQ ID NO: 1013746 - DNA, 22 bp, Homo sapiens
gaaattaatttgtgaatttgca

SEQ ID NO: 1013747 - DNA, 15 bp, Homo sapiens
gaaattacctgtgga

SEQ ID NO: 1013748 - DNA, 22 bp, Homo sapiens
gaaattactgcccacttgtcaa

SEQ ID NO: 1013749 - DNA, 12 bp, Homo sapiens
gaacagctgtgt

SEQ ID NO: 1013750 - DNA, 13 bp, Homo sapiens
gaacagctgtgtc

SEQ ID NO: 1013751 - DNA, 17 bp, Homo sapiens
gaacagctgttcctgtg

SEQ ID NO: 1013752 - DNA, 18 bp, Homo sapiens
gaacagctgttcctgtgt

SEQ ID NO: 1013753 - DNA, 12 bp, Homo sapiens
gaacaggctggg

SEQ ID NO: 1013754 - DNA, 14 bp, Homo sapiens
gaacaggctggggc

SEQ ID NO: 1013755 - DNA, 18 bp, Homo sapiens
gaacaggctggggccttt

SEQ ID NO: 1013756 - DNA, 21 bp, Homo sapiens
gaacagggaaaataggcagga

SEQ ID NO: 1013757 - DNA, 19 bp, Homo sapiens
gaacagggcccaggcctgg

SEQ ID NO: 1013758 - DNA, 21 bp, Homo sapiens
gaacagggcccaggcctggag

SEQ ID NO: 1013759 - DNA, 14 bp, Homo sapiens
gaacaggtggatgt

SEQ ID NO: 1013760 - DNA, 16 bp, Homo sapiens
gaacaggtggttttta

SEQ ID NO: 1013761 - DNA, 12 bp, Homo sapiens
gaacagtaaaca

SEQ ID NO: 1013762 - DNA, 20 bp, Homo sapiens
gaacagtaaagaaagcagaa

SEQ ID NO: 1013763 - DNA, 21 bp, Homo sapiens
gaacagtaaagaaagcagaat

SEQ ID NO: 1013764 - DNA, 14 bp, Homo sapiens
gaacagtaactgcc

SEQ ID NO: 1013765 - DNA, 18 bp, Homo sapiens
gaacagtaggattgctgt

SEQ ID NO: 1013766 - DNA, 21 bp, Homo sapiens
gaacagtcacccttctgggca

SEQ ID NO: 1013767 - DNA, 14 bp, Homo sapiens
gaacagtgtttccc

SEQ ID NO: 1013768 - DNA, 16 bp, Homo sapiens
gaacataaaaaggaca

SEQ ID NO: 1013769 - DNA, 12 bp, Homo sapiens
gaacatacagac

SEQ ID NO: 1013770 - DNA, 21 bp, Homo sapiens
gaacatacatgatacattttt

SEQ ID NO: 1013771 - DNA, 23 bp, Homo sapiens
gaacatacatgatacatttttat

SEQ ID NO: 1013772 - DNA, 19 bp, Homo sapiens
gaacatatcatttgtgaag

SEQ ID NO: 1013773 - DNA, 18 bp, Homo sapiens
gaacatattgttgaaagg

SEQ ID NO: 1013774 - DNA, 15 bp, Homo sapiens
gaacatcaagatacc

SEQ ID NO: 1013775 - DNA, 17 bp, Homo sapiens
gaacatcacattcctct

SEQ ID NO: 1013776 - DNA, 15 bp, Homo sapiens
gaacatcattagaac

SEQ ID NO: 1013777 - DNA, 14 bp, Homo sapiens
gaacatccctgggc

SEQ ID NO: 1013778 - DNA, 15 bp, Homo sapiens
gaacatccctgggca

SEQ ID NO: 1013779 - DNA, 17 bp, Homo sapiens
gaacatccctttttcaa

SEQ ID NO: 1013780 - DNA, 13 bp, Homo sapiens
gaacatccttcct

SEQ ID NO: 1013781 - DNA, 14 bp, Homo sapiens
gaacatctcttgaa

SEQ ID NO: 1013782 - DNA, 17 bp, Homo sapiens
gaacatctcttgaaacc

SEQ ID NO: 1013783 - DNA, 17 bp, Homo sapiens
gaacatctgagtcctgg

SEQ ID NO: 1013784 - DNA, 21 bp, Homo sapiens
gaacatctgagtcctggatga

SEQ ID NO: 1013785 - DNA, 23 bp, Homo sapiens
gaacatctgcactcctgaacaca

SEQ ID NO: 1013786 - DNA, 16 bp, Homo sapiens
gaacatgaaatgccct

SEQ ID NO: 1013787 - DNA, 21 bp, Homo sapiens
gaacatgaactcatcattttt

SEQ ID NO: 1013788 - DNA, 16 bp, Homo sapiens
gaacatgcctgccaaa

SEQ ID NO: 1013789 - DNA, 22 bp, Homo sapiens
gaacatggctagcctttcttgt

SEQ ID NO: 1013790 - DNA, 16 bp, Homo sapiens
gaacatgtacactggt

SEQ ID NO: 1013791 - DNA, 24 bp, Homo sapiens
gaacatgtcctaattcttctgtcc

SEQ ID NO: 1013792 - DNA, 18 bp, Homo sapiens
gaacattaggaattgttt

SEQ ID NO: 1013793 - DNA, 18 bp, Homo sapiens
gaacattcccagcccagc

SEQ ID NO: 1013794 - DNA, 23 bp, Homo sapiens
gaacattcgaggtgtcaccctgc

SEQ ID NO: 1013795 - DNA, 15 bp, Homo sapiens
gaacattctggatct

SEQ ID NO: 1013796 - DNA, 12 bp, Homo sapiens
gaacattggaat

SEQ ID NO: 1013797 - DNA, 21 bp, Homo sapiens
gaacattggaatgttctcaga

SEQ ID NO: 1013798 - DNA, 22 bp, Homo sapiens
gaacattggggattgaaaatca

SEQ ID NO: 1013799 - DNA, 15 bp, Homo sapiens
gaacattgtactgtt

SEQ ID NO: 1013800 - DNA, 15 bp, Homo sapiens
gaacattgttctgaa

SEQ ID NO: 1013801 - DNA, 13 bp, Homo sapiens
gaacatttatatc

SEQ ID NO: 1013802 - DNA, 20 bp, Homo sapiens
gaacatttcttatgattttt

SEQ ID NO: 1013803 - DNA, 14 bp, Homo sapiens
gaacattttttatt

SEQ ID NO: 1013804 - DNA, 15 bp, Homo sapiens
gaaccaaaaagagca

SEQ ID NO: 1013805 - DNA, 17 bp, Homo sapiens
gaaccaaagagactgga

SEQ ID NO: 1013806 - DNA, 15 bp, Homo sapiens
gaaccaaatacctca

SEQ ID NO: 1013807 - DNA, 22 bp, Homo sapiens
gaaccaaatacctcaatttttg

SEQ ID NO: 1013808 - DNA, 13 bp, Homo sapiens
gaaccaaggcagc

SEQ ID NO: 1013809 - DNA, 16 bp, Homo sapiens
gaaccaaggcagcctc

SEQ ID NO: 1013810 - DNA, 18 bp, Homo sapiens
gaaccaaggcagcctcca

SEQ ID NO: 1013811 - DNA, 20 bp, Homo sapiens
gaaccaaggcagcctccaga

SEQ ID NO: 1013812 - DNA, 23 bp, Homo sapiens
gaaccaaggcagcctccagagcc

SEQ ID NO: 1013813 - DNA, 14 bp, Homo sapiens
gaaccacaactttg

SEQ ID NO: 1013814 - DNA, 23 bp, Homo sapiens
gaaccacagatgtgtctgggaga

SEQ ID NO: 1013815 - DNA, 18 bp, Homo sapiens
ccattgtactccagcctg

SEQ ID NO: 1013816 - DNA, 20 bp, Homo sapiens
ccattgtggctcctatctgt

SEQ ID NO: 1013817 - DNA, 12 bp, Homo sapiens
ccattgtgtgag

SEQ ID NO: 1013818 - DNA, 19 bp, Homo sapiens
ccattgtgtgatccagccc

SEQ ID NO: 1013819 - DNA, 21 bp, Homo sapiens
ccattgtgtgatccagccctg

SEQ ID NO: 1013820 - DNA, 14 bp, Homo sapiens
ccattgttcccttc

SEQ ID NO: 1013821 - DNA, 15 bp, Homo sapiens
ccattgtttgaaaca

SEQ ID NO: 1013822 - DNA, 19 bp, Homo sapiens
ccatttaagagactcttta

SEQ ID NO: 1013823 - DNA, 20 bp, Homo sapiens
ccatttaagagactctttat

SEQ ID NO: 1013824 - DNA, 23 bp, Homo sapiens
ccatttaagagactctttatttt

SEQ ID NO: 1013825 - DNA, 14 bp, Homo sapiens
ccatttaataaaga

SEQ ID NO: 1013826 - DNA, 19 bp, Homo sapiens
ccatttaataaagaaatat

SEQ ID NO: 1013827 - DNA, 22 bp, Homo sapiens
ccatttactgacacttcctgtc

SEQ ID NO: 1013828 - DNA, 23 bp, Homo sapiens
ccatttacttaagacttaatgag

SEQ ID NO: 1013829 - DNA, 21 bp, Homo sapiens
ccatttataaccccagcctga

SEQ ID NO: 1013830 - DNA, 14 bp, Homo sapiens
ccatttatagaata

SEQ ID NO: 1013831 - DNA, 21 bp, Homo sapiens
ccatttcatctatttctgaga

SEQ ID NO: 1013832 - DNA, 16 bp, Homo sapiens
ccatttcccacatctt

SEQ ID NO: 1013833 - DNA, 13 bp, Homo sapiens
ccatttcccatct

SEQ ID NO: 1013834 - DNA, 15 bp, Homo sapiens
ccatttcccatctgc

SEQ ID NO: 1013835 - DNA, 11 bp, Homo sapiens
ccatttccctt

SEQ ID NO: 1013836 - DNA, 19 bp, Homo sapiens
ccatttcctcacgtgcagg

SEQ ID NO: 1013837 - DNA, 12 bp, Homo sapiens
ccatttcctgat

SEQ ID NO: 1013838 - DNA, 13 bp, Homo sapiens
ccatttctattta

SEQ ID NO: 1013839 - DNA, 17 bp, Homo sapiens
ccatttctccatgggcc

SEQ ID NO: 1013840 - DNA, 15 bp, Homo sapiens
ccatttctctacact

SEQ ID NO: 1013841 - DNA, 12 bp, Homo sapiens
ccatttctgcct

SEQ ID NO: 1013842 - DNA, 13 bp, Homo sapiens
ccatttcttctct

SEQ ID NO: 1013843 - DNA, 15 bp, Homo sapiens
ccatttcttctctct

SEQ ID NO: 1013844 - DNA, 21 bp, Homo sapiens
ccatttcttctctctgttccc

SEQ ID NO: 1013845 - DNA, 16 bp, Homo sapiens
ccatttgaacacatta

SEQ ID NO: 1013846 - DNA, 17 bp, Homo sapiens
ccatttgaacacattat

SEQ ID NO: 1013847 - DNA, 13 bp, Homo sapiens
ccatttgaagtgt

SEQ ID NO: 1013848 - DNA, 20 bp, Homo sapiens
ccatttgcaataacagctgc

SEQ ID NO: 1013849 - DNA, 16 bp, Homo sapiens
ccatttgctttttcac

SEQ ID NO: 1013850 - DNA, 15 bp, Homo sapiens
ccatttgtaataaag

SEQ ID NO: 1013851 - DNA, 20 bp, Homo sapiens
ccatttgtaataaagtatat

SEQ ID NO: 1013852 - DNA, 20 bp, Homo sapiens
ccatttgtattaccattact

SEQ ID NO: 1013853 - DNA, 22 bp, Homo sapiens
ccatttgtcatcgttccccacc

SEQ ID NO: 1013854 - DNA, 13 bp, Homo sapiens
ccatttgtcccag

SEQ ID NO: 1013855 - DNA, 17 bp, Homo sapiens
ccatttgtcccagacta

SEQ ID NO: 1013856 - DNA, 14 bp, Homo sapiens
ccatttgtgccaga

SEQ ID NO: 1013857 - DNA, 17 bp, Homo sapiens
ccatttgttaatatcac

SEQ ID NO: 1013858 - DNA, 16 bp, Homo sapiens
ccatttgttcctgctt

SEQ ID NO: 1013859 - DNA, 13 bp, Homo sapiens
ccattttaaattt

SEQ ID NO: 1013860 - DNA, 19 bp, Homo sapiens
ccattttaaattttatttt

SEQ ID NO: 1013861 - DNA, 16 bp, Homo sapiens
ccattttacatttcta

SEQ ID NO: 1013862 - DNA, 12 bp, Homo sapiens
ccattttatgca

SEQ ID NO: 1013863 - DNA, 18 bp, Homo sapiens
ccattttcaactgctttg

SEQ ID NO: 1013864 - DNA, 19 bp, Homo sapiens
ccattttcaactgctttga

SEQ ID NO: 1013865 - DNA, 15 bp, Homo sapiens
ccattttcatcctga

SEQ ID NO: 1013866 - DNA, 22 bp, Homo sapiens
ccattttcccccactactgcag

SEQ ID NO: 1013867 - DNA, 12 bp, Homo sapiens
ccattttcgctt

SEQ ID NO: 1013868 - DNA, 18 bp, Homo sapiens
ccattttctaagggtaga

SEQ ID NO: 1013869 - DNA, 16 bp, Homo sapiens
ccatttttcctctgtt

SEQ ID NO: 1013870 - DNA, 15 bp, Homo sapiens
ccatttttctataaa

SEQ ID NO: 1013871 - DNA, 14 bp, Homo sapiens
ccatttttgctaat

SEQ ID NO: 1013872 - DNA, 23 bp, Homo sapiens
gaactgattcacatctcattttt

SEQ ID NO: 1013873 - DNA, 16 bp, Homo sapiens
gaactgcaacactgga

SEQ ID NO: 1013874 - DNA, 17 bp, Homo sapiens
gaactgcaactgaatga

SEQ ID NO: 1013875 - DNA, 13 bp, Homo sapiens
gaactgcactttt

SEQ ID NO: 1013876 - DNA, 20 bp, Homo sapiens
gaactgcagacctcactgtc

SEQ ID NO: 1013877 - DNA, 16 bp, Homo sapiens
gaactgcaggccctgg

SEQ ID NO: 1013878 - DNA, 17 bp, Homo sapiens
gaactgcaggccctggc

SEQ ID NO: 1013879 - DNA, 18 bp, Homo sapiens
gaactgcaggccctggcc

SEQ ID NO: 1013880 - DNA, 23 bp, Homo sapiens
gaactgcaggccctggcctcccc

SEQ ID NO: 1013881 - DNA, 15 bp, Homo sapiens
gaactgcatatgttt

SEQ ID NO: 1013882 - DNA, 22 bp, Homo sapiens
gaactgcatggacctaacattc

SEQ ID NO: 1013883 - DNA, 16 bp, Homo sapiens
gaactgcccttgctgc

SEQ ID NO: 1013884 - DNA, 20 bp, Homo sapiens
gaactgcccttgctgcccgc

SEQ ID NO: 1013885 - DNA, 15 bp, Homo sapiens
gaactgcttcatgtg

SEQ ID NO: 1013886 - DNA, 21 bp, Homo sapiens
gaactgcttttcctcaagcaa

SEQ ID NO: 1013887 - DNA, 23 bp, Homo sapiens
gaactggacacaataggtctttc

SEQ ID NO: 1013888 - DNA, 21 bp, Homo sapiens
gaactggctgggcccctgggg

SEQ ID NO: 1013889 - DNA, 22 bp, Homo sapiens
gaactggctgggcccctgggga

SEQ ID NO: 1013890 - DNA, 23 bp, Homo sapiens
gaactggctgggcccctggggac

SEQ ID NO: 1013891 - DNA, 11 bp, Homo sapiens
gaactgggctg

SEQ ID NO: 1013892 - DNA, 13 bp, Homo sapiens
gaactgggctggc

SEQ ID NO: 1013893 - DNA, 16 bp, Homo sapiens
gaactgggctgggcct

SEQ ID NO: 1013894 - DNA, 14 bp, Homo sapiens
gaactgtagggcca

SEQ ID NO: 1013895 - DNA, 20 bp, Homo sapiens
gaactgtattctagtggctg

SEQ ID NO: 1013896 - DNA, 18 bp, Homo sapiens
gaactgtccagagagcaa

SEQ ID NO: 1013897 - DNA, 12 bp, Homo sapiens
gaactgtcccat

SEQ ID NO: 1013898 - DNA, 22 bp, Homo sapiens
gaactgtgcatagtgctgggat

SEQ ID NO: 1013899 - DNA, 18 bp, Homo sapiens
gaactgtgcatcaaccag

SEQ ID NO: 1013900 - DNA, 14 bp, Homo sapiens
gaactgtgcctagt

SEQ ID NO: 1013901 - DNA, 14 bp, Homo sapiens
gaactgtgtattta

SEQ ID NO: 1013902 - DNA, 16 bp, Homo sapiens
gaactgtgtatttatt

SEQ ID NO: 1013903 - DNA, 23 bp, Homo sapiens
gaactgtgtatttatttaaaact

SEQ ID NO: 1013904 - DNA, 17 bp, Homo sapiens
gaactgttagatgctga

SEQ ID NO: 1013905 - DNA, 14 bp, Homo sapiens
gaactgttcacact

SEQ ID NO: 1013906 - DNA, 17 bp, Homo sapiens
gaactgttcacactgca

SEQ ID NO: 1013907 - DNA, 13 bp, Homo sapiens
gaactgttgtata

SEQ ID NO: 1013908 - DNA, 20 bp, Homo sapiens
gaactgttgtataaatttat

SEQ ID NO: 1013909 - DNA, 13 bp, Homo sapiens
gaacttaaaatga

SEQ ID NO: 1013910 - DNA, 14 bp, Homo sapiens
gaacttaaataatg

SEQ ID NO: 1013911 - DNA, 17 bp, Homo sapiens
gaacttaaataatgtga

SEQ ID NO: 1013912 - DNA, 20 bp, Homo sapiens
gaacttaaattatgttttaa

SEQ ID NO: 1013913 - DNA, 17 bp, Homo sapiens
gaacttacattgttcaa

SEQ ID NO: 1013914 - DNA, 20 bp, Homo sapiens
gaacttagatgttaaatgtt

SEQ ID NO: 1013915 - DNA, 22 bp, Homo sapiens
gaacttagccatttttcaaagc

SEQ ID NO: 1013916 - DNA, 13 bp, Homo sapiens
gaacttcagaaag

SEQ ID NO: 1013917 - DNA, 14 bp, Homo sapiens
gaacttcagaaaga

SEQ ID NO: 1013918 - DNA, 16 bp, Homo sapiens
gaacttgaactgattc

SEQ ID NO: 1013919 - DNA, 17 bp, Homo sapiens
gaacttgaatgtgtcag

SEQ ID NO: 1013920 - DNA, 17 bp, Homo sapiens
gaacttgagctctgtaa

SEQ ID NO: 1013921 - DNA, 14 bp, Homo sapiens
gaacttgctgctgt

SEQ ID NO: 1013922 - DNA, 18 bp, Homo sapiens
gaacttgctgctgtcttg

SEQ ID NO: 1013923 - DNA, 16 bp, Homo sapiens
gaacttgctgctgtgc

SEQ ID NO: 1013924 - DNA, 15 bp, Homo sapiens
gaacttgtctcttca

SEQ ID NO: 1013925 - DNA, 19 bp, Homo sapiens
gaactttaaagctcaggag

SEQ ID NO: 1013926 - DNA, 14 bp, Homo sapiens
gaactttctccctc

SEQ ID NO: 1013927 - DNA, 21 bp, Homo sapiens
gaactttctcttcatactttt

SEQ ID NO: 1013928 - DNA, 14 bp, Homo sapiens
gaactttctgcttt

SEQ ID NO: 1013929 - DNA, 20 bp, Homo sapiens
gaacttttaaaagattatct

SEQ ID NO: 1013930 - DNA, 15 bp, Homo sapiens
gaacttttacagaat

SEQ ID NO: 1013931 - DNA, 18 bp, Homo sapiens
gaacttttacagaatgca

SEQ ID NO: 1013932 - DNA, 19 bp, Homo sapiens
gaacttttacagaatgcat

SEQ ID NO: 1013933 - DNA, 21 bp, Homo sapiens
gaacttttggctaacagaaat

SEQ ID NO: 1013934 - DNA, 18 bp, Homo sapiens
gaacttttgtaatttgaa

SEQ ID NO: 1013935 - DNA, 21 bp, Homo sapiens
gaacttttgtactgaattttt

SEQ ID NO: 1013936 - DNA, 14 bp, Homo sapiens
gaactttttatttg

SEQ ID NO: 1013937 - DNA, 21 bp, Homo sapiens
gaactttttatttgaggagac

SEQ ID NO: 1013938 - DNA, 10 bp, Homo sapiens
gaagaaaaaa

SEQ ID NO: 1013939 - DNA, 21 bp, Homo sapiens
gaagaaaactatcctgcgggt

SEQ ID NO: 1013940 - DNA, 21 bp, Homo sapiens
gaagaaaaggggagcacaagg

SEQ ID NO: 1013941 - DNA, 18 bp, Homo sapiens
gaagaaactttctggtgc

SEQ ID NO: 1013942 - DNA, 14 bp, Homo sapiens
gaagaaagaagaca

SEQ ID NO: 1013943 - DNA, 17 bp, Homo sapiens
gaagaaagagcttgagg

SEQ ID NO: 1013944 - DNA, 17 bp, Homo sapiens
gaagaaagatttgttac

SEQ ID NO: 1013945 - DNA, 22 bp, Homo sapiens
gaagaaagatttgttactgtat

SEQ ID NO: 1013946 - DNA, 22 bp, Homo sapiens
gaagaaagtcaaaaaattattt

SEQ ID NO: 1013947 - DNA, 16 bp, Homo sapiens
gaagaaatagcagagc

SEQ ID NO: 1013948 - DNA, 13 bp, Homo sapiens
cccacacagggca

SEQ ID NO: 1013949 - DNA, 14 bp, Homo sapiens
cccacaccccagcc

SEQ ID NO: 1013950 - DNA, 15 bp, Homo sapiens
cccacaccccagccc

SEQ ID NO: 1013951 - DNA, 16 bp, Homo sapiens
cccacaccgtcttcct

SEQ ID NO: 1013952 - DNA, 22 bp, Homo sapiens
cccacacctcagttcccttggc

SEQ ID NO: 1013953 - DNA, 18 bp, Homo sapiens
cccacacggactcccggg

SEQ ID NO: 1013954 - DNA, 21 bp, Homo sapiens
cccacacggactcccgggcca

SEQ ID NO: 1013955 - DNA, 17 bp, Homo sapiens
cccacacggcagccccc

SEQ ID NO: 1013956 - DNA, 19 bp, Homo sapiens
cccacactgaaaccaaaac

SEQ ID NO: 1013957 - DNA, 16 bp, Homo sapiens
cccacactgccagaag

SEQ ID NO: 1013958 - DNA, 15 bp, Homo sapiens
cccacagactccggc

SEQ ID NO: 1013959 - DNA, 14 bp, Homo sapiens
cccacagactgccc

SEQ ID NO: 1013960 - DNA, 17 bp, Homo sapiens
cccacagactgccccag

SEQ ID NO: 1013961 - DNA, 15 bp, Homo sapiens
cccacagagcctggc

SEQ ID NO: 1013962 - DNA, 19 bp, Homo sapiens
cccacagagtgctggactg

SEQ ID NO: 1013963 - DNA, 20 bp, Homo sapiens
cccacagagtgctggactgt

SEQ ID NO: 1013964 - DNA, 13 bp, Homo sapiens
cccacagcagggg

SEQ ID NO: 1013965 - DNA, 17 bp, Homo sapiens
cccacagcgtccctggc

SEQ ID NO: 1013966 - DNA, 18 bp, Homo sapiens
cccacagcgtccctggcg

SEQ ID NO: 1013967 - DNA, 17 bp, Homo sapiens
cccacagctccaggaca

SEQ ID NO: 1013968 - DNA, 14 bp, Homo sapiens
cccacagctcccac

SEQ ID NO: 1013969 - DNA, 20 bp, Homo sapiens
cccacagctcccaccccacc

SEQ ID NO: 1013970 - DNA, 13 bp, Homo sapiens
cccacagctctgg

SEQ ID NO: 1013971 - DNA, 14 bp, Homo sapiens
cccacagctctggg

SEQ ID NO: 1013972 - DNA, 17 bp, Homo sapiens
cccacagcttcctgagg

SEQ ID NO: 1013973 - DNA, 22 bp, Homo sapiens
cccacaggaagcctgcagtcct

SEQ ID NO: 1013974 - DNA, 23 bp, Homo sapiens
cccacaggaagcctgcagtcctg

SEQ ID NO: 1013975 - DNA, 19 bp, Homo sapiens
cccacaggacatttctcta

SEQ ID NO: 1013976 - DNA, 18 bp, Homo sapiens
cccacaggcccttcctct

SEQ ID NO: 1013977 - DNA, 13 bp, Homo sapiens
cccacaggtgagg

SEQ ID NO: 1013978 - DNA, 23 bp, Homo sapiens
cccacaggtgaggggcaggacct

SEQ ID NO: 1013979 - DNA, 18 bp, Homo sapiens
cccacagtgagaggggag

SEQ ID NO: 1013980 - DNA, 19 bp, Homo sapiens
cccacatccaactccagca

SEQ ID NO: 1013981 - DNA, 14 bp, Homo sapiens
cccacatcccactg

SEQ ID NO: 1013982 - DNA, 16 bp, Homo sapiens
cccacatcccaggctt

SEQ ID NO: 1013983 - DNA, 20 bp, Homo sapiens
cccacatgaggccatctcag

SEQ ID NO: 1013984 - DNA, 22 bp, Homo sapiens
cccacatgtggccatggcctct

SEQ ID NO: 1013985 - DNA, 14 bp, Homo sapiens
cccacatttgggct

SEQ ID NO: 1013986 - DNA, 17 bp, Homo sapiens
cccacatttgggctcag

SEQ ID NO: 1013987 - DNA, 16 bp, Homo sapiens
cccaccaaactgcaca

SEQ ID NO: 1013988 - DNA, 11 bp, Homo sapiens
cccaccaacaa

SEQ ID NO: 1013989 - DNA, 13 bp, Homo sapiens
cccaccacctagg

SEQ ID NO: 1013990 - DNA, 20 bp, Homo sapiens
cccaccacctaggccactcc

SEQ ID NO: 1013991 - DNA, 19 bp, Homo sapiens
cccaccacgatgtggccct

SEQ ID NO: 1013992 - DNA, 16 bp, Homo sapiens
cccaccacgcatgctc

SEQ ID NO: 1013993 - DNA, 20 bp, Homo sapiens
cccaccagaacgcaccccac

SEQ ID NO: 1013994 - DNA, 18 bp, Homo sapiens
cccacggagacagaggaa

SEQ ID NO: 1013995 - DNA, 19 bp, Homo sapiens
cccacggcacctcggggac

SEQ ID NO: 1013996 - DNA, 14 bp, Homo sapiens
cccacgtctggcca

SEQ ID NO: 1013997 - DNA, 19 bp, Homo sapiens
cccacgtctggccaggcac

SEQ ID NO: 1013998 - DNA, 22 bp, Homo sapiens
cccacgtctggccaggcactgc

SEQ ID NO: 1013999 - DNA, 16 bp, Homo sapiens
cccacgttctcacacc

SEQ ID NO: 1014000 - DNA, 15 bp, Homo sapiens
cccactactgcagca

SEQ ID NO: 1014001 - DNA, 18 bp, Homo sapiens
cccactactgcagcacct

SEQ ID NO: 1014002 - DNA, 18 bp, Homo sapiens
cccactagacccactgga

SEQ ID NO: 1014003 - DNA, 17 bp, Homo sapiens
cccactcaccagcccta

SEQ ID NO: 1014004 - DNA, 14 bp, Homo sapiens
cccactccaccctg

SEQ ID NO: 1014005 - DNA, 16 bp, Homo sapiens
cccactccaccctgtt

SEQ ID NO: 1014006 - DNA, 18 bp, Homo sapiens
cccactccaccctgttag

SEQ ID NO: 1014007 - DNA, 18 bp, Homo sapiens
cccactcccatctcctta

SEQ ID NO: 1014008 - DNA, 14 bp, Homo sapiens
cccactccccagcc

SEQ ID NO: 1014009 - DNA, 13 bp, Homo sapiens
cccactcccccac

SEQ ID NO: 1014010 - DNA, 13 bp, Homo sapiens
cccactccctggc

SEQ ID NO: 1014011 - DNA, 20 bp, Homo sapiens
cccactccctggctctcaga

SEQ ID NO: 1014012 - DNA, 19 bp, Homo sapiens
cccactcccttgctggccc

SEQ ID NO: 1014013 - DNA, 12 bp, Homo sapiens
cccactcctcta

SEQ ID NO: 1014014 - DNA, 13 bp, Homo sapiens
cccactcctctcc

SEQ ID NO: 1014015 - DNA, 15 bp, Homo sapiens
cccactcctctccac

SEQ ID NO: 1014016 - DNA, 16 bp, Homo sapiens
cccactcctctcccac

SEQ ID NO: 1014017 - DNA, 21 bp, Homo sapiens
cccactctcattccccaggtg

SEQ ID NO: 1014018 - DNA, 20 bp, Homo sapiens
cccactctccatcagatgtg

SEQ ID NO: 1014019 - DNA, 14 bp, Homo sapiens
cccactctctcacc

SEQ ID NO: 1014020 - DNA, 16 bp, Homo sapiens
cccactctctcaccca

SEQ ID NO: 1014021 - DNA, 17 bp, Homo sapiens
cccactctgcctgcctg

SEQ ID NO: 1014022 - DNA, 15 bp, Homo sapiens
cccactctgcggccc

SEQ ID NO: 1014023 - DNA, 23 bp, Homo sapiens
cccactgaattgacatgaccctc

SEQ ID NO: 1014024 - DNA, 16 bp, Homo sapiens
cccactgacagcctcc

SEQ ID NO: 1014025 - DNA, 15 bp, Homo sapiens
cccactgcaacttgt

SEQ ID NO: 1014026 - DNA, 16 bp, Homo sapiens
cccactgcacacacct

SEQ ID NO: 1014027 - DNA, 18 bp, Homo sapiens
cccactgccagatgctgc

SEQ ID NO: 1014028 - DNA, 16 bp, Homo sapiens
cccactgccagcagca

SEQ ID NO: 1014029 - DNA, 21 bp, Homo sapiens
cccactgccagcagcagcagg

SEQ ID NO: 1014030 - DNA, 22 bp, Homo sapiens
cccactgccaggggttcttgag

SEQ ID NO: 1014031 - DNA, 19 bp, Homo sapiens
cccactgcccaccccctca

SEQ ID NO: 1014032 - DNA, 22 bp, Homo sapiens
cccactgcccaccccctcaagc

SEQ ID NO: 1014033 - DNA, 21 bp, Homo sapiens
cccactgccccgtgtgaatgt

SEQ ID NO: 1014034 - DNA, 22 bp, Homo sapiens
cccactgcctcctgcctggggt

SEQ ID NO: 1014035 - DNA, 16 bp, Homo sapiens
cccactgcctgcccac

SEQ ID NO: 1014036 - DNA, 18 bp, Homo sapiens
cccactgcggggagacag

SEQ ID NO: 1014037 - DNA, 20 bp, Homo sapiens
cccactgctaaggctgctgg

SEQ ID NO: 1014038 - DNA, 12 bp, Homo sapiens
cccactggaaga

SEQ ID NO: 1014039 - DNA, 24 bp, Homo sapiens
cccactggaagatcccctctcctg

SEQ ID NO: 1014040 - DNA, 11 bp, Homo sapiens
cccactggaca

SEQ ID NO: 1014041 - DNA, 12 bp, Homo sapiens
cccactggacaa

SEQ ID NO: 1014042 - DNA, 21 bp, Homo sapiens
cccactgggactcccagcaga

SEQ ID NO: 1014043 - DNA, 22 bp, Homo sapiens
cccactgtccccctacccaccg

SEQ ID NO: 1014044 - DNA, 22 bp, Homo sapiens
cccactgtttctcttgagctgg

SEQ ID NO: 1014045 - DNA, 20 bp, Homo sapiens
cccacttagccgcaccctgc

SEQ ID NO: 1014046 - DNA, 20 bp, Homo sapiens
cccacttagccgtccatggc

SEQ ID NO: 1014047 - DNA, 18 bp, Homo sapiens
cccacttagtgctggtcc

SEQ ID NO: 1014048 - DNA, 15 bp, Homo sapiens
cccacttatgctgct

SEQ ID NO: 1014049 - DNA, 16 bp, Homo sapiens
cccacttatgctgctg

SEQ ID NO: 1014050 - DNA, 13 bp, Homo sapiens
cccacttcccctc

SEQ ID NO: 1014051 - DNA, 12 bp, Homo sapiens
cccacttcctcc

SEQ ID NO: 1014052 - DNA, 18 bp, Homo sapiens
cccacttctctctaagga

SEQ ID NO: 1014053 - DNA, 14 bp, Homo sapiens
cccacttctggcat

SEQ ID NO: 1014054 - DNA, 15 bp, Homo sapiens
cccacttctggcctc

SEQ ID NO: 1014055 - DNA, 16 bp, Homo sapiens
cccacttctggcctcc

SEQ ID NO: 1014056 - DNA, 18 bp, Homo sapiens
cccacttctggcctccag

SEQ ID NO: 1014057 - DNA, 19 bp, Homo sapiens
cccacttctggcctccagc

SEQ ID NO: 1014058 - DNA, 23 bp, Homo sapiens
cccacttctggcctccagccttt

SEQ ID NO: 1014059 - DNA, 14 bp, Homo sapiens
cccacttgcctctt

SEQ ID NO: 1014060 - DNA, 14 bp, Homo sapiens
cccacttggggcct

SEQ ID NO: 1014061 - DNA, 21 bp, Homo sapiens
cccactttgctgttccttact

SEQ ID NO: 1014062 - DNA, 17 bp, Homo sapiens
cccagaaaaactggctc

SEQ ID NO: 1014063 - DNA, 14 bp, Homo sapiens
cccagaaacaacag

SEQ ID NO: 1014064 - DNA, 13 bp, Homo sapiens
cccagaaactgaa

SEQ ID NO: 1014065 - DNA, 19 bp, Homo sapiens
cccagaaagattttctcca

SEQ ID NO: 1014066 - DNA, 17 bp, Homo sapiens
cccagaaagctgccaga

SEQ ID NO: 1014067 - DNA, 18 bp, Homo sapiens
cccagaaagctgccagag

SEQ ID NO: 1014068 - DNA, 16 bp, Homo sapiens
cccagaaagctgcgga

SEQ ID NO: 1014069 - DNA, 14 bp, Homo sapiens
cccagaaaggagac

SEQ ID NO: 1014070 - DNA, 15 bp, Homo sapiens
cccagaaaggagact

SEQ ID NO: 1014071 - DNA, 17 bp, Homo sapiens
cccagaaaggagactag

SEQ ID NO: 1014072 - DNA, 14 bp, Homo sapiens
cccagaaatcactg

SEQ ID NO: 1014073 - DNA, 22 bp, Homo sapiens
cccagaacaaaaagaaatcttg

SEQ ID NO: 1014074 - DNA, 19 bp, Homo sapiens
cccagaacatacactgtga

SEQ ID NO: 1014075 - DNA, 20 bp, Homo sapiens
cccagaacatacactgtgaa

SEQ ID NO: 1014076 - DNA, 23 bp, Homo sapiens
cccagaactattctgggggcccg

SEQ ID NO: 1014077 - DNA, 14 bp, Homo sapiens
cccagaactgcccc

SEQ ID NO: 1014078 - DNA, 22 bp, Homo sapiens
gaagatccgagtgtgatttgaa

SEQ ID NO: 1014079 - DNA, 16 bp, Homo sapiens
gaagatctgcaaacat

SEQ ID NO: 1014080 - DNA, 14 bp, Homo sapiens
gaagatgaaatata

SEQ ID NO: 1014081 - DNA, 16 bp, Homo sapiens
gaagatgccagcttct

SEQ ID NO: 1014082 - DNA, 19 bp, Homo sapiens
gaagatgccagcttctctc

SEQ ID NO: 1014083 - DNA, 15 bp, Homo sapiens
gaagatgcccctgct

SEQ ID NO: 1014084 - DNA, 17 bp, Homo sapiens
gaagatgcctgttaatt

SEQ ID NO: 1014085 - DNA, 16 bp, Homo sapiens
gaagatggcatcctgt

SEQ ID NO: 1014086 - DNA, 22 bp, Homo sapiens
gaagatggtccgtgcccaggcc

SEQ ID NO: 1014087 - DNA, 22 bp, Homo sapiens
gaagatggtttcaattcagatt

SEQ ID NO: 1014088 - DNA, 18 bp, Homo sapiens
gaagatgtatgctttgaa

SEQ ID NO: 1014089 - DNA, 21 bp, Homo sapiens
gaagatgtatgctttgaatgc

SEQ ID NO: 1014090 - DNA, 22 bp, Homo sapiens
gaagatgtctcctcaagcctgt

SEQ ID NO: 1014091 - DNA, 23 bp, Homo sapiens
gaagatgtctcctcaagcctgtg

SEQ ID NO: 1014092 - DNA, 14 bp, Homo sapiens
gaagatgtgtaaac

SEQ ID NO: 1014093 - DNA, 15 bp, Homo sapiens
gaagatgtgtaaaca

SEQ ID NO: 1014094 - DNA, 20 bp, Homo sapiens
gaagattaggagaaacacat

SEQ ID NO: 1014095 - DNA, 12 bp, Homo sapiens
gaagattctatt

SEQ ID NO: 1014096 - DNA, 21 bp, Homo sapiens
gaagattctatttaattgaaa

SEQ ID NO: 1014097 - DNA, 17 bp, Homo sapiens
gaagattctcctgtgct

SEQ ID NO: 1014098 - DNA, 14 bp, Homo sapiens
gaagattctttccc

SEQ ID NO: 1014099 - DNA, 18 bp, Homo sapiens
gaagatttcagagctgag

SEQ ID NO: 1014100 - DNA, 19 bp, Homo sapiens
gaagatttgacgttgttgt

SEQ ID NO: 1014101 - DNA, 20 bp, Homo sapiens
gaagatttgatgctggagag

SEQ ID NO: 1014102 - DNA, 20 bp, Homo sapiens
gaagattttatgcacagcct

SEQ ID NO: 1014103 - DNA, 22 bp, Homo sapiens
gaagattttatgcacagcctag

SEQ ID NO: 1014104 - DNA, 16 bp, Homo sapiens
gaagcaaagacaaaag

SEQ ID NO: 1014105 - DNA, 17 bp, Homo sapiens
gaagcaaagacaaaaga

SEQ ID NO: 1014106 - DNA, 18 bp, Homo sapiens
gaagcaaagatttcagta

SEQ ID NO: 1014107 - DNA, 12 bp, Homo sapiens
gaagcaaatgtg

SEQ ID NO: 1014108 - DNA, 15 bp, Homo sapiens
gaagcaaccaccaca

SEQ ID NO: 1014109 - DNA, 21 bp, Homo sapiens
gaagcaactccgtgtgcctgg

SEQ ID NO: 1014110 - DNA, 22 bp, Homo sapiens
gaagcaactccgtgtgcctggg

SEQ ID NO: 1014111 - DNA, 16 bp, Homo sapiens
gaagcaagcttaatgg

SEQ ID NO: 1014112 - DNA, 18 bp, Homo sapiens
gaagcaaggaagatatac

SEQ ID NO: 1014113 - DNA, 19 bp, Homo sapiens
gaagcaaggagaaaatata

SEQ ID NO: 1014114 - DNA, 14 bp, Homo sapiens
gaagcaagggcaag

SEQ ID NO: 1014115 - DNA, 18 bp, Homo sapiens
gaagcaataaagaagagt

SEQ ID NO: 1014116 - DNA, 13 bp, Homo sapiens
gaagctcagccca

SEQ ID NO: 1014117 - DNA, 14 bp, Homo sapiens
gaagctcagcccac

SEQ ID NO: 1014118 - DNA, 17 bp, Homo sapiens
gaagctcagcccacccc

SEQ ID NO: 1014119 - DNA, 18 bp, Homo sapiens
gaagctcagcccaccccc

SEQ ID NO: 1014120 - DNA, 21 bp, Homo sapiens
gaagctcagctgcattccgca

SEQ ID NO: 1014121 - DNA, 18 bp, Homo sapiens
gaagctcccaccccactc

SEQ ID NO: 1014122 - DNA, 20 bp, Homo sapiens
gaagctcccaccccactcag

SEQ ID NO: 1014123 - DNA, 13 bp, Homo sapiens
gaagctccttcct

SEQ ID NO: 1014124 - DNA, 14 bp, Homo sapiens
gaagctccttcctg

SEQ ID NO: 1014125 - DNA, 15 bp, Homo sapiens
gaagctccttcctgt

SEQ ID NO: 1014126 - DNA, 16 bp, Homo sapiens
gaagctctccaggccc

SEQ ID NO: 1014127 - DNA, 13 bp, Homo sapiens
gaagctctgaagt

SEQ ID NO: 1014128 - DNA, 20 bp, Homo sapiens
gaagctctggctgaaccctg

SEQ ID NO: 1014129 - DNA, 22 bp, Homo sapiens
gaagctgaaaacctaagtcctt

SEQ ID NO: 1014130 - DNA, 15 bp, Homo sapiens
gaagctgcaggcttt

SEQ ID NO: 1014131 - DNA, 14 bp, Homo sapiens
gaagctgcatgtta

SEQ ID NO: 1014132 - DNA, 20 bp, Homo sapiens
gaagctgccacccctcttct

SEQ ID NO: 1014133 - DNA, 23 bp, Homo sapiens
gaagctgccatccttgctgcagc

SEQ ID NO: 1014134 - DNA, 18 bp, Homo sapiens
gaagctgctccaggcctg

SEQ ID NO: 1014135 - DNA, 12 bp, Homo sapiens
gaagctgctgac

SEQ ID NO: 1014136 - DNA, 13 bp, Homo sapiens
gaagctgctgacc

SEQ ID NO: 1014137 - DNA, 14 bp, Homo sapiens
gaagctggagtgct

SEQ ID NO: 1014138 - DNA, 17 bp, Homo sapiens
gaagctggccgagggtc

SEQ ID NO: 1014139 - DNA, 14 bp, Homo sapiens
gaagctggcctgag

SEQ ID NO: 1014140 - DNA, 15 bp, Homo sapiens
gaagctggctttgaa

SEQ ID NO: 1014141 - DNA, 16 bp, Homo sapiens
gaagctgggcccaaag

SEQ ID NO: 1014142 - DNA, 22 bp, Homo sapiens
gaagctgtactcagagcagagc

SEQ ID NO: 1014143 - DNA, 23 bp, Homo sapiens
gaagctgtactcagagcagagca

SEQ ID NO: 1014144 - DNA, 18 bp, Homo sapiens
gaagctgtcaggctggga

SEQ ID NO: 1014145 - DNA, 21 bp, Homo sapiens
gaagctgtcataaaaagacaa

SEQ ID NO: 1014146 - DNA, 20 bp, Homo sapiens
gaagctgtgtccttgcacct

SEQ ID NO: 1014147 - DNA, 24 bp, Homo sapiens
gaagctgttcagggcatcggcagc

SEQ ID NO: 1014148 - DNA, 17 bp, Homo sapiens
gaagcttggggaaccca

SEQ ID NO: 1014149 - DNA, 18 bp, Homo sapiens
gaagctttaccagctgaa

SEQ ID NO: 1014150 - DNA, 22 bp, Homo sapiens
gaagctttatttgcatatttat

SEQ ID NO: 1014151 - DNA, 19 bp, Homo sapiens
gaagctttgtacctttaga

SEQ ID NO: 1014152 - DNA, 15 bp, Homo sapiens
gaaggaaaaatgtgt

SEQ ID NO: 1014153 - DNA, 16 bp, Homo sapiens
gaaggaaacaaatgtg

SEQ ID NO: 1014154 - DNA, 15 bp, Homo sapiens
gaaggaaactggaat

SEQ ID NO: 1014155 - DNA, 15 bp, Homo sapiens
gaaggaaataaacat

SEQ ID NO: 1014156 - DNA, 12 bp, Homo sapiens
gaaggaaataac

SEQ ID NO: 1014157 - DNA, 14 bp, Homo sapiens
gaaggaaatatatt

SEQ ID NO: 1014158 - DNA, 15 bp, Homo sapiens
gaaggaaatgagtgg

SEQ ID NO: 1014159 - DNA, 21 bp, Homo sapiens
gaaggaaatgagtggccagcg

SEQ ID NO: 1014160 - DNA, 13 bp, Homo sapiens
gaaggaaatgatg

SEQ ID NO: 1014161 - DNA, 21 bp, Homo sapiens
gaaggaacttgtctcttcatc

SEQ ID NO: 1014162 - DNA, 23 bp, Homo sapiens
gaaggaaggagactcacctctgc

SEQ ID NO: 1014163 - DNA, 16 bp, Homo sapiens
gaaggaaggaggcaga

SEQ ID NO: 1014164 - DNA, 18 bp, Homo sapiens
gaaggaaggaggcagact

SEQ ID NO: 1014165 - DNA, 15 bp, Homo sapiens
gaaggaagggcagag

SEQ ID NO: 1014166 - DNA, 16 bp, Homo sapiens
gaaggaagtgaagagg

SEQ ID NO: 1014167 - DNA, 20 bp, Homo sapiens
gaaggaatcattccagtgct

SEQ ID NO: 1014168 - DNA, 22 bp, Homo sapiens
gaaggaatttgattgctttgct

SEQ ID NO: 1014169 - DNA, 17 bp, Homo sapiens
gaaggaatttgggagga

SEQ ID NO: 1014170 - DNA, 12 bp, Homo sapiens
gaaggacacagc

SEQ ID NO: 1014171 - DNA, 17 bp, Homo sapiens
gaaggacacttcctgcc

SEQ ID NO: 1014172 - DNA, 23 bp, Homo sapiens
gaaggacccggaggggcctggca

SEQ ID NO: 1014173 - DNA, 17 bp, Homo sapiens
gaaggagaaggaaggag

SEQ ID NO: 1014174 - DNA, 15 bp, Homo sapiens
gaaggagactcacct

SEQ ID NO: 1014175 - DNA, 17 bp, Homo sapiens
gaaggagactcacctct

SEQ ID NO: 1014176 - DNA, 20 bp, Homo sapiens
gaaggagactcacctctgcc

SEQ ID NO: 1014177 - DNA, 22 bp, Homo sapiens
gaaggagactcacctctgcctc

SEQ ID NO: 1014178 - DNA, 18 bp, Homo sapiens
gaaggagaggaaaatgtt

SEQ ID NO: 1014179 - DNA, 17 bp, Homo sapiens
gaaggagatagggaaaa

SEQ ID NO: 1014180 - DNA, 20 bp, Homo sapiens
gaaggagccccattcctggg

SEQ ID NO: 1014181 - DNA, 17 bp, Homo sapiens
gaaggagcccctgagtc

SEQ ID NO: 1014182 - DNA, 23 bp, Homo sapiens
gaaggagcccctgagtccgcctg

SEQ ID NO: 1014183 - DNA, 20 bp, Homo sapiens
gaaggaggaatgctggactg

SEQ ID NO: 1014184 - DNA, 19 bp, Homo sapiens
gaaggaggacccaggacag

SEQ ID NO: 1014185 - DNA, 12 bp, Homo sapiens
gaaggaggagag

SEQ ID NO: 1014186 - DNA, 20 bp, Homo sapiens
gaaggaggagagagagggga

SEQ ID NO: 1014187 - DNA, 19 bp, Homo sapiens
gaaggaggagggcgcccat

SEQ ID NO: 1014188 - DNA, 15 bp, Homo sapiens
gaaggaggcagactg

SEQ ID NO: 1014189 - DNA, 19 bp, Homo sapiens
gaaggaggccaaccagccc

SEQ ID NO: 1014190 - DNA, 21 bp, Homo sapiens
gaaggaggccaaccagcccga

SEQ ID NO: 1014191 - DNA, 15 bp, Homo sapiens
gaaggagggacttgg

SEQ ID NO: 1014192 - DNA, 17 bp, Homo sapiens
gaaggagggcagagcca

SEQ ID NO: 1014193 - DNA, 19 bp, Homo sapiens
gaaggaggggagagacagg

SEQ ID NO: 1014194 - DNA, 21 bp, Homo sapiens
gaaggagtgtatgagtgtgag

SEQ ID NO: 1014195 - DNA, 17 bp, Homo sapiens
gaaggataaagccactt

SEQ ID NO: 1014196 - DNA, 18 bp, Homo sapiens
gaaggatggcatctccat

SEQ ID NO: 1014197 - DNA, 16 bp, Homo sapiens
gaaggatgtacatttc

SEQ ID NO: 1014198 - DNA, 17 bp, Homo sapiens
gaaggatgtacatttcc

SEQ ID NO: 1014199 - DNA, 14 bp, Homo sapiens
gaaggattgcatcc

SEQ ID NO: 1014200 - DNA, 18 bp, Homo sapiens
gaaggattgcatcctgct

SEQ ID NO: 1014201 - DNA, 19 bp, Homo sapiens
gaaggcaaaaactgtactg

SEQ ID NO: 1014202 - DNA, 22 bp, Homo sapiens
gaaggcaaaaactgtactgtgt

SEQ ID NO: 1014203 - DNA, 15 bp, Homo sapiens
gaaggcaaagcacga

SEQ ID NO: 1014204 - DNA, 12 bp, Homo sapiens
gaaggcaaaggc

SEQ ID NO: 1014205 - DNA, 17 bp, Homo sapiens
gaaggcaaaggcagagg

SEQ ID NO: 1014206 - DNA, 20 bp, Homo sapiens
gaaggcaaagtttacagatg

SEQ ID NO: 1014207 - DNA, 23 bp, Homo sapiens
gaaggcaaatataagctgggaaa

SEQ ID NO: 1014208 - DNA, 15 bp, Homo sapiens
gaaggcagaaagcaa

SEQ ID NO: 1014209 - DNA, 12 bp, Homo sapiens
gaaggcagaata

SEQ ID NO: 1014210 - DNA, 16 bp, Homo sapiens
gaaggcagacagcagg

SEQ ID NO: 1014211 - DNA, 21 bp, Homo sapiens
gaaggcagacagcaggcagcg

SEQ ID NO: 1014212 - DNA, 18 bp, Homo sapiens
catggggcccctggccca

SEQ ID NO: 1014213 - DNA, 19 bp, Homo sapiens
catggggcccctggcccag

SEQ ID NO: 1014214 - DNA, 21 bp, Homo sapiens
catggggcccctggcccagag

SEQ ID NO: 1014215 - DNA, 22 bp, Homo sapiens
catgggggcaccgggctccatg

SEQ ID NO: 1014216 - DNA, 21 bp, Homo sapiens
catggggtcagccccaagggc

SEQ ID NO: 1014217 - DNA, 22 bp, Homo sapiens
catggggtcagccccaagggct

SEQ ID NO: 1014218 - DNA, 15 bp, Homo sapiens
catggggtccttgga

SEQ ID NO: 1014219 - DNA, 23 bp, Homo sapiens
catggggtggggttggggcaaag

SEQ ID NO: 1014220 - DNA, 19 bp, Homo sapiens
catggggttggctgggccc

SEQ ID NO: 1014221 - DNA, 22 bp, Homo sapiens
catggggttggctgggcccaga

SEQ ID NO: 1014222 - DNA, 21 bp, Homo sapiens
catggggtttcagttgcgaaa

SEQ ID NO: 1014223 - DNA, 15 bp, Homo sapiens
catggggtttttatt

SEQ ID NO: 1014224 - DNA, 22 bp, Homo sapiens
catggggtttttattattttta

SEQ ID NO: 1014225 - DNA, 14 bp, Homo sapiens
catgggtcaagaga

SEQ ID NO: 1014226 - DNA, 17 bp, Homo sapiens
catgggtccaagagaca

SEQ ID NO: 1014227 - DNA, 19 bp, Homo sapiens
catgggtccaagagacatg

SEQ ID NO: 1014228 - DNA, 23 bp, Homo sapiens
catgggtccaagagacatggaag

SEQ ID NO: 1014229 - DNA, 22 bp, Homo sapiens
catgggtcctagcccttccctg

SEQ ID NO: 1014230 - DNA, 19 bp, Homo sapiens
catgggtccttgatgccag

SEQ ID NO: 1014231 - DNA, 21 bp, Homo sapiens
catgggtccttgatgccagag

SEQ ID NO: 1014232 - DNA, 22 bp, Homo sapiens
catgggtgaagggagagccagc

SEQ ID NO: 1014233 - DNA, 15 bp, Homo sapiens
catgggtggctgtga

SEQ ID NO: 1014234 - DNA, 17 bp, Homo sapiens
catggtaacgaacccct

SEQ ID NO: 1014235 - DNA, 14 bp, Homo sapiens
catggtactacccc

SEQ ID NO: 1014236 - DNA, 15 bp, Homo sapiens
catggtactacccca

SEQ ID NO: 1014237 - DNA, 16 bp, Homo sapiens
catggtactaccccag

SEQ ID NO: 1014238 - DNA, 18 bp, Homo sapiens
catggtactaccccagcc

SEQ ID NO: 1014239 - DNA, 15 bp, Homo sapiens
catggtataattgaa

SEQ ID NO: 1014240 - DNA, 18 bp, Homo sapiens
catggtcaagttcccaac

SEQ ID NO: 1014241 - DNA, 14 bp, Homo sapiens
catggtcacacact

SEQ ID NO: 1014242 - DNA, 21 bp, Homo sapiens
catggtcccgaagtgtagggc

SEQ ID NO: 1014243 - DNA, 13 bp, Homo sapiens
catggtccctgcc

SEQ ID NO: 1014244 - DNA, 20 bp, Homo sapiens
catggtcccttaaggcacag

SEQ ID NO: 1014245 - DNA, 20 bp, Homo sapiens
catggtccggtgtccttttc

SEQ ID NO: 1014246 - DNA, 18 bp, Homo sapiens
catggtcctgtctgtcct

SEQ ID NO: 1014247 - DNA, 17 bp, Homo sapiens
catggtcggaaaacatg

SEQ ID NO: 1014248 - DNA, 19 bp, Homo sapiens
catggtcggaaaacatgct

SEQ ID NO: 1014249 - DNA, 17 bp, Homo sapiens
catggtgaaaagctcca

SEQ ID NO: 1014250 - DNA, 18 bp, Homo sapiens
catggtgaaaatgtactg

SEQ ID NO: 1014251 - DNA, 19 bp, Homo sapiens
catggtgaaaatgtactga

SEQ ID NO: 1014252 - DNA, 22 bp, Homo sapiens
catggtgaccaccccctgttcc

SEQ ID NO: 1014253 - DNA, 19 bp, Homo sapiens
catggtgagcctagccctg

SEQ ID NO: 1014254 - DNA, 19 bp, Homo sapiens
catggtgcagttgacagca

SEQ ID NO: 1014255 - DNA, 18 bp, Homo sapiens
catggtgcccctagcttt

SEQ ID NO: 1014256 - DNA, 13 bp, Homo sapiens
catggtgcctgag

SEQ ID NO: 1014257 - DNA, 14 bp, Homo sapiens
cttcaaataaagaa

SEQ ID NO: 1014258 - DNA, 14 bp, Homo sapiens
cttcaaataattaa

SEQ ID NO: 1014259 - DNA, 17 bp, Homo sapiens
cttcaaattatagaaac

SEQ ID NO: 1014260 - DNA, 19 bp, Homo sapiens
cttcaacaactttgtgctt

SEQ ID NO: 1014261 - DNA, 16 bp, Homo sapiens
cttcaacatcaatgtt

SEQ ID NO: 1014262 - DNA, 20 bp, Homo sapiens
cttcaacatcaatgttcatt

SEQ ID NO: 1014263 - DNA, 22 bp, Homo sapiens
cttcaacatcaatgttcattgt

SEQ ID NO: 1014264 - DNA, 15 bp, Homo sapiens
cttcaacatgctcca

SEQ ID NO: 1014265 - DNA, 20 bp, Homo sapiens
cttcaaccattccccatggg

SEQ ID NO: 1014266 - DNA, 20 bp, Homo sapiens
cttcaactgaccagcctcca

SEQ ID NO: 1014267 - DNA, 20 bp, Homo sapiens
cttcaagcatcctcagaagc

SEQ ID NO: 1014268 - DNA, 20 bp, Homo sapiens
catttttgtataaaaaggaa

SEQ ID NO: 1014269 - DNA, 22 bp, Homo sapiens
catttttgtataaaaaggaaat

SEQ ID NO: 1014270 - DNA, 23 bp, Homo sapiens
catttttgtataaaaaggaaatt

SEQ ID NO: 1014271 - DNA, 15 bp, Homo sapiens
catttttgttttgaa

SEQ ID NO: 1014272 - DNA, 17 bp, Homo sapiens
cattttttaaggaaaca

SEQ ID NO: 1014273 - DNA, 18 bp, Homo sapiens
cattttttaaggaaacaa

SEQ ID NO: 1014274 - DNA, 14 bp, Homo sapiens
cattttttgctata

SEQ ID NO: 1014275 - DNA, 22 bp, Homo sapiens
cattttttgggcagcaatttaa

SEQ ID NO: 1014276 - DNA, 19 bp, Homo sapiens
catttttttctctctggag

SEQ ID NO: 1014277 - DNA, 21 bp, Homo sapiens
catttttttctctctggagcc

SEQ ID NO: 1014278 - DNA, 23 bp, Homo sapiens
catttttttctctctggagcccc

SEQ ID NO: 1014279 - DNA, 22 bp, Homo sapiens
cattttttttatattgccttat

SEQ ID NO: 1014280 - DNA, 15 bp, Homo sapiens
catttttttttcaat

SEQ ID NO: 1014281 - DNA, 14 bp, Homo sapiens
ccaaaaaaaggaaa

SEQ ID NO: 1014282 - DNA, 23 bp, Homo sapiens
ccaaaaaaaggaaaaataatcaa

SEQ ID NO: 1014283 - DNA, 21 bp, Homo sapiens
ccaaaaaaggacgtaaaattt

SEQ ID NO: 1014284 - DNA, 20 bp, Homo sapiens
ccaaaaaattctacaacaca

SEQ ID NO: 1014285 - DNA, 22 bp, Homo sapiens
ccaaaaaattctacaacacaca

SEQ ID NO: 1014286 - DNA, 19 bp, Homo sapiens
ccaaaaagagacccacaat

SEQ ID NO: 1014287 - DNA, 16 bp, Homo sapiens
ccaaaaagagactgat

SEQ ID NO: 1014288 - DNA, 14 bp, Homo sapiens
ccaaaaagcacata

SEQ ID NO: 1014289 - DNA, 17 bp, Homo sapiens
ccaaaaagctctgaaaa

SEQ ID NO: 1014290 - DNA, 23 bp, Homo sapiens
ccaaaaagctctgaaaacaaggt

SEQ ID NO: 1014291 - DNA, 21 bp, Homo sapiens
ccaaaaaggcaaataatggaa

SEQ ID NO: 1014292 - DNA, 23 bp, Homo sapiens
ccaaaaaggttgctgtttcacaa

SEQ ID NO: 1014293 - DNA, 12 bp, Homo sapiens
ccaaaaatagct

SEQ ID NO: 1014294 - DNA, 16 bp, Homo sapiens
ccaaaaattgccaagt

SEQ ID NO: 1014295 - DNA, 20 bp, Homo sapiens
ccaaaaattgccaagtgcct

SEQ ID NO: 1014296 - DNA, 18 bp, Homo sapiens
ccaaaacaaacaaacaga

SEQ ID NO: 1014297 - DNA, 13 bp, Homo sapiens
ccaaaacacagga

SEQ ID NO: 1014298 - DNA, 14 bp, Homo sapiens
ccaaaacaccccaa

SEQ ID NO: 1014299 - DNA, 18 bp, Homo sapiens
ccaaaacaccccaacttg

SEQ ID NO: 1014300 - DNA, 18 bp, Homo sapiens
ccaaaacacgcacaccct

SEQ ID NO: 1014301 - DNA, 17 bp, Homo sapiens
ccaaaacataaaaacca

SEQ ID NO: 1014302 - DNA, 18 bp, Homo sapiens
ccaaaacataaaaaccaa

SEQ ID NO: 1014303 - DNA, 13 bp, Homo sapiens
ccaaaacatttct

SEQ ID NO: 1014304 - DNA, 18 bp, Homo sapiens
ccaaaacatttctggaca

SEQ ID NO: 1014305 - DNA, 13 bp, Homo sapiens
ccaaaaccaatgc

SEQ ID NO: 1014306 - DNA, 17 bp, Homo sapiens
ccaaaaccaatgctgat

SEQ ID NO: 1014307 - DNA, 21 bp, Homo sapiens
ccaaaaccaatgctgatgacc

SEQ ID NO: 1014308 - DNA, 16 bp, Homo sapiens
ccaaaaccacatgggc

SEQ ID NO: 1014309 - DNA, 16 bp, Homo sapiens
ccaaaacccagggcaa

SEQ ID NO: 1014310 - DNA, 19 bp, Homo sapiens
ccaaaacctgcttccttca

SEQ ID NO: 1014311 - DNA, 22 bp, Homo sapiens
ccaaaacttctcttgaaaagtt

SEQ ID NO: 1014312 - DNA, 18 bp, Homo sapiens
ccaaaagaaaccatgaca

SEQ ID NO: 1014313 - DNA, 18 bp, Homo sapiens
ccaaaagattgctgaaaa

SEQ ID NO: 1014314 - DNA, 23 bp, Homo sapiens
ccaaaagattgctgaaattttat

SEQ ID NO: 1014315 - DNA, 16 bp, Homo sapiens
ccaaaagggaggctct

SEQ ID NO: 1014316 - DNA, 21 bp, Homo sapiens
ccaaaagggcacccaccagaa

SEQ ID NO: 1014317 - DNA, 20 bp, Homo sapiens
ccaaaagttacatgtttgca

SEQ ID NO: 1014318 - DNA, 18 bp, Homo sapiens
ccaaaagttttcctgaga

SEQ ID NO: 1014319 - DNA, 18 bp, Homo sapiens
ccaaaatattttttgcaa

SEQ ID NO: 1014320 - DNA, 14 bp, Homo sapiens
ccaaaatcaagagt

SEQ ID NO: 1014321 - DNA, 23 bp, Homo sapiens
ccaaaatgtaggcttagtttgtg

SEQ ID NO: 1014322 - DNA, 20 bp, Homo sapiens
ccaaaattactaataaattg

SEQ ID NO: 1014323 - DNA, 22 bp, Homo sapiens
ccaaaatttattttataagaaa

SEQ ID NO: 1014324 - DNA, 15 bp, Homo sapiens
ccaaacacttctgct

SEQ ID NO: 1014325 - DNA, 19 bp, Homo sapiens
ccaaacacttctgctttca

SEQ ID NO: 1014326 - DNA, 15 bp, Homo sapiens
ccaaacatagcccct

SEQ ID NO: 1014327 - DNA, 20 bp, Homo sapiens
ccaaacatagcccctgcccc

SEQ ID NO: 1014328 - DNA, 13 bp, Homo sapiens
ccaaacatcagac

SEQ ID NO: 1014329 - DNA, 21 bp, Homo sapiens
ccaaacatcagacctgtcttc

SEQ ID NO: 1014330 - DNA, 19 bp, Homo sapiens
ccaaacatcctacaagaca

SEQ ID NO: 1014331 - DNA, 18 bp, Homo sapiens
ccaaaccagtttattctg

SEQ ID NO: 1014332 - DNA, 20 bp, Homo sapiens
ccaaaccagtttattctgtg

SEQ ID NO: 1014333 - DNA, 12 bp, Homo sapiens
ccaaaccataaa

SEQ ID NO: 1014334 - DNA, 14 bp, Homo sapiens
ccaaacccagccac

SEQ ID NO: 1014335 - DNA, 17 bp, Homo sapiens
ccaaacccagccactgc

SEQ ID NO: 1014336 - DNA, 14 bp, Homo sapiens
ccaaaccccttccc

SEQ ID NO: 1014337 - DNA, 15 bp, Homo sapiens
ccaaaccccttccca

SEQ ID NO: 1014338 - DNA, 12 bp, Homo sapiens
ccaaaccctagg

SEQ ID NO: 1014339 - DNA, 19 bp, Homo sapiens
ccaaacccttaactgacat

SEQ ID NO: 1014340 - DNA, 13 bp, Homo sapiens
ccaaacccttcaa

SEQ ID NO: 1014341 - DNA, 21 bp, Homo sapiens
ccaaacccttcaactcctggc

SEQ ID NO: 1014342 - DNA, 21 bp, Homo sapiens
ccaaacctccagcctccctgt

SEQ ID NO: 1014343 - DNA, 13 bp, Homo sapiens
ccaaacctgtctt

SEQ ID NO: 1014344 - DNA, 13 bp, Homo sapiens
ccaaacgcctccc

SEQ ID NO: 1014345 - DNA, 13 bp, Homo sapiens
ccaaactacagaa

SEQ ID NO: 1014346 - DNA, 14 bp, Homo sapiens
ccaaactccccttc

SEQ ID NO: 1014347 - DNA, 18 bp, Homo sapiens
ccaaactccccttccctg

SEQ ID NO: 1014348 - DNA, 23 bp, Homo sapiens
ccaaactccccttccctggggag

SEQ ID NO: 1014349 - DNA, 13 bp, Homo sapiens
ccaaactccttta

SEQ ID NO: 1014350 - DNA, 23 bp, Homo sapiens
ccaaactcctttactgcagcctg

SEQ ID NO: 1014351 - DNA, 19 bp, Homo sapiens
ccaaactgcacacacagct

SEQ ID NO: 1014352 - DNA, 14 bp, Homo sapiens
ccaaactttaaaat

SEQ ID NO: 1014353 - DNA, 18 bp, Homo sapiens
ccaaactttaaaatgcga

SEQ ID NO: 1014354 - DNA, 15 bp, Homo sapiens
ccaaagaaacaagct

SEQ ID NO: 1014355 - DNA, 20 bp, Homo sapiens
ccaaagaaatgggcctgcct

SEQ ID NO: 1014356 - DNA, 21 bp, Homo sapiens
ccaaagaaatgggcctgcctg

SEQ ID NO: 1014357 - DNA, 19 bp, Homo sapiens
ccaaagaaccaaagaagaa

SEQ ID NO: 1014358 - DNA, 19 bp, Homo sapiens
ccaaagactgtactggcca

SEQ ID NO: 1014359 - DNA, 20 bp, Homo sapiens
ccaaagactgtactggccag

SEQ ID NO: 1014360 - DNA, 17 bp, Homo sapiens
ccaaagagactggagca

SEQ ID NO: 1014361 - DNA, 20 bp, Homo sapiens
ccaaagagactggagcatct

SEQ ID NO: 1014362 - DNA, 12 bp, Homo sapiens
ccaaagagcctg

SEQ ID NO: 1014363 - DNA, 15 bp, Homo sapiens
ccaaagagccttcag

SEQ ID NO: 1014364 - DNA, 13 bp, Homo sapiens
ccaaagaggctgc

SEQ ID NO: 1014365 - DNA, 14 bp, Homo sapiens
ccaaagaggctgcc

SEQ ID NO: 1014366 - DNA, 16 bp, Homo sapiens
ccaaagaggctgcccc

SEQ ID NO: 1014367 - DNA, 23 bp, Homo sapiens
ccaaagagggatgtttggaaaaa

SEQ ID NO: 1014368 - DNA, 22 bp, Homo sapiens
ccaaagagtagaattgcattga

SEQ ID NO: 1014369 - DNA, 10 bp, Homo sapiens
ccaaagataa

SEQ ID NO: 1014370 - DNA, 17 bp, Homo sapiens
ccaaagatgtcctgact

SEQ ID NO: 1014371 - DNA, 13 bp, Homo sapiens
ccaaagcacatgc

SEQ ID NO: 1014372 - DNA, 20 bp, Homo sapiens
ccaaagcacatgcttagctt

SEQ ID NO: 1014373 - DNA, 13 bp, Homo sapiens
ccaaagcacattt

SEQ ID NO: 1014374 - DNA, 19 bp, Homo sapiens
ccaaagcagcaggcctctg

SEQ ID NO: 1014375 - DNA, 15 bp, Homo sapiens
ccaaagccagacagc

SEQ ID NO: 1014376 - DNA, 19 bp, Homo sapiens
ccaaagccccatgtgcctt

SEQ ID NO: 1014377 - DNA, 23 bp, Homo sapiens
ccaaagccccatgtgccttgtcc

SEQ ID NO: 1014378 - DNA, 20 bp, Homo sapiens
ccaacatccagatctatagc

SEQ ID NO: 1014379 - DNA, 17 bp, Homo sapiens
ccaacatcccattgccc

SEQ ID NO: 1014380 - DNA, 13 bp, Homo sapiens
ccaacatgcactg

SEQ ID NO: 1014381 - DNA, 17 bp, Homo sapiens
ccaacatgcactgatgt

SEQ ID NO: 1014382 - DNA, 16 bp, Homo sapiens
ccaacatgcctgcacc

SEQ ID NO: 1014383 - DNA, 17 bp, Homo sapiens
ccaacatgggagggatc

SEQ ID NO: 1014384 - DNA, 15 bp, Homo sapiens
ccaacatgtggctcc

SEQ ID NO: 1014385 - DNA, 21 bp, Homo sapiens
ccaacatgtttctgttttgtt

SEQ ID NO: 1014386 - DNA, 18 bp, Homo sapiens
ccaacattttttcccagt

SEQ ID NO: 1014387 - DNA, 15 bp, Homo sapiens
ccaaccaaataagac

SEQ ID NO: 1014388 - DNA, 14 bp, Homo sapiens
ccaaccacagagaa

SEQ ID NO: 1014389 - DNA, 13 bp, Homo sapiens
ccaaccagcccga

SEQ ID NO: 1014390 - DNA, 13 bp, Homo sapiens
ccaaccagccttt

SEQ ID NO: 1014391 - DNA, 12 bp, Homo sapiens
ccaaccaggacc

SEQ ID NO: 1014392 - DNA, 17 bp, Homo sapiens
ccaaccaggacccaggg

SEQ ID NO: 1014393 - DNA, 19 bp, Homo sapiens
ccaaccaggacccagggtc

SEQ ID NO: 1014394 - DNA, 23 bp, Homo sapiens
ccaaccaggagctgatggcagct

SEQ ID NO: 1014395 - DNA, 18 bp, Homo sapiens
ccaacccaatccctctcc

SEQ ID NO: 1014396 - DNA, 14 bp, Homo sapiens
ccaacccagccacg

SEQ ID NO: 1014397 - DNA, 12 bp, Homo sapiens
ccaacccaggaa

SEQ ID NO: 1014398 - DNA, 22 bp, Homo sapiens
cttcaggggaagagaagacaaa

SEQ ID NO: 1014399 - DNA, 20 bp, Homo sapiens
cttcagggtatcccagaccc

SEQ ID NO: 1014400 - DNA, 14 bp, Homo sapiens
cttcaggtccgtgg

SEQ ID NO: 1014401 - DNA, 15 bp, Homo sapiens
cttcaggtgaacact

SEQ ID NO: 1014402 - DNA, 13 bp, Homo sapiens
cttcaggtgcttt

SEQ ID NO: 1014403 - DNA, 19 bp, Homo sapiens
cttcaggtggagagcacta

SEQ ID NO: 1014404 - DNA, 12 bp, Homo sapiens
cttcaggttctc

SEQ ID NO: 1014405 - DNA, 11 bp, Homo sapiens
cttcaggtttt

SEQ ID NO: 1014406 - DNA, 22 bp, Homo sapiens
cttcagtaaatgtgattcacct

SEQ ID NO: 1014407 - DNA, 19 bp, Homo sapiens
cttcagtaccctctcagct

SEQ ID NO: 1014408 - DNA, 22 bp, Homo sapiens
cttcagtaccctctcagctcca

SEQ ID NO: 1014409 - DNA, 23 bp, Homo sapiens
cttcagtaccctctcagctccag

SEQ ID NO: 1014410 - DNA, 21 bp, Homo sapiens
cttcagtaggaacaagctggc

SEQ ID NO: 1014411 - DNA, 22 bp, Homo sapiens
cttcagtaggaacaagctggct

SEQ ID NO: 1014412 - DNA, 14 bp, Homo sapiens
cttcagtatgttgt

SEQ ID NO: 1014413 - DNA, 15 bp, Homo sapiens
cttcagtatgttgtc

SEQ ID NO: 1014414 - DNA, 11 bp, Homo sapiens
cttcagtcctg

SEQ ID NO: 1014415 - DNA, 15 bp, Homo sapiens
cttcagtcctgctcc

SEQ ID NO: 1014416 - DNA, 23 bp, Homo sapiens
cttcagtcctgctccagaatttg

SEQ ID NO: 1014417 - DNA, 14 bp, Homo sapiens
cttcagtctgctcc

SEQ ID NO: 1014418 - DNA, 17 bp, Homo sapiens
cttcagtcttaatactt

SEQ ID NO: 1014419 - DNA, 19 bp, Homo sapiens
cttcagtgagcccctcccc

SEQ ID NO: 1014420 - DNA, 19 bp, Homo sapiens
cttcagtggaacacaaatg

SEQ ID NO: 1014421 - DNA, 17 bp, Homo sapiens
cttcagtggagaattat

SEQ ID NO: 1014422 - DNA, 13 bp, Homo sapiens
cttcagtgggaga

SEQ ID NO: 1014423 - DNA, 17 bp, Homo sapiens
cttcagtgtatggaaat

SEQ ID NO: 1014424 - DNA, 14 bp, Homo sapiens
cttcagtgtctctg

SEQ ID NO: 1014425 - DNA, 16 bp, Homo sapiens
cttcagtgtctctgtt

SEQ ID NO: 1014426 - DNA, 17 bp, Homo sapiens
cttcagttgtctctgat

SEQ ID NO: 1014427 - DNA, 23 bp, Homo sapiens
cttcagttgtctctgatgcagct

SEQ ID NO: 1014428 - DNA, 20 bp, Homo sapiens
cttcagtttccgaatctctt

SEQ ID NO: 1014429 - DNA, 14 bp, Homo sapiens
cttcagtttgtaaa

SEQ ID NO: 1014430 - DNA, 18 bp, Homo sapiens
cttcataccgcctcgtgc

SEQ ID NO: 1014431 - DNA, 19 bp, Homo sapiens
cttcataccgcctcgtgcc

SEQ ID NO: 1014432 - DNA, 21 bp, Homo sapiens
cttcataccgcctcgtgccag

SEQ ID NO: 1014433 - DNA, 21 bp, Homo sapiens
cttcataggcggtcatgtgtg

SEQ ID NO: 1014434 - DNA, 23 bp, Homo sapiens
cttcataggcggtcatgtgtgca

SEQ ID NO: 1014435 - DNA, 23 bp, Homo sapiens
cttcatatagcattgataatctt

SEQ ID NO: 1014436 - DNA, 20 bp, Homo sapiens
cttcatatgtcacctttgct

SEQ ID NO: 1014437 - DNA, 18 bp, Homo sapiens
cttcatatttttgatcat

SEQ ID NO: 1014438 - DNA, 18 bp, Homo sapiens
cttcatcaaaatcatgga

SEQ ID NO: 1014439 - DNA, 17 bp, Homo sapiens
cttcatcattccctctc

SEQ ID NO: 1014440 - DNA, 17 bp, Homo sapiens
cttcatccaacttccaa

SEQ ID NO: 1014441 - DNA, 14 bp, Homo sapiens
cttcatccatttgt

SEQ ID NO: 1014442 - DNA, 16 bp, Homo sapiens
cttcatccgcctgtgg

SEQ ID NO: 1014443 - DNA, 11 bp, Homo sapiens
cttcatcctct

SEQ ID NO: 1014444 - DNA, 13 bp, Homo sapiens
cttcatctccagg

SEQ ID NO: 1014445 - DNA, 20 bp, Homo sapiens
cttcatctcccacctagcag

SEQ ID NO: 1014446 - DNA, 15 bp, Homo sapiens
cttcatctccctgcc

SEQ ID NO: 1014447 - DNA, 16 bp, Homo sapiens
cttcatctccctgcca

SEQ ID NO: 1014448 - DNA, 17 bp, Homo sapiens
cttcatctccctgccat

SEQ ID NO: 1014449 - DNA, 15 bp, Homo sapiens
cttcatctgcctgcg

SEQ ID NO: 1014450 - DNA, 17 bp, Homo sapiens
cttcatctgcctgcgct

SEQ ID NO: 1014451 - DNA, 19 bp, Homo sapiens
cttcatctggcaacatctt

SEQ ID NO: 1014452 - DNA, 23 bp, Homo sapiens
cttcatctggcaacatctttatc

SEQ ID NO: 1014453 - DNA, 14 bp, Homo sapiens
cttcatcttcctgt

SEQ ID NO: 1014454 - DNA, 15 bp, Homo sapiens
cttcatcttcctgtg

SEQ ID NO: 1014455 - DNA, 16 bp, Homo sapiens
cttcatcttcctgtgt

SEQ ID NO: 1014456 - DNA, 22 bp, Homo sapiens
cttcatgcaatgacatcttcaa

SEQ ID NO: 1014457 - DNA, 15 bp, Homo sapiens
cttcatgcctttgta

SEQ ID NO: 1014458 - DNA, 19 bp, Homo sapiens
cttcatgcctttgtaagtt

SEQ ID NO: 1014459 - DNA, 17 bp, Homo sapiens
cttcatgctcagccctg

SEQ ID NO: 1014460 - DNA, 19 bp, Homo sapiens
cttcatgctcagccctgac

SEQ ID NO: 1014461 - DNA, 19 bp, Homo sapiens
cttcatgcttgacatacct

SEQ ID NO: 1014462 - DNA, 17 bp, Homo sapiens
cttcatgcttttttccc

SEQ ID NO: 1014463 - DNA, 13 bp, Homo sapiens
cttcatgtaaatt

SEQ ID NO: 1014464 - DNA, 23 bp, Homo sapiens
cttcatgtcaacttctggctcct

SEQ ID NO: 1014465 - DNA, 10 bp, Homo sapiens
cttcatgtgg

SEQ ID NO: 1014466 - DNA, 23 bp, Homo sapiens
cttcatgtggcacttgggcattt

SEQ ID NO: 1014467 - DNA, 16 bp, Homo sapiens
cttcatgtggcttccc

SEQ ID NO: 1014468 - DNA, 17 bp, Homo sapiens
cttcattatctgagttg

SEQ ID NO: 1014469 - DNA, 22 bp, Homo sapiens
cttcattcaatattgacatttg

SEQ ID NO: 1014470 - DNA, 14 bp, Homo sapiens
cttcattccagcag

SEQ ID NO: 1014471 - DNA, 22 bp, Homo sapiens
cttcattccagcagctgcaccc

SEQ ID NO: 1014472 - DNA, 17 bp, Homo sapiens
cttcattctaaaccaaa

SEQ ID NO: 1014473 - DNA, 22 bp, Homo sapiens
cttcattctcgtgagtcattta

SEQ ID NO: 1014474 - DNA, 15 bp, Homo sapiens
cttcattctggaaac

SEQ ID NO: 1014475 - DNA, 18 bp, Homo sapiens
cttcattctggaaacttt

SEQ ID NO: 1014476 - DNA, 14 bp, Homo sapiens
cttcattgagagtt

SEQ ID NO: 1014477 - DNA, 19 bp, Homo sapiens
cttcattgtccctcttcac

SEQ ID NO: 1014478 - DNA, 21 bp, Homo sapiens
cttcattgtccctcttcactc

SEQ ID NO: 1014479 - DNA, 14 bp, Homo sapiens
cttcatttaaaaaa

SEQ ID NO: 1014480 - DNA, 22 bp, Homo sapiens
cttcatttaaactaaattactg

SEQ ID NO: 1014481 - DNA, 23 bp, Homo sapiens
cttcatttaaactaaattactgt

SEQ ID NO: 1014482 - DNA, 15 bp, Homo sapiens
cttcatttcaatcat

SEQ ID NO: 1014483 - DNA, 13 bp, Homo sapiens
cttcatttggaga

SEQ ID NO: 1014484 - DNA, 11 bp, Homo sapiens
cttcatttgtg

SEQ ID NO: 1014485 - DNA, 21 bp, Homo sapiens
cttcattttaggaataataaa

SEQ ID NO: 1014486 - DNA, 14 bp, Homo sapiens
cttcattttgttct

SEQ ID NO: 1014487 - DNA, 12 bp, Homo sapiens
cttcatttttaa

SEQ ID NO: 1014488 - DNA, 18 bp, Homo sapiens
cttccaaaacctgcttcc

SEQ ID NO: 1014489 - DNA, 20 bp, Homo sapiens
cttccaaaacctgcttcctt

SEQ ID NO: 1014490 - DNA, 16 bp, Homo sapiens
cttccaaacagtgtgt

SEQ ID NO: 1014491 - DNA, 16 bp, Homo sapiens
cttccaaactaatttt

SEQ ID NO: 1014492 - DNA, 13 bp, Homo sapiens
cttccaaagcaca

SEQ ID NO: 1014493 - DNA, 14 bp, Homo sapiens
cttccaacaagcct

SEQ ID NO: 1014494 - DNA, 16 bp, Homo sapiens
cttccaacaagcctca

SEQ ID NO: 1014495 - DNA, 15 bp, Homo sapiens
cttccaacaaggaca

SEQ ID NO: 1014496 - DNA, 17 bp, Homo sapiens
cttccaacaaggacagc

SEQ ID NO: 1014497 - DNA, 14 bp, Homo sapiens
cttccaagaaaaat

SEQ ID NO: 1014498 - DNA, 16 bp, Homo sapiens
cttccaagctccaaat

SEQ ID NO: 1014499 - DNA, 12 bp, Homo sapiens
cttccaaggaga

SEQ ID NO: 1014500 - DNA, 15 bp, Homo sapiens
cttccaaggagacca

SEQ ID NO: 1014501 - DNA, 21 bp, Homo sapiens
ccaaggagaaacagagacagg

SEQ ID NO: 1014502 - DNA, 14 bp, Homo sapiens
ccaaggagcacagg

SEQ ID NO: 1014503 - DNA, 16 bp, Homo sapiens
ccaaggagcacaggtc

SEQ ID NO: 1014504 - DNA, 14 bp, Homo sapiens
ccaaggagcagaga

SEQ ID NO: 1014505 - DNA, 17 bp, Homo sapiens
ccaaggagcagagaggt

SEQ ID NO: 1014506 - DNA, 22 bp, Homo sapiens
ccaaggagctgatttccaggcc

SEQ ID NO: 1014507 - DNA, 12 bp, Homo sapiens
ccaaggagctgc

SEQ ID NO: 1014508 - DNA, 14 bp, Homo sapiens
ccaaggagctgcta

SEQ ID NO: 1014509 - DNA, 23 bp, Homo sapiens
ccaaggaggaaataactaagaga

SEQ ID NO: 1014510 - DNA, 17 bp, Homo sapiens
ccaaggaggcctgggga

SEQ ID NO: 1014511 - DNA, 14 bp, Homo sapiens
ccaaggaggggcca

SEQ ID NO: 1014512 - DNA, 16 bp, Homo sapiens
ccaaggagggtccagg

SEQ ID NO: 1014513 - DNA, 23 bp, Homo sapiens
ccaaggaggtgaggagcagagca

SEQ ID NO: 1014514 - DNA, 19 bp, Homo sapiens
ccaaggagtcactgagacc

SEQ ID NO: 1014515 - DNA, 15 bp, Homo sapiens
ccaaggatcctctcc

SEQ ID NO: 1014516 - DNA, 20 bp, Homo sapiens
ccaaggatcctctccactcc

SEQ ID NO: 1014517 - DNA, 22 bp, Homo sapiens
ccaaggatcctctccactccat

SEQ ID NO: 1014518 - DNA, 20 bp, Homo sapiens
ccaaggatcggactctgccc

SEQ ID NO: 1014519 - DNA, 10 bp, Homo sapiens
ccaaggcaaa

SEQ ID NO: 1014520 - DNA, 23 bp, Homo sapiens
ccaaggcaaggcaggtgcctcca

SEQ ID NO: 1014521 - DNA, 20 bp, Homo sapiens
ccaaggcagaggcctgggct

SEQ ID NO: 1014522 - DNA, 21 bp, Homo sapiens
ccaaggcagaggcctgggctg

SEQ ID NO: 1014523 - DNA, 13 bp, Homo sapiens
ccaaggcagcctc

SEQ ID NO: 1014524 - DNA, 20 bp, Homo sapiens
ccaaggcagcctccagagcc

SEQ ID NO: 1014525 - DNA, 15 bp, Homo sapiens
ccaaggccagagtgg

SEQ ID NO: 1014526 - DNA, 23 bp, Homo sapiens
ccaaggcccaactaacagtcaag

SEQ ID NO: 1014527 - DNA, 16 bp, Homo sapiens
ccaaggccccagggac

SEQ ID NO: 1014528 - DNA, 17 bp, Homo sapiens
ccaaggccccagggaca

SEQ ID NO: 1014529 - DNA, 18 bp, Homo sapiens
ccaaggccccagggacag

SEQ ID NO: 1014530 - DNA, 18 bp, Homo sapiens
ccaaggccctgctttttt

SEQ ID NO: 1014531 - DNA, 15 bp, Homo sapiens
cttcccctccctacc

SEQ ID NO: 1014532 - DNA, 17 bp, Homo sapiens
cttcccctgggatgctg

SEQ ID NO: 1014533 - DNA, 20 bp, Homo sapiens
cttcccctgggatgctgacc

SEQ ID NO: 1014534 - DNA, 13 bp, Homo sapiens
cttcccctgggca

SEQ ID NO: 1014535 - DNA, 18 bp, Homo sapiens
cttccccttccccgtccc

SEQ ID NO: 1014536 - DNA, 17 bp, Homo sapiens
cttccccttcctgtttc

SEQ ID NO: 1014537 - DNA, 12 bp, Homo sapiens
cttccccttgcc

SEQ ID NO: 1014538 - DNA, 22 bp, Homo sapiens
cttccccttgcccttgccctga

SEQ ID NO: 1014539 - DNA, 17 bp, Homo sapiens
cttccccttttgcctgg

SEQ ID NO: 1014540 - DNA, 16 bp, Homo sapiens
cttcccgacccagcca

SEQ ID NO: 1014541 - DNA, 17 bp, Homo sapiens
cttcccgacccagccag

SEQ ID NO: 1014542 - DNA, 20 bp, Homo sapiens
cttcccgacccagccagctg

SEQ ID NO: 1014543 - DNA, 14 bp, Homo sapiens
cttcccgccccacc

SEQ ID NO: 1014544 - DNA, 19 bp, Homo sapiens
cttcccgcctccctctcag

SEQ ID NO: 1014545 - DNA, 15 bp, Homo sapiens
cttcccgccttccaa

SEQ ID NO: 1014546 - DNA, 15 bp, Homo sapiens
cttcccgctcagccc

SEQ ID NO: 1014547 - DNA, 18 bp, Homo sapiens
cttcccgctcagccctcc

SEQ ID NO: 1014548 - DNA, 23 bp, Homo sapiens
cttcccgctcagccctccctgcc

SEQ ID NO: 1014549 - DNA, 20 bp, Homo sapiens
cttcccgtgtgtatttctaa

SEQ ID NO: 1014550 - DNA, 16 bp, Homo sapiens
cttccctaaactgcag

SEQ ID NO: 1014551 - DNA, 17 bp, Homo sapiens
cttccctaaactgcagc

SEQ ID NO: 1014552 - DNA, 17 bp, Homo sapiens
cttccctacagttgaaa

SEQ ID NO: 1014553 - DNA, 13 bp, Homo sapiens
cttccctacctca

SEQ ID NO: 1014554 - DNA, 17 bp, Homo sapiens
cttccctacctcaggca

SEQ ID NO: 1014555 - DNA, 20 bp, Homo sapiens
cttccctagagggttcctgt

SEQ ID NO: 1014556 - DNA, 21 bp, Homo sapiens
cttccctagctttagaccctg

SEQ ID NO: 1014557 - DNA, 22 bp, Homo sapiens
cttccctagctttagaccctgg

SEQ ID NO: 1014558 - DNA, 11 bp, Homo sapiens
cttccctcacc

SEQ ID NO: 1014559 - DNA, 17 bp, Homo sapiens
cttccctcacccctgac

SEQ ID NO: 1014560 - DNA, 16 bp, Homo sapiens
cttccctcactcttcc

SEQ ID NO: 1014561 - DNA, 17 bp, Homo sapiens
cttccctcatctctcct

SEQ ID NO: 1014562 - DNA, 17 bp, Homo sapiens
cttccctccgccttctc

SEQ ID NO: 1014563 - DNA, 12 bp, Homo sapiens
cttccctcctcc

SEQ ID NO: 1014564 - DNA, 16 bp, Homo sapiens
cttccctcctcccatg

SEQ ID NO: 1014565 - DNA, 19 bp, Homo sapiens
cttccctcctcccatgtca

SEQ ID NO: 1014566 - DNA, 12 bp, Homo sapiens
cttccctctctg

SEQ ID NO: 1014567 - DNA, 17 bp, Homo sapiens
cttccctctgcctgtcc

SEQ ID NO: 1014568 - DNA, 18 bp, Homo sapiens
cttccctctgcctgtccc

SEQ ID NO: 1014569 - DNA, 12 bp, Homo sapiens
cttccctctggg

SEQ ID NO: 1014570 - DNA, 21 bp, Homo sapiens
cttccctctgtttctctttcc

SEQ ID NO: 1014571 - DNA, 21 bp, Homo sapiens
cttccctgaacgttttcttct

SEQ ID NO: 1014572 - DNA, 22 bp, Homo sapiens
cttccctgaacgttttcttctt

SEQ ID NO: 1014573 - DNA, 14 bp, Homo sapiens
cttccctgactcat

SEQ ID NO: 1014574 - DNA, 22 bp, Homo sapiens
cttccctgatggcctttggacc

SEQ ID NO: 1014575 - DNA, 16 bp, Homo sapiens
cttccctgctcttgca

SEQ ID NO: 1014576 - DNA, 12 bp, Homo sapiens
cttccctggcat

SEQ ID NO: 1014577 - DNA, 15 bp, Homo sapiens
cttccctggccccgc

SEQ ID NO: 1014578 - DNA, 10 bp, Homo sapiens
cttccctggg

SEQ ID NO: 1014579 - DNA, 14 bp, Homo sapiens
cttccctggggagc

SEQ ID NO: 1014580 - DNA, 20 bp, Homo sapiens
cttccctggggagccctcag

SEQ ID NO: 1014581 - DNA, 23 bp, Homo sapiens
cttccctggggagccctcaggct

SEQ ID NO: 1014582 - DNA, 16 bp, Homo sapiens
cttccctggtcaccaa

SEQ ID NO: 1014583 - DNA, 22 bp, Homo sapiens
cttccctggtcaccaaggcagt

SEQ ID NO: 1014584 - DNA, 22 bp, Homo sapiens
cttccctgtatgattccttgat

SEQ ID NO: 1014585 - DNA, 22 bp, Homo sapiens
cttccctgtattttctttctct

SEQ ID NO: 1014586 - DNA, 16 bp, Homo sapiens
cttccctgttctccct

SEQ ID NO: 1014587 - DNA, 16 bp, Homo sapiens
cttcccttaactccaa

SEQ ID NO: 1014588 - DNA, 15 bp, Homo sapiens
cttcccttacctcaa

SEQ ID NO: 1014589 - DNA, 17 bp, Homo sapiens
cttcccttacctcaaag

SEQ ID NO: 1014590 - DNA, 20 bp, Homo sapiens
cttcccttagcctctcccac

SEQ ID NO: 1014591 - DNA, 14 bp, Homo sapiens
cttcccttccctca

SEQ ID NO: 1014592 - DNA, 14 bp, Homo sapiens
cttcccttcctcca

SEQ ID NO: 1014593 - DNA, 15 bp, Homo sapiens
cttcccttcctccat

SEQ ID NO: 1014594 - DNA, 17 bp, Homo sapiens
cttcccttgccactttg

SEQ ID NO: 1014595 - DNA, 20 bp, Homo sapiens
cttcccttgccactttgcac

SEQ ID NO: 1014596 - DNA, 15 bp, Homo sapiens
cttccgaccctctgg

SEQ ID NO: 1014597 - DNA, 18 bp, Homo sapiens
cttccgcagcccctttcc

SEQ ID NO: 1014598 - DNA, 12 bp, Homo sapiens
cttccgccactc

SEQ ID NO: 1014599 - DNA, 16 bp, Homo sapiens
cttccgcgcccagcgc

SEQ ID NO: 1014600 - DNA, 15 bp, Homo sapiens
cttccgctctgaggc

SEQ ID NO: 1014601 - DNA, 14 bp, Homo sapiens
cttccgctgagggg

SEQ ID NO: 1014602 - DNA, 16 bp, Homo sapiens
cttccgctgaggggtc

SEQ ID NO: 1014603 - DNA, 21 bp, Homo sapiens
cttccgctgaggggtctcgga

SEQ ID NO: 1014604 - DNA, 16 bp, Homo sapiens
cttccgggagctggtg

SEQ ID NO: 1014605 - DNA, 17 bp, Homo sapiens
cttccgggagctggtga

SEQ ID NO: 1014606 - DNA, 15 bp, Homo sapiens
cttccgtccatcccc

SEQ ID NO: 1014607 - DNA, 17 bp, Homo sapiens
cttccgtgcatcccaga

SEQ ID NO: 1014608 - DNA, 15 bp, Homo sapiens
cttccgtgtcctctc

SEQ ID NO: 1014609 - DNA, 17 bp, Homo sapiens
cttcctaattccacagc

SEQ ID NO: 1014610 - DNA, 18 bp, Homo sapiens
cttcctacaagagcagcc

SEQ ID NO: 1014611 - DNA, 22 bp, Homo sapiens
cttcctacaagagcagcctgtg

SEQ ID NO: 1014612 - DNA, 18 bp, Homo sapiens
cttcctaccctccttcca

SEQ ID NO: 1014613 - DNA, 14 bp, Homo sapiens
cttcctacctctgg

SEQ ID NO: 1014614 - DNA, 20 bp, Homo sapiens
cttcctagaagcccctgtcg

SEQ ID NO: 1014615 - DNA, 23 bp, Homo sapiens
cttcctagaagcccctgtcgccc

SEQ ID NO: 1014616 - DNA, 22 bp, Homo sapiens
cttcctagttttctcctcccag

SEQ ID NO: 1014617 - DNA, 23 bp, Homo sapiens
cttcctagttttctcctcccagg

SEQ ID NO: 1014618 - DNA, 15 bp, Homo sapiens
cttcctatgcccagg

SEQ ID NO: 1014619 - DNA, 22 bp, Homo sapiens
cttcctattctcctgccatggg

SEQ ID NO: 1014620 - DNA, 14 bp, Homo sapiens
cttcctcacacccc

SEQ ID NO: 1014621 - DNA, 15 bp, Homo sapiens
cttcctcacacccct

SEQ ID NO: 1014622 - DNA, 20 bp, Homo sapiens
cttcctcacacccctgtccc

SEQ ID NO: 1014623 - DNA, 18 bp, Homo sapiens
ccaagttgcagtgagcag

SEQ ID NO: 1014624 - DNA, 22 bp, Homo sapiens
ccaagttgcagtgagcagggtg

SEQ ID NO: 1014625 - DNA, 20 bp, Homo sapiens
ccaagttgtgcttgagccag

SEQ ID NO: 1014626 - DNA, 14 bp, Homo sapiens
ccaagtttatatac

SEQ ID NO: 1014627 - DNA, 16 bp, Homo sapiens
ccaagtttatttctct

SEQ ID NO: 1014628 - DNA, 18 bp, Homo sapiens
ccaataaaaaaaaaccta

SEQ ID NO: 1014629 - DNA, 17 bp, Homo sapiens
ccaataaaaagttcaga

SEQ ID NO: 1014630 - DNA, 15 bp, Homo sapiens
ccaataaaactgatg

SEQ ID NO: 1014631 - DNA, 17 bp, Homo sapiens
ccaataaaactgatgtt

SEQ ID NO: 1014632 - DNA, 21 bp, Homo sapiens
ccaataaaagtgactctcagc

SEQ ID NO: 1014633 - DNA, 22 bp, Homo sapiens
ccaataaaagttttctccaact

SEQ ID NO: 1014634 - DNA, 16 bp, Homo sapiens
ccaataaacagctccc

SEQ ID NO: 1014635 - DNA, 13 bp, Homo sapiens
ccaataaaccagg

SEQ ID NO: 1014636 - DNA, 17 bp, Homo sapiens
ccaataaaccttgaaca

SEQ ID NO: 1014637 - DNA, 20 bp, Homo sapiens
ccaataaactgagcgacccc

SEQ ID NO: 1014638 - DNA, 16 bp, Homo sapiens
ccaataaaggcagctg

SEQ ID NO: 1014639 - DNA, 17 bp, Homo sapiens
ccaataaaggcagctgc

SEQ ID NO: 1014640 - DNA, 19 bp, Homo sapiens
ccaataaaggcagctgcct

SEQ ID NO: 1014641 - DNA, 22 bp, Homo sapiens
ccaataaaggcagctgcctctg

SEQ ID NO: 1014642 - DNA, 15 bp, Homo sapiens
ccaataaagtgcctt

SEQ ID NO: 1014643 - DNA, 16 bp, Homo sapiens
ccaataaagtgccttc

SEQ ID NO: 1014644 - DNA, 19 bp, Homo sapiens
ccaataaagtgccttctgg

SEQ ID NO: 1014645 - DNA, 22 bp, Homo sapiens
ccaataaatgtttgttatttac

SEQ ID NO: 1014646 - DNA, 21 bp, Homo sapiens
ccaataacaaggagctcaccc

SEQ ID NO: 1014647 - DNA, 22 bp, Homo sapiens
ccaataataaaaaacaagaaac

SEQ ID NO: 1014648 - DNA, 22 bp, Homo sapiens
ccaataataaagacatttccta

SEQ ID NO: 1014649 - DNA, 23 bp, Homo sapiens
ccaataattttaattatttatat

SEQ ID NO: 1014650 - DNA, 18 bp, Homo sapiens
ccaatagggctgagctct

SEQ ID NO: 1014651 - DNA, 22 bp, Homo sapiens
ccaatagggctgagctctctgt

SEQ ID NO: 1014652 - DNA, 13 bp, Homo sapiens
ccaatatcatgtc

SEQ ID NO: 1014653 - DNA, 16 bp, Homo sapiens
ccaatatgtattgtaa

SEQ ID NO: 1014654 - DNA, 18 bp, Homo sapiens
ccaatattaaaagagacc

SEQ ID NO: 1014655 - DNA, 23 bp, Homo sapiens
ccaatattaacacgctgcctggt

SEQ ID NO: 1014656 - DNA, 12 bp, Homo sapiens
ccaatattataa

SEQ ID NO: 1014657 - DNA, 22 bp, Homo sapiens
ccaatattggagcatatcaaaa

SEQ ID NO: 1014658 - DNA, 12 bp, Homo sapiens
ccaatattgtaa

SEQ ID NO: 1014659 - DNA, 15 bp, Homo sapiens
cttcctcctgggccc

SEQ ID NO: 1014660 - DNA, 22 bp, Homo sapiens
cttcctcggtggctctggggta

SEQ ID NO: 1014661 - DNA, 17 bp, Homo sapiens
cttcctcgtgcagagct

SEQ ID NO: 1014662 - DNA, 15 bp, Homo sapiens
cttcctcgttgggcc

SEQ ID NO: 1014663 - DNA, 23 bp, Homo sapiens
cttcctcgttgggccgctctgat

SEQ ID NO: 1014664 - DNA, 22 bp, Homo sapiens
cttcctctcaagctagccagag

SEQ ID NO: 1014665 - DNA, 13 bp, Homo sapiens
cttcctctcaggc

SEQ ID NO: 1014666 - DNA, 15 bp, Homo sapiens
cttcctctccactgc

SEQ ID NO: 1014667 - DNA, 18 bp, Homo sapiens
cttcctctcggctggaag

SEQ ID NO: 1014668 - DNA, 14 bp, Homo sapiens
cttcctctctaccc

SEQ ID NO: 1014669 - DNA, 16 bp, Homo sapiens
cttcctctctccagat

SEQ ID NO: 1014670 - DNA, 14 bp, Homo sapiens
cttcctctctcgga

SEQ ID NO: 1014671 - DNA, 15 bp, Homo sapiens
cttcctctctcggag

SEQ ID NO: 1014672 - DNA, 15 bp, Homo sapiens
cttcctctgagcctt

SEQ ID NO: 1014673 - DNA, 12 bp, Homo sapiens
cttcctctgagg

SEQ ID NO: 1014674 - DNA, 14 bp, Homo sapiens
cttcctctgaggct

SEQ ID NO: 1014675 - DNA, 12 bp, Homo sapiens
cttcctctgcat

SEQ ID NO: 1014676 - DNA, 21 bp, Homo sapiens
cttcctctggtaaacattcct

SEQ ID NO: 1014677 - DNA, 15 bp, Homo sapiens
cttcctctggttcct

SEQ ID NO: 1014678 - DNA, 17 bp, Homo sapiens
cttcctcttcccccaag

SEQ ID NO: 1014679 - DNA, 19 bp, Homo sapiens
cttcctcttcctgcccttg

SEQ ID NO: 1014680 - DNA, 19 bp, Homo sapiens
cttcctcttcggccctcag

SEQ ID NO: 1014681 - DNA, 15 bp, Homo sapiens
cttcctcttcttgtt

SEQ ID NO: 1014682 - DNA, 22 bp, Homo sapiens
cttcctcttgaccctgcaccct

SEQ ID NO: 1014683 - DNA, 16 bp, Homo sapiens
cttcctgacactttaa

SEQ ID NO: 1014684 - DNA, 17 bp, Homo sapiens
cttcctgacactttaat

SEQ ID NO: 1014685 - DNA, 20 bp, Homo sapiens
cttcctgagaaagcccacct

SEQ ID NO: 1014686 - DNA, 15 bp, Homo sapiens
cttcctgcaaggact

SEQ ID NO: 1014687 - DNA, 20 bp, Homo sapiens
cttcctgcatagtctgttcc

SEQ ID NO: 1014688 - DNA, 11 bp, Homo sapiens
cttcctgccac

SEQ ID NO: 1014689 - DNA, 13 bp, Homo sapiens
cttcctgccacca

SEQ ID NO: 1014690 - DNA, 13 bp, Homo sapiens
cttcctgcccctc

SEQ ID NO: 1014691 - DNA, 16 bp, Homo sapiens
cttcctgcccctcttt

SEQ ID NO: 1014692 - DNA, 19 bp, Homo sapiens
cttcctgcccctctttctc

SEQ ID NO: 1014693 - DNA, 22 bp, Homo sapiens
cttcctgcccctctttctcttt

SEQ ID NO: 1014694 - DNA, 16 bp, Homo sapiens
cttcctgcccttccct

SEQ ID NO: 1014695 - DNA, 18 bp, Homo sapiens
cttcctgcgtcctcctca

SEQ ID NO: 1014696 - DNA, 15 bp, Homo sapiens
cttcctgctcctttt

SEQ ID NO: 1014697 - DNA, 18 bp, Homo sapiens
cttcctgctccttttgta

SEQ ID NO: 1014698 - DNA, 17 bp, Homo sapiens
cttcctgctgagtccct

SEQ ID NO: 1014699 - DNA, 14 bp, Homo sapiens
cttcctgctgcacc

SEQ ID NO: 1014700 - DNA, 14 bp, Homo sapiens
cttcctgctgggac

SEQ ID NO: 1014701 - DNA, 15 bp, Homo sapiens
cttcctgcttcctgt

SEQ ID NO: 1014702 - DNA, 12 bp, Homo sapiens
cttcctgcttgc

SEQ ID NO: 1014703 - DNA, 13 bp, Homo sapiens
cttcctgctttcc

SEQ ID NO: 1014704 - DNA, 15 bp, Homo sapiens
cttcctgctttccat

SEQ ID NO: 1014705 - DNA, 16 bp, Homo sapiens
cttcctggacacactc

SEQ ID NO: 1014706 - DNA, 18 bp, Homo sapiens
cttcctggacacactctc

SEQ ID NO: 1014707 - DNA, 14 bp, Homo sapiens
cttcctggagactg

SEQ ID NO: 1014708 - DNA, 16 bp, Homo sapiens
cttcctggcccaggcc

SEQ ID NO: 1014709 - DNA, 19 bp, Homo sapiens
cttcctggcctcactggct

SEQ ID NO: 1014710 - DNA, 21 bp, Homo sapiens
cttcctggcctcactggctgg

SEQ ID NO: 1014711 - DNA, 19 bp, Homo sapiens
cttcctggcctgagagtca

SEQ ID NO: 1014712 - DNA, 20 bp, Homo sapiens
cttcctggcgggggtgggcc

SEQ ID NO: 1014713 - DNA, 12 bp, Homo sapiens
cttcctggctct

SEQ ID NO: 1014714 - DNA, 13 bp, Homo sapiens
cttcctggctctg

SEQ ID NO: 1014715 - DNA, 15 bp, Homo sapiens
cttcctggctctggg

SEQ ID NO: 1014716 - DNA, 16 bp, Homo sapiens
cttcctgggaccccct

SEQ ID NO: 1014717 - DNA, 17 bp, Homo sapiens
cttcctgggaccccctc

SEQ ID NO: 1014718 - DNA, 22 bp, Homo sapiens
cttcctgggaccccctcgccag

SEQ ID NO: 1014719 - DNA, 20 bp, Homo sapiens
cttcctgggcagcctttcca

SEQ ID NO: 1014720 - DNA, 21 bp, Homo sapiens
cttcctgggcagcctttccag

SEQ ID NO: 1014721 - DNA, 22 bp, Homo sapiens
cttcctggggccccgctgggat

SEQ ID NO: 1014722 - DNA, 21 bp, Homo sapiens
cttcctgggtcctgttcccta

SEQ ID NO: 1014723 - DNA, 23 bp, Homo sapiens
cttcctggtgaggcccagcctgt

SEQ ID NO: 1014724 - DNA, 15 bp, Homo sapiens
cttcctgtccagaga

SEQ ID NO: 1014725 - DNA, 19 bp, Homo sapiens
cttcctgtccagagagaga

SEQ ID NO: 1014726 - DNA, 15 bp, Homo sapiens
cttcctgtccctgag

SEQ ID NO: 1014727 - DNA, 17 bp, Homo sapiens
cttcctgtcctgcctcc

SEQ ID NO: 1014728 - DNA, 19 bp, Homo sapiens
cttcctgtcctgcctcctc

SEQ ID NO: 1014729 - DNA, 21 bp, Homo sapiens
cttcctgtcctgcctcctcat

SEQ ID NO: 1014730 - DNA, 23 bp, Homo sapiens
cttcctgtccttgttcatggaga

SEQ ID NO: 1014731 - DNA, 13 bp, Homo sapiens
cttcctgtgactt

SEQ ID NO: 1014732 - DNA, 13 bp, Homo sapiens
cttcctgtgccct

SEQ ID NO: 1014733 - DNA, 16 bp, Homo sapiens
cttcctgtgccctcac

SEQ ID NO: 1014734 - DNA, 20 bp, Homo sapiens
cttcctgtgccctcacccca

SEQ ID NO: 1014735 - DNA, 21 bp, Homo sapiens
cttcctgtgccctcaccccaa

SEQ ID NO: 1014736 - DNA, 14 bp, Homo sapiens
cttcctgtgccttt

SEQ ID NO: 1014737 - DNA, 18 bp, Homo sapiens
cttcctgtgcctttccta

SEQ ID NO: 1014738 - DNA, 19 bp, Homo sapiens
cttcctgtgcctttcctat

SEQ ID NO: 1014739 - DNA, 22 bp, Homo sapiens
cttcctgtgtactctttatttc

SEQ ID NO: 1014740 - DNA, 23 bp, Homo sapiens
cttcctgtgtgtccaaaactgcc

SEQ ID NO: 1014741 - DNA, 17 bp, Homo sapiens
cttcctgttacctgtct

SEQ ID NO: 1014742 - DNA, 18 bp, Homo sapiens
cttcctgttccctcctgg

SEQ ID NO: 1014743 - DNA, 20 bp, Homo sapiens
cttcctgttccctcctggtc

SEQ ID NO: 1014744 - DNA, 18 bp, Homo sapiens
cttcctgttcttccttcc

SEQ ID NO: 1014745 - DNA, 15 bp, Homo sapiens
cttctcaagatactg

SEQ ID NO: 1014746 - DNA, 15 bp, Homo sapiens
cttctcaagtgcctt

SEQ ID NO: 1014747 - DNA, 16 bp, Homo sapiens
cttctcaagtgcctta

SEQ ID NO: 1014748 - DNA, 22 bp, Homo sapiens
cttctcacacacaactgtccat

SEQ ID NO: 1014749 - DNA, 13 bp, Homo sapiens
cttctcacggcga

SEQ ID NO: 1014750 - DNA, 15 bp, Homo sapiens
cttctcactcaccac

SEQ ID NO: 1014751 - DNA, 13 bp, Homo sapiens
cttctcactgcca

SEQ ID NO: 1014752 - DNA, 13 bp, Homo sapiens
cttctcagaagca

SEQ ID NO: 1014753 - DNA, 16 bp, Homo sapiens
cttctcagaagcacag

SEQ ID NO: 1014754 - DNA, 14 bp, Homo sapiens
cttctcagaatcta

SEQ ID NO: 1014755 - DNA, 19 bp, Homo sapiens
cttctcagatttctgagga

SEQ ID NO: 1014756 - DNA, 15 bp, Homo sapiens
cttctcagccccttt

SEQ ID NO: 1014757 - DNA, 18 bp, Homo sapiens
cttctcagctcttccatg

SEQ ID NO: 1014758 - DNA, 14 bp, Homo sapiens
cttctcataaatct

SEQ ID NO: 1014759 - DNA, 18 bp, Homo sapiens
cttctccaaaggctctgt

SEQ ID NO: 1014760 - DNA, 14 bp, Homo sapiens
cttctccaaggaaa

SEQ ID NO: 1014761 - DNA, 17 bp, Homo sapiens
cttctccaatgctctgg

SEQ ID NO: 1014762 - DNA, 16 bp, Homo sapiens
cttctccaattctgaa

SEQ ID NO: 1014763 - DNA, 16 bp, Homo sapiens
cttctccaccagcccc

SEQ ID NO: 1014764 - DNA, 13 bp, Homo sapiens
cttctccactgga

SEQ ID NO: 1014765 - DNA, 14 bp, Homo sapiens
cttctccactggat

SEQ ID NO: 1014766 - DNA, 15 bp, Homo sapiens
cttctccactggatg

SEQ ID NO: 1014767 - DNA, 17 bp, Homo sapiens
cttctccactggatgga

SEQ ID NO: 1014768 - DNA, 12 bp, Homo sapiens
cttctccaggct

SEQ ID NO: 1014769 - DNA, 12 bp, Homo sapiens
cttctccagtgg

SEQ ID NO: 1014770 - DNA, 13 bp, Homo sapiens
cttctccagtggt

SEQ ID NO: 1014771 - DNA, 12 bp, Homo sapiens
cttctccatgct

SEQ ID NO: 1014772 - DNA, 13 bp, Homo sapiens
cttctcccagaat

SEQ ID NO: 1014773 - DNA, 14 bp, Homo sapiens
cttctcccatttcc

SEQ ID NO: 1014774 - DNA, 15 bp, Homo sapiens
cttctcccatttcct

SEQ ID NO: 1014775 - DNA, 23 bp, Homo sapiens
cttctccccaacaattggagggt

SEQ ID NO: 1014776 - DNA, 13 bp, Homo sapiens
cttctccccaatc

SEQ ID NO: 1014777 - DNA, 14 bp, Homo sapiens
cttctccccccatc

SEQ ID NO: 1014778 - DNA, 15 bp, Homo sapiens
cttctccccccatcc

SEQ ID NO: 1014779 - DNA, 12 bp, Homo sapiens
cttctcccccgc

SEQ ID NO: 1014780 - DNA, 18 bp, Homo sapiens
cttctcccccgccctgcc

SEQ ID NO: 1014781 - DNA, 22 bp, Homo sapiens
cttctcccccgccctgccccgc

SEQ ID NO: 1014782 - DNA, 21 bp, Homo sapiens
cttctcccccttgtcttcccc

SEQ ID NO: 1014783 - DNA, 21 bp, Homo sapiens
cttctccccgaggctgcccca

SEQ ID NO: 1014784 - DNA, 23 bp, Homo sapiens
cttctccccgaggctgccccagg

SEQ ID NO: 1014785 - DNA, 14 bp, Homo sapiens
cttctccccgcagc

SEQ ID NO: 1014786 - DNA, 16 bp, Homo sapiens
cttctcccctgccctt

SEQ ID NO: 1014787 - DNA, 17 bp, Homo sapiens
cttctcccctgcccttc

SEQ ID NO: 1014788 - DNA, 16 bp, Homo sapiens
cttctcccggccctca

SEQ ID NO: 1014789 - DNA, 14 bp, Homo sapiens
cttctcccggggac

SEQ ID NO: 1014790 - DNA, 11 bp, Homo sapiens
cttctccctgg

SEQ ID NO: 1014791 - DNA, 14 bp, Homo sapiens
ccacacccagcggc

SEQ ID NO: 1014792 - DNA, 15 bp, Homo sapiens
ccacacccagcggcc

SEQ ID NO: 1014793 - DNA, 16 bp, Homo sapiens
ccacacccagctcagc

SEQ ID NO: 1014794 - DNA, 13 bp, Homo sapiens
ccacacccaggaa

SEQ ID NO: 1014795 - DNA, 14 bp, Homo sapiens
ccacacccaggaag

SEQ ID NO: 1014796 - DNA, 15 bp, Homo sapiens
ccacacccaggaagg

SEQ ID NO: 1014797 - DNA, 22 bp, Homo sapiens
ccacacccaggggaaggccctg

SEQ ID NO: 1014798 - DNA, 12 bp, Homo sapiens
ccacaccccagc

SEQ ID NO: 1014799 - DNA, 16 bp, Homo sapiens
ccacaccccagcccac

SEQ ID NO: 1014800 - DNA, 20 bp, Homo sapiens
ccacaccccagcccaccctg

SEQ ID NO: 1014801 - DNA, 21 bp, Homo sapiens
ccacacccgaagtcctgtcac

SEQ ID NO: 1014802 - DNA, 11 bp, Homo sapiens
ccacaccctcc

SEQ ID NO: 1014803 - DNA, 21 bp, Homo sapiens
ccacaccctcccccgccactc

SEQ ID NO: 1014804 - DNA, 23 bp, Homo sapiens
ccacaccctgtactgttctgtgt

SEQ ID NO: 1014805 - DNA, 15 bp, Homo sapiens
ccacaccgcagaagc

SEQ ID NO: 1014806 - DNA, 17 bp, Homo sapiens
ccacaccgtcttccttc

SEQ ID NO: 1014807 - DNA, 14 bp, Homo sapiens
ccacacctccctac

SEQ ID NO: 1014808 - DNA, 19 bp, Homo sapiens
ccacacctgagcgctgtgg

SEQ ID NO: 1014809 - DNA, 21 bp, Homo sapiens
ccacacctgagcgctgtggac

SEQ ID NO: 1014810 - DNA, 18 bp, Homo sapiens
ccacacctggcatggtgc

SEQ ID NO: 1014811 - DNA, 14 bp, Homo sapiens
ccacacctggcctt

SEQ ID NO: 1014812 - DNA, 16 bp, Homo sapiens
ccacaccttggccttc

SEQ ID NO: 1014813 - DNA, 18 bp, Homo sapiens
ccacacgcaggcggccag

SEQ ID NO: 1014814 - DNA, 16 bp, Homo sapiens
ccacacgcatgggcat

SEQ ID NO: 1014815 - DNA, 23 bp, Homo sapiens
ccacacgcatgggcattgcagcc

SEQ ID NO: 1014816 - DNA, 16 bp, Homo sapiens
ccacacggactcccgg

SEQ ID NO: 1014817 - DNA, 14 bp, Homo sapiens
ccacacggcagccc

SEQ ID NO: 1014818 - DNA, 23 bp, Homo sapiens
ccacacggccccttcccagccag

SEQ ID NO: 1014819 - DNA, 14 bp, Homo sapiens
ccacactcagcaca

SEQ ID NO: 1014820 - DNA, 15 bp, Homo sapiens
ccacactcccaaggt

SEQ ID NO: 1014821 - DNA, 23 bp, Homo sapiens
ccacactcccaaggttggagccc

SEQ ID NO: 1014822 - DNA, 17 bp, Homo sapiens
ccacactgaaaccaaaa

SEQ ID NO: 1014823 - DNA, 23 bp, Homo sapiens
ccacactgaggcttaggcctctc

SEQ ID NO: 1014824 - DNA, 16 bp, Homo sapiens
ccacactgagttctat

SEQ ID NO: 1014825 - DNA, 18 bp, Homo sapiens
ccacactgccagaagaga

SEQ ID NO: 1014826 - DNA, 23 bp, Homo sapiens
ccacactgctaggtgggccagcc

SEQ ID NO: 1014827 - DNA, 21 bp, Homo sapiens
ccacactggactccggccctc

SEQ ID NO: 1014828 - DNA, 14 bp, Homo sapiens
ccacactgggcctg

SEQ ID NO: 1014829 - DNA, 14 bp, Homo sapiens
ccacactgtggcca

SEQ ID NO: 1014830 - DNA, 11 bp, Homo sapiens
ccacacttccc

SEQ ID NO: 1014831 - DNA, 20 bp, Homo sapiens
ccacacttcccacccccagg

SEQ ID NO: 1014832 - DNA, 18 bp, Homo sapiens
ccacacttcctgtccaga

SEQ ID NO: 1014833 - DNA, 20 bp, Homo sapiens
ccacacttcctgtccagaga

SEQ ID NO: 1014834 - DNA, 21 bp, Homo sapiens
ccacacttcctgtccagagag

SEQ ID NO: 1014835 - DNA, 14 bp, Homo sapiens
ccacacttccttta

SEQ ID NO: 1014836 - DNA, 13 bp, Homo sapiens
ccacacttgctgg

SEQ ID NO: 1014837 - DNA, 17 bp, Homo sapiens
ccacacttgctggggct

SEQ ID NO: 1014838 - DNA, 19 bp, Homo sapiens
ccacacttgtgccagcccg

SEQ ID NO: 1014839 - DNA, 21 bp, Homo sapiens
ccacagaagacttcccagctt

SEQ ID NO: 1014840 - DNA, 18 bp, Homo sapiens
ccacagaagccaggagca

SEQ ID NO: 1014841 - DNA, 12 bp, Homo sapiens
ccacagacacac

SEQ ID NO: 1014842 - DNA, 13 bp, Homo sapiens
ccacagacctgca

SEQ ID NO: 1014843 - DNA, 15 bp, Homo sapiens
ccacagacctgcagt

SEQ ID NO: 1014844 - DNA, 15 bp, Homo sapiens
ccacagacctgctct

SEQ ID NO: 1014845 - DNA, 20 bp, Homo sapiens
ccacagagaagtttgtagcc

SEQ ID NO: 1014846 - DNA, 21 bp, Homo sapiens
ccacagagagggagagcagag

SEQ ID NO: 1014847 - DNA, 14 bp, Homo sapiens
ccacagagatgcat

SEQ ID NO: 1014848 - DNA, 11 bp, Homo sapiens
ccacagagcct

SEQ ID NO: 1014849 - DNA, 15 bp, Homo sapiens
ccacagagcctggct

SEQ ID NO: 1014850 - DNA, 13 bp, Homo sapiens
ccacagaggacac

SEQ ID NO: 1014851 - DNA, 15 bp, Homo sapiens
ccacagagtgagcca

SEQ ID NO: 1014852 - DNA, 19 bp, Homo sapiens
ccacagagtgagccagtga

SEQ ID NO: 1014853 - DNA, 15 bp, Homo sapiens
ccacagagtgctgga

SEQ ID NO: 1014854 - DNA, 16 bp, Homo sapiens
ccacagagtgctggac

SEQ ID NO: 1014855 - DNA, 17 bp, Homo sapiens
ccacagagtgctggact

SEQ ID NO: 1014856 - DNA, 20 bp, Homo sapiens
ccacagatgatgaagaaatg

SEQ ID NO: 1014857 - DNA, 19 bp, Homo sapiens
ccacagatgtctctggggc

SEQ ID NO: 1014858 - DNA, 16 bp, Homo sapiens
ccacagatttgtgccc

SEQ ID NO: 1014859 - DNA, 21 bp, Homo sapiens
ccacagcaagtacagcggctc

SEQ ID NO: 1014860 - DNA, 20 bp, Homo sapiens
ccacagcagcctctgaagtt

SEQ ID NO: 1014861 - DNA, 21 bp, Homo sapiens
ccacagcaggatcgaagggtt

SEQ ID NO: 1014862 - DNA, 14 bp, Homo sapiens
ccacagcaggggct

SEQ ID NO: 1014863 - DNA, 12 bp, Homo sapiens
ccacagccagag

SEQ ID NO: 1014864 - DNA, 22 bp, Homo sapiens
ccacagcccccttgccctccgc

SEQ ID NO: 1014865 - DNA, 12 bp, Homo sapiens
ccacagcgagcc

SEQ ID NO: 1014866 - DNA, 14 bp, Homo sapiens
ccacagcgagcctg

SEQ ID NO: 1014867 - DNA, 18 bp, Homo sapiens
ccacagcgagcctgtgcc

SEQ ID NO: 1014868 - DNA, 20 bp, Homo sapiens
ccacagcgagggcagctgct

SEQ ID NO: 1014869 - DNA, 21 bp, Homo sapiens
ccaccagaacgcaccccactg

SEQ ID NO: 1014870 - DNA, 20 bp, Homo sapiens
ccaccagacccacctggagc

SEQ ID NO: 1014871 - DNA, 15 bp, Homo sapiens
ccaccagagactggg

SEQ ID NO: 1014872 - DNA, 11 bp, Homo sapiens
ccaccagcagc

SEQ ID NO: 1014873 - DNA, 11 bp, Homo sapiens
ccaccagccag

SEQ ID NO: 1014874 - DNA, 15 bp, Homo sapiens
ccaccagccagccct

SEQ ID NO: 1014875 - DNA, 16 bp, Homo sapiens
ccaccagccagccctg

SEQ ID NO: 1014876 - DNA, 17 bp, Homo sapiens
ccaccagccagccctgg

SEQ ID NO: 1014877 - DNA, 21 bp, Homo sapiens
ccaccagccagccctggccca

SEQ ID NO: 1014878 - DNA, 12 bp, Homo sapiens
ccaccagccatc

SEQ ID NO: 1014879 - DNA, 20 bp, Homo sapiens
ccaccagccatcctccctcc

SEQ ID NO: 1014880 - DNA, 19 bp, Homo sapiens
ccaccagccgccccagccc

SEQ ID NO: 1014881 - DNA, 19 bp, Homo sapiens
ccaccaggagaaccactac

SEQ ID NO: 1014882 - DNA, 21 bp, Homo sapiens
ccaccaggagcacctggaccc

SEQ ID NO: 1014883 - DNA, 14 bp, Homo sapiens
ccaccaggagcagc

SEQ ID NO: 1014884 - DNA, 15 bp, Homo sapiens
ccaccaggagcagca

SEQ ID NO: 1014885 - DNA, 18 bp, Homo sapiens
ccaccaggagcagcagcc

SEQ ID NO: 1014886 - DNA, 15 bp, Homo sapiens
ccaccaggcctcact

SEQ ID NO: 1014887 - DNA, 17 bp, Homo sapiens
ccaccaggcctcactgg

SEQ ID NO: 1014888 - DNA, 20 bp, Homo sapiens
ccaccagggagcttcctggc

SEQ ID NO: 1014889 - DNA, 15 bp, Homo sapiens
ccaccaggggaagga

SEQ ID NO: 1014890 - DNA, 16 bp, Homo sapiens
ccaccaggggaaggaa

SEQ ID NO: 1014891 - DNA, 19 bp, Homo sapiens
ccaccagggtcccaggaag

SEQ ID NO: 1014892 - DNA, 17 bp, Homo sapiens
ccaccagggtggaccag

SEQ ID NO: 1014893 - DNA, 16 bp, Homo sapiens
ccaccaggtgcctttc

SEQ ID NO: 1014894 - DNA, 21 bp, Homo sapiens
ccaccagtgtgtgggggagat

SEQ ID NO: 1014895 - DNA, 17 bp, Homo sapiens
ccaccagtttatacaga

SEQ ID NO: 1014896 - DNA, 22 bp, Homo sapiens
ccaccatattcagtgctgtggc

SEQ ID NO: 1014897 - DNA, 21 bp, Homo sapiens
ccaccatcactcactcactcc

SEQ ID NO: 1014898 - DNA, 17 bp, Homo sapiens
ccaccatccccagctgg

SEQ ID NO: 1014899 - DNA, 19 bp, Homo sapiens
ccaccatgaccccttctct

SEQ ID NO: 1014900 - DNA, 19 bp, Homo sapiens
ccaccatgcactgtaaata

SEQ ID NO: 1014901 - DNA, 13 bp, Homo sapiens
ccaccatggacca

SEQ ID NO: 1014902 - DNA, 14 bp, Homo sapiens
ccaccatggaccag

SEQ ID NO: 1014903 - DNA, 16 bp, Homo sapiens
ccaccatggccagcca

SEQ ID NO: 1014904 - DNA, 23 bp, Homo sapiens
ccacccaaaccccttcccacgac

SEQ ID NO: 1014905 - DNA, 15 bp, Homo sapiens
ccacccaacagctca

SEQ ID NO: 1014906 - DNA, 13 bp, Homo sapiens
ccacccaacccta

SEQ ID NO: 1014907 - DNA, 16 bp, Homo sapiens
ccacccaaccctatct

SEQ ID NO: 1014908 - DNA, 14 bp, Homo sapiens
ccacccaagagagg

SEQ ID NO: 1014909 - DNA, 15 bp, Homo sapiens
ccacccaagcctgct

SEQ ID NO: 1014910 - DNA, 18 bp, Homo sapiens
ccacccaagcctgctggc

SEQ ID NO: 1014911 - DNA, 23 bp, Homo sapiens
ccacccacaatcacaagaagatt

SEQ ID NO: 1014912 - DNA, 19 bp, Homo sapiens
ccacccacacagctgccct

SEQ ID NO: 1014913 - DNA, 15 bp, Homo sapiens
ccacccaccagggcg

SEQ ID NO: 1014914 - DNA, 16 bp, Homo sapiens
ccacccacccccaggc

SEQ ID NO: 1014915 - DNA, 17 bp, Homo sapiens
ccacccacccccaggcc

SEQ ID NO: 1014916 - DNA, 11 bp, Homo sapiens
ccacccacctc

SEQ ID NO: 1014917 - DNA, 18 bp, Homo sapiens
ccacccacctccacccag

SEQ ID NO: 1014918 - DNA, 14 bp, Homo sapiens
ccacccacctcctg

SEQ ID NO: 1014919 - DNA, 15 bp, Homo sapiens
ccacccacctcctgc

SEQ ID NO: 1014920 - DNA, 19 bp, Homo sapiens
ccacccacctcctgcggct

SEQ ID NO: 1014921 - DNA, 17 bp, Homo sapiens
ccacccagcccttcctt

SEQ ID NO: 1014922 - DNA, 20 bp, Homo sapiens
cttctggggcaggctgggcc

SEQ ID NO: 1014923 - DNA, 18 bp, Homo sapiens
cttctggtactctcctag

SEQ ID NO: 1014924 - DNA, 14 bp, Homo sapiens
cttctggtcccctg

SEQ ID NO: 1014925 - DNA, 16 bp, Homo sapiens
cttctggtcccctgtg

SEQ ID NO: 1014926 - DNA, 17 bp, Homo sapiens
cttctggtcccctgtgg

SEQ ID NO: 1014927 - DNA, 16 bp, Homo sapiens
cttctgtaatcaatat

SEQ ID NO: 1014928 - DNA, 20 bp, Homo sapiens
cttctgtaattgtgtggatt

SEQ ID NO: 1014929 - DNA, 18 bp, Homo sapiens
cttctgtactaaagtatt

SEQ ID NO: 1014930 - DNA, 16 bp, Homo sapiens
cttctgtagtttttaa

SEQ ID NO: 1014931 - DNA, 20 bp, Homo sapiens
cttctgtagtttttaattaa

SEQ ID NO: 1014932 - DNA, 21 bp, Homo sapiens
cttctgtatttctaggcacaa

SEQ ID NO: 1014933 - DNA, 20 bp, Homo sapiens
cttctgtatttttttttcta

SEQ ID NO: 1014934 - DNA, 13 bp, Homo sapiens
cttctgtccacca

SEQ ID NO: 1014935 - DNA, 16 bp, Homo sapiens
cttctgtccccagccc

SEQ ID NO: 1014936 - DNA, 14 bp, Homo sapiens
cttctgtgaaatat

SEQ ID NO: 1014937 - DNA, 14 bp, Homo sapiens
cttctgtgatgagc

SEQ ID NO: 1014938 - DNA, 18 bp, Homo sapiens
cttctgtgcactagcctg

SEQ ID NO: 1014939 - DNA, 14 bp, Homo sapiens
cttctgtgccaccc

SEQ ID NO: 1014940 - DNA, 15 bp, Homo sapiens
cttctgtgcccaggg

SEQ ID NO: 1014941 - DNA, 19 bp, Homo sapiens
cttctgtgcccagggtggc

SEQ ID NO: 1014942 - DNA, 15 bp, Homo sapiens
cttctgtgggcatgg

SEQ ID NO: 1014943 - DNA, 20 bp, Homo sapiens
cttctgtggggctgggcacc

SEQ ID NO: 1014944 - DNA, 23 bp, Homo sapiens
cttctgtgtaccacttctgtggg

SEQ ID NO: 1014945 - DNA, 13 bp, Homo sapiens
cttctgtgtcaca

SEQ ID NO: 1014946 - DNA, 13 bp, Homo sapiens
cttctgttaagaa

SEQ ID NO: 1014947 - DNA, 14 bp, Homo sapiens
cttctgttaagaaa

SEQ ID NO: 1014948 - DNA, 19 bp, Homo sapiens
cttctgttctctgctgagg

SEQ ID NO: 1014949 - DNA, 14 bp, Homo sapiens
cttctgttctctgg

SEQ ID NO: 1014950 - DNA, 14 bp, Homo sapiens
cttcttaaaaactg

SEQ ID NO: 1014951 - DNA, 17 bp, Homo sapiens
cttcttaaaaactgtgt

SEQ ID NO: 1014952 - DNA, 19 bp, Homo sapiens
cttcttaaaaactgtgtat

SEQ ID NO: 1014953 - DNA, 16 bp, Homo sapiens
cttcttaaaggcctgg

SEQ ID NO: 1014954 - DNA, 17 bp, Homo sapiens
cttcttaaaggcctgga

SEQ ID NO: 1014955 - DNA, 19 bp, Homo sapiens
cttcttaaaggcctggaac

SEQ ID NO: 1014956 - DNA, 14 bp, Homo sapiens
cttcttaaagtatt

SEQ ID NO: 1014957 - DNA, 13 bp, Homo sapiens
cttcttaagtgtt

SEQ ID NO: 1014958 - DNA, 23 bp, Homo sapiens
cttcttacaaaaagaaatgtcaa

SEQ ID NO: 1014959 - DNA, 22 bp, Homo sapiens
cttcttacacttcttaccccag

SEQ ID NO: 1014960 - DNA, 17 bp, Homo sapiens
cttcttacccgaaagca

SEQ ID NO: 1014961 - DNA, 19 bp, Homo sapiens
cttcttatggaattgattt

SEQ ID NO: 1014962 - DNA, 22 bp, Homo sapiens
cttcttattctcactccaccac

SEQ ID NO: 1014963 - DNA, 17 bp, Homo sapiens
cttcttcacctcttcca

SEQ ID NO: 1014964 - DNA, 20 bp, Homo sapiens
cttcttcagaagacactgca

SEQ ID NO: 1014965 - DNA, 16 bp, Homo sapiens
cttcttcagagtgaag

SEQ ID NO: 1014966 - DNA, 18 bp, Homo sapiens
cttcttcagatcagtgct

SEQ ID NO: 1014967 - DNA, 19 bp, Homo sapiens
cttcttcagcaggaagggt

SEQ ID NO: 1014968 - DNA, 16 bp, Homo sapiens
cttcttcatattctaa

SEQ ID NO: 1014969 - DNA, 18 bp, Homo sapiens
cttcttcatctttaaaat

SEQ ID NO: 1014970 - DNA, 15 bp, Homo sapiens
cttcttccacttctc

SEQ ID NO: 1014971 - DNA, 21 bp, Homo sapiens
cttcttcccctttgtcctgcg

SEQ ID NO: 1014972 - DNA, 20 bp, Homo sapiens
cttcttcccgccccacctcc

SEQ ID NO: 1014973 - DNA, 22 bp, Homo sapiens
cttcttcccgccccacctccca

SEQ ID NO: 1014974 - DNA, 14 bp, Homo sapiens
cttcttccctccct

SEQ ID NO: 1014975 - DNA, 22 bp, Homo sapiens
cttcttcccttaactccaagaa

SEQ ID NO: 1014976 - DNA, 14 bp, Homo sapiens
cttcttcctaggtc

SEQ ID NO: 1014977 - DNA, 13 bp, Homo sapiens
cttcttcctattg

SEQ ID NO: 1014978 - DNA, 12 bp, Homo sapiens
cttcttcctccc

SEQ ID NO: 1014979 - DNA, 14 bp, Homo sapiens
cttcttcctcccct

SEQ ID NO: 1014980 - DNA, 20 bp, Homo sapiens
cttcttccttcttgtcacca

SEQ ID NO: 1014981 - DNA, 17 bp, Homo sapiens
cttcttcggggaactcc

SEQ ID NO: 1014982 - DNA, 19 bp, Homo sapiens
cttcttctaagaagacatt

SEQ ID NO: 1014983 - DNA, 20 bp, Homo sapiens
cttcttctaagaagacattt

SEQ ID NO: 1014984 - DNA, 22 bp, Homo sapiens
cttcttctaagaagacattttg

SEQ ID NO: 1014985 - DNA, 21 bp, Homo sapiens
cttcttctacttcagtcttct

SEQ ID NO: 1014986 - DNA, 12 bp, Homo sapiens
cttcttctccta

SEQ ID NO: 1014987 - DNA, 17 bp, Homo sapiens
cttcttctctccacatg

SEQ ID NO: 1014988 - DNA, 20 bp, Homo sapiens
cttcttctgccacttctgcg

SEQ ID NO: 1014989 - DNA, 23 bp, Homo sapiens
cttcttctgccacttctgcgggc

SEQ ID NO: 1014990 - DNA, 12 bp, Homo sapiens
cttcttctgccc

SEQ ID NO: 1014991 - DNA, 17 bp, Homo sapiens
cttgaccctttcctccc

SEQ ID NO: 1014992 - DNA, 14 bp, Homo sapiens
cttgacctgaggct

SEQ ID NO: 1014993 - DNA, 20 bp, Homo sapiens
cttgacctgaggctgtggtc

SEQ ID NO: 1014994 - DNA, 19 bp, Homo sapiens
cttgacctgcattgtaaat

SEQ ID NO: 1014995 - DNA, 18 bp, Homo sapiens
cttgaccttttcgacgct

SEQ ID NO: 1014996 - DNA, 15 bp, Homo sapiens
cttgacgtttcttct

SEQ ID NO: 1014997 - DNA, 21 bp, Homo sapiens
cttgacgtttcttctttctag

SEQ ID NO: 1014998 - DNA, 14 bp, Homo sapiens
cttgactctaaatg

SEQ ID NO: 1014999 - DNA, 19 bp, Homo sapiens
cttgactgggtgagaccca

SEQ ID NO: 1015000 - DNA, 12 bp, Homo sapiens
cttgagaaacct

SEQ ID NO: 1015001 - DNA, 13 bp, Homo sapiens
cttgagaaacctt

SEQ ID NO: 1015002 - DNA, 23 bp, Homo sapiens
cttgagaaagatctaagcagctg

SEQ ID NO: 1015003 - DNA, 22 bp, Homo sapiens
cttgagaaatatggacacttaa

SEQ ID NO: 1015004 - DNA, 21 bp, Homo sapiens
cttgagaaccagtctcctcac

SEQ ID NO: 1015005 - DNA, 21 bp, Homo sapiens
cttgagaatcctctcctttct

SEQ ID NO: 1015006 - DNA, 22 bp, Homo sapiens
cttgagaatggtgatccaccca

SEQ ID NO: 1015007 - DNA, 18 bp, Homo sapiens
cttgagacaatgttttct

SEQ ID NO: 1015008 - DNA, 14 bp, Homo sapiens
cttgagacctcagc

SEQ ID NO: 1015009 - DNA, 15 bp, Homo sapiens
cttgagacctcagcc

SEQ ID NO: 1015010 - DNA, 18 bp, Homo sapiens
cttgagacctcagccatg

SEQ ID NO: 1015011 - DNA, 22 bp, Homo sapiens
cttgagagaaaaagtgcccctt

SEQ ID NO: 1015012 - DNA, 14 bp, Homo sapiens
cttgagagggtgga

SEQ ID NO: 1015013 - DNA, 21 bp, Homo sapiens
cttgagatctgattttttccc

SEQ ID NO: 1015014 - DNA, 14 bp, Homo sapiens
cttgagatctgtat

SEQ ID NO: 1015015 - DNA, 18 bp, Homo sapiens
cttgagatggtgaggctg

SEQ ID NO: 1015016 - DNA, 22 bp, Homo sapiens
cttgagatggtgaggctgtcag

SEQ ID NO: 1015017 - DNA, 15 bp, Homo sapiens
cttgagatgtcttct

SEQ ID NO: 1015018 - DNA, 21 bp, Homo sapiens
cttgagcaagttccttctggt

SEQ ID NO: 1015019 - DNA, 20 bp, Homo sapiens
cttgagcatcaatcttgtta

SEQ ID NO: 1015020 - DNA, 18 bp, Homo sapiens
cttgagccaggaggcctg

SEQ ID NO: 1015021 - DNA, 13 bp, Homo sapiens
cttgagcccagga

SEQ ID NO: 1015022 - DNA, 12 bp, Homo sapiens
cttgagccctgg

SEQ ID NO: 1015023 - DNA, 12 bp, Homo sapiens
cttgagcctggg

SEQ ID NO: 1015024 - DNA, 15 bp, Homo sapiens
cttgagcctgggagg

SEQ ID NO: 1015025 - DNA, 16 bp, Homo sapiens
cttgagcctgggaggt

SEQ ID NO: 1015026 - DNA, 19 bp, Homo sapiens
cttgagcggagcccgatat

SEQ ID NO: 1015027 - DNA, 23 bp, Homo sapiens
cttgagctagagataaaacagaa

SEQ ID NO: 1015028 - DNA, 20 bp, Homo sapiens
cttgagctctgtaacttaca

SEQ ID NO: 1015029 - DNA, 14 bp, Homo sapiens
cttgagctggcctc

SEQ ID NO: 1015030 - DNA, 13 bp, Homo sapiens
cttgaggaaacaa

SEQ ID NO: 1015031 - DNA, 20 bp, Homo sapiens
cttgaggaaacaacagcttt

SEQ ID NO: 1015032 - DNA, 14 bp, Homo sapiens
cttgaggagtgtga

SEQ ID NO: 1015033 - DNA, 23 bp, Homo sapiens
cttgagggataaccccaggcact

SEQ ID NO: 1015034 - DNA, 19 bp, Homo sapiens
cttgagggcccagagcagg

SEQ ID NO: 1015035 - DNA, 16 bp, Homo sapiens
cttgagggtgggccag

SEQ ID NO: 1015036 - DNA, 17 bp, Homo sapiens
cttgaggtcttttgaca

SEQ ID NO: 1015037 - DNA, 23 bp, Homo sapiens
cttgaggtcttttgacatgtgga

SEQ ID NO: 1015038 - DNA, 15 bp, Homo sapiens
cttgagtaaaaaggt

SEQ ID NO: 1015039 - DNA, 14 bp, Homo sapiens
cttgagtcagaaaa

SEQ ID NO: 1015040 - DNA, 21 bp, Homo sapiens
cttgagtgagaagagcttgca

SEQ ID NO: 1015041 - DNA, 22 bp, Homo sapiens
cttgagtgcttgttagagagaa

SEQ ID NO: 1015042 - DNA, 22 bp, Homo sapiens
cttgagtggggttatctctgtg

SEQ ID NO: 1015043 - DNA, 17 bp, Homo sapiens
cttgagttcctctgcag

SEQ ID NO: 1015044 - DNA, 19 bp, Homo sapiens
cttgagttgattcagctct

SEQ ID NO: 1015045 - DNA, 21 bp, Homo sapiens
cttgagttgattcagctctgc

SEQ ID NO: 1015046 - DNA, 13 bp, Homo sapiens
cttgagttggctg

SEQ ID NO: 1015047 - DNA, 17 bp, Homo sapiens
cttgagttggctgtgtt

SEQ ID NO: 1015048 - DNA, 18 bp, Homo sapiens
cttgagttggctgtgttc

SEQ ID NO: 1015049 - DNA, 22 bp, Homo sapiens
cttgataatattagtgattctg

SEQ ID NO: 1015050 - DNA, 23 bp, Homo sapiens
cttgataatattagtgattctga

SEQ ID NO: 1015051 - DNA, 20 bp, Homo sapiens
cttgatacattcaaatttgt

SEQ ID NO: 1015052 - DNA, 23 bp, Homo sapiens
ccaccgcatatgcatgccaggct

SEQ ID NO: 1015053 - DNA, 13 bp, Homo sapiens
ccaccgcccagag

SEQ ID NO: 1015054 - DNA, 12 bp, Homo sapiens
ccaccgccctcc

SEQ ID NO: 1015055 - DNA, 13 bp, Homo sapiens
ccaccgccctcct

SEQ ID NO: 1015056 - DNA, 13 bp, Homo sapiens
ccaccgctcagtg

SEQ ID NO: 1015057 - DNA, 17 bp, Homo sapiens
ccaccgctcagtgtcag

SEQ ID NO: 1015058 - DNA, 14 bp, Homo sapiens
ccaccgctgccagc

SEQ ID NO: 1015059 - DNA, 15 bp, Homo sapiens
ccaccgctgccagca

SEQ ID NO: 1015060 - DNA, 14 bp, Homo sapiens
ccaccgctgcctaa

SEQ ID NO: 1015061 - DNA, 17 bp, Homo sapiens
ccaccggaactgggctg

SEQ ID NO: 1015062 - DNA, 18 bp, Homo sapiens
ccaccggaactgggctgg

SEQ ID NO: 1015063 - DNA, 16 bp, Homo sapiens
ccaccggatgctgtgc

SEQ ID NO: 1015064 - DNA, 18 bp, Homo sapiens
ccaccggatgctgtgcct

SEQ ID NO: 1015065 - DNA, 14 bp, Homo sapiens
ccaccgggagcctc

SEQ ID NO: 1015066 - DNA, 20 bp, Homo sapiens
ccaccgggagcctccccctc

SEQ ID NO: 1015067 - DNA, 18 bp, Homo sapiens
ccaccgggctgcaggtgc

SEQ ID NO: 1015068 - DNA, 19 bp, Homo sapiens
ccaccgggctgggagctct

SEQ ID NO: 1015069 - DNA, 17 bp, Homo sapiens
ccaccggggcaagaggg

SEQ ID NO: 1015070 - DNA, 17 bp, Homo sapiens
ccaccggtccagctggc

SEQ ID NO: 1015071 - DNA, 18 bp, Homo sapiens
ccaccggtccagctggcc

SEQ ID NO: 1015072 - DNA, 20 bp, Homo sapiens
ccaccgtccgccctgctcct

SEQ ID NO: 1015073 - DNA, 20 bp, Homo sapiens
ccaccgtctcggccctgaac

SEQ ID NO: 1015074 - DNA, 15 bp, Homo sapiens
ccaccgtgaaccaga

SEQ ID NO: 1015075 - DNA, 19 bp, Homo sapiens
ccaccgtgcctggccagat

SEQ ID NO: 1015076 - DNA, 14 bp, Homo sapiens
ccacctacacccct

SEQ ID NO: 1015077 - DNA, 21 bp, Homo sapiens
ccacctacacccctgtgctcc

SEQ ID NO: 1015078 - DNA, 17 bp, Homo sapiens
ccacctacttgtgactg

SEQ ID NO: 1015079 - DNA, 14 bp, Homo sapiens
ccacctagaacact

SEQ ID NO: 1015080 - DNA, 14 bp, Homo sapiens
ccacctagcagcac

SEQ ID NO: 1015081 - DNA, 20 bp, Homo sapiens
ccacctaggccactcctcca

SEQ ID NO: 1015082 - DNA, 15 bp, Homo sapiens
ccacctatgcctgtg

SEQ ID NO: 1015083 - DNA, 16 bp, Homo sapiens
ccacctatgcctgtgg

SEQ ID NO: 1015084 - DNA, 20 bp, Homo sapiens
ccacctatgcctgtggtgaa

SEQ ID NO: 1015085 - DNA, 19 bp, Homo sapiens
ccacctcacctagcctgat

SEQ ID NO: 1015086 - DNA, 10 bp, Homo sapiens
ccacctcagc

SEQ ID NO: 1015087 - DNA, 12 bp, Homo sapiens
ccacctcagcct

SEQ ID NO: 1015088 - DNA, 16 bp, Homo sapiens
ccacctcagcctccca

SEQ ID NO: 1015089 - DNA, 14 bp, Homo sapiens
ccacctcagccttg

SEQ ID NO: 1015090 - DNA, 14 bp, Homo sapiens
ccacctcagggcac

SEQ ID NO: 1015091 - DNA, 17 bp, Homo sapiens
ccacctcatcactggac

SEQ ID NO: 1015092 - DNA, 18 bp, Homo sapiens
ccacctcatcactggact

SEQ ID NO: 1015093 - DNA, 22 bp, Homo sapiens
ccacctcatcactggactgcat

SEQ ID NO: 1015094 - DNA, 23 bp, Homo sapiens
ccacctcatcactggactgcatg

SEQ ID NO: 1015095 - DNA, 20 bp, Homo sapiens
ccacctcatggattgccaca

SEQ ID NO: 1015096 - DNA, 13 bp, Homo sapiens
ccacctccaccca

SEQ ID NO: 1015097 - DNA, 15 bp, Homo sapiens
ccacctccacccact

SEQ ID NO: 1015098 - DNA, 16 bp, Homo sapiens
ccacctccacccagcc

SEQ ID NO: 1015099 - DNA, 12 bp, Homo sapiens
ccacctccagcc

SEQ ID NO: 1015100 - DNA, 17 bp, Homo sapiens
ccacctcccacaaagga

SEQ ID NO: 1015101 - DNA, 14 bp, Homo sapiens
ccacctccccacac

SEQ ID NO: 1015102 - DNA, 23 bp, Homo sapiens
ccacctccccacacacaggcctt

SEQ ID NO: 1015103 - DNA, 19 bp, Homo sapiens
ccacctcccctatccaccc

SEQ ID NO: 1015104 - DNA, 22 bp, Homo sapiens
ccacctcccctatccacccagc

SEQ ID NO: 1015105 - DNA, 13 bp, Homo sapiens
ccacctcccgccc

SEQ ID NO: 1015106 - DNA, 14 bp, Homo sapiens
ccacctcccgccct

SEQ ID NO: 1015107 - DNA, 13 bp, Homo sapiens
ccacctccctcac

SEQ ID NO: 1015108 - DNA, 15 bp, Homo sapiens
ccacctccctcacca

SEQ ID NO: 1015109 - DNA, 16 bp, Homo sapiens
ccacctccctctgcca

SEQ ID NO: 1015110 - DNA, 18 bp, Homo sapiens
ccacctccctgcctccag

SEQ ID NO: 1015111 - DNA, 22 bp, Homo sapiens
ccacctccctgcgcccttgagg

SEQ ID NO: 1015112 - DNA, 15 bp, Homo sapiens
ccacctcccttccca

SEQ ID NO: 1015113 - DNA, 16 bp, Homo sapiens
ccacgctccagctgcc

SEQ ID NO: 1015114 - DNA, 21 bp, Homo sapiens
ccacgctgaccatgcgtcagg

SEQ ID NO: 1015115 - DNA, 13 bp, Homo sapiens
ccacgctgtcctc

SEQ ID NO: 1015116 - DNA, 14 bp, Homo sapiens
ccacgctgtcctct

SEQ ID NO: 1015117 - DNA, 21 bp, Homo sapiens
ccacgctgtcctctcgagccc

SEQ ID NO: 1015118 - DNA, 18 bp, Homo sapiens
ccacgctgtctccagacc

SEQ ID NO: 1015119 - DNA, 19 bp, Homo sapiens
ccacgctgtctccagaccc

SEQ ID NO: 1015120 - DNA, 21 bp, Homo sapiens
ccacgctgtctccagaccccc

SEQ ID NO: 1015121 - DNA, 18 bp, Homo sapiens
ccacgctttgctgctacc

SEQ ID NO: 1015122 - DNA, 14 bp, Homo sapiens
ccacggaaacagaa

SEQ ID NO: 1015123 - DNA, 23 bp, Homo sapiens
ccacggcatcgcatccgtcctgg

SEQ ID NO: 1015124 - DNA, 14 bp, Homo sapiens
ccacggccaccact

SEQ ID NO: 1015125 - DNA, 13 bp, Homo sapiens
ccacggccaccct

SEQ ID NO: 1015126 - DNA, 16 bp, Homo sapiens
ccacggccaccctcct

SEQ ID NO: 1015127 - DNA, 17 bp, Homo sapiens
ccacggccaccctcctt

SEQ ID NO: 1015128 - DNA, 21 bp, Homo sapiens
ccacggccaccctccttcccg

SEQ ID NO: 1015129 - DNA, 16 bp, Homo sapiens
ccacggggatcacagc

SEQ ID NO: 1015130 - DNA, 17 bp, Homo sapiens
ccacgggggcagtgtga

SEQ ID NO: 1015131 - DNA, 13 bp, Homo sapiens
ccacggtctgagc

SEQ ID NO: 1015132 - DNA, 20 bp, Homo sapiens
ccacggtgcgtggctgtggc

SEQ ID NO: 1015133 - DNA, 16 bp, Homo sapiens
ccacgtagggggctct

SEQ ID NO: 1015134 - DNA, 12 bp, Homo sapiens
ccacgtcccagc

SEQ ID NO: 1015135 - DNA, 21 bp, Homo sapiens
ccacgtcccagcatccctgga

SEQ ID NO: 1015136 - DNA, 23 bp, Homo sapiens
ccacgtcctcgaattctcagacg

SEQ ID NO: 1015137 - DNA, 16 bp, Homo sapiens
ccacgtctgccaggcc

SEQ ID NO: 1015138 - DNA, 18 bp, Homo sapiens
ccacgtctgccaggccca

SEQ ID NO: 1015139 - DNA, 13 bp, Homo sapiens
ccacgtctggcca

SEQ ID NO: 1015140 - DNA, 21 bp, Homo sapiens
ccacgtctggccaggcactgc

SEQ ID NO: 1015141 - DNA, 23 bp, Homo sapiens
ccacgtctggccaggcactgcct

SEQ ID NO: 1015142 - DNA, 12 bp, Homo sapiens
ccacgtctggct

SEQ ID NO: 1015143 - DNA, 14 bp, Homo sapiens
ccacgtctggctcc

SEQ ID NO: 1015144 - DNA, 16 bp, Homo sapiens
ccacgtctttcctgct

SEQ ID NO: 1015145 - DNA, 19 bp, Homo sapiens
ccacgtgaaatttgcctct

SEQ ID NO: 1015146 - DNA, 17 bp, Homo sapiens
ccacgtgacagtgcctg

SEQ ID NO: 1015147 - DNA, 18 bp, Homo sapiens
ccacgtgagagaatctgc

SEQ ID NO: 1015148 - DNA, 17 bp, Homo sapiens
ccacgtgcgacagagag

SEQ ID NO: 1015149 - DNA, 15 bp, Homo sapiens
ccacgtgctaccccc

SEQ ID NO: 1015150 - DNA, 14 bp, Homo sapiens
ccacgtggatgggc

SEQ ID NO: 1015151 - DNA, 23 bp, Homo sapiens
ccacgtggcctctctctctctcc

SEQ ID NO: 1015152 - DNA, 18 bp, Homo sapiens
ccacgtgtatagtatctg

SEQ ID NO: 1015153 - DNA, 20 bp, Homo sapiens
ccacgtgtatagtatctgta

SEQ ID NO: 1015154 - DNA, 19 bp, Homo sapiens
ccacgtgtccgtccaccct

SEQ ID NO: 1015155 - DNA, 16 bp, Homo sapiens
ccacgtgtgctgtggc

SEQ ID NO: 1015156 - DNA, 14 bp, Homo sapiens
ccacgttcagggag

SEQ ID NO: 1015157 - DNA, 16 bp, Homo sapiens
ccacgttcagggaggg

SEQ ID NO: 1015158 - DNA, 15 bp, Homo sapiens
ccacgttccttactg

SEQ ID NO: 1015159 - DNA, 20 bp, Homo sapiens
ccacgttccttactgcagaa

SEQ ID NO: 1015160 - DNA, 13 bp, Homo sapiens
ccactaaaaatat

SEQ ID NO: 1015161 - DNA, 15 bp, Homo sapiens
ccactaaagcttcag

SEQ ID NO: 1015162 - DNA, 18 bp, Homo sapiens
ccactaaagcttcagact

SEQ ID NO: 1015163 - DNA, 21 bp, Homo sapiens
ccactaaagcttcagactcaa

SEQ ID NO: 1015164 - DNA, 22 bp, Homo sapiens
ccactaaagcttcagactcaag

SEQ ID NO: 1015165 - DNA, 18 bp, Homo sapiens
ccactaaccatccccaac

SEQ ID NO: 1015166 - DNA, 21 bp, Homo sapiens
ccactaaccttgcctggtaca

SEQ ID NO: 1015167 - DNA, 21 bp, Homo sapiens
ccactaagaattcaaactggg

SEQ ID NO: 1015168 - DNA, 19 bp, Homo sapiens
ccactaatccattatcctt

SEQ ID NO: 1015169 - DNA, 14 bp, Homo sapiens
ccactacactccag

SEQ ID NO: 1015170 - DNA, 21 bp, Homo sapiens
ccactacactccagcctgagc

SEQ ID NO: 1015171 - DNA, 22 bp, Homo sapiens
ccactacactccagcctgagca

SEQ ID NO: 1015172 - DNA, 11 bp, Homo sapiens
ccactacattc

SEQ ID NO: 1015173 - DNA, 14 bp, Homo sapiens
ccactacattctgt

SEQ ID NO: 1015174 - DNA, 20 bp, Homo sapiens
ccactaccagccagcctcag

SEQ ID NO: 1015175 - DNA, 12 bp, Homo sapiens
ccactactgcag

SEQ ID NO: 1015176 - DNA, 21 bp, Homo sapiens
ccactagaactctccatctta

SEQ ID NO: 1015177 - DNA, 17 bp, Homo sapiens
ccactagacccactgga

SEQ ID NO: 1015178 - DNA, 23 bp, Homo sapiens
ccactagagggcccatcaggcag

SEQ ID NO: 1015179 - DNA, 16 bp, Homo sapiens
ccactaggactctgag

SEQ ID NO: 1015180 - DNA, 21 bp, Homo sapiens
ccactaggtgtccccaacgtc

SEQ ID NO: 1015181 - DNA, 18 bp, Homo sapiens
ccactagtgacagtttct

SEQ ID NO: 1015182 - DNA, 16 bp, Homo sapiens
ccactagtgcaaatca

SEQ ID NO: 1015183 - DNA, 23 bp, Homo sapiens
cttgccccctttgaccttcccca

SEQ ID NO: 1015184 - DNA, 21 bp, Homo sapiens
cttgccccggccccggcccca

SEQ ID NO: 1015185 - DNA, 16 bp, Homo sapiens
cttgccccttgtcctg

SEQ ID NO: 1015186 - DNA, 15 bp, Homo sapiens
cttgcccgccagcct

SEQ ID NO: 1015187 - DNA, 17 bp, Homo sapiens
cttgcccgccagcctca

SEQ ID NO: 1015188 - DNA, 18 bp, Homo sapiens
cttgcccgccagcctcag

SEQ ID NO: 1015189 - DNA, 14 bp, Homo sapiens
cttgcccgctccca

SEQ ID NO: 1015190 - DNA, 17 bp, Homo sapiens
cttgcccggattctggg

SEQ ID NO: 1015191 - DNA, 20 bp, Homo sapiens
cttgcccggattctgggagg

SEQ ID NO: 1015192 - DNA, 21 bp, Homo sapiens
cttgcccgtcggccctgcgtc

SEQ ID NO: 1015193 - DNA, 16 bp, Homo sapiens
cttgccctccgcctgg

SEQ ID NO: 1015194 - DNA, 21 bp, Homo sapiens
cttgccctccgcctgggatct

SEQ ID NO: 1015195 - DNA, 15 bp, Homo sapiens
cttgccctgacctcc

SEQ ID NO: 1015196 - DNA, 19 bp, Homo sapiens
cttgccctgacctcccagc

SEQ ID NO: 1015197 - DNA, 15 bp, Homo sapiens
cttgcccttccctgt

SEQ ID NO: 1015198 - DNA, 15 bp, Homo sapiens
cttgcccttcctact

SEQ ID NO: 1015199 - DNA, 16 bp, Homo sapiens
cttgcccttgccctga

SEQ ID NO: 1015200 - DNA, 13 bp, Homo sapiens
cttgcccttggag

SEQ ID NO: 1015201 - DNA, 22 bp, Homo sapiens
cttgccctttccccccatgttg

SEQ ID NO: 1015202 - DNA, 16 bp, Homo sapiens
cttgccgagagaggcg

SEQ ID NO: 1015203 - DNA, 23 bp, Homo sapiens
cttgccgagagaggcgcgtctgc

SEQ ID NO: 1015204 - DNA, 18 bp, Homo sapiens
cttgccgctccccttgga

SEQ ID NO: 1015205 - DNA, 21 bp, Homo sapiens
cttgcctaaatttaatgctgc

SEQ ID NO: 1015206 - DNA, 23 bp, Homo sapiens
cttgcctaaatttaatgctgcct

SEQ ID NO: 1015207 - DNA, 18 bp, Homo sapiens
cttgcctacttttcttta

SEQ ID NO: 1015208 - DNA, 19 bp, Homo sapiens
cttgcctagggcctggtcc

SEQ ID NO: 1015209 - DNA, 20 bp, Homo sapiens
cttgcctagggcctggtcca

SEQ ID NO: 1015210 - DNA, 20 bp, Homo sapiens
cttgcctcaagttccatgct

SEQ ID NO: 1015211 - DNA, 21 bp, Homo sapiens
cttgcctcaagttccatgctt

SEQ ID NO: 1015212 - DNA, 18 bp, Homo sapiens
cttgcctcaatgccagta

SEQ ID NO: 1015213 - DNA, 14 bp, Homo sapiens
cttgcctccccatt

SEQ ID NO: 1015214 - DNA, 12 bp, Homo sapiens
cttgcctcctgt

SEQ ID NO: 1015215 - DNA, 14 bp, Homo sapiens
cttgcctctctcag

SEQ ID NO: 1015216 - DNA, 17 bp, Homo sapiens
cttgcctctctcaggag

SEQ ID NO: 1015217 - DNA, 16 bp, Homo sapiens
cttgcctcttccttga

SEQ ID NO: 1015218 - DNA, 18 bp, Homo sapiens
cttgcctcttccttgaag

SEQ ID NO: 1015219 - DNA, 17 bp, Homo sapiens
cttgcctgaactccaga

SEQ ID NO: 1015220 - DNA, 20 bp, Homo sapiens
cttgcctgaactccagaggt

SEQ ID NO: 1015221 - DNA, 14 bp, Homo sapiens
cttgcctgcctcct

SEQ ID NO: 1015222 - DNA, 15 bp, Homo sapiens
cttgcctgcctccta

SEQ ID NO: 1015223 - DNA, 17 bp, Homo sapiens
cttgcctgcctcctagg

SEQ ID NO: 1015224 - DNA, 18 bp, Homo sapiens
cttgcctgcctcctaggc

SEQ ID NO: 1015225 - DNA, 12 bp, Homo sapiens
cttgcctggaat

SEQ ID NO: 1015226 - DNA, 17 bp, Homo sapiens
cttgcctggaataaaat

SEQ ID NO: 1015227 - DNA, 20 bp, Homo sapiens
cttgcctggagacgtggaac

SEQ ID NO: 1015228 - DNA, 12 bp, Homo sapiens
cttgcctgggct

SEQ ID NO: 1015229 - DNA, 12 bp, Homo sapiens
cttgcctggggc

SEQ ID NO: 1015230 - DNA, 16 bp, Homo sapiens
cttgcctggtacagta

SEQ ID NO: 1015231 - DNA, 16 bp, Homo sapiens
cttgccttaataaata

SEQ ID NO: 1015232 - DNA, 18 bp, Homo sapiens
cttgccttgcttctccca

SEQ ID NO: 1015233 - DNA, 19 bp, Homo sapiens
cttgcctttcgaggcctga

SEQ ID NO: 1015234 - DNA, 16 bp, Homo sapiens
cttgcgaatccaagct

SEQ ID NO: 1015235 - DNA, 19 bp, Homo sapiens
cttggagagggggccggac

SEQ ID NO: 1015236 - DNA, 22 bp, Homo sapiens
cttggagccaatggagactgtc

SEQ ID NO: 1015237 - DNA, 18 bp, Homo sapiens
cttggagcccgtgcagta

SEQ ID NO: 1015238 - DNA, 13 bp, Homo sapiens
cttggagctgagc

SEQ ID NO: 1015239 - DNA, 18 bp, Homo sapiens
cttggagctgagcctctc

SEQ ID NO: 1015240 - DNA, 15 bp, Homo sapiens
cttggagctttggaa

SEQ ID NO: 1015241 - DNA, 18 bp, Homo sapiens
cttggagctttggaatat

SEQ ID NO: 1015242 - DNA, 17 bp, Homo sapiens
cttggagctttttcaaa

SEQ ID NO: 1015243 - DNA, 21 bp, Homo sapiens
cttggaggacctggcgtgctc

SEQ ID NO: 1015244 - DNA, 12 bp, Homo sapiens
cttggaggagga

SEQ ID NO: 1015245 - DNA, 14 bp, Homo sapiens
cttggagggaccaa

SEQ ID NO: 1015246 - DNA, 12 bp, Homo sapiens
cttggagggaga

SEQ ID NO: 1015247 - DNA, 18 bp, Homo sapiens
cttggagggctcagggca

SEQ ID NO: 1015248 - DNA, 22 bp, Homo sapiens
cttggagggtctgggggcagct

SEQ ID NO: 1015249 - DNA, 15 bp, Homo sapiens
cttggagtaattgca

SEQ ID NO: 1015250 - DNA, 14 bp, Homo sapiens
cttggataccagct

SEQ ID NO: 1015251 - DNA, 16 bp, Homo sapiens
cttggatacttggatt

SEQ ID NO: 1015252 - DNA, 13 bp, Homo sapiens
cttggatcctggg

SEQ ID NO: 1015253 - DNA, 14 bp, Homo sapiens
cttggatgcgagct

SEQ ID NO: 1015254 - DNA, 17 bp, Homo sapiens
cttggattaaggaagac

SEQ ID NO: 1015255 - DNA, 14 bp, Homo sapiens
cttggattctctaa

SEQ ID NO: 1015256 - DNA, 18 bp, Homo sapiens
cttggattctctgagaaa

SEQ ID NO: 1015257 - DNA, 22 bp, Homo sapiens
cttggattctctgagaaatgat

SEQ ID NO: 1015258 - DNA, 21 bp, Homo sapiens
cttggattctttccatttgca

SEQ ID NO: 1015259 - DNA, 23 bp, Homo sapiens
cttggatttgaacttgctctttt

SEQ ID NO: 1015260 - DNA, 16 bp, Homo sapiens
cttggcaaattttaaa

SEQ ID NO: 1015261 - DNA, 16 bp, Homo sapiens
cttggcaccaccaggg

SEQ ID NO: 1015262 - DNA, 18 bp, Homo sapiens
cttggcacccccatgctg

SEQ ID NO: 1015263 - DNA, 21 bp, Homo sapiens
cttggcacccccatgctgcct

SEQ ID NO: 1015264 - DNA, 21 bp, Homo sapiens
cttggcagctttttctgtgga

SEQ ID NO: 1015265 - DNA, 15 bp, Homo sapiens
cttggcatagacatg

SEQ ID NO: 1015266 - DNA, 15 bp, Homo sapiens
cttggcattggaatt

SEQ ID NO: 1015267 - DNA, 13 bp, Homo sapiens
cttggcatttcta

SEQ ID NO: 1015268 - DNA, 19 bp, Homo sapiens
cttggccacagactgaact

SEQ ID NO: 1015269 - DNA, 17 bp, Homo sapiens
cttggccagaagggggc

SEQ ID NO: 1015270 - DNA, 14 bp, Homo sapiens
cttggccaggattt

SEQ ID NO: 1015271 - DNA, 21 bp, Homo sapiens
cttggccatgatgtccttgga

SEQ ID NO: 1015272 - DNA, 14 bp, Homo sapiens
cttggcccaggagc

SEQ ID NO: 1015273 - DNA, 22 bp, Homo sapiens
cttggcccaggagctctgcgcc

SEQ ID NO: 1015274 - DNA, 17 bp, Homo sapiens
cttggccccccaaagtg

SEQ ID NO: 1015275 - DNA, 19 bp, Homo sapiens
cttggcccctcacatcctc

SEQ ID NO: 1015276 - DNA, 22 bp, Homo sapiens
cttggcccctcacatcctctcc

SEQ ID NO: 1015277 - DNA, 23 bp, Homo sapiens
cttggcccctccctcccggctgc

SEQ ID NO: 1015278 - DNA, 19 bp, Homo sapiens
cttggcccgcggcctgcac

SEQ ID NO: 1015279 - DNA, 20 bp, Homo sapiens
cttggccggctgtgctcaga

SEQ ID NO: 1015280 - DNA, 22 bp, Homo sapiens
cttggccggctgtgctcagaga

SEQ ID NO: 1015281 - DNA, 19 bp, Homo sapiens
cttggcctaaacctcagtt

SEQ ID NO: 1015282 - DNA, 12 bp, Homo sapiens
cttggcctcaga

SEQ ID NO: 1015283 - DNA, 23 bp, Homo sapiens
cttggcctcagaattcacaaaat

SEQ ID NO: 1015284 - DNA, 20 bp, Homo sapiens
cttggcctcccaaagtgctg

SEQ ID NO: 1015285 - DNA, 23 bp, Homo sapiens
cttggcctcccaaagtgctggga

SEQ ID NO: 1015286 - DNA, 21 bp, Homo sapiens
cttggcctcccaaagtgttgg

SEQ ID NO: 1015287 - DNA, 14 bp, Homo sapiens
cttggcctcccaga

SEQ ID NO: 1015288 - DNA, 13 bp, Homo sapiens
cttggcctctcct

SEQ ID NO: 1015289 - DNA, 14 bp, Homo sapiens
cttggcctgtccac

SEQ ID NO: 1015290 - DNA, 12 bp, Homo sapiens
cttggccttggc

SEQ ID NO: 1015291 - DNA, 14 bp, Homo sapiens
cttggccttgggct

SEQ ID NO: 1015292 - DNA, 19 bp, Homo sapiens
cttggcggcaaaagcccat

SEQ ID NO: 1015293 - DNA, 19 bp, Homo sapiens
cttggcggcagcagccatc

SEQ ID NO: 1015294 - DNA, 18 bp, Homo sapiens
cttggcgtggagccaggg

SEQ ID NO: 1015295 - DNA, 19 bp, Homo sapiens
cttggctatgaaaatgagc

SEQ ID NO: 1015296 - DNA, 14 bp, Homo sapiens
cttggctcactgca

SEQ ID NO: 1015297 - DNA, 14 bp, Homo sapiens
cttggctcagacat

SEQ ID NO: 1015298 - DNA, 18 bp, Homo sapiens
cttggctcgaatctctgt

SEQ ID NO: 1015299 - DNA, 19 bp, Homo sapiens
cttggctcgatgtttgcca

SEQ ID NO: 1015300 - DNA, 13 bp, Homo sapiens
cttggctgacccc

SEQ ID NO: 1015301 - DNA, 15 bp, Homo sapiens
cttggctgacccctc

SEQ ID NO: 1015302 - DNA, 13 bp, Homo sapiens
cttggctgcagcc

SEQ ID NO: 1015303 - DNA, 17 bp, Homo sapiens
cttggctgcagccatcc

SEQ ID NO: 1015304 - DNA, 18 bp, Homo sapiens
cttggctggactgtagaa

SEQ ID NO: 1015305 - DNA, 11 bp, Homo sapiens
cttggctgggc

SEQ ID NO: 1015306 - DNA, 12 bp, Homo sapiens
cttggctgggcc

SEQ ID NO: 1015307 - DNA, 15 bp, Homo sapiens
cttggctgggcctct

SEQ ID NO: 1015308 - DNA, 14 bp, Homo sapiens
cttggctgtccttc

SEQ ID NO: 1015309 - DNA, 21 bp, Homo sapiens
cttggctgtccttccccttcc

SEQ ID NO: 1015310 - DNA, 13 bp, Homo sapiens
cttggctgtgagg

SEQ ID NO: 1015311 - DNA, 14 bp, Homo sapiens
cttggcttacctga

SEQ ID NO: 1015312 - DNA, 16 bp, Homo sapiens
cttggcttacctgacc

SEQ ID NO: 1015313 - DNA, 19 bp, Homo sapiens
ccactggggtccagggagc

SEQ ID NO: 1015314 - DNA, 16 bp, Homo sapiens
ccactgggtctcactc

SEQ ID NO: 1015315 - DNA, 19 bp, Homo sapiens
ccactgggtctcactcctg

SEQ ID NO: 1015316 - DNA, 21 bp, Homo sapiens
ccactgtaggggttggggttt

SEQ ID NO: 1015317 - DNA, 19 bp, Homo sapiens
ccactgtatattttttaat

SEQ ID NO: 1015318 - DNA, 21 bp, Homo sapiens
ccactgtatgatttataaaca

SEQ ID NO: 1015319 - DNA, 17 bp, Homo sapiens
ccactgtcaccctccac

SEQ ID NO: 1015320 - DNA, 22 bp, Homo sapiens
ccactgtcactgtttctctgct

SEQ ID NO: 1015321 - DNA, 23 bp, Homo sapiens
ccactgtcactgtttctctgctg

SEQ ID NO: 1015322 - DNA, 18 bp, Homo sapiens
ccactgtccccctaccca

SEQ ID NO: 1015323 - DNA, 12 bp, Homo sapiens
ccactgtccctg

SEQ ID NO: 1015324 - DNA, 17 bp, Homo sapiens
ccactgtccctgtcctt

SEQ ID NO: 1015325 - DNA, 19 bp, Homo sapiens
ccactgtccctgtccttct

SEQ ID NO: 1015326 - DNA, 15 bp, Homo sapiens
ccactgtccgcctct

SEQ ID NO: 1015327 - DNA, 22 bp, Homo sapiens
ccactgtcctaccagttgccct

SEQ ID NO: 1015328 - DNA, 15 bp, Homo sapiens
ccactgtcctccttg

SEQ ID NO: 1015329 - DNA, 11 bp, Homo sapiens
ccactgtcctg

SEQ ID NO: 1015330 - DNA, 16 bp, Homo sapiens
ccactgtcctgggcgc

SEQ ID NO: 1015331 - DNA, 14 bp, Homo sapiens
ccactgtgccactg

SEQ ID NO: 1015332 - DNA, 17 bp, Homo sapiens
ccactgtgccactgact

SEQ ID NO: 1015333 - DNA, 16 bp, Homo sapiens
ccactgtgcctcagag

SEQ ID NO: 1015334 - DNA, 18 bp, Homo sapiens
ccactgtgcctcagagac

SEQ ID NO: 1015335 - DNA, 22 bp, Homo sapiens
ccactgtgcctcagagaccagg

SEQ ID NO: 1015336 - DNA, 20 bp, Homo sapiens
ccactgtgcctttgcaaatc

SEQ ID NO: 1015337 - DNA, 22 bp, Homo sapiens
ccactgtgcctttgcaaatcag

SEQ ID NO: 1015338 - DNA, 13 bp, Homo sapiens
ccactgtgcttgg

SEQ ID NO: 1015339 - DNA, 18 bp, Homo sapiens
ccactgtggcaaatggag

SEQ ID NO: 1015340 - DNA, 16 bp, Homo sapiens
ccactgtggcactggc

SEQ ID NO: 1015341 - DNA, 12 bp, Homo sapiens
ccactgtggcca

SEQ ID NO: 1015342 - DNA, 16 bp, Homo sapiens
ccactgtggccagagc

SEQ ID NO: 1015343 - DNA, 17 bp, Homo sapiens
ccactgtggccagagct

SEQ ID NO: 1015344 - DNA, 19 bp, Homo sapiens
ccactgtggccagagctgg

SEQ ID NO: 1015345 - DNA, 14 bp, Homo sapiens
ccactgtgggtgaa

SEQ ID NO: 1015346 - DNA, 13 bp, Homo sapiens
ccactgtgtctct

SEQ ID NO: 1015347 - DNA, 22 bp, Homo sapiens
ccactgtgtctctgtttcctga

SEQ ID NO: 1015348 - DNA, 17 bp, Homo sapiens
ccactgtgtgccttctg

SEQ ID NO: 1015349 - DNA, 19 bp, Homo sapiens
ccactgtgtgccttctgcc

SEQ ID NO: 1015350 - DNA, 16 bp, Homo sapiens
ccactgtgtttagttg

SEQ ID NO: 1015351 - DNA, 21 bp, Homo sapiens
ccactgttctgaaaggagaca

SEQ ID NO: 1015352 - DNA, 17 bp, Homo sapiens
ccactgttgagccccag

SEQ ID NO: 1015353 - DNA, 18 bp, Homo sapiens
ccactgttgggtgggtgg

SEQ ID NO: 1015354 - DNA, 21 bp, Homo sapiens
ccactgtttctcttgagctgg

SEQ ID NO: 1015355 - DNA, 17 bp, Homo sapiens
ccacttaaaaaatgtcc

SEQ ID NO: 1015356 - DNA, 19 bp, Homo sapiens
ccacttaaaaaatgtccat

SEQ ID NO: 1015357 - DNA, 15 bp, Homo sapiens
ccagaataagttatt

SEQ ID NO: 1015358 - DNA, 19 bp, Homo sapiens
ccagaataagttattgcag

SEQ ID NO: 1015359 - DNA, 21 bp, Homo sapiens
ccagaataagttattgcagtt

SEQ ID NO: 1015360 - DNA, 18 bp, Homo sapiens
ccagaatccataaatgtg

SEQ ID NO: 1015361 - DNA, 14 bp, Homo sapiens
ccagaatctgctgt

SEQ ID NO: 1015362 - DNA, 17 bp, Homo sapiens
ccagaatctgctgttgc

SEQ ID NO: 1015363 - DNA, 20 bp, Homo sapiens
ccagaatcttgactttctga

SEQ ID NO: 1015364 - DNA, 16 bp, Homo sapiens
ccagaatgtaagaaaa

SEQ ID NO: 1015365 - DNA, 15 bp, Homo sapiens
ccagaattcccttga

SEQ ID NO: 1015366 - DNA, 13 bp, Homo sapiens
ccagaatttggaa

SEQ ID NO: 1015367 - DNA, 18 bp, Homo sapiens
ccagaatttggaaatcct

SEQ ID NO: 1015368 - DNA, 21 bp, Homo sapiens
ccagaatttggaaatcctagt

SEQ ID NO: 1015369 - DNA, 17 bp, Homo sapiens
ccagacaaataggagtg

SEQ ID NO: 1015370 - DNA, 15 bp, Homo sapiens
ccagacaaatttaaa

SEQ ID NO: 1015371 - DNA, 18 bp, Homo sapiens
ccagacaacagcccaggc

SEQ ID NO: 1015372 - DNA, 13 bp, Homo sapiens
ccagacaaccaaa

SEQ ID NO: 1015373 - DNA, 13 bp, Homo sapiens
ccagacaaggaga

SEQ ID NO: 1015374 - DNA, 17 bp, Homo sapiens
ccagacaattccattca

SEQ ID NO: 1015375 - DNA, 18 bp, Homo sapiens
ccagacacagactggcaa

SEQ ID NO: 1015376 - DNA, 22 bp, Homo sapiens
ccagacagacatctctgcaccc

SEQ ID NO: 1015377 - DNA, 12 bp, Homo sapiens
ccagacaggccc

SEQ ID NO: 1015378 - DNA, 13 bp, Homo sapiens
ccagacagggtgg

SEQ ID NO: 1015379 - DNA, 15 bp, Homo sapiens
ccagaccaaccctgg

SEQ ID NO: 1015380 - DNA, 16 bp, Homo sapiens
ccagaccaaccctggg

SEQ ID NO: 1015381 - DNA, 17 bp, Homo sapiens
ccagaccaaccctggga

SEQ ID NO: 1015382 - DNA, 18 bp, Homo sapiens
ccagaccaaccctgggac

SEQ ID NO: 1015383 - DNA, 20 bp, Homo sapiens
ccagaccaaccctgggacct

SEQ ID NO: 1015384 - DNA, 18 bp, Homo sapiens
ccagaccaccagccgccc

SEQ ID NO: 1015385 - DNA, 19 bp, Homo sapiens
ccagacccacctggagccc

SEQ ID NO: 1015386 - DNA, 17 bp, Homo sapiens
ccagacccactgaaatg

SEQ ID NO: 1015387 - DNA, 15 bp, Homo sapiens
ccagacccagaggcc

SEQ ID NO: 1015388 - DNA, 22 bp, Homo sapiens
ccagacccagcccgcggcctgg

SEQ ID NO: 1015389 - DNA, 23 bp, Homo sapiens
ccagacccagcccgcggcctgga

SEQ ID NO: 1015390 - DNA, 17 bp, Homo sapiens
ccagacccatgtgctgg

SEQ ID NO: 1015391 - DNA, 18 bp, Homo sapiens
ccagacccatgtgctggg

SEQ ID NO: 1015392 - DNA, 21 bp, Homo sapiens
ccagacccatgtgctgggaaa

SEQ ID NO: 1015393 - DNA, 14 bp, Homo sapiens
ccagacccattcct

SEQ ID NO: 1015394 - DNA, 16 bp, Homo sapiens
ccagaccccagggcag

SEQ ID NO: 1015395 - DNA, 16 bp, Homo sapiens
ccagacccccacccct

SEQ ID NO: 1015396 - DNA, 14 bp, Homo sapiens
ccagacccccagca

SEQ ID NO: 1015397 - DNA, 22 bp, Homo sapiens
ccagacccccagcaaccctcct

SEQ ID NO: 1015398 - DNA, 12 bp, Homo sapiens
ccagaccccgcc

SEQ ID NO: 1015399 - DNA, 18 bp, Homo sapiens
ccagaccccgtggctctg

SEQ ID NO: 1015400 - DNA, 23 bp, Homo sapiens
ccagaccccgtggctctgggaga

SEQ ID NO: 1015401 - DNA, 15 bp, Homo sapiens
ccagacccctggctt

SEQ ID NO: 1015402 - DNA, 18 bp, Homo sapiens
ccagaccctgcctgagcc

SEQ ID NO: 1015403 - DNA, 23 bp, Homo sapiens
ccagacctgttagcagacaggcc

SEQ ID NO: 1015404 - DNA, 16 bp, Homo sapiens
ccagacgccttcctct

SEQ ID NO: 1015405 - DNA, 18 bp, Homo sapiens
ccagacgctgccgctgcc

SEQ ID NO: 1015406 - DNA, 21 bp, Homo sapiens
ccagacgtcaggccctgactc

SEQ ID NO: 1015407 - DNA, 23 bp, Homo sapiens
ccagactaaaggatccagagagc

SEQ ID NO: 1015408 - DNA, 22 bp, Homo sapiens
ccagactagatggacctgcctg

SEQ ID NO: 1015409 - DNA, 20 bp, Homo sapiens
ccagactatcgtaacctggt

SEQ ID NO: 1015410 - DNA, 21 bp, Homo sapiens
ccagactcacttgccattgcc

SEQ ID NO: 1015411 - DNA, 14 bp, Homo sapiens
ccagactcagctcc

SEQ ID NO: 1015412 - DNA, 15 bp, Homo sapiens
ccagactcctttcct

SEQ ID NO: 1015413 - DNA, 17 bp, Homo sapiens
ccagactctaggttata

SEQ ID NO: 1015414 - DNA, 22 bp, Homo sapiens
ccagactctgagctgctcaccg

SEQ ID NO: 1015415 - DNA, 13 bp, Homo sapiens
ccagactgagctc

SEQ ID NO: 1015416 - DNA, 17 bp, Homo sapiens
ccagactgagctctcca

SEQ ID NO: 1015417 - DNA, 15 bp, Homo sapiens
ccagactgatgagca

SEQ ID NO: 1015418 - DNA, 21 bp, Homo sapiens
ccagactgatgagcacatctc

SEQ ID NO: 1015419 - DNA, 12 bp, Homo sapiens
ccagactgggcc

SEQ ID NO: 1015420 - DNA, 17 bp, Homo sapiens
ccagactgtaagatgtt

SEQ ID NO: 1015421 - DNA, 22 bp, Homo sapiens
ccagactgtagagatttttatg

SEQ ID NO: 1015422 - DNA, 14 bp, Homo sapiens
ccagacttccttga

SEQ ID NO: 1015423 - DNA, 16 bp, Homo sapiens
ccagagaacaatcact

SEQ ID NO: 1015424 - DNA, 18 bp, Homo sapiens
ccagagaacaatcactat

SEQ ID NO: 1015425 - DNA, 21 bp, Homo sapiens
ccagagaacaatcactattct

SEQ ID NO: 1015426 - DNA, 18 bp, Homo sapiens
ccagagaacattggaaga

SEQ ID NO: 1015427 - DNA, 15 bp, Homo sapiens
ccagagaactgcaga

SEQ ID NO: 1015428 - DNA, 18 bp, Homo sapiens
ccagagaactgcagacct

SEQ ID NO: 1015429 - DNA, 23 bp, Homo sapiens
ccagagaagcatcggagggaatt

SEQ ID NO: 1015430 - DNA, 17 bp, Homo sapiens
ccagagaagccccgcac

SEQ ID NO: 1015431 - DNA, 20 bp, Homo sapiens
ccagagaagccccgcacggg

SEQ ID NO: 1015432 - DNA, 21 bp, Homo sapiens
ccagagaagccccgcacgggc

SEQ ID NO: 1015433 - DNA, 23 bp, Homo sapiens
ccagagaagccccgcacgggctg

SEQ ID NO: 1015434 - DNA, 20 bp, Homo sapiens
ccagagaagctggaagcctg

SEQ ID NO: 1015435 - DNA, 22 bp, Homo sapiens
ccagagaaggacggtgccaagg

SEQ ID NO: 1015436 - DNA, 16 bp, Homo sapiens
ccagagaattcttaga

SEQ ID NO: 1015437 - DNA, 12 bp, Homo sapiens
ccagagacagga

SEQ ID NO: 1015438 - DNA, 13 bp, Homo sapiens
ccagagacaggaa

SEQ ID NO: 1015439 - DNA, 13 bp, Homo sapiens
ccagagacaggga

SEQ ID NO: 1015440 - DNA, 10 bp, Homo sapiens
ccagagacat

SEQ ID NO: 1015441 - DNA, 11 bp, Homo sapiens
ccagagacata

SEQ ID NO: 1015442 - DNA, 20 bp, Homo sapiens
ccagagagagaagtgcccct

SEQ ID NO: 1015443 - DNA, 20 bp, Homo sapiens
cttgtaatgatatagccaga

SEQ ID NO: 1015444 - DNA, 23 bp, Homo sapiens
cttgtaatttaaacatttgttcc

SEQ ID NO: 1015445 - DNA, 13 bp, Homo sapiens
cttgtacaaaata

SEQ ID NO: 1015446 - DNA, 15 bp, Homo sapiens
cttgtacataatgcg

SEQ ID NO: 1015447 - DNA, 19 bp, Homo sapiens
cttgtacataatgcgtgca

SEQ ID NO: 1015448 - DNA, 21 bp, Homo sapiens
cttgtacataatgcgtgcata

SEQ ID NO: 1015449 - DNA, 19 bp, Homo sapiens
cttgtaccatagaaaaatg

SEQ ID NO: 1015450 - DNA, 22 bp, Homo sapiens
cttgtacccccaggtggaaggc

SEQ ID NO: 1015451 - DNA, 19 bp, Homo sapiens
cttgtactaagccaggagg

SEQ ID NO: 1015452 - DNA, 16 bp, Homo sapiens
cttgtactatgttaat

SEQ ID NO: 1015453 - DNA, 18 bp, Homo sapiens
cttgtacttctgtgttca

SEQ ID NO: 1015454 - DNA, 21 bp, Homo sapiens
cttgtacttctgtgttcattt

SEQ ID NO: 1015455 - DNA, 22 bp, Homo sapiens
cttgtacttctgtgttcatttt

SEQ ID NO: 1015456 - DNA, 18 bp, Homo sapiens
cttgtagaactcactctg

SEQ ID NO: 1015457 - DNA, 19 bp, Homo sapiens
cttgtagaactcactctgg

SEQ ID NO: 1015458 - DNA, 20 bp, Homo sapiens
cttgtagaactcactctggg

SEQ ID NO: 1015459 - DNA, 21 bp, Homo sapiens
cttgtagaactcactctgggc

SEQ ID NO: 1015460 - DNA, 17 bp, Homo sapiens
cttgtaggaatctgcct

SEQ ID NO: 1015461 - DNA, 21 bp, Homo sapiens
cttgtaggagctgaggtttca

SEQ ID NO: 1015462 - DNA, 21 bp, Homo sapiens
cttgtatagcatgaaataaaa

SEQ ID NO: 1015463 - DNA, 17 bp, Homo sapiens
cttgtatagtgtaaaat

SEQ ID NO: 1015464 - DNA, 16 bp, Homo sapiens
cttgtatatttgtaca

SEQ ID NO: 1015465 - DNA, 23 bp, Homo sapiens
cttgtatattttaagaaataaca

SEQ ID NO: 1015466 - DNA, 20 bp, Homo sapiens
cttgtatcaacactgttact

SEQ ID NO: 1015467 - DNA, 23 bp, Homo sapiens
cttgtatgcaaatgagttcagga

SEQ ID NO: 1015468 - DNA, 17 bp, Homo sapiens
cttgtattaaagacaga

SEQ ID NO: 1015469 - DNA, 13 bp, Homo sapiens
cttgtattaagtt

SEQ ID NO: 1015470 - DNA, 22 bp, Homo sapiens
cttgtattaagttgttaataaa

SEQ ID NO: 1015471 - DNA, 23 bp, Homo sapiens
cttgtattaagttgttaataaaa

SEQ ID NO: 1015472 - DNA, 19 bp, Homo sapiens
cttgtattgactttatgtt

SEQ ID NO: 1015473 - DNA, 14 bp, Homo sapiens
cttgtattgtaaat

SEQ ID NO: 1015474 - DNA, 16 bp, Homo sapiens
cttgtattgtaaatgt

SEQ ID NO: 1015475 - DNA, 12 bp, Homo sapiens
cttgtatttaaa

SEQ ID NO: 1015476 - DNA, 19 bp, Homo sapiens
cttgtcaaagaaggtgctg

SEQ ID NO: 1015477 - DNA, 23 bp, Homo sapiens
cttgtcaagcctgtgcaaaaaaa

SEQ ID NO: 1015478 - DNA, 12 bp, Homo sapiens
ctgtcaggaagt

SEQ ID NO: 1015479 - DNA, 22 bp, Homo sapiens
ctgtcaggaagtaaaataaata

SEQ ID NO: 1015480 - DNA, 21 bp, Homo sapiens
ctgtcaggctgggacaggctt

SEQ ID NO: 1015481 - DNA, 12 bp, Homo sapiens
ctgtcagggagg

SEQ ID NO: 1015482 - DNA, 18 bp, Homo sapiens
ctgtcagggagggccagg

SEQ ID NO: 1015483 - DNA, 23 bp, Homo sapiens
ctgtcagggagggccagggaggc

SEQ ID NO: 1015484 - DNA, 14 bp, Homo sapiens
ctgtcagggccttg

SEQ ID NO: 1015485 - DNA, 22 bp, Homo sapiens
ctgtcagggccttggcccaggg

SEQ ID NO: 1015486 - DNA, 16 bp, Homo sapiens
ctgtcagtatgacatt

SEQ ID NO: 1015487 - DNA, 19 bp, Homo sapiens
ctgtcagtgcagcccgtgt

SEQ ID NO: 1015488 - DNA, 22 bp, Homo sapiens
ctgtcagtgttaaagattttgt

SEQ ID NO: 1015489 - DNA, 20 bp, Homo sapiens
ctgtcagttgtacttctgct

SEQ ID NO: 1015490 - DNA, 21 bp, Homo sapiens
ctgtcagtttcccctctcggc

SEQ ID NO: 1015491 - DNA, 22 bp, Homo sapiens
ctgtcagtttcccctctcggcc

SEQ ID NO: 1015492 - DNA, 23 bp, Homo sapiens
ctgtcagtttcccctctcggcca

SEQ ID NO: 1015493 - DNA, 14 bp, Homo sapiens
ctgtcatagaaatt

SEQ ID NO: 1015494 - DNA, 16 bp, Homo sapiens
ctgtcatagaaattac

SEQ ID NO: 1015495 - DNA, 17 bp, Homo sapiens
ctgtcatcactccctgg

SEQ ID NO: 1015496 - DNA, 17 bp, Homo sapiens
ctgtcatccagctcact

SEQ ID NO: 1015497 - DNA, 23 bp, Homo sapiens
ctgtcatcctcaaagaaagtgta

SEQ ID NO: 1015498 - DNA, 18 bp, Homo sapiens
ctgtcatctctctggggc

SEQ ID NO: 1015499 - DNA, 18 bp, Homo sapiens
ctgtcatgcccccctcaa

SEQ ID NO: 1015500 - DNA, 20 bp, Homo sapiens
ctgtccaacctaaccccttt

SEQ ID NO: 1015501 - DNA, 21 bp, Homo sapiens
ctgtccacatccccagagccc

SEQ ID NO: 1015502 - DNA, 16 bp, Homo sapiens
ctgtccacatctgcct

SEQ ID NO: 1015503 - DNA, 18 bp, Homo sapiens
ctgtccacatctgcctcc

SEQ ID NO: 1015504 - DNA, 17 bp, Homo sapiens
ctgtccacatgacctcc

SEQ ID NO: 1015505 - DNA, 16 bp, Homo sapiens
ctgtccaccagaccca

SEQ ID NO: 1015506 - DNA, 21 bp, Homo sapiens
ctgtccacctgtgctgctgca

SEQ ID NO: 1015507 - DNA, 23 bp, Homo sapiens
ctgtccactctcggggcccttgg

SEQ ID NO: 1015508 - DNA, 12 bp, Homo sapiens
ctgtccagaaag

SEQ ID NO: 1015509 - DNA, 12 bp, Homo sapiens
ctgtccagcccc

SEQ ID NO: 1015510 - DNA, 14 bp, Homo sapiens
ctgtccagccccca

SEQ ID NO: 1015511 - DNA, 20 bp, Homo sapiens
ctgtccagctggggccagag

SEQ ID NO: 1015512 - DNA, 21 bp, Homo sapiens
ctgtccagctggggccagagg

SEQ ID NO: 1015513 - DNA, 12 bp, Homo sapiens
ctgtccaggaca

SEQ ID NO: 1015514 - DNA, 16 bp, Homo sapiens
ctgtccaggacatgat

SEQ ID NO: 1015515 - DNA, 21 bp, Homo sapiens
ctgtccaggatggagggtcca

SEQ ID NO: 1015516 - DNA, 18 bp, Homo sapiens
ctgtccaggcagctccct

SEQ ID NO: 1015517 - DNA, 22 bp, Homo sapiens
ctgtccaggcagctccctcctg

SEQ ID NO: 1015518 - DNA, 12 bp, Homo sapiens
ctgtccaggcca

SEQ ID NO: 1015519 - DNA, 17 bp, Homo sapiens
ctgtccaggccactgtg

SEQ ID NO: 1015520 - DNA, 21 bp, Homo sapiens
ctgtccaggccactgtggcca

SEQ ID NO: 1015521 - DNA, 14 bp, Homo sapiens
ctgtccaggccctt

SEQ ID NO: 1015522 - DNA, 12 bp, Homo sapiens
ctgtccaggtga

SEQ ID NO: 1015523 - DNA, 19 bp, Homo sapiens
ctgtccatctgtctgtcct

SEQ ID NO: 1015524 - DNA, 12 bp, Homo sapiens
ctgtccatgatg

SEQ ID NO: 1015525 - DNA, 18 bp, Homo sapiens
catctggatgccttcccc

SEQ ID NO: 1015526 - DNA, 20 bp, Homo sapiens
catctggcaacatctttatc

SEQ ID NO: 1015527 - DNA, 14 bp, Homo sapiens
catctggccctgac

SEQ ID NO: 1015528 - DNA, 14 bp, Homo sapiens
catctggctcagca

SEQ ID NO: 1015529 - DNA, 14 bp, Homo sapiens
catctggctctaat

SEQ ID NO: 1015530 - DNA, 20 bp, Homo sapiens
catctggctgcacaggctga

SEQ ID NO: 1015531 - DNA, 15 bp, Homo sapiens
catctggctggaaag

SEQ ID NO: 1015532 - DNA, 18 bp, Homo sapiens
catctggctgtctagaat

SEQ ID NO: 1015533 - DNA, 18 bp, Homo sapiens
catctgggagtccccttt

SEQ ID NO: 1015534 - DNA, 19 bp, Homo sapiens
catctgggagtcccctttt

SEQ ID NO: 1015535 - DNA, 15 bp, Homo sapiens
catctgggtccttgc

SEQ ID NO: 1015536 - DNA, 17 bp, Homo sapiens
catctgggtgccctgaa

SEQ ID NO: 1015537 - DNA, 23 bp, Homo sapiens
catctgggttgccatggcaatgg

SEQ ID NO: 1015538 - DNA, 20 bp, Homo sapiens
catctggtcttccaggcact

SEQ ID NO: 1015539 - DNA, 18 bp, Homo sapiens
catctggtgtaggaagtt

SEQ ID NO: 1015540 - DNA, 22 bp, Homo sapiens
catctggttgaactctggtggc

SEQ ID NO: 1015541 - DNA, 14 bp, Homo sapiens
catctgtaaagaaa

SEQ ID NO: 1015542 - DNA, 14 bp, Homo sapiens
catctgtaaatatc

SEQ ID NO: 1015543 - DNA, 16 bp, Homo sapiens
catctgtaactctaaa

SEQ ID NO: 1015544 - DNA, 22 bp, Homo sapiens
catctgtataagtaagaaaata

SEQ ID NO: 1015545 - DNA, 20 bp, Homo sapiens
catctgtcaccaattggtta

SEQ ID NO: 1015546 - DNA, 14 bp, Homo sapiens
catctgtccagctg

SEQ ID NO: 1015547 - DNA, 16 bp, Homo sapiens
catctgtccctccggg

SEQ ID NO: 1015548 - DNA, 18 bp, Homo sapiens
catctgtccgtccagagc

SEQ ID NO: 1015549 - DNA, 19 bp, Homo sapiens
catctgtccgtccagagcc

SEQ ID NO: 1015550 - DNA, 15 bp, Homo sapiens
catctgtcctcaccc

SEQ ID NO: 1015551 - DNA, 20 bp, Homo sapiens
catctgtcctcaccctgtgg

SEQ ID NO: 1015552 - DNA, 22 bp, Homo sapiens
catctgtcctcaccctgtggga

SEQ ID NO: 1015553 - DNA, 22 bp, Homo sapiens
catctgtctccctccccaaatg

SEQ ID NO: 1015554 - DNA, 11 bp, Homo sapiens
catctgtctgt

SEQ ID NO: 1015555 - DNA, 16 bp, Homo sapiens
catctgtctgtcctac

SEQ ID NO: 1015556 - DNA, 14 bp, Homo sapiens
catctgtctgtctg

SEQ ID NO: 1015557 - DNA, 18 bp, Homo sapiens
catctgtctgtctgtggg

SEQ ID NO: 1015558 - DNA, 19 bp, Homo sapiens
catctgtctgtctgtgggc

SEQ ID NO: 1015559 - DNA, 11 bp, Homo sapiens
catctgtgaat

SEQ ID NO: 1015560 - DNA, 17 bp, Homo sapiens
catctgtgcactgccca

SEQ ID NO: 1015561 - DNA, 21 bp, Homo sapiens
catctgtgcactgcccatgga

SEQ ID NO: 1015562 - DNA, 10 bp, Homo sapiens
catctgtgcg

SEQ ID NO: 1015563 - DNA, 10 bp, Homo sapiens
catctgtgtg

SEQ ID NO: 1015564 - DNA, 15 bp, Homo sapiens
catctgtgtgaaaat

SEQ ID NO: 1015565 - DNA, 17 bp, Homo sapiens
catctgtgtttcaagtg

SEQ ID NO: 1015566 - DNA, 15 bp, Homo sapiens
catctgttagcagag

SEQ ID NO: 1015567 - DNA, 16 bp, Homo sapiens
catctgttagcagagt

SEQ ID NO: 1015568 - DNA, 22 bp, Homo sapiens
catctgttgttctgtggtcaca

SEQ ID NO: 1015569 - DNA, 19 bp, Homo sapiens
catctgtttaatttacaca

SEQ ID NO: 1015570 - DNA, 20 bp, Homo sapiens
catcttaaaagctatcttca

SEQ ID NO: 1015571 - DNA, 20 bp, Homo sapiens
catcttaaactaatacgtgc

SEQ ID NO: 1015572 - DNA, 12 bp, Homo sapiens
catcttaaatga

SEQ ID NO: 1015573 - DNA, 16 bp, Homo sapiens
catcttaaatgacagt

SEQ ID NO: 1015574 - DNA, 15 bp, Homo sapiens
catcttaatgttact

SEQ ID NO: 1015575 - DNA, 14 bp, Homo sapiens
catcttactgaagg

SEQ ID NO: 1015576 - DNA, 22 bp, Homo sapiens
catcttaggttggcaaaaaggc

SEQ ID NO: 1015577 - DNA, 19 bp, Homo sapiens
catcttattgaataaagag

SEQ ID NO: 1015578 - DNA, 22 bp, Homo sapiens
catcttcaatttattactgaaa

SEQ ID NO: 1015579 - DNA, 12 bp, Homo sapiens
catcttcactct

SEQ ID NO: 1015580 - DNA, 13 bp, Homo sapiens
catcttcactctt

SEQ ID NO: 1015581 - DNA, 21 bp, Homo sapiens
catcttcacttctaaatgcat

SEQ ID NO: 1015582 - DNA, 22 bp, Homo sapiens
catcttccaagggtactaagga

SEQ ID NO: 1015583 - DNA, 17 bp, Homo sapiens
catcttccacctgtgcc

SEQ ID NO: 1015584 - DNA, 22 bp, Homo sapiens
catcttccctagagggttcctg

SEQ ID NO: 1015585 - DNA, 13 bp, Homo sapiens
catcttcctgctg

SEQ ID NO: 1015586 - DNA, 17 bp, Homo sapiens
catcttcctgtgtcctg

SEQ ID NO: 1015587 - DNA, 16 bp, Homo sapiens
catcttctccatctgg

SEQ ID NO: 1015588 - DNA, 21 bp, Homo sapiens
catcttctccccgaggctgcc

SEQ ID NO: 1015589 - DNA, 13 bp, Homo sapiens
catcttctgcctt

SEQ ID NO: 1015590 - DNA, 12 bp, Homo sapiens
catcttctggaa

SEQ ID NO: 1015591 - DNA, 13 bp, Homo sapiens
catcttctggagt

SEQ ID NO: 1015592 - DNA, 22 bp, Homo sapiens
catcttctggagtctccagtgg

SEQ ID NO: 1015593 - DNA, 14 bp, Homo sapiens
catcttctggcttg

SEQ ID NO: 1015594 - DNA, 17 bp, Homo sapiens
catcttctggcttgact

SEQ ID NO: 1015595 - DNA, 22 bp, Homo sapiens
catcttgaatactctgccctct

SEQ ID NO: 1015596 - DNA, 16 bp, Homo sapiens
catcttgagccacagt

SEQ ID NO: 1015597 - DNA, 21 bp, Homo sapiens
catcttgagccacagtcactg

SEQ ID NO: 1015598 - DNA, 19 bp, Homo sapiens
catcttgccaagggtccct

SEQ ID NO: 1015599 - DNA, 13 bp, Homo sapiens
catcttgccagcc

SEQ ID NO: 1015600 - DNA, 21 bp, Homo sapiens
ctgtccgcctctgcccgcaga

SEQ ID NO: 1015601 - DNA, 14 bp, Homo sapiens
ctgtccggcccagt

SEQ ID NO: 1015602 - DNA, 15 bp, Homo sapiens
ctgtccggcccagtg

SEQ ID NO: 1015603 - DNA, 16 bp, Homo sapiens
ctgtccggcccagtgc

SEQ ID NO: 1015604 - DNA, 22 bp, Homo sapiens
ctgtccggcccagtgccactgc

SEQ ID NO: 1015605 - DNA, 15 bp, Homo sapiens
ctgtccgtccagagc

SEQ ID NO: 1015606 - DNA, 16 bp, Homo sapiens
ctgtccgtccagagcc

SEQ ID NO: 1015607 - DNA, 18 bp, Homo sapiens
ctgtccgtttactccaag

SEQ ID NO: 1015608 - DNA, 20 bp, Homo sapiens
ctgtcctaaggaaccttcct

SEQ ID NO: 1015609 - DNA, 14 bp, Homo sapiens
ctgtcctacccgcc

SEQ ID NO: 1015610 - DNA, 23 bp, Homo sapiens
ctgtcctacttctgactttactt

SEQ ID NO: 1015611 - DNA, 12 bp, Homo sapiens
ctgtcctcaggt

SEQ ID NO: 1015612 - DNA, 15 bp, Homo sapiens
ctgtcctcaggtggc

SEQ ID NO: 1015613 - DNA, 14 bp, Homo sapiens
ctgtcctcccacag

SEQ ID NO: 1015614 - DNA, 22 bp, Homo sapiens
ctgtcctcccacagacctgcag

SEQ ID NO: 1015615 - DNA, 18 bp, Homo sapiens
ctgtcctcccatcccctg

SEQ ID NO: 1015616 - DNA, 19 bp, Homo sapiens
ctgtcctcccatcccctgg

SEQ ID NO: 1015617 - DNA, 12 bp, Homo sapiens
ctgtcctcctcg

SEQ ID NO: 1015618 - DNA, 13 bp, Homo sapiens
ctgtcctcctgga

SEQ ID NO: 1015619 - DNA, 16 bp, Homo sapiens
ctgtcctccttcctgg

SEQ ID NO: 1015620 - DNA, 17 bp, Homo sapiens
ctgtcctccttcctggg

SEQ ID NO: 1015621 - DNA, 18 bp, Homo sapiens
ctgtcctccttcctggga

SEQ ID NO: 1015622 - DNA, 20 bp, Homo sapiens
ctgtcctccttcctgggacc

SEQ ID NO: 1015623 - DNA, 21 bp, Homo sapiens
ctgtcctcgaattttatctgt

SEQ ID NO: 1015624 - DNA, 23 bp, Homo sapiens
ctgtcctcgaattttatctgtgg

SEQ ID NO: 1015625 - DNA, 13 bp, Homo sapiens
ctgtcctctcccc

SEQ ID NO: 1015626 - DNA, 17 bp, Homo sapiens
ctgtcctctcccccttc

SEQ ID NO: 1015627 - DNA, 13 bp, Homo sapiens
ctgtcctctgtag

SEQ ID NO: 1015628 - DNA, 17 bp, Homo sapiens
ctgtcctgaggagccct

SEQ ID NO: 1015629 - DNA, 18 bp, Homo sapiens
ctgtcctgaggagccctg

SEQ ID NO: 1015630 - DNA, 20 bp, Homo sapiens
ctgtcctgaggagccctgag

SEQ ID NO: 1015631 - DNA, 21 bp, Homo sapiens
ctgtcctgaggagccctgagg

SEQ ID NO: 1015632 - DNA, 23 bp, Homo sapiens
ctgtcctgaggagccctgaggac

SEQ ID NO: 1015633 - DNA, 16 bp, Homo sapiens
ctgtcctgatctgtga

SEQ ID NO: 1015634 - DNA, 17 bp, Homo sapiens
ctgtcctgatggtcagc

SEQ ID NO: 1015635 - DNA, 20 bp, Homo sapiens
ctgtcctgatggtcagctcc

SEQ ID NO: 1015636 - DNA, 21 bp, Homo sapiens
ctgtcctgatggtcagctccc

SEQ ID NO: 1015637 - DNA, 14 bp, Homo sapiens
ctgtcctgcagcaa

SEQ ID NO: 1015638 - DNA, 23 bp, Homo sapiens
ctgtcctgcagcaaacactccac

SEQ ID NO: 1015639 - DNA, 20 bp, Homo sapiens
ctgtcctgcagtcccacact

SEQ ID NO: 1015640 - DNA, 19 bp, Homo sapiens
ctgtcctgcgttcagcccc

SEQ ID NO: 1015641 - DNA, 22 bp, Homo sapiens
ctgtcctgctcattatgccact

SEQ ID NO: 1015642 - DNA, 13 bp, Homo sapiens
ctgtcctggaacc

SEQ ID NO: 1015643 - DNA, 12 bp, Homo sapiens
ctgtcctgggca

SEQ ID NO: 1015644 - DNA, 20 bp, Homo sapiens
ctgtcctgggcatgggtcca

SEQ ID NO: 1015645 - DNA, 18 bp, Homo sapiens
ctgtcctgggcgccctgg

SEQ ID NO: 1015646 - DNA, 22 bp, Homo sapiens
ctgtcctgggcgccctggaagc

SEQ ID NO: 1015647 - DNA, 14 bp, Homo sapiens
ctgtcctggtacag

SEQ ID NO: 1015648 - DNA, 14 bp, Homo sapiens
ctgtcctgtacatt

SEQ ID NO: 1015649 - DNA, 16 bp, Homo sapiens
ctgtcctgttgattaa

SEQ ID NO: 1015650 - DNA, 18 bp, Homo sapiens
ctgtccttagactccttc

SEQ ID NO: 1015651 - DNA, 14 bp, Homo sapiens
ctgtccttcagatg

SEQ ID NO: 1015652 - DNA, 19 bp, Homo sapiens
catgaaccctcttgccatc

SEQ ID NO: 1015653 - DNA, 17 bp, Homo sapiens
catgaacgttattatat

SEQ ID NO: 1015654 - DNA, 14 bp, Homo sapiens
catgaacttgatac

SEQ ID NO: 1015655 - DNA, 20 bp, Homo sapiens
catgaagaatgcattcaaaa

SEQ ID NO: 1015656 - DNA, 13 bp, Homo sapiens
catgaagaccaca

SEQ ID NO: 1015657 - DNA, 20 bp, Homo sapiens
catgaagagcttgtgtcctg

SEQ ID NO: 1015658 - DNA, 20 bp, Homo sapiens
catgaagaggagattggcca

SEQ ID NO: 1015659 - DNA, 18 bp, Homo sapiens
catgaagatgttaaaatc

SEQ ID NO: 1015660 - DNA, 23 bp, Homo sapiens
catgaagcaggaggcccttgtcg

SEQ ID NO: 1015661 - DNA, 17 bp, Homo sapiens
catgaagcataatttgt

SEQ ID NO: 1015662 - DNA, 18 bp, Homo sapiens
catgaagcataatttgtt

SEQ ID NO: 1015663 - DNA, 19 bp, Homo sapiens
catgaagcatgagttatct

SEQ ID NO: 1015664 - DNA, 14 bp, Homo sapiens
catgaagccttgct

SEQ ID NO: 1015665 - DNA, 19 bp, Homo sapiens
catgaagccttgctgaact

SEQ ID NO: 1015666 - DNA, 15 bp, Homo sapiens
catgaagctgttgtg

SEQ ID NO: 1015667 - DNA, 14 bp, Homo sapiens
catgaagggctgga

SEQ ID NO: 1015668 - DNA, 21 bp, Homo sapiens
catgaaggtaaataaaaagaa

SEQ ID NO: 1015669 - DNA, 18 bp, Homo sapiens
catgaagtaaattatgta

SEQ ID NO: 1015670 - DNA, 14 bp, Homo sapiens
catgaataaaacac

SEQ ID NO: 1015671 - DNA, 18 bp, Homo sapiens
catgaataacatttaaat

SEQ ID NO: 1015672 - DNA, 21 bp, Homo sapiens
catgaatcgggctaaggtccc

SEQ ID NO: 1015673 - DNA, 18 bp, Homo sapiens
catgaatctctgcctctc

SEQ ID NO: 1015674 - DNA, 16 bp, Homo sapiens
catgaatgatttgtgt

SEQ ID NO: 1015675 - DNA, 16 bp, Homo sapiens
catgaatgcacactag

SEQ ID NO: 1015676 - DNA, 17 bp, Homo sapiens
catgaatgtatcaggaa

SEQ ID NO: 1015677 - DNA, 13 bp, Homo sapiens
catgaatgtgctg

SEQ ID NO: 1015678 - DNA, 21 bp, Homo sapiens
catgaattacctggatgttct

SEQ ID NO: 1015679 - DNA, 22 bp, Homo sapiens
catgaattacctggatgttctt

SEQ ID NO: 1015680 - DNA, 18 bp, Homo sapiens
catgaattattacagtgt

SEQ ID NO: 1015681 - DNA, 16 bp, Homo sapiens
catgaatttagaaata

SEQ ID NO: 1015682 - DNA, 16 bp, Homo sapiens
catgaattttaaagta

SEQ ID NO: 1015683 - DNA, 23 bp, Homo sapiens
catgacaaaaataacactgttgg

SEQ ID NO: 1015684 - DNA, 19 bp, Homo sapiens
catgacaacttttaaagaa

SEQ ID NO: 1015685 - DNA, 15 bp, Homo sapiens
catgacaatgcaatg

SEQ ID NO: 1015686 - DNA, 15 bp, Homo sapiens
catgacagaggctgc

SEQ ID NO: 1015687 - DNA, 13 bp, Homo sapiens
catgacagcctcc

SEQ ID NO: 1015688 - DNA, 13 bp, Homo sapiens
catgacagtgctt

SEQ ID NO: 1015689 - DNA, 18 bp, Homo sapiens
catgacagtgcttgcatc

SEQ ID NO: 1015690 - DNA, 14 bp, Homo sapiens
catgacatcaaaat

SEQ ID NO: 1015691 - DNA, 19 bp, Homo sapiens
catgacatgttatatattt

SEQ ID NO: 1015692 - DNA, 15 bp, Homo sapiens
catgacatttcatct

SEQ ID NO: 1015693 - DNA, 14 bp, Homo sapiens
catgaccacataga

SEQ ID NO: 1015694 - DNA, 12 bp, Homo sapiens
catgaccactgg

SEQ ID NO: 1015695 - DNA, 18 bp, Homo sapiens
catgaccactgggcctgc

SEQ ID NO: 1015696 - DNA, 22 bp, Homo sapiens
catgaccactgggcctgctagt

SEQ ID NO: 1015697 - DNA, 17 bp, Homo sapiens
catgacccacccctgtg

SEQ ID NO: 1015698 - DNA, 12 bp, Homo sapiens
catgacccagcc

SEQ ID NO: 1015699 - DNA, 14 bp, Homo sapiens
catgaccctctgtc

SEQ ID NO: 1015700 - DNA, 21 bp, Homo sapiens
catgaccctctgtccccaggc

SEQ ID NO: 1015701 - DNA, 19 bp, Homo sapiens
catgacctcagtcaggcac

SEQ ID NO: 1015702 - DNA, 12 bp, Homo sapiens
catgacctccat

SEQ ID NO: 1015703 - DNA, 20 bp, Homo sapiens
catgactaatgctttttaga

SEQ ID NO: 1015704 - DNA, 21 bp, Homo sapiens
catgactcttggagcctcttt

SEQ ID NO: 1015705 - DNA, 18 bp, Homo sapiens
catgactgcacccagctc

SEQ ID NO: 1015706 - DNA, 13 bp, Homo sapiens
catgactgcattt

SEQ ID NO: 1015707 - DNA, 16 bp, Homo sapiens
catgactgcattttac

SEQ ID NO: 1015708 - DNA, 16 bp, Homo sapiens
catgactggctgtctg

SEQ ID NO: 1015709 - DNA, 15 bp, Homo sapiens
catgactgggcctcc

SEQ ID NO: 1015710 - DNA, 21 bp, Homo sapiens
catgactgggcctcccttggg

SEQ ID NO: 1015711 - DNA, 22 bp, Homo sapiens
catgacttctttactaacactg

SEQ ID NO: 1015712 - DNA, 20 bp, Homo sapiens
catgacttttctgccctgcc

SEQ ID NO: 1015713 - DNA, 19 bp, Homo sapiens
catgagaaaaactgttctt

SEQ ID NO: 1015714 - DNA, 13 bp, Homo sapiens
catgagaaaggga

SEQ ID NO: 1015715 - DNA, 18 bp, Homo sapiens
catgagaaagggagagga

SEQ ID NO: 1015716 - DNA, 21 bp, Homo sapiens
catgagaaagggagaggaaga

SEQ ID NO: 1015717 - DNA, 17 bp, Homo sapiens
catgagaagagggcctg

SEQ ID NO: 1015718 - DNA, 18 bp, Homo sapiens
catgagaagagggcctgt

SEQ ID NO: 1015719 - DNA, 22 bp, Homo sapiens
catgagaagccaagcgctcatg

SEQ ID NO: 1015720 - DNA, 20 bp, Homo sapiens
catgagaataagagaaagaa

SEQ ID NO: 1015721 - DNA, 14 bp, Homo sapiens
catgagacacatct

SEQ ID NO: 1015722 - DNA, 14 bp, Homo sapiens
ctgtctcctccctg

SEQ ID NO: 1015723 - DNA, 17 bp, Homo sapiens
ctgtctcctccctgggc

SEQ ID NO: 1015724 - DNA, 15 bp, Homo sapiens
ctgtctcgatgcctg

SEQ ID NO: 1015725 - DNA, 21 bp, Homo sapiens
ctgtctctaaggagcagcggg

SEQ ID NO: 1015726 - DNA, 20 bp, Homo sapiens
ctgtctctattagctgggtt

SEQ ID NO: 1015727 - DNA, 15 bp, Homo sapiens
ctgtctctcccttcc

SEQ ID NO: 1015728 - DNA, 19 bp, Homo sapiens
ctgtctctcctagcccctc

SEQ ID NO: 1015729 - DNA, 13 bp, Homo sapiens
ctgtctctctggg

SEQ ID NO: 1015730 - DNA, 14 bp, Homo sapiens
ctgtctctctgggc

SEQ ID NO: 1015731 - DNA, 21 bp, Homo sapiens
ctgtctctcttctcagagtgg

SEQ ID NO: 1015732 - DNA, 18 bp, Homo sapiens
ctgtctctgcctccctca

SEQ ID NO: 1015733 - DNA, 13 bp, Homo sapiens
ctgtctctgcctg

SEQ ID NO: 1015734 - DNA, 14 bp, Homo sapiens
ctgtctctgcctgc

SEQ ID NO: 1015735 - DNA, 12 bp, Homo sapiens
ctgtctctgctc

SEQ ID NO: 1015736 - DNA, 12 bp, Homo sapiens
ctgtctctgtgg

SEQ ID NO: 1015737 - DNA, 14 bp, Homo sapiens
ctgtctctttccac

SEQ ID NO: 1015738 - DNA, 19 bp, Homo sapiens
ctgtctgaaggacacttcc

SEQ ID NO: 1015739 - DNA, 19 bp, Homo sapiens
ctgtctgaatgatcttgtg

SEQ ID NO: 1015740 - DNA, 13 bp, Homo sapiens
ctgtctgcacaga

SEQ ID NO: 1015741 - DNA, 16 bp, Homo sapiens
ctgtctgccaggcact

SEQ ID NO: 1015742 - DNA, 17 bp, Homo sapiens
ctgtctgccaggcactc

SEQ ID NO: 1015743 - DNA, 11 bp, Homo sapiens
ctgtctgcccc

SEQ ID NO: 1015744 - DNA, 18 bp, Homo sapiens
ctgtctgccccagcccag

SEQ ID NO: 1015745 - DNA, 19 bp, Homo sapiens
ctgtctgccccagcccaga

SEQ ID NO: 1015746 - DNA, 16 bp, Homo sapiens
ctgtctgcctgtattt

SEQ ID NO: 1015747 - DNA, 23 bp, Homo sapiens
ctgtctggaagacgtggctctgg

SEQ ID NO: 1015748 - DNA, 15 bp, Homo sapiens
ctgtctggccaggcc

SEQ ID NO: 1015749 - DNA, 22 bp, Homo sapiens
ctgtctggcttctagagatgtg

SEQ ID NO: 1015750 - DNA, 12 bp, Homo sapiens
ctgtctggggcc

SEQ ID NO: 1015751 - DNA, 19 bp, Homo sapiens
ctgtctggtgcccctactg

SEQ ID NO: 1015752 - DNA, 23 bp, Homo sapiens
ctgtctggtggccccgtttctgg

SEQ ID NO: 1015753 - DNA, 18 bp, Homo sapiens
ctgtctggttttaacaat

SEQ ID NO: 1015754 - DNA, 13 bp, Homo sapiens
ctgtctgtcacca

SEQ ID NO: 1015755 - DNA, 22 bp, Homo sapiens
ctgtctgtcaccagctatctgt

SEQ ID NO: 1015756 - DNA, 13 bp, Homo sapiens
ctgtctgtccctt

SEQ ID NO: 1015757 - DNA, 20 bp, Homo sapiens
ctgtctgtcctacccgcccg

SEQ ID NO: 1015758 - DNA, 15 bp, Homo sapiens
ctgtctgtccttctg

SEQ ID NO: 1015759 - DNA, 20 bp, Homo sapiens
ctgtctgtctctccatctgt

SEQ ID NO: 1015760 - DNA, 23 bp, Homo sapiens
ctgtctgtctctccccctctgtc

SEQ ID NO: 1015761 - DNA, 14 bp, Homo sapiens
ctgtctgtgaacag

SEQ ID NO: 1015762 - DNA, 12 bp, Homo sapiens
ctgtctgtgggc

SEQ ID NO: 1015763 - DNA, 21 bp, Homo sapiens
ctgtctgtgggcttcagcact

SEQ ID NO: 1015764 - DNA, 15 bp, Homo sapiens
ctgtctgttacactg

SEQ ID NO: 1015765 - DNA, 18 bp, Homo sapiens
ctgtctgttgtattcatt

SEQ ID NO: 1015766 - DNA, 14 bp, Homo sapiens
ctgtcttaattttc

SEQ ID NO: 1015767 - DNA, 19 bp, Homo sapiens
ctgtcttactattatagca

SEQ ID NO: 1015768 - DNA, 19 bp, Homo sapiens
ctgtcttcagcacattcca

SEQ ID NO: 1015769 - DNA, 15 bp, Homo sapiens
ctgtcttccaaggag

SEQ ID NO: 1015770 - DNA, 12 bp, Homo sapiens
ctgtcttcccct

SEQ ID NO: 1015771 - DNA, 15 bp, Homo sapiens
ctgtcttcccctgag

SEQ ID NO: 1015772 - DNA, 21 bp, Homo sapiens
ctgtcttctctccacttctgg

SEQ ID NO: 1015773 - DNA, 22 bp, Homo sapiens
ctgtcttctctccacttctggt

SEQ ID NO: 1015774 - DNA, 13 bp, Homo sapiens
ctgtcttctgggc

SEQ ID NO: 1015775 - DNA, 18 bp, Homo sapiens
ctgtcttgatgactgctg

SEQ ID NO: 1015776 - DNA, 14 bp, Homo sapiens
ctgtcttgccccag

SEQ ID NO: 1015777 - DNA, 17 bp, Homo sapiens
ctgtcttgctcctgggg

SEQ ID NO: 1015778 - DNA, 14 bp, Homo sapiens
ctgtcttggcatta

SEQ ID NO: 1015779 - DNA, 14 bp, Homo sapiens
ctgtcttggggcca

SEQ ID NO: 1015780 - DNA, 17 bp, Homo sapiens
ctgtcttgttcattttg

SEQ ID NO: 1015781 - DNA, 22 bp, Homo sapiens
catgatgggaaaatatttcctg

SEQ ID NO: 1015782 - DNA, 20 bp, Homo sapiens
catgatgtagtgcctctttc

SEQ ID NO: 1015783 - DNA, 13 bp, Homo sapiens
catgatgtccttg

SEQ ID NO: 1015784 - DNA, 22 bp, Homo sapiens
catgatgtgaagagtttcacaa

SEQ ID NO: 1015785 - DNA, 22 bp, Homo sapiens
catgatgttaaccagaataaag

SEQ ID NO: 1015786 - DNA, 13 bp, Homo sapiens
catgatgttaact

SEQ ID NO: 1015787 - DNA, 14 bp, Homo sapiens
catgatgttaactt

SEQ ID NO: 1015788 - DNA, 12 bp, Homo sapiens
catgatgtttgc

SEQ ID NO: 1015789 - DNA, 22 bp, Homo sapiens
catgattaaccacttcagctga

SEQ ID NO: 1015790 - DNA, 22 bp, Homo sapiens
catgattatagcaactaatgtt

SEQ ID NO: 1015791 - DNA, 15 bp, Homo sapiens
catgattccatgccc

SEQ ID NO: 1015792 - DNA, 21 bp, Homo sapiens
catgattcgcccaaagccaga

SEQ ID NO: 1015793 - DNA, 14 bp, Homo sapiens
catgattctattta

SEQ ID NO: 1015794 - DNA, 16 bp, Homo sapiens
catgattcttctcttg

SEQ ID NO: 1015795 - DNA, 17 bp, Homo sapiens
catgattggcttaaagt

SEQ ID NO: 1015796 - DNA, 23 bp, Homo sapiens
catgattggcttaaagtgaagga

SEQ ID NO: 1015797 - DNA, 20 bp, Homo sapiens
catgatttagggaagcaggg

SEQ ID NO: 1015798 - DNA, 14 bp, Homo sapiens
catgatttccttga

SEQ ID NO: 1015799 - DNA, 20 bp, Homo sapiens
catgatttgaaaaaaagcat

SEQ ID NO: 1015800 - DNA, 19 bp, Homo sapiens
catgatttgtcccagcctg

SEQ ID NO: 1015801 - DNA, 18 bp, Homo sapiens
catgattttaagaggctt

SEQ ID NO: 1015802 - DNA, 21 bp, Homo sapiens
catgatttttggtatttatgt

SEQ ID NO: 1015803 - DNA, 15 bp, Homo sapiens
catgcaaaagtgggg

SEQ ID NO: 1015804 - DNA, 16 bp, Homo sapiens
catgcaaaatatgttt

SEQ ID NO: 1015805 - DNA, 15 bp, Homo sapiens
catgcaaactgcttt

SEQ ID NO: 1015806 - DNA, 16 bp, Homo sapiens
catgcaaactgcttta

SEQ ID NO: 1015807 - DNA, 22 bp, Homo sapiens
catgcaaactgctttattttcc

SEQ ID NO: 1015808 - DNA, 19 bp, Homo sapiens
catgcaaatgtcttccagg

SEQ ID NO: 1015809 - DNA, 21 bp, Homo sapiens
catgcaacagaagtgacttct

SEQ ID NO: 1015810 - DNA, 17 bp, Homo sapiens
catgcaagcttggtcaa

SEQ ID NO: 1015811 - DNA, 21 bp, Homo sapiens
catgcaagcttggtcaaactt

SEQ ID NO: 1015812 - DNA, 22 bp, Homo sapiens
catgcaagcttggtcaaacttt

SEQ ID NO: 1015813 - DNA, 22 bp, Homo sapiens
catgcaaggtcattttttttaa

SEQ ID NO: 1015814 - DNA, 12 bp, Homo sapiens
catgcaataatg

SEQ ID NO: 1015815 - DNA, 13 bp, Homo sapiens
catgcacacagat

SEQ ID NO: 1015816 - DNA, 21 bp, Homo sapiens
catgcacacggctggtcactc

SEQ ID NO: 1015817 - DNA, 12 bp, Homo sapiens
catgcacagctg

SEQ ID NO: 1015818 - DNA, 19 bp, Homo sapiens
catgcacagctgcttgtcc

SEQ ID NO: 1015819 - DNA, 22 bp, Homo sapiens
catgcacagtatttgtaattaa

SEQ ID NO: 1015820 - DNA, 13 bp, Homo sapiens
catgcacatttat

SEQ ID NO: 1015821 - DNA, 17 bp, Homo sapiens
catgcacatttatatat

SEQ ID NO: 1015822 - DNA, 17 bp, Homo sapiens
catgcactatatttgta

SEQ ID NO: 1015823 - DNA, 18 bp, Homo sapiens
catgcactatatttgtat

SEQ ID NO: 1015824 - DNA, 19 bp, Homo sapiens
catgcactatatttgtata

SEQ ID NO: 1015825 - DNA, 15 bp, Homo sapiens
catgcactcagctct

SEQ ID NO: 1015826 - DNA, 14 bp, Homo sapiens
catgcactgatgtt

SEQ ID NO: 1015827 - DNA, 20 bp, Homo sapiens
catgcactgtaaatatccct

SEQ ID NO: 1015828 - DNA, 23 bp, Homo sapiens
catgcactgttccccctgtgcag

SEQ ID NO: 1015829 - DNA, 22 bp, Homo sapiens
catgcagacctcatgcccagct

SEQ ID NO: 1015830 - DNA, 20 bp, Homo sapiens
catgcagcccatgcccacct

SEQ ID NO: 1015831 - DNA, 23 bp, Homo sapiens
catgcagcccatgcccacctgcc

SEQ ID NO: 1015832 - DNA, 18 bp, Homo sapiens
catgcagcccctgggccc

SEQ ID NO: 1015833 - DNA, 22 bp, Homo sapiens
catgcagcccctgggcccttgt

SEQ ID NO: 1015834 - DNA, 19 bp, Homo sapiens
catgcagccttggggcatt

SEQ ID NO: 1015835 - DNA, 20 bp, Homo sapiens
catgcagctgcaccctccct

SEQ ID NO: 1015836 - DNA, 21 bp, Homo sapiens
catgcagctgcaccctccctc

SEQ ID NO: 1015837 - DNA, 12 bp, Homo sapiens
catgcagctgcc

SEQ ID NO: 1015838 - DNA, 18 bp, Homo sapiens
catgcagctgcctggggc

SEQ ID NO: 1015839 - DNA, 12 bp, Homo sapiens
catgcaggaaga

SEQ ID NO: 1015840 - DNA, 12 bp, Homo sapiens
catgcaggaggt

SEQ ID NO: 1015841 - DNA, 12 bp, Homo sapiens
catgcaggccct

SEQ ID NO: 1015842 - DNA, 19 bp, Homo sapiens
catgcagggggctcctggg

SEQ ID NO: 1015843 - DNA, 22 bp, Homo sapiens
catgcaggtggtgggacactgg

SEQ ID NO: 1015844 - DNA, 17 bp, Homo sapiens
ctgtgactgaagaagat

SEQ ID NO: 1015845 - DNA, 23 bp, Homo sapiens
ctgtgactgaagaagatgagcct

SEQ ID NO: 1015846 - DNA, 23 bp, Homo sapiens
ctgtgactggatcttctatcatt

SEQ ID NO: 1015847 - DNA, 19 bp, Homo sapiens
ctgtgagacagtgggaaat

SEQ ID NO: 1015848 - DNA, 18 bp, Homo sapiens
ctgtgagacccccacacc

SEQ ID NO: 1015849 - DNA, 20 bp, Homo sapiens
ctgtgagacccccacacctc

SEQ ID NO: 1015850 - DNA, 23 bp, Homo sapiens
ctgtgagacccccacacctcagt

SEQ ID NO: 1015851 - DNA, 16 bp, Homo sapiens
ctgtgagaggcagcta

SEQ ID NO: 1015852 - DNA, 17 bp, Homo sapiens
ctgtgagagttgtctct

SEQ ID NO: 1015853 - DNA, 23 bp, Homo sapiens
ctgtgagcaaggagcacaagcca

SEQ ID NO: 1015854 - DNA, 20 bp, Homo sapiens
ctgtgagcattaaataaagg

SEQ ID NO: 1015855 - DNA, 20 bp, Homo sapiens
ctgtgagccatgcctccctg

SEQ ID NO: 1015856 - DNA, 15 bp, Homo sapiens
ctgtgagcccagctg

SEQ ID NO: 1015857 - DNA, 13 bp, Homo sapiens
ctgtgagcccctg

SEQ ID NO: 1015858 - DNA, 16 bp, Homo sapiens
ctgtgagcccctggtc

SEQ ID NO: 1015859 - DNA, 17 bp, Homo sapiens
ctgtgaggaatgctctg

SEQ ID NO: 1015860 - DNA, 19 bp, Homo sapiens
ctgtgaggaatgctctgtg

SEQ ID NO: 1015861 - DNA, 20 bp, Homo sapiens
ctgtgaggaatgctctgtgc

SEQ ID NO: 1015862 - DNA, 14 bp, Homo sapiens
ctgtgaggcagggg

SEQ ID NO: 1015863 - DNA, 16 bp, Homo sapiens
ctgtgaggctgtcctg

SEQ ID NO: 1015864 - DNA, 15 bp, Homo sapiens
ctgtgagggagggga

SEQ ID NO: 1015865 - DNA, 22 bp, Homo sapiens
ctgtgagggaggggaaaagcat

SEQ ID NO: 1015866 - DNA, 22 bp, Homo sapiens
ctgtgaggtaactgggatcgca

SEQ ID NO: 1015867 - DNA, 22 bp, Homo sapiens
ctgtgagtggttcaagcacact

SEQ ID NO: 1015868 - DNA, 14 bp, Homo sapiens
ctgtgagtgtaagt

SEQ ID NO: 1015869 - DNA, 21 bp, Homo sapiens
ctgtgagtgtaagtgtgagta

SEQ ID NO: 1015870 - DNA, 15 bp, Homo sapiens
ctgtgagttctccct

SEQ ID NO: 1015871 - DNA, 18 bp, Homo sapiens
ctgtgataactctgcaaa

SEQ ID NO: 1015872 - DNA, 19 bp, Homo sapiens
ctgtgatagttcaccccct

SEQ ID NO: 1015873 - DNA, 16 bp, Homo sapiens
ctgtgatatgccatag

SEQ ID NO: 1015874 - DNA, 21 bp, Homo sapiens
ctgtgatcactccagtgcact

SEQ ID NO: 1015875 - DNA, 14 bp, Homo sapiens
ctgtgatctgtgta

SEQ ID NO: 1015876 - DNA, 14 bp, Homo sapiens
ctgtgatgagctga

SEQ ID NO: 1015877 - DNA, 15 bp, Homo sapiens
ctgtgatgagctgat

SEQ ID NO: 1015878 - DNA, 17 bp, Homo sapiens
ctgtgatgccacacaga

SEQ ID NO: 1015879 - DNA, 14 bp, Homo sapiens
ctgtgatgctgtgt

SEQ ID NO: 1015880 - DNA, 21 bp, Homo sapiens
ctgtgatgctgtgtgcccaag

SEQ ID NO: 1015881 - DNA, 19 bp, Homo sapiens
ctgtgatggcgggcactgg

SEQ ID NO: 1015882 - DNA, 17 bp, Homo sapiens
ctgtgattaacttgctt

SEQ ID NO: 1015883 - DNA, 19 bp, Homo sapiens
ctgtgattacatagatcag

SEQ ID NO: 1015884 - DNA, 17 bp, Homo sapiens
ctgtgattaggtgaagg

SEQ ID NO: 1015885 - DNA, 22 bp, Homo sapiens
ctgtgattaggtgaagggatgg

SEQ ID NO: 1015886 - DNA, 23 bp, Homo sapiens
ctgtgattgggtgggattttttc

SEQ ID NO: 1015887 - DNA, 14 bp, Homo sapiens
ctgtgatttcttct

SEQ ID NO: 1015888 - DNA, 16 bp, Homo sapiens
ctgtgattttgccctc

SEQ ID NO: 1015889 - DNA, 23 bp, Homo sapiens
ctgtgattttgccctcctgccca

SEQ ID NO: 1015890 - DNA, 16 bp, Homo sapiens
ctgtgcaaacagtaac

SEQ ID NO: 1015891 - DNA, 20 bp, Homo sapiens
ctgtgcaaggtattacactc

SEQ ID NO: 1015892 - DNA, 22 bp, Homo sapiens
ctgtgcacaccccactcccaca

SEQ ID NO: 1015893 - DNA, 16 bp, Homo sapiens
ctgtgcacagtggctt

SEQ ID NO: 1015894 - DNA, 13 bp, Homo sapiens
ctgtgcacctacc

SEQ ID NO: 1015895 - DNA, 15 bp, Homo sapiens
ctgtgcacggtggac

SEQ ID NO: 1015896 - DNA, 23 bp, Homo sapiens
ctgtgcactgggcaggttcctgg

SEQ ID NO: 1015897 - DNA, 13 bp, Homo sapiens
ctgtgcagaataa

SEQ ID NO: 1015898 - DNA, 15 bp, Homo sapiens
ctgtgcagaccttac

SEQ ID NO: 1015899 - DNA, 18 bp, Homo sapiens
ctgtgcagaccttactca

SEQ ID NO: 1015900 - DNA, 13 bp, Homo sapiens
ctgtgcagatgct

SEQ ID NO: 1015901 - DNA, 15 bp, Homo sapiens
ctgtgcagatgctgc

SEQ ID NO: 1015902 - DNA, 19 bp, Homo sapiens
ctgtgcagatgctgctgaa

SEQ ID NO: 1015903 - DNA, 16 bp, Homo sapiens
ctgtgcagccgctgag

SEQ ID NO: 1015904 - DNA, 18 bp, Homo sapiens
ctgtgcagtcactggagg

SEQ ID NO: 1015905 - DNA, 20 bp, Homo sapiens
ctgtgcatcaaccaggaaga

SEQ ID NO: 1015906 - DNA, 22 bp, Homo sapiens
ctgtgcatcaaccaggaagagt

SEQ ID NO: 1015907 - DNA, 20 bp, Homo sapiens
catgcctgagggtggagact

SEQ ID NO: 1015908 - DNA, 11 bp, Homo sapiens
catgcctgcca

SEQ ID NO: 1015909 - DNA, 20 bp, Homo sapiens
catgcctgccccaaacaaat

SEQ ID NO: 1015910 - DNA, 16 bp, Homo sapiens
catgcctgcgcctgct

SEQ ID NO: 1015911 - DNA, 20 bp, Homo sapiens
catgcctgcgcctgctgcct

SEQ ID NO: 1015912 - DNA, 21 bp, Homo sapiens
catgcctgcgcctgctgcctg

SEQ ID NO: 1015913 - DNA, 17 bp, Homo sapiens
catgcctggtattttca

SEQ ID NO: 1015914 - DNA, 23 bp, Homo sapiens
catgccttaaatttgtttaatta

SEQ ID NO: 1015915 - DNA, 17 bp, Homo sapiens
catgccttggtgccggt

SEQ ID NO: 1015916 - DNA, 19 bp, Homo sapiens
catgcctttaatgttgccc

SEQ ID NO: 1015917 - DNA, 13 bp, Homo sapiens
catgcctttgtaa

SEQ ID NO: 1015918 - DNA, 16 bp, Homo sapiens
catgcctttgtaagtt

SEQ ID NO: 1015919 - DNA, 19 bp, Homo sapiens
catgcgaggggccagcaga

SEQ ID NO: 1015920 - DNA, 13 bp, Homo sapiens
catgcgcacaagg

SEQ ID NO: 1015921 - DNA, 16 bp, Homo sapiens
catgcgcagatgaggg

SEQ ID NO: 1015922 - DNA, 20 bp, Homo sapiens
catgcgcagatgaggggcca

SEQ ID NO: 1015923 - DNA, 23 bp, Homo sapiens
catgcgcagatgaggggccactg

SEQ ID NO: 1015924 - DNA, 23 bp, Homo sapiens
catgcgctcagggccatgctgag

SEQ ID NO: 1015925 - DNA, 15 bp, Homo sapiens
catgcggagccagca

SEQ ID NO: 1015926 - DNA, 13 bp, Homo sapiens
catgcggctgccc

SEQ ID NO: 1015927 - DNA, 23 bp, Homo sapiens
catgcggctgcccacgctcctgc

SEQ ID NO: 1015928 - DNA, 19 bp, Homo sapiens
catgcgggctcgcccatac

SEQ ID NO: 1015929 - DNA, 13 bp, Homo sapiens
catgcggtagcca

SEQ ID NO: 1015930 - DNA, 15 bp, Homo sapiens
catgcggtagccagc

SEQ ID NO: 1015931 - DNA, 17 bp, Homo sapiens
catgcggtagccagcac

SEQ ID NO: 1015932 - DNA, 21 bp, Homo sapiens
catgcggtagccagcacacag

SEQ ID NO: 1015933 - DNA, 16 bp, Homo sapiens
catgcggtttccaagg

SEQ ID NO: 1015934 - DNA, 19 bp, Homo sapiens
catgcgtatatgtgcgtct

SEQ ID NO: 1015935 - DNA, 16 bp, Homo sapiens
catgcgtcaggggcct

SEQ ID NO: 1015936 - DNA, 19 bp, Homo sapiens
catgctaacctctctgaac

SEQ ID NO: 1015937 - DNA, 21 bp, Homo sapiens
catgctaagagaagtagaaat

SEQ ID NO: 1015938 - DNA, 20 bp, Homo sapiens
catgctacacactgcatgtt

SEQ ID NO: 1015939 - DNA, 23 bp, Homo sapiens
catgctatctctgtgtgcacaaa

SEQ ID NO: 1015940 - DNA, 16 bp, Homo sapiens
catgctatctgttcct

SEQ ID NO: 1015941 - DNA, 20 bp, Homo sapiens
catgctatgagttttctcct

SEQ ID NO: 1015942 - DNA, 23 bp, Homo sapiens
catgctatgctgaagacattcaa

SEQ ID NO: 1015943 - DNA, 21 bp, Homo sapiens
catgctatgttctgtcttccc

SEQ ID NO: 1015944 - DNA, 18 bp, Homo sapiens
catgctcaactaatttta

SEQ ID NO: 1015945 - DNA, 20 bp, Homo sapiens
catgctcagccctgactggt

SEQ ID NO: 1015946 - DNA, 23 bp, Homo sapiens
catgctcagccctgactggtgct

SEQ ID NO: 1015947 - DNA, 14 bp, Homo sapiens
catgctcagtgcct

SEQ ID NO: 1015948 - DNA, 19 bp, Homo sapiens
catgctcatctgctggtcc

SEQ ID NO: 1015949 - DNA, 17 bp, Homo sapiens
catgctcatgtatattt

SEQ ID NO: 1015950 - DNA, 14 bp, Homo sapiens
catgctccaaatat

SEQ ID NO: 1015951 - DNA, 14 bp, Homo sapiens
catgctccaagact

SEQ ID NO: 1015952 - DNA, 14 bp, Homo sapiens
catgctcctcacct

SEQ ID NO: 1015953 - DNA, 14 bp, Homo sapiens
catgctcctggccc

SEQ ID NO: 1015954 - DNA, 22 bp, Homo sapiens
catgctccttaatggcgccatg

SEQ ID NO: 1015955 - DNA, 12 bp, Homo sapiens
catgctccttac

SEQ ID NO: 1015956 - DNA, 21 bp, Homo sapiens
catgctctctgcagccagccc

SEQ ID NO: 1015957 - DNA, 11 bp, Homo sapiens
catgctctgga

SEQ ID NO: 1015958 - DNA, 21 bp, Homo sapiens
catgctcttgaccttgtagag

SEQ ID NO: 1015959 - DNA, 13 bp, Homo sapiens
catgctctttttt

SEQ ID NO: 1015960 - DNA, 15 bp, Homo sapiens
catgctgaaaaatat

SEQ ID NO: 1015961 - DNA, 12 bp, Homo sapiens
catgctgaatgc

SEQ ID NO: 1015962 - DNA, 22 bp, Homo sapiens
catgctgaatgccccctgctta

SEQ ID NO: 1015963 - DNA, 18 bp, Homo sapiens
catgctgaggttttgaat

SEQ ID NO: 1015964 - DNA, 20 bp, Homo sapiens
catgctgaggttttgaataa

SEQ ID NO: 1015965 - DNA, 13 bp, Homo sapiens
ctgtgctgtgcct

SEQ ID NO: 1015966 - DNA, 17 bp, Homo sapiens
ctgtgctgtgcctgcta

SEQ ID NO: 1015967 - DNA, 18 bp, Homo sapiens
ctgtgctgtgcctgctag

SEQ ID NO: 1015968 - DNA, 19 bp, Homo sapiens
ctgtgctgtgcctgctaga

SEQ ID NO: 1015969 - DNA, 21 bp, Homo sapiens
ctgtgctgtggagagaagctg

SEQ ID NO: 1015970 - DNA, 18 bp, Homo sapiens
ctgtgctgtgtgtgacgt

SEQ ID NO: 1015971 - DNA, 21 bp, Homo sapiens
ctgtgcttcgactactgctcc

SEQ ID NO: 1015972 - DNA, 22 bp, Homo sapiens
ctgtgcttcgactactgctcct

SEQ ID NO: 1015973 - DNA, 17 bp, Homo sapiens
ctgtgcttcgggccctt

SEQ ID NO: 1015974 - DNA, 20 bp, Homo sapiens
ctgtgcttcgggcccttccc

SEQ ID NO: 1015975 - DNA, 16 bp, Homo sapiens
ctgtgcttgaaggccc

SEQ ID NO: 1015976 - DNA, 20 bp, Homo sapiens
ctgtgcttgaaggccctgct

SEQ ID NO: 1015977 - DNA, 14 bp, Homo sapiens
ctgtgctttctgca

SEQ ID NO: 1015978 - DNA, 15 bp, Homo sapiens
ctgtgctttctgcat

SEQ ID NO: 1015979 - DNA, 16 bp, Homo sapiens
ctgtgctttgactcac

SEQ ID NO: 1015980 - DNA, 19 bp, Homo sapiens
ctgtgctttgactcacctg

SEQ ID NO: 1015981 - DNA, 14 bp, Homo sapiens
ctgtgctttgagat

SEQ ID NO: 1015982 - DNA, 19 bp, Homo sapiens
ctgtgcttttgatctctgc

SEQ ID NO: 1015983 - DNA, 12 bp, Homo sapiens
ctgtggaaagct

SEQ ID NO: 1015984 - DNA, 13 bp, Homo sapiens
ctgtggaagagat

SEQ ID NO: 1015985 - DNA, 17 bp, Homo sapiens
ctgtggaagcatggctg

SEQ ID NO: 1015986 - DNA, 21 bp, Homo sapiens
ctgtggaagcatggctgtctg

SEQ ID NO: 1015987 - DNA, 19 bp, Homo sapiens
ctgtggaaggcagagaaat

SEQ ID NO: 1015988 - DNA, 16 bp, Homo sapiens
ctgtggaagggactag

SEQ ID NO: 1015989 - DNA, 17 bp, Homo sapiens
ctgtggaatataaatag

SEQ ID NO: 1015990 - DNA, 19 bp, Homo sapiens
ctgtggaatgagtgtgcat

SEQ ID NO: 1015991 - DNA, 20 bp, Homo sapiens
ctgtggacggggaggctctc

SEQ ID NO: 1015992 - DNA, 16 bp, Homo sapiens
ctgtggactgtcctga

SEQ ID NO: 1015993 - DNA, 22 bp, Homo sapiens
ctgtggactgtcctgaggagcc

SEQ ID NO: 1015994 - DNA, 14 bp, Homo sapiens
ctgtggagacactg

SEQ ID NO: 1015995 - DNA, 16 bp, Homo sapiens
ctgtggagacactgag

SEQ ID NO: 1015996 - DNA, 20 bp, Homo sapiens
ctgtggagactttctgttac

SEQ ID NO: 1015997 - DNA, 15 bp, Homo sapiens
ctgtggagcaaaagg

SEQ ID NO: 1015998 - DNA, 15 bp, Homo sapiens
ctgtggagcccgcac

SEQ ID NO: 1015999 - DNA, 23 bp, Homo sapiens
ctgtggagcccgcacccccaccc

SEQ ID NO: 1016000 - DNA, 17 bp, Homo sapiens
ctgtggagctcagcccc

SEQ ID NO: 1016001 - DNA, 20 bp, Homo sapiens
ctgtggagctgccacagaga

SEQ ID NO: 1016002 - DNA, 22 bp, Homo sapiens
ctgtggagctgccacagagaag

SEQ ID NO: 1016003 - DNA, 13 bp, Homo sapiens
ctgtggaggcctg

SEQ ID NO: 1016004 - DNA, 14 bp, Homo sapiens
ctgtggaggcctga

SEQ ID NO: 1016005 - DNA, 16 bp, Homo sapiens
ctgtggaggcctgatg

SEQ ID NO: 1016006 - DNA, 21 bp, Homo sapiens
ctgtggaggcctgatgctgcc

SEQ ID NO: 1016007 - DNA, 22 bp, Homo sapiens
ctgtggagggagggcagctggc

SEQ ID NO: 1016008 - DNA, 17 bp, Homo sapiens
ctgtggagtccagctct

SEQ ID NO: 1016009 - DNA, 14 bp, Homo sapiens
ctgtggagttcctg

SEQ ID NO: 1016010 - DNA, 15 bp, Homo sapiens
ctgtggagttcctgc

SEQ ID NO: 1016011 - DNA, 16 bp, Homo sapiens
ctgtggatacagtgcc

SEQ ID NO: 1016012 - DNA, 17 bp, Homo sapiens
ctgtggatacagtgccc

SEQ ID NO: 1016013 - DNA, 19 bp, Homo sapiens
ctgtggatgggatcctctc

SEQ ID NO: 1016014 - DNA, 15 bp, Homo sapiens
ctgtggcactggcca

SEQ ID NO: 1016015 - DNA, 17 bp, Homo sapiens
ctgtggcactggccacc

SEQ ID NO: 1016016 - DNA, 17 bp, Homo sapiens
ctgtggcagagttacag

SEQ ID NO: 1016017 - DNA, 23 bp, Homo sapiens
ctgtggcagagttacagttctgt

SEQ ID NO: 1016018 - DNA, 21 bp, Homo sapiens
ctgtggcagccgtcccaggcc

SEQ ID NO: 1016019 - DNA, 22 bp, Homo sapiens
ctgtggcagccgtcccaggcca

SEQ ID NO: 1016020 - DNA, 23 bp, Homo sapiens
ctgtggcagccgtcccaggccac

SEQ ID NO: 1016021 - DNA, 16 bp, Homo sapiens
ctgtggcattgaaatg

SEQ ID NO: 1016022 - DNA, 18 bp, Homo sapiens
ctgtggccacagccccct

SEQ ID NO: 1016023 - DNA, 12 bp, Homo sapiens
ctgtggccagag

SEQ ID NO: 1016024 - DNA, 15 bp, Homo sapiens
ctgtggccagagctg

SEQ ID NO: 1016025 - DNA, 19 bp, Homo sapiens
ctgtggccagagctggaag

SEQ ID NO: 1016026 - DNA, 22 bp, Homo sapiens
ctgtggccagcttgttatttat

SEQ ID NO: 1016027 - DNA, 13 bp, Homo sapiens
ctgtggccaggcc

SEQ ID NO: 1016028 - DNA, 18 bp, Homo sapiens
ctgtggccccctgtcccc

SEQ ID NO: 1016029 - DNA, 13 bp, Homo sapiens
ctgtggccctgcc

SEQ ID NO: 1016030 - DNA, 15 bp, Homo sapiens
ctgtggccctgccct

SEQ ID NO: 1016031 - DNA, 23 bp, Homo sapiens
ctgtggccctgcccttggcacca

SEQ ID NO: 1016032 - DNA, 13 bp, Homo sapiens
ctgtggccctggc

SEQ ID NO: 1016033 - DNA, 13 bp, Homo sapiens
ctgtggccgccat

SEQ ID NO: 1016034 - DNA, 17 bp, Homo sapiens
catggaccagcatctgg

SEQ ID NO: 1016035 - DNA, 21 bp, Homo sapiens
catggaccagcatctggtctt

SEQ ID NO: 1016036 - DNA, 15 bp, Homo sapiens
catggacccggagct

SEQ ID NO: 1016037 - DNA, 16 bp, Homo sapiens
catggacctaacattc

SEQ ID NO: 1016038 - DNA, 20 bp, Homo sapiens
catggacgaatatgaatgtc

SEQ ID NO: 1016039 - DNA, 22 bp, Homo sapiens
catggactctgggtttcatatc

SEQ ID NO: 1016040 - DNA, 24 bp, Homo sapiens
catggactctgggtttcatatcca

SEQ ID NO: 1016041 - DNA, 17 bp, Homo sapiens
catggacttctggatgc

SEQ ID NO: 1016042 - DNA, 22 bp, Homo sapiens
catggacttgtatatttgtaca

SEQ ID NO: 1016043 - DNA, 18 bp, Homo sapiens
catggagaaaatgggcgg

SEQ ID NO: 1016044 - DNA, 16 bp, Homo sapiens
catggagaaaccctgt

SEQ ID NO: 1016045 - DNA, 16 bp, Homo sapiens
catggagagcctctta

SEQ ID NO: 1016046 - DNA, 13 bp, Homo sapiens
catggagagctgt

SEQ ID NO: 1016047 - DNA, 15 bp, Homo sapiens
catggagatctgaag

SEQ ID NO: 1016048 - DNA, 15 bp, Homo sapiens
catggagccccctct

SEQ ID NO: 1016049 - DNA, 22 bp, Homo sapiens
catggaggagcttgggggatga

SEQ ID NO: 1016050 - DNA, 18 bp, Homo sapiens
catggaggccctcctgtg

SEQ ID NO: 1016051 - DNA, 17 bp, Homo sapiens
catggaggtttgaagat

SEQ ID NO: 1016052 - DNA, 20 bp, Homo sapiens
catggagtgtgtattgttcc

SEQ ID NO: 1016053 - DNA, 21 bp, Homo sapiens
catggagtgtgtattgttccc

SEQ ID NO: 1016054 - DNA, 15 bp, Homo sapiens
catggatacttcctg

SEQ ID NO: 1016055 - DNA, 18 bp, Homo sapiens
catggatacttcctgggt

SEQ ID NO: 1016056 - DNA, 22 bp, Homo sapiens
catggatgttttagccattgtt

SEQ ID NO: 1016057 - DNA, 14 bp, Homo sapiens
catggattgccaca

SEQ ID NO: 1016058 - DNA, 16 bp, Homo sapiens
catggattgccacagc

SEQ ID NO: 1016059 - DNA, 22 bp, Homo sapiens
catggcaaatcaggggccagag

SEQ ID NO: 1016060 - DNA, 16 bp, Homo sapiens
catggcaaatcctgtc

SEQ ID NO: 1016061 - DNA, 17 bp, Homo sapiens
catggcaaatcctgtcg

SEQ ID NO: 1016062 - DNA, 14 bp, Homo sapiens
catggcaaatgggc

SEQ ID NO: 1016063 - DNA, 16 bp, Homo sapiens
catggcaaatgggcag

SEQ ID NO: 1016064 - DNA, 18 bp, Homo sapiens
catggcaatggcatgccc

SEQ ID NO: 1016065 - DNA, 17 bp, Homo sapiens
catggcaattctggaag

SEQ ID NO: 1016066 - DNA, 17 bp, Homo sapiens
catggcaattgcactca

SEQ ID NO: 1016067 - DNA, 15 bp, Homo sapiens
catggcacaggcccg

SEQ ID NO: 1016068 - DNA, 20 bp, Homo sapiens
catggcaccaaagccaccag

SEQ ID NO: 1016069 - DNA, 12 bp, Homo sapiens
catggcaccagc

SEQ ID NO: 1016070 - DNA, 22 bp, Homo sapiens
catggcaccagccccctggatg

SEQ ID NO: 1016071 - DNA, 21 bp, Homo sapiens
catggcagaataatctttggg

SEQ ID NO: 1016072 - DNA, 18 bp, Homo sapiens
catggcagagtttgtgtg

SEQ ID NO: 1016073 - DNA, 20 bp, Homo sapiens
catggcagctgtttctcatg

SEQ ID NO: 1016074 - DNA, 17 bp, Homo sapiens
catggcagggcctcatc

SEQ ID NO: 1016075 - DNA, 23 bp, Homo sapiens
catggcatccctttttcataaat

SEQ ID NO: 1016076 - DNA, 18 bp, Homo sapiens
catggcatgcttaaattt

SEQ ID NO: 1016077 - DNA, 13 bp, Homo sapiens
catggccaggtgg

SEQ ID NO: 1016078 - DNA, 14 bp, Homo sapiens
catggccaggtggc

SEQ ID NO: 1016079 - DNA, 17 bp, Homo sapiens
catggccatagaggccc

SEQ ID NO: 1016080 - DNA, 22 bp, Homo sapiens
catggccatagaggcccaggca

SEQ ID NO: 1016081 - DNA, 15 bp, Homo sapiens
catggccatttctgt

SEQ ID NO: 1016082 - DNA, 21 bp, Homo sapiens
catggcccattggagcacctg

SEQ ID NO: 1016083 - DNA, 16 bp, Homo sapiens
catggcccccaataaa

SEQ ID NO: 1016084 - DNA, 21 bp, Homo sapiens
catggcccccaataaaggcag

SEQ ID NO: 1016085 - DNA, 22 bp, Homo sapiens
catggcccccaataaaggcagc

SEQ ID NO: 1016086 - DNA, 22 bp, Homo sapiens
ctgtacctcttgagccttgaac

SEQ ID NO: 1016087 - DNA, 22 bp, Homo sapiens
ctgtaccttttgaggagcccca

SEQ ID NO: 1016088 - DNA, 18 bp, Homo sapiens
ctgtactaaggagcatga

SEQ ID NO: 1016089 - DNA, 16 bp, Homo sapiens
ctgtactcagagcaga

SEQ ID NO: 1016090 - DNA, 13 bp, Homo sapiens
ctgtactcaggag

SEQ ID NO: 1016091 - DNA, 21 bp, Homo sapiens
ctgtactcctcccaggcgccc

SEQ ID NO: 1016092 - DNA, 14 bp, Homo sapiens
ctgtactgctcagg

SEQ ID NO: 1016093 - DNA, 21 bp, Homo sapiens
ctgtactgctcaggctgcagc

SEQ ID NO: 1016094 - DNA, 17 bp, Homo sapiens
ctgtactgttctgtgtc

SEQ ID NO: 1016095 - DNA, 16 bp, Homo sapiens
ctgtacttaataaatt

SEQ ID NO: 1016096 - DNA, 20 bp, Homo sapiens
ctgtacttcaagttaaagtg

SEQ ID NO: 1016097 - DNA, 17 bp, Homo sapiens
ctgtacttcactgtcag

SEQ ID NO: 1016098 - DNA, 20 bp, Homo sapiens
ctgtacttgtggttctcttt

SEQ ID NO: 1016099 - DNA, 15 bp, Homo sapiens
ctgtactttgccatt

SEQ ID NO: 1016100 - DNA, 13 bp, Homo sapiens
ctgtactttgtgt

SEQ ID NO: 1016101 - DNA, 16 bp, Homo sapiens
ctgtactttgtgttta

SEQ ID NO: 1016102 - DNA, 19 bp, Homo sapiens
ctgtagaaaagggaactga

SEQ ID NO: 1016103 - DNA, 22 bp, Homo sapiens
ctgtagaagtgagtttgtaaat

SEQ ID NO: 1016104 - DNA, 23 bp, Homo sapiens
ctgtagaagtgagtttgtaaata

SEQ ID NO: 1016105 - DNA, 14 bp, Homo sapiens
ctgtagacatctgt

SEQ ID NO: 1016106 - DNA, 15 bp, Homo sapiens
ctgtagacatctgtc

SEQ ID NO: 1016107 - DNA, 18 bp, Homo sapiens
ctgtagacggctcagtat

SEQ ID NO: 1016108 - DNA, 21 bp, Homo sapiens
ctgtagacttactttcctatt

SEQ ID NO: 1016109 - DNA, 15 bp, Homo sapiens
ctgtagagttgctga

SEQ ID NO: 1016110 - DNA, 17 bp, Homo sapiens
ctgtagagttgctgaga

SEQ ID NO: 1016111 - DNA, 18 bp, Homo sapiens
ctgtagatggaaaaactt

SEQ ID NO: 1016112 - DNA, 15 bp, Homo sapiens
ctgtagattctgtgg

SEQ ID NO: 1016113 - DNA, 18 bp, Homo sapiens
ctgtagattgcttctgta

SEQ ID NO: 1016114 - DNA, 19 bp, Homo sapiens
ctgtagcaatggccagagc

SEQ ID NO: 1016115 - DNA, 20 bp, Homo sapiens
ctgtagcagtgagaaaaagc

SEQ ID NO: 1016116 - DNA, 16 bp, Homo sapiens
ctgtagcatcttctgg

SEQ ID NO: 1016117 - DNA, 17 bp, Homo sapiens
ctgtagccatggctcag

SEQ ID NO: 1016118 - DNA, 18 bp, Homo sapiens
ctgtagccatggctcagg

SEQ ID NO: 1016119 - DNA, 19 bp, Homo sapiens
ctgtagccatggctcaggc

SEQ ID NO: 1016120 - DNA, 21 bp, Homo sapiens
ctgtagccatggctcaggcaa

SEQ ID NO: 1016121 - DNA, 21 bp, Homo sapiens
ctgtagcctaaaacgaatggt

SEQ ID NO: 1016122 - DNA, 13 bp, Homo sapiens
ctgtagccttctg

SEQ ID NO: 1016123 - DNA, 15 bp, Homo sapiens
ctgtagcgaccccag

SEQ ID NO: 1016124 - DNA, 20 bp, Homo sapiens
ctgtagctattagcggctcc

SEQ ID NO: 1016125 - DNA, 20 bp, Homo sapiens
ctgtagctcaagtttaaaag

SEQ ID NO: 1016126 - DNA, 13 bp, Homo sapiens
ctgtagctcagtc

SEQ ID NO: 1016127 - DNA, 22 bp, Homo sapiens
ctgtagctcccctgctgaggca

SEQ ID NO: 1016128 - DNA, 21 bp, Homo sapiens
ctgtagctgcagcctgcatcc

SEQ ID NO: 1016129 - DNA, 12 bp, Homo sapiens
ctgtagctttaa

SEQ ID NO: 1016130 - DNA, 13 bp, Homo sapiens
ctgtagctttaaa

SEQ ID NO: 1016131 - DNA, 21 bp, Homo sapiens
ctgtaggaaggttaatgttca

SEQ ID NO: 1016132 - DNA, 16 bp, Homo sapiens
ctgtaggcacagagct

SEQ ID NO: 1016133 - DNA, 17 bp, Homo sapiens
ctgtaggcagaggctgc

SEQ ID NO: 1016134 - DNA, 13 bp, Homo sapiens
ctgtaggcctcag

SEQ ID NO: 1016135 - DNA, 14 bp, Homo sapiens
ctgtagggaactct

SEQ ID NO: 1016136 - DNA, 18 bp, Homo sapiens
ctgtagggaattcttctg

SEQ ID NO: 1016137 - DNA, 21 bp, Homo sapiens
ctgtagggagggcggcagggg

SEQ ID NO: 1016138 - DNA, 14 bp, Homo sapiens
ctgtagggctggac

SEQ ID NO: 1016139 - DNA, 18 bp, Homo sapiens
ctgtagggctggacctat

SEQ ID NO: 1016140 - DNA, 24 bp, Homo sapiens
ctgtagggtaattagtaacatgtg

SEQ ID NO: 1016141 - DNA, 13 bp, Homo sapiens
ctgtaggtcagga

SEQ ID NO: 1016142 - DNA, 20 bp, Homo sapiens
ctgtaggtcaggaccatcag

SEQ ID NO: 1016143 - DNA, 15 bp, Homo sapiens
ctgtaggtgtctctg

SEQ ID NO: 1016144 - DNA, 18 bp, Homo sapiens
ctgtaggtgtctctgggc

SEQ ID NO: 1016145 - DNA, 19 bp, Homo sapiens
ctgtaggtgtctctgggcc

SEQ ID NO: 1016146 - DNA, 18 bp, Homo sapiens
ctgtagtactccttaaga

SEQ ID NO: 1016147 - DNA, 23 bp, Homo sapiens
ctgtagtactccttaagaacaca

SEQ ID NO: 1016148 - DNA, 22 bp, Homo sapiens
ctgtagtcatcttaaatttcaa

SEQ ID NO: 1016149 - DNA, 17 bp, Homo sapiens
ctgtagtcccagccact

SEQ ID NO: 1016150 - DNA, 18 bp, Homo sapiens
ctgtagtcccagctactt

SEQ ID NO: 1016151 - DNA, 22 bp, Homo sapiens
ctgtagtcctagccactcagga

SEQ ID NO: 1016152 - DNA, 15 bp, Homo sapiens
ctgtagtctcagttc

SEQ ID NO: 1016153 - DNA, 18 bp, Homo sapiens
ctgtagtgagaaactgat

SEQ ID NO: 1016154 - DNA, 23 bp, Homo sapiens
ctgtagtgccagctactcaggag

SEQ ID NO: 1016155 - DNA, 22 bp, Homo sapiens
ctgtagttaggaaataaaacct

SEQ ID NO: 1016156 - DNA, 19 bp, Homo sapiens
ctgtagtttagttctgttg

SEQ ID NO: 1016157 - DNA, 23 bp, Homo sapiens
ctgtagtttatggcagaagggaa

SEQ ID NO: 1016158 - DNA, 19 bp, Homo sapiens
ctgtagttttccctgcact

SEQ ID NO: 1016159 - DNA, 20 bp, Homo sapiens
ctgtagttttccctgcactg

SEQ ID NO: 1016160 - DNA, 24 bp, Homo sapiens
ctgtagttttgagtgtatacatgt

SEQ ID NO: 1016161 - DNA, 18 bp, Homo sapiens
ctgtagtttttaattaaa

SEQ ID NO: 1016162 - DNA, 15 bp, Homo sapiens
ctgtataaataagag

SEQ ID NO: 1016163 - DNA, 14 bp, Homo sapiens
ctgtataagcactg

SEQ ID NO: 1016164 - DNA, 15 bp, Homo sapiens
ctgtataagtaagaa

SEQ ID NO: 1016165 - DNA, 17 bp, Homo sapiens
ctgtataagtaagaaaa

SEQ ID NO: 1016166 - DNA, 18 bp, Homo sapiens
ctgtataagtaagaaaat

SEQ ID NO: 1016167 - DNA, 21 bp, Homo sapiens
ctgtataagtaagaaaatatt

SEQ ID NO: 1016168 - DNA, 21 bp, Homo sapiens
ctgtataagtggaggcacttt

SEQ ID NO: 1016169 - DNA, 21 bp, Homo sapiens
ctgtataatactttgtataca

SEQ ID NO: 1016170 - DNA, 19 bp, Homo sapiens
ctgtatacaaccctggcat

SEQ ID NO: 1016171 - DNA, 22 bp, Homo sapiens
ctgtatacagtgcagagccttc

SEQ ID NO: 1016172 - DNA, 20 bp, Homo sapiens
ctgtataggtagatccagat

SEQ ID NO: 1016173 - DNA, 14 bp, Homo sapiens
ctgtatatacattt

SEQ ID NO: 1016174 - DNA, 19 bp, Homo sapiens
ctgtatatgattctctgtg

SEQ ID NO: 1016175 - DNA, 20 bp, Homo sapiens
ctgtatatgattctctgtgg

SEQ ID NO: 1016176 - DNA, 14 bp, Homo sapiens
ctgtatatgttgta

SEQ ID NO: 1016177 - DNA, 16 bp, Homo sapiens
ctgtatatgttgtaat

SEQ ID NO: 1016178 - DNA, 13 bp, Homo sapiens
ctgtatattgcta

SEQ ID NO: 1016179 - DNA, 12 bp, Homo sapiens
ctgtatatttgt

SEQ ID NO: 1016180 - DNA, 16 bp, Homo sapiens
ctgtatatttgtatga

SEQ ID NO: 1016181 - DNA, 21 bp, Homo sapiens
ctgtatatttgtatgatattt

SEQ ID NO: 1016182 - DNA, 22 bp, Homo sapiens
ctgtatatttgtgatagcactt

SEQ ID NO: 1016183 - DNA, 23 bp, Homo sapiens
ctgtatcatcagtgcctctttga

SEQ ID NO: 1016184 - DNA, 14 bp, Homo sapiens
ctgtatctattttt

SEQ ID NO: 1016185 - DNA, 20 bp, Homo sapiens
ctgtatctgtaattaatatt

SEQ ID NO: 1016186 - DNA, 17 bp, Homo sapiens
ctgtatctgtagtgaga

SEQ ID NO: 1016187 - DNA, 14 bp, Homo sapiens
ctgtatctgtgtag

SEQ ID NO: 1016188 - DNA, 19 bp, Homo sapiens
ctgtatcttgatgtttaga

SEQ ID NO: 1016189 - DNA, 13 bp, Homo sapiens
ctgtatgatttgt

SEQ ID NO: 1016190 - DNA, 16 bp, Homo sapiens
ctgtatggcatgacaa

SEQ ID NO: 1016191 - DNA, 17 bp, Homo sapiens
ctgtatggcccaggcag

SEQ ID NO: 1016192 - DNA, 20 bp, Homo sapiens
ctgtatggcccaggcagcct

SEQ ID NO: 1016193 - DNA, 18 bp, Homo sapiens
ctgtatgggagcttaact

SEQ ID NO: 1016194 - DNA, 12 bp, Homo sapiens
ctgtatgtcaga

SEQ ID NO: 1016195 - DNA, 16 bp, Homo sapiens
ctgtatgtggtgtggg

SEQ ID NO: 1016196 - DNA, 18 bp, Homo sapiens
ctgtatgttatagaactt

SEQ ID NO: 1016197 - DNA, 19 bp, Homo sapiens
ctgtatgttatagaacttc

SEQ ID NO: 1016198 - DNA, 18 bp, Homo sapiens
ctgtatgttgtccaattg

SEQ ID NO: 1016199 - DNA, 20 bp, Homo sapiens
ctgtattactgaataatatc

SEQ ID NO: 1016200 - DNA, 22 bp, Homo sapiens
ctgtattataataagcaaaaag

SEQ ID NO: 1016201 - DNA, 17 bp, Homo sapiens
ctgtattctagtggctg

SEQ ID NO: 1016202 - DNA, 21 bp, Homo sapiens
ctgtattctagtggctgttca

SEQ ID NO: 1016203 - DNA, 13 bp, Homo sapiens
ctgtattctcaaa

SEQ ID NO: 1016204 - DNA, 18 bp, Homo sapiens
ctgtattctcaaacacag

SEQ ID NO: 1016205 - DNA, 21 bp, Homo sapiens
ctgtattctcaaacacagtta

SEQ ID NO: 1016206 - DNA, 17 bp, Homo sapiens
ctgtattcttgtttgaa

SEQ ID NO: 1016207 - DNA, 15 bp, Homo sapiens
ctgtattgcccccat

SEQ ID NO: 1016208 - DNA, 14 bp, Homo sapiens
ctgtattgtctgaa

SEQ ID NO: 1016209 - DNA, 17 bp, Homo sapiens
ctgtatttatgtgtgag

SEQ ID NO: 1016210 - DNA, 17 bp, Homo sapiens
catcccggaggaaatct

SEQ ID NO: 1016211 - DNA, 18 bp, Homo sapiens
catcccggaggaaatctg

SEQ ID NO: 1016212 - DNA, 19 bp, Homo sapiens
catcccggaggaaatctgc

SEQ ID NO: 1016213 - DNA, 14 bp, Homo sapiens
catcccggcctctt

SEQ ID NO: 1016214 - DNA, 18 bp, Homo sapiens
catcccggcctcttccac

SEQ ID NO: 1016215 - DNA, 21 bp, Homo sapiens
catcccggcctcttccaccca

SEQ ID NO: 1016216 - DNA, 18 bp, Homo sapiens
catcccgtatcacagtgt

SEQ ID NO: 1016217 - DNA, 17 bp, Homo sapiens
catcccgtgttctcctt

SEQ ID NO: 1016218 - DNA, 14 bp, Homo sapiens
catccctccccagt

SEQ ID NO: 1016219 - DNA, 18 bp, Homo sapiens
catccctcccccagcaga

SEQ ID NO: 1016220 - DNA, 14 bp, Homo sapiens
catccctcctgctt

SEQ ID NO: 1016221 - DNA, 16 bp, Homo sapiens
catccctccttaagag

SEQ ID NO: 1016222 - DNA, 19 bp, Homo sapiens
catccctccttgcctagca

SEQ ID NO: 1016223 - DNA, 19 bp, Homo sapiens
catccctcggaagccgtct

SEQ ID NO: 1016224 - DNA, 23 bp, Homo sapiens
catccctgagacagggagggaag

SEQ ID NO: 1016225 - DNA, 13 bp, Homo sapiens
catccctgctctg

SEQ ID NO: 1016226 - DNA, 13 bp, Homo sapiens
catccctggagca

SEQ ID NO: 1016227 - DNA, 19 bp, Homo sapiens
catccctggagcaggagcc

SEQ ID NO: 1016228 - DNA, 15 bp, Homo sapiens
catccctgggcaagt

SEQ ID NO: 1016229 - DNA, 24 bp, Homo sapiens
catccctgggcccctccacgcctc

SEQ ID NO: 1016230 - DNA, 13 bp, Homo sapiens
catccctgtcatt

SEQ ID NO: 1016231 - DNA, 15 bp, Homo sapiens
catcccttcctggaa

SEQ ID NO: 1016232 - DNA, 19 bp, Homo sapiens
catcccttcctggaaacag

SEQ ID NO: 1016233 - DNA, 19 bp, Homo sapiens
catcccttcggagccaaca

SEQ ID NO: 1016234 - DNA, 16 bp, Homo sapiens
catcccttggggaagg

SEQ ID NO: 1016235 - DNA, 16 bp, Homo sapiens
catccctttctcccag

SEQ ID NO: 1016236 - DNA, 18 bp, Homo sapiens
catcccttttcctttctg

SEQ ID NO: 1016237 - DNA, 14 bp, Homo sapiens
catccgactgcccc

SEQ ID NO: 1016238 - DNA, 16 bp, Homo sapiens
catccgaggcagggtc

SEQ ID NO: 1016239 - DNA, 20 bp, Homo sapiens
catccgcagactgcttggcc

SEQ ID NO: 1016240 - DNA, 21 bp, Homo sapiens
catccggtcccctgcctggaa

SEQ ID NO: 1016241 - DNA, 17 bp, Homo sapiens
catccgtagttccctga

SEQ ID NO: 1016242 - DNA, 19 bp, Homo sapiens
catcctaaaagccacccca

SEQ ID NO: 1016243 - DNA, 15 bp, Homo sapiens
catcctaccaatgca

SEQ ID NO: 1016244 - DNA, 14 bp, Homo sapiens
catcctacccagcg

SEQ ID NO: 1016245 - DNA, 23 bp, Homo sapiens
catcctaccctcgggcccacctg

SEQ ID NO: 1016246 - DNA, 11 bp, Homo sapiens
catcctataag

SEQ ID NO: 1016247 - DNA, 14 bp, Homo sapiens
catcctatgcttaa

SEQ ID NO: 1016248 - DNA, 15 bp, Homo sapiens
catcctatgcttaat

SEQ ID NO: 1016249 - DNA, 17 bp, Homo sapiens
catcctatgcttaataa

SEQ ID NO: 1016250 - DNA, 22 bp, Homo sapiens
catcctatgcttaataaaagaa

SEQ ID NO: 1016251 - DNA, 21 bp, Homo sapiens
catcctcaaacgacagaggag

SEQ ID NO: 1016252 - DNA, 22 bp, Homo sapiens
catcctcagaggctgagccctg

SEQ ID NO: 1016253 - DNA, 13 bp, Homo sapiens
catcctcatccct

SEQ ID NO: 1016254 - DNA, 20 bp, Homo sapiens
catcctccacgttctgctca

SEQ ID NO: 1016255 - DNA, 14 bp, Homo sapiens
catcctccagccct

SEQ ID NO: 1016256 - DNA, 13 bp, Homo sapiens
catcctccagctt

SEQ ID NO: 1016257 - DNA, 14 bp, Homo sapiens
catcctccagcttc

SEQ ID NO: 1016258 - DNA, 13 bp, Homo sapiens
catcctcccaagg

SEQ ID NO: 1016259 - DNA, 15 bp, Homo sapiens
catcctccccttccc

SEQ ID NO: 1016260 - DNA, 16 bp, Homo sapiens
catcctccccttccct

SEQ ID NO: 1016261 - DNA, 13 bp, Homo sapiens
catcctccctcca

SEQ ID NO: 1016262 - DNA, 20 bp, Homo sapiens
catcctccctccacctcaag

SEQ ID NO: 1016263 - DNA, 21 bp, Homo sapiens
catcctccctccacctcaaga

SEQ ID NO: 1016264 - DNA, 23 bp, Homo sapiens
catcctccctcccccagccacca

SEQ ID NO: 1016265 - DNA, 19 bp, Homo sapiens
catcctcccttgccccagg

SEQ ID NO: 1016266 - DNA, 21 bp, Homo sapiens
catcctcccttgccccaggcc

SEQ ID NO: 1016267 - DNA, 17 bp, Homo sapiens
catcctcctcagccccc

SEQ ID NO: 1016268 - DNA, 20 bp, Homo sapiens
catcctcctcccacccggct

SEQ ID NO: 1016269 - DNA, 13 bp, Homo sapiens
catcctcctgccc

SEQ ID NO: 1016270 - DNA, 16 bp, Homo sapiens
catcctcctgcccagc

SEQ ID NO: 1016271 - DNA, 14 bp, Homo sapiens
catcctcctggaac

SEQ ID NO: 1016272 - DNA, 16 bp, Homo sapiens
catcctcctggaacct

SEQ ID NO: 1016273 - DNA, 20 bp, Homo sapiens
catcctctaaagcagaggca

SEQ ID NO: 1016274 - DNA, 13 bp, Homo sapiens
catcctctccagg

SEQ ID NO: 1016275 - DNA, 14 bp, Homo sapiens
catcctctccagga

SEQ ID NO: 1016276 - DNA, 15 bp, Homo sapiens
catcctcttctgctt

SEQ ID NO: 1016277 - DNA, 14 bp, Homo sapiens
catcctcttttaat

SEQ ID NO: 1016278 - DNA, 23 bp, Homo sapiens
catcctcttttaatggcatttct

SEQ ID NO: 1016279 - DNA, 17 bp, Homo sapiens
catcctgaatctgatct

SEQ ID NO: 1016280 - DNA, 19 bp, Homo sapiens
catcctgaatctgatcttt

SEQ ID NO: 1016281 - DNA, 12 bp, Homo sapiens
catcctgaccaa

SEQ ID NO: 1016282 - DNA, 13 bp, Homo sapiens
catcctgacctgc

SEQ ID NO: 1016283 - DNA, 21 bp, Homo sapiens
catcctgagccccgccctctt

SEQ ID NO: 1016284 - DNA, 15 bp, Homo sapiens
catcctgaggccagt

SEQ ID NO: 1016285 - DNA, 16 bp, Homo sapiens
catcctgaggccagtg

SEQ ID NO: 1016286 - DNA, 17 bp, Homo sapiens
catcctgaggccagtgg

SEQ ID NO: 1016287 - DNA, 15 bp, Homo sapiens
catcctgatcccaga

SEQ ID NO: 1016288 - DNA, 17 bp, Homo sapiens
catcctgatcccagacc

SEQ ID NO: 1016289 - DNA, 19 bp, Homo sapiens
catcctgatggacctgccc

SEQ ID NO: 1016290 - DNA, 14 bp, Homo sapiens
catcctgcaaggtg

SEQ ID NO: 1016291 - DNA, 16 bp, Homo sapiens
catcctgccctgcagc

SEQ ID NO: 1016292 - DNA, 10 bp, Homo sapiens
catcctggat

SEQ ID NO: 1016293 - DNA, 19 bp, Homo sapiens
catcctggcccctccagac

SEQ ID NO: 1016294 - DNA, 16 bp, Homo sapiens
catcctggcctccttt

SEQ ID NO: 1016295 - DNA, 21 bp, Homo sapiens
catcctggcctggcacatcag

SEQ ID NO: 1016296 - DNA, 23 bp, Homo sapiens
catcctggcctggcacatcagaa

SEQ ID NO: 1016297 - DNA, 15 bp, Homo sapiens
catcctgtgtcccct

SEQ ID NO: 1016298 - DNA, 20 bp, Homo sapiens
catcctgtttgtatgaaatt

SEQ ID NO: 1016299 - DNA, 11 bp, Homo sapiens
catccttaaag

SEQ ID NO: 1016300 - DNA, 23 bp, Homo sapiens
catccttcaagaactctgggctg

SEQ ID NO: 1016301 - DNA, 20 bp, Homo sapiens
catccttcaaggtggcagct

SEQ ID NO: 1016302 - DNA, 21 bp, Homo sapiens
catccttccccaacttcccta

SEQ ID NO: 1016303 - DNA, 17 bp, Homo sapiens
catccttccttcccacc

SEQ ID NO: 1016304 - DNA, 15 bp, Homo sapiens
catccttgcctgtct

SEQ ID NO: 1016305 - DNA, 13 bp, Homo sapiens
catccttgtcttt

SEQ ID NO: 1016306 - DNA, 15 bp, Homo sapiens
catcctttacgtgtt

SEQ ID NO: 1016307 - DNA, 21 bp, Homo sapiens
catcctttagggttctgcctc

SEQ ID NO: 1016308 - DNA, 22 bp, Homo sapiens
catcctttagggttctgcctct

SEQ ID NO: 1016309 - DNA, 16 bp, Homo sapiens
catcctttccctctcc

SEQ ID NO: 1016310 - DNA, 18 bp, Homo sapiens
catcctttccctctccca

SEQ ID NO: 1016311 - DNA, 23 bp, Homo sapiens
catcctttcctctagcttttcta

SEQ ID NO: 1016312 - DNA, 15 bp, Homo sapiens
catcctttgttctga

SEQ ID NO: 1016313 - DNA, 19 bp, Homo sapiens
catcctttgttctgagcat

SEQ ID NO: 1016314 - DNA, 15 bp, Homo sapiens
catccttttttctct

SEQ ID NO: 1016315 - DNA, 15 bp, Homo sapiens
catcgaagtcttccc

SEQ ID NO: 1016316 - DNA, 14 bp, Homo sapiens
catcgatatgtata

SEQ ID NO: 1016317 - DNA, 20 bp, Homo sapiens
catcgcaatagttttttact

SEQ ID NO: 1016318 - DNA, 13 bp, Homo sapiens
catcgcactgtgg

SEQ ID NO: 1016319 - DNA, 18 bp, Homo sapiens
ctggtggttgatggtttt

SEQ ID NO: 1016320 - DNA, 20 bp, Homo sapiens
ctggtggtttgatcatttct

SEQ ID NO: 1016321 - DNA, 18 bp, Homo sapiens
ctggtggtttttcagctc

SEQ ID NO: 1016322 - DNA, 20 bp, Homo sapiens
ctggtgtcagcccctcttcc

SEQ ID NO: 1016323 - DNA, 15 bp, Homo sapiens
ctggtgtcaggcagg

SEQ ID NO: 1016324 - DNA, 16 bp, Homo sapiens
ctggtgtcataaactt

SEQ ID NO: 1016325 - DNA, 20 bp, Homo sapiens
ctggtgtcatggtgaccacc

SEQ ID NO: 1016326 - DNA, 14 bp, Homo sapiens
ctggtgtccagctg

SEQ ID NO: 1016327 - DNA, 12 bp, Homo sapiens
ctggtgtcccct

SEQ ID NO: 1016328 - DNA, 17 bp, Homo sapiens
ctggtgtccccttcccc

SEQ ID NO: 1016329 - DNA, 20 bp, Homo sapiens
ctggtgtccccttcccctgc

SEQ ID NO: 1016330 - DNA, 19 bp, Homo sapiens
ctggtgtcctgaccaccct

SEQ ID NO: 1016331 - DNA, 20 bp, Homo sapiens
ctggtgtcctgaccaccctc

SEQ ID NO: 1016332 - DNA, 21 bp, Homo sapiens
ctggtgtgggtaaagggacag

SEQ ID NO: 1016333 - DNA, 14 bp, Homo sapiens
ctggtgtgtggtga

SEQ ID NO: 1016334 - DNA, 20 bp, Homo sapiens
ctggtgtgtggtgaggggct

SEQ ID NO: 1016335 - DNA, 14 bp, Homo sapiens
ctggtgttctgaag

SEQ ID NO: 1016336 - DNA, 22 bp, Homo sapiens
ctggttaaatagtatgggaaaa

SEQ ID NO: 1016337 - DNA, 16 bp, Homo sapiens
ctggttaagcaggcat

SEQ ID NO: 1016338 - DNA, 17 bp, Homo sapiens
ctggttacctgttccat

SEQ ID NO: 1016339 - DNA, 13 bp, Homo sapiens
ctggttagtgtga

SEQ ID NO: 1016340 - DNA, 17 bp, Homo sapiens
ctggttatttttctctt

SEQ ID NO: 1016341 - DNA, 20 bp, Homo sapiens
ctggttcacactgaccaaga

SEQ ID NO: 1016342 - DNA, 13 bp, Homo sapiens
ctggttccagggt

SEQ ID NO: 1016343 - DNA, 16 bp, Homo sapiens
ctggttccagggtccc

SEQ ID NO: 1016344 - DNA, 18 bp, Homo sapiens
ctggttccagggtccctc

SEQ ID NO: 1016345 - DNA, 16 bp, Homo sapiens
ctggttcccactgagg

SEQ ID NO: 1016346 - DNA, 21 bp, Homo sapiens
ctggttcccgtttctccacct

SEQ ID NO: 1016347 - DNA, 19 bp, Homo sapiens
ctggttccttcctatgccc

SEQ ID NO: 1016348 - DNA, 16 bp, Homo sapiens
ctggttcctttcatct

SEQ ID NO: 1016349 - DNA, 17 bp, Homo sapiens
ctggttctatttaatgg

SEQ ID NO: 1016350 - DNA, 18 bp, Homo sapiens
ctggttctatttaatgga

SEQ ID NO: 1016351 - DNA, 14 bp, Homo sapiens
ctggttctgtgtcc

SEQ ID NO: 1016352 - DNA, 23 bp, Homo sapiens
ctggttcttgcaaatgggagctg

SEQ ID NO: 1016353 - DNA, 15 bp, Homo sapiens
ctggttgactttcta

SEQ ID NO: 1016354 - DNA, 12 bp, Homo sapiens
ctggttgatttg

SEQ ID NO: 1016355 - DNA, 13 bp, Homo sapiens
ctggttgtcattt

SEQ ID NO: 1016356 - DNA, 20 bp, Homo sapiens
ctggttgtctagtcattgtc

SEQ ID NO: 1016357 - DNA, 22 bp, Homo sapiens
ctggttgttgcaccatctgctt

SEQ ID NO: 1016358 - DNA, 22 bp, Homo sapiens
ctggttgttgtagtaagagctt

SEQ ID NO: 1016359 - DNA, 14 bp, Homo sapiens
ctggtttaatgttt

SEQ ID NO: 1016360 - DNA, 21 bp, Homo sapiens
ctggtttacaggccctgctcc

SEQ ID NO: 1016361 - DNA, 19 bp, Homo sapiens
ctggtttacttctttagca

SEQ ID NO: 1016362 - DNA, 14 bp, Homo sapiens
ctggtttcaccagc

SEQ ID NO: 1016363 - DNA, 14 bp, Homo sapiens
ctggtttctgttct

SEQ ID NO: 1016364 - DNA, 21 bp, Homo sapiens
ctggtttgaaagatgcagtgg

SEQ ID NO: 1016365 - DNA, 16 bp, Homo sapiens
ctggtttgaaagatta

SEQ ID NO: 1016366 - DNA, 19 bp, Homo sapiens
ctggtttgcaaagaccacc

SEQ ID NO: 1016367 - DNA, 23 bp, Homo sapiens
ctggtttgtttgcttaatttcct

SEQ ID NO: 1016368 - DNA, 18 bp, Homo sapiens
ctggttttcctaaatgca

SEQ ID NO: 1016369 - DNA, 21 bp, Homo sapiens
ctggttttctagcccctctgg

SEQ ID NO: 1016370 - DNA, 15 bp, Homo sapiens
ctggttttgtaagat

SEQ ID NO: 1016371 - DNA, 14 bp, Homo sapiens
ctggtttttcagtt

SEQ ID NO: 1016372 - DNA, 15 bp, Homo sapiens
ctggtttttcagttt

SEQ ID NO: 1016373 - DNA, 15 bp, Homo sapiens
ctggtttttgtagcc

SEQ ID NO: 1016374 - DNA, 13 bp, Homo sapiens
ctgtaaaaaatgg

SEQ ID NO: 1016375 - DNA, 15 bp, Homo sapiens
ctgtaaaaatgttac

SEQ ID NO: 1016376 - DNA, 19 bp, Homo sapiens
ctgtaaaagagcctagttt

SEQ ID NO: 1016377 - DNA, 14 bp, Homo sapiens
ctgtaaaagttata

SEQ ID NO: 1016378 - DNA, 15 bp, Homo sapiens
ctgtaaaatgaaatt

SEQ ID NO: 1016379 - DNA, 22 bp, Homo sapiens
ctgtaaaatgcatgattttgta

SEQ ID NO: 1016380 - DNA, 14 bp, Homo sapiens
ctgtaaaatttgtg

SEQ ID NO: 1016381 - DNA, 20 bp, Homo sapiens
ctgtaaacctctcgagggca

SEQ ID NO: 1016382 - DNA, 22 bp, Homo sapiens
ctgtaaactcaaaacttaacat

SEQ ID NO: 1016383 - DNA, 20 bp, Homo sapiens
ctgtaaactgtgtattccaa

SEQ ID NO: 1016384 - DNA, 18 bp, Homo sapiens
ctgtaaactttatcactt

SEQ ID NO: 1016385 - DNA, 12 bp, Homo sapiens
ctgtaaagaatt

SEQ ID NO: 1016386 - DNA, 16 bp, Homo sapiens
ctgtaaagacaaataa

SEQ ID NO: 1016387 - DNA, 12 bp, Homo sapiens
ctgtaaagatgt

SEQ ID NO: 1016388 - DNA, 21 bp, Homo sapiens
ctgtaaagatgtttatttcag

SEQ ID NO: 1016389 - DNA, 16 bp, Homo sapiens
ctgtaaagatttgttg

SEQ ID NO: 1016390 - DNA, 12 bp, Homo sapiens
ctgtaaagcaaa

SEQ ID NO: 1016391 - DNA, 23 bp, Homo sapiens
ctgtaaataaaatgtgtacagtg

SEQ ID NO: 1016392 - DNA, 15 bp, Homo sapiens
ctgtaaatatcccag

SEQ ID NO: 1016393 - DNA, 14 bp, Homo sapiens
ctgtaaatatccct

SEQ ID NO: 1016394 - DNA, 18 bp, Homo sapiens
ctgtaaatatgtttgtgc

SEQ ID NO: 1016395 - DNA, 20 bp, Homo sapiens
ctgtaaatcctagacttgaa

SEQ ID NO: 1016396 - DNA, 20 bp, Homo sapiens
ctgtaaatctaacattatta

SEQ ID NO: 1016397 - DNA, 17 bp, Homo sapiens
ctgtaaatggtgtacat

SEQ ID NO: 1016398 - DNA, 17 bp, Homo sapiens
ctgtaaattgcagaatt

SEQ ID NO: 1016399 - DNA, 22 bp, Homo sapiens
ctgtaacacaagccacagaagc

SEQ ID NO: 1016400 - DNA, 16 bp, Homo sapiens
ctgtaacactttacaa

SEQ ID NO: 1016401 - DNA, 18 bp, Homo sapiens
ctgtaacctcaaactctg

SEQ ID NO: 1016402 - DNA, 15 bp, Homo sapiens
ctgtaactacaatga

SEQ ID NO: 1016403 - DNA, 19 bp, Homo sapiens
ctgtaactcagacattcca

SEQ ID NO: 1016404 - DNA, 15 bp, Homo sapiens
ctgtaactctaaaag

SEQ ID NO: 1016405 - DNA, 14 bp, Homo sapiens
ctgtaactgagaga

SEQ ID NO: 1016406 - DNA, 15 bp, Homo sapiens
ctgtaactgcccagc

SEQ ID NO: 1016407 - DNA, 17 bp, Homo sapiens
ctgtaactgcccagccc

SEQ ID NO: 1016408 - DNA, 20 bp, Homo sapiens
ctgtaactgcccagcccctt

SEQ ID NO: 1016409 - DNA, 13 bp, Homo sapiens
ctgtaactgctca

SEQ ID NO: 1016410 - DNA, 16 bp, Homo sapiens
ctgtaactgctgagcc

SEQ ID NO: 1016411 - DNA, 20 bp, Homo sapiens
ctgtaactgctgagccactc

SEQ ID NO: 1016412 - DNA, 16 bp, Homo sapiens
ctgtaacttccaaata

SEQ ID NO: 1016413 - DNA, 20 bp, Homo sapiens
ctgtaacttccaaataaata

SEQ ID NO: 1016414 - DNA, 21 bp, Homo sapiens
ctgtaacttttttaaattaag

SEQ ID NO: 1016415 - DNA, 19 bp, Homo sapiens
ctgtaactttttttcagtt

SEQ ID NO: 1016416 - DNA, 18 bp, Homo sapiens
ctgtaagaaaaaaaatgt

SEQ ID NO: 1016417 - DNA, 22 bp, Homo sapiens
ctgtaagaagagactgggaaga

SEQ ID NO: 1016418 - DNA, 21 bp, Homo sapiens
ctgtaagactcattccctaga

SEQ ID NO: 1016419 - DNA, 20 bp, Homo sapiens
ctgtaagcattctgagctgg

SEQ ID NO: 1016420 - DNA, 22 bp, Homo sapiens
ctgtaagcattctgagctgggc

SEQ ID NO: 1016421 - DNA, 16 bp, Homo sapiens
ctgtaagggcagtgcc

SEQ ID NO: 1016422 - DNA, 17 bp, Homo sapiens
ctgtaataaagctcttt

SEQ ID NO: 1016423 - DNA, 15 bp, Homo sapiens
ctgtaatattgtaaa

SEQ ID NO: 1016424 - DNA, 16 bp, Homo sapiens
ctgtaatattgtaaat

SEQ ID NO: 1016425 - DNA, 21 bp, Homo sapiens
ctgtaatattgtaaatactgg

SEQ ID NO: 1016426 - DNA, 15 bp, Homo sapiens
ctgtaatatttacaa

SEQ ID NO: 1016427 - DNA, 22 bp, Homo sapiens
ctgtaatatttacaatgtatta

SEQ ID NO: 1016428 - DNA, 20 bp, Homo sapiens
ctgtaatcaatatcccaaca

SEQ ID NO: 1016429 - DNA, 21 bp, Homo sapiens
ctgtaatcagctctcctggct

SEQ ID NO: 1016430 - DNA, 19 bp, Homo sapiens
ctgtaatcagttatgccgt

SEQ ID NO: 1016431 - DNA, 18 bp, Homo sapiens
ctgtaatcatttgtttac

SEQ ID NO: 1016432 - DNA, 20 bp, Homo sapiens
ctgtaatcatttgtttacat

SEQ ID NO: 1016433 - DNA, 13 bp, Homo sapiens
ctgtaatcccagc

SEQ ID NO: 1016434 - DNA, 15 bp, Homo sapiens
ctgtaatcccagcac

SEQ ID NO: 1016435 - DNA, 17 bp, Homo sapiens
ctgtaatcccagcactt

SEQ ID NO: 1016436 - DNA, 20 bp, Homo sapiens
ctgtaatcccagcactttgg

SEQ ID NO: 1016437 - DNA, 19 bp, Homo sapiens
ctgtaatcccagctactca

SEQ ID NO: 1016438 - DNA, 18 bp, Homo sapiens
ctgtaatcccagctactt

SEQ ID NO: 1016439 - DNA, 20 bp, Homo sapiens
ctgtaatcctagcactttgg

SEQ ID NO: 1016440 - DNA, 18 bp, Homo sapiens
ctgtaatggtactgactt

SEQ ID NO: 1016441 - DNA, 21 bp, Homo sapiens
ctgtaatgttaaactctttgg

SEQ ID NO: 1016442 - DNA, 21 bp, Homo sapiens
ctgtaattaaactagtttaag

SEQ ID NO: 1016443 - DNA, 15 bp, Homo sapiens
ctgtaattaatattc

SEQ ID NO: 1016444 - DNA, 17 bp, Homo sapiens
ctgtaattaatattcct

SEQ ID NO: 1016445 - DNA, 14 bp, Homo sapiens
ctgtaattacatat

SEQ ID NO: 1016446 - DNA, 16 bp, Homo sapiens
ctgtaattcctacctc

SEQ ID NO: 1016447 - DNA, 21 bp, Homo sapiens
ctgtaatttcgccttaaactc

SEQ ID NO: 1016448 - DNA, 15 bp, Homo sapiens
ctgtaatttgtgata

SEQ ID NO: 1016449 - DNA, 21 bp, Homo sapiens
ctgtaatttgtgatacaatgc

SEQ ID NO: 1016450 - DNA, 13 bp, Homo sapiens
ctgtaattttata

SEQ ID NO: 1016451 - DNA, 13 bp, Homo sapiens
ctgtacaaagtag

SEQ ID NO: 1016452 - DNA, 16 bp, Homo sapiens
ctgtacaaatataaga

SEQ ID NO: 1016453 - DNA, 19 bp, Homo sapiens
ctgtacaaatataagaata

SEQ ID NO: 1016454 - DNA, 19 bp, Homo sapiens
ctgtacaaatgacactgca

SEQ ID NO: 1016455 - DNA, 13 bp, Homo sapiens
ctgtacacggacc

SEQ ID NO: 1016456 - DNA, 21 bp, Homo sapiens
ctgtacatacattgtataggc

SEQ ID NO: 1016457 - DNA, 18 bp, Homo sapiens
ctgtacatactgcagtgt

SEQ ID NO: 1016458 - DNA, 15 bp, Homo sapiens
ctgtacatactggcc

SEQ ID NO: 1016459 - DNA, 17 bp, Homo sapiens
ctgtacatactggcctc

SEQ ID NO: 1016460 - DNA, 19 bp, Homo sapiens
ctgtacatactggcctctg

SEQ ID NO: 1016461 - DNA, 20 bp, Homo sapiens
ctgtacatactggcctctgt

SEQ ID NO: 1016462 - DNA, 22 bp, Homo sapiens
ctgtacatactggcctctgtga

SEQ ID NO: 1016463 - DNA, 20 bp, Homo sapiens
ctgtacatatttgagactag

SEQ ID NO: 1016464 - DNA, 14 bp, Homo sapiens
ctgtacattgtgag

SEQ ID NO: 1016465 - DNA, 15 bp, Homo sapiens
ctgtacattgtggga

SEQ ID NO: 1016466 - DNA, 23 bp, Homo sapiens
ctgtaccacagacacaatatgta

SEQ ID NO: 1016467 - DNA, 14 bp, Homo sapiens
ctgtaccacatctg

SEQ ID NO: 1016468 - DNA, 15 bp, Homo sapiens
ctgtaccacatctgc

SEQ ID NO: 1016469 - DNA, 12 bp, Homo sapiens
ctgtaccagtta

SEQ ID NO: 1016470 - DNA, 16 bp, Homo sapiens
ctgtaccagttaattt

SEQ ID NO: 1016471 - DNA, 15 bp, Homo sapiens
ctgtacccaccccag

SEQ ID NO: 1016472 - DNA, 18 bp, Homo sapiens
ctgtaccgtcgacaagaa

SEQ ID NO: 1016473 - DNA, 20 bp, Homo sapiens
ctgtaccgtcgacaagaatg

SEQ ID NO: 1016474 - DNA, 23 bp, Homo sapiens
ctgtacctcagtggatcttcaga

SEQ ID NO: 1016475 - DNA, 16 bp, Homo sapiens
cagttcacctgcactt

SEQ ID NO: 1016476 - DNA, 17 bp, Homo sapiens
cagttcagcaccaccct

SEQ ID NO: 1016477 - DNA, 14 bp, Homo sapiens
cagttcataaacaa

SEQ ID NO: 1016478 - DNA, 15 bp, Homo sapiens
cagttcataaacaac

SEQ ID NO: 1016479 - DNA, 15 bp, Homo sapiens
cagttcatatgcaga

SEQ ID NO: 1016480 - DNA, 23 bp, Homo sapiens
cagttcatatgtaccatgtacat

SEQ ID NO: 1016481 - DNA, 19 bp, Homo sapiens
cagttcatcaccatttcct

SEQ ID NO: 1016482 - DNA, 16 bp, Homo sapiens
cagttcatgtttgctt

SEQ ID NO: 1016483 - DNA, 15 bp, Homo sapiens
cagttcattgcactt

SEQ ID NO: 1016484 - DNA, 13 bp, Homo sapiens
cagttccaagaaa

SEQ ID NO: 1016485 - DNA, 15 bp, Homo sapiens
cagttcccagctccc

SEQ ID NO: 1016486 - DNA, 17 bp, Homo sapiens
cagttcccagctccccc

SEQ ID NO: 1016487 - DNA, 17 bp, Homo sapiens
cagttcccccaacctca

SEQ ID NO: 1016488 - DNA, 18 bp, Homo sapiens
cagttcccccagtacctc

SEQ ID NO: 1016489 - DNA, 17 bp, Homo sapiens
cagttcccggagcacag

SEQ ID NO: 1016490 - DNA, 12 bp, Homo sapiens
cagttccctcct

SEQ ID NO: 1016491 - DNA, 14 bp, Homo sapiens
cagttccctcctgc

SEQ ID NO: 1016492 - DNA, 13 bp, Homo sapiens
cagttcccttggc

SEQ ID NO: 1016493 - DNA, 14 bp, Homo sapiens
cagttcccttggcc

SEQ ID NO: 1016494 - DNA, 16 bp, Homo sapiens
cagttcccttggcctc

SEQ ID NO: 1016495 - DNA, 22 bp, Homo sapiens
cagttcctaccgtactccctgc

SEQ ID NO: 1016496 - DNA, 17 bp, Homo sapiens
cagttcctatgacacag

SEQ ID NO: 1016497 - DNA, 14 bp, Homo sapiens
cagttcctcgccct

SEQ ID NO: 1016498 - DNA, 11 bp, Homo sapiens
cagttcctgct

SEQ ID NO: 1016499 - DNA, 13 bp, Homo sapiens
cagttcctgctct

SEQ ID NO: 1016500 - DNA, 20 bp, Homo sapiens
cagttcctgctctctgctca

SEQ ID NO: 1016501 - DNA, 21 bp, Homo sapiens
cagttcctggcccatcaactg

SEQ ID NO: 1016502 - DNA, 19 bp, Homo sapiens
cagttcctgtggctccctc

SEQ ID NO: 1016503 - DNA, 15 bp, Homo sapiens
cagttcctttgtgtg

SEQ ID NO: 1016504 - DNA, 24 bp, Homo sapiens
cagttcgtgtttgattccattcca

SEQ ID NO: 1016505 - DNA, 15 bp, Homo sapiens
cagttctaacctcct

SEQ ID NO: 1016506 - DNA, 20 bp, Homo sapiens
cagttctacaagcatatttg

SEQ ID NO: 1016507 - DNA, 21 bp, Homo sapiens
cagttctacaagcatatttga

SEQ ID NO: 1016508 - DNA, 17 bp, Homo sapiens
cagttctagtctctctg

SEQ ID NO: 1016509 - DNA, 15 bp, Homo sapiens
cagttctcacaatgt

SEQ ID NO: 1016510 - DNA, 17 bp, Homo sapiens
cagttctcactcctagg

SEQ ID NO: 1016511 - DNA, 20 bp, Homo sapiens
cagttctcactcctaggaga

SEQ ID NO: 1016512 - DNA, 20 bp, Homo sapiens
cagttctcccagggagtgag

SEQ ID NO: 1016513 - DNA, 23 bp, Homo sapiens
cagttctctcccttcctctctcc

SEQ ID NO: 1016514 - DNA, 16 bp, Homo sapiens
cagttctcttgctttc

SEQ ID NO: 1016515 - DNA, 19 bp, Homo sapiens
cagttctgaataacttgaa

SEQ ID NO: 1016516 - DNA, 13 bp, Homo sapiens
cagttctgcaaat

SEQ ID NO: 1016517 - DNA, 20 bp, Homo sapiens
cagttctgctcctctccagg

SEQ ID NO: 1016518 - DNA, 22 bp, Homo sapiens
cagttcttagattcaggggaag

SEQ ID NO: 1016519 - DNA, 15 bp, Homo sapiens
cagttctttcctctt

SEQ ID NO: 1016520 - DNA, 18 bp, Homo sapiens
cagttgaaaaacagctga

SEQ ID NO: 1016521 - DNA, 18 bp, Homo sapiens
cagttgaaaatggatttt

SEQ ID NO: 1016522 - DNA, 19 bp, Homo sapiens
cagttgaacactagtctgt

SEQ ID NO: 1016523 - DNA, 19 bp, Homo sapiens
cagttgaagggaggggctg

SEQ ID NO: 1016524 - DNA, 23 bp, Homo sapiens
cagttgaggtctgcgtcgggctt

SEQ ID NO: 1016525 - DNA, 21 bp, Homo sapiens
cagttgatataaaactctggg

SEQ ID NO: 1016526 - DNA, 23 bp, Homo sapiens
cagttgattatttcaactaatgt

SEQ ID NO: 1016527 - DNA, 23 bp, Homo sapiens
cagttgcaagtctggacaaatgt

SEQ ID NO: 1016528 - DNA, 20 bp, Homo sapiens
cagttgcagcccttgtgatg

SEQ ID NO: 1016529 - DNA, 16 bp, Homo sapiens
cagttgcatgtagtaa

SEQ ID NO: 1016530 - DNA, 18 bp, Homo sapiens
cagttgcatgtagtaaca

SEQ ID NO: 1016531 - DNA, 23 bp, Homo sapiens
cagttgcatgtagtaacactaat

SEQ ID NO: 1016532 - DNA, 22 bp, Homo sapiens
cagttgccaccacctctgtggc

SEQ ID NO: 1016533 - DNA, 17 bp, Homo sapiens
cagttgccctagcccag

SEQ ID NO: 1016534 - DNA, 13 bp, Homo sapiens
cagttgcctttta

SEQ ID NO: 1016535 - DNA, 17 bp, Homo sapiens
cagttgctcaaaaagaa

SEQ ID NO: 1016536 - DNA, 20 bp, Homo sapiens
cagttgctctgacgtagaaa

SEQ ID NO: 1016537 - DNA, 14 bp, Homo sapiens
cagttgctgtggac

SEQ ID NO: 1016538 - DNA, 15 bp, Homo sapiens
cagttgctgttctta

SEQ ID NO: 1016539 - DNA, 19 bp, Homo sapiens
cagttgcttcttcagctga

SEQ ID NO: 1016540 - DNA, 22 bp, Homo sapiens
cagttggcagagaaggcctctt

SEQ ID NO: 1016541 - DNA, 17 bp, Homo sapiens
cagttggccagagagcc

SEQ ID NO: 1016542 - DNA, 22 bp, Homo sapiens
cagttgggacccaaaacacagg

SEQ ID NO: 1016543 - DNA, 15 bp, Homo sapiens
cagttgggagcactg

SEQ ID NO: 1016544 - DNA, 16 bp, Homo sapiens
cagttggggccctctt

SEQ ID NO: 1016545 - DNA, 17 bp, Homo sapiens
cagttggggccctcttg

SEQ ID NO: 1016546 - DNA, 21 bp, Homo sapiens
cagttggtgactgggaaagtt

SEQ ID NO: 1016547 - DNA, 21 bp, Homo sapiens
cagttgtagggttacagagac

SEQ ID NO: 1016548 - DNA, 18 bp, Homo sapiens
cagttgtatttaacagaa

SEQ ID NO: 1016549 - DNA, 15 bp, Homo sapiens
cagttgtcctgattt

SEQ ID NO: 1016550 - DNA, 14 bp, Homo sapiens
cagttgtccttaaa

SEQ ID NO: 1016551 - DNA, 13 bp, Homo sapiens
cagttgtctctga

SEQ ID NO: 1016552 - DNA, 22 bp, Homo sapiens
cagttgtctctgatgcagctta

SEQ ID NO: 1016553 - DNA, 15 bp, Homo sapiens
cagttgttcttttta

SEQ ID NO: 1016554 - DNA, 19 bp, Homo sapiens
cagttgttctttttagaaa

SEQ ID NO: 1016555 - DNA, 14 bp, Homo sapiens
cagttgttggcctc

SEQ ID NO: 1016556 - DNA, 16 bp, Homo sapiens
cagttgtttagatctt

SEQ ID NO: 1016557 - DNA, 21 bp, Homo sapiens
cagttgtttgtttttgcttgt

SEQ ID NO: 1016558 - DNA, 12 bp, Homo sapiens
cagtttaaagca

SEQ ID NO: 1016559 - DNA, 20 bp, Homo sapiens
cagtttaagagcagaacaga

SEQ ID NO: 1016560 - DNA, 20 bp, Homo sapiens
cagtttaagtaattgcctac

SEQ ID NO: 1016561 - DNA, 17 bp, Homo sapiens
cagtttaatattccaat

SEQ ID NO: 1016562 - DNA, 18 bp, Homo sapiens
cagtttaccagttgcctt

SEQ ID NO: 1016563 - DNA, 15 bp, Homo sapiens
cagtttactttgcca

SEQ ID NO: 1016564 - DNA, 11 bp, Homo sapiens
cagtttataca

SEQ ID NO: 1016565 - DNA, 17 bp, Homo sapiens
cagtttatatttaactc

SEQ ID NO: 1016566 - DNA, 13 bp, Homo sapiens
cagtttatcattc

SEQ ID NO: 1016567 - DNA, 21 bp, Homo sapiens
cagtttatcctgacatattca

SEQ ID NO: 1016568 - DNA, 17 bp, Homo sapiens
cagtttattgatattca

SEQ ID NO: 1016569 - DNA, 21 bp, Homo sapiens
cagtttatttccactattttc

SEQ ID NO: 1016570 - DNA, 18 bp, Homo sapiens
cagtttatttttaaagat

SEQ ID NO: 1016571 - DNA, 15 bp, Homo sapiens
cagtttcacagaaaa

SEQ ID NO: 1016572 - DNA, 16 bp, Homo sapiens
cagtttcactccctct

SEQ ID NO: 1016573 - DNA, 22 bp, Homo sapiens
cagtttcagagagtcaatgtca

SEQ ID NO: 1016574 - DNA, 15 bp, Homo sapiens
cagtttcaggtgttt

SEQ ID NO: 1016575 - DNA, 23 bp, Homo sapiens
cagtttcataaaaggagaaccag

SEQ ID NO: 1016576 - DNA, 16 bp, Homo sapiens
cagtttcatcaggacc

SEQ ID NO: 1016577 - DNA, 17 bp, Homo sapiens
cagtttccgaatctctt

SEQ ID NO: 1016578 - DNA, 13 bp, Homo sapiens
cagtttcctctcc

SEQ ID NO: 1016579 - DNA, 16 bp, Homo sapiens
cagtttctccttgaaa

SEQ ID NO: 1016580 - DNA, 21 bp, Homo sapiens
cagtttcttgcttggaagcca

SEQ ID NO: 1016581 - DNA, 18 bp, Homo sapiens
ctggctcatgccccttgg

SEQ ID NO: 1016582 - DNA, 24 bp, Homo sapiens
ctggctccagaggacctgagactc

SEQ ID NO: 1016583 - DNA, 18 bp, Homo sapiens
ctggctccagctggccgg

SEQ ID NO: 1016584 - DNA, 20 bp, Homo sapiens
ctggctccagctggccggga

SEQ ID NO: 1016585 - DNA, 20 bp, Homo sapiens
ctggctcccacctgtttctg

SEQ ID NO: 1016586 - DNA, 13 bp, Homo sapiens
ctggctcccaggg

SEQ ID NO: 1016587 - DNA, 14 bp, Homo sapiens
ctggctcccagggt

SEQ ID NO: 1016588 - DNA, 16 bp, Homo sapiens
ctggctccccacgagt

SEQ ID NO: 1016589 - DNA, 22 bp, Homo sapiens
ctggctccccacgagtcacctg

SEQ ID NO: 1016590 - DNA, 17 bp, Homo sapiens
ctggctccccctcccca

SEQ ID NO: 1016591 - DNA, 19 bp, Homo sapiens
ctggctccccctccccagg

SEQ ID NO: 1016592 - DNA, 13 bp, Homo sapiens
ctggctccctgcc

SEQ ID NO: 1016593 - DNA, 14 bp, Homo sapiens
ctggctccctgccc

SEQ ID NO: 1016594 - DNA, 16 bp, Homo sapiens
ctggctccctgcccct

SEQ ID NO: 1016595 - DNA, 21 bp, Homo sapiens
ctggctccctgccccttaacc

SEQ ID NO: 1016596 - DNA, 12 bp, Homo sapiens
ctggctcctccg

SEQ ID NO: 1016597 - DNA, 15 bp, Homo sapiens
ctgggaacacatctg

SEQ ID NO: 1016598 - DNA, 20 bp, Homo sapiens
ctgggaacacatctggctgc

SEQ ID NO: 1016599 - DNA, 18 bp, Homo sapiens
ctgggaacacttgcattt

SEQ ID NO: 1016600 - DNA, 15 bp, Homo sapiens
ctgggaacaggcccc

SEQ ID NO: 1016601 - DNA, 23 bp, Homo sapiens
ctgggaacatcacattcctctgc

SEQ ID NO: 1016602 - DNA, 16 bp, Homo sapiens
ctgggaacatgaccca

SEQ ID NO: 1016603 - DNA, 18 bp, Homo sapiens
ctgggaacatgacccagc

SEQ ID NO: 1016604 - DNA, 20 bp, Homo sapiens
ctgggaaccactcccaccac

SEQ ID NO: 1016605 - DNA, 17 bp, Homo sapiens
ctgggaaccccgcagcc

SEQ ID NO: 1016606 - DNA, 21 bp, Homo sapiens
ctgggaaccccgcagcccgtg

SEQ ID NO: 1016607 - DNA, 15 bp, Homo sapiens
ctgggaacctcccag

SEQ ID NO: 1016608 - DNA, 22 bp, Homo sapiens
ctgggaacctcccagaggtcca

SEQ ID NO: 1016609 - DNA, 19 bp, Homo sapiens
ctgggaacgtgtgtccagg

SEQ ID NO: 1016610 - DNA, 22 bp, Homo sapiens
ctgggaacgtgtgtccaggctc

SEQ ID NO: 1016611 - DNA, 17 bp, Homo sapiens
ctgggaactcatctggt

SEQ ID NO: 1016612 - DNA, 17 bp, Homo sapiens
ctgggaagaagcaaggg

SEQ ID NO: 1016613 - DNA, 13 bp, Homo sapiens
ctgggaagctccc

SEQ ID NO: 1016614 - DNA, 15 bp, Homo sapiens
ctgggaagctcccac

SEQ ID NO: 1016615 - DNA, 20 bp, Homo sapiens
ctgggaagctcccaccccac

SEQ ID NO: 1016616 - DNA, 20 bp, Homo sapiens
ctgggaagctgtactcagag

SEQ ID NO: 1016617 - DNA, 12 bp, Homo sapiens
ctgggaaggaaa

SEQ ID NO: 1016618 - DNA, 19 bp, Homo sapiens
ctgggaaggaaacaaatgt

SEQ ID NO: 1016619 - DNA, 21 bp, Homo sapiens
ctgggaatggaaggctttgcc

SEQ ID NO: 1016620 - DNA, 14 bp, Homo sapiens
ctgggaatgggaga

SEQ ID NO: 1016621 - DNA, 16 bp, Homo sapiens
ctgggaatgggagagg

SEQ ID NO: 1016622 - DNA, 21 bp, Homo sapiens
ctgggacacaaaactccgccc

SEQ ID NO: 1016623 - DNA, 13 bp, Homo sapiens
ctgggacacacac

SEQ ID NO: 1016624 - DNA, 16 bp, Homo sapiens
ctgggacacagaccca

SEQ ID NO: 1016625 - DNA, 23 bp, Homo sapiens
ctgggacacttaacagatgcaat

SEQ ID NO: 1016626 - DNA, 23 bp, Homo sapiens
ctgggacacttccctgggcctca

SEQ ID NO: 1016627 - DNA, 22 bp, Homo sapiens
ctgggaccacaggttcatgcca

SEQ ID NO: 1016628 - DNA, 19 bp, Homo sapiens
ctgggacccagctactctg

SEQ ID NO: 1016629 - DNA, 20 bp, Homo sapiens
ctgggaccccctcgccagct

SEQ ID NO: 1016630 - DNA, 12 bp, Homo sapiens
ctgggacccctc

SEQ ID NO: 1016631 - DNA, 18 bp, Homo sapiens
ctgggacccttaggatgg

SEQ ID NO: 1016632 - DNA, 15 bp, Homo sapiens
ctgggaccctttcct

SEQ ID NO: 1016633 - DNA, 20 bp, Homo sapiens
ctgggaccgtgcgagctgcc

SEQ ID NO: 1016634 - DNA, 20 bp, Homo sapiens
ctgggacctatacagaacag

SEQ ID NO: 1016635 - DNA, 19 bp, Homo sapiens
ctgggacctgccaggcagg

SEQ ID NO: 1016636 - DNA, 14 bp, Homo sapiens
ctgggacctgtgtt

SEQ ID NO: 1016637 - DNA, 22 bp, Homo sapiens
ctgggacgatcgcccaggctgg

SEQ ID NO: 1016638 - DNA, 19 bp, Homo sapiens
ctgggacggaccagcatct

SEQ ID NO: 1016639 - DNA, 16 bp, Homo sapiens
ctgggacgtggctcag

SEQ ID NO: 1016640 - DNA, 21 bp, Homo sapiens
ctgggacgtggctcagccagc

SEQ ID NO: 1016641 - DNA, 16 bp, Homo sapiens
ctgggactacaggtgc

SEQ ID NO: 1016642 - DNA, 17 bp, Homo sapiens
ctgggactcagccttca

SEQ ID NO: 1016643 - DNA, 13 bp, Homo sapiens
ctgggactcccag

SEQ ID NO: 1016644 - DNA, 16 bp, Homo sapiens
ctgggactctcctcct

SEQ ID NO: 1016645 - DNA, 21 bp, Homo sapiens
ctgggactctcctcctcccct

SEQ ID NO: 1016646 - DNA, 13 bp, Homo sapiens
ctgggactgagcc

SEQ ID NO: 1016647 - DNA, 15 bp, Homo sapiens
ctgggactgagccag

SEQ ID NO: 1016648 - DNA, 15 bp, Homo sapiens
ctgggactggacagc

SEQ ID NO: 1016649 - DNA, 13 bp, Homo sapiens
ctgggactggcca

SEQ ID NO: 1016650 - DNA, 14 bp, Homo sapiens
ctgggacttccatg

SEQ ID NO: 1016651 - DNA, 19 bp, Homo sapiens
ctgggacttccatgcctta

SEQ ID NO: 1016652 - DNA, 17 bp, Homo sapiens
ctgggacttccttgctc

SEQ ID NO: 1016653 - DNA, 21 bp, Homo sapiens
ctgggacttcttacccaaagc

SEQ ID NO: 1016654 - DNA, 22 bp, Homo sapiens
ctgggacttcttacccaaagca

SEQ ID NO: 1016655 - DNA, 17 bp, Homo sapiens
ctgggagaaaatcatca

SEQ ID NO: 1016656 - DNA, 15 bp, Homo sapiens
ctgggagaaagacca

SEQ ID NO: 1016657 - DNA, 12 bp, Homo sapiens
ctgggagaacct

SEQ ID NO: 1016658 - DNA, 13 bp, Homo sapiens
ctgggagacaaag

SEQ ID NO: 1016659 - DNA, 18 bp, Homo sapiens
ctgggagacaactggaca

SEQ ID NO: 1016660 - DNA, 13 bp, Homo sapiens
ctgggagagccag

SEQ ID NO: 1016661 - DNA, 20 bp, Homo sapiens
ctgggagagccagctttgct

SEQ ID NO: 1016662 - DNA, 14 bp, Homo sapiens
ctgggagagcctgg

SEQ ID NO: 1016663 - DNA, 19 bp, Homo sapiens
ctgggagagcctggcaagg

SEQ ID NO: 1016664 - DNA, 23 bp, Homo sapiens
ctgggagagctggtggtgcagcc

SEQ ID NO: 1016665 - DNA, 14 bp, Homo sapiens
ctgggagcagaaca

SEQ ID NO: 1016666 - DNA, 16 bp, Homo sapiens
ctgggagccaggctct

SEQ ID NO: 1016667 - DNA, 12 bp, Homo sapiens
ctgggagccagt

SEQ ID NO: 1016668 - DNA, 13 bp, Homo sapiens
ctgggagccagtg

SEQ ID NO: 1016669 - DNA, 21 bp, Homo sapiens
ctgggagcctcgcccctccag

SEQ ID NO: 1016670 - DNA, 20 bp, Homo sapiens
ctgggagctccactctgctt

SEQ ID NO: 1016671 - DNA, 21 bp, Homo sapiens
ctgggagctccactctgcttc

SEQ ID NO: 1016672 - DNA, 14 bp, Homo sapiens
ctgggagctctgca

SEQ ID NO: 1016673 - DNA, 15 bp, Homo sapiens
ctgggagctctgcag

SEQ ID NO: 1016674 - DNA, 22 bp, Homo sapiens
ctgggaggaaaagaaaagaggg

SEQ ID NO: 1016675 - DNA, 13 bp, Homo sapiens
ctgggaggaagca

SEQ ID NO: 1016676 - DNA, 15 bp, Homo sapiens
ctgggaggaagcagg

SEQ ID NO: 1016677 - DNA, 14 bp, Homo sapiens
ctgggaggaaggac

SEQ ID NO: 1016678 - DNA, 23 bp, Homo sapiens
ctgggaggaagggatgggccccg

SEQ ID NO: 1016679 - DNA, 12 bp, Homo sapiens
ctgggaggacag

SEQ ID NO: 1016680 - DNA, 16 bp, Homo sapiens
ctgggaggacaggcag

SEQ ID NO: 1016681 - DNA, 18 bp, Homo sapiens
ctgggaggacaggcaggc

SEQ ID NO: 1016682 - DNA, 19 bp, Homo sapiens
ctgggaggacaggcaggcc

SEQ ID NO: 1016683 - DNA, 20 bp, Homo sapiens
ctgggaggacaggcaggcca

SEQ ID NO: 1016684 - DNA, 23 bp, Homo sapiens
ctgggaggcagaggttgcagtga

SEQ ID NO: 1016685 - DNA, 19 bp, Homo sapiens
ctgggaggcagggctctcc

SEQ ID NO: 1016686 - DNA, 13 bp, Homo sapiens
ctgggaggcatgg

SEQ ID NO: 1016687 - DNA, 20 bp, Homo sapiens
ctgggaggccctgagacagg

SEQ ID NO: 1016688 - DNA, 11 bp, Homo sapiens
ctgggaggggg

SEQ ID NO: 1016689 - DNA, 19 bp, Homo sapiens
ctgggaggtcaaggctgca

SEQ ID NO: 1016690 - DNA, 19 bp, Homo sapiens
ctgggaggttgggaggctg

SEQ ID NO: 1016691 - DNA, 16 bp, Homo sapiens
ctgggagtagctagtt

SEQ ID NO: 1016692 - DNA, 21 bp, Homo sapiens
ctgggagtagttgtctttcct

SEQ ID NO: 1016693 - DNA, 23 bp, Homo sapiens
ctgggagtagttgtctttcctgg

SEQ ID NO: 1016694 - DNA, 18 bp, Homo sapiens
ctgggagtcagagccctg

SEQ ID NO: 1016695 - DNA, 17 bp, Homo sapiens
ctgggagtccccatccc

SEQ ID NO: 1016696 - DNA, 18 bp, Homo sapiens
ctgggagtccccatccca

SEQ ID NO: 1016697 - DNA, 13 bp, Homo sapiens
ctgggagtcccct

SEQ ID NO: 1016698 - DNA, 17 bp, Homo sapiens
ctgggagtccttacctc

SEQ ID NO: 1016699 - DNA, 22 bp, Homo sapiens
ctgggagtccttacctcgggga

SEQ ID NO: 1016700 - DNA, 19 bp, Homo sapiens
ctgggagtgggtggaggca

SEQ ID NO: 1016701 - DNA, 22 bp, Homo sapiens
ctgggataactggccagccata

SEQ ID NO: 1016702 - DNA, 23 bp, Homo sapiens
ctgggatgacaggtgtgagccac

SEQ ID NO: 1016703 - DNA, 22 bp, Homo sapiens
ctgggatgagccgctgtgagcc

SEQ ID NO: 1016704 - DNA, 22 bp, Homo sapiens
ctgggatgcctcaccacaccca

SEQ ID NO: 1016705 - DNA, 14 bp, Homo sapiens
ctgggatgctgacc

SEQ ID NO: 1016706 - DNA, 21 bp, Homo sapiens
ctgggatgctgacccaggaat

SEQ ID NO: 1016707 - DNA, 22 bp, Homo sapiens
ctgggatgctgacccaggaata

SEQ ID NO: 1016708 - DNA, 20 bp, Homo sapiens
ctgggatggaacctcaggat

SEQ ID NO: 1016709 - DNA, 19 bp, Homo sapiens
ctgggatgggaacactggt

SEQ ID NO: 1016710 - DNA, 15 bp, Homo sapiens
ctgggatgggaccag

SEQ ID NO: 1016711 - DNA, 19 bp, Homo sapiens
cataataaagttgttttat

SEQ ID NO: 1016712 - DNA, 18 bp, Homo sapiens
cataataaatatctgtac

SEQ ID NO: 1016713 - DNA, 23 bp, Homo sapiens
cataataaccctgccagtgccag

SEQ ID NO: 1016714 - DNA, 15 bp, Homo sapiens
cataatcactctaat

SEQ ID NO: 1016715 - DNA, 16 bp, Homo sapiens
cataatcatgtaaatg

SEQ ID NO: 1016716 - DNA, 20 bp, Homo sapiens
cataatcatgtaaatgctca

SEQ ID NO: 1016717 - DNA, 22 bp, Homo sapiens
cataatctagtttacagaaaaa

SEQ ID NO: 1016718 - DNA, 18 bp, Homo sapiens
catacttcaaaaataatg

SEQ ID NO: 1016719 - DNA, 16 bp, Homo sapiens
catacttcaaaaatgt

SEQ ID NO: 1016720 - DNA, 18 bp, Homo sapiens
catacttcatgaaatcct

SEQ ID NO: 1016721 - DNA, 14 bp, Homo sapiens
catacttggctgct

SEQ ID NO: 1016722 - DNA, 12 bp, Homo sapiens
catactttattg

SEQ ID NO: 1016723 - DNA, 18 bp, Homo sapiens
catactttgacaaggaaa

SEQ ID NO: 1016724 - DNA, 14 bp, Homo sapiens
catactttgtaaat

SEQ ID NO: 1016725 - DNA, 11 bp, Homo sapiens
catacttttct

SEQ ID NO: 1016726 - DNA, 12 bp, Homo sapiens
catacttttctt

SEQ ID NO: 1016727 - DNA, 15 bp, Homo sapiens
catacttttggctcc

SEQ ID NO: 1016728 - DNA, 16 bp, Homo sapiens
catacttttggctcct

SEQ ID NO: 1016729 - DNA, 14 bp, Homo sapiens
catactttttaaaa

SEQ ID NO: 1016730 - DNA, 15 bp, Homo sapiens
catactttttaaaaa

SEQ ID NO: 1016731 - DNA, 16 bp, Homo sapiens
catactttttaaatgt

SEQ ID NO: 1016732 - DNA, 20 bp, Homo sapiens
catactttttaaatgtaaag

SEQ ID NO: 1016733 - DNA, 22 bp, Homo sapiens
catactttttaaatgtaaagat

SEQ ID NO: 1016734 - DNA, 23 bp, Homo sapiens
catagaaatggaaattttgctat

SEQ ID NO: 1016735 - DNA, 21 bp, Homo sapiens
catagaaggaagtgtgtttgc

SEQ ID NO: 1016736 - DNA, 23 bp, Homo sapiens
catagaaggaagtgtgtttgcct

SEQ ID NO: 1016737 - DNA, 20 bp, Homo sapiens
catagaagggagggaataaa

SEQ ID NO: 1016738 - DNA, 12 bp, Homo sapiens
catagaagtgtt

SEQ ID NO: 1016739 - DNA, 22 bp, Homo sapiens
catagacatttcaaaattaata

SEQ ID NO: 1016740 - DNA, 21 bp, Homo sapiens
catagaccctgaggccctggg

SEQ ID NO: 1016741 - DNA, 20 bp, Homo sapiens
catagactgaggtataaaga

SEQ ID NO: 1016742 - DNA, 17 bp, Homo sapiens
catagagatttgtctaa

SEQ ID NO: 1016743 - DNA, 16 bp, Homo sapiens
catagagctctatttc

SEQ ID NO: 1016744 - DNA, 13 bp, Homo sapiens
catagagcttttt

SEQ ID NO: 1016745 - DNA, 22 bp, Homo sapiens
catagagctttttaatagcact

SEQ ID NO: 1016746 - DNA, 13 bp, Homo sapiens
catagaggcccag

SEQ ID NO: 1016747 - DNA, 15 bp, Homo sapiens
catagaggcccaggc

SEQ ID NO: 1016748 - DNA, 19 bp, Homo sapiens
catagaggcccaggcacca

SEQ ID NO: 1016749 - DNA, 20 bp, Homo sapiens
catagaggcttctccgccag

SEQ ID NO: 1016750 - DNA, 21 bp, Homo sapiens
catagaggcttctccgccagc

SEQ ID NO: 1016751 - DNA, 17 bp, Homo sapiens
catagaggttttgtatt

SEQ ID NO: 1016752 - DNA, 15 bp, Homo sapiens
catagagtttaacac

SEQ ID NO: 1016753 - DNA, 15 bp, Homo sapiens
catagatcagccatt

SEQ ID NO: 1016754 - DNA, 22 bp, Homo sapiens
catagatcagccattaaaataa

SEQ ID NO: 1016755 - DNA, 13 bp, Homo sapiens
catagatcttctg

SEQ ID NO: 1016756 - DNA, 21 bp, Homo sapiens
catagattcacctgtaaaact

SEQ ID NO: 1016757 - DNA, 20 bp, Homo sapiens
catagatttaagtgaataca

SEQ ID NO: 1016758 - DNA, 15 bp, Homo sapiens
catagatttatttta

SEQ ID NO: 1016759 - DNA, 16 bp, Homo sapiens
catagatttatttttc

SEQ ID NO: 1016760 - DNA, 20 bp, Homo sapiens
catagatttatttttcagtt

SEQ ID NO: 1016761 - DNA, 23 bp, Homo sapiens
catagatttatttttcagttcca

SEQ ID NO: 1016762 - DNA, 21 bp, Homo sapiens
catagatttcttctctttagt

SEQ ID NO: 1016763 - DNA, 14 bp, Homo sapiens
catagcaagacaca

SEQ ID NO: 1016764 - DNA, 23 bp, Homo sapiens
catagcaagattgcttaaaatag

SEQ ID NO: 1016765 - DNA, 23 bp, Homo sapiens
catagcagactttcccaaatgta

SEQ ID NO: 1016766 - DNA, 14 bp, Homo sapiens
catagcagatctgt

SEQ ID NO: 1016767 - DNA, 16 bp, Homo sapiens
catagcagattttaat

SEQ ID NO: 1016768 - DNA, 18 bp, Homo sapiens
catagcagattttaattt

SEQ ID NO: 1016769 - DNA, 22 bp, Homo sapiens
catagcataatatgaagccttt

SEQ ID NO: 1016770 - DNA, 16 bp, Homo sapiens
catagcatagccagca

SEQ ID NO: 1016771 - DNA, 18 bp, Homo sapiens
catagcatgcttcctttc

SEQ ID NO: 1016772 - DNA, 21 bp, Homo sapiens
catagcatgcttcctttctct

SEQ ID NO: 1016773 - DNA, 11 bp, Homo sapiens
catagcattaa

SEQ ID NO: 1016774 - DNA, 11 bp, Homo sapiens
catagcccagt

SEQ ID NO: 1016775 - DNA, 23 bp, Homo sapiens
catagccctggtgctcctgccca

SEQ ID NO: 1016776 - DNA, 18 bp, Homo sapiens
catagcctaatccctggg

SEQ ID NO: 1016777 - DNA, 17 bp, Homo sapiens
catagcctgcctgatcc

SEQ ID NO: 1016778 - DNA, 22 bp, Homo sapiens
catagcgccgtgctgtaaataa

SEQ ID NO: 1016779 - DNA, 14 bp, Homo sapiens
catagcgtcctgcc

SEQ ID NO: 1016780 - DNA, 15 bp, Homo sapiens
catagctaaaggcta

SEQ ID NO: 1016781 - DNA, 17 bp, Homo sapiens
catagctacaatttgtt

SEQ ID NO: 1016782 - DNA, 18 bp, Homo sapiens
catagctacaatttgttt

SEQ ID NO: 1016783 - DNA, 16 bp, Homo sapiens
catagctatcaagtgt

SEQ ID NO: 1016784 - DNA, 12 bp, Homo sapiens
catagctcactg

SEQ ID NO: 1016785 - DNA, 18 bp, Homo sapiens
catagctccttcccagga

SEQ ID NO: 1016786 - DNA, 16 bp, Homo sapiens
catagctccttggagc

SEQ ID NO: 1016787 - DNA, 13 bp, Homo sapiens
catagctctgggg

SEQ ID NO: 1016788 - DNA, 16 bp, Homo sapiens
catagctgtacttctt

SEQ ID NO: 1016789 - DNA, 15 bp, Homo sapiens
catagctgtctagag

SEQ ID NO: 1016790 - DNA, 22 bp, Homo sapiens
catagcttacaagccagctgga

SEQ ID NO: 1016791 - DNA, 12 bp, Homo sapiens
cataggaaaagt

SEQ ID NO: 1016792 - DNA, 23 bp, Homo sapiens
cataggaaaagtacatttaatac

SEQ ID NO: 1016793 - DNA, 17 bp, Homo sapiens
cataggaagacataaaa

SEQ ID NO: 1016794 - DNA, 23 bp, Homo sapiens
cataggaagtggctggtctggag

SEQ ID NO: 1016795 - DNA, 17 bp, Homo sapiens
cataggactaccgcagg

SEQ ID NO: 1016796 - DNA, 19 bp, Homo sapiens
cataggactaccgcaggcc

SEQ ID NO: 1016797 - DNA, 16 bp, Homo sapiens
cataggaggggtctgg

SEQ ID NO: 1016798 - DNA, 19 bp, Homo sapiens
cataggaggggtctggaca

SEQ ID NO: 1016799 - DNA, 13 bp, Homo sapiens
cataggccaaggc

SEQ ID NO: 1016800 - DNA, 14 bp, Homo sapiens
cataggccaaggcc

SEQ ID NO: 1016801 - DNA, 16 bp, Homo sapiens
cataggccaaggtgca

SEQ ID NO: 1016802 - DNA, 22 bp, Homo sapiens
cataggcccaggatatttctga

SEQ ID NO: 1016803 - DNA, 15 bp, Homo sapiens
cataggcctgggtgc

SEQ ID NO: 1016804 - DNA, 18 bp, Homo sapiens
cataggcctgggtgctgg

SEQ ID NO: 1016805 - DNA, 19 bp, Homo sapiens
cataggcctgggtgctggc

SEQ ID NO: 1016806 - DNA, 19 bp, Homo sapiens
cataggcggtcatgtgtgc

SEQ ID NO: 1016807 - DNA, 19 bp, Homo sapiens
cataggctggtggccttgg

SEQ ID NO: 1016808 - DNA, 15 bp, Homo sapiens
cataggcttctatta

SEQ ID NO: 1016809 - DNA, 13 bp, Homo sapiens
cataggggggagg

SEQ ID NO: 1016810 - DNA, 14 bp, Homo sapiens
cataggggggaggg

SEQ ID NO: 1016811 - DNA, 20 bp, Homo sapiens
cataggggggagggtctttt

SEQ ID NO: 1016812 - DNA, 18 bp, Homo sapiens
catagggtcactttgcca

SEQ ID NO: 1016813 - DNA, 19 bp, Homo sapiens
catagggtcactttgccat

SEQ ID NO: 1016814 - DNA, 17 bp, Homo sapiens
catagggtctcttcagg

SEQ ID NO: 1016815 - DNA, 17 bp, Homo sapiens
cataggtagaatgtaaa

SEQ ID NO: 1016816 - DNA, 16 bp, Homo sapiens
cataggtcactggctc

SEQ ID NO: 1016817 - DNA, 18 bp, Homo sapiens
cataggtcactggctctc

SEQ ID NO: 1016818 - DNA, 21 bp, Homo sapiens
cataggtctgaaatttttctt

SEQ ID NO: 1016819 - DNA, 16 bp, Homo sapiens
cataggtctgtatggc

SEQ ID NO: 1016820 - DNA, 22 bp, Homo sapiens
cataggttaaaaaaaaaagtca

SEQ ID NO: 1016821 - DNA, 14 bp, Homo sapiens
cataggtttctctc

SEQ ID NO: 1016822 - DNA, 21 bp, Homo sapiens
catagtaacttcttatggaat

SEQ ID NO: 1016823 - DNA, 23 bp, Homo sapiens
catagtaacttcttatggaattg

SEQ ID NO: 1016824 - DNA, 24 bp, Homo sapiens
catagtaacttcttatggaattga

SEQ ID NO: 1016825 - DNA, 16 bp, Homo sapiens
catagtaccatttata

SEQ ID NO: 1016826 - DNA, 19 bp, Homo sapiens
catagtaccatttatacaa

SEQ ID NO: 1016827 - DNA, 17 bp, Homo sapiens
catagtagtttttacag

SEQ ID NO: 1016828 - DNA, 20 bp, Homo sapiens
catagtgagacccctgtctc

SEQ ID NO: 1016829 - DNA, 21 bp, Homo sapiens
catagtgagacccctgtctcc

SEQ ID NO: 1016830 - DNA, 17 bp, Homo sapiens
catagtgcaaaactgtg

SEQ ID NO: 1016831 - DNA, 14 bp, Homo sapiens
catagtgccttttt

SEQ ID NO: 1016832 - DNA, 18 bp, Homo sapiens
catagtgcctttttcctt

SEQ ID NO: 1016833 - DNA, 17 bp, Homo sapiens
catagtgctgggatgga

SEQ ID NO: 1016834 - DNA, 19 bp, Homo sapiens
catagtggggcctgggagg

SEQ ID NO: 1016835 - DNA, 18 bp, Homo sapiens
catagtgtcaagaaggaa

SEQ ID NO: 1016836 - DNA, 15 bp, Homo sapiens
catagtgtcctgccc

SEQ ID NO: 1016837 - DNA, 18 bp, Homo sapiens
catagtgtcctgcccacc

SEQ ID NO: 1016838 - DNA, 13 bp, Homo sapiens
catagttcagaat

SEQ ID NO: 1016839 - DNA, 21 bp, Homo sapiens
catagttgtagacaaagtaca

SEQ ID NO: 1016840 - DNA, 14 bp, Homo sapiens
ctggggcaggctct

SEQ ID NO: 1016841 - DNA, 16 bp, Homo sapiens
ctggggcaggctgggc

SEQ ID NO: 1016842 - DNA, 21 bp, Homo sapiens
ctggggcaggggcctgggccg

SEQ ID NO: 1016843 - DNA, 20 bp, Homo sapiens
ctggggcatggcaaatcagg

SEQ ID NO: 1016844 - DNA, 18 bp, Homo sapiens
ctggggcatgtgtgcctg

SEQ ID NO: 1016845 - DNA, 21 bp, Homo sapiens
catcaagaggtgggagggccc

SEQ ID NO: 1016846 - DNA, 18 bp, Homo sapiens
catcaagcaggaattatg

SEQ ID NO: 1016847 - DNA, 15 bp, Homo sapiens
catcaagcatgcaat

SEQ ID NO: 1016848 - DNA, 14 bp, Homo sapiens
catcaagcttttct

SEQ ID NO: 1016849 - DNA, 14 bp, Homo sapiens
catcaagtccatct

SEQ ID NO: 1016850 - DNA, 13 bp, Homo sapiens
catcaagtgcagt

SEQ ID NO: 1016851 - DNA, 17 bp, Homo sapiens
catcaagttctccccag

SEQ ID NO: 1016852 - DNA, 19 bp, Homo sapiens
catcaagttgtgccaaatt

SEQ ID NO: 1016853 - DNA, 20 bp, Homo sapiens
catcaatatccctcttgtaa

SEQ ID NO: 1016854 - DNA, 17 bp, Homo sapiens
catcaatcttgttactg

SEQ ID NO: 1016855 - DNA, 19 bp, Homo sapiens
catcaatggggccagtcag

SEQ ID NO: 1016856 - DNA, 11 bp, Homo sapiens
catcacacaca

SEQ ID NO: 1016857 - DNA, 15 bp, Homo sapiens
catcacactcaagga

SEQ ID NO: 1016858 - DNA, 19 bp, Homo sapiens
catcacacttatattttat

SEQ ID NO: 1016859 - DNA, 20 bp, Homo sapiens
catcacacttatattttatg

SEQ ID NO: 1016860 - DNA, 14 bp, Homo sapiens
catcacagcccagc

SEQ ID NO: 1016861 - DNA, 22 bp, Homo sapiens
catcacaggacacggggcagtg

SEQ ID NO: 1016862 - DNA, 21 bp, Homo sapiens
catcacattccagtctgaagt

SEQ ID NO: 1016863 - DNA, 21 bp, Homo sapiens
catcaccaggtgcatctgcag

SEQ ID NO: 1016864 - DNA, 18 bp, Homo sapiens
catcaccatttcctcctt

SEQ ID NO: 1016865 - DNA, 20 bp, Homo sapiens
catcaccccagaggccttgt

SEQ ID NO: 1016866 - DNA, 14 bp, Homo sapiens
catcaccctcaccc

SEQ ID NO: 1016867 - DNA, 17 bp, Homo sapiens
catcaccctcacccact

SEQ ID NO: 1016868 - DNA, 19 bp, Homo sapiens
catcaccgacgcgtctcct

SEQ ID NO: 1016869 - DNA, 22 bp, Homo sapiens
catcaccgacgcgtctcctgtt

SEQ ID NO: 1016870 - DNA, 13 bp, Homo sapiens
catcaccgctggg

SEQ ID NO: 1016871 - DNA, 14 bp, Homo sapiens
catcaccgctgggt

SEQ ID NO: 1016872 - DNA, 22 bp, Homo sapiens
catcaccgtcccgcacagtgga

SEQ ID NO: 1016873 - DNA, 23 bp, Homo sapiens
catcacctcaccaaggatcggac

SEQ ID NO: 1016874 - DNA, 16 bp, Homo sapiens
catcacctctactgtc

SEQ ID NO: 1016875 - DNA, 14 bp, Homo sapiens
catcacctgaaaca

SEQ ID NO: 1016876 - DNA, 18 bp, Homo sapiens
catcacctgaaacactgg

SEQ ID NO: 1016877 - DNA, 22 bp, Homo sapiens
catcacctttttgacttttcca

SEQ ID NO: 1016878 - DNA, 23 bp, Homo sapiens
catcacggatggtgcatgggctc

SEQ ID NO: 1016879 - DNA, 19 bp, Homo sapiens
catcacgtaccccactggg

SEQ ID NO: 1016880 - DNA, 24 bp, Homo sapiens
catcacgtaccccactgggccagc

SEQ ID NO: 1016881 - DNA, 22 bp, Homo sapiens
catcacgtcagtgctcagaaat

SEQ ID NO: 1016882 - DNA, 17 bp, Homo sapiens
catcactagaagaaaag

SEQ ID NO: 1016883 - DNA, 18 bp, Homo sapiens
catcactagagtgctctg

SEQ ID NO: 1016884 - DNA, 17 bp, Homo sapiens
catcactcactcactcc

SEQ ID NO: 1016885 - DNA, 14 bp, Homo sapiens
catcactccctgga

SEQ ID NO: 1016886 - DNA, 17 bp, Homo sapiens
catcactccctggatgt

SEQ ID NO: 1016887 - DNA, 20 bp, Homo sapiens
catcactcgcaggaccaagg

SEQ ID NO: 1016888 - DNA, 13 bp, Homo sapiens
catcactcttgta

SEQ ID NO: 1016889 - DNA, 18 bp, Homo sapiens
catcactgccttggcccc

SEQ ID NO: 1016890 - DNA, 19 bp, Homo sapiens
catcactggactgcatggg

SEQ ID NO: 1016891 - DNA, 18 bp, Homo sapiens
catcactgtaaagacaaa

SEQ ID NO: 1016892 - DNA, 17 bp, Homo sapiens
catcacttctccccgca

SEQ ID NO: 1016893 - DNA, 14 bp, Homo sapiens
catcacttgtacaa

SEQ ID NO: 1016894 - DNA, 15 bp, Homo sapiens
catcacttgtacaaa

SEQ ID NO: 1016895 - DNA, 19 bp, Homo sapiens
catcacttgtacaaaataa

SEQ ID NO: 1016896 - DNA, 15 bp, Homo sapiens
catcacttttcagtg

SEQ ID NO: 1016897 - DNA, 17 bp, Homo sapiens
catcacttttcagtgat

SEQ ID NO: 1016898 - DNA, 15 bp, Homo sapiens
catcagaaagaattg

SEQ ID NO: 1016899 - DNA, 23 bp, Homo sapiens
catcagaaagaattgatcagaat

SEQ ID NO: 1016900 - DNA, 14 bp, Homo sapiens
catcagaaaggaat

SEQ ID NO: 1016901 - DNA, 16 bp, Homo sapiens
catcagaacctgagct

SEQ ID NO: 1016902 - DNA, 13 bp, Homo sapiens
catcagaagataa

SEQ ID NO: 1016903 - DNA, 15 bp, Homo sapiens
catcagacctgtctt

SEQ ID NO: 1016904 - DNA, 19 bp, Homo sapiens
catcagacctgtcttccaa

SEQ ID NO: 1016905 - DNA, 22 bp, Homo sapiens
catcagacctgtcttccaagga

SEQ ID NO: 1016906 - DNA, 14 bp, Homo sapiens
catcagagcagcta

SEQ ID NO: 1016907 - DNA, 17 bp, Homo sapiens
catcagatatgcttact

SEQ ID NO: 1016908 - DNA, 11 bp, Homo sapiens
catcagatgcc

SEQ ID NO: 1016909 - DNA, 15 bp, Homo sapiens
catcagatgcctgct

SEQ ID NO: 1016910 - DNA, 11 bp, Homo sapiens
catcagcaaac

SEQ ID NO: 1016911 - DNA, 19 bp, Homo sapiens
catcagcaagactttataa

SEQ ID NO: 1016912 - DNA, 18 bp, Homo sapiens
catcagcacgatttctgt

SEQ ID NO: 1016913 - DNA, 18 bp, Homo sapiens
catcagcccctgggaaca

SEQ ID NO: 1016914 - DNA, 12 bp, Homo sapiens
catcagcctgct

SEQ ID NO: 1016915 - DNA, 15 bp, Homo sapiens
catcagcgtagtgtt

SEQ ID NO: 1016916 - DNA, 22 bp, Homo sapiens
catcagctcccaacgagcctcc

SEQ ID NO: 1016917 - DNA, 17 bp, Homo sapiens
catcagctgtaagaaga

SEQ ID NO: 1016918 - DNA, 23 bp, Homo sapiens
catcagctgtaagaagagactgg

SEQ ID NO: 1016919 - DNA, 13 bp, Homo sapiens
catcaggatgaac

SEQ ID NO: 1016920 - DNA, 19 bp, Homo sapiens
catcaggatgaacccagga

SEQ ID NO: 1016921 - DNA, 15 bp, Homo sapiens
catcaggcagtgtta

SEQ ID NO: 1016922 - DNA, 15 bp, Homo sapiens
catcaggctctgttc

SEQ ID NO: 1016923 - DNA, 20 bp, Homo sapiens
catcaggctgttattatgaa

SEQ ID NO: 1016924 - DNA, 15 bp, Homo sapiens
catcagggccctgcc

SEQ ID NO: 1016925 - DNA, 19 bp, Homo sapiens
catcagggccctgccccag

SEQ ID NO: 1016926 - DNA, 12 bp, Homo sapiens
catcagggcctg

SEQ ID NO: 1016927 - DNA, 18 bp, Homo sapiens
catcagggcctggggcct

SEQ ID NO: 1016928 - DNA, 20 bp, Homo sapiens
catcagggcctttctcctcc

SEQ ID NO: 1016929 - DNA, 22 bp, Homo sapiens
catcagggcctttctcctcccc

SEQ ID NO: 1016930 - DNA, 14 bp, Homo sapiens
catcagggggaaga

SEQ ID NO: 1016931 - DNA, 19 bp, Homo sapiens
catcaggtcccccccaggt

SEQ ID NO: 1016932 - DNA, 15 bp, Homo sapiens
catcagtcaatggaa

SEQ ID NO: 1016933 - DNA, 17 bp, Homo sapiens
catcagtccctatgtat

SEQ ID NO: 1016934 - DNA, 14 bp, Homo sapiens
catcagtgacagac

SEQ ID NO: 1016935 - DNA, 17 bp, Homo sapiens
catcagtgacagactgg

SEQ ID NO: 1016936 - DNA, 24 bp, Homo sapiens
catcagtgctccctcacatgtcag

SEQ ID NO: 1016937 - DNA, 16 bp, Homo sapiens
catcagtggcatggct

SEQ ID NO: 1016938 - DNA, 18 bp, Homo sapiens
catcagtggcatggctcc

SEQ ID NO: 1016939 - DNA, 22 bp, Homo sapiens
catcagtggcatggctccagtc

SEQ ID NO: 1016940 - DNA, 21 bp, Homo sapiens
catcagttacagagaatttct

SEQ ID NO: 1016941 - DNA, 22 bp, Homo sapiens
catcagttactctgaagggcat

SEQ ID NO: 1016942 - DNA, 20 bp, Homo sapiens
catcataaggagttggtgta

SEQ ID NO: 1016943 - DNA, 19 bp, Homo sapiens
catcataattacattccta

SEQ ID NO: 1016944 - DNA, 22 bp, Homo sapiens
catcataattacattcctaact

SEQ ID NO: 1016945 - DNA, 23 bp, Homo sapiens
catcataggaagggaccaaggca

SEQ ID NO: 1016946 - DNA, 18 bp, Homo sapiens
catcatatgcctgacccc

SEQ ID NO: 1016947 - DNA, 20 bp, Homo sapiens
catcatattgtatgtaagta

SEQ ID NO: 1016948 - DNA, 18 bp, Homo sapiens
catcatcacgacacattt

SEQ ID NO: 1016949 - DNA, 14 bp, Homo sapiens
catcatcactgtaa

SEQ ID NO: 1016950 - DNA, 16 bp, Homo sapiens
catcatcactgtaaag

SEQ ID NO: 1016951 - DNA, 14 bp, Homo sapiens
catcatcagggcct

SEQ ID NO: 1016952 - DNA, 13 bp, Homo sapiens
catcatcccagct

SEQ ID NO: 1016953 - DNA, 21 bp, Homo sapiens
catcatcctttgttctgagca

SEQ ID NO: 1016954 - DNA, 13 bp, Homo sapiens
catcatctgtaga

SEQ ID NO: 1016955 - DNA, 18 bp, Homo sapiens
catcatctgtagatacta

SEQ ID NO: 1016956 - DNA, 14 bp, Homo sapiens
catcatgccttgat

SEQ ID NO: 1016957 - DNA, 21 bp, Homo sapiens
catcatgccttgataaatata

SEQ ID NO: 1016958 - DNA, 21 bp, Homo sapiens
catcatgcttacaaaaaagaa

SEQ ID NO: 1016959 - DNA, 20 bp, Homo sapiens
catcatgcttatgttaaact

SEQ ID NO: 1016960 - DNA, 21 bp, Homo sapiens
catcatggaaagactgggaca

SEQ ID NO: 1016961 - DNA, 19 bp, Homo sapiens
cagaggttatctgcctggc

SEQ ID NO: 1016962 - DNA, 22 bp, Homo sapiens
cagaggttatctgcctggcctg

SEQ ID NO: 1016963 - DNA, 23 bp, Homo sapiens
cagaggttatctgcctggcctgg

SEQ ID NO: 1016964 - DNA, 12 bp, Homo sapiens
ctctcctcctcc

SEQ ID NO: 1016965 - DNA, 13 bp, Homo sapiens
ctctcctctccgc

SEQ ID NO: 1016966 - DNA, 14 bp, Homo sapiens
ctctcctctctgct

SEQ ID NO: 1016967 - DNA, 15 bp, Homo sapiens
ctctcctctctgctt

SEQ ID NO: 1016968 - DNA, 12 bp, Homo sapiens
ctctcctgccca

SEQ ID NO: 1016969 - DNA, 19 bp, Homo sapiens
ctctcctgcccaagcactt

SEQ ID NO: 1016970 - DNA, 15 bp, Homo sapiens
ctctcctgcctcagc

SEQ ID NO: 1016971 - DNA, 12 bp, Homo sapiens
ctctcctggcct

SEQ ID NO: 1016972 - DNA, 11 bp, Homo sapiens
ctctcctggtg

SEQ ID NO: 1016973 - DNA, 14 bp, Homo sapiens
ctctcctggtgtgg

SEQ ID NO: 1016974 - DNA, 14 bp, Homo sapiens
ctctcctgtacctc

SEQ ID NO: 1016975 - DNA, 22 bp, Homo sapiens
ctctcctgtacctcttgagcct

SEQ ID NO: 1016976 - DNA, 19 bp, Homo sapiens
ctctcctgtgtgcttgtca

SEQ ID NO: 1016977 - DNA, 16 bp, Homo sapiens
ctctccttcccacaaa

SEQ ID NO: 1016978 - DNA, 21 bp, Homo sapiens
ctctccttcgtgtctctccca

SEQ ID NO: 1016979 - DNA, 22 bp, Homo sapiens
ctctccttcgtgtctctcccac

SEQ ID NO: 1016980 - DNA, 13 bp, Homo sapiens
ctctccttgggct

SEQ ID NO: 1016981 - DNA, 20 bp, Homo sapiens
ctctccttgggctcctggct

SEQ ID NO: 1016982 - DNA, 14 bp, Homo sapiens
ctctcctttctttt

SEQ ID NO: 1016983 - DNA, 19 bp, Homo sapiens
ctctcctttggccattcca

SEQ ID NO: 1016984 - DNA, 20 bp, Homo sapiens
ctctcctttgtgtggctgcc

SEQ ID NO: 1016985 - DNA, 18 bp, Homo sapiens
ctctccttttccttacca

SEQ ID NO: 1016986 - DNA, 13 bp, Homo sapiens
ctctcgcacacct

SEQ ID NO: 1016987 - DNA, 17 bp, Homo sapiens
ctctcgcacctttccaa

SEQ ID NO: 1016988 - DNA, 19 bp, Homo sapiens
ctctcgcacctttccaaag

SEQ ID NO: 1016989 - DNA, 19 bp, Homo sapiens
ctctcgccccatccctgct

SEQ ID NO: 1016990 - DNA, 22 bp, Homo sapiens
ctctcggaaggctggctgggca

SEQ ID NO: 1016991 - DNA, 14 bp, Homo sapiens
ctctcggagccctc

SEQ ID NO: 1016992 - DNA, 16 bp, Homo sapiens
ctctcggctccccatg

SEQ ID NO: 1016993 - DNA, 18 bp, Homo sapiens
ctctcggctccccatgtg

SEQ ID NO: 1016994 - DNA, 19 bp, Homo sapiens
ctctcggctggaagaacat

SEQ ID NO: 1016995 - DNA, 15 bp, Homo sapiens
ctctcggggcccttg

SEQ ID NO: 1016996 - DNA, 21 bp, Homo sapiens
ctctctaaactggtacaattt

SEQ ID NO: 1016997 - DNA, 14 bp, Homo sapiens
ctctctaagccaca

SEQ ID NO: 1016998 - DNA, 13 bp, Homo sapiens
ctctctacagtgc

SEQ ID NO: 1016999 - DNA, 16 bp, Homo sapiens
ctctctacctccaccc

SEQ ID NO: 1017000 - DNA, 15 bp, Homo sapiens
ctctctactcagatg

SEQ ID NO: 1017001 - DNA, 17 bp, Homo sapiens
ctctctactcagatgac

SEQ ID NO: 1017002 - DNA, 17 bp, Homo sapiens
ctctctagctccccaat

SEQ ID NO: 1017003 - DNA, 19 bp, Homo sapiens
ctctctaggcctctccagt

SEQ ID NO: 1017004 - DNA, 14 bp, Homo sapiens
ctctctcacccacc

SEQ ID NO: 1017005 - DNA, 17 bp, Homo sapiens
ctctctcacccaccagc

SEQ ID NO: 1017006 - DNA, 14 bp, Homo sapiens
ctctctccacccta

SEQ ID NO: 1017007 - DNA, 21 bp, Homo sapiens
ctctctccagaaacagctgct

SEQ ID NO: 1017008 - DNA, 19 bp, Homo sapiens
ctctctccatttggaatta

SEQ ID NO: 1017009 - DNA, 23 bp, Homo sapiens
ctctctcccaccctaagggcagc

SEQ ID NO: 1017010 - DNA, 19 bp, Homo sapiens
ctctctccctacctccctc

SEQ ID NO: 1017011 - DNA, 13 bp, Homo sapiens
ctctctccctgtc

SEQ ID NO: 1017012 - DNA, 17 bp, Homo sapiens
ctctctccctgtcacac

SEQ ID NO: 1017013 - DNA, 16 bp, Homo sapiens
ctctctcctctctgct

SEQ ID NO: 1017014 - DNA, 14 bp, Homo sapiens
ctctctcctggtgt

SEQ ID NO: 1017015 - DNA, 20 bp, Homo sapiens
ctctctcctgtactttttcc

SEQ ID NO: 1017016 - DNA, 19 bp, Homo sapiens
ctctctcctgtccaaccta

SEQ ID NO: 1017017 - DNA, 15 bp, Homo sapiens
ctctctcctttgctg

SEQ ID NO: 1017018 - DNA, 15 bp, Homo sapiens
ctctctctccctccc

SEQ ID NO: 1017019 - DNA, 13 bp, Homo sapiens
ctctctctctcta

SEQ ID NO: 1017020 - DNA, 14 bp, Homo sapiens
ctctctctcttcta

SEQ ID NO: 1017021 - DNA, 11 bp, Homo sapiens
ctctctctggg

SEQ ID NO: 1017022 - DNA, 14 bp, Homo sapiens
ctctctctgtgggg

SEQ ID NO: 1017023 - DNA, 12 bp, Homo sapiens
ctctctcttctg

SEQ ID NO: 1017024 - DNA, 15 bp, Homo sapiens
ctctctgaactgcaa

SEQ ID NO: 1017025 - DNA, 21 bp, Homo sapiens
ctctctgaactgcaacactgg

SEQ ID NO: 1017026 - DNA, 16 bp, Homo sapiens
ctctctgacctttcat

SEQ ID NO: 1017027 - DNA, 17 bp, Homo sapiens
ctctctgcagccagccc

SEQ ID NO: 1017028 - DNA, 14 bp, Homo sapiens
ctctctgcagccca

SEQ ID NO: 1017029 - DNA, 22 bp, Homo sapiens
ctctctgcagcccagcctagtc

SEQ ID NO: 1017030 - DNA, 13 bp, Homo sapiens
ctctctgcagctg

SEQ ID NO: 1017031 - DNA, 13 bp, Homo sapiens
ctctctgccctct

SEQ ID NO: 1017032 - DNA, 11 bp, Homo sapiens
ctctctgcctc

SEQ ID NO: 1017033 - DNA, 15 bp, Homo sapiens
ctctctgcctctctt

SEQ ID NO: 1017034 - DNA, 9 bp, Homo sapiens
ctctctgct

SEQ ID NO: 1017035 - DNA, 14 bp, Homo sapiens
ctctctgctcatgg

SEQ ID NO: 1017036 - DNA, 15 bp, Homo sapiens
ctctctgctcatggg

SEQ ID NO: 1017037 - DNA, 16 bp, Homo sapiens
ctctctgctcatgggt

SEQ ID NO: 1017038 - DNA, 12 bp, Homo sapiens
ctctctgctcca

SEQ ID NO: 1017039 - DNA, 13 bp, Homo sapiens
ctctctgctccag

SEQ ID NO: 1017040 - DNA, 16 bp, Homo sapiens
ctctctgctctagcca

SEQ ID NO: 1017041 - DNA, 12 bp, Homo sapiens
ctctctgctctg

SEQ ID NO: 1017042 - DNA, 20 bp, Homo sapiens
ctctctgctgagctgggccc

SEQ ID NO: 1017043 - DNA, 21 bp, Homo sapiens
ctctctggaaagaggctctgg

SEQ ID NO: 1017044 - DNA, 20 bp, Homo sapiens
ctctctggaagcccctgggc

SEQ ID NO: 1017045 - DNA, 12 bp, Homo sapiens
ctctctggagcc

SEQ ID NO: 1017046 - DNA, 15 bp, Homo sapiens
ctctctggagcccct

SEQ ID NO: 1017047 - DNA, 16 bp, Homo sapiens
ctctctggcctcccac

SEQ ID NO: 1017048 - DNA, 18 bp, Homo sapiens
ctctctggcctcccaccc

SEQ ID NO: 1017049 - DNA, 19 bp, Homo sapiens
ctctctggccttttcctat

SEQ ID NO: 1017050 - DNA, 12 bp, Homo sapiens
ctctctggctgg

SEQ ID NO: 1017051 - DNA, 13 bp, Homo sapiens
ctctctggctgtc

SEQ ID NO: 1017052 - DNA, 12 bp, Homo sapiens
ctctctggcttc

SEQ ID NO: 1017053 - DNA, 17 bp, Homo sapiens
ctctctgggacctcctt

SEQ ID NO: 1017054 - DNA, 20 bp, Homo sapiens
ctctctgggactctcctcct

SEQ ID NO: 1017055 - DNA, 15 bp, Homo sapiens
ctctctgggcccagg

SEQ ID NO: 1017056 - DNA, 12 bp, Homo sapiens
ctctctgggctg

SEQ ID NO: 1017057 - DNA, 19 bp, Homo sapiens
ctctctggggccctgggcc

SEQ ID NO: 1017058 - DNA, 19 bp, Homo sapiens
ctctctgtcccttgctgta

SEQ ID NO: 1017059 - DNA, 18 bp, Homo sapiens
ctctctgtctgtctctcc

SEQ ID NO: 1017060 - DNA, 21 bp, Homo sapiens
ctctctgtgaatacaattaaa

SEQ ID NO: 1017061 - DNA, 14 bp, Homo sapiens
ctctctgttccctt

SEQ ID NO: 1017062 - DNA, 23 bp, Homo sapiens
ctctctgttgcgctcccgcattt

SEQ ID NO: 1017063 - DNA, 20 bp, Homo sapiens
ctctcttaaagttggaattt

SEQ ID NO: 1017064 - DNA, 18 bp, Homo sapiens
ctctcttatagaatattt

SEQ ID NO: 1017065 - DNA, 21 bp, Homo sapiens
ctctcttatagaatatttatt

SEQ ID NO: 1017066 - DNA, 22 bp, Homo sapiens
ctctcttcagcccctagtgcta

SEQ ID NO: 1017067 - DNA, 13 bp, Homo sapiens
ctctcttcaggag

SEQ ID NO: 1017068 - DNA, 23 bp, Homo sapiens
ctctcttcaggaggccctggtgt

SEQ ID NO: 1017069 - DNA, 24 bp, Homo sapiens
ctctcttcaggaggccctggtgtc

SEQ ID NO: 1017070 - DNA, 22 bp, Homo sapiens
ctctcttccagaagatgccctc

SEQ ID NO: 1017071 - DNA, 13 bp, Homo sapiens
ctctcttcctgcc

SEQ ID NO: 1017072 - DNA, 19 bp, Homo sapiens
ctctcttcctgcccctctt

SEQ ID NO: 1017073 - DNA, 20 bp, Homo sapiens
ctctcttcctgcccctcttt

SEQ ID NO: 1017074 - DNA, 17 bp, Homo sapiens
ctctcttctcagagtgg

SEQ ID NO: 1017075 - DNA, 19 bp, Homo sapiens
ctctcttctcagagtggtg

SEQ ID NO: 1017076 - DNA, 17 bp, Homo sapiens
ctctcttctgctccacc

SEQ ID NO: 1017077 - DNA, 18 bp, Homo sapiens
ctctcttctgctccaccc

SEQ ID NO: 1017078 - DNA, 16 bp, Homo sapiens
ctctcttcttttttct

SEQ ID NO: 1017079 - DNA, 22 bp, Homo sapiens
ctctcttgtgacgtgcactgtg

SEQ ID NO: 1017080 - DNA, 19 bp, Homo sapiens
ctctcttgttgtccaggct

SEQ ID NO: 1017081 - DNA, 17 bp, Homo sapiens
ctctctttatacagctg

SEQ ID NO: 1017082 - DNA, 11 bp, Homo sapiens
ctctctttcct

SEQ ID NO: 1017083 - DNA, 18 bp, Homo sapiens
ctctctttccttgagctg

SEQ ID NO: 1017084 - DNA, 14 bp, Homo sapiens
cagtagaactgtct

SEQ ID NO: 1017085 - DNA, 19 bp, Homo sapiens
cagtagacaatccccacat

SEQ ID NO: 1017086 - DNA, 12 bp, Homo sapiens
cagtagagccag

SEQ ID NO: 1017087 - DNA, 24 bp, Homo sapiens
cagtagagtagggtagaaggaaag

SEQ ID NO: 1017088 - DNA, 19 bp, Homo sapiens
cagtagatgtgcttctgaa

SEQ ID NO: 1017089 - DNA, 15 bp, Homo sapiens
cagtagattgcagaa

SEQ ID NO: 1017090 - DNA, 18 bp, Homo sapiens
cagtagattgcagaaaat

SEQ ID NO: 1017091 - DNA, 16 bp, Homo sapiens
cagtagattttccaaa

SEQ ID NO: 1017092 - DNA, 18 bp, Homo sapiens
cagtagcacaagttattt

SEQ ID NO: 1017093 - DNA, 23 bp, Homo sapiens
cagtagctccaacactttgagca

SEQ ID NO: 1017094 - DNA, 15 bp, Homo sapiens
cagtaggagcccagc

SEQ ID NO: 1017095 - DNA, 17 bp, Homo sapiens
cagtaggataagccact

SEQ ID NO: 1017096 - DNA, 16 bp, Homo sapiens
cagtaggattgctgtg

SEQ ID NO: 1017097 - DNA, 12 bp, Homo sapiens
cagtaggggagg

SEQ ID NO: 1017098 - DNA, 16 bp, Homo sapiens
cagtaggtccaagggc

SEQ ID NO: 1017099 - DNA, 15 bp, Homo sapiens
cagtaggttggcagt

SEQ ID NO: 1017100 - DNA, 16 bp, Homo sapiens
cagtagtctctgtgct

SEQ ID NO: 1017101 - DNA, 23 bp, Homo sapiens
cagtagtcttgatgaccaaagtc

SEQ ID NO: 1017102 - DNA, 15 bp, Homo sapiens
cagtagtgtacatta

SEQ ID NO: 1017103 - DNA, 16 bp, Homo sapiens
cagtagttgtattctt

SEQ ID NO: 1017104 - DNA, 13 bp, Homo sapiens
cagtagtttctca

SEQ ID NO: 1017105 - DNA, 12 bp, Homo sapiens
cagtagtttgag

SEQ ID NO: 1017106 - DNA, 18 bp, Homo sapiens
cagtagttttcaaaacac

SEQ ID NO: 1017107 - DNA, 21 bp, Homo sapiens
cagtagttttgacacttccca

SEQ ID NO: 1017108 - DNA, 16 bp, Homo sapiens
cagtataaaagacaaa

SEQ ID NO: 1017109 - DNA, 14 bp, Homo sapiens
cagtataaacaaag

SEQ ID NO: 1017110 - DNA, 19 bp, Homo sapiens
cagtataaacaaagttact

SEQ ID NO: 1017111 - DNA, 14 bp, Homo sapiens
cagtatactgtgtg

SEQ ID NO: 1017112 - DNA, 18 bp, Homo sapiens
cagtatagaataggcact

SEQ ID NO: 1017113 - DNA, 23 bp, Homo sapiens
cagtatataataactttattgca

SEQ ID NO: 1017114 - DNA, 23 bp, Homo sapiens
cagtatatgttaatttgtgtgtt

SEQ ID NO: 1017115 - DNA, 14 bp, Homo sapiens
cagtatatttaaac

SEQ ID NO: 1017116 - DNA, 16 bp, Homo sapiens
cagtatatttaaactc

SEQ ID NO: 1017117 - DNA, 14 bp, Homo sapiens
cagtatatttatag

SEQ ID NO: 1017118 - DNA, 15 bp, Homo sapiens
cagtatatttatagt

SEQ ID NO: 1017119 - DNA, 16 bp, Homo sapiens
cagtatattttatttc

SEQ ID NO: 1017120 - DNA, 20 bp, Homo sapiens
cagtatattttatttcaatg

SEQ ID NO: 1017121 - DNA, 15 bp, Homo sapiens
cagtatcatattatt

SEQ ID NO: 1017122 - DNA, 17 bp, Homo sapiens
cagtatcatctccatca

SEQ ID NO: 1017123 - DNA, 16 bp, Homo sapiens
cagtatcatgccctgt

SEQ ID NO: 1017124 - DNA, 17 bp, Homo sapiens
cagtatcatgccctgtg

SEQ ID NO: 1017125 - DNA, 20 bp, Homo sapiens
cagtatcatgccctgtgcaa

SEQ ID NO: 1017126 - DNA, 16 bp, Homo sapiens
cagtatccactttgca

SEQ ID NO: 1017127 - DNA, 20 bp, Homo sapiens
cagtatctatatatgtgtat

SEQ ID NO: 1017128 - DNA, 21 bp, Homo sapiens
cagtatctatatatgtgtatg

SEQ ID NO: 1017129 - DNA, 22 bp, Homo sapiens
cagtatctatatatgtgtatgt

SEQ ID NO: 1017130 - DNA, 23 bp, Homo sapiens
cagtatctatatatgtgtatgta

SEQ ID NO: 1017131 - DNA, 15 bp, Homo sapiens
cagtatctcagggcc

SEQ ID NO: 1017132 - DNA, 22 bp, Homo sapiens
cagtatgatggcaggagaatca

SEQ ID NO: 1017133 - DNA, 15 bp, Homo sapiens
cagtatgatttatcc

SEQ ID NO: 1017134 - DNA, 20 bp, Homo sapiens
cagtatgctttccctgagga

SEQ ID NO: 1017135 - DNA, 23 bp, Homo sapiens
cagtatgctttccctgaggaatg

SEQ ID NO: 1017136 - DNA, 20 bp, Homo sapiens
cagtatgggggttgtaaatt

SEQ ID NO: 1017137 - DNA, 13 bp, Homo sapiens
cagtatgttgtca

SEQ ID NO: 1017138 - DNA, 19 bp, Homo sapiens
cagtattaaaggggggagg

SEQ ID NO: 1017139 - DNA, 20 bp, Homo sapiens
cagtattaaaggggggaggg

SEQ ID NO: 1017140 - DNA, 23 bp, Homo sapiens
cagtattaaattagatatcttca

SEQ ID NO: 1017141 - DNA, 20 bp, Homo sapiens
cagtattaagggtaggatgt

SEQ ID NO: 1017142 - DNA, 14 bp, Homo sapiens
cagtattaaggttt

SEQ ID NO: 1017143 - DNA, 16 bp, Homo sapiens
cagtattactgctgct

SEQ ID NO: 1017144 - DNA, 20 bp, Homo sapiens
cagtattatttctccatccc

SEQ ID NO: 1017145 - DNA, 20 bp, Homo sapiens
cagtattctcagagcatgtg

SEQ ID NO: 1017146 - DNA, 14 bp, Homo sapiens
cagtattctgacat

SEQ ID NO: 1017147 - DNA, 16 bp, Homo sapiens
cagtattctgacatgt

SEQ ID NO: 1017148 - DNA, 17 bp, Homo sapiens
cagtattctgacatgta

SEQ ID NO: 1017149 - DNA, 21 bp, Homo sapiens
cagtattctgacatgtaagaa

SEQ ID NO: 1017150 - DNA, 17 bp, Homo sapiens
cagtattgccacctctg

SEQ ID NO: 1017151 - DNA, 13 bp, Homo sapiens
cagtatttactct

SEQ ID NO: 1017152 - DNA, 16 bp, Homo sapiens
cagtatttagaagcca

SEQ ID NO: 1017153 - DNA, 17 bp, Homo sapiens
cagtatttagaagccaa

SEQ ID NO: 1017154 - DNA, 15 bp, Homo sapiens
cagtatttcattgcc

SEQ ID NO: 1017155 - DNA, 18 bp, Homo sapiens
ctggaagatataacattc

SEQ ID NO: 1017156 - DNA, 21 bp, Homo sapiens
ctggaagatcccctctcctgc

SEQ ID NO: 1017157 - DNA, 14 bp, Homo sapiens
ctggaagatcctgc

SEQ ID NO: 1017158 - DNA, 18 bp, Homo sapiens
ctggaagatcctgcgggt

SEQ ID NO: 1017159 - DNA, 13 bp, Homo sapiens
ctggaagcacagc

SEQ ID NO: 1017160 - DNA, 17 bp, Homo sapiens
ctggaagcacagcctcg

SEQ ID NO: 1017161 - DNA, 15 bp, Homo sapiens
ctggaagcacatgtt

SEQ ID NO: 1017162 - DNA, 23 bp, Homo sapiens
ctggaagcatgtaggagaatcca

SEQ ID NO: 1017163 - DNA, 22 bp, Homo sapiens
ctggaagcccagcccctactgc

SEQ ID NO: 1017164 - DNA, 17 bp, Homo sapiens
ctggaagccctggagac

SEQ ID NO: 1017165 - DNA, 13 bp, Homo sapiens
ctggaagcctgcc

SEQ ID NO: 1017166 - DNA, 19 bp, Homo sapiens
ctggaagctaatttgcatt

SEQ ID NO: 1017167 - DNA, 15 bp, Homo sapiens
ctggaagctgtcagg

SEQ ID NO: 1017168 - DNA, 16 bp, Homo sapiens
ctggaagctgtcaggc

SEQ ID NO: 1017169 - DNA, 22 bp, Homo sapiens
ctggaagctgtgtccttgcacc

SEQ ID NO: 1017170 - DNA, 13 bp, Homo sapiens
ctggaaggcaggg

SEQ ID NO: 1017171 - DNA, 15 bp, Homo sapiens
ctggaaggcagggca

SEQ ID NO: 1017172 - DNA, 16 bp, Homo sapiens
ctggaaggcagggcag

SEQ ID NO: 1017173 - DNA, 18 bp, Homo sapiens
ctggaaggcagggcagag

SEQ ID NO: 1017174 - DNA, 16 bp, Homo sapiens
ctggaaggctggctga

SEQ ID NO: 1017175 - DNA, 22 bp, Homo sapiens
ctggaagggaggaaggcctttc

SEQ ID NO: 1017176 - DNA, 20 bp, Homo sapiens
ctggaaggggcagccctgag

SEQ ID NO: 1017177 - DNA, 13 bp, Homo sapiens
ctggaaggggcca

SEQ ID NO: 1017178 - DNA, 15 bp, Homo sapiens
ctggaagttgtggat

SEQ ID NO: 1017179 - DNA, 17 bp, Homo sapiens
ctggaagttgtggatat

SEQ ID NO: 1017180 - DNA, 23 bp, Homo sapiens
ctggaataaaatataaaactgaa

SEQ ID NO: 1017181 - DNA, 13 bp, Homo sapiens
ctggaataaacag

SEQ ID NO: 1017182 - DNA, 15 bp, Homo sapiens
ctggaataaacagtg

SEQ ID NO: 1017183 - DNA, 18 bp, Homo sapiens
ctggaataaagttgcaga

SEQ ID NO: 1017184 - DNA, 23 bp, Homo sapiens
ctggaataaagttgcagatgatt

SEQ ID NO: 1017185 - DNA, 16 bp, Homo sapiens
ctggaataatttgtaa

SEQ ID NO: 1017186 - DNA, 18 bp, Homo sapiens
ctggaataatttgtaaat

SEQ ID NO: 1017187 - DNA, 15 bp, Homo sapiens
ctggaatacatgaaa

SEQ ID NO: 1017188 - DNA, 18 bp, Homo sapiens
ctggaatacatgaaatat

SEQ ID NO: 1017189 - DNA, 18 bp, Homo sapiens
ctggaatatataaccagt

SEQ ID NO: 1017190 - DNA, 22 bp, Homo sapiens
ctggaatattgtttctagaaca

SEQ ID NO: 1017191 - DNA, 20 bp, Homo sapiens
ctggaatcttccatctgcat

SEQ ID NO: 1017192 - DNA, 14 bp, Homo sapiens
ctggaatgagggag

SEQ ID NO: 1017193 - DNA, 22 bp, Homo sapiens
ctggaatggtacatgtcttcca

SEQ ID NO: 1017194 - DNA, 20 bp, Homo sapiens
ctggaatgtaatcaatgttt

SEQ ID NO: 1017195 - DNA, 21 bp, Homo sapiens
ctggaatgtaatcaatgtttc

SEQ ID NO: 1017196 - DNA, 18 bp, Homo sapiens
ctggaatgtttttccctc

SEQ ID NO: 1017197 - DNA, 15 bp, Homo sapiens
ctggaattcagcacc

SEQ ID NO: 1017198 - DNA, 15 bp, Homo sapiens
ctggaattgtggcta

SEQ ID NO: 1017199 - DNA, 14 bp, Homo sapiens
ctggacaaagaatt

SEQ ID NO: 1017200 - DNA, 18 bp, Homo sapiens
ctggacaagcagaggtgg

SEQ ID NO: 1017201 - DNA, 15 bp, Homo sapiens
ctggacaagccaact

SEQ ID NO: 1017202 - DNA, 20 bp, Homo sapiens
ctggacacactaaactctgg

SEQ ID NO: 1017203 - DNA, 22 bp, Homo sapiens
ctggacaccgggccagtatcta

SEQ ID NO: 1017204 - DNA, 16 bp, Homo sapiens
ctggacacctcccagg

SEQ ID NO: 1017205 - DNA, 18 bp, Homo sapiens
ctggacactcagacctga

SEQ ID NO: 1017206 - DNA, 15 bp, Homo sapiens
ctggagatcctcctg

SEQ ID NO: 1017207 - DNA, 20 bp, Homo sapiens
ctggagatcctcctgcagac

SEQ ID NO: 1017208 - DNA, 23 bp, Homo sapiens
ctggagatcctcctgcagaccac

SEQ ID NO: 1017209 - DNA, 17 bp, Homo sapiens
ctggagatgaggccaga

SEQ ID NO: 1017210 - DNA, 18 bp, Homo sapiens
ctggagatgaggccagac

SEQ ID NO: 1017211 - DNA, 19 bp, Homo sapiens
ctggagatgcaaggtgctg

SEQ ID NO: 1017212 - DNA, 14 bp, Homo sapiens
ctggagcaccaggc

SEQ ID NO: 1017213 - DNA, 21 bp, Homo sapiens
ctggagcacttgttttaaaat

SEQ ID NO: 1017214 - DNA, 13 bp, Homo sapiens
ctggagcagaaag

SEQ ID NO: 1017215 - DNA, 18 bp, Homo sapiens
ctggagcagaccaccccg

SEQ ID NO: 1017216 - DNA, 15 bp, Homo sapiens
ctggagccaagtcca

SEQ ID NO: 1017217 - DNA, 16 bp, Homo sapiens
ctggagccaagtccag

SEQ ID NO: 1017218 - DNA, 16 bp, Homo sapiens
ctggagccagactctg

SEQ ID NO: 1017219 - DNA, 13 bp, Homo sapiens
ctggagccagaga

SEQ ID NO: 1017220 - DNA, 19 bp, Homo sapiens
ctggagccagggcagagga

SEQ ID NO: 1017221 - DNA, 21 bp, Homo sapiens
ctggagccagggcagaggaat

SEQ ID NO: 1017222 - DNA, 15 bp, Homo sapiens
ctggagcccaggagt

SEQ ID NO: 1017223 - DNA, 21 bp, Homo sapiens
ctggagccccatcctgtgtta

SEQ ID NO: 1017224 - DNA, 15 bp, Homo sapiens
ctggagcccccagca

SEQ ID NO: 1017225 - DNA, 19 bp, Homo sapiens
ctggagcccccagcagagg

SEQ ID NO: 1017226 - DNA, 16 bp, Homo sapiens
ctggagcccctcctcc

SEQ ID NO: 1017227 - DNA, 17 bp, Homo sapiens
ctggagcccctcctccc

SEQ ID NO: 1017228 - DNA, 15 bp, Homo sapiens
ctggagcccctgggt

SEQ ID NO: 1017229 - DNA, 14 bp, Homo sapiens
ctggagccctaacc

SEQ ID NO: 1017230 - DNA, 15 bp, Homo sapiens
ctggagccctgggcg

SEQ ID NO: 1017231 - DNA, 15 bp, Homo sapiens
ctggagccctgttgg

SEQ ID NO: 1017232 - DNA, 23 bp, Homo sapiens
ctggagcctccgacgctgcctct

SEQ ID NO: 1017233 - DNA, 22 bp, Homo sapiens
ctggagcgtttgctgtgccagg

SEQ ID NO: 1017234 - DNA, 21 bp, Homo sapiens
ctggagctcatctgcaaaagg

SEQ ID NO: 1017235 - DNA, 15 bp, Homo sapiens
ctggagctctgtggg

SEQ ID NO: 1017236 - DNA, 23 bp, Homo sapiens
ctggagctctgtgggtctctgga

SEQ ID NO: 1017237 - DNA, 13 bp, Homo sapiens
ctggagctcttgg

SEQ ID NO: 1017238 - DNA, 16 bp, Homo sapiens
ctggagctcttggaag

SEQ ID NO: 1017239 - DNA, 11 bp, Homo sapiens
ctggagctgag

SEQ ID NO: 1017240 - DNA, 12 bp, Homo sapiens
ctggagctgagg

SEQ ID NO: 1017241 - DNA, 14 bp, Homo sapiens
ctggagctgaggaa

SEQ ID NO: 1017242 - DNA, 11 bp, Homo sapiens
ctggagctggc

SEQ ID NO: 1017243 - DNA, 16 bp, Homo sapiens
ctggagctgggagaca

SEQ ID NO: 1017244 - DNA, 15 bp, Homo sapiens
ctggagctgggaggt

SEQ ID NO: 1017245 - DNA, 17 bp, Homo sapiens
ctggagctgggaggtct

SEQ ID NO: 1017246 - DNA, 17 bp, Homo sapiens
ctggaggaaagggagga

SEQ ID NO: 1017247 - DNA, 20 bp, Homo sapiens
ctggaggaaagggaggagtg

SEQ ID NO: 1017248 - DNA, 18 bp, Homo sapiens
ctggaggaacacagagaa

SEQ ID NO: 1017249 - DNA, 23 bp, Homo sapiens
ctggaggaacttgctgctgtgcc

SEQ ID NO: 1017250 - DNA, 23 bp, Homo sapiens
ctggaggaccagattgctctgcc

SEQ ID NO: 1017251 - DNA, 17 bp, Homo sapiens
ctggaggagagaagaat

SEQ ID NO: 1017252 - DNA, 19 bp, Homo sapiens
ctggaggaggggaagctgg

SEQ ID NO: 1017253 - DNA, 20 bp, Homo sapiens
ctggaggaggggaagctggg

SEQ ID NO: 1017254 - DNA, 16 bp, Homo sapiens
ctggaggcaagaggga

SEQ ID NO: 1017255 - DNA, 16 bp, Homo sapiens
ctggaggcagggcctt

SEQ ID NO: 1017256 - DNA, 12 bp, Homo sapiens
ctggaggcccag

SEQ ID NO: 1017257 - DNA, 14 bp, Homo sapiens
ctggaggcccaggc

SEQ ID NO: 1017258 - DNA, 17 bp, Homo sapiens
ctggaggcccaggctgg

SEQ ID NO: 1017259 - DNA, 18 bp, Homo sapiens
ctggaggcccaggctggg

SEQ ID NO: 1017260 - DNA, 19 bp, Homo sapiens
ctggaggcccaggctggga

SEQ ID NO: 1017261 - DNA, 19 bp, Homo sapiens
ctggaggcccctggagcca

SEQ ID NO: 1017262 - DNA, 15 bp, Homo sapiens
ctggaggcctcaggt

SEQ ID NO: 1017263 - DNA, 19 bp, Homo sapiens
ctggaggcctcaggtgctg

SEQ ID NO: 1017264 - DNA, 18 bp, Homo sapiens
ctggaggccttccagctg

SEQ ID NO: 1017265 - DNA, 20 bp, Homo sapiens
ctggaggccttccagctgct

SEQ ID NO: 1017266 - DNA, 22 bp, Homo sapiens
ctggaggccttccagctgctgt

SEQ ID NO: 1017267 - DNA, 16 bp, Homo sapiens
ctggaggcggtgcggc

SEQ ID NO: 1017268 - DNA, 19 bp, Homo sapiens
ctggaggctcagcccaccc

SEQ ID NO: 1017269 - DNA, 16 bp, Homo sapiens
ctggaggctgcagagc

SEQ ID NO: 1017270 - DNA, 11 bp, Homo sapiens
ctggaggctgg

SEQ ID NO: 1017271 - DNA, 17 bp, Homo sapiens
ctggagggaagagtgga

SEQ ID NO: 1017272 - DNA, 21 bp, Homo sapiens
ctggagggaagagtggaggtg

SEQ ID NO: 1017273 - DNA, 22 bp, Homo sapiens
ctggagggaagagtggaggtgg

SEQ ID NO: 1017274 - DNA, 22 bp, Homo sapiens
ctggagggatgcccccaggcag

SEQ ID NO: 1017275 - DNA, 21 bp, Homo sapiens
ctggagggcacttcctccaca

SEQ ID NO: 1017276 - DNA, 16 bp, Homo sapiens
ctggaggggagagctt

SEQ ID NO: 1017277 - DNA, 23 bp, Homo sapiens
ctggaggggagagctttgtgctt

SEQ ID NO: 1017278 - DNA, 21 bp, Homo sapiens
ctggaggggctgtcctccttc

SEQ ID NO: 1017279 - DNA, 16 bp, Homo sapiens
ctggagggtaactggg

SEQ ID NO: 1017280 - DNA, 20 bp, Homo sapiens
ctggaggtaaggcctttgag

SEQ ID NO: 1017281 - DNA, 19 bp, Homo sapiens
ctggaggtcacattcagga

SEQ ID NO: 1017282 - DNA, 21 bp, Homo sapiens
ctggaggtcacattcaggaag

SEQ ID NO: 1017283 - DNA, 17 bp, Homo sapiens
ctggaggtgctgctcta

SEQ ID NO: 1017284 - DNA, 14 bp, Homo sapiens
ctggaggtgctggt

SEQ ID NO: 1017285 - DNA, 13 bp, Homo sapiens
ctggaggtgggca

SEQ ID NO: 1017286 - DNA, 22 bp, Homo sapiens
cagtctcctcccctactctgcc

SEQ ID NO: 1017287 - DNA, 15 bp, Homo sapiens
cagtctcgggtggct

SEQ ID NO: 1017288 - DNA, 22 bp, Homo sapiens
cagtctcgggtggctagtcaga

SEQ ID NO: 1017289 - DNA, 14 bp, Homo sapiens
cagtctctcttctc

SEQ ID NO: 1017290 - DNA, 14 bp, Homo sapiens
cagtctctgagcag

SEQ ID NO: 1017291 - DNA, 14 bp, Homo sapiens
cagtctctgtcgtg

SEQ ID NO: 1017292 - DNA, 19 bp, Homo sapiens
cagtctctttaatcttcag

SEQ ID NO: 1017293 - DNA, 20 bp, Homo sapiens
cagtctctttaatcttcagt

SEQ ID NO: 1017294 - DNA, 16 bp, Homo sapiens
cagtctctttcttcct

SEQ ID NO: 1017295 - DNA, 17 bp, Homo sapiens
cagtctctttcttcctt

SEQ ID NO: 1017296 - DNA, 18 bp, Homo sapiens
cagtctctttcttccttt

SEQ ID NO: 1017297 - DNA, 19 bp, Homo sapiens
cagtctgaacccttgtgct

SEQ ID NO: 1017298 - DNA, 22 bp, Homo sapiens
cagtctgaacccttgtgcttgg

SEQ ID NO: 1017299 - DNA, 17 bp, Homo sapiens
cagtctgaagctcgcat

SEQ ID NO: 1017300 - DNA, 13 bp, Homo sapiens
cagtctgaagttt

SEQ ID NO: 1017301 - DNA, 19 bp, Homo sapiens
cagtctgcccacgcagagg

SEQ ID NO: 1017302 - DNA, 15 bp, Homo sapiens
cagtctgctccacca

SEQ ID NO: 1017303 - DNA, 13 bp, Homo sapiens
cagtctgctctgc

SEQ ID NO: 1017304 - DNA, 16 bp, Homo sapiens
cagtctgctctgctgc

SEQ ID NO: 1017305 - DNA, 21 bp, Homo sapiens
cagtctgctctgctgctctga

SEQ ID NO: 1017306 - DNA, 13 bp, Homo sapiens
cagtctgctgccc

SEQ ID NO: 1017307 - DNA, 14 bp, Homo sapiens
cagtctgcttagaa

SEQ ID NO: 1017308 - DNA, 15 bp, Homo sapiens
cagtctgcttagaaa

SEQ ID NO: 1017309 - DNA, 17 bp, Homo sapiens
cagtctgcttagaaata

SEQ ID NO: 1017310 - DNA, 17 bp, Homo sapiens
cagtctgtaaaatacat

SEQ ID NO: 1017311 - DNA, 18 bp, Homo sapiens
cagtctgtaaaatacatg

SEQ ID NO: 1017312 - DNA, 14 bp, Homo sapiens
cagtctgtagggag

SEQ ID NO: 1017313 - DNA, 24 bp, Homo sapiens
cagtctgtcatgaacatgttcctg

SEQ ID NO: 1017314 - DNA, 15 bp, Homo sapiens
cagtctgtctactgt

SEQ ID NO: 1017315 - DNA, 16 bp, Homo sapiens
cagtctgtctactgtg

SEQ ID NO: 1017316 - DNA, 17 bp, Homo sapiens
cagtctgtctactgtgg

SEQ ID NO: 1017317 - DNA, 15 bp, Homo sapiens
cagtctgtggatcag

SEQ ID NO: 1017318 - DNA, 16 bp, Homo sapiens
cagtctgttatgcact

SEQ ID NO: 1017319 - DNA, 22 bp, Homo sapiens
cagtctgttatgcactgtggtt

SEQ ID NO: 1017320 - DNA, 24 bp, Homo sapiens
cagtctgttatgcactgtggtttc

SEQ ID NO: 1017321 - DNA, 21 bp, Homo sapiens
cagtcttactctgtctcccag

SEQ ID NO: 1017322 - DNA, 18 bp, Homo sapiens
cagtcttccacaaagaaa

SEQ ID NO: 1017323 - DNA, 19 bp, Homo sapiens
cagtcttccacaaagaaaa

SEQ ID NO: 1017324 - DNA, 17 bp, Homo sapiens
cagtcttccatttgcaa

SEQ ID NO: 1017325 - DNA, 21 bp, Homo sapiens
cagtcttccatttgcaaggga

SEQ ID NO: 1017326 - DNA, 16 bp, Homo sapiens
cagtcttcctgacact

SEQ ID NO: 1017327 - DNA, 12 bp, Homo sapiens
cagtcttccttg

SEQ ID NO: 1017328 - DNA, 18 bp, Homo sapiens
cagtgccatccccacctt

SEQ ID NO: 1017329 - DNA, 20 bp, Homo sapiens
cagtgccattccactccact

SEQ ID NO: 1017330 - DNA, 15 bp, Homo sapiens
cagtgcccaccgccc

SEQ ID NO: 1017331 - DNA, 16 bp, Homo sapiens
cagtgcccatgaatgg

SEQ ID NO: 1017332 - DNA, 17 bp, Homo sapiens
cagtgcccatgtgtaca

SEQ ID NO: 1017333 - DNA, 23 bp, Homo sapiens
cagtgcccatgtgtacattctgc

SEQ ID NO: 1017334 - DNA, 14 bp, Homo sapiens
cagtgccccaggga

SEQ ID NO: 1017335 - DNA, 22 bp, Homo sapiens
cagtgccccagggagtccaggg

SEQ ID NO: 1017336 - DNA, 19 bp, Homo sapiens
cagtgccctcattttatgt

SEQ ID NO: 1017337 - DNA, 15 bp, Homo sapiens
cagtgccgagaagga

SEQ ID NO: 1017338 - DNA, 15 bp, Homo sapiens
cagtgccgctcctgc

SEQ ID NO: 1017339 - DNA, 21 bp, Homo sapiens
cagtgccgctcctgcttcccc

SEQ ID NO: 1017340 - DNA, 19 bp, Homo sapiens
cagtgccggaggccttggg

SEQ ID NO: 1017341 - DNA, 23 bp, Homo sapiens
cagtgcctccacatgctgcctgg

SEQ ID NO: 1017342 - DNA, 11 bp, Homo sapiens
cagtgcctcct

SEQ ID NO: 1017343 - DNA, 18 bp, Homo sapiens
cagtgcctcgaggcaccg

SEQ ID NO: 1017344 - DNA, 10 bp, Homo sapiens
cagtgcctgc

SEQ ID NO: 1017345 - DNA, 12 bp, Homo sapiens
cagtgcctgcca

SEQ ID NO: 1017346 - DNA, 16 bp, Homo sapiens
cagtgcctgccactct

SEQ ID NO: 1017347 - DNA, 12 bp, Homo sapiens
cagtgcctgcct

SEQ ID NO: 1017348 - DNA, 21 bp, Homo sapiens
cagtgcctgctctgctgtgag

SEQ ID NO: 1017349 - DNA, 14 bp, Homo sapiens
cagtgcctggccca

SEQ ID NO: 1017350 - DNA, 14 bp, Homo sapiens
cagtgcctgggaat

SEQ ID NO: 1017351 - DNA, 20 bp, Homo sapiens
cagtgcctgggaatgtatta

SEQ ID NO: 1017352 - DNA, 17 bp, Homo sapiens
cagtgccttttggaact

SEQ ID NO: 1017353 - DNA, 17 bp, Homo sapiens
cagtgccttttggtttc

SEQ ID NO: 1017354 - DNA, 21 bp, Homo sapiens
cagtgcggacccttcccagcc

SEQ ID NO: 1017355 - DNA, 22 bp, Homo sapiens
cagtgcggacccttcccagccc

SEQ ID NO: 1017356 - DNA, 18 bp, Homo sapiens
cagtgcggttcctcatct

SEQ ID NO: 1017357 - DNA, 18 bp, Homo sapiens
cagtgctctgcctcagac

SEQ ID NO: 1017358 - DNA, 23 bp, Homo sapiens
cagtgctgaccagacagcctccc

SEQ ID NO: 1017359 - DNA, 14 bp, Homo sapiens
cagtgctgccatgc

SEQ ID NO: 1017360 - DNA, 17 bp, Homo sapiens
cagtgctgccatgccac

SEQ ID NO: 1017361 - DNA, 20 bp, Homo sapiens
cagtgctgccatgccactgc

SEQ ID NO: 1017362 - DNA, 21 bp, Homo sapiens
cagtgctgccatgccactgcc

SEQ ID NO: 1017363 - DNA, 19 bp, Homo sapiens
cagtgctgccccttgcaag

SEQ ID NO: 1017364 - DNA, 20 bp, Homo sapiens
cagtgctgccccttgcaagc

SEQ ID NO: 1017365 - DNA, 22 bp, Homo sapiens
cagtgctgccccttgcaagcca

SEQ ID NO: 1017366 - DNA, 13 bp, Homo sapiens
cagtgctgccctg

SEQ ID NO: 1017367 - DNA, 13 bp, Homo sapiens
cagtgctgcctgt

SEQ ID NO: 1017368 - DNA, 14 bp, Homo sapiens
cagtgctgcctgtc

SEQ ID NO: 1017369 - DNA, 18 bp, Homo sapiens
cagtgctgcttctcttgg

SEQ ID NO: 1017370 - DNA, 15 bp, Homo sapiens
cagtgctggaaggga

SEQ ID NO: 1017371 - DNA, 19 bp, Homo sapiens
cagtgctgtggcctgggca

SEQ ID NO: 1017372 - DNA, 14 bp, Homo sapiens
cagtgcttagcaaa

SEQ ID NO: 1017373 - DNA, 16 bp, Homo sapiens
cagtgcttagcaaaaa

SEQ ID NO: 1017374 - DNA, 15 bp, Homo sapiens
cagtgcttcccgagt

SEQ ID NO: 1017375 - DNA, 17 bp, Homo sapiens
cagtgcttctctacaga

SEQ ID NO: 1017376 - DNA, 20 bp, Homo sapiens
cagtgcttgagtttggggaa

SEQ ID NO: 1017377 - DNA, 17 bp, Homo sapiens
cagtgcttgcatcctat

SEQ ID NO: 1017378 - DNA, 15 bp, Homo sapiens
cagtgcttgggctcc

SEQ ID NO: 1017379 - DNA, 17 bp, Homo sapiens
cagtgcttgggctccac

SEQ ID NO: 1017380 - DNA, 18 bp, Homo sapiens
cagtgcttgggctccacg

SEQ ID NO: 1017381 - DNA, 12 bp, Homo sapiens
cagtgctttttc

SEQ ID NO: 1017382 - DNA, 14 bp, Homo sapiens
cagtggaaaacaaa

SEQ ID NO: 1017383 - DNA, 21 bp, Homo sapiens
cagtggaacacaaatgaaaat

SEQ ID NO: 1017384 - DNA, 15 bp, Homo sapiens
cagtggaagaaacac

SEQ ID NO: 1017385 - DNA, 23 bp, Homo sapiens
cagtggaagttcttcaagaggaa

SEQ ID NO: 1017386 - DNA, 21 bp, Homo sapiens
cagtggaattccaacttgaag

SEQ ID NO: 1017387 - DNA, 15 bp, Homo sapiens
cagtggaccctggac

SEQ ID NO: 1017388 - DNA, 15 bp, Homo sapiens
cagtggaccctgtgg

SEQ ID NO: 1017389 - DNA, 20 bp, Homo sapiens
cagtggacctagcctggatg

SEQ ID NO: 1017390 - DNA, 22 bp, Homo sapiens
cagtggactcagaaagccaaca

SEQ ID NO: 1017391 - DNA, 20 bp, Homo sapiens
cagtggactcagcagtgacc

SEQ ID NO: 1017392 - DNA, 20 bp, Homo sapiens
cagtggaggaagagggacag

SEQ ID NO: 1017393 - DNA, 21 bp, Homo sapiens
cagtggatatgacccacactg

SEQ ID NO: 1017394 - DNA, 22 bp, Homo sapiens
cagtggatatgacccacactgc

SEQ ID NO: 1017395 - DNA, 23 bp, Homo sapiens
cagtggatatgacccacactgcc

SEQ ID NO: 1017396 - DNA, 17 bp, Homo sapiens
cagtggatcacaaagtg

SEQ ID NO: 1017397 - DNA, 13 bp, Homo sapiens
cagtggatcttca

SEQ ID NO: 1017398 - DNA, 20 bp, Homo sapiens
cagtggatgttagcctgcaa

SEQ ID NO: 1017399 - DNA, 17 bp, Homo sapiens
cagtggcacaaaaaaat

SEQ ID NO: 1017400 - DNA, 20 bp, Homo sapiens
cagtggcacaatcatggctc

SEQ ID NO: 1017401 - DNA, 18 bp, Homo sapiens
cagtggcacggagagaag

SEQ ID NO: 1017402 - DNA, 23 bp, Homo sapiens
cagtggcacggagagaaggccca

SEQ ID NO: 1017403 - DNA, 12 bp, Homo sapiens
cagtggccaagc

SEQ ID NO: 1017404 - DNA, 15 bp, Homo sapiens
cagtggccaagcctg

SEQ ID NO: 1017405 - DNA, 16 bp, Homo sapiens
cagtggcccatggcat

SEQ ID NO: 1017406 - DNA, 23 bp, Homo sapiens
cagtggcccccgggcctgcacag

SEQ ID NO: 1017407 - DNA, 19 bp, Homo sapiens
cagtggcctcaaccctccc

SEQ ID NO: 1017408 - DNA, 20 bp, Homo sapiens
cagtggcctcaaccctccct

SEQ ID NO: 1017409 - DNA, 23 bp, Homo sapiens
cagtggcctcaaccctccctcag

SEQ ID NO: 1017410 - DNA, 14 bp, Homo sapiens
cagtggcctttcag

SEQ ID NO: 1017411 - DNA, 18 bp, Homo sapiens
cagtggctcgctccctgt

SEQ ID NO: 1017412 - DNA, 16 bp, Homo sapiens
cagtggctctcagagc

SEQ ID NO: 1017413 - DNA, 18 bp, Homo sapiens
cagtggctctcagagcag

SEQ ID NO: 1017414 - DNA, 20 bp, Homo sapiens
cagtggctctcagagcagca

SEQ ID NO: 1017415 - DNA, 22 bp, Homo sapiens
cagtggctgggtgggcccagaa

SEQ ID NO: 1017416 - DNA, 19 bp, Homo sapiens
ctggcagaactgagctcct

SEQ ID NO: 1017417 - DNA, 23 bp, Homo sapiens
ctggcagactcaaggggctggaa

SEQ ID NO: 1017418 - DNA, 14 bp, Homo sapiens
ctggcagagcacag

SEQ ID NO: 1017419 - DNA, 16 bp, Homo sapiens
ctggcagagcacagcc

SEQ ID NO: 1017420 - DNA, 14 bp, Homo sapiens
ctggcagagcctct

SEQ ID NO: 1017421 - DNA, 18 bp, Homo sapiens
ctggcagcacagcccagg

SEQ ID NO: 1017422 - DNA, 20 bp, Homo sapiens
ctggcagcacagcccagggc

SEQ ID NO: 1017423 - DNA, 13 bp, Homo sapiens
ctggcagcccaga

SEQ ID NO: 1017424 - DNA, 22 bp, Homo sapiens
ctggcagccgtgccttcagctc

SEQ ID NO: 1017425 - DNA, 15 bp, Homo sapiens
ctggcagcctcccat

SEQ ID NO: 1017426 - DNA, 22 bp, Homo sapiens
ctggcagcctcccatccagggc

SEQ ID NO: 1017427 - DNA, 16 bp, Homo sapiens
ctggcagctcctctcc

SEQ ID NO: 1017428 - DNA, 23 bp, Homo sapiens
ctggcagctcctctccttgggct

SEQ ID NO: 1017429 - DNA, 14 bp, Homo sapiens
ctggcagctctcca

SEQ ID NO: 1017430 - DNA, 16 bp, Homo sapiens
ctggcagctctccagt

SEQ ID NO: 1017431 - DNA, 17 bp, Homo sapiens
ctggcagctctccagtc

SEQ ID NO: 1017432 - DNA, 23 bp, Homo sapiens
ctggcagctctccagtcaggagg

SEQ ID NO: 1017433 - DNA, 12 bp, Homo sapiens
ctggcagctgag

SEQ ID NO: 1017434 - DNA, 19 bp, Homo sapiens
ctggcagctgagagccctg

SEQ ID NO: 1017435 - DNA, 20 bp, Homo sapiens
ctggcagctgagagccctgc

SEQ ID NO: 1017436 - DNA, 12 bp, Homo sapiens
ctggcaggacct

SEQ ID NO: 1017437 - DNA, 18 bp, Homo sapiens
ctggcaggatgaccctgc

SEQ ID NO: 1017438 - DNA, 15 bp, Homo sapiens
ctggcagggccacct

SEQ ID NO: 1017439 - DNA, 19 bp, Homo sapiens
ctggcagggccacctgcag

SEQ ID NO: 1017440 - DNA, 13 bp, Homo sapiens
ctggcagggccag

SEQ ID NO: 1017441 - DNA, 14 bp, Homo sapiens
ctggcagggccagg

SEQ ID NO: 1017442 - DNA, 16 bp, Homo sapiens
ctggcagggccagggc

SEQ ID NO: 1017443 - DNA, 17 bp, Homo sapiens
ctggcagggccagggca

SEQ ID NO: 1017444 - DNA, 21 bp, Homo sapiens
ctggcagggccagggcaatgc

SEQ ID NO: 1017445 - DNA, 23 bp, Homo sapiens
ctggcagggccagggcaatgcca

SEQ ID NO: 1017446 - DNA, 22 bp, Homo sapiens
ctggcagggctcacactcctgg

SEQ ID NO: 1017447 - DNA, 16 bp, Homo sapiens
ctggcagggctttggg

SEQ ID NO: 1017448 - DNA, 21 bp, Homo sapiens
ctggcaggggagacaggagcc

SEQ ID NO: 1017449 - DNA, 14 bp, Homo sapiens
ctggccctggggat

SEQ ID NO: 1017450 - DNA, 14 bp, Homo sapiens
ctggccctgggggt

SEQ ID NO: 1017451 - DNA, 19 bp, Homo sapiens
ctggccctgggggtctggg

SEQ ID NO: 1017452 - DNA, 13 bp, Homo sapiens
ctggccctgtgca

SEQ ID NO: 1017453 - DNA, 19 bp, Homo sapiens
ctggcccttacttgcttct

SEQ ID NO: 1017454 - DNA, 13 bp, Homo sapiens
ctggcccttagag

SEQ ID NO: 1017455 - DNA, 13 bp, Homo sapiens
ctggcccttcagt

SEQ ID NO: 1017456 - DNA, 23 bp, Homo sapiens
ctggcccttcagtctgctccacc

SEQ ID NO: 1017457 - DNA, 13 bp, Homo sapiens
ctggcccttggaa

SEQ ID NO: 1017458 - DNA, 15 bp, Homo sapiens
ctggcccttggaata

SEQ ID NO: 1017459 - DNA, 17 bp, Homo sapiens
ctggccgacccactgac

SEQ ID NO: 1017460 - DNA, 20 bp, Homo sapiens
ctggccgagtccaagctggg

SEQ ID NO: 1017461 - DNA, 20 bp, Homo sapiens
ctggccgccacccccatctt

SEQ ID NO: 1017462 - DNA, 22 bp, Homo sapiens
ctggccgccccctgccccccag

SEQ ID NO: 1017463 - DNA, 20 bp, Homo sapiens
ctggccgcgctccgggcttt

SEQ ID NO: 1017464 - DNA, 16 bp, Homo sapiens
ctggccgctgagcgcc

SEQ ID NO: 1017465 - DNA, 19 bp, Homo sapiens
ctggccggggcccctcacc

SEQ ID NO: 1017466 - DNA, 21 bp, Homo sapiens
ctggccgggtcaccctgtgac

SEQ ID NO: 1017467 - DNA, 15 bp, Homo sapiens
ctggccgtccttgtc

SEQ ID NO: 1017468 - DNA, 21 bp, Homo sapiens
ctggcctaaatttcttctggt

SEQ ID NO: 1017469 - DNA, 17 bp, Homo sapiens
ctggcctagcatacgta

SEQ ID NO: 1017470 - DNA, 16 bp, Homo sapiens
ctggcctcactggctg

SEQ ID NO: 1017471 - DNA, 18 bp, Homo sapiens
ctggcctcagttcccagc

SEQ ID NO: 1017472 - DNA, 13 bp, Homo sapiens
ctggcctccagcc

SEQ ID NO: 1017473 - DNA, 14 bp, Homo sapiens
ctggcctcccaaat

SEQ ID NO: 1017474 - DNA, 17 bp, Homo sapiens
ctggcctcccacagact

SEQ ID NO: 1017475 - DNA, 14 bp, Homo sapiens
ctggcctcccccaa

SEQ ID NO: 1017476 - DNA, 16 bp, Homo sapiens
ctggcctcccccaaca

SEQ ID NO: 1017477 - DNA, 19 bp, Homo sapiens
ctggcctcccccaacacct

SEQ ID NO: 1017478 - DNA, 16 bp, Homo sapiens
ctggcctcccctgcca

SEQ ID NO: 1017479 - DNA, 18 bp, Homo sapiens
ctggcctcccctgccacc

SEQ ID NO: 1017480 - DNA, 23 bp, Homo sapiens
ctggcctcctaaggctccccacc

SEQ ID NO: 1017481 - DNA, 16 bp, Homo sapiens
ctggcctcgcctgcct

SEQ ID NO: 1017482 - DNA, 17 bp, Homo sapiens
ctggcctctctagcaca

SEQ ID NO: 1017483 - DNA, 18 bp, Homo sapiens
ctggcctctctagcacaa

SEQ ID NO: 1017484 - DNA, 21 bp, Homo sapiens
ctggcctctgcttacttttta

SEQ ID NO: 1017485 - DNA, 17 bp, Homo sapiens
ctggcctgaactgagga

SEQ ID NO: 1017486 - DNA, 12 bp, Homo sapiens
ctggcctgactt

SEQ ID NO: 1017487 - DNA, 18 bp, Homo sapiens
ctggcctgacttggggga

SEQ ID NO: 1017488 - DNA, 17 bp, Homo sapiens
ctggcctgagctggggc

SEQ ID NO: 1017489 - DNA, 18 bp, Homo sapiens
ctggcctgagctggggcc

SEQ ID NO: 1017490 - DNA, 16 bp, Homo sapiens
ctggcctgccagtctg

SEQ ID NO: 1017491 - DNA, 14 bp, Homo sapiens
ctggcctgctggga

SEQ ID NO: 1017492 - DNA, 15 bp, Homo sapiens
ctggcctgctgggaa

SEQ ID NO: 1017493 - DNA, 23 bp, Homo sapiens
ctggcctggacagtatcccacat

SEQ ID NO: 1017494 - DNA, 18 bp, Homo sapiens
ctggcctggactgttttc

SEQ ID NO: 1017495 - DNA, 12 bp, Homo sapiens
ctggcctggatc

SEQ ID NO: 1017496 - DNA, 14 bp, Homo sapiens
ctggcctgggccac

SEQ ID NO: 1017497 - DNA, 19 bp, Homo sapiens
ctggcctgggccacacctg

SEQ ID NO: 1017498 - DNA, 23 bp, Homo sapiens
ctggcctgggccacacctgagcg

SEQ ID NO: 1017499 - DNA, 12 bp, Homo sapiens
ctggcctgttct

SEQ ID NO: 1017500 - DNA, 22 bp, Homo sapiens
ctggccttaaagagggacaggc

SEQ ID NO: 1017501 - DNA, 15 bp, Homo sapiens
ctggccttcctcgtt

SEQ ID NO: 1017502 - DNA, 14 bp, Homo sapiens
ctggccttctccta

SEQ ID NO: 1017503 - DNA, 13 bp, Homo sapiens
ctggccttgcccg

SEQ ID NO: 1017504 - DNA, 20 bp, Homo sapiens
ctggccttggtatgtgccag

SEQ ID NO: 1017505 - DNA, 23 bp, Homo sapiens
ctggccttggtatgtgccaggct

SEQ ID NO: 1017506 - DNA, 15 bp, Homo sapiens
ctggccttgtcctca

SEQ ID NO: 1017507 - DNA, 21 bp, Homo sapiens
ctggcctttcaggtccaggcc

SEQ ID NO: 1017508 - DNA, 22 bp, Homo sapiens
ctggcctttcaggtccaggcca

SEQ ID NO: 1017509 - DNA, 14 bp, Homo sapiens
ctggcctttgtaag

SEQ ID NO: 1017510 - DNA, 14 bp, Homo sapiens
ctggccttttccta

SEQ ID NO: 1017511 - DNA, 21 bp, Homo sapiens
ctggcctttttcatttatcta

SEQ ID NO: 1017512 - DNA, 23 bp, Homo sapiens
ctggcgacacactccgtccatcc

SEQ ID NO: 1017513 - DNA, 16 bp, Homo sapiens
ctggcgacactcaggg

SEQ ID NO: 1017514 - DNA, 20 bp, Homo sapiens
ctggcgacactcagggcagc

SEQ ID NO: 1017515 - DNA, 21 bp, Homo sapiens
ctggcgacactcagggcagct

SEQ ID NO: 1017516 - DNA, 24 bp, Homo sapiens
ctggcgacactcagggcagctgcc

SEQ ID NO: 1017517 - DNA, 20 bp, Homo sapiens
ctggcgacagttttccttct

SEQ ID NO: 1017518 - DNA, 15 bp, Homo sapiens
ctggcgagttctctt

SEQ ID NO: 1017519 - DNA, 12 bp, Homo sapiens
ctggcgcagcca

SEQ ID NO: 1017520 - DNA, 14 bp, Homo sapiens
ctggcgcaggtggg

SEQ ID NO: 1017521 - DNA, 16 bp, Homo sapiens
ctggcgcaggtgggct

SEQ ID NO: 1017522 - DNA, 20 bp, Homo sapiens
ctggcgcccctgcctgtgcc

SEQ ID NO: 1017523 - DNA, 16 bp, Homo sapiens
ctggcgcttggatctg

SEQ ID NO: 1017524 - DNA, 17 bp, Homo sapiens
ctggcggctactcagca

SEQ ID NO: 1017525 - DNA, 13 bp, Homo sapiens
ctggcggcttcct

SEQ ID NO: 1017526 - DNA, 17 bp, Homo sapiens
ctggcggcttcctgtcc

SEQ ID NO: 1017527 - DNA, 20 bp, Homo sapiens
ctggcggtggccacagcgtg

SEQ ID NO: 1017528 - DNA, 13 bp, Homo sapiens
ctggcgtctgtct

SEQ ID NO: 1017529 - DNA, 16 bp, Homo sapiens
ctggcgtgctcagacc

SEQ ID NO: 1017530 - DNA, 19 bp, Homo sapiens
ctggcgttctcaagaatct

SEQ ID NO: 1017531 - DNA, 20 bp, Homo sapiens
ctggcgttctcaagaatcta

SEQ ID NO: 1017532 - DNA, 17 bp, Homo sapiens
ctggctaactggaagca

SEQ ID NO: 1017533 - DNA, 21 bp, Homo sapiens
ctggctagaggccagccccac

SEQ ID NO: 1017534 - DNA, 22 bp, Homo sapiens
ctggctagaggccagccccacc

SEQ ID NO: 1017535 - DNA, 21 bp, Homo sapiens
ctggctagagtcctcactccc

SEQ ID NO: 1017536 - DNA, 18 bp, Homo sapiens
ctggctagcattcctcag

SEQ ID NO: 1017537 - DNA, 15 bp, Homo sapiens
ctggctcacacatcc

SEQ ID NO: 1017538 - DNA, 17 bp, Homo sapiens
ctggctcacagtacagc

SEQ ID NO: 1017539 - DNA, 19 bp, Homo sapiens
ctggctcacagtacagcat

SEQ ID NO: 1017540 - DNA, 21 bp, Homo sapiens
ctggctcacgccccgctgtgt

SEQ ID NO: 1017541 - DNA, 20 bp, Homo sapiens
ctggctcacgcgttctggga

SEQ ID NO: 1017542 - DNA, 17 bp, Homo sapiens
ctggctcagcctgtctc

SEQ ID NO: 1017543 - DNA, 18 bp, Homo sapiens
ctggctcagcctgtctcg

SEQ ID NO: 1017544 - DNA, 11 bp, Homo sapiens
ctggctcatgc

SEQ ID NO: 1017545 - DNA, 16 bp, Homo sapiens
ctggctcatgcccctt

SEQ ID NO: 1017546 - DNA, 15 bp, Homo sapiens
tgagcaaatgtggct

SEQ ID NO: 1017547 - DNA, 18 bp, Homo sapiens
tgagcaactcttgattat

SEQ ID NO: 1017548 - DNA, 19 bp, Homo sapiens
tgagcaagaccctgtctct

SEQ ID NO: 1017549 - DNA, 17 bp, Homo sapiens
tgagcaagatgatgtaa

SEQ ID NO: 1017550 - DNA, 23 bp, Homo sapiens
tgagcaaggagcacaagccacaa

SEQ ID NO: 1017551 - DNA, 16 bp, Homo sapiens
tgagcaagggggccca

SEQ ID NO: 1017552 - DNA, 16 bp, Homo sapiens
tgagcaatgtctgtgc

SEQ ID NO: 1017553 - DNA, 18 bp, Homo sapiens
tgagcaatgtctgtgcta

SEQ ID NO: 1017554 - DNA, 20 bp, Homo sapiens
tgagcacactttagtggccg

SEQ ID NO: 1017555 - DNA, 13 bp, Homo sapiens
tgagcacaggtga

SEQ ID NO: 1017556 - DNA, 23 bp, Homo sapiens
tgagcacagtcaggggctgggca

SEQ ID NO: 1017557 - DNA, 19 bp, Homo sapiens
tgagcacatagtgtcctgc

SEQ ID NO: 1017558 - DNA, 20 bp, Homo sapiens
tgagcacatagtgtcctgcc

SEQ ID NO: 1017559 - DNA, 21 bp, Homo sapiens
tgagcacatagtgtcctgccc

SEQ ID NO: 1017560 - DNA, 22 bp, Homo sapiens
tgagcacatagtgtcctgccca

SEQ ID NO: 1017561 - DNA, 23 bp, Homo sapiens
tgagcacatgcgtatatgtgcgt

SEQ ID NO: 1017562 - DNA, 19 bp, Homo sapiens
tgagcaccgtcatggctta

SEQ ID NO: 1017563 - DNA, 21 bp, Homo sapiens
tgagcaccgtgtcaagctgct

SEQ ID NO: 1017564 - DNA, 22 bp, Homo sapiens
tgagcaccgtgtcaagctgctc

SEQ ID NO: 1017565 - DNA, 12 bp, Homo sapiens
tgagcagaacag

SEQ ID NO: 1017566 - DNA, 16 bp, Homo sapiens
tgagcagaacaggtag

SEQ ID NO: 1017567 - DNA, 18 bp, Homo sapiens
tgagcagaatgttgtact

SEQ ID NO: 1017568 - DNA, 11 bp, Homo sapiens
tgagcagaccg

SEQ ID NO: 1017569 - DNA, 17 bp, Homo sapiens
tgagcagagatgtactg

SEQ ID NO: 1017570 - DNA, 22 bp, Homo sapiens
tgagcagagatgtactgcaaag

SEQ ID NO: 1017571 - DNA, 23 bp, Homo sapiens
tgagcagccgccagctgggagca

SEQ ID NO: 1017572 - DNA, 14 bp, Homo sapiens
tgagcagcctctgg

SEQ ID NO: 1017573 - DNA, 15 bp, Homo sapiens
tgagcagctactgta

SEQ ID NO: 1017574 - DNA, 20 bp, Homo sapiens
tgagcagctactgtaacttt

SEQ ID NO: 1017575 - DNA, 21 bp, Homo sapiens
tgagcagctactgtaactttt

SEQ ID NO: 1017576 - DNA, 18 bp, Homo sapiens
tgagcaggacagccagca

SEQ ID NO: 1017577 - DNA, 13 bp, Homo sapiens
tgagcaggctgtg

SEQ ID NO: 1017578 - DNA, 17 bp, Homo sapiens
tgagcagggatcctggt

SEQ ID NO: 1017579 - DNA, 13 bp, Homo sapiens
tgagcagggcttg

SEQ ID NO: 1017580 - DNA, 23 bp, Homo sapiens
tgagcagggcttgctcctgccaa

SEQ ID NO: 1017581 - DNA, 14 bp, Homo sapiens
tgagcaggggcagg

SEQ ID NO: 1017582 - DNA, 23 bp, Homo sapiens
tgagcaggggcaggcgcagaggt

SEQ ID NO: 1017583 - DNA, 13 bp, Homo sapiens
tgagcagggtggg

SEQ ID NO: 1017584 - DNA, 20 bp, Homo sapiens
tgagcagggtggggtctggg

SEQ ID NO: 1017585 - DNA, 14 bp, Homo sapiens
tgagcagtggctgg

SEQ ID NO: 1017586 - DNA, 18 bp, Homo sapiens
tgagcagtggctggtcca

SEQ ID NO: 1017587 - DNA, 22 bp, Homo sapiens
tgagcatatctggtatatgtca

SEQ ID NO: 1017588 - DNA, 17 bp, Homo sapiens
tgagcatcaatcttgtt

SEQ ID NO: 1017589 - DNA, 14 bp, Homo sapiens
tgagcatcctgagc

SEQ ID NO: 1017590 - DNA, 16 bp, Homo sapiens
tgagcatcctgagccc

SEQ ID NO: 1017591 - DNA, 17 bp, Homo sapiens
tgagcatcctgagcccc

SEQ ID NO: 1017592 - DNA, 19 bp, Homo sapiens
tgagcatcctgagccccgc

SEQ ID NO: 1017593 - DNA, 14 bp, Homo sapiens
tgagcatcctgcaa

SEQ ID NO: 1017594 - DNA, 18 bp, Homo sapiens
tgagcatcttgccagcct

SEQ ID NO: 1017595 - DNA, 18 bp, Homo sapiens
tgagcatgcacagctgct

SEQ ID NO: 1017596 - DNA, 17 bp, Homo sapiens
tgagcatggcagctggt

SEQ ID NO: 1017597 - DNA, 14 bp, Homo sapiens
tgagcattcaggca

SEQ ID NO: 1017598 - DNA, 20 bp, Homo sapiens
tgagcattcaggcagcactg

SEQ ID NO: 1017599 - DNA, 14 bp, Homo sapiens
tgagccaagaaaca

SEQ ID NO: 1017600 - DNA, 14 bp, Homo sapiens
tgagccaaggaggc

SEQ ID NO: 1017601 - DNA, 19 bp, Homo sapiens
tgagccaaggaggcctggg

SEQ ID NO: 1017602 - DNA, 13 bp, Homo sapiens
tgagccaagggag

SEQ ID NO: 1017603 - DNA, 23 bp, Homo sapiens
tgagccaagggagggaagggcca

SEQ ID NO: 1017604 - DNA, 20 bp, Homo sapiens
tgagccacagaaagctcctt

SEQ ID NO: 1017605 - DNA, 15 bp, Homo sapiens
tgagccaccgtgcct

SEQ ID NO: 1017606 - DNA, 18 bp, Homo sapiens
tgagccaccgtgcctggc

SEQ ID NO: 1017607 - DNA, 19 bp, Homo sapiens
tgagccaccgtgcctggcc

SEQ ID NO: 1017608 - DNA, 21 bp, Homo sapiens
tgagccaccgtgcctggccag

SEQ ID NO: 1017609 - DNA, 16 bp, Homo sapiens
tgagccactccttcct

SEQ ID NO: 1017610 - DNA, 21 bp, Homo sapiens
tgagccactgcacctgcccag

SEQ ID NO: 1017611 - DNA, 17 bp, Homo sapiens
tgagccactgtgcttgg

SEQ ID NO: 1017612 - DNA, 19 bp, Homo sapiens
tgagccactgtgcttggcc

SEQ ID NO: 1017613 - DNA, 15 bp, Homo sapiens
tgagccactgttccc

SEQ ID NO: 1017614 - DNA, 20 bp, Homo sapiens
tgagccagccaggccctgcc

SEQ ID NO: 1017615 - DNA, 18 bp, Homo sapiens
tgagccaggcctgggtct

SEQ ID NO: 1017616 - DNA, 16 bp, Homo sapiens
tgagccagtaatcttt

SEQ ID NO: 1017617 - DNA, 13 bp, Homo sapiens
tgagccagtccca

SEQ ID NO: 1017618 - DNA, 14 bp, Homo sapiens
tgagccagtcccag

SEQ ID NO: 1017619 - DNA, 18 bp, Homo sapiens
tgagccagtcccaggggc

SEQ ID NO: 1017620 - DNA, 20 bp, Homo sapiens
tgagccatcactagaagaaa

SEQ ID NO: 1017621 - DNA, 20 bp, Homo sapiens
tgagccatgcctccctgggc

SEQ ID NO: 1017622 - DNA, 18 bp, Homo sapiens
tgagccatgctacagtta

SEQ ID NO: 1017623 - DNA, 22 bp, Homo sapiens
tgagcccaaccaggccctgcca

SEQ ID NO: 1017624 - DNA, 15 bp, Homo sapiens
tgagcccacaaagcc

SEQ ID NO: 1017625 - DNA, 12 bp, Homo sapiens
tgagcccactcc

SEQ ID NO: 1017626 - DNA, 13 bp, Homo sapiens
tgagcccactcct

SEQ ID NO: 1017627 - DNA, 21 bp, Homo sapiens
tgagcccactgcccaccccct

SEQ ID NO: 1017628 - DNA, 13 bp, Homo sapiens
tgagcccagagaa

SEQ ID NO: 1017629 - DNA, 16 bp, Homo sapiens
tgagcccagagaacag

SEQ ID NO: 1017630 - DNA, 17 bp, Homo sapiens
tgagcccagagaacagc

SEQ ID NO: 1017631 - DNA, 21 bp, Homo sapiens
tgagcccagctgggtcaggca

SEQ ID NO: 1017632 - DNA, 12 bp, Homo sapiens
tgagcccaggag

SEQ ID NO: 1017633 - DNA, 22 bp, Homo sapiens
tgagcccaggagctgagtcacc

SEQ ID NO: 1017634 - DNA, 22 bp, Homo sapiens
tgagcccaggagtttgagacaa

SEQ ID NO: 1017635 - DNA, 12 bp, Homo sapiens
tgagcccaggcc

SEQ ID NO: 1017636 - DNA, 21 bp, Homo sapiens
tgagcccatgttctgccccca

SEQ ID NO: 1017637 - DNA, 17 bp, Homo sapiens
tgagcccattcttctgg

SEQ ID NO: 1017638 - DNA, 17 bp, Homo sapiens
tgagccccaagtcctga

SEQ ID NO: 1017639 - DNA, 21 bp, Homo sapiens
tgagccccaagtcctgaagag

SEQ ID NO: 1017640 - DNA, 19 bp, Homo sapiens
tgagccccacctctccaag

SEQ ID NO: 1017641 - DNA, 23 bp, Homo sapiens
tgagccccagggtgcccagaact

SEQ ID NO: 1017642 - DNA, 19 bp, Homo sapiens
tgagccccagtgctggaag

SEQ ID NO: 1017643 - DNA, 19 bp, Homo sapiens
tgagcccccaccggaactg

SEQ ID NO: 1017644 - DNA, 20 bp, Homo sapiens
tgagcccccccaacactgtg

SEQ ID NO: 1017645 - DNA, 19 bp, Homo sapiens
tgagccccgccctcttcct

SEQ ID NO: 1017646 - DNA, 21 bp, Homo sapiens
tgagccccgccctcttcctga

SEQ ID NO: 1017647 - DNA, 19 bp, Homo sapiens
tgagcccctaccccacacc

SEQ ID NO: 1017648 - DNA, 22 bp, Homo sapiens
tgagcccctaccccacaccagg

SEQ ID NO: 1017649 - DNA, 14 bp, Homo sapiens
tgagcccctcccca

SEQ ID NO: 1017650 - DNA, 18 bp, Homo sapiens
tgagcccctccccagcca

SEQ ID NO: 1017651 - DNA, 19 bp, Homo sapiens
tgagcccctccccagccag

SEQ ID NO: 1017652 - DNA, 15 bp, Homo sapiens
tgagcccctggaggc

SEQ ID NO: 1017653 - DNA, 14 bp, Homo sapiens
tgagcccctggtct

SEQ ID NO: 1017654 - DNA, 22 bp, Homo sapiens
tgagcccctgtctagagaggga

SEQ ID NO: 1017655 - DNA, 23 bp, Homo sapiens
tgagccccttcatccgcctgtgg

SEQ ID NO: 1017656 - DNA, 12 bp, Homo sapiens
tgagccccttcc

SEQ ID NO: 1017657 - DNA, 22 bp, Homo sapiens
tgagcccggccctcccccagct

SEQ ID NO: 1017658 - DNA, 14 bp, Homo sapiens
tgagcccgggctgc

SEQ ID NO: 1017659 - DNA, 15 bp, Homo sapiens
tgagcccgggctgcc

SEQ ID NO: 1017660 - DNA, 18 bp, Homo sapiens
tgagcccgggctgcctgg

SEQ ID NO: 1017661 - DNA, 16 bp, Homo sapiens
tgagccctctagggca

SEQ ID NO: 1017662 - DNA, 20 bp, Homo sapiens
tgagccctctcactccagcc

SEQ ID NO: 1017663 - DNA, 13 bp, Homo sapiens
tgagccctggctc

SEQ ID NO: 1017664 - DNA, 14 bp, Homo sapiens
tgagccctggctcc

SEQ ID NO: 1017665 - DNA, 19 bp, Homo sapiens
tgagccctggctcccacct

SEQ ID NO: 1017666 - DNA, 20 bp, Homo sapiens
tgagccctggctcccacctg

SEQ ID NO: 1017667 - DNA, 16 bp, Homo sapiens
tgagccctgtacccac

SEQ ID NO: 1017668 - DNA, 20 bp, Homo sapiens
tgagccctgtacccacccca

SEQ ID NO: 1017669 - DNA, 19 bp, Homo sapiens
tgagccgagattgcaccac

SEQ ID NO: 1017670 - DNA, 15 bp, Homo sapiens
ggcactgactgatag

SEQ ID NO: 1017671 - DNA, 12 bp, Homo sapiens
ggcactgagccc

SEQ ID NO: 1017672 - DNA, 13 bp, Homo sapiens
ggcactgagcctg

SEQ ID NO: 1017673 - DNA, 16 bp, Homo sapiens
ggcactgagggatctg

SEQ ID NO: 1017674 - DNA, 21 bp, Homo sapiens
ggcactgcccttttcaggaag

SEQ ID NO: 1017675 - DNA, 13 bp, Homo sapiens
ggcactgccttct

SEQ ID NO: 1017676 - DNA, 20 bp, Homo sapiens
ggcactgctccaagggacag

SEQ ID NO: 1017677 - DNA, 20 bp, Homo sapiens
ggcactggcattgtccctgt

SEQ ID NO: 1017678 - DNA, 16 bp, Homo sapiens
ggcactggcgaggaga

SEQ ID NO: 1017679 - DNA, 17 bp, Homo sapiens
ggcactgggaggcaggg

SEQ ID NO: 1017680 - DNA, 22 bp, Homo sapiens
ggcactgggctgttgttccatt

SEQ ID NO: 1017681 - DNA, 14 bp, Homo sapiens
ggcactggtgggcc

SEQ ID NO: 1017682 - DNA, 15 bp, Homo sapiens
ggcactgtggccctt

SEQ ID NO: 1017683 - DNA, 16 bp, Homo sapiens
ggcactgtggcccttc

SEQ ID NO: 1017684 - DNA, 20 bp, Homo sapiens
ggcacttaagtgcacttttt

SEQ ID NO: 1017685 - DNA, 19 bp, Homo sapiens
ggcacttaatttgtaaact

SEQ ID NO: 1017686 - DNA, 21 bp, Homo sapiens
ggcacttaatttgtaaacttc

SEQ ID NO: 1017687 - DNA, 22 bp, Homo sapiens
ggcacttaatttgtaaacttct

SEQ ID NO: 1017688 - DNA, 17 bp, Homo sapiens
ggcacttagcccaagag

SEQ ID NO: 1017689 - DNA, 18 bp, Homo sapiens
ggcacttcctccacagtc

SEQ ID NO: 1017690 - DNA, 16 bp, Homo sapiens
ggcacttgattccttg

SEQ ID NO: 1017691 - DNA, 19 bp, Homo sapiens
ggcacttggaggacctggc

SEQ ID NO: 1017692 - DNA, 11 bp, Homo sapiens
ggcacttgtat

SEQ ID NO: 1017693 - DNA, 18 bp, Homo sapiens
ggcactttaaaacactct

SEQ ID NO: 1017694 - DNA, 14 bp, Homo sapiens
ggcactttttaatt

SEQ ID NO: 1017695 - DNA, 17 bp, Homo sapiens
ggcagaaacaataaaac

SEQ ID NO: 1017696 - DNA, 16 bp, Homo sapiens
ggcagaaacaggaggc

SEQ ID NO: 1017697 - DNA, 20 bp, Homo sapiens
ggcagaaacctatctcaggg

SEQ ID NO: 1017698 - DNA, 21 bp, Homo sapiens
ggcagaaacctatctcaggga

SEQ ID NO: 1017699 - DNA, 23 bp, Homo sapiens
ggcagaaacctatctcagggagg

SEQ ID NO: 1017700 - DNA, 17 bp, Homo sapiens
ggcagaaagcaaaatta

SEQ ID NO: 1017701 - DNA, 22 bp, Homo sapiens
ggcagaaaggaaaacctgaaga

SEQ ID NO: 1017702 - DNA, 20 bp, Homo sapiens
ggcagaaatcgagagtgtgc

SEQ ID NO: 1017703 - DNA, 22 bp, Homo sapiens
ggcagaaatgattaaaatgttt

SEQ ID NO: 1017704 - DNA, 14 bp, Homo sapiens
ggcagaacagccgc

SEQ ID NO: 1017705 - DNA, 20 bp, Homo sapiens
ggcagaacagccgctcctgt

SEQ ID NO: 1017706 - DNA, 13 bp, Homo sapiens
ggcagaactgagc

SEQ ID NO: 1017707 - DNA, 23 bp, Homo sapiens
ggcagaagactagaggccagggc

SEQ ID NO: 1017708 - DNA, 15 bp, Homo sapiens
ggcagaagtcagccc

SEQ ID NO: 1017709 - DNA, 16 bp, Homo sapiens
ggcagaatggctgcac

SEQ ID NO: 1017710 - DNA, 14 bp, Homo sapiens
ggcagacaagagct

SEQ ID NO: 1017711 - DNA, 18 bp, Homo sapiens
ggcagacaagagctgctg

SEQ ID NO: 1017712 - DNA, 14 bp, Homo sapiens
ggcagacacaaccc

SEQ ID NO: 1017713 - DNA, 17 bp, Homo sapiens
ggcagacacggatctga

SEQ ID NO: 1017714 - DNA, 15 bp, Homo sapiens
ggcagacagcagctc

SEQ ID NO: 1017715 - DNA, 19 bp, Homo sapiens
ggcagacagcagctcaggc

SEQ ID NO: 1017716 - DNA, 17 bp, Homo sapiens
ggcagacagcaggcagc

SEQ ID NO: 1017717 - DNA, 23 bp, Homo sapiens
ggcagacagcaggcagcgccaag

SEQ ID NO: 1017718 - DNA, 18 bp, Homo sapiens
ggcagactcaaggggctg

SEQ ID NO: 1017719 - DNA, 14 bp, Homo sapiens
ggcagactgggttt

SEQ ID NO: 1017720 - DNA, 14 bp, Homo sapiens
ggcagactgtgaac

SEQ ID NO: 1017721 - DNA, 16 bp, Homo sapiens
ggcagagaaggcctct

SEQ ID NO: 1017722 - DNA, 15 bp, Homo sapiens
ggcagagaagttctc

SEQ ID NO: 1017723 - DNA, 14 bp, Homo sapiens
ggcagagaatcata

SEQ ID NO: 1017724 - DNA, 14 bp, Homo sapiens
ggcagagaatctct

SEQ ID NO: 1017725 - DNA, 19 bp, Homo sapiens
ggcagagaatctcttggga

SEQ ID NO: 1017726 - DNA, 17 bp, Homo sapiens
ggcagagaggaagtggt

SEQ ID NO: 1017727 - DNA, 14 bp, Homo sapiens
ggcagagaggagtg

SEQ ID NO: 1017728 - DNA, 21 bp, Homo sapiens
ggcagagagtacagactgcag

SEQ ID NO: 1017729 - DNA, 15 bp, Homo sapiens
ggcagagcacagccc

SEQ ID NO: 1017730 - DNA, 13 bp, Homo sapiens
ggcagagccatgg

SEQ ID NO: 1017731 - DNA, 24 bp, Homo sapiens
ggcagagccatgggcctgggcctg

SEQ ID NO: 1017732 - DNA, 16 bp, Homo sapiens
ggcagagccgggaagc

SEQ ID NO: 1017733 - DNA, 14 bp, Homo sapiens
ggcagagcctgtcc

SEQ ID NO: 1017734 - DNA, 13 bp, Homo sapiens
ggcagaggcctgg

SEQ ID NO: 1017735 - DNA, 12 bp, Homo sapiens
ggcagaggctgg

SEQ ID NO: 1017736 - DNA, 13 bp, Homo sapiens
ggcagaggctgga

SEQ ID NO: 1017737 - DNA, 13 bp, Homo sapiens
ggcagaggctggc

SEQ ID NO: 1017738 - DNA, 22 bp, Homo sapiens
ggcagagggaatgttccctgca

SEQ ID NO: 1017739 - DNA, 16 bp, Homo sapiens
ggcagagggcagaggc

SEQ ID NO: 1017740 - DNA, 20 bp, Homo sapiens
ggcagagggcagaggctgga

SEQ ID NO: 1017741 - DNA, 18 bp, Homo sapiens
ggcagaggggcagccgct

SEQ ID NO: 1017742 - DNA, 21 bp, Homo sapiens
ggcagaggttgcagtgagccg

SEQ ID NO: 1017743 - DNA, 21 bp, Homo sapiens
ggcagaggttttaatgtctgt

SEQ ID NO: 1017744 - DNA, 18 bp, Homo sapiens
ggcagagttacagttctg

SEQ ID NO: 1017745 - DNA, 15 bp, Homo sapiens
ggcagagttgtaaat

SEQ ID NO: 1017746 - DNA, 20 bp, Homo sapiens
ggcagataatcagcctctta

SEQ ID NO: 1017747 - DNA, 18 bp, Homo sapiens
ggcagatcctctggacac

SEQ ID NO: 1017748 - DNA, 18 bp, Homo sapiens
ggcagatcttttctttaa

SEQ ID NO: 1017749 - DNA, 17 bp, Homo sapiens
ggcagatgtcttccctg

SEQ ID NO: 1017750 - DNA, 13 bp, Homo sapiens
ggcagattgaaaa

SEQ ID NO: 1017751 - DNA, 24 bp, Homo sapiens
ggcagatttagtgaaagctagaga

SEQ ID NO: 1017752 - DNA, 15 bp, Homo sapiens
ggcagcaacaataaa

SEQ ID NO: 1017753 - DNA, 13 bp, Homo sapiens
ggcagcaaggctg

SEQ ID NO: 1017754 - DNA, 17 bp, Homo sapiens
ggcagcaaggctgctgc

SEQ ID NO: 1017755 - DNA, 18 bp, Homo sapiens
ggcagcaaggctgctgcc

SEQ ID NO: 1017756 - DNA, 15 bp, Homo sapiens
ggcagcaagggacct

SEQ ID NO: 1017757 - DNA, 14 bp, Homo sapiens
ggcagcacagccca

SEQ ID NO: 1017758 - DNA, 17 bp, Homo sapiens
ggcagcacagcccaggg

SEQ ID NO: 1017759 - DNA, 18 bp, Homo sapiens
ggcagcacagcccagggc

SEQ ID NO: 1017760 - DNA, 21 bp, Homo sapiens
ggcagcacagcccagggcctg

SEQ ID NO: 1017761 - DNA, 23 bp, Homo sapiens
ggcagcacagcccagggcctgca

SEQ ID NO: 1017762 - DNA, 20 bp, Homo sapiens
ggcagcacagtgtgtgaact

SEQ ID NO: 1017763 - DNA, 15 bp, Homo sapiens
ggcagcaccacactg

SEQ ID NO: 1017764 - DNA, 14 bp, Homo sapiens
ggcagcaccctccc

SEQ ID NO: 1017765 - DNA, 20 bp, Homo sapiens
ggcagcaccctcccccgcag

SEQ ID NO: 1017766 - DNA, 22 bp, Homo sapiens
ggcagcacggcccggcccctca

SEQ ID NO: 1017767 - DNA, 22 bp, Homo sapiens
ggcagcactccccagagctgtg

SEQ ID NO: 1017768 - DNA, 23 bp, Homo sapiens
ggcagcactccccagagctgtgc

SEQ ID NO: 1017769 - DNA, 19 bp, Homo sapiens
ggcagcactgggaagctgg

SEQ ID NO: 1017770 - DNA, 16 bp, Homo sapiens
ggcagcagacacatgc

SEQ ID NO: 1017771 - DNA, 14 bp, Homo sapiens
ggcagcagcagccc

SEQ ID NO: 1017772 - DNA, 15 bp, Homo sapiens
ggcagcagcatccca

SEQ ID NO: 1017773 - DNA, 15 bp, Homo sapiens
ggcagcaggggctgc

SEQ ID NO: 1017774 - DNA, 12 bp, Homo sapiens
ggcagcagtgaa

SEQ ID NO: 1017775 - DNA, 13 bp, Homo sapiens
ggcagcagtgaag

SEQ ID NO: 1017776 - DNA, 22 bp, Homo sapiens
ggcagcagtgtgaggccagggc

SEQ ID NO: 1017777 - DNA, 19 bp, Homo sapiens
ggcagcatagcaagacaca

SEQ ID NO: 1017778 - DNA, 18 bp, Homo sapiens
ggcagcatgcttgggctg

SEQ ID NO: 1017779 - DNA, 19 bp, Homo sapiens
ggcagcatgcttgggctga

SEQ ID NO: 1017780 - DNA, 19 bp, Homo sapiens
ggcagccaaacccatgagg

SEQ ID NO: 1017781 - DNA, 12 bp, Homo sapiens
ggcagccaagga

SEQ ID NO: 1017782 - DNA, 16 bp, Homo sapiens
ggcagccacacgcagg

SEQ ID NO: 1017783 - DNA, 22 bp, Homo sapiens
ggcagccacacgcaggcggcca

SEQ ID NO: 1017784 - DNA, 13 bp, Homo sapiens
ggcagccacagga

SEQ ID NO: 1017785 - DNA, 16 bp, Homo sapiens
ggcagccacaggactg

SEQ ID NO: 1017786 - DNA, 21 bp, Homo sapiens
ggcagccacaggactgagccc

SEQ ID NO: 1017787 - DNA, 23 bp, Homo sapiens
ggcagccacaggactgagccctc

SEQ ID NO: 1017788 - DNA, 22 bp, Homo sapiens
ggcagccacccaagcctgctgg

SEQ ID NO: 1017789 - DNA, 15 bp, Homo sapiens
ggcagccagatggcc

SEQ ID NO: 1017790 - DNA, 13 bp, Homo sapiens
ggcagccaggctg

SEQ ID NO: 1017791 - DNA, 16 bp, Homo sapiens
ggcagccaggctgggc

SEQ ID NO: 1017792 - DNA, 18 bp, Homo sapiens
ggcagccaggctgggccg

SEQ ID NO: 1017793 - DNA, 22 bp, Homo sapiens
ggcagccagtgagatgagggat

SEQ ID NO: 1017794 - DNA, 14 bp, Homo sapiens
ggcagccatgcctc

SEQ ID NO: 1017795 - DNA, 20 bp, Homo sapiens
tgagccgcatcttctccatc

SEQ ID NO: 1017796 - DNA, 23 bp, Homo sapiens
tgagccgcatcttctccatctgg

SEQ ID NO: 1017797 - DNA, 15 bp, Homo sapiens
tgagccgcggggaag

SEQ ID NO: 1017798 - DNA, 21 bp, Homo sapiens
tgagccgctgtgagcccctgg

SEQ ID NO: 1017799 - DNA, 14 bp, Homo sapiens
tgagccgtgaactg

SEQ ID NO: 1017800 - DNA, 16 bp, Homo sapiens
tgagcctacgctgaag

SEQ ID NO: 1017801 - DNA, 14 bp, Homo sapiens
tgagcctcacagca

SEQ ID NO: 1017802 - DNA, 15 bp, Homo sapiens
tgagcctcacagcag

SEQ ID NO: 1017803 - DNA, 14 bp, Homo sapiens
tgagcctcagtctc

SEQ ID NO: 1017804 - DNA, 12 bp, Homo sapiens
tgagcctcctgt

SEQ ID NO: 1017805 - DNA, 19 bp, Homo sapiens
tgagcctcctgtgcctggc

SEQ ID NO: 1017806 - DNA, 17 bp, Homo sapiens
tgagcctcgtgtcatct

SEQ ID NO: 1017807 - DNA, 17 bp, Homo sapiens
tgagcctcgtgtccaga

SEQ ID NO: 1017808 - DNA, 12 bp, Homo sapiens
tgagcctctgct

SEQ ID NO: 1017809 - DNA, 12 bp, Homo sapiens
tgagcctctttg

SEQ ID NO: 1017810 - DNA, 14 bp, Homo sapiens
tgagcctgagcaga

SEQ ID NO: 1017811 - DNA, 20 bp, Homo sapiens
tgagcctgccaaagtgcctg

SEQ ID NO: 1017812 - DNA, 20 bp, Homo sapiens
tgagcctgcccgctgcaatg

SEQ ID NO: 1017813 - DNA, 16 bp, Homo sapiens
tgagcctggcaagaat

SEQ ID NO: 1017814 - DNA, 13 bp, Homo sapiens
tgagcctggctgg

SEQ ID NO: 1017815 - DNA, 17 bp, Homo sapiens
tgagcctggctggcaca

SEQ ID NO: 1017816 - DNA, 14 bp, Homo sapiens
tgagcctgggaggt

SEQ ID NO: 1017817 - DNA, 19 bp, Homo sapiens
tgagcctgggaggtcaagg

SEQ ID NO: 1017818 - DNA, 14 bp, Homo sapiens
tgagcctgggcagc

SEQ ID NO: 1017819 - DNA, 20 bp, Homo sapiens
tgagcctgtgggtccccact

SEQ ID NO: 1017820 - DNA, 21 bp, Homo sapiens
tgagcctgtgggtccccactc

SEQ ID NO: 1017821 - DNA, 14 bp, Homo sapiens
tgagccttcagtct

SEQ ID NO: 1017822 - DNA, 19 bp, Homo sapiens
tgagccttcgtgccccccc

SEQ ID NO: 1017823 - DNA, 18 bp, Homo sapiens
tgagccttgaactttgac

SEQ ID NO: 1017824 - DNA, 20 bp, Homo sapiens
tgagccttgcatgtacttga

SEQ ID NO: 1017825 - DNA, 13 bp, Homo sapiens
tgagccttgtaat

SEQ ID NO: 1017826 - DNA, 13 bp, Homo sapiens
tgagcgcttgggc

SEQ ID NO: 1017827 - DNA, 21 bp, Homo sapiens
tgagcgtggaagggggaggag

SEQ ID NO: 1017828 - DNA, 14 bp, Homo sapiens
tgagcgtggccttg

SEQ ID NO: 1017829 - DNA, 15 bp, Homo sapiens
tgagcgtggccttgg

SEQ ID NO: 1017830 - DNA, 18 bp, Homo sapiens
tgagcgtggccttgggag

SEQ ID NO: 1017831 - DNA, 22 bp, Homo sapiens
tgagcgtgtagcgtcctgagga

SEQ ID NO: 1017832 - DNA, 15 bp, Homo sapiens
tgagctacaggacaa

SEQ ID NO: 1017833 - DNA, 12 bp, Homo sapiens
tgagctagcctc

SEQ ID NO: 1017834 - DNA, 17 bp, Homo sapiens
tgagctagctagcgcac

SEQ ID NO: 1017835 - DNA, 15 bp, Homo sapiens
tgagctagtgtctta

SEQ ID NO: 1017836 - DNA, 17 bp, Homo sapiens
tgagctagtgtcttatg

SEQ ID NO: 1017837 - DNA, 21 bp, Homo sapiens
tgagctatttccattccagaa

SEQ ID NO: 1017838 - DNA, 18 bp, Homo sapiens
tgagctattttcctctgg

SEQ ID NO: 1017839 - DNA, 19 bp, Homo sapiens
tgagctattttcctctggc

SEQ ID NO: 1017840 - DNA, 24 bp, Homo sapiens
tgagctattttcctctggccgcag

SEQ ID NO: 1017841 - DNA, 21 bp, Homo sapiens
tgagctcacatgggactggga

SEQ ID NO: 1017842 - DNA, 18 bp, Homo sapiens
tgagctcagacccccact

SEQ ID NO: 1017843 - DNA, 20 bp, Homo sapiens
tgagctcagccctggtgggc

SEQ ID NO: 1017844 - DNA, 15 bp, Homo sapiens
tgagctccacctctg

SEQ ID NO: 1017845 - DNA, 18 bp, Homo sapiens
tgagctccacctctggtg

SEQ ID NO: 1017846 - DNA, 19 bp, Homo sapiens
tgagctccacctctggtgg

SEQ ID NO: 1017847 - DNA, 23 bp, Homo sapiens
tgagctccacctctggtggctcc

SEQ ID NO: 1017848 - DNA, 17 bp, Homo sapiens
tgagctccagaccccca

SEQ ID NO: 1017849 - DNA, 19 bp, Homo sapiens
tgagctcccacctcccttc

SEQ ID NO: 1017850 - DNA, 22 bp, Homo sapiens
tgagctccccagatctcccact

SEQ ID NO: 1017851 - DNA, 15 bp, Homo sapiens
tgagctccccatcac

SEQ ID NO: 1017852 - DNA, 18 bp, Homo sapiens
tgagctcctctgggcagg

SEQ ID NO: 1017853 - DNA, 15 bp, Homo sapiens
tgagctcgcagcccc

SEQ ID NO: 1017854 - DNA, 20 bp, Homo sapiens
tgagctcgcagcccccgcgc

SEQ ID NO: 1017855 - DNA, 19 bp, Homo sapiens
tgagctcggggtccaccag

SEQ ID NO: 1017856 - DNA, 22 bp, Homo sapiens
tgagctcggggtccaccagtgt

SEQ ID NO: 1017857 - DNA, 16 bp, Homo sapiens
tgagctctccaggcca

SEQ ID NO: 1017858 - DNA, 17 bp, Homo sapiens
tgagctctccaggccag

SEQ ID NO: 1017859 - DNA, 21 bp, Homo sapiens
tgagctctggttatttttctc

SEQ ID NO: 1017860 - DNA, 17 bp, Homo sapiens
tgagctgaaatgctgca

SEQ ID NO: 1017861 - DNA, 18 bp, Homo sapiens
tgagctgaaatgctgcat

SEQ ID NO: 1017862 - DNA, 23 bp, Homo sapiens
tgagctgaacacatttgcccaat

SEQ ID NO: 1017863 - DNA, 14 bp, Homo sapiens
tgagctgaatgttt

SEQ ID NO: 1017864 - DNA, 17 bp, Homo sapiens
tgagctgcagaaacgaa

SEQ ID NO: 1017865 - DNA, 14 bp, Homo sapiens
tgagctgcagcccc

SEQ ID NO: 1017866 - DNA, 19 bp, Homo sapiens
tgagctgcccggcgcctgc

SEQ ID NO: 1017867 - DNA, 22 bp, Homo sapiens
tgagctgcccggcgcctgccct

SEQ ID NO: 1017868 - DNA, 17 bp, Homo sapiens
tgagctgccttccctag

SEQ ID NO: 1017869 - DNA, 13 bp, Homo sapiens
tgagctgctgtgc

SEQ ID NO: 1017870 - DNA, 15 bp, Homo sapiens
tgagctgctgtgccc

SEQ ID NO: 1017871 - DNA, 12 bp, Homo sapiens
tgagctgctgtt

SEQ ID NO: 1017872 - DNA, 12 bp, Homo sapiens
tgagctggaagg

SEQ ID NO: 1017873 - DNA, 13 bp, Homo sapiens
tgagctggccctt

SEQ ID NO: 1017874 - DNA, 16 bp, Homo sapiens
tgagctggcccttggg

SEQ ID NO: 1017875 - DNA, 14 bp, Homo sapiens
tgagctgggcccag

SEQ ID NO: 1017876 - DNA, 15 bp, Homo sapiens
tgagctgggcccagc

SEQ ID NO: 1017877 - DNA, 19 bp, Homo sapiens
tgagctgggcccagcccct

SEQ ID NO: 1017878 - DNA, 19 bp, Homo sapiens
tgagctggggactcaggga

SEQ ID NO: 1017879 - DNA, 13 bp, Homo sapiens
tgagctggggagg

SEQ ID NO: 1017880 - DNA, 12 bp, Homo sapiens
tgagctggggcc

SEQ ID NO: 1017881 - DNA, 15 bp, Homo sapiens
tgagctggggccaca

SEQ ID NO: 1017882 - DNA, 21 bp, Homo sapiens
tgagctggggccgtctgtgtg

SEQ ID NO: 1017883 - DNA, 12 bp, Homo sapiens
tgagctgtcact

SEQ ID NO: 1017884 - DNA, 21 bp, Homo sapiens
tgagctgtgacattgctggtc

SEQ ID NO: 1017885 - DNA, 15 bp, Homo sapiens
tgagctgtgttcttg

SEQ ID NO: 1017886 - DNA, 16 bp, Homo sapiens
tgagcttaaaatacaa

SEQ ID NO: 1017887 - DNA, 20 bp, Homo sapiens
tgagcttaaaatacaagact

SEQ ID NO: 1017888 - DNA, 15 bp, Homo sapiens
tgagcttaaacagaa

SEQ ID NO: 1017889 - DNA, 16 bp, Homo sapiens
tgagcttagtgaaatt

SEQ ID NO: 1017890 - DNA, 16 bp, Homo sapiens
tgagcttcaatataag

SEQ ID NO: 1017891 - DNA, 19 bp, Homo sapiens
tgagcttcggttctccaga

SEQ ID NO: 1017892 - DNA, 13 bp, Homo sapiens
tgagcttctgaga

SEQ ID NO: 1017893 - DNA, 18 bp, Homo sapiens
tgagcttggaggaagtat

SEQ ID NO: 1017894 - DNA, 15 bp, Homo sapiens
tgagcttggccagaa

SEQ ID NO: 1017895 - DNA, 18 bp, Homo sapiens
tgagctttccatgttgct

SEQ ID NO: 1017896 - DNA, 19 bp, Homo sapiens
tgagctttccatgttgctg

SEQ ID NO: 1017897 - DNA, 16 bp, Homo sapiens
tgagctttgctgctac

SEQ ID NO: 1017898 - DNA, 17 bp, Homo sapiens
tgagcttttcatggaag

SEQ ID NO: 1017899 - DNA, 16 bp, Homo sapiens
tgaggaaaagactgtg

SEQ ID NO: 1017900 - DNA, 19 bp, Homo sapiens
tgaggaaaagactgtgggt

SEQ ID NO: 1017901 - DNA, 23 bp, Homo sapiens
tgaggaaagcctcctatggaatg

SEQ ID NO: 1017902 - DNA, 22 bp, Homo sapiens
tgaggaaagtgcgttctcccag

SEQ ID NO: 1017903 - DNA, 20 bp, Homo sapiens
tgaggaaatccattgtttaa

SEQ ID NO: 1017904 - DNA, 21 bp, Homo sapiens
tgaggaaatccattgtttaaa

SEQ ID NO: 1017905 - DNA, 14 bp, Homo sapiens
tgaggaagagtctt

SEQ ID NO: 1017906 - DNA, 15 bp, Homo sapiens
tgaggaagagtttat

SEQ ID NO: 1017907 - DNA, 14 bp, Homo sapiens
tgaggaagcagttg

SEQ ID NO: 1017908 - DNA, 14 bp, Homo sapiens
tgaggaagttttgt

SEQ ID NO: 1017909 - DNA, 17 bp, Homo sapiens
tgaggaataattattta

SEQ ID NO: 1017910 - DNA, 19 bp, Homo sapiens
tgaggaatagttgagcccc

SEQ ID NO: 1017911 - DNA, 19 bp, Homo sapiens
tgaggacaaccattccaga

SEQ ID NO: 1017912 - DNA, 10 bp, Homo sapiens
tgaggacaga

SEQ ID NO: 1017913 - DNA, 13 bp, Homo sapiens
tgaggacagctgt

SEQ ID NO: 1017914 - DNA, 14 bp, Homo sapiens
tgaggacagctgtc

SEQ ID NO: 1017915 - DNA, 17 bp, Homo sapiens
tgaggacagctgtcctc

SEQ ID NO: 1017916 - DNA, 21 bp, Homo sapiens
tgaggacatgtttttgttttc

SEQ ID NO: 1017917 - DNA, 22 bp, Homo sapiens
tgaggaccagggtggagctgag

SEQ ID NO: 1017918 - DNA, 18 bp, Homo sapiens
tgaggaccgctgataagc

SEQ ID NO: 1017919 - DNA, 22 bp, Homo sapiens
tgaggaccgctgataagcattg

SEQ ID NO: 1017920 - DNA, 18 bp, Homo sapiens
ggcagcccccccctcaag

SEQ ID NO: 1017921 - DNA, 15 bp, Homo sapiens
ggcagccccctccac

SEQ ID NO: 1017922 - DNA, 16 bp, Homo sapiens
ggcagcccggctgctg

SEQ ID NO: 1017923 - DNA, 17 bp, Homo sapiens
ggcagcccggctgctgc

SEQ ID NO: 1017924 - DNA, 14 bp, Homo sapiens
ggcagccctcacct

SEQ ID NO: 1017925 - DNA, 20 bp, Homo sapiens
ggcagccctcacctctgagg

SEQ ID NO: 1017926 - DNA, 21 bp, Homo sapiens
ggcagccctcacctctgagga

SEQ ID NO: 1017927 - DNA, 11 bp, Homo sapiens
ggcagccctcc

SEQ ID NO: 1017928 - DNA, 15 bp, Homo sapiens
ggcagccctccatgg

SEQ ID NO: 1017929 - DNA, 21 bp, Homo sapiens
ggcagccctccatggtcctgt

SEQ ID NO: 1017930 - DNA, 13 bp, Homo sapiens
ggcagccgagctc

SEQ ID NO: 1017931 - DNA, 21 bp, Homo sapiens
ggcagccgctaggagagactg

SEQ ID NO: 1017932 - DNA, 23 bp, Homo sapiens
ggcagccgctaggagagactgaa

SEQ ID NO: 1017933 - DNA, 15 bp, Homo sapiens
ggcagccgtcccagg

SEQ ID NO: 1017934 - DNA, 18 bp, Homo sapiens
ggcagccgtcccaggcca

SEQ ID NO: 1017935 - DNA, 19 bp, Homo sapiens
ggcagccgtcccaggccac

SEQ ID NO: 1017936 - DNA, 19 bp, Homo sapiens
ggcagccgtgccttcagct

SEQ ID NO: 1017937 - DNA, 22 bp, Homo sapiens
ggcagcctatgggggctctcgg

SEQ ID NO: 1017938 - DNA, 13 bp, Homo sapiens
ggcagcctccaga

SEQ ID NO: 1017939 - DNA, 18 bp, Homo sapiens
ggcagcctccagagccag

SEQ ID NO: 1017940 - DNA, 19 bp, Homo sapiens
ggcagcctccagagccagc

SEQ ID NO: 1017941 - DNA, 20 bp, Homo sapiens
ggcagcctccagagccagcc

SEQ ID NO: 1017942 - DNA, 20 bp, Homo sapiens
ggcagcctccgtcatccatg

SEQ ID NO: 1017943 - DNA, 11 bp, Homo sapiens
ggcagcctgcc

SEQ ID NO: 1017944 - DNA, 14 bp, Homo sapiens
ggcagcctgccgcc

SEQ ID NO: 1017945 - DNA, 23 bp, Homo sapiens
ggcagccttgggggggctgcctt

SEQ ID NO: 1017946 - DNA, 12 bp, Homo sapiens
ggcagcgcaggg

SEQ ID NO: 1017947 - DNA, 13 bp, Homo sapiens
ggcagcgcagggc

SEQ ID NO: 1017948 - DNA, 22 bp, Homo sapiens
ggcagcgccaagtgcgtgccgt

SEQ ID NO: 1017949 - DNA, 18 bp, Homo sapiens
ggcagcgcggggagcccg

SEQ ID NO: 1017950 - DNA, 16 bp, Homo sapiens
ggcagcgtgggctctg

SEQ ID NO: 1017951 - DNA, 18 bp, Homo sapiens
ggcagctagactggagtg

SEQ ID NO: 1017952 - DNA, 16 bp, Homo sapiens
ggcagctagtgccttt

SEQ ID NO: 1017953 - DNA, 17 bp, Homo sapiens
ggcagctatttcagcct

SEQ ID NO: 1017954 - DNA, 16 bp, Homo sapiens
ggcagctcacccctgg

SEQ ID NO: 1017955 - DNA, 20 bp, Homo sapiens
ggcagctcacccctgggcag

SEQ ID NO: 1017956 - DNA, 22 bp, Homo sapiens
ggcagctcacccctgggcaggc

SEQ ID NO: 1017957 - DNA, 13 bp, Homo sapiens
ggcagctccctcc

SEQ ID NO: 1017958 - DNA, 16 bp, Homo sapiens
ggcagctcctctcctt

SEQ ID NO: 1017959 - DNA, 22 bp, Homo sapiens
ggcagctcggattcaactacct

SEQ ID NO: 1017960 - DNA, 14 bp, Homo sapiens
ggcagctctccagt

SEQ ID NO: 1017961 - DNA, 12 bp, Homo sapiens
ggcagctcttct

SEQ ID NO: 1017962 - DNA, 18 bp, Homo sapiens
ggcagctcttctggagtt

SEQ ID NO: 1017963 - DNA, 20 bp, Homo sapiens
ggcagctcttctgggcagag

SEQ ID NO: 1017964 - DNA, 14 bp, Homo sapiens
ggcagctgagacca

SEQ ID NO: 1017965 - DNA, 12 bp, Homo sapiens
ggcagctgccac

SEQ ID NO: 1017966 - DNA, 14 bp, Homo sapiens
ggcagctgccagag

SEQ ID NO: 1017967 - DNA, 15 bp, Homo sapiens
ggcagctgccagaga

SEQ ID NO: 1017968 - DNA, 18 bp, Homo sapiens
ggcagctgcccctcctgg

SEQ ID NO: 1017969 - DNA, 20 bp, Homo sapiens
ggcagctgcccctcctggag

SEQ ID NO: 1017970 - DNA, 21 bp, Homo sapiens
ggcagctgcccctcctggagc

SEQ ID NO: 1017971 - DNA, 13 bp, Homo sapiens
ggcagctgcctct

SEQ ID NO: 1017972 - DNA, 14 bp, Homo sapiens
ggcagctgcctctg

SEQ ID NO: 1017973 - DNA, 16 bp, Homo sapiens
ggcagctgcctctgct

SEQ ID NO: 1017974 - DNA, 21 bp, Homo sapiens
ggcagctgcctctgctccctc

SEQ ID NO: 1017975 - DNA, 12 bp, Homo sapiens
ggcagctgcctg

SEQ ID NO: 1017976 - DNA, 16 bp, Homo sapiens
ggcagctgcctggcca

SEQ ID NO: 1017977 - DNA, 11 bp, Homo sapiens
ggcagctgctg

SEQ ID NO: 1017978 - DNA, 22 bp, Homo sapiens
ggcagctggaccatctctgtag

SEQ ID NO: 1017979 - DNA, 11 bp, Homo sapiens
ggcagctggcc

SEQ ID NO: 1017980 - DNA, 12 bp, Homo sapiens
ggcagctggccc

SEQ ID NO: 1017981 - DNA, 20 bp, Homo sapiens
ggcagctggcccccagccct

SEQ ID NO: 1017982 - DNA, 16 bp, Homo sapiens
ggcagctgtttctcat

SEQ ID NO: 1017983 - DNA, 18 bp, Homo sapiens
ggcagctgtttctcatga

SEQ ID NO: 1017984 - DNA, 22 bp, Homo sapiens
ggcagctgtttctcatgaagct

SEQ ID NO: 1017985 - DNA, 18 bp, Homo sapiens
ggcagcttagggccctgg

SEQ ID NO: 1017986 - DNA, 20 bp, Homo sapiens
ggcagcttctgttggcagag

SEQ ID NO: 1017987 - DNA, 15 bp, Homo sapiens
ggcagcttgccccgg

SEQ ID NO: 1017988 - DNA, 13 bp, Homo sapiens
ggcaggaaagcca

SEQ ID NO: 1017989 - DNA, 15 bp, Homo sapiens
ggcaggaaagccaca

SEQ ID NO: 1017990 - DNA, 18 bp, Homo sapiens
ggcaggaaagccacatct

SEQ ID NO: 1017991 - DNA, 16 bp, Homo sapiens
ggcaggaaggactgtc

SEQ ID NO: 1017992 - DNA, 15 bp, Homo sapiens
ggcaggaatgggggt

SEQ ID NO: 1017993 - DNA, 19 bp, Homo sapiens
ggcaggaatgggggtcaga

SEQ ID NO: 1017994 - DNA, 14 bp, Homo sapiens
ggcaggaccctgct

SEQ ID NO: 1017995 - DNA, 21 bp, Homo sapiens
ggcaggacctcagagtccagg

SEQ ID NO: 1017996 - DNA, 21 bp, Homo sapiens
ggcaggaccttcgggctgtgc

SEQ ID NO: 1017997 - DNA, 23 bp, Homo sapiens
ggcaggagaagaacaagaaatgg

SEQ ID NO: 1017998 - DNA, 22 bp, Homo sapiens
ggcaggagagtgtgtgggcagg

SEQ ID NO: 1017999 - DNA, 14 bp, Homo sapiens
ggcaggagggccct

SEQ ID NO: 1018000 - DNA, 20 bp, Homo sapiens
ggcaggagtgccaggaccag

SEQ ID NO: 1018001 - DNA, 16 bp, Homo sapiens
ggcaggagtggcagct

SEQ ID NO: 1018002 - DNA, 17 bp, Homo sapiens
ggcaggatctcaagcca

SEQ ID NO: 1018003 - DNA, 19 bp, Homo sapiens
ggcaggatggcctttcctt

SEQ ID NO: 1018004 - DNA, 20 bp, Homo sapiens
ggcaggcacacagcagcccc

SEQ ID NO: 1018005 - DNA, 22 bp, Homo sapiens
ggcaggcacacagcagcccccc

SEQ ID NO: 1018006 - DNA, 21 bp, Homo sapiens
ggcaggcactgtggcccttct

SEQ ID NO: 1018007 - DNA, 13 bp, Homo sapiens
ggcaggcagggct

SEQ ID NO: 1018008 - DNA, 21 bp, Homo sapiens
ggcaggccagcttcgtgctgg

SEQ ID NO: 1018009 - DNA, 14 bp, Homo sapiens
ggcaggccaggctg

SEQ ID NO: 1018010 - DNA, 12 bp, Homo sapiens
ggcaggcccact

SEQ ID NO: 1018011 - DNA, 15 bp, Homo sapiens
ggcaggcccactccc

SEQ ID NO: 1018012 - DNA, 20 bp, Homo sapiens
ggcaggcctccgtcttccca

SEQ ID NO: 1018013 - DNA, 21 bp, Homo sapiens
ggcaggcctgagaatgagtgg

SEQ ID NO: 1018014 - DNA, 17 bp, Homo sapiens
ggcaggccttgctgggg

SEQ ID NO: 1018015 - DNA, 15 bp, Homo sapiens
ggcaggcggctcctc

SEQ ID NO: 1018016 - DNA, 19 bp, Homo sapiens
ggcaggcggctcctcctca

SEQ ID NO: 1018017 - DNA, 19 bp, Homo sapiens
ggcaggctcactgccaggc

SEQ ID NO: 1018018 - DNA, 17 bp, Homo sapiens
ggcaggctctctcctct

SEQ ID NO: 1018019 - DNA, 16 bp, Homo sapiens
ggcaggctgacatctg

SEQ ID NO: 1018020 - DNA, 17 bp, Homo sapiens
ggcaggctgaggtgggg

SEQ ID NO: 1018021 - DNA, 14 bp, Homo sapiens
ggcaggctgggacg

SEQ ID NO: 1018022 - DNA, 14 bp, Homo sapiens
ggcaggctgggcca

SEQ ID NO: 1018023 - DNA, 15 bp, Homo sapiens
ggcaggctgggccat

SEQ ID NO: 1018024 - DNA, 18 bp, Homo sapiens
ggcagggaatgcctggag

SEQ ID NO: 1018025 - DNA, 14 bp, Homo sapiens
ggcagggaccacac

SEQ ID NO: 1018026 - DNA, 21 bp, Homo sapiens
ggcagggagagcgcctcttcc

SEQ ID NO: 1018027 - DNA, 22 bp, Homo sapiens
ggcagggagcggccggccagcc

SEQ ID NO: 1018028 - DNA, 14 bp, Homo sapiens
ggcagggaggggct

SEQ ID NO: 1018029 - DNA, 18 bp, Homo sapiens
ggcagggaggggctgggg

SEQ ID NO: 1018030 - DNA, 15 bp, Homo sapiens
ggcagggccagggca

SEQ ID NO: 1018031 - DNA, 21 bp, Homo sapiens
ggcagggccagggcaatgcca

SEQ ID NO: 1018032 - DNA, 18 bp, Homo sapiens
ggcagggcccctgaccct

SEQ ID NO: 1018033 - DNA, 21 bp, Homo sapiens
ggcagggccttgcccagagat

SEQ ID NO: 1018034 - DNA, 20 bp, Homo sapiens
ggcagggctggaatgggaga

SEQ ID NO: 1018035 - DNA, 16 bp, Homo sapiens
ggcaggggagccaggg

SEQ ID NO: 1018036 - DNA, 17 bp, Homo sapiens
ggcaggggagccagggt

SEQ ID NO: 1018037 - DNA, 15 bp, Homo sapiens
ggcaggggcatctgt

SEQ ID NO: 1018038 - DNA, 22 bp, Homo sapiens
ggcaggggcccacttggggcct

SEQ ID NO: 1018039 - DNA, 16 bp, Homo sapiens
ggcaggggcctggaga

SEQ ID NO: 1018040 - DNA, 14 bp, Homo sapiens
ggcaggggcctggg

SEQ ID NO: 1018041 - DNA, 18 bp, Homo sapiens
ggcaggggcctgggccgg

SEQ ID NO: 1018042 - DNA, 22 bp, Homo sapiens
ggcagggggccccgccagggct

SEQ ID NO: 1018043 - DNA, 19 bp, Homo sapiens
ggcagggggccctgcccca

SEQ ID NO: 1018044 - DNA, 21 bp, Homo sapiens
ggcagggggccctgccccacc

SEQ ID NO: 1018045 - DNA, 14 bp, Homo sapiens
ggcaggggtgagag

SEQ ID NO: 1018046 - DNA, 15 bp, Homo sapiens
ggcaggggtgggaga

SEQ ID NO: 1018047 - DNA, 16 bp, Homo sapiens
ggcaggggtgggagag

SEQ ID NO: 1018048 - DNA, 15 bp, Homo sapiens
ggcagggtccacgcc

SEQ ID NO: 1018049 - DNA, 15 bp, Homo sapiens
ggcagggtgggagcc

SEQ ID NO: 1018050 - DNA, 20 bp, Homo sapiens
ggcaggtagatcgcttgagc

SEQ ID NO: 1018051 - DNA, 21 bp, Homo sapiens
ggcaggtagatcgcttgagcc

SEQ ID NO: 1018052 - DNA, 15 bp, Homo sapiens
ggcaggtcactgtca

SEQ ID NO: 1018053 - DNA, 20 bp, Homo sapiens
ggcaggtcactgtcactgcc

SEQ ID NO: 1018054 - DNA, 15 bp, Homo sapiens
ggcaggtcctgccca

SEQ ID NO: 1018055 - DNA, 20 bp, Homo sapiens
ggcaggtcttcatatttttg

SEQ ID NO: 1018056 - DNA, 16 bp, Homo sapiens
ggcaggtgcctccagg

SEQ ID NO: 1018057 - DNA, 21 bp, Homo sapiens
ggcaggtgcctccaggtgtgc

SEQ ID NO: 1018058 - DNA, 13 bp, Homo sapiens
ggcaggtgggagc

SEQ ID NO: 1018059 - DNA, 17 bp, Homo sapiens
ggcaggtgggagctgaa

SEQ ID NO: 1018060 - DNA, 22 bp, Homo sapiens
ggcaggtggtggcactgagccc

SEQ ID NO: 1018061 - DNA, 15 bp, Homo sapiens
ggcaggtgtcatatg

SEQ ID NO: 1018062 - DNA, 22 bp, Homo sapiens
ggcaggtgtttattaaaattct

SEQ ID NO: 1018063 - DNA, 15 bp, Homo sapiens
ggcaggttcctgggg

SEQ ID NO: 1018064 - DNA, 16 bp, Homo sapiens
ggcaggttcctggggc

SEQ ID NO: 1018065 - DNA, 17 bp, Homo sapiens
ggcaggttcctggggcc

SEQ ID NO: 1018066 - DNA, 21 bp, Homo sapiens
ggcaggttcctggggccgcct

SEQ ID NO: 1018067 - DNA, 23 bp, Homo sapiens
ggcagtagctgtggtgaggtggg

SEQ ID NO: 1018068 - DNA, 21 bp, Homo sapiens
ggcagtaggggaacctaggag

SEQ ID NO: 1018069 - DNA, 20 bp, Homo sapiens
ggcagtatgtgatggactgg

SEQ ID NO: 1018070 - DNA, 13 bp, Homo sapiens
ggcagtcaccacc

SEQ ID NO: 1018071 - DNA, 17 bp, Homo sapiens
ggcagtcaccacccagc

SEQ ID NO: 1018072 - DNA, 21 bp, Homo sapiens
ggcagtcaccacccagccctt

SEQ ID NO: 1018073 - DNA, 22 bp, Homo sapiens
ggcagtcaccacccagcccttc

SEQ ID NO: 1018074 - DNA, 20 bp, Homo sapiens
ggcagtcattggctgtctcc

SEQ ID NO: 1018075 - DNA, 15 bp, Homo sapiens
ggcagtccagagctt

SEQ ID NO: 1018076 - DNA, 15 bp, Homo sapiens
ggcagtccaggcctc

SEQ ID NO: 1018077 - DNA, 20 bp, Homo sapiens
ggcagtccaggcctctctct

SEQ ID NO: 1018078 - DNA, 19 bp, Homo sapiens
ggcagtcgatagagctgta

SEQ ID NO: 1018079 - DNA, 15 bp, Homo sapiens
ggcagtcgggggctg

SEQ ID NO: 1018080 - DNA, 19 bp, Homo sapiens
ggcagtctgaatttttaaa

SEQ ID NO: 1018081 - DNA, 15 bp, Homo sapiens
ggcagtctgctctgc

SEQ ID NO: 1018082 - DNA, 20 bp, Homo sapiens
ggcagtctgctctgctgctc

SEQ ID NO: 1018083 - DNA, 17 bp, Homo sapiens
ggcagtgactggcaggt

SEQ ID NO: 1018084 - DNA, 20 bp, Homo sapiens
ggcagtgactggcaggtgca

SEQ ID NO: 1018085 - DNA, 16 bp, Homo sapiens
ggcagtgagggagggc

SEQ ID NO: 1018086 - DNA, 21 bp, Homo sapiens
ggcagtgagggagggctgtca

SEQ ID NO: 1018087 - DNA, 16 bp, Homo sapiens
ggcagtgcatgcatgt

SEQ ID NO: 1018088 - DNA, 15 bp, Homo sapiens
ggcagtgccacagcc

SEQ ID NO: 1018089 - DNA, 16 bp, Homo sapiens
ggcagtgccacagcct

SEQ ID NO: 1018090 - DNA, 20 bp, Homo sapiens
ggcagtgccacagcctgctg

SEQ ID NO: 1018091 - DNA, 19 bp, Homo sapiens
ggcagtgccacccgcagat

SEQ ID NO: 1018092 - DNA, 12 bp, Homo sapiens
ggcagtgcccca

SEQ ID NO: 1018093 - DNA, 14 bp, Homo sapiens
ggcagtgccccagg

SEQ ID NO: 1018094 - DNA, 17 bp, Homo sapiens
ggcagtgccccagggag

SEQ ID NO: 1018095 - DNA, 19 bp, Homo sapiens
tgaggcatctttacatcta

SEQ ID NO: 1018096 - DNA, 23 bp, Homo sapiens
tgaggcatggcaattctggaagc

SEQ ID NO: 1018097 - DNA, 16 bp, Homo sapiens
tgaggccaagaatatt

SEQ ID NO: 1018098 - DNA, 23 bp, Homo sapiens
tgaggccacactcagcacaaggc

SEQ ID NO: 1018099 - DNA, 22 bp, Homo sapiens
tgaggccactgctgcttctcca

SEQ ID NO: 1018100 - DNA, 13 bp, Homo sapiens
tgaggccaggagt

SEQ ID NO: 1018101 - DNA, 13 bp, Homo sapiens
tgaggccagggca

SEQ ID NO: 1018102 - DNA, 15 bp, Homo sapiens
tgaggccagggcaga

SEQ ID NO: 1018103 - DNA, 16 bp, Homo sapiens
tgaggccagggcagag

SEQ ID NO: 1018104 - DNA, 12 bp, Homo sapiens
tgaggccagtgg

SEQ ID NO: 1018105 - DNA, 16 bp, Homo sapiens
tgaggccatctcagga

SEQ ID NO: 1018106 - DNA, 17 bp, Homo sapiens
tgaggccatctcaggag

SEQ ID NO: 1018107 - DNA, 13 bp, Homo sapiens
tgaggcccaagga

SEQ ID NO: 1018108 - DNA, 17 bp, Homo sapiens
tgaggcccagggagagg

SEQ ID NO: 1018109 - DNA, 21 bp, Homo sapiens
tgaggcccccgtcagggagag

SEQ ID NO: 1018110 - DNA, 23 bp, Homo sapiens
tgaggcccccgtcagggagaggt

SEQ ID NO: 1018111 - DNA, 15 bp, Homo sapiens
tgaggccctgggctg

SEQ ID NO: 1018112 - DNA, 15 bp, Homo sapiens
tgaggccctgtgata

SEQ ID NO: 1018113 - DNA, 15 bp, Homo sapiens
tgaggcctcagtgga

SEQ ID NO: 1018114 - DNA, 21 bp, Homo sapiens
tgaggcctcttggacctctgc

SEQ ID NO: 1018115 - DNA, 16 bp, Homo sapiens
tgaggcctgccccctg

SEQ ID NO: 1018116 - DNA, 19 bp, Homo sapiens
tgaggcctgccccctgggc

SEQ ID NO: 1018117 - DNA, 18 bp, Homo sapiens
tgaggcctgccctcaggg

SEQ ID NO: 1018118 - DNA, 19 bp, Homo sapiens
tgaggcctggactttcctg

SEQ ID NO: 1018119 - DNA, 20 bp, Homo sapiens
tgaggcctggactttcctgc

SEQ ID NO: 1018120 - DNA, 23 bp, Homo sapiens
tgaggcctggactttcctgcaac

SEQ ID NO: 1018121 - DNA, 13 bp, Homo sapiens
tgaggcctgggcc

SEQ ID NO: 1018122 - DNA, 13 bp, Homo sapiens
tgaggcctgtgct

SEQ ID NO: 1018123 - DNA, 15 bp, Homo sapiens
tgaggccttgtgtgt

SEQ ID NO: 1018124 - DNA, 18 bp, Homo sapiens
tgaggcggaggctgtgct

SEQ ID NO: 1018125 - DNA, 20 bp, Homo sapiens
tgaggcgggtggatcacgag

SEQ ID NO: 1018126 - DNA, 16 bp, Homo sapiens
tgaggctctgtcactg

SEQ ID NO: 1018127 - DNA, 21 bp, Homo sapiens
tgaggctctgtcactgagcaa

SEQ ID NO: 1018128 - DNA, 17 bp, Homo sapiens
tgaggctctttctgggc

SEQ ID NO: 1018129 - DNA, 15 bp, Homo sapiens
tgaggctggcacagg

SEQ ID NO: 1018130 - DNA, 12 bp, Homo sapiens
tgaggctgtcct

SEQ ID NO: 1018131 - DNA, 11 bp, Homo sapiens
tgaggctgtgg

SEQ ID NO: 1018132 - DNA, 13 bp, Homo sapiens
tgaggctgtgtct

SEQ ID NO: 1018133 - DNA, 16 bp, Homo sapiens
tgaggctgtgtctctg

SEQ ID NO: 1018134 - DNA, 20 bp, Homo sapiens
tgaggcttccaggctcttcc

SEQ ID NO: 1018135 - DNA, 23 bp, Homo sapiens
tgaggctttggatttgacattgc

SEQ ID NO: 1018136 - DNA, 21 bp, Homo sapiens
tgagggaaagagcttataaaa

SEQ ID NO: 1018137 - DNA, 16 bp, Homo sapiens
tgagggaacagacagg

SEQ ID NO: 1018138 - DNA, 17 bp, Homo sapiens
tgagggaacagacagga

SEQ ID NO: 1018139 - DNA, 22 bp, Homo sapiens
tgagggaacagacaggagaaat

SEQ ID NO: 1018140 - DNA, 21 bp, Homo sapiens
tgagggaagaacattattcat

SEQ ID NO: 1018141 - DNA, 15 bp, Homo sapiens
tgagggaatccattg

SEQ ID NO: 1018142 - DNA, 17 bp, Homo sapiens
tgagggagaacaagacc

SEQ ID NO: 1018143 - DNA, 20 bp, Homo sapiens
tgagggaggacctggggcac

SEQ ID NO: 1018144 - DNA, 23 bp, Homo sapiens
tgagggaggacctggggcacagt

SEQ ID NO: 1018145 - DNA, 15 bp, Homo sapiens
tgagggagggagcca

SEQ ID NO: 1018146 - DNA, 18 bp, Homo sapiens
tgagggagggagccatgg

SEQ ID NO: 1018147 - DNA, 21 bp, Homo sapiens
tgagggagggggcgctcagga

SEQ ID NO: 1018148 - DNA, 21 bp, Homo sapiens
tgagggatctgagtaggtctg

SEQ ID NO: 1018149 - DNA, 15 bp, Homo sapiens
tgagggcaagccacc

SEQ ID NO: 1018150 - DNA, 15 bp, Homo sapiens
tgagggcagcactgg

SEQ ID NO: 1018151 - DNA, 17 bp, Homo sapiens
tgagggcagtgcccttt

SEQ ID NO: 1018152 - DNA, 23 bp, Homo sapiens
tgagggccaataccctactgtgg

SEQ ID NO: 1018153 - DNA, 13 bp, Homo sapiens
tgagggccagtga

SEQ ID NO: 1018154 - DNA, 19 bp, Homo sapiens
tgagggccagtgatgatgt

SEQ ID NO: 1018155 - DNA, 14 bp, Homo sapiens
tgagggcccagagc

SEQ ID NO: 1018156 - DNA, 15 bp, Homo sapiens
tgagggcccagagca

SEQ ID NO: 1018157 - DNA, 19 bp, Homo sapiens
tgagggcccagagcaggaa

SEQ ID NO: 1018158 - DNA, 16 bp, Homo sapiens
tgagggcccagccagg

SEQ ID NO: 1018159 - DNA, 15 bp, Homo sapiens
tgagggcccctctgc

SEQ ID NO: 1018160 - DNA, 19 bp, Homo sapiens
tgagggcccctctgcccag

SEQ ID NO: 1018161 - DNA, 17 bp, Homo sapiens
tgagggcctcagagcct

SEQ ID NO: 1018162 - DNA, 18 bp, Homo sapiens
tgagggcctcagagcctg

SEQ ID NO: 1018163 - DNA, 19 bp, Homo sapiens
tgagggcctcagagcctga

SEQ ID NO: 1018164 - DNA, 19 bp, Homo sapiens
tgagggcctgctggaggcc

SEQ ID NO: 1018165 - DNA, 22 bp, Homo sapiens
tgagggcctgctggaggcctca

SEQ ID NO: 1018166 - DNA, 11 bp, Homo sapiens
tgagggctcca

SEQ ID NO: 1018167 - DNA, 13 bp, Homo sapiens
tgagggctgcagt

SEQ ID NO: 1018168 - DNA, 16 bp, Homo sapiens
tgagggctgggcccac

SEQ ID NO: 1018169 - DNA, 13 bp, Homo sapiens
tgaggggaagctg

SEQ ID NO: 1018170 - DNA, 16 bp, Homo sapiens
tgaggggagaggagac

SEQ ID NO: 1018171 - DNA, 11 bp, Homo sapiens
tgaggggagga

SEQ ID NO: 1018172 - DNA, 19 bp, Homo sapiens
ggcatgcagctgcctgggg

SEQ ID NO: 1018173 - DNA, 21 bp, Homo sapiens
ggcatgcagctgcctggggcc

SEQ ID NO: 1018174 - DNA, 23 bp, Homo sapiens
ggcatgcagctgcctggggccca

SEQ ID NO: 1018175 - DNA, 14 bp, Homo sapiens
ggcatgccaccctc

SEQ ID NO: 1018176 - DNA, 24 bp, Homo sapiens
ggcatgccaccctcacacacacag

SEQ ID NO: 1018177 - DNA, 14 bp, Homo sapiens
ggcatgccaggacc

SEQ ID NO: 1018178 - DNA, 15 bp, Homo sapiens
ggcatgcctggacaa

SEQ ID NO: 1018179 - DNA, 13 bp, Homo sapiens
ggcatgcctgtgt

SEQ ID NO: 1018180 - DNA, 12 bp, Homo sapiens
ggcatgctgggg

SEQ ID NO: 1018181 - DNA, 12 bp, Homo sapiens
ggcatggaaatt

SEQ ID NO: 1018182 - DNA, 15 bp, Homo sapiens
ggcatggaaggggct

SEQ ID NO: 1018183 - DNA, 19 bp, Homo sapiens
ggcatggaaggggcttctg

SEQ ID NO: 1018184 - DNA, 16 bp, Homo sapiens
ggcatggacagggcca

SEQ ID NO: 1018185 - DNA, 21 bp, Homo sapiens
ggcatggacagggccagggtt

SEQ ID NO: 1018186 - DNA, 18 bp, Homo sapiens
ggcatggcaaatcagggg

SEQ ID NO: 1018187 - DNA, 21 bp, Homo sapiens
ggcatggcaaatcaggggcca

SEQ ID NO: 1018188 - DNA, 18 bp, Homo sapiens
ggcatggccaggtggcca

SEQ ID NO: 1018189 - DNA, 17 bp, Homo sapiens
ggcatggccgcttctag

SEQ ID NO: 1018190 - DNA, 16 bp, Homo sapiens
ggcatggctccagtct

SEQ ID NO: 1018191 - DNA, 17 bp, Homo sapiens
ggcatgggacaggggga

SEQ ID NO: 1018192 - DNA, 18 bp, Homo sapiens
ggcatgggcctctctggg

SEQ ID NO: 1018193 - DNA, 19 bp, Homo sapiens
ggcatgggcctctctgggg

SEQ ID NO: 1018194 - DNA, 16 bp, Homo sapiens
ggcatgggcgcaggcc

SEQ ID NO: 1018195 - DNA, 17 bp, Homo sapiens
ggcatggggcatgtcct

SEQ ID NO: 1018196 - DNA, 17 bp, Homo sapiens
ggcatggtgcagggaga

SEQ ID NO: 1018197 - DNA, 23 bp, Homo sapiens
ggcatggtggcacacgcctgtag

SEQ ID NO: 1018198 - DNA, 22 bp, Homo sapiens
ggcatggtggcgcaagcctgta

SEQ ID NO: 1018199 - DNA, 21 bp, Homo sapiens
ggcatggtggctcatgcctgt

SEQ ID NO: 1018200 - DNA, 18 bp, Homo sapiens
ggcatggtgtgtggtgct

SEQ ID NO: 1018201 - DNA, 21 bp, Homo sapiens
ggcatggttccttccctggga

SEQ ID NO: 1018202 - DNA, 16 bp, Homo sapiens
ggcatgtattggcctg

SEQ ID NO: 1018203 - DNA, 21 bp, Homo sapiens
ggcatgtcagaggaccccagg

SEQ ID NO: 1018204 - DNA, 23 bp, Homo sapiens
ggcatgtcagaggaccccagggt

SEQ ID NO: 1018205 - DNA, 13 bp, Homo sapiens
ggcatgtgctggt

SEQ ID NO: 1018206 - DNA, 12 bp, Homo sapiens
ggcatgtggaga

SEQ ID NO: 1018207 - DNA, 14 bp, Homo sapiens
ggcatgtggagaca

SEQ ID NO: 1018208 - DNA, 21 bp, Homo sapiens
ggcatgtgtgcctgtggcaga

SEQ ID NO: 1018209 - DNA, 16 bp, Homo sapiens
ggcatgttcctgcccc

SEQ ID NO: 1018210 - DNA, 19 bp, Homo sapiens
ggcatgttttgtgcatttg

SEQ ID NO: 1018211 - DNA, 20 bp, Homo sapiens
ggcattacttgctttcaatt

SEQ ID NO: 1018212 - DNA, 20 bp, Homo sapiens
ggcattagaattatttaaac

SEQ ID NO: 1018213 - DNA, 17 bp, Homo sapiens
ggcattagtgtcccccc

SEQ ID NO: 1018214 - DNA, 18 bp, Homo sapiens
ggcattagtgtcccccct

SEQ ID NO: 1018215 - DNA, 20 bp, Homo sapiens
ggcattagtgtccccccttg

SEQ ID NO: 1018216 - DNA, 16 bp, Homo sapiens
ggcattcctgaaggga

SEQ ID NO: 1018217 - DNA, 19 bp, Homo sapiens
tgaggtccaccggcccctg

SEQ ID NO: 1018218 - DNA, 13 bp, Homo sapiens
tgaggtcccaggc

SEQ ID NO: 1018219 - DNA, 15 bp, Homo sapiens
tgaggtcccaggcag

SEQ ID NO: 1018220 - DNA, 23 bp, Homo sapiens
tgaggtcccctcgtcccatccag

SEQ ID NO: 1018221 - DNA, 22 bp, Homo sapiens
tgaggtcccttcaaggcctccc

SEQ ID NO: 1018222 - DNA, 14 bp, Homo sapiens
tgaggtcctcaggt

SEQ ID NO: 1018223 - DNA, 19 bp, Homo sapiens
tgaggtcctcaggtcagct

SEQ ID NO: 1018224 - DNA, 22 bp, Homo sapiens
tgaggtcctcaggtcagctggg

SEQ ID NO: 1018225 - DNA, 13 bp, Homo sapiens
tgaggtctgcgtc

SEQ ID NO: 1018226 - DNA, 16 bp, Homo sapiens
tgaggtctgctcggcc

SEQ ID NO: 1018227 - DNA, 13 bp, Homo sapiens
tgaggtctgttcc

SEQ ID NO: 1018228 - DNA, 20 bp, Homo sapiens
tgaggtctgttctttccaaa

SEQ ID NO: 1018229 - DNA, 19 bp, Homo sapiens
tgaggtcttttgacatgtg

SEQ ID NO: 1018230 - DNA, 20 bp, Homo sapiens
tgaggtcttttgacatgtgg

SEQ ID NO: 1018231 - DNA, 23 bp, Homo sapiens
tgaggtcttttgacatgtggaaa

SEQ ID NO: 1018232 - DNA, 16 bp, Homo sapiens
tgaggtgatgggtgca

SEQ ID NO: 1018233 - DNA, 14 bp, Homo sapiens
tgaggtgcctgtcc

SEQ ID NO: 1018234 - DNA, 16 bp, Homo sapiens
tgaggtgctatgttct

SEQ ID NO: 1018235 - DNA, 14 bp, Homo sapiens
tgaggtggcccagg

SEQ ID NO: 1018236 - DNA, 15 bp, Homo sapiens
tgaggtggcccaggc

SEQ ID NO: 1018237 - DNA, 12 bp, Homo sapiens
tgaggtgggagg

SEQ ID NO: 1018238 - DNA, 13 bp, Homo sapiens
tgaggtgggagga

SEQ ID NO: 1018239 - DNA, 20 bp, Homo sapiens
tgaggtgggcagatcacgag

SEQ ID NO: 1018240 - DNA, 11 bp, Homo sapiens
tgaggtgggcc

SEQ ID NO: 1018241 - DNA, 15 bp, Homo sapiens
tgaggtgggcccagg

SEQ ID NO: 1018242 - DNA, 16 bp, Homo sapiens
tgaggtgggctggggc

SEQ ID NO: 1018243 - DNA, 15 bp, Homo sapiens
tgaggtggggaagga

SEQ ID NO: 1018244 - DNA, 16 bp, Homo sapiens
tgaggtggggaaggag

SEQ ID NO: 1018245 - DNA, 20 bp, Homo sapiens
tgaggtggggaaggagggac

SEQ ID NO: 1018246 - DNA, 18 bp, Homo sapiens
tgaggtggtctgaatgtt

SEQ ID NO: 1018247 - DNA, 21 bp, Homo sapiens
tgaggtggtctgaatgttctg

SEQ ID NO: 1018248 - DNA, 14 bp, Homo sapiens
tgaggtgtgggggc

SEQ ID NO: 1018249 - DNA, 18 bp, Homo sapiens
tgaggtgtgggggctgca

SEQ ID NO: 1018250 - DNA, 22 bp, Homo sapiens
tgaggttaaacggtgcccatcc

SEQ ID NO: 1018251 - DNA, 15 bp, Homo sapiens
tgaggttaagtttct

SEQ ID NO: 1018252 - DNA, 22 bp, Homo sapiens
tgaggttaagtttctcttcacc

SEQ ID NO: 1018253 - DNA, 12 bp, Homo sapiens
tgaggttaggag

SEQ ID NO: 1018254 - DNA, 14 bp, Homo sapiens
tgaggttcctctgc

SEQ ID NO: 1018255 - DNA, 15 bp, Homo sapiens
tgaggttcctctgcc

SEQ ID NO: 1018256 - DNA, 16 bp, Homo sapiens
tgaggttcctctgcct

SEQ ID NO: 1018257 - DNA, 21 bp, Homo sapiens
tgaggtttccttcagacagat

SEQ ID NO: 1018258 - DNA, 16 bp, Homo sapiens
tgaggtttgaaaagct

SEQ ID NO: 1018259 - DNA, 20 bp, Homo sapiens
tgagtaaaaagtttctaaag

SEQ ID NO: 1018260 - DNA, 20 bp, Homo sapiens
tgagtaaaacacatattcaa

SEQ ID NO: 1018261 - DNA, 22 bp, Homo sapiens
tgagtaaaccctatctgtgatt

SEQ ID NO: 1018262 - DNA, 20 bp, Homo sapiens
tgagtaaattggaaacattt

SEQ ID NO: 1018263 - DNA, 19 bp, Homo sapiens
tgagtaactggttgctgtg

SEQ ID NO: 1018264 - DNA, 14 bp, Homo sapiens
tgagtaagaacatc

SEQ ID NO: 1018265 - DNA, 17 bp, Homo sapiens
tgagtaagagctggtgt

SEQ ID NO: 1018266 - DNA, 21 bp, Homo sapiens
tgagtaagagctggtgtctga

SEQ ID NO: 1018267 - DNA, 16 bp, Homo sapiens
tgagtaagtgtgttca

SEQ ID NO: 1018268 - DNA, 15 bp, Homo sapiens
tgagtaatagattgt

SEQ ID NO: 1018269 - DNA, 23 bp, Homo sapiens
tgagtaattcaagcctctaaaca

SEQ ID NO: 1018270 - DNA, 16 bp, Homo sapiens
tgagtacagtgaggag

SEQ ID NO: 1018271 - DNA, 18 bp, Homo sapiens
tgagtacagtgaggaggg

SEQ ID NO: 1018272 - DNA, 14 bp, Homo sapiens
tgagtactggaata

SEQ ID NO: 1018273 - DNA, 20 bp, Homo sapiens
tgagtactggaataaacagt

SEQ ID NO: 1018274 - DNA, 15 bp, Homo sapiens
tgagtatgaacttga

SEQ ID NO: 1018275 - DNA, 13 bp, Homo sapiens
tgagtattctcat

SEQ ID NO: 1018276 - DNA, 16 bp, Homo sapiens
tgagtattttttataa

SEQ ID NO: 1018277 - DNA, 16 bp, Homo sapiens
tgagtcaaaagcctgg

SEQ ID NO: 1018278 - DNA, 13 bp, Homo sapiens
tgagtcaatcagc

SEQ ID NO: 1018279 - DNA, 18 bp, Homo sapiens
tgagtcaatgtgcagtgt

SEQ ID NO: 1018280 - DNA, 13 bp, Homo sapiens
tgagtcacctcct

SEQ ID NO: 1018281 - DNA, 14 bp, Homo sapiens
tgagtcacctgctc

SEQ ID NO: 1018282 - DNA, 23 bp, Homo sapiens
tgagtcactatgggatgagaaaa

SEQ ID NO: 1018283 - DNA, 15 bp, Homo sapiens
tgagtcagcaccttg

SEQ ID NO: 1018284 - DNA, 15 bp, Homo sapiens
tgagtcatctgttag

SEQ ID NO: 1018285 - DNA, 16 bp, Homo sapiens
tgagtcatttaaatgt

SEQ ID NO: 1018286 - DNA, 19 bp, Homo sapiens
tgagtccagaagtttgaga

SEQ ID NO: 1018287 - DNA, 15 bp, Homo sapiens
tgagtccagagcttg

SEQ ID NO: 1018288 - DNA, 19 bp, Homo sapiens
tgagtccagagcttgtgct

SEQ ID NO: 1018289 - DNA, 15 bp, Homo sapiens
tgagtccatgaaaat

SEQ ID NO: 1018290 - DNA, 17 bp, Homo sapiens
tgagtccattctcccag

SEQ ID NO: 1018291 - DNA, 19 bp, Homo sapiens
tgagtcccaggctgagcct

SEQ ID NO: 1018292 - DNA, 21 bp, Homo sapiens
tgagtcccaggctgagcctca

SEQ ID NO: 1018293 - DNA, 19 bp, Homo sapiens
tgagtcccctactccctct

SEQ ID NO: 1018294 - DNA, 12 bp, Homo sapiens
tgagtccctgct

SEQ ID NO: 1018295 - DNA, 17 bp, Homo sapiens
tgagtcctaggacttaa

SEQ ID NO: 1018296 - DNA, 14 bp, Homo sapiens
tgagtcctgtctct

SEQ ID NO: 1018297 - DNA, 15 bp, Homo sapiens
tgagtcctgttgaag

SEQ ID NO: 1018298 - DNA, 18 bp, Homo sapiens
tgagtcctgttgaagact

SEQ ID NO: 1018299 - DNA, 14 bp, Homo sapiens
tgagtcctttgcta

SEQ ID NO: 1018300 - DNA, 22 bp, Homo sapiens
ggccaccagccatcctccctcc

SEQ ID NO: 1018301 - DNA, 23 bp, Homo sapiens
ggccaccagccatcctccctcca

SEQ ID NO: 1018302 - DNA, 11 bp, Homo sapiens
ggccaccagga

SEQ ID NO: 1018303 - DNA, 14 bp, Homo sapiens
ggccaccaggctgg

SEQ ID NO: 1018304 - DNA, 16 bp, Homo sapiens
ggccaccaggctggcg

SEQ ID NO: 1018305 - DNA, 20 bp, Homo sapiens
ggccaccccagagtgggaga

SEQ ID NO: 1018306 - DNA, 19 bp, Homo sapiens
ggccacccccatggaagca

SEQ ID NO: 1018307 - DNA, 20 bp, Homo sapiens
ggccaccccgtgccacccgt

SEQ ID NO: 1018308 - DNA, 13 bp, Homo sapiens
ggccacccgggct

SEQ ID NO: 1018309 - DNA, 16 bp, Homo sapiens
ggccacccgggctgcc

SEQ ID NO: 1018310 - DNA, 21 bp, Homo sapiens
ggccacccgttctgctggcct

SEQ ID NO: 1018311 - DNA, 23 bp, Homo sapiens
ggccacccgttctgctggcctgg

SEQ ID NO: 1018312 - DNA, 19 bp, Homo sapiens
ggccaccctccttcccgcc

SEQ ID NO: 1018313 - DNA, 14 bp, Homo sapiens
ggccaccctgctgc

SEQ ID NO: 1018314 - DNA, 15 bp, Homo sapiens
ggccaccctgctgca

SEQ ID NO: 1018315 - DNA, 13 bp, Homo sapiens
ggccaccctggcc

SEQ ID NO: 1018316 - DNA, 13 bp, Homo sapiens
ggccacccttggc

SEQ ID NO: 1018317 - DNA, 17 bp, Homo sapiens
ggccaccggggcaagag

SEQ ID NO: 1018318 - DNA, 11 bp, Homo sapiens
ggccacctcct

SEQ ID NO: 1018319 - DNA, 14 bp, Homo sapiens
ggccacctcctccc

SEQ ID NO: 1018320 - DNA, 19 bp, Homo sapiens
ggccacctcctccccctgt

SEQ ID NO: 1018321 - DNA, 22 bp, Homo sapiens
ggccacctgaggtgggcccagg

SEQ ID NO: 1018322 - DNA, 11 bp, Homo sapiens
ggccacctgcc

SEQ ID NO: 1018323 - DNA, 14 bp, Homo sapiens
ggccacctgccccc

SEQ ID NO: 1018324 - DNA, 23 bp, Homo sapiens
ggccacctgcccccttctcccac

SEQ ID NO: 1018325 - DNA, 13 bp, Homo sapiens
ggccacctgcctg

SEQ ID NO: 1018326 - DNA, 17 bp, Homo sapiens
ggccaccttggaggagg

SEQ ID NO: 1018327 - DNA, 18 bp, Homo sapiens
ggccaccttggaggagga

SEQ ID NO: 1018328 - DNA, 14 bp, Homo sapiens
ggccaccttttcag

SEQ ID NO: 1018329 - DNA, 14 bp, Homo sapiens
ggccacgccccagc

SEQ ID NO: 1018330 - DNA, 18 bp, Homo sapiens
ggccacgctccagctgcc

SEQ ID NO: 1018331 - DNA, 16 bp, Homo sapiens
ggccacgggggcagtg

SEQ ID NO: 1018332 - DNA, 16 bp, Homo sapiens
ggccacgtgccaggcc

SEQ ID NO: 1018333 - DNA, 17 bp, Homo sapiens
ggccacgtgccaggccc

SEQ ID NO: 1018334 - DNA, 18 bp, Homo sapiens
ggccacgtgccaggcccg

SEQ ID NO: 1018335 - DNA, 21 bp, Homo sapiens
ggccacgtgtgctgtggccag

SEQ ID NO: 1018336 - DNA, 19 bp, Homo sapiens
ggccacgttcagggagggg

SEQ ID NO: 1018337 - DNA, 13 bp, Homo sapiens
ggccactagtgac

SEQ ID NO: 1018338 - DNA, 15 bp, Homo sapiens
ggccactcagaggcc

SEQ ID NO: 1018339 - DNA, 23 bp, Homo sapiens
ggccactcccggcactccatgct

SEQ ID NO: 1018340 - DNA, 20 bp, Homo sapiens
tgagtggccagccagtgcca

SEQ ID NO: 1018341 - DNA, 18 bp, Homo sapiens
tgagtggccagcgccagg

SEQ ID NO: 1018342 - DNA, 12 bp, Homo sapiens
tgagtggcctgc

SEQ ID NO: 1018343 - DNA, 14 bp, Homo sapiens
tgagtgggaagccc

SEQ ID NO: 1018344 - DNA, 17 bp, Homo sapiens
tgagtgggaggcgtgcc

SEQ ID NO: 1018345 - DNA, 22 bp, Homo sapiens
tgagtgggccctgcccggggag

SEQ ID NO: 1018346 - DNA, 15 bp, Homo sapiens
tgagtggggagcagt

SEQ ID NO: 1018347 - DNA, 21 bp, Homo sapiens
tgagtgggggatcacagcctc

SEQ ID NO: 1018348 - DNA, 21 bp, Homo sapiens
tgagtggggttatctctgtgt

SEQ ID NO: 1018349 - DNA, 15 bp, Homo sapiens
tgagtggtcactggt

SEQ ID NO: 1018350 - DNA, 22 bp, Homo sapiens
tgagtggtcactggtcagggca

SEQ ID NO: 1018351 - DNA, 14 bp, Homo sapiens
tgagtgtaaataat

SEQ ID NO: 1018352 - DNA, 22 bp, Homo sapiens
tgagtgtaaataattttaaata

SEQ ID NO: 1018353 - DNA, 14 bp, Homo sapiens
tgagtgtaagtgtg

SEQ ID NO: 1018354 - DNA, 21 bp, Homo sapiens
tgagtgtacagattttattta

SEQ ID NO: 1018355 - DNA, 12 bp, Homo sapiens
tgagtgtactgt

SEQ ID NO: 1018356 - DNA, 16 bp, Homo sapiens
tgagtgtatgtgtgtg

SEQ ID NO: 1018357 - DNA, 22 bp, Homo sapiens
tgagtgtattttttaaaattga

SEQ ID NO: 1018358 - DNA, 13 bp, Homo sapiens
tgagtgtgacagg

SEQ ID NO: 1018359 - DNA, 16 bp, Homo sapiens
tgagtgtgacagggcc

SEQ ID NO: 1018360 - DNA, 12 bp, Homo sapiens
tgagtgtgagag

SEQ ID NO: 1018361 - DNA, 15 bp, Homo sapiens
tgagtgtgagggcag

SEQ ID NO: 1018362 - DNA, 22 bp, Homo sapiens
tgagtgtgagggcagcactggg

SEQ ID NO: 1018363 - DNA, 12 bp, Homo sapiens
tgagtgtgagtg

SEQ ID NO: 1018364 - DNA, 21 bp, Homo sapiens
tgagtgtgatgggccaccggg

SEQ ID NO: 1018365 - DNA, 13 bp, Homo sapiens
tgagtgtgtgaag

SEQ ID NO: 1018366 - DNA, 14 bp, Homo sapiens
tgagtgtgtgtgct

SEQ ID NO: 1018367 - DNA, 16 bp, Homo sapiens
tgagtgtgtgtgtgca

SEQ ID NO: 1018368 - DNA, 23 bp, Homo sapiens
tgagtgttcaaactactgtacat

SEQ ID NO: 1018369 - DNA, 12 bp, Homo sapiens
tgagtgttcatt

SEQ ID NO: 1018370 - DNA, 14 bp, Homo sapiens
tgagtgttcatttt

SEQ ID NO: 1018371 - DNA, 22 bp, Homo sapiens
tgagtgttcccaatctgaaatt

SEQ ID NO: 1018372 - DNA, 21 bp, Homo sapiens
tgagtgttcctttttaaatgt

SEQ ID NO: 1018373 - DNA, 24 bp, Homo sapiens
tgagtgttcctttttaaatgtgaa

SEQ ID NO: 1018374 - DNA, 14 bp, Homo sapiens
tgagttaagtctat

SEQ ID NO: 1018375 - DNA, 23 bp, Homo sapiens
tgagttacaccagacctgttctg

SEQ ID NO: 1018376 - DNA, 22 bp, Homo sapiens
tgagttacttgtctgaggcctc

SEQ ID NO: 1018377 - DNA, 12 bp, Homo sapiens
tgagttatcatg

SEQ ID NO: 1018378 - DNA, 20 bp, Homo sapiens
tgagttatcatgaattttaa

SEQ ID NO: 1018379 - DNA, 23 bp, Homo sapiens
tgagttatcatgaattttaaagt

SEQ ID NO: 1018380 - DNA, 15 bp, Homo sapiens
tgagttatgatgtaa

SEQ ID NO: 1018381 - DNA, 14 bp, Homo sapiens
tgagttattttaat

SEQ ID NO: 1018382 - DNA, 17 bp, Homo sapiens
tgagttattttaattat

SEQ ID NO: 1018383 - DNA, 17 bp, Homo sapiens
tgagttccagaaagtaa

SEQ ID NO: 1018384 - DNA, 16 bp, Homo sapiens
tgagttccagttgaag

SEQ ID NO: 1018385 - DNA, 17 bp, Homo sapiens
tgagttccagttgaagt

SEQ ID NO: 1018386 - DNA, 14 bp, Homo sapiens
tgagttcctctgca

SEQ ID NO: 1018387 - DNA, 16 bp, Homo sapiens
tgagttgattcagctc

SEQ ID NO: 1018388 - DNA, 15 bp, Homo sapiens
tgagttgcagttttt

SEQ ID NO: 1018389 - DNA, 18 bp, Homo sapiens
tgagttgggcagccagga

SEQ ID NO: 1018390 - DNA, 19 bp, Homo sapiens
tgagttgggggagggaaga

SEQ ID NO: 1018391 - DNA, 17 bp, Homo sapiens
tgagttggggtctggca

SEQ ID NO: 1018392 - DNA, 15 bp, Homo sapiens
tgagtttaccatttg

SEQ ID NO: 1018393 - DNA, 23 bp, Homo sapiens
tgagtttaccttgtatactgtag

SEQ ID NO: 1018394 - DNA, 22 bp, Homo sapiens
tgagtttcactgtactgcatgt

SEQ ID NO: 1018395 - DNA, 18 bp, Homo sapiens
tgagtttcattctcctgc

SEQ ID NO: 1018396 - DNA, 17 bp, Homo sapiens
tgagtttgagctgcctt

SEQ ID NO: 1018397 - DNA, 19 bp, Homo sapiens
tgagtttgctggttgtaaa

SEQ ID NO: 1018398 - DNA, 13 bp, Homo sapiens
tgagtttgcttat

SEQ ID NO: 1018399 - DNA, 14 bp, Homo sapiens
tgagtttgtaaata

SEQ ID NO: 1018400 - DNA, 18 bp, Homo sapiens
tgagttttattgagaatt

SEQ ID NO: 1018401 - DNA, 13 bp, Homo sapiens
tgagttttctcct

SEQ ID NO: 1018402 - DNA, 18 bp, Homo sapiens
tgagttttgataaagtaa

SEQ ID NO: 1018403 - DNA, 19 bp, Homo sapiens
tgagttttgatgctgtatt

SEQ ID NO: 1018404 - DNA, 18 bp, Homo sapiens
tgagttttgtgtttgttg

SEQ ID NO: 1018405 - DNA, 14 bp, Homo sapiens
tgagtttttcctcc

SEQ ID NO: 1018406 - DNA, 18 bp, Homo sapiens
tgagtttttgatagcttt

SEQ ID NO: 1018407 - DNA, 17 bp, Homo sapiens
tgagttttttctcttgg

SEQ ID NO: 1018408 - DNA, 18 bp, Homo sapiens
tgagttttttctcttggg

SEQ ID NO: 1018409 - DNA, 15 bp, Homo sapiens
tgataaaaataaagc

SEQ ID NO: 1018410 - DNA, 13 bp, Homo sapiens
tgataaaaatact

SEQ ID NO: 1018411 - DNA, 19 bp, Homo sapiens
tgataaaataaataatttt

SEQ ID NO: 1018412 - DNA, 13 bp, Homo sapiens
tgataaaattgtg

SEQ ID NO: 1018413 - DNA, 14 bp, Homo sapiens
tgataaaattgtga

SEQ ID NO: 1018414 - DNA, 16 bp, Homo sapiens
tgataaacattaaaca

SEQ ID NO: 1018415 - DNA, 22 bp, Homo sapiens
tgataaacattaaacactgtaa

SEQ ID NO: 1018416 - DNA, 17 bp, Homo sapiens
tgataaacattcctgtt

SEQ ID NO: 1018417 - DNA, 13 bp, Homo sapiens
tgataaactcaga

SEQ ID NO: 1018418 - DNA, 13 bp, Homo sapiens
tgataaagacttt

SEQ ID NO: 1018419 - DNA, 14 bp, Homo sapiens
tgataaagactttt

SEQ ID NO: 1018420 - DNA, 16 bp, Homo sapiens
tgataaagaggcatct

SEQ ID NO: 1018421 - DNA, 14 bp, Homo sapiens
tgataaagtaataa

SEQ ID NO: 1018422 - DNA, 12 bp, Homo sapiens
tgataaagttgt

SEQ ID NO: 1018423 - DNA, 18 bp, Homo sapiens
tgataaatatatatgatc

SEQ ID NO: 1018424 - DNA, 17 bp, Homo sapiens
tgataaatcagtcaagc

SEQ ID NO: 1018425 - DNA, 14 bp, Homo sapiens
tgataagaacagag

SEQ ID NO: 1018426 - DNA, 20 bp, Homo sapiens
tgataaggcctactatacat

SEQ ID NO: 1018427 - DNA, 20 bp, Homo sapiens
tgataagggaaaagataaag

SEQ ID NO: 1018428 - DNA, 10 bp, Homo sapiens
ggccagggag

SEQ ID NO: 1018429 - DNA, 11 bp, Homo sapiens
ggccagggagg

SEQ ID NO: 1018430 - DNA, 17 bp, Homo sapiens
ggccagggaggcagagc

SEQ ID NO: 1018431 - DNA, 19 bp, Homo sapiens
ggccagggaggcgcaggga

SEQ ID NO: 1018432 - DNA, 21 bp, Homo sapiens
ggccagggaggcgcagggaca

SEQ ID NO: 1018433 - DNA, 16 bp, Homo sapiens
ggccagggcaatgcca

SEQ ID NO: 1018434 - DNA, 18 bp, Homo sapiens
ggccagggcaatgccatc

SEQ ID NO: 1018435 - DNA, 23 bp, Homo sapiens
ggccagggcccctcaccctgcct

SEQ ID NO: 1018436 - DNA, 14 bp, Homo sapiens
ggccagggcctctc

SEQ ID NO: 1018437 - DNA, 15 bp, Homo sapiens
ggccagggcggccag

SEQ ID NO: 1018438 - DNA, 19 bp, Homo sapiens
ggccagggcggccagggac

SEQ ID NO: 1018439 - DNA, 17 bp, Homo sapiens
ggccagggctgccctga

SEQ ID NO: 1018440 - DNA, 20 bp, Homo sapiens
ggccagggcttccccatcag

SEQ ID NO: 1018441 - DNA, 21 bp, Homo sapiens
ggccagggcttccccatcagc

SEQ ID NO: 1018442 - DNA, 17 bp, Homo sapiens
ggccaggggcaggcagg

SEQ ID NO: 1018443 - DNA, 14 bp, Homo sapiens
ggccaggggtggga

SEQ ID NO: 1018444 - DNA, 17 bp, Homo sapiens
ggccagggtctgtgtga

SEQ ID NO: 1018445 - DNA, 21 bp, Homo sapiens
ggccaggtagcaagagagcag

SEQ ID NO: 1018446 - DNA, 16 bp, Homo sapiens
ggccaggtgcggcctg

SEQ ID NO: 1018447 - DNA, 22 bp, Homo sapiens
ggccaggtgcggcctgggggga

SEQ ID NO: 1018448 - DNA, 18 bp, Homo sapiens
ggccagtacctttccatt

SEQ ID NO: 1018449 - DNA, 21 bp, Homo sapiens
ggccagtccaggctgccgtgg

SEQ ID NO: 1018450 - DNA, 12 bp, Homo sapiens
ggccagtcccca

SEQ ID NO: 1018451 - DNA, 22 bp, Homo sapiens
ggccagtccccatttctgcctc

SEQ ID NO: 1018452 - DNA, 18 bp, Homo sapiens
ggccagtcctgcctggcc

SEQ ID NO: 1018453 - DNA, 22 bp, Homo sapiens
ggccagtcctgcctggccaggc

SEQ ID NO: 1018454 - DNA, 15 bp, Homo sapiens
ggccagtcctggtcc

SEQ ID NO: 1018455 - DNA, 14 bp, Homo sapiens
ggccagtctgtgga

SEQ ID NO: 1018456 - DNA, 15 bp, Homo sapiens
ggccagtctgtggat

SEQ ID NO: 1018457 - DNA, 16 bp, Homo sapiens
ggccagtgagaagctg

SEQ ID NO: 1018458 - DNA, 17 bp, Homo sapiens
ggccagtgagaagctga

SEQ ID NO: 1018459 - DNA, 21 bp, Homo sapiens
ggccagtgagaagctgaggcc

SEQ ID NO: 1018460 - DNA, 23 bp, Homo sapiens
ggccagtgagaagctgaggccta

SEQ ID NO: 1018461 - DNA, 16 bp, Homo sapiens
ggccagtgagggctgg

SEQ ID NO: 1018462 - DNA, 18 bp, Homo sapiens
tgatcatgtttatgagaa

SEQ ID NO: 1018463 - DNA, 22 bp, Homo sapiens
tgatcattacatggctgtggtt

SEQ ID NO: 1018464 - DNA, 12 bp, Homo sapiens
tgatcattgaaa

SEQ ID NO: 1018465 - DNA, 16 bp, Homo sapiens
tgatcattgaaatact

SEQ ID NO: 1018466 - DNA, 21 bp, Homo sapiens
tgatcattgaaatacttttta

SEQ ID NO: 1018467 - DNA, 19 bp, Homo sapiens
tgatcattttccccccact

SEQ ID NO: 1018468 - DNA, 22 bp, Homo sapiens
tgatcattttccccccactctc

SEQ ID NO: 1018469 - DNA, 19 bp, Homo sapiens
tgatccacactttgggctt

SEQ ID NO: 1018470 - DNA, 21 bp, Homo sapiens
tgatccacccaaccctatctc

SEQ ID NO: 1018471 - DNA, 13 bp, Homo sapiens
tgatccagaagag

SEQ ID NO: 1018472 - DNA, 18 bp, Homo sapiens
tgatccagaagagcccat

SEQ ID NO: 1018473 - DNA, 15 bp, Homo sapiens
tgatccagagcacag

SEQ ID NO: 1018474 - DNA, 14 bp, Homo sapiens
tgatccagccctgg

SEQ ID NO: 1018475 - DNA, 16 bp, Homo sapiens
tgatccatccatctcc

SEQ ID NO: 1018476 - DNA, 19 bp, Homo sapiens
tgatcccaagtgccagtct

SEQ ID NO: 1018477 - DNA, 13 bp, Homo sapiens
tgatcccaccccc

SEQ ID NO: 1018478 - DNA, 17 bp, Homo sapiens
tgatcccaccccctcct

SEQ ID NO: 1018479 - DNA, 18 bp, Homo sapiens
tgatcccacttcactgtg

SEQ ID NO: 1018480 - DNA, 12 bp, Homo sapiens
tgatcccagacc

SEQ ID NO: 1018481 - DNA, 13 bp, Homo sapiens
tgatcccagcact

SEQ ID NO: 1018482 - DNA, 17 bp, Homo sapiens
tgatcccagtcactcct

SEQ ID NO: 1018483 - DNA, 20 bp, Homo sapiens
tgatcccagtcactcctctc

SEQ ID NO: 1018484 - DNA, 15 bp, Homo sapiens
tgatcccatattctt

SEQ ID NO: 1018485 - DNA, 18 bp, Homo sapiens
tgatccccaagtgtgaac

SEQ ID NO: 1018486 - DNA, 11 bp, Homo sapiens
tgatccctcca

SEQ ID NO: 1018487 - DNA, 14 bp, Homo sapiens
tgatccctccaccc

SEQ ID NO: 1018488 - DNA, 22 bp, Homo sapiens
tgatccctgaacccctggccag

SEQ ID NO: 1018489 - DNA, 15 bp, Homo sapiens
tgatccctggccact

SEQ ID NO: 1018490 - DNA, 16 bp, Homo sapiens
tgatccctggccactg

SEQ ID NO: 1018491 - DNA, 17 bp, Homo sapiens
tgatcccttgagatatg

SEQ ID NO: 1018492 - DNA, 20 bp, Homo sapiens
tgatccggctgctcctccag

SEQ ID NO: 1018493 - DNA, 23 bp, Homo sapiens
tgatccggctgctcctccagccc

SEQ ID NO: 1018494 - DNA, 18 bp, Homo sapiens
tgatccgtccgaggctgc

SEQ ID NO: 1018495 - DNA, 14 bp, Homo sapiens
tgatcctcacgcct

SEQ ID NO: 1018496 - DNA, 17 bp, Homo sapiens
tgatcctcacgccttgg

SEQ ID NO: 1018497 - DNA, 19 bp, Homo sapiens
tgatcctcacgccttggcc

SEQ ID NO: 1018498 - DNA, 15 bp, Homo sapiens
tgatcctcagcccct

SEQ ID NO: 1018499 - DNA, 13 bp, Homo sapiens
tgatcctccaaca

SEQ ID NO: 1018500 - DNA, 17 bp, Homo sapiens
tgatcctccaacttcat

SEQ ID NO: 1018501 - DNA, 14 bp, Homo sapiens
tgatcctccaatgt

SEQ ID NO: 1018502 - DNA, 17 bp, Homo sapiens
tgatcctctattttgtg

SEQ ID NO: 1018503 - DNA, 14 bp, Homo sapiens
tgatcctctcacct

SEQ ID NO: 1018504 - DNA, 11 bp, Homo sapiens
tgatcctgcca

SEQ ID NO: 1018505 - DNA, 13 bp, Homo sapiens
tgatcctgcggag

SEQ ID NO: 1018506 - DNA, 21 bp, Homo sapiens
tgatcctgcggagaacaccct

SEQ ID NO: 1018507 - DNA, 23 bp, Homo sapiens
tgatcctggaggtcttttctagt

SEQ ID NO: 1018508 - DNA, 13 bp, Homo sapiens
tgatcctgtcctt

SEQ ID NO: 1018509 - DNA, 17 bp, Homo sapiens
tgatccttttttgtcat

SEQ ID NO: 1018510 - DNA, 18 bp, Homo sapiens
tgatccttttttgtcatt

SEQ ID NO: 1018511 - DNA, 19 bp, Homo sapiens
tgatccttttttgtcattt

SEQ ID NO: 1018512 - DNA, 22 bp, Homo sapiens
tgatccttttttgtcattttat

SEQ ID NO: 1018513 - DNA, 23 bp, Homo sapiens
tgatccttttttgtcattttatg

SEQ ID NO: 1018514 - DNA, 15 bp, Homo sapiens
tgatcgaaaaaataa

SEQ ID NO: 1018515 - DNA, 17 bp, Homo sapiens
tgatcgacttcttggtt

SEQ ID NO: 1018516 - DNA, 20 bp, Homo sapiens
tgatcgtagaaaatttgctt

SEQ ID NO: 1018517 - DNA, 15 bp, Homo sapiens
tgatcgtgctaaatt

SEQ ID NO: 1018518 - DNA, 22 bp, Homo sapiens
tgatcgtgctaaattttcagta

SEQ ID NO: 1018519 - DNA, 18 bp, Homo sapiens
tgatctaatacaaagatg

SEQ ID NO: 1018520 - DNA, 22 bp, Homo sapiens
tgatctatgtttgtgtgatttc

SEQ ID NO: 1018521 - DNA, 16 bp, Homo sapiens
tgatctccatatgtta

SEQ ID NO: 1018522 - DNA, 13 bp, Homo sapiens
tgatctccctgcc

SEQ ID NO: 1018523 - DNA, 14 bp, Homo sapiens
tgatctccctgccg

SEQ ID NO: 1018524 - DNA, 15 bp, Homo sapiens
tgatctcggatgacc

SEQ ID NO: 1018525 - DNA, 17 bp, Homo sapiens
tgatctcggatgaccaa

SEQ ID NO: 1018526 - DNA, 20 bp, Homo sapiens
tgatctcggctcactgcaaa

SEQ ID NO: 1018527 - DNA, 12 bp, Homo sapiens
tgatctctccac

SEQ ID NO: 1018528 - DNA, 14 bp, Homo sapiens
tgatctctccacgg

SEQ ID NO: 1018529 - DNA, 17 bp, Homo sapiens
tgatctctgacctctgc

SEQ ID NO: 1018530 - DNA, 19 bp, Homo sapiens
tgatctctgacctctgctg

SEQ ID NO: 1018531 - DNA, 15 bp, Homo sapiens
tgatctcttagaagc

SEQ ID NO: 1018532 - DNA, 12 bp, Homo sapiens
tgatctcttcct

SEQ ID NO: 1018533 - DNA, 17 bp, Homo sapiens
tgatctgagtcccagga

SEQ ID NO: 1018534 - DNA, 19 bp, Homo sapiens
tgatctgcatatttctgta

SEQ ID NO: 1018535 - DNA, 20 bp, Homo sapiens
tgatctgcatatttctgtat

SEQ ID NO: 1018536 - DNA, 18 bp, Homo sapiens
tgatctggacagaacatt

SEQ ID NO: 1018537 - DNA, 20 bp, Homo sapiens
tgatctgggcattttcctcc

SEQ ID NO: 1018538 - DNA, 13 bp, Homo sapiens
tgatctgtacttt

SEQ ID NO: 1018539 - DNA, 16 bp, Homo sapiens
tgatctgtactttgtg

SEQ ID NO: 1018540 - DNA, 18 bp, Homo sapiens
tgatctgtagacttctgg

SEQ ID NO: 1018541 - DNA, 13 bp, Homo sapiens
tgatctgtatata

SEQ ID NO: 1018542 - DNA, 22 bp, Homo sapiens
tgatctgtatatacaataacat

SEQ ID NO: 1018543 - DNA, 14 bp, Homo sapiens
tgatctgtgatttc

SEQ ID NO: 1018544 - DNA, 12 bp, Homo sapiens
tgatctgtgtac

SEQ ID NO: 1018545 - DNA, 19 bp, Homo sapiens
tgatcttctgggagcagga

SEQ ID NO: 1018546 - DNA, 18 bp, Homo sapiens
tgatcttgcctgtctggc

SEQ ID NO: 1018547 - DNA, 13 bp, Homo sapiens
tgatctttgagcc

SEQ ID NO: 1018548 - DNA, 15 bp, Homo sapiens
tgatctttgtttaaa

SEQ ID NO: 1018549 - DNA, 17 bp, Homo sapiens
tgatctttgtttaaatg

SEQ ID NO: 1018550 - DNA, 14 bp, Homo sapiens
tgatcttttaaagt

SEQ ID NO: 1018551 - DNA, 15 bp, Homo sapiens
tgatcttttaaagtg

SEQ ID NO: 1018552 - DNA, 19 bp, Homo sapiens
tgatctttttatacacaat

SEQ ID NO: 1018553 - DNA, 14 bp, Homo sapiens
tgatgaaacattca

SEQ ID NO: 1018554 - DNA, 22 bp, Homo sapiens
tgatgaaactcctgattttgta

SEQ ID NO: 1018555 - DNA, 13 bp, Homo sapiens
tgatgaaagctga

SEQ ID NO: 1018556 - DNA, 19 bp, Homo sapiens
tgatgaaagctgattactg

SEQ ID NO: 1018557 - DNA, 18 bp, Homo sapiens
tgatgaaatctgctagaa

SEQ ID NO: 1018558 - DNA, 13 bp, Homo sapiens
tgatgaaatcttt

SEQ ID NO: 1018559 - DNA, 20 bp, Homo sapiens
tgatgaacatattcatgaaa

SEQ ID NO: 1018560 - DNA, 22 bp, Homo sapiens
tgatgaacatattcatgaaatg

SEQ ID NO: 1018561 - DNA, 18 bp, Homo sapiens
ggcccctccacgcctcct

SEQ ID NO: 1018562 - DNA, 12 bp, Homo sapiens
ggcccctccact

SEQ ID NO: 1018563 - DNA, 18 bp, Homo sapiens
ggcccctccctcccggct

SEQ ID NO: 1018564 - DNA, 17 bp, Homo sapiens
ggcccctccctctgccc

SEQ ID NO: 1018565 - DNA, 21 bp, Homo sapiens
ggcccctccctctgccccaag

SEQ ID NO: 1018566 - DNA, 14 bp, Homo sapiens
ggcccctctgccca

SEQ ID NO: 1018567 - DNA, 17 bp, Homo sapiens
ggcccctctgcccagct

SEQ ID NO: 1018568 - DNA, 17 bp, Homo sapiens
ggcccctctgtggagcg

SEQ ID NO: 1018569 - DNA, 20 bp, Homo sapiens
ggcccctctgtggagcgccc

SEQ ID NO: 1018570 - DNA, 16 bp, Homo sapiens
ggcccctgaggactgg

SEQ ID NO: 1018571 - DNA, 17 bp, Homo sapiens
ggcccctgcatcccctt

SEQ ID NO: 1018572 - DNA, 16 bp, Homo sapiens
ggcccctgctgtctct

SEQ ID NO: 1018573 - DNA, 21 bp, Homo sapiens
ggcccctgctgtctctctggg

SEQ ID NO: 1018574 - DNA, 14 bp, Homo sapiens
ggcccctggatctc

SEQ ID NO: 1018575 - DNA, 18 bp, Homo sapiens
ggcccctggcccagcggc

SEQ ID NO: 1018576 - DNA, 15 bp, Homo sapiens
ggcccctggcctgcc

SEQ ID NO: 1018577 - DNA, 12 bp, Homo sapiens
ggcccctgggat

SEQ ID NO: 1018578 - DNA, 13 bp, Homo sapiens
ggcccctgggatg

SEQ ID NO: 1018579 - DNA, 20 bp, Homo sapiens
ggcccctgggatgggaccag

SEQ ID NO: 1018580 - DNA, 22 bp, Homo sapiens
ggcccctgggatgggaccaggg

SEQ ID NO: 1018581 - DNA, 17 bp, Homo sapiens
ggcccctggggacagag

SEQ ID NO: 1018582 - DNA, 13 bp, Homo sapiens
ggcccctgtcccc

SEQ ID NO: 1018583 - DNA, 21 bp, Homo sapiens
ggccccttccaaatgtccctc

SEQ ID NO: 1018584 - DNA, 20 bp, Homo sapiens
ggccccttcccagccagccc

SEQ ID NO: 1018585 - DNA, 15 bp, Homo sapiens
ggccctgttccctgg

SEQ ID NO: 1018586 - DNA, 14 bp, Homo sapiens
ggccctgttctcct

SEQ ID NO: 1018587 - DNA, 19 bp, Homo sapiens
ggccctgttctcctcccca

SEQ ID NO: 1018588 - DNA, 18 bp, Homo sapiens
ggcccttcagtctgctcc

SEQ ID NO: 1018589 - DNA, 22 bp, Homo sapiens
ggcccttcagtctgctccacca

SEQ ID NO: 1018590 - DNA, 18 bp, Homo sapiens
ggcccttccttccatttt

SEQ ID NO: 1018591 - DNA, 18 bp, Homo sapiens
ggcccttctgtccaccag

SEQ ID NO: 1018592 - DNA, 18 bp, Homo sapiens
ggcccttggccccagagg

SEQ ID NO: 1018593 - DNA, 18 bp, Homo sapiens
ggcccttgggacagccag

SEQ ID NO: 1018594 - DNA, 19 bp, Homo sapiens
ggcccttgggccacgctct

SEQ ID NO: 1018595 - DNA, 15 bp, Homo sapiens
ggcccttggggcctg

SEQ ID NO: 1018596 - DNA, 14 bp, Homo sapiens
ggcccttggtgggg

SEQ ID NO: 1018597 - DNA, 16 bp, Homo sapiens
ggcccttgtcattgcc

SEQ ID NO: 1018598 - DNA, 17 bp, Homo sapiens
ggcccttgtcctgccag

SEQ ID NO: 1018599 - DNA, 18 bp, Homo sapiens
ggcccttgtcctgccagc

SEQ ID NO: 1018600 - DNA, 19 bp, Homo sapiens
ggcccttgtcctgccagct

SEQ ID NO: 1018601 - DNA, 21 bp, Homo sapiens
ggcccttgtttacagtgagga

SEQ ID NO: 1018602 - DNA, 20 bp, Homo sapiens
ggccctttgaagcctcagct

SEQ ID NO: 1018603 - DNA, 18 bp, Homo sapiens
ggccgaagccccttggag

SEQ ID NO: 1018604 - DNA, 20 bp, Homo sapiens
ggccgaagccccttggagag

SEQ ID NO: 1018605 - DNA, 14 bp, Homo sapiens
ggccgaagctctgg

SEQ ID NO: 1018606 - DNA, 16 bp, Homo sapiens
ggccgaagctctggct

SEQ ID NO: 1018607 - DNA, 19 bp, Homo sapiens
ggccgacgttttctccgca

SEQ ID NO: 1018608 - DNA, 19 bp, Homo sapiens
ggccgagctcctggggagc

SEQ ID NO: 1018609 - DNA, 20 bp, Homo sapiens
ggccgagctcctggggagct

SEQ ID NO: 1018610 - DNA, 14 bp, Homo sapiens
ggccgaggcgggtg

SEQ ID NO: 1018611 - DNA, 13 bp, Homo sapiens
ggccgagggccag

SEQ ID NO: 1018612 - DNA, 17 bp, Homo sapiens
ggccgagggccaggcag

SEQ ID NO: 1018613 - DNA, 20 bp, Homo sapiens
ggccgagggccaggcagaat

SEQ ID NO: 1018614 - DNA, 16 bp, Homo sapiens
ggccgagggtcctggc

SEQ ID NO: 1018615 - DNA, 15 bp, Homo sapiens
ggccgaggtgggcag

SEQ ID NO: 1018616 - DNA, 17 bp, Homo sapiens
ggccgcaagggcctgga

SEQ ID NO: 1018617 - DNA, 17 bp, Homo sapiens
ggccgcacgcctctccc

SEQ ID NO: 1018618 - DNA, 13 bp, Homo sapiens
ggccgcaggaggg

SEQ ID NO: 1018619 - DNA, 13 bp, Homo sapiens
ggccgcagggccc

SEQ ID NO: 1018620 - DNA, 14 bp, Homo sapiens
ggccgcagggccca

SEQ ID NO: 1018621 - DNA, 15 bp, Homo sapiens
ggccgcagggcccac

SEQ ID NO: 1018622 - DNA, 13 bp, Homo sapiens
ggccgccagcgtg

SEQ ID NO: 1018623 - DNA, 20 bp, Homo sapiens
ggccgcccacccgcccgagg

SEQ ID NO: 1018624 - DNA, 18 bp, Homo sapiens
ggccgccccctgcccccc

SEQ ID NO: 1018625 - DNA, 19 bp, Homo sapiens
ggccgccccctgcccccca

SEQ ID NO: 1018626 - DNA, 16 bp, Homo sapiens
ggccgccgccaggact

SEQ ID NO: 1018627 - DNA, 14 bp, Homo sapiens
ggccgccgcctctt

SEQ ID NO: 1018628 - DNA, 16 bp, Homo sapiens
ggccgcctgccctgcc

SEQ ID NO: 1018629 - DNA, 19 bp, Homo sapiens
ggccgcctgccctgccttg

SEQ ID NO: 1018630 - DNA, 14 bp, Homo sapiens
ggccgcctgcctta

SEQ ID NO: 1018631 - DNA, 17 bp, Homo sapiens
ggccgcctgcgggctgc

SEQ ID NO: 1018632 - DNA, 18 bp, Homo sapiens
ggccgccttctcccctct

SEQ ID NO: 1018633 - DNA, 14 bp, Homo sapiens
ggccgcgccacccg

SEQ ID NO: 1018634 - DNA, 19 bp, Homo sapiens
ggccgcgcgtccagctgcc

SEQ ID NO: 1018635 - DNA, 22 bp, Homo sapiens
ggccgcggccctggggcgggca

SEQ ID NO: 1018636 - DNA, 19 bp, Homo sapiens
ggccgcggcctccccgagg

SEQ ID NO: 1018637 - DNA, 19 bp, Homo sapiens
ggccgctagaggcctgagg

SEQ ID NO: 1018638 - DNA, 20 bp, Homo sapiens
ggccgctagaggcctgagga

SEQ ID NO: 1018639 - DNA, 15 bp, Homo sapiens
ggccgctgagcgccc

SEQ ID NO: 1018640 - DNA, 22 bp, Homo sapiens
ggccgctgagcgcccccgagcc

SEQ ID NO: 1018641 - DNA, 13 bp, Homo sapiens
ggccgctgccacc

SEQ ID NO: 1018642 - DNA, 22 bp, Homo sapiens
ggccgctgccacccacctccct

SEQ ID NO: 1018643 - DNA, 22 bp, Homo sapiens
ggccggacccccgtcagctgct

SEQ ID NO: 1018644 - DNA, 18 bp, Homo sapiens
ggccggccggacctctga

SEQ ID NO: 1018645 - DNA, 19 bp, Homo sapiens
ggccggctgtgctcagaga

SEQ ID NO: 1018646 - DNA, 16 bp, Homo sapiens
ggccgggaggcagtgc

SEQ ID NO: 1018647 - DNA, 15 bp, Homo sapiens
ggccgggcaggtcct

SEQ ID NO: 1018648 - DNA, 23 bp, Homo sapiens
ggccgggctgtagatcaggtttg

SEQ ID NO: 1018649 - DNA, 13 bp, Homo sapiens
ggccggggagggg

SEQ ID NO: 1018650 - DNA, 21 bp, Homo sapiens
ggccggggagggggcacggca

SEQ ID NO: 1018651 - DNA, 13 bp, Homo sapiens
ggccggggggagg

SEQ ID NO: 1018652 - DNA, 14 bp, Homo sapiens
ggccggggggaggg

SEQ ID NO: 1018653 - DNA, 17 bp, Homo sapiens
ggccggggggggtagga

SEQ ID NO: 1018654 - DNA, 13 bp, Homo sapiens
ggccggtgctggg

SEQ ID NO: 1018655 - DNA, 14 bp, Homo sapiens
ggccggtgctgggg

SEQ ID NO: 1018656 - DNA, 20 bp, Homo sapiens
ggccggtgctgggggcacag

SEQ ID NO: 1018657 - DNA, 13 bp, Homo sapiens
ggccgtctcctcc

SEQ ID NO: 1018658 - DNA, 13 bp, Homo sapiens
ggccgtgcccagg

SEQ ID NO: 1018659 - DNA, 23 bp, Homo sapiens
ggccgtgggccgggaggcagtgc

SEQ ID NO: 1018660 - DNA, 13 bp, Homo sapiens
ggccgtgtctctg

SEQ ID NO: 1018661 - DNA, 16 bp, Homo sapiens
ggccgttccccttggc

SEQ ID NO: 1018662 - DNA, 22 bp, Homo sapiens
ggccgttccccttggcttcctc

SEQ ID NO: 1018663 - DNA, 18 bp, Homo sapiens
ggcctaaaactggcctga

SEQ ID NO: 1018664 - DNA, 20 bp, Homo sapiens
ggcctaaaactggcctgact

SEQ ID NO: 1018665 - DNA, 17 bp, Homo sapiens
ggcctaaaagtaaacat

SEQ ID NO: 1018666 - DNA, 20 bp, Homo sapiens
ggcctacagaggaggcctca

SEQ ID NO: 1018667 - DNA, 17 bp, Homo sapiens
ggcctacatgctttgtg

SEQ ID NO: 1018668 - DNA, 18 bp, Homo sapiens
ggcctacatgctttgtga

SEQ ID NO: 1018669 - DNA, 23 bp, Homo sapiens
ggcctaccccgcagacaccttgg

SEQ ID NO: 1018670 - DNA, 19 bp, Homo sapiens
ggcctacctcaagttcttg

SEQ ID NO: 1018671 - DNA, 24 bp, Homo sapiens
ggcctactagagtctgaacagctg

SEQ ID NO: 1018672 - DNA, 13 bp, Homo sapiens
ggcctagaccagc

SEQ ID NO: 1018673 - DNA, 13 bp, Homo sapiens
ggcctagactctg

SEQ ID NO: 1018674 - DNA, 17 bp, Homo sapiens
ggcctagatccacacac

SEQ ID NO: 1018675 - DNA, 20 bp, Homo sapiens
ggcctagcatacgtacacat

SEQ ID NO: 1018676 - DNA, 23 bp, Homo sapiens
ggcctagcatacgtacacatttt

SEQ ID NO: 1018677 - DNA, 21 bp, Homo sapiens
ggcctagcgatctctcctggc

SEQ ID NO: 1018678 - DNA, 23 bp, Homo sapiens
ggcctagcgatctctcctggcct

SEQ ID NO: 1018679 - DNA, 13 bp, Homo sapiens
ggcctaggaggcc

SEQ ID NO: 1018680 - DNA, 22 bp, Homo sapiens
ggcctataaaattaaatgcctt

SEQ ID NO: 1018681 - DNA, 14 bp, Homo sapiens
ggcctatgtggtct

SEQ ID NO: 1018682 - DNA, 19 bp, Homo sapiens
ggcctattatattaaaata

SEQ ID NO: 1018683 - DNA, 18 bp, Homo sapiens
ggcctcaaaggcccgctc

SEQ ID NO: 1018684 - DNA, 22 bp, Homo sapiens
ggcctcaaagttggggcaggct

SEQ ID NO: 1018685 - DNA, 22 bp, Homo sapiens
ggcctcaacaaggatcaggctg

SEQ ID NO: 1018686 - DNA, 23 bp, Homo sapiens
ggcctcaacaaggatcaggctgc

SEQ ID NO: 1018687 - DNA, 17 bp, Homo sapiens
ggcctcaaccctccctc

SEQ ID NO: 1018688 - DNA, 23 bp, Homo sapiens
ggcctcaaccctccctcagcccc

SEQ ID NO: 1018689 - DNA, 23 bp, Homo sapiens
ggcctcaagaaaggcccggaagc

SEQ ID NO: 1018690 - DNA, 22 bp, Homo sapiens
tgatgtaatcttgaattgtaac

SEQ ID NO: 1018691 - DNA, 17 bp, Homo sapiens
tgatgtacagaacacaa

SEQ ID NO: 1018692 - DNA, 18 bp, Homo sapiens
tgatgtacagaacacaaa

SEQ ID NO: 1018693 - DNA, 19 bp, Homo sapiens
tgatgtacagtctgtcatg

SEQ ID NO: 1018694 - DNA, 20 bp, Homo sapiens
tgatgtaccatgaaacaaag

SEQ ID NO: 1018695 - DNA, 18 bp, Homo sapiens
tgatgtagaaaagagact

SEQ ID NO: 1018696 - DNA, 14 bp, Homo sapiens
tgatgtatatgttt

SEQ ID NO: 1018697 - DNA, 16 bp, Homo sapiens
tgatgtatatgtttat

SEQ ID NO: 1018698 - DNA, 13 bp, Homo sapiens
tgatgtatgtgtg

SEQ ID NO: 1018699 - DNA, 21 bp, Homo sapiens
tgatgtatgtgtgaaacaatg

SEQ ID NO: 1018700 - DNA, 19 bp, Homo sapiens
tgatgtcaatttctgtgtt

SEQ ID NO: 1018701 - DNA, 14 bp, Homo sapiens
tgatgtcagaaaca

SEQ ID NO: 1018702 - DNA, 13 bp, Homo sapiens
tgatgtcagcctt

SEQ ID NO: 1018703 - DNA, 15 bp, Homo sapiens
tgatgtcagccttgc

SEQ ID NO: 1018704 - DNA, 16 bp, Homo sapiens
tgatgtcagccttgca

SEQ ID NO: 1018705 - DNA, 17 bp, Homo sapiens
tgatgtcagccttgcat

SEQ ID NO: 1018706 - DNA, 18 bp, Homo sapiens
tgattgtggaatggagat

SEQ ID NO: 1018707 - DNA, 16 bp, Homo sapiens
tgattgtgttgaagaa

SEQ ID NO: 1018708 - DNA, 18 bp, Homo sapiens
tgattgtgttgagtgaag

SEQ ID NO: 1018709 - DNA, 19 bp, Homo sapiens
tgattgttaatttacagct

SEQ ID NO: 1018710 - DNA, 13 bp, Homo sapiens
tgattgttataaa

SEQ ID NO: 1018711 - DNA, 22 bp, Homo sapiens
tgattgtttcttcttcatgctt

SEQ ID NO: 1018712 - DNA, 16 bp, Homo sapiens
tgattgtttgctctga

SEQ ID NO: 1018713 - DNA, 13 bp, Homo sapiens
tgattgttttatt

SEQ ID NO: 1018714 - DNA, 15 bp, Homo sapiens
tgatttaatatgcaa

SEQ ID NO: 1018715 - DNA, 18 bp, Homo sapiens
tgatttaatgttttctgc

SEQ ID NO: 1018716 - DNA, 15 bp, Homo sapiens
tgatttaatttgaaa

SEQ ID NO: 1018717 - DNA, 16 bp, Homo sapiens
tgatttacagcaagta

SEQ ID NO: 1018718 - DNA, 21 bp, Homo sapiens
tgatttagaactgtatgtcag

SEQ ID NO: 1018719 - DNA, 17 bp, Homo sapiens
tgatttataaacagaca

SEQ ID NO: 1018720 - DNA, 20 bp, Homo sapiens
tgatttatgatcacttggaa

SEQ ID NO: 1018721 - DNA, 22 bp, Homo sapiens
tgatttatgcatggaaacctga

SEQ ID NO: 1018722 - DNA, 17 bp, Homo sapiens
tgatttatttgcttctt

SEQ ID NO: 1018723 - DNA, 18 bp, Homo sapiens
tgatttattttgtatgaa

SEQ ID NO: 1018724 - DNA, 16 bp, Homo sapiens
tgatttcacaacagat

SEQ ID NO: 1018725 - DNA, 16 bp, Homo sapiens
tgatttcactttggga

SEQ ID NO: 1018726 - DNA, 19 bp, Homo sapiens
tgatttcaggatactctgt

SEQ ID NO: 1018727 - DNA, 14 bp, Homo sapiens
tgatttcagtaagt

SEQ ID NO: 1018728 - DNA, 16 bp, Homo sapiens
tgatttcagtaagtct

SEQ ID NO: 1018729 - DNA, 13 bp, Homo sapiens
tgatttcagtttt

SEQ ID NO: 1018730 - DNA, 18 bp, Homo sapiens
tgatttcatcttctggaa

SEQ ID NO: 1018731 - DNA, 14 bp, Homo sapiens
tgatttccaaagag

SEQ ID NO: 1018732 - DNA, 18 bp, Homo sapiens
tgatttccaaagagaaaa

SEQ ID NO: 1018733 - DNA, 15 bp, Homo sapiens
tgatttccaggcccc

SEQ ID NO: 1018734 - DNA, 20 bp, Homo sapiens
tgatttccaggcccctgagg

SEQ ID NO: 1018735 - DNA, 19 bp, Homo sapiens
tgatttccagtgagtgtaa

SEQ ID NO: 1018736 - DNA, 15 bp, Homo sapiens
tgatttccatttctg

SEQ ID NO: 1018737 - DNA, 17 bp, Homo sapiens
tgatttccatttctgat

SEQ ID NO: 1018738 - DNA, 16 bp, Homo sapiens
tgatttcccccctccg

SEQ ID NO: 1018739 - DNA, 20 bp, Homo sapiens
tgatttcccccctccgcctc

SEQ ID NO: 1018740 - DNA, 22 bp, Homo sapiens
tgatttccgttaaaataccagc

SEQ ID NO: 1018741 - DNA, 14 bp, Homo sapiens
tgatttcctaaaca

SEQ ID NO: 1018742 - DNA, 17 bp, Homo sapiens
tgatttccttaatgaaa

SEQ ID NO: 1018743 - DNA, 12 bp, Homo sapiens
tgatttccttcc

SEQ ID NO: 1018744 - DNA, 13 bp, Homo sapiens
tgatttccttgaa

SEQ ID NO: 1018745 - DNA, 15 bp, Homo sapiens
tgatttccttgaatg

SEQ ID NO: 1018746 - DNA, 19 bp, Homo sapiens
tgatttccttgaatgtggc

SEQ ID NO: 1018747 - DNA, 11 bp, Homo sapiens
tgatttctaat

SEQ ID NO: 1018748 - DNA, 14 bp, Homo sapiens
tgatttctaattgt

SEQ ID NO: 1018749 - DNA, 22 bp, Homo sapiens
tgatttctaattgtaagtgaaa

SEQ ID NO: 1018750 - DNA, 14 bp, Homo sapiens
tgatttctattcaa

SEQ ID NO: 1018751 - DNA, 21 bp, Homo sapiens
tgatttcttattgaatttgtt

SEQ ID NO: 1018752 - DNA, 21 bp, Homo sapiens
tgatttcttcagaattagatg

SEQ ID NO: 1018753 - DNA, 19 bp, Homo sapiens
tgatttgaaaaaaagcatg

SEQ ID NO: 1018754 - DNA, 19 bp, Homo sapiens
tgatttgaagaacatgtga

SEQ ID NO: 1018755 - DNA, 17 bp, Homo sapiens
tgatttgatgtgacttt

SEQ ID NO: 1018756 - DNA, 21 bp, Homo sapiens
tgatttgcatggattttggat

SEQ ID NO: 1018757 - DNA, 22 bp, Homo sapiens
tgatttgcatggattttggata

SEQ ID NO: 1018758 - DNA, 13 bp, Homo sapiens
tgatttgcattga

SEQ ID NO: 1018759 - DNA, 13 bp, Homo sapiens
tgatttgcctgta

SEQ ID NO: 1018760 - DNA, 17 bp, Homo sapiens
tgatttgctctttgaca

SEQ ID NO: 1018761 - DNA, 21 bp, Homo sapiens
tgatttgggctgaatgtatgt

SEQ ID NO: 1018762 - DNA, 17 bp, Homo sapiens
tgatttggggatatttt

SEQ ID NO: 1018763 - DNA, 13 bp, Homo sapiens
tgatttgggggag

SEQ ID NO: 1018764 - DNA, 18 bp, Homo sapiens
tgatttgggggaggcttt

SEQ ID NO: 1018765 - DNA, 19 bp, Homo sapiens
tgatttggtgaccaactgt

SEQ ID NO: 1018766 - DNA, 20 bp, Homo sapiens
tgatttggttgcactttaga

SEQ ID NO: 1018767 - DNA, 16 bp, Homo sapiens
tgatttgtaaatagct

SEQ ID NO: 1018768 - DNA, 17 bp, Homo sapiens
tgatttgtaccattcct

SEQ ID NO: 1018769 - DNA, 22 bp, Homo sapiens
tgatttgtcccagcctggggct

SEQ ID NO: 1018770 - DNA, 15 bp, Homo sapiens
tgatttgttttgaat

SEQ ID NO: 1018771 - DNA, 15 bp, Homo sapiens
tgattttaaaatgaa

SEQ ID NO: 1018772 - DNA, 19 bp, Homo sapiens
tgattttaaagaacagtga

SEQ ID NO: 1018773 - DNA, 22 bp, Homo sapiens
tgattttaaaggcagagaagtt

SEQ ID NO: 1018774 - DNA, 12 bp, Homo sapiens
tgattttaacaa

SEQ ID NO: 1018775 - DNA, 14 bp, Homo sapiens
tgattttaatttta

SEQ ID NO: 1018776 - DNA, 19 bp, Homo sapiens
tgattttacaattgaaatg

SEQ ID NO: 1018777 - DNA, 14 bp, Homo sapiens
tgattttataattg

SEQ ID NO: 1018778 - DNA, 15 bp, Homo sapiens
tgattttatctgtga

SEQ ID NO: 1018779 - DNA, 18 bp, Homo sapiens
tgattttatgatcagtgt

SEQ ID NO: 1018780 - DNA, 15 bp, Homo sapiens
tgattttattacaga

SEQ ID NO: 1018781 - DNA, 21 bp, Homo sapiens
tgattttattacagaaatgtt

SEQ ID NO: 1018782 - DNA, 19 bp, Homo sapiens
tgattttatttttgcaaaa

SEQ ID NO: 1018783 - DNA, 13 bp, Homo sapiens
tgattttgaactt

SEQ ID NO: 1018784 - DNA, 15 bp, Homo sapiens
tgattttgaactttt

SEQ ID NO: 1018785 - DNA, 16 bp, Homo sapiens
tgattttgccctcctg

SEQ ID NO: 1018786 - DNA, 17 bp, Homo sapiens
tgattttgccctcctgc

SEQ ID NO: 1018787 - DNA, 16 bp, Homo sapiens
tgattttgctgtagaa

SEQ ID NO: 1018788 - DNA, 20 bp, Homo sapiens
tgattttggaaagatgttaa

SEQ ID NO: 1018789 - DNA, 20 bp, Homo sapiens
tgattttgtagttaatttat

SEQ ID NO: 1018790 - DNA, 21 bp, Homo sapiens
tgatttttaccgtttcttccc

SEQ ID NO: 1018791 - DNA, 22 bp, Homo sapiens
tgatttttaccgtttcttccct

SEQ ID NO: 1018792 - DNA, 20 bp, Homo sapiens
tgatttttagatgagattgt

SEQ ID NO: 1018793 - DNA, 23 bp, Homo sapiens
tgatttttataaatactgcaaat

SEQ ID NO: 1018794 - DNA, 17 bp, Homo sapiens
tgatttttggtatttat

SEQ ID NO: 1018795 - DNA, 18 bp, Homo sapiens
tgattttttcaaaaaagt

SEQ ID NO: 1018796 - DNA, 22 bp, Homo sapiens
tgatttttttttcatacactta

SEQ ID NO: 1018797 - DNA, 15 bp, Homo sapiens
tgcaaaaaaagcctc

SEQ ID NO: 1018798 - DNA, 18 bp, Homo sapiens
tgcaaaaaattctttaga

SEQ ID NO: 1018799 - DNA, 21 bp, Homo sapiens
tgcaaaaactctttgagaggg

SEQ ID NO: 1018800 - DNA, 15 bp, Homo sapiens
tgcaaaaagaaaaaa

SEQ ID NO: 1018801 - DNA, 23 bp, Homo sapiens
tgcaaaaatatttataaaacttc

SEQ ID NO: 1018802 - DNA, 19 bp, Homo sapiens
tgcaaaaccttttactggt

SEQ ID NO: 1018803 - DNA, 21 bp, Homo sapiens
tgcaaaacggatgagttatta

SEQ ID NO: 1018804 - DNA, 12 bp, Homo sapiens
tgcaaaagcagc

SEQ ID NO: 1018805 - DNA, 19 bp, Homo sapiens
tgcaaaaggactctcagga

SEQ ID NO: 1018806 - DNA, 12 bp, Homo sapiens
tgcaaaaggctg

SEQ ID NO: 1018807 - DNA, 21 bp, Homo sapiens
tgcaaaaggctgattactgaa

SEQ ID NO: 1018808 - DNA, 22 bp, Homo sapiens
tgcaaaaggctgattactgaaa

SEQ ID NO: 1018809 - DNA, 23 bp, Homo sapiens
tgcaaaaggttcactaaagcagt

SEQ ID NO: 1018810 - DNA, 22 bp, Homo sapiens
tgcaaaagtggggctaaatgaa

SEQ ID NO: 1018811 - DNA, 23 bp, Homo sapiens
tgcaaaagtggggctaaatgaag

SEQ ID NO: 1018812 - DNA, 22 bp, Homo sapiens
tgcaaaataagtttttctttaa

SEQ ID NO: 1018813 - DNA, 13 bp, Homo sapiens
tgcaaaatacatg

SEQ ID NO: 1018814 - DNA, 22 bp, Homo sapiens
tgcaaaatctgttatagcttta

SEQ ID NO: 1018815 - DNA, 23 bp, Homo sapiens
tgcaaaattagtacctcaaagta

SEQ ID NO: 1018816 - DNA, 22 bp, Homo sapiens
tgcaaaattgtctaaaatgtca

SEQ ID NO: 1018817 - DNA, 14 bp, Homo sapiens
tgcaaaattgtttt

SEQ ID NO: 1018818 - DNA, 16 bp, Homo sapiens
tgcaaaattgttttca

SEQ ID NO: 1018819 - DNA, 20 bp, Homo sapiens
tgcaaaattgttttcacttg

SEQ ID NO: 1018820 - DNA, 16 bp, Homo sapiens
ggcctgcatggagaag

SEQ ID NO: 1018821 - DNA, 14 bp, Homo sapiens
ggcctgccagtctg

SEQ ID NO: 1018822 - DNA, 14 bp, Homo sapiens
ggcctgcccagcct

SEQ ID NO: 1018823 - DNA, 16 bp, Homo sapiens
ggcctgcccagcctca

SEQ ID NO: 1018824 - DNA, 15 bp, Homo sapiens
ggcctgcccagttgc

SEQ ID NO: 1018825 - DNA, 19 bp, Homo sapiens
ggcctgccccctgggctgg

SEQ ID NO: 1018826 - DNA, 13 bp, Homo sapiens
ggcctgcccctgt

SEQ ID NO: 1018827 - DNA, 17 bp, Homo sapiens
ggcctgccctcagggat

SEQ ID NO: 1018828 - DNA, 15 bp, Homo sapiens
tgcaagtgctggagt

SEQ ID NO: 1018829 - DNA, 21 bp, Homo sapiens
tgcaagtgtatgcacgtgtgc

SEQ ID NO: 1018830 - DNA, 17 bp, Homo sapiens
tgcaagtgtctgtgtgc

SEQ ID NO: 1018831 - DNA, 22 bp, Homo sapiens
tgcaagtgtgtatgtgcgtgtg

SEQ ID NO: 1018832 - DNA, 23 bp, Homo sapiens
tgcaagtgtgtgcatgtgtgcga

SEQ ID NO: 1018833 - DNA, 17 bp, Homo sapiens
tgcaagttattttattt

SEQ ID NO: 1018834 - DNA, 13 bp, Homo sapiens
tgcaagttgagga

SEQ ID NO: 1018835 - DNA, 15 bp, Homo sapiens
tgcaataaagtataa

SEQ ID NO: 1018836 - DNA, 17 bp, Homo sapiens
tgcaataaagttattca

SEQ ID NO: 1018837 - DNA, 15 bp, Homo sapiens
tgcaataacagctgc

SEQ ID NO: 1018838 - DNA, 14 bp, Homo sapiens
tgcaataactctgg

SEQ ID NO: 1018839 - DNA, 16 bp, Homo sapiens
tgcaataactctggga

SEQ ID NO: 1018840 - DNA, 17 bp, Homo sapiens
tgcaataactctgggag

SEQ ID NO: 1018841 - DNA, 16 bp, Homo sapiens
tgcaataacttctata

SEQ ID NO: 1018842 - DNA, 22 bp, Homo sapiens
tgcaataacttctatattttaa

SEQ ID NO: 1018843 - DNA, 18 bp, Homo sapiens
tgcaataatccaccccca

SEQ ID NO: 1018844 - DNA, 14 bp, Homo sapiens
tgcaataattttac

SEQ ID NO: 1018845 - DNA, 14 bp, Homo sapiens
tgcaatagagactg

SEQ ID NO: 1018846 - DNA, 16 bp, Homo sapiens
tgcaatagagactgta

SEQ ID NO: 1018847 - DNA, 19 bp, Homo sapiens
tgcaatagagactgtagat

SEQ ID NO: 1018848 - DNA, 21 bp, Homo sapiens
tgcaataggtgagagaatgta

SEQ ID NO: 1018849 - DNA, 16 bp, Homo sapiens
tgcaatataagcataa

SEQ ID NO: 1018850 - DNA, 21 bp, Homo sapiens
tgcaatatcttcgttagtaat

SEQ ID NO: 1018851 - DNA, 18 bp, Homo sapiens
tgcaatcactttttggaa

SEQ ID NO: 1018852 - DNA, 23 bp, Homo sapiens
tgcaatcaggattttaaacatgt

SEQ ID NO: 1018853 - DNA, 15 bp, Homo sapiens
tgcaatcccttaata

SEQ ID NO: 1018854 - DNA, 15 bp, Homo sapiens
tgcaatctaatctga

SEQ ID NO: 1018855 - DNA, 18 bp, Homo sapiens
tgcaatctaatctgaact

SEQ ID NO: 1018856 - DNA, 13 bp, Homo sapiens
tgcaatctactgg

SEQ ID NO: 1018857 - DNA, 17 bp, Homo sapiens
tgcaatctactggaaat

SEQ ID NO: 1018858 - DNA, 19 bp, Homo sapiens
tgcaatcttggctcactgc

SEQ ID NO: 1018859 - DNA, 17 bp, Homo sapiens
tgcaatgacatcttcaa

SEQ ID NO: 1018860 - DNA, 18 bp, Homo sapiens
tgcaatgggggagggagg

SEQ ID NO: 1018861 - DNA, 17 bp, Homo sapiens
tgcaatggttaacatct

SEQ ID NO: 1018862 - DNA, 22 bp, Homo sapiens
tgcaatgtaaatattttaaaga

SEQ ID NO: 1018863 - DNA, 20 bp, Homo sapiens
tgcaatgtcacaacctctct

SEQ ID NO: 1018864 - DNA, 16 bp, Homo sapiens
tgcaatgtgctactga

SEQ ID NO: 1018865 - DNA, 23 bp, Homo sapiens
tgcaatgtggtgacacctccccc

SEQ ID NO: 1018866 - DNA, 16 bp, Homo sapiens
tgcaattaaaactatg

SEQ ID NO: 1018867 - DNA, 22 bp, Homo sapiens
tgcaattaaaactatgtgctat

SEQ ID NO: 1018868 - DNA, 22 bp, Homo sapiens
tgcaattaaacttccaaagaaa

SEQ ID NO: 1018869 - DNA, 23 bp, Homo sapiens
tgcaattaaacttccaaagaaag

SEQ ID NO: 1018870 - DNA, 24 bp, Homo sapiens
tgcaattaaacttccaaagaaagt

SEQ ID NO: 1018871 - DNA, 20 bp, Homo sapiens
tgcaattaggtttttcctta

SEQ ID NO: 1018872 - DNA, 14 bp, Homo sapiens
tgcaattcatgtaa

SEQ ID NO: 1018873 - DNA, 16 bp, Homo sapiens
tgcaattcatgtaaca

SEQ ID NO: 1018874 - DNA, 23 bp, Homo sapiens
tgcaattcatgtaacagttgtgt

SEQ ID NO: 1018875 - DNA, 18 bp, Homo sapiens
tgcaattcccctctgctg

SEQ ID NO: 1018876 - DNA, 18 bp, Homo sapiens
tgcaattgctcttctcca

SEQ ID NO: 1018877 - DNA, 19 bp, Homo sapiens
tgcaattgctcttctccac

SEQ ID NO: 1018878 - DNA, 15 bp, Homo sapiens
tgcaattgcttagga

SEQ ID NO: 1018879 - DNA, 21 bp, Homo sapiens
tgcaattgtaggggtgtgtgt

SEQ ID NO: 1018880 - DNA, 22 bp, Homo sapiens
tgcaattgtaggggtgtgtgtg

SEQ ID NO: 1018881 - DNA, 16 bp, Homo sapiens
tgcaatttaaaattat

SEQ ID NO: 1018882 - DNA, 15 bp, Homo sapiens
tgcaatttattaaaa

SEQ ID NO: 1018883 - DNA, 18 bp, Homo sapiens
tgcaatttattaaaatga

SEQ ID NO: 1018884 - DNA, 20 bp, Homo sapiens
tgcaatttgggatttactag

SEQ ID NO: 1018885 - DNA, 12 bp, Homo sapiens
tgcacaacagcc

SEQ ID NO: 1018886 - DNA, 19 bp, Homo sapiens
tgcacaacagccctgcctg

SEQ ID NO: 1018887 - DNA, 20 bp, Homo sapiens
tgcacaacagccctgcctga

SEQ ID NO: 1018888 - DNA, 15 bp, Homo sapiens
tgcacaagaatggat

SEQ ID NO: 1018889 - DNA, 14 bp, Homo sapiens
tgcacaagctcaga

SEQ ID NO: 1018890 - DNA, 15 bp, Homo sapiens
tgcacaataaaaatg

SEQ ID NO: 1018891 - DNA, 14 bp, Homo sapiens
tgcacaatatttct

SEQ ID NO: 1018892 - DNA, 19 bp, Homo sapiens
tgcacacagaatgctcagg

SEQ ID NO: 1018893 - DNA, 20 bp, Homo sapiens
tgcacacagaatgctcaggg

SEQ ID NO: 1018894 - DNA, 18 bp, Homo sapiens
tgcacacagacggcctag

SEQ ID NO: 1018895 - DNA, 12 bp, Homo sapiens
tgcacacagcac

SEQ ID NO: 1018896 - DNA, 24 bp, Homo sapiens
tgcacacagcacgggggccaagga

SEQ ID NO: 1018897 - DNA, 14 bp, Homo sapiens
tgcacacaggacag

SEQ ID NO: 1018898 - DNA, 17 bp, Homo sapiens
tgcacacatcaccaggt

SEQ ID NO: 1018899 - DNA, 21 bp, Homo sapiens
tgcacacatcaccaggtgcat

SEQ ID NO: 1018900 - DNA, 15 bp, Homo sapiens
tgcacacatttttta

SEQ ID NO: 1018901 - DNA, 12 bp, Homo sapiens
tgcacacccact

SEQ ID NO: 1018902 - DNA, 15 bp, Homo sapiens
tgcacacccactgcc

SEQ ID NO: 1018903 - DNA, 20 bp, Homo sapiens
tgcacacccatgcacactca

SEQ ID NO: 1018904 - DNA, 20 bp, Homo sapiens
tgcacaccctccagagacaa

SEQ ID NO: 1018905 - DNA, 17 bp, Homo sapiens
tgcacacggctggtcac

SEQ ID NO: 1018906 - DNA, 22 bp, Homo sapiens
tgcacacggctggtcactctgc

SEQ ID NO: 1018907 - DNA, 21 bp, Homo sapiens
tgcacacgtgtgtatgagtgc

SEQ ID NO: 1018908 - DNA, 22 bp, Homo sapiens
tgcacactagtttatgctacct

SEQ ID NO: 1018909 - DNA, 14 bp, Homo sapiens
tgcacacttctgac

SEQ ID NO: 1018910 - DNA, 21 bp, Homo sapiens
tgcacacttgtgtgtgggctg

SEQ ID NO: 1018911 - DNA, 14 bp, Homo sapiens
tgcacactttgcca

SEQ ID NO: 1018912 - DNA, 20 bp, Homo sapiens
tgcacagaaacttgaactcc

SEQ ID NO: 1018913 - DNA, 11 bp, Homo sapiens
tgcacagaagg

SEQ ID NO: 1018914 - DNA, 22 bp, Homo sapiens
tgcacagaagggctctttctct

SEQ ID NO: 1018915 - DNA, 18 bp, Homo sapiens
tgcacagagaagctgggg

SEQ ID NO: 1018916 - DNA, 19 bp, Homo sapiens
tgcacagagacggtctgga

SEQ ID NO: 1018917 - DNA, 22 bp, Homo sapiens
tgcacagagggtcccattgtgc

SEQ ID NO: 1018918 - DNA, 20 bp, Homo sapiens
tgcacagagttgttacattt

SEQ ID NO: 1018919 - DNA, 22 bp, Homo sapiens
tgcacagagttgttacattttt

SEQ ID NO: 1018920 - DNA, 16 bp, Homo sapiens
tgcacagattgctgaa

SEQ ID NO: 1018921 - DNA, 18 bp, Homo sapiens
tgcacagcacaaattagt

SEQ ID NO: 1018922 - DNA, 15 bp, Homo sapiens
tgcacagcaggacct

SEQ ID NO: 1018923 - DNA, 18 bp, Homo sapiens
tgcacagccaacgagaca

SEQ ID NO: 1018924 - DNA, 22 bp, Homo sapiens
tgcacagccaacgagacacatt

SEQ ID NO: 1018925 - DNA, 24 bp, Homo sapiens
tgcacagcctagttatcaagggga

SEQ ID NO: 1018926 - DNA, 16 bp, Homo sapiens
tgcacagcggcccctg

SEQ ID NO: 1018927 - DNA, 16 bp, Homo sapiens
tgcacagctgcttgtc

SEQ ID NO: 1018928 - DNA, 19 bp, Homo sapiens
tgcacaggcacacagggcc

SEQ ID NO: 1018929 - DNA, 14 bp, Homo sapiens
tgcacagtaaaaat

SEQ ID NO: 1018930 - DNA, 17 bp, Homo sapiens
tgcacagtgacttctga

SEQ ID NO: 1018931 - DNA, 16 bp, Homo sapiens
tgcacagtgcatctca

SEQ ID NO: 1018932 - DNA, 17 bp, Homo sapiens
tgcacagtgcatctcag

SEQ ID NO: 1018933 - DNA, 20 bp, Homo sapiens
tgcacagtgcatctcagccc

SEQ ID NO: 1018934 - DNA, 15 bp, Homo sapiens
tgcacagtgctgttg

SEQ ID NO: 1018935 - DNA, 18 bp, Homo sapiens
tgcacagtgctgttggtg

SEQ ID NO: 1018936 - DNA, 23 bp, Homo sapiens
tgcacagttagttgtgaaagaaa

SEQ ID NO: 1018937 - DNA, 15 bp, Homo sapiens
tgcacatgaaagttt

SEQ ID NO: 1018938 - DNA, 13 bp, Homo sapiens
tgcacatgaacat

SEQ ID NO: 1018939 - DNA, 21 bp, Homo sapiens
tgcacatgaacatatgtccat

SEQ ID NO: 1018940 - DNA, 16 bp, Homo sapiens
tgcacatgctgtctgg

SEQ ID NO: 1018941 - DNA, 19 bp, Homo sapiens
tgcacatgctgtctggccc

SEQ ID NO: 1018942 - DNA, 22 bp, Homo sapiens
tgcacatgctgtctggccctgg

SEQ ID NO: 1018943 - DNA, 13 bp, Homo sapiens
tgcacatgtgtgc

SEQ ID NO: 1018944 - DNA, 16 bp, Homo sapiens
tgcacatgtttcctct

SEQ ID NO: 1018945 - DNA, 14 bp, Homo sapiens
tgcacattcctggc

SEQ ID NO: 1018946 - DNA, 16 bp, Homo sapiens
tgcacatttatatata

SEQ ID NO: 1018947 - DNA, 22 bp, Homo sapiens
tgcacatttatttcctccctct

SEQ ID NO: 1018948 - DNA, 13 bp, Homo sapiens
tgcacattttcca

SEQ ID NO: 1018949 - DNA, 19 bp, Homo sapiens
tgcactgtgccccgcgggc

SEQ ID NO: 1018950 - DNA, 21 bp, Homo sapiens
tgcactgtggtttcagatgtg

SEQ ID NO: 1018951 - DNA, 19 bp, Homo sapiens
tgcactgtgtcatcttttc

SEQ ID NO: 1018952 - DNA, 13 bp, Homo sapiens
tgcactgttcccc

SEQ ID NO: 1018953 - DNA, 19 bp, Homo sapiens
tgcactgttccccctgtgc

SEQ ID NO: 1018954 - DNA, 20 bp, Homo sapiens
tgcactgttccccctgtgca

SEQ ID NO: 1018955 - DNA, 13 bp, Homo sapiens
tgcactgttttta

SEQ ID NO: 1018956 - DNA, 13 bp, Homo sapiens
tgcacttaaagaa

SEQ ID NO: 1018957 - DNA, 20 bp, Homo sapiens
ggctcccacaggcccttcct

SEQ ID NO: 1018958 - DNA, 23 bp, Homo sapiens
ggctcccaggggtctccctggct

SEQ ID NO: 1018959 - DNA, 13 bp, Homo sapiens
ggctcccagggtg

SEQ ID NO: 1018960 - DNA, 14 bp, Homo sapiens
ggctcccagggtgg

SEQ ID NO: 1018961 - DNA, 15 bp, Homo sapiens
ggctcccattcactc

SEQ ID NO: 1018962 - DNA, 18 bp, Homo sapiens
ggctcccattcactcttc

SEQ ID NO: 1018963 - DNA, 14 bp, Homo sapiens
ggctccccacctgg

SEQ ID NO: 1018964 - DNA, 21 bp, Homo sapiens
ggctccccacgagtcacctgc

SEQ ID NO: 1018965 - DNA, 22 bp, Homo sapiens
ggctccccacgagtcacctgca

SEQ ID NO: 1018966 - DNA, 14 bp, Homo sapiens
ggctccccagaact

SEQ ID NO: 1018967 - DNA, 22 bp, Homo sapiens
ggctccccagaactggctgggc

SEQ ID NO: 1018968 - DNA, 17 bp, Homo sapiens
ggctccccctccccagg

SEQ ID NO: 1018969 - DNA, 15 bp, Homo sapiens
ggctccccctctgct

SEQ ID NO: 1018970 - DNA, 17 bp, Homo sapiens
ggctccccctctgcttc

SEQ ID NO: 1018971 - DNA, 18 bp, Homo sapiens
ggctccccgcctccactc

SEQ ID NO: 1018972 - DNA, 11 bp, Homo sapiens
ggctcccctct

SEQ ID NO: 1018973 - DNA, 14 bp, Homo sapiens
ggctcccctctgct

SEQ ID NO: 1018974 - DNA, 17 bp, Homo sapiens
ggctcccgggggcccca

SEQ ID NO: 1018975 - DNA, 21 bp, Homo sapiens
ggctccctacattccccagag

SEQ ID NO: 1018976 - DNA, 13 bp, Homo sapiens
ggctccctcctct

SEQ ID NO: 1018977 - DNA, 14 bp, Homo sapiens
ggctccctcctctg

SEQ ID NO: 1018978 - DNA, 17 bp, Homo sapiens
ggctccctcctctggca

SEQ ID NO: 1018979 - DNA, 18 bp, Homo sapiens
ggctccctgactgggagt

SEQ ID NO: 1018980 - DNA, 20 bp, Homo sapiens
ggctccctgtaacctcttca

SEQ ID NO: 1018981 - DNA, 22 bp, Homo sapiens
ggctccgcccttagtcccccaa

SEQ ID NO: 1018982 - DNA, 20 bp, Homo sapiens
ggctccggaggggacccagc

SEQ ID NO: 1018983 - DNA, 23 bp, Homo sapiens
ggctccggaggggacccagctcc

SEQ ID NO: 1018984 - DNA, 20 bp, Homo sapiens
ggctccgggtcactgctgta

SEQ ID NO: 1018985 - DNA, 13 bp, Homo sapiens
ggctcctcagagc

SEQ ID NO: 1018986 - DNA, 17 bp, Homo sapiens
ggctcctcagagcgcca

SEQ ID NO: 1018987 - DNA, 13 bp, Homo sapiens
ggctcctcccagc

SEQ ID NO: 1018988 - DNA, 13 bp, Homo sapiens
ggctcctccccga

SEQ ID NO: 1018989 - DNA, 17 bp, Homo sapiens
ggctcctccccgatccc

SEQ ID NO: 1018990 - DNA, 15 bp, Homo sapiens
ggctcctcctcaccc

SEQ ID NO: 1018991 - DNA, 16 bp, Homo sapiens
ggctcctcgcccccac

SEQ ID NO: 1018992 - DNA, 12 bp, Homo sapiens
ggctcctggctg

SEQ ID NO: 1018993 - DNA, 14 bp, Homo sapiens
ggctcctggctgcc

SEQ ID NO: 1018994 - DNA, 17 bp, Homo sapiens
ggctcctggctgccagg

SEQ ID NO: 1018995 - DNA, 15 bp, Homo sapiens
ggctcctggctgtgc

SEQ ID NO: 1018996 - DNA, 16 bp, Homo sapiens
ggctcctggctgtgcc

SEQ ID NO: 1018997 - DNA, 18 bp, Homo sapiens
ggctcctggctgtgccca

SEQ ID NO: 1018998 - DNA, 20 bp, Homo sapiens
ggctcctggctgtgcccagc

SEQ ID NO: 1018999 - DNA, 23 bp, Homo sapiens
ggctcctggctgtgcccagcagg

SEQ ID NO: 1019000 - DNA, 11 bp, Homo sapiens
ggctcctgggg

SEQ ID NO: 1019001 - DNA, 12 bp, Homo sapiens
ggctcctggggc

SEQ ID NO: 1019002 - DNA, 15 bp, Homo sapiens
ggctcctgttttgca

SEQ ID NO: 1019003 - DNA, 21 bp, Homo sapiens
ggctccttcccctgcacctgg

SEQ ID NO: 1019004 - DNA, 23 bp, Homo sapiens
ggctccttcccctgcacctggcc

SEQ ID NO: 1019005 - DNA, 13 bp, Homo sapiens
ggctcgaatctct

SEQ ID NO: 1019006 - DNA, 18 bp, Homo sapiens
ggctcgaatctctgtgcc

SEQ ID NO: 1019007 - DNA, 21 bp, Homo sapiens
ggctcgagcagtcctgcctca

SEQ ID NO: 1019008 - DNA, 19 bp, Homo sapiens
ggctcgatgtttgccatga

SEQ ID NO: 1019009 - DNA, 14 bp, Homo sapiens
ggctcgcactgccc

SEQ ID NO: 1019010 - DNA, 15 bp, Homo sapiens
ggctcgcactgccca

SEQ ID NO: 1019011 - DNA, 19 bp, Homo sapiens
ggctcgcagggtgcaggag

SEQ ID NO: 1019012 - DNA, 14 bp, Homo sapiens
ggctcgccccaccc

SEQ ID NO: 1019013 - DNA, 14 bp, Homo sapiens
ggctcgccttccct

SEQ ID NO: 1019014 - DNA, 18 bp, Homo sapiens
ggctcgccttccctcctg

SEQ ID NO: 1019015 - DNA, 22 bp, Homo sapiens
ggctcgccttccctcctgcttt

SEQ ID NO: 1019016 - DNA, 18 bp, Homo sapiens
ggctcggggaggcagaga

SEQ ID NO: 1019017 - DNA, 13 bp, Homo sapiens
ggctcgtggactg

SEQ ID NO: 1019018 - DNA, 23 bp, Homo sapiens
ggctcgtggactgagtgggaagc

SEQ ID NO: 1019019 - DNA, 15 bp, Homo sapiens
ggctcgttctcttct

SEQ ID NO: 1019020 - DNA, 17 bp, Homo sapiens
ggctctaattcacagtg

SEQ ID NO: 1019021 - DNA, 20 bp, Homo sapiens
ggctctaccctgtctgtccc

SEQ ID NO: 1019022 - DNA, 17 bp, Homo sapiens
ggctctaccttcctgtc

SEQ ID NO: 1019023 - DNA, 13 bp, Homo sapiens
ggctctagagaga

SEQ ID NO: 1019024 - DNA, 20 bp, Homo sapiens
ggctctagagagagggagaa

SEQ ID NO: 1019025 - DNA, 17 bp, Homo sapiens
ggctctatgcctgcact

SEQ ID NO: 1019026 - DNA, 21 bp, Homo sapiens
ggctctcacccccatccctgg

SEQ ID NO: 1019027 - DNA, 19 bp, Homo sapiens
ggctctcagctcagcgcca

SEQ ID NO: 1019028 - DNA, 19 bp, Homo sapiens
ggctctccaaaggggctgc

SEQ ID NO: 1019029 - DNA, 22 bp, Homo sapiens
ggctctccaaaggggctgctgg

SEQ ID NO: 1019030 - DNA, 12 bp, Homo sapiens
ggctctccaagt

SEQ ID NO: 1019031 - DNA, 14 bp, Homo sapiens
ggctctccacctca

SEQ ID NO: 1019032 - DNA, 20 bp, Homo sapiens
ggctctccacctcagccttg

SEQ ID NO: 1019033 - DNA, 21 bp, Homo sapiens
ggctctccacctcagccttgg

SEQ ID NO: 1019034 - DNA, 22 bp, Homo sapiens
ggctctcccctctcgccccatc

SEQ ID NO: 1019035 - DNA, 13 bp, Homo sapiens
ggctctgaacaca

SEQ ID NO: 1019036 - DNA, 16 bp, Homo sapiens
ggctctgagacacacc

SEQ ID NO: 1019037 - DNA, 16 bp, Homo sapiens
ggctctgagcaggggc

SEQ ID NO: 1019038 - DNA, 18 bp, Homo sapiens
ggctctgagcaggggcag

SEQ ID NO: 1019039 - DNA, 17 bp, Homo sapiens
ggctctgaggtgcctgt

SEQ ID NO: 1019040 - DNA, 19 bp, Homo sapiens
ggctctgcaattcccctct

SEQ ID NO: 1019041 - DNA, 15 bp, Homo sapiens
ggctctgcaggccac

SEQ ID NO: 1019042 - DNA, 22 bp, Homo sapiens
ggctctgccaatgtgggctgcc

SEQ ID NO: 1019043 - DNA, 23 bp, Homo sapiens
ggctctgccaatgtgggctgccc

SEQ ID NO: 1019044 - DNA, 14 bp, Homo sapiens
ggctctgccaccct

SEQ ID NO: 1019045 - DNA, 19 bp, Homo sapiens
ggctctgccaccctacctg

SEQ ID NO: 1019046 - DNA, 11 bp, Homo sapiens
ggctctgccca

SEQ ID NO: 1019047 - DNA, 16 bp, Homo sapiens
ggctctgcccacctct

SEQ ID NO: 1019048 - DNA, 18 bp, Homo sapiens
ggctctgcccacctctct

SEQ ID NO: 1019049 - DNA, 15 bp, Homo sapiens
ggctctgcccacctg

SEQ ID NO: 1019050 - DNA, 20 bp, Homo sapiens
ggctctgcccacctggggtc

SEQ ID NO: 1019051 - DNA, 12 bp, Homo sapiens
ggctctgcccca

SEQ ID NO: 1019052 - DNA, 21 bp, Homo sapiens
ggctctgccccagctctggct

SEQ ID NO: 1019053 - DNA, 21 bp, Homo sapiens
ggctctgccccagtcgttaga

SEQ ID NO: 1019054 - DNA, 18 bp, Homo sapiens
ggctctgccccctccccc

SEQ ID NO: 1019055 - DNA, 19 bp, Homo sapiens
ggctctgccccctccccca

SEQ ID NO: 1019056 - DNA, 16 bp, Homo sapiens
ggctctgcccctcagg

SEQ ID NO: 1019057 - DNA, 17 bp, Homo sapiens
ggctctgcccctcaggg

SEQ ID NO: 1019058 - DNA, 18 bp, Homo sapiens
ggctctgcccctcagggg

SEQ ID NO: 1019059 - DNA, 20 bp, Homo sapiens
ggctctgcccctcagggggc

SEQ ID NO: 1019060 - DNA, 19 bp, Homo sapiens
ggctctgctggccggagca

SEQ ID NO: 1019061 - DNA, 15 bp, Homo sapiens
ggctctggacctcag

SEQ ID NO: 1019062 - DNA, 20 bp, Homo sapiens
ggctctggacctcaggaggg

SEQ ID NO: 1019063 - DNA, 17 bp, Homo sapiens
ggctctggagccagaga

SEQ ID NO: 1019064 - DNA, 18 bp, Homo sapiens
ggctctggccaccctggc

SEQ ID NO: 1019065 - DNA, 15 bp, Homo sapiens
ggctctgggaatggg

SEQ ID NO: 1019066 - DNA, 18 bp, Homo sapiens
ggctctgggagagccagc

SEQ ID NO: 1019067 - DNA, 17 bp, Homo sapiens
ggctctgggcacagtgc

SEQ ID NO: 1019068 - DNA, 16 bp, Homo sapiens
ggctctgggctcaggg

SEQ ID NO: 1019069 - DNA, 14 bp, Homo sapiens
ggctctgggggacc

SEQ ID NO: 1019070 - DNA, 17 bp, Homo sapiens
ggctctgtcactgagca

SEQ ID NO: 1019071 - DNA, 13 bp, Homo sapiens
ggctgcccctctc

SEQ ID NO: 1019072 - DNA, 23 bp, Homo sapiens
ggctgcccctgtaaggtttcaat

SEQ ID NO: 1019073 - DNA, 14 bp, Homo sapiens
ggctgccctgaggg

SEQ ID NO: 1019074 - DNA, 20 bp, Homo sapiens
ggctgccctgaggggctggg

SEQ ID NO: 1019075 - DNA, 12 bp, Homo sapiens
ggctgccctgcc

SEQ ID NO: 1019076 - DNA, 13 bp, Homo sapiens
ggctgccctgcca

SEQ ID NO: 1019077 - DNA, 12 bp, Homo sapiens
ggctgccctggc

SEQ ID NO: 1019078 - DNA, 14 bp, Homo sapiens
ggctgccctggccc

SEQ ID NO: 1019079 - DNA, 16 bp, Homo sapiens
ggctgccctggccctg

SEQ ID NO: 1019080 - DNA, 21 bp, Homo sapiens
ggctgccctggccctgaggtg

SEQ ID NO: 1019081 - DNA, 14 bp, Homo sapiens
ggctgccctggtgc

SEQ ID NO: 1019082 - DNA, 16 bp, Homo sapiens
ggctgccgatgggaaa

SEQ ID NO: 1019083 - DNA, 18 bp, Homo sapiens
ggctgccggatctgggct

SEQ ID NO: 1019084 - DNA, 16 bp, Homo sapiens
ggctgccgtggggccg

SEQ ID NO: 1019085 - DNA, 23 bp, Homo sapiens
ggctgccgtggggccgccgcctc

SEQ ID NO: 1019086 - DNA, 21 bp, Homo sapiens
ggctgcctagccctcccccca

SEQ ID NO: 1019087 - DNA, 18 bp, Homo sapiens
tgcagcatggtccctgcc

SEQ ID NO: 1019088 - DNA, 18 bp, Homo sapiens
tgcagcatgttgctgagg

SEQ ID NO: 1019089 - DNA, 23 bp, Homo sapiens
tgcagcatgttgctgaggagtga

SEQ ID NO: 1019090 - DNA, 19 bp, Homo sapiens
tgcagccaaaggggagcca

SEQ ID NO: 1019091 - DNA, 20 bp, Homo sapiens
tgcagccaaaggggagccag

SEQ ID NO: 1019092 - DNA, 19 bp, Homo sapiens
tgcagccacgattggagaa

SEQ ID NO: 1019093 - DNA, 19 bp, Homo sapiens
tgcagccagcccagcccag

SEQ ID NO: 1019094 - DNA, 21 bp, Homo sapiens
tgcagccagcccagcccagct

SEQ ID NO: 1019095 - DNA, 20 bp, Homo sapiens
tgcagccatcccgcttagcc

SEQ ID NO: 1019096 - DNA, 23 bp, Homo sapiens
tgcagccatcccgcttagcctgc

SEQ ID NO: 1019097 - DNA, 10 bp, Homo sapiens
tgcagcccac

SEQ ID NO: 1019098 - DNA, 12 bp, Homo sapiens
tgcagcccacca

SEQ ID NO: 1019099 - DNA, 16 bp, Homo sapiens
tgcagcccaccagacg

SEQ ID NO: 1019100 - DNA, 18 bp, Homo sapiens
tgcagcccaccaggagca

SEQ ID NO: 1019101 - DNA, 12 bp, Homo sapiens
tgcagcccatgc

SEQ ID NO: 1019102 - DNA, 14 bp, Homo sapiens
tgcagcccatgccc

SEQ ID NO: 1019103 - DNA, 21 bp, Homo sapiens
tgcagcccatgcccacctgcc

SEQ ID NO: 1019104 - DNA, 23 bp, Homo sapiens
tgcagcccatgcccacctgccca

SEQ ID NO: 1019105 - DNA, 17 bp, Homo sapiens
tgcagccccagggcctg

SEQ ID NO: 1019106 - DNA, 14 bp, Homo sapiens
tgcagcccctgggc

SEQ ID NO: 1019107 - DNA, 15 bp, Homo sapiens
tgcagcccctgggcc

SEQ ID NO: 1019108 - DNA, 20 bp, Homo sapiens
tgcagcccggcgccaccatc

SEQ ID NO: 1019109 - DNA, 15 bp, Homo sapiens
tgcagccctcttgcc

SEQ ID NO: 1019110 - DNA, 12 bp, Homo sapiens
tgcagcccttcc

SEQ ID NO: 1019111 - DNA, 13 bp, Homo sapiens
tgcagcccttcct

SEQ ID NO: 1019112 - DNA, 14 bp, Homo sapiens
tgcagcccttcctc

SEQ ID NO: 1019113 - DNA, 15 bp, Homo sapiens
tgcagcccttcctcc

SEQ ID NO: 1019114 - DNA, 18 bp, Homo sapiens
tgcagcccttcctcctga

SEQ ID NO: 1019115 - DNA, 16 bp, Homo sapiens
tgcagccggaggagga

SEQ ID NO: 1019116 - DNA, 17 bp, Homo sapiens
tgcagccggcacagggt

SEQ ID NO: 1019117 - DNA, 18 bp, Homo sapiens
tgcagccggcacagggtc

SEQ ID NO: 1019118 - DNA, 16 bp, Homo sapiens
tgcagccgtggtccaa

SEQ ID NO: 1019119 - DNA, 23 bp, Homo sapiens
tgcagcctcatactcctgggctc

SEQ ID NO: 1019120 - DNA, 14 bp, Homo sapiens
tgcagcctcctcct

SEQ ID NO: 1019121 - DNA, 15 bp, Homo sapiens
tgcagcctcctcctg

SEQ ID NO: 1019122 - DNA, 18 bp, Homo sapiens
tgcagcctctctggctgg

SEQ ID NO: 1019123 - DNA, 14 bp, Homo sapiens
tgcagcctctgcct

SEQ ID NO: 1019124 - DNA, 15 bp, Homo sapiens
tgcagcctctgcctc

SEQ ID NO: 1019125 - DNA, 16 bp, Homo sapiens
tgcagcctgctggggc

SEQ ID NO: 1019126 - DNA, 14 bp, Homo sapiens
tgcagcctgggtct

SEQ ID NO: 1019127 - DNA, 19 bp, Homo sapiens
tgcagcctgggtctggatg

SEQ ID NO: 1019128 - DNA, 22 bp, Homo sapiens
tgcagcctgggtctggatggga

SEQ ID NO: 1019129 - DNA, 23 bp, Homo sapiens
tgcagcctgggtctggatgggag

SEQ ID NO: 1019130 - DNA, 15 bp, Homo sapiens
tgcagcctggtagaa

SEQ ID NO: 1019131 - DNA, 22 bp, Homo sapiens
tgcagcctgtggcttggagtgg

SEQ ID NO: 1019132 - DNA, 16 bp, Homo sapiens
tgcagccttcccctcc

SEQ ID NO: 1019133 - DNA, 23 bp, Homo sapiens
tgcagccttgaactcctggcctc

SEQ ID NO: 1019134 - DNA, 23 bp, Homo sapiens
tgcagccttgcgctgtcccaggc

SEQ ID NO: 1019135 - DNA, 12 bp, Homo sapiens
tgcagcgaccct

SEQ ID NO: 1019136 - DNA, 22 bp, Homo sapiens
tgcagcgcagctggactctgca

SEQ ID NO: 1019137 - DNA, 14 bp, Homo sapiens
tgcagcgcctccct

SEQ ID NO: 1019138 - DNA, 14 bp, Homo sapiens
tgcagctatctggt

SEQ ID NO: 1019139 - DNA, 16 bp, Homo sapiens
tgcagctgattttaac

SEQ ID NO: 1019140 - DNA, 21 bp, Homo sapiens
tgcagctgcctggggcccaag

SEQ ID NO: 1019141 - DNA, 19 bp, Homo sapiens
tgcagctggaaaagggtct

SEQ ID NO: 1019142 - DNA, 18 bp, Homo sapiens
tgcagctgggccccatgc

SEQ ID NO: 1019143 - DNA, 15 bp, Homo sapiens
tgcagctgggtgggg

SEQ ID NO: 1019144 - DNA, 13 bp, Homo sapiens
tgcagctgtgagt

SEQ ID NO: 1019145 - DNA, 21 bp, Homo sapiens
tgcagctgtttgttgccccat

SEQ ID NO: 1019146 - DNA, 18 bp, Homo sapiens
tgcagctgttttgttgac

SEQ ID NO: 1019147 - DNA, 20 bp, Homo sapiens
tgcagcttcaacttttctct

SEQ ID NO: 1019148 - DNA, 13 bp, Homo sapiens
tgcagcttgcagt

SEQ ID NO: 1019149 - DNA, 15 bp, Homo sapiens
tgcagcttgcagtcc

SEQ ID NO: 1019150 - DNA, 15 bp, Homo sapiens
tgcagctttacatgc

SEQ ID NO: 1019151 - DNA, 22 bp, Homo sapiens
tgcagctttatgttcatttgtt

SEQ ID NO: 1019152 - DNA, 22 bp, Homo sapiens
tgcaggaacgagcactggccag

SEQ ID NO: 1019153 - DNA, 14 bp, Homo sapiens
tgcaggaagaggcc

SEQ ID NO: 1019154 - DNA, 15 bp, Homo sapiens
tgcaggacagctctt

SEQ ID NO: 1019155 - DNA, 18 bp, Homo sapiens
tgcaggacctcaggtgag

SEQ ID NO: 1019156 - DNA, 16 bp, Homo sapiens
tgcaggagagagcagc

SEQ ID NO: 1019157 - DNA, 21 bp, Homo sapiens
tgcaggagagagcagcactcc

SEQ ID NO: 1019158 - DNA, 13 bp, Homo sapiens
tgcaggagcctcc

SEQ ID NO: 1019159 - DNA, 15 bp, Homo sapiens
tgcaggagcctccct

SEQ ID NO: 1019160 - DNA, 17 bp, Homo sapiens
tgcaggagcctccctgc

SEQ ID NO: 1019161 - DNA, 13 bp, Homo sapiens
tgcaggagcttct

SEQ ID NO: 1019162 - DNA, 13 bp, Homo sapiens
tgcaggagggcac

SEQ ID NO: 1019163 - DNA, 21 bp, Homo sapiens
tgcaggagggcactggagctg

SEQ ID NO: 1019164 - DNA, 14 bp, Homo sapiens
tgcaggaggtggag

SEQ ID NO: 1019165 - DNA, 19 bp, Homo sapiens
tgcaggagtgtcctgccca

SEQ ID NO: 1019166 - DNA, 14 bp, Homo sapiens
tgcaggatggtgtc

SEQ ID NO: 1019167 - DNA, 15 bp, Homo sapiens
tgcaggattcccttc

SEQ ID NO: 1019168 - DNA, 18 bp, Homo sapiens
tgcaggattcccttctgg

SEQ ID NO: 1019169 - DNA, 18 bp, Homo sapiens
tgcaggcacagaggaggt

SEQ ID NO: 1019170 - DNA, 15 bp, Homo sapiens
tgcaggcagcacagc

SEQ ID NO: 1019171 - DNA, 21 bp, Homo sapiens
tgcaggccaagagcagaggca

SEQ ID NO: 1019172 - DNA, 17 bp, Homo sapiens
tgcaggccactgtgagc

SEQ ID NO: 1019173 - DNA, 13 bp, Homo sapiens
tgcaggccctccc

SEQ ID NO: 1019174 - DNA, 12 bp, Homo sapiens
tgcaggccctgg

SEQ ID NO: 1019175 - DNA, 17 bp, Homo sapiens
tgcaggccctggcctcc

SEQ ID NO: 1019176 - DNA, 22 bp, Homo sapiens
tgcaggccctttgaagcctcag

SEQ ID NO: 1019177 - DNA, 21 bp, Homo sapiens
tgcaggcctaggtgcagctcc

SEQ ID NO: 1019178 - DNA, 22 bp, Homo sapiens
tgcaggcctaggtgcagctcct

SEQ ID NO: 1019179 - DNA, 13 bp, Homo sapiens
tgcaggcggccct

SEQ ID NO: 1019180 - DNA, 13 bp, Homo sapiens
tgcaggctctggg

SEQ ID NO: 1019181 - DNA, 16 bp, Homo sapiens
tgcaggctctgggctc

SEQ ID NO: 1019182 - DNA, 21 bp, Homo sapiens
tgcaggctctgggctcagggc

SEQ ID NO: 1019183 - DNA, 15 bp, Homo sapiens
tgcaggctgcaggag

SEQ ID NO: 1019184 - DNA, 16 bp, Homo sapiens
tgcaggctgcaggagg

SEQ ID NO: 1019185 - DNA, 19 bp, Homo sapiens
tgcaggctgcaggagggca

SEQ ID NO: 1019186 - DNA, 12 bp, Homo sapiens
tgcaggctgggg

SEQ ID NO: 1019187 - DNA, 19 bp, Homo sapiens
tgcaggctttgccattgtg

SEQ ID NO: 1019188 - DNA, 15 bp, Homo sapiens
tgcagggaaaattat

SEQ ID NO: 1019189 - DNA, 21 bp, Homo sapiens
tgcagggaaaattatttgcat

SEQ ID NO: 1019190 - DNA, 16 bp, Homo sapiens
tgcagggacaaagagg

SEQ ID NO: 1019191 - DNA, 21 bp, Homo sapiens
tgcagggagacatctgcaccc

SEQ ID NO: 1019192 - DNA, 14 bp, Homo sapiens
tgcagggaggccac

SEQ ID NO: 1019193 - DNA, 20 bp, Homo sapiens
tgcagggagggcagttttct

SEQ ID NO: 1019194 - DNA, 23 bp, Homo sapiens
tgcatattctattgtattatttg

SEQ ID NO: 1019195 - DNA, 23 bp, Homo sapiens
tgcatatttgccacaaaacctgt

SEQ ID NO: 1019196 - DNA, 19 bp, Homo sapiens
tgcatatttttctaaagaa

SEQ ID NO: 1019197 - DNA, 13 bp, Homo sapiens
tgcatcacactca

SEQ ID NO: 1019198 - DNA, 13 bp, Homo sapiens
tgcatcagtgact

SEQ ID NO: 1019199 - DNA, 16 bp, Homo sapiens
tgcatcatctgtagat

SEQ ID NO: 1019200 - DNA, 17 bp, Homo sapiens
tgcatcatctgtagata

SEQ ID NO: 1019201 - DNA, 18 bp, Homo sapiens
tgcatccattcctcaggg

SEQ ID NO: 1019202 - DNA, 20 bp, Homo sapiens
tgcatccattgttgtgtctg

SEQ ID NO: 1019203 - DNA, 21 bp, Homo sapiens
tgcatccatttgaacacatta

SEQ ID NO: 1019204 - DNA, 17 bp, Homo sapiens
tgcatcccccctgctca

SEQ ID NO: 1019205 - DNA, 16 bp, Homo sapiens
tgcatccccttggctg

SEQ ID NO: 1019206 - DNA, 14 bp, Homo sapiens
tgcatccctgagac

SEQ ID NO: 1019207 - DNA, 16 bp, Homo sapiens
tgcatcctatttggtg

SEQ ID NO: 1019208 - DNA, 15 bp, Homo sapiens
tgcatcctgaggcca

SEQ ID NO: 1019209 - DNA, 17 bp, Homo sapiens
tgcatcctgaggccagt

SEQ ID NO: 1019210 - DNA, 23 bp, Homo sapiens
tgcatcctgaggccagtggcccc

SEQ ID NO: 1019211 - DNA, 20 bp, Homo sapiens
tgcatctaatgaaaaacaaa

SEQ ID NO: 1019212 - DNA, 21 bp, Homo sapiens
tgcatctcactggatgcaaag

SEQ ID NO: 1019213 - DNA, 13 bp, Homo sapiens
tgcatctcagccc

SEQ ID NO: 1019214 - DNA, 14 bp, Homo sapiens
tgcatctcagccca

SEQ ID NO: 1019215 - DNA, 15 bp, Homo sapiens
tgcatctgaccagca

SEQ ID NO: 1019216 - DNA, 21 bp, Homo sapiens
tgcatctgaccagcagcgcct

SEQ ID NO: 1019217 - DNA, 16 bp, Homo sapiens
ggctgcctcagccagt

SEQ ID NO: 1019218 - DNA, 18 bp, Homo sapiens
ggctgcctcagccagtgg

SEQ ID NO: 1019219 - DNA, 10 bp, Homo sapiens
ggctgcctgc

SEQ ID NO: 1019220 - DNA, 20 bp, Homo sapiens
ggctgcctgcccctgctgct

SEQ ID NO: 1019221 - DNA, 14 bp, Homo sapiens
ggctgcctgctgtg

SEQ ID NO: 1019222 - DNA, 21 bp, Homo sapiens
ggctgcctttgatcacaggag

SEQ ID NO: 1019223 - DNA, 12 bp, Homo sapiens
ggctgcctttgt

SEQ ID NO: 1019224 - DNA, 23 bp, Homo sapiens
ggctgcctttgtggtgggcgctg

SEQ ID NO: 1019225 - DNA, 16 bp, Homo sapiens
ggctgcgctagcagcc

SEQ ID NO: 1019226 - DNA, 17 bp, Homo sapiens
ggctgcgctagcagccc

SEQ ID NO: 1019227 - DNA, 17 bp, Homo sapiens
ggctgcggcgtctgtct

SEQ ID NO: 1019228 - DNA, 22 bp, Homo sapiens
ggctgcggtgtttggcaatgct

SEQ ID NO: 1019229 - DNA, 16 bp, Homo sapiens
ggctgctacccagaaa

SEQ ID NO: 1019230 - DNA, 19 bp, Homo sapiens
ggctgctcctccagggcca

SEQ ID NO: 1019231 - DNA, 15 bp, Homo sapiens
ggctgctctgcctgt

SEQ ID NO: 1019232 - DNA, 11 bp, Homo sapiens
ggctgctgccc

SEQ ID NO: 1019233 - DNA, 17 bp, Homo sapiens
ggctgctgcccccaccc

SEQ ID NO: 1019234 - DNA, 18 bp, Homo sapiens
ggctgctgcccccacccc

SEQ ID NO: 1019235 - DNA, 12 bp, Homo sapiens
ggctgctgccgg

SEQ ID NO: 1019236 - DNA, 15 bp, Homo sapiens
ggctgctgcttctgc

SEQ ID NO: 1019237 - DNA, 23 bp, Homo sapiens
ggctgctgcttctgctccagccc

SEQ ID NO: 1019238 - DNA, 13 bp, Homo sapiens
ggctgctggcttc

SEQ ID NO: 1019239 - DNA, 14 bp, Homo sapiens
ggctgctgggcgtc

SEQ ID NO: 1019240 - DNA, 15 bp, Homo sapiens
ggctgctgggcgtct

SEQ ID NO: 1019241 - DNA, 17 bp, Homo sapiens
ggctgctgggcgtctgt

SEQ ID NO: 1019242 - DNA, 21 bp, Homo sapiens
ggctgctggggcatgtgtgcc

SEQ ID NO: 1019243 - DNA, 22 bp, Homo sapiens
ggctgctggggcatgtgtgcct

SEQ ID NO: 1019244 - DNA, 22 bp, Homo sapiens
ggctgctgggggcaactggcca

SEQ ID NO: 1019245 - DNA, 22 bp, Homo sapiens
ggctgctgtgtggacggcgctg

SEQ ID NO: 1019246 - DNA, 18 bp, Homo sapiens
ggctgcttcctcctggaa

SEQ ID NO: 1019247 - DNA, 13 bp, Homo sapiens
ggctgcttcctgt

SEQ ID NO: 1019248 - DNA, 18 bp, Homo sapiens
ggctgcttctacggccat

SEQ ID NO: 1019249 - DNA, 19 bp, Homo sapiens
ggctgcttctacggccatg

SEQ ID NO: 1019250 - DNA, 19 bp, Homo sapiens
ggctggaaagcagagcctc

SEQ ID NO: 1019251 - DNA, 23 bp, Homo sapiens
ggctggaaagcagagcctcctgg

SEQ ID NO: 1019252 - DNA, 14 bp, Homo sapiens
ggctggaatgaggg

SEQ ID NO: 1019253 - DNA, 15 bp, Homo sapiens
ggctggaatgaggga

SEQ ID NO: 1019254 - DNA, 22 bp, Homo sapiens
ggctggaatgggagacctgttg

SEQ ID NO: 1019255 - DNA, 16 bp, Homo sapiens
ggctggacctatgtcc

SEQ ID NO: 1019256 - DNA, 21 bp, Homo sapiens
ggctggagataacagcctctt

SEQ ID NO: 1019257 - DNA, 22 bp, Homo sapiens
ggctggagataacagcctcttg

SEQ ID NO: 1019258 - DNA, 15 bp, Homo sapiens
ggctggagcggagat

SEQ ID NO: 1019259 - DNA, 18 bp, Homo sapiens
ggctggaggaagtggggt

SEQ ID NO: 1019260 - DNA, 15 bp, Homo sapiens
ggctggaggcagggc

SEQ ID NO: 1019261 - DNA, 14 bp, Homo sapiens
ggctggagtgcgct

SEQ ID NO: 1019262 - DNA, 20 bp, Homo sapiens
ggctggagtgtagtggcgcg

SEQ ID NO: 1019263 - DNA, 15 bp, Homo sapiens
ggctggatggacaga

SEQ ID NO: 1019264 - DNA, 20 bp, Homo sapiens
ggctggatggacagacacct

SEQ ID NO: 1019265 - DNA, 15 bp, Homo sapiens
ggctggatgggaaag

SEQ ID NO: 1019266 - DNA, 13 bp, Homo sapiens
ggctggcaagcag

SEQ ID NO: 1019267 - DNA, 17 bp, Homo sapiens
ggctggcaagcagggaa

SEQ ID NO: 1019268 - DNA, 14 bp, Homo sapiens
ggctggcagctctc

SEQ ID NO: 1019269 - DNA, 20 bp, Homo sapiens
ggctggccagcaaggcaggt

SEQ ID NO: 1019270 - DNA, 13 bp, Homo sapiens
ggctggcccagcc

SEQ ID NO: 1019271 - DNA, 14 bp, Homo sapiens
ggctggccctgtgc

SEQ ID NO: 1019272 - DNA, 15 bp, Homo sapiens
ggctggccctgtgca

SEQ ID NO: 1019273 - DNA, 19 bp, Homo sapiens
ggctggcctctggctctca

SEQ ID NO: 1019274 - DNA, 12 bp, Homo sapiens
ggctggcctgag

SEQ ID NO: 1019275 - DNA, 14 bp, Homo sapiens
ggctggcctggagg

SEQ ID NO: 1019276 - DNA, 16 bp, Homo sapiens
ggctggcgcagccaag

SEQ ID NO: 1019277 - DNA, 18 bp, Homo sapiens
ggctggcgcttggatctg

SEQ ID NO: 1019278 - DNA, 24 bp, Homo sapiens
ggctggctccagatgcagggcagt

SEQ ID NO: 1019279 - DNA, 12 bp, Homo sapiens
ggctggctccca

SEQ ID NO: 1019280 - DNA, 14 bp, Homo sapiens
ggctggctccccct

SEQ ID NO: 1019281 - DNA, 22 bp, Homo sapiens
ggctgggaacatgacccagcct

SEQ ID NO: 1019282 - DNA, 12 bp, Homo sapiens
ggctgggacaga

SEQ ID NO: 1019283 - DNA, 23 bp, Homo sapiens
ggctgggacgtggctcagccagc

SEQ ID NO: 1019284 - DNA, 15 bp, Homo sapiens
ggctgggacttctta

SEQ ID NO: 1019285 - DNA, 20 bp, Homo sapiens
ggctgggagcctcgcccctc

SEQ ID NO: 1019286 - DNA, 15 bp, Homo sapiens
ggctgggagctctgc

SEQ ID NO: 1019287 - DNA, 22 bp, Homo sapiens
ggctgggagtccttacctcggg

SEQ ID NO: 1019288 - DNA, 16 bp, Homo sapiens
ggctgggcaccgtgtc

SEQ ID NO: 1019289 - DNA, 21 bp, Homo sapiens
ggctgggcagcacaaggcctt

SEQ ID NO: 1019290 - DNA, 17 bp, Homo sapiens
ggctgggccatgtccaa

SEQ ID NO: 1019291 - DNA, 20 bp, Homo sapiens
ggctgggccatgtccaaaga

SEQ ID NO: 1019292 - DNA, 15 bp, Homo sapiens
ggctgggcccaccca

SEQ ID NO: 1019293 - DNA, 21 bp, Homo sapiens
ggctgggcccacccagggagc

SEQ ID NO: 1019294 - DNA, 14 bp, Homo sapiens
ggctgggcccagaa

SEQ ID NO: 1019295 - DNA, 17 bp, Homo sapiens
ggctgggcccctgggat

SEQ ID NO: 1019296 - DNA, 16 bp, Homo sapiens
ggctgggcccctgggg

SEQ ID NO: 1019297 - DNA, 17 bp, Homo sapiens
ggctgggcccctgggga

SEQ ID NO: 1019298 - DNA, 22 bp, Homo sapiens
ggctgggccctctttccctgcg

SEQ ID NO: 1019299 - DNA, 18 bp, Homo sapiens
ggctgggccgcaagggcc

SEQ ID NO: 1019300 - DNA, 13 bp, Homo sapiens
ggctgggcctcct

SEQ ID NO: 1019301 - DNA, 13 bp, Homo sapiens
ggctgggcctgcg

SEQ ID NO: 1019302 - DNA, 16 bp, Homo sapiens
ggctgggctgggctga

SEQ ID NO: 1019303 - DNA, 17 bp, Homo sapiens
ggctgggctgggctgag

SEQ ID NO: 1019304 - DNA, 19 bp, Homo sapiens
ggctggggacccacccagc

SEQ ID NO: 1019305 - DNA, 21 bp, Homo sapiens
ggctggggacccacccagccc

SEQ ID NO: 1019306 - DNA, 16 bp, Homo sapiens
ggctggggactctggc

SEQ ID NO: 1019307 - DNA, 17 bp, Homo sapiens
ggctggggactctggca

SEQ ID NO: 1019308 - DNA, 18 bp, Homo sapiens
ggctggggactctggcac

SEQ ID NO: 1019309 - DNA, 13 bp, Homo sapiens
ggctggggactgg

SEQ ID NO: 1019310 - DNA, 14 bp, Homo sapiens
ggctggggactggg

SEQ ID NO: 1019311 - DNA, 17 bp, Homo sapiens
ggctggggaggaggaga

SEQ ID NO: 1019312 - DNA, 13 bp, Homo sapiens
ggctggggagggg

SEQ ID NO: 1019313 - DNA, 21 bp, Homo sapiens
ggctggggaggtgctggggga

SEQ ID NO: 1019314 - DNA, 14 bp, Homo sapiens
ggctggggcagagg

SEQ ID NO: 1019315 - DNA, 22 bp, Homo sapiens
ggctggggcagaggggcagccg

SEQ ID NO: 1019316 - DNA, 15 bp, Homo sapiens
tgcattgagaactgc

SEQ ID NO: 1019317 - DNA, 16 bp, Homo sapiens
tgcattgatggttttt

SEQ ID NO: 1019318 - DNA, 17 bp, Homo sapiens
tgcattgctagataaaa

SEQ ID NO: 1019319 - DNA, 19 bp, Homo sapiens
tgcattggaagaccccacc

SEQ ID NO: 1019320 - DNA, 20 bp, Homo sapiens
tgcattggaagaccccaccc

SEQ ID NO: 1019321 - DNA, 12 bp, Homo sapiens
tgcattgtctgt

SEQ ID NO: 1019322 - DNA, 23 bp, Homo sapiens
tgcattgtgtcagaaacatgaaa

SEQ ID NO: 1019323 - DNA, 22 bp, Homo sapiens
tgcatttaaaacagacactggc

SEQ ID NO: 1019324 - DNA, 15 bp, Homo sapiens
tgcatttaaactctg

SEQ ID NO: 1019325 - DNA, 15 bp, Homo sapiens
tgcatttaaagtatt

SEQ ID NO: 1019326 - DNA, 16 bp, Homo sapiens
tgcatttaaatacagt

SEQ ID NO: 1019327 - DNA, 14 bp, Homo sapiens
tgcatttaataaag

SEQ ID NO: 1019328 - DNA, 15 bp, Homo sapiens
tgcatttaataaaga

SEQ ID NO: 1019329 - DNA, 18 bp, Homo sapiens
tgcatttaataaagatga

SEQ ID NO: 1019330 - DNA, 23 bp, Homo sapiens
tgcatttaataaagatgagttgg

SEQ ID NO: 1019331 - DNA, 20 bp, Homo sapiens
tgcatttagttttatggcat

SEQ ID NO: 1019332 - DNA, 18 bp, Homo sapiens
tgcatttataaagaccgt

SEQ ID NO: 1019333 - DNA, 14 bp, Homo sapiens
tgcatttatatgta

SEQ ID NO: 1019334 - DNA, 15 bp, Homo sapiens
tgcatttcacctgtg

SEQ ID NO: 1019335 - DNA, 21 bp, Homo sapiens
tgcatttcattcaaatcagtg

SEQ ID NO: 1019336 - DNA, 17 bp, Homo sapiens
tgcatttccagaaatct

SEQ ID NO: 1019337 - DNA, 13 bp, Homo sapiens
tgcatttcctgac

SEQ ID NO: 1019338 - DNA, 18 bp, Homo sapiens
tgcatttgagagaagcca

SEQ ID NO: 1019339 - DNA, 21 bp, Homo sapiens
tgcatttgagagaagccacgc

SEQ ID NO: 1019340 - DNA, 18 bp, Homo sapiens
tgcatttgaggtctgttc

SEQ ID NO: 1019341 - DNA, 21 bp, Homo sapiens
tgcatttggtggtttcagaaa

SEQ ID NO: 1019342 - DNA, 18 bp, Homo sapiens
tgcatttgtgctagaaat

SEQ ID NO: 1019343 - DNA, 18 bp, Homo sapiens
tgcatttgtttatgtaat

SEQ ID NO: 1019344 - DNA, 13 bp, Homo sapiens
ggctggtcactct

SEQ ID NO: 1019345 - DNA, 23 bp, Homo sapiens
ggctggtccagggctagtgactt

SEQ ID NO: 1019346 - DNA, 23 bp, Homo sapiens
ggctggtgagaccccgcactgca

SEQ ID NO: 1019347 - DNA, 17 bp, Homo sapiens
ggctggtgcccatgaag

SEQ ID NO: 1019348 - DNA, 17 bp, Homo sapiens
ggctggtgccccacagc

SEQ ID NO: 1019349 - DNA, 22 bp, Homo sapiens
ggctggtggagaactctggctt

SEQ ID NO: 1019350 - DNA, 16 bp, Homo sapiens
ggctggtggcccagga

SEQ ID NO: 1019351 - DNA, 13 bp, Homo sapiens
ggctggtggcctt

SEQ ID NO: 1019352 - DNA, 21 bp, Homo sapiens
ggctggtggttttcagagcag

SEQ ID NO: 1019353 - DNA, 22 bp, Homo sapiens
ggctggtggttttcagagcagg

SEQ ID NO: 1019354 - DNA, 13 bp, Homo sapiens
ggctggtgtcccc

SEQ ID NO: 1019355 - DNA, 14 bp, Homo sapiens
ggctggtgtcccct

SEQ ID NO: 1019356 - DNA, 14 bp, Homo sapiens
ggctggttaatgta

SEQ ID NO: 1019357 - DNA, 13 bp, Homo sapiens
ggctggttttgta

SEQ ID NO: 1019358 - DNA, 15 bp, Homo sapiens
ggctgtaacctgctg

SEQ ID NO: 1019359 - DNA, 21 bp, Homo sapiens
ggctgtactgctcaggctgca

SEQ ID NO: 1019360 - DNA, 18 bp, Homo sapiens
ggctgtagatggtgacct

SEQ ID NO: 1019361 - DNA, 15 bp, Homo sapiens
ggctgtccagcctta

SEQ ID NO: 1019362 - DNA, 20 bp, Homo sapiens
ggctgtccctcatggagacc

SEQ ID NO: 1019363 - DNA, 20 bp, Homo sapiens
ggctgtcctccttcctggga

SEQ ID NO: 1019364 - DNA, 22 bp, Homo sapiens
ggctgtccttagactccttctc

SEQ ID NO: 1019365 - DNA, 16 bp, Homo sapiens
ggctgtctagaatgtg

SEQ ID NO: 1019366 - DNA, 15 bp, Homo sapiens
ggctgtctggggcct

SEQ ID NO: 1019367 - DNA, 13 bp, Homo sapiens
ggctgtctgtcac

SEQ ID NO: 1019368 - DNA, 17 bp, Homo sapiens
ggctgtctttgcagggc

SEQ ID NO: 1019369 - DNA, 19 bp, Homo sapiens
ggctgtgacaaccctggcc

SEQ ID NO: 1019370 - DNA, 21 bp, Homo sapiens
ggctgtgacaaccctggcctc

SEQ ID NO: 1019371 - DNA, 15 bp, Homo sapiens
ggctgtgacctcttc

SEQ ID NO: 1019372 - DNA, 15 bp, Homo sapiens
ggctgtgcccagcag

SEQ ID NO: 1019373 - DNA, 23 bp, Homo sapiens
ggctgtgcccctgatgcagcctg

SEQ ID NO: 1019374 - DNA, 16 bp, Homo sapiens
ggctgtgcccggcccc

SEQ ID NO: 1019375 - DNA, 13 bp, Homo sapiens
ggctgtgcctctg

SEQ ID NO: 1019376 - DNA, 14 bp, Homo sapiens
ggctgtgctcagag

SEQ ID NO: 1019377 - DNA, 15 bp, Homo sapiens
ggctgtgctgccctg

SEQ ID NO: 1019378 - DNA, 22 bp, Homo sapiens
ggctgtggagcaaaaggcagct

SEQ ID NO: 1019379 - DNA, 13 bp, Homo sapiens
ggctgtggaggcc

SEQ ID NO: 1019380 - DNA, 16 bp, Homo sapiens
ggctgtggaggcctga

SEQ ID NO: 1019381 - DNA, 13 bp, Homo sapiens
ggctgtggcacag

SEQ ID NO: 1019382 - DNA, 16 bp, Homo sapiens
ggctgtggccctgccc

SEQ ID NO: 1019383 - DNA, 19 bp, Homo sapiens
ggctgtggggtctggctgt

SEQ ID NO: 1019384 - DNA, 20 bp, Homo sapiens
ggctgtggggtggagcactg

SEQ ID NO: 1019385 - DNA, 20 bp, Homo sapiens
ggctgtggggtgggctggag

SEQ ID NO: 1019386 - DNA, 13 bp, Homo sapiens
ggctgtgtctctg

SEQ ID NO: 1019387 - DNA, 20 bp, Homo sapiens
ggctgtgttatgaaaatata

SEQ ID NO: 1019388 - DNA, 16 bp, Homo sapiens
ggctgtgttgactgct

SEQ ID NO: 1019389 - DNA, 18 bp, Homo sapiens
ggctgtgtttccatctca

SEQ ID NO: 1019390 - DNA, 14 bp, Homo sapiens
ggctgttaccattt

SEQ ID NO: 1019391 - DNA, 22 bp, Homo sapiens
ggctgttattatgaaggaattt

SEQ ID NO: 1019392 - DNA, 14 bp, Homo sapiens
ggctgttcatgctc

SEQ ID NO: 1019393 - DNA, 16 bp, Homo sapiens
ggctgttcatgctcca

SEQ ID NO: 1019394 - DNA, 13 bp, Homo sapiens
ggctgttccagac

SEQ ID NO: 1019395 - DNA, 20 bp, Homo sapiens
ggctgttccagactcaggtt

SEQ ID NO: 1019396 - DNA, 18 bp, Homo sapiens
ggctgttccctttgcctt

SEQ ID NO: 1019397 - DNA, 21 bp, Homo sapiens
ggctgttctgtggttcctctg

SEQ ID NO: 1019398 - DNA, 11 bp, Homo sapiens
ggctgttcttc

SEQ ID NO: 1019399 - DNA, 13 bp, Homo sapiens
ggctgttgcatgg

SEQ ID NO: 1019400 - DNA, 16 bp, Homo sapiens
ggctgttgctagggag

SEQ ID NO: 1019401 - DNA, 18 bp, Homo sapiens
ggctgttgctagggagag

SEQ ID NO: 1019402 - DNA, 18 bp, Homo sapiens
ggctgttggacagctgct

SEQ ID NO: 1019403 - DNA, 20 bp, Homo sapiens
ggctgttggacagctgcttg

SEQ ID NO: 1019404 - DNA, 21 bp, Homo sapiens
ggctgttggacagctgcttgt

SEQ ID NO: 1019405 - DNA, 12 bp, Homo sapiens
ggcttaaagtga

SEQ ID NO: 1019406 - DNA, 16 bp, Homo sapiens
ggcttaaagtgaagga

SEQ ID NO: 1019407 - DNA, 17 bp, Homo sapiens
ggcttaaagtgaaggaa

SEQ ID NO: 1019408 - DNA, 18 bp, Homo sapiens
ggcttaaagtgaaggaaa

SEQ ID NO: 1019409 - DNA, 14 bp, Homo sapiens
ggcttaagaactgc

SEQ ID NO: 1019410 - DNA, 12 bp, Homo sapiens
ggcttaatgttt

SEQ ID NO: 1019411 - DNA, 16 bp, Homo sapiens
ggcttaatgtttattc

SEQ ID NO: 1019412 - DNA, 13 bp, Homo sapiens
ggcttacaggagc

SEQ ID NO: 1019413 - DNA, 21 bp, Homo sapiens
ggcttagacttcgactcagga

SEQ ID NO: 1019414 - DNA, 17 bp, Homo sapiens
ggcttaggtgccaggct

SEQ ID NO: 1019415 - DNA, 15 bp, Homo sapiens
ggcttagtatttctc

SEQ ID NO: 1019416 - DNA, 21 bp, Homo sapiens
ggcttagtatttctcaggaag

SEQ ID NO: 1019417 - DNA, 19 bp, Homo sapiens
ggcttatttctatgacaaa

SEQ ID NO: 1019418 - DNA, 18 bp, Homo sapiens
ggcttcagaaaaggagtg

SEQ ID NO: 1019419 - DNA, 14 bp, Homo sapiens
ggcttcagggaggg

SEQ ID NO: 1019420 - DNA, 23 bp, Homo sapiens
ggcttcagggagggttagcctgc

SEQ ID NO: 1019421 - DNA, 15 bp, Homo sapiens
ggcttcatgccagct

SEQ ID NO: 1019422 - DNA, 21 bp, Homo sapiens
ggcttccagaaaaccccagca

SEQ ID NO: 1019423 - DNA, 18 bp, Homo sapiens
ggcttccagaaggcagca

SEQ ID NO: 1019424 - DNA, 14 bp, Homo sapiens
ggcttccagagagt

SEQ ID NO: 1019425 - DNA, 22 bp, Homo sapiens
ggcttccagagagtcctctgga

SEQ ID NO: 1019426 - DNA, 17 bp, Homo sapiens
ggcttccatttgtgtgt

SEQ ID NO: 1019427 - DNA, 20 bp, Homo sapiens
ggcttcccactttggcttat

SEQ ID NO: 1019428 - DNA, 19 bp, Homo sapiens
ggcttccccatcagctccc

SEQ ID NO: 1019429 - DNA, 22 bp, Homo sapiens
ggcttccctggcatgatggaca

SEQ ID NO: 1019430 - DNA, 21 bp, Homo sapiens
ggcttcctccgtccacccagg

SEQ ID NO: 1019431 - DNA, 22 bp, Homo sapiens
ggcttcctccgtccacccaggc

SEQ ID NO: 1019432 - DNA, 12 bp, Homo sapiens
ggcttcctgccc

SEQ ID NO: 1019433 - DNA, 11 bp, Homo sapiens
ggcttcctggg

SEQ ID NO: 1019434 - DNA, 12 bp, Homo sapiens
ggcttcctgtcc

SEQ ID NO: 1019435 - DNA, 13 bp, Homo sapiens
ggcttcctgtcca

SEQ ID NO: 1019436 - DNA, 12 bp, Homo sapiens
ggcttcctttct

SEQ ID NO: 1019437 - DNA, 17 bp, Homo sapiens
ggcttcggacaaaatat

SEQ ID NO: 1019438 - DNA, 17 bp, Homo sapiens
tgccacagcttttgcaa

SEQ ID NO: 1019439 - DNA, 22 bp, Homo sapiens
tgccacagtagaactgtctgtg

SEQ ID NO: 1019440 - DNA, 15 bp, Homo sapiens
tgccacatggagccc

SEQ ID NO: 1019441 - DNA, 18 bp, Homo sapiens
tgccacatggtgtctccc

SEQ ID NO: 1019442 - DNA, 17 bp, Homo sapiens
tgccaccacgtctgcca

SEQ ID NO: 1019443 - DNA, 19 bp, Homo sapiens
tgccaccacgtctgccagg

SEQ ID NO: 1019444 - DNA, 23 bp, Homo sapiens
tgccaccagcccccgccccagag

SEQ ID NO: 1019445 - DNA, 15 bp, Homo sapiens
tgccaccatcctgct

SEQ ID NO: 1019446 - DNA, 16 bp, Homo sapiens
tgccacccacctccct

SEQ ID NO: 1019447 - DNA, 14 bp, Homo sapiens
tgccacccactcag

SEQ ID NO: 1019448 - DNA, 15 bp, Homo sapiens
tgccacccactcagg

SEQ ID NO: 1019449 - DNA, 14 bp, Homo sapiens
tgccaccccaaccc

SEQ ID NO: 1019450 - DNA, 14 bp, Homo sapiens
tgccacccccaggt

SEQ ID NO: 1019451 - DNA, 15 bp, Homo sapiens
tgccacccccagttc

SEQ ID NO: 1019452 - DNA, 18 bp, Homo sapiens
tgccaccccgagggctga

SEQ ID NO: 1019453 - DNA, 21 bp, Homo sapiens
tgccacccctcttctgctcct

SEQ ID NO: 1019454 - DNA, 13 bp, Homo sapiens
tgccaccctacct

SEQ ID NO: 1019455 - DNA, 14 bp, Homo sapiens
tgccaccctagcca

SEQ ID NO: 1019456 - DNA, 12 bp, Homo sapiens
tgccaccctcac

SEQ ID NO: 1019457 - DNA, 19 bp, Homo sapiens
tgccaccctcctccctcca

SEQ ID NO: 1019458 - DNA, 21 bp, Homo sapiens
tgccaccctcctccctccaag

SEQ ID NO: 1019459 - DNA, 17 bp, Homo sapiens
tgccaccctctgggagt

SEQ ID NO: 1019460 - DNA, 18 bp, Homo sapiens
tgccaccctctgggagtc

SEQ ID NO: 1019461 - DNA, 21 bp, Homo sapiens
tgccaccggaggtcactccac

SEQ ID NO: 1019462 - DNA, 20 bp, Homo sapiens
tgccacctctggccaaatat

SEQ ID NO: 1019463 - DNA, 21 bp, Homo sapiens
tgccacctctggccaaatatg

SEQ ID NO: 1019464 - DNA, 20 bp, Homo sapiens
tgccacctgtccggcccagt

SEQ ID NO: 1019465 - DNA, 21 bp, Homo sapiens
tgccacctgttaaaatgtaca

SEQ ID NO: 1019466 - DNA, 23 bp, Homo sapiens
tgccacctgttaaaatgtacact

SEQ ID NO: 1019467 - DNA, 17 bp, Homo sapiens
tgccaccttgtggccgc

SEQ ID NO: 1019468 - DNA, 16 bp, Homo sapiens
tgccacgcaggccacc

SEQ ID NO: 1019469 - DNA, 22 bp, Homo sapiens
tgccacggtttatcctcttggt

SEQ ID NO: 1019470 - DNA, 15 bp, Homo sapiens
tgccacgtcccgctg

SEQ ID NO: 1019471 - DNA, 19 bp, Homo sapiens
tgccactaaactacattgt

SEQ ID NO: 1019472 - DNA, 12 bp, Homo sapiens
ggcttggccttg

SEQ ID NO: 1019473 - DNA, 14 bp, Homo sapiens
ggcttggccttgtg

SEQ ID NO: 1019474 - DNA, 20 bp, Homo sapiens
ggcttggctcttggcttcca

SEQ ID NO: 1019475 - DNA, 21 bp, Homo sapiens
ggcttggctcttggcttccag

SEQ ID NO: 1019476 - DNA, 16 bp, Homo sapiens
ggcttgggctggtcag

SEQ ID NO: 1019477 - DNA, 15 bp, Homo sapiens
ggcttggggcttcct

SEQ ID NO: 1019478 - DNA, 16 bp, Homo sapiens
ggcttggggtgtgggg

SEQ ID NO: 1019479 - DNA, 21 bp, Homo sapiens
ggcttggtggctcacgcctgt

SEQ ID NO: 1019480 - DNA, 22 bp, Homo sapiens
ggcttgtgatttccatttctga

SEQ ID NO: 1019481 - DNA, 17 bp, Homo sapiens
ggcttgttctctggaac

SEQ ID NO: 1019482 - DNA, 19 bp, Homo sapiens
ggcttgttctctggaacct

SEQ ID NO: 1019483 - DNA, 20 bp, Homo sapiens
ggcttgttctctggaacctg

SEQ ID NO: 1019484 - DNA, 21 bp, Homo sapiens
ggctttaaactaccctccaga

SEQ ID NO: 1019485 - DNA, 19 bp, Homo sapiens
ggctttaattgtataagtc

SEQ ID NO: 1019486 - DNA, 19 bp, Homo sapiens
ggctttcaaggctggggca

SEQ ID NO: 1019487 - DNA, 18 bp, Homo sapiens
ggctttcaattgtatttt

SEQ ID NO: 1019488 - DNA, 16 bp, Homo sapiens
ggctttcactgctgag

SEQ ID NO: 1019489 - DNA, 16 bp, Homo sapiens
ggctttcatcctgtgt

SEQ ID NO: 1019490 - DNA, 14 bp, Homo sapiens
ggctttcccaggag

SEQ ID NO: 1019491 - DNA, 16 bp, Homo sapiens
ggctttcccttatcaa

SEQ ID NO: 1019492 - DNA, 12 bp, Homo sapiens
ggctttcctccg

SEQ ID NO: 1019493 - DNA, 16 bp, Homo sapiens
ggctttcggggagggc

SEQ ID NO: 1019494 - DNA, 12 bp, Homo sapiens
ggctttctccct

SEQ ID NO: 1019495 - DNA, 16 bp, Homo sapiens
ggctttctcctggaga

SEQ ID NO: 1019496 - DNA, 12 bp, Homo sapiens
ggctttctcttc

SEQ ID NO: 1019497 - DNA, 20 bp, Homo sapiens
ggctttctcttccccttcct

SEQ ID NO: 1019498 - DNA, 21 bp, Homo sapiens
ggctttctcttccccttcctg

SEQ ID NO: 1019499 - DNA, 13 bp, Homo sapiens
ggctttctggagt

SEQ ID NO: 1019500 - DNA, 15 bp, Homo sapiens
ggctttctgttgcca

SEQ ID NO: 1019501 - DNA, 14 bp, Homo sapiens
ggctttgcaggctc

SEQ ID NO: 1019502 - DNA, 18 bp, Homo sapiens
ggctttgcccacccctca

SEQ ID NO: 1019503 - DNA, 12 bp, Homo sapiens
ggctttggccca

SEQ ID NO: 1019504 - DNA, 13 bp, Homo sapiens
ggctttggcttct

SEQ ID NO: 1019505 - DNA, 20 bp, Homo sapiens
ggcttttattaatgcacttt

SEQ ID NO: 1019506 - DNA, 19 bp, Homo sapiens
ggcttttcaccccagagga

SEQ ID NO: 1019507 - DNA, 13 bp, Homo sapiens
ggcttttcactgc

SEQ ID NO: 1019508 - DNA, 22 bp, Homo sapiens
ggcttttcactgcctgtagaga

SEQ ID NO: 1019509 - DNA, 17 bp, Homo sapiens
ggcttttcactgctggc

SEQ ID NO: 1019510 - DNA, 22 bp, Homo sapiens
ggcttttcactgctggctgcct

SEQ ID NO: 1019511 - DNA, 14 bp, Homo sapiens
ggcttttgtgcatt

SEQ ID NO: 1019512 - DNA, 16 bp, Homo sapiens
ggctttttaaaatata

SEQ ID NO: 1019513 - DNA, 18 bp, Homo sapiens
gggaaaaaaaagaaaaaa

SEQ ID NO: 1019514 - DNA, 19 bp, Homo sapiens
gggaaaaaaaagaaaaaat

SEQ ID NO: 1019515 - DNA, 17 bp, Homo sapiens
gggaaaaaaaagagact

SEQ ID NO: 1019516 - DNA, 11 bp, Homo sapiens
gggaaaaaaga

SEQ ID NO: 1019517 - DNA, 18 bp, Homo sapiens
gggaaaaaagaaagaaaa

SEQ ID NO: 1019518 - DNA, 20 bp, Homo sapiens
gggaaaaaagaaagaaaaag

SEQ ID NO: 1019519 - DNA, 20 bp, Homo sapiens
gggaaaaactttggaaccag

SEQ ID NO: 1019520 - DNA, 15 bp, Homo sapiens
gggaaaactcttcat

SEQ ID NO: 1019521 - DNA, 13 bp, Homo sapiens
gggaaaagcagct

SEQ ID NO: 1019522 - DNA, 13 bp, Homo sapiens
gggaaaatatttc

SEQ ID NO: 1019523 - DNA, 17 bp, Homo sapiens
gggaaaatatttcctga

SEQ ID NO: 1019524 - DNA, 13 bp, Homo sapiens
gggaaaatcagcc

SEQ ID NO: 1019525 - DNA, 21 bp, Homo sapiens
gggaaacatcacacctgccct

SEQ ID NO: 1019526 - DNA, 20 bp, Homo sapiens
gggaaaccctggagccatcc

SEQ ID NO: 1019527 - DNA, 19 bp, Homo sapiens
gggaaaccttggagaggag

SEQ ID NO: 1019528 - DNA, 18 bp, Homo sapiens
gggaaactaagattcttt

SEQ ID NO: 1019529 - DNA, 21 bp, Homo sapiens
gggaaactcagatgtccaaac

SEQ ID NO: 1019530 - DNA, 12 bp, Homo sapiens
gggaaagaagaa

SEQ ID NO: 1019531 - DNA, 19 bp, Homo sapiens
gggaaaggaatcaattatt

SEQ ID NO: 1019532 - DNA, 22 bp, Homo sapiens
gggaaatcaaaagggccaaaga

SEQ ID NO: 1019533 - DNA, 23 bp, Homo sapiens
gggaaatgttttgtaaacattta

SEQ ID NO: 1019534 - DNA, 11 bp, Homo sapiens
gggaaattttt

SEQ ID NO: 1019535 - DNA, 21 bp, Homo sapiens
gggaacaaaactgttcttttg

SEQ ID NO: 1019536 - DNA, 19 bp, Homo sapiens
gggaacaagggtggcatcc

SEQ ID NO: 1019537 - DNA, 21 bp, Homo sapiens
gggaacaatttggcaattttg

SEQ ID NO: 1019538 - DNA, 19 bp, Homo sapiens
gggaacagacaacagaagt

SEQ ID NO: 1019539 - DNA, 14 bp, Homo sapiens
gggaacagacagga

SEQ ID NO: 1019540 - DNA, 12 bp, Homo sapiens
gggaacaggccc

SEQ ID NO: 1019541 - DNA, 12 bp, Homo sapiens
gggaacagggcg

SEQ ID NO: 1019542 - DNA, 23 bp, Homo sapiens
gggaacagtaaagaaagcagaat

SEQ ID NO: 1019543 - DNA, 14 bp, Homo sapiens
gggaacatgccccc

SEQ ID NO: 1019544 - DNA, 22 bp, Homo sapiens
gggaaccagcagaaatgccccc

SEQ ID NO: 1019545 - DNA, 16 bp, Homo sapiens
gggaaccccgcagccc

SEQ ID NO: 1019546 - DNA, 12 bp, Homo sapiens
gggaaccctgct

SEQ ID NO: 1019547 - DNA, 16 bp, Homo sapiens
gggaacctcccagagg

SEQ ID NO: 1019548 - DNA, 16 bp, Homo sapiens
gggaacgatgtgtctg

SEQ ID NO: 1019549 - DNA, 19 bp, Homo sapiens
gggaacgcagcctccagtt

SEQ ID NO: 1019550 - DNA, 15 bp, Homo sapiens
gggaactccactctc

SEQ ID NO: 1019551 - DNA, 18 bp, Homo sapiens
gggaactccactctcctt

SEQ ID NO: 1019552 - DNA, 13 bp, Homo sapiens
gggaactcctgga

SEQ ID NO: 1019553 - DNA, 19 bp, Homo sapiens
gggaagaagcagagagatg

SEQ ID NO: 1019554 - DNA, 22 bp, Homo sapiens
gggaagaccagaattcccttga

SEQ ID NO: 1019555 - DNA, 17 bp, Homo sapiens
gggaagacgcctgagct

SEQ ID NO: 1019556 - DNA, 14 bp, Homo sapiens
gggaagagaagaaa

SEQ ID NO: 1019557 - DNA, 12 bp, Homo sapiens
gggaagagctcc

SEQ ID NO: 1019558 - DNA, 19 bp, Homo sapiens
gggaagaggatgagcagag

SEQ ID NO: 1019559 - DNA, 15 bp, Homo sapiens
gggaagagggcagta

SEQ ID NO: 1019560 - DNA, 15 bp, Homo sapiens
tgccaggaccccagg

SEQ ID NO: 1019561 - DNA, 17 bp, Homo sapiens
tgccaggagatggcccc

SEQ ID NO: 1019562 - DNA, 18 bp, Homo sapiens
tgccaggagatggcccca

SEQ ID NO: 1019563 - DNA, 20 bp, Homo sapiens
tgccaggagatggccccaac

SEQ ID NO: 1019564 - DNA, 20 bp, Homo sapiens
tgccaggcaacttttaaagc

SEQ ID NO: 1019565 - DNA, 15 bp, Homo sapiens
tgccaggcacctggc

SEQ ID NO: 1019566 - DNA, 18 bp, Homo sapiens
tgccaggcacctggcctg

SEQ ID NO: 1019567 - DNA, 23 bp, Homo sapiens
tgccaggcacctggcctgctggg

SEQ ID NO: 1019568 - DNA, 16 bp, Homo sapiens
tgccaggcaggggtgg

SEQ ID NO: 1019569 - DNA, 17 bp, Homo sapiens
tgccaggcaggggtggg

SEQ ID NO: 1019570 - DNA, 15 bp, Homo sapiens
tgccaggccagcctc

SEQ ID NO: 1019571 - DNA, 17 bp, Homo sapiens
tgccaggccagcctccg

SEQ ID NO: 1019572 - DNA, 12 bp, Homo sapiens
tgccaggcccat

SEQ ID NO: 1019573 - DNA, 23 bp, Homo sapiens
tgccaggcccatctcaggtgcca

SEQ ID NO: 1019574 - DNA, 19 bp, Homo sapiens
tgccaggcggccctgggga

SEQ ID NO: 1019575 - DNA, 20 bp, Homo sapiens
tgccaggcggccctggggag

SEQ ID NO: 1019576 - DNA, 18 bp, Homo sapiens
tgccaggcgttggtgcca

SEQ ID NO: 1019577 - DNA, 19 bp, Homo sapiens
tgccaggcgttggtgccac

SEQ ID NO: 1019578 - DNA, 16 bp, Homo sapiens
tgccaggctaattttt

SEQ ID NO: 1019579 - DNA, 17 bp, Homo sapiens
tgccaggctaatttttt

SEQ ID NO: 1019580 - DNA, 14 bp, Homo sapiens
tgccaggctccctt

SEQ ID NO: 1019581 - DNA, 22 bp, Homo sapiens
tgccaggctgaattacagtgaa

SEQ ID NO: 1019582 - DNA, 19 bp, Homo sapiens
tgccaggctgggcacggct

SEQ ID NO: 1019583 - DNA, 13 bp, Homo sapiens
tgccaggcttgcc

SEQ ID NO: 1019584 - DNA, 14 bp, Homo sapiens
tgccaggcttgcct

SEQ ID NO: 1019585 - DNA, 19 bp, Homo sapiens
tgccaggcttgcctgggct

SEQ ID NO: 1019586 - DNA, 20 bp, Homo sapiens
tgccaggcttgcctgggctg

SEQ ID NO: 1019587 - DNA, 17 bp, Homo sapiens
tgccagggcaatgatga

SEQ ID NO: 1019588 - DNA, 22 bp, Homo sapiens
tgccagggcaatgatgaatgag

SEQ ID NO: 1019589 - DNA, 11 bp, Homo sapiens
tgccagggcag

SEQ ID NO: 1019590 - DNA, 12 bp, Homo sapiens
tgccagggcagg

SEQ ID NO: 1019591 - DNA, 14 bp, Homo sapiens
tgccagggcagggt

SEQ ID NO: 1019592 - DNA, 21 bp, Homo sapiens
tgccagggcagggtctgggct

SEQ ID NO: 1019593 - DNA, 23 bp, Homo sapiens
tgccagggccatgtcagacacag

SEQ ID NO: 1019594 - DNA, 13 bp, Homo sapiens
tgccagggcttcc

SEQ ID NO: 1019595 - DNA, 16 bp, Homo sapiens
tgccaggggcttgaga

SEQ ID NO: 1019596 - DNA, 17 bp, Homo sapiens
tgccagggtgagcaggg

SEQ ID NO: 1019597 - DNA, 20 bp, Homo sapiens
tgccagggtgggctggggac

SEQ ID NO: 1019598 - DNA, 17 bp, Homo sapiens
tgccaggtggctcagtg

SEQ ID NO: 1019599 - DNA, 18 bp, Homo sapiens
tgccagtatttttaaagg

SEQ ID NO: 1019600 - DNA, 15 bp, Homo sapiens
gggaagtcaggggag

SEQ ID NO: 1019601 - DNA, 17 bp, Homo sapiens
gggaagtgaggaagcca

SEQ ID NO: 1019602 - DNA, 15 bp, Homo sapiens
gggaagtgaggccca

SEQ ID NO: 1019603 - DNA, 22 bp, Homo sapiens
gggaagttgcattcctttgtct

SEQ ID NO: 1019604 - DNA, 16 bp, Homo sapiens
gggaagtttatttgag

SEQ ID NO: 1019605 - DNA, 17 bp, Homo sapiens
gggaatagggagacagg

SEQ ID NO: 1019606 - DNA, 21 bp, Homo sapiens
gggaatccaagcctccacagc

SEQ ID NO: 1019607 - DNA, 21 bp, Homo sapiens
gggaatccagctccctagact

SEQ ID NO: 1019608 - DNA, 22 bp, Homo sapiens
gggaatctaagagagctgccat

SEQ ID NO: 1019609 - DNA, 17 bp, Homo sapiens
gggaatgagcccagaga

SEQ ID NO: 1019610 - DNA, 21 bp, Homo sapiens
gggaatgagcccagagaacag

SEQ ID NO: 1019611 - DNA, 13 bp, Homo sapiens
gggaatgcctgga

SEQ ID NO: 1019612 - DNA, 14 bp, Homo sapiens
gggaatgcctggag

SEQ ID NO: 1019613 - DNA, 15 bp, Homo sapiens
gggaatggcagctgc

SEQ ID NO: 1019614 - DNA, 14 bp, Homo sapiens
gggaatgggagagg

SEQ ID NO: 1019615 - DNA, 21 bp, Homo sapiens
gggaatgtattattctgcagc

SEQ ID NO: 1019616 - DNA, 17 bp, Homo sapiens
gggaatgttccctgcac

SEQ ID NO: 1019617 - DNA, 23 bp, Homo sapiens
gggaatgttccctgcaccctgga

SEQ ID NO: 1019618 - DNA, 22 bp, Homo sapiens
gggaatgtttgggcagaaggga

SEQ ID NO: 1019619 - DNA, 12 bp, Homo sapiens
gggaattaaata

SEQ ID NO: 1019620 - DNA, 16 bp, Homo sapiens
gggaattaaatagtgt

SEQ ID NO: 1019621 - DNA, 16 bp, Homo sapiens
gggaattccctccccc

SEQ ID NO: 1019622 - DNA, 22 bp, Homo sapiens
gggaattggggagggagaaagg

SEQ ID NO: 1019623 - DNA, 12 bp, Homo sapiens
gggaatttcctc

SEQ ID NO: 1019624 - DNA, 17 bp, Homo sapiens
gggaatttcttcaactc

SEQ ID NO: 1019625 - DNA, 15 bp, Homo sapiens
gggacaaagaggcct

SEQ ID NO: 1019626 - DNA, 13 bp, Homo sapiens
gggacacacagcc

SEQ ID NO: 1019627 - DNA, 14 bp, Homo sapiens
gggacaccagagct

SEQ ID NO: 1019628 - DNA, 17 bp, Homo sapiens
gggacaccagagctgcc

SEQ ID NO: 1019629 - DNA, 16 bp, Homo sapiens
gggacacctgccctgc

SEQ ID NO: 1019630 - DNA, 17 bp, Homo sapiens
gggacacctgccctgcc

SEQ ID NO: 1019631 - DNA, 16 bp, Homo sapiens
gggacacggtgtccac

SEQ ID NO: 1019632 - DNA, 15 bp, Homo sapiens
gggacactgggcagc

SEQ ID NO: 1019633 - DNA, 20 bp, Homo sapiens
gggacactgggcagcaaggc

SEQ ID NO: 1019634 - DNA, 21 bp, Homo sapiens
gggacactgggcagcaaggct

SEQ ID NO: 1019635 - DNA, 21 bp, Homo sapiens
gggacagacgcttgcgccgag

SEQ ID NO: 1019636 - DNA, 17 bp, Homo sapiens
gggacagagccacccca

SEQ ID NO: 1019637 - DNA, 23 bp, Homo sapiens
gggacagagccaccccatgagct

SEQ ID NO: 1019638 - DNA, 19 bp, Homo sapiens
gggacagaggccctgccac

SEQ ID NO: 1019639 - DNA, 17 bp, Homo sapiens
gggacagattcgcagca

SEQ ID NO: 1019640 - DNA, 20 bp, Homo sapiens
gggacagcaagtgagcagag

SEQ ID NO: 1019641 - DNA, 17 bp, Homo sapiens
gggacagccagagctgg

SEQ ID NO: 1019642 - DNA, 13 bp, Homo sapiens
gggacagcttcct

SEQ ID NO: 1019643 - DNA, 20 bp, Homo sapiens
gggacagcttcctcacaccc

SEQ ID NO: 1019644 - DNA, 19 bp, Homo sapiens
gggacaggaccccagctct

SEQ ID NO: 1019645 - DNA, 21 bp, Homo sapiens
gggacaggaccccagctctgc

SEQ ID NO: 1019646 - DNA, 20 bp, Homo sapiens
gggacaggatctataggcag

SEQ ID NO: 1019647 - DNA, 21 bp, Homo sapiens
gggacaggcccgcttgctggg

SEQ ID NO: 1019648 - DNA, 13 bp, Homo sapiens
gggacaggcctca

SEQ ID NO: 1019649 - DNA, 17 bp, Homo sapiens
gggacaggcctcacctc

SEQ ID NO: 1019650 - DNA, 18 bp, Homo sapiens
gggacaggctgaagagag

SEQ ID NO: 1019651 - DNA, 23 bp, Homo sapiens
gggacaggctggaatgagggagg

SEQ ID NO: 1019652 - DNA, 17 bp, Homo sapiens
gggacatgctcacctct

SEQ ID NO: 1019653 - DNA, 14 bp, Homo sapiens
gggacatggcacag

SEQ ID NO: 1019654 - DNA, 19 bp, Homo sapiens
gggacattttctggattct

SEQ ID NO: 1019655 - DNA, 20 bp, Homo sapiens
gggaccaaactcacggacca

SEQ ID NO: 1019656 - DNA, 17 bp, Homo sapiens
gggaccaaagggggagt

SEQ ID NO: 1019657 - DNA, 20 bp, Homo sapiens
gggaccaagcgaccaaggat

SEQ ID NO: 1019658 - DNA, 17 bp, Homo sapiens
gggaccaaggacccctc

SEQ ID NO: 1019659 - DNA, 23 bp, Homo sapiens
gggaccaaggcaaggcaggtgcc

SEQ ID NO: 1019660 - DNA, 17 bp, Homo sapiens
gggaccaccctgagccg

SEQ ID NO: 1019661 - DNA, 23 bp, Homo sapiens
gggaccactaaatctccaagacc

SEQ ID NO: 1019662 - DNA, 22 bp, Homo sapiens
gggaccactgggtgagagagga

SEQ ID NO: 1019663 - DNA, 15 bp, Homo sapiens
gggaccatctgctgc

SEQ ID NO: 1019664 - DNA, 18 bp, Homo sapiens
gggaccatctgctgcagt

SEQ ID NO: 1019665 - DNA, 17 bp, Homo sapiens
gggaccatgtgtcactt

SEQ ID NO: 1019666 - DNA, 22 bp, Homo sapiens
gggaccattgacctcagctgca

SEQ ID NO: 1019667 - DNA, 21 bp, Homo sapiens
gggacccaatgtaggagctgc

SEQ ID NO: 1019668 - DNA, 19 bp, Homo sapiens
gggacccagagtcccaggc

SEQ ID NO: 1019669 - DNA, 14 bp, Homo sapiens
gggacccagctcct

SEQ ID NO: 1019670 - DNA, 16 bp, Homo sapiens
gggacccagctcctct

SEQ ID NO: 1019671 - DNA, 22 bp, Homo sapiens
gggacccagctcctctgagcca

SEQ ID NO: 1019672 - DNA, 17 bp, Homo sapiens
gggacccaggctccgcc

SEQ ID NO: 1019673 - DNA, 19 bp, Homo sapiens
gggacccaggctccgccct

SEQ ID NO: 1019674 - DNA, 22 bp, Homo sapiens
gggacccaggctccgcccttag

SEQ ID NO: 1019675 - DNA, 20 bp, Homo sapiens
gggacccatagatcttctga

SEQ ID NO: 1019676 - DNA, 17 bp, Homo sapiens
gggacccccgccccctg

SEQ ID NO: 1019677 - DNA, 16 bp, Homo sapiens
gggaccccctcgccag

SEQ ID NO: 1019678 - DNA, 19 bp, Homo sapiens
gggacccctcccaacctca

SEQ ID NO: 1019679 - DNA, 19 bp, Homo sapiens
gggacccggggtctcctgg

SEQ ID NO: 1019680 - DNA, 19 bp, Homo sapiens
gggaccctccagaggtgga

SEQ ID NO: 1019681 - DNA, 19 bp, Homo sapiens
tgcccaaactccccttccc

SEQ ID NO: 1019682 - DNA, 23 bp, Homo sapiens
tgcccaaccaggttgcagtagca

SEQ ID NO: 1019683 - DNA, 22 bp, Homo sapiens
tgcccaagaatagatgctgact

SEQ ID NO: 1019684 - DNA, 20 bp, Homo sapiens
tgcccaagcagcctggagac

SEQ ID NO: 1019685 - DNA, 23 bp, Homo sapiens
tgcccaagccagaggctgggttc

SEQ ID NO: 1019686 - DNA, 17 bp, Homo sapiens
tgcccaagggcctccca

SEQ ID NO: 1019687 - DNA, 19 bp, Homo sapiens
tgcccaagggcctcccacc

SEQ ID NO: 1019688 - DNA, 22 bp, Homo sapiens
tgcccaagggcctcccaccaga

SEQ ID NO: 1019689 - DNA, 18 bp, Homo sapiens
tgcccaagtgaccaggga

SEQ ID NO: 1019690 - DNA, 14 bp, Homo sapiens
tgcccaagtgggca

SEQ ID NO: 1019691 - DNA, 15 bp, Homo sapiens
tgcccaagtgggcag

SEQ ID NO: 1019692 - DNA, 15 bp, Homo sapiens
tgcccaatgaataat

SEQ ID NO: 1019693 - DNA, 20 bp, Homo sapiens
tgcccaatgctttgggaggc

SEQ ID NO: 1019694 - DNA, 22 bp, Homo sapiens
tgcccaatgctttgggaggcca

SEQ ID NO: 1019695 - DNA, 12 bp, Homo sapiens
tgcccacaggcc

SEQ ID NO: 1019696 - DNA, 14 bp, Homo sapiens
tgcccacaggtgcg

SEQ ID NO: 1019697 - DNA, 13 bp, Homo sapiens
tgcccacataccc

SEQ ID NO: 1019698 - DNA, 17 bp, Homo sapiens
tgcccacatttgggctc

SEQ ID NO: 1019699 - DNA, 19 bp, Homo sapiens
tgcccacatttgggctcag

SEQ ID NO: 1019700 - DNA, 20 bp, Homo sapiens
tgcccacatttgggctcagg

SEQ ID NO: 1019701 - DNA, 23 bp, Homo sapiens
tgcccaccaacatcccattgccc

SEQ ID NO: 1019702 - DNA, 11 bp, Homo sapiens
tgcccaccccc

SEQ ID NO: 1019703 - DNA, 22 bp, Homo sapiens
tgcccacccccaccatgcagcc

SEQ ID NO: 1019704 - DNA, 23 bp, Homo sapiens
tgcccacccccgggatcctgccc

SEQ ID NO: 1019705 - DNA, 13 bp, Homo sapiens
tgcccaccccctc

SEQ ID NO: 1019706 - DNA, 14 bp, Homo sapiens
tgcccaccccctgc

SEQ ID NO: 1019707 - DNA, 15 bp, Homo sapiens
tgcccaccccctgcc

SEQ ID NO: 1019708 - DNA, 16 bp, Homo sapiens
tgcccaccccctgccc

SEQ ID NO: 1019709 - DNA, 19 bp, Homo sapiens
tgcccaccccctgccctgc

SEQ ID NO: 1019710 - DNA, 12 bp, Homo sapiens
tgcccacccctc

SEQ ID NO: 1019711 - DNA, 18 bp, Homo sapiens
tgcccacccctcactccc

SEQ ID NO: 1019712 - DNA, 21 bp, Homo sapiens
tgcccacccctcactccccag

SEQ ID NO: 1019713 - DNA, 21 bp, Homo sapiens
tgcccaccctaccagctcctc

SEQ ID NO: 1019714 - DNA, 15 bp, Homo sapiens
tgcccaccgccctcc

SEQ ID NO: 1019715 - DNA, 16 bp, Homo sapiens
tgcccaccgccctcct

SEQ ID NO: 1019716 - DNA, 17 bp, Homo sapiens
tgcccaccgccctcctc

SEQ ID NO: 1019717 - DNA, 21 bp, Homo sapiens
tgcccaccgccctcctccact

SEQ ID NO: 1019718 - DNA, 14 bp, Homo sapiens
tgcccacctctccc

SEQ ID NO: 1019719 - DNA, 15 bp, Homo sapiens
tgcccacctctccct

SEQ ID NO: 1019720 - DNA, 18 bp, Homo sapiens
tgcccacctggggtctct

SEQ ID NO: 1019721 - DNA, 19 bp, Homo sapiens
tgcccacgcagaggacgca

SEQ ID NO: 1019722 - DNA, 20 bp, Homo sapiens
tgcccacggtctgagctagc

SEQ ID NO: 1019723 - DNA, 15 bp, Homo sapiens
tgcccactggccgct

SEQ ID NO: 1019724 - DNA, 20 bp, Homo sapiens
tgcccactggccgctgagcg

SEQ ID NO: 1019725 - DNA, 22 bp, Homo sapiens
tgcccacttagccgtccatggc

SEQ ID NO: 1019726 - DNA, 18 bp, Homo sapiens
gggacttgaatctttcca

SEQ ID NO: 1019727 - DNA, 22 bp, Homo sapiens
gggacttggagagcaaaggccc

SEQ ID NO: 1019728 - DNA, 13 bp, Homo sapiens
gggacttgtaaca

SEQ ID NO: 1019729 - DNA, 24 bp, Homo sapiens
gggacttgtaggaatctgccttcc

SEQ ID NO: 1019730 - DNA, 15 bp, Homo sapiens
gggacttgtgtctgc

SEQ ID NO: 1019731 - DNA, 20 bp, Homo sapiens
gggagaaaaagaaacacaag

SEQ ID NO: 1019732 - DNA, 13 bp, Homo sapiens
gggagaaaattca

SEQ ID NO: 1019733 - DNA, 18 bp, Homo sapiens
gggagaaaattgttgcaa

SEQ ID NO: 1019734 - DNA, 15 bp, Homo sapiens
gggagaacctcaggc

SEQ ID NO: 1019735 - DNA, 13 bp, Homo sapiens
gggagaactgaag

SEQ ID NO: 1019736 - DNA, 22 bp, Homo sapiens
gggagaagaaaggtgagtttga

SEQ ID NO: 1019737 - DNA, 21 bp, Homo sapiens
gggagaagctgaagcccccct

SEQ ID NO: 1019738 - DNA, 18 bp, Homo sapiens
gggagaaggaagggcaga

SEQ ID NO: 1019739 - DNA, 19 bp, Homo sapiens
gggagaaggaagggcagag

SEQ ID NO: 1019740 - DNA, 20 bp, Homo sapiens
gggagacaattagcagaatg

SEQ ID NO: 1019741 - DNA, 19 bp, Homo sapiens
gggagacactggcccctca

SEQ ID NO: 1019742 - DNA, 16 bp, Homo sapiens
gggagacagcagcctg

SEQ ID NO: 1019743 - DNA, 15 bp, Homo sapiens
gggagacagggctgc

SEQ ID NO: 1019744 - DNA, 14 bp, Homo sapiens
gggagacagggtag

SEQ ID NO: 1019745 - DNA, 22 bp, Homo sapiens
gggagacagtggtagagaggtt

SEQ ID NO: 1019746 - DNA, 19 bp, Homo sapiens
gggagacagttgagagcgg

SEQ ID NO: 1019747 - DNA, 23 bp, Homo sapiens
gggagaccccttgttgcactgcc

SEQ ID NO: 1019748 - DNA, 22 bp, Homo sapiens
gggagacctgttggcctgtggg

SEQ ID NO: 1019749 - DNA, 24 bp, Homo sapiens
gggagacctgttggcctgtgggcc

SEQ ID NO: 1019750 - DNA, 21 bp, Homo sapiens
gggagacggccctgctggggc

SEQ ID NO: 1019751 - DNA, 17 bp, Homo sapiens
gggagacttggggccag

SEQ ID NO: 1019752 - DNA, 14 bp, Homo sapiens
gggagagacacaga

SEQ ID NO: 1019753 - DNA, 21 bp, Homo sapiens
gggagagacaggcagcccagc

SEQ ID NO: 1019754 - DNA, 22 bp, Homo sapiens
gggagagacctcatcaggatga

SEQ ID NO: 1019755 - DNA, 13 bp, Homo sapiens
gggagagcaggct

SEQ ID NO: 1019756 - DNA, 14 bp, Homo sapiens
gggagagcaggctg

SEQ ID NO: 1019757 - DNA, 15 bp, Homo sapiens
gggagagcaggctgg

SEQ ID NO: 1019758 - DNA, 16 bp, Homo sapiens
gggagagcaggctggc

SEQ ID NO: 1019759 - DNA, 14 bp, Homo sapiens
gggagagccagctt

SEQ ID NO: 1019760 - DNA, 12 bp, Homo sapiens
gggagagccagg

SEQ ID NO: 1019761 - DNA, 22 bp, Homo sapiens
gggagagccaggcttggatgga

SEQ ID NO: 1019762 - DNA, 12 bp, Homo sapiens
gggagagcctgc

SEQ ID NO: 1019763 - DNA, 13 bp, Homo sapiens
gggagagcctggc

SEQ ID NO: 1019764 - DNA, 15 bp, Homo sapiens
gggagagctgagcca

SEQ ID NO: 1019765 - DNA, 22 bp, Homo sapiens
gggagaggccatgattcgccca

SEQ ID NO: 1019766 - DNA, 14 bp, Homo sapiens
gggagagggaagag

SEQ ID NO: 1019767 - DNA, 18 bp, Homo sapiens
gggagagggtgaaggagg

SEQ ID NO: 1019768 - DNA, 16 bp, Homo sapiens
gggagaggtcaccagc

SEQ ID NO: 1019769 - DNA, 20 bp, Homo sapiens
gggagaggtcaccagctgct

SEQ ID NO: 1019770 - DNA, 16 bp, Homo sapiens
gggagaggtgccagca

SEQ ID NO: 1019771 - DNA, 21 bp, Homo sapiens
gggagagttgaccgttttcat

SEQ ID NO: 1019772 - DNA, 21 bp, Homo sapiens
gggagatgcttctctccttgc

SEQ ID NO: 1019773 - DNA, 22 bp, Homo sapiens
gggagatgggggcttcttcctc

SEQ ID NO: 1019774 - DNA, 14 bp, Homo sapiens
gggagatggtcagt

SEQ ID NO: 1019775 - DNA, 14 bp, Homo sapiens
gggagattctgggt

SEQ ID NO: 1019776 - DNA, 13 bp, Homo sapiens
gggagcacaaggc

SEQ ID NO: 1019777 - DNA, 13 bp, Homo sapiens
gggagcagagaca

SEQ ID NO: 1019778 - DNA, 23 bp, Homo sapiens
gggagcagagagagccagacagc

SEQ ID NO: 1019779 - DNA, 20 bp, Homo sapiens
gggagcagcggctctggtcc

SEQ ID NO: 1019780 - DNA, 13 bp, Homo sapiens
gggagcagcttct

SEQ ID NO: 1019781 - DNA, 19 bp, Homo sapiens
gggagcagtgtcttccata

SEQ ID NO: 1019782 - DNA, 20 bp, Homo sapiens
gggagcagtgtcttccataa

SEQ ID NO: 1019783 - DNA, 24 bp, Homo sapiens
gggagcatcggagggagtcccaga

SEQ ID NO: 1019784 - DNA, 19 bp, Homo sapiens
gggagccacttctccccag

SEQ ID NO: 1019785 - DNA, 11 bp, Homo sapiens
gggagccagct

SEQ ID NO: 1019786 - DNA, 20 bp, Homo sapiens
gggagccagctgctttttgt

SEQ ID NO: 1019787 - DNA, 13 bp, Homo sapiens
gggagccaggctc

SEQ ID NO: 1019788 - DNA, 14 bp, Homo sapiens
gggagccaggctct

SEQ ID NO: 1019789 - DNA, 14 bp, Homo sapiens
gggagccagtgtgc

SEQ ID NO: 1019790 - DNA, 16 bp, Homo sapiens
gggagccccagggtct

SEQ ID NO: 1019791 - DNA, 21 bp, Homo sapiens
gggagccccagggtcttccct

SEQ ID NO: 1019792 - DNA, 19 bp, Homo sapiens
gggagccccttctgctcag

SEQ ID NO: 1019793 - DNA, 13 bp, Homo sapiens
gggagccctcagg

SEQ ID NO: 1019794 - DNA, 15 bp, Homo sapiens
gggagccctcaggct

SEQ ID NO: 1019795 - DNA, 18 bp, Homo sapiens
gggagccctcaggctccc

SEQ ID NO: 1019796 - DNA, 14 bp, Homo sapiens
gggagccctgacct

SEQ ID NO: 1019797 - DNA, 17 bp, Homo sapiens
gggagcctagctcctgc

SEQ ID NO: 1019798 - DNA, 11 bp, Homo sapiens
gggagcctccc

SEQ ID NO: 1019799 - DNA, 17 bp, Homo sapiens
gggagcctcgcccctcc

SEQ ID NO: 1019800 - DNA, 23 bp, Homo sapiens
gggagcctcgcccctccagtgtt

SEQ ID NO: 1019801 - DNA, 17 bp, Homo sapiens
gggagcctgaggcagga

SEQ ID NO: 1019802 - DNA, 19 bp, Homo sapiens
gggagcctttggggggcca

SEQ ID NO: 1019803 - DNA, 18 bp, Homo sapiens
tgccccacccccctcctc

SEQ ID NO: 1019804 - DNA, 21 bp, Homo sapiens
tgccccacccccctcctcccc

SEQ ID NO: 1019805 - DNA, 15 bp, Homo sapiens
tgccccacctcccca

SEQ ID NO: 1019806 - DNA, 18 bp, Homo sapiens
tgccccacctccccacac

SEQ ID NO: 1019807 - DNA, 17 bp, Homo sapiens
tgccccaccttgccagg

SEQ ID NO: 1019808 - DNA, 20 bp, Homo sapiens
tgccccaccttgccagggca

SEQ ID NO: 1019809 - DNA, 19 bp, Homo sapiens
tgccccacctttattaaaa

SEQ ID NO: 1019810 - DNA, 21 bp, Homo sapiens
tgccccacctttattaaaatc

SEQ ID NO: 1019811 - DNA, 21 bp, Homo sapiens
tgccccacgctgtggccctgg

SEQ ID NO: 1019812 - DNA, 11 bp, Homo sapiens
tgccccactcc

SEQ ID NO: 1019813 - DNA, 19 bp, Homo sapiens
tgccccacttctggcatgg

SEQ ID NO: 1019814 - DNA, 22 bp, Homo sapiens
tgccccagactgagctctccag

SEQ ID NO: 1019815 - DNA, 23 bp, Homo sapiens
tgccccagactgagctctccagg

SEQ ID NO: 1019816 - DNA, 14 bp, Homo sapiens
tgccccagagctgt

SEQ ID NO: 1019817 - DNA, 15 bp, Homo sapiens
tgccccagagctgtt

SEQ ID NO: 1019818 - DNA, 13 bp, Homo sapiens
tgccccagccaga

SEQ ID NO: 1019819 - DNA, 14 bp, Homo sapiens
tgccccagcccaga

SEQ ID NO: 1019820 - DNA, 21 bp, Homo sapiens
tgccccagcccctaagccccg

SEQ ID NO: 1019821 - DNA, 15 bp, Homo sapiens
tgccccagctctgga

SEQ ID NO: 1019822 - DNA, 16 bp, Homo sapiens
tgccccagctctggct

SEQ ID NO: 1019823 - DNA, 18 bp, Homo sapiens
tgccccagctctggcttc

SEQ ID NO: 1019824 - DNA, 18 bp, Homo sapiens
tgccccagctgactgtgg

SEQ ID NO: 1019825 - DNA, 19 bp, Homo sapiens
tgccccagctgactgtggc

SEQ ID NO: 1019826 - DNA, 18 bp, Homo sapiens
tgccccagctgccaggcg

SEQ ID NO: 1019827 - DNA, 19 bp, Homo sapiens
tgccccagctgccaggcgg

SEQ ID NO: 1019828 - DNA, 21 bp, Homo sapiens
tgccccaggactctggcactt

SEQ ID NO: 1019829 - DNA, 16 bp, Homo sapiens
tgccccaggccaggta

SEQ ID NO: 1019830 - DNA, 12 bp, Homo sapiens
tgccccaggccc

SEQ ID NO: 1019831 - DNA, 21 bp, Homo sapiens
tgccccaggccggagcccaga

SEQ ID NO: 1019832 - DNA, 22 bp, Homo sapiens
tgccccaggccggagcccagat

SEQ ID NO: 1019833 - DNA, 20 bp, Homo sapiens
tgccccagggagtccagggt

SEQ ID NO: 1019834 - DNA, 19 bp, Homo sapiens
tgccccagggcctgcttcc

SEQ ID NO: 1019835 - DNA, 14 bp, Homo sapiens
tgccccagtttggg

SEQ ID NO: 1019836 - DNA, 16 bp, Homo sapiens
tgccccatcagtgctc

SEQ ID NO: 1019837 - DNA, 20 bp, Homo sapiens
tgccccatcagtgctccctc

SEQ ID NO: 1019838 - DNA, 21 bp, Homo sapiens
tgccccatcagtgctccctca

SEQ ID NO: 1019839 - DNA, 18 bp, Homo sapiens
tgccccatcctccagcag

SEQ ID NO: 1019840 - DNA, 20 bp, Homo sapiens
tgccccatcctccagcaggg

SEQ ID NO: 1019841 - DNA, 15 bp, Homo sapiens
tgccccatgcctgtc

SEQ ID NO: 1019842 - DNA, 18 bp, Homo sapiens
tgccccattcttttgtaa

SEQ ID NO: 1019843 - DNA, 22 bp, Homo sapiens
tgcccccaccccggggaccctg

SEQ ID NO: 1019844 - DNA, 23 bp, Homo sapiens
tgcccccaccccggggaccctgt

SEQ ID NO: 1019845 - DNA, 18 bp, Homo sapiens
tgcccccagaaagcctcc

SEQ ID NO: 1019846 - DNA, 16 bp, Homo sapiens
tgcccccagccccggg

SEQ ID NO: 1019847 - DNA, 20 bp, Homo sapiens
tgcccccagccccggggtga

SEQ ID NO: 1019848 - DNA, 13 bp, Homo sapiens
tgcccccagcctc

SEQ ID NO: 1019849 - DNA, 20 bp, Homo sapiens
tgcccccagcctcagcccaa

SEQ ID NO: 1019850 - DNA, 14 bp, Homo sapiens
tgcccccagctggc

SEQ ID NO: 1019851 - DNA, 16 bp, Homo sapiens
tgcccccagctggccc

SEQ ID NO: 1019852 - DNA, 14 bp, Homo sapiens
tgcccccaggcagc

SEQ ID NO: 1019853 - DNA, 20 bp, Homo sapiens
gggaggcggagcttgcagtg

SEQ ID NO: 1019854 - DNA, 22 bp, Homo sapiens
gggaggcggggaggaggaacgg

SEQ ID NO: 1019855 - DNA, 10 bp, Homo sapiens
gggaggctga

SEQ ID NO: 1019856 - DNA, 15 bp, Homo sapiens
gggaggctgagacag

SEQ ID NO: 1019857 - DNA, 19 bp, Homo sapiens
gggaggctgaggcaggaga

SEQ ID NO: 1019858 - DNA, 17 bp, Homo sapiens
gggaggctgaggcaggc

SEQ ID NO: 1019859 - DNA, 24 bp, Homo sapiens
gggaggctgcactggagccacagg

SEQ ID NO: 1019860 - DNA, 13 bp, Homo sapiens
gggaggcttcccc

SEQ ID NO: 1019861 - DNA, 13 bp, Homo sapiens
gggaggctttcaa

SEQ ID NO: 1019862 - DNA, 20 bp, Homo sapiens
gggagggaaaagggaagtag

SEQ ID NO: 1019863 - DNA, 22 bp, Homo sapiens
gggagggagccatggaaggtgc

SEQ ID NO: 1019864 - DNA, 22 bp, Homo sapiens
gggagggatgaagggcgagtga

SEQ ID NO: 1019865 - DNA, 11 bp, Homo sapiens
gggagggatta

SEQ ID NO: 1019866 - DNA, 16 bp, Homo sapiens
gggagggcagctggcc

SEQ ID NO: 1019867 - DNA, 19 bp, Homo sapiens
gggagggcaggatggcctt

SEQ ID NO: 1019868 - DNA, 13 bp, Homo sapiens
gggagggccaggg

SEQ ID NO: 1019869 - DNA, 18 bp, Homo sapiens
gggagggccagggaggca

SEQ ID NO: 1019870 - DNA, 19 bp, Homo sapiens
gggagggccggcggctctg

SEQ ID NO: 1019871 - DNA, 14 bp, Homo sapiens
gggaggggacagag

SEQ ID NO: 1019872 - DNA, 15 bp, Homo sapiens
gggaggggacagagc

SEQ ID NO: 1019873 - DNA, 22 bp, Homo sapiens
gggaggggacagaggccctgcc

SEQ ID NO: 1019874 - DNA, 16 bp, Homo sapiens
gggaggggcaggctga

SEQ ID NO: 1019875 - DNA, 15 bp, Homo sapiens
gggaggggccctcag

SEQ ID NO: 1019876 - DNA, 14 bp, Homo sapiens
gggaggggcctagg

SEQ ID NO: 1019877 - DNA, 13 bp, Homo sapiens
gggagggggaagc

SEQ ID NO: 1019878 - DNA, 13 bp, Homo sapiens
gggagggggacct

SEQ ID NO: 1019879 - DNA, 15 bp, Homo sapiens
gggagggggatccga

SEQ ID NO: 1019880 - DNA, 18 bp, Homo sapiens
gggagggggcacggcagg

SEQ ID NO: 1019881 - DNA, 24 bp, Homo sapiens
gggagggtgacccacagctctggg

SEQ ID NO: 1019882 - DNA, 20 bp, Homo sapiens
gggagggtgttcagaggcag

SEQ ID NO: 1019883 - DNA, 15 bp, Homo sapiens
gggagggtgttttgg

SEQ ID NO: 1019884 - DNA, 17 bp, Homo sapiens
gggagggttagcctgca

SEQ ID NO: 1019885 - DNA, 14 bp, Homo sapiens
gggaggtcattttg

SEQ ID NO: 1019886 - DNA, 16 bp, Homo sapiens
gggaggtccaagcaga

SEQ ID NO: 1019887 - DNA, 15 bp, Homo sapiens
gggaggtcgaggcag

SEQ ID NO: 1019888 - DNA, 17 bp, Homo sapiens
gggaggtcgaggcagga

SEQ ID NO: 1019889 - DNA, 16 bp, Homo sapiens
gggaggtcgaggtagg

SEQ ID NO: 1019890 - DNA, 19 bp, Homo sapiens
gggaggtctcgtcccagcc

SEQ ID NO: 1019891 - DNA, 23 bp, Homo sapiens
gggaggtggaagaagggagaaga

SEQ ID NO: 1019892 - DNA, 19 bp, Homo sapiens
gggaggtgggaggccaggc

SEQ ID NO: 1019893 - DNA, 22 bp, Homo sapiens
gggaggtgtttaaagagaggtt

SEQ ID NO: 1019894 - DNA, 14 bp, Homo sapiens
gggaggttgggagg

SEQ ID NO: 1019895 - DNA, 19 bp, Homo sapiens
gggaggttgggaggctgtg

SEQ ID NO: 1019896 - DNA, 15 bp, Homo sapiens
gggaggttggttcct

SEQ ID NO: 1019897 - DNA, 22 bp, Homo sapiens
gggaggttggttccttgggggg

SEQ ID NO: 1019898 - DNA, 23 bp, Homo sapiens
gggaggttttattctgacttcct

SEQ ID NO: 1019899 - DNA, 20 bp, Homo sapiens
gggagtaataggaccagagc

SEQ ID NO: 1019900 - DNA, 23 bp, Homo sapiens
gggagtacctgctgccccagctg

SEQ ID NO: 1019901 - DNA, 16 bp, Homo sapiens
gggagtatgcaaaagt

SEQ ID NO: 1019902 - DNA, 21 bp, Homo sapiens
gggagtatgcaaaagttctga

SEQ ID NO: 1019903 - DNA, 21 bp, Homo sapiens
gggagtatgttgtcataacat

SEQ ID NO: 1019904 - DNA, 16 bp, Homo sapiens
gggagtcaccttccct

SEQ ID NO: 1019905 - DNA, 22 bp, Homo sapiens
gggagtcagagccctggctggg

SEQ ID NO: 1019906 - DNA, 15 bp, Homo sapiens
gggagtccaggcaca

SEQ ID NO: 1019907 - DNA, 14 bp, Homo sapiens
gggagtccagggtt

SEQ ID NO: 1019908 - DNA, 17 bp, Homo sapiens
gggagtccctacctgct

SEQ ID NO: 1019909 - DNA, 21 bp, Homo sapiens
gggagtgaaacagagaaagaa

SEQ ID NO: 1019910 - DNA, 13 bp, Homo sapiens
gggagtgagcagc

SEQ ID NO: 1019911 - DNA, 15 bp, Homo sapiens
gggagtgaggggctg

SEQ ID NO: 1019912 - DNA, 19 bp, Homo sapiens
gggagtgaggggctgtgac

SEQ ID NO: 1019913 - DNA, 18 bp, Homo sapiens
gggagtgcagagaaagaa

SEQ ID NO: 1019914 - DNA, 19 bp, Homo sapiens
gggagtgctggctcacagt

SEQ ID NO: 1019915 - DNA, 20 bp, Homo sapiens
gggagtggcacttctgcctt

SEQ ID NO: 1019916 - DNA, 18 bp, Homo sapiens
gggagtgggcacctcaga

SEQ ID NO: 1019917 - DNA, 20 bp, Homo sapiens
gggagtgggcacctcagaaa

SEQ ID NO: 1019918 - DNA, 18 bp, Homo sapiens
gggagtggttcctgtgga

SEQ ID NO: 1019919 - DNA, 18 bp, Homo sapiens
gggagtgttctgtgggct

SEQ ID NO: 1019920 - DNA, 20 bp, Homo sapiens
gggagttgagtcacaagagg

SEQ ID NO: 1019921 - DNA, 21 bp, Homo sapiens
gggataaccccaggcactgtt

SEQ ID NO: 1019922 - DNA, 17 bp, Homo sapiens
gggataatgtccccact

SEQ ID NO: 1019923 - DNA, 14 bp, Homo sapiens
gggataatttattt

SEQ ID NO: 1019924 - DNA, 14 bp, Homo sapiens
tgcccctgatgcag

SEQ ID NO: 1019925 - DNA, 17 bp, Homo sapiens
tgcccctgatgcagcct

SEQ ID NO: 1019926 - DNA, 21 bp, Homo sapiens
tgcccctgcagtttggccctg

SEQ ID NO: 1019927 - DNA, 16 bp, Homo sapiens
tgcccctgctgcctcc

SEQ ID NO: 1019928 - DNA, 17 bp, Homo sapiens
tgcccctgctgcctccc

SEQ ID NO: 1019929 - DNA, 19 bp, Homo sapiens
tgcccctggacctgggaac

SEQ ID NO: 1019930 - DNA, 17 bp, Homo sapiens
tgcccctggcccatctc

SEQ ID NO: 1019931 - DNA, 13 bp, Homo sapiens
tgcccctggctgg

SEQ ID NO: 1019932 - DNA, 15 bp, Homo sapiens
tgcccctgtccggac

SEQ ID NO: 1019933 - DNA, 16 bp, Homo sapiens
tgcccctgtctggaag

SEQ ID NO: 1019934 - DNA, 17 bp, Homo sapiens
tgcccctgtgctgcggg

SEQ ID NO: 1019935 - DNA, 21 bp, Homo sapiens
tgccccttcccatctcttcct

SEQ ID NO: 1019936 - DNA, 13 bp, Homo sapiens
tgccccttgcaag

SEQ ID NO: 1019937 - DNA, 15 bp, Homo sapiens
tgccccttgcaagcc

SEQ ID NO: 1019938 - DNA, 17 bp, Homo sapiens
tgccccttgcaagccat

SEQ ID NO: 1019939 - DNA, 18 bp, Homo sapiens
tgccccttgcaagccata

SEQ ID NO: 1019940 - DNA, 13 bp, Homo sapiens
tgccccttgccat

SEQ ID NO: 1019941 - DNA, 12 bp, Homo sapiens
tgccccttggct

SEQ ID NO: 1019942 - DNA, 12 bp, Homo sapiens
tgccccttgggc

SEQ ID NO: 1019943 - DNA, 19 bp, Homo sapiens
tgccccttggggggcttga

SEQ ID NO: 1019944 - DNA, 18 bp, Homo sapiens
tgcccctttccttcactg

SEQ ID NO: 1019945 - DNA, 20 bp, Homo sapiens
tgcccctttccttcactgcc

SEQ ID NO: 1019946 - DNA, 23 bp, Homo sapiens
tgcccgaaactaagccaggcctg

SEQ ID NO: 1019947 - DNA, 20 bp, Homo sapiens
tgcccgagtccgcccatccc

SEQ ID NO: 1019948 - DNA, 23 bp, Homo sapiens
tgcccgcacccctccctgcttgc

SEQ ID NO: 1019949 - DNA, 13 bp, Homo sapiens
tgcccgcagagcc

SEQ ID NO: 1019950 - DNA, 19 bp, Homo sapiens
tgcccgcagagcccacgcc

SEQ ID NO: 1019951 - DNA, 18 bp, Homo sapiens
tgcccgcatgtgtgcctg

SEQ ID NO: 1019952 - DNA, 15 bp, Homo sapiens
tgcccgccagcctca

SEQ ID NO: 1019953 - DNA, 22 bp, Homo sapiens
tgcccgccagcctcagtgccac

SEQ ID NO: 1019954 - DNA, 18 bp, Homo sapiens
tgcccgcctaggagttga

SEQ ID NO: 1019955 - DNA, 15 bp, Homo sapiens
tgcccgctcagccca

SEQ ID NO: 1019956 - DNA, 14 bp, Homo sapiens
tgcccgctcccaca

SEQ ID NO: 1019957 - DNA, 16 bp, Homo sapiens
tgcccgctcccacagc

SEQ ID NO: 1019958 - DNA, 23 bp, Homo sapiens
tgcccggagattggacggcctga

SEQ ID NO: 1019959 - DNA, 22 bp, Homo sapiens
tgcccggcacagatgctccagg

SEQ ID NO: 1019960 - DNA, 18 bp, Homo sapiens
tgcccggggagctgcaga

SEQ ID NO: 1019961 - DNA, 20 bp, Homo sapiens
tgcccggggagctgcagagc

SEQ ID NO: 1019962 - DNA, 20 bp, Homo sapiens
tgcccggggcagctgccaga

SEQ ID NO: 1019963 - DNA, 14 bp, Homo sapiens
tgcccgggggacgc

SEQ ID NO: 1019964 - DNA, 19 bp, Homo sapiens
tgcccgggggacgcctgcc

SEQ ID NO: 1019965 - DNA, 18 bp, Homo sapiens
tgcccggttgccatggag

SEQ ID NO: 1019966 - DNA, 16 bp, Homo sapiens
tgcccgtcggccctgc

SEQ ID NO: 1019967 - DNA, 17 bp, Homo sapiens
tgcccgtcggccctgcg

SEQ ID NO: 1019968 - DNA, 17 bp, Homo sapiens
tgcccgtcttcagccta

SEQ ID NO: 1019969 - DNA, 13 bp, Homo sapiens
tgccctaaaccct

SEQ ID NO: 1019970 - DNA, 20 bp, Homo sapiens
tgccctaaagtgtatttttt

SEQ ID NO: 1019971 - DNA, 22 bp, Homo sapiens
tgccctaactctgcccaccctc

SEQ ID NO: 1019972 - DNA, 18 bp, Homo sapiens
tgccctaagcccccaggg

SEQ ID NO: 1019973 - DNA, 21 bp, Homo sapiens
tgccctaagcccccagggcct

SEQ ID NO: 1019974 - DNA, 23 bp, Homo sapiens
tgccctaagcccccagggcctcc

SEQ ID NO: 1019975 - DNA, 13 bp, Homo sapiens
tgccctaagggac

SEQ ID NO: 1019976 - DNA, 22 bp, Homo sapiens
tgccctactatagcagttttta

SEQ ID NO: 1019977 - DNA, 17 bp, Homo sapiens
tgccctagaccctcccc

SEQ ID NO: 1019978 - DNA, 23 bp, Homo sapiens
tgccctagagacggcaggatcat

SEQ ID NO: 1019979 - DNA, 18 bp, Homo sapiens
gggattgaggggccctgg

SEQ ID NO: 1019980 - DNA, 20 bp, Homo sapiens
gggattggaccgagctggaa

SEQ ID NO: 1019981 - DNA, 15 bp, Homo sapiens
gggatttctcccagc

SEQ ID NO: 1019982 - DNA, 17 bp, Homo sapiens
gggatttctcccagctc

SEQ ID NO: 1019983 - DNA, 19 bp, Homo sapiens
gggatttcttcgctgctct

SEQ ID NO: 1019984 - DNA, 20 bp, Homo sapiens
gggatttcttcgctgctcta

SEQ ID NO: 1019985 - DNA, 12 bp, Homo sapiens
gggatttgagat

SEQ ID NO: 1019986 - DNA, 16 bp, Homo sapiens
gggattttttcccttt

SEQ ID NO: 1019987 - DNA, 23 bp, Homo sapiens
gggattttttccctttttatgtg

SEQ ID NO: 1019988 - DNA, 14 bp, Homo sapiens
gggcaaacaggcag

SEQ ID NO: 1019989 - DNA, 15 bp, Homo sapiens
gggcaaacaggcagt

SEQ ID NO: 1019990 - DNA, 16 bp, Homo sapiens
gggcaaatgccagggc

SEQ ID NO: 1019991 - DNA, 17 bp, Homo sapiens
gggcaaatgccagggcc

SEQ ID NO: 1019992 - DNA, 15 bp, Homo sapiens
gggcaaatggctgag

SEQ ID NO: 1019993 - DNA, 18 bp, Homo sapiens
gggcaaccaactgcccca

SEQ ID NO: 1019994 - DNA, 21 bp, Homo sapiens
gggcaaccaactgccccaggg

SEQ ID NO: 1019995 - DNA, 14 bp, Homo sapiens
gggcaacgaagaaa

SEQ ID NO: 1019996 - DNA, 15 bp, Homo sapiens
gggcaacgaagaaaa

SEQ ID NO: 1019997 - DNA, 13 bp, Homo sapiens
gggcaagaggaat

SEQ ID NO: 1019998 - DNA, 12 bp, Homo sapiens
gggcaagaggga

SEQ ID NO: 1019999 - DNA, 17 bp, Homo sapiens
gggcaagagggggacct

SEQ ID NO: 1020000 - DNA, 17 bp, Homo sapiens
gggcaagccagggccca

SEQ ID NO: 1020001 - DNA, 22 bp, Homo sapiens
gggcaagccagggcccagagcc

SEQ ID NO: 1020002 - DNA, 21 bp, Homo sapiens
gggcaagcctaagggatcctg

SEQ ID NO: 1020003 - DNA, 13 bp, Homo sapiens
gggcaagggccat

SEQ ID NO: 1020004 - DNA, 23 bp, Homo sapiens
gggcaagggctcctatctttcct

SEQ ID NO: 1020005 - DNA, 16 bp, Homo sapiens
gggcaagggtgcctca

SEQ ID NO: 1020006 - DNA, 17 bp, Homo sapiens
gggcaagtagcaggact

SEQ ID NO: 1020007 - DNA, 22 bp, Homo sapiens
gggcaagtcatcctcctggtgc

SEQ ID NO: 1020008 - DNA, 18 bp, Homo sapiens
gggcaagtgagaggggag

SEQ ID NO: 1020009 - DNA, 21 bp, Homo sapiens
gggcaagtgagaggggaggga

SEQ ID NO: 1020010 - DNA, 22 bp, Homo sapiens
gggcaagtgagaggggagggag

SEQ ID NO: 1020011 - DNA, 23 bp, Homo sapiens
gggcaatgccatcagcccctggg

SEQ ID NO: 1020012 - DNA, 15 bp, Homo sapiens
gggcacacagactgg

SEQ ID NO: 1020013 - DNA, 14 bp, Homo sapiens
gggcacaccactgc

SEQ ID NO: 1020014 - DNA, 18 bp, Homo sapiens
gggcacaccactgccctg

SEQ ID NO: 1020015 - DNA, 13 bp, Homo sapiens
gggcacagattga

SEQ ID NO: 1020016 - DNA, 13 bp, Homo sapiens
gggcacagcaggg

SEQ ID NO: 1020017 - DNA, 13 bp, Homo sapiens
gggcacagccagc

SEQ ID NO: 1020018 - DNA, 17 bp, Homo sapiens
gggcacagccagcccaa

SEQ ID NO: 1020019 - DNA, 12 bp, Homo sapiens
gggcacattgcc

SEQ ID NO: 1020020 - DNA, 22 bp, Homo sapiens
gggcaccacaaaatatacaaaa

SEQ ID NO: 1020021 - DNA, 16 bp, Homo sapiens
gggcacccacctccac

SEQ ID NO: 1020022 - DNA, 18 bp, Homo sapiens
gggcaccgtgtcctcctc

SEQ ID NO: 1020023 - DNA, 13 bp, Homo sapiens
gggcacctcagaa

SEQ ID NO: 1020024 - DNA, 23 bp, Homo sapiens
gggcacctccggctgcctagccc

SEQ ID NO: 1020025 - DNA, 19 bp, Homo sapiens
gggcacctgcgcacaggtg

SEQ ID NO: 1020026 - DNA, 20 bp, Homo sapiens
gggcacgccctcctcagcga

SEQ ID NO: 1020027 - DNA, 13 bp, Homo sapiens
gggcacggcaggc

SEQ ID NO: 1020028 - DNA, 23 bp, Homo sapiens
gggcacggcgggatcctccacag

SEQ ID NO: 1020029 - DNA, 22 bp, Homo sapiens
gggcacgtcgcccgctgagctg

SEQ ID NO: 1020030 - DNA, 22 bp, Homo sapiens
gggcactccgcgccgatgccac

SEQ ID NO: 1020031 - DNA, 17 bp, Homo sapiens
gggcactggagctggga

SEQ ID NO: 1020032 - DNA, 14 bp, Homo sapiens
gggcactggcccag

SEQ ID NO: 1020033 - DNA, 12 bp, Homo sapiens
gggcactgggcg

SEQ ID NO: 1020034 - DNA, 22 bp, Homo sapiens
gggcactgggtacccaagtgaa

SEQ ID NO: 1020035 - DNA, 16 bp, Homo sapiens
gggcactggtggcccg

SEQ ID NO: 1020036 - DNA, 17 bp, Homo sapiens
gggcacttaatttgtaa

SEQ ID NO: 1020037 - DNA, 20 bp, Homo sapiens
gggcacttaatttgtaaact

SEQ ID NO: 1020038 - DNA, 14 bp, Homo sapiens
gggcacttcaggtc

SEQ ID NO: 1020039 - DNA, 20 bp, Homo sapiens
gggcacttcaggtccgtggg

SEQ ID NO: 1020040 - DNA, 19 bp, Homo sapiens
gggcacttcctccacagtc

SEQ ID NO: 1020041 - DNA, 22 bp, Homo sapiens
gggcagaagactagaggccagg

SEQ ID NO: 1020042 - DNA, 14 bp, Homo sapiens
gggcagagccagga

SEQ ID NO: 1020043 - DNA, 15 bp, Homo sapiens
gggcagagccatggg

SEQ ID NO: 1020044 - DNA, 16 bp, Homo sapiens
gggcagagccatgggc

SEQ ID NO: 1020045 - DNA, 20 bp, Homo sapiens
gggcagagccatgggcctgg

SEQ ID NO: 1020046 - DNA, 13 bp, Homo sapiens
tgccctgggccag

SEQ ID NO: 1020047 - DNA, 14 bp, Homo sapiens
tgccctgggccagg

SEQ ID NO: 1020048 - DNA, 17 bp, Homo sapiens
tgccctgggccaggcag

SEQ ID NO: 1020049 - DNA, 15 bp, Homo sapiens
tgccctggggagaaa

SEQ ID NO: 1020050 - DNA, 18 bp, Homo sapiens
tgccctggtccagggaag

SEQ ID NO: 1020051 - DNA, 12 bp, Homo sapiens
tgccctggtgct

SEQ ID NO: 1020052 - DNA, 16 bp, Homo sapiens
tgccctggtgctgcca

SEQ ID NO: 1020053 - DNA, 17 bp, Homo sapiens
tgccctggtgctgccac

SEQ ID NO: 1020054 - DNA, 18 bp, Homo sapiens
tgccctggtgctgccaca

SEQ ID NO: 1020055 - DNA, 13 bp, Homo sapiens
tgccctggtggag

SEQ ID NO: 1020056 - DNA, 17 bp, Homo sapiens
tgccctgtaacttatct

SEQ ID NO: 1020057 - DNA, 18 bp, Homo sapiens
tgccctgtccctgtcccc

SEQ ID NO: 1020058 - DNA, 12 bp, Homo sapiens
tgccctgtgccg

SEQ ID NO: 1020059 - DNA, 15 bp, Homo sapiens
tgccctgtgtacttc

SEQ ID NO: 1020060 - DNA, 20 bp, Homo sapiens
tgccctgtgtacttcccggg

SEQ ID NO: 1020061 - DNA, 15 bp, Homo sapiens
tgcccttcactgtca

SEQ ID NO: 1020062 - DNA, 16 bp, Homo sapiens
tgcccttccctgtccc

SEQ ID NO: 1020063 - DNA, 17 bp, Homo sapiens
tgcccttccctgtccct

SEQ ID NO: 1020064 - DNA, 14 bp, Homo sapiens
tgcccttctcctta

SEQ ID NO: 1020065 - DNA, 14 bp, Homo sapiens
tgcccttctctgcc

SEQ ID NO: 1020066 - DNA, 18 bp, Homo sapiens
tgcccttgaaccccctcc

SEQ ID NO: 1020067 - DNA, 14 bp, Homo sapiens
tgcccttgccctga

SEQ ID NO: 1020068 - DNA, 17 bp, Homo sapiens
tgcccttgccctgacct

SEQ ID NO: 1020069 - DNA, 18 bp, Homo sapiens
tgcccttgccctgacctc

SEQ ID NO: 1020070 - DNA, 14 bp, Homo sapiens
tgcccttgcccttg

SEQ ID NO: 1020071 - DNA, 11 bp, Homo sapiens
tgcccttgggg

SEQ ID NO: 1020072 - DNA, 15 bp, Homo sapiens
tgccctttagggctg

SEQ ID NO: 1020073 - DNA, 14 bp, Homo sapiens
tgccctttcctagg

SEQ ID NO: 1020074 - DNA, 22 bp, Homo sapiens
tgccctttcctaggcccaggcc

SEQ ID NO: 1020075 - DNA, 16 bp, Homo sapiens
tgccctttggccaaca

SEQ ID NO: 1020076 - DNA, 19 bp, Homo sapiens
tgccgaatgtgcaggtttg

SEQ ID NO: 1020077 - DNA, 15 bp, Homo sapiens
tgccgacatcagcat

SEQ ID NO: 1020078 - DNA, 17 bp, Homo sapiens
tgccgacctcgtcctcc

SEQ ID NO: 1020079 - DNA, 13 bp, Homo sapiens
tgccgagagaggc

SEQ ID NO: 1020080 - DNA, 23 bp, Homo sapiens
tgccgagagaggcgcgtctgccc

SEQ ID NO: 1020081 - DNA, 21 bp, Homo sapiens
tgccgatatactctagatgaa

SEQ ID NO: 1020082 - DNA, 18 bp, Homo sapiens
tgccgatttctgtaaact

SEQ ID NO: 1020083 - DNA, 15 bp, Homo sapiens
tgccgcaaattgtac

SEQ ID NO: 1020084 - DNA, 17 bp, Homo sapiens
tgccgcaatacaggaac

SEQ ID NO: 1020085 - DNA, 15 bp, Homo sapiens
tgccgcaccccagag

SEQ ID NO: 1020086 - DNA, 18 bp, Homo sapiens
tgccgcaccccagagtgt

SEQ ID NO: 1020087 - DNA, 14 bp, Homo sapiens
tgccgcactctggc

SEQ ID NO: 1020088 - DNA, 15 bp, Homo sapiens
tgccgcactctggcg

SEQ ID NO: 1020089 - DNA, 21 bp, Homo sapiens
tgccgcagcggtgggaaggaa

SEQ ID NO: 1020090 - DNA, 16 bp, Homo sapiens
tgccgcctcaatgtgg

SEQ ID NO: 1020091 - DNA, 20 bp, Homo sapiens
tgccgcgtcgccctcccagg

SEQ ID NO: 1020092 - DNA, 12 bp, Homo sapiens
tgccgctcccct

SEQ ID NO: 1020093 - DNA, 13 bp, Homo sapiens
tgccgctcccctt

SEQ ID NO: 1020094 - DNA, 16 bp, Homo sapiens
tgccgctcctgcttcc

SEQ ID NO: 1020095 - DNA, 20 bp, Homo sapiens
tgccgctcctgcttcccctc

SEQ ID NO: 1020096 - DNA, 12 bp, Homo sapiens
tgccgctgcacc

SEQ ID NO: 1020097 - DNA, 14 bp, Homo sapiens
tgccgctgcaccac

SEQ ID NO: 1020098 - DNA, 17 bp, Homo sapiens
tgccgctgcaccacggc

SEQ ID NO: 1020099 - DNA, 16 bp, Homo sapiens
tgccgctgcacctgcc

SEQ ID NO: 1020100 - DNA, 17 bp, Homo sapiens
tgccgctgcacctgcct

SEQ ID NO: 1020101 - DNA, 17 bp, Homo sapiens
tgccgctgcaggaaaca

SEQ ID NO: 1020102 - DNA, 18 bp, Homo sapiens
tgccggatacaaactggt

SEQ ID NO: 1020103 - DNA, 20 bp, Homo sapiens
tgccggcggcagccccactt

SEQ ID NO: 1020104 - DNA, 20 bp, Homo sapiens
tgccggctctttccttgctc

SEQ ID NO: 1020105 - DNA, 16 bp, Homo sapiens
tgccggctgtggagca

SEQ ID NO: 1020106 - DNA, 15 bp, Homo sapiens
tgccgggcgccagga

SEQ ID NO: 1020107 - DNA, 15 bp, Homo sapiens
tgccggtcacactct

SEQ ID NO: 1020108 - DNA, 13 bp, Homo sapiens
gggcagggcccct

SEQ ID NO: 1020109 - DNA, 11 bp, Homo sapiens
gggcagggctg

SEQ ID NO: 1020110 - DNA, 12 bp, Homo sapiens
gggcaggggcct

SEQ ID NO: 1020111 - DNA, 17 bp, Homo sapiens
gggcaggggcctgggcc

SEQ ID NO: 1020112 - DNA, 15 bp, Homo sapiens
gggcagggtctgggc

SEQ ID NO: 1020113 - DNA, 18 bp, Homo sapiens
gggcagggtgggcagcct

SEQ ID NO: 1020114 - DNA, 13 bp, Homo sapiens
gggcagggtgggg

SEQ ID NO: 1020115 - DNA, 22 bp, Homo sapiens
gggcaggtcctagtcgggcagg

SEQ ID NO: 1020116 - DNA, 15 bp, Homo sapiens
gggcaggtggccgcc

SEQ ID NO: 1020117 - DNA, 13 bp, Homo sapiens
gggcaggtgggag

SEQ ID NO: 1020118 - DNA, 17 bp, Homo sapiens
gggcaggtgggagctga

SEQ ID NO: 1020119 - DNA, 14 bp, Homo sapiens
gggcaggttcctgg

SEQ ID NO: 1020120 - DNA, 15 bp, Homo sapiens
gggcaggttcctggg

SEQ ID NO: 1020121 - DNA, 19 bp, Homo sapiens
gggcaggttcctggggccg

SEQ ID NO: 1020122 - DNA, 22 bp, Homo sapiens
gggcaggttcctggggccgcct

SEQ ID NO: 1020123 - DNA, 17 bp, Homo sapiens
gggcaggttggtggggg

SEQ ID NO: 1020124 - DNA, 14 bp, Homo sapiens
gggcagtacctggg

SEQ ID NO: 1020125 - DNA, 17 bp, Homo sapiens
gggcagtcaccacccag

SEQ ID NO: 1020126 - DNA, 16 bp, Homo sapiens
gggcagtctgctctgc

SEQ ID NO: 1020127 - DNA, 18 bp, Homo sapiens
gggcagtctgctctgctg

SEQ ID NO: 1020128 - DNA, 12 bp, Homo sapiens
gggcagtgactg

SEQ ID NO: 1020129 - DNA, 18 bp, Homo sapiens
gggcagtgactggcaggt

SEQ ID NO: 1020130 - DNA, 20 bp, Homo sapiens
gggcagtgagtgccatgctt

SEQ ID NO: 1020131 - DNA, 20 bp, Homo sapiens
gggcagtgccacagcctgct

SEQ ID NO: 1020132 - DNA, 17 bp, Homo sapiens
gggcagtggccaagcct

SEQ ID NO: 1020133 - DNA, 15 bp, Homo sapiens
gggcagtggcttctt

SEQ ID NO: 1020134 - DNA, 16 bp, Homo sapiens
gggcagtgtgaggacc

SEQ ID NO: 1020135 - DNA, 16 bp, Homo sapiens
gggcagttagagcagc

SEQ ID NO: 1020136 - DNA, 13 bp, Homo sapiens
gggcagttctccc

SEQ ID NO: 1020137 - DNA, 15 bp, Homo sapiens
gggcagttctcccag

SEQ ID NO: 1020138 - DNA, 16 bp, Homo sapiens
gggcagttctcccagg

SEQ ID NO: 1020139 - DNA, 22 bp, Homo sapiens
gggcagttctcccagggagtga

SEQ ID NO: 1020140 - DNA, 23 bp, Homo sapiens
gggcagttctcccagggagtgag

SEQ ID NO: 1020141 - DNA, 18 bp, Homo sapiens
gggcataccttgtgcatt

SEQ ID NO: 1020142 - DNA, 21 bp, Homo sapiens
gggcatcaggcactggtggca

SEQ ID NO: 1020143 - DNA, 20 bp, Homo sapiens
gggcatcagggcctttctcc

SEQ ID NO: 1020144 - DNA, 17 bp, Homo sapiens
gggcatcctggatgatt

SEQ ID NO: 1020145 - DNA, 13 bp, Homo sapiens
gggcatctcttcc

SEQ ID NO: 1020146 - DNA, 17 bp, Homo sapiens
gggcatctcttccccag

SEQ ID NO: 1020147 - DNA, 22 bp, Homo sapiens
gggcatctgagtccagctcccc

SEQ ID NO: 1020148 - DNA, 17 bp, Homo sapiens
gggcatctgcccctccc

SEQ ID NO: 1020149 - DNA, 19 bp, Homo sapiens
gggcatctgcccctccccc

SEQ ID NO: 1020150 - DNA, 17 bp, Homo sapiens
gggcatgcacacggctg

SEQ ID NO: 1020151 - DNA, 14 bp, Homo sapiens
gggcatgccaccct

SEQ ID NO: 1020152 - DNA, 18 bp, Homo sapiens
gggcatggacagggccag

SEQ ID NO: 1020153 - DNA, 23 bp, Homo sapiens
gggcatggacagggccagggttg

SEQ ID NO: 1020154 - DNA, 16 bp, Homo sapiens
gggcatggcaggctgg

SEQ ID NO: 1020155 - DNA, 17 bp, Homo sapiens
gggcatggccaggtggc

SEQ ID NO: 1020156 - DNA, 20 bp, Homo sapiens
gggcatggccaggtggccac

SEQ ID NO: 1020157 - DNA, 21 bp, Homo sapiens
gggcatggccgcttctagagc

SEQ ID NO: 1020158 - DNA, 13 bp, Homo sapiens
gggcatgggcctc

SEQ ID NO: 1020159 - DNA, 16 bp, Homo sapiens
gggcatgggcctctct

SEQ ID NO: 1020160 - DNA, 18 bp, Homo sapiens
gggcatgggcctctctgg

SEQ ID NO: 1020161 - DNA, 19 bp, Homo sapiens
gggcatgggcctctctggg

SEQ ID NO: 1020162 - DNA, 21 bp, Homo sapiens
gggcatggtggctcatgcctg

SEQ ID NO: 1020163 - DNA, 22 bp, Homo sapiens
gggcatgtattggcctggaggt

SEQ ID NO: 1020164 - DNA, 15 bp, Homo sapiens
gggcatgtgtgcctg

SEQ ID NO: 1020165 - DNA, 22 bp, Homo sapiens
gggcatgtgtgcctgtggcaga

SEQ ID NO: 1020166 - DNA, 14 bp, Homo sapiens
gggcattgctttcc

SEQ ID NO: 1020167 - DNA, 17 bp, Homo sapiens
gggcattttcctcctct

SEQ ID NO: 1020168 - DNA, 20 bp, Homo sapiens
gggcattttcctcctctgcc

SEQ ID NO: 1020169 - DNA, 19 bp, Homo sapiens
gggcccctcccctcagagc

SEQ ID NO: 1020170 - DNA, 21 bp, Homo sapiens
gggcccctcccctcagagccc

SEQ ID NO: 1020171 - DNA, 18 bp, Homo sapiens
gggcccctccctctgccc

SEQ ID NO: 1020172 - DNA, 15 bp, Homo sapiens
gggcccctctgccca

SEQ ID NO: 1020173 - DNA, 16 bp, Homo sapiens
gggcccctctgcccag

SEQ ID NO: 1020174 - DNA, 23 bp, Homo sapiens
gggcccctctgcccagcttgggc

SEQ ID NO: 1020175 - DNA, 18 bp, Homo sapiens
gggcccctggcccagagt

SEQ ID NO: 1020176 - DNA, 12 bp, Homo sapiens
gggcccctggga

SEQ ID NO: 1020177 - DNA, 14 bp, Homo sapiens
gggcccctgggctt

SEQ ID NO: 1020178 - DNA, 21 bp, Homo sapiens
gggcccctgggcttggcctgc

SEQ ID NO: 1020179 - DNA, 16 bp, Homo sapiens
gggcccctggggacag

SEQ ID NO: 1020180 - DNA, 16 bp, Homo sapiens
gggccccttgctgatg

SEQ ID NO: 1020181 - DNA, 22 bp, Homo sapiens
gggccccttgctgatgctcctc

SEQ ID NO: 1020182 - DNA, 18 bp, Homo sapiens
gggcccctttttactccc

SEQ ID NO: 1020183 - DNA, 20 bp, Homo sapiens
gggcccgacaggtgggcctg

SEQ ID NO: 1020184 - DNA, 21 bp, Homo sapiens
gggcccgacaggtgggcctgg

SEQ ID NO: 1020185 - DNA, 20 bp, Homo sapiens
gggcccgcctggcagaactg

SEQ ID NO: 1020186 - DNA, 13 bp, Homo sapiens
gggcccgggcagg

SEQ ID NO: 1020187 - DNA, 14 bp, Homo sapiens
gggcccgggccccc

SEQ ID NO: 1020188 - DNA, 21 bp, Homo sapiens
gggcccgggttgggtcaccag

SEQ ID NO: 1020189 - DNA, 13 bp, Homo sapiens
gggccctcaggcc

SEQ ID NO: 1020190 - DNA, 14 bp, Homo sapiens
gggccctcaggcca

SEQ ID NO: 1020191 - DNA, 19 bp, Homo sapiens
gggccctcaggccattccc

SEQ ID NO: 1020192 - DNA, 21 bp, Homo sapiens
gggccctccgaccacttccag

SEQ ID NO: 1020193 - DNA, 12 bp, Homo sapiens
gggccctcctga

SEQ ID NO: 1020194 - DNA, 23 bp, Homo sapiens
gggccctccttccctcctgtgcc

SEQ ID NO: 1020195 - DNA, 18 bp, Homo sapiens
gggccctcttgccagcct

SEQ ID NO: 1020196 - DNA, 13 bp, Homo sapiens
gggccctgagctc

SEQ ID NO: 1020197 - DNA, 22 bp, Homo sapiens
gggccctgcaggctgcaggagg

SEQ ID NO: 1020198 - DNA, 11 bp, Homo sapiens
gggccctgccc

SEQ ID NO: 1020199 - DNA, 19 bp, Homo sapiens
gggccctgccccaccccat

SEQ ID NO: 1020200 - DNA, 21 bp, Homo sapiens
gggccctgccccaccccatcc

SEQ ID NO: 1020201 - DNA, 15 bp, Homo sapiens
gggccctgccccagg

SEQ ID NO: 1020202 - DNA, 12 bp, Homo sapiens
gggccctgcccg

SEQ ID NO: 1020203 - DNA, 23 bp, Homo sapiens
gggccctgcccggggagctgcag

SEQ ID NO: 1020204 - DNA, 13 bp, Homo sapiens
gggccctgccctg

SEQ ID NO: 1020205 - DNA, 15 bp, Homo sapiens
gggccctgccctgta

SEQ ID NO: 1020206 - DNA, 12 bp, Homo sapiens
gggccctggagg

SEQ ID NO: 1020207 - DNA, 17 bp, Homo sapiens
gggccctgggcctcagt

SEQ ID NO: 1020208 - DNA, 19 bp, Homo sapiens
gggccctggtccttccagg

SEQ ID NO: 1020209 - DNA, 18 bp, Homo sapiens
gggccctgtggagtccag

SEQ ID NO: 1020210 - DNA, 19 bp, Homo sapiens
gggcccttcttgctgccct

SEQ ID NO: 1020211 - DNA, 19 bp, Homo sapiens
gggcccttggccccagagg

SEQ ID NO: 1020212 - DNA, 21 bp, Homo sapiens
gggcccttggccccagaggac

SEQ ID NO: 1020213 - DNA, 19 bp, Homo sapiens
gggcccttggggcctggct

SEQ ID NO: 1020214 - DNA, 18 bp, Homo sapiens
gggccgcaagggcctgga

SEQ ID NO: 1020215 - DNA, 19 bp, Homo sapiens
gggccgcaagggcctggac

SEQ ID NO: 1020216 - DNA, 13 bp, Homo sapiens
gggccgcagggcc

SEQ ID NO: 1020217 - DNA, 21 bp, Homo sapiens
gggccgcccccacctgcggcc

SEQ ID NO: 1020218 - DNA, 20 bp, Homo sapiens
gggccgcccgctcccttcct

SEQ ID NO: 1020219 - DNA, 21 bp, Homo sapiens
gggccgcccgctcccttcctg

SEQ ID NO: 1020220 - DNA, 13 bp, Homo sapiens
gggccgctgccac

SEQ ID NO: 1020221 - DNA, 15 bp, Homo sapiens
gggccgctgccaccc

SEQ ID NO: 1020222 - DNA, 22 bp, Homo sapiens
gggccggacccccgtcagctgc

SEQ ID NO: 1020223 - DNA, 17 bp, Homo sapiens
gggccggccagtggcct

SEQ ID NO: 1020224 - DNA, 15 bp, Homo sapiens
gggccggcggctctg

SEQ ID NO: 1020225 - DNA, 16 bp, Homo sapiens
gggccggcggctctga

SEQ ID NO: 1020226 - DNA, 14 bp, Homo sapiens
gggccggctggcct

SEQ ID NO: 1020227 - DNA, 23 bp, Homo sapiens
gggccggctggcctggaggctca

SEQ ID NO: 1020228 - DNA, 15 bp, Homo sapiens
gggccgggaggcagt

SEQ ID NO: 1020229 - DNA, 20 bp, Homo sapiens
gggccggggagggggcacgg

SEQ ID NO: 1020230 - DNA, 13 bp, Homo sapiens
gggccggggctga

SEQ ID NO: 1020231 - DNA, 23 bp, Homo sapiens
gggccggggggggtaggagagga

SEQ ID NO: 1020232 - DNA, 15 bp, Homo sapiens
gggccggtgagggga

SEQ ID NO: 1020233 - DNA, 18 bp, Homo sapiens
gggccgtgcccttgccct

SEQ ID NO: 1020234 - DNA, 18 bp, Homo sapiens
gggccgtggcttgggctg

SEQ ID NO: 1020235 - DNA, 17 bp, Homo sapiens
gggcctactagagtctg

SEQ ID NO: 1020236 - DNA, 22 bp, Homo sapiens
tgccggtcatttgaatgagacc

SEQ ID NO: 1020237 - DNA, 14 bp, Homo sapiens
tgccgtaatttaac

SEQ ID NO: 1020238 - DNA, 17 bp, Homo sapiens
tgccgtcaccaccaccc

SEQ ID NO: 1020239 - DNA, 15 bp, Homo sapiens
tgccgtcctgctgga

SEQ ID NO: 1020240 - DNA, 20 bp, Homo sapiens
tgccgtctcatcttctctca

SEQ ID NO: 1020241 - DNA, 16 bp, Homo sapiens
tgccgtgcatggctcc

SEQ ID NO: 1020242 - DNA, 22 bp, Homo sapiens
tgccgtggattgcacgtggcct

SEQ ID NO: 1020243 - DNA, 16 bp, Homo sapiens
tgccgtgtgagtgtga

SEQ ID NO: 1020244 - DNA, 20 bp, Homo sapiens
tgccgtgtgagtgtgacagg

SEQ ID NO: 1020245 - DNA, 21 bp, Homo sapiens
tgccgtgtgagtgtgacaggg

SEQ ID NO: 1020246 - DNA, 22 bp, Homo sapiens
tgccgtgtgagtgtgacagggc

SEQ ID NO: 1020247 - DNA, 19 bp, Homo sapiens
tgccgttactctccaacct

SEQ ID NO: 1020248 - DNA, 22 bp, Homo sapiens
tgccgttactctccaacctgga

SEQ ID NO: 1020249 - DNA, 17 bp, Homo sapiens
tgcctaaaaattccctt

SEQ ID NO: 1020250 - DNA, 22 bp, Homo sapiens
tgcctaaaaattcccttcctgt

SEQ ID NO: 1020251 - DNA, 20 bp, Homo sapiens
tgcctaaaacaatctaaaac

SEQ ID NO: 1020252 - DNA, 16 bp, Homo sapiens
tgcctaaaattgtatg

SEQ ID NO: 1020253 - DNA, 16 bp, Homo sapiens
tgcctaaagtgctgca

SEQ ID NO: 1020254 - DNA, 20 bp, Homo sapiens
tgcctaaatttaatgctgcc

SEQ ID NO: 1020255 - DNA, 14 bp, Homo sapiens
tgcctaacttgtaa

SEQ ID NO: 1020256 - DNA, 15 bp, Homo sapiens
tgcctaacttgtaaa

SEQ ID NO: 1020257 - DNA, 17 bp, Homo sapiens
tgcctaagtggctgctg

SEQ ID NO: 1020258 - DNA, 15 bp, Homo sapiens
tgcctaatggagaag

SEQ ID NO: 1020259 - DNA, 14 bp, Homo sapiens
tgcctaattcctgg

SEQ ID NO: 1020260 - DNA, 20 bp, Homo sapiens
tgcctacaaaacctcaaacc

SEQ ID NO: 1020261 - DNA, 13 bp, Homo sapiens
tgcctacagccag

SEQ ID NO: 1020262 - DNA, 15 bp, Homo sapiens
tgcctacagccaggt

SEQ ID NO: 1020263 - DNA, 20 bp, Homo sapiens
tgcctacctaatgaggactt

SEQ ID NO: 1020264 - DNA, 18 bp, Homo sapiens
tgcctacgtgacaacaca

SEQ ID NO: 1020265 - DNA, 23 bp, Homo sapiens
tgcctacgttctctttaaaagct

SEQ ID NO: 1020266 - DNA, 19 bp, Homo sapiens
tgcctactgttactctaaa

SEQ ID NO: 1020267 - DNA, 13 bp, Homo sapiens
tgcctacttttct

SEQ ID NO: 1020268 - DNA, 17 bp, Homo sapiens
tgcctagaaatatcttt

SEQ ID NO: 1020269 - DNA, 20 bp, Homo sapiens
tgcctagattaggtagactt

SEQ ID NO: 1020270 - DNA, 21 bp, Homo sapiens
tgcctagattaggtagacttt

SEQ ID NO: 1020271 - DNA, 22 bp, Homo sapiens
tgcctagattaggtagactttg

SEQ ID NO: 1020272 - DNA, 17 bp, Homo sapiens
tgcctagggcctggtcc

SEQ ID NO: 1020273 - DNA, 18 bp, Homo sapiens
tgcctagggcctggtcca

SEQ ID NO: 1020274 - DNA, 17 bp, Homo sapiens
tgcctaggtcccttccc

SEQ ID NO: 1020275 - DNA, 20 bp, Homo sapiens
tgcctagtgggagttaggac

SEQ ID NO: 1020276 - DNA, 20 bp, Homo sapiens
tgcctataaaatgcccattt

SEQ ID NO: 1020277 - DNA, 14 bp, Homo sapiens
tgcctatttgaagt

SEQ ID NO: 1020278 - DNA, 14 bp, Homo sapiens
tgcctatttgtgtg

SEQ ID NO: 1020279 - DNA, 24 bp, Homo sapiens
tgcctcaccacacccaggtctctt

SEQ ID NO: 1020280 - DNA, 18 bp, Homo sapiens
tgcctcactaatttttgt

SEQ ID NO: 1020281 - DNA, 22 bp, Homo sapiens
tgcctcactaatttttgtatta

SEQ ID NO: 1020282 - DNA, 15 bp, Homo sapiens
tgcctcagccctgac

SEQ ID NO: 1020283 - DNA, 16 bp, Homo sapiens
tgcctcagccctgacc

SEQ ID NO: 1020284 - DNA, 14 bp, Homo sapiens
tgcctcagccttcc

SEQ ID NO: 1020285 - DNA, 15 bp, Homo sapiens
tgcctcagctaccta

SEQ ID NO: 1020286 - DNA, 10 bp, Homo sapiens
tgcctcagga

SEQ ID NO: 1020287 - DNA, 13 bp, Homo sapiens
tgcctcaggcact

SEQ ID NO: 1020288 - DNA, 21 bp, Homo sapiens
tgcctcagttttccttctgtt

SEQ ID NO: 1020289 - DNA, 14 bp, Homo sapiens
tgcctcatgccaca

SEQ ID NO: 1020290 - DNA, 20 bp, Homo sapiens
gggcctgggacacttccctg

SEQ ID NO: 1020291 - DNA, 15 bp, Homo sapiens
gggcctgggcagccc

SEQ ID NO: 1020292 - DNA, 22 bp, Homo sapiens
gggcctgggggcagtgactggc

SEQ ID NO: 1020293 - DNA, 16 bp, Homo sapiens
gggcctggtccctggg

SEQ ID NO: 1020294 - DNA, 10 bp, Homo sapiens
gggcctgtct

SEQ ID NO: 1020295 - DNA, 12 bp, Homo sapiens
gggcctgtgcag

SEQ ID NO: 1020296 - DNA, 22 bp, Homo sapiens
gggcctgtggaatgagtgtgca

SEQ ID NO: 1020297 - DNA, 17 bp, Homo sapiens
gggccttagggagcccc

SEQ ID NO: 1020298 - DNA, 21 bp, Homo sapiens
gggccttagggcactgggctg

SEQ ID NO: 1020299 - DNA, 21 bp, Homo sapiens
gggccttcgggaccctggggc

SEQ ID NO: 1020300 - DNA, 17 bp, Homo sapiens
gggccttgcccagagat

SEQ ID NO: 1020301 - DNA, 16 bp, Homo sapiens
gggccttgcggaagcc

SEQ ID NO: 1020302 - DNA, 21 bp, Homo sapiens
gggccttgctctgagcacagg

SEQ ID NO: 1020303 - DNA, 16 bp, Homo sapiens
gggccttggctgggcc

SEQ ID NO: 1020304 - DNA, 16 bp, Homo sapiens
gggcctttcagtccca

SEQ ID NO: 1020305 - DNA, 23 bp, Homo sapiens
gggcctttccagagaactgcaga

SEQ ID NO: 1020306 - DNA, 14 bp, Homo sapiens
gggccttttctgtg

SEQ ID NO: 1020307 - DNA, 20 bp, Homo sapiens
gggccttttgcccggaggcc

SEQ ID NO: 1020308 - DNA, 20 bp, Homo sapiens
gggcgagactctgtctcaaa

SEQ ID NO: 1020309 - DNA, 22 bp, Homo sapiens
gggcgatcgcggcggagctggc

SEQ ID NO: 1020310 - DNA, 17 bp, Homo sapiens
gggcgccaggacagcag

SEQ ID NO: 1020311 - DNA, 13 bp, Homo sapiens
gggcgccagggtg

SEQ ID NO: 1020312 - DNA, 22 bp, Homo sapiens
gggcgcccattcgtctgtccca

SEQ ID NO: 1020313 - DNA, 22 bp, Homo sapiens
gggcgccgcaaaccacactgga

SEQ ID NO: 1020314 - DNA, 22 bp, Homo sapiens
gggcgccgtgctgggcagcccg

SEQ ID NO: 1020315 - DNA, 17 bp, Homo sapiens
gggcgctcaggacccag

SEQ ID NO: 1020316 - DNA, 14 bp, Homo sapiens
gggcgctggcccag

SEQ ID NO: 1020317 - DNA, 15 bp, Homo sapiens
gggcgctggcccagc

SEQ ID NO: 1020318 - DNA, 17 bp, Homo sapiens
gggcgctggcccagccg

SEQ ID NO: 1020319 - DNA, 19 bp, Homo sapiens
gggcgctggcccagccggc

SEQ ID NO: 1020320 - DNA, 20 bp, Homo sapiens
gggcggacaaaagggccagg

SEQ ID NO: 1020321 - DNA, 19 bp, Homo sapiens
gggcgggcagccaggctgg

SEQ ID NO: 1020322 - DNA, 16 bp, Homo sapiens
gggcgggccagggtgg

SEQ ID NO: 1020323 - DNA, 13 bp, Homo sapiens
gggcgggctcaga

SEQ ID NO: 1020324 - DNA, 14 bp, Homo sapiens
gggcgggctcagag

SEQ ID NO: 1020325 - DNA, 22 bp, Homo sapiens
gggcgggctcagagctttgtca

SEQ ID NO: 1020326 - DNA, 16 bp, Homo sapiens
gggcggggcaggaatg

SEQ ID NO: 1020327 - DNA, 22 bp, Homo sapiens
gggcgggtacagcgcggaggag

SEQ ID NO: 1020328 - DNA, 13 bp, Homo sapiens
gggcgtcaggcag

SEQ ID NO: 1020329 - DNA, 15 bp, Homo sapiens
gggcgtcaggggtgc

SEQ ID NO: 1020330 - DNA, 21 bp, Homo sapiens
gggcgtccagctcagccctgg

SEQ ID NO: 1020331 - DNA, 15 bp, Homo sapiens
gggcgtctcccccag

SEQ ID NO: 1020332 - DNA, 17 bp, Homo sapiens
gggcgtctcccccagag

SEQ ID NO: 1020333 - DNA, 17 bp, Homo sapiens
gggcgtctgactccctc

SEQ ID NO: 1020334 - DNA, 18 bp, Homo sapiens
gggcgtctgactccctcc

SEQ ID NO: 1020335 - DNA, 21 bp, Homo sapiens
gggcgtctgactccctcccca

SEQ ID NO: 1020336 - DNA, 17 bp, Homo sapiens
gggcgtctgttccccct

SEQ ID NO: 1020337 - DNA, 15 bp, Homo sapiens
gggcgtggtggcagg

SEQ ID NO: 1020338 - DNA, 23 bp, Homo sapiens
gggctaagagctagcgctgccgc

SEQ ID NO: 1020339 - DNA, 21 bp, Homo sapiens
gggctaattctgggaagggag

SEQ ID NO: 1020340 - DNA, 22 bp, Homo sapiens
gggctaattctgggaagggaga

SEQ ID NO: 1020341 - DNA, 13 bp, Homo sapiens
gggctaatttaac

SEQ ID NO: 1020342 - DNA, 14 bp, Homo sapiens
gggctacaggatgg

SEQ ID NO: 1020343 - DNA, 20 bp, Homo sapiens
gggctaccctgagctgaggc

SEQ ID NO: 1020344 - DNA, 14 bp, Homo sapiens
gggctactggcagc

SEQ ID NO: 1020345 - DNA, 18 bp, Homo sapiens
gggctactggcagctcct

SEQ ID NO: 1020346 - DNA, 22 bp, Homo sapiens
gggctactggcagctcctctcc

SEQ ID NO: 1020347 - DNA, 13 bp, Homo sapiens
gggctagccctga

SEQ ID NO: 1020348 - DNA, 16 bp, Homo sapiens
gggctagccctgagcc

SEQ ID NO: 1020349 - DNA, 19 bp, Homo sapiens
gggctagccctgagcccgg

SEQ ID NO: 1020350 - DNA, 14 bp, Homo sapiens
gggctagggagacg

SEQ ID NO: 1020351 - DNA, 22 bp, Homo sapiens
gggctagtcttcccttacctca

SEQ ID NO: 1020352 - DNA, 17 bp, Homo sapiens
gggctagtgaagtggcc

SEQ ID NO: 1020353 - DNA, 21 bp, Homo sapiens
gggctagtgtgagtggcagcc

SEQ ID NO: 1020354 - DNA, 13 bp, Homo sapiens
gggctatggacac

SEQ ID NO: 1020355 - DNA, 20 bp, Homo sapiens
gggctcaagcaatcctcctg

SEQ ID NO: 1020356 - DNA, 19 bp, Homo sapiens
gggctcaagcagttctccc

SEQ ID NO: 1020357 - DNA, 16 bp, Homo sapiens
gggctcacactcctgg

SEQ ID NO: 1020358 - DNA, 14 bp, Homo sapiens
gggctcacagggca

SEQ ID NO: 1020359 - DNA, 16 bp, Homo sapiens
gggctcacagggcagg

SEQ ID NO: 1020360 - DNA, 18 bp, Homo sapiens
gggctcacagggcaggcc

SEQ ID NO: 1020361 - DNA, 22 bp, Homo sapiens
gggctcaccagctggggtcctg

SEQ ID NO: 1020362 - DNA, 12 bp, Homo sapiens
tgcctctgcctg

SEQ ID NO: 1020363 - DNA, 12 bp, Homo sapiens
tgcctctgctcc

SEQ ID NO: 1020364 - DNA, 13 bp, Homo sapiens
tgcctctgctccc

SEQ ID NO: 1020365 - DNA, 18 bp, Homo sapiens
tgcctctggaaaactatt

SEQ ID NO: 1020366 - DNA, 16 bp, Homo sapiens
tgcctctgggcagcct

SEQ ID NO: 1020367 - DNA, 19 bp, Homo sapiens
tgcctctgggcagcctgct

SEQ ID NO: 1020368 - DNA, 13 bp, Homo sapiens
tgcctctgggcca

SEQ ID NO: 1020369 - DNA, 12 bp, Homo sapiens
tgcctctgtcca

SEQ ID NO: 1020370 - DNA, 13 bp, Homo sapiens
tgcctctgtgctg

SEQ ID NO: 1020371 - DNA, 16 bp, Homo sapiens
tgcctctgtgctgtgt

SEQ ID NO: 1020372 - DNA, 14 bp, Homo sapiens
tgcctcttcattct

SEQ ID NO: 1020373 - DNA, 21 bp, Homo sapiens
tgcctcttccagtcttcctga

SEQ ID NO: 1020374 - DNA, 23 bp, Homo sapiens
tgcctcttccagtcttcctgaca

SEQ ID NO: 1020375 - DNA, 21 bp, Homo sapiens
tgcctcttctctactctaggg

SEQ ID NO: 1020376 - DNA, 21 bp, Homo sapiens
tgcctcttctgggagggcagc

SEQ ID NO: 1020377 - DNA, 16 bp, Homo sapiens
tgcctcttctgtgggt

SEQ ID NO: 1020378 - DNA, 12 bp, Homo sapiens
tgcctcttggct

SEQ ID NO: 1020379 - DNA, 17 bp, Homo sapiens
tgcctcttggcttctca

SEQ ID NO: 1020380 - DNA, 18 bp, Homo sapiens
tgcctcttggcttctcag

SEQ ID NO: 1020381 - DNA, 23 bp, Homo sapiens
tgcctcttggcttctcagcccct

SEQ ID NO: 1020382 - DNA, 15 bp, Homo sapiens
tgcctcttgttgcag

SEQ ID NO: 1020383 - DNA, 17 bp, Homo sapiens
tgcctcttgttgcagag

SEQ ID NO: 1020384 - DNA, 16 bp, Homo sapiens
tgcctctttcatccac

SEQ ID NO: 1020385 - DNA, 13 bp, Homo sapiens
tgcctctttgaag

SEQ ID NO: 1020386 - DNA, 21 bp, Homo sapiens
tgcctgaacatccttccttcc

SEQ ID NO: 1020387 - DNA, 22 bp, Homo sapiens
tgcctgaacatccttccttccc

SEQ ID NO: 1020388 - DNA, 21 bp, Homo sapiens
tgcctgaagcttcggccgcgc

SEQ ID NO: 1020389 - DNA, 12 bp, Homo sapiens
tgcctgaataaa

SEQ ID NO: 1020390 - DNA, 17 bp, Homo sapiens
tgcctgacactgagccc

SEQ ID NO: 1020391 - DNA, 15 bp, Homo sapiens
tgcctgacagccttc

SEQ ID NO: 1020392 - DNA, 17 bp, Homo sapiens
tgcctgacccatccctt

SEQ ID NO: 1020393 - DNA, 19 bp, Homo sapiens
tgcctgacccatccctttt

SEQ ID NO: 1020394 - DNA, 21 bp, Homo sapiens
tgcctgaccccttgctccctt

SEQ ID NO: 1020395 - DNA, 23 bp, Homo sapiens
tgcctgaccctacttcttttgct

SEQ ID NO: 1020396 - DNA, 15 bp, Homo sapiens
tgcctgagaggcagg

SEQ ID NO: 1020397 - DNA, 15 bp, Homo sapiens
tgcctgagcccagga

SEQ ID NO: 1020398 - DNA, 18 bp, Homo sapiens
tgcctgagcccaggagct

SEQ ID NO: 1020399 - DNA, 19 bp, Homo sapiens
tgcctgaggaggaggacac

SEQ ID NO: 1020400 - DNA, 21 bp, Homo sapiens
tgcctgaggaggaggacacag

SEQ ID NO: 1020401 - DNA, 14 bp, Homo sapiens
tgcctgaggctgta

SEQ ID NO: 1020402 - DNA, 14 bp, Homo sapiens
tgcctgagggcccc

SEQ ID NO: 1020403 - DNA, 23 bp, Homo sapiens
tgcctgagggcccctctgcccag

SEQ ID NO: 1020404 - DNA, 11 bp, Homo sapiens
tgcctgagggt

SEQ ID NO: 1020405 - DNA, 18 bp, Homo sapiens
tgcctgagggtggagact

SEQ ID NO: 1020406 - DNA, 18 bp, Homo sapiens
tgcctgaggtctgtacgt

SEQ ID NO: 1020407 - DNA, 19 bp, Homo sapiens
tgcctgagtcacccatgaa

SEQ ID NO: 1020408 - DNA, 15 bp, Homo sapiens
tgcctgatccctgaa

SEQ ID NO: 1020409 - DNA, 16 bp, Homo sapiens
tgcctgatccctgaac

SEQ ID NO: 1020410 - DNA, 16 bp, Homo sapiens
tgcctgcactccctgg

SEQ ID NO: 1020411 - DNA, 17 bp, Homo sapiens
tgcctgcactccctggc

SEQ ID NO: 1020412 - DNA, 18 bp, Homo sapiens
gggctctggacctcagga

SEQ ID NO: 1020413 - DNA, 19 bp, Homo sapiens
gggctctggccaccctggc

SEQ ID NO: 1020414 - DNA, 15 bp, Homo sapiens
gggctctgggcggcc

SEQ ID NO: 1020415 - DNA, 19 bp, Homo sapiens
gggctctgtctacccagtg

SEQ ID NO: 1020416 - DNA, 13 bp, Homo sapiens
gggctcttcccct

SEQ ID NO: 1020417 - DNA, 16 bp, Homo sapiens
gggctgaacatgcctg

SEQ ID NO: 1020418 - DNA, 20 bp, Homo sapiens
gggctgactagaagggccag

SEQ ID NO: 1020419 - DNA, 23 bp, Homo sapiens
gggctgagcccctaccccacacc

SEQ ID NO: 1020420 - DNA, 14 bp, Homo sapiens
gggctgagcccctg

SEQ ID NO: 1020421 - DNA, 17 bp, Homo sapiens
gggctgagccctggcag

SEQ ID NO: 1020422 - DNA, 14 bp, Homo sapiens
gggctgagcgtgga

SEQ ID NO: 1020423 - DNA, 17 bp, Homo sapiens
gggctgagcgtggaagg

SEQ ID NO: 1020424 - DNA, 16 bp, Homo sapiens
gggctgagctgcctgt

SEQ ID NO: 1020425 - DNA, 23 bp, Homo sapiens
gggctgagctggggacctggtac

SEQ ID NO: 1020426 - DNA, 12 bp, Homo sapiens
gggctgaggagc

SEQ ID NO: 1020427 - DNA, 12 bp, Homo sapiens
gggctgagggag

SEQ ID NO: 1020428 - DNA, 14 bp, Homo sapiens
gggctgagggagcc

SEQ ID NO: 1020429 - DNA, 14 bp, Homo sapiens
gggctgagggcctg

SEQ ID NO: 1020430 - DNA, 12 bp, Homo sapiens
gggctgaggggc

SEQ ID NO: 1020431 - DNA, 21 bp, Homo sapiens
gggctgaggggcctgcgccca

SEQ ID NO: 1020432 - DNA, 16 bp, Homo sapiens
gggctgaggtgggagg

SEQ ID NO: 1020433 - DNA, 16 bp, Homo sapiens
gggctgatggcctggc

SEQ ID NO: 1020434 - DNA, 22 bp, Homo sapiens
gggctgcagcatgttgctgagg

SEQ ID NO: 1020435 - DNA, 18 bp, Homo sapiens
gggctgcagcccgccttg

SEQ ID NO: 1020436 - DNA, 13 bp, Homo sapiens
gggctgcaggcag

SEQ ID NO: 1020437 - DNA, 14 bp, Homo sapiens
gggctgcaggcagg

SEQ ID NO: 1020438 - DNA, 21 bp, Homo sapiens
gggctgcaggcaggcggctcc

SEQ ID NO: 1020439 - DNA, 23 bp, Homo sapiens
gggctgcaggcaggcggctcctc

SEQ ID NO: 1020440 - DNA, 11 bp, Homo sapiens
gggctgcaggt

SEQ ID NO: 1020441 - DNA, 11 bp, Homo sapiens
gggctgcatga

SEQ ID NO: 1020442 - DNA, 14 bp, Homo sapiens
gggctgccagcctg

SEQ ID NO: 1020443 - DNA, 15 bp, Homo sapiens
gggctgccagcctga

SEQ ID NO: 1020444 - DNA, 23 bp, Homo sapiens
gggctgccagcctgagcggaggc

SEQ ID NO: 1020445 - DNA, 21 bp, Homo sapiens
gggctgccatagggtctgcag

SEQ ID NO: 1020446 - DNA, 18 bp, Homo sapiens
gggctgccatgtgaagag

SEQ ID NO: 1020447 - DNA, 13 bp, Homo sapiens
gggctgccctgag

SEQ ID NO: 1020448 - DNA, 21 bp, Homo sapiens
gggctgccctggtgctgccac

SEQ ID NO: 1020449 - DNA, 16 bp, Homo sapiens
gggctgcctgcccctg

SEQ ID NO: 1020450 - DNA, 20 bp, Homo sapiens
gggctgcctgcccctgctgc

SEQ ID NO: 1020451 - DNA, 14 bp, Homo sapiens
gggctgcctgggct

SEQ ID NO: 1020452 - DNA, 21 bp, Homo sapiens
gggctgcctgggctgttggca

SEQ ID NO: 1020453 - DNA, 15 bp, Homo sapiens
gggctgcgctagcag

SEQ ID NO: 1020454 - DNA, 20 bp, Homo sapiens
gggctgctcacccacctctt

SEQ ID NO: 1020455 - DNA, 16 bp, Homo sapiens
gggctgctcctccagg

SEQ ID NO: 1020456 - DNA, 13 bp, Homo sapiens
gggctgctgcttc

SEQ ID NO: 1020457 - DNA, 11 bp, Homo sapiens
gggctgctggg

SEQ ID NO: 1020458 - DNA, 19 bp, Homo sapiens
gggctggaatgggagacct

SEQ ID NO: 1020459 - DNA, 20 bp, Homo sapiens
gggctggaatgggagacctg

SEQ ID NO: 1020460 - DNA, 19 bp, Homo sapiens
gggctggactggaggtggg

SEQ ID NO: 1020461 - DNA, 18 bp, Homo sapiens
gggctggacttctacctg

SEQ ID NO: 1020462 - DNA, 11 bp, Homo sapiens
gggctggagaa

SEQ ID NO: 1020463 - DNA, 15 bp, Homo sapiens
gggctggagcctggg

SEQ ID NO: 1020464 - DNA, 17 bp, Homo sapiens
gggctggagcctggggt

SEQ ID NO: 1020465 - DNA, 14 bp, Homo sapiens
gggctggaggccca

SEQ ID NO: 1020466 - DNA, 19 bp, Homo sapiens
gggctggaggcccaggctg

SEQ ID NO: 1020467 - DNA, 23 bp, Homo sapiens
gggctggagtgcgctcttggtcc

SEQ ID NO: 1020468 - DNA, 16 bp, Homo sapiens
gggctggatggacaga

SEQ ID NO: 1020469 - DNA, 19 bp, Homo sapiens
gggctggatggacagacac

SEQ ID NO: 1020470 - DNA, 13 bp, Homo sapiens
gggctggcccagc

SEQ ID NO: 1020471 - DNA, 16 bp, Homo sapiens
gggctggcccagccaa

SEQ ID NO: 1020472 - DNA, 11 bp, Homo sapiens
gggctggccct

SEQ ID NO: 1020473 - DNA, 12 bp, Homo sapiens
gggctggccctg

SEQ ID NO: 1020474 - DNA, 14 bp, Homo sapiens
gggctggccctgtg

SEQ ID NO: 1020475 - DNA, 13 bp, Homo sapiens
gggctggcctagg

SEQ ID NO: 1020476 - DNA, 19 bp, Homo sapiens
gggctggcctctggctctc

SEQ ID NO: 1020477 - DNA, 15 bp, Homo sapiens
gggctggccttcctg

SEQ ID NO: 1020478 - DNA, 22 bp, Homo sapiens
gggctggctccccctccccagg

SEQ ID NO: 1020479 - DNA, 17 bp, Homo sapiens
gggctggctgcttgcag

SEQ ID NO: 1020480 - DNA, 18 bp, Homo sapiens
gggctgggagaagaaata

SEQ ID NO: 1020481 - DNA, 15 bp, Homo sapiens
gggctgggcatccca

SEQ ID NO: 1020482 - DNA, 18 bp, Homo sapiens
gggctgggcatcccagct

SEQ ID NO: 1020483 - DNA, 12 bp, Homo sapiens
gggctgggccca

SEQ ID NO: 1020484 - DNA, 22 bp, Homo sapiens
gggctgggcccacagagatgca

SEQ ID NO: 1020485 - DNA, 15 bp, Homo sapiens
gggctgggcccaccc

SEQ ID NO: 1020486 - DNA, 16 bp, Homo sapiens
gggctggggactctgg

SEQ ID NO: 1020487 - DNA, 14 bp, Homo sapiens
gggctggggcaggc

SEQ ID NO: 1020488 - DNA, 15 bp, Homo sapiens
gggctggggcaggct

SEQ ID NO: 1020489 - DNA, 16 bp, Homo sapiens
gggctggggcaggctc

SEQ ID NO: 1020490 - DNA, 17 bp, Homo sapiens
gggctggggcaggggcc

SEQ ID NO: 1020491 - DNA, 19 bp, Homo sapiens
gggctgggggctgccgagc

SEQ ID NO: 1020492 - DNA, 19 bp, Homo sapiens
gggctgggggtagcctgga

SEQ ID NO: 1020493 - DNA, 18 bp, Homo sapiens
gggctggggtgagagagg

SEQ ID NO: 1020494 - DNA, 16 bp, Homo sapiens
gggctggtccttattt

SEQ ID NO: 1020495 - DNA, 20 bp, Homo sapiens
gggctggtgccagccttcct

SEQ ID NO: 1020496 - DNA, 16 bp, Homo sapiens
gggctggtgccccaca

SEQ ID NO: 1020497 - DNA, 18 bp, Homo sapiens
gggctgtagatcaggttt

SEQ ID NO: 1020498 - DNA, 21 bp, Homo sapiens
gggctgtatttatctctgagg

SEQ ID NO: 1020499 - DNA, 24 bp, Homo sapiens
gggctgtccactagaccagtgagc

SEQ ID NO: 1020500 - DNA, 15 bp, Homo sapiens
gggctgtcccagccc

SEQ ID NO: 1020501 - DNA, 16 bp, Homo sapiens
gggctgtcctccttcc

SEQ ID NO: 1020502 - DNA, 22 bp, Homo sapiens
gggctgtcctccttcctgggac

SEQ ID NO: 1020503 - DNA, 11 bp, Homo sapiens
gggctgtcctt

SEQ ID NO: 1020504 - DNA, 13 bp, Homo sapiens
gggctgtctgggt

SEQ ID NO: 1020505 - DNA, 19 bp, Homo sapiens
gggctgtgactctgggcag

SEQ ID NO: 1020506 - DNA, 12 bp, Homo sapiens
gggctgtgccaa

SEQ ID NO: 1020507 - DNA, 14 bp, Homo sapiens
gggctgtgccaacc

SEQ ID NO: 1020508 - DNA, 16 bp, Homo sapiens
gggctgtgccaacctg

SEQ ID NO: 1020509 - DNA, 11 bp, Homo sapiens
gggctgtgcta

SEQ ID NO: 1020510 - DNA, 16 bp, Homo sapiens
gggctgttgctaggga

SEQ ID NO: 1020511 - DNA, 22 bp, Homo sapiens
gggctgttgctagggagaggga

SEQ ID NO: 1020512 - DNA, 18 bp, Homo sapiens
gggctgttggaggacccc

SEQ ID NO: 1020513 - DNA, 22 bp, Homo sapiens
gggcttacctgtacactgactt

SEQ ID NO: 1020514 - DNA, 19 bp, Homo sapiens
gggcttatatctggcctct

SEQ ID NO: 1020515 - DNA, 19 bp, Homo sapiens
gggcttcagaaaaggagtg

SEQ ID NO: 1020516 - DNA, 19 bp, Homo sapiens
gggcttcctctagaagcca

SEQ ID NO: 1020517 - DNA, 14 bp, Homo sapiens
gggcttcctgccct

SEQ ID NO: 1020518 - DNA, 22 bp, Homo sapiens
gggcttcctgcccttccctctg

SEQ ID NO: 1020519 - DNA, 15 bp, Homo sapiens
gggcttcctgggtcc

SEQ ID NO: 1020520 - DNA, 16 bp, Homo sapiens
gggcttctcctgaccc

SEQ ID NO: 1020521 - DNA, 14 bp, Homo sapiens
gggcttctgcaccc

SEQ ID NO: 1020522 - DNA, 18 bp, Homo sapiens
gggcttctgcaccctcca

SEQ ID NO: 1020523 - DNA, 19 bp, Homo sapiens
gggcttctgcaccctccac

SEQ ID NO: 1020524 - DNA, 19 bp, Homo sapiens
gggcttctgtaccacacta

SEQ ID NO: 1020525 - DNA, 18 bp, Homo sapiens
gggcttctgttctctgct

SEQ ID NO: 1020526 - DNA, 13 bp, Homo sapiens
gggcttcttcctc

SEQ ID NO: 1020527 - DNA, 15 bp, Homo sapiens
gggcttgaagccaaa

SEQ ID NO: 1020528 - DNA, 19 bp, Homo sapiens
gggcttgcaagtatgtttt

SEQ ID NO: 1020529 - DNA, 16 bp, Homo sapiens
gggcttgccccactct

SEQ ID NO: 1020530 - DNA, 16 bp, Homo sapiens
gggcttggacttcctg

SEQ ID NO: 1020531 - DNA, 15 bp, Homo sapiens
gggcttggcccagcg

SEQ ID NO: 1020532 - DNA, 21 bp, Homo sapiens
gggcttggcccgcggcctgca

SEQ ID NO: 1020533 - DNA, 13 bp, Homo sapiens
gggcttggcctgc

SEQ ID NO: 1020534 - DNA, 23 bp, Homo sapiens
gggcttgttgctgttgatgtttt

SEQ ID NO: 1020535 - DNA, 17 bp, Homo sapiens
tgcctgttaatttataa

SEQ ID NO: 1020536 - DNA, 21 bp, Homo sapiens
tgcctgttaatttataatgta

SEQ ID NO: 1020537 - DNA, 13 bp, Homo sapiens
tgcctgttctgct

SEQ ID NO: 1020538 - DNA, 18 bp, Homo sapiens
tgcctgttggcaggccca

SEQ ID NO: 1020539 - DNA, 14 bp, Homo sapiens
tgcctgttgtattt

SEQ ID NO: 1020540 - DNA, 20 bp, Homo sapiens
tgccttaaaaccaaagaggg

SEQ ID NO: 1020541 - DNA, 22 bp, Homo sapiens
tgccttaaaaccaaagagggct

SEQ ID NO: 1020542 - DNA, 21 bp, Homo sapiens
tgccttaaacctgaagatgtc

SEQ ID NO: 1020543 - DNA, 23 bp, Homo sapiens
tgccttaaacctgaagatgtctc

SEQ ID NO: 1020544 - DNA, 14 bp, Homo sapiens
tgccttaagcagaa

SEQ ID NO: 1020545 - DNA, 15 bp, Homo sapiens
tgccttaagcagaac

SEQ ID NO: 1020546 - DNA, 15 bp, Homo sapiens
tgccttaataaatat

SEQ ID NO: 1020547 - DNA, 16 bp, Homo sapiens
tgccttaataaatatg

SEQ ID NO: 1020548 - DNA, 17 bp, Homo sapiens
tgccttaataaatatgt

SEQ ID NO: 1020549 - DNA, 17 bp, Homo sapiens
tgccttacatcttttct

SEQ ID NO: 1020550 - DNA, 19 bp, Homo sapiens
tgccttacatcttttctaa

SEQ ID NO: 1020551 - DNA, 16 bp, Homo sapiens
tgccttacctcctgcc

SEQ ID NO: 1020552 - DNA, 18 bp, Homo sapiens
tgccttacctcctgccca

SEQ ID NO: 1020553 - DNA, 23 bp, Homo sapiens
tgccttacctcctgcccaggaga

SEQ ID NO: 1020554 - DNA, 20 bp, Homo sapiens
tgccttactggtttccccag

SEQ ID NO: 1020555 - DNA, 21 bp, Homo sapiens
tgccttattagagtgtctttc

SEQ ID NO: 1020556 - DNA, 22 bp, Homo sapiens
tgccttatttctcattgcctct

SEQ ID NO: 1020557 - DNA, 12 bp, Homo sapiens
tgccttatttgt

SEQ ID NO: 1020558 - DNA, 20 bp, Homo sapiens
tgccttatttgtctgtaaaa

SEQ ID NO: 1020559 - DNA, 16 bp, Homo sapiens
tgccttcacaaatgtc

SEQ ID NO: 1020560 - DNA, 18 bp, Homo sapiens
tgccttcagctctacagc

SEQ ID NO: 1020561 - DNA, 18 bp, Homo sapiens
tgccttcagtcttggtaa

SEQ ID NO: 1020562 - DNA, 20 bp, Homo sapiens
tgccttcagtcttggtaaaa

SEQ ID NO: 1020563 - DNA, 13 bp, Homo sapiens
tgccttccacgct

SEQ ID NO: 1020564 - DNA, 13 bp, Homo sapiens
tgccttccctagc

SEQ ID NO: 1020565 - DNA, 17 bp, Homo sapiens
tgccttccctagcttta

SEQ ID NO: 1020566 - DNA, 13 bp, Homo sapiens
tgccttcctcatc

SEQ ID NO: 1020567 - DNA, 16 bp, Homo sapiens
tgccttcctcatcccc

SEQ ID NO: 1020568 - DNA, 17 bp, Homo sapiens
tgccttcctcatcccct

SEQ ID NO: 1020569 - DNA, 16 bp, Homo sapiens
tgccttcctcctgggc

SEQ ID NO: 1020570 - DNA, 17 bp, Homo sapiens
tgccttcctcctgggcc

SEQ ID NO: 1020571 - DNA, 17 bp, Homo sapiens
tgccttcctcgtgcaga

SEQ ID NO: 1020572 - DNA, 19 bp, Homo sapiens
tgccttcctcgtgcagagc

SEQ ID NO: 1020573 - DNA, 19 bp, Homo sapiens
tgccttcctctgaggacag

SEQ ID NO: 1020574 - DNA, 18 bp, Homo sapiens
tgccttcctttctccagg

SEQ ID NO: 1020575 - DNA, 22 bp, Homo sapiens
tgccttcctttctccaggacca

SEQ ID NO: 1020576 - DNA, 22 bp, Homo sapiens
tgccttcgcaccttgctgtgtg

SEQ ID NO: 1020577 - DNA, 19 bp, Homo sapiens
tgccttcgctccatgtttt

SEQ ID NO: 1020578 - DNA, 13 bp, Homo sapiens
tgccttcgcttct

SEQ ID NO: 1020579 - DNA, 16 bp, Homo sapiens
tgccttcgcttcttgc

SEQ ID NO: 1020580 - DNA, 21 bp, Homo sapiens
tgccttcgcttcttgcctctg

SEQ ID NO: 1020581 - DNA, 20 bp, Homo sapiens
tgccttcgttaactgtgtat

SEQ ID NO: 1020582 - DNA, 15 bp, Homo sapiens
tgccttctgggcttt

SEQ ID NO: 1020583 - DNA, 21 bp, Homo sapiens
tgccttcttattctcactcca

SEQ ID NO: 1020584 - DNA, 13 bp, Homo sapiens
tgccttcttttgt

SEQ ID NO: 1020585 - DNA, 14 bp, Homo sapiens
tgccttcttttgta

SEQ ID NO: 1020586 - DNA, 17 bp, Homo sapiens
tgccttgaaccacttcc

SEQ ID NO: 1020587 - DNA, 19 bp, Homo sapiens
tgccttgaaccacttccct

SEQ ID NO: 1020588 - DNA, 15 bp, Homo sapiens
tgccttgaataataa

SEQ ID NO: 1020589 - DNA, 16 bp, Homo sapiens
tgccttgcagaactgc

SEQ ID NO: 1020590 - DNA, 18 bp, Homo sapiens
tgccttgcccacaggtgc

SEQ ID NO: 1020591 - DNA, 15 bp, Homo sapiens
tgccttgccgctccc

SEQ ID NO: 1020592 - DNA, 18 bp, Homo sapiens
tgccttgccgctcccctt

SEQ ID NO: 1020593 - DNA, 22 bp, Homo sapiens
tgccttggccccccaaagtgct

SEQ ID NO: 1020594 - DNA, 14 bp, Homo sapiens
tgccttggcccctc

SEQ ID NO: 1020595 - DNA, 18 bp, Homo sapiens
tgccttggcccctccctc

SEQ ID NO: 1020596 - DNA, 12 bp, Homo sapiens
tgccttggcctc

SEQ ID NO: 1020597 - DNA, 18 bp, Homo sapiens
tgccttggggaatttcct

SEQ ID NO: 1020598 - DNA, 18 bp, Homo sapiens
tgccttggttctggccac

SEQ ID NO: 1020599 - DNA, 23 bp, Homo sapiens
tgccttggttctggccaccccag

SEQ ID NO: 1020600 - DNA, 13 bp, Homo sapiens
tgccttgtataaa

SEQ ID NO: 1020601 - DNA, 23 bp, Homo sapiens
tgccttgtccaggaactgcctgg

SEQ ID NO: 1020602 - DNA, 19 bp, Homo sapiens
tgccttgtgtacagttatt

SEQ ID NO: 1020603 - DNA, 23 bp, Homo sapiens
tgccttgtttgagtttttcctcc

SEQ ID NO: 1020604 - DNA, 16 bp, Homo sapiens
tgccttgttttttgtt

SEQ ID NO: 1020605 - DNA, 16 bp, Homo sapiens
tgcctttaaagtatga

SEQ ID NO: 1020606 - DNA, 17 bp, Homo sapiens
tgcctttaaagtatgaa

SEQ ID NO: 1020607 - DNA, 16 bp, Homo sapiens
tgcctttaaatgaaac

SEQ ID NO: 1020608 - DNA, 13 bp, Homo sapiens
tgcctttaatatt

SEQ ID NO: 1020609 - DNA, 23 bp, Homo sapiens
tgcctttagaaaatataagtaaa

SEQ ID NO: 1020610 - DNA, 23 bp, Homo sapiens
tgcctttagcctggaccaaaggg

SEQ ID NO: 1020611 - DNA, 22 bp, Homo sapiens
tgcctttagtccacggaccccc

SEQ ID NO: 1020612 - DNA, 18 bp, Homo sapiens
tgcctttatctcagccat

SEQ ID NO: 1020613 - DNA, 13 bp, Homo sapiens
tgcctttcaaatt

SEQ ID NO: 1020614 - DNA, 19 bp, Homo sapiens
tgcctttcagaagtgattt

SEQ ID NO: 1020615 - DNA, 20 bp, Homo sapiens
tgcctttcagaagtgattta

SEQ ID NO: 1020616 - DNA, 12 bp, Homo sapiens
tgcctttccccc

SEQ ID NO: 1020617 - DNA, 14 bp, Homo sapiens
ggggaggcagcaga

SEQ ID NO: 1020618 - DNA, 13 bp, Homo sapiens
ggggaggccaagt

SEQ ID NO: 1020619 - DNA, 21 bp, Homo sapiens
ggggaggccaagtgcaggctg

SEQ ID NO: 1020620 - DNA, 16 bp, Homo sapiens
ggggaggcccaaatga

SEQ ID NO: 1020621 - DNA, 15 bp, Homo sapiens
ggggaggccctgcct

SEQ ID NO: 1020622 - DNA, 17 bp, Homo sapiens
ggggaggccctgcctga

SEQ ID NO: 1020623 - DNA, 15 bp, Homo sapiens
ggggagggaggggaa

SEQ ID NO: 1020624 - DNA, 14 bp, Homo sapiens
ggggagggattctg

SEQ ID NO: 1020625 - DNA, 15 bp, Homo sapiens
ggggagggattctgg

SEQ ID NO: 1020626 - DNA, 23 bp, Homo sapiens
ggggagggctcctggggcagaga

SEQ ID NO: 1020627 - DNA, 14 bp, Homo sapiens
ggggaggggacaga

SEQ ID NO: 1020628 - DNA, 14 bp, Homo sapiens
ggggaggggccctc

SEQ ID NO: 1020629 - DNA, 21 bp, Homo sapiens
ggggaggggcctagggagccg

SEQ ID NO: 1020630 - DNA, 14 bp, Homo sapiens
ggggagggggaagc

SEQ ID NO: 1020631 - DNA, 20 bp, Homo sapiens
ggggagggtgacagtggccg

SEQ ID NO: 1020632 - DNA, 12 bp, Homo sapiens
ggggaggtggga

SEQ ID NO: 1020633 - DNA, 11 bp, Homo sapiens
ggggagtgagt

SEQ ID NO: 1020634 - DNA, 16 bp, Homo sapiens
ggggagttgttatgcc

SEQ ID NO: 1020635 - DNA, 13 bp, Homo sapiens
ggggatcacagcg

SEQ ID NO: 1020636 - DNA, 17 bp, Homo sapiens
ggggatcacagcgtttc

SEQ ID NO: 1020637 - DNA, 23 bp, Homo sapiens
ggggatccccgcctggccaggag

SEQ ID NO: 1020638 - DNA, 23 bp, Homo sapiens
ggggatctggggggtggggagga

SEQ ID NO: 1020639 - DNA, 22 bp, Homo sapiens
ggggatcttcccacaggagggc

SEQ ID NO: 1020640 - DNA, 21 bp, Homo sapiens
ggggatgactagaggcaggga

SEQ ID NO: 1020641 - DNA, 20 bp, Homo sapiens
ggggatgagagggtgctatc

SEQ ID NO: 1020642 - DNA, 15 bp, Homo sapiens
ggggatggacacccc

SEQ ID NO: 1020643 - DNA, 15 bp, Homo sapiens
ggggatggggaggga

SEQ ID NO: 1020644 - DNA, 23 bp, Homo sapiens
ggggatgttctgcctctccctgg

SEQ ID NO: 1020645 - DNA, 18 bp, Homo sapiens
ggggattggagggaagac

SEQ ID NO: 1020646 - DNA, 14 bp, Homo sapiens
ggggatttctccca

SEQ ID NO: 1020647 - DNA, 21 bp, Homo sapiens
ggggcaaccaactgccccagg

SEQ ID NO: 1020648 - DNA, 13 bp, Homo sapiens
ggggcaagccagg

SEQ ID NO: 1020649 - DNA, 16 bp, Homo sapiens
ggggcaagccagggcc

SEQ ID NO: 1020650 - DNA, 17 bp, Homo sapiens
ggggcaagccagggccc

SEQ ID NO: 1020651 - DNA, 21 bp, Homo sapiens
ggggcacaccactgccctgcc

SEQ ID NO: 1020652 - DNA, 22 bp, Homo sapiens
ggggcacagctgtctgccaggc

SEQ ID NO: 1020653 - DNA, 15 bp, Homo sapiens
ggggcactgaccagg

SEQ ID NO: 1020654 - DNA, 14 bp, Homo sapiens
ggggcagagaggaa

SEQ ID NO: 1020655 - DNA, 15 bp, Homo sapiens
ggggcagagccagga

SEQ ID NO: 1020656 - DNA, 20 bp, Homo sapiens
ggggcagaggggcagccgct

SEQ ID NO: 1020657 - DNA, 19 bp, Homo sapiens
tgcgacggagagaaaaaag

SEQ ID NO: 1020658 - DNA, 17 bp, Homo sapiens
tgcgactttctgcctgg

SEQ ID NO: 1020659 - DNA, 21 bp, Homo sapiens
tgcgactttctgcctggagtg

SEQ ID NO: 1020660 - DNA, 23 bp, Homo sapiens
tgcgagacgcacacagctgagca

SEQ ID NO: 1020661 - DNA, 12 bp, Homo sapiens
tgcgagactctg

SEQ ID NO: 1020662 - DNA, 11 bp, Homo sapiens
tgcgagctgcc

SEQ ID NO: 1020663 - DNA, 21 bp, Homo sapiens
tgcgaggggccagcagagggc

SEQ ID NO: 1020664 - DNA, 18 bp, Homo sapiens
tgcgagtccaaggccagt

SEQ ID NO: 1020665 - DNA, 16 bp, Homo sapiens
tgcgatcttcagagca

SEQ ID NO: 1020666 - DNA, 13 bp, Homo sapiens
tgcgcaactgatc

SEQ ID NO: 1020667 - DNA, 19 bp, Homo sapiens
tgcgcacagagggaagcca

SEQ ID NO: 1020668 - DNA, 16 bp, Homo sapiens
tgcgcagatctgtgcc

SEQ ID NO: 1020669 - DNA, 19 bp, Homo sapiens
tgcgcagatctgtgcctgg

SEQ ID NO: 1020670 - DNA, 20 bp, Homo sapiens
tgcgcagatctgtgcctggg

SEQ ID NO: 1020671 - DNA, 22 bp, Homo sapiens
tgcgcagatctgtgcctgggat

SEQ ID NO: 1020672 - DNA, 14 bp, Homo sapiens
tgcgccaccatgcc

SEQ ID NO: 1020673 - DNA, 15 bp, Homo sapiens
tgcgccaccatgccc

SEQ ID NO: 1020674 - DNA, 23 bp, Homo sapiens
tgcgccactgccatcggacagga

SEQ ID NO: 1020675 - DNA, 14 bp, Homo sapiens
tgcgccactgctcc

SEQ ID NO: 1020676 - DNA, 18 bp, Homo sapiens
tgcgcccagagctggcct

SEQ ID NO: 1020677 - DNA, 14 bp, Homo sapiens
tgcgcccagcctga

SEQ ID NO: 1020678 - DNA, 15 bp, Homo sapiens
tgcgcccccagcttc

SEQ ID NO: 1020679 - DNA, 22 bp, Homo sapiens
tgcgcccccagcttctctctcc

SEQ ID NO: 1020680 - DNA, 23 bp, Homo sapiens
tgcgccccctccgccctgccact

SEQ ID NO: 1020681 - DNA, 20 bp, Homo sapiens
tgcgcccttgaggggcccca

SEQ ID NO: 1020682 - DNA, 12 bp, Homo sapiens
tgcgcctcagcc

SEQ ID NO: 1020683 - DNA, 18 bp, Homo sapiens
tgcgcctcagccctcagt

SEQ ID NO: 1020684 - DNA, 19 bp, Homo sapiens
tgcgcctccatccatctgt

SEQ ID NO: 1020685 - DNA, 20 bp, Homo sapiens
tgcgcctccatccatctgtc

SEQ ID NO: 1020686 - DNA, 12 bp, Homo sapiens
tgcgcctgcagg

SEQ ID NO: 1020687 - DNA, 12 bp, Homo sapiens
tgcgcctgctgc

SEQ ID NO: 1020688 - DNA, 19 bp, Homo sapiens
tgcgcctgtgatgctgggc

SEQ ID NO: 1020689 - DNA, 19 bp, Homo sapiens
tgcgcctttgtattataaa

SEQ ID NO: 1020690 - DNA, 16 bp, Homo sapiens
tgcgcgctatcccctc

SEQ ID NO: 1020691 - DNA, 23 bp, Homo sapiens
tgcgcgtgcacgtggagagctgg

SEQ ID NO: 1020692 - DNA, 22 bp, Homo sapiens
tgcgctaacccccagcccacag

SEQ ID NO: 1020693 - DNA, 15 bp, Homo sapiens
tgcgctagcagccct

SEQ ID NO: 1020694 - DNA, 14 bp, Homo sapiens
tgcgctcagggcca

SEQ ID NO: 1020695 - DNA, 23 bp, Homo sapiens
tgcgctcagggccatgctgaggc

SEQ ID NO: 1020696 - DNA, 20 bp, Homo sapiens
tgcgctctagcctgggcaac

SEQ ID NO: 1020697 - DNA, 18 bp, Homo sapiens
tgcgctctcaagaccaga

SEQ ID NO: 1020698 - DNA, 23 bp, Homo sapiens
tgcgctgctctgcaggctgggga

SEQ ID NO: 1020699 - DNA, 16 bp, Homo sapiens
tgcgcttatttggaaa

SEQ ID NO: 1020700 - DNA, 17 bp, Homo sapiens
tgcgcttatttggaaat

SEQ ID NO: 1020701 - DNA, 17 bp, Homo sapiens
tgcgctttattgcccat

SEQ ID NO: 1020702 - DNA, 23 bp, Homo sapiens
tgcgctttattgcccatgggata

SEQ ID NO: 1020703 - DNA, 16 bp, Homo sapiens
tgcggaagccataggg

SEQ ID NO: 1020704 - DNA, 23 bp, Homo sapiens
tgcggaagccatagggggctgca

SEQ ID NO: 1020705 - DNA, 15 bp, Homo sapiens
tgcggacaagtttta

SEQ ID NO: 1020706 - DNA, 18 bp, Homo sapiens
tgcggacaccgtggcctg

SEQ ID NO: 1020707 - DNA, 18 bp, Homo sapiens
tgcggaccaccctcactg

SEQ ID NO: 1020708 - DNA, 21 bp, Homo sapiens
tgcggacccttcccagccctc

SEQ ID NO: 1020709 - DNA, 20 bp, Homo sapiens
tgcggagtgaagaggggcag

SEQ ID NO: 1020710 - DNA, 21 bp, Homo sapiens
tgcggagtgaagaggggcagc

SEQ ID NO: 1020711 - DNA, 23 bp, Homo sapiens
tgcggccccctctcggccaggca

SEQ ID NO: 1020712 - DNA, 18 bp, Homo sapiens
tgcggccgcattccctga

SEQ ID NO: 1020713 - DNA, 19 bp, Homo sapiens
tgcggccgccccccgcccc

SEQ ID NO: 1020714 - DNA, 20 bp, Homo sapiens
tgcggcctggggggaacgga

SEQ ID NO: 1020715 - DNA, 16 bp, Homo sapiens
tgcggctgcccacgct

SEQ ID NO: 1020716 - DNA, 17 bp, Homo sapiens
tgcggctgcctgccccc

SEQ ID NO: 1020717 - DNA, 23 bp, Homo sapiens
tgcggctttatcattcctttcca

SEQ ID NO: 1020718 - DNA, 15 bp, Homo sapiens
tgcggctttctctgc

SEQ ID NO: 1020719 - DNA, 17 bp, Homo sapiens
tgcggctttctctgcct

SEQ ID NO: 1020720 - DNA, 19 bp, Homo sapiens
tgcggctttctctgcctct

SEQ ID NO: 1020721 - DNA, 17 bp, Homo sapiens
tgcgggcacaataaatc

SEQ ID NO: 1020722 - DNA, 16 bp, Homo sapiens
tgcgggccacagggca

SEQ ID NO: 1020723 - DNA, 12 bp, Homo sapiens
tgcgggccaggg

SEQ ID NO: 1020724 - DNA, 14 bp, Homo sapiens
tgcgggccagggtc

SEQ ID NO: 1020725 - DNA, 16 bp, Homo sapiens
tgcgggccagggtcct

SEQ ID NO: 1020726 - DNA, 17 bp, Homo sapiens
tgcgggccagggtcctg

SEQ ID NO: 1020727 - DNA, 17 bp, Homo sapiens
tgcgggctccctcctct

SEQ ID NO: 1020728 - DNA, 19 bp, Homo sapiens
tgcgggctccctcctctgg

SEQ ID NO: 1020729 - DNA, 20 bp, Homo sapiens
tgcgggctccctcctctggc

SEQ ID NO: 1020730 - DNA, 17 bp, Homo sapiens
tgcgggcttttccccgg

SEQ ID NO: 1020731 - DNA, 14 bp, Homo sapiens
tgcggggccaccca

SEQ ID NO: 1020732 - DNA, 16 bp, Homo sapiens
tgcgggtcctcagctg

SEQ ID NO: 1020733 - DNA, 21 bp, Homo sapiens
tgcgggtgaacaaagcagcca

SEQ ID NO: 1020734 - DNA, 23 bp, Homo sapiens
tgcgggtgaacaaagcagccacg

SEQ ID NO: 1020735 - DNA, 17 bp, Homo sapiens
tgcggtagccagcacac

SEQ ID NO: 1020736 - DNA, 20 bp, Homo sapiens
tgcggtgaagttgaggctta

SEQ ID NO: 1020737 - DNA, 19 bp, Homo sapiens
tgcggttcttacagcacat

SEQ ID NO: 1020738 - DNA, 15 bp, Homo sapiens
tgcgtactccactgg

SEQ ID NO: 1020739 - DNA, 17 bp, Homo sapiens
tgcgtatatgtgcgtct

SEQ ID NO: 1020740 - DNA, 14 bp, Homo sapiens
tgcgtatgtctgtt

SEQ ID NO: 1020741 - DNA, 19 bp, Homo sapiens
tgcgtatgtctgttaccat

SEQ ID NO: 1020742 - DNA, 14 bp, Homo sapiens
tgcgtccaccaggc

SEQ ID NO: 1020743 - DNA, 16 bp, Homo sapiens
tgcgtccaccaggcct

SEQ ID NO: 1020744 - DNA, 18 bp, Homo sapiens
ggggctccgggtcactgc

SEQ ID NO: 1020745 - DNA, 19 bp, Homo sapiens
ggggctccgggtcactgct

SEQ ID NO: 1020746 - DNA, 13 bp, Homo sapiens
ggggctcctggaa

SEQ ID NO: 1020747 - DNA, 21 bp, Homo sapiens
ggggctcctggaaaggctcag

SEQ ID NO: 1020748 - DNA, 20 bp, Homo sapiens
ggggctcctgggttggaggg

SEQ ID NO: 1020749 - DNA, 15 bp, Homo sapiens
ggggctcggggaggc

SEQ ID NO: 1020750 - DNA, 20 bp, Homo sapiens
ggggctctcagctcagcgcc

SEQ ID NO: 1020751 - DNA, 18 bp, Homo sapiens
ggggctctccaaaggggc

SEQ ID NO: 1020752 - DNA, 17 bp, Homo sapiens
ggggctctctgacccgg

SEQ ID NO: 1020753 - DNA, 13 bp, Homo sapiens
ggggctctgtgtt

SEQ ID NO: 1020754 - DNA, 20 bp, Homo sapiens
ggggctgaacatgcctgcca

SEQ ID NO: 1020755 - DNA, 14 bp, Homo sapiens
ggggctgagctggg

SEQ ID NO: 1020756 - DNA, 19 bp, Homo sapiens
ggggctgcacctcctaccc

SEQ ID NO: 1020757 - DNA, 13 bp, Homo sapiens
ggggctgcagcat

SEQ ID NO: 1020758 - DNA, 20 bp, Homo sapiens
ggggctgctcacccacctct

SEQ ID NO: 1020759 - DNA, 20 bp, Homo sapiens
ggggctgctcctccagggcc

SEQ ID NO: 1020760 - DNA, 12 bp, Homo sapiens
ggggctgctggg

SEQ ID NO: 1020761 - DNA, 16 bp, Homo sapiens
ggggctgcttcctcct

SEQ ID NO: 1020762 - DNA, 17 bp, Homo sapiens
ggggctggcactgactg

SEQ ID NO: 1020763 - DNA, 13 bp, Homo sapiens
ggggctggctccc

SEQ ID NO: 1020764 - DNA, 12 bp, Homo sapiens
ggggctgggctg

SEQ ID NO: 1020765 - DNA, 13 bp, Homo sapiens
ggggctggggcag

SEQ ID NO: 1020766 - DNA, 14 bp, Homo sapiens
ggggctgtcctcct

SEQ ID NO: 1020767 - DNA, 22 bp, Homo sapiens
ggggctgtcctccttcctggga

SEQ ID NO: 1020768 - DNA, 16 bp, Homo sapiens
ggggctgtctttgcag

SEQ ID NO: 1020769 - DNA, 20 bp, Homo sapiens
ggggctgtgactctgggcag

SEQ ID NO: 1020770 - DNA, 12 bp, Homo sapiens
ggggctgtggat

SEQ ID NO: 1020771 - DNA, 17 bp, Homo sapiens
ggggctgtggccctgcc

SEQ ID NO: 1020772 - DNA, 15 bp, Homo sapiens
ggggcttatgggtgg

SEQ ID NO: 1020773 - DNA, 17 bp, Homo sapiens
ggggcttcacagccaca

SEQ ID NO: 1020774 - DNA, 24 bp, Homo sapiens
ggggcttcaccagtctgtctactg

SEQ ID NO: 1020775 - DNA, 21 bp, Homo sapiens
ggggcttctggacctagggtg

SEQ ID NO: 1020776 - DNA, 16 bp, Homo sapiens
ggggctttcggggagg

SEQ ID NO: 1020777 - DNA, 13 bp, Homo sapiens
ggggctttctctt

SEQ ID NO: 1020778 - DNA, 14 bp, Homo sapiens
ggggctttgggccc

SEQ ID NO: 1020779 - DNA, 21 bp, Homo sapiens
gggtatacagcattgactcag

SEQ ID NO: 1020780 - DNA, 15 bp, Homo sapiens
gggtatcccctgcct

SEQ ID NO: 1020781 - DNA, 18 bp, Homo sapiens
gggtatcccctgcctcct

SEQ ID NO: 1020782 - DNA, 15 bp, Homo sapiens
gggtatgctctgtga

SEQ ID NO: 1020783 - DNA, 17 bp, Homo sapiens
gggtatgctctgtgaca

SEQ ID NO: 1020784 - DNA, 22 bp, Homo sapiens
gggtattcccactcaccagccc

SEQ ID NO: 1020785 - DNA, 15 bp, Homo sapiens
gggtcaaggacaggg

SEQ ID NO: 1020786 - DNA, 14 bp, Homo sapiens
gggtcacgcttgcc

SEQ ID NO: 1020787 - DNA, 20 bp, Homo sapiens
gggtcagaagaagtgggagc

SEQ ID NO: 1020788 - DNA, 22 bp, Homo sapiens
gggtcagaagaagtgggagcag

SEQ ID NO: 1020789 - DNA, 17 bp, Homo sapiens
gggtcagccagggccag

SEQ ID NO: 1020790 - DNA, 20 bp, Homo sapiens
gggtcagccatttttaatga

SEQ ID NO: 1020791 - DNA, 17 bp, Homo sapiens
gggtcagccccaagggc

SEQ ID NO: 1020792 - DNA, 14 bp, Homo sapiens
gggtcaggagaggg

SEQ ID NO: 1020793 - DNA, 18 bp, Homo sapiens
gggtcagggaccaaggac

SEQ ID NO: 1020794 - DNA, 14 bp, Homo sapiens
gggtcagggggagt

SEQ ID NO: 1020795 - DNA, 21 bp, Homo sapiens
gggtcatcctgtgctcggagg

SEQ ID NO: 1020796 - DNA, 14 bp, Homo sapiens
gggtcatgccctcc

SEQ ID NO: 1020797 - DNA, 23 bp, Homo sapiens
gggtccaccagtgtgtgggggag

SEQ ID NO: 1020798 - DNA, 16 bp, Homo sapiens
gggtccaggaaggcag

SEQ ID NO: 1020799 - DNA, 20 bp, Homo sapiens
gggtccaggaaggcagctgc

SEQ ID NO: 1020800 - DNA, 21 bp, Homo sapiens
gggtccaggaaggcagctgct

SEQ ID NO: 1020801 - DNA, 22 bp, Homo sapiens
gggtccaggaaggcagctgctc

SEQ ID NO: 1020802 - DNA, 19 bp, Homo sapiens
gggtccaggagagcctggg

SEQ ID NO: 1020803 - DNA, 13 bp, Homo sapiens
gggtccaggcccg

SEQ ID NO: 1020804 - DNA, 16 bp, Homo sapiens
gggtccagggctgttg

SEQ ID NO: 1020805 - DNA, 12 bp, Homo sapiens
gggtcccacccc

SEQ ID NO: 1020806 - DNA, 14 bp, Homo sapiens
gggtcccagggctg

SEQ ID NO: 1020807 - DNA, 14 bp, Homo sapiens
gggtcccagtggga

SEQ ID NO: 1020808 - DNA, 17 bp, Homo sapiens
gggtccccatcatccca

SEQ ID NO: 1020809 - DNA, 14 bp, Homo sapiens
gggtcccctcccca

SEQ ID NO: 1020810 - DNA, 15 bp, Homo sapiens
gggtccctgctcccc

SEQ ID NO: 1020811 - DNA, 20 bp, Homo sapiens
gggtcctagcccttccctga

SEQ ID NO: 1020812 - DNA, 21 bp, Homo sapiens
gggtcctagcccttccctgag

SEQ ID NO: 1020813 - DNA, 22 bp, Homo sapiens
gggtcctcctaagtcccttcct

SEQ ID NO: 1020814 - DNA, 19 bp, Homo sapiens
gggtcctcctcgctcctcc

SEQ ID NO: 1020815 - DNA, 22 bp, Homo sapiens
gggtcctctagcccactccctg

SEQ ID NO: 1020816 - DNA, 14 bp, Homo sapiens
gggtcctcttttcc

SEQ ID NO: 1020817 - DNA, 23 bp, Homo sapiens
gggtcctcttttcctggcagctg

SEQ ID NO: 1020818 - DNA, 19 bp, Homo sapiens
gggtcctgcagcctgcagg

SEQ ID NO: 1020819 - DNA, 13 bp, Homo sapiens
gggtcctggccat

SEQ ID NO: 1020820 - DNA, 17 bp, Homo sapiens
gggtcctggccatccca

SEQ ID NO: 1020821 - DNA, 18 bp, Homo sapiens
gggtcctggctcctgagg

SEQ ID NO: 1020822 - DNA, 15 bp, Homo sapiens
gggtcggccctgccc

SEQ ID NO: 1020823 - DNA, 20 bp, Homo sapiens
gggtcggctgaccatgctca

SEQ ID NO: 1020824 - DNA, 20 bp, Homo sapiens
gggtcgtcaccacctctcct

SEQ ID NO: 1020825 - DNA, 21 bp, Homo sapiens
gggtctaaggagcgctagtgc

SEQ ID NO: 1020826 - DNA, 12 bp, Homo sapiens
gggtctaccagg

SEQ ID NO: 1020827 - DNA, 19 bp, Homo sapiens
gggtctcactctctgggga

SEQ ID NO: 1020828 - DNA, 13 bp, Homo sapiens
gggtctccctggc

SEQ ID NO: 1020829 - DNA, 16 bp, Homo sapiens
gggtctccctggctcc

SEQ ID NO: 1020830 - DNA, 17 bp, Homo sapiens
gggtctccctggctccc

SEQ ID NO: 1020831 - DNA, 18 bp, Homo sapiens
gggtctcctcccagcggc

SEQ ID NO: 1020832 - DNA, 19 bp, Homo sapiens
gggtctcctggaccttgac

SEQ ID NO: 1020833 - DNA, 14 bp, Homo sapiens
gggtctcgcagcct

SEQ ID NO: 1020834 - DNA, 14 bp, Homo sapiens
gggtctctccctca

SEQ ID NO: 1020835 - DNA, 14 bp, Homo sapiens
gggtctctctccct

SEQ ID NO: 1020836 - DNA, 23 bp, Homo sapiens
gggtctgaaggaatagccagaga

SEQ ID NO: 1020837 - DNA, 17 bp, Homo sapiens
gggtctgattttctcac

SEQ ID NO: 1020838 - DNA, 20 bp, Homo sapiens
gggtctgccaccatcctgct

SEQ ID NO: 1020839 - DNA, 16 bp, Homo sapiens
gggtctgccctgccca

SEQ ID NO: 1020840 - DNA, 17 bp, Homo sapiens
gggtctgccctgcccat

SEQ ID NO: 1020841 - DNA, 21 bp, Homo sapiens
gggtctgctctttctctgcca

SEQ ID NO: 1020842 - DNA, 16 bp, Homo sapiens
gggtctggatgggagg

SEQ ID NO: 1020843 - DNA, 22 bp, Homo sapiens
gggtctggcagcctcccatcca

SEQ ID NO: 1020844 - DNA, 17 bp, Homo sapiens
gggtctgggcagtgcca

SEQ ID NO: 1020845 - DNA, 14 bp, Homo sapiens
gggtctgggcgtcc

SEQ ID NO: 1020846 - DNA, 14 bp, Homo sapiens
gggtctgggctggg

SEQ ID NO: 1020847 - DNA, 16 bp, Homo sapiens
gggtctggggacaggc

SEQ ID NO: 1020848 - DNA, 16 bp, Homo sapiens
gggtctgggggcagct

SEQ ID NO: 1020849 - DNA, 21 bp, Homo sapiens
gggtctgggggcagctgtcct

SEQ ID NO: 1020850 - DNA, 17 bp, Homo sapiens
gggtctgtgactggatc

SEQ ID NO: 1020851 - DNA, 20 bp, Homo sapiens
gggtctgtgactggatcttc

SEQ ID NO: 1020852 - DNA, 15 bp, Homo sapiens
gggtctgtgctgtgc

SEQ ID NO: 1020853 - DNA, 17 bp, Homo sapiens
gggtctgtgctgtgcct

SEQ ID NO: 1020854 - DNA, 18 bp, Homo sapiens
gggtctgtgctgtgcctg

SEQ ID NO: 1020855 - DNA, 20 bp, Homo sapiens
gggtctgtgctgtgcctgct

SEQ ID NO: 1020856 - DNA, 17 bp, Homo sapiens
gggtctgtgtcagcggg

SEQ ID NO: 1020857 - DNA, 15 bp, Homo sapiens
gggtctgtgtgaatg

SEQ ID NO: 1020858 - DNA, 17 bp, Homo sapiens
gggtctgtgtgaatgtg

SEQ ID NO: 1020859 - DNA, 14 bp, Homo sapiens
gggtcttaggatgt

SEQ ID NO: 1020860 - DNA, 19 bp, Homo sapiens
gggtctttcttgggatagt

SEQ ID NO: 1020861 - DNA, 22 bp, Homo sapiens
gggtcttttaccctgtgtcaga

SEQ ID NO: 1020862 - DNA, 17 bp, Homo sapiens
gggtctttttctcttct

SEQ ID NO: 1020863 - DNA, 16 bp, Homo sapiens
gggtgaactgcaaagc

SEQ ID NO: 1020864 - DNA, 13 bp, Homo sapiens
gggtgaagggaga

SEQ ID NO: 1020865 - DNA, 14 bp, Homo sapiens
gggtgaagggagag

SEQ ID NO: 1020866 - DNA, 16 bp, Homo sapiens
gggtgacaagagcctg

SEQ ID NO: 1020867 - DNA, 14 bp, Homo sapiens
gggtgacagtcctc

SEQ ID NO: 1020868 - DNA, 18 bp, Homo sapiens
gggtgacatggggaaggc

SEQ ID NO: 1020869 - DNA, 21 bp, Homo sapiens
gggtgacatggggaaggcaga

SEQ ID NO: 1020870 - DNA, 19 bp, Homo sapiens
gggtgacccacagctctgg

SEQ ID NO: 1020871 - DNA, 21 bp, Homo sapiens
gggtgacccacagctctgggc

SEQ ID NO: 1020872 - DNA, 18 bp, Homo sapiens
gggtgaccttcttgggga

SEQ ID NO: 1020873 - DNA, 17 bp, Homo sapiens
gggtgacgcccagctcc

SEQ ID NO: 1020874 - DNA, 21 bp, Homo sapiens
gggtgacttccctggtcacca

SEQ ID NO: 1020875 - DNA, 22 bp, Homo sapiens
tgctatcgccctcctttccctt

SEQ ID NO: 1020876 - DNA, 21 bp, Homo sapiens
tgctatctagcagtaaaagat

SEQ ID NO: 1020877 - DNA, 23 bp, Homo sapiens
tgctatctggaggccttccagct

SEQ ID NO: 1020878 - DNA, 16 bp, Homo sapiens
tgctatgaaaatgagc

SEQ ID NO: 1020879 - DNA, 16 bp, Homo sapiens
tgctatgagttttctc

SEQ ID NO: 1020880 - DNA, 20 bp, Homo sapiens
tgctatgagttttctccttg

SEQ ID NO: 1020881 - DNA, 14 bp, Homo sapiens
tgctatggttttct

SEQ ID NO: 1020882 - DNA, 17 bp, Homo sapiens
tgctatgttctgtcttc

SEQ ID NO: 1020883 - DNA, 21 bp, Homo sapiens
tgctattaatatttgtttagt

SEQ ID NO: 1020884 - DNA, 15 bp, Homo sapiens
tgctattatgtaaca

SEQ ID NO: 1020885 - DNA, 17 bp, Homo sapiens
tgctattatgtaacatc

SEQ ID NO: 1020886 - DNA, 22 bp, Homo sapiens
tgctattatgtaacatccagaa

SEQ ID NO: 1020887 - DNA, 14 bp, Homo sapiens
tgctattctgtgtt

SEQ ID NO: 1020888 - DNA, 15 bp, Homo sapiens
tgctattctgtgttg

SEQ ID NO: 1020889 - DNA, 16 bp, Homo sapiens
tgctattgacaagtca

SEQ ID NO: 1020890 - DNA, 16 bp, Homo sapiens
tgctattgctgtctgg

SEQ ID NO: 1020891 - DNA, 16 bp, Homo sapiens
tgctattgtaaatatg

SEQ ID NO: 1020892 - DNA, 18 bp, Homo sapiens
tgctattgttgtgggctt

SEQ ID NO: 1020893 - DNA, 17 bp, Homo sapiens
tgctatttcaataacag

SEQ ID NO: 1020894 - DNA, 20 bp, Homo sapiens
tgctatttcacttgagcaag

SEQ ID NO: 1020895 - DNA, 13 bp, Homo sapiens
tgctatttctatt

SEQ ID NO: 1020896 - DNA, 11 bp, Homo sapiens
tgctatttgaa

SEQ ID NO: 1020897 - DNA, 17 bp, Homo sapiens
tgctatttgagcatgca

SEQ ID NO: 1020898 - DNA, 19 bp, Homo sapiens
tgctatttgagcatgcaca

SEQ ID NO: 1020899 - DNA, 24 bp, Homo sapiens
tgctatttgagcatgcacagctgc

SEQ ID NO: 1020900 - DNA, 19 bp, Homo sapiens
tgctattttatttgtattc

SEQ ID NO: 1020901 - DNA, 14 bp, Homo sapiens
tgctccgccaggaa

SEQ ID NO: 1020902 - DNA, 16 bp, Homo sapiens
tgctccgcctggcctg

SEQ ID NO: 1020903 - DNA, 18 bp, Homo sapiens
tgctccgcctggcctggc

SEQ ID NO: 1020904 - DNA, 15 bp, Homo sapiens
tgctccgctgctcct

SEQ ID NO: 1020905 - DNA, 20 bp, Homo sapiens
tgctccgctgctccttggct

SEQ ID NO: 1020906 - DNA, 21 bp, Homo sapiens
tgctccgctgctccttggctt

SEQ ID NO: 1020907 - DNA, 16 bp, Homo sapiens
tgctccggcctgcgtc

SEQ ID NO: 1020908 - DNA, 17 bp, Homo sapiens
tgctccggcctgcgtct

SEQ ID NO: 1020909 - DNA, 13 bp, Homo sapiens
tgctccgtgcctc

SEQ ID NO: 1020910 - DNA, 19 bp, Homo sapiens
tgctccgtgcctccaccac

SEQ ID NO: 1020911 - DNA, 13 bp, Homo sapiens
tgctccgtggact

SEQ ID NO: 1020912 - DNA, 13 bp, Homo sapiens
tgctccgtggagg

SEQ ID NO: 1020913 - DNA, 17 bp, Homo sapiens
tgctccgtggaggaggt

SEQ ID NO: 1020914 - DNA, 14 bp, Homo sapiens
tgctcctacatcca

SEQ ID NO: 1020915 - DNA, 22 bp, Homo sapiens
tgctcctacatccagctcctct

SEQ ID NO: 1020916 - DNA, 14 bp, Homo sapiens
tgctcctagaggga

SEQ ID NO: 1020917 - DNA, 24 bp, Homo sapiens
tgctcctagagggaggggcctagg

SEQ ID NO: 1020918 - DNA, 13 bp, Homo sapiens
tgctcctagcaga

SEQ ID NO: 1020919 - DNA, 14 bp, Homo sapiens
tgctcctcacctgt

SEQ ID NO: 1020920 - DNA, 22 bp, Homo sapiens
tgctcctcactggaggagcagc

SEQ ID NO: 1020921 - DNA, 10 bp, Homo sapiens
tgctcctcat

SEQ ID NO: 1020922 - DNA, 12 bp, Homo sapiens
tgctcctcatgg

SEQ ID NO: 1020923 - DNA, 13 bp, Homo sapiens
tgctcctccagcc

SEQ ID NO: 1020924 - DNA, 15 bp, Homo sapiens
tgctcctccagccct

SEQ ID NO: 1020925 - DNA, 13 bp, Homo sapiens
tgctcctccaggg

SEQ ID NO: 1020926 - DNA, 21 bp, Homo sapiens
tgctcctccagggccacgtgc

SEQ ID NO: 1020927 - DNA, 10 bp, Homo sapiens
tgctcctccc

SEQ ID NO: 1020928 - DNA, 19 bp, Homo sapiens
tgctcctcccacttctcaa

SEQ ID NO: 1020929 - DNA, 13 bp, Homo sapiens
tgctcctccctgc

SEQ ID NO: 1020930 - DNA, 14 bp, Homo sapiens
tgctcctccctgcc

SEQ ID NO: 1020931 - DNA, 15 bp, Homo sapiens
tgctcctccctgccc

SEQ ID NO: 1020932 - DNA, 17 bp, Homo sapiens
tgctcctccctgccccc

SEQ ID NO: 1020933 - DNA, 21 bp, Homo sapiens
tgctcctccctgccccccaag

SEQ ID NO: 1020934 - DNA, 15 bp, Homo sapiens
tgctcctccctggct

SEQ ID NO: 1020935 - DNA, 19 bp, Homo sapiens
tgctcctccctggctgccc

SEQ ID NO: 1020936 - DNA, 20 bp, Homo sapiens
tgctcctccctggctgccct

SEQ ID NO: 1020937 - DNA, 13 bp, Homo sapiens
tgctcctccgggt

SEQ ID NO: 1020938 - DNA, 11 bp, Homo sapiens
tgctcctcctg

SEQ ID NO: 1020939 - DNA, 15 bp, Homo sapiens
tgctcctcctgccct

SEQ ID NO: 1020940 - DNA, 14 bp, Homo sapiens
tgctcctctccagg

SEQ ID NO: 1020941 - DNA, 21 bp, Homo sapiens
tgctcctctcgcacaatgcat

SEQ ID NO: 1020942 - DNA, 14 bp, Homo sapiens
tgctcctctttccc

SEQ ID NO: 1020943 - DNA, 13 bp, Homo sapiens
tgctcctgcagca

SEQ ID NO: 1020944 - DNA, 14 bp, Homo sapiens
tgctcctgcatgca

SEQ ID NO: 1020945 - DNA, 19 bp, Homo sapiens
tgctcctgcatgcaactaa

SEQ ID NO: 1020946 - DNA, 15 bp, Homo sapiens
tgctcctgccaacca

SEQ ID NO: 1020947 - DNA, 14 bp, Homo sapiens
tgctcctgcccagc

SEQ ID NO: 1020948 - DNA, 15 bp, Homo sapiens
tgctcctgcccagcc

SEQ ID NO: 1020949 - DNA, 21 bp, Homo sapiens
tgctcctgcttttctgtcctg

SEQ ID NO: 1020950 - DNA, 22 bp, Homo sapiens
tgctcctgcttttctgtcctgg

SEQ ID NO: 1020951 - DNA, 23 bp, Homo sapiens
tgctcctgcttttctgtcctggg

SEQ ID NO: 1020952 - DNA, 14 bp, Homo sapiens
tgctcctggagcct

SEQ ID NO: 1020953 - DNA, 20 bp, Homo sapiens
tgctcctggagcctttgaat

SEQ ID NO: 1020954 - DNA, 18 bp, Homo sapiens
tgctcctgtacttgtcct

SEQ ID NO: 1020955 - DNA, 23 bp, Homo sapiens
tgctccttcactgttccctctgg

SEQ ID NO: 1020956 - DNA, 12 bp, Homo sapiens
tgctccttgctg

SEQ ID NO: 1020957 - DNA, 18 bp, Homo sapiens
tgctccttggcaccccca

SEQ ID NO: 1020958 - DNA, 22 bp, Homo sapiens
tgctccttggcacccccatgct

SEQ ID NO: 1020959 - DNA, 23 bp, Homo sapiens
tgctccttggcacccccatgctg

SEQ ID NO: 1020960 - DNA, 17 bp, Homo sapiens
tgctccttggcttacct

SEQ ID NO: 1020961 - DNA, 14 bp, Homo sapiens
tgctccttgggccc

SEQ ID NO: 1020962 - DNA, 19 bp, Homo sapiens
tgctccttgggccctttga

SEQ ID NO: 1020963 - DNA, 21 bp, Homo sapiens
tgctccttgggccctttgagt

SEQ ID NO: 1020964 - DNA, 19 bp, Homo sapiens
tgctccttttgtatcttcc

SEQ ID NO: 1020965 - DNA, 13 bp, Homo sapiens
tgctcgaccttga

SEQ ID NO: 1020966 - DNA, 12 bp, Homo sapiens
tgctcgccatca

SEQ ID NO: 1020967 - DNA, 23 bp, Homo sapiens
tgctcgcccctgttttttgtaga

SEQ ID NO: 1020968 - DNA, 13 bp, Homo sapiens
tgctcgccctgcg

SEQ ID NO: 1020969 - DNA, 14 bp, Homo sapiens
tgctcgccctgcgg

SEQ ID NO: 1020970 - DNA, 19 bp, Homo sapiens
tgctcggagaagagcgcag

SEQ ID NO: 1020971 - DNA, 15 bp, Homo sapiens
tgctcggccgtcttc

SEQ ID NO: 1020972 - DNA, 19 bp, Homo sapiens
tgctcgggaagggagggga

SEQ ID NO: 1020973 - DNA, 18 bp, Homo sapiens
tgctcgtggactgtgctg

SEQ ID NO: 1020974 - DNA, 12 bp, Homo sapiens
tgctctaaatta

SEQ ID NO: 1020975 - DNA, 20 bp, Homo sapiens
tgctctacaatgacacacaa

SEQ ID NO: 1020976 - DNA, 13 bp, Homo sapiens
tgctctagaaagt

SEQ ID NO: 1020977 - DNA, 13 bp, Homo sapiens
tgctctagccagg

SEQ ID NO: 1020978 - DNA, 15 bp, Homo sapiens
tgctctagccaggag

SEQ ID NO: 1020979 - DNA, 16 bp, Homo sapiens
tgctctagccaggagt

SEQ ID NO: 1020980 - DNA, 14 bp, Homo sapiens
tgctctagctggca

SEQ ID NO: 1020981 - DNA, 17 bp, Homo sapiens
tgctctagctggcagga

SEQ ID NO: 1020982 - DNA, 15 bp, Homo sapiens
tgctctaggaagaca

SEQ ID NO: 1020983 - DNA, 21 bp, Homo sapiens
tgctctagggaatctggatta

SEQ ID NO: 1020984 - DNA, 13 bp, Homo sapiens
tgctctagtgcct

SEQ ID NO: 1020985 - DNA, 21 bp, Homo sapiens
tgctctattaagattggaaat

SEQ ID NO: 1020986 - DNA, 22 bp, Homo sapiens
tgctctattaagattggaaatg

SEQ ID NO: 1020987 - DNA, 12 bp, Homo sapiens
tgctctattgta

SEQ ID NO: 1020988 - DNA, 21 bp, Homo sapiens
tgctctattgtagcatttctt

SEQ ID NO: 1020989 - DNA, 14 bp, Homo sapiens
tgctctcactgttt

SEQ ID NO: 1020990 - DNA, 14 bp, Homo sapiens
tgctctcagctggc

SEQ ID NO: 1020991 - DNA, 21 bp, Homo sapiens
tgctctccccggcaggcctga

SEQ ID NO: 1020992 - DNA, 15 bp, Homo sapiens
tgctctcccctgccc

SEQ ID NO: 1020993 - DNA, 16 bp, Homo sapiens
tgctctcccctgccct

SEQ ID NO: 1020994 - DNA, 20 bp, Homo sapiens
tgctctcccctgccctgctg

SEQ ID NO: 1020995 - DNA, 12 bp, Homo sapiens
tgctctcctctt

SEQ ID NO: 1020996 - DNA, 14 bp, Homo sapiens
tgctctcctcttgc

SEQ ID NO: 1020997 - DNA, 18 bp, Homo sapiens
tgctctcctcttgccact

SEQ ID NO: 1020998 - DNA, 15 bp, Homo sapiens
tgctctctctccctg

SEQ ID NO: 1020999 - DNA, 19 bp, Homo sapiens
tgctctctctccctgcctt

SEQ ID NO: 1021000 - DNA, 20 bp, Homo sapiens
tgctctctgcagccagccca

SEQ ID NO: 1021001 - DNA, 21 bp, Homo sapiens
tgctctctgcagccagcccag

SEQ ID NO: 1021002 - DNA, 12 bp, Homo sapiens
tgctctctgcca

SEQ ID NO: 1021003 - DNA, 13 bp, Homo sapiens
tgctctcttcagg

SEQ ID NO: 1021004 - DNA, 15 bp, Homo sapiens
tgctctcttcaggag

SEQ ID NO: 1021005 - DNA, 17 bp, Homo sapiens
tgctctgaaatctcctt

SEQ ID NO: 1021006 - DNA, 20 bp, Homo sapiens
tgctctgaatattttgtaat

SEQ ID NO: 1021007 - DNA, 15 bp, Homo sapiens
tgctctgaatctgta

SEQ ID NO: 1021008 - DNA, 13 bp, Homo sapiens
gggttgggacagg

SEQ ID NO: 1021009 - DNA, 17 bp, Homo sapiens
gggttggggcaaagcct

SEQ ID NO: 1021010 - DNA, 14 bp, Homo sapiens
gggttggggtggga

SEQ ID NO: 1021011 - DNA, 19 bp, Homo sapiens
gggttggtgcacagtgatt

SEQ ID NO: 1021012 - DNA, 20 bp, Homo sapiens
gggttggtgggctggcccag

SEQ ID NO: 1021013 - DNA, 14 bp, Homo sapiens
gggttggtgtgctg

SEQ ID NO: 1021014 - DNA, 14 bp, Homo sapiens
gggttgtgaggcct

SEQ ID NO: 1021015 - DNA, 14 bp, Homo sapiens
gggttgtttccagg

SEQ ID NO: 1021016 - DNA, 16 bp, Homo sapiens
gggtttatataaataa

SEQ ID NO: 1021017 - DNA, 20 bp, Homo sapiens
gggtttcactgtgttagcca

SEQ ID NO: 1021018 - DNA, 13 bp, Homo sapiens
gggtttgcccagt

SEQ ID NO: 1021019 - DNA, 16 bp, Homo sapiens
gggtttggccagggag

SEQ ID NO: 1021020 - DNA, 15 bp, Homo sapiens
gggtttgggagtcag

SEQ ID NO: 1021021 - DNA, 20 bp, Homo sapiens
gggtttgggcccctcagagc

SEQ ID NO: 1021022 - DNA, 14 bp, Homo sapiens
gggtttgggtgcct

SEQ ID NO: 1021023 - DNA, 17 bp, Homo sapiens
gggtttgggtgggggct

SEQ ID NO: 1021024 - DNA, 23 bp, Homo sapiens
gggttttattgtccttcagagct

SEQ ID NO: 1021025 - DNA, 16 bp, Homo sapiens
tgctgcaaggtggcct

SEQ ID NO: 1021026 - DNA, 14 bp, Homo sapiens
tgctgcaatgggaa

SEQ ID NO: 1021027 - DNA, 15 bp, Homo sapiens
tgctgcacagcagga

SEQ ID NO: 1021028 - DNA, 16 bp, Homo sapiens
tgctgcaccctgcgcc

SEQ ID NO: 1021029 - DNA, 17 bp, Homo sapiens
tgctgcacttcctgttt

SEQ ID NO: 1021030 - DNA, 12 bp, Homo sapiens
tgctgcagcaga

SEQ ID NO: 1021031 - DNA, 14 bp, Homo sapiens
tgctgcaggaaaag

SEQ ID NO: 1021032 - DNA, 19 bp, Homo sapiens
tgctgcaggccctccctct

SEQ ID NO: 1021033 - DNA, 20 bp, Homo sapiens
tgctgcatagctctatttta

SEQ ID NO: 1021034 - DNA, 18 bp, Homo sapiens
tgctgcattgatccagga

SEQ ID NO: 1021035 - DNA, 16 bp, Homo sapiens
tgctgccaaaaccaca

SEQ ID NO: 1021036 - DNA, 21 bp, Homo sapiens
tgctgccaaaaccacatgggc

SEQ ID NO: 1021037 - DNA, 22 bp, Homo sapiens
tgctgccaaaaccacatgggct

SEQ ID NO: 1021038 - DNA, 15 bp, Homo sapiens
tgctgccacacttca

SEQ ID NO: 1021039 - DNA, 22 bp, Homo sapiens
tgctgccacacttcaggctctt

SEQ ID NO: 1021040 - DNA, 23 bp, Homo sapiens
tgctgccagacactgagcttctg

SEQ ID NO: 1021041 - DNA, 15 bp, Homo sapiens
tgctgcccagccact

SEQ ID NO: 1021042 - DNA, 16 bp, Homo sapiens
tgctgcccagcctcca

SEQ ID NO: 1021043 - DNA, 17 bp, Homo sapiens
tgctgcccatgtttcaa

SEQ ID NO: 1021044 - DNA, 14 bp, Homo sapiens
tgctgccccagctg

SEQ ID NO: 1021045 - DNA, 19 bp, Homo sapiens
tgctgccccatcagtgctc

SEQ ID NO: 1021046 - DNA, 22 bp, Homo sapiens
tgctgcccccaccccggggacc

SEQ ID NO: 1021047 - DNA, 21 bp, Homo sapiens
tgctgccccgttccctgtcag

SEQ ID NO: 1021048 - DNA, 17 bp, Homo sapiens
tgctgccccttgcaagc

SEQ ID NO: 1021049 - DNA, 20 bp, Homo sapiens
tgctgcccgcgggagacagc

SEQ ID NO: 1021050 - DNA, 23 bp, Homo sapiens
tgctgcccgcgggagacagcttc

SEQ ID NO: 1021051 - DNA, 23 bp, Homo sapiens
tgctgcccggttgccatggagat

SEQ ID NO: 1021052 - DNA, 20 bp, Homo sapiens
tgctgcccgtcttcagccta

SEQ ID NO: 1021053 - DNA, 21 bp, Homo sapiens
tgctgcccgtcttcagcctag

SEQ ID NO: 1021054 - DNA, 14 bp, Homo sapiens
tgctgccctcttaa

SEQ ID NO: 1021055 - DNA, 15 bp, Homo sapiens
tgctgccctgaagaa

SEQ ID NO: 1021056 - DNA, 11 bp, Homo sapiens
tgctgccctgc

SEQ ID NO: 1021057 - DNA, 11 bp, Homo sapiens
tgctgccctgt

SEQ ID NO: 1021058 - DNA, 13 bp, Homo sapiens
tgctgcctcccca

SEQ ID NO: 1021059 - DNA, 20 bp, Homo sapiens
tgctgcctctgtggaagaga

SEQ ID NO: 1021060 - DNA, 14 bp, Homo sapiens
tgctgcctgagtca

SEQ ID NO: 1021061 - DNA, 13 bp, Homo sapiens
tgctgcctggcac

SEQ ID NO: 1021062 - DNA, 13 bp, Homo sapiens
tgctgcctggcca

SEQ ID NO: 1021063 - DNA, 20 bp, Homo sapiens
tgctgcctggccctccccac

SEQ ID NO: 1021064 - DNA, 13 bp, Homo sapiens
tgctgcctgtccc

SEQ ID NO: 1021065 - DNA, 15 bp, Homo sapiens
tgctgcctgtcccca

SEQ ID NO: 1021066 - DNA, 16 bp, Homo sapiens
tgctgcgcctgcaggc

SEQ ID NO: 1021067 - DNA, 18 bp, Homo sapiens
tgctgcgcctgcaggcag

SEQ ID NO: 1021068 - DNA, 19 bp, Homo sapiens
tgctgcgcctgcaggcaga

SEQ ID NO: 1021069 - DNA, 22 bp, Homo sapiens
tgctgcgcctgcaggcagagct

SEQ ID NO: 1021070 - DNA, 23 bp, Homo sapiens
tgctgcggggccttttgcccgga

SEQ ID NO: 1021071 - DNA, 14 bp, Homo sapiens
tgctgcgtccccac

SEQ ID NO: 1021072 - DNA, 22 bp, Homo sapiens
tgctgcgtccccactcccttgg

SEQ ID NO: 1021073 - DNA, 23 bp, Homo sapiens
tgctgctaaagggagaaatgcca

SEQ ID NO: 1021074 - DNA, 20 bp, Homo sapiens
tgctgctaccgccctgggct

SEQ ID NO: 1021075 - DNA, 22 bp, Homo sapiens
tgctgctaccgccctgggctgg

SEQ ID NO: 1021076 - DNA, 14 bp, Homo sapiens
tgctgctatgaaaa

SEQ ID NO: 1021077 - DNA, 21 bp, Homo sapiens
tgctgctatgaaaatgagcat

SEQ ID NO: 1021078 - DNA, 18 bp, Homo sapiens
tgctgctattgctgtctg

SEQ ID NO: 1021079 - DNA, 23 bp, Homo sapiens
tgctgctccggtttgggctgtct

SEQ ID NO: 1021080 - DNA, 19 bp, Homo sapiens
tgctgctcctctttcccct

SEQ ID NO: 1021081 - DNA, 21 bp, Homo sapiens
tgctgctcctctttcccctcc

SEQ ID NO: 1021082 - DNA, 14 bp, Homo sapiens
tgctgctgaagaga

SEQ ID NO: 1021083 - DNA, 18 bp, Homo sapiens
tgctgctgccccagcgtc

SEQ ID NO: 1021084 - DNA, 10 bp, Homo sapiens
tgctgctgct

SEQ ID NO: 1021085 - DNA, 22 bp, Homo sapiens
tgctgctgctattgctgtctgg

SEQ ID NO: 1021086 - DNA, 21 bp, Homo sapiens
tgctgctggccaaatagcaaa

SEQ ID NO: 1021087 - DNA, 9 bp, Homo sapiens
tgctgctgt

SEQ ID NO: 1021088 - DNA, 23 bp, Homo sapiens
tgctgctgtaactgctgagccac

SEQ ID NO: 1021089 - DNA, 12 bp, Homo sapiens
tgctgctgtctt

SEQ ID NO: 1021090 - DNA, 13 bp, Homo sapiens
tgctgctgtgcct

SEQ ID NO: 1021091 - DNA, 15 bp, Homo sapiens
tgctgctgtgcctgc

SEQ ID NO: 1021092 - DNA, 13 bp, Homo sapiens
tgctgctgtgctt

SEQ ID NO: 1021093 - DNA, 20 bp, Homo sapiens
tgctgcttagacataacaaa

SEQ ID NO: 1021094 - DNA, 15 bp, Homo sapiens
tgctgcttccctctg

SEQ ID NO: 1021095 - DNA, 17 bp, Homo sapiens
tgctgcttccctctgcc

SEQ ID NO: 1021096 - DNA, 15 bp, Homo sapiens
tgctgcttctgctcc

SEQ ID NO: 1021097 - DNA, 20 bp, Homo sapiens
tgctgcttctgctccagccc

SEQ ID NO: 1021098 - DNA, 12 bp, Homo sapiens
tgctgcttgagg

SEQ ID NO: 1021099 - DNA, 23 bp, Homo sapiens
tgctgcttgtgcctcccttccca

SEQ ID NO: 1021100 - DNA, 23 bp, Homo sapiens
tgctgctttcccctgtggggatc

SEQ ID NO: 1021101 - DNA, 16 bp, Homo sapiens
tgctgctttgtccagg

SEQ ID NO: 1021102 - DNA, 17 bp, Homo sapiens
tgctgctttttggcaca

SEQ ID NO: 1021103 - DNA, 17 bp, Homo sapiens
tgctggaaaccacactt

SEQ ID NO: 1021104 - DNA, 18 bp, Homo sapiens
tgctggaaaccacacttc

SEQ ID NO: 1021105 - DNA, 14 bp, Homo sapiens
tgctggaagcccag

SEQ ID NO: 1021106 - DNA, 15 bp, Homo sapiens
tgctggaagcccagc

SEQ ID NO: 1021107 - DNA, 14 bp, Homo sapiens
tgctggaagtctcc

SEQ ID NO: 1021108 - DNA, 23 bp, Homo sapiens
tgctggacatgagatggagaggc

SEQ ID NO: 1021109 - DNA, 18 bp, Homo sapiens
tgctggaccagctggcct

SEQ ID NO: 1021110 - DNA, 21 bp, Homo sapiens
tgctggaccagctggcctggg

SEQ ID NO: 1021111 - DNA, 20 bp, Homo sapiens
tgctggacggggactgggga

SEQ ID NO: 1021112 - DNA, 21 bp, Homo sapiens
tgctggacggggactggggat

SEQ ID NO: 1021113 - DNA, 21 bp, Homo sapiens
tgctggactggaggcccctgg

SEQ ID NO: 1021114 - DNA, 19 bp, Homo sapiens
tgctggactgtcatagaaa

SEQ ID NO: 1021115 - DNA, 20 bp, Homo sapiens
tgctggactttaaaaaaaca

SEQ ID NO: 1021116 - DNA, 13 bp, Homo sapiens
tgctggagaggtt

SEQ ID NO: 1021117 - DNA, 20 bp, Homo sapiens
tgctggaggaggggaagctg

SEQ ID NO: 1021118 - DNA, 21 bp, Homo sapiens
tgctggaggaggggaagctgg

SEQ ID NO: 1021119 - DNA, 16 bp, Homo sapiens
tgctggaggcctcagg

SEQ ID NO: 1021120 - DNA, 17 bp, Homo sapiens
tgctggaggcctcaggt

SEQ ID NO: 1021121 - DNA, 20 bp, Homo sapiens
tgctggaggcctcaggtgct

SEQ ID NO: 1021122 - DNA, 16 bp, Homo sapiens
tgctggagggaggctg

SEQ ID NO: 1021123 - DNA, 21 bp, Homo sapiens
tgctggaggggctgtcctcct

SEQ ID NO: 1021124 - DNA, 22 bp, Homo sapiens
tgctggaggggctgtcctcctt

SEQ ID NO: 1021125 - DNA, 12 bp, Homo sapiens
tgctggagtcca

SEQ ID NO: 1021126 - DNA, 14 bp, Homo sapiens
tgctggagtgcagt

SEQ ID NO: 1021127 - DNA, 16 bp, Homo sapiens
tgctggatactggaca

SEQ ID NO: 1021128 - DNA, 15 bp, Homo sapiens
tgctggatgggactc

SEQ ID NO: 1021129 - DNA, 16 bp, Homo sapiens
tgctggattaatgttt

SEQ ID NO: 1021130 - DNA, 14 bp, Homo sapiens
tgctggcagggcca

SEQ ID NO: 1021131 - DNA, 17 bp, Homo sapiens
tgctggcagggccaggg

SEQ ID NO: 1021132 - DNA, 22 bp, Homo sapiens
tgctggcagggccagggcaatg

SEQ ID NO: 1021133 - DNA, 16 bp, Homo sapiens
tgctggcatcaggtct

SEQ ID NO: 1021134 - DNA, 18 bp, Homo sapiens
tgctggcatcaggtctgg

SEQ ID NO: 1021135 - DNA, 18 bp, Homo sapiens
tgctggccaaatagcaaa

SEQ ID NO: 1021136 - DNA, 19 bp, Homo sapiens
tgctggccaaatagcaaag

SEQ ID NO: 1021137 - DNA, 20 bp, Homo sapiens
tgctggccaaatagcaaaga

SEQ ID NO: 1021138 - DNA, 13 bp, Homo sapiens
tgctggccagcac

SEQ ID NO: 1021139 - DNA, 16 bp, Homo sapiens
tgctggccagcaccct

SEQ ID NO: 1021140 - DNA, 13 bp, Homo sapiens
tgctggcccctca

SEQ ID NO: 1021141 - DNA, 11 bp, Homo sapiens
ggtcccagtgg

SEQ ID NO: 1021142 - DNA, 18 bp, Homo sapiens
ggtcccagtgggaggggc

SEQ ID NO: 1021143 - DNA, 19 bp, Homo sapiens
ggtcccagtgggaggggca

SEQ ID NO: 1021144 - DNA, 23 bp, Homo sapiens
ggtcccagtgggaggggcaggct

SEQ ID NO: 1021145 - DNA, 23 bp, Homo sapiens
ggtcccagttttgttgccccaga

SEQ ID NO: 1021146 - DNA, 14 bp, Homo sapiens
ggtcccatccaggc

SEQ ID NO: 1021147 - DNA, 17 bp, Homo sapiens
tgctggccttggtatgt

SEQ ID NO: 1021148 - DNA, 13 bp, Homo sapiens
tgctggcgacact

SEQ ID NO: 1021149 - DNA, 18 bp, Homo sapiens
tgctggcgacactcaggg

SEQ ID NO: 1021150 - DNA, 13 bp, Homo sapiens
tgctggctctgag

SEQ ID NO: 1021151 - DNA, 15 bp, Homo sapiens
tgctggctctgagaa

SEQ ID NO: 1021152 - DNA, 19 bp, Homo sapiens
tgctggctgacctgggccc

SEQ ID NO: 1021153 - DNA, 21 bp, Homo sapiens
tgctggctgcccagacccctc

SEQ ID NO: 1021154 - DNA, 13 bp, Homo sapiens
tgctggctgcctt

SEQ ID NO: 1021155 - DNA, 19 bp, Homo sapiens
tgctggcttttcaccccag

SEQ ID NO: 1021156 - DNA, 23 bp, Homo sapiens
tgctggcttttcaccccagagga

SEQ ID NO: 1021157 - DNA, 16 bp, Homo sapiens
tgctgggaaatgcaga

SEQ ID NO: 1021158 - DNA, 17 bp, Homo sapiens
tgctgggaaatgcagaa

SEQ ID NO: 1021159 - DNA, 19 bp, Homo sapiens
tgctgggaacctagcacac

SEQ ID NO: 1021160 - DNA, 15 bp, Homo sapiens
tgctgggaagagctc

SEQ ID NO: 1021161 - DNA, 21 bp, Homo sapiens
tgctgggacgatcgcccaggc

SEQ ID NO: 1021162 - DNA, 16 bp, Homo sapiens
tgctgggactcagcct

SEQ ID NO: 1021163 - DNA, 23 bp, Homo sapiens
tgctgggactcagccttcagaca

SEQ ID NO: 1021164 - DNA, 15 bp, Homo sapiens
tgctgggactgagcc

SEQ ID NO: 1021165 - DNA, 20 bp, Homo sapiens
tgctgggactgagccagtcc

SEQ ID NO: 1021166 - DNA, 15 bp, Homo sapiens
tgctgggactggcca

SEQ ID NO: 1021167 - DNA, 17 bp, Homo sapiens
tgctgggactggccagg

SEQ ID NO: 1021168 - DNA, 21 bp, Homo sapiens
tgctgggagctgaaaaatcac

SEQ ID NO: 1021169 - DNA, 16 bp, Homo sapiens
tgctgggatttccaac

SEQ ID NO: 1021170 - DNA, 17 bp, Homo sapiens
tgctgggcactgctcca

SEQ ID NO: 1021171 - DNA, 15 bp, Homo sapiens
tgctgggcagcccgc

SEQ ID NO: 1021172 - DNA, 22 bp, Homo sapiens
tgctgggcatactttctctcta

SEQ ID NO: 1021173 - DNA, 14 bp, Homo sapiens
tgctgggccactgg

SEQ ID NO: 1021174 - DNA, 13 bp, Homo sapiens
tgctgggccaggg

SEQ ID NO: 1021175 - DNA, 15 bp, Homo sapiens
tgctgggcccccagc

SEQ ID NO: 1021176 - DNA, 18 bp, Homo sapiens
tgctgggcggctgtgctt

SEQ ID NO: 1021177 - DNA, 21 bp, Homo sapiens
tgctgggcgtgtgtgacactg

SEQ ID NO: 1021178 - DNA, 15 bp, Homo sapiens
tgctgggctctccac

SEQ ID NO: 1021179 - DNA, 18 bp, Homo sapiens
tgctgggctctccacctc

SEQ ID NO: 1021180 - DNA, 20 bp, Homo sapiens
tgctgggctctccacctcag

SEQ ID NO: 1021181 - DNA, 23 bp, Homo sapiens
tgctgggctctccacctcagcct

SEQ ID NO: 1021182 - DNA, 19 bp, Homo sapiens
tgctgggctgacggtgcag

SEQ ID NO: 1021183 - DNA, 24 bp, Homo sapiens
tgctgggctgacggtgcagtctgg

SEQ ID NO: 1021184 - DNA, 16 bp, Homo sapiens
tgctgggctgggccct

SEQ ID NO: 1021185 - DNA, 13 bp, Homo sapiens
tgctggggaaggg

SEQ ID NO: 1021186 - DNA, 17 bp, Homo sapiens
tgctggggagtccctgc

SEQ ID NO: 1021187 - DNA, 23 bp, Homo sapiens
tgctggggcaagtccctgactct

SEQ ID NO: 1021188 - DNA, 19 bp, Homo sapiens
tgctggggcatgtgtgcct

SEQ ID NO: 1021189 - DNA, 11 bp, Homo sapiens
tgctggggcca

SEQ ID NO: 1021190 - DNA, 13 bp, Homo sapiens
tgctggggccagc

SEQ ID NO: 1021191 - DNA, 14 bp, Homo sapiens
tgctggggccaggg

SEQ ID NO: 1021192 - DNA, 15 bp, Homo sapiens
tgctggggccagggc

SEQ ID NO: 1021193 - DNA, 18 bp, Homo sapiens
tgctggggccagggcaga

SEQ ID NO: 1021194 - DNA, 17 bp, Homo sapiens
tgctggggcctcagacg

SEQ ID NO: 1021195 - DNA, 18 bp, Homo sapiens
tgctggggcctcagacga

SEQ ID NO: 1021196 - DNA, 10 bp, Homo sapiens
tgctggggct

SEQ ID NO: 1021197 - DNA, 15 bp, Homo sapiens
tgctgggggaatgag

SEQ ID NO: 1021198 - DNA, 20 bp, Homo sapiens
tgctgggggaatgagcccag

SEQ ID NO: 1021199 - DNA, 21 bp, Homo sapiens
tgctgggggagccctgggttc

SEQ ID NO: 1021200 - DNA, 13 bp, Homo sapiens
tgctgggggaggc

SEQ ID NO: 1021201 - DNA, 14 bp, Homo sapiens
tgctgggggcacag

SEQ ID NO: 1021202 - DNA, 20 bp, Homo sapiens
tgctgggggcacagctgtct

SEQ ID NO: 1021203 - DNA, 21 bp, Homo sapiens
tgctgggggcacagctgtctg

SEQ ID NO: 1021204 - DNA, 22 bp, Homo sapiens
tgctgggggcacagctgtctgc

SEQ ID NO: 1021205 - DNA, 18 bp, Homo sapiens
tgctggggtacacagtga

SEQ ID NO: 1021206 - DNA, 19 bp, Homo sapiens
tgctggggtcaaggcagta

SEQ ID NO: 1021207 - DNA, 15 bp, Homo sapiens
tgctggggtccaggg

SEQ ID NO: 1021208 - DNA, 17 bp, Homo sapiens
tgctggggtccagggct

SEQ ID NO: 1021209 - DNA, 16 bp, Homo sapiens
tgctgggtaaactgtg

SEQ ID NO: 1021210 - DNA, 22 bp, Homo sapiens
tgctgggtacctggtccccact

SEQ ID NO: 1021211 - DNA, 21 bp, Homo sapiens
tgctgggtataagcagagagg

SEQ ID NO: 1021212 - DNA, 12 bp, Homo sapiens
tgctgggtccca

SEQ ID NO: 1021213 - DNA, 14 bp, Homo sapiens
tgctgggttggtgc

SEQ ID NO: 1021214 - DNA, 18 bp, Homo sapiens
tgctgggttggtgcacag

SEQ ID NO: 1021215 - DNA, 23 bp, Homo sapiens
tgctgggttggtgcacagtgatt

SEQ ID NO: 1021216 - DNA, 16 bp, Homo sapiens
tgctggtaacagtggc

SEQ ID NO: 1021217 - DNA, 19 bp, Homo sapiens
tgctggtagagacccccag

SEQ ID NO: 1021218 - DNA, 14 bp, Homo sapiens
tgctggtatttcta

SEQ ID NO: 1021219 - DNA, 16 bp, Homo sapiens
tgctggtatttctaat

SEQ ID NO: 1021220 - DNA, 14 bp, Homo sapiens
tgctggtcagagag

SEQ ID NO: 1021221 - DNA, 15 bp, Homo sapiens
tgctggtcagagaga

SEQ ID NO: 1021222 - DNA, 21 bp, Homo sapiens
tgctggtcagagagacctcat

SEQ ID NO: 1021223 - DNA, 13 bp, Homo sapiens
tgctggtcctagg

SEQ ID NO: 1021224 - DNA, 19 bp, Homo sapiens
tgctggtgaacactgtgac

SEQ ID NO: 1021225 - DNA, 23 bp, Homo sapiens
tgctggttgtcatttttgcagta

SEQ ID NO: 1021226 - DNA, 16 bp, Homo sapiens
tgctggtttttcagtt

SEQ ID NO: 1021227 - DNA, 17 bp, Homo sapiens
tgctgtaaaatttgtgt

SEQ ID NO: 1021228 - DNA, 21 bp, Homo sapiens
tgctgtaaaatttgtgtaaat

SEQ ID NO: 1021229 - DNA, 20 bp, Homo sapiens
tgctgtaaataaatgcttta

SEQ ID NO: 1021230 - DNA, 14 bp, Homo sapiens
tgctgtaaataagc

SEQ ID NO: 1021231 - DNA, 16 bp, Homo sapiens
tgctgtaactgctgag

SEQ ID NO: 1021232 - DNA, 17 bp, Homo sapiens
tgctgtaacttaaaata

SEQ ID NO: 1021233 - DNA, 14 bp, Homo sapiens
tgctgtaatattgt

SEQ ID NO: 1021234 - DNA, 20 bp, Homo sapiens
tgctgtacccttccacctcc

SEQ ID NO: 1021235 - DNA, 21 bp, Homo sapiens
tgctgtacccttccacctcct

SEQ ID NO: 1021236 - DNA, 16 bp, Homo sapiens
tgctgtacgtactgca

SEQ ID NO: 1021237 - DNA, 18 bp, Homo sapiens
tgctgtactcttgctgat

SEQ ID NO: 1021238 - DNA, 14 bp, Homo sapiens
tgctgtacttgtgg

SEQ ID NO: 1021239 - DNA, 17 bp, Homo sapiens
tgctgtagcctattttt

SEQ ID NO: 1021240 - DNA, 21 bp, Homo sapiens
tgctgtatatttgtgatagca

SEQ ID NO: 1021241 - DNA, 20 bp, Homo sapiens
tgctgtatgctgatcatcgc

SEQ ID NO: 1021242 - DNA, 14 bp, Homo sapiens
tgctgtatggccca

SEQ ID NO: 1021243 - DNA, 20 bp, Homo sapiens
tgctgtatggcccaggcagc

SEQ ID NO: 1021244 - DNA, 22 bp, Homo sapiens
tgctgtatggcccaggcagcct

SEQ ID NO: 1021245 - DNA, 18 bp, Homo sapiens
tgctgtatttatagtaac

SEQ ID NO: 1021246 - DNA, 13 bp, Homo sapiens
tgctgtatttctt

SEQ ID NO: 1021247 - DNA, 17 bp, Homo sapiens
tgctgtatttctttgta

SEQ ID NO: 1021248 - DNA, 16 bp, Homo sapiens
tgctgtcaacttccca

SEQ ID NO: 1021249 - DNA, 22 bp, Homo sapiens
tgctgtcaacttcccatctggc

SEQ ID NO: 1021250 - DNA, 21 bp, Homo sapiens
tgctgtcaataaatgacaccc

SEQ ID NO: 1021251 - DNA, 23 bp, Homo sapiens
tgctgtcaataaatgacacccag

SEQ ID NO: 1021252 - DNA, 16 bp, Homo sapiens
tgctgtcactggcaga

SEQ ID NO: 1021253 - DNA, 18 bp, Homo sapiens
tgctgtcactggcagagc

SEQ ID NO: 1021254 - DNA, 22 bp, Homo sapiens
tgctgtcatgaaatcagcaaga

SEQ ID NO: 1021255 - DNA, 13 bp, Homo sapiens
tgctgtccacatg

SEQ ID NO: 1021256 - DNA, 21 bp, Homo sapiens
tgctgtccacatgacctccat

SEQ ID NO: 1021257 - DNA, 21 bp, Homo sapiens
tgctgtccaggcagctccctc

SEQ ID NO: 1021258 - DNA, 23 bp, Homo sapiens
tgctgtccaggcagctccctcct

SEQ ID NO: 1021259 - DNA, 20 bp, Homo sapiens
tgctgtccctgcactgtgcc

SEQ ID NO: 1021260 - DNA, 21 bp, Homo sapiens
tgctgtccctgcactgtgccc

SEQ ID NO: 1021261 - DNA, 14 bp, Homo sapiens
tgctgtcctcaggt

SEQ ID NO: 1021262 - DNA, 15 bp, Homo sapiens
tgctgtccttttagg

SEQ ID NO: 1021263 - DNA, 22 bp, Homo sapiens
tgctgtcgggaccacatctgtc

SEQ ID NO: 1021264 - DNA, 17 bp, Homo sapiens
tgctgtctaacctgtga

SEQ ID NO: 1021265 - DNA, 18 bp, Homo sapiens
tgctgtctaacctgtgac

SEQ ID NO: 1021266 - DNA, 15 bp, Homo sapiens
tgctgtctctctggg

SEQ ID NO: 1021267 - DNA, 18 bp, Homo sapiens
tgctgtctctctgggctg

SEQ ID NO: 1021268 - DNA, 19 bp, Homo sapiens
ggtggcaatgcttaaacta

SEQ ID NO: 1021269 - DNA, 12 bp, Homo sapiens
ggtggcaccaga

SEQ ID NO: 1021270 - DNA, 22 bp, Homo sapiens
ggtggcacctgtttcccgggca

SEQ ID NO: 1021271 - DNA, 12 bp, Homo sapiens
ggtggcagacta

SEQ ID NO: 1021272 - DNA, 15 bp, Homo sapiens
ggtggcaggaccagg

SEQ ID NO: 1021273 - DNA, 20 bp, Homo sapiens
ggtggcaggcacacagcagc

SEQ ID NO: 1021274 - DNA, 22 bp, Homo sapiens
ggtggcaggcacacagcagccc

SEQ ID NO: 1021275 - DNA, 22 bp, Homo sapiens
ggtggcaggtgggggtgggctg

SEQ ID NO: 1021276 - DNA, 17 bp, Homo sapiens
ggtggcatcccagtggc

SEQ ID NO: 1021277 - DNA, 23 bp, Homo sapiens
ggtggcatgtgcctatagtccca

SEQ ID NO: 1021278 - DNA, 13 bp, Homo sapiens
ggtggccacagcg

SEQ ID NO: 1021279 - DNA, 17 bp, Homo sapiens
ggtggccacagtgtcac

SEQ ID NO: 1021280 - DNA, 20 bp, Homo sapiens
ggtggccaccgggggtggct

SEQ ID NO: 1021281 - DNA, 16 bp, Homo sapiens
ggtggccatccctggg

SEQ ID NO: 1021282 - DNA, 19 bp, Homo sapiens
ggtggccatccctgggccc

SEQ ID NO: 1021283 - DNA, 21 bp, Homo sapiens
ggtggccatccctgggcccct

SEQ ID NO: 1021284 - DNA, 19 bp, Homo sapiens
ggtggcccacgcctgtaat

SEQ ID NO: 1021285 - DNA, 14 bp, Homo sapiens
ggtggcccaggccc

SEQ ID NO: 1021286 - DNA, 22 bp, Homo sapiens
ggtggcccctgctgtctctctg

SEQ ID NO: 1021287 - DNA, 18 bp, Homo sapiens
ggtggcccgacagcctgg

SEQ ID NO: 1021288 - DNA, 20 bp, Homo sapiens
ggtggcccgacagcctggca

SEQ ID NO: 1021289 - DNA, 20 bp, Homo sapiens
ggtggccctgactgtcaggg

SEQ ID NO: 1021290 - DNA, 23 bp, Homo sapiens
ggtggccgcccctgaggcttcac

SEQ ID NO: 1021291 - DNA, 22 bp, Homo sapiens
ggtggccggcttgctgctccgg

SEQ ID NO: 1021292 - DNA, 22 bp, Homo sapiens
ggtggcgctttctcctgtgccc

SEQ ID NO: 1021293 - DNA, 22 bp, Homo sapiens
ggtggcggctgcacaacagccc

SEQ ID NO: 1021294 - DNA, 21 bp, Homo sapiens
ggtggcgggcgcctgtaatcc

SEQ ID NO: 1021295 - DNA, 22 bp, Homo sapiens
ggtggcgttatggcagcccggc

SEQ ID NO: 1021296 - DNA, 20 bp, Homo sapiens
ggtggctagtcaagctcctc

SEQ ID NO: 1021297 - DNA, 15 bp, Homo sapiens
ggtggctcactactg

SEQ ID NO: 1021298 - DNA, 13 bp, Homo sapiens
ggtggctctgggg

SEQ ID NO: 1021299 - DNA, 15 bp, Homo sapiens
ggtggctctggggta

SEQ ID NO: 1021300 - DNA, 13 bp, Homo sapiens
ggtggctgaccca

SEQ ID NO: 1021301 - DNA, 19 bp, Homo sapiens
ggtggctgacccagtccct

SEQ ID NO: 1021302 - DNA, 22 bp, Homo sapiens
ggtggctgacccagtccctggg

SEQ ID NO: 1021303 - DNA, 20 bp, Homo sapiens
ggtggctgccccggcctcct

SEQ ID NO: 1021304 - DNA, 14 bp, Homo sapiens
ggtggctgcctttg

SEQ ID NO: 1021305 - DNA, 17 bp, Homo sapiens
ggtggctggtgagaccc

SEQ ID NO: 1021306 - DNA, 22 bp, Homo sapiens
ggtggctgtgacaaccctggcc

SEQ ID NO: 1021307 - DNA, 13 bp, Homo sapiens
ggtggctgtgtct

SEQ ID NO: 1021308 - DNA, 21 bp, Homo sapiens
ggtggctttcaaggctggggc

SEQ ID NO: 1021309 - DNA, 14 bp, Homo sapiens
ggtggcttttgcgg

SEQ ID NO: 1021310 - DNA, 23 bp, Homo sapiens
ggtggcttttgcggttcaggaaa

SEQ ID NO: 1021311 - DNA, 22 bp, Homo sapiens
ggtgggaaatggtatgagctga

SEQ ID NO: 1021312 - DNA, 20 bp, Homo sapiens
ggtgggacagggagggccgg

SEQ ID NO: 1021313 - DNA, 15 bp, Homo sapiens
ggtgggagagcccag

SEQ ID NO: 1021314 - DNA, 22 bp, Homo sapiens
ggtgggaggaaagggcctggcc

SEQ ID NO: 1021315 - DNA, 14 bp, Homo sapiens
ggtgggaggccagg

SEQ ID NO: 1021316 - DNA, 12 bp, Homo sapiens
ggtgggagggcg

SEQ ID NO: 1021317 - DNA, 17 bp, Homo sapiens
ggtgggagtaacagggc

SEQ ID NO: 1021318 - DNA, 18 bp, Homo sapiens
ggtgggagtaacagggca

SEQ ID NO: 1021319 - DNA, 19 bp, Homo sapiens
ggtgggagtgtgtctgctg

SEQ ID NO: 1021320 - DNA, 17 bp, Homo sapiens
ggtgggatggaggagaa

SEQ ID NO: 1021321 - DNA, 13 bp, Homo sapiens
ggtgggcagggag

SEQ ID NO: 1021322 - DNA, 14 bp, Homo sapiens
ggtgggcaggtggt

SEQ ID NO: 1021323 - DNA, 16 bp, Homo sapiens
ggtgggccagcccctc

SEQ ID NO: 1021324 - DNA, 14 bp, Homo sapiens
ggtgggccaggctg

SEQ ID NO: 1021325 - DNA, 22 bp, Homo sapiens
ggtgggcccagaactgccccca

SEQ ID NO: 1021326 - DNA, 23 bp, Homo sapiens
ggtgggcccaggaccagctgggg

SEQ ID NO: 1021327 - DNA, 13 bp, Homo sapiens
ggtgggcctgact

SEQ ID NO: 1021328 - DNA, 17 bp, Homo sapiens
ggtgggcctggcctgag

SEQ ID NO: 1021329 - DNA, 13 bp, Homo sapiens
ggtgggctgagcc

SEQ ID NO: 1021330 - DNA, 14 bp, Homo sapiens
ggtgggctgcctgc

SEQ ID NO: 1021331 - DNA, 21 bp, Homo sapiens
ggtgggctggggactctggca

SEQ ID NO: 1021332 - DNA, 14 bp, Homo sapiens
ggtgggctggggct

SEQ ID NO: 1021333 - DNA, 19 bp, Homo sapiens
ggtgggctggggctgctcc

SEQ ID NO: 1021334 - DNA, 12 bp, Homo sapiens
ggtggggaaagg

SEQ ID NO: 1021335 - DNA, 23 bp, Homo sapiens
ggtggggaggccctgcctgaccc

SEQ ID NO: 1021336 - DNA, 14 bp, Homo sapiens
ggtggggaggggcg

SEQ ID NO: 1021337 - DNA, 13 bp, Homo sapiens
ggtggggccctgc

SEQ ID NO: 1021338 - DNA, 12 bp, Homo sapiens
ggtggggcctca

SEQ ID NO: 1021339 - DNA, 15 bp, Homo sapiens
ggtggggcctcagcc

SEQ ID NO: 1021340 - DNA, 12 bp, Homo sapiens
ggtggggctcgt

SEQ ID NO: 1021341 - DNA, 19 bp, Homo sapiens
ggtgggggaggagcctctg

SEQ ID NO: 1021342 - DNA, 14 bp, Homo sapiens
ggtgggggagggag

SEQ ID NO: 1021343 - DNA, 14 bp, Homo sapiens
ggtgggggccaggc

SEQ ID NO: 1021344 - DNA, 15 bp, Homo sapiens
ggtgggggccaggcc

SEQ ID NO: 1021345 - DNA, 13 bp, Homo sapiens
ggtgggggcctcg

SEQ ID NO: 1021346 - DNA, 16 bp, Homo sapiens
ggtgggggctggaggt

SEQ ID NO: 1021347 - DNA, 16 bp, Homo sapiens
ggtgggggtggaggct

SEQ ID NO: 1021348 - DNA, 22 bp, Homo sapiens
ggtgggggttctggcaggacct

SEQ ID NO: 1021349 - DNA, 24 bp, Homo sapiens
ggtgggggttctggcaggacctgc

SEQ ID NO: 1021350 - DNA, 18 bp, Homo sapiens
ggtggggtgatggccaga

SEQ ID NO: 1021351 - DNA, 14 bp, Homo sapiens
ggtggggtgggggt

SEQ ID NO: 1021352 - DNA, 16 bp, Homo sapiens
ggtgggtctgagctgg

SEQ ID NO: 1021353 - DNA, 18 bp, Homo sapiens
ggtgggtctgagctggac

SEQ ID NO: 1021354 - DNA, 13 bp, Homo sapiens
ggtgggtgctcag

SEQ ID NO: 1021355 - DNA, 14 bp, Homo sapiens
ggtgggtgggcctg

SEQ ID NO: 1021356 - DNA, 16 bp, Homo sapiens
ggtgggtggtggggag

SEQ ID NO: 1021357 - DNA, 16 bp, Homo sapiens
ggtgggttttcttccc

SEQ ID NO: 1021358 - DNA, 13 bp, Homo sapiens
ggtggtaaagaaa

SEQ ID NO: 1021359 - DNA, 16 bp, Homo sapiens
ggtggtaccctctgga

SEQ ID NO: 1021360 - DNA, 14 bp, Homo sapiens
ggtggtaggcctat

SEQ ID NO: 1021361 - DNA, 14 bp, Homo sapiens
ggtggtcagcccta

SEQ ID NO: 1021362 - DNA, 18 bp, Homo sapiens
ggtggtcctgagacctga

SEQ ID NO: 1021363 - DNA, 18 bp, Homo sapiens
ggtggtctgaatgttctg

SEQ ID NO: 1021364 - DNA, 17 bp, Homo sapiens
ggtggtcttccttctac

SEQ ID NO: 1021365 - DNA, 20 bp, Homo sapiens
ggtggtgctgggactgagcc

SEQ ID NO: 1021366 - DNA, 14 bp, Homo sapiens
ggtggtggatctgt

SEQ ID NO: 1021367 - DNA, 13 bp, Homo sapiens
ggtggtggggagg

SEQ ID NO: 1021368 - DNA, 14 bp, Homo sapiens
ggtggtgggggtca

SEQ ID NO: 1021369 - DNA, 19 bp, Homo sapiens
ggtggtggtattctgtcat

SEQ ID NO: 1021370 - DNA, 23 bp, Homo sapiens
ggtggtgtcagaccctggaggcc

SEQ ID NO: 1021371 - DNA, 16 bp, Homo sapiens
ggtggttaaggccagg

SEQ ID NO: 1021372 - DNA, 21 bp, Homo sapiens
ggtggttatggagagggtgtc

SEQ ID NO: 1021373 - DNA, 21 bp, Homo sapiens
ggtggttgctgttttcctccc

SEQ ID NO: 1021374 - DNA, 18 bp, Homo sapiens
ggtggttttcagagcagg

SEQ ID NO: 1021375 - DNA, 20 bp, Homo sapiens
ggtggttttcagagcaggag

SEQ ID NO: 1021376 - DNA, 21 bp, Homo sapiens
ggtggttttcagagcaggagg

SEQ ID NO: 1021377 - DNA, 15 bp, Homo sapiens
ggtggttttctgttc

SEQ ID NO: 1021378 - DNA, 12 bp, Homo sapiens
ggtggtttttca

SEQ ID NO: 1021379 - DNA, 17 bp, Homo sapiens
ggtggttttttccccct

SEQ ID NO: 1021380 - DNA, 13 bp, Homo sapiens
ggtgtaaacacat

SEQ ID NO: 1021381 - DNA, 14 bp, Homo sapiens
ggtgtaaacacatc

SEQ ID NO: 1021382 - DNA, 20 bp, Homo sapiens
ggtgtactgggttaatggct

SEQ ID NO: 1021383 - DNA, 14 bp, Homo sapiens
ggtgtagaaaaggt

SEQ ID NO: 1021384 - DNA, 23 bp, Homo sapiens
ggtgtagctcttagaggaaggag

SEQ ID NO: 1021385 - DNA, 20 bp, Homo sapiens
ggtgtaggggccacctcctc

SEQ ID NO: 1021386 - DNA, 21 bp, Homo sapiens
ggtgtatagtgttcacaaact

SEQ ID NO: 1021387 - DNA, 19 bp, Homo sapiens
ggtgtatatcatgaagcct

SEQ ID NO: 1021388 - DNA, 21 bp, Homo sapiens
ggtgtatcctggccctggggg

SEQ ID NO: 1021389 - DNA, 13 bp, Homo sapiens
ggtgtatttaaac

SEQ ID NO: 1021390 - DNA, 15 bp, Homo sapiens
ggttcatcagtgtta

SEQ ID NO: 1021391 - DNA, 22 bp, Homo sapiens
ggttcatcagtgttaaaaaatt

SEQ ID NO: 1021392 - DNA, 15 bp, Homo sapiens
ggttcatctgagcaa

SEQ ID NO: 1021393 - DNA, 21 bp, Homo sapiens
ggttcatgcttaataaacatg

SEQ ID NO: 1021394 - DNA, 16 bp, Homo sapiens
ggttcattattggaat

SEQ ID NO: 1021395 - DNA, 18 bp, Homo sapiens
ggttcattattggaatta

SEQ ID NO: 1021396 - DNA, 23 bp, Homo sapiens
ggttcatttcaaatacatctttg

SEQ ID NO: 1021397 - DNA, 23 bp, Homo sapiens
ggttccaaattatcctggtcttt

SEQ ID NO: 1021398 - DNA, 16 bp, Homo sapiens
ggttccaaccaggcag

SEQ ID NO: 1021399 - DNA, 16 bp, Homo sapiens
ggttcccaagctcaga

SEQ ID NO: 1021400 - DNA, 13 bp, Homo sapiens
ggttcccaaggac

SEQ ID NO: 1021401 - DNA, 14 bp, Homo sapiens
ggttcccaataaaa

SEQ ID NO: 1021402 - DNA, 20 bp, Homo sapiens
ggttcccaataaaagtgact

SEQ ID NO: 1021403 - DNA, 23 bp, Homo sapiens
ggttcccattttcgctttcctct

SEQ ID NO: 1021404 - DNA, 18 bp, Homo sapiens
ggttccccacacagggca

SEQ ID NO: 1021405 - DNA, 15 bp, Homo sapiens
ggttccccagagagc

SEQ ID NO: 1021406 - DNA, 23 bp, Homo sapiens
tgctttctgttgtcattgctgtt

SEQ ID NO: 1021407 - DNA, 16 bp, Homo sapiens
tgctttctgtttctta

SEQ ID NO: 1021408 - DNA, 15 bp, Homo sapiens
tgctttcttcctgca

SEQ ID NO: 1021409 - DNA, 18 bp, Homo sapiens
tgctttcttcctgcatag

SEQ ID NO: 1021410 - DNA, 15 bp, Homo sapiens
tgctttcttctttcc

SEQ ID NO: 1021411 - DNA, 22 bp, Homo sapiens
tgctttctttggcctacattct

SEQ ID NO: 1021412 - DNA, 18 bp, Homo sapiens
tgctttgaataaatgtgt

SEQ ID NO: 1021413 - DNA, 13 bp, Homo sapiens
tgctttgaatgca

SEQ ID NO: 1021414 - DNA, 22 bp, Homo sapiens
tgctttgatttacagcaagtag

SEQ ID NO: 1021415 - DNA, 19 bp, Homo sapiens
tgctttgatttttgaagtt

SEQ ID NO: 1021416 - DNA, 17 bp, Homo sapiens
tgctttgcacaggaaag

SEQ ID NO: 1021417 - DNA, 17 bp, Homo sapiens
tgctttgcattttctga

SEQ ID NO: 1021418 - DNA, 17 bp, Homo sapiens
tgctttgccaagttgct

SEQ ID NO: 1021419 - DNA, 24 bp, Homo sapiens
tgctttgccaagttgctgtcactg

SEQ ID NO: 1021420 - DNA, 15 bp, Homo sapiens
tgctttgccagagca

SEQ ID NO: 1021421 - DNA, 12 bp, Homo sapiens
tgctttgctctt

SEQ ID NO: 1021422 - DNA, 14 bp, Homo sapiens
tgctttgctcttgt

SEQ ID NO: 1021423 - DNA, 15 bp, Homo sapiens
tgctttgctgctatg

SEQ ID NO: 1021424 - DNA, 19 bp, Homo sapiens
tgctttgctttctgctcag

SEQ ID NO: 1021425 - DNA, 15 bp, Homo sapiens
tgctttgggaagccg

SEQ ID NO: 1021426 - DNA, 22 bp, Homo sapiens
tgctttgggagacagtctagga

SEQ ID NO: 1021427 - DNA, 17 bp, Homo sapiens
tgctttgggaggccaag

SEQ ID NO: 1021428 - DNA, 16 bp, Homo sapiens
tgctttgggctgccct

SEQ ID NO: 1021429 - DNA, 20 bp, Homo sapiens
tgctttgggctgccctggtg

SEQ ID NO: 1021430 - DNA, 17 bp, Homo sapiens
tgctttggggaaaaaga

SEQ ID NO: 1021431 - DNA, 12 bp, Homo sapiens
tgctttgtattg

SEQ ID NO: 1021432 - DNA, 13 bp, Homo sapiens
tgctttgtccagg

SEQ ID NO: 1021433 - DNA, 16 bp, Homo sapiens
tgctttgtctggcctc

SEQ ID NO: 1021434 - DNA, 20 bp, Homo sapiens
tgctttgtctggcctcacgt

SEQ ID NO: 1021435 - DNA, 14 bp, Homo sapiens
tgctttgtgaacaa

SEQ ID NO: 1021436 - DNA, 14 bp, Homo sapiens
tgctttgtgatttt

SEQ ID NO: 1021437 - DNA, 17 bp, Homo sapiens
tgctttgtgatttttgt

SEQ ID NO: 1021438 - DNA, 17 bp, Homo sapiens
tgctttgtgtgattgaa

SEQ ID NO: 1021439 - DNA, 14 bp, Homo sapiens
tgctttgtttggat

SEQ ID NO: 1021440 - DNA, 16 bp, Homo sapiens
tgcttttaattaaata

SEQ ID NO: 1021441 - DNA, 23 bp, Homo sapiens
tgcttttatatggcccagccttg

SEQ ID NO: 1021442 - DNA, 15 bp, Homo sapiens
tgcttttatattcta

SEQ ID NO: 1021443 - DNA, 23 bp, Homo sapiens
tgcttttcaccaaaatttctaca

SEQ ID NO: 1021444 - DNA, 15 bp, Homo sapiens
tgcttttcactactt

SEQ ID NO: 1021445 - DNA, 23 bp, Homo sapiens
tgcttttccaggatcctgcagga

SEQ ID NO: 1021446 - DNA, 13 bp, Homo sapiens
tgcttttccctct

SEQ ID NO: 1021447 - DNA, 17 bp, Homo sapiens
tgcttttccctttgtga

SEQ ID NO: 1021448 - DNA, 21 bp, Homo sapiens
tgcttttccctttgtgagtca

SEQ ID NO: 1021449 - DNA, 18 bp, Homo sapiens
tgcttttctgccctggct

SEQ ID NO: 1021450 - DNA, 15 bp, Homo sapiens
tgcttttctgtcctg

SEQ ID NO: 1021451 - DNA, 16 bp, Homo sapiens
tgcttttctgtcctgg

SEQ ID NO: 1021452 - DNA, 19 bp, Homo sapiens
tgcttttctgtcctgggca

SEQ ID NO: 1021453 - DNA, 15 bp, Homo sapiens
tgcttttgaaaaaca

SEQ ID NO: 1021454 - DNA, 12 bp, Homo sapiens
tgcttttgatgt

SEQ ID NO: 1021455 - DNA, 14 bp, Homo sapiens
tgcttttgctgctg

SEQ ID NO: 1021456 - DNA, 15 bp, Homo sapiens
tgcttttgtgagaaa

SEQ ID NO: 1021457 - DNA, 23 bp, Homo sapiens
tgcttttgttccaatgtcaatgt

SEQ ID NO: 1021458 - DNA, 17 bp, Homo sapiens
tgcttttgttgtgactt

SEQ ID NO: 1021459 - DNA, 12 bp, Homo sapiens
tgctttttagaa

SEQ ID NO: 1021460 - DNA, 19 bp, Homo sapiens
tgctttttatttctgcata

SEQ ID NO: 1021461 - DNA, 21 bp, Homo sapiens
tgctttttccaactcagaaat

SEQ ID NO: 1021462 - DNA, 22 bp, Homo sapiens
tgctttttcttgtttgtttaaa

SEQ ID NO: 1021463 - DNA, 19 bp, Homo sapiens
tgctttttgcgtacacaga

SEQ ID NO: 1021464 - DNA, 13 bp, Homo sapiens
tgctttttggaaa

SEQ ID NO: 1021465 - DNA, 19 bp, Homo sapiens
tgcttttttccaaaacaaa

SEQ ID NO: 1021466 - DNA, 19 bp, Homo sapiens
tgcttttttgaaagatgct

SEQ ID NO: 1021467 - DNA, 18 bp, Homo sapiens
tgctttttttcttaaaag

SEQ ID NO: 1021468 - DNA, 23 bp, Homo sapiens
tgctttttttgtgtgtatttgct

SEQ ID NO: 1021469 - DNA, 14 bp, Homo sapiens
tggaaaaaaacata

SEQ ID NO: 1021470 - DNA, 15 bp, Homo sapiens
tggaaaaaaacataa

SEQ ID NO: 1021471 - DNA, 21 bp, Homo sapiens
tggaaaaaaacataaaaagca

SEQ ID NO: 1021472 - DNA, 17 bp, Homo sapiens
tggaaaaaaatacaaaa

SEQ ID NO: 1021473 - DNA, 19 bp, Homo sapiens
tggaaaaaaatacaaaaag

SEQ ID NO: 1021474 - DNA, 21 bp, Homo sapiens
tggaaaaaagattctgtctta

SEQ ID NO: 1021475 - DNA, 20 bp, Homo sapiens
tggaaaaaccacccccaaat

SEQ ID NO: 1021476 - DNA, 17 bp, Homo sapiens
tggaaaaataaaactgt

SEQ ID NO: 1021477 - DNA, 14 bp, Homo sapiens
tggaaaaatagctc

SEQ ID NO: 1021478 - DNA, 13 bp, Homo sapiens
tggaaaaatagta

SEQ ID NO: 1021479 - DNA, 13 bp, Homo sapiens
tggaaaaatccag

SEQ ID NO: 1021480 - DNA, 15 bp, Homo sapiens
tggaaaaatccttga

SEQ ID NO: 1021481 - DNA, 13 bp, Homo sapiens
tggaaaaatgcca

SEQ ID NO: 1021482 - DNA, 11 bp, Homo sapiens
tggaaaaatgg

SEQ ID NO: 1021483 - DNA, 14 bp, Homo sapiens
tggaaaaatggttg

SEQ ID NO: 1021484 - DNA, 16 bp, Homo sapiens
tggaaaaatggttgat

SEQ ID NO: 1021485 - DNA, 19 bp, Homo sapiens
tggaaaaatggttgatgga

SEQ ID NO: 1021486 - DNA, 21 bp, Homo sapiens
tggaaaaatggttgatggaaa

SEQ ID NO: 1021487 - DNA, 23 bp, Homo sapiens
tggaaaaatggttgatggaaaat

SEQ ID NO: 1021488 - DNA, 18 bp, Homo sapiens
tggaaaacagaacactta

SEQ ID NO: 1021489 - DNA, 14 bp, Homo sapiens
tggaaaacctcctt

SEQ ID NO: 1021490 - DNA, 18 bp, Homo sapiens
tggaaaagaatccctgca

SEQ ID NO: 1021491 - DNA, 16 bp, Homo sapiens
tggaaaaggaagacta

SEQ ID NO: 1021492 - DNA, 18 bp, Homo sapiens
tggaaaaggaagactaga

SEQ ID NO: 1021493 - DNA, 22 bp, Homo sapiens
tggaaaaggaagactagaggct

SEQ ID NO: 1021494 - DNA, 18 bp, Homo sapiens
tggaaaagtgatgtattt

SEQ ID NO: 1021495 - DNA, 15 bp, Homo sapiens
tggaaaataaaaatg

SEQ ID NO: 1021496 - DNA, 24 bp, Homo sapiens
tggaaaatacctaattgtggatga

SEQ ID NO: 1021497 - DNA, 18 bp, Homo sapiens
tggaaaatgtatattttg

SEQ ID NO: 1021498 - DNA, 15 bp, Homo sapiens
tggaaaatgtgtctc

SEQ ID NO: 1021499 - DNA, 19 bp, Homo sapiens
tggaaaattttctccttgg

SEQ ID NO: 1021500 - DNA, 12 bp, Homo sapiens
tggaaacagcat

SEQ ID NO: 1021501 - DNA, 13 bp, Homo sapiens
tggaaacagcatg

SEQ ID NO: 1021502 - DNA, 14 bp, Homo sapiens
tggaaacagcatga

SEQ ID NO: 1021503 - DNA, 16 bp, Homo sapiens
tggaaacattacagtt

SEQ ID NO: 1021504 - DNA, 23 bp, Homo sapiens
tggaaacatttacaataaatatt

SEQ ID NO: 1021505 - DNA, 20 bp, Homo sapiens
tggaaacattttatactgta

SEQ ID NO: 1021506 - DNA, 21 bp, Homo sapiens
tggaaacattttatactgtac

SEQ ID NO: 1021507 - DNA, 22 bp, Homo sapiens
tggaaacattttatactgtaca

SEQ ID NO: 1021508 - DNA, 21 bp, Homo sapiens
tggaaaccacacttcttgaaa

SEQ ID NO: 1021509 - DNA, 22 bp, Homo sapiens
tggaaaccgtgtgtccagcatt

SEQ ID NO: 1021510 - DNA, 15 bp, Homo sapiens
tggaaacctgccctg

SEQ ID NO: 1021511 - DNA, 16 bp, Homo sapiens
tggaaacgcacttaca

SEQ ID NO: 1021512 - DNA, 18 bp, Homo sapiens
tggaagggttctggctgc

SEQ ID NO: 1021513 - DNA, 15 bp, Homo sapiens
tggaaggtctattgg

SEQ ID NO: 1021514 - DNA, 23 bp, Homo sapiens
tggaaggtgaggcgttctcctgc

SEQ ID NO: 1021515 - DNA, 20 bp, Homo sapiens
tggaaggtggaagttgcagt

SEQ ID NO: 1021516 - DNA, 22 bp, Homo sapiens
tggaagtatgtatattaaaaaa

SEQ ID NO: 1021517 - DNA, 14 bp, Homo sapiens
tggaagtcatgagc

SEQ ID NO: 1021518 - DNA, 18 bp, Homo sapiens
tggaagtgaaaactttgt

SEQ ID NO: 1021519 - DNA, 17 bp, Homo sapiens
tggaagtgcatctactt

SEQ ID NO: 1021520 - DNA, 17 bp, Homo sapiens
tggaagtggcagtgaaa

SEQ ID NO: 1021521 - DNA, 15 bp, Homo sapiens
tggaagttgtggata

SEQ ID NO: 1021522 - DNA, 13 bp, Homo sapiens
tggaagttttcag

SEQ ID NO: 1021523 - DNA, 15 bp, Homo sapiens
tggaagttttcagga

SEQ ID NO: 1021524 - DNA, 18 bp, Homo sapiens
tggaataaaaggcttgaa

SEQ ID NO: 1021525 - DNA, 22 bp, Homo sapiens
tggaataaaaggcttgaagctg

SEQ ID NO: 1021526 - DNA, 13 bp, Homo sapiens
tggaataaacagt

SEQ ID NO: 1021527 - DNA, 15 bp, Homo sapiens
tggaataaacattaa

SEQ ID NO: 1021528 - DNA, 19 bp, Homo sapiens
tggaataaacattaatttt

SEQ ID NO: 1021529 - DNA, 20 bp, Homo sapiens
tggaataaacattaattttg

SEQ ID NO: 1021530 - DNA, 21 bp, Homo sapiens
tggaataaagttctgttttct

SEQ ID NO: 1021531 - DNA, 17 bp, Homo sapiens
tggaataaagttgcaga

SEQ ID NO: 1021532 - DNA, 20 bp, Homo sapiens
tggaataacaactttcagtg

SEQ ID NO: 1021533 - DNA, 14 bp, Homo sapiens
tggaataacatgta

SEQ ID NO: 1021534 - DNA, 18 bp, Homo sapiens
tggaataagacagagacc

SEQ ID NO: 1021535 - DNA, 16 bp, Homo sapiens
tggaataatttctatt

SEQ ID NO: 1021536 - DNA, 16 bp, Homo sapiens
ggtttggccagggagg

SEQ ID NO: 1021537 - DNA, 21 bp, Homo sapiens
ggtttggccagggaggcgcag

SEQ ID NO: 1021538 - DNA, 19 bp, Homo sapiens
ggtttggcgggccaaggac

SEQ ID NO: 1021539 - DNA, 15 bp, Homo sapiens
ggtttggctgtgtct

SEQ ID NO: 1021540 - DNA, 17 bp, Homo sapiens
ggtttgggaaagatgga

SEQ ID NO: 1021541 - DNA, 12 bp, Homo sapiens
ggtttggggaga

SEQ ID NO: 1021542 - DNA, 17 bp, Homo sapiens
ggtttggggagaaataa

SEQ ID NO: 1021543 - DNA, 21 bp, Homo sapiens
ggtttggggccatggtggagg

SEQ ID NO: 1021544 - DNA, 17 bp, Homo sapiens
ggtttgggggcgccctc

SEQ ID NO: 1021545 - DNA, 20 bp, Homo sapiens
ggtttgggggcgccctctct

SEQ ID NO: 1021546 - DNA, 18 bp, Homo sapiens
ggtttgtggcgtctccct

SEQ ID NO: 1021547 - DNA, 19 bp, Homo sapiens
ggtttgtgtttgagtttta

SEQ ID NO: 1021548 - DNA, 13 bp, Homo sapiens
ggtttgtttgctt

SEQ ID NO: 1021549 - DNA, 16 bp, Homo sapiens
ggttttaaagtgatta

SEQ ID NO: 1021550 - DNA, 18 bp, Homo sapiens
ggttttaggaaacttgta

SEQ ID NO: 1021551 - DNA, 17 bp, Homo sapiens
ggttttataaggctgat

SEQ ID NO: 1021552 - DNA, 16 bp, Homo sapiens
ggttttatactgaagg

SEQ ID NO: 1021553 - DNA, 23 bp, Homo sapiens
ggttttatggttacttcttctct

SEQ ID NO: 1021554 - DNA, 19 bp, Homo sapiens
ggttttcagagcaggaggc

SEQ ID NO: 1021555 - DNA, 13 bp, Homo sapiens
ggttttcatttgc

SEQ ID NO: 1021556 - DNA, 18 bp, Homo sapiens
ggttttcccctccctggg

SEQ ID NO: 1021557 - DNA, 15 bp, Homo sapiens
ggttttctgttactt

SEQ ID NO: 1021558 - DNA, 17 bp, Homo sapiens
ggttttcttaaccatct

SEQ ID NO: 1021559 - DNA, 12 bp, Homo sapiens
ggttttctttgg

SEQ ID NO: 1021560 - DNA, 17 bp, Homo sapiens
ggttttgcaataacttc

SEQ ID NO: 1021561 - DNA, 20 bp, Homo sapiens
ggttttgccccaagtcctca

SEQ ID NO: 1021562 - DNA, 14 bp, Homo sapiens
ggttttggagtcag

SEQ ID NO: 1021563 - DNA, 18 bp, Homo sapiens
ggttttgtattctctgag

SEQ ID NO: 1021564 - DNA, 22 bp, Homo sapiens
ggttttgttgtgttctgttgaa

SEQ ID NO: 1021565 - DNA, 15 bp, Homo sapiens
ggtttttaaattgtt

SEQ ID NO: 1021566 - DNA, 18 bp, Homo sapiens
ggtttttaaattttgtaa

SEQ ID NO: 1021567 - DNA, 20 bp, Homo sapiens
ggtttttaggagtctgagca

SEQ ID NO: 1021568 - DNA, 16 bp, Homo sapiens
ggtttttatttctcgg

SEQ ID NO: 1021569 - DNA, 15 bp, Homo sapiens
ggtttttggctcttt

SEQ ID NO: 1021570 - DNA, 15 bp, Homo sapiens
ggttttttctgtttt

SEQ ID NO: 1021571 - DNA, 14 bp, Homo sapiens
ggtttttttcctgt

SEQ ID NO: 1021572 - DNA, 20 bp, Homo sapiens
ggttttttttttttcctttt

SEQ ID NO: 1021573 - DNA, 23 bp, Homo sapiens
gtaaaaaaaaaaaaaatgttctt

SEQ ID NO: 1021574 - DNA, 18 bp, Homo sapiens
gtaaaaaggggaggagaa

SEQ ID NO: 1021575 - DNA, 19 bp, Homo sapiens
gtaaaaagtattttttcaa

SEQ ID NO: 1021576 - DNA, 16 bp, Homo sapiens
gtaaaaagtggctgcg

SEQ ID NO: 1021577 - DNA, 13 bp, Homo sapiens
gtaaaaatgctgc

SEQ ID NO: 1021578 - DNA, 17 bp, Homo sapiens
gtaaaaatggaaactat

SEQ ID NO: 1021579 - DNA, 14 bp, Homo sapiens
gtaaaaattaaaaa

SEQ ID NO: 1021580 - DNA, 23 bp, Homo sapiens
gtaaaaattaaaaaatgaaatta

SEQ ID NO: 1021581 - DNA, 17 bp, Homo sapiens
gtaaaacagggccacat

SEQ ID NO: 1021582 - DNA, 11 bp, Homo sapiens
gtaaaacattt

SEQ ID NO: 1021583 - DNA, 18 bp, Homo sapiens
gtaaaacatttattttga

SEQ ID NO: 1021584 - DNA, 16 bp, Homo sapiens
gtaaaaccttgttcta

SEQ ID NO: 1021585 - DNA, 21 bp, Homo sapiens
gtaaaaccttgttctattttt

SEQ ID NO: 1021586 - DNA, 21 bp, Homo sapiens
gtaaaactacacatccctaat

SEQ ID NO: 1021587 - DNA, 18 bp, Homo sapiens
gtaaaactttattttata

SEQ ID NO: 1021588 - DNA, 18 bp, Homo sapiens
gtaaaagagataataaga

SEQ ID NO: 1021589 - DNA, 17 bp, Homo sapiens
gtaaaagataacaagat

SEQ ID NO: 1021590 - DNA, 21 bp, Homo sapiens
gtaaaagatcaggttatactt

SEQ ID NO: 1021591 - DNA, 16 bp, Homo sapiens
gtaaaagcattttgta

SEQ ID NO: 1021592 - DNA, 17 bp, Homo sapiens
gtaaaaggattattact

SEQ ID NO: 1021593 - DNA, 17 bp, Homo sapiens
gtaaaaggtattaaatt

SEQ ID NO: 1021594 - DNA, 12 bp, Homo sapiens
gtaaaagtctac

SEQ ID NO: 1021595 - DNA, 19 bp, Homo sapiens
gtaaaagtctacctgtgtt

SEQ ID NO: 1021596 - DNA, 20 bp, Homo sapiens
gtaaaagtggtctctgctgg

SEQ ID NO: 1021597 - DNA, 21 bp, Homo sapiens
gtaaaagtggtctctgctggg

SEQ ID NO: 1021598 - DNA, 13 bp, Homo sapiens
gtaaaagttataa

SEQ ID NO: 1021599 - DNA, 17 bp, Homo sapiens
gtaaaagttataataac

SEQ ID NO: 1021600 - DNA, 19 bp, Homo sapiens
gtaaaagttataataactg

SEQ ID NO: 1021601 - DNA, 15 bp, Homo sapiens
gtaaaatatagctgt

SEQ ID NO: 1021602 - DNA, 18 bp, Homo sapiens
gtaaaatatagctgtaca

SEQ ID NO: 1021603 - DNA, 12 bp, Homo sapiens
gtaaaatcactt

SEQ ID NO: 1021604 - DNA, 22 bp, Homo sapiens
gtaaaatgtatatttttaaaga

SEQ ID NO: 1021605 - DNA, 19 bp, Homo sapiens
gtaaaatgtattatgtcct

SEQ ID NO: 1021606 - DNA, 17 bp, Homo sapiens
gtaaaatgtctttccaa

SEQ ID NO: 1021607 - DNA, 11 bp, Homo sapiens
gtaaaatgttt

SEQ ID NO: 1021608 - DNA, 16 bp, Homo sapiens
gtaaaattgaaaggca

SEQ ID NO: 1021609 - DNA, 17 bp, Homo sapiens
gtaaaattgagtgcact

SEQ ID NO: 1021610 - DNA, 19 bp, Homo sapiens
gtaaacaaaccacagcagg

SEQ ID NO: 1021611 - DNA, 14 bp, Homo sapiens
gtaaacaaactctt

SEQ ID NO: 1021612 - DNA, 19 bp, Homo sapiens
gtaaacacagtcaaaataa

SEQ ID NO: 1021613 - DNA, 13 bp, Homo sapiens
gtaaacacatcta

SEQ ID NO: 1021614 - DNA, 17 bp, Homo sapiens
gtaaacaggtatttttt

SEQ ID NO: 1021615 - DNA, 23 bp, Homo sapiens
gtaaacaggtatttttttaaatc

SEQ ID NO: 1021616 - DNA, 13 bp, Homo sapiens
gtaaacagtgcct

SEQ ID NO: 1021617 - DNA, 20 bp, Homo sapiens
gtaaacagtgcctgctgaat

SEQ ID NO: 1021618 - DNA, 14 bp, Homo sapiens
gtaaacatgtgttt

SEQ ID NO: 1021619 - DNA, 24 bp, Homo sapiens
gtaaaccacataatttttgtacat

SEQ ID NO: 1021620 - DNA, 14 bp, Homo sapiens
gtaaaccactgaaa

SEQ ID NO: 1021621 - DNA, 18 bp, Homo sapiens
gtaaaccagatctgtctc

SEQ ID NO: 1021622 - DNA, 14 bp, Homo sapiens
gtaaaccattgtaa

SEQ ID NO: 1021623 - DNA, 20 bp, Homo sapiens
gtaaaccctatctgtgattc

SEQ ID NO: 1021624 - DNA, 16 bp, Homo sapiens
gtaaactcaaaatatt

SEQ ID NO: 1021625 - DNA, 12 bp, Homo sapiens
gtaaactcctgt

SEQ ID NO: 1021626 - DNA, 14 bp, Homo sapiens
gtaaactgaggccc

SEQ ID NO: 1021627 - DNA, 11 bp, Homo sapiens
gtaaactgcca

SEQ ID NO: 1021628 - DNA, 23 bp, Homo sapiens
gtaaactgttgttttgtatgagc

SEQ ID NO: 1021629 - DNA, 13 bp, Homo sapiens
gtaaacttctgaa

SEQ ID NO: 1021630 - DNA, 19 bp, Homo sapiens
gtaaactttatcacttaaa

SEQ ID NO: 1021631 - DNA, 17 bp, Homo sapiens
gtaaactttttcaatgg

SEQ ID NO: 1021632 - DNA, 23 bp, Homo sapiens
gtaaagaacgcgacttccacaaa

SEQ ID NO: 1021633 - DNA, 20 bp, Homo sapiens
gtaaagccatgttaaatgac

SEQ ID NO: 1021634 - DNA, 12 bp, Homo sapiens
gtaactttaaac

SEQ ID NO: 1021635 - DNA, 14 bp, Homo sapiens
gtaactttaaacat

SEQ ID NO: 1021636 - DNA, 21 bp, Homo sapiens
gtaactttactctgtgtttaa

SEQ ID NO: 1021637 - DNA, 22 bp, Homo sapiens
gtaactttactctgtgtttaaa

SEQ ID NO: 1021638 - DNA, 15 bp, Homo sapiens
gtaacttttgtaaga

SEQ ID NO: 1021639 - DNA, 14 bp, Homo sapiens
gtaacttttgtgaa

SEQ ID NO: 1021640 - DNA, 19 bp, Homo sapiens
gtaacttttttgtgtatgt

SEQ ID NO: 1021641 - DNA, 17 bp, Homo sapiens
gtaactttttttcagtt

SEQ ID NO: 1021642 - DNA, 22 bp, Homo sapiens
gtaagaaaatattttgtctaaa

SEQ ID NO: 1021643 - DNA, 20 bp, Homo sapiens
gtaagaaagtgaagcaaatc

SEQ ID NO: 1021644 - DNA, 17 bp, Homo sapiens
gtaagaaatactgtaca

SEQ ID NO: 1021645 - DNA, 16 bp, Homo sapiens
gtaagaaatttctagt

SEQ ID NO: 1021646 - DNA, 18 bp, Homo sapiens
gtaagaacaatgccaggg

SEQ ID NO: 1021647 - DNA, 20 bp, Homo sapiens
gtaagaacatccctgtctta

SEQ ID NO: 1021648 - DNA, 15 bp, Homo sapiens
gtaagaaccttgcct

SEQ ID NO: 1021649 - DNA, 19 bp, Homo sapiens
gtaagaactgtacattgtg

SEQ ID NO: 1021650 - DNA, 15 bp, Homo sapiens
gtaagaagacatgaa

SEQ ID NO: 1021651 - DNA, 13 bp, Homo sapiens
gtaagaagagact

SEQ ID NO: 1021652 - DNA, 22 bp, Homo sapiens
gtaagaagtttcttaaacattg

SEQ ID NO: 1021653 - DNA, 18 bp, Homo sapiens
gtaagaagtttgtgtctt

SEQ ID NO: 1021654 - DNA, 14 bp, Homo sapiens
gtaagaatggccaa

SEQ ID NO: 1021655 - DNA, 14 bp, Homo sapiens
gtaagacatttgta

SEQ ID NO: 1021656 - DNA, 17 bp, Homo sapiens
gtaagagcaccttcctc

SEQ ID NO: 1021657 - DNA, 23 bp, Homo sapiens
gtaagagtactgggagaatcact

SEQ ID NO: 1021658 - DNA, 18 bp, Homo sapiens
gtaagatacaagtttcag

SEQ ID NO: 1021659 - DNA, 17 bp, Homo sapiens
gtaagatctctttctaa

SEQ ID NO: 1021660 - DNA, 14 bp, Homo sapiens
gtaagatgactctg

SEQ ID NO: 1021661 - DNA, 15 bp, Homo sapiens
gtaagatgcactgaa

SEQ ID NO: 1021662 - DNA, 20 bp, Homo sapiens
gtaagatgctgggttggtgc

SEQ ID NO: 1021663 - DNA, 13 bp, Homo sapiens
gtaagattgttat

SEQ ID NO: 1021664 - DNA, 15 bp, Homo sapiens
gtaagccagagcctg

SEQ ID NO: 1021665 - DNA, 16 bp, Homo sapiens
gtaagccagagcctgg

SEQ ID NO: 1021666 - DNA, 13 bp, Homo sapiens
gtaagctctggct

SEQ ID NO: 1021667 - DNA, 19 bp, Homo sapiens
tggacattgagatactatc

SEQ ID NO: 1021668 - DNA, 17 bp, Homo sapiens
tggacatttgccttgct

SEQ ID NO: 1021669 - DNA, 18 bp, Homo sapiens
tggacatttgccttgctg

SEQ ID NO: 1021670 - DNA, 22 bp, Homo sapiens
tggacatttgccttgctggacg

SEQ ID NO: 1021671 - DNA, 16 bp, Homo sapiens
tggacattttctttta

SEQ ID NO: 1021672 - DNA, 21 bp, Homo sapiens
tggacattttcttttattatc

SEQ ID NO: 1021673 - DNA, 22 bp, Homo sapiens
tggaccaaagggaagtgaggcc

SEQ ID NO: 1021674 - DNA, 11 bp, Homo sapiens
tggaccaaatg

SEQ ID NO: 1021675 - DNA, 13 bp, Homo sapiens
tggaccaaatgtg

SEQ ID NO: 1021676 - DNA, 17 bp, Homo sapiens
tggaccaacctgctctg

SEQ ID NO: 1021677 - DNA, 22 bp, Homo sapiens
tggaccaacctgctctgtcccc

SEQ ID NO: 1021678 - DNA, 17 bp, Homo sapiens
tggaccaccagccccag

SEQ ID NO: 1021679 - DNA, 20 bp, Homo sapiens
tggaccaccagccccagcaa

SEQ ID NO: 1021680 - DNA, 18 bp, Homo sapiens
tggaccacgccgccctcc

SEQ ID NO: 1021681 - DNA, 16 bp, Homo sapiens
tggaccactcctgtcc

SEQ ID NO: 1021682 - DNA, 19 bp, Homo sapiens
tggaccactcctgtccctg

SEQ ID NO: 1021683 - DNA, 19 bp, Homo sapiens
tggaccactgggcaatgat

SEQ ID NO: 1021684 - DNA, 14 bp, Homo sapiens
tggaccagagactt

SEQ ID NO: 1021685 - DNA, 15 bp, Homo sapiens
tggaccagctggcct

SEQ ID NO: 1021686 - DNA, 21 bp, Homo sapiens
tggaccaggaggattgccttt

SEQ ID NO: 1021687 - DNA, 16 bp, Homo sapiens
tggaccaggcctggag

SEQ ID NO: 1021688 - DNA, 22 bp, Homo sapiens
tggaccaggcctggagggcact

SEQ ID NO: 1021689 - DNA, 16 bp, Homo sapiens
tggaccatgccagatt

SEQ ID NO: 1021690 - DNA, 23 bp, Homo sapiens
tggaccatgccagattctgcctc

SEQ ID NO: 1021691 - DNA, 14 bp, Homo sapiens
tggacccagggcct

SEQ ID NO: 1021692 - DNA, 14 bp, Homo sapiens
tggaccccactggc

SEQ ID NO: 1021693 - DNA, 14 bp, Homo sapiens
tggaccccagctgg

SEQ ID NO: 1021694 - DNA, 16 bp, Homo sapiens
tggaccccagctggga

SEQ ID NO: 1021695 - DNA, 18 bp, Homo sapiens
tggaccccagctgggagg

SEQ ID NO: 1021696 - DNA, 20 bp, Homo sapiens
tggaccccagctgggaggca

SEQ ID NO: 1021697 - DNA, 16 bp, Homo sapiens
tggaccccatctgtga

SEQ ID NO: 1021698 - DNA, 18 bp, Homo sapiens
tggaccccatctgtgaat

SEQ ID NO: 1021699 - DNA, 21 bp, Homo sapiens
tggaccccatctgtgaataag

SEQ ID NO: 1021700 - DNA, 21 bp, Homo sapiens
tggacccccagcccccagggc

SEQ ID NO: 1021701 - DNA, 18 bp, Homo sapiens
tggacccctcccttgctc

SEQ ID NO: 1021702 - DNA, 16 bp, Homo sapiens
tggacccctggggtgg

SEQ ID NO: 1021703 - DNA, 22 bp, Homo sapiens
tggacccctggggtggccaggg

SEQ ID NO: 1021704 - DNA, 14 bp, Homo sapiens
tggacccgctctgg

SEQ ID NO: 1021705 - DNA, 15 bp, Homo sapiens
tggacccgctctgga

SEQ ID NO: 1021706 - DNA, 19 bp, Homo sapiens
tggacccgctctggaccaa

SEQ ID NO: 1021707 - DNA, 16 bp, Homo sapiens
tggaccctgcttcacc

SEQ ID NO: 1021708 - DNA, 23 bp, Homo sapiens
tggaccctggtgacctcctgtca

SEQ ID NO: 1021709 - DNA, 18 bp, Homo sapiens
tggaccctgtcttctggg

SEQ ID NO: 1021710 - DNA, 19 bp, Homo sapiens
tggaccctgtggccaggtg

SEQ ID NO: 1021711 - DNA, 13 bp, Homo sapiens
tggacccttccat

SEQ ID NO: 1021712 - DNA, 20 bp, Homo sapiens
tggacccttggcctccattt

SEQ ID NO: 1021713 - DNA, 19 bp, Homo sapiens
tggaccgggtgggcctggc

SEQ ID NO: 1021714 - DNA, 22 bp, Homo sapiens
tggaccgggtgggcctggcctg

SEQ ID NO: 1021715 - DNA, 14 bp, Homo sapiens
tggacctagcctgg

SEQ ID NO: 1021716 - DNA, 15 bp, Homo sapiens
tggacctagcctgga

SEQ ID NO: 1021717 - DNA, 16 bp, Homo sapiens
tggacctagcctggat

SEQ ID NO: 1021718 - DNA, 12 bp, Homo sapiens
tggacctagctt

SEQ ID NO: 1021719 - DNA, 22 bp, Homo sapiens
tggacctatgtcctaaggacac

SEQ ID NO: 1021720 - DNA, 16 bp, Homo sapiens
tggacctcaggagggc

SEQ ID NO: 1021721 - DNA, 16 bp, Homo sapiens
tggacctccaggggct

SEQ ID NO: 1021722 - DNA, 23 bp, Homo sapiens
tggacctccaggggctcctgggt

SEQ ID NO: 1021723 - DNA, 17 bp, Homo sapiens
tggacctccatccctgc

SEQ ID NO: 1021724 - DNA, 18 bp, Homo sapiens
tggacctgagtcggcccc

SEQ ID NO: 1021725 - DNA, 23 bp, Homo sapiens
tggacctgccccggacctacctc

SEQ ID NO: 1021726 - DNA, 19 bp, Homo sapiens
tggacctgcctcctgcctg

SEQ ID NO: 1021727 - DNA, 15 bp, Homo sapiens
tggaccttaggcctt

SEQ ID NO: 1021728 - DNA, 18 bp, Homo sapiens
tggaccttgacagagcag

SEQ ID NO: 1021729 - DNA, 21 bp, Homo sapiens
tggaccttgacagagcagcta

SEQ ID NO: 1021730 - DNA, 16 bp, Homo sapiens
tggaccttgagaccac

SEQ ID NO: 1021731 - DNA, 20 bp, Homo sapiens
tggacctttgggttctttct

SEQ ID NO: 1021732 - DNA, 14 bp, Homo sapiens
tggacgctgccctg

SEQ ID NO: 1021733 - DNA, 18 bp, Homo sapiens
tggacgctgccctgcatg

SEQ ID NO: 1021734 - DNA, 16 bp, Homo sapiens
tggacggaggtccccg

SEQ ID NO: 1021735 - DNA, 15 bp, Homo sapiens
tggacggcaggctca

SEQ ID NO: 1021736 - DNA, 18 bp, Homo sapiens
tggacggcaggctcactg

SEQ ID NO: 1021737 - DNA, 20 bp, Homo sapiens
tggacggcaggctcactgcc

SEQ ID NO: 1021738 - DNA, 22 bp, Homo sapiens
tggacggcaggctcactgccag

SEQ ID NO: 1021739 - DNA, 15 bp, Homo sapiens
tggacggcgctgcct

SEQ ID NO: 1021740 - DNA, 23 bp, Homo sapiens
tggacggcgctgcctcaggcact

SEQ ID NO: 1021741 - DNA, 17 bp, Homo sapiens
tggacggtttctagcct

SEQ ID NO: 1021742 - DNA, 20 bp, Homo sapiens
tggacggtttctagcctctg

SEQ ID NO: 1021743 - DNA, 21 bp, Homo sapiens
tggacggtttctagcctctga

SEQ ID NO: 1021744 - DNA, 16 bp, Homo sapiens
tggacgtgcactgaca

SEQ ID NO: 1021745 - DNA, 17 bp, Homo sapiens
tggacgtgcactgacag

SEQ ID NO: 1021746 - DNA, 17 bp, Homo sapiens
tggacgttcggggcatg

SEQ ID NO: 1021747 - DNA, 14 bp, Homo sapiens
tggactaagcaatt

SEQ ID NO: 1021748 - DNA, 17 bp, Homo sapiens
tggactacaaaatacaa

SEQ ID NO: 1021749 - DNA, 13 bp, Homo sapiens
tggactagtgtcc

SEQ ID NO: 1021750 - DNA, 22 bp, Homo sapiens
tggactatctgtctggtggccc

SEQ ID NO: 1021751 - DNA, 22 bp, Homo sapiens
tggactatggagtgcaccaaag

SEQ ID NO: 1021752 - DNA, 14 bp, Homo sapiens
tggactcaggatcc

SEQ ID NO: 1021753 - DNA, 16 bp, Homo sapiens
tggactcaggatccag

SEQ ID NO: 1021754 - DNA, 21 bp, Homo sapiens
tggactcaggatccagtgaca

SEQ ID NO: 1021755 - DNA, 17 bp, Homo sapiens
tggagcagaccaccccg

SEQ ID NO: 1021756 - DNA, 12 bp, Homo sapiens
tggagcagaggg

SEQ ID NO: 1021757 - DNA, 17 bp, Homo sapiens
tggagcagaggggctga

SEQ ID NO: 1021758 - DNA, 13 bp, Homo sapiens
tggagcagccaag

SEQ ID NO: 1021759 - DNA, 22 bp, Homo sapiens
tggagcagccaaggccgccagc

SEQ ID NO: 1021760 - DNA, 13 bp, Homo sapiens
tggagcagccaga

SEQ ID NO: 1021761 - DNA, 15 bp, Homo sapiens
tggagcagccagagc

SEQ ID NO: 1021762 - DNA, 16 bp, Homo sapiens
tggagcagccagagct

SEQ ID NO: 1021763 - DNA, 20 bp, Homo sapiens
tggagcagccagagctgtgc

SEQ ID NO: 1021764 - DNA, 17 bp, Homo sapiens
tggagcagctattttaa

SEQ ID NO: 1021765 - DNA, 18 bp, Homo sapiens
tggagcaggagccccgcc

SEQ ID NO: 1021766 - DNA, 19 bp, Homo sapiens
tggagcaggagccccgcca

SEQ ID NO: 1021767 - DNA, 14 bp, Homo sapiens
tggagcatcccagg

SEQ ID NO: 1021768 - DNA, 17 bp, Homo sapiens
tggagccaagggttcag

SEQ ID NO: 1021769 - DNA, 17 bp, Homo sapiens
tggagccaatggagact

SEQ ID NO: 1021770 - DNA, 12 bp, Homo sapiens
tggagccacagg

SEQ ID NO: 1021771 - DNA, 15 bp, Homo sapiens
tggagccacaggcag

SEQ ID NO: 1021772 - DNA, 16 bp, Homo sapiens
tggagccactcctgtc

SEQ ID NO: 1021773 - DNA, 17 bp, Homo sapiens
tggagccactcctgtcc

SEQ ID NO: 1021774 - DNA, 19 bp, Homo sapiens
tggagccactcctgtcccg

SEQ ID NO: 1021775 - DNA, 11 bp, Homo sapiens
tggagccaggg

SEQ ID NO: 1021776 - DNA, 16 bp, Homo sapiens
tggagccagggcagag

SEQ ID NO: 1021777 - DNA, 11 bp, Homo sapiens
tggagccaggt

SEQ ID NO: 1021778 - DNA, 22 bp, Homo sapiens
tggagccatcccttcggagcca

SEQ ID NO: 1021779 - DNA, 18 bp, Homo sapiens
tggagccattgaacagct

SEQ ID NO: 1021780 - DNA, 23 bp, Homo sapiens
tggagccattgaacagctgtgag

SEQ ID NO: 1021781 - DNA, 19 bp, Homo sapiens
tggagcccacagcgagcct

SEQ ID NO: 1021782 - DNA, 14 bp, Homo sapiens
tggagcccagggca

SEQ ID NO: 1021783 - DNA, 21 bp, Homo sapiens
tggagcccataggccaccccc

SEQ ID NO: 1021784 - DNA, 13 bp, Homo sapiens
tggagcccctggg

SEQ ID NO: 1021785 - DNA, 18 bp, Homo sapiens
tggagcccgcacccccac

SEQ ID NO: 1021786 - DNA, 19 bp, Homo sapiens
tggagcccgcacccccacc

SEQ ID NO: 1021787 - DNA, 19 bp, Homo sapiens
tggagcccgcttcaagctc

SEQ ID NO: 1021788 - DNA, 20 bp, Homo sapiens
tggagcctctttttccttct

SEQ ID NO: 1021789 - DNA, 21 bp, Homo sapiens
tggagcctctttttccttctt

SEQ ID NO: 1021790 - DNA, 13 bp, Homo sapiens
tggagcctgcagg

SEQ ID NO: 1021791 - DNA, 15 bp, Homo sapiens
tggagcctgccaaga

SEQ ID NO: 1021792 - DNA, 12 bp, Homo sapiens
tggagcctggaa

SEQ ID NO: 1021793 - DNA, 13 bp, Homo sapiens
tggagcctggaac

SEQ ID NO: 1021794 - DNA, 13 bp, Homo sapiens
tggagcctggggt

SEQ ID NO: 1021795 - DNA, 19 bp, Homo sapiens
tggagcctttgaataaaaa

SEQ ID NO: 1021796 - DNA, 23 bp, Homo sapiens
tggagcgagcatcccccaaagtt

SEQ ID NO: 1021797 - DNA, 15 bp, Homo sapiens
gtaatttttttcacc

SEQ ID NO: 1021798 - DNA, 20 bp, Homo sapiens
gtacaaaaaaaaagttttat

SEQ ID NO: 1021799 - DNA, 18 bp, Homo sapiens
gtacaaaaataaatttat

SEQ ID NO: 1021800 - DNA, 12 bp, Homo sapiens
gtacaaaataaa

SEQ ID NO: 1021801 - DNA, 14 bp, Homo sapiens
gtacaaaataaaca

SEQ ID NO: 1021802 - DNA, 16 bp, Homo sapiens
gtacaaaataaacaaa

SEQ ID NO: 1021803 - DNA, 14 bp, Homo sapiens
gtacaaacatgaaa

SEQ ID NO: 1021804 - DNA, 16 bp, Homo sapiens
gtacaaacatgaaaaa

SEQ ID NO: 1021805 - DNA, 20 bp, Homo sapiens
gtacaaacctgcatggtgtt

SEQ ID NO: 1021806 - DNA, 14 bp, Homo sapiens
gtacaaactcagat

SEQ ID NO: 1021807 - DNA, 18 bp, Homo sapiens
gtacaaactcagatcctt

SEQ ID NO: 1021808 - DNA, 21 bp, Homo sapiens
gtacaaagattagtttcaatg

SEQ ID NO: 1021809 - DNA, 13 bp, Homo sapiens
gtacaaatataag

SEQ ID NO: 1021810 - DNA, 20 bp, Homo sapiens
gtacaaatataagaataaaa

SEQ ID NO: 1021811 - DNA, 19 bp, Homo sapiens
gtacaaatgtgataatata

SEQ ID NO: 1021812 - DNA, 12 bp, Homo sapiens
gtacaaccctga

SEQ ID NO: 1021813 - DNA, 15 bp, Homo sapiens
gtacaagaagcattt

SEQ ID NO: 1021814 - DNA, 17 bp, Homo sapiens
gtacaaggtaattgttt

SEQ ID NO: 1021815 - DNA, 18 bp, Homo sapiens
gtacaaggtaattgtttt

SEQ ID NO: 1021816 - DNA, 20 bp, Homo sapiens
gtacaagtatataatatgtc

SEQ ID NO: 1021817 - DNA, 21 bp, Homo sapiens
gtacaagtatataatatgtca

SEQ ID NO: 1021818 - DNA, 23 bp, Homo sapiens
gtacaagtatataatatgtcacc

SEQ ID NO: 1021819 - DNA, 11 bp, Homo sapiens
gtacaataaaa

SEQ ID NO: 1021820 - DNA, 22 bp, Homo sapiens
gtacaataagtgtttttgtatt

SEQ ID NO: 1021821 - DNA, 16 bp, Homo sapiens
gtacaatacaatgtac

SEQ ID NO: 1021822 - DNA, 19 bp, Homo sapiens
gtacaatacaatgtacaat

SEQ ID NO: 1021823 - DNA, 17 bp, Homo sapiens
gtacaatatgaaaagga

SEQ ID NO: 1021824 - DNA, 20 bp, Homo sapiens
gtacaatgaactgcttttcc

SEQ ID NO: 1021825 - DNA, 18 bp, Homo sapiens
gtacaatgaagaagtttc

SEQ ID NO: 1021826 - DNA, 18 bp, Homo sapiens
gtacaatggcccgacatt

SEQ ID NO: 1021827 - DNA, 22 bp, Homo sapiens
gtacaatggcccgacatttctt

SEQ ID NO: 1021828 - DNA, 17 bp, Homo sapiens
gtacaatggtttattcc

SEQ ID NO: 1021829 - DNA, 19 bp, Homo sapiens
gtacaatggtttattccca

SEQ ID NO: 1021830 - DNA, 15 bp, Homo sapiens
gtacaattactaaat

SEQ ID NO: 1021831 - DNA, 13 bp, Homo sapiens
gtacaattttaaa

SEQ ID NO: 1021832 - DNA, 15 bp, Homo sapiens
gtacacagagaaggc

SEQ ID NO: 1021833 - DNA, 21 bp, Homo sapiens
gtacacagagaaggctatgta

SEQ ID NO: 1021834 - DNA, 20 bp, Homo sapiens
gtacacagctctagacactg

SEQ ID NO: 1021835 - DNA, 23 bp, Homo sapiens
gtacactaccaaacactcagtcc

SEQ ID NO: 1021836 - DNA, 16 bp, Homo sapiens
gtacactgacttgaga

SEQ ID NO: 1021837 - DNA, 18 bp, Homo sapiens
gtacactgtttcaaactt

SEQ ID NO: 1021838 - DNA, 16 bp, Homo sapiens
gtacagaaaaatactt

SEQ ID NO: 1021839 - DNA, 20 bp, Homo sapiens
gtacagaaaacatgtttaaa

SEQ ID NO: 1021840 - DNA, 14 bp, Homo sapiens
gtacagaacacaaa

SEQ ID NO: 1021841 - DNA, 22 bp, Homo sapiens
gtacagaacacaaatgtctagt

SEQ ID NO: 1021842 - DNA, 18 bp, Homo sapiens
gtacagaatcattgctta

SEQ ID NO: 1021843 - DNA, 21 bp, Homo sapiens
gtacagaatcattgcttatga

SEQ ID NO: 1021844 - DNA, 17 bp, Homo sapiens
gtacagaatttgaatta

SEQ ID NO: 1021845 - DNA, 21 bp, Homo sapiens
gtacagacatggagatgtaaa

SEQ ID NO: 1021846 - DNA, 21 bp, Homo sapiens
gtacagaccgagaggccagtt

SEQ ID NO: 1021847 - DNA, 15 bp, Homo sapiens
gtacagactgtttta

SEQ ID NO: 1021848 - DNA, 18 bp, Homo sapiens
gtacagactgttttactg

SEQ ID NO: 1021849 - DNA, 16 bp, Homo sapiens
gtacagatcaagaaaa

SEQ ID NO: 1021850 - DNA, 19 bp, Homo sapiens
gtacagattgctgcttctg

SEQ ID NO: 1021851 - DNA, 13 bp, Homo sapiens
gtacagcacagaa

SEQ ID NO: 1021852 - DNA, 14 bp, Homo sapiens
gtacagcagggtct

SEQ ID NO: 1021853 - DNA, 15 bp, Homo sapiens
gtacagcagggtctt

SEQ ID NO: 1021854 - DNA, 20 bp, Homo sapiens
gtacagcagggtcttgctgt

SEQ ID NO: 1021855 - DNA, 20 bp, Homo sapiens
gtacagcggctcccctctgc

SEQ ID NO: 1021856 - DNA, 23 bp, Homo sapiens
gtacagcggctcccctctgcttc

SEQ ID NO: 1021857 - DNA, 18 bp, Homo sapiens
gtacagctgtttaagatg

SEQ ID NO: 1021858 - DNA, 16 bp, Homo sapiens
gtacaggagaggcagc

SEQ ID NO: 1021859 - DNA, 21 bp, Homo sapiens
gtacaggcaaaacacgcaagg

SEQ ID NO: 1021860 - DNA, 17 bp, Homo sapiens
gtacaggggccatgccc

SEQ ID NO: 1021861 - DNA, 22 bp, Homo sapiens
gtacagggtggctgtggtccta

SEQ ID NO: 1021862 - DNA, 22 bp, Homo sapiens
gtacagtatgggggttgtaaat

SEQ ID NO: 1021863 - DNA, 16 bp, Homo sapiens
gtacagtattctttta

SEQ ID NO: 1021864 - DNA, 14 bp, Homo sapiens
gtacagtgaattgt

SEQ ID NO: 1021865 - DNA, 22 bp, Homo sapiens
gtacagtgaattgtcttttaga

SEQ ID NO: 1021866 - DNA, 21 bp, Homo sapiens
gtacagtgtctttttttgtat

SEQ ID NO: 1021867 - DNA, 14 bp, Homo sapiens
gtacagttatctaa

SEQ ID NO: 1021868 - DNA, 12 bp, Homo sapiens
gtacagttttta

SEQ ID NO: 1021869 - DNA, 20 bp, Homo sapiens
gtacataatgcgtgcatacc

SEQ ID NO: 1021870 - DNA, 14 bp, Homo sapiens
gtacataattgatt

SEQ ID NO: 1021871 - DNA, 20 bp, Homo sapiens
gtacataattgattaaaatc

SEQ ID NO: 1021872 - DNA, 16 bp, Homo sapiens
gtacatacattgtata

SEQ ID NO: 1021873 - DNA, 13 bp, Homo sapiens
gtacatactggcc

SEQ ID NO: 1021874 - DNA, 14 bp, Homo sapiens
gtacatactggcct

SEQ ID NO: 1021875 - DNA, 17 bp, Homo sapiens
gtacatactggcctctg

SEQ ID NO: 1021876 - DNA, 14 bp, Homo sapiens
gtacataggcttct

SEQ ID NO: 1021877 - DNA, 21 bp, Homo sapiens
gtactggggtgggatcttgga

SEQ ID NO: 1021878 - DNA, 16 bp, Homo sapiens
gtactgtaactgctca

SEQ ID NO: 1021879 - DNA, 14 bp, Homo sapiens
gtactgtagcaggg

SEQ ID NO: 1021880 - DNA, 19 bp, Homo sapiens
gtactgtattgggcttctt

SEQ ID NO: 1021881 - DNA, 22 bp, Homo sapiens
gtactgtcctcaaataagtctt

SEQ ID NO: 1021882 - DNA, 22 bp, Homo sapiens
gtactgttcggaaggggttcct

SEQ ID NO: 1021883 - DNA, 14 bp, Homo sapiens
gtactgttctgtgt

SEQ ID NO: 1021884 - DNA, 17 bp, Homo sapiens
gtactgttctgtgtctt

SEQ ID NO: 1021885 - DNA, 17 bp, Homo sapiens
gtacttaaatgaaagca

SEQ ID NO: 1021886 - DNA, 17 bp, Homo sapiens
gtacttagagtttctgt

SEQ ID NO: 1021887 - DNA, 19 bp, Homo sapiens
gtacttagccagttcaaag

SEQ ID NO: 1021888 - DNA, 22 bp, Homo sapiens
gtacttagccagttcaaagtgt

SEQ ID NO: 1021889 - DNA, 15 bp, Homo sapiens
gtacttattactgct

SEQ ID NO: 1021890 - DNA, 15 bp, Homo sapiens
gtacttcactgtcag

SEQ ID NO: 1021891 - DNA, 22 bp, Homo sapiens
gtacttcccgggccagggctgc

SEQ ID NO: 1021892 - DNA, 15 bp, Homo sapiens
gtacttcctcctgat

SEQ ID NO: 1021893 - DNA, 14 bp, Homo sapiens
gtacttctgtgttc

SEQ ID NO: 1021894 - DNA, 17 bp, Homo sapiens
gtacttctgtgttcatt

SEQ ID NO: 1021895 - DNA, 19 bp, Homo sapiens
gtacttctgtgttcatttt

SEQ ID NO: 1021896 - DNA, 16 bp, Homo sapiens
gtacttcttctgtaat

SEQ ID NO: 1021897 - DNA, 18 bp, Homo sapiens
gtacttcttgaatataaa

SEQ ID NO: 1021898 - DNA, 19 bp, Homo sapiens
gtacttcttgaatataaaa

SEQ ID NO: 1021899 - DNA, 17 bp, Homo sapiens
gtacttgaaggatggat

SEQ ID NO: 1021900 - DNA, 17 bp, Homo sapiens
gtacttgaatttttctt

SEQ ID NO: 1021901 - DNA, 24 bp, Homo sapiens
gtacttgaccgtttttatattact

SEQ ID NO: 1021902 - DNA, 23 bp, Homo sapiens
gtacttgatttgatgtgactttt

SEQ ID NO: 1021903 - DNA, 22 bp, Homo sapiens
gtacttgccttattagagtgtc

SEQ ID NO: 1021904 - DNA, 22 bp, Homo sapiens
gtacttgcttgtattgtaaatg

SEQ ID NO: 1021905 - DNA, 14 bp, Homo sapiens
gtacttgtcaaaga

SEQ ID NO: 1021906 - DNA, 15 bp, Homo sapiens
gtacttgtcaaagaa

SEQ ID NO: 1021907 - DNA, 17 bp, Homo sapiens
gtacttgtcatatgtag

SEQ ID NO: 1021908 - DNA, 17 bp, Homo sapiens
gtactttaaaaaggaaa

SEQ ID NO: 1021909 - DNA, 22 bp, Homo sapiens
gtactttattcttgctgggcat

SEQ ID NO: 1021910 - DNA, 22 bp, Homo sapiens
gtactttattgcaactctttta

SEQ ID NO: 1021911 - DNA, 16 bp, Homo sapiens
gtactttatttttgta

SEQ ID NO: 1021912 - DNA, 21 bp, Homo sapiens
gtactttggatgcaattaaaa

SEQ ID NO: 1021913 - DNA, 17 bp, Homo sapiens
gtacttttcattctctt

SEQ ID NO: 1021914 - DNA, 20 bp, Homo sapiens
gtacttttctggttccaaac

SEQ ID NO: 1021915 - DNA, 19 bp, Homo sapiens
gtagaaaaattattagaac

SEQ ID NO: 1021916 - DNA, 14 bp, Homo sapiens
gtagaaaactccag

SEQ ID NO: 1021917 - DNA, 16 bp, Homo sapiens
gtagaaaactccaggg

SEQ ID NO: 1021918 - DNA, 23 bp, Homo sapiens
gtagaaaagaaaacatttaacat

SEQ ID NO: 1021919 - DNA, 18 bp, Homo sapiens
gtagaaaatgtgaccctc

SEQ ID NO: 1021920 - DNA, 18 bp, Homo sapiens
gtagaaacacagttttga

SEQ ID NO: 1021921 - DNA, 16 bp, Homo sapiens
gtagaaactatttctg

SEQ ID NO: 1021922 - DNA, 19 bp, Homo sapiens
gtagaaactgcagggaaaa

SEQ ID NO: 1021923 - DNA, 20 bp, Homo sapiens
gtagaaagacatctgcctgt

SEQ ID NO: 1021924 - DNA, 21 bp, Homo sapiens
gtagaaagacatctgcctgta

SEQ ID NO: 1021925 - DNA, 18 bp, Homo sapiens
tggagtgagagcctttgc

SEQ ID NO: 1021926 - DNA, 19 bp, Homo sapiens
tggagtgagagcctttgcc

SEQ ID NO: 1021927 - DNA, 17 bp, Homo sapiens
tggagtgaggcttccag

SEQ ID NO: 1021928 - DNA, 23 bp, Homo sapiens
tggagtgaggcttccaggctctt

SEQ ID NO: 1021929 - DNA, 18 bp, Homo sapiens
tggagtgagggcctcaga

SEQ ID NO: 1021930 - DNA, 19 bp, Homo sapiens
tggagtgagtcacctgctc

SEQ ID NO: 1021931 - DNA, 20 bp, Homo sapiens
tggagtgagtcacctgctcc

SEQ ID NO: 1021932 - DNA, 22 bp, Homo sapiens
tggagtgatatgatccagagca

SEQ ID NO: 1021933 - DNA, 20 bp, Homo sapiens
tggagtgatggtgtccttcc

SEQ ID NO: 1021934 - DNA, 18 bp, Homo sapiens
tggagtgatttatactgt

SEQ ID NO: 1021935 - DNA, 17 bp, Homo sapiens
tggagtgcaatgacaca

SEQ ID NO: 1021936 - DNA, 16 bp, Homo sapiens
tggagtgcaccaaaga

SEQ ID NO: 1021937 - DNA, 18 bp, Homo sapiens
tggagtgcactgagaaca

SEQ ID NO: 1021938 - DNA, 19 bp, Homo sapiens
tggagtgcagggaggagag

SEQ ID NO: 1021939 - DNA, 21 bp, Homo sapiens
tggagtgccctgcaggcacag

SEQ ID NO: 1021940 - DNA, 17 bp, Homo sapiens
tggagtgctgttttgtt

SEQ ID NO: 1021941 - DNA, 20 bp, Homo sapiens
tggagtggaaggtctattgg

SEQ ID NO: 1021942 - DNA, 17 bp, Homo sapiens
tggagtgtatgactgca

SEQ ID NO: 1021943 - DNA, 20 bp, Homo sapiens
tggagtgtcggatcctgtga

SEQ ID NO: 1021944 - DNA, 16 bp, Homo sapiens
tggagtgtgcagacag

SEQ ID NO: 1021945 - DNA, 22 bp, Homo sapiens
tggagtgtgcagacagccatgc

SEQ ID NO: 1021946 - DNA, 15 bp, Homo sapiens
tggagtgtgtattgt

SEQ ID NO: 1021947 - DNA, 17 bp, Homo sapiens
tggagtgtgtcagagcc

SEQ ID NO: 1021948 - DNA, 20 bp, Homo sapiens
tggagtgtgtcagagcccag

SEQ ID NO: 1021949 - DNA, 18 bp, Homo sapiens
tggagtgttatgtatttc

SEQ ID NO: 1021950 - DNA, 22 bp, Homo sapiens
tggagtgttccccttccactga

SEQ ID NO: 1021951 - DNA, 24 bp, Homo sapiens
tggagtgtttctaataaacttgga

SEQ ID NO: 1021952 - DNA, 17 bp, Homo sapiens
tggagttacattaatgt

SEQ ID NO: 1021953 - DNA, 18 bp, Homo sapiens
tggagttacattaatgtt

SEQ ID NO: 1021954 - DNA, 19 bp, Homo sapiens
tggagttcaccttggaagg

SEQ ID NO: 1021955 - DNA, 16 bp, Homo sapiens
tggagttccggcctgg

SEQ ID NO: 1021956 - DNA, 22 bp, Homo sapiens
tggagttcgtaccgcttcctta

SEQ ID NO: 1021957 - DNA, 19 bp, Homo sapiens
tggagtttaatacagtgag

SEQ ID NO: 1021958 - DNA, 14 bp, Homo sapiens
tggagtttctctct

SEQ ID NO: 1021959 - DNA, 13 bp, Homo sapiens
tggagtttctctg

SEQ ID NO: 1021960 - DNA, 15 bp, Homo sapiens
tggagtttgacacct

SEQ ID NO: 1021961 - DNA, 23 bp, Homo sapiens
tggagtttgtaaaattgttcctg

SEQ ID NO: 1021962 - DNA, 20 bp, Homo sapiens
tggagtttgtattttgcata

SEQ ID NO: 1021963 - DNA, 19 bp, Homo sapiens
tggagttttatttttaaga

SEQ ID NO: 1021964 - DNA, 20 bp, Homo sapiens
tggagttttatttttaagaa

SEQ ID NO: 1021965 - DNA, 16 bp, Homo sapiens
tggataaaactgtgta

SEQ ID NO: 1021966 - DNA, 16 bp, Homo sapiens
tggataaaccaccctc

SEQ ID NO: 1021967 - DNA, 17 bp, Homo sapiens
tggataaattgtttagt

SEQ ID NO: 1021968 - DNA, 16 bp, Homo sapiens
tggataactagccaga

SEQ ID NO: 1021969 - DNA, 21 bp, Homo sapiens
tggataacttaggtggcaagc

SEQ ID NO: 1021970 - DNA, 15 bp, Homo sapiens
tggataataaaaatt

SEQ ID NO: 1021971 - DNA, 16 bp, Homo sapiens
tggataataaaaattg

SEQ ID NO: 1021972 - DNA, 23 bp, Homo sapiens
tggataataaacctgggctcagc

SEQ ID NO: 1021973 - DNA, 14 bp, Homo sapiens
tggataataggaat

SEQ ID NO: 1021974 - DNA, 16 bp, Homo sapiens
tggataataggaattc

SEQ ID NO: 1021975 - DNA, 18 bp, Homo sapiens
tggataataggaattcaa

SEQ ID NO: 1021976 - DNA, 16 bp, Homo sapiens
tggataatcaggaaaa

SEQ ID NO: 1021977 - DNA, 20 bp, Homo sapiens
tggataatcaggaaaaatga

SEQ ID NO: 1021978 - DNA, 19 bp, Homo sapiens
tggataatcttaaattttg

SEQ ID NO: 1021979 - DNA, 14 bp, Homo sapiens
tggatacagagcca

SEQ ID NO: 1021980 - DNA, 14 bp, Homo sapiens
tggatacagctgct

SEQ ID NO: 1021981 - DNA, 16 bp, Homo sapiens
tggatacagtgcccac

SEQ ID NO: 1021982 - DNA, 17 bp, Homo sapiens
tggatacagtgcccacc

SEQ ID NO: 1021983 - DNA, 20 bp, Homo sapiens
tggatacagtgcccaccgcc

SEQ ID NO: 1021984 - DNA, 13 bp, Homo sapiens
tggatacatctgc

SEQ ID NO: 1021985 - DNA, 16 bp, Homo sapiens
tggatacatctgctgt

SEQ ID NO: 1021986 - DNA, 21 bp, Homo sapiens
tggatacgtgtcaatgtgtgc

SEQ ID NO: 1021987 - DNA, 13 bp, Homo sapiens
tggatactggaca

SEQ ID NO: 1021988 - DNA, 14 bp, Homo sapiens
tggatacttggatt

SEQ ID NO: 1021989 - DNA, 23 bp, Homo sapiens
tggatagaacatgggatacttta

SEQ ID NO: 1021990 - DNA, 15 bp, Homo sapiens
tggatagacttggga

SEQ ID NO: 1021991 - DNA, 21 bp, Homo sapiens
tggatagcattgttttctttt

SEQ ID NO: 1021992 - DNA, 17 bp, Homo sapiens
tggatataatgtatttt

SEQ ID NO: 1021993 - DNA, 19 bp, Homo sapiens
tggatatcagggtataaat

SEQ ID NO: 1021994 - DNA, 15 bp, Homo sapiens
tggatatgacccaca

SEQ ID NO: 1021995 - DNA, 19 bp, Homo sapiens
tggatatgacccacactgc

SEQ ID NO: 1021996 - DNA, 21 bp, Homo sapiens
tggatatgtaaaacatttatt

SEQ ID NO: 1021997 - DNA, 16 bp, Homo sapiens
tggattttaaaaaatc

SEQ ID NO: 1021998 - DNA, 15 bp, Homo sapiens
tggattttctactgt

SEQ ID NO: 1021999 - DNA, 16 bp, Homo sapiens
tggatttttaaattat

SEQ ID NO: 1022000 - DNA, 15 bp, Homo sapiens
tggatttttctttaa

SEQ ID NO: 1022001 - DNA, 20 bp, Homo sapiens
tggatttttgactctggcaa

SEQ ID NO: 1022002 - DNA, 23 bp, Homo sapiens
tggattttttccattatgttcat

SEQ ID NO: 1022003 - DNA, 23 bp, Homo sapiens
tggattttttccttcaaagttta

SEQ ID NO: 1022004 - DNA, 16 bp, Homo sapiens
tggcaaaaaggcagga

SEQ ID NO: 1022005 - DNA, 20 bp, Homo sapiens
tggcaaaactctacttaatc

SEQ ID NO: 1022006 - DNA, 21 bp, Homo sapiens
tggcaaaatagttctgcaggt

SEQ ID NO: 1022007 - DNA, 16 bp, Homo sapiens
tggcaaaatatggttt

SEQ ID NO: 1022008 - DNA, 24 bp, Homo sapiens
tggcaaacgctaaagagcccttgc

SEQ ID NO: 1022009 - DNA, 17 bp, Homo sapiens
tggcaaaggaaggtgga

SEQ ID NO: 1022010 - DNA, 15 bp, Homo sapiens
tggcaaatcaggggc

SEQ ID NO: 1022011 - DNA, 20 bp, Homo sapiens
tggcaaatcaggggccagag

SEQ ID NO: 1022012 - DNA, 20 bp, Homo sapiens
tggcaaattaacttgagttt

SEQ ID NO: 1022013 - DNA, 12 bp, Homo sapiens
tggcaacagaag

SEQ ID NO: 1022014 - DNA, 15 bp, Homo sapiens
tggcaacagaagcag

SEQ ID NO: 1022015 - DNA, 13 bp, Homo sapiens
tggcaagagcccc

SEQ ID NO: 1022016 - DNA, 21 bp, Homo sapiens
tggcaagcagggaaagctcca

SEQ ID NO: 1022017 - DNA, 22 bp, Homo sapiens
tggcaagcagggaaagctccac

SEQ ID NO: 1022018 - DNA, 17 bp, Homo sapiens
tggcaagctgcaggttt

SEQ ID NO: 1022019 - DNA, 16 bp, Homo sapiens
tggcaaggaaaaacag

SEQ ID NO: 1022020 - DNA, 11 bp, Homo sapiens
tggcaataaac

SEQ ID NO: 1022021 - DNA, 12 bp, Homo sapiens
tggcaatagacc

SEQ ID NO: 1022022 - DNA, 15 bp, Homo sapiens
tggcaataggacaaa

SEQ ID NO: 1022023 - DNA, 22 bp, Homo sapiens
tggcaataggacaaaacgggtt

SEQ ID NO: 1022024 - DNA, 15 bp, Homo sapiens
tggcaatagtgtgtt

SEQ ID NO: 1022025 - DNA, 19 bp, Homo sapiens
tggcaatattctgtaacta

SEQ ID NO: 1022026 - DNA, 20 bp, Homo sapiens
tggcaatattctgtaactat

SEQ ID NO: 1022027 - DNA, 16 bp, Homo sapiens
tggcaatgctaattca

SEQ ID NO: 1022028 - DNA, 19 bp, Homo sapiens
tggcaatgctaattcaatg

SEQ ID NO: 1022029 - DNA, 19 bp, Homo sapiens
tggcaatgcttaaactaaa

SEQ ID NO: 1022030 - DNA, 21 bp, Homo sapiens
tggcaatgcttaaactaaata

SEQ ID NO: 1022031 - DNA, 20 bp, Homo sapiens
tggcaatgggccgtcccctc

SEQ ID NO: 1022032 - DNA, 15 bp, Homo sapiens
tggcaattgcactca

SEQ ID NO: 1022033 - DNA, 16 bp, Homo sapiens
tggcaattgcactcat

SEQ ID NO: 1022034 - DNA, 14 bp, Homo sapiens
tggcaatttgaatt

SEQ ID NO: 1022035 - DNA, 19 bp, Homo sapiens
tggcaattttgtaaattga

SEQ ID NO: 1022036 - DNA, 15 bp, Homo sapiens
tggcaattttgtaac

SEQ ID NO: 1022037 - DNA, 23 bp, Homo sapiens
tggcacaatggctaattcccaga

SEQ ID NO: 1022038 - DNA, 12 bp, Homo sapiens
tggcacactccc

SEQ ID NO: 1022039 - DNA, 14 bp, Homo sapiens
tggcacagaaacac

SEQ ID NO: 1022040 - DNA, 16 bp, Homo sapiens
tggcacagaccaggcc

SEQ ID NO: 1022041 - DNA, 16 bp, Homo sapiens
tggcacagctgggagc

SEQ ID NO: 1022042 - DNA, 16 bp, Homo sapiens
tggcacagggcagtgg

SEQ ID NO: 1022043 - DNA, 21 bp, Homo sapiens
tggcacattcattttctcagt

SEQ ID NO: 1022044 - DNA, 21 bp, Homo sapiens
tggcaccaccagggtggacca

SEQ ID NO: 1022045 - DNA, 22 bp, Homo sapiens
tggcaccacttatttattgttg

SEQ ID NO: 1022046 - DNA, 13 bp, Homo sapiens
tggcaccatgtgc

SEQ ID NO: 1022047 - DNA, 15 bp, Homo sapiens
tggcaccatgtgcca

SEQ ID NO: 1022048 - DNA, 21 bp, Homo sapiens
tggcacccaccgtggaggagg

SEQ ID NO: 1022049 - DNA, 14 bp, Homo sapiens
tggcaccccagcta

SEQ ID NO: 1022050 - DNA, 21 bp, Homo sapiens
tggcaccccagctaccccttc

SEQ ID NO: 1022051 - DNA, 19 bp, Homo sapiens
tggcacccccatgctgcct

SEQ ID NO: 1022052 - DNA, 17 bp, Homo sapiens
tggcacctcaggctgag

SEQ ID NO: 1022053 - DNA, 16 bp, Homo sapiens
tggcacctgaaattaa

SEQ ID NO: 1022054 - DNA, 18 bp, Homo sapiens
gtagctgggatgacaggc

SEQ ID NO: 1022055 - DNA, 18 bp, Homo sapiens
gtagctgggcctgtgcac

SEQ ID NO: 1022056 - DNA, 17 bp, Homo sapiens
gtagctggtggttgtgc

SEQ ID NO: 1022057 - DNA, 14 bp, Homo sapiens
gtagctgtaagggc

SEQ ID NO: 1022058 - DNA, 16 bp, Homo sapiens
gtagctgtaagggcag

SEQ ID NO: 1022059 - DNA, 18 bp, Homo sapiens
gtagctgtggtgaggtgg

SEQ ID NO: 1022060 - DNA, 16 bp, Homo sapiens
gtagcttccacctcat

SEQ ID NO: 1022061 - DNA, 14 bp, Homo sapiens
gtagcttgctccct

SEQ ID NO: 1022062 - DNA, 20 bp, Homo sapiens
gtagctttaaaaccacagct

SEQ ID NO: 1022063 - DNA, 23 bp, Homo sapiens
gtagctttaacttgtaaaccaca

SEQ ID NO: 1022064 - DNA, 16 bp, Homo sapiens
gtagctttatccttag

SEQ ID NO: 1022065 - DNA, 16 bp, Homo sapiens
gtaggaaagaggaagc

SEQ ID NO: 1022066 - DNA, 23 bp, Homo sapiens
gtaggaaagtcacccaaacactt

SEQ ID NO: 1022067 - DNA, 16 bp, Homo sapiens
gtaggaacaagctggc

SEQ ID NO: 1022068 - DNA, 23 bp, Homo sapiens
gtaggaacaagctggcttctgtg

SEQ ID NO: 1022069 - DNA, 22 bp, Homo sapiens
gtaggaaccgtggtatgtctgc

SEQ ID NO: 1022070 - DNA, 12 bp, Homo sapiens
gtaggaatcctt

SEQ ID NO: 1022071 - DNA, 17 bp, Homo sapiens
gtaggaatcctttgaga

SEQ ID NO: 1022072 - DNA, 21 bp, Homo sapiens
gtaggaatcctttgagaatgt

SEQ ID NO: 1022073 - DNA, 16 bp, Homo sapiens
gtaggaatctgccttc

SEQ ID NO: 1022074 - DNA, 18 bp, Homo sapiens
gtaggaatctgccttcca

SEQ ID NO: 1022075 - DNA, 19 bp, Homo sapiens
gtaggactttcctaaatgt

SEQ ID NO: 1022076 - DNA, 15 bp, Homo sapiens
gtaggagagcactgc

SEQ ID NO: 1022077 - DNA, 12 bp, Homo sapiens
gtaggagaggag

SEQ ID NO: 1022078 - DNA, 15 bp, Homo sapiens
gtaggagaggagaaa

SEQ ID NO: 1022079 - DNA, 22 bp, Homo sapiens
gtaggagcccttctctttgact

SEQ ID NO: 1022080 - DNA, 16 bp, Homo sapiens
gtaggagggtgggaag

SEQ ID NO: 1022081 - DNA, 14 bp, Homo sapiens
gtaggaggtttgga

SEQ ID NO: 1022082 - DNA, 21 bp, Homo sapiens
gtaggatagctactaaatata

SEQ ID NO: 1022083 - DNA, 16 bp, Homo sapiens
gtaggatgttgcttct

SEQ ID NO: 1022084 - DNA, 18 bp, Homo sapiens
gtaggatgttgcttctga

SEQ ID NO: 1022085 - DNA, 13 bp, Homo sapiens
gtaggattgctgg

SEQ ID NO: 1022086 - DNA, 18 bp, Homo sapiens
gtaggatttatgtatttt

SEQ ID NO: 1022087 - DNA, 15 bp, Homo sapiens
gtaggcacagagctg

SEQ ID NO: 1022088 - DNA, 11 bp, Homo sapiens
gtaggcagaca

SEQ ID NO: 1022089 - DNA, 13 bp, Homo sapiens
gtaggcagacaca

SEQ ID NO: 1022090 - DNA, 22 bp, Homo sapiens
gtaggcagacacagggacttga

SEQ ID NO: 1022091 - DNA, 15 bp, Homo sapiens
gtaggcagagccttt

SEQ ID NO: 1022092 - DNA, 14 bp, Homo sapiens
gtaggcagaggctg

SEQ ID NO: 1022093 - DNA, 20 bp, Homo sapiens
gtaggcatgagggatcacag

SEQ ID NO: 1022094 - DNA, 23 bp, Homo sapiens
gtaggcatgagggatcacagggc

SEQ ID NO: 1022095 - DNA, 18 bp, Homo sapiens
gtaggctgtctgtgccat

SEQ ID NO: 1022096 - DNA, 13 bp, Homo sapiens
gtaggctgtgggg

SEQ ID NO: 1022097 - DNA, 14 bp, Homo sapiens
gtaggctgtggggt

SEQ ID NO: 1022098 - DNA, 20 bp, Homo sapiens
gtaggctgtggggtctggct

SEQ ID NO: 1022099 - DNA, 16 bp, Homo sapiens
gtaggctgttcccttt

SEQ ID NO: 1022100 - DNA, 17 bp, Homo sapiens
gtaggctgttccctttg

SEQ ID NO: 1022101 - DNA, 16 bp, Homo sapiens
gtagggaattcttctg

SEQ ID NO: 1022102 - DNA, 20 bp, Homo sapiens
gtagggatatggcaggactc

SEQ ID NO: 1022103 - DNA, 12 bp, Homo sapiens
gtaggggcaggg

SEQ ID NO: 1022104 - DNA, 13 bp, Homo sapiens
gtaggggcaggga

SEQ ID NO: 1022105 - DNA, 14 bp, Homo sapiens
gtaggggcagggag

SEQ ID NO: 1022106 - DNA, 16 bp, Homo sapiens
gtaggggcagggaggc

SEQ ID NO: 1022107 - DNA, 18 bp, Homo sapiens
gtaggggccacctcctcc

SEQ ID NO: 1022108 - DNA, 20 bp, Homo sapiens
gtaggggccacctcctcccc

SEQ ID NO: 1022109 - DNA, 22 bp, Homo sapiens
gtagggggccttgcggaagcca

SEQ ID NO: 1022110 - DNA, 13 bp, Homo sapiens
gtagggggctctg

SEQ ID NO: 1022111 - DNA, 14 bp, Homo sapiens
gtagggtctttctt

SEQ ID NO: 1022112 - DNA, 22 bp, Homo sapiens
gtaggtcacaacaactcatttt

SEQ ID NO: 1022113 - DNA, 14 bp, Homo sapiens
gtaggtccaagggc

SEQ ID NO: 1022114 - DNA, 18 bp, Homo sapiens
gtaggtctgtttgccact

SEQ ID NO: 1022115 - DNA, 16 bp, Homo sapiens
gtaggtgagcctgggc

SEQ ID NO: 1022116 - DNA, 20 bp, Homo sapiens
gtaggtgagcctgggcagct

SEQ ID NO: 1022117 - DNA, 24 bp, Homo sapiens
gtaggtggaagctagacacatgaa

SEQ ID NO: 1022118 - DNA, 23 bp, Homo sapiens
gtaggtgtctctgggcctgtgtg

SEQ ID NO: 1022119 - DNA, 21 bp, Homo sapiens
gtatatggcttcaagttgtaa

SEQ ID NO: 1022120 - DNA, 12 bp, Homo sapiens
gtatatgtatat

SEQ ID NO: 1022121 - DNA, 20 bp, Homo sapiens
gtatatgtattcccttgtat

SEQ ID NO: 1022122 - DNA, 21 bp, Homo sapiens
gtatatgtattcccttgtatt

SEQ ID NO: 1022123 - DNA, 22 bp, Homo sapiens
gtatatgtattcccttgtattt

SEQ ID NO: 1022124 - DNA, 12 bp, Homo sapiens
gtatatgtattt

SEQ ID NO: 1022125 - DNA, 13 bp, Homo sapiens
gtatatgtattta

SEQ ID NO: 1022126 - DNA, 14 bp, Homo sapiens
gtatatgtcattat

SEQ ID NO: 1022127 - DNA, 22 bp, Homo sapiens
gtatatgtcattatttattgtt

SEQ ID NO: 1022128 - DNA, 15 bp, Homo sapiens
gtatatgtgaaaaaa

SEQ ID NO: 1022129 - DNA, 18 bp, Homo sapiens
gtatatgtgcgtctctct

SEQ ID NO: 1022130 - DNA, 15 bp, Homo sapiens
gtatatgttgtaata

SEQ ID NO: 1022131 - DNA, 24 bp, Homo sapiens
gtatattaaaatagcatactgtgt

SEQ ID NO: 1022132 - DNA, 13 bp, Homo sapiens
gtatattacaatg

SEQ ID NO: 1022133 - DNA, 21 bp, Homo sapiens
gtatattgggtgtagatttct

SEQ ID NO: 1022134 - DNA, 22 bp, Homo sapiens
gtatattgtaggaatcctttga

SEQ ID NO: 1022135 - DNA, 22 bp, Homo sapiens
gtatatttaaactcaagacaat

SEQ ID NO: 1022136 - DNA, 18 bp, Homo sapiens
gtatatttaattaaagca

SEQ ID NO: 1022137 - DNA, 13 bp, Homo sapiens
gtatatttatact

SEQ ID NO: 1022138 - DNA, 14 bp, Homo sapiens
gtatatttatactc

SEQ ID NO: 1022139 - DNA, 15 bp, Homo sapiens
gtatatttatactct

SEQ ID NO: 1022140 - DNA, 16 bp, Homo sapiens
gtatatttatactcta

SEQ ID NO: 1022141 - DNA, 13 bp, Homo sapiens
gtatatttatagt

SEQ ID NO: 1022142 - DNA, 15 bp, Homo sapiens
gtatatttgtatgat

SEQ ID NO: 1022143 - DNA, 21 bp, Homo sapiens
gtatatttgtgatagcacttt

SEQ ID NO: 1022144 - DNA, 17 bp, Homo sapiens
gtatattttaatgaata

SEQ ID NO: 1022145 - DNA, 19 bp, Homo sapiens
gtatattttaatgaatatt

SEQ ID NO: 1022146 - DNA, 15 bp, Homo sapiens
gtatattttatttca

SEQ ID NO: 1022147 - DNA, 20 bp, Homo sapiens
gtatattttatttcaatgta

SEQ ID NO: 1022148 - DNA, 17 bp, Homo sapiens
gtatatttttgtatgtc

SEQ ID NO: 1022149 - DNA, 17 bp, Homo sapiens
gtatatttttgtctgca

SEQ ID NO: 1022150 - DNA, 15 bp, Homo sapiens
gtatcaaacccacga

SEQ ID NO: 1022151 - DNA, 14 bp, Homo sapiens
gtatcaaatacatt

SEQ ID NO: 1022152 - DNA, 19 bp, Homo sapiens
gtatcaataccaaatagct

SEQ ID NO: 1022153 - DNA, 14 bp, Homo sapiens
gtatcacagtgttt

SEQ ID NO: 1022154 - DNA, 16 bp, Homo sapiens
gtatcacgatttgcag

SEQ ID NO: 1022155 - DNA, 14 bp, Homo sapiens
gtatcacttttctg

SEQ ID NO: 1022156 - DNA, 16 bp, Homo sapiens
gtatcagccagccttc

SEQ ID NO: 1022157 - DNA, 13 bp, Homo sapiens
gtatcagctctct

SEQ ID NO: 1022158 - DNA, 14 bp, Homo sapiens
gtatcagtgtttat

SEQ ID NO: 1022159 - DNA, 19 bp, Homo sapiens
gtatcagtgtttatgtgct

SEQ ID NO: 1022160 - DNA, 17 bp, Homo sapiens
gtatcagttatatgata

SEQ ID NO: 1022161 - DNA, 12 bp, Homo sapiens
gtatcatagaaa

SEQ ID NO: 1022162 - DNA, 15 bp, Homo sapiens
gtatcattaaaatat

SEQ ID NO: 1022163 - DNA, 19 bp, Homo sapiens
gtatcattaaaatatatgt

SEQ ID NO: 1022164 - DNA, 22 bp, Homo sapiens
gtatcattaaaatatatgttct

SEQ ID NO: 1022165 - DNA, 19 bp, Homo sapiens
gtatcatttttgtgcacag

SEQ ID NO: 1022166 - DNA, 23 bp, Homo sapiens
gtatccagaggaattgattgtca

SEQ ID NO: 1022167 - DNA, 20 bp, Homo sapiens
gtatccatattttattactg

SEQ ID NO: 1022168 - DNA, 21 bp, Homo sapiens
gtatccatattttattactgt

SEQ ID NO: 1022169 - DNA, 17 bp, Homo sapiens
gtatccccccatcttgc

SEQ ID NO: 1022170 - DNA, 19 bp, Homo sapiens
gtatcccctgcctcctgcc

SEQ ID NO: 1022171 - DNA, 16 bp, Homo sapiens
gtatccccttctcatc

SEQ ID NO: 1022172 - DNA, 11 bp, Homo sapiens
gtatcctaaac

SEQ ID NO: 1022173 - DNA, 18 bp, Homo sapiens
gtatcctccctgcccatc

SEQ ID NO: 1022174 - DNA, 17 bp, Homo sapiens
gtatcctccctggcaga

SEQ ID NO: 1022175 - DNA, 16 bp, Homo sapiens
gtatcctgcccagtgt

SEQ ID NO: 1022176 - DNA, 17 bp, Homo sapiens
gtatcctgcccagtgtt

SEQ ID NO: 1022177 - DNA, 17 bp, Homo sapiens
gtatcctggaacaatat

SEQ ID NO: 1022178 - DNA, 22 bp, Homo sapiens
gtatcctggaacaatattttat

SEQ ID NO: 1022179 - DNA, 14 bp, Homo sapiens
gtatcctggccctg

SEQ ID NO: 1022180 - DNA, 19 bp, Homo sapiens
gtatctaaaggatggaaaa

SEQ ID NO: 1022181 - DNA, 21 bp, Homo sapiens
gtatctaagaataataaaatc

SEQ ID NO: 1022182 - DNA, 19 bp, Homo sapiens
gtatctacagtaatgaaat

SEQ ID NO: 1022183 - DNA, 14 bp, Homo sapiens
gtatctagcaatca

SEQ ID NO: 1022184 - DNA, 17 bp, Homo sapiens
gtatctaggcatttcat

SEQ ID NO: 1022185 - DNA, 16 bp, Homo sapiens
tggcatcgcagcttcc

SEQ ID NO: 1022186 - DNA, 14 bp, Homo sapiens
tggcatctgtgtgc

SEQ ID NO: 1022187 - DNA, 14 bp, Homo sapiens
tggcatctgtgtgt

SEQ ID NO: 1022188 - DNA, 18 bp, Homo sapiens
tggcatcttaaaagctat

SEQ ID NO: 1022189 - DNA, 20 bp, Homo sapiens
tggcatcttagacctccaca

SEQ ID NO: 1022190 - DNA, 16 bp, Homo sapiens
tggcatctttgccttg

SEQ ID NO: 1022191 - DNA, 21 bp, Homo sapiens
tggcatgatcatagctcactg

SEQ ID NO: 1022192 - DNA, 19 bp, Homo sapiens
tggcatggaaggggcttct

SEQ ID NO: 1022193 - DNA, 17 bp, Homo sapiens
tggcatggctccagtct

SEQ ID NO: 1022194 - DNA, 15 bp, Homo sapiens
tggcatgggacagac

SEQ ID NO: 1022195 - DNA, 21 bp, Homo sapiens
tggcatgggcgcaggcccagt

SEQ ID NO: 1022196 - DNA, 20 bp, Homo sapiens
tggcatgtgctgtgaccatt

SEQ ID NO: 1022197 - DNA, 22 bp, Homo sapiens
tggcatgtgctgtgaccattta

SEQ ID NO: 1022198 - DNA, 15 bp, Homo sapiens
tggcatgtggcctgt

SEQ ID NO: 1022199 - DNA, 18 bp, Homo sapiens
tggcatgtttcactcctg

SEQ ID NO: 1022200 - DNA, 17 bp, Homo sapiens
tggcatgttttctttgt

SEQ ID NO: 1022201 - DNA, 22 bp, Homo sapiens
tggcatgttttctttgtttcct

SEQ ID NO: 1022202 - DNA, 20 bp, Homo sapiens
tggcatgttttgtgcatttg

SEQ ID NO: 1022203 - DNA, 19 bp, Homo sapiens
tggcattaaaccacatcat

SEQ ID NO: 1022204 - DNA, 17 bp, Homo sapiens
tggcattctacacctgg

SEQ ID NO: 1022205 - DNA, 15 bp, Homo sapiens
tggcattcttgtaca

SEQ ID NO: 1022206 - DNA, 19 bp, Homo sapiens
tggcatttcaattcctggc

SEQ ID NO: 1022207 - DNA, 15 bp, Homo sapiens
tggcatttccctact

SEQ ID NO: 1022208 - DNA, 16 bp, Homo sapiens
tggcatttctatactt

SEQ ID NO: 1022209 - DNA, 17 bp, Homo sapiens
tggcatttctatacttt

SEQ ID NO: 1022210 - DNA, 16 bp, Homo sapiens
tggcatttctctttaa

SEQ ID NO: 1022211 - DNA, 17 bp, Homo sapiens
tggcatttctctttaaa

SEQ ID NO: 1022212 - DNA, 17 bp, Homo sapiens
tggcattttcctcgcct

SEQ ID NO: 1022213 - DNA, 16 bp, Homo sapiens
tggccaaacatcagac

SEQ ID NO: 1022214 - DNA, 14 bp, Homo sapiens
tggccaaagagcct

SEQ ID NO: 1022215 - DNA, 20 bp, Homo sapiens
tggccaaagagcctttccaa

SEQ ID NO: 1022216 - DNA, 17 bp, Homo sapiens
tggccaaataggaggga

SEQ ID NO: 1022217 - DNA, 18 bp, Homo sapiens
tggccaaatatgcacttt

SEQ ID NO: 1022218 - DNA, 19 bp, Homo sapiens
tggccaaatatgcactttc

SEQ ID NO: 1022219 - DNA, 18 bp, Homo sapiens
tggccaaattatttgtgt

SEQ ID NO: 1022220 - DNA, 13 bp, Homo sapiens
tggccaaccagga

SEQ ID NO: 1022221 - DNA, 16 bp, Homo sapiens
tggccaaccaggaccc

SEQ ID NO: 1022222 - DNA, 19 bp, Homo sapiens
tggccaaccaggacccagg

SEQ ID NO: 1022223 - DNA, 20 bp, Homo sapiens
tggccaaccaggacccaggg

SEQ ID NO: 1022224 - DNA, 22 bp, Homo sapiens
tggccaaccaggacccagggtc

SEQ ID NO: 1022225 - DNA, 13 bp, Homo sapiens
tggccaactgcaa

SEQ ID NO: 1022226 - DNA, 14 bp, Homo sapiens
tggccaactgcaaa

SEQ ID NO: 1022227 - DNA, 21 bp, Homo sapiens
tggccaagaagcagtggcctt

SEQ ID NO: 1022228 - DNA, 19 bp, Homo sapiens
tggccaaggagctgctata

SEQ ID NO: 1022229 - DNA, 22 bp, Homo sapiens
tggccaaggtgtccagggtcct

SEQ ID NO: 1022230 - DNA, 22 bp, Homo sapiens
tggccacaactgctgtggcccc

SEQ ID NO: 1022231 - DNA, 14 bp, Homo sapiens
tggccacagcaccc

SEQ ID NO: 1022232 - DNA, 15 bp, Homo sapiens
tggccacagccccct

SEQ ID NO: 1022233 - DNA, 19 bp, Homo sapiens
tggccacagcccccttgcc

SEQ ID NO: 1022234 - DNA, 23 bp, Homo sapiens
tggccacagcccccttgccctcc

SEQ ID NO: 1022235 - DNA, 13 bp, Homo sapiens
tggccacagcgcc

SEQ ID NO: 1022236 - DNA, 18 bp, Homo sapiens
tggccacagcgccagcct

SEQ ID NO: 1022237 - DNA, 20 bp, Homo sapiens
tggccacagcgccagcctca

SEQ ID NO: 1022238 - DNA, 18 bp, Homo sapiens
tggccacagcgtgctggc

SEQ ID NO: 1022239 - DNA, 20 bp, Homo sapiens
tggccacagtgtcactggtc

SEQ ID NO: 1022240 - DNA, 16 bp, Homo sapiens
tggccacatcagcccc

SEQ ID NO: 1022241 - DNA, 20 bp, Homo sapiens
gccctggctcccacaggccc

SEQ ID NO: 1022242 - DNA, 17 bp, Homo sapiens
gccctggctcccacctg

SEQ ID NO: 1022243 - DNA, 23 bp, Homo sapiens
gccctggctccttgcagcagggc

SEQ ID NO: 1022244 - DNA, 12 bp, Homo sapiens
gccctggctctg

SEQ ID NO: 1022245 - DNA, 14 bp, Homo sapiens
gccctggctctgca

SEQ ID NO: 1022246 - DNA, 14 bp, Homo sapiens
gccctggctctgcc

SEQ ID NO: 1022247 - DNA, 19 bp, Homo sapiens
gccctggctctgcccctca

SEQ ID NO: 1022248 - DNA, 21 bp, Homo sapiens
gccctggctctgcccctcagg

SEQ ID NO: 1022249 - DNA, 12 bp, Homo sapiens
gccctggctgct

SEQ ID NO: 1022250 - DNA, 19 bp, Homo sapiens
gccctggctgctgccccca

SEQ ID NO: 1022251 - DNA, 22 bp, Homo sapiens
gccctggctgctgcccccaccc

SEQ ID NO: 1022252 - DNA, 15 bp, Homo sapiens
gccctggctgggttc

SEQ ID NO: 1022253 - DNA, 16 bp, Homo sapiens
gccctgggagggggct

SEQ ID NO: 1022254 - DNA, 15 bp, Homo sapiens
gccctgggcagggca

SEQ ID NO: 1022255 - DNA, 13 bp, Homo sapiens
gccctgggccagg

SEQ ID NO: 1022256 - DNA, 18 bp, Homo sapiens
gccctgggccaggcaggc

SEQ ID NO: 1022257 - DNA, 19 bp, Homo sapiens
gccctgggccaggcaggcg

SEQ ID NO: 1022258 - DNA, 15 bp, Homo sapiens
gccctgggccccacc

SEQ ID NO: 1022259 - DNA, 18 bp, Homo sapiens
tccctcttttcttactcc

SEQ ID NO: 1022260 - DNA, 17 bp, Homo sapiens
tccctgaaaacccagag

SEQ ID NO: 1022261 - DNA, 19 bp, Homo sapiens
tccctgaaaacccagagag

SEQ ID NO: 1022262 - DNA, 20 bp, Homo sapiens
tccctgaaaacccagagagg

SEQ ID NO: 1022263 - DNA, 17 bp, Homo sapiens
tccctgaaaatgttttt

SEQ ID NO: 1022264 - DNA, 18 bp, Homo sapiens
tccctgaaacactgcttc

SEQ ID NO: 1022265 - DNA, 19 bp, Homo sapiens
tccctgaacccctggccag

SEQ ID NO: 1022266 - DNA, 20 bp, Homo sapiens
tccctgaacccctggccagc

SEQ ID NO: 1022267 - DNA, 19 bp, Homo sapiens
tccctgaacgttttcttct

SEQ ID NO: 1022268 - DNA, 20 bp, Homo sapiens
tccctgaacgttttcttctt

SEQ ID NO: 1022269 - DNA, 11 bp, Homo sapiens
tccctgaccat

SEQ ID NO: 1022270 - DNA, 21 bp, Homo sapiens
tccctgacctccctctaattt

SEQ ID NO: 1022271 - DNA, 23 bp, Homo sapiens
tccctgaccttagcgttctggac

SEQ ID NO: 1022272 - DNA, 17 bp, Homo sapiens
tccctgactccctgtgg

SEQ ID NO: 1022273 - DNA, 19 bp, Homo sapiens
tccctgactccctgtgggg

SEQ ID NO: 1022274 - DNA, 19 bp, Homo sapiens
tccctgacttctcccccgc

SEQ ID NO: 1022275 - DNA, 16 bp, Homo sapiens
tccctgacttgcttta

SEQ ID NO: 1022276 - DNA, 15 bp, Homo sapiens
tccctgagacaggga

SEQ ID NO: 1022277 - DNA, 13 bp, Homo sapiens
tccctgagcctgc

SEQ ID NO: 1022278 - DNA, 22 bp, Homo sapiens
tccctgaggttaaacggtgccc

SEQ ID NO: 1022279 - DNA, 15 bp, Homo sapiens
tccctgagtcaccag

SEQ ID NO: 1022280 - DNA, 21 bp, Homo sapiens
tccctgagtcaccaggaatgt

SEQ ID NO: 1022281 - DNA, 14 bp, Homo sapiens
tccctgatggaccc

SEQ ID NO: 1022282 - DNA, 18 bp, Homo sapiens
tccctgatggcctttgga

SEQ ID NO: 1022283 - DNA, 21 bp, Homo sapiens
tccctgatggcctttggaccc

SEQ ID NO: 1022284 - DNA, 18 bp, Homo sapiens
tccctgattgacctgctc

SEQ ID NO: 1022285 - DNA, 20 bp, Homo sapiens
tccctgcacagtgacttctg

SEQ ID NO: 1022286 - DNA, 22 bp, Homo sapiens
tccctgcaccgccgcagaagca

SEQ ID NO: 1022287 - DNA, 23 bp, Homo sapiens
tccctgcaccgccgcagaagcag

SEQ ID NO: 1022288 - DNA, 19 bp, Homo sapiens
tccctgcacggcccaaggg

SEQ ID NO: 1022289 - DNA, 22 bp, Homo sapiens
tccctgcactaaagccagcctg

SEQ ID NO: 1022290 - DNA, 23 bp, Homo sapiens
tccctgcactaaagccagcctga

SEQ ID NO: 1022291 - DNA, 14 bp, Homo sapiens
tccctgcactgtgc

SEQ ID NO: 1022292 - DNA, 14 bp, Homo sapiens
tccctgcactgtgt

SEQ ID NO: 1022293 - DNA, 17 bp, Homo sapiens
tccctgcagaagccaga

SEQ ID NO: 1022294 - DNA, 19 bp, Homo sapiens
tccctgcagacctcaagcc

SEQ ID NO: 1022295 - DNA, 20 bp, Homo sapiens
tccctgcagacctcaagcca

SEQ ID NO: 1022296 - DNA, 22 bp, Homo sapiens
tccctgcagacctcaagccatc

SEQ ID NO: 1022297 - DNA, 23 bp, Homo sapiens
tccctgcagatgccaccctagcc

SEQ ID NO: 1022298 - DNA, 15 bp, Homo sapiens
tccctgcagccacca

SEQ ID NO: 1022299 - DNA, 14 bp, Homo sapiens
tccctgcaggggct

SEQ ID NO: 1022300 - DNA, 15 bp, Homo sapiens
tccctgcatcctgag

SEQ ID NO: 1022301 - DNA, 18 bp, Homo sapiens
tccctgcatctgaccagc

SEQ ID NO: 1022302 - DNA, 20 bp, Homo sapiens
tccctgcatctgaccagcag

SEQ ID NO: 1022303 - DNA, 14 bp, Homo sapiens
tccctgcatttctg

SEQ ID NO: 1022304 - DNA, 20 bp, Homo sapiens
tccctgccactgggctctgg

SEQ ID NO: 1022305 - DNA, 18 bp, Homo sapiens
tccctgcccaaaccctta

SEQ ID NO: 1022306 - DNA, 21 bp, Homo sapiens
tccctgcccatccgtctgtct

SEQ ID NO: 1022307 - DNA, 13 bp, Homo sapiens
tccctgccccaaa

SEQ ID NO: 1022308 - DNA, 15 bp, Homo sapiens
tccctgccccgcccc

SEQ ID NO: 1022309 - DNA, 20 bp, Homo sapiens
tccctgcccctcccttcaac

SEQ ID NO: 1022310 - DNA, 23 bp, Homo sapiens
tccctgcctctcatcaactgaat

SEQ ID NO: 1022311 - DNA, 13 bp, Homo sapiens
tccctgcctgagg

SEQ ID NO: 1022312 - DNA, 18 bp, Homo sapiens
tccctgcctgctccttgg

SEQ ID NO: 1022313 - DNA, 19 bp, Homo sapiens
tccctgcctgctccttggc

SEQ ID NO: 1022314 - DNA, 11 bp, Homo sapiens
tccctgccttt

SEQ ID NO: 1022315 - DNA, 18 bp, Homo sapiens
tccctgcgcttcatctca

SEQ ID NO: 1022316 - DNA, 15 bp, Homo sapiens
tccctgcgggccagg

SEQ ID NO: 1022317 - DNA, 16 bp, Homo sapiens
tccctgctcagtgctt

SEQ ID NO: 1022318 - DNA, 22 bp, Homo sapiens
tccctgctcagtgcttgggctc

SEQ ID NO: 1022319 - DNA, 11 bp, Homo sapiens
tccctgctccc

SEQ ID NO: 1022320 - DNA, 14 bp, Homo sapiens
tccctgctctggtc

SEQ ID NO: 1022321 - DNA, 20 bp, Homo sapiens
tccctgctgtgccatgctgg

SEQ ID NO: 1022322 - DNA, 21 bp, Homo sapiens
tccctgcttgcacacttcccc

SEQ ID NO: 1022323 - DNA, 15 bp, Homo sapiens
tccctgcttgcccgc

SEQ ID NO: 1022324 - DNA, 22 bp, Homo sapiens
tccctgcttgcccgctcccaca

SEQ ID NO: 1022325 - DNA, 17 bp, Homo sapiens
tccctggaaccttctag

SEQ ID NO: 1022326 - DNA, 13 bp, Homo sapiens
tccctggaagctt

SEQ ID NO: 1022327 - DNA, 19 bp, Homo sapiens
tccctggacaggcagcctc

SEQ ID NO: 1022328 - DNA, 23 bp, Homo sapiens
tccctggacaggcagcctccttt

SEQ ID NO: 1022329 - DNA, 17 bp, Homo sapiens
tccctggagcaggagcc

SEQ ID NO: 1022330 - DNA, 17 bp, Homo sapiens
tccctggagccagactc

SEQ ID NO: 1022331 - DNA, 19 bp, Homo sapiens
tccctggagccagactctg

SEQ ID NO: 1022332 - DNA, 14 bp, Homo sapiens
tccctggccatctc

SEQ ID NO: 1022333 - DNA, 13 bp, Homo sapiens
tccctggcctgtt

SEQ ID NO: 1022334 - DNA, 11 bp, Homo sapiens
tccctggcgca

SEQ ID NO: 1022335 - DNA, 19 bp, Homo sapiens
tccctggcggccccaactc

SEQ ID NO: 1022336 - DNA, 12 bp, Homo sapiens
tccctggctccc

SEQ ID NO: 1022337 - DNA, 16 bp, Homo sapiens
tccctggctctcagaa

SEQ ID NO: 1022338 - DNA, 16 bp, Homo sapiens
tccctggctgccctgg

SEQ ID NO: 1022339 - DNA, 18 bp, Homo sapiens
tccctggctgccctggcc

SEQ ID NO: 1022340 - DNA, 20 bp, Homo sapiens
tccctggctgccctggccct

SEQ ID NO: 1022341 - DNA, 22 bp, Homo sapiens
tccctggcttgtaactccacca

SEQ ID NO: 1022342 - DNA, 22 bp, Homo sapiens
tccctgggacacagacccagga

SEQ ID NO: 1022343 - DNA, 23 bp, Homo sapiens
tccctgggacacagacccaggac

SEQ ID NO: 1022344 - DNA, 15 bp, Homo sapiens
tccctgggatctggt

SEQ ID NO: 1022345 - DNA, 16 bp, Homo sapiens
tccctgggccacctcc

SEQ ID NO: 1022346 - DNA, 17 bp, Homo sapiens
tccctgggccacctcct

SEQ ID NO: 1022347 - DNA, 17 bp, Homo sapiens
tccctgggccagggtct

SEQ ID NO: 1022348 - DNA, 17 bp, Homo sapiens
tccctgggcccctccac

SEQ ID NO: 1022349 - DNA, 18 bp, Homo sapiens
tccctgggcccctccacg

SEQ ID NO: 1022350 - DNA, 20 bp, Homo sapiens
tccctgggcccctccacgcc

SEQ ID NO: 1022351 - DNA, 12 bp, Homo sapiens
tccctgggcctc

SEQ ID NO: 1022352 - DNA, 16 bp, Homo sapiens
tccctgggctgtgcta

SEQ ID NO: 1022353 - DNA, 20 bp, Homo sapiens
tccctgggctgtgctacctg

SEQ ID NO: 1022354 - DNA, 20 bp, Homo sapiens
tccctggggaaaacttgcag

SEQ ID NO: 1022355 - DNA, 17 bp, Homo sapiens
tccctggggagccctca

SEQ ID NO: 1022356 - DNA, 22 bp, Homo sapiens
tccctggggagccctcaggctc

SEQ ID NO: 1022357 - DNA, 17 bp, Homo sapiens
tccctggggatatgcaa

SEQ ID NO: 1022358 - DNA, 22 bp, Homo sapiens
tccctggggatatgcaaccctt

SEQ ID NO: 1022359 - DNA, 21 bp, Homo sapiens
tccctggggccaacggcaaca

SEQ ID NO: 1022360 - DNA, 20 bp, Homo sapiens
tccctgggggaagccctgga

SEQ ID NO: 1022361 - DNA, 21 bp, Homo sapiens
tccctgggggaagccctggat

SEQ ID NO: 1022362 - DNA, 15 bp, Homo sapiens
tccctgggggcccca

SEQ ID NO: 1022363 - DNA, 21 bp, Homo sapiens
tccctgggggccttgggtgag

SEQ ID NO: 1022364 - DNA, 22 bp, Homo sapiens
tccctgggggccttgggtgagt

SEQ ID NO: 1022365 - DNA, 14 bp, Homo sapiens
tccctggggtgggg

SEQ ID NO: 1022366 - DNA, 14 bp, Homo sapiens
tccctgggtctggg

SEQ ID NO: 1022367 - DNA, 12 bp, Homo sapiens
tccctggtcacc

SEQ ID NO: 1022368 - DNA, 17 bp, Homo sapiens
tccctggtccctcgtcc

SEQ ID NO: 1022369 - DNA, 19 bp, Homo sapiens
tccctggtcccttggagac

SEQ ID NO: 1022370 - DNA, 17 bp, Homo sapiens
tccctggtgcctctgtg

SEQ ID NO: 1022371 - DNA, 15 bp, Homo sapiens
tccctggttgcctct

SEQ ID NO: 1022372 - DNA, 22 bp, Homo sapiens
gccctttcccaggtaatttaaa

SEQ ID NO: 1022373 - DNA, 21 bp, Homo sapiens
gccctttcctaggcccaggcc

SEQ ID NO: 1022374 - DNA, 16 bp, Homo sapiens
gccctttcctcctcag

SEQ ID NO: 1022375 - DNA, 21 bp, Homo sapiens
gccctttgagatctggggagg

SEQ ID NO: 1022376 - DNA, 19 bp, Homo sapiens
gccctttgcagtgtgcagg

SEQ ID NO: 1022377 - DNA, 15 bp, Homo sapiens
gccctttgctctgat

SEQ ID NO: 1022378 - DNA, 17 bp, Homo sapiens
gccctttggccaacagg

SEQ ID NO: 1022379 - DNA, 16 bp, Homo sapiens
gcccttttccagcctc

SEQ ID NO: 1022380 - DNA, 13 bp, Homo sapiens
gccgaagcccagg

SEQ ID NO: 1022381 - DNA, 22 bp, Homo sapiens
gccgaagccccttggagagaga

SEQ ID NO: 1022382 - DNA, 17 bp, Homo sapiens
gccgaatgactatgtcc

SEQ ID NO: 1022383 - DNA, 14 bp, Homo sapiens
gccgaatgtgcagg

SEQ ID NO: 1022384 - DNA, 13 bp, Homo sapiens
gccgacagtcggt

SEQ ID NO: 1022385 - DNA, 24 bp, Homo sapiens
gccgacagtcggtgaccccatcac

SEQ ID NO: 1022386 - DNA, 14 bp, Homo sapiens
gccgacatccctcc

SEQ ID NO: 1022387 - DNA, 18 bp, Homo sapiens
gccgacatccctccccca

SEQ ID NO: 1022388 - DNA, 19 bp, Homo sapiens
gccgacatccctcccccag

SEQ ID NO: 1022389 - DNA, 23 bp, Homo sapiens
gccgacatccctcccccagcaga

SEQ ID NO: 1022390 - DNA, 16 bp, Homo sapiens
gccgacattgtctccc

SEQ ID NO: 1022391 - DNA, 17 bp, Homo sapiens
gccgaccagagccccac

SEQ ID NO: 1022392 - DNA, 13 bp, Homo sapiens
gccgaccctcctg

SEQ ID NO: 1022393 - DNA, 14 bp, Homo sapiens
gccgaccctcctgg

SEQ ID NO: 1022394 - DNA, 21 bp, Homo sapiens
gccgaccctcctggccttcct

SEQ ID NO: 1022395 - DNA, 23 bp, Homo sapiens
gccgaccctcctggccttcctcg

SEQ ID NO: 1022396 - DNA, 12 bp, Homo sapiens
gccgaccctgcg

SEQ ID NO: 1022397 - DNA, 22 bp, Homo sapiens
gccgaccgaggctggagctggc

SEQ ID NO: 1022398 - DNA, 14 bp, Homo sapiens
gccgacctcagcct

SEQ ID NO: 1022399 - DNA, 17 bp, Homo sapiens
gccgacctcagccttcc

SEQ ID NO: 1022400 - DNA, 13 bp, Homo sapiens
gccgactcctggg

SEQ ID NO: 1022401 - DNA, 16 bp, Homo sapiens
gccgactctggccctg

SEQ ID NO: 1022402 - DNA, 22 bp, Homo sapiens
gccgactgcacagcggcccctg

SEQ ID NO: 1022403 - DNA, 14 bp, Homo sapiens
gccgagaccgcaga

SEQ ID NO: 1022404 - DNA, 16 bp, Homo sapiens
gccgagagcctgctcc

SEQ ID NO: 1022405 - DNA, 22 bp, Homo sapiens
gccgagatcacaccactgtact

SEQ ID NO: 1022406 - DNA, 15 bp, Homo sapiens
gccgagccgggcctg

SEQ ID NO: 1022407 - DNA, 16 bp, Homo sapiens
gccgagccgggcctgg

SEQ ID NO: 1022408 - DNA, 19 bp, Homo sapiens
gccgagccgggcctggggc

SEQ ID NO: 1022409 - DNA, 13 bp, Homo sapiens
gccgagctcctgg

SEQ ID NO: 1022410 - DNA, 16 bp, Homo sapiens
gccgagctcctgggga

SEQ ID NO: 1022411 - DNA, 19 bp, Homo sapiens
gccgagctcctggggagct

SEQ ID NO: 1022412 - DNA, 22 bp, Homo sapiens
gccgagctcctggggagctcct

SEQ ID NO: 1022413 - DNA, 12 bp, Homo sapiens
gccgagctgcct

SEQ ID NO: 1022414 - DNA, 16 bp, Homo sapiens
gccgagctgcctggcg

SEQ ID NO: 1022415 - DNA, 12 bp, Homo sapiens
gccgagggccag

SEQ ID NO: 1022416 - DNA, 13 bp, Homo sapiens
gccgagggccagg

SEQ ID NO: 1022417 - DNA, 17 bp, Homo sapiens
gccgagggccaggcaga

SEQ ID NO: 1022418 - DNA, 14 bp, Homo sapiens
gccgattctctgcc

SEQ ID NO: 1022419 - DNA, 17 bp, Homo sapiens
gccgcaagtctgcagcc

SEQ ID NO: 1022420 - DNA, 16 bp, Homo sapiens
gccgcaatacaggaac

SEQ ID NO: 1022421 - DNA, 16 bp, Homo sapiens
gccgcaccccagagtg

SEQ ID NO: 1022422 - DNA, 15 bp, Homo sapiens
gccgcaccctgcacc

SEQ ID NO: 1022423 - DNA, 18 bp, Homo sapiens
gccgcaccctgcacctgc

SEQ ID NO: 1022424 - DNA, 21 bp, Homo sapiens
gccgcaccctgcacctgctgc

SEQ ID NO: 1022425 - DNA, 19 bp, Homo sapiens
gccgcacgcctctccctgc

SEQ ID NO: 1022426 - DNA, 14 bp, Homo sapiens
gccgcagaagcagc

SEQ ID NO: 1022427 - DNA, 15 bp, Homo sapiens
gccgcagaagcagcc

SEQ ID NO: 1022428 - DNA, 18 bp, Homo sapiens
gccgcagaagcagcccct

SEQ ID NO: 1022429 - DNA, 21 bp, Homo sapiens
gccgcagaggtgtaggggtgg

SEQ ID NO: 1022430 - DNA, 18 bp, Homo sapiens
gccgcagcctccctctga

SEQ ID NO: 1022431 - DNA, 13 bp, Homo sapiens
gccgcagcggtgg

SEQ ID NO: 1022432 - DNA, 12 bp, Homo sapiens
gccgcaggaggg

SEQ ID NO: 1022433 - DNA, 14 bp, Homo sapiens
gccgcaggagggag

SEQ ID NO: 1022434 - DNA, 17 bp, Homo sapiens
gccgcaggagggaggcg

SEQ ID NO: 1022435 - DNA, 23 bp, Homo sapiens
gccgcaggagggaggcggggagg

SEQ ID NO: 1022436 - DNA, 18 bp, Homo sapiens
gccgcagggcccaccttg

SEQ ID NO: 1022437 - DNA, 20 bp, Homo sapiens
gccgcataggcccagccagg

SEQ ID NO: 1022438 - DNA, 14 bp, Homo sapiens
gccgcattccctga

SEQ ID NO: 1022439 - DNA, 18 bp, Homo sapiens
gccgcattccctgagtca

SEQ ID NO: 1022440 - DNA, 22 bp, Homo sapiens
gccgccacctgaggtgggctgg

SEQ ID NO: 1022441 - DNA, 17 bp, Homo sapiens
gccgccactaggtgtcc

SEQ ID NO: 1022442 - DNA, 21 bp, Homo sapiens
gccgccactaggtgtccccaa

SEQ ID NO: 1022443 - DNA, 20 bp, Homo sapiens
gccgccagcgtgtggagcag

SEQ ID NO: 1022444 - DNA, 21 bp, Homo sapiens
gccgccagcgtgtggagcaga

SEQ ID NO: 1022445 - DNA, 20 bp, Homo sapiens
gccgccagtacttgtcatat

SEQ ID NO: 1022446 - DNA, 18 bp, Homo sapiens
gccgccagttcatctttt

SEQ ID NO: 1022447 - DNA, 14 bp, Homo sapiens
gccgccatctgcgc

SEQ ID NO: 1022448 - DNA, 18 bp, Homo sapiens
gccgccattgccaccagg

SEQ ID NO: 1022449 - DNA, 21 bp, Homo sapiens
gccgccattgccaccaggaga

SEQ ID NO: 1022450 - DNA, 14 bp, Homo sapiens
gccgcccaaggccc

SEQ ID NO: 1022451 - DNA, 23 bp, Homo sapiens
gccgcccacccccacccccagtg

SEQ ID NO: 1022452 - DNA, 15 bp, Homo sapiens
gccgcccacctcgct

SEQ ID NO: 1022453 - DNA, 19 bp, Homo sapiens
gccgcccacctcgctcccc

SEQ ID NO: 1022454 - DNA, 13 bp, Homo sapiens
gccgcccacgccg

SEQ ID NO: 1022455 - DNA, 19 bp, Homo sapiens
gccgcccacgccggcctct

SEQ ID NO: 1022456 - DNA, 21 bp, Homo sapiens
gccgcccacgccggcctctgc

SEQ ID NO: 1022457 - DNA, 15 bp, Homo sapiens
gccgccccagcccct

SEQ ID NO: 1022458 - DNA, 13 bp, Homo sapiens
gccgccctgagag

SEQ ID NO: 1022459 - DNA, 16 bp, Homo sapiens
gccgccctggacagat

SEQ ID NO: 1022460 - DNA, 15 bp, Homo sapiens
gccgccctgggctgt

SEQ ID NO: 1022461 - DNA, 15 bp, Homo sapiens
gccgccgccaggact

SEQ ID NO: 1022462 - DNA, 21 bp, Homo sapiens
gccgccgtgacctattcaccc

SEQ ID NO: 1022463 - DNA, 13 bp, Homo sapiens
gccgcctcccagc

SEQ ID NO: 1022464 - DNA, 17 bp, Homo sapiens
gccgcctcccagcctgg

SEQ ID NO: 1022465 - DNA, 20 bp, Homo sapiens
gccgcctgagaccctcgcgc

SEQ ID NO: 1022466 - DNA, 14 bp, Homo sapiens
gccgcctgccctgc

SEQ ID NO: 1022467 - DNA, 14 bp, Homo sapiens
gccgcctgctcctc

SEQ ID NO: 1022468 - DNA, 16 bp, Homo sapiens
gccgcctgctcctcac

SEQ ID NO: 1022469 - DNA, 13 bp, Homo sapiens
gccgcctggtact

SEQ ID NO: 1022470 - DNA, 15 bp, Homo sapiens
gccgccttctcccct

SEQ ID NO: 1022471 - DNA, 23 bp, Homo sapiens
gccgcgaactgggttctttggaa

SEQ ID NO: 1022472 - DNA, 23 bp, Homo sapiens
gccgcgctccgaaccccgggccc

SEQ ID NO: 1022473 - DNA, 21 bp, Homo sapiens
gccgcggccctggggcgggca

SEQ ID NO: 1022474 - DNA, 16 bp, Homo sapiens
gccgctacctccctcc

SEQ ID NO: 1022475 - DNA, 16 bp, Homo sapiens
gccgctagaggcctga

SEQ ID NO: 1022476 - DNA, 17 bp, Homo sapiens
gccgctagaggcctgag

SEQ ID NO: 1022477 - DNA, 19 bp, Homo sapiens
gccgctagaggcctgagga

SEQ ID NO: 1022478 - DNA, 22 bp, Homo sapiens
gccgctaggagagactgaaagc

SEQ ID NO: 1022479 - DNA, 14 bp, Homo sapiens
gccgctccccttgg

SEQ ID NO: 1022480 - DNA, 18 bp, Homo sapiens
gccgctccccttggacct

SEQ ID NO: 1022481 - DNA, 22 bp, Homo sapiens
gccgctccccttggacctccag

SEQ ID NO: 1022482 - DNA, 14 bp, Homo sapiens
gccgctcctccctg

SEQ ID NO: 1022483 - DNA, 21 bp, Homo sapiens
gccgctcctccctgctcctca

SEQ ID NO: 1022484 - DNA, 19 bp, Homo sapiens
gccgctcctgtctgccagc

SEQ ID NO: 1022485 - DNA, 22 bp, Homo sapiens
gccgctcctgtctgccagccag

SEQ ID NO: 1022486 - DNA, 14 bp, Homo sapiens
gccgctcgatgcct

SEQ ID NO: 1022487 - DNA, 14 bp, Homo sapiens
gccgctgcaccacg

SEQ ID NO: 1022488 - DNA, 12 bp, Homo sapiens
gccgctgcacct

SEQ ID NO: 1022489 - DNA, 16 bp, Homo sapiens
gccgctgcacctgcct

SEQ ID NO: 1022490 - DNA, 11 bp, Homo sapiens
gccgctgcagg

SEQ ID NO: 1022491 - DNA, 15 bp, Homo sapiens
gccgctgcaggaaac

SEQ ID NO: 1022492 - DNA, 12 bp, Homo sapiens
gccgctgcaggg

SEQ ID NO: 1022493 - DNA, 16 bp, Homo sapiens
gccgctgcagggctcc

SEQ ID NO: 1022494 - DNA, 18 bp, Homo sapiens
gccgctgcagggctccca

SEQ ID NO: 1022495 - DNA, 20 bp, Homo sapiens
gccgctgcagggctcccatg

SEQ ID NO: 1022496 - DNA, 22 bp, Homo sapiens
gccgctgcagggctcccatggg

SEQ ID NO: 1022497 - DNA, 18 bp, Homo sapiens
tccctggttgcctctctt

SEQ ID NO: 1022498 - DNA, 22 bp, Homo sapiens
tccctggttgcctctcttgccc

SEQ ID NO: 1022499 - DNA, 18 bp, Homo sapiens
tccctggtttgcagctgt

SEQ ID NO: 1022500 - DNA, 19 bp, Homo sapiens
tccctggtttgcagctgtt

SEQ ID NO: 1022501 - DNA, 22 bp, Homo sapiens
tccctgtaaattgcagaattca

SEQ ID NO: 1022502 - DNA, 14 bp, Homo sapiens
tccctgtaacctct

SEQ ID NO: 1022503 - DNA, 20 bp, Homo sapiens
tccctgtaattgttgtttgt

SEQ ID NO: 1022504 - DNA, 21 bp, Homo sapiens
tccctgtaattgttgtttgta

SEQ ID NO: 1022505 - DNA, 18 bp, Homo sapiens
tccctgtagctctgcctc

SEQ ID NO: 1022506 - DNA, 23 bp, Homo sapiens
tccctgtagttgacaattctgca

SEQ ID NO: 1022507 - DNA, 22 bp, Homo sapiens
tccctgtattttctttctctac

SEQ ID NO: 1022508 - DNA, 16 bp, Homo sapiens
tccctgtcacacactg

SEQ ID NO: 1022509 - DNA, 18 bp, Homo sapiens
tccctgtcacacactgga

SEQ ID NO: 1022510 - DNA, 19 bp, Homo sapiens
tccctgtcacacactggac

SEQ ID NO: 1022511 - DNA, 15 bp, Homo sapiens
tccctgtcaggacac

SEQ ID NO: 1022512 - DNA, 18 bp, Homo sapiens
tccctgtcaggacacatg

SEQ ID NO: 1022513 - DNA, 19 bp, Homo sapiens
tccctgtcaggacacatgg

SEQ ID NO: 1022514 - DNA, 16 bp, Homo sapiens
tccctgtccccaggcc

SEQ ID NO: 1022515 - DNA, 18 bp, Homo sapiens
tccctgtccccaggccca

SEQ ID NO: 1022516 - DNA, 20 bp, Homo sapiens
tccctgtccccaggcccagc

SEQ ID NO: 1022517 - DNA, 23 bp, Homo sapiens
tccctgtccccaggcccagccct

SEQ ID NO: 1022518 - DNA, 14 bp, Homo sapiens
tccctgtcccccag

SEQ ID NO: 1022519 - DNA, 14 bp, Homo sapiens
tccctgtccctcta

SEQ ID NO: 1022520 - DNA, 21 bp, Homo sapiens
tccctgtccctctagtgcctt

SEQ ID NO: 1022521 - DNA, 18 bp, Homo sapiens
tccctgtccctgccccgc

SEQ ID NO: 1022522 - DNA, 23 bp, Homo sapiens
tccctgtcccttcgagtccagga

SEQ ID NO: 1022523 - DNA, 12 bp, Homo sapiens
tccctgtccttc

SEQ ID NO: 1022524 - DNA, 17 bp, Homo sapiens
tccctgtccttccctgt

SEQ ID NO: 1022525 - DNA, 14 bp, Homo sapiens
tccctgtctccagc

SEQ ID NO: 1022526 - DNA, 19 bp, Homo sapiens
tccctgtctccagctgcct

SEQ ID NO: 1022527 - DNA, 16 bp, Homo sapiens
tccctgtctccagggc

SEQ ID NO: 1022528 - DNA, 21 bp, Homo sapiens
tccctgtctccagggccccca

SEQ ID NO: 1022529 - DNA, 23 bp, Homo sapiens
tccctgtctccagggcccccacc

SEQ ID NO: 1022530 - DNA, 19 bp, Homo sapiens
tccctgtgcccccagcctc

SEQ ID NO: 1022531 - DNA, 20 bp, Homo sapiens
tccctgtgcccccagcctca

SEQ ID NO: 1022532 - DNA, 22 bp, Homo sapiens
tccctgtgcccccagcctcagc

SEQ ID NO: 1022533 - DNA, 20 bp, Homo sapiens
tccctgtgcctaacaccagc

SEQ ID NO: 1022534 - DNA, 21 bp, Homo sapiens
tccctgtggcactcagggagc

SEQ ID NO: 1022535 - DNA, 12 bp, Homo sapiens
tccctgtggggg

SEQ ID NO: 1022536 - DNA, 19 bp, Homo sapiens
tccctgtgggggtggccat

SEQ ID NO: 1022537 - DNA, 20 bp, Homo sapiens
tccctgtgtccacctgtggg

SEQ ID NO: 1022538 - DNA, 22 bp, Homo sapiens
tccctgtgtccacctgtgggtg

SEQ ID NO: 1022539 - DNA, 21 bp, Homo sapiens
tccctgtgtggatgctgagct

SEQ ID NO: 1022540 - DNA, 17 bp, Homo sapiens
tccctgtgttacccagg

SEQ ID NO: 1022541 - DNA, 18 bp, Homo sapiens
tccctgtgttctgggctg

SEQ ID NO: 1022542 - DNA, 19 bp, Homo sapiens
tccctgtgttctgggctgg

SEQ ID NO: 1022543 - DNA, 23 bp, Homo sapiens
tccctgttctccctttctctctc

SEQ ID NO: 1022544 - DNA, 15 bp, Homo sapiens
tccctgttcttcctc

SEQ ID NO: 1022545 - DNA, 21 bp, Homo sapiens
tccctgttcttcctccagctg

SEQ ID NO: 1022546 - DNA, 16 bp, Homo sapiens
tccctgtttctccaca

SEQ ID NO: 1022547 - DNA, 11 bp, Homo sapiens
tccctgttttc

SEQ ID NO: 1022548 - DNA, 18 bp, Homo sapiens
tcccttaaaatagaaata

SEQ ID NO: 1022549 - DNA, 12 bp, Homo sapiens
tcccttaaaatt

SEQ ID NO: 1022550 - DNA, 20 bp, Homo sapiens
tcccttaactctaaccctgt

SEQ ID NO: 1022551 - DNA, 15 bp, Homo sapiens
tcccttaacttttcc

SEQ ID NO: 1022552 - DNA, 21 bp, Homo sapiens
tcccttaatatcctaaacatc

SEQ ID NO: 1022553 - DNA, 14 bp, Homo sapiens
tcccttagcctctc

SEQ ID NO: 1022554 - DNA, 15 bp, Homo sapiens
tcccttagcctctcc

SEQ ID NO: 1022555 - DNA, 16 bp, Homo sapiens
tcccttagcctctccc

SEQ ID NO: 1022556 - DNA, 18 bp, Homo sapiens
tcccttagcctctcccac

SEQ ID NO: 1022557 - DNA, 13 bp, Homo sapiens
tcccttaggcatt

SEQ ID NO: 1022558 - DNA, 20 bp, Homo sapiens
tcccttatgagcgtcactgc

SEQ ID NO: 1022559 - DNA, 16 bp, Homo sapiens
tcccttattagttaca

SEQ ID NO: 1022560 - DNA, 11 bp, Homo sapiens
tcccttcaacc

SEQ ID NO: 1022561 - DNA, 21 bp, Homo sapiens
tcccttcaaccattccccatg

SEQ ID NO: 1022562 - DNA, 19 bp, Homo sapiens
tcccttcagggattccctg

SEQ ID NO: 1022563 - DNA, 21 bp, Homo sapiens
tcccttcagtaccctctcagc

SEQ ID NO: 1022564 - DNA, 23 bp, Homo sapiens
tcccttcagtaccctctcagctc

SEQ ID NO: 1022565 - DNA, 18 bp, Homo sapiens
tcccttcatctccaggga

SEQ ID NO: 1022566 - DNA, 19 bp, Homo sapiens
tcccttcatttaaactaaa

SEQ ID NO: 1022567 - DNA, 20 bp, Homo sapiens
tcccttcatttaaactaaat

SEQ ID NO: 1022568 - DNA, 13 bp, Homo sapiens
tcccttcccacat

SEQ ID NO: 1022569 - DNA, 13 bp, Homo sapiens
tcccttcccagtg

SEQ ID NO: 1022570 - DNA, 17 bp, Homo sapiens
tcccttcccagtgggct

SEQ ID NO: 1022571 - DNA, 22 bp, Homo sapiens
tcccttcccagtgggctgtgtt

SEQ ID NO: 1022572 - DNA, 20 bp, Homo sapiens
tcccttcccctccctggctc

SEQ ID NO: 1022573 - DNA, 13 bp, Homo sapiens
tcccttccctcct

SEQ ID NO: 1022574 - DNA, 14 bp, Homo sapiens
tcccttccctcctc

SEQ ID NO: 1022575 - DNA, 20 bp, Homo sapiens
tcccttcctattctcctgcc

SEQ ID NO: 1022576 - DNA, 23 bp, Homo sapiens
tcccttcctattctcctgccatg

SEQ ID NO: 1022577 - DNA, 14 bp, Homo sapiens
tcccttcctcaccc

SEQ ID NO: 1022578 - DNA, 22 bp, Homo sapiens
tcccttcctcggtggctctggg

SEQ ID NO: 1022579 - DNA, 16 bp, Homo sapiens
tcccttcctctctcct

SEQ ID NO: 1022580 - DNA, 12 bp, Homo sapiens
tcccttcctctt

SEQ ID NO: 1022581 - DNA, 14 bp, Homo sapiens
tcccttcctgccac

SEQ ID NO: 1022582 - DNA, 13 bp, Homo sapiens
tcccttcctggaa

SEQ ID NO: 1022583 - DNA, 17 bp, Homo sapiens
tcccttcctggaaacag

SEQ ID NO: 1022584 - DNA, 22 bp, Homo sapiens
tcccttcctggaaacagcatga

SEQ ID NO: 1022585 - DNA, 15 bp, Homo sapiens
tcccttcctggcctc

SEQ ID NO: 1022586 - DNA, 18 bp, Homo sapiens
tcccttccttgggcagaa

SEQ ID NO: 1022587 - DNA, 13 bp, Homo sapiens
tcccttcctttct

SEQ ID NO: 1022588 - DNA, 17 bp, Homo sapiens
tcccttccttttccctg

SEQ ID NO: 1022589 - DNA, 18 bp, Homo sapiens
tcccttccttttccctgc

SEQ ID NO: 1022590 - DNA, 17 bp, Homo sapiens
tcccttcgagtccagga

SEQ ID NO: 1022591 - DNA, 17 bp, Homo sapiens
tcccttctacaaggact

SEQ ID NO: 1022592 - DNA, 19 bp, Homo sapiens
tcccttctcccccttgtct

SEQ ID NO: 1022593 - DNA, 23 bp, Homo sapiens
tcccttctctgtagggaactctg

SEQ ID NO: 1022594 - DNA, 13 bp, Homo sapiens
tcccttctgctac

SEQ ID NO: 1022595 - DNA, 14 bp, Homo sapiens
tcccttctgctact

SEQ ID NO: 1022596 - DNA, 19 bp, Homo sapiens
tcccttctggacactgaga

SEQ ID NO: 1022597 - DNA, 16 bp, Homo sapiens
tcccttcttgggtagg

SEQ ID NO: 1022598 - DNA, 21 bp, Homo sapiens
tcccttcttgggtctgccctg

SEQ ID NO: 1022599 - DNA, 13 bp, Homo sapiens
tcccttcttggtt

SEQ ID NO: 1022600 - DNA, 15 bp, Homo sapiens
tcccttgaattgtgt

SEQ ID NO: 1022601 - DNA, 17 bp, Homo sapiens
tcccttgaattgtgtat

SEQ ID NO: 1022602 - DNA, 23 bp, Homo sapiens
tcccttgaggaaacaacagcttt

SEQ ID NO: 1022603 - DNA, 18 bp, Homo sapiens
tcccttgagggctgcagt

SEQ ID NO: 1022604 - DNA, 19 bp, Homo sapiens
tcccttgagggctgcagtt

SEQ ID NO: 1022605 - DNA, 18 bp, Homo sapiens
tcccttgatgcacagaga

SEQ ID NO: 1022606 - DNA, 22 bp, Homo sapiens
tcccttgatgcacagagaagct

SEQ ID NO: 1022607 - DNA, 21 bp, Homo sapiens
tcccttgcaggggtcccccct

SEQ ID NO: 1022608 - DNA, 13 bp, Homo sapiens
tcccttgccactt

SEQ ID NO: 1022609 - DNA, 15 bp, Homo sapiens
tcccttgccccaggc

SEQ ID NO: 1022610 - DNA, 12 bp, Homo sapiens
tcccttgcctca

SEQ ID NO: 1022611 - DNA, 20 bp, Homo sapiens
tcccttgcctcaatgccagt

SEQ ID NO: 1022612 - DNA, 21 bp, Homo sapiens
tcccttgctcagtgcctcctg

SEQ ID NO: 1022613 - DNA, 19 bp, Homo sapiens
tcccttgcttttccctctt

SEQ ID NO: 1022614 - DNA, 19 bp, Homo sapiens
tcccttgggaaggacacag

SEQ ID NO: 1022615 - DNA, 21 bp, Homo sapiens
tcccttgggaaggacacagca

SEQ ID NO: 1022616 - DNA, 16 bp, Homo sapiens
tcccttggggaagggt

SEQ ID NO: 1022617 - DNA, 17 bp, Homo sapiens
tcccttgggttctgata

SEQ ID NO: 1022618 - DNA, 21 bp, Homo sapiens
tcccttgtaaagacagagtga

SEQ ID NO: 1022619 - DNA, 23 bp, Homo sapiens
tcccttgtaaagacagagtgaat

SEQ ID NO: 1022620 - DNA, 14 bp, Homo sapiens
gccgctgccaccca

SEQ ID NO: 1022621 - DNA, 12 bp, Homo sapiens
gccgctgccacg

SEQ ID NO: 1022622 - DNA, 16 bp, Homo sapiens
gccgctgccgctgcac

SEQ ID NO: 1022623 - DNA, 17 bp, Homo sapiens
gccgctgccgctgcacc

SEQ ID NO: 1022624 - DNA, 22 bp, Homo sapiens
gccgctggctggtgggccccca

SEQ ID NO: 1022625 - DNA, 12 bp, Homo sapiens
gccgctgtgagc

SEQ ID NO: 1022626 - DNA, 17 bp, Homo sapiens
gccgctgtgagcccctg

SEQ ID NO: 1022627 - DNA, 17 bp, Homo sapiens
gccgctgttcacccaca

SEQ ID NO: 1022628 - DNA, 22 bp, Homo sapiens
gccggaaggaatgtcagggcca

SEQ ID NO: 1022629 - DNA, 20 bp, Homo sapiens
gccggaccgcgtagagagcc

SEQ ID NO: 1022630 - DNA, 23 bp, Homo sapiens
gccggaccgcgtagagagccggg

SEQ ID NO: 1022631 - DNA, 15 bp, Homo sapiens
gccggacctgagccc

SEQ ID NO: 1022632 - DNA, 17 bp, Homo sapiens
gccggacctgagcccgc

SEQ ID NO: 1022633 - DNA, 13 bp, Homo sapiens
gccggagcccaga

SEQ ID NO: 1022634 - DNA, 14 bp, Homo sapiens
gccggaggaggaga

SEQ ID NO: 1022635 - DNA, 21 bp, Homo sapiens
gccggcaaaactttggcactg

SEQ ID NO: 1022636 - DNA, 21 bp, Homo sapiens
gccggcaaccccagttctgct

SEQ ID NO: 1022637 - DNA, 13 bp, Homo sapiens
gccggcacagggt

SEQ ID NO: 1022638 - DNA, 22 bp, Homo sapiens
gccggcacccacaagtgccact

SEQ ID NO: 1022639 - DNA, 16 bp, Homo sapiens
gccggcatccttgcct

SEQ ID NO: 1022640 - DNA, 19 bp, Homo sapiens
gccggccaatggaaacctc

SEQ ID NO: 1022641 - DNA, 12 bp, Homo sapiens
gccggccagccc

SEQ ID NO: 1022642 - DNA, 13 bp, Homo sapiens
gccggcccagatg

SEQ ID NO: 1022643 - DNA, 14 bp, Homo sapiens
gccggccccaggct

SEQ ID NO: 1022644 - DNA, 16 bp, Homo sapiens
gccggcccgcctctcc

SEQ ID NO: 1022645 - DNA, 17 bp, Homo sapiens
gccggccggacctctga

SEQ ID NO: 1022646 - DNA, 18 bp, Homo sapiens
gccggccggacctctgag

SEQ ID NO: 1022647 - DNA, 12 bp, Homo sapiens
gccggcctctct

SEQ ID NO: 1022648 - DNA, 13 bp, Homo sapiens
gccggcctctctg

SEQ ID NO: 1022649 - DNA, 14 bp, Homo sapiens
gccggcgagggggc

SEQ ID NO: 1022650 - DNA, 17 bp, Homo sapiens
gccggcgagggggccgg

SEQ ID NO: 1022651 - DNA, 23 bp, Homo sapiens
gccggcgagggggccggggggag

SEQ ID NO: 1022652 - DNA, 19 bp, Homo sapiens
gccggcggcagccccactt

SEQ ID NO: 1022653 - DNA, 14 bp, Homo sapiens
gccggcggctctga

SEQ ID NO: 1022654 - DNA, 16 bp, Homo sapiens
gccggcggctctgagc

SEQ ID NO: 1022655 - DNA, 19 bp, Homo sapiens
gccggcggctctgagcagg

SEQ ID NO: 1022656 - DNA, 13 bp, Homo sapiens
gccggctggcctg

SEQ ID NO: 1022657 - DNA, 18 bp, Homo sapiens
gccggctgtgctcagaga

SEQ ID NO: 1022658 - DNA, 15 bp, Homo sapiens
gccggctgtggagca

SEQ ID NO: 1022659 - DNA, 19 bp, Homo sapiens
gccggcttcatgccagcta

SEQ ID NO: 1022660 - DNA, 16 bp, Homo sapiens
gccgggaccctcaggt

SEQ ID NO: 1022661 - DNA, 17 bp, Homo sapiens
gccgggagaagccacct

SEQ ID NO: 1022662 - DNA, 18 bp, Homo sapiens
gccgggagaggactctgc

SEQ ID NO: 1022663 - DNA, 15 bp, Homo sapiens
gccgggaggcagtgc

SEQ ID NO: 1022664 - DNA, 16 bp, Homo sapiens
gccgggaggcagtgct

SEQ ID NO: 1022665 - DNA, 19 bp, Homo sapiens
gccgggcaggtcctgccca

SEQ ID NO: 1022666 - DNA, 23 bp, Homo sapiens
gccgggcatggtggcgcaagcct

SEQ ID NO: 1022667 - DNA, 12 bp, Homo sapiens
gccgggcccctg

SEQ ID NO: 1022668 - DNA, 19 bp, Homo sapiens
gccgggccgaatcccctcc

SEQ ID NO: 1022669 - DNA, 20 bp, Homo sapiens
gccgggcgccaggacagcag

SEQ ID NO: 1022670 - DNA, 13 bp, Homo sapiens
gccgggctgtaga

SEQ ID NO: 1022671 - DNA, 14 bp, Homo sapiens
gccggggacccact

SEQ ID NO: 1022672 - DNA, 23 bp, Homo sapiens
gccggggaggggcagagaggaag

SEQ ID NO: 1022673 - DNA, 18 bp, Homo sapiens
gccggggagggggcacgg

SEQ ID NO: 1022674 - DNA, 20 bp, Homo sapiens
gccggggccacccaaatgtg

SEQ ID NO: 1022675 - DNA, 15 bp, Homo sapiens
gccggggctgagact

SEQ ID NO: 1022676 - DNA, 16 bp, Homo sapiens
gccgggggaggggccc

SEQ ID NO: 1022677 - DNA, 19 bp, Homo sapiens
gccgggggaggggccctca

SEQ ID NO: 1022678 - DNA, 22 bp, Homo sapiens
gccgggggaggggccctcaggc

SEQ ID NO: 1022679 - DNA, 23 bp, Homo sapiens
gccgggggaggggccctcaggcc

SEQ ID NO: 1022680 - DNA, 13 bp, Homo sapiens
gccggggggaggg

SEQ ID NO: 1022681 - DNA, 23 bp, Homo sapiens
gccggggggaggggacagagctg

SEQ ID NO: 1022682 - DNA, 20 bp, Homo sapiens
gccggggggggtaggagagg

SEQ ID NO: 1022683 - DNA, 23 bp, Homo sapiens
gccggggggggtaggagaggaga

SEQ ID NO: 1022684 - DNA, 20 bp, Homo sapiens
gccggggtccaggcccgtgg

SEQ ID NO: 1022685 - DNA, 21 bp, Homo sapiens
gccggggtgtaacttcctgct

SEQ ID NO: 1022686 - DNA, 24 bp, Homo sapiens
gccggggtgtaacttcctgctgca

SEQ ID NO: 1022687 - DNA, 19 bp, Homo sapiens
gccgggtgcggtggctcac

SEQ ID NO: 1022688 - DNA, 21 bp, Homo sapiens
gccgggtgtggcacgcacctg

SEQ ID NO: 1022689 - DNA, 22 bp, Homo sapiens
gccggtaactgtcctgtcctgc

SEQ ID NO: 1022690 - DNA, 16 bp, Homo sapiens
gccggtcacccaggct

SEQ ID NO: 1022691 - DNA, 18 bp, Homo sapiens
gccggtccggcgccccgc

SEQ ID NO: 1022692 - DNA, 15 bp, Homo sapiens
gccggtcgggcagcc

SEQ ID NO: 1022693 - DNA, 15 bp, Homo sapiens
gccggtgaggggagg

SEQ ID NO: 1022694 - DNA, 15 bp, Homo sapiens
gccggtgcctgggtg

SEQ ID NO: 1022695 - DNA, 22 bp, Homo sapiens
gccggtgcctgggtggccatcc

SEQ ID NO: 1022696 - DNA, 22 bp, Homo sapiens
gccggtgcttccaacaaggaca

SEQ ID NO: 1022697 - DNA, 13 bp, Homo sapiens
gccggtgggaccc

SEQ ID NO: 1022698 - DNA, 16 bp, Homo sapiens
gccggtgggaccctgt

SEQ ID NO: 1022699 - DNA, 21 bp, Homo sapiens
gccgtagggagtacctgctgc

SEQ ID NO: 1022700 - DNA, 23 bp, Homo sapiens
gccgtatctgtcacaataaatgg

SEQ ID NO: 1022701 - DNA, 23 bp, Homo sapiens
gccgtcaccaccacccctaccac

SEQ ID NO: 1022702 - DNA, 13 bp, Homo sapiens
gccgtcagccatc

SEQ ID NO: 1022703 - DNA, 19 bp, Homo sapiens
gccgtcagccatcagccat

SEQ ID NO: 1022704 - DNA, 17 bp, Homo sapiens
gccgtccatggcaccag

SEQ ID NO: 1022705 - DNA, 18 bp, Homo sapiens
gccgtccatggcaccagc

SEQ ID NO: 1022706 - DNA, 22 bp, Homo sapiens
gccgtccatggcaccagccccc

SEQ ID NO: 1022707 - DNA, 20 bp, Homo sapiens
gccgtcccaccagcttcact

SEQ ID NO: 1022708 - DNA, 16 bp, Homo sapiens
gccgtcccaggccacc

SEQ ID NO: 1022709 - DNA, 17 bp, Homo sapiens
gccgtcccctctcccct

SEQ ID NO: 1022710 - DNA, 18 bp, Homo sapiens
gccgtcccgcgttcaaga

SEQ ID NO: 1022711 - DNA, 20 bp, Homo sapiens
gccgtcctcccgggccctcc

SEQ ID NO: 1022712 - DNA, 13 bp, Homo sapiens
gccgtcctgctgg

SEQ ID NO: 1022713 - DNA, 17 bp, Homo sapiens
gccgtcctgctggagtg

SEQ ID NO: 1022714 - DNA, 11 bp, Homo sapiens
gccgtctcaac

SEQ ID NO: 1022715 - DNA, 17 bp, Homo sapiens
gccgtctcatcttctct

SEQ ID NO: 1022716 - DNA, 13 bp, Homo sapiens
gccgtctcctccc

SEQ ID NO: 1022717 - DNA, 14 bp, Homo sapiens
gccgtctgactcca

SEQ ID NO: 1022718 - DNA, 18 bp, Homo sapiens
gccgtctgactccagagt

SEQ ID NO: 1022719 - DNA, 19 bp, Homo sapiens
gccgtctgcaggggcctgg

SEQ ID NO: 1022720 - DNA, 20 bp, Homo sapiens
gccgtcttcactcgcccccg

SEQ ID NO: 1022721 - DNA, 22 bp, Homo sapiens
gccgtcttcactcgcccccggg

SEQ ID NO: 1022722 - DNA, 21 bp, Homo sapiens
gccgtgacctattcaccctcc

SEQ ID NO: 1022723 - DNA, 20 bp, Homo sapiens
gccgtgctcgccccagcagg

SEQ ID NO: 1022724 - DNA, 16 bp, Homo sapiens
gccgtgctgggcagcc

SEQ ID NO: 1022725 - DNA, 13 bp, Homo sapiens
gccgtggatggcc

SEQ ID NO: 1022726 - DNA, 16 bp, Homo sapiens
gccgtggcacagctgg

SEQ ID NO: 1022727 - DNA, 17 bp, Homo sapiens
gccgtgggccgggaggc

SEQ ID NO: 1022728 - DNA, 23 bp, Homo sapiens
gccgtgggcctgtcgtgccagtc

SEQ ID NO: 1022729 - DNA, 16 bp, Homo sapiens
gccgtggtcctttggg

SEQ ID NO: 1022730 - DNA, 18 bp, Homo sapiens
gccgtgtcccctgacagg

SEQ ID NO: 1022731 - DNA, 14 bp, Homo sapiens
gccgtgtgagtgtg

SEQ ID NO: 1022732 - DNA, 18 bp, Homo sapiens
gccgtgtgagtgtgacag

SEQ ID NO: 1022733 - DNA, 15 bp, Homo sapiens
gccgttactctccaa

SEQ ID NO: 1022734 - DNA, 20 bp, Homo sapiens
gccgttgaatctgggaggga

SEQ ID NO: 1022735 - DNA, 22 bp, Homo sapiens
gcctaaaaattcccttcctgtt

SEQ ID NO: 1022736 - DNA, 18 bp, Homo sapiens
gcctaaaactggcctgac

SEQ ID NO: 1022737 - DNA, 15 bp, Homo sapiens
gcctaaaagtaaaca

SEQ ID NO: 1022738 - DNA, 23 bp, Homo sapiens
gcctaaaagtgggcttgattctg

SEQ ID NO: 1022739 - DNA, 18 bp, Homo sapiens
gcctaaaattgtatgaaa

SEQ ID NO: 1022740 - DNA, 19 bp, Homo sapiens
gcctaaagctaaaaatatt

SEQ ID NO: 1022741 - DNA, 21 bp, Homo sapiens
gcctaaagggcagggcccacg

SEQ ID NO: 1022742 - DNA, 19 bp, Homo sapiens
gcctaaatcccaagaaatg

SEQ ID NO: 1022743 - DNA, 19 bp, Homo sapiens
gcctaaatttaatgctgcc

SEQ ID NO: 1022744 - DNA, 13 bp, Homo sapiens
tcccttgttctct

SEQ ID NO: 1022745 - DNA, 23 bp, Homo sapiens
tccctttaaagagagtttgccac

SEQ ID NO: 1022746 - DNA, 13 bp, Homo sapiens
tccctttatgtat

SEQ ID NO: 1022747 - DNA, 14 bp, Homo sapiens
tccctttccctacc

SEQ ID NO: 1022748 - DNA, 18 bp, Homo sapiens
tccctttccttccatccc

SEQ ID NO: 1022749 - DNA, 13 bp, Homo sapiens
tccctttctcagg

SEQ ID NO: 1022750 - DNA, 14 bp, Homo sapiens
tccctttctcccag

SEQ ID NO: 1022751 - DNA, 14 bp, Homo sapiens
tccctttctctctc

SEQ ID NO: 1022752 - DNA, 19 bp, Homo sapiens
tccctttctctctcctctc

SEQ ID NO: 1022753 - DNA, 17 bp, Homo sapiens
tccctttctcttcttcc

SEQ ID NO: 1022754 - DNA, 13 bp, Homo sapiens
tccctttctggga

SEQ ID NO: 1022755 - DNA, 16 bp, Homo sapiens
tccctttcttggccag

SEQ ID NO: 1022756 - DNA, 16 bp, Homo sapiens
tccctttgaagataat

SEQ ID NO: 1022757 - DNA, 23 bp, Homo sapiens
tccctttgacttcagctgcctga

SEQ ID NO: 1022758 - DNA, 20 bp, Homo sapiens
tcccttttctgttctagttt

SEQ ID NO: 1022759 - DNA, 14 bp, Homo sapiens
tccctttttaaaaa

SEQ ID NO: 1022760 - DNA, 20 bp, Homo sapiens
tccctttttatatcccattt

SEQ ID NO: 1022761 - DNA, 20 bp, Homo sapiens
tccctttttcataaattatt

SEQ ID NO: 1022762 - DNA, 19 bp, Homo sapiens
tccctttttttacatttca

SEQ ID NO: 1022763 - DNA, 16 bp, Homo sapiens
tcccttttttttttaa

SEQ ID NO: 1022764 - DNA, 22 bp, Homo sapiens
tccgaaaaatcctcttcctctg

SEQ ID NO: 1022765 - DNA, 20 bp, Homo sapiens
tccgaaggtgtctctggtct

SEQ ID NO: 1022766 - DNA, 21 bp, Homo sapiens
tccgaaggtgtctctggtctt

SEQ ID NO: 1022767 - DNA, 17 bp, Homo sapiens
tccgaatgggttttcta

SEQ ID NO: 1022768 - DNA, 20 bp, Homo sapiens
tccgacaaccgatgctccag

SEQ ID NO: 1022769 - DNA, 21 bp, Homo sapiens
tccgacaaccgatgctccagc

SEQ ID NO: 1022770 - DNA, 17 bp, Homo sapiens
tccgacatcccagacca

SEQ ID NO: 1022771 - DNA, 17 bp, Homo sapiens
tccgacctacgttcctg

SEQ ID NO: 1022772 - DNA, 22 bp, Homo sapiens
tccgacctacgttcctggcccc

SEQ ID NO: 1022773 - DNA, 17 bp, Homo sapiens
tccgacctctctcagcc

SEQ ID NO: 1022774 - DNA, 14 bp, Homo sapiens
tccgacttcccctg

SEQ ID NO: 1022775 - DNA, 15 bp, Homo sapiens
tccgacttcccctgg

SEQ ID NO: 1022776 - DNA, 16 bp, Homo sapiens
tccgacttcccctggg

SEQ ID NO: 1022777 - DNA, 19 bp, Homo sapiens
tccgacttcccctgggcaa

SEQ ID NO: 1022778 - DNA, 13 bp, Homo sapiens
tccgagagggaga

SEQ ID NO: 1022779 - DNA, 16 bp, Homo sapiens
tccgagaggtgggcca

SEQ ID NO: 1022780 - DNA, 20 bp, Homo sapiens
tccgagatccccagggcagc

SEQ ID NO: 1022781 - DNA, 12 bp, Homo sapiens
tccgagctgctt

SEQ ID NO: 1022782 - DNA, 17 bp, Homo sapiens
tccgagctgctttgtgg

SEQ ID NO: 1022783 - DNA, 21 bp, Homo sapiens
tccgaggacccaggaaaggca

SEQ ID NO: 1022784 - DNA, 15 bp, Homo sapiens
tccgaggactggact

SEQ ID NO: 1022785 - DNA, 12 bp, Homo sapiens
tccgaggcaggg

SEQ ID NO: 1022786 - DNA, 13 bp, Homo sapiens
tccgaggcagggt

SEQ ID NO: 1022787 - DNA, 21 bp, Homo sapiens
tccgaggctccccgcctccac

SEQ ID NO: 1022788 - DNA, 23 bp, Homo sapiens
tccgagtgtgatttgaattctgt

SEQ ID NO: 1022789 - DNA, 15 bp, Homo sapiens
tccgatccttcctcc

SEQ ID NO: 1022790 - DNA, 16 bp, Homo sapiens
tccgcaccagctgctc

SEQ ID NO: 1022791 - DNA, 18 bp, Homo sapiens
tccgcaccagctgctctg

SEQ ID NO: 1022792 - DNA, 20 bp, Homo sapiens
tccgcaccagctgctctgcc

SEQ ID NO: 1022793 - DNA, 21 bp, Homo sapiens
tccgcaccagctgctctgccc

SEQ ID NO: 1022794 - DNA, 23 bp, Homo sapiens
tccgcaccagctgctctgcccct

SEQ ID NO: 1022795 - DNA, 15 bp, Homo sapiens
tccgcactttccact

SEQ ID NO: 1022796 - DNA, 15 bp, Homo sapiens
tccgcagaagccctg

SEQ ID NO: 1022797 - DNA, 20 bp, Homo sapiens
tccgcagcccctttccccac

SEQ ID NO: 1022798 - DNA, 15 bp, Homo sapiens
tccgcaggtgctggt

SEQ ID NO: 1022799 - DNA, 16 bp, Homo sapiens
tccgcagtgtctccac

SEQ ID NO: 1022800 - DNA, 18 bp, Homo sapiens
tccgcagtgtggccaggc

SEQ ID NO: 1022801 - DNA, 17 bp, Homo sapiens
tccgcattggaagagcc

SEQ ID NO: 1022802 - DNA, 19 bp, Homo sapiens
tccgcattggaagagcccg

SEQ ID NO: 1022803 - DNA, 21 bp, Homo sapiens
tccgccacccccgccgtgggg

SEQ ID NO: 1022804 - DNA, 14 bp, Homo sapiens
tccgccactcagcc

SEQ ID NO: 1022805 - DNA, 14 bp, Homo sapiens
tccgccactccagt

SEQ ID NO: 1022806 - DNA, 22 bp, Homo sapiens
tccgccagaccccgtggctctg

SEQ ID NO: 1022807 - DNA, 11 bp, Homo sapiens
tccgccagcct

SEQ ID NO: 1022808 - DNA, 12 bp, Homo sapiens
tccgccagcctc

SEQ ID NO: 1022809 - DNA, 18 bp, Homo sapiens
tccgccagcctcctctgg

SEQ ID NO: 1022810 - DNA, 12 bp, Homo sapiens
tccgccaggaaa

SEQ ID NO: 1022811 - DNA, 18 bp, Homo sapiens
tccgcccacctcagcctc

SEQ ID NO: 1022812 - DNA, 14 bp, Homo sapiens
tccgcccagcctct

SEQ ID NO: 1022813 - DNA, 15 bp, Homo sapiens
tccgcccagcctctc

SEQ ID NO: 1022814 - DNA, 17 bp, Homo sapiens
tccgcccatccctgacc

SEQ ID NO: 1022815 - DNA, 16 bp, Homo sapiens
tccgcccccagcctat

SEQ ID NO: 1022816 - DNA, 16 bp, Homo sapiens
tccgcccctgcctgcc

SEQ ID NO: 1022817 - DNA, 15 bp, Homo sapiens
tccgccctgccactc

SEQ ID NO: 1022818 - DNA, 14 bp, Homo sapiens
tccgccctgctcct

SEQ ID NO: 1022819 - DNA, 19 bp, Homo sapiens
tccgcccttagtcccccaa

SEQ ID NO: 1022820 - DNA, 21 bp, Homo sapiens
tccgcccttagtcccccaact

SEQ ID NO: 1022821 - DNA, 13 bp, Homo sapiens
tccgcctccagga

SEQ ID NO: 1022822 - DNA, 13 bp, Homo sapiens
tccgcctgcgcct

SEQ ID NO: 1022823 - DNA, 14 bp, Homo sapiens
tccgcctgcgcctc

SEQ ID NO: 1022824 - DNA, 12 bp, Homo sapiens
tccgcctgggat

SEQ ID NO: 1022825 - DNA, 12 bp, Homo sapiens
tccgcctgtggg

SEQ ID NO: 1022826 - DNA, 17 bp, Homo sapiens
tccgccttcactccggt

SEQ ID NO: 1022827 - DNA, 19 bp, Homo sapiens
tccgcgcccagcgctcgcc

SEQ ID NO: 1022828 - DNA, 14 bp, Homo sapiens
tccgcgccctccga

SEQ ID NO: 1022829 - DNA, 16 bp, Homo sapiens
tccgcgccgatgccac

SEQ ID NO: 1022830 - DNA, 18 bp, Homo sapiens
tccgcgggagaccccttg

SEQ ID NO: 1022831 - DNA, 22 bp, Homo sapiens
tccgcgggctgactgggccaca

SEQ ID NO: 1022832 - DNA, 12 bp, Homo sapiens
tccgctcccacc

SEQ ID NO: 1022833 - DNA, 12 bp, Homo sapiens
tccgctccctgg

SEQ ID NO: 1022834 - DNA, 12 bp, Homo sapiens
tccgctctcttc

SEQ ID NO: 1022835 - DNA, 18 bp, Homo sapiens
tccgctctcttcctgccc

SEQ ID NO: 1022836 - DNA, 20 bp, Homo sapiens
tccgctctgaggcaaccccc

SEQ ID NO: 1022837 - DNA, 14 bp, Homo sapiens
tccgctgccaccac

SEQ ID NO: 1022838 - DNA, 16 bp, Homo sapiens
tccgctgtcgccccag

SEQ ID NO: 1022839 - DNA, 18 bp, Homo sapiens
tccgctgtcgccccaggc

SEQ ID NO: 1022840 - DNA, 21 bp, Homo sapiens
tccgctgtcgccccaggccct

SEQ ID NO: 1022841 - DNA, 16 bp, Homo sapiens
tccggaattgtattta

SEQ ID NO: 1022842 - DNA, 20 bp, Homo sapiens
tccggaccgccgatcccagg

SEQ ID NO: 1022843 - DNA, 23 bp, Homo sapiens
tccggaggggacccagctcctct

SEQ ID NO: 1022844 - DNA, 13 bp, Homo sapiens
tccggccacatca

SEQ ID NO: 1022845 - DNA, 14 bp, Homo sapiens
tccggcctcccctc

SEQ ID NO: 1022846 - DNA, 18 bp, Homo sapiens
tccggcgtcttgcccagc

SEQ ID NO: 1022847 - DNA, 20 bp, Homo sapiens
tccggctgcctagccctccc

SEQ ID NO: 1022848 - DNA, 17 bp, Homo sapiens
tccggctgctcctccag

SEQ ID NO: 1022849 - DNA, 19 bp, Homo sapiens
tccggctgctcctccagcc

SEQ ID NO: 1022850 - DNA, 13 bp, Homo sapiens
tccgggaaaacag

SEQ ID NO: 1022851 - DNA, 20 bp, Homo sapiens
tccgggacacctgggccggg

SEQ ID NO: 1022852 - DNA, 21 bp, Homo sapiens
tccgggacctggtgctgcctc

SEQ ID NO: 1022853 - DNA, 19 bp, Homo sapiens
tccgggaggcagagaggag

SEQ ID NO: 1022854 - DNA, 20 bp, Homo sapiens
tccgggcaaatgccagggcc

SEQ ID NO: 1022855 - DNA, 19 bp, Homo sapiens
tccgggcaggggagccagg

SEQ ID NO: 1022856 - DNA, 18 bp, Homo sapiens
tccgggcgtgtgaagaac

SEQ ID NO: 1022857 - DNA, 20 bp, Homo sapiens
tccgggggggcccatctctt

SEQ ID NO: 1022858 - DNA, 14 bp, Homo sapiens
tccggggtctgtgc

SEQ ID NO: 1022859 - DNA, 15 bp, Homo sapiens
tccggggtctgtgct

SEQ ID NO: 1022860 - DNA, 18 bp, Homo sapiens
tccggggtctgtgctgtg

SEQ ID NO: 1022861 - DNA, 15 bp, Homo sapiens
tccgggtcactgctg

SEQ ID NO: 1022862 - DNA, 16 bp, Homo sapiens
tccgggtcactgctgt

SEQ ID NO: 1022863 - DNA, 16 bp, Homo sapiens
tccgggtgtggcctca

SEQ ID NO: 1022864 - DNA, 22 bp, Homo sapiens
tccgggtgtggcctcagccctc

SEQ ID NO: 1022865 - DNA, 23 bp, Homo sapiens
tccggtcccaaatgtagcaggtg

SEQ ID NO: 1022866 - DNA, 23 bp, Homo sapiens
tccggtccccacagactgcccca

SEQ ID NO: 1022867 - DNA, 20 bp, Homo sapiens
tccggtcccctgcctggaac

SEQ ID NO: 1022868 - DNA, 12 bp, Homo sapiens
tccggtgtgcct

SEQ ID NO: 1022869 - DNA, 20 bp, Homo sapiens
gcctaagaagttattttctt

SEQ ID NO: 1022870 - DNA, 15 bp, Homo sapiens
gcctaagacatgtga

SEQ ID NO: 1022871 - DNA, 17 bp, Homo sapiens
gcctaatcactctgagt

SEQ ID NO: 1022872 - DNA, 14 bp, Homo sapiens
gcctaatccctggg

SEQ ID NO: 1022873 - DNA, 22 bp, Homo sapiens
gcctaatccctgggcattgctt

SEQ ID NO: 1022874 - DNA, 17 bp, Homo sapiens
gcctacacacacagcct

SEQ ID NO: 1022875 - DNA, 19 bp, Homo sapiens
gcctacagaggaggcctca

SEQ ID NO: 1022876 - DNA, 13 bp, Homo sapiens
gcctacagccagg

SEQ ID NO: 1022877 - DNA, 14 bp, Homo sapiens
gcctacagccaggt

SEQ ID NO: 1022878 - DNA, 18 bp, Homo sapiens
gcctacattttagtttct

SEQ ID NO: 1022879 - DNA, 23 bp, Homo sapiens
gcctaccgtatttcagccatgat

SEQ ID NO: 1022880 - DNA, 18 bp, Homo sapiens
gcctacctcaagttcttg

SEQ ID NO: 1022881 - DNA, 22 bp, Homo sapiens
gcctacgttctctttaaaagct

SEQ ID NO: 1022882 - DNA, 14 bp, Homo sapiens
gcctactatacatt

SEQ ID NO: 1022883 - DNA, 20 bp, Homo sapiens
gcctactatacattaggaag

SEQ ID NO: 1022884 - DNA, 12 bp, Homo sapiens
gcctactcacga

SEQ ID NO: 1022885 - DNA, 15 bp, Homo sapiens
gcctactcttcaggg

SEQ ID NO: 1022886 - DNA, 13 bp, Homo sapiens
gcctactgttact

SEQ ID NO: 1022887 - DNA, 21 bp, Homo sapiens
gcctactttggggaaataaag

SEQ ID NO: 1022888 - DNA, 16 bp, Homo sapiens
gcctagatccacgtgt

SEQ ID NO: 1022889 - DNA, 16 bp, Homo sapiens
gcctagcacagcagct

SEQ ID NO: 1022890 - DNA, 12 bp, Homo sapiens
gcctagcatacg

SEQ ID NO: 1022891 - DNA, 23 bp, Homo sapiens
gcctagcatggggtcagccccaa

SEQ ID NO: 1022892 - DNA, 21 bp, Homo sapiens
gcctagccccaggtcttttct

SEQ ID NO: 1022893 - DNA, 15 bp, Homo sapiens
gcctagccctgggac

SEQ ID NO: 1022894 - DNA, 19 bp, Homo sapiens
gcctagccgacctcagcct

SEQ ID NO: 1022895 - DNA, 12 bp, Homo sapiens
gcctagcctggc

SEQ ID NO: 1022896 - DNA, 16 bp, Homo sapiens
gcctagcctggctctg

SEQ ID NO: 1022897 - DNA, 23 bp, Homo sapiens
gcctagctcctgccacatggagc

SEQ ID NO: 1022898 - DNA, 12 bp, Homo sapiens
gcctagctgctg

SEQ ID NO: 1022899 - DNA, 15 bp, Homo sapiens
gcctagctgctgtca

SEQ ID NO: 1022900 - DNA, 23 bp, Homo sapiens
gcctaggaccactcagcccctag

SEQ ID NO: 1022901 - DNA, 21 bp, Homo sapiens
gcctaggagttgagtacagtg

SEQ ID NO: 1022902 - DNA, 21 bp, Homo sapiens
gcctaggccaaatgcacaagc

SEQ ID NO: 1022903 - DNA, 17 bp, Homo sapiens
gcctaggcctcagccag

SEQ ID NO: 1022904 - DNA, 18 bp, Homo sapiens
gcctaggcctcagccaga

SEQ ID NO: 1022905 - DNA, 12 bp, Homo sapiens
gcctagggcaga

SEQ ID NO: 1022906 - DNA, 19 bp, Homo sapiens
gcctaggggtggcgctcag

SEQ ID NO: 1022907 - DNA, 20 bp, Homo sapiens
gcctaggggtggcgctcaga

SEQ ID NO: 1022908 - DNA, 21 bp, Homo sapiens
gcctaggtcccttcccgaccc

SEQ ID NO: 1022909 - DNA, 16 bp, Homo sapiens
gcctaggtgcagctcc

SEQ ID NO: 1022910 - DNA, 16 bp, Homo sapiens
gcctaggtggaggcaa

SEQ ID NO: 1022911 - DNA, 23 bp, Homo sapiens
gcctaggtgttgtcagcaggcag

SEQ ID NO: 1022912 - DNA, 22 bp, Homo sapiens
gcctagtcagggcacagctgcc

SEQ ID NO: 1022913 - DNA, 19 bp, Homo sapiens
gcctagtgaaggcttctct

SEQ ID NO: 1022914 - DNA, 18 bp, Homo sapiens
gcctagtggggtctccct

SEQ ID NO: 1022915 - DNA, 17 bp, Homo sapiens
gcctagttatcaagggg

SEQ ID NO: 1022916 - DNA, 18 bp, Homo sapiens
gcctagttatcaagggga

SEQ ID NO: 1022917 - DNA, 22 bp, Homo sapiens
gcctagttcctgtggccaggag

SEQ ID NO: 1022918 - DNA, 20 bp, Homo sapiens
gcctatacgtttctgtggag

SEQ ID NO: 1022919 - DNA, 15 bp, Homo sapiens
gcctatagtaaatgt

SEQ ID NO: 1022920 - DNA, 13 bp, Homo sapiens
gcctatccgctgc

SEQ ID NO: 1022921 - DNA, 21 bp, Homo sapiens
gcctatctaatttctttagtt

SEQ ID NO: 1022922 - DNA, 20 bp, Homo sapiens
gcctatgagcatcctgagcc

SEQ ID NO: 1022923 - DNA, 22 bp, Homo sapiens
gcctatgagcatcctgagcccc

SEQ ID NO: 1022924 - DNA, 21 bp, Homo sapiens
gcctatgcagacatctctgga

SEQ ID NO: 1022925 - DNA, 23 bp, Homo sapiens
gcctatgcagacatctctggagc

SEQ ID NO: 1022926 - DNA, 16 bp, Homo sapiens
gcctatgccctgccct

SEQ ID NO: 1022927 - DNA, 23 bp, Homo sapiens
gcctatttttttagattgagaaa

SEQ ID NO: 1022928 - DNA, 22 bp, Homo sapiens
gcctcaaagcaagcattcagaa

SEQ ID NO: 1022929 - DNA, 17 bp, Homo sapiens
gcctcaaaggcccgctc

SEQ ID NO: 1022930 - DNA, 17 bp, Homo sapiens
gcctcaaccctccctca

SEQ ID NO: 1022931 - DNA, 19 bp, Homo sapiens
gcctcaaccctccctcagc

SEQ ID NO: 1022932 - DNA, 21 bp, Homo sapiens
gcctcaaccctccctcagccc

SEQ ID NO: 1022933 - DNA, 14 bp, Homo sapiens
gcctcaacctcctg

SEQ ID NO: 1022934 - DNA, 24 bp, Homo sapiens
gcctcaagtgagccaagaaacact

SEQ ID NO: 1022935 - DNA, 19 bp, Homo sapiens
gcctcaatctaaggccttc

SEQ ID NO: 1022936 - DNA, 17 bp, Homo sapiens
gcctcaatgtgaccagg

SEQ ID NO: 1022937 - DNA, 13 bp, Homo sapiens
gcctcacagaaga

SEQ ID NO: 1022938 - DNA, 16 bp, Homo sapiens
gcctcacagaagaata

SEQ ID NO: 1022939 - DNA, 17 bp, Homo sapiens
gcctcaccacacccagg

SEQ ID NO: 1022940 - DNA, 19 bp, Homo sapiens
gcctcaccacacccaggtc

SEQ ID NO: 1022941 - DNA, 23 bp, Homo sapiens
gcctcaccacacccaggtctctt

SEQ ID NO: 1022942 - DNA, 15 bp, Homo sapiens
gcctcacccacccct

SEQ ID NO: 1022943 - DNA, 19 bp, Homo sapiens
gcctcacccacccctgcac

SEQ ID NO: 1022944 - DNA, 16 bp, Homo sapiens
gcctcacctctaccca

SEQ ID NO: 1022945 - DNA, 17 bp, Homo sapiens
gcctcacctctacccaa

SEQ ID NO: 1022946 - DNA, 18 bp, Homo sapiens
gcctcacctctacccaaa

SEQ ID NO: 1022947 - DNA, 19 bp, Homo sapiens
gcctcacctgcccctctgt

SEQ ID NO: 1022948 - DNA, 20 bp, Homo sapiens
gcctcacctgcccctctgtt

SEQ ID NO: 1022949 - DNA, 21 bp, Homo sapiens
gcctcacctgcccctctgttc

SEQ ID NO: 1022950 - DNA, 12 bp, Homo sapiens
gcctcactgaaa

SEQ ID NO: 1022951 - DNA, 14 bp, Homo sapiens
gcctcactttccac

SEQ ID NO: 1022952 - DNA, 15 bp, Homo sapiens
gcctcactttcttct

SEQ ID NO: 1022953 - DNA, 23 bp, Homo sapiens
gcctcacttttaatgaacaaatg

SEQ ID NO: 1022954 - DNA, 22 bp, Homo sapiens
gcctcagaaggccccagagaga

SEQ ID NO: 1022955 - DNA, 20 bp, Homo sapiens
gcctcagaccccctcagcct

SEQ ID NO: 1022956 - DNA, 12 bp, Homo sapiens
gcctcagactgg

SEQ ID NO: 1022957 - DNA, 21 bp, Homo sapiens
gcctcagactggagggcaagg

SEQ ID NO: 1022958 - DNA, 15 bp, Homo sapiens
gcctcagagcaggct

SEQ ID NO: 1022959 - DNA, 16 bp, Homo sapiens
gcctcagccagagaag

SEQ ID NO: 1022960 - DNA, 14 bp, Homo sapiens
gcctcagccaggcc

SEQ ID NO: 1022961 - DNA, 19 bp, Homo sapiens
gcctcagccagtggcacag

SEQ ID NO: 1022962 - DNA, 22 bp, Homo sapiens
gcctcagcccaacttcttaccc

SEQ ID NO: 1022963 - DNA, 14 bp, Homo sapiens
gcctcagccctcag

SEQ ID NO: 1022964 - DNA, 15 bp, Homo sapiens
gcctcagccctcaga

SEQ ID NO: 1022965 - DNA, 17 bp, Homo sapiens
gcctcagccctgaccct

SEQ ID NO: 1022966 - DNA, 15 bp, Homo sapiens
gcctcagcctactcc

SEQ ID NO: 1022967 - DNA, 18 bp, Homo sapiens
gcctcagcctcctgagta

SEQ ID NO: 1022968 - DNA, 13 bp, Homo sapiens
gcctcagcctggg

SEQ ID NO: 1022969 - DNA, 18 bp, Homo sapiens
gcctcagcctggggctct

SEQ ID NO: 1022970 - DNA, 13 bp, Homo sapiens
gcctcagccttcc

SEQ ID NO: 1022971 - DNA, 14 bp, Homo sapiens
gcctcagctgcctc

SEQ ID NO: 1022972 - DNA, 20 bp, Homo sapiens
gcctcagctgcctcacttcc

SEQ ID NO: 1022973 - DNA, 20 bp, Homo sapiens
gcctcaggcactctcctgtc

SEQ ID NO: 1022974 - DNA, 18 bp, Homo sapiens
gcctcaggccagggctca

SEQ ID NO: 1022975 - DNA, 23 bp, Homo sapiens
gcctcaggcttgagggagggctg

SEQ ID NO: 1022976 - DNA, 15 bp, Homo sapiens
gcctcagggtcctgc

SEQ ID NO: 1022977 - DNA, 19 bp, Homo sapiens
gcctcagggtctaaggagc

SEQ ID NO: 1022978 - DNA, 15 bp, Homo sapiens
gcctcaggtgctgtc

SEQ ID NO: 1022979 - DNA, 16 bp, Homo sapiens
gcctcagtatatttaa

SEQ ID NO: 1022980 - DNA, 16 bp, Homo sapiens
gcctcagtgacccatg

SEQ ID NO: 1022981 - DNA, 15 bp, Homo sapiens
gcctcagtgccactt

SEQ ID NO: 1022982 - DNA, 16 bp, Homo sapiens
gcctcagtgtgcccat

SEQ ID NO: 1022983 - DNA, 23 bp, Homo sapiens
gcctcagttcccagctccccccg

SEQ ID NO: 1022984 - DNA, 16 bp, Homo sapiens
gcctcagtttctccat

SEQ ID NO: 1022985 - DNA, 20 bp, Homo sapiens
gcctcagtttctccatcagc

SEQ ID NO: 1022986 - DNA, 15 bp, Homo sapiens
gcctcatactcctgg

SEQ ID NO: 1022987 - DNA, 17 bp, Homo sapiens
gcctcatactcctgggc

SEQ ID NO: 1022988 - DNA, 18 bp, Homo sapiens
gcctcatactcctgggct

SEQ ID NO: 1022989 - DNA, 22 bp, Homo sapiens
gcctcatactcctgggctcaag

SEQ ID NO: 1022990 - DNA, 17 bp, Homo sapiens
gcctcatagcatagcca

SEQ ID NO: 1022991 - DNA, 22 bp, Homo sapiens
gcctcatatttaaagacaggga

SEQ ID NO: 1022992 - DNA, 21 bp, Homo sapiens
gcctcatcatcagagcctttc

SEQ ID NO: 1022993 - DNA, 15 bp, Homo sapiens
tccggtgtgcctgca

SEQ ID NO: 1022994 - DNA, 13 bp, Homo sapiens
tccgtaaaaatga

SEQ ID NO: 1022995 - DNA, 15 bp, Homo sapiens
tccgtaaaaatgatt

SEQ ID NO: 1022996 - DNA, 16 bp, Homo sapiens
tccgtcaaaacagatt

SEQ ID NO: 1022997 - DNA, 20 bp, Homo sapiens
tccgtcatccatgccctccc

SEQ ID NO: 1022998 - DNA, 15 bp, Homo sapiens
tccgtccacccaggc

SEQ ID NO: 1022999 - DNA, 16 bp, Homo sapiens
tccgtccacccaggct

SEQ ID NO: 1023000 - DNA, 18 bp, Homo sapiens
tccgtccacccaggctgc

SEQ ID NO: 1023001 - DNA, 21 bp, Homo sapiens
tccgtccacccaggctgcact

SEQ ID NO: 1023002 - DNA, 22 bp, Homo sapiens
tccgtccacccaggctgcactg

SEQ ID NO: 1023003 - DNA, 13 bp, Homo sapiens
tccgtccaccctt

SEQ ID NO: 1023004 - DNA, 14 bp, Homo sapiens
tccgtccatccccc

SEQ ID NO: 1023005 - DNA, 16 bp, Homo sapiens
tccgtccatccccctt

SEQ ID NO: 1023006 - DNA, 20 bp, Homo sapiens
tccgtccatccgactgcccc

SEQ ID NO: 1023007 - DNA, 21 bp, Homo sapiens
tccgtccatccgactgcccct

SEQ ID NO: 1023008 - DNA, 17 bp, Homo sapiens
tccgtccccccccaggc

SEQ ID NO: 1023009 - DNA, 12 bp, Homo sapiens
tccgtcctgggc

SEQ ID NO: 1023010 - DNA, 16 bp, Homo sapiens
tccgtcctgtcactga

SEQ ID NO: 1023011 - DNA, 20 bp, Homo sapiens
tccgtctcccccgtgttccc

SEQ ID NO: 1023012 - DNA, 14 bp, Homo sapiens
tccgtctctgtcct

SEQ ID NO: 1023013 - DNA, 15 bp, Homo sapiens
tccgtctctgtcctc

SEQ ID NO: 1023014 - DNA, 17 bp, Homo sapiens
tccgtctgaccctctgc

SEQ ID NO: 1023015 - DNA, 21 bp, Homo sapiens
tccgtctgaccctctgcggcc

SEQ ID NO: 1023016 - DNA, 15 bp, Homo sapiens
tccgtctgtgtgggg

SEQ ID NO: 1023017 - DNA, 20 bp, Homo sapiens
tccgtgagtgaaccatcatt

SEQ ID NO: 1023018 - DNA, 20 bp, Homo sapiens
tccgtgatccatccatctcc

SEQ ID NO: 1023019 - DNA, 23 bp, Homo sapiens
tccgtgcccaggcccttggctgc

SEQ ID NO: 1023020 - DNA, 16 bp, Homo sapiens
tccgtgcctccaccac

SEQ ID NO: 1023021 - DNA, 21 bp, Homo sapiens
tccgtgcctccaccaccactg

SEQ ID NO: 1023022 - DNA, 18 bp, Homo sapiens
tccgtggaacattctgga

SEQ ID NO: 1023023 - DNA, 19 bp, Homo sapiens
tccgtggaacattctggat

SEQ ID NO: 1023024 - DNA, 17 bp, Homo sapiens
tccgtgggacggtgccc

SEQ ID NO: 1023025 - DNA, 23 bp, Homo sapiens
tccgtgggacggtgcccaagcca

SEQ ID NO: 1023026 - DNA, 22 bp, Homo sapiens
tccgtgtgattgtctttgaatc

SEQ ID NO: 1023027 - DNA, 16 bp, Homo sapiens
tccgtgtggagcacgt

SEQ ID NO: 1023028 - DNA, 16 bp, Homo sapiens
tccgtgtgtcccagat

SEQ ID NO: 1023029 - DNA, 15 bp, Homo sapiens
tccgttaaaatacca

SEQ ID NO: 1023030 - DNA, 20 bp, Homo sapiens
tccgttaacctttttgtaaa

SEQ ID NO: 1023031 - DNA, 22 bp, Homo sapiens
tccgttaacctttttgtaaata

SEQ ID NO: 1023032 - DNA, 15 bp, Homo sapiens
tccgttagctcctgt

SEQ ID NO: 1023033 - DNA, 19 bp, Homo sapiens
tccgttagctcctgtggcc

SEQ ID NO: 1023034 - DNA, 13 bp, Homo sapiens
tccgttcctggca

SEQ ID NO: 1023035 - DNA, 14 bp, Homo sapiens
tccgttgctgaaaa

SEQ ID NO: 1023036 - DNA, 19 bp, Homo sapiens
tccgttgctgaaaatgatt

SEQ ID NO: 1023037 - DNA, 13 bp, Homo sapiens
tccgttggccact

SEQ ID NO: 1023038 - DNA, 16 bp, Homo sapiens
tccgtttatgggcctt

SEQ ID NO: 1023039 - DNA, 18 bp, Homo sapiens
tccgtttatgggccttgc

SEQ ID NO: 1023040 - DNA, 20 bp, Homo sapiens
tcctaaaacaacagatgtac

SEQ ID NO: 1023041 - DNA, 17 bp, Homo sapiens
tcctaaaattatggaaa

SEQ ID NO: 1023042 - DNA, 15 bp, Homo sapiens
tcctaaacataattg

SEQ ID NO: 1023043 - DNA, 21 bp, Homo sapiens
tcctaaacatcattcattttt

SEQ ID NO: 1023044 - DNA, 14 bp, Homo sapiens
tcctaaactctcta

SEQ ID NO: 1023045 - DNA, 15 bp, Homo sapiens
tcctaaactctctag

SEQ ID NO: 1023046 - DNA, 12 bp, Homo sapiens
tcctaaagccaa

SEQ ID NO: 1023047 - DNA, 23 bp, Homo sapiens
tcctaaagccaaagtttctgttg

SEQ ID NO: 1023048 - DNA, 17 bp, Homo sapiens
tcctaaagccatcatgc

SEQ ID NO: 1023049 - DNA, 13 bp, Homo sapiens
tcctaaatatcca

SEQ ID NO: 1023050 - DNA, 19 bp, Homo sapiens
tcctaaatatccaaagact

SEQ ID NO: 1023051 - DNA, 16 bp, Homo sapiens
tcctaacacagcatgt

SEQ ID NO: 1023052 - DNA, 16 bp, Homo sapiens
tcctaacataacacta

SEQ ID NO: 1023053 - DNA, 23 bp, Homo sapiens
tcctaacataacactaaatgctg

SEQ ID NO: 1023054 - DNA, 18 bp, Homo sapiens
tcctaacatgacagtatt

SEQ ID NO: 1023055 - DNA, 15 bp, Homo sapiens
tcctaactagaatta

SEQ ID NO: 1023056 - DNA, 22 bp, Homo sapiens
tcctaagaaagaggagtgcttg

SEQ ID NO: 1023057 - DNA, 13 bp, Homo sapiens
tcctaagacacaa

SEQ ID NO: 1023058 - DNA, 19 bp, Homo sapiens
tcctaagagtgctgggcat

SEQ ID NO: 1023059 - DNA, 17 bp, Homo sapiens
tcctaagagtggaggag

SEQ ID NO: 1023060 - DNA, 12 bp, Homo sapiens
tcctaaggacac

SEQ ID NO: 1023061 - DNA, 21 bp, Homo sapiens
tcctaaggcacccacaaataa

SEQ ID NO: 1023062 - DNA, 15 bp, Homo sapiens
tcctaaggctcccca

SEQ ID NO: 1023063 - DNA, 15 bp, Homo sapiens
tcctaagtcccttcc

SEQ ID NO: 1023064 - DNA, 14 bp, Homo sapiens
tcctaatactgtca

SEQ ID NO: 1023065 - DNA, 14 bp, Homo sapiens
tcctaatatgatct

SEQ ID NO: 1023066 - DNA, 15 bp, Homo sapiens
tcctaattttaaata

SEQ ID NO: 1023067 - DNA, 19 bp, Homo sapiens
tcctacaagagcagcctgt

SEQ ID NO: 1023068 - DNA, 18 bp, Homo sapiens
tcctacaagatttagaaa

SEQ ID NO: 1023069 - DNA, 22 bp, Homo sapiens
tcctacagaaatactgctctga

SEQ ID NO: 1023070 - DNA, 23 bp, Homo sapiens
tcctacagaaatactgctctgaa

SEQ ID NO: 1023071 - DNA, 13 bp, Homo sapiens
tcctacagcccct

SEQ ID NO: 1023072 - DNA, 16 bp, Homo sapiens
tcctacagtacaatca

SEQ ID NO: 1023073 - DNA, 22 bp, Homo sapiens
tcctacagtgactccctgggag

SEQ ID NO: 1023074 - DNA, 15 bp, Homo sapiens
tcctacatccagctc

SEQ ID NO: 1023075 - DNA, 16 bp, Homo sapiens
tcctacatccagctcc

SEQ ID NO: 1023076 - DNA, 17 bp, Homo sapiens
tcctacatccagctcct

SEQ ID NO: 1023077 - DNA, 13 bp, Homo sapiens
tcctaccaatgca

SEQ ID NO: 1023078 - DNA, 17 bp, Homo sapiens
tcctaccaatgcatgca

SEQ ID NO: 1023079 - DNA, 24 bp, Homo sapiens
tcctaccagttgccctagcccaga

SEQ ID NO: 1023080 - DNA, 12 bp, Homo sapiens
tcctacccagcg

SEQ ID NO: 1023081 - DNA, 19 bp, Homo sapiens
tcctaccccttcctgtcct

SEQ ID NO: 1023082 - DNA, 21 bp, Homo sapiens
tcctaccctcccaccagaacg

SEQ ID NO: 1023083 - DNA, 15 bp, Homo sapiens
tcctaccctgcctcc

SEQ ID NO: 1023084 - DNA, 20 bp, Homo sapiens
tcctaccctgcgcccagtcc

SEQ ID NO: 1023085 - DNA, 21 bp, Homo sapiens
tcctaccgtactccctgcacc

SEQ ID NO: 1023086 - DNA, 13 bp, Homo sapiens
tcctaccgtcttt

SEQ ID NO: 1023087 - DNA, 14 bp, Homo sapiens
tcctacctattatc

SEQ ID NO: 1023088 - DNA, 15 bp, Homo sapiens
tcctacctcaaaatt

SEQ ID NO: 1023089 - DNA, 15 bp, Homo sapiens
tcctacctcagcctc

SEQ ID NO: 1023090 - DNA, 21 bp, Homo sapiens
tcctacctccactctctgccc

SEQ ID NO: 1023091 - DNA, 21 bp, Homo sapiens
tcctacctggggactcctcaa

SEQ ID NO: 1023092 - DNA, 14 bp, Homo sapiens
tcctaccttgcttt

SEQ ID NO: 1023093 - DNA, 16 bp, Homo sapiens
tcctactaggcaaaat

SEQ ID NO: 1023094 - DNA, 18 bp, Homo sapiens
tcctactccctcttccaa

SEQ ID NO: 1023095 - DNA, 19 bp, Homo sapiens
tcctacttagggaagaaaa

SEQ ID NO: 1023096 - DNA, 13 bp, Homo sapiens
tcctactttgaaa

SEQ ID NO: 1023097 - DNA, 23 bp, Homo sapiens
tcctagaagaaccaaatacctca

SEQ ID NO: 1023098 - DNA, 17 bp, Homo sapiens
tcctagaattcgaaggc

SEQ ID NO: 1023099 - DNA, 12 bp, Homo sapiens
tcctagacactc

SEQ ID NO: 1023100 - DNA, 23 bp, Homo sapiens
tcctagactaattaaaatctgga

SEQ ID NO: 1023101 - DNA, 15 bp, Homo sapiens
tcctagacttgaaag

SEQ ID NO: 1023102 - DNA, 20 bp, Homo sapiens
tcctagacttgaaagttttc

SEQ ID NO: 1023103 - DNA, 18 bp, Homo sapiens
tcctagagacagaagcag

SEQ ID NO: 1023104 - DNA, 19 bp, Homo sapiens
tcctagagacagaagcagg

SEQ ID NO: 1023105 - DNA, 21 bp, Homo sapiens
tcctagagggaggggcctagg

SEQ ID NO: 1023106 - DNA, 18 bp, Homo sapiens
tcctagaggtgggcagct

SEQ ID NO: 1023107 - DNA, 23 bp, Homo sapiens
tcctagaggtgggcagctgggcc

SEQ ID NO: 1023108 - DNA, 21 bp, Homo sapiens
tcctagcaaatttctctcttt

SEQ ID NO: 1023109 - DNA, 23 bp, Homo sapiens
tcctagcaagtaagaatggccaa

SEQ ID NO: 1023110 - DNA, 21 bp, Homo sapiens
tcctagcacaaggagtgcccg

SEQ ID NO: 1023111 - DNA, 13 bp, Homo sapiens
tcctagccactca

SEQ ID NO: 1023112 - DNA, 14 bp, Homo sapiens
tcctagcccctctc

SEQ ID NO: 1023113 - DNA, 15 bp, Homo sapiens
tcctagcccctctct

SEQ ID NO: 1023114 - DNA, 18 bp, Homo sapiens
tcctagcccttccctgag

SEQ ID NO: 1023115 - DNA, 20 bp, Homo sapiens
tcctagcccttccctgagtg

SEQ ID NO: 1023116 - DNA, 21 bp, Homo sapiens
tcctagccttatcctctgatc

SEQ ID NO: 1023117 - DNA, 13 bp, Homo sapiens
gcctcatccaggg

SEQ ID NO: 1023118 - DNA, 14 bp, Homo sapiens
gcctcatccagggc

SEQ ID NO: 1023119 - DNA, 19 bp, Homo sapiens
gcctcatccagggcccagc

SEQ ID NO: 1023120 - DNA, 13 bp, Homo sapiens
gcctcatccctcg

SEQ ID NO: 1023121 - DNA, 22 bp, Homo sapiens
gcctcatccgaggcagggtcag

SEQ ID NO: 1023122 - DNA, 15 bp, Homo sapiens
gcctcatctccttta

SEQ ID NO: 1023123 - DNA, 16 bp, Homo sapiens
gcctcatgccacacct

SEQ ID NO: 1023124 - DNA, 18 bp, Homo sapiens
gcctcatgccacaccttc

SEQ ID NO: 1023125 - DNA, 19 bp, Homo sapiens
gcctcatgtcaaatattta

SEQ ID NO: 1023126 - DNA, 17 bp, Homo sapiens
gcctcatgtggctggaa

SEQ ID NO: 1023127 - DNA, 22 bp, Homo sapiens
gcctcatgttctcttcccaggc

SEQ ID NO: 1023128 - DNA, 15 bp, Homo sapiens
gcctcatgttctgtg

SEQ ID NO: 1023129 - DNA, 15 bp, Homo sapiens
gcctcattcagcatg

SEQ ID NO: 1023130 - DNA, 18 bp, Homo sapiens
gcctcattgtgccaagcc

SEQ ID NO: 1023131 - DNA, 21 bp, Homo sapiens
gcctcatttcactagagacaa

SEQ ID NO: 1023132 - DNA, 20 bp, Homo sapiens
gcctcatttctttgtctttt

SEQ ID NO: 1023133 - DNA, 19 bp, Homo sapiens
gcctccaaagtggagctgg

SEQ ID NO: 1023134 - DNA, 20 bp, Homo sapiens
gcctccaaccctagcaaaag

SEQ ID NO: 1023135 - DNA, 17 bp, Homo sapiens
gcctccaacgcccctgt

SEQ ID NO: 1023136 - DNA, 20 bp, Homo sapiens
gcctccaacgcccctgtggc

SEQ ID NO: 1023137 - DNA, 15 bp, Homo sapiens
gcctccaagcacaga

SEQ ID NO: 1023138 - DNA, 23 bp, Homo sapiens
gcctccaagcacagagcctggcc

SEQ ID NO: 1023139 - DNA, 17 bp, Homo sapiens
gcctccaagcggccctg

SEQ ID NO: 1023140 - DNA, 17 bp, Homo sapiens
gcctccaagctccatct

SEQ ID NO: 1023141 - DNA, 22 bp, Homo sapiens
gcctccaattggtgcttcagcc

SEQ ID NO: 1023142 - DNA, 12 bp, Homo sapiens
gcctccacagcg

SEQ ID NO: 1023143 - DNA, 23 bp, Homo sapiens
gcctccacatgctgcctggcaca

SEQ ID NO: 1023144 - DNA, 14 bp, Homo sapiens
gcctccaccaccac

SEQ ID NO: 1023145 - DNA, 18 bp, Homo sapiens
gcctccaccaccactggc

SEQ ID NO: 1023146 - DNA, 19 bp, Homo sapiens
gcctccacccgtcctccct

SEQ ID NO: 1023147 - DNA, 20 bp, Homo sapiens
gcctccacccgtcctccctc

SEQ ID NO: 1023148 - DNA, 22 bp, Homo sapiens
gcctccacccgtcctccctcag

SEQ ID NO: 1023149 - DNA, 21 bp, Homo sapiens
gcctccactcccccacctgac

SEQ ID NO: 1023150 - DNA, 15 bp, Homo sapiens
gcctccactctagtt

SEQ ID NO: 1023151 - DNA, 19 bp, Homo sapiens
gcctccactctagttctag

SEQ ID NO: 1023152 - DNA, 17 bp, Homo sapiens
gcctccagaagctgctc

SEQ ID NO: 1023153 - DNA, 22 bp, Homo sapiens
gcctccagagaagccccgcacg

SEQ ID NO: 1023154 - DNA, 12 bp, Homo sapiens
gcctccagagcc

SEQ ID NO: 1023155 - DNA, 15 bp, Homo sapiens
gcctccagagccagc

SEQ ID NO: 1023156 - DNA, 18 bp, Homo sapiens
gcctccagagccagcctg

SEQ ID NO: 1023157 - DNA, 19 bp, Homo sapiens
gcctccagagccagcctgg

SEQ ID NO: 1023158 - DNA, 21 bp, Homo sapiens
gcctccagagccagcctggga

SEQ ID NO: 1023159 - DNA, 19 bp, Homo sapiens
gcctccagaggtcctccgt

SEQ ID NO: 1023160 - DNA, 13 bp, Homo sapiens
gcctccagcctct

SEQ ID NO: 1023161 - DNA, 14 bp, Homo sapiens
gcctccagctttgg

SEQ ID NO: 1023162 - DNA, 18 bp, Homo sapiens
gcctccaggaggggcctg

SEQ ID NO: 1023163 - DNA, 11 bp, Homo sapiens
gcctccagggc

SEQ ID NO: 1023164 - DNA, 13 bp, Homo sapiens
gcctccagggccc

SEQ ID NO: 1023165 - DNA, 16 bp, Homo sapiens
gcctccaggtgtgcac

SEQ ID NO: 1023166 - DNA, 23 bp, Homo sapiens
gcctccagtcatggtactacccc

SEQ ID NO: 1023167 - DNA, 12 bp, Homo sapiens
gcctccagtgca

SEQ ID NO: 1023168 - DNA, 15 bp, Homo sapiens
gcctccagtgcagtc

SEQ ID NO: 1023169 - DNA, 16 bp, Homo sapiens
gcctccatccaaggcc

SEQ ID NO: 1023170 - DNA, 20 bp, Homo sapiens
gcctccatccatctgtccgt

SEQ ID NO: 1023171 - DNA, 21 bp, Homo sapiens
gcctccatccatctgtccgtc

SEQ ID NO: 1023172 - DNA, 21 bp, Homo sapiens
gcctccatgccccagctctgg

SEQ ID NO: 1023173 - DNA, 22 bp, Homo sapiens
gcctccatgccccagctctgga

SEQ ID NO: 1023174 - DNA, 23 bp, Homo sapiens
gcctccatgccccagctctggat

SEQ ID NO: 1023175 - DNA, 14 bp, Homo sapiens
gcctccatgtttta

SEQ ID NO: 1023176 - DNA, 17 bp, Homo sapiens
gcctccattctgaccat

SEQ ID NO: 1023177 - DNA, 13 bp, Homo sapiens
gcctcccaaagtg

SEQ ID NO: 1023178 - DNA, 19 bp, Homo sapiens
gcctcccaaagtgctggga

SEQ ID NO: 1023179 - DNA, 15 bp, Homo sapiens
gcctcccaaatgagc

SEQ ID NO: 1023180 - DNA, 12 bp, Homo sapiens
gcctcccacact

SEQ ID NO: 1023181 - DNA, 17 bp, Homo sapiens
gcctcccaccagagccg

SEQ ID NO: 1023182 - DNA, 20 bp, Homo sapiens
gcctcccacccgatgctgct

SEQ ID NO: 1023183 - DNA, 14 bp, Homo sapiens
gcctcccacggcac

SEQ ID NO: 1023184 - DNA, 14 bp, Homo sapiens
gcctcccactgggg

SEQ ID NO: 1023185 - DNA, 17 bp, Homo sapiens
gcctcccagagtgctgg

SEQ ID NO: 1023186 - DNA, 18 bp, Homo sapiens
gcctcccagagtgctggg

SEQ ID NO: 1023187 - DNA, 10 bp, Homo sapiens
gcctcccagc

SEQ ID NO: 1023188 - DNA, 13 bp, Homo sapiens
gcctcccaggcaa

SEQ ID NO: 1023189 - DNA, 19 bp, Homo sapiens
gcctccccaaccctgcccc

SEQ ID NO: 1023190 - DNA, 21 bp, Homo sapiens
gcctccccaaccctgcccctg

SEQ ID NO: 1023191 - DNA, 20 bp, Homo sapiens
gcctccccaccccagtggga

SEQ ID NO: 1023192 - DNA, 17 bp, Homo sapiens
gcctccccaccctcctc

SEQ ID NO: 1023193 - DNA, 18 bp, Homo sapiens
gcctccccaccctcctct

SEQ ID NO: 1023194 - DNA, 19 bp, Homo sapiens
gcctccccatctgtccagc

SEQ ID NO: 1023195 - DNA, 16 bp, Homo sapiens
gcctccccatttccca

SEQ ID NO: 1023196 - DNA, 20 bp, Homo sapiens
gcctccccatttcccatctg

SEQ ID NO: 1023197 - DNA, 22 bp, Homo sapiens
gcctccccatttcccatctgca

SEQ ID NO: 1023198 - DNA, 20 bp, Homo sapiens
gcctcccccaacacctgctg

SEQ ID NO: 1023199 - DNA, 21 bp, Homo sapiens
gcctcccccaacacctgctgc

SEQ ID NO: 1023200 - DNA, 24 bp, Homo sapiens
gcctcccccagcacagatgaggag

SEQ ID NO: 1023201 - DNA, 14 bp, Homo sapiens
gcctcccccgcctc

SEQ ID NO: 1023202 - DNA, 18 bp, Homo sapiens
gcctccccgaaacaggct

SEQ ID NO: 1023203 - DNA, 21 bp, Homo sapiens
gcctccccgaggttgtgggga

SEQ ID NO: 1023204 - DNA, 14 bp, Homo sapiens
gcctcccctcccct

SEQ ID NO: 1023205 - DNA, 17 bp, Homo sapiens
gcctcccctcccctggg

SEQ ID NO: 1023206 - DNA, 16 bp, Homo sapiens
gcctcccctgccacca

SEQ ID NO: 1023207 - DNA, 19 bp, Homo sapiens
gcctcccctgccaccaggc

SEQ ID NO: 1023208 - DNA, 18 bp, Homo sapiens
gcctcccctgccagggca

SEQ ID NO: 1023209 - DNA, 13 bp, Homo sapiens
gcctccccttctt

SEQ ID NO: 1023210 - DNA, 18 bp, Homo sapiens
gcctccccttcttcccgc

SEQ ID NO: 1023211 - DNA, 19 bp, Homo sapiens
gcctccccttcttcccgcc

SEQ ID NO: 1023212 - DNA, 18 bp, Homo sapiens
gcctcccgagtagctggg

SEQ ID NO: 1023213 - DNA, 16 bp, Homo sapiens
gcctcccggggcccag

SEQ ID NO: 1023214 - DNA, 17 bp, Homo sapiens
gcctccctcaccctgag

SEQ ID NO: 1023215 - DNA, 16 bp, Homo sapiens
gcctccctccacccca

SEQ ID NO: 1023216 - DNA, 19 bp, Homo sapiens
gcctccctccaccccagga

SEQ ID NO: 1023217 - DNA, 23 bp, Homo sapiens
gcctccctctcagaggcctgctg

SEQ ID NO: 1023218 - DNA, 13 bp, Homo sapiens
gcctccctctcca

SEQ ID NO: 1023219 - DNA, 21 bp, Homo sapiens
gcctccctctccatatctcct

SEQ ID NO: 1023220 - DNA, 20 bp, Homo sapiens
gcctccctctcttccgggag

SEQ ID NO: 1023221 - DNA, 10 bp, Homo sapiens
gcctccctga

SEQ ID NO: 1023222 - DNA, 22 bp, Homo sapiens
gcctccctgaaaatgtttttct

SEQ ID NO: 1023223 - DNA, 14 bp, Homo sapiens
gcctccctgagcct

SEQ ID NO: 1023224 - DNA, 15 bp, Homo sapiens
gcctccctgcagcca

SEQ ID NO: 1023225 - DNA, 17 bp, Homo sapiens
gcctccctgctgtgcca

SEQ ID NO: 1023226 - DNA, 17 bp, Homo sapiens
gcctccctggctcctcc

SEQ ID NO: 1023227 - DNA, 20 bp, Homo sapiens
gcctccctgggccacctcct

SEQ ID NO: 1023228 - DNA, 13 bp, Homo sapiens
gcctccctgtctc

SEQ ID NO: 1023229 - DNA, 18 bp, Homo sapiens
gcctccctgtctccagct

SEQ ID NO: 1023230 - DNA, 19 bp, Homo sapiens
gcctccctgtctccagctg

SEQ ID NO: 1023231 - DNA, 22 bp, Homo sapiens
gcctcccttcccagtgggctgt

SEQ ID NO: 1023232 - DNA, 14 bp, Homo sapiens
gcctcccttgggct

SEQ ID NO: 1023233 - DNA, 14 bp, Homo sapiens
gcctcccttgtggc

SEQ ID NO: 1023234 - DNA, 15 bp, Homo sapiens
gcctccctttctggg

SEQ ID NO: 1023235 - DNA, 18 bp, Homo sapiens
gcctcccttttctcctct

SEQ ID NO: 1023236 - DNA, 14 bp, Homo sapiens
gcctccgacgctgc

SEQ ID NO: 1023237 - DNA, 21 bp, Homo sapiens
gcctccgacgctgcctctcat

SEQ ID NO: 1023238 - DNA, 17 bp, Homo sapiens
gcctccgaggctccccg

SEQ ID NO: 1023239 - DNA, 19 bp, Homo sapiens
gcctccgaggctccccgcc

SEQ ID NO: 1023240 - DNA, 17 bp, Homo sapiens
gcctccgatgcctggcc

SEQ ID NO: 1023241 - DNA, 18 bp, Homo sapiens
tcctaggaaaaaaggaat

SEQ ID NO: 1023242 - DNA, 13 bp, Homo sapiens
tcctaggacttaa

SEQ ID NO: 1023243 - DNA, 18 bp, Homo sapiens
tcctaggacttaaaatta

SEQ ID NO: 1023244 - DNA, 18 bp, Homo sapiens
tcctaggaggtaatgacc

SEQ ID NO: 1023245 - DNA, 20 bp, Homo sapiens
tcctaggcattgcaggacct

SEQ ID NO: 1023246 - DNA, 20 bp, Homo sapiens
tcctaggcccaggcctgggt

SEQ ID NO: 1023247 - DNA, 21 bp, Homo sapiens
tcctaggcccaggcctgggtt

SEQ ID NO: 1023248 - DNA, 22 bp, Homo sapiens
tcctaggctccaccccatccag

SEQ ID NO: 1023249 - DNA, 23 bp, Homo sapiens
tcctagggcacttctagtttcac

SEQ ID NO: 1023250 - DNA, 14 bp, Homo sapiens
tcctaggggaaggg

SEQ ID NO: 1023251 - DNA, 15 bp, Homo sapiens
tcctaggggaagggg

SEQ ID NO: 1023252 - DNA, 21 bp, Homo sapiens
tcctagggggtgtcagaagct

SEQ ID NO: 1023253 - DNA, 22 bp, Homo sapiens
tcctagggggtgtcagaagctg

SEQ ID NO: 1023254 - DNA, 14 bp, Homo sapiens
tcctaggtccaagc

SEQ ID NO: 1023255 - DNA, 16 bp, Homo sapiens
tcctaggtccaagccc

SEQ ID NO: 1023256 - DNA, 22 bp, Homo sapiens
tcctaggtccaagccccccaca

SEQ ID NO: 1023257 - DNA, 20 bp, Homo sapiens
tcctaggtcctctgaggcac

SEQ ID NO: 1023258 - DNA, 16 bp, Homo sapiens
tcctagtctttccagt

SEQ ID NO: 1023259 - DNA, 13 bp, Homo sapiens
tcctagttttctc

SEQ ID NO: 1023260 - DNA, 20 bp, Homo sapiens
tcctataataaaatggcacc

SEQ ID NO: 1023261 - DNA, 15 bp, Homo sapiens
tcctataatctgtca

SEQ ID NO: 1023262 - DNA, 16 bp, Homo sapiens
tcctataatctgtcaa

SEQ ID NO: 1023263 - DNA, 23 bp, Homo sapiens
tcctataatctgtcaaaacactg

SEQ ID NO: 1023264 - DNA, 20 bp, Homo sapiens
tcctataattccctatcttt

SEQ ID NO: 1023265 - DNA, 16 bp, Homo sapiens
tcctatacatttctgt

SEQ ID NO: 1023266 - DNA, 17 bp, Homo sapiens
tcctatacatttctgtt

SEQ ID NO: 1023267 - DNA, 16 bp, Homo sapiens
tcctatatatttctat

SEQ ID NO: 1023268 - DNA, 12 bp, Homo sapiens
tcctatatctgt

SEQ ID NO: 1023269 - DNA, 22 bp, Homo sapiens
tcctatccttggagagcagctg

SEQ ID NO: 1023270 - DNA, 19 bp, Homo sapiens
tcctatctccagcggccct

SEQ ID NO: 1023271 - DNA, 15 bp, Homo sapiens
tcctatctggggagc

SEQ ID NO: 1023272 - DNA, 18 bp, Homo sapiens
tcctatctggggagctcc

SEQ ID NO: 1023273 - DNA, 20 bp, Homo sapiens
tcctatctggggagctcctg

SEQ ID NO: 1023274 - DNA, 17 bp, Homo sapiens
tcctatctgtgttttga

SEQ ID NO: 1023275 - DNA, 20 bp, Homo sapiens
tcctatctttcctccctatc

SEQ ID NO: 1023276 - DNA, 17 bp, Homo sapiens
tcctatgatggatggca

SEQ ID NO: 1023277 - DNA, 22 bp, Homo sapiens
tcctatgatggatggcagactc

SEQ ID NO: 1023278 - DNA, 16 bp, Homo sapiens
tcctatgcccaggtac

SEQ ID NO: 1023279 - DNA, 14 bp, Homo sapiens
tcctatgcttaata

SEQ ID NO: 1023280 - DNA, 15 bp, Homo sapiens
tcctatgcttaataa

SEQ ID NO: 1023281 - DNA, 17 bp, Homo sapiens
tcctatgcttaataaaa

SEQ ID NO: 1023282 - DNA, 17 bp, Homo sapiens
tcctatggaaacatttt

SEQ ID NO: 1023283 - DNA, 18 bp, Homo sapiens
tcctatggacaacttatt

SEQ ID NO: 1023284 - DNA, 19 bp, Homo sapiens
tcctatggacaacttattt

SEQ ID NO: 1023285 - DNA, 16 bp, Homo sapiens
tcctatgtacagagct

SEQ ID NO: 1023286 - DNA, 19 bp, Homo sapiens
tcctatgtttttgttcaaa

SEQ ID NO: 1023287 - DNA, 17 bp, Homo sapiens
tcctattcaaattccta

SEQ ID NO: 1023288 - DNA, 14 bp, Homo sapiens
tcctattctattgc

SEQ ID NO: 1023289 - DNA, 17 bp, Homo sapiens
tcctattctcaccagga

SEQ ID NO: 1023290 - DNA, 22 bp, Homo sapiens
tcctattgaaagaccagatcct

SEQ ID NO: 1023291 - DNA, 21 bp, Homo sapiens
tcctattttctatccccctta

SEQ ID NO: 1023292 - DNA, 17 bp, Homo sapiens
tcctcaaaactggagtc

SEQ ID NO: 1023293 - DNA, 17 bp, Homo sapiens
tcctcaagaaataaaag

SEQ ID NO: 1023294 - DNA, 13 bp, Homo sapiens
tcctcaagacttt

SEQ ID NO: 1023295 - DNA, 12 bp, Homo sapiens
tcctcaagcctg

SEQ ID NO: 1023296 - DNA, 22 bp, Homo sapiens
tcctcaaggcccagccataaaa

SEQ ID NO: 1023297 - DNA, 13 bp, Homo sapiens
tcctcacaagcct

SEQ ID NO: 1023298 - DNA, 13 bp, Homo sapiens
tcctcacacccct

SEQ ID NO: 1023299 - DNA, 17 bp, Homo sapiens
tcctcacacccctgtcc

SEQ ID NO: 1023300 - DNA, 20 bp, Homo sapiens
tcctcacactgctgtcctct

SEQ ID NO: 1023301 - DNA, 21 bp, Homo sapiens
tcctcacagttgccatgtaga

SEQ ID NO: 1023302 - DNA, 12 bp, Homo sapiens
tcctcacccacc

SEQ ID NO: 1023303 - DNA, 13 bp, Homo sapiens
tcctcacccccag

SEQ ID NO: 1023304 - DNA, 20 bp, Homo sapiens
tcctcaccccgtctggggtt

SEQ ID NO: 1023305 - DNA, 15 bp, Homo sapiens
tcctcaccctgtggg

SEQ ID NO: 1023306 - DNA, 15 bp, Homo sapiens
tcctcacctcatgcc

SEQ ID NO: 1023307 - DNA, 12 bp, Homo sapiens
tcctcacctctg

SEQ ID NO: 1023308 - DNA, 16 bp, Homo sapiens
tcctcacctctggact

SEQ ID NO: 1023309 - DNA, 20 bp, Homo sapiens
tcctcacctctggactggct

SEQ ID NO: 1023310 - DNA, 23 bp, Homo sapiens
tcctcacgtgcaggacagctctt

SEQ ID NO: 1023311 - DNA, 17 bp, Homo sapiens
tcctcactcccagtcca

SEQ ID NO: 1023312 - DNA, 15 bp, Homo sapiens
tcctcactctgtccc

SEQ ID NO: 1023313 - DNA, 19 bp, Homo sapiens
tcctcactctgtccctgtc

SEQ ID NO: 1023314 - DNA, 19 bp, Homo sapiens
tcctcactgccctccccag

SEQ ID NO: 1023315 - DNA, 14 bp, Homo sapiens
tcctcactgggtgg

SEQ ID NO: 1023316 - DNA, 22 bp, Homo sapiens
tcctcactgggtggggtgagga

SEQ ID NO: 1023317 - DNA, 17 bp, Homo sapiens
tcctcagagaatttcta

SEQ ID NO: 1023318 - DNA, 20 bp, Homo sapiens
tcctcagagaatttctacca

SEQ ID NO: 1023319 - DNA, 21 bp, Homo sapiens
tcctcagagcgccaggaagcc

SEQ ID NO: 1023320 - DNA, 22 bp, Homo sapiens
tcctcagagcgccaggaagcca

SEQ ID NO: 1023321 - DNA, 16 bp, Homo sapiens
tcctcagaggacagtt

SEQ ID NO: 1023322 - DNA, 13 bp, Homo sapiens
tcctcagaggctg

SEQ ID NO: 1023323 - DNA, 16 bp, Homo sapiens
tcctcagaggctgagc

SEQ ID NO: 1023324 - DNA, 20 bp, Homo sapiens
tcctcagaggctgagccctg

SEQ ID NO: 1023325 - DNA, 22 bp, Homo sapiens
tcctcagatccccagctttctc

SEQ ID NO: 1023326 - DNA, 17 bp, Homo sapiens
tcctcagcccccaggcc

SEQ ID NO: 1023327 - DNA, 20 bp, Homo sapiens
tcctcagccgagaaattggg

SEQ ID NO: 1023328 - DNA, 11 bp, Homo sapiens
tcctcagcctc

SEQ ID NO: 1023329 - DNA, 13 bp, Homo sapiens
tcctcagcctcca

SEQ ID NO: 1023330 - DNA, 16 bp, Homo sapiens
tcctcagcctctgcaa

SEQ ID NO: 1023331 - DNA, 16 bp, Homo sapiens
tcctcagctgcatgga

SEQ ID NO: 1023332 - DNA, 15 bp, Homo sapiens
tcctcagctgccaag

SEQ ID NO: 1023333 - DNA, 19 bp, Homo sapiens
tcctcaggaccctcagccc

SEQ ID NO: 1023334 - DNA, 20 bp, Homo sapiens
tcctcaggaccctcagccct

SEQ ID NO: 1023335 - DNA, 21 bp, Homo sapiens
tcctcaggagccgaagcccag

SEQ ID NO: 1023336 - DNA, 22 bp, Homo sapiens
tcctcaggagccgaagcccagg

SEQ ID NO: 1023337 - DNA, 16 bp, Homo sapiens
tcctcaggcacacagc

SEQ ID NO: 1023338 - DNA, 14 bp, Homo sapiens
tcctcaggcccagc

SEQ ID NO: 1023339 - DNA, 18 bp, Homo sapiens
tcctcaggcccagctgct

SEQ ID NO: 1023340 - DNA, 22 bp, Homo sapiens
tcctcaggcccagctgctcccc

SEQ ID NO: 1023341 - DNA, 19 bp, Homo sapiens
tcctcagggctcagtcttt

SEQ ID NO: 1023342 - DNA, 16 bp, Homo sapiens
tcctcaggggtggaga

SEQ ID NO: 1023343 - DNA, 21 bp, Homo sapiens
tcctcaggggtggagaagtgt

SEQ ID NO: 1023344 - DNA, 13 bp, Homo sapiens
tcctcagggtggg

SEQ ID NO: 1023345 - DNA, 17 bp, Homo sapiens
tcctcagggtgtcctga

SEQ ID NO: 1023346 - DNA, 23 bp, Homo sapiens
tcctcaggtacagcgggctgtgc

SEQ ID NO: 1023347 - DNA, 19 bp, Homo sapiens
tcctcaggtcagctgggag

SEQ ID NO: 1023348 - DNA, 21 bp, Homo sapiens
tcctcaggtcagctgggagcc

SEQ ID NO: 1023349 - DNA, 22 bp, Homo sapiens
tcctcaggtcagctgggagcca

SEQ ID NO: 1023350 - DNA, 13 bp, Homo sapiens
tcctcaggtggcc

SEQ ID NO: 1023351 - DNA, 21 bp, Homo sapiens
tcctcagtaacatttctgttc

SEQ ID NO: 1023352 - DNA, 22 bp, Homo sapiens
tcctcagtaacatttctgttct

SEQ ID NO: 1023353 - DNA, 15 bp, Homo sapiens
tcctcagtttacatc

SEQ ID NO: 1023354 - DNA, 15 bp, Homo sapiens
tcctcatatggccca

SEQ ID NO: 1023355 - DNA, 21 bp, Homo sapiens
tcctcatatggcccagtgtca

SEQ ID NO: 1023356 - DNA, 15 bp, Homo sapiens
tcctcatccatttct

SEQ ID NO: 1023357 - DNA, 16 bp, Homo sapiens
tcctcatccatttctt

SEQ ID NO: 1023358 - DNA, 14 bp, Homo sapiens
tcctcatcccgtgt

SEQ ID NO: 1023359 - DNA, 12 bp, Homo sapiens
tcctcatccctg

SEQ ID NO: 1023360 - DNA, 13 bp, Homo sapiens
tcctcatccctga

SEQ ID NO: 1023361 - DNA, 20 bp, Homo sapiens
tcctcatcctttccctctcc

SEQ ID NO: 1023362 - DNA, 22 bp, Homo sapiens
tcctcatctgagaggctctccg

SEQ ID NO: 1023363 - DNA, 15 bp, Homo sapiens
tcctcatctgggtct

SEQ ID NO: 1023364 - DNA, 14 bp, Homo sapiens
tcctcatgtaacat

SEQ ID NO: 1023365 - DNA, 17 bp, Homo sapiens
gcctccgcttatcctgc

SEQ ID NO: 1023366 - DNA, 18 bp, Homo sapiens
gcctccgcttatcctgct

SEQ ID NO: 1023367 - DNA, 20 bp, Homo sapiens
gcctccgcttatcctgctag

SEQ ID NO: 1023368 - DNA, 22 bp, Homo sapiens
gcctccggcgtcttgcccagca

SEQ ID NO: 1023369 - DNA, 23 bp, Homo sapiens
gcctccggcgtcttgcccagcag

SEQ ID NO: 1023370 - DNA, 20 bp, Homo sapiens
gcctccgtcatccatgccct

SEQ ID NO: 1023371 - DNA, 14 bp, Homo sapiens
gcctccgtcttccc

SEQ ID NO: 1023372 - DNA, 17 bp, Homo sapiens
gcctccgtcttcccagc

SEQ ID NO: 1023373 - DNA, 13 bp, Homo sapiens
gcctccgtggaac

SEQ ID NO: 1023374 - DNA, 19 bp, Homo sapiens
gcctccgtttatgggcctt

SEQ ID NO: 1023375 - DNA, 20 bp, Homo sapiens
gcctccgtttatgggccttg

SEQ ID NO: 1023376 - DNA, 18 bp, Homo sapiens
gcctcctaaggctcccca

SEQ ID NO: 1023377 - DNA, 19 bp, Homo sapiens
gcctcctaaggctccccac

SEQ ID NO: 1023378 - DNA, 15 bp, Homo sapiens
gcctcctaggggaag

SEQ ID NO: 1023379 - DNA, 21 bp, Homo sapiens
gcctcctaggggaagggggtg

SEQ ID NO: 1023380 - DNA, 12 bp, Homo sapiens
gcctcctcagcc

SEQ ID NO: 1023381 - DNA, 14 bp, Homo sapiens
gcctcctcagcctc

SEQ ID NO: 1023382 - DNA, 21 bp, Homo sapiens
gcctcctcagcctctgcaact

SEQ ID NO: 1023383 - DNA, 13 bp, Homo sapiens
gcctcctcagggg

SEQ ID NO: 1023384 - DNA, 15 bp, Homo sapiens
gcctcctcatcccgt

SEQ ID NO: 1023385 - DNA, 22 bp, Homo sapiens
gcctcctcatcccgtgttctcc

SEQ ID NO: 1023386 - DNA, 12 bp, Homo sapiens
gcctcctccctc

SEQ ID NO: 1023387 - DNA, 16 bp, Homo sapiens
gcctcctccctcccag

SEQ ID NO: 1023388 - DNA, 20 bp, Homo sapiens
gcctcctccctcccagctgc

SEQ ID NO: 1023389 - DNA, 21 bp, Homo sapiens
gcctcctccctcccagctgca

SEQ ID NO: 1023390 - DNA, 21 bp, Homo sapiens
gcctcctcggagagcagcagc

SEQ ID NO: 1023391 - DNA, 13 bp, Homo sapiens
gcctcctctgtcc

SEQ ID NO: 1023392 - DNA, 14 bp, Homo sapiens
gcctcctgagcctg

SEQ ID NO: 1023393 - DNA, 19 bp, Homo sapiens
gcctcctgagcctgtgggt

SEQ ID NO: 1023394 - DNA, 15 bp, Homo sapiens
gcctcctgccccctg

SEQ ID NO: 1023395 - DNA, 17 bp, Homo sapiens
gcctcctgccccctgcc

SEQ ID NO: 1023396 - DNA, 14 bp, Homo sapiens
gcctcctgcctgcc

SEQ ID NO: 1023397 - DNA, 23 bp, Homo sapiens
gcctcctgcctgcccctctcccg

SEQ ID NO: 1023398 - DNA, 16 bp, Homo sapiens
gcctcctggaggacca

SEQ ID NO: 1023399 - DNA, 15 bp, Homo sapiens
gcctcctgtacctca

SEQ ID NO: 1023400 - DNA, 14 bp, Homo sapiens
gcctcctgtgcctg

SEQ ID NO: 1023401 - DNA, 13 bp, Homo sapiens
gcctcctgtttgg

SEQ ID NO: 1023402 - DNA, 15 bp, Homo sapiens
gcctcctgttttctc

SEQ ID NO: 1023403 - DNA, 18 bp, Homo sapiens
gcctccttcccatgcctg

SEQ ID NO: 1023404 - DNA, 15 bp, Homo sapiens
gcctccttcttccac

SEQ ID NO: 1023405 - DNA, 17 bp, Homo sapiens
gcctccttgctgacccc

SEQ ID NO: 1023406 - DNA, 19 bp, Homo sapiens
gcctccttgctgaccccag

SEQ ID NO: 1023407 - DNA, 20 bp, Homo sapiens
gcctccttgctgaccccagg

SEQ ID NO: 1023408 - DNA, 16 bp, Homo sapiens
gcctcgaaacacagaa

SEQ ID NO: 1023409 - DNA, 22 bp, Homo sapiens
gcctcgacagggcctggagccc

SEQ ID NO: 1023410 - DNA, 13 bp, Homo sapiens
gcctcgaggcacc

SEQ ID NO: 1023411 - DNA, 14 bp, Homo sapiens
gcctcgaggcaccg

SEQ ID NO: 1023412 - DNA, 15 bp, Homo sapiens
gcctcgaggcaccgg

SEQ ID NO: 1023413 - DNA, 22 bp, Homo sapiens
gcctcgaggcaccggcgctgca

SEQ ID NO: 1023414 - DNA, 13 bp, Homo sapiens
gcctcgaggctgg

SEQ ID NO: 1023415 - DNA, 17 bp, Homo sapiens
gcctcgaggctggtggt

SEQ ID NO: 1023416 - DNA, 21 bp, Homo sapiens
gcctcgaggctggtggttttc

SEQ ID NO: 1023417 - DNA, 19 bp, Homo sapiens
gcctcgagggccgcctgcc

SEQ ID NO: 1023418 - DNA, 21 bp, Homo sapiens
gcctcgagggccgcctgcctt

SEQ ID NO: 1023419 - DNA, 15 bp, Homo sapiens
gcctcgcacaggccc

SEQ ID NO: 1023420 - DNA, 16 bp, Homo sapiens
gcctcgcacaggccct

SEQ ID NO: 1023421 - DNA, 14 bp, Homo sapiens
gcctcgcatcctat

SEQ ID NO: 1023422 - DNA, 13 bp, Homo sapiens
gcctcgcccctcc

SEQ ID NO: 1023423 - DNA, 15 bp, Homo sapiens
gcctcgcccctccag

SEQ ID NO: 1023424 - DNA, 20 bp, Homo sapiens
gcctcgcctccccaccctcc

SEQ ID NO: 1023425 - DNA, 15 bp, Homo sapiens
gcctcgctcaccgct

SEQ ID NO: 1023426 - DNA, 22 bp, Homo sapiens
gcctcgctcaccgctggccctt

SEQ ID NO: 1023427 - DNA, 20 bp, Homo sapiens
gcctcggcagaactctctgt

SEQ ID NO: 1023428 - DNA, 19 bp, Homo sapiens
gcctcggggatggggaggg

SEQ ID NO: 1023429 - DNA, 14 bp, Homo sapiens
gcctcgtgccagca

SEQ ID NO: 1023430 - DNA, 16 bp, Homo sapiens
gcctcgtgccagcagc

SEQ ID NO: 1023431 - DNA, 17 bp, Homo sapiens
gcctcgtgccagcagcc

SEQ ID NO: 1023432 - DNA, 19 bp, Homo sapiens
gcctcgtgccagcagcctc

SEQ ID NO: 1023433 - DNA, 19 bp, Homo sapiens
gcctcgtgccatgatctgt

SEQ ID NO: 1023434 - DNA, 13 bp, Homo sapiens
gcctcgtggagct

SEQ ID NO: 1023435 - DNA, 15 bp, Homo sapiens
gcctcgttggagagc

SEQ ID NO: 1023436 - DNA, 21 bp, Homo sapiens
gcctctacacaggggccctgt

SEQ ID NO: 1023437 - DNA, 23 bp, Homo sapiens
gcctctacctgacactcccttgg

SEQ ID NO: 1023438 - DNA, 13 bp, Homo sapiens
gcctctatgccct

SEQ ID NO: 1023439 - DNA, 21 bp, Homo sapiens
gcctctatgccctgcagagca

SEQ ID NO: 1023440 - DNA, 22 bp, Homo sapiens
gcctctatgccctgcagagcaa

SEQ ID NO: 1023441 - DNA, 19 bp, Homo sapiens
gcctctcagtgccctccag

SEQ ID NO: 1023442 - DNA, 19 bp, Homo sapiens
gcctctcatcaactgaatg

SEQ ID NO: 1023443 - DNA, 22 bp, Homo sapiens
gcctctccaaccactgtgccac

SEQ ID NO: 1023444 - DNA, 21 bp, Homo sapiens
gcctctccagtttgcacctgt

SEQ ID NO: 1023445 - DNA, 10 bp, Homo sapiens
gcctctccca

SEQ ID NO: 1023446 - DNA, 12 bp, Homo sapiens
gcctctcccacc

SEQ ID NO: 1023447 - DNA, 15 bp, Homo sapiens
gcctctcccaggctg

SEQ ID NO: 1023448 - DNA, 18 bp, Homo sapiens
gcctctccccaggtccag

SEQ ID NO: 1023449 - DNA, 22 bp, Homo sapiens
gcctctccccaggtccagctct

SEQ ID NO: 1023450 - DNA, 13 bp, Homo sapiens
gcctctcccggct

SEQ ID NO: 1023451 - DNA, 14 bp, Homo sapiens
gcctctcccggctg

SEQ ID NO: 1023452 - DNA, 16 bp, Homo sapiens
gcctctcccggctgcc

SEQ ID NO: 1023453 - DNA, 17 bp, Homo sapiens
gcctctcccggctgcct

SEQ ID NO: 1023454 - DNA, 18 bp, Homo sapiens
gcctctcccggctgcctg

SEQ ID NO: 1023455 - DNA, 19 bp, Homo sapiens
gcctctcccggctgcctgc

SEQ ID NO: 1023456 - DNA, 13 bp, Homo sapiens
gcctctcccgtca

SEQ ID NO: 1023457 - DNA, 14 bp, Homo sapiens
gcctctccctgggt

SEQ ID NO: 1023458 - DNA, 18 bp, Homo sapiens
gcctctcctgccctctgc

SEQ ID NO: 1023459 - DNA, 19 bp, Homo sapiens
gcctctcggtggccagcag

SEQ ID NO: 1023460 - DNA, 20 bp, Homo sapiens
gcctctctatcctctcttcc

SEQ ID NO: 1023461 - DNA, 14 bp, Homo sapiens
gcctctctcctgcc

SEQ ID NO: 1023462 - DNA, 16 bp, Homo sapiens
gcctctctctccctcc

SEQ ID NO: 1023463 - DNA, 21 bp, Homo sapiens
gcctctctctctctcctcagg

SEQ ID NO: 1023464 - DNA, 13 bp, Homo sapiens
gcctctctctgct

SEQ ID NO: 1023465 - DNA, 10 bp, Homo sapiens
gcctctctgg

SEQ ID NO: 1023466 - DNA, 12 bp, Homo sapiens
gcctctctggcc

SEQ ID NO: 1023467 - DNA, 14 bp, Homo sapiens
gcctctctggcctc

SEQ ID NO: 1023468 - DNA, 20 bp, Homo sapiens
gcctctctggcctcccaccc

SEQ ID NO: 1023469 - DNA, 23 bp, Homo sapiens
gcctctctggcctcccacccgat

SEQ ID NO: 1023470 - DNA, 11 bp, Homo sapiens
gcctctctggg

SEQ ID NO: 1023471 - DNA, 12 bp, Homo sapiens
gcctctctgggg

SEQ ID NO: 1023472 - DNA, 13 bp, Homo sapiens
gcctctctggggg

SEQ ID NO: 1023473 - DNA, 15 bp, Homo sapiens
gcctctctgggggag

SEQ ID NO: 1023474 - DNA, 18 bp, Homo sapiens
gcctctctgggggaggca

SEQ ID NO: 1023475 - DNA, 14 bp, Homo sapiens
gcctctcttgcccc

SEQ ID NO: 1023476 - DNA, 18 bp, Homo sapiens
gcctctgaagttggacag

SEQ ID NO: 1023477 - DNA, 17 bp, Homo sapiens
gcctctgacagcagcct

SEQ ID NO: 1023478 - DNA, 19 bp, Homo sapiens
gcctctgacagtccacagg

SEQ ID NO: 1023479 - DNA, 15 bp, Homo sapiens
gcctctgagatgcta

SEQ ID NO: 1023480 - DNA, 21 bp, Homo sapiens
gcctctgcacaccctccagag

SEQ ID NO: 1023481 - DNA, 15 bp, Homo sapiens
gcctctgcattcagg

SEQ ID NO: 1023482 - DNA, 16 bp, Homo sapiens
gcctctgcccgcagag

SEQ ID NO: 1023483 - DNA, 18 bp, Homo sapiens
gcctctgcccgcagagcc

SEQ ID NO: 1023484 - DNA, 12 bp, Homo sapiens
gcctctgccctg

SEQ ID NO: 1023485 - DNA, 18 bp, Homo sapiens
gcctctgctgcccccttc

SEQ ID NO: 1023486 - DNA, 18 bp, Homo sapiens
gcctctgcttacttttta

SEQ ID NO: 1023487 - DNA, 17 bp, Homo sapiens
gcctctggaaagcaaag

SEQ ID NO: 1023488 - DNA, 17 bp, Homo sapiens
gcctctggacagccagt

SEQ ID NO: 1023489 - DNA, 17 bp, Homo sapiens
gcctctggactggcctg

SEQ ID NO: 1023490 - DNA, 14 bp, Homo sapiens
gcctctggaggcct

SEQ ID NO: 1023491 - DNA, 21 bp, Homo sapiens
tcctcatgtaacattggtgaa

SEQ ID NO: 1023492 - DNA, 20 bp, Homo sapiens
tcctcattaatagctgcctt

SEQ ID NO: 1023493 - DNA, 22 bp, Homo sapiens
tcctcattaatagctgccttca

SEQ ID NO: 1023494 - DNA, 17 bp, Homo sapiens
tcctcattagcattttg

SEQ ID NO: 1023495 - DNA, 17 bp, Homo sapiens
tcctcattgcctcctgt

SEQ ID NO: 1023496 - DNA, 23 bp, Homo sapiens
tcctccaaaggaagtctaggagc

SEQ ID NO: 1023497 - DNA, 13 bp, Homo sapiens
tcctccaacagct

SEQ ID NO: 1023498 - DNA, 20 bp, Homo sapiens
tcctccaagacactgtggac

SEQ ID NO: 1023499 - DNA, 21 bp, Homo sapiens
tcctccaagacactgtggact

SEQ ID NO: 1023500 - DNA, 14 bp, Homo sapiens
tcctccaagccagc

SEQ ID NO: 1023501 - DNA, 13 bp, Homo sapiens
tcctccacagaga

SEQ ID NO: 1023502 - DNA, 15 bp, Homo sapiens
tcctccacagagagg

SEQ ID NO: 1023503 - DNA, 16 bp, Homo sapiens
tcctccacatcctttc

SEQ ID NO: 1023504 - DNA, 19 bp, Homo sapiens
tcctccacgttctgctcat

SEQ ID NO: 1023505 - DNA, 18 bp, Homo sapiens
tcctccactcactccagc

SEQ ID NO: 1023506 - DNA, 16 bp, Homo sapiens
tcctccactcgaccca

SEQ ID NO: 1023507 - DNA, 17 bp, Homo sapiens
tcctccagaccaccagc

SEQ ID NO: 1023508 - DNA, 12 bp, Homo sapiens
tcctccagagga

SEQ ID NO: 1023509 - DNA, 14 bp, Homo sapiens
tcctccagcccctg

SEQ ID NO: 1023510 - DNA, 17 bp, Homo sapiens
tcctccagcctcccctc

SEQ ID NO: 1023511 - DNA, 22 bp, Homo sapiens
tcctccagcctcccctcccctg

SEQ ID NO: 1023512 - DNA, 10 bp, Homo sapiens
tcctccagct

SEQ ID NO: 1023513 - DNA, 15 bp, Homo sapiens
tcctccagctgcacc

SEQ ID NO: 1023514 - DNA, 17 bp, Homo sapiens
tcctccaggcctgcctc

SEQ ID NO: 1023515 - DNA, 19 bp, Homo sapiens
tcctccaggcctgcctccc

SEQ ID NO: 1023516 - DNA, 13 bp, Homo sapiens
tcctccagggaag

SEQ ID NO: 1023517 - DNA, 22 bp, Homo sapiens
tcctccagggaaggtggccaca

SEQ ID NO: 1023518 - DNA, 13 bp, Homo sapiens
tcctccagggcca

SEQ ID NO: 1023519 - DNA, 17 bp, Homo sapiens
tcctccagggtgatttt

SEQ ID NO: 1023520 - DNA, 22 bp, Homo sapiens
tcctccagggtgattttatgat

SEQ ID NO: 1023521 - DNA, 15 bp, Homo sapiens
tcctccatcacctga

SEQ ID NO: 1023522 - DNA, 12 bp, Homo sapiens
tcctccatccac

SEQ ID NO: 1023523 - DNA, 22 bp, Homo sapiens
tcctccatcttactctgcccta

SEQ ID NO: 1023524 - DNA, 14 bp, Homo sapiens
tcctcccacagacc

SEQ ID NO: 1023525 - DNA, 18 bp, Homo sapiens
tcctcccacagacctgca

SEQ ID NO: 1023526 - DNA, 22 bp, Homo sapiens
tcctcccacagacctgcagtga

SEQ ID NO: 1023527 - DNA, 12 bp, Homo sapiens
tcctcccacttc

SEQ ID NO: 1023528 - DNA, 12 bp, Homo sapiens
tcctcccagctg

SEQ ID NO: 1023529 - DNA, 13 bp, Homo sapiens
tcctcccagctgc

SEQ ID NO: 1023530 - DNA, 13 bp, Homo sapiens
tcctcccaggcgc

SEQ ID NO: 1023531 - DNA, 11 bp, Homo sapiens
tcctcccagtg

SEQ ID NO: 1023532 - DNA, 23 bp, Homo sapiens
tcctcccatcccctggactggga

SEQ ID NO: 1023533 - DNA, 19 bp, Homo sapiens
tcctcccatgtcactgcag

SEQ ID NO: 1023534 - DNA, 21 bp, Homo sapiens
tcctccccaaatcaatacact

SEQ ID NO: 1023535 - DNA, 13 bp, Homo sapiens
tcctccccacctg

SEQ ID NO: 1023536 - DNA, 16 bp, Homo sapiens
tcctccccacctgtag

SEQ ID NO: 1023537 - DNA, 18 bp, Homo sapiens
tcctccccacctgtagct

SEQ ID NO: 1023538 - DNA, 10 bp, Homo sapiens
tcctccccag

SEQ ID NO: 1023539 - DNA, 16 bp, Homo sapiens
tcctccccagcaggtg

SEQ ID NO: 1023540 - DNA, 15 bp, Homo sapiens
tcctccccaggaccc

SEQ ID NO: 1023541 - DNA, 15 bp, Homo sapiens
tcctccccatacaca

SEQ ID NO: 1023542 - DNA, 16 bp, Homo sapiens
tcctccccatacacac

SEQ ID NO: 1023543 - DNA, 18 bp, Homo sapiens
tcctcccccagcgtcagt

SEQ ID NO: 1023544 - DNA, 13 bp, Homo sapiens
tcctcccccggct

SEQ ID NO: 1023545 - DNA, 22 bp, Homo sapiens
tcctcccccggctgggcctcct

SEQ ID NO: 1023546 - DNA, 20 bp, Homo sapiens
tcctccccctcctagggggt

SEQ ID NO: 1023547 - DNA, 24 bp, Homo sapiens
tcctccccctgccagtgccttacc

SEQ ID NO: 1023548 - DNA, 15 bp, Homo sapiens
tcctccccctgttct

SEQ ID NO: 1023549 - DNA, 12 bp, Homo sapiens
tcctcccccttt

SEQ ID NO: 1023550 - DNA, 20 bp, Homo sapiens
tcctccccgcctcctcccac

SEQ ID NO: 1023551 - DNA, 21 bp, Homo sapiens
tcctcccctctcatccccctg

SEQ ID NO: 1023552 - DNA, 22 bp, Homo sapiens
tcctccccttttttttctgatt

SEQ ID NO: 1023553 - DNA, 16 bp, Homo sapiens
tcctcccgggccctcc

SEQ ID NO: 1023554 - DNA, 17 bp, Homo sapiens
tcctcccgggccctccc

SEQ ID NO: 1023555 - DNA, 13 bp, Homo sapiens
tcctccctcagcc

SEQ ID NO: 1023556 - DNA, 16 bp, Homo sapiens
tcctccctccaagcct

SEQ ID NO: 1023557 - DNA, 23 bp, Homo sapiens
tcctccctccaagcctggcaccc

SEQ ID NO: 1023558 - DNA, 15 bp, Homo sapiens
tcctccctcccagct

SEQ ID NO: 1023559 - DNA, 17 bp, Homo sapiens
tcctccctcccagctgc

SEQ ID NO: 1023560 - DNA, 20 bp, Homo sapiens
tcctccctcccagctgcact

SEQ ID NO: 1023561 - DNA, 14 bp, Homo sapiens
tcctccctgccccc

SEQ ID NO: 1023562 - DNA, 17 bp, Homo sapiens
tcctccctgccccccaa

SEQ ID NO: 1023563 - DNA, 18 bp, Homo sapiens
tcctccctgctcctcatg

SEQ ID NO: 1023564 - DNA, 15 bp, Homo sapiens
tcctccctggcagac

SEQ ID NO: 1023565 - DNA, 12 bp, Homo sapiens
tcctccctggct

SEQ ID NO: 1023566 - DNA, 20 bp, Homo sapiens
tcctccctgttatctgctag

SEQ ID NO: 1023567 - DNA, 19 bp, Homo sapiens
tcctcccttaccctcctct

SEQ ID NO: 1023568 - DNA, 10 bp, Homo sapiens
tcctcccttc

SEQ ID NO: 1023569 - DNA, 13 bp, Homo sapiens
tcctcccttcctt

SEQ ID NO: 1023570 - DNA, 18 bp, Homo sapiens
tcctcccttccttttccc

SEQ ID NO: 1023571 - DNA, 19 bp, Homo sapiens
tcctcccttccttttccct

SEQ ID NO: 1023572 - DNA, 22 bp, Homo sapiens
tcctcccttccttttccctgct

SEQ ID NO: 1023573 - DNA, 16 bp, Homo sapiens
tcctcccttctgctac

SEQ ID NO: 1023574 - DNA, 18 bp, Homo sapiens
tcctcccttgccccaggc

SEQ ID NO: 1023575 - DNA, 14 bp, Homo sapiens
tcctccgaggccag

SEQ ID NO: 1023576 - DNA, 16 bp, Homo sapiens
tcctccgcctgtgtcc

SEQ ID NO: 1023577 - DNA, 19 bp, Homo sapiens
tcctccgtagggtctttct

SEQ ID NO: 1023578 - DNA, 23 bp, Homo sapiens
tcctccgtagggtctttcttggg

SEQ ID NO: 1023579 - DNA, 17 bp, Homo sapiens
tcctccgtccacccagg

SEQ ID NO: 1023580 - DNA, 22 bp, Homo sapiens
tcctccgtccatatcagaactg

SEQ ID NO: 1023581 - DNA, 15 bp, Homo sapiens
tcctccgtctgaccc

SEQ ID NO: 1023582 - DNA, 23 bp, Homo sapiens
tcctcctacctcagcctcctggg

SEQ ID NO: 1023583 - DNA, 21 bp, Homo sapiens
tcctcctacctggggactcct

SEQ ID NO: 1023584 - DNA, 20 bp, Homo sapiens
tcctcctaggaaaccagctc

SEQ ID NO: 1023585 - DNA, 22 bp, Homo sapiens
tcctcctcacccacctctgggt

SEQ ID NO: 1023586 - DNA, 16 bp, Homo sapiens
tcctcctcacctcatg

SEQ ID NO: 1023587 - DNA, 12 bp, Homo sapiens
tcctcctcaggc

SEQ ID NO: 1023588 - DNA, 12 bp, Homo sapiens
tcctcctccaca

SEQ ID NO: 1023589 - DNA, 13 bp, Homo sapiens
tcctcctccacag

SEQ ID NO: 1023590 - DNA, 11 bp, Homo sapiens
tcctcctccat

SEQ ID NO: 1023591 - DNA, 20 bp, Homo sapiens
tcctcctcccacccggctgc

SEQ ID NO: 1023592 - DNA, 14 bp, Homo sapiens
tcctcctcccctcc

SEQ ID NO: 1023593 - DNA, 17 bp, Homo sapiens
tcctcctccctgcatct

SEQ ID NO: 1023594 - DNA, 20 bp, Homo sapiens
tcctcctcgctcctccttcc

SEQ ID NO: 1023595 - DNA, 15 bp, Homo sapiens
tcctcctctacctct

SEQ ID NO: 1023596 - DNA, 19 bp, Homo sapiens
tcctcctctacctctctcc

SEQ ID NO: 1023597 - DNA, 17 bp, Homo sapiens
tcctcctctgaggaagc

SEQ ID NO: 1023598 - DNA, 22 bp, Homo sapiens
tcctcctctgcctacagccagg

SEQ ID NO: 1023599 - DNA, 16 bp, Homo sapiens
tcctcctctttctctc

SEQ ID NO: 1023600 - DNA, 17 bp, Homo sapiens
tcctcctctttctctcc

SEQ ID NO: 1023601 - DNA, 19 bp, Homo sapiens
tcctcctctttctctcccc

SEQ ID NO: 1023602 - DNA, 16 bp, Homo sapiens
tcctcctgaagcctct

SEQ ID NO: 1023603 - DNA, 18 bp, Homo sapiens
tcctcctgaagcctctgc

SEQ ID NO: 1023604 - DNA, 23 bp, Homo sapiens
tcctcctgatggccaagagcatc

SEQ ID NO: 1023605 - DNA, 22 bp, Homo sapiens
tcctcctgcagacacctggact

SEQ ID NO: 1023606 - DNA, 20 bp, Homo sapiens
tcctcctgcccagctcctca

SEQ ID NO: 1023607 - DNA, 22 bp, Homo sapiens
tcctcctgcccagctcctcaca

SEQ ID NO: 1023608 - DNA, 12 bp, Homo sapiens
tcctcctgccct

SEQ ID NO: 1023609 - DNA, 15 bp, Homo sapiens
tcctcctgccctgtc

SEQ ID NO: 1023610 - DNA, 16 bp, Homo sapiens
tcctcctgccctgtcc

SEQ ID NO: 1023611 - DNA, 13 bp, Homo sapiens
tcctcctgcctca

SEQ ID NO: 1023612 - DNA, 14 bp, Homo sapiens
tcctcctgcctcag

SEQ ID NO: 1023613 - DNA, 18 bp, Homo sapiens
tcctcctggaaccttgct

SEQ ID NO: 1023614 - DNA, 19 bp, Homo sapiens
tcctcctggaaccttgctg

SEQ ID NO: 1023615 - DNA, 21 bp, Homo sapiens
tcctcctggaaccttgctgtc

SEQ ID NO: 1023616 - DNA, 18 bp, Homo sapiens
gcctctggaggcctctgg

SEQ ID NO: 1023617 - DNA, 14 bp, Homo sapiens
gcctctggccgcca

SEQ ID NO: 1023618 - DNA, 19 bp, Homo sapiens
gcctctggccgccaccccc

SEQ ID NO: 1023619 - DNA, 23 bp, Homo sapiens
gcctctggctagaggccagcccc

SEQ ID NO: 1023620 - DNA, 12 bp, Homo sapiens
gcctctgggcag

SEQ ID NO: 1023621 - DNA, 17 bp, Homo sapiens
gcctctgggcagcctgc

SEQ ID NO: 1023622 - DNA, 18 bp, Homo sapiens
gcctctgggcagcctgct

SEQ ID NO: 1023623 - DNA, 14 bp, Homo sapiens
gcctctggttgcct

SEQ ID NO: 1023624 - DNA, 11 bp, Homo sapiens
gcctctgtcca

SEQ ID NO: 1023625 - DNA, 14 bp, Homo sapiens
gcctctgtcctccc

SEQ ID NO: 1023626 - DNA, 16 bp, Homo sapiens
gcctctgtcctcccat

SEQ ID NO: 1023627 - DNA, 19 bp, Homo sapiens
gcctctgtcctcccatccc

SEQ ID NO: 1023628 - DNA, 13 bp, Homo sapiens
gcctctgtctcct

SEQ ID NO: 1023629 - DNA, 16 bp, Homo sapiens
gcctctgtctggagcc

SEQ ID NO: 1023630 - DNA, 13 bp, Homo sapiens
gcctctgtgcaca

SEQ ID NO: 1023631 - DNA, 19 bp, Homo sapiens
gcctctgtgcacagtggct

SEQ ID NO: 1023632 - DNA, 14 bp, Homo sapiens
gcctctgtgctgtg

SEQ ID NO: 1023633 - DNA, 18 bp, Homo sapiens
gcctctgtgctgtgtgtg

SEQ ID NO: 1023634 - DNA, 16 bp, Homo sapiens
gcctctgtggaagaga

SEQ ID NO: 1023635 - DNA, 17 bp, Homo sapiens
gcctctgtggaagagat

SEQ ID NO: 1023636 - DNA, 14 bp, Homo sapiens
gcctctgtgtcctt

SEQ ID NO: 1023637 - DNA, 15 bp, Homo sapiens
gcctctgtgtccttc

SEQ ID NO: 1023638 - DNA, 18 bp, Homo sapiens
gcctctgtgtccttccct

SEQ ID NO: 1023639 - DNA, 14 bp, Homo sapiens
gcctcttagtgatt

SEQ ID NO: 1023640 - DNA, 20 bp, Homo sapiens
gcctcttattccaggagaag

SEQ ID NO: 1023641 - DNA, 15 bp, Homo sapiens
gcctcttccctctga

SEQ ID NO: 1023642 - DNA, 14 bp, Homo sapiens
gcctcttcctctgg

SEQ ID NO: 1023643 - DNA, 16 bp, Homo sapiens
gcctcttcctctgggc

SEQ ID NO: 1023644 - DNA, 17 bp, Homo sapiens
gcctcttcctctgggca

SEQ ID NO: 1023645 - DNA, 21 bp, Homo sapiens
gcctcttcctctgggcagcgc

SEQ ID NO: 1023646 - DNA, 23 bp, Homo sapiens
gcctcttctctactctagggaaa

SEQ ID NO: 1023647 - DNA, 14 bp, Homo sapiens
gcctcttctctgca

SEQ ID NO: 1023648 - DNA, 22 bp, Homo sapiens
gcctcttctcttgacagtctga

SEQ ID NO: 1023649 - DNA, 18 bp, Homo sapiens
gcctcttctgggagggca

SEQ ID NO: 1023650 - DNA, 16 bp, Homo sapiens
gcctcttctgggctac

SEQ ID NO: 1023651 - DNA, 23 bp, Homo sapiens
gcctcttctgggctactgccact

SEQ ID NO: 1023652 - DNA, 15 bp, Homo sapiens
gcctcttcttcttca

SEQ ID NO: 1023653 - DNA, 22 bp, Homo sapiens
gcctcttgaccaggctgcctcc

SEQ ID NO: 1023654 - DNA, 21 bp, Homo sapiens
gcctcttgagcagtggctggt

SEQ ID NO: 1023655 - DNA, 19 bp, Homo sapiens
gcctcttgagttcctctgc

SEQ ID NO: 1023656 - DNA, 14 bp, Homo sapiens
gcctcttgcccgtc

SEQ ID NO: 1023657 - DNA, 21 bp, Homo sapiens
gcctcttgcccgtcggccctg

SEQ ID NO: 1023658 - DNA, 17 bp, Homo sapiens
gcctcttggacctctgc

SEQ ID NO: 1023659 - DNA, 21 bp, Homo sapiens
gcctcttggacctctgctctg

SEQ ID NO: 1023660 - DNA, 23 bp, Homo sapiens
gcctcttggataccagctcaggg

SEQ ID NO: 1023661 - DNA, 23 bp, Homo sapiens
gcctcttggcttctcagcccctt

SEQ ID NO: 1023662 - DNA, 15 bp, Homo sapiens
gcctcttgtcccttg

SEQ ID NO: 1023663 - DNA, 16 bp, Homo sapiens
gcctcttgtgctcacg

SEQ ID NO: 1023664 - DNA, 16 bp, Homo sapiens
gcctcttgttgcagag

SEQ ID NO: 1023665 - DNA, 18 bp, Homo sapiens
gcctcttgtttctgtgcc

SEQ ID NO: 1023666 - DNA, 20 bp, Homo sapiens
gcctctttttccttcttcag

SEQ ID NO: 1023667 - DNA, 21 bp, Homo sapiens
gcctctttttccttcttcagc

SEQ ID NO: 1023668 - DNA, 19 bp, Homo sapiens
gcctgaaacagccatgtcc

SEQ ID NO: 1023669 - DNA, 20 bp, Homo sapiens
gcctgaaacccgccctcagg

SEQ ID NO: 1023670 - DNA, 16 bp, Homo sapiens
gcctgaaagaggctga

SEQ ID NO: 1023671 - DNA, 14 bp, Homo sapiens
gcctgaaagataca

SEQ ID NO: 1023672 - DNA, 22 bp, Homo sapiens
gcctgaaagatacaggggatca

SEQ ID NO: 1023673 - DNA, 21 bp, Homo sapiens
gcctgaacatccttccttccc

SEQ ID NO: 1023674 - DNA, 13 bp, Homo sapiens
gcctgaactccag

SEQ ID NO: 1023675 - DNA, 17 bp, Homo sapiens
gcctgaactcctgccat

SEQ ID NO: 1023676 - DNA, 14 bp, Homo sapiens
gcctgaactgaggc

SEQ ID NO: 1023677 - DNA, 15 bp, Homo sapiens
gcctgaagccagctg

SEQ ID NO: 1023678 - DNA, 16 bp, Homo sapiens
gcctgaagccagctgc

SEQ ID NO: 1023679 - DNA, 15 bp, Homo sapiens
gcctgaagcctggat

SEQ ID NO: 1023680 - DNA, 18 bp, Homo sapiens
gcctgaagctggcctgga

SEQ ID NO: 1023681 - DNA, 18 bp, Homo sapiens
gcctgaaggggcgtctgt

SEQ ID NO: 1023682 - DNA, 20 bp, Homo sapiens
gcctgaagtcttctcctcca

SEQ ID NO: 1023683 - DNA, 18 bp, Homo sapiens
gcctgaagttggagtgag

SEQ ID NO: 1023684 - DNA, 17 bp, Homo sapiens
gcctgaatcatgagcct

SEQ ID NO: 1023685 - DNA, 18 bp, Homo sapiens
gcctgaatcatgagcctg

SEQ ID NO: 1023686 - DNA, 21 bp, Homo sapiens
gcctgaatcatgagcctgctg

SEQ ID NO: 1023687 - DNA, 21 bp, Homo sapiens
gcctgacaaccactggtctgt

SEQ ID NO: 1023688 - DNA, 17 bp, Homo sapiens
gcctgacaccccctccc

SEQ ID NO: 1023689 - DNA, 21 bp, Homo sapiens
gcctgacaccccctccccgcc

SEQ ID NO: 1023690 - DNA, 14 bp, Homo sapiens
gcctgacagccttc

SEQ ID NO: 1023691 - DNA, 22 bp, Homo sapiens
gcctgacagccttccccagctc

SEQ ID NO: 1023692 - DNA, 17 bp, Homo sapiens
gcctgacccacggggca

SEQ ID NO: 1023693 - DNA, 19 bp, Homo sapiens
gcctgacccacggggcagt

SEQ ID NO: 1023694 - DNA, 13 bp, Homo sapiens
gcctgacctgaga

SEQ ID NO: 1023695 - DNA, 17 bp, Homo sapiens
gcctgactcctgggtgg

SEQ ID NO: 1023696 - DNA, 15 bp, Homo sapiens
gcctgactgctcaga

SEQ ID NO: 1023697 - DNA, 19 bp, Homo sapiens
gcctgacttctgctggcat

SEQ ID NO: 1023698 - DNA, 13 bp, Homo sapiens
gcctgacttgagc

SEQ ID NO: 1023699 - DNA, 14 bp, Homo sapiens
gcctgacttgagcc

SEQ ID NO: 1023700 - DNA, 18 bp, Homo sapiens
gcctgacttgagccactc

SEQ ID NO: 1023701 - DNA, 21 bp, Homo sapiens
gcctgacttgagccactcctt

SEQ ID NO: 1023702 - DNA, 13 bp, Homo sapiens
gcctgacttgggg

SEQ ID NO: 1023703 - DNA, 17 bp, Homo sapiens
gcctgagaagaagtggc

SEQ ID NO: 1023704 - DNA, 18 bp, Homo sapiens
gcctgagaagaagtggct

SEQ ID NO: 1023705 - DNA, 13 bp, Homo sapiens
gcctgagaatgag

SEQ ID NO: 1023706 - DNA, 15 bp, Homo sapiens
gcctgagacagcacc

SEQ ID NO: 1023707 - DNA, 16 bp, Homo sapiens
gcctgagacagcacca

SEQ ID NO: 1023708 - DNA, 17 bp, Homo sapiens
gcctgagacagcaccac

SEQ ID NO: 1023709 - DNA, 20 bp, Homo sapiens
gcctgagacagcaccactgc

SEQ ID NO: 1023710 - DNA, 20 bp, Homo sapiens
gcctgagagaattggctcaa

SEQ ID NO: 1023711 - DNA, 14 bp, Homo sapiens
gcctgagaggcagg

SEQ ID NO: 1023712 - DNA, 15 bp, Homo sapiens
gcctgagaggcaggc

SEQ ID NO: 1023713 - DNA, 21 bp, Homo sapiens
gcctgagagtatttaggcaga

SEQ ID NO: 1023714 - DNA, 20 bp, Homo sapiens
gcctgagcaacatctcggga

SEQ ID NO: 1023715 - DNA, 18 bp, Homo sapiens
gcctgagcaactcttgat

SEQ ID NO: 1023716 - DNA, 14 bp, Homo sapiens
gcctgagcccagga

SEQ ID NO: 1023717 - DNA, 13 bp, Homo sapiens
gcctgaggaggag

SEQ ID NO: 1023718 - DNA, 19 bp, Homo sapiens
gcctgaggaggaggacaca

SEQ ID NO: 1023719 - DNA, 23 bp, Homo sapiens
gcctgaggaggaggacacagcac

SEQ ID NO: 1023720 - DNA, 17 bp, Homo sapiens
gcctgaggatgagctgg

SEQ ID NO: 1023721 - DNA, 13 bp, Homo sapiens
gcctgaggcagga

SEQ ID NO: 1023722 - DNA, 14 bp, Homo sapiens
gcctgaggcaggag

SEQ ID NO: 1023723 - DNA, 15 bp, Homo sapiens
gcctgaggcaggaga

SEQ ID NO: 1023724 - DNA, 14 bp, Homo sapiens
gcctgaggctgaga

SEQ ID NO: 1023725 - DNA, 18 bp, Homo sapiens
gcctgaggctgagactgc

SEQ ID NO: 1023726 - DNA, 13 bp, Homo sapiens
gcctgaggctgta

SEQ ID NO: 1023727 - DNA, 10 bp, Homo sapiens
gcctgaggga

SEQ ID NO: 1023728 - DNA, 16 bp, Homo sapiens
gcctgagggcccctct

SEQ ID NO: 1023729 - DNA, 21 bp, Homo sapiens
gcctgagggcccctctgccca

SEQ ID NO: 1023730 - DNA, 14 bp, Homo sapiens
gcctgagggtggag

SEQ ID NO: 1023731 - DNA, 17 bp, Homo sapiens
gcctgagggtggagact

SEQ ID NO: 1023732 - DNA, 17 bp, Homo sapiens
gcctgagtcagtgctct

SEQ ID NO: 1023733 - DNA, 22 bp, Homo sapiens
gcctgagtcagtgctctcagct

SEQ ID NO: 1023734 - DNA, 23 bp, Homo sapiens
gcctgagtcagtgctctcagctg

SEQ ID NO: 1023735 - DNA, 13 bp, Homo sapiens
gcctgagtctcct

SEQ ID NO: 1023736 - DNA, 16 bp, Homo sapiens
gcctgagtgagtgtgt

SEQ ID NO: 1023737 - DNA, 15 bp, Homo sapiens
gcctgataagcttca

SEQ ID NO: 1023738 - DNA, 16 bp, Homo sapiens
gcctgatcagaccacg

SEQ ID NO: 1023739 - DNA, 21 bp, Homo sapiens
gcctgatccctgaacccctgg

SEQ ID NO: 1023740 - DNA, 16 bp, Homo sapiens
gcctgatcctccaaca

SEQ ID NO: 1023741 - DNA, 13 bp, Homo sapiens
tcctcctggaagg

SEQ ID NO: 1023742 - DNA, 12 bp, Homo sapiens
tcctcctgggag

SEQ ID NO: 1023743 - DNA, 13 bp, Homo sapiens
tcctcctgggagc

SEQ ID NO: 1023744 - DNA, 15 bp, Homo sapiens
tcctcctgggccctc

SEQ ID NO: 1023745 - DNA, 20 bp, Homo sapiens
tcctcctgggccctctctgc

SEQ ID NO: 1023746 - DNA, 12 bp, Homo sapiens
tcctcctggggg

SEQ ID NO: 1023747 - DNA, 20 bp, Homo sapiens
tcctcctgggggctggctcc

SEQ ID NO: 1023748 - DNA, 15 bp, Homo sapiens
tcctccttcactgtt

SEQ ID NO: 1023749 - DNA, 15 bp, Homo sapiens
tcctccttcccaggg

SEQ ID NO: 1023750 - DNA, 20 bp, Homo sapiens
tcctccttccccccatctct

SEQ ID NO: 1023751 - DNA, 18 bp, Homo sapiens
tcctccttcctgggaccc

SEQ ID NO: 1023752 - DNA, 23 bp, Homo sapiens
tcctccttgcccagactacaggg

SEQ ID NO: 1023753 - DNA, 17 bp, Homo sapiens
tcctcctttcagttcgt

SEQ ID NO: 1023754 - DNA, 14 bp, Homo sapiens
tcctccttttcact

SEQ ID NO: 1023755 - DNA, 16 bp, Homo sapiens
tcctccttttcacttt

SEQ ID NO: 1023756 - DNA, 11 bp, Homo sapiens
tcctccttttt

SEQ ID NO: 1023757 - DNA, 14 bp, Homo sapiens
tcctcctttttcca

SEQ ID NO: 1023758 - DNA, 21 bp, Homo sapiens
tcctcgaattttatctgtgga

SEQ ID NO: 1023759 - DNA, 15 bp, Homo sapiens
tcctcgagccctccc

SEQ ID NO: 1023760 - DNA, 17 bp, Homo sapiens
tcctcgagccctccccc

SEQ ID NO: 1023761 - DNA, 18 bp, Homo sapiens
tcctcgcacacactggct

SEQ ID NO: 1023762 - DNA, 20 bp, Homo sapiens
tcctcgcccccaccagtgta

SEQ ID NO: 1023763 - DNA, 17 bp, Homo sapiens
tcctcgctcctccttcc

SEQ ID NO: 1023764 - DNA, 19 bp, Homo sapiens
tcctcgctcctccttccca

SEQ ID NO: 1023765 - DNA, 20 bp, Homo sapiens
tcctcgctcctccttcccag

SEQ ID NO: 1023766 - DNA, 16 bp, Homo sapiens
tcctcggagagcagca

SEQ ID NO: 1023767 - DNA, 17 bp, Homo sapiens
tcctcggagagcagcag

SEQ ID NO: 1023768 - DNA, 13 bp, Homo sapiens
tcctcgggaaaca

SEQ ID NO: 1023769 - DNA, 17 bp, Homo sapiens
tcctcggtactcccata

SEQ ID NO: 1023770 - DNA, 22 bp, Homo sapiens
tcctcggtctcccttccgtcca

SEQ ID NO: 1023771 - DNA, 17 bp, Homo sapiens
tcctcgttcctttctcc

SEQ ID NO: 1023772 - DNA, 15 bp, Homo sapiens
tcctcgttgggccgc

SEQ ID NO: 1023773 - DNA, 19 bp, Homo sapiens
tcctctaactcactgccta

SEQ ID NO: 1023774 - DNA, 21 bp, Homo sapiens
tcctctaagccactcttccaa

SEQ ID NO: 1023775 - DNA, 18 bp, Homo sapiens
tcctctactcttacagag

SEQ ID NO: 1023776 - DNA, 14 bp, Homo sapiens
tcctctagaagcca

SEQ ID NO: 1023777 - DNA, 19 bp, Homo sapiens
tcctctagaagccaaggga

SEQ ID NO: 1023778 - DNA, 13 bp, Homo sapiens
tcctctagccatc

SEQ ID NO: 1023779 - DNA, 18 bp, Homo sapiens
tcctctaggggcagcctc

SEQ ID NO: 1023780 - DNA, 21 bp, Homo sapiens
tcctctagtaagatgcactga

SEQ ID NO: 1023781 - DNA, 19 bp, Homo sapiens
tcctctattgatgtacagt

SEQ ID NO: 1023782 - DNA, 17 bp, Homo sapiens
tcctctatttaagatat

SEQ ID NO: 1023783 - DNA, 18 bp, Homo sapiens
tcctctcactaaacttta

SEQ ID NO: 1023784 - DNA, 13 bp, Homo sapiens
tcctctcactccc

SEQ ID NO: 1023785 - DNA, 22 bp, Homo sapiens
tcctctcactccccagcctggg

SEQ ID NO: 1023786 - DNA, 13 bp, Homo sapiens
tcctctcagagtg

SEQ ID NO: 1023787 - DNA, 14 bp, Homo sapiens
tcctctcagtgttt

SEQ ID NO: 1023788 - DNA, 15 bp, Homo sapiens
tcctctcattgtctt

SEQ ID NO: 1023789 - DNA, 20 bp, Homo sapiens
tcctctcattgtcttgttat

SEQ ID NO: 1023790 - DNA, 14 bp, Homo sapiens
tcctctccaccctc

SEQ ID NO: 1023791 - DNA, 16 bp, Homo sapiens
tcctctccaccctcct

SEQ ID NO: 1023792 - DNA, 20 bp, Homo sapiens
tcctctccaccctcctctag

SEQ ID NO: 1023793 - DNA, 12 bp, Homo sapiens
tcctctccactg

SEQ ID NO: 1023794 - DNA, 13 bp, Homo sapiens
tcctctccactgc

SEQ ID NO: 1023795 - DNA, 14 bp, Homo sapiens
tcctctccactgcc

SEQ ID NO: 1023796 - DNA, 18 bp, Homo sapiens
tcctctccactgctggac

SEQ ID NO: 1023797 - DNA, 22 bp, Homo sapiens
tcctctccactgctggacatga

SEQ ID NO: 1023798 - DNA, 11 bp, Homo sapiens
tcctctccaga

SEQ ID NO: 1023799 - DNA, 23 bp, Homo sapiens
tcctctccattttagcccagtgt

SEQ ID NO: 1023800 - DNA, 13 bp, Homo sapiens
tcctctcccatcc

SEQ ID NO: 1023801 - DNA, 14 bp, Homo sapiens
tcctctcccatccc

SEQ ID NO: 1023802 - DNA, 16 bp, Homo sapiens
tcctctcccatccccc

SEQ ID NO: 1023803 - DNA, 22 bp, Homo sapiens
tcctctcccatccccctgccct

SEQ ID NO: 1023804 - DNA, 17 bp, Homo sapiens
tcctctcccatccttga

SEQ ID NO: 1023805 - DNA, 23 bp, Homo sapiens
tcctctcccattgtccctctgcc

SEQ ID NO: 1023806 - DNA, 23 bp, Homo sapiens
tcctctcccccaaccccctgcaa

SEQ ID NO: 1023807 - DNA, 19 bp, Homo sapiens
tcctctccccctcctccag

SEQ ID NO: 1023808 - DNA, 22 bp, Homo sapiens
tcctctccccctcctccaggga

SEQ ID NO: 1023809 - DNA, 13 bp, Homo sapiens
tcctctccccctt

SEQ ID NO: 1023810 - DNA, 13 bp, Homo sapiens
tcctctccctcag

SEQ ID NO: 1023811 - DNA, 14 bp, Homo sapiens
tcctctccctcagg

SEQ ID NO: 1023812 - DNA, 15 bp, Homo sapiens
tcctctccctcaggg

SEQ ID NO: 1023813 - DNA, 12 bp, Homo sapiens
tcctctccctgt

SEQ ID NO: 1023814 - DNA, 15 bp, Homo sapiens
tcctctccttcccac

SEQ ID NO: 1023815 - DNA, 22 bp, Homo sapiens
tcctctccttgggctcctggct

SEQ ID NO: 1023816 - DNA, 23 bp, Homo sapiens
tcctctccttgggctcctggctg

SEQ ID NO: 1023817 - DNA, 17 bp, Homo sapiens
tcctctcgagcccagat

SEQ ID NO: 1023818 - DNA, 20 bp, Homo sapiens
tcctctctagggcagaagac

SEQ ID NO: 1023819 - DNA, 19 bp, Homo sapiens
tcctctctccagatgtttc

SEQ ID NO: 1023820 - DNA, 21 bp, Homo sapiens
tcctctctcccaccctaaggg

SEQ ID NO: 1023821 - DNA, 12 bp, Homo sapiens
tcctctctctca

SEQ ID NO: 1023822 - DNA, 16 bp, Homo sapiens
tcctctctctcttcta

SEQ ID NO: 1023823 - DNA, 11 bp, Homo sapiens
tcctctctctg

SEQ ID NO: 1023824 - DNA, 13 bp, Homo sapiens
tcctctctctgtg

SEQ ID NO: 1023825 - DNA, 11 bp, Homo sapiens
tcctctctgct

SEQ ID NO: 1023826 - DNA, 13 bp, Homo sapiens
tcctctctgcttc

SEQ ID NO: 1023827 - DNA, 14 bp, Homo sapiens
tcctctctgcttca

SEQ ID NO: 1023828 - DNA, 12 bp, Homo sapiens
tcctctctgggc

SEQ ID NO: 1023829 - DNA, 12 bp, Homo sapiens
tcctctctgtct

SEQ ID NO: 1023830 - DNA, 18 bp, Homo sapiens
tcctctgaccctccttct

SEQ ID NO: 1023831 - DNA, 16 bp, Homo sapiens
tcctctgactcagggc

SEQ ID NO: 1023832 - DNA, 18 bp, Homo sapiens
tcctctgactcagggctc

SEQ ID NO: 1023833 - DNA, 12 bp, Homo sapiens
tcctctgagcct

SEQ ID NO: 1023834 - DNA, 21 bp, Homo sapiens
tcctctgaggatgatgtactt

SEQ ID NO: 1023835 - DNA, 21 bp, Homo sapiens
tcctctgatagctgtttcaaa

SEQ ID NO: 1023836 - DNA, 13 bp, Homo sapiens
tcctctgatctcc

SEQ ID NO: 1023837 - DNA, 14 bp, Homo sapiens
tcctctgcagcact

SEQ ID NO: 1023838 - DNA, 16 bp, Homo sapiens
tcctctgcagctgacc

SEQ ID NO: 1023839 - DNA, 20 bp, Homo sapiens
tcctctgcagctgacctctg

SEQ ID NO: 1023840 - DNA, 15 bp, Homo sapiens
tcctctgcagtgcct

SEQ ID NO: 1023841 - DNA, 18 bp, Homo sapiens
tcctctgcagtgccttgg

SEQ ID NO: 1023842 - DNA, 12 bp, Homo sapiens
tcctctgcagtt

SEQ ID NO: 1023843 - DNA, 16 bp, Homo sapiens
tcctctgcagttttga

SEQ ID NO: 1023844 - DNA, 12 bp, Homo sapiens
tcctctgccacc

SEQ ID NO: 1023845 - DNA, 18 bp, Homo sapiens
tcctctgccacctcccct

SEQ ID NO: 1023846 - DNA, 23 bp, Homo sapiens
tcctctgccacctcccctatcca

SEQ ID NO: 1023847 - DNA, 12 bp, Homo sapiens
tcctctgccttg

SEQ ID NO: 1023848 - DNA, 14 bp, Homo sapiens
tcctctgccttgga

SEQ ID NO: 1023849 - DNA, 15 bp, Homo sapiens
tcctctgccttggac

SEQ ID NO: 1023850 - DNA, 20 bp, Homo sapiens
tcctctgctatgcattttct

SEQ ID NO: 1023851 - DNA, 17 bp, Homo sapiens
tcctctgctccagcaac

SEQ ID NO: 1023852 - DNA, 21 bp, Homo sapiens
tcctctgctgacctgctgacc

SEQ ID NO: 1023853 - DNA, 17 bp, Homo sapiens
tcctctggacggcaggc

SEQ ID NO: 1023854 - DNA, 20 bp, Homo sapiens
tcctctggacggcaggctca

SEQ ID NO: 1023855 - DNA, 22 bp, Homo sapiens
tcctctggacggcaggctcact

SEQ ID NO: 1023856 - DNA, 16 bp, Homo sapiens
tcctctggccgcagag

SEQ ID NO: 1023857 - DNA, 17 bp, Homo sapiens
tcctctggccgcagagg

SEQ ID NO: 1023858 - DNA, 18 bp, Homo sapiens
tcctctggccgcagaggt

SEQ ID NO: 1023859 - DNA, 17 bp, Homo sapiens
tcctctggctttcccag

SEQ ID NO: 1023860 - DNA, 18 bp, Homo sapiens
tcctctggctttcccagg

SEQ ID NO: 1023861 - DNA, 19 bp, Homo sapiens
tcctctggctttcccagga

SEQ ID NO: 1023862 - DNA, 12 bp, Homo sapiens
tcctctgggcag

SEQ ID NO: 1023863 - DNA, 20 bp, Homo sapiens
tcctctgggcaggacctcag

SEQ ID NO: 1023864 - DNA, 12 bp, Homo sapiens
tcctctgggcct

SEQ ID NO: 1023865 - DNA, 13 bp, Homo sapiens
tcctctgggcctg

SEQ ID NO: 1023866 - DNA, 14 bp, Homo sapiens
tcctctgggcctgg

SEQ ID NO: 1023867 - DNA, 16 bp, Homo sapiens
gcctgatctcttcctg

SEQ ID NO: 1023868 - DNA, 17 bp, Homo sapiens
gcctgatctcttcctgt

SEQ ID NO: 1023869 - DNA, 20 bp, Homo sapiens
gcctgatggtgctgctcagg

SEQ ID NO: 1023870 - DNA, 17 bp, Homo sapiens
gcctgcaaaccttcctg

SEQ ID NO: 1023871 - DNA, 17 bp, Homo sapiens
gcctgcaaatctagtgc

SEQ ID NO: 1023872 - DNA, 18 bp, Homo sapiens
gcctgcaatctgagccag

SEQ ID NO: 1023873 - DNA, 16 bp, Homo sapiens
gcctgcacaataaaaa

SEQ ID NO: 1023874 - DNA, 23 bp, Homo sapiens
gcctgcaccgaccccgggccgga

SEQ ID NO: 1023875 - DNA, 16 bp, Homo sapiens
gcctgcactccctggc

SEQ ID NO: 1023876 - DNA, 22 bp, Homo sapiens
gcctgcactccctggccttgcc

SEQ ID NO: 1023877 - DNA, 19 bp, Homo sapiens
gcctgcagaagtaagcctc

SEQ ID NO: 1023878 - DNA, 21 bp, Homo sapiens
gcctgcagaagtaagcctcat

SEQ ID NO: 1023879 - DNA, 12 bp, Homo sapiens
gcctgcagagag

SEQ ID NO: 1023880 - DNA, 13 bp, Homo sapiens
gcctgcagcagga

SEQ ID NO: 1023881 - DNA, 14 bp, Homo sapiens
gcctgcaggagaga

SEQ ID NO: 1023882 - DNA, 20 bp, Homo sapiens
gcctgcaggagagagcagca

SEQ ID NO: 1023883 - DNA, 19 bp, Homo sapiens
gcctgcaggcagagctgga

SEQ ID NO: 1023884 - DNA, 21 bp, Homo sapiens
gcctgcaggcagagctggagc

SEQ ID NO: 1023885 - DNA, 19 bp, Homo sapiens
gcctgcaggctggagactg

SEQ ID NO: 1023886 - DNA, 20 bp, Homo sapiens
gcctgcagggtggtgctggg

SEQ ID NO: 1023887 - DNA, 21 bp, Homo sapiens
gcctgcagggtggtgctggga

SEQ ID NO: 1023888 - DNA, 22 bp, Homo sapiens
gcctgcagggtggtgctgggac

SEQ ID NO: 1023889 - DNA, 20 bp, Homo sapiens
gcctgcagtttcttgtgtag

SEQ ID NO: 1023890 - DNA, 13 bp, Homo sapiens
gcctgccaaagta

SEQ ID NO: 1023891 - DNA, 14 bp, Homo sapiens
gcctgccactctct

SEQ ID NO: 1023892 - DNA, 15 bp, Homo sapiens
gcctgccactctctg

SEQ ID NO: 1023893 - DNA, 12 bp, Homo sapiens
gcctgccatctt

SEQ ID NO: 1023894 - DNA, 16 bp, Homo sapiens
gcctgccatcttctcc

SEQ ID NO: 1023895 - DNA, 20 bp, Homo sapiens
gcctgccatgtacctcccct

SEQ ID NO: 1023896 - DNA, 14 bp, Homo sapiens
gcctgcccacccgt

SEQ ID NO: 1023897 - DNA, 14 bp, Homo sapiens
gcctgcccagacaa

SEQ ID NO: 1023898 - DNA, 15 bp, Homo sapiens
gcctgcccagacaag

SEQ ID NO: 1023899 - DNA, 21 bp, Homo sapiens
gcctgcccagactgatgagca

SEQ ID NO: 1023900 - DNA, 20 bp, Homo sapiens
gcctgcccagcctcaatgtc

SEQ ID NO: 1023901 - DNA, 19 bp, Homo sapiens
gcctgcccagttgcactca

SEQ ID NO: 1023902 - DNA, 21 bp, Homo sapiens
gcctgccccccagtctcccca

SEQ ID NO: 1023903 - DNA, 21 bp, Homo sapiens
gcctgccccctatcttgtcct

SEQ ID NO: 1023904 - DNA, 22 bp, Homo sapiens
gcctgccccctatcttgtcctg

SEQ ID NO: 1023905 - DNA, 15 bp, Homo sapiens
gcctgccccctgggc

SEQ ID NO: 1023906 - DNA, 14 bp, Homo sapiens
gcctgcccctctcc

SEQ ID NO: 1023907 - DNA, 14 bp, Homo sapiens
gcctgccctcactc

SEQ ID NO: 1023908 - DNA, 22 bp, Homo sapiens
gcctgccctcactccctctgca

SEQ ID NO: 1023909 - DNA, 14 bp, Homo sapiens
gcctgccctcaggg

SEQ ID NO: 1023910 - DNA, 20 bp, Homo sapiens
gcctgccctcatggcccctc

SEQ ID NO: 1023911 - DNA, 13 bp, Homo sapiens
gcctgccctccca

SEQ ID NO: 1023912 - DNA, 15 bp, Homo sapiens
gcctgccctccccag

SEQ ID NO: 1023913 - DNA, 22 bp, Homo sapiens
gcctgccctccccagagcactg

SEQ ID NO: 1023914 - DNA, 16 bp, Homo sapiens
gcctgccctgcccaag

SEQ ID NO: 1023915 - DNA, 23 bp, Homo sapiens
gcctgccctgcccaagtgaccag

SEQ ID NO: 1023916 - DNA, 13 bp, Homo sapiens
gcctgccctggag

SEQ ID NO: 1023917 - DNA, 12 bp, Homo sapiens
gcctgccgtgca

SEQ ID NO: 1023918 - DNA, 14 bp, Homo sapiens
gcctgccgtgcatg

SEQ ID NO: 1023919 - DNA, 11 bp, Homo sapiens
gcctgcctcac

SEQ ID NO: 1023920 - DNA, 18 bp, Homo sapiens
gcctgcctcccaaggtcc

SEQ ID NO: 1023921 - DNA, 13 bp, Homo sapiens
gcctgcctcccac

SEQ ID NO: 1023922 - DNA, 14 bp, Homo sapiens
gcctgcctcctagg

SEQ ID NO: 1023923 - DNA, 22 bp, Homo sapiens
gcctgcctcctaggctggaagc

SEQ ID NO: 1023924 - DNA, 15 bp, Homo sapiens
gcctgcctcctccct

SEQ ID NO: 1023925 - DNA, 16 bp, Homo sapiens
gcctgcctcttctcta

SEQ ID NO: 1023926 - DNA, 20 bp, Homo sapiens
gcctgcctcttggcctcacg

SEQ ID NO: 1023927 - DNA, 13 bp, Homo sapiens
gcctgcctgcatg

SEQ ID NO: 1023928 - DNA, 13 bp, Homo sapiens
gcctgcctgtctg

SEQ ID NO: 1023929 - DNA, 14 bp, Homo sapiens
gcctgcctgtctgt

SEQ ID NO: 1023930 - DNA, 16 bp, Homo sapiens
gcctgcctgtctgtct

SEQ ID NO: 1023931 - DNA, 23 bp, Homo sapiens
gcctgccttgaagccactgaagc

SEQ ID NO: 1023932 - DNA, 13 bp, Homo sapiens
gcctgcgtcttcc

SEQ ID NO: 1023933 - DNA, 14 bp, Homo sapiens
gcctgcgtcttccg

SEQ ID NO: 1023934 - DNA, 23 bp, Homo sapiens
gcctgcgtcttccgcccctgcct

SEQ ID NO: 1023935 - DNA, 20 bp, Homo sapiens
gcctgcgttggtccagagcg

SEQ ID NO: 1023936 - DNA, 17 bp, Homo sapiens
gcctgctagagcaaccc

SEQ ID NO: 1023937 - DNA, 23 bp, Homo sapiens
gcctgctagagcaacccctgtac

SEQ ID NO: 1023938 - DNA, 16 bp, Homo sapiens
gcctgctcagcagcca

SEQ ID NO: 1023939 - DNA, 21 bp, Homo sapiens
gcctgctcagcagccagtctc

SEQ ID NO: 1023940 - DNA, 13 bp, Homo sapiens
gcctgctcaggtg

SEQ ID NO: 1023941 - DNA, 14 bp, Homo sapiens
gcctgctcaggtgc

SEQ ID NO: 1023942 - DNA, 16 bp, Homo sapiens
gcctgctccagctgtt

SEQ ID NO: 1023943 - DNA, 17 bp, Homo sapiens
gcctgctcccagcagcc

SEQ ID NO: 1023944 - DNA, 11 bp, Homo sapiens
gcctgctcccc

SEQ ID NO: 1023945 - DNA, 15 bp, Homo sapiens
gcctgctcccccacc

SEQ ID NO: 1023946 - DNA, 17 bp, Homo sapiens
gcctgctcccccacccc

SEQ ID NO: 1023947 - DNA, 19 bp, Homo sapiens
gcctgctcccccaccccct

SEQ ID NO: 1023948 - DNA, 20 bp, Homo sapiens
gcctgctccttggcaccccc

SEQ ID NO: 1023949 - DNA, 23 bp, Homo sapiens
gcctgctgaatgatttccaaaga

SEQ ID NO: 1023950 - DNA, 13 bp, Homo sapiens
gcctgctgagagc

SEQ ID NO: 1023951 - DNA, 15 bp, Homo sapiens
gcctgctgagagccc

SEQ ID NO: 1023952 - DNA, 17 bp, Homo sapiens
gcctgctgagagccccc

SEQ ID NO: 1023953 - DNA, 18 bp, Homo sapiens
gcctgctgagatgaggag

SEQ ID NO: 1023954 - DNA, 14 bp, Homo sapiens
gcctgctgaggcct

SEQ ID NO: 1023955 - DNA, 18 bp, Homo sapiens
gcctgctgcatggggtgg

SEQ ID NO: 1023956 - DNA, 18 bp, Homo sapiens
gcctgctgccagtgcagc

SEQ ID NO: 1023957 - DNA, 18 bp, Homo sapiens
gcctgctgcccaggctgt

SEQ ID NO: 1023958 - DNA, 17 bp, Homo sapiens
gcctgctgcgtcagacc

SEQ ID NO: 1023959 - DNA, 19 bp, Homo sapiens
gcctgctgcgtcagaccag

SEQ ID NO: 1023960 - DNA, 13 bp, Homo sapiens
gcctgctggaggc

SEQ ID NO: 1023961 - DNA, 19 bp, Homo sapiens
gcctgctggaggcctcagg

SEQ ID NO: 1023962 - DNA, 13 bp, Homo sapiens
gcctgctggcacc

SEQ ID NO: 1023963 - DNA, 19 bp, Homo sapiens
gcctgctggcacccaccgt

SEQ ID NO: 1023964 - DNA, 22 bp, Homo sapiens
gcctgctggcacccaccgtgga

SEQ ID NO: 1023965 - DNA, 12 bp, Homo sapiens
gcctgctggcag

SEQ ID NO: 1023966 - DNA, 15 bp, Homo sapiens
gcctgctggcagggc

SEQ ID NO: 1023967 - DNA, 19 bp, Homo sapiens
gcctgctggcagggccagg

SEQ ID NO: 1023968 - DNA, 16 bp, Homo sapiens
gcctgctggcatcagg

SEQ ID NO: 1023969 - DNA, 20 bp, Homo sapiens
gcctgctggccgacccactg

SEQ ID NO: 1023970 - DNA, 20 bp, Homo sapiens
gcctgctgggaaccccgcag

SEQ ID NO: 1023971 - DNA, 21 bp, Homo sapiens
gcctgctgggaaccccgcagc

SEQ ID NO: 1023972 - DNA, 22 bp, Homo sapiens
gcctgctgggaaccccgcagcc

SEQ ID NO: 1023973 - DNA, 23 bp, Homo sapiens
gcctgctgggaaccccgcagccc

SEQ ID NO: 1023974 - DNA, 13 bp, Homo sapiens
gcctgctgggctc

SEQ ID NO: 1023975 - DNA, 16 bp, Homo sapiens
gcctgctgggctctcc

SEQ ID NO: 1023976 - DNA, 24 bp, Homo sapiens
gcctgctgggctctccacctcagc

SEQ ID NO: 1023977 - DNA, 13 bp, Homo sapiens
gcctgctggggct

SEQ ID NO: 1023978 - DNA, 13 bp, Homo sapiens
gcctgctgtgctg

SEQ ID NO: 1023979 - DNA, 20 bp, Homo sapiens
gcctgctgtgtccttcctcc

SEQ ID NO: 1023980 - DNA, 22 bp, Homo sapiens
gcctgctgtgtccttcctccac

SEQ ID NO: 1023981 - DNA, 23 bp, Homo sapiens
gcctgctgtgtccttcctccaca

SEQ ID NO: 1023982 - DNA, 22 bp, Homo sapiens
gcctgctgttggtcctctctct

SEQ ID NO: 1023983 - DNA, 20 bp, Homo sapiens
gcctgcttcttctctccaca

SEQ ID NO: 1023984 - DNA, 22 bp, Homo sapiens
gcctgctttggcctttccttgt

SEQ ID NO: 1023985 - DNA, 17 bp, Homo sapiens
gcctgcttttccaggat

SEQ ID NO: 1023986 - DNA, 17 bp, Homo sapiens
gcctggaaccagggagg

SEQ ID NO: 1023987 - DNA, 14 bp, Homo sapiens
gcctggaataaaat

SEQ ID NO: 1023988 - DNA, 15 bp, Homo sapiens
gcctggacccctgga

SEQ ID NO: 1023989 - DNA, 16 bp, Homo sapiens
gcctggacccctggac

SEQ ID NO: 1023990 - DNA, 14 bp, Homo sapiens
gcctggaccctgtg

SEQ ID NO: 1023991 - DNA, 23 bp, Homo sapiens
gcctggaccgagatgtgagtcct

SEQ ID NO: 1023992 - DNA, 13 bp, Homo sapiens
tcctctggggcct

SEQ ID NO: 1023993 - DNA, 15 bp, Homo sapiens
tcctctggtaaacat

SEQ ID NO: 1023994 - DNA, 20 bp, Homo sapiens
tcctctggttcctttcatct

SEQ ID NO: 1023995 - DNA, 17 bp, Homo sapiens
tcctctgtagtattttt

SEQ ID NO: 1023996 - DNA, 20 bp, Homo sapiens
tcctctgtagtattttttaa

SEQ ID NO: 1023997 - DNA, 19 bp, Homo sapiens
tcctctgtcagtcacagcc

SEQ ID NO: 1023998 - DNA, 23 bp, Homo sapiens
tcctctgtccagggccctgagct

SEQ ID NO: 1023999 - DNA, 17 bp, Homo sapiens
tcctctgttctatccca

SEQ ID NO: 1024000 - DNA, 20 bp, Homo sapiens
tcctcttcaagtactgtttt

SEQ ID NO: 1024001 - DNA, 19 bp, Homo sapiens
tcctcttcagaacttgtca

SEQ ID NO: 1024002 - DNA, 15 bp, Homo sapiens
tcctcttccatgctg

SEQ ID NO: 1024003 - DNA, 16 bp, Homo sapiens
tcctcttccccttgcc

SEQ ID NO: 1024004 - DNA, 19 bp, Homo sapiens
tcctcttccccttgccctt

SEQ ID NO: 1024005 - DNA, 14 bp, Homo sapiens
tcctcttccctctc

SEQ ID NO: 1024006 - DNA, 12 bp, Homo sapiens
tcctcttcctct

SEQ ID NO: 1024007 - DNA, 14 bp, Homo sapiens
tcctcttcctctga

SEQ ID NO: 1024008 - DNA, 17 bp, Homo sapiens
tcctcttctgcatcttg

SEQ ID NO: 1024009 - DNA, 13 bp, Homo sapiens
tcctcttctgggc

SEQ ID NO: 1024010 - DNA, 16 bp, Homo sapiens
tcctcttcttgttgac

SEQ ID NO: 1024011 - DNA, 17 bp, Homo sapiens
tcctcttgaccctgcac

SEQ ID NO: 1024012 - DNA, 14 bp, Homo sapiens
tcctcttgctcaaa

SEQ ID NO: 1024013 - DNA, 18 bp, Homo sapiens
tcctcttgtaaataaagc

SEQ ID NO: 1024014 - DNA, 21 bp, Homo sapiens
tcctcttgtaaataaagccct

SEQ ID NO: 1024015 - DNA, 16 bp, Homo sapiens
tcctcttgtcctggcc

SEQ ID NO: 1024016 - DNA, 16 bp, Homo sapiens
tcctctttactctggg

SEQ ID NO: 1024017 - DNA, 11 bp, Homo sapiens
tcctctttctg

SEQ ID NO: 1024018 - DNA, 14 bp, Homo sapiens
tcctctttctgctc

SEQ ID NO: 1024019 - DNA, 19 bp, Homo sapiens
tcctctttctgctctgcca

SEQ ID NO: 1024020 - DNA, 22 bp, Homo sapiens
tcctctttctgctctgccatct

SEQ ID NO: 1024021 - DNA, 23 bp, Homo sapiens
tcctctttgctttgctttctgct

SEQ ID NO: 1024022 - DNA, 19 bp, Homo sapiens
tcctcttttcctggcagct

SEQ ID NO: 1024023 - DNA, 17 bp, Homo sapiens
tcctgaaacgctccttt

SEQ ID NO: 1024024 - DNA, 21 bp, Homo sapiens
tcctgaaacgctcctttgtgt

SEQ ID NO: 1024025 - DNA, 12 bp, Homo sapiens
tcctgaaattca

SEQ ID NO: 1024026 - DNA, 14 bp, Homo sapiens
tcctgaaattcaga

SEQ ID NO: 1024027 - DNA, 14 bp, Homo sapiens
tcctgaaccatgtg

SEQ ID NO: 1024028 - DNA, 19 bp, Homo sapiens
tcctgaaccgactgaccct

SEQ ID NO: 1024029 - DNA, 16 bp, Homo sapiens
tcctgaaccgcacagc

SEQ ID NO: 1024030 - DNA, 20 bp, Homo sapiens
tcctgaaccgcacagctcag

SEQ ID NO: 1024031 - DNA, 17 bp, Homo sapiens
tcctgaactcctggctt

SEQ ID NO: 1024032 - DNA, 19 bp, Homo sapiens
tcctgaactcttctgcaaa

SEQ ID NO: 1024033 - DNA, 14 bp, Homo sapiens
tcctgaagaattaa

SEQ ID NO: 1024034 - DNA, 19 bp, Homo sapiens
tcctgaagaggcgggccag

SEQ ID NO: 1024035 - DNA, 15 bp, Homo sapiens
tcctgaagcctctgc

SEQ ID NO: 1024036 - DNA, 13 bp, Homo sapiens
tcctgaagctgct

SEQ ID NO: 1024037 - DNA, 17 bp, Homo sapiens
tcctgaagctgctgtgt

SEQ ID NO: 1024038 - DNA, 14 bp, Homo sapiens
tcctgaagggaact

SEQ ID NO: 1024039 - DNA, 15 bp, Homo sapiens
tcctgaagggaacta

SEQ ID NO: 1024040 - DNA, 21 bp, Homo sapiens
tcctgaagggaaggcaaaggc

SEQ ID NO: 1024041 - DNA, 19 bp, Homo sapiens
tcctgaagggggacactcc

SEQ ID NO: 1024042 - DNA, 14 bp, Homo sapiens
tcctgaagtagatg

SEQ ID NO: 1024043 - DNA, 22 bp, Homo sapiens
tcctgaatccaaactaatccat

SEQ ID NO: 1024044 - DNA, 19 bp, Homo sapiens
tcctgaatgaaatatcaga

SEQ ID NO: 1024045 - DNA, 23 bp, Homo sapiens
tcctgaattcagttgctttgccc

SEQ ID NO: 1024046 - DNA, 22 bp, Homo sapiens
tcctgacaaatattttagaagc

SEQ ID NO: 1024047 - DNA, 19 bp, Homo sapiens
tcctgacaagttattactg

SEQ ID NO: 1024048 - DNA, 15 bp, Homo sapiens
tcctgacagaaggtg

SEQ ID NO: 1024049 - DNA, 15 bp, Homo sapiens
tcctgacatattcaa

SEQ ID NO: 1024050 - DNA, 16 bp, Homo sapiens
tcctgacatattcaag

SEQ ID NO: 1024051 - DNA, 15 bp, Homo sapiens
tcctgaccaccctcc

SEQ ID NO: 1024052 - DNA, 16 bp, Homo sapiens
tcctgaccaccctccc

SEQ ID NO: 1024053 - DNA, 12 bp, Homo sapiens
tcctgacccagg

SEQ ID NO: 1024054 - DNA, 18 bp, Homo sapiens
tcctgacccctctcctca

SEQ ID NO: 1024055 - DNA, 15 bp, Homo sapiens
tcctgaccctcccac

SEQ ID NO: 1024056 - DNA, 20 bp, Homo sapiens
tcctgaccctcccactccca

SEQ ID NO: 1024057 - DNA, 16 bp, Homo sapiens
tcctgacctcaggtga

SEQ ID NO: 1024058 - DNA, 15 bp, Homo sapiens
tcctgacctccgcca

SEQ ID NO: 1024059 - DNA, 20 bp, Homo sapiens
tcctgacgaaactggccccg

SEQ ID NO: 1024060 - DNA, 22 bp, Homo sapiens
tcctgacggcgcccccagtgtg

SEQ ID NO: 1024061 - DNA, 18 bp, Homo sapiens
tcctgacgtctgaagctt

SEQ ID NO: 1024062 - DNA, 20 bp, Homo sapiens
tcctgacgtctgaagcttga

SEQ ID NO: 1024063 - DNA, 20 bp, Homo sapiens
tcctgactgaaagtaggggg

SEQ ID NO: 1024064 - DNA, 13 bp, Homo sapiens
tcctgacttttaa

SEQ ID NO: 1024065 - DNA, 21 bp, Homo sapiens
tcctgagaaagcccacctggg

SEQ ID NO: 1024066 - DNA, 16 bp, Homo sapiens
tcctgagaaggcgagg

SEQ ID NO: 1024067 - DNA, 17 bp, Homo sapiens
tcctgagaaggcgagga

SEQ ID NO: 1024068 - DNA, 23 bp, Homo sapiens
tcctgagaataagaaagtttcac

SEQ ID NO: 1024069 - DNA, 18 bp, Homo sapiens
tcctgagagctgcatgtg

SEQ ID NO: 1024070 - DNA, 14 bp, Homo sapiens
tcctgagccccgcc

SEQ ID NO: 1024071 - DNA, 18 bp, Homo sapiens
tcctgagccccgccctct

SEQ ID NO: 1024072 - DNA, 22 bp, Homo sapiens
tcctgagccccgccctcttcct

SEQ ID NO: 1024073 - DNA, 23 bp, Homo sapiens
tcctgagccccgccctcttcctg

SEQ ID NO: 1024074 - DNA, 13 bp, Homo sapiens
tcctgagcctgtg

SEQ ID NO: 1024075 - DNA, 15 bp, Homo sapiens
tcctgagcctgtggg

SEQ ID NO: 1024076 - DNA, 12 bp, Homo sapiens
tcctgagcttgg

SEQ ID NO: 1024077 - DNA, 16 bp, Homo sapiens
tcctgaggacagctgt

SEQ ID NO: 1024078 - DNA, 12 bp, Homo sapiens
tcctgaggccag

SEQ ID NO: 1024079 - DNA, 16 bp, Homo sapiens
tcctgaggccagtggc

SEQ ID NO: 1024080 - DNA, 18 bp, Homo sapiens
tcctgaggccagtggccc

SEQ ID NO: 1024081 - DNA, 17 bp, Homo sapiens
tcctgaggctttggatt

SEQ ID NO: 1024082 - DNA, 21 bp, Homo sapiens
tcctgagggaggacctggggc

SEQ ID NO: 1024083 - DNA, 15 bp, Homo sapiens
tcctgaggggcatct

SEQ ID NO: 1024084 - DNA, 16 bp, Homo sapiens
tcctgagtagctgggc

SEQ ID NO: 1024085 - DNA, 17 bp, Homo sapiens
tcctgagtagctgggcc

SEQ ID NO: 1024086 - DNA, 23 bp, Homo sapiens
tcctgagtagctgggcctgtgca

SEQ ID NO: 1024087 - DNA, 15 bp, Homo sapiens
tcctgagtgccccac

SEQ ID NO: 1024088 - DNA, 18 bp, Homo sapiens
tcctgagtgccccacttc

SEQ ID NO: 1024089 - DNA, 18 bp, Homo sapiens
tccttctccgaggggctg

SEQ ID NO: 1024090 - DNA, 13 bp, Homo sapiens
tccttctctcact

SEQ ID NO: 1024091 - DNA, 13 bp, Homo sapiens
tccttctctgcct

SEQ ID NO: 1024092 - DNA, 14 bp, Homo sapiens
tccttctctgggtc

SEQ ID NO: 1024093 - DNA, 24 bp, Homo sapiens
tccttctgagcccggtaagagcaa

SEQ ID NO: 1024094 - DNA, 14 bp, Homo sapiens
tccttctgagctcc

SEQ ID NO: 1024095 - DNA, 22 bp, Homo sapiens
tccttctgagctccacctctgg

SEQ ID NO: 1024096 - DNA, 20 bp, Homo sapiens
tccttctgcctaacttgtaa

SEQ ID NO: 1024097 - DNA, 12 bp, Homo sapiens
tccttctgcctt

SEQ ID NO: 1024098 - DNA, 19 bp, Homo sapiens
tccttctgctcccacccca

SEQ ID NO: 1024099 - DNA, 17 bp, Homo sapiens
tccttctgttaagaaag

SEQ ID NO: 1024100 - DNA, 18 bp, Homo sapiens
tccttctgttaagaaagg

SEQ ID NO: 1024101 - DNA, 20 bp, Homo sapiens
tccttcttcagcaggaaggg

SEQ ID NO: 1024102 - DNA, 17 bp, Homo sapiens
tccttcttccacttctc

SEQ ID NO: 1024103 - DNA, 16 bp, Homo sapiens
tccttcttgtagtagt

SEQ ID NO: 1024104 - DNA, 13 bp, Homo sapiens
tccttgaactgag

SEQ ID NO: 1024105 - DNA, 18 bp, Homo sapiens
tccttgaagaactgcagg

SEQ ID NO: 1024106 - DNA, 21 bp, Homo sapiens
tccttgaagaactgcaggccc

SEQ ID NO: 1024107 - DNA, 23 bp, Homo sapiens
tccttgaagaactgcaggccctg

SEQ ID NO: 1024108 - DNA, 13 bp, Homo sapiens
tccttgaagaagg

SEQ ID NO: 1024109 - DNA, 16 bp, Homo sapiens
tccttgactgtctagc

SEQ ID NO: 1024110 - DNA, 14 bp, Homo sapiens
tccttgagctgttg

SEQ ID NO: 1024111 - DNA, 14 bp, Homo sapiens
tccttgaggacaga

SEQ ID NO: 1024112 - DNA, 17 bp, Homo sapiens
tccttgataatatattg

SEQ ID NO: 1024113 - DNA, 17 bp, Homo sapiens
tccttgcaaccaggcag

SEQ ID NO: 1024114 - DNA, 16 bp, Homo sapiens
tccttgcagcagggct

SEQ ID NO: 1024115 - DNA, 19 bp, Homo sapiens
tccttgcagcagggctggg

SEQ ID NO: 1024116 - DNA, 22 bp, Homo sapiens
tccttgcagcagggctgggcct

SEQ ID NO: 1024117 - DNA, 15 bp, Homo sapiens
tccttgccccactcc

SEQ ID NO: 1024118 - DNA, 20 bp, Homo sapiens
tccttgccccactcctctcc

SEQ ID NO: 1024119 - DNA, 16 bp, Homo sapiens
tccttgccccccgccc

SEQ ID NO: 1024120 - DNA, 16 bp, Homo sapiens
tccttgcctcctgtgt

SEQ ID NO: 1024121 - DNA, 17 bp, Homo sapiens
tccttgcctcctgtgta

SEQ ID NO: 1024122 - DNA, 13 bp, Homo sapiens
tccttgccttaat

SEQ ID NO: 1024123 - DNA, 21 bp, Homo sapiens
tccttgccttaataaatatgt

SEQ ID NO: 1024124 - DNA, 20 bp, Homo sapiens
tccttgccttgcttctccca

SEQ ID NO: 1024125 - DNA, 13 bp, Homo sapiens
tccttgcgcctca

SEQ ID NO: 1024126 - DNA, 19 bp, Homo sapiens
tccttgcgcctcagccctc

SEQ ID NO: 1024127 - DNA, 13 bp, Homo sapiens
tccttgcttttct

SEQ ID NO: 1024128 - DNA, 12 bp, Homo sapiens
tccttggactcc

SEQ ID NO: 1024129 - DNA, 23 bp, Homo sapiens
tccttggcacccccatgctgcct

SEQ ID NO: 1024130 - DNA, 23 bp, Homo sapiens
tccttggcaggctgatttctagg

SEQ ID NO: 1024131 - DNA, 21 bp, Homo sapiens
tccttggcagtggactcagaa

SEQ ID NO: 1024132 - DNA, 14 bp, Homo sapiens
tccttggccccctt

SEQ ID NO: 1024133 - DNA, 20 bp, Homo sapiens
tccttggctcccattcactc

SEQ ID NO: 1024134 - DNA, 22 bp, Homo sapiens
tccttggctcccgggggcccca

SEQ ID NO: 1024135 - DNA, 22 bp, Homo sapiens
tccttggctgaattaaaatggt

SEQ ID NO: 1024136 - DNA, 17 bp, Homo sapiens
tccttggctgcagccat

SEQ ID NO: 1024137 - DNA, 16 bp, Homo sapiens
gcgaaggggccctggt

SEQ ID NO: 1024138 - DNA, 16 bp, Homo sapiens
gcgaagtagcttgctc

SEQ ID NO: 1024139 - DNA, 20 bp, Homo sapiens
gcgaagtagcttgctccctg

SEQ ID NO: 1024140 - DNA, 19 bp, Homo sapiens
gcgaagtctcatgggaagc

SEQ ID NO: 1024141 - DNA, 19 bp, Homo sapiens
gcgaagtctttgccttctc

SEQ ID NO: 1024142 - DNA, 14 bp, Homo sapiens
gcgaatcatttgtt

SEQ ID NO: 1024143 - DNA, 13 bp, Homo sapiens
gcgaatccaagct

SEQ ID NO: 1024144 - DNA, 15 bp, Homo sapiens
gcgacaagagtgaga

SEQ ID NO: 1024145 - DNA, 13 bp, Homo sapiens
gcgacactcaggg

SEQ ID NO: 1024146 - DNA, 14 bp, Homo sapiens
gcgacactcagggc

SEQ ID NO: 1024147 - DNA, 13 bp, Homo sapiens
gcgaccaccaaag

SEQ ID NO: 1024148 - DNA, 15 bp, Homo sapiens
gcgaccgccccctcc

SEQ ID NO: 1024149 - DNA, 15 bp, Homo sapiens
gcgacctctctgcct

SEQ ID NO: 1024150 - DNA, 23 bp, Homo sapiens
gcgaccttcctcatccaccccat

SEQ ID NO: 1024151 - DNA, 17 bp, Homo sapiens
gcgacgctcccctgaga

SEQ ID NO: 1024152 - DNA, 17 bp, Homo sapiens
gcgacggagagaaaaaa

SEQ ID NO: 1024153 - DNA, 23 bp, Homo sapiens
gcgactaatttcaaaatgctttt

SEQ ID NO: 1024154 - DNA, 19 bp, Homo sapiens
gcgactctgcagagtcact

SEQ ID NO: 1024155 - DNA, 12 bp, Homo sapiens
gcgactgagaac

SEQ ID NO: 1024156 - DNA, 15 bp, Homo sapiens
gcgactggatgctcg

SEQ ID NO: 1024157 - DNA, 19 bp, Homo sapiens
gcgacttccacagcagcag

SEQ ID NO: 1024158 - DNA, 14 bp, Homo sapiens
gcgactttctgcct

SEQ ID NO: 1024159 - DNA, 17 bp, Homo sapiens
gcgactttctgcctgga

SEQ ID NO: 1024160 - DNA, 12 bp, Homo sapiens
gcgacttttgtt

SEQ ID NO: 1024161 - DNA, 20 bp, Homo sapiens
gcgagaacctaagtttcagt

SEQ ID NO: 1024162 - DNA, 15 bp, Homo sapiens
gcgagacccaaggct

SEQ ID NO: 1024163 - DNA, 14 bp, Homo sapiens
gcgagactccgtct

SEQ ID NO: 1024164 - DNA, 18 bp, Homo sapiens
gcgagactccgtctcaaa

SEQ ID NO: 1024165 - DNA, 15 bp, Homo sapiens
gcgagactctgatgg

SEQ ID NO: 1024166 - DNA, 18 bp, Homo sapiens
gcgagcacagtattattt

SEQ ID NO: 1024167 - DNA, 15 bp, Homo sapiens
gcgagcatcccccaa

SEQ ID NO: 1024168 - DNA, 18 bp, Homo sapiens
gcgagcatgtcgtggaca

SEQ ID NO: 1024169 - DNA, 17 bp, Homo sapiens
gcgagcctgtgccttcc

SEQ ID NO: 1024170 - DNA, 21 bp, Homo sapiens
gcgagctatgatcgcgccact

SEQ ID NO: 1024171 - DNA, 23 bp, Homo sapiens
gcgagctctcaaatccctctcca

SEQ ID NO: 1024172 - DNA, 13 bp, Homo sapiens
gcgagctgctctg

SEQ ID NO: 1024173 - DNA, 13 bp, Homo sapiens
gcgagcttggcct

SEQ ID NO: 1024174 - DNA, 18 bp, Homo sapiens
gcgaggccggagagctgg

SEQ ID NO: 1024175 - DNA, 20 bp, Homo sapiens
gcgaggccggagagctggtg

SEQ ID NO: 1024176 - DNA, 13 bp, Homo sapiens
gcgagggcagctg

SEQ ID NO: 1024177 - DNA, 16 bp, Homo sapiens
gcgagggcagctgcta

SEQ ID NO: 1024178 - DNA, 14 bp, Homo sapiens
gcgaggggagggtg

SEQ ID NO: 1024179 - DNA, 19 bp, Homo sapiens
gcgagggggccggggggag

SEQ ID NO: 1024180 - DNA, 16 bp, Homo sapiens
gcgaggtcaacagaga

SEQ ID NO: 1024181 - DNA, 18 bp, Homo sapiens
gcgaggtcaacagagaag

SEQ ID NO: 1024182 - DNA, 23 bp, Homo sapiens
gcgaggtcaacagagaaggcagg

SEQ ID NO: 1024183 - DNA, 16 bp, Homo sapiens
gcgagtccaaggccag

SEQ ID NO: 1024184 - DNA, 20 bp, Homo sapiens
gcgagtgtgtgcatgtgtgt

SEQ ID NO: 1024185 - DNA, 22 bp, Homo sapiens
gcgataaaactaaatatatgtc

SEQ ID NO: 1024186 - DNA, 16 bp, Homo sapiens
gcgatccacctgtctc

SEQ ID NO: 1024187 - DNA, 21 bp, Homo sapiens
gcgatccacctgtctcagcct

SEQ ID NO: 1024188 - DNA, 16 bp, Homo sapiens
gcgatccccgcttccc

SEQ ID NO: 1024189 - DNA, 17 bp, Homo sapiens
gcgatccccgcttcccc

SEQ ID NO: 1024190 - DNA, 18 bp, Homo sapiens
gcgatctctcctggccta

SEQ ID NO: 1024191 - DNA, 16 bp, Homo sapiens
gcgatggcaggcctga

SEQ ID NO: 1024192 - DNA, 18 bp, Homo sapiens
gcgatggggactctgccg

SEQ ID NO: 1024193 - DNA, 23 bp, Homo sapiens
gcgatggggactctgccgctgtg

SEQ ID NO: 1024194 - DNA, 21 bp, Homo sapiens
gcgatggggcaagacagaaaa

SEQ ID NO: 1024195 - DNA, 16 bp, Homo sapiens
gcgattccctctcacc

SEQ ID NO: 1024196 - DNA, 20 bp, Homo sapiens
gcgcaagatagatttggaat

SEQ ID NO: 1024197 - DNA, 13 bp, Homo sapiens
gcgcaaggcactt

SEQ ID NO: 1024198 - DNA, 17 bp, Homo sapiens
gcgcacaaggctgacca

SEQ ID NO: 1024199 - DNA, 18 bp, Homo sapiens
gcgcacctgccccctggt

SEQ ID NO: 1024200 - DNA, 19 bp, Homo sapiens
gcgcacttaccgccctgcg

SEQ ID NO: 1024201 - DNA, 14 bp, Homo sapiens
gcgcagaggtccca

SEQ ID NO: 1024202 - DNA, 17 bp, Homo sapiens
gcgcagatctgtgcctg

SEQ ID NO: 1024203 - DNA, 17 bp, Homo sapiens
gcgcagatgaggggcca

SEQ ID NO: 1024204 - DNA, 14 bp, Homo sapiens
gcgcaggcagcgca

SEQ ID NO: 1024205 - DNA, 21 bp, Homo sapiens
gcgcaggcagcgcagggctgg

SEQ ID NO: 1024206 - DNA, 15 bp, Homo sapiens
gcgcaggcagggaga

SEQ ID NO: 1024207 - DNA, 17 bp, Homo sapiens
gcgcaggctgcagagcc

SEQ ID NO: 1024208 - DNA, 18 bp, Homo sapiens
gcgcaggctgcagagccc

SEQ ID NO: 1024209 - DNA, 20 bp, Homo sapiens
gcgcaggctgcagagcccgg

SEQ ID NO: 1024210 - DNA, 17 bp, Homo sapiens
gcgcagggacatggggc

SEQ ID NO: 1024211 - DNA, 16 bp, Homo sapiens
gcgcttctgcagcctc

SEQ ID NO: 1024212 - DNA, 14 bp, Homo sapiens
gcgcttctgctgga

SEQ ID NO: 1024213 - DNA, 16 bp, Homo sapiens
gcgcttctgctggagg

SEQ ID NO: 1024214 - DNA, 21 bp, Homo sapiens
gcgcttgggcgccgtgctggg

SEQ ID NO: 1024215 - DNA, 23 bp, Homo sapiens
gcgcttgggcgccgtgctgggca

SEQ ID NO: 1024216 - DNA, 16 bp, Homo sapiens
gcggaaacaggtgtgt

SEQ ID NO: 1024217 - DNA, 16 bp, Homo sapiens
gcggacatcagctggt

SEQ ID NO: 1024218 - DNA, 17 bp, Homo sapiens
gcggaccaccctcactg

SEQ ID NO: 1024219 - DNA, 15 bp, Homo sapiens
gcggacgtgctggcc

SEQ ID NO: 1024220 - DNA, 20 bp, Homo sapiens
gcggagagggctagccctga

SEQ ID NO: 1024221 - DNA, 16 bp, Homo sapiens
gcggagagtacagtga

SEQ ID NO: 1024222 - DNA, 20 bp, Homo sapiens
gcggagagtacagtgagcca

SEQ ID NO: 1024223 - DNA, 13 bp, Homo sapiens
gcggagcccagcc

SEQ ID NO: 1024224 - DNA, 23 bp, Homo sapiens
gcggagcgggaggcggtggtaga

SEQ ID NO: 1024225 - DNA, 17 bp, Homo sapiens
gcggaggaggagggagg

SEQ ID NO: 1024226 - DNA, 18 bp, Homo sapiens
gcggaggaggagggaggc

SEQ ID NO: 1024227 - DNA, 14 bp, Homo sapiens
gcggaggcaggagc

SEQ ID NO: 1024228 - DNA, 15 bp, Homo sapiens
gcggaggcaggagca

SEQ ID NO: 1024229 - DNA, 15 bp, Homo sapiens
gcggaggctgtgctc

SEQ ID NO: 1024230 - DNA, 18 bp, Homo sapiens
gcggaggctgtgtgcctg

SEQ ID NO: 1024231 - DNA, 22 bp, Homo sapiens
gcggattgctctggagcagcca

SEQ ID NO: 1024232 - DNA, 14 bp, Homo sapiens
gcggattggggtga

SEQ ID NO: 1024233 - DNA, 19 bp, Homo sapiens
gcggcagctcttctgggca

SEQ ID NO: 1024234 - DNA, 16 bp, Homo sapiens
gcggcaggggcctgga

SEQ ID NO: 1024235 - DNA, 19 bp, Homo sapiens
gcggcaggggcctggagat

SEQ ID NO: 1024236 - DNA, 21 bp, Homo sapiens
gcggccaagataggaccttgg

SEQ ID NO: 1024237 - DNA, 19 bp, Homo sapiens
gcggcccagaagtttccct

SEQ ID NO: 1024238 - DNA, 18 bp, Homo sapiens
gcggccccccgcacagcc

SEQ ID NO: 1024239 - DNA, 22 bp, Homo sapiens
gcggccccctctcggccaggca

SEQ ID NO: 1024240 - DNA, 13 bp, Homo sapiens
gcggcccgggccg

SEQ ID NO: 1024241 - DNA, 17 bp, Homo sapiens
gcggcccgtggacaccc

SEQ ID NO: 1024242 - DNA, 13 bp, Homo sapiens
gcggccctcagta

SEQ ID NO: 1024243 - DNA, 12 bp, Homo sapiens
gcggccctgggg

SEQ ID NO: 1024244 - DNA, 13 bp, Homo sapiens
gcggccctgtcat

SEQ ID NO: 1024245 - DNA, 17 bp, Homo sapiens
gcggcccttcctgcagc

SEQ ID NO: 1024246 - DNA, 20 bp, Homo sapiens
gcggccgccccccgcccctc

SEQ ID NO: 1024247 - DNA, 13 bp, Homo sapiens
gcggccggccagc

SEQ ID NO: 1024248 - DNA, 12 bp, Homo sapiens
gcggcctcacca

SEQ ID NO: 1024249 - DNA, 14 bp, Homo sapiens
gcggcctccccgag

SEQ ID NO: 1024250 - DNA, 21 bp, Homo sapiens
gcggcctccggcgtcttgccc

SEQ ID NO: 1024251 - DNA, 23 bp, Homo sapiens
gcggcctccggcgtcttgcccag

SEQ ID NO: 1024252 - DNA, 16 bp, Homo sapiens
gcggcctgcagtggtg

SEQ ID NO: 1024253 - DNA, 18 bp, Homo sapiens
gcggcctggacccctgga

SEQ ID NO: 1024254 - DNA, 18 bp, Homo sapiens
gcggccttgtctgggtgc

SEQ ID NO: 1024255 - DNA, 17 bp, Homo sapiens
gcggcgatttttgtatg

SEQ ID NO: 1024256 - DNA, 13 bp, Homo sapiens
gcggcgcagaggg

SEQ ID NO: 1024257 - DNA, 18 bp, Homo sapiens
gcggcgcgaccctccccg

SEQ ID NO: 1024258 - DNA, 18 bp, Homo sapiens
gcggcggagctggccccg

SEQ ID NO: 1024259 - DNA, 13 bp, Homo sapiens
gcggctactcagc

SEQ ID NO: 1024260 - DNA, 20 bp, Homo sapiens
gcggctactcagcagccctc

SEQ ID NO: 1024261 - DNA, 19 bp, Homo sapiens
gcggctcaaaaggaaacca

SEQ ID NO: 1024262 - DNA, 17 bp, Homo sapiens
gcggctcagccttgcac

SEQ ID NO: 1024263 - DNA, 18 bp, Homo sapiens
gcggctcccctctgcttc

SEQ ID NO: 1024264 - DNA, 22 bp, Homo sapiens
gcggctcccctctgcttctcat

SEQ ID NO: 1024265 - DNA, 15 bp, Homo sapiens
gcggctcctcgcccc

SEQ ID NO: 1024266 - DNA, 20 bp, Homo sapiens
gcggctcctcgcccccacca

SEQ ID NO: 1024267 - DNA, 16 bp, Homo sapiens
tcgaatgtaattggaa

SEQ ID NO: 1024268 - DNA, 15 bp, Homo sapiens
tcgaattaatagctt

SEQ ID NO: 1024269 - DNA, 16 bp, Homo sapiens
tcgaattaatagcttt

SEQ ID NO: 1024270 - DNA, 23 bp, Homo sapiens
tcgaattttgtctttaaaattca

SEQ ID NO: 1024271 - DNA, 17 bp, Homo sapiens
tcgacaaaggccacagg

SEQ ID NO: 1024272 - DNA, 21 bp, Homo sapiens
tcgacacgtgggctcccctct

SEQ ID NO: 1024273 - DNA, 22 bp, Homo sapiens
tcgacatccgtcattgctgctg

SEQ ID NO: 1024274 - DNA, 21 bp, Homo sapiens
tcgaccacagcaagccatcat

SEQ ID NO: 1024275 - DNA, 14 bp, Homo sapiens
tcgacccagaatgg

SEQ ID NO: 1024276 - DNA, 14 bp, Homo sapiens
tcgaccccaaagcc

SEQ ID NO: 1024277 - DNA, 16 bp, Homo sapiens
tcgaccgactttcccc

SEQ ID NO: 1024278 - DNA, 15 bp, Homo sapiens
tcgactactgctcct

SEQ ID NO: 1024279 - DNA, 19 bp, Homo sapiens
tcgactactgctcctgtgg

SEQ ID NO: 1024280 - DNA, 12 bp, Homo sapiens
tcgactcagcac

SEQ ID NO: 1024281 - DNA, 12 bp, Homo sapiens
tcgactggtcca

SEQ ID NO: 1024282 - DNA, 14 bp, Homo sapiens
tcgactggtccagc

SEQ ID NO: 1024283 - DNA, 15 bp, Homo sapiens
tcgactggtccagct

SEQ ID NO: 1024284 - DNA, 16 bp, Homo sapiens
tcgactgtgacctgtg

SEQ ID NO: 1024285 - DNA, 14 bp, Homo sapiens
tcgacttgcatttt

SEQ ID NO: 1024286 - DNA, 16 bp, Homo sapiens
tcgagacacagtgaag

SEQ ID NO: 1024287 - DNA, 14 bp, Homo sapiens
tcgagacacttgcc

SEQ ID NO: 1024288 - DNA, 15 bp, Homo sapiens
tcgagaccagcctgg

SEQ ID NO: 1024289 - DNA, 17 bp, Homo sapiens
tcgagaccagcctggcc

SEQ ID NO: 1024290 - DNA, 19 bp, Homo sapiens
tcgagaccatcctggctaa

SEQ ID NO: 1024291 - DNA, 19 bp, Homo sapiens
tcgagagctggccaaagag

SEQ ID NO: 1024292 - DNA, 20 bp, Homo sapiens
tcgagattatcgttttctta

SEQ ID NO: 1024293 - DNA, 19 bp, Homo sapiens
tcgagattgcactgctgca

SEQ ID NO: 1024294 - DNA, 17 bp, Homo sapiens
tcgagatttgggagctg

SEQ ID NO: 1024295 - DNA, 14 bp, Homo sapiens
tcgagcactctaat

SEQ ID NO: 1024296 - DNA, 13 bp, Homo sapiens
tcgagcccagatg

SEQ ID NO: 1024297 - DNA, 16 bp, Homo sapiens
tcgagccctcccccaa

SEQ ID NO: 1024298 - DNA, 21 bp, Homo sapiens
tcgaggacaggaaaggcccca

SEQ ID NO: 1024299 - DNA, 14 bp, Homo sapiens
tcgaggagtaacaa

SEQ ID NO: 1024300 - DNA, 20 bp, Homo sapiens
tcgaggagtaacaatacaaa

SEQ ID NO: 1024301 - DNA, 21 bp, Homo sapiens
tcgaggcaccggcgctgcagg

SEQ ID NO: 1024302 - DNA, 18 bp, Homo sapiens
tcgaggcccagcgacctc

SEQ ID NO: 1024303 - DNA, 15 bp, Homo sapiens
tcgaggcctacagag

SEQ ID NO: 1024304 - DNA, 12 bp, Homo sapiens
tcgaggcctgaa

SEQ ID NO: 1024305 - DNA, 20 bp, Homo sapiens
tcgaggcctgaagccagctg

SEQ ID NO: 1024306 - DNA, 16 bp, Homo sapiens
tcgaggctgcagtcag

SEQ ID NO: 1024307 - DNA, 20 bp, Homo sapiens
tcgaggctgcagtcagtcat

SEQ ID NO: 1024308 - DNA, 16 bp, Homo sapiens
tcgaggggctctcagc

SEQ ID NO: 1024309 - DNA, 20 bp, Homo sapiens
tcgaggggctctcagctcag

SEQ ID NO: 1024310 - DNA, 23 bp, Homo sapiens
tcgaggggtcctcacctggttga

SEQ ID NO: 1024311 - DNA, 21 bp, Homo sapiens
tcgaggtagagtttgaaggag

SEQ ID NO: 1024312 - DNA, 23 bp, Homo sapiens
tcgaggtgtcaccctgcagagct

SEQ ID NO: 1024313 - DNA, 15 bp, Homo sapiens
tcgagtctttgtgtg

SEQ ID NO: 1024314 - DNA, 16 bp, Homo sapiens
tcgagtgtagctgtga

SEQ ID NO: 1024315 - DNA, 15 bp, Homo sapiens
tcgagttcccagggt

SEQ ID NO: 1024316 - DNA, 22 bp, Homo sapiens
tcgatactgcgactttctgcct

SEQ ID NO: 1024317 - DNA, 16 bp, Homo sapiens
tcgatcaagagaatca

SEQ ID NO: 1024318 - DNA, 17 bp, Homo sapiens
tcgatcatatttcccct

SEQ ID NO: 1024319 - DNA, 18 bp, Homo sapiens
tcgatcatatttcccctt

SEQ ID NO: 1024320 - DNA, 13 bp, Homo sapiens
tcgatcctggatt

SEQ ID NO: 1024321 - DNA, 20 bp, Homo sapiens
tcgatctcattcagtattaa

SEQ ID NO: 1024322 - DNA, 12 bp, Homo sapiens
tcgatctcctga

SEQ ID NO: 1024323 - DNA, 12 bp, Homo sapiens
tcgatgaatgta

SEQ ID NO: 1024324 - DNA, 16 bp, Homo sapiens
tcgatgcgtattctgt

SEQ ID NO: 1024325 - DNA, 19 bp, Homo sapiens
tcgatgggggatgcttcat

SEQ ID NO: 1024326 - DNA, 12 bp, Homo sapiens
tcgattagactg

SEQ ID NO: 1024327 - DNA, 17 bp, Homo sapiens
tcgcaagagggtctctt

SEQ ID NO: 1024328 - DNA, 17 bp, Homo sapiens
tcgcaatgtaagactcg

SEQ ID NO: 1024329 - DNA, 23 bp, Homo sapiens
tcgcacacagggctcacagggca

SEQ ID NO: 1024330 - DNA, 16 bp, Homo sapiens
tcgcacaggccctagc

SEQ ID NO: 1024331 - DNA, 17 bp, Homo sapiens
tcgcaccattctcctgc

SEQ ID NO: 1024332 - DNA, 17 bp, Homo sapiens
tcgcaccattctgactc

SEQ ID NO: 1024333 - DNA, 22 bp, Homo sapiens
gcggtgctctggcggcttcctg

SEQ ID NO: 1024334 - DNA, 16 bp, Homo sapiens
gcggtgctgtcctcag

SEQ ID NO: 1024335 - DNA, 18 bp, Homo sapiens
gcggtggactgcgctgga

SEQ ID NO: 1024336 - DNA, 15 bp, Homo sapiens
gcggtggaggaaggc

SEQ ID NO: 1024337 - DNA, 21 bp, Homo sapiens
gcggtggaggaaggctctgtc

SEQ ID NO: 1024338 - DNA, 15 bp, Homo sapiens
gcggtggctcacgcc

SEQ ID NO: 1024339 - DNA, 21 bp, Homo sapiens
gcggtggctgccccggcctcc

SEQ ID NO: 1024340 - DNA, 14 bp, Homo sapiens
gcggtgggaaggaa

SEQ ID NO: 1024341 - DNA, 18 bp, Homo sapiens
gcggtgggaaggaaaggc

SEQ ID NO: 1024342 - DNA, 18 bp, Homo sapiens
gcggtgggcacccaccct

SEQ ID NO: 1024343 - DNA, 21 bp, Homo sapiens
gcggtgtcaggtcccagcgag

SEQ ID NO: 1024344 - DNA, 18 bp, Homo sapiens
gcggttataaaaaatggt

SEQ ID NO: 1024345 - DNA, 23 bp, Homo sapiens
gcggttatgaaattcaccccctt

SEQ ID NO: 1024346 - DNA, 19 bp, Homo sapiens
gcggttcctcatctgagag

SEQ ID NO: 1024347 - DNA, 19 bp, Homo sapiens
gcggttcctgtgcagatgc

SEQ ID NO: 1024348 - DNA, 19 bp, Homo sapiens
gcggtttcacgccccacac

SEQ ID NO: 1024349 - DNA, 14 bp, Homo sapiens
gcgtaatttaatgg

SEQ ID NO: 1024350 - DNA, 22 bp, Homo sapiens
gcgtagacttgacaacatccca

SEQ ID NO: 1024351 - DNA, 16 bp, Homo sapiens
gcgtagcagagttaaa

SEQ ID NO: 1024352 - DNA, 19 bp, Homo sapiens
gcgtatatacttaagaata

SEQ ID NO: 1024353 - DNA, 13 bp, Homo sapiens
gcgtatgtctgtt

SEQ ID NO: 1024354 - DNA, 15 bp, Homo sapiens
gcgtattctgtggcc

SEQ ID NO: 1024355 - DNA, 14 bp, Homo sapiens
gcgtcaagacattt

SEQ ID NO: 1024356 - DNA, 19 bp, Homo sapiens
gcgtcactgcccaccaaag

SEQ ID NO: 1024357 - DNA, 12 bp, Homo sapiens
gcgtcaggccta

SEQ ID NO: 1024358 - DNA, 23 bp, Homo sapiens
gcgtcaggggtgcacagtccaca

SEQ ID NO: 1024359 - DNA, 21 bp, Homo sapiens
gcgtcagggttggtgtgctga

SEQ ID NO: 1024360 - DNA, 21 bp, Homo sapiens
gcgtcagtttcactccctctt

SEQ ID NO: 1024361 - DNA, 20 bp, Homo sapiens
gcgtcccctgctactcctgt

SEQ ID NO: 1024362 - DNA, 15 bp, Homo sapiens
gcgtccctccgagct

SEQ ID NO: 1024363 - DNA, 14 bp, Homo sapiens
gcgtccctggcgca

SEQ ID NO: 1024364 - DNA, 16 bp, Homo sapiens
gcgtccgcgcgccagc

SEQ ID NO: 1024365 - DNA, 12 bp, Homo sapiens
gcgtcctgagga

SEQ ID NO: 1024366 - DNA, 13 bp, Homo sapiens
gcgtcctgcagag

SEQ ID NO: 1024367 - DNA, 12 bp, Homo sapiens
gcgtcctgccct

SEQ ID NO: 1024368 - DNA, 17 bp, Homo sapiens
gcgtccttccccctgta

SEQ ID NO: 1024369 - DNA, 15 bp, Homo sapiens
gcgtcgccccagtgg

SEQ ID NO: 1024370 - DNA, 17 bp, Homo sapiens
gcgtcgccccagtggca

SEQ ID NO: 1024371 - DNA, 19 bp, Homo sapiens
gcgtctctgtcgtggacac

SEQ ID NO: 1024372 - DNA, 14 bp, Homo sapiens
gcgtctgactccct

SEQ ID NO: 1024373 - DNA, 14 bp, Homo sapiens
gcgtctgaggcctg

SEQ ID NO: 1024374 - DNA, 15 bp, Homo sapiens
gcgtctgcagggtga

SEQ ID NO: 1024375 - DNA, 20 bp, Homo sapiens
gcgtctgcagggtgacgcct

SEQ ID NO: 1024376 - DNA, 13 bp, Homo sapiens
gcgtctgccccac

SEQ ID NO: 1024377 - DNA, 12 bp, Homo sapiens
gcgtctgcctgg

SEQ ID NO: 1024378 - DNA, 20 bp, Homo sapiens
gcgtcttcatctccctgcca

SEQ ID NO: 1024379 - DNA, 17 bp, Homo sapiens
gcgtcttgcccagcagc

SEQ ID NO: 1024380 - DNA, 23 bp, Homo sapiens
gcgtgaaacacaccaggctgtgg

SEQ ID NO: 1024381 - DNA, 23 bp, Homo sapiens
gcgtgaacccgggaggcggagct

SEQ ID NO: 1024382 - DNA, 14 bp, Homo sapiens
gcgtgactcaccca

SEQ ID NO: 1024383 - DNA, 13 bp, Homo sapiens
gcgtgagctgccc

SEQ ID NO: 1024384 - DNA, 19 bp, Homo sapiens
gcgtgatcaaagccacact

SEQ ID NO: 1024385 - DNA, 18 bp, Homo sapiens
gcgtgatgaagacagaag

SEQ ID NO: 1024386 - DNA, 14 bp, Homo sapiens
gcgtgccctcgctg

SEQ ID NO: 1024387 - DNA, 15 bp, Homo sapiens
gcgtgccgcctgctc

SEQ ID NO: 1024388 - DNA, 19 bp, Homo sapiens
gcgtgccgcctgctcctca

SEQ ID NO: 1024389 - DNA, 23 bp, Homo sapiens
gcgtgcgagcacacacacacata

SEQ ID NO: 1024390 - DNA, 16 bp, Homo sapiens
gcgtgcgcgtgagtgt

SEQ ID NO: 1024391 - DNA, 15 bp, Homo sapiens
gcgtgctcagaccca

SEQ ID NO: 1024392 - DNA, 14 bp, Homo sapiens
gcgtgctgacatca

SEQ ID NO: 1024393 - DNA, 13 bp, Homo sapiens
gcgtggaaggggg

SEQ ID NO: 1024394 - DNA, 19 bp, Homo sapiens
gcgtggaagggggaggagt

SEQ ID NO: 1024395 - DNA, 16 bp, Homo sapiens
tcgccttccctcctgc

SEQ ID NO: 1024396 - DNA, 23 bp, Homo sapiens
tcgcctttcccaggtgctacacc

SEQ ID NO: 1024397 - DNA, 19 bp, Homo sapiens
tcgcctttgtcttgtactt

SEQ ID NO: 1024398 - DNA, 19 bp, Homo sapiens
tcgcgccagcgacctctct

SEQ ID NO: 1024399 - DNA, 23 bp, Homo sapiens
tcgcgccagcgacctctctgcct

SEQ ID NO: 1024400 - DNA, 14 bp, Homo sapiens
tcgcgctcagcatg

SEQ ID NO: 1024401 - DNA, 19 bp, Homo sapiens
tcgcggcggagctggcccc

SEQ ID NO: 1024402 - DNA, 20 bp, Homo sapiens
tcgcgtgccctcgctgcttc

SEQ ID NO: 1024403 - DNA, 23 bp, Homo sapiens
tcgctaaagggaccatctgctgc

SEQ ID NO: 1024404 - DNA, 23 bp, Homo sapiens
tcgctagcatttcccaacacaaa

SEQ ID NO: 1024405 - DNA, 20 bp, Homo sapiens
tcgctatgtgacttgcgctt

SEQ ID NO: 1024406 - DNA, 16 bp, Homo sapiens
tcgctcaccgctggcc

SEQ ID NO: 1024407 - DNA, 23 bp, Homo sapiens
tcgctcaggtgatcaaaataaag

SEQ ID NO: 1024408 - DNA, 21 bp, Homo sapiens
tcgctcccacattctgatgag

SEQ ID NO: 1024409 - DNA, 15 bp, Homo sapiens
tcgctcccctctgga

SEQ ID NO: 1024410 - DNA, 16 bp, Homo sapiens
tcgctcccctctggaa

SEQ ID NO: 1024411 - DNA, 18 bp, Homo sapiens
tcgctcccctctggaatc

SEQ ID NO: 1024412 - DNA, 13 bp, Homo sapiens
tcgctcctcccag

SEQ ID NO: 1024413 - DNA, 16 bp, Homo sapiens
tcgctcctccttccca

SEQ ID NO: 1024414 - DNA, 15 bp, Homo sapiens
tcgctcctgcagccc

SEQ ID NO: 1024415 - DNA, 15 bp, Homo sapiens
tcgctctgctggcct

SEQ ID NO: 1024416 - DNA, 21 bp, Homo sapiens
tcgctctgctggcctggccgg

SEQ ID NO: 1024417 - DNA, 17 bp, Homo sapiens
tcgctgaaattgcttat

SEQ ID NO: 1024418 - DNA, 19 bp, Homo sapiens
tcgctgccagctctgtatc

SEQ ID NO: 1024419 - DNA, 20 bp, Homo sapiens
tcgctgccagctctgtatca

SEQ ID NO: 1024420 - DNA, 16 bp, Homo sapiens
tcgctgtcacaggcgg

SEQ ID NO: 1024421 - DNA, 23 bp, Homo sapiens
tcgctgtgtcagcatagaagtaa

SEQ ID NO: 1024422 - DNA, 21 bp, Homo sapiens
tcgctgtgtgttagttcccaa

SEQ ID NO: 1024423 - DNA, 21 bp, Homo sapiens
tcgcttcttgcctctgtgctg

SEQ ID NO: 1024424 - DNA, 14 bp, Homo sapiens
tcgcttgagcccag

SEQ ID NO: 1024425 - DNA, 18 bp, Homo sapiens
tcggaaaaaaaaaaagaa

SEQ ID NO: 1024426 - DNA, 20 bp, Homo sapiens
tcggaaaaaaaaaaagaaaa

SEQ ID NO: 1024427 - DNA, 13 bp, Homo sapiens
tcggaaaaataat

SEQ ID NO: 1024428 - DNA, 18 bp, Homo sapiens
tcggaaaacatgctacac

SEQ ID NO: 1024429 - DNA, 15 bp, Homo sapiens
tcggaaatcttaaac

SEQ ID NO: 1024430 - DNA, 19 bp, Homo sapiens
tcggaacccaagcttagaa

SEQ ID NO: 1024431 - DNA, 16 bp, Homo sapiens
tcggaaccgctcacct

SEQ ID NO: 1024432 - DNA, 13 bp, Homo sapiens
tcggaagcagtgc

SEQ ID NO: 1024433 - DNA, 15 bp, Homo sapiens
tcggaagcagtgcct

SEQ ID NO: 1024434 - DNA, 16 bp, Homo sapiens
tcggaagcagtgcctt

SEQ ID NO: 1024435 - DNA, 23 bp, Homo sapiens
tcggaagcagtgccttccataat

SEQ ID NO: 1024436 - DNA, 12 bp, Homo sapiens
tcggaagcctgt

SEQ ID NO: 1024437 - DNA, 18 bp, Homo sapiens
tcggaatggtaaccgagc

SEQ ID NO: 1024438 - DNA, 21 bp, Homo sapiens
tcggacaagacccccagcact

SEQ ID NO: 1024439 - DNA, 22 bp, Homo sapiens
tcggacccaccaaactgcacac

SEQ ID NO: 1024440 - DNA, 13 bp, Homo sapiens
tcggacccacccc

SEQ ID NO: 1024441 - DNA, 17 bp, Homo sapiens
tcggacccaccccaact

SEQ ID NO: 1024442 - DNA, 20 bp, Homo sapiens
tcggacccaccccaactctc

SEQ ID NO: 1024443 - DNA, 23 bp, Homo sapiens
tcggacccaccccaactctcccc

SEQ ID NO: 1024444 - DNA, 13 bp, Homo sapiens
tcggacggggcag

SEQ ID NO: 1024445 - DNA, 19 bp, Homo sapiens
tcggacggggcaggcgctg

SEQ ID NO: 1024446 - DNA, 15 bp, Homo sapiens
tcggactctgcccct

SEQ ID NO: 1024447 - DNA, 12 bp, Homo sapiens
tcggactgccaa

SEQ ID NO: 1024448 - DNA, 13 bp, Homo sapiens
tcggactgccaaa

SEQ ID NO: 1024449 - DNA, 17 bp, Homo sapiens
tcggacttgaatgctgc

SEQ ID NO: 1024450 - DNA, 16 bp, Homo sapiens
tcggagaagagcgcag

SEQ ID NO: 1024451 - DNA, 14 bp, Homo sapiens
tcggagacagtgat

SEQ ID NO: 1024452 - DNA, 23 bp, Homo sapiens
tcggagacagtgatctccatatg

SEQ ID NO: 1024453 - DNA, 18 bp, Homo sapiens
tcggagactatggcctcg

SEQ ID NO: 1024454 - DNA, 14 bp, Homo sapiens
tcggagagcagcag

SEQ ID NO: 1024455 - DNA, 17 bp, Homo sapiens
gctaaagcaatatgcat

SEQ ID NO: 1024456 - DNA, 17 bp, Homo sapiens
gctaaagggaccatctg

SEQ ID NO: 1024457 - DNA, 20 bp, Homo sapiens
gctaaagggagaaatgccag

SEQ ID NO: 1024458 - DNA, 18 bp, Homo sapiens
gctaaaggggagaaactg

SEQ ID NO: 1024459 - DNA, 20 bp, Homo sapiens
gctaaaggggagaaactgaa

SEQ ID NO: 1024460 - DNA, 12 bp, Homo sapiens
gctaaatgaagt

SEQ ID NO: 1024461 - DNA, 21 bp, Homo sapiens
gctaaatgtaacttattccaa

SEQ ID NO: 1024462 - DNA, 15 bp, Homo sapiens
gctaaatgtttaaag

SEQ ID NO: 1024463 - DNA, 17 bp, Homo sapiens
gctaaatgtttaaagaa

SEQ ID NO: 1024464 - DNA, 22 bp, Homo sapiens
gctaaattctatgttaaatact

SEQ ID NO: 1024465 - DNA, 21 bp, Homo sapiens
gctaaattttgttactgattc

SEQ ID NO: 1024466 - DNA, 20 bp, Homo sapiens
gctaacacggtgaaaccccg

SEQ ID NO: 1024467 - DNA, 19 bp, Homo sapiens
gctaacacggtgaaacccg

SEQ ID NO: 1024468 - DNA, 15 bp, Homo sapiens
gctaacactggcccc

SEQ ID NO: 1024469 - DNA, 20 bp, Homo sapiens
gctaacatggtgaaaccccg

SEQ ID NO: 1024470 - DNA, 13 bp, Homo sapiens
gctaacattttaa

SEQ ID NO: 1024471 - DNA, 14 bp, Homo sapiens
gctaacattttaaa

SEQ ID NO: 1024472 - DNA, 17 bp, Homo sapiens
gctaacattttaaataa

SEQ ID NO: 1024473 - DNA, 21 bp, Homo sapiens
gctaacattttaaataaaaga

SEQ ID NO: 1024474 - DNA, 22 bp, Homo sapiens
gctaaccccaagctgcctctgg

SEQ ID NO: 1024475 - DNA, 14 bp, Homo sapiens
gctaacctggaaag

SEQ ID NO: 1024476 - DNA, 15 bp, Homo sapiens
gctaactccgagagc

SEQ ID NO: 1024477 - DNA, 12 bp, Homo sapiens
gctaactggaag

SEQ ID NO: 1024478 - DNA, 13 bp, Homo sapiens
gctaactgtaaat

SEQ ID NO: 1024479 - DNA, 14 bp, Homo sapiens
gctaactgtaaatc

SEQ ID NO: 1024480 - DNA, 16 bp, Homo sapiens
gctaactgtaaatcat

SEQ ID NO: 1024481 - DNA, 19 bp, Homo sapiens
gctaagaaagtagaggcat

SEQ ID NO: 1024482 - DNA, 13 bp, Homo sapiens
gctaagcatattt

SEQ ID NO: 1024483 - DNA, 18 bp, Homo sapiens
gctaagcatattttctct

SEQ ID NO: 1024484 - DNA, 14 bp, Homo sapiens
gctaagcctggaag

SEQ ID NO: 1024485 - DNA, 16 bp, Homo sapiens
gctaagcctggaagcc

SEQ ID NO: 1024486 - DNA, 17 bp, Homo sapiens
gctaagcctggaagcca

SEQ ID NO: 1024487 - DNA, 20 bp, Homo sapiens
gctaagctcacgtcctgaga

SEQ ID NO: 1024488 - DNA, 15 bp, Homo sapiens
gctaagctggctctg

SEQ ID NO: 1024489 - DNA, 19 bp, Homo sapiens
gctaagctggctctgtttg

SEQ ID NO: 1024490 - DNA, 20 bp, Homo sapiens
gctaaggacatttcccaggg

SEQ ID NO: 1024491 - DNA, 23 bp, Homo sapiens
gctaaggcccccaaacatagccc

SEQ ID NO: 1024492 - DNA, 19 bp, Homo sapiens
gctaaggctcctccttgcc

SEQ ID NO: 1024493 - DNA, 21 bp, Homo sapiens
gctaaggctgctggcttcagg

SEQ ID NO: 1024494 - DNA, 12 bp, Homo sapiens
gctaaggtccct

SEQ ID NO: 1024495 - DNA, 15 bp, Homo sapiens
gctaaggtccctggg

SEQ ID NO: 1024496 - DNA, 19 bp, Homo sapiens
gctaaggtttccagtcaga

SEQ ID NO: 1024497 - DNA, 21 bp, Homo sapiens
gctaaggtttccagtcagatg

SEQ ID NO: 1024498 - DNA, 20 bp, Homo sapiens
gctaagtacacaataagcaa

SEQ ID NO: 1024499 - DNA, 21 bp, Homo sapiens
gctaagtacacaataagcaaa

SEQ ID NO: 1024500 - DNA, 22 bp, Homo sapiens
gctaagtcacccagagcacagg

SEQ ID NO: 1024501 - DNA, 18 bp, Homo sapiens
gctaagtgaaaaggtcat

SEQ ID NO: 1024502 - DNA, 22 bp, Homo sapiens
gctaataaaattcgctttctaa

SEQ ID NO: 1024503 - DNA, 11 bp, Homo sapiens
gctaataaatc

SEQ ID NO: 1024504 - DNA, 17 bp, Homo sapiens
gctaataaatctcttct

SEQ ID NO: 1024505 - DNA, 21 bp, Homo sapiens
gctaatacctcttactttgct

SEQ ID NO: 1024506 - DNA, 17 bp, Homo sapiens
gctaatcagcattctca

SEQ ID NO: 1024507 - DNA, 21 bp, Homo sapiens
gctaatcatgtgggtgagcca

SEQ ID NO: 1024508 - DNA, 22 bp, Homo sapiens
gctaatcatgtgggtgagccag

SEQ ID NO: 1024509 - DNA, 20 bp, Homo sapiens
gctaatctgcctggttttat

SEQ ID NO: 1024510 - DNA, 20 bp, Homo sapiens
gctaatgctatgcaaaaaat

SEQ ID NO: 1024511 - DNA, 19 bp, Homo sapiens
gctaatgtaggactgtata

SEQ ID NO: 1024512 - DNA, 18 bp, Homo sapiens
gctaattgagaccacagg

SEQ ID NO: 1024513 - DNA, 12 bp, Homo sapiens
gctaatttttat

SEQ ID NO: 1024514 - DNA, 13 bp, Homo sapiens
gctaatttttgta

SEQ ID NO: 1024515 - DNA, 17 bp, Homo sapiens
gctaatttttgtaattt

SEQ ID NO: 1024516 - DNA, 18 bp, Homo sapiens
gctaattttttgtacttt

SEQ ID NO: 1024517 - DNA, 21 bp, Homo sapiens
gctaatttttttgtattttag

SEQ ID NO: 1024518 - DNA, 16 bp, Homo sapiens
gctacaagtgttttag

SEQ ID NO: 1024519 - DNA, 22 bp, Homo sapiens
gctacaattttctcccaggaag

SEQ ID NO: 1024520 - DNA, 13 bp, Homo sapiens
gctacacactgca

SEQ ID NO: 1024521 - DNA, 21 bp, Homo sapiens
gctacagaatagggtggcaga

SEQ ID NO: 1024522 - DNA, 22 bp, Homo sapiens
tcgggatcaaacctttctggcc

SEQ ID NO: 1024523 - DNA, 17 bp, Homo sapiens
tcgggcaccagccagcg

SEQ ID NO: 1024524 - DNA, 17 bp, Homo sapiens
tcgggcagccagcagag

SEQ ID NO: 1024525 - DNA, 14 bp, Homo sapiens
tcgggcccacctgg

SEQ ID NO: 1024526 - DNA, 18 bp, Homo sapiens
tcgggcccacctggccac

SEQ ID NO: 1024527 - DNA, 14 bp, Homo sapiens
tcgggcccagggac

SEQ ID NO: 1024528 - DNA, 20 bp, Homo sapiens
tcgggcgtgggtctctgggg

SEQ ID NO: 1024529 - DNA, 14 bp, Homo sapiens
tcgggctcccgggt

SEQ ID NO: 1024530 - DNA, 16 bp, Homo sapiens
tcggggaactcctgga

SEQ ID NO: 1024531 - DNA, 22 bp, Homo sapiens
tcggggaagctgcacatgtgcc

SEQ ID NO: 1024532 - DNA, 13 bp, Homo sapiens
tcggggagaaata

SEQ ID NO: 1024533 - DNA, 17 bp, Homo sapiens
tcggggcatgctggggc

SEQ ID NO: 1024534 - DNA, 18 bp, Homo sapiens
tcggggcatgctggggca

SEQ ID NO: 1024535 - DNA, 23 bp, Homo sapiens
tcggggcccttggggcctggctt

SEQ ID NO: 1024536 - DNA, 23 bp, Homo sapiens
tcggggccggtgaggggaggggc

SEQ ID NO: 1024537 - DNA, 12 bp, Homo sapiens
tcggggcctgct

SEQ ID NO: 1024538 - DNA, 14 bp, Homo sapiens
tcggggcctgctgg

SEQ ID NO: 1024539 - DNA, 19 bp, Homo sapiens
tcgggggagcagagagagc

SEQ ID NO: 1024540 - DNA, 12 bp, Homo sapiens
tcgggggcctgc

SEQ ID NO: 1024541 - DNA, 14 bp, Homo sapiens
tcgggggcctgcaa

SEQ ID NO: 1024542 - DNA, 16 bp, Homo sapiens
tcgggggcgcctggag

SEQ ID NO: 1024543 - DNA, 15 bp, Homo sapiens
tcgggggctgtggat

SEQ ID NO: 1024544 - DNA, 19 bp, Homo sapiens
tcggggtaaaaagtggctg

SEQ ID NO: 1024545 - DNA, 20 bp, Homo sapiens
tcggggtaaaaagtggctgc

SEQ ID NO: 1024546 - DNA, 16 bp, Homo sapiens
tcggtaggttcagcca

SEQ ID NO: 1024547 - DNA, 20 bp, Homo sapiens
tcggtatccccccatcttgc

SEQ ID NO: 1024548 - DNA, 18 bp, Homo sapiens
tcggtcagcgactggatg

SEQ ID NO: 1024549 - DNA, 20 bp, Homo sapiens
tcggtctcccaaagtgctgg

SEQ ID NO: 1024550 - DNA, 19 bp, Homo sapiens
tcggtctcccttccgtcca

SEQ ID NO: 1024551 - DNA, 17 bp, Homo sapiens
tcggtgaccccatcact

SEQ ID NO: 1024552 - DNA, 13 bp, Homo sapiens
tcggtggccctga

SEQ ID NO: 1024553 - DNA, 17 bp, Homo sapiens
tcggtgggccagagctg

SEQ ID NO: 1024554 - DNA, 15 bp, Homo sapiens
tcggttccacgtccc

SEQ ID NO: 1024555 - DNA, 13 bp, Homo sapiens
tcggttccagaca

SEQ ID NO: 1024556 - DNA, 18 bp, Homo sapiens
tcggttctccagaatgta

SEQ ID NO: 1024557 - DNA, 14 bp, Homo sapiens
tcggttgcagggct

SEQ ID NO: 1024558 - DNA, 15 bp, Homo sapiens
tcggttgcagggctg

SEQ ID NO: 1024559 - DNA, 17 bp, Homo sapiens
tcgtaccgcttccttag

SEQ ID NO: 1024560 - DNA, 14 bp, Homo sapiens
tcgtaccttcccac

SEQ ID NO: 1024561 - DNA, 21 bp, Homo sapiens
tcgtacgcccaggacagctgg

SEQ ID NO: 1024562 - DNA, 21 bp, Homo sapiens
tcgtagcaaattctgtggcag

SEQ ID NO: 1024563 - DNA, 19 bp, Homo sapiens
tcgtccccctccctgccca

SEQ ID NO: 1024564 - DNA, 14 bp, Homo sapiens
tcgtcctccccctg

SEQ ID NO: 1024565 - DNA, 16 bp, Homo sapiens
tcgtcctccccctgcc

SEQ ID NO: 1024566 - DNA, 23 bp, Homo sapiens
tcgtcctccccctgccagtgcct

SEQ ID NO: 1024567 - DNA, 18 bp, Homo sapiens
tcgtcctgatccctccac

SEQ ID NO: 1024568 - DNA, 14 bp, Homo sapiens
tcgtcctgtcccag

SEQ ID NO: 1024569 - DNA, 21 bp, Homo sapiens
tcgtctccctggtgcctctgt

SEQ ID NO: 1024570 - DNA, 19 bp, Homo sapiens
tcgtctcggcccctctgat

SEQ ID NO: 1024571 - DNA, 12 bp, Homo sapiens
tcgtctgtccca

SEQ ID NO: 1024572 - DNA, 10 bp, Homo sapiens
tcgtctttgt

SEQ ID NO: 1024573 - DNA, 18 bp, Homo sapiens
tcgtgaaaccctgtctct

SEQ ID NO: 1024574 - DNA, 17 bp, Homo sapiens
tcgtgaacatagagttt

SEQ ID NO: 1024575 - DNA, 14 bp, Homo sapiens
tcgtgaacatcccc

SEQ ID NO: 1024576 - DNA, 19 bp, Homo sapiens
tcgtgaacatcccctccca

SEQ ID NO: 1024577 - DNA, 15 bp, Homo sapiens
gctacttgggagcct

SEQ ID NO: 1024578 - DNA, 18 bp, Homo sapiens
gctacttgggagcctgag

SEQ ID NO: 1024579 - DNA, 19 bp, Homo sapiens
gctacttgggagcctgagg

SEQ ID NO: 1024580 - DNA, 16 bp, Homo sapiens
gctacttgggaggctg

SEQ ID NO: 1024581 - DNA, 23 bp, Homo sapiens
gctacttttttttagttcaatac

SEQ ID NO: 1024582 - DNA, 18 bp, Homo sapiens
gctagaaaaatgttcttt

SEQ ID NO: 1024583 - DNA, 18 bp, Homo sapiens
gctagaaatatgatttta

SEQ ID NO: 1024584 - DNA, 13 bp, Homo sapiens
gctagaatacttt

SEQ ID NO: 1024585 - DNA, 15 bp, Homo sapiens
gctagacacccattt

SEQ ID NO: 1024586 - DNA, 20 bp, Homo sapiens
gctagacagaaaccaagcca

SEQ ID NO: 1024587 - DNA, 18 bp, Homo sapiens
gctagagaaattcttgtt

SEQ ID NO: 1024588 - DNA, 21 bp, Homo sapiens
gctagagatatggcagcgaaa

SEQ ID NO: 1024589 - DNA, 21 bp, Homo sapiens
gctagagcaacccctgtaccc

SEQ ID NO: 1024590 - DNA, 15 bp, Homo sapiens
gctagagcagacagg

SEQ ID NO: 1024591 - DNA, 16 bp, Homo sapiens
gctagaggcctgagga

SEQ ID NO: 1024592 - DNA, 19 bp, Homo sapiens
gctagaggttgcagcatga

SEQ ID NO: 1024593 - DNA, 13 bp, Homo sapiens
gctagataaaagc

SEQ ID NO: 1024594 - DNA, 15 bp, Homo sapiens
gctagatatgcctta

SEQ ID NO: 1024595 - DNA, 11 bp, Homo sapiens
gctagccctga

SEQ ID NO: 1024596 - DNA, 18 bp, Homo sapiens
gctagccctgagcccggc

SEQ ID NO: 1024597 - DNA, 21 bp, Homo sapiens
gctagccctgagcccggccct

SEQ ID NO: 1024598 - DNA, 22 bp, Homo sapiens
gctagcgctgccgcaccccaga

SEQ ID NO: 1024599 - DNA, 11 bp, Homo sapiens
gctagctgcca

SEQ ID NO: 1024600 - DNA, 14 bp, Homo sapiens
gctagctgccactt

SEQ ID NO: 1024601 - DNA, 15 bp, Homo sapiens
gctagctgccacttt

SEQ ID NO: 1024602 - DNA, 16 bp, Homo sapiens
gctagctgccactttc

SEQ ID NO: 1024603 - DNA, 15 bp, Homo sapiens
gctagcttctgcttt

SEQ ID NO: 1024604 - DNA, 22 bp, Homo sapiens
gctagcttctgcttttctgccc

SEQ ID NO: 1024605 - DNA, 12 bp, Homo sapiens
gctaggaagagg

SEQ ID NO: 1024606 - DNA, 21 bp, Homo sapiens
gctaggaagagtctacccgac

SEQ ID NO: 1024607 - DNA, 18 bp, Homo sapiens
gctaggaatgaaatcctg

SEQ ID NO: 1024608 - DNA, 17 bp, Homo sapiens
gctaggactgaggagtg

SEQ ID NO: 1024609 - DNA, 19 bp, Homo sapiens
gctaggactgaggagtggg

SEQ ID NO: 1024610 - DNA, 20 bp, Homo sapiens
gctaggcataggtctctttg

SEQ ID NO: 1024611 - DNA, 18 bp, Homo sapiens
gctaggcgctggggagac

SEQ ID NO: 1024612 - DNA, 19 bp, Homo sapiens
gctaggctcgccttccctc

SEQ ID NO: 1024613 - DNA, 18 bp, Homo sapiens
gctagggagaatgcagag

SEQ ID NO: 1024614 - DNA, 13 bp, Homo sapiens
gctagggagaggg

SEQ ID NO: 1024615 - DNA, 19 bp, Homo sapiens
gctagggctgctgcttctg

SEQ ID NO: 1024616 - DNA, 14 bp, Homo sapiens
gctagggtggccct

SEQ ID NO: 1024617 - DNA, 15 bp, Homo sapiens
gctagggtggccctt

SEQ ID NO: 1024618 - DNA, 22 bp, Homo sapiens
gctaggtgacatatacatactt

SEQ ID NO: 1024619 - DNA, 17 bp, Homo sapiens
gctaggtgggccagccc

SEQ ID NO: 1024620 - DNA, 18 bp, Homo sapiens
gctaggtgggccagcccc

SEQ ID NO: 1024621 - DNA, 19 bp, Homo sapiens
gctaggtgggccagcccct

SEQ ID NO: 1024622 - DNA, 18 bp, Homo sapiens
gctagtagcaatgtgcct

SEQ ID NO: 1024623 - DNA, 17 bp, Homo sapiens
gctagtatcttcaaact

SEQ ID NO: 1024624 - DNA, 23 bp, Homo sapiens
gctagtcaagctcctcctccctg

SEQ ID NO: 1024625 - DNA, 21 bp, Homo sapiens
gctagtcttcccttacctcaa

SEQ ID NO: 1024626 - DNA, 15 bp, Homo sapiens
gctagtcttttgctt

SEQ ID NO: 1024627 - DNA, 21 bp, Homo sapiens
gctagtgacttgtgtcccatg

SEQ ID NO: 1024628 - DNA, 13 bp, Homo sapiens
gctagtgccaaat

SEQ ID NO: 1024629 - DNA, 18 bp, Homo sapiens
gctagtgccaaataattg

SEQ ID NO: 1024630 - DNA, 14 bp, Homo sapiens
gctagtgccttgcc

SEQ ID NO: 1024631 - DNA, 20 bp, Homo sapiens
gctagtgccttgcccacagg

SEQ ID NO: 1024632 - DNA, 19 bp, Homo sapiens
gctagtgctgtaatattgt

SEQ ID NO: 1024633 - DNA, 17 bp, Homo sapiens
gctagtggctcttctca

SEQ ID NO: 1024634 - DNA, 17 bp, Homo sapiens
gctagtgtacctcctct

SEQ ID NO: 1024635 - DNA, 18 bp, Homo sapiens
gctagtgtgagtggcagc

SEQ ID NO: 1024636 - DNA, 13 bp, Homo sapiens
gctagtgtttcta

SEQ ID NO: 1024637 - DNA, 15 bp, Homo sapiens
gctagttctgctgcc

SEQ ID NO: 1024638 - DNA, 18 bp, Homo sapiens
gctagttctgctgccctc

SEQ ID NO: 1024639 - DNA, 16 bp, Homo sapiens
gctagttttttgcttc

SEQ ID NO: 1024640 - DNA, 16 bp, Homo sapiens
gctataaagtatatat

SEQ ID NO: 1024641 - DNA, 20 bp, Homo sapiens
gctataagtgctcaatagct

SEQ ID NO: 1024642 - DNA, 16 bp, Homo sapiens
gctataagttttagaa

SEQ ID NO: 1024643 - DNA, 22 bp, Homo sapiens
gctatacatgttggaaatgtgt

SEQ ID NO: 1024644 - DNA, 17 bp, Homo sapiens
gctatagcctggggtgg

SEQ ID NO: 1024645 - DNA, 16 bp, Homo sapiens
gctatagctcaggacc

SEQ ID NO: 1024646 - DNA, 16 bp, Homo sapiens
gctataggctggagaa

SEQ ID NO: 1024647 - DNA, 20 bp, Homo sapiens
gctatagtatttgattcaaa

SEQ ID NO: 1024648 - DNA, 23 bp, Homo sapiens
gctatagtgtataccacctgtac

SEQ ID NO: 1024649 - DNA, 23 bp, Homo sapiens
gctatagttactgtcctgttgat

SEQ ID NO: 1024650 - DNA, 19 bp, Homo sapiens
tctaaaatggacattttct

SEQ ID NO: 1024651 - DNA, 20 bp, Homo sapiens
tctaaaatggacattttctt

SEQ ID NO: 1024652 - DNA, 12 bp, Homo sapiens
tctaaaatgtca

SEQ ID NO: 1024653 - DNA, 22 bp, Homo sapiens
tctaaaattgagttcttcctgt

SEQ ID NO: 1024654 - DNA, 23 bp, Homo sapiens
tctaaaattgagttcttcctgta

SEQ ID NO: 1024655 - DNA, 22 bp, Homo sapiens
tctaaaatttcataattctgaa

SEQ ID NO: 1024656 - DNA, 14 bp, Homo sapiens
tctaaacaaaaaat

SEQ ID NO: 1024657 - DNA, 13 bp, Homo sapiens
tctaaacaaataa

SEQ ID NO: 1024658 - DNA, 23 bp, Homo sapiens
tctaaacacaacaataactttta

SEQ ID NO: 1024659 - DNA, 16 bp, Homo sapiens
tctaaacccaatccaa

SEQ ID NO: 1024660 - DNA, 20 bp, Homo sapiens
tctaaacgtggtcaccttcg

SEQ ID NO: 1024661 - DNA, 21 bp, Homo sapiens
tctaaactgagctcgcagccc

SEQ ID NO: 1024662 - DNA, 23 bp, Homo sapiens
tctaaactgagctcgcagccccc

SEQ ID NO: 1024663 - DNA, 14 bp, Homo sapiens
tctaaactgcaaac

SEQ ID NO: 1024664 - DNA, 18 bp, Homo sapiens
tctaaactggtacaattt

SEQ ID NO: 1024665 - DNA, 12 bp, Homo sapiens
tctaaagagcat

SEQ ID NO: 1024666 - DNA, 14 bp, Homo sapiens
tctaaagagcatct

SEQ ID NO: 1024667 - DNA, 21 bp, Homo sapiens
tctaaagcactggtttcaaga

SEQ ID NO: 1024668 - DNA, 22 bp, Homo sapiens
tctaaagccttaactaagactc

SEQ ID NO: 1024669 - DNA, 18 bp, Homo sapiens
tctaaagcttctataaaa

SEQ ID NO: 1024670 - DNA, 21 bp, Homo sapiens
tctaaagctttatctttgtgt

SEQ ID NO: 1024671 - DNA, 20 bp, Homo sapiens
tctaaaggatggaaaaataa

SEQ ID NO: 1024672 - DNA, 21 bp, Homo sapiens
tctaaaggatggaaaaataaa

SEQ ID NO: 1024673 - DNA, 22 bp, Homo sapiens
tctaaaggggttttttgggaag

SEQ ID NO: 1024674 - DNA, 17 bp, Homo sapiens
tctaaagtaaaattgaa

SEQ ID NO: 1024675 - DNA, 12 bp, Homo sapiens
tctaaagtgttg

SEQ ID NO: 1024676 - DNA, 15 bp, Homo sapiens
tctaaagtgttggtc

SEQ ID NO: 1024677 - DNA, 12 bp, Homo sapiens
tctaaagttata

SEQ ID NO: 1024678 - DNA, 15 bp, Homo sapiens
tctaaagttttgcaa

SEQ ID NO: 1024679 - DNA, 16 bp, Homo sapiens
tctaaatatggactgc

SEQ ID NO: 1024680 - DNA, 22 bp, Homo sapiens
tctaaatgaatgagccaaaatg

SEQ ID NO: 1024681 - DNA, 23 bp, Homo sapiens
tctaaatgcatatcctgagccat

SEQ ID NO: 1024682 - DNA, 13 bp, Homo sapiens
tctaaatgcccag

SEQ ID NO: 1024683 - DNA, 12 bp, Homo sapiens
tctaacagccct

SEQ ID NO: 1024684 - DNA, 20 bp, Homo sapiens
tctaacagccctcctctgca

SEQ ID NO: 1024685 - DNA, 18 bp, Homo sapiens
tctaacatatgatactga

SEQ ID NO: 1024686 - DNA, 21 bp, Homo sapiens
tctaacatattcaatgcaagt

SEQ ID NO: 1024687 - DNA, 21 bp, Homo sapiens
tctaaccccctctgctctgtc

SEQ ID NO: 1024688 - DNA, 21 bp, Homo sapiens
tctaaccctcccatggcacct

SEQ ID NO: 1024689 - DNA, 14 bp, Homo sapiens
tctaacctgtgacc

SEQ ID NO: 1024690 - DNA, 21 bp, Homo sapiens
tctaaccttgaatgctgccag

SEQ ID NO: 1024691 - DNA, 22 bp, Homo sapiens
tctaacgctgaactgacaatga

SEQ ID NO: 1024692 - DNA, 22 bp, Homo sapiens
tctaactatatgtacagctctc

SEQ ID NO: 1024693 - DNA, 15 bp, Homo sapiens
tctaactcagaaaca

SEQ ID NO: 1024694 - DNA, 14 bp, Homo sapiens
tctaactcagaatt

SEQ ID NO: 1024695 - DNA, 18 bp, Homo sapiens
tctaactcagaattattt

SEQ ID NO: 1024696 - DNA, 12 bp, Homo sapiens
tctaactgtata

SEQ ID NO: 1024697 - DNA, 17 bp, Homo sapiens
tctaactgtatatttgt

SEQ ID NO: 1024698 - DNA, 15 bp, Homo sapiens
gctattctgtgttga

SEQ ID NO: 1024699 - DNA, 16 bp, Homo sapiens
gctattgcaaatgagg

SEQ ID NO: 1024700 - DNA, 16 bp, Homo sapiens
gctattggaggatcag

SEQ ID NO: 1024701 - DNA, 18 bp, Homo sapiens
gctattgttgtgggcttt

SEQ ID NO: 1024702 - DNA, 22 bp, Homo sapiens
gctattgtttctttaagaaagt

SEQ ID NO: 1024703 - DNA, 14 bp, Homo sapiens
gctatttaaaactt

SEQ ID NO: 1024704 - DNA, 15 bp, Homo sapiens
gctatttatcccttt

SEQ ID NO: 1024705 - DNA, 13 bp, Homo sapiens
gctatttatgcaa

SEQ ID NO: 1024706 - DNA, 14 bp, Homo sapiens
gctatttcatctat

SEQ ID NO: 1024707 - DNA, 18 bp, Homo sapiens
gctatttctattccttat

SEQ ID NO: 1024708 - DNA, 11 bp, Homo sapiens
gctatttgaag

SEQ ID NO: 1024709 - DNA, 14 bp, Homo sapiens
gctatttgtcatct

SEQ ID NO: 1024710 - DNA, 16 bp, Homo sapiens
gctatttgtgtgtatg

SEQ ID NO: 1024711 - DNA, 14 bp, Homo sapiens
gctatttgttcaga

SEQ ID NO: 1024712 - DNA, 17 bp, Homo sapiens
gctatttgttcagagag

SEQ ID NO: 1024713 - DNA, 18 bp, Homo sapiens
gctatttgttcagagagg

SEQ ID NO: 1024714 - DNA, 23 bp, Homo sapiens
gctattttatattacactacaca

SEQ ID NO: 1024715 - DNA, 16 bp, Homo sapiens
gctattttcctctggc

SEQ ID NO: 1024716 - DNA, 23 bp, Homo sapiens
gctattttcctctggccgcagag

SEQ ID NO: 1024717 - DNA, 12 bp, Homo sapiens
gctcaaaatctt

SEQ ID NO: 1024718 - DNA, 14 bp, Homo sapiens
gctcaaatctattc

SEQ ID NO: 1024719 - DNA, 17 bp, Homo sapiens
gctcaaatctattcaga

SEQ ID NO: 1024720 - DNA, 22 bp, Homo sapiens
gctcaaatctattcagacaagc

SEQ ID NO: 1024721 - DNA, 15 bp, Homo sapiens
gctcaaatgaaatgt

SEQ ID NO: 1024722 - DNA, 15 bp, Homo sapiens
gctcaacccccctcc

SEQ ID NO: 1024723 - DNA, 16 bp, Homo sapiens
gctcaacccccctccc

SEQ ID NO: 1024724 - DNA, 18 bp, Homo sapiens
gctcaacccccctcccag

SEQ ID NO: 1024725 - DNA, 21 bp, Homo sapiens
gctcaacccccctcccagaca

SEQ ID NO: 1024726 - DNA, 18 bp, Homo sapiens
gctcaactcacagcttct

SEQ ID NO: 1024727 - DNA, 20 bp, Homo sapiens
gctcaactcgggggcgcctg

SEQ ID NO: 1024728 - DNA, 20 bp, Homo sapiens
gctcaactctacccctgctc

SEQ ID NO: 1024729 - DNA, 22 bp, Homo sapiens
gctcaagcagcgaccgccccct

SEQ ID NO: 1024730 - DNA, 18 bp, Homo sapiens
gctcaagcagttctccca

SEQ ID NO: 1024731 - DNA, 23 bp, Homo sapiens
gctcaaggaaagggggtcccagt

SEQ ID NO: 1024732 - DNA, 19 bp, Homo sapiens
gctcaagggaccctgggtg

SEQ ID NO: 1024733 - DNA, 13 bp, Homo sapiens
gctcaagtagaaa

SEQ ID NO: 1024734 - DNA, 14 bp, Homo sapiens
gctcaagtgatcct

SEQ ID NO: 1024735 - DNA, 19 bp, Homo sapiens
gctcaatattcctgaatga

SEQ ID NO: 1024736 - DNA, 21 bp, Homo sapiens
gctcaatattcctgaatgaaa

SEQ ID NO: 1024737 - DNA, 16 bp, Homo sapiens
gctcaatcaagaaaat

SEQ ID NO: 1024738 - DNA, 20 bp, Homo sapiens
gctcaatccctgaggactga

SEQ ID NO: 1024739 - DNA, 23 bp, Homo sapiens
gctcaatgcattgtcttgtggag

SEQ ID NO: 1024740 - DNA, 20 bp, Homo sapiens
gctcaattcaagtgacacat

SEQ ID NO: 1024741 - DNA, 22 bp, Homo sapiens
gctcaattcaagtgacacatta

SEQ ID NO: 1024742 - DNA, 14 bp, Homo sapiens
gctcaattgttaat

SEQ ID NO: 1024743 - DNA, 19 bp, Homo sapiens
gctcaattgttaatgtgat

SEQ ID NO: 1024744 - DNA, 14 bp, Homo sapiens
gctcacaaaccatg

SEQ ID NO: 1024745 - DNA, 14 bp, Homo sapiens
gctcacaaattccg

SEQ ID NO: 1024746 - DNA, 18 bp, Homo sapiens
gctcacaacttgggttct

SEQ ID NO: 1024747 - DNA, 22 bp, Homo sapiens
gctcacacatccccagccaggg

SEQ ID NO: 1024748 - DNA, 15 bp, Homo sapiens
gctcacaccaaattt

SEQ ID NO: 1024749 - DNA, 17 bp, Homo sapiens
gctcacactccagtggc

SEQ ID NO: 1024750 - DNA, 19 bp, Homo sapiens
gctcacactccagtggcag

SEQ ID NO: 1024751 - DNA, 14 bp, Homo sapiens
gctcacactgatgg

SEQ ID NO: 1024752 - DNA, 12 bp, Homo sapiens
gctcacagggca

SEQ ID NO: 1024753 - DNA, 15 bp, Homo sapiens
gctcacagggcaggc

SEQ ID NO: 1024754 - DNA, 20 bp, Homo sapiens
gctcacagggcaggccttgc

SEQ ID NO: 1024755 - DNA, 15 bp, Homo sapiens
gctcacagtacagca

SEQ ID NO: 1024756 - DNA, 15 bp, Homo sapiens
gctcacagttcctcg

SEQ ID NO: 1024757 - DNA, 16 bp, Homo sapiens
gctcacagttcctcgc

SEQ ID NO: 1024758 - DNA, 19 bp, Homo sapiens
gctcacagttcctcgccct

SEQ ID NO: 1024759 - DNA, 19 bp, Homo sapiens
gctcacatccagccttgga

SEQ ID NO: 1024760 - DNA, 13 bp, Homo sapiens
gctcaccagccct

SEQ ID NO: 1024761 - DNA, 16 bp, Homo sapiens
gctcaccagccctgca

SEQ ID NO: 1024762 - DNA, 14 bp, Homo sapiens
gctcacccacctct

SEQ ID NO: 1024763 - DNA, 18 bp, Homo sapiens
gctcacccccttctccat

SEQ ID NO: 1024764 - DNA, 12 bp, Homo sapiens
gctcacccctgg

SEQ ID NO: 1024765 - DNA, 16 bp, Homo sapiens
gctcacccctgggcag

SEQ ID NO: 1024766 - DNA, 17 bp, Homo sapiens
gctcacccctgggcagg

SEQ ID NO: 1024767 - DNA, 18 bp, Homo sapiens
gctcaccctgcccgctcc

SEQ ID NO: 1024768 - DNA, 16 bp, Homo sapiens
gctcaccgctggccct

SEQ ID NO: 1024769 - DNA, 14 bp, Homo sapiens
gctcacctcaacct

SEQ ID NO: 1024770 - DNA, 13 bp, Homo sapiens
gctcacctttgtt

SEQ ID NO: 1024771 - DNA, 22 bp, Homo sapiens
gctcacgccccgctgtgtcctc

SEQ ID NO: 1024772 - DNA, 22 bp, Homo sapiens
gctcacgcctatgatcccagca

SEQ ID NO: 1024773 - DNA, 23 bp, Homo sapiens
gctcacgcctgtaatcccagcac

SEQ ID NO: 1024774 - DNA, 14 bp, Homo sapiens
gctcactactgaac

SEQ ID NO: 1024775 - DNA, 15 bp, Homo sapiens
gctcactactgaaca

SEQ ID NO: 1024776 - DNA, 13 bp, Homo sapiens
gctcactgccagg

SEQ ID NO: 1024777 - DNA, 23 bp, Homo sapiens
gctcactgccaggccagcctccg

SEQ ID NO: 1024778 - DNA, 13 bp, Homo sapiens
tctacagaaaaac

SEQ ID NO: 1024779 - DNA, 13 bp, Homo sapiens
tctacagaaaatg

SEQ ID NO: 1024780 - DNA, 22 bp, Homo sapiens
tctacagaaataacagctgggg

SEQ ID NO: 1024781 - DNA, 18 bp, Homo sapiens
tctacagacttctccaga

SEQ ID NO: 1024782 - DNA, 16 bp, Homo sapiens
tctacagagcttccct

SEQ ID NO: 1024783 - DNA, 18 bp, Homo sapiens
tctacagagcttccctga

SEQ ID NO: 1024784 - DNA, 23 bp, Homo sapiens
tctacagctaatcagcattctca

SEQ ID NO: 1024785 - DNA, 18 bp, Homo sapiens
tctacagtcgtaaaagag

SEQ ID NO: 1024786 - DNA, 23 bp, Homo sapiens
tctacagtcgtaaaagagataat

SEQ ID NO: 1024787 - DNA, 22 bp, Homo sapiens
tctacagtggttttatactgaa

SEQ ID NO: 1024788 - DNA, 21 bp, Homo sapiens
tctacatatgatctgtctgtg

SEQ ID NO: 1024789 - DNA, 15 bp, Homo sapiens
tctacatcttctgcc

SEQ ID NO: 1024790 - DNA, 17 bp, Homo sapiens
tctacatcttctgcctt

SEQ ID NO: 1024791 - DNA, 14 bp, Homo sapiens
tctacattaaacaa

SEQ ID NO: 1024792 - DNA, 15 bp, Homo sapiens
tctacattcttggtt

SEQ ID NO: 1024793 - DNA, 11 bp, Homo sapiens
tctacatttca

SEQ ID NO: 1024794 - DNA, 12 bp, Homo sapiens
tctacatttcac

SEQ ID NO: 1024795 - DNA, 20 bp, Homo sapiens
tctacattttttaaaactga

SEQ ID NO: 1024796 - DNA, 23 bp, Homo sapiens
tctaccaacaataaaccaaaccc

SEQ ID NO: 1024797 - DNA, 17 bp, Homo sapiens
tctaccagatgtgcttt

SEQ ID NO: 1024798 - DNA, 14 bp, Homo sapiens
tctaccagtctatt

SEQ ID NO: 1024799 - DNA, 12 bp, Homo sapiens
tctacccctgct

SEQ ID NO: 1024800 - DNA, 18 bp, Homo sapiens
tctacccctttcttctcg

SEQ ID NO: 1024801 - DNA, 19 bp, Homo sapiens
tctacccggcccagagacc

SEQ ID NO: 1024802 - DNA, 22 bp, Homo sapiens
tctacccggcccagagacccct

SEQ ID NO: 1024803 - DNA, 14 bp, Homo sapiens
tctacccgtgcctg

SEQ ID NO: 1024804 - DNA, 21 bp, Homo sapiens
tctacccgtgcctgggcccct

SEQ ID NO: 1024805 - DNA, 22 bp, Homo sapiens
tctacccgtgcctgggcccctc

SEQ ID NO: 1024806 - DNA, 21 bp, Homo sapiens
tctaccctggcactataatgt

SEQ ID NO: 1024807 - DNA, 18 bp, Homo sapiens
tctaccctgtcctttgca

SEQ ID NO: 1024808 - DNA, 19 bp, Homo sapiens
tctaccctgtctgtccctt

SEQ ID NO: 1024809 - DNA, 21 bp, Homo sapiens
tctacctaatgtctcactgtt

SEQ ID NO: 1024810 - DNA, 23 bp, Homo sapiens
tctacctaatgtctcactgttct

SEQ ID NO: 1024811 - DNA, 23 bp, Homo sapiens
tctacctatacttaatctaagaa

SEQ ID NO: 1024812 - DNA, 15 bp, Homo sapiens
tctacctccaccctg

SEQ ID NO: 1024813 - DNA, 18 bp, Homo sapiens
tctacctccaccctgcat

SEQ ID NO: 1024814 - DNA, 13 bp, Homo sapiens
tctacctgagcat

SEQ ID NO: 1024815 - DNA, 16 bp, Homo sapiens
tctacctgaggccagg

SEQ ID NO: 1024816 - DNA, 16 bp, Homo sapiens
tctacctgcttggtct

SEQ ID NO: 1024817 - DNA, 18 bp, Homo sapiens
tctacctgcttggtcttt

SEQ ID NO: 1024818 - DNA, 18 bp, Homo sapiens
tctacctggagggaagag

SEQ ID NO: 1024819 - DNA, 22 bp, Homo sapiens
tctacctgtgtttttttctaaa

SEQ ID NO: 1024820 - DNA, 15 bp, Homo sapiens
tctaggtgtggctgt

SEQ ID NO: 1024821 - DNA, 20 bp, Homo sapiens
tctaggttaaagctaaactg

SEQ ID NO: 1024822 - DNA, 15 bp, Homo sapiens
tctaggttatacaat

SEQ ID NO: 1024823 - DNA, 19 bp, Homo sapiens
tctaggttatacaataacc

SEQ ID NO: 1024824 - DNA, 13 bp, Homo sapiens
tctagtacataat

SEQ ID NO: 1024825 - DNA, 16 bp, Homo sapiens
tctagtacataattga

SEQ ID NO: 1024826 - DNA, 20 bp, Homo sapiens
tctagtagtgtggcctgtgc

SEQ ID NO: 1024827 - DNA, 16 bp, Homo sapiens
tctagtatttgaacaa

SEQ ID NO: 1024828 - DNA, 15 bp, Homo sapiens
tctagtattttatct

SEQ ID NO: 1024829 - DNA, 17 bp, Homo sapiens
tctagtattttatctgg

SEQ ID NO: 1024830 - DNA, 22 bp, Homo sapiens
tctagtctcctttgcactgagg

SEQ ID NO: 1024831 - DNA, 15 bp, Homo sapiens
tctagtctgtcttcc

SEQ ID NO: 1024832 - DNA, 13 bp, Homo sapiens
tctagtcttctgg

SEQ ID NO: 1024833 - DNA, 14 bp, Homo sapiens
tctagtcttggcca

SEQ ID NO: 1024834 - DNA, 11 bp, Homo sapiens
tctagtgaatg

SEQ ID NO: 1024835 - DNA, 15 bp, Homo sapiens
tctagtgacttcctg

SEQ ID NO: 1024836 - DNA, 16 bp, Homo sapiens
tctagtgagcctgggc

SEQ ID NO: 1024837 - DNA, 14 bp, Homo sapiens
tctagtgcagctga

SEQ ID NO: 1024838 - DNA, 16 bp, Homo sapiens
tctagtgcagctgatt

SEQ ID NO: 1024839 - DNA, 23 bp, Homo sapiens
tctagtgcagctgattttaacaa

SEQ ID NO: 1024840 - DNA, 20 bp, Homo sapiens
tctagtgccctccacagccg

SEQ ID NO: 1024841 - DNA, 17 bp, Homo sapiens
tctagtgctgctgaaga

SEQ ID NO: 1024842 - DNA, 15 bp, Homo sapiens
tctagtgctgtgaaa

SEQ ID NO: 1024843 - DNA, 16 bp, Homo sapiens
tctagtgctgtgaaaa

SEQ ID NO: 1024844 - DNA, 22 bp, Homo sapiens
tctagtggctgttcatgctcca

SEQ ID NO: 1024845 - DNA, 12 bp, Homo sapiens
tctagtgggaag

SEQ ID NO: 1024846 - DNA, 22 bp, Homo sapiens
tctagtgggttgacctttaaat

SEQ ID NO: 1024847 - DNA, 12 bp, Homo sapiens
tctagttcaaga

SEQ ID NO: 1024848 - DNA, 22 bp, Homo sapiens
tctagttctcaatcactgctcc

SEQ ID NO: 1024849 - DNA, 14 bp, Homo sapiens
tctagttctgttgt

SEQ ID NO: 1024850 - DNA, 15 bp, Homo sapiens
tctagttctttcctc

SEQ ID NO: 1024851 - DNA, 13 bp, Homo sapiens
tctagttctttgt

SEQ ID NO: 1024852 - DNA, 22 bp, Homo sapiens
tctagttgccctctacctgact

SEQ ID NO: 1024853 - DNA, 14 bp, Homo sapiens
tctagtttacagaa

SEQ ID NO: 1024854 - DNA, 13 bp, Homo sapiens
tctagtttattct

SEQ ID NO: 1024855 - DNA, 15 bp, Homo sapiens
tctagtttcagtaaa

SEQ ID NO: 1024856 - DNA, 16 bp, Homo sapiens
tctagtttctagtgtc

SEQ ID NO: 1024857 - DNA, 14 bp, Homo sapiens
tctagtttcttgtg

SEQ ID NO: 1024858 - DNA, 22 bp, Homo sapiens
tctagtttgattaaattcttgc

SEQ ID NO: 1024859 - DNA, 15 bp, Homo sapiens
tctagtttgcaactt

SEQ ID NO: 1024860 - DNA, 20 bp, Homo sapiens
tctagttttcagtttgtata

SEQ ID NO: 1024861 - DNA, 17 bp, Homo sapiens
tctagttttttttgtaa

SEQ ID NO: 1024862 - DNA, 15 bp, Homo sapiens
tctataaaaaatatg

SEQ ID NO: 1024863 - DNA, 15 bp, Homo sapiens
tctataaaataaact

SEQ ID NO: 1024864 - DNA, 18 bp, Homo sapiens
tctataaaataaacttct

SEQ ID NO: 1024865 - DNA, 21 bp, Homo sapiens
tctataaaataaacttcttaa

SEQ ID NO: 1024866 - DNA, 21 bp, Homo sapiens
tctataaactataacctctcc

SEQ ID NO: 1024867 - DNA, 17 bp, Homo sapiens
tctataaagcatttaac

SEQ ID NO: 1024868 - DNA, 13 bp, Homo sapiens
tctataaataacc

SEQ ID NO: 1024869 - DNA, 16 bp, Homo sapiens
tctataaattgtccgt

SEQ ID NO: 1024870 - DNA, 18 bp, Homo sapiens
tctataaatttaagaaaa

SEQ ID NO: 1024871 - DNA, 21 bp, Homo sapiens
tctataacagatcctttcaaa

SEQ ID NO: 1024872 - DNA, 22 bp, Homo sapiens
tctataacagatcctttcaaaa

SEQ ID NO: 1024873 - DNA, 22 bp, Homo sapiens
tctataaggccataaaacaggt

SEQ ID NO: 1024874 - DNA, 16 bp, Homo sapiens
tctataagtagtaaat

SEQ ID NO: 1024875 - DNA, 14 bp, Homo sapiens
tctataataagttt

SEQ ID NO: 1024876 - DNA, 19 bp, Homo sapiens
tctataataagttttgata

SEQ ID NO: 1024877 - DNA, 19 bp, Homo sapiens
tctataatggaaacattta

SEQ ID NO: 1024878 - DNA, 15 bp, Homo sapiens
tctatactaatgctt

SEQ ID NO: 1024879 - DNA, 18 bp, Homo sapiens
tctatactaatgcttaca

SEQ ID NO: 1024880 - DNA, 17 bp, Homo sapiens
tctatagccaaaaatag

SEQ ID NO: 1024881 - DNA, 20 bp, Homo sapiens
tctatagccaactgctaatg

SEQ ID NO: 1024882 - DNA, 23 bp, Homo sapiens
tctatagccaactgctaatgcaa

SEQ ID NO: 1024883 - DNA, 21 bp, Homo sapiens
tctataggaacatatgaaaat

SEQ ID NO: 1024884 - DNA, 21 bp, Homo sapiens
tctatagttgatatgttttat

SEQ ID NO: 1024885 - DNA, 21 bp, Homo sapiens
tctatataaaatgtattcaag

SEQ ID NO: 1024886 - DNA, 19 bp, Homo sapiens
tctatatatgtatctacaa

SEQ ID NO: 1024887 - DNA, 15 bp, Homo sapiens
tctatatatgtgtat

SEQ ID NO: 1024888 - DNA, 13 bp, Homo sapiens
tctatatcaaaaa

SEQ ID NO: 1024889 - DNA, 14 bp, Homo sapiens
tctatattatgtct

SEQ ID NO: 1024890 - DNA, 16 bp, Homo sapiens
tctatattattatata

SEQ ID NO: 1024891 - DNA, 15 bp, Homo sapiens
tctatatttgtcttc

SEQ ID NO: 1024892 - DNA, 18 bp, Homo sapiens
tctatatttgtcttccga

SEQ ID NO: 1024893 - DNA, 19 bp, Homo sapiens
tctatcaaccccagacact

SEQ ID NO: 1024894 - DNA, 20 bp, Homo sapiens
tctatcaaccccagacactg

SEQ ID NO: 1024895 - DNA, 14 bp, Homo sapiens
tctatcaccaagga

SEQ ID NO: 1024896 - DNA, 23 bp, Homo sapiens
tctatcactaaaaatttttacaa

SEQ ID NO: 1024897 - DNA, 14 bp, Homo sapiens
tctatcagagaaaa

SEQ ID NO: 1024898 - DNA, 16 bp, Homo sapiens
tctatcagcattgttt

SEQ ID NO: 1024899 - DNA, 21 bp, Homo sapiens
tctatcagttatcctttgtga

SEQ ID NO: 1024900 - DNA, 21 bp, Homo sapiens
tctatcatggaatatttatag

SEQ ID NO: 1024901 - DNA, 20 bp, Homo sapiens
tctatccatctcctggtgtt

SEQ ID NO: 1024902 - DNA, 16 bp, Homo sapiens
tctatccccaagctgg

SEQ ID NO: 1024903 - DNA, 15 bp, Homo sapiens
tctatccccatccag

SEQ ID NO: 1024904 - DNA, 17 bp, Homo sapiens
tctatcccccttaaaga

SEQ ID NO: 1024905 - DNA, 16 bp, Homo sapiens
tctatcctacaacaag

SEQ ID NO: 1024906 - DNA, 19 bp, Homo sapiens
tctatcctctctctctcta

SEQ ID NO: 1024907 - DNA, 21 bp, Homo sapiens
gctcattttctacgtcatgta

SEQ ID NO: 1024908 - DNA, 17 bp, Homo sapiens
gctccaagatgttctcc

SEQ ID NO: 1024909 - DNA, 21 bp, Homo sapiens
gctccaagatgttctcctgat

SEQ ID NO: 1024910 - DNA, 20 bp, Homo sapiens
gctccaagggaccctttgcc

SEQ ID NO: 1024911 - DNA, 20 bp, Homo sapiens
gctccacacattccagccag

SEQ ID NO: 1024912 - DNA, 21 bp, Homo sapiens
gctccacacattccagccagg

SEQ ID NO: 1024913 - DNA, 22 bp, Homo sapiens
gctccacacattccagccaggc

SEQ ID NO: 1024914 - DNA, 15 bp, Homo sapiens
gctccaccacatcct

SEQ ID NO: 1024915 - DNA, 11 bp, Homo sapiens
gctccaccctt

SEQ ID NO: 1024916 - DNA, 23 bp, Homo sapiens
gctccacccttggcctgtctcat

SEQ ID NO: 1024917 - DNA, 13 bp, Homo sapiens
gctccacctctgg

SEQ ID NO: 1024918 - DNA, 22 bp, Homo sapiens
gctccacctctggtggctcctc

SEQ ID NO: 1024919 - DNA, 14 bp, Homo sapiens
gctccaccttgatg

SEQ ID NO: 1024920 - DNA, 21 bp, Homo sapiens
gctccacggtgcgtggctgtg

SEQ ID NO: 1024921 - DNA, 13 bp, Homo sapiens
gctccactctgct

SEQ ID NO: 1024922 - DNA, 19 bp, Homo sapiens
gctccactctgcttctctg

SEQ ID NO: 1024923 - DNA, 17 bp, Homo sapiens
gctccactttctcatcc

SEQ ID NO: 1024924 - DNA, 20 bp, Homo sapiens
gctccagaaatgtctaaatg

SEQ ID NO: 1024925 - DNA, 17 bp, Homo sapiens
gctccagaagatgccag

SEQ ID NO: 1024926 - DNA, 23 bp, Homo sapiens
gctccagaagatgccagcttctc

SEQ ID NO: 1024927 - DNA, 23 bp, Homo sapiens
gctccagacccccagcaaccctc

SEQ ID NO: 1024928 - DNA, 15 bp, Homo sapiens
gctccagaggacctg

SEQ ID NO: 1024929 - DNA, 17 bp, Homo sapiens
gctccagaggacctgag

SEQ ID NO: 1024930 - DNA, 21 bp, Homo sapiens
gctccagagggcactctgctt

SEQ ID NO: 1024931 - DNA, 22 bp, Homo sapiens
gctccagataactctctttcct

SEQ ID NO: 1024932 - DNA, 17 bp, Homo sapiens
gctccagattctgatgc

SEQ ID NO: 1024933 - DNA, 22 bp, Homo sapiens
gctccagcaactgcccttccag

SEQ ID NO: 1024934 - DNA, 22 bp, Homo sapiens
gctccagcatccagcctgtgtg

SEQ ID NO: 1024935 - DNA, 18 bp, Homo sapiens
gctccagccaacccctgt

SEQ ID NO: 1024936 - DNA, 14 bp, Homo sapiens
gctccagccatctc

SEQ ID NO: 1024937 - DNA, 11 bp, Homo sapiens
gctccagcccc

SEQ ID NO: 1024938 - DNA, 21 bp, Homo sapiens
gctccagcccctttgcctctg

SEQ ID NO: 1024939 - DNA, 22 bp, Homo sapiens
gctccagcccctttgcctctgt

SEQ ID NO: 1024940 - DNA, 12 bp, Homo sapiens
gctccagctgcc

SEQ ID NO: 1024941 - DNA, 21 bp, Homo sapiens
gctccagctgccccggcccct

SEQ ID NO: 1024942 - DNA, 14 bp, Homo sapiens
gctccgttggtcag

SEQ ID NO: 1024943 - DNA, 22 bp, Homo sapiens
gctcctaacccttatcaccagc

SEQ ID NO: 1024944 - DNA, 23 bp, Homo sapiens
gctcctaacccttatcaccagct

SEQ ID NO: 1024945 - DNA, 16 bp, Homo sapiens
gctcctacatccagct

SEQ ID NO: 1024946 - DNA, 18 bp, Homo sapiens
gctcctacatccagctcc

SEQ ID NO: 1024947 - DNA, 22 bp, Homo sapiens
gctcctaccagcaaacagctga

SEQ ID NO: 1024948 - DNA, 19 bp, Homo sapiens
gctcctagagggaggggcc

SEQ ID NO: 1024949 - DNA, 22 bp, Homo sapiens
gctcctagcagacagaaactgg

SEQ ID NO: 1024950 - DNA, 22 bp, Homo sapiens
gctcctattgaaagaccagatc

SEQ ID NO: 1024951 - DNA, 21 bp, Homo sapiens
gctcctcacatacccacacat

SEQ ID NO: 1024952 - DNA, 14 bp, Homo sapiens
gctcctcacccctg

SEQ ID NO: 1024953 - DNA, 18 bp, Homo sapiens
gctcctcacccctgtagg

SEQ ID NO: 1024954 - DNA, 20 bp, Homo sapiens
gctcctcactggaggagcag

SEQ ID NO: 1024955 - DNA, 22 bp, Homo sapiens
gctcctcagagcgccaggaagc

SEQ ID NO: 1024956 - DNA, 15 bp, Homo sapiens
gctcctcatgggaag

SEQ ID NO: 1024957 - DNA, 19 bp, Homo sapiens
gctcctcatggtgggttca

SEQ ID NO: 1024958 - DNA, 14 bp, Homo sapiens
gctcctccagggcc

SEQ ID NO: 1024959 - DNA, 18 bp, Homo sapiens
gctcctccagggccacgt

SEQ ID NO: 1024960 - DNA, 22 bp, Homo sapiens
gctcctccagggccacgtgcca

SEQ ID NO: 1024961 - DNA, 14 bp, Homo sapiens
gctcctccccgatc

SEQ ID NO: 1024962 - DNA, 16 bp, Homo sapiens
gctcctcccctcttga

SEQ ID NO: 1024963 - DNA, 17 bp, Homo sapiens
gctcctcccctcttgag

SEQ ID NO: 1024964 - DNA, 11 bp, Homo sapiens
gctcctccctg

SEQ ID NO: 1024965 - DNA, 12 bp, Homo sapiens
gctcctccctgc

SEQ ID NO: 1024966 - DNA, 22 bp, Homo sapiens
gctcctccctgccccccaaggt

SEQ ID NO: 1024967 - DNA, 17 bp, Homo sapiens
gctcctccctgctcctc

SEQ ID NO: 1024968 - DNA, 18 bp, Homo sapiens
gctcctccctgctcctca

SEQ ID NO: 1024969 - DNA, 19 bp, Homo sapiens
gctcctccctgctcctcat

SEQ ID NO: 1024970 - DNA, 22 bp, Homo sapiens
gctcctccctgctcctcatggg

SEQ ID NO: 1024971 - DNA, 23 bp, Homo sapiens
gctcctccctgctcctcatggga

SEQ ID NO: 1024972 - DNA, 14 bp, Homo sapiens
gctcctccctggct

SEQ ID NO: 1024973 - DNA, 15 bp, Homo sapiens
gctcctccctggctg

SEQ ID NO: 1024974 - DNA, 18 bp, Homo sapiens
gctcctccctggctgccc

SEQ ID NO: 1024975 - DNA, 21 bp, Homo sapiens
gctcctccctggctgccctgg

SEQ ID NO: 1024976 - DNA, 21 bp, Homo sapiens
gctcctccctgtgcccccagc

SEQ ID NO: 1024977 - DNA, 22 bp, Homo sapiens
gctcctccctgtgcccccagcc

SEQ ID NO: 1024978 - DNA, 15 bp, Homo sapiens
gctcctccgggtctg

SEQ ID NO: 1024979 - DNA, 15 bp, Homo sapiens
gctcctcctccctgc

SEQ ID NO: 1024980 - DNA, 12 bp, Homo sapiens
gctcctccttcc

SEQ ID NO: 1024981 - DNA, 21 bp, Homo sapiens
gctcctccttcccagggacca

SEQ ID NO: 1024982 - DNA, 17 bp, Homo sapiens
gctcctctccttgggct

SEQ ID NO: 1024983 - DNA, 20 bp, Homo sapiens
gctcctctccttgggctcct

SEQ ID NO: 1024984 - DNA, 23 bp, Homo sapiens
gctcctctccttgggctcctggc

SEQ ID NO: 1024985 - DNA, 12 bp, Homo sapiens
gctcctctctga

SEQ ID NO: 1024986 - DNA, 12 bp, Homo sapiens
gctcctctgagc

SEQ ID NO: 1024987 - DNA, 16 bp, Homo sapiens
gctcctctgggcagga

SEQ ID NO: 1024988 - DNA, 19 bp, Homo sapiens
gctcctctgggcaggacct

SEQ ID NO: 1024989 - DNA, 15 bp, Homo sapiens
gctcctctttcccct

SEQ ID NO: 1024990 - DNA, 18 bp, Homo sapiens
gctcctctttcccctcct

SEQ ID NO: 1024991 - DNA, 21 bp, Homo sapiens
gctcctgacccctccctgcag

SEQ ID NO: 1024992 - DNA, 18 bp, Homo sapiens
gctcctgaggggcatctg

SEQ ID NO: 1024993 - DNA, 23 bp, Homo sapiens
gctcctgaggggcatctgcccct

SEQ ID NO: 1024994 - DNA, 19 bp, Homo sapiens
gctcctgccaaccacaatt

SEQ ID NO: 1024995 - DNA, 19 bp, Homo sapiens
gctcctgccagtgtggaac

SEQ ID NO: 1024996 - DNA, 13 bp, Homo sapiens
gctcctgcccagc

SEQ ID NO: 1024997 - DNA, 16 bp, Homo sapiens
gctcctgcccagccac

SEQ ID NO: 1024998 - DNA, 19 bp, Homo sapiens
gctcctgctgaccttctgc

SEQ ID NO: 1024999 - DNA, 18 bp, Homo sapiens
gctcctgcttttctgtcc

SEQ ID NO: 1025000 - DNA, 22 bp, Homo sapiens
gctcctgcttttctgtcctggg

SEQ ID NO: 1025001 - DNA, 23 bp, Homo sapiens
gctcctgcttttctgtcctgggc

SEQ ID NO: 1025002 - DNA, 22 bp, Homo sapiens
gctcctggaaaggctcagtctc

SEQ ID NO: 1025003 - DNA, 15 bp, Homo sapiens
gctcctggcccactg

SEQ ID NO: 1025004 - DNA, 20 bp, Homo sapiens
gctcctggcccactgcatcg

SEQ ID NO: 1025005 - DNA, 12 bp, Homo sapiens
gctcctggctgc

SEQ ID NO: 1025006 - DNA, 13 bp, Homo sapiens
gctcctggctgcc

SEQ ID NO: 1025007 - DNA, 16 bp, Homo sapiens
gctcctggctgccagg

SEQ ID NO: 1025008 - DNA, 18 bp, Homo sapiens
gctcctggctgtgcccag

SEQ ID NO: 1025009 - DNA, 19 bp, Homo sapiens
gctcctggctgtgcccagc

SEQ ID NO: 1025010 - DNA, 23 bp, Homo sapiens
gctcctggctgtgcccagcaggc

SEQ ID NO: 1025011 - DNA, 17 bp, Homo sapiens
gctcctgggacccttgg

SEQ ID NO: 1025012 - DNA, 20 bp, Homo sapiens
gctcctgggacccttggcta

SEQ ID NO: 1025013 - DNA, 10 bp, Homo sapiens
gctcctgggg

SEQ ID NO: 1025014 - DNA, 13 bp, Homo sapiens
gctcctggggaga

SEQ ID NO: 1025015 - DNA, 14 bp, Homo sapiens
gctcctggggagaa

SEQ ID NO: 1025016 - DNA, 19 bp, Homo sapiens
gctcctggggagctcctgg

SEQ ID NO: 1025017 - DNA, 20 bp, Homo sapiens
gctcctggggagctcctggg

SEQ ID NO: 1025018 - DNA, 23 bp, Homo sapiens
gctcctggggagctcctgggacc

SEQ ID NO: 1025019 - DNA, 14 bp, Homo sapiens
gctcctggggcaga

SEQ ID NO: 1025020 - DNA, 16 bp, Homo sapiens
gctcctggggcagaga

SEQ ID NO: 1025021 - DNA, 19 bp, Homo sapiens
gctcctggtcttgagatgt

SEQ ID NO: 1025022 - DNA, 20 bp, Homo sapiens
gctcctgtacttgtcctcag

SEQ ID NO: 1025023 - DNA, 14 bp, Homo sapiens
gctcctgtctgcca

SEQ ID NO: 1025024 - DNA, 15 bp, Homo sapiens
gctcctgtctggctc

SEQ ID NO: 1025025 - DNA, 14 bp, Homo sapiens
gctcctgtggcagg

SEQ ID NO: 1025026 - DNA, 15 bp, Homo sapiens
gctcctgtggcagga

SEQ ID NO: 1025027 - DNA, 13 bp, Homo sapiens
gctcctgtggccc

SEQ ID NO: 1025028 - DNA, 16 bp, Homo sapiens
gctccttcactgttcc

SEQ ID NO: 1025029 - DNA, 18 bp, Homo sapiens
gctccttcactgttccct

SEQ ID NO: 1025030 - DNA, 16 bp, Homo sapiens
gctccttcccaggacc

SEQ ID NO: 1025031 - DNA, 12 bp, Homo sapiens
gctccttcccct

SEQ ID NO: 1025032 - DNA, 13 bp, Homo sapiens
gctccttcccctg

SEQ ID NO: 1025033 - DNA, 11 bp, Homo sapiens
gctccttcctg

SEQ ID NO: 1025034 - DNA, 14 bp, Homo sapiens
gctccttcctggag

SEQ ID NO: 1025035 - DNA, 15 bp, Homo sapiens
gctccttcctgtttg

SEQ ID NO: 1025036 - DNA, 17 bp, Homo sapiens
gctccttgagaggagaa

SEQ ID NO: 1025037 - DNA, 12 bp, Homo sapiens
tctcactcacca

SEQ ID NO: 1025038 - DNA, 10 bp, Homo sapiens
tctcactcca

SEQ ID NO: 1025039 - DNA, 12 bp, Homo sapiens
tctcactccacc

SEQ ID NO: 1025040 - DNA, 13 bp, Homo sapiens
tctcactccacca

SEQ ID NO: 1025041 - DNA, 12 bp, Homo sapiens
tctcactcccca

SEQ ID NO: 1025042 - DNA, 13 bp, Homo sapiens
tctcactcctacc

SEQ ID NO: 1025043 - DNA, 18 bp, Homo sapiens
tctcactcctacctggta

SEQ ID NO: 1025044 - DNA, 19 bp, Homo sapiens
tctcactcctgaattcagt

SEQ ID NO: 1025045 - DNA, 17 bp, Homo sapiens
tctcactctctggggaa

SEQ ID NO: 1025046 - DNA, 19 bp, Homo sapiens
tctcactctgtcgctcagg

SEQ ID NO: 1025047 - DNA, 15 bp, Homo sapiens
tctcactctgttgcc

SEQ ID NO: 1025048 - DNA, 18 bp, Homo sapiens
tctcactgaactccaccg

SEQ ID NO: 1025049 - DNA, 22 bp, Homo sapiens
tctcactgaactccaccgacca

SEQ ID NO: 1025050 - DNA, 16 bp, Homo sapiens
tctcactgttccctct

SEQ ID NO: 1025051 - DNA, 17 bp, Homo sapiens
tctcactgttccctctg

SEQ ID NO: 1025052 - DNA, 21 bp, Homo sapiens
tctcactgttccctctgctcc

SEQ ID NO: 1025053 - DNA, 15 bp, Homo sapiens
tctcactgttctgca

SEQ ID NO: 1025054 - DNA, 17 bp, Homo sapiens
tctcactgttctgcaaa

SEQ ID NO: 1025055 - DNA, 15 bp, Homo sapiens
tctcacttagtcctt

SEQ ID NO: 1025056 - DNA, 17 bp, Homo sapiens
tctcacttttaaaaaga

SEQ ID NO: 1025057 - DNA, 18 bp, Homo sapiens
tctcacttttaaaaagaa

SEQ ID NO: 1025058 - DNA, 15 bp, Homo sapiens
tctcacttttctcca

SEQ ID NO: 1025059 - DNA, 20 bp, Homo sapiens
tctcacttttctccatgagt

SEQ ID NO: 1025060 - DNA, 19 bp, Homo sapiens
tctcagaaagtgcctgaca

SEQ ID NO: 1025061 - DNA, 11 bp, Homo sapiens
tctcagaacat

SEQ ID NO: 1025062 - DNA, 15 bp, Homo sapiens
tctcagaagcacaga

SEQ ID NO: 1025063 - DNA, 12 bp, Homo sapiens
tctcagaatccc

SEQ ID NO: 1025064 - DNA, 17 bp, Homo sapiens
gctcgcagggtgcagga

SEQ ID NO: 1025065 - DNA, 16 bp, Homo sapiens
gctcgcatccagacag

SEQ ID NO: 1025066 - DNA, 21 bp, Homo sapiens
gctcgccacgctcagtgcccg

SEQ ID NO: 1025067 - DNA, 15 bp, Homo sapiens
gctcgcccagacacc

SEQ ID NO: 1025068 - DNA, 13 bp, Homo sapiens
gctcgcccagcag

SEQ ID NO: 1025069 - DNA, 16 bp, Homo sapiens
gctcgcccctcccctc

SEQ ID NO: 1025070 - DNA, 18 bp, Homo sapiens
gctcgcccctgttttttg

SEQ ID NO: 1025071 - DNA, 15 bp, Homo sapiens
gctcgccttccctcc

SEQ ID NO: 1025072 - DNA, 21 bp, Homo sapiens
gctcgccttccctcctgcttt

SEQ ID NO: 1025073 - DNA, 21 bp, Homo sapiens
gctcgctccctgtagctctgc

SEQ ID NO: 1025074 - DNA, 15 bp, Homo sapiens
gctcggacccacccc

SEQ ID NO: 1025075 - DNA, 19 bp, Homo sapiens
gctcggagaagagcgcagt

SEQ ID NO: 1025076 - DNA, 17 bp, Homo sapiens
gctcggcccggagcagc

SEQ ID NO: 1025077 - DNA, 18 bp, Homo sapiens
gctcggcccggagcagca

SEQ ID NO: 1025078 - DNA, 13 bp, Homo sapiens
gctcgggaaggga

SEQ ID NO: 1025079 - DNA, 19 bp, Homo sapiens
gctcgggaagggaggggaa

SEQ ID NO: 1025080 - DNA, 21 bp, Homo sapiens
gctcggggtccaccagtgtgt

SEQ ID NO: 1025081 - DNA, 21 bp, Homo sapiens
gctcgggtctccctcctgcag

SEQ ID NO: 1025082 - DNA, 14 bp, Homo sapiens
gctcggtggaccca

SEQ ID NO: 1025083 - DNA, 21 bp, Homo sapiens
gctcggttaagtacccgaggc

SEQ ID NO: 1025084 - DNA, 23 bp, Homo sapiens
gctcgtgtatcctggggctccct

SEQ ID NO: 1025085 - DNA, 21 bp, Homo sapiens
gctcgtttttcagcaccccca

SEQ ID NO: 1025086 - DNA, 23 bp, Homo sapiens
gctcgtttttcagcacccccacc

SEQ ID NO: 1025087 - DNA, 20 bp, Homo sapiens
gctctaaattaagacagcat

SEQ ID NO: 1025088 - DNA, 15 bp, Homo sapiens
gctctaacagccctc

SEQ ID NO: 1025089 - DNA, 16 bp, Homo sapiens
gctctaagcagccagg

SEQ ID NO: 1025090 - DNA, 20 bp, Homo sapiens
gctctaagcagccaggaggg

SEQ ID NO: 1025091 - DNA, 21 bp, Homo sapiens
gctctaagcagccaggaggga

SEQ ID NO: 1025092 - DNA, 20 bp, Homo sapiens
gctctaataagtttgtgtta

SEQ ID NO: 1025093 - DNA, 20 bp, Homo sapiens
gctctaatgagcatttcctt

SEQ ID NO: 1025094 - DNA, 18 bp, Homo sapiens
gctctaattcacagtgct

SEQ ID NO: 1025095 - DNA, 19 bp, Homo sapiens
gctctaattcacagtgctc

SEQ ID NO: 1025096 - DNA, 22 bp, Homo sapiens
gctctacagctaatcagcattc

SEQ ID NO: 1025097 - DNA, 19 bp, Homo sapiens
gctctacatcttctgcctt

SEQ ID NO: 1025098 - DNA, 15 bp, Homo sapiens
gctctacccatgagc

SEQ ID NO: 1025099 - DNA, 22 bp, Homo sapiens
gctctaccctgtctgtcccttt

SEQ ID NO: 1025100 - DNA, 22 bp, Homo sapiens
gctctaccttcctgtccctgag

SEQ ID NO: 1025101 - DNA, 23 bp, Homo sapiens
gctctaccttcctgtccctgagg

SEQ ID NO: 1025102 - DNA, 18 bp, Homo sapiens
gctctagacaaccctgca

SEQ ID NO: 1025103 - DNA, 13 bp, Homo sapiens
gctctagagagag

SEQ ID NO: 1025104 - DNA, 23 bp, Homo sapiens
gctctagattgagagaagagaca

SEQ ID NO: 1025105 - DNA, 14 bp, Homo sapiens
gctctagccaggag

SEQ ID NO: 1025106 - DNA, 14 bp, Homo sapiens
gctctagcctgggc

SEQ ID NO: 1025107 - DNA, 13 bp, Homo sapiens
gctctagctggca

SEQ ID NO: 1025108 - DNA, 19 bp, Homo sapiens
gctctagctggcaggacac

SEQ ID NO: 1025109 - DNA, 20 bp, Homo sapiens
gctctagctggcaggacaca

SEQ ID NO: 1025110 - DNA, 20 bp, Homo sapiens
gctctagggaatctggatta

SEQ ID NO: 1025111 - DNA, 22 bp, Homo sapiens
gctctagggactgccaggctgt

SEQ ID NO: 1025112 - DNA, 23 bp, Homo sapiens
gctctagggactgccaggctgtt

SEQ ID NO: 1025113 - DNA, 19 bp, Homo sapiens
gctctaggtacgatgacag

SEQ ID NO: 1025114 - DNA, 14 bp, Homo sapiens
gctctagtgggaag

SEQ ID NO: 1025115 - DNA, 22 bp, Homo sapiens
gctctagttttcagccttggga

SEQ ID NO: 1025116 - DNA, 14 bp, Homo sapiens
gctctatgcctgca

SEQ ID NO: 1025117 - DNA, 13 bp, Homo sapiens
gctctatgtctgc

SEQ ID NO: 1025118 - DNA, 15 bp, Homo sapiens
gctctatgtctgcct

SEQ ID NO: 1025119 - DNA, 14 bp, Homo sapiens
gctctatgtttgta

SEQ ID NO: 1025120 - DNA, 15 bp, Homo sapiens
gctctcaattaaagt

SEQ ID NO: 1025121 - DNA, 12 bp, Homo sapiens
gctctcagaagg

SEQ ID NO: 1025122 - DNA, 17 bp, Homo sapiens
gctctcagcctcccaca

SEQ ID NO: 1025123 - DNA, 16 bp, Homo sapiens
gctctcagctcagcgc

SEQ ID NO: 1025124 - DNA, 18 bp, Homo sapiens
gctctcagctcagcgcca

SEQ ID NO: 1025125 - DNA, 16 bp, Homo sapiens
gctctcagctttccct

SEQ ID NO: 1025126 - DNA, 12 bp, Homo sapiens
gctctcagttct

SEQ ID NO: 1025127 - DNA, 15 bp, Homo sapiens
gctctccaccaccca

SEQ ID NO: 1025128 - DNA, 16 bp, Homo sapiens
gctctccacctcagcc

SEQ ID NO: 1025129 - DNA, 19 bp, Homo sapiens
gctctccacctcagccttg

SEQ ID NO: 1025130 - DNA, 13 bp, Homo sapiens
gctctccaccttg

SEQ ID NO: 1025131 - DNA, 12 bp, Homo sapiens
gctctccaggcc

SEQ ID NO: 1025132 - DNA, 17 bp, Homo sapiens
gctctccaggccaggtg

SEQ ID NO: 1025133 - DNA, 18 bp, Homo sapiens
gctctccaggccaggtgg

SEQ ID NO: 1025134 - DNA, 12 bp, Homo sapiens
gctctcccaccc

SEQ ID NO: 1025135 - DNA, 23 bp, Homo sapiens
gctctcccagtgaactcctgcca

SEQ ID NO: 1025136 - DNA, 23 bp, Homo sapiens
gctctcccccttggatttgaact

SEQ ID NO: 1025137 - DNA, 23 bp, Homo sapiens
gctctccccggcaggcctgagaa

SEQ ID NO: 1025138 - DNA, 16 bp, Homo sapiens
gctctcccctcccttg

SEQ ID NO: 1025139 - DNA, 20 bp, Homo sapiens
gctctcccctcccttgtcct

SEQ ID NO: 1025140 - DNA, 14 bp, Homo sapiens
gctctcccctcctg

SEQ ID NO: 1025141 - DNA, 19 bp, Homo sapiens
gctctcccctgccctgctg

SEQ ID NO: 1025142 - DNA, 15 bp, Homo sapiens
gctctccctctggcc

SEQ ID NO: 1025143 - DNA, 17 bp, Homo sapiens
gctctccctctggccct

SEQ ID NO: 1025144 - DNA, 16 bp, Homo sapiens
gctctccctcttctca

SEQ ID NO: 1025145 - DNA, 21 bp, Homo sapiens
gctctccctcttctcaagtgc

SEQ ID NO: 1025146 - DNA, 23 bp, Homo sapiens
gctctccctcttctcaagtgcct

SEQ ID NO: 1025147 - DNA, 24 bp, Homo sapiens
gctctccctcttctcaagtgcctt

SEQ ID NO: 1025148 - DNA, 18 bp, Homo sapiens
gctctcccttgtttactc

SEQ ID NO: 1025149 - DNA, 22 bp, Homo sapiens
gctctccggggccatttgcaat

SEQ ID NO: 1025150 - DNA, 19 bp, Homo sapiens
gctctcctcgagccctccc

SEQ ID NO: 1025151 - DNA, 15 bp, Homo sapiens
gctctcctcttgcca

SEQ ID NO: 1025152 - DNA, 19 bp, Homo sapiens
gctctcctcttgccactgc

SEQ ID NO: 1025153 - DNA, 14 bp, Homo sapiens
gctctcctgacttt

SEQ ID NO: 1025154 - DNA, 16 bp, Homo sapiens
gctctcctgactttta

SEQ ID NO: 1025155 - DNA, 14 bp, Homo sapiens
gctctcctggccct

SEQ ID NO: 1025156 - DNA, 12 bp, Homo sapiens
gctctcctggct

SEQ ID NO: 1025157 - DNA, 18 bp, Homo sapiens
gctctcctggctccctcc

SEQ ID NO: 1025158 - DNA, 16 bp, Homo sapiens
gctctcgaggaaagtg

SEQ ID NO: 1025159 - DNA, 19 bp, Homo sapiens
gctctcgcacacctctgca

SEQ ID NO: 1025160 - DNA, 18 bp, Homo sapiens
gctctcgttctccttccc

SEQ ID NO: 1025161 - DNA, 15 bp, Homo sapiens
gctctctaggcctct

SEQ ID NO: 1025162 - DNA, 19 bp, Homo sapiens
gctctctaggcctctccag

SEQ ID NO: 1025163 - DNA, 19 bp, Homo sapiens
gctctctcacccagcctgg

SEQ ID NO: 1025164 - DNA, 22 bp, Homo sapiens
gctctctctacccggcccagag

SEQ ID NO: 1025165 - DNA, 16 bp, Homo sapiens
tctcatgtccctccag

SEQ ID NO: 1025166 - DNA, 17 bp, Homo sapiens
tctcatgttccttttga

SEQ ID NO: 1025167 - DNA, 18 bp, Homo sapiens
tctcatgttttccattgt

SEQ ID NO: 1025168 - DNA, 20 bp, Homo sapiens
tctcattaaaagaatatctg

SEQ ID NO: 1025169 - DNA, 17 bp, Homo sapiens
tctcattaaaatccagt

SEQ ID NO: 1025170 - DNA, 13 bp, Homo sapiens
tctcattcagtat

SEQ ID NO: 1025171 - DNA, 19 bp, Homo sapiens
tctcattccaacagtgagt

SEQ ID NO: 1025172 - DNA, 10 bp, Homo sapiens
tctcattccc

SEQ ID NO: 1025173 - DNA, 21 bp, Homo sapiens
tctcattcccagagtcagagg

SEQ ID NO: 1025174 - DNA, 13 bp, Homo sapiens
tctcattccccag

SEQ ID NO: 1025175 - DNA, 18 bp, Homo sapiens
tctcattccgttgtctgt

SEQ ID NO: 1025176 - DNA, 16 bp, Homo sapiens
tctcattcgcctttgt

SEQ ID NO: 1025177 - DNA, 18 bp, Homo sapiens
tctcattcgcctttgtct

SEQ ID NO: 1025178 - DNA, 21 bp, Homo sapiens
tctcattcgcctttgtcttgt

SEQ ID NO: 1025179 - DNA, 22 bp, Homo sapiens
tctcattcgcctttgtcttgta

SEQ ID NO: 1025180 - DNA, 14 bp, Homo sapiens
tctcattctttgaa

SEQ ID NO: 1025181 - DNA, 18 bp, Homo sapiens
tctcattctttgaacatg

SEQ ID NO: 1025182 - DNA, 19 bp, Homo sapiens
tctcattggacccttccat

SEQ ID NO: 1025183 - DNA, 12 bp, Homo sapiens
tctcattgtctt

SEQ ID NO: 1025184 - DNA, 22 bp, Homo sapiens
tctcattgtcttgttatgtaca

SEQ ID NO: 1025185 - DNA, 22 bp, Homo sapiens
tctccccaaccctaggttccct

SEQ ID NO: 1025186 - DNA, 21 bp, Homo sapiens
tctccccaatccatgcttcac

SEQ ID NO: 1025187 - DNA, 14 bp, Homo sapiens
tctccccaccccta

SEQ ID NO: 1025188 - DNA, 19 bp, Homo sapiens
tctccccactccaccctgt

SEQ ID NO: 1025189 - DNA, 20 bp, Homo sapiens
tctccccaggcatttgccaa

SEQ ID NO: 1025190 - DNA, 13 bp, Homo sapiens
tctccccaggcct

SEQ ID NO: 1025191 - DNA, 16 bp, Homo sapiens
tctccccaggcctcca

SEQ ID NO: 1025192 - DNA, 20 bp, Homo sapiens
tctccccaggcctccagcct

SEQ ID NO: 1025193 - DNA, 19 bp, Homo sapiens
tctccccagtgcctgccac

SEQ ID NO: 1025194 - DNA, 19 bp, Homo sapiens
tctcccccatagcaccctg

SEQ ID NO: 1025195 - DNA, 15 bp, Homo sapiens
tctccccccatccca

SEQ ID NO: 1025196 - DNA, 19 bp, Homo sapiens
tctccccccatcccagggt

SEQ ID NO: 1025197 - DNA, 19 bp, Homo sapiens
tctcccccgacactgctgc

SEQ ID NO: 1025198 - DNA, 14 bp, Homo sapiens
tctcccccgccctg

SEQ ID NO: 1025199 - DNA, 13 bp, Homo sapiens
tctccccctgggc

SEQ ID NO: 1025200 - DNA, 14 bp, Homo sapiens
tctcccccttcagc

SEQ ID NO: 1025201 - DNA, 17 bp, Homo sapiens
tctcccccttcagctcc

SEQ ID NO: 1025202 - DNA, 19 bp, Homo sapiens
tctcccccttcagctcctg

SEQ ID NO: 1025203 - DNA, 20 bp, Homo sapiens
tctcccccttcagctcctga

SEQ ID NO: 1025204 - DNA, 21 bp, Homo sapiens
tctcccccttcagctcctgag

SEQ ID NO: 1025205 - DNA, 22 bp, Homo sapiens
tctcccccttgccctcattctt

SEQ ID NO: 1025206 - DNA, 18 bp, Homo sapiens
tctcccccttgtcttccc

SEQ ID NO: 1025207 - DNA, 19 bp, Homo sapiens
tctcccccttgtcttcccc

SEQ ID NO: 1025208 - DNA, 19 bp, Homo sapiens
tctcccctattttttggta

SEQ ID NO: 1025209 - DNA, 21 bp, Homo sapiens
tctcccctcacatcctcctgc

SEQ ID NO: 1025210 - DNA, 13 bp, Homo sapiens
tctcccctcagag

SEQ ID NO: 1025211 - DNA, 18 bp, Homo sapiens
tctcccctcagagtgcaa

SEQ ID NO: 1025212 - DNA, 17 bp, Homo sapiens
tctcccctgccctgctg

SEQ ID NO: 1025213 - DNA, 22 bp, Homo sapiens
tctcccctgcccttcctcctga

SEQ ID NO: 1025214 - DNA, 23 bp, Homo sapiens
tctccccttcctggacacactct

SEQ ID NO: 1025215 - DNA, 18 bp, Homo sapiens
tctccccttggttctgca

SEQ ID NO: 1025216 - DNA, 17 bp, Homo sapiens
tctcccgccccccacac

SEQ ID NO: 1025217 - DNA, 15 bp, Homo sapiens
tctcccgctgctgct

SEQ ID NO: 1025218 - DNA, 14 bp, Homo sapiens
tctcccggccctca

SEQ ID NO: 1025219 - DNA, 15 bp, Homo sapiens
tctcccggctgcctg

SEQ ID NO: 1025220 - DNA, 16 bp, Homo sapiens
tctcccggctgcctgc

SEQ ID NO: 1025221 - DNA, 17 bp, Homo sapiens
tctcccggctgcctgcc

SEQ ID NO: 1025222 - DNA, 22 bp, Homo sapiens
tctccctacctccctcctcagg

SEQ ID NO: 1025223 - DNA, 19 bp, Homo sapiens
tctccctcaactgaagggg

SEQ ID NO: 1025224 - DNA, 23 bp, Homo sapiens
tctccctcaactgaaggggtgca

SEQ ID NO: 1025225 - DNA, 22 bp, Homo sapiens
tctccctccccaaatggctgct

SEQ ID NO: 1025226 - DNA, 23 bp, Homo sapiens
tctccctccccaaatggctgctt

SEQ ID NO: 1025227 - DNA, 19 bp, Homo sapiens
tctccctcccctctcagaa

SEQ ID NO: 1025228 - DNA, 23 bp, Homo sapiens
tctccctcccctctcagaacata

SEQ ID NO: 1025229 - DNA, 19 bp, Homo sapiens
tctccctccgactccagat

SEQ ID NO: 1025230 - DNA, 21 bp, Homo sapiens
tctccctcgggggctcttccc

SEQ ID NO: 1025231 - DNA, 17 bp, Homo sapiens
tctccctctcatgtccc

SEQ ID NO: 1025232 - DNA, 23 bp, Homo sapiens
tctccctctcatgtccctccagg

SEQ ID NO: 1025233 - DNA, 14 bp, Homo sapiens
tctccctctcctgc

SEQ ID NO: 1025234 - DNA, 13 bp, Homo sapiens
tctccctctggtc

SEQ ID NO: 1025235 - DNA, 16 bp, Homo sapiens
tctccctctggtccca

SEQ ID NO: 1025236 - DNA, 21 bp, Homo sapiens
tctccctctgtcttttctcct

SEQ ID NO: 1025237 - DNA, 15 bp, Homo sapiens
tctccctcttctcaa

SEQ ID NO: 1025238 - DNA, 14 bp, Homo sapiens
tctccctgacattt

SEQ ID NO: 1025239 - DNA, 12 bp, Homo sapiens
tctccctgacct

SEQ ID NO: 1025240 - DNA, 13 bp, Homo sapiens
tctccctgacctt

SEQ ID NO: 1025241 - DNA, 14 bp, Homo sapiens
tctccctgcagcct

SEQ ID NO: 1025242 - DNA, 13 bp, Homo sapiens
tctccctgccatc

SEQ ID NO: 1025243 - DNA, 14 bp, Homo sapiens
tctccctgccatcc

SEQ ID NO: 1025244 - DNA, 13 bp, Homo sapiens
tctccctgcctgg

SEQ ID NO: 1025245 - DNA, 12 bp, Homo sapiens
tctccctgcctt

SEQ ID NO: 1025246 - DNA, 14 bp, Homo sapiens
tctccctgccttta

SEQ ID NO: 1025247 - DNA, 22 bp, Homo sapiens
tctccctggatctacctggagg

SEQ ID NO: 1025248 - DNA, 19 bp, Homo sapiens
tctccctggccacccttgg

SEQ ID NO: 1025249 - DNA, 21 bp, Homo sapiens
tctccctgggaagcctgtgcc

SEQ ID NO: 1025250 - DNA, 16 bp, Homo sapiens
tctccctggtgcctct

SEQ ID NO: 1025251 - DNA, 20 bp, Homo sapiens
tctccctggtgcctctgtgc

SEQ ID NO: 1025252 - DNA, 20 bp, Homo sapiens
tctccctgtgttctgggctg

SEQ ID NO: 1025253 - DNA, 23 bp, Homo sapiens
tctcccttcccttccctcacccc

SEQ ID NO: 1025254 - DNA, 17 bp, Homo sapiens
tctcccttcctctctcc

SEQ ID NO: 1025255 - DNA, 21 bp, Homo sapiens
tctcccttcttgggtctgccc

SEQ ID NO: 1025256 - DNA, 19 bp, Homo sapiens
tctcccttgtttactctgt

SEQ ID NO: 1025257 - DNA, 18 bp, Homo sapiens
tctccctttatgtatctc

SEQ ID NO: 1025258 - DNA, 15 bp, Homo sapiens
tctccctttcccttc

SEQ ID NO: 1025259 - DNA, 13 bp, Homo sapiens
tctccctttctct

SEQ ID NO: 1025260 - DNA, 14 bp, Homo sapiens
tctccctttctctc

SEQ ID NO: 1025261 - DNA, 17 bp, Homo sapiens
tctccctttctctctcc

SEQ ID NO: 1025262 - DNA, 15 bp, Homo sapiens
tctcccttttccatg

SEQ ID NO: 1025263 - DNA, 12 bp, Homo sapiens
tctccgaaagaa

SEQ ID NO: 1025264 - DNA, 16 bp, Homo sapiens
tctccgaaagaagaca

SEQ ID NO: 1025265 - DNA, 17 bp, Homo sapiens
tctccgcattggaagag

SEQ ID NO: 1025266 - DNA, 21 bp, Homo sapiens
tctccgcattggaagagcccg

SEQ ID NO: 1025267 - DNA, 13 bp, Homo sapiens
tctccgccagcct

SEQ ID NO: 1025268 - DNA, 18 bp, Homo sapiens
tctccgccagcctcctct

SEQ ID NO: 1025269 - DNA, 21 bp, Homo sapiens
tctccgccagcctcctctgga

SEQ ID NO: 1025270 - DNA, 13 bp, Homo sapiens
tctccgcgcctac

SEQ ID NO: 1025271 - DNA, 13 bp, Homo sapiens
tctccggggtctg

SEQ ID NO: 1025272 - DNA, 20 bp, Homo sapiens
tctccggggtctgtgctgtg

SEQ ID NO: 1025273 - DNA, 14 bp, Homo sapiens
tctccgggtcctcc

SEQ ID NO: 1025274 - DNA, 21 bp, Homo sapiens
tctccgggtgtggcctcagcc

SEQ ID NO: 1025275 - DNA, 21 bp, Homo sapiens
tctccgttagctcctgtggcc

SEQ ID NO: 1025276 - DNA, 14 bp, Homo sapiens
tctcctactctgtg

SEQ ID NO: 1025277 - DNA, 15 bp, Homo sapiens
tctcctactctgtgt

SEQ ID NO: 1025278 - DNA, 17 bp, Homo sapiens
tctcctactctgtgtaa

SEQ ID NO: 1025279 - DNA, 21 bp, Homo sapiens
tctcctacttagggaagaaaa

SEQ ID NO: 1025280 - DNA, 14 bp, Homo sapiens
tctcctagcccctc

SEQ ID NO: 1025281 - DNA, 17 bp, Homo sapiens
tctcctataatctgtca

SEQ ID NO: 1025282 - DNA, 19 bp, Homo sapiens
tctcctatatatttctatt

SEQ ID NO: 1025283 - DNA, 16 bp, Homo sapiens
tctcctcaagcctgtg

SEQ ID NO: 1025284 - DNA, 20 bp, Homo sapiens
tctcctcaagcctgtgggca

SEQ ID NO: 1025285 - DNA, 23 bp, Homo sapiens
tctcctcaagcctgtgggcagca

SEQ ID NO: 1025286 - DNA, 20 bp, Homo sapiens
tctcctcaagtccccaagat

SEQ ID NO: 1025287 - DNA, 19 bp, Homo sapiens
tctcctcactctgtccctg

SEQ ID NO: 1025288 - DNA, 21 bp, Homo sapiens
tctcctcagacagtaaccatg

SEQ ID NO: 1025289 - DNA, 13 bp, Homo sapiens
tctcctcaggaca

SEQ ID NO: 1025290 - DNA, 19 bp, Homo sapiens
tctcctcaggaccctcagc

SEQ ID NO: 1025291 - DNA, 20 bp, Homo sapiens
tctcctcaggaccctcagcc

SEQ ID NO: 1025292 - DNA, 12 bp, Homo sapiens
tctcctcagggt

SEQ ID NO: 1025293 - DNA, 17 bp, Homo sapiens
tctcctcatccatttct

SEQ ID NO: 1025294 - DNA, 18 bp, Homo sapiens
tctcctccatactcagga

SEQ ID NO: 1025295 - DNA, 16 bp, Homo sapiens
tctcctccatgggaga

SEQ ID NO: 1025296 - DNA, 16 bp, Homo sapiens
tctcctccccacctgt

SEQ ID NO: 1025297 - DNA, 14 bp, Homo sapiens
gctctctctccctg

SEQ ID NO: 1025298 - DNA, 18 bp, Homo sapiens
gctctctctccctgcctt

SEQ ID NO: 1025299 - DNA, 20 bp, Homo sapiens
gctctctctccctgccttta

SEQ ID NO: 1025300 - DNA, 13 bp, Homo sapiens
gctctctgacccg

SEQ ID NO: 1025301 - DNA, 22 bp, Homo sapiens
gctctctgacccggttgcagtc

SEQ ID NO: 1025302 - DNA, 23 bp, Homo sapiens
gctctctgacgtcaacccaagct

SEQ ID NO: 1025303 - DNA, 11 bp, Homo sapiens
gctctctgagg

SEQ ID NO: 1025304 - DNA, 13 bp, Homo sapiens
gctctctgcagcc

SEQ ID NO: 1025305 - DNA, 15 bp, Homo sapiens
gctctctgcagccag

SEQ ID NO: 1025306 - DNA, 17 bp, Homo sapiens
gctctctgcagccagcc

SEQ ID NO: 1025307 - DNA, 19 bp, Homo sapiens
gctctctgcagccagccca

SEQ ID NO: 1025308 - DNA, 20 bp, Homo sapiens
gctctctgcagccagcccag

SEQ ID NO: 1025309 - DNA, 22 bp, Homo sapiens
gctctctgcagccagcccagcc

SEQ ID NO: 1025310 - DNA, 12 bp, Homo sapiens
gctctctgccct

SEQ ID NO: 1025311 - DNA, 16 bp, Homo sapiens
gctctctgctcatggg

SEQ ID NO: 1025312 - DNA, 11 bp, Homo sapiens
gctctctgctg

SEQ ID NO: 1025313 - DNA, 18 bp, Homo sapiens
gctctctggccttttcct

SEQ ID NO: 1025314 - DNA, 13 bp, Homo sapiens
gctctctgggctt

SEQ ID NO: 1025315 - DNA, 21 bp, Homo sapiens
gctctctgtaggcacagagct

SEQ ID NO: 1025316 - DNA, 13 bp, Homo sapiens
gctctcttcctgc

SEQ ID NO: 1025317 - DNA, 14 bp, Homo sapiens
gctctcttcctgcc

SEQ ID NO: 1025318 - DNA, 15 bp, Homo sapiens
gctctcttcctgccc

SEQ ID NO: 1025319 - DNA, 18 bp, Homo sapiens
gctctcttcctgcccctc

SEQ ID NO: 1025320 - DNA, 23 bp, Homo sapiens
gctctcttcctgcccctctttct

SEQ ID NO: 1025321 - DNA, 14 bp, Homo sapiens
gctctctttctgtc

SEQ ID NO: 1025322 - DNA, 14 bp, Homo sapiens
gctctctttgcaac

SEQ ID NO: 1025323 - DNA, 16 bp, Homo sapiens
gctctgaaaccagtgt

SEQ ID NO: 1025324 - DNA, 22 bp, Homo sapiens
gctctgaacacacacgccagct

SEQ ID NO: 1025325 - DNA, 24 bp, Homo sapiens
gctctgaacacacacgccagctcc

SEQ ID NO: 1025326 - DNA, 19 bp, Homo sapiens
gctctgaatctgtacatgt

SEQ ID NO: 1025327 - DNA, 15 bp, Homo sapiens
gctctgacatccctt

SEQ ID NO: 1025328 - DNA, 16 bp, Homo sapiens
gctctgacatcccttc

SEQ ID NO: 1025329 - DNA, 20 bp, Homo sapiens
gctctgacatcccttcctgg

SEQ ID NO: 1025330 - DNA, 17 bp, Homo sapiens
gctctgacccagtgaga

SEQ ID NO: 1025331 - DNA, 15 bp, Homo sapiens
gctctgacgtagaaa

SEQ ID NO: 1025332 - DNA, 22 bp, Homo sapiens
gctctgacgtagaaagatcctt

SEQ ID NO: 1025333 - DNA, 21 bp, Homo sapiens
gctctgagacccttttctcag

SEQ ID NO: 1025334 - DNA, 15 bp, Homo sapiens
gctctgagcacaggt

SEQ ID NO: 1025335 - DNA, 17 bp, Homo sapiens
gctctgagcacaggtga

SEQ ID NO: 1025336 - DNA, 16 bp, Homo sapiens
gctctgagcaggggca

SEQ ID NO: 1025337 - DNA, 18 bp, Homo sapiens
gctctgagcaggggcagg

SEQ ID NO: 1025338 - DNA, 21 bp, Homo sapiens
gctctgagcaggggcaggcgc

SEQ ID NO: 1025339 - DNA, 22 bp, Homo sapiens
gctctgagcaggggcaggcgca

SEQ ID NO: 1025340 - DNA, 17 bp, Homo sapiens
gctctgagcgcctccat

SEQ ID NO: 1025341 - DNA, 20 bp, Homo sapiens
gctctgaggcttccagagag

SEQ ID NO: 1025342 - DNA, 17 bp, Homo sapiens
gctctgaggggaggcac

SEQ ID NO: 1025343 - DNA, 23 bp, Homo sapiens
gctctgaggtcaataaagcagag

SEQ ID NO: 1025344 - DNA, 22 bp, Homo sapiens
gctctgaggtcccttcaaggcc

SEQ ID NO: 1025345 - DNA, 21 bp, Homo sapiens
gctctgatattccatgaatgt

SEQ ID NO: 1025346 - DNA, 23 bp, Homo sapiens
gctctgcaattcccctctgctgc

SEQ ID NO: 1025347 - DNA, 17 bp, Homo sapiens
gctctgcacccctctgc

SEQ ID NO: 1025348 - DNA, 15 bp, Homo sapiens
gctctgcaggctggg

SEQ ID NO: 1025349 - DNA, 16 bp, Homo sapiens
gctctgcaggctgggg

SEQ ID NO: 1025350 - DNA, 17 bp, Homo sapiens
gctctgcaggctgggga

SEQ ID NO: 1025351 - DNA, 20 bp, Homo sapiens
gctctgccaatgtgggctgc

SEQ ID NO: 1025352 - DNA, 18 bp, Homo sapiens
gctctgccaccctacctg

SEQ ID NO: 1025353 - DNA, 15 bp, Homo sapiens
gctctgccatcttca

SEQ ID NO: 1025354 - DNA, 13 bp, Homo sapiens
gctctgcccacct

SEQ ID NO: 1025355 - DNA, 17 bp, Homo sapiens
gctctgcccacctctct

SEQ ID NO: 1025356 - DNA, 21 bp, Homo sapiens
gctctgccccaccttgccagg

SEQ ID NO: 1025357 - DNA, 12 bp, Homo sapiens
gctctgccccag

SEQ ID NO: 1025358 - DNA, 18 bp, Homo sapiens
gctctgccccagctctgg

SEQ ID NO: 1025359 - DNA, 13 bp, Homo sapiens
gctctgccccagg

SEQ ID NO: 1025360 - DNA, 18 bp, Homo sapiens
gctctgccccctccccca

SEQ ID NO: 1025361 - DNA, 14 bp, Homo sapiens
gctctgcccctcag

SEQ ID NO: 1025362 - DNA, 17 bp, Homo sapiens
gctctgcccctcagggg

SEQ ID NO: 1025363 - DNA, 19 bp, Homo sapiens
gctctgcccctcagggggc

SEQ ID NO: 1025364 - DNA, 17 bp, Homo sapiens
gctctgccgtctctgga

SEQ ID NO: 1025365 - DNA, 22 bp, Homo sapiens
gctctgcctcagacgttgcctg

SEQ ID NO: 1025366 - DNA, 23 bp, Homo sapiens
gctctgcctcagacgttgcctga

SEQ ID NO: 1025367 - DNA, 23 bp, Homo sapiens
gctctgcctccctctccatatct

SEQ ID NO: 1025368 - DNA, 16 bp, Homo sapiens
gctctgcgccaggcag

SEQ ID NO: 1025369 - DNA, 17 bp, Homo sapiens
gctctgcgtgtcacctg

SEQ ID NO: 1025370 - DNA, 22 bp, Homo sapiens
gctctgcgtgtcacctgtgctt

SEQ ID NO: 1025371 - DNA, 15 bp, Homo sapiens
gctctgctggcctgg

SEQ ID NO: 1025372 - DNA, 17 bp, Homo sapiens
gctctgctggcctggcc

SEQ ID NO: 1025373 - DNA, 22 bp, Homo sapiens
gctctggaaaatgtgacccaga

SEQ ID NO: 1025374 - DNA, 14 bp, Homo sapiens
gctctggaagagag

SEQ ID NO: 1025375 - DNA, 24 bp, Homo sapiens
gctctggaataaagttgcagatga

SEQ ID NO: 1025376 - DNA, 20 bp, Homo sapiens
gctctggacagcagaagcct

SEQ ID NO: 1025377 - DNA, 22 bp, Homo sapiens
gctctggaccaaccctgtttcc

SEQ ID NO: 1025378 - DNA, 13 bp, Homo sapiens
gctctggacctca

SEQ ID NO: 1025379 - DNA, 22 bp, Homo sapiens
gctctggacctcaggagggcag

SEQ ID NO: 1025380 - DNA, 16 bp, Homo sapiens
gctctggagcagccaa

SEQ ID NO: 1025381 - DNA, 16 bp, Homo sapiens
gctctggagccagaga

SEQ ID NO: 1025382 - DNA, 22 bp, Homo sapiens
gctctggagccagagagacaga

SEQ ID NO: 1025383 - DNA, 15 bp, Homo sapiens
gctctggaggggagg

SEQ ID NO: 1025384 - DNA, 14 bp, Homo sapiens
gctctggaggtgct

SEQ ID NO: 1025385 - DNA, 20 bp, Homo sapiens
gctctggaggtgctgctcta

SEQ ID NO: 1025386 - DNA, 14 bp, Homo sapiens
gctctggagtgtgc

SEQ ID NO: 1025387 - DNA, 13 bp, Homo sapiens
gctctggccaccc

SEQ ID NO: 1025388 - DNA, 14 bp, Homo sapiens
gctctggccaccct

SEQ ID NO: 1025389 - DNA, 15 bp, Homo sapiens
gctctggccaccctg

SEQ ID NO: 1025390 - DNA, 17 bp, Homo sapiens
gctctggccaccctggc

SEQ ID NO: 1025391 - DNA, 21 bp, Homo sapiens
gctctggcggcttcctgtcca

SEQ ID NO: 1025392 - DNA, 16 bp, Homo sapiens
gctctggctgaaccct

SEQ ID NO: 1025393 - DNA, 19 bp, Homo sapiens
gctctggcttcctgctgag

SEQ ID NO: 1025394 - DNA, 14 bp, Homo sapiens
gctctggcttgccc

SEQ ID NO: 1025395 - DNA, 23 bp, Homo sapiens
gctctggcttgccccaggactct

SEQ ID NO: 1025396 - DNA, 15 bp, Homo sapiens
gctctgggagaggat

SEQ ID NO: 1025397 - DNA, 18 bp, Homo sapiens
gctctgggagccacgcct

SEQ ID NO: 1025398 - DNA, 17 bp, Homo sapiens
gctctgggatcctgggg

SEQ ID NO: 1025399 - DNA, 13 bp, Homo sapiens
gctctgggcacag

SEQ ID NO: 1025400 - DNA, 15 bp, Homo sapiens
gctctgggcacagtg

SEQ ID NO: 1025401 - DNA, 18 bp, Homo sapiens
gctctgggcacagtgctg

SEQ ID NO: 1025402 - DNA, 17 bp, Homo sapiens
gctctgggctcactgca

SEQ ID NO: 1025403 - DNA, 15 bp, Homo sapiens
gctctgggctcaggg

SEQ ID NO: 1025404 - DNA, 16 bp, Homo sapiens
gctctgggctcagggc

SEQ ID NO: 1025405 - DNA, 20 bp, Homo sapiens
gctctgggctcagggctgga

SEQ ID NO: 1025406 - DNA, 21 bp, Homo sapiens
gctctgggctcagggctggag

SEQ ID NO: 1025407 - DNA, 17 bp, Homo sapiens
gctctggggacagcttc

SEQ ID NO: 1025408 - DNA, 21 bp, Homo sapiens
gctctggggacagcttcctca

SEQ ID NO: 1025409 - DNA, 20 bp, Homo sapiens
gctctggggtatgtgtgtgt

SEQ ID NO: 1025410 - DNA, 23 bp, Homo sapiens
gctctggtccaggccctgtggca

SEQ ID NO: 1025411 - DNA, 15 bp, Homo sapiens
gctctggtgcacgcc

SEQ ID NO: 1025412 - DNA, 23 bp, Homo sapiens
gctctggtggcttaagtgagcag

SEQ ID NO: 1025413 - DNA, 19 bp, Homo sapiens
gctctggttgtttctgttc

SEQ ID NO: 1025414 - DNA, 20 bp, Homo sapiens
gctctggttgtttctgttcc

SEQ ID NO: 1025415 - DNA, 22 bp, Homo sapiens
gctctggttgtttctgttccaa

SEQ ID NO: 1025416 - DNA, 17 bp, Homo sapiens
gctctgtcactccaggc

SEQ ID NO: 1025417 - DNA, 15 bp, Homo sapiens
gctctgtccagaggc

SEQ ID NO: 1025418 - DNA, 16 bp, Homo sapiens
gctctgtcccccaggc

SEQ ID NO: 1025419 - DNA, 15 bp, Homo sapiens
gctctgtctacccag

SEQ ID NO: 1025420 - DNA, 19 bp, Homo sapiens
gctctgtctcccaggctgg

SEQ ID NO: 1025421 - DNA, 17 bp, Homo sapiens
tctcctccccacctgta

SEQ ID NO: 1025422 - DNA, 19 bp, Homo sapiens
tctcctccccacctgtagc

SEQ ID NO: 1025423 - DNA, 13 bp, Homo sapiens
tctcctccctggg

SEQ ID NO: 1025424 - DNA, 13 bp, Homo sapiens
tctcctcccttcc

SEQ ID NO: 1025425 - DNA, 23 bp, Homo sapiens
tctcctcccttccttttccctgc

SEQ ID NO: 1025426 - DNA, 14 bp, Homo sapiens
tctcctcctcccct

SEQ ID NO: 1025427 - DNA, 15 bp, Homo sapiens
tctcctcctcccctc

SEQ ID NO: 1025428 - DNA, 18 bp, Homo sapiens
tctctacccggcccagag

SEQ ID NO: 1025429 - DNA, 19 bp, Homo sapiens
tctctacccggcccagaga

SEQ ID NO: 1025430 - DNA, 13 bp, Homo sapiens
tctctacctccac

SEQ ID NO: 1025431 - DNA, 14 bp, Homo sapiens
tctctactaaaaat

SEQ ID NO: 1025432 - DNA, 18 bp, Homo sapiens
tctctactaaaaatacaa

SEQ ID NO: 1025433 - DNA, 19 bp, Homo sapiens
tctctactcctacctcagc

SEQ ID NO: 1025434 - DNA, 20 bp, Homo sapiens
tctctactcctacctcagcc

SEQ ID NO: 1025435 - DNA, 21 bp, Homo sapiens
tctctactcctacctcagcct

SEQ ID NO: 1025436 - DNA, 23 bp, Homo sapiens
tctctagagggttgctgcctttc

SEQ ID NO: 1025437 - DNA, 24 bp, Homo sapiens
tctctagcttaagtgtaaatgaag

SEQ ID NO: 1025438 - DNA, 17 bp, Homo sapiens
tctctagtgctgtgaaa

SEQ ID NO: 1025439 - DNA, 13 bp, Homo sapiens
tctctataaaaaa

SEQ ID NO: 1025440 - DNA, 14 bp, Homo sapiens
tctctatattatgt

SEQ ID NO: 1025441 - DNA, 18 bp, Homo sapiens
tctctatattatgtcttc

SEQ ID NO: 1025442 - DNA, 14 bp, Homo sapiens
tctctatgtactat

SEQ ID NO: 1025443 - DNA, 19 bp, Homo sapiens
tctctatgtttattctagt

SEQ ID NO: 1025444 - DNA, 17 bp, Homo sapiens
tctctattggaggtgag

SEQ ID NO: 1025445 - DNA, 16 bp, Homo sapiens
tctctcaatatgctta

SEQ ID NO: 1025446 - DNA, 20 bp, Homo sapiens
tctctcaatatgcttacaaa

SEQ ID NO: 1025447 - DNA, 13 bp, Homo sapiens
tctctcacccacc

SEQ ID NO: 1025448 - DNA, 14 bp, Homo sapiens
tctctcacccacca

SEQ ID NO: 1025449 - DNA, 15 bp, Homo sapiens
tctctcacccaccag

SEQ ID NO: 1025450 - DNA, 19 bp, Homo sapiens
tctctcacccaccagctcc

SEQ ID NO: 1025451 - DNA, 17 bp, Homo sapiens
tctctcacccagcctgg

SEQ ID NO: 1025452 - DNA, 13 bp, Homo sapiens
tctctcagcccca

SEQ ID NO: 1025453 - DNA, 15 bp, Homo sapiens
tctctcagccccatc

SEQ ID NO: 1025454 - DNA, 19 bp, Homo sapiens
tctctcagccccatcgccc

SEQ ID NO: 1025455 - DNA, 15 bp, Homo sapiens
tctctcaggagcaca

SEQ ID NO: 1025456 - DNA, 17 bp, Homo sapiens
tctctcaggagcacagg

SEQ ID NO: 1025457 - DNA, 19 bp, Homo sapiens
tctctcaggagcacaggca

SEQ ID NO: 1025458 - DNA, 12 bp, Homo sapiens
tctctcagtgaa

SEQ ID NO: 1025459 - DNA, 17 bp, Homo sapiens
tctctcatctaactgat

SEQ ID NO: 1025460 - DNA, 21 bp, Homo sapiens
tctctccacttctggtcccct

SEQ ID NO: 1025461 - DNA, 18 bp, Homo sapiens
tctctccagctgactaaa

SEQ ID NO: 1025462 - DNA, 13 bp, Homo sapiens
tctctccaggatc

SEQ ID NO: 1025463 - DNA, 14 bp, Homo sapiens
tctctccattcccg

SEQ ID NO: 1025464 - DNA, 21 bp, Homo sapiens
tctctcccaccccggcctcca

SEQ ID NO: 1025465 - DNA, 22 bp, Homo sapiens
tctctcccaccccggcctccac

SEQ ID NO: 1025466 - DNA, 13 bp, Homo sapiens
tctctcccaccct

SEQ ID NO: 1025467 - DNA, 14 bp, Homo sapiens
tctctcccacttcc

SEQ ID NO: 1025468 - DNA, 15 bp, Homo sapiens
tctctcccacttcct

SEQ ID NO: 1025469 - DNA, 21 bp, Homo sapiens
tctctcccacttcctcctacc

SEQ ID NO: 1025470 - DNA, 22 bp, Homo sapiens
tctctcccacttcctcctacct

SEQ ID NO: 1025471 - DNA, 19 bp, Homo sapiens
tctctccccctatttattg

SEQ ID NO: 1025472 - DNA, 23 bp, Homo sapiens
tctctccctacctccctcctcag

SEQ ID NO: 1025473 - DNA, 13 bp, Homo sapiens
tctctccctctgt

SEQ ID NO: 1025474 - DNA, 15 bp, Homo sapiens
tctctccctgtcaca

SEQ ID NO: 1025475 - DNA, 16 bp, Homo sapiens
tctctcctagcccctc

SEQ ID NO: 1025476 - DNA, 21 bp, Homo sapiens
tctctcctcaggaccctcagc

SEQ ID NO: 1025477 - DNA, 17 bp, Homo sapiens
tctctcctgaactgctt

SEQ ID NO: 1025478 - DNA, 11 bp, Homo sapiens
tctctcctggc

SEQ ID NO: 1025479 - DNA, 22 bp, Homo sapiens
tctctcctggtgtgggtaaagg

SEQ ID NO: 1025480 - DNA, 16 bp, Homo sapiens
tctctcctgtacctct

SEQ ID NO: 1025481 - DNA, 20 bp, Homo sapiens
tctctcctgtacctcttgag

SEQ ID NO: 1025482 - DNA, 15 bp, Homo sapiens
tctctccttgccccc

SEQ ID NO: 1025483 - DNA, 13 bp, Homo sapiens
tctctccttggcc

SEQ ID NO: 1025484 - DNA, 22 bp, Homo sapiens
tctctcctttctttttcttctt

SEQ ID NO: 1025485 - DNA, 18 bp, Homo sapiens
tctctcggagccctcaga

SEQ ID NO: 1025486 - DNA, 15 bp, Homo sapiens
tctctcggccccctc

SEQ ID NO: 1025487 - DNA, 18 bp, Homo sapiens
tctctcggccccctcacc

SEQ ID NO: 1025488 - DNA, 15 bp, Homo sapiens
tctctcggctcccca

SEQ ID NO: 1025489 - DNA, 23 bp, Homo sapiens
tctctcggttccacgtccccctg

SEQ ID NO: 1025490 - DNA, 17 bp, Homo sapiens
tctctctaccagtctat

SEQ ID NO: 1025491 - DNA, 22 bp, Homo sapiens
tctctctaccagtctatttcca

SEQ ID NO: 1025492 - DNA, 20 bp, Homo sapiens
tctctctactcctacctcag

SEQ ID NO: 1025493 - DNA, 13 bp, Homo sapiens
tctctctatgcaa

SEQ ID NO: 1025494 - DNA, 22 bp, Homo sapiens
tctctctcactccctccctttc

SEQ ID NO: 1025495 - DNA, 15 bp, Homo sapiens
tctctctccagggtg

SEQ ID NO: 1025496 - DNA, 13 bp, Homo sapiens
tctctctcctcag

SEQ ID NO: 1025497 - DNA, 12 bp, Homo sapiens
tctctctcctgt

SEQ ID NO: 1025498 - DNA, 20 bp, Homo sapiens
tctctctcgaccttctggta

SEQ ID NO: 1025499 - DNA, 12 bp, Homo sapiens
tctctctctcct

SEQ ID NO: 1025500 - DNA, 13 bp, Homo sapiens
tctctctctttgt

SEQ ID NO: 1025501 - DNA, 16 bp, Homo sapiens
tctctctgcagctgcc

SEQ ID NO: 1025502 - DNA, 18 bp, Homo sapiens
tctctctgcagctgccgg

SEQ ID NO: 1025503 - DNA, 12 bp, Homo sapiens
tctctctgccaa

SEQ ID NO: 1025504 - DNA, 14 bp, Homo sapiens
tctctctgccctct

SEQ ID NO: 1025505 - DNA, 16 bp, Homo sapiens
tctctctggatggaac

SEQ ID NO: 1025506 - DNA, 11 bp, Homo sapiens
tctctctgggc

SEQ ID NO: 1025507 - DNA, 20 bp, Homo sapiens
tctctctggggccacacaga

SEQ ID NO: 1025508 - DNA, 14 bp, Homo sapiens
tctctctgggtcag

SEQ ID NO: 1025509 - DNA, 14 bp, Homo sapiens
tctctctgtgaata

SEQ ID NO: 1025510 - DNA, 15 bp, Homo sapiens
tctctctgttccctt

SEQ ID NO: 1025511 - DNA, 18 bp, Homo sapiens
tctctctgttcccttcct

SEQ ID NO: 1025512 - DNA, 14 bp, Homo sapiens
tctctcttaaagtt

SEQ ID NO: 1025513 - DNA, 14 bp, Homo sapiens
tctctcttccctca

SEQ ID NO: 1025514 - DNA, 13 bp, Homo sapiens
tctctcttctagg

SEQ ID NO: 1025515 - DNA, 12 bp, Homo sapiens
tctctgaacaca

SEQ ID NO: 1025516 - DNA, 14 bp, Homo sapiens
tctctgaacagaaa

SEQ ID NO: 1025517 - DNA, 16 bp, Homo sapiens
tctctgaacagaaaac

SEQ ID NO: 1025518 - DNA, 19 bp, Homo sapiens
tctctgaactgcaacactg

SEQ ID NO: 1025519 - DNA, 13 bp, Homo sapiens
tctctgaagatga

SEQ ID NO: 1025520 - DNA, 12 bp, Homo sapiens
tctctgaagcat

SEQ ID NO: 1025521 - DNA, 16 bp, Homo sapiens
tctctgaagcatgttt

SEQ ID NO: 1025522 - DNA, 11 bp, Homo sapiens
tctctgaaggg

SEQ ID NO: 1025523 - DNA, 15 bp, Homo sapiens
tctctgaatacacag

SEQ ID NO: 1025524 - DNA, 13 bp, Homo sapiens
tctctgaatcaga

SEQ ID NO: 1025525 - DNA, 15 bp, Homo sapiens
tctctgaattttcag

SEQ ID NO: 1025526 - DNA, 15 bp, Homo sapiens
tctctgacctctgct

SEQ ID NO: 1025527 - DNA, 19 bp, Homo sapiens
tctctgacgcttgtgacag

SEQ ID NO: 1025528 - DNA, 23 bp, Homo sapiens
tctctgacgcttgtgacagtgcc

SEQ ID NO: 1025529 - DNA, 13 bp, Homo sapiens
tctctgacgtcaa

SEQ ID NO: 1025530 - DNA, 16 bp, Homo sapiens
tctctgacttctgcct

SEQ ID NO: 1025531 - DNA, 18 bp, Homo sapiens
tctctgacttctgcctgg

SEQ ID NO: 1025532 - DNA, 16 bp, Homo sapiens
tctctgagctggggag

SEQ ID NO: 1025533 - DNA, 19 bp, Homo sapiens
tctctgagtggaggaagcc

SEQ ID NO: 1025534 - DNA, 14 bp, Homo sapiens
tctctgatacacag

SEQ ID NO: 1025535 - DNA, 16 bp, Homo sapiens
tctctgatacacagta

SEQ ID NO: 1025536 - DNA, 14 bp, Homo sapiens
tctctgatcttgtg

SEQ ID NO: 1025537 - DNA, 19 bp, Homo sapiens
tctctgatcttgtgctcag

SEQ ID NO: 1025538 - DNA, 22 bp, Homo sapiens
tctctgatcttgtgctcagcat

SEQ ID NO: 1025539 - DNA, 13 bp, Homo sapiens
tctctgatgcaga

SEQ ID NO: 1025540 - DNA, 16 bp, Homo sapiens
tctctgatgcagctta

SEQ ID NO: 1025541 - DNA, 20 bp, Homo sapiens
tctctgattccctgatttaa

SEQ ID NO: 1025542 - DNA, 19 bp, Homo sapiens
tctctgattttcaaagctt

SEQ ID NO: 1025543 - DNA, 20 bp, Homo sapiens
tctctgattttcaaagcttt

SEQ ID NO: 1025544 - DNA, 13 bp, Homo sapiens
tctctgcaacact

SEQ ID NO: 1025545 - DNA, 15 bp, Homo sapiens
tctctgcagacttcc

SEQ ID NO: 1025546 - DNA, 14 bp, Homo sapiens
tctctgcagatgtg

SEQ ID NO: 1025547 - DNA, 19 bp, Homo sapiens
tctctgcagccagcccagc

SEQ ID NO: 1025548 - DNA, 14 bp, Homo sapiens
tctctgcagcccag

SEQ ID NO: 1025549 - DNA, 16 bp, Homo sapiens
tctctgcagcccagcc

SEQ ID NO: 1025550 - DNA, 12 bp, Homo sapiens
tctctgcagctg

SEQ ID NO: 1025551 - DNA, 13 bp, Homo sapiens
tctctgcagtaaa

SEQ ID NO: 1025552 - DNA, 22 bp, Homo sapiens
tctctgcagtcctccggggtgg

SEQ ID NO: 1025553 - DNA, 22 bp, Homo sapiens
gctgacccagccccttgagaaa

SEQ ID NO: 1025554 - DNA, 22 bp, Homo sapiens
gctgacccaggaatagtggaca

SEQ ID NO: 1025555 - DNA, 23 bp, Homo sapiens
gctgacccaggaatagtggacat

SEQ ID NO: 1025556 - DNA, 17 bp, Homo sapiens
gctgacccagtccctgg

SEQ ID NO: 1025557 - DNA, 14 bp, Homo sapiens
gctgaccccaggtc

SEQ ID NO: 1025558 - DNA, 22 bp, Homo sapiens
gctgaccccaggtcagccctgt

SEQ ID NO: 1025559 - DNA, 19 bp, Homo sapiens
gctgacctctgttgtcctc

SEQ ID NO: 1025560 - DNA, 22 bp, Homo sapiens
gctgacctctgttgtcctcccc

SEQ ID NO: 1025561 - DNA, 17 bp, Homo sapiens
gctgacctgctgacctg

SEQ ID NO: 1025562 - DNA, 20 bp, Homo sapiens
gctgacctgggcccacagag

SEQ ID NO: 1025563 - DNA, 23 bp, Homo sapiens
gctgacctgggcccacagagcct

SEQ ID NO: 1025564 - DNA, 16 bp, Homo sapiens
gctgacgttccgggca

SEQ ID NO: 1025565 - DNA, 20 bp, Homo sapiens
gctgactaaactttttttct

SEQ ID NO: 1025566 - DNA, 21 bp, Homo sapiens
gctgactactactctgccaat

SEQ ID NO: 1025567 - DNA, 16 bp, Homo sapiens
gctgactcgtggcgcg

SEQ ID NO: 1025568 - DNA, 15 bp, Homo sapiens
gctgactctctgagc

SEQ ID NO: 1025569 - DNA, 17 bp, Homo sapiens
gctgactgcaccagcgc

SEQ ID NO: 1025570 - DNA, 20 bp, Homo sapiens
gctgactgtggccccctccg

SEQ ID NO: 1025571 - DNA, 14 bp, Homo sapiens
gctgacttctctga

SEQ ID NO: 1025572 - DNA, 15 bp, Homo sapiens
gctgacttggcactt

SEQ ID NO: 1025573 - DNA, 19 bp, Homo sapiens
gctgacttggttctgaagc

SEQ ID NO: 1025574 - DNA, 14 bp, Homo sapiens
gctgagaaatgcag

SEQ ID NO: 1025575 - DNA, 13 bp, Homo sapiens
gctgagaagagga

SEQ ID NO: 1025576 - DNA, 13 bp, Homo sapiens
gctgagaaggcag

SEQ ID NO: 1025577 - DNA, 20 bp, Homo sapiens
gctgagaatctgggggtgag

SEQ ID NO: 1025578 - DNA, 20 bp, Homo sapiens
gctgagactggatactgccc

SEQ ID NO: 1025579 - DNA, 13 bp, Homo sapiens
gctgagagcccca

SEQ ID NO: 1025580 - DNA, 18 bp, Homo sapiens
gctgagagccccagctga

SEQ ID NO: 1025581 - DNA, 20 bp, Homo sapiens
gctgagagccccagctgaca

SEQ ID NO: 1025582 - DNA, 16 bp, Homo sapiens
gctgagcaccctctcc

SEQ ID NO: 1025583 - DNA, 17 bp, Homo sapiens
gctgagcagcctctgga

SEQ ID NO: 1025584 - DNA, 21 bp, Homo sapiens
gctgagcaggaggggggctgg

SEQ ID NO: 1025585 - DNA, 12 bp, Homo sapiens
gctgagccactc

SEQ ID NO: 1025586 - DNA, 17 bp, Homo sapiens
gctgagccactcgcagt

SEQ ID NO: 1025587 - DNA, 14 bp, Homo sapiens
gctgagcccctacc

SEQ ID NO: 1025588 - DNA, 17 bp, Homo sapiens
gctgagcccctacccca

SEQ ID NO: 1025589 - DNA, 13 bp, Homo sapiens
gctgagcccctgg

SEQ ID NO: 1025590 - DNA, 16 bp, Homo sapiens
gctgagcccctggtct

SEQ ID NO: 1025591 - DNA, 21 bp, Homo sapiens
gctgagcccctggtcttctct

SEQ ID NO: 1025592 - DNA, 23 bp, Homo sapiens
gctgagcccctgtctagagaggg

SEQ ID NO: 1025593 - DNA, 11 bp, Homo sapiens
gctgagccctg

SEQ ID NO: 1025594 - DNA, 16 bp, Homo sapiens
gctgagccctggcagg

SEQ ID NO: 1025595 - DNA, 12 bp, Homo sapiens
gctgagcctcag

SEQ ID NO: 1025596 - DNA, 23 bp, Homo sapiens
gctgagcgaggagatgctccttg

SEQ ID NO: 1025597 - DNA, 12 bp, Homo sapiens
gctgagcgcccc

SEQ ID NO: 1025598 - DNA, 15 bp, Homo sapiens
gctgagctgggccca

SEQ ID NO: 1025599 - DNA, 21 bp, Homo sapiens
gctgagctgggcccagcccct

SEQ ID NO: 1025600 - DNA, 12 bp, Homo sapiens
gctgagctgtga

SEQ ID NO: 1025601 - DNA, 14 bp, Homo sapiens
gctgagctgtgaca

SEQ ID NO: 1025602 - DNA, 23 bp, Homo sapiens
gctgagcttagccttgtgccctg

SEQ ID NO: 1025603 - DNA, 20 bp, Homo sapiens
gctgagcttcggttctccag

SEQ ID NO: 1025604 - DNA, 22 bp, Homo sapiens
gctgagcttcggttctccagaa

SEQ ID NO: 1025605 - DNA, 20 bp, Homo sapiens
gctgagcttggaggaagtat

SEQ ID NO: 1025606 - DNA, 21 bp, Homo sapiens
gctgaggaacaggttcctgtg

SEQ ID NO: 1025607 - DNA, 14 bp, Homo sapiens
gctgaggagcagcc

SEQ ID NO: 1025608 - DNA, 17 bp, Homo sapiens
gctgaggagcagccagg

SEQ ID NO: 1025609 - DNA, 23 bp, Homo sapiens
gctgaggagtctgaggactgtcc

SEQ ID NO: 1025610 - DNA, 16 bp, Homo sapiens
gctgaggagtgaggaa

SEQ ID NO: 1025611 - DNA, 14 bp, Homo sapiens
gctgaggatgattg

SEQ ID NO: 1025612 - DNA, 17 bp, Homo sapiens
gctgaggatttcctgga

SEQ ID NO: 1025613 - DNA, 19 bp, Homo sapiens
gctgaggatttcctggagt

SEQ ID NO: 1025614 - DNA, 13 bp, Homo sapiens
gctgaggcagaag

SEQ ID NO: 1025615 - DNA, 15 bp, Homo sapiens
gctgaggcagaagaa

SEQ ID NO: 1025616 - DNA, 13 bp, Homo sapiens
gctgaggcagcag

SEQ ID NO: 1025617 - DNA, 14 bp, Homo sapiens
gctgaggcaggaga

SEQ ID NO: 1025618 - DNA, 21 bp, Homo sapiens
gctgaggccacactcagcaca

SEQ ID NO: 1025619 - DNA, 12 bp, Homo sapiens
gctgaggccagg

SEQ ID NO: 1025620 - DNA, 19 bp, Homo sapiens
gctgaggccagggctgatg

SEQ ID NO: 1025621 - DNA, 17 bp, Homo sapiens
gctgaggcccagtgcat

SEQ ID NO: 1025622 - DNA, 12 bp, Homo sapiens
gctgaggcctgg

SEQ ID NO: 1025623 - DNA, 13 bp, Homo sapiens
gctgaggcctgga

SEQ ID NO: 1025624 - DNA, 21 bp, Homo sapiens
gctgaggcctggactttcctg

SEQ ID NO: 1025625 - DNA, 14 bp, Homo sapiens
gctgaggcctgggc

SEQ ID NO: 1025626 - DNA, 17 bp, Homo sapiens
gctgaggcctgggccgc

SEQ ID NO: 1025627 - DNA, 19 bp, Homo sapiens
gctgaggccttctcttgag

SEQ ID NO: 1025628 - DNA, 15 bp, Homo sapiens
gctgaggcgggagaa

SEQ ID NO: 1025629 - DNA, 23 bp, Homo sapiens
gctgaggctctgacccagtgaga

SEQ ID NO: 1025630 - DNA, 15 bp, Homo sapiens
gctgaggctggcaca

SEQ ID NO: 1025631 - DNA, 18 bp, Homo sapiens
gctgaggctggcacagga

SEQ ID NO: 1025632 - DNA, 15 bp, Homo sapiens
gctgaggctggggga

SEQ ID NO: 1025633 - DNA, 22 bp, Homo sapiens
gctgaggctgggggagagccgt

SEQ ID NO: 1025634 - DNA, 14 bp, Homo sapiens
gctgagggagcctg

SEQ ID NO: 1025635 - DNA, 12 bp, Homo sapiens
gctgagggaggg

SEQ ID NO: 1025636 - DNA, 19 bp, Homo sapiens
gctgagggagggagccatg

SEQ ID NO: 1025637 - DNA, 20 bp, Homo sapiens
gctgagggagggagccatgg

SEQ ID NO: 1025638 - DNA, 16 bp, Homo sapiens
gctgagggcagactgg

SEQ ID NO: 1025639 - DNA, 17 bp, Homo sapiens
gctgagggccctgtgga

SEQ ID NO: 1025640 - DNA, 15 bp, Homo sapiens
gctgagggcctgctg

SEQ ID NO: 1025641 - DNA, 16 bp, Homo sapiens
gctgagggcctgctgg

SEQ ID NO: 1025642 - DNA, 18 bp, Homo sapiens
gctgagggcctgctggag

SEQ ID NO: 1025643 - DNA, 22 bp, Homo sapiens
gctgagggcctgctggaggcct

SEQ ID NO: 1025644 - DNA, 17 bp, Homo sapiens
gctgaggggacgggcaa

SEQ ID NO: 1025645 - DNA, 21 bp, Homo sapiens
gctgaggggggccgtgcccag

SEQ ID NO: 1025646 - DNA, 21 bp, Homo sapiens
gctgaggggtctcggatgaca

SEQ ID NO: 1025647 - DNA, 23 bp, Homo sapiens
gctgagggtgagtgggtgaataa

SEQ ID NO: 1025648 - DNA, 21 bp, Homo sapiens
gctgagggtgcccttttccag

SEQ ID NO: 1025649 - DNA, 21 bp, Homo sapiens
gctgaggtcccgggcttagtg

SEQ ID NO: 1025650 - DNA, 15 bp, Homo sapiens
gctgaggtgagagga

SEQ ID NO: 1025651 - DNA, 14 bp, Homo sapiens
gctgaggtgggagg

SEQ ID NO: 1025652 - DNA, 19 bp, Homo sapiens
gctgaggtgggaggatcac

SEQ ID NO: 1025653 - DNA, 13 bp, Homo sapiens
gctgaggtgggga

SEQ ID NO: 1025654 - DNA, 17 bp, Homo sapiens
gctgaggtggggaagga

SEQ ID NO: 1025655 - DNA, 21 bp, Homo sapiens
gctgaggtgtcttaagccttt

SEQ ID NO: 1025656 - DNA, 16 bp, Homo sapiens
gctgaggttcctctgc

SEQ ID NO: 1025657 - DNA, 18 bp, Homo sapiens
gctgaggttcctctgcct

SEQ ID NO: 1025658 - DNA, 20 bp, Homo sapiens
gctgaggttcctctgcctgc

SEQ ID NO: 1025659 - DNA, 21 bp, Homo sapiens
gctgaggttcctctgcctgcc

SEQ ID NO: 1025660 - DNA, 15 bp, Homo sapiens
gctgaggttttgaat

SEQ ID NO: 1025661 - DNA, 22 bp, Homo sapiens
gctgaggttttgaataaaaagt

SEQ ID NO: 1025662 - DNA, 16 bp, Homo sapiens
gctgagtcacctcctc

SEQ ID NO: 1025663 - DNA, 17 bp, Homo sapiens
gctgagtcccaggctga

SEQ ID NO: 1025664 - DNA, 22 bp, Homo sapiens
gctgagtccctcacgtttcttc

SEQ ID NO: 1025665 - DNA, 18 bp, Homo sapiens
gctgagtccctccatgca

SEQ ID NO: 1025666 - DNA, 21 bp, Homo sapiens
gctgagtgacacaagcacttt

SEQ ID NO: 1025667 - DNA, 13 bp, Homo sapiens
gctgagtgcagcc

SEQ ID NO: 1025668 - DNA, 19 bp, Homo sapiens
gctgagtgcagccaaaggg

SEQ ID NO: 1025669 - DNA, 15 bp, Homo sapiens
gctgagtgctgggca

SEQ ID NO: 1025670 - DNA, 18 bp, Homo sapiens
gctgagtgctgggcactg

SEQ ID NO: 1025671 - DNA, 17 bp, Homo sapiens
gctgagtggcaggggac

SEQ ID NO: 1025672 - DNA, 15 bp, Homo sapiens
gctgagtggccagcc

SEQ ID NO: 1025673 - DNA, 22 bp, Homo sapiens
gctgagtgggggatcacagcct

SEQ ID NO: 1025674 - DNA, 21 bp, Homo sapiens
tctcttctgggttccttcctc

SEQ ID NO: 1025675 - DNA, 14 bp, Homo sapiens
tctcttctgtccat

SEQ ID NO: 1025676 - DNA, 14 bp, Homo sapiens
tctcttcttcccct

SEQ ID NO: 1025677 - DNA, 23 bp, Homo sapiens
tctcttctttattgcactaggaa

SEQ ID NO: 1025678 - DNA, 15 bp, Homo sapiens
tctcttctttctgaa

SEQ ID NO: 1025679 - DNA, 16 bp, Homo sapiens
tctcttcttttggctt

SEQ ID NO: 1025680 - DNA, 11 bp, Homo sapiens
gctgagtttcc

SEQ ID NO: 1025681 - DNA, 15 bp, Homo sapiens
gctgagtttcccttc

SEQ ID NO: 1025682 - DNA, 12 bp, Homo sapiens
gctgagtttcct

SEQ ID NO: 1025683 - DNA, 18 bp, Homo sapiens
gctgataaggaaacttta

SEQ ID NO: 1025684 - DNA, 18 bp, Homo sapiens
gctgataattgtgtattt

SEQ ID NO: 1025685 - DNA, 14 bp, Homo sapiens
gctgataattttaa

SEQ ID NO: 1025686 - DNA, 15 bp, Homo sapiens
gctgataattttaaa

SEQ ID NO: 1025687 - DNA, 20 bp, Homo sapiens
gctgatatatgtgtttttca

SEQ ID NO: 1025688 - DNA, 18 bp, Homo sapiens
gctgatattatttcttct

SEQ ID NO: 1025689 - DNA, 20 bp, Homo sapiens
gctgatattatttcttctct

SEQ ID NO: 1025690 - DNA, 22 bp, Homo sapiens
gctgatattatttcttctctta

SEQ ID NO: 1025691 - DNA, 18 bp, Homo sapiens
gctgatcatcgccagagg

SEQ ID NO: 1025692 - DNA, 20 bp, Homo sapiens
gctgatcatcgccagaggtg

SEQ ID NO: 1025693 - DNA, 12 bp, Homo sapiens
gctgatccggct

SEQ ID NO: 1025694 - DNA, 13 bp, Homo sapiens
gctgatccggctg

SEQ ID NO: 1025695 - DNA, 18 bp, Homo sapiens
gctgatcctaagaatttt

SEQ ID NO: 1025696 - DNA, 18 bp, Homo sapiens
gctgatcgtagaaaattt

SEQ ID NO: 1025697 - DNA, 16 bp, Homo sapiens
gctgatcgtgctaaat

SEQ ID NO: 1025698 - DNA, 15 bp, Homo sapiens
gctgatgatccagaa

SEQ ID NO: 1025699 - DNA, 19 bp, Homo sapiens
gctgatgatccagaacagt

SEQ ID NO: 1025700 - DNA, 19 bp, Homo sapiens
gctgatgatgtcttctggt

SEQ ID NO: 1025701 - DNA, 15 bp, Homo sapiens
gctgatgattttgca

SEQ ID NO: 1025702 - DNA, 17 bp, Homo sapiens
gctgatgccccttctcc

SEQ ID NO: 1025703 - DNA, 17 bp, Homo sapiens
gctgatgctcctccggg

SEQ ID NO: 1025704 - DNA, 18 bp, Homo sapiens
gctgatggaggaaaaagg

SEQ ID NO: 1025705 - DNA, 23 bp, Homo sapiens
gctgatggataacctatatgatt

SEQ ID NO: 1025706 - DNA, 23 bp, Homo sapiens
gctgatggctgctagattttaat

SEQ ID NO: 1025707 - DNA, 20 bp, Homo sapiens
gctgatggcttgacatgtgc

SEQ ID NO: 1025708 - DNA, 14 bp, Homo sapiens
gctgatgggaagga

SEQ ID NO: 1025709 - DNA, 17 bp, Homo sapiens
gctgatgggaaggaggg

SEQ ID NO: 1025710 - DNA, 22 bp, Homo sapiens
gctgatgtttataaactgagag

SEQ ID NO: 1025711 - DNA, 22 bp, Homo sapiens
gctgattactgtcaataaacag

SEQ ID NO: 1025712 - DNA, 22 bp, Homo sapiens
gctgattcaaaccaaagctgcc

SEQ ID NO: 1025713 - DNA, 17 bp, Homo sapiens
gctgattcttgtaaatc

SEQ ID NO: 1025714 - DNA, 21 bp, Homo sapiens
gctgattcttgtaaatctttt

SEQ ID NO: 1025715 - DNA, 22 bp, Homo sapiens
gctgattcttgtaaatcttttt

SEQ ID NO: 1025716 - DNA, 15 bp, Homo sapiens
gctgatttccaggcc

SEQ ID NO: 1025717 - DNA, 16 bp, Homo sapiens
gctgatttccaggccc

SEQ ID NO: 1025718 - DNA, 13 bp, Homo sapiens
gctgatttctagg

SEQ ID NO: 1025719 - DNA, 23 bp, Homo sapiens
gctgatttctaggtaggaaatgt

SEQ ID NO: 1025720 - DNA, 20 bp, Homo sapiens
gctgattttaacaataacta

SEQ ID NO: 1025721 - DNA, 16 bp, Homo sapiens
gctgcaaaattaaatc

SEQ ID NO: 1025722 - DNA, 10 bp, Homo sapiens
gctgcaaaga

SEQ ID NO: 1025723 - DNA, 15 bp, Homo sapiens
gctgcaaagagaaac

SEQ ID NO: 1025724 - DNA, 22 bp, Homo sapiens
gctgcaaagagaaaccgctttt

SEQ ID NO: 1025725 - DNA, 15 bp, Homo sapiens
gctgcaaaggagaag

SEQ ID NO: 1025726 - DNA, 18 bp, Homo sapiens
gctgcaaaggagaagcac

SEQ ID NO: 1025727 - DNA, 15 bp, Homo sapiens
gctgcaacaaaatgt

SEQ ID NO: 1025728 - DNA, 18 bp, Homo sapiens
gctgcaaggtggcctctg

SEQ ID NO: 1025729 - DNA, 22 bp, Homo sapiens
gctgcaaggtggcctctgcctg

SEQ ID NO: 1025730 - DNA, 16 bp, Homo sapiens
gctgcacaacagccct

SEQ ID NO: 1025731 - DNA, 22 bp, Homo sapiens
gctgcacaacagccctgcctga

SEQ ID NO: 1025732 - DNA, 18 bp, Homo sapiens
gctgcacacagacggcct

SEQ ID NO: 1025733 - DNA, 14 bp, Homo sapiens
gctgcacagcagga

SEQ ID NO: 1025734 - DNA, 13 bp, Homo sapiens
gctgcacaggctg

SEQ ID NO: 1025735 - DNA, 18 bp, Homo sapiens
gctgcacattcctggccc

SEQ ID NO: 1025736 - DNA, 23 bp, Homo sapiens
gctgcacattgcctgttctgctt

SEQ ID NO: 1025737 - DNA, 20 bp, Homo sapiens
gctgcaccacggcgtttttt

SEQ ID NO: 1025738 - DNA, 13 bp, Homo sapiens
gctgcaccagagc

SEQ ID NO: 1025739 - DNA, 14 bp, Homo sapiens
gctgcaccagagtg

SEQ ID NO: 1025740 - DNA, 15 bp, Homo sapiens
gctgcaccagagtga

SEQ ID NO: 1025741 - DNA, 16 bp, Homo sapiens
gctgcaccagagtgaa

SEQ ID NO: 1025742 - DNA, 14 bp, Homo sapiens
gctgcaccagcagg

SEQ ID NO: 1025743 - DNA, 16 bp, Homo sapiens
gctgcaccctcaggca

SEQ ID NO: 1025744 - DNA, 19 bp, Homo sapiens
gctgcacctcctaccctcc

SEQ ID NO: 1025745 - DNA, 23 bp, Homo sapiens
gctgcacctcctaccctcccacc

SEQ ID NO: 1025746 - DNA, 17 bp, Homo sapiens
gctgcacctgccagcct

SEQ ID NO: 1025747 - DNA, 20 bp, Homo sapiens
gctgcacctgccagcctggc

SEQ ID NO: 1025748 - DNA, 18 bp, Homo sapiens
gctgcacgctcccctcca

SEQ ID NO: 1025749 - DNA, 22 bp, Homo sapiens
gctgcacgggatgcgtgggagg

SEQ ID NO: 1025750 - DNA, 20 bp, Homo sapiens
gctgcactatcacgagcctt

SEQ ID NO: 1025751 - DNA, 14 bp, Homo sapiens
gctgcactcttgaa

SEQ ID NO: 1025752 - DNA, 15 bp, Homo sapiens
gctgcactggagcca

SEQ ID NO: 1025753 - DNA, 17 bp, Homo sapiens
gctgcactggagccaca

SEQ ID NO: 1025754 - DNA, 12 bp, Homo sapiens
gctgcactgtga

SEQ ID NO: 1025755 - DNA, 20 bp, Homo sapiens
gctgcagaccatgccagacc

SEQ ID NO: 1025756 - DNA, 13 bp, Homo sapiens
gctgcagagcagc

SEQ ID NO: 1025757 - DNA, 15 bp, Homo sapiens
gctgcagagcccggc

SEQ ID NO: 1025758 - DNA, 16 bp, Homo sapiens
gctgcagagcccggcc

SEQ ID NO: 1025759 - DNA, 19 bp, Homo sapiens
gctgcagagcccggcccca

SEQ ID NO: 1025760 - DNA, 17 bp, Homo sapiens
gctgcagagctgaccca

SEQ ID NO: 1025761 - DNA, 17 bp, Homo sapiens
gctgcagcagagtgagc

SEQ ID NO: 1025762 - DNA, 12 bp, Homo sapiens
gctgcagcagcc

SEQ ID NO: 1025763 - DNA, 16 bp, Homo sapiens
gctgcagcagggcagg

SEQ ID NO: 1025764 - DNA, 19 bp, Homo sapiens
gctgcagcaggtgctgggc

SEQ ID NO: 1025765 - DNA, 16 bp, Homo sapiens
gctgcagccaaagaca

SEQ ID NO: 1025766 - DNA, 13 bp, Homo sapiens
gctgcagcctctg

SEQ ID NO: 1025767 - DNA, 16 bp, Homo sapiens
gctgcagcctgcgcca

SEQ ID NO: 1025768 - DNA, 20 bp, Homo sapiens
gctgcagctgatccatagga

SEQ ID NO: 1025769 - DNA, 14 bp, Homo sapiens
gctgcagctggaca

SEQ ID NO: 1025770 - DNA, 12 bp, Homo sapiens
gctgcagctggg

SEQ ID NO: 1025771 - DNA, 13 bp, Homo sapiens
gctgcagctgggc

SEQ ID NO: 1025772 - DNA, 17 bp, Homo sapiens
gctgcaggacttgagaa

SEQ ID NO: 1025773 - DNA, 12 bp, Homo sapiens
gctgcaggaggg

SEQ ID NO: 1025774 - DNA, 13 bp, Homo sapiens
gctgcaggagggc

SEQ ID NO: 1025775 - DNA, 21 bp, Homo sapiens
gctgcaggcaggcggctcctc

SEQ ID NO: 1025776 - DNA, 12 bp, Homo sapiens
gctgcaggccct

SEQ ID NO: 1025777 - DNA, 15 bp, Homo sapiens
gctgcaggccctccc

SEQ ID NO: 1025778 - DNA, 23 bp, Homo sapiens
gctgcagggcacggggacctgga

SEQ ID NO: 1025779 - DNA, 16 bp, Homo sapiens
gctgcagggctcccat

SEQ ID NO: 1025780 - DNA, 17 bp, Homo sapiens
gctgcagggctcccatg

SEQ ID NO: 1025781 - DNA, 18 bp, Homo sapiens
gctgcagggctcccatgg

SEQ ID NO: 1025782 - DNA, 20 bp, Homo sapiens
gctgcagtgacgtgcacctg

SEQ ID NO: 1025783 - DNA, 22 bp, Homo sapiens
gctgcatcccccccacctctcc

SEQ ID NO: 1025784 - DNA, 22 bp, Homo sapiens
gctgcatctgggattcccacca

SEQ ID NO: 1025785 - DNA, 13 bp, Homo sapiens
gctgcatgatgtt

SEQ ID NO: 1025786 - DNA, 20 bp, Homo sapiens
gctgcatgcctggtctttcc

SEQ ID NO: 1025787 - DNA, 16 bp, Homo sapiens
gctgcatggagcctgg

SEQ ID NO: 1025788 - DNA, 19 bp, Homo sapiens
gctgcatgttaagtgccat

SEQ ID NO: 1025789 - DNA, 17 bp, Homo sapiens
gctgcatttaaaagata

SEQ ID NO: 1025790 - DNA, 23 bp, Homo sapiens
gctgcattttaattttaaccaaa

SEQ ID NO: 1025791 - DNA, 12 bp, Homo sapiens
gctgccaaaacc

SEQ ID NO: 1025792 - DNA, 19 bp, Homo sapiens
gctgccaaaaccacatggg

SEQ ID NO: 1025793 - DNA, 21 bp, Homo sapiens
gctgccaaaaccacatgggct

SEQ ID NO: 1025794 - DNA, 21 bp, Homo sapiens
gctgccaagcactcgagacca

SEQ ID NO: 1025795 - DNA, 15 bp, Homo sapiens
gctgccaaggccaga

SEQ ID NO: 1025796 - DNA, 17 bp, Homo sapiens
tctgaatgctgctactt

SEQ ID NO: 1025797 - DNA, 17 bp, Homo sapiens
tctgaatgcttctaagt

SEQ ID NO: 1025798 - DNA, 18 bp, Homo sapiens
tctgaatgggagccagaa

SEQ ID NO: 1025799 - DNA, 12 bp, Homo sapiens
tctgaatgttct

SEQ ID NO: 1025800 - DNA, 16 bp, Homo sapiens
tctgaatgttctgaca

SEQ ID NO: 1025801 - DNA, 21 bp, Homo sapiens
tctgaattaattaatttggag

SEQ ID NO: 1025802 - DNA, 18 bp, Homo sapiens
tctgaattgttggggttt

SEQ ID NO: 1025803 - DNA, 12 bp, Homo sapiens
tctgaatttatt

SEQ ID NO: 1025804 - DNA, 13 bp, Homo sapiens
tctgaattttcag

SEQ ID NO: 1025805 - DNA, 14 bp, Homo sapiens
tctgaattttcaga

SEQ ID NO: 1025806 - DNA, 21 bp, Homo sapiens
tctgaattttggggattttca

SEQ ID NO: 1025807 - DNA, 19 bp, Homo sapiens
tctgaatttttaaacaagt

SEQ ID NO: 1025808 - DNA, 13 bp, Homo sapiens
gctgccactgggc

SEQ ID NO: 1025809 - DNA, 15 bp, Homo sapiens
gctgccactgggcac

SEQ ID NO: 1025810 - DNA, 16 bp, Homo sapiens
gctgccagaatcaggt

SEQ ID NO: 1025811 - DNA, 15 bp, Homo sapiens
gctgccagcccactg

SEQ ID NO: 1025812 - DNA, 15 bp, Homo sapiens
gctgccagccgggca

SEQ ID NO: 1025813 - DNA, 14 bp, Homo sapiens
gctgccagcctgag

SEQ ID NO: 1025814 - DNA, 15 bp, Homo sapiens
gctgccagcctgagc

SEQ ID NO: 1025815 - DNA, 19 bp, Homo sapiens
gctgccaggaaacaaggga

SEQ ID NO: 1025816 - DNA, 18 bp, Homo sapiens
gctgccaggcggccctgg

SEQ ID NO: 1025817 - DNA, 14 bp, Homo sapiens
gctgccagggcttc

SEQ ID NO: 1025818 - DNA, 17 bp, Homo sapiens
gctgccaggtgagaaac

SEQ ID NO: 1025819 - DNA, 16 bp, Homo sapiens
gctgccatcaccgctg

SEQ ID NO: 1025820 - DNA, 18 bp, Homo sapiens
gctgccatcaccgctggg

SEQ ID NO: 1025821 - DNA, 19 bp, Homo sapiens
gctgccatcaccgctgggt

SEQ ID NO: 1025822 - DNA, 18 bp, Homo sapiens
gctgccatcccctccccg

SEQ ID NO: 1025823 - DNA, 14 bp, Homo sapiens
gctgccatgccact

SEQ ID NO: 1025824 - DNA, 17 bp, Homo sapiens
gctgccatgtgaagagg

SEQ ID NO: 1025825 - DNA, 19 bp, Homo sapiens
gctgcccacgctcctgccc

SEQ ID NO: 1025826 - DNA, 18 bp, Homo sapiens
gctgcccactgtttctct

SEQ ID NO: 1025827 - DNA, 23 bp, Homo sapiens
gctgcccactgtttctcttgagc

SEQ ID NO: 1025828 - DNA, 20 bp, Homo sapiens
gctgcccagctgctcccctg

SEQ ID NO: 1025829 - DNA, 13 bp, Homo sapiens
gctgcccaggaga

SEQ ID NO: 1025830 - DNA, 18 bp, Homo sapiens
gctgcccaggggcttcag

SEQ ID NO: 1025831 - DNA, 19 bp, Homo sapiens
gctgcccaggggcttcaga

SEQ ID NO: 1025832 - DNA, 13 bp, Homo sapiens
gctgcccagtgca

SEQ ID NO: 1025833 - DNA, 22 bp, Homo sapiens
gctgcccagtgcaaaccacttc

SEQ ID NO: 1025834 - DNA, 17 bp, Homo sapiens
gctgcccatcatgtggc

SEQ ID NO: 1025835 - DNA, 21 bp, Homo sapiens
gctgcccatcatgtggcccca

SEQ ID NO: 1025836 - DNA, 14 bp, Homo sapiens
gctgccccaacctg

SEQ ID NO: 1025837 - DNA, 14 bp, Homo sapiens
gctgccccagctga

SEQ ID NO: 1025838 - DNA, 21 bp, Homo sapiens
gctgccccagctgactgtggc

SEQ ID NO: 1025839 - DNA, 21 bp, Homo sapiens
gctgccccagggcctgcttcc

SEQ ID NO: 1025840 - DNA, 18 bp, Homo sapiens
gctgccccatcagtgctc

SEQ ID NO: 1025841 - DNA, 20 bp, Homo sapiens
gctgcccccaccccggggac

SEQ ID NO: 1025842 - DNA, 14 bp, Homo sapiens
gctgcccccatcca

SEQ ID NO: 1025843 - DNA, 18 bp, Homo sapiens
gctgcccccatccagcca

SEQ ID NO: 1025844 - DNA, 19 bp, Homo sapiens
gctgcccccatccagccac

SEQ ID NO: 1025845 - DNA, 15 bp, Homo sapiens
gctgcccccttcccc

SEQ ID NO: 1025846 - DNA, 22 bp, Homo sapiens
gctgcccccttccccagccctt

SEQ ID NO: 1025847 - DNA, 16 bp, Homo sapiens
gctgccccggcccctc

SEQ ID NO: 1025848 - DNA, 19 bp, Homo sapiens
gctgccccgttccctgtca

SEQ ID NO: 1025849 - DNA, 20 bp, Homo sapiens
gctgccccgttccctgtcag

SEQ ID NO: 1025850 - DNA, 16 bp, Homo sapiens
gctgcccctccccgtc

SEQ ID NO: 1025851 - DNA, 22 bp, Homo sapiens
gctgcccctccccgtccctgtc

SEQ ID NO: 1025852 - DNA, 14 bp, Homo sapiens
gctgcccctcgcac

SEQ ID NO: 1025853 - DNA, 20 bp, Homo sapiens
gctgcccctcgcacacaggg

SEQ ID NO: 1025854 - DNA, 13 bp, Homo sapiens
gctgccccttgca

SEQ ID NO: 1025855 - DNA, 14 bp, Homo sapiens
gctgccccttgcaa

SEQ ID NO: 1025856 - DNA, 17 bp, Homo sapiens
gctgccccttgcaagcc

SEQ ID NO: 1025857 - DNA, 18 bp, Homo sapiens
gctgccccttgcaagcca

SEQ ID NO: 1025858 - DNA, 19 bp, Homo sapiens
gctgccccttgcaagccat

SEQ ID NO: 1025859 - DNA, 21 bp, Homo sapiens
gctgccccttgcaagccataa

SEQ ID NO: 1025860 - DNA, 23 bp, Homo sapiens
gctgcccgcgggagacagcttct

SEQ ID NO: 1025861 - DNA, 20 bp, Homo sapiens
gctgcccgctcagcccagct

SEQ ID NO: 1025862 - DNA, 19 bp, Homo sapiens
gctgcccgtcttcagccta

SEQ ID NO: 1025863 - DNA, 21 bp, Homo sapiens
gctgccctccatcccgacatg

SEQ ID NO: 1025864 - DNA, 12 bp, Homo sapiens
gctgccctgaga

SEQ ID NO: 1025865 - DNA, 21 bp, Homo sapiens
gctgccctgagaagctgctcc

SEQ ID NO: 1025866 - DNA, 11 bp, Homo sapiens
gctgccctgct

SEQ ID NO: 1025867 - DNA, 16 bp, Homo sapiens
gctgccctggccctga

SEQ ID NO: 1025868 - DNA, 17 bp, Homo sapiens
gctgccctggccctgag

SEQ ID NO: 1025869 - DNA, 23 bp, Homo sapiens
gctgccctggccctgaggtgtgg

SEQ ID NO: 1025870 - DNA, 12 bp, Homo sapiens
gctgccctggtg

SEQ ID NO: 1025871 - DNA, 15 bp, Homo sapiens
gctgccctggtgctg

SEQ ID NO: 1025872 - DNA, 17 bp, Homo sapiens
gctgccctggtgctgcc

SEQ ID NO: 1025873 - DNA, 14 bp, Homo sapiens
gctgccctgtgtac

SEQ ID NO: 1025874 - DNA, 20 bp, Homo sapiens
gctgccctttggccaacagg

SEQ ID NO: 1025875 - DNA, 13 bp, Homo sapiens
gctgccgactccc

SEQ ID NO: 1025876 - DNA, 15 bp, Homo sapiens
gctgccgcaccccag

SEQ ID NO: 1025877 - DNA, 15 bp, Homo sapiens
gctgccgcctcccag

SEQ ID NO: 1025878 - DNA, 18 bp, Homo sapiens
gctgccgcctcccagcct

SEQ ID NO: 1025879 - DNA, 20 bp, Homo sapiens
gctgccgcctcccagcctgg

SEQ ID NO: 1025880 - DNA, 17 bp, Homo sapiens
gctgccgctgcaccacg

SEQ ID NO: 1025881 - DNA, 19 bp, Homo sapiens
gctgccgggcctgatttgg

SEQ ID NO: 1025882 - DNA, 21 bp, Homo sapiens
gctgccgtgcctgtgtcctga

SEQ ID NO: 1025883 - DNA, 17 bp, Homo sapiens
gctgcctaagtggctgc

SEQ ID NO: 1025884 - DNA, 18 bp, Homo sapiens
gctgcctaagtggctgct

SEQ ID NO: 1025885 - DNA, 10 bp, Homo sapiens
gctgcctcag

SEQ ID NO: 1025886 - DNA, 22 bp, Homo sapiens
gctgcctcaggcactctcctgt

SEQ ID NO: 1025887 - DNA, 17 bp, Homo sapiens
gctgcctccccaaccct

SEQ ID NO: 1025888 - DNA, 20 bp, Homo sapiens
gctgcctccccaaccctgcc

SEQ ID NO: 1025889 - DNA, 23 bp, Homo sapiens
gctgcctccccaaccctgcccct

SEQ ID NO: 1025890 - DNA, 13 bp, Homo sapiens
gctgcctcctgct

SEQ ID NO: 1025891 - DNA, 17 bp, Homo sapiens
gctgcctcctgctctct

SEQ ID NO: 1025892 - DNA, 19 bp, Homo sapiens
gctgcctcctgctctctgg

SEQ ID NO: 1025893 - DNA, 21 bp, Homo sapiens
gctgcctcggactccatggct

SEQ ID NO: 1025894 - DNA, 21 bp, Homo sapiens
gctgcctctgacagcagcctg

SEQ ID NO: 1025895 - DNA, 12 bp, Homo sapiens
gctgcctctgtg

SEQ ID NO: 1025896 - DNA, 13 bp, Homo sapiens
gctgcctctgtgg

SEQ ID NO: 1025897 - DNA, 16 bp, Homo sapiens
gctgcctctgtggaag

SEQ ID NO: 1025898 - DNA, 19 bp, Homo sapiens
gctgcctctgtggaagaga

SEQ ID NO: 1025899 - DNA, 14 bp, Homo sapiens
gctgcctcttggct

SEQ ID NO: 1025900 - DNA, 21 bp, Homo sapiens
gctgcctcttggcttctcagc

SEQ ID NO: 1025901 - DNA, 13 bp, Homo sapiens
gctgcctctttcc

SEQ ID NO: 1025902 - DNA, 21 bp, Homo sapiens
gctgcctgacactgagcccca

SEQ ID NO: 1025903 - DNA, 23 bp, Homo sapiens
gctgcctgacactgagccccacc

SEQ ID NO: 1025904 - DNA, 15 bp, Homo sapiens
gctgcctgccaaagt

SEQ ID NO: 1025905 - DNA, 19 bp, Homo sapiens
gctgcctgcccctgctgct

SEQ ID NO: 1025906 - DNA, 13 bp, Homo sapiens
gctgcctgcctgt

SEQ ID NO: 1025907 - DNA, 15 bp, Homo sapiens
gctgcctgcctgtct

SEQ ID NO: 1025908 - DNA, 11 bp, Homo sapiens
gctgcctggca

SEQ ID NO: 1025909 - DNA, 12 bp, Homo sapiens
gctgcctggcac

SEQ ID NO: 1025910 - DNA, 18 bp, Homo sapiens
gctgcctggccatgctgt

SEQ ID NO: 1025911 - DNA, 20 bp, Homo sapiens
gctgcctggccctccccaca

SEQ ID NO: 1025912 - DNA, 16 bp, Homo sapiens
gctgcctgggcccgga

SEQ ID NO: 1025913 - DNA, 12 bp, Homo sapiens
gctgcctgggct

SEQ ID NO: 1025914 - DNA, 13 bp, Homo sapiens
gctgcctgggctg

SEQ ID NO: 1025915 - DNA, 19 bp, Homo sapiens
gctgcctgggctgttggca

SEQ ID NO: 1025916 - DNA, 14 bp, Homo sapiens
gctgcctggtctgt

SEQ ID NO: 1025917 - DNA, 16 bp, Homo sapiens
gctgcctgtagttagg

SEQ ID NO: 1025918 - DNA, 20 bp, Homo sapiens
gctggaacccaggaggtgga

SEQ ID NO: 1025919 - DNA, 16 bp, Homo sapiens
gctggaagaacatcaa

SEQ ID NO: 1025920 - DNA, 12 bp, Homo sapiens
gctggaagccca

SEQ ID NO: 1025921 - DNA, 18 bp, Homo sapiens
gctggaaggcagggcaga

SEQ ID NO: 1025922 - DNA, 16 bp, Homo sapiens
gctggaaggggcagca

SEQ ID NO: 1025923 - DNA, 19 bp, Homo sapiens
gctggaaggggcagcagga

SEQ ID NO: 1025924 - DNA, 20 bp, Homo sapiens
gctggaagtctccatgaaga

SEQ ID NO: 1025925 - DNA, 23 bp, Homo sapiens
gctggaagtctccatgaagagct

SEQ ID NO: 1025926 - DNA, 22 bp, Homo sapiens
gctggaatgggagacctgttgg

SEQ ID NO: 1025927 - DNA, 13 bp, Homo sapiens
gctggacatactg

SEQ ID NO: 1025928 - DNA, 21 bp, Homo sapiens
gctggacatgagatggagagg

SEQ ID NO: 1025929 - DNA, 17 bp, Homo sapiens
gctggaccagctggcct

SEQ ID NO: 1025930 - DNA, 13 bp, Homo sapiens
gctggaccctgct

SEQ ID NO: 1025931 - DNA, 13 bp, Homo sapiens
gctggactagtgt

SEQ ID NO: 1025932 - DNA, 22 bp, Homo sapiens
gctggactctcagtctctgagc

SEQ ID NO: 1025933 - DNA, 12 bp, Homo sapiens
gctggactggag

SEQ ID NO: 1025934 - DNA, 13 bp, Homo sapiens
gctggactggcca

SEQ ID NO: 1025935 - DNA, 20 bp, Homo sapiens
gctggacttctacctgccct

SEQ ID NO: 1025936 - DNA, 23 bp, Homo sapiens
gctggacttctacctgccctcaa

SEQ ID NO: 1025937 - DNA, 12 bp, Homo sapiens
gctggagaagct

SEQ ID NO: 1025938 - DNA, 20 bp, Homo sapiens
gctggagaataaatttggga

SEQ ID NO: 1025939 - DNA, 18 bp, Homo sapiens
tctgagtctatgttcaaa

SEQ ID NO: 1025940 - DNA, 20 bp, Homo sapiens
tctgagtctatgttcaaaga

SEQ ID NO: 1025941 - DNA, 17 bp, Homo sapiens
tctgagtctgagtcctg

SEQ ID NO: 1025942 - DNA, 13 bp, Homo sapiens
tctgagttcttga

SEQ ID NO: 1025943 - DNA, 20 bp, Homo sapiens
tctgagtttcattctcctgc

SEQ ID NO: 1025944 - DNA, 20 bp, Homo sapiens
tctgagttttgtgtttgttg

SEQ ID NO: 1025945 - DNA, 18 bp, Homo sapiens
tctgataaagttccttaa

SEQ ID NO: 1025946 - DNA, 17 bp, Homo sapiens
tctgataccttcattta

SEQ ID NO: 1025947 - DNA, 18 bp, Homo sapiens
tctgatagctgtttcaaa

SEQ ID NO: 1025948 - DNA, 22 bp, Homo sapiens
tctgatagctgtttcaaatgtg

SEQ ID NO: 1025949 - DNA, 15 bp, Homo sapiens
tctgataggaggggg

SEQ ID NO: 1025950 - DNA, 23 bp, Homo sapiens
tctgataggagggggcggcaggg

SEQ ID NO: 1025951 - DNA, 17 bp, Homo sapiens
tctgatattaaagattt

SEQ ID NO: 1025952 - DNA, 19 bp, Homo sapiens
tctgatattccatgaatgt

SEQ ID NO: 1025953 - DNA, 20 bp, Homo sapiens
tctgatattccatgaatgta

SEQ ID NO: 1025954 - DNA, 22 bp, Homo sapiens
tctgatcacattcttcaaagac

SEQ ID NO: 1025955 - DNA, 15 bp, Homo sapiens
tctgatcacttcatg

SEQ ID NO: 1025956 - DNA, 21 bp, Homo sapiens
tctgatcgtctcggcccctct

SEQ ID NO: 1025957 - DNA, 13 bp, Homo sapiens
tctgatctataca

SEQ ID NO: 1025958 - DNA, 17 bp, Homo sapiens
tctgatctgtactttgt

SEQ ID NO: 1025959 - DNA, 19 bp, Homo sapiens
tctgatctgtactttgtgt

SEQ ID NO: 1025960 - DNA, 12 bp, Homo sapiens
tctgatctgtga

SEQ ID NO: 1025961 - DNA, 19 bp, Homo sapiens
tctgatcttgtgctcagca

SEQ ID NO: 1025962 - DNA, 17 bp, Homo sapiens
tctgatctttttataca

SEQ ID NO: 1025963 - DNA, 19 bp, Homo sapiens
tctgatctttttatacaca

SEQ ID NO: 1025964 - DNA, 20 bp, Homo sapiens
tctgatgaaatgttaacaat

SEQ ID NO: 1025965 - DNA, 22 bp, Homo sapiens
tctgatgacagtgttatcccaa

SEQ ID NO: 1025966 - DNA, 17 bp, Homo sapiens
tctgatgacgcctgtct

SEQ ID NO: 1025967 - DNA, 12 bp, Homo sapiens
tctgatgatgtc

SEQ ID NO: 1025968 - DNA, 12 bp, Homo sapiens
tctgatgcagaa

SEQ ID NO: 1025969 - DNA, 13 bp, Homo sapiens
tctgatgcagctt

SEQ ID NO: 1025970 - DNA, 16 bp, Homo sapiens
tctgatgcagcttata

SEQ ID NO: 1025971 - DNA, 22 bp, Homo sapiens
tctgatggaatgtgccacctgt

SEQ ID NO: 1025972 - DNA, 13 bp, Homo sapiens
tctgatggcctta

SEQ ID NO: 1025973 - DNA, 21 bp, Homo sapiens
tctgatggccttaatttcctt

SEQ ID NO: 1025974 - DNA, 17 bp, Homo sapiens
tctgatggtgagctggg

SEQ ID NO: 1025975 - DNA, 21 bp, Homo sapiens
tctgatgtattacatgactgt

SEQ ID NO: 1025976 - DNA, 13 bp, Homo sapiens
tctgatgtcccag

SEQ ID NO: 1025977 - DNA, 14 bp, Homo sapiens
tctgatgtcccagt

SEQ ID NO: 1025978 - DNA, 12 bp, Homo sapiens
tctgatgtttat

SEQ ID NO: 1025979 - DNA, 20 bp, Homo sapiens
tctgattaatatatttaata

SEQ ID NO: 1025980 - DNA, 14 bp, Homo sapiens
tctgattactgtcc

SEQ ID NO: 1025981 - DNA, 18 bp, Homo sapiens
tctgattcacctcttcct

SEQ ID NO: 1025982 - DNA, 22 bp, Homo sapiens
tctgattcacctcttcctctgg

SEQ ID NO: 1025983 - DNA, 16 bp, Homo sapiens
tctgattggacatttt

SEQ ID NO: 1025984 - DNA, 13 bp, Homo sapiens
tctgattggctca

SEQ ID NO: 1025985 - DNA, 13 bp, Homo sapiens
tctgatttaattg

SEQ ID NO: 1025986 - DNA, 20 bp, Homo sapiens
tctgatttattttgtatgaa

SEQ ID NO: 1025987 - DNA, 23 bp, Homo sapiens
tctgatttattttgtatgaaata

SEQ ID NO: 1025988 - DNA, 12 bp, Homo sapiens
tctgatttcagt

SEQ ID NO: 1025989 - DNA, 18 bp, Homo sapiens
tctgatttcagtttttca

SEQ ID NO: 1025990 - DNA, 22 bp, Homo sapiens
tctgatttcagtttttcatttg

SEQ ID NO: 1025991 - DNA, 13 bp, Homo sapiens
tctgatttcataa

SEQ ID NO: 1025992 - DNA, 13 bp, Homo sapiens
tctgatttcatta

SEQ ID NO: 1025993 - DNA, 15 bp, Homo sapiens
tctgatttccttcca

SEQ ID NO: 1025994 - DNA, 20 bp, Homo sapiens
tctgatttgtccctatgcat

SEQ ID NO: 1025995 - DNA, 15 bp, Homo sapiens
tctgatttgtcctgc

SEQ ID NO: 1025996 - DNA, 21 bp, Homo sapiens
tctgattttgtgcaaaagctt

SEQ ID NO: 1025997 - DNA, 16 bp, Homo sapiens
tctgatttttcctttc

SEQ ID NO: 1025998 - DNA, 19 bp, Homo sapiens
tctgcaaaaatatttataa

SEQ ID NO: 1025999 - DNA, 20 bp, Homo sapiens
tctgcaaaatgaggaatgta

SEQ ID NO: 1026000 - DNA, 23 bp, Homo sapiens
tctgcaaaatgaggaatgtatat

SEQ ID NO: 1026001 - DNA, 19 bp, Homo sapiens
tctgcaaacaatgaagaat

SEQ ID NO: 1026002 - DNA, 21 bp, Homo sapiens
tctgcaaaggtggcaatgctt

SEQ ID NO: 1026003 - DNA, 14 bp, Homo sapiens
tctgcaacactttg

SEQ ID NO: 1026004 - DNA, 17 bp, Homo sapiens
tctgcaactagccaagg

SEQ ID NO: 1026005 - DNA, 19 bp, Homo sapiens
tctgcaactagccaaggct

SEQ ID NO: 1026006 - DNA, 14 bp, Homo sapiens
tctgcaactgctca

SEQ ID NO: 1026007 - DNA, 17 bp, Homo sapiens
tctgcaactgctcagct

SEQ ID NO: 1026008 - DNA, 22 bp, Homo sapiens
tctgcaactgctcagctctggt

SEQ ID NO: 1026009 - DNA, 22 bp, Homo sapiens
tctgcaagaattaaaactgagt

SEQ ID NO: 1026010 - DNA, 14 bp, Homo sapiens
tctgcaagacaaag

SEQ ID NO: 1026011 - DNA, 18 bp, Homo sapiens
tctgcaagggcccagagt

SEQ ID NO: 1026012 - DNA, 18 bp, Homo sapiens
tctgcaattcccctctgc

SEQ ID NO: 1026013 - DNA, 20 bp, Homo sapiens
tctgcaattcccctctgctg

SEQ ID NO: 1026014 - DNA, 21 bp, Homo sapiens
tctgcaattcccctctgctgc

SEQ ID NO: 1026015 - DNA, 22 bp, Homo sapiens
tctgcaattcccctctgctgct

SEQ ID NO: 1026016 - DNA, 12 bp, Homo sapiens
tctgcaatttgt

SEQ ID NO: 1026017 - DNA, 14 bp, Homo sapiens
tctgcacaagctgc

SEQ ID NO: 1026018 - DNA, 19 bp, Homo sapiens
tctgcacaagctgcaccct

SEQ ID NO: 1026019 - DNA, 14 bp, Homo sapiens
tctgcacagagggt

SEQ ID NO: 1026020 - DNA, 13 bp, Homo sapiens
tctgcacagatgg

SEQ ID NO: 1026021 - DNA, 21 bp, Homo sapiens
tctgcacatgcagctgcaccc

SEQ ID NO: 1026022 - DNA, 17 bp, Homo sapiens
tctgcaccaccatgccc

SEQ ID NO: 1026023 - DNA, 15 bp, Homo sapiens
tctgcacccaggggt

SEQ ID NO: 1026024 - DNA, 21 bp, Homo sapiens
tctgcacccccagcaagaagg

SEQ ID NO: 1026025 - DNA, 14 bp, Homo sapiens
tctgcaccctccac

SEQ ID NO: 1026026 - DNA, 21 bp, Homo sapiens
tctgcaccctccaccctgtcc

SEQ ID NO: 1026027 - DNA, 19 bp, Homo sapiens
tctgcacccttcttttctc

SEQ ID NO: 1026028 - DNA, 21 bp, Homo sapiens
tctgcacccttcttttctcat

SEQ ID NO: 1026029 - DNA, 12 bp, Homo sapiens
tctgcactactc

SEQ ID NO: 1026030 - DNA, 14 bp, Homo sapiens
tctgcactactcct

SEQ ID NO: 1026031 - DNA, 23 bp, Homo sapiens
tctgcactactcctctgcagtgc

SEQ ID NO: 1026032 - DNA, 13 bp, Homo sapiens
tctgcactccatg

SEQ ID NO: 1026033 - DNA, 18 bp, Homo sapiens
tctgcactccatggccac

SEQ ID NO: 1026034 - DNA, 19 bp, Homo sapiens
tctgcactccatggccacc

SEQ ID NO: 1026035 - DNA, 21 bp, Homo sapiens
tctgcactcccacctgacaca

SEQ ID NO: 1026036 - DNA, 19 bp, Homo sapiens
tctgcactctaaactgcaa

SEQ ID NO: 1026037 - DNA, 22 bp, Homo sapiens
tctgcagaacatcgatatgtat

SEQ ID NO: 1026038 - DNA, 15 bp, Homo sapiens
tctgcagaaggaaaa

SEQ ID NO: 1026039 - DNA, 22 bp, Homo sapiens
tctgcagaataaaatctctatt

SEQ ID NO: 1026040 - DNA, 21 bp, Homo sapiens
tctgcctctgggcagcctgct

SEQ ID NO: 1026041 - DNA, 17 bp, Homo sapiens
tctgcctcttctgggag

SEQ ID NO: 1026042 - DNA, 14 bp, Homo sapiens
tctgcctgccccgc

SEQ ID NO: 1026043 - DNA, 20 bp, Homo sapiens
tctgcctgcctcctccctcc

SEQ ID NO: 1026044 - DNA, 13 bp, Homo sapiens
tctgcctgcctgc

SEQ ID NO: 1026045 - DNA, 12 bp, Homo sapiens
tctgcctggagt

SEQ ID NO: 1026046 - DNA, 13 bp, Homo sapiens
tctgcctggagtg

SEQ ID NO: 1026047 - DNA, 13 bp, Homo sapiens
tctgcctggcctg

SEQ ID NO: 1026048 - DNA, 18 bp, Homo sapiens
tctgcctggcctggctcc

SEQ ID NO: 1026049 - DNA, 19 bp, Homo sapiens
tctgcctggcctggctccc

SEQ ID NO: 1026050 - DNA, 20 bp, Homo sapiens
tctgcctggcctggctcccc

SEQ ID NO: 1026051 - DNA, 14 bp, Homo sapiens
tctgcctgggcctg

SEQ ID NO: 1026052 - DNA, 15 bp, Homo sapiens
tctgcctgggcctgt

SEQ ID NO: 1026053 - DNA, 16 bp, Homo sapiens
tctgcctgggcctgtg

SEQ ID NO: 1026054 - DNA, 22 bp, Homo sapiens
tctgcctgggcctgtgcagcag

SEQ ID NO: 1026055 - DNA, 23 bp, Homo sapiens
tctgcctggggcctccagaagct

SEQ ID NO: 1026056 - DNA, 14 bp, Homo sapiens
tctgcctgtctccc

SEQ ID NO: 1026057 - DNA, 18 bp, Homo sapiens
tctgcctgtctggtgcct

SEQ ID NO: 1026058 - DNA, 19 bp, Homo sapiens
tctgcctgttataactctg

SEQ ID NO: 1026059 - DNA, 22 bp, Homo sapiens
tctgcctgttataactctgcac

SEQ ID NO: 1026060 - DNA, 13 bp, Homo sapiens
tctgccttagcct

SEQ ID NO: 1026061 - DNA, 21 bp, Homo sapiens
tctgccttcacaaatgtcatt

SEQ ID NO: 1026062 - DNA, 17 bp, Homo sapiens
tctgccttcaggcttct

SEQ ID NO: 1026063 - DNA, 18 bp, Homo sapiens
tctgccttccagcccaga

SEQ ID NO: 1026064 - DNA, 20 bp, Homo sapiens
tctgccttccagcccagacc

SEQ ID NO: 1026065 - DNA, 12 bp, Homo sapiens
tctgccttggac

SEQ ID NO: 1026066 - DNA, 14 bp, Homo sapiens
tctgccttggacac

SEQ ID NO: 1026067 - DNA, 16 bp, Homo sapiens
tctgccttggacacca

SEQ ID NO: 1026068 - DNA, 19 bp, Homo sapiens
tctgccttggttctggcca

SEQ ID NO: 1026069 - DNA, 20 bp, Homo sapiens
gctgggacctaatgctggcc

SEQ ID NO: 1026070 - DNA, 18 bp, Homo sapiens
gctgggacgatcgcccag

SEQ ID NO: 1026071 - DNA, 20 bp, Homo sapiens
gctgggacgtggctcagcca

SEQ ID NO: 1026072 - DNA, 22 bp, Homo sapiens
gctgggacgtggctcagccagc

SEQ ID NO: 1026073 - DNA, 14 bp, Homo sapiens
gctgggactacagg

SEQ ID NO: 1026074 - DNA, 15 bp, Homo sapiens
gctgggactcagcct

SEQ ID NO: 1026075 - DNA, 14 bp, Homo sapiens
gctgggactgagcc

SEQ ID NO: 1026076 - DNA, 17 bp, Homo sapiens
gctgggactgagccagt

SEQ ID NO: 1026077 - DNA, 14 bp, Homo sapiens
gctgggactggcca

SEQ ID NO: 1026078 - DNA, 15 bp, Homo sapiens
gctgggactggccag

SEQ ID NO: 1026079 - DNA, 16 bp, Homo sapiens
gctgggactggccagg

SEQ ID NO: 1026080 - DNA, 19 bp, Homo sapiens
gctgggacttcttacccaa

SEQ ID NO: 1026081 - DNA, 13 bp, Homo sapiens
gctgggagccagg

SEQ ID NO: 1026082 - DNA, 17 bp, Homo sapiens
gctgggagccagtgtgc

SEQ ID NO: 1026083 - DNA, 19 bp, Homo sapiens
gctgggagcctcgcccctc

SEQ ID NO: 1026084 - DNA, 13 bp, Homo sapiens
gctgggagcctgg

SEQ ID NO: 1026085 - DNA, 13 bp, Homo sapiens
gctgggagctcca

SEQ ID NO: 1026086 - DNA, 18 bp, Homo sapiens
gctgggagctccactctg

SEQ ID NO: 1026087 - DNA, 16 bp, Homo sapiens
gctgggagctctgcag

SEQ ID NO: 1026088 - DNA, 15 bp, Homo sapiens
gctgggaggaaggac

SEQ ID NO: 1026089 - DNA, 22 bp, Homo sapiens
gctgggaggaaggacttccctg

SEQ ID NO: 1026090 - DNA, 16 bp, Homo sapiens
gctgggaggagggaga

SEQ ID NO: 1026091 - DNA, 17 bp, Homo sapiens
gctgggaggagggagag

SEQ ID NO: 1026092 - DNA, 21 bp, Homo sapiens
gctgggaggcaagaggggtgg

SEQ ID NO: 1026093 - DNA, 15 bp, Homo sapiens
gctgggaggcatggc

SEQ ID NO: 1026094 - DNA, 20 bp, Homo sapiens
gctgggaggcatggccctgg

SEQ ID NO: 1026095 - DNA, 21 bp, Homo sapiens
gctgggaggtctcgtcccagc

SEQ ID NO: 1026096 - DNA, 18 bp, Homo sapiens
gctgggaggttgggaggc

SEQ ID NO: 1026097 - DNA, 21 bp, Homo sapiens
gctgggagtccctacctgctt

SEQ ID NO: 1026098 - DNA, 23 bp, Homo sapiens
gctgggatgacaggtgtgagcca

SEQ ID NO: 1026099 - DNA, 21 bp, Homo sapiens
gctgggattacaggcatgagc

SEQ ID NO: 1026100 - DNA, 22 bp, Homo sapiens
gctgggattacaggcatgtgcc

SEQ ID NO: 1026101 - DNA, 17 bp, Homo sapiens
gctgggattacagggat

SEQ ID NO: 1026102 - DNA, 16 bp, Homo sapiens
gctgggattacaggtg

SEQ ID NO: 1026103 - DNA, 23 bp, Homo sapiens
gctgggatttcttcgctgctcta

SEQ ID NO: 1026104 - DNA, 20 bp, Homo sapiens
gctgggcacacgcctcccac

SEQ ID NO: 1026105 - DNA, 22 bp, Homo sapiens
gctgggcacacgcctcccactg

SEQ ID NO: 1026106 - DNA, 17 bp, Homo sapiens
gctgggcaccgtgtcct

SEQ ID NO: 1026107 - DNA, 21 bp, Homo sapiens
gctgggcagcacaaggccttg

SEQ ID NO: 1026108 - DNA, 14 bp, Homo sapiens
gctgggcagcccgc

SEQ ID NO: 1026109 - DNA, 12 bp, Homo sapiens
gctgggcagcct

SEQ ID NO: 1026110 - DNA, 15 bp, Homo sapiens
gctgggcagccttgg

SEQ ID NO: 1026111 - DNA, 14 bp, Homo sapiens
gctgggcagggtga

SEQ ID NO: 1026112 - DNA, 13 bp, Homo sapiens
gctgggcatccca

SEQ ID NO: 1026113 - DNA, 16 bp, Homo sapiens
gctgggcatcccagct

SEQ ID NO: 1026114 - DNA, 17 bp, Homo sapiens
gctgggcatcccagctt

SEQ ID NO: 1026115 - DNA, 14 bp, Homo sapiens
gctgggccagggaa

SEQ ID NO: 1026116 - DNA, 14 bp, Homo sapiens
gctgggcccaaagg

SEQ ID NO: 1026117 - DNA, 18 bp, Homo sapiens
gctgggcccaaaggccca

SEQ ID NO: 1026118 - DNA, 19 bp, Homo sapiens
gctgggcccaaaggcccag

SEQ ID NO: 1026119 - DNA, 20 bp, Homo sapiens
gctgggcccaaaggcccagg

SEQ ID NO: 1026120 - DNA, 22 bp, Homo sapiens
gctgggcccaaaggcccaggga

SEQ ID NO: 1026121 - DNA, 15 bp, Homo sapiens
gctgggcccacccag

SEQ ID NO: 1026122 - DNA, 14 bp, Homo sapiens
gctgggcccagaag

SEQ ID NO: 1026123 - DNA, 20 bp, Homo sapiens
gctgggccccatgctctgcc

SEQ ID NO: 1026124 - DNA, 18 bp, Homo sapiens
gctgggcccccagcctgg

SEQ ID NO: 1026125 - DNA, 19 bp, Homo sapiens
gctgggcccccagcctggc

SEQ ID NO: 1026126 - DNA, 12 bp, Homo sapiens
gctgggcccctg

SEQ ID NO: 1026127 - DNA, 13 bp, Homo sapiens
gctgggcccctgc

SEQ ID NO: 1026128 - DNA, 14 bp, Homo sapiens
gctgggcccctggg

SEQ ID NO: 1026129 - DNA, 23 bp, Homo sapiens
gctgggcccctgggatgggacca

SEQ ID NO: 1026130 - DNA, 21 bp, Homo sapiens
gctgggcccctggggacagag

SEQ ID NO: 1026131 - DNA, 17 bp, Homo sapiens
gctgggccctcttatct

SEQ ID NO: 1026132 - DNA, 24 bp, Homo sapiens
gctgggccctctttccctgcgaga

SEQ ID NO: 1026133 - DNA, 19 bp, Homo sapiens
gctgggcctcccctgggca

SEQ ID NO: 1026134 - DNA, 20 bp, Homo sapiens
gctgggcctcccctgggcag

SEQ ID NO: 1026135 - DNA, 15 bp, Homo sapiens
gctgggcctccttct

SEQ ID NO: 1026136 - DNA, 17 bp, Homo sapiens
gctgggcctgtgcactg

SEQ ID NO: 1026137 - DNA, 16 bp, Homo sapiens
gctgggcgtgtgtgac

SEQ ID NO: 1026138 - DNA, 17 bp, Homo sapiens
gctgggctaggcatagg

SEQ ID NO: 1026139 - DNA, 19 bp, Homo sapiens
gctgggctctccacctcag

SEQ ID NO: 1026140 - DNA, 21 bp, Homo sapiens
gctgggctctccacctcagcc

SEQ ID NO: 1026141 - DNA, 18 bp, Homo sapiens
gctgggctgagcccctac

SEQ ID NO: 1026142 - DNA, 14 bp, Homo sapiens
gctgggctgagtga

SEQ ID NO: 1026143 - DNA, 15 bp, Homo sapiens
gctgggctggactgg

SEQ ID NO: 1026144 - DNA, 19 bp, Homo sapiens
gctgggctggactggccat

SEQ ID NO: 1026145 - DNA, 18 bp, Homo sapiens
gctgggctgggccctctt

SEQ ID NO: 1026146 - DNA, 12 bp, Homo sapiens
gctggggaaggg

SEQ ID NO: 1026147 - DNA, 21 bp, Homo sapiens
gctggggaagggttttctttt

SEQ ID NO: 1026148 - DNA, 23 bp, Homo sapiens
gctggggaagggttttcttttct

SEQ ID NO: 1026149 - DNA, 21 bp, Homo sapiens
gctggggaagtacgtcccagc

SEQ ID NO: 1026150 - DNA, 16 bp, Homo sapiens
gctggggacagagggt

SEQ ID NO: 1026151 - DNA, 18 bp, Homo sapiens
gctggggacccacccagc

SEQ ID NO: 1026152 - DNA, 22 bp, Homo sapiens
gctggggacccacccagcccct

SEQ ID NO: 1026153 - DNA, 23 bp, Homo sapiens
gctggggacctggtaccctcctg

SEQ ID NO: 1026154 - DNA, 15 bp, Homo sapiens
gctggggactcaggg

SEQ ID NO: 1026155 - DNA, 16 bp, Homo sapiens
gctggggactcaggga

SEQ ID NO: 1026156 - DNA, 20 bp, Homo sapiens
gctggggactctggcacagt

SEQ ID NO: 1026157 - DNA, 16 bp, Homo sapiens
gctggggagatggggg

SEQ ID NO: 1026158 - DNA, 17 bp, Homo sapiens
gctggggagatgggggc

SEQ ID NO: 1026159 - DNA, 22 bp, Homo sapiens
gctggggaggaccagggccctg

SEQ ID NO: 1026160 - DNA, 22 bp, Homo sapiens
gctggggaggtgggaggccagg

SEQ ID NO: 1026161 - DNA, 18 bp, Homo sapiens
gctggggcagaggggcag

SEQ ID NO: 1026162 - DNA, 19 bp, Homo sapiens
gctgtatggcccaggcagc

SEQ ID NO: 1026163 - DNA, 17 bp, Homo sapiens
gctgtattaagccactt

SEQ ID NO: 1026164 - DNA, 13 bp, Homo sapiens
gctgtatttatct

SEQ ID NO: 1026165 - DNA, 16 bp, Homo sapiens
gctgtatttctttgta

SEQ ID NO: 1026166 - DNA, 14 bp, Homo sapiens
gctgtattttaaca

SEQ ID NO: 1026167 - DNA, 22 bp, Homo sapiens
gctgtattttaacactttgtat

SEQ ID NO: 1026168 - DNA, 20 bp, Homo sapiens
gctgtcaaggccgagggcca

SEQ ID NO: 1026169 - DNA, 23 bp, Homo sapiens
gctgtcaaggccgagggccaggc

SEQ ID NO: 1026170 - DNA, 12 bp, Homo sapiens
gctgtcaataaa

SEQ ID NO: 1026171 - DNA, 22 bp, Homo sapiens
gctgtcaataaatgacacccag

SEQ ID NO: 1026172 - DNA, 13 bp, Homo sapiens
gctgtcacaggcg

SEQ ID NO: 1026173 - DNA, 20 bp, Homo sapiens
gctgtcactggcagagcaca

SEQ ID NO: 1026174 - DNA, 15 bp, Homo sapiens
gctgtcacttcttca

SEQ ID NO: 1026175 - DNA, 16 bp, Homo sapiens
gctgtcacttcttcac

SEQ ID NO: 1026176 - DNA, 12 bp, Homo sapiens
gctgtcaggctg

SEQ ID NO: 1026177 - DNA, 16 bp, Homo sapiens
gctgtcaggctgggac

SEQ ID NO: 1026178 - DNA, 17 bp, Homo sapiens
gctgtcatgtggaaact

SEQ ID NO: 1026179 - DNA, 19 bp, Homo sapiens
gctgtcatgtggaaactat

SEQ ID NO: 1026180 - DNA, 15 bp, Homo sapiens
gctgtccagccttaa

SEQ ID NO: 1026181 - DNA, 24 bp, Homo sapiens
gctgtcccaggcatgcagctgcct

SEQ ID NO: 1026182 - DNA, 12 bp, Homo sapiens
gctgtcccctct

SEQ ID NO: 1026183 - DNA, 14 bp, Homo sapiens
gctgtcccctctcc

SEQ ID NO: 1026184 - DNA, 16 bp, Homo sapiens
gctgtccctccccctt

SEQ ID NO: 1026185 - DNA, 21 bp, Homo sapiens
gctgtccctgcactgtgcccc

SEQ ID NO: 1026186 - DNA, 13 bp, Homo sapiens
gctgtccctgtca

SEQ ID NO: 1026187 - DNA, 18 bp, Homo sapiens
gctgtccctgtcaccaag

SEQ ID NO: 1026188 - DNA, 14 bp, Homo sapiens
gctgtccctgtcag

SEQ ID NO: 1026189 - DNA, 13 bp, Homo sapiens
gctgtcctaggcc

SEQ ID NO: 1026190 - DNA, 20 bp, Homo sapiens
gctgtcctcaggtggccatg

SEQ ID NO: 1026191 - DNA, 12 bp, Homo sapiens
gctgtcctcctt

SEQ ID NO: 1026192 - DNA, 18 bp, Homo sapiens
gctgtcctccttcctggg

SEQ ID NO: 1026193 - DNA, 19 bp, Homo sapiens
gctgtcctccttcctggga

SEQ ID NO: 1026194 - DNA, 20 bp, Homo sapiens
gctgtcctctcgagcccaga

SEQ ID NO: 1026195 - DNA, 11 bp, Homo sapiens
gctgtcctgcg

SEQ ID NO: 1026196 - DNA, 16 bp, Homo sapiens
gctgtcctggaggggc

SEQ ID NO: 1026197 - DNA, 23 bp, Homo sapiens
gctgtcctggaggggctggggac

SEQ ID NO: 1026198 - DNA, 21 bp, Homo sapiens
tctggaccccgtttcattttt

SEQ ID NO: 1026199 - DNA, 14 bp, Homo sapiens
tctggacctcagga

SEQ ID NO: 1026200 - DNA, 17 bp, Homo sapiens
tctggacctccatccct

SEQ ID NO: 1026201 - DNA, 17 bp, Homo sapiens
tctggacggcaggctca

SEQ ID NO: 1026202 - DNA, 23 bp, Homo sapiens
tctggacggcaggctcactgcca

SEQ ID NO: 1026203 - DNA, 20 bp, Homo sapiens
tctggactacacccaagcct

SEQ ID NO: 1026204 - DNA, 22 bp, Homo sapiens
tctggactacacccaagcctga

SEQ ID NO: 1026205 - DNA, 14 bp, Homo sapiens
tctggactctgccc

SEQ ID NO: 1026206 - DNA, 16 bp, Homo sapiens
tctggactctgcccca

SEQ ID NO: 1026207 - DNA, 17 bp, Homo sapiens
tctggactctgccccaa

SEQ ID NO: 1026208 - DNA, 12 bp, Homo sapiens
tctggactctgg

SEQ ID NO: 1026209 - DNA, 21 bp, Homo sapiens
tctggactgaagcctgcagga

SEQ ID NO: 1026210 - DNA, 12 bp, Homo sapiens
tctggactggcc

SEQ ID NO: 1026211 - DNA, 15 bp, Homo sapiens
tctggactggctaga

SEQ ID NO: 1026212 - DNA, 22 bp, Homo sapiens
tctggagaagctcccaggaaca

SEQ ID NO: 1026213 - DNA, 21 bp, Homo sapiens
tctggagaccagggagccttt

SEQ ID NO: 1026214 - DNA, 22 bp, Homo sapiens
tctggagaggttataggtcact

SEQ ID NO: 1026215 - DNA, 21 bp, Homo sapiens
tctggagcaatctgacccttc

SEQ ID NO: 1026216 - DNA, 16 bp, Homo sapiens
tctggagccaagtcca

SEQ ID NO: 1026217 - DNA, 13 bp, Homo sapiens
tctggagccagag

SEQ ID NO: 1026218 - DNA, 13 bp, Homo sapiens
tctggagcccctc

SEQ ID NO: 1026219 - DNA, 16 bp, Homo sapiens
tctggagcccctcctc

SEQ ID NO: 1026220 - DNA, 23 bp, Homo sapiens
tctggagccctaaccccttccag

SEQ ID NO: 1026221 - DNA, 18 bp, Homo sapiens
tctggaggaaagggagga

SEQ ID NO: 1026222 - DNA, 19 bp, Homo sapiens
tctggaggaaagggaggag

SEQ ID NO: 1026223 - DNA, 15 bp, Homo sapiens
tctggaggcctctgg

SEQ ID NO: 1026224 - DNA, 16 bp, Homo sapiens
tctggaggcctctggc

SEQ ID NO: 1026225 - DNA, 18 bp, Homo sapiens
tctggaggcctctggccc

SEQ ID NO: 1026226 - DNA, 20 bp, Homo sapiens
tctggaggcctctggccctc

SEQ ID NO: 1026227 - DNA, 20 bp, Homo sapiens
tctggaggccttccagctgc

SEQ ID NO: 1026228 - DNA, 21 bp, Homo sapiens
tctggaggccttccagctgct

SEQ ID NO: 1026229 - DNA, 16 bp, Homo sapiens
tctggagggaaacacc

SEQ ID NO: 1026230 - DNA, 16 bp, Homo sapiens
tctggagggctggtgg

SEQ ID NO: 1026231 - DNA, 18 bp, Homo sapiens
tctggaggggagagcttt

SEQ ID NO: 1026232 - DNA, 18 bp, Homo sapiens
tctggaggtgctgctcta

SEQ ID NO: 1026233 - DNA, 16 bp, Homo sapiens
tctggagtcccacccg

SEQ ID NO: 1026234 - DNA, 17 bp, Homo sapiens
tctggagtcccacccgg

SEQ ID NO: 1026235 - DNA, 20 bp, Homo sapiens
tctggagtgatggtgtcctt

SEQ ID NO: 1026236 - DNA, 14 bp, Homo sapiens
tctggagtggccac

SEQ ID NO: 1026237 - DNA, 19 bp, Homo sapiens
tctggagtggccactaagc

SEQ ID NO: 1026238 - DNA, 15 bp, Homo sapiens
tctggatcagtaaaa

SEQ ID NO: 1026239 - DNA, 17 bp, Homo sapiens
tctggatctgaccctcc

SEQ ID NO: 1026240 - DNA, 18 bp, Homo sapiens
tctggatgggaggagagc

SEQ ID NO: 1026241 - DNA, 13 bp, Homo sapiens
tctggattcaaat

SEQ ID NO: 1026242 - DNA, 17 bp, Homo sapiens
tctggattcagccttct

SEQ ID NO: 1026243 - DNA, 21 bp, Homo sapiens
tctggattctgaatctcaaga

SEQ ID NO: 1026244 - DNA, 18 bp, Homo sapiens
tctggcaaggactttgta

SEQ ID NO: 1026245 - DNA, 16 bp, Homo sapiens
tctggcacactccctc

SEQ ID NO: 1026246 - DNA, 16 bp, Homo sapiens
tctggcagcctcccat

SEQ ID NO: 1026247 - DNA, 16 bp, Homo sapiens
tctggcatggctccct

SEQ ID NO: 1026248 - DNA, 20 bp, Homo sapiens
tctggcattctacacctgga

SEQ ID NO: 1026249 - DNA, 16 bp, Homo sapiens
tctggccaaatatgca

SEQ ID NO: 1026250 - DNA, 11 bp, Homo sapiens
tctggccaccc

SEQ ID NO: 1026251 - DNA, 17 bp, Homo sapiens
tctggccaccctggccc

SEQ ID NO: 1026252 - DNA, 18 bp, Homo sapiens
tctggccaccctggcccg

SEQ ID NO: 1026253 - DNA, 18 bp, Homo sapiens
tctggccaggcactgcct

SEQ ID NO: 1026254 - DNA, 11 bp, Homo sapiens
tctggccctga

SEQ ID NO: 1026255 - DNA, 13 bp, Homo sapiens
tctggcccttgga

SEQ ID NO: 1026256 - DNA, 14 bp, Homo sapiens
tctggcccttggaa

SEQ ID NO: 1026257 - DNA, 15 bp, Homo sapiens
tctggcccttggaat

SEQ ID NO: 1026258 - DNA, 16 bp, Homo sapiens
tctggcccttggaata

SEQ ID NO: 1026259 - DNA, 14 bp, Homo sapiens
tctggcctccagcc

SEQ ID NO: 1026260 - DNA, 15 bp, Homo sapiens
tctggcctccagcct

SEQ ID NO: 1026261 - DNA, 13 bp, Homo sapiens
tctggcctcccac

SEQ ID NO: 1026262 - DNA, 14 bp, Homo sapiens
tctggcctcccacc

SEQ ID NO: 1026263 - DNA, 12 bp, Homo sapiens
tctggcctccta

SEQ ID NO: 1026264 - DNA, 16 bp, Homo sapiens
tctggcctcctaaggc

SEQ ID NO: 1026265 - DNA, 21 bp, Homo sapiens
tctggcctcctaaggctcccc

SEQ ID NO: 1026266 - DNA, 23 bp, Homo sapiens
tctggcctcctaaggctccccac

SEQ ID NO: 1026267 - DNA, 21 bp, Homo sapiens
tctggcgcccctgcctgtgcc

SEQ ID NO: 1026268 - DNA, 16 bp, Homo sapiens
tctggcggtggccaca

SEQ ID NO: 1026269 - DNA, 22 bp, Homo sapiens
tctggcggtggccacagcgtgc

SEQ ID NO: 1026270 - DNA, 23 bp, Homo sapiens
tctggcggtggccacagcgtgct

SEQ ID NO: 1026271 - DNA, 18 bp, Homo sapiens
tctggcgttctcaagaat

SEQ ID NO: 1026272 - DNA, 16 bp, Homo sapiens
tctggctagaggccag

SEQ ID NO: 1026273 - DNA, 21 bp, Homo sapiens
tctggctagaggccagcccca

SEQ ID NO: 1026274 - DNA, 22 bp, Homo sapiens
tctggctagaggccagccccac

SEQ ID NO: 1026275 - DNA, 19 bp, Homo sapiens
tctggctatgcatttgaaa

SEQ ID NO: 1026276 - DNA, 23 bp, Homo sapiens
tctggctcagcctgtctcgggct

SEQ ID NO: 1026277 - DNA, 22 bp, Homo sapiens
tctggctctaattcacagtgct

SEQ ID NO: 1026278 - DNA, 16 bp, Homo sapiens
tctggctgaaccctgt

SEQ ID NO: 1026279 - DNA, 18 bp, Homo sapiens
tctggctgaaccctgtgc

SEQ ID NO: 1026280 - DNA, 22 bp, Homo sapiens
tctggctggaaagcagagcctc

SEQ ID NO: 1026281 - DNA, 21 bp, Homo sapiens
tctggctggctaactggaagc

SEQ ID NO: 1026282 - DNA, 15 bp, Homo sapiens
tctggctggtcttca

SEQ ID NO: 1026283 - DNA, 14 bp, Homo sapiens
tctggctgtctaga

SEQ ID NO: 1026284 - DNA, 16 bp, Homo sapiens
tctggtgtaggaagtt

SEQ ID NO: 1026285 - DNA, 13 bp, Homo sapiens
tctggtgtctgct

SEQ ID NO: 1026286 - DNA, 13 bp, Homo sapiens
tctggttaaaaaa

SEQ ID NO: 1026287 - DNA, 13 bp, Homo sapiens
tctggttccaaac

SEQ ID NO: 1026288 - DNA, 12 bp, Homo sapiens
tctggttccagg

SEQ ID NO: 1026289 - DNA, 22 bp, Homo sapiens
tctggttgatttgtaacacagt

SEQ ID NO: 1026290 - DNA, 16 bp, Homo sapiens
tctggttgtatttcta

SEQ ID NO: 1026291 - DNA, 16 bp, Homo sapiens
tctggtttctgtcccc

SEQ ID NO: 1026292 - DNA, 23 bp, Homo sapiens
tctggttttctagcccctctgga

SEQ ID NO: 1026293 - DNA, 12 bp, Homo sapiens
tctgtaaactgt

SEQ ID NO: 1026294 - DNA, 15 bp, Homo sapiens
tctgtaaagaaaacc

SEQ ID NO: 1026295 - DNA, 19 bp, Homo sapiens
tctgtaaagctaaaataaa

SEQ ID NO: 1026296 - DNA, 12 bp, Homo sapiens
tctgtaaataac

SEQ ID NO: 1026297 - DNA, 16 bp, Homo sapiens
tctgtaacccccaagg

SEQ ID NO: 1026298 - DNA, 20 bp, Homo sapiens
tctgtaacccttgaatttct

SEQ ID NO: 1026299 - DNA, 23 bp, Homo sapiens
tctgtaactctttctgaggagct

SEQ ID NO: 1026300 - DNA, 15 bp, Homo sapiens
tctgtaactgcccag

SEQ ID NO: 1026301 - DNA, 17 bp, Homo sapiens
tctgtaactgcccagcc

SEQ ID NO: 1026302 - DNA, 20 bp, Homo sapiens
tctgtaactgcccagcccct

SEQ ID NO: 1026303 - DNA, 18 bp, Homo sapiens
tctgtaacttacacctgg

SEQ ID NO: 1026304 - DNA, 13 bp, Homo sapiens
tctgtaataatag

SEQ ID NO: 1026305 - DNA, 16 bp, Homo sapiens
tctgtaataatagact

SEQ ID NO: 1026306 - DNA, 19 bp, Homo sapiens
tctgtaataatagactgta

SEQ ID NO: 1026307 - DNA, 16 bp, Homo sapiens
tctgtaatagttcagt

SEQ ID NO: 1026308 - DNA, 17 bp, Homo sapiens
tctgtaatagttcagta

SEQ ID NO: 1026309 - DNA, 14 bp, Homo sapiens
tctgtaatcaatat

SEQ ID NO: 1026310 - DNA, 20 bp, Homo sapiens
tctgtaattcaggtttttcc

SEQ ID NO: 1026311 - DNA, 14 bp, Homo sapiens
tctgtaattgcaaa

SEQ ID NO: 1026312 - DNA, 18 bp, Homo sapiens
tctgtaatttgcttgttt

SEQ ID NO: 1026313 - DNA, 13 bp, Homo sapiens
tctgtacaatgaa

SEQ ID NO: 1026314 - DNA, 23 bp, Homo sapiens
tctgtacaatgaacccccatgat

SEQ ID NO: 1026315 - DNA, 19 bp, Homo sapiens
tctgtacagaatgctattt

SEQ ID NO: 1026316 - DNA, 17 bp, Homo sapiens
tctgtacatactggcct

SEQ ID NO: 1026317 - DNA, 18 bp, Homo sapiens
tctgtacatactggcctc

SEQ ID NO: 1026318 - DNA, 14 bp, Homo sapiens
tctgtaccacacta

SEQ ID NO: 1026319 - DNA, 12 bp, Homo sapiens
tctgtaccagtt

SEQ ID NO: 1026320 - DNA, 14 bp, Homo sapiens
tctgtactttgtgt

SEQ ID NO: 1026321 - DNA, 20 bp, Homo sapiens
tctgtagaaaagaaaacatt

SEQ ID NO: 1026322 - DNA, 14 bp, Homo sapiens
tctgtagacttctg

SEQ ID NO: 1026323 - DNA, 19 bp, Homo sapiens
tctgtagacttctggttgt

SEQ ID NO: 1026324 - DNA, 22 bp, Homo sapiens
tctgtagacttctggttgtatt

SEQ ID NO: 1026325 - DNA, 19 bp, Homo sapiens
tctgtagattctgtggaac

SEQ ID NO: 1026326 - DNA, 14 bp, Homo sapiens
tctgtagctcctca

SEQ ID NO: 1026327 - DNA, 17 bp, Homo sapiens
gctgttgccatagcccc

SEQ ID NO: 1026328 - DNA, 19 bp, Homo sapiens
gctgttgctagggagaggg

SEQ ID NO: 1026329 - DNA, 17 bp, Homo sapiens
gctgttggacagctgct

SEQ ID NO: 1026330 - DNA, 18 bp, Homo sapiens
gctgttggacagctgctt

SEQ ID NO: 1026331 - DNA, 20 bp, Homo sapiens
gctgttggaggaccccgagg

SEQ ID NO: 1026332 - DNA, 22 bp, Homo sapiens
gctgttggcactcacagacctg

SEQ ID NO: 1026333 - DNA, 23 bp, Homo sapiens
gctgttggcactcacagacctgg

SEQ ID NO: 1026334 - DNA, 21 bp, Homo sapiens
gctgttggtcctctctctgtg

SEQ ID NO: 1026335 - DNA, 22 bp, Homo sapiens
gctgttggtcctctctctgtgg

SEQ ID NO: 1026336 - DNA, 17 bp, Homo sapiens
gctgtttatacttgaga

SEQ ID NO: 1026337 - DNA, 16 bp, Homo sapiens
gctgtttatggcctca

SEQ ID NO: 1026338 - DNA, 17 bp, Homo sapiens
gctgtttatggcctcag

SEQ ID NO: 1026339 - DNA, 23 bp, Homo sapiens
gctgtttatggcctcagctgcct

SEQ ID NO: 1026340 - DNA, 18 bp, Homo sapiens
gctgtttatttattcact

SEQ ID NO: 1026341 - DNA, 21 bp, Homo sapiens
gctgtttattttttttggcct

SEQ ID NO: 1026342 - DNA, 13 bp, Homo sapiens
gctgtttccatag

SEQ ID NO: 1026343 - DNA, 12 bp, Homo sapiens
gctgtttctaag

SEQ ID NO: 1026344 - DNA, 13 bp, Homo sapiens
gctgtttctcatg

SEQ ID NO: 1026345 - DNA, 13 bp, Homo sapiens
gctgtttgaaaat

SEQ ID NO: 1026346 - DNA, 19 bp, Homo sapiens
gctgtttgagattctcaaa

SEQ ID NO: 1026347 - DNA, 12 bp, Homo sapiens
gctgtttggaaa

SEQ ID NO: 1026348 - DNA, 18 bp, Homo sapiens
gctgtttgtagtgaaata

SEQ ID NO: 1026349 - DNA, 17 bp, Homo sapiens
gctgtttgttccaggct

SEQ ID NO: 1026350 - DNA, 21 bp, Homo sapiens
gctgtttgtttgacaaagaaa

SEQ ID NO: 1026351 - DNA, 16 bp, Homo sapiens
gctgttttaaacatta

SEQ ID NO: 1026352 - DNA, 18 bp, Homo sapiens
gctgttttagctgaggga

SEQ ID NO: 1026353 - DNA, 21 bp, Homo sapiens
gctgttttcctcccttctgct

SEQ ID NO: 1026354 - DNA, 12 bp, Homo sapiens
gctgttttctag

SEQ ID NO: 1026355 - DNA, 15 bp, Homo sapiens
gctgttttgtgtata

SEQ ID NO: 1026356 - DNA, 13 bp, Homo sapiens
gctgttttgttat

SEQ ID NO: 1026357 - DNA, 16 bp, Homo sapiens
gctgttttgttatata

SEQ ID NO: 1026358 - DNA, 23 bp, Homo sapiens
gctgttttgttatataatttaga

SEQ ID NO: 1026359 - DNA, 13 bp, Homo sapiens
gctgtttttttgt

SEQ ID NO: 1026360 - DNA, 12 bp, Homo sapiens
gcttaaaataca

SEQ ID NO: 1026361 - DNA, 14 bp, Homo sapiens
gcttaaaatacaag

SEQ ID NO: 1026362 - DNA, 20 bp, Homo sapiens
gcttaaaatatgtatgtcta

SEQ ID NO: 1026363 - DNA, 22 bp, Homo sapiens
gcttaaacccatattgtaaaac

SEQ ID NO: 1026364 - DNA, 12 bp, Homo sapiens
gcttaaactaaa

SEQ ID NO: 1026365 - DNA, 22 bp, Homo sapiens
gcttaaacttgacccaggtggc

SEQ ID NO: 1026366 - DNA, 23 bp, Homo sapiens
gcttaaaggcagtattttgtgtc

SEQ ID NO: 1026367 - DNA, 16 bp, Homo sapiens
gcttaaagtgaaggaa

SEQ ID NO: 1026368 - DNA, 17 bp, Homo sapiens
gcttaaagtgaaggaaa

SEQ ID NO: 1026369 - DNA, 14 bp, Homo sapiens
gcttaaattttaac

SEQ ID NO: 1026370 - DNA, 17 bp, Homo sapiens
gcttaagaactgcttca

SEQ ID NO: 1026371 - DNA, 18 bp, Homo sapiens
gcttaagccactgcctct

SEQ ID NO: 1026372 - DNA, 18 bp, Homo sapiens
gcttaagtgagcagaaca

SEQ ID NO: 1026373 - DNA, 19 bp, Homo sapiens
gcttaagtgagcagaacag

SEQ ID NO: 1026374 - DNA, 18 bp, Homo sapiens
gcttaagtgtaaatgaag

SEQ ID NO: 1026375 - DNA, 16 bp, Homo sapiens
gcttaataaaagaaca

SEQ ID NO: 1026376 - DNA, 17 bp, Homo sapiens
gcttaataaaagaacat

SEQ ID NO: 1026377 - DNA, 15 bp, Homo sapiens
gcttaatagccctcc

SEQ ID NO: 1026378 - DNA, 16 bp, Homo sapiens
gcttacaactttctaa

SEQ ID NO: 1026379 - DNA, 19 bp, Homo sapiens
gcttacaattccctgctgt

SEQ ID NO: 1026380 - DNA, 14 bp, Homo sapiens
gcttacactgagga

SEQ ID NO: 1026381 - DNA, 15 bp, Homo sapiens
gcttacactgaggac

SEQ ID NO: 1026382 - DNA, 20 bp, Homo sapiens
gcttacaggaaaacctgcag

SEQ ID NO: 1026383 - DNA, 11 bp, Homo sapiens
gcttacatttt

SEQ ID NO: 1026384 - DNA, 18 bp, Homo sapiens
gcttacatttttacaata

SEQ ID NO: 1026385 - DNA, 19 bp, Homo sapiens
gcttacatttttacaataa

SEQ ID NO: 1026386 - DNA, 14 bp, Homo sapiens
gcttacccaagctg

SEQ ID NO: 1026387 - DNA, 14 bp, Homo sapiens
gcttaccttttcct

SEQ ID NO: 1026388 - DNA, 23 bp, Homo sapiens
gcttactaagctttgccagctgc

SEQ ID NO: 1026389 - DNA, 15 bp, Homo sapiens
gcttactcctctgac

SEQ ID NO: 1026390 - DNA, 17 bp, Homo sapiens
gcttactgatatatttt

SEQ ID NO: 1026391 - DNA, 14 bp, Homo sapiens
gcttactttttaat

SEQ ID NO: 1026392 - DNA, 16 bp, Homo sapiens
gcttactttttaattt

SEQ ID NO: 1026393 - DNA, 12 bp, Homo sapiens
gcttagaaataa

SEQ ID NO: 1026394 - DNA, 15 bp, Homo sapiens
gcttagacctcagcc

SEQ ID NO: 1026395 - DNA, 21 bp, Homo sapiens
gcttagacttcgactcaggat

SEQ ID NO: 1026396 - DNA, 23 bp, Homo sapiens
gcttagacttcgactcaggatcc

SEQ ID NO: 1026397 - DNA, 23 bp, Homo sapiens
gcttagagagaggaggcagcccc

SEQ ID NO: 1026398 - DNA, 16 bp, Homo sapiens
gcttagagtgcccagc

SEQ ID NO: 1026399 - DNA, 19 bp, Homo sapiens
gcttagagtgcccagcaga

SEQ ID NO: 1026400 - DNA, 20 bp, Homo sapiens
gcttagagtgcccagcagag

SEQ ID NO: 1026401 - DNA, 14 bp, Homo sapiens
gcttagagttcttc

SEQ ID NO: 1026402 - DNA, 18 bp, Homo sapiens
gcttagagttcttctttc

SEQ ID NO: 1026403 - DNA, 15 bp, Homo sapiens
gcttagccaagccct

SEQ ID NO: 1026404 - DNA, 18 bp, Homo sapiens
gcttagccaagccctaag

SEQ ID NO: 1026405 - DNA, 23 bp, Homo sapiens
gcttagccccgctgagcttggag

SEQ ID NO: 1026406 - DNA, 17 bp, Homo sapiens
tctgtcccccaggctgg

SEQ ID NO: 1026407 - DNA, 15 bp, Homo sapiens
tctgtccccggggca

SEQ ID NO: 1026408 - DNA, 22 bp, Homo sapiens
tctgtccctattatttgcccta

SEQ ID NO: 1026409 - DNA, 15 bp, Homo sapiens
tctgtccctgtcctt

SEQ ID NO: 1026410 - DNA, 19 bp, Homo sapiens
tctgtccgagctttgaaaa

SEQ ID NO: 1026411 - DNA, 18 bp, Homo sapiens
tctgtcctacttctgact

SEQ ID NO: 1026412 - DNA, 13 bp, Homo sapiens
tctgtcctcagag

SEQ ID NO: 1026413 - DNA, 15 bp, Homo sapiens
tctgtcctcagagca

SEQ ID NO: 1026414 - DNA, 22 bp, Homo sapiens
tctgtcctcccatcccctcaac

SEQ ID NO: 1026415 - DNA, 14 bp, Homo sapiens
tctgtcctctgtag

SEQ ID NO: 1026416 - DNA, 16 bp, Homo sapiens
tctgtcctgagaagca

SEQ ID NO: 1026417 - DNA, 21 bp, Homo sapiens
tctgtcctgggcatgggtcca

SEQ ID NO: 1026418 - DNA, 19 bp, Homo sapiens
tctgtccttttggcactga

SEQ ID NO: 1026419 - DNA, 21 bp, Homo sapiens
tctgtctactaagtgatgctg

SEQ ID NO: 1026420 - DNA, 15 bp, Homo sapiens
tctgtctactgtggt

SEQ ID NO: 1026421 - DNA, 14 bp, Homo sapiens
tctgtctaggactg

SEQ ID NO: 1026422 - DNA, 20 bp, Homo sapiens
tctgtctaggttaaagctaa

SEQ ID NO: 1026423 - DNA, 21 bp, Homo sapiens
tctgtctcaaaaaataaaaat

SEQ ID NO: 1026424 - DNA, 22 bp, Homo sapiens
tctgtctccctcccctctcaga

SEQ ID NO: 1026425 - DNA, 12 bp, Homo sapiens
tctgtctcgatg

SEQ ID NO: 1026426 - DNA, 20 bp, Homo sapiens
tctgtctcgatgcctgattc

SEQ ID NO: 1026427 - DNA, 20 bp, Homo sapiens
tctgtctctccccctctgtc

SEQ ID NO: 1026428 - DNA, 12 bp, Homo sapiens
tctgtctctgcc

SEQ ID NO: 1026429 - DNA, 17 bp, Homo sapiens
tctgtctctgcctccct

SEQ ID NO: 1026430 - DNA, 13 bp, Homo sapiens
tctgtctctgtgg

SEQ ID NO: 1026431 - DNA, 21 bp, Homo sapiens
tctgtctgaatgatcttgtgt

SEQ ID NO: 1026432 - DNA, 13 bp, Homo sapiens
tctgtctggtggc

SEQ ID NO: 1026433 - DNA, 20 bp, Homo sapiens
tctgtctgtcctacccgccc

SEQ ID NO: 1026434 - DNA, 15 bp, Homo sapiens
tctgtctgtctctcc

SEQ ID NO: 1026435 - DNA, 16 bp, Homo sapiens
tctgtctgtctctccc

SEQ ID NO: 1026436 - DNA, 16 bp, Homo sapiens
tctgtctgtctgtggg

SEQ ID NO: 1026437 - DNA, 13 bp, Homo sapiens
tctgtctgtgggc

SEQ ID NO: 1026438 - DNA, 17 bp, Homo sapiens
tctgtcttctctatcct

SEQ ID NO: 1026439 - DNA, 15 bp, Homo sapiens
tctgtcttctctcca

SEQ ID NO: 1026440 - DNA, 18 bp, Homo sapiens
tctgtcttctctccactt

SEQ ID NO: 1026441 - DNA, 13 bp, Homo sapiens
tctgtcttgttca

SEQ ID NO: 1026442 - DNA, 16 bp, Homo sapiens
tctgtctttccactct

SEQ ID NO: 1026443 - DNA, 21 bp, Homo sapiens
tctgtctttcctgaaccatgt

SEQ ID NO: 1026444 - DNA, 14 bp, Homo sapiens
tctgtctttctata

SEQ ID NO: 1026445 - DNA, 14 bp, Homo sapiens
tctgtcttttctcc

SEQ ID NO: 1026446 - DNA, 18 bp, Homo sapiens
tctgtcttttctcctccg

SEQ ID NO: 1026447 - DNA, 20 bp, Homo sapiens
tctgtgaaatataattgtac

SEQ ID NO: 1026448 - DNA, 15 bp, Homo sapiens
tctgtgaaatatcat

SEQ ID NO: 1026449 - DNA, 12 bp, Homo sapiens
tctgtgaataag

SEQ ID NO: 1026450 - DNA, 19 bp, Homo sapiens
tctgtgaatacaattaaag

SEQ ID NO: 1026451 - DNA, 13 bp, Homo sapiens
tctgtgaattaaa

SEQ ID NO: 1026452 - DNA, 19 bp, Homo sapiens
tctgtgaatttcagaggtc

SEQ ID NO: 1026453 - DNA, 23 bp, Homo sapiens
tctgtgacaaatgttgacctttg

SEQ ID NO: 1026454 - DNA, 16 bp, Homo sapiens
tctgtgaccaactgtt

SEQ ID NO: 1026455 - DNA, 14 bp, Homo sapiens
gcttcacagccaca

SEQ ID NO: 1026456 - DNA, 19 bp, Homo sapiens
gcttcacagtagagccagc

SEQ ID NO: 1026457 - DNA, 20 bp, Homo sapiens
gcttcacagtagagccagct

SEQ ID NO: 1026458 - DNA, 22 bp, Homo sapiens
gcttcacagtagagccagcttg

SEQ ID NO: 1026459 - DNA, 16 bp, Homo sapiens
gcttcacatagcatgt

SEQ ID NO: 1026460 - DNA, 12 bp, Homo sapiens
gcttcacatttg

SEQ ID NO: 1026461 - DNA, 14 bp, Homo sapiens
gcttcacatttgta

SEQ ID NO: 1026462 - DNA, 14 bp, Homo sapiens
gcttcaccagagca

SEQ ID NO: 1026463 - DNA, 15 bp, Homo sapiens
gcttcaccagagcat

SEQ ID NO: 1026464 - DNA, 18 bp, Homo sapiens
gcttcaccagtctgtcta

SEQ ID NO: 1026465 - DNA, 14 bp, Homo sapiens
gcttcacccctgca

SEQ ID NO: 1026466 - DNA, 15 bp, Homo sapiens
gcttcacccctgcac

SEQ ID NO: 1026467 - DNA, 21 bp, Homo sapiens
gcttcacccctgcacttcaga

SEQ ID NO: 1026468 - DNA, 23 bp, Homo sapiens
gcttcaccctcaccccctcctgg

SEQ ID NO: 1026469 - DNA, 15 bp, Homo sapiens
gcttcaccctgtcaa

SEQ ID NO: 1026470 - DNA, 15 bp, Homo sapiens
gcttcacggaagagc

SEQ ID NO: 1026471 - DNA, 23 bp, Homo sapiens
gcttcactcatgcaaactgcttt

SEQ ID NO: 1026472 - DNA, 17 bp, Homo sapiens
gcttcagaccatcagtt

SEQ ID NO: 1026473 - DNA, 13 bp, Homo sapiens
gcttcagactcaa

SEQ ID NO: 1026474 - DNA, 18 bp, Homo sapiens
gcttcagagtttgtgtgt

SEQ ID NO: 1026475 - DNA, 16 bp, Homo sapiens
gcttcagcccccacca

SEQ ID NO: 1026476 - DNA, 12 bp, Homo sapiens
gcttcagcctga

SEQ ID NO: 1026477 - DNA, 14 bp, Homo sapiens
gcttcagcctgagg

SEQ ID NO: 1026478 - DNA, 16 bp, Homo sapiens
gcttcagggagctcgc

SEQ ID NO: 1026479 - DNA, 19 bp, Homo sapiens
gcttcagtcatcagccagc

SEQ ID NO: 1026480 - DNA, 20 bp, Homo sapiens
gcttcagtcatcagccagca

SEQ ID NO: 1026481 - DNA, 14 bp, Homo sapiens
gcttcagtggagaa

SEQ ID NO: 1026482 - DNA, 18 bp, Homo sapiens
gcttcagttgttctttag

SEQ ID NO: 1026483 - DNA, 18 bp, Homo sapiens
gcttcataaatgaagcag

SEQ ID NO: 1026484 - DNA, 23 bp, Homo sapiens
gcttcatacttcatgaaatcctg

SEQ ID NO: 1026485 - DNA, 18 bp, Homo sapiens
gcttcatagtattggagc

SEQ ID NO: 1026486 - DNA, 20 bp, Homo sapiens
gcttcatgcacttaaagaag

SEQ ID NO: 1026487 - DNA, 16 bp, Homo sapiens
gcttcatgcctttgta

SEQ ID NO: 1026488 - DNA, 17 bp, Homo sapiens
gcttcatgtggcttccc

SEQ ID NO: 1026489 - DNA, 15 bp, Homo sapiens
gcttcattctccttg

SEQ ID NO: 1026490 - DNA, 10 bp, Homo sapiens
gcttcattgt

SEQ ID NO: 1026491 - DNA, 14 bp, Homo sapiens
gcttcatttcaatc

SEQ ID NO: 1026492 - DNA, 22 bp, Homo sapiens
gcttcatttccttggggctgca

SEQ ID NO: 1026493 - DNA, 22 bp, Homo sapiens
gcttcattttaggaataataaa

SEQ ID NO: 1026494 - DNA, 15 bp, Homo sapiens
gcttccaaagcctag

SEQ ID NO: 1026495 - DNA, 12 bp, Homo sapiens
gcttccaaatgt

SEQ ID NO: 1026496 - DNA, 13 bp, Homo sapiens
gcttccacaaaat

SEQ ID NO: 1026497 - DNA, 19 bp, Homo sapiens
gcttccacaaaattagaaa

SEQ ID NO: 1026498 - DNA, 16 bp, Homo sapiens
gcttccacctcatgga

SEQ ID NO: 1026499 - DNA, 16 bp, Homo sapiens
gcttccagaaggcagc

SEQ ID NO: 1026500 - DNA, 19 bp, Homo sapiens
gcttccagagagtcctctg

SEQ ID NO: 1026501 - DNA, 21 bp, Homo sapiens
gcttccaggaaactccacatc

SEQ ID NO: 1026502 - DNA, 11 bp, Homo sapiens
gcttccaggat

SEQ ID NO: 1026503 - DNA, 22 bp, Homo sapiens
gcttccaggataaggagactga

SEQ ID NO: 1026504 - DNA, 18 bp, Homo sapiens
gcttccaggctcttcctg

SEQ ID NO: 1026505 - DNA, 21 bp, Homo sapiens
gcttccaggctcttcctggac

SEQ ID NO: 1026506 - DNA, 12 bp, Homo sapiens
gcttccaggctg

SEQ ID NO: 1026507 - DNA, 15 bp, Homo sapiens
gcttccaggctgggc

SEQ ID NO: 1026508 - DNA, 19 bp, Homo sapiens
gcttccaggctgggcagca

SEQ ID NO: 1026509 - DNA, 18 bp, Homo sapiens
gcttccatgattctattt

SEQ ID NO: 1026510 - DNA, 20 bp, Homo sapiens
gcttccatggcttcctgaga

SEQ ID NO: 1026511 - DNA, 12 bp, Homo sapiens
gcttccattcca

SEQ ID NO: 1026512 - DNA, 14 bp, Homo sapiens
gcttcccagctctg

SEQ ID NO: 1026513 - DNA, 19 bp, Homo sapiens
gcttcccattgtggctcct

SEQ ID NO: 1026514 - DNA, 19 bp, Homo sapiens
gcttccccatcagctccca

SEQ ID NO: 1026515 - DNA, 20 bp, Homo sapiens
gcttccccatcagctcccaa

SEQ ID NO: 1026516 - DNA, 14 bp, Homo sapiens
gcttcccccacccc

SEQ ID NO: 1026517 - DNA, 19 bp, Homo sapiens
gcttcccccacccctccac

SEQ ID NO: 1026518 - DNA, 15 bp, Homo sapiens
gcttcccgctcagcc

SEQ ID NO: 1026519 - DNA, 16 bp, Homo sapiens
gcttcccgctcagccc

SEQ ID NO: 1026520 - DNA, 18 bp, Homo sapiens
gcttcccgctcagccctc

SEQ ID NO: 1026521 - DNA, 15 bp, Homo sapiens
gcttccctccatccc

SEQ ID NO: 1026522 - DNA, 20 bp, Homo sapiens
gcttccctctgcctgtccct

SEQ ID NO: 1026523 - DNA, 23 bp, Homo sapiens
gcttccctctgcctgtccctctc

SEQ ID NO: 1026524 - DNA, 11 bp, Homo sapiens
gcttccctgaa

SEQ ID NO: 1026525 - DNA, 14 bp, Homo sapiens
gcttccctgactca

SEQ ID NO: 1026526 - DNA, 13 bp, Homo sapiens
gcttccgccactc

SEQ ID NO: 1026527 - DNA, 14 bp, Homo sapiens
gcttccgccactca

SEQ ID NO: 1026528 - DNA, 17 bp, Homo sapiens
gcttccgccactcagcc

SEQ ID NO: 1026529 - DNA, 15 bp, Homo sapiens
tctgtgtgtgtggcg

SEQ ID NO: 1026530 - DNA, 13 bp, Homo sapiens
tctgtgttcattt

SEQ ID NO: 1026531 - DNA, 14 bp, Homo sapiens
tctgtgttgccaag

SEQ ID NO: 1026532 - DNA, 16 bp, Homo sapiens
tctgtgttgccaagct

SEQ ID NO: 1026533 - DNA, 12 bp, Homo sapiens
tctgtgtttaaa

SEQ ID NO: 1026534 - DNA, 13 bp, Homo sapiens
tctgttaactgaa

SEQ ID NO: 1026535 - DNA, 16 bp, Homo sapiens
tctgttaactgaatac

SEQ ID NO: 1026536 - DNA, 21 bp, Homo sapiens
tctgttaactgaataccactc

SEQ ID NO: 1026537 - DNA, 21 bp, Homo sapiens
tctgttaccatgtcactgtgg

SEQ ID NO: 1026538 - DNA, 15 bp, Homo sapiens
tctgttacccaggct

SEQ ID NO: 1026539 - DNA, 20 bp, Homo sapiens
tctgttagcagagtctgtct

SEQ ID NO: 1026540 - DNA, 21 bp, Homo sapiens
tctgttatcagctgggcagtg

SEQ ID NO: 1026541 - DNA, 14 bp, Homo sapiens
tctgttatcctgct

SEQ ID NO: 1026542 - DNA, 19 bp, Homo sapiens
tctgttcacaaactacctc

SEQ ID NO: 1026543 - DNA, 19 bp, Homo sapiens
tctgttcacttttcctccc

SEQ ID NO: 1026544 - DNA, 21 bp, Homo sapiens
tctgttcacttttcctccctc

SEQ ID NO: 1026545 - DNA, 15 bp, Homo sapiens
tctgttcagcaaact

SEQ ID NO: 1026546 - DNA, 17 bp, Homo sapiens
tctgttccaaattcagt

SEQ ID NO: 1026547 - DNA, 20 bp, Homo sapiens
tctgttccccatggccactt

SEQ ID NO: 1026548 - DNA, 18 bp, Homo sapiens
tctgttcccccaccctcc

SEQ ID NO: 1026549 - DNA, 18 bp, Homo sapiens
tctgttcccccttcacaa

SEQ ID NO: 1026550 - DNA, 14 bp, Homo sapiens
tctgttccctgggc

SEQ ID NO: 1026551 - DNA, 16 bp, Homo sapiens
tctgttcccttcctca

SEQ ID NO: 1026552 - DNA, 15 bp, Homo sapiens
tctgttccttcacat

SEQ ID NO: 1026553 - DNA, 15 bp, Homo sapiens
tctgttccttcctcc

SEQ ID NO: 1026554 - DNA, 13 bp, Homo sapiens
tctgttctagttt

SEQ ID NO: 1026555 - DNA, 15 bp, Homo sapiens
tctgttctccctggg

SEQ ID NO: 1026556 - DNA, 15 bp, Homo sapiens
tctgttctgctccca

SEQ ID NO: 1026557 - DNA, 18 bp, Homo sapiens
tctgttctgctcccagat

SEQ ID NO: 1026558 - DNA, 17 bp, Homo sapiens
tctgttcttacaaatgt

SEQ ID NO: 1026559 - DNA, 21 bp, Homo sapiens
tctgttcttacaaatgtgaaa

SEQ ID NO: 1026560 - DNA, 13 bp, Homo sapiens
tctgttcttgaag

SEQ ID NO: 1026561 - DNA, 22 bp, Homo sapiens
tctgttctttccaaagtacact

SEQ ID NO: 1026562 - DNA, 22 bp, Homo sapiens
tctgttgaaggtgccattttaa

SEQ ID NO: 1026563 - DNA, 17 bp, Homo sapiens
tctgttgagtaaaacac

SEQ ID NO: 1026564 - DNA, 17 bp, Homo sapiens
tctgttgatcccacttc

SEQ ID NO: 1026565 - DNA, 18 bp, Homo sapiens
tctgttgatcccacttca

SEQ ID NO: 1026566 - DNA, 22 bp, Homo sapiens
tctgttgatcccacttcactgt

SEQ ID NO: 1026567 - DNA, 12 bp, Homo sapiens
tctgttgcccag

SEQ ID NO: 1026568 - DNA, 16 bp, Homo sapiens
tctgttgcccaggctg

SEQ ID NO: 1026569 - DNA, 20 bp, Homo sapiens
tctgttgccttatttctcat

SEQ ID NO: 1026570 - DNA, 19 bp, Homo sapiens
tctgttggtccactgtgtt

SEQ ID NO: 1026571 - DNA, 14 bp, Homo sapiens
tctgttgtcaaact

SEQ ID NO: 1026572 - DNA, 18 bp, Homo sapiens
tctgttgtcattgctgtt

SEQ ID NO: 1026573 - DNA, 17 bp, Homo sapiens
tctgttgtcctcccctt

SEQ ID NO: 1026574 - DNA, 19 bp, Homo sapiens
tctgttgtcctccccttgg

SEQ ID NO: 1026575 - DNA, 23 bp, Homo sapiens
tctgttgtcgtaaagatttgggt

SEQ ID NO: 1026576 - DNA, 14 bp, Homo sapiens
tctgttgttccatt

SEQ ID NO: 1026577 - DNA, 13 bp, Homo sapiens
tctgttgttctgt

SEQ ID NO: 1026578 - DNA, 18 bp, Homo sapiens
tctgtttaaaatttgtgc

SEQ ID NO: 1026579 - DNA, 16 bp, Homo sapiens
tctgtttagataatac

SEQ ID NO: 1026580 - DNA, 23 bp, Homo sapiens
tctgtttagataatacaccacta

SEQ ID NO: 1026581 - DNA, 20 bp, Homo sapiens
tctgtttattaactactgaa

SEQ ID NO: 1026582 - DNA, 23 bp, Homo sapiens
tctgtttattcttccagaatgct

SEQ ID NO: 1026583 - DNA, 16 bp, Homo sapiens
gcttctccagtggtga

SEQ ID NO: 1026584 - DNA, 17 bp, Homo sapiens
gcttctcccatttcctg

SEQ ID NO: 1026585 - DNA, 20 bp, Homo sapiens
gcttctcccatttcctgatc

SEQ ID NO: 1026586 - DNA, 22 bp, Homo sapiens
gcttctccccccatcccagggt

SEQ ID NO: 1026587 - DNA, 18 bp, Homo sapiens
gcttctccgccagcctcc

SEQ ID NO: 1026588 - DNA, 20 bp, Homo sapiens
gcttctccgccagcctcctc

SEQ ID NO: 1026589 - DNA, 16 bp, Homo sapiens
gcttctcctgtgaccc

SEQ ID NO: 1026590 - DNA, 15 bp, Homo sapiens
gcttctcctgtgtga

SEQ ID NO: 1026591 - DNA, 16 bp, Homo sapiens
gcttctcggccagccc

SEQ ID NO: 1026592 - DNA, 22 bp, Homo sapiens
gcttctcggcttggatcctggg

SEQ ID NO: 1026593 - DNA, 16 bp, Homo sapiens
gcttctctcagccagc

SEQ ID NO: 1026594 - DNA, 15 bp, Homo sapiens
gcttctctcctcaga

SEQ ID NO: 1026595 - DNA, 14 bp, Homo sapiens
gcttctctctccag

SEQ ID NO: 1026596 - DNA, 15 bp, Homo sapiens
gcttctctctccctg

SEQ ID NO: 1026597 - DNA, 17 bp, Homo sapiens
gcttctctctccctgtc

SEQ ID NO: 1026598 - DNA, 19 bp, Homo sapiens
gcttctctcttttaaagta

SEQ ID NO: 1026599 - DNA, 17 bp, Homo sapiens
gcttctctgacttctgc

SEQ ID NO: 1026600 - DNA, 22 bp, Homo sapiens
gcttctctgacttctgcctgga

SEQ ID NO: 1026601 - DNA, 17 bp, Homo sapiens
gcttctctgtctctgtg

SEQ ID NO: 1026602 - DNA, 21 bp, Homo sapiens
gcttctcttctttattgcact

SEQ ID NO: 1026603 - DNA, 22 bp, Homo sapiens
gcttctcttctttattgcacta

SEQ ID NO: 1026604 - DNA, 16 bp, Homo sapiens
gcttctcttctttctg

SEQ ID NO: 1026605 - DNA, 17 bp, Homo sapiens
gcttctctttcccccac

SEQ ID NO: 1026606 - DNA, 20 bp, Homo sapiens
gcttctctttcccccaccct

SEQ ID NO: 1026607 - DNA, 13 bp, Homo sapiens
gcttctcttttga

SEQ ID NO: 1026608 - DNA, 21 bp, Homo sapiens
gcttctgaagagcctgaagct

SEQ ID NO: 1026609 - DNA, 22 bp, Homo sapiens
gcttctgaagagcctgaagctg

SEQ ID NO: 1026610 - DNA, 15 bp, Homo sapiens
gcttctgaatcactg

SEQ ID NO: 1026611 - DNA, 17 bp, Homo sapiens
gcttctgcaccctccac

SEQ ID NO: 1026612 - DNA, 18 bp, Homo sapiens
gcttctgcagcctcggcc

SEQ ID NO: 1026613 - DNA, 16 bp, Homo sapiens
gcttctgccacataaa

SEQ ID NO: 1026614 - DNA, 12 bp, Homo sapiens
gcttctgcctgc

SEQ ID NO: 1026615 - DNA, 15 bp, Homo sapiens
gcttctgctggagga

SEQ ID NO: 1026616 - DNA, 13 bp, Homo sapiens
gcttctgcttttc

SEQ ID NO: 1026617 - DNA, 20 bp, Homo sapiens
gcttctgcttttctgccctg

SEQ ID NO: 1026618 - DNA, 21 bp, Homo sapiens
gcttctgcttttctgccctgg

SEQ ID NO: 1026619 - DNA, 17 bp, Homo sapiens
gcttctggaatttgttc

SEQ ID NO: 1026620 - DNA, 12 bp, Homo sapiens
gcttctggagcc

SEQ ID NO: 1026621 - DNA, 15 bp, Homo sapiens
gcttctggtactctc

SEQ ID NO: 1026622 - DNA, 19 bp, Homo sapiens
gcttctggtactctcctag

SEQ ID NO: 1026623 - DNA, 20 bp, Homo sapiens
gcttctgtatttcactcttt

SEQ ID NO: 1026624 - DNA, 16 bp, Homo sapiens
gcttctgtgatgagct

SEQ ID NO: 1026625 - DNA, 18 bp, Homo sapiens
gcttctgtgatgagctga

SEQ ID NO: 1026626 - DNA, 12 bp, Homo sapiens
gcttctgtgtag

SEQ ID NO: 1026627 - DNA, 17 bp, Homo sapiens
gcttctgttctctgctg

SEQ ID NO: 1026628 - DNA, 18 bp, Homo sapiens
gcttctgttggcagagct

SEQ ID NO: 1026629 - DNA, 12 bp, Homo sapiens
gcttcttaaaaa

SEQ ID NO: 1026630 - DNA, 15 bp, Homo sapiens
gcttcttaaagagtt

SEQ ID NO: 1026631 - DNA, 18 bp, Homo sapiens
gcttcttcacaggcactc

SEQ ID NO: 1026632 - DNA, 18 bp, Homo sapiens
gcttcttcagagatcaag

SEQ ID NO: 1026633 - DNA, 15 bp, Homo sapiens
gcttcttcctaggtc

SEQ ID NO: 1026634 - DNA, 17 bp, Homo sapiens
gcttcttcctcctccat

SEQ ID NO: 1026635 - DNA, 14 bp, Homo sapiens
gcttcttccttctt

SEQ ID NO: 1026636 - DNA, 16 bp, Homo sapiens
gcttcttctcatgggg

SEQ ID NO: 1026637 - DNA, 18 bp, Homo sapiens
gcttcttctcctatgtgt

SEQ ID NO: 1026638 - DNA, 19 bp, Homo sapiens
gcttcttctcctatgtgta

SEQ ID NO: 1026639 - DNA, 16 bp, Homo sapiens
gcttcttgcactcctt

SEQ ID NO: 1026640 - DNA, 17 bp, Homo sapiens
gcttcttgcctctgtgc

SEQ ID NO: 1026641 - DNA, 20 bp, Homo sapiens
gcttcttgcctctgtgctgt

SEQ ID NO: 1026642 - DNA, 14 bp, Homo sapiens
gcttcttggacctt

SEQ ID NO: 1026643 - DNA, 19 bp, Homo sapiens
gcttcttgggctgagtgca

SEQ ID NO: 1026644 - DNA, 21 bp, Homo sapiens
gcttctttctagaaagagaaa

SEQ ID NO: 1026645 - DNA, 19 bp, Homo sapiens
gcttgaaaagctagtgtac

SEQ ID NO: 1026646 - DNA, 21 bp, Homo sapiens
gcttgaaattactgtgtaaat

SEQ ID NO: 1026647 - DNA, 13 bp, Homo sapiens
gcttgaacccagg

SEQ ID NO: 1026648 - DNA, 21 bp, Homo sapiens
gcttgaacctgcttcctggct

SEQ ID NO: 1026649 - DNA, 19 bp, Homo sapiens
gcttgaactaggctgagca

SEQ ID NO: 1026650 - DNA, 11 bp, Homo sapiens
gcttgaagcca

SEQ ID NO: 1026651 - DNA, 21 bp, Homo sapiens
gctttattttttaagtattta

SEQ ID NO: 1026652 - DNA, 14 bp, Homo sapiens
gctttcaaaataag

SEQ ID NO: 1026653 - DNA, 13 bp, Homo sapiens
gctttcaaatgta

SEQ ID NO: 1026654 - DNA, 15 bp, Homo sapiens
gctttcaaggctggg

SEQ ID NO: 1026655 - DNA, 22 bp, Homo sapiens
gctttcaaggctggggcatggc

SEQ ID NO: 1026656 - DNA, 21 bp, Homo sapiens
gctttcaattgacaaatgatg

SEQ ID NO: 1026657 - DNA, 17 bp, Homo sapiens
gctttcactatttcctt

SEQ ID NO: 1026658 - DNA, 19 bp, Homo sapiens
gctttcagagccagcctgg

SEQ ID NO: 1026659 - DNA, 16 bp, Homo sapiens
gctttcagagccagtg

SEQ ID NO: 1026660 - DNA, 12 bp, Homo sapiens
gctttcatgtaa

SEQ ID NO: 1026661 - DNA, 16 bp, Homo sapiens
gctttccatgggcccg

SEQ ID NO: 1026662 - DNA, 12 bp, Homo sapiens
gctttcccagga

SEQ ID NO: 1026663 - DNA, 20 bp, Homo sapiens
gctttcccagtcccattcct

SEQ ID NO: 1026664 - DNA, 17 bp, Homo sapiens
gctttcccctgtgggga

SEQ ID NO: 1026665 - DNA, 11 bp, Homo sapiens
gctttcctgaa

SEQ ID NO: 1026666 - DNA, 22 bp, Homo sapiens
gctttcctgaatccaaactaat

SEQ ID NO: 1026667 - DNA, 19 bp, Homo sapiens
gctttcctgggcctttgca

SEQ ID NO: 1026668 - DNA, 18 bp, Homo sapiens
gctttccttctccaggaa

SEQ ID NO: 1026669 - DNA, 23 bp, Homo sapiens
gctttccttgttagaatgcaagc

SEQ ID NO: 1026670 - DNA, 19 bp, Homo sapiens
gctttccttttatttttta

SEQ ID NO: 1026671 - DNA, 16 bp, Homo sapiens
gctttcgaactgctag

SEQ ID NO: 1026672 - DNA, 14 bp, Homo sapiens
gctttcggggaggg

SEQ ID NO: 1026673 - DNA, 22 bp, Homo sapiens
gctttctcctcatccatttctt

SEQ ID NO: 1026674 - DNA, 18 bp, Homo sapiens
gctttctcctctgctatg

SEQ ID NO: 1026675 - DNA, 13 bp, Homo sapiens
gctttctcctgga

SEQ ID NO: 1026676 - DNA, 14 bp, Homo sapiens
gctttctcctggag

SEQ ID NO: 1026677 - DNA, 23 bp, Homo sapiens
gctttctcctggagatagctggg

SEQ ID NO: 1026678 - DNA, 13 bp, Homo sapiens
gctttctctcaga

SEQ ID NO: 1026679 - DNA, 23 bp, Homo sapiens
gctttctctccgacttcccctgg

SEQ ID NO: 1026680 - DNA, 12 bp, Homo sapiens
gctttctctgcc

SEQ ID NO: 1026681 - DNA, 13 bp, Homo sapiens
gctttctctgcct

SEQ ID NO: 1026682 - DNA, 15 bp, Homo sapiens
gctttctctgcctct

SEQ ID NO: 1026683 - DNA, 16 bp, Homo sapiens
gctttctctgcctctg

SEQ ID NO: 1026684 - DNA, 18 bp, Homo sapiens
gctttctctgcctctggg

SEQ ID NO: 1026685 - DNA, 20 bp, Homo sapiens
gctttctctgcctctgggca

SEQ ID NO: 1026686 - DNA, 13 bp, Homo sapiens
gctttctcttccc

SEQ ID NO: 1026687 - DNA, 15 bp, Homo sapiens
gctttctcttcccct

SEQ ID NO: 1026688 - DNA, 15 bp, Homo sapiens
gctttctgccatcta

SEQ ID NO: 1026689 - DNA, 18 bp, Homo sapiens
gctttctgctcagcttct

SEQ ID NO: 1026690 - DNA, 22 bp, Homo sapiens
gctttctggaaaagaggagttt

SEQ ID NO: 1026691 - DNA, 13 bp, Homo sapiens
gctttctggagag

SEQ ID NO: 1026692 - DNA, 20 bp, Homo sapiens
gctttctgggatgtcacagt

SEQ ID NO: 1026693 - DNA, 17 bp, Homo sapiens
gctttctggggcctagc

SEQ ID NO: 1026694 - DNA, 13 bp, Homo sapiens
gctttctgttcca

SEQ ID NO: 1026695 - DNA, 14 bp, Homo sapiens
gctttctgttccaa

SEQ ID NO: 1026696 - DNA, 15 bp, Homo sapiens
gctttctgtttctta

SEQ ID NO: 1026697 - DNA, 19 bp, Homo sapiens
gctttcttattttgtttga

SEQ ID NO: 1026698 - DNA, 21 bp, Homo sapiens
gctttctttccgtcaccctgg

SEQ ID NO: 1026699 - DNA, 21 bp, Homo sapiens
gctttctttcgtttgtttgtt

SEQ ID NO: 1026700 - DNA, 15 bp, Homo sapiens
gctttgaaaatattt

SEQ ID NO: 1026701 - DNA, 19 bp, Homo sapiens
gctttgacgtattatctgt

SEQ ID NO: 1026702 - DNA, 20 bp, Homo sapiens
gctttgactcacctgttact

SEQ ID NO: 1026703 - DNA, 13 bp, Homo sapiens
gctttgactccct

SEQ ID NO: 1026704 - DNA, 14 bp, Homo sapiens
gctttgagaaaaca

SEQ ID NO: 1026705 - DNA, 14 bp, Homo sapiens
gctttgatccctga

SEQ ID NO: 1026706 - DNA, 15 bp, Homo sapiens
gctttgatccctgac

SEQ ID NO: 1026707 - DNA, 14 bp, Homo sapiens
gctttgcaggctct

SEQ ID NO: 1026708 - DNA, 17 bp, Homo sapiens
gctttgcaggctctggg

SEQ ID NO: 1026709 - DNA, 21 bp, Homo sapiens
gctttgcaggctctgggctca

SEQ ID NO: 1026710 - DNA, 20 bp, Homo sapiens
gctttgcattcctacaaaga

SEQ ID NO: 1026711 - DNA, 22 bp, Homo sapiens
gctttgcattcctacaaagatg

SEQ ID NO: 1026712 - DNA, 13 bp, Homo sapiens
gctttgcattttc

SEQ ID NO: 1026713 - DNA, 17 bp, Homo sapiens
tcttagataacttcttg

SEQ ID NO: 1026714 - DNA, 21 bp, Homo sapiens
tcttagataacttcttgaaaa

SEQ ID NO: 1026715 - DNA, 23 bp, Homo sapiens
tcttagataacttcttgaaaaag

SEQ ID NO: 1026716 - DNA, 22 bp, Homo sapiens
tcttagatacactaaaaatctg

SEQ ID NO: 1026717 - DNA, 23 bp, Homo sapiens
tcttagatattcactaaggactt

SEQ ID NO: 1026718 - DNA, 15 bp, Homo sapiens
tcttagatgtatata

SEQ ID NO: 1026719 - DNA, 13 bp, Homo sapiens
tcttagattctta

SEQ ID NO: 1026720 - DNA, 16 bp, Homo sapiens
tcttagcagcttccag

SEQ ID NO: 1026721 - DNA, 19 bp, Homo sapiens
tcttagctctttctctatt

SEQ ID NO: 1026722 - DNA, 12 bp, Homo sapiens
tcttagctgagt

SEQ ID NO: 1026723 - DNA, 13 bp, Homo sapiens
tcttagctggata

SEQ ID NO: 1026724 - DNA, 20 bp, Homo sapiens
tcttagctggatataatgta

SEQ ID NO: 1026725 - DNA, 22 bp, Homo sapiens
tcttagctggatataatgtatt

SEQ ID NO: 1026726 - DNA, 14 bp, Homo sapiens
tcttagctttgaaa

SEQ ID NO: 1026727 - DNA, 17 bp, Homo sapiens
tcttaggagcaagaaga

SEQ ID NO: 1026728 - DNA, 20 bp, Homo sapiens
tcttaggttggcaaaaaggc

SEQ ID NO: 1026729 - DNA, 12 bp, Homo sapiens
tcttagtcccaa

SEQ ID NO: 1026730 - DNA, 17 bp, Homo sapiens
tcttagtgcaaaaaaca

SEQ ID NO: 1026731 - DNA, 21 bp, Homo sapiens
tcttagtgcttcagagtttgt

SEQ ID NO: 1026732 - DNA, 16 bp, Homo sapiens
tcttagtggaagacaa

SEQ ID NO: 1026733 - DNA, 23 bp, Homo sapiens
tcttagttgacaacctagaatgt

SEQ ID NO: 1026734 - DNA, 23 bp, Homo sapiens
tcttagtttggattcttatgtag

SEQ ID NO: 1026735 - DNA, 20 bp, Homo sapiens
tcttataatactctgttgta

SEQ ID NO: 1026736 - DNA, 21 bp, Homo sapiens
tcttataattgttctcagaat

SEQ ID NO: 1026737 - DNA, 15 bp, Homo sapiens
tcttatacatttgat

SEQ ID NO: 1026738 - DNA, 20 bp, Homo sapiens
tcttatacgcttttctttgt

SEQ ID NO: 1026739 - DNA, 20 bp, Homo sapiens
tcttatatatatttctttgt

SEQ ID NO: 1026740 - DNA, 16 bp, Homo sapiens
tcttatcctccaccgt

SEQ ID NO: 1026741 - DNA, 17 bp, Homo sapiens
tcttatctgttcagtgt

SEQ ID NO: 1026742 - DNA, 15 bp, Homo sapiens
tcttatcttctgcaa

SEQ ID NO: 1026743 - DNA, 18 bp, Homo sapiens
tcttatcttttggcttct

SEQ ID NO: 1026744 - DNA, 17 bp, Homo sapiens
tcttatgcttataatat

SEQ ID NO: 1026745 - DNA, 15 bp, Homo sapiens
tcttatggaattgat

SEQ ID NO: 1026746 - DNA, 15 bp, Homo sapiens
tcttatgtaaagtat

SEQ ID NO: 1026747 - DNA, 15 bp, Homo sapiens
tcttatgtgaaaaat

SEQ ID NO: 1026748 - DNA, 17 bp, Homo sapiens
tcttatgtgaaaaatta

SEQ ID NO: 1026749 - DNA, 13 bp, Homo sapiens
tcttatgtgacat

SEQ ID NO: 1026750 - DNA, 19 bp, Homo sapiens
tcttattccaggagaaggg

SEQ ID NO: 1026751 - DNA, 22 bp, Homo sapiens
tcttattcccaaactacagaat

SEQ ID NO: 1026752 - DNA, 18 bp, Homo sapiens
tcttattccgagcattcc

SEQ ID NO: 1026753 - DNA, 15 bp, Homo sapiens
tcttattctcactcc

SEQ ID NO: 1026754 - DNA, 13 bp, Homo sapiens
tcttattcttaag

SEQ ID NO: 1026755 - DNA, 16 bp, Homo sapiens
tcttattgaatttgtt

SEQ ID NO: 1026756 - DNA, 16 bp, Homo sapiens
tcttattgcgctgcta

SEQ ID NO: 1026757 - DNA, 12 bp, Homo sapiens
tcttattttgca

SEQ ID NO: 1026758 - DNA, 22 bp, Homo sapiens
tcttattttgcattccagaatc

SEQ ID NO: 1026759 - DNA, 16 bp, Homo sapiens
tcttatttttttctat

SEQ ID NO: 1026760 - DNA, 16 bp, Homo sapiens
tcttcaaaaagcagag

SEQ ID NO: 1026761 - DNA, 14 bp, Homo sapiens
tcttcaaactgtga

SEQ ID NO: 1026762 - DNA, 14 bp, Homo sapiens
tcttcaaactttca

SEQ ID NO: 1026763 - DNA, 15 bp, Homo sapiens
tcttcaaactttcac

SEQ ID NO: 1026764 - DNA, 17 bp, Homo sapiens
tcttcaaactttcactt

SEQ ID NO: 1026765 - DNA, 16 bp, Homo sapiens
tcttcaaagcagagtg

SEQ ID NO: 1026766 - DNA, 19 bp, Homo sapiens
tcttcaaattagaagacat

SEQ ID NO: 1026767 - DNA, 19 bp, Homo sapiens
tcttcaatctctgttctgc

SEQ ID NO: 1026768 - DNA, 20 bp, Homo sapiens
tcttcaatttgtataaaatg

SEQ ID NO: 1026769 - DNA, 23 bp, Homo sapiens
tcttcacagtgcagcttgcagtc

SEQ ID NO: 1026770 - DNA, 19 bp, Homo sapiens
tcttcaccaagtgcaatag

SEQ ID NO: 1026771 - DNA, 20 bp, Homo sapiens
tcttcacccagctaatctgt

SEQ ID NO: 1026772 - DNA, 22 bp, Homo sapiens
tcttcacccctacactgtgaag

SEQ ID NO: 1026773 - DNA, 20 bp, Homo sapiens
gcttttccaggatcctgcag

SEQ ID NO: 1026774 - DNA, 23 bp, Homo sapiens
gcttttccaggatcctgcaggaa

SEQ ID NO: 1026775 - DNA, 18 bp, Homo sapiens
gcttttccccggtccctt

SEQ ID NO: 1026776 - DNA, 16 bp, Homo sapiens
gcttttccctttgtga

SEQ ID NO: 1026777 - DNA, 14 bp, Homo sapiens
gcttttctgccctg

SEQ ID NO: 1026778 - DNA, 15 bp, Homo sapiens
gcttttctgccctgg

SEQ ID NO: 1026779 - DNA, 16 bp, Homo sapiens
gcttttctgccctggc

SEQ ID NO: 1026780 - DNA, 23 bp, Homo sapiens
gcttttctgtagatgttgtcttg

SEQ ID NO: 1026781 - DNA, 18 bp, Homo sapiens
gcttttctgtattttatt

SEQ ID NO: 1026782 - DNA, 15 bp, Homo sapiens
gcttttctgtcctgg

SEQ ID NO: 1026783 - DNA, 18 bp, Homo sapiens
gcttttctgtcctgggca

SEQ ID NO: 1026784 - DNA, 18 bp, Homo sapiens
gcttttgaggctcagtga

SEQ ID NO: 1026785 - DNA, 13 bp, Homo sapiens
gcttttgattagt

SEQ ID NO: 1026786 - DNA, 16 bp, Homo sapiens
gcttttgcagcagagg

SEQ ID NO: 1026787 - DNA, 15 bp, Homo sapiens
gcttttgccactttg

SEQ ID NO: 1026788 - DNA, 15 bp, Homo sapiens
gcttttgcctgtaag

SEQ ID NO: 1026789 - DNA, 17 bp, Homo sapiens
gcttttgcctgtaagaa

SEQ ID NO: 1026790 - DNA, 23 bp, Homo sapiens
gcttttgctagatggaatggaaa

SEQ ID NO: 1026791 - DNA, 20 bp, Homo sapiens
gcttttgtctacacaccctg

SEQ ID NO: 1026792 - DNA, 19 bp, Homo sapiens
gcttttgtgatggagtgct

SEQ ID NO: 1026793 - DNA, 12 bp, Homo sapiens
gcttttgtgtgc

SEQ ID NO: 1026794 - DNA, 20 bp, Homo sapiens
gcttttgttgtgacttttta

SEQ ID NO: 1026795 - DNA, 19 bp, Homo sapiens
gcttttgtttgctctttta

SEQ ID NO: 1026796 - DNA, 20 bp, Homo sapiens
gctttttaaaatatatgtat

SEQ ID NO: 1026797 - DNA, 13 bp, Homo sapiens
gctttttataaaa

SEQ ID NO: 1026798 - DNA, 19 bp, Homo sapiens
gctttttattccctgccca

SEQ ID NO: 1026799 - DNA, 17 bp, Homo sapiens
gctttttatttctgcat

SEQ ID NO: 1026800 - DNA, 15 bp, Homo sapiens
gctttttcacagtca

SEQ ID NO: 1026801 - DNA, 23 bp, Homo sapiens
gctttttcagaaacagggcagca

SEQ ID NO: 1026802 - DNA, 12 bp, Homo sapiens
gctttttccttt

SEQ ID NO: 1026803 - DNA, 24 bp, Homo sapiens
gctttttccttttcatctgttgtt

SEQ ID NO: 1026804 - DNA, 22 bp, Homo sapiens
gctttttctgtggaggacagac

SEQ ID NO: 1026805 - DNA, 14 bp, Homo sapiens
gctttttcttctct

SEQ ID NO: 1026806 - DNA, 12 bp, Homo sapiens
gctttttggaaa

SEQ ID NO: 1026807 - DNA, 13 bp, Homo sapiens
gctttttggaatc

SEQ ID NO: 1026808 - DNA, 15 bp, Homo sapiens
gctttttggcacagt

SEQ ID NO: 1026809 - DNA, 21 bp, Homo sapiens
gcttttttaaccaaggagggg

SEQ ID NO: 1026810 - DNA, 22 bp, Homo sapiens
gcttttttaaccaaggaggggc

SEQ ID NO: 1026811 - DNA, 20 bp, Homo sapiens
gcttttttattttaatacaa

SEQ ID NO: 1026812 - DNA, 17 bp, Homo sapiens
gcttttttccaaaacaa

SEQ ID NO: 1026813 - DNA, 24 bp, Homo sapiens
gctttttttttctctttctctcct

SEQ ID NO: 1026814 - DNA, 15 bp, Homo sapiens
gcttttttttttcca

SEQ ID NO: 1026815 - DNA, 16 bp, Homo sapiens
gcttttttttttccag

SEQ ID NO: 1026816 - DNA, 21 bp, Homo sapiens
gcttttttttttccagcaagt

SEQ ID NO: 1026817 - DNA, 19 bp, Homo sapiens
ggaaaaaaaaaaaaactac

SEQ ID NO: 1026818 - DNA, 20 bp, Homo sapiens
ggaaaaaaaaaaaagaaaag

SEQ ID NO: 1026819 - DNA, 15 bp, Homo sapiens
ggaaaaaaaaaaaga

SEQ ID NO: 1026820 - DNA, 19 bp, Homo sapiens
ggaaaaaaaaaaagaaaaa

SEQ ID NO: 1026821 - DNA, 14 bp, Homo sapiens
ggaaaaaaaagaaa

SEQ ID NO: 1026822 - DNA, 17 bp, Homo sapiens
ggaaaaaaaagagactg

SEQ ID NO: 1026823 - DNA, 18 bp, Homo sapiens
ggaaaaaaaagagactgg

SEQ ID NO: 1026824 - DNA, 17 bp, Homo sapiens
ggaaaaaaacataaaaa

SEQ ID NO: 1026825 - DNA, 20 bp, Homo sapiens
ggaaaaaaacataaaaagca

SEQ ID NO: 1026826 - DNA, 21 bp, Homo sapiens
ggaaaaaaacataaaaagcag

SEQ ID NO: 1026827 - DNA, 14 bp, Homo sapiens
ggaaaaaaactttt

SEQ ID NO: 1026828 - DNA, 13 bp, Homo sapiens
ggaaaaaaatgtt

SEQ ID NO: 1026829 - DNA, 23 bp, Homo sapiens
ggaaaaaacaaaataccacccta

SEQ ID NO: 1026830 - DNA, 12 bp, Homo sapiens
ggaaaaaagaaa

SEQ ID NO: 1026831 - DNA, 17 bp, Homo sapiens
ggaaaaaataaaaagag

SEQ ID NO: 1026832 - DNA, 19 bp, Homo sapiens
ggaaaaaatgttggattta

SEQ ID NO: 1026833 - DNA, 13 bp, Homo sapiens
ggaaaaaattaac

SEQ ID NO: 1026834 - DNA, 19 bp, Homo sapiens
ggaaaaaccacccccaaat

SEQ ID NO: 1026835 - DNA, 23 bp, Homo sapiens
ggaaaaaccgagataggggaggg

SEQ ID NO: 1026836 - DNA, 23 bp, Homo sapiens
ggaaaaagcaagttcgtctgttg

SEQ ID NO: 1026837 - DNA, 15 bp, Homo sapiens
ggaaaaatagcctgc

SEQ ID NO: 1026838 - DNA, 15 bp, Homo sapiens
ggaaaaatagtaaac

SEQ ID NO: 1026839 - DNA, 17 bp, Homo sapiens
tcttccatgctgtgcgc

SEQ ID NO: 1026840 - DNA, 17 bp, Homo sapiens
tcttccattccttcatg

SEQ ID NO: 1026841 - DNA, 14 bp, Homo sapiens
tcttccatttgcaa

SEQ ID NO: 1026842 - DNA, 22 bp, Homo sapiens
tcttcccatgactgcacccagc

SEQ ID NO: 1026843 - DNA, 21 bp, Homo sapiens
tcttcccatttaacattgttt

SEQ ID NO: 1026844 - DNA, 13 bp, Homo sapiens
tcttcccccctct

SEQ ID NO: 1026845 - DNA, 19 bp, Homo sapiens
tcttcccccctctcctccc

SEQ ID NO: 1026846 - DNA, 23 bp, Homo sapiens
tcttcccccctctcctcccagct

SEQ ID NO: 1026847 - DNA, 15 bp, Homo sapiens
tcttcccctccctcc

SEQ ID NO: 1026848 - DNA, 13 bp, Homo sapiens
tcttcccctgaga

SEQ ID NO: 1026849 - DNA, 14 bp, Homo sapiens
tcttccccttcctg

SEQ ID NO: 1026850 - DNA, 18 bp, Homo sapiens
tcttccccttcctgtttc

SEQ ID NO: 1026851 - DNA, 13 bp, Homo sapiens
tcttccccttgcc

SEQ ID NO: 1026852 - DNA, 19 bp, Homo sapiens
tcttcccgccccacctccc

SEQ ID NO: 1026853 - DNA, 20 bp, Homo sapiens
tcttcccgtgtgtatttcta

SEQ ID NO: 1026854 - DNA, 21 bp, Homo sapiens
tcttcccgtgtgtatttctaa

SEQ ID NO: 1026855 - DNA, 13 bp, Homo sapiens
tcttccctacctc

SEQ ID NO: 1026856 - DNA, 10 bp, Homo sapiens
tcttccctcc

SEQ ID NO: 1026857 - DNA, 11 bp, Homo sapiens
tcttccctggg

SEQ ID NO: 1026858 - DNA, 13 bp, Homo sapiens
tcttccctgggct

SEQ ID NO: 1026859 - DNA, 19 bp, Homo sapiens
tcttcccttaactccaaga

SEQ ID NO: 1026860 - DNA, 17 bp, Homo sapiens
tcttcccttagcctctc

SEQ ID NO: 1026861 - DNA, 14 bp, Homo sapiens
tcttcccttcctcc

SEQ ID NO: 1026862 - DNA, 19 bp, Homo sapiens
tcttcccttcctccattgc

SEQ ID NO: 1026863 - DNA, 19 bp, Homo sapiens
tcttcccttttacatactg

SEQ ID NO: 1026864 - DNA, 21 bp, Homo sapiens
tcttcccttttacatactgct

SEQ ID NO: 1026865 - DNA, 20 bp, Homo sapiens
tcttccgagctgctttgtgg

SEQ ID NO: 1026866 - DNA, 17 bp, Homo sapiens
tcttccgcccctgcctg

SEQ ID NO: 1026867 - DNA, 18 bp, Homo sapiens
tcttccggagatgtagca

SEQ ID NO: 1026868 - DNA, 19 bp, Homo sapiens
tcttccggagatgtagcaa

SEQ ID NO: 1026869 - DNA, 15 bp, Homo sapiens
tcttccgtctccccc

SEQ ID NO: 1026870 - DNA, 20 bp, Homo sapiens
tcttcctaccaagtcaaact

SEQ ID NO: 1026871 - DNA, 21 bp, Homo sapiens
tcttcctaccctgcctccctt

SEQ ID NO: 1026872 - DNA, 18 bp, Homo sapiens
tcttcctcacactgctgt

SEQ ID NO: 1026873 - DNA, 14 bp, Homo sapiens
tcttcctcatcctg

SEQ ID NO: 1026874 - DNA, 13 bp, Homo sapiens
tcttcctccagct

SEQ ID NO: 1026875 - DNA, 14 bp, Homo sapiens
tcttcctccagctg

SEQ ID NO: 1026876 - DNA, 15 bp, Homo sapiens
tcttcctccagctgc

SEQ ID NO: 1026877 - DNA, 17 bp, Homo sapiens
tcttcctccagctgcac

SEQ ID NO: 1026878 - DNA, 16 bp, Homo sapiens
tcttcctcccctctca

SEQ ID NO: 1026879 - DNA, 14 bp, Homo sapiens
tcttcctctccttc

SEQ ID NO: 1026880 - DNA, 13 bp, Homo sapiens
tcttcctctgagg

SEQ ID NO: 1026881 - DNA, 14 bp, Homo sapiens
tcttcctctgctga

SEQ ID NO: 1026882 - DNA, 16 bp, Homo sapiens
tcttcctcttccccca

SEQ ID NO: 1026883 - DNA, 14 bp, Homo sapiens
tcttcctcttcttt

SEQ ID NO: 1026884 - DNA, 20 bp, Homo sapiens
tcttcctcttgaccctgcac

SEQ ID NO: 1026885 - DNA, 23 bp, Homo sapiens
tcttcctgacgaaactggccccg

SEQ ID NO: 1026886 - DNA, 10 bp, Homo sapiens
tcttcctgca

SEQ ID NO: 1026887 - DNA, 11 bp, Homo sapiens
tcttcctgccc

SEQ ID NO: 1026888 - DNA, 19 bp, Homo sapiens
tcttcctgcccctctttct

SEQ ID NO: 1026889 - DNA, 12 bp, Homo sapiens
tcttcctgccct

SEQ ID NO: 1026890 - DNA, 13 bp, Homo sapiens
tcttcctgccctt

SEQ ID NO: 1026891 - DNA, 14 bp, Homo sapiens
tcttcctgccttcg

SEQ ID NO: 1026892 - DNA, 15 bp, Homo sapiens
tcttcctgctccttt

SEQ ID NO: 1026893 - DNA, 13 bp, Homo sapiens
tcttcctgctgct

SEQ ID NO: 1026894 - DNA, 14 bp, Homo sapiens
tcttcctgctgctg

SEQ ID NO: 1026895 - DNA, 15 bp, Homo sapiens
tcttcctgctgctgt

SEQ ID NO: 1026896 - DNA, 18 bp, Homo sapiens
tcttgagcatcaatcttg

SEQ ID NO: 1026897 - DNA, 11 bp, Homo sapiens
tcttgagccag

SEQ ID NO: 1026898 - DNA, 16 bp, Homo sapiens
tcttgagccagccagg

SEQ ID NO: 1026899 - DNA, 21 bp, Homo sapiens
tcttgagccagccaggccctg

SEQ ID NO: 1026900 - DNA, 19 bp, Homo sapiens
tcttgagccagtaatcttt

SEQ ID NO: 1026901 - DNA, 16 bp, Homo sapiens
tcttgagccttgaact

SEQ ID NO: 1026902 - DNA, 19 bp, Homo sapiens
tcttgagccttgaactttg

SEQ ID NO: 1026903 - DNA, 14 bp, Homo sapiens
tcttgagctggcct

SEQ ID NO: 1026904 - DNA, 20 bp, Homo sapiens
tcttgaggaagcccaggctc

SEQ ID NO: 1026905 - DNA, 15 bp, Homo sapiens
tcttgaggagcatta

SEQ ID NO: 1026906 - DNA, 15 bp, Homo sapiens
tcttgaggccaggag

SEQ ID NO: 1026907 - DNA, 14 bp, Homo sapiens
tcttgagggagctt

SEQ ID NO: 1026908 - DNA, 20 bp, Homo sapiens
tcttgaggggaagctgccac

SEQ ID NO: 1026909 - DNA, 21 bp, Homo sapiens
tcttgagtttgtcgctcatgt

SEQ ID NO: 1026910 - DNA, 20 bp, Homo sapiens
tcttgatacccccctctgtc

SEQ ID NO: 1026911 - DNA, 18 bp, Homo sapiens
tcttgatcagttaagaaa

SEQ ID NO: 1026912 - DNA, 17 bp, Homo sapiens
tcttgatctttgagccc

SEQ ID NO: 1026913 - DNA, 21 bp, Homo sapiens
tcttgatgcatgcactgttcc

SEQ ID NO: 1026914 - DNA, 12 bp, Homo sapiens
tcttgatgtgaa

SEQ ID NO: 1026915 - DNA, 19 bp, Homo sapiens
tcttgattataaatgtttg

SEQ ID NO: 1026916 - DNA, 23 bp, Homo sapiens
tcttgattatccatattgagtca

SEQ ID NO: 1026917 - DNA, 17 bp, Homo sapiens
tcttgattcctggctct

SEQ ID NO: 1026918 - DNA, 18 bp, Homo sapiens
tcttgcaaagcgacagat

SEQ ID NO: 1026919 - DNA, 20 bp, Homo sapiens
tcttgcacagtcactgctct

SEQ ID NO: 1026920 - DNA, 17 bp, Homo sapiens
tcttgcactccttccct

SEQ ID NO: 1026921 - DNA, 23 bp, Homo sapiens
tcttgcaggaaggactatgaaaa

SEQ ID NO: 1026922 - DNA, 20 bp, Homo sapiens
tcttgcagtggcttttcatg

SEQ ID NO: 1026923 - DNA, 22 bp, Homo sapiens
tcttgcataggctcttaagcag

SEQ ID NO: 1026924 - DNA, 16 bp, Homo sapiens
tcttgcatctaatgaa

SEQ ID NO: 1026925 - DNA, 16 bp, Homo sapiens
tcttgccactgcctct

SEQ ID NO: 1026926 - DNA, 21 bp, Homo sapiens
tcttgccagcattttcacatt

SEQ ID NO: 1026927 - DNA, 13 bp, Homo sapiens
tcttgccagcctc

SEQ ID NO: 1026928 - DNA, 15 bp, Homo sapiens
tcttgccagcctcct

SEQ ID NO: 1026929 - DNA, 13 bp, Homo sapiens
tcttgccatcctg

SEQ ID NO: 1026930 - DNA, 20 bp, Homo sapiens
tcttgccattattaacccat

SEQ ID NO: 1026931 - DNA, 11 bp, Homo sapiens
tcttgcccact

SEQ ID NO: 1026932 - DNA, 15 bp, Homo sapiens
tcttgcccatcctga

SEQ ID NO: 1026933 - DNA, 14 bp, Homo sapiens
tcttgccccatcac

SEQ ID NO: 1026934 - DNA, 18 bp, Homo sapiens
tcttgcccgcacccctcc

SEQ ID NO: 1026935 - DNA, 21 bp, Homo sapiens
tcttgcccgcacccctccctg

SEQ ID NO: 1026936 - DNA, 20 bp, Homo sapiens
tcttgcccgtcggccctgcg

SEQ ID NO: 1026937 - DNA, 20 bp, Homo sapiens
tcttgcccttccctgtccct

SEQ ID NO: 1026938 - DNA, 21 bp, Homo sapiens
tcttgcccttccctgtccctc

SEQ ID NO: 1026939 - DNA, 17 bp, Homo sapiens
tcttgcctacttttctt

SEQ ID NO: 1026940 - DNA, 16 bp, Homo sapiens
tcttgcctaggccaaa

SEQ ID NO: 1026941 - DNA, 14 bp, Homo sapiens
tcttgcctctctca

SEQ ID NO: 1026942 - DNA, 12 bp, Homo sapiens
tcttgcctctgt

SEQ ID NO: 1026943 - DNA, 13 bp, Homo sapiens
tcttgcctctgtg

SEQ ID NO: 1026944 - DNA, 20 bp, Homo sapiens
tcttgccttaaccagtctct

SEQ ID NO: 1026945 - DNA, 20 bp, Homo sapiens
tcttgcgaatccaagctccc

SEQ ID NO: 1026946 - DNA, 18 bp, Homo sapiens
tcttgcgggcctggacaa

SEQ ID NO: 1026947 - DNA, 16 bp, Homo sapiens
tcttgctatttgagca

SEQ ID NO: 1026948 - DNA, 18 bp, Homo sapiens
tcttgctatttgagcatg

SEQ ID NO: 1026949 - DNA, 18 bp, Homo sapiens
tcttgctcaaaaatctgt

SEQ ID NO: 1026950 - DNA, 18 bp, Homo sapiens
tcttgctccattgtcatg

SEQ ID NO: 1026951 - DNA, 17 bp, Homo sapiens
tcttgctcctggggaga

SEQ ID NO: 1026952 - DNA, 18 bp, Homo sapiens
tcttgctctctctccctg

SEQ ID NO: 1026953 - DNA, 19 bp, Homo sapiens
tcttgctctttctactctg

SEQ ID NO: 1026954 - DNA, 20 bp, Homo sapiens
tcttgctgatggctgctaga

SEQ ID NO: 1026955 - DNA, 18 bp, Homo sapiens
tcttgctgccctgcccca

SEQ ID NO: 1026956 - DNA, 19 bp, Homo sapiens
tcttgctggctctgagaat

SEQ ID NO: 1026957 - DNA, 22 bp, Homo sapiens
tcttgctggttgtcatttttgc

SEQ ID NO: 1026958 - DNA, 13 bp, Homo sapiens
tcttgctgtctct

SEQ ID NO: 1026959 - DNA, 17 bp, Homo sapiens
tcttgctgtctctgctc

SEQ ID NO: 1026960 - DNA, 14 bp, Homo sapiens
tcttgctgttcagt

SEQ ID NO: 1026961 - DNA, 19 bp, Homo sapiens
tcttgctgttcagtgcttt

SEQ ID NO: 1026962 - DNA, 14 bp, Homo sapiens
tcttgctgttgaca

SEQ ID NO: 1026963 - DNA, 18 bp, Homo sapiens
tcttgctgttgacatatt

SEQ ID NO: 1026964 - DNA, 19 bp, Homo sapiens
tcttgctgttgacatattt

SEQ ID NO: 1026965 - DNA, 14 bp, Homo sapiens
tcttgcttcagtca

SEQ ID NO: 1026966 - DNA, 22 bp, Homo sapiens
tcttgcttccctaatctatggt

SEQ ID NO: 1026967 - DNA, 16 bp, Homo sapiens
tcttgcttctttctag

SEQ ID NO: 1026968 - DNA, 18 bp, Homo sapiens
tcttgcttctttctagaa

SEQ ID NO: 1026969 - DNA, 16 bp, Homo sapiens
tcttgcttggaagcca

SEQ ID NO: 1026970 - DNA, 18 bp, Homo sapiens
tcttgctttagaaaacat

SEQ ID NO: 1026971 - DNA, 14 bp, Homo sapiens
ggaaatttttaatg

SEQ ID NO: 1026972 - DNA, 14 bp, Homo sapiens
ggaacaaacagggc

SEQ ID NO: 1026973 - DNA, 17 bp, Homo sapiens
ggaacaaattagaggag

SEQ ID NO: 1026974 - DNA, 18 bp, Homo sapiens
ggaacaagctggcttctg

SEQ ID NO: 1026975 - DNA, 15 bp, Homo sapiens
ggaacaattgaagta

SEQ ID NO: 1026976 - DNA, 14 bp, Homo sapiens
ggaacacacttgga

SEQ ID NO: 1026977 - DNA, 16 bp, Homo sapiens
ggaacacatctggctg

SEQ ID NO: 1026978 - DNA, 17 bp, Homo sapiens
ggaacacatctggctgc

SEQ ID NO: 1026979 - DNA, 22 bp, Homo sapiens
ggaacactggcttgaaggactg

SEQ ID NO: 1026980 - DNA, 13 bp, Homo sapiens
ggaacagaaattg

SEQ ID NO: 1026981 - DNA, 16 bp, Homo sapiens
ggaacagaatgtttta

SEQ ID NO: 1026982 - DNA, 19 bp, Homo sapiens
ggaacagaatgttttactg

SEQ ID NO: 1026983 - DNA, 21 bp, Homo sapiens
ggaacagacaacagaagtcat

SEQ ID NO: 1026984 - DNA, 15 bp, Homo sapiens
ggaacagacaggaga

SEQ ID NO: 1026985 - DNA, 20 bp, Homo sapiens
ggaacagctatgggagcccc

SEQ ID NO: 1026986 - DNA, 15 bp, Homo sapiens
ggaacaggccccacg

SEQ ID NO: 1026987 - DNA, 20 bp, Homo sapiens
ggaacaggccccacgccctc

SEQ ID NO: 1026988 - DNA, 21 bp, Homo sapiens
ggaacagtaaagaaagcagaa

SEQ ID NO: 1026989 - DNA, 22 bp, Homo sapiens
ggaacagtaaagaaagcagaat

SEQ ID NO: 1026990 - DNA, 13 bp, Homo sapiens
ggaacagtcctgt

SEQ ID NO: 1026991 - DNA, 14 bp, Homo sapiens
ggaacagtggctgg

SEQ ID NO: 1026992 - DNA, 13 bp, Homo sapiens
ggaacataaaaag

SEQ ID NO: 1026993 - DNA, 18 bp, Homo sapiens
ggaacataaaaaggacat

SEQ ID NO: 1026994 - DNA, 20 bp, Homo sapiens
ggaacatcaccctatatata

SEQ ID NO: 1026995 - DNA, 11 bp, Homo sapiens
ggaacatttct

SEQ ID NO: 1026996 - DNA, 23 bp, Homo sapiens
ggaaccaccagcgttcccttctc

SEQ ID NO: 1026997 - DNA, 22 bp, Homo sapiens
ggaaccagcagaaatgccccca

SEQ ID NO: 1026998 - DNA, 12 bp, Homo sapiens
ggaaccagcccc

SEQ ID NO: 1026999 - DNA, 22 bp, Homo sapiens
ggaaccagccccatcagaacct

SEQ ID NO: 1027000 - DNA, 23 bp, Homo sapiens
ggaaccaggagaagggctggggc

SEQ ID NO: 1027001 - DNA, 18 bp, Homo sapiens
ggaaccattgttgtcttc

SEQ ID NO: 1027002 - DNA, 21 bp, Homo sapiens
ggaaccccggggtgcccacag

SEQ ID NO: 1027003 - DNA, 13 bp, Homo sapiens
ggaaccctaaagc

SEQ ID NO: 1027004 - DNA, 12 bp, Homo sapiens
ggaaccctcagg

SEQ ID NO: 1027005 - DNA, 14 bp, Homo sapiens
ggaaccgctcacct

SEQ ID NO: 1027006 - DNA, 20 bp, Homo sapiens
ggaaccgctcacctagagcc

SEQ ID NO: 1027007 - DNA, 18 bp, Homo sapiens
ggaacctagtactctctg

SEQ ID NO: 1027008 - DNA, 20 bp, Homo sapiens
ggaacctagtactctctgct

SEQ ID NO: 1027009 - DNA, 23 bp, Homo sapiens
ggaacctagtactctctgctcta

SEQ ID NO: 1027010 - DNA, 14 bp, Homo sapiens
ggaacctcccagag

SEQ ID NO: 1027011 - DNA, 15 bp, Homo sapiens
ggaacctctgtctca

SEQ ID NO: 1027012 - DNA, 13 bp, Homo sapiens
ggaacctgacttt

SEQ ID NO: 1027013 - DNA, 11 bp, Homo sapiens
ggaacctgcca

SEQ ID NO: 1027014 - DNA, 16 bp, Homo sapiens
ggaaccttccttcctg

SEQ ID NO: 1027015 - DNA, 20 bp, Homo sapiens
ggaaccttccttcctgcttg

SEQ ID NO: 1027016 - DNA, 21 bp, Homo sapiens
ggaaccttccttcctgcttga

SEQ ID NO: 1027017 - DNA, 15 bp, Homo sapiens
ggaaccttgctgtcc

SEQ ID NO: 1027018 - DNA, 15 bp, Homo sapiens
ggaagcgccaggctg

SEQ ID NO: 1027019 - DNA, 20 bp, Homo sapiens
ggaagcggaggttgcaggga

SEQ ID NO: 1027020 - DNA, 18 bp, Homo sapiens
ggaagcgtcgccccagtg

SEQ ID NO: 1027021 - DNA, 23 bp, Homo sapiens
ggaagcgtcgccccagtggcact

SEQ ID NO: 1027022 - DNA, 16 bp, Homo sapiens
ggaagctaatttgcat

SEQ ID NO: 1027023 - DNA, 19 bp, Homo sapiens
ggaagctagacacatgaag

SEQ ID NO: 1027024 - DNA, 16 bp, Homo sapiens
ggaagctagtcttttg

SEQ ID NO: 1027025 - DNA, 12 bp, Homo sapiens
ggaagctccttc

SEQ ID NO: 1027026 - DNA, 21 bp, Homo sapiens
ggaagctctcccttgtttact

SEQ ID NO: 1027027 - DNA, 13 bp, Homo sapiens
ggaagctgaggcg

SEQ ID NO: 1027028 - DNA, 17 bp, Homo sapiens
ggaagctgcacatgtgc

SEQ ID NO: 1027029 - DNA, 22 bp, Homo sapiens
ggaagctgccacccctcttctg

SEQ ID NO: 1027030 - DNA, 16 bp, Homo sapiens
ggaagctggagtgctg

SEQ ID NO: 1027031 - DNA, 17 bp, Homo sapiens
ggaagctggcagaacgg

SEQ ID NO: 1027032 - DNA, 12 bp, Homo sapiens
ggaagctgggcc

SEQ ID NO: 1027033 - DNA, 13 bp, Homo sapiens
ggaagctgggccc

SEQ ID NO: 1027034 - DNA, 15 bp, Homo sapiens
ggaagcttaaagtat

SEQ ID NO: 1027035 - DNA, 22 bp, Homo sapiens
ggaagcttaaagtatctacctg

SEQ ID NO: 1027036 - DNA, 14 bp, Homo sapiens
ggaagcttggcttc

SEQ ID NO: 1027037 - DNA, 19 bp, Homo sapiens
ggaaggaaagaaagaagga

SEQ ID NO: 1027038 - DNA, 17 bp, Homo sapiens
ggaaggaactctggctt

SEQ ID NO: 1027039 - DNA, 21 bp, Homo sapiens
ggaaggagactcacctctgcc

SEQ ID NO: 1027040 - DNA, 22 bp, Homo sapiens
ggaaggagactcacctctgcct

SEQ ID NO: 1027041 - DNA, 19 bp, Homo sapiens
ggaaggagagatgacccct

SEQ ID NO: 1027042 - DNA, 13 bp, Homo sapiens
ggaaggagccagt

SEQ ID NO: 1027043 - DNA, 17 bp, Homo sapiens
ggaaggagcccctgagt

SEQ ID NO: 1027044 - DNA, 19 bp, Homo sapiens
ggaaggaggacccaggaca

SEQ ID NO: 1027045 - DNA, 23 bp, Homo sapiens
ggaaggagggacttggctgtcct

SEQ ID NO: 1027046 - DNA, 12 bp, Homo sapiens
ggaaggagggca

SEQ ID NO: 1027047 - DNA, 12 bp, Homo sapiens
ggaaggagggga

SEQ ID NO: 1027048 - DNA, 17 bp, Homo sapiens
ggaaggatctgctgagg

SEQ ID NO: 1027049 - DNA, 17 bp, Homo sapiens
ggaaggcagacagcagg

SEQ ID NO: 1027050 - DNA, 15 bp, Homo sapiens
ggaaggcagagaaat

SEQ ID NO: 1027051 - DNA, 16 bp, Homo sapiens
ggaaggcagaggctgg

SEQ ID NO: 1027052 - DNA, 15 bp, Homo sapiens
ggaaggcagctgctc

SEQ ID NO: 1027053 - DNA, 13 bp, Homo sapiens
ggaaggcagggca

SEQ ID NO: 1027054 - DNA, 15 bp, Homo sapiens
ggaaggcagggcggt

SEQ ID NO: 1027055 - DNA, 19 bp, Homo sapiens
ggaaggcatgcctggacaa

SEQ ID NO: 1027056 - DNA, 20 bp, Homo sapiens
ggaaggcctgacttctgctg

SEQ ID NO: 1027057 - DNA, 14 bp, Homo sapiens
ggaaggcctttctt

SEQ ID NO: 1027058 - DNA, 19 bp, Homo sapiens
ggaaggcgagtctggggac

SEQ ID NO: 1027059 - DNA, 21 bp, Homo sapiens
ggaaggctaagttcagttctg

SEQ ID NO: 1027060 - DNA, 20 bp, Homo sapiens
ggaaggctgaactcttcaga

SEQ ID NO: 1027061 - DNA, 14 bp, Homo sapiens
ggaaggctggctgg

SEQ ID NO: 1027062 - DNA, 17 bp, Homo sapiens
ggaaggctggctgggca

SEQ ID NO: 1027063 - DNA, 16 bp, Homo sapiens
ggaagggactaggagc

SEQ ID NO: 1027064 - DNA, 15 bp, Homo sapiens
ggaagggaggagcag

SEQ ID NO: 1027065 - DNA, 14 bp, Homo sapiens
ggaagggaggggaa

SEQ ID NO: 1027066 - DNA, 20 bp, Homo sapiens
ggaagggaggggaaggggcc

SEQ ID NO: 1027067 - DNA, 16 bp, Homo sapiens
ggaagggatctgagaa

SEQ ID NO: 1027068 - DNA, 15 bp, Homo sapiens
ggaagggcaggaagg

SEQ ID NO: 1027069 - DNA, 21 bp, Homo sapiens
ggaagggcatgcacgggcatg

SEQ ID NO: 1027070 - DNA, 14 bp, Homo sapiens
ggaagggccaccct

SEQ ID NO: 1027071 - DNA, 23 bp, Homo sapiens
ggaagggccaccctgctgcacta

SEQ ID NO: 1027072 - DNA, 14 bp, Homo sapiens
ggaaggggatggac

SEQ ID NO: 1027073 - DNA, 19 bp, Homo sapiens
ggaaggggatggaggccag

SEQ ID NO: 1027074 - DNA, 14 bp, Homo sapiens
ggaaggggcagcag

SEQ ID NO: 1027075 - DNA, 14 bp, Homo sapiens
ggaaggggcagccc

SEQ ID NO: 1027076 - DNA, 13 bp, Homo sapiens
ggaaggggccacg

SEQ ID NO: 1027077 - DNA, 17 bp, Homo sapiens
ggaaggggccagaggct

SEQ ID NO: 1027078 - DNA, 12 bp, Homo sapiens
ggaaggggccgg

SEQ ID NO: 1027079 - DNA, 19 bp, Homo sapiens
ggaaggggttcctcaaatt

SEQ ID NO: 1027080 - DNA, 21 bp, Homo sapiens
ggaaggggttcctcaaatttt

SEQ ID NO: 1027081 - DNA, 14 bp, Homo sapiens
ggaagggtggggag

SEQ ID NO: 1027082 - DNA, 20 bp, Homo sapiens
ggaaggtaaaaacccagcgg

SEQ ID NO: 1027083 - DNA, 22 bp, Homo sapiens
ggaaggtgaggcagaagcattg

SEQ ID NO: 1027084 - DNA, 15 bp, Homo sapiens
ggaaggtgcctggcc

SEQ ID NO: 1027085 - DNA, 15 bp, Homo sapiens
ggaaggtgctgagct

SEQ ID NO: 1027086 - DNA, 13 bp, Homo sapiens
ggaaggtggggcc

SEQ ID NO: 1027087 - DNA, 14 bp, Homo sapiens
ggaagtagtccttg

SEQ ID NO: 1027088 - DNA, 18 bp, Homo sapiens
ggaagtagtccttggcat

SEQ ID NO: 1027089 - DNA, 17 bp, Homo sapiens
ggaagtatacctggctt

SEQ ID NO: 1027090 - DNA, 16 bp, Homo sapiens
ggaagtatgagtgctg

SEQ ID NO: 1027091 - DNA, 15 bp, Homo sapiens
ggaagtcacctttct

SEQ ID NO: 1027092 - DNA, 16 bp, Homo sapiens
ggaagtcacctttctg

SEQ ID NO: 1027093 - DNA, 19 bp, Homo sapiens
ggaagtcacctttctgggc

SEQ ID NO: 1027094 - DNA, 15 bp, Homo sapiens
ggaagtcctgggagg

SEQ ID NO: 1027095 - DNA, 14 bp, Homo sapiens
ggaagtctaggagc

SEQ ID NO: 1027096 - DNA, 17 bp, Homo sapiens
ggaagtctaggagctgg

SEQ ID NO: 1027097 - DNA, 21 bp, Homo sapiens
ggaagtgacaaggccccagag

SEQ ID NO: 1027098 - DNA, 16 bp, Homo sapiens
ggaagtgaggaagcca

SEQ ID NO: 1027099 - DNA, 16 bp, Homo sapiens
ggaagtgaggcccaag

SEQ ID NO: 1027100 - DNA, 12 bp, Homo sapiens
ggaagtggctgg

SEQ ID NO: 1027101 - DNA, 18 bp, Homo sapiens
ggaagtggggacagattc

SEQ ID NO: 1027102 - DNA, 18 bp, Homo sapiens
ggaagtggggtgttcttc

SEQ ID NO: 1027103 - DNA, 17 bp, Homo sapiens
ggaagtgtaacagctga

SEQ ID NO: 1027104 - DNA, 21 bp, Homo sapiens
ggaagtgtaacagctgaggtc

SEQ ID NO: 1027105 - DNA, 12 bp, Homo sapiens
ggaagtgttcaa

SEQ ID NO: 1027106 - DNA, 18 bp, Homo sapiens
ggaagtgttcaagaaata

SEQ ID NO: 1027107 - DNA, 22 bp, Homo sapiens
ggaagtgttcaagaaataaaaa

SEQ ID NO: 1027108 - DNA, 16 bp, Homo sapiens
ggaagttcagaaggtg

SEQ ID NO: 1027109 - DNA, 14 bp, Homo sapiens
ggaagttctccagc

SEQ ID NO: 1027110 - DNA, 18 bp, Homo sapiens
ggaagttgacttatagta

SEQ ID NO: 1027111 - DNA, 17 bp, Homo sapiens
ggaagttggggcactgg

SEQ ID NO: 1027112 - DNA, 18 bp, Homo sapiens
ggaagttgtctccttcca

SEQ ID NO: 1027113 - DNA, 23 bp, Homo sapiens
ggaagtttatttgagaaaatata

SEQ ID NO: 1027114 - DNA, 18 bp, Homo sapiens
ggaagtttcatatattgt

SEQ ID NO: 1027115 - DNA, 14 bp, Homo sapiens
ggaataaaaggctt

SEQ ID NO: 1027116 - DNA, 22 bp, Homo sapiens
ggaataaaatataaaactgaaa

SEQ ID NO: 1027117 - DNA, 15 bp, Homo sapiens
ggaataaaatgattt

SEQ ID NO: 1027118 - DNA, 13 bp, Homo sapiens
ggaataaacagtg

SEQ ID NO: 1027119 - DNA, 15 bp, Homo sapiens
ggaataaagttgcag

SEQ ID NO: 1027120 - DNA, 21 bp, Homo sapiens
ggaataaagttgcagatgatt

SEQ ID NO: 1027121 - DNA, 19 bp, Homo sapiens
ggaataacaactttcagtg

SEQ ID NO: 1027122 - DNA, 14 bp, Homo sapiens
ggaataaccttcca

SEQ ID NO: 1027123 - DNA, 15 bp, Homo sapiens
ggaataacctttctg

SEQ ID NO: 1027124 - DNA, 17 bp, Homo sapiens
ggaataacctttctgga

SEQ ID NO: 1027125 - DNA, 20 bp, Homo sapiens
ggaataaggccttaatatgt

SEQ ID NO: 1027126 - DNA, 17 bp, Homo sapiens
ggaataatttgtaaatg

SEQ ID NO: 1027127 - DNA, 20 bp, Homo sapiens
ggaataatttgtaaatgatt

SEQ ID NO: 1027128 - DNA, 18 bp, Homo sapiens
ggaatacattttattctg

SEQ ID NO: 1027129 - DNA, 18 bp, Homo sapiens
ggaatactcacattttgt

SEQ ID NO: 1027130 - DNA, 19 bp, Homo sapiens
ggaatactgaacatctgag

SEQ ID NO: 1027131 - DNA, 12 bp, Homo sapiens
ggaatacttttt

SEQ ID NO: 1027132 - DNA, 14 bp, Homo sapiens
ggaatagaggaaga

SEQ ID NO: 1027133 - DNA, 16 bp, Homo sapiens
ggaatagaggaagaaa

SEQ ID NO: 1027134 - DNA, 12 bp, Homo sapiens
ggaatagggaga

SEQ ID NO: 1027135 - DNA, 15 bp, Homo sapiens
ggaatagggagacag

SEQ ID NO: 1027136 - DNA, 17 bp, Homo sapiens
ggaatagttgagcccca

SEQ ID NO: 1027137 - DNA, 23 bp, Homo sapiens
ggaatataaggaaagcaataaat

SEQ ID NO: 1027138 - DNA, 15 bp, Homo sapiens
ggaatataattgttt

SEQ ID NO: 1027139 - DNA, 18 bp, Homo sapiens
ggaatatatgtgtgccta

SEQ ID NO: 1027140 - DNA, 22 bp, Homo sapiens
ggaatatgttcaatgcaaagta

SEQ ID NO: 1027141 - DNA, 13 bp, Homo sapiens
ggacccacccagc

SEQ ID NO: 1027142 - DNA, 21 bp, Homo sapiens
ggacccaccccaactctcccc

SEQ ID NO: 1027143 - DNA, 18 bp, Homo sapiens
ggacccagagtcccaggc

SEQ ID NO: 1027144 - DNA, 20 bp, Homo sapiens
ggacccagctactctgtcca

SEQ ID NO: 1027145 - DNA, 21 bp, Homo sapiens
ggacccagctactctgtccag

SEQ ID NO: 1027146 - DNA, 20 bp, Homo sapiens
ggacccagctcctctgagcc

SEQ ID NO: 1027147 - DNA, 13 bp, Homo sapiens
ggacccaggacag

SEQ ID NO: 1027148 - DNA, 11 bp, Homo sapiens
ggacccaggcc

SEQ ID NO: 1027149 - DNA, 12 bp, Homo sapiens
ggacccaggccc

SEQ ID NO: 1027150 - DNA, 14 bp, Homo sapiens
ggacccaggccctc

SEQ ID NO: 1027151 - DNA, 22 bp, Homo sapiens
ggacccaggccctccatgggct

SEQ ID NO: 1027152 - DNA, 17 bp, Homo sapiens
ggacccaggctccgccc

SEQ ID NO: 1027153 - DNA, 21 bp, Homo sapiens
ggacccagggcctgacttgag

SEQ ID NO: 1027154 - DNA, 19 bp, Homo sapiens
ggacccagggtcccctccc

SEQ ID NO: 1027155 - DNA, 16 bp, Homo sapiens
ggaccccacatccttc

SEQ ID NO: 1027156 - DNA, 17 bp, Homo sapiens
ggaccccagccatccag

SEQ ID NO: 1027157 - DNA, 18 bp, Homo sapiens
ggaccccagctgggaggc

SEQ ID NO: 1027158 - DNA, 20 bp, Homo sapiens
ggaccccagctgggaggcaa

SEQ ID NO: 1027159 - DNA, 13 bp, Homo sapiens
ggaccccagggtg

SEQ ID NO: 1027160 - DNA, 16 bp, Homo sapiens
ggacccccactaagac

SEQ ID NO: 1027161 - DNA, 14 bp, Homo sapiens
ggacccccgccccc

SEQ ID NO: 1027162 - DNA, 23 bp, Homo sapiens
ggacccccgccccctgccctccc

SEQ ID NO: 1027163 - DNA, 19 bp, Homo sapiens
ggaccccctcgccagcttg

SEQ ID NO: 1027164 - DNA, 22 bp, Homo sapiens
ggaccccctgagtcaactggag

SEQ ID NO: 1027165 - DNA, 12 bp, Homo sapiens
ggacccccttcc

SEQ ID NO: 1027166 - DNA, 14 bp, Homo sapiens
ggaccccgagggct

SEQ ID NO: 1027167 - DNA, 21 bp, Homo sapiens
ggaccccgagggctgaggagc

SEQ ID NO: 1027168 - DNA, 22 bp, Homo sapiens
ggaccccgagggctgaggagca

SEQ ID NO: 1027169 - DNA, 23 bp, Homo sapiens
ggacccctcccttgctcagtgcc

SEQ ID NO: 1027170 - DNA, 17 bp, Homo sapiens
ggacccctgccttcctc

SEQ ID NO: 1027171 - DNA, 19 bp, Homo sapiens
ggacccctgccttcctctg

SEQ ID NO: 1027172 - DNA, 22 bp, Homo sapiens
ggacccctgccttcctctgagg

SEQ ID NO: 1027173 - DNA, 22 bp, Homo sapiens
ggacccctgctcccagcctgct

SEQ ID NO: 1027174 - DNA, 16 bp, Homo sapiens
ggacccctggggtggc

SEQ ID NO: 1027175 - DNA, 21 bp, Homo sapiens
ggaccccttaatcttgctttc

SEQ ID NO: 1027176 - DNA, 15 bp, Homo sapiens
ggacccgctctggac

SEQ ID NO: 1027177 - DNA, 21 bp, Homo sapiens
ggacccggaggggcctggcag

SEQ ID NO: 1027178 - DNA, 21 bp, Homo sapiens
ggacccggccgccgccaggac

SEQ ID NO: 1027179 - DNA, 22 bp, Homo sapiens
ggacccggccgccgccaggact

SEQ ID NO: 1027180 - DNA, 17 bp, Homo sapiens
ggacccggggtctcctg

SEQ ID NO: 1027181 - DNA, 19 bp, Homo sapiens
ggacccggggtctcctgga

SEQ ID NO: 1027182 - DNA, 15 bp, Homo sapiens
ggaccctcagccctg

SEQ ID NO: 1027183 - DNA, 16 bp, Homo sapiens
ggaccctgccgagggg

SEQ ID NO: 1027184 - DNA, 13 bp, Homo sapiens
ggaccctggggca

SEQ ID NO: 1027185 - DNA, 13 bp, Homo sapiens
ggaccctgtccaa

SEQ ID NO: 1027186 - DNA, 22 bp, Homo sapiens
ggaccctgtccggcccagtgcc

SEQ ID NO: 1027187 - DNA, 23 bp, Homo sapiens
ggaccctgtccggcccagtgcca

SEQ ID NO: 1027188 - DNA, 22 bp, Homo sapiens
ggaccctgtgacatggtgcctg

SEQ ID NO: 1027189 - DNA, 23 bp, Homo sapiens
ggaccctgtgacatggtgcctga

SEQ ID NO: 1027190 - DNA, 20 bp, Homo sapiens
ggacccttaggatggggctc

SEQ ID NO: 1027191 - DNA, 24 bp, Homo sapiens
ggacccttaggatggggctcccag

SEQ ID NO: 1027192 - DNA, 19 bp, Homo sapiens
ggacccttcccagccctca

SEQ ID NO: 1027193 - DNA, 18 bp, Homo sapiens
ggaccctttttgttatga

SEQ ID NO: 1027194 - DNA, 20 bp, Homo sapiens
ggaccgagatgtgagtcctg

SEQ ID NO: 1027195 - DNA, 15 bp, Homo sapiens
ggaccgcctggccct

SEQ ID NO: 1027196 - DNA, 21 bp, Homo sapiens
ggaccgcctggccctccctcc

SEQ ID NO: 1027197 - DNA, 16 bp, Homo sapiens
ggaccgcgtagagagc

SEQ ID NO: 1027198 - DNA, 16 bp, Homo sapiens
ggaccgggtgggcctg

SEQ ID NO: 1027199 - DNA, 21 bp, Homo sapiens
ggaccgggtgggcctggcctg

SEQ ID NO: 1027200 - DNA, 19 bp, Homo sapiens
ggaccggtgctgcaggagt

SEQ ID NO: 1027201 - DNA, 19 bp, Homo sapiens
ggaccgtccaggggagatg

SEQ ID NO: 1027202 - DNA, 23 bp, Homo sapiens
ggaccgtgccattgtactccagc

SEQ ID NO: 1027203 - DNA, 19 bp, Homo sapiens
ggaccgtgccccacctccc

SEQ ID NO: 1027204 - DNA, 22 bp, Homo sapiens
ggacctaacattcgatctcatt

SEQ ID NO: 1027205 - DNA, 21 bp, Homo sapiens
ggacctaatgctggcctgact

SEQ ID NO: 1027206 - DNA, 16 bp, Homo sapiens
ggacctacctccctcc

SEQ ID NO: 1027207 - DNA, 20 bp, Homo sapiens
ggacctacctccctccctct

SEQ ID NO: 1027208 - DNA, 21 bp, Homo sapiens
ggacctacctccctccctctc

SEQ ID NO: 1027209 - DNA, 21 bp, Homo sapiens
ggacctcagagtccaggcccc

SEQ ID NO: 1027210 - DNA, 19 bp, Homo sapiens
ggacctcaggagggcaggc

SEQ ID NO: 1027211 - DNA, 15 bp, Homo sapiens
ggacctcaggggcac

SEQ ID NO: 1027212 - DNA, 23 bp, Homo sapiens
ggacctcaggtgagaagcagagg

SEQ ID NO: 1027213 - DNA, 11 bp, Homo sapiens
ggacctccagg

SEQ ID NO: 1027214 - DNA, 14 bp, Homo sapiens
ggacctccaggggc

SEQ ID NO: 1027215 - DNA, 20 bp, Homo sapiens
ggacctccaggggctcctgg

SEQ ID NO: 1027216 - DNA, 21 bp, Homo sapiens
ggacctccaggggctcctggg

SEQ ID NO: 1027217 - DNA, 17 bp, Homo sapiens
ggacctcccctgaggct

SEQ ID NO: 1027218 - DNA, 11 bp, Homo sapiens
ggacctccctt

SEQ ID NO: 1027219 - DNA, 17 bp, Homo sapiens
ggacctctgctctgagg

SEQ ID NO: 1027220 - DNA, 17 bp, Homo sapiens
ggacctgccaggcaggg

SEQ ID NO: 1027221 - DNA, 23 bp, Homo sapiens
ggacctgccccggacctacctcc

SEQ ID NO: 1027222 - DNA, 16 bp, Homo sapiens
ggacctgcctagcatg

SEQ ID NO: 1027223 - DNA, 18 bp, Homo sapiens
ggacctgcctagcatggg

SEQ ID NO: 1027224 - DNA, 13 bp, Homo sapiens
ggacctgcctgca

SEQ ID NO: 1027225 - DNA, 12 bp, Homo sapiens
ggacctgctcat

SEQ ID NO: 1027226 - DNA, 22 bp, Homo sapiens
ggacctgggaacgactggactg

SEQ ID NO: 1027227 - DNA, 21 bp, Homo sapiens
ggacctggggcacagtccagg

SEQ ID NO: 1027228 - DNA, 12 bp, Homo sapiens
ggacctgtcccc

SEQ ID NO: 1027229 - DNA, 19 bp, Homo sapiens
ggacctgtcccccactctc

SEQ ID NO: 1027230 - DNA, 16 bp, Homo sapiens
ggacctgttttcttca

SEQ ID NO: 1027231 - DNA, 21 bp, Homo sapiens
ggaccttaggccttcctctct

SEQ ID NO: 1027232 - DNA, 15 bp, Homo sapiens
ggaccttcctgccac

SEQ ID NO: 1027233 - DNA, 20 bp, Homo sapiens
ggaccttcgggctgtgcccg

SEQ ID NO: 1027234 - DNA, 16 bp, Homo sapiens
ggaccttgacagagca

SEQ ID NO: 1027235 - DNA, 19 bp, Homo sapiens
ggaccttgacagagcagct

SEQ ID NO: 1027236 - DNA, 20 bp, Homo sapiens
ggaccttggcgctctcagct

SEQ ID NO: 1027237 - DNA, 14 bp, Homo sapiens
ggaccttggcgctt

SEQ ID NO: 1027238 - DNA, 22 bp, Homo sapiens
ggacctttaggtcaaactccct

SEQ ID NO: 1027239 - DNA, 19 bp, Homo sapiens
ggacctttccaccacagcc

SEQ ID NO: 1027240 - DNA, 19 bp, Homo sapiens
ggaccttttggtcttcagc

SEQ ID NO: 1027241 - DNA, 16 bp, Homo sapiens
ggaccttttgttttct

SEQ ID NO: 1027242 - DNA, 15 bp, Homo sapiens
ggacgaatatgaatg

SEQ ID NO: 1027243 - DNA, 18 bp, Homo sapiens
ggacgcacgctcgctgcc

SEQ ID NO: 1027244 - DNA, 24 bp, Homo sapiens
ggacgcacgctcgctgccatcacc

SEQ ID NO: 1027245 - DNA, 14 bp, Homo sapiens
ggacgcaggccctg

SEQ ID NO: 1027246 - DNA, 16 bp, Homo sapiens
ggacgcaggccctgtc

SEQ ID NO: 1027247 - DNA, 20 bp, Homo sapiens
ggacgcaggccctgtccagc

SEQ ID NO: 1027248 - DNA, 18 bp, Homo sapiens
ggacgccaacttctccca

SEQ ID NO: 1027249 - DNA, 21 bp, Homo sapiens
ggacgccaacttctcccaccc

SEQ ID NO: 1027250 - DNA, 22 bp, Homo sapiens
ggacgccaacttctcccacccc

SEQ ID NO: 1027251 - DNA, 14 bp, Homo sapiens
ggacgcctgccctg

SEQ ID NO: 1027252 - DNA, 13 bp, Homo sapiens
ggacgcttctgaa

SEQ ID NO: 1027253 - DNA, 22 bp, Homo sapiens
ggacgcttttgagtgggccctg

SEQ ID NO: 1027254 - DNA, 15 bp, Homo sapiens
ggacggaccagcatc

SEQ ID NO: 1027255 - DNA, 15 bp, Homo sapiens
ggacggccctgcctg

SEQ ID NO: 1027256 - DNA, 19 bp, Homo sapiens
ggacggccctgcctgcctc

SEQ ID NO: 1027257 - DNA, 22 bp, Homo sapiens
ggacggcctgatgctccctccc

SEQ ID NO: 1027258 - DNA, 15 bp, Homo sapiens
ggacggctgggcaca

SEQ ID NO: 1027259 - DNA, 13 bp, Homo sapiens
ggacggggaggct

SEQ ID NO: 1027260 - DNA, 21 bp, Homo sapiens
ggacggtgcccaagccagagg

SEQ ID NO: 1027261 - DNA, 16 bp, Homo sapiens
ggacttggtaagatga

SEQ ID NO: 1027262 - DNA, 14 bp, Homo sapiens
ggacttgtatattt

SEQ ID NO: 1027263 - DNA, 15 bp, Homo sapiens
ggacttgtatatttg

SEQ ID NO: 1027264 - DNA, 16 bp, Homo sapiens
ggactttatttatttc

SEQ ID NO: 1027265 - DNA, 17 bp, Homo sapiens
ggactttctctaataat

SEQ ID NO: 1027266 - DNA, 22 bp, Homo sapiens
ggactttgcagccggcacaggg

SEQ ID NO: 1027267 - DNA, 22 bp, Homo sapiens
ggacttttcgttaacattgacc

SEQ ID NO: 1027268 - DNA, 21 bp, Homo sapiens
ggacttttttgattaagtggt

SEQ ID NO: 1027269 - DNA, 11 bp, Homo sapiens
ggagaaaaaaa

SEQ ID NO: 1027270 - DNA, 22 bp, Homo sapiens
ggagaaaaaaatcaaccctgca

SEQ ID NO: 1027271 - DNA, 18 bp, Homo sapiens
ggagaaaaagaaacacaa

SEQ ID NO: 1027272 - DNA, 21 bp, Homo sapiens
ggagaaaagacggatggcagg

SEQ ID NO: 1027273 - DNA, 15 bp, Homo sapiens
ggagaaaagtgggct

SEQ ID NO: 1027274 - DNA, 17 bp, Homo sapiens
ggagaaaagtgggctgc

SEQ ID NO: 1027275 - DNA, 18 bp, Homo sapiens
ggagaaaatcatcaagaa

SEQ ID NO: 1027276 - DNA, 23 bp, Homo sapiens
ggagaaaattggaactctactca

SEQ ID NO: 1027277 - DNA, 11 bp, Homo sapiens
ggagaaacaca

SEQ ID NO: 1027278 - DNA, 16 bp, Homo sapiens
ggagaaacagagacag

SEQ ID NO: 1027279 - DNA, 15 bp, Homo sapiens
ggagaaagaaaactg

SEQ ID NO: 1027280 - DNA, 12 bp, Homo sapiens
ggagaaagaagt

SEQ ID NO: 1027281 - DNA, 21 bp, Homo sapiens
ggagaaagaagtggagacagt

SEQ ID NO: 1027282 - DNA, 12 bp, Homo sapiens
ggagaaaggaga

SEQ ID NO: 1027283 - DNA, 20 bp, Homo sapiens
ggagaaataatgcatttctg

SEQ ID NO: 1027284 - DNA, 20 bp, Homo sapiens
ggagaaatgcatccattcct

SEQ ID NO: 1027285 - DNA, 13 bp, Homo sapiens
ggagaaatgccag

SEQ ID NO: 1027286 - DNA, 17 bp, Homo sapiens
ggagaaatgttgttcat

SEQ ID NO: 1027287 - DNA, 20 bp, Homo sapiens
ggagaacaagaaagggccag

SEQ ID NO: 1027288 - DNA, 22 bp, Homo sapiens
ggagaacagtttcatcaggacc

SEQ ID NO: 1027289 - DNA, 13 bp, Homo sapiens
ggagaactagaga

SEQ ID NO: 1027290 - DNA, 19 bp, Homo sapiens
ggagaagaacaagaaatgg

SEQ ID NO: 1027291 - DNA, 18 bp, Homo sapiens
ggagaagaagaattggcc

SEQ ID NO: 1027292 - DNA, 13 bp, Homo sapiens
ggagaagaagtca

SEQ ID NO: 1027293 - DNA, 22 bp, Homo sapiens
ggagaagaattttcagacccca

SEQ ID NO: 1027294 - DNA, 14 bp, Homo sapiens
ggagaagacccacg

SEQ ID NO: 1027295 - DNA, 13 bp, Homo sapiens
ggagaagagccct

SEQ ID NO: 1027296 - DNA, 16 bp, Homo sapiens
ggagaagagtattttt

SEQ ID NO: 1027297 - DNA, 18 bp, Homo sapiens
ggagaagagtatttttaa

SEQ ID NO: 1027298 - DNA, 21 bp, Homo sapiens
ggagaagcacagctcctgcca

SEQ ID NO: 1027299 - DNA, 22 bp, Homo sapiens
ggagaagcagctaacaatgtct

SEQ ID NO: 1027300 - DNA, 16 bp, Homo sapiens
ggagaagcagtgagcc

SEQ ID NO: 1027301 - DNA, 13 bp, Homo sapiens
ggagaagcatgaa

SEQ ID NO: 1027302 - DNA, 13 bp, Homo sapiens
ggagaagccacct

SEQ ID NO: 1027303 - DNA, 12 bp, Homo sapiens
ggagaagctgaa

SEQ ID NO: 1027304 - DNA, 13 bp, Homo sapiens
ggagaagctgaag

SEQ ID NO: 1027305 - DNA, 14 bp, Homo sapiens
ggagaagctgaagc

SEQ ID NO: 1027306 - DNA, 18 bp, Homo sapiens
ggagaagctgaagccccc

SEQ ID NO: 1027307 - DNA, 13 bp, Homo sapiens
ggagaagctgatg

SEQ ID NO: 1027308 - DNA, 16 bp, Homo sapiens
ggagaagctgatgctt

SEQ ID NO: 1027309 - DNA, 12 bp, Homo sapiens
ggagaaggaaaa

SEQ ID NO: 1027310 - DNA, 14 bp, Homo sapiens
ggagaaggaaaaca

SEQ ID NO: 1027311 - DNA, 23 bp, Homo sapiens
ggagaaggaagggcagagaatgg

SEQ ID NO: 1027312 - DNA, 18 bp, Homo sapiens
ggagaagggctggggccg

SEQ ID NO: 1027313 - DNA, 20 bp, Homo sapiens
ggagaagggggctctgcccc

SEQ ID NO: 1027314 - DNA, 20 bp, Homo sapiens
ggagaagggggtctctgtta

SEQ ID NO: 1027315 - DNA, 15 bp, Homo sapiens
ggagaaggtcagcga

SEQ ID NO: 1027316 - DNA, 22 bp, Homo sapiens
ggagaagtcttagacttgaaat

SEQ ID NO: 1027317 - DNA, 21 bp, Homo sapiens
ggagaagttcttgattcagcc

SEQ ID NO: 1027318 - DNA, 18 bp, Homo sapiens
ggagaatactttgcttca

SEQ ID NO: 1027319 - DNA, 17 bp, Homo sapiens
ggagaatcatgtgaacc

SEQ ID NO: 1027320 - DNA, 20 bp, Homo sapiens
ggagaatcgcttgaacctgg

SEQ ID NO: 1027321 - DNA, 19 bp, Homo sapiens
ggagaatgagaagggaagg

SEQ ID NO: 1027322 - DNA, 22 bp, Homo sapiens
ggagaattgcacacagatgtga

SEQ ID NO: 1027323 - DNA, 22 bp, Homo sapiens
ggagaatttaggtttttattag

SEQ ID NO: 1027324 - DNA, 13 bp, Homo sapiens
ggagacaaagcag

SEQ ID NO: 1027325 - DNA, 16 bp, Homo sapiens
ggagacaaagcaggag

SEQ ID NO: 1027326 - DNA, 15 bp, Homo sapiens
ggagacaagaaatcc

SEQ ID NO: 1027327 - DNA, 18 bp, Homo sapiens
ggagacaagaaatccctg

SEQ ID NO: 1027328 - DNA, 14 bp, Homo sapiens
ggagacaattagca

SEQ ID NO: 1027329 - DNA, 18 bp, Homo sapiens
ggagacactgagtcagaa

SEQ ID NO: 1027330 - DNA, 20 bp, Homo sapiens
ggagacactggcccctcaaa

SEQ ID NO: 1027331 - DNA, 18 bp, Homo sapiens
ggagacagcttctctgca

SEQ ID NO: 1027332 - DNA, 18 bp, Homo sapiens
ggagacagggctgctccc

SEQ ID NO: 1027333 - DNA, 19 bp, Homo sapiens
ggagacagggtaggaaagg

SEQ ID NO: 1027334 - DNA, 17 bp, Homo sapiens
ggagacatggaccagca

SEQ ID NO: 1027335 - DNA, 19 bp, Homo sapiens
ggagacatgtgacatttat

SEQ ID NO: 1027336 - DNA, 19 bp, Homo sapiens
ggagaccaagtcctggcta

SEQ ID NO: 1027337 - DNA, 16 bp, Homo sapiens
ggagaccctgcaaaca

SEQ ID NO: 1027338 - DNA, 21 bp, Homo sapiens
ggagaccctgcaaacagaaca

SEQ ID NO: 1027339 - DNA, 16 bp, Homo sapiens
ggagaccctgccacag

SEQ ID NO: 1027340 - DNA, 17 bp, Homo sapiens
ggagaccctgccacagc

SEQ ID NO: 1027341 - DNA, 15 bp, Homo sapiens
ggagaccgcttcacc

SEQ ID NO: 1027342 - DNA, 15 bp, Homo sapiens
ggagacctcatgcca

SEQ ID NO: 1027343 - DNA, 13 bp, Homo sapiens
ggagacggccctg

SEQ ID NO: 1027344 - DNA, 19 bp, Homo sapiens
ggagacgtggaacctctgt

SEQ ID NO: 1027345 - DNA, 16 bp, Homo sapiens
ggagactaagccctgt

SEQ ID NO: 1027346 - DNA, 13 bp, Homo sapiens
ggagactcacctc

SEQ ID NO: 1027347 - DNA, 21 bp, Homo sapiens
ggagactccaaggagctactg

SEQ ID NO: 1027348 - DNA, 18 bp, Homo sapiens
ggagactccatgagaagc

SEQ ID NO: 1027349 - DNA, 17 bp, Homo sapiens
ggagactcctggtctgt

SEQ ID NO: 1027350 - DNA, 20 bp, Homo sapiens
ggagactctgtggggccttg

SEQ ID NO: 1027351 - DNA, 14 bp, Homo sapiens
ggagactgcttccc

SEQ ID NO: 1027352 - DNA, 19 bp, Homo sapiens
ggagactgcttcccatcct

SEQ ID NO: 1027353 - DNA, 13 bp, Homo sapiens
ggagactgggctg

SEQ ID NO: 1027354 - DNA, 17 bp, Homo sapiens
ggagactgggctgaggg

SEQ ID NO: 1027355 - DNA, 20 bp, Homo sapiens
ggagactggtcctgtgtgca

SEQ ID NO: 1027356 - DNA, 19 bp, Homo sapiens
ggagacttggggccagcgc

SEQ ID NO: 1027357 - DNA, 23 bp, Homo sapiens
ggagactttgctgttactgcttc

SEQ ID NO: 1027358 - DNA, 14 bp, Homo sapiens
ggagagaaaatata

SEQ ID NO: 1027359 - DNA, 15 bp, Homo sapiens
ggagagaaaatatat

SEQ ID NO: 1027360 - DNA, 15 bp, Homo sapiens
ggagagaagaaagtg

SEQ ID NO: 1027361 - DNA, 13 bp, Homo sapiens
ggagagacaggca

SEQ ID NO: 1027362 - DNA, 17 bp, Homo sapiens
tctttctctttcttcct

SEQ ID NO: 1027363 - DNA, 18 bp, Homo sapiens
tctttctgagcacacttt

SEQ ID NO: 1027364 - DNA, 12 bp, Homo sapiens
tctttctgcctt

SEQ ID NO: 1027365 - DNA, 12 bp, Homo sapiens
tctttctggact

SEQ ID NO: 1027366 - DNA, 13 bp, Homo sapiens
tctttctggactg

SEQ ID NO: 1027367 - DNA, 14 bp, Homo sapiens
tctttctggactgg

SEQ ID NO: 1027368 - DNA, 23 bp, Homo sapiens
tctttctggcctgccttcgttaa

SEQ ID NO: 1027369 - DNA, 23 bp, Homo sapiens
tctttctggggggatatttccta

SEQ ID NO: 1027370 - DNA, 17 bp, Homo sapiens
tctttctggtgttttat

SEQ ID NO: 1027371 - DNA, 14 bp, Homo sapiens
tctttctgtaaaca

SEQ ID NO: 1027372 - DNA, 20 bp, Homo sapiens
tctttcttcccgtgtgtatt

SEQ ID NO: 1027373 - DNA, 22 bp, Homo sapiens
tctttcttcccgtgtgtatttc

SEQ ID NO: 1027374 - DNA, 15 bp, Homo sapiens
tctttcttcctctgc

SEQ ID NO: 1027375 - DNA, 14 bp, Homo sapiens
tctttcttcctctt

SEQ ID NO: 1027376 - DNA, 14 bp, Homo sapiens
tctttcttcctttc

SEQ ID NO: 1027377 - DNA, 16 bp, Homo sapiens
tctttcttcctttcta

SEQ ID NO: 1027378 - DNA, 19 bp, Homo sapiens
tctttcttcttttttaagt

SEQ ID NO: 1027379 - DNA, 20 bp, Homo sapiens
tctttcttgctggctctgag

SEQ ID NO: 1027380 - DNA, 22 bp, Homo sapiens
tctttctttccaaaacatttct

SEQ ID NO: 1027381 - DNA, 14 bp, Homo sapiens
tctttctttcttaa

SEQ ID NO: 1027382 - DNA, 18 bp, Homo sapiens
tctttctttgcaccaaag

SEQ ID NO: 1027383 - DNA, 12 bp, Homo sapiens
tcttttgtttcc

SEQ ID NO: 1027384 - DNA, 14 bp, Homo sapiens
tctttttaaatttt

SEQ ID NO: 1027385 - DNA, 14 bp, Homo sapiens
tctttttacagcat

SEQ ID NO: 1027386 - DNA, 15 bp, Homo sapiens
tctttttacagcatt

SEQ ID NO: 1027387 - DNA, 20 bp, Homo sapiens
tctttttacagcattgtctt

SEQ ID NO: 1027388 - DNA, 13 bp, Homo sapiens
tctttttattgaa

SEQ ID NO: 1027389 - DNA, 16 bp, Homo sapiens
tctttttcattttgca

SEQ ID NO: 1027390 - DNA, 13 bp, Homo sapiens
tctttttcctact

SEQ ID NO: 1027391 - DNA, 17 bp, Homo sapiens
tctttttcctactccgt

SEQ ID NO: 1027392 - DNA, 13 bp, Homo sapiens
tctttttccttct

SEQ ID NO: 1027393 - DNA, 15 bp, Homo sapiens
tctttttctggactc

SEQ ID NO: 1027394 - DNA, 22 bp, Homo sapiens
tctttttgataagcacattaaa

SEQ ID NO: 1027395 - DNA, 14 bp, Homo sapiens
tctttttgcttcta

SEQ ID NO: 1027396 - DNA, 19 bp, Homo sapiens
tctttttggtaataacaaa

SEQ ID NO: 1027397 - DNA, 15 bp, Homo sapiens
tcttttttaaaatca

SEQ ID NO: 1027398 - DNA, 23 bp, Homo sapiens
tcttttttaaaggggtctgttct

SEQ ID NO: 1027399 - DNA, 20 bp, Homo sapiens
tcttttttaaagtaaacttg

SEQ ID NO: 1027400 - DNA, 15 bp, Homo sapiens
tcttttttagcataa

SEQ ID NO: 1027401 - DNA, 16 bp, Homo sapiens
tcttttttagcataaa

SEQ ID NO: 1027402 - DNA, 20 bp, Homo sapiens
tcttttttagcataaaattt

SEQ ID NO: 1027403 - DNA, 13 bp, Homo sapiens
tcttttttatgtg

SEQ ID NO: 1027404 - DNA, 16 bp, Homo sapiens
tcttttttcaaaagaa

SEQ ID NO: 1027405 - DNA, 17 bp, Homo sapiens
tcttttttcaaaagaaa

SEQ ID NO: 1027406 - DNA, 12 bp, Homo sapiens
tcttttttcagt

SEQ ID NO: 1027407 - DNA, 14 bp, Homo sapiens
tcttttttctatct

SEQ ID NO: 1027408 - DNA, 16 bp, Homo sapiens
tcttttttgctttctt

SEQ ID NO: 1027409 - DNA, 15 bp, Homo sapiens
tctttttttgtatag

SEQ ID NO: 1027410 - DNA, 17 bp, Homo sapiens
tctttttttgtatagtt

SEQ ID NO: 1027411 - DNA, 16 bp, Homo sapiens
tctttttttgtgatgt

SEQ ID NO: 1027412 - DNA, 15 bp, Homo sapiens
tctttttttttaagt

SEQ ID NO: 1027413 - DNA, 18 bp, Homo sapiens
tctttttttttaagttct

SEQ ID NO: 1027414 - DNA, 20 bp, Homo sapiens
tctttttttttaagttctta

SEQ ID NO: 1027415 - DNA, 22 bp, Homo sapiens
tctttttttttttttttgaaag

SEQ ID NO: 1027416 - DNA, 16 bp, Homo sapiens
tgaaaaaaaaaaacaa

SEQ ID NO: 1027417 - DNA, 22 bp, Homo sapiens
tgaaaaaaaaaaacaatatctg

SEQ ID NO: 1027418 - DNA, 18 bp, Homo sapiens
tgaaaaaaaaaatgctga

SEQ ID NO: 1027419 - DNA, 20 bp, Homo sapiens
tgaaaaaaaaaatgctgaac

SEQ ID NO: 1027420 - DNA, 22 bp, Homo sapiens
tgaaaaaaaaaatgctgaacat

SEQ ID NO: 1027421 - DNA, 17 bp, Homo sapiens
tgaaaaaaaaaatgttg

SEQ ID NO: 1027422 - DNA, 14 bp, Homo sapiens
tgaaaaaaaagttt

SEQ ID NO: 1027423 - DNA, 15 bp, Homo sapiens
tgaaaaaaacttcat

SEQ ID NO: 1027424 - DNA, 14 bp, Homo sapiens
tgaaaaaaagaaac

SEQ ID NO: 1027425 - DNA, 19 bp, Homo sapiens
tgaaaaaaagaaacgaaaa

SEQ ID NO: 1027426 - DNA, 17 bp, Homo sapiens
tgaaaaaaagtttacaa

SEQ ID NO: 1027427 - DNA, 14 bp, Homo sapiens
tgaaaaaagaaaat

SEQ ID NO: 1027428 - DNA, 12 bp, Homo sapiens
tgaaaaaatata

SEQ ID NO: 1027429 - DNA, 13 bp, Homo sapiens
tgaaaaaatatat

SEQ ID NO: 1027430 - DNA, 20 bp, Homo sapiens
tgaaaaaatttaaaagtaaa

SEQ ID NO: 1027431 - DNA, 11 bp, Homo sapiens
tgaaaaacaaa

SEQ ID NO: 1027432 - DNA, 16 bp, Homo sapiens
tgaaaaacaaaaagct

SEQ ID NO: 1027433 - DNA, 19 bp, Homo sapiens
tgaaaaacacggcagctgt

SEQ ID NO: 1027434 - DNA, 19 bp, Homo sapiens
tgaaaaacatcccaaactt

SEQ ID NO: 1027435 - DNA, 20 bp, Homo sapiens
tgaaaaacatcccaaacttt

SEQ ID NO: 1027436 - DNA, 14 bp, Homo sapiens
tgaaaaacattcca

SEQ ID NO: 1027437 - DNA, 22 bp, Homo sapiens
tgaaaaactatgtcagtatttt

SEQ ID NO: 1027438 - DNA, 12 bp, Homo sapiens
tgaaaaacttcc

SEQ ID NO: 1027439 - DNA, 12 bp, Homo sapiens
tgaaaaactttt

SEQ ID NO: 1027440 - DNA, 21 bp, Homo sapiens
tgaaaaagagaacagaaaaca

SEQ ID NO: 1027441 - DNA, 16 bp, Homo sapiens
tgaaaaaggaaatatt

SEQ ID NO: 1027442 - DNA, 15 bp, Homo sapiens
tgaaaaagtttgttt

SEQ ID NO: 1027443 - DNA, 11 bp, Homo sapiens
tgaaaaatata

SEQ ID NO: 1027444 - DNA, 15 bp, Homo sapiens
tgaaaaatatgtgct

SEQ ID NO: 1027445 - DNA, 20 bp, Homo sapiens
tgaaaaatatgtgcttgaaa

SEQ ID NO: 1027446 - DNA, 16 bp, Homo sapiens
tgaaaaatatgttgag

SEQ ID NO: 1027447 - DNA, 20 bp, Homo sapiens
tgaaaaatattgctaaaagt

SEQ ID NO: 1027448 - DNA, 15 bp, Homo sapiens
tgaaaaatgtaaata

SEQ ID NO: 1027449 - DNA, 11 bp, Homo sapiens
tgaaaaattaa

SEQ ID NO: 1027450 - DNA, 12 bp, Homo sapiens
tgaaaaattaac

SEQ ID NO: 1027451 - DNA, 21 bp, Homo sapiens
tgaaaacaaataaaagttgaa

SEQ ID NO: 1027452 - DNA, 12 bp, Homo sapiens
tgaaaacacatt

SEQ ID NO: 1027453 - DNA, 17 bp, Homo sapiens
tgaaaacacatttttct

SEQ ID NO: 1027454 - DNA, 21 bp, Homo sapiens
tgaaaacacatttttcttagg

SEQ ID NO: 1027455 - DNA, 19 bp, Homo sapiens
tgaaaacacttgatgatgt

SEQ ID NO: 1027456 - DNA, 18 bp, Homo sapiens
tgaaaacagaatcagtgt

SEQ ID NO: 1027457 - DNA, 21 bp, Homo sapiens
tgaaaacagaatcagtgttaa

SEQ ID NO: 1027458 - DNA, 23 bp, Homo sapiens
tgaaaacatggtagaattggaga

SEQ ID NO: 1027459 - DNA, 17 bp, Homo sapiens
tgaaaacatttcttaaa

SEQ ID NO: 1027460 - DNA, 23 bp, Homo sapiens
tgaaaaccaaattttaaaagcca

SEQ ID NO: 1027461 - DNA, 15 bp, Homo sapiens
tgaaaacctaccagc

SEQ ID NO: 1027462 - DNA, 16 bp, Homo sapiens
tgaaaactaaggattt

SEQ ID NO: 1027463 - DNA, 19 bp, Homo sapiens
tgaaaactaatgtactgta

SEQ ID NO: 1027464 - DNA, 17 bp, Homo sapiens
tgaaaactctttgctgc

SEQ ID NO: 1027465 - DNA, 19 bp, Homo sapiens
tgaaaactgtgcaactttt

SEQ ID NO: 1027466 - DNA, 23 bp, Homo sapiens
tgaaaactgtgcaactttttaaa

SEQ ID NO: 1027467 - DNA, 22 bp, Homo sapiens
tgaaaacttcaaagctgaatat

SEQ ID NO: 1027468 - DNA, 15 bp, Homo sapiens
tgaaaagaaaaatga

SEQ ID NO: 1027469 - DNA, 16 bp, Homo sapiens
tgaaaagaaggaaaga

SEQ ID NO: 1027470 - DNA, 16 bp, Homo sapiens
tgaaaagagaatgatg

SEQ ID NO: 1027471 - DNA, 21 bp, Homo sapiens
tgaaaagagaatgatgctcaa

SEQ ID NO: 1027472 - DNA, 14 bp, Homo sapiens
tgaaaagaggaaca

SEQ ID NO: 1027473 - DNA, 16 bp, Homo sapiens
tgaaaagattttattt

SEQ ID NO: 1027474 - DNA, 17 bp, Homo sapiens
tgaaaagattttattta

SEQ ID NO: 1027475 - DNA, 20 bp, Homo sapiens
tgaaaagcaatacaacttta

SEQ ID NO: 1027476 - DNA, 22 bp, Homo sapiens
tgaaaagcctctgttttgatat

SEQ ID NO: 1027477 - DNA, 16 bp, Homo sapiens
tgaaaagcttaataaa

SEQ ID NO: 1027478 - DNA, 16 bp, Homo sapiens
tgaaaaggtgaccttg

SEQ ID NO: 1027479 - DNA, 18 bp, Homo sapiens
tgaaaaggtgtccttttc

SEQ ID NO: 1027480 - DNA, 17 bp, Homo sapiens
tgaaaaggttgcctgaa

SEQ ID NO: 1027481 - DNA, 21 bp, Homo sapiens
tgaaaaggtttatgaaaaaga

SEQ ID NO: 1027482 - DNA, 14 bp, Homo sapiens
tgaaaagtcaaact

SEQ ID NO: 1027483 - DNA, 16 bp, Homo sapiens
tgaaaagttggaagga

SEQ ID NO: 1027484 - DNA, 23 bp, Homo sapiens
tgaaaagttggaaggatctgctg

SEQ ID NO: 1027485 - DNA, 21 bp, Homo sapiens
tgaaaataaaaagatcacttt

SEQ ID NO: 1027486 - DNA, 15 bp, Homo sapiens
tgaaaataaaacaca

SEQ ID NO: 1027487 - DNA, 16 bp, Homo sapiens
tgaaaataaaacacac

SEQ ID NO: 1027488 - DNA, 17 bp, Homo sapiens
tgaaaataatctctgat

SEQ ID NO: 1027489 - DNA, 16 bp, Homo sapiens
tgaaaataattttcca

SEQ ID NO: 1027490 - DNA, 19 bp, Homo sapiens
tgaaaataccataggaaga

SEQ ID NO: 1027491 - DNA, 20 bp, Homo sapiens
tgaaaataccataggaagac

SEQ ID NO: 1027492 - DNA, 23 bp, Homo sapiens
tgaaaatatagacattctcacat

SEQ ID NO: 1027493 - DNA, 18 bp, Homo sapiens
tgaaaatatctgctcaaa

SEQ ID NO: 1027494 - DNA, 16 bp, Homo sapiens
cttgcttggaagccag

SEQ ID NO: 1027495 - DNA, 20 bp, Homo sapiens
cttgctttaccttttcaggg

SEQ ID NO: 1027496 - DNA, 17 bp, Homo sapiens
cttgctttagaaaacat

SEQ ID NO: 1027497 - DNA, 15 bp, Homo sapiens
cttgctttcctgcat

SEQ ID NO: 1027498 - DNA, 17 bp, Homo sapiens
cttgctttcctgcatct

SEQ ID NO: 1027499 - DNA, 15 bp, Homo sapiens
cttgctttcctgggc

SEQ ID NO: 1027500 - DNA, 18 bp, Homo sapiens
cttgctttcttctttcct

SEQ ID NO: 1027501 - DNA, 17 bp, Homo sapiens
cttgctttctttagaat

SEQ ID NO: 1027502 - DNA, 13 bp, Homo sapiens
cttgctttgattt

SEQ ID NO: 1027503 - DNA, 20 bp, Homo sapiens
cttgctttgatttacagcaa

SEQ ID NO: 1027504 - DNA, 23 bp, Homo sapiens
cttgctttgggctttgcaggctc

SEQ ID NO: 1027505 - DNA, 20 bp, Homo sapiens
cttgctttgttttaataaac

SEQ ID NO: 1027506 - DNA, 18 bp, Homo sapiens
cttgcttttcttttttaa

SEQ ID NO: 1027507 - DNA, 19 bp, Homo sapiens
cttgcttttgcctctgccc

SEQ ID NO: 1027508 - DNA, 16 bp, Homo sapiens
cttgctttttgcccgt

SEQ ID NO: 1027509 - DNA, 22 bp, Homo sapiens
cttgcttttttgaaagatgctt

SEQ ID NO: 1027510 - DNA, 22 bp, Homo sapiens
cttggaaaaatccagaaagaaa

SEQ ID NO: 1027511 - DNA, 14 bp, Homo sapiens
cttggaaacctgcc

SEQ ID NO: 1027512 - DNA, 16 bp, Homo sapiens
cttggaaacctgccct

SEQ ID NO: 1027513 - DNA, 22 bp, Homo sapiens
cttggaaagcatcacctcaggc

SEQ ID NO: 1027514 - DNA, 24 bp, Homo sapiens
cttggaaagctgatgatgtctctt

SEQ ID NO: 1027515 - DNA, 14 bp, Homo sapiens
cttggaaataaacc

SEQ ID NO: 1027516 - DNA, 20 bp, Homo sapiens
cttggaaatagaaagaagcc

SEQ ID NO: 1027517 - DNA, 23 bp, Homo sapiens
cttggaaatagaaagaagccata

SEQ ID NO: 1027518 - DNA, 15 bp, Homo sapiens
cttggaaatcaggta

SEQ ID NO: 1027519 - DNA, 16 bp, Homo sapiens
cttggaaatgtctgct

SEQ ID NO: 1027520 - DNA, 16 bp, Homo sapiens
cttggaacattggaat

SEQ ID NO: 1027521 - DNA, 13 bp, Homo sapiens
cttggaactgcat

SEQ ID NO: 1027522 - DNA, 15 bp, Homo sapiens
cttggaagaggagga

SEQ ID NO: 1027523 - DNA, 15 bp, Homo sapiens
cttggaagctgtttg

SEQ ID NO: 1027524 - DNA, 21 bp, Homo sapiens
cttggacaacagctctcgttc

SEQ ID NO: 1027525 - DNA, 19 bp, Homo sapiens
cttggacatcctcctccca

SEQ ID NO: 1027526 - DNA, 15 bp, Homo sapiens
cttggacatctctct

SEQ ID NO: 1027527 - DNA, 16 bp, Homo sapiens
cttggacatctctctg

SEQ ID NO: 1027528 - DNA, 20 bp, Homo sapiens
cttggacatctctctggctt

SEQ ID NO: 1027529 - DNA, 22 bp, Homo sapiens
cttggacatctctctggcttct

SEQ ID NO: 1027530 - DNA, 14 bp, Homo sapiens
cttggaccactcct

SEQ ID NO: 1027531 - DNA, 20 bp, Homo sapiens
cttggaccactcctgtccct

SEQ ID NO: 1027532 - DNA, 22 bp, Homo sapiens
cttggaccactcctgtccctgt

SEQ ID NO: 1027533 - DNA, 20 bp, Homo sapiens
cttggaccagtttgcagagt

SEQ ID NO: 1027534 - DNA, 16 bp, Homo sapiens
cttggaccatgccaga

SEQ ID NO: 1027535 - DNA, 18 bp, Homo sapiens
cttggaccatgccagatt

SEQ ID NO: 1027536 - DNA, 16 bp, Homo sapiens
cttggaccctggtgac

SEQ ID NO: 1027537 - DNA, 15 bp, Homo sapiens
cttggacctccaggg

SEQ ID NO: 1027538 - DNA, 22 bp, Homo sapiens
cttggacctccaggggctcctg

SEQ ID NO: 1027539 - DNA, 23 bp, Homo sapiens
cttggacctccaggggctcctgg

SEQ ID NO: 1027540 - DNA, 14 bp, Homo sapiens
cttggactattata

SEQ ID NO: 1027541 - DNA, 15 bp, Homo sapiens
cttggactcttgctc

SEQ ID NO: 1027542 - DNA, 13 bp, Homo sapiens
cttggacttcctg

SEQ ID NO: 1027543 - DNA, 14 bp, Homo sapiens
cttggacttcctgg

SEQ ID NO: 1027544 - DNA, 17 bp, Homo sapiens
cttggacttcctggggc

SEQ ID NO: 1027545 - DNA, 19 bp, Homo sapiens
cttggacttcctggggccc

SEQ ID NO: 1027546 - DNA, 21 bp, Homo sapiens
cttggacttcctggggccccg

SEQ ID NO: 1027547 - DNA, 23 bp, Homo sapiens
cttggacttcctggggccccgct

SEQ ID NO: 1027548 - DNA, 23 bp, Homo sapiens
cttggagaatgtgagaagccagc

SEQ ID NO: 1027549 - DNA, 20 bp, Homo sapiens
cttggagagagaggctgcct

SEQ ID NO: 1027550 - DNA, 12 bp, Homo sapiens
gtgtggtggcct

SEQ ID NO: 1027551 - DNA, 23 bp, Homo sapiens
gtgtggtggcctcagctgaatgc

SEQ ID NO: 1027552 - DNA, 23 bp, Homo sapiens
gtgtggtggcgttatggcagccc

SEQ ID NO: 1027553 - DNA, 13 bp, Homo sapiens
gtgtggtggctca

SEQ ID NO: 1027554 - DNA, 16 bp, Homo sapiens
gtgtgtaattgttcct

SEQ ID NO: 1027555 - DNA, 17 bp, Homo sapiens
gtgtgtactctgtccag

SEQ ID NO: 1027556 - DNA, 20 bp, Homo sapiens
gtgtgtatgtgcgtgtgtgc

SEQ ID NO: 1027557 - DNA, 22 bp, Homo sapiens
gtgtgtatgtgtatgtgtgtga

SEQ ID NO: 1027558 - DNA, 20 bp, Homo sapiens
gtgtgtattaaaaaaaacaa

SEQ ID NO: 1027559 - DNA, 19 bp, Homo sapiens
gtgtgtattcagaggcagt

SEQ ID NO: 1027560 - DNA, 13 bp, Homo sapiens
gtgtgtatttcta

SEQ ID NO: 1027561 - DNA, 15 bp, Homo sapiens
gtgtgtatttgctaa

SEQ ID NO: 1027562 - DNA, 17 bp, Homo sapiens
gtgtgtcagagcccagg

SEQ ID NO: 1027563 - DNA, 14 bp, Homo sapiens
gtgtgtcaggccct

SEQ ID NO: 1027564 - DNA, 19 bp, Homo sapiens
gtgtgtcaggccctctgcc

SEQ ID NO: 1027565 - DNA, 22 bp, Homo sapiens
gtgtgtccaggctctgggcaca

SEQ ID NO: 1027566 - DNA, 17 bp, Homo sapiens
gtgtgtccccctctgtc

SEQ ID NO: 1027567 - DNA, 20 bp, Homo sapiens
gtgtgtcctctgtgcccacg

SEQ ID NO: 1027568 - DNA, 13 bp, Homo sapiens
gtgtgtctgtcct

SEQ ID NO: 1027569 - DNA, 13 bp, Homo sapiens
gtgtgtctgtctt

SEQ ID NO: 1027570 - DNA, 18 bp, Homo sapiens
gtgtgtctgtctttgtgg

SEQ ID NO: 1027571 - DNA, 14 bp, Homo sapiens
gtgtgtgaaaggaa

SEQ ID NO: 1027572 - DNA, 22 bp, Homo sapiens
gtgtgtgagtgtgagtgtgaga

SEQ ID NO: 1027573 - DNA, 21 bp, Homo sapiens
gtgtgtgcagagtccatttcc

SEQ ID NO: 1027574 - DNA, 13 bp, Homo sapiens
gtgtgtgcatgtg

SEQ ID NO: 1027575 - DNA, 13 bp, Homo sapiens
gtgtgtgccctgg

SEQ ID NO: 1027576 - DNA, 19 bp, Homo sapiens
gtgtgtgccctgggccagg

SEQ ID NO: 1027577 - DNA, 22 bp, Homo sapiens
gtgtgtgccctgggccaggcag

SEQ ID NO: 1027578 - DNA, 19 bp, Homo sapiens
gtgtgtgccttgggtctca

SEQ ID NO: 1027579 - DNA, 14 bp, Homo sapiens
gtgtgtggcagggg

SEQ ID NO: 1027580 - DNA, 17 bp, Homo sapiens
gtgtgtggcgtggcccg

SEQ ID NO: 1027581 - DNA, 14 bp, Homo sapiens
gtgtgtgggcaggg

SEQ ID NO: 1027582 - DNA, 14 bp, Homo sapiens
gtgtgtgggggaga

SEQ ID NO: 1027583 - DNA, 16 bp, Homo sapiens
gtgtgtgggtgaaatg

SEQ ID NO: 1027584 - DNA, 14 bp, Homo sapiens
gtgtgtgggtgggg

SEQ ID NO: 1027585 - DNA, 14 bp, Homo sapiens
gtgtgtgggtgtgt

SEQ ID NO: 1027586 - DNA, 21 bp, Homo sapiens
gtgtgtggtgaggggctttct

SEQ ID NO: 1027587 - DNA, 13 bp, Homo sapiens
gtgtgtggtgcac

SEQ ID NO: 1027588 - DNA, 15 bp, Homo sapiens
gtgtgtgtctgcttt

SEQ ID NO: 1027589 - DNA, 11 bp, Homo sapiens
gtgtgtgtgca

SEQ ID NO: 1027590 - DNA, 12 bp, Homo sapiens
gtgtgtgtgcac

SEQ ID NO: 1027591 - DNA, 14 bp, Homo sapiens
gtgtgtgtgcatgt

SEQ ID NO: 1027592 - DNA, 15 bp, Homo sapiens
gtgtgtgtgtcagct

SEQ ID NO: 1027593 - DNA, 13 bp, Homo sapiens
gtgtgtgtgtggc

SEQ ID NO: 1027594 - DNA, 16 bp, Homo sapiens
gtgtgtgtgtgtatgt

SEQ ID NO: 1027595 - DNA, 13 bp, Homo sapiens
gtgtgtgtgtgtg

SEQ ID NO: 1027596 - DNA, 20 bp, Homo sapiens
gtgtgttatattccaaggaa

SEQ ID NO: 1027597 - DNA, 19 bp, Homo sapiens
gtgtgttcttttgagtcct

SEQ ID NO: 1027598 - DNA, 13 bp, Homo sapiens
gtgtgttggacag

SEQ ID NO: 1027599 - DNA, 14 bp, Homo sapiens
gtgtgttgtctctt

SEQ ID NO: 1027600 - DNA, 13 bp, Homo sapiens
gtgtgttgtgtga

SEQ ID NO: 1027601 - DNA, 15 bp, Homo sapiens
gtgtgtttaaataaa

SEQ ID NO: 1027602 - DNA, 18 bp, Homo sapiens
gtgtgtttaaataaagta

SEQ ID NO: 1027603 - DNA, 19 bp, Homo sapiens
gtgtgtttaaataaagtat

SEQ ID NO: 1027604 - DNA, 21 bp, Homo sapiens
gtgtgtttaggcctcatttct

SEQ ID NO: 1027605 - DNA, 22 bp, Homo sapiens
gtgtgtttccagatcgatcctg

SEQ ID NO: 1027606 - DNA, 15 bp, Homo sapiens
gtgtgtttctgtcct

SEQ ID NO: 1027607 - DNA, 14 bp, Homo sapiens
gtgtgtttgtgatt

SEQ ID NO: 1027608 - DNA, 10 bp, Homo sapiens
gtgtgtttta

SEQ ID NO: 1027609 - DNA, 18 bp, Homo sapiens
gtgtgttttcataataaa

SEQ ID NO: 1027610 - DNA, 20 bp, Homo sapiens
gtgtgttttgagagtatatt

SEQ ID NO: 1027611 - DNA, 14 bp, Homo sapiens
gtgtgttttgtaca

SEQ ID NO: 1027612 - DNA, 15 bp, Homo sapiens
gtgttaaagctgtac

SEQ ID NO: 1027613 - DNA, 18 bp, Homo sapiens
gtgttaaagctgtacacc

SEQ ID NO: 1027614 - DNA, 19 bp, Homo sapiens
gtgttaaaggttttctcta

SEQ ID NO: 1027615 - DNA, 14 bp, Homo sapiens
gtgttaagattgca

SEQ ID NO: 1027616 - DNA, 12 bp, Homo sapiens
gtgttaattttt

SEQ ID NO: 1027617 - DNA, 21 bp, Homo sapiens
gtgttacacagcccaagagga

SEQ ID NO: 1027618 - DNA, 20 bp, Homo sapiens
gtgttactaaaaaaaagatg

SEQ ID NO: 1027619 - DNA, 21 bp, Homo sapiens
gtgttactaaaaaaaagatga

SEQ ID NO: 1027620 - DNA, 14 bp, Homo sapiens
gtgttactttttgt

SEQ ID NO: 1027621 - DNA, 11 bp, Homo sapiens
cttggccttgt

SEQ ID NO: 1027622 - DNA, 23 bp, Homo sapiens
cttggcgctctcagctttccctg

SEQ ID NO: 1027623 - DNA, 15 bp, Homo sapiens
cttggcggcagcagc

SEQ ID NO: 1027624 - DNA, 14 bp, Homo sapiens
cttggcgtggagcc

SEQ ID NO: 1027625 - DNA, 21 bp, Homo sapiens
cttggctatgaaaatgagccc

SEQ ID NO: 1027626 - DNA, 20 bp, Homo sapiens
cttggctcccgggggcccca

SEQ ID NO: 1027627 - DNA, 20 bp, Homo sapiens
cttggctcttggcttccaga

SEQ ID NO: 1027628 - DNA, 16 bp, Homo sapiens
cttggctgacccctct

SEQ ID NO: 1027629 - DNA, 14 bp, Homo sapiens
cttggctgactggg

SEQ ID NO: 1027630 - DNA, 16 bp, Homo sapiens
cttggctgactggggc

SEQ ID NO: 1027631 - DNA, 12 bp, Homo sapiens
cttggctgctca

SEQ ID NO: 1027632 - DNA, 20 bp, Homo sapiens
cttggctgctcactgtccac

SEQ ID NO: 1027633 - DNA, 16 bp, Homo sapiens
cttggctgcttcctgt

SEQ ID NO: 1027634 - DNA, 22 bp, Homo sapiens
cttggctggactgtagaaggtg

SEQ ID NO: 1027635 - DNA, 17 bp, Homo sapiens
cttggctgtaatcagtt

SEQ ID NO: 1027636 - DNA, 13 bp, Homo sapiens
cttggctgtcctt

SEQ ID NO: 1027637 - DNA, 12 bp, Homo sapiens
cttggctgtgag

SEQ ID NO: 1027638 - DNA, 21 bp, Homo sapiens
cttggctgtgaggcccctgga

SEQ ID NO: 1027639 - DNA, 14 bp, Homo sapiens
cttggcttaatcat

SEQ ID NO: 1027640 - DNA, 18 bp, Homo sapiens
cttggcttacctgacctc

SEQ ID NO: 1027641 - DNA, 18 bp, Homo sapiens
cttggcttcctttcttgg

SEQ ID NO: 1027642 - DNA, 18 bp, Homo sapiens
cttggcttctgggacctg

SEQ ID NO: 1027643 - DNA, 17 bp, Homo sapiens
cttggcttctgtgatga

SEQ ID NO: 1027644 - DNA, 21 bp, Homo sapiens
cttggcttctgtgatgagctg

SEQ ID NO: 1027645 - DNA, 15 bp, Homo sapiens
cttggcttcttaaaa

SEQ ID NO: 1027646 - DNA, 18 bp, Homo sapiens
cttggcttcttaaaaact

SEQ ID NO: 1027647 - DNA, 19 bp, Homo sapiens
cttggcttcttaaaaactg

SEQ ID NO: 1027648 - DNA, 15 bp, Homo sapiens
cttgggaaagagaca

SEQ ID NO: 1027649 - DNA, 11 bp, Homo sapiens
cttgggacagc

SEQ ID NO: 1027650 - DNA, 19 bp, Homo sapiens
cttgggacatggcacaggc

SEQ ID NO: 1027651 - DNA, 18 bp, Homo sapiens
cttgggaccaaaggggga

SEQ ID NO: 1027652 - DNA, 18 bp, Homo sapiens
cttgggaccagaagtgtt

SEQ ID NO: 1027653 - DNA, 20 bp, Homo sapiens
cttgggacccccactaagac

SEQ ID NO: 1027654 - DNA, 22 bp, Homo sapiens
cttgggacgtgtacagcacaga

SEQ ID NO: 1027655 - DNA, 14 bp, Homo sapiens
cttgggactcaggt

SEQ ID NO: 1027656 - DNA, 20 bp, Homo sapiens
cttgggactcaggtctgtaa

SEQ ID NO: 1027657 - DNA, 15 bp, Homo sapiens
cttgggactgggttt

SEQ ID NO: 1027658 - DNA, 15 bp, Homo sapiens
cttgggagcctgagg

SEQ ID NO: 1027659 - DNA, 19 bp, Homo sapiens
cttgggagcctgaggcagg

SEQ ID NO: 1027660 - DNA, 20 bp, Homo sapiens
cttgggagcctgaggcagga

SEQ ID NO: 1027661 - DNA, 14 bp, Homo sapiens
cttgggagctgctg

SEQ ID NO: 1027662 - DNA, 15 bp, Homo sapiens
cttgggagctgctgg

SEQ ID NO: 1027663 - DNA, 21 bp, Homo sapiens
cttgggaggacatgcgtgtgt

SEQ ID NO: 1027664 - DNA, 14 bp, Homo sapiens
cttgggaggctgag

SEQ ID NO: 1027665 - DNA, 22 bp, Homo sapiens
cttgggaggttttattctgact

SEQ ID NO: 1027666 - DNA, 17 bp, Homo sapiens
cttgggatagtgttctg

SEQ ID NO: 1027667 - DNA, 19 bp, Homo sapiens
cttgggatagtgttctgct

SEQ ID NO: 1027668 - DNA, 21 bp, Homo sapiens
cttgggatagtgttctgctcc

SEQ ID NO: 1027669 - DNA, 17 bp, Homo sapiens
cttgggatttgctgtgt

SEQ ID NO: 1027670 - DNA, 24 bp, Homo sapiens
cttgggcatccacccagtgctgcc

SEQ ID NO: 1027671 - DNA, 13 bp, Homo sapiens
cttgggcatttat

SEQ ID NO: 1027672 - DNA, 21 bp, Homo sapiens
cttgggccacgctcttgagga

SEQ ID NO: 1027673 - DNA, 14 bp, Homo sapiens
gtgttgccaagctc

SEQ ID NO: 1027674 - DNA, 18 bp, Homo sapiens
gtgttgccaagctccaag

SEQ ID NO: 1027675 - DNA, 19 bp, Homo sapiens
gtgttgccatttctctgct

SEQ ID NO: 1027676 - DNA, 12 bp, Homo sapiens
gtgttggaaaaa

SEQ ID NO: 1027677 - DNA, 15 bp, Homo sapiens
gtgttggctgtgtga

SEQ ID NO: 1027678 - DNA, 14 bp, Homo sapiens
gtgttgggagggat

SEQ ID NO: 1027679 - DNA, 18 bp, Homo sapiens
gtgttggtctttctaatg

SEQ ID NO: 1027680 - DNA, 20 bp, Homo sapiens
gtgttggtctttctaatgta

SEQ ID NO: 1027681 - DNA, 15 bp, Homo sapiens
gtgttgtcagcaggc

SEQ ID NO: 1027682 - DNA, 17 bp, Homo sapiens
gtgttgtcattgtaaac

SEQ ID NO: 1027683 - DNA, 14 bp, Homo sapiens
gtgttgtcccttct

SEQ ID NO: 1027684 - DNA, 12 bp, Homo sapiens
gtgttgtctcta

SEQ ID NO: 1027685 - DNA, 14 bp, Homo sapiens
gtgttgtgtccatt

SEQ ID NO: 1027686 - DNA, 13 bp, Homo sapiens
gtgttgtgtgagc

SEQ ID NO: 1027687 - DNA, 13 bp, Homo sapiens
gtgttgtgttcct

SEQ ID NO: 1027688 - DNA, 19 bp, Homo sapiens
gtgttgttttttgttcaat

SEQ ID NO: 1027689 - DNA, 22 bp, Homo sapiens
gtgtttaaaaattgaaaaaagt

SEQ ID NO: 1027690 - DNA, 12 bp, Homo sapiens
gtgtttaaaact

SEQ ID NO: 1027691 - DNA, 17 bp, Homo sapiens
gtgtttaaataaagacc

SEQ ID NO: 1027692 - DNA, 15 bp, Homo sapiens
gtgtttaacattcac

SEQ ID NO: 1027693 - DNA, 14 bp, Homo sapiens
gtgtttaactggca

SEQ ID NO: 1027694 - DNA, 22 bp, Homo sapiens
gtgtttacacaaccaaatttga

SEQ ID NO: 1027695 - DNA, 17 bp, Homo sapiens
gtgtttatcctttcata

SEQ ID NO: 1027696 - DNA, 16 bp, Homo sapiens
gtgtttatgtgctatt

SEQ ID NO: 1027697 - DNA, 20 bp, Homo sapiens
gtgtttattacaagtggctc

SEQ ID NO: 1027698 - DNA, 16 bp, Homo sapiens
gtgtttatttttcata

SEQ ID NO: 1027699 - DNA, 14 bp, Homo sapiens
gtgtttccatctca

SEQ ID NO: 1027700 - DNA, 12 bp, Homo sapiens
gtgtttcccata

SEQ ID NO: 1027701 - DNA, 15 bp, Homo sapiens
gtgtttcccataatt

SEQ ID NO: 1027702 - DNA, 18 bp, Homo sapiens
gtgtttcccttcctcggt

SEQ ID NO: 1027703 - DNA, 13 bp, Homo sapiens
gtgtttctatctc

SEQ ID NO: 1027704 - DNA, 12 bp, Homo sapiens
gtgtttctgtaa

SEQ ID NO: 1027705 - DNA, 17 bp, Homo sapiens
gtgtttctgtaacaaat

SEQ ID NO: 1027706 - DNA, 19 bp, Homo sapiens
gtgtttctgtaacaaattg

SEQ ID NO: 1027707 - DNA, 21 bp, Homo sapiens
gtgtttctgtaacaaattggg

SEQ ID NO: 1027708 - DNA, 12 bp, Homo sapiens
gtgtttctgtat

SEQ ID NO: 1027709 - DNA, 13 bp, Homo sapiens
gtgtttgaagttt

SEQ ID NO: 1027710 - DNA, 16 bp, Homo sapiens
gtgtttgacatgtgaa

SEQ ID NO: 1027711 - DNA, 24 bp, Homo sapiens
gtgtttgacatgtgaagctatttg

SEQ ID NO: 1027712 - DNA, 21 bp, Homo sapiens
gtgtttgactttcaaaatata

SEQ ID NO: 1027713 - DNA, 13 bp, Homo sapiens
gtgtttgattcca

SEQ ID NO: 1027714 - DNA, 9 bp, Homo sapiens
gtgtttgct

SEQ ID NO: 1027715 - DNA, 15 bp, Homo sapiens
gtgtttgcttaaaat

SEQ ID NO: 1027716 - DNA, 22 bp, Homo sapiens
gtgtttggatacatctgctgtg

SEQ ID NO: 1027717 - DNA, 22 bp, Homo sapiens
gtgtttgggaagcaacaaagag

SEQ ID NO: 1027718 - DNA, 14 bp, Homo sapiens
gtgtttgtcctggg

SEQ ID NO: 1027719 - DNA, 14 bp, Homo sapiens
gtgtttgtgtgtgt

SEQ ID NO: 1027720 - DNA, 22 bp, Homo sapiens
gtgttttaattccaatatgatg

SEQ ID NO: 1027721 - DNA, 16 bp, Homo sapiens
gtgttttaattgtaaa

SEQ ID NO: 1027722 - DNA, 16 bp, Homo sapiens
gtgttttatttcctat

SEQ ID NO: 1027723 - DNA, 13 bp, Homo sapiens
gtgttttcataat

SEQ ID NO: 1027724 - DNA, 14 bp, Homo sapiens
gtgttttcataata

SEQ ID NO: 1027725 - DNA, 13 bp, Homo sapiens
gtgttttcatcat

SEQ ID NO: 1027726 - DNA, 20 bp, Homo sapiens
gtgttttcatcatttcagcc

SEQ ID NO: 1027727 - DNA, 19 bp, Homo sapiens
gtgttttctgtagactcta

SEQ ID NO: 1027728 - DNA, 23 bp, Homo sapiens
gtgttttctgtagactctaagat

SEQ ID NO: 1027729 - DNA, 19 bp, Homo sapiens
gtgttttcttgtaaatgtt

SEQ ID NO: 1027730 - DNA, 20 bp, Homo sapiens
gtgttttcttgtaaatgttt

SEQ ID NO: 1027731 - DNA, 20 bp, Homo sapiens
gtgttttgaaagaatagaac

SEQ ID NO: 1027732 - DNA, 17 bp, Homo sapiens
gtgtttttagctgtgac

SEQ ID NO: 1027733 - DNA, 15 bp, Homo sapiens
gtgtttttcatttct

SEQ ID NO: 1027734 - DNA, 14 bp, Homo sapiens
gtgtttttctatat

SEQ ID NO: 1027735 - DNA, 13 bp, Homo sapiens
gtgttttttaaaa

SEQ ID NO: 1027736 - DNA, 17 bp, Homo sapiens
gtgttttttaaaaaagc

SEQ ID NO: 1027737 - DNA, 17 bp, Homo sapiens
gtgtttttttatttcta

SEQ ID NO: 1027738 - DNA, 19 bp, Homo sapiens
gtgtttttttatttctact

SEQ ID NO: 1027739 - DNA, 18 bp, Homo sapiens
gtgtttttttctaaaaag

SEQ ID NO: 1027740 - DNA, 13 bp, Homo sapiens
gttaaaaaaaaaa

SEQ ID NO: 1027741 - DNA, 14 bp, Homo sapiens
gttaaaaaagcgag

SEQ ID NO: 1027742 - DNA, 12 bp, Homo sapiens
gttaaaaaggcc

SEQ ID NO: 1027743 - DNA, 14 bp, Homo sapiens
gttaaaaaggccaa

SEQ ID NO: 1027744 - DNA, 20 bp, Homo sapiens
gttaaaaatggctcaagtag

SEQ ID NO: 1027745 - DNA, 14 bp, Homo sapiens
gttaaaacacatat

SEQ ID NO: 1027746 - DNA, 18 bp, Homo sapiens
gttaaaactgtacattta

SEQ ID NO: 1027747 - DNA, 19 bp, Homo sapiens
gttaaaactgtacatttaa

SEQ ID NO: 1027748 - DNA, 22 bp, Homo sapiens
gttaaaactgtacatttaaaat

SEQ ID NO: 1027749 - DNA, 14 bp, Homo sapiens
cttggtcaccagct

SEQ ID NO: 1027750 - DNA, 16 bp, Homo sapiens
cttggtcaccagctcc

SEQ ID NO: 1027751 - DNA, 20 bp, Homo sapiens
cttggtcattttttttatat

SEQ ID NO: 1027752 - DNA, 17 bp, Homo sapiens
cttggtcccatggctga

SEQ ID NO: 1027753 - DNA, 17 bp, Homo sapiens
cttggtccctggtccct

SEQ ID NO: 1027754 - DNA, 18 bp, Homo sapiens
cttggtctttctgtgctt

SEQ ID NO: 1027755 - DNA, 20 bp, Homo sapiens
cttggtgaaataataaaatg

SEQ ID NO: 1027756 - DNA, 23 bp, Homo sapiens
cttggtgaaataataaaatgcaa

SEQ ID NO: 1027757 - DNA, 21 bp, Homo sapiens
cttggtgacaaaattcatttg

SEQ ID NO: 1027758 - DNA, 16 bp, Homo sapiens
cttggtgactgtccca

SEQ ID NO: 1027759 - DNA, 14 bp, Homo sapiens
cttggtgagtcttg

SEQ ID NO: 1027760 - DNA, 21 bp, Homo sapiens
cttggtgcacagattgctgaa

SEQ ID NO: 1027761 - DNA, 23 bp, Homo sapiens
cttggtgcacagattgctgaaac

SEQ ID NO: 1027762 - DNA, 17 bp, Homo sapiens
cttggtgccttttgtgt

SEQ ID NO: 1027763 - DNA, 21 bp, Homo sapiens
cttggtgcggggttaacacct

SEQ ID NO: 1027764 - DNA, 18 bp, Homo sapiens
cttggtgcttattgatat

SEQ ID NO: 1027765 - DNA, 21 bp, Homo sapiens
cttggtggggctcgtggcctt

SEQ ID NO: 1027766 - DNA, 12 bp, Homo sapiens
cttggtgtaatt

SEQ ID NO: 1027767 - DNA, 13 bp, Homo sapiens
cttggtgtaattt

SEQ ID NO: 1027768 - DNA, 16 bp, Homo sapiens
cttggtgtaatttgaa

SEQ ID NO: 1027769 - DNA, 18 bp, Homo sapiens
cttggtgtaatttgaaga

SEQ ID NO: 1027770 - DNA, 19 bp, Homo sapiens
cttggtgtccacctggccc

SEQ ID NO: 1027771 - DNA, 13 bp, Homo sapiens
cttggttatattt

SEQ ID NO: 1027772 - DNA, 17 bp, Homo sapiens
cttggttcatcagtgtt

SEQ ID NO: 1027773 - DNA, 12 bp, Homo sapiens
cttggttcctgg

SEQ ID NO: 1027774 - DNA, 12 bp, Homo sapiens
cttggttctaaa

SEQ ID NO: 1027775 - DNA, 16 bp, Homo sapiens
cttggttctgtgaaca

SEQ ID NO: 1027776 - DNA, 15 bp, Homo sapiens
cttggttcttttttc

SEQ ID NO: 1027777 - DNA, 14 bp, Homo sapiens
cttggttgaggaaa

SEQ ID NO: 1027778 - DNA, 16 bp, Homo sapiens
cttggttgaggaaaca

SEQ ID NO: 1027779 - DNA, 20 bp, Homo sapiens
cttggttgggtcaaggacag

SEQ ID NO: 1027780 - DNA, 17 bp, Homo sapiens
cttggttgttaatttag

SEQ ID NO: 1027781 - DNA, 12 bp, Homo sapiens
cttggtttctgg

SEQ ID NO: 1027782 - DNA, 14 bp, Homo sapiens
cttggtttgtaaat

SEQ ID NO: 1027783 - DNA, 22 bp, Homo sapiens
cttggtttgtggcgtctccctc

SEQ ID NO: 1027784 - DNA, 13 bp, Homo sapiens
cttggttttctct

SEQ ID NO: 1027785 - DNA, 14 bp, Homo sapiens
cttggttttctctc

SEQ ID NO: 1027786 - DNA, 17 bp, Homo sapiens
cttggttttctctctgg

SEQ ID NO: 1027787 - DNA, 21 bp, Homo sapiens
cttggttttgctacataatta

SEQ ID NO: 1027788 - DNA, 20 bp, Homo sapiens
cttggtttttactgctctga

SEQ ID NO: 1027789 - DNA, 21 bp, Homo sapiens
cttggtttttactgctctgag

SEQ ID NO: 1027790 - DNA, 23 bp, Homo sapiens
cttggtttttactgctctgagaa

SEQ ID NO: 1027791 - DNA, 11 bp, Homo sapiens
cttgtaaaaaa

SEQ ID NO: 1027792 - DNA, 18 bp, Homo sapiens
cttgtaaaaattaaaagt

SEQ ID NO: 1027793 - DNA, 16 bp, Homo sapiens
cttgtaaaatgctttt

SEQ ID NO: 1027794 - DNA, 12 bp, Homo sapiens
cttgtaaagact

SEQ ID NO: 1027795 - DNA, 13 bp, Homo sapiens
cttgtaaatacac

SEQ ID NO: 1027796 - DNA, 23 bp, Homo sapiens
cttgtgggagcacagtcagtgac

SEQ ID NO: 1027797 - DNA, 20 bp, Homo sapiens
cttgtgggcaaaggcagggc

SEQ ID NO: 1027798 - DNA, 12 bp, Homo sapiens
cttgtgggctgg

SEQ ID NO: 1027799 - DNA, 20 bp, Homo sapiens
cttgtggggacccaggctcc

SEQ ID NO: 1027800 - DNA, 21 bp, Homo sapiens
cttgtggggacccaggctccg

SEQ ID NO: 1027801 - DNA, 14 bp, Homo sapiens
cttgtggggccagg

SEQ ID NO: 1027802 - DNA, 15 bp, Homo sapiens
cttgtggggccagga

SEQ ID NO: 1027803 - DNA, 14 bp, Homo sapiens
cttgtgggtccatg

SEQ ID NO: 1027804 - DNA, 15 bp, Homo sapiens
cttgtggtacctagt

SEQ ID NO: 1027805 - DNA, 14 bp, Homo sapiens
cttgtggtgtgacc

SEQ ID NO: 1027806 - DNA, 16 bp, Homo sapiens
cttgtggtgtgaccat

SEQ ID NO: 1027807 - DNA, 21 bp, Homo sapiens
cttgtggtgtgaccatgttca

SEQ ID NO: 1027808 - DNA, 23 bp, Homo sapiens
cttgtggtgtgaccatgttcatt

SEQ ID NO: 1027809 - DNA, 24 bp, Homo sapiens
cttgtggtgtgaccatgttcatta

SEQ ID NO: 1027810 - DNA, 23 bp, Homo sapiens
cttgtggttataacttaatgaaa

SEQ ID NO: 1027811 - DNA, 12 bp, Homo sapiens
cttgtgtcctga

SEQ ID NO: 1027812 - DNA, 21 bp, Homo sapiens
cttgtgtcctgtcctttcttg

SEQ ID NO: 1027813 - DNA, 13 bp, Homo sapiens
cttgtgtctgcgt

SEQ ID NO: 1027814 - DNA, 22 bp, Homo sapiens
cttgtgtctttggaggtgctgc

SEQ ID NO: 1027815 - DNA, 21 bp, Homo sapiens
cttgtgtgtcaggccctctgc

SEQ ID NO: 1027816 - DNA, 23 bp, Homo sapiens
cttgtgtgtcaggccctctgcct

SEQ ID NO: 1027817 - DNA, 17 bp, Homo sapiens
cttgtgtgtgccctggg

SEQ ID NO: 1027818 - DNA, 17 bp, Homo sapiens
cttgtgttacttgccaa

SEQ ID NO: 1027819 - DNA, 21 bp, Homo sapiens
cttgtgttcagctctttccaa

SEQ ID NO: 1027820 - DNA, 23 bp, Homo sapiens
cttgtgttcagctctttccaaat

SEQ ID NO: 1027821 - DNA, 13 bp, Homo sapiens
cttgtgtttgctt

SEQ ID NO: 1027822 - DNA, 15 bp, Homo sapiens
cttgtgttttgtcct

SEQ ID NO: 1027823 - DNA, 16 bp, Homo sapiens
cttgttaagatagtta

SEQ ID NO: 1027824 - DNA, 18 bp, Homo sapiens
cttgttaatgctttctga

SEQ ID NO: 1027825 - DNA, 13 bp, Homo sapiens
cttgttaatgtca

SEQ ID NO: 1027826 - DNA, 14 bp, Homo sapiens
cttgttaatgtcat

SEQ ID NO: 1027827 - DNA, 20 bp, Homo sapiens
cttgttaattgatttgggga

SEQ ID NO: 1027828 - DNA, 14 bp, Homo sapiens
cttgttactgctga

SEQ ID NO: 1027829 - DNA, 19 bp, Homo sapiens
cttgttactgctgattctt

SEQ ID NO: 1027830 - DNA, 13 bp, Homo sapiens
cttgttactgtga

SEQ ID NO: 1027831 - DNA, 17 bp, Homo sapiens
cttgttagcccttcaga

SEQ ID NO: 1027832 - DNA, 18 bp, Homo sapiens
cttgttatggtagaaaaa

SEQ ID NO: 1027833 - DNA, 15 bp, Homo sapiens
cttgttatgtacaaa

SEQ ID NO: 1027834 - DNA, 23 bp, Homo sapiens
cttgttatgtacaaactagtttt

SEQ ID NO: 1027835 - DNA, 15 bp, Homo sapiens
cttgttattaatgtt

SEQ ID NO: 1027836 - DNA, 22 bp, Homo sapiens
cttgttattaatgtttcttctc

SEQ ID NO: 1027837 - DNA, 15 bp, Homo sapiens
cttgttattgtgaat

SEQ ID NO: 1027838 - DNA, 18 bp, Homo sapiens
cttgttattgtgaatgat

SEQ ID NO: 1027839 - DNA, 13 bp, Homo sapiens
cttgttatttata

SEQ ID NO: 1027840 - DNA, 14 bp, Homo sapiens
cttgttcaggaaaa

SEQ ID NO: 1027841 - DNA, 19 bp, Homo sapiens
cttgttcaggaaaaggttg

SEQ ID NO: 1027842 - DNA, 12 bp, Homo sapiens
cttgttcattta

SEQ ID NO: 1027843 - DNA, 16 bp, Homo sapiens
cttgttcattttgagt

SEQ ID NO: 1027844 - DNA, 21 bp, Homo sapiens
cttgttccccactgacagcct

SEQ ID NO: 1027845 - DNA, 14 bp, Homo sapiens
cttgttcctgctct

SEQ ID NO: 1027846 - DNA, 12 bp, Homo sapiens
cttgttctctgc

SEQ ID NO: 1027847 - DNA, 17 bp, Homo sapiens
cttgttcttgcagcatt

SEQ ID NO: 1027848 - DNA, 20 bp, Homo sapiens
cttgttcttggttcctgttt

SEQ ID NO: 1027849 - DNA, 15 bp, Homo sapiens
cttgttgcactgccc

SEQ ID NO: 1027850 - DNA, 16 bp, Homo sapiens
cttgttgcactgcccc

SEQ ID NO: 1027851 - DNA, 22 bp, Homo sapiens
cttgttgcagagatttcctcca

SEQ ID NO: 1027852 - DNA, 18 bp, Homo sapiens
cttgttggagcctgcagg

SEQ ID NO: 1027853 - DNA, 19 bp, Homo sapiens
cttgttggagcctgcaggg

SEQ ID NO: 1027854 - DNA, 21 bp, Homo sapiens
cttgttggatttttgtcttgt

SEQ ID NO: 1027855 - DNA, 23 bp, Homo sapiens
cttgttggatttttgtcttgtgt

SEQ ID NO: 1027856 - DNA, 21 bp, Homo sapiens
cttgttgtcccaatgaaatac

SEQ ID NO: 1027857 - DNA, 19 bp, Homo sapiens
cttgttgttttactaaaga

SEQ ID NO: 1027858 - DNA, 15 bp, Homo sapiens
cttgttgtttttaag

SEQ ID NO: 1027859 - DNA, 18 bp, Homo sapiens
cttgttgtttttaagtcc

SEQ ID NO: 1027860 - DNA, 19 bp, Homo sapiens
cttgtttacagcactactc

SEQ ID NO: 1027861 - DNA, 19 bp, Homo sapiens
cttgtttacgatttcacta

SEQ ID NO: 1027862 - DNA, 21 bp, Homo sapiens
cttgtttatcagatacatcac

SEQ ID NO: 1027863 - DNA, 13 bp, Homo sapiens
cttgtttatgata

SEQ ID NO: 1027864 - DNA, 19 bp, Homo sapiens
cttgtttatgatatttctt

SEQ ID NO: 1027865 - DNA, 23 bp, Homo sapiens
cttgtttatgatatttcttgctt

SEQ ID NO: 1027866 - DNA, 14 bp, Homo sapiens
cttgtttattaaat

SEQ ID NO: 1027867 - DNA, 22 bp, Homo sapiens
cttgtttcaattccacctgcaa

SEQ ID NO: 1027868 - DNA, 22 bp, Homo sapiens
cttgtttcactccaccatcact

SEQ ID NO: 1027869 - DNA, 15 bp, Homo sapiens
cttgtttccaggagc

SEQ ID NO: 1027870 - DNA, 13 bp, Homo sapiens
cttgtttccttgt

SEQ ID NO: 1027871 - DNA, 22 bp, Homo sapiens
cttgtttctgggtccctgctcc

SEQ ID NO: 1027872 - DNA, 14 bp, Homo sapiens
cttgtttctgtgcc

SEQ ID NO: 1027873 - DNA, 15 bp, Homo sapiens
cttgtttctgtgccc

SEQ ID NO: 1027874 - DNA, 19 bp, Homo sapiens
cttgtttgagtttttcctc

SEQ ID NO: 1027875 - DNA, 16 bp, Homo sapiens
cttgtttgatttcaac

SEQ ID NO: 1027876 - DNA, 22 bp, Homo sapiens
gttaaaagggaacacaaaacat

SEQ ID NO: 1027877 - DNA, 20 bp, Homo sapiens
gttaaaatagcggtacaagt

SEQ ID NO: 1027878 - DNA, 23 bp, Homo sapiens
gttaaaatcacattttaagtgct

SEQ ID NO: 1027879 - DNA, 12 bp, Homo sapiens
gttaaaatgtga

SEQ ID NO: 1027880 - DNA, 11 bp, Homo sapiens
gttaaacacac

SEQ ID NO: 1027881 - DNA, 22 bp, Homo sapiens
gttaaactaaaaaaaaaaaggc

SEQ ID NO: 1027882 - DNA, 21 bp, Homo sapiens
gttaaagaggagaaggaaaac

SEQ ID NO: 1027883 - DNA, 17 bp, Homo sapiens
gttaaaggcagtccaga

SEQ ID NO: 1027884 - DNA, 20 bp, Homo sapiens
gttaaaggcagtccagagct

SEQ ID NO: 1027885 - DNA, 18 bp, Homo sapiens
gttaaaggtgaacattgg

SEQ ID NO: 1027886 - DNA, 14 bp, Homo sapiens
gttaaataaataga

SEQ ID NO: 1027887 - DNA, 20 bp, Homo sapiens
gttaaatacaggaaacagtt

SEQ ID NO: 1027888 - DNA, 13 bp, Homo sapiens
gttaaatactgtg

SEQ ID NO: 1027889 - DNA, 14 bp, Homo sapiens
gttaaatcatttgg

SEQ ID NO: 1027890 - DNA, 15 bp, Homo sapiens
gttaaatgaaattgt

SEQ ID NO: 1027891 - DNA, 20 bp, Homo sapiens
gttaaatgaaattgtaaaac

SEQ ID NO: 1027892 - DNA, 21 bp, Homo sapiens
gttaaatgacttgattgtact

SEQ ID NO: 1027893 - DNA, 12 bp, Homo sapiens
gttaaatggaat

SEQ ID NO: 1027894 - DNA, 15 bp, Homo sapiens
gttaacaaggaatgc

SEQ ID NO: 1027895 - DNA, 22 bp, Homo sapiens
gttaacaaggaatgcctgtgcc

SEQ ID NO: 1027896 - DNA, 23 bp, Homo sapiens
gttaacagagacagataactctc

SEQ ID NO: 1027897 - DNA, 12 bp, Homo sapiens
gttaacagattt

SEQ ID NO: 1027898 - DNA, 15 bp, Homo sapiens
gttaacagtatttct

SEQ ID NO: 1027899 - DNA, 18 bp, Homo sapiens
gttaacattgaccaagaa

SEQ ID NO: 1027900 - DNA, 21 bp, Homo sapiens
gttaacattgaccaagaactg

SEQ ID NO: 1027901 - DNA, 22 bp, Homo sapiens
gttaacccttcatcttcctgtg

SEQ ID NO: 1027902 - DNA, 16 bp, Homo sapiens
gttaacctctgctttt

SEQ ID NO: 1027903 - DNA, 17 bp, Homo sapiens
gttaaccttaaatacac

SEQ ID NO: 1027904 - DNA, 17 bp, Homo sapiens
gttaactattgcattta

SEQ ID NO: 1027905 - DNA, 13 bp, Homo sapiens
gttaactcttcaa

SEQ ID NO: 1027906 - DNA, 22 bp, Homo sapiens
gttaactgaataccactctgta

SEQ ID NO: 1027907 - DNA, 18 bp, Homo sapiens
gttaactgaatttggaat

SEQ ID NO: 1027908 - DNA, 14 bp, Homo sapiens
gttaacttgtatat

SEQ ID NO: 1027909 - DNA, 23 bp, Homo sapiens
gttaactttaagactgagcacct

SEQ ID NO: 1027910 - DNA, 12 bp, Homo sapiens
gttaagaaagga

SEQ ID NO: 1027911 - DNA, 21 bp, Homo sapiens
gttaagaaaggatataaaagg

SEQ ID NO: 1027912 - DNA, 21 bp, Homo sapiens
gttaagaatgaagttctgcta

SEQ ID NO: 1027913 - DNA, 22 bp, Homo sapiens
gttaagagatcccttaagaagt

SEQ ID NO: 1027914 - DNA, 15 bp, Homo sapiens
gttaagataacttac

SEQ ID NO: 1027915 - DNA, 14 bp, Homo sapiens
gttaagccctggca

SEQ ID NO: 1027916 - DNA, 13 bp, Homo sapiens
gttaagctttatt

SEQ ID NO: 1027917 - DNA, 22 bp, Homo sapiens
ctttaaagaggctgtgtggcca

SEQ ID NO: 1027918 - DNA, 21 bp, Homo sapiens
ctttaaagataagtctacatt

SEQ ID NO: 1027919 - DNA, 15 bp, Homo sapiens
ctttaaaggcccagc

SEQ ID NO: 1027920 - DNA, 13 bp, Homo sapiens
ctttaaagtaaag

SEQ ID NO: 1027921 - DNA, 17 bp, Homo sapiens
ctttaaagtacctgtag

SEQ ID NO: 1027922 - DNA, 15 bp, Homo sapiens
ctttaaataaattaa

SEQ ID NO: 1027923 - DNA, 21 bp, Homo sapiens
ctttaaataaattaagatcct

SEQ ID NO: 1027924 - DNA, 13 bp, Homo sapiens
ctttaaatagata

SEQ ID NO: 1027925 - DNA, 19 bp, Homo sapiens
ctttaaatagatacaaatg

SEQ ID NO: 1027926 - DNA, 12 bp, Homo sapiens
ctttaaatcatt

SEQ ID NO: 1027927 - DNA, 19 bp, Homo sapiens
ctttaaatgaaacaagtct

SEQ ID NO: 1027928 - DNA, 21 bp, Homo sapiens
ctttaaatgcaacagttttta

SEQ ID NO: 1027929 - DNA, 13 bp, Homo sapiens
ctttaaattgtgt

SEQ ID NO: 1027930 - DNA, 15 bp, Homo sapiens
ctttaagaaaaatga

SEQ ID NO: 1027931 - DNA, 20 bp, Homo sapiens
ctttaagaaaaatgaaaact

SEQ ID NO: 1027932 - DNA, 16 bp, Homo sapiens
ctttaagaatagttct

SEQ ID NO: 1027933 - DNA, 15 bp, Homo sapiens
ctttaagactgagca

SEQ ID NO: 1027934 - DNA, 19 bp, Homo sapiens
ctttaagcactacataaac

SEQ ID NO: 1027935 - DNA, 14 bp, Homo sapiens
ctttaagccaaaga

SEQ ID NO: 1027936 - DNA, 17 bp, Homo sapiens
ctttaagccaaagaaac

SEQ ID NO: 1027937 - DNA, 19 bp, Homo sapiens
ctttaagccatagaccctg

SEQ ID NO: 1027938 - DNA, 17 bp, Homo sapiens
ctttaagctccagcttt

SEQ ID NO: 1027939 - DNA, 20 bp, Homo sapiens
ctttaaggtactgaagcttt

SEQ ID NO: 1027940 - DNA, 14 bp, Homo sapiens
ctttaataaaacaa

SEQ ID NO: 1027941 - DNA, 19 bp, Homo sapiens
ctttaataagtcattgaaa

SEQ ID NO: 1027942 - DNA, 16 bp, Homo sapiens
ctttaatattttgtaa

SEQ ID NO: 1027943 - DNA, 20 bp, Homo sapiens
ctttaatattttgtaatatt

SEQ ID NO: 1027944 - DNA, 17 bp, Homo sapiens
ctttaatcactgcattt

SEQ ID NO: 1027945 - DNA, 14 bp, Homo sapiens
ctttaatcttcagt

SEQ ID NO: 1027946 - DNA, 21 bp, Homo sapiens
ctttaatcttcagttttatct

SEQ ID NO: 1027947 - DNA, 13 bp, Homo sapiens
ctttaatgagaaa

SEQ ID NO: 1027948 - DNA, 13 bp, Homo sapiens
ctttaatgcatct

SEQ ID NO: 1027949 - DNA, 14 bp, Homo sapiens
ctttaatgctgtct

SEQ ID NO: 1027950 - DNA, 17 bp, Homo sapiens
ctttaatgctgtctttg

SEQ ID NO: 1027951 - DNA, 17 bp, Homo sapiens
ctttaatggcctggagg

SEQ ID NO: 1027952 - DNA, 23 bp, Homo sapiens
ctttaatgttttttgccacagct

SEQ ID NO: 1027953 - DNA, 14 bp, Homo sapiens
ctttaattctgtat

SEQ ID NO: 1027954 - DNA, 18 bp, Homo sapiens
ctttaattctgtatctgt

SEQ ID NO: 1027955 - DNA, 18 bp, Homo sapiens
ctttaattgaagaactgc

SEQ ID NO: 1027956 - DNA, 23 bp, Homo sapiens
ctttaattgaagaactgcacttt

SEQ ID NO: 1027957 - DNA, 13 bp, Homo sapiens
ctttaattgtata

SEQ ID NO: 1027958 - DNA, 14 bp, Homo sapiens
ctttaattgtataa

SEQ ID NO: 1027959 - DNA, 16 bp, Homo sapiens
ctttaattgtataagt

SEQ ID NO: 1027960 - DNA, 12 bp, Homo sapiens
ctttaatttatg

SEQ ID NO: 1027961 - DNA, 15 bp, Homo sapiens
ctttaatttatgtaa

SEQ ID NO: 1027962 - DNA, 23 bp, Homo sapiens
ctttaatttcaggaatcagaaat

SEQ ID NO: 1027963 - DNA, 21 bp, Homo sapiens
ctttaatttttttaaccaaag

SEQ ID NO: 1027964 - DNA, 16 bp, Homo sapiens
ctttacacaagaatct

SEQ ID NO: 1027965 - DNA, 21 bp, Homo sapiens
ctttacatctaagaatttttt

SEQ ID NO: 1027966 - DNA, 22 bp, Homo sapiens
ctttaccataaagcctttaaaa

SEQ ID NO: 1027967 - DNA, 14 bp, Homo sapiens
ctttaccatgctca

SEQ ID NO: 1027968 - DNA, 19 bp, Homo sapiens
ctttacccacctagaacac

SEQ ID NO: 1027969 - DNA, 14 bp, Homo sapiens
ctttaccttcctca

SEQ ID NO: 1027970 - DNA, 19 bp, Homo sapiens
ctttaccttctaaaagcca

SEQ ID NO: 1027971 - DNA, 22 bp, Homo sapiens
ctttaccttttttatacataaa

SEQ ID NO: 1027972 - DNA, 18 bp, Homo sapiens
ctttacgtactgtaactg

SEQ ID NO: 1027973 - DNA, 15 bp, Homo sapiens
ctttactactgtgga

SEQ ID NO: 1027974 - DNA, 22 bp, Homo sapiens
ctttactcccaagacttcattg

SEQ ID NO: 1027975 - DNA, 16 bp, Homo sapiens
ctttactcccttcctg

SEQ ID NO: 1027976 - DNA, 18 bp, Homo sapiens
ctttactcccttcctggc

SEQ ID NO: 1027977 - DNA, 12 bp, Homo sapiens
ctttactcctgg

SEQ ID NO: 1027978 - DNA, 14 bp, Homo sapiens
ctttactctgtgtt

SEQ ID NO: 1027979 - DNA, 19 bp, Homo sapiens
ctttactctgtgtttaaaa

SEQ ID NO: 1027980 - DNA, 15 bp, Homo sapiens
ctttactgaatgtaa

SEQ ID NO: 1027981 - DNA, 23 bp, Homo sapiens
ctttactgcagcctgggctccct

SEQ ID NO: 1027982 - DNA, 14 bp, Homo sapiens
ctttactgtgctta

SEQ ID NO: 1027983 - DNA, 14 bp, Homo sapiens
ctttactgtttgtt

SEQ ID NO: 1027984 - DNA, 21 bp, Homo sapiens
ctttacttgtggtgtgaccat

SEQ ID NO: 1027985 - DNA, 13 bp, Homo sapiens
ctttactttccct

SEQ ID NO: 1027986 - DNA, 18 bp, Homo sapiens
ctttagaaaatataagta

SEQ ID NO: 1027987 - DNA, 13 bp, Homo sapiens
ctttagaacagga

SEQ ID NO: 1027988 - DNA, 14 bp, Homo sapiens
ctttagaagcctgc

SEQ ID NO: 1027989 - DNA, 14 bp, Homo sapiens
ctttagaccctggg

SEQ ID NO: 1027990 - DNA, 19 bp, Homo sapiens
ctttagagaagtatacata

SEQ ID NO: 1027991 - DNA, 14 bp, Homo sapiens
ctttagagattata

SEQ ID NO: 1027992 - DNA, 19 bp, Homo sapiens
ctttagagattataacaaa

SEQ ID NO: 1027993 - DNA, 20 bp, Homo sapiens
ctttagatagccctgtcctg

SEQ ID NO: 1027994 - DNA, 12 bp, Homo sapiens
ctttagatgctg

SEQ ID NO: 1027995 - DNA, 13 bp, Homo sapiens
ctttagatgctga

SEQ ID NO: 1027996 - DNA, 22 bp, Homo sapiens
ctttagcatttttatgcagaca

SEQ ID NO: 1027997 - DNA, 16 bp, Homo sapiens
ctttagccatcataac

SEQ ID NO: 1027998 - DNA, 15 bp, Homo sapiens
ctttagcctggacca

SEQ ID NO: 1027999 - DNA, 15 bp, Homo sapiens
ctttagcttttcctt

SEQ ID NO: 1028000 - DNA, 21 bp, Homo sapiens
ctttaggagggagttatctaa

SEQ ID NO: 1028001 - DNA, 14 bp, Homo sapiens
ctttaggatgtaaa

SEQ ID NO: 1028002 - DNA, 15 bp, Homo sapiens
ctttaggcagcctgc

SEQ ID NO: 1028003 - DNA, 19 bp, Homo sapiens
ctttagggctgttgctagg

SEQ ID NO: 1028004 - DNA, 23 bp, Homo sapiens
gttagactgacttgtttgtcttc

SEQ ID NO: 1028005 - DNA, 23 bp, Homo sapiens
gttagagaactaaactagttttt

SEQ ID NO: 1028006 - DNA, 17 bp, Homo sapiens
gttagagagaaagagaa

SEQ ID NO: 1028007 - DNA, 22 bp, Homo sapiens
gttagagagggaccatgtgtca

SEQ ID NO: 1028008 - DNA, 17 bp, Homo sapiens
gttagagccaagctgca

SEQ ID NO: 1028009 - DNA, 19 bp, Homo sapiens
gttagagccaagctgcaca

SEQ ID NO: 1028010 - DNA, 23 bp, Homo sapiens
gttagaggaaaagactcctcctg

SEQ ID NO: 1028011 - DNA, 13 bp, Homo sapiens
gttagaggaaggc

SEQ ID NO: 1028012 - DNA, 14 bp, Homo sapiens
gttagagggaacag

SEQ ID NO: 1028013 - DNA, 20 bp, Homo sapiens
gttagatattattttagctt

SEQ ID NO: 1028014 - DNA, 11 bp, Homo sapiens
gttagatgctg

SEQ ID NO: 1028015 - DNA, 13 bp, Homo sapiens
gttagcagacagg

SEQ ID NO: 1028016 - DNA, 13 bp, Homo sapiens
gttagcagagtct

SEQ ID NO: 1028017 - DNA, 15 bp, Homo sapiens
gttagcagagtctgt

SEQ ID NO: 1028018 - DNA, 16 bp, Homo sapiens
gttagcagagtctgtc

SEQ ID NO: 1028019 - DNA, 19 bp, Homo sapiens
gttagcatgtatgaatgta

SEQ ID NO: 1028020 - DNA, 14 bp, Homo sapiens
gttagccccaggga

SEQ ID NO: 1028021 - DNA, 13 bp, Homo sapiens
gttagcctgcacc

SEQ ID NO: 1028022 - DNA, 14 bp, Homo sapiens
gttagcctgcaccg

SEQ ID NO: 1028023 - DNA, 21 bp, Homo sapiens
gttagctaaaccaagaaggag

SEQ ID NO: 1028024 - DNA, 21 bp, Homo sapiens
gttagctaataaaaagctttt

SEQ ID NO: 1028025 - DNA, 14 bp, Homo sapiens
gttagctcctgtgg

SEQ ID NO: 1028026 - DNA, 11 bp, Homo sapiens
gttagctgagc

SEQ ID NO: 1028027 - DNA, 11 bp, Homo sapiens
gttagctggag

SEQ ID NO: 1028028 - DNA, 16 bp, Homo sapiens
gttaggaatctcttca

SEQ ID NO: 1028029 - DNA, 17 bp, Homo sapiens
gttaggaggctgcatgc

SEQ ID NO: 1028030 - DNA, 18 bp, Homo sapiens
gttaggaggctgcatgct

SEQ ID NO: 1028031 - DNA, 22 bp, Homo sapiens
gttaggaggctgcatgctctgg

SEQ ID NO: 1028032 - DNA, 23 bp, Homo sapiens
gttaggaggctgcatgctctgga

SEQ ID NO: 1028033 - DNA, 15 bp, Homo sapiens
gttaggagttcgaga

SEQ ID NO: 1028034 - DNA, 17 bp, Homo sapiens
gttaggcatttcctgct

SEQ ID NO: 1028035 - DNA, 20 bp, Homo sapiens
gttagggctgcttttcttaa

SEQ ID NO: 1028036 - DNA, 22 bp, Homo sapiens
gttaggtgctgaatgaagctgc

SEQ ID NO: 1028037 - DNA, 17 bp, Homo sapiens
gttaggttgtctccagg

SEQ ID NO: 1028038 - DNA, 17 bp, Homo sapiens
gttagtaatctgtataa

SEQ ID NO: 1028039 - DNA, 16 bp, Homo sapiens
gttagtatctaacatg

SEQ ID NO: 1028040 - DNA, 17 bp, Homo sapiens
gttagtatctaacatgt

SEQ ID NO: 1028041 - DNA, 20 bp, Homo sapiens
gttagtatgaggcatttgtt

SEQ ID NO: 1028042 - DNA, 19 bp, Homo sapiens
gttagtcgggtgccaggac

SEQ ID NO: 1028043 - DNA, 23 bp, Homo sapiens
gttagtgtctgtccatctgtctg

SEQ ID NO: 1028044 - DNA, 23 bp, Homo sapiens
gttagtgtgtgtgcatgtgtgtg

SEQ ID NO: 1028045 - DNA, 23 bp, Homo sapiens
gttagttataaaactatgtgttc

SEQ ID NO: 1028046 - DNA, 16 bp, Homo sapiens
gttagttccactgaga

SEQ ID NO: 1028047 - DNA, 19 bp, Homo sapiens
gttagttgtgaaagaaagc

SEQ ID NO: 1028048 - DNA, 16 bp, Homo sapiens
gttataaaaaatggtt

SEQ ID NO: 1028049 - DNA, 22 bp, Homo sapiens
gttataaaaaatggttcagaat

SEQ ID NO: 1028050 - DNA, 14 bp, Homo sapiens
gttataacttaatg

SEQ ID NO: 1028051 - DNA, 17 bp, Homo sapiens
gttataacttaatgaaa

SEQ ID NO: 1028052 - DNA, 21 bp, Homo sapiens
gttataataactgaactgttt

SEQ ID NO: 1028053 - DNA, 23 bp, Homo sapiens
gttataattttttttaaaataga

SEQ ID NO: 1028054 - DNA, 20 bp, Homo sapiens
gttatacaaccttcatttaa

SEQ ID NO: 1028055 - DNA, 17 bp, Homo sapiens
gttatagattgtcttaa

SEQ ID NO: 1028056 - DNA, 15 bp, Homo sapiens
gttatagtatatctg

SEQ ID NO: 1028057 - DNA, 14 bp, Homo sapiens
gttatagtgtttaa

SEQ ID NO: 1028058 - DNA, 14 bp, Homo sapiens
gttatataatttag

SEQ ID NO: 1028059 - DNA, 22 bp, Homo sapiens
gttatatagtggatgatataca

SEQ ID NO: 1028060 - DNA, 22 bp, Homo sapiens
gttatatatggggatggtagtt

SEQ ID NO: 1028061 - DNA, 18 bp, Homo sapiens
gttatattagtgaagatg

SEQ ID NO: 1028062 - DNA, 19 bp, Homo sapiens
gttatattgaaaaaataga

SEQ ID NO: 1028063 - DNA, 14 bp, Homo sapiens
gttatatttttgtg

SEQ ID NO: 1028064 - DNA, 23 bp, Homo sapiens
gttatcaaacttcagctgtactt

SEQ ID NO: 1028065 - DNA, 20 bp, Homo sapiens
gttatcaccgtgggctccct

SEQ ID NO: 1028066 - DNA, 22 bp, Homo sapiens
gttatcaccgtgggctccctga

SEQ ID NO: 1028067 - DNA, 13 bp, Homo sapiens
gttatcactttaa

SEQ ID NO: 1028068 - DNA, 13 bp, Homo sapiens
gttatcatcctcc

SEQ ID NO: 1028069 - DNA, 13 bp, Homo sapiens
gttatcatgaatt

SEQ ID NO: 1028070 - DNA, 16 bp, Homo sapiens
gttatcctttgtgagc

SEQ ID NO: 1028071 - DNA, 23 bp, Homo sapiens
gttatcctttgtgagcctatgat

SEQ ID NO: 1028072 - DNA, 13 bp, Homo sapiens
gttatctctgtgt

SEQ ID NO: 1028073 - DNA, 14 bp, Homo sapiens
gttatctctgtgtt

SEQ ID NO: 1028074 - DNA, 17 bp, Homo sapiens
gttatctgcctggcctg

SEQ ID NO: 1028075 - DNA, 21 bp, Homo sapiens
gttatctgcctggcctggctc

SEQ ID NO: 1028076 - DNA, 20 bp, Homo sapiens
gttatcttttgaattcttga

SEQ ID NO: 1028077 - DNA, 22 bp, Homo sapiens
gttatctttttaaaaactcttc

SEQ ID NO: 1028078 - DNA, 12 bp, Homo sapiens
gttatgaaaatc

SEQ ID NO: 1028079 - DNA, 13 bp, Homo sapiens
gttatgaaacata

SEQ ID NO: 1028080 - DNA, 15 bp, Homo sapiens
gttatgaaacatatc

SEQ ID NO: 1028081 - DNA, 17 bp, Homo sapiens
gttatgaaacatatcat

SEQ ID NO: 1028082 - DNA, 18 bp, Homo sapiens
gttatgaacacttaaatt

SEQ ID NO: 1028083 - DNA, 15 bp, Homo sapiens
gttatgaacagctgt

SEQ ID NO: 1028084 - DNA, 14 bp, Homo sapiens
gttatgaacatcca

SEQ ID NO: 1028085 - DNA, 20 bp, Homo sapiens
gttatgaacatccaagtctt

SEQ ID NO: 1028086 - DNA, 17 bp, Homo sapiens
gttatgactatgtaaac

SEQ ID NO: 1028087 - DNA, 13 bp, Homo sapiens
gttatgattctga

SEQ ID NO: 1028088 - DNA, 15 bp, Homo sapiens
gttatgcactgtggt

SEQ ID NO: 1028089 - DNA, 19 bp, Homo sapiens
gttatgcctctgacagtcc

SEQ ID NO: 1028090 - DNA, 17 bp, Homo sapiens
gttatgggatgtaaaca

SEQ ID NO: 1028091 - DNA, 16 bp, Homo sapiens
gttatggtagaaaaat

SEQ ID NO: 1028092 - DNA, 20 bp, Homo sapiens
gttatggtagaaaaatttca

SEQ ID NO: 1028093 - DNA, 17 bp, Homo sapiens
gttatggtgatgactta

SEQ ID NO: 1028094 - DNA, 16 bp, Homo sapiens
gttatggtttaatgtt

SEQ ID NO: 1028095 - DNA, 22 bp, Homo sapiens
gttatgtgaatgatctctctga

SEQ ID NO: 1028096 - DNA, 19 bp, Homo sapiens
gttattaaaaatctcaaat

SEQ ID NO: 1028097 - DNA, 22 bp, Homo sapiens
gttattaaacgtatgcatgtga

SEQ ID NO: 1028098 - DNA, 22 bp, Homo sapiens
gttattagagattacctcctga

SEQ ID NO: 1028099 - DNA, 17 bp, Homo sapiens
gttattagcaaggctgg

SEQ ID NO: 1028100 - DNA, 17 bp, Homo sapiens
gttattatctgggctta

SEQ ID NO: 1028101 - DNA, 15 bp, Homo sapiens
gttattatgaaggaa

SEQ ID NO: 1028102 - DNA, 16 bp, Homo sapiens
gttattatgaaggaat

SEQ ID NO: 1028103 - DNA, 14 bp, Homo sapiens
gttattattcttga

SEQ ID NO: 1028104 - DNA, 13 bp, Homo sapiens
gttattcaaattt

SEQ ID NO: 1028105 - DNA, 23 bp, Homo sapiens
gttattcacaacctcaccaaact

SEQ ID NO: 1028106 - DNA, 12 bp, Homo sapiens
gttattcgccca

SEQ ID NO: 1028107 - DNA, 20 bp, Homo sapiens
gttattctagtactagaaac

SEQ ID NO: 1028108 - DNA, 17 bp, Homo sapiens
gttattcttggtactgt

SEQ ID NO: 1028109 - DNA, 14 bp, Homo sapiens
gttattgaagtgtt

SEQ ID NO: 1028110 - DNA, 17 bp, Homo sapiens
gttattgcaataaagta

SEQ ID NO: 1028111 - DNA, 23 bp, Homo sapiens
gttattgcagtttatcattcaag

SEQ ID NO: 1028112 - DNA, 21 bp, Homo sapiens
gttattgggcaagtgattgaa

SEQ ID NO: 1028113 - DNA, 15 bp, Homo sapiens
gttattgtgaatgat

SEQ ID NO: 1028114 - DNA, 16 bp, Homo sapiens
gttattgttgttgcca

SEQ ID NO: 1028115 - DNA, 10 bp, Homo sapiens
gttatttaaa

SEQ ID NO: 1028116 - DNA, 18 bp, Homo sapiens
gttatttacactggtcta

SEQ ID NO: 1028117 - DNA, 14 bp, Homo sapiens
gttatttactttta

SEQ ID NO: 1028118 - DNA, 12 bp, Homo sapiens
gttatttagact

SEQ ID NO: 1028119 - DNA, 20 bp, Homo sapiens
gttatttatacaagattgaa

SEQ ID NO: 1028120 - DNA, 23 bp, Homo sapiens
gttatttatttccttagtgccag

SEQ ID NO: 1028121 - DNA, 19 bp, Homo sapiens
gttatttctgtttgtttaa

SEQ ID NO: 1028122 - DNA, 22 bp, Homo sapiens
gttatttgaaaacatgtttatt

SEQ ID NO: 1028123 - DNA, 23 bp, Homo sapiens
gttatttgagcaagtaacattaa

SEQ ID NO: 1028124 - DNA, 16 bp, Homo sapiens
gttatttgtaatagat

SEQ ID NO: 1028125 - DNA, 14 bp, Homo sapiens
gttattttaaatat

SEQ ID NO: 1028126 - DNA, 18 bp, Homo sapiens
gttattttatttgcttat

SEQ ID NO: 1028127 - DNA, 15 bp, Homo sapiens
gttattttcagtatt

SEQ ID NO: 1028128 - DNA, 18 bp, Homo sapiens
ctttagggttctgcctct

SEQ ID NO: 1028129 - DNA, 19 bp, Homo sapiens
ctttaggtcaaactcccta

SEQ ID NO: 1028130 - DNA, 17 bp, Homo sapiens
ctttagtacctgaaaag

SEQ ID NO: 1028131 - DNA, 22 bp, Homo sapiens
ctttagtagtaacaaaagggtt

SEQ ID NO: 1028132 - DNA, 18 bp, Homo sapiens
ctttagtgccggctgtgg

SEQ ID NO: 1028133 - DNA, 16 bp, Homo sapiens
ctttagtggagccagg

SEQ ID NO: 1028134 - DNA, 15 bp, Homo sapiens
ctttagttatattca

SEQ ID NO: 1028135 - DNA, 13 bp, Homo sapiens
ctttataaacttt

SEQ ID NO: 1028136 - DNA, 18 bp, Homo sapiens
ctttataactaacatgtc

SEQ ID NO: 1028137 - DNA, 19 bp, Homo sapiens
ctttataaggaaatgtatt

SEQ ID NO: 1028138 - DNA, 20 bp, Homo sapiens
ctttatacaacgattgtatt

SEQ ID NO: 1028139 - DNA, 15 bp, Homo sapiens
ctttatacacagtgg

SEQ ID NO: 1028140 - DNA, 23 bp, Homo sapiens
ctttatagaaggaatttgtactt

SEQ ID NO: 1028141 - DNA, 20 bp, Homo sapiens
ctttatagctgcaagtgtat

SEQ ID NO: 1028142 - DNA, 17 bp, Homo sapiens
ctttatatcttgtttac

SEQ ID NO: 1028143 - DNA, 13 bp, Homo sapiens
ctttatatgaaga

SEQ ID NO: 1028144 - DNA, 13 bp, Homo sapiens
ctttatatttagt

SEQ ID NO: 1028145 - DNA, 19 bp, Homo sapiens
ctttatcacattatttgca

SEQ ID NO: 1028146 - DNA, 12 bp, Homo sapiens
ctttatcacctc

SEQ ID NO: 1028147 - DNA, 17 bp, Homo sapiens
ctttatcacctcattct

SEQ ID NO: 1028148 - DNA, 19 bp, Homo sapiens
ctttatcacctcattctga

SEQ ID NO: 1028149 - DNA, 20 bp, Homo sapiens
ctttatcacctcattctgaa

SEQ ID NO: 1028150 - DNA, 22 bp, Homo sapiens
ctttatccacttttcttcttcc

SEQ ID NO: 1028151 - DNA, 22 bp, Homo sapiens
ctttatccagctagtgccaaat

SEQ ID NO: 1028152 - DNA, 16 bp, Homo sapiens
ctttatccttaggaaa

SEQ ID NO: 1028153 - DNA, 17 bp, Homo sapiens
ctttatctctgaggcta

SEQ ID NO: 1028154 - DNA, 15 bp, Homo sapiens
ctttatcttgaagtc

SEQ ID NO: 1028155 - DNA, 13 bp, Homo sapiens
ctttatcttttca

SEQ ID NO: 1028156 - DNA, 22 bp, Homo sapiens
ctttatgaatgaaaaaacagtc

SEQ ID NO: 1028157 - DNA, 17 bp, Homo sapiens
ctttatgatgctaagct

SEQ ID NO: 1028158 - DNA, 15 bp, Homo sapiens
ctttatgcacaaaat

SEQ ID NO: 1028159 - DNA, 19 bp, Homo sapiens
ctttatgtagtttttatat

SEQ ID NO: 1028160 - DNA, 14 bp, Homo sapiens
ctttatgtgaattt

SEQ ID NO: 1028161 - DNA, 17 bp, Homo sapiens
ctttatgtgaattttta

SEQ ID NO: 1028162 - DNA, 21 bp, Homo sapiens
ctttccctagaaagccatatt

SEQ ID NO: 1028163 - DNA, 14 bp, Homo sapiens
ctttccctcacccc

SEQ ID NO: 1028164 - DNA, 16 bp, Homo sapiens
ctttccctcaccccct

SEQ ID NO: 1028165 - DNA, 14 bp, Homo sapiens
ctttccctctccca

SEQ ID NO: 1028166 - DNA, 12 bp, Homo sapiens
ctttccctgagg

SEQ ID NO: 1028167 - DNA, 12 bp, Homo sapiens
ctttccctggac

SEQ ID NO: 1028168 - DNA, 14 bp, Homo sapiens
ctttccctggagct

SEQ ID NO: 1028169 - DNA, 20 bp, Homo sapiens
ctttcccttattgcctccca

SEQ ID NO: 1028170 - DNA, 22 bp, Homo sapiens
ctttcccttattgcctcccagg

SEQ ID NO: 1028171 - DNA, 14 bp, Homo sapiens
ctttcccttcctct

SEQ ID NO: 1028172 - DNA, 19 bp, Homo sapiens
ctttcccttgcttttccct

SEQ ID NO: 1028173 - DNA, 23 bp, Homo sapiens
ctttcccttgcttttccctcttt

SEQ ID NO: 1028174 - DNA, 19 bp, Homo sapiens
ctttccgctgtcgccccag

SEQ ID NO: 1028175 - DNA, 21 bp, Homo sapiens
ctttccgctgtcgccccaggc

SEQ ID NO: 1028176 - DNA, 19 bp, Homo sapiens
ctttccgtggcactgcata

SEQ ID NO: 1028177 - DNA, 23 bp, Homo sapiens
ctttccgtttttttctttcctgt

SEQ ID NO: 1028178 - DNA, 20 bp, Homo sapiens
ctttcctaaagccaaagttt

SEQ ID NO: 1028179 - DNA, 22 bp, Homo sapiens
ctttcctaaagccatcatgcct

SEQ ID NO: 1028180 - DNA, 15 bp, Homo sapiens
ctttcctaaatgttt

SEQ ID NO: 1028181 - DNA, 16 bp, Homo sapiens
ctttcctaaggctgca

SEQ ID NO: 1028182 - DNA, 17 bp, Homo sapiens
ctttcctactgtcctgg

SEQ ID NO: 1028183 - DNA, 15 bp, Homo sapiens
ctttcctaggcccag

SEQ ID NO: 1028184 - DNA, 20 bp, Homo sapiens
ctttcctcaagtatcttcta

SEQ ID NO: 1028185 - DNA, 15 bp, Homo sapiens
ctttcctcacatttg

SEQ ID NO: 1028186 - DNA, 19 bp, Homo sapiens
ctttcctccccaccttccc

SEQ ID NO: 1028187 - DNA, 20 bp, Homo sapiens
ctttcctccccaccttcccc

SEQ ID NO: 1028188 - DNA, 16 bp, Homo sapiens
ctttcctccccataca

SEQ ID NO: 1028189 - DNA, 16 bp, Homo sapiens
ctttcctcccccagcg

SEQ ID NO: 1028190 - DNA, 18 bp, Homo sapiens
ctttcctcccccagcgtc

SEQ ID NO: 1028191 - DNA, 19 bp, Homo sapiens
ctttcctccccctgcaact

SEQ ID NO: 1028192 - DNA, 19 bp, Homo sapiens
ctttcctccttcactgttt

SEQ ID NO: 1028193 - DNA, 11 bp, Homo sapiens
ctttcctctga

SEQ ID NO: 1028194 - DNA, 19 bp, Homo sapiens
ctttcctctttctgctctg

SEQ ID NO: 1028195 - DNA, 23 bp, Homo sapiens
ctttcctctttctgctctgccat

SEQ ID NO: 1028196 - DNA, 22 bp, Homo sapiens
ctttcctgatggtacaggaaag

SEQ ID NO: 1028197 - DNA, 21 bp, Homo sapiens
ctttcctgcaactcaaggact

SEQ ID NO: 1028198 - DNA, 21 bp, Homo sapiens
ctttcctgccatgtttagtga

SEQ ID NO: 1028199 - DNA, 13 bp, Homo sapiens
ctttcctgcccca

SEQ ID NO: 1028200 - DNA, 14 bp, Homo sapiens
ctttcctgccctgt

SEQ ID NO: 1028201 - DNA, 17 bp, Homo sapiens
ctttcctgccctgtcca

SEQ ID NO: 1028202 - DNA, 13 bp, Homo sapiens
ctttcctgctaca

SEQ ID NO: 1028203 - DNA, 20 bp, Homo sapiens
ctttcctggacactcagacc

SEQ ID NO: 1028204 - DNA, 18 bp, Homo sapiens
ctttcctgggcctttgca

SEQ ID NO: 1028205 - DNA, 20 bp, Homo sapiens
ctttcctgtagccttctgta

SEQ ID NO: 1028206 - DNA, 12 bp, Homo sapiens
ctttcctgtgcc

SEQ ID NO: 1028207 - DNA, 21 bp, Homo sapiens
ctttcctgtgtgtactctgtc

SEQ ID NO: 1028208 - DNA, 17 bp, Homo sapiens
ctttccttagttaaaaa

SEQ ID NO: 1028209 - DNA, 20 bp, Homo sapiens
ctttccttatgtctcctgac

SEQ ID NO: 1028210 - DNA, 15 bp, Homo sapiens
ctttccttccatccc

SEQ ID NO: 1028211 - DNA, 14 bp, Homo sapiens
ctttccttccctct

SEQ ID NO: 1028212 - DNA, 22 bp, Homo sapiens
ctttccttggctcccattcact

SEQ ID NO: 1028213 - DNA, 17 bp, Homo sapiens
ctttcctttactcctgg

SEQ ID NO: 1028214 - DNA, 12 bp, Homo sapiens
ctttccttttct

SEQ ID NO: 1028215 - DNA, 15 bp, Homo sapiens
ctttccttttctctg

SEQ ID NO: 1028216 - DNA, 15 bp, Homo sapiens
ctttccttttcttta

SEQ ID NO: 1028217 - DNA, 21 bp, Homo sapiens
ctttcctttttcccaataaat

SEQ ID NO: 1028218 - DNA, 13 bp, Homo sapiens
ctttcgaggcctg

SEQ ID NO: 1028219 - DNA, 14 bp, Homo sapiens
ctttcgaggcctga

SEQ ID NO: 1028220 - DNA, 15 bp, Homo sapiens
ctttcggggagggcg

SEQ ID NO: 1028221 - DNA, 13 bp, Homo sapiens
ctttctaagaaat

SEQ ID NO: 1028222 - DNA, 13 bp, Homo sapiens
ctttctaatagag

SEQ ID NO: 1028223 - DNA, 15 bp, Homo sapiens
ctttctaatgtagct

SEQ ID NO: 1028224 - DNA, 15 bp, Homo sapiens
ctttctaatgtttct

SEQ ID NO: 1028225 - DNA, 18 bp, Homo sapiens
ctttctacaatgtgaact

SEQ ID NO: 1028226 - DNA, 19 bp, Homo sapiens
ctttctacatgactgggcc

SEQ ID NO: 1028227 - DNA, 22 bp, Homo sapiens
ctttctagaaagagaaacagtt

SEQ ID NO: 1028228 - DNA, 17 bp, Homo sapiens
ctttctagatgtctctg

SEQ ID NO: 1028229 - DNA, 16 bp, Homo sapiens
ctttctagttgaaaat

SEQ ID NO: 1028230 - DNA, 17 bp, Homo sapiens
ctttctatataaaatgt

SEQ ID NO: 1028231 - DNA, 23 bp, Homo sapiens
ctttctcaaagagggggctctgc

SEQ ID NO: 1028232 - DNA, 17 bp, Homo sapiens
ctttctcactaaatctt

SEQ ID NO: 1028233 - DNA, 20 bp, Homo sapiens
ctttctcagttttcataagt

SEQ ID NO: 1028234 - DNA, 15 bp, Homo sapiens
ctttctcataaaact

SEQ ID NO: 1028235 - DNA, 16 bp, Homo sapiens
ctttctcatttctttc

SEQ ID NO: 1028236 - DNA, 16 bp, Homo sapiens
ctttctccagccagca

SEQ ID NO: 1028237 - DNA, 19 bp, Homo sapiens
ctttctcccccgacactgc

SEQ ID NO: 1028238 - DNA, 22 bp, Homo sapiens
ctttctcccccgacactgctgc

SEQ ID NO: 1028239 - DNA, 13 bp, Homo sapiens
ctttctccctcac

SEQ ID NO: 1028240 - DNA, 15 bp, Homo sapiens
ctttctcctcaggac

SEQ ID NO: 1028241 - DNA, 20 bp, Homo sapiens
ctttctcctccccacctgta

SEQ ID NO: 1028242 - DNA, 23 bp, Homo sapiens
ctttctcctccccacctgtagct

SEQ ID NO: 1028243 - DNA, 17 bp, Homo sapiens
ctttctcctctgctatg

SEQ ID NO: 1028244 - DNA, 22 bp, Homo sapiens
ctttctcctctgctatgcattt

SEQ ID NO: 1028245 - DNA, 23 bp, Homo sapiens
ctttctcctctgctatgcatttt

SEQ ID NO: 1028246 - DNA, 11 bp, Homo sapiens
ctttctcctgg

SEQ ID NO: 1028247 - DNA, 14 bp, Homo sapiens
ctttctcctgtgcc

SEQ ID NO: 1028248 - DNA, 12 bp, Homo sapiens
ctttctcctgtt

SEQ ID NO: 1028249 - DNA, 22 bp, Homo sapiens
ctttctcctgtttattcccatc

SEQ ID NO: 1028250 - DNA, 20 bp, Homo sapiens
ctttctccttagtcttctca

SEQ ID NO: 1028251 - DNA, 16 bp, Homo sapiens
ctttctcgcgccctcc

SEQ ID NO: 1028252 - DNA, 20 bp, Homo sapiens
ctttctcgcgccctccccca

SEQ ID NO: 1028253 - DNA, 15 bp, Homo sapiens
ctttctctaataata

SEQ ID NO: 1028254 - DNA, 18 bp, Homo sapiens
ctttctctaataataaat

SEQ ID NO: 1028255 - DNA, 13 bp, Homo sapiens
ctttctctcagtg

SEQ ID NO: 1028256 - DNA, 14 bp, Homo sapiens
ctttctctcagtga

SEQ ID NO: 1028257 - DNA, 14 bp, Homo sapiens
ctttctctccccaa

SEQ ID NO: 1028258 - DNA, 19 bp, Homo sapiens
gttccaaatgaatgttgtc

SEQ ID NO: 1028259 - DNA, 15 bp, Homo sapiens
gttccaaatgtttat

SEQ ID NO: 1028260 - DNA, 14 bp, Homo sapiens
gttccaaattcagt

SEQ ID NO: 1028261 - DNA, 15 bp, Homo sapiens
gttccaaccaggcag

SEQ ID NO: 1028262 - DNA, 21 bp, Homo sapiens
gttccaagaaagatccaccct

SEQ ID NO: 1028263 - DNA, 19 bp, Homo sapiens
gttccaagacattgtcaat

SEQ ID NO: 1028264 - DNA, 17 bp, Homo sapiens
gttccacacatttaaaa

SEQ ID NO: 1028265 - DNA, 16 bp, Homo sapiens
gttccacagttgccac

SEQ ID NO: 1028266 - DNA, 21 bp, Homo sapiens
gttccaccccaagagaactcg

SEQ ID NO: 1028267 - DNA, 20 bp, Homo sapiens
gttccacctggggcttccct

SEQ ID NO: 1028268 - DNA, 16 bp, Homo sapiens
gttccacgtgttttat

SEQ ID NO: 1028269 - DNA, 21 bp, Homo sapiens
gttccactgcaaataaagcct

SEQ ID NO: 1028270 - DNA, 22 bp, Homo sapiens
gttccactgcaaataaagcctt

SEQ ID NO: 1028271 - DNA, 13 bp, Homo sapiens
gttccagaggagc

SEQ ID NO: 1028272 - DNA, 18 bp, Homo sapiens
gttccaggccctccagtg

SEQ ID NO: 1028273 - DNA, 23 bp, Homo sapiens
gttccaggcctgatcttgcctgt

SEQ ID NO: 1028274 - DNA, 19 bp, Homo sapiens
gttccagggtccctctgtg

SEQ ID NO: 1028275 - DNA, 14 bp, Homo sapiens
gttccagtttctcc

SEQ ID NO: 1028276 - DNA, 20 bp, Homo sapiens
gttccagtttctccttgaaa

SEQ ID NO: 1028277 - DNA, 12 bp, Homo sapiens
gttccatgcagc

SEQ ID NO: 1028278 - DNA, 20 bp, Homo sapiens
gttccatgcctgagggtgga

SEQ ID NO: 1028279 - DNA, 22 bp, Homo sapiens
gttccattgaagccgactctgg

SEQ ID NO: 1028280 - DNA, 18 bp, Homo sapiens
gttccattttatgcagaa

SEQ ID NO: 1028281 - DNA, 23 bp, Homo sapiens
gttccatttttcctctgttcaca

SEQ ID NO: 1028282 - DNA, 19 bp, Homo sapiens
gttcccaagctcagaggcg

SEQ ID NO: 1028283 - DNA, 23 bp, Homo sapiens
gttcccaaggacatgagtctgta

SEQ ID NO: 1028284 - DNA, 15 bp, Homo sapiens
ctttgcaaagtattg

SEQ ID NO: 1028285 - DNA, 19 bp, Homo sapiens
ctttgcaaagtattgtaaa

SEQ ID NO: 1028286 - DNA, 22 bp, Homo sapiens
ctttgcaaagtattgtaaatta

SEQ ID NO: 1028287 - DNA, 19 bp, Homo sapiens
ctttgcaaattatttatta

SEQ ID NO: 1028288 - DNA, 17 bp, Homo sapiens
ctttgcaattgctcttc

SEQ ID NO: 1028289 - DNA, 21 bp, Homo sapiens
ctttgcacaggaaagagtcac

SEQ ID NO: 1028290 - DNA, 20 bp, Homo sapiens
ctttgcacaggatgctggcc

SEQ ID NO: 1028291 - DNA, 17 bp, Homo sapiens
ctttgcacatgtgacca

SEQ ID NO: 1028292 - DNA, 13 bp, Homo sapiens
ctttgcaccaaag

SEQ ID NO: 1028293 - DNA, 17 bp, Homo sapiens
ctttgcaccaaagacat

SEQ ID NO: 1028294 - DNA, 21 bp, Homo sapiens
ctttgcacccctttcctcccc

SEQ ID NO: 1028295 - DNA, 17 bp, Homo sapiens
ctttgcacgacgccctc

SEQ ID NO: 1028296 - DNA, 15 bp, Homo sapiens
ctttgcactgagggc

SEQ ID NO: 1028297 - DNA, 18 bp, Homo sapiens
ctttgcactgagggccac

SEQ ID NO: 1028298 - DNA, 23 bp, Homo sapiens
ctttgcactgagggccacactat

SEQ ID NO: 1028299 - DNA, 21 bp, Homo sapiens
ctttgcaggcggccctcagtg

SEQ ID NO: 1028300 - DNA, 15 bp, Homo sapiens
ctttgcaggctctgg

SEQ ID NO: 1028301 - DNA, 19 bp, Homo sapiens
ctttgcaggctctgggctc

SEQ ID NO: 1028302 - DNA, 18 bp, Homo sapiens
ctttgcagggcacagatg

SEQ ID NO: 1028303 - DNA, 20 bp, Homo sapiens
ctttgcagttggactctcag

SEQ ID NO: 1028304 - DNA, 19 bp, Homo sapiens
ctttgcatagctctccttc

SEQ ID NO: 1028305 - DNA, 17 bp, Homo sapiens
ctttgcatggatttctt

SEQ ID NO: 1028306 - DNA, 13 bp, Homo sapiens
ctttgcatggcag

SEQ ID NO: 1028307 - DNA, 21 bp, Homo sapiens
ctttgcatggcagggcctcat

SEQ ID NO: 1028308 - DNA, 20 bp, Homo sapiens
ctttgcattgtctgtctgca

SEQ ID NO: 1028309 - DNA, 22 bp, Homo sapiens
ctttgcattttctgatgtatta

SEQ ID NO: 1028310 - DNA, 15 bp, Homo sapiens
ctttgccaacatggt

SEQ ID NO: 1028311 - DNA, 23 bp, Homo sapiens
ctttgccaagttgctgtcactgt

SEQ ID NO: 1028312 - DNA, 18 bp, Homo sapiens
ctttgccagagcaggagc

SEQ ID NO: 1028313 - DNA, 17 bp, Homo sapiens
ctttgccagctgctgct

SEQ ID NO: 1028314 - DNA, 18 bp, Homo sapiens
ctttgccatgggcctgct

SEQ ID NO: 1028315 - DNA, 19 bp, Homo sapiens
ctttgccatgggcctgctg

SEQ ID NO: 1028316 - DNA, 15 bp, Homo sapiens
ctttgcccacccctc

SEQ ID NO: 1028317 - DNA, 18 bp, Homo sapiens
ctttgcccacccctcact

SEQ ID NO: 1028318 - DNA, 19 bp, Homo sapiens
ctttgcccacccctcactc

SEQ ID NO: 1028319 - DNA, 20 bp, Homo sapiens
ctttgcccagggtcctgtgc

SEQ ID NO: 1028320 - DNA, 23 bp, Homo sapiens
ctttgccccacctttattaaaat

SEQ ID NO: 1028321 - DNA, 16 bp, Homo sapiens
ctttgcccccttgccc

SEQ ID NO: 1028322 - DNA, 17 bp, Homo sapiens
ctttgcccccttgccca

SEQ ID NO: 1028323 - DNA, 11 bp, Homo sapiens
ctttgcctcaa

SEQ ID NO: 1028324 - DNA, 14 bp, Homo sapiens
ctttgcctccctca

SEQ ID NO: 1028325 - DNA, 12 bp, Homo sapiens
ctttgcctctgt

SEQ ID NO: 1028326 - DNA, 15 bp, Homo sapiens
ctttgcctctgtcct

SEQ ID NO: 1028327 - DNA, 16 bp, Homo sapiens
ctttgcctctgtcctc

SEQ ID NO: 1028328 - DNA, 11 bp, Homo sapiens
ctttgcctggt

SEQ ID NO: 1028329 - DNA, 22 bp, Homo sapiens
ctttgccttccacgctgtctcc

SEQ ID NO: 1028330 - DNA, 13 bp, Homo sapiens
ctttgccttctct

SEQ ID NO: 1028331 - DNA, 13 bp, Homo sapiens
ctttgccttgggc

SEQ ID NO: 1028332 - DNA, 16 bp, Homo sapiens
ctttgccttgggctgc

SEQ ID NO: 1028333 - DNA, 19 bp, Homo sapiens
ctttgccttgggctgctcc

SEQ ID NO: 1028334 - DNA, 22 bp, Homo sapiens
ctttgccttgggctgctcctca

SEQ ID NO: 1028335 - DNA, 20 bp, Homo sapiens
ctttgcctttcttctgccct

SEQ ID NO: 1028336 - DNA, 18 bp, Homo sapiens
ctttgctacaaatttatg

SEQ ID NO: 1028337 - DNA, 21 bp, Homo sapiens
ctttgctacaaatttatgcat

SEQ ID NO: 1028338 - DNA, 23 bp, Homo sapiens
ctttgctacaaatttatgcattt

SEQ ID NO: 1028339 - DNA, 21 bp, Homo sapiens
ctttgctaggcctcttgctga

SEQ ID NO: 1028340 - DNA, 16 bp, Homo sapiens
ctttgctatgtaaggg

SEQ ID NO: 1028341 - DNA, 11 bp, Homo sapiens
ctttgctattc

SEQ ID NO: 1028342 - DNA, 15 bp, Homo sapiens
ctttgctcagtgtcc

SEQ ID NO: 1028343 - DNA, 12 bp, Homo sapiens
ctttgctccaga

SEQ ID NO: 1028344 - DNA, 19 bp, Homo sapiens
ctttgctccgctcccaccg

SEQ ID NO: 1028345 - DNA, 13 bp, Homo sapiens
ctttgctctggag

SEQ ID NO: 1028346 - DNA, 21 bp, Homo sapiens
ctttgctctggaggaagttct

SEQ ID NO: 1028347 - DNA, 14 bp, Homo sapiens
ctttgctgcacagc

SEQ ID NO: 1028348 - DNA, 17 bp, Homo sapiens
ctttgctgcacagcagg

SEQ ID NO: 1028349 - DNA, 15 bp, Homo sapiens
ctttgctgcagagaa

SEQ ID NO: 1028350 - DNA, 14 bp, Homo sapiens
ctttgctgcatttt

SEQ ID NO: 1028351 - DNA, 11 bp, Homo sapiens
ctttgctgccc

SEQ ID NO: 1028352 - DNA, 21 bp, Homo sapiens
ctttgctgctaccgccctggg

SEQ ID NO: 1028353 - DNA, 22 bp, Homo sapiens
ctttgctgctatgaaaatgagc

SEQ ID NO: 1028354 - DNA, 17 bp, Homo sapiens
ctttgctgtactcttgc

SEQ ID NO: 1028355 - DNA, 19 bp, Homo sapiens
ctttgctgtactcttgctg

SEQ ID NO: 1028356 - DNA, 23 bp, Homo sapiens
ctttgctgtgaggaatgctctgt

SEQ ID NO: 1028357 - DNA, 17 bp, Homo sapiens
ctttgctgtgaggctgt

SEQ ID NO: 1028358 - DNA, 13 bp, Homo sapiens
ctttgctgttact

SEQ ID NO: 1028359 - DNA, 14 bp, Homo sapiens
ctttgctgttactg

SEQ ID NO: 1028360 - DNA, 18 bp, Homo sapiens
ctttgctgttactgcttc

SEQ ID NO: 1028361 - DNA, 12 bp, Homo sapiens
ctttgcttcata

SEQ ID NO: 1028362 - DNA, 13 bp, Homo sapiens
ctttgcttcatag

SEQ ID NO: 1028363 - DNA, 18 bp, Homo sapiens
ctttgcttccgccactca

SEQ ID NO: 1028364 - DNA, 17 bp, Homo sapiens
ctttgcttgagaatcct

SEQ ID NO: 1028365 - DNA, 13 bp, Homo sapiens
ctttgcttgcttt

SEQ ID NO: 1028366 - DNA, 17 bp, Homo sapiens
ctttgctttgctttctg

SEQ ID NO: 1028367 - DNA, 22 bp, Homo sapiens
ctttggaaagtacactctgctg

SEQ ID NO: 1028368 - DNA, 23 bp, Homo sapiens
ctttggaaagtacactctgctgt

SEQ ID NO: 1028369 - DNA, 24 bp, Homo sapiens
ctttggaaagtacactctgctgtt

SEQ ID NO: 1028370 - DNA, 21 bp, Homo sapiens
ctttggaacaagacagccttc

SEQ ID NO: 1028371 - DNA, 14 bp, Homo sapiens
ctttggaaccagac

SEQ ID NO: 1028372 - DNA, 17 bp, Homo sapiens
ctttggaagaaaaaatc

SEQ ID NO: 1028373 - DNA, 13 bp, Homo sapiens
ctttggaagcagc

SEQ ID NO: 1028374 - DNA, 14 bp, Homo sapiens
ctttggaagcagcc

SEQ ID NO: 1028375 - DNA, 11 bp, Homo sapiens
ctttggaagga

SEQ ID NO: 1028376 - DNA, 17 bp, Homo sapiens
ctttggaaggagtgaga

SEQ ID NO: 1028377 - DNA, 19 bp, Homo sapiens
ctttggaatattttatcct

SEQ ID NO: 1028378 - DNA, 22 bp, Homo sapiens
ctttggaatgaaattcctcctt

SEQ ID NO: 1028379 - DNA, 15 bp, Homo sapiens
ctttggacagtggcc

SEQ ID NO: 1028380 - DNA, 18 bp, Homo sapiens
ctttggacccagggcctg

SEQ ID NO: 1028381 - DNA, 21 bp, Homo sapiens
ctttggacctaaatggcctca

SEQ ID NO: 1028382 - DNA, 14 bp, Homo sapiens
ctttggagtcccct

SEQ ID NO: 1028383 - DNA, 17 bp, Homo sapiens
ctttggataataggaat

SEQ ID NO: 1028384 - DNA, 19 bp, Homo sapiens
ctttggatgcaattaaaac

SEQ ID NO: 1028385 - DNA, 21 bp, Homo sapiens
ctttggatgcaattaaaacta

SEQ ID NO: 1028386 - DNA, 16 bp, Homo sapiens
ctttggcactggatgg

SEQ ID NO: 1028387 - DNA, 18 bp, Homo sapiens
ctttggcactggggcact

SEQ ID NO: 1028388 - DNA, 17 bp, Homo sapiens
ctttggcagtgttttgg

SEQ ID NO: 1028389 - DNA, 18 bp, Homo sapiens
ctttggccaacagggtag

SEQ ID NO: 1028390 - DNA, 17 bp, Homo sapiens
ctttggccattccaaca

SEQ ID NO: 1028391 - DNA, 21 bp, Homo sapiens
ctttggccccactttgaaggg

SEQ ID NO: 1028392 - DNA, 17 bp, Homo sapiens
ctttggcctacattctt

SEQ ID NO: 1028393 - DNA, 18 bp, Homo sapiens
ctttggcctacattcttt

SEQ ID NO: 1028394 - DNA, 22 bp, Homo sapiens
ctttgggaaaggagaagttaag

SEQ ID NO: 1028395 - DNA, 13 bp, Homo sapiens
ctttgggaggcca

SEQ ID NO: 1028396 - DNA, 18 bp, Homo sapiens
ctttgggaggccaaggca

SEQ ID NO: 1028397 - DNA, 17 bp, Homo sapiens
ctttgggatcagcctcc

SEQ ID NO: 1028398 - DNA, 15 bp, Homo sapiens
ctttgggcccaagaa

SEQ ID NO: 1028399 - DNA, 20 bp, Homo sapiens
ctttgggcccaagaactgca

SEQ ID NO: 1028400 - DNA, 21 bp, Homo sapiens
ctttgggcccaagaactgcag

SEQ ID NO: 1028401 - DNA, 22 bp, Homo sapiens
ctttgggcttagtatttctcag

SEQ ID NO: 1028402 - DNA, 17 bp, Homo sapiens
ctttgggctttgcaggc

SEQ ID NO: 1028403 - DNA, 21 bp, Homo sapiens
ctttgggctttgcaggctctg

SEQ ID NO: 1028404 - DNA, 18 bp, Homo sapiens
ctttggggctaatttaac

SEQ ID NO: 1028405 - DNA, 22 bp, Homo sapiens
ctttgggggagtgggcgcagtg

SEQ ID NO: 1028406 - DNA, 17 bp, Homo sapiens
cttttacattctgtgtg

SEQ ID NO: 1028407 - DNA, 22 bp, Homo sapiens
cttttaccaacttcctctgcca

SEQ ID NO: 1028408 - DNA, 14 bp, Homo sapiens
cttttaccatgccc

SEQ ID NO: 1028409 - DNA, 16 bp, Homo sapiens
cttttaccatgcccct

SEQ ID NO: 1028410 - DNA, 20 bp, Homo sapiens
cttttacccctgcacagttt

SEQ ID NO: 1028411 - DNA, 23 bp, Homo sapiens
cttttactcatgatcttgtgaca

SEQ ID NO: 1028412 - DNA, 16 bp, Homo sapiens
cttttactggttgcat

SEQ ID NO: 1028413 - DNA, 17 bp, Homo sapiens
cttttactggttgcatg

SEQ ID NO: 1028414 - DNA, 18 bp, Homo sapiens
cttttacttttttatagc

SEQ ID NO: 1028415 - DNA, 14 bp, Homo sapiens
cttttagaaatgca

SEQ ID NO: 1028416 - DNA, 17 bp, Homo sapiens
cttttagaaatgcatat

SEQ ID NO: 1028417 - DNA, 13 bp, Homo sapiens
cttttagacaact

SEQ ID NO: 1028418 - DNA, 16 bp, Homo sapiens
cttttagacaactaga

SEQ ID NO: 1028419 - DNA, 19 bp, Homo sapiens
cttttagacaactagattt

SEQ ID NO: 1028420 - DNA, 21 bp, Homo sapiens
cttttagacaactagatttgt

SEQ ID NO: 1028421 - DNA, 14 bp, Homo sapiens
cttttaggaaaatc

SEQ ID NO: 1028422 - DNA, 21 bp, Homo sapiens
cttttaggaaaatcactttgt

SEQ ID NO: 1028423 - DNA, 20 bp, Homo sapiens
cttttaggagaattcacaga

SEQ ID NO: 1028424 - DNA, 20 bp, Homo sapiens
cttttagggagctggtctga

SEQ ID NO: 1028425 - DNA, 15 bp, Homo sapiens
cttttagtgtttact

SEQ ID NO: 1028426 - DNA, 18 bp, Homo sapiens
cttttagttcatatatac

SEQ ID NO: 1028427 - DNA, 19 bp, Homo sapiens
cttttagttgtatctcttt

SEQ ID NO: 1028428 - DNA, 21 bp, Homo sapiens
cttttagtttgatcagacagc

SEQ ID NO: 1028429 - DNA, 20 bp, Homo sapiens
cttttataaactttaccttt

SEQ ID NO: 1028430 - DNA, 21 bp, Homo sapiens
cttttataaactttacctttt

SEQ ID NO: 1028431 - DNA, 11 bp, Homo sapiens
cttttataaat

SEQ ID NO: 1028432 - DNA, 13 bp, Homo sapiens
cttttataaatta

SEQ ID NO: 1028433 - DNA, 16 bp, Homo sapiens
cttttataaattaaat

SEQ ID NO: 1028434 - DNA, 18 bp, Homo sapiens
cttttataaattaaatat

SEQ ID NO: 1028435 - DNA, 14 bp, Homo sapiens
cttttataatgatt

SEQ ID NO: 1028436 - DNA, 12 bp, Homo sapiens
cttttatactct

SEQ ID NO: 1028437 - DNA, 14 bp, Homo sapiens
cttttatattctaa

SEQ ID NO: 1028438 - DNA, 20 bp, Homo sapiens
cttttatattctaatagttt

SEQ ID NO: 1028439 - DNA, 22 bp, Homo sapiens
cttttatattctaatagttttt

SEQ ID NO: 1028440 - DNA, 13 bp, Homo sapiens
cttttatcaaaca

SEQ ID NO: 1028441 - DNA, 19 bp, Homo sapiens
cttttatctggtgcctcct

SEQ ID NO: 1028442 - DNA, 14 bp, Homo sapiens
cttttatgtagcac

SEQ ID NO: 1028443 - DNA, 14 bp, Homo sapiens
cttttattaatgca

SEQ ID NO: 1028444 - DNA, 15 bp, Homo sapiens
cttttattatcagtt

SEQ ID NO: 1028445 - DNA, 16 bp, Homo sapiens
cttttattcctttgaa

SEQ ID NO: 1028446 - DNA, 18 bp, Homo sapiens
cttttattgacacagaaa

SEQ ID NO: 1028447 - DNA, 13 bp, Homo sapiens
cttttattgtata

SEQ ID NO: 1028448 - DNA, 13 bp, Homo sapiens
cttttattgtcag

SEQ ID NO: 1028449 - DNA, 13 bp, Homo sapiens
cttttatttctcc

SEQ ID NO: 1028450 - DNA, 19 bp, Homo sapiens
cttttattttttaaatgta

SEQ ID NO: 1028451 - DNA, 19 bp, Homo sapiens
cttttattttttcttttgt

SEQ ID NO: 1028452 - DNA, 23 bp, Homo sapiens
cttttattttttcttttgtaatt

SEQ ID NO: 1028453 - DNA, 19 bp, Homo sapiens
cttttcaagtaattttcat

SEQ ID NO: 1028454 - DNA, 18 bp, Homo sapiens
cttttcaatgtgattctt

SEQ ID NO: 1028455 - DNA, 21 bp, Homo sapiens
cttttcaatgtgattcttcta

SEQ ID NO: 1028456 - DNA, 20 bp, Homo sapiens
cttttcaatttgtcatgtta

SEQ ID NO: 1028457 - DNA, 19 bp, Homo sapiens
cttttcacactgtcttccc

SEQ ID NO: 1028458 - DNA, 20 bp, Homo sapiens
cttttcacactgtcttcccg

SEQ ID NO: 1028459 - DNA, 20 bp, Homo sapiens
cttttcacatagctgtctag

SEQ ID NO: 1028460 - DNA, 21 bp, Homo sapiens
cttttcacatccatttcccct

SEQ ID NO: 1028461 - DNA, 21 bp, Homo sapiens
cttttcacatgctaatgtgca

SEQ ID NO: 1028462 - DNA, 19 bp, Homo sapiens
cttttcacattaggctgtt

SEQ ID NO: 1028463 - DNA, 15 bp, Homo sapiens
cttttcacgttttct

SEQ ID NO: 1028464 - DNA, 16 bp, Homo sapiens
cttttcactgctggct

SEQ ID NO: 1028465 - DNA, 21 bp, Homo sapiens
cttttcagaagtgagctttgc

SEQ ID NO: 1028466 - DNA, 20 bp, Homo sapiens
cttttcagccaatttgtctc

SEQ ID NO: 1028467 - DNA, 21 bp, Homo sapiens
cttttcagccaatttgtctcc

SEQ ID NO: 1028468 - DNA, 13 bp, Homo sapiens
cttttcagggctg

SEQ ID NO: 1028469 - DNA, 23 bp, Homo sapiens
cttttcataaagggttgaaaatg

SEQ ID NO: 1028470 - DNA, 18 bp, Homo sapiens
cttttcataggtctgaaa

SEQ ID NO: 1028471 - DNA, 15 bp, Homo sapiens
cttttcatatcattt

SEQ ID NO: 1028472 - DNA, 18 bp, Homo sapiens
cttttcatcaaaaagcct

SEQ ID NO: 1028473 - DNA, 21 bp, Homo sapiens
cttttcatcaccgtcccgcac

SEQ ID NO: 1028474 - DNA, 13 bp, Homo sapiens
cttttcatctggg

SEQ ID NO: 1028475 - DNA, 16 bp, Homo sapiens
cttttcatctgggaaa

SEQ ID NO: 1028476 - DNA, 18 bp, Homo sapiens
cttttcatctgttgttct

SEQ ID NO: 1028477 - DNA, 22 bp, Homo sapiens
cttttcatgtacagcattaaaa

SEQ ID NO: 1028478 - DNA, 15 bp, Homo sapiens
cttttcattagcagt

SEQ ID NO: 1028479 - DNA, 17 bp, Homo sapiens
cttttcccaggaatatc

SEQ ID NO: 1028480 - DNA, 16 bp, Homo sapiens
cttttcccctacagaa

SEQ ID NO: 1028481 - DNA, 15 bp, Homo sapiens
cttttcccctgttaa

SEQ ID NO: 1028482 - DNA, 15 bp, Homo sapiens
cttttccctatccac

SEQ ID NO: 1028483 - DNA, 14 bp, Homo sapiens
cttttccctctcta

SEQ ID NO: 1028484 - DNA, 13 bp, Homo sapiens
cttttccctcttt

SEQ ID NO: 1028485 - DNA, 20 bp, Homo sapiens
cttttccctctttggctccc

SEQ ID NO: 1028486 - DNA, 16 bp, Homo sapiens
cttttccctcttttct

SEQ ID NO: 1028487 - DNA, 14 bp, Homo sapiens
cttttcccttcttt

SEQ ID NO: 1028488 - DNA, 15 bp, Homo sapiens
cttttcccttgcttc

SEQ ID NO: 1028489 - DNA, 19 bp, Homo sapiens
cttttccctttgtgagtca

SEQ ID NO: 1028490 - DNA, 14 bp, Homo sapiens
cttttcctcaagca

SEQ ID NO: 1028491 - DNA, 13 bp, Homo sapiens
cttttcctccctt

SEQ ID NO: 1028492 - DNA, 16 bp, Homo sapiens
cttttcctctctcccg

SEQ ID NO: 1028493 - DNA, 13 bp, Homo sapiens
cttttcctctctg

SEQ ID NO: 1028494 - DNA, 17 bp, Homo sapiens
cttttcctctctgtctg

SEQ ID NO: 1028495 - DNA, 19 bp, Homo sapiens
cttttcctgataaagcaca

SEQ ID NO: 1028496 - DNA, 17 bp, Homo sapiens
cttttcctggcagctgc

SEQ ID NO: 1028497 - DNA, 21 bp, Homo sapiens
cttttcctgggaatggaataa

SEQ ID NO: 1028498 - DNA, 13 bp, Homo sapiens
cttttccttacca

SEQ ID NO: 1028499 - DNA, 16 bp, Homo sapiens
cttttccttatactgt

SEQ ID NO: 1028500 - DNA, 15 bp, Homo sapiens
cttttccttcattca

SEQ ID NO: 1028501 - DNA, 16 bp, Homo sapiens
cttttccttccctttt

SEQ ID NO: 1028502 - DNA, 20 bp, Homo sapiens
cttttccttcccttttctgt

SEQ ID NO: 1028503 - DNA, 22 bp, Homo sapiens
cttttccttcccttttctgttc

SEQ ID NO: 1028504 - DNA, 15 bp, Homo sapiens
cttttcctttatcca

SEQ ID NO: 1028505 - DNA, 16 bp, Homo sapiens
cttttcctttctggcc

SEQ ID NO: 1028506 - DNA, 16 bp, Homo sapiens
cttttccttttcttaa

SEQ ID NO: 1028507 - DNA, 11 bp, Homo sapiens
cttttcgttaa

SEQ ID NO: 1028508 - DNA, 15 bp, Homo sapiens
cttttcgttaacatt

SEQ ID NO: 1028509 - DNA, 20 bp, Homo sapiens
cttttcgttaacattgacca

SEQ ID NO: 1028510 - DNA, 13 bp, Homo sapiens
cttttctaagaaa

SEQ ID NO: 1028511 - DNA, 17 bp, Homo sapiens
cttttctaccctagcca

SEQ ID NO: 1028512 - DNA, 15 bp, Homo sapiens
cttttctagagacac

SEQ ID NO: 1028513 - DNA, 18 bp, Homo sapiens
cttttctaggctacaatt

SEQ ID NO: 1028514 - DNA, 15 bp, Homo sapiens
cttttctataagttg

SEQ ID NO: 1028515 - DNA, 23 bp, Homo sapiens
cttttctatgttgctattgtaag

SEQ ID NO: 1028516 - DNA, 17 bp, Homo sapiens
gttcttacaagcttaaa

SEQ ID NO: 1028517 - DNA, 22 bp, Homo sapiens
gttcttagattcaggggaaggg

SEQ ID NO: 1028518 - DNA, 17 bp, Homo sapiens
gttcttagttctcactg

SEQ ID NO: 1028519 - DNA, 22 bp, Homo sapiens
gttcttagttgacaacctagaa

SEQ ID NO: 1028520 - DNA, 17 bp, Homo sapiens
gttcttagtttgcagtt

SEQ ID NO: 1028521 - DNA, 15 bp, Homo sapiens
gttcttatgaggagg

SEQ ID NO: 1028522 - DNA, 14 bp, Homo sapiens
gttcttcacctcta

SEQ ID NO: 1028523 - DNA, 17 bp, Homo sapiens
gttcttcacctctatcc

SEQ ID NO: 1028524 - DNA, 15 bp, Homo sapiens
gttcttcctgtaatc

SEQ ID NO: 1028525 - DNA, 23 bp, Homo sapiens
gttcttgaagcatttcaaagccc

SEQ ID NO: 1028526 - DNA, 16 bp, Homo sapiens
gttcttgaagctgggc

SEQ ID NO: 1028527 - DNA, 19 bp, Homo sapiens
gttcttgaagctgggctgt

SEQ ID NO: 1028528 - DNA, 16 bp, Homo sapiens
gttgccttatttctca

SEQ ID NO: 1028529 - DNA, 17 bp, Homo sapiens
gttgccttatttctcat

SEQ ID NO: 1028530 - DNA, 17 bp, Homo sapiens
gttgcgacggagagaaa

SEQ ID NO: 1028531 - DNA, 20 bp, Homo sapiens
gttgcgacggagagaaaaaa

SEQ ID NO: 1028532 - DNA, 15 bp, Homo sapiens
gttgcgtctgaggcc

SEQ ID NO: 1028533 - DNA, 14 bp, Homo sapiens
gttgctagggagag

SEQ ID NO: 1028534 - DNA, 21 bp, Homo sapiens
gttgctattgtaaggtctttg

SEQ ID NO: 1028535 - DNA, 18 bp, Homo sapiens
gttgctcaaaaaatgagc

SEQ ID NO: 1028536 - DNA, 22 bp, Homo sapiens
gttgctcagtctccctttccct

SEQ ID NO: 1028537 - DNA, 22 bp, Homo sapiens
gttgctccgcctggcctggcca

SEQ ID NO: 1028538 - DNA, 15 bp, Homo sapiens
gttgctgaagatgcc

SEQ ID NO: 1028539 - DNA, 13 bp, Homo sapiens
gttgctggagggg

SEQ ID NO: 1028540 - DNA, 15 bp, Homo sapiens
gttgctggaggggct

SEQ ID NO: 1028541 - DNA, 16 bp, Homo sapiens
gttgctggaggggctg

SEQ ID NO: 1028542 - DNA, 18 bp, Homo sapiens
gttgctggatcaggaagc

SEQ ID NO: 1028543 - DNA, 16 bp, Homo sapiens
gttgctgggagctgaa

SEQ ID NO: 1028544 - DNA, 22 bp, Homo sapiens
gttgctgggattacaggtgtga

SEQ ID NO: 1028545 - DNA, 15 bp, Homo sapiens
gttgctggtcaggtc

SEQ ID NO: 1028546 - DNA, 19 bp, Homo sapiens
gttgctgtcataagaatga

SEQ ID NO: 1028547 - DNA, 12 bp, Homo sapiens
gttgctgtggac

SEQ ID NO: 1028548 - DNA, 20 bp, Homo sapiens
gttgctgtggaccaatgcat

SEQ ID NO: 1028549 - DNA, 23 bp, Homo sapiens
gttgctgtggaccaatgcatctc

SEQ ID NO: 1028550 - DNA, 15 bp, Homo sapiens
gttgctgtttcacaa

SEQ ID NO: 1028551 - DNA, 19 bp, Homo sapiens
gttgctgttttcctccctt

SEQ ID NO: 1028552 - DNA, 23 bp, Homo sapiens
gttgcttagatgagggtgactgt

SEQ ID NO: 1028553 - DNA, 12 bp, Homo sapiens
gttgcttcagac

SEQ ID NO: 1028554 - DNA, 13 bp, Homo sapiens
gttgcttctgaat

SEQ ID NO: 1028555 - DNA, 14 bp, Homo sapiens
gttgcttctgagtg

SEQ ID NO: 1028556 - DNA, 17 bp, Homo sapiens
gttgctttcttcctgca

SEQ ID NO: 1028557 - DNA, 17 bp, Homo sapiens
gttgctttgcccaagat

SEQ ID NO: 1028558 - DNA, 15 bp, Homo sapiens
gttgcttttattgca

SEQ ID NO: 1028559 - DNA, 15 bp, Homo sapiens
gttggaaaagaatac

SEQ ID NO: 1028560 - DNA, 22 bp, Homo sapiens
gttggaaaagaatacagaaaga

SEQ ID NO: 1028561 - DNA, 16 bp, Homo sapiens
gttggaaaatgtgtct

SEQ ID NO: 1028562 - DNA, 16 bp, Homo sapiens
gttggaaagcaggtgg

SEQ ID NO: 1028563 - DNA, 22 bp, Homo sapiens
gttggaactatacccgggacca

SEQ ID NO: 1028564 - DNA, 17 bp, Homo sapiens
gttggaaggatctgctg

SEQ ID NO: 1028565 - DNA, 19 bp, Homo sapiens
gttggaaggatctgctgag

SEQ ID NO: 1028566 - DNA, 22 bp, Homo sapiens
gttggaatgaattaaataaacc

SEQ ID NO: 1028567 - DNA, 15 bp, Homo sapiens
gttggaatggatttt

SEQ ID NO: 1028568 - DNA, 14 bp, Homo sapiens
gttggacagccccc

SEQ ID NO: 1028569 - DNA, 16 bp, Homo sapiens
gttggacagctgcttg

SEQ ID NO: 1028570 - DNA, 15 bp, Homo sapiens
gttggacccgctctg

SEQ ID NO: 1028571 - DNA, 18 bp, Homo sapiens
gttggacccgctctggac

SEQ ID NO: 1028572 - DNA, 14 bp, Homo sapiens
gttggactctcagg

SEQ ID NO: 1028573 - DNA, 17 bp, Homo sapiens
gttggacttgagaaaga

SEQ ID NO: 1028574 - DNA, 17 bp, Homo sapiens
gttggacttttcgttaa

SEQ ID NO: 1028575 - DNA, 13 bp, Homo sapiens
gttggagagcagc

SEQ ID NO: 1028576 - DNA, 13 bp, Homo sapiens
gttggagagccct

SEQ ID NO: 1028577 - DNA, 15 bp, Homo sapiens
gttggagctcattct

SEQ ID NO: 1028578 - DNA, 21 bp, Homo sapiens
gttggaggaccccgagggctg

SEQ ID NO: 1028579 - DNA, 13 bp, Homo sapiens
gttggagggaacc

SEQ ID NO: 1028580 - DNA, 20 bp, Homo sapiens
gttggagggaaccaccagcg

SEQ ID NO: 1028581 - DNA, 13 bp, Homo sapiens
gttggatgtctgt

SEQ ID NO: 1028582 - DNA, 19 bp, Homo sapiens
gttggcaagctgcaggttt

SEQ ID NO: 1028583 - DNA, 20 bp, Homo sapiens
gttggcagaaatacagtctt

SEQ ID NO: 1028584 - DNA, 20 bp, Homo sapiens
gttggcagaccgggcccccc

SEQ ID NO: 1028585 - DNA, 18 bp, Homo sapiens
gttggcagagaaggcctc

SEQ ID NO: 1028586 - DNA, 13 bp, Homo sapiens
gttggcaggctgg

SEQ ID NO: 1028587 - DNA, 14 bp, Homo sapiens
gttggcaggctggc

SEQ ID NO: 1028588 - DNA, 15 bp, Homo sapiens
gttggcaggctggcc

SEQ ID NO: 1028589 - DNA, 15 bp, Homo sapiens
gttggccaggctggt

SEQ ID NO: 1028590 - DNA, 20 bp, Homo sapiens
gttggccatgtattatgaaa

SEQ ID NO: 1028591 - DNA, 15 bp, Homo sapiens
gttggctagtacttt

SEQ ID NO: 1028592 - DNA, 16 bp, Homo sapiens
gttggctcaggcagac

SEQ ID NO: 1028593 - DNA, 11 bp, Homo sapiens
gttggctgagc

SEQ ID NO: 1028594 - DNA, 22 bp, Homo sapiens
gttgggaaggggtcctgcaggg

SEQ ID NO: 1028595 - DNA, 15 bp, Homo sapiens
gttgggagcctagct

SEQ ID NO: 1028596 - DNA, 16 bp, Homo sapiens
gttgggagcctagctc

SEQ ID NO: 1028597 - DNA, 18 bp, Homo sapiens
gttgggatctaggagagg

SEQ ID NO: 1028598 - DNA, 20 bp, Homo sapiens
gttgggattcctgacccagg

SEQ ID NO: 1028599 - DNA, 21 bp, Homo sapiens
gttgggattcctgacccaggc

SEQ ID NO: 1028600 - DNA, 16 bp, Homo sapiens
gttgggcccagatctg

SEQ ID NO: 1028601 - DNA, 17 bp, Homo sapiens
gttgggcccagatctgg

SEQ ID NO: 1028602 - DNA, 14 bp, Homo sapiens
gttggggaaggcaa

SEQ ID NO: 1028603 - DNA, 13 bp, Homo sapiens
gttggggagctgg

SEQ ID NO: 1028604 - DNA, 17 bp, Homo sapiens
gttggggagggatgaag

SEQ ID NO: 1028605 - DNA, 21 bp, Homo sapiens
gttggggccctcttgccagcc

SEQ ID NO: 1028606 - DNA, 22 bp, Homo sapiens
gttggggctgccatagggtctg

SEQ ID NO: 1028607 - DNA, 14 bp, Homo sapiens
gttggggcttcaca

SEQ ID NO: 1028608 - DNA, 15 bp, Homo sapiens
gttggggtgggaggg

SEQ ID NO: 1028609 - DNA, 13 bp, Homo sapiens
gttggtcaggctg

SEQ ID NO: 1028610 - DNA, 14 bp, Homo sapiens
gttggtcctctctc

SEQ ID NO: 1028611 - DNA, 14 bp, Homo sapiens
gttggtgactgaaa

SEQ ID NO: 1028612 - DNA, 13 bp, Homo sapiens
gttggtgccactt

SEQ ID NO: 1028613 - DNA, 18 bp, Homo sapiens
gttggtgggctggcccag

SEQ ID NO: 1028614 - DNA, 21 bp, Homo sapiens
gttggttagccgactgtcttg

SEQ ID NO: 1028615 - DNA, 14 bp, Homo sapiens
gttggttccttggg

SEQ ID NO: 1028616 - DNA, 15 bp, Homo sapiens
gttggttctgcacta

SEQ ID NO: 1028617 - DNA, 20 bp, Homo sapiens
gttggtttcactgagagctg

SEQ ID NO: 1028618 - DNA, 14 bp, Homo sapiens
gttggtttcccctg

SEQ ID NO: 1028619 - DNA, 16 bp, Homo sapiens
gttggtttcccctgca

SEQ ID NO: 1028620 - DNA, 14 bp, Homo sapiens
gttggtttgtatga

SEQ ID NO: 1028621 - DNA, 13 bp, Homo sapiens
gttgtaaaatata

SEQ ID NO: 1028622 - DNA, 20 bp, Homo sapiens
gttgtaaataattttctaag

SEQ ID NO: 1028623 - DNA, 14 bp, Homo sapiens
gttgtaaatatata

SEQ ID NO: 1028624 - DNA, 15 bp, Homo sapiens
gttgtaaatatataa

SEQ ID NO: 1028625 - DNA, 20 bp, Homo sapiens
gttgtaaatatttatgtaaa

SEQ ID NO: 1028626 - DNA, 18 bp, Homo sapiens
gttgtaaatgctcgtgtg

SEQ ID NO: 1028627 - DNA, 20 bp, Homo sapiens
gttgtaaatgctcgtgtgat

SEQ ID NO: 1028628 - DNA, 14 bp, Homo sapiens
gttgtaaattggca

SEQ ID NO: 1028629 - DNA, 22 bp, Homo sapiens
gttgtaaattggcatggaaatt

SEQ ID NO: 1028630 - DNA, 17 bp, Homo sapiens
gttgtaacctgctgtga

SEQ ID NO: 1028631 - DNA, 20 bp, Homo sapiens
gttgtaagtaataatttgta

SEQ ID NO: 1028632 - DNA, 15 bp, Homo sapiens
gttgtaatagtccat

SEQ ID NO: 1028633 - DNA, 14 bp, Homo sapiens
gttgtaatgctgca

SEQ ID NO: 1028634 - DNA, 23 bp, Homo sapiens
gttgtactatggaaaatcagctg

SEQ ID NO: 1028635 - DNA, 14 bp, Homo sapiens
gttgtagtaaagaa

SEQ ID NO: 1028636 - DNA, 16 bp, Homo sapiens
gttgtataaatttatt

SEQ ID NO: 1028637 - DNA, 15 bp, Homo sapiens
gttgtatctacagta

SEQ ID NO: 1028638 - DNA, 16 bp, Homo sapiens
gttgtatgattccaat

SEQ ID NO: 1028639 - DNA, 13 bp, Homo sapiens
gttgtatgtttgc

SEQ ID NO: 1028640 - DNA, 16 bp, Homo sapiens
gttgtattaacaaaag

SEQ ID NO: 1028641 - DNA, 20 bp, Homo sapiens
gttgtattcaccccacaccc

SEQ ID NO: 1028642 - DNA, 13 bp, Homo sapiens
gttgtattcttct

SEQ ID NO: 1028643 - DNA, 19 bp, Homo sapiens
gttgtatttgttatttatt

SEQ ID NO: 1028644 - DNA, 15 bp, Homo sapiens
gttgtcaaagaagct

SEQ ID NO: 1028645 - DNA, 18 bp, Homo sapiens
gttgtcaagaatagcatt

SEQ ID NO: 1028646 - DNA, 17 bp, Homo sapiens
gttgtcaagtctctgct

SEQ ID NO: 1028647 - DNA, 17 bp, Homo sapiens
gttgtcaatattaaata

SEQ ID NO: 1028648 - DNA, 15 bp, Homo sapiens
cttttgttttttggg

SEQ ID NO: 1028649 - DNA, 13 bp, Homo sapiens
ctttttaaaaaat

SEQ ID NO: 1028650 - DNA, 19 bp, Homo sapiens
ctttttaaaaactcttcag

SEQ ID NO: 1028651 - DNA, 11 bp, Homo sapiens
gaaaagaaaaa

SEQ ID NO: 1028652 - DNA, 13 bp, Homo sapiens
gaaaagaaacaag

SEQ ID NO: 1028653 - DNA, 16 bp, Homo sapiens
gaaaagaacaaacaaa

SEQ ID NO: 1028654 - DNA, 15 bp, Homo sapiens
gaaaagaagtagtgt

SEQ ID NO: 1028655 - DNA, 16 bp, Homo sapiens
gaaaagaatacagaaa

SEQ ID NO: 1028656 - DNA, 18 bp, Homo sapiens
gaaaagaatacagaaaga

SEQ ID NO: 1028657 - DNA, 18 bp, Homo sapiens
gtttagtggctcaacatt

SEQ ID NO: 1028658 - DNA, 19 bp, Homo sapiens
gtttagtttctagaggcct

SEQ ID NO: 1028659 - DNA, 15 bp, Homo sapiens
gtttagtttgcattt

SEQ ID NO: 1028660 - DNA, 21 bp, Homo sapiens
gtttataaaggtaaaatggca

SEQ ID NO: 1028661 - DNA, 13 bp, Homo sapiens
gtttataataaaa

SEQ ID NO: 1028662 - DNA, 14 bp, Homo sapiens
gtttataataaaaa

SEQ ID NO: 1028663 - DNA, 13 bp, Homo sapiens
gtttataatctga

SEQ ID NO: 1028664 - DNA, 16 bp, Homo sapiens
gtttatacacaacttt

SEQ ID NO: 1028665 - DNA, 14 bp, Homo sapiens
gtttatacagaact

SEQ ID NO: 1028666 - DNA, 23 bp, Homo sapiens
gtttatactgtatttctaagaag

SEQ ID NO: 1028667 - DNA, 17 bp, Homo sapiens
gtttatagacattatgt

SEQ ID NO: 1028668 - DNA, 20 bp, Homo sapiens
gtttatagcaaacttggaat

SEQ ID NO: 1028669 - DNA, 23 bp, Homo sapiens
gtttatataaataaatgtttcta

SEQ ID NO: 1028670 - DNA, 16 bp, Homo sapiens
gtttatataaggcagt

SEQ ID NO: 1028671 - DNA, 19 bp, Homo sapiens
gtttatatggaagaaagta

SEQ ID NO: 1028672 - DNA, 14 bp, Homo sapiens
gtttatattgtgga

SEQ ID NO: 1028673 - DNA, 19 bp, Homo sapiens
gtttatcagatacatcact

SEQ ID NO: 1028674 - DNA, 15 bp, Homo sapiens
gtttatcagcaaaaa

SEQ ID NO: 1028675 - DNA, 14 bp, Homo sapiens
gtttatcattcaag

SEQ ID NO: 1028676 - DNA, 16 bp, Homo sapiens
gtttatcattcaagtg

SEQ ID NO: 1028677 - DNA, 15 bp, Homo sapiens
gtttatccaaatctt

SEQ ID NO: 1028678 - DNA, 18 bp, Homo sapiens
gtttatgaaaaagaagaa

SEQ ID NO: 1028679 - DNA, 21 bp, Homo sapiens
gtttatgagatgctggttttc

SEQ ID NO: 1028680 - DNA, 13 bp, Homo sapiens
gtttatgagccag

SEQ ID NO: 1028681 - DNA, 21 bp, Homo sapiens
gtttatgatatttcttgcttt

SEQ ID NO: 1028682 - DNA, 16 bp, Homo sapiens
gtttatgccaaatgtt

SEQ ID NO: 1028683 - DNA, 13 bp, Homo sapiens
gtttatgtaatag

SEQ ID NO: 1028684 - DNA, 17 bp, Homo sapiens
gtttatgtgttatgaac

SEQ ID NO: 1028685 - DNA, 22 bp, Homo sapiens
gtttattaaaattctgaatttt

SEQ ID NO: 1028686 - DNA, 14 bp, Homo sapiens
gtttattaaatgct

SEQ ID NO: 1028687 - DNA, 18 bp, Homo sapiens
gtttattaacaaattatg

SEQ ID NO: 1028688 - DNA, 20 bp, Homo sapiens
gtttattaatcttagtgtat

SEQ ID NO: 1028689 - DNA, 22 bp, Homo sapiens
gtttattaatcttagtgtatga

SEQ ID NO: 1028690 - DNA, 23 bp, Homo sapiens
gtttattaatcttagtgtatgat

SEQ ID NO: 1028691 - DNA, 15 bp, Homo sapiens
gtttattacaagttt

SEQ ID NO: 1028692 - DNA, 19 bp, Homo sapiens
gtttattacttccatgaat

SEQ ID NO: 1028693 - DNA, 20 bp, Homo sapiens
gtttattcccaagtatgcct

SEQ ID NO: 1028694 - DNA, 18 bp, Homo sapiens
gtttattgatattcaata

SEQ ID NO: 1028695 - DNA, 14 bp, Homo sapiens
gtttattggaagtg

SEQ ID NO: 1028696 - DNA, 20 bp, Homo sapiens
gtttattggaagtgttcaag

SEQ ID NO: 1028697 - DNA, 14 bp, Homo sapiens
gtttattgtttgat

SEQ ID NO: 1028698 - DNA, 17 bp, Homo sapiens
gtttatttagctctgaa

SEQ ID NO: 1028699 - DNA, 16 bp, Homo sapiens
gtttatttatcagtga

SEQ ID NO: 1028700 - DNA, 15 bp, Homo sapiens
gtttatttattcact

SEQ ID NO: 1028701 - DNA, 18 bp, Homo sapiens
gtttatttttcatattgt

SEQ ID NO: 1028702 - DNA, 18 bp, Homo sapiens
gtttattttttctacaca

SEQ ID NO: 1028703 - DNA, 17 bp, Homo sapiens
gtttcaaactttactat

SEQ ID NO: 1028704 - DNA, 23 bp, Homo sapiens
gtttcaaccaagtcatgtgcatt

SEQ ID NO: 1028705 - DNA, 16 bp, Homo sapiens
gtttcaagaaaatctt

SEQ ID NO: 1028706 - DNA, 20 bp, Homo sapiens
gtttcaagaaaatctttgtt

SEQ ID NO: 1028707 - DNA, 23 bp, Homo sapiens
gtttcaagttattcaaatttgta

SEQ ID NO: 1028708 - DNA, 21 bp, Homo sapiens
gtttcaatgcatacaataaaa

SEQ ID NO: 1028709 - DNA, 13 bp, Homo sapiens
gtttcaatgtgat

SEQ ID NO: 1028710 - DNA, 15 bp, Homo sapiens
gtttcacacaaacaa

SEQ ID NO: 1028711 - DNA, 16 bp, Homo sapiens
gtttcaccttccctcg

SEQ ID NO: 1028712 - DNA, 15 bp, Homo sapiens
gtttcactccaccat

SEQ ID NO: 1028713 - DNA, 18 bp, Homo sapiens
gtttcactccctcttggt

SEQ ID NO: 1028714 - DNA, 21 bp, Homo sapiens
gtttcactgaaatgtttggat

SEQ ID NO: 1028715 - DNA, 18 bp, Homo sapiens
gtttcactgtactgcatg

SEQ ID NO: 1028716 - DNA, 17 bp, Homo sapiens
gtttcacttaatgtttc

SEQ ID NO: 1028717 - DNA, 18 bp, Homo sapiens
gtttcagaaatgtgttat

SEQ ID NO: 1028718 - DNA, 16 bp, Homo sapiens
gtttcagaattttgta

SEQ ID NO: 1028719 - DNA, 13 bp, Homo sapiens
gtttcagacaggg

SEQ ID NO: 1028720 - DNA, 14 bp, Homo sapiens
gtttcagacccccc

SEQ ID NO: 1028721 - DNA, 22 bp, Homo sapiens
gtttcagcaacaagactgccag

SEQ ID NO: 1028722 - DNA, 18 bp, Homo sapiens
gtttcagcgactccgttg

SEQ ID NO: 1028723 - DNA, 15 bp, Homo sapiens
gtttcaggtttccat

SEQ ID NO: 1028724 - DNA, 19 bp, Homo sapiens
gtttcagtttttttaaatg

SEQ ID NO: 1028725 - DNA, 16 bp, Homo sapiens
gtttcattcatcctga

SEQ ID NO: 1028726 - DNA, 11 bp, Homo sapiens
gtttcattgac

SEQ ID NO: 1028727 - DNA, 16 bp, Homo sapiens
gtttcatttctgcaga

SEQ ID NO: 1028728 - DNA, 15 bp, Homo sapiens
gtttccaaaggttcc

SEQ ID NO: 1028729 - DNA, 17 bp, Homo sapiens
gtttccaaatccctttc

SEQ ID NO: 1028730 - DNA, 16 bp, Homo sapiens
gtttccaacctggagt

SEQ ID NO: 1028731 - DNA, 20 bp, Homo sapiens
gtttccaacttgtctgggaa

SEQ ID NO: 1028732 - DNA, 17 bp, Homo sapiens
gtttccaatgtgttcaa

SEQ ID NO: 1028733 - DNA, 21 bp, Homo sapiens
gtttccaattatttgacttta

SEQ ID NO: 1028734 - DNA, 16 bp, Homo sapiens
gtttccacagcctgca

SEQ ID NO: 1028735 - DNA, 14 bp, Homo sapiens
gtttccatagttta

SEQ ID NO: 1028736 - DNA, 17 bp, Homo sapiens
gtttccatcatgtctgt

SEQ ID NO: 1028737 - DNA, 13 bp, Homo sapiens
gtttccatttact

SEQ ID NO: 1028738 - DNA, 21 bp, Homo sapiens
gtttcccataattttcttcat

SEQ ID NO: 1028739 - DNA, 21 bp, Homo sapiens
gtttcccatcccactgctccc

SEQ ID NO: 1028740 - DNA, 14 bp, Homo sapiens
gtttccccagggaa

SEQ ID NO: 1028741 - DNA, 16 bp, Homo sapiens
gtttccccatctctgt

SEQ ID NO: 1028742 - DNA, 18 bp, Homo sapiens
gtttccccatctctgtct

SEQ ID NO: 1028743 - DNA, 18 bp, Homo sapiens
gtttcccctgcactcccg

SEQ ID NO: 1028744 - DNA, 15 bp, Homo sapiens
gtttcctaaatccaa

SEQ ID NO: 1028745 - DNA, 20 bp, Homo sapiens
gtttcctccatttgagaaaa

SEQ ID NO: 1028746 - DNA, 20 bp, Homo sapiens
gtttcctctgttcaaagctg

SEQ ID NO: 1028747 - DNA, 22 bp, Homo sapiens
gtttcctctgttcaaagctgcc

SEQ ID NO: 1028748 - DNA, 14 bp, Homo sapiens
gtttcctcttccaa

SEQ ID NO: 1028749 - DNA, 13 bp, Homo sapiens
gtttcctgaaata

SEQ ID NO: 1028750 - DNA, 17 bp, Homo sapiens
gtttcctgacattgtct

SEQ ID NO: 1028751 - DNA, 14 bp, Homo sapiens
gtttcctgcaggcc

SEQ ID NO: 1028752 - DNA, 16 bp, Homo sapiens
gtttcctgcaggccag

SEQ ID NO: 1028753 - DNA, 17 bp, Homo sapiens
gtttcctgctccagtgt

SEQ ID NO: 1028754 - DNA, 20 bp, Homo sapiens
gtttccttgttggtcagagg

SEQ ID NO: 1028755 - DNA, 18 bp, Homo sapiens
gtttcctttctcatttct

SEQ ID NO: 1028756 - DNA, 18 bp, Homo sapiens
gtttcgaagttgatgcaa

SEQ ID NO: 1028757 - DNA, 18 bp, Homo sapiens
gtttcgactggtccagct

SEQ ID NO: 1028758 - DNA, 17 bp, Homo sapiens
gtttcgagtaaacttga

SEQ ID NO: 1028759 - DNA, 18 bp, Homo sapiens
gtttcgagtaaacttgaa

SEQ ID NO: 1028760 - DNA, 15 bp, Homo sapiens
gtttcgtggggaggt

SEQ ID NO: 1028761 - DNA, 23 bp, Homo sapiens
gtttcgtggggaggtctaatcta

SEQ ID NO: 1028762 - DNA, 13 bp, Homo sapiens
gtttctaaaacta

SEQ ID NO: 1028763 - DNA, 22 bp, Homo sapiens
gtttctaaaggctacctttgta

SEQ ID NO: 1028764 - DNA, 18 bp, Homo sapiens
gtttctaagaaaatgtag

SEQ ID NO: 1028765 - DNA, 23 bp, Homo sapiens
gtttctaccggagagagaatgta

SEQ ID NO: 1028766 - DNA, 14 bp, Homo sapiens
gtttctagcctctg

SEQ ID NO: 1028767 - DNA, 15 bp, Homo sapiens
gtttctagggaaatg

SEQ ID NO: 1028768 - DNA, 22 bp, Homo sapiens
gtttctatgacacatgcaaggt

SEQ ID NO: 1028769 - DNA, 16 bp, Homo sapiens
gtttctcagaagtact

SEQ ID NO: 1028770 - DNA, 14 bp, Homo sapiens
gtttctcagctccc

SEQ ID NO: 1028771 - DNA, 17 bp, Homo sapiens
gtttctcattaaactct

SEQ ID NO: 1028772 - DNA, 17 bp, Homo sapiens
gtttctccccctgggct

SEQ ID NO: 1028773 - DNA, 15 bp, Homo sapiens
gtttgggggaaaaaa

SEQ ID NO: 1028774 - DNA, 23 bp, Homo sapiens
gtttgggggaaaaaaaagaaaaa

SEQ ID NO: 1028775 - DNA, 17 bp, Homo sapiens
gtttgggtgattcctaa

SEQ ID NO: 1028776 - DNA, 15 bp, Homo sapiens
gtttggtagacttgg

SEQ ID NO: 1028777 - DNA, 16 bp, Homo sapiens
gtttggtccagcctgg

SEQ ID NO: 1028778 - DNA, 17 bp, Homo sapiens
gtttggtctggactgac

SEQ ID NO: 1028779 - DNA, 23 bp, Homo sapiens
gtttggtctgggacttccttgct

SEQ ID NO: 1028780 - DNA, 18 bp, Homo sapiens
gtttggttagaggaaggc

SEQ ID NO: 1028781 - DNA, 11 bp, Homo sapiens
gtttgtaaatt

SEQ ID NO: 1028782 - DNA, 13 bp, Homo sapiens
gtttgtaaattat

SEQ ID NO: 1028783 - DNA, 15 bp, Homo sapiens
gtttgtaaattattt

SEQ ID NO: 1028784 - DNA, 17 bp, Homo sapiens
gtttgtaaattatttgc

SEQ ID NO: 1028785 - DNA, 18 bp, Homo sapiens
gtttgtaaattatttgct

SEQ ID NO: 1028786 - DNA, 17 bp, Homo sapiens
gtttgtacagtaatatg

SEQ ID NO: 1028787 - DNA, 21 bp, Homo sapiens
gaaaatgtttatgccacagaa

SEQ ID NO: 1028788 - DNA, 17 bp, Homo sapiens
gaaaattaaaataggca

SEQ ID NO: 1028789 - DNA, 18 bp, Homo sapiens
gaaaattaaaataggcat

SEQ ID NO: 1028790 - DNA, 19 bp, Homo sapiens
gaaaattaattatatttct

SEQ ID NO: 1028791 - DNA, 14 bp, Homo sapiens
gaaaattagactgt

SEQ ID NO: 1028792 - DNA, 18 bp, Homo sapiens
gaaaattaggatttcatg

SEQ ID NO: 1028793 - DNA, 22 bp, Homo sapiens
gaaaattagtgaccattattca

SEQ ID NO: 1028794 - DNA, 19 bp, Homo sapiens
gaaaattcaaaaagtgttt

SEQ ID NO: 1028795 - DNA, 18 bp, Homo sapiens
gaaaattccagaaaggat

SEQ ID NO: 1028796 - DNA, 20 bp, Homo sapiens
gaaaattccagaaaggatat

SEQ ID NO: 1028797 - DNA, 13 bp, Homo sapiens
gaaaattcctaga

SEQ ID NO: 1028798 - DNA, 21 bp, Homo sapiens
gaaaattctaacccaagacat

SEQ ID NO: 1028799 - DNA, 20 bp, Homo sapiens
gaaaattctgtgccttgttt

SEQ ID NO: 1028800 - DNA, 16 bp, Homo sapiens
gaaaattgaaagtatt

SEQ ID NO: 1028801 - DNA, 13 bp, Homo sapiens
gaaaattgcatga

SEQ ID NO: 1028802 - DNA, 17 bp, Homo sapiens
gaaaattgcatgaaact

SEQ ID NO: 1028803 - DNA, 14 bp, Homo sapiens
gaaaattgtatacc

SEQ ID NO: 1028804 - DNA, 23 bp, Homo sapiens
gaaaattgtataccaatgtgttt

SEQ ID NO: 1028805 - DNA, 12 bp, Homo sapiens
gaaaattgtatt

SEQ ID NO: 1028806 - DNA, 15 bp, Homo sapiens
gaaaatttaaaacga

SEQ ID NO: 1028807 - DNA, 14 bp, Homo sapiens
gaaaatttaacagt

SEQ ID NO: 1028808 - DNA, 22 bp, Homo sapiens
gaaaatttacaaaatttattct

SEQ ID NO: 1028809 - DNA, 18 bp, Homo sapiens
gaaaatttagccctttaa

SEQ ID NO: 1028810 - DNA, 21 bp, Homo sapiens
gaaaatttgttattttgcaac

SEQ ID NO: 1028811 - DNA, 14 bp, Homo sapiens
gaaaattttacttc

SEQ ID NO: 1028812 - DNA, 17 bp, Homo sapiens
gaaaattttctccttgg

SEQ ID NO: 1028813 - DNA, 19 bp, Homo sapiens
gaaaattttgtattaattt

SEQ ID NO: 1028814 - DNA, 18 bp, Homo sapiens
gaaaatttttacattcat

SEQ ID NO: 1028815 - DNA, 15 bp, Homo sapiens
gaaacaaaaagagct

SEQ ID NO: 1028816 - DNA, 15 bp, Homo sapiens
gaaacaaaatcctca

SEQ ID NO: 1028817 - DNA, 12 bp, Homo sapiens
gaaacaaaatgt

SEQ ID NO: 1028818 - DNA, 22 bp, Homo sapiens
gaaacaaaccgaaaatggacat

SEQ ID NO: 1028819 - DNA, 17 bp, Homo sapiens
gaaacaaataatcacat

SEQ ID NO: 1028820 - DNA, 15 bp, Homo sapiens
gaaacaacagcttta

SEQ ID NO: 1028821 - DNA, 16 bp, Homo sapiens
gaaacaaccatgtcat

SEQ ID NO: 1028822 - DNA, 15 bp, Homo sapiens
gaaacaagctgtgca

SEQ ID NO: 1028823 - DNA, 14 bp, Homo sapiens
gaaacaatgaaaac

SEQ ID NO: 1028824 - DNA, 10 bp, Homo sapiens
gaaacaatgt

SEQ ID NO: 1028825 - DNA, 14 bp, Homo sapiens
gaaacacacaagca

SEQ ID NO: 1028826 - DNA, 23 bp, Homo sapiens
gaaacacacgtgctgtgggcctc

SEQ ID NO: 1028827 - DNA, 14 bp, Homo sapiens
gaaacacagaaacc

SEQ ID NO: 1028828 - DNA, 13 bp, Homo sapiens
gaaacacatgcca

SEQ ID NO: 1028829 - DNA, 21 bp, Homo sapiens
gaaacaccttctctggagcca

SEQ ID NO: 1028830 - DNA, 16 bp, Homo sapiens
gaaacactgaaaagaa

SEQ ID NO: 1028831 - DNA, 12 bp, Homo sapiens
gaaacactggac

SEQ ID NO: 1028832 - DNA, 19 bp, Homo sapiens
gaaacactggacctggggg

SEQ ID NO: 1028833 - DNA, 20 bp, Homo sapiens
gaaacactggacctgggggt

SEQ ID NO: 1028834 - DNA, 15 bp, Homo sapiens
gaaacacttctattt

SEQ ID NO: 1028835 - DNA, 22 bp, Homo sapiens
gaaacagaaacaaaaacactaa

SEQ ID NO: 1028836 - DNA, 17 bp, Homo sapiens
gaaacagaactcgatgc

SEQ ID NO: 1028837 - DNA, 17 bp, Homo sapiens
gaaacagagaaagaaaa

SEQ ID NO: 1028838 - DNA, 19 bp, Homo sapiens
gaaacagagacaggcccaa

SEQ ID NO: 1028839 - DNA, 19 bp, Homo sapiens
gaaacagaggagagtccca

SEQ ID NO: 1028840 - DNA, 20 bp, Homo sapiens
gaaacagaggagagtcccag

SEQ ID NO: 1028841 - DNA, 22 bp, Homo sapiens
gaaacagagtccaatttaagga

SEQ ID NO: 1028842 - DNA, 17 bp, Homo sapiens
gaaacagatgataaata

SEQ ID NO: 1028843 - DNA, 20 bp, Homo sapiens
gaaacagatgataaatattt

SEQ ID NO: 1028844 - DNA, 22 bp, Homo sapiens
gaaacagattcaggccagccca

SEQ ID NO: 1028845 - DNA, 17 bp, Homo sapiens
gaaacagcatgaataaa

SEQ ID NO: 1028846 - DNA, 20 bp, Homo sapiens
gaaacagcatgaataaaaca

SEQ ID NO: 1028847 - DNA, 15 bp, Homo sapiens
gaaacagctgcttct

SEQ ID NO: 1028848 - DNA, 19 bp, Homo sapiens
gaaacagctgcttctcccc

SEQ ID NO: 1028849 - DNA, 20 bp, Homo sapiens
gaaacagctgcttctccccc

SEQ ID NO: 1028850 - DNA, 16 bp, Homo sapiens
gaaacagctttcaagt

SEQ ID NO: 1028851 - DNA, 22 bp, Homo sapiens
gaaacaggaccacaaaaatgaa

SEQ ID NO: 1028852 - DNA, 17 bp, Homo sapiens
gaaacagggacaaagaa

SEQ ID NO: 1028853 - DNA, 18 bp, Homo sapiens
gaaacagggacaaagaaa

SEQ ID NO: 1028854 - DNA, 12 bp, Homo sapiens
gaaacagggcag

SEQ ID NO: 1028855 - DNA, 20 bp, Homo sapiens
gaaacaggtgtgtgtgaact

SEQ ID NO: 1028856 - DNA, 17 bp, Homo sapiens
gaaacagttgcatgtag

SEQ ID NO: 1028857 - DNA, 21 bp, Homo sapiens
gaaacagttggtaacttttgt

SEQ ID NO: 1028858 - DNA, 14 bp, Homo sapiens
gaaacatatcatgg

SEQ ID NO: 1028859 - DNA, 14 bp, Homo sapiens
gaaacatctctggc

SEQ ID NO: 1028860 - DNA, 18 bp, Homo sapiens
gaaacatgaagcataatt

SEQ ID NO: 1028861 - DNA, 20 bp, Homo sapiens
gaaacatgactcgtatatgt

SEQ ID NO: 1028862 - DNA, 18 bp, Homo sapiens
gaaacattccgaagaggg

SEQ ID NO: 1028863 - DNA, 22 bp, Homo sapiens
gaaacattttatactgtacatg

SEQ ID NO: 1028864 - DNA, 16 bp, Homo sapiens
gaaacattttttaaaa

SEQ ID NO: 1028865 - DNA, 15 bp, Homo sapiens
gaaaccaaaacataa

SEQ ID NO: 1028866 - DNA, 16 bp, Homo sapiens
gaaaccaaagtctgcc

SEQ ID NO: 1028867 - DNA, 21 bp, Homo sapiens
gaaaccaagtcaggccaggtg

SEQ ID NO: 1028868 - DNA, 17 bp, Homo sapiens
gaaaccaagtgggctgg

SEQ ID NO: 1028869 - DNA, 13 bp, Homo sapiens
gaaaccagaaaag

SEQ ID NO: 1028870 - DNA, 15 bp, Homo sapiens
gaaaccagctcgtgg

SEQ ID NO: 1028871 - DNA, 18 bp, Homo sapiens
gaaaccagtgcaacagca

SEQ ID NO: 1028872 - DNA, 14 bp, Homo sapiens
gaaaccatgacaaa

SEQ ID NO: 1028873 - DNA, 15 bp, Homo sapiens
gaaaccatgacaaac

SEQ ID NO: 1028874 - DNA, 20 bp, Homo sapiens
gaaaccattttcccatcatc

SEQ ID NO: 1028875 - DNA, 23 bp, Homo sapiens
gaaaccattttcccatcatcctt

SEQ ID NO: 1028876 - DNA, 13 bp, Homo sapiens
gaaacccaagctc

SEQ ID NO: 1028877 - DNA, 18 bp, Homo sapiens
gaaacccggcttcctgtg

SEQ ID NO: 1028878 - DNA, 14 bp, Homo sapiens
gaaaccctccaaat

SEQ ID NO: 1028879 - DNA, 16 bp, Homo sapiens
gaaacccttgctgctt

SEQ ID NO: 1028880 - DNA, 16 bp, Homo sapiens
gaaaccgtgtgtccag

SEQ ID NO: 1028881 - DNA, 20 bp, Homo sapiens
gaaacctcagggctgtccca

SEQ ID NO: 1028882 - DNA, 20 bp, Homo sapiens
gaaacctctactaaaaagaa

SEQ ID NO: 1028883 - DNA, 20 bp, Homo sapiens
gaaacctcttttgttgtcct

SEQ ID NO: 1028884 - DNA, 13 bp, Homo sapiens
gaaacctgaaaaa

SEQ ID NO: 1028885 - DNA, 18 bp, Homo sapiens
gaaacctgaaaaaaagtt

SEQ ID NO: 1028886 - DNA, 14 bp, Homo sapiens
gaaacctgccctgc

SEQ ID NO: 1028887 - DNA, 17 bp, Homo sapiens
gaaacctgccctgcctg

SEQ ID NO: 1028888 - DNA, 19 bp, Homo sapiens
gaaacctgcctttgtatgt

SEQ ID NO: 1028889 - DNA, 13 bp, Homo sapiens
gaaaccttaatat

SEQ ID NO: 1028890 - DNA, 19 bp, Homo sapiens
gaaaccttattgtacctct

SEQ ID NO: 1028891 - DNA, 20 bp, Homo sapiens
gaaaccttattgtacctctc

SEQ ID NO: 1028892 - DNA, 15 bp, Homo sapiens
gaaaccttggagagg

SEQ ID NO: 1028893 - DNA, 14 bp, Homo sapiens
gaaacgaaaaggac

SEQ ID NO: 1028894 - DNA, 20 bp, Homo sapiens
gaaacgaagccatctttctt

SEQ ID NO: 1028895 - DNA, 15 bp, Homo sapiens
gtttttgcacatgtt

SEQ ID NO: 1028896 - DNA, 15 bp, Homo sapiens
gtttttgcatgaaat

SEQ ID NO: 1028897 - DNA, 12 bp, Homo sapiens
gtttttgcattt

SEQ ID NO: 1028898 - DNA, 23 bp, Homo sapiens
gtttttgcatttttgttttgaaa

SEQ ID NO: 1028899 - DNA, 13 bp, Homo sapiens
gtttttggctctt

SEQ ID NO: 1028900 - DNA, 18 bp, Homo sapiens
gtttttggtttttaaaac

SEQ ID NO: 1028901 - DNA, 19 bp, Homo sapiens
gtttttgtatctttatgct

SEQ ID NO: 1028902 - DNA, 20 bp, Homo sapiens
gtttttgtatctttatgctg

SEQ ID NO: 1028903 - DNA, 13 bp, Homo sapiens
gttttttaaagca

SEQ ID NO: 1028904 - DNA, 14 bp, Homo sapiens
gttttttaaagcaa

SEQ ID NO: 1028905 - DNA, 16 bp, Homo sapiens
gttttttaaagcaagt

SEQ ID NO: 1028906 - DNA, 19 bp, Homo sapiens
gttttttagatcaaatact

SEQ ID NO: 1028907 - DNA, 14 bp, Homo sapiens
gttttttcaaaata

SEQ ID NO: 1028908 - DNA, 18 bp, Homo sapiens
gttttttcaaaatagaaa

SEQ ID NO: 1028909 - DNA, 13 bp, Homo sapiens
gttttttcatagt

SEQ ID NO: 1028910 - DNA, 22 bp, Homo sapiens
gttttttcatcttcagttgtct

SEQ ID NO: 1028911 - DNA, 20 bp, Homo sapiens
gttttttcctcagtgcattt

SEQ ID NO: 1028912 - DNA, 13 bp, Homo sapiens
gttttttcctttg

SEQ ID NO: 1028913 - DNA, 13 bp, Homo sapiens
gttttttgcttct

SEQ ID NO: 1028914 - DNA, 12 bp, Homo sapiens
gttttttggaaa

SEQ ID NO: 1028915 - DNA, 10 bp, Homo sapiens
gttttttggt

SEQ ID NO: 1028916 - DNA, 13 bp, Homo sapiens
gttttttgtaact

SEQ ID NO: 1028917 - DNA, 13 bp, Homo sapiens
gttttttgtagaa

SEQ ID NO: 1028918 - DNA, 15 bp, Homo sapiens
gttttttgttactgt

SEQ ID NO: 1028919 - DNA, 16 bp, Homo sapiens
gttttttgttactgtt

SEQ ID NO: 1028920 - DNA, 21 bp, Homo sapiens
gttttttgttcaatgttccat

SEQ ID NO: 1028921 - DNA, 13 bp, Homo sapiens
gttttttgtttct

SEQ ID NO: 1028922 - DNA, 22 bp, Homo sapiens
gaaagggggtcccagtgggagg

SEQ ID NO: 1028923 - DNA, 16 bp, Homo sapiens
gaaagggtgctgcttc

SEQ ID NO: 1028924 - DNA, 21 bp, Homo sapiens
gaaagggtttgtaatacttta

SEQ ID NO: 1028925 - DNA, 13 bp, Homo sapiens
gaaaggtcagccc

SEQ ID NO: 1028926 - DNA, 22 bp, Homo sapiens
gaaaggtgagtttgagctgcct

SEQ ID NO: 1028927 - DNA, 17 bp, Homo sapiens
gaaaggtgtaggctggg

SEQ ID NO: 1028928 - DNA, 13 bp, Homo sapiens
gaaaggttttgga

SEQ ID NO: 1028929 - DNA, 20 bp, Homo sapiens
gaaagtaagcatttccagcc

SEQ ID NO: 1028930 - DNA, 19 bp, Homo sapiens
gaaagtacactctgctgtt

SEQ ID NO: 1028931 - DNA, 21 bp, Homo sapiens
gaaagtaccctcttttaccaa

SEQ ID NO: 1028932 - DNA, 19 bp, Homo sapiens
gaaagtatagatggccaaa

SEQ ID NO: 1028933 - DNA, 15 bp, Homo sapiens
gaaagtatatactga

SEQ ID NO: 1028934 - DNA, 14 bp, Homo sapiens
gaaagtattcagaa

SEQ ID NO: 1028935 - DNA, 16 bp, Homo sapiens
gaaagtattcagaaat

SEQ ID NO: 1028936 - DNA, 21 bp, Homo sapiens
gaaagtattcagaaattaaaa

SEQ ID NO: 1028937 - DNA, 21 bp, Homo sapiens
gaaagtcaaaaaattatttgc

SEQ ID NO: 1028938 - DNA, 21 bp, Homo sapiens
gaaagtcagaatcagaagata

SEQ ID NO: 1028939 - DNA, 22 bp, Homo sapiens
gaaagtcgaattaatagctttt

SEQ ID NO: 1028940 - DNA, 13 bp, Homo sapiens
gaaagtctgtcct

SEQ ID NO: 1028941 - DNA, 23 bp, Homo sapiens
gaaagtctgtccttgaaggacta

SEQ ID NO: 1028942 - DNA, 19 bp, Homo sapiens
gaaagtgaagcaaatcaga

SEQ ID NO: 1028943 - DNA, 19 bp, Homo sapiens
gaaagtgaatttgaatgaa

SEQ ID NO: 1028944 - DNA, 17 bp, Homo sapiens
gaaagtgactttaaaag

SEQ ID NO: 1028945 - DNA, 17 bp, Homo sapiens
gaaagtgcgttctccca

SEQ ID NO: 1028946 - DNA, 18 bp, Homo sapiens
gaaagtgcgttctcccag

SEQ ID NO: 1028947 - DNA, 21 bp, Homo sapiens
gaaagtggccatgccaccctg

SEQ ID NO: 1028948 - DNA, 10 bp, Homo sapiens
gaaagtggtg

SEQ ID NO: 1028949 - DNA, 11 bp, Homo sapiens
gaaagtgtatt

SEQ ID NO: 1028950 - DNA, 17 bp, Homo sapiens
gaaagtgttatttttca

SEQ ID NO: 1028951 - DNA, 23 bp, Homo sapiens
gaaagtgttatttttcaaggaag

SEQ ID NO: 1028952 - DNA, 11 bp, Homo sapiens
gaaagtgtttt

SEQ ID NO: 1028953 - DNA, 17 bp, Homo sapiens
gaaagttaacattaatg

SEQ ID NO: 1028954 - DNA, 19 bp, Homo sapiens
gaaagttagggggttctta

SEQ ID NO: 1028955 - DNA, 18 bp, Homo sapiens
gaaagttccaaatgttta

SEQ ID NO: 1028956 - DNA, 20 bp, Homo sapiens
gaaagttccaaatgtttata

SEQ ID NO: 1028957 - DNA, 19 bp, Homo sapiens
gaaagttgcttttattgca

SEQ ID NO: 1028958 - DNA, 20 bp, Homo sapiens
gaaagtttagatctgtccct

SEQ ID NO: 1028959 - DNA, 13 bp, Homo sapiens
gaaagttttccag

SEQ ID NO: 1028960 - DNA, 14 bp, Homo sapiens
gaaagttttccagt

SEQ ID NO: 1028961 - DNA, 18 bp, Homo sapiens
gaaagttttccagtattg

SEQ ID NO: 1028962 - DNA, 13 bp, Homo sapiens
gaaagttttgtaa

SEQ ID NO: 1028963 - DNA, 15 bp, Homo sapiens
gaaagttttgtaaaa

SEQ ID NO: 1028964 - DNA, 17 bp, Homo sapiens
gaaagttttgtaaaaga

SEQ ID NO: 1028965 - DNA, 21 bp, Homo sapiens
gaaagttttgtaaaagaaatc

SEQ ID NO: 1028966 - DNA, 18 bp, Homo sapiens
gaaataaaacaactctga

SEQ ID NO: 1028967 - DNA, 15 bp, Homo sapiens
gaaataaaacctttc

SEQ ID NO: 1028968 - DNA, 16 bp, Homo sapiens
gaaataaaacctttca

SEQ ID NO: 1028969 - DNA, 17 bp, Homo sapiens
gaaataaaacctttcaa

SEQ ID NO: 1028970 - DNA, 17 bp, Homo sapiens
gaaataaaaggaagcca

SEQ ID NO: 1028971 - DNA, 19 bp, Homo sapiens
gaaataaaaggaagccaaa

SEQ ID NO: 1028972 - DNA, 21 bp, Homo sapiens
gaaataaaatttgataaacat

SEQ ID NO: 1028973 - DNA, 22 bp, Homo sapiens
gaaataaaccttaatatttctt

SEQ ID NO: 1028974 - DNA, 20 bp, Homo sapiens
gaaataaaggtaaaatcact

SEQ ID NO: 1028975 - DNA, 19 bp, Homo sapiens
gaaataaagttaagtttgt

SEQ ID NO: 1028976 - DNA, 15 bp, Homo sapiens
gaaataaatagctat

SEQ ID NO: 1028977 - DNA, 17 bp, Homo sapiens
gaaataaatagctatat

SEQ ID NO: 1028978 - DNA, 16 bp, Homo sapiens
gaaataaatcagagag

SEQ ID NO: 1028979 - DNA, 18 bp, Homo sapiens
gaaataaatcagagagca

SEQ ID NO: 1028980 - DNA, 21 bp, Homo sapiens
gaaataaatcagagagcaagg

SEQ ID NO: 1028981 - DNA, 13 bp, Homo sapiens
gaaataaatgaaa

SEQ ID NO: 1028982 - DNA, 16 bp, Homo sapiens
gaaataaatgaaactt

SEQ ID NO: 1028983 - DNA, 13 bp, Homo sapiens
gaaataaatgttt

SEQ ID NO: 1028984 - DNA, 15 bp, Homo sapiens
gaaataaattcctaa

SEQ ID NO: 1028985 - DNA, 18 bp, Homo sapiens
gaaataacagaagaaaat

SEQ ID NO: 1028986 - DNA, 14 bp, Homo sapiens
gaaataacagagag

SEQ ID NO: 1028987 - DNA, 18 bp, Homo sapiens
gaaataacagagagaatg

SEQ ID NO: 1028988 - DNA, 22 bp, Homo sapiens
gaaataactccttcttgtagta

SEQ ID NO: 1028989 - DNA, 13 bp, Homo sapiens
gaaataagagcag

SEQ ID NO: 1028990 - DNA, 11 bp, Homo sapiens
gaaataataaa

SEQ ID NO: 1028991 - DNA, 15 bp, Homo sapiens
gaaataataaaatgc

SEQ ID NO: 1028992 - DNA, 19 bp, Homo sapiens
gaaataataaaatgcaaat

SEQ ID NO: 1028993 - DNA, 17 bp, Homo sapiens
gaaataataaatctggt

SEQ ID NO: 1028994 - DNA, 16 bp, Homo sapiens
gaaataatatatttct

SEQ ID NO: 1028995 - DNA, 18 bp, Homo sapiens
gaaataatatatttcttc

SEQ ID NO: 1028996 - DNA, 14 bp, Homo sapiens
gaaataatttgaat

SEQ ID NO: 1028997 - DNA, 22 bp, Homo sapiens
gaaataatttgtgtctgtgttt

SEQ ID NO: 1028998 - DNA, 15 bp, Homo sapiens
gaaatacagctggct

SEQ ID NO: 1028999 - DNA, 14 bp, Homo sapiens
gaaatacctgtcta

SEQ ID NO: 1029000 - DNA, 19 bp, Homo sapiens
gaaatactactcctgtaat

SEQ ID NO: 1029001 - DNA, 16 bp, Homo sapiens
gaaatactgagatgct

SEQ ID NO: 1029002 - DNA, 19 bp, Homo sapiens
gaaatactgagatgctggg

SEQ ID NO: 1029003 - DNA, 18 bp, Homo sapiens
gaaatactgcaagaaaat

SEQ ID NO: 1029004 - DNA, 16 bp, Homo sapiens
gaaatagaaagaagcc

SEQ ID NO: 1029005 - DNA, 19 bp, Homo sapiens
gaaatagacagtatattta

SEQ ID NO: 1029006 - DNA, 22 bp, Homo sapiens
gaaatagaggtgatgctgctaa

SEQ ID NO: 1029007 - DNA, 18 bp, Homo sapiens
gaaatagatatcctctcc

SEQ ID NO: 1029008 - DNA, 15 bp, Homo sapiens
gaaataggtatcaaa

SEQ ID NO: 1029009 - DNA, 18 bp, Homo sapiens
gaaataggtatcaaaata

SEQ ID NO: 1029010 - DNA, 16 bp, Homo sapiens
gaaatatacagtttga

SEQ ID NO: 1029011 - DNA, 17 bp, Homo sapiens
gaaatatacagtttgac

SEQ ID NO: 1029012 - DNA, 19 bp, Homo sapiens
gaaatatatacaaaaagaa

SEQ ID NO: 1029013 - DNA, 17 bp, Homo sapiens
gaaatatatatgtgtgt

SEQ ID NO: 1029014 - DNA, 20 bp, Homo sapiens
gaaatatattacttaactgt

SEQ ID NO: 1029015 - DNA, 12 bp, Homo sapiens
gaaatatatttg

SEQ ID NO: 1029016 - DNA, 16 bp, Homo sapiens
gaaatatcaaagtcat

SEQ ID NO: 1029017 - DNA, 20 bp, Homo sapiens
gaaatatcagttactcagcc

SEQ ID NO: 1029018 - DNA, 19 bp, Homo sapiens
taaaagaacttactgatta

SEQ ID NO: 1029019 - DNA, 13 bp, Homo sapiens
taaaagaagagag

SEQ ID NO: 1029020 - DNA, 15 bp, Homo sapiens
taaaagaatgactat

SEQ ID NO: 1029021 - DNA, 13 bp, Homo sapiens
taaaagaattttt

SEQ ID NO: 1029022 - DNA, 19 bp, Homo sapiens
taaaagaatttttttgtct

SEQ ID NO: 1029023 - DNA, 20 bp, Homo sapiens
taaaagactgcagctgctga

SEQ ID NO: 1029024 - DNA, 22 bp, Homo sapiens
taaaagagaccacccatatcat

SEQ ID NO: 1029025 - DNA, 14 bp, Homo sapiens
taaaagagataata

SEQ ID NO: 1029026 - DNA, 15 bp, Homo sapiens
taaaagagctgtctg

SEQ ID NO: 1029027 - DNA, 20 bp, Homo sapiens
taaaagagctgtctgactgc

SEQ ID NO: 1029028 - DNA, 13 bp, Homo sapiens
taaaagagcttta

SEQ ID NO: 1029029 - DNA, 20 bp, Homo sapiens
taaaagatacagttactcag

SEQ ID NO: 1029030 - DNA, 21 bp, Homo sapiens
taaaagatcaggttatacttt

SEQ ID NO: 1029031 - DNA, 19 bp, Homo sapiens
taaaagatggttgtagcat

SEQ ID NO: 1029032 - DNA, 22 bp, Homo sapiens
taaaagatggttgtagcattta

SEQ ID NO: 1029033 - DNA, 22 bp, Homo sapiens
taaaagcaaaaaagaaaacctt

SEQ ID NO: 1029034 - DNA, 13 bp, Homo sapiens
taaaagcaaatca

SEQ ID NO: 1029035 - DNA, 15 bp, Homo sapiens
taaaagcaaatcatt

SEQ ID NO: 1029036 - DNA, 15 bp, Homo sapiens
taaaagcaattctga

SEQ ID NO: 1029037 - DNA, 18 bp, Homo sapiens
taaaagcaattctgactg

SEQ ID NO: 1029038 - DNA, 22 bp, Homo sapiens
taaaagcagaaaataaaggaag

SEQ ID NO: 1029039 - DNA, 15 bp, Homo sapiens
taaaagcataaatgc

SEQ ID NO: 1029040 - DNA, 17 bp, Homo sapiens
taaaagcatgaaacatt

SEQ ID NO: 1029041 - DNA, 12 bp, Homo sapiens
taaaagcattgt

SEQ ID NO: 1029042 - DNA, 14 bp, Homo sapiens
taaaagcattttgt

SEQ ID NO: 1029043 - DNA, 15 bp, Homo sapiens
taaaagcattttgta

SEQ ID NO: 1029044 - DNA, 14 bp, Homo sapiens
taaaagcctgctca

SEQ ID NO: 1029045 - DNA, 20 bp, Homo sapiens
taaaagcgttggatgtagca

SEQ ID NO: 1029046 - DNA, 14 bp, Homo sapiens
taaaagctataaag

SEQ ID NO: 1029047 - DNA, 19 bp, Homo sapiens
taaaagctataaagtatat

SEQ ID NO: 1029048 - DNA, 22 bp, Homo sapiens
taaaagctcagatgacatttcg

SEQ ID NO: 1029049 - DNA, 12 bp, Homo sapiens
taaaaggaaaag

SEQ ID NO: 1029050 - DNA, 16 bp, Homo sapiens
taaaaggaaaagcaaa

SEQ ID NO: 1029051 - DNA, 19 bp, Homo sapiens
taaaaggaagccaaagagt

SEQ ID NO: 1029052 - DNA, 19 bp, Homo sapiens
taaaaggagagaagaaagt

SEQ ID NO: 1029053 - DNA, 12 bp, Homo sapiens
taaaaggatgtt

SEQ ID NO: 1029054 - DNA, 18 bp, Homo sapiens
taaaaggcaaatgtgtac

SEQ ID NO: 1029055 - DNA, 17 bp, Homo sapiens
gaaatttttcagatgct

SEQ ID NO: 1029056 - DNA, 15 bp, Homo sapiens
gaaatttttcttctt

SEQ ID NO: 1029057 - DNA, 15 bp, Homo sapiens
gaaattttttagtat

SEQ ID NO: 1029058 - DNA, 17 bp, Homo sapiens
gaaatttttttcctaag

SEQ ID NO: 1029059 - DNA, 21 bp, Homo sapiens
gaacaaaaaaatctgcagaag

SEQ ID NO: 1029060 - DNA, 10 bp, Homo sapiens
gaacaaaact

SEQ ID NO: 1029061 - DNA, 19 bp, Homo sapiens
gaacaaaactgttcttttg

SEQ ID NO: 1029062 - DNA, 22 bp, Homo sapiens
gaacaaaactgttcttttgcat

SEQ ID NO: 1029063 - DNA, 14 bp, Homo sapiens
gaacaaaattattt

SEQ ID NO: 1029064 - DNA, 20 bp, Homo sapiens
gaacaaacaaaacttaaaag

SEQ ID NO: 1029065 - DNA, 23 bp, Homo sapiens
gaacaaacactgaatcatgttaa

SEQ ID NO: 1029066 - DNA, 23 bp, Homo sapiens
gaacaaacactgcagtttcctgg

SEQ ID NO: 1029067 - DNA, 13 bp, Homo sapiens
gaacaaagctgtt

SEQ ID NO: 1029068 - DNA, 14 bp, Homo sapiens
gaacaaagctgtta

SEQ ID NO: 1029069 - DNA, 20 bp, Homo sapiens
gaacaaagctgttaaactgt

SEQ ID NO: 1029070 - DNA, 22 bp, Homo sapiens
gaacaaatcacacctctgggct

SEQ ID NO: 1029071 - DNA, 15 bp, Homo sapiens
gaacaaatggccttt

SEQ ID NO: 1029072 - DNA, 17 bp, Homo sapiens
gaacaaattagaggaga

SEQ ID NO: 1029073 - DNA, 17 bp, Homo sapiens
gaacaacaggcaggggc

SEQ ID NO: 1029074 - DNA, 20 bp, Homo sapiens
gaacaacaggcaggggccca

SEQ ID NO: 1029075 - DNA, 22 bp, Homo sapiens
gaacaacaggcaggggcccact

SEQ ID NO: 1029076 - DNA, 19 bp, Homo sapiens
gaacaactaggcttcagca

SEQ ID NO: 1029077 - DNA, 14 bp, Homo sapiens
gaacaacttgtagc

SEQ ID NO: 1029078 - DNA, 15 bp, Homo sapiens
gaacaagacagcctt

SEQ ID NO: 1029079 - DNA, 18 bp, Homo sapiens
gaacaagcttcagtaagt

SEQ ID NO: 1029080 - DNA, 15 bp, Homo sapiens
gaacaagtaatgtat

SEQ ID NO: 1029081 - DNA, 16 bp, Homo sapiens
gaacaagtaatgtatt

SEQ ID NO: 1029082 - DNA, 14 bp, Homo sapiens
gaacaagtcacagc

SEQ ID NO: 1029083 - DNA, 23 bp, Homo sapiens
gaacaagtgcctcctggactgtt

SEQ ID NO: 1029084 - DNA, 19 bp, Homo sapiens
gaacaatcactattcttaa

SEQ ID NO: 1029085 - DNA, 15 bp, Homo sapiens
gaacaatgccagggc

SEQ ID NO: 1029086 - DNA, 20 bp, Homo sapiens
gaacaattgaagtaaacttt

SEQ ID NO: 1029087 - DNA, 19 bp, Homo sapiens
gaacaatttggcaattttg

SEQ ID NO: 1029088 - DNA, 19 bp, Homo sapiens
gaacacaaactgtaaataa

SEQ ID NO: 1029089 - DNA, 14 bp, Homo sapiens
gaacacacacgcca

SEQ ID NO: 1029090 - DNA, 15 bp, Homo sapiens
gaacacacacgccag

SEQ ID NO: 1029091 - DNA, 17 bp, Homo sapiens
gaacacacacgccagct

SEQ ID NO: 1029092 - DNA, 19 bp, Homo sapiens
gaacacacacgccagctcc

SEQ ID NO: 1029093 - DNA, 14 bp, Homo sapiens
gaacacactgtgtc

SEQ ID NO: 1029094 - DNA, 16 bp, Homo sapiens
gaacacactgtgtcct

SEQ ID NO: 1029095 - DNA, 16 bp, Homo sapiens
gaacacagcatgtgcc

SEQ ID NO: 1029096 - DNA, 15 bp, Homo sapiens
gaacacagtgtctgt

SEQ ID NO: 1029097 - DNA, 15 bp, Homo sapiens
gaacacagttctggg

SEQ ID NO: 1029098 - DNA, 16 bp, Homo sapiens
gaacacatgtgtatga

SEQ ID NO: 1029099 - DNA, 17 bp, Homo sapiens
gaacacatgtgtatgat

SEQ ID NO: 1029100 - DNA, 20 bp, Homo sapiens
gaacaccataggtagaatgt

SEQ ID NO: 1029101 - DNA, 21 bp, Homo sapiens
gaacacccgactcctcaaaag

SEQ ID NO: 1029102 - DNA, 23 bp, Homo sapiens
gaacacccttagaaaatgtgtcc

SEQ ID NO: 1029103 - DNA, 16 bp, Homo sapiens
gaacacgcgtatttac

SEQ ID NO: 1029104 - DNA, 15 bp, Homo sapiens
gaacactaattcata

SEQ ID NO: 1029105 - DNA, 21 bp, Homo sapiens
gaacactactgctaaatcctc

SEQ ID NO: 1029106 - DNA, 16 bp, Homo sapiens
gaacactcttttgctt

SEQ ID NO: 1029107 - DNA, 22 bp, Homo sapiens
gaacactggacaacattttact

SEQ ID NO: 1029108 - DNA, 13 bp, Homo sapiens
gaacactggacct

SEQ ID NO: 1029109 - DNA, 17 bp, Homo sapiens
gaacactgggggagggg

SEQ ID NO: 1029110 - DNA, 12 bp, Homo sapiens
gaacactgtgac

SEQ ID NO: 1029111 - DNA, 19 bp, Homo sapiens
gaacagaaggatgaatgag

SEQ ID NO: 1029112 - DNA, 12 bp, Homo sapiens
gaacagaatgtt

SEQ ID NO: 1029113 - DNA, 18 bp, Homo sapiens
gaacagacaacagaagtc

SEQ ID NO: 1029114 - DNA, 19 bp, Homo sapiens
gaacagacaacagaagtca

SEQ ID NO: 1029115 - DNA, 16 bp, Homo sapiens
gaacagacaggagaaa

SEQ ID NO: 1029116 - DNA, 21 bp, Homo sapiens
gaacagagagacccttgtggg

SEQ ID NO: 1029117 - DNA, 17 bp, Homo sapiens
gaacagataatccctgt

SEQ ID NO: 1029118 - DNA, 18 bp, Homo sapiens
gaacagataatccctgta

SEQ ID NO: 1029119 - DNA, 21 bp, Homo sapiens
gaacagcagactcagctctga

SEQ ID NO: 1029120 - DNA, 23 bp, Homo sapiens
gaacagccagttttactgtgatt

SEQ ID NO: 1029121 - DNA, 24 bp, Homo sapiens
gaacagccctcggcctccgaggct

SEQ ID NO: 1029122 - DNA, 16 bp, Homo sapiens
gaacagcctgcctgtc

SEQ ID NO: 1029123 - DNA, 19 bp, Homo sapiens
gaacagcgggagacctgtg

SEQ ID NO: 1029124 - DNA, 22 bp, Homo sapiens
gaacagctatgggagccccagg

SEQ ID NO: 1029125 - DNA, 16 bp, Homo sapiens
gaacagctctgagatc

SEQ ID NO: 1029126 - DNA, 22 bp, Homo sapiens
gaacagctctgagatcctggag

SEQ ID NO: 1029127 - DNA, 15 bp, Homo sapiens
gaacagctgtaatct

SEQ ID NO: 1029128 - DNA, 11 bp, Homo sapiens
gaacagctgtg

SEQ ID NO: 1029129 - DNA, 13 bp, Homo sapiens
gaacagctgtgag

SEQ ID NO: 1029130 - DNA, 16 bp, Homo sapiens
gaacagctgtgtctgc

SEQ ID NO: 1029131 - DNA, 16 bp, Homo sapiens
gaacagctgttcctgt

SEQ ID NO: 1029132 - DNA, 19 bp, Homo sapiens
gaacagctgttcctgtgtt

SEQ ID NO: 1029133 - DNA, 11 bp, Homo sapiens
gaacaggagac

SEQ ID NO: 1029134 - DNA, 18 bp, Homo sapiens
gaacagggcccaggcctg

SEQ ID NO: 1029135 - DNA, 20 bp, Homo sapiens
gaacagggcccaggcctgga

SEQ ID NO: 1029136 - DNA, 16 bp, Homo sapiens
gaacaggtggatgtat

SEQ ID NO: 1029137 - DNA, 20 bp, Homo sapiens
gaacagtaggattgctgtgg

SEQ ID NO: 1029138 - DNA, 18 bp, Homo sapiens
gaacagtcacccttctgg

SEQ ID NO: 1029139 - DNA, 22 bp, Homo sapiens
gaacagtccctcacacctgggc

SEQ ID NO: 1029140 - DNA, 12 bp, Homo sapiens
taaacaggccca

SEQ ID NO: 1029141 - DNA, 13 bp, Homo sapiens
taaacaggcccag

SEQ ID NO: 1029142 - DNA, 23 bp, Homo sapiens
taaacaggtatttttttaaatca

SEQ ID NO: 1029143 - DNA, 17 bp, Homo sapiens
taaacagtagttgtatt

SEQ ID NO: 1029144 - DNA, 19 bp, Homo sapiens
taaacagtagttgtattct

SEQ ID NO: 1029145 - DNA, 23 bp, Homo sapiens
taaacagtgagcatatctggtat

SEQ ID NO: 1029146 - DNA, 12 bp, Homo sapiens
taaacagtgcct

SEQ ID NO: 1029147 - DNA, 13 bp, Homo sapiens
taaacagtgcctg

SEQ ID NO: 1029148 - DNA, 17 bp, Homo sapiens
taaacagtgcctgctga

SEQ ID NO: 1029149 - DNA, 16 bp, Homo sapiens
taaacagttgttactt

SEQ ID NO: 1029150 - DNA, 15 bp, Homo sapiens
taaacataattcttg

SEQ ID NO: 1029151 - DNA, 19 bp, Homo sapiens
taaacataattgtggatta

SEQ ID NO: 1029152 - DNA, 23 bp, Homo sapiens
taaacataattgtggattataaa

SEQ ID NO: 1029153 - DNA, 18 bp, Homo sapiens
taaacatatggctttagt

SEQ ID NO: 1029154 - DNA, 21 bp, Homo sapiens
taaacatatttttatacttta

SEQ ID NO: 1029155 - DNA, 23 bp, Homo sapiens
taaacatatttttatactttatt

SEQ ID NO: 1029156 - DNA, 15 bp, Homo sapiens
taaacatcagtttct

SEQ ID NO: 1029157 - DNA, 20 bp, Homo sapiens
taaacatccaatattttctt

SEQ ID NO: 1029158 - DNA, 22 bp, Homo sapiens
taaacatctagcagtaaatact

SEQ ID NO: 1029159 - DNA, 20 bp, Homo sapiens
taaacatgtcacaatacagt

SEQ ID NO: 1029160 - DNA, 12 bp, Homo sapiens
taaacatgtgtt

SEQ ID NO: 1029161 - DNA, 13 bp, Homo sapiens
taaacatgtttaa

SEQ ID NO: 1029162 - DNA, 17 bp, Homo sapiens
taaacattaaacactgt

SEQ ID NO: 1029163 - DNA, 19 bp, Homo sapiens
taaacattaattttgtgca

SEQ ID NO: 1029164 - DNA, 18 bp, Homo sapiens
taaacattacggtacaga

SEQ ID NO: 1029165 - DNA, 21 bp, Homo sapiens
taaacattacggtacagacat

SEQ ID NO: 1029166 - DNA, 15 bp, Homo sapiens
taaacattcctccag

SEQ ID NO: 1029167 - DNA, 20 bp, Homo sapiens
taaacattcctccagcctcc

SEQ ID NO: 1029168 - DNA, 23 bp, Homo sapiens
taaacatttattttttttaaaga

SEQ ID NO: 1029169 - DNA, 17 bp, Homo sapiens
taaacatttgttcctgg

SEQ ID NO: 1029170 - DNA, 11 bp, Homo sapiens
taaacattttc

SEQ ID NO: 1029171 - DNA, 21 bp, Homo sapiens
taaaccaagattatgtgactt

SEQ ID NO: 1029172 - DNA, 22 bp, Homo sapiens
taaaccaagattatgtgacttg

SEQ ID NO: 1029173 - DNA, 22 bp, Homo sapiens
taaaccaccagtgcccaaagtc

SEQ ID NO: 1029174 - DNA, 17 bp, Homo sapiens
taaaccaccctctgggg

SEQ ID NO: 1029175 - DNA, 18 bp, Homo sapiens
taaaccaccctctgggga

SEQ ID NO: 1029176 - DNA, 22 bp, Homo sapiens
taaaccacctcagaaaggattt

SEQ ID NO: 1029177 - DNA, 19 bp, Homo sapiens
taaaccacttctctgctgc

SEQ ID NO: 1029178 - DNA, 13 bp, Homo sapiens
taaacccatacaa

SEQ ID NO: 1029179 - DNA, 15 bp, Homo sapiens
taaacccatacaatg

SEQ ID NO: 1029180 - DNA, 17 bp, Homo sapiens
taaacccatacaatgta

SEQ ID NO: 1029181 - DNA, 18 bp, Homo sapiens
taaacccatacaatgtat

SEQ ID NO: 1029182 - DNA, 19 bp, Homo sapiens
taaacccatacaatgtatg

SEQ ID NO: 1029183 - DNA, 23 bp, Homo sapiens
taaacccatattgtaaaacaggt

SEQ ID NO: 1029184 - DNA, 18 bp, Homo sapiens
taaaccgccaaggctggg

SEQ ID NO: 1029185 - DNA, 17 bp, Homo sapiens
taaaccgctaaaagaaa

SEQ ID NO: 1029186 - DNA, 15 bp, Homo sapiens
taaaccgtgtattta

SEQ ID NO: 1029187 - DNA, 17 bp, Homo sapiens
gaactccatacagcctc

SEQ ID NO: 1029188 - DNA, 19 bp, Homo sapiens
gaactcctccaaagcatgt

SEQ ID NO: 1029189 - DNA, 13 bp, Homo sapiens
gaactcctgacct

SEQ ID NO: 1029190 - DNA, 12 bp, Homo sapiens
gaactcctgcca

SEQ ID NO: 1029191 - DNA, 17 bp, Homo sapiens
gaactccttccccactt

SEQ ID NO: 1029192 - DNA, 12 bp, Homo sapiens
gaactcgatgca

SEQ ID NO: 1029193 - DNA, 17 bp, Homo sapiens
gaactcgcgctcagtaa

SEQ ID NO: 1029194 - DNA, 22 bp, Homo sapiens
gaactctcaaaagtctattttt

SEQ ID NO: 1029195 - DNA, 14 bp, Homo sapiens
gaactctctccctg

SEQ ID NO: 1029196 - DNA, 18 bp, Homo sapiens
gaactctctccctggtct

SEQ ID NO: 1029197 - DNA, 16 bp, Homo sapiens
gaactctctgcctgta

SEQ ID NO: 1029198 - DNA, 20 bp, Homo sapiens
gaactctggcttccaggtat

SEQ ID NO: 1029199 - DNA, 14 bp, Homo sapiens
gaactctggtggca

SEQ ID NO: 1029200 - DNA, 18 bp, Homo sapiens
gaactcttaaatactttt

SEQ ID NO: 1029201 - DNA, 22 bp, Homo sapiens
gaactcttaaatactttttcag

SEQ ID NO: 1029202 - DNA, 15 bp, Homo sapiens
gaactcttctttgct

SEQ ID NO: 1029203 - DNA, 15 bp, Homo sapiens
gaactgaagccactt

SEQ ID NO: 1029204 - DNA, 20 bp, Homo sapiens
gaactgaagccacttggccc

SEQ ID NO: 1029205 - DNA, 21 bp, Homo sapiens
gaactgaagccacttggccca

SEQ ID NO: 1029206 - DNA, 20 bp, Homo sapiens
gaactgacaaaggagccttg

SEQ ID NO: 1029207 - DNA, 17 bp, Homo sapiens
gaactgaccccctcccc

SEQ ID NO: 1029208 - DNA, 16 bp, Homo sapiens
gaactgactgaaggaa

SEQ ID NO: 1029209 - DNA, 14 bp, Homo sapiens
gaactgactttctc

SEQ ID NO: 1029210 - DNA, 16 bp, Homo sapiens
gaactgagaaggcagg

SEQ ID NO: 1029211 - DNA, 11 bp, Homo sapiens
gaactgaggag

SEQ ID NO: 1029212 - DNA, 21 bp, Homo sapiens
gaactgaggagatgaccaggg

SEQ ID NO: 1029213 - DNA, 23 bp, Homo sapiens
gaactgaggagatgaccagggat

SEQ ID NO: 1029214 - DNA, 14 bp, Homo sapiens
gaactgaggccctg

SEQ ID NO: 1029215 - DNA, 13 bp, Homo sapiens
gaactgaggcctt

SEQ ID NO: 1029216 - DNA, 22 bp, Homo sapiens
gaactgatcatgtttatgagaa

SEQ ID NO: 1029217 - DNA, 21 bp, Homo sapiens
gaactgattcacatctcattt

SEQ ID NO: 1029218 - DNA, 13 bp, Homo sapiens
gaactgcaaagct

SEQ ID NO: 1029219 - DNA, 19 bp, Homo sapiens
gaactgcaaagctttggct

SEQ ID NO: 1029220 - DNA, 12 bp, Homo sapiens
gaactgcacttt

SEQ ID NO: 1029221 - DNA, 11 bp, Homo sapiens
gaactgcagac

SEQ ID NO: 1029222 - DNA, 19 bp, Homo sapiens
gaactgcagatagcccagg

SEQ ID NO: 1029223 - DNA, 22 bp, Homo sapiens
gaactgcagatagcccaggagc

SEQ ID NO: 1029224 - DNA, 12 bp, Homo sapiens
gaactgcaggcc

SEQ ID NO: 1029225 - DNA, 14 bp, Homo sapiens
gaactgcaggccct

SEQ ID NO: 1029226 - DNA, 21 bp, Homo sapiens
gaactgcatatgtttcgctga

SEQ ID NO: 1029227 - DNA, 14 bp, Homo sapiens
gaactgcatggacc

SEQ ID NO: 1029228 - DNA, 20 bp, Homo sapiens
gaactgccattattttctgt

SEQ ID NO: 1029229 - DNA, 23 bp, Homo sapiens
gaactgccattattttctgtcag

SEQ ID NO: 1029230 - DNA, 18 bp, Homo sapiens
gaactgcccttgctgccc

SEQ ID NO: 1029231 - DNA, 19 bp, Homo sapiens
gaactgcgttatgaagagc

SEQ ID NO: 1029232 - DNA, 22 bp, Homo sapiens
gaactgctagtcaagtgcgtcc

SEQ ID NO: 1029233 - DNA, 15 bp, Homo sapiens
gaactgctttcaagt

SEQ ID NO: 1029234 - DNA, 13 bp, Homo sapiens
gaactgcttttcc

SEQ ID NO: 1029235 - DNA, 17 bp, Homo sapiens
gaactgcttttcctcaa

SEQ ID NO: 1029236 - DNA, 23 bp, Homo sapiens
gaactgcttttcctcaagcaata

SEQ ID NO: 1029237 - DNA, 18 bp, Homo sapiens
gaactggctgggcccctg

SEQ ID NO: 1029238 - DNA, 15 bp, Homo sapiens
gaactggctgtgaag

SEQ ID NO: 1029239 - DNA, 22 bp, Homo sapiens
gaactgggcacagattgaagaa

SEQ ID NO: 1029240 - DNA, 14 bp, Homo sapiens
gaactgggctgggc

SEQ ID NO: 1029241 - DNA, 20 bp, Homo sapiens
gaactggtcaccatgaaact

SEQ ID NO: 1029242 - DNA, 14 bp, Homo sapiens
gaactgtacattgt

SEQ ID NO: 1029243 - DNA, 19 bp, Homo sapiens
gaactgtacattgtgagct

SEQ ID NO: 1029244 - DNA, 19 bp, Homo sapiens
gaactgtccacatctgcct

SEQ ID NO: 1029245 - DNA, 20 bp, Homo sapiens
gaactgtccacatctgcctc

SEQ ID NO: 1029246 - DNA, 14 bp, Homo sapiens
gaactgtccagaga

SEQ ID NO: 1029247 - DNA, 15 bp, Homo sapiens
gaactgtccagagag

SEQ ID NO: 1029248 - DNA, 17 bp, Homo sapiens
gaactgtccagagagca

SEQ ID NO: 1029249 - DNA, 17 bp, Homo sapiens
gaactgtcccatcccca

SEQ ID NO: 1029250 - DNA, 19 bp, Homo sapiens
gaactgtcccatccccagg

SEQ ID NO: 1029251 - DNA, 20 bp, Homo sapiens
gaactgtcccatccccaggt

SEQ ID NO: 1029252 - DNA, 19 bp, Homo sapiens
gaactgtgcatagtgctgg

SEQ ID NO: 1029253 - DNA, 23 bp, Homo sapiens
gaactgtgcatcaaccaggaaga

SEQ ID NO: 1029254 - DNA, 17 bp, Homo sapiens
gaactgtgtatttattt

SEQ ID NO: 1029255 - DNA, 19 bp, Homo sapiens
gaactgtgtatttatttaa

SEQ ID NO: 1029256 - DNA, 20 bp, Homo sapiens
gaactgtgtatttatttaaa

SEQ ID NO: 1029257 - DNA, 14 bp, Homo sapiens
gaactgtgtgtaat

SEQ ID NO: 1029258 - DNA, 16 bp, Homo sapiens
gaactgttagatgctg

SEQ ID NO: 1029259 - DNA, 16 bp, Homo sapiens
gaacttaaatgccccc

SEQ ID NO: 1029260 - DNA, 19 bp, Homo sapiens
gaacttaaatgcccccctc

SEQ ID NO: 1029261 - DNA, 17 bp, Homo sapiens
gaacttaagtctcgaat

SEQ ID NO: 1029262 - DNA, 20 bp, Homo sapiens
taaaggaaacactaaggctg

SEQ ID NO: 1029263 - DNA, 16 bp, Homo sapiens
taaaggaccctgtttc

SEQ ID NO: 1029264 - DNA, 21 bp, Homo sapiens
taaaggaccctgtttctgtag

SEQ ID NO: 1029265 - DNA, 20 bp, Homo sapiens
taaaggagttaagagtagca

SEQ ID NO: 1029266 - DNA, 15 bp, Homo sapiens
taaaggataactctg

SEQ ID NO: 1029267 - DNA, 15 bp, Homo sapiens
taaaggatccagaga

SEQ ID NO: 1029268 - DNA, 14 bp, Homo sapiens
taaaggatggaaaa

SEQ ID NO: 1029269 - DNA, 22 bp, Homo sapiens
taaaggatgtgattgtggaatg

SEQ ID NO: 1029270 - DNA, 10 bp, Homo sapiens
taaaggcagc

SEQ ID NO: 1029271 - DNA, 20 bp, Homo sapiens
taaaggcagctgcctctgct

SEQ ID NO: 1029272 - DNA, 23 bp, Homo sapiens
taaaggcagctgcctctgctccc

SEQ ID NO: 1029273 - DNA, 24 bp, Homo sapiens
taaaggcagctgcctctgctccct

SEQ ID NO: 1029274 - DNA, 20 bp, Homo sapiens
taaaggcagtccagagcttt

SEQ ID NO: 1029275 - DNA, 18 bp, Homo sapiens
taaaggccacaggagaca

SEQ ID NO: 1029276 - DNA, 19 bp, Homo sapiens
taaaggcctcatctccttt

SEQ ID NO: 1029277 - DNA, 23 bp, Homo sapiens
taaaggcctggaaccagggagga

SEQ ID NO: 1029278 - DNA, 15 bp, Homo sapiens
taaaggctacctttg

SEQ ID NO: 1029279 - DNA, 17 bp, Homo sapiens
taaaggctacctttgta

SEQ ID NO: 1029280 - DNA, 18 bp, Homo sapiens
taaaggctcgattttgta

SEQ ID NO: 1029281 - DNA, 17 bp, Homo sapiens
taaagggcaaataatga

SEQ ID NO: 1029282 - DNA, 21 bp, Homo sapiens
taaagggcagggcccacgtgt

SEQ ID NO: 1029283 - DNA, 14 bp, Homo sapiens
taaagggcctgcct

SEQ ID NO: 1029284 - DNA, 15 bp, Homo sapiens
taaaggggggagggg

SEQ ID NO: 1029285 - DNA, 21 bp, Homo sapiens
taaagggttgaaaatgtgttt

SEQ ID NO: 1029286 - DNA, 17 bp, Homo sapiens
taaaggtaaaatcactt

SEQ ID NO: 1029287 - DNA, 22 bp, Homo sapiens
taaaggtgacatcggaaaaata

SEQ ID NO: 1029288 - DNA, 15 bp, Homo sapiens
taaaggtgatgtaaa

SEQ ID NO: 1029289 - DNA, 20 bp, Homo sapiens
taaaggtggtgaggcaataa

SEQ ID NO: 1029290 - DNA, 21 bp, Homo sapiens
taaaggtggtgaggcaataaa

SEQ ID NO: 1029291 - DNA, 18 bp, Homo sapiens
taaaggtgtagaaaaggt

SEQ ID NO: 1029292 - DNA, 14 bp, Homo sapiens
taaaggttatgaaa

SEQ ID NO: 1029293 - DNA, 18 bp, Homo sapiens
taaaggttatgaaacata

SEQ ID NO: 1029294 - DNA, 15 bp, Homo sapiens
taaaggtttattttt

SEQ ID NO: 1029295 - DNA, 15 bp, Homo sapiens
taaaggtttttaaat

SEQ ID NO: 1029296 - DNA, 14 bp, Homo sapiens
taaagtaaagctaa

SEQ ID NO: 1029297 - DNA, 15 bp, Homo sapiens
taaagtaaagctaaa

SEQ ID NO: 1029298 - DNA, 14 bp, Homo sapiens
taaagtaataatgt

SEQ ID NO: 1029299 - DNA, 14 bp, Homo sapiens
taaagtaattcata

SEQ ID NO: 1029300 - DNA, 20 bp, Homo sapiens
taaagtacacaattgtttta

SEQ ID NO: 1029301 - DNA, 14 bp, Homo sapiens
taaagtacctgtag

SEQ ID NO: 1029302 - DNA, 16 bp, Homo sapiens
taaagtacctttatgt

SEQ ID NO: 1029303 - DNA, 13 bp, Homo sapiens
taaagtagaagag

SEQ ID NO: 1029304 - DNA, 18 bp, Homo sapiens
taaagtagcaaaacaaat

SEQ ID NO: 1029305 - DNA, 21 bp, Homo sapiens
taaagtatacaactgcctggg

SEQ ID NO: 1029306 - DNA, 15 bp, Homo sapiens
taaagtatcatgcat

SEQ ID NO: 1029307 - DNA, 15 bp, Homo sapiens
taaagtatgaatcta

SEQ ID NO: 1029308 - DNA, 16 bp, Homo sapiens
taaagtatgaatctat

SEQ ID NO: 1029309 - DNA, 21 bp, Homo sapiens
taaagtatgcaaaataaagaa

SEQ ID NO: 1029310 - DNA, 22 bp, Homo sapiens
taaagtatgtaaagtatgtaaa

SEQ ID NO: 1029311 - DNA, 19 bp, Homo sapiens
taaagtatgtattatttac

SEQ ID NO: 1029312 - DNA, 21 bp, Homo sapiens
taaagtatgtattatttacat

SEQ ID NO: 1029313 - DNA, 21 bp, Homo sapiens
taaagtatgtttttacattat

SEQ ID NO: 1029314 - DNA, 14 bp, Homo sapiens
taaagtattctcca

SEQ ID NO: 1029315 - DNA, 13 bp, Homo sapiens
taaagtattcttc

SEQ ID NO: 1029316 - DNA, 12 bp, Homo sapiens
ctgtgtccatct

SEQ ID NO: 1029317 - DNA, 19 bp, Homo sapiens
ctgtgtccatgcgctcagg

SEQ ID NO: 1029318 - DNA, 17 bp, Homo sapiens
ctgtgtcccatgaccca

SEQ ID NO: 1029319 - DNA, 17 bp, Homo sapiens
ctgtgtcccctgacctg

SEQ ID NO: 1029320 - DNA, 22 bp, Homo sapiens
ctgtgtcccctgacctgtccag

SEQ ID NO: 1029321 - DNA, 18 bp, Homo sapiens
ctgtgtcctaaggcccat

SEQ ID NO: 1029322 - DNA, 13 bp, Homo sapiens
ctgtgtcctccct

SEQ ID NO: 1029323 - DNA, 17 bp, Homo sapiens
ctgtgtcctctgcctgg

SEQ ID NO: 1029324 - DNA, 18 bp, Homo sapiens
ctgtgtcctgatggccca

SEQ ID NO: 1029325 - DNA, 13 bp, Homo sapiens
ctgtgtcctggtg

SEQ ID NO: 1029326 - DNA, 15 bp, Homo sapiens
ctgtgtccttccctg

SEQ ID NO: 1029327 - DNA, 16 bp, Homo sapiens
ctgtgtccttccctgc

SEQ ID NO: 1029328 - DNA, 16 bp, Homo sapiens
ctgtgtccttcctcca

SEQ ID NO: 1029329 - DNA, 14 bp, Homo sapiens
ctgtgtccttgcac

SEQ ID NO: 1029330 - DNA, 22 bp, Homo sapiens
ctgtgtccttgcacctgcatcc

SEQ ID NO: 1029331 - DNA, 11 bp, Homo sapiens
ctgtgtctaaa

SEQ ID NO: 1029332 - DNA, 15 bp, Homo sapiens
ctgtgtctaaactgc

SEQ ID NO: 1029333 - DNA, 16 bp, Homo sapiens
ctgtgtctaaactgca

SEQ ID NO: 1029334 - DNA, 19 bp, Homo sapiens
ctgtgtctctgtttcctga

SEQ ID NO: 1029335 - DNA, 23 bp, Homo sapiens
ctgtgtctctgtttcctgaaata

SEQ ID NO: 1029336 - DNA, 19 bp, Homo sapiens
ctgtgtctgcctgtcccca

SEQ ID NO: 1029337 - DNA, 16 bp, Homo sapiens
ctgtgtctgtcacagg

SEQ ID NO: 1029338 - DNA, 18 bp, Homo sapiens
ctgtgtctgtcacaggct

SEQ ID NO: 1029339 - DNA, 21 bp, Homo sapiens
ctgtgtgaaataccagtgtgg

SEQ ID NO: 1029340 - DNA, 19 bp, Homo sapiens
ctgtgtgaatacctgctca

SEQ ID NO: 1029341 - DNA, 13 bp, Homo sapiens
ctgtgtgaatgtg

SEQ ID NO: 1029342 - DNA, 17 bp, Homo sapiens
ctgtgtgaatgtgggca

SEQ ID NO: 1029343 - DNA, 20 bp, Homo sapiens
ctgtgtgaccctgggcaagt

SEQ ID NO: 1029344 - DNA, 22 bp, Homo sapiens
ctgtgtgaggattaagggacgg

SEQ ID NO: 1029345 - DNA, 18 bp, Homo sapiens
ctgtgtgaggctgtgtct

SEQ ID NO: 1029346 - DNA, 20 bp, Homo sapiens
ctgtgtgattttcatacagg

SEQ ID NO: 1029347 - DNA, 16 bp, Homo sapiens
ctgtgtgcacaaatat

SEQ ID NO: 1029348 - DNA, 16 bp, Homo sapiens
ctgtgtgcctggggga

SEQ ID NO: 1029349 - DNA, 20 bp, Homo sapiens
ctgtgtgcgtggcgtggccc

SEQ ID NO: 1029350 - DNA, 18 bp, Homo sapiens
ctgtgtggactgtgatgc

SEQ ID NO: 1029351 - DNA, 17 bp, Homo sapiens
ctgtgtggatgctgagc

SEQ ID NO: 1029352 - DNA, 19 bp, Homo sapiens
ctgtgtggatgctgagctg

SEQ ID NO: 1029353 - DNA, 17 bp, Homo sapiens
ctgtgtggccaaccagg

SEQ ID NO: 1029354 - DNA, 21 bp, Homo sapiens
ctgtgtggcccagttctgaaa

SEQ ID NO: 1029355 - DNA, 24 bp, Homo sapiens
ctgtgtgggatacttagtggtatg

SEQ ID NO: 1029356 - DNA, 23 bp, Homo sapiens
ctgtgtgggtaaatgcttttaaa

SEQ ID NO: 1029357 - DNA, 22 bp, Homo sapiens
ctgtgtggtggagccagggcct

SEQ ID NO: 1029358 - DNA, 14 bp, Homo sapiens
ctgtgtgtcagttt

SEQ ID NO: 1029359 - DNA, 17 bp, Homo sapiens
ctgtgtgtcagttttca

SEQ ID NO: 1029360 - DNA, 18 bp, Homo sapiens
ctgtgtgtcagttttcat

SEQ ID NO: 1029361 - DNA, 19 bp, Homo sapiens
ctgtgtgtccaaaactgcc

SEQ ID NO: 1029362 - DNA, 22 bp, Homo sapiens
ctgtgtgtctcgtgtcagtaat

SEQ ID NO: 1029363 - DNA, 12 bp, Homo sapiens
ctgtgtgtctgt

SEQ ID NO: 1029364 - DNA, 13 bp, Homo sapiens
ctgtgtgtctgtc

SEQ ID NO: 1029365 - DNA, 16 bp, Homo sapiens
ctgtgtgtgggtgggg

SEQ ID NO: 1029366 - DNA, 18 bp, Homo sapiens
ctgtgtgttagttcccaa

SEQ ID NO: 1029367 - DNA, 21 bp, Homo sapiens
ctgtgtgttagttcccaacat

SEQ ID NO: 1029368 - DNA, 16 bp, Homo sapiens
ctgtgtgttgacactg

SEQ ID NO: 1029369 - DNA, 15 bp, Homo sapiens
ctgtgtgttttccca

SEQ ID NO: 1029370 - DNA, 22 bp, Homo sapiens
ctgtgttaattgcgtagaggct

SEQ ID NO: 1029371 - DNA, 21 bp, Homo sapiens
ctgtgttacccaggctggtct

SEQ ID NO: 1029372 - DNA, 15 bp, Homo sapiens
ctgtgttagtgtctg

SEQ ID NO: 1029373 - DNA, 17 bp, Homo sapiens
ctgtgttagtgtctgtc

SEQ ID NO: 1029374 - DNA, 15 bp, Homo sapiens
ctgtgttatgaaaat

SEQ ID NO: 1029375 - DNA, 16 bp, Homo sapiens
ctgtgttatgaaaata

SEQ ID NO: 1029376 - DNA, 13 bp, Homo sapiens
ctgtgttcatttt

SEQ ID NO: 1029377 - DNA, 21 bp, Homo sapiens
ctgtgttcccagaggcaggcg

SEQ ID NO: 1029378 - DNA, 13 bp, Homo sapiens
ctgtgttcctggc

SEQ ID NO: 1029379 - DNA, 12 bp, Homo sapiens
ctgtgttcgggg

SEQ ID NO: 1029380 - DNA, 18 bp, Homo sapiens
ctgtgttcgggggagcag

SEQ ID NO: 1029381 - DNA, 13 bp, Homo sapiens
ctgtgttctgggc

SEQ ID NO: 1029382 - DNA, 15 bp, Homo sapiens
gtctcactgcttgaa

SEQ ID NO: 1029383 - DNA, 22 bp, Homo sapiens
gtctcactgtgggaaggccagc

SEQ ID NO: 1029384 - DNA, 23 bp, Homo sapiens
gtctcactgtgggaaggccagct

SEQ ID NO: 1029385 - DNA, 16 bp, Homo sapiens
gtctcacttttaaaaa

SEQ ID NO: 1029386 - DNA, 17 bp, Homo sapiens
gtctcacttttaaaaag

SEQ ID NO: 1029387 - DNA, 21 bp, Homo sapiens
gtctcagaaactcccctgggg

SEQ ID NO: 1029388 - DNA, 13 bp, Homo sapiens
gtctcagaatcta

SEQ ID NO: 1029389 - DNA, 23 bp, Homo sapiens
gtctcagacactaaatgcagaca

SEQ ID NO: 1029390 - DNA, 15 bp, Homo sapiens
gtctcagagccttcc

SEQ ID NO: 1029391 - DNA, 18 bp, Homo sapiens
gtctcagagccttccatg

SEQ ID NO: 1029392 - DNA, 18 bp, Homo sapiens
gtctcagatggtgtgtcc

SEQ ID NO: 1029393 - DNA, 13 bp, Homo sapiens
gtctcagcctccc

SEQ ID NO: 1029394 - DNA, 14 bp, Homo sapiens
gtctcagcctctgc

SEQ ID NO: 1029395 - DNA, 18 bp, Homo sapiens
gtctcagcctctgccagc

SEQ ID NO: 1029396 - DNA, 10 bp, Homo sapiens
gtctcaggag

SEQ ID NO: 1029397 - DNA, 17 bp, Homo sapiens
gtctcaggaggaggctg

SEQ ID NO: 1029398 - DNA, 19 bp, Homo sapiens
gtctcaggaggaggctgcc

SEQ ID NO: 1029399 - DNA, 17 bp, Homo sapiens
gtctcaggagtctctgg

SEQ ID NO: 1029400 - DNA, 23 bp, Homo sapiens
gtctcaggcagcaccacactggg

SEQ ID NO: 1029401 - DNA, 17 bp, Homo sapiens
gtctcagggtgcagagg

SEQ ID NO: 1029402 - DNA, 15 bp, Homo sapiens
gtctcagtgaagact

SEQ ID NO: 1029403 - DNA, 19 bp, Homo sapiens
gtctcagttcgtgtttgat

SEQ ID NO: 1029404 - DNA, 24 bp, Homo sapiens
gtctcagttcgtgtttgattccat

SEQ ID NO: 1029405 - DNA, 14 bp, Homo sapiens
gtctcagtttcttg

SEQ ID NO: 1029406 - DNA, 18 bp, Homo sapiens
gtctcagtttgtgtgtct

SEQ ID NO: 1029407 - DNA, 18 bp, Homo sapiens
gtctcataggttaaaaaa

SEQ ID NO: 1029408 - DNA, 14 bp, Homo sapiens
gtctcatcctcctt

SEQ ID NO: 1029409 - DNA, 18 bp, Homo sapiens
gtctcatctcctgaccct

SEQ ID NO: 1029410 - DNA, 22 bp, Homo sapiens
gtctcatctcctgaccctccca

SEQ ID NO: 1029411 - DNA, 18 bp, Homo sapiens
gtctcatctcttcaggtt

SEQ ID NO: 1029412 - DNA, 18 bp, Homo sapiens
gtctcatgtaatttgcat

SEQ ID NO: 1029413 - DNA, 17 bp, Homo sapiens
gtctcattcgcctttgt

SEQ ID NO: 1029414 - DNA, 19 bp, Homo sapiens
gtctcattcgcctttgtct

SEQ ID NO: 1029415 - DNA, 21 bp, Homo sapiens
gtctcattttggtctgttttg

SEQ ID NO: 1029416 - DNA, 22 bp, Homo sapiens
gtctccaaaaaaaaaaaaaata

SEQ ID NO: 1029417 - DNA, 14 bp, Homo sapiens
gtctccaagacctt

SEQ ID NO: 1029418 - DNA, 12 bp, Homo sapiens
gtctccactgtg

SEQ ID NO: 1029419 - DNA, 20 bp, Homo sapiens
gtctccacttgtatatatgg

SEQ ID NO: 1029420 - DNA, 20 bp, Homo sapiens
gtctccagacccccacccct

SEQ ID NO: 1029421 - DNA, 10 bp, Homo sapiens
gtctccagct

SEQ ID NO: 1029422 - DNA, 15 bp, Homo sapiens
gtctccagctgcctg

SEQ ID NO: 1029423 - DNA, 16 bp, Homo sapiens
gtctccagctgcctgg

SEQ ID NO: 1029424 - DNA, 17 bp, Homo sapiens
gtctccagctgcctggg

SEQ ID NO: 1029425 - DNA, 18 bp, Homo sapiens
gtctccagctgcctgggc

SEQ ID NO: 1029426 - DNA, 19 bp, Homo sapiens
gtctccagctgcctgggcc

SEQ ID NO: 1029427 - DNA, 13 bp, Homo sapiens
gtctccagggacc

SEQ ID NO: 1029428 - DNA, 20 bp, Homo sapiens
gtctccaggggctgcttcct

SEQ ID NO: 1029429 - DNA, 22 bp, Homo sapiens
gtctccaggggctgcttcctcc

SEQ ID NO: 1029430 - DNA, 23 bp, Homo sapiens
gtctccatcgtctcatcctcctt

SEQ ID NO: 1029431 - DNA, 23 bp, Homo sapiens
gtctccatgaagagcttgtgtcc

SEQ ID NO: 1029432 - DNA, 21 bp, Homo sapiens
gtctccatgaggtactggtcc

SEQ ID NO: 1029433 - DNA, 24 bp, Homo sapiens
gtctccatgctggatactggacac

SEQ ID NO: 1029434 - DNA, 16 bp, Homo sapiens
gtctccattgtgtgat

SEQ ID NO: 1029435 - DNA, 17 bp, Homo sapiens
gtctcccaaagtgctgg

SEQ ID NO: 1029436 - DNA, 19 bp, Homo sapiens
gtctcccaaagtgctggga

SEQ ID NO: 1029437 - DNA, 21 bp, Homo sapiens
gtctcccaaagtgctgggatt

SEQ ID NO: 1029438 - DNA, 19 bp, Homo sapiens
gtctcccacacccaccctt

SEQ ID NO: 1029439 - DNA, 17 bp, Homo sapiens
gtctcccacgtgggaga

SEQ ID NO: 1029440 - DNA, 14 bp, Homo sapiens
gtctcccactttct

SEQ ID NO: 1029441 - DNA, 13 bp, Homo sapiens
gtctcccaggctg

SEQ ID NO: 1029442 - DNA, 20 bp, Homo sapiens
gtctcccaggctggagtgca

SEQ ID NO: 1029443 - DNA, 21 bp, Homo sapiens
gtctcccaggctggagtgcag

SEQ ID NO: 1029444 - DNA, 21 bp, Homo sapiens
gtctcccagtgggtgatgctt

SEQ ID NO: 1029445 - DNA, 21 bp, Homo sapiens
gtctcccatcctgatcccaga

SEQ ID NO: 1029446 - DNA, 22 bp, Homo sapiens
gtctccccactccaccctgtta

SEQ ID NO: 1029447 - DNA, 15 bp, Homo sapiens
gtctcccccagagtg

SEQ ID NO: 1029448 - DNA, 21 bp, Homo sapiens
gtctcccctcctgcacacagg

SEQ ID NO: 1029449 - DNA, 17 bp, Homo sapiens
gtctcccctgttcccct

SEQ ID NO: 1029450 - DNA, 19 bp, Homo sapiens
gtctcccctgttcccctct

SEQ ID NO: 1029451 - DNA, 20 bp, Homo sapiens
gtctccctcccctctcagaa

SEQ ID NO: 1029452 - DNA, 14 bp, Homo sapiens
gtctccctccgact

SEQ ID NO: 1029453 - DNA, 10 bp, Homo sapiens
gtctccctcg

SEQ ID NO: 1029454 - DNA, 23 bp, Homo sapiens
gtctccctcgggggctcttcccc

SEQ ID NO: 1029455 - DNA, 15 bp, Homo sapiens
gtctccctctcctgc

SEQ ID NO: 1029456 - DNA, 20 bp, Homo sapiens
gtctccctctcctgcctact

SEQ ID NO: 1029457 - DNA, 14 bp, Homo sapiens
gtctccctgatgga

SEQ ID NO: 1029458 - DNA, 14 bp, Homo sapiens
gtctccctggccac

SEQ ID NO: 1029459 - DNA, 21 bp, Homo sapiens
gtctccctggccacccttggc

SEQ ID NO: 1029460 - DNA, 12 bp, Homo sapiens
gtctccctggct

SEQ ID NO: 1029461 - DNA, 14 bp, Homo sapiens
gtctccctggctcc

SEQ ID NO: 1029462 - DNA, 13 bp, Homo sapiens
gtctccctgggag

SEQ ID NO: 1029463 - DNA, 20 bp, Homo sapiens
cttaacccctaagactgcct

SEQ ID NO: 1029464 - DNA, 22 bp, Homo sapiens
cttaaccctgacaaattttaat

SEQ ID NO: 1029465 - DNA, 18 bp, Homo sapiens
cttaacctttattaaaac

SEQ ID NO: 1029466 - DNA, 15 bp, Homo sapiens
cttaacctttgctat

SEQ ID NO: 1029467 - DNA, 18 bp, Homo sapiens
cttaacctttgctatgta

SEQ ID NO: 1029468 - DNA, 14 bp, Homo sapiens
cttaacggctccag

SEQ ID NO: 1029469 - DNA, 15 bp, Homo sapiens
cttaacggctccagg

SEQ ID NO: 1029470 - DNA, 12 bp, Homo sapiens
cttaactaattt

SEQ ID NO: 1029471 - DNA, 13 bp, Homo sapiens
cttaactaatttg

SEQ ID NO: 1029472 - DNA, 15 bp, Homo sapiens
cttaactaatttgaa

SEQ ID NO: 1029473 - DNA, 13 bp, Homo sapiens
cttaactccaaga

SEQ ID NO: 1029474 - DNA, 21 bp, Homo sapiens
cttaactctaaccctgtggaa

SEQ ID NO: 1029475 - DNA, 14 bp, Homo sapiens
cttaactgaagaaa

SEQ ID NO: 1029476 - DNA, 19 bp, Homo sapiens
cttaactgcatttttagac

SEQ ID NO: 1029477 - DNA, 16 bp, Homo sapiens
cttaactggtctcctt

SEQ ID NO: 1029478 - DNA, 13 bp, Homo sapiens
cttaactgtattt

SEQ ID NO: 1029479 - DNA, 14 bp, Homo sapiens
cttaactgtatttc

SEQ ID NO: 1029480 - DNA, 15 bp, Homo sapiens
cttaactgtatttca

SEQ ID NO: 1029481 - DNA, 17 bp, Homo sapiens
cttaactgtatttcagt

SEQ ID NO: 1029482 - DNA, 22 bp, Homo sapiens
cttaacttaaattttaatttat

SEQ ID NO: 1029483 - DNA, 22 bp, Homo sapiens
cttaacttcacatattgatttc

SEQ ID NO: 1029484 - DNA, 12 bp, Homo sapiens
cttaacttgttt

SEQ ID NO: 1029485 - DNA, 13 bp, Homo sapiens
cttaacttttcct

SEQ ID NO: 1029486 - DNA, 16 bp, Homo sapiens
cttaagaactgctttc

SEQ ID NO: 1029487 - DNA, 13 bp, Homo sapiens
cttaagaactgtg

SEQ ID NO: 1029488 - DNA, 15 bp, Homo sapiens
cttaagaactgtgtc

SEQ ID NO: 1029489 - DNA, 17 bp, Homo sapiens
cttaagacactgtgaga

SEQ ID NO: 1029490 - DNA, 18 bp, Homo sapiens
cttaagacactgtgagag

SEQ ID NO: 1029491 - DNA, 23 bp, Homo sapiens
cttaagacagagtcttgctctgt

SEQ ID NO: 1029492 - DNA, 15 bp, Homo sapiens
cttaagacagcatgt

SEQ ID NO: 1029493 - DNA, 17 bp, Homo sapiens
cttaagacttaatgaga

SEQ ID NO: 1029494 - DNA, 18 bp, Homo sapiens
cttaagagaatattttaa

SEQ ID NO: 1029495 - DNA, 16 bp, Homo sapiens
cttaagatctgactgc

SEQ ID NO: 1029496 - DNA, 17 bp, Homo sapiens
cttaagatctgactgcc

SEQ ID NO: 1029497 - DNA, 21 bp, Homo sapiens
cttaagatgtccagggcccca

SEQ ID NO: 1029498 - DNA, 15 bp, Homo sapiens
cttaagcaaaagaaa

SEQ ID NO: 1029499 - DNA, 12 bp, Homo sapiens
cttaagcacttt

SEQ ID NO: 1029500 - DNA, 14 bp, Homo sapiens
cttaagcagaagca

SEQ ID NO: 1029501 - DNA, 13 bp, Homo sapiens
cttaagcagcatg

SEQ ID NO: 1029502 - DNA, 14 bp, Homo sapiens
cttaagcagcatgg

SEQ ID NO: 1029503 - DNA, 15 bp, Homo sapiens
cttaagcatctggct

SEQ ID NO: 1029504 - DNA, 23 bp, Homo sapiens
cttaagcatctggctctaattca

SEQ ID NO: 1029505 - DNA, 17 bp, Homo sapiens
cttaagccactgcctct

SEQ ID NO: 1029506 - DNA, 21 bp, Homo sapiens
cttaagccactgcctctccct

SEQ ID NO: 1029507 - DNA, 22 bp, Homo sapiens
cttaagcccagtgcactgaaag

SEQ ID NO: 1029508 - DNA, 18 bp, Homo sapiens
cttaagccctttgctctg

SEQ ID NO: 1029509 - DNA, 23 bp, Homo sapiens
cttaagcgaagtctttgccttct

SEQ ID NO: 1029510 - DNA, 23 bp, Homo sapiens
cttaagctaggatgttgctcaga

SEQ ID NO: 1029511 - DNA, 12 bp, Homo sapiens
cttaagcttccg

SEQ ID NO: 1029512 - DNA, 20 bp, Homo sapiens
cttaaggaagtttgattttt

SEQ ID NO: 1029513 - DNA, 21 bp, Homo sapiens
cttaaggatggagccagctct

SEQ ID NO: 1029514 - DNA, 16 bp, Homo sapiens
cttaaggcactctgtt

SEQ ID NO: 1029515 - DNA, 20 bp, Homo sapiens
cttaaggcctaaggaagcca

SEQ ID NO: 1029516 - DNA, 21 bp, Homo sapiens
cttaagggttgaaggcagtct

SEQ ID NO: 1029517 - DNA, 21 bp, Homo sapiens
cttaagtaccaatgggaagca

SEQ ID NO: 1029518 - DNA, 18 bp, Homo sapiens
cttaagtcttccttaaat

SEQ ID NO: 1029519 - DNA, 18 bp, Homo sapiens
cttaagtgagcagaacag

SEQ ID NO: 1029520 - DNA, 19 bp, Homo sapiens
cttaagtgagcagaacagg

SEQ ID NO: 1029521 - DNA, 15 bp, Homo sapiens
cttaagtgcactttt

SEQ ID NO: 1029522 - DNA, 20 bp, Homo sapiens
cttaagtgcccacatttgat

SEQ ID NO: 1029523 - DNA, 15 bp, Homo sapiens
cttaagtgctgcagc

SEQ ID NO: 1029524 - DNA, 13 bp, Homo sapiens
cttaagtgtctgg

SEQ ID NO: 1029525 - DNA, 19 bp, Homo sapiens
cttaagttagttccactga

SEQ ID NO: 1029526 - DNA, 18 bp, Homo sapiens
cttaataaaaatatatat

SEQ ID NO: 1029527 - DNA, 20 bp, Homo sapiens
cttaataaaagaacatgctt

SEQ ID NO: 1029528 - DNA, 18 bp, Homo sapiens
cttaataaaataaactag

SEQ ID NO: 1029529 - DNA, 13 bp, Homo sapiens
cttaataaatatg

SEQ ID NO: 1029530 - DNA, 19 bp, Homo sapiens
cttaataacatacaatgac

SEQ ID NO: 1029531 - DNA, 15 bp, Homo sapiens
cttaataactgtgta

SEQ ID NO: 1029532 - DNA, 12 bp, Homo sapiens
cttaatagcaac

SEQ ID NO: 1029533 - DNA, 13 bp, Homo sapiens
cttaatagcaaca

SEQ ID NO: 1029534 - DNA, 22 bp, Homo sapiens
cttaatagctgtagttttccct

SEQ ID NO: 1029535 - DNA, 17 bp, Homo sapiens
cttaatagtatttatga

SEQ ID NO: 1029536 - DNA, 13 bp, Homo sapiens
cttaatataaatt

SEQ ID NO: 1029537 - DNA, 14 bp, Homo sapiens
cttaatatatttga

SEQ ID NO: 1029538 - DNA, 23 bp, Homo sapiens
cttaatatgctgcaacaaaatgt

SEQ ID NO: 1029539 - DNA, 17 bp, Homo sapiens
cttaatattgagaatca

SEQ ID NO: 1029540 - DNA, 19 bp, Homo sapiens
cttaatatttcttcaaata

SEQ ID NO: 1029541 - DNA, 20 bp, Homo sapiens
cttaatatttcttcaaatat

SEQ ID NO: 1029542 - DNA, 16 bp, Homo sapiens
cttaatcactactgta

SEQ ID NO: 1029543 - DNA, 22 bp, Homo sapiens
cttaatcaggtcctcagagaat

SEQ ID NO: 1029544 - DNA, 19 bp, Homo sapiens
cttaatcctaccccctctt

SEQ ID NO: 1029545 - DNA, 21 bp, Homo sapiens
cttaatcctaccccctcttca

SEQ ID NO: 1029546 - DNA, 18 bp, Homo sapiens
cttaatcgatgaatgtaa

SEQ ID NO: 1029547 - DNA, 16 bp, Homo sapiens
cttaatctaaatggaa

SEQ ID NO: 1029548 - DNA, 19 bp, Homo sapiens
cttaatctaagaaacaaag

SEQ ID NO: 1029549 - DNA, 13 bp, Homo sapiens
cttaatcttgctt

SEQ ID NO: 1029550 - DNA, 14 bp, Homo sapiens
cttaatcttgcttt

SEQ ID NO: 1029551 - DNA, 18 bp, Homo sapiens
cttaatcttgctttcttt

SEQ ID NO: 1029552 - DNA, 15 bp, Homo sapiens
cttaatgaaaacaat

SEQ ID NO: 1029553 - DNA, 12 bp, Homo sapiens
cttaatgaaata

SEQ ID NO: 1029554 - DNA, 15 bp, Homo sapiens
cttaatgacaacact

SEQ ID NO: 1029555 - DNA, 23 bp, Homo sapiens
cttaatgagactttaaaagcatt

SEQ ID NO: 1029556 - DNA, 21 bp, Homo sapiens
cttaatgatccgttccattgc

SEQ ID NO: 1029557 - DNA, 21 bp, Homo sapiens
cttaatggtatcatattaaca

SEQ ID NO: 1029558 - DNA, 23 bp, Homo sapiens
cttaatggtatcatattaacata

SEQ ID NO: 1029559 - DNA, 15 bp, Homo sapiens
cttaatgtaattcag

SEQ ID NO: 1029560 - DNA, 14 bp, Homo sapiens
cttaatgtatgtta

SEQ ID NO: 1029561 - DNA, 22 bp, Homo sapiens
cttaatgtgattactgctctat

SEQ ID NO: 1029562 - DNA, 13 bp, Homo sapiens
cttaatgttactc

SEQ ID NO: 1029563 - DNA, 15 bp, Homo sapiens
cttaatgtttattcc

SEQ ID NO: 1029564 - DNA, 23 bp, Homo sapiens
cttaatgtttattcctgataata

SEQ ID NO: 1029565 - DNA, 15 bp, Homo sapiens
cttaattattatttg

SEQ ID NO: 1029566 - DNA, 15 bp, Homo sapiens
cttaattctctgcaa

SEQ ID NO: 1029567 - DNA, 15 bp, Homo sapiens
cttaattctttgttc

SEQ ID NO: 1029568 - DNA, 16 bp, Homo sapiens
cttaattctttgttct

SEQ ID NO: 1029569 - DNA, 17 bp, Homo sapiens
cttaattctttgttctg

SEQ ID NO: 1029570 - DNA, 18 bp, Homo sapiens
cttaattctttgttctgt

SEQ ID NO: 1029571 - DNA, 18 bp, Homo sapiens
cttaattgatgcaaataa

SEQ ID NO: 1029572 - DNA, 20 bp, Homo sapiens
cttaattgtattgttttccc

SEQ ID NO: 1029573 - DNA, 15 bp, Homo sapiens
cttaatttaattgct

SEQ ID NO: 1029574 - DNA, 16 bp, Homo sapiens
cttaatttaattgctt

SEQ ID NO: 1029575 - DNA, 23 bp, Homo sapiens
cttaatttatttcttaacctttg

SEQ ID NO: 1029576 - DNA, 18 bp, Homo sapiens
cttaatttccttctgtta

SEQ ID NO: 1029577 - DNA, 22 bp, Homo sapiens
cttaatttccttctgttaagaa

SEQ ID NO: 1029578 - DNA, 21 bp, Homo sapiens
cttaatttcctttttgacact

SEQ ID NO: 1029579 - DNA, 16 bp, Homo sapiens
cttaatttggataata

SEQ ID NO: 1029580 - DNA, 13 bp, Homo sapiens
cttaatttgtaaa

SEQ ID NO: 1029581 - DNA, 14 bp, Homo sapiens
cttaattttcagta

SEQ ID NO: 1029582 - DNA, 18 bp, Homo sapiens
cttaattttcagtataat

SEQ ID NO: 1029583 - DNA, 19 bp, Homo sapiens
cttaatttttttttcatag

SEQ ID NO: 1029584 - DNA, 19 bp, Homo sapiens
cttacaaaatcctggaaga

SEQ ID NO: 1029585 - DNA, 16 bp, Homo sapiens
cttacaaaatgccaag

SEQ ID NO: 1029586 - DNA, 16 bp, Homo sapiens
cttacaaatgtgaaac

SEQ ID NO: 1029587 - DNA, 18 bp, Homo sapiens
cttacaagcttaaagctt

SEQ ID NO: 1029588 - DNA, 19 bp, Homo sapiens
gtctccctggtgcctctgt

SEQ ID NO: 1029589 - DNA, 19 bp, Homo sapiens
gtctcccttccgtccatcc

SEQ ID NO: 1029590 - DNA, 14 bp, Homo sapiens
gtctcctactctgt

SEQ ID NO: 1029591 - DNA, 18 bp, Homo sapiens
gtctcctactctgtgtaa

SEQ ID NO: 1029592 - DNA, 18 bp, Homo sapiens
gtctcctatcctggtttt

SEQ ID NO: 1029593 - DNA, 15 bp, Homo sapiens
gtctcctcaagcctg

SEQ ID NO: 1029594 - DNA, 18 bp, Homo sapiens
gtctcctcaagcctgtgg

SEQ ID NO: 1029595 - DNA, 23 bp, Homo sapiens
gtctcctcaatttttgtctcaga

SEQ ID NO: 1029596 - DNA, 18 bp, Homo sapiens
gtctcctcactctgtccc

SEQ ID NO: 1029597 - DNA, 21 bp, Homo sapiens
gtctcctcactctgtccctgt

SEQ ID NO: 1029598 - DNA, 19 bp, Homo sapiens
gtctcctcagggtgggggg

SEQ ID NO: 1029599 - DNA, 13 bp, Homo sapiens
gtctcctcccagc

SEQ ID NO: 1029600 - DNA, 16 bp, Homo sapiens
gtctcctcccagcggc

SEQ ID NO: 1029601 - DNA, 20 bp, Homo sapiens
gtctcctcccctactctgcc

SEQ ID NO: 1029602 - DNA, 15 bp, Homo sapiens
gtctcctccctcagc

SEQ ID NO: 1029603 - DNA, 17 bp, Homo sapiens
gtctcctccctgggcta

SEQ ID NO: 1029604 - DNA, 13 bp, Homo sapiens
gtctcctctccat

SEQ ID NO: 1029605 - DNA, 15 bp, Homo sapiens
gtctcctctccattt

SEQ ID NO: 1029606 - DNA, 23 bp, Homo sapiens
gtctcctgtcttatggtccagaa

SEQ ID NO: 1029607 - DNA, 21 bp, Homo sapiens
gtctcctgtgcccacatccca

SEQ ID NO: 1029608 - DNA, 17 bp, Homo sapiens
gtctccttactctgagc

SEQ ID NO: 1029609 - DNA, 18 bp, Homo sapiens
gtctccttactctgagcc

SEQ ID NO: 1029610 - DNA, 23 bp, Homo sapiens
gtctccttactctgagcccaggc

SEQ ID NO: 1029611 - DNA, 11 bp, Homo sapiens
gtctccttggc

SEQ ID NO: 1029612 - DNA, 17 bp, Homo sapiens
gtctccttggctgtctg

SEQ ID NO: 1029613 - DNA, 19 bp, Homo sapiens
gtctcctttactgaatgta

SEQ ID NO: 1029614 - DNA, 18 bp, Homo sapiens
gtctcctttctgactgtc

SEQ ID NO: 1029615 - DNA, 20 bp, Homo sapiens
gtctcctttctgactgtccc

SEQ ID NO: 1029616 - DNA, 17 bp, Homo sapiens
gtctcgatgcctgattc

SEQ ID NO: 1029617 - DNA, 17 bp, Homo sapiens
gtctcgcagcctgaagc

SEQ ID NO: 1029618 - DNA, 20 bp, Homo sapiens
gtctcgcagcctgaagcctg

SEQ ID NO: 1029619 - DNA, 17 bp, Homo sapiens
gtctcgctttgttgccc

SEQ ID NO: 1029620 - DNA, 19 bp, Homo sapiens
gtctcgctttgttgcccag

SEQ ID NO: 1029621 - DNA, 23 bp, Homo sapiens
gtctcgctttgttgcccaggctg

SEQ ID NO: 1029622 - DNA, 15 bp, Homo sapiens
gtctcggcccctctg

SEQ ID NO: 1029623 - DNA, 17 bp, Homo sapiens
gtctcggccctgaacca

SEQ ID NO: 1029624 - DNA, 19 bp, Homo sapiens
gtctcgggctgaccctttt

SEQ ID NO: 1029625 - DNA, 20 bp, Homo sapiens
cttaccccttagcctccctg

SEQ ID NO: 1029626 - DNA, 19 bp, Homo sapiens
cttacccgaaagcatcact

SEQ ID NO: 1029627 - DNA, 18 bp, Homo sapiens
cttaccctcatgttctta

SEQ ID NO: 1029628 - DNA, 15 bp, Homo sapiens
cttaccctcctctgc

SEQ ID NO: 1029629 - DNA, 17 bp, Homo sapiens
cttaccgttcaagaggc

SEQ ID NO: 1029630 - DNA, 18 bp, Homo sapiens
cttacctaaacagatata

SEQ ID NO: 1029631 - DNA, 14 bp, Homo sapiens
cttacctcctgccc

SEQ ID NO: 1029632 - DNA, 17 bp, Homo sapiens
cttacctcctgcccagg

SEQ ID NO: 1029633 - DNA, 22 bp, Homo sapiens
cttacctcggggagagggggag

SEQ ID NO: 1029634 - DNA, 13 bp, Homo sapiens
cttacctcggtgc

SEQ ID NO: 1029635 - DNA, 21 bp, Homo sapiens
cttacctcggtgccttcctct

SEQ ID NO: 1029636 - DNA, 14 bp, Homo sapiens
cttacctctctggg

SEQ ID NO: 1029637 - DNA, 18 bp, Homo sapiens
cttacctctctgggacct

SEQ ID NO: 1029638 - DNA, 12 bp, Homo sapiens
cttacctctgga

SEQ ID NO: 1029639 - DNA, 15 bp, Homo sapiens
cttacctctggaacc

SEQ ID NO: 1029640 - DNA, 18 bp, Homo sapiens
cttacctgacctcttgct

SEQ ID NO: 1029641 - DNA, 20 bp, Homo sapiens
cttacctgacctcttgctgt

SEQ ID NO: 1029642 - DNA, 19 bp, Homo sapiens
cttacctgggcattcttgt

SEQ ID NO: 1029643 - DNA, 20 bp, Homo sapiens
cttacctgtatgtctccagt

SEQ ID NO: 1029644 - DNA, 12 bp, Homo sapiens
cttaccttgggg

SEQ ID NO: 1029645 - DNA, 15 bp, Homo sapiens
cttaccttttcctat

SEQ ID NO: 1029646 - DNA, 13 bp, Homo sapiens
cttacctttttat

SEQ ID NO: 1029647 - DNA, 19 bp, Homo sapiens
cttacctttttatttgcat

SEQ ID NO: 1029648 - DNA, 20 bp, Homo sapiens
cttacctttttatttgcatg

SEQ ID NO: 1029649 - DNA, 14 bp, Homo sapiens
cttacgctttgtca

SEQ ID NO: 1029650 - DNA, 13 bp, Homo sapiens
cttactaaaaagt

SEQ ID NO: 1029651 - DNA, 14 bp, Homo sapiens
cttactaaatcttc

SEQ ID NO: 1029652 - DNA, 21 bp, Homo sapiens
cttactaagctttgccagctg

SEQ ID NO: 1029653 - DNA, 17 bp, Homo sapiens
cttactaatgtgcccca

SEQ ID NO: 1029654 - DNA, 12 bp, Homo sapiens
cttactaggaag

SEQ ID NO: 1029655 - DNA, 15 bp, Homo sapiens
cttactataatttga

SEQ ID NO: 1029656 - DNA, 22 bp, Homo sapiens
cttactatttctgggtcttttg

SEQ ID NO: 1029657 - DNA, 12 bp, Homo sapiens
cttactattttg

SEQ ID NO: 1029658 - DNA, 20 bp, Homo sapiens
cttactcaagtgttaaatta

SEQ ID NO: 1029659 - DNA, 13 bp, Homo sapiens
cttactcagggga

SEQ ID NO: 1029660 - DNA, 15 bp, Homo sapiens
cttactcctcctctt

SEQ ID NO: 1029661 - DNA, 17 bp, Homo sapiens
cttactctgagcccagg

SEQ ID NO: 1029662 - DNA, 20 bp, Homo sapiens
cttactctgagcccaggccg

SEQ ID NO: 1029663 - DNA, 16 bp, Homo sapiens
cttactctgtccattt

SEQ ID NO: 1029664 - DNA, 23 bp, Homo sapiens
cttactctttcctatttcagtgt

SEQ ID NO: 1029665 - DNA, 15 bp, Homo sapiens
cttactgaagttcag

SEQ ID NO: 1029666 - DNA, 19 bp, Homo sapiens
cttactgatatattttaca

SEQ ID NO: 1029667 - DNA, 17 bp, Homo sapiens
cttactgattattttct

SEQ ID NO: 1029668 - DNA, 13 bp, Homo sapiens
cttactgcagaat

SEQ ID NO: 1029669 - DNA, 15 bp, Homo sapiens
cttactgtagcctca

SEQ ID NO: 1029670 - DNA, 16 bp, Homo sapiens
cttactgtagcctcag

SEQ ID NO: 1029671 - DNA, 19 bp, Homo sapiens
cttactgtatatgtattcc

SEQ ID NO: 1029672 - DNA, 20 bp, Homo sapiens
cttactgtccaccagtttat

SEQ ID NO: 1029673 - DNA, 23 bp, Homo sapiens
cttacttcctggcctcttctggg

SEQ ID NO: 1029674 - DNA, 20 bp, Homo sapiens
cttacttggtgagggtgccc

SEQ ID NO: 1029675 - DNA, 17 bp, Homo sapiens
cttactttgcttgagaa

SEQ ID NO: 1029676 - DNA, 20 bp, Homo sapiens
cttactttgcttgagaatcc

SEQ ID NO: 1029677 - DNA, 18 bp, Homo sapiens
cttacttttccagtctgt

SEQ ID NO: 1029678 - DNA, 19 bp, Homo sapiens
cttacttttccagtctgta

SEQ ID NO: 1029679 - DNA, 14 bp, Homo sapiens
cttagaaaattaaa

SEQ ID NO: 1029680 - DNA, 21 bp, Homo sapiens
cttagaaaattaaaataggca

SEQ ID NO: 1029681 - DNA, 20 bp, Homo sapiens
cttagaaaattcaagcattt

SEQ ID NO: 1029682 - DNA, 11 bp, Homo sapiens
cttagaaactg

SEQ ID NO: 1029683 - DNA, 23 bp, Homo sapiens
cttagaaagttccaaatgtttat

SEQ ID NO: 1029684 - DNA, 21 bp, Homo sapiens
cttagaaataacagaagaaaa

SEQ ID NO: 1029685 - DNA, 13 bp, Homo sapiens
cttagaaatactt

SEQ ID NO: 1029686 - DNA, 16 bp, Homo sapiens
cttagaagaatattgt

SEQ ID NO: 1029687 - DNA, 21 bp, Homo sapiens
cttagaagtggaccaggacag

SEQ ID NO: 1029688 - DNA, 16 bp, Homo sapiens
cttagaatacagtttt

SEQ ID NO: 1029689 - DNA, 16 bp, Homo sapiens
cttagaatagtgccta

SEQ ID NO: 1029690 - DNA, 16 bp, Homo sapiens
cttagaatccaaactt

SEQ ID NO: 1029691 - DNA, 17 bp, Homo sapiens
cttagaatccaaacttg

SEQ ID NO: 1029692 - DNA, 14 bp, Homo sapiens
cttagacaaatgat

SEQ ID NO: 1029693 - DNA, 20 bp, Homo sapiens
cttagacaccacctggagtg

SEQ ID NO: 1029694 - DNA, 12 bp, Homo sapiens
cttagacctcag

SEQ ID NO: 1029695 - DNA, 16 bp, Homo sapiens
cttagacctcagcctg

SEQ ID NO: 1029696 - DNA, 18 bp, Homo sapiens
cttagaccttccataatg

SEQ ID NO: 1029697 - DNA, 21 bp, Homo sapiens
cttagactccttctccccaat

SEQ ID NO: 1029698 - DNA, 16 bp, Homo sapiens
cttagacttgaaatac

SEQ ID NO: 1029699 - DNA, 17 bp, Homo sapiens
cttagagaagtttgtgg

SEQ ID NO: 1029700 - DNA, 20 bp, Homo sapiens
cttagagaatgttctcctaa

SEQ ID NO: 1029701 - DNA, 13 bp, Homo sapiens
cttagagaccccg

SEQ ID NO: 1029702 - DNA, 17 bp, Homo sapiens
cttagagagaggaggca

SEQ ID NO: 1029703 - DNA, 16 bp, Homo sapiens
cttagagattgcccca

SEQ ID NO: 1029704 - DNA, 15 bp, Homo sapiens
cttagaggaaaaggg

SEQ ID NO: 1029705 - DNA, 16 bp, Homo sapiens
cttagagtgcccagca

SEQ ID NO: 1029706 - DNA, 17 bp, Homo sapiens
cttagagtgtagctgta

SEQ ID NO: 1029707 - DNA, 15 bp, Homo sapiens
cttagagtttacagt

SEQ ID NO: 1029708 - DNA, 21 bp, Homo sapiens
cttagagtttacagtttgtgt

SEQ ID NO: 1029709 - DNA, 14 bp, Homo sapiens
cttagagtttctgt

SEQ ID NO: 1029710 - DNA, 12 bp, Homo sapiens
cttagataactt

SEQ ID NO: 1029711 - DNA, 19 bp, Homo sapiens
cttagataacttcttgaaa

SEQ ID NO: 1029712 - DNA, 19 bp, Homo sapiens
cttagataatatttctgaa

SEQ ID NO: 1029713 - DNA, 18 bp, Homo sapiens
cttagatacactaaaaat

SEQ ID NO: 1029714 - DNA, 14 bp, Homo sapiens
cttagatattaaaa

SEQ ID NO: 1029715 - DNA, 15 bp, Homo sapiens
cttagatattaaaat

SEQ ID NO: 1029716 - DNA, 23 bp, Homo sapiens
gtctgactccctccccacccaag

SEQ ID NO: 1029717 - DNA, 15 bp, Homo sapiens
gtctgactctgggtt

SEQ ID NO: 1029718 - DNA, 13 bp, Homo sapiens
gtctgagaaatag

SEQ ID NO: 1029719 - DNA, 22 bp, Homo sapiens
gtctgagactcacaggaaggag

SEQ ID NO: 1029720 - DNA, 23 bp, Homo sapiens
gtctgagcatccatcaatacctg

SEQ ID NO: 1029721 - DNA, 16 bp, Homo sapiens
gtctgagcatgatggg

SEQ ID NO: 1029722 - DNA, 12 bp, Homo sapiens
gtctgagccctg

SEQ ID NO: 1029723 - DNA, 13 bp, Homo sapiens
gtctgagccctgg

SEQ ID NO: 1029724 - DNA, 20 bp, Homo sapiens
gtctgagctagctagcgcac

SEQ ID NO: 1029725 - DNA, 14 bp, Homo sapiens
gtctgaggactgtc

SEQ ID NO: 1029726 - DNA, 22 bp, Homo sapiens
gtctgaggagtaagtgtacaat

SEQ ID NO: 1029727 - DNA, 13 bp, Homo sapiens
gtctgaggcctca

SEQ ID NO: 1029728 - DNA, 20 bp, Homo sapiens
gtctgaggcctgccccctgg

SEQ ID NO: 1029729 - DNA, 19 bp, Homo sapiens
gtctgagtcctgtctctgc

SEQ ID NO: 1029730 - DNA, 21 bp, Homo sapiens
gtctgagtcctgtctctgcct

SEQ ID NO: 1029731 - DNA, 22 bp, Homo sapiens
gtctgagtcctgtctctgcctg

SEQ ID NO: 1029732 - DNA, 14 bp, Homo sapiens
gtctgagtctatgt

SEQ ID NO: 1029733 - DNA, 17 bp, Homo sapiens
gtctgagtctatgttca

SEQ ID NO: 1029734 - DNA, 20 bp, Homo sapiens
gtctgatggaactgtgtatt

SEQ ID NO: 1029735 - DNA, 22 bp, Homo sapiens
gtctgattctctttaactgtgt

SEQ ID NO: 1029736 - DNA, 22 bp, Homo sapiens
gtctgattttctcactgaactc

SEQ ID NO: 1029737 - DNA, 23 bp, Homo sapiens
gtctgcaaaatgaggaatgtata

SEQ ID NO: 1029738 - DNA, 17 bp, Homo sapiens
gtctgcaagggcccaga

SEQ ID NO: 1029739 - DNA, 21 bp, Homo sapiens
gtctgcaagggcccagagtga

SEQ ID NO: 1029740 - DNA, 21 bp, Homo sapiens
gtctgcacctccgcttgccag

SEQ ID NO: 1029741 - DNA, 20 bp, Homo sapiens
gtctgcactcctttatctgt

SEQ ID NO: 1029742 - DNA, 18 bp, Homo sapiens
gtctgcagcccggcgcca

SEQ ID NO: 1029743 - DNA, 16 bp, Homo sapiens
gtctgcaggggcctgg

SEQ ID NO: 1029744 - DNA, 17 bp, Homo sapiens
gtctgcaggggcctgga

SEQ ID NO: 1029745 - DNA, 19 bp, Homo sapiens
gtctgcagggtgacgcctg

SEQ ID NO: 1029746 - DNA, 17 bp, Homo sapiens
gtctgcagtgcccggct

SEQ ID NO: 1029747 - DNA, 17 bp, Homo sapiens
gtctgtttaaagtggca

SEQ ID NO: 1029748 - DNA, 14 bp, Homo sapiens
gtctgtttgccact

SEQ ID NO: 1029749 - DNA, 21 bp, Homo sapiens
gtctgtttggactgcagaagc

SEQ ID NO: 1029750 - DNA, 18 bp, Homo sapiens
gtctgtttgtttcaagaa

SEQ ID NO: 1029751 - DNA, 15 bp, Homo sapiens
gtctgtttttgtatc

SEQ ID NO: 1029752 - DNA, 17 bp, Homo sapiens
gtcttaaaaaatgtgaa

SEQ ID NO: 1029753 - DNA, 13 bp, Homo sapiens
gtcttaaaaccag

SEQ ID NO: 1029754 - DNA, 17 bp, Homo sapiens
gtcttaaactaaatgtg

SEQ ID NO: 1029755 - DNA, 22 bp, Homo sapiens
gtcttaaactaaatgtgcaata

SEQ ID NO: 1029756 - DNA, 18 bp, Homo sapiens
gtcttaaataaaactatt

SEQ ID NO: 1029757 - DNA, 20 bp, Homo sapiens
gtcttaaatgctcattttct

SEQ ID NO: 1029758 - DNA, 23 bp, Homo sapiens
gtcttaaatgctcattttctggt

SEQ ID NO: 1029759 - DNA, 21 bp, Homo sapiens
gtcttaacaaaccaacatctt

SEQ ID NO: 1029760 - DNA, 21 bp, Homo sapiens
gtcttaataaaataaactaga

SEQ ID NO: 1029761 - DNA, 17 bp, Homo sapiens
gtcttacaatcaaatct

SEQ ID NO: 1029762 - DNA, 18 bp, Homo sapiens
gtcttacaatcaaatctc

SEQ ID NO: 1029763 - DNA, 15 bp, Homo sapiens
gtcttactctgtctc

SEQ ID NO: 1029764 - DNA, 16 bp, Homo sapiens
gtcttactctgtctcc

SEQ ID NO: 1029765 - DNA, 22 bp, Homo sapiens
gtcttagaagtggaccaggaca

SEQ ID NO: 1029766 - DNA, 13 bp, Homo sapiens
gtcttagagcctt

SEQ ID NO: 1029767 - DNA, 15 bp, Homo sapiens
gtcttagagcctttt

SEQ ID NO: 1029768 - DNA, 20 bp, Homo sapiens
gtcttagagccttttatctg

SEQ ID NO: 1029769 - DNA, 15 bp, Homo sapiens
gtcttaggatgtctg

SEQ ID NO: 1029770 - DNA, 17 bp, Homo sapiens
gtcttatcccccccagc

SEQ ID NO: 1029771 - DNA, 14 bp, Homo sapiens
gtcttatggtccag

SEQ ID NO: 1029772 - DNA, 17 bp, Homo sapiens
gtcttatggtccagaaa

SEQ ID NO: 1029773 - DNA, 14 bp, Homo sapiens
gtcttatgtaaagt

SEQ ID NO: 1029774 - DNA, 16 bp, Homo sapiens
gtcttatgtaaagtat

SEQ ID NO: 1029775 - DNA, 18 bp, Homo sapiens
gtcttatgtgaaaaatta

SEQ ID NO: 1029776 - DNA, 12 bp, Homo sapiens
gtcttattctta

SEQ ID NO: 1029777 - DNA, 13 bp, Homo sapiens
gtcttattcttaa

SEQ ID NO: 1029778 - DNA, 20 bp, Homo sapiens
gtcttattgaaaaaaaaaat

SEQ ID NO: 1029779 - DNA, 14 bp, Homo sapiens
gtcttatttccaag

SEQ ID NO: 1029780 - DNA, 21 bp, Homo sapiens
gtcttcaactggttagtgtga

SEQ ID NO: 1029781 - DNA, 18 bp, Homo sapiens
gtcttcaatctctgttct

SEQ ID NO: 1029782 - DNA, 22 bp, Homo sapiens
gtcttcagagataggcctgtgg

SEQ ID NO: 1029783 - DNA, 13 bp, Homo sapiens
gtcttcagcctag

SEQ ID NO: 1029784 - DNA, 15 bp, Homo sapiens
gtcttcagcctagcc

SEQ ID NO: 1029785 - DNA, 13 bp, Homo sapiens
gtcttcagcctcc

SEQ ID NO: 1029786 - DNA, 15 bp, Homo sapiens
gtcttcagcctccct

SEQ ID NO: 1029787 - DNA, 19 bp, Homo sapiens
gtcttcagcctccctcagc

SEQ ID NO: 1029788 - DNA, 16 bp, Homo sapiens
gtcttcagtaagccgt

SEQ ID NO: 1029789 - DNA, 15 bp, Homo sapiens
gtcttcatctccctg

SEQ ID NO: 1029790 - DNA, 23 bp, Homo sapiens
gtcttcatctccctgccatcccc

SEQ ID NO: 1029791 - DNA, 16 bp, Homo sapiens
gtcttcatttcattgt

SEQ ID NO: 1029792 - DNA, 19 bp, Homo sapiens
gtcttccaaggagaccaag

SEQ ID NO: 1029793 - DNA, 20 bp, Homo sapiens
gtcttccaaggccagaagga

SEQ ID NO: 1029794 - DNA, 11 bp, Homo sapiens
gtcttccacaa

SEQ ID NO: 1029795 - DNA, 15 bp, Homo sapiens
gtcttccacaaagaa

SEQ ID NO: 1029796 - DNA, 16 bp, Homo sapiens
gtcttccacaaagaaa

SEQ ID NO: 1029797 - DNA, 23 bp, Homo sapiens
gtcttccagggggaaggccaagg

SEQ ID NO: 1029798 - DNA, 19 bp, Homo sapiens
gtcttccaggtccaaaccc

SEQ ID NO: 1029799 - DNA, 15 bp, Homo sapiens
gtcttccataatgta

SEQ ID NO: 1029800 - DNA, 17 bp, Homo sapiens
gtcttccataatgtata

SEQ ID NO: 1029801 - DNA, 20 bp, Homo sapiens
gtcttcccccctctcctccc

SEQ ID NO: 1029802 - DNA, 18 bp, Homo sapiens
gtcttccctacctcaggc

SEQ ID NO: 1029803 - DNA, 23 bp, Homo sapiens
gtcttccgatcaacatttatgac

SEQ ID NO: 1029804 - DNA, 23 bp, Homo sapiens
gtcttcctcaaaataaagaagta

SEQ ID NO: 1029805 - DNA, 19 bp, Homo sapiens
gtcttcctgacactttaat

SEQ ID NO: 1029806 - DNA, 12 bp, Homo sapiens
gtcttcctgagt

SEQ ID NO: 1029807 - DNA, 15 bp, Homo sapiens
gtcttccttctaccc

SEQ ID NO: 1029808 - DNA, 21 bp, Homo sapiens
gtcttcgccctctgaaattaa

SEQ ID NO: 1029809 - DNA, 14 bp, Homo sapiens
gtcttctaaacttc

SEQ ID NO: 1029810 - DNA, 16 bp, Homo sapiens
gtcttctccaccagcc

SEQ ID NO: 1029811 - DNA, 18 bp, Homo sapiens
gtcttctctatcctctct

SEQ ID NO: 1029812 - DNA, 21 bp, Homo sapiens
gtcttctctatcctctctctc

SEQ ID NO: 1029813 - DNA, 13 bp, Homo sapiens
gtcttctctccac

SEQ ID NO: 1029814 - DNA, 15 bp, Homo sapiens
gtcttctctccactt

SEQ ID NO: 1029815 - DNA, 15 bp, Homo sapiens
gtcttctgcctgtta

SEQ ID NO: 1029816 - DNA, 14 bp, Homo sapiens
gtcttctgctgttc

SEQ ID NO: 1029817 - DNA, 15 bp, Homo sapiens
gtcttctgctgttct

SEQ ID NO: 1029818 - DNA, 17 bp, Homo sapiens
gtcttctgctgttcttc

SEQ ID NO: 1029819 - DNA, 18 bp, Homo sapiens
gtcttctggacaggctct

SEQ ID NO: 1029820 - DNA, 11 bp, Homo sapiens
gtcttcttggc

SEQ ID NO: 1029821 - DNA, 16 bp, Homo sapiens
gtcttgaaagtggcac

SEQ ID NO: 1029822 - DNA, 15 bp, Homo sapiens
gtcttgaatgtcttt

SEQ ID NO: 1029823 - DNA, 17 bp, Homo sapiens
gtcttgaatgtcttttg

SEQ ID NO: 1029824 - DNA, 22 bp, Homo sapiens
gtcttgactctaaatgcagttt

SEQ ID NO: 1029825 - DNA, 14 bp, Homo sapiens
gtcttgagccagta

SEQ ID NO: 1029826 - DNA, 19 bp, Homo sapiens
gtcttgagccagtaatctt

SEQ ID NO: 1029827 - DNA, 21 bp, Homo sapiens
gtcttgagccagtaatcttta

SEQ ID NO: 1029828 - DNA, 19 bp, Homo sapiens
gtcttgatcctccaatgtc

SEQ ID NO: 1029829 - DNA, 19 bp, Homo sapiens
gtcttgcaaagcgacagat

SEQ ID NO: 1029830 - DNA, 22 bp, Homo sapiens
gtcttgcccagcagctcaagaa

SEQ ID NO: 1029831 - DNA, 19 bp, Homo sapiens
gtcttgctatattgcccag

SEQ ID NO: 1029832 - DNA, 13 bp, Homo sapiens
gtcttgctatgtt

SEQ ID NO: 1029833 - DNA, 12 bp, Homo sapiens
gtcttgctctgt

SEQ ID NO: 1029834 - DNA, 15 bp, Homo sapiens
gtcttgctctgtctc

SEQ ID NO: 1029835 - DNA, 16 bp, Homo sapiens
gtcttgctctgtctcc

SEQ ID NO: 1029836 - DNA, 19 bp, Homo sapiens
gtcttgctgttgacatatt

SEQ ID NO: 1029837 - DNA, 15 bp, Homo sapiens
gtcttggatatatag

SEQ ID NO: 1029838 - DNA, 15 bp, Homo sapiens
gtcttggcattaaac

SEQ ID NO: 1029839 - DNA, 15 bp, Homo sapiens
gtcttggcggcagca

SEQ ID NO: 1029840 - DNA, 18 bp, Homo sapiens
gtcttggcggcagcagcc

SEQ ID NO: 1029841 - DNA, 16 bp, Homo sapiens
gtcttgggaaatatga

SEQ ID NO: 1029842 - DNA, 16 bp, Homo sapiens
gtcttgggcagagctg

SEQ ID NO: 1029843 - DNA, 21 bp, Homo sapiens
gtcttgggcagagctggctct

SEQ ID NO: 1029844 - DNA, 22 bp, Homo sapiens
gtcttgggctactggcagctcc

SEQ ID NO: 1029845 - DNA, 24 bp, Homo sapiens
gtcttgggctactggcagctcctc

SEQ ID NO: 1029846 - DNA, 17 bp, Homo sapiens
cttatattgtaagaaat

SEQ ID NO: 1029847 - DNA, 18 bp, Homo sapiens
cttatattgtaagaaata

SEQ ID NO: 1029848 - DNA, 18 bp, Homo sapiens
cttatattttatgaacat

SEQ ID NO: 1029849 - DNA, 12 bp, Homo sapiens
cttatattttga

SEQ ID NO: 1029850 - DNA, 15 bp, Homo sapiens
cttatattttgattt

SEQ ID NO: 1029851 - DNA, 16 bp, Homo sapiens
cttatcaagtgtcttc

SEQ ID NO: 1029852 - DNA, 17 bp, Homo sapiens
cttatcaagtgtcttcc

SEQ ID NO: 1029853 - DNA, 23 bp, Homo sapiens
cttatcaccacagtaagttccta

SEQ ID NO: 1029854 - DNA, 19 bp, Homo sapiens
cttatcaccagctgcctct
